United States Patent 10,611,818 (MHC MULTIMERS IN TUBERCULOSIS DIAGNOSTICS, VACCINE AND THERAPEUTICS) - sequence listing, part 4

SEQ ID NO: 84982 - protein, 14 aa, Mycobacterium tuberculosis
RAALIVLMQRYLVG

SEQ ID NO: 84983 - protein, 14 aa, Mycobacterium tuberculosis
AALIVLMQRYLVGD

SEQ ID NO: 84984 - protein, 14 aa, Mycobacterium tuberculosis
ALIVLMQRYLVGDL

SEQ ID NO: 84985 - protein, 14 aa, Mycobacterium tuberculosis
LIVLMQRYLVGDLA

SEQ ID NO: 84986 - protein, 14 aa, Mycobacterium tuberculosis
IVLMQRYLVGDLAA

SEQ ID NO: 84987 - protein, 14 aa, Mycobacterium tuberculosis
VLMQRYLVGDLAAG

SEQ ID NO: 84988 - protein, 14 aa, Mycobacterium tuberculosis
LMQRYLVGDLAAGS

SEQ ID NO: 84989 - protein, 14 aa, Mycobacterium tuberculosis
MQRYLVGDLAAGSI

SEQ ID NO: 84990 - protein, 14 aa, Mycobacterium tuberculosis
QRYLVGDLAAGSIK

SEQ ID NO: 84991 - protein, 14 aa, Mycobacterium tuberculosis
RYLVGDLAAGSIKP

SEQ ID NO: 84992 - protein, 14 aa, Mycobacterium tuberculosis
YLVGDLAAGSIKPI

SEQ ID NO: 84993 - protein, 14 aa, Mycobacterium tuberculosis
LVGDLAAGSIKPIR

SEQ ID NO: 84994 - protein, 14 aa, Mycobacterium tuberculosis
VGDLAAGSIKPIRG

SEQ ID NO: 84995 - protein, 14 aa, Mycobacterium tuberculosis
GDLAAGSIKPIRGD

SEQ ID NO: 84996 - protein, 14 aa, Mycobacterium tuberculosis
DLAAGSIKPIRGDI

SEQ ID NO: 84997 - protein, 14 aa, Mycobacterium tuberculosis
LAAGSIKPIRGDIL

SEQ ID NO: 84998 - protein, 14 aa, Mycobacterium tuberculosis
AAGSIKPIRGDILE

SEQ ID NO: 84999 - protein, 14 aa, Mycobacterium tuberculosis
AGSIKPIRGDILEL

SEQ ID NO: 85000 - protein, 14 aa, Mycobacterium tuberculosis
GSIKPIRGDILELR

SEQ ID NO: 85001 - protein, 14 aa, Mycobacterium tuberculosis
SIKPIRGDILELRW

SEQ ID NO: 85002 - protein, 14 aa, Mycobacterium tuberculosis
IKPIRGDILELRWH

SEQ ID NO: 85003 - protein, 14 aa, Mycobacterium tuberculosis
KPIRGDILELRWHE

SEQ ID NO: 85004 - protein, 14 aa, Mycobacterium tuberculosis
PIRGDILELRWHEA

SEQ ID NO: 85005 - protein, 14 aa, Mycobacterium tuberculosis
IRGDILELRWHEAN

SEQ ID NO: 85006 - protein, 14 aa, Mycobacterium tuberculosis
RGDILELRWHEANN

SEQ ID NO: 85007 - protein, 14 aa, Mycobacterium tuberculosis
GDILELRWHEANNH

SEQ ID NO: 85008 - protein, 14 aa, Mycobacterium tuberculosis
DILELRWHEANNHF

SEQ ID NO: 85009 - protein, 14 aa, Mycobacterium tuberculosis
ILELRWHEANNHFR

SEQ ID NO: 85010 - protein, 14 aa, Mycobacterium tuberculosis
LELRWHEANNHFRV

SEQ ID NO: 85011 - protein, 14 aa, Mycobacterium tuberculosis
ELRWHEANNHFRVL

SEQ ID NO: 85012 - protein, 14 aa, Mycobacterium tuberculosis
LRWHEANNHFRVLF

SEQ ID NO: 85013 - protein, 14 aa, Mycobacterium tuberculosis
RWHEANNHFRVLFF

SEQ ID NO: 85014 - protein, 14 aa, Mycobacterium tuberculosis
WHEANNHFRVLFFR

SEQ ID NO: 85015 - protein, 14 aa, Mycobacterium tuberculosis
HEANNHFRVLFFRW

SEQ ID NO: 85016 - protein, 14 aa, Mycobacterium tuberculosis
EANNHFRVLFFRWG

SEQ ID NO: 85017 - protein, 14 aa, Mycobacterium tuberculosis
ANNHFRVLFFRWGQ

SEQ ID NO: 85018 - protein, 14 aa, Mycobacterium tuberculosis
NNHFRVLFFRWGQH

SEQ ID NO: 85019 - protein, 14 aa, Mycobacterium tuberculosis
NHFRVLFFRWGQHP

SEQ ID NO: 85020 - protein, 14 aa, Mycobacterium tuberculosis
HFRVLFFRWGQHPV

SEQ ID NO: 85021 - protein, 14 aa, Mycobacterium tuberculosis
FRVLFFRWGQHPVA

SEQ ID NO: 85022 - protein, 14 aa, Mycobacterium tuberculosis
RVLFFRWGQHPVAL

SEQ ID NO: 85023 - protein, 14 aa, Mycobacterium tuberculosis
VLFFRWGQHPVALT

SEQ ID NO: 85024 - protein, 14 aa, Mycobacterium tuberculosis
LFFRWGQHPVALTA

SEQ ID NO: 85025 - protein, 14 aa, Mycobacterium tuberculosis
FFRWGQHPVALTAF

SEQ ID NO: 85026 - protein, 14 aa, Mycobacterium tuberculosis
FRWGQHPVALTAFY

SEQ ID NO: 85027 - protein, 14 aa, Mycobacterium tuberculosis
RWGQHPVALTAFYK

SEQ ID NO: 85028 - protein, 14 aa, Mycobacterium tuberculosis
WGQHPVALTAFYKN

SEQ ID NO: 85029 - protein, 14 aa, Mycobacterium tuberculosis
GQHPVALTAFYKNQ

SEQ ID NO: 85030 - protein, 14 aa, Mycobacterium tuberculosis
QHPVALTAFYKNQQ

SEQ ID NO: 85031 - protein, 14 aa, Mycobacterium tuberculosis
HPVALTAFYKNQQK

SEQ ID NO: 85032 - protein, 14 aa, Mycobacterium tuberculosis
PVALTAFYKNQQKT

SEQ ID NO: 85033 - protein, 14 aa, Mycobacterium tuberculosis
VALTAFYKNQQKTP

SEQ ID NO: 85034 - protein, 14 aa, Mycobacterium tuberculosis
ALTAFYKNQQKTPK

SEQ ID NO: 85035 - protein, 14 aa, Mycobacterium tuberculosis
LTAFYKNQQKTPKT

SEQ ID NO: 85036 - protein, 14 aa, Mycobacterium tuberculosis
TAFYKNQQKTPKTK

SEQ ID NO: 85037 - protein, 14 aa, Mycobacterium tuberculosis
AFYKNQQKTPKTKI

SEQ ID NO: 85038 - protein, 14 aa, Mycobacterium tuberculosis
FYKNQQKTPKTKIE

SEQ ID NO: 85039 - protein, 14 aa, Mycobacterium tuberculosis
YKNQQKTPKTKIET

SEQ ID NO: 85040 - protein, 14 aa, Mycobacterium tuberculosis
KNQQKTPKTKIETA

SEQ ID NO: 85041 - protein, 14 aa, Mycobacterium tuberculosis
NQQKTPKTKIETAL

SEQ ID NO: 85042 - protein, 14 aa, Mycobacterium tuberculosis
QQKTPKTKIETALD

SEQ ID NO: 85043 - protein, 14 aa, Mycobacterium tuberculosis
QKTPKTKIETALDR

SEQ ID NO: 85044 - protein, 14 aa, Mycobacterium tuberculosis
KTPKTKIETALDRQ

SEQ ID NO: 85045 - protein, 14 aa, Mycobacterium tuberculosis
TPKTKIETALDRQK

SEQ ID NO: 85046 - protein, 14 aa, Mycobacterium tuberculosis
PKTKIETALDRQKI

SEQ ID NO: 85047 - protein, 14 aa, Mycobacterium tuberculosis
KTKIETALDRQKIW

SEQ ID NO: 85048 - protein, 14 aa, Mycobacterium tuberculosis
TKIETALDRQKIWK

SEQ ID NO: 85049 - protein, 14 aa, Mycobacterium tuberculosis
KIETALDRQKIWKR

SEQ ID NO: 85050 - protein, 14 aa, Mycobacterium tuberculosis
IETALDRQKIWKRA

SEQ ID NO: 85051 - protein, 14 aa, Mycobacterium tuberculosis
ETALDRQKIWKRAF

SEQ ID NO: 85052 - protein, 14 aa, Mycobacterium tuberculosis
TALDRQKIWKRAFG

SEQ ID NO: 85053 - protein, 14 aa, Mycobacterium tuberculosis
ALDRQKIWKRAFGD

SEQ ID NO: 85054 - protein, 14 aa, Mycobacterium tuberculosis
LDRQKIWKRAFGDT

SEQ ID NO: 85055 - protein, 14 aa, Mycobacterium tuberculosis
DRQKIWKRAFGDTP

SEQ ID NO: 85056 - protein, 14 aa, Mycobacterium tuberculosis
RQKIWKRAFGDTPP

SEQ ID NO: 85057 - protein, 14 aa, Mycobacterium tuberculosis
QKIWKRAFGDTPPI

SEQ ID NO: 85058 - protein, 15 aa, Mycobacterium tuberculosis
MPSGWVSHRLGGSPK

SEQ ID NO: 85059 - protein, 15 aa, Mycobacterium tuberculosis
PSGWVSHRLGGSPKC

SEQ ID NO: 85060 - protein, 15 aa, Mycobacterium tuberculosis
SGWVSHRLGGSPKCI

SEQ ID NO: 85061 - protein, 15 aa, Mycobacterium tuberculosis
GWVSHRLGGSPKCIS

SEQ ID NO: 85062 - protein, 15 aa, Mycobacterium tuberculosis
WVSHRLGGSPKCISA

SEQ ID NO: 85063 - protein, 15 aa, Mycobacterium tuberculosis
VSHRLGGSPKCISAL

SEQ ID NO: 85064 - protein, 15 aa, Mycobacterium tuberculosis
SHRLGGSPKCISALS

SEQ ID NO: 85065 - protein, 15 aa, Mycobacterium tuberculosis
HRLGGSPKCISALSL

SEQ ID NO: 85066 - protein, 15 aa, Mycobacterium tuberculosis
RLGGSPKCISALSLP

SEQ ID NO: 85067 - protein, 15 aa, Mycobacterium tuberculosis
LGGSPKCISALSLPS

SEQ ID NO: 85068 - protein, 15 aa, Mycobacterium tuberculosis
GGSPKCISALSLPSG

SEQ ID NO: 85069 - protein, 15 aa, Mycobacterium tuberculosis
GSPKCISALSLPSGT

SEQ ID NO: 85070 - protein, 15 aa, Mycobacterium tuberculosis
SPKCISALSLPSGTV

SEQ ID NO: 85071 - protein, 15 aa, Mycobacterium tuberculosis
PKCISALSLPSGTVG

SEQ ID NO: 85072 - protein, 15 aa, Mycobacterium tuberculosis
KCISALSLPSGTVGA

SEQ ID NO: 85073 - protein, 15 aa, Mycobacterium tuberculosis
CISALSLPSGTVGAP

SEQ ID NO: 85074 - protein, 15 aa, Mycobacterium tuberculosis
ISALSLPSGTVGAPS

SEQ ID NO: 85075 - protein, 15 aa, Mycobacterium tuberculosis
SALSLPSGTVGAPSK

SEQ ID NO: 85076 - protein, 15 aa, Mycobacterium tuberculosis
ALSLPSGTVGAPSKP

SEQ ID NO: 85077 - protein, 15 aa, Mycobacterium tuberculosis
LSLPSGTVGAPSKPD

SEQ ID NO: 85078 - protein, 15 aa, Mycobacterium tuberculosis
SLPSGTVGAPSKPDN

SEQ ID NO: 85079 - protein, 15 aa, Mycobacterium tuberculosis
LPSGTVGAPSKPDND

SEQ ID NO: 85080 - protein, 15 aa, Mycobacterium tuberculosis
PSGTVGAPSKPDNDA

SEQ ID NO: 85081 - protein, 15 aa, Mycobacterium tuberculosis
SGTVGAPSKPDNDAT

SEQ ID NO: 85082 - protein, 15 aa, Mycobacterium tuberculosis
GTVGAPSKPDNDATR

SEQ ID NO: 85083 - protein, 15 aa, Mycobacterium tuberculosis
TVGAPSKPDNDATRG

SEQ ID NO: 85084 - protein, 15 aa, Mycobacterium tuberculosis
VGAPSKPDNDATRGR

SEQ ID NO: 85085 - protein, 15 aa, Mycobacterium tuberculosis
GAPSKPDNDATRGRT

SEQ ID NO: 85086 - protein, 15 aa, Mycobacterium tuberculosis
APSKPDNDATRGRTR

SEQ ID NO: 85087 - protein, 15 aa, Mycobacterium tuberculosis
PSKPDNDATRGRTRP

SEQ ID NO: 85088 - protein, 15 aa, Mycobacterium tuberculosis
SKPDNDATRGRTRPT

SEQ ID NO: 85089 - protein, 15 aa, Mycobacterium tuberculosis
KPDNDATRGRTRPTV

SEQ ID NO: 85090 - protein, 15 aa, Mycobacterium tuberculosis
PDNDATRGRTRPTVP

SEQ ID NO: 85091 - protein, 15 aa, Mycobacterium tuberculosis
DNDATRGRTRPTVPP

SEQ ID NO: 85092 - protein, 15 aa, Mycobacterium tuberculosis
NDATRGRTRPTVPPP

SEQ ID NO: 85093 - protein, 15 aa, Mycobacterium tuberculosis
DATRGRTRPTVPPPD

SEQ ID NO: 85094 - protein, 15 aa, Mycobacterium tuberculosis
ATRGRTRPTVPPPDP

SEQ ID NO: 85095 - protein, 15 aa, Mycobacterium tuberculosis
TRGRTRPTVPPPDPA

SEQ ID NO: 85096 - protein, 15 aa, Mycobacterium tuberculosis
RGRTRPTVPPPDPAA

SEQ ID NO: 85097 - protein, 15 aa, Mycobacterium tuberculosis
GRTRPTVPPPDPAAM

SEQ ID NO: 85098 - protein, 15 aa, Mycobacterium tuberculosis
RTRPTVPPPDPAAMG

SEQ ID NO: 85099 - protein, 15 aa, Mycobacterium tuberculosis
TRPTVPPPDPAAMGT

SEQ ID NO: 85100 - protein, 15 aa, Mycobacterium tuberculosis
RPTVPPPDPAAMGTW

SEQ ID NO: 85101 - protein, 15 aa, Mycobacterium tuberculosis
PTVPPPDPAAMGTWK

SEQ ID NO: 85102 - protein, 15 aa, Mycobacterium tuberculosis
TVPPPDPAAMGTWKF

SEQ ID NO: 85103 - protein, 15 aa, Mycobacterium tuberculosis
VPPPDPAAMGTWKFF

SEQ ID NO: 85104 - protein, 15 aa, Mycobacterium tuberculosis
PPPDPAAMGTWKFFR

SEQ ID NO: 85105 - protein, 15 aa, Mycobacterium tuberculosis
PPDPAAMGTWKFFRA

SEQ ID NO: 85106 - protein, 15 aa, Mycobacterium tuberculosis
PDPAAMGTWKFFRAS

SEQ ID NO: 85107 - protein, 15 aa, Mycobacterium tuberculosis
DPAAMGTWKFFRASV

SEQ ID NO: 85108 - protein, 15 aa, Mycobacterium tuberculosis
PAAMGTWKFFRASVD

SEQ ID NO: 85109 - protein, 15 aa, Mycobacterium tuberculosis
AAMGTWKFFRASVDG

SEQ ID NO: 85110 - protein, 15 aa, Mycobacterium tuberculosis
AMGTWKFFRASVDGR

SEQ ID NO: 85111 - protein, 15 aa, Mycobacterium tuberculosis
MGTWKFFRASVDGRP

SEQ ID NO: 85112 - protein, 15 aa, Mycobacterium tuberculosis
GTWKFFRASVDGRPV

SEQ ID NO: 85113 - protein, 15 aa, Mycobacterium tuberculosis
TWKFFRASVDGRPVF

SEQ ID NO: 85114 - protein, 15 aa, Mycobacterium tuberculosis
WKFFRASVDGRPVFK

SEQ ID NO: 85115 - protein, 15 aa, Mycobacterium tuberculosis
KFFRASVDGRPVFKK

SEQ ID NO: 85116 - protein, 15 aa, Mycobacterium tuberculosis
FFRASVDGRPVFKKE

SEQ ID NO: 85117 - protein, 15 aa, Mycobacterium tuberculosis
FRASVDGRPVFKKEF

SEQ ID NO: 85118 - protein, 15 aa, Mycobacterium tuberculosis
RASVDGRPVFKKEFD

SEQ ID NO: 85119 - protein, 15 aa, Mycobacterium tuberculosis
ASVDGRPVFKKEFDK

SEQ ID NO: 85120 - protein, 15 aa, Mycobacterium tuberculosis
SVDGRPVFKKEFDKL

SEQ ID NO: 85121 - protein, 15 aa, Mycobacterium tuberculosis
VDGRPVFKKEFDKLP

SEQ ID NO: 85122 - protein, 15 aa, Mycobacterium tuberculosis
DGRPVFKKEFDKLPD

SEQ ID NO: 85123 - protein, 15 aa, Mycobacterium tuberculosis
GRPVFKKEFDKLPDQ

SEQ ID NO: 85124 - protein, 15 aa, Mycobacterium tuberculosis
RPVFKKEFDKLPDQA

SEQ ID NO: 85125 - protein, 15 aa, Mycobacterium tuberculosis
PVFKKEFDKLPDQAR

SEQ ID NO: 85126 - protein, 15 aa, Mycobacterium tuberculosis
VFKKEFDKLPDQARA

SEQ ID NO: 85127 - protein, 15 aa, Mycobacterium tuberculosis
FKKEFDKLPDQARAA

SEQ ID NO: 85128 - protein, 15 aa, Mycobacterium tuberculosis
KKEFDKLPDQARAAL

SEQ ID NO: 85129 - protein, 15 aa, Mycobacterium tuberculosis
KEFDKLPDQARAALI

SEQ ID NO: 85130 - protein, 15 aa, Mycobacterium tuberculosis
EFDKLPDQARAALIV

SEQ ID NO: 85131 - protein, 15 aa, Mycobacterium tuberculosis
FDKLPDQARAALIVL

SEQ ID NO: 85132 - protein, 15 aa, Mycobacterium tuberculosis
DKLPDQARAALIVLM

SEQ ID NO: 85133 - protein, 15 aa, Mycobacterium tuberculosis
KLPDQARAALIVLMQ

SEQ ID NO: 85134 - protein, 15 aa, Mycobacterium tuberculosis
LPDQARAALIVLMQR

SEQ ID NO: 85135 - protein, 15 aa, Mycobacterium tuberculosis
PDQARAALIVLMQRY

SEQ ID NO: 85136 - protein, 15 aa, Mycobacterium tuberculosis
DQARAALIVLMQRYL

SEQ ID NO: 85137 - protein, 15 aa, Mycobacterium tuberculosis
QARAALIVLMQRYLV

SEQ ID NO: 85138 - protein, 15 aa, Mycobacterium tuberculosis
ARAALIVLMQRYLVG

SEQ ID NO: 85139 - protein, 15 aa, Mycobacterium tuberculosis
RAALIVLMQRYLVGD

SEQ ID NO: 85140 - protein, 15 aa, Mycobacterium tuberculosis
AALIVLMQRYLVGDL

SEQ ID NO: 85141 - protein, 15 aa, Mycobacterium tuberculosis
ALIVLMQRYLVGDLA

SEQ ID NO: 85142 - protein, 15 aa, Mycobacterium tuberculosis
LIVLMQRYLVGDLAA

SEQ ID NO: 85143 - protein, 15 aa, Mycobacterium tuberculosis
IVLMQRYLVGDLAAG

SEQ ID NO: 85144 - protein, 15 aa, Mycobacterium tuberculosis
VLMQRYLVGDLAAGS

SEQ ID NO: 85145 - protein, 15 aa, Mycobacterium tuberculosis
LMQRYLVGDLAAGSI

SEQ ID NO: 85146 - protein, 15 aa, Mycobacterium tuberculosis
MQRYLVGDLAAGSIK

SEQ ID NO: 85147 - protein, 15 aa, Mycobacterium tuberculosis
QRYLVGDLAAGSIKP

SEQ ID NO: 85148 - protein, 15 aa, Mycobacterium tuberculosis
RYLVGDLAAGSIKPI

SEQ ID NO: 85149 - protein, 15 aa, Mycobacterium tuberculosis
YLVGDLAAGSIKPIR

SEQ ID NO: 85150 - protein, 15 aa, Mycobacterium tuberculosis
LVGDLAAGSIKPIRG

SEQ ID NO: 85151 - protein, 15 aa, Mycobacterium tuberculosis
VGDLAAGSIKPIRGD

SEQ ID NO: 85152 - protein, 15 aa, Mycobacterium tuberculosis
GDLAAGSIKPIRGDI

SEQ ID NO: 85153 - protein, 15 aa, Mycobacterium tuberculosis
DLAAGSIKPIRGDIL

SEQ ID NO: 85154 - protein, 15 aa, Mycobacterium tuberculosis
LAAGSIKPIRGDILE

SEQ ID NO: 85155 - protein, 15 aa, Mycobacterium tuberculosis
AAGSIKPIRGDILEL

SEQ ID NO: 85156 - protein, 15 aa, Mycobacterium tuberculosis
AGSIKPIRGDILELR

SEQ ID NO: 85157 - protein, 15 aa, Mycobacterium tuberculosis
GSIKPIRGDILELRW

SEQ ID NO: 85158 - protein, 15 aa, Mycobacterium tuberculosis
SIKPIRGDILELRWH

SEQ ID NO: 85159 - protein, 15 aa, Mycobacterium tuberculosis
IKPIRGDILELRWHE

SEQ ID NO: 85160 - protein, 15 aa, Mycobacterium tuberculosis
KPIRGDILELRWHEA

SEQ ID NO: 85161 - protein, 15 aa, Mycobacterium tuberculosis
PIRGDILELRWHEAN

SEQ ID NO: 85162 - protein, 15 aa, Mycobacterium tuberculosis
IRGDILELRWHEANN

SEQ ID NO: 85163 - protein, 15 aa, Mycobacterium tuberculosis
RGDILELRWHEANNH

SEQ ID NO: 85164 - protein, 15 aa, Mycobacterium tuberculosis
GDILELRWHEANNHF

SEQ ID NO: 85165 - protein, 15 aa, Mycobacterium tuberculosis
DILELRWHEANNHFR

SEQ ID NO: 85166 - protein, 15 aa, Mycobacterium tuberculosis
ILELRWHEANNHFRV

SEQ ID NO: 85167 - protein, 15 aa, Mycobacterium tuberculosis
LELRWHEANNHFRVL

SEQ ID NO: 85168 - protein, 15 aa, Mycobacterium tuberculosis
ELRWHEANNHFRVLF

SEQ ID NO: 85169 - protein, 15 aa, Mycobacterium tuberculosis
LRWHEANNHFRVLFF

SEQ ID NO: 85170 - protein, 15 aa, Mycobacterium tuberculosis
RWHEANNHFRVLFFR

SEQ ID NO: 85171 - protein, 15 aa, Mycobacterium tuberculosis
WHEANNHFRVLFFRW

SEQ ID NO: 85172 - protein, 15 aa, Mycobacterium tuberculosis
HEANNHFRVLFFRWG

SEQ ID NO: 85173 - protein, 15 aa, Mycobacterium tuberculosis
EANNHFRVLFFRWGQ

SEQ ID NO: 85174 - protein, 15 aa, Mycobacterium tuberculosis
ANNHFRVLFFRWGQH

SEQ ID NO: 85175 - protein, 15 aa, Mycobacterium tuberculosis
NNHFRVLFFRWGQHP

SEQ ID NO: 85176 - protein, 15 aa, Mycobacterium tuberculosis
NHFRVLFFRWGQHPV

SEQ ID NO: 85177 - protein, 15 aa, Mycobacterium tuberculosis
HFRVLFFRWGQHPVA

SEQ ID NO: 85178 - protein, 15 aa, Mycobacterium tuberculosis
FRVLFFRWGQHPVAL

SEQ ID NO: 85179 - protein, 15 aa, Mycobacterium tuberculosis
RVLFFRWGQHPVALT

SEQ ID NO: 85180 - protein, 15 aa, Mycobacterium tuberculosis
VLFFRWGQHPVALTA

SEQ ID NO: 85181 - protein, 15 aa, Mycobacterium tuberculosis
LFFRWGQHPVALTAF

SEQ ID NO: 85182 - protein, 15 aa, Mycobacterium tuberculosis
FFRWGQHPVALTAFY

SEQ ID NO: 85183 - protein, 15 aa, Mycobacterium tuberculosis
FRWGQHPVALTAFYK

SEQ ID NO: 85184 - protein, 15 aa, Mycobacterium tuberculosis
RWGQHPVALTAFYKN

SEQ ID NO: 85185 - protein, 15 aa, Mycobacterium tuberculosis
WGQHPVALTAFYKNQ

SEQ ID NO: 85186 - protein, 15 aa, Mycobacterium tuberculosis
GQHPVALTAFYKNQQ

SEQ ID NO: 85187 - protein, 15 aa, Mycobacterium tuberculosis
QHPVALTAFYKNQQK

SEQ ID NO: 85188 - protein, 15 aa, Mycobacterium tuberculosis
HPVALTAFYKNQQKT

SEQ ID NO: 85189 - protein, 15 aa, Mycobacterium tuberculosis
PVALTAFYKNQQKTP

SEQ ID NO: 85190 - protein, 15 aa, Mycobacterium tuberculosis
VALTAFYKNQQKTPK

SEQ ID NO: 85191 - protein, 15 aa, Mycobacterium tuberculosis
ALTAFYKNQQKTPKT

SEQ ID NO: 85192 - protein, 15 aa, Mycobacterium tuberculosis
LTAFYKNQQKTPKTK

SEQ ID NO: 85193 - protein, 15 aa, Mycobacterium tuberculosis
TAFYKNQQKTPKTKI

SEQ ID NO: 85194 - protein, 15 aa, Mycobacterium tuberculosis
AFYKNQQKTPKTKIE

SEQ ID NO: 85195 - protein, 15 aa, Mycobacterium tuberculosis
FYKNQQKTPKTKIET

SEQ ID NO: 85196 - protein, 15 aa, Mycobacterium tuberculosis
YKNQQKTPKTKIETA

SEQ ID NO: 85197 - protein, 15 aa, Mycobacterium tuberculosis
KNQQKTPKTKIETAL

SEQ ID NO: 85198 - protein, 15 aa, Mycobacterium tuberculosis
NQQKTPKTKIETALD

SEQ ID NO: 85199 - protein, 15 aa, Mycobacterium tuberculosis
QQKTPKTKIETALDR

SEQ ID NO: 85200 - protein, 15 aa, Mycobacterium tuberculosis
QKTPKTKIETALDRQ

SEQ ID NO: 85201 - protein, 15 aa, Mycobacterium tuberculosis
KTPKTKIETALDRQK

SEQ ID NO: 85202 - protein, 15 aa, Mycobacterium tuberculosis
TPKTKIETALDRQKI

SEQ ID NO: 85203 - protein, 15 aa, Mycobacterium tuberculosis
PKTKIETALDRQKIW

SEQ ID NO: 85204 - protein, 15 aa, Mycobacterium tuberculosis
KTKIETALDRQKIWK

SEQ ID NO: 85205 - protein, 15 aa, Mycobacterium tuberculosis
TKIETALDRQKIWKR

SEQ ID NO: 85206 - protein, 15 aa, Mycobacterium tuberculosis
KIETALDRQKIWKRA

SEQ ID NO: 85207 - protein, 15 aa, Mycobacterium tuberculosis
IETALDRQKIWKRAF

SEQ ID NO: 85208 - protein, 15 aa, Mycobacterium tuberculosis
ETALDRQKIWKRAFG

SEQ ID NO: 85209 - protein, 15 aa, Mycobacterium tuberculosis
TALDRQKIWKRAFGD

SEQ ID NO: 85210 - protein, 15 aa, Mycobacterium tuberculosis
ALDRQKIWKRAFGDT

SEQ ID NO: 85211 - protein, 15 aa, Mycobacterium tuberculosis
LDRQKIWKRAFGDTP

SEQ ID NO: 85212 - protein, 15 aa, Mycobacterium tuberculosis
DRQKIWKRAFGDTPP

SEQ ID NO: 85213 - protein, 15 aa, Mycobacterium tuberculosis
RQKIWKRAFGDTPPI

SEQ ID NO: 85214 - protein, 16 aa, Mycobacterium tuberculosis
MPSGWVSHRLGGSPKC

SEQ ID NO: 85215 - protein, 16 aa, Mycobacterium tuberculosis
PSGWVSHRLGGSPKCI

SEQ ID NO: 85216 - protein, 16 aa, Mycobacterium tuberculosis
SGWVSHRLGGSPKCIS

SEQ ID NO: 85217 - protein, 16 aa, Mycobacterium tuberculosis
GWVSHRLGGSPKCISA

SEQ ID NO: 85218 - protein, 16 aa, Mycobacterium tuberculosis
WVSHRLGGSPKCISAL

SEQ ID NO: 85219 - protein, 16 aa, Mycobacterium tuberculosis
VSHRLGGSPKCISALS

SEQ ID NO: 85220 - protein, 16 aa, Mycobacterium tuberculosis
SHRLGGSPKCISALSL

SEQ ID NO: 85221 - protein, 16 aa, Mycobacterium tuberculosis
HRLGGSPKCISALSLP

SEQ ID NO: 85222 - protein, 16 aa, Mycobacterium tuberculosis
RLGGSPKCISALSLPS

SEQ ID NO: 85223 - protein, 16 aa, Mycobacterium tuberculosis
LGGSPKCISALSLPSG

SEQ ID NO: 85224 - protein, 16 aa, Mycobacterium tuberculosis
GGSPKCISALSLPSGT

SEQ ID NO: 85225 - protein, 16 aa, Mycobacterium tuberculosis
GSPKCISALSLPSGTV

SEQ ID NO: 85226 - protein, 16 aa, Mycobacterium tuberculosis
SPKCISALSLPSGTVG

SEQ ID NO: 85227 - protein, 16 aa, Mycobacterium tuberculosis
PKCISALSLPSGTVGA

SEQ ID NO: 85228 - protein, 16 aa, Mycobacterium tuberculosis
KCISALSLPSGTVGAP

SEQ ID NO: 85229 - protein, 16 aa, Mycobacterium tuberculosis
CISALSLPSGTVGAPS

SEQ ID NO: 85230 - protein, 16 aa, Mycobacterium tuberculosis
ISALSLPSGTVGAPSK

SEQ ID NO: 85231 - protein, 16 aa, Mycobacterium tuberculosis
SALSLPSGTVGAPSKP

SEQ ID NO: 85232 - protein, 16 aa, Mycobacterium tuberculosis
ALSLPSGTVGAPSKPD

SEQ ID NO: 85233 - protein, 16 aa, Mycobacterium tuberculosis
LSLPSGTVGAPSKPDN

SEQ ID NO: 85234 - protein, 16 aa, Mycobacterium tuberculosis
SLPSGTVGAPSKPDND

SEQ ID NO: 85235 - protein, 16 aa, Mycobacterium tuberculosis
LPSGTVGAPSKPDNDA

SEQ ID NO: 85236 - protein, 16 aa, Mycobacterium tuberculosis
PSGTVGAPSKPDNDAT

SEQ ID NO: 85237 - protein, 16 aa, Mycobacterium tuberculosis
SGTVGAPSKPDNDATR

SEQ ID NO: 85238 - protein, 16 aa, Mycobacterium tuberculosis
GTVGAPSKPDNDATRG

SEQ ID NO: 85239 - protein, 16 aa, Mycobacterium tuberculosis
TVGAPSKPDNDATRGR

SEQ ID NO: 85240 - protein, 16 aa, Mycobacterium tuberculosis
VGAPSKPDNDATRGRT

SEQ ID NO: 85241 - protein, 16 aa, Mycobacterium tuberculosis
GAPSKPDNDATRGRTR

SEQ ID NO: 85242 - protein, 16 aa, Mycobacterium tuberculosis
APSKPDNDATRGRTRP

SEQ ID NO: 85243 - protein, 16 aa, Mycobacterium tuberculosis
PSKPDNDATRGRTRPT

SEQ ID NO: 85244 - protein, 16 aa, Mycobacterium tuberculosis
SKPDNDATRGRTRPTV

SEQ ID NO: 85245 - protein, 16 aa, Mycobacterium tuberculosis
KPDNDATRGRTRPTVP

SEQ ID NO: 85246 - protein, 16 aa, Mycobacterium tuberculosis
PDNDATRGRTRPTVPP

SEQ ID NO: 85247 - protein, 16 aa, Mycobacterium tuberculosis
DNDATRGRTRPTVPPP

SEQ ID NO: 85248 - protein, 16 aa, Mycobacterium tuberculosis
NDATRGRTRPTVPPPD

SEQ ID NO: 85249 - protein, 16 aa, Mycobacterium tuberculosis
DATRGRTRPTVPPPDP

SEQ ID NO: 85250 - protein, 16 aa, Mycobacterium tuberculosis
ATRGRTRPTVPPPDPA

SEQ ID NO: 85251 - protein, 16 aa, Mycobacterium tuberculosis
TRGRTRPTVPPPDPAA

SEQ ID NO: 85252 - protein, 16 aa, Mycobacterium tuberculosis
RGRTRPTVPPPDPAAM

SEQ ID NO: 85253 - protein, 16 aa, Mycobacterium tuberculosis
GRTRPTVPPPDPAAMG

SEQ ID NO: 85254 - protein, 16 aa, Mycobacterium tuberculosis
RTRPTVPPPDPAAMGT

SEQ ID NO: 85255 - protein, 16 aa, Mycobacterium tuberculosis
TRPTVPPPDPAAMGTW

SEQ ID NO: 85256 - protein, 16 aa, Mycobacterium tuberculosis
RPTVPPPDPAAMGTWK

SEQ ID NO: 85257 - protein, 16 aa, Mycobacterium tuberculosis
PTVPPPDPAAMGTWKF

SEQ ID NO: 85258 - protein, 16 aa, Mycobacterium tuberculosis
TVPPPDPAAMGTWKFF

SEQ ID NO: 85259 - protein, 16 aa, Mycobacterium tuberculosis
VPPPDPAAMGTWKFFR

SEQ ID NO: 85260 - protein, 16 aa, Mycobacterium tuberculosis
PPPDPAAMGTWKFFRA

SEQ ID NO: 85261 - protein, 16 aa, Mycobacterium tuberculosis
PPDPAAMGTWKFFRAS

SEQ ID NO: 85262 - protein, 16 aa, Mycobacterium tuberculosis
PDPAAMGTWKFFRASV

SEQ ID NO: 85263 - protein, 16 aa, Mycobacterium tuberculosis
DPAAMGTWKFFRASVD

SEQ ID NO: 85264 - protein, 16 aa, Mycobacterium tuberculosis
PAAMGTWKFFRASVDG

SEQ ID NO: 85265 - protein, 16 aa, Mycobacterium tuberculosis
AAMGTWKFFRASVDGR

SEQ ID NO: 85266 - protein, 16 aa, Mycobacterium tuberculosis
AMGTWKFFRASVDGRP

SEQ ID NO: 85267 - protein, 16 aa, Mycobacterium tuberculosis
MGTWKFFRASVDGRPV

SEQ ID NO: 85268 - protein, 16 aa, Mycobacterium tuberculosis
GTWKFFRASVDGRPVF

SEQ ID NO: 85269 - protein, 16 aa, Mycobacterium tuberculosis
TWKFFRASVDGRPVFK

SEQ ID NO: 85270 - protein, 16 aa, Mycobacterium tuberculosis
WKFFRASVDGRPVFKK

SEQ ID NO: 85271 - protein, 16 aa, Mycobacterium tuberculosis
KFFRASVDGRPVFKKE

SEQ ID NO: 85272 - protein, 16 aa, Mycobacterium tuberculosis
FFRASVDGRPVFKKEF

SEQ ID NO: 85273 - protein, 16 aa, Mycobacterium tuberculosis
FRASVDGRPVFKKEFD

SEQ ID NO: 85274 - protein, 16 aa, Mycobacterium tuberculosis
RASVDGRPVFKKEFDK

SEQ ID NO: 85275 - protein, 16 aa, Mycobacterium tuberculosis
ASVDGRPVFKKEFDKL

SEQ ID NO: 85276 - protein, 16 aa, Mycobacterium tuberculosis
SVDGRPVFKKEFDKLP

SEQ ID NO: 85277 - protein, 16 aa, Mycobacterium tuberculosis
VDGRPVFKKEFDKLPD

SEQ ID NO: 85278 - protein, 16 aa, Mycobacterium tuberculosis
DGRPVFKKEFDKLPDQ

SEQ ID NO: 85279 - protein, 16 aa, Mycobacterium tuberculosis
GRPVFKKEFDKLPDQA

SEQ ID NO: 85280 - protein, 16 aa, Mycobacterium tuberculosis
RPVFKKEFDKLPDQAR

SEQ ID NO: 85281 - protein, 16 aa, Mycobacterium tuberculosis
PVFKKEFDKLPDQARA

SEQ ID NO: 85282 - protein, 16 aa, Mycobacterium tuberculosis
VFKKEFDKLPDQARAA

SEQ ID NO: 85283 - protein, 16 aa, Mycobacterium tuberculosis
FKKEFDKLPDQARAAL

SEQ ID NO: 85284 - protein, 16 aa, Mycobacterium tuberculosis
KKEFDKLPDQARAALI

SEQ ID NO: 85285 - protein, 16 aa, Mycobacterium tuberculosis
KEFDKLPDQARAALIV

SEQ ID NO: 85286 - protein, 16 aa, Mycobacterium tuberculosis
EFDKLPDQARAALIVL

SEQ ID NO: 85287 - protein, 16 aa, Mycobacterium tuberculosis
FDKLPDQARAALIVLM

SEQ ID NO: 85288 - protein, 16 aa, Mycobacterium tuberculosis
DKLPDQARAALIVLMQ

SEQ ID NO: 85289 - protein, 16 aa, Mycobacterium tuberculosis
KLPDQARAALIVLMQR

SEQ ID NO: 85290 - protein, 16 aa, Mycobacterium tuberculosis
LPDQARAALIVLMQRY

SEQ ID NO: 85291 - protein, 16 aa, Mycobacterium tuberculosis
PDQARAALIVLMQRYL

SEQ ID NO: 85292 - protein, 16 aa, Mycobacterium tuberculosis
DQARAALIVLMQRYLV

SEQ ID NO: 85293 - protein, 16 aa, Mycobacterium tuberculosis
QARAALIVLMQRYLVG

SEQ ID NO: 85294 - protein, 16 aa, Mycobacterium tuberculosis
ARAALIVLMQRYLVGD

SEQ ID NO: 85295 - protein, 16 aa, Mycobacterium tuberculosis
RAALIVLMQRYLVGDL

SEQ ID NO: 85296 - protein, 16 aa, Mycobacterium tuberculosis
AALIVLMQRYLVGDLA

SEQ ID NO: 85297 - protein, 16 aa, Mycobacterium tuberculosis
ALIVLMQRYLVGDLAA

SEQ ID NO: 85298 - protein, 16 aa, Mycobacterium tuberculosis
LIVLMQRYLVGDLAAG

SEQ ID NO: 85299 - protein, 16 aa, Mycobacterium tuberculosis
IVLMQRYLVGDLAAGS

SEQ ID NO: 85300 - protein, 16 aa, Mycobacterium tuberculosis
VLMQRYLVGDLAAGSI

SEQ ID NO: 85301 - protein, 16 aa, Mycobacterium tuberculosis
LMQRYLVGDLAAGSIK

SEQ ID NO: 85302 - protein, 16 aa, Mycobacterium tuberculosis
MQRYLVGDLAAGSIKP

SEQ ID NO: 85303 - protein, 16 aa, Mycobacterium tuberculosis
QRYLVGDLAAGSIKPI

SEQ ID NO: 85304 - protein, 16 aa, Mycobacterium tuberculosis
RYLVGDLAAGSIKPIR

SEQ ID NO: 85305 - protein, 16 aa, Mycobacterium tuberculosis
YLVGDLAAGSIKPIRG

SEQ ID NO: 85306 - protein, 16 aa, Mycobacterium tuberculosis
LVGDLAAGSIKPIRGD

SEQ ID NO: 85307 - protein, 16 aa, Mycobacterium tuberculosis
VGDLAAGSIKPIRGDI

SEQ ID NO: 85308 - protein, 16 aa, Mycobacterium tuberculosis
GDLAAGSIKPIRGDIL

SEQ ID NO: 85309 - protein, 16 aa, Mycobacterium tuberculosis
DLAAGSIKPIRGDILE

SEQ ID NO: 85310 - protein, 16 aa, Mycobacterium tuberculosis
LAAGSIKPIRGDILEL

SEQ ID NO: 85311 - protein, 16 aa, Mycobacterium tuberculosis
AAGSIKPIRGDILELR

SEQ ID NO: 85312 - protein, 16 aa, Mycobacterium tuberculosis
AGSIKPIRGDILELRW

SEQ ID NO: 85313 - protein, 16 aa, Mycobacterium tuberculosis
GSIKPIRGDILELRWH

SEQ ID NO: 85314 - protein, 16 aa, Mycobacterium tuberculosis
SIKPIRGDILELRWHE

SEQ ID NO: 85315 - protein, 16 aa, Mycobacterium tuberculosis
IKPIRGDILELRWHEA

SEQ ID NO: 85316 - protein, 16 aa, Mycobacterium tuberculosis
KPIRGDILELRWHEAN

SEQ ID NO: 85317 - protein, 16 aa, Mycobacterium tuberculosis
PIRGDILELRWHEANN

SEQ ID NO: 85318 - protein, 16 aa, Mycobacterium tuberculosis
IRGDILELRWHEANNH

SEQ ID NO: 85319 - protein, 16 aa, Mycobacterium tuberculosis
RGDILELRWHEANNHF

SEQ ID NO: 85320 - protein, 16 aa, Mycobacterium tuberculosis
GDILELRWHEANNHFR

SEQ ID NO: 85321 - protein, 16 aa, Mycobacterium tuberculosis
DILELRWHEANNHFRV

SEQ ID NO: 85322 - protein, 16 aa, Mycobacterium tuberculosis
ILELRWHEANNHFRVL

SEQ ID NO: 85323 - protein, 16 aa, Mycobacterium tuberculosis
LELRWHEANNHFRVLF

SEQ ID NO: 85324 - protein, 16 aa, Mycobacterium tuberculosis
ELRWHEANNHFRVLFF

SEQ ID NO: 85325 - protein, 16 aa, Mycobacterium tuberculosis
LRWHEANNHFRVLFFR

SEQ ID NO: 85326 - protein, 16 aa, Mycobacterium tuberculosis
RWHEANNHFRVLFFRW

SEQ ID NO: 85327 - protein, 16 aa, Mycobacterium tuberculosis
WHEANNHFRVLFFRWG

SEQ ID NO: 85328 - protein, 16 aa, Mycobacterium tuberculosis
HEANNHFRVLFFRWGQ

SEQ ID NO: 85329 - protein, 16 aa, Mycobacterium tuberculosis
EANNHFRVLFFRWGQH

SEQ ID NO: 85330 - protein, 16 aa, Mycobacterium tuberculosis
ANNHFRVLFFRWGQHP

SEQ ID NO: 85331 - protein, 16 aa, Mycobacterium tuberculosis
NNHFRVLFFRWGQHPV

SEQ ID NO: 85332 - protein, 16 aa, Mycobacterium tuberculosis
NHFRVLFFRWGQHPVA

SEQ ID NO: 85333 - protein, 16 aa, Mycobacterium tuberculosis
HFRVLFFRWGQHPVAL

SEQ ID NO: 85334 - protein, 16 aa, Mycobacterium tuberculosis
FRVLFFRWGQHPVALT

SEQ ID NO: 85335 - protein, 16 aa, Mycobacterium tuberculosis
RVLFFRWGQHPVALTA

SEQ ID NO: 85336 - protein, 16 aa, Mycobacterium tuberculosis
VLFFRWGQHPVALTAF

SEQ ID NO: 85337 - protein, 16 aa, Mycobacterium tuberculosis
LFFRWGQHPVALTAFY

SEQ ID NO: 85338 - protein, 16 aa, Mycobacterium tuberculosis
FFRWGQHPVALTAFYK

SEQ ID NO: 85339 - protein, 16 aa, Mycobacterium tuberculosis
FRWGQHPVALTAFYKN

SEQ ID NO: 85340 - protein, 16 aa, Mycobacterium tuberculosis
RWGQHPVALTAFYKNQ

SEQ ID NO: 85341 - protein, 16 aa, Mycobacterium tuberculosis
WGQHPVALTAFYKNQQ

SEQ ID NO: 85342 - protein, 16 aa, Mycobacterium tuberculosis
GQHPVALTAFYKNQQK

SEQ ID NO: 85343 - protein, 16 aa, Mycobacterium tuberculosis
QHPVALTAFYKNQQKT

SEQ ID NO: 85344 - protein, 16 aa, Mycobacterium tuberculosis
HPVALTAFYKNQQKTP

SEQ ID NO: 85345 - protein, 16 aa, Mycobacterium tuberculosis
PVALTAFYKNQQKTPK

SEQ ID NO: 85346 - protein, 16 aa, Mycobacterium tuberculosis
VALTAFYKNQQKTPKT

SEQ ID NO: 85347 - protein, 16 aa, Mycobacterium tuberculosis
ALTAFYKNQQKTPKTK

SEQ ID NO: 85348 - protein, 16 aa, Mycobacterium tuberculosis
LTAFYKNQQKTPKTKI

SEQ ID NO: 85349 - protein, 16 aa, Mycobacterium tuberculosis
TAFYKNQQKTPKTKIE

SEQ ID NO: 85350 - protein, 16 aa, Mycobacterium tuberculosis
AFYKNQQKTPKTKIET

SEQ ID NO: 85351 - protein, 16 aa, Mycobacterium tuberculosis
FYKNQQKTPKTKIETA

SEQ ID NO: 85352 - protein, 16 aa, Mycobacterium tuberculosis
YKNQQKTPKTKIETAL

SEQ ID NO: 85353 - protein, 16 aa, Mycobacterium tuberculosis
KNQQKTPKTKIETALD

SEQ ID NO: 85354 - protein, 16 aa, Mycobacterium tuberculosis
NQQKTPKTKIETALDR

SEQ ID NO: 85355 - protein, 16 aa, Mycobacterium tuberculosis
QQKTPKTKIETALDRQ

SEQ ID NO: 85356 - protein, 16 aa, Mycobacterium tuberculosis
QKTPKTKIETALDRQK

SEQ ID NO: 85357 - protein, 16 aa, Mycobacterium tuberculosis
KTPKTKIETALDRQKI

SEQ ID NO: 85358 - protein, 16 aa, Mycobacterium tuberculosis
TPKTKIETALDRQKIW

SEQ ID NO: 85359 - protein, 16 aa, Mycobacterium tuberculosis
PKTKIETALDRQKIWK

SEQ ID NO: 85360 - protein, 16 aa, Mycobacterium tuberculosis
KTKIETALDRQKIWKR

SEQ ID NO: 85361 - protein, 16 aa, Mycobacterium tuberculosis
TKIETALDRQKIWKRA

SEQ ID NO: 85362 - protein, 16 aa, Mycobacterium tuberculosis
KIETALDRQKIWKRAF

SEQ ID NO: 85363 - protein, 16 aa, Mycobacterium tuberculosis
IETALDRQKIWKRAFG

SEQ ID NO: 85364 - protein, 16 aa, Mycobacterium tuberculosis
ETALDRQKIWKRAFGD

SEQ ID NO: 85365 - protein, 16 aa, Mycobacterium tuberculosis
TALDRQKIWKRAFGDT

SEQ ID NO: 85366 - protein, 16 aa, Mycobacterium tuberculosis
ALDRQKIWKRAFGDTP

SEQ ID NO: 85367 - protein, 16 aa, Mycobacterium tuberculosis
LDRQKIWKRAFGDTPP

SEQ ID NO: 85368 - protein, 16 aa, Mycobacterium tuberculosis
DRQKIWKRAFGDTPPI

SEQ ID NO: 85369 - protein, 13 aa, Mycobacterium tuberculosis
MSTYRSPDRAWQA

SEQ ID NO: 85370 - protein, 13 aa, Mycobacterium tuberculosis
STYRSPDRAWQAL

SEQ ID NO: 85371 - protein, 13 aa, Mycobacterium tuberculosis
TYRSPDRAWQALA

SEQ ID NO: 85372 - protein, 13 aa, Mycobacterium tuberculosis
YRSPDRAWQALAD

SEQ ID NO: 85373 - protein, 13 aa, Mycobacterium tuberculosis
RSPDRAWQALADG

SEQ ID NO: 85374 - protein, 13 aa, Mycobacterium tuberculosis
SPDRAWQALADGT

SEQ ID NO: 85375 - protein, 13 aa, Mycobacterium tuberculosis
PDRAWQALADGTR

SEQ ID NO: 85376 - protein, 13 aa, Mycobacterium tuberculosis
DRAWQALADGTRR

SEQ ID NO: 85377 - protein, 13 aa, Mycobacterium tuberculosis
RAWQALADGTRRA

SEQ ID NO: 85378 - protein, 13 aa, Mycobacterium tuberculosis
AWQALADGTRRAI

SEQ ID NO: 85379 - protein, 13 aa, Mycobacterium tuberculosis
WQALADGTRRAIV

SEQ ID NO: 85380 - protein, 13 aa, Mycobacterium tuberculosis
QALADGTRRAIVE

SEQ ID NO: 85381 - protein, 13 aa, Mycobacterium tuberculosis
ALADGTRRAIVER

SEQ ID NO: 85382 - protein, 13 aa, Mycobacterium tuberculosis
LADGTRRAIVERL

SEQ ID NO: 85383 - protein, 13 aa, Mycobacterium tuberculosis
ADGTRRAIVERLA

SEQ ID NO: 85384 - protein, 13 aa, Mycobacterium tuberculosis
DGTRRAIVERLAH

SEQ ID NO: 85385 - protein, 13 aa, Mycobacterium tuberculosis
GTRRAIVERLAHG

SEQ ID NO: 85386 - protein, 13 aa, Mycobacterium tuberculosis
TRRAIVERLAHGP

SEQ ID NO: 85387 - protein, 13 aa, Mycobacterium tuberculosis
RRAIVERLAHGPL

SEQ ID NO: 85388 - protein, 13 aa, Mycobacterium tuberculosis
RAIVERLAHGPLA

SEQ ID NO: 85389 - protein, 13 aa, Mycobacterium tuberculosis
AIVERLAHGPLAV

SEQ ID NO: 85390 - protein, 13 aa, Mycobacterium tuberculosis
IVERLAHGPLAVG

SEQ ID NO: 85391 - protein, 13 aa, Mycobacterium tuberculosis
VERLAHGPLAVGE

SEQ ID NO: 85392 - protein, 13 aa, Mycobacterium tuberculosis
ERLAHGPLAVGEL

SEQ ID NO: 85393 - protein, 13 aa, Mycobacterium tuberculosis
RLAHGPLAVGELA

SEQ ID NO: 85394 - protein, 13 aa, Mycobacterium tuberculosis
LAHGPLAVGELAR

SEQ ID NO: 85395 - protein, 13 aa, Mycobacterium tuberculosis
AHGPLAVGELARD

SEQ ID NO: 85396 - protein, 13 aa, Mycobacterium tuberculosis
HGPLAVGELARDL

SEQ ID NO: 85397 - protein, 13 aa, Mycobacterium tuberculosis
GPLAVGELARDLP

SEQ ID NO: 85398 - protein, 13 aa, Mycobacterium tuberculosis
PLAVGELARDLPV

SEQ ID NO: 85399 - protein, 13 aa, Mycobacterium tuberculosis
LAVGELARDLPVS

SEQ ID NO: 85400 - protein, 13 aa, Mycobacterium tuberculosis
AVGELARDLPVSR

SEQ ID NO: 85401 - protein, 13 aa, Mycobacterium tuberculosis
VGELARDLPVSRP

SEQ ID NO: 85402 - protein, 13 aa, Mycobacterium tuberculosis
GELARDLPVSRPA

SEQ ID NO: 85403 - protein, 13 aa, Mycobacterium tuberculosis
ELARDLPVSRPAV

SEQ ID NO: 85404 - protein, 13 aa, Mycobacterium tuberculosis
LARDLPVSRPAVS

SEQ ID NO: 85405 - protein, 13 aa, Mycobacterium tuberculosis
ARDLPVSRPAVSQ

SEQ ID NO: 85406 - protein, 13 aa, Mycobacterium tuberculosis
RDLPVSRPAVSQH

SEQ ID NO: 85407 - protein, 13 aa, Mycobacterium tuberculosis
DLPVSRPAVSQHL

SEQ ID NO: 85408 - protein, 13 aa, Mycobacterium tuberculosis
LPVSRPAVSQHLK

SEQ ID NO: 85409 - protein, 13 aa, Mycobacterium tuberculosis
PVSRPAVSQHLKV

SEQ ID NO: 85410 - protein, 13 aa, Mycobacterium tuberculosis
VSRPAVSQHLKVL

SEQ ID NO: 85411 - protein, 13 aa, Mycobacterium tuberculosis
SRPAVSQHLKVLK

SEQ ID NO: 85412 - protein, 13 aa, Mycobacterium tuberculosis
RPAVSQHLKVLKT

SEQ ID NO: 85413 - protein, 13 aa, Mycobacterium tuberculosis
PAVSQHLKVLKTA

SEQ ID NO: 85414 - protein, 13 aa, Mycobacterium tuberculosis
AVSQHLKVLKTAR

SEQ ID NO: 85415 - protein, 13 aa, Mycobacterium tuberculosis
VSQHLKVLKTARL

SEQ ID NO: 85416 - protein, 13 aa, Mycobacterium tuberculosis
SQHLKVLKTARLV

SEQ ID NO: 85417 - protein, 13 aa, Mycobacterium tuberculosis
QHLKVLKTARLVC

SEQ ID NO: 85418 - protein, 13 aa, Mycobacterium tuberculosis
HLKVLKTARLVCD

SEQ ID NO: 85419 - protein, 13 aa, Mycobacterium tuberculosis
LKVLKTARLVCDR

SEQ ID NO: 85420 - protein, 13 aa, Mycobacterium tuberculosis
KVLKTARLVCDRP

SEQ ID NO: 85421 - protein, 13 aa, Mycobacterium tuberculosis
VLKTARLVCDRPA

SEQ ID NO: 85422 - protein, 13 aa, Mycobacterium tuberculosis
LKTARLVCDRPAG

SEQ ID NO: 85423 - protein, 13 aa, Mycobacterium tuberculosis
KTARLVCDRPAGT

SEQ ID NO: 85424 - protein, 13 aa, Mycobacterium tuberculosis
TARLVCDRPAGTR

SEQ ID NO: 85425 - protein, 13 aa, Mycobacterium tuberculosis
ARLVCDRPAGTRR

SEQ ID NO: 85426 - protein, 13 aa, Mycobacterium tuberculosis
RLVCDRPAGTRRV

SEQ ID NO: 85427 - protein, 13 aa, Mycobacterium tuberculosis
LVCDRPAGTRRVY

SEQ ID NO: 85428 - protein, 13 aa, Mycobacterium tuberculosis
VCDRPAGTRRVYQ

SEQ ID NO: 85429 - protein, 13 aa, Mycobacterium tuberculosis
CDRPAGTRRVYQL

SEQ ID NO: 85430 - protein, 13 aa, Mycobacterium tuberculosis
DRPAGTRRVYQLD

SEQ ID NO: 85431 - protein, 13 aa, Mycobacterium tuberculosis
RPAGTRRVYQLDP

SEQ ID NO: 85432 - protein, 13 aa, Mycobacterium tuberculosis
PAGTRRVYQLDPT

SEQ ID NO: 85433 - protein, 13 aa, Mycobacterium tuberculosis
AGTRRVYQLDPTG

SEQ ID NO: 85434 - protein, 13 aa, Mycobacterium tuberculosis
GTRRVYQLDPTGL

SEQ ID NO: 85435 - protein, 13 aa, Mycobacterium tuberculosis
TRRVYQLDPTGLA

SEQ ID NO: 85436 - protein, 13 aa, Mycobacterium tuberculosis
RRVYQLDPTGLAA

SEQ ID NO: 85437 - protein, 13 aa, Mycobacterium tuberculosis
RVYQLDPTGLAAL

SEQ ID NO: 85438 - protein, 13 aa, Mycobacterium tuberculosis
VYQLDPTGLAALR

SEQ ID NO: 85439 - protein, 13 aa, Mycobacterium tuberculosis
YQLDPTGLAALRT

SEQ ID NO: 85440 - protein, 13 aa, Mycobacterium tuberculosis
QLDPTGLAALRTD

SEQ ID NO: 85441 - protein, 13 aa, Mycobacterium tuberculosis
LDPTGLAALRTDL

SEQ ID NO: 85442 - protein, 13 aa, Mycobacterium tuberculosis
DPTGLAALRTDLD

SEQ ID NO: 85443 - protein, 13 aa, Mycobacterium tuberculosis
PTGLAALRTDLDR

SEQ ID NO: 85444 - protein, 13 aa, Mycobacterium tuberculosis
TGLAALRTDLDRF

SEQ ID NO: 85445 - protein, 13 aa, Mycobacterium tuberculosis
GLAALRTDLDRFW

SEQ ID NO: 85446 - protein, 13 aa, Mycobacterium tuberculosis
LAALRTDLDRFWT

SEQ ID NO: 85447 - protein, 13 aa, Mycobacterium tuberculosis
AALRTDLDRFWTR

SEQ ID NO: 85448 - protein, 13 aa, Mycobacterium tuberculosis
ALRTDLDRFWTRA

SEQ ID NO: 85449 - protein, 13 aa, Mycobacterium tuberculosis
LRTDLDRFWTRAL

SEQ ID NO: 85450 - protein, 13 aa, Mycobacterium tuberculosis
RTDLDRFWTRALT

SEQ ID NO: 85451 - protein, 13 aa, Mycobacterium tuberculosis
TDLDRFWTRALTG

SEQ ID NO: 85452 - protein, 13 aa, Mycobacterium tuberculosis
DLDRFWTRALTGY

SEQ ID NO: 85453 - protein, 13 aa, Mycobacterium tuberculosis
LDRFWTRALTGYA

SEQ ID NO: 85454 - protein, 13 aa, Mycobacterium tuberculosis
DRFWTRALTGYAQ

SEQ ID NO: 85455 - protein, 13 aa, Mycobacterium tuberculosis
RFWTRALTGYAQL

SEQ ID NO: 85456 - protein, 13 aa, Mycobacterium tuberculosis
FWTRALTGYAQLI

SEQ ID NO: 85457 - protein, 13 aa, Mycobacterium tuberculosis
WTRALTGYAQLID

SEQ ID NO: 85458 - protein, 13 aa, Mycobacterium tuberculosis
TRALTGYAQLIDS

SEQ ID NO: 85459 - protein, 13 aa, Mycobacterium tuberculosis
RALTGYAQLIDSE

SEQ ID NO: 85460 - protein, 13 aa, Mycobacterium tuberculosis
ALTGYAQLIDSEG

SEQ ID NO: 85461 - protein, 13 aa, Mycobacterium tuberculosis
LTGYAQLIDSEGD

SEQ ID NO: 85462 - protein, 13 aa, Mycobacterium tuberculosis
TGYAQLIDSEGDD

SEQ ID NO: 85463 - protein, 13 aa, Mycobacterium tuberculosis
GYAQLIDSEGDDT

SEQ ID NO: 85464 - protein, 14 aa, Mycobacterium tuberculosis
MSTYRSPDRAWQAL

SEQ ID NO: 85465 - protein, 14 aa, Mycobacterium tuberculosis
STYRSPDRAWQALA

SEQ ID NO: 85466 - protein, 14 aa, Mycobacterium tuberculosis
TYRSPDRAWQALAD

SEQ ID NO: 85467 - protein, 14 aa, Mycobacterium tuberculosis
YRSPDRAWQALADG

SEQ ID NO: 85468 - protein, 14 aa, Mycobacterium tuberculosis
RSPDRAWQALADGT

SEQ ID NO: 85469 - protein, 14 aa, Mycobacterium tuberculosis
SPDRAWQALADGTR

SEQ ID NO: 85470 - protein, 14 aa, Mycobacterium tuberculosis
PDRAWQALADGTRR

SEQ ID NO: 85471 - protein, 14 aa, Mycobacterium tuberculosis
DRAWQALADGTRRA

SEQ ID NO: 85472 - protein, 14 aa, Mycobacterium tuberculosis
RAWQALADGTRRAI

SEQ ID NO: 85473 - protein, 14 aa, Mycobacterium tuberculosis
AWQALADGTRRAIV

SEQ ID NO: 85474 - protein, 14 aa, Mycobacterium tuberculosis
WQALADGTRRAIVE

SEQ ID NO: 85475 - protein, 14 aa, Mycobacterium tuberculosis
QALADGTRRAIVER

SEQ ID NO: 85476 - protein, 14 aa, Mycobacterium tuberculosis
ALADGTRRAIVERL

SEQ ID NO: 85477 - protein, 14 aa, Mycobacterium tuberculosis
LADGTRRAIVERLA

SEQ ID NO: 85478 - protein, 14 aa, Mycobacterium tuberculosis
ADGTRRAIVERLAH

SEQ ID NO: 85479 - protein, 14 aa, Mycobacterium tuberculosis
DGTRRAIVERLAHG

SEQ ID NO: 85480 - protein, 14 aa, Mycobacterium tuberculosis
GTRRAIVERLAHGP

SEQ ID NO: 85481 - protein, 14 aa, Mycobacterium tuberculosis
TRRAIVERLAHGPL

SEQ ID NO: 85482 - protein, 14 aa, Mycobacterium tuberculosis
RRAIVERLAHGPLA

SEQ ID NO: 85483 - protein, 14 aa, Mycobacterium tuberculosis
RAIVERLAHGPLAV

SEQ ID NO: 85484 - protein, 14 aa, Mycobacterium tuberculosis
AIVERLAHGPLAVG

SEQ ID NO: 85485 - protein, 14 aa, Mycobacterium tuberculosis
IVERLAHGPLAVGE

SEQ ID NO: 85486 - protein, 14 aa, Mycobacterium tuberculosis
VERLAHGPLAVGEL

SEQ ID NO: 85487 - protein, 14 aa, Mycobacterium tuberculosis
ERLAHGPLAVGELA

SEQ ID NO: 85488 - protein, 14 aa, Mycobacterium tuberculosis
RLAHGPLAVGELAR

SEQ ID NO: 85489 - protein, 14 aa, Mycobacterium tuberculosis
LAHGPLAVGELARD

SEQ ID NO: 85490 - protein, 14 aa, Mycobacterium tuberculosis
AHGPLAVGELARDL

SEQ ID NO: 85491 - protein, 14 aa, Mycobacterium tuberculosis
HGPLAVGELARDLP

SEQ ID NO: 85492 - protein, 14 aa, Mycobacterium tuberculosis
GPLAVGELARDLPV

SEQ ID NO: 85493 - protein, 14 aa, Mycobacterium tuberculosis
PLAVGELARDLPVS

SEQ ID NO: 85494 - protein, 14 aa, Mycobacterium tuberculosis
LAVGELARDLPVSR

SEQ ID NO: 85495 - protein, 14 aa, Mycobacterium tuberculosis
AVGELARDLPVSRP

SEQ ID NO: 85496 - protein, 14 aa, Mycobacterium tuberculosis
VGELARDLPVSRPA

SEQ ID NO: 85497 - protein, 14 aa, Mycobacterium tuberculosis
GELARDLPVSRPAV

SEQ ID NO: 85498 - protein, 14 aa, Mycobacterium tuberculosis
ELARDLPVSRPAVS

SEQ ID NO: 85499 - protein, 14 aa, Mycobacterium tuberculosis
LARDLPVSRPAVSQ

SEQ ID NO: 85500 - protein, 14 aa, Mycobacterium tuberculosis
ARDLPVSRPAVSQH

SEQ ID NO: 85501 - protein, 14 aa, Mycobacterium tuberculosis
RDLPVSRPAVSQHL

SEQ ID NO: 85502 - protein, 14 aa, Mycobacterium tuberculosis
DLPVSRPAVSQHLK

SEQ ID NO: 85503 - protein, 14 aa, Mycobacterium tuberculosis
LPVSRPAVSQHLKV

SEQ ID NO: 85504 - protein, 14 aa, Mycobacterium tuberculosis
PVSRPAVSQHLKVL

SEQ ID NO: 85505 - protein, 14 aa, Mycobacterium tuberculosis
VSRPAVSQHLKVLK

SEQ ID NO: 85506 - protein, 14 aa, Mycobacterium tuberculosis
SRPAVSQHLKVLKT

SEQ ID NO: 85507 - protein, 14 aa, Mycobacterium tuberculosis
RPAVSQHLKVLKTA

SEQ ID NO: 85508 - protein, 14 aa, Mycobacterium tuberculosis
PAVSQHLKVLKTAR

SEQ ID NO: 85509 - protein, 14 aa, Mycobacterium tuberculosis
AVSQHLKVLKTARL

SEQ ID NO: 85510 - protein, 14 aa, Mycobacterium tuberculosis
VSQHLKVLKTARLV

SEQ ID NO: 85511 - protein, 14 aa, Mycobacterium tuberculosis
SQHLKVLKTARLVC

SEQ ID NO: 85512 - protein, 14 aa, Mycobacterium tuberculosis
QHLKVLKTARLVCD

SEQ ID NO: 85513 - protein, 14 aa, Mycobacterium tuberculosis
HLKVLKTARLVCDR

SEQ ID NO: 85514 - protein, 14 aa, Mycobacterium tuberculosis
LKVLKTARLVCDRP

SEQ ID NO: 85515 - protein, 14 aa, Mycobacterium tuberculosis
KVLKTARLVCDRPA

SEQ ID NO: 85516 - protein, 14 aa, Mycobacterium tuberculosis
VLKTARLVCDRPAG

SEQ ID NO: 85517 - protein, 14 aa, Mycobacterium tuberculosis
LKTARLVCDRPAGT

SEQ ID NO: 85518 - protein, 14 aa, Mycobacterium tuberculosis
KTARLVCDRPAGTR

SEQ ID NO: 85519 - protein, 14 aa, Mycobacterium tuberculosis
TARLVCDRPAGTRR

SEQ ID NO: 85520 - protein, 14 aa, Mycobacterium tuberculosis
ARLVCDRPAGTRRV

SEQ ID NO: 85521 - protein, 14 aa, Mycobacterium tuberculosis
RLVCDRPAGTRRVY

SEQ ID NO: 85522 - protein, 14 aa, Mycobacterium tuberculosis
LVCDRPAGTRRVYQ

SEQ ID NO: 85523 - protein, 14 aa, Mycobacterium tuberculosis
VCDRPAGTRRVYQL

SEQ ID NO: 85524 - protein, 14 aa, Mycobacterium tuberculosis
CDRPAGTRRVYQLD

SEQ ID NO: 85525 - protein, 14 aa, Mycobacterium tuberculosis
DRPAGTRRVYQLDP

SEQ ID NO: 85526 - protein, 14 aa, Mycobacterium tuberculosis
RPAGTRRVYQLDPT

SEQ ID NO: 85527 - protein, 14 aa, Mycobacterium tuberculosis
PAGTRRVYQLDPTG

SEQ ID NO: 85528 - protein, 14 aa, Mycobacterium tuberculosis
AGTRRVYQLDPTGL

SEQ ID NO: 85529 - protein, 14 aa, Mycobacterium tuberculosis
GTRRVYQLDPTGLA

SEQ ID NO: 85530 - protein, 14 aa, Mycobacterium tuberculosis
TRRVYQLDPTGLAA

SEQ ID NO: 85531 - protein, 14 aa, Mycobacterium tuberculosis
RRVYQLDPTGLAAL

SEQ ID NO: 85532 - protein, 14 aa, Mycobacterium tuberculosis
RVYQLDPTGLAALR

SEQ ID NO: 85533 - protein, 14 aa, Mycobacterium tuberculosis
VYQLDPTGLAALRT

SEQ ID NO: 85534 - protein, 14 aa, Mycobacterium tuberculosis
YQLDPTGLAALRTD

SEQ ID NO: 85535 - protein, 14 aa, Mycobacterium tuberculosis
QLDPTGLAALRTDL

SEQ ID NO: 85536 - protein, 14 aa, Mycobacterium tuberculosis
LDPTGLAALRTDLD

SEQ ID NO: 85537 - protein, 14 aa, Mycobacterium tuberculosis
DPTGLAALRTDLDR

SEQ ID NO: 85538 - protein, 14 aa, Mycobacterium tuberculosis
PTGLAALRTDLDRF

SEQ ID NO: 85539 - protein, 14 aa, Mycobacterium tuberculosis
TGLAALRTDLDRFW

SEQ ID NO: 85540 - protein, 14 aa, Mycobacterium tuberculosis
GLAALRTDLDRFWT

SEQ ID NO: 85541 - protein, 14 aa, Mycobacterium tuberculosis
LAALRTDLDRFWTR

SEQ ID NO: 85542 - protein, 14 aa, Mycobacterium tuberculosis
AALRTDLDRFWTRA

SEQ ID NO: 85543 - protein, 14 aa, Mycobacterium tuberculosis
ALRTDLDRFWTRAL

SEQ ID NO: 85544 - protein, 14 aa, Mycobacterium tuberculosis
LRTDLDRFWTRALT

SEQ ID NO: 85545 - protein, 14 aa, Mycobacterium tuberculosis
RTDLDRFWTRALTG

SEQ ID NO: 85546 - protein, 14 aa, Mycobacterium tuberculosis
TDLDRFWTRALTGY

SEQ ID NO: 85547 - protein, 14 aa, Mycobacterium tuberculosis
DLDRFWTRALTGYA

SEQ ID NO: 85548 - protein, 14 aa, Mycobacterium tuberculosis
LDRFWTRALTGYAQ

SEQ ID NO: 85549 - protein, 14 aa, Mycobacterium tuberculosis
DRFWTRALTGYAQL

SEQ ID NO: 85550 - protein, 14 aa, Mycobacterium tuberculosis
RFWTRALTGYAQLI

SEQ ID NO: 85551 - protein, 14 aa, Mycobacterium tuberculosis
FWTRALTGYAQLID

SEQ ID NO: 85552 - protein, 14 aa, Mycobacterium tuberculosis
WTRALTGYAQLIDS

SEQ ID NO: 85553 - protein, 14 aa, Mycobacterium tuberculosis
TRALTGYAQLIDSE

SEQ ID NO: 85554 - protein, 14 aa, Mycobacterium tuberculosis
RALTGYAQLIDSEG

SEQ ID NO: 85555 - protein, 14 aa, Mycobacterium tuberculosis
ALTGYAQLIDSEGD

SEQ ID NO: 85556 - protein, 14 aa, Mycobacterium tuberculosis
LTGYAQLIDSEGDD

SEQ ID NO: 85557 - protein, 14 aa, Mycobacterium tuberculosis
TGYAQLIDSEGDDT

SEQ ID NO: 85558 - protein, 15 aa, Mycobacterium tuberculosis
MSTYRSPDRAWQALA

SEQ ID NO: 85559 - protein, 15 aa, Mycobacterium tuberculosis
STYRSPDRAWQALAD

SEQ ID NO: 85560 - protein, 15 aa, Mycobacterium tuberculosis
TYRSPDRAWQALADG

SEQ ID NO: 85561 - protein, 15 aa, Mycobacterium tuberculosis
YRSPDRAWQALADGT

SEQ ID NO: 85562 - protein, 15 aa, Mycobacterium tuberculosis
RSPDRAWQALADGTR

SEQ ID NO: 85563 - protein, 15 aa, Mycobacterium tuberculosis
SPDRAWQALADGTRR

SEQ ID NO: 85564 - protein, 15 aa, Mycobacterium tuberculosis
PDRAWQALADGTRRA

SEQ ID NO: 85565 - protein, 15 aa, Mycobacterium tuberculosis
DRAWQALADGTRRAI

SEQ ID NO: 85566 - protein, 15 aa, Mycobacterium tuberculosis
RAWQALADGTRRAIV

SEQ ID NO: 85567 - protein, 15 aa, Mycobacterium tuberculosis
AWQALADGTRRAIVE

SEQ ID NO: 85568 - protein, 15 aa, Mycobacterium tuberculosis
WQALADGTRRAIVER

SEQ ID NO: 85569 - protein, 15 aa, Mycobacterium tuberculosis
QALADGTRRAIVERL

SEQ ID NO: 85570 - protein, 15 aa, Mycobacterium tuberculosis
ALADGTRRAIVERLA

SEQ ID NO: 85571 - protein, 15 aa, Mycobacterium tuberculosis
LADGTRRAIVERLAH

SEQ ID NO: 85572 - protein, 15 aa, Mycobacterium tuberculosis
ADGTRRAIVERLAHG

SEQ ID NO: 85573 - protein, 15 aa, Mycobacterium tuberculosis
DGTRRAIVERLAHGP

SEQ ID NO: 85574 - protein, 15 aa, Mycobacterium tuberculosis
GTRRAIVERLAHGPL

SEQ ID NO: 85575 - protein, 15 aa, Mycobacterium tuberculosis
TRRAIVERLAHGPLA

SEQ ID NO: 85576 - protein, 15 aa, Mycobacterium tuberculosis
RRAIVERLAHGPLAV

SEQ ID NO: 85577 - protein, 15 aa, Mycobacterium tuberculosis
RAIVERLAHGPLAVG

SEQ ID NO: 85578 - protein, 15 aa, Mycobacterium tuberculosis
AIVERLAHGPLAVGE

SEQ ID NO: 85579 - protein, 15 aa, Mycobacterium tuberculosis
IVERLAHGPLAVGEL

SEQ ID NO: 85580 - protein, 15 aa, Mycobacterium tuberculosis
VERLAHGPLAVGELA

SEQ ID NO: 85581 - protein, 15 aa, Mycobacterium tuberculosis
ERLAHGPLAVGELAR

SEQ ID NO: 85582 - protein, 15 aa, Mycobacterium tuberculosis
RLAHGPLAVGELARD

SEQ ID NO: 85583 - protein, 15 aa, Mycobacterium tuberculosis
LAHGPLAVGELARDL

SEQ ID NO: 85584 - protein, 15 aa, Mycobacterium tuberculosis
AHGPLAVGELARDLP

SEQ ID NO: 85585 - protein, 15 aa, Mycobacterium tuberculosis
HGPLAVGELARDLPV

SEQ ID NO: 85586 - protein, 15 aa, Mycobacterium tuberculosis
GPLAVGELARDLPVS

SEQ ID NO: 85587 - protein, 15 aa, Mycobacterium tuberculosis
PLAVGELARDLPVSR

SEQ ID NO: 85588 - protein, 15 aa, Mycobacterium tuberculosis
LAVGELARDLPVSRP

SEQ ID NO: 85589 - protein, 15 aa, Mycobacterium tuberculosis
AVGELARDLPVSRPA

SEQ ID NO: 85590 - protein, 15 aa, Mycobacterium tuberculosis
VGELARDLPVSRPAV

SEQ ID NO: 85591 - protein, 15 aa, Mycobacterium tuberculosis
GELARDLPVSRPAVS

SEQ ID NO: 85592 - protein, 15 aa, Mycobacterium tuberculosis
ELARDLPVSRPAVSQ

SEQ ID NO: 85593 - protein, 15 aa, Mycobacterium tuberculosis
LARDLPVSRPAVSQH

SEQ ID NO: 85594 - protein, 15 aa, Mycobacterium tuberculosis
ARDLPVSRPAVSQHL

SEQ ID NO: 85595 - protein, 15 aa, Mycobacterium tuberculosis
RDLPVSRPAVSQHLK

SEQ ID NO: 85596 - protein, 15 aa, Mycobacterium tuberculosis
DLPVSRPAVSQHLKV

SEQ ID NO: 85597 - protein, 15 aa, Mycobacterium tuberculosis
LPVSRPAVSQHLKVL

SEQ ID NO: 85598 - protein, 15 aa, Mycobacterium tuberculosis
PVSRPAVSQHLKVLK

SEQ ID NO: 85599 - protein, 15 aa, Mycobacterium tuberculosis
VSRPAVSQHLKVLKT

SEQ ID NO: 85600 - protein, 15 aa, Mycobacterium tuberculosis
SRPAVSQHLKVLKTA

SEQ ID NO: 85601 - protein, 15 aa, Mycobacterium tuberculosis
RPAVSQHLKVLKTAR

SEQ ID NO: 85602 - protein, 15 aa, Mycobacterium tuberculosis
PAVSQHLKVLKTARL

SEQ ID NO: 85603 - protein, 15 aa, Mycobacterium tuberculosis
AVSQHLKVLKTARLV

SEQ ID NO: 85604 - protein, 15 aa, Mycobacterium tuberculosis
VSQHLKVLKTARLVC

SEQ ID NO: 85605 - protein, 15 aa, Mycobacterium tuberculosis
SQHLKVLKTARLVCD

SEQ ID NO: 85606 - protein, 15 aa, Mycobacterium tuberculosis
QHLKVLKTARLVCDR

SEQ ID NO: 85607 - protein, 15 aa, Mycobacterium tuberculosis
HLKVLKTARLVCDRP

SEQ ID NO: 85608 - protein, 15 aa, Mycobacterium tuberculosis
LKVLKTARLVCDRPA

SEQ ID NO: 85609 - protein, 15 aa, Mycobacterium tuberculosis
KVLKTARLVCDRPAG

SEQ ID NO: 85610 - protein, 15 aa, Mycobacterium tuberculosis
VLKTARLVCDRPAGT

SEQ ID NO: 85611 - protein, 15 aa, Mycobacterium tuberculosis
LKTARLVCDRPAGTR

SEQ ID NO: 85612 - protein, 15 aa, Mycobacterium tuberculosis
KTARLVCDRPAGTRR

SEQ ID NO: 85613 - protein, 15 aa, Mycobacterium tuberculosis
TARLVCDRPAGTRRV

SEQ ID NO: 85614 - protein, 15 aa, Mycobacterium tuberculosis
ARLVCDRPAGTRRVY

SEQ ID NO: 85615 - protein, 15 aa, Mycobacterium tuberculosis
RLVCDRPAGTRRVYQ

SEQ ID NO: 85616 - protein, 15 aa, Mycobacterium tuberculosis
LVCDRPAGTRRVYQL

SEQ ID NO: 85617 - protein, 15 aa, Mycobacterium tuberculosis
VCDRPAGTRRVYQLD

SEQ ID NO: 85618 - protein, 15 aa, Mycobacterium tuberculosis
CDRPAGTRRVYQLDP

SEQ ID NO: 85619 - protein, 15 aa, Mycobacterium tuberculosis
DRPAGTRRVYQLDPT

SEQ ID NO: 85620 - protein, 15 aa, Mycobacterium tuberculosis
RPAGTRRVYQLDPTG

SEQ ID NO: 85621 - protein, 15 aa, Mycobacterium tuberculosis
PAGTRRVYQLDPTGL

SEQ ID NO: 85622 - protein, 15 aa, Mycobacterium tuberculosis
AGTRRVYQLDPTGLA

SEQ ID NO: 85623 - protein, 15 aa, Mycobacterium tuberculosis
GTRRVYQLDPTGLAA

SEQ ID NO: 85624 - protein, 15 aa, Mycobacterium tuberculosis
TRRVYQLDPTGLAAL

SEQ ID NO: 85625 - protein, 15 aa, Mycobacterium tuberculosis
RRVYQLDPTGLAALR

SEQ ID NO: 85626 - protein, 15 aa, Mycobacterium tuberculosis
RVYQLDPTGLAALRT

SEQ ID NO: 85627 - protein, 15 aa, Mycobacterium tuberculosis
VYQLDPTGLAALRTD

SEQ ID NO: 85628 - protein, 15 aa, Mycobacterium tuberculosis
YQLDPTGLAALRTDL

SEQ ID NO: 85629 - protein, 15 aa, Mycobacterium tuberculosis
QLDPTGLAALRTDLD

SEQ ID NO: 85630 - protein, 15 aa, Mycobacterium tuberculosis
LDPTGLAALRTDLDR

SEQ ID NO: 85631 - protein, 15 aa, Mycobacterium tuberculosis
DPTGLAALRTDLDRF

SEQ ID NO: 85632 - protein, 15 aa, Mycobacterium tuberculosis
PTGLAALRTDLDRFW

SEQ ID NO: 85633 - protein, 15 aa, Mycobacterium tuberculosis
TGLAALRTDLDRFWT

SEQ ID NO: 85634 - protein, 15 aa, Mycobacterium tuberculosis
GLAALRTDLDRFWTR

SEQ ID NO: 85635 - protein, 15 aa, Mycobacterium tuberculosis
LAALRTDLDRFWTRA

SEQ ID NO: 85636 - protein, 15 aa, Mycobacterium tuberculosis
AALRTDLDRFWTRAL

SEQ ID NO: 85637 - protein, 15 aa, Mycobacterium tuberculosis
ALRTDLDRFWTRALT

SEQ ID NO: 85638 - protein, 15 aa, Mycobacterium tuberculosis
LRTDLDRFWTRALTG

SEQ ID NO: 85639 - protein, 15 aa, Mycobacterium tuberculosis
RTDLDRFWTRALTGY

SEQ ID NO: 85640 - protein, 15 aa, Mycobacterium tuberculosis
TDLDRFWTRALTGYA

SEQ ID NO: 85641 - protein, 15 aa, Mycobacterium tuberculosis
DLDRFWTRALTGYAQ

SEQ ID NO: 85642 - protein, 15 aa, Mycobacterium tuberculosis
LDRFWTRALTGYAQL

SEQ ID NO: 85643 - protein, 15 aa, Mycobacterium tuberculosis
DRFWTRALTGYAQLI

SEQ ID NO: 85644 - protein, 15 aa, Mycobacterium tuberculosis
RFWTRALTGYAQLID

SEQ ID NO: 85645 - protein, 15 aa, Mycobacterium tuberculosis
FWTRALTGYAQLIDS

SEQ ID NO: 85646 - protein, 15 aa, Mycobacterium tuberculosis
WTRALTGYAQLIDSE

SEQ ID NO: 85647 - protein, 15 aa, Mycobacterium tuberculosis
TRALTGYAQLIDSEG

SEQ ID NO: 85648 - protein, 15 aa, Mycobacterium tuberculosis
RALTGYAQLIDSEGD

SEQ ID NO: 85649 - protein, 15 aa, Mycobacterium tuberculosis
ALTGYAQLIDSEGDD

SEQ ID NO: 85650 - protein, 15 aa, Mycobacterium tuberculosis
LTGYAQLIDSEGDDT

SEQ ID NO: 85651 - protein, 16 aa, Mycobacterium tuberculosis
MSTYRSPDRAWQALAD

SEQ ID NO: 85652 - protein, 16 aa, Mycobacterium tuberculosis
STYRSPDRAWQALADG

SEQ ID NO: 85653 - protein, 16 aa, Mycobacterium tuberculosis
TYRSPDRAWQALADGT

SEQ ID NO: 85654 - protein, 16 aa, Mycobacterium tuberculosis
YRSPDRAWQALADGTR

SEQ ID NO: 85655 - protein, 16 aa, Mycobacterium tuberculosis
RSPDRAWQALADGTRR

SEQ ID NO: 85656 - protein, 16 aa, Mycobacterium tuberculosis
SPDRAWQALADGTRRA

SEQ ID NO: 85657 - protein, 16 aa, Mycobacterium tuberculosis
PDRAWQALADGTRRAI

SEQ ID NO: 85658 - protein, 16 aa, Mycobacterium tuberculosis
DRAWQALADGTRRAIV

SEQ ID NO: 85659 - protein, 16 aa, Mycobacterium tuberculosis
RAWQALADGTRRAIVE

SEQ ID NO: 85660 - protein, 16 aa, Mycobacterium tuberculosis
AWQALADGTRRAIVER

SEQ ID NO: 85661 - protein, 16 aa, Mycobacterium tuberculosis
WQALADGTRRAIVERL

SEQ ID NO: 85662 - protein, 16 aa, Mycobacterium tuberculosis
QALADGTRRAIVERLA

SEQ ID NO: 85663 - protein, 16 aa, Mycobacterium tuberculosis
ALADGTRRAIVERLAH

SEQ ID NO: 85664 - protein, 16 aa, Mycobacterium tuberculosis
LADGTRRAIVERLAHG

SEQ ID NO: 85665 - protein, 16 aa, Mycobacterium tuberculosis
ADGTRRAIVERLAHGP

SEQ ID NO: 85666 - protein, 16 aa, Mycobacterium tuberculosis
DGTRRAIVERLAHGPL

SEQ ID NO: 85667 - protein, 16 aa, Mycobacterium tuberculosis
GTRRAIVERLAHGPLA

SEQ ID NO: 85668 - protein, 16 aa, Mycobacterium tuberculosis
TRRAIVERLAHGPLAV

SEQ ID NO: 85669 - protein, 16 aa, Mycobacterium tuberculosis
RRAIVERLAHGPLAVG

SEQ ID NO: 85670 - protein, 16 aa, Mycobacterium tuberculosis
RAIVERLAHGPLAVGE

SEQ ID NO: 85671 - protein, 16 aa, Mycobacterium tuberculosis
AIVERLAHGPLAVGEL

SEQ ID NO: 85672 - protein, 16 aa, Mycobacterium tuberculosis
IVERLAHGPLAVGELA

SEQ ID NO: 85673 - protein, 16 aa, Mycobacterium tuberculosis
VERLAHGPLAVGELAR

SEQ ID NO: 85674 - protein, 16 aa, Mycobacterium tuberculosis
ERLAHGPLAVGELARD

SEQ ID NO: 85675 - protein, 16 aa, Mycobacterium tuberculosis
RLAHGPLAVGELARDL

SEQ ID NO: 85676 - protein, 16 aa, Mycobacterium tuberculosis
LAHGPLAVGELARDLP

SEQ ID NO: 85677 - protein, 16 aa, Mycobacterium tuberculosis
AHGPLAVGELARDLPV

SEQ ID NO: 85678 - protein, 16 aa, Mycobacterium tuberculosis
HGPLAVGELARDLPVS

SEQ ID NO: 85679 - protein, 16 aa, Mycobacterium tuberculosis
GPLAVGELARDLPVSR

SEQ ID NO: 85680 - protein, 16 aa, Mycobacterium tuberculosis
PLAVGELARDLPVSRP

SEQ ID NO: 85681 - protein, 16 aa, Mycobacterium tuberculosis
LAVGELARDLPVSRPA

SEQ ID NO: 85682 - protein, 16 aa, Mycobacterium tuberculosis
AVGELARDLPVSRPAV

SEQ ID NO: 85683 - protein, 16 aa, Mycobacterium tuberculosis
VGELARDLPVSRPAVS

SEQ ID NO: 85684 - protein, 16 aa, Mycobacterium tuberculosis
GELARDLPVSRPAVSQ

SEQ ID NO: 85685 - protein, 16 aa, Mycobacterium tuberculosis
ELARDLPVSRPAVSQH

SEQ ID NO: 85686 - protein, 16 aa, Mycobacterium tuberculosis
LARDLPVSRPAVSQHL

SEQ ID NO: 85687 - protein, 16 aa, Mycobacterium tuberculosis
ARDLPVSRPAVSQHLK

SEQ ID NO: 85688 - protein, 16 aa, Mycobacterium tuberculosis
RDLPVSRPAVSQHLKV

SEQ ID NO: 85689 - protein, 16 aa, Mycobacterium tuberculosis
DLPVSRPAVSQHLKVL

SEQ ID NO: 85690 - protein, 16 aa, Mycobacterium tuberculosis
LPVSRPAVSQHLKVLK

SEQ ID NO: 85691 - protein, 16 aa, Mycobacterium tuberculosis
PVSRPAVSQHLKVLKT

SEQ ID NO: 85692 - protein, 16 aa, Mycobacterium tuberculosis
VSRPAVSQHLKVLKTA

SEQ ID NO: 85693 - protein, 16 aa, Mycobacterium tuberculosis
SRPAVSQHLKVLKTAR

SEQ ID NO: 85694 - protein, 16 aa, Mycobacterium tuberculosis
RPAVSQHLKVLKTARL

SEQ ID NO: 85695 - protein, 16 aa, Mycobacterium tuberculosis
PAVSQHLKVLKTARLV

SEQ ID NO: 85696 - protein, 16 aa, Mycobacterium tuberculosis
AVSQHLKVLKTARLVC

SEQ ID NO: 85697 - protein, 16 aa, Mycobacterium tuberculosis
VSQHLKVLKTARLVCD

SEQ ID NO: 85698 - protein, 16 aa, Mycobacterium tuberculosis
SQHLKVLKTARLVCDR

SEQ ID NO: 85699 - protein, 16 aa, Mycobacterium tuberculosis
QHLKVLKTARLVCDRP

SEQ ID NO: 85700 - protein, 16 aa, Mycobacterium tuberculosis
HLKVLKTARLVCDRPA

SEQ ID NO: 85701 - protein, 16 aa, Mycobacterium tuberculosis
LKVLKTARLVCDRPAG

SEQ ID NO: 85702 - protein, 16 aa, Mycobacterium tuberculosis
KVLKTARLVCDRPAGT

SEQ ID NO: 85703 - protein, 16 aa, Mycobacterium tuberculosis
VLKTARLVCDRPAGTR

SEQ ID NO: 85704 - protein, 16 aa, Mycobacterium tuberculosis
LKTARLVCDRPAGTRR

SEQ ID NO: 85705 - protein, 16 aa, Mycobacterium tuberculosis
KTARLVCDRPAGTRRV

SEQ ID NO: 85706 - protein, 16 aa, Mycobacterium tuberculosis
TARLVCDRPAGTRRVY

SEQ ID NO: 85707 - protein, 16 aa, Mycobacterium tuberculosis
ARLVCDRPAGTRRVYQ

SEQ ID NO: 85708 - protein, 16 aa, Mycobacterium tuberculosis
RLVCDRPAGTRRVYQL

SEQ ID NO: 85709 - protein, 16 aa, Mycobacterium tuberculosis
LVCDRPAGTRRVYQLD

SEQ ID NO: 85710 - protein, 16 aa, Mycobacterium tuberculosis
VCDRPAGTRRVYQLDP

SEQ ID NO: 85711 - protein, 16 aa, Mycobacterium tuberculosis
CDRPAGTRRVYQLDPT

SEQ ID NO: 85712 - protein, 16 aa, Mycobacterium tuberculosis
DRPAGTRRVYQLDPTG

SEQ ID NO: 85713 - protein, 16 aa, Mycobacterium tuberculosis
RPAGTRRVYQLDPTGL

SEQ ID NO: 85714 - protein, 16 aa, Mycobacterium tuberculosis
PAGTRRVYQLDPTGLA

SEQ ID NO: 85715 - protein, 16 aa, Mycobacterium tuberculosis
AGTRRVYQLDPTGLAA

SEQ ID NO: 85716 - protein, 16 aa, Mycobacterium tuberculosis
GTRRVYQLDPTGLAAL

SEQ ID NO: 85717 - protein, 16 aa, Mycobacterium tuberculosis
TRRVYQLDPTGLAALR

SEQ ID NO: 85718 - protein, 16 aa, Mycobacterium tuberculosis
RRVYQLDPTGLAALRT

SEQ ID NO: 85719 - protein, 16 aa, Mycobacterium tuberculosis
RVYQLDPTGLAALRTD

SEQ ID NO: 85720 - protein, 16 aa, Mycobacterium tuberculosis
VYQLDPTGLAALRTDL

SEQ ID NO: 85721 - protein, 16 aa, Mycobacterium tuberculosis
YQLDPTGLAALRTDLD

SEQ ID NO: 85722 - protein, 16 aa, Mycobacterium tuberculosis
QLDPTGLAALRTDLDR

SEQ ID NO: 85723 - protein, 16 aa, Mycobacterium tuberculosis
LDPTGLAALRTDLDRF

SEQ ID NO: 85724 - protein, 16 aa, Mycobacterium tuberculosis
DPTGLAALRTDLDRFW

SEQ ID NO: 85725 - protein, 16 aa, Mycobacterium tuberculosis
PTGLAALRTDLDRFWT

SEQ ID NO: 85726 - protein, 16 aa, Mycobacterium tuberculosis
TGLAALRTDLDRFWTR

SEQ ID NO: 85727 - protein, 16 aa, Mycobacterium tuberculosis
GLAALRTDLDRFWTRA

SEQ ID NO: 85728 - protein, 16 aa, Mycobacterium tuberculosis
LAALRTDLDRFWTRAL

SEQ ID NO: 85729 - protein, 16 aa, Mycobacterium tuberculosis
AALRTDLDRFWTRALT

SEQ ID NO: 85730 - protein, 16 aa, Mycobacterium tuberculosis
ALRTDLDRFWTRALTG

SEQ ID NO: 85731 - protein, 16 aa, Mycobacterium tuberculosis
LRTDLDRFWTRALTGY

SEQ ID NO: 85732 - protein, 16 aa, Mycobacterium tuberculosis
RTDLDRFWTRALTGYA

SEQ ID NO: 85733 - protein, 16 aa, Mycobacterium tuberculosis
TDLDRFWTRALTGYAQ

SEQ ID NO: 85734 - protein, 16 aa, Mycobacterium tuberculosis
DLDRFWTRALTGYAQL

SEQ ID NO: 85735 - protein, 16 aa, Mycobacterium tuberculosis
LDRFWTRALTGYAQLI

SEQ ID NO: 85736 - protein, 16 aa, Mycobacterium tuberculosis
DRFWTRALTGYAQLID

SEQ ID NO: 85737 - protein, 16 aa, Mycobacterium tuberculosis
RFWTRALTGYAQLIDS

SEQ ID NO: 85738 - protein, 16 aa, Mycobacterium tuberculosis
FWTRALTGYAQLIDSE

SEQ ID NO: 85739 - protein, 16 aa, Mycobacterium tuberculosis
WTRALTGYAQLIDSEG

SEQ ID NO: 85740 - protein, 16 aa, Mycobacterium tuberculosis
TRALTGYAQLIDSEGD

SEQ ID NO: 85741 - protein, 16 aa, Mycobacterium tuberculosis
RALTGYAQLIDSEGDD

SEQ ID NO: 85742 - protein, 16 aa, Mycobacterium tuberculosis
ALTGYAQLIDSEGDDT

SEQ ID NO: 85743 - protein, 13 aa, Mycobacterium tuberculosis
MADRVLRGSRLGA

SEQ ID NO: 85744 - protein, 13 aa, Mycobacterium tuberculosis
ADRVLRGSRLGAV

SEQ ID NO: 85745 - protein, 13 aa, Mycobacterium tuberculosis
DRVLRGSRLGAVS

SEQ ID NO: 85746 - protein, 13 aa, Mycobacterium tuberculosis
RVLRGSRLGAVSY

SEQ ID NO: 85747 - protein, 13 aa, Mycobacterium tuberculosis
VLRGSRLGAVSYE

SEQ ID NO: 85748 - protein, 13 aa, Mycobacterium tuberculosis
LRGSRLGAVSYET

SEQ ID NO: 85749 - protein, 13 aa, Mycobacterium tuberculosis
RGSRLGAVSYETD

SEQ ID NO: 85750 - protein, 13 aa, Mycobacterium tuberculosis
GSRLGAVSYETDR

SEQ ID NO: 85751 - protein, 13 aa, Mycobacterium tuberculosis
SRLGAVSYETDRN

SEQ ID NO: 85752 - protein, 13 aa, Mycobacterium tuberculosis
RLGAVSYETDRNH

SEQ ID NO: 85753 - protein, 13 aa, Mycobacterium tuberculosis
LGAVSYETDRNHD

SEQ ID NO: 85754 - protein, 13 aa, Mycobacterium tuberculosis
GAVSYETDRNHDL

SEQ ID NO: 85755 - protein, 13 aa, Mycobacterium tuberculosis
AVSYETDRNHDLA

SEQ ID NO: 85756 - protein, 13 aa, Mycobacterium tuberculosis
VSYETDRNHDLAP

SEQ ID NO: 85757 - protein, 13 aa, Mycobacterium tuberculosis
SYETDRNHDLAPR

SEQ ID NO: 85758 - protein, 13 aa, Mycobacterium tuberculosis
YETDRNHDLAPRQ

SEQ ID NO: 85759 - protein, 13 aa, Mycobacterium tuberculosis
ETDRNHDLAPRQI

SEQ ID NO: 85760 - protein, 13 aa, Mycobacterium tuberculosis
TDRNHDLAPRQIA

SEQ ID NO: 85761 - protein, 13 aa, Mycobacterium tuberculosis
DRNHDLAPRQIAR

SEQ ID NO: 85762 - protein, 13 aa, Mycobacterium tuberculosis
RNHDLAPRQIARY

SEQ ID NO: 85763 - protein, 13 aa, Mycobacterium tuberculosis
NHDLAPRQIARYR

SEQ ID NO: 85764 - protein, 13 aa, Mycobacterium tuberculosis
HDLAPRQIARYRT

SEQ ID NO: 85765 - protein, 13 aa, Mycobacterium tuberculosis
DLAPRQIARYRTD

SEQ ID NO: 85766 - protein, 13 aa, Mycobacterium tuberculosis
LAPRQIARYRTDN

SEQ ID NO: 85767 - protein, 13 aa, Mycobacterium tuberculosis
APRQIARYRTDNG

SEQ ID NO: 85768 - protein, 13 aa, Mycobacterium tuberculosis
PRQIARYRTDNGE

SEQ ID NO: 85769 - protein, 13 aa, Mycobacterium tuberculosis
RQIARYRTDNGEE

SEQ ID NO: 85770 - protein, 13 aa, Mycobacterium tuberculosis
QIARYRTDNGEEF

SEQ ID NO: 85771 - protein, 13 aa, Mycobacterium tuberculosis
IARYRTDNGEEFE

SEQ ID NO: 85772 - protein, 13 aa, Mycobacterium tuberculosis
ARYRTDNGEEFEV

SEQ ID NO: 85773 - protein, 13 aa, Mycobacterium tuberculosis
RYRTDNGEEFEVP

SEQ ID NO: 85774 - protein, 13 aa, Mycobacterium tuberculosis
YRTDNGEEFEVPF

SEQ ID NO: 85775 - protein, 13 aa, Mycobacterium tuberculosis
RTDNGEEFEVPFA

SEQ ID NO: 85776 - protein, 13 aa, Mycobacterium tuberculosis
TDNGEEFEVPFAD

SEQ ID NO: 85777 - protein, 13 aa, Mycobacterium tuberculosis
DNGEEFEVPFADD

SEQ ID NO: 85778 - protein, 13 aa, Mycobacterium tuberculosis
NGEEFEVPFADDA

SEQ ID NO: 85779 - protein, 13 aa, Mycobacterium tuberculosis
GEEFEVPFADDAE

SEQ ID NO: 85780 - protein, 13 aa, Mycobacterium tuberculosis
EEFEVPFADDAEI

SEQ ID NO: 85781 - protein, 13 aa, Mycobacterium tuberculosis
EFEVPFADDAEIP

SEQ ID NO: 85782 - protein, 13 aa, Mycobacterium tuberculosis
FEVPFADDAEIPG

SEQ ID NO: 85783 - protein, 13 aa, Mycobacterium tuberculosis
EVPFADDAEIPGT

SEQ ID NO: 85784 - protein, 13 aa, Mycobacterium tuberculosis
VPFADDAEIPGTW

SEQ ID NO: 85785 - protein, 13 aa, Mycobacterium tuberculosis
PFADDAEIPGTWL

SEQ ID NO: 85786 - protein, 13 aa, Mycobacterium tuberculosis
FADDAEIPGTWLC

SEQ ID NO: 85787 - protein, 13 aa, Mycobacterium tuberculosis
ADDAEIPGTWLCR

SEQ ID NO: 85788 - protein, 13 aa, Mycobacterium tuberculosis
DDAEIPGTWLCRN

SEQ ID NO: 85789 - protein, 13 aa, Mycobacterium tuberculosis
DAEIPGTWLCRNG

SEQ ID NO: 85790 - protein, 13 aa, Mycobacterium tuberculosis
AEIPGTWLCRNGM

SEQ ID NO: 85791 - protein, 13 aa, Mycobacterium tuberculosis
EIPGTWLCRNGME

SEQ ID NO: 85792 - protein, 13 aa, Mycobacterium tuberculosis
IPGTWLCRNGMEG

SEQ ID NO: 85793 - protein, 13 aa, Mycobacterium tuberculosis
PGTWLCRNGMEGT

SEQ ID NO: 85794 - protein, 13 aa, Mycobacterium tuberculosis
GTWLCRNGMEGTL

SEQ ID NO: 85795 - protein, 13 aa, Mycobacterium tuberculosis
TWLCRNGMEGTLI

SEQ ID NO: 85796 - protein, 13 aa, Mycobacterium tuberculosis
WLCRNGMEGTLIE

SEQ ID NO: 85797 - protein, 13 aa, Mycobacterium tuberculosis
LCRNGMEGTLIEG

SEQ ID NO: 85798 - protein, 13 aa, Mycobacterium tuberculosis
CRNGMEGTLIEGD

SEQ ID NO: 85799 - protein, 13 aa, Mycobacterium tuberculosis
RNGMEGTLIEGDL

SEQ ID NO: 85800 - protein, 13 aa, Mycobacterium tuberculosis
NGMEGTLIEGDLP

SEQ ID NO: 85801 - protein, 13 aa, Mycobacterium tuberculosis
GMEGTLIEGDLPE

SEQ ID NO: 85802 - protein, 13 aa, Mycobacterium tuberculosis
MEGTLIEGDLPEP

SEQ ID NO: 85803 - protein, 13 aa, Mycobacterium tuberculosis
EGTLIEGDLPEPK

SEQ ID NO: 85804 - protein, 13 aa, Mycobacterium tuberculosis
GTLIEGDLPEPKK

SEQ ID NO: 85805 - protein, 13 aa, Mycobacterium tuberculosis
TLIEGDLPEPKKV

SEQ ID NO: 85806 - protein, 13 aa, Mycobacterium tuberculosis
LIEGDLPEPKKVK

SEQ ID NO: 85807 - protein, 13 aa, Mycobacterium tuberculosis
IEGDLPEPKKVKP

SEQ ID NO: 85808 - protein, 13 aa, Mycobacterium tuberculosis
EGDLPEPKKVKPP

SEQ ID NO: 85809 - protein, 13 aa, Mycobacterium tuberculosis
GDLPEPKKVKPPR

SEQ ID NO: 85810 - protein, 13 aa, Mycobacterium tuberculosis
DLPEPKKVKPPRT

SEQ ID NO: 85811 - protein, 13 aa, Mycobacterium tuberculosis
LPEPKKVKPPRTH

SEQ ID NO: 85812 - protein, 13 aa, Mycobacterium tuberculosis
PEPKKVKPPRTHW

SEQ ID NO: 85813 - protein, 13 aa, Mycobacterium tuberculosis
EPKKVKPPRTHWD

SEQ ID NO: 85814 - protein, 13 aa, Mycobacterium tuberculosis
PKKVKPPRTHWDM

SEQ ID NO: 85815 - protein, 13 aa, Mycobacterium tuberculosis
KKVKPPRTHWDML

SEQ ID NO: 85816 - protein, 13 aa, Mycobacterium tuberculosis
KVKPPRTHWDMLL

SEQ ID NO: 85817 - protein, 13 aa, Mycobacterium tuberculosis
VKPPRTHWDMLLE

SEQ ID NO: 85818 - protein, 13 aa, Mycobacterium tuberculosis
KPPRTHWDMLLER

SEQ ID NO: 85819 - protein, 13 aa, Mycobacterium tuberculosis
PPRTHWDMLLERR

SEQ ID NO: 85820 - protein, 13 aa, Mycobacterium tuberculosis
PRTHWDMLLERRS

SEQ ID NO: 85821 - protein, 13 aa, Mycobacterium tuberculosis
RTHWDMLLERRSI

SEQ ID NO: 85822 - protein, 13 aa, Mycobacterium tuberculosis
THWDMLLERRSIE

SEQ ID NO: 85823 - protein, 13 aa, Mycobacterium tuberculosis
HWDMLLERRSIEE

SEQ ID NO: 85824 - protein, 13 aa, Mycobacterium tuberculosis
WDMLLERRSIEEL

SEQ ID NO: 85825 - protein, 13 aa, Mycobacterium tuberculosis
DMLLERRSIEELE

SEQ ID NO: 85826 - protein, 13 aa, Mycobacterium tuberculosis
MLLERRSIEELEE

SEQ ID NO: 85827 - protein, 13 aa, Mycobacterium tuberculosis
LLERRSIEELEEL

SEQ ID NO: 85828 - protein, 13 aa, Mycobacterium tuberculosis
LERRSIEELEELL

SEQ ID NO: 85829 - protein, 13 aa, Mycobacterium tuberculosis
ERRSIEELEELLK

SEQ ID NO: 85830 - protein, 13 aa, Mycobacterium tuberculosis
RRSIEELEELLKE

SEQ ID NO: 85831 - protein, 13 aa, Mycobacterium tuberculosis
RSIEELEELLKER

SEQ ID NO: 85832 - protein, 13 aa, Mycobacterium tuberculosis
SIEELEELLKERL

SEQ ID NO: 85833 - protein, 13 aa, Mycobacterium tuberculosis
IEELEELLKERLE

SEQ ID NO: 85834 - protein, 13 aa, Mycobacterium tuberculosis
EELEELLKERLEL

SEQ ID NO: 85835 - protein, 13 aa, Mycobacterium tuberculosis
ELEELLKERLELI

SEQ ID NO: 85836 - protein, 13 aa, Mycobacterium tuberculosis
LEELLKERLELIR

SEQ ID NO: 85837 - protein, 13 aa, Mycobacterium tuberculosis
EELLKERLELIRS

SEQ ID NO: 85838 - protein, 13 aa, Mycobacterium tuberculosis
ELLKERLELIRSR

SEQ ID NO: 85839 - protein, 13 aa, Mycobacterium tuberculosis
LLKERLELIRSRR

SEQ ID NO: 85840 - protein, 13 aa, Mycobacterium tuberculosis
LKERLELIRSRRR

SEQ ID NO: 85841 - protein, 13 aa, Mycobacterium tuberculosis
KERLELIRSRRRG

SEQ ID NO: 85842 - protein, 14 aa, Mycobacterium tuberculosis
MADRVLRGSRLGAV

SEQ ID NO: 85843 - protein, 14 aa, Mycobacterium tuberculosis
ADRVLRGSRLGAVS

SEQ ID NO: 85844 - protein, 14 aa, Mycobacterium tuberculosis
DRVLRGSRLGAVSY

SEQ ID NO: 85845 - protein, 14 aa, Mycobacterium tuberculosis
RVLRGSRLGAVSYE

SEQ ID NO: 85846 - protein, 14 aa, Mycobacterium tuberculosis
VLRGSRLGAVSYET

SEQ ID NO: 85847 - protein, 14 aa, Mycobacterium tuberculosis
LRGSRLGAVSYETD

SEQ ID NO: 85848 - protein, 14 aa, Mycobacterium tuberculosis
RGSRLGAVSYETDR

SEQ ID NO: 85849 - protein, 14 aa, Mycobacterium tuberculosis
GSRLGAVSYETDRN

SEQ ID NO: 85850 - protein, 14 aa, Mycobacterium tuberculosis
SRLGAVSYETDRNH

SEQ ID NO: 85851 - protein, 14 aa, Mycobacterium tuberculosis
RLGAVSYETDRNHD

SEQ ID NO: 85852 - protein, 14 aa, Mycobacterium tuberculosis
LGAVSYETDRNHDL

SEQ ID NO: 85853 - protein, 14 aa, Mycobacterium tuberculosis
GAVSYETDRNHDLA

SEQ ID NO: 85854 - protein, 14 aa, Mycobacterium tuberculosis
AVSYETDRNHDLAP

SEQ ID NO: 85855 - protein, 14 aa, Mycobacterium tuberculosis
VSYETDRNHDLAPR

SEQ ID NO: 85856 - protein, 14 aa, Mycobacterium tuberculosis
SYETDRNHDLAPRQ

SEQ ID NO: 85857 - protein, 14 aa, Mycobacterium tuberculosis
YETDRNHDLAPRQI

SEQ ID NO: 85858 - protein, 14 aa, Mycobacterium tuberculosis
ETDRNHDLAPRQIA

SEQ ID NO: 85859 - protein, 14 aa, Mycobacterium tuberculosis
TDRNHDLAPRQIAR

SEQ ID NO: 85860 - protein, 14 aa, Mycobacterium tuberculosis
DRNHDLAPRQIARY

SEQ ID NO: 85861 - protein, 14 aa, Mycobacterium tuberculosis
RNHDLAPRQIARYR

SEQ ID NO: 85862 - protein, 14 aa, Mycobacterium tuberculosis
NHDLAPRQIARYRT

SEQ ID NO: 85863 - protein, 14 aa, Mycobacterium tuberculosis
HDLAPRQIARYRTD

SEQ ID NO: 85864 - protein, 14 aa, Mycobacterium tuberculosis
DLAPRQIARYRTDN

SEQ ID NO: 85865 - protein, 14 aa, Mycobacterium tuberculosis
LAPRQIARYRTDNG

SEQ ID NO: 85866 - protein, 14 aa, Mycobacterium tuberculosis
APRQIARYRTDNGE

SEQ ID NO: 85867 - protein, 14 aa, Mycobacterium tuberculosis
PRQIARYRTDNGEE

SEQ ID NO: 85868 - protein, 14 aa, Mycobacterium tuberculosis
RQIARYRTDNGEEF

SEQ ID NO: 85869 - protein, 14 aa, Mycobacterium tuberculosis
QIARYRTDNGEEFE

SEQ ID NO: 85870 - protein, 14 aa, Mycobacterium tuberculosis
IARYRTDNGEEFEV

SEQ ID NO: 85871 - protein, 14 aa, Mycobacterium tuberculosis
ARYRTDNGEEFEVP

SEQ ID NO: 85872 - protein, 14 aa, Mycobacterium tuberculosis
RYRTDNGEEFEVPF

SEQ ID NO: 85873 - protein, 14 aa, Mycobacterium tuberculosis
YRTDNGEEFEVPFA

SEQ ID NO: 85874 - protein, 14 aa, Mycobacterium tuberculosis
RTDNGEEFEVPFAD

SEQ ID NO: 85875 - protein, 14 aa, Mycobacterium tuberculosis
TDNGEEFEVPFADD

SEQ ID NO: 85876 - protein, 14 aa, Mycobacterium tuberculosis
DNGEEFEVPFADDA

SEQ ID NO: 85877 - protein, 14 aa, Mycobacterium tuberculosis
NGEEFEVPFADDAE

SEQ ID NO: 85878 - protein, 14 aa, Mycobacterium tuberculosis
GEEFEVPFADDAEI

SEQ ID NO: 85879 - protein, 14 aa, Mycobacterium tuberculosis
EEFEVPFADDAEIP

SEQ ID NO: 85880 - protein, 14 aa, Mycobacterium tuberculosis
EFEVPFADDAEIPG

SEQ ID NO: 85881 - protein, 14 aa, Mycobacterium tuberculosis
FEVPFADDAEIPGT

SEQ ID NO: 85882 - protein, 14 aa, Mycobacterium tuberculosis
EVPFADDAEIPGTW

SEQ ID NO: 85883 - protein, 14 aa, Mycobacterium tuberculosis
VPFADDAEIPGTWL

SEQ ID NO: 85884 - protein, 14 aa, Mycobacterium tuberculosis
PFADDAEIPGTWLC

SEQ ID NO: 85885 - protein, 14 aa, Mycobacterium tuberculosis
FADDAEIPGTWLCR

SEQ ID NO: 85886 - protein, 14 aa, Mycobacterium tuberculosis
ADDAEIPGTWLCRN

SEQ ID NO: 85887 - protein, 14 aa, Mycobacterium tuberculosis
DDAEIPGTWLCRNG

SEQ ID NO: 85888 - protein, 14 aa, Mycobacterium tuberculosis
DAEIPGTWLCRNGM

SEQ ID NO: 85889 - protein, 14 aa, Mycobacterium tuberculosis
AEIPGTWLCRNGME

SEQ ID NO: 85890 - protein, 14 aa, Mycobacterium tuberculosis
EIPGTWLCRNGMEG

SEQ ID NO: 85891 - protein, 14 aa, Mycobacterium tuberculosis
IPGTWLCRNGMEGT

SEQ ID NO: 85892 - protein, 14 aa, Mycobacterium tuberculosis
PGTWLCRNGMEGTL

SEQ ID NO: 85893 - protein, 14 aa, Mycobacterium tuberculosis
GTWLCRNGMEGTLI

SEQ ID NO: 85894 - protein, 14 aa, Mycobacterium tuberculosis
TWLCRNGMEGTLIE

SEQ ID NO: 85895 - protein, 14 aa, Mycobacterium tuberculosis
WLCRNGMEGTLIEG

SEQ ID NO: 85896 - protein, 14 aa, Mycobacterium tuberculosis
LCRNGMEGTLIEGD

SEQ ID NO: 85897 - protein, 14 aa, Mycobacterium tuberculosis
CRNGMEGTLIEGDL

SEQ ID NO: 85898 - protein, 14 aa, Mycobacterium tuberculosis
RNGMEGTLIEGDLP

SEQ ID NO: 85899 - protein, 14 aa, Mycobacterium tuberculosis
NGMEGTLIEGDLPE

SEQ ID NO: 85900 - protein, 14 aa, Mycobacterium tuberculosis
GMEGTLIEGDLPEP

SEQ ID NO: 85901 - protein, 14 aa, Mycobacterium tuberculosis
MEGTLIEGDLPEPK

SEQ ID NO: 85902 - protein, 14 aa, Mycobacterium tuberculosis
EGTLIEGDLPEPKK

SEQ ID NO: 85903 - protein, 14 aa, Mycobacterium tuberculosis
GTLIEGDLPEPKKV

SEQ ID NO: 85904 - protein, 14 aa, Mycobacterium tuberculosis
TLIEGDLPEPKKVK

SEQ ID NO: 85905 - protein, 14 aa, Mycobacterium tuberculosis
LIEGDLPEPKKVKP

SEQ ID NO: 85906 - protein, 14 aa, Mycobacterium tuberculosis
IEGDLPEPKKVKPP

SEQ ID NO: 85907 - protein, 14 aa, Mycobacterium tuberculosis
EGDLPEPKKVKPPR

SEQ ID NO: 85908 - protein, 14 aa, Mycobacterium tuberculosis
GDLPEPKKVKPPRT

SEQ ID NO: 85909 - protein, 14 aa, Mycobacterium tuberculosis
DLPEPKKVKPPRTH

SEQ ID NO: 85910 - protein, 14 aa, Mycobacterium tuberculosis
LPEPKKVKPPRTHW

SEQ ID NO: 85911 - protein, 14 aa, Mycobacterium tuberculosis
PEPKKVKPPRTHWD

SEQ ID NO: 85912 - protein, 14 aa, Mycobacterium tuberculosis
EPKKVKPPRTHWDM

SEQ ID NO: 85913 - protein, 14 aa, Mycobacterium tuberculosis
PKKVKPPRTHWDML

SEQ ID NO: 85914 - protein, 14 aa, Mycobacterium tuberculosis
KKVKPPRTHWDMLL

SEQ ID NO: 85915 - protein, 14 aa, Mycobacterium tuberculosis
KVKPPRTHWDMLLE

SEQ ID NO: 85916 - protein, 14 aa, Mycobacterium tuberculosis
VKPPRTHWDMLLER

SEQ ID NO: 85917 - protein, 14 aa, Mycobacterium tuberculosis
KPPRTHWDMLLERR

SEQ ID NO: 85918 - protein, 14 aa, Mycobacterium tuberculosis
PPRTHWDMLLERRS

SEQ ID NO: 85919 - protein, 14 aa, Mycobacterium tuberculosis
PRTHWDMLLERRSI

SEQ ID NO: 85920 - protein, 14 aa, Mycobacterium tuberculosis
RTHWDMLLERRSIE

SEQ ID NO: 85921 - protein, 14 aa, Mycobacterium tuberculosis
THWDMLLERRSIEE

SEQ ID NO: 85922 - protein, 14 aa, Mycobacterium tuberculosis
HWDMLLERRSIEEL

SEQ ID NO: 85923 - protein, 14 aa, Mycobacterium tuberculosis
WDMLLERRSIEELE

SEQ ID NO: 85924 - protein, 14 aa, Mycobacterium tuberculosis
DMLLERRSIEELEE

SEQ ID NO: 85925 - protein, 14 aa, Mycobacterium tuberculosis
MLLERRSIEELEEL

SEQ ID NO: 85926 - protein, 14 aa, Mycobacterium tuberculosis
LLERRSIEELEELL

SEQ ID NO: 85927 - protein, 14 aa, Mycobacterium tuberculosis
LERRSIEELEELLK

SEQ ID NO: 85928 - protein, 14 aa, Mycobacterium tuberculosis
ERRSIEELEELLKE

SEQ ID NO: 85929 - protein, 14 aa, Mycobacterium tuberculosis
RRSIEELEELLKER

SEQ ID NO: 85930 - protein, 14 aa, Mycobacterium tuberculosis
RSIEELEELLKERL

SEQ ID NO: 85931 - protein, 14 aa, Mycobacterium tuberculosis
SIEELEELLKERLE

SEQ ID NO: 85932 - protein, 14 aa, Mycobacterium tuberculosis
IEELEELLKERLEL

SEQ ID NO: 85933 - protein, 14 aa, Mycobacterium tuberculosis
EELEELLKERLELI

SEQ ID NO: 85934 - protein, 14 aa, Mycobacterium tuberculosis
ELEELLKERLELIR

SEQ ID NO: 85935 - protein, 14 aa, Mycobacterium tuberculosis
LEELLKERLELIRS

SEQ ID NO: 85936 - protein, 14 aa, Mycobacterium tuberculosis
EELLKERLELIRSR

SEQ ID NO: 85937 - protein, 14 aa, Mycobacterium tuberculosis
ELLKERLELIRSRR

SEQ ID NO: 85938 - protein, 14 aa, Mycobacterium tuberculosis
LLKERLELIRSRRR

SEQ ID NO: 85939 - protein, 14 aa, Mycobacterium tuberculosis
LKERLELIRSRRRG

SEQ ID NO: 85940 - protein, 15 aa, Mycobacterium tuberculosis
MADRVLRGSRLGAVS

SEQ ID NO: 85941 - protein, 15 aa, Mycobacterium tuberculosis
ADRVLRGSRLGAVSY

SEQ ID NO: 85942 - protein, 15 aa, Mycobacterium tuberculosis
DRVLRGSRLGAVSYE

SEQ ID NO: 85943 - protein, 15 aa, Mycobacterium tuberculosis
RVLRGSRLGAVSYET

SEQ ID NO: 85944 - protein, 15 aa, Mycobacterium tuberculosis
VLRGSRLGAVSYETD

SEQ ID NO: 85945 - protein, 15 aa, Mycobacterium tuberculosis
LRGSRLGAVSYETDR

SEQ ID NO: 85946 - protein, 15 aa, Mycobacterium tuberculosis
RGSRLGAVSYETDRN

SEQ ID NO: 85947 - protein, 15 aa, Mycobacterium tuberculosis
GSRLGAVSYETDRNH

SEQ ID NO: 85948 - protein, 15 aa, Mycobacterium tuberculosis
SRLGAVSYETDRNHD

SEQ ID NO: 85949 - protein, 15 aa, Mycobacterium tuberculosis
RLGAVSYETDRNHDL

SEQ ID NO: 85950 - protein, 15 aa, Mycobacterium tuberculosis
LGAVSYETDRNHDLA

SEQ ID NO: 85951 - protein, 15 aa, Mycobacterium tuberculosis
GAVSYETDRNHDLAP

SEQ ID NO: 85952 - protein, 15 aa, Mycobacterium tuberculosis
AVSYETDRNHDLAPR

SEQ ID NO: 85953 - protein, 15 aa, Mycobacterium tuberculosis
VSYETDRNHDLAPRQ

SEQ ID NO: 85954 - protein, 15 aa, Mycobacterium tuberculosis
SYETDRNHDLAPRQI

SEQ ID NO: 85955 - protein, 15 aa, Mycobacterium tuberculosis
YETDRNHDLAPRQIA

SEQ ID NO: 85956 - protein, 15 aa, Mycobacterium tuberculosis
ETDRNHDLAPRQIAR

SEQ ID NO: 85957 - protein, 15 aa, Mycobacterium tuberculosis
TDRNHDLAPRQIARY

SEQ ID NO: 85958 - protein, 15 aa, Mycobacterium tuberculosis
DRNHDLAPRQIARYR

SEQ ID NO: 85959 - protein, 15 aa, Mycobacterium tuberculosis
RNHDLAPRQIARYRT

SEQ ID NO: 85960 - protein, 15 aa, Mycobacterium tuberculosis
NHDLAPRQIARYRTD

SEQ ID NO: 85961 - protein, 15 aa, Mycobacterium tuberculosis
HDLAPRQIARYRTDN

SEQ ID NO: 85962 - protein, 15 aa, Mycobacterium tuberculosis
DLAPRQIARYRTDNG

SEQ ID NO: 85963 - protein, 15 aa, Mycobacterium tuberculosis
LAPRQIARYRTDNGE

SEQ ID NO: 85964 - protein, 15 aa, Mycobacterium tuberculosis
APRQIARYRTDNGEE

SEQ ID NO: 85965 - protein, 15 aa, Mycobacterium tuberculosis
PRQIARYRTDNGEEF

SEQ ID NO: 85966 - protein, 15 aa, Mycobacterium tuberculosis
RQIARYRTDNGEEFE

SEQ ID NO: 85967 - protein, 15 aa, Mycobacterium tuberculosis
QIARYRTDNGEEFEV

SEQ ID NO: 85968 - protein, 15 aa, Mycobacterium tuberculosis
IARYRTDNGEEFEVP

SEQ ID NO: 85969 - protein, 15 aa, Mycobacterium tuberculosis
ARYRTDNGEEFEVPF

SEQ ID NO: 85970 - protein, 15 aa, Mycobacterium tuberculosis
RYRTDNGEEFEVPFA

SEQ ID NO: 85971 - protein, 15 aa, Mycobacterium tuberculosis
YRTDNGEEFEVPFAD

SEQ ID NO: 85972 - protein, 15 aa, Mycobacterium tuberculosis
RTDNGEEFEVPFADD

SEQ ID NO: 85973 - protein, 15 aa, Mycobacterium tuberculosis
TDNGEEFEVPFADDA

SEQ ID NO: 85974 - protein, 15 aa, Mycobacterium tuberculosis
DNGEEFEVPFADDAE

SEQ ID NO: 85975 - protein, 15 aa, Mycobacterium tuberculosis
NGEEFEVPFADDAEI

SEQ ID NO: 85976 - protein, 15 aa, Mycobacterium tuberculosis
GEEFEVPFADDAEIP

SEQ ID NO: 85977 - protein, 15 aa, Mycobacterium tuberculosis
EEFEVPFADDAEIPG

SEQ ID NO: 85978 - protein, 15 aa, Mycobacterium tuberculosis
EFEVPFADDAEIPGT

SEQ ID NO: 85979 - protein, 15 aa, Mycobacterium tuberculosis
FEVPFADDAEIPGTW

SEQ ID NO: 85980 - protein, 15 aa, Mycobacterium tuberculosis
EVPFADDAEIPGTWL

SEQ ID NO: 85981 - protein, 15 aa, Mycobacterium tuberculosis
VPFADDAEIPGTWLC

SEQ ID NO: 85982 - protein, 15 aa, Mycobacterium tuberculosis
PFADDAEIPGTWLCR

SEQ ID NO: 85983 - protein, 15 aa, Mycobacterium tuberculosis
FADDAEIPGTWLCRN

SEQ ID NO: 85984 - protein, 15 aa, Mycobacterium tuberculosis
ADDAEIPGTWLCRNG

SEQ ID NO: 85985 - protein, 15 aa, Mycobacterium tuberculosis
DDAEIPGTWLCRNGM

SEQ ID NO: 85986 - protein, 15 aa, Mycobacterium tuberculosis
DAEIPGTWLCRNGME

SEQ ID NO: 85987 - protein, 15 aa, Mycobacterium tuberculosis
AEIPGTWLCRNGMEG

SEQ ID NO: 85988 - protein, 15 aa, Mycobacterium tuberculosis
EIPGTWLCRNGMEGT

SEQ ID NO: 85989 - protein, 15 aa, Mycobacterium tuberculosis
IPGTWLCRNGMEGTL

SEQ ID NO: 85990 - protein, 15 aa, Mycobacterium tuberculosis
PGTWLCRNGMEGTLI

SEQ ID NO: 85991 - protein, 15 aa, Mycobacterium tuberculosis
GTWLCRNGMEGTLIE

SEQ ID NO: 85992 - protein, 15 aa, Mycobacterium tuberculosis
TWLCRNGMEGTLIEG

SEQ ID NO: 85993 - protein, 15 aa, Mycobacterium tuberculosis
WLCRNGMEGTLIEGD

SEQ ID NO: 85994 - protein, 15 aa, Mycobacterium tuberculosis
LCRNGMEGTLIEGDL

SEQ ID NO: 85995 - protein, 15 aa, Mycobacterium tuberculosis
CRNGMEGTLIEGDLP

SEQ ID NO: 85996 - protein, 15 aa, Mycobacterium tuberculosis
RNGMEGTLIEGDLPE

SEQ ID NO: 85997 - protein, 15 aa, Mycobacterium tuberculosis
NGMEGTLIEGDLPEP

SEQ ID NO: 85998 - protein, 15 aa, Mycobacterium tuberculosis
GMEGTLIEGDLPEPK

SEQ ID NO: 85999 - protein, 15 aa, Mycobacterium tuberculosis
MEGTLIEGDLPEPKK

SEQ ID NO: 86000 - protein, 15 aa, Mycobacterium tuberculosis
EGTLIEGDLPEPKKV

SEQ ID NO: 86001 - protein, 15 aa, Mycobacterium tuberculosis
GTLIEGDLPEPKKVK

SEQ ID NO: 86002 - protein, 15 aa, Mycobacterium tuberculosis
TLIEGDLPEPKKVKP

SEQ ID NO: 86003 - protein, 15 aa, Mycobacterium tuberculosis
LIEGDLPEPKKVKPP

SEQ ID NO: 86004 - protein, 15 aa, Mycobacterium tuberculosis
IEGDLPEPKKVKPPR

SEQ ID NO: 86005 - protein, 15 aa, Mycobacterium tuberculosis
EGDLPEPKKVKPPRT

SEQ ID NO: 86006 - protein, 15 aa, Mycobacterium tuberculosis
GDLPEPKKVKPPRTH

SEQ ID NO: 86007 - protein, 15 aa, Mycobacterium tuberculosis
DLPEPKKVKPPRTHW

SEQ ID NO: 86008 - protein, 15 aa, Mycobacterium tuberculosis
LPEPKKVKPPRTHWD

SEQ ID NO: 86009 - protein, 15 aa, Mycobacterium tuberculosis
PEPKKVKPPRTHWDM

SEQ ID NO: 86010 - protein, 15 aa, Mycobacterium tuberculosis
EPKKVKPPRTHWDML

SEQ ID NO: 86011 - protein, 15 aa, Mycobacterium tuberculosis
PKKVKPPRTHWDMLL

SEQ ID NO: 86012 - protein, 15 aa, Mycobacterium tuberculosis
KKVKPPRTHWDMLLE

SEQ ID NO: 86013 - protein, 15 aa, Mycobacterium tuberculosis
KVKPPRTHWDMLLER

SEQ ID NO: 86014 - protein, 15 aa, Mycobacterium tuberculosis
VKPPRTHWDMLLERR

SEQ ID NO: 86015 - protein, 15 aa, Mycobacterium tuberculosis
KPPRTHWDMLLERRS

SEQ ID NO: 86016 - protein, 15 aa, Mycobacterium tuberculosis
PPRTHWDMLLERRSI

SEQ ID NO: 86017 - protein, 15 aa, Mycobacterium tuberculosis
PRTHWDMLLERRSIE

SEQ ID NO: 86018 - protein, 15 aa, Mycobacterium tuberculosis
RTHWDMLLERRSIEE

SEQ ID NO: 86019 - protein, 15 aa, Mycobacterium tuberculosis
THWDMLLERRSIEEL

SEQ ID NO: 86020 - protein, 15 aa, Mycobacterium tuberculosis
HWDMLLERRSIEELE

SEQ ID NO: 86021 - protein, 15 aa, Mycobacterium tuberculosis
WDMLLERRSIEELEE

SEQ ID NO: 86022 - protein, 15 aa, Mycobacterium tuberculosis
DMLLERRSIEELEEL

SEQ ID NO: 86023 - protein, 15 aa, Mycobacterium tuberculosis
MLLERRSIEELEELL

SEQ ID NO: 86024 - protein, 15 aa, Mycobacterium tuberculosis
LLERRSIEELEELLK

SEQ ID NO: 86025 - protein, 15 aa, Mycobacterium tuberculosis
LERRSIEELEELLKE

SEQ ID NO: 86026 - protein, 15 aa, Mycobacterium tuberculosis
ERRSIEELEELLKER

SEQ ID NO: 86027 - protein, 15 aa, Mycobacterium tuberculosis
RRSIEELEELLKERL

SEQ ID NO: 86028 - protein, 15 aa, Mycobacterium tuberculosis
RSIEELEELLKERLE

SEQ ID NO: 86029 - protein, 15 aa, Mycobacterium tuberculosis
SIEELEELLKERLEL

SEQ ID NO: 86030 - protein, 15 aa, Mycobacterium tuberculosis
IEELEELLKERLELI

SEQ ID NO: 86031 - protein, 15 aa, Mycobacterium tuberculosis
EELEELLKERLELIR

SEQ ID NO: 86032 - protein, 15 aa, Mycobacterium tuberculosis
ELEELLKERLELIRS

SEQ ID NO: 86033 - protein, 15 aa, Mycobacterium tuberculosis
LEELLKERLELIRSR

SEQ ID NO: 86034 - protein, 15 aa, Mycobacterium tuberculosis
EELLKERLELIRSRR

SEQ ID NO: 86035 - protein, 15 aa, Mycobacterium tuberculosis
ELLKERLELIRSRRR

SEQ ID NO: 86036 - protein, 15 aa, Mycobacterium tuberculosis
LLKERLELIRSRRRG

SEQ ID NO: 86037 - protein, 16 aa, Mycobacterium tuberculosis
MADRVLRGSRLGAVSY

SEQ ID NO: 86038 - protein, 16 aa, Mycobacterium tuberculosis
ADRVLRGSRLGAVSYE

SEQ ID NO: 86039 - protein, 16 aa, Mycobacterium tuberculosis
DRVLRGSRLGAVSYET

SEQ ID NO: 86040 - protein, 16 aa, Mycobacterium tuberculosis
RVLRGSRLGAVSYETD

SEQ ID NO: 86041 - protein, 16 aa, Mycobacterium tuberculosis
VLRGSRLGAVSYETDR

SEQ ID NO: 86042 - protein, 16 aa, Mycobacterium tuberculosis
LRGSRLGAVSYETDRN

SEQ ID NO: 86043 - protein, 16 aa, Mycobacterium tuberculosis
RGSRLGAVSYETDRNH

SEQ ID NO: 86044 - protein, 16 aa, Mycobacterium tuberculosis
GSRLGAVSYETDRNHD

SEQ ID NO: 86045 - protein, 16 aa, Mycobacterium tuberculosis
SRLGAVSYETDRNHDL

SEQ ID NO: 86046 - protein, 16 aa, Mycobacterium tuberculosis
RLGAVSYETDRNHDLA

SEQ ID NO: 86047 - protein, 16 aa, Mycobacterium tuberculosis
LGAVSYETDRNHDLAP

SEQ ID NO: 86048 - protein, 16 aa, Mycobacterium tuberculosis
GAVSYETDRNHDLAPR

SEQ ID NO: 86049 - protein, 16 aa, Mycobacterium tuberculosis
AVSYETDRNHDLAPRQ

SEQ ID NO: 86050 - protein, 16 aa, Mycobacterium tuberculosis
VSYETDRNHDLAPRQI

SEQ ID NO: 86051 - protein, 16 aa, Mycobacterium tuberculosis
SYETDRNHDLAPRQIA

SEQ ID NO: 86052 - protein, 16 aa, Mycobacterium tuberculosis
YETDRNHDLAPRQIAR

SEQ ID NO: 86053 - protein, 16 aa, Mycobacterium tuberculosis
ETDRNHDLAPRQIARY

SEQ ID NO: 86054 - protein, 16 aa, Mycobacterium tuberculosis
TDRNHDLAPRQIARYR

SEQ ID NO: 86055 - protein, 16 aa, Mycobacterium tuberculosis
DRNHDLAPRQIARYRT

SEQ ID NO: 86056 - protein, 16 aa, Mycobacterium tuberculosis
RNHDLAPRQIARYRTD

SEQ ID NO: 86057 - protein, 16 aa, Mycobacterium tuberculosis
NHDLAPRQIARYRTDN

SEQ ID NO: 86058 - protein, 16 aa, Mycobacterium tuberculosis
HDLAPRQIARYRTDNG

SEQ ID NO: 86059 - protein, 16 aa, Mycobacterium tuberculosis
DLAPRQIARYRTDNGE

SEQ ID NO: 86060 - protein, 16 aa, Mycobacterium tuberculosis
LAPRQIARYRTDNGEE

SEQ ID NO: 86061 - protein, 16 aa, Mycobacterium tuberculosis
APRQIARYRTDNGEEF

SEQ ID NO: 86062 - protein, 16 aa, Mycobacterium tuberculosis
PRQIARYRTDNGEEFE

SEQ ID NO: 86063 - protein, 16 aa, Mycobacterium tuberculosis
RQIARYRTDNGEEFEV

SEQ ID NO: 86064 - protein, 16 aa, Mycobacterium tuberculosis
QIARYRTDNGEEFEVP

SEQ ID NO: 86065 - protein, 16 aa, Mycobacterium tuberculosis
IARYRTDNGEEFEVPF

SEQ ID NO: 86066 - protein, 16 aa, Mycobacterium tuberculosis
ARYRTDNGEEFEVPFA

SEQ ID NO: 86067 - protein, 16 aa, Mycobacterium tuberculosis
RYRTDNGEEFEVPFAD

SEQ ID NO: 86068 - protein, 16 aa, Mycobacterium tuberculosis
YRTDNGEEFEVPFADD

SEQ ID NO: 86069 - protein, 16 aa, Mycobacterium tuberculosis
RTDNGEEFEVPFADDA

SEQ ID NO: 86070 - protein, 16 aa, Mycobacterium tuberculosis
TDNGEEFEVPFADDAE

SEQ ID NO: 86071 - protein, 16 aa, Mycobacterium tuberculosis
DNGEEFEVPFADDAEI

SEQ ID NO: 86072 - protein, 16 aa, Mycobacterium tuberculosis
NGEEFEVPFADDAEIP

SEQ ID NO: 86073 - protein, 16 aa, Mycobacterium tuberculosis
GEEFEVPFADDAEIPG

SEQ ID NO: 86074 - protein, 16 aa, Mycobacterium tuberculosis
EEFEVPFADDAEIPGT

SEQ ID NO: 86075 - protein, 16 aa, Mycobacterium tuberculosis
EFEVPFADDAEIPGTW

SEQ ID NO: 86076 - protein, 16 aa, Mycobacterium tuberculosis
FEVPFADDAEIPGTWL

SEQ ID NO: 86077 - protein, 16 aa, Mycobacterium tuberculosis
EVPFADDAEIPGTWLC

SEQ ID NO: 86078 - protein, 16 aa, Mycobacterium tuberculosis
VPFADDAEIPGTWLCR

SEQ ID NO: 86079 - protein, 16 aa, Mycobacterium tuberculosis
PFADDAEIPGTWLCRN

SEQ ID NO: 86080 - protein, 16 aa, Mycobacterium tuberculosis
FADDAEIPGTWLCRNG

SEQ ID NO: 86081 - protein, 16 aa, Mycobacterium tuberculosis
ADDAEIPGTWLCRNGM

SEQ ID NO: 86082 - protein, 16 aa, Mycobacterium tuberculosis
DDAEIPGTWLCRNGME

SEQ ID NO: 86083 - protein, 16 aa, Mycobacterium tuberculosis
DAEIPGTWLCRNGMEG

SEQ ID NO: 86084 - protein, 16 aa, Mycobacterium tuberculosis
AEIPGTWLCRNGMEGT

SEQ ID NO: 86085 - protein, 16 aa, Mycobacterium tuberculosis
EIPGTWLCRNGMEGTL

SEQ ID NO: 86086 - protein, 16 aa, Mycobacterium tuberculosis
IPGTWLCRNGMEGTLI

SEQ ID NO: 86087 - protein, 16 aa, Mycobacterium tuberculosis
PGTWLCRNGMEGTLIE

SEQ ID NO: 86088 - protein, 16 aa, Mycobacterium tuberculosis
GTWLCRNGMEGTLIEG

SEQ ID NO: 86089 - protein, 16 aa, Mycobacterium tuberculosis
TWLCRNGMEGTLIEGD

SEQ ID NO: 86090 - protein, 16 aa, Mycobacterium tuberculosis
WLCRNGMEGTLIEGDL

SEQ ID NO: 86091 - protein, 16 aa, Mycobacterium tuberculosis
LCRNGMEGTLIEGDLP

SEQ ID NO: 86092 - protein, 16 aa, Mycobacterium tuberculosis
CRNGMEGTLIEGDLPE

SEQ ID NO: 86093 - protein, 16 aa, Mycobacterium tuberculosis
RNGMEGTLIEGDLPEP

SEQ ID NO: 86094 - protein, 16 aa, Mycobacterium tuberculosis
NGMEGTLIEGDLPEPK

SEQ ID NO: 86095 - protein, 16 aa, Mycobacterium tuberculosis
GMEGTLIEGDLPEPKK

SEQ ID NO: 86096 - protein, 16 aa, Mycobacterium tuberculosis
MEGTLIEGDLPEPKKV

SEQ ID NO: 86097 - protein, 16 aa, Mycobacterium tuberculosis
EGTLIEGDLPEPKKVK

SEQ ID NO: 86098 - protein, 16 aa, Mycobacterium tuberculosis
GTLIEGDLPEPKKVKP

SEQ ID NO: 86099 - protein, 16 aa, Mycobacterium tuberculosis
TLIEGDLPEPKKVKPP

SEQ ID NO: 86100 - protein, 16 aa, Mycobacterium tuberculosis
LIEGDLPEPKKVKPPR

SEQ ID NO: 86101 - protein, 16 aa, Mycobacterium tuberculosis
IEGDLPEPKKVKPPRT

SEQ ID NO: 86102 - protein, 16 aa, Mycobacterium tuberculosis
EGDLPEPKKVKPPRTH

SEQ ID NO: 86103 - protein, 16 aa, Mycobacterium tuberculosis
GDLPEPKKVKPPRTHW

SEQ ID NO: 86104 - protein, 16 aa, Mycobacterium tuberculosis
DLPEPKKVKPPRTHWD

SEQ ID NO: 86105 - protein, 16 aa, Mycobacterium tuberculosis
LPEPKKVKPPRTHWDM

SEQ ID NO: 86106 - protein, 16 aa, Mycobacterium tuberculosis
PEPKKVKPPRTHWDML

SEQ ID NO: 86107 - protein, 16 aa, Mycobacterium tuberculosis
EPKKVKPPRTHWDMLL

SEQ ID NO: 86108 - protein, 16 aa, Mycobacterium tuberculosis
PKKVKPPRTHWDMLLE

SEQ ID NO: 86109 - protein, 16 aa, Mycobacterium tuberculosis
KKVKPPRTHWDMLLER

SEQ ID NO: 86110 - protein, 16 aa, Mycobacterium tuberculosis
KVKPPRTHWDMLLERR

SEQ ID NO: 86111 - protein, 16 aa, Mycobacterium tuberculosis
VKPPRTHWDMLLERRS

SEQ ID NO: 86112 - protein, 16 aa, Mycobacterium tuberculosis
KPPRTHWDMLLERRSI

SEQ ID NO: 86113 - protein, 16 aa, Mycobacterium tuberculosis
PPRTHWDMLLERRSIE

SEQ ID NO: 86114 - protein, 16 aa, Mycobacterium tuberculosis
PRTHWDMLLERRSIEE

SEQ ID NO: 86115 - protein, 16 aa, Mycobacterium tuberculosis
RTHWDMLLERRSIEEL

SEQ ID NO: 86116 - protein, 16 aa, Mycobacterium tuberculosis
THWDMLLERRSIEELE

SEQ ID NO: 86117 - protein, 16 aa, Mycobacterium tuberculosis
HWDMLLERRSIEELEE

SEQ ID NO: 86118 - protein, 16 aa, Mycobacterium tuberculosis
WDMLLERRSIEELEEL

SEQ ID NO: 86119 - protein, 16 aa, Mycobacterium tuberculosis
DMLLERRSIEELEELL

SEQ ID NO: 86120 - protein, 16 aa, Mycobacterium tuberculosis
MLLERRSIEELEELLK

SEQ ID NO: 86121 - protein, 16 aa, Mycobacterium tuberculosis
LLERRSIEELEELLKE

SEQ ID NO: 86122 - protein, 16 aa, Mycobacterium tuberculosis
LERRSIEELEELLKER

SEQ ID NO: 86123 - protein, 16 aa, Mycobacterium tuberculosis
ERRSIEELEELLKERL

SEQ ID NO: 86124 - protein, 16 aa, Mycobacterium tuberculosis
RRSIEELEELLKERLE

SEQ ID NO: 86125 - protein, 16 aa, Mycobacterium tuberculosis
RSIEELEELLKERLEL

SEQ ID NO: 86126 - protein, 16 aa, Mycobacterium tuberculosis
SIEELEELLKERLELI

SEQ ID NO: 86127 - protein, 16 aa, Mycobacterium tuberculosis
IEELEELLKERLELIR

SEQ ID NO: 86128 - protein, 16 aa, Mycobacterium tuberculosis
EELEELLKERLELIRS

SEQ ID NO: 86129 - protein, 16 aa, Mycobacterium tuberculosis
ELEELLKERLELIRSR

SEQ ID NO: 86130 - protein, 16 aa, Mycobacterium tuberculosis
LEELLKERLELIRSRR

SEQ ID NO: 86131 - protein, 16 aa, Mycobacterium tuberculosis
EELLKERLELIRSRRR

SEQ ID NO: 86132 - protein, 16 aa, Mycobacterium tuberculosis
ELLKERLELIRSRRRG

SEQ ID NO: 86133 - protein, 13 aa, Mycobacterium tuberculosis
MPLSDHEQRMLDQ

SEQ ID NO: 86134 - protein, 13 aa, Mycobacterium tuberculosis
PLSDHEQRMLDQI

SEQ ID NO: 86135 - protein, 13 aa, Mycobacterium tuberculosis
LSDHEQRMLDQIE

SEQ ID NO: 86136 - protein, 13 aa, Mycobacterium tuberculosis
SDHEQRMLDQIES

SEQ ID NO: 86137 - protein, 13 aa, Mycobacterium tuberculosis
DHEQRMLDQIESA

SEQ ID NO: 86138 - protein, 13 aa, Mycobacterium tuberculosis
HEQRMLDQIESAL

SEQ ID NO: 86139 - protein, 13 aa, Mycobacterium tuberculosis
EQRMLDQIESALY

SEQ ID NO: 86140 - protein, 13 aa, Mycobacterium tuberculosis
QRMLDQIESALYA

SEQ ID NO: 86141 - protein, 13 aa, Mycobacterium tuberculosis
RMLDQIESALYAE

SEQ ID NO: 86142 - protein, 13 aa, Mycobacterium tuberculosis
MLDQIESALYAED

SEQ ID NO: 86143 - protein, 13 aa, Mycobacterium tuberculosis
LDQIESALYAEDP

SEQ ID NO: 86144 - protein, 13 aa, Mycobacterium tuberculosis
DQIESALYAEDPK

SEQ ID NO: 86145 - protein, 13 aa, Mycobacterium tuberculosis
QIESALYAEDPKF

SEQ ID NO: 86146 - protein, 13 aa, Mycobacterium tuberculosis
IESALYAEDPKFA

SEQ ID NO: 86147 - protein, 13 aa, Mycobacterium tuberculosis
ESALYAEDPKFAS

SEQ ID NO: 86148 - protein, 13 aa, Mycobacterium tuberculosis
SALYAEDPKFASS

SEQ ID NO: 86149 - protein, 13 aa, Mycobacterium tuberculosis
ALYAEDPKFASSV

SEQ ID NO: 86150 - protein, 13 aa, Mycobacterium tuberculosis
LYAEDPKFASSVR

SEQ ID NO: 86151 - protein, 13 aa, Mycobacterium tuberculosis
YAEDPKFASSVRG

SEQ ID NO: 86152 - protein, 13 aa, Mycobacterium tuberculosis
AEDPKFASSVRGG

SEQ ID NO: 86153 - protein, 13 aa, Mycobacterium tuberculosis
EDPKFASSVRGGG

SEQ ID NO: 86154 - protein, 13 aa, Mycobacterium tuberculosis
DPKFASSVRGGGF

SEQ ID NO: 86155 - protein, 13 aa, Mycobacterium tuberculosis
PKFASSVRGGGFR

SEQ ID NO: 86156 - protein, 13 aa, Mycobacterium tuberculosis
KFASSVRGGGFRA

SEQ ID NO: 86157 - protein, 13 aa, Mycobacterium tuberculosis
FASSVRGGGFRAP

SEQ ID NO: 86158 - protein, 13 aa, Mycobacterium tuberculosis
ASSVRGGGFRAPT

SEQ ID NO: 86159 - protein, 13 aa, Mycobacterium tuberculosis
SSVRGGGFRAPTA

SEQ ID NO: 86160 - protein, 13 aa, Mycobacterium tuberculosis
SVRGGGFRAPTAR

SEQ ID NO: 86161 - protein, 13 aa, Mycobacterium tuberculosis
VRGGGFRAPTARR

SEQ ID NO: 86162 - protein, 13 aa, Mycobacterium tuberculosis
RGGGFRAPTARRR

SEQ ID NO: 86163 - protein, 13 aa, Mycobacterium tuberculosis
GGGFRAPTARRRL

SEQ ID NO: 86164 - protein, 13 aa, Mycobacterium tuberculosis
GGFRAPTARRRLQ

SEQ ID NO: 86165 - protein, 13 aa, Mycobacterium tuberculosis
GFRAPTARRRLQG

SEQ ID NO: 86166 - protein, 13 aa, Mycobacterium tuberculosis
FRAPTARRRLQGA

SEQ ID NO: 86167 - protein, 13 aa, Mycobacterium tuberculosis
RAPTARRRLQGAA

SEQ ID NO: 86168 - protein, 13 aa, Mycobacterium tuberculosis
APTARRRLQGAAL

SEQ ID NO: 86169 - protein, 13 aa, Mycobacterium tuberculosis
PTARRRLQGAALF

SEQ ID NO: 86170 - protein, 13 aa, Mycobacterium tuberculosis
TARRRLQGAALFI

SEQ ID NO: 86171 - protein, 13 aa, Mycobacterium tuberculosis
ARRRLQGAALFII

SEQ ID NO: 86172 - protein, 13 aa, Mycobacterium tuberculosis
RRRLQGAALFIIG

SEQ ID NO: 86173 - protein, 13 aa, Mycobacterium tuberculosis
RRLQGAALFIIGL

SEQ ID NO: 86174 - protein, 13 aa, Mycobacterium tuberculosis
RLQGAALFIIGLG

SEQ ID NO: 86175 - protein, 13 aa, Mycobacterium tuberculosis
LQGAALFIIGLGM

SEQ ID NO: 86176 - protein, 13 aa, Mycobacterium tuberculosis
QGAALFIIGLGML

SEQ ID NO: 86177 - protein, 13 aa, Mycobacterium tuberculosis
GAALFIIGLGMLV

SEQ ID NO: 86178 - protein, 13 aa, Mycobacterium tuberculosis
AALFIIGLGMLVS

SEQ ID NO: 86179 - protein, 13 aa, Mycobacterium tuberculosis
ALFIIGLGMLVSG

SEQ ID NO: 86180 - protein, 13 aa, Mycobacterium tuberculosis
LFIIGLGMLVSGV

SEQ ID NO: 86181 - protein, 13 aa, Mycobacterium tuberculosis
FIIGLGMLVSGVA

SEQ ID NO: 86182 - protein, 13 aa, Mycobacterium tuberculosis
IIGLGMLVSGVAF

SEQ ID NO: 86183 - protein, 13 aa, Mycobacterium tuberculosis
IGLGMLVSGVAFK

SEQ ID NO: 86184 - protein, 13 aa, Mycobacterium tuberculosis
GLGMLVSGVAFKE

SEQ ID NO: 86185 - protein, 13 aa, Mycobacterium tuberculosis
LGMLVSGVAFKET

SEQ ID NO: 86186 - protein, 13 aa, Mycobacterium tuberculosis
GMLVSGVAFKETM

SEQ ID NO: 86187 - protein, 13 aa, Mycobacterium tuberculosis
MLVSGVAFKETMI

SEQ ID NO: 86188 - protein, 13 aa, Mycobacterium tuberculosis
LVSGVAFKETMIG

SEQ ID NO: 86189 - protein, 13 aa, Mycobacterium tuberculosis
VSGVAFKETMIGS

SEQ ID NO: 86190 - protein, 13 aa, Mycobacterium tuberculosis
SGVAFKETMIGSF

SEQ ID NO: 86191 - protein, 13 aa, Mycobacterium tuberculosis
GVAFKETMIGSFP

SEQ ID NO: 86192 - protein, 13 aa, Mycobacterium tuberculosis
VAFKETMIGSFPI

SEQ ID NO: 86193 - protein, 13 aa, Mycobacterium tuberculosis
AFKETMIGSFPIL

SEQ ID NO: 86194 - protein, 13 aa, Mycobacterium tuberculosis
FKETMIGSFPILS

SEQ ID NO: 86195 - protein, 13 aa, Mycobacterium tuberculosis
KETMIGSFPILSV

SEQ ID NO: 86196 - protein, 13 aa, Mycobacterium tuberculosis
ETMIGSFPILSVF

SEQ ID NO: 86197 - protein, 13 aa, Mycobacterium tuberculosis
TMIGSFPILSVFG

SEQ ID NO: 86198 - protein, 13 aa, Mycobacterium tuberculosis
MIGSFPILSVFGF

SEQ ID NO: 86199 - protein, 13 aa, Mycobacterium tuberculosis
IGSFPILSVFGFV

SEQ ID NO: 86200 - protein, 13 aa, Mycobacterium tuberculosis
GSFPILSVFGFVV

SEQ ID NO: 86201 - protein, 13 aa, Mycobacterium tuberculosis
SFPILSVFGFVVM

SEQ ID NO: 86202 - protein, 13 aa, Mycobacterium tuberculosis
FPILSVFGFVVMF

SEQ ID NO: 86203 - protein, 13 aa, Mycobacterium tuberculosis
PILSVFGFVVMFG

SEQ ID NO: 86204 - protein, 13 aa, Mycobacterium tuberculosis
ILSVFGFVVMFGG

SEQ ID NO: 86205 - protein, 13 aa, Mycobacterium tuberculosis
LSVFGFVVMFGGV

SEQ ID NO: 86206 - protein, 13 aa, Mycobacterium tuberculosis
SVFGFVVMFGGVV

SEQ ID NO: 86207 - protein, 13 aa, Mycobacterium tuberculosis
VFGFVVMFGGVVY

SEQ ID NO: 86208 - protein, 13 aa, Mycobacterium tuberculosis
FGFVVMFGGVVYA

SEQ ID NO: 86209 - protein, 13 aa, Mycobacterium tuberculosis
GFVVMFGGVVYAI

SEQ ID NO: 86210 - protein, 13 aa, Mycobacterium tuberculosis
FVVMFGGVVYAIT

SEQ ID NO: 86211 - protein, 13 aa, Mycobacterium tuberculosis
VVMFGGVVYAITG

SEQ ID NO: 86212 - protein, 13 aa, Mycobacterium tuberculosis
VMFGGVVYAITGP

SEQ ID NO: 86213 - protein, 13 aa, Mycobacterium tuberculosis
MFGGVVYAITGPR

SEQ ID NO: 86214 - protein, 13 aa, Mycobacterium tuberculosis
FGGVVYAITGPRL

SEQ ID NO: 86215 - protein, 13 aa, Mycobacterium tuberculosis
GGVVYAITGPRLS

SEQ ID NO: 86216 - protein, 13 aa, Mycobacterium tuberculosis
GVVYAITGPRLSG

SEQ ID NO: 86217 - protein, 13 aa, Mycobacterium tuberculosis
VVYAITGPRLSGR

SEQ ID NO: 86218 - protein, 13 aa, Mycobacterium tuberculosis
VYAITGPRLSGRM

SEQ ID NO: 86219 - protein, 13 aa, Mycobacterium tuberculosis
YAITGPRLSGRMD

SEQ ID NO: 86220 - protein, 13 aa, Mycobacterium tuberculosis
AITGPRLSGRMDR

SEQ ID NO: 86221 - protein, 13 aa, Mycobacterium tuberculosis
ITGPRLSGRMDRG

SEQ ID NO: 86222 - protein, 13 aa, Mycobacterium tuberculosis
TGPRLSGRMDRGG

SEQ ID NO: 86223 - protein, 13 aa, Mycobacterium tuberculosis
GPRLSGRMDRGGS

SEQ ID NO: 86224 - protein, 13 aa, Mycobacterium tuberculosis
PRLSGRMDRGGSA

SEQ ID NO: 86225 - protein, 13 aa, Mycobacterium tuberculosis
RLSGRMDRGGSAA

SEQ ID NO: 86226 - protein, 13 aa, Mycobacterium tuberculosis
LSGRMDRGGSAAG

SEQ ID NO: 86227 - protein, 13 aa, Mycobacterium tuberculosis
SGRMDRGGSAAGA

SEQ ID NO: 86228 - protein, 13 aa, Mycobacterium tuberculosis
GRMDRGGSAAGAS

SEQ ID NO: 86229 - protein, 13 aa, Mycobacterium tuberculosis
RMDRGGSAAGASR

SEQ ID NO: 86230 - protein, 13 aa, Mycobacterium tuberculosis
MDRGGSAAGASRQ

SEQ ID NO: 86231 - protein, 13 aa, Mycobacterium tuberculosis
DRGGSAAGASRQR

SEQ ID NO: 86232 - protein, 13 aa, Mycobacterium tuberculosis
RGGSAAGASRQRR

SEQ ID NO: 86233 - protein, 13 aa, Mycobacterium tuberculosis
GGSAAGASRQRRT

SEQ ID NO: 86234 - protein, 13 aa, Mycobacterium tuberculosis
GSAAGASRQRRTK

SEQ ID NO: 86235 - protein, 13 aa, Mycobacterium tuberculosis
SAAGASRQRRTKG

SEQ ID NO: 86236 - protein, 13 aa, Mycobacterium tuberculosis
AAGASRQRRTKGA

SEQ ID NO: 86237 - protein, 13 aa, Mycobacterium tuberculosis
AGASRQRRTKGAG

SEQ ID NO: 86238 - protein, 13 aa, Mycobacterium tuberculosis
GASRQRRTKGAGG

SEQ ID NO: 86239 - protein, 13 aa, Mycobacterium tuberculosis
ASRQRRTKGAGGS

SEQ ID NO: 86240 - protein, 13 aa, Mycobacterium tuberculosis
SRQRRTKGAGGSF

SEQ ID NO: 86241 - protein, 13 aa, Mycobacterium tuberculosis
RQRRTKGAGGSFT

SEQ ID NO: 86242 - protein, 13 aa, Mycobacterium tuberculosis
QRRTKGAGGSFTS

SEQ ID NO: 86243 - protein, 13 aa, Mycobacterium tuberculosis
RRTKGAGGSFTSR

SEQ ID NO: 86244 - protein, 13 aa, Mycobacterium tuberculosis
RTKGAGGSFTSRM

SEQ ID NO: 86245 - protein, 13 aa, Mycobacterium tuberculosis
TKGAGGSFTSRME

SEQ ID NO: 86246 - protein, 13 aa, Mycobacterium tuberculosis
KGAGGSFTSRMED

SEQ ID NO: 86247 - protein, 13 aa, Mycobacterium tuberculosis
GAGGSFTSRMEDR

SEQ ID NO: 86248 - protein, 13 aa, Mycobacterium tuberculosis
AGGSFTSRMEDRF

SEQ ID NO: 86249 - protein, 13 aa, Mycobacterium tuberculosis
GGSFTSRMEDRFR

SEQ ID NO: 86250 - protein, 13 aa, Mycobacterium tuberculosis
GSFTSRMEDRFRR

SEQ ID NO: 86251 - protein, 13 aa, Mycobacterium tuberculosis
SFTSRMEDRFRRR

SEQ ID NO: 86252 - protein, 13 aa, Mycobacterium tuberculosis
FTSRMEDRFRRRF

SEQ ID NO: 86253 - protein, 13 aa, Mycobacterium tuberculosis
TSRMEDRFRRRFD

SEQ ID NO: 86254 - protein, 13 aa, Mycobacterium tuberculosis
SRMEDRFRRRFDE

SEQ ID NO: 86255 - protein, 14 aa, Mycobacterium tuberculosis
MPLSDHEQRMLDQI

SEQ ID NO: 86256 - protein, 14 aa, Mycobacterium tuberculosis
PLSDHEQRMLDQIE

SEQ ID NO: 86257 - protein, 14 aa, Mycobacterium tuberculosis
LSDHEQRMLDQIES

SEQ ID NO: 86258 - protein, 14 aa, Mycobacterium tuberculosis
SDHEQRMLDQIESA

SEQ ID NO: 86259 - protein, 14 aa, Mycobacterium tuberculosis
DHEQRMLDQIESAL

SEQ ID NO: 86260 - protein, 14 aa, Mycobacterium tuberculosis
HEQRMLDQIESALY

SEQ ID NO: 86261 - protein, 14 aa, Mycobacterium tuberculosis
EQRMLDQIESALYA

SEQ ID NO: 86262 - protein, 14 aa, Mycobacterium tuberculosis
QRMLDQIESALYAE

SEQ ID NO: 86263 - protein, 14 aa, Mycobacterium tuberculosis
RMLDQIESALYAED

SEQ ID NO: 86264 - protein, 14 aa, Mycobacterium tuberculosis
MLDQIESALYAEDP

SEQ ID NO: 86265 - protein, 14 aa, Mycobacterium tuberculosis
LDQIESALYAEDPK

SEQ ID NO: 86266 - protein, 14 aa, Mycobacterium tuberculosis
DQIESALYAEDPKF

SEQ ID NO: 86267 - protein, 14 aa, Mycobacterium tuberculosis
QIESALYAEDPKFA

SEQ ID NO: 86268 - protein, 14 aa, Mycobacterium tuberculosis
IESALYAEDPKFAS

SEQ ID NO: 86269 - protein, 14 aa, Mycobacterium tuberculosis
ESALYAEDPKFASS

SEQ ID NO: 86270 - protein, 14 aa, Mycobacterium tuberculosis
SALYAEDPKFASSV

SEQ ID NO: 86271 - protein, 14 aa, Mycobacterium tuberculosis
ALYAEDPKFASSVR

SEQ ID NO: 86272 - protein, 14 aa, Mycobacterium tuberculosis
LYAEDPKFASSVRG

SEQ ID NO: 86273 - protein, 14 aa, Mycobacterium tuberculosis
YAEDPKFASSVRGG

SEQ ID NO: 86274 - protein, 14 aa, Mycobacterium tuberculosis
AEDPKFASSVRGGG

SEQ ID NO: 86275 - protein, 14 aa, Mycobacterium tuberculosis
EDPKFASSVRGGGF

SEQ ID NO: 86276 - protein, 14 aa, Mycobacterium tuberculosis
DPKFASSVRGGGFR

SEQ ID NO: 86277 - protein, 14 aa, Mycobacterium tuberculosis
PKFASSVRGGGFRA

SEQ ID NO: 86278 - protein, 14 aa, Mycobacterium tuberculosis
KFASSVRGGGFRAP

SEQ ID NO: 86279 - protein, 14 aa, Mycobacterium tuberculosis
FASSVRGGGFRAPT

SEQ ID NO: 86280 - protein, 14 aa, Mycobacterium tuberculosis
ASSVRGGGFRAPTA

SEQ ID NO: 86281 - protein, 14 aa, Mycobacterium tuberculosis
SSVRGGGFRAPTAR

SEQ ID NO: 86282 - protein, 14 aa, Mycobacterium tuberculosis
SVRGGGFRAPTARR

SEQ ID NO: 86283 - protein, 14 aa, Mycobacterium tuberculosis
VRGGGFRAPTARRR

SEQ ID NO: 86284 - protein, 14 aa, Mycobacterium tuberculosis
RGGGFRAPTARRRL

SEQ ID NO: 86285 - protein, 14 aa, Mycobacterium tuberculosis
GGGFRAPTARRRLQ

SEQ ID NO: 86286 - protein, 14 aa, Mycobacterium tuberculosis
GGFRAPTARRRLQG

SEQ ID NO: 86287 - protein, 14 aa, Mycobacterium tuberculosis
GFRAPTARRRLQGA

SEQ ID NO: 86288 - protein, 14 aa, Mycobacterium tuberculosis
FRAPTARRRLQGAA

SEQ ID NO: 86289 - protein, 14 aa, Mycobacterium tuberculosis
RAPTARRRLQGAAL

SEQ ID NO: 86290 - protein, 14 aa, Mycobacterium tuberculosis
APTARRRLQGAALF

SEQ ID NO: 86291 - protein, 14 aa, Mycobacterium tuberculosis
PTARRRLQGAALFI

SEQ ID NO: 86292 - protein, 14 aa, Mycobacterium tuberculosis
TARRRLQGAALFII

SEQ ID NO: 86293 - protein, 14 aa, Mycobacterium tuberculosis
ARRRLQGAALFIIG

SEQ ID NO: 86294 - protein, 14 aa, Mycobacterium tuberculosis
RRRLQGAALFIIGL

SEQ ID NO: 86295 - protein, 14 aa, Mycobacterium tuberculosis
RRLQGAALFIIGLG

SEQ ID NO: 86296 - protein, 14 aa, Mycobacterium tuberculosis
RLQGAALFIIGLGM

SEQ ID NO: 86297 - protein, 14 aa, Mycobacterium tuberculosis
LQGAALFIIGLGML

SEQ ID NO: 86298 - protein, 14 aa, Mycobacterium tuberculosis
QGAALFIIGLGMLV

SEQ ID NO: 86299 - protein, 14 aa, Mycobacterium tuberculosis
GAALFIIGLGMLVS

SEQ ID NO: 86300 - protein, 14 aa, Mycobacterium tuberculosis
AALFIIGLGMLVSG

SEQ ID NO: 86301 - protein, 14 aa, Mycobacterium tuberculosis
ALFIIGLGMLVSGV

SEQ ID NO: 86302 - protein, 14 aa, Mycobacterium tuberculosis
LFIIGLGMLVSGVA

SEQ ID NO: 86303 - protein, 14 aa, Mycobacterium tuberculosis
FIIGLGMLVSGVAF

SEQ ID NO: 86304 - protein, 14 aa, Mycobacterium tuberculosis
IIGLGMLVSGVAFK

SEQ ID NO: 86305 - protein, 14 aa, Mycobacterium tuberculosis
IGLGMLVSGVAFKE

SEQ ID NO: 86306 - protein, 14 aa, Mycobacterium tuberculosis
GLGMLVSGVAFKET

SEQ ID NO: 86307 - protein, 14 aa, Mycobacterium tuberculosis
LGMLVSGVAFKETM

SEQ ID NO: 86308 - protein, 14 aa, Mycobacterium tuberculosis
GMLVSGVAFKETMI

SEQ ID NO: 86309 - protein, 14 aa, Mycobacterium tuberculosis
MLVSGVAFKETMIG

SEQ ID NO: 86310 - protein, 14 aa, Mycobacterium tuberculosis
LVSGVAFKETMIGS

SEQ ID NO: 86311 - protein, 14 aa, Mycobacterium tuberculosis
VSGVAFKETMIGSF

SEQ ID NO: 86312 - protein, 14 aa, Mycobacterium tuberculosis
SGVAFKETMIGSFP

SEQ ID NO: 86313 - protein, 14 aa, Mycobacterium tuberculosis
GVAFKETMIGSFPI

SEQ ID NO: 86314 - protein, 14 aa, Mycobacterium tuberculosis
VAFKETMIGSFPIL

SEQ ID NO: 86315 - protein, 14 aa, Mycobacterium tuberculosis
AFKETMIGSFPILS

SEQ ID NO: 86316 - protein, 14 aa, Mycobacterium tuberculosis
FKETMIGSFPILSV

SEQ ID NO: 86317 - protein, 14 aa, Mycobacterium tuberculosis
KETMIGSFPILSVF

SEQ ID NO: 86318 - protein, 14 aa, Mycobacterium tuberculosis
ETMIGSFPILSVFG

SEQ ID NO: 86319 - protein, 14 aa, Mycobacterium tuberculosis
TMIGSFPILSVFGF

SEQ ID NO: 86320 - protein, 14 aa, Mycobacterium tuberculosis
MIGSFPILSVFGFV

SEQ ID NO: 86321 - protein, 14 aa, Mycobacterium tuberculosis
IGSFPILSVFGFVV

SEQ ID NO: 86322 - protein, 14 aa, Mycobacterium tuberculosis
GSFPILSVFGFVVM

SEQ ID NO: 86323 - protein, 14 aa, Mycobacterium tuberculosis
SFPILSVFGFVVMF

SEQ ID NO: 86324 - protein, 14 aa, Mycobacterium tuberculosis
FPILSVFGFVVMFG

SEQ ID NO: 86325 - protein, 14 aa, Mycobacterium tuberculosis
PILSVFGFVVMFGG

SEQ ID NO: 86326 - protein, 14 aa, Mycobacterium tuberculosis
ILSVFGFVVMFGGV

SEQ ID NO: 86327 - protein, 14 aa, Mycobacterium tuberculosis
LSVFGFVVMFGGVV

SEQ ID NO: 86328 - protein, 14 aa, Mycobacterium tuberculosis
SVFGFVVMFGGVVY

SEQ ID NO: 86329 - protein, 14 aa, Mycobacterium tuberculosis
VFGFVVMFGGVVYA

SEQ ID NO: 86330 - protein, 14 aa, Mycobacterium tuberculosis
FGFVVMFGGVVYAI

SEQ ID NO: 86331 - protein, 14 aa, Mycobacterium tuberculosis
GFVVMFGGVVYAIT

SEQ ID NO: 86332 - protein, 14 aa, Mycobacterium tuberculosis
FVVMFGGVVYAITG

SEQ ID NO: 86333 - protein, 14 aa, Mycobacterium tuberculosis
VVMFGGVVYAITGP

SEQ ID NO: 86334 - protein, 14 aa, Mycobacterium tuberculosis
VMFGGVVYAITGPR

SEQ ID NO: 86335 - protein, 14 aa, Mycobacterium tuberculosis
MFGGVVYAITGPRL

SEQ ID NO: 86336 - protein, 14 aa, Mycobacterium tuberculosis
FGGVVYAITGPRLS

SEQ ID NO: 86337 - protein, 14 aa, Mycobacterium tuberculosis
GGVVYAITGPRLSG

SEQ ID NO: 86338 - protein, 14 aa, Mycobacterium tuberculosis
GVVYAITGPRLSGR

SEQ ID NO: 86339 - protein, 14 aa, Mycobacterium tuberculosis
VVYAITGPRLSGRM

SEQ ID NO: 86340 - protein, 14 aa, Mycobacterium tuberculosis
VYAITGPRLSGRMD

SEQ ID NO: 86341 - protein, 14 aa, Mycobacterium tuberculosis
YAITGPRLSGRMDR

SEQ ID NO: 86342 - protein, 14 aa, Mycobacterium tuberculosis
AITGPRLSGRMDRG

SEQ ID NO: 86343 - protein, 14 aa, Mycobacterium tuberculosis
ITGPRLSGRMDRGG

SEQ ID NO: 86344 - protein, 14 aa, Mycobacterium tuberculosis
TGPRLSGRMDRGGS

SEQ ID NO: 86345 - protein, 14 aa, Mycobacterium tuberculosis
GPRLSGRMDRGGSA

SEQ ID NO: 86346 - protein, 14 aa, Mycobacterium tuberculosis
PRLSGRMDRGGSAA

SEQ ID NO: 86347 - protein, 14 aa, Mycobacterium tuberculosis
RLSGRMDRGGSAAG

SEQ ID NO: 86348 - protein, 14 aa, Mycobacterium tuberculosis
LSGRMDRGGSAAGA

SEQ ID NO: 86349 - protein, 14 aa, Mycobacterium tuberculosis
SGRMDRGGSAAGAS

SEQ ID NO: 86350 - protein, 14 aa, Mycobacterium tuberculosis
GRMDRGGSAAGASR

SEQ ID NO: 86351 - protein, 14 aa, Mycobacterium tuberculosis
RMDRGGSAAGASRQ

SEQ ID NO: 86352 - protein, 14 aa, Mycobacterium tuberculosis
MDRGGSAAGASRQR

SEQ ID NO: 86353 - protein, 14 aa, Mycobacterium tuberculosis
DRGGSAAGASRQRR

SEQ ID NO: 86354 - protein, 14 aa, Mycobacterium tuberculosis
RGGSAAGASRQRRT

SEQ ID NO: 86355 - protein, 14 aa, Mycobacterium tuberculosis
GGSAAGASRQRRTK

SEQ ID NO: 86356 - protein, 14 aa, Mycobacterium tuberculosis
GSAAGASRQRRTKG

SEQ ID NO: 86357 - protein, 14 aa, Mycobacterium tuberculosis
SAAGASRQRRTKGA

SEQ ID NO: 86358 - protein, 14 aa, Mycobacterium tuberculosis
AAGASRQRRTKGAG

SEQ ID NO: 86359 - protein, 14 aa, Mycobacterium tuberculosis
AGASRQRRTKGAGG

SEQ ID NO: 86360 - protein, 14 aa, Mycobacterium tuberculosis
GASRQRRTKGAGGS

SEQ ID NO: 86361 - protein, 14 aa, Mycobacterium tuberculosis
ASRQRRTKGAGGSF

SEQ ID NO: 86362 - protein, 14 aa, Mycobacterium tuberculosis
SRQRRTKGAGGSFT

SEQ ID NO: 86363 - protein, 14 aa, Mycobacterium tuberculosis
RQRRTKGAGGSFTS

SEQ ID NO: 86364 - protein, 14 aa, Mycobacterium tuberculosis
QRRTKGAGGSFTSR

SEQ ID NO: 86365 - protein, 14 aa, Mycobacterium tuberculosis
RRTKGAGGSFTSRM

SEQ ID NO: 86366 - protein, 14 aa, Mycobacterium tuberculosis
RTKGAGGSFTSRME

SEQ ID NO: 86367 - protein, 14 aa, Mycobacterium tuberculosis
TKGAGGSFTSRMED

SEQ ID NO: 86368 - protein, 14 aa, Mycobacterium tuberculosis
KGAGGSFTSRMEDR

SEQ ID NO: 86369 - protein, 14 aa, Mycobacterium tuberculosis
GAGGSFTSRMEDRF

SEQ ID NO: 86370 - protein, 14 aa, Mycobacterium tuberculosis
AGGSFTSRMEDRFR

SEQ ID NO: 86371 - protein, 14 aa, Mycobacterium tuberculosis
GGSFTSRMEDRFRR

SEQ ID NO: 86372 - protein, 14 aa, Mycobacterium tuberculosis
GSFTSRMEDRFRRR

SEQ ID NO: 86373 - protein, 14 aa, Mycobacterium tuberculosis
SFTSRMEDRFRRRF

SEQ ID NO: 86374 - protein, 14 aa, Mycobacterium tuberculosis
FTSRMEDRFRRRFD

SEQ ID NO: 86375 - protein, 14 aa, Mycobacterium tuberculosis
TSRMEDRFRRRFDE

SEQ ID NO: 86376 - protein, 15 aa, Mycobacterium tuberculosis
MPLSDHEQRMLDQIE

SEQ ID NO: 86377 - protein, 15 aa, Mycobacterium tuberculosis
PLSDHEQRMLDQIES

SEQ ID NO: 86378 - protein, 15 aa, Mycobacterium tuberculosis
LSDHEQRMLDQIESA

SEQ ID NO: 86379 - protein, 15 aa, Mycobacterium tuberculosis
SDHEQRMLDQIESAL

SEQ ID NO: 86380 - protein, 15 aa, Mycobacterium tuberculosis
DHEQRMLDQIESALY

SEQ ID NO: 86381 - protein, 15 aa, Mycobacterium tuberculosis
HEQRMLDQIESALYA

SEQ ID NO: 86382 - protein, 15 aa, Mycobacterium tuberculosis
EQRMLDQIESALYAE

SEQ ID NO: 86383 - protein, 15 aa, Mycobacterium tuberculosis
QRMLDQIESALYAED

SEQ ID NO: 86384 - protein, 15 aa, Mycobacterium tuberculosis
RMLDQIESALYAEDP

SEQ ID NO: 86385 - protein, 15 aa, Mycobacterium tuberculosis
MLDQIESALYAEDPK

SEQ ID NO: 86386 - protein, 15 aa, Mycobacterium tuberculosis
LDQIESALYAEDPKF

SEQ ID NO: 86387 - protein, 15 aa, Mycobacterium tuberculosis
DQIESALYAEDPKFA

SEQ ID NO: 86388 - protein, 15 aa, Mycobacterium tuberculosis
QIESALYAEDPKFAS

SEQ ID NO: 86389 - protein, 15 aa, Mycobacterium tuberculosis
IESALYAEDPKFASS

SEQ ID NO: 86390 - protein, 15 aa, Mycobacterium tuberculosis
ESALYAEDPKFASSV

SEQ ID NO: 86391 - protein, 15 aa, Mycobacterium tuberculosis
SALYAEDPKFASSVR

SEQ ID NO: 86392 - protein, 15 aa, Mycobacterium tuberculosis
ALYAEDPKFASSVRG

SEQ ID NO: 86393 - protein, 15 aa, Mycobacterium tuberculosis
LYAEDPKFASSVRGG

SEQ ID NO: 86394 - protein, 15 aa, Mycobacterium tuberculosis
YAEDPKFASSVRGGG

SEQ ID NO: 86395 - protein, 15 aa, Mycobacterium tuberculosis
AEDPKFASSVRGGGF

SEQ ID NO: 86396 - protein, 15 aa, Mycobacterium tuberculosis
EDPKFASSVRGGGFR

SEQ ID NO: 86397 - protein, 15 aa, Mycobacterium tuberculosis
DPKFASSVRGGGFRA

SEQ ID NO: 86398 - protein, 15 aa, Mycobacterium tuberculosis
PKFASSVRGGGFRAP

SEQ ID NO: 86399 - protein, 15 aa, Mycobacterium tuberculosis
KFASSVRGGGFRAPT

SEQ ID NO: 86400 - protein, 15 aa, Mycobacterium tuberculosis
FASSVRGGGFRAPTA

SEQ ID NO: 86401 - protein, 15 aa, Mycobacterium tuberculosis
ASSVRGGGFRAPTAR

SEQ ID NO: 86402 - protein, 15 aa, Mycobacterium tuberculosis
SSVRGGGFRAPTARR

SEQ ID NO: 86403 - protein, 15 aa, Mycobacterium tuberculosis
SVRGGGFRAPTARRR

SEQ ID NO: 86404 - protein, 15 aa, Mycobacterium tuberculosis
VRGGGFRAPTARRRL

SEQ ID NO: 86405 - protein, 15 aa, Mycobacterium tuberculosis
RGGGFRAPTARRRLQ

SEQ ID NO: 86406 - protein, 15 aa, Mycobacterium tuberculosis
GGGFRAPTARRRLQG

SEQ ID NO: 86407 - protein, 15 aa, Mycobacterium tuberculosis
GGFRAPTARRRLQGA

SEQ ID NO: 86408 - protein, 15 aa, Mycobacterium tuberculosis
GFRAPTARRRLQGAA

SEQ ID NO: 86409 - protein, 15 aa, Mycobacterium tuberculosis
FRAPTARRRLQGAAL

SEQ ID NO: 86410 - protein, 15 aa, Mycobacterium tuberculosis
RAPTARRRLQGAALF

SEQ ID NO: 86411 - protein, 15 aa, Mycobacterium tuberculosis
APTARRRLQGAALFI

SEQ ID NO: 86412 - protein, 15 aa, Mycobacterium tuberculosis
PTARRRLQGAALFII

SEQ ID NO: 86413 - protein, 15 aa, Mycobacterium tuberculosis
TARRRLQGAALFIIG

SEQ ID NO: 86414 - protein, 15 aa, Mycobacterium tuberculosis
ARRRLQGAALFIIGL

SEQ ID NO: 86415 - protein, 15 aa, Mycobacterium tuberculosis
RRRLQGAALFIIGLG

SEQ ID NO: 86416 - protein, 15 aa, Mycobacterium tuberculosis
RRLQGAALFIIGLGM

SEQ ID NO: 86417 - protein, 15 aa, Mycobacterium tuberculosis
RLQGAALFIIGLGML

SEQ ID NO: 86418 - protein, 15 aa, Mycobacterium tuberculosis
LQGAALFIIGLGMLV

SEQ ID NO: 86419 - protein, 15 aa, Mycobacterium tuberculosis
QGAALFIIGLGMLVS

SEQ ID NO: 86420 - protein, 15 aa, Mycobacterium tuberculosis
GAALFIIGLGMLVSG

SEQ ID NO: 86421 - protein, 15 aa, Mycobacterium tuberculosis
AALFIIGLGMLVSGV

SEQ ID NO: 86422 - protein, 15 aa, Mycobacterium tuberculosis
ALFIIGLGMLVSGVA

SEQ ID NO: 86423 - protein, 15 aa, Mycobacterium tuberculosis
LFIIGLGMLVSGVAF

SEQ ID NO: 86424 - protein, 15 aa, Mycobacterium tuberculosis
FIIGLGMLVSGVAFK

SEQ ID NO: 86425 - protein, 15 aa, Mycobacterium tuberculosis
IIGLGMLVSGVAFKE

SEQ ID NO: 86426 - protein, 15 aa, Mycobacterium tuberculosis
IGLGMLVSGVAFKET

SEQ ID NO: 86427 - protein, 15 aa, Mycobacterium tuberculosis
GLGMLVSGVAFKETM

SEQ ID NO: 86428 - protein, 15 aa, Mycobacterium tuberculosis
LGMLVSGVAFKETMI

SEQ ID NO: 86429 - protein, 15 aa, Mycobacterium tuberculosis
GMLVSGVAFKETMIG

SEQ ID NO: 86430 - protein, 15 aa, Mycobacterium tuberculosis
MLVSGVAFKETMIGS

SEQ ID NO: 86431 - protein, 15 aa, Mycobacterium tuberculosis
LVSGVAFKETMIGSF

SEQ ID NO: 86432 - protein, 15 aa, Mycobacterium tuberculosis
VSGVAFKETMIGSFP

SEQ ID NO: 86433 - protein, 15 aa, Mycobacterium tuberculosis
SGVAFKETMIGSFPI

SEQ ID NO: 86434 - protein, 15 aa, Mycobacterium tuberculosis
GVAFKETMIGSFPIL

SEQ ID NO: 86435 - protein, 15 aa, Mycobacterium tuberculosis
VAFKETMIGSFPILS

SEQ ID NO: 86436 - protein, 15 aa, Mycobacterium tuberculosis
AFKETMIGSFPILSV

SEQ ID NO: 86437 - protein, 15 aa, Mycobacterium tuberculosis
FKETMIGSFPILSVF

SEQ ID NO: 86438 - protein, 15 aa, Mycobacterium tuberculosis
KETMIGSFPILSVFG

SEQ ID NO: 86439 - protein, 15 aa, Mycobacterium tuberculosis
ETMIGSFPILSVFGF

SEQ ID NO: 86440 - protein, 15 aa, Mycobacterium tuberculosis
TMIGSFPILSVFGFV

SEQ ID NO: 86441 - protein, 15 aa, Mycobacterium tuberculosis
MIGSFPILSVFGFVV

SEQ ID NO: 86442 - protein, 15 aa, Mycobacterium tuberculosis
IGSFPILSVFGFVVM

SEQ ID NO: 86443 - protein, 15 aa, Mycobacterium tuberculosis
GSFPILSVFGFVVMF

SEQ ID NO: 86444 - protein, 15 aa, Mycobacterium tuberculosis
SFPILSVFGFVVMFG

SEQ ID NO: 86445 - protein, 15 aa, Mycobacterium tuberculosis
FPILSVFGFVVMFGG

SEQ ID NO: 86446 - protein, 15 aa, Mycobacterium tuberculosis
PILSVFGFVVMFGGV

SEQ ID NO: 86447 - protein, 15 aa, Mycobacterium tuberculosis
ILSVFGFVVMFGGVV

SEQ ID NO: 86448 - protein, 15 aa, Mycobacterium tuberculosis
LSVFGFVVMFGGVVY

SEQ ID NO: 86449 - protein, 15 aa, Mycobacterium tuberculosis
SVFGFVVMFGGVVYA

SEQ ID NO: 86450 - protein, 15 aa, Mycobacterium tuberculosis
VFGFVVMFGGVVYAI

SEQ ID NO: 86451 - protein, 15 aa, Mycobacterium tuberculosis
FGFVVMFGGVVYAIT

SEQ ID NO: 86452 - protein, 15 aa, Mycobacterium tuberculosis
GFVVMFGGVVYAITG

SEQ ID NO: 86453 - protein, 15 aa, Mycobacterium tuberculosis
FVVMFGGVVYAITGP

SEQ ID NO: 86454 - protein, 15 aa, Mycobacterium tuberculosis
VVMFGGVVYAITGPR

SEQ ID NO: 86455 - protein, 15 aa, Mycobacterium tuberculosis
VMFGGVVYAITGPRL

SEQ ID NO: 86456 - protein, 15 aa, Mycobacterium tuberculosis
MFGGVVYAITGPRLS

SEQ ID NO: 86457 - protein, 15 aa, Mycobacterium tuberculosis
FGGVVYAITGPRLSG

SEQ ID NO: 86458 - protein, 15 aa, Mycobacterium tuberculosis
GGVVYAITGPRLSGR

SEQ ID NO: 86459 - protein, 15 aa, Mycobacterium tuberculosis
GVVYAITGPRLSGRM

SEQ ID NO: 86460 - protein, 15 aa, Mycobacterium tuberculosis
VVYAITGPRLSGRMD

SEQ ID NO: 86461 - protein, 15 aa, Mycobacterium tuberculosis
VYAITGPRLSGRMDR

SEQ ID NO: 86462 - protein, 15 aa, Mycobacterium tuberculosis
YAITGPRLSGRMDRG

SEQ ID NO: 86463 - protein, 15 aa, Mycobacterium tuberculosis
AITGPRLSGRMDRGG

SEQ ID NO: 86464 - protein, 15 aa, Mycobacterium tuberculosis
ITGPRLSGRMDRGGS

SEQ ID NO: 86465 - protein, 15 aa, Mycobacterium tuberculosis
TGPRLSGRMDRGGSA

SEQ ID NO: 86466 - protein, 15 aa, Mycobacterium tuberculosis
GPRLSGRMDRGGSAA

SEQ ID NO: 86467 - protein, 15 aa, Mycobacterium tuberculosis
PRLSGRMDRGGSAAG

SEQ ID NO: 86468 - protein, 15 aa, Mycobacterium tuberculosis
RLSGRMDRGGSAAGA

SEQ ID NO: 86469 - protein, 15 aa, Mycobacterium tuberculosis
LSGRMDRGGSAAGAS

SEQ ID NO: 86470 - protein, 15 aa, Mycobacterium tuberculosis
SGRMDRGGSAAGASR

SEQ ID NO: 86471 - protein, 15 aa, Mycobacterium tuberculosis
GRMDRGGSAAGASRQ

SEQ ID NO: 86472 - protein, 15 aa, Mycobacterium tuberculosis
RMDRGGSAAGASRQR

SEQ ID NO: 86473 - protein, 15 aa, Mycobacterium tuberculosis
MDRGGSAAGASRQRR

SEQ ID NO: 86474 - protein, 15 aa, Mycobacterium tuberculosis
DRGGSAAGASRQRRT

SEQ ID NO: 86475 - protein, 15 aa, Mycobacterium tuberculosis
RGGSAAGASRQRRTK

SEQ ID NO: 86476 - protein, 15 aa, Mycobacterium tuberculosis
GGSAAGASRQRRTKG

SEQ ID NO: 86477 - protein, 15 aa, Mycobacterium tuberculosis
GSAAGASRQRRTKGA

SEQ ID NO: 86478 - protein, 15 aa, Mycobacterium tuberculosis
SAAGASRQRRTKGAG

SEQ ID NO: 86479 - protein, 15 aa, Mycobacterium tuberculosis
AAGASRQRRTKGAGG

SEQ ID NO: 86480 - protein, 15 aa, Mycobacterium tuberculosis
AGASRQRRTKGAGGS

SEQ ID NO: 86481 - protein, 15 aa, Mycobacterium tuberculosis
GASRQRRTKGAGGSF

SEQ ID NO: 86482 - protein, 15 aa, Mycobacterium tuberculosis
ASRQRRTKGAGGSFT

SEQ ID NO: 86483 - protein, 15 aa, Mycobacterium tuberculosis
SRQRRTKGAGGSFTS

SEQ ID NO: 86484 - protein, 15 aa, Mycobacterium tuberculosis
RQRRTKGAGGSFTSR

SEQ ID NO: 86485 - protein, 15 aa, Mycobacterium tuberculosis
QRRTKGAGGSFTSRM

SEQ ID NO: 86486 - protein, 15 aa, Mycobacterium tuberculosis
RRTKGAGGSFTSRME

SEQ ID NO: 86487 - protein, 15 aa, Mycobacterium tuberculosis
RTKGAGGSFTSRMED

SEQ ID NO: 86488 - protein, 15 aa, Mycobacterium tuberculosis
TKGAGGSFTSRMEDR

SEQ ID NO: 86489 - protein, 15 aa, Mycobacterium tuberculosis
KGAGGSFTSRMEDRF

SEQ ID NO: 86490 - protein, 15 aa, Mycobacterium tuberculosis
GAGGSFTSRMEDRFR

SEQ ID NO: 86491 - protein, 15 aa, Mycobacterium tuberculosis
AGGSFTSRMEDRFRR

SEQ ID NO: 86492 - protein, 15 aa, Mycobacterium tuberculosis
GGSFTSRMEDRFRRR

SEQ ID NO: 86493 - protein, 15 aa, Mycobacterium tuberculosis
GSFTSRMEDRFRRRF

SEQ ID NO: 86494 - protein, 15 aa, Mycobacterium tuberculosis
SFTSRMEDRFRRRFD

SEQ ID NO: 86495 - protein, 15 aa, Mycobacterium tuberculosis
FTSRMEDRFRRRFDE

SEQ ID NO: 86496 - protein, 14 aa, Mycobacterium tuberculosis
TSRMEDRFRRRFDE

SEQ ID NO: 86497 - protein, 16 aa, Mycobacterium tuberculosis
MPLSDHEQRMLDQIES

SEQ ID NO: 86498 - protein, 16 aa, Mycobacterium tuberculosis
PLSDHEQRMLDQIESA

SEQ ID NO: 86499 - protein, 16 aa, Mycobacterium tuberculosis
LSDHEQRMLDQIESAL

SEQ ID NO: 86500 - protein, 16 aa, Mycobacterium tuberculosis
SDHEQRMLDQIESALY

SEQ ID NO: 86501 - protein, 16 aa, Mycobacterium tuberculosis
DHEQRMLDQIESALYA

SEQ ID NO: 86502 - protein, 16 aa, Mycobacterium tuberculosis
HEQRMLDQIESALYAE

SEQ ID NO: 86503 - protein, 16 aa, Mycobacterium tuberculosis
EQRMLDQIESALYAED

SEQ ID NO: 86504 - protein, 16 aa, Mycobacterium tuberculosis
QRMLDQIESALYAEDP

SEQ ID NO: 86505 - protein, 16 aa, Mycobacterium tuberculosis
RMLDQIESALYAEDPK

SEQ ID NO: 86506 - protein, 16 aa, Mycobacterium tuberculosis
MLDQIESALYAEDPKF

SEQ ID NO: 86507 - protein, 16 aa, Mycobacterium tuberculosis
LDQIESALYAEDPKFA

SEQ ID NO: 86508 - protein, 16 aa, Mycobacterium tuberculosis
DQIESALYAEDPKFAS

SEQ ID NO: 86509 - protein, 16 aa, Mycobacterium tuberculosis
QIESALYAEDPKFASS

SEQ ID NO: 86510 - protein, 16 aa, Mycobacterium tuberculosis
IESALYAEDPKFASSV

SEQ ID NO: 86511 - protein, 16 aa, Mycobacterium tuberculosis
ESALYAEDPKFASSVR

SEQ ID NO: 86512 - protein, 16 aa, Mycobacterium tuberculosis
SALYAEDPKFASSVRG

SEQ ID NO: 86513 - protein, 16 aa, Mycobacterium tuberculosis
ALYAEDPKFASSVRGG

SEQ ID NO: 86514 - protein, 16 aa, Mycobacterium tuberculosis
LYAEDPKFASSVRGGG

SEQ ID NO: 86515 - protein, 16 aa, Mycobacterium tuberculosis
YAEDPKFASSVRGGGF

SEQ ID NO: 86516 - protein, 16 aa, Mycobacterium tuberculosis
AEDPKFASSVRGGGFR

SEQ ID NO: 86517 - protein, 16 aa, Mycobacterium tuberculosis
EDPKFASSVRGGGFRA

SEQ ID NO: 86518 - protein, 16 aa, Mycobacterium tuberculosis
DPKFASSVRGGGFRAP

SEQ ID NO: 86519 - protein, 16 aa, Mycobacterium tuberculosis
PKFASSVRGGGFRAPT

SEQ ID NO: 86520 - protein, 16 aa, Mycobacterium tuberculosis
KFASSVRGGGFRAPTA

SEQ ID NO: 86521 - protein, 16 aa, Mycobacterium tuberculosis
FASSVRGGGFRAPTAR

SEQ ID NO: 86522 - protein, 16 aa, Mycobacterium tuberculosis
ASSVRGGGFRAPTARR

SEQ ID NO: 86523 - protein, 16 aa, Mycobacterium tuberculosis
SSVRGGGFRAPTARRR

SEQ ID NO: 86524 - protein, 16 aa, Mycobacterium tuberculosis
SVRGGGFRAPTARRRL

SEQ ID NO: 86525 - protein, 16 aa, Mycobacterium tuberculosis
VRGGGFRAPTARRRLQ

SEQ ID NO: 86526 - protein, 16 aa, Mycobacterium tuberculosis
RGGGFRAPTARRRLQG

SEQ ID NO: 86527 - protein, 16 aa, Mycobacterium tuberculosis
GGGFRAPTARRRLQGA

SEQ ID NO: 86528 - protein, 16 aa, Mycobacterium tuberculosis
GGFRAPTARRRLQGAA

SEQ ID NO: 86529 - protein, 16 aa, Mycobacterium tuberculosis
GFRAPTARRRLQGAAL

SEQ ID NO: 86530 - protein, 16 aa, Mycobacterium tuberculosis
FRAPTARRRLQGAALF

SEQ ID NO: 86531 - protein, 16 aa, Mycobacterium tuberculosis
RAPTARRRLQGAALFI

SEQ ID NO: 86532 - protein, 16 aa, Mycobacterium tuberculosis
APTARRRLQGAALFII

SEQ ID NO: 86533 - protein, 16 aa, Mycobacterium tuberculosis
PTARRRLQGAALFIIG

SEQ ID NO: 86534 - protein, 16 aa, Mycobacterium tuberculosis
TARRRLQGAALFIIGL

SEQ ID NO: 86535 - protein, 16 aa, Mycobacterium tuberculosis
ARRRLQGAALFIIGLG

SEQ ID NO: 86536 - protein, 16 aa, Mycobacterium tuberculosis
RRRLQGAALFIIGLGM

SEQ ID NO: 86537 - protein, 16 aa, Mycobacterium tuberculosis
RRLQGAALFIIGLGML

SEQ ID NO: 86538 - protein, 16 aa, Mycobacterium tuberculosis
RLQGAALFIIGLGMLV

SEQ ID NO: 86539 - protein, 16 aa, Mycobacterium tuberculosis
LQGAALFIIGLGMLVS

SEQ ID NO: 86540 - protein, 16 aa, Mycobacterium tuberculosis
QGAALFIIGLGMLVSG

SEQ ID NO: 86541 - protein, 16 aa, Mycobacterium tuberculosis
GAALFIIGLGMLVSGV

SEQ ID NO: 86542 - protein, 16 aa, Mycobacterium tuberculosis
AALFIIGLGMLVSGVA

SEQ ID NO: 86543 - protein, 16 aa, Mycobacterium tuberculosis
ALFIIGLGMLVSGVAF

SEQ ID NO: 86544 - protein, 16 aa, Mycobacterium tuberculosis
LFIIGLGMLVSGVAFK

SEQ ID NO: 86545 - protein, 16 aa, Mycobacterium tuberculosis
FIIGLGMLVSGVAFKE

SEQ ID NO: 86546 - protein, 16 aa, Mycobacterium tuberculosis
IIGLGMLVSGVAFKET

SEQ ID NO: 86547 - protein, 16 aa, Mycobacterium tuberculosis
IGLGMLVSGVAFKETM

SEQ ID NO: 86548 - protein, 16 aa, Mycobacterium tuberculosis
GLGMLVSGVAFKETMI

SEQ ID NO: 86549 - protein, 16 aa, Mycobacterium tuberculosis
LGMLVSGVAFKETMIG

SEQ ID NO: 86550 - protein, 16 aa, Mycobacterium tuberculosis
GMLVSGVAFKETMIGS

SEQ ID NO: 86551 - protein, 16 aa, Mycobacterium tuberculosis
MLVSGVAFKETMIGSF

SEQ ID NO: 86552 - protein, 16 aa, Mycobacterium tuberculosis
LVSGVAFKETMIGSFP

SEQ ID NO: 86553 - protein, 16 aa, Mycobacterium tuberculosis
VSGVAFKETMIGSFPI

SEQ ID NO: 86554 - protein, 16 aa, Mycobacterium tuberculosis
SGVAFKETMIGSFPIL

SEQ ID NO: 86555 - protein, 16 aa, Mycobacterium tuberculosis
GVAFKETMIGSFPILS

SEQ ID NO: 86556 - protein, 16 aa, Mycobacterium tuberculosis
VAFKETMIGSFPILSV

SEQ ID NO: 86557 - protein, 16 aa, Mycobacterium tuberculosis
AFKETMIGSFPILSVF

SEQ ID NO: 86558 - protein, 16 aa, Mycobacterium tuberculosis
FKETMIGSFPILSVFG

SEQ ID NO: 86559 - protein, 16 aa, Mycobacterium tuberculosis
KETMIGSFPILSVFGF

SEQ ID NO: 86560 - protein, 16 aa, Mycobacterium tuberculosis
ETMIGSFPILSVFGFV

SEQ ID NO: 86561 - protein, 16 aa, Mycobacterium tuberculosis
TMIGSFPILSVFGFVV

SEQ ID NO: 86562 - protein, 16 aa, Mycobacterium tuberculosis
MIGSFPILSVFGFVVM

SEQ ID NO: 86563 - protein, 16 aa, Mycobacterium tuberculosis
IGSFPILSVFGFVVMF

SEQ ID NO: 86564 - protein, 16 aa, Mycobacterium tuberculosis
GSFPILSVFGFVVMFG

SEQ ID NO: 86565 - protein, 16 aa, Mycobacterium tuberculosis
SFPILSVFGFVVMFGG

SEQ ID NO: 86566 - protein, 16 aa, Mycobacterium tuberculosis
FPILSVFGFVVMFGGV

SEQ ID NO: 86567 - protein, 16 aa, Mycobacterium tuberculosis
PILSVFGFVVMFGGVV

SEQ ID NO: 86568 - protein, 16 aa, Mycobacterium tuberculosis
ILSVFGFVVMFGGVVY

SEQ ID NO: 86569 - protein, 16 aa, Mycobacterium tuberculosis
LSVFGFVVMFGGVVYA

SEQ ID NO: 86570 - protein, 16 aa, Mycobacterium tuberculosis
SVFGFVVMFGGVVYAI

SEQ ID NO: 86571 - protein, 16 aa, Mycobacterium tuberculosis
VFGFVVMFGGVVYAIT

SEQ ID NO: 86572 - protein, 16 aa, Mycobacterium tuberculosis
FGFVVMFGGVVYAITG

SEQ ID NO: 86573 - protein, 16 aa, Mycobacterium tuberculosis
GFVVMFGGVVYAITGP

SEQ ID NO: 86574 - protein, 16 aa, Mycobacterium tuberculosis
FVVMFGGVVYAITGPR

SEQ ID NO: 86575 - protein, 16 aa, Mycobacterium tuberculosis
VVMFGGVVYAITGPRL

SEQ ID NO: 86576 - protein, 16 aa, Mycobacterium tuberculosis
VMFGGVVYAITGPRLS

SEQ ID NO: 86577 - protein, 16 aa, Mycobacterium tuberculosis
MFGGVVYAITGPRLSG

SEQ ID NO: 86578 - protein, 16 aa, Mycobacterium tuberculosis
FGGVVYAITGPRLSGR

SEQ ID NO: 86579 - protein, 16 aa, Mycobacterium tuberculosis
GGVVYAITGPRLSGRM

SEQ ID NO: 86580 - protein, 16 aa, Mycobacterium tuberculosis
GVVYAITGPRLSGRMD

SEQ ID NO: 86581 - protein, 16 aa, Mycobacterium tuberculosis
VVYAITGPRLSGRMDR

SEQ ID NO: 86582 - protein, 16 aa, Mycobacterium tuberculosis
VYAITGPRLSGRMDRG

SEQ ID NO: 86583 - protein, 16 aa, Mycobacterium tuberculosis
YAITGPRLSGRMDRGG

SEQ ID NO: 86584 - protein, 16 aa, Mycobacterium tuberculosis
AITGPRLSGRMDRGGS

SEQ ID NO: 86585 - protein, 16 aa, Mycobacterium tuberculosis
ITGPRLSGRMDRGGSA

SEQ ID NO: 86586 - protein, 16 aa, Mycobacterium tuberculosis
TGPRLSGRMDRGGSAA

SEQ ID NO: 86587 - protein, 16 aa, Mycobacterium tuberculosis
GPRLSGRMDRGGSAAG

SEQ ID NO: 86588 - protein, 16 aa, Mycobacterium tuberculosis
PRLSGRMDRGGSAAGA

SEQ ID NO: 86589 - protein, 16 aa, Mycobacterium tuberculosis
RLSGRMDRGGSAAGAS

SEQ ID NO: 86590 - protein, 16 aa, Mycobacterium tuberculosis
LSGRMDRGGSAAGASR

SEQ ID NO: 86591 - protein, 16 aa, Mycobacterium tuberculosis
SGRMDRGGSAAGASRQ

SEQ ID NO: 86592 - protein, 16 aa, Mycobacterium tuberculosis
GRMDRGGSAAGASRQR

SEQ ID NO: 86593 - protein, 16 aa, Mycobacterium tuberculosis
RMDRGGSAAGASRQRR

SEQ ID NO: 86594 - protein, 16 aa, Mycobacterium tuberculosis
MDRGGSAAGASRQRRT

SEQ ID NO: 86595 - protein, 16 aa, Mycobacterium tuberculosis
DRGGSAAGASRQRRTK

SEQ ID NO: 86596 - protein, 16 aa, Mycobacterium tuberculosis
RGGSAAGASRQRRTKG

SEQ ID NO: 86597 - protein, 16 aa, Mycobacterium tuberculosis
GGSAAGASRQRRTKGA

SEQ ID NO: 86598 - protein, 16 aa, Mycobacterium tuberculosis
GSAAGASRQRRTKGAG

SEQ ID NO: 86599 - protein, 16 aa, Mycobacterium tuberculosis
SAAGASRQRRTKGAGG

SEQ ID NO: 86600 - protein, 16 aa, Mycobacterium tuberculosis
AAGASRQRRTKGAGGS

SEQ ID NO: 86601 - protein, 16 aa, Mycobacterium tuberculosis
AGASRQRRTKGAGGSF

SEQ ID NO: 86602 - protein, 16 aa, Mycobacterium tuberculosis
GASRQRRTKGAGGSFT

SEQ ID NO: 86603 - protein, 16 aa, Mycobacterium tuberculosis
ASRQRRTKGAGGSFTS

SEQ ID NO: 86604 - protein, 16 aa, Mycobacterium tuberculosis
SRQRRTKGAGGSFTSR

SEQ ID NO: 86605 - protein, 16 aa, Mycobacterium tuberculosis
RQRRTKGAGGSFTSRM

SEQ ID NO: 86606 - protein, 16 aa, Mycobacterium tuberculosis
QRRTKGAGGSFTSRME

SEQ ID NO: 86607 - protein, 16 aa, Mycobacterium tuberculosis
RRTKGAGGSFTSRMED

SEQ ID NO: 86608 - protein, 16 aa, Mycobacterium tuberculosis
RTKGAGGSFTSRMEDR

SEQ ID NO: 86609 - protein, 16 aa, Mycobacterium tuberculosis
TKGAGGSFTSRMEDRF

SEQ ID NO: 86610 - protein, 16 aa, Mycobacterium tuberculosis
KGAGGSFTSRMEDRFR

SEQ ID NO: 86611 - protein, 16 aa, Mycobacterium tuberculosis
GAGGSFTSRMEDRFRR

SEQ ID NO: 86612 - protein, 16 aa, Mycobacterium tuberculosis
AGGSFTSRMEDRFRRR

SEQ ID NO: 86613 - protein, 16 aa, Mycobacterium tuberculosis
GGSFTSRMEDRFRRRF

SEQ ID NO: 86614 - protein, 16 aa, Mycobacterium tuberculosis
GSFTSRMEDRFRRRFD

SEQ ID NO: 86615 - protein, 16 aa, Mycobacterium tuberculosis
SFTSRMEDRFRRRFDE

SEQ ID NO: 86616 - protein, 13 aa, Mycobacterium tuberculosis
MRLPGRHVLYALS

SEQ ID NO: 86617 - protein, 13 aa, Mycobacterium tuberculosis
RLPGRHVLYALSA

SEQ ID NO: 86618 - protein, 13 aa, Mycobacterium tuberculosis
LPGRHVLYALSAV

SEQ ID NO: 86619 - protein, 13 aa, Mycobacterium tuberculosis
PGRHVLYALSAVT

SEQ ID NO: 86620 - protein, 13 aa, Mycobacterium tuberculosis
GRHVLYALSAVTM

SEQ ID NO: 86621 - protein, 13 aa, Mycobacterium tuberculosis
RHVLYALSAVTML

SEQ ID NO: 86622 - protein, 13 aa, Mycobacterium tuberculosis
HVLYALSAVTMLA

SEQ ID NO: 86623 - protein, 13 aa, Mycobacterium tuberculosis
VLYALSAVTMLAA

SEQ ID NO: 86624 - protein, 13 aa, Mycobacterium tuberculosis
LYALSAVTMLAAC

SEQ ID NO: 86625 - protein, 13 aa, Mycobacterium tuberculosis
YALSAVTMLAACS

SEQ ID NO: 86626 - protein, 13 aa, Mycobacterium tuberculosis
ALSAVTMLAACSS

SEQ ID NO: 86627 - protein, 13 aa, Mycobacterium tuberculosis
LSAVTMLAACSSN

SEQ ID NO: 86628 - protein, 13 aa, Mycobacterium tuberculosis
SAVTMLAACSSNG

SEQ ID NO: 86629 - protein, 13 aa, Mycobacterium tuberculosis
AVTMLAACSSNGA

SEQ ID NO: 86630 - protein, 13 aa, Mycobacterium tuberculosis
VTMLAACSSNGAR

SEQ ID NO: 86631 - protein, 13 aa, Mycobacterium tuberculosis
TMLAACSSNGARG

SEQ ID NO: 86632 - protein, 13 aa, Mycobacterium tuberculosis
MLAACSSNGARGG

SEQ ID NO: 86633 - protein, 13 aa, Mycobacterium tuberculosis
LAACSSNGARGGI

SEQ ID NO: 86634 - protein, 13 aa, Mycobacterium tuberculosis
AACSSNGARGGIA

SEQ ID NO: 86635 - protein, 13 aa, Mycobacterium tuberculosis
ACSSNGARGGIAS

SEQ ID NO: 86636 - protein, 13 aa, Mycobacterium tuberculosis
CSSNGARGGIAST

SEQ ID NO: 86637 - protein, 13 aa, Mycobacterium tuberculosis
SSNGARGGIASTN

SEQ ID NO: 86638 - protein, 13 aa, Mycobacterium tuberculosis
SNGARGGIASTNM

SEQ ID NO: 86639 - protein, 13 aa, Mycobacterium tuberculosis
NGARGGIASTNMN

SEQ ID NO: 86640 - protein, 13 aa, Mycobacterium tuberculosis
GARGGIASTNMNP

SEQ ID NO: 86641 - protein, 13 aa, Mycobacterium tuberculosis
ARGGIASTNMNPT

SEQ ID NO: 86642 - protein, 13 aa, Mycobacterium tuberculosis
RGGIASTNMNPTN

SEQ ID NO: 86643 - protein, 13 aa, Mycobacterium tuberculosis
GGIASTNMNPTNP

SEQ ID NO: 86644 - protein, 13 aa, Mycobacterium tuberculosis
GIASTNMNPTNPP

SEQ ID NO: 86645 - protein, 13 aa, Mycobacterium tuberculosis
IASTNMNPTNPPA

SEQ ID NO: 86646 - protein, 13 aa, Mycobacterium tuberculosis
ASTNMNPTNPPAT

SEQ ID NO: 86647 - protein, 13 aa, Mycobacterium tuberculosis
STNMNPTNPPATA

SEQ ID NO: 86648 - protein, 13 aa, Mycobacterium tuberculosis
TNMNPTNPPATAE

SEQ ID NO: 86649 - protein, 13 aa, Mycobacterium tuberculosis
NMNPTNPPATAET

SEQ ID NO: 86650 - protein, 13 aa, Mycobacterium tuberculosis
MNPTNPPATAETA

SEQ ID NO: 86651 - protein, 13 aa, Mycobacterium tuberculosis
NPTNPPATAETAT

SEQ ID NO: 86652 - protein, 13 aa, Mycobacterium tuberculosis
PTNPPATAETATV

SEQ ID NO: 86653 - protein, 13 aa, Mycobacterium tuberculosis
TNPPATAETATVS

SEQ ID NO: 86654 - protein, 13 aa, Mycobacterium tuberculosis
NPPATAETATVSP

SEQ ID NO: 86655 - protein, 13 aa, Mycobacterium tuberculosis
PPATAETATVSPT

SEQ ID NO: 86656 - protein, 13 aa, Mycobacterium tuberculosis
PATAETATVSPTP

SEQ ID NO: 86657 - protein, 13 aa, Mycobacterium tuberculosis
ATAETATVSPTPA

SEQ ID NO: 86658 - protein, 13 aa, Mycobacterium tuberculosis
TAETATVSPTPAP

SEQ ID NO: 86659 - protein, 13 aa, Mycobacterium tuberculosis
AETATVSPTPAPQ

SEQ ID NO: 86660 - protein, 13 aa, Mycobacterium tuberculosis
ETATVSPTPAPQS

SEQ ID NO: 86661 - protein, 13 aa, Mycobacterium tuberculosis
TATVSPTPAPQSA

SEQ ID NO: 86662 - protein, 13 aa, Mycobacterium tuberculosis
ATVSPTPAPQSAR

SEQ ID NO: 86663 - protein, 13 aa, Mycobacterium tuberculosis
TVSPTPAPQSART

SEQ ID NO: 86664 - protein, 13 aa, Mycobacterium tuberculosis
VSPTPAPQSARTE

SEQ ID NO: 86665 - protein, 13 aa, Mycobacterium tuberculosis
SPTPAPQSARTET

SEQ ID NO: 86666 - protein, 13 aa, Mycobacterium tuberculosis
PTPAPQSARTETW

SEQ ID NO: 86667 - protein, 13 aa, Mycobacterium tuberculosis
TPAPQSARTETWI

SEQ ID NO: 86668 - protein, 13 aa, Mycobacterium tuberculosis
PAPQSARTETWIN

SEQ ID NO: 86669 - protein, 13 aa, Mycobacterium tuberculosis
APQSARTETWINL

SEQ ID NO: 86670 - protein, 13 aa, Mycobacterium tuberculosis
PQSARTETWINLQ

SEQ ID NO: 86671 - protein, 13 aa, Mycobacterium tuberculosis
QSARTETWINLQV

SEQ ID NO: 86672 - protein, 13 aa, Mycobacterium tuberculosis
SARTETWINLQVG

SEQ ID NO: 86673 - protein, 13 aa, Mycobacterium tuberculosis
ARTETWINLQVGD

SEQ ID NO: 86674 - protein, 13 aa, Mycobacterium tuberculosis
RTETWINLQVGDC

SEQ ID NO: 86675 - protein, 13 aa, Mycobacterium tuberculosis
TETWINLQVGDCL

SEQ ID NO: 86676 - protein, 13 aa, Mycobacterium tuberculosis
ETWINLQVGDCLA

SEQ ID NO: 86677 - protein, 13 aa, Mycobacterium tuberculosis
TWINLQVGDCLAD

SEQ ID NO: 86678 - protein, 13 aa, Mycobacterium tuberculosis
WINLQVGDCLADL

SEQ ID NO: 86679 - protein, 13 aa, Mycobacterium tuberculosis
INLQVGDCLADLP

SEQ ID NO: 86680 - protein, 13 aa, Mycobacterium tuberculosis
NLQVGDCLADLPP

SEQ ID NO: 86681 - protein, 13 aa, Mycobacterium tuberculosis
LQVGDCLADLPPA

SEQ ID NO: 86682 - protein, 13 aa, Mycobacterium tuberculosis
QVGDCLADLPPAD

SEQ ID NO: 86683 - protein, 13 aa, Mycobacterium tuberculosis
VGDCLADLPPADL

SEQ ID NO: 86684 - protein, 13 aa, Mycobacterium tuberculosis
GDCLADLPPADLS

SEQ ID NO: 86685 - protein, 13 aa, Mycobacterium tuberculosis
DCLADLPPADLSR

SEQ ID NO: 86686 - protein, 13 aa, Mycobacterium tuberculosis
CLADLPPADLSRI

SEQ ID NO: 86687 - protein, 13 aa, Mycobacterium tuberculosis
LADLPPADLSRIT

SEQ ID NO: 86688 - protein, 13 aa, Mycobacterium tuberculosis
ADLPPADLSRITV

SEQ ID NO: 86689 - protein, 13 aa, Mycobacterium tuberculosis
DLPPADLSRITVT

SEQ ID NO: 86690 - protein, 13 aa, Mycobacterium tuberculosis
LPPADLSRITVTI

SEQ ID NO: 86691 - protein, 13 aa, Mycobacterium tuberculosis
PPADLSRITVTIV

SEQ ID NO: 86692 - protein, 13 aa, Mycobacterium tuberculosis
PADLSRITVTIVD

SEQ ID NO: 86693 - protein, 13 aa, Mycobacterium tuberculosis
ADLSRITVTIVDC

SEQ ID NO: 86694 - protein, 13 aa, Mycobacterium tuberculosis
DLSRITVTIVDCA

SEQ ID NO: 86695 - protein, 13 aa, Mycobacterium tuberculosis
LSRITVTIVDCAT

SEQ ID NO: 86696 - protein, 13 aa, Mycobacterium tuberculosis
SRITVTIVDCATA

SEQ ID NO: 86697 - protein, 13 aa, Mycobacterium tuberculosis
RITVTIVDCATAH

SEQ ID NO: 86698 - protein, 13 aa, Mycobacterium tuberculosis
ITVTIVDCATAHS

SEQ ID NO: 86699 - protein, 13 aa, Mycobacterium tuberculosis
TVTIVDCATAHSA

SEQ ID NO: 86700 - protein, 13 aa, Mycobacterium tuberculosis
VTIVDCATAHSAE

SEQ ID NO: 86701 - protein, 13 aa, Mycobacterium tuberculosis
TIVDCATAHSAEV

SEQ ID NO: 86702 - protein, 13 aa, Mycobacterium tuberculosis
IVDCATAHSAEVY

SEQ ID NO: 86703 - protein, 13 aa, Mycobacterium tuberculosis
VDCATAHSAEVYL

SEQ ID NO: 86704 - protein, 13 aa, Mycobacterium tuberculosis
DCATAHSAEVYLR

SEQ ID NO: 86705 - protein, 13 aa, Mycobacterium tuberculosis
CATAHSAEVYLRA

SEQ ID NO: 86706 - protein, 13 aa, Mycobacterium tuberculosis
ATAHSAEVYLRAP

SEQ ID NO: 86707 - protein, 13 aa, Mycobacterium tuberculosis
TAHSAEVYLRAPV

SEQ ID NO: 86708 - protein, 13 aa, Mycobacterium tuberculosis
AHSAEVYLRAPVA

SEQ ID NO: 86709 - protein, 13 aa, Mycobacterium tuberculosis
HSAEVYLRAPVAV

SEQ ID NO: 86710 - protein, 13 aa, Mycobacterium tuberculosis
SAEVYLRAPVAVD

SEQ ID NO: 86711 - protein, 13 aa, Mycobacterium tuberculosis
AEVYLRAPVAVDA

SEQ ID NO: 86712 - protein, 13 aa, Mycobacterium tuberculosis
EVYLRAPVAVDAA

SEQ ID NO: 86713 - protein, 13 aa, Mycobacterium tuberculosis
VYLRAPVAVDAAV

SEQ ID NO: 86714 - protein, 13 aa, Mycobacterium tuberculosis
YLRAPVAVDAAVV

SEQ ID NO: 86715 - protein, 13 aa, Mycobacterium tuberculosis
LRAPVAVDAAVVS

SEQ ID NO: 86716 - protein, 13 aa, Mycobacterium tuberculosis
RAPVAVDAAVVSM

SEQ ID NO: 86717 - protein, 13 aa, Mycobacterium tuberculosis
APVAVDAAVVSMA

SEQ ID NO: 86718 - protein, 13 aa, Mycobacterium tuberculosis
PVAVDAAVVSMAN

SEQ ID NO: 86719 - protein, 13 aa, Mycobacterium tuberculosis
VAVDAAVVSMANR

SEQ ID NO: 86720 - protein, 13 aa, Mycobacterium tuberculosis
AVDAAVVSMANRD

SEQ ID NO: 86721 - protein, 13 aa, Mycobacterium tuberculosis
VDAAVVSMANRDC

SEQ ID NO: 86722 - protein, 13 aa, Mycobacterium tuberculosis
DAAVVSMANRDCA

SEQ ID NO: 86723 - protein, 13 aa, Mycobacterium tuberculosis
AAVVSMANRDCAA

SEQ ID NO: 86724 - protein, 13 aa, Mycobacterium tuberculosis
AVVSMANRDCAAG

SEQ ID NO: 86725 - protein, 13 aa, Mycobacterium tuberculosis
VVSMANRDCAAGF

SEQ ID NO: 86726 - protein, 13 aa, Mycobacterium tuberculosis
VSMANRDCAAGFA

SEQ ID NO: 86727 - protein, 13 aa, Mycobacterium tuberculosis
SMANRDCAAGFAP

SEQ ID NO: 86728 - protein, 13 aa, Mycobacterium tuberculosis
MANRDCAAGFAPY

SEQ ID NO: 86729 - protein, 13 aa, Mycobacterium tuberculosis
ANRDCAAGFAPYT

SEQ ID NO: 86730 - protein, 13 aa, Mycobacterium tuberculosis
NRDCAAGFAPYTG

SEQ ID NO: 86731 - protein, 13 aa, Mycobacterium tuberculosis
RDCAAGFAPYTGQ

SEQ ID NO: 86732 - protein, 13 aa, Mycobacterium tuberculosis
DCAAGFAPYTGQS

SEQ ID NO: 86733 - protein, 13 aa, Mycobacterium tuberculosis
CAAGFAPYTGQSV

SEQ ID NO: 86734 - protein, 13 aa, Mycobacterium tuberculosis
AAGFAPYTGQSVD

SEQ ID NO: 86735 - protein, 13 aa, Mycobacterium tuberculosis
AGFAPYTGQSVDT

SEQ ID NO: 86736 - protein, 13 aa, Mycobacterium tuberculosis
GFAPYTGQSVDTS

SEQ ID NO: 86737 - protein, 13 aa, Mycobacterium tuberculosis
FAPYTGQSVDTSP

SEQ ID NO: 86738 - protein, 13 aa, Mycobacterium tuberculosis
APYTGQSVDTSPY

SEQ ID NO: 86739 - protein, 13 aa, Mycobacterium tuberculosis
PYTGQSVDTSPYS

SEQ ID NO: 86740 - protein, 13 aa, Mycobacterium tuberculosis
YTGQSVDTSPYSV

SEQ ID NO: 86741 - protein, 13 aa, Mycobacterium tuberculosis
TGQSVDTSPYSVA

SEQ ID NO: 86742 - protein, 13 aa, Mycobacterium tuberculosis
GQSVDTSPYSVAY

SEQ ID NO: 86743 - protein, 13 aa, Mycobacterium tuberculosis
QSVDTSPYSVAYL

SEQ ID NO: 86744 - protein, 13 aa, Mycobacterium tuberculosis
SVDTSPYSVAYLI

SEQ ID NO: 86745 - protein, 13 aa, Mycobacterium tuberculosis
VDTSPYSVAYLID

SEQ ID NO: 86746 - protein, 13 aa, Mycobacterium tuberculosis
DTSPYSVAYLIDS

SEQ ID NO: 86747 - protein, 13 aa, Mycobacterium tuberculosis
TSPYSVAYLIDSH

SEQ ID NO: 86748 - protein, 13 aa, Mycobacterium tuberculosis
SPYSVAYLIDSHQ

SEQ ID NO: 86749 - protein, 13 aa, Mycobacterium tuberculosis
PYSVAYLIDSHQD

SEQ ID NO: 86750 - protein, 13 aa, Mycobacterium tuberculosis
YSVAYLIDSHQDR

SEQ ID NO: 86751 - protein, 13 aa, Mycobacterium tuberculosis
SVAYLIDSHQDRT

SEQ ID NO: 86752 - protein, 13 aa, Mycobacterium tuberculosis
VAYLIDSHQDRTG

SEQ ID NO: 86753 - protein, 13 aa, Mycobacterium tuberculosis
AYLIDSHQDRTGA

SEQ ID NO: 86754 - protein, 13 aa, Mycobacterium tuberculosis
YLIDSHQDRTGAD

SEQ ID NO: 86755 - protein, 13 aa, Mycobacterium tuberculosis
LIDSHQDRTGADP

SEQ ID NO: 86756 - protein, 13 aa, Mycobacterium tuberculosis
IDSHQDRTGADPT

SEQ ID NO: 86757 - protein, 13 aa, Mycobacterium tuberculosis
DSHQDRTGADPTP

SEQ ID NO: 86758 - protein, 13 aa, Mycobacterium tuberculosis
SHQDRTGADPTPS

SEQ ID NO: 86759 - protein, 13 aa, Mycobacterium tuberculosis
HQDRTGADPTPST

SEQ ID NO: 86760 - protein, 13 aa, Mycobacterium tuberculosis
QDRTGADPTPSTV

SEQ ID NO: 86761 - protein, 13 aa, Mycobacterium tuberculosis
DRTGADPTPSTVI

SEQ ID NO: 86762 - protein, 13 aa, Mycobacterium tuberculosis
RTGADPTPSTVIC

SEQ ID NO: 86763 - protein, 13 aa, Mycobacterium tuberculosis
TGADPTPSTVICL

SEQ ID NO: 86764 - protein, 13 aa, Mycobacterium tuberculosis
GADPTPSTVICLL

SEQ ID NO: 86765 - protein, 13 aa, Mycobacterium tuberculosis
ADPTPSTVICLLQ

SEQ ID NO: 86766 - protein, 13 aa, Mycobacterium tuberculosis
DPTPSTVICLLQP

SEQ ID NO: 86767 - protein, 13 aa, Mycobacterium tuberculosis
PTPSTVICLLQPA

SEQ ID NO: 86768 - protein, 13 aa, Mycobacterium tuberculosis
TPSTVICLLQPAN

SEQ ID NO: 86769 - protein, 13 aa, Mycobacterium tuberculosis
PSTVICLLQPANG

SEQ ID NO: 86770 - protein, 13 aa, Mycobacterium tuberculosis
STVICLLQPANGQ

SEQ ID NO: 86771 - protein, 13 aa, Mycobacterium tuberculosis
TVICLLQPANGQL

SEQ ID NO: 86772 - protein, 13 aa, Mycobacterium tuberculosis
VICLLQPANGQLL

SEQ ID NO: 86773 - protein, 13 aa, Mycobacterium tuberculosis
ICLLQPANGQLLT

SEQ ID NO: 86774 - protein, 13 aa, Mycobacterium tuberculosis
CLLQPANGQLLTG

SEQ ID NO: 86775 - protein, 13 aa, Mycobacterium tuberculosis
LLQPANGQLLTGS

SEQ ID NO: 86776 - protein, 13 aa, Mycobacterium tuberculosis
LQPANGQLLTGSA

SEQ ID NO: 86777 - protein, 13 aa, Mycobacterium tuberculosis
QPANGQLLTGSAR

SEQ ID NO: 86778 - protein, 13 aa, Mycobacterium tuberculosis
PANGQLLTGSARR

SEQ ID NO: 86779 - protein, 14 aa, Mycobacterium tuberculosis
MRLPGRHVLYALSA

SEQ ID NO: 86780 - protein, 14 aa, Mycobacterium tuberculosis
RLPGRHVLYALSAV

SEQ ID NO: 86781 - protein, 14 aa, Mycobacterium tuberculosis
LPGRHVLYALSAVT

SEQ ID NO: 86782 - protein, 14 aa, Mycobacterium tuberculosis
PGRHVLYALSAVTM

SEQ ID NO: 86783 - protein, 14 aa, Mycobacterium tuberculosis
GRHVLYALSAVTML

SEQ ID NO: 86784 - protein, 14 aa, Mycobacterium tuberculosis
RHVLYALSAVTMLA

SEQ ID NO: 86785 - protein, 14 aa, Mycobacterium tuberculosis
HVLYALSAVTMLAA

SEQ ID NO: 86786 - protein, 14 aa, Mycobacterium tuberculosis
VLYALSAVTMLAAC

SEQ ID NO: 86787 - protein, 14 aa, Mycobacterium tuberculosis
LYALSAVTMLAACS

SEQ ID NO: 86788 - protein, 14 aa, Mycobacterium tuberculosis
YALSAVTMLAACSS

SEQ ID NO: 86789 - protein, 14 aa, Mycobacterium tuberculosis
ALSAVTMLAACSSN

SEQ ID NO: 86790 - protein, 14 aa, Mycobacterium tuberculosis
LSAVTMLAACSSNG

SEQ ID NO: 86791 - protein, 14 aa, Mycobacterium tuberculosis
SAVTMLAACSSNGA

SEQ ID NO: 86792 - protein, 14 aa, Mycobacterium tuberculosis
AVTMLAACSSNGAR

SEQ ID NO: 86793 - protein, 14 aa, Mycobacterium tuberculosis
VTMLAACSSNGARG

SEQ ID NO: 86794 - protein, 14 aa, Mycobacterium tuberculosis
TMLAACSSNGARGG

SEQ ID NO: 86795 - protein, 14 aa, Mycobacterium tuberculosis
MLAACSSNGARGGI

SEQ ID NO: 86796 - protein, 14 aa, Mycobacterium tuberculosis
LAACSSNGARGGIA

SEQ ID NO: 86797 - protein, 14 aa, Mycobacterium tuberculosis
AACSSNGARGGIAS

SEQ ID NO: 86798 - protein, 14 aa, Mycobacterium tuberculosis
ACSSNGARGGIAST

SEQ ID NO: 86799 - protein, 14 aa, Mycobacterium tuberculosis
CSSNGARGGIASTN

SEQ ID NO: 86800 - protein, 14 aa, Mycobacterium tuberculosis
SSNGARGGIASTNM

SEQ ID NO: 86801 - protein, 14 aa, Mycobacterium tuberculosis
SNGARGGIASTNMN

SEQ ID NO: 86802 - protein, 14 aa, Mycobacterium tuberculosis
NGARGGIASTNMNP

SEQ ID NO: 86803 - protein, 14 aa, Mycobacterium tuberculosis
GARGGIASTNMNPT

SEQ ID NO: 86804 - protein, 14 aa, Mycobacterium tuberculosis
ARGGIASTNMNPTN

SEQ ID NO: 86805 - protein, 14 aa, Mycobacterium tuberculosis
RGGIASTNMNPTNP

SEQ ID NO: 86806 - protein, 14 aa, Mycobacterium tuberculosis
GGIASTNMNPTNPP

SEQ ID NO: 86807 - protein, 14 aa, Mycobacterium tuberculosis
GIASTNMNPTNPPA

SEQ ID NO: 86808 - protein, 14 aa, Mycobacterium tuberculosis
IASTNMNPTNPPAT

SEQ ID NO: 86809 - protein, 14 aa, Mycobacterium tuberculosis
ASTNMNPTNPPATA

SEQ ID NO: 86810 - protein, 14 aa, Mycobacterium tuberculosis
STNMNPTNPPATAE

SEQ ID NO: 86811 - protein, 14 aa, Mycobacterium tuberculosis
TNMNPTNPPATAET

SEQ ID NO: 86812 - protein, 14 aa, Mycobacterium tuberculosis
NMNPTNPPATAETA

SEQ ID NO: 86813 - protein, 14 aa, Mycobacterium tuberculosis
MNPTNPPATAETAT

SEQ ID NO: 86814 - protein, 14 aa, Mycobacterium tuberculosis
NPTNPPATAETATV

SEQ ID NO: 86815 - protein, 14 aa, Mycobacterium tuberculosis
PTNPPATAETATVS

SEQ ID NO: 86816 - protein, 14 aa, Mycobacterium tuberculosis
TNPPATAETATVSP

SEQ ID NO: 86817 - protein, 14 aa, Mycobacterium tuberculosis
NPPATAETATVSPT

SEQ ID NO: 86818 - protein, 14 aa, Mycobacterium tuberculosis
PPATAETATVSPTP

SEQ ID NO: 86819 - protein, 14 aa, Mycobacterium tuberculosis
PATAETATVSPTPA

SEQ ID NO: 86820 - protein, 14 aa, Mycobacterium tuberculosis
ATAETATVSPTPAP

SEQ ID NO: 86821 - protein, 14 aa, Mycobacterium tuberculosis
TAETATVSPTPAPQ

SEQ ID NO: 86822 - protein, 14 aa, Mycobacterium tuberculosis
AETATVSPTPAPQS

SEQ ID NO: 86823 - protein, 14 aa, Mycobacterium tuberculosis
ETATVSPTPAPQSA

SEQ ID NO: 86824 - protein, 14 aa, Mycobacterium tuberculosis
TATVSPTPAPQSAR

SEQ ID NO: 86825 - protein, 14 aa, Mycobacterium tuberculosis
ATVSPTPAPQSART

SEQ ID NO: 86826 - protein, 14 aa, Mycobacterium tuberculosis
TVSPTPAPQSARTE

SEQ ID NO: 86827 - protein, 14 aa, Mycobacterium tuberculosis
VSPTPAPQSARTET

SEQ ID NO: 86828 - protein, 14 aa, Mycobacterium tuberculosis
SPTPAPQSARTETW

SEQ ID NO: 86829 - protein, 14 aa, Mycobacterium tuberculosis
PTPAPQSARTETWI

SEQ ID NO: 86830 - protein, 14 aa, Mycobacterium tuberculosis
TPAPQSARTETWIN

SEQ ID NO: 86831 - protein, 14 aa, Mycobacterium tuberculosis
PAPQSARTETWINL

SEQ ID NO: 86832 - protein, 14 aa, Mycobacterium tuberculosis
APQSARTETWINLQ

SEQ ID NO: 86833 - protein, 14 aa, Mycobacterium tuberculosis
PQSARTETWINLQV

SEQ ID NO: 86834 - protein, 14 aa, Mycobacterium tuberculosis
QSARTETWINLQVG

SEQ ID NO: 86835 - protein, 14 aa, Mycobacterium tuberculosis
SARTETWINLQVGD

SEQ ID NO: 86836 - protein, 14 aa, Mycobacterium tuberculosis
ARTETWINLQVGDC

SEQ ID NO: 86837 - protein, 14 aa, Mycobacterium tuberculosis
RTETWINLQVGDCL

SEQ ID NO: 86838 - protein, 14 aa, Mycobacterium tuberculosis
TETWINLQVGDCLA

SEQ ID NO: 86839 - protein, 14 aa, Mycobacterium tuberculosis
ETWINLQVGDCLAD

SEQ ID NO: 86840 - protein, 14 aa, Mycobacterium tuberculosis
TWINLQVGDCLADL

SEQ ID NO: 86841 - protein, 14 aa, Mycobacterium tuberculosis
WINLQVGDCLADLP

SEQ ID NO: 86842 - protein, 14 aa, Mycobacterium tuberculosis
INLQVGDCLADLPP

SEQ ID NO: 86843 - protein, 14 aa, Mycobacterium tuberculosis
NLQVGDCLADLPPA

SEQ ID NO: 86844 - protein, 14 aa, Mycobacterium tuberculosis
LQVGDCLADLPPAD

SEQ ID NO: 86845 - protein, 14 aa, Mycobacterium tuberculosis
QVGDCLADLPPADL

SEQ ID NO: 86846 - protein, 14 aa, Mycobacterium tuberculosis
VGDCLADLPPADLS

SEQ ID NO: 86847 - protein, 14 aa, Mycobacterium tuberculosis
GDCLADLPPADLSR

SEQ ID NO: 86848 - protein, 14 aa, Mycobacterium tuberculosis
DCLADLPPADLSRI

SEQ ID NO: 86849 - protein, 14 aa, Mycobacterium tuberculosis
CLADLPPADLSRIT

SEQ ID NO: 86850 - protein, 14 aa, Mycobacterium tuberculosis
LADLPPADLSRITV

SEQ ID NO: 86851 - protein, 14 aa, Mycobacterium tuberculosis
ADLPPADLSRITVT

SEQ ID NO: 86852 - protein, 14 aa, Mycobacterium tuberculosis
DLPPADLSRITVTI

SEQ ID NO: 86853 - protein, 14 aa, Mycobacterium tuberculosis
LPPADLSRITVTIV

SEQ ID NO: 86854 - protein, 14 aa, Mycobacterium tuberculosis
PPADLSRITVTIVD

SEQ ID NO: 86855 - protein, 14 aa, Mycobacterium tuberculosis
PADLSRITVTIVDC

SEQ ID NO: 86856 - protein, 14 aa, Mycobacterium tuberculosis
ADLSRITVTIVDCA

SEQ ID NO: 86857 - protein, 14 aa, Mycobacterium tuberculosis
DLSRITVTIVDCAT

SEQ ID NO: 86858 - protein, 14 aa, Mycobacterium tuberculosis
LSRITVTIVDCATA

SEQ ID NO: 86859 - protein, 14 aa, Mycobacterium tuberculosis
SRITVTIVDCATAH

SEQ ID NO: 86860 - protein, 14 aa, Mycobacterium tuberculosis
RITVTIVDCATAHS

SEQ ID NO: 86861 - protein, 14 aa, Mycobacterium tuberculosis
ITVTIVDCATAHSA

SEQ ID NO: 86862 - protein, 14 aa, Mycobacterium tuberculosis
TVTIVDCATAHSAE

SEQ ID NO: 86863 - protein, 14 aa, Mycobacterium tuberculosis
VTIVDCATAHSAEV

SEQ ID NO: 86864 - protein, 14 aa, Mycobacterium tuberculosis
TIVDCATAHSAEVY

SEQ ID NO: 86865 - protein, 14 aa, Mycobacterium tuberculosis
IVDCATAHSAEVYL

SEQ ID NO: 86866 - protein, 14 aa, Mycobacterium tuberculosis
VDCATAHSAEVYLR

SEQ ID NO: 86867 - protein, 14 aa, Mycobacterium tuberculosis
DCATAHSAEVYLRA

SEQ ID NO: 86868 - protein, 14 aa, Mycobacterium tuberculosis
CATAHSAEVYLRAP

SEQ ID NO: 86869 - protein, 14 aa, Mycobacterium tuberculosis
ATAHSAEVYLRAPV

SEQ ID NO: 86870 - protein, 14 aa, Mycobacterium tuberculosis
TAHSAEVYLRAPVA

SEQ ID NO: 86871 - protein, 14 aa, Mycobacterium tuberculosis
AHSAEVYLRAPVAV

SEQ ID NO: 86872 - protein, 14 aa, Mycobacterium tuberculosis
HSAEVYLRAPVAVD

SEQ ID NO: 86873 - protein, 14 aa, Mycobacterium tuberculosis
SAEVYLRAPVAVDA

SEQ ID NO: 86874 - protein, 14 aa, Mycobacterium tuberculosis
AEVYLRAPVAVDAA

SEQ ID NO: 86875 - protein, 14 aa, Mycobacterium tuberculosis
EVYLRAPVAVDAAV

SEQ ID NO: 86876 - protein, 14 aa, Mycobacterium tuberculosis
VYLRAPVAVDAAVV

SEQ ID NO: 86877 - protein, 14 aa, Mycobacterium tuberculosis
YLRAPVAVDAAVVS

SEQ ID NO: 86878 - protein, 14 aa, Mycobacterium tuberculosis
LRAPVAVDAAVVSM

SEQ ID NO: 86879 - protein, 14 aa, Mycobacterium tuberculosis
RAPVAVDAAVVSMA

SEQ ID NO: 86880 - protein, 14 aa, Mycobacterium tuberculosis
APVAVDAAVVSMAN

SEQ ID NO: 86881 - protein, 14 aa, Mycobacterium tuberculosis
PVAVDAAVVSMANR

SEQ ID NO: 86882 - protein, 14 aa, Mycobacterium tuberculosis
VAVDAAVVSMANRD

SEQ ID NO: 86883 - protein, 14 aa, Mycobacterium tuberculosis
AVDAAVVSMANRDC

SEQ ID NO: 86884 - protein, 14 aa, Mycobacterium tuberculosis
VDAAVVSMANRDCA

SEQ ID NO: 86885 - protein, 14 aa, Mycobacterium tuberculosis
DAAVVSMANRDCAA

SEQ ID NO: 86886 - protein, 14 aa, Mycobacterium tuberculosis
AAVVSMANRDCAAG

SEQ ID NO: 86887 - protein, 14 aa, Mycobacterium tuberculosis
AVVSMANRDCAAGF

SEQ ID NO: 86888 - protein, 14 aa, Mycobacterium tuberculosis
VVSMANRDCAAGFA

SEQ ID NO: 86889 - protein, 14 aa, Mycobacterium tuberculosis
VSMANRDCAAGFAP

SEQ ID NO: 86890 - protein, 14 aa, Mycobacterium tuberculosis
SMANRDCAAGFAPY

SEQ ID NO: 86891 - protein, 14 aa, Mycobacterium tuberculosis
MANRDCAAGFAPYT

SEQ ID NO: 86892 - protein, 14 aa, Mycobacterium tuberculosis
ANRDCAAGFAPYTG

SEQ ID NO: 86893 - protein, 14 aa, Mycobacterium tuberculosis
NRDCAAGFAPYTGQ

SEQ ID NO: 86894 - protein, 14 aa, Mycobacterium tuberculosis
RDCAAGFAPYTGQS

SEQ ID NO: 86895 - protein, 14 aa, Mycobacterium tuberculosis
DCAAGFAPYTGQSV

SEQ ID NO: 86896 - protein, 14 aa, Mycobacterium tuberculosis
CAAGFAPYTGQSVD

SEQ ID NO: 86897 - protein, 14 aa, Mycobacterium tuberculosis
AAGFAPYTGQSVDT

SEQ ID NO: 86898 - protein, 14 aa, Mycobacterium tuberculosis
AGFAPYTGQSVDTS

SEQ ID NO: 86899 - protein, 14 aa, Mycobacterium tuberculosis
GFAPYTGQSVDTSP

SEQ ID NO: 86900 - protein, 14 aa, Mycobacterium tuberculosis
FAPYTGQSVDTSPY

SEQ ID NO: 86901 - protein, 14 aa, Mycobacterium tuberculosis
APYTGQSVDTSPYS

SEQ ID NO: 86902 - protein, 14 aa, Mycobacterium tuberculosis
PYTGQSVDTSPYSV

SEQ ID NO: 86903 - protein, 14 aa, Mycobacterium tuberculosis
YTGQSVDTSPYSVA

SEQ ID NO: 86904 - protein, 14 aa, Mycobacterium tuberculosis
TGQSVDTSPYSVAY

SEQ ID NO: 86905 - protein, 14 aa, Mycobacterium tuberculosis
GQSVDTSPYSVAYL

SEQ ID NO: 86906 - protein, 14 aa, Mycobacterium tuberculosis
QSVDTSPYSVAYLI

SEQ ID NO: 86907 - protein, 14 aa, Mycobacterium tuberculosis
SVDTSPYSVAYLID

SEQ ID NO: 86908 - protein, 14 aa, Mycobacterium tuberculosis
VDTSPYSVAYLIDS

SEQ ID NO: 86909 - protein, 14 aa, Mycobacterium tuberculosis
DTSPYSVAYLIDSH

SEQ ID NO: 86910 - protein, 14 aa, Mycobacterium tuberculosis
TSPYSVAYLIDSHQ

SEQ ID NO: 86911 - protein, 14 aa, Mycobacterium tuberculosis
SPYSVAYLIDSHQD

SEQ ID NO: 86912 - protein, 14 aa, Mycobacterium tuberculosis
PYSVAYLIDSHQDR

SEQ ID NO: 86913 - protein, 14 aa, Mycobacterium tuberculosis
YSVAYLIDSHQDRT

SEQ ID NO: 86914 - protein, 14 aa, Mycobacterium tuberculosis
SVAYLIDSHQDRTG

SEQ ID NO: 86915 - protein, 14 aa, Mycobacterium tuberculosis
VAYLIDSHQDRTGA

SEQ ID NO: 86916 - protein, 14 aa, Mycobacterium tuberculosis
AYLIDSHQDRTGAD

SEQ ID NO: 86917 - protein, 14 aa, Mycobacterium tuberculosis
YLIDSHQDRTGADP

SEQ ID NO: 86918 - protein, 14 aa, Mycobacterium tuberculosis
LIDSHQDRTGADPT

SEQ ID NO: 86919 - protein, 14 aa, Mycobacterium tuberculosis
IDSHQDRTGADPTP

SEQ ID NO: 86920 - protein, 14 aa, Mycobacterium tuberculosis
DSHQDRTGADPTPS

SEQ ID NO: 86921 - protein, 14 aa, Mycobacterium tuberculosis
SHQDRTGADPTPST

SEQ ID NO: 86922 - protein, 14 aa, Mycobacterium tuberculosis
HQDRTGADPTPSTV

SEQ ID NO: 86923 - protein, 14 aa, Mycobacterium tuberculosis
QDRTGADPTPSTVI

SEQ ID NO: 86924 - protein, 14 aa, Mycobacterium tuberculosis
DRTGADPTPSTVIC

SEQ ID NO: 86925 - protein, 14 aa, Mycobacterium tuberculosis
RTGADPTPSTVICL

SEQ ID NO: 86926 - protein, 14 aa, Mycobacterium tuberculosis
TGADPTPSTVICLL

SEQ ID NO: 86927 - protein, 14 aa, Mycobacterium tuberculosis
GADPTPSTVICLLQ

SEQ ID NO: 86928 - protein, 14 aa, Mycobacterium tuberculosis
ADPTPSTVICLLQP

SEQ ID NO: 86929 - protein, 14 aa, Mycobacterium tuberculosis
DPTPSTVICLLQPA

SEQ ID NO: 86930 - protein, 14 aa, Mycobacterium tuberculosis
PTPSTVICLLQPAN

SEQ ID NO: 86931 - protein, 14 aa, Mycobacterium tuberculosis
TPSTVICLLQPANG

SEQ ID NO: 86932 - protein, 14 aa, Mycobacterium tuberculosis
PSTVICLLQPANGQ

SEQ ID NO: 86933 - protein, 14 aa, Mycobacterium tuberculosis
STVICLLQPANGQL

SEQ ID NO: 86934 - protein, 14 aa, Mycobacterium tuberculosis
TVICLLQPANGQLL

SEQ ID NO: 86935 - protein, 14 aa, Mycobacterium tuberculosis
VICLLQPANGQLLT

SEQ ID NO: 86936 - protein, 14 aa, Mycobacterium tuberculosis
ICLLQPANGQLLTG

SEQ ID NO: 86937 - protein, 14 aa, Mycobacterium tuberculosis
CLLQPANGQLLTGS

SEQ ID NO: 86938 - protein, 14 aa, Mycobacterium tuberculosis
LLQPANGQLLTGSA

SEQ ID NO: 86939 - protein, 14 aa, Mycobacterium tuberculosis
LQPANGQLLTGSAR

SEQ ID NO: 86940 - protein, 14 aa, Mycobacterium tuberculosis
QPANGQLLTGSARR

SEQ ID NO: 86941 - protein, 15 aa, Mycobacterium tuberculosis
MRLPGRHVLYALSAV

SEQ ID NO: 86942 - protein, 15 aa, Mycobacterium tuberculosis
RLPGRHVLYALSAVT

SEQ ID NO: 86943 - protein, 15 aa, Mycobacterium tuberculosis
LPGRHVLYALSAVTM

SEQ ID NO: 86944 - protein, 15 aa, Mycobacterium tuberculosis
PGRHVLYALSAVTML

SEQ ID NO: 86945 - protein, 15 aa, Mycobacterium tuberculosis
GRHVLYALSAVTMLA

SEQ ID NO: 86946 - protein, 15 aa, Mycobacterium tuberculosis
RHVLYALSAVTMLAA

SEQ ID NO: 86947 - protein, 15 aa, Mycobacterium tuberculosis
HVLYALSAVTMLAAC

SEQ ID NO: 86948 - protein, 15 aa, Mycobacterium tuberculosis
VLYALSAVTMLAACS

SEQ ID NO: 86949 - protein, 15 aa, Mycobacterium tuberculosis
LYALSAVTMLAACSS

SEQ ID NO: 86950 - protein, 15 aa, Mycobacterium tuberculosis
YALSAVTMLAACSSN

SEQ ID NO: 86951 - protein, 15 aa, Mycobacterium tuberculosis
ALSAVTMLAACSSNG

SEQ ID NO: 86952 - protein, 15 aa, Mycobacterium tuberculosis
LSAVTMLAACSSNGA

SEQ ID NO: 86953 - protein, 15 aa, Mycobacterium tuberculosis
SAVTMLAACSSNGAR

SEQ ID NO: 86954 - protein, 15 aa, Mycobacterium tuberculosis
AVTMLAACSSNGARG

SEQ ID NO: 86955 - protein, 15 aa, Mycobacterium tuberculosis
VTMLAACSSNGARGG

SEQ ID NO: 86956 - protein, 15 aa, Mycobacterium tuberculosis
TMLAACSSNGARGGI

SEQ ID NO: 86957 - protein, 15 aa, Mycobacterium tuberculosis
MLAACSSNGARGGIA

SEQ ID NO: 86958 - protein, 15 aa, Mycobacterium tuberculosis
LAACSSNGARGGIAS

SEQ ID NO: 86959 - protein, 15 aa, Mycobacterium tuberculosis
AACSSNGARGGIAST

SEQ ID NO: 86960 - protein, 15 aa, Mycobacterium tuberculosis
ACSSNGARGGIASTN

SEQ ID NO: 86961 - protein, 15 aa, Mycobacterium tuberculosis
CSSNGARGGIASTNM

SEQ ID NO: 86962 - protein, 15 aa, Mycobacterium tuberculosis
SSNGARGGIASTNMN

SEQ ID NO: 86963 - protein, 15 aa, Mycobacterium tuberculosis
SNGARGGIASTNMNP

SEQ ID NO: 86964 - protein, 15 aa, Mycobacterium tuberculosis
NGARGGIASTNMNPT

SEQ ID NO: 86965 - protein, 15 aa, Mycobacterium tuberculosis
GARGGIASTNMNPTN

SEQ ID NO: 86966 - protein, 15 aa, Mycobacterium tuberculosis
ARGGIASTNMNPTNP

SEQ ID NO: 86967 - protein, 15 aa, Mycobacterium tuberculosis
RGGIASTNMNPTNPP

SEQ ID NO: 86968 - protein, 15 aa, Mycobacterium tuberculosis
GGIASTNMNPTNPPA

SEQ ID NO: 86969 - protein, 15 aa, Mycobacterium tuberculosis
GIASTNMNPTNPPAT

SEQ ID NO: 86970 - protein, 15 aa, Mycobacterium tuberculosis
IASTNMNPTNPPATA

SEQ ID NO: 86971 - protein, 15 aa, Mycobacterium tuberculosis
ASTNMNPTNPPATAE

SEQ ID NO: 86972 - protein, 15 aa, Mycobacterium tuberculosis
STNMNPTNPPATAET

SEQ ID NO: 86973 - protein, 15 aa, Mycobacterium tuberculosis
TNMNPTNPPATAETA

SEQ ID NO: 86974 - protein, 15 aa, Mycobacterium tuberculosis
NMNPTNPPATAETAT

SEQ ID NO: 86975 - protein, 15 aa, Mycobacterium tuberculosis
MNPTNPPATAETATV

SEQ ID NO: 86976 - protein, 15 aa, Mycobacterium tuberculosis
NPTNPPATAETATVS

SEQ ID NO: 86977 - protein, 15 aa, Mycobacterium tuberculosis
PTNPPATAETATVSP

SEQ ID NO: 86978 - protein, 15 aa, Mycobacterium tuberculosis
TNPPATAETATVSPT

SEQ ID NO: 86979 - protein, 15 aa, Mycobacterium tuberculosis
NPPATAETATVSPTP

SEQ ID NO: 86980 - protein, 15 aa, Mycobacterium tuberculosis
PPATAETATVSPTPA

SEQ ID NO: 86981 - protein, 15 aa, Mycobacterium tuberculosis
PATAETATVSPTPAP

SEQ ID NO: 86982 - protein, 15 aa, Mycobacterium tuberculosis
ATAETATVSPTPAPQ

SEQ ID NO: 86983 - protein, 15 aa, Mycobacterium tuberculosis
TAETATVSPTPAPQS

SEQ ID NO: 86984 - protein, 15 aa, Mycobacterium tuberculosis
AETATVSPTPAPQSA

SEQ ID NO: 86985 - protein, 15 aa, Mycobacterium tuberculosis
ETATVSPTPAPQSAR

SEQ ID NO: 86986 - protein, 15 aa, Mycobacterium tuberculosis
TATVSPTPAPQSART

SEQ ID NO: 86987 - protein, 15 aa, Mycobacterium tuberculosis
ATVSPTPAPQSARTE

SEQ ID NO: 86988 - protein, 15 aa, Mycobacterium tuberculosis
TVSPTPAPQSARTET

SEQ ID NO: 86989 - protein, 15 aa, Mycobacterium tuberculosis
VSPTPAPQSARTETW

SEQ ID NO: 86990 - protein, 15 aa, Mycobacterium tuberculosis
SPTPAPQSARTETWI

SEQ ID NO: 86991 - protein, 15 aa, Mycobacterium tuberculosis
PTPAPQSARTETWIN

SEQ ID NO: 86992 - protein, 15 aa, Mycobacterium tuberculosis
TPAPQSARTETWINL

SEQ ID NO: 86993 - protein, 15 aa, Mycobacterium tuberculosis
PAPQSARTETWINLQ

SEQ ID NO: 86994 - protein, 15 aa, Mycobacterium tuberculosis
APQSARTETWINLQV

SEQ ID NO: 86995 - protein, 15 aa, Mycobacterium tuberculosis
PQSARTETWINLQVG

SEQ ID NO: 86996 - protein, 15 aa, Mycobacterium tuberculosis
QSARTETWINLQVGD

SEQ ID NO: 86997 - protein, 15 aa, Mycobacterium tuberculosis
SARTETWINLQVGDC

SEQ ID NO: 86998 - protein, 15 aa, Mycobacterium tuberculosis
ARTETWINLQVGDCL

SEQ ID NO: 86999 - protein, 15 aa, Mycobacterium tuberculosis
RTETWINLQVGDCLA

SEQ ID NO: 87000 - protein, 15 aa, Mycobacterium tuberculosis
TETWINLQVGDCLAD

SEQ ID NO: 87001 - protein, 15 aa, Mycobacterium tuberculosis
ETWINLQVGDCLADL

SEQ ID NO: 87002 - protein, 15 aa, Mycobacterium tuberculosis
TWINLQVGDCLADLP

SEQ ID NO: 87003 - protein, 15 aa, Mycobacterium tuberculosis
WINLQVGDCLADLPP

SEQ ID NO: 87004 - protein, 15 aa, Mycobacterium tuberculosis
INLQVGDCLADLPPA

SEQ ID NO: 87005 - protein, 15 aa, Mycobacterium tuberculosis
NLQVGDCLADLPPAD

SEQ ID NO: 87006 - protein, 15 aa, Mycobacterium tuberculosis
LQVGDCLADLPPADL

SEQ ID NO: 87007 - protein, 15 aa, Mycobacterium tuberculosis
QVGDCLADLPPADLS

SEQ ID NO: 87008 - protein, 15 aa, Mycobacterium tuberculosis
VGDCLADLPPADLSR

SEQ ID NO: 87009 - protein, 15 aa, Mycobacterium tuberculosis
GDCLADLPPADLSRI

SEQ ID NO: 87010 - protein, 15 aa, Mycobacterium tuberculosis
DCLADLPPADLSRIT

SEQ ID NO: 87011 - protein, 15 aa, Mycobacterium tuberculosis
CLADLPPADLSRITV

SEQ ID NO: 87012 - protein, 15 aa, Mycobacterium tuberculosis
LADLPPADLSRITVT

SEQ ID NO: 87013 - protein, 15 aa, Mycobacterium tuberculosis
ADLPPADLSRITVTI

SEQ ID NO: 87014 - protein, 15 aa, Mycobacterium tuberculosis
DLPPADLSRITVTIV

SEQ ID NO: 87015 - protein, 15 aa, Mycobacterium tuberculosis
LPPADLSRITVTIVD

SEQ ID NO: 87016 - protein, 15 aa, Mycobacterium tuberculosis
PPADLSRITVTIVDC

SEQ ID NO: 87017 - protein, 15 aa, Mycobacterium tuberculosis
PADLSRITVTIVDCA

SEQ ID NO: 87018 - protein, 15 aa, Mycobacterium tuberculosis
ADLSRITVTIVDCAT

SEQ ID NO: 87019 - protein, 15 aa, Mycobacterium tuberculosis
DLSRITVTIVDCATA

SEQ ID NO: 87020 - protein, 15 aa, Mycobacterium tuberculosis
LSRITVTIVDCATAH

SEQ ID NO: 87021 - protein, 15 aa, Mycobacterium tuberculosis
SRITVTIVDCATAHS

SEQ ID NO: 87022 - protein, 15 aa, Mycobacterium tuberculosis
RITVTIVDCATAHSA

SEQ ID NO: 87023 - protein, 15 aa, Mycobacterium tuberculosis
ITVTIVDCATAHSAE

SEQ ID NO: 87024 - protein, 15 aa, Mycobacterium tuberculosis
TVTIVDCATAHSAEV

SEQ ID NO: 87025 - protein, 15 aa, Mycobacterium tuberculosis
VTIVDCATAHSAEVY

SEQ ID NO: 87026 - protein, 15 aa, Mycobacterium tuberculosis
TIVDCATAHSAEVYL

SEQ ID NO: 87027 - protein, 15 aa, Mycobacterium tuberculosis
IVDCATAHSAEVYLR

SEQ ID NO: 87028 - protein, 15 aa, Mycobacterium tuberculosis
VDCATAHSAEVYLRA

SEQ ID NO: 87029 - protein, 15 aa, Mycobacterium tuberculosis
DCATAHSAEVYLRAP

SEQ ID NO: 87030 - protein, 15 aa, Mycobacterium tuberculosis
CATAHSAEVYLRAPV

SEQ ID NO: 87031 - protein, 15 aa, Mycobacterium tuberculosis
ATAHSAEVYLRAPVA

SEQ ID NO: 87032 - protein, 15 aa, Mycobacterium tuberculosis
TAHSAEVYLRAPVAV

SEQ ID NO: 87033 - protein, 15 aa, Mycobacterium tuberculosis
AHSAEVYLRAPVAVD

SEQ ID NO: 87034 - protein, 15 aa, Mycobacterium tuberculosis
HSAEVYLRAPVAVDA

SEQ ID NO: 87035 - protein, 15 aa, Mycobacterium tuberculosis
SAEVYLRAPVAVDAA

SEQ ID NO: 87036 - protein, 15 aa, Mycobacterium tuberculosis
AEVYLRAPVAVDAAV

SEQ ID NO: 87037 - protein, 15 aa, Mycobacterium tuberculosis
EVYLRAPVAVDAAVV

SEQ ID NO: 87038 - protein, 15 aa, Mycobacterium tuberculosis
VYLRAPVAVDAAVVS

SEQ ID NO: 87039 - protein, 15 aa, Mycobacterium tuberculosis
YLRAPVAVDAAVVSM

SEQ ID NO: 87040 - protein, 15 aa, Mycobacterium tuberculosis
LRAPVAVDAAVVSMA

SEQ ID NO: 87041 - protein, 15 aa, Mycobacterium tuberculosis
RAPVAVDAAVVSMAN

SEQ ID NO: 87042 - protein, 15 aa, Mycobacterium tuberculosis
APVAVDAAVVSMANR

SEQ ID NO: 87043 - protein, 15 aa, Mycobacterium tuberculosis
PVAVDAAVVSMANRD

SEQ ID NO: 87044 - protein, 15 aa, Mycobacterium tuberculosis
VAVDAAVVSMANRDC

SEQ ID NO: 87045 - protein, 15 aa, Mycobacterium tuberculosis
AVDAAVVSMANRDCA

SEQ ID NO: 87046 - protein, 15 aa, Mycobacterium tuberculosis
VDAAVVSMANRDCAA

SEQ ID NO: 87047 - protein, 15 aa, Mycobacterium tuberculosis
DAAVVSMANRDCAAG

SEQ ID NO: 87048 - protein, 15 aa, Mycobacterium tuberculosis
AAVVSMANRDCAAGF

SEQ ID NO: 87049 - protein, 15 aa, Mycobacterium tuberculosis
AVVSMANRDCAAGFA

SEQ ID NO: 87050 - protein, 15 aa, Mycobacterium tuberculosis
VVSMANRDCAAGFAP

SEQ ID NO: 87051 - protein, 15 aa, Mycobacterium tuberculosis
VSMANRDCAAGFAPY

SEQ ID NO: 87052 - protein, 15 aa, Mycobacterium tuberculosis
SMANRDCAAGFAPYT

SEQ ID NO: 87053 - protein, 15 aa, Mycobacterium tuberculosis
MANRDCAAGFAPYTG

SEQ ID NO: 87054 - protein, 15 aa, Mycobacterium tuberculosis
ANRDCAAGFAPYTGQ

SEQ ID NO: 87055 - protein, 15 aa, Mycobacterium tuberculosis
NRDCAAGFAPYTGQS

SEQ ID NO: 87056 - protein, 15 aa, Mycobacterium tuberculosis
RDCAAGFAPYTGQSV

SEQ ID NO: 87057 - protein, 15 aa, Mycobacterium tuberculosis
DCAAGFAPYTGQSVD

SEQ ID NO: 87058 - protein, 15 aa, Mycobacterium tuberculosis
CAAGFAPYTGQSVDT

SEQ ID NO: 87059 - protein, 15 aa, Mycobacterium tuberculosis
AAGFAPYTGQSVDTS

SEQ ID NO: 87060 - protein, 15 aa, Mycobacterium tuberculosis
AGFAPYTGQSVDTSP

SEQ ID NO: 87061 - protein, 15 aa, Mycobacterium tuberculosis
GFAPYTGQSVDTSPY

SEQ ID NO: 87062 - protein, 15 aa, Mycobacterium tuberculosis
FAPYTGQSVDTSPYS

SEQ ID NO: 87063 - protein, 15 aa, Mycobacterium tuberculosis
APYTGQSVDTSPYSV

SEQ ID NO: 87064 - protein, 15 aa, Mycobacterium tuberculosis
PYTGQSVDTSPYSVA

SEQ ID NO: 87065 - protein, 15 aa, Mycobacterium tuberculosis
YTGQSVDTSPYSVAY

SEQ ID NO: 87066 - protein, 15 aa, Mycobacterium tuberculosis
TGQSVDTSPYSVAYL

SEQ ID NO: 87067 - protein, 15 aa, Mycobacterium tuberculosis
GQSVDTSPYSVAYLI

SEQ ID NO: 87068 - protein, 15 aa, Mycobacterium tuberculosis
QSVDTSPYSVAYLID

SEQ ID NO: 87069 - protein, 15 aa, Mycobacterium tuberculosis
SVDTSPYSVAYLIDS

SEQ ID NO: 87070 - protein, 15 aa, Mycobacterium tuberculosis
VDTSPYSVAYLIDSH

SEQ ID NO: 87071 - protein, 15 aa, Mycobacterium tuberculosis
DTSPYSVAYLIDSHQ

SEQ ID NO: 87072 - protein, 15 aa, Mycobacterium tuberculosis
TSPYSVAYLIDSHQD

SEQ ID NO: 87073 - protein, 15 aa, Mycobacterium tuberculosis
SPYSVAYLIDSHQDR

SEQ ID NO: 87074 - protein, 15 aa, Mycobacterium tuberculosis
PYSVAYLIDSHQDRT

SEQ ID NO: 87075 - protein, 15 aa, Mycobacterium tuberculosis
YSVAYLIDSHQDRTG

SEQ ID NO: 87076 - protein, 15 aa, Mycobacterium tuberculosis
SVAYLIDSHQDRTGA

SEQ ID NO: 87077 - protein, 15 aa, Mycobacterium tuberculosis
VAYLIDSHQDRTGAD

SEQ ID NO: 87078 - protein, 15 aa, Mycobacterium tuberculosis
AYLIDSHQDRTGADP

SEQ ID NO: 87079 - protein, 15 aa, Mycobacterium tuberculosis
YLIDSHQDRTGADPT

SEQ ID NO: 87080 - protein, 15 aa, Mycobacterium tuberculosis
LIDSHQDRTGADPTP

SEQ ID NO: 87081 - protein, 15 aa, Mycobacterium tuberculosis
IDSHQDRTGADPTPS

SEQ ID NO: 87082 - protein, 15 aa, Mycobacterium tuberculosis
DSHQDRTGADPTPST

SEQ ID NO: 87083 - protein, 15 aa, Mycobacterium tuberculosis
SHQDRTGADPTPSTV

SEQ ID NO: 87084 - protein, 15 aa, Mycobacterium tuberculosis
HQDRTGADPTPSTVI

SEQ ID NO: 87085 - protein, 15 aa, Mycobacterium tuberculosis
QDRTGADPTPSTVIC

SEQ ID NO: 87086 - protein, 15 aa, Mycobacterium tuberculosis
DRTGADPTPSTVICL

SEQ ID NO: 87087 - protein, 15 aa, Mycobacterium tuberculosis
RTGADPTPSTVICLL

SEQ ID NO: 87088 - protein, 15 aa, Mycobacterium tuberculosis
TGADPTPSTVICLLQ

SEQ ID NO: 87089 - protein, 15 aa, Mycobacterium tuberculosis
GADPTPSTVICLLQP

SEQ ID NO: 87090 - protein, 15 aa, Mycobacterium tuberculosis
ADPTPSTVICLLQPA

SEQ ID NO: 87091 - protein, 15 aa, Mycobacterium tuberculosis
DPTPSTVICLLQPAN

SEQ ID NO: 87092 - protein, 15 aa, Mycobacterium tuberculosis
PTPSTVICLLQPANG

SEQ ID NO: 87093 - protein, 15 aa, Mycobacterium tuberculosis
TPSTVICLLQPANGQ

SEQ ID NO: 87094 - protein, 15 aa, Mycobacterium tuberculosis
PSTVICLLQPANGQL

SEQ ID NO: 87095 - protein, 15 aa, Mycobacterium tuberculosis
STVICLLQPANGQLL

SEQ ID NO: 87096 - protein, 15 aa, Mycobacterium tuberculosis
TVICLLQPANGQLLT

SEQ ID NO: 87097 - protein, 15 aa, Mycobacterium tuberculosis
VICLLQPANGQLLTG

SEQ ID NO: 87098 - protein, 15 aa, Mycobacterium tuberculosis
ICLLQPANGQLLTGS

SEQ ID NO: 87099 - protein, 15 aa, Mycobacterium tuberculosis
CLLQPANGQLLTGSA

SEQ ID NO: 87100 - protein, 15 aa, Mycobacterium tuberculosis
LLQPANGQLLTGSAR

SEQ ID NO: 87101 - protein, 15 aa, Mycobacterium tuberculosis
LQPANGQLLTGSARR

SEQ ID NO: 87102 - protein, 16 aa, Mycobacterium tuberculosis
MRLPGRHVLYALSAVT

SEQ ID NO: 87103 - protein, 16 aa, Mycobacterium tuberculosis
RLPGRHVLYALSAVTM

SEQ ID NO: 87104 - protein, 16 aa, Mycobacterium tuberculosis
LPGRHVLYALSAVTML

SEQ ID NO: 87105 - protein, 16 aa, Mycobacterium tuberculosis
PGRHVLYALSAVTMLA

SEQ ID NO: 87106 - protein, 16 aa, Mycobacterium tuberculosis
GRHVLYALSAVTMLAA

SEQ ID NO: 87107 - protein, 16 aa, Mycobacterium tuberculosis
RHVLYALSAVTMLAAC

SEQ ID NO: 87108 - protein, 16 aa, Mycobacterium tuberculosis
HVLYALSAVTMLAACS

SEQ ID NO: 87109 - protein, 16 aa, Mycobacterium tuberculosis
VLYALSAVTMLAACSS

SEQ ID NO: 87110 - protein, 16 aa, Mycobacterium tuberculosis
LYALSAVTMLAACSSN

SEQ ID NO: 87111 - protein, 16 aa, Mycobacterium tuberculosis
YALSAVTMLAACSSNG

SEQ ID NO: 87112 - protein, 16 aa, Mycobacterium tuberculosis
ALSAVTMLAACSSNGA

SEQ ID NO: 87113 - protein, 16 aa, Mycobacterium tuberculosis
LSAVTMLAACSSNGAR

SEQ ID NO: 87114 - protein, 16 aa, Mycobacterium tuberculosis
SAVTMLAACSSNGARG

SEQ ID NO: 87115 - protein, 16 aa, Mycobacterium tuberculosis
AVTMLAACSSNGARGG

SEQ ID NO: 87116 - protein, 16 aa, Mycobacterium tuberculosis
VTMLAACSSNGARGGI

SEQ ID NO: 87117 - protein, 16 aa, Mycobacterium tuberculosis
TMLAACSSNGARGGIA

SEQ ID NO: 87118 - protein, 16 aa, Mycobacterium tuberculosis
MLAACSSNGARGGIAS

SEQ ID NO: 87119 - protein, 16 aa, Mycobacterium tuberculosis
LAACSSNGARGGIAST

SEQ ID NO: 87120 - protein, 16 aa, Mycobacterium tuberculosis
AACSSNGARGGIASTN

SEQ ID NO: 87121 - protein, 16 aa, Mycobacterium tuberculosis
ACSSNGARGGIASTNM

SEQ ID NO: 87122 - protein, 16 aa, Mycobacterium tuberculosis
CSSNGARGGIASTNMN

SEQ ID NO: 87123 - protein, 16 aa, Mycobacterium tuberculosis
SSNGARGGIASTNMNP

SEQ ID NO: 87124 - protein, 16 aa, Mycobacterium tuberculosis
SNGARGGIASTNMNPT

SEQ ID NO: 87125 - protein, 16 aa, Mycobacterium tuberculosis
NGARGGIASTNMNPTN

SEQ ID NO: 87126 - protein, 16 aa, Mycobacterium tuberculosis
GARGGIASTNMNPTNP

SEQ ID NO: 87127 - protein, 16 aa, Mycobacterium tuberculosis
ARGGIASTNMNPTNPP

SEQ ID NO: 87128 - protein, 16 aa, Mycobacterium tuberculosis
RGGIASTNMNPTNPPA

SEQ ID NO: 87129 - protein, 16 aa, Mycobacterium tuberculosis
GGIASTNMNPTNPPAT

SEQ ID NO: 87130 - protein, 16 aa, Mycobacterium tuberculosis
GIASTNMNPTNPPATA

SEQ ID NO: 87131 - protein, 16 aa, Mycobacterium tuberculosis
IASTNMNPTNPPATAE

SEQ ID NO: 87132 - protein, 16 aa, Mycobacterium tuberculosis
ASTNMNPTNPPATAET

SEQ ID NO: 87133 - protein, 16 aa, Mycobacterium tuberculosis
STNMNPTNPPATAETA

SEQ ID NO: 87134 - protein, 16 aa, Mycobacterium tuberculosis
TNMNPTNPPATAETAT

SEQ ID NO: 87135 - protein, 16 aa, Mycobacterium tuberculosis
NMNPTNPPATAETATV

SEQ ID NO: 87136 - protein, 16 aa, Mycobacterium tuberculosis
MNPTNPPATAETATVS

SEQ ID NO: 87137 - protein, 16 aa, Mycobacterium tuberculosis
NPTNPPATAETATVSP

SEQ ID NO: 87138 - protein, 16 aa, Mycobacterium tuberculosis
PTNPPATAETATVSPT

SEQ ID NO: 87139 - protein, 16 aa, Mycobacterium tuberculosis
TNPPATAETATVSPTP

SEQ ID NO: 87140 - protein, 16 aa, Mycobacterium tuberculosis
NPPATAETATVSPTPA

SEQ ID NO: 87141 - protein, 16 aa, Mycobacterium tuberculosis
PPATAETATVSPTPAP

SEQ ID NO: 87142 - protein, 16 aa, Mycobacterium tuberculosis
PATAETATVSPTPAPQ

SEQ ID NO: 87143 - protein, 16 aa, Mycobacterium tuberculosis
ATAETATVSPTPAPQS

SEQ ID NO: 87144 - protein, 16 aa, Mycobacterium tuberculosis
TAETATVSPTPAPQSA

SEQ ID NO: 87145 - protein, 16 aa, Mycobacterium tuberculosis
AETATVSPTPAPQSAR

SEQ ID NO: 87146 - protein, 16 aa, Mycobacterium tuberculosis
ETATVSPTPAPQSART

SEQ ID NO: 87147 - protein, 16 aa, Mycobacterium tuberculosis
TATVSPTPAPQSARTE

SEQ ID NO: 87148 - protein, 16 aa, Mycobacterium tuberculosis
ATVSPTPAPQSARTET

SEQ ID NO: 87149 - protein, 16 aa, Mycobacterium tuberculosis
TVSPTPAPQSARTETW

SEQ ID NO: 87150 - protein, 16 aa, Mycobacterium tuberculosis
VSPTPAPQSARTETWI

SEQ ID NO: 87151 - protein, 16 aa, Mycobacterium tuberculosis
SPTPAPQSARTETWIN

SEQ ID NO: 87152 - protein, 16 aa, Mycobacterium tuberculosis
PTPAPQSARTETWINL

SEQ ID NO: 87153 - protein, 16 aa, Mycobacterium tuberculosis
TPAPQSARTETWINLQ

SEQ ID NO: 87154 - protein, 16 aa, Mycobacterium tuberculosis
PAPQSARTETWINLQV

SEQ ID NO: 87155 - protein, 16 aa, Mycobacterium tuberculosis
APQSARTETWINLQVG

SEQ ID NO: 87156 - protein, 16 aa, Mycobacterium tuberculosis
PQSARTETWINLQVGD

SEQ ID NO: 87157 - protein, 16 aa, Mycobacterium tuberculosis
QSARTETWINLQVGDC

SEQ ID NO: 87158 - protein, 16 aa, Mycobacterium tuberculosis
SARTETWINLQVGDCL

SEQ ID NO: 87159 - protein, 16 aa, Mycobacterium tuberculosis
ARTETWINLQVGDCLA

SEQ ID NO: 87160 - protein, 16 aa, Mycobacterium tuberculosis
RTETWINLQVGDCLAD

SEQ ID NO: 87161 - protein, 16 aa, Mycobacterium tuberculosis
TETWINLQVGDCLADL

SEQ ID NO: 87162 - protein, 16 aa, Mycobacterium tuberculosis
ETWINLQVGDCLADLP

SEQ ID NO: 87163 - protein, 16 aa, Mycobacterium tuberculosis
TWINLQVGDCLADLPP

SEQ ID NO: 87164 - protein, 16 aa, Mycobacterium tuberculosis
WINLQVGDCLADLPPA

SEQ ID NO: 87165 - protein, 16 aa, Mycobacterium tuberculosis
INLQVGDCLADLPPAD

SEQ ID NO: 87166 - protein, 16 aa, Mycobacterium tuberculosis
NLQVGDCLADLPPADL

SEQ ID NO: 87167 - protein, 16 aa, Mycobacterium tuberculosis
LQVGDCLADLPPADLS

SEQ ID NO: 87168 - protein, 16 aa, Mycobacterium tuberculosis
QVGDCLADLPPADLSR

SEQ ID NO: 87169 - protein, 16 aa, Mycobacterium tuberculosis
VGDCLADLPPADLSRI

SEQ ID NO: 87170 - protein, 16 aa, Mycobacterium tuberculosis
GDCLADLPPADLSRIT

SEQ ID NO: 87171 - protein, 16 aa, Mycobacterium tuberculosis
DCLADLPPADLSRITV

SEQ ID NO: 87172 - protein, 16 aa, Mycobacterium tuberculosis
CLADLPPADLSRITVT

SEQ ID NO: 87173 - protein, 16 aa, Mycobacterium tuberculosis
LADLPPADLSRITVTI

SEQ ID NO: 87174 - protein, 16 aa, Mycobacterium tuberculosis
ADLPPADLSRITVTIV

SEQ ID NO: 87175 - protein, 16 aa, Mycobacterium tuberculosis
DLPPADLSRITVTIVD

SEQ ID NO: 87176 - protein, 16 aa, Mycobacterium tuberculosis
LPPADLSRITVTIVDC

SEQ ID NO: 87177 - protein, 16 aa, Mycobacterium tuberculosis
PPADLSRITVTIVDCA

SEQ ID NO: 87178 - protein, 16 aa, Mycobacterium tuberculosis
PADLSRITVTIVDCAT

SEQ ID NO: 87179 - protein, 16 aa, Mycobacterium tuberculosis
ADLSRITVTIVDCATA

SEQ ID NO: 87180 - protein, 16 aa, Mycobacterium tuberculosis
DLSRITVTIVDCATAH

SEQ ID NO: 87181 - protein, 16 aa, Mycobacterium tuberculosis
LSRITVTIVDCATAHS

SEQ ID NO: 87182 - protein, 16 aa, Mycobacterium tuberculosis
SRITVTIVDCATAHSA

SEQ ID NO: 87183 - protein, 16 aa, Mycobacterium tuberculosis
RITVTIVDCATAHSAE

SEQ ID NO: 87184 - protein, 16 aa, Mycobacterium tuberculosis
ITVTIVDCATAHSAEV

SEQ ID NO: 87185 - protein, 16 aa, Mycobacterium tuberculosis
TVTIVDCATAHSAEVY

SEQ ID NO: 87186 - protein, 16 aa, Mycobacterium tuberculosis
VTIVDCATAHSAEVYL

SEQ ID NO: 87187 - protein, 16 aa, Mycobacterium tuberculosis
TIVDCATAHSAEVYLR

SEQ ID NO: 87188 - protein, 16 aa, Mycobacterium tuberculosis
IVDCATAHSAEVYLRA

SEQ ID NO: 87189 - protein, 16 aa, Mycobacterium tuberculosis
VDCATAHSAEVYLRAP

SEQ ID NO: 87190 - protein, 16 aa, Mycobacterium tuberculosis
DCATAHSAEVYLRAPV

SEQ ID NO: 87191 - protein, 16 aa, Mycobacterium tuberculosis
CATAHSAEVYLRAPVA

SEQ ID NO: 87192 - protein, 16 aa, Mycobacterium tuberculosis
ATAHSAEVYLRAPVAV

SEQ ID NO: 87193 - protein, 16 aa, Mycobacterium tuberculosis
TAHSAEVYLRAPVAVD

SEQ ID NO: 87194 - protein, 16 aa, Mycobacterium tuberculosis
AHSAEVYLRAPVAVDA

SEQ ID NO: 87195 - protein, 16 aa, Mycobacterium tuberculosis
HSAEVYLRAPVAVDAA

SEQ ID NO: 87196 - protein, 16 aa, Mycobacterium tuberculosis
SAEVYLRAPVAVDAAV

SEQ ID NO: 87197 - protein, 16 aa, Mycobacterium tuberculosis
AEVYLRAPVAVDAAVV

SEQ ID NO: 87198 - protein, 16 aa, Mycobacterium tuberculosis
EVYLRAPVAVDAAVVS

SEQ ID NO: 87199 - protein, 16 aa, Mycobacterium tuberculosis
VYLRAPVAVDAAVVSM

SEQ ID NO: 87200 - protein, 16 aa, Mycobacterium tuberculosis
YLRAPVAVDAAVVSMA

SEQ ID NO: 87201 - protein, 16 aa, Mycobacterium tuberculosis
LRAPVAVDAAVVSMAN

SEQ ID NO: 87202 - protein, 16 aa, Mycobacterium tuberculosis
RAPVAVDAAVVSMANR

SEQ ID NO: 87203 - protein, 16 aa, Mycobacterium tuberculosis
APVAVDAAVVSMANRD

SEQ ID NO: 87204 - protein, 16 aa, Mycobacterium tuberculosis
PVAVDAAVVSMANRDC

SEQ ID NO: 87205 - protein, 16 aa, Mycobacterium tuberculosis
VAVDAAVVSMANRDCA

SEQ ID NO: 87206 - protein, 16 aa, Mycobacterium tuberculosis
AVDAAVVSMANRDCAA

SEQ ID NO: 87207 - protein, 16 aa, Mycobacterium tuberculosis
VDAAVVSMANRDCAAG

SEQ ID NO: 87208 - protein, 16 aa, Mycobacterium tuberculosis
DAAVVSMANRDCAAGF

SEQ ID NO: 87209 - protein, 16 aa, Mycobacterium tuberculosis
AAVVSMANRDCAAGFA

SEQ ID NO: 87210 - protein, 16 aa, Mycobacterium tuberculosis
AVVSMANRDCAAGFAP

SEQ ID NO: 87211 - protein, 16 aa, Mycobacterium tuberculosis
VVSMANRDCAAGFAPY

SEQ ID NO: 87212 - protein, 16 aa, Mycobacterium tuberculosis
VSMANRDCAAGFAPYT

SEQ ID NO: 87213 - protein, 16 aa, Mycobacterium tuberculosis
SMANRDCAAGFAPYTG

SEQ ID NO: 87214 - protein, 16 aa, Mycobacterium tuberculosis
MANRDCAAGFAPYTGQ

SEQ ID NO: 87215 - protein, 16 aa, Mycobacterium tuberculosis
ANRDCAAGFAPYTGQS

SEQ ID NO: 87216 - protein, 16 aa, Mycobacterium tuberculosis
NRDCAAGFAPYTGQSV

SEQ ID NO: 87217 - protein, 16 aa, Mycobacterium tuberculosis
RDCAAGFAPYTGQSVD

SEQ ID NO: 87218 - protein, 16 aa, Mycobacterium tuberculosis
DCAAGFAPYTGQSVDT

SEQ ID NO: 87219 - protein, 16 aa, Mycobacterium tuberculosis
CAAGFAPYTGQSVDTS

SEQ ID NO: 87220 - protein, 16 aa, Mycobacterium tuberculosis
AAGFAPYTGQSVDTSP

SEQ ID NO: 87221 - protein, 16 aa, Mycobacterium tuberculosis
AGFAPYTGQSVDTSPY

SEQ ID NO: 87222 - protein, 16 aa, Mycobacterium tuberculosis
GFAPYTGQSVDTSPYS

SEQ ID NO: 87223 - protein, 16 aa, Mycobacterium tuberculosis
FAPYTGQSVDTSPYSV

SEQ ID NO: 87224 - protein, 16 aa, Mycobacterium tuberculosis
APYTGQSVDTSPYSVA

SEQ ID NO: 87225 - protein, 16 aa, Mycobacterium tuberculosis
PYTGQSVDTSPYSVAY

SEQ ID NO: 87226 - protein, 16 aa, Mycobacterium tuberculosis
YTGQSVDTSPYSVAYL

SEQ ID NO: 87227 - protein, 16 aa, Mycobacterium tuberculosis
TGQSVDTSPYSVAYLI

SEQ ID NO: 87228 - protein, 16 aa, Mycobacterium tuberculosis
GQSVDTSPYSVAYLID

SEQ ID NO: 87229 - protein, 16 aa, Mycobacterium tuberculosis
QSVDTSPYSVAYLIDS

SEQ ID NO: 87230 - protein, 16 aa, Mycobacterium tuberculosis
SVDTSPYSVAYLIDSH

SEQ ID NO: 87231 - protein, 16 aa, Mycobacterium tuberculosis
VDTSPYSVAYLIDSHQ

SEQ ID NO: 87232 - protein, 16 aa, Mycobacterium tuberculosis
DTSPYSVAYLIDSHQD

SEQ ID NO: 87233 - protein, 16 aa, Mycobacterium tuberculosis
TSPYSVAYLIDSHQDR

SEQ ID NO: 87234 - protein, 16 aa, Mycobacterium tuberculosis
SPYSVAYLIDSHQDRT

SEQ ID NO: 87235 - protein, 16 aa, Mycobacterium tuberculosis
PYSVAYLIDSHQDRTG

SEQ ID NO: 87236 - protein, 16 aa, Mycobacterium tuberculosis
YSVAYLIDSHQDRTGA

SEQ ID NO: 87237 - protein, 16 aa, Mycobacterium tuberculosis
SVAYLIDSHQDRTGAD

SEQ ID NO: 87238 - protein, 16 aa, Mycobacterium tuberculosis
VAYLIDSHQDRTGADP

SEQ ID NO: 87239 - protein, 16 aa, Mycobacterium tuberculosis
AYLIDSHQDRTGADPT

SEQ ID NO: 87240 - protein, 16 aa, Mycobacterium tuberculosis
YLIDSHQDRTGADPTP

SEQ ID NO: 87241 - protein, 16 aa, Mycobacterium tuberculosis
LIDSHQDRTGADPTPS

SEQ ID NO: 87242 - protein, 16 aa, Mycobacterium tuberculosis
IDSHQDRTGADPTPST

SEQ ID NO: 87243 - protein, 16 aa, Mycobacterium tuberculosis
DSHQDRTGADPTPSTV

SEQ ID NO: 87244 - protein, 16 aa, Mycobacterium tuberculosis
SHQDRTGADPTPSTVI

SEQ ID NO: 87245 - protein, 16 aa, Mycobacterium tuberculosis
HQDRTGADPTPSTVIC

SEQ ID NO: 87246 - protein, 16 aa, Mycobacterium tuberculosis
QDRTGADPTPSTVICL

SEQ ID NO: 87247 - protein, 16 aa, Mycobacterium tuberculosis
DRTGADPTPSTVICLL

SEQ ID NO: 87248 - protein, 16 aa, Mycobacterium tuberculosis
RTGADPTPSTVICLLQ

SEQ ID NO: 87249 - protein, 16 aa, Mycobacterium tuberculosis
TGADPTPSTVICLLQP

SEQ ID NO: 87250 - protein, 16 aa, Mycobacterium tuberculosis
GADPTPSTVICLLQPA

SEQ ID NO: 87251 - protein, 16 aa, Mycobacterium tuberculosis
ADPTPSTVICLLQPAN

SEQ ID NO: 87252 - protein, 16 aa, Mycobacterium tuberculosis
DPTPSTVICLLQPANG

SEQ ID NO: 87253 - protein, 16 aa, Mycobacterium tuberculosis
PTPSTVICLLQPANGQ

SEQ ID NO: 87254 - protein, 16 aa, Mycobacterium tuberculosis
TPSTVICLLQPANGQL

SEQ ID NO: 87255 - protein, 16 aa, Mycobacterium tuberculosis
PSTVICLLQPANGQLL

SEQ ID NO: 87256 - protein, 16 aa, Mycobacterium tuberculosis
STVICLLQPANGQLLT

SEQ ID NO: 87257 - protein, 16 aa, Mycobacterium tuberculosis
TVICLLQPANGQLLTG

SEQ ID NO: 87258 - protein, 16 aa, Mycobacterium tuberculosis
VICLLQPANGQLLTGS

SEQ ID NO: 87259 - protein, 16 aa, Mycobacterium tuberculosis
ICLLQPANGQLLTGSA

SEQ ID NO: 87260 - protein, 16 aa, Mycobacterium tuberculosis
CLLQPANGQLLTGSAR

SEQ ID NO: 87261 - protein, 16 aa, Mycobacterium tuberculosis
LLQPANGQLLTGSARR

SEQ ID NO: 87262 - protein, 13 aa, Mycobacterium tuberculosis
MHAKVGDYLVVKG

SEQ ID NO: 87263 - protein, 13 aa, Mycobacterium tuberculosis
HAKVGDYLVVKGT

SEQ ID NO: 87264 - protein, 13 aa, Mycobacterium tuberculosis
AKVGDYLVVKGTT

SEQ ID NO: 87265 - protein, 13 aa, Mycobacterium tuberculosis
KVGDYLVVKGTTT

SEQ ID NO: 87266 - protein, 13 aa, Mycobacterium tuberculosis
VGDYLVVKGTTTE

SEQ ID NO: 87267 - protein, 13 aa, Mycobacterium tuberculosis
GDYLVVKGTTTER

SEQ ID NO: 87268 - protein, 13 aa, Mycobacterium tuberculosis
DYLVVKGTTTERH

SEQ ID NO: 87269 - protein, 13 aa, Mycobacterium tuberculosis
YLVVKGTTTERHD

SEQ ID NO: 87270 - protein, 13 aa, Mycobacterium tuberculosis
LVVKGTTTERHDQ

SEQ ID NO: 87271 - protein, 13 aa, Mycobacterium tuberculosis
VVKGTTTERHDQH

SEQ ID NO: 87272 - protein, 13 aa, Mycobacterium tuberculosis
VKGTTTERHDQHA

SEQ ID NO: 87273 - protein, 13 aa, Mycobacterium tuberculosis
KGTTTERHDQHAE

SEQ ID NO: 87274 - protein, 13 aa, Mycobacterium tuberculosis
GTTTERHDQHAEI

SEQ ID NO: 87275 - protein, 13 aa, Mycobacterium tuberculosis
TTTERHDQHAEII

SEQ ID NO: 87276 - protein, 13 aa, Mycobacterium tuberculosis
TTERHDQHAEIIE

SEQ ID NO: 87277 - protein, 13 aa, Mycobacterium tuberculosis
TERHDQHAEIIEV

SEQ ID NO: 87278 - protein, 13 aa, Mycobacterium tuberculosis
ERHDQHAEIIEVR

SEQ ID NO: 87279 - protein, 13 aa, Mycobacterium tuberculosis
RHDQHAEIIEVRS

SEQ ID NO: 87280 - protein, 13 aa, Mycobacterium tuberculosis
HDQHAEIIEVRSA

SEQ ID NO: 87281 - protein, 13 aa, Mycobacterium tuberculosis
DQHAEIIEVRSAD

SEQ ID NO: 87282 - protein, 13 aa, Mycobacterium tuberculosis
QHAEIIEVRSADG

SEQ ID NO: 87283 - protein, 13 aa, Mycobacterium tuberculosis
HAEIIEVRSADGS

SEQ ID NO: 87284 - protein, 13 aa, Mycobacterium tuberculosis
AEIIEVRSADGSP

SEQ ID NO: 87285 - protein, 13 aa, Mycobacterium tuberculosis
EIIEVRSADGSPP

SEQ ID NO: 87286 - protein, 13 aa, Mycobacterium tuberculosis
IIEVRSADGSPPY

SEQ ID NO: 87287 - protein, 13 aa, Mycobacterium tuberculosis
IEVRSADGSPPYV

SEQ ID NO: 87288 - protein, 13 aa, Mycobacterium tuberculosis
EVRSADGSPPYVV

SEQ ID NO: 87289 - protein, 13 aa, Mycobacterium tuberculosis
VRSADGSPPYVVR

SEQ ID NO: 87290 - protein, 13 aa, Mycobacterium tuberculosis
RSADGSPPYVVRW

SEQ ID NO: 87291 - protein, 13 aa, Mycobacterium tuberculosis
SADGSPPYVVRWL

SEQ ID NO: 87292 - protein, 13 aa, Mycobacterium tuberculosis
ADGSPPYVVRWLV

SEQ ID NO: 87293 - protein, 13 aa, Mycobacterium tuberculosis
DGSPPYVVRWLVN

SEQ ID NO: 87294 - protein, 13 aa, Mycobacterium tuberculosis
GSPPYVVRWLVNG

SEQ ID NO: 87295 - protein, 13 aa, Mycobacterium tuberculosis
SPPYVVRWLVNGH

SEQ ID NO: 87296 - protein, 13 aa, Mycobacterium tuberculosis
PPYVVRWLVNGHE

SEQ ID NO: 87297 - protein, 13 aa, Mycobacterium tuberculosis
PYVVRWLVNGHET

SEQ ID NO: 87298 - protein, 13 aa, Mycobacterium tuberculosis
YVVRWLVNGHETT

SEQ ID NO: 87299 - protein, 13 aa, Mycobacterium tuberculosis
VVRWLVNGHETTV

SEQ ID NO: 87300 - protein, 13 aa, Mycobacterium tuberculosis
VRWLVNGHETTVY

SEQ ID NO: 87301 - protein, 13 aa, Mycobacterium tuberculosis
RWLVNGHETTVYP

SEQ ID NO: 87302 - protein, 13 aa, Mycobacterium tuberculosis
WLVNGHETTVYPG

SEQ ID NO: 87303 - protein, 13 aa, Mycobacterium tuberculosis
LVNGHETTVYPGS

SEQ ID NO: 87304 - protein, 13 aa, Mycobacterium tuberculosis
VNGHETTVYPGSD

SEQ ID NO: 87305 - protein, 13 aa, Mycobacterium tuberculosis
NGHETTVYPGSDA

SEQ ID NO: 87306 - protein, 13 aa, Mycobacterium tuberculosis
GHETTVYPGSDAV

SEQ ID NO: 87307 - protein, 13 aa, Mycobacterium tuberculosis
HETTVYPGSDAVV

SEQ ID NO: 87308 - protein, 13 aa, Mycobacterium tuberculosis
ETTVYPGSDAVVV

SEQ ID NO: 87309 - protein, 13 aa, Mycobacterium tuberculosis
TTVYPGSDAVVVT

SEQ ID NO: 87310 - protein, 13 aa, Mycobacterium tuberculosis
TVYPGSDAVVVTA

SEQ ID NO: 87311 - protein, 13 aa, Mycobacterium tuberculosis
VYPGSDAVVVTAT

SEQ ID NO: 87312 - protein, 13 aa, Mycobacterium tuberculosis
YPGSDAVVVTATE

SEQ ID NO: 87313 - protein, 13 aa, Mycobacterium tuberculosis
PGSDAVVVTATEH

SEQ ID NO: 87314 - protein, 13 aa, Mycobacterium tuberculosis
GSDAVVVTATEHA

SEQ ID NO: 87315 - protein, 13 aa, Mycobacterium tuberculosis
SDAVVVTATEHAE

SEQ ID NO: 87316 - protein, 13 aa, Mycobacterium tuberculosis
DAVVVTATEHAEA

SEQ ID NO: 87317 - protein, 13 aa, Mycobacterium tuberculosis
AVVVTATEHAEAE

SEQ ID NO: 87318 - protein, 13 aa, Mycobacterium tuberculosis
VVVTATEHAEAEK

SEQ ID NO: 87319 - protein, 13 aa, Mycobacterium tuberculosis
VVTATEHAEAEKR

SEQ ID NO: 87320 - protein, 13 aa, Mycobacterium tuberculosis
VTATEHAEAEKRA

SEQ ID NO: 87321 - protein, 13 aa, Mycobacterium tuberculosis
TATEHAEAEKRAA

SEQ ID NO: 87322 - protein, 13 aa, Mycobacterium tuberculosis
ATEHAEAEKRAAA

SEQ ID NO: 87323 - protein, 13 aa, Mycobacterium tuberculosis
TEHAEAEKRAAAR

SEQ ID NO: 87324 - protein, 13 aa, Mycobacterium tuberculosis
EHAEAEKRAAARA

SEQ ID NO: 87325 - protein, 13 aa, Mycobacterium tuberculosis
HAEAEKRAAARAG

SEQ ID NO: 87326 - protein, 13 aa, Mycobacterium tuberculosis
AEAEKRAAARAGH

SEQ ID NO: 87327 - protein, 13 aa, Mycobacterium tuberculosis
EAEKRAAARAGHA

SEQ ID NO: 87328 - protein, 13 aa, Mycobacterium tuberculosis
AEKRAAARAGHAA

SEQ ID NO: 87329 - protein, 13 aa, Mycobacterium tuberculosis
EKRAAARAGHAAT

SEQ ID NO: 87330 - protein, 12 aa, Mycobacterium tuberculosis
KRAAARAGHAAT

SEQ ID NO: 87331 - protein, 11 aa, Mycobacterium tuberculosis
RAAARAGHAAT

SEQ ID NO: 87332 - protein, 14 aa, Mycobacterium tuberculosis
MHAKVGDYLVVKGT

SEQ ID NO: 87333 - protein, 14 aa, Mycobacterium tuberculosis
HAKVGDYLVVKGTT

SEQ ID NO: 87334 - protein, 14 aa, Mycobacterium tuberculosis
AKVGDYLVVKGTTT

SEQ ID NO: 87335 - protein, 14 aa, Mycobacterium tuberculosis
KVGDYLVVKGTTTE

SEQ ID NO: 87336 - protein, 14 aa, Mycobacterium tuberculosis
VGDYLVVKGTTTER

SEQ ID NO: 87337 - protein, 14 aa, Mycobacterium tuberculosis
GDYLVVKGTTTERH

SEQ ID NO: 87338 - protein, 14 aa, Mycobacterium tuberculosis
DYLVVKGTTTERHD

SEQ ID NO: 87339 - protein, 14 aa, Mycobacterium tuberculosis
YLVVKGTTTERHDQ

SEQ ID NO: 87340 - protein, 14 aa, Mycobacterium tuberculosis
LVVKGTTTERHDQH

SEQ ID NO: 87341 - protein, 14 aa, Mycobacterium tuberculosis
VVKGTTTERHDQHA

SEQ ID NO: 87342 - protein, 14 aa, Mycobacterium tuberculosis
VKGTTTERHDQHAE

SEQ ID NO: 87343 - protein, 14 aa, Mycobacterium tuberculosis
KGTTTERHDQHAEI

SEQ ID NO: 87344 - protein, 14 aa, Mycobacterium tuberculosis
GTTTERHDQHAEII

SEQ ID NO: 87345 - protein, 14 aa, Mycobacterium tuberculosis
TTTERHDQHAEIIE

SEQ ID NO: 87346 - protein, 14 aa, Mycobacterium tuberculosis
TTERHDQHAEIIEV

SEQ ID NO: 87347 - protein, 14 aa, Mycobacterium tuberculosis
TERHDQHAEIIEVR

SEQ ID NO: 87348 - protein, 14 aa, Mycobacterium tuberculosis
ERHDQHAEIIEVRS

SEQ ID NO: 87349 - protein, 14 aa, Mycobacterium tuberculosis
RHDQHAEIIEVRSA

SEQ ID NO: 87350 - protein, 14 aa, Mycobacterium tuberculosis
HDQHAEIIEVRSAD

SEQ ID NO: 87351 - protein, 14 aa, Mycobacterium tuberculosis
DQHAEIIEVRSADG

SEQ ID NO: 87352 - protein, 14 aa, Mycobacterium tuberculosis
QHAEIIEVRSADGS

SEQ ID NO: 87353 - protein, 14 aa, Mycobacterium tuberculosis
HAEIIEVRSADGSP

SEQ ID NO: 87354 - protein, 14 aa, Mycobacterium tuberculosis
AEIIEVRSADGSPP

SEQ ID NO: 87355 - protein, 14 aa, Mycobacterium tuberculosis
EIIEVRSADGSPPY

SEQ ID NO: 87356 - protein, 14 aa, Mycobacterium tuberculosis
IIEVRSADGSPPYV

SEQ ID NO: 87357 - protein, 14 aa, Mycobacterium tuberculosis
IEVRSADGSPPYVV

SEQ ID NO: 87358 - protein, 14 aa, Mycobacterium tuberculosis
EVRSADGSPPYVVR

SEQ ID NO: 87359 - protein, 14 aa, Mycobacterium tuberculosis
VRSADGSPPYVVRW

SEQ ID NO: 87360 - protein, 14 aa, Mycobacterium tuberculosis
RSADGSPPYVVRWL

SEQ ID NO: 87361 - protein, 14 aa, Mycobacterium tuberculosis
SADGSPPYVVRWLV

SEQ ID NO: 87362 - protein, 14 aa, Mycobacterium tuberculosis
ADGSPPYVVRWLVN

SEQ ID NO: 87363 - protein, 14 aa, Mycobacterium tuberculosis
DGSPPYVVRWLVNG

SEQ ID NO: 87364 - protein, 14 aa, Mycobacterium tuberculosis
GSPPYVVRWLVNGH

SEQ ID NO: 87365 - protein, 14 aa, Mycobacterium tuberculosis
SPPYVVRWLVNGHE

SEQ ID NO: 87366 - protein, 14 aa, Mycobacterium tuberculosis
PPYVVRWLVNGHET

SEQ ID NO: 87367 - protein, 14 aa, Mycobacterium tuberculosis
PYVVRWLVNGHETT

SEQ ID NO: 87368 - protein, 14 aa, Mycobacterium tuberculosis
YVVRWLVNGHETTV

SEQ ID NO: 87369 - protein, 14 aa, Mycobacterium tuberculosis
VVRWLVNGHETTVY

SEQ ID NO: 87370 - protein, 14 aa, Mycobacterium tuberculosis
VRWLVNGHETTVYP

SEQ ID NO: 87371 - protein, 14 aa, Mycobacterium tuberculosis
RWLVNGHETTVYPG

SEQ ID NO: 87372 - protein, 14 aa, Mycobacterium tuberculosis
WLVNGHETTVYPGS

SEQ ID NO: 87373 - protein, 14 aa, Mycobacterium tuberculosis
LVNGHETTVYPGSD

SEQ ID NO: 87374 - protein, 14 aa, Mycobacterium tuberculosis
VNGHETTVYPGSDA

SEQ ID NO: 87375 - protein, 14 aa, Mycobacterium tuberculosis
NGHETTVYPGSDAV

SEQ ID NO: 87376 - protein, 14 aa, Mycobacterium tuberculosis
GHETTVYPGSDAVV

SEQ ID NO: 87377 - protein, 14 aa, Mycobacterium tuberculosis
HETTVYPGSDAVVV

SEQ ID NO: 87378 - protein, 14 aa, Mycobacterium tuberculosis
ETTVYPGSDAVVVT

SEQ ID NO: 87379 - protein, 14 aa, Mycobacterium tuberculosis
TTVYPGSDAVVVTA

SEQ ID NO: 87380 - protein, 14 aa, Mycobacterium tuberculosis
TVYPGSDAVVVTAT

SEQ ID NO: 87381 - protein, 14 aa, Mycobacterium tuberculosis
VYPGSDAVVVTATE

SEQ ID NO: 87382 - protein, 14 aa, Mycobacterium tuberculosis
YPGSDAVVVTATEH

SEQ ID NO: 87383 - protein, 14 aa, Mycobacterium tuberculosis
PGSDAVVVTATEHA

SEQ ID NO: 87384 - protein, 14 aa, Mycobacterium tuberculosis
GSDAVVVTATEHAE

SEQ ID NO: 87385 - protein, 14 aa, Mycobacterium tuberculosis
SDAVVVTATEHAEA

SEQ ID NO: 87386 - protein, 14 aa, Mycobacterium tuberculosis
DAVVVTATEHAEAE

SEQ ID NO: 87387 - protein, 14 aa, Mycobacterium tuberculosis
AVVVTATEHAEAEK

SEQ ID NO: 87388 - protein, 14 aa, Mycobacterium tuberculosis
VVVTATEHAEAEKR

SEQ ID NO: 87389 - protein, 14 aa, Mycobacterium tuberculosis
VVTATEHAEAEKRA

SEQ ID NO: 87390 - protein, 14 aa, Mycobacterium tuberculosis
VTATEHAEAEKRAA

SEQ ID NO: 87391 - protein, 14 aa, Mycobacterium tuberculosis
TATEHAEAEKRAAA

SEQ ID NO: 87392 - protein, 14 aa, Mycobacterium tuberculosis
ATEHAEAEKRAAAR

SEQ ID NO: 87393 - protein, 14 aa, Mycobacterium tuberculosis
TEHAEAEKRAAARA

SEQ ID NO: 87394 - protein, 14 aa, Mycobacterium tuberculosis
EHAEAEKRAAARAG

SEQ ID NO: 87395 - protein, 14 aa, Mycobacterium tuberculosis
HAEAEKRAAARAGH

SEQ ID NO: 87396 - protein, 14 aa, Mycobacterium tuberculosis
AEAEKRAAARAGHA

SEQ ID NO: 87397 - protein, 14 aa, Mycobacterium tuberculosis
EAEKRAAARAGHAA

SEQ ID NO: 87398 - protein, 14 aa, Mycobacterium tuberculosis
AEKRAAARAGHAAT

SEQ ID NO: 87399 - protein, 15 aa, Mycobacterium tuberculosis
MHAKVGDYLVVKGTT

SEQ ID NO: 87400 - protein, 15 aa, Mycobacterium tuberculosis
HAKVGDYLVVKGTTT

SEQ ID NO: 87401 - protein, 15 aa, Mycobacterium tuberculosis
AKVGDYLVVKGTTTE

SEQ ID NO: 87402 - protein, 15 aa, Mycobacterium tuberculosis
KVGDYLVVKGTTTER

SEQ ID NO: 87403 - protein, 15 aa, Mycobacterium tuberculosis
VGDYLVVKGTTTERH

SEQ ID NO: 87404 - protein, 15 aa, Mycobacterium tuberculosis
GDYLVVKGTTTERHD

SEQ ID NO: 87405 - protein, 15 aa, Mycobacterium tuberculosis
DYLVVKGTTTERHDQ

SEQ ID NO: 87406 - protein, 15 aa, Mycobacterium tuberculosis
YLVVKGTTTERHDQH

SEQ ID NO: 87407 - protein, 15 aa, Mycobacterium tuberculosis
LVVKGTTTERHDQHA

SEQ ID NO: 87408 - protein, 15 aa, Mycobacterium tuberculosis
VVKGTTTERHDQHAE

SEQ ID NO: 87409 - protein, 15 aa, Mycobacterium tuberculosis
VKGTTTERHDQHAEI

SEQ ID NO: 87410 - protein, 15 aa, Mycobacterium tuberculosis
KGTTTERHDQHAEII

SEQ ID NO: 87411 - protein, 15 aa, Mycobacterium tuberculosis
GTTTERHDQHAEIIE

SEQ ID NO: 87412 - protein, 15 aa, Mycobacterium tuberculosis
TTTERHDQHAEIIEV

SEQ ID NO: 87413 - protein, 15 aa, Mycobacterium tuberculosis
TTERHDQHAEIIEVR

SEQ ID NO: 87414 - protein, 15 aa, Mycobacterium tuberculosis
TERHDQHAEIIEVRS

SEQ ID NO: 87415 - protein, 15 aa, Mycobacterium tuberculosis
ERHDQHAEIIEVRSA

SEQ ID NO: 87416 - protein, 15 aa, Mycobacterium tuberculosis
RHDQHAEIIEVRSAD

SEQ ID NO: 87417 - protein, 15 aa, Mycobacterium tuberculosis
HDQHAEIIEVRSADG

SEQ ID NO: 87418 - protein, 15 aa, Mycobacterium tuberculosis
DQHAEIIEVRSADGS

SEQ ID NO: 87419 - protein, 15 aa, Mycobacterium tuberculosis
QHAEIIEVRSADGSP

SEQ ID NO: 87420 - protein, 15 aa, Mycobacterium tuberculosis
HAEIIEVRSADGSPP

SEQ ID NO: 87421 - protein, 15 aa, Mycobacterium tuberculosis
AEIIEVRSADGSPPY

SEQ ID NO: 87422 - protein, 15 aa, Mycobacterium tuberculosis
EIIEVRSADGSPPYV

SEQ ID NO: 87423 - protein, 15 aa, Mycobacterium tuberculosis
IIEVRSADGSPPYVV

SEQ ID NO: 87424 - protein, 15 aa, Mycobacterium tuberculosis
IEVRSADGSPPYVVR

SEQ ID NO: 87425 - protein, 15 aa, Mycobacterium tuberculosis
EVRSADGSPPYVVRW

SEQ ID NO: 87426 - protein, 15 aa, Mycobacterium tuberculosis
VRSADGSPPYVVRWL

SEQ ID NO: 87427 - protein, 15 aa, Mycobacterium tuberculosis
RSADGSPPYVVRWLV

SEQ ID NO: 87428 - protein, 15 aa, Mycobacterium tuberculosis
SADGSPPYVVRWLVN

SEQ ID NO: 87429 - protein, 15 aa, Mycobacterium tuberculosis
ADGSPPYVVRWLVNG

SEQ ID NO: 87430 - protein, 15 aa, Mycobacterium tuberculosis
DGSPPYVVRWLVNGH

SEQ ID NO: 87431 - protein, 15 aa, Mycobacterium tuberculosis
GSPPYVVRWLVNGHE

SEQ ID NO: 87432 - protein, 15 aa, Mycobacterium tuberculosis
SPPYVVRWLVNGHET

SEQ ID NO: 87433 - protein, 15 aa, Mycobacterium tuberculosis
PPYVVRWLVNGHETT

SEQ ID NO: 87434 - protein, 15 aa, Mycobacterium tuberculosis
PYVVRWLVNGHETTV

SEQ ID NO: 87435 - protein, 15 aa, Mycobacterium tuberculosis
YVVRWLVNGHETTVY

SEQ ID NO: 87436 - protein, 15 aa, Mycobacterium tuberculosis
VVRWLVNGHETTVYP

SEQ ID NO: 87437 - protein, 15 aa, Mycobacterium tuberculosis
VRWLVNGHETTVYPG

SEQ ID NO: 87438 - protein, 15 aa, Mycobacterium tuberculosis
RWLVNGHETTVYPGS

SEQ ID NO: 87439 - protein, 15 aa, Mycobacterium tuberculosis
WLVNGHETTVYPGSD

SEQ ID NO: 87440 - protein, 15 aa, Mycobacterium tuberculosis
LVNGHETTVYPGSDA

SEQ ID NO: 87441 - protein, 15 aa, Mycobacterium tuberculosis
VNGHETTVYPGSDAV

SEQ ID NO: 87442 - protein, 15 aa, Mycobacterium tuberculosis
NGHETTVYPGSDAVV

SEQ ID NO: 87443 - protein, 15 aa, Mycobacterium tuberculosis
GHETTVYPGSDAVVV

SEQ ID NO: 87444 - protein, 15 aa, Mycobacterium tuberculosis
HETTVYPGSDAVVVT

SEQ ID NO: 87445 - protein, 15 aa, Mycobacterium tuberculosis
ETTVYPGSDAVVVTA

SEQ ID NO: 87446 - protein, 15 aa, Mycobacterium tuberculosis
TTVYPGSDAVVVTAT

SEQ ID NO: 87447 - protein, 15 aa, Mycobacterium tuberculosis
TVYPGSDAVVVTATE

SEQ ID NO: 87448 - protein, 15 aa, Mycobacterium tuberculosis
VYPGSDAVVVTATEH

SEQ ID NO: 87449 - protein, 15 aa, Mycobacterium tuberculosis
YPGSDAVVVTATEHA

SEQ ID NO: 87450 - protein, 15 aa, Mycobacterium tuberculosis
PGSDAVVVTATEHAE

SEQ ID NO: 87451 - protein, 15 aa, Mycobacterium tuberculosis
GSDAVVVTATEHAEA

SEQ ID NO: 87452 - protein, 15 aa, Mycobacterium tuberculosis
SDAVVVTATEHAEAE

SEQ ID NO: 87453 - protein, 15 aa, Mycobacterium tuberculosis
DAVVVTATEHAEAEK

SEQ ID NO: 87454 - protein, 15 aa, Mycobacterium tuberculosis
AVVVTATEHAEAEKR

SEQ ID NO: 87455 - protein, 15 aa, Mycobacterium tuberculosis
VVVTATEHAEAEKRA

SEQ ID NO: 87456 - protein, 15 aa, Mycobacterium tuberculosis
VVTATEHAEAEKRAA

SEQ ID NO: 87457 - protein, 15 aa, Mycobacterium tuberculosis
VTATEHAEAEKRAAA

SEQ ID NO: 87458 - protein, 15 aa, Mycobacterium tuberculosis
TATEHAEAEKRAAAR

SEQ ID NO: 87459 - protein, 15 aa, Mycobacterium tuberculosis
ATEHAEAEKRAAARA

SEQ ID NO: 87460 - protein, 15 aa, Mycobacterium tuberculosis
TEHAEAEKRAAARAG

SEQ ID NO: 87461 - protein, 15 aa, Mycobacterium tuberculosis
EHAEAEKRAAARAGH

SEQ ID NO: 87462 - protein, 15 aa, Mycobacterium tuberculosis
HAEAEKRAAARAGHA

SEQ ID NO: 87463 - protein, 15 aa, Mycobacterium tuberculosis
AEAEKRAAARAGHAA

SEQ ID NO: 87464 - protein, 15 aa, Mycobacterium tuberculosis
EAEKRAAARAGHAAT

SEQ ID NO: 87465 - protein, 16 aa, Mycobacterium tuberculosis
MHAKVGDYLVVKGTTT

SEQ ID NO: 87466 - protein, 16 aa, Mycobacterium tuberculosis
HAKVGDYLVVKGTTTE

SEQ ID NO: 87467 - protein, 16 aa, Mycobacterium tuberculosis
AKVGDYLVVKGTTTER

SEQ ID NO: 87468 - protein, 16 aa, Mycobacterium tuberculosis
KVGDYLVVKGTTTERH

SEQ ID NO: 87469 - protein, 16 aa, Mycobacterium tuberculosis
VGDYLVVKGTTTERHD

SEQ ID NO: 87470 - protein, 16 aa, Mycobacterium tuberculosis
GDYLVVKGTTTERHDQ

SEQ ID NO: 87471 - protein, 16 aa, Mycobacterium tuberculosis
DYLVVKGTTTERHDQH

SEQ ID NO: 87472 - protein, 16 aa, Mycobacterium tuberculosis
YLVVKGTTTERHDQHA

SEQ ID NO: 87473 - protein, 16 aa, Mycobacterium tuberculosis
LVVKGTTTERHDQHAE

SEQ ID NO: 87474 - protein, 16 aa, Mycobacterium tuberculosis
VVKGTTTERHDQHAEI

SEQ ID NO: 87475 - protein, 16 aa, Mycobacterium tuberculosis
VKGTTTERHDQHAEII

SEQ ID NO: 87476 - protein, 16 aa, Mycobacterium tuberculosis
KGTTTERHDQHAEIIE

SEQ ID NO: 87477 - protein, 16 aa, Mycobacterium tuberculosis
GTTTERHDQHAEIIEV

SEQ ID NO: 87478 - protein, 16 aa, Mycobacterium tuberculosis
TTTERHDQHAEIIEVR

SEQ ID NO: 87479 - protein, 16 aa, Mycobacterium tuberculosis
TTERHDQHAEIIEVRS

SEQ ID NO: 87480 - protein, 16 aa, Mycobacterium tuberculosis
TERHDQHAEIIEVRSA

SEQ ID NO: 87481 - protein, 16 aa, Mycobacterium tuberculosis
ERHDQHAEIIEVRSAD

SEQ ID NO: 87482 - protein, 16 aa, Mycobacterium tuberculosis
RHDQHAEIIEVRSADG

SEQ ID NO: 87483 - protein, 16 aa, Mycobacterium tuberculosis
HDQHAEIIEVRSADGS

SEQ ID NO: 87484 - protein, 16 aa, Mycobacterium tuberculosis
DQHAEIIEVRSADGSP

SEQ ID NO: 87485 - protein, 16 aa, Mycobacterium tuberculosis
QHAEIIEVRSADGSPP

SEQ ID NO: 87486 - protein, 16 aa, Mycobacterium tuberculosis
HAEIIEVRSADGSPPY

SEQ ID NO: 87487 - protein, 16 aa, Mycobacterium tuberculosis
AEIIEVRSADGSPPYV

SEQ ID NO: 87488 - protein, 16 aa, Mycobacterium tuberculosis
EIIEVRSADGSPPYVV

SEQ ID NO: 87489 - protein, 16 aa, Mycobacterium tuberculosis
IIEVRSADGSPPYVVR

SEQ ID NO: 87490 - protein, 16 aa, Mycobacterium tuberculosis
IEVRSADGSPPYVVRW

SEQ ID NO: 87491 - protein, 16 aa, Mycobacterium tuberculosis
EVRSADGSPPYVVRWL

SEQ ID NO: 87492 - protein, 16 aa, Mycobacterium tuberculosis
VRSADGSPPYVVRWLV

SEQ ID NO: 87493 - protein, 16 aa, Mycobacterium tuberculosis
RSADGSPPYVVRWLVN

SEQ ID NO: 87494 - protein, 16 aa, Mycobacterium tuberculosis
SADGSPPYVVRWLVNG

SEQ ID NO: 87495 - protein, 16 aa, Mycobacterium tuberculosis
ADGSPPYVVRWLVNGH

SEQ ID NO: 87496 - protein, 16 aa, Mycobacterium tuberculosis
DGSPPYVVRWLVNGHE

SEQ ID NO: 87497 - protein, 16 aa, Mycobacterium tuberculosis
GSPPYVVRWLVNGHET

SEQ ID NO: 87498 - protein, 16 aa, Mycobacterium tuberculosis
SPPYVVRWLVNGHETT

SEQ ID NO: 87499 - protein, 16 aa, Mycobacterium tuberculosis
PPYVVRWLVNGHETTV

SEQ ID NO: 87500 - protein, 16 aa, Mycobacterium tuberculosis
PYVVRWLVNGHETTVY

SEQ ID NO: 87501 - protein, 16 aa, Mycobacterium tuberculosis
YVVRWLVNGHETTVYP

SEQ ID NO: 87502 - protein, 16 aa, Mycobacterium tuberculosis
VVRWLVNGHETTVYPG

SEQ ID NO: 87503 - protein, 16 aa, Mycobacterium tuberculosis
VRWLVNGHETTVYPGS

SEQ ID NO: 87504 - protein, 16 aa, Mycobacterium tuberculosis
RWLVNGHETTVYPGSD

SEQ ID NO: 87505 - protein, 16 aa, Mycobacterium tuberculosis
WLVNGHETTVYPGSDA

SEQ ID NO: 87506 - protein, 16 aa, Mycobacterium tuberculosis
LVNGHETTVYPGSDAV

SEQ ID NO: 87507 - protein, 16 aa, Mycobacterium tuberculosis
VNGHETTVYPGSDAVV

SEQ ID NO: 87508 - protein, 16 aa, Mycobacterium tuberculosis
NGHETTVYPGSDAVVV

SEQ ID NO: 87509 - protein, 16 aa, Mycobacterium tuberculosis
GHETTVYPGSDAVVVT

SEQ ID NO: 87510 - protein, 16 aa, Mycobacterium tuberculosis
HETTVYPGSDAVVVTA

SEQ ID NO: 87511 - protein, 16 aa, Mycobacterium tuberculosis
ETTVYPGSDAVVVTAT

SEQ ID NO: 87512 - protein, 16 aa, Mycobacterium tuberculosis
TTVYPGSDAVVVTATE

SEQ ID NO: 87513 - protein, 16 aa, Mycobacterium tuberculosis
TVYPGSDAVVVTATEH

SEQ ID NO: 87514 - protein, 16 aa, Mycobacterium tuberculosis
VYPGSDAVVVTATEHA

SEQ ID NO: 87515 - protein, 16 aa, Mycobacterium tuberculosis
YPGSDAVVVTATEHAE

SEQ ID NO: 87516 - protein, 16 aa, Mycobacterium tuberculosis
PGSDAVVVTATEHAEA

SEQ ID NO: 87517 - protein, 16 aa, Mycobacterium tuberculosis
GSDAVVVTATEHAEAE

SEQ ID NO: 87518 - protein, 16 aa, Mycobacterium tuberculosis
SDAVVVTATEHAEAEK

SEQ ID NO: 87519 - protein, 16 aa, Mycobacterium tuberculosis
DAVVVTATEHAEAEKR

SEQ ID NO: 87520 - protein, 16 aa, Mycobacterium tuberculosis
AVVVTATEHAEAEKRA

SEQ ID NO: 87521 - protein, 16 aa, Mycobacterium tuberculosis
VVVTATEHAEAEKRAA

SEQ ID NO: 87522 - protein, 16 aa, Mycobacterium tuberculosis
VVTATEHAEAEKRAAA

SEQ ID NO: 87523 - protein, 16 aa, Mycobacterium tuberculosis
VTATEHAEAEKRAAAR

SEQ ID NO: 87524 - protein, 16 aa, Mycobacterium tuberculosis
TATEHAEAEKRAAARA

SEQ ID NO: 87525 - protein, 16 aa, Mycobacterium tuberculosis
ATEHAEAEKRAAARAG

SEQ ID NO: 87526 - protein, 16 aa, Mycobacterium tuberculosis
TEHAEAEKRAAARAGH

SEQ ID NO: 87527 - protein, 16 aa, Mycobacterium tuberculosis
EHAEAEKRAAARAGHA

SEQ ID NO: 87528 - protein, 16 aa, Mycobacterium tuberculosis
HAEAEKRAAARAGHAA

SEQ ID NO: 87529 - protein, 16 aa, Mycobacterium tuberculosis
AEAEKRAAARAGHAAT

SEQ ID NO: 87530 - protein, 13 aa, Mycobacterium tuberculosis
MTINYQFGDVDAH

SEQ ID NO: 87531 - protein, 13 aa, Mycobacterium tuberculosis
TINYQFGDVDAHG

SEQ ID NO: 87532 - protein, 13 aa, Mycobacterium tuberculosis
INYQFGDVDAHGA

SEQ ID NO: 87533 - protein, 13 aa, Mycobacterium tuberculosis
NYQFGDVDAHGAM

SEQ ID NO: 87534 - protein, 13 aa, Mycobacterium tuberculosis
YQFGDVDAHGAMI

SEQ ID NO: 87535 - protein, 13 aa, Mycobacterium tuberculosis
QFGDVDAHGAMIR

SEQ ID NO: 87536 - protein, 13 aa, Mycobacterium tuberculosis
FGDVDAHGAMIRA

SEQ ID NO: 87537 - protein, 13 aa, Mycobacterium tuberculosis
GDVDAHGAMIRAQ

SEQ ID NO: 87538 - protein, 13 aa, Mycobacterium tuberculosis
DVDAHGAMIRAQA

SEQ ID NO: 87539 - protein, 13 aa, Mycobacterium tuberculosis
VDAHGAMIRAQAG

SEQ ID NO: 87540 - protein, 13 aa, Mycobacterium tuberculosis
DAHGAMIRAQAGL

SEQ ID NO: 87541 - protein, 13 aa, Mycobacterium tuberculosis
AHGAMIRAQAGLL

SEQ ID NO: 87542 - protein, 13 aa, Mycobacterium tuberculosis
HGAMIRAQAGLLE

SEQ ID NO: 87543 - protein, 13 aa, Mycobacterium tuberculosis
GAMIRAQAGLLEA

SEQ ID NO: 87544 - protein, 13 aa, Mycobacterium tuberculosis
AMIRAQAGLLEAE

SEQ ID NO: 87545 - protein, 13 aa, Mycobacterium tuberculosis
MIRAQAGLLEAEH

SEQ ID NO: 87546 - protein, 13 aa, Mycobacterium tuberculosis
IRAQAGLLEAEHQ

SEQ ID NO: 87547 - protein, 13 aa, Mycobacterium tuberculosis
RAQAGLLEAEHQA

SEQ ID NO: 87548 - protein, 13 aa, Mycobacterium tuberculosis
AQAGLLEAEHQAI

SEQ ID NO: 87549 - protein, 13 aa, Mycobacterium tuberculosis
QAGLLEAEHQAIV

SEQ ID NO: 87550 - protein, 13 aa, Mycobacterium tuberculosis
AGLLEAEHQAIVR

SEQ ID NO: 87551 - protein, 13 aa, Mycobacterium tuberculosis
GLLEAEHQAIVRD

SEQ ID NO: 87552 - protein, 13 aa, Mycobacterium tuberculosis
LLEAEHQAIVRDV

SEQ ID NO: 87553 - protein, 13 aa, Mycobacterium tuberculosis
LEAEHQAIVRDVL

SEQ ID NO: 87554 - protein, 13 aa, Mycobacterium tuberculosis
EAEHQAIVRDVLA

SEQ ID NO: 87555 - protein, 13 aa, Mycobacterium tuberculosis
AEHQAIVRDVLAA

SEQ ID NO: 87556 - protein, 13 aa, Mycobacterium tuberculosis
EHQAIVRDVLAAG

SEQ ID NO: 87557 - protein, 13 aa, Mycobacterium tuberculosis
HQAIVRDVLAAGD

SEQ ID NO: 87558 - protein, 13 aa, Mycobacterium tuberculosis
QAIVRDVLAAGDF

SEQ ID NO: 87559 - protein, 13 aa, Mycobacterium tuberculosis
AIVRDVLAAGDFW

SEQ ID NO: 87560 - protein, 13 aa, Mycobacterium tuberculosis
IVRDVLAAGDFWG

SEQ ID NO: 87561 - protein, 13 aa, Mycobacterium tuberculosis
VRDVLAAGDFWGG

SEQ ID NO: 87562 - protein, 13 aa, Mycobacterium tuberculosis
RDVLAAGDFWGGA

SEQ ID NO: 87563 - protein, 13 aa, Mycobacterium tuberculosis
DVLAAGDFWGGAG

SEQ ID NO: 87564 - protein, 13 aa, Mycobacterium tuberculosis
VLAAGDFWGGAGS

SEQ ID NO: 87565 - protein, 13 aa, Mycobacterium tuberculosis
LAAGDFWGGAGSV

SEQ ID NO: 87566 - protein, 13 aa, Mycobacterium tuberculosis
AAGDFWGGAGSVA

SEQ ID NO: 87567 - protein, 13 aa, Mycobacterium tuberculosis
AGDFWGGAGSVAC

SEQ ID NO: 87568 - protein, 13 aa, Mycobacterium tuberculosis
GDFWGGAGSVACQ

SEQ ID NO: 87569 - protein, 13 aa, Mycobacterium tuberculosis
DFWGGAGSVACQE

SEQ ID NO: 87570 - protein, 13 aa, Mycobacterium tuberculosis
FWGGAGSVACQEF

SEQ ID NO: 87571 - protein, 13 aa, Mycobacterium tuberculosis
WGGAGSVACQEFI

SEQ ID NO: 87572 - protein, 13 aa, Mycobacterium tuberculosis
GGAGSVACQEFIT

SEQ ID NO: 87573 - protein, 13 aa, Mycobacterium tuberculosis
GAGSVACQEFITQ

SEQ ID NO: 87574 - protein, 13 aa, Mycobacterium tuberculosis
AGSVACQEFITQL

SEQ ID NO: 87575 - protein, 13 aa, Mycobacterium tuberculosis
GSVACQEFITQLG

SEQ ID NO: 87576 - protein, 13 aa, Mycobacterium tuberculosis
SVACQEFITQLGR

SEQ ID NO: 87577 - protein, 13 aa, Mycobacterium tuberculosis
VACQEFITQLGRN

SEQ ID NO: 87578 - protein, 13 aa, Mycobacterium tuberculosis
ACQEFITQLGRNF

SEQ ID NO: 87579 - protein, 13 aa, Mycobacterium tuberculosis
CQEFITQLGRNFQ

SEQ ID NO: 87580 - protein, 13 aa, Mycobacterium tuberculosis
QEFITQLGRNFQV

SEQ ID NO: 87581 - protein, 13 aa, Mycobacterium tuberculosis
EFITQLGRNFQVI

SEQ ID NO: 87582 - protein, 13 aa, Mycobacterium tuberculosis
FITQLGRNFQVIY

SEQ ID NO: 87583 - protein, 13 aa, Mycobacterium tuberculosis
ITQLGRNFQVIYE

SEQ ID NO: 87584 - protein, 13 aa, Mycobacterium tuberculosis
TQLGRNFQVIYEQ

SEQ ID NO: 87585 - protein, 13 aa, Mycobacterium tuberculosis
QLGRNFQVIYEQA

SEQ ID NO: 87586 - protein, 13 aa, Mycobacterium tuberculosis
LGRNFQVIYEQAN

SEQ ID NO: 87587 - protein, 13 aa, Mycobacterium tuberculosis
GRNFQVIYEQANA

SEQ ID NO: 87588 - protein, 13 aa, Mycobacterium tuberculosis
RNFQVIYEQANAH

SEQ ID NO: 87589 - protein, 13 aa, Mycobacterium tuberculosis
NFQVIYEQANAHG

SEQ ID NO: 87590 - protein, 13 aa, Mycobacterium tuberculosis
FQVIYEQANAHGQ

SEQ ID NO: 87591 - protein, 13 aa, Mycobacterium tuberculosis
QVIYEQANAHGQK

SEQ ID NO: 87592 - protein, 13 aa, Mycobacterium tuberculosis
VIYEQANAHGQKV

SEQ ID NO: 87593 - protein, 13 aa, Mycobacterium tuberculosis
IYEQANAHGQKVQ

SEQ ID NO: 87594 - protein, 13 aa, Mycobacterium tuberculosis
YEQANAHGQKVQA

SEQ ID NO: 87595 - protein, 13 aa, Mycobacterium tuberculosis
EQANAHGQKVQAA

SEQ ID NO: 87596 - protein, 13 aa, Mycobacterium tuberculosis
QANAHGQKVQAAG

SEQ ID NO: 87597 - protein, 13 aa, Mycobacterium tuberculosis
ANAHGQKVQAAGN

SEQ ID NO: 87598 - protein, 13 aa, Mycobacterium tuberculosis
NAHGQKVQAAGNN

SEQ ID NO: 87599 - protein, 13 aa, Mycobacterium tuberculosis
AHGQKVQAAGNNM

SEQ ID NO: 87600 - protein, 13 aa, Mycobacterium tuberculosis
HGQKVQAAGNNMA

SEQ ID NO: 87601 - protein, 13 aa, Mycobacterium tuberculosis
GQKVQAAGNNMAQ

SEQ ID NO: 87602 - protein, 13 aa, Mycobacterium tuberculosis
QKVQAAGNNMAQT

SEQ ID NO: 87603 - protein, 13 aa, Mycobacterium tuberculosis
KVQAAGNNMAQTD

SEQ ID NO: 87604 - protein, 13 aa, Mycobacterium tuberculosis
VQAAGNNMAQTDS

SEQ ID NO: 87605 - protein, 13 aa, Mycobacterium tuberculosis
QAAGNNMAQTDSA

SEQ ID NO: 87606 - protein, 13 aa, Mycobacterium tuberculosis
AAGNNMAQTDSAV

SEQ ID NO: 87607 - protein, 13 aa, Mycobacterium tuberculosis
AGNNMAQTDSAVG

SEQ ID NO: 87608 - protein, 13 aa, Mycobacterium tuberculosis
GNNMAQTDSAVGS

SEQ ID NO: 87609 - protein, 13 aa, Mycobacterium tuberculosis
NNMAQTDSAVGSS

SEQ ID NO: 87610 - protein, 13 aa, Mycobacterium tuberculosis
NMAQTDSAVGSSW

SEQ ID NO: 87611 - protein, 13 aa, Mycobacterium tuberculosis
MAQTDSAVGSSWA

SEQ ID NO: 87612 - protein, 14 aa, Mycobacterium tuberculosis
MTINYQFGDVDAHG

SEQ ID NO: 87613 - protein, 14 aa, Mycobacterium tuberculosis
TINYQFGDVDAHGA

SEQ ID NO: 87614 - protein, 14 aa, Mycobacterium tuberculosis
INYQFGDVDAHGAM

SEQ ID NO: 87615 - protein, 14 aa, Mycobacterium tuberculosis
NYQFGDVDAHGAMI

SEQ ID NO: 87616 - protein, 14 aa, Mycobacterium tuberculosis
YQFGDVDAHGAMIR

SEQ ID NO: 87617 - protein, 14 aa, Mycobacterium tuberculosis
QFGDVDAHGAMIRA

SEQ ID NO: 87618 - protein, 14 aa, Mycobacterium tuberculosis
FGDVDAHGAMIRAQ

SEQ ID NO: 87619 - protein, 14 aa, Mycobacterium tuberculosis
GDVDAHGAMIRAQA

SEQ ID NO: 87620 - protein, 14 aa, Mycobacterium tuberculosis
DVDAHGAMIRAQAG

SEQ ID NO: 87621 - protein, 14 aa, Mycobacterium tuberculosis
VDAHGAMIRAQAGL

SEQ ID NO: 87622 - protein, 14 aa, Mycobacterium tuberculosis
DAHGAMIRAQAGLL

SEQ ID NO: 87623 - protein, 14 aa, Mycobacterium tuberculosis
AHGAMIRAQAGLLE

SEQ ID NO: 87624 - protein, 14 aa, Mycobacterium tuberculosis
HGAMIRAQAGLLEA

SEQ ID NO: 87625 - protein, 14 aa, Mycobacterium tuberculosis
GAMIRAQAGLLEAE

SEQ ID NO: 87626 - protein, 14 aa, Mycobacterium tuberculosis
AMIRAQAGLLEAEH

SEQ ID NO: 87627 - protein, 14 aa, Mycobacterium tuberculosis
MIRAQAGLLEAEHQ

SEQ ID NO: 87628 - protein, 14 aa, Mycobacterium tuberculosis
IRAQAGLLEAEHQA

SEQ ID NO: 87629 - protein, 14 aa, Mycobacterium tuberculosis
RAQAGLLEAEHQAI

SEQ ID NO: 87630 - protein, 14 aa, Mycobacterium tuberculosis
AQAGLLEAEHQAIV

SEQ ID NO: 87631 - protein, 14 aa, Mycobacterium tuberculosis
QAGLLEAEHQAIVR

SEQ ID NO: 87632 - protein, 14 aa, Mycobacterium tuberculosis
AGLLEAEHQAIVRD

SEQ ID NO: 87633 - protein, 14 aa, Mycobacterium tuberculosis
GLLEAEHQAIVRDV

SEQ ID NO: 87634 - protein, 14 aa, Mycobacterium tuberculosis
LLEAEHQAIVRDVL

SEQ ID NO: 87635 - protein, 14 aa, Mycobacterium tuberculosis
LEAEHQAIVRDVLA

SEQ ID NO: 87636 - protein, 14 aa, Mycobacterium tuberculosis
EAEHQAIVRDVLAA

SEQ ID NO: 87637 - protein, 14 aa, Mycobacterium tuberculosis
AEHQAIVRDVLAAG

SEQ ID NO: 87638 - protein, 14 aa, Mycobacterium tuberculosis
EHQAIVRDVLAAGD

SEQ ID NO: 87639 - protein, 14 aa, Mycobacterium tuberculosis
HQAIVRDVLAAGDF

SEQ ID NO: 87640 - protein, 14 aa, Mycobacterium tuberculosis
QAIVRDVLAAGDFW

SEQ ID NO: 87641 - protein, 14 aa, Mycobacterium tuberculosis
AIVRDVLAAGDFWG

SEQ ID NO: 87642 - protein, 14 aa, Mycobacterium tuberculosis
IVRDVLAAGDFWGG

SEQ ID NO: 87643 - protein, 14 aa, Mycobacterium tuberculosis
VRDVLAAGDFWGGA

SEQ ID NO: 87644 - protein, 14 aa, Mycobacterium tuberculosis
RDVLAAGDFWGGAG

SEQ ID NO: 87645 - protein, 14 aa, Mycobacterium tuberculosis
DVLAAGDFWGGAGS

SEQ ID NO: 87646 - protein, 14 aa, Mycobacterium tuberculosis
VLAAGDFWGGAGSV

SEQ ID NO: 87647 - protein, 14 aa, Mycobacterium tuberculosis
LAAGDFWGGAGSVA

SEQ ID NO: 87648 - protein, 14 aa, Mycobacterium tuberculosis
AAGDFWGGAGSVAC

SEQ ID NO: 87649 - protein, 14 aa, Mycobacterium tuberculosis
AGDFWGGAGSVACQ

SEQ ID NO: 87650 - protein, 14 aa, Mycobacterium tuberculosis
GDFWGGAGSVACQE

SEQ ID NO: 87651 - protein, 14 aa, Mycobacterium tuberculosis
DFWGGAGSVACQEF

SEQ ID NO: 87652 - protein, 14 aa, Mycobacterium tuberculosis
FWGGAGSVACQEFI

SEQ ID NO: 87653 - protein, 14 aa, Mycobacterium tuberculosis
WGGAGSVACQEFIT

SEQ ID NO: 87654 - protein, 14 aa, Mycobacterium tuberculosis
GGAGSVACQEFITQ

SEQ ID NO: 87655 - protein, 14 aa, Mycobacterium tuberculosis
GAGSVACQEFITQL

SEQ ID NO: 87656 - protein, 14 aa, Mycobacterium tuberculosis
AGSVACQEFITQLG

SEQ ID NO: 87657 - protein, 14 aa, Mycobacterium tuberculosis
GSVACQEFITQLGR

SEQ ID NO: 87658 - protein, 14 aa, Mycobacterium tuberculosis
SVACQEFITQLGRN

SEQ ID NO: 87659 - protein, 14 aa, Mycobacterium tuberculosis
VACQEFITQLGRNF

SEQ ID NO: 87660 - protein, 14 aa, Mycobacterium tuberculosis
ACQEFITQLGRNFQ

SEQ ID NO: 87661 - protein, 14 aa, Mycobacterium tuberculosis
CQEFITQLGRNFQV

SEQ ID NO: 87662 - protein, 14 aa, Mycobacterium tuberculosis
QEFITQLGRNFQVI

SEQ ID NO: 87663 - protein, 14 aa, Mycobacterium tuberculosis
EFITQLGRNFQVIY

SEQ ID NO: 87664 - protein, 14 aa, Mycobacterium tuberculosis
FITQLGRNFQVIYE

SEQ ID NO: 87665 - protein, 14 aa, Mycobacterium tuberculosis
ITQLGRNFQVIYEQ

SEQ ID NO: 87666 - protein, 14 aa, Mycobacterium tuberculosis
TQLGRNFQVIYEQA

SEQ ID NO: 87667 - protein, 14 aa, Mycobacterium tuberculosis
QLGRNFQVIYEQAN

SEQ ID NO: 87668 - protein, 14 aa, Mycobacterium tuberculosis
LGRNFQVIYEQANA

SEQ ID NO: 87669 - protein, 14 aa, Mycobacterium tuberculosis
GRNFQVIYEQANAH

SEQ ID NO: 87670 - protein, 14 aa, Mycobacterium tuberculosis
RNFQVIYEQANAHG

SEQ ID NO: 87671 - protein, 14 aa, Mycobacterium tuberculosis
NFQVIYEQANAHGQ

SEQ ID NO: 87672 - protein, 14 aa, Mycobacterium tuberculosis
FQVIYEQANAHGQK

SEQ ID NO: 87673 - protein, 14 aa, Mycobacterium tuberculosis
QVIYEQANAHGQKV

SEQ ID NO: 87674 - protein, 14 aa, Mycobacterium tuberculosis
VIYEQANAHGQKVQ

SEQ ID NO: 87675 - protein, 14 aa, Mycobacterium tuberculosis
IYEQANAHGQKVQA

SEQ ID NO: 87676 - protein, 14 aa, Mycobacterium tuberculosis
YEQANAHGQKVQAA

SEQ ID NO: 87677 - protein, 14 aa, Mycobacterium tuberculosis
EQANAHGQKVQAAG

SEQ ID NO: 87678 - protein, 14 aa, Mycobacterium tuberculosis
QANAHGQKVQAAGN

SEQ ID NO: 87679 - protein, 14 aa, Mycobacterium tuberculosis
ANAHGQKVQAAGNN

SEQ ID NO: 87680 - protein, 14 aa, Mycobacterium tuberculosis
NAHGQKVQAAGNNM

SEQ ID NO: 87681 - protein, 14 aa, Mycobacterium tuberculosis
AHGQKVQAAGNNMA

SEQ ID NO: 87682 - protein, 14 aa, Mycobacterium tuberculosis
HGQKVQAAGNNMAQ

SEQ ID NO: 87683 - protein, 14 aa, Mycobacterium tuberculosis
GQKVQAAGNNMAQT

SEQ ID NO: 87684 - protein, 14 aa, Mycobacterium tuberculosis
QKVQAAGNNMAQTD

SEQ ID NO: 87685 - protein, 14 aa, Mycobacterium tuberculosis
KVQAAGNNMAQTDS

SEQ ID NO: 87686 - protein, 14 aa, Mycobacterium tuberculosis
VQAAGNNMAQTDSA

SEQ ID NO: 87687 - protein, 14 aa, Mycobacterium tuberculosis
QAAGNNMAQTDSAV

SEQ ID NO: 87688 - protein, 14 aa, Mycobacterium tuberculosis
AAGNNMAQTDSAVG

SEQ ID NO: 87689 - protein, 14 aa, Mycobacterium tuberculosis
AGNNMAQTDSAVGS

SEQ ID NO: 87690 - protein, 14 aa, Mycobacterium tuberculosis
GNNMAQTDSAVGSS

SEQ ID NO: 87691 - protein, 14 aa, Mycobacterium tuberculosis
NNMAQTDSAVGSSW

SEQ ID NO: 87692 - protein, 14 aa, Mycobacterium tuberculosis
NMAQTDSAVGSSWA

SEQ ID NO: 87693 - protein, 15 aa, Mycobacterium tuberculosis
MTINYQFGDVDAHGA

SEQ ID NO: 87694 - protein, 15 aa, Mycobacterium tuberculosis
TINYQFGDVDAHGAM

SEQ ID NO: 87695 - protein, 15 aa, Mycobacterium tuberculosis
INYQFGDVDAHGAMI

SEQ ID NO: 87696 - protein, 15 aa, Mycobacterium tuberculosis
NYQFGDVDAHGAMIR

SEQ ID NO: 87697 - protein, 15 aa, Mycobacterium tuberculosis
YQFGDVDAHGAMIRA

SEQ ID NO: 87698 - protein, 15 aa, Mycobacterium tuberculosis
QFGDVDAHGAMIRAQ

SEQ ID NO: 87699 - protein, 15 aa, Mycobacterium tuberculosis
FGDVDAHGAMIRAQA

SEQ ID NO: 87700 - protein, 15 aa, Mycobacterium tuberculosis
GDVDAHGAMIRAQAG

SEQ ID NO: 87701 - protein, 15 aa, Mycobacterium tuberculosis
DVDAHGAMIRAQAGL

SEQ ID NO: 87702 - protein, 15 aa, Mycobacterium tuberculosis
VDAHGAMIRAQAGLL

SEQ ID NO: 87703 - protein, 15 aa, Mycobacterium tuberculosis
DAHGAMIRAQAGLLE

SEQ ID NO: 87704 - protein, 15 aa, Mycobacterium tuberculosis
AHGAMIRAQAGLLEA

SEQ ID NO: 87705 - protein, 15 aa, Mycobacterium tuberculosis
HGAMIRAQAGLLEAE

SEQ ID NO: 87706 - protein, 15 aa, Mycobacterium tuberculosis
GAMIRAQAGLLEAEH

SEQ ID NO: 87707 - protein, 15 aa, Mycobacterium tuberculosis
AMIRAQAGLLEAEHQ

SEQ ID NO: 87708 - protein, 15 aa, Mycobacterium tuberculosis
MIRAQAGLLEAEHQA

SEQ ID NO: 87709 - protein, 15 aa, Mycobacterium tuberculosis
IRAQAGLLEAEHQAI

SEQ ID NO: 87710 - protein, 15 aa, Mycobacterium tuberculosis
RAQAGLLEAEHQAIV

SEQ ID NO: 87711 - protein, 15 aa, Mycobacterium tuberculosis
AQAGLLEAEHQAIVR

SEQ ID NO: 87712 - protein, 15 aa, Mycobacterium tuberculosis
QAGLLEAEHQAIVRD

SEQ ID NO: 87713 - protein, 15 aa, Mycobacterium tuberculosis
AGLLEAEHQAIVRDV

SEQ ID NO: 87714 - protein, 15 aa, Mycobacterium tuberculosis
GLLEAEHQAIVRDVL

SEQ ID NO: 87715 - protein, 15 aa, Mycobacterium tuberculosis
LLEAEHQAIVRDVLA

SEQ ID NO: 87716 - protein, 15 aa, Mycobacterium tuberculosis
LEAEHQAIVRDVLAA

SEQ ID NO: 87717 - protein, 15 aa, Mycobacterium tuberculosis
EAEHQAIVRDVLAAG

SEQ ID NO: 87718 - protein, 15 aa, Mycobacterium tuberculosis
AEHQAIVRDVLAAGD

SEQ ID NO: 87719 - protein, 15 aa, Mycobacterium tuberculosis
EHQAIVRDVLAAGDF

SEQ ID NO: 87720 - protein, 15 aa, Mycobacterium tuberculosis
HQAIVRDVLAAGDFW

SEQ ID NO: 87721 - protein, 15 aa, Mycobacterium tuberculosis
QAIVRDVLAAGDFWG

SEQ ID NO: 87722 - protein, 15 aa, Mycobacterium tuberculosis
AIVRDVLAAGDFWGG

SEQ ID NO: 87723 - protein, 15 aa, Mycobacterium tuberculosis
IVRDVLAAGDFWGGA

SEQ ID NO: 87724 - protein, 15 aa, Mycobacterium tuberculosis
VRDVLAAGDFWGGAG

SEQ ID NO: 87725 - protein, 15 aa, Mycobacterium tuberculosis
RDVLAAGDFWGGAGS

SEQ ID NO: 87726 - protein, 15 aa, Mycobacterium tuberculosis
DVLAAGDFWGGAGSV

SEQ ID NO: 87727 - protein, 15 aa, Mycobacterium tuberculosis
VLAAGDFWGGAGSVA

SEQ ID NO: 87728 - protein, 15 aa, Mycobacterium tuberculosis
LAAGDFWGGAGSVAC

SEQ ID NO: 87729 - protein, 15 aa, Mycobacterium tuberculosis
AAGDFWGGAGSVACQ

SEQ ID NO: 87730 - protein, 15 aa, Mycobacterium tuberculosis
AGDFWGGAGSVACQE

SEQ ID NO: 87731 - protein, 15 aa, Mycobacterium tuberculosis
GDFWGGAGSVACQEF

SEQ ID NO: 87732 - protein, 15 aa, Mycobacterium tuberculosis
DFWGGAGSVACQEFI

SEQ ID NO: 87733 - protein, 15 aa, Mycobacterium tuberculosis
FWGGAGSVACQEFIT

SEQ ID NO: 87734 - protein, 15 aa, Mycobacterium tuberculosis
WGGAGSVACQEFITQ

SEQ ID NO: 87735 - protein, 15 aa, Mycobacterium tuberculosis
GGAGSVACQEFITQL

SEQ ID NO: 87736 - protein, 15 aa, Mycobacterium tuberculosis
GAGSVACQEFITQLG

SEQ ID NO: 87737 - protein, 15 aa, Mycobacterium tuberculosis
AGSVACQEFITQLGR

SEQ ID NO: 87738 - protein, 15 aa, Mycobacterium tuberculosis
GSVACQEFITQLGRN

SEQ ID NO: 87739 - protein, 15 aa, Mycobacterium tuberculosis
SVACQEFITQLGRNF

SEQ ID NO: 87740 - protein, 15 aa, Mycobacterium tuberculosis
VACQEFITQLGRNFQ

SEQ ID NO: 87741 - protein, 15 aa, Mycobacterium tuberculosis
ACQEFITQLGRNFQV

SEQ ID NO: 87742 - protein, 15 aa, Mycobacterium tuberculosis
CQEFITQLGRNFQVI

SEQ ID NO: 87743 - protein, 15 aa, Mycobacterium tuberculosis
QEFITQLGRNFQVIY

SEQ ID NO: 87744 - protein, 15 aa, Mycobacterium tuberculosis
EFITQLGRNFQVIYE

SEQ ID NO: 87745 - protein, 15 aa, Mycobacterium tuberculosis
FITQLGRNFQVIYEQ

SEQ ID NO: 87746 - protein, 15 aa, Mycobacterium tuberculosis
ITQLGRNFQVIYEQA

SEQ ID NO: 87747 - protein, 15 aa, Mycobacterium tuberculosis
TQLGRNFQVIYEQAN

SEQ ID NO: 87748 - protein, 15 aa, Mycobacterium tuberculosis
QLGRNFQVIYEQANA

SEQ ID NO: 87749 - protein, 15 aa, Mycobacterium tuberculosis
LGRNFQVIYEQANAH

SEQ ID NO: 87750 - protein, 15 aa, Mycobacterium tuberculosis
GRNFQVIYEQANAHG

SEQ ID NO: 87751 - protein, 15 aa, Mycobacterium tuberculosis
RNFQVIYEQANAHGQ

SEQ ID NO: 87752 - protein, 15 aa, Mycobacterium tuberculosis
NFQVIYEQANAHGQK

SEQ ID NO: 87753 - protein, 15 aa, Mycobacterium tuberculosis
FQVIYEQANAHGQKV

SEQ ID NO: 87754 - protein, 15 aa, Mycobacterium tuberculosis
QVIYEQANAHGQKVQ

SEQ ID NO: 87755 - protein, 15 aa, Mycobacterium tuberculosis
VIYEQANAHGQKVQA

SEQ ID NO: 87756 - protein, 15 aa, Mycobacterium tuberculosis
IYEQANAHGQKVQAA

SEQ ID NO: 87757 - protein, 15 aa, Mycobacterium tuberculosis
YEQANAHGQKVQAAG

SEQ ID NO: 87758 - protein, 15 aa, Mycobacterium tuberculosis
EQANAHGQKVQAAGN

SEQ ID NO: 87759 - protein, 15 aa, Mycobacterium tuberculosis
QANAHGQKVQAAGNN

SEQ ID NO: 87760 - protein, 15 aa, Mycobacterium tuberculosis
ANAHGQKVQAAGNNM

SEQ ID NO: 87761 - protein, 15 aa, Mycobacterium tuberculosis
NAHGQKVQAAGNNMA

SEQ ID NO: 87762 - protein, 15 aa, Mycobacterium tuberculosis
AHGQKVQAAGNNMAQ

SEQ ID NO: 87763 - protein, 15 aa, Mycobacterium tuberculosis
HGQKVQAAGNNMAQT

SEQ ID NO: 87764 - protein, 15 aa, Mycobacterium tuberculosis
GQKVQAAGNNMAQTD

SEQ ID NO: 87765 - protein, 15 aa, Mycobacterium tuberculosis
QKVQAAGNNMAQTDS

SEQ ID NO: 87766 - protein, 15 aa, Mycobacterium tuberculosis
KVQAAGNNMAQTDSA

SEQ ID NO: 87767 - protein, 15 aa, Mycobacterium tuberculosis
VQAAGNNMAQTDSAV

SEQ ID NO: 87768 - protein, 15 aa, Mycobacterium tuberculosis
QAAGNNMAQTDSAVG

SEQ ID NO: 87769 - protein, 15 aa, Mycobacterium tuberculosis
AAGNNMAQTDSAVGS

SEQ ID NO: 87770 - protein, 15 aa, Mycobacterium tuberculosis
AGNNMAQTDSAVGSS

SEQ ID NO: 87771 - protein, 15 aa, Mycobacterium tuberculosis
GNNMAQTDSAVGSSW

SEQ ID NO: 87772 - protein, 15 aa, Mycobacterium tuberculosis
NNMAQTDSAVGSSWA

SEQ ID NO: 87773 - protein, 16 aa, Mycobacterium tuberculosis
MTINYQFGDVDAHGAM

SEQ ID NO: 87774 - protein, 16 aa, Mycobacterium tuberculosis
TINYQFGDVDAHGAMI

SEQ ID NO: 87775 - protein, 16 aa, Mycobacterium tuberculosis
INYQFGDVDAHGAMIR

SEQ ID NO: 87776 - protein, 16 aa, Mycobacterium tuberculosis
NYQFGDVDAHGAMIRA

SEQ ID NO: 87777 - protein, 16 aa, Mycobacterium tuberculosis
YQFGDVDAHGAMIRAQ

SEQ ID NO: 87778 - protein, 16 aa, Mycobacterium tuberculosis
QFGDVDAHGAMIRAQA

SEQ ID NO: 87779 - protein, 16 aa, Mycobacterium tuberculosis
FGDVDAHGAMIRAQAG

SEQ ID NO: 87780 - protein, 16 aa, Mycobacterium tuberculosis
GDVDAHGAMIRAQAGL

SEQ ID NO: 87781 - protein, 16 aa, Mycobacterium tuberculosis
DVDAHGAMIRAQAGLL

SEQ ID NO: 87782 - protein, 16 aa, Mycobacterium tuberculosis
VDAHGAMIRAQAGLLE

SEQ ID NO: 87783 - protein, 16 aa, Mycobacterium tuberculosis
DAHGAMIRAQAGLLEA

SEQ ID NO: 87784 - protein, 16 aa, Mycobacterium tuberculosis
AHGAMIRAQAGLLEAE

SEQ ID NO: 87785 - protein, 16 aa, Mycobacterium tuberculosis
HGAMIRAQAGLLEAEH

SEQ ID NO: 87786 - protein, 16 aa, Mycobacterium tuberculosis
GAMIRAQAGLLEAEHQ

SEQ ID NO: 87787 - protein, 16 aa, Mycobacterium tuberculosis
AMIRAQAGLLEAEHQA

SEQ ID NO: 87788 - protein, 16 aa, Mycobacterium tuberculosis
MIRAQAGLLEAEHQAI

SEQ ID NO: 87789 - protein, 16 aa, Mycobacterium tuberculosis
IRAQAGLLEAEHQAIV

SEQ ID NO: 87790 - protein, 16 aa, Mycobacterium tuberculosis
RAQAGLLEAEHQAIVR

SEQ ID NO: 87791 - protein, 16 aa, Mycobacterium tuberculosis
AQAGLLEAEHQAIVRD

SEQ ID NO: 87792 - protein, 16 aa, Mycobacterium tuberculosis
QAGLLEAEHQAIVRDV

SEQ ID NO: 87793 - protein, 16 aa, Mycobacterium tuberculosis
AGLLEAEHQAIVRDVL

SEQ ID NO: 87794 - protein, 16 aa, Mycobacterium tuberculosis
GLLEAEHQAIVRDVLA

SEQ ID NO: 87795 - protein, 16 aa, Mycobacterium tuberculosis
LLEAEHQAIVRDVLAA

SEQ ID NO: 87796 - protein, 16 aa, Mycobacterium tuberculosis
LEAEHQAIVRDVLAAG

SEQ ID NO: 87797 - protein, 16 aa, Mycobacterium tuberculosis
EAEHQAIVRDVLAAGD

SEQ ID NO: 87798 - protein, 16 aa, Mycobacterium tuberculosis
AEHQAIVRDVLAAGDF

SEQ ID NO: 87799 - protein, 16 aa, Mycobacterium tuberculosis
EHQAIVRDVLAAGDFW

SEQ ID NO: 87800 - protein, 16 aa, Mycobacterium tuberculosis
HQAIVRDVLAAGDFWG

SEQ ID NO: 87801 - protein, 16 aa, Mycobacterium tuberculosis
QAIVRDVLAAGDFWGG

SEQ ID NO: 87802 - protein, 16 aa, Mycobacterium tuberculosis
AIVRDVLAAGDFWGGA

SEQ ID NO: 87803 - protein, 16 aa, Mycobacterium tuberculosis
IVRDVLAAGDFWGGAG

SEQ ID NO: 87804 - protein, 16 aa, Mycobacterium tuberculosis
VRDVLAAGDFWGGAGS

SEQ ID NO: 87805 - protein, 16 aa, Mycobacterium tuberculosis
RDVLAAGDFWGGAGSV

SEQ ID NO: 87806 - protein, 16 aa, Mycobacterium tuberculosis
DVLAAGDFWGGAGSVA

SEQ ID NO: 87807 - protein, 16 aa, Mycobacterium tuberculosis
VLAAGDFWGGAGSVAC

SEQ ID NO: 87808 - protein, 16 aa, Mycobacterium tuberculosis
LAAGDFWGGAGSVACQ

SEQ ID NO: 87809 - protein, 16 aa, Mycobacterium tuberculosis
AAGDFWGGAGSVACQE

SEQ ID NO: 87810 - protein, 16 aa, Mycobacterium tuberculosis
AGDFWGGAGSVACQEF

SEQ ID NO: 87811 - protein, 16 aa, Mycobacterium tuberculosis
GDFWGGAGSVACQEFI

SEQ ID NO: 87812 - protein, 16 aa, Mycobacterium tuberculosis
DFWGGAGSVACQEFIT

SEQ ID NO: 87813 - protein, 16 aa, Mycobacterium tuberculosis
FWGGAGSVACQEFITQ

SEQ ID NO: 87814 - protein, 16 aa, Mycobacterium tuberculosis
WGGAGSVACQEFITQL

SEQ ID NO: 87815 - protein, 16 aa, Mycobacterium tuberculosis
GGAGSVACQEFITQLG

SEQ ID NO: 87816 - protein, 16 aa, Mycobacterium tuberculosis
GAGSVACQEFITQLGR

SEQ ID NO: 87817 - protein, 16 aa, Mycobacterium tuberculosis
AGSVACQEFITQLGRN

SEQ ID NO: 87818 - protein, 16 aa, Mycobacterium tuberculosis
GSVACQEFITQLGRNF

SEQ ID NO: 87819 - protein, 16 aa, Mycobacterium tuberculosis
SVACQEFITQLGRNFQ

SEQ ID NO: 87820 - protein, 16 aa, Mycobacterium tuberculosis
VACQEFITQLGRNFQV

SEQ ID NO: 87821 - protein, 16 aa, Mycobacterium tuberculosis
ACQEFITQLGRNFQVI

SEQ ID NO: 87822 - protein, 16 aa, Mycobacterium tuberculosis
CQEFITQLGRNFQVIY

SEQ ID NO: 87823 - protein, 16 aa, Mycobacterium tuberculosis
QEFITQLGRNFQVIYE

SEQ ID NO: 87824 - protein, 16 aa, Mycobacterium tuberculosis
EFITQLGRNFQVIYEQ

SEQ ID NO: 87825 - protein, 16 aa, Mycobacterium tuberculosis
FITQLGRNFQVIYEQA

SEQ ID NO: 87826 - protein, 16 aa, Mycobacterium tuberculosis
ITQLGRNFQVIYEQAN

SEQ ID NO: 87827 - protein, 16 aa, Mycobacterium tuberculosis
TQLGRNFQVIYEQANA

SEQ ID NO: 87828 - protein, 16 aa, Mycobacterium tuberculosis
QLGRNFQVIYEQANAH

SEQ ID NO: 87829 - protein, 16 aa, Mycobacterium tuberculosis
LGRNFQVIYEQANAHG

SEQ ID NO: 87830 - protein, 16 aa, Mycobacterium tuberculosis
GRNFQVIYEQANAHGQ

SEQ ID NO: 87831 - protein, 16 aa, Mycobacterium tuberculosis
RNFQVIYEQANAHGQK

SEQ ID NO: 87832 - protein, 16 aa, Mycobacterium tuberculosis
NFQVIYEQANAHGQKV

SEQ ID NO: 87833 - protein, 16 aa, Mycobacterium tuberculosis
FQVIYEQANAHGQKVQ

SEQ ID NO: 87834 - protein, 16 aa, Mycobacterium tuberculosis
QVIYEQANAHGQKVQA

SEQ ID NO: 87835 - protein, 16 aa, Mycobacterium tuberculosis
VIYEQANAHGQKVQAA

SEQ ID NO: 87836 - protein, 16 aa, Mycobacterium tuberculosis
IYEQANAHGQKVQAAG

SEQ ID NO: 87837 - protein, 16 aa, Mycobacterium tuberculosis
YEQANAHGQKVQAAGN

SEQ ID NO: 87838 - protein, 16 aa, Mycobacterium tuberculosis
EQANAHGQKVQAAGNN

SEQ ID NO: 87839 - protein, 16 aa, Mycobacterium tuberculosis
QANAHGQKVQAAGNNM

SEQ ID NO: 87840 - protein, 16 aa, Mycobacterium tuberculosis
ANAHGQKVQAAGNNMA

SEQ ID NO: 87841 - protein, 16 aa, Mycobacterium tuberculosis
NAHGQKVQAAGNNMAQ

SEQ ID NO: 87842 - protein, 16 aa, Mycobacterium tuberculosis
AHGQKVQAAGNNMAQT

SEQ ID NO: 87843 - protein, 16 aa, Mycobacterium tuberculosis
HGQKVQAAGNNMAQTD

SEQ ID NO: 87844 - protein, 16 aa, Mycobacterium tuberculosis
GQKVQAAGNNMAQTDS

SEQ ID NO: 87845 - protein, 16 aa, Mycobacterium tuberculosis
QKVQAAGNNMAQTDSA

SEQ ID NO: 87846 - protein, 16 aa, Mycobacterium tuberculosis
KVQAAGNNMAQTDSAV

SEQ ID NO: 87847 - protein, 16 aa, Mycobacterium tuberculosis
VQAAGNNMAQTDSAVG

SEQ ID NO: 87848 - protein, 16 aa, Mycobacterium tuberculosis
QAAGNNMAQTDSAVGS

SEQ ID NO: 87849 - protein, 16 aa, Mycobacterium tuberculosis
AAGNNMAQTDSAVGSS

SEQ ID NO: 87850 - protein, 16 aa, Mycobacterium tuberculosis
AGNNMAQTDSAVGSSW

SEQ ID NO: 87851 - protein, 16 aa, Mycobacterium tuberculosis
GNNMAQTDSAVGSSWA

SEQ ID NO: 87852 - protein, 13 aa, Mycobacterium tuberculosis
MATRFMTDPHAMR

SEQ ID NO: 87853 - protein, 13 aa, Mycobacterium tuberculosis
ATRFMTDPHAMRD

SEQ ID NO: 87854 - protein, 13 aa, Mycobacterium tuberculosis
TRFMTDPHAMRDM

SEQ ID NO: 87855 - protein, 13 aa, Mycobacterium tuberculosis
RFMTDPHAMRDMA

SEQ ID NO: 87856 - protein, 13 aa, Mycobacterium tuberculosis
FMTDPHAMRDMAG

SEQ ID NO: 87857 - protein, 13 aa, Mycobacterium tuberculosis
MTDPHAMRDMAGR

SEQ ID NO: 87858 - protein, 13 aa, Mycobacterium tuberculosis
TDPHAMRDMAGRF

SEQ ID NO: 87859 - protein, 13 aa, Mycobacterium tuberculosis
DPHAMRDMAGRFE

SEQ ID NO: 87860 - protein, 13 aa, Mycobacterium tuberculosis
PHAMRDMAGRFEV

SEQ ID NO: 87861 - protein, 13 aa, Mycobacterium tuberculosis
HAMRDMAGRFEVH

SEQ ID NO: 87862 - protein, 13 aa, Mycobacterium tuberculosis
AMRDMAGRFEVHA

SEQ ID NO: 87863 - protein, 13 aa, Mycobacterium tuberculosis
MRDMAGRFEVHAQ

SEQ ID NO: 87864 - protein, 13 aa, Mycobacterium tuberculosis
RDMAGRFEVHAQT

SEQ ID NO: 87865 - protein, 13 aa, Mycobacterium tuberculosis
DMAGRFEVHAQTV

SEQ ID NO: 87866 - protein, 13 aa, Mycobacterium tuberculosis
MAGRFEVHAQTVE

SEQ ID NO: 87867 - protein, 13 aa, Mycobacterium tuberculosis
AGRFEVHAQTVED

SEQ ID NO: 87868 - protein, 13 aa, Mycobacterium tuberculosis
GRFEVHAQTVEDE

SEQ ID NO: 87869 - protein, 13 aa, Mycobacterium tuberculosis
RFEVHAQTVEDEA

SEQ ID NO: 87870 - protein, 13 aa, Mycobacterium tuberculosis
FEVHAQTVEDEAR

SEQ ID NO: 87871 - protein, 13 aa, Mycobacterium tuberculosis
EVHAQTVEDEARR

SEQ ID NO: 87872 - protein, 13 aa, Mycobacterium tuberculosis
VHAQTVEDEARRM

SEQ ID NO: 87873 - protein, 13 aa, Mycobacterium tuberculosis
HAQTVEDEARRMW

SEQ ID NO: 87874 - protein, 13 aa, Mycobacterium tuberculosis
AQTVEDEARRMWA

SEQ ID NO: 87875 - protein, 13 aa, Mycobacterium tuberculosis
QTVEDEARRMWAS

SEQ ID NO: 87876 - protein, 13 aa, Mycobacterium tuberculosis
TVEDEARRMWASA

SEQ ID NO: 87877 - protein, 13 aa, Mycobacterium tuberculosis
VEDEARRMWASAQ

SEQ ID NO: 87878 - protein, 13 aa, Mycobacterium tuberculosis
EDEARRMWASAQN

SEQ ID NO: 87879 - protein, 13 aa, Mycobacterium tuberculosis
DEARRMWASAQNI

SEQ ID NO: 87880 - protein, 13 aa, Mycobacterium tuberculosis
EARRMWASAQNIS

SEQ ID NO: 87881 - protein, 13 aa, Mycobacterium tuberculosis
ARRMWASAQNISG

SEQ ID NO: 87882 - protein, 13 aa, Mycobacterium tuberculosis
RRMWASAQNISGA

SEQ ID NO: 87883 - protein, 13 aa, Mycobacterium tuberculosis
RMWASAQNISGAG

SEQ ID NO: 87884 - protein, 13 aa, Mycobacterium tuberculosis
MWASAQNISGAGW

SEQ ID NO: 87885 - protein, 13 aa, Mycobacterium tuberculosis
WASAQNISGAGWS

SEQ ID NO: 87886 - protein, 13 aa, Mycobacterium tuberculosis
ASAQNISGAGWSG

SEQ ID NO: 87887 - protein, 13 aa, Mycobacterium tuberculosis
SAQNISGAGWSGM

SEQ ID NO: 87888 - protein, 13 aa, Mycobacterium tuberculosis
AQNISGAGWSGMA

SEQ ID NO: 87889 - protein, 13 aa, Mycobacterium tuberculosis
QNISGAGWSGMAE

SEQ ID NO: 87890 - protein, 13 aa, Mycobacterium tuberculosis
NISGAGWSGMAEA

SEQ ID NO: 87891 - protein, 13 aa, Mycobacterium tuberculosis
ISGAGWSGMAEAT

SEQ ID NO: 87892 - protein, 13 aa, Mycobacterium tuberculosis
SGAGWSGMAEATS

SEQ ID NO: 87893 - protein, 13 aa, Mycobacterium tuberculosis
GAGWSGMAEATSL

SEQ ID NO: 87894 - protein, 13 aa, Mycobacterium tuberculosis
AGWSGMAEATSLD

SEQ ID NO: 87895 - protein, 13 aa, Mycobacterium tuberculosis
GWSGMAEATSLDT

SEQ ID NO: 87896 - protein, 13 aa, Mycobacterium tuberculosis
WSGMAEATSLDTM

SEQ ID NO: 87897 - protein, 13 aa, Mycobacterium tuberculosis
SGMAEATSLDTMA

SEQ ID NO: 87898 - protein, 13 aa, Mycobacterium tuberculosis
GMAEATSLDTMAQ

SEQ ID NO: 87899 - protein, 13 aa, Mycobacterium tuberculosis
MAEATSLDTMAQM

SEQ ID NO: 87900 - protein, 13 aa, Mycobacterium tuberculosis
AEATSLDTMAQMN

SEQ ID NO: 87901 - protein, 13 aa, Mycobacterium tuberculosis
EATSLDTMAQMNQ

SEQ ID NO: 87902 - protein, 13 aa, Mycobacterium tuberculosis
ATSLDTMAQMNQA

SEQ ID NO: 87903 - protein, 13 aa, Mycobacterium tuberculosis
TSLDTMAQMNQAF

SEQ ID NO: 87904 - protein, 13 aa, Mycobacterium tuberculosis
SLDTMAQMNQAFR

SEQ ID NO: 87905 - protein, 13 aa, Mycobacterium tuberculosis
LDTMAQMNQAFRN

SEQ ID NO: 87906 - protein, 13 aa, Mycobacterium tuberculosis
DTMAQMNQAFRNI

SEQ ID NO: 87907 - protein, 13 aa, Mycobacterium tuberculosis
TMAQMNQAFRNIV

SEQ ID NO: 87908 - protein, 13 aa, Mycobacterium tuberculosis
MAQMNQAFRNIVN

SEQ ID NO: 87909 - protein, 13 aa, Mycobacterium tuberculosis
AQMNQAFRNIVNM

SEQ ID NO: 87910 - protein, 13 aa, Mycobacterium tuberculosis
QMNQAFRNIVNML

SEQ ID NO: 87911 - protein, 13 aa, Mycobacterium tuberculosis
MNQAFRNIVNMLH

SEQ ID NO: 87912 - protein, 13 aa, Mycobacterium tuberculosis
NQAFRNIVNMLHG

SEQ ID NO: 87913 - protein, 13 aa, Mycobacterium tuberculosis
QAFRNIVNMLHGV

SEQ ID NO: 87914 - protein, 13 aa, Mycobacterium tuberculosis
AFRNIVNMLHGVR

SEQ ID NO: 87915 - protein, 13 aa, Mycobacterium tuberculosis
FRNIVNMLHGVRD

SEQ ID NO: 87916 - protein, 13 aa, Mycobacterium tuberculosis
RNIVNMLHGVRDG

SEQ ID NO: 87917 - protein, 13 aa, Mycobacterium tuberculosis
NIVNMLHGVRDGL

SEQ ID NO: 87918 - protein, 13 aa, Mycobacterium tuberculosis
IVNMLHGVRDGLV

SEQ ID NO: 87919 - protein, 13 aa, Mycobacterium tuberculosis
VNMLHGVRDGLVR

SEQ ID NO: 87920 - protein, 13 aa, Mycobacterium tuberculosis
NMLHGVRDGLVRD

SEQ ID NO: 87921 - protein, 13 aa, Mycobacterium tuberculosis
MLHGVRDGLVRDA

SEQ ID NO: 87922 - protein, 13 aa, Mycobacterium tuberculosis
LHGVRDGLVRDAN

SEQ ID NO: 87923 - protein, 13 aa, Mycobacterium tuberculosis
HGVRDGLVRDANN

SEQ ID NO: 87924 - protein, 13 aa, Mycobacterium tuberculosis
GVRDGLVRDANNY

SEQ ID NO: 87925 - protein, 13 aa, Mycobacterium tuberculosis
VRDGLVRDANNYE

SEQ ID NO: 87926 - protein, 13 aa, Mycobacterium tuberculosis
RDGLVRDANNYEQ

SEQ ID NO: 87927 - protein, 13 aa, Mycobacterium tuberculosis
DGLVRDANNYEQQ

SEQ ID NO: 87928 - protein, 13 aa, Mycobacterium tuberculosis
GLVRDANNYEQQE

SEQ ID NO: 87929 - protein, 13 aa, Mycobacterium tuberculosis
LVRDANNYEQQEQ

SEQ ID NO: 87930 - protein, 13 aa, Mycobacterium tuberculosis
VRDANNYEQQEQA

SEQ ID NO: 87931 - protein, 13 aa, Mycobacterium tuberculosis
RDANNYEQQEQAS

SEQ ID NO: 87932 - protein, 13 aa, Mycobacterium tuberculosis
DANNYEQQEQASQ

SEQ ID NO: 87933 - protein, 13 aa, Mycobacterium tuberculosis
ANNYEQQEQASQQ

SEQ ID NO: 87934 - protein, 13 aa, Mycobacterium tuberculosis
NNYEQQEQASQQI

SEQ ID NO: 87935 - protein, 13 aa, Mycobacterium tuberculosis
NYEQQEQASQQIL

SEQ ID NO: 87936 - protein, 13 aa, Mycobacterium tuberculosis
YEQQEQASQQILS

SEQ ID NO: 87937 - protein, 13 aa, Mycobacterium tuberculosis
EQQEQASQQILSS

SEQ ID NO: 87938 - protein, 14 aa, Mycobacterium tuberculosis
MATRFMTDPHAMRD

SEQ ID NO: 87939 - protein, 14 aa, Mycobacterium tuberculosis
ATRFMTDPHAMRDM

SEQ ID NO: 87940 - protein, 14 aa, Mycobacterium tuberculosis
TRFMTDPHAMRDMA

SEQ ID NO: 87941 - protein, 14 aa, Mycobacterium tuberculosis
RFMTDPHAMRDMAG

SEQ ID NO: 87942 - protein, 14 aa, Mycobacterium tuberculosis
FMTDPHAMRDMAGR

SEQ ID NO: 87943 - protein, 14 aa, Mycobacterium tuberculosis
MTDPHAMRDMAGRF

SEQ ID NO: 87944 - protein, 14 aa, Mycobacterium tuberculosis
TDPHAMRDMAGRFE

SEQ ID NO: 87945 - protein, 14 aa, Mycobacterium tuberculosis
DPHAMRDMAGRFEV

SEQ ID NO: 87946 - protein, 14 aa, Mycobacterium tuberculosis
PHAMRDMAGRFEVH

SEQ ID NO: 87947 - protein, 14 aa, Mycobacterium tuberculosis
HAMRDMAGRFEVHA

SEQ ID NO: 87948 - protein, 14 aa, Mycobacterium tuberculosis
AMRDMAGRFEVHAQ

SEQ ID NO: 87949 - protein, 14 aa, Mycobacterium tuberculosis
MRDMAGRFEVHAQT

SEQ ID NO: 87950 - protein, 14 aa, Mycobacterium tuberculosis
RDMAGRFEVHAQTV

SEQ ID NO: 87951 - protein, 14 aa, Mycobacterium tuberculosis
DMAGRFEVHAQTVE

SEQ ID NO: 87952 - protein, 14 aa, Mycobacterium tuberculosis
MAGRFEVHAQTVED

SEQ ID NO: 87953 - protein, 14 aa, Mycobacterium tuberculosis
AGRFEVHAQTVEDE

SEQ ID NO: 87954 - protein, 14 aa, Mycobacterium tuberculosis
GRFEVHAQTVEDEA

SEQ ID NO: 87955 - protein, 14 aa, Mycobacterium tuberculosis
RFEVHAQTVEDEAR

SEQ ID NO: 87956 - protein, 14 aa, Mycobacterium tuberculosis
FEVHAQTVEDEARR

SEQ ID NO: 87957 - protein, 14 aa, Mycobacterium tuberculosis
EVHAQTVEDEARRM

SEQ ID NO: 87958 - protein, 14 aa, Mycobacterium tuberculosis
VHAQTVEDEARRMW

SEQ ID NO: 87959 - protein, 14 aa, Mycobacterium tuberculosis
HAQTVEDEARRMWA

SEQ ID NO: 87960 - protein, 14 aa, Mycobacterium tuberculosis
AQTVEDEARRMWAS

SEQ ID NO: 87961 - protein, 14 aa, Mycobacterium tuberculosis
QTVEDEARRMWASA

SEQ ID NO: 87962 - protein, 14 aa, Mycobacterium tuberculosis
TVEDEARRMWASAQ

SEQ ID NO: 87963 - protein, 14 aa, Mycobacterium tuberculosis
VEDEARRMWASAQN

SEQ ID NO: 87964 - protein, 14 aa, Mycobacterium tuberculosis
EDEARRMWASAQNI

SEQ ID NO: 87965 - protein, 14 aa, Mycobacterium tuberculosis
DEARRMWASAQNIS

SEQ ID NO: 87966 - protein, 14 aa, Mycobacterium tuberculosis
EARRMWASAQNISG

SEQ ID NO: 87967 - protein, 14 aa, Mycobacterium tuberculosis
ARRMWASAQNISGA

SEQ ID NO: 87968 - protein, 14 aa, Mycobacterium tuberculosis
RRMWASAQNISGAG

SEQ ID NO: 87969 - protein, 14 aa, Mycobacterium tuberculosis
RMWASAQNISGAGW

SEQ ID NO: 87970 - protein, 14 aa, Mycobacterium tuberculosis
MWASAQNISGAGWS

SEQ ID NO: 87971 - protein, 14 aa, Mycobacterium tuberculosis
WASAQNISGAGWSG

SEQ ID NO: 87972 - protein, 14 aa, Mycobacterium tuberculosis
ASAQNISGAGWSGM

SEQ ID NO: 87973 - protein, 14 aa, Mycobacterium tuberculosis
SAQNISGAGWSGMA

SEQ ID NO: 87974 - protein, 14 aa, Mycobacterium tuberculosis
AQNISGAGWSGMAE

SEQ ID NO: 87975 - protein, 14 aa, Mycobacterium tuberculosis
QNISGAGWSGMAEA

SEQ ID NO: 87976 - protein, 14 aa, Mycobacterium tuberculosis
NISGAGWSGMAEAT

SEQ ID NO: 87977 - protein, 14 aa, Mycobacterium tuberculosis
ISGAGWSGMAEATS

SEQ ID NO: 87978 - protein, 14 aa, Mycobacterium tuberculosis
SGAGWSGMAEATSL

SEQ ID NO: 87979 - protein, 14 aa, Mycobacterium tuberculosis
GAGWSGMAEATSLD

SEQ ID NO: 87980 - protein, 14 aa, Mycobacterium tuberculosis
AGWSGMAEATSLDT

SEQ ID NO: 87981 - protein, 14 aa, Mycobacterium tuberculosis
GWSGMAEATSLDTM

SEQ ID NO: 87982 - protein, 14 aa, Mycobacterium tuberculosis
WSGMAEATSLDTMA

SEQ ID NO: 87983 - protein, 14 aa, Mycobacterium tuberculosis
SGMAEATSLDTMAQ

SEQ ID NO: 87984 - protein, 14 aa, Mycobacterium tuberculosis
GMAEATSLDTMAQM

SEQ ID NO: 87985 - protein, 14 aa, Mycobacterium tuberculosis
MAEATSLDTMAQMN

SEQ ID NO: 87986 - protein, 14 aa, Mycobacterium tuberculosis
AEATSLDTMAQMNQ

SEQ ID NO: 87987 - protein, 14 aa, Mycobacterium tuberculosis
EATSLDTMAQMNQA

SEQ ID NO: 87988 - protein, 14 aa, Mycobacterium tuberculosis
ATSLDTMAQMNQAF

SEQ ID NO: 87989 - protein, 14 aa, Mycobacterium tuberculosis
TSLDTMAQMNQAFR

SEQ ID NO: 87990 - protein, 14 aa, Mycobacterium tuberculosis
SLDTMAQMNQAFRN

SEQ ID NO: 87991 - protein, 14 aa, Mycobacterium tuberculosis
LDTMAQMNQAFRNI

SEQ ID NO: 87992 - protein, 14 aa, Mycobacterium tuberculosis
DTMAQMNQAFRNIV

SEQ ID NO: 87993 - protein, 14 aa, Mycobacterium tuberculosis
TMAQMNQAFRNIVN

SEQ ID NO: 87994 - protein, 14 aa, Mycobacterium tuberculosis
MAQMNQAFRNIVNM

SEQ ID NO: 87995 - protein, 14 aa, Mycobacterium tuberculosis
AQMNQAFRNIVNML

SEQ ID NO: 87996 - protein, 14 aa, Mycobacterium tuberculosis
QMNQAFRNIVNMLH

SEQ ID NO: 87997 - protein, 14 aa, Mycobacterium tuberculosis
MNQAFRNIVNMLHG

SEQ ID NO: 87998 - protein, 14 aa, Mycobacterium tuberculosis
NQAFRNIVNMLHGV

SEQ ID NO: 87999 - protein, 14 aa, Mycobacterium tuberculosis
QAFRNIVNMLHGVR

SEQ ID NO: 88000 - protein, 14 aa, Mycobacterium tuberculosis
AFRNIVNMLHGVRD

SEQ ID NO: 88001 - protein, 14 aa, Mycobacterium tuberculosis
FRNIVNMLHGVRDG

SEQ ID NO: 88002 - protein, 14 aa, Mycobacterium tuberculosis
RNIVNMLHGVRDGL

SEQ ID NO: 88003 - protein, 14 aa, Mycobacterium tuberculosis
NIVNMLHGVRDGLV

SEQ ID NO: 88004 - protein, 14 aa, Mycobacterium tuberculosis
IVNMLHGVRDGLVR

SEQ ID NO: 88005 - protein, 14 aa, Mycobacterium tuberculosis
VNMLHGVRDGLVRD

SEQ ID NO: 88006 - protein, 14 aa, Mycobacterium tuberculosis
NMLHGVRDGLVRDA

SEQ ID NO: 88007 - protein, 14 aa, Mycobacterium tuberculosis
MLHGVRDGLVRDAN

SEQ ID NO: 88008 - protein, 14 aa, Mycobacterium tuberculosis
LHGVRDGLVRDANN

SEQ ID NO: 88009 - protein, 14 aa, Mycobacterium tuberculosis
HGVRDGLVRDANNY

SEQ ID NO: 88010 - protein, 14 aa, Mycobacterium tuberculosis
GVRDGLVRDANNYE

SEQ ID NO: 88011 - protein, 14 aa, Mycobacterium tuberculosis
VRDGLVRDANNYEQ

SEQ ID NO: 88012 - protein, 14 aa, Mycobacterium tuberculosis
RDGLVRDANNYEQQ

SEQ ID NO: 88013 - protein, 14 aa, Mycobacterium tuberculosis
DGLVRDANNYEQQE

SEQ ID NO: 88014 - protein, 14 aa, Mycobacterium tuberculosis
GLVRDANNYEQQEQ

SEQ ID NO: 88015 - protein, 14 aa, Mycobacterium tuberculosis
LVRDANNYEQQEQA

SEQ ID NO: 88016 - protein, 14 aa, Mycobacterium tuberculosis
VRDANNYEQQEQAS

SEQ ID NO: 88017 - protein, 14 aa, Mycobacterium tuberculosis
RDANNYEQQEQASQ

SEQ ID NO: 88018 - protein, 14 aa, Mycobacterium tuberculosis
DANNYEQQEQASQQ

SEQ ID NO: 88019 - protein, 14 aa, Mycobacterium tuberculosis
ANNYEQQEQASQQI

SEQ ID NO: 88020 - protein, 14 aa, Mycobacterium tuberculosis
NNYEQQEQASQQIL

SEQ ID NO: 88021 - protein, 14 aa, Mycobacterium tuberculosis
NYEQQEQASQQILS

SEQ ID NO: 88022 - protein, 14 aa, Mycobacterium tuberculosis
YEQQEQASQQILSS

SEQ ID NO: 88023 - protein, 15 aa, Mycobacterium tuberculosis
MATRFMTDPHAMRDM

SEQ ID NO: 88024 - protein, 15 aa, Mycobacterium tuberculosis
ATRFMTDPHAMRDMA

SEQ ID NO: 88025 - protein, 15 aa, Mycobacterium tuberculosis
TRFMTDPHAMRDMAG

SEQ ID NO: 88026 - protein, 15 aa, Mycobacterium tuberculosis
RFMTDPHAMRDMAGR

SEQ ID NO: 88027 - protein, 15 aa, Mycobacterium tuberculosis
FMTDPHAMRDMAGRF

SEQ ID NO: 88028 - protein, 15 aa, Mycobacterium tuberculosis
MTDPHAMRDMAGRFE

SEQ ID NO: 88029 - protein, 15 aa, Mycobacterium tuberculosis
TDPHAMRDMAGRFEV

SEQ ID NO: 88030 - protein, 15 aa, Mycobacterium tuberculosis
DPHAMRDMAGRFEVH

SEQ ID NO: 88031 - protein, 15 aa, Mycobacterium tuberculosis
PHAMRDMAGRFEVHA

SEQ ID NO: 88032 - protein, 15 aa, Mycobacterium tuberculosis
HAMRDMAGRFEVHAQ

SEQ ID NO: 88033 - protein, 15 aa, Mycobacterium tuberculosis
AMRDMAGRFEVHAQT

SEQ ID NO: 88034 - protein, 15 aa, Mycobacterium tuberculosis
MRDMAGRFEVHAQTV

SEQ ID NO: 88035 - protein, 15 aa, Mycobacterium tuberculosis
RDMAGRFEVHAQTVE

SEQ ID NO: 88036 - protein, 15 aa, Mycobacterium tuberculosis
DMAGRFEVHAQTVED

SEQ ID NO: 88037 - protein, 15 aa, Mycobacterium tuberculosis
MAGRFEVHAQTVEDE

SEQ ID NO: 88038 - protein, 15 aa, Mycobacterium tuberculosis
AGRFEVHAQTVEDEA

SEQ ID NO: 88039 - protein, 15 aa, Mycobacterium tuberculosis
GRFEVHAQTVEDEAR

SEQ ID NO: 88040 - protein, 15 aa, Mycobacterium tuberculosis
RFEVHAQTVEDEARR

SEQ ID NO: 88041 - protein, 15 aa, Mycobacterium tuberculosis
FEVHAQTVEDEARRM

SEQ ID NO: 88042 - protein, 15 aa, Mycobacterium tuberculosis
EVHAQTVEDEARRMW

SEQ ID NO: 88043 - protein, 15 aa, Mycobacterium tuberculosis
VHAQTVEDEARRMWA

SEQ ID NO: 88044 - protein, 15 aa, Mycobacterium tuberculosis
HAQTVEDEARRMWAS

SEQ ID NO: 88045 - protein, 15 aa, Mycobacterium tuberculosis
AQTVEDEARRMWASA

SEQ ID NO: 88046 - protein, 15 aa, Mycobacterium tuberculosis
QTVEDEARRMWASAQ

SEQ ID NO: 88047 - protein, 15 aa, Mycobacterium tuberculosis
TVEDEARRMWASAQN

SEQ ID NO: 88048 - protein, 15 aa, Mycobacterium tuberculosis
VEDEARRMWASAQNI

SEQ ID NO: 88049 - protein, 15 aa, Mycobacterium tuberculosis
EDEARRMWASAQNIS

SEQ ID NO: 88050 - protein, 15 aa, Mycobacterium tuberculosis
DEARRMWASAQNISG

SEQ ID NO: 88051 - protein, 15 aa, Mycobacterium tuberculosis
EARRMWASAQNISGA

SEQ ID NO: 88052 - protein, 15 aa, Mycobacterium tuberculosis
ARRMWASAQNISGAG

SEQ ID NO: 88053 - protein, 15 aa, Mycobacterium tuberculosis
RRMWASAQNISGAGW

SEQ ID NO: 88054 - protein, 15 aa, Mycobacterium tuberculosis
RMWASAQNISGAGWS

SEQ ID NO: 88055 - protein, 15 aa, Mycobacterium tuberculosis
MWASAQNISGAGWSG

SEQ ID NO: 88056 - protein, 15 aa, Mycobacterium tuberculosis
WASAQNISGAGWSGM

SEQ ID NO: 88057 - protein, 15 aa, Mycobacterium tuberculosis
ASAQNISGAGWSGMA

SEQ ID NO: 88058 - protein, 15 aa, Mycobacterium tuberculosis
SAQNISGAGWSGMAE

SEQ ID NO: 88059 - protein, 15 aa, Mycobacterium tuberculosis
AQNISGAGWSGMAEA

SEQ ID NO: 88060 - protein, 15 aa, Mycobacterium tuberculosis
QNISGAGWSGMAEAT

SEQ ID NO: 88061 - protein, 15 aa, Mycobacterium tuberculosis
NISGAGWSGMAEATS

SEQ ID NO: 88062 - protein, 15 aa, Mycobacterium tuberculosis
ISGAGWSGMAEATSL

SEQ ID NO: 88063 - protein, 15 aa, Mycobacterium tuberculosis
SGAGWSGMAEATSLD

SEQ ID NO: 88064 - protein, 15 aa, Mycobacterium tuberculosis
GAGWSGMAEATSLDT

SEQ ID NO: 88065 - protein, 15 aa, Mycobacterium tuberculosis
AGWSGMAEATSLDTM

SEQ ID NO: 88066 - protein, 15 aa, Mycobacterium tuberculosis
GWSGMAEATSLDTMA

SEQ ID NO: 88067 - protein, 15 aa, Mycobacterium tuberculosis
WSGMAEATSLDTMAQ

SEQ ID NO: 88068 - protein, 15 aa, Mycobacterium tuberculosis
SGMAEATSLDTMAQM

SEQ ID NO: 88069 - protein, 15 aa, Mycobacterium tuberculosis
GMAEATSLDTMAQMN

SEQ ID NO: 88070 - protein, 15 aa, Mycobacterium tuberculosis
MAEATSLDTMAQMNQ

SEQ ID NO: 88071 - protein, 15 aa, Mycobacterium tuberculosis
AEATSLDTMAQMNQA

SEQ ID NO: 88072 - protein, 15 aa, Mycobacterium tuberculosis
EATSLDTMAQMNQAF

SEQ ID NO: 88073 - protein, 15 aa, Mycobacterium tuberculosis
ATSLDTMAQMNQAFR

SEQ ID NO: 88074 - protein, 15 aa, Mycobacterium tuberculosis
TSLDTMAQMNQAFRN

SEQ ID NO: 88075 - protein, 15 aa, Mycobacterium tuberculosis
SLDTMAQMNQAFRNI

SEQ ID NO: 88076 - protein, 15 aa, Mycobacterium tuberculosis
LDTMAQMNQAFRNIV

SEQ ID NO: 88077 - protein, 15 aa, Mycobacterium tuberculosis
DTMAQMNQAFRNIVN

SEQ ID NO: 88078 - protein, 15 aa, Mycobacterium tuberculosis
TMAQMNQAFRNIVNM

SEQ ID NO: 88079 - protein, 15 aa, Mycobacterium tuberculosis
MAQMNQAFRNIVNML

SEQ ID NO: 88080 - protein, 15 aa, Mycobacterium tuberculosis
AQMNQAFRNIVNMLH

SEQ ID NO: 88081 - protein, 15 aa, Mycobacterium tuberculosis
QMNQAFRNIVNMLHG

SEQ ID NO: 88082 - protein, 15 aa, Mycobacterium tuberculosis
MNQAFRNIVNMLHGV

SEQ ID NO: 88083 - protein, 15 aa, Mycobacterium tuberculosis
NQAFRNIVNMLHGVR

SEQ ID NO: 88084 - protein, 15 aa, Mycobacterium tuberculosis
QAFRNIVNMLHGVRD

SEQ ID NO: 88085 - protein, 15 aa, Mycobacterium tuberculosis
AFRNIVNMLHGVRDG

SEQ ID NO: 88086 - protein, 15 aa, Mycobacterium tuberculosis
FRNIVNMLHGVRDGL

SEQ ID NO: 88087 - protein, 15 aa, Mycobacterium tuberculosis
RNIVNMLHGVRDGLV

SEQ ID NO: 88088 - protein, 15 aa, Mycobacterium tuberculosis
NIVNMLHGVRDGLVR

SEQ ID NO: 88089 - protein, 15 aa, Mycobacterium tuberculosis
IVNMLHGVRDGLVRD

SEQ ID NO: 88090 - protein, 15 aa, Mycobacterium tuberculosis
VNMLHGVRDGLVRDA

SEQ ID NO: 88091 - protein, 15 aa, Mycobacterium tuberculosis
NMLHGVRDGLVRDAN

SEQ ID NO: 88092 - protein, 15 aa, Mycobacterium tuberculosis
MLHGVRDGLVRDANN

SEQ ID NO: 88093 - protein, 15 aa, Mycobacterium tuberculosis
LHGVRDGLVRDANNY

SEQ ID NO: 88094 - protein, 15 aa, Mycobacterium tuberculosis
HGVRDGLVRDANNYE

SEQ ID NO: 88095 - protein, 15 aa, Mycobacterium tuberculosis
GVRDGLVRDANNYEQ

SEQ ID NO: 88096 - protein, 15 aa, Mycobacterium tuberculosis
VRDGLVRDANNYEQQ

SEQ ID NO: 88097 - protein, 15 aa, Mycobacterium tuberculosis
RDGLVRDANNYEQQE

SEQ ID NO: 88098 - protein, 15 aa, Mycobacterium tuberculosis
DGLVRDANNYEQQEQ

SEQ ID NO: 88099 - protein, 15 aa, Mycobacterium tuberculosis
GLVRDANNYEQQEQA

SEQ ID NO: 88100 - protein, 15 aa, Mycobacterium tuberculosis
LVRDANNYEQQEQAS

SEQ ID NO: 88101 - protein, 15 aa, Mycobacterium tuberculosis
VRDANNYEQQEQASQ

SEQ ID NO: 88102 - protein, 15 aa, Mycobacterium tuberculosis
RDANNYEQQEQASQQ

SEQ ID NO: 88103 - protein, 15 aa, Mycobacterium tuberculosis
DANNYEQQEQASQQI

SEQ ID NO: 88104 - protein, 15 aa, Mycobacterium tuberculosis
ANNYEQQEQASQQIL

SEQ ID NO: 88105 - protein, 15 aa, Mycobacterium tuberculosis
NNYEQQEQASQQILS

SEQ ID NO: 88106 - protein, 15 aa, Mycobacterium tuberculosis
NYEQQEQASQQILSS

SEQ ID NO: 88107 - protein, 16 aa, Mycobacterium tuberculosis
MATRFMTDPHAMRDMA

SEQ ID NO: 88108 - protein, 16 aa, Mycobacterium tuberculosis
ATRFMTDPHAMRDMAG

SEQ ID NO: 88109 - protein, 16 aa, Mycobacterium tuberculosis
TRFMTDPHAMRDMAGR

SEQ ID NO: 88110 - protein, 16 aa, Mycobacterium tuberculosis
RFMTDPHAMRDMAGRF

SEQ ID NO: 88111 - protein, 16 aa, Mycobacterium tuberculosis
FMTDPHAMRDMAGRFE

SEQ ID NO: 88112 - protein, 16 aa, Mycobacterium tuberculosis
MTDPHAMRDMAGRFEV

SEQ ID NO: 88113 - protein, 16 aa, Mycobacterium tuberculosis
TDPHAMRDMAGRFEVH

SEQ ID NO: 88114 - protein, 16 aa, Mycobacterium tuberculosis
DPHAMRDMAGRFEVHA

SEQ ID NO: 88115 - protein, 16 aa, Mycobacterium tuberculosis
PHAMRDMAGRFEVHAQ

SEQ ID NO: 88116 - protein, 16 aa, Mycobacterium tuberculosis
HAMRDMAGRFEVHAQT

SEQ ID NO: 88117 - protein, 16 aa, Mycobacterium tuberculosis
AMRDMAGRFEVHAQTV

SEQ ID NO: 88118 - protein, 16 aa, Mycobacterium tuberculosis
MRDMAGRFEVHAQTVE

SEQ ID NO: 88119 - protein, 16 aa, Mycobacterium tuberculosis
RDMAGRFEVHAQTVED

SEQ ID NO: 88120 - protein, 16 aa, Mycobacterium tuberculosis
DMAGRFEVHAQTVEDE

SEQ ID NO: 88121 - protein, 16 aa, Mycobacterium tuberculosis
MAGRFEVHAQTVEDEA

SEQ ID NO: 88122 - protein, 16 aa, Mycobacterium tuberculosis
AGRFEVHAQTVEDEAR

SEQ ID NO: 88123 - protein, 16 aa, Mycobacterium tuberculosis
GRFEVHAQTVEDEARR

SEQ ID NO: 88124 - protein, 16 aa, Mycobacterium tuberculosis
RFEVHAQTVEDEARRM

SEQ ID NO: 88125 - protein, 16 aa, Mycobacterium tuberculosis
FEVHAQTVEDEARRMW

SEQ ID NO: 88126 - protein, 16 aa, Mycobacterium tuberculosis
EVHAQTVEDEARRMWA

SEQ ID NO: 88127 - protein, 16 aa, Mycobacterium tuberculosis
VHAQTVEDEARRMWAS

SEQ ID NO: 88128 - protein, 16 aa, Mycobacterium tuberculosis
HAQTVEDEARRMWASA

SEQ ID NO: 88129 - protein, 16 aa, Mycobacterium tuberculosis
AQTVEDEARRMWASAQ

SEQ ID NO: 88130 - protein, 16 aa, Mycobacterium tuberculosis
QTVEDEARRMWASAQN

SEQ ID NO: 88131 - protein, 16 aa, Mycobacterium tuberculosis
TVEDEARRMWASAQNI

SEQ ID NO: 88132 - protein, 16 aa, Mycobacterium tuberculosis
VEDEARRMWASAQNIS

SEQ ID NO: 88133 - protein, 16 aa, Mycobacterium tuberculosis
EDEARRMWASAQNISG

SEQ ID NO: 88134 - protein, 16 aa, Mycobacterium tuberculosis
DEARRMWASAQNISGA

SEQ ID NO: 88135 - protein, 16 aa, Mycobacterium tuberculosis
EARRMWASAQNISGAG

SEQ ID NO: 88136 - protein, 16 aa, Mycobacterium tuberculosis
ARRMWASAQNISGAGW

SEQ ID NO: 88137 - protein, 16 aa, Mycobacterium tuberculosis
RRMWASAQNISGAGWS

SEQ ID NO: 88138 - protein, 16 aa, Mycobacterium tuberculosis
RMWASAQNISGAGWSG

SEQ ID NO: 88139 - protein, 16 aa, Mycobacterium tuberculosis
MWASAQNISGAGWSGM

SEQ ID NO: 88140 - protein, 16 aa, Mycobacterium tuberculosis
WASAQNISGAGWSGMA

SEQ ID NO: 88141 - protein, 16 aa, Mycobacterium tuberculosis
ASAQNISGAGWSGMAE

SEQ ID NO: 88142 - protein, 16 aa, Mycobacterium tuberculosis
SAQNISGAGWSGMAEA

SEQ ID NO: 88143 - protein, 16 aa, Mycobacterium tuberculosis
AQNISGAGWSGMAEAT

SEQ ID NO: 88144 - protein, 16 aa, Mycobacterium tuberculosis
QNISGAGWSGMAEATS

SEQ ID NO: 88145 - protein, 16 aa, Mycobacterium tuberculosis
NISGAGWSGMAEATSL

SEQ ID NO: 88146 - protein, 16 aa, Mycobacterium tuberculosis
ISGAGWSGMAEATSLD

SEQ ID NO: 88147 - protein, 16 aa, Mycobacterium tuberculosis
SGAGWSGMAEATSLDT

SEQ ID NO: 88148 - protein, 16 aa, Mycobacterium tuberculosis
GAGWSGMAEATSLDTM

SEQ ID NO: 88149 - protein, 16 aa, Mycobacterium tuberculosis
AGWSGMAEATSLDTMA

SEQ ID NO: 88150 - protein, 16 aa, Mycobacterium tuberculosis
GWSGMAEATSLDTMAQ

SEQ ID NO: 88151 - protein, 16 aa, Mycobacterium tuberculosis
WSGMAEATSLDTMAQM

SEQ ID NO: 88152 - protein, 16 aa, Mycobacterium tuberculosis
SGMAEATSLDTMAQMN

SEQ ID NO: 88153 - protein, 16 aa, Mycobacterium tuberculosis
GMAEATSLDTMAQMNQ

SEQ ID NO: 88154 - protein, 16 aa, Mycobacterium tuberculosis
MAEATSLDTMAQMNQA

SEQ ID NO: 88155 - protein, 16 aa, Mycobacterium tuberculosis
AEATSLDTMAQMNQAF

SEQ ID NO: 88156 - protein, 16 aa, Mycobacterium tuberculosis
EATSLDTMAQMNQAFR

SEQ ID NO: 88157 - protein, 16 aa, Mycobacterium tuberculosis
ATSLDTMAQMNQAFRN

SEQ ID NO: 88158 - protein, 16 aa, Mycobacterium tuberculosis
TSLDTMAQMNQAFRNI

SEQ ID NO: 88159 - protein, 16 aa, Mycobacterium tuberculosis
SLDTMAQMNQAFRNIV

SEQ ID NO: 88160 - protein, 16 aa, Mycobacterium tuberculosis
LDTMAQMNQAFRNIVN

SEQ ID NO: 88161 - protein, 16 aa, Mycobacterium tuberculosis
DTMAQMNQAFRNIVNM

SEQ ID NO: 88162 - protein, 16 aa, Mycobacterium tuberculosis
TMAQMNQAFRNIVNML

SEQ ID NO: 88163 - protein, 16 aa, Mycobacterium tuberculosis
MAQMNQAFRNIVNMLH

SEQ ID NO: 88164 - protein, 16 aa, Mycobacterium tuberculosis
AQMNQAFRNIVNMLHG

SEQ ID NO: 88165 - protein, 16 aa, Mycobacterium tuberculosis
QMNQAFRNIVNMLHGV

SEQ ID NO: 88166 - protein, 16 aa, Mycobacterium tuberculosis
MNQAFRNIVNMLHGVR

SEQ ID NO: 88167 - protein, 16 aa, Mycobacterium tuberculosis
NQAFRNIVNMLHGVRD

SEQ ID NO: 88168 - protein, 16 aa, Mycobacterium tuberculosis
QAFRNIVNMLHGVRDG

SEQ ID NO: 88169 - protein, 16 aa, Mycobacterium tuberculosis
AFRNIVNMLHGVRDGL

SEQ ID NO: 88170 - protein, 16 aa, Mycobacterium tuberculosis
FRNIVNMLHGVRDGLV

SEQ ID NO: 88171 - protein, 16 aa, Mycobacterium tuberculosis
RNIVNMLHGVRDGLVR

SEQ ID NO: 88172 - protein, 16 aa, Mycobacterium tuberculosis
NIVNMLHGVRDGLVRD

SEQ ID NO: 88173 - protein, 16 aa, Mycobacterium tuberculosis
IVNMLHGVRDGLVRDA

SEQ ID NO: 88174 - protein, 16 aa, Mycobacterium tuberculosis
VNMLHGVRDGLVRDAN

SEQ ID NO: 88175 - protein, 16 aa, Mycobacterium tuberculosis
NMLHGVRDGLVRDANN

SEQ ID NO: 88176 - protein, 16 aa, Mycobacterium tuberculosis
MLHGVRDGLVRDANNY

SEQ ID NO: 88177 - protein, 16 aa, Mycobacterium tuberculosis
LHGVRDGLVRDANNYE

SEQ ID NO: 88178 - protein, 16 aa, Mycobacterium tuberculosis
HGVRDGLVRDANNYEQ

SEQ ID NO: 88179 - protein, 16 aa, Mycobacterium tuberculosis
GVRDGLVRDANNYEQQ

SEQ ID NO: 88180 - protein, 16 aa, Mycobacterium tuberculosis
VRDGLVRDANNYEQQE

SEQ ID NO: 88181 - protein, 16 aa, Mycobacterium tuberculosis
RDGLVRDANNYEQQEQ

SEQ ID NO: 88182 - protein, 16 aa, Mycobacterium tuberculosis
DGLVRDANNYEQQEQA

SEQ ID NO: 88183 - protein, 16 aa, Mycobacterium tuberculosis
GLVRDANNYEQQEQAS

SEQ ID NO: 88184 - protein, 16 aa, Mycobacterium tuberculosis
LVRDANNYEQQEQASQ

SEQ ID NO: 88185 - protein, 16 aa, Mycobacterium tuberculosis
VRDANNYEQQEQASQQ

SEQ ID NO: 88186 - protein, 16 aa, Mycobacterium tuberculosis
RDANNYEQQEQASQQI

SEQ ID NO: 88187 - protein, 16 aa, Mycobacterium tuberculosis
DANNYEQQEQASQQIL

SEQ ID NO: 88188 - protein, 16 aa, Mycobacterium tuberculosis
ANNYEQQEQASQQILS

SEQ ID NO: 88189 - protein, 16 aa, Mycobacterium tuberculosis
NNYEQQEQASQQILSS

SEQ ID NO: 88190 - protein, 13 aa, Mycobacterium tuberculosis
MLLPLGPPLPPDA

SEQ ID NO: 88191 - protein, 13 aa, Mycobacterium tuberculosis
LLPLGPPLPPDAV

SEQ ID NO: 88192 - protein, 13 aa, Mycobacterium tuberculosis
LPLGPPLPPDAVV

SEQ ID NO: 88193 - protein, 13 aa, Mycobacterium tuberculosis
PLGPPLPPDAVVA

SEQ ID NO: 88194 - protein, 13 aa, Mycobacterium tuberculosis
LGPPLPPDAVVAK

SEQ ID NO: 88195 - protein, 13 aa, Mycobacterium tuberculosis
GPPLPPDAVVAKR

SEQ ID NO: 88196 - protein, 13 aa, Mycobacterium tuberculosis
PPLPPDAVVAKRA

SEQ ID NO: 88197 - protein, 13 aa, Mycobacterium tuberculosis
PLPPDAVVAKRAE

SEQ ID NO: 88198 - protein, 13 aa, Mycobacterium tuberculosis
LPPDAVVAKRAES

SEQ ID NO: 88199 - protein, 13 aa, Mycobacterium tuberculosis
PPDAVVAKRAESG

SEQ ID NO: 88200 - protein, 13 aa, Mycobacterium tuberculosis
PDAVVAKRAESGM

SEQ ID NO: 88201 - protein, 13 aa, Mycobacterium tuberculosis
DAVVAKRAESGML

SEQ ID NO: 88202 - protein, 13 aa, Mycobacterium tuberculosis
AVVAKRAESGMLG

SEQ ID NO: 88203 - protein, 13 aa, Mycobacterium tuberculosis
VVAKRAESGMLGG

SEQ ID NO: 88204 - protein, 13 aa, Mycobacterium tuberculosis
VAKRAESGMLGGL

SEQ ID NO: 88205 - protein, 13 aa, Mycobacterium tuberculosis
AKRAESGMLGGLS

SEQ ID NO: 88206 - protein, 13 aa, Mycobacterium tuberculosis
KRAESGMLGGLSV

SEQ ID NO: 88207 - protein, 13 aa, Mycobacterium tuberculosis
RAESGMLGGLSVP

SEQ ID NO: 88208 - protein, 13 aa, Mycobacterium tuberculosis
AESGMLGGLSVPL

SEQ ID NO: 88209 - protein, 13 aa, Mycobacterium tuberculosis
ESGMLGGLSVPLS

SEQ ID NO: 88210 - protein, 13 aa, Mycobacterium tuberculosis
SGMLGGLSVPLSW

SEQ ID NO: 88211 - protein, 13 aa, Mycobacterium tuberculosis
GMLGGLSVPLSWG

SEQ ID NO: 88212 - protein, 13 aa, Mycobacterium tuberculosis
MLGGLSVPLSWGV

SEQ ID NO: 88213 - protein, 13 aa, Mycobacterium tuberculosis
LGGLSVPLSWGVA

SEQ ID NO: 88214 - protein, 13 aa, Mycobacterium tuberculosis
GGLSVPLSWGVAV

SEQ ID NO: 88215 - protein, 13 aa, Mycobacterium tuberculosis
GLSVPLSWGVAVP

SEQ ID NO: 88216 - protein, 13 aa, Mycobacterium tuberculosis
LSVPLSWGVAVPP

SEQ ID NO: 88217 - protein, 13 aa, Mycobacterium tuberculosis
SVPLSWGVAVPPD

SEQ ID NO: 88218 - protein, 13 aa, Mycobacterium tuberculosis
VPLSWGVAVPPDD

SEQ ID NO: 88219 - protein, 13 aa, Mycobacterium tuberculosis
PLSWGVAVPPDDY

SEQ ID NO: 88220 - protein, 13 aa, Mycobacterium tuberculosis
LSWGVAVPPDDYD

SEQ ID NO: 88221 - protein, 13 aa, Mycobacterium tuberculosis
SWGVAVPPDDYDH

SEQ ID NO: 88222 - protein, 13 aa, Mycobacterium tuberculosis
WGVAVPPDDYDHW

SEQ ID NO: 88223 - protein, 13 aa, Mycobacterium tuberculosis
GVAVPPDDYDHWA

SEQ ID NO: 88224 - protein, 13 aa, Mycobacterium tuberculosis
VAVPPDDYDHWAP

SEQ ID NO: 88225 - protein, 13 aa, Mycobacterium tuberculosis
AVPPDDYDHWAPA

SEQ ID NO: 88226 - protein, 13 aa, Mycobacterium tuberculosis
VPPDDYDHWAPAP

SEQ ID NO: 88227 - protein, 13 aa, Mycobacterium tuberculosis
PPDDYDHWAPAPE

SEQ ID NO: 88228 - protein, 13 aa, Mycobacterium tuberculosis
PDDYDHWAPAPED

SEQ ID NO: 88229 - protein, 13 aa, Mycobacterium tuberculosis
DDYDHWAPAPEDG

SEQ ID NO: 88230 - protein, 13 aa, Mycobacterium tuberculosis
DYDHWAPAPEDGA

SEQ ID NO: 88231 - protein, 13 aa, Mycobacterium tuberculosis
YDHWAPAPEDGAD

SEQ ID NO: 88232 - protein, 13 aa, Mycobacterium tuberculosis
DHWAPAPEDGADV

SEQ ID NO: 88233 - protein, 13 aa, Mycobacterium tuberculosis
HWAPAPEDGADVD

SEQ ID NO: 88234 - protein, 13 aa, Mycobacterium tuberculosis
WAPAPEDGADVDV

SEQ ID NO: 88235 - protein, 13 aa, Mycobacterium tuberculosis
APAPEDGADVDVQ

SEQ ID NO: 88236 - protein, 13 aa, Mycobacterium tuberculosis
PAPEDGADVDVQA

SEQ ID NO: 88237 - protein, 13 aa, Mycobacterium tuberculosis
APEDGADVDVQAA

SEQ ID NO: 88238 - protein, 13 aa, Mycobacterium tuberculosis
PEDGADVDVQAAE

SEQ ID NO: 88239 - protein, 13 aa, Mycobacterium tuberculosis
EDGADVDVQAAEG

SEQ ID NO: 88240 - protein, 13 aa, Mycobacterium tuberculosis
DGADVDVQAAEGA

SEQ ID NO: 88241 - protein, 13 aa, Mycobacterium tuberculosis
GADVDVQAAEGAD

SEQ ID NO: 88242 - protein, 13 aa, Mycobacterium tuberculosis
ADVDVQAAEGADA

SEQ ID NO: 88243 - protein, 13 aa, Mycobacterium tuberculosis
DVDVQAAEGADAE

SEQ ID NO: 88244 - protein, 13 aa, Mycobacterium tuberculosis
VDVQAAEGADAEA

SEQ ID NO: 88245 - protein, 13 aa, Mycobacterium tuberculosis
DVQAAEGADAEAA

SEQ ID NO: 88246 - protein, 13 aa, Mycobacterium tuberculosis
VQAAEGADAEAAA

SEQ ID NO: 88247 - protein, 13 aa, Mycobacterium tuberculosis
QAAEGADAEAAAM

SEQ ID NO: 88248 - protein, 13 aa, Mycobacterium tuberculosis
AAEGADAEAAAMD

SEQ ID NO: 88249 - protein, 13 aa, Mycobacterium tuberculosis
AEGADAEAAAMDE

SEQ ID NO: 88250 - protein, 13 aa, Mycobacterium tuberculosis
EGADAEAAAMDEW

SEQ ID NO: 88251 - protein, 13 aa, Mycobacterium tuberculosis
GADAEAAAMDEWD

SEQ ID NO: 88252 - protein, 13 aa, Mycobacterium tuberculosis
ADAEAAAMDEWDE

SEQ ID NO: 88253 - protein, 13 aa, Mycobacterium tuberculosis
DAEAAAMDEWDEW

SEQ ID NO: 88254 - protein, 13 aa, Mycobacterium tuberculosis
AEAAAMDEWDEWQ

SEQ ID NO: 88255 - protein, 13 aa, Mycobacterium tuberculosis
EAAAMDEWDEWQA

SEQ ID NO: 88256 - protein, 13 aa, Mycobacterium tuberculosis
AAAMDEWDEWQAW

SEQ ID NO: 88257 - protein, 13 aa, Mycobacterium tuberculosis
AAMDEWDEWQAWN

SEQ ID NO: 88258 - protein, 13 aa, Mycobacterium tuberculosis
AMDEWDEWQAWNE

SEQ ID NO: 88259 - protein, 13 aa, Mycobacterium tuberculosis
MDEWDEWQAWNEW

SEQ ID NO: 88260 - protein, 13 aa, Mycobacterium tuberculosis
DEWDEWQAWNEWV

SEQ ID NO: 88261 - protein, 13 aa, Mycobacterium tuberculosis
EWDEWQAWNEWVA

SEQ ID NO: 88262 - protein, 13 aa, Mycobacterium tuberculosis
WDEWQAWNEWVAE

SEQ ID NO: 88263 - protein, 13 aa, Mycobacterium tuberculosis
DEWQAWNEWVAEN

SEQ ID NO: 88264 - protein, 13 aa, Mycobacterium tuberculosis
EWQAWNEWVAENA

SEQ ID NO: 88265 - protein, 13 aa, Mycobacterium tuberculosis
WQAWNEWVAENAE

SEQ ID NO: 88266 - protein, 13 aa, Mycobacterium tuberculosis
QAWNEWVAENAEP

SEQ ID NO: 88267 - protein, 13 aa, Mycobacterium tuberculosis
AWNEWVAENAEPR

SEQ ID NO: 88268 - protein, 13 aa, Mycobacterium tuberculosis
WNEWVAENAEPRF

SEQ ID NO: 88269 - protein, 13 aa, Mycobacterium tuberculosis
NEWVAENAEPRFE

SEQ ID NO: 88270 - protein, 13 aa, Mycobacterium tuberculosis
EWVAENAEPRFEV

SEQ ID NO: 88271 - protein, 13 aa, Mycobacterium tuberculosis
WVAENAEPRFEVP

SEQ ID NO: 88272 - protein, 13 aa, Mycobacterium tuberculosis
VAENAEPRFEVPR

SEQ ID NO: 88273 - protein, 13 aa, Mycobacterium tuberculosis
AENAEPRFEVPRS

SEQ ID NO: 88274 - protein, 13 aa, Mycobacterium tuberculosis
ENAEPRFEVPRSS

SEQ ID NO: 88275 - protein, 13 aa, Mycobacterium tuberculosis
NAEPRFEVPRSSS

SEQ ID NO: 88276 - protein, 13 aa, Mycobacterium tuberculosis
AEPRFEVPRSSSS

SEQ ID NO: 88277 - protein, 13 aa, Mycobacterium tuberculosis
EPRFEVPRSSSSV

SEQ ID NO: 88278 - protein, 13 aa, Mycobacterium tuberculosis
PRFEVPRSSSSVI

SEQ ID NO: 88279 - protein, 13 aa, Mycobacterium tuberculosis
RFEVPRSSSSVIP

SEQ ID NO: 88280 - protein, 13 aa, Mycobacterium tuberculosis
FEVPRSSSSVIPH

SEQ ID NO: 88281 - protein, 13 aa, Mycobacterium tuberculosis
EVPRSSSSVIPHS

SEQ ID NO: 88282 - protein, 13 aa, Mycobacterium tuberculosis
VPRSSSSVIPHSP

SEQ ID NO: 88283 - protein, 13 aa, Mycobacterium tuberculosis
PRSSSSVIPHSPA

SEQ ID NO: 88284 - protein, 13 aa, Mycobacterium tuberculosis
RSSSSVIPHSPAA

SEQ ID NO: 88285 - protein, 13 aa, Mycobacterium tuberculosis
SSSSVIPHSPAAG

SEQ ID NO: 88286 - protein, 14 aa, Mycobacterium tuberculosis
MLLPLGPPLPPDAV

SEQ ID NO: 88287 - protein, 14 aa, Mycobacterium tuberculosis
LLPLGPPLPPDAVV

SEQ ID NO: 88288 - protein, 14 aa, Mycobacterium tuberculosis
LPLGPPLPPDAVVA

SEQ ID NO: 88289 - protein, 14 aa, Mycobacterium tuberculosis
PLGPPLPPDAVVAK

SEQ ID NO: 88290 - protein, 14 aa, Mycobacterium tuberculosis
LGPPLPPDAVVAKR

SEQ ID NO: 88291 - protein, 14 aa, Mycobacterium tuberculosis
GPPLPPDAVVAKRA

SEQ ID NO: 88292 - protein, 14 aa, Mycobacterium tuberculosis
PPLPPDAVVAKRAE

SEQ ID NO: 88293 - protein, 14 aa, Mycobacterium tuberculosis
PLPPDAVVAKRAES

SEQ ID NO: 88294 - protein, 14 aa, Mycobacterium tuberculosis
LPPDAVVAKRAESG

SEQ ID NO: 88295 - protein, 14 aa, Mycobacterium tuberculosis
PPDAVVAKRAESGM

SEQ ID NO: 88296 - protein, 14 aa, Mycobacterium tuberculosis
PDAVVAKRAESGML

SEQ ID NO: 88297 - protein, 14 aa, Mycobacterium tuberculosis
DAVVAKRAESGMLG

SEQ ID NO: 88298 - protein, 14 aa, Mycobacterium tuberculosis
AVVAKRAESGMLGG

SEQ ID NO: 88299 - protein, 14 aa, Mycobacterium tuberculosis
VVAKRAESGMLGGL

SEQ ID NO: 88300 - protein, 14 aa, Mycobacterium tuberculosis
VAKRAESGMLGGLS

SEQ ID NO: 88301 - protein, 14 aa, Mycobacterium tuberculosis
AKRAESGMLGGLSV

SEQ ID NO: 88302 - protein, 14 aa, Mycobacterium tuberculosis
KRAESGMLGGLSVP

SEQ ID NO: 88303 - protein, 14 aa, Mycobacterium tuberculosis
RAESGMLGGLSVPL

SEQ ID NO: 88304 - protein, 14 aa, Mycobacterium tuberculosis
AESGMLGGLSVPLS

SEQ ID NO: 88305 - protein, 14 aa, Mycobacterium tuberculosis
ESGMLGGLSVPLSW

SEQ ID NO: 88306 - protein, 14 aa, Mycobacterium tuberculosis
SGMLGGLSVPLSWG

SEQ ID NO: 88307 - protein, 14 aa, Mycobacterium tuberculosis
GMLGGLSVPLSWGV

SEQ ID NO: 88308 - protein, 14 aa, Mycobacterium tuberculosis
MLGGLSVPLSWGVA

SEQ ID NO: 88309 - protein, 14 aa, Mycobacterium tuberculosis
LGGLSVPLSWGVAV

SEQ ID NO: 88310 - protein, 14 aa, Mycobacterium tuberculosis
GGLSVPLSWGVAVP

SEQ ID NO: 88311 - protein, 14 aa, Mycobacterium tuberculosis
GLSVPLSWGVAVPP

SEQ ID NO: 88312 - protein, 14 aa, Mycobacterium tuberculosis
LSVPLSWGVAVPPD

SEQ ID NO: 88313 - protein, 14 aa, Mycobacterium tuberculosis
SVPLSWGVAVPPDD

SEQ ID NO: 88314 - protein, 14 aa, Mycobacterium tuberculosis
VPLSWGVAVPPDDY

SEQ ID NO: 88315 - protein, 14 aa, Mycobacterium tuberculosis
PLSWGVAVPPDDYD

SEQ ID NO: 88316 - protein, 14 aa, Mycobacterium tuberculosis
LSWGVAVPPDDYDH

SEQ ID NO: 88317 - protein, 14 aa, Mycobacterium tuberculosis
SWGVAVPPDDYDHW

SEQ ID NO: 88318 - protein, 14 aa, Mycobacterium tuberculosis
WGVAVPPDDYDHWA

SEQ ID NO: 88319 - protein, 14 aa, Mycobacterium tuberculosis
GVAVPPDDYDHWAP

SEQ ID NO: 88320 - protein, 14 aa, Mycobacterium tuberculosis
VAVPPDDYDHWAPA

SEQ ID NO: 88321 - protein, 14 aa, Mycobacterium tuberculosis
AVPPDDYDHWAPAP

SEQ ID NO: 88322 - protein, 14 aa, Mycobacterium tuberculosis
VPPDDYDHWAPAPE

SEQ ID NO: 88323 - protein, 14 aa, Mycobacterium tuberculosis
PPDDYDHWAPAPED

SEQ ID NO: 88324 - protein, 14 aa, Mycobacterium tuberculosis
PDDYDHWAPAPEDG

SEQ ID NO: 88325 - protein, 14 aa, Mycobacterium tuberculosis
DDYDHWAPAPEDGA

SEQ ID NO: 88326 - protein, 14 aa, Mycobacterium tuberculosis
DYDHWAPAPEDGAD

SEQ ID NO: 88327 - protein, 14 aa, Mycobacterium tuberculosis
YDHWAPAPEDGADV

SEQ ID NO: 88328 - protein, 14 aa, Mycobacterium tuberculosis
DHWAPAPEDGADVD

SEQ ID NO: 88329 - protein, 14 aa, Mycobacterium tuberculosis
HWAPAPEDGADVDV

SEQ ID NO: 88330 - protein, 14 aa, Mycobacterium tuberculosis
WAPAPEDGADVDVQ

SEQ ID NO: 88331 - protein, 14 aa, Mycobacterium tuberculosis
APAPEDGADVDVQA

SEQ ID NO: 88332 - protein, 14 aa, Mycobacterium tuberculosis
PAPEDGADVDVQAA

SEQ ID NO: 88333 - protein, 14 aa, Mycobacterium tuberculosis
APEDGADVDVQAAE

SEQ ID NO: 88334 - protein, 14 aa, Mycobacterium tuberculosis
PEDGADVDVQAAEG

SEQ ID NO: 88335 - protein, 14 aa, Mycobacterium tuberculosis
EDGADVDVQAAEGA

SEQ ID NO: 88336 - protein, 14 aa, Mycobacterium tuberculosis
DGADVDVQAAEGAD

SEQ ID NO: 88337 - protein, 14 aa, Mycobacterium tuberculosis
GADVDVQAAEGADA

SEQ ID NO: 88338 - protein, 14 aa, Mycobacterium tuberculosis
ADVDVQAAEGADAE

SEQ ID NO: 88339 - protein, 14 aa, Mycobacterium tuberculosis
DVDVQAAEGADAEA

SEQ ID NO: 88340 - protein, 14 aa, Mycobacterium tuberculosis
VDVQAAEGADAEAA

SEQ ID NO: 88341 - protein, 14 aa, Mycobacterium tuberculosis
DVQAAEGADAEAAA

SEQ ID NO: 88342 - protein, 14 aa, Mycobacterium tuberculosis
VQAAEGADAEAAAM

SEQ ID NO: 88343 - protein, 14 aa, Mycobacterium tuberculosis
QAAEGADAEAAAMD

SEQ ID NO: 88344 - protein, 14 aa, Mycobacterium tuberculosis
AAEGADAEAAAMDE

SEQ ID NO: 88345 - protein, 14 aa, Mycobacterium tuberculosis
AEGADAEAAAMDEW

SEQ ID NO: 88346 - protein, 14 aa, Mycobacterium tuberculosis
EGADAEAAAMDEWD

SEQ ID NO: 88347 - protein, 14 aa, Mycobacterium tuberculosis
GADAEAAAMDEWDE

SEQ ID NO: 88348 - protein, 14 aa, Mycobacterium tuberculosis
ADAEAAAMDEWDEW

SEQ ID NO: 88349 - protein, 14 aa, Mycobacterium tuberculosis
DAEAAAMDEWDEWQ

SEQ ID NO: 88350 - protein, 14 aa, Mycobacterium tuberculosis
AEAAAMDEWDEWQA

SEQ ID NO: 88351 - protein, 14 aa, Mycobacterium tuberculosis
EAAAMDEWDEWQAW

SEQ ID NO: 88352 - protein, 14 aa, Mycobacterium tuberculosis
AAAMDEWDEWQAWN

SEQ ID NO: 88353 - protein, 14 aa, Mycobacterium tuberculosis
AAMDEWDEWQAWNE

SEQ ID NO: 88354 - protein, 14 aa, Mycobacterium tuberculosis
AMDEWDEWQAWNEW

SEQ ID NO: 88355 - protein, 14 aa, Mycobacterium tuberculosis
MDEWDEWQAWNEWV

SEQ ID NO: 88356 - protein, 14 aa, Mycobacterium tuberculosis
DEWDEWQAWNEWVA

SEQ ID NO: 88357 - protein, 14 aa, Mycobacterium tuberculosis
EWDEWQAWNEWVAE

SEQ ID NO: 88358 - protein, 14 aa, Mycobacterium tuberculosis
WDEWQAWNEWVAEN

SEQ ID NO: 88359 - protein, 14 aa, Mycobacterium tuberculosis
DEWQAWNEWVAENA

SEQ ID NO: 88360 - protein, 14 aa, Mycobacterium tuberculosis
EWQAWNEWVAENAE

SEQ ID NO: 88361 - protein, 14 aa, Mycobacterium tuberculosis
WQAWNEWVAENAEP

SEQ ID NO: 88362 - protein, 14 aa, Mycobacterium tuberculosis
QAWNEWVAENAEPR

SEQ ID NO: 88363 - protein, 14 aa, Mycobacterium tuberculosis
AWNEWVAENAEPRF

SEQ ID NO: 88364 - protein, 14 aa, Mycobacterium tuberculosis
WNEWVAENAEPRFE

SEQ ID NO: 88365 - protein, 14 aa, Mycobacterium tuberculosis
NEWVAENAEPRFEV

SEQ ID NO: 88366 - protein, 14 aa, Mycobacterium tuberculosis
EWVAENAEPRFEVP

SEQ ID NO: 88367 - protein, 14 aa, Mycobacterium tuberculosis
WVAENAEPRFEVPR

SEQ ID NO: 88368 - protein, 14 aa, Mycobacterium tuberculosis
VAENAEPRFEVPRS

SEQ ID NO: 88369 - protein, 14 aa, Mycobacterium tuberculosis
AENAEPRFEVPRSS

SEQ ID NO: 88370 - protein, 14 aa, Mycobacterium tuberculosis
ENAEPRFEVPRSSS

SEQ ID NO: 88371 - protein, 14 aa, Mycobacterium tuberculosis
NAEPRFEVPRSSSS

SEQ ID NO: 88372 - protein, 14 aa, Mycobacterium tuberculosis
AEPRFEVPRSSSSV

SEQ ID NO: 88373 - protein, 14 aa, Mycobacterium tuberculosis
EPRFEVPRSSSSVI

SEQ ID NO: 88374 - protein, 14 aa, Mycobacterium tuberculosis
PRFEVPRSSSSVIP

SEQ ID NO: 88375 - protein, 14 aa, Mycobacterium tuberculosis
RFEVPRSSSSVIPH

SEQ ID NO: 88376 - protein, 14 aa, Mycobacterium tuberculosis
FEVPRSSSSVIPHS

SEQ ID NO: 88377 - protein, 14 aa, Mycobacterium tuberculosis
EVPRSSSSVIPHSP

SEQ ID NO: 88378 - protein, 14 aa, Mycobacterium tuberculosis
VPRSSSSVIPHSPA

SEQ ID NO: 88379 - protein, 14 aa, Mycobacterium tuberculosis
PRSSSSVIPHSPAA

SEQ ID NO: 88380 - protein, 14 aa, Mycobacterium tuberculosis
RSSSSVIPHSPAAG

SEQ ID NO: 88381 - protein, 15 aa, Mycobacterium tuberculosis
MLLPLGPPLPPDAVV

SEQ ID NO: 88382 - protein, 15 aa, Mycobacterium tuberculosis
LLPLGPPLPPDAVVA

SEQ ID NO: 88383 - protein, 15 aa, Mycobacterium tuberculosis
LPLGPPLPPDAVVAK

SEQ ID NO: 88384 - protein, 15 aa, Mycobacterium tuberculosis
PLGPPLPPDAVVAKR

SEQ ID NO: 88385 - protein, 15 aa, Mycobacterium tuberculosis
LGPPLPPDAVVAKRA

SEQ ID NO: 88386 - protein, 15 aa, Mycobacterium tuberculosis
GPPLPPDAVVAKRAE

SEQ ID NO: 88387 - protein, 15 aa, Mycobacterium tuberculosis
PPLPPDAVVAKRAES

SEQ ID NO: 88388 - protein, 15 aa, Mycobacterium tuberculosis
PLPPDAVVAKRAESG

SEQ ID NO: 88389 - protein, 15 aa, Mycobacterium tuberculosis
LPPDAVVAKRAESGM

SEQ ID NO: 88390 - protein, 15 aa, Mycobacterium tuberculosis
PPDAVVAKRAESGML

SEQ ID NO: 88391 - protein, 15 aa, Mycobacterium tuberculosis
PDAVVAKRAESGMLG

SEQ ID NO: 88392 - protein, 15 aa, Mycobacterium tuberculosis
DAVVAKRAESGMLGG

SEQ ID NO: 88393 - protein, 15 aa, Mycobacterium tuberculosis
AVVAKRAESGMLGGL

SEQ ID NO: 88394 - protein, 15 aa, Mycobacterium tuberculosis
VVAKRAESGMLGGLS

SEQ ID NO: 88395 - protein, 15 aa, Mycobacterium tuberculosis
VAKRAESGMLGGLSV

SEQ ID NO: 88396 - protein, 15 aa, Mycobacterium tuberculosis
AKRAESGMLGGLSVP

SEQ ID NO: 88397 - protein, 15 aa, Mycobacterium tuberculosis
KRAESGMLGGLSVPL

SEQ ID NO: 88398 - protein, 15 aa, Mycobacterium tuberculosis
RAESGMLGGLSVPLS

SEQ ID NO: 88399 - protein, 15 aa, Mycobacterium tuberculosis
AESGMLGGLSVPLSW

SEQ ID NO: 88400 - protein, 15 aa, Mycobacterium tuberculosis
ESGMLGGLSVPLSWG

SEQ ID NO: 88401 - protein, 15 aa, Mycobacterium tuberculosis
SGMLGGLSVPLSWGV

SEQ ID NO: 88402 - protein, 15 aa, Mycobacterium tuberculosis
GMLGGLSVPLSWGVA

SEQ ID NO: 88403 - protein, 15 aa, Mycobacterium tuberculosis
MLGGLSVPLSWGVAV

SEQ ID NO: 88404 - protein, 15 aa, Mycobacterium tuberculosis
LGGLSVPLSWGVAVP

SEQ ID NO: 88405 - protein, 15 aa, Mycobacterium tuberculosis
GGLSVPLSWGVAVPP

SEQ ID NO: 88406 - protein, 15 aa, Mycobacterium tuberculosis
GLSVPLSWGVAVPPD

SEQ ID NO: 88407 - protein, 15 aa, Mycobacterium tuberculosis
LSVPLSWGVAVPPDD

SEQ ID NO: 88408 - protein, 15 aa, Mycobacterium tuberculosis
SVPLSWGVAVPPDDY

SEQ ID NO: 88409 - protein, 15 aa, Mycobacterium tuberculosis
VPLSWGVAVPPDDYD

SEQ ID NO: 88410 - protein, 15 aa, Mycobacterium tuberculosis
PLSWGVAVPPDDYDH

SEQ ID NO: 88411 - protein, 15 aa, Mycobacterium tuberculosis
LSWGVAVPPDDYDHW

SEQ ID NO: 88412 - protein, 15 aa, Mycobacterium tuberculosis
SWGVAVPPDDYDHWA

SEQ ID NO: 88413 - protein, 15 aa, Mycobacterium tuberculosis
WGVAVPPDDYDHWAP

SEQ ID NO: 88414 - protein, 15 aa, Mycobacterium tuberculosis
GVAVPPDDYDHWAPA

SEQ ID NO: 88415 - protein, 15 aa, Mycobacterium tuberculosis
VAVPPDDYDHWAPAP

SEQ ID NO: 88416 - protein, 15 aa, Mycobacterium tuberculosis
AVPPDDYDHWAPAPE

SEQ ID NO: 88417 - protein, 15 aa, Mycobacterium tuberculosis
VPPDDYDHWAPAPED

SEQ ID NO: 88418 - protein, 15 aa, Mycobacterium tuberculosis
PPDDYDHWAPAPEDG

SEQ ID NO: 88419 - protein, 15 aa, Mycobacterium tuberculosis
PDDYDHWAPAPEDGA

SEQ ID NO: 88420 - protein, 15 aa, Mycobacterium tuberculosis
DDYDHWAPAPEDGAD

SEQ ID NO: 88421 - protein, 15 aa, Mycobacterium tuberculosis
DYDHWAPAPEDGADV

SEQ ID NO: 88422 - protein, 15 aa, Mycobacterium tuberculosis
YDHWAPAPEDGADVD

SEQ ID NO: 88423 - protein, 15 aa, Mycobacterium tuberculosis
DHWAPAPEDGADVDV

SEQ ID NO: 88424 - protein, 15 aa, Mycobacterium tuberculosis
HWAPAPEDGADVDVQ

SEQ ID NO: 88425 - protein, 15 aa, Mycobacterium tuberculosis
WAPAPEDGADVDVQA

SEQ ID NO: 88426 - protein, 15 aa, Mycobacterium tuberculosis
APAPEDGADVDVQAA

SEQ ID NO: 88427 - protein, 15 aa, Mycobacterium tuberculosis
PAPEDGADVDVQAAE

SEQ ID NO: 88428 - protein, 15 aa, Mycobacterium tuberculosis
APEDGADVDVQAAEG

SEQ ID NO: 88429 - protein, 15 aa, Mycobacterium tuberculosis
PEDGADVDVQAAEGA

SEQ ID NO: 88430 - protein, 15 aa, Mycobacterium tuberculosis
EDGADVDVQAAEGAD

SEQ ID NO: 88431 - protein, 15 aa, Mycobacterium tuberculosis
DGADVDVQAAEGADA

SEQ ID NO: 88432 - protein, 15 aa, Mycobacterium tuberculosis
GADVDVQAAEGADAE

SEQ ID NO: 88433 - protein, 15 aa, Mycobacterium tuberculosis
ADVDVQAAEGADAEA

SEQ ID NO: 88434 - protein, 15 aa, Mycobacterium tuberculosis
DVDVQAAEGADAEAA

SEQ ID NO: 88435 - protein, 15 aa, Mycobacterium tuberculosis
VDVQAAEGADAEAAA

SEQ ID NO: 88436 - protein, 15 aa, Mycobacterium tuberculosis
DVQAAEGADAEAAAM

SEQ ID NO: 88437 - protein, 15 aa, Mycobacterium tuberculosis
VQAAEGADAEAAAMD

SEQ ID NO: 88438 - protein, 15 aa, Mycobacterium tuberculosis
QAAEGADAEAAAMDE

SEQ ID NO: 88439 - protein, 15 aa, Mycobacterium tuberculosis
AAEGADAEAAAMDEW

SEQ ID NO: 88440 - protein, 15 aa, Mycobacterium tuberculosis
AEGADAEAAAMDEWD

SEQ ID NO: 88441 - protein, 15 aa, Mycobacterium tuberculosis
EGADAEAAAMDEWDE

SEQ ID NO: 88442 - protein, 15 aa, Mycobacterium tuberculosis
GADAEAAAMDEWDEW

SEQ ID NO: 88443 - protein, 15 aa, Mycobacterium tuberculosis
ADAEAAAMDEWDEWQ

SEQ ID NO: 88444 - protein, 15 aa, Mycobacterium tuberculosis
DAEAAAMDEWDEWQA

SEQ ID NO: 88445 - protein, 15 aa, Mycobacterium tuberculosis
AEAAAMDEWDEWQAW

SEQ ID NO: 88446 - protein, 15 aa, Mycobacterium tuberculosis
EAAAMDEWDEWQAWN

SEQ ID NO: 88447 - protein, 15 aa, Mycobacterium tuberculosis
AAAMDEWDEWQAWNE

SEQ ID NO: 88448 - protein, 15 aa, Mycobacterium tuberculosis
AAMDEWDEWQAWNEW

SEQ ID NO: 88449 - protein, 15 aa, Mycobacterium tuberculosis
AMDEWDEWQAWNEWV

SEQ ID NO: 88450 - protein, 15 aa, Mycobacterium tuberculosis
MDEWDEWQAWNEWVA

SEQ ID NO: 88451 - protein, 15 aa, Mycobacterium tuberculosis
DEWDEWQAWNEWVAE

SEQ ID NO: 88452 - protein, 15 aa, Mycobacterium tuberculosis
EWDEWQAWNEWVAEN

SEQ ID NO: 88453 - protein, 15 aa, Mycobacterium tuberculosis
WDEWQAWNEWVAENA

SEQ ID NO: 88454 - protein, 15 aa, Mycobacterium tuberculosis
DEWQAWNEWVAENAE

SEQ ID NO: 88455 - protein, 15 aa, Mycobacterium tuberculosis
EWQAWNEWVAENAEP

SEQ ID NO: 88456 - protein, 15 aa, Mycobacterium tuberculosis
WQAWNEWVAENAEPR

SEQ ID NO: 88457 - protein, 15 aa, Mycobacterium tuberculosis
QAWNEWVAENAEPRF

SEQ ID NO: 88458 - protein, 15 aa, Mycobacterium tuberculosis
AWNEWVAENAEPRFE

SEQ ID NO: 88459 - protein, 15 aa, Mycobacterium tuberculosis
WNEWVAENAEPRFEV

SEQ ID NO: 88460 - protein, 15 aa, Mycobacterium tuberculosis
NEWVAENAEPRFEVP

SEQ ID NO: 88461 - protein, 15 aa, Mycobacterium tuberculosis
EWVAENAEPRFEVPR

SEQ ID NO: 88462 - protein, 15 aa, Mycobacterium tuberculosis
WVAENAEPRFEVPRS

SEQ ID NO: 88463 - protein, 15 aa, Mycobacterium tuberculosis
VAENAEPRFEVPRSS

SEQ ID NO: 88464 - protein, 15 aa, Mycobacterium tuberculosis
AENAEPRFEVPRSSS

SEQ ID NO: 88465 - protein, 15 aa, Mycobacterium tuberculosis
ENAEPRFEVPRSSSS

SEQ ID NO: 88466 - protein, 15 aa, Mycobacterium tuberculosis
NAEPRFEVPRSSSSV

SEQ ID NO: 88467 - protein, 15 aa, Mycobacterium tuberculosis
AEPRFEVPRSSSSVI

SEQ ID NO: 88468 - protein, 15 aa, Mycobacterium tuberculosis
EPRFEVPRSSSSVIP

SEQ ID NO: 88469 - protein, 15 aa, Mycobacterium tuberculosis
PRFEVPRSSSSVIPH

SEQ ID NO: 88470 - protein, 15 aa, Mycobacterium tuberculosis
RFEVPRSSSSVIPHS

SEQ ID NO: 88471 - protein, 15 aa, Mycobacterium tuberculosis
FEVPRSSSSVIPHSP

SEQ ID NO: 88472 - protein, 15 aa, Mycobacterium tuberculosis
EVPRSSSSVIPHSPA

SEQ ID NO: 88473 - protein, 15 aa, Mycobacterium tuberculosis
VPRSSSSVIPHSPAA

SEQ ID NO: 88474 - protein, 15 aa, Mycobacterium tuberculosis
PRSSSSVIPHSPAAG

SEQ ID NO: 88475 - protein, 16 aa, Mycobacterium tuberculosis
MLLPLGPPLPPDAVVA

SEQ ID NO: 88476 - protein, 16 aa, Mycobacterium tuberculosis
LLPLGPPLPPDAVVAK

SEQ ID NO: 88477 - protein, 16 aa, Mycobacterium tuberculosis
LPLGPPLPPDAVVAKR

SEQ ID NO: 88478 - protein, 16 aa, Mycobacterium tuberculosis
PLGPPLPPDAVVAKRA

SEQ ID NO: 88479 - protein, 16 aa, Mycobacterium tuberculosis
LGPPLPPDAVVAKRAE

SEQ ID NO: 88480 - protein, 16 aa, Mycobacterium tuberculosis
GPPLPPDAVVAKRAES

SEQ ID NO: 88481 - protein, 16 aa, Mycobacterium tuberculosis
PPLPPDAVVAKRAESG

SEQ ID NO: 88482 - protein, 16 aa, Mycobacterium tuberculosis
PLPPDAVVAKRAESGM

SEQ ID NO: 88483 - protein, 16 aa, Mycobacterium tuberculosis
LPPDAVVAKRAESGML

SEQ ID NO: 88484 - protein, 16 aa, Mycobacterium tuberculosis
PPDAVVAKRAESGMLG

SEQ ID NO: 88485 - protein, 16 aa, Mycobacterium tuberculosis
PDAVVAKRAESGMLGG

SEQ ID NO: 88486 - protein, 16 aa, Mycobacterium tuberculosis
DAVVAKRAESGMLGGL

SEQ ID NO: 88487 - protein, 16 aa, Mycobacterium tuberculosis
AVVAKRAESGMLGGLS

SEQ ID NO: 88488 - protein, 16 aa, Mycobacterium tuberculosis
VVAKRAESGMLGGLSV

SEQ ID NO: 88489 - protein, 16 aa, Mycobacterium tuberculosis
VAKRAESGMLGGLSVP

SEQ ID NO: 88490 - protein, 16 aa, Mycobacterium tuberculosis
AKRAESGMLGGLSVPL

SEQ ID NO: 88491 - protein, 16 aa, Mycobacterium tuberculosis
KRAESGMLGGLSVPLS

SEQ ID NO: 88492 - protein, 16 aa, Mycobacterium tuberculosis
RAESGMLGGLSVPLSW

SEQ ID NO: 88493 - protein, 16 aa, Mycobacterium tuberculosis
AESGMLGGLSVPLSWG

SEQ ID NO: 88494 - protein, 16 aa, Mycobacterium tuberculosis
ESGMLGGLSVPLSWGV

SEQ ID NO: 88495 - protein, 16 aa, Mycobacterium tuberculosis
SGMLGGLSVPLSWGVA

SEQ ID NO: 88496 - protein, 16 aa, Mycobacterium tuberculosis
GMLGGLSVPLSWGVAV

SEQ ID NO: 88497 - protein, 16 aa, Mycobacterium tuberculosis
MLGGLSVPLSWGVAVP

SEQ ID NO: 88498 - protein, 16 aa, Mycobacterium tuberculosis
LGGLSVPLSWGVAVPP

SEQ ID NO: 88499 - protein, 16 aa, Mycobacterium tuberculosis
GGLSVPLSWGVAVPPD

SEQ ID NO: 88500 - protein, 16 aa, Mycobacterium tuberculosis
GLSVPLSWGVAVPPDD

SEQ ID NO: 88501 - protein, 16 aa, Mycobacterium tuberculosis
LSVPLSWGVAVPPDDY

SEQ ID NO: 88502 - protein, 16 aa, Mycobacterium tuberculosis
SVPLSWGVAVPPDDYD

SEQ ID NO: 88503 - protein, 16 aa, Mycobacterium tuberculosis
VPLSWGVAVPPDDYDH

SEQ ID NO: 88504 - protein, 16 aa, Mycobacterium tuberculosis
PLSWGVAVPPDDYDHW

SEQ ID NO: 88505 - protein, 16 aa, Mycobacterium tuberculosis
LSWGVAVPPDDYDHWA

SEQ ID NO: 88506 - protein, 16 aa, Mycobacterium tuberculosis
SWGVAVPPDDYDHWAP

SEQ ID NO: 88507 - protein, 16 aa, Mycobacterium tuberculosis
WGVAVPPDDYDHWAPA

SEQ ID NO: 88508 - protein, 16 aa, Mycobacterium tuberculosis
GVAVPPDDYDHWAPAP

SEQ ID NO: 88509 - protein, 16 aa, Mycobacterium tuberculosis
VAVPPDDYDHWAPAPE

SEQ ID NO: 88510 - protein, 16 aa, Mycobacterium tuberculosis
AVPPDDYDHWAPAPED

SEQ ID NO: 88511 - protein, 16 aa, Mycobacterium tuberculosis
VPPDDYDHWAPAPEDG

SEQ ID NO: 88512 - protein, 16 aa, Mycobacterium tuberculosis
PPDDYDHWAPAPEDGA

SEQ ID NO: 88513 - protein, 16 aa, Mycobacterium tuberculosis
PDDYDHWAPAPEDGAD

SEQ ID NO: 88514 - protein, 16 aa, Mycobacterium tuberculosis
DDYDHWAPAPEDGADV

SEQ ID NO: 88515 - protein, 16 aa, Mycobacterium tuberculosis
DYDHWAPAPEDGADVD

SEQ ID NO: 88516 - protein, 16 aa, Mycobacterium tuberculosis
YDHWAPAPEDGADVDV

SEQ ID NO: 88517 - protein, 16 aa, Mycobacterium tuberculosis
DHWAPAPEDGADVDVQ

SEQ ID NO: 88518 - protein, 16 aa, Mycobacterium tuberculosis
HWAPAPEDGADVDVQA

SEQ ID NO: 88519 - protein, 16 aa, Mycobacterium tuberculosis
WAPAPEDGADVDVQAA

SEQ ID NO: 88520 - protein, 16 aa, Mycobacterium tuberculosis
APAPEDGADVDVQAAE

SEQ ID NO: 88521 - protein, 16 aa, Mycobacterium tuberculosis
PAPEDGADVDVQAAEG

SEQ ID NO: 88522 - protein, 16 aa, Mycobacterium tuberculosis
APEDGADVDVQAAEGA

SEQ ID NO: 88523 - protein, 16 aa, Mycobacterium tuberculosis
PEDGADVDVQAAEGAD

SEQ ID NO: 88524 - protein, 16 aa, Mycobacterium tuberculosis
EDGADVDVQAAEGADA

SEQ ID NO: 88525 - protein, 16 aa, Mycobacterium tuberculosis
DGADVDVQAAEGADAE

SEQ ID NO: 88526 - protein, 16 aa, Mycobacterium tuberculosis
GADVDVQAAEGADAEA

SEQ ID NO: 88527 - protein, 16 aa, Mycobacterium tuberculosis
ADVDVQAAEGADAEAA

SEQ ID NO: 88528 - protein, 16 aa, Mycobacterium tuberculosis
DVDVQAAEGADAEAAA

SEQ ID NO: 88529 - protein, 16 aa, Mycobacterium tuberculosis
VDVQAAEGADAEAAAM

SEQ ID NO: 88530 - protein, 16 aa, Mycobacterium tuberculosis
DVQAAEGADAEAAAMD

SEQ ID NO: 88531 - protein, 16 aa, Mycobacterium tuberculosis
VQAAEGADAEAAAMDE

SEQ ID NO: 88532 - protein, 16 aa, Mycobacterium tuberculosis
QAAEGADAEAAAMDEW

SEQ ID NO: 88533 - protein, 16 aa, Mycobacterium tuberculosis
AAEGADAEAAAMDEWD

SEQ ID NO: 88534 - protein, 16 aa, Mycobacterium tuberculosis
AEGADAEAAAMDEWDE

SEQ ID NO: 88535 - protein, 16 aa, Mycobacterium tuberculosis
EGADAEAAAMDEWDEW

SEQ ID NO: 88536 - protein, 16 aa, Mycobacterium tuberculosis
GADAEAAAMDEWDEWQ

SEQ ID NO: 88537 - protein, 16 aa, Mycobacterium tuberculosis
ADAEAAAMDEWDEWQA

SEQ ID NO: 88538 - protein, 16 aa, Mycobacterium tuberculosis
DAEAAAMDEWDEWQAW

SEQ ID NO: 88539 - protein, 16 aa, Mycobacterium tuberculosis
AEAAAMDEWDEWQAWN

SEQ ID NO: 88540 - protein, 16 aa, Mycobacterium tuberculosis
EAAAMDEWDEWQAWNE

SEQ ID NO: 88541 - protein, 16 aa, Mycobacterium tuberculosis
AAAMDEWDEWQAWNEW

SEQ ID NO: 88542 - protein, 16 aa, Mycobacterium tuberculosis
AAMDEWDEWQAWNEWV

SEQ ID NO: 88543 - protein, 16 aa, Mycobacterium tuberculosis
AMDEWDEWQAWNEWVA

SEQ ID NO: 88544 - protein, 16 aa, Mycobacterium tuberculosis
MDEWDEWQAWNEWVAE

SEQ ID NO: 88545 - protein, 16 aa, Mycobacterium tuberculosis
DEWDEWQAWNEWVAEN

SEQ ID NO: 88546 - protein, 16 aa, Mycobacterium tuberculosis
EWDEWQAWNEWVAENA

SEQ ID NO: 88547 - protein, 16 aa, Mycobacterium tuberculosis
WDEWQAWNEWVAENAE

SEQ ID NO: 88548 - protein, 16 aa, Mycobacterium tuberculosis
DEWQAWNEWVAENAEP

SEQ ID NO: 88549 - protein, 16 aa, Mycobacterium tuberculosis
EWQAWNEWVAENAEPR

SEQ ID NO: 88550 - protein, 16 aa, Mycobacterium tuberculosis
WQAWNEWVAENAEPRF

SEQ ID NO: 88551 - protein, 16 aa, Mycobacterium tuberculosis
QAWNEWVAENAEPRFE

SEQ ID NO: 88552 - protein, 16 aa, Mycobacterium tuberculosis
AWNEWVAENAEPRFEV

SEQ ID NO: 88553 - protein, 16 aa, Mycobacterium tuberculosis
WNEWVAENAEPRFEVP

SEQ ID NO: 88554 - protein, 16 aa, Mycobacterium tuberculosis
NEWVAENAEPRFEVPR

SEQ ID NO: 88555 - protein, 16 aa, Mycobacterium tuberculosis
EWVAENAEPRFEVPRS

SEQ ID NO: 88556 - protein, 16 aa, Mycobacterium tuberculosis
WVAENAEPRFEVPRSS

SEQ ID NO: 88557 - protein, 16 aa, Mycobacterium tuberculosis
VAENAEPRFEVPRSSS

SEQ ID NO: 88558 - protein, 16 aa, Mycobacterium tuberculosis
AENAEPRFEVPRSSSS

SEQ ID NO: 88559 - protein, 16 aa, Mycobacterium tuberculosis
ENAEPRFEVPRSSSSV

SEQ ID NO: 88560 - protein, 16 aa, Mycobacterium tuberculosis
NAEPRFEVPRSSSSVI

SEQ ID NO: 88561 - protein, 16 aa, Mycobacterium tuberculosis
AEPRFEVPRSSSSVIP

SEQ ID NO: 88562 - protein, 16 aa, Mycobacterium tuberculosis
EPRFEVPRSSSSVIPH

SEQ ID NO: 88563 - protein, 16 aa, Mycobacterium tuberculosis
PRFEVPRSSSSVIPHS

SEQ ID NO: 88564 - protein, 16 aa, Mycobacterium tuberculosis
RFEVPRSSSSVIPHSP

SEQ ID NO: 88565 - protein, 16 aa, Mycobacterium tuberculosis
FEVPRSSSSVIPHSPA

SEQ ID NO: 88566 - protein, 16 aa, Mycobacterium tuberculosis
EVPRSSSSVIPHSPAA

SEQ ID NO: 88567 - protein, 16 aa, Mycobacterium tuberculosis
VPRSSSSVIPHSPAAG

SEQ ID NO: 88568 - protein, 13 aa, Mycobacterium tuberculosis
MGEGSRRPSGMLM

SEQ ID NO: 88569 - protein, 13 aa, Mycobacterium tuberculosis
GEGSRRPSGMLMS

SEQ ID NO: 88570 - protein, 13 aa, Mycobacterium tuberculosis
EGSRRPSGMLMSV

SEQ ID NO: 88571 - protein, 13 aa, Mycobacterium tuberculosis
GSRRPSGMLMSVD

SEQ ID NO: 88572 - protein, 13 aa, Mycobacterium tuberculosis
SRRPSGMLMSVDL

SEQ ID NO: 88573 - protein, 13 aa, Mycobacterium tuberculosis
RRPSGMLMSVDLE

SEQ ID NO: 88574 - protein, 13 aa, Mycobacterium tuberculosis
RPSGMLMSVDLEP

SEQ ID NO: 88575 - protein, 13 aa, Mycobacterium tuberculosis
PSGMLMSVDLEPV

SEQ ID NO: 88576 - protein, 13 aa, Mycobacterium tuberculosis
SGMLMSVDLEPVQ

SEQ ID NO: 88577 - protein, 13 aa, Mycobacterium tuberculosis
GMLMSVDLEPVQL

SEQ ID NO: 88578 - protein, 13 aa, Mycobacterium tuberculosis
MLMSVDLEPVQLV

SEQ ID NO: 88579 - protein, 13 aa, Mycobacterium tuberculosis
LMSVDLEPVQLVG

SEQ ID NO: 88580 - protein, 13 aa, Mycobacterium tuberculosis
MSVDLEPVQLVGP

SEQ ID NO: 88581 - protein, 13 aa, Mycobacterium tuberculosis
SVDLEPVQLVGPD

SEQ ID NO: 88582 - protein, 13 aa, Mycobacterium tuberculosis
VDLEPVQLVGPDG

SEQ ID NO: 88583 - protein, 13 aa, Mycobacterium tuberculosis
DLEPVQLVGPDGT

SEQ ID NO: 88584 - protein, 13 aa, Mycobacterium tuberculosis
LEPVQLVGPDGTP

SEQ ID NO: 88585 - protein, 13 aa, Mycobacterium tuberculosis
EPVQLVGPDGTPT

SEQ ID NO: 88586 - protein, 13 aa, Mycobacterium tuberculosis
PVQLVGPDGTPTA

SEQ ID NO: 88587 - protein, 13 aa, Mycobacterium tuberculosis
VQLVGPDGTPTAE

SEQ ID NO: 88588 - protein, 13 aa, Mycobacterium tuberculosis
QLVGPDGTPTAER

SEQ ID NO: 88589 - protein, 13 aa, Mycobacterium tuberculosis
LVGPDGTPTAERR

SEQ ID NO: 88590 - protein, 13 aa, Mycobacterium tuberculosis
VGPDGTPTAERRY

SEQ ID NO: 88591 - protein, 13 aa, Mycobacterium tuberculosis
GPDGTPTAERRYH

SEQ ID NO: 88592 - protein, 13 aa, Mycobacterium tuberculosis
PDGTPTAERRYHR

SEQ ID NO: 88593 - protein, 13 aa, Mycobacterium tuberculosis
DGTPTAERRYHRD

SEQ ID NO: 88594 - protein, 13 aa, Mycobacterium tuberculosis
GTPTAERRYHRDL

SEQ ID NO: 88595 - protein, 13 aa, Mycobacterium tuberculosis
TPTAERRYHRDLP

SEQ ID NO: 88596 - protein, 13 aa, Mycobacterium tuberculosis
PTAERRYHRDLPE

SEQ ID NO: 88597 - protein, 13 aa, Mycobacterium tuberculosis
TAERRYHRDLPEE

SEQ ID NO: 88598 - protein, 13 aa, Mycobacterium tuberculosis
AERRYHRDLPEET

SEQ ID NO: 88599 - protein, 13 aa, Mycobacterium tuberculosis
ERRYHRDLPEETL

SEQ ID NO: 88600 - protein, 13 aa, Mycobacterium tuberculosis
RRYHRDLPEETLR

SEQ ID NO: 88601 - protein, 13 aa, Mycobacterium tuberculosis
RYHRDLPEETLRW

SEQ ID NO: 88602 - protein, 13 aa, Mycobacterium tuberculosis
YHRDLPEETLRWL

SEQ ID NO: 88603 - protein, 13 aa, Mycobacterium tuberculosis
HRDLPEETLRWLY

SEQ ID NO: 88604 - protein, 13 aa, Mycobacterium tuberculosis
RDLPEETLRWLYE

SEQ ID NO: 88605 - protein, 13 aa, Mycobacterium tuberculosis
DLPEETLRWLYEM

SEQ ID NO: 88606 - protein, 13 aa, Mycobacterium tuberculosis
LPEETLRWLYEMM

SEQ ID NO: 88607 - protein, 13 aa, Mycobacterium tuberculosis
PEETLRWLYEMMV

SEQ ID NO: 88608 - protein, 13 aa, Mycobacterium tuberculosis
EETLRWLYEMMVV

SEQ ID NO: 88609 - protein, 13 aa, Mycobacterium tuberculosis
ETLRWLYEMMVVT

SEQ ID NO: 88610 - protein, 13 aa, Mycobacterium tuberculosis
TLRWLYEMMVVTR

SEQ ID NO: 88611 - protein, 13 aa, Mycobacterium tuberculosis
LRWLYEMMVVTRE

SEQ ID NO: 88612 - protein, 13 aa, Mycobacterium tuberculosis
RWLYEMMVVTREL

SEQ ID NO: 88613 - protein, 13 aa, Mycobacterium tuberculosis
WLYEMMVVTRELD

SEQ ID NO: 88614 - protein, 13 aa, Mycobacterium tuberculosis
LYEMMVVTRELDT

SEQ ID NO: 88615 - protein, 13 aa, Mycobacterium tuberculosis
YEMMVVTRELDTE

SEQ ID NO: 88616 - protein, 13 aa, Mycobacterium tuberculosis
EMMVVTRELDTEF

SEQ ID NO: 88617 - protein, 13 aa, Mycobacterium tuberculosis
MMVVTRELDTEFV

SEQ ID NO: 88618 - protein, 13 aa, Mycobacterium tuberculosis
MVVTRELDTEFVN

SEQ ID NO: 88619 - protein, 13 aa, Mycobacterium tuberculosis
VVTRELDTEFVNL

SEQ ID NO: 88620 - protein, 13 aa, Mycobacterium tuberculosis
VTRELDTEFVNLQ

SEQ ID NO: 88621 - protein, 13 aa, Mycobacterium tuberculosis
TRELDTEFVNLQR

SEQ ID NO: 88622 - protein, 13 aa, Mycobacterium tuberculosis
RELDTEFVNLQRQ

SEQ ID NO: 88623 - protein, 13 aa, Mycobacterium tuberculosis
ELDTEFVNLQRQG

SEQ ID NO: 88624 - protein, 13 aa, Mycobacterium tuberculosis
LDTEFVNLQRQGE

SEQ ID NO: 88625 - protein, 13 aa, Mycobacterium tuberculosis
DTEFVNLQRQGEL

SEQ ID NO: 88626 - protein, 13 aa, Mycobacterium tuberculosis
TEFVNLQRQGELA

SEQ ID NO: 88627 - protein, 13 aa, Mycobacterium tuberculosis
EFVNLQRQGELAL

SEQ ID NO: 88628 - protein, 13 aa, Mycobacterium tuberculosis
FVNLQRQGELALY

SEQ ID NO: 88629 - protein, 13 aa, Mycobacterium tuberculosis
VNLQRQGELALYT

SEQ ID NO: 88630 - protein, 13 aa, Mycobacterium tuberculosis
NLQRQGELALYTP

SEQ ID NO: 88631 - protein, 13 aa, Mycobacterium tuberculosis
LQRQGELALYTPC

SEQ ID NO: 88632 - protein, 13 aa, Mycobacterium tuberculosis
QRQGELALYTPCR

SEQ ID NO: 88633 - protein, 13 aa, Mycobacterium tuberculosis
RQGELALYTPCRG

SEQ ID NO: 88634 - protein, 13 aa, Mycobacterium tuberculosis
QGELALYTPCRGQ

SEQ ID NO: 88635 - protein, 13 aa, Mycobacterium tuberculosis
GELALYTPCRGQE

SEQ ID NO: 88636 - protein, 13 aa, Mycobacterium tuberculosis
ELALYTPCRGQEA

SEQ ID NO: 88637 - protein, 13 aa, Mycobacterium tuberculosis
LALYTPCRGQEAA

SEQ ID NO: 88638 - protein, 13 aa, Mycobacterium tuberculosis
ALYTPCRGQEAAQ

SEQ ID NO: 88639 - protein, 13 aa, Mycobacterium tuberculosis
LYTPCRGQEAAQV

SEQ ID NO: 88640 - protein, 13 aa, Mycobacterium tuberculosis
YTPCRGQEAAQVG

SEQ ID NO: 88641 - protein, 13 aa, Mycobacterium tuberculosis
TPCRGQEAAQVGA

SEQ ID NO: 88642 - protein, 13 aa, Mycobacterium tuberculosis
PCRGQEAAQVGAA

SEQ ID NO: 88643 - protein, 13 aa, Mycobacterium tuberculosis
CRGQEAAQVGAAA

SEQ ID NO: 88644 - protein, 13 aa, Mycobacterium tuberculosis
RGQEAAQVGAAAC

SEQ ID NO: 88645 - protein, 13 aa, Mycobacterium tuberculosis
GQEAAQVGAAACL

SEQ ID NO: 88646 - protein, 13 aa, Mycobacterium tuberculosis
QEAAQVGAAACLR

SEQ ID NO: 88647 - protein, 13 aa, Mycobacterium tuberculosis
EAAQVGAAACLRK

SEQ ID NO: 88648 - protein, 13 aa, Mycobacterium tuberculosis
AAQVGAAACLRKT

SEQ ID NO: 88649 - protein, 13 aa, Mycobacterium tuberculosis
AQVGAAACLRKTD

SEQ ID NO: 88650 - protein, 13 aa, Mycobacterium tuberculosis
QVGAAACLRKTDW

SEQ ID NO: 88651 - protein, 13 aa, Mycobacterium tuberculosis
VGAAACLRKTDWL

SEQ ID NO: 88652 - protein, 13 aa, Mycobacterium tuberculosis
GAAACLRKTDWLF

SEQ ID NO: 88653 - protein, 13 aa, Mycobacterium tuberculosis
AAACLRKTDWLFP

SEQ ID NO: 88654 - protein, 13 aa, Mycobacterium tuberculosis
AACLRKTDWLFPQ

SEQ ID NO: 88655 - protein, 13 aa, Mycobacterium tuberculosis
ACLRKTDWLFPQY

SEQ ID NO: 88656 - protein, 13 aa, Mycobacterium tuberculosis
CLRKTDWLFPQYR

SEQ ID NO: 88657 - protein, 13 aa, Mycobacterium tuberculosis
LRKTDWLFPQYRE

SEQ ID NO: 88658 - protein, 13 aa, Mycobacterium tuberculosis
RKTDWLFPQYREL

SEQ ID NO: 88659 - protein, 13 aa, Mycobacterium tuberculosis
KTDWLFPQYRELG

SEQ ID NO: 88660 - protein, 13 aa, Mycobacterium tuberculosis
TDWLFPQYRELGV

SEQ ID NO: 88661 - protein, 13 aa, Mycobacterium tuberculosis
DWLFPQYRELGVY

SEQ ID NO: 88662 - protein, 13 aa, Mycobacterium tuberculosis
WLFPQYRELGVYL

SEQ ID NO: 88663 - protein, 13 aa, Mycobacterium tuberculosis
LFPQYRELGVYLV

SEQ ID NO: 88664 - protein, 13 aa, Mycobacterium tuberculosis
FPQYRELGVYLVR

SEQ ID NO: 88665 - protein, 13 aa, Mycobacterium tuberculosis
PQYRELGVYLVRG

SEQ ID NO: 88666 - protein, 13 aa, Mycobacterium tuberculosis
QYRELGVYLVRGI

SEQ ID NO: 88667 - protein, 13 aa, Mycobacterium tuberculosis
YRELGVYLVRGIP

SEQ ID NO: 88668 - protein, 13 aa, Mycobacterium tuberculosis
RELGVYLVRGIPP

SEQ ID NO: 88669 - protein, 13 aa, Mycobacterium tuberculosis
ELGVYLVRGIPPG

SEQ ID NO: 88670 - protein, 13 aa, Mycobacterium tuberculosis
LGVYLVRGIPPGH

SEQ ID NO: 88671 - protein, 13 aa, Mycobacterium tuberculosis
GVYLVRGIPPGHV

SEQ ID NO: 88672 - protein, 13 aa, Mycobacterium tuberculosis
VYLVRGIPPGHVG

SEQ ID NO: 88673 - protein, 13 aa, Mycobacterium tuberculosis
YLVRGIPPGHVGV

SEQ ID NO: 88674 - protein, 13 aa, Mycobacterium tuberculosis
LVRGIPPGHVGVA

SEQ ID NO: 88675 - protein, 13 aa, Mycobacterium tuberculosis
VRGIPPGHVGVAW

SEQ ID NO: 88676 - protein, 13 aa, Mycobacterium tuberculosis
RGIPPGHVGVAWR

SEQ ID NO: 88677 - protein, 13 aa, Mycobacterium tuberculosis
GIPPGHVGVAWRG

SEQ ID NO: 88678 - protein, 13 aa, Mycobacterium tuberculosis
IPPGHVGVAWRGT

SEQ ID NO: 88679 - protein, 13 aa, Mycobacterium tuberculosis
PPGHVGVAWRGTW

SEQ ID NO: 88680 - protein, 13 aa, Mycobacterium tuberculosis
PGHVGVAWRGTWH

SEQ ID NO: 88681 - protein, 13 aa, Mycobacterium tuberculosis
GHVGVAWRGTWHG

SEQ ID NO: 88682 - protein, 13 aa, Mycobacterium tuberculosis
HVGVAWRGTWHGG

SEQ ID NO: 88683 - protein, 13 aa, Mycobacterium tuberculosis
VGVAWRGTWHGGL

SEQ ID NO: 88684 - protein, 13 aa, Mycobacterium tuberculosis
GVAWRGTWHGGLQ

SEQ ID NO: 88685 - protein, 13 aa, Mycobacterium tuberculosis
VAWRGTWHGGLQF

SEQ ID NO: 88686 - protein, 13 aa, Mycobacterium tuberculosis
AWRGTWHGGLQFT

SEQ ID NO: 88687 - protein, 13 aa, Mycobacterium tuberculosis
WRGTWHGGLQFTT

SEQ ID NO: 88688 - protein, 13 aa, Mycobacterium tuberculosis
RGTWHGGLQFTTK

SEQ ID NO: 88689 - protein, 13 aa, Mycobacterium tuberculosis
GTWHGGLQFTTKC

SEQ ID NO: 88690 - protein, 13 aa, Mycobacterium tuberculosis
TWHGGLQFTTKCC

SEQ ID NO: 88691 - protein, 13 aa, Mycobacterium tuberculosis
WHGGLQFTTKCCA

SEQ ID NO: 88692 - protein, 13 aa, Mycobacterium tuberculosis
HGGLQFTTKCCAP

SEQ ID NO: 88693 - protein, 13 aa, Mycobacterium tuberculosis
GGLQFTTKCCAPM

SEQ ID NO: 88694 - protein, 13 aa, Mycobacterium tuberculosis
GLQFTTKCCAPMS

SEQ ID NO: 88695 - protein, 13 aa, Mycobacterium tuberculosis
LQFTTKCCAPMSV

SEQ ID NO: 88696 - protein, 13 aa, Mycobacterium tuberculosis
QFTTKCCAPMSVP

SEQ ID NO: 88697 - protein, 13 aa, Mycobacterium tuberculosis
FTTKCCAPMSVPI

SEQ ID NO: 88698 - protein, 13 aa, Mycobacterium tuberculosis
TTKCCAPMSVPIG

SEQ ID NO: 88699 - protein, 13 aa, Mycobacterium tuberculosis
TKCCAPMSVPIGT

SEQ ID NO: 88700 - protein, 13 aa, Mycobacterium tuberculosis
KCCAPMSVPIGTQ

SEQ ID NO: 88701 - protein, 13 aa, Mycobacterium tuberculosis
CCAPMSVPIGTQT

SEQ ID NO: 88702 - protein, 13 aa, Mycobacterium tuberculosis
CAPMSVPIGTQTL

SEQ ID NO: 88703 - protein, 13 aa, Mycobacterium tuberculosis
APMSVPIGTQTLH

SEQ ID NO: 88704 - protein, 13 aa, Mycobacterium tuberculosis
PMSVPIGTQTLHA

SEQ ID NO: 88705 - protein, 13 aa, Mycobacterium tuberculosis
MSVPIGTQTLHAV

SEQ ID NO: 88706 - protein, 13 aa, Mycobacterium tuberculosis
SVPIGTQTLHAVG

SEQ ID NO: 88707 - protein, 13 aa, Mycobacterium tuberculosis
VPIGTQTLHAVGA

SEQ ID NO: 88708 - protein, 13 aa, Mycobacterium tuberculosis
PIGTQTLHAVGAA

SEQ ID NO: 88709 - protein, 13 aa, Mycobacterium tuberculosis
IGTQTLHAVGAAM

SEQ ID NO: 88710 - protein, 13 aa, Mycobacterium tuberculosis
GTQTLHAVGAAMA

SEQ ID NO: 88711 - protein, 13 aa, Mycobacterium tuberculosis
TQTLHAVGAAMAA

SEQ ID NO: 88712 - protein, 13 aa, Mycobacterium tuberculosis
QTLHAVGAAMAAQ

SEQ ID NO: 88713 - protein, 13 aa, Mycobacterium tuberculosis
TLHAVGAAMAAQR

SEQ ID NO: 88714 - protein, 13 aa, Mycobacterium tuberculosis
LHAVGAAMAAQRL

SEQ ID NO: 88715 - protein, 13 aa, Mycobacterium tuberculosis
HAVGAAMAAQRLD

SEQ ID NO: 88716 - protein, 13 aa, Mycobacterium tuberculosis
AVGAAMAAQRLDE

SEQ ID NO: 88717 - protein, 13 aa, Mycobacterium tuberculosis
VGAAMAAQRLDED

SEQ ID NO: 88718 - protein, 13 aa, Mycobacterium tuberculosis
GAAMAAQRLDEDS

SEQ ID NO: 88719 - protein, 13 aa, Mycobacterium tuberculosis
AAMAAQRLDEDSV

SEQ ID NO: 88720 - protein, 13 aa, Mycobacterium tuberculosis
AMAAQRLDEDSVT

SEQ ID NO: 88721 - protein, 13 aa, Mycobacterium tuberculosis
MAAQRLDEDSVTV

SEQ ID NO: 88722 - protein, 13 aa, Mycobacterium tuberculosis
AAQRLDEDSVTVA

SEQ ID NO: 88723 - protein, 13 aa, Mycobacterium tuberculosis
AQRLDEDSVTVAF

SEQ ID NO: 88724 - protein, 13 aa, Mycobacterium tuberculosis
QRLDEDSVTVAFL

SEQ ID NO: 88725 - protein, 13 aa, Mycobacterium tuberculosis
RLDEDSVTVAFLG

SEQ ID NO: 88726 - protein, 13 aa, Mycobacterium tuberculosis
LDEDSVTVAFLGD

SEQ ID NO: 88727 - protein, 13 aa, Mycobacterium tuberculosis
DEDSVTVAFLGDG

SEQ ID NO: 88728 - protein, 13 aa, Mycobacterium tuberculosis
EDSVTVAFLGDGA

SEQ ID NO: 88729 - protein, 13 aa, Mycobacterium tuberculosis
DSVTVAFLGDGAT

SEQ ID NO: 88730 - protein, 13 aa, Mycobacterium tuberculosis
SVTVAFLGDGATS

SEQ ID NO: 88731 - protein, 13 aa, Mycobacterium tuberculosis
VTVAFLGDGATSE

SEQ ID NO: 88732 - protein, 13 aa, Mycobacterium tuberculosis
TVAFLGDGATSEG

SEQ ID NO: 88733 - protein, 13 aa, Mycobacterium tuberculosis
VAFLGDGATSEGD

SEQ ID NO: 88734 - protein, 13 aa, Mycobacterium tuberculosis
AFLGDGATSEGDV

SEQ ID NO: 88735 - protein, 13 aa, Mycobacterium tuberculosis
FLGDGATSEGDVH

SEQ ID NO: 88736 - protein, 13 aa, Mycobacterium tuberculosis
LGDGATSEGDVHE

SEQ ID NO: 88737 - protein, 13 aa, Mycobacterium tuberculosis
GDGATSEGDVHEA

SEQ ID NO: 88738 - protein, 13 aa, Mycobacterium tuberculosis
DGATSEGDVHEAL

SEQ ID NO: 88739 - protein, 13 aa, Mycobacterium tuberculosis
GATSEGDVHEALN

SEQ ID NO: 88740 - protein, 13 aa, Mycobacterium tuberculosis
ATSEGDVHEALNF

SEQ ID NO: 88741 - protein, 13 aa, Mycobacterium tuberculosis
TSEGDVHEALNFA

SEQ ID NO: 88742 - protein, 13 aa, Mycobacterium tuberculosis
SEGDVHEALNFAA

SEQ ID NO: 88743 - protein, 13 aa, Mycobacterium tuberculosis
EGDVHEALNFAAV

SEQ ID NO: 88744 - protein, 13 aa, Mycobacterium tuberculosis
GDVHEALNFAAVF

SEQ ID NO: 88745 - protein, 13 aa, Mycobacterium tuberculosis
DVHEALNFAAVFT

SEQ ID NO: 88746 - protein, 13 aa, Mycobacterium tuberculosis
VHEALNFAAVFTT

SEQ ID NO: 88747 - protein, 13 aa, Mycobacterium tuberculosis
HEALNFAAVFTTP

SEQ ID NO: 88748 - protein, 13 aa, Mycobacterium tuberculosis
EALNFAAVFTTPC

SEQ ID NO: 88749 - protein, 13 aa, Mycobacterium tuberculosis
ALNFAAVFTTPCV

SEQ ID NO: 88750 - protein, 13 aa, Mycobacterium tuberculosis
LNFAAVFTTPCVF

SEQ ID NO: 88751 - protein, 13 aa, Mycobacterium tuberculosis
NFAAVFTTPCVFY

SEQ ID NO: 88752 - protein, 13 aa, Mycobacterium tuberculosis
FAAVFTTPCVFYV

SEQ ID NO: 88753 - protein, 13 aa, Mycobacterium tuberculosis
AAVFTTPCVFYVQ

SEQ ID NO: 88754 - protein, 13 aa, Mycobacterium tuberculosis
AVFTTPCVFYVQN

SEQ ID NO: 88755 - protein, 13 aa, Mycobacterium tuberculosis
VFTTPCVFYVQNN

SEQ ID NO: 88756 - protein, 13 aa, Mycobacterium tuberculosis
FTTPCVFYVQNNQ

SEQ ID NO: 88757 - protein, 13 aa, Mycobacterium tuberculosis
TTPCVFYVQNNQW

SEQ ID NO: 88758 - protein, 13 aa, Mycobacterium tuberculosis
TPCVFYVQNNQWA

SEQ ID NO: 88759 - protein, 13 aa, Mycobacterium tuberculosis
PCVFYVQNNQWAI

SEQ ID NO: 88760 - protein, 13 aa, Mycobacterium tuberculosis
CVFYVQNNQWAIS

SEQ ID NO: 88761 - protein, 13 aa, Mycobacterium tuberculosis
VFYVQNNQWAISM

SEQ ID NO: 88762 - protein, 13 aa, Mycobacterium tuberculosis
FYVQNNQWAISMP

SEQ ID NO: 88763 - protein, 13 aa, Mycobacterium tuberculosis
YVQNNQWAISMPV

SEQ ID NO: 88764 - protein, 13 aa, Mycobacterium tuberculosis
VQNNQWAISMPVS

SEQ ID NO: 88765 - protein, 13 aa, Mycobacterium tuberculosis
QNNQWAISMPVSR

SEQ ID NO: 88766 - protein, 13 aa, Mycobacterium tuberculosis
NNQWAISMPVSRQ

SEQ ID NO: 88767 - protein, 13 aa, Mycobacterium tuberculosis
NQWAISMPVSRQT

SEQ ID NO: 88768 - protein, 13 aa, Mycobacterium tuberculosis
QWAISMPVSRQTA

SEQ ID NO: 88769 - protein, 13 aa, Mycobacterium tuberculosis
WAISMPVSRQTAA

SEQ ID NO: 88770 - protein, 13 aa, Mycobacterium tuberculosis
AISMPVSRQTAAP

SEQ ID NO: 88771 - protein, 13 aa, Mycobacterium tuberculosis
ISMPVSRQTAAPS

SEQ ID NO: 88772 - protein, 13 aa, Mycobacterium tuberculosis
SMPVSRQTAAPSI

SEQ ID NO: 88773 - protein, 13 aa, Mycobacterium tuberculosis
MPVSRQTAAPSIA

SEQ ID NO: 88774 - protein, 13 aa, Mycobacterium tuberculosis
PVSRQTAAPSIAH

SEQ ID NO: 88775 - protein, 13 aa, Mycobacterium tuberculosis
VSRQTAAPSIAHK

SEQ ID NO: 88776 - protein, 13 aa, Mycobacterium tuberculosis
SRQTAAPSIAHKA

SEQ ID NO: 88777 - protein, 13 aa, Mycobacterium tuberculosis
RQTAAPSIAHKAI

SEQ ID NO: 88778 - protein, 13 aa, Mycobacterium tuberculosis
QTAAPSIAHKAIG

SEQ ID NO: 88779 - protein, 13 aa, Mycobacterium tuberculosis
TAAPSIAHKAIGY

SEQ ID NO: 88780 - protein, 13 aa, Mycobacterium tuberculosis
AAPSIAHKAIGYG

SEQ ID NO: 88781 - protein, 13 aa, Mycobacterium tuberculosis
APSIAHKAIGYGM

SEQ ID NO: 88782 - protein, 13 aa, Mycobacterium tuberculosis
PSIAHKAIGYGMP

SEQ ID NO: 88783 - protein, 13 aa, Mycobacterium tuberculosis
SIAHKAIGYGMPG

SEQ ID NO: 88784 - protein, 13 aa, Mycobacterium tuberculosis
IAHKAIGYGMPGI

SEQ ID NO: 88785 - protein, 13 aa, Mycobacterium tuberculosis
AHKAIGYGMPGIR

SEQ ID NO: 88786 - protein, 13 aa, Mycobacterium tuberculosis
HKAIGYGMPGIRV

SEQ ID NO: 88787 - protein, 13 aa, Mycobacterium tuberculosis
KAIGYGMPGIRVD

SEQ ID NO: 88788 - protein, 13 aa, Mycobacterium tuberculosis
AIGYGMPGIRVDG

SEQ ID NO: 88789 - protein, 13 aa, Mycobacterium tuberculosis
IGYGMPGIRVDGN

SEQ ID NO: 88790 - protein, 13 aa, Mycobacterium tuberculosis
GYGMPGIRVDGND

SEQ ID NO: 88791 - protein, 13 aa, Mycobacterium tuberculosis
YGMPGIRVDGNDV

SEQ ID NO: 88792 - protein, 13 aa, Mycobacterium tuberculosis
GMPGIRVDGNDVL

SEQ ID NO: 88793 - protein, 13 aa, Mycobacterium tuberculosis
MPGIRVDGNDVLA

SEQ ID NO: 88794 - protein, 13 aa, Mycobacterium tuberculosis
PGIRVDGNDVLAC

SEQ ID NO: 88795 - protein, 13 aa, Mycobacterium tuberculosis
GIRVDGNDVLACY

SEQ ID NO: 88796 - protein, 13 aa, Mycobacterium tuberculosis
IRVDGNDVLACYA

SEQ ID NO: 88797 - protein, 13 aa, Mycobacterium tuberculosis
RVDGNDVLACYAV

SEQ ID NO: 88798 - protein, 13 aa, Mycobacterium tuberculosis
VDGNDVLACYAVM

SEQ ID NO: 88799 - protein, 13 aa, Mycobacterium tuberculosis
DGNDVLACYAVMA

SEQ ID NO: 88800 - protein, 13 aa, Mycobacterium tuberculosis
GNDVLACYAVMAE

SEQ ID NO: 88801 - protein, 13 aa, Mycobacterium tuberculosis
NDVLACYAVMAEA

SEQ ID NO: 88802 - protein, 13 aa, Mycobacterium tuberculosis
DVLACYAVMAEAA

SEQ ID NO: 88803 - protein, 13 aa, Mycobacterium tuberculosis
VLACYAVMAEAAA

SEQ ID NO: 88804 - protein, 13 aa, Mycobacterium tuberculosis
LACYAVMAEAAAR

SEQ ID NO: 88805 - protein, 13 aa, Mycobacterium tuberculosis
ACYAVMAEAAARA

SEQ ID NO: 88806 - protein, 13 aa, Mycobacterium tuberculosis
CYAVMAEAAARAR

SEQ ID NO: 88807 - protein, 13 aa, Mycobacterium tuberculosis
YAVMAEAAARARA

SEQ ID NO: 88808 - protein, 13 aa, Mycobacterium tuberculosis
AVMAEAAARARAG

SEQ ID NO: 88809 - protein, 13 aa, Mycobacterium tuberculosis
VMAEAAARARAGD

SEQ ID NO: 88810 - protein, 13 aa, Mycobacterium tuberculosis
MAEAAARARAGDG

SEQ ID NO: 88811 - protein, 13 aa, Mycobacterium tuberculosis
AEAAARARAGDGP

SEQ ID NO: 88812 - protein, 13 aa, Mycobacterium tuberculosis
EAAARARAGDGPT

SEQ ID NO: 88813 - protein, 13 aa, Mycobacterium tuberculosis
AAARARAGDGPTL

SEQ ID NO: 88814 - protein, 13 aa, Mycobacterium tuberculosis
AARARAGDGPTLI

SEQ ID NO: 88815 - protein, 13 aa, Mycobacterium tuberculosis
ARARAGDGPTLIE

SEQ ID NO: 88816 - protein, 13 aa, Mycobacterium tuberculosis
RARAGDGPTLIEA

SEQ ID NO: 88817 - protein, 13 aa, Mycobacterium tuberculosis
ARAGDGPTLIEAV

SEQ ID NO: 88818 - protein, 13 aa, Mycobacterium tuberculosis
RAGDGPTLIEAVT

SEQ ID NO: 88819 - protein, 13 aa, Mycobacterium tuberculosis
AGDGPTLIEAVTY

SEQ ID NO: 88820 - protein, 13 aa, Mycobacterium tuberculosis
GDGPTLIEAVTYR

SEQ ID NO: 88821 - protein, 13 aa, Mycobacterium tuberculosis
DGPTLIEAVTYRL

SEQ ID NO: 88822 - protein, 13 aa, Mycobacterium tuberculosis
GPTLIEAVTYRLG

SEQ ID NO: 88823 - protein, 13 aa, Mycobacterium tuberculosis
PTLIEAVTYRLGP

SEQ ID NO: 88824 - protein, 13 aa, Mycobacterium tuberculosis
TLIEAVTYRLGPH

SEQ ID NO: 88825 - protein, 13 aa, Mycobacterium tuberculosis
LIEAVTYRLGPHT

SEQ ID NO: 88826 - protein, 13 aa, Mycobacterium tuberculosis
IEAVTYRLGPHTT

SEQ ID NO: 88827 - protein, 13 aa, Mycobacterium tuberculosis
EAVTYRLGPHTTA

SEQ ID NO: 88828 - protein, 13 aa, Mycobacterium tuberculosis
AVTYRLGPHTTAD

SEQ ID NO: 88829 - protein, 13 aa, Mycobacterium tuberculosis
VTYRLGPHTTADD

SEQ ID NO: 88830 - protein, 13 aa, Mycobacterium tuberculosis
TYRLGPHTTADDP

SEQ ID NO: 88831 - protein, 13 aa, Mycobacterium tuberculosis
YRLGPHTTADDPT

SEQ ID NO: 88832 - protein, 13 aa, Mycobacterium tuberculosis
RLGPHTTADDPTR

SEQ ID NO: 88833 - protein, 13 aa, Mycobacterium tuberculosis
LGPHTTADDPTRY

SEQ ID NO: 88834 - protein, 13 aa, Mycobacterium tuberculosis
GPHTTADDPTRYR

SEQ ID NO: 88835 - protein, 13 aa, Mycobacterium tuberculosis
PHTTADDPTRYRS

SEQ ID NO: 88836 - protein, 13 aa, Mycobacterium tuberculosis
HTTADDPTRYRSQ

SEQ ID NO: 88837 - protein, 13 aa, Mycobacterium tuberculosis
TTADDPTRYRSQE

SEQ ID NO: 88838 - protein, 13 aa, Mycobacterium tuberculosis
TADDPTRYRSQEE

SEQ ID NO: 88839 - protein, 13 aa, Mycobacterium tuberculosis
ADDPTRYRSQEEV

SEQ ID NO: 88840 - protein, 13 aa, Mycobacterium tuberculosis
DDPTRYRSQEEVD

SEQ ID NO: 88841 - protein, 13 aa, Mycobacterium tuberculosis
DPTRYRSQEEVDR

SEQ ID NO: 88842 - protein, 13 aa, Mycobacterium tuberculosis
PTRYRSQEEVDRW

SEQ ID NO: 88843 - protein, 13 aa, Mycobacterium tuberculosis
TRYRSQEEVDRWA

SEQ ID NO: 88844 - protein, 13 aa, Mycobacterium tuberculosis
RYRSQEEVDRWAT

SEQ ID NO: 88845 - protein, 13 aa, Mycobacterium tuberculosis
YRSQEEVDRWATL

SEQ ID NO: 88846 - protein, 13 aa, Mycobacterium tuberculosis
RSQEEVDRWATLD

SEQ ID NO: 88847 - protein, 13 aa, Mycobacterium tuberculosis
SQEEVDRWATLDP

SEQ ID NO: 88848 - protein, 13 aa, Mycobacterium tuberculosis
QEEVDRWATLDPI

SEQ ID NO: 88849 - protein, 13 aa, Mycobacterium tuberculosis
EEVDRWATLDPIP

SEQ ID NO: 88850 - protein, 13 aa, Mycobacterium tuberculosis
EVDRWATLDPIPR

SEQ ID NO: 88851 - protein, 13 aa, Mycobacterium tuberculosis
VDRWATLDPIPRY

SEQ ID NO: 88852 - protein, 13 aa, Mycobacterium tuberculosis
DRWATLDPIPRYR

SEQ ID NO: 88853 - protein, 13 aa, Mycobacterium tuberculosis
RWATLDPIPRYRT

SEQ ID NO: 88854 - protein, 13 aa, Mycobacterium tuberculosis
WATLDPIPRYRTY

SEQ ID NO: 88855 - protein, 13 aa, Mycobacterium tuberculosis
ATLDPIPRYRTYL

SEQ ID NO: 88856 - protein, 13 aa, Mycobacterium tuberculosis
TLDPIPRYRTYLQ

SEQ ID NO: 88857 - protein, 13 aa, Mycobacterium tuberculosis
LDPIPRYRTYLQD

SEQ ID NO: 88858 - protein, 13 aa, Mycobacterium tuberculosis
DPIPRYRTYLQDQ

SEQ ID NO: 88859 - protein, 13 aa, Mycobacterium tuberculosis
PIPRYRTYLQDQG

SEQ ID NO: 88860 - protein, 13 aa, Mycobacterium tuberculosis
IPRYRTYLQDQGL

SEQ ID NO: 88861 - protein, 13 aa, Mycobacterium tuberculosis
PRYRTYLQDQGLW

SEQ ID NO: 88862 - protein, 13 aa, Mycobacterium tuberculosis
RYRTYLQDQGLWS

SEQ ID NO: 88863 - protein, 13 aa, Mycobacterium tuberculosis
YRTYLQDQGLWSQ

SEQ ID NO: 88864 - protein, 13 aa, Mycobacterium tuberculosis
RTYLQDQGLWSQR

SEQ ID NO: 88865 - protein, 13 aa, Mycobacterium tuberculosis
TYLQDQGLWSQRL

SEQ ID NO: 88866 - protein, 13 aa, Mycobacterium tuberculosis
YLQDQGLWSQRLE

SEQ ID NO: 88867 - protein, 13 aa, Mycobacterium tuberculosis
LQDQGLWSQRLEE

SEQ ID NO: 88868 - protein, 13 aa, Mycobacterium tuberculosis
QDQGLWSQRLEEQ

SEQ ID NO: 88869 - protein, 13 aa, Mycobacterium tuberculosis
DQGLWSQRLEEQV

SEQ ID NO: 88870 - protein, 13 aa, Mycobacterium tuberculosis
QGLWSQRLEEQVT

SEQ ID NO: 88871 - protein, 13 aa, Mycobacterium tuberculosis
GLWSQRLEEQVTA

SEQ ID NO: 88872 - protein, 13 aa, Mycobacterium tuberculosis
LWSQRLEEQVTAR

SEQ ID NO: 88873 - protein, 13 aa, Mycobacterium tuberculosis
WSQRLEEQVTARA

SEQ ID NO: 88874 - protein, 13 aa, Mycobacterium tuberculosis
SQRLEEQVTARAK

SEQ ID NO: 88875 - protein, 13 aa, Mycobacterium tuberculosis
QRLEEQVTARAKH

SEQ ID NO: 88876 - protein, 13 aa, Mycobacterium tuberculosis
RLEEQVTARAKHV

SEQ ID NO: 88877 - protein, 13 aa, Mycobacterium tuberculosis
LEEQVTARAKHVR

SEQ ID NO: 88878 - protein, 13 aa, Mycobacterium tuberculosis
EEQVTARAKHVRS

SEQ ID NO: 88879 - protein, 13 aa, Mycobacterium tuberculosis
EQVTARAKHVRSE

SEQ ID NO: 88880 - protein, 13 aa, Mycobacterium tuberculosis
QVTARAKHVRSEL

SEQ ID NO: 88881 - protein, 13 aa, Mycobacterium tuberculosis
VTARAKHVRSELR

SEQ ID NO: 88882 - protein, 13 aa, Mycobacterium tuberculosis
TARAKHVRSELRD

SEQ ID NO: 88883 - protein, 13 aa, Mycobacterium tuberculosis
ARAKHVRSELRDA

SEQ ID NO: 88884 - protein, 13 aa, Mycobacterium tuberculosis
RAKHVRSELRDAV

SEQ ID NO: 88885 - protein, 13 aa, Mycobacterium tuberculosis
AKHVRSELRDAVF

SEQ ID NO: 88886 - protein, 13 aa, Mycobacterium tuberculosis
KHVRSELRDAVFD

SEQ ID NO: 88887 - protein, 13 aa, Mycobacterium tuberculosis
HVRSELRDAVFDA

SEQ ID NO: 88888 - protein, 13 aa, Mycobacterium tuberculosis
VRSELRDAVFDAP

SEQ ID NO: 88889 - protein, 13 aa, Mycobacterium tuberculosis
RSELRDAVFDAPD

SEQ ID NO: 88890 - protein, 13 aa, Mycobacterium tuberculosis
SELRDAVFDAPDF

SEQ ID NO: 88891 - protein, 13 aa, Mycobacterium tuberculosis
ELRDAVFDAPDFD

SEQ ID NO: 88892 - protein, 13 aa, Mycobacterium tuberculosis
LRDAVFDAPDFDV

SEQ ID NO: 88893 - protein, 13 aa, Mycobacterium tuberculosis
RDAVFDAPDFDVD

SEQ ID NO: 88894 - protein, 13 aa, Mycobacterium tuberculosis
DAVFDAPDFDVDE

SEQ ID NO: 88895 - protein, 13 aa, Mycobacterium tuberculosis
AVFDAPDFDVDEV

SEQ ID NO: 88896 - protein, 13 aa, Mycobacterium tuberculosis
VFDAPDFDVDEVF

SEQ ID NO: 88897 - protein, 13 aa, Mycobacterium tuberculosis
FDAPDFDVDEVFT

SEQ ID NO: 88898 - protein, 13 aa, Mycobacterium tuberculosis
DAPDFDVDEVFTT

SEQ ID NO: 88899 - protein, 13 aa, Mycobacterium tuberculosis
APDFDVDEVFTTV

SEQ ID NO: 88900 - protein, 13 aa, Mycobacterium tuberculosis
PDFDVDEVFTTVY

SEQ ID NO: 88901 - protein, 13 aa, Mycobacterium tuberculosis
DFDVDEVFTTVYA

SEQ ID NO: 88902 - protein, 13 aa, Mycobacterium tuberculosis
FDVDEVFTTVYAE

SEQ ID NO: 88903 - protein, 13 aa, Mycobacterium tuberculosis
DVDEVFTTVYAEI

SEQ ID NO: 88904 - protein, 13 aa, Mycobacterium tuberculosis
VDEVFTTVYAEIT

SEQ ID NO: 88905 - protein, 13 aa, Mycobacterium tuberculosis
DEVFTTVYAEITP

SEQ ID NO: 88906 - protein, 13 aa, Mycobacterium tuberculosis
EVFTTVYAEITPG

SEQ ID NO: 88907 - protein, 13 aa, Mycobacterium tuberculosis
VFTTVYAEITPGL

SEQ ID NO: 88908 - protein, 13 aa, Mycobacterium tuberculosis
FTTVYAEITPGLQ

SEQ ID NO: 88909 - protein, 13 aa, Mycobacterium tuberculosis
TTVYAEITPGLQA

SEQ ID NO: 88910 - protein, 13 aa, Mycobacterium tuberculosis
TVYAEITPGLQAQ

SEQ ID NO: 88911 - protein, 13 aa, Mycobacterium tuberculosis
VYAEITPGLQAQR

SEQ ID NO: 88912 - protein, 13 aa, Mycobacterium tuberculosis
YAEITPGLQAQRE

SEQ ID NO: 88913 - protein, 13 aa, Mycobacterium tuberculosis
AEITPGLQAQREQ

SEQ ID NO: 88914 - protein, 13 aa, Mycobacterium tuberculosis
EITPGLQAQREQL

SEQ ID NO: 88915 - protein, 13 aa, Mycobacterium tuberculosis
ITPGLQAQREQLR

SEQ ID NO: 88916 - protein, 13 aa, Mycobacterium tuberculosis
TPGLQAQREQLRA

SEQ ID NO: 88917 - protein, 13 aa, Mycobacterium tuberculosis
PGLQAQREQLRAE

SEQ ID NO: 88918 - protein, 13 aa, Mycobacterium tuberculosis
GLQAQREQLRAEL

SEQ ID NO: 88919 - protein, 13 aa, Mycobacterium tuberculosis
LQAQREQLRAELA

SEQ ID NO: 88920 - protein, 13 aa, Mycobacterium tuberculosis
QAQREQLRAELAR

SEQ ID NO: 88921 - protein, 13 aa, Mycobacterium tuberculosis
AQREQLRAELART

SEQ ID NO: 88922 - protein, 13 aa, Mycobacterium tuberculosis
QREQLRAELARTD

SEQ ID NO: 88923 - protein, 14 aa, Mycobacterium tuberculosis
MGEGSRRPSGMLMS

SEQ ID NO: 88924 - protein, 14 aa, Mycobacterium tuberculosis
GEGSRRPSGMLMSV

SEQ ID NO: 88925 - protein, 14 aa, Mycobacterium tuberculosis
EGSRRPSGMLMSVD

SEQ ID NO: 88926 - protein, 14 aa, Mycobacterium tuberculosis
GSRRPSGMLMSVDL

SEQ ID NO: 88927 - protein, 14 aa, Mycobacterium tuberculosis
SRRPSGMLMSVDLE

SEQ ID NO: 88928 - protein, 14 aa, Mycobacterium tuberculosis
RRPSGMLMSVDLEP

SEQ ID NO: 88929 - protein, 14 aa, Mycobacterium tuberculosis
RPSGMLMSVDLEPV

SEQ ID NO: 88930 - protein, 14 aa, Mycobacterium tuberculosis
PSGMLMSVDLEPVQ

SEQ ID NO: 88931 - protein, 14 aa, Mycobacterium tuberculosis
SGMLMSVDLEPVQL

SEQ ID NO: 88932 - protein, 14 aa, Mycobacterium tuberculosis
GMLMSVDLEPVQLV

SEQ ID NO: 88933 - protein, 14 aa, Mycobacterium tuberculosis
MLMSVDLEPVQLVG

SEQ ID NO: 88934 - protein, 14 aa, Mycobacterium tuberculosis
LMSVDLEPVQLVGP

SEQ ID NO: 88935 - protein, 14 aa, Mycobacterium tuberculosis
MSVDLEPVQLVGPD

SEQ ID NO: 88936 - protein, 14 aa, Mycobacterium tuberculosis
SVDLEPVQLVGPDG

SEQ ID NO: 88937 - protein, 14 aa, Mycobacterium tuberculosis
VDLEPVQLVGPDGT

SEQ ID NO: 88938 - protein, 14 aa, Mycobacterium tuberculosis
DLEPVQLVGPDGTP

SEQ ID NO: 88939 - protein, 14 aa, Mycobacterium tuberculosis
LEPVQLVGPDGTPT

SEQ ID NO: 88940 - protein, 14 aa, Mycobacterium tuberculosis
EPVQLVGPDGTPTA

SEQ ID NO: 88941 - protein, 14 aa, Mycobacterium tuberculosis
PVQLVGPDGTPTAE

SEQ ID NO: 88942 - protein, 14 aa, Mycobacterium tuberculosis
VQLVGPDGTPTAER

SEQ ID NO: 88943 - protein, 14 aa, Mycobacterium tuberculosis
QLVGPDGTPTAERR

SEQ ID NO: 88944 - protein, 14 aa, Mycobacterium tuberculosis
LVGPDGTPTAERRY

SEQ ID NO: 88945 - protein, 14 aa, Mycobacterium tuberculosis
VGPDGTPTAERRYH

SEQ ID NO: 88946 - protein, 14 aa, Mycobacterium tuberculosis
GPDGTPTAERRYHR

SEQ ID NO: 88947 - protein, 14 aa, Mycobacterium tuberculosis
PDGTPTAERRYHRD

SEQ ID NO: 88948 - protein, 14 aa, Mycobacterium tuberculosis
DGTPTAERRYHRDL

SEQ ID NO: 88949 - protein, 14 aa, Mycobacterium tuberculosis
GTPTAERRYHRDLP

SEQ ID NO: 88950 - protein, 14 aa, Mycobacterium tuberculosis
TPTAERRYHRDLPE

SEQ ID NO: 88951 - protein, 14 aa, Mycobacterium tuberculosis
PTAERRYHRDLPEE

SEQ ID NO: 88952 - protein, 14 aa, Mycobacterium tuberculosis
TAERRYHRDLPEET

SEQ ID NO: 88953 - protein, 14 aa, Mycobacterium tuberculosis
AERRYHRDLPEETL

SEQ ID NO: 88954 - protein, 14 aa, Mycobacterium tuberculosis
ERRYHRDLPEETLR

SEQ ID NO: 88955 - protein, 14 aa, Mycobacterium tuberculosis
RRYHRDLPEETLRW

SEQ ID NO: 88956 - protein, 14 aa, Mycobacterium tuberculosis
RYHRDLPEETLRWL

SEQ ID NO: 88957 - protein, 14 aa, Mycobacterium tuberculosis
YHRDLPEETLRWLY

SEQ ID NO: 88958 - protein, 14 aa, Mycobacterium tuberculosis
HRDLPEETLRWLYE

SEQ ID NO: 88959 - protein, 14 aa, Mycobacterium tuberculosis
RDLPEETLRWLYEM

SEQ ID NO: 88960 - protein, 14 aa, Mycobacterium tuberculosis
DLPEETLRWLYEMM

SEQ ID NO: 88961 - protein, 14 aa, Mycobacterium tuberculosis
LPEETLRWLYEMMV

SEQ ID NO: 88962 - protein, 14 aa, Mycobacterium tuberculosis
PEETLRWLYEMMVV

SEQ ID NO: 88963 - protein, 14 aa, Mycobacterium tuberculosis
EETLRWLYEMMVVT

SEQ ID NO: 88964 - protein, 14 aa, Mycobacterium tuberculosis
ETLRWLYEMMVVTR

SEQ ID NO: 88965 - protein, 14 aa, Mycobacterium tuberculosis
TLRWLYEMMVVTRE

SEQ ID NO: 88966 - protein, 14 aa, Mycobacterium tuberculosis
LRWLYEMMVVTREL

SEQ ID NO: 88967 - protein, 14 aa, Mycobacterium tuberculosis
RWLYEMMVVTRELD

SEQ ID NO: 88968 - protein, 14 aa, Mycobacterium tuberculosis
WLYEMMVVTRELDT

SEQ ID NO: 88969 - protein, 14 aa, Mycobacterium tuberculosis
LYEMMVVTRELDTE

SEQ ID NO: 88970 - protein, 14 aa, Mycobacterium tuberculosis
YEMMVVTRELDTEF

SEQ ID NO: 88971 - protein, 14 aa, Mycobacterium tuberculosis
EMMVVTRELDTEFV

SEQ ID NO: 88972 - protein, 14 aa, Mycobacterium tuberculosis
MMVVTRELDTEFVN

SEQ ID NO: 88973 - protein, 14 aa, Mycobacterium tuberculosis
MVVTRELDTEFVNL

SEQ ID NO: 88974 - protein, 14 aa, Mycobacterium tuberculosis
VVTRELDTEFVNLQ

SEQ ID NO: 88975 - protein, 14 aa, Mycobacterium tuberculosis
VTRELDTEFVNLQR

SEQ ID NO: 88976 - protein, 14 aa, Mycobacterium tuberculosis
TRELDTEFVNLQRQ

SEQ ID NO: 88977 - protein, 14 aa, Mycobacterium tuberculosis
RELDTEFVNLQRQG

SEQ ID NO: 88978 - protein, 14 aa, Mycobacterium tuberculosis
ELDTEFVNLQRQGE

SEQ ID NO: 88979 - protein, 14 aa, Mycobacterium tuberculosis
LDTEFVNLQRQGEL

SEQ ID NO: 88980 - protein, 14 aa, Mycobacterium tuberculosis
DTEFVNLQRQGELA

SEQ ID NO: 88981 - protein, 14 aa, Mycobacterium tuberculosis
TEFVNLQRQGELAL

SEQ ID NO: 88982 - protein, 14 aa, Mycobacterium tuberculosis
EFVNLQRQGELALY

SEQ ID NO: 88983 - protein, 14 aa, Mycobacterium tuberculosis
FVNLQRQGELALYT

SEQ ID NO: 88984 - protein, 14 aa, Mycobacterium tuberculosis
VNLQRQGELALYTP

SEQ ID NO: 88985 - protein, 14 aa, Mycobacterium tuberculosis
NLQRQGELALYTPC

SEQ ID NO: 88986 - protein, 14 aa, Mycobacterium tuberculosis
LQRQGELALYTPCR

SEQ ID NO: 88987 - protein, 14 aa, Mycobacterium tuberculosis
QRQGELALYTPCRG

SEQ ID NO: 88988 - protein, 14 aa, Mycobacterium tuberculosis
RQGELALYTPCRGQ

SEQ ID NO: 88989 - protein, 14 aa, Mycobacterium tuberculosis
QGELALYTPCRGQE

SEQ ID NO: 88990 - protein, 14 aa, Mycobacterium tuberculosis
GELALYTPCRGQEA

SEQ ID NO: 88991 - protein, 14 aa, Mycobacterium tuberculosis
ELALYTPCRGQEAA

SEQ ID NO: 88992 - protein, 14 aa, Mycobacterium tuberculosis
LALYTPCRGQEAAQ

SEQ ID NO: 88993 - protein, 14 aa, Mycobacterium tuberculosis
ALYTPCRGQEAAQV

SEQ ID NO: 88994 - protein, 14 aa, Mycobacterium tuberculosis
LYTPCRGQEAAQVG

SEQ ID NO: 88995 - protein, 14 aa, Mycobacterium tuberculosis
YTPCRGQEAAQVGA

SEQ ID NO: 88996 - protein, 14 aa, Mycobacterium tuberculosis
TPCRGQEAAQVGAA

SEQ ID NO: 88997 - protein, 14 aa, Mycobacterium tuberculosis
PCRGQEAAQVGAAA

SEQ ID NO: 88998 - protein, 14 aa, Mycobacterium tuberculosis
CRGQEAAQVGAAAC

SEQ ID NO: 88999 - protein, 14 aa, Mycobacterium tuberculosis
RGQEAAQVGAAACL

SEQ ID NO: 89000 - protein, 14 aa, Mycobacterium tuberculosis
GQEAAQVGAAACLR

SEQ ID NO: 89001 - protein, 14 aa, Mycobacterium tuberculosis
QEAAQVGAAACLRK

SEQ ID NO: 89002 - protein, 14 aa, Mycobacterium tuberculosis
EAAQVGAAACLRKT

SEQ ID NO: 89003 - protein, 14 aa, Mycobacterium tuberculosis
AAQVGAAACLRKTD

SEQ ID NO: 89004 - protein, 14 aa, Mycobacterium tuberculosis
AQVGAAACLRKTDW

SEQ ID NO: 89005 - protein, 14 aa, Mycobacterium tuberculosis
QVGAAACLRKTDWL

SEQ ID NO: 89006 - protein, 14 aa, Mycobacterium tuberculosis
VGAAACLRKTDWLF

SEQ ID NO: 89007 - protein, 14 aa, Mycobacterium tuberculosis
GAAACLRKTDWLFP

SEQ ID NO: 89008 - protein, 14 aa, Mycobacterium tuberculosis
AAACLRKTDWLFPQ

SEQ ID NO: 89009 - protein, 14 aa, Mycobacterium tuberculosis
AACLRKTDWLFPQY

SEQ ID NO: 89010 - protein, 14 aa, Mycobacterium tuberculosis
ACLRKTDWLFPQYR

SEQ ID NO: 89011 - protein, 14 aa, Mycobacterium tuberculosis
CLRKTDWLFPQYRE

SEQ ID NO: 89012 - protein, 14 aa, Mycobacterium tuberculosis
LRKTDWLFPQYREL

SEQ ID NO: 89013 - protein, 14 aa, Mycobacterium tuberculosis
RKTDWLFPQYRELG

SEQ ID NO: 89014 - protein, 14 aa, Mycobacterium tuberculosis
KTDWLFPQYRELGV

SEQ ID NO: 89015 - protein, 14 aa, Mycobacterium tuberculosis
TDWLFPQYRELGVY

SEQ ID NO: 89016 - protein, 14 aa, Mycobacterium tuberculosis
DWLFPQYRELGVYL

SEQ ID NO: 89017 - protein, 14 aa, Mycobacterium tuberculosis
WLFPQYRELGVYLV

SEQ ID NO: 89018 - protein, 14 aa, Mycobacterium tuberculosis
LFPQYRELGVYLVR

SEQ ID NO: 89019 - protein, 14 aa, Mycobacterium tuberculosis
FPQYRELGVYLVRG

SEQ ID NO: 89020 - protein, 14 aa, Mycobacterium tuberculosis
PQYRELGVYLVRGI

SEQ ID NO: 89021 - protein, 14 aa, Mycobacterium tuberculosis
QYRELGVYLVRGIP

SEQ ID NO: 89022 - protein, 14 aa, Mycobacterium tuberculosis
YRELGVYLVRGIPP

SEQ ID NO: 89023 - protein, 14 aa, Mycobacterium tuberculosis
RELGVYLVRGIPPG

SEQ ID NO: 89024 - protein, 14 aa, Mycobacterium tuberculosis
ELGVYLVRGIPPGH

SEQ ID NO: 89025 - protein, 14 aa, Mycobacterium tuberculosis
LGVYLVRGIPPGHV

SEQ ID NO: 89026 - protein, 14 aa, Mycobacterium tuberculosis
GVYLVRGIPPGHVG

SEQ ID NO: 89027 - protein, 14 aa, Mycobacterium tuberculosis
VYLVRGIPPGHVGV

SEQ ID NO: 89028 - protein, 14 aa, Mycobacterium tuberculosis
YLVRGIPPGHVGVA

SEQ ID NO: 89029 - protein, 14 aa, Mycobacterium tuberculosis
LVRGIPPGHVGVAW

SEQ ID NO: 89030 - protein, 14 aa, Mycobacterium tuberculosis
VRGIPPGHVGVAWR

SEQ ID NO: 89031 - protein, 14 aa, Mycobacterium tuberculosis
RGIPPGHVGVAWRG

SEQ ID NO: 89032 - protein, 14 aa, Mycobacterium tuberculosis
GIPPGHVGVAWRGT

SEQ ID NO: 89033 - protein, 14 aa, Mycobacterium tuberculosis
IPPGHVGVAWRGTW

SEQ ID NO: 89034 - protein, 14 aa, Mycobacterium tuberculosis
PPGHVGVAWRGTWH

SEQ ID NO: 89035 - protein, 14 aa, Mycobacterium tuberculosis
PGHVGVAWRGTWHG

SEQ ID NO: 89036 - protein, 14 aa, Mycobacterium tuberculosis
GHVGVAWRGTWHGG

SEQ ID NO: 89037 - protein, 14 aa, Mycobacterium tuberculosis
HVGVAWRGTWHGGL

SEQ ID NO: 89038 - protein, 14 aa, Mycobacterium tuberculosis
VGVAWRGTWHGGLQ

SEQ ID NO: 89039 - protein, 14 aa, Mycobacterium tuberculosis
GVAWRGTWHGGLQF

SEQ ID NO: 89040 - protein, 14 aa, Mycobacterium tuberculosis
VAWRGTWHGGLQFT

SEQ ID NO: 89041 - protein, 14 aa, Mycobacterium tuberculosis
AWRGTWHGGLQFTT

SEQ ID NO: 89042 - protein, 14 aa, Mycobacterium tuberculosis
WRGTWHGGLQFTTK

SEQ ID NO: 89043 - protein, 14 aa, Mycobacterium tuberculosis
RGTWHGGLQFTTKC

SEQ ID NO: 89044 - protein, 14 aa, Mycobacterium tuberculosis
GTWHGGLQFTTKCC

SEQ ID NO: 89045 - protein, 14 aa, Mycobacterium tuberculosis
TWHGGLQFTTKCCA

SEQ ID NO: 89046 - protein, 14 aa, Mycobacterium tuberculosis
WHGGLQFTTKCCAP

SEQ ID NO: 89047 - protein, 14 aa, Mycobacterium tuberculosis
HGGLQFTTKCCAPM

SEQ ID NO: 89048 - protein, 14 aa, Mycobacterium tuberculosis
GGLQFTTKCCAPMS

SEQ ID NO: 89049 - protein, 14 aa, Mycobacterium tuberculosis
GLQFTTKCCAPMSV

SEQ ID NO: 89050 - protein, 14 aa, Mycobacterium tuberculosis
LQFTTKCCAPMSVP

SEQ ID NO: 89051 - protein, 14 aa, Mycobacterium tuberculosis
QFTTKCCAPMSVPI

SEQ ID NO: 89052 - protein, 14 aa, Mycobacterium tuberculosis
FTTKCCAPMSVPIG

SEQ ID NO: 89053 - protein, 14 aa, Mycobacterium tuberculosis
TTKCCAPMSVPIGT

SEQ ID NO: 89054 - protein, 14 aa, Mycobacterium tuberculosis
TKCCAPMSVPIGTQ

SEQ ID NO: 89055 - protein, 14 aa, Mycobacterium tuberculosis
KCCAPMSVPIGTQT

SEQ ID NO: 89056 - protein, 14 aa, Mycobacterium tuberculosis
CCAPMSVPIGTQTL

SEQ ID NO: 89057 - protein, 14 aa, Mycobacterium tuberculosis
CAPMSVPIGTQTLH

SEQ ID NO: 89058 - protein, 14 aa, Mycobacterium tuberculosis
APMSVPIGTQTLHA

SEQ ID NO: 89059 - protein, 14 aa, Mycobacterium tuberculosis
PMSVPIGTQTLHAV

SEQ ID NO: 89060 - protein, 14 aa, Mycobacterium tuberculosis
MSVPIGTQTLHAVG

SEQ ID NO: 89061 - protein, 14 aa, Mycobacterium tuberculosis
SVPIGTQTLHAVGA

SEQ ID NO: 89062 - protein, 14 aa, Mycobacterium tuberculosis
VPIGTQTLHAVGAA

SEQ ID NO: 89063 - protein, 14 aa, Mycobacterium tuberculosis
PIGTQTLHAVGAAM

SEQ ID NO: 89064 - protein, 14 aa, Mycobacterium tuberculosis
IGTQTLHAVGAAMA

SEQ ID NO: 89065 - protein, 14 aa, Mycobacterium tuberculosis
GTQTLHAVGAAMAA

SEQ ID NO: 89066 - protein, 14 aa, Mycobacterium tuberculosis
TQTLHAVGAAMAAQ

SEQ ID NO: 89067 - protein, 14 aa, Mycobacterium tuberculosis
QTLHAVGAAMAAQR

SEQ ID NO: 89068 - protein, 14 aa, Mycobacterium tuberculosis
TLHAVGAAMAAQRL

SEQ ID NO: 89069 - protein, 14 aa, Mycobacterium tuberculosis
LHAVGAAMAAQRLD

SEQ ID NO: 89070 - protein, 14 aa, Mycobacterium tuberculosis
HAVGAAMAAQRLDE

SEQ ID NO: 89071 - protein, 14 aa, Mycobacterium tuberculosis
AVGAAMAAQRLDED

SEQ ID NO: 89072 - protein, 14 aa, Mycobacterium tuberculosis
VGAAMAAQRLDEDS

SEQ ID NO: 89073 - protein, 14 aa, Mycobacterium tuberculosis
GAAMAAQRLDEDSV

SEQ ID NO: 89074 - protein, 14 aa, Mycobacterium tuberculosis
AAMAAQRLDEDSVT

SEQ ID NO: 89075 - protein, 14 aa, Mycobacterium tuberculosis
AMAAQRLDEDSVTV

SEQ ID NO: 89076 - protein, 14 aa, Mycobacterium tuberculosis
MAAQRLDEDSVTVA

SEQ ID NO: 89077 - protein, 14 aa, Mycobacterium tuberculosis
AAQRLDEDSVTVAF

SEQ ID NO: 89078 - protein, 14 aa, Mycobacterium tuberculosis
AQRLDEDSVTVAFL

SEQ ID NO: 89079 - protein, 14 aa, Mycobacterium tuberculosis
QRLDEDSVTVAFLG

SEQ ID NO: 89080 - protein, 14 aa, Mycobacterium tuberculosis
RLDEDSVTVAFLGD

SEQ ID NO: 89081 - protein, 14 aa, Mycobacterium tuberculosis
LDEDSVTVAFLGDG

SEQ ID NO: 89082 - protein, 14 aa, Mycobacterium tuberculosis
DEDSVTVAFLGDGA

SEQ ID NO: 89083 - protein, 14 aa, Mycobacterium tuberculosis
EDSVTVAFLGDGAT

SEQ ID NO: 89084 - protein, 14 aa, Mycobacterium tuberculosis
DSVTVAFLGDGATS

SEQ ID NO: 89085 - protein, 14 aa, Mycobacterium tuberculosis
SVTVAFLGDGATSE

SEQ ID NO: 89086 - protein, 14 aa, Mycobacterium tuberculosis
VTVAFLGDGATSEG

SEQ ID NO: 89087 - protein, 14 aa, Mycobacterium tuberculosis
TVAFLGDGATSEGD

SEQ ID NO: 89088 - protein, 14 aa, Mycobacterium tuberculosis
VAFLGDGATSEGDV

SEQ ID NO: 89089 - protein, 14 aa, Mycobacterium tuberculosis
AFLGDGATSEGDVH

SEQ ID NO: 89090 - protein, 14 aa, Mycobacterium tuberculosis
FLGDGATSEGDVHE

SEQ ID NO: 89091 - protein, 14 aa, Mycobacterium tuberculosis
LGDGATSEGDVHEA

SEQ ID NO: 89092 - protein, 14 aa, Mycobacterium tuberculosis
GDGATSEGDVHEAL

SEQ ID NO: 89093 - protein, 14 aa, Mycobacterium tuberculosis
DGATSEGDVHEALN

SEQ ID NO: 89094 - protein, 14 aa, Mycobacterium tuberculosis
GATSEGDVHEALNF

SEQ ID NO: 89095 - protein, 14 aa, Mycobacterium tuberculosis
ATSEGDVHEALNFA

SEQ ID NO: 89096 - protein, 14 aa, Mycobacterium tuberculosis
TSEGDVHEALNFAA

SEQ ID NO: 89097 - protein, 14 aa, Mycobacterium tuberculosis
SEGDVHEALNFAAV

SEQ ID NO: 89098 - protein, 14 aa, Mycobacterium tuberculosis
EGDVHEALNFAAVF

SEQ ID NO: 89099 - protein, 14 aa, Mycobacterium tuberculosis
GDVHEALNFAAVFT

SEQ ID NO: 89100 - protein, 14 aa, Mycobacterium tuberculosis
DVHEALNFAAVFTT

SEQ ID NO: 89101 - protein, 14 aa, Mycobacterium tuberculosis
VHEALNFAAVFTTP

SEQ ID NO: 89102 - protein, 14 aa, Mycobacterium tuberculosis
HEALNFAAVFTTPC

SEQ ID NO: 89103 - protein, 14 aa, Mycobacterium tuberculosis
EALNFAAVFTTPCV

SEQ ID NO: 89104 - protein, 14 aa, Mycobacterium tuberculosis
ALNFAAVFTTPCVF

SEQ ID NO: 89105 - protein, 14 aa, Mycobacterium tuberculosis
LNFAAVFTTPCVFY

SEQ ID NO: 89106 - protein, 14 aa, Mycobacterium tuberculosis
NFAAVFTTPCVFYV

SEQ ID NO: 89107 - protein, 14 aa, Mycobacterium tuberculosis
FAAVFTTPCVFYVQ

SEQ ID NO: 89108 - protein, 14 aa, Mycobacterium tuberculosis
AAVFTTPCVFYVQN

SEQ ID NO: 89109 - protein, 14 aa, Mycobacterium tuberculosis
AVFTTPCVFYVQNN

SEQ ID NO: 89110 - protein, 14 aa, Mycobacterium tuberculosis
VFTTPCVFYVQNNQ

SEQ ID NO: 89111 - protein, 14 aa, Mycobacterium tuberculosis
FTTPCVFYVQNNQW

SEQ ID NO: 89112 - protein, 14 aa, Mycobacterium tuberculosis
TTPCVFYVQNNQWA

SEQ ID NO: 89113 - protein, 14 aa, Mycobacterium tuberculosis
TPCVFYVQNNQWAI

SEQ ID NO: 89114 - protein, 14 aa, Mycobacterium tuberculosis
PCVFYVQNNQWAIS

SEQ ID NO: 89115 - protein, 14 aa, Mycobacterium tuberculosis
CVFYVQNNQWAISM

SEQ ID NO: 89116 - protein, 14 aa, Mycobacterium tuberculosis
VFYVQNNQWAISMP

SEQ ID NO: 89117 - protein, 14 aa, Mycobacterium tuberculosis
FYVQNNQWAISMPV

SEQ ID NO: 89118 - protein, 14 aa, Mycobacterium tuberculosis
YVQNNQWAISMPVS

SEQ ID NO: 89119 - protein, 14 aa, Mycobacterium tuberculosis
VQNNQWAISMPVSR

SEQ ID NO: 89120 - protein, 14 aa, Mycobacterium tuberculosis
QNNQWAISMPVSRQ

SEQ ID NO: 89121 - protein, 14 aa, Mycobacterium tuberculosis
NNQWAISMPVSRQT

SEQ ID NO: 89122 - protein, 14 aa, Mycobacterium tuberculosis
NQWAISMPVSRQTA

SEQ ID NO: 89123 - protein, 14 aa, Mycobacterium tuberculosis
QWAISMPVSRQTAA

SEQ ID NO: 89124 - protein, 14 aa, Mycobacterium tuberculosis
WAISMPVSRQTAAP

SEQ ID NO: 89125 - protein, 14 aa, Mycobacterium tuberculosis
AISMPVSRQTAAPS

SEQ ID NO: 89126 - protein, 14 aa, Mycobacterium tuberculosis
ISMPVSRQTAAPSI

SEQ ID NO: 89127 - protein, 14 aa, Mycobacterium tuberculosis
SMPVSRQTAAPSIA

SEQ ID NO: 89128 - protein, 14 aa, Mycobacterium tuberculosis
MPVSRQTAAPSIAH

SEQ ID NO: 89129 - protein, 14 aa, Mycobacterium tuberculosis
PVSRQTAAPSIAHK

SEQ ID NO: 89130 - protein, 14 aa, Mycobacterium tuberculosis
VSRQTAAPSIAHKA

SEQ ID NO: 89131 - protein, 14 aa, Mycobacterium tuberculosis
SRQTAAPSIAHKAI

SEQ ID NO: 89132 - protein, 14 aa, Mycobacterium tuberculosis
RQTAAPSIAHKAIG

SEQ ID NO: 89133 - protein, 14 aa, Mycobacterium tuberculosis
QTAAPSIAHKAIGY

SEQ ID NO: 89134 - protein, 14 aa, Mycobacterium tuberculosis
TAAPSIAHKAIGYG

SEQ ID NO: 89135 - protein, 14 aa, Mycobacterium tuberculosis
AAPSIAHKAIGYGM

SEQ ID NO: 89136 - protein, 14 aa, Mycobacterium tuberculosis
APSIAHKAIGYGMP

SEQ ID NO: 89137 - protein, 14 aa, Mycobacterium tuberculosis
PSIAHKAIGYGMPG

SEQ ID NO: 89138 - protein, 14 aa, Mycobacterium tuberculosis
SIAHKAIGYGMPGI

SEQ ID NO: 89139 - protein, 14 aa, Mycobacterium tuberculosis
IAHKAIGYGMPGIR

SEQ ID NO: 89140 - protein, 14 aa, Mycobacterium tuberculosis
AHKAIGYGMPGIRV

SEQ ID NO: 89141 - protein, 14 aa, Mycobacterium tuberculosis
HKAIGYGMPGIRVD

SEQ ID NO: 89142 - protein, 14 aa, Mycobacterium tuberculosis
KAIGYGMPGIRVDG

SEQ ID NO: 89143 - protein, 14 aa, Mycobacterium tuberculosis
AIGYGMPGIRVDGN

SEQ ID NO: 89144 - protein, 14 aa, Mycobacterium tuberculosis
IGYGMPGIRVDGND

SEQ ID NO: 89145 - protein, 14 aa, Mycobacterium tuberculosis
GYGMPGIRVDGNDV

SEQ ID NO: 89146 - protein, 14 aa, Mycobacterium tuberculosis
YGMPGIRVDGNDVL

SEQ ID NO: 89147 - protein, 14 aa, Mycobacterium tuberculosis
GMPGIRVDGNDVLA

SEQ ID NO: 89148 - protein, 14 aa, Mycobacterium tuberculosis
MPGIRVDGNDVLAC

SEQ ID NO: 89149 - protein, 14 aa, Mycobacterium tuberculosis
PGIRVDGNDVLACY

SEQ ID NO: 89150 - protein, 14 aa, Mycobacterium tuberculosis
GIRVDGNDVLACYA

SEQ ID NO: 89151 - protein, 14 aa, Mycobacterium tuberculosis
IRVDGNDVLACYAV

SEQ ID NO: 89152 - protein, 14 aa, Mycobacterium tuberculosis
RVDGNDVLACYAVM

SEQ ID NO: 89153 - protein, 14 aa, Mycobacterium tuberculosis
VDGNDVLACYAVMA

SEQ ID NO: 89154 - protein, 14 aa, Mycobacterium tuberculosis
DGNDVLACYAVMAE

SEQ ID NO: 89155 - protein, 14 aa, Mycobacterium tuberculosis
GNDVLACYAVMAEA

SEQ ID NO: 89156 - protein, 14 aa, Mycobacterium tuberculosis
NDVLACYAVMAEAA

SEQ ID NO: 89157 - protein, 14 aa, Mycobacterium tuberculosis
DVLACYAVMAEAAA

SEQ ID NO: 89158 - protein, 14 aa, Mycobacterium tuberculosis
VLACYAVMAEAAAR

SEQ ID NO: 89159 - protein, 14 aa, Mycobacterium tuberculosis
LACYAVMAEAAARA

SEQ ID NO: 89160 - protein, 14 aa, Mycobacterium tuberculosis
ACYAVMAEAAARAR

SEQ ID NO: 89161 - protein, 14 aa, Mycobacterium tuberculosis
CYAVMAEAAARARA

SEQ ID NO: 89162 - protein, 14 aa, Mycobacterium tuberculosis
YAVMAEAAARARAG

SEQ ID NO: 89163 - protein, 14 aa, Mycobacterium tuberculosis
AVMAEAAARARAGD

SEQ ID NO: 89164 - protein, 14 aa, Mycobacterium tuberculosis
VMAEAAARARAGDG

SEQ ID NO: 89165 - protein, 14 aa, Mycobacterium tuberculosis
MAEAAARARAGDGP

SEQ ID NO: 89166 - protein, 14 aa, Mycobacterium tuberculosis
AEAAARARAGDGPT

SEQ ID NO: 89167 - protein, 14 aa, Mycobacterium tuberculosis
EAAARARAGDGPTL

SEQ ID NO: 89168 - protein, 14 aa, Mycobacterium tuberculosis
AAARARAGDGPTLI

SEQ ID NO: 89169 - protein, 14 aa, Mycobacterium tuberculosis
AARARAGDGPTLIE

SEQ ID NO: 89170 - protein, 14 aa, Mycobacterium tuberculosis
ARARAGDGPTLIEA

SEQ ID NO: 89171 - protein, 14 aa, Mycobacterium tuberculosis
RARAGDGPTLIEAV

SEQ ID NO: 89172 - protein, 14 aa, Mycobacterium tuberculosis
ARAGDGPTLIEAVT

SEQ ID NO: 89173 - protein, 14 aa, Mycobacterium tuberculosis
RAGDGPTLIEAVTY

SEQ ID NO: 89174 - protein, 14 aa, Mycobacterium tuberculosis
AGDGPTLIEAVTYR

SEQ ID NO: 89175 - protein, 14 aa, Mycobacterium tuberculosis
GDGPTLIEAVTYRL

SEQ ID NO: 89176 - protein, 14 aa, Mycobacterium tuberculosis
DGPTLIEAVTYRLG

SEQ ID NO: 89177 - protein, 14 aa, Mycobacterium tuberculosis
GPTLIEAVTYRLGP

SEQ ID NO: 89178 - protein, 14 aa, Mycobacterium tuberculosis
PTLIEAVTYRLGPH

SEQ ID NO: 89179 - protein, 14 aa, Mycobacterium tuberculosis
TLIEAVTYRLGPHT

SEQ ID NO: 89180 - protein, 14 aa, Mycobacterium tuberculosis
LIEAVTYRLGPHTT

SEQ ID NO: 89181 - protein, 14 aa, Mycobacterium tuberculosis
IEAVTYRLGPHTTA

SEQ ID NO: 89182 - protein, 14 aa, Mycobacterium tuberculosis
EAVTYRLGPHTTAD

SEQ ID NO: 89183 - protein, 14 aa, Mycobacterium tuberculosis
AVTYRLGPHTTADD

SEQ ID NO: 89184 - protein, 14 aa, Mycobacterium tuberculosis
VTYRLGPHTTADDP

SEQ ID NO: 89185 - protein, 14 aa, Mycobacterium tuberculosis
TYRLGPHTTADDPT

SEQ ID NO: 89186 - protein, 14 aa, Mycobacterium tuberculosis
YRLGPHTTADDPTR

SEQ ID NO: 89187 - protein, 14 aa, Mycobacterium tuberculosis
RLGPHTTADDPTRY

SEQ ID NO: 89188 - protein, 14 aa, Mycobacterium tuberculosis
LGPHTTADDPTRYR

SEQ ID NO: 89189 - protein, 14 aa, Mycobacterium tuberculosis
GPHTTADDPTRYRS

SEQ ID NO: 89190 - protein, 14 aa, Mycobacterium tuberculosis
PHTTADDPTRYRSQ

SEQ ID NO: 89191 - protein, 14 aa, Mycobacterium tuberculosis
HTTADDPTRYRSQE

SEQ ID NO: 89192 - protein, 14 aa, Mycobacterium tuberculosis
TTADDPTRYRSQEE

SEQ ID NO: 89193 - protein, 14 aa, Mycobacterium tuberculosis
TADDPTRYRSQEEV

SEQ ID NO: 89194 - protein, 14 aa, Mycobacterium tuberculosis
ADDPTRYRSQEEVD

SEQ ID NO: 89195 - protein, 14 aa, Mycobacterium tuberculosis
DDPTRYRSQEEVDR

SEQ ID NO: 89196 - protein, 14 aa, Mycobacterium tuberculosis
DPTRYRSQEEVDRW

SEQ ID NO: 89197 - protein, 14 aa, Mycobacterium tuberculosis
PTRYRSQEEVDRWA

SEQ ID NO: 89198 - protein, 14 aa, Mycobacterium tuberculosis
TRYRSQEEVDRWAT

SEQ ID NO: 89199 - protein, 14 aa, Mycobacterium tuberculosis
RYRSQEEVDRWATL

SEQ ID NO: 89200 - protein, 14 aa, Mycobacterium tuberculosis
YRSQEEVDRWATLD

SEQ ID NO: 89201 - protein, 14 aa, Mycobacterium tuberculosis
RSQEEVDRWATLDP

SEQ ID NO: 89202 - protein, 14 aa, Mycobacterium tuberculosis
SQEEVDRWATLDPI

SEQ ID NO: 89203 - protein, 14 aa, Mycobacterium tuberculosis
QEEVDRWATLDPIP

SEQ ID NO: 89204 - protein, 14 aa, Mycobacterium tuberculosis
EEVDRWATLDPIPR

SEQ ID NO: 89205 - protein, 14 aa, Mycobacterium tuberculosis
EVDRWATLDPIPRY

SEQ ID NO: 89206 - protein, 14 aa, Mycobacterium tuberculosis
VDRWATLDPIPRYR

SEQ ID NO: 89207 - protein, 14 aa, Mycobacterium tuberculosis
DRWATLDPIPRYRT

SEQ ID NO: 89208 - protein, 14 aa, Mycobacterium tuberculosis
RWATLDPIPRYRTY

SEQ ID NO: 89209 - protein, 14 aa, Mycobacterium tuberculosis
WATLDPIPRYRTYL

SEQ ID NO: 89210 - protein, 14 aa, Mycobacterium tuberculosis
ATLDPIPRYRTYLQ

SEQ ID NO: 89211 - protein, 14 aa, Mycobacterium tuberculosis
TLDPIPRYRTYLQD

SEQ ID NO: 89212 - protein, 14 aa, Mycobacterium tuberculosis
LDPIPRYRTYLQDQ

SEQ ID NO: 89213 - protein, 14 aa, Mycobacterium tuberculosis
DPIPRYRTYLQDQG

SEQ ID NO: 89214 - protein, 14 aa, Mycobacterium tuberculosis
PIPRYRTYLQDQGL

SEQ ID NO: 89215 - protein, 14 aa, Mycobacterium tuberculosis
IPRYRTYLQDQGLW

SEQ ID NO: 89216 - protein, 14 aa, Mycobacterium tuberculosis
PRYRTYLQDQGLWS

SEQ ID NO: 89217 - protein, 14 aa, Mycobacterium tuberculosis
RYRTYLQDQGLWSQ

SEQ ID NO: 89218 - protein, 14 aa, Mycobacterium tuberculosis
YRTYLQDQGLWSQR

SEQ ID NO: 89219 - protein, 14 aa, Mycobacterium tuberculosis
RTYLQDQGLWSQRL

SEQ ID NO: 89220 - protein, 14 aa, Mycobacterium tuberculosis
TYLQDQGLWSQRLE

SEQ ID NO: 89221 - protein, 14 aa, Mycobacterium tuberculosis
YLQDQGLWSQRLEE

SEQ ID NO: 89222 - protein, 14 aa, Mycobacterium tuberculosis
LQDQGLWSQRLEEQ

SEQ ID NO: 89223 - protein, 14 aa, Mycobacterium tuberculosis
QDQGLWSQRLEEQV

SEQ ID NO: 89224 - protein, 14 aa, Mycobacterium tuberculosis
DQGLWSQRLEEQVT

SEQ ID NO: 89225 - protein, 14 aa, Mycobacterium tuberculosis
QGLWSQRLEEQVTA

SEQ ID NO: 89226 - protein, 14 aa, Mycobacterium tuberculosis
GLWSQRLEEQVTAR

SEQ ID NO: 89227 - protein, 14 aa, Mycobacterium tuberculosis
LWSQRLEEQVTARA

SEQ ID NO: 89228 - protein, 14 aa, Mycobacterium tuberculosis
WSQRLEEQVTARAK

SEQ ID NO: 89229 - protein, 14 aa, Mycobacterium tuberculosis
SQRLEEQVTARAKH

SEQ ID NO: 89230 - protein, 14 aa, Mycobacterium tuberculosis
QRLEEQVTARAKHV

SEQ ID NO: 89231 - protein, 14 aa, Mycobacterium tuberculosis
RLEEQVTARAKHVR

SEQ ID NO: 89232 - protein, 14 aa, Mycobacterium tuberculosis
LEEQVTARAKHVRS

SEQ ID NO: 89233 - protein, 14 aa, Mycobacterium tuberculosis
EEQVTARAKHVRSE

SEQ ID NO: 89234 - protein, 14 aa, Mycobacterium tuberculosis
EQVTARAKHVRSEL

SEQ ID NO: 89235 - protein, 14 aa, Mycobacterium tuberculosis
QVTARAKHVRSELR

SEQ ID NO: 89236 - protein, 14 aa, Mycobacterium tuberculosis
VTARAKHVRSELRD

SEQ ID NO: 89237 - protein, 14 aa, Mycobacterium tuberculosis
TARAKHVRSELRDA

SEQ ID NO: 89238 - protein, 14 aa, Mycobacterium tuberculosis
ARAKHVRSELRDAV

SEQ ID NO: 89239 - protein, 14 aa, Mycobacterium tuberculosis
RAKHVRSELRDAVF

SEQ ID NO: 89240 - protein, 14 aa, Mycobacterium tuberculosis
AKHVRSELRDAVFD

SEQ ID NO: 89241 - protein, 14 aa, Mycobacterium tuberculosis
KHVRSELRDAVFDA

SEQ ID NO: 89242 - protein, 14 aa, Mycobacterium tuberculosis
HVRSELRDAVFDAP

SEQ ID NO: 89243 - protein, 14 aa, Mycobacterium tuberculosis
VRSELRDAVFDAPD

SEQ ID NO: 89244 - protein, 14 aa, Mycobacterium tuberculosis
RSELRDAVFDAPDF

SEQ ID NO: 89245 - protein, 14 aa, Mycobacterium tuberculosis
SELRDAVFDAPDFD

SEQ ID NO: 89246 - protein, 14 aa, Mycobacterium tuberculosis
ELRDAVFDAPDFDV

SEQ ID NO: 89247 - protein, 14 aa, Mycobacterium tuberculosis
LRDAVFDAPDFDVD

SEQ ID NO: 89248 - protein, 14 aa, Mycobacterium tuberculosis
RDAVFDAPDFDVDE

SEQ ID NO: 89249 - protein, 14 aa, Mycobacterium tuberculosis
DAVFDAPDFDVDEV

SEQ ID NO: 89250 - protein, 14 aa, Mycobacterium tuberculosis
AVFDAPDFDVDEVF

SEQ ID NO: 89251 - protein, 14 aa, Mycobacterium tuberculosis
VFDAPDFDVDEVFT

SEQ ID NO: 89252 - protein, 14 aa, Mycobacterium tuberculosis
FDAPDFDVDEVFTT

SEQ ID NO: 89253 - protein, 14 aa, Mycobacterium tuberculosis
DAPDFDVDEVFTTV

SEQ ID NO: 89254 - protein, 14 aa, Mycobacterium tuberculosis
APDFDVDEVFTTVY

SEQ ID NO: 89255 - protein, 14 aa, Mycobacterium tuberculosis
PDFDVDEVFTTVYA

SEQ ID NO: 89256 - protein, 14 aa, Mycobacterium tuberculosis
DFDVDEVFTTVYAE

SEQ ID NO: 89257 - protein, 14 aa, Mycobacterium tuberculosis
FDVDEVFTTVYAEI

SEQ ID NO: 89258 - protein, 14 aa, Mycobacterium tuberculosis
DVDEVFTTVYAEIT

SEQ ID NO: 89259 - protein, 14 aa, Mycobacterium tuberculosis
VDEVFTTVYAEITP

SEQ ID NO: 89260 - protein, 14 aa, Mycobacterium tuberculosis
DEVFTTVYAEITPG

SEQ ID NO: 89261 - protein, 14 aa, Mycobacterium tuberculosis
EVFTTVYAEITPGL

SEQ ID NO: 89262 - protein, 14 aa, Mycobacterium tuberculosis
VFTTVYAEITPGLQ

SEQ ID NO: 89263 - protein, 14 aa, Mycobacterium tuberculosis
FTTVYAEITPGLQA

SEQ ID NO: 89264 - protein, 14 aa, Mycobacterium tuberculosis
TTVYAEITPGLQAQ

SEQ ID NO: 89265 - protein, 14 aa, Mycobacterium tuberculosis
TVYAEITPGLQAQR

SEQ ID NO: 89266 - protein, 14 aa, Mycobacterium tuberculosis
VYAEITPGLQAQRE

SEQ ID NO: 89267 - protein, 14 aa, Mycobacterium tuberculosis
YAEITPGLQAQREQ

SEQ ID NO: 89268 - protein, 14 aa, Mycobacterium tuberculosis
AEITPGLQAQREQL

SEQ ID NO: 89269 - protein, 14 aa, Mycobacterium tuberculosis
EITPGLQAQREQLR

SEQ ID NO: 89270 - protein, 14 aa, Mycobacterium tuberculosis
ITPGLQAQREQLRA

SEQ ID NO: 89271 - protein, 14 aa, Mycobacterium tuberculosis
TPGLQAQREQLRAE

SEQ ID NO: 89272 - protein, 14 aa, Mycobacterium tuberculosis
PGLQAQREQLRAEL

SEQ ID NO: 89273 - protein, 14 aa, Mycobacterium tuberculosis
GLQAQREQLRAELA

SEQ ID NO: 89274 - protein, 14 aa, Mycobacterium tuberculosis
LQAQREQLRAELAR

SEQ ID NO: 89275 - protein, 14 aa, Mycobacterium tuberculosis
QAQREQLRAELART

SEQ ID NO: 89276 - protein, 14 aa, Mycobacterium tuberculosis
AQREQLRAELARTD

SEQ ID NO: 89277 - protein, 15 aa, Mycobacterium tuberculosis
MGEGSRRPSGMLMSV

SEQ ID NO: 89278 - protein, 15 aa, Mycobacterium tuberculosis
GEGSRRPSGMLMSVD

SEQ ID NO: 89279 - protein, 15 aa, Mycobacterium tuberculosis
EGSRRPSGMLMSVDL

SEQ ID NO: 89280 - protein, 15 aa, Mycobacterium tuberculosis
GSRRPSGMLMSVDLE

SEQ ID NO: 89281 - protein, 15 aa, Mycobacterium tuberculosis
SRRPSGMLMSVDLEP

SEQ ID NO: 89282 - protein, 15 aa, Mycobacterium tuberculosis
RRPSGMLMSVDLEPV

SEQ ID NO: 89283 - protein, 15 aa, Mycobacterium tuberculosis
RPSGMLMSVDLEPVQ

SEQ ID NO: 89284 - protein, 15 aa, Mycobacterium tuberculosis
PSGMLMSVDLEPVQL

SEQ ID NO: 89285 - protein, 15 aa, Mycobacterium tuberculosis
SGMLMSVDLEPVQLV

SEQ ID NO: 89286 - protein, 15 aa, Mycobacterium tuberculosis
GMLMSVDLEPVQLVG

SEQ ID NO: 89287 - protein, 15 aa, Mycobacterium tuberculosis
MLMSVDLEPVQLVGP

SEQ ID NO: 89288 - protein, 15 aa, Mycobacterium tuberculosis
LMSVDLEPVQLVGPD

SEQ ID NO: 89289 - protein, 15 aa, Mycobacterium tuberculosis
MSVDLEPVQLVGPDG

SEQ ID NO: 89290 - protein, 15 aa, Mycobacterium tuberculosis
SVDLEPVQLVGPDGT

SEQ ID NO: 89291 - protein, 15 aa, Mycobacterium tuberculosis
VDLEPVQLVGPDGTP

SEQ ID NO: 89292 - protein, 15 aa, Mycobacterium tuberculosis
DLEPVQLVGPDGTPT

SEQ ID NO: 89293 - protein, 15 aa, Mycobacterium tuberculosis
LEPVQLVGPDGTPTA

SEQ ID NO: 89294 - protein, 15 aa, Mycobacterium tuberculosis
EPVQLVGPDGTPTAE

SEQ ID NO: 89295 - protein, 15 aa, Mycobacterium tuberculosis
PVQLVGPDGTPTAER

SEQ ID NO: 89296 - protein, 15 aa, Mycobacterium tuberculosis
VQLVGPDGTPTAERR

SEQ ID NO: 89297 - protein, 15 aa, Mycobacterium tuberculosis
QLVGPDGTPTAERRY

SEQ ID NO: 89298 - protein, 15 aa, Mycobacterium tuberculosis
LVGPDGTPTAERRYH

SEQ ID NO: 89299 - protein, 15 aa, Mycobacterium tuberculosis
VGPDGTPTAERRYHR

SEQ ID NO: 89300 - protein, 15 aa, Mycobacterium tuberculosis
GPDGTPTAERRYHRD

SEQ ID NO: 89301 - protein, 15 aa, Mycobacterium tuberculosis
PDGTPTAERRYHRDL

SEQ ID NO: 89302 - protein, 15 aa, Mycobacterium tuberculosis
DGTPTAERRYHRDLP

SEQ ID NO: 89303 - protein, 15 aa, Mycobacterium tuberculosis
GTPTAERRYHRDLPE

SEQ ID NO: 89304 - protein, 15 aa, Mycobacterium tuberculosis
TPTAERRYHRDLPEE

SEQ ID NO: 89305 - protein, 15 aa, Mycobacterium tuberculosis
PTAERRYHRDLPEET

SEQ ID NO: 89306 - protein, 15 aa, Mycobacterium tuberculosis
TAERRYHRDLPEETL

SEQ ID NO: 89307 - protein, 15 aa, Mycobacterium tuberculosis
AERRYHRDLPEETLR

SEQ ID NO: 89308 - protein, 15 aa, Mycobacterium tuberculosis
ERRYHRDLPEETLRW

SEQ ID NO: 89309 - protein, 15 aa, Mycobacterium tuberculosis
RRYHRDLPEETLRWL

SEQ ID NO: 89310 - protein, 15 aa, Mycobacterium tuberculosis
RYHRDLPEETLRWLY

SEQ ID NO: 89311 - protein, 15 aa, Mycobacterium tuberculosis
YHRDLPEETLRWLYE

SEQ ID NO: 89312 - protein, 15 aa, Mycobacterium tuberculosis
HRDLPEETLRWLYEM

SEQ ID NO: 89313 - protein, 15 aa, Mycobacterium tuberculosis
RDLPEETLRWLYEMM

SEQ ID NO: 89314 - protein, 15 aa, Mycobacterium tuberculosis
DLPEETLRWLYEMMV

SEQ ID NO: 89315 - protein, 15 aa, Mycobacterium tuberculosis
LPEETLRWLYEMMVV

SEQ ID NO: 89316 - protein, 15 aa, Mycobacterium tuberculosis
PEETLRWLYEMMVVT

SEQ ID NO: 89317 - protein, 15 aa, Mycobacterium tuberculosis
EETLRWLYEMMVVTR

SEQ ID NO: 89318 - protein, 15 aa, Mycobacterium tuberculosis
ETLRWLYEMMVVTRE

SEQ ID NO: 89319 - protein, 15 aa, Mycobacterium tuberculosis
TLRWLYEMMVVTREL

SEQ ID NO: 89320 - protein, 15 aa, Mycobacterium tuberculosis
LRWLYEMMVVTRELD

SEQ ID NO: 89321 - protein, 15 aa, Mycobacterium tuberculosis
RWLYEMMVVTRELDT

SEQ ID NO: 89322 - protein, 15 aa, Mycobacterium tuberculosis
WLYEMMVVTRELDTE

SEQ ID NO: 89323 - protein, 15 aa, Mycobacterium tuberculosis
LYEMMVVTRELDTEF

SEQ ID NO: 89324 - protein, 15 aa, Mycobacterium tuberculosis
YEMMVVTRELDTEFV

SEQ ID NO: 89325 - protein, 15 aa, Mycobacterium tuberculosis
EMMVVTRELDTEFVN

SEQ ID NO: 89326 - protein, 15 aa, Mycobacterium tuberculosis
MMVVTRELDTEFVNL

SEQ ID NO: 89327 - protein, 15 aa, Mycobacterium tuberculosis
MVVTRELDTEFVNLQ

SEQ ID NO: 89328 - protein, 15 aa, Mycobacterium tuberculosis
VVTRELDTEFVNLQR

SEQ ID NO: 89329 - protein, 15 aa, Mycobacterium tuberculosis
VTRELDTEFVNLQRQ

SEQ ID NO: 89330 - protein, 15 aa, Mycobacterium tuberculosis
TRELDTEFVNLQRQG

SEQ ID NO: 89331 - protein, 15 aa, Mycobacterium tuberculosis
RELDTEFVNLQRQGE

SEQ ID NO: 89332 - protein, 15 aa, Mycobacterium tuberculosis
ELDTEFVNLQRQGEL

SEQ ID NO: 89333 - protein, 15 aa, Mycobacterium tuberculosis
LDTEFVNLQRQGELA

SEQ ID NO: 89334 - protein, 15 aa, Mycobacterium tuberculosis
DTEFVNLQRQGELAL

SEQ ID NO: 89335 - protein, 15 aa, Mycobacterium tuberculosis
TEFVNLQRQGELALY

SEQ ID NO: 89336 - protein, 15 aa, Mycobacterium tuberculosis
EFVNLQRQGELALYT

SEQ ID NO: 89337 - protein, 15 aa, Mycobacterium tuberculosis
FVNLQRQGELALYTP

SEQ ID NO: 89338 - protein, 15 aa, Mycobacterium tuberculosis
VNLQRQGELALYTPC

SEQ ID NO: 89339 - protein, 15 aa, Mycobacterium tuberculosis
NLQRQGELALYTPCR

SEQ ID NO: 89340 - protein, 15 aa, Mycobacterium tuberculosis
LQRQGELALYTPCRG

SEQ ID NO: 89341 - protein, 15 aa, Mycobacterium tuberculosis
QRQGELALYTPCRGQ

SEQ ID NO: 89342 - protein, 15 aa, Mycobacterium tuberculosis
RQGELALYTPCRGQE

SEQ ID NO: 89343 - protein, 15 aa, Mycobacterium tuberculosis
QGELALYTPCRGQEA

SEQ ID NO: 89344 - protein, 15 aa, Mycobacterium tuberculosis
GELALYTPCRGQEAA

SEQ ID NO: 89345 - protein, 15 aa, Mycobacterium tuberculosis
ELALYTPCRGQEAAQ

SEQ ID NO: 89346 - protein, 15 aa, Mycobacterium tuberculosis
LALYTPCRGQEAAQV

SEQ ID NO: 89347 - protein, 15 aa, Mycobacterium tuberculosis
ALYTPCRGQEAAQVG

SEQ ID NO: 89348 - protein, 15 aa, Mycobacterium tuberculosis
LYTPCRGQEAAQVGA

SEQ ID NO: 89349 - protein, 15 aa, Mycobacterium tuberculosis
YTPCRGQEAAQVGAA

SEQ ID NO: 89350 - protein, 15 aa, Mycobacterium tuberculosis
TPCRGQEAAQVGAAA

SEQ ID NO: 89351 - protein, 15 aa, Mycobacterium tuberculosis
PCRGQEAAQVGAAAC

SEQ ID NO: 89352 - protein, 15 aa, Mycobacterium tuberculosis
CRGQEAAQVGAAACL

SEQ ID NO: 89353 - protein, 15 aa, Mycobacterium tuberculosis
RGQEAAQVGAAACLR

SEQ ID NO: 89354 - protein, 15 aa, Mycobacterium tuberculosis
GQEAAQVGAAACLRK

SEQ ID NO: 89355 - protein, 15 aa, Mycobacterium tuberculosis
QEAAQVGAAACLRKT

SEQ ID NO: 89356 - protein, 15 aa, Mycobacterium tuberculosis
EAAQVGAAACLRKTD

SEQ ID NO: 89357 - protein, 15 aa, Mycobacterium tuberculosis
AAQVGAAACLRKTDW

SEQ ID NO: 89358 - protein, 15 aa, Mycobacterium tuberculosis
AQVGAAACLRKTDWL

SEQ ID NO: 89359 - protein, 15 aa, Mycobacterium tuberculosis
QVGAAACLRKTDWLF

SEQ ID NO: 89360 - protein, 15 aa, Mycobacterium tuberculosis
VGAAACLRKTDWLFP

SEQ ID NO: 89361 - protein, 15 aa, Mycobacterium tuberculosis
GAAACLRKTDWLFPQ

SEQ ID NO: 89362 - protein, 15 aa, Mycobacterium tuberculosis
AAACLRKTDWLFPQY

SEQ ID NO: 89363 - protein, 15 aa, Mycobacterium tuberculosis
AACLRKTDWLFPQYR

SEQ ID NO: 89364 - protein, 15 aa, Mycobacterium tuberculosis
ACLRKTDWLFPQYRE

SEQ ID NO: 89365 - protein, 15 aa, Mycobacterium tuberculosis
CLRKTDWLFPQYREL

SEQ ID NO: 89366 - protein, 15 aa, Mycobacterium tuberculosis
LRKTDWLFPQYRELG

SEQ ID NO: 89367 - protein, 15 aa, Mycobacterium tuberculosis
RKTDWLFPQYRELGV

SEQ ID NO: 89368 - protein, 15 aa, Mycobacterium tuberculosis
KTDWLFPQYRELGVY

SEQ ID NO: 89369 - protein, 15 aa, Mycobacterium tuberculosis
TDWLFPQYRELGVYL

SEQ ID NO: 89370 - protein, 15 aa, Mycobacterium tuberculosis
DWLFPQYRELGVYLV

SEQ ID NO: 89371 - protein, 15 aa, Mycobacterium tuberculosis
WLFPQYRELGVYLVR

SEQ ID NO: 89372 - protein, 15 aa, Mycobacterium tuberculosis
LFPQYRELGVYLVRG

SEQ ID NO: 89373 - protein, 15 aa, Mycobacterium tuberculosis
FPQYRELGVYLVRGI

SEQ ID NO: 89374 - protein, 15 aa, Mycobacterium tuberculosis
PQYRELGVYLVRGIP

SEQ ID NO: 89375 - protein, 15 aa, Mycobacterium tuberculosis
QYRELGVYLVRGIPP

SEQ ID NO: 89376 - protein, 15 aa, Mycobacterium tuberculosis
YRELGVYLVRGIPPG

SEQ ID NO: 89377 - protein, 15 aa, Mycobacterium tuberculosis
RELGVYLVRGIPPGH

SEQ ID NO: 89378 - protein, 15 aa, Mycobacterium tuberculosis
ELGVYLVRGIPPGHV

SEQ ID NO: 89379 - protein, 15 aa, Mycobacterium tuberculosis
LGVYLVRGIPPGHVG

SEQ ID NO: 89380 - protein, 15 aa, Mycobacterium tuberculosis
GVYLVRGIPPGHVGV

SEQ ID NO: 89381 - protein, 15 aa, Mycobacterium tuberculosis
VYLVRGIPPGHVGVA

SEQ ID NO: 89382 - protein, 15 aa, Mycobacterium tuberculosis
YLVRGIPPGHVGVAW

SEQ ID NO: 89383 - protein, 15 aa, Mycobacterium tuberculosis
LVRGIPPGHVGVAWR

SEQ ID NO: 89384 - protein, 15 aa, Mycobacterium tuberculosis
VRGIPPGHVGVAWRG

SEQ ID NO: 89385 - protein, 15 aa, Mycobacterium tuberculosis
RGIPPGHVGVAWRGT

SEQ ID NO: 89386 - protein, 15 aa, Mycobacterium tuberculosis
GIPPGHVGVAWRGTW

SEQ ID NO: 89387 - protein, 15 aa, Mycobacterium tuberculosis
IPPGHVGVAWRGTWH

SEQ ID NO: 89388 - protein, 15 aa, Mycobacterium tuberculosis
PPGHVGVAWRGTWHG

SEQ ID NO: 89389 - protein, 15 aa, Mycobacterium tuberculosis
PGHVGVAWRGTWHGG

SEQ ID NO: 89390 - protein, 15 aa, Mycobacterium tuberculosis
GHVGVAWRGTWHGGL

SEQ ID NO: 89391 - protein, 15 aa, Mycobacterium tuberculosis
HVGVAWRGTWHGGLQ

SEQ ID NO: 89392 - protein, 15 aa, Mycobacterium tuberculosis
VGVAWRGTWHGGLQF

SEQ ID NO: 89393 - protein, 15 aa, Mycobacterium tuberculosis
GVAWRGTWHGGLQFT

SEQ ID NO: 89394 - protein, 15 aa, Mycobacterium tuberculosis
VAWRGTWHGGLQFTT

SEQ ID NO: 89395 - protein, 15 aa, Mycobacterium tuberculosis
AWRGTWHGGLQFTTK

SEQ ID NO: 89396 - protein, 15 aa, Mycobacterium tuberculosis
WRGTWHGGLQFTTKC

SEQ ID NO: 89397 - protein, 15 aa, Mycobacterium tuberculosis
RGTWHGGLQFTTKCC

SEQ ID NO: 89398 - protein, 15 aa, Mycobacterium tuberculosis
GTWHGGLQFTTKCCA

SEQ ID NO: 89399 - protein, 15 aa, Mycobacterium tuberculosis
TWHGGLQFTTKCCAP

SEQ ID NO: 89400 - protein, 15 aa, Mycobacterium tuberculosis
WHGGLQFTTKCCAPM

SEQ ID NO: 89401 - protein, 15 aa, Mycobacterium tuberculosis
HGGLQFTTKCCAPMS

SEQ ID NO: 89402 - protein, 15 aa, Mycobacterium tuberculosis
GGLQFTTKCCAPMSV

SEQ ID NO: 89403 - protein, 15 aa, Mycobacterium tuberculosis
GLQFTTKCCAPMSVP

SEQ ID NO: 89404 - protein, 15 aa, Mycobacterium tuberculosis
LQFTTKCCAPMSVPI

SEQ ID NO: 89405 - protein, 15 aa, Mycobacterium tuberculosis
QFTTKCCAPMSVPIG

SEQ ID NO: 89406 - protein, 15 aa, Mycobacterium tuberculosis
FTTKCCAPMSVPIGT

SEQ ID NO: 89407 - protein, 15 aa, Mycobacterium tuberculosis
TTKCCAPMSVPIGTQ

SEQ ID NO: 89408 - protein, 15 aa, Mycobacterium tuberculosis
TKCCAPMSVPIGTQT

SEQ ID NO: 89409 - protein, 15 aa, Mycobacterium tuberculosis
KCCAPMSVPIGTQTL

SEQ ID NO: 89410 - protein, 15 aa, Mycobacterium tuberculosis
CCAPMSVPIGTQTLH

SEQ ID NO: 89411 - protein, 15 aa, Mycobacterium tuberculosis
CAPMSVPIGTQTLHA

SEQ ID NO: 89412 - protein, 15 aa, Mycobacterium tuberculosis
APMSVPIGTQTLHAV

SEQ ID NO: 89413 - protein, 15 aa, Mycobacterium tuberculosis
PMSVPIGTQTLHAVG

SEQ ID NO: 89414 - protein, 15 aa, Mycobacterium tuberculosis
MSVPIGTQTLHAVGA

SEQ ID NO: 89415 - protein, 15 aa, Mycobacterium tuberculosis
SVPIGTQTLHAVGAA

SEQ ID NO: 89416 - protein, 15 aa, Mycobacterium tuberculosis
VPIGTQTLHAVGAAM

SEQ ID NO: 89417 - protein, 15 aa, Mycobacterium tuberculosis
PIGTQTLHAVGAAMA

SEQ ID NO: 89418 - protein, 15 aa, Mycobacterium tuberculosis
IGTQTLHAVGAAMAA

SEQ ID NO: 89419 - protein, 15 aa, Mycobacterium tuberculosis
GTQTLHAVGAAMAAQ

SEQ ID NO: 89420 - protein, 15 aa, Mycobacterium tuberculosis
TQTLHAVGAAMAAQR

SEQ ID NO: 89421 - protein, 15 aa, Mycobacterium tuberculosis
QTLHAVGAAMAAQRL

SEQ ID NO: 89422 - protein, 15 aa, Mycobacterium tuberculosis
TLHAVGAAMAAQRLD

SEQ ID NO: 89423 - protein, 15 aa, Mycobacterium tuberculosis
LHAVGAAMAAQRLDE

SEQ ID NO: 89424 - protein, 15 aa, Mycobacterium tuberculosis
HAVGAAMAAQRLDED

SEQ ID NO: 89425 - protein, 15 aa, Mycobacterium tuberculosis
AVGAAMAAQRLDEDS

SEQ ID NO: 89426 - protein, 15 aa, Mycobacterium tuberculosis
VGAAMAAQRLDEDSV

SEQ ID NO: 89427 - protein, 15 aa, Mycobacterium tuberculosis
GAAMAAQRLDEDSVT

SEQ ID NO: 89428 - protein, 15 aa, Mycobacterium tuberculosis
AAMAAQRLDEDSVTV

SEQ ID NO: 89429 - protein, 15 aa, Mycobacterium tuberculosis
AMAAQRLDEDSVTVA

SEQ ID NO: 89430 - protein, 15 aa, Mycobacterium tuberculosis
MAAQRLDEDSVTVAF

SEQ ID NO: 89431 - protein, 15 aa, Mycobacterium tuberculosis
AAQRLDEDSVTVAFL

SEQ ID NO: 89432 - protein, 15 aa, Mycobacterium tuberculosis
AQRLDEDSVTVAFLG

SEQ ID NO: 89433 - protein, 15 aa, Mycobacterium tuberculosis
QRLDEDSVTVAFLGD

SEQ ID NO: 89434 - protein, 15 aa, Mycobacterium tuberculosis
RLDEDSVTVAFLGDG

SEQ ID NO: 89435 - protein, 15 aa, Mycobacterium tuberculosis
LDEDSVTVAFLGDGA

SEQ ID NO: 89436 - protein, 15 aa, Mycobacterium tuberculosis
DEDSVTVAFLGDGAT

SEQ ID NO: 89437 - protein, 15 aa, Mycobacterium tuberculosis
EDSVTVAFLGDGATS

SEQ ID NO: 89438 - protein, 15 aa, Mycobacterium tuberculosis
DSVTVAFLGDGATSE

SEQ ID NO: 89439 - protein, 15 aa, Mycobacterium tuberculosis
SVTVAFLGDGATSEG

SEQ ID NO: 89440 - protein, 15 aa, Mycobacterium tuberculosis
VTVAFLGDGATSEGD

SEQ ID NO: 89441 - protein, 15 aa, Mycobacterium tuberculosis
TVAFLGDGATSEGDV

SEQ ID NO: 89442 - protein, 15 aa, Mycobacterium tuberculosis
VAFLGDGATSEGDVH

SEQ ID NO: 89443 - protein, 15 aa, Mycobacterium tuberculosis
AFLGDGATSEGDVHE

SEQ ID NO: 89444 - protein, 15 aa, Mycobacterium tuberculosis
FLGDGATSEGDVHEA

SEQ ID NO: 89445 - protein, 15 aa, Mycobacterium tuberculosis
LGDGATSEGDVHEAL

SEQ ID NO: 89446 - protein, 15 aa, Mycobacterium tuberculosis
GDGATSEGDVHEALN

SEQ ID NO: 89447 - protein, 15 aa, Mycobacterium tuberculosis
DGATSEGDVHEALNF

SEQ ID NO: 89448 - protein, 15 aa, Mycobacterium tuberculosis
GATSEGDVHEALNFA

SEQ ID NO: 89449 - protein, 15 aa, Mycobacterium tuberculosis
ATSEGDVHEALNFAA

SEQ ID NO: 89450 - protein, 15 aa, Mycobacterium tuberculosis
TSEGDVHEALNFAAV

SEQ ID NO: 89451 - protein, 15 aa, Mycobacterium tuberculosis
SEGDVHEALNFAAVF

SEQ ID NO: 89452 - protein, 15 aa, Mycobacterium tuberculosis
EGDVHEALNFAAVFT

SEQ ID NO: 89453 - protein, 15 aa, Mycobacterium tuberculosis
GDVHEALNFAAVFTT

SEQ ID NO: 89454 - protein, 15 aa, Mycobacterium tuberculosis
DVHEALNFAAVFTTP

SEQ ID NO: 89455 - protein, 15 aa, Mycobacterium tuberculosis
VHEALNFAAVFTTPC

SEQ ID NO: 89456 - protein, 15 aa, Mycobacterium tuberculosis
HEALNFAAVFTTPCV

SEQ ID NO: 89457 - protein, 15 aa, Mycobacterium tuberculosis
EALNFAAVFTTPCVF

SEQ ID NO: 89458 - protein, 15 aa, Mycobacterium tuberculosis
ALNFAAVFTTPCVFY

SEQ ID NO: 89459 - protein, 15 aa, Mycobacterium tuberculosis
LNFAAVFTTPCVFYV

SEQ ID NO: 89460 - protein, 15 aa, Mycobacterium tuberculosis
NFAAVFTTPCVFYVQ

SEQ ID NO: 89461 - protein, 15 aa, Mycobacterium tuberculosis
FAAVFTTPCVFYVQN

SEQ ID NO: 89462 - protein, 15 aa, Mycobacterium tuberculosis
AAVFTTPCVFYVQNN

SEQ ID NO: 89463 - protein, 15 aa, Mycobacterium tuberculosis
AVFTTPCVFYVQNNQ

SEQ ID NO: 89464 - protein, 15 aa, Mycobacterium tuberculosis
VFTTPCVFYVQNNQW

SEQ ID NO: 89465 - protein, 15 aa, Mycobacterium tuberculosis
FTTPCVFYVQNNQWA

SEQ ID NO: 89466 - protein, 15 aa, Mycobacterium tuberculosis
TTPCVFYVQNNQWAI

SEQ ID NO: 89467 - protein, 15 aa, Mycobacterium tuberculosis
TPCVFYVQNNQWAIS

SEQ ID NO: 89468 - protein, 15 aa, Mycobacterium tuberculosis
PCVFYVQNNQWAISM

SEQ ID NO: 89469 - protein, 15 aa, Mycobacterium tuberculosis
CVFYVQNNQWAISMP

SEQ ID NO: 89470 - protein, 15 aa, Mycobacterium tuberculosis
VFYVQNNQWAISMPV

SEQ ID NO: 89471 - protein, 15 aa, Mycobacterium tuberculosis
FYVQNNQWAISMPVS

SEQ ID NO: 89472 - protein, 15 aa, Mycobacterium tuberculosis
YVQNNQWAISMPVSR

SEQ ID NO: 89473 - protein, 15 aa, Mycobacterium tuberculosis
VQNNQWAISMPVSRQ

SEQ ID NO: 89474 - protein, 15 aa, Mycobacterium tuberculosis
QNNQWAISMPVSRQT

SEQ ID NO: 89475 - protein, 15 aa, Mycobacterium tuberculosis
NNQWAISMPVSRQTA

SEQ ID NO: 89476 - protein, 15 aa, Mycobacterium tuberculosis
NQWAISMPVSRQTAA

SEQ ID NO: 89477 - protein, 15 aa, Mycobacterium tuberculosis
QWAISMPVSRQTAAP

SEQ ID NO: 89478 - protein, 15 aa, Mycobacterium tuberculosis
WAISMPVSRQTAAPS

SEQ ID NO: 89479 - protein, 15 aa, Mycobacterium tuberculosis
AISMPVSRQTAAPSI

SEQ ID NO: 89480 - protein, 15 aa, Mycobacterium tuberculosis
ISMPVSRQTAAPSIA

SEQ ID NO: 89481 - protein, 15 aa, Mycobacterium tuberculosis
SMPVSRQTAAPSIAH

SEQ ID NO: 89482 - protein, 15 aa, Mycobacterium tuberculosis
MPVSRQTAAPSIAHK

SEQ ID NO: 89483 - protein, 15 aa, Mycobacterium tuberculosis
PVSRQTAAPSIAHKA

SEQ ID NO: 89484 - protein, 15 aa, Mycobacterium tuberculosis
VSRQTAAPSIAHKAI

SEQ ID NO: 89485 - protein, 15 aa, Mycobacterium tuberculosis
SRQTAAPSIAHKAIG

SEQ ID NO: 89486 - protein, 15 aa, Mycobacterium tuberculosis
RQTAAPSIAHKAIGY

SEQ ID NO: 89487 - protein, 15 aa, Mycobacterium tuberculosis
QTAAPSIAHKAIGYG

SEQ ID NO: 89488 - protein, 15 aa, Mycobacterium tuberculosis
TAAPSIAHKAIGYGM

SEQ ID NO: 89489 - protein, 15 aa, Mycobacterium tuberculosis
AAPSIAHKAIGYGMP

SEQ ID NO: 89490 - protein, 15 aa, Mycobacterium tuberculosis
APSIAHKAIGYGMPG

SEQ ID NO: 89491 - protein, 15 aa, Mycobacterium tuberculosis
PSIAHKAIGYGMPGI

SEQ ID NO: 89492 - protein, 15 aa, Mycobacterium tuberculosis
SIAHKAIGYGMPGIR

SEQ ID NO: 89493 - protein, 15 aa, Mycobacterium tuberculosis
IAHKAIGYGMPGIRV

SEQ ID NO: 89494 - protein, 15 aa, Mycobacterium tuberculosis
AHKAIGYGMPGIRVD

SEQ ID NO: 89495 - protein, 15 aa, Mycobacterium tuberculosis
HKAIGYGMPGIRVDG

SEQ ID NO: 89496 - protein, 15 aa, Mycobacterium tuberculosis
KAIGYGMPGIRVDGN

SEQ ID NO: 89497 - protein, 15 aa, Mycobacterium tuberculosis
AIGYGMPGIRVDGND

SEQ ID NO: 89498 - protein, 15 aa, Mycobacterium tuberculosis
IGYGMPGIRVDGNDV

SEQ ID NO: 89499 - protein, 15 aa, Mycobacterium tuberculosis
GYGMPGIRVDGNDVL

SEQ ID NO: 89500 - protein, 15 aa, Mycobacterium tuberculosis
YGMPGIRVDGNDVLA

SEQ ID NO: 89501 - protein, 15 aa, Mycobacterium tuberculosis
GMPGIRVDGNDVLAC

SEQ ID NO: 89502 - protein, 15 aa, Mycobacterium tuberculosis
MPGIRVDGNDVLACY

SEQ ID NO: 89503 - protein, 15 aa, Mycobacterium tuberculosis
PGIRVDGNDVLACYA

SEQ ID NO: 89504 - protein, 15 aa, Mycobacterium tuberculosis
GIRVDGNDVLACYAV

SEQ ID NO: 89505 - protein, 15 aa, Mycobacterium tuberculosis
IRVDGNDVLACYAVM

SEQ ID NO: 89506 - protein, 15 aa, Mycobacterium tuberculosis
RVDGNDVLACYAVMA

SEQ ID NO: 89507 - protein, 15 aa, Mycobacterium tuberculosis
VDGNDVLACYAVMAE

SEQ ID NO: 89508 - protein, 15 aa, Mycobacterium tuberculosis
DGNDVLACYAVMAEA

SEQ ID NO: 89509 - protein, 15 aa, Mycobacterium tuberculosis
GNDVLACYAVMAEAA

SEQ ID NO: 89510 - protein, 15 aa, Mycobacterium tuberculosis
NDVLACYAVMAEAAA

SEQ ID NO: 89511 - protein, 15 aa, Mycobacterium tuberculosis
DVLACYAVMAEAAAR

SEQ ID NO: 89512 - protein, 15 aa, Mycobacterium tuberculosis
VLACYAVMAEAAARA

SEQ ID NO: 89513 - protein, 15 aa, Mycobacterium tuberculosis
LACYAVMAEAAARAR

SEQ ID NO: 89514 - protein, 15 aa, Mycobacterium tuberculosis
ACYAVMAEAAARARA

SEQ ID NO: 89515 - protein, 15 aa, Mycobacterium tuberculosis
CYAVMAEAAARARAG

SEQ ID NO: 89516 - protein, 15 aa, Mycobacterium tuberculosis
YAVMAEAAARARAGD

SEQ ID NO: 89517 - protein, 15 aa, Mycobacterium tuberculosis
AVMAEAAARARAGDG

SEQ ID NO: 89518 - protein, 15 aa, Mycobacterium tuberculosis
VMAEAAARARAGDGP

SEQ ID NO: 89519 - protein, 15 aa, Mycobacterium tuberculosis
MAEAAARARAGDGPT

SEQ ID NO: 89520 - protein, 15 aa, Mycobacterium tuberculosis
AEAAARARAGDGPTL

SEQ ID NO: 89521 - protein, 15 aa, Mycobacterium tuberculosis
EAAARARAGDGPTLI

SEQ ID NO: 89522 - protein, 15 aa, Mycobacterium tuberculosis
AAARARAGDGPTLIE

SEQ ID NO: 89523 - protein, 15 aa, Mycobacterium tuberculosis
AARARAGDGPTLIEA

SEQ ID NO: 89524 - protein, 15 aa, Mycobacterium tuberculosis
ARARAGDGPTLIEAV

SEQ ID NO: 89525 - protein, 15 aa, Mycobacterium tuberculosis
RARAGDGPTLIEAVT

SEQ ID NO: 89526 - protein, 15 aa, Mycobacterium tuberculosis
ARAGDGPTLIEAVTY

SEQ ID NO: 89527 - protein, 15 aa, Mycobacterium tuberculosis
RAGDGPTLIEAVTYR

SEQ ID NO: 89528 - protein, 15 aa, Mycobacterium tuberculosis
AGDGPTLIEAVTYRL

SEQ ID NO: 89529 - protein, 15 aa, Mycobacterium tuberculosis
GDGPTLIEAVTYRLG

SEQ ID NO: 89530 - protein, 15 aa, Mycobacterium tuberculosis
DGPTLIEAVTYRLGP

SEQ ID NO: 89531 - protein, 15 aa, Mycobacterium tuberculosis
GPTLIEAVTYRLGPH

SEQ ID NO: 89532 - protein, 15 aa, Mycobacterium tuberculosis
PTLIEAVTYRLGPHT

SEQ ID NO: 89533 - protein, 15 aa, Mycobacterium tuberculosis
TLIEAVTYRLGPHTT

SEQ ID NO: 89534 - protein, 15 aa, Mycobacterium tuberculosis
LIEAVTYRLGPHTTA

SEQ ID NO: 89535 - protein, 15 aa, Mycobacterium tuberculosis
IEAVTYRLGPHTTAD

SEQ ID NO: 89536 - protein, 15 aa, Mycobacterium tuberculosis
EAVTYRLGPHTTADD

SEQ ID NO: 89537 - protein, 15 aa, Mycobacterium tuberculosis
AVTYRLGPHTTADDP

SEQ ID NO: 89538 - protein, 15 aa, Mycobacterium tuberculosis
VTYRLGPHTTADDPT

SEQ ID NO: 89539 - protein, 15 aa, Mycobacterium tuberculosis
TYRLGPHTTADDPTR

SEQ ID NO: 89540 - protein, 15 aa, Mycobacterium tuberculosis
YRLGPHTTADDPTRY

SEQ ID NO: 89541 - protein, 15 aa, Mycobacterium tuberculosis
RLGPHTTADDPTRYR

SEQ ID NO: 89542 - protein, 15 aa, Mycobacterium tuberculosis
LGPHTTADDPTRYRS

SEQ ID NO: 89543 - protein, 15 aa, Mycobacterium tuberculosis
GPHTTADDPTRYRSQ

SEQ ID NO: 89544 - protein, 15 aa, Mycobacterium tuberculosis
PHTTADDPTRYRSQE

SEQ ID NO: 89545 - protein, 15 aa, Mycobacterium tuberculosis
HTTADDPTRYRSQEE

SEQ ID NO: 89546 - protein, 15 aa, Mycobacterium tuberculosis
TTADDPTRYRSQEEV

SEQ ID NO: 89547 - protein, 15 aa, Mycobacterium tuberculosis
TADDPTRYRSQEEVD

SEQ ID NO: 89548 - protein, 15 aa, Mycobacterium tuberculosis
ADDPTRYRSQEEVDR

SEQ ID NO: 89549 - protein, 15 aa, Mycobacterium tuberculosis
DDPTRYRSQEEVDRW

SEQ ID NO: 89550 - protein, 15 aa, Mycobacterium tuberculosis
DPTRYRSQEEVDRWA

SEQ ID NO: 89551 - protein, 15 aa, Mycobacterium tuberculosis
PTRYRSQEEVDRWAT

SEQ ID NO: 89552 - protein, 15 aa, Mycobacterium tuberculosis
TRYRSQEEVDRWATL

SEQ ID NO: 89553 - protein, 15 aa, Mycobacterium tuberculosis
RYRSQEEVDRWATLD

SEQ ID NO: 89554 - protein, 15 aa, Mycobacterium tuberculosis
YRSQEEVDRWATLDP

SEQ ID NO: 89555 - protein, 15 aa, Mycobacterium tuberculosis
RSQEEVDRWATLDPI

SEQ ID NO: 89556 - protein, 15 aa, Mycobacterium tuberculosis
SQEEVDRWATLDPIP

SEQ ID NO: 89557 - protein, 15 aa, Mycobacterium tuberculosis
QEEVDRWATLDPIPR

SEQ ID NO: 89558 - protein, 15 aa, Mycobacterium tuberculosis
EEVDRWATLDPIPRY

SEQ ID NO: 89559 - protein, 15 aa, Mycobacterium tuberculosis
EVDRWATLDPIPRYR

SEQ ID NO: 89560 - protein, 15 aa, Mycobacterium tuberculosis
VDRWATLDPIPRYRT

SEQ ID NO: 89561 - protein, 15 aa, Mycobacterium tuberculosis
DRWATLDPIPRYRTY

SEQ ID NO: 89562 - protein, 15 aa, Mycobacterium tuberculosis
RWATLDPIPRYRTYL

SEQ ID NO: 89563 - protein, 15 aa, Mycobacterium tuberculosis
WATLDPIPRYRTYLQ

SEQ ID NO: 89564 - protein, 15 aa, Mycobacterium tuberculosis
ATLDPIPRYRTYLQD

SEQ ID NO: 89565 - protein, 15 aa, Mycobacterium tuberculosis
TLDPIPRYRTYLQDQ

SEQ ID NO: 89566 - protein, 15 aa, Mycobacterium tuberculosis
LDPIPRYRTYLQDQG

SEQ ID NO: 89567 - protein, 15 aa, Mycobacterium tuberculosis
DPIPRYRTYLQDQGL

SEQ ID NO: 89568 - protein, 15 aa, Mycobacterium tuberculosis
PIPRYRTYLQDQGLW

SEQ ID NO: 89569 - protein, 15 aa, Mycobacterium tuberculosis
IPRYRTYLQDQGLWS

SEQ ID NO: 89570 - protein, 15 aa, Mycobacterium tuberculosis
PRYRTYLQDQGLWSQ

SEQ ID NO: 89571 - protein, 15 aa, Mycobacterium tuberculosis
RYRTYLQDQGLWSQR

SEQ ID NO: 89572 - protein, 15 aa, Mycobacterium tuberculosis
YRTYLQDQGLWSQRL

SEQ ID NO: 89573 - protein, 15 aa, Mycobacterium tuberculosis
RTYLQDQGLWSQRLE

SEQ ID NO: 89574 - protein, 15 aa, Mycobacterium tuberculosis
TYLQDQGLWSQRLEE

SEQ ID NO: 89575 - protein, 15 aa, Mycobacterium tuberculosis
YLQDQGLWSQRLEEQ

SEQ ID NO: 89576 - protein, 15 aa, Mycobacterium tuberculosis
LQDQGLWSQRLEEQV

SEQ ID NO: 89577 - protein, 15 aa, Mycobacterium tuberculosis
QDQGLWSQRLEEQVT

SEQ ID NO: 89578 - protein, 15 aa, Mycobacterium tuberculosis
DQGLWSQRLEEQVTA

SEQ ID NO: 89579 - protein, 15 aa, Mycobacterium tuberculosis
QGLWSQRLEEQVTAR

SEQ ID NO: 89580 - protein, 15 aa, Mycobacterium tuberculosis
GLWSQRLEEQVTARA

SEQ ID NO: 89581 - protein, 15 aa, Mycobacterium tuberculosis
LWSQRLEEQVTARAK

SEQ ID NO: 89582 - protein, 15 aa, Mycobacterium tuberculosis
WSQRLEEQVTARAKH

SEQ ID NO: 89583 - protein, 15 aa, Mycobacterium tuberculosis
SQRLEEQVTARAKHV

SEQ ID NO: 89584 - protein, 15 aa, Mycobacterium tuberculosis
QRLEEQVTARAKHVR

SEQ ID NO: 89585 - protein, 15 aa, Mycobacterium tuberculosis
RLEEQVTARAKHVRS

SEQ ID NO: 89586 - protein, 15 aa, Mycobacterium tuberculosis
LEEQVTARAKHVRSE

SEQ ID NO: 89587 - protein, 15 aa, Mycobacterium tuberculosis
EEQVTARAKHVRSEL

SEQ ID NO: 89588 - protein, 15 aa, Mycobacterium tuberculosis
EQVTARAKHVRSELR

SEQ ID NO: 89589 - protein, 15 aa, Mycobacterium tuberculosis
QVTARAKHVRSELRD

SEQ ID NO: 89590 - protein, 15 aa, Mycobacterium tuberculosis
VTARAKHVRSELRDA

SEQ ID NO: 89591 - protein, 15 aa, Mycobacterium tuberculosis
TARAKHVRSELRDAV

SEQ ID NO: 89592 - protein, 15 aa, Mycobacterium tuberculosis
ARAKHVRSELRDAVF

SEQ ID NO: 89593 - protein, 15 aa, Mycobacterium tuberculosis
RAKHVRSELRDAVFD

SEQ ID NO: 89594 - protein, 15 aa, Mycobacterium tuberculosis
AKHVRSELRDAVFDA

SEQ ID NO: 89595 - protein, 15 aa, Mycobacterium tuberculosis
KHVRSELRDAVFDAP

SEQ ID NO: 89596 - protein, 15 aa, Mycobacterium tuberculosis
HVRSELRDAVFDAPD

SEQ ID NO: 89597 - protein, 15 aa, Mycobacterium tuberculosis
VRSELRDAVFDAPDF

SEQ ID NO: 89598 - protein, 15 aa, Mycobacterium tuberculosis
RSELRDAVFDAPDFD

SEQ ID NO: 89599 - protein, 15 aa, Mycobacterium tuberculosis
SELRDAVFDAPDFDV

SEQ ID NO: 89600 - protein, 15 aa, Mycobacterium tuberculosis
ELRDAVFDAPDFDVD

SEQ ID NO: 89601 - protein, 15 aa, Mycobacterium tuberculosis
LRDAVFDAPDFDVDE

SEQ ID NO: 89602 - protein, 15 aa, Mycobacterium tuberculosis
RDAVFDAPDFDVDEV

SEQ ID NO: 89603 - protein, 15 aa, Mycobacterium tuberculosis
DAVFDAPDFDVDEVF

SEQ ID NO: 89604 - protein, 15 aa, Mycobacterium tuberculosis
AVFDAPDFDVDEVFT

SEQ ID NO: 89605 - protein, 15 aa, Mycobacterium tuberculosis
VFDAPDFDVDEVFTT

SEQ ID NO: 89606 - protein, 15 aa, Mycobacterium tuberculosis
FDAPDFDVDEVFTTV

SEQ ID NO: 89607 - protein, 15 aa, Mycobacterium tuberculosis
DAPDFDVDEVFTTVY

SEQ ID NO: 89608 - protein, 15 aa, Mycobacterium tuberculosis
APDFDVDEVFTTVYA

SEQ ID NO: 89609 - protein, 15 aa, Mycobacterium tuberculosis
PDFDVDEVFTTVYAE

SEQ ID NO: 89610 - protein, 15 aa, Mycobacterium tuberculosis
DFDVDEVFTTVYAEI

SEQ ID NO: 89611 - protein, 15 aa, Mycobacterium tuberculosis
FDVDEVFTTVYAEIT

SEQ ID NO: 89612 - protein, 15 aa, Mycobacterium tuberculosis
DVDEVFTTVYAEITP

SEQ ID NO: 89613 - protein, 15 aa, Mycobacterium tuberculosis
VDEVFTTVYAEITPG

SEQ ID NO: 89614 - protein, 15 aa, Mycobacterium tuberculosis
DEVFTTVYAEITPGL

SEQ ID NO: 89615 - protein, 15 aa, Mycobacterium tuberculosis
EVFTTVYAEITPGLQ

SEQ ID NO: 89616 - protein, 15 aa, Mycobacterium tuberculosis
VFTTVYAEITPGLQA

SEQ ID NO: 89617 - protein, 15 aa, Mycobacterium tuberculosis
FTTVYAEITPGLQAQ

SEQ ID NO: 89618 - protein, 15 aa, Mycobacterium tuberculosis
TTVYAEITPGLQAQR

SEQ ID NO: 89619 - protein, 15 aa, Mycobacterium tuberculosis
TVYAEITPGLQAQRE

SEQ ID NO: 89620 - protein, 15 aa, Mycobacterium tuberculosis
VYAEITPGLQAQREQ

SEQ ID NO: 89621 - protein, 15 aa, Mycobacterium tuberculosis
YAEITPGLQAQREQL

SEQ ID NO: 89622 - protein, 15 aa, Mycobacterium tuberculosis
AEITPGLQAQREQLR

SEQ ID NO: 89623 - protein, 15 aa, Mycobacterium tuberculosis
EITPGLQAQREQLRA

SEQ ID NO: 89624 - protein, 15 aa, Mycobacterium tuberculosis
ITPGLQAQREQLRAE

SEQ ID NO: 89625 - protein, 15 aa, Mycobacterium tuberculosis
TPGLQAQREQLRAEL

SEQ ID NO: 89626 - protein, 15 aa, Mycobacterium tuberculosis
PGLQAQREQLRAELA

SEQ ID NO: 89627 - protein, 15 aa, Mycobacterium tuberculosis
GLQAQREQLRAELAR

SEQ ID NO: 89628 - protein, 15 aa, Mycobacterium tuberculosis
LQAQREQLRAELART

SEQ ID NO: 89629 - protein, 15 aa, Mycobacterium tuberculosis
QAQREQLRAELARTD

SEQ ID NO: 89630 - protein, 16 aa, Mycobacterium tuberculosis
MGEGSRRPSGMLMSVD

SEQ ID NO: 89631 - protein, 16 aa, Mycobacterium tuberculosis
GEGSRRPSGMLMSVDL

SEQ ID NO: 89632 - protein, 16 aa, Mycobacterium tuberculosis
EGSRRPSGMLMSVDLE

SEQ ID NO: 89633 - protein, 16 aa, Mycobacterium tuberculosis
GSRRPSGMLMSVDLEP

SEQ ID NO: 89634 - protein, 16 aa, Mycobacterium tuberculosis
SRRPSGMLMSVDLEPV

SEQ ID NO: 89635 - protein, 16 aa, Mycobacterium tuberculosis
RRPSGMLMSVDLEPVQ

SEQ ID NO: 89636 - protein, 16 aa, Mycobacterium tuberculosis
RPSGMLMSVDLEPVQL

SEQ ID NO: 89637 - protein, 16 aa, Mycobacterium tuberculosis
PSGMLMSVDLEPVQLV

SEQ ID NO: 89638 - protein, 16 aa, Mycobacterium tuberculosis
SGMLMSVDLEPVQLVG

SEQ ID NO: 89639 - protein, 16 aa, Mycobacterium tuberculosis
GMLMSVDLEPVQLVGP

SEQ ID NO: 89640 - protein, 16 aa, Mycobacterium tuberculosis
MLMSVDLEPVQLVGPD

SEQ ID NO: 89641 - protein, 16 aa, Mycobacterium tuberculosis
LMSVDLEPVQLVGPDG

SEQ ID NO: 89642 - protein, 16 aa, Mycobacterium tuberculosis
MSVDLEPVQLVGPDGT

SEQ ID NO: 89643 - protein, 16 aa, Mycobacterium tuberculosis
SVDLEPVQLVGPDGTP

SEQ ID NO: 89644 - protein, 16 aa, Mycobacterium tuberculosis
VDLEPVQLVGPDGTPT

SEQ ID NO: 89645 - protein, 16 aa, Mycobacterium tuberculosis
DLEPVQLVGPDGTPTA

SEQ ID NO: 89646 - protein, 16 aa, Mycobacterium tuberculosis
LEPVQLVGPDGTPTAE

SEQ ID NO: 89647 - protein, 16 aa, Mycobacterium tuberculosis
EPVQLVGPDGTPTAER

SEQ ID NO: 89648 - protein, 16 aa, Mycobacterium tuberculosis
PVQLVGPDGTPTAERR

SEQ ID NO: 89649 - protein, 16 aa, Mycobacterium tuberculosis
VQLVGPDGTPTAERRY

SEQ ID NO: 89650 - protein, 16 aa, Mycobacterium tuberculosis
QLVGPDGTPTAERRYH

SEQ ID NO: 89651 - protein, 16 aa, Mycobacterium tuberculosis
LVGPDGTPTAERRYHR

SEQ ID NO: 89652 - protein, 16 aa, Mycobacterium tuberculosis
VGPDGTPTAERRYHRD

SEQ ID NO: 89653 - protein, 16 aa, Mycobacterium tuberculosis
GPDGTPTAERRYHRDL

SEQ ID NO: 89654 - protein, 16 aa, Mycobacterium tuberculosis
PDGTPTAERRYHRDLP

SEQ ID NO: 89655 - protein, 16 aa, Mycobacterium tuberculosis
DGTPTAERRYHRDLPE

SEQ ID NO: 89656 - protein, 16 aa, Mycobacterium tuberculosis
GTPTAERRYHRDLPEE

SEQ ID NO: 89657 - protein, 16 aa, Mycobacterium tuberculosis
TPTAERRYHRDLPEET

SEQ ID NO: 89658 - protein, 16 aa, Mycobacterium tuberculosis
PTAERRYHRDLPEETL

SEQ ID NO: 89659 - protein, 16 aa, Mycobacterium tuberculosis
TAERRYHRDLPEETLR

SEQ ID NO: 89660 - protein, 16 aa, Mycobacterium tuberculosis
AERRYHRDLPEETLRW

SEQ ID NO: 89661 - protein, 16 aa, Mycobacterium tuberculosis
ERRYHRDLPEETLRWL

SEQ ID NO: 89662 - protein, 16 aa, Mycobacterium tuberculosis
RRYHRDLPEETLRWLY

SEQ ID NO: 89663 - protein, 16 aa, Mycobacterium tuberculosis
RYHRDLPEETLRWLYE

SEQ ID NO: 89664 - protein, 16 aa, Mycobacterium tuberculosis
YHRDLPEETLRWLYEM

SEQ ID NO: 89665 - protein, 16 aa, Mycobacterium tuberculosis
HRDLPEETLRWLYEMM

SEQ ID NO: 89666 - protein, 16 aa, Mycobacterium tuberculosis
RDLPEETLRWLYEMMV

SEQ ID NO: 89667 - protein, 16 aa, Mycobacterium tuberculosis
DLPEETLRWLYEMMVV

SEQ ID NO: 89668 - protein, 16 aa, Mycobacterium tuberculosis
LPEETLRWLYEMMVVT

SEQ ID NO: 89669 - protein, 16 aa, Mycobacterium tuberculosis
PEETLRWLYEMMVVTR

SEQ ID NO: 89670 - protein, 16 aa, Mycobacterium tuberculosis
EETLRWLYEMMVVTRE

SEQ ID NO: 89671 - protein, 16 aa, Mycobacterium tuberculosis
ETLRWLYEMMVVTREL

SEQ ID NO: 89672 - protein, 16 aa, Mycobacterium tuberculosis
TLRWLYEMMVVTRELD

SEQ ID NO: 89673 - protein, 16 aa, Mycobacterium tuberculosis
LRWLYEMMVVTRELDT

SEQ ID NO: 89674 - protein, 16 aa, Mycobacterium tuberculosis
RWLYEMMVVTRELDTE

SEQ ID NO: 89675 - protein, 16 aa, Mycobacterium tuberculosis
WLYEMMVVTRELDTEF

SEQ ID NO: 89676 - protein, 16 aa, Mycobacterium tuberculosis
LYEMMVVTRELDTEFV

SEQ ID NO: 89677 - protein, 16 aa, Mycobacterium tuberculosis
YEMMVVTRELDTEFVN

SEQ ID NO: 89678 - protein, 16 aa, Mycobacterium tuberculosis
EMMVVTRELDTEFVNL

SEQ ID NO: 89679 - protein, 16 aa, Mycobacterium tuberculosis
MMVVTRELDTEFVNLQ

SEQ ID NO: 89680 - protein, 16 aa, Mycobacterium tuberculosis
MVVTRELDTEFVNLQR

SEQ ID NO: 89681 - protein, 16 aa, Mycobacterium tuberculosis
VVTRELDTEFVNLQRQ

SEQ ID NO: 89682 - protein, 16 aa, Mycobacterium tuberculosis
VTRELDTEFVNLQRQG

SEQ ID NO: 89683 - protein, 16 aa, Mycobacterium tuberculosis
TRELDTEFVNLQRQGE

SEQ ID NO: 89684 - protein, 16 aa, Mycobacterium tuberculosis
RELDTEFVNLQRQGEL

SEQ ID NO: 89685 - protein, 16 aa, Mycobacterium tuberculosis
ELDTEFVNLQRQGELA

SEQ ID NO: 89686 - protein, 16 aa, Mycobacterium tuberculosis
LDTEFVNLQRQGELAL

SEQ ID NO: 89687 - protein, 16 aa, Mycobacterium tuberculosis
DTEFVNLQRQGELALY

SEQ ID NO: 89688 - protein, 16 aa, Mycobacterium tuberculosis
TEFVNLQRQGELALYT

SEQ ID NO: 89689 - protein, 16 aa, Mycobacterium tuberculosis
EFVNLQRQGELALYTP

SEQ ID NO: 89690 - protein, 16 aa, Mycobacterium tuberculosis
FVNLQRQGELALYTPC

SEQ ID NO: 89691 - protein, 16 aa, Mycobacterium tuberculosis
VNLQRQGELALYTPCR

SEQ ID NO: 89692 - protein, 16 aa, Mycobacterium tuberculosis
NLQRQGELALYTPCRG

SEQ ID NO: 89693 - protein, 16 aa, Mycobacterium tuberculosis
LQRQGELALYTPCRGQ

SEQ ID NO: 89694 - protein, 16 aa, Mycobacterium tuberculosis
QRQGELALYTPCRGQE

SEQ ID NO: 89695 - protein, 16 aa, Mycobacterium tuberculosis
RQGELALYTPCRGQEA

SEQ ID NO: 89696 - protein, 16 aa, Mycobacterium tuberculosis
QGELALYTPCRGQEAA

SEQ ID NO: 89697 - protein, 16 aa, Mycobacterium tuberculosis
GELALYTPCRGQEAAQ

SEQ ID NO: 89698 - protein, 16 aa, Mycobacterium tuberculosis
ELALYTPCRGQEAAQV

SEQ ID NO: 89699 - protein, 16 aa, Mycobacterium tuberculosis
LALYTPCRGQEAAQVG

SEQ ID NO: 89700 - protein, 16 aa, Mycobacterium tuberculosis
ALYTPCRGQEAAQVGA

SEQ ID NO: 89701 - protein, 16 aa, Mycobacterium tuberculosis
LYTPCRGQEAAQVGAA

SEQ ID NO: 89702 - protein, 16 aa, Mycobacterium tuberculosis
YTPCRGQEAAQVGAAA

SEQ ID NO: 89703 - protein, 16 aa, Mycobacterium tuberculosis
TPCRGQEAAQVGAAAC

SEQ ID NO: 89704 - protein, 16 aa, Mycobacterium tuberculosis
PCRGQEAAQVGAAACL

SEQ ID NO: 89705 - protein, 16 aa, Mycobacterium tuberculosis
CRGQEAAQVGAAACLR

SEQ ID NO: 89706 - protein, 16 aa, Mycobacterium tuberculosis
RGQEAAQVGAAACLRK

SEQ ID NO: 89707 - protein, 16 aa, Mycobacterium tuberculosis
GQEAAQVGAAACLRKT

SEQ ID NO: 89708 - protein, 16 aa, Mycobacterium tuberculosis
QEAAQVGAAACLRKTD

SEQ ID NO: 89709 - protein, 16 aa, Mycobacterium tuberculosis
EAAQVGAAACLRKTDW

SEQ ID NO: 89710 - protein, 16 aa, Mycobacterium tuberculosis
AAQVGAAACLRKTDWL

SEQ ID NO: 89711 - protein, 16 aa, Mycobacterium tuberculosis
AQVGAAACLRKTDWLF

SEQ ID NO: 89712 - protein, 16 aa, Mycobacterium tuberculosis
QVGAAACLRKTDWLFP

SEQ ID NO: 89713 - protein, 16 aa, Mycobacterium tuberculosis
VGAAACLRKTDWLFPQ

SEQ ID NO: 89714 - protein, 16 aa, Mycobacterium tuberculosis
GAAACLRKTDWLFPQY

SEQ ID NO: 89715 - protein, 16 aa, Mycobacterium tuberculosis
AAACLRKTDWLFPQYR

SEQ ID NO: 89716 - protein, 16 aa, Mycobacterium tuberculosis
AACLRKTDWLFPQYRE

SEQ ID NO: 89717 - protein, 16 aa, Mycobacterium tuberculosis
ACLRKTDWLFPQYREL

SEQ ID NO: 89718 - protein, 16 aa, Mycobacterium tuberculosis
CLRKTDWLFPQYRELG

SEQ ID NO: 89719 - protein, 16 aa, Mycobacterium tuberculosis
LRKTDWLFPQYRELGV

SEQ ID NO: 89720 - protein, 16 aa, Mycobacterium tuberculosis
RKTDWLFPQYRELGVY

SEQ ID NO: 89721 - protein, 16 aa, Mycobacterium tuberculosis
KTDWLFPQYRELGVYL

SEQ ID NO: 89722 - protein, 16 aa, Mycobacterium tuberculosis
TDWLFPQYRELGVYLV

SEQ ID NO: 89723 - protein, 16 aa, Mycobacterium tuberculosis
DWLFPQYRELGVYLVR

SEQ ID NO: 89724 - protein, 16 aa, Mycobacterium tuberculosis
WLFPQYRELGVYLVRG

SEQ ID NO: 89725 - protein, 16 aa, Mycobacterium tuberculosis
LFPQYRELGVYLVRGI

SEQ ID NO: 89726 - protein, 16 aa, Mycobacterium tuberculosis
FPQYRELGVYLVRGIP

SEQ ID NO: 89727 - protein, 16 aa, Mycobacterium tuberculosis
PQYRELGVYLVRGIPP

SEQ ID NO: 89728 - protein, 16 aa, Mycobacterium tuberculosis
QYRELGVYLVRGIPPG

SEQ ID NO: 89729 - protein, 16 aa, Mycobacterium tuberculosis
YRELGVYLVRGIPPGH

SEQ ID NO: 89730 - protein, 16 aa, Mycobacterium tuberculosis
RELGVYLVRGIPPGHV

SEQ ID NO: 89731 - protein, 16 aa, Mycobacterium tuberculosis
ELGVYLVRGIPPGHVG

SEQ ID NO: 89732 - protein, 16 aa, Mycobacterium tuberculosis
LGVYLVRGIPPGHVGV

SEQ ID NO: 89733 - protein, 16 aa, Mycobacterium tuberculosis
GVYLVRGIPPGHVGVA

SEQ ID NO: 89734 - protein, 16 aa, Mycobacterium tuberculosis
VYLVRGIPPGHVGVAW

SEQ ID NO: 89735 - protein, 16 aa, Mycobacterium tuberculosis
YLVRGIPPGHVGVAWR

SEQ ID NO: 89736 - protein, 16 aa, Mycobacterium tuberculosis
LVRGIPPGHVGVAWRG

SEQ ID NO: 89737 - protein, 16 aa, Mycobacterium tuberculosis
VRGIPPGHVGVAWRGT

SEQ ID NO: 89738 - protein, 16 aa, Mycobacterium tuberculosis
RGIPPGHVGVAWRGTW

SEQ ID NO: 89739 - protein, 16 aa, Mycobacterium tuberculosis
GIPPGHVGVAWRGTWH

SEQ ID NO: 89740 - protein, 16 aa, Mycobacterium tuberculosis
IPPGHVGVAWRGTWHG

SEQ ID NO: 89741 - protein, 16 aa, Mycobacterium tuberculosis
PPGHVGVAWRGTWHGG

SEQ ID NO: 89742 - protein, 16 aa, Mycobacterium tuberculosis
PGHVGVAWRGTWHGGL

SEQ ID NO: 89743 - protein, 16 aa, Mycobacterium tuberculosis
GHVGVAWRGTWHGGLQ

SEQ ID NO: 89744 - protein, 16 aa, Mycobacterium tuberculosis
HVGVAWRGTWHGGLQF

SEQ ID NO: 89745 - protein, 16 aa, Mycobacterium tuberculosis
VGVAWRGTWHGGLQFT

SEQ ID NO: 89746 - protein, 16 aa, Mycobacterium tuberculosis
GVAWRGTWHGGLQFTT

SEQ ID NO: 89747 - protein, 16 aa, Mycobacterium tuberculosis
VAWRGTWHGGLQFTTK

SEQ ID NO: 89748 - protein, 16 aa, Mycobacterium tuberculosis
AWRGTWHGGLQFTTKC

SEQ ID NO: 89749 - protein, 16 aa, Mycobacterium tuberculosis
WRGTWHGGLQFTTKCC

SEQ ID NO: 89750 - protein, 16 aa, Mycobacterium tuberculosis
RGTWHGGLQFTTKCCA

SEQ ID NO: 89751 - protein, 16 aa, Mycobacterium tuberculosis
GTWHGGLQFTTKCCAP

SEQ ID NO: 89752 - protein, 16 aa, Mycobacterium tuberculosis
TWHGGLQFTTKCCAPM

SEQ ID NO: 89753 - protein, 16 aa, Mycobacterium tuberculosis
WHGGLQFTTKCCAPMS

SEQ ID NO: 89754 - protein, 16 aa, Mycobacterium tuberculosis
HGGLQFTTKCCAPMSV

SEQ ID NO: 89755 - protein, 16 aa, Mycobacterium tuberculosis
GGLQFTTKCCAPMSVP

SEQ ID NO: 89756 - protein, 16 aa, Mycobacterium tuberculosis
GLQFTTKCCAPMSVPI

SEQ ID NO: 89757 - protein, 16 aa, Mycobacterium tuberculosis
LQFTTKCCAPMSVPIG

SEQ ID NO: 89758 - protein, 16 aa, Mycobacterium tuberculosis
QFTTKCCAPMSVPIGT

SEQ ID NO: 89759 - protein, 16 aa, Mycobacterium tuberculosis
FTTKCCAPMSVPIGTQ

SEQ ID NO: 89760 - protein, 16 aa, Mycobacterium tuberculosis
TTKCCAPMSVPIGTQT

SEQ ID NO: 89761 - protein, 16 aa, Mycobacterium tuberculosis
TKCCAPMSVPIGTQTL

SEQ ID NO: 89762 - protein, 16 aa, Mycobacterium tuberculosis
KCCAPMSVPIGTQTLH

SEQ ID NO: 89763 - protein, 16 aa, Mycobacterium tuberculosis
CCAPMSVPIGTQTLHA

SEQ ID NO: 89764 - protein, 16 aa, Mycobacterium tuberculosis
CAPMSVPIGTQTLHAV

SEQ ID NO: 89765 - protein, 16 aa, Mycobacterium tuberculosis
APMSVPIGTQTLHAVG

SEQ ID NO: 89766 - protein, 16 aa, Mycobacterium tuberculosis
PMSVPIGTQTLHAVGA

SEQ ID NO: 89767 - protein, 16 aa, Mycobacterium tuberculosis
MSVPIGTQTLHAVGAA

SEQ ID NO: 89768 - protein, 16 aa, Mycobacterium tuberculosis
SVPIGTQTLHAVGAAM

SEQ ID NO: 89769 - protein, 16 aa, Mycobacterium tuberculosis
VPIGTQTLHAVGAAMA

SEQ ID NO: 89770 - protein, 16 aa, Mycobacterium tuberculosis
PIGTQTLHAVGAAMAA

SEQ ID NO: 89771 - protein, 16 aa, Mycobacterium tuberculosis
IGTQTLHAVGAAMAAQ

SEQ ID NO: 89772 - protein, 16 aa, Mycobacterium tuberculosis
GTQTLHAVGAAMAAQR

SEQ ID NO: 89773 - protein, 16 aa, Mycobacterium tuberculosis
TQTLHAVGAAMAAQRL

SEQ ID NO: 89774 - protein, 16 aa, Mycobacterium tuberculosis
QTLHAVGAAMAAQRLD

SEQ ID NO: 89775 - protein, 16 aa, Mycobacterium tuberculosis
TLHAVGAAMAAQRLDE

SEQ ID NO: 89776 - protein, 16 aa, Mycobacterium tuberculosis
LHAVGAAMAAQRLDED

SEQ ID NO: 89777 - protein, 16 aa, Mycobacterium tuberculosis
HAVGAAMAAQRLDEDS

SEQ ID NO: 89778 - protein, 16 aa, Mycobacterium tuberculosis
AVGAAMAAQRLDEDSV

SEQ ID NO: 89779 - protein, 16 aa, Mycobacterium tuberculosis
VGAAMAAQRLDEDSVT

SEQ ID NO: 89780 - protein, 16 aa, Mycobacterium tuberculosis
GAAMAAQRLDEDSVTV

SEQ ID NO: 89781 - protein, 16 aa, Mycobacterium tuberculosis
AAMAAQRLDEDSVTVA

SEQ ID NO: 89782 - protein, 16 aa, Mycobacterium tuberculosis
AMAAQRLDEDSVTVAF

SEQ ID NO: 89783 - protein, 16 aa, Mycobacterium tuberculosis
MAAQRLDEDSVTVAFL

SEQ ID NO: 89784 - protein, 16 aa, Mycobacterium tuberculosis
AAQRLDEDSVTVAFLG

SEQ ID NO: 89785 - protein, 16 aa, Mycobacterium tuberculosis
AQRLDEDSVTVAFLGD

SEQ ID NO: 89786 - protein, 16 aa, Mycobacterium tuberculosis
QRLDEDSVTVAFLGDG

SEQ ID NO: 89787 - protein, 16 aa, Mycobacterium tuberculosis
RLDEDSVTVAFLGDGA

SEQ ID NO: 89788 - protein, 16 aa, Mycobacterium tuberculosis
LDEDSVTVAFLGDGAT

SEQ ID NO: 89789 - protein, 16 aa, Mycobacterium tuberculosis
DEDSVTVAFLGDGATS

SEQ ID NO: 89790 - protein, 16 aa, Mycobacterium tuberculosis
EDSVTVAFLGDGATSE

SEQ ID NO: 89791 - protein, 16 aa, Mycobacterium tuberculosis
DSVTVAFLGDGATSEG

SEQ ID NO: 89792 - protein, 16 aa, Mycobacterium tuberculosis
SVTVAFLGDGATSEGD

SEQ ID NO: 89793 - protein, 16 aa, Mycobacterium tuberculosis
VTVAFLGDGATSEGDV

SEQ ID NO: 89794 - protein, 16 aa, Mycobacterium tuberculosis
TVAFLGDGATSEGDVH

SEQ ID NO: 89795 - protein, 16 aa, Mycobacterium tuberculosis
VAFLGDGATSEGDVHE

SEQ ID NO: 89796 - protein, 16 aa, Mycobacterium tuberculosis
AFLGDGATSEGDVHEA

SEQ ID NO: 89797 - protein, 16 aa, Mycobacterium tuberculosis
FLGDGATSEGDVHEAL

SEQ ID NO: 89798 - protein, 16 aa, Mycobacterium tuberculosis
LGDGATSEGDVHEALN

SEQ ID NO: 89799 - protein, 16 aa, Mycobacterium tuberculosis
GDGATSEGDVHEALNF

SEQ ID NO: 89800 - protein, 16 aa, Mycobacterium tuberculosis
DGATSEGDVHEALNFA

SEQ ID NO: 89801 - protein, 16 aa, Mycobacterium tuberculosis
GATSEGDVHEALNFAA

SEQ ID NO: 89802 - protein, 16 aa, Mycobacterium tuberculosis
ATSEGDVHEALNFAAV

SEQ ID NO: 89803 - protein, 16 aa, Mycobacterium tuberculosis
TSEGDVHEALNFAAVF

SEQ ID NO: 89804 - protein, 16 aa, Mycobacterium tuberculosis
SEGDVHEALNFAAVFT

SEQ ID NO: 89805 - protein, 16 aa, Mycobacterium tuberculosis
EGDVHEALNFAAVFTT

SEQ ID NO: 89806 - protein, 16 aa, Mycobacterium tuberculosis
GDVHEALNFAAVFTTP

SEQ ID NO: 89807 - protein, 16 aa, Mycobacterium tuberculosis
DVHEALNFAAVFTTPC

SEQ ID NO: 89808 - protein, 16 aa, Mycobacterium tuberculosis
VHEALNFAAVFTTPCV

SEQ ID NO: 89809 - protein, 16 aa, Mycobacterium tuberculosis
HEALNFAAVFTTPCVF

SEQ ID NO: 89810 - protein, 16 aa, Mycobacterium tuberculosis
EALNFAAVFTTPCVFY

SEQ ID NO: 89811 - protein, 16 aa, Mycobacterium tuberculosis
ALNFAAVFTTPCVFYV

SEQ ID NO: 89812 - protein, 16 aa, Mycobacterium tuberculosis
LNFAAVFTTPCVFYVQ

SEQ ID NO: 89813 - protein, 16 aa, Mycobacterium tuberculosis
NFAAVFTTPCVFYVQN

SEQ ID NO: 89814 - protein, 16 aa, Mycobacterium tuberculosis
FAAVFTTPCVFYVQNN

SEQ ID NO: 89815 - protein, 16 aa, Mycobacterium tuberculosis
AAVFTTPCVFYVQNNQ

SEQ ID NO: 89816 - protein, 16 aa, Mycobacterium tuberculosis
AVFTTPCVFYVQNNQW

SEQ ID NO: 89817 - protein, 16 aa, Mycobacterium tuberculosis
VFTTPCVFYVQNNQWA

SEQ ID NO: 89818 - protein, 16 aa, Mycobacterium tuberculosis
FTTPCVFYVQNNQWAI

SEQ ID NO: 89819 - protein, 16 aa, Mycobacterium tuberculosis
TTPCVFYVQNNQWAIS

SEQ ID NO: 89820 - protein, 16 aa, Mycobacterium tuberculosis
TPCVFYVQNNQWAISM

SEQ ID NO: 89821 - protein, 16 aa, Mycobacterium tuberculosis
PCVFYVQNNQWAISMP

SEQ ID NO: 89822 - protein, 16 aa, Mycobacterium tuberculosis
CVFYVQNNQWAISMPV

SEQ ID NO: 89823 - protein, 16 aa, Mycobacterium tuberculosis
VFYVQNNQWAISMPVS

SEQ ID NO: 89824 - protein, 16 aa, Mycobacterium tuberculosis
FYVQNNQWAISMPVSR

SEQ ID NO: 89825 - protein, 16 aa, Mycobacterium tuberculosis
YVQNNQWAISMPVSRQ

SEQ ID NO: 89826 - protein, 16 aa, Mycobacterium tuberculosis
VQNNQWAISMPVSRQT

SEQ ID NO: 89827 - protein, 16 aa, Mycobacterium tuberculosis
QNNQWAISMPVSRQTA

SEQ ID NO: 89828 - protein, 16 aa, Mycobacterium tuberculosis
NNQWAISMPVSRQTAA

SEQ ID NO: 89829 - protein, 16 aa, Mycobacterium tuberculosis
NQWAISMPVSRQTAAP

SEQ ID NO: 89830 - protein, 16 aa, Mycobacterium tuberculosis
QWAISMPVSRQTAAPS

SEQ ID NO: 89831 - protein, 16 aa, Mycobacterium tuberculosis
WAISMPVSRQTAAPSI

SEQ ID NO: 89832 - protein, 16 aa, Mycobacterium tuberculosis
AISMPVSRQTAAPSIA

SEQ ID NO: 89833 - protein, 16 aa, Mycobacterium tuberculosis
ISMPVSRQTAAPSIAH

SEQ ID NO: 89834 - protein, 16 aa, Mycobacterium tuberculosis
SMPVSRQTAAPSIAHK

SEQ ID NO: 89835 - protein, 16 aa, Mycobacterium tuberculosis
MPVSRQTAAPSIAHKA

SEQ ID NO: 89836 - protein, 16 aa, Mycobacterium tuberculosis
PVSRQTAAPSIAHKAI

SEQ ID NO: 89837 - protein, 16 aa, Mycobacterium tuberculosis
VSRQTAAPSIAHKAIG

SEQ ID NO: 89838 - protein, 16 aa, Mycobacterium tuberculosis
SRQTAAPSIAHKAIGY

SEQ ID NO: 89839 - protein, 16 aa, Mycobacterium tuberculosis
RQTAAPSIAHKAIGYG

SEQ ID NO: 89840 - protein, 16 aa, Mycobacterium tuberculosis
QTAAPSIAHKAIGYGM

SEQ ID NO: 89841 - protein, 16 aa, Mycobacterium tuberculosis
TAAPSIAHKAIGYGMP

SEQ ID NO: 89842 - protein, 16 aa, Mycobacterium tuberculosis
AAPSIAHKAIGYGMPG

SEQ ID NO: 89843 - protein, 16 aa, Mycobacterium tuberculosis
APSIAHKAIGYGMPGI

SEQ ID NO: 89844 - protein, 16 aa, Mycobacterium tuberculosis
PSIAHKAIGYGMPGIR

SEQ ID NO: 89845 - protein, 16 aa, Mycobacterium tuberculosis
SIAHKAIGYGMPGIRV

SEQ ID NO: 89846 - protein, 16 aa, Mycobacterium tuberculosis
IAHKAIGYGMPGIRVD

SEQ ID NO: 89847 - protein, 16 aa, Mycobacterium tuberculosis
AHKAIGYGMPGIRVDG

SEQ ID NO: 89848 - protein, 16 aa, Mycobacterium tuberculosis
HKAIGYGMPGIRVDGN

SEQ ID NO: 89849 - protein, 16 aa, Mycobacterium tuberculosis
KAIGYGMPGIRVDGND

SEQ ID NO: 89850 - protein, 16 aa, Mycobacterium tuberculosis
AIGYGMPGIRVDGNDV

SEQ ID NO: 89851 - protein, 16 aa, Mycobacterium tuberculosis
IGYGMPGIRVDGNDVL

SEQ ID NO: 89852 - protein, 16 aa, Mycobacterium tuberculosis
GYGMPGIRVDGNDVLA

SEQ ID NO: 89853 - protein, 16 aa, Mycobacterium tuberculosis
YGMPGIRVDGNDVLAC

SEQ ID NO: 89854 - protein, 16 aa, Mycobacterium tuberculosis
GMPGIRVDGNDVLACY

SEQ ID NO: 89855 - protein, 16 aa, Mycobacterium tuberculosis
MPGIRVDGNDVLACYA

SEQ ID NO: 89856 - protein, 16 aa, Mycobacterium tuberculosis
PGIRVDGNDVLACYAV

SEQ ID NO: 89857 - protein, 16 aa, Mycobacterium tuberculosis
GIRVDGNDVLACYAVM

SEQ ID NO: 89858 - protein, 16 aa, Mycobacterium tuberculosis
IRVDGNDVLACYAVMA

SEQ ID NO: 89859 - protein, 16 aa, Mycobacterium tuberculosis
RVDGNDVLACYAVMAE

SEQ ID NO: 89860 - protein, 16 aa, Mycobacterium tuberculosis
VDGNDVLACYAVMAEA

SEQ ID NO: 89861 - protein, 16 aa, Mycobacterium tuberculosis
DGNDVLACYAVMAEAA

SEQ ID NO: 89862 - protein, 16 aa, Mycobacterium tuberculosis
GNDVLACYAVMAEAAA

SEQ ID NO: 89863 - protein, 16 aa, Mycobacterium tuberculosis
NDVLACYAVMAEAAAR

SEQ ID NO: 89864 - protein, 16 aa, Mycobacterium tuberculosis
DVLACYAVMAEAAARA

SEQ ID NO: 89865 - protein, 16 aa, Mycobacterium tuberculosis
VLACYAVMAEAAARAR

SEQ ID NO: 89866 - protein, 16 aa, Mycobacterium tuberculosis
LACYAVMAEAAARARA

SEQ ID NO: 89867 - protein, 16 aa, Mycobacterium tuberculosis
ACYAVMAEAAARARAG

SEQ ID NO: 89868 - protein, 16 aa, Mycobacterium tuberculosis
CYAVMAEAAARARAGD

SEQ ID NO: 89869 - protein, 16 aa, Mycobacterium tuberculosis
YAVMAEAAARARAGDG

SEQ ID NO: 89870 - protein, 16 aa, Mycobacterium tuberculosis
AVMAEAAARARAGDGP

SEQ ID NO: 89871 - protein, 16 aa, Mycobacterium tuberculosis
VMAEAAARARAGDGPT

SEQ ID NO: 89872 - protein, 16 aa, Mycobacterium tuberculosis
MAEAAARARAGDGPTL

SEQ ID NO: 89873 - protein, 16 aa, Mycobacterium tuberculosis
AEAAARARAGDGPTLI

SEQ ID NO: 89874 - protein, 16 aa, Mycobacterium tuberculosis
EAAARARAGDGPTLIE

SEQ ID NO: 89875 - protein, 16 aa, Mycobacterium tuberculosis
AAARARAGDGPTLIEA

SEQ ID NO: 89876 - protein, 16 aa, Mycobacterium tuberculosis
AARARAGDGPTLIEAV

SEQ ID NO: 89877 - protein, 16 aa, Mycobacterium tuberculosis
ARARAGDGPTLIEAVT

SEQ ID NO: 89878 - protein, 16 aa, Mycobacterium tuberculosis
RARAGDGPTLIEAVTY

SEQ ID NO: 89879 - protein, 16 aa, Mycobacterium tuberculosis
ARAGDGPTLIEAVTYR

SEQ ID NO: 89880 - protein, 16 aa, Mycobacterium tuberculosis
RAGDGPTLIEAVTYRL

SEQ ID NO: 89881 - protein, 16 aa, Mycobacterium tuberculosis
AGDGPTLIEAVTYRLG

SEQ ID NO: 89882 - protein, 16 aa, Mycobacterium tuberculosis
GDGPTLIEAVTYRLGP

SEQ ID NO: 89883 - protein, 16 aa, Mycobacterium tuberculosis
DGPTLIEAVTYRLGPH

SEQ ID NO: 89884 - protein, 16 aa, Mycobacterium tuberculosis
GPTLIEAVTYRLGPHT

SEQ ID NO: 89885 - protein, 16 aa, Mycobacterium tuberculosis
PTLIEAVTYRLGPHTT

SEQ ID NO: 89886 - protein, 16 aa, Mycobacterium tuberculosis
TLIEAVTYRLGPHTTA

SEQ ID NO: 89887 - protein, 16 aa, Mycobacterium tuberculosis
LIEAVTYRLGPHTTAD

SEQ ID NO: 89888 - protein, 16 aa, Mycobacterium tuberculosis
IEAVTYRLGPHTTADD

SEQ ID NO: 89889 - protein, 16 aa, Mycobacterium tuberculosis
EAVTYRLGPHTTADDP

SEQ ID NO: 89890 - protein, 16 aa, Mycobacterium tuberculosis
AVTYRLGPHTTADDPT

SEQ ID NO: 89891 - protein, 16 aa, Mycobacterium tuberculosis
VTYRLGPHTTADDPTR

SEQ ID NO: 89892 - protein, 16 aa, Mycobacterium tuberculosis
TYRLGPHTTADDPTRY

SEQ ID NO: 89893 - protein, 16 aa, Mycobacterium tuberculosis
YRLGPHTTADDPTRYR

SEQ ID NO: 89894 - protein, 16 aa, Mycobacterium tuberculosis
RLGPHTTADDPTRYRS

SEQ ID NO: 89895 - protein, 16 aa, Mycobacterium tuberculosis
LGPHTTADDPTRYRSQ

SEQ ID NO: 89896 - protein, 16 aa, Mycobacterium tuberculosis
GPHTTADDPTRYRSQE

SEQ ID NO: 89897 - protein, 16 aa, Mycobacterium tuberculosis
PHTTADDPTRYRSQEE

SEQ ID NO: 89898 - protein, 16 aa, Mycobacterium tuberculosis
HTTADDPTRYRSQEEV

SEQ ID NO: 89899 - protein, 16 aa, Mycobacterium tuberculosis
TTADDPTRYRSQEEVD

SEQ ID NO: 89900 - protein, 16 aa, Mycobacterium tuberculosis
TADDPTRYRSQEEVDR

SEQ ID NO: 89901 - protein, 16 aa, Mycobacterium tuberculosis
ADDPTRYRSQEEVDRW

SEQ ID NO: 89902 - protein, 16 aa, Mycobacterium tuberculosis
DDPTRYRSQEEVDRWA

SEQ ID NO: 89903 - protein, 16 aa, Mycobacterium tuberculosis
DPTRYRSQEEVDRWAT

SEQ ID NO: 89904 - protein, 16 aa, Mycobacterium tuberculosis
PTRYRSQEEVDRWATL

SEQ ID NO: 89905 - protein, 16 aa, Mycobacterium tuberculosis
TRYRSQEEVDRWATLD

SEQ ID NO: 89906 - protein, 16 aa, Mycobacterium tuberculosis
RYRSQEEVDRWATLDP

SEQ ID NO: 89907 - protein, 16 aa, Mycobacterium tuberculosis
YRSQEEVDRWATLDPI

SEQ ID NO: 89908 - protein, 16 aa, Mycobacterium tuberculosis
RSQEEVDRWATLDPIP

SEQ ID NO: 89909 - protein, 16 aa, Mycobacterium tuberculosis
SQEEVDRWATLDPIPR

SEQ ID NO: 89910 - protein, 16 aa, Mycobacterium tuberculosis
QEEVDRWATLDPIPRY

SEQ ID NO: 89911 - protein, 16 aa, Mycobacterium tuberculosis
EEVDRWATLDPIPRYR

SEQ ID NO: 89912 - protein, 16 aa, Mycobacterium tuberculosis
EVDRWATLDPIPRYRT

SEQ ID NO: 89913 - protein, 16 aa, Mycobacterium tuberculosis
VDRWATLDPIPRYRTY

SEQ ID NO: 89914 - protein, 16 aa, Mycobacterium tuberculosis
DRWATLDPIPRYRTYL

SEQ ID NO: 89915 - protein, 16 aa, Mycobacterium tuberculosis
RWATLDPIPRYRTYLQ

SEQ ID NO: 89916 - protein, 16 aa, Mycobacterium tuberculosis
WATLDPIPRYRTYLQD

SEQ ID NO: 89917 - protein, 16 aa, Mycobacterium tuberculosis
ATLDPIPRYRTYLQDQ

SEQ ID NO: 89918 - protein, 16 aa, Mycobacterium tuberculosis
TLDPIPRYRTYLQDQG

SEQ ID NO: 89919 - protein, 16 aa, Mycobacterium tuberculosis
LDPIPRYRTYLQDQGL

SEQ ID NO: 89920 - protein, 16 aa, Mycobacterium tuberculosis
DPIPRYRTYLQDQGLW

SEQ ID NO: 89921 - protein, 16 aa, Mycobacterium tuberculosis
PIPRYRTYLQDQGLWS

SEQ ID NO: 89922 - protein, 16 aa, Mycobacterium tuberculosis
IPRYRTYLQDQGLWSQ

SEQ ID NO: 89923 - protein, 16 aa, Mycobacterium tuberculosis
PRYRTYLQDQGLWSQR

SEQ ID NO: 89924 - protein, 16 aa, Mycobacterium tuberculosis
RYRTYLQDQGLWSQRL

SEQ ID NO: 89925 - protein, 16 aa, Mycobacterium tuberculosis
YRTYLQDQGLWSQRLE

SEQ ID NO: 89926 - protein, 16 aa, Mycobacterium tuberculosis
RTYLQDQGLWSQRLEE

SEQ ID NO: 89927 - protein, 16 aa, Mycobacterium tuberculosis
TYLQDQGLWSQRLEEQ

SEQ ID NO: 89928 - protein, 16 aa, Mycobacterium tuberculosis
YLQDQGLWSQRLEEQV

SEQ ID NO: 89929 - protein, 16 aa, Mycobacterium tuberculosis
LQDQGLWSQRLEEQVT

SEQ ID NO: 89930 - protein, 16 aa, Mycobacterium tuberculosis
QDQGLWSQRLEEQVTA

SEQ ID NO: 89931 - protein, 16 aa, Mycobacterium tuberculosis
DQGLWSQRLEEQVTAR

SEQ ID NO: 89932 - protein, 16 aa, Mycobacterium tuberculosis
QGLWSQRLEEQVTARA

SEQ ID NO: 89933 - protein, 16 aa, Mycobacterium tuberculosis
GLWSQRLEEQVTARAK

SEQ ID NO: 89934 - protein, 16 aa, Mycobacterium tuberculosis
LWSQRLEEQVTARAKH

SEQ ID NO: 89935 - protein, 16 aa, Mycobacterium tuberculosis
WSQRLEEQVTARAKHV

SEQ ID NO: 89936 - protein, 16 aa, Mycobacterium tuberculosis
SQRLEEQVTARAKHVR

SEQ ID NO: 89937 - protein, 16 aa, Mycobacterium tuberculosis
QRLEEQVTARAKHVRS

SEQ ID NO: 89938 - protein, 16 aa, Mycobacterium tuberculosis
RLEEQVTARAKHVRSE

SEQ ID NO: 89939 - protein, 16 aa, Mycobacterium tuberculosis
LEEQVTARAKHVRSEL

SEQ ID NO: 89940 - protein, 16 aa, Mycobacterium tuberculosis
EEQVTARAKHVRSELR

SEQ ID NO: 89941 - protein, 16 aa, Mycobacterium tuberculosis
EQVTARAKHVRSELRD

SEQ ID NO: 89942 - protein, 16 aa, Mycobacterium tuberculosis
QVTARAKHVRSELRDA

SEQ ID NO: 89943 - protein, 16 aa, Mycobacterium tuberculosis
VTARAKHVRSELRDAV

SEQ ID NO: 89944 - protein, 16 aa, Mycobacterium tuberculosis
TARAKHVRSELRDAVF

SEQ ID NO: 89945 - protein, 16 aa, Mycobacterium tuberculosis
ARAKHVRSELRDAVFD

SEQ ID NO: 89946 - protein, 16 aa, Mycobacterium tuberculosis
RAKHVRSELRDAVFDA

SEQ ID NO: 89947 - protein, 16 aa, Mycobacterium tuberculosis
AKHVRSELRDAVFDAP

SEQ ID NO: 89948 - protein, 16 aa, Mycobacterium tuberculosis
KHVRSELRDAVFDAPD

SEQ ID NO: 89949 - protein, 16 aa, Mycobacterium tuberculosis
HVRSELRDAVFDAPDF

SEQ ID NO: 89950 - protein, 16 aa, Mycobacterium tuberculosis
VRSELRDAVFDAPDFD

SEQ ID NO: 89951 - protein, 16 aa, Mycobacterium tuberculosis
RSELRDAVFDAPDFDV

SEQ ID NO: 89952 - protein, 16 aa, Mycobacterium tuberculosis
SELRDAVFDAPDFDVD

SEQ ID NO: 89953 - protein, 16 aa, Mycobacterium tuberculosis
ELRDAVFDAPDFDVDE

SEQ ID NO: 89954 - protein, 16 aa, Mycobacterium tuberculosis
LRDAVFDAPDFDVDEV

SEQ ID NO: 89955 - protein, 16 aa, Mycobacterium tuberculosis
RDAVFDAPDFDVDEVF

SEQ ID NO: 89956 - protein, 16 aa, Mycobacterium tuberculosis
DAVFDAPDFDVDEVFT

SEQ ID NO: 89957 - protein, 16 aa, Mycobacterium tuberculosis
AVFDAPDFDVDEVFTT

SEQ ID NO: 89958 - protein, 16 aa, Mycobacterium tuberculosis
VFDAPDFDVDEVFTTV

SEQ ID NO: 89959 - protein, 16 aa, Mycobacterium tuberculosis
FDAPDFDVDEVFTTVY

SEQ ID NO: 89960 - protein, 16 aa, Mycobacterium tuberculosis
DAPDFDVDEVFTTVYA

SEQ ID NO: 89961 - protein, 16 aa, Mycobacterium tuberculosis
APDFDVDEVFTTVYAE

SEQ ID NO: 89962 - protein, 16 aa, Mycobacterium tuberculosis
PDFDVDEVFTTVYAEI

SEQ ID NO: 89963 - protein, 16 aa, Mycobacterium tuberculosis
DFDVDEVFTTVYAEIT

SEQ ID NO: 89964 - protein, 16 aa, Mycobacterium tuberculosis
FDVDEVFTTVYAEITP

SEQ ID NO: 89965 - protein, 16 aa, Mycobacterium tuberculosis
DVDEVFTTVYAEITPG

SEQ ID NO: 89966 - protein, 16 aa, Mycobacterium tuberculosis
VDEVFTTVYAEITPGL

SEQ ID NO: 89967 - protein, 16 aa, Mycobacterium tuberculosis
DEVFTTVYAEITPGLQ

SEQ ID NO: 89968 - protein, 16 aa, Mycobacterium tuberculosis
EVFTTVYAEITPGLQA

SEQ ID NO: 89969 - protein, 16 aa, Mycobacterium tuberculosis
VFTTVYAEITPGLQAQ

SEQ ID NO: 89970 - protein, 16 aa, Mycobacterium tuberculosis
FTTVYAEITPGLQAQR

SEQ ID NO: 89971 - protein, 16 aa, Mycobacterium tuberculosis
TTVYAEITPGLQAQRE

SEQ ID NO: 89972 - protein, 16 aa, Mycobacterium tuberculosis
TVYAEITPGLQAQREQ

SEQ ID NO: 89973 - protein, 16 aa, Mycobacterium tuberculosis
VYAEITPGLQAQREQL

SEQ ID NO: 89974 - protein, 16 aa, Mycobacterium tuberculosis
YAEITPGLQAQREQLR

SEQ ID NO: 89975 - protein, 16 aa, Mycobacterium tuberculosis
AEITPGLQAQREQLRA

SEQ ID NO: 89976 - protein, 16 aa, Mycobacterium tuberculosis
EITPGLQAQREQLRAE

SEQ ID NO: 89977 - protein, 16 aa, Mycobacterium tuberculosis
ITPGLQAQREQLRAEL

SEQ ID NO: 89978 - protein, 16 aa, Mycobacterium tuberculosis
TPGLQAQREQLRAELA

SEQ ID NO: 89979 - protein, 16 aa, Mycobacterium tuberculosis
PGLQAQREQLRAELAR

SEQ ID NO: 89980 - protein, 16 aa, Mycobacterium tuberculosis
GLQAQREQLRAELART

SEQ ID NO: 89981 - protein, 16 aa, Mycobacterium tuberculosis
LQAQREQLRAELARTD

SEQ ID NO: 89982 - protein, 13 aa, Mycobacterium tuberculosis
MNSAIIKIAKWAQ

SEQ ID NO: 89983 - protein, 13 aa, Mycobacterium tuberculosis
NSAIIKIAKWAQS

SEQ ID NO: 89984 - protein, 13 aa, Mycobacterium tuberculosis
SAIIKIAKWAQSQ

SEQ ID NO: 89985 - protein, 13 aa, Mycobacterium tuberculosis
AIIKIAKWAQSQQ

SEQ ID NO: 89986 - protein, 13 aa, Mycobacterium tuberculosis
IIKIAKWAQSQQW

SEQ ID NO: 89987 - protein, 13 aa, Mycobacterium tuberculosis
IKIAKWAQSQQWT

SEQ ID NO: 89988 - protein, 13 aa, Mycobacterium tuberculosis
KIAKWAQSQQWTV

SEQ ID NO: 89989 - protein, 13 aa, Mycobacterium tuberculosis
IAKWAQSQQWTVE

SEQ ID NO: 89990 - protein, 13 aa, Mycobacterium tuberculosis
AKWAQSQQWTVED

SEQ ID NO: 89991 - protein, 13 aa, Mycobacterium tuberculosis
KWAQSQQWTVEDD

SEQ ID NO: 89992 - protein, 13 aa, Mycobacterium tuberculosis
WAQSQQWTVEDDA

SEQ ID NO: 89993 - protein, 13 aa, Mycobacterium tuberculosis
AQSQQWTVEDDAS

SEQ ID NO: 89994 - protein, 13 aa, Mycobacterium tuberculosis
QSQQWTVEDDASG

SEQ ID NO: 89995 - protein, 13 aa, Mycobacterium tuberculosis
SQQWTVEDDASGY

SEQ ID NO: 89996 - protein, 13 aa, Mycobacterium tuberculosis
QQWTVEDDASGYT

SEQ ID NO: 89997 - protein, 13 aa, Mycobacterium tuberculosis
QWTVEDDASGYTR

SEQ ID NO: 89998 - protein, 13 aa, Mycobacterium tuberculosis
WTVEDDASGYTRF

SEQ ID NO: 89999 - protein, 13 aa, Mycobacterium tuberculosis
TVEDDASGYTRFY

SEQ ID NO: 90000 - protein, 13 aa, Mycobacterium tuberculosis
VEDDASGYTRFYN

SEQ ID NO: 90001 - protein, 13 aa, Mycobacterium tuberculosis
EDDASGYTRFYNP

SEQ ID NO: 90002 - protein, 13 aa, Mycobacterium tuberculosis
DDASGYTRFYNPQ

SEQ ID NO: 90003 - protein, 13 aa, Mycobacterium tuberculosis
DASGYTRFYNPQG

SEQ ID NO: 90004 - protein, 13 aa, Mycobacterium tuberculosis
ASGYTRFYNPQGV

SEQ ID NO: 90005 - protein, 13 aa, Mycobacterium tuberculosis
SGYTRFYNPQGVY

SEQ ID NO: 90006 - protein, 13 aa, Mycobacterium tuberculosis
GYTRFYNPQGVYI

SEQ ID NO: 90007 - protein, 13 aa, Mycobacterium tuberculosis
YTRFYNPQGVYIA

SEQ ID NO: 90008 - protein, 13 aa, Mycobacterium tuberculosis
TRFYNPQGVYIAR

SEQ ID NO: 90009 - protein, 13 aa, Mycobacterium tuberculosis
RFYNPQGVYIARF

SEQ ID NO: 90010 - protein, 13 aa, Mycobacterium tuberculosis
FYNPQGVYIARFP

SEQ ID NO: 90011 - protein, 13 aa, Mycobacterium tuberculosis
YNPQGVYIARFPA

SEQ ID NO: 90012 - protein, 13 aa, Mycobacterium tuberculosis
NPQGVYIARFPAT

SEQ ID NO: 90013 - protein, 13 aa, Mycobacterium tuberculosis
PQGVYIARFPATP

SEQ ID NO: 90014 - protein, 13 aa, Mycobacterium tuberculosis
QGVYIARFPATPS

SEQ ID NO: 90015 - protein, 13 aa, Mycobacterium tuberculosis
GVYIARFPATPSN

SEQ ID NO: 90016 - protein, 13 aa, Mycobacterium tuberculosis
VYIARFPATPSNE

SEQ ID NO: 90017 - protein, 13 aa, Mycobacterium tuberculosis
YIARFPATPSNEY

SEQ ID NO: 90018 - protein, 13 aa, Mycobacterium tuberculosis
IARFPATPSNEYR

SEQ ID NO: 90019 - protein, 13 aa, Mycobacterium tuberculosis
ARFPATPSNEYRR

SEQ ID NO: 90020 - protein, 13 aa, Mycobacterium tuberculosis
RFPATPSNEYRRM

SEQ ID NO: 90021 - protein, 13 aa, Mycobacterium tuberculosis
FPATPSNEYRRMR

SEQ ID NO: 90022 - protein, 13 aa, Mycobacterium tuberculosis
PATPSNEYRRMRD

SEQ ID NO: 90023 - protein, 13 aa, Mycobacterium tuberculosis
ATPSNEYRRMRDL

SEQ ID NO: 90024 - protein, 13 aa, Mycobacterium tuberculosis
TPSNEYRRMRDLL

SEQ ID NO: 90025 - protein, 13 aa, Mycobacterium tuberculosis
PSNEYRRMRDLLG

SEQ ID NO: 90026 - protein, 13 aa, Mycobacterium tuberculosis
SNEYRRMRDLLGA

SEQ ID NO: 90027 - protein, 13 aa, Mycobacterium tuberculosis
NEYRRMRDLLGAL

SEQ ID NO: 90028 - protein, 13 aa, Mycobacterium tuberculosis
EYRRMRDLLGALK

SEQ ID NO: 90029 - protein, 13 aa, Mycobacterium tuberculosis
YRRMRDLLGALKK

SEQ ID NO: 90030 - protein, 13 aa, Mycobacterium tuberculosis
RRMRDLLGALKKA

SEQ ID NO: 90031 - protein, 13 aa, Mycobacterium tuberculosis
RMRDLLGALKKAG

SEQ ID NO: 90032 - protein, 13 aa, Mycobacterium tuberculosis
MRDLLGALKKAGL

SEQ ID NO: 90033 - protein, 13 aa, Mycobacterium tuberculosis
RDLLGALKKAGLT

SEQ ID NO: 90034 - protein, 13 aa, Mycobacterium tuberculosis
DLLGALKKAGLTW

SEQ ID NO: 90035 - protein, 13 aa, Mycobacterium tuberculosis
LLGALKKAGLTWP

SEQ ID NO: 90036 - protein, 13 aa, Mycobacterium tuberculosis
LGALKKAGLTWPP

SEQ ID NO: 90037 - protein, 13 aa, Mycobacterium tuberculosis
GALKKAGLTWPPP

SEQ ID NO: 90038 - protein, 13 aa, Mycobacterium tuberculosis
ALKKAGLTWPPPS

SEQ ID NO: 90039 - protein, 13 aa, Mycobacterium tuberculosis
LKKAGLTWPPPSK

SEQ ID NO: 90040 - protein, 13 aa, Mycobacterium tuberculosis
KKAGLTWPPPSKK

SEQ ID NO: 90041 - protein, 13 aa, Mycobacterium tuberculosis
KAGLTWPPPSKKE

SEQ ID NO: 90042 - protein, 13 aa, Mycobacterium tuberculosis
AGLTWPPPSKKER

SEQ ID NO: 90043 - protein, 13 aa, Mycobacterium tuberculosis
GLTWPPPSKKERR

SEQ ID NO: 90044 - protein, 13 aa, Mycobacterium tuberculosis
LTWPPPSKKERRA

SEQ ID NO: 90045 - protein, 13 aa, Mycobacterium tuberculosis
TWPPPSKKERRAQ

SEQ ID NO: 90046 - protein, 13 aa, Mycobacterium tuberculosis
WPPPSKKERRAQH

SEQ ID NO: 90047 - protein, 13 aa, Mycobacterium tuberculosis
PPPSKKERRAQHR

SEQ ID NO: 90048 - protein, 13 aa, Mycobacterium tuberculosis
PPSKKERRAQHRK

SEQ ID NO: 90049 - protein, 13 aa, Mycobacterium tuberculosis
PSKKERRAQHRKE

SEQ ID NO: 90050 - protein, 13 aa, Mycobacterium tuberculosis
SKKERRAQHRKEG

SEQ ID NO: 90051 - protein, 13 aa, Mycobacterium tuberculosis
KKERRAQHRKEGA

SEQ ID NO: 90052 - protein, 13 aa, Mycobacterium tuberculosis
KERRAQHRKEGAQ

SEQ ID NO: 90053 - protein, 14 aa, Mycobacterium tuberculosis
MNSAIIKIAKWAQS

SEQ ID NO: 90054 - protein, 14 aa, Mycobacterium tuberculosis
NSAIIKIAKWAQSQ

SEQ ID NO: 90055 - protein, 14 aa, Mycobacterium tuberculosis
SAIIKIAKWAQSQQ

SEQ ID NO: 90056 - protein, 14 aa, Mycobacterium tuberculosis
AIIKIAKWAQSQQW

SEQ ID NO: 90057 - protein, 14 aa, Mycobacterium tuberculosis
IIKIAKWAQSQQWT

SEQ ID NO: 90058 - protein, 14 aa, Mycobacterium tuberculosis
IKIAKWAQSQQWTV

SEQ ID NO: 90059 - protein, 14 aa, Mycobacterium tuberculosis
KIAKWAQSQQWTVE

SEQ ID NO: 90060 - protein, 14 aa, Mycobacterium tuberculosis
IAKWAQSQQWTVED

SEQ ID NO: 90061 - protein, 14 aa, Mycobacterium tuberculosis
AKWAQSQQWTVEDD

SEQ ID NO: 90062 - protein, 14 aa, Mycobacterium tuberculosis
KWAQSQQWTVEDDA

SEQ ID NO: 90063 - protein, 14 aa, Mycobacterium tuberculosis
WAQSQQWTVEDDAS

SEQ ID NO: 90064 - protein, 14 aa, Mycobacterium tuberculosis
AQSQQWTVEDDASG

SEQ ID NO: 90065 - protein, 14 aa, Mycobacterium tuberculosis
QSQQWTVEDDASGY

SEQ ID NO: 90066 - protein, 14 aa, Mycobacterium tuberculosis
SQQWTVEDDASGYT

SEQ ID NO: 90067 - protein, 14 aa, Mycobacterium tuberculosis
QQWTVEDDASGYTR

SEQ ID NO: 90068 - protein, 14 aa, Mycobacterium tuberculosis
QWTVEDDASGYTRF

SEQ ID NO: 90069 - protein, 14 aa, Mycobacterium tuberculosis
WTVEDDASGYTRFY

SEQ ID NO: 90070 - protein, 14 aa, Mycobacterium tuberculosis
TVEDDASGYTRFYN

SEQ ID NO: 90071 - protein, 14 aa, Mycobacterium tuberculosis
VEDDASGYTRFYNP

SEQ ID NO: 90072 - protein, 14 aa, Mycobacterium tuberculosis
EDDASGYTRFYNPQ

SEQ ID NO: 90073 - protein, 14 aa, Mycobacterium tuberculosis
DDASGYTRFYNPQG

SEQ ID NO: 90074 - protein, 14 aa, Mycobacterium tuberculosis
DASGYTRFYNPQGV

SEQ ID NO: 90075 - protein, 14 aa, Mycobacterium tuberculosis
ASGYTRFYNPQGVY

SEQ ID NO: 90076 - protein, 14 aa, Mycobacterium tuberculosis
SGYTRFYNPQGVYI

SEQ ID NO: 90077 - protein, 14 aa, Mycobacterium tuberculosis
GYTRFYNPQGVYIA

SEQ ID NO: 90078 - protein, 14 aa, Mycobacterium tuberculosis
YTRFYNPQGVYIAR

SEQ ID NO: 90079 - protein, 14 aa, Mycobacterium tuberculosis
TRFYNPQGVYIARF

SEQ ID NO: 90080 - protein, 14 aa, Mycobacterium tuberculosis
RFYNPQGVYIARFP

SEQ ID NO: 90081 - protein, 14 aa, Mycobacterium tuberculosis
FYNPQGVYIARFPA

SEQ ID NO: 90082 - protein, 14 aa, Mycobacterium tuberculosis
YNPQGVYIARFPAT

SEQ ID NO: 90083 - protein, 14 aa, Mycobacterium tuberculosis
NPQGVYIARFPATP

SEQ ID NO: 90084 - protein, 14 aa, Mycobacterium tuberculosis
PQGVYIARFPATPS

SEQ ID NO: 90085 - protein, 14 aa, Mycobacterium tuberculosis
QGVYIARFPATPSN

SEQ ID NO: 90086 - protein, 14 aa, Mycobacterium tuberculosis
GVYIARFPATPSNE

SEQ ID NO: 90087 - protein, 14 aa, Mycobacterium tuberculosis
VYIARFPATPSNEY

SEQ ID NO: 90088 - protein, 14 aa, Mycobacterium tuberculosis
YIARFPATPSNEYR

SEQ ID NO: 90089 - protein, 14 aa, Mycobacterium tuberculosis
IARFPATPSNEYRR

SEQ ID NO: 90090 - protein, 14 aa, Mycobacterium tuberculosis
ARFPATPSNEYRRM

SEQ ID NO: 90091 - protein, 14 aa, Mycobacterium tuberculosis
RFPATPSNEYRRMR

SEQ ID NO: 90092 - protein, 14 aa, Mycobacterium tuberculosis
FPATPSNEYRRMRD

SEQ ID NO: 90093 - protein, 14 aa, Mycobacterium tuberculosis
PATPSNEYRRMRDL

SEQ ID NO: 90094 - protein, 14 aa, Mycobacterium tuberculosis
ATPSNEYRRMRDLL

SEQ ID NO: 90095 - protein, 14 aa, Mycobacterium tuberculosis
TPSNEYRRMRDLLG

SEQ ID NO: 90096 - protein, 14 aa, Mycobacterium tuberculosis
PSNEYRRMRDLLGA

SEQ ID NO: 90097 - protein, 14 aa, Mycobacterium tuberculosis
SNEYRRMRDLLGAL

SEQ ID NO: 90098 - protein, 14 aa, Mycobacterium tuberculosis
NEYRRMRDLLGALK

SEQ ID NO: 90099 - protein, 14 aa, Mycobacterium tuberculosis
EYRRMRDLLGALKK

SEQ ID NO: 90100 - protein, 14 aa, Mycobacterium tuberculosis
YRRMRDLLGALKKA

SEQ ID NO: 90101 - protein, 14 aa, Mycobacterium tuberculosis
RRMRDLLGALKKAG

SEQ ID NO: 90102 - protein, 14 aa, Mycobacterium tuberculosis
RMRDLLGALKKAGL

SEQ ID NO: 90103 - protein, 14 aa, Mycobacterium tuberculosis
MRDLLGALKKAGLT

SEQ ID NO: 90104 - protein, 14 aa, Mycobacterium tuberculosis
RDLLGALKKAGLTW

SEQ ID NO: 90105 - protein, 14 aa, Mycobacterium tuberculosis
DLLGALKKAGLTWP

SEQ ID NO: 90106 - protein, 14 aa, Mycobacterium tuberculosis
LLGALKKAGLTWPP

SEQ ID NO: 90107 - protein, 14 aa, Mycobacterium tuberculosis
LGALKKAGLTWPPP

SEQ ID NO: 90108 - protein, 14 aa, Mycobacterium tuberculosis
GALKKAGLTWPPPS

SEQ ID NO: 90109 - protein, 14 aa, Mycobacterium tuberculosis
ALKKAGLTWPPPSK

SEQ ID NO: 90110 - protein, 14 aa, Mycobacterium tuberculosis
LKKAGLTWPPPSKK

SEQ ID NO: 90111 - protein, 14 aa, Mycobacterium tuberculosis
KKAGLTWPPPSKKE

SEQ ID NO: 90112 - protein, 14 aa, Mycobacterium tuberculosis
KAGLTWPPPSKKER

SEQ ID NO: 90113 - protein, 14 aa, Mycobacterium tuberculosis
AGLTWPPPSKKERR

SEQ ID NO: 90114 - protein, 14 aa, Mycobacterium tuberculosis
GLTWPPPSKKERRA

SEQ ID NO: 90115 - protein, 14 aa, Mycobacterium tuberculosis
LTWPPPSKKERRAQ

SEQ ID NO: 90116 - protein, 14 aa, Mycobacterium tuberculosis
TWPPPSKKERRAQH

SEQ ID NO: 90117 - protein, 14 aa, Mycobacterium tuberculosis
WPPPSKKERRAQHR

SEQ ID NO: 90118 - protein, 14 aa, Mycobacterium tuberculosis
PPPSKKERRAQHRK

SEQ ID NO: 90119 - protein, 14 aa, Mycobacterium tuberculosis
PPSKKERRAQHRKE

SEQ ID NO: 90120 - protein, 14 aa, Mycobacterium tuberculosis
PSKKERRAQHRKEG

SEQ ID NO: 90121 - protein, 14 aa, Mycobacterium tuberculosis
SKKERRAQHRKEGA

SEQ ID NO: 90122 - protein, 14 aa, Mycobacterium tuberculosis
KKERRAQHRKEGAQ

SEQ ID NO: 90123 - protein, 15 aa, Mycobacterium tuberculosis
MNSAIIKIAKWAQSQ

SEQ ID NO: 90124 - protein, 15 aa, Mycobacterium tuberculosis
NSAIIKIAKWAQSQQ

SEQ ID NO: 90125 - protein, 15 aa, Mycobacterium tuberculosis
SAIIKIAKWAQSQQW

SEQ ID NO: 90126 - protein, 15 aa, Mycobacterium tuberculosis
AIIKIAKWAQSQQWT

SEQ ID NO: 90127 - protein, 15 aa, Mycobacterium tuberculosis
IIKIAKWAQSQQWTV

SEQ ID NO: 90128 - protein, 15 aa, Mycobacterium tuberculosis
IKIAKWAQSQQWTVE

SEQ ID NO: 90129 - protein, 15 aa, Mycobacterium tuberculosis
KIAKWAQSQQWTVED

SEQ ID NO: 90130 - protein, 15 aa, Mycobacterium tuberculosis
IAKWAQSQQWTVEDD

SEQ ID NO: 90131 - protein, 15 aa, Mycobacterium tuberculosis
AKWAQSQQWTVEDDA

SEQ ID NO: 90132 - protein, 15 aa, Mycobacterium tuberculosis
KWAQSQQWTVEDDAS

SEQ ID NO: 90133 - protein, 15 aa, Mycobacterium tuberculosis
WAQSQQWTVEDDASG

SEQ ID NO: 90134 - protein, 15 aa, Mycobacterium tuberculosis
AQSQQWTVEDDASGY

SEQ ID NO: 90135 - protein, 15 aa, Mycobacterium tuberculosis
QSQQWTVEDDASGYT

SEQ ID NO: 90136 - protein, 15 aa, Mycobacterium tuberculosis
SQQWTVEDDASGYTR

SEQ ID NO: 90137 - protein, 15 aa, Mycobacterium tuberculosis
QQWTVEDDASGYTRF

SEQ ID NO: 90138 - protein, 15 aa, Mycobacterium tuberculosis
QWTVEDDASGYTRFY

SEQ ID NO: 90139 - protein, 15 aa, Mycobacterium tuberculosis
WTVEDDASGYTRFYN

SEQ ID NO: 90140 - protein, 15 aa, Mycobacterium tuberculosis
TVEDDASGYTRFYNP

SEQ ID NO: 90141 - protein, 15 aa, Mycobacterium tuberculosis
VEDDASGYTRFYNPQ

SEQ ID NO: 90142 - protein, 15 aa, Mycobacterium tuberculosis
EDDASGYTRFYNPQG

SEQ ID NO: 90143 - protein, 15 aa, Mycobacterium tuberculosis
DDASGYTRFYNPQGV

SEQ ID NO: 90144 - protein, 15 aa, Mycobacterium tuberculosis
DASGYTRFYNPQGVY

SEQ ID NO: 90145 - protein, 15 aa, Mycobacterium tuberculosis
ASGYTRFYNPQGVYI

SEQ ID NO: 90146 - protein, 15 aa, Mycobacterium tuberculosis
SGYTRFYNPQGVYIA

SEQ ID NO: 90147 - protein, 15 aa, Mycobacterium tuberculosis
GYTRFYNPQGVYIAR

SEQ ID NO: 90148 - protein, 15 aa, Mycobacterium tuberculosis
YTRFYNPQGVYIARF

SEQ ID NO: 90149 - protein, 15 aa, Mycobacterium tuberculosis
TRFYNPQGVYIARFP

SEQ ID NO: 90150 - protein, 15 aa, Mycobacterium tuberculosis
RFYNPQGVYIARFPA

SEQ ID NO: 90151 - protein, 15 aa, Mycobacterium tuberculosis
FYNPQGVYIARFPAT

SEQ ID NO: 90152 - protein, 15 aa, Mycobacterium tuberculosis
YNPQGVYIARFPATP

SEQ ID NO: 90153 - protein, 15 aa, Mycobacterium tuberculosis
NPQGVYIARFPATPS

SEQ ID NO: 90154 - protein, 15 aa, Mycobacterium tuberculosis
PQGVYIARFPATPSN

SEQ ID NO: 90155 - protein, 15 aa, Mycobacterium tuberculosis
QGVYIARFPATPSNE

SEQ ID NO: 90156 - protein, 15 aa, Mycobacterium tuberculosis
GVYIARFPATPSNEY

SEQ ID NO: 90157 - protein, 15 aa, Mycobacterium tuberculosis
VYIARFPATPSNEYR

SEQ ID NO: 90158 - protein, 15 aa, Mycobacterium tuberculosis
YIARFPATPSNEYRR

SEQ ID NO: 90159 - protein, 15 aa, Mycobacterium tuberculosis
IARFPATPSNEYRRM

SEQ ID NO: 90160 - protein, 15 aa, Mycobacterium tuberculosis
ARFPATPSNEYRRMR

SEQ ID NO: 90161 - protein, 15 aa, Mycobacterium tuberculosis
RFPATPSNEYRRMRD

SEQ ID NO: 90162 - protein, 15 aa, Mycobacterium tuberculosis
FPATPSNEYRRMRDL

SEQ ID NO: 90163 - protein, 15 aa, Mycobacterium tuberculosis
PATPSNEYRRMRDLL

SEQ ID NO: 90164 - protein, 15 aa, Mycobacterium tuberculosis
ATPSNEYRRMRDLLG

SEQ ID NO: 90165 - protein, 15 aa, Mycobacterium tuberculosis
TPSNEYRRMRDLLGA

SEQ ID NO: 90166 - protein, 15 aa, Mycobacterium tuberculosis
PSNEYRRMRDLLGAL

SEQ ID NO: 90167 - protein, 15 aa, Mycobacterium tuberculosis
SNEYRRMRDLLGALK

SEQ ID NO: 90168 - protein, 15 aa, Mycobacterium tuberculosis
NEYRRMRDLLGALKK

SEQ ID NO: 90169 - protein, 15 aa, Mycobacterium tuberculosis
EYRRMRDLLGALKKA

SEQ ID NO: 90170 - protein, 15 aa, Mycobacterium tuberculosis
YRRMRDLLGALKKAG

SEQ ID NO: 90171 - protein, 15 aa, Mycobacterium tuberculosis
RRMRDLLGALKKAGL

SEQ ID NO: 90172 - protein, 15 aa, Mycobacterium tuberculosis
RMRDLLGALKKAGLT

SEQ ID NO: 90173 - protein, 15 aa, Mycobacterium tuberculosis
MRDLLGALKKAGLTW

SEQ ID NO: 90174 - protein, 15 aa, Mycobacterium tuberculosis
RDLLGALKKAGLTWP

SEQ ID NO: 90175 - protein, 15 aa, Mycobacterium tuberculosis
DLLGALKKAGLTWPP

SEQ ID NO: 90176 - protein, 15 aa, Mycobacterium tuberculosis
LLGALKKAGLTWPPP

SEQ ID NO: 90177 - protein, 15 aa, Mycobacterium tuberculosis
LGALKKAGLTWPPPS

SEQ ID NO: 90178 - protein, 15 aa, Mycobacterium tuberculosis
GALKKAGLTWPPPSK

SEQ ID NO: 90179 - protein, 15 aa, Mycobacterium tuberculosis
ALKKAGLTWPPPSKK

SEQ ID NO: 90180 - protein, 15 aa, Mycobacterium tuberculosis
LKKAGLTWPPPSKKE

SEQ ID NO: 90181 - protein, 15 aa, Mycobacterium tuberculosis
KKAGLTWPPPSKKER

SEQ ID NO: 90182 - protein, 15 aa, Mycobacterium tuberculosis
KAGLTWPPPSKKERR

SEQ ID NO: 90183 - protein, 15 aa, Mycobacterium tuberculosis
AGLTWPPPSKKERRA

SEQ ID NO: 90184 - protein, 15 aa, Mycobacterium tuberculosis
GLTWPPPSKKERRAQ

SEQ ID NO: 90185 - protein, 15 aa, Mycobacterium tuberculosis
LTWPPPSKKERRAQH

SEQ ID NO: 90186 - protein, 15 aa, Mycobacterium tuberculosis
TWPPPSKKERRAQHR

SEQ ID NO: 90187 - protein, 15 aa, Mycobacterium tuberculosis
WPPPSKKERRAQHRK

SEQ ID NO: 90188 - protein, 15 aa, Mycobacterium tuberculosis
PPPSKKERRAQHRKE

SEQ ID NO: 90189 - protein, 15 aa, Mycobacterium tuberculosis
PPSKKERRAQHRKEG

SEQ ID NO: 90190 - protein, 15 aa, Mycobacterium tuberculosis
PSKKERRAQHRKEGA

SEQ ID NO: 90191 - protein, 15 aa, Mycobacterium tuberculosis
SKKERRAQHRKEGAQ

SEQ ID NO: 90192 - protein, 16 aa, Mycobacterium tuberculosis
MNSAIIKIAKWAQSQQ

SEQ ID NO: 90193 - protein, 16 aa, Mycobacterium tuberculosis
NSAIIKIAKWAQSQQW

SEQ ID NO: 90194 - protein, 16 aa, Mycobacterium tuberculosis
SAIIKIAKWAQSQQWT

SEQ ID NO: 90195 - protein, 16 aa, Mycobacterium tuberculosis
AIIKIAKWAQSQQWTV

SEQ ID NO: 90196 - protein, 16 aa, Mycobacterium tuberculosis
IIKIAKWAQSQQWTVE

SEQ ID NO: 90197 - protein, 16 aa, Mycobacterium tuberculosis
IKIAKWAQSQQWTVED

SEQ ID NO: 90198 - protein, 16 aa, Mycobacterium tuberculosis
KIAKWAQSQQWTVEDD

SEQ ID NO: 90199 - protein, 16 aa, Mycobacterium tuberculosis
IAKWAQSQQWTVEDDA

SEQ ID NO: 90200 - protein, 16 aa, Mycobacterium tuberculosis
AKWAQSQQWTVEDDAS

SEQ ID NO: 90201 - protein, 16 aa, Mycobacterium tuberculosis
KWAQSQQWTVEDDASG

SEQ ID NO: 90202 - protein, 16 aa, Mycobacterium tuberculosis
WAQSQQWTVEDDASGY

SEQ ID NO: 90203 - protein, 16 aa, Mycobacterium tuberculosis
AQSQQWTVEDDASGYT

SEQ ID NO: 90204 - protein, 16 aa, Mycobacterium tuberculosis
QSQQWTVEDDASGYTR

SEQ ID NO: 90205 - protein, 16 aa, Mycobacterium tuberculosis
SQQWTVEDDASGYTRF

SEQ ID NO: 90206 - protein, 16 aa, Mycobacterium tuberculosis
QQWTVEDDASGYTRFY

SEQ ID NO: 90207 - protein, 16 aa, Mycobacterium tuberculosis
QWTVEDDASGYTRFYN

SEQ ID NO: 90208 - protein, 16 aa, Mycobacterium tuberculosis
WTVEDDASGYTRFYNP

SEQ ID NO: 90209 - protein, 16 aa, Mycobacterium tuberculosis
TVEDDASGYTRFYNPQ

SEQ ID NO: 90210 - protein, 16 aa, Mycobacterium tuberculosis
VEDDASGYTRFYNPQG

SEQ ID NO: 90211 - protein, 16 aa, Mycobacterium tuberculosis
EDDASGYTRFYNPQGV

SEQ ID NO: 90212 - protein, 16 aa, Mycobacterium tuberculosis
DDASGYTRFYNPQGVY

SEQ ID NO: 90213 - protein, 16 aa, Mycobacterium tuberculosis
DASGYTRFYNPQGVYI

SEQ ID NO: 90214 - protein, 16 aa, Mycobacterium tuberculosis
ASGYTRFYNPQGVYIA

SEQ ID NO: 90215 - protein, 16 aa, Mycobacterium tuberculosis
SGYTRFYNPQGVYIAR

SEQ ID NO: 90216 - protein, 16 aa, Mycobacterium tuberculosis
GYTRFYNPQGVYIARF

SEQ ID NO: 90217 - protein, 16 aa, Mycobacterium tuberculosis
YTRFYNPQGVYIARFP

SEQ ID NO: 90218 - protein, 16 aa, Mycobacterium tuberculosis
TRFYNPQGVYIARFPA

SEQ ID NO: 90219 - protein, 16 aa, Mycobacterium tuberculosis
RFYNPQGVYIARFPAT

SEQ ID NO: 90220 - protein, 16 aa, Mycobacterium tuberculosis
FYNPQGVYIARFPATP

SEQ ID NO: 90221 - protein, 16 aa, Mycobacterium tuberculosis
YNPQGVYIARFPATPS

SEQ ID NO: 90222 - protein, 16 aa, Mycobacterium tuberculosis
NPQGVYIARFPATPSN

SEQ ID NO: 90223 - protein, 16 aa, Mycobacterium tuberculosis
PQGVYIARFPATPSNE

SEQ ID NO: 90224 - protein, 16 aa, Mycobacterium tuberculosis
QGVYIARFPATPSNEY

SEQ ID NO: 90225 - protein, 16 aa, Mycobacterium tuberculosis
GVYIARFPATPSNEYR

SEQ ID NO: 90226 - protein, 16 aa, Mycobacterium tuberculosis
VYIARFPATPSNEYRR

SEQ ID NO: 90227 - protein, 16 aa, Mycobacterium tuberculosis
YIARFPATPSNEYRRM

SEQ ID NO: 90228 - protein, 16 aa, Mycobacterium tuberculosis
IARFPATPSNEYRRMR

SEQ ID NO: 90229 - protein, 16 aa, Mycobacterium tuberculosis
ARFPATPSNEYRRMRD

SEQ ID NO: 90230 - protein, 16 aa, Mycobacterium tuberculosis
RFPATPSNEYRRMRDL

SEQ ID NO: 90231 - protein, 16 aa, Mycobacterium tuberculosis
FPATPSNEYRRMRDLL

SEQ ID NO: 90232 - protein, 16 aa, Mycobacterium tuberculosis
PATPSNEYRRMRDLLG

SEQ ID NO: 90233 - protein, 16 aa, Mycobacterium tuberculosis
ATPSNEYRRMRDLLGA

SEQ ID NO: 90234 - protein, 16 aa, Mycobacterium tuberculosis
TPSNEYRRMRDLLGAL

SEQ ID NO: 90235 - protein, 16 aa, Mycobacterium tuberculosis
PSNEYRRMRDLLGALK

SEQ ID NO: 90236 - protein, 16 aa, Mycobacterium tuberculosis
SNEYRRMRDLLGALKK

SEQ ID NO: 90237 - protein, 16 aa, Mycobacterium tuberculosis
NEYRRMRDLLGALKKA

SEQ ID NO: 90238 - protein, 16 aa, Mycobacterium tuberculosis
EYRRMRDLLGALKKAG

SEQ ID NO: 90239 - protein, 16 aa, Mycobacterium tuberculosis
YRRMRDLLGALKKAGL

SEQ ID NO: 90240 - protein, 16 aa, Mycobacterium tuberculosis
RRMRDLLGALKKAGLT

SEQ ID NO: 90241 - protein, 16 aa, Mycobacterium tuberculosis
RMRDLLGALKKAGLTW

SEQ ID NO: 90242 - protein, 16 aa, Mycobacterium tuberculosis
MRDLLGALKKAGLTWP

SEQ ID NO: 90243 - protein, 16 aa, Mycobacterium tuberculosis
RDLLGALKKAGLTWPP

SEQ ID NO: 90244 - protein, 16 aa, Mycobacterium tuberculosis
DLLGALKKAGLTWPPP

SEQ ID NO: 90245 - protein, 16 aa, Mycobacterium tuberculosis
LLGALKKAGLTWPPPS

SEQ ID NO: 90246 - protein, 16 aa, Mycobacterium tuberculosis
LGALKKAGLTWPPPSK

SEQ ID NO: 90247 - protein, 16 aa, Mycobacterium tuberculosis
GALKKAGLTWPPPSKK

SEQ ID NO: 90248 - protein, 16 aa, Mycobacterium tuberculosis
ALKKAGLTWPPPSKKE

SEQ ID NO: 90249 - protein, 16 aa, Mycobacterium tuberculosis
LKKAGLTWPPPSKKER

SEQ ID NO: 90250 - protein, 16 aa, Mycobacterium tuberculosis
KKAGLTWPPPSKKERR

SEQ ID NO: 90251 - protein, 16 aa, Mycobacterium tuberculosis
KAGLTWPPPSKKERRA

SEQ ID NO: 90252 - protein, 16 aa, Mycobacterium tuberculosis
AGLTWPPPSKKERRAQ

SEQ ID NO: 90253 - protein, 16 aa, Mycobacterium tuberculosis
GLTWPPPSKKERRAQH

SEQ ID NO: 90254 - protein, 16 aa, Mycobacterium tuberculosis
LTWPPPSKKERRAQHR

SEQ ID NO: 90255 - protein, 16 aa, Mycobacterium tuberculosis
TWPPPSKKERRAQHRK

SEQ ID NO: 90256 - protein, 16 aa, Mycobacterium tuberculosis
WPPPSKKERRAQHRKE

SEQ ID NO: 90257 - protein, 16 aa, Mycobacterium tuberculosis
PPPSKKERRAQHRKEG

SEQ ID NO: 90258 - protein, 16 aa, Mycobacterium tuberculosis
PPSKKERRAQHRKEGA

SEQ ID NO: 90259 - protein, 16 aa, Mycobacterium tuberculosis
PSKKERRAQHRKEGAQ

SEQ ID NO: 90260 - protein, 13 aa, Mycobacterium tuberculosis
MTVKRTTIELDED

SEQ ID NO: 90261 - protein, 13 aa, Mycobacterium tuberculosis
TVKRTTIELDEDL

SEQ ID NO: 90262 - protein, 13 aa, Mycobacterium tuberculosis
VKRTTIELDEDLV

SEQ ID NO: 90263 - protein, 13 aa, Mycobacterium tuberculosis
KRTTIELDEDLVR

SEQ ID NO: 90264 - protein, 13 aa, Mycobacterium tuberculosis
RTTIELDEDLVRA

SEQ ID NO: 90265 - protein, 13 aa, Mycobacterium tuberculosis
TTIELDEDLVRAA

SEQ ID NO: 90266 - protein, 13 aa, Mycobacterium tuberculosis
TIELDEDLVRAAQ

SEQ ID NO: 90267 - protein, 13 aa, Mycobacterium tuberculosis
IELDEDLVRAAQA

SEQ ID NO: 90268 - protein, 13 aa, Mycobacterium tuberculosis
ELDEDLVRAAQAV

SEQ ID NO: 90269 - protein, 13 aa, Mycobacterium tuberculosis
LDEDLVRAAQAVT

SEQ ID NO: 90270 - protein, 13 aa, Mycobacterium tuberculosis
DEDLVRAAQAVTG

SEQ ID NO: 90271 - protein, 13 aa, Mycobacterium tuberculosis
EDLVRAAQAVTGE

SEQ ID NO: 90272 - protein, 13 aa, Mycobacterium tuberculosis
DLVRAAQAVTGET

SEQ ID NO: 90273 - protein, 13 aa, Mycobacterium tuberculosis
LVRAAQAVTGETL

SEQ ID NO: 90274 - protein, 13 aa, Mycobacterium tuberculosis
VRAAQAVTGETLR

SEQ ID NO: 90275 - protein, 13 aa, Mycobacterium tuberculosis
RAAQAVTGETLRA

SEQ ID NO: 90276 - protein, 13 aa, Mycobacterium tuberculosis
AAQAVTGETLRAT

SEQ ID NO: 90277 - protein, 13 aa, Mycobacterium tuberculosis
AQAVTGETLRATV

SEQ ID NO: 90278 - protein, 13 aa, Mycobacterium tuberculosis
QAVTGETLRATVE

SEQ ID NO: 90279 - protein, 13 aa, Mycobacterium tuberculosis
AVTGETLRATVER

SEQ ID NO: 90280 - protein, 13 aa, Mycobacterium tuberculosis
VTGETLRATVERA

SEQ ID NO: 90281 - protein, 13 aa, Mycobacterium tuberculosis
TGETLRATVERAL

SEQ ID NO: 90282 - protein, 13 aa, Mycobacterium tuberculosis
GETLRATVERALQ

SEQ ID NO: 90283 - protein, 13 aa, Mycobacterium tuberculosis
ETLRATVERALQQ

SEQ ID NO: 90284 - protein, 13 aa, Mycobacterium tuberculosis
TLRATVERALQQL

SEQ ID NO: 90285 - protein, 13 aa, Mycobacterium tuberculosis
LRATVERALQQLV

SEQ ID NO: 90286 - protein, 13 aa, Mycobacterium tuberculosis
RATVERALQQLVA

SEQ ID NO: 90287 - protein, 13 aa, Mycobacterium tuberculosis
ATVERALQQLVAA

SEQ ID NO: 90288 - protein, 13 aa, Mycobacterium tuberculosis
TVERALQQLVAAA

SEQ ID NO: 90289 - protein, 13 aa, Mycobacterium tuberculosis
VERALQQLVAAAA

SEQ ID NO: 90290 - protein, 13 aa, Mycobacterium tuberculosis
ERALQQLVAAAAE

SEQ ID NO: 90291 - protein, 13 aa, Mycobacterium tuberculosis
RALQQLVAAAAEQ

SEQ ID NO: 90292 - protein, 13 aa, Mycobacterium tuberculosis
ALQQLVAAAAEQA

SEQ ID NO: 90293 - protein, 13 aa, Mycobacterium tuberculosis
LQQLVAAAAEQAA

SEQ ID NO: 90294 - protein, 13 aa, Mycobacterium tuberculosis
QQLVAAAAEQAAA

SEQ ID NO: 90295 - protein, 13 aa, Mycobacterium tuberculosis
QLVAAAAEQAAAR

SEQ ID NO: 90296 - protein, 13 aa, Mycobacterium tuberculosis
LVAAAAEQAAARR

SEQ ID NO: 90297 - protein, 13 aa, Mycobacterium tuberculosis
VAAAAEQAAARRR

SEQ ID NO: 90298 - protein, 13 aa, Mycobacterium tuberculosis
AAAAEQAAARRRR

SEQ ID NO: 90299 - protein, 13 aa, Mycobacterium tuberculosis
AAAEQAAARRRRI

SEQ ID NO: 90300 - protein, 13 aa, Mycobacterium tuberculosis
AAEQAAARRRRIV

SEQ ID NO: 90301 - protein, 13 aa, Mycobacterium tuberculosis
AEQAAARRRRIVD

SEQ ID NO: 90302 - protein, 13 aa, Mycobacterium tuberculosis
EQAAARRRRIVDH

SEQ ID NO: 90303 - protein, 13 aa, Mycobacterium tuberculosis
QAAARRRRIVDHL

SEQ ID NO: 90304 - protein, 13 aa, Mycobacterium tuberculosis
AAARRRRIVDHLA

SEQ ID NO: 90305 - protein, 13 aa, Mycobacterium tuberculosis
AARRRRIVDHLAH

SEQ ID NO: 90306 - protein, 13 aa, Mycobacterium tuberculosis
ARRRRIVDHLAHA

SEQ ID NO: 90307 - protein, 13 aa, Mycobacterium tuberculosis
RRRRIVDHLAHAG

SEQ ID NO: 90308 - protein, 13 aa, Mycobacterium tuberculosis
RRRIVDHLAHAGT

SEQ ID NO: 90309 - protein, 13 aa, Mycobacterium tuberculosis
RRIVDHLAHAGTH

SEQ ID NO: 90310 - protein, 13 aa, Mycobacterium tuberculosis
RIVDHLAHAGTHV

SEQ ID NO: 90311 - protein, 13 aa, Mycobacterium tuberculosis
IVDHLAHAGTHVD

SEQ ID NO: 90312 - protein, 13 aa, Mycobacterium tuberculosis
VDHLAHAGTHVDA

SEQ ID NO: 90313 - protein, 13 aa, Mycobacterium tuberculosis
DHLAHAGTHVDAD

SEQ ID NO: 90314 - protein, 13 aa, Mycobacterium tuberculosis
HLAHAGTHVDADV

SEQ ID NO: 90315 - protein, 13 aa, Mycobacterium tuberculosis
LAHAGTHVDADVL

SEQ ID NO: 90316 - protein, 13 aa, Mycobacterium tuberculosis
AHAGTHVDADVLL

SEQ ID NO: 90317 - protein, 13 aa, Mycobacterium tuberculosis
HAGTHVDADVLLS

SEQ ID NO: 90318 - protein, 13 aa, Mycobacterium tuberculosis
AGTHVDADVLLSE

SEQ ID NO: 90319 - protein, 13 aa, Mycobacterium tuberculosis
GTHVDADVLLSEQ

SEQ ID NO: 90320 - protein, 13 aa, Mycobacterium tuberculosis
THVDADVLLSEQA

SEQ ID NO: 90321 - protein, 13 aa, Mycobacterium tuberculosis
HVDADVLLSEQAW

SEQ ID NO: 90322 - protein, 13 aa, Mycobacterium tuberculosis
VDADVLLSEQAWR

SEQ ID NO: 90323 - protein, 14 aa, Mycobacterium tuberculosis
MTVKRTTIELDEDL

SEQ ID NO: 90324 - protein, 14 aa, Mycobacterium tuberculosis
TVKRTTIELDEDLV

SEQ ID NO: 90325 - protein, 14 aa, Mycobacterium tuberculosis
VKRTTIELDEDLVR

SEQ ID NO: 90326 - protein, 14 aa, Mycobacterium tuberculosis
KRTTIELDEDLVRA

SEQ ID NO: 90327 - protein, 14 aa, Mycobacterium tuberculosis
RTTIELDEDLVRAA

SEQ ID NO: 90328 - protein, 14 aa, Mycobacterium tuberculosis
TTIELDEDLVRAAQ

SEQ ID NO: 90329 - protein, 14 aa, Mycobacterium tuberculosis
TIELDEDLVRAAQA

SEQ ID NO: 90330 - protein, 14 aa, Mycobacterium tuberculosis
IELDEDLVRAAQAV

SEQ ID NO: 90331 - protein, 14 aa, Mycobacterium tuberculosis
ELDEDLVRAAQAVT

SEQ ID NO: 90332 - protein, 14 aa, Mycobacterium tuberculosis
LDEDLVRAAQAVTG

SEQ ID NO: 90333 - protein, 14 aa, Mycobacterium tuberculosis
DEDLVRAAQAVTGE

SEQ ID NO: 90334 - protein, 14 aa, Mycobacterium tuberculosis
EDLVRAAQAVTGET

SEQ ID NO: 90335 - protein, 14 aa, Mycobacterium tuberculosis
DLVRAAQAVTGETL

SEQ ID NO: 90336 - protein, 14 aa, Mycobacterium tuberculosis
LVRAAQAVTGETLR

SEQ ID NO: 90337 - protein, 14 aa, Mycobacterium tuberculosis
VRAAQAVTGETLRA

SEQ ID NO: 90338 - protein, 14 aa, Mycobacterium tuberculosis
RAAQAVTGETLRAT

SEQ ID NO: 90339 - protein, 14 aa, Mycobacterium tuberculosis
AAQAVTGETLRATV

SEQ ID NO: 90340 - protein, 14 aa, Mycobacterium tuberculosis
AQAVTGETLRATVE

SEQ ID NO: 90341 - protein, 14 aa, Mycobacterium tuberculosis
QAVTGETLRATVER

SEQ ID NO: 90342 - protein, 14 aa, Mycobacterium tuberculosis
AVTGETLRATVERA

SEQ ID NO: 90343 - protein, 14 aa, Mycobacterium tuberculosis
VTGETLRATVERAL

SEQ ID NO: 90344 - protein, 14 aa, Mycobacterium tuberculosis
TGETLRATVERALQ

SEQ ID NO: 90345 - protein, 14 aa, Mycobacterium tuberculosis
GETLRATVERALQQ

SEQ ID NO: 90346 - protein, 14 aa, Mycobacterium tuberculosis
ETLRATVERALQQL

SEQ ID NO: 90347 - protein, 14 aa, Mycobacterium tuberculosis
TLRATVERALQQLV

SEQ ID NO: 90348 - protein, 14 aa, Mycobacterium tuberculosis
LRATVERALQQLVA

SEQ ID NO: 90349 - protein, 14 aa, Mycobacterium tuberculosis
RATVERALQQLVAA

SEQ ID NO: 90350 - protein, 14 aa, Mycobacterium tuberculosis
ATVERALQQLVAAA

SEQ ID NO: 90351 - protein, 14 aa, Mycobacterium tuberculosis
TVERALQQLVAAAA

SEQ ID NO: 90352 - protein, 14 aa, Mycobacterium tuberculosis
VERALQQLVAAAAE

SEQ ID NO: 90353 - protein, 14 aa, Mycobacterium tuberculosis
ERALQQLVAAAAEQ

SEQ ID NO: 90354 - protein, 14 aa, Mycobacterium tuberculosis
RALQQLVAAAAEQA

SEQ ID NO: 90355 - protein, 14 aa, Mycobacterium tuberculosis
ALQQLVAAAAEQAA

SEQ ID NO: 90356 - protein, 14 aa, Mycobacterium tuberculosis
LQQLVAAAAEQAAA

SEQ ID NO: 90357 - protein, 14 aa, Mycobacterium tuberculosis
QQLVAAAAEQAAAR

SEQ ID NO: 90358 - protein, 14 aa, Mycobacterium tuberculosis
QLVAAAAEQAAARR

SEQ ID NO: 90359 - protein, 14 aa, Mycobacterium tuberculosis
LVAAAAEQAAARRR

SEQ ID NO: 90360 - protein, 14 aa, Mycobacterium tuberculosis
VAAAAEQAAARRRR

SEQ ID NO: 90361 - protein, 14 aa, Mycobacterium tuberculosis
AAAAEQAAARRRRI

SEQ ID NO: 90362 - protein, 14 aa, Mycobacterium tuberculosis
AAAEQAAARRRRIV

SEQ ID NO: 90363 - protein, 14 aa, Mycobacterium tuberculosis
AAEQAAARRRRIVD

SEQ ID NO: 90364 - protein, 14 aa, Mycobacterium tuberculosis
AEQAAARRRRIVDH

SEQ ID NO: 90365 - protein, 14 aa, Mycobacterium tuberculosis
EQAAARRRRIVDHL

SEQ ID NO: 90366 - protein, 14 aa, Mycobacterium tuberculosis
QAAARRRRIVDHLA

SEQ ID NO: 90367 - protein, 14 aa, Mycobacterium tuberculosis
AAARRRRIVDHLAH

SEQ ID NO: 90368 - protein, 14 aa, Mycobacterium tuberculosis
AARRRRIVDHLAHA

SEQ ID NO: 90369 - protein, 14 aa, Mycobacterium tuberculosis
ARRRRIVDHLAHAG

SEQ ID NO: 90370 - protein, 14 aa, Mycobacterium tuberculosis
RRRRIVDHLAHAGT

SEQ ID NO: 90371 - protein, 14 aa, Mycobacterium tuberculosis
RRRIVDHLAHAGTH

SEQ ID NO: 90372 - protein, 14 aa, Mycobacterium tuberculosis
RRIVDHLAHAGTHV

SEQ ID NO: 90373 - protein, 14 aa, Mycobacterium tuberculosis
RIVDHLAHAGTHVD

SEQ ID NO: 90374 - protein, 14 aa, Mycobacterium tuberculosis
IVDHLAHAGTHVDA

SEQ ID NO: 90375 - protein, 14 aa, Mycobacterium tuberculosis
VDHLAHAGTHVDAD

SEQ ID NO: 90376 - protein, 14 aa, Mycobacterium tuberculosis
DHLAHAGTHVDADV

SEQ ID NO: 90377 - protein, 14 aa, Mycobacterium tuberculosis
HLAHAGTHVDADVL

SEQ ID NO: 90378 - protein, 14 aa, Mycobacterium tuberculosis
LAHAGTHVDADVLL

SEQ ID NO: 90379 - protein, 14 aa, Mycobacterium tuberculosis
AHAGTHVDADVLLS

SEQ ID NO: 90380 - protein, 14 aa, Mycobacterium tuberculosis
HAGTHVDADVLLSE

SEQ ID NO: 90381 - protein, 14 aa, Mycobacterium tuberculosis
AGTHVDADVLLSEQ

SEQ ID NO: 90382 - protein, 14 aa, Mycobacterium tuberculosis
GTHVDADVLLSEQA

SEQ ID NO: 90383 - protein, 14 aa, Mycobacterium tuberculosis
THVDADVLLSEQAW

SEQ ID NO: 90384 - protein, 14 aa, Mycobacterium tuberculosis
HVDADVLLSEQAWR

SEQ ID NO: 90385 - protein, 15 aa, Mycobacterium tuberculosis
MTVKRTTIELDEDLV

SEQ ID NO: 90386 - protein, 15 aa, Mycobacterium tuberculosis
TVKRTTIELDEDLVR

SEQ ID NO: 90387 - protein, 15 aa, Mycobacterium tuberculosis
VKRTTIELDEDLVRA

SEQ ID NO: 90388 - protein, 15 aa, Mycobacterium tuberculosis
KRTTIELDEDLVRAA

SEQ ID NO: 90389 - protein, 15 aa, Mycobacterium tuberculosis
RTTIELDEDLVRAAQ

SEQ ID NO: 90390 - protein, 15 aa, Mycobacterium tuberculosis
TTIELDEDLVRAAQA

SEQ ID NO: 90391 - protein, 15 aa, Mycobacterium tuberculosis
TIELDEDLVRAAQAV

SEQ ID NO: 90392 - protein, 15 aa, Mycobacterium tuberculosis
IELDEDLVRAAQAVT

SEQ ID NO: 90393 - protein, 15 aa, Mycobacterium tuberculosis
ELDEDLVRAAQAVTG

SEQ ID NO: 90394 - protein, 15 aa, Mycobacterium tuberculosis
LDEDLVRAAQAVTGE

SEQ ID NO: 90395 - protein, 15 aa, Mycobacterium tuberculosis
DEDLVRAAQAVTGET

SEQ ID NO: 90396 - protein, 15 aa, Mycobacterium tuberculosis
EDLVRAAQAVTGETL

SEQ ID NO: 90397 - protein, 15 aa, Mycobacterium tuberculosis
DLVRAAQAVTGETLR

SEQ ID NO: 90398 - protein, 15 aa, Mycobacterium tuberculosis
LVRAAQAVTGETLRA

SEQ ID NO: 90399 - protein, 15 aa, Mycobacterium tuberculosis
VRAAQAVTGETLRAT

SEQ ID NO: 90400 - protein, 15 aa, Mycobacterium tuberculosis
RAAQAVTGETLRATV

SEQ ID NO: 90401 - protein, 15 aa, Mycobacterium tuberculosis
AAQAVTGETLRATVE

SEQ ID NO: 90402 - protein, 15 aa, Mycobacterium tuberculosis
AQAVTGETLRATVER

SEQ ID NO: 90403 - protein, 15 aa, Mycobacterium tuberculosis
QAVTGETLRATVERA

SEQ ID NO: 90404 - protein, 15 aa, Mycobacterium tuberculosis
AVTGETLRATVERAL

SEQ ID NO: 90405 - protein, 15 aa, Mycobacterium tuberculosis
VTGETLRATVERALQ

SEQ ID NO: 90406 - protein, 15 aa, Mycobacterium tuberculosis
TGETLRATVERALQQ

SEQ ID NO: 90407 - protein, 15 aa, Mycobacterium tuberculosis
GETLRATVERALQQL

SEQ ID NO: 90408 - protein, 15 aa, Mycobacterium tuberculosis
ETLRATVERALQQLV

SEQ ID NO: 90409 - protein, 15 aa, Mycobacterium tuberculosis
TLRATVERALQQLVA

SEQ ID NO: 90410 - protein, 15 aa, Mycobacterium tuberculosis
LRATVERALQQLVAA

SEQ ID NO: 90411 - protein, 15 aa, Mycobacterium tuberculosis
RATVERALQQLVAAA

SEQ ID NO: 90412 - protein, 15 aa, Mycobacterium tuberculosis
ATVERALQQLVAAAA

SEQ ID NO: 90413 - protein, 15 aa, Mycobacterium tuberculosis
TVERALQQLVAAAAE

SEQ ID NO: 90414 - protein, 15 aa, Mycobacterium tuberculosis
VERALQQLVAAAAEQ

SEQ ID NO: 90415 - protein, 15 aa, Mycobacterium tuberculosis
ERALQQLVAAAAEQA

SEQ ID NO: 90416 - protein, 15 aa, Mycobacterium tuberculosis
RALQQLVAAAAEQAA

SEQ ID NO: 90417 - protein, 15 aa, Mycobacterium tuberculosis
ALQQLVAAAAEQAAA

SEQ ID NO: 90418 - protein, 15 aa, Mycobacterium tuberculosis
LQQLVAAAAEQAAAR

SEQ ID NO: 90419 - protein, 15 aa, Mycobacterium tuberculosis
QQLVAAAAEQAAARR

SEQ ID NO: 90420 - protein, 15 aa, Mycobacterium tuberculosis
QLVAAAAEQAAARRR

SEQ ID NO: 90421 - protein, 15 aa, Mycobacterium tuberculosis
LVAAAAEQAAARRRR

SEQ ID NO: 90422 - protein, 15 aa, Mycobacterium tuberculosis
VAAAAEQAAARRRRI

SEQ ID NO: 90423 - protein, 15 aa, Mycobacterium tuberculosis
AAAAEQAAARRRRIV

SEQ ID NO: 90424 - protein, 15 aa, Mycobacterium tuberculosis
AAAEQAAARRRRIVD

SEQ ID NO: 90425 - protein, 15 aa, Mycobacterium tuberculosis
AAEQAAARRRRIVDH

SEQ ID NO: 90426 - protein, 15 aa, Mycobacterium tuberculosis
AEQAAARRRRIVDHL

SEQ ID NO: 90427 - protein, 15 aa, Mycobacterium tuberculosis
EQAAARRRRIVDHLA

SEQ ID NO: 90428 - protein, 15 aa, Mycobacterium tuberculosis
QAAARRRRIVDHLAH

SEQ ID NO: 90429 - protein, 15 aa, Mycobacterium tuberculosis
AAARRRRIVDHLAHA

SEQ ID NO: 90430 - protein, 15 aa, Mycobacterium tuberculosis
AARRRRIVDHLAHAG

SEQ ID NO: 90431 - protein, 15 aa, Mycobacterium tuberculosis
ARRRRIVDHLAHAGT

SEQ ID NO: 90432 - protein, 15 aa, Mycobacterium tuberculosis
RRRRIVDHLAHAGTH

SEQ ID NO: 90433 - protein, 15 aa, Mycobacterium tuberculosis
RRRIVDHLAHAGTHV

SEQ ID NO: 90434 - protein, 15 aa, Mycobacterium tuberculosis
RRIVDHLAHAGTHVD

SEQ ID NO: 90435 - protein, 15 aa, Mycobacterium tuberculosis
RIVDHLAHAGTHVDA

SEQ ID NO: 90436 - protein, 15 aa, Mycobacterium tuberculosis
IVDHLAHAGTHVDAD

SEQ ID NO: 90437 - protein, 15 aa, Mycobacterium tuberculosis
VDHLAHAGTHVDADV

SEQ ID NO: 90438 - protein, 15 aa, Mycobacterium tuberculosis
DHLAHAGTHVDADVL

SEQ ID NO: 90439 - protein, 15 aa, Mycobacterium tuberculosis
HLAHAGTHVDADVLL

SEQ ID NO: 90440 - protein, 15 aa, Mycobacterium tuberculosis
LAHAGTHVDADVLLS

SEQ ID NO: 90441 - protein, 15 aa, Mycobacterium tuberculosis
AHAGTHVDADVLLSE

SEQ ID NO: 90442 - protein, 15 aa, Mycobacterium tuberculosis
HAGTHVDADVLLSEQ

SEQ ID NO: 90443 - protein, 15 aa, Mycobacterium tuberculosis
AGTHVDADVLLSEQA

SEQ ID NO: 90444 - protein, 15 aa, Mycobacterium tuberculosis
GTHVDADVLLSEQAW

SEQ ID NO: 90445 - protein, 15 aa, Mycobacterium tuberculosis
THVDADVLLSEQAWR

SEQ ID NO: 90446 - protein, 16 aa, Mycobacterium tuberculosis
MTVKRTTIELDEDLVR

SEQ ID NO: 90447 - protein, 16 aa, Mycobacterium tuberculosis
TVKRTTIELDEDLVRA

SEQ ID NO: 90448 - protein, 16 aa, Mycobacterium tuberculosis
VKRTTIELDEDLVRAA

SEQ ID NO: 90449 - protein, 16 aa, Mycobacterium tuberculosis
KRTTIELDEDLVRAAQ

SEQ ID NO: 90450 - protein, 16 aa, Mycobacterium tuberculosis
RTTIELDEDLVRAAQA

SEQ ID NO: 90451 - protein, 16 aa, Mycobacterium tuberculosis
TTIELDEDLVRAAQAV

SEQ ID NO: 90452 - protein, 16 aa, Mycobacterium tuberculosis
TIELDEDLVRAAQAVT

SEQ ID NO: 90453 - protein, 16 aa, Mycobacterium tuberculosis
IELDEDLVRAAQAVTG

SEQ ID NO: 90454 - protein, 16 aa, Mycobacterium tuberculosis
ELDEDLVRAAQAVTGE

SEQ ID NO: 90455 - protein, 16 aa, Mycobacterium tuberculosis
LDEDLVRAAQAVTGET

SEQ ID NO: 90456 - protein, 16 aa, Mycobacterium tuberculosis
DEDLVRAAQAVTGETL

SEQ ID NO: 90457 - protein, 16 aa, Mycobacterium tuberculosis
EDLVRAAQAVTGETLR

SEQ ID NO: 90458 - protein, 16 aa, Mycobacterium tuberculosis
DLVRAAQAVTGETLRA

SEQ ID NO: 90459 - protein, 16 aa, Mycobacterium tuberculosis
LVRAAQAVTGETLRAT

SEQ ID NO: 90460 - protein, 16 aa, Mycobacterium tuberculosis
VRAAQAVTGETLRATV

SEQ ID NO: 90461 - protein, 16 aa, Mycobacterium tuberculosis
RAAQAVTGETLRATVE

SEQ ID NO: 90462 - protein, 16 aa, Mycobacterium tuberculosis
AAQAVTGETLRATVER

SEQ ID NO: 90463 - protein, 16 aa, Mycobacterium tuberculosis
AQAVTGETLRATVERA

SEQ ID NO: 90464 - protein, 16 aa, Mycobacterium tuberculosis
QAVTGETLRATVERAL

SEQ ID NO: 90465 - protein, 16 aa, Mycobacterium tuberculosis
AVTGETLRATVERALQ

SEQ ID NO: 90466 - protein, 16 aa, Mycobacterium tuberculosis
VTGETLRATVERALQQ

SEQ ID NO: 90467 - protein, 16 aa, Mycobacterium tuberculosis
TGETLRATVERALQQL

SEQ ID NO: 90468 - protein, 16 aa, Mycobacterium tuberculosis
GETLRATVERALQQLV

SEQ ID NO: 90469 - protein, 16 aa, Mycobacterium tuberculosis
ETLRATVERALQQLVA

SEQ ID NO: 90470 - protein, 16 aa, Mycobacterium tuberculosis
TLRATVERALQQLVAA

SEQ ID NO: 90471 - protein, 16 aa, Mycobacterium tuberculosis
LRATVERALQQLVAAA

SEQ ID NO: 90472 - protein, 16 aa, Mycobacterium tuberculosis
RATVERALQQLVAAAA

SEQ ID NO: 90473 - protein, 16 aa, Mycobacterium tuberculosis
ATVERALQQLVAAAAE

SEQ ID NO: 90474 - protein, 16 aa, Mycobacterium tuberculosis
TVERALQQLVAAAAEQ

SEQ ID NO: 90475 - protein, 16 aa, Mycobacterium tuberculosis
VERALQQLVAAAAEQA

SEQ ID NO: 90476 - protein, 16 aa, Mycobacterium tuberculosis
ERALQQLVAAAAEQAA

SEQ ID NO: 90477 - protein, 16 aa, Mycobacterium tuberculosis
RALQQLVAAAAEQAAA

SEQ ID NO: 90478 - protein, 16 aa, Mycobacterium tuberculosis
ALQQLVAAAAEQAAAR

SEQ ID NO: 90479 - protein, 16 aa, Mycobacterium tuberculosis
LQQLVAAAAEQAAARR

SEQ ID NO: 90480 - protein, 16 aa, Mycobacterium tuberculosis
QQLVAAAAEQAAARRR

SEQ ID NO: 90481 - protein, 16 aa, Mycobacterium tuberculosis
QLVAAAAEQAAARRRR

SEQ ID NO: 90482 - protein, 16 aa, Mycobacterium tuberculosis
LVAAAAEQAAARRRRI

SEQ ID NO: 90483 - protein, 16 aa, Mycobacterium tuberculosis
VAAAAEQAAARRRRIV

SEQ ID NO: 90484 - protein, 16 aa, Mycobacterium tuberculosis
AAAAEQAAARRRRIVD

SEQ ID NO: 90485 - protein, 16 aa, Mycobacterium tuberculosis
AAAEQAAARRRRIVDH

SEQ ID NO: 90486 - protein, 16 aa, Mycobacterium tuberculosis
AAEQAAARRRRIVDHL

SEQ ID NO: 90487 - protein, 16 aa, Mycobacterium tuberculosis
AEQAAARRRRIVDHLA

SEQ ID NO: 90488 - protein, 16 aa, Mycobacterium tuberculosis
EQAAARRRRIVDHLAH

SEQ ID NO: 90489 - protein, 16 aa, Mycobacterium tuberculosis
QAAARRRRIVDHLAHA

SEQ ID NO: 90490 - protein, 16 aa, Mycobacterium tuberculosis
AAARRRRIVDHLAHAG

SEQ ID NO: 90491 - protein, 16 aa, Mycobacterium tuberculosis
AARRRRIVDHLAHAGT

SEQ ID NO: 90492 - protein, 16 aa, Mycobacterium tuberculosis
ARRRRIVDHLAHAGTH

SEQ ID NO: 90493 - protein, 16 aa, Mycobacterium tuberculosis
RRRRIVDHLAHAGTHV

SEQ ID NO: 90494 - protein, 16 aa, Mycobacterium tuberculosis
RRRIVDHLAHAGTHVD

SEQ ID NO: 90495 - protein, 16 aa, Mycobacterium tuberculosis
RRIVDHLAHAGTHVDA

SEQ ID NO: 90496 - protein, 16 aa, Mycobacterium tuberculosis
RIVDHLAHAGTHVDAD

SEQ ID NO: 90497 - protein, 16 aa, Mycobacterium tuberculosis
IVDHLAHAGTHVDADV

SEQ ID NO: 90498 - protein, 16 aa, Mycobacterium tuberculosis
VDHLAHAGTHVDADVL

SEQ ID NO: 90499 - protein, 16 aa, Mycobacterium tuberculosis
DHLAHAGTHVDADVLL

SEQ ID NO: 90500 - protein, 16 aa, Mycobacterium tuberculosis
HLAHAGTHVDADVLLS

SEQ ID NO: 90501 - protein, 16 aa, Mycobacterium tuberculosis
LAHAGTHVDADVLLSE

SEQ ID NO: 90502 - protein, 16 aa, Mycobacterium tuberculosis
AHAGTHVDADVLLSEQ

SEQ ID NO: 90503 - protein, 16 aa, Mycobacterium tuberculosis
HAGTHVDADVLLSEQA

SEQ ID NO: 90504 - protein, 16 aa, Mycobacterium tuberculosis
AGTHVDADVLLSEQAW

SEQ ID NO: 90505 - protein, 16 aa, Mycobacterium tuberculosis
GTHVDADVLLSEQAWR

SEQ ID NO: 90506 - protein, 13 aa, Mycobacterium tuberculosis
MTGGATGALPRTM

SEQ ID NO: 90507 - protein, 13 aa, Mycobacterium tuberculosis
TGGATGALPRTMK

SEQ ID NO: 90508 - protein, 13 aa, Mycobacterium tuberculosis
GGATGALPRTMKE

SEQ ID NO: 90509 - protein, 13 aa, Mycobacterium tuberculosis
GATGALPRTMKEG

SEQ ID NO: 90510 - protein, 13 aa, Mycobacterium tuberculosis
ATGALPRTMKEGW

SEQ ID NO: 90511 - protein, 13 aa, Mycobacterium tuberculosis
TGALPRTMKEGWI

SEQ ID NO: 90512 - protein, 13 aa, Mycobacterium tuberculosis
GALPRTMKEGWIV

SEQ ID NO: 90513 - protein, 13 aa, Mycobacterium tuberculosis
ALPRTMKEGWIVY

SEQ ID NO: 90514 - protein, 13 aa, Mycobacterium tuberculosis
LPRTMKEGWIVYA

SEQ ID NO: 90515 - protein, 13 aa, Mycobacterium tuberculosis
PRTMKEGWIVYAR

SEQ ID NO: 90516 - protein, 13 aa, Mycobacterium tuberculosis
RTMKEGWIVYARS

SEQ ID NO: 90517 - protein, 13 aa, Mycobacterium tuberculosis
TMKEGWIVYARST

SEQ ID NO: 90518 - protein, 13 aa, Mycobacterium tuberculosis
MKEGWIVYARSTT

SEQ ID NO: 90519 - protein, 13 aa, Mycobacterium tuberculosis
KEGWIVYARSTTI

SEQ ID NO: 90520 - protein, 13 aa, Mycobacterium tuberculosis
EGWIVYARSTTIQ

SEQ ID NO: 90521 - protein, 13 aa, Mycobacterium tuberculosis
GWIVYARSTTIQA

SEQ ID NO: 90522 - protein, 13 aa, Mycobacterium tuberculosis
WIVYARSTTIQAQ

SEQ ID NO: 90523 - protein, 13 aa, Mycobacterium tuberculosis
IVYARSTTIQAQS

SEQ ID NO: 90524 - protein, 13 aa, Mycobacterium tuberculosis
VYARSTTIQAQSE

SEQ ID NO: 90525 - protein, 13 aa, Mycobacterium tuberculosis
YARSTTIQAQSEC

SEQ ID NO: 90526 - protein, 13 aa, Mycobacterium tuberculosis
ARSTTIQAQSECI

SEQ ID NO: 90527 - protein, 13 aa, Mycobacterium tuberculosis
RSTTIQAQSECID

SEQ ID NO: 90528 - protein, 13 aa, Mycobacterium tuberculosis
STTIQAQSECIDT

SEQ ID NO: 90529 - protein, 13 aa, Mycobacterium tuberculosis
TTIQAQSECIDTG

SEQ ID NO: 90530 - protein, 13 aa, Mycobacterium tuberculosis
TIQAQSECIDTGI

SEQ ID NO: 90531 - protein, 13 aa, Mycobacterium tuberculosis
IQAQSECIDTGIA

SEQ ID NO: 90532 - protein, 13 aa, Mycobacterium tuberculosis
QAQSECIDTGIAH

SEQ ID NO: 90533 - protein, 13 aa, Mycobacterium tuberculosis
AQSECIDTGIAHV

SEQ ID NO: 90534 - protein, 13 aa, Mycobacterium tuberculosis
QSECIDTGIAHVR

SEQ ID NO: 90535 - protein, 13 aa, Mycobacterium tuberculosis
SECIDTGIAHVRD

SEQ ID NO: 90536 - protein, 13 aa, Mycobacterium tuberculosis
ECIDTGIAHVRDV

SEQ ID NO: 90537 - protein, 13 aa, Mycobacterium tuberculosis
CIDTGIAHVRDVV

SEQ ID NO: 90538 - protein, 13 aa, Mycobacterium tuberculosis
IDTGIAHVRDVVM

SEQ ID NO: 90539 - protein, 13 aa, Mycobacterium tuberculosis
DTGIAHVRDVVMP

SEQ ID NO: 90540 - protein, 13 aa, Mycobacterium tuberculosis
TGIAHVRDVVMPA

SEQ ID NO: 90541 - protein, 13 aa, Mycobacterium tuberculosis
GIAHVRDVVMPAL

SEQ ID NO: 90542 - protein, 13 aa, Mycobacterium tuberculosis
IAHVRDVVMPALQ

SEQ ID NO: 90543 - protein, 13 aa, Mycobacterium tuberculosis
AHVRDVVMPALQG

SEQ ID NO: 90544 - protein, 13 aa, Mycobacterium tuberculosis
HVRDVVMPALQGM

SEQ ID NO: 90545 - protein, 13 aa, Mycobacterium tuberculosis
VRDVVMPALQGMD

SEQ ID NO: 90546 - protein, 13 aa, Mycobacterium tuberculosis
RDVVMPALQGMDG

SEQ ID NO: 90547 - protein, 13 aa, Mycobacterium tuberculosis
DVVMPALQGMDGC

SEQ ID NO: 90548 - protein, 13 aa, Mycobacterium tuberculosis
VVMPALQGMDGCI

SEQ ID NO: 90549 - protein, 13 aa, Mycobacterium tuberculosis
VMPALQGMDGCIG

SEQ ID NO: 90550 - protein, 13 aa, Mycobacterium tuberculosis
MPALQGMDGCIGV

SEQ ID NO: 90551 - protein, 13 aa, Mycobacterium tuberculosis
PALQGMDGCIGVS

SEQ ID NO: 90552 - protein, 13 aa, Mycobacterium tuberculosis
ALQGMDGCIGVSL

SEQ ID NO: 90553 - protein, 13 aa, Mycobacterium tuberculosis
LQGMDGCIGVSLL

SEQ ID NO: 90554 - protein, 13 aa, Mycobacterium tuberculosis
QGMDGCIGVSLLV

SEQ ID NO: 90555 - protein, 13 aa, Mycobacterium tuberculosis
GMDGCIGVSLLVD

SEQ ID NO: 90556 - protein, 13 aa, Mycobacterium tuberculosis
MDGCIGVSLLVDR

SEQ ID NO: 90557 - protein, 13 aa, Mycobacterium tuberculosis
DGCIGVSLLVDRQ

SEQ ID NO: 90558 - protein, 13 aa, Mycobacterium tuberculosis
GCIGVSLLVDRQS

SEQ ID NO: 90559 - protein, 13 aa, Mycobacterium tuberculosis
CIGVSLLVDRQSG

SEQ ID NO: 90560 - protein, 13 aa, Mycobacterium tuberculosis
IGVSLLVDRQSGR

SEQ ID NO: 90561 - protein, 13 aa, Mycobacterium tuberculosis
GVSLLVDRQSGRC

SEQ ID NO: 90562 - protein, 13 aa, Mycobacterium tuberculosis
VSLLVDRQSGRCI

SEQ ID NO: 90563 - protein, 13 aa, Mycobacterium tuberculosis
SLLVDRQSGRCIA

SEQ ID NO: 90564 - protein, 13 aa, Mycobacterium tuberculosis
LLVDRQSGRCIAT

SEQ ID NO: 90565 - protein, 13 aa, Mycobacterium tuberculosis
LVDRQSGRCIATS

SEQ ID NO: 90566 - protein, 13 aa, Mycobacterium tuberculosis
VDRQSGRCIATSA

SEQ ID NO: 90567 - protein, 13 aa, Mycobacterium tuberculosis
DRQSGRCIATSAW

SEQ ID NO: 90568 - protein, 13 aa, Mycobacterium tuberculosis
RQSGRCIATSAWE

SEQ ID NO: 90569 - protein, 13 aa, Mycobacterium tuberculosis
QSGRCIATSAWET

SEQ ID NO: 90570 - protein, 13 aa, Mycobacterium tuberculosis
SGRCIATSAWETA

SEQ ID NO: 90571 - protein, 13 aa, Mycobacterium tuberculosis
GRCIATSAWETAE

SEQ ID NO: 90572 - protein, 13 aa, Mycobacterium tuberculosis
RCIATSAWETAEA

SEQ ID NO: 90573 - protein, 13 aa, Mycobacterium tuberculosis
CIATSAWETAEAM

SEQ ID NO: 90574 - protein, 13 aa, Mycobacterium tuberculosis
IATSAWETAEAMH

SEQ ID NO: 90575 - protein, 13 aa, Mycobacterium tuberculosis
ATSAWETAEAMHA

SEQ ID NO: 90576 - protein, 13 aa, Mycobacterium tuberculosis
TSAWETAEAMHAS

SEQ ID NO: 90577 - protein, 13 aa, Mycobacterium tuberculosis
SAWETAEAMHASR

SEQ ID NO: 90578 - protein, 13 aa, Mycobacterium tuberculosis
AWETAEAMHASRE

SEQ ID NO: 90579 - protein, 13 aa, Mycobacterium tuberculosis
WETAEAMHASREQ

SEQ ID NO: 90580 - protein, 13 aa, Mycobacterium tuberculosis
ETAEAMHASREQV

SEQ ID NO: 90581 - protein, 13 aa, Mycobacterium tuberculosis
TAEAMHASREQVT

SEQ ID NO: 90582 - protein, 13 aa, Mycobacterium tuberculosis
AEAMHASREQVTP

SEQ ID NO: 90583 - protein, 13 aa, Mycobacterium tuberculosis
EAMHASREQVTPI

SEQ ID NO: 90584 - protein, 13 aa, Mycobacterium tuberculosis
AMHASREQVTPIR

SEQ ID NO: 90585 - protein, 13 aa, Mycobacterium tuberculosis
MHASREQVTPIRD

SEQ ID NO: 90586 - protein, 13 aa, Mycobacterium tuberculosis
HASREQVTPIRDR

SEQ ID NO: 90587 - protein, 13 aa, Mycobacterium tuberculosis
ASREQVTPIRDRC

SEQ ID NO: 90588 - protein, 13 aa, Mycobacterium tuberculosis
SREQVTPIRDRCA

SEQ ID NO: 90589 - protein, 13 aa, Mycobacterium tuberculosis
REQVTPIRDRCAE

SEQ ID NO: 90590 - protein, 13 aa, Mycobacterium tuberculosis
EQVTPIRDRCAEM

SEQ ID NO: 90591 - protein, 13 aa, Mycobacterium tuberculosis
QVTPIRDRCAEMF

SEQ ID NO: 90592 - protein, 13 aa, Mycobacterium tuberculosis
VTPIRDRCAEMFG

SEQ ID NO: 90593 - protein, 13 aa, Mycobacterium tuberculosis
TPIRDRCAEMFGG

SEQ ID NO: 90594 - protein, 13 aa, Mycobacterium tuberculosis
PIRDRCAEMFGGT

SEQ ID NO: 90595 - protein, 13 aa, Mycobacterium tuberculosis
IRDRCAEMFGGTP

SEQ ID NO: 90596 - protein, 13 aa, Mycobacterium tuberculosis
RDRCAEMFGGTPA

SEQ ID NO: 90597 - protein, 13 aa, Mycobacterium tuberculosis
DRCAEMFGGTPAV

SEQ ID NO: 90598 - protein, 13 aa, Mycobacterium tuberculosis
RCAEMFGGTPAVE

SEQ ID NO: 90599 - protein, 13 aa, Mycobacterium tuberculosis
CAEMFGGTPAVEE

SEQ ID NO: 90600 - protein, 13 aa, Mycobacterium tuberculosis
AEMFGGTPAVEEW

SEQ ID NO: 90601 - protein, 13 aa, Mycobacterium tuberculosis
EMFGGTPAVEEWE

SEQ ID NO: 90602 - protein, 13 aa, Mycobacterium tuberculosis
MFGGTPAVEEWEI

SEQ ID NO: 90603 - protein, 13 aa, Mycobacterium tuberculosis
FGGTPAVEEWEIA

SEQ ID NO: 90604 - protein, 13 aa, Mycobacterium tuberculosis
GGTPAVEEWEIAA

SEQ ID NO: 90605 - protein, 13 aa, Mycobacterium tuberculosis
GTPAVEEWEIAAM

SEQ ID NO: 90606 - protein, 13 aa, Mycobacterium tuberculosis
TPAVEEWEIAAMH

SEQ ID NO: 90607 - protein, 13 aa, Mycobacterium tuberculosis
PAVEEWEIAAMHR

SEQ ID NO: 90608 - protein, 13 aa, Mycobacterium tuberculosis
AVEEWEIAAMHRD

SEQ ID NO: 90609 - protein, 13 aa, Mycobacterium tuberculosis
VEEWEIAAMHRDH

SEQ ID NO: 90610 - protein, 13 aa, Mycobacterium tuberculosis
EEWEIAAMHRDHR

SEQ ID NO: 90611 - protein, 13 aa, Mycobacterium tuberculosis
EWEIAAMHRDHRS

SEQ ID NO: 90612 - protein, 13 aa, Mycobacterium tuberculosis
WEIAAMHRDHRSA

SEQ ID NO: 90613 - protein, 13 aa, Mycobacterium tuberculosis
EIAAMHRDHRSAE

SEQ ID NO: 90614 - protein, 13 aa, Mycobacterium tuberculosis
IAAMHRDHRSAEG

SEQ ID NO: 90615 - protein, 13 aa, Mycobacterium tuberculosis
AAMHRDHRSAEGA

SEQ ID NO: 90616 - protein, 13 aa, Mycobacterium tuberculosis
AMHRDHRSAEGAC

SEQ ID NO: 90617 - protein, 13 aa, Mycobacterium tuberculosis
MHRDHRSAEGACV

SEQ ID NO: 90618 - protein, 13 aa, Mycobacterium tuberculosis
HRDHRSAEGACVR

SEQ ID NO: 90619 - protein, 13 aa, Mycobacterium tuberculosis
RDHRSAEGACVRA

SEQ ID NO: 90620 - protein, 13 aa, Mycobacterium tuberculosis
DHRSAEGACVRAT

SEQ ID NO: 90621 - protein, 13 aa, Mycobacterium tuberculosis
HRSAEGACVRATW

SEQ ID NO: 90622 - protein, 13 aa, Mycobacterium tuberculosis
RSAEGACVRATWV

SEQ ID NO: 90623 - protein, 13 aa, Mycobacterium tuberculosis
SAEGACVRATWVK

SEQ ID NO: 90624 - protein, 13 aa, Mycobacterium tuberculosis
AEGACVRATWVKV

SEQ ID NO: 90625 - protein, 13 aa, Mycobacterium tuberculosis
EGACVRATWVKVP

SEQ ID NO: 90626 - protein, 13 aa, Mycobacterium tuberculosis
GACVRATWVKVPA

SEQ ID NO: 90627 - protein, 13 aa, Mycobacterium tuberculosis
ACVRATWVKVPAD

SEQ ID NO: 90628 - protein, 13 aa, Mycobacterium tuberculosis
CVRATWVKVPADQ

SEQ ID NO: 90629 - protein, 13 aa, Mycobacterium tuberculosis
VRATWVKVPADQV

SEQ ID NO: 90630 - protein, 13 aa, Mycobacterium tuberculosis
RATWVKVPADQVD

SEQ ID NO: 90631 - protein, 13 aa, Mycobacterium tuberculosis
ATWVKVPADQVDQ

SEQ ID NO: 90632 - protein, 13 aa, Mycobacterium tuberculosis
TWVKVPADQVDQG

SEQ ID NO: 90633 - protein, 13 aa, Mycobacterium tuberculosis
WVKVPADQVDQGI

SEQ ID NO: 90634 - protein, 13 aa, Mycobacterium tuberculosis
VKVPADQVDQGIE

SEQ ID NO: 90635 - protein, 13 aa, Mycobacterium tuberculosis
KVPADQVDQGIEY

SEQ ID NO: 90636 - protein, 13 aa, Mycobacterium tuberculosis
VPADQVDQGIEYY

SEQ ID NO: 90637 - protein, 13 aa, Mycobacterium tuberculosis
PADQVDQGIEYYK

SEQ ID NO: 90638 - protein, 13 aa, Mycobacterium tuberculosis
ADQVDQGIEYYKS

SEQ ID NO: 90639 - protein, 13 aa, Mycobacterium tuberculosis
DQVDQGIEYYKSS

SEQ ID NO: 90640 - protein, 13 aa, Mycobacterium tuberculosis
QVDQGIEYYKSSV

SEQ ID NO: 90641 - protein, 13 aa, Mycobacterium tuberculosis
VDQGIEYYKSSVL

SEQ ID NO: 90642 - protein, 13 aa, Mycobacterium tuberculosis
DQGIEYYKSSVLP

SEQ ID NO: 90643 - protein, 13 aa, Mycobacterium tuberculosis
QGIEYYKSSVLPQ

SEQ ID NO: 90644 - protein, 13 aa, Mycobacterium tuberculosis
GIEYYKSSVLPQI

SEQ ID NO: 90645 - protein, 13 aa, Mycobacterium tuberculosis
IEYYKSSVLPQIE

SEQ ID NO: 90646 - protein, 13 aa, Mycobacterium tuberculosis
EYYKSSVLPQIEG

SEQ ID NO: 90647 - protein, 13 aa, Mycobacterium tuberculosis
YYKSSVLPQIEGL

SEQ ID NO: 90648 - protein, 13 aa, Mycobacterium tuberculosis
YKSSVLPQIEGLD

SEQ ID NO: 90649 - protein, 13 aa, Mycobacterium tuberculosis
KSSVLPQIEGLDG

SEQ ID NO: 90650 - protein, 13 aa, Mycobacterium tuberculosis
SSVLPQIEGLDGF

SEQ ID NO: 90651 - protein, 13 aa, Mycobacterium tuberculosis
SVLPQIEGLDGFC

SEQ ID NO: 90652 - protein, 13 aa, Mycobacterium tuberculosis
VLPQIEGLDGFCS

SEQ ID NO: 90653 - protein, 13 aa, Mycobacterium tuberculosis
LPQIEGLDGFCSA

SEQ ID NO: 90654 - protein, 13 aa, Mycobacterium tuberculosis
PQIEGLDGFCSAS

SEQ ID NO: 90655 - protein, 13 aa, Mycobacterium tuberculosis
QIEGLDGFCSASL

SEQ ID NO: 90656 - protein, 13 aa, Mycobacterium tuberculosis
IEGLDGFCSASLL

SEQ ID NO: 90657 - protein, 13 aa, Mycobacterium tuberculosis
EGLDGFCSASLLV

SEQ ID NO: 90658 - protein, 13 aa, Mycobacterium tuberculosis
GLDGFCSASLLVD

SEQ ID NO: 90659 - protein, 13 aa, Mycobacterium tuberculosis
LDGFCSASLLVDR

SEQ ID NO: 90660 - protein, 13 aa, Mycobacterium tuberculosis
DGFCSASLLVDRT

SEQ ID NO: 90661 - protein, 13 aa, Mycobacterium tuberculosis
GFCSASLLVDRTS

SEQ ID NO: 90662 - protein, 13 aa, Mycobacterium tuberculosis
FCSASLLVDRTSG

SEQ ID NO: 90663 - protein, 13 aa, Mycobacterium tuberculosis
CSASLLVDRTSGR

SEQ ID NO: 90664 - protein, 13 aa, Mycobacterium tuberculosis
SASLLVDRTSGRA

SEQ ID NO: 90665 - protein, 13 aa, Mycobacterium tuberculosis
ASLLVDRTSGRAV

SEQ ID NO: 90666 - protein, 13 aa, Mycobacterium tuberculosis
SLLVDRTSGRAVS

SEQ ID NO: 90667 - protein, 13 aa, Mycobacterium tuberculosis
LLVDRTSGRAVSS

SEQ ID NO: 90668 - protein, 13 aa, Mycobacterium tuberculosis
LVDRTSGRAVSSA

SEQ ID NO: 90669 - protein, 13 aa, Mycobacterium tuberculosis
VDRTSGRAVSSAT

SEQ ID NO: 90670 - protein, 13 aa, Mycobacterium tuberculosis
DRTSGRAVSSATF

SEQ ID NO: 90671 - protein, 13 aa, Mycobacterium tuberculosis
RTSGRAVSSATFD

SEQ ID NO: 90672 - protein, 13 aa, Mycobacterium tuberculosis
TSGRAVSSATFDS

SEQ ID NO: 90673 - protein, 13 aa, Mycobacterium tuberculosis
SGRAVSSATFDSF

SEQ ID NO: 90674 - protein, 13 aa, Mycobacterium tuberculosis
GRAVSSATFDSFD

SEQ ID NO: 90675 - protein, 13 aa, Mycobacterium tuberculosis
RAVSSATFDSFDA

SEQ ID NO: 90676 - protein, 13 aa, Mycobacterium tuberculosis
AVSSATFDSFDAM

SEQ ID NO: 90677 - protein, 13 aa, Mycobacterium tuberculosis
VSSATFDSFDAME

SEQ ID NO: 90678 - protein, 13 aa, Mycobacterium tuberculosis
SSATFDSFDAMER

SEQ ID NO: 90679 - protein, 13 aa, Mycobacterium tuberculosis
SATFDSFDAMERN

SEQ ID NO: 90680 - protein, 13 aa, Mycobacterium tuberculosis
ATFDSFDAMERNR

SEQ ID NO: 90681 - protein, 13 aa, Mycobacterium tuberculosis
TFDSFDAMERNRD

SEQ ID NO: 90682 - protein, 13 aa, Mycobacterium tuberculosis
FDSFDAMERNRDQ

SEQ ID NO: 90683 - protein, 13 aa, Mycobacterium tuberculosis
DSFDAMERNRDQS

SEQ ID NO: 90684 - protein, 13 aa, Mycobacterium tuberculosis
SFDAMERNRDQSN

SEQ ID NO: 90685 - protein, 13 aa, Mycobacterium tuberculosis
FDAMERNRDQSNA

SEQ ID NO: 90686 - protein, 13 aa, Mycobacterium tuberculosis
DAMERNRDQSNAL

SEQ ID NO: 90687 - protein, 13 aa, Mycobacterium tuberculosis
AMERNRDQSNALK

SEQ ID NO: 90688 - protein, 13 aa, Mycobacterium tuberculosis
MERNRDQSNALKA

SEQ ID NO: 90689 - protein, 13 aa, Mycobacterium tuberculosis
ERNRDQSNALKAT

SEQ ID NO: 90690 - protein, 13 aa, Mycobacterium tuberculosis
RNRDQSNALKATS

SEQ ID NO: 90691 - protein, 13 aa, Mycobacterium tuberculosis
NRDQSNALKATSL

SEQ ID NO: 90692 - protein, 13 aa, Mycobacterium tuberculosis
RDQSNALKATSLR

SEQ ID NO: 90693 - protein, 13 aa, Mycobacterium tuberculosis
DQSNALKATSLRE

SEQ ID NO: 90694 - protein, 13 aa, Mycobacterium tuberculosis
QSNALKATSLREA

SEQ ID NO: 90695 - protein, 13 aa, Mycobacterium tuberculosis
SNALKATSLREAG

SEQ ID NO: 90696 - protein, 13 aa, Mycobacterium tuberculosis
NALKATSLREAGG

SEQ ID NO: 90697 - protein, 13 aa, Mycobacterium tuberculosis
ALKATSLREAGGE

SEQ ID NO: 90698 - protein, 13 aa, Mycobacterium tuberculosis
LKATSLREAGGEE

SEQ ID NO: 90699 - protein, 13 aa, Mycobacterium tuberculosis
KATSLREAGGEEL

SEQ ID NO: 90700 - protein, 13 aa, Mycobacterium tuberculosis
ATSLREAGGEELD

SEQ ID NO: 90701 - protein, 13 aa, Mycobacterium tuberculosis
TSLREAGGEELDE

SEQ ID NO: 90702 - protein, 13 aa, Mycobacterium tuberculosis
SLREAGGEELDEC

SEQ ID NO: 90703 - protein, 13 aa, Mycobacterium tuberculosis
LREAGGEELDECE

SEQ ID NO: 90704 - protein, 13 aa, Mycobacterium tuberculosis
REAGGEELDECEF

SEQ ID NO: 90705 - protein, 13 aa, Mycobacterium tuberculosis
EAGGEELDECEFE

SEQ ID NO: 90706 - protein, 13 aa, Mycobacterium tuberculosis
AGGEELDECEFEL

SEQ ID NO: 90707 - protein, 13 aa, Mycobacterium tuberculosis
GGEELDECEFELA

SEQ ID NO: 90708 - protein, 13 aa, Mycobacterium tuberculosis
GEELDECEFELAL

SEQ ID NO: 90709 - protein, 13 aa, Mycobacterium tuberculosis
EELDECEFELALA

SEQ ID NO: 90710 - protein, 13 aa, Mycobacterium tuberculosis
ELDECEFELALAH

SEQ ID NO: 90711 - protein, 13 aa, Mycobacterium tuberculosis
LDECEFELALAHL

SEQ ID NO: 90712 - protein, 13 aa, Mycobacterium tuberculosis
DECEFELALAHLR

SEQ ID NO: 90713 - protein, 13 aa, Mycobacterium tuberculosis
ECEFELALAHLRV

SEQ ID NO: 90714 - protein, 13 aa, Mycobacterium tuberculosis
CEFELALAHLRVP

SEQ ID NO: 90715 - protein, 13 aa, Mycobacterium tuberculosis
EFELALAHLRVPE

SEQ ID NO: 90716 - protein, 13 aa, Mycobacterium tuberculosis
FELALAHLRVPEL

SEQ ID NO: 90717 - protein, 13 aa, Mycobacterium tuberculosis
ELALAHLRVPELV

SEQ ID NO: 90718 - protein, 14 aa, Mycobacterium tuberculosis
MTGGATGALPRTMK

SEQ ID NO: 90719 - protein, 14 aa, Mycobacterium tuberculosis
TGGATGALPRTMKE

SEQ ID NO: 90720 - protein, 14 aa, Mycobacterium tuberculosis
GGATGALPRTMKEG

SEQ ID NO: 90721 - protein, 14 aa, Mycobacterium tuberculosis
GATGALPRTMKEGW

SEQ ID NO: 90722 - protein, 14 aa, Mycobacterium tuberculosis
ATGALPRTMKEGWI

SEQ ID NO: 90723 - protein, 14 aa, Mycobacterium tuberculosis
TGALPRTMKEGWIV

SEQ ID NO: 90724 - protein, 14 aa, Mycobacterium tuberculosis
GALPRTMKEGWIVY

SEQ ID NO: 90725 - protein, 14 aa, Mycobacterium tuberculosis
ALPRTMKEGWIVYA

SEQ ID NO: 90726 - protein, 14 aa, Mycobacterium tuberculosis
LPRTMKEGWIVYAR

SEQ ID NO: 90727 - protein, 14 aa, Mycobacterium tuberculosis
PRTMKEGWIVYARS

SEQ ID NO: 90728 - protein, 14 aa, Mycobacterium tuberculosis
RTMKEGWIVYARST

SEQ ID NO: 90729 - protein, 14 aa, Mycobacterium tuberculosis
TMKEGWIVYARSTT

SEQ ID NO: 90730 - protein, 14 aa, Mycobacterium tuberculosis
MKEGWIVYARSTTI

SEQ ID NO: 90731 - protein, 14 aa, Mycobacterium tuberculosis
KEGWIVYARSTTIQ

SEQ ID NO: 90732 - protein, 14 aa, Mycobacterium tuberculosis
EGWIVYARSTTIQA

SEQ ID NO: 90733 - protein, 14 aa, Mycobacterium tuberculosis
GWIVYARSTTIQAQ

SEQ ID NO: 90734 - protein, 14 aa, Mycobacterium tuberculosis
WIVYARSTTIQAQS

SEQ ID NO: 90735 - protein, 14 aa, Mycobacterium tuberculosis
IVYARSTTIQAQSE

SEQ ID NO: 90736 - protein, 14 aa, Mycobacterium tuberculosis
VYARSTTIQAQSEC

SEQ ID NO: 90737 - protein, 14 aa, Mycobacterium tuberculosis
YARSTTIQAQSECI

SEQ ID NO: 90738 - protein, 14 aa, Mycobacterium tuberculosis
ARSTTIQAQSECID

SEQ ID NO: 90739 - protein, 14 aa, Mycobacterium tuberculosis
RSTTIQAQSECIDT

SEQ ID NO: 90740 - protein, 14 aa, Mycobacterium tuberculosis
STTIQAQSECIDTG

SEQ ID NO: 90741 - protein, 14 aa, Mycobacterium tuberculosis
TTIQAQSECIDTGI

SEQ ID NO: 90742 - protein, 14 aa, Mycobacterium tuberculosis
TIQAQSECIDTGIA

SEQ ID NO: 90743 - protein, 14 aa, Mycobacterium tuberculosis
IQAQSECIDTGIAH

SEQ ID NO: 90744 - protein, 14 aa, Mycobacterium tuberculosis
QAQSECIDTGIAHV

SEQ ID NO: 90745 - protein, 14 aa, Mycobacterium tuberculosis
AQSECIDTGIAHVR

SEQ ID NO: 90746 - protein, 14 aa, Mycobacterium tuberculosis
QSECIDTGIAHVRD

SEQ ID NO: 90747 - protein, 14 aa, Mycobacterium tuberculosis
SECIDTGIAHVRDV

SEQ ID NO: 90748 - protein, 14 aa, Mycobacterium tuberculosis
ECIDTGIAHVRDVV

SEQ ID NO: 90749 - protein, 14 aa, Mycobacterium tuberculosis
CIDTGIAHVRDVVM

SEQ ID NO: 90750 - protein, 14 aa, Mycobacterium tuberculosis
IDTGIAHVRDVVMP

SEQ ID NO: 90751 - protein, 14 aa, Mycobacterium tuberculosis
DTGIAHVRDVVMPA

SEQ ID NO: 90752 - protein, 14 aa, Mycobacterium tuberculosis
TGIAHVRDVVMPAL

SEQ ID NO: 90753 - protein, 14 aa, Mycobacterium tuberculosis
GIAHVRDVVMPALQ

SEQ ID NO: 90754 - protein, 14 aa, Mycobacterium tuberculosis
IAHVRDVVMPALQG

SEQ ID NO: 90755 - protein, 14 aa, Mycobacterium tuberculosis
AHVRDVVMPALQGM

SEQ ID NO: 90756 - protein, 14 aa, Mycobacterium tuberculosis
HVRDVVMPALQGMD

SEQ ID NO: 90757 - protein, 14 aa, Mycobacterium tuberculosis
VRDVVMPALQGMDG

SEQ ID NO: 90758 - protein, 14 aa, Mycobacterium tuberculosis
RDVVMPALQGMDGC

SEQ ID NO: 90759 - protein, 14 aa, Mycobacterium tuberculosis
DVVMPALQGMDGCI

SEQ ID NO: 90760 - protein, 14 aa, Mycobacterium tuberculosis
VVMPALQGMDGCIG

SEQ ID NO: 90761 - protein, 14 aa, Mycobacterium tuberculosis
VMPALQGMDGCIGV

SEQ ID NO: 90762 - protein, 14 aa, Mycobacterium tuberculosis
MPALQGMDGCIGVS

SEQ ID NO: 90763 - protein, 14 aa, Mycobacterium tuberculosis
PALQGMDGCIGVSL

SEQ ID NO: 90764 - protein, 14 aa, Mycobacterium tuberculosis
ALQGMDGCIGVSLL

SEQ ID NO: 90765 - protein, 14 aa, Mycobacterium tuberculosis
LQGMDGCIGVSLLV

SEQ ID NO: 90766 - protein, 14 aa, Mycobacterium tuberculosis
QGMDGCIGVSLLVD

SEQ ID NO: 90767 - protein, 14 aa, Mycobacterium tuberculosis
GMDGCIGVSLLVDR

SEQ ID NO: 90768 - protein, 14 aa, Mycobacterium tuberculosis
MDGCIGVSLLVDRQ

SEQ ID NO: 90769 - protein, 14 aa, Mycobacterium tuberculosis
DGCIGVSLLVDRQS

SEQ ID NO: 90770 - protein, 14 aa, Mycobacterium tuberculosis
GCIGVSLLVDRQSG

SEQ ID NO: 90771 - protein, 14 aa, Mycobacterium tuberculosis
CIGVSLLVDRQSGR

SEQ ID NO: 90772 - protein, 14 aa, Mycobacterium tuberculosis
IGVSLLVDRQSGRC

SEQ ID NO: 90773 - protein, 14 aa, Mycobacterium tuberculosis
GVSLLVDRQSGRCI

SEQ ID NO: 90774 - protein, 14 aa, Mycobacterium tuberculosis
VSLLVDRQSGRCIA

SEQ ID NO: 90775 - protein, 14 aa, Mycobacterium tuberculosis
SLLVDRQSGRCIAT

SEQ ID NO: 90776 - protein, 14 aa, Mycobacterium tuberculosis
LLVDRQSGRCIATS

SEQ ID NO: 90777 - protein, 14 aa, Mycobacterium tuberculosis
LVDRQSGRCIATSA

SEQ ID NO: 90778 - protein, 14 aa, Mycobacterium tuberculosis
VDRQSGRCIATSAW

SEQ ID NO: 90779 - protein, 14 aa, Mycobacterium tuberculosis
DRQSGRCIATSAWE

SEQ ID NO: 90780 - protein, 14 aa, Mycobacterium tuberculosis
RQSGRCIATSAWET

SEQ ID NO: 90781 - protein, 14 aa, Mycobacterium tuberculosis
QSGRCIATSAWETA

SEQ ID NO: 90782 - protein, 14 aa, Mycobacterium tuberculosis
SGRCIATSAWETAE

SEQ ID NO: 90783 - protein, 14 aa, Mycobacterium tuberculosis
GRCIATSAWETAEA

SEQ ID NO: 90784 - protein, 14 aa, Mycobacterium tuberculosis
RCIATSAWETAEAM

SEQ ID NO: 90785 - protein, 14 aa, Mycobacterium tuberculosis
CIATSAWETAEAMH

SEQ ID NO: 90786 - protein, 14 aa, Mycobacterium tuberculosis
IATSAWETAEAMHA

SEQ ID NO: 90787 - protein, 14 aa, Mycobacterium tuberculosis
ATSAWETAEAMHAS

SEQ ID NO: 90788 - protein, 14 aa, Mycobacterium tuberculosis
TSAWETAEAMHASR

SEQ ID NO: 90789 - protein, 14 aa, Mycobacterium tuberculosis
SAWETAEAMHASRE

SEQ ID NO: 90790 - protein, 14 aa, Mycobacterium tuberculosis
AWETAEAMHASREQ

SEQ ID NO: 90791 - protein, 14 aa, Mycobacterium tuberculosis
WETAEAMHASREQV

SEQ ID NO: 90792 - protein, 14 aa, Mycobacterium tuberculosis
ETAEAMHASREQVT

SEQ ID NO: 90793 - protein, 14 aa, Mycobacterium tuberculosis
TAEAMHASREQVTP

SEQ ID NO: 90794 - protein, 14 aa, Mycobacterium tuberculosis
AEAMHASREQVTPI

SEQ ID NO: 90795 - protein, 14 aa, Mycobacterium tuberculosis
EAMHASREQVTPIR

SEQ ID NO: 90796 - protein, 14 aa, Mycobacterium tuberculosis
AMHASREQVTPIRD

SEQ ID NO: 90797 - protein, 14 aa, Mycobacterium tuberculosis
MHASREQVTPIRDR

SEQ ID NO: 90798 - protein, 14 aa, Mycobacterium tuberculosis
HASREQVTPIRDRC

SEQ ID NO: 90799 - protein, 14 aa, Mycobacterium tuberculosis
ASREQVTPIRDRCA

SEQ ID NO: 90800 - protein, 14 aa, Mycobacterium tuberculosis
SREQVTPIRDRCAE

SEQ ID NO: 90801 - protein, 14 aa, Mycobacterium tuberculosis
REQVTPIRDRCAEM

SEQ ID NO: 90802 - protein, 14 aa, Mycobacterium tuberculosis
EQVTPIRDRCAEMF

SEQ ID NO: 90803 - protein, 14 aa, Mycobacterium tuberculosis
QVTPIRDRCAEMFG

SEQ ID NO: 90804 - protein, 14 aa, Mycobacterium tuberculosis
VTPIRDRCAEMFGG

SEQ ID NO: 90805 - protein, 14 aa, Mycobacterium tuberculosis
TPIRDRCAEMFGGT

SEQ ID NO: 90806 - protein, 14 aa, Mycobacterium tuberculosis
PIRDRCAEMFGGTP

SEQ ID NO: 90807 - protein, 14 aa, Mycobacterium tuberculosis
IRDRCAEMFGGTPA

SEQ ID NO: 90808 - protein, 14 aa, Mycobacterium tuberculosis
RDRCAEMFGGTPAV

SEQ ID NO: 90809 - protein, 14 aa, Mycobacterium tuberculosis
DRCAEMFGGTPAVE

SEQ ID NO: 90810 - protein, 14 aa, Mycobacterium tuberculosis
RCAEMFGGTPAVEE

SEQ ID NO: 90811 - protein, 14 aa, Mycobacterium tuberculosis
CAEMFGGTPAVEEW

SEQ ID NO: 90812 - protein, 14 aa, Mycobacterium tuberculosis
AEMFGGTPAVEEWE

SEQ ID NO: 90813 - protein, 14 aa, Mycobacterium tuberculosis
EMFGGTPAVEEWEI

SEQ ID NO: 90814 - protein, 14 aa, Mycobacterium tuberculosis
MFGGTPAVEEWEIA

SEQ ID NO: 90815 - protein, 14 aa, Mycobacterium tuberculosis
FGGTPAVEEWEIAA

SEQ ID NO: 90816 - protein, 14 aa, Mycobacterium tuberculosis
GGTPAVEEWEIAAM

SEQ ID NO: 90817 - protein, 14 aa, Mycobacterium tuberculosis
GTPAVEEWEIAAMH

SEQ ID NO: 90818 - protein, 14 aa, Mycobacterium tuberculosis
TPAVEEWEIAAMHR

SEQ ID NO: 90819 - protein, 14 aa, Mycobacterium tuberculosis
PAVEEWEIAAMHRD

SEQ ID NO: 90820 - protein, 14 aa, Mycobacterium tuberculosis
AVEEWEIAAMHRDH

SEQ ID NO: 90821 - protein, 14 aa, Mycobacterium tuberculosis
VEEWEIAAMHRDHR

SEQ ID NO: 90822 - protein, 14 aa, Mycobacterium tuberculosis
EEWEIAAMHRDHRS

SEQ ID NO: 90823 - protein, 14 aa, Mycobacterium tuberculosis
EWEIAAMHRDHRSA

SEQ ID NO: 90824 - protein, 14 aa, Mycobacterium tuberculosis
WEIAAMHRDHRSAE

SEQ ID NO: 90825 - protein, 14 aa, Mycobacterium tuberculosis
EIAAMHRDHRSAEG

SEQ ID NO: 90826 - protein, 14 aa, Mycobacterium tuberculosis
IAAMHRDHRSAEGA

SEQ ID NO: 90827 - protein, 14 aa, Mycobacterium tuberculosis
AAMHRDHRSAEGAC

SEQ ID NO: 90828 - protein, 14 aa, Mycobacterium tuberculosis
AMHRDHRSAEGACV

SEQ ID NO: 90829 - protein, 14 aa, Mycobacterium tuberculosis
MHRDHRSAEGACVR

SEQ ID NO: 90830 - protein, 14 aa, Mycobacterium tuberculosis
HRDHRSAEGACVRA

SEQ ID NO: 90831 - protein, 14 aa, Mycobacterium tuberculosis
RDHRSAEGACVRAT

SEQ ID NO: 90832 - protein, 14 aa, Mycobacterium tuberculosis
DHRSAEGACVRATW

SEQ ID NO: 90833 - protein, 14 aa, Mycobacterium tuberculosis
HRSAEGACVRATWV

SEQ ID NO: 90834 - protein, 14 aa, Mycobacterium tuberculosis
RSAEGACVRATWVK

SEQ ID NO: 90835 - protein, 14 aa, Mycobacterium tuberculosis
SAEGACVRATWVKV

SEQ ID NO: 90836 - protein, 14 aa, Mycobacterium tuberculosis
AEGACVRATWVKVP

SEQ ID NO: 90837 - protein, 14 aa, Mycobacterium tuberculosis
EGACVRATWVKVPA

SEQ ID NO: 90838 - protein, 14 aa, Mycobacterium tuberculosis
GACVRATWVKVPAD

SEQ ID NO: 90839 - protein, 14 aa, Mycobacterium tuberculosis
ACVRATWVKVPADQ

SEQ ID NO: 90840 - protein, 14 aa, Mycobacterium tuberculosis
CVRATWVKVPADQV

SEQ ID NO: 90841 - protein, 14 aa, Mycobacterium tuberculosis
VRATWVKVPADQVD

SEQ ID NO: 90842 - protein, 14 aa, Mycobacterium tuberculosis
RATWVKVPADQVDQ

SEQ ID NO: 90843 - protein, 14 aa, Mycobacterium tuberculosis
ATWVKVPADQVDQG

SEQ ID NO: 90844 - protein, 14 aa, Mycobacterium tuberculosis
TWVKVPADQVDQGI

SEQ ID NO: 90845 - protein, 14 aa, Mycobacterium tuberculosis
WVKVPADQVDQGIE

SEQ ID NO: 90846 - protein, 14 aa, Mycobacterium tuberculosis
VKVPADQVDQGIEY

SEQ ID NO: 90847 - protein, 14 aa, Mycobacterium tuberculosis
KVPADQVDQGIEYY

SEQ ID NO: 90848 - protein, 14 aa, Mycobacterium tuberculosis
VPADQVDQGIEYYK

SEQ ID NO: 90849 - protein, 14 aa, Mycobacterium tuberculosis
PADQVDQGIEYYKS

SEQ ID NO: 90850 - protein, 14 aa, Mycobacterium tuberculosis
ADQVDQGIEYYKSS

SEQ ID NO: 90851 - protein, 14 aa, Mycobacterium tuberculosis
DQVDQGIEYYKSSV

SEQ ID NO: 90852 - protein, 14 aa, Mycobacterium tuberculosis
QVDQGIEYYKSSVL

SEQ ID NO: 90853 - protein, 14 aa, Mycobacterium tuberculosis
VDQGIEYYKSSVLP

SEQ ID NO: 90854 - protein, 14 aa, Mycobacterium tuberculosis
DQGIEYYKSSVLPQ

SEQ ID NO: 90855 - protein, 14 aa, Mycobacterium tuberculosis
QGIEYYKSSVLPQI

SEQ ID NO: 90856 - protein, 14 aa, Mycobacterium tuberculosis
GIEYYKSSVLPQIE

SEQ ID NO: 90857 - protein, 14 aa, Mycobacterium tuberculosis
IEYYKSSVLPQIEG

SEQ ID NO: 90858 - protein, 14 aa, Mycobacterium tuberculosis
EYYKSSVLPQIEGL

SEQ ID NO: 90859 - protein, 14 aa, Mycobacterium tuberculosis
YYKSSVLPQIEGLD

SEQ ID NO: 90860 - protein, 14 aa, Mycobacterium tuberculosis
YKSSVLPQIEGLDG

SEQ ID NO: 90861 - protein, 14 aa, Mycobacterium tuberculosis
KSSVLPQIEGLDGF

SEQ ID NO: 90862 - protein, 14 aa, Mycobacterium tuberculosis
SSVLPQIEGLDGFC

SEQ ID NO: 90863 - protein, 14 aa, Mycobacterium tuberculosis
SVLPQIEGLDGFCS

SEQ ID NO: 90864 - protein, 14 aa, Mycobacterium tuberculosis
VLPQIEGLDGFCSA

SEQ ID NO: 90865 - protein, 14 aa, Mycobacterium tuberculosis
LPQIEGLDGFCSAS

SEQ ID NO: 90866 - protein, 14 aa, Mycobacterium tuberculosis
PQIEGLDGFCSASL

SEQ ID NO: 90867 - protein, 14 aa, Mycobacterium tuberculosis
QIEGLDGFCSASLL

SEQ ID NO: 90868 - protein, 14 aa, Mycobacterium tuberculosis
IEGLDGFCSASLLV

SEQ ID NO: 90869 - protein, 14 aa, Mycobacterium tuberculosis
EGLDGFCSASLLVD

SEQ ID NO: 90870 - protein, 14 aa, Mycobacterium tuberculosis
GLDGFCSASLLVDR

SEQ ID NO: 90871 - protein, 14 aa, Mycobacterium tuberculosis
LDGFCSASLLVDRT

SEQ ID NO: 90872 - protein, 14 aa, Mycobacterium tuberculosis
DGFCSASLLVDRTS

SEQ ID NO: 90873 - protein, 14 aa, Mycobacterium tuberculosis
GFCSASLLVDRTSG

SEQ ID NO: 90874 - protein, 14 aa, Mycobacterium tuberculosis
FCSASLLVDRTSGR

SEQ ID NO: 90875 - protein, 14 aa, Mycobacterium tuberculosis
CSASLLVDRTSGRA

SEQ ID NO: 90876 - protein, 14 aa, Mycobacterium tuberculosis
SASLLVDRTSGRAV

SEQ ID NO: 90877 - protein, 14 aa, Mycobacterium tuberculosis
ASLLVDRTSGRAVS

SEQ ID NO: 90878 - protein, 14 aa, Mycobacterium tuberculosis
SLLVDRTSGRAVSS

SEQ ID NO: 90879 - protein, 14 aa, Mycobacterium tuberculosis
LLVDRTSGRAVSSA

SEQ ID NO: 90880 - protein, 14 aa, Mycobacterium tuberculosis
LVDRTSGRAVSSAT

SEQ ID NO: 90881 - protein, 14 aa, Mycobacterium tuberculosis
VDRTSGRAVSSATF

SEQ ID NO: 90882 - protein, 14 aa, Mycobacterium tuberculosis
DRTSGRAVSSATFD

SEQ ID NO: 90883 - protein, 14 aa, Mycobacterium tuberculosis
RTSGRAVSSATFDS

SEQ ID NO: 90884 - protein, 14 aa, Mycobacterium tuberculosis
TSGRAVSSATFDSF

SEQ ID NO: 90885 - protein, 14 aa, Mycobacterium tuberculosis
SGRAVSSATFDSFD

SEQ ID NO: 90886 - protein, 14 aa, Mycobacterium tuberculosis
GRAVSSATFDSFDA

SEQ ID NO: 90887 - protein, 14 aa, Mycobacterium tuberculosis
RAVSSATFDSFDAM

SEQ ID NO: 90888 - protein, 14 aa, Mycobacterium tuberculosis
AVSSATFDSFDAME

SEQ ID NO: 90889 - protein, 14 aa, Mycobacterium tuberculosis
VSSATFDSFDAMER

SEQ ID NO: 90890 - protein, 14 aa, Mycobacterium tuberculosis
SSATFDSFDAMERN

SEQ ID NO: 90891 - protein, 14 aa, Mycobacterium tuberculosis
SATFDSFDAMERNR

SEQ ID NO: 90892 - protein, 14 aa, Mycobacterium tuberculosis
ATFDSFDAMERNRD

SEQ ID NO: 90893 - protein, 14 aa, Mycobacterium tuberculosis
TFDSFDAMERNRDQ

SEQ ID NO: 90894 - protein, 14 aa, Mycobacterium tuberculosis
FDSFDAMERNRDQS

SEQ ID NO: 90895 - protein, 14 aa, Mycobacterium tuberculosis
DSFDAMERNRDQSN

SEQ ID NO: 90896 - protein, 14 aa, Mycobacterium tuberculosis
SFDAMERNRDQSNA

SEQ ID NO: 90897 - protein, 14 aa, Mycobacterium tuberculosis
FDAMERNRDQSNAL

SEQ ID NO: 90898 - protein, 14 aa, Mycobacterium tuberculosis
DAMERNRDQSNALK

SEQ ID NO: 90899 - protein, 14 aa, Mycobacterium tuberculosis
AMERNRDQSNALKA

SEQ ID NO: 90900 - protein, 14 aa, Mycobacterium tuberculosis
MERNRDQSNALKAT

SEQ ID NO: 90901 - protein, 14 aa, Mycobacterium tuberculosis
ERNRDQSNALKATS

SEQ ID NO: 90902 - protein, 14 aa, Mycobacterium tuberculosis
RNRDQSNALKATSL

SEQ ID NO: 90903 - protein, 14 aa, Mycobacterium tuberculosis
NRDQSNALKATSLR

SEQ ID NO: 90904 - protein, 14 aa, Mycobacterium tuberculosis
RDQSNALKATSLRE

SEQ ID NO: 90905 - protein, 14 aa, Mycobacterium tuberculosis
DQSNALKATSLREA

SEQ ID NO: 90906 - protein, 14 aa, Mycobacterium tuberculosis
QSNALKATSLREAG

SEQ ID NO: 90907 - protein, 14 aa, Mycobacterium tuberculosis
SNALKATSLREAGG

SEQ ID NO: 90908 - protein, 14 aa, Mycobacterium tuberculosis
NALKATSLREAGGE

SEQ ID NO: 90909 - protein, 14 aa, Mycobacterium tuberculosis
ALKATSLREAGGEE

SEQ ID NO: 90910 - protein, 14 aa, Mycobacterium tuberculosis
LKATSLREAGGEEL

SEQ ID NO: 90911 - protein, 14 aa, Mycobacterium tuberculosis
KATSLREAGGEELD

SEQ ID NO: 90912 - protein, 14 aa, Mycobacterium tuberculosis
ATSLREAGGEELDE

SEQ ID NO: 90913 - protein, 14 aa, Mycobacterium tuberculosis
TSLREAGGEELDEC

SEQ ID NO: 90914 - protein, 14 aa, Mycobacterium tuberculosis
SLREAGGEELDECE

SEQ ID NO: 90915 - protein, 14 aa, Mycobacterium tuberculosis
LREAGGEELDECEF

SEQ ID NO: 90916 - protein, 14 aa, Mycobacterium tuberculosis
REAGGEELDECEFE

SEQ ID NO: 90917 - protein, 14 aa, Mycobacterium tuberculosis
EAGGEELDECEFEL

SEQ ID NO: 90918 - protein, 14 aa, Mycobacterium tuberculosis
AGGEELDECEFELA

SEQ ID NO: 90919 - protein, 14 aa, Mycobacterium tuberculosis
GGEELDECEFELAL

SEQ ID NO: 90920 - protein, 14 aa, Mycobacterium tuberculosis
GEELDECEFELALA

SEQ ID NO: 90921 - protein, 14 aa, Mycobacterium tuberculosis
EELDECEFELALAH

SEQ ID NO: 90922 - protein, 14 aa, Mycobacterium tuberculosis
ELDECEFELALAHL

SEQ ID NO: 90923 - protein, 14 aa, Mycobacterium tuberculosis
LDECEFELALAHLR

SEQ ID NO: 90924 - protein, 14 aa, Mycobacterium tuberculosis
DECEFELALAHLRV

SEQ ID NO: 90925 - protein, 14 aa, Mycobacterium tuberculosis
ECEFELALAHLRVP

SEQ ID NO: 90926 - protein, 14 aa, Mycobacterium tuberculosis
CEFELALAHLRVPE

SEQ ID NO: 90927 - protein, 14 aa, Mycobacterium tuberculosis
EFELALAHLRVPEL

SEQ ID NO: 90928 - protein, 14 aa, Mycobacterium tuberculosis
FELALAHLRVPELV

SEQ ID NO: 90929 - protein, 15 aa, Mycobacterium tuberculosis
MTGGATGALPRTMKE

SEQ ID NO: 90930 - protein, 15 aa, Mycobacterium tuberculosis
TGGATGALPRTMKEG

SEQ ID NO: 90931 - protein, 15 aa, Mycobacterium tuberculosis
GGATGALPRTMKEGW

SEQ ID NO: 90932 - protein, 15 aa, Mycobacterium tuberculosis
GATGALPRTMKEGWI

SEQ ID NO: 90933 - protein, 15 aa, Mycobacterium tuberculosis
ATGALPRTMKEGWIV

SEQ ID NO: 90934 - protein, 15 aa, Mycobacterium tuberculosis
TGALPRTMKEGWIVY

SEQ ID NO: 90935 - protein, 15 aa, Mycobacterium tuberculosis
GALPRTMKEGWIVYA

SEQ ID NO: 90936 - protein, 15 aa, Mycobacterium tuberculosis
ALPRTMKEGWIVYAR

SEQ ID NO: 90937 - protein, 15 aa, Mycobacterium tuberculosis
LPRTMKEGWIVYARS

SEQ ID NO: 90938 - protein, 15 aa, Mycobacterium tuberculosis
PRTMKEGWIVYARST

SEQ ID NO: 90939 - protein, 15 aa, Mycobacterium tuberculosis
RTMKEGWIVYARSTT

SEQ ID NO: 90940 - protein, 15 aa, Mycobacterium tuberculosis
TMKEGWIVYARSTTI

SEQ ID NO: 90941 - protein, 15 aa, Mycobacterium tuberculosis
MKEGWIVYARSTTIQ

SEQ ID NO: 90942 - protein, 15 aa, Mycobacterium tuberculosis
KEGWIVYARSTTIQA

SEQ ID NO: 90943 - protein, 15 aa, Mycobacterium tuberculosis
EGWIVYARSTTIQAQ

SEQ ID NO: 90944 - protein, 15 aa, Mycobacterium tuberculosis
GWIVYARSTTIQAQS

SEQ ID NO: 90945 - protein, 15 aa, Mycobacterium tuberculosis
WIVYARSTTIQAQSE

SEQ ID NO: 90946 - protein, 15 aa, Mycobacterium tuberculosis
IVYARSTTIQAQSEC

SEQ ID NO: 90947 - protein, 15 aa, Mycobacterium tuberculosis
VYARSTTIQAQSECI

SEQ ID NO: 90948 - protein, 15 aa, Mycobacterium tuberculosis
YARSTTIQAQSECID

SEQ ID NO: 90949 - protein, 15 aa, Mycobacterium tuberculosis
ARSTTIQAQSECIDT

SEQ ID NO: 90950 - protein, 15 aa, Mycobacterium tuberculosis
RSTTIQAQSECIDTG

SEQ ID NO: 90951 - protein, 15 aa, Mycobacterium tuberculosis
STTIQAQSECIDTGI

SEQ ID NO: 90952 - protein, 15 aa, Mycobacterium tuberculosis
TTIQAQSECIDTGIA

SEQ ID NO: 90953 - protein, 15 aa, Mycobacterium tuberculosis
TIQAQSECIDTGIAH

SEQ ID NO: 90954 - protein, 15 aa, Mycobacterium tuberculosis
IQAQSECIDTGIAHV

SEQ ID NO: 90955 - protein, 15 aa, Mycobacterium tuberculosis
QAQSECIDTGIAHVR

SEQ ID NO: 90956 - protein, 15 aa, Mycobacterium tuberculosis
AQSECIDTGIAHVRD

SEQ ID NO: 90957 - protein, 15 aa, Mycobacterium tuberculosis
QSECIDTGIAHVRDV

SEQ ID NO: 90958 - protein, 15 aa, Mycobacterium tuberculosis
SECIDTGIAHVRDVV

SEQ ID NO: 90959 - protein, 15 aa, Mycobacterium tuberculosis
ECIDTGIAHVRDVVM

SEQ ID NO: 90960 - protein, 15 aa, Mycobacterium tuberculosis
CIDTGIAHVRDVVMP

SEQ ID NO: 90961 - protein, 15 aa, Mycobacterium tuberculosis
IDTGIAHVRDVVMPA

SEQ ID NO: 90962 - protein, 15 aa, Mycobacterium tuberculosis
DTGIAHVRDVVMPAL

SEQ ID NO: 90963 - protein, 15 aa, Mycobacterium tuberculosis
TGIAHVRDVVMPALQ

SEQ ID NO: 90964 - protein, 15 aa, Mycobacterium tuberculosis
GIAHVRDVVMPALQG

SEQ ID NO: 90965 - protein, 15 aa, Mycobacterium tuberculosis
IAHVRDVVMPALQGM

SEQ ID NO: 90966 - protein, 15 aa, Mycobacterium tuberculosis
AHVRDVVMPALQGMD

SEQ ID NO: 90967 - protein, 15 aa, Mycobacterium tuberculosis
HVRDVVMPALQGMDG

SEQ ID NO: 90968 - protein, 15 aa, Mycobacterium tuberculosis
VRDVVMPALQGMDGC

SEQ ID NO: 90969 - protein, 15 aa, Mycobacterium tuberculosis
RDVVMPALQGMDGCI

SEQ ID NO: 90970 - protein, 15 aa, Mycobacterium tuberculosis
DVVMPALQGMDGCIG

SEQ ID NO: 90971 - protein, 15 aa, Mycobacterium tuberculosis
VVMPALQGMDGCIGV

SEQ ID NO: 90972 - protein, 15 aa, Mycobacterium tuberculosis
VMPALQGMDGCIGVS

SEQ ID NO: 90973 - protein, 15 aa, Mycobacterium tuberculosis
MPALQGMDGCIGVSL

SEQ ID NO: 90974 - protein, 15 aa, Mycobacterium tuberculosis
PALQGMDGCIGVSLL

SEQ ID NO: 90975 - protein, 15 aa, Mycobacterium tuberculosis
ALQGMDGCIGVSLLV

SEQ ID NO: 90976 - protein, 15 aa, Mycobacterium tuberculosis
LQGMDGCIGVSLLVD

SEQ ID NO: 90977 - protein, 15 aa, Mycobacterium tuberculosis
QGMDGCIGVSLLVDR

SEQ ID NO: 90978 - protein, 15 aa, Mycobacterium tuberculosis
GMDGCIGVSLLVDRQ

SEQ ID NO: 90979 - protein, 15 aa, Mycobacterium tuberculosis
MDGCIGVSLLVDRQS

SEQ ID NO: 90980 - protein, 15 aa, Mycobacterium tuberculosis
DGCIGVSLLVDRQSG

SEQ ID NO: 90981 - protein, 15 aa, Mycobacterium tuberculosis
GCIGVSLLVDRQSGR

SEQ ID NO: 90982 - protein, 15 aa, Mycobacterium tuberculosis
CIGVSLLVDRQSGRC

SEQ ID NO: 90983 - protein, 15 aa, Mycobacterium tuberculosis
IGVSLLVDRQSGRCI

SEQ ID NO: 90984 - protein, 15 aa, Mycobacterium tuberculosis
GVSLLVDRQSGRCIA

SEQ ID NO: 90985 - protein, 15 aa, Mycobacterium tuberculosis
VSLLVDRQSGRCIAT

SEQ ID NO: 90986 - protein, 15 aa, Mycobacterium tuberculosis
SLLVDRQSGRCIATS

SEQ ID NO: 90987 - protein, 15 aa, Mycobacterium tuberculosis
LLVDRQSGRCIATSA

SEQ ID NO: 90988 - protein, 15 aa, Mycobacterium tuberculosis
LVDRQSGRCIATSAW

SEQ ID NO: 90989 - protein, 15 aa, Mycobacterium tuberculosis
VDRQSGRCIATSAWE

SEQ ID NO: 90990 - protein, 15 aa, Mycobacterium tuberculosis
DRQSGRCIATSAWET

SEQ ID NO: 90991 - protein, 15 aa, Mycobacterium tuberculosis
RQSGRCIATSAWETA

SEQ ID NO: 90992 - protein, 15 aa, Mycobacterium tuberculosis
QSGRCIATSAWETAE

SEQ ID NO: 90993 - protein, 15 aa, Mycobacterium tuberculosis
SGRCIATSAWETAEA

SEQ ID NO: 90994 - protein, 15 aa, Mycobacterium tuberculosis
GRCIATSAWETAEAM

SEQ ID NO: 90995 - protein, 15 aa, Mycobacterium tuberculosis
RCIATSAWETAEAMH

SEQ ID NO: 90996 - protein, 15 aa, Mycobacterium tuberculosis
CIATSAWETAEAMHA

SEQ ID NO: 90997 - protein, 15 aa, Mycobacterium tuberculosis
IATSAWETAEAMHAS

SEQ ID NO: 90998 - protein, 15 aa, Mycobacterium tuberculosis
ATSAWETAEAMHASR

SEQ ID NO: 90999 - protein, 15 aa, Mycobacterium tuberculosis
TSAWETAEAMHASRE

SEQ ID NO: 91000 - protein, 15 aa, Mycobacterium tuberculosis
SAWETAEAMHASREQ

SEQ ID NO: 91001 - protein, 15 aa, Mycobacterium tuberculosis
AWETAEAMHASREQV

SEQ ID NO: 91002 - protein, 15 aa, Mycobacterium tuberculosis
WETAEAMHASREQVT

SEQ ID NO: 91003 - protein, 15 aa, Mycobacterium tuberculosis
ETAEAMHASREQVTP

SEQ ID NO: 91004 - protein, 15 aa, Mycobacterium tuberculosis
TAEAMHASREQVTPI

SEQ ID NO: 91005 - protein, 15 aa, Mycobacterium tuberculosis
AEAMHASREQVTPIR

SEQ ID NO: 91006 - protein, 15 aa, Mycobacterium tuberculosis
EAMHASREQVTPIRD

SEQ ID NO: 91007 - protein, 15 aa, Mycobacterium tuberculosis
AMHASREQVTPIRDR

SEQ ID NO: 91008 - protein, 15 aa, Mycobacterium tuberculosis
MHASREQVTPIRDRC

SEQ ID NO: 91009 - protein, 15 aa, Mycobacterium tuberculosis
HASREQVTPIRDRCA

SEQ ID NO: 91010 - protein, 15 aa, Mycobacterium tuberculosis
ASREQVTPIRDRCAE

SEQ ID NO: 91011 - protein, 15 aa, Mycobacterium tuberculosis
SREQVTPIRDRCAEM

SEQ ID NO: 91012 - protein, 15 aa, Mycobacterium tuberculosis
REQVTPIRDRCAEMF

SEQ ID NO: 91013 - protein, 15 aa, Mycobacterium tuberculosis
EQVTPIRDRCAEMFG

SEQ ID NO: 91014 - protein, 15 aa, Mycobacterium tuberculosis
QVTPIRDRCAEMFGG

SEQ ID NO: 91015 - protein, 15 aa, Mycobacterium tuberculosis
VTPIRDRCAEMFGGT

SEQ ID NO: 91016 - protein, 15 aa, Mycobacterium tuberculosis
TPIRDRCAEMFGGTP

SEQ ID NO: 91017 - protein, 15 aa, Mycobacterium tuberculosis
PIRDRCAEMFGGTPA

SEQ ID NO: 91018 - protein, 15 aa, Mycobacterium tuberculosis
IRDRCAEMFGGTPAV

SEQ ID NO: 91019 - protein, 15 aa, Mycobacterium tuberculosis
RDRCAEMFGGTPAVE

SEQ ID NO: 91020 - protein, 15 aa, Mycobacterium tuberculosis
DRCAEMFGGTPAVEE

SEQ ID NO: 91021 - protein, 15 aa, Mycobacterium tuberculosis
RCAEMFGGTPAVEEW

SEQ ID NO: 91022 - protein, 15 aa, Mycobacterium tuberculosis
CAEMFGGTPAVEEWE

SEQ ID NO: 91023 - protein, 15 aa, Mycobacterium tuberculosis
AEMFGGTPAVEEWEI

SEQ ID NO: 91024 - protein, 15 aa, Mycobacterium tuberculosis
EMFGGTPAVEEWEIA

SEQ ID NO: 91025 - protein, 15 aa, Mycobacterium tuberculosis
MFGGTPAVEEWEIAA

SEQ ID NO: 91026 - protein, 15 aa, Mycobacterium tuberculosis
FGGTPAVEEWEIAAM

SEQ ID NO: 91027 - protein, 15 aa, Mycobacterium tuberculosis
GGTPAVEEWEIAAMH

SEQ ID NO: 91028 - protein, 15 aa, Mycobacterium tuberculosis
GTPAVEEWEIAAMHR

SEQ ID NO: 91029 - protein, 15 aa, Mycobacterium tuberculosis
TPAVEEWEIAAMHRD

SEQ ID NO: 91030 - protein, 15 aa, Mycobacterium tuberculosis
PAVEEWEIAAMHRDH

SEQ ID NO: 91031 - protein, 15 aa, Mycobacterium tuberculosis
AVEEWEIAAMHRDHR

SEQ ID NO: 91032 - protein, 15 aa, Mycobacterium tuberculosis
VEEWEIAAMHRDHRS

SEQ ID NO: 91033 - protein, 15 aa, Mycobacterium tuberculosis
EEWEIAAMHRDHRSA

SEQ ID NO: 91034 - protein, 15 aa, Mycobacterium tuberculosis
EWEIAAMHRDHRSAE

SEQ ID NO: 91035 - protein, 15 aa, Mycobacterium tuberculosis
WEIAAMHRDHRSAEG

SEQ ID NO: 91036 - protein, 15 aa, Mycobacterium tuberculosis
EIAAMHRDHRSAEGA

SEQ ID NO: 91037 - protein, 15 aa, Mycobacterium tuberculosis
IAAMHRDHRSAEGAC

SEQ ID NO: 91038 - protein, 15 aa, Mycobacterium tuberculosis
AAMHRDHRSAEGACV

SEQ ID NO: 91039 - protein, 15 aa, Mycobacterium tuberculosis
AMHRDHRSAEGACVR

SEQ ID NO: 91040 - protein, 15 aa, Mycobacterium tuberculosis
MHRDHRSAEGACVRA

SEQ ID NO: 91041 - protein, 15 aa, Mycobacterium tuberculosis
HRDHRSAEGACVRAT

SEQ ID NO: 91042 - protein, 15 aa, Mycobacterium tuberculosis
RDHRSAEGACVRATW

SEQ ID NO: 91043 - protein, 15 aa, Mycobacterium tuberculosis
DHRSAEGACVRATWV

SEQ ID NO: 91044 - protein, 15 aa, Mycobacterium tuberculosis
HRSAEGACVRATWVK

SEQ ID NO: 91045 - protein, 15 aa, Mycobacterium tuberculosis
RSAEGACVRATWVKV

SEQ ID NO: 91046 - protein, 15 aa, Mycobacterium tuberculosis
SAEGACVRATWVKVP

SEQ ID NO: 91047 - protein, 15 aa, Mycobacterium tuberculosis
AEGACVRATWVKVPA

SEQ ID NO: 91048 - protein, 15 aa, Mycobacterium tuberculosis
EGACVRATWVKVPAD

SEQ ID NO: 91049 - protein, 15 aa, Mycobacterium tuberculosis
GACVRATWVKVPADQ

SEQ ID NO: 91050 - protein, 15 aa, Mycobacterium tuberculosis
ACVRATWVKVPADQV

SEQ ID NO: 91051 - protein, 15 aa, Mycobacterium tuberculosis
CVRATWVKVPADQVD

SEQ ID NO: 91052 - protein, 15 aa, Mycobacterium tuberculosis
VRATWVKVPADQVDQ

SEQ ID NO: 91053 - protein, 15 aa, Mycobacterium tuberculosis
RATWVKVPADQVDQG

SEQ ID NO: 91054 - protein, 15 aa, Mycobacterium tuberculosis
ATWVKVPADQVDQGI

SEQ ID NO: 91055 - protein, 15 aa, Mycobacterium tuberculosis
TWVKVPADQVDQGIE

SEQ ID NO: 91056 - protein, 15 aa, Mycobacterium tuberculosis
WVKVPADQVDQGIEY

SEQ ID NO: 91057 - protein, 15 aa, Mycobacterium tuberculosis
VKVPADQVDQGIEYY

SEQ ID NO: 91058 - protein, 15 aa, Mycobacterium tuberculosis
KVPADQVDQGIEYYK

SEQ ID NO: 91059 - protein, 15 aa, Mycobacterium tuberculosis
VPADQVDQGIEYYKS

SEQ ID NO: 91060 - protein, 15 aa, Mycobacterium tuberculosis
PADQVDQGIEYYKSS

SEQ ID NO: 91061 - protein, 15 aa, Mycobacterium tuberculosis
ADQVDQGIEYYKSSV

SEQ ID NO: 91062 - protein, 15 aa, Mycobacterium tuberculosis
DQVDQGIEYYKSSVL

SEQ ID NO: 91063 - protein, 15 aa, Mycobacterium tuberculosis
QVDQGIEYYKSSVLP

SEQ ID NO: 91064 - protein, 15 aa, Mycobacterium tuberculosis
VDQGIEYYKSSVLPQ

SEQ ID NO: 91065 - protein, 15 aa, Mycobacterium tuberculosis
DQGIEYYKSSVLPQI

SEQ ID NO: 91066 - protein, 15 aa, Mycobacterium tuberculosis
QGIEYYKSSVLPQIE

SEQ ID NO: 91067 - protein, 15 aa, Mycobacterium tuberculosis
GIEYYKSSVLPQIEG

SEQ ID NO: 91068 - protein, 15 aa, Mycobacterium tuberculosis
IEYYKSSVLPQIEGL

SEQ ID NO: 91069 - protein, 15 aa, Mycobacterium tuberculosis
EYYKSSVLPQIEGLD

SEQ ID NO: 91070 - protein, 15 aa, Mycobacterium tuberculosis
YYKSSVLPQIEGLDG

SEQ ID NO: 91071 - protein, 15 aa, Mycobacterium tuberculosis
YKSSVLPQIEGLDGF

SEQ ID NO: 91072 - protein, 15 aa, Mycobacterium tuberculosis
KSSVLPQIEGLDGFC

SEQ ID NO: 91073 - protein, 15 aa, Mycobacterium tuberculosis
SSVLPQIEGLDGFCS

SEQ ID NO: 91074 - protein, 15 aa, Mycobacterium tuberculosis
SVLPQIEGLDGFCSA

SEQ ID NO: 91075 - protein, 15 aa, Mycobacterium tuberculosis
VLPQIEGLDGFCSAS

SEQ ID NO: 91076 - protein, 15 aa, Mycobacterium tuberculosis
LPQIEGLDGFCSASL

SEQ ID NO: 91077 - protein, 15 aa, Mycobacterium tuberculosis
PQIEGLDGFCSASLL

SEQ ID NO: 91078 - protein, 15 aa, Mycobacterium tuberculosis
QIEGLDGFCSASLLV

SEQ ID NO: 91079 - protein, 15 aa, Mycobacterium tuberculosis
IEGLDGFCSASLLVD

SEQ ID NO: 91080 - protein, 15 aa, Mycobacterium tuberculosis
EGLDGFCSASLLVDR

SEQ ID NO: 91081 - protein, 15 aa, Mycobacterium tuberculosis
GLDGFCSASLLVDRT

SEQ ID NO: 91082 - protein, 15 aa, Mycobacterium tuberculosis
LDGFCSASLLVDRTS

SEQ ID NO: 91083 - protein, 15 aa, Mycobacterium tuberculosis
DGFCSASLLVDRTSG

SEQ ID NO: 91084 - protein, 15 aa, Mycobacterium tuberculosis
GFCSASLLVDRTSGR

SEQ ID NO: 91085 - protein, 15 aa, Mycobacterium tuberculosis
FCSASLLVDRTSGRA

SEQ ID NO: 91086 - protein, 15 aa, Mycobacterium tuberculosis
CSASLLVDRTSGRAV

SEQ ID NO: 91087 - protein, 15 aa, Mycobacterium tuberculosis
SASLLVDRTSGRAVS

SEQ ID NO: 91088 - protein, 15 aa, Mycobacterium tuberculosis
ASLLVDRTSGRAVSS

SEQ ID NO: 91089 - protein, 15 aa, Mycobacterium tuberculosis
SLLVDRTSGRAVSSA

SEQ ID NO: 91090 - protein, 15 aa, Mycobacterium tuberculosis
LLVDRTSGRAVSSAT

SEQ ID NO: 91091 - protein, 15 aa, Mycobacterium tuberculosis
LVDRTSGRAVSSATF

SEQ ID NO: 91092 - protein, 15 aa, Mycobacterium tuberculosis
VDRTSGRAVSSATFD

SEQ ID NO: 91093 - protein, 15 aa, Mycobacterium tuberculosis
DRTSGRAVSSATFDS

SEQ ID NO: 91094 - protein, 15 aa, Mycobacterium tuberculosis
RTSGRAVSSATFDSF

SEQ ID NO: 91095 - protein, 15 aa, Mycobacterium tuberculosis
TSGRAVSSATFDSFD

SEQ ID NO: 91096 - protein, 15 aa, Mycobacterium tuberculosis
SGRAVSSATFDSFDA

SEQ ID NO: 91097 - protein, 15 aa, Mycobacterium tuberculosis
GRAVSSATFDSFDAM

SEQ ID NO: 91098 - protein, 15 aa, Mycobacterium tuberculosis
RAVSSATFDSFDAME

SEQ ID NO: 91099 - protein, 15 aa, Mycobacterium tuberculosis
AVSSATFDSFDAMER

SEQ ID NO: 91100 - protein, 15 aa, Mycobacterium tuberculosis
VSSATFDSFDAMERN

SEQ ID NO: 91101 - protein, 15 aa, Mycobacterium tuberculosis
SSATFDSFDAMERNR

SEQ ID NO: 91102 - protein, 15 aa, Mycobacterium tuberculosis
SATFDSFDAMERNRD

SEQ ID NO: 91103 - protein, 15 aa, Mycobacterium tuberculosis
ATFDSFDAMERNRDQ

SEQ ID NO: 91104 - protein, 15 aa, Mycobacterium tuberculosis
TFDSFDAMERNRDQS

SEQ ID NO: 91105 - protein, 15 aa, Mycobacterium tuberculosis
FDSFDAMERNRDQSN

SEQ ID NO: 91106 - protein, 15 aa, Mycobacterium tuberculosis
DSFDAMERNRDQSNA

SEQ ID NO: 91107 - protein, 15 aa, Mycobacterium tuberculosis
SFDAMERNRDQSNAL

SEQ ID NO: 91108 - protein, 15 aa, Mycobacterium tuberculosis
FDAMERNRDQSNALK

SEQ ID NO: 91109 - protein, 15 aa, Mycobacterium tuberculosis
DAMERNRDQSNALKA

SEQ ID NO: 91110 - protein, 15 aa, Mycobacterium tuberculosis
AMERNRDQSNALKAT

SEQ ID NO: 91111 - protein, 15 aa, Mycobacterium tuberculosis
MERNRDQSNALKATS

SEQ ID NO: 91112 - protein, 15 aa, Mycobacterium tuberculosis
ERNRDQSNALKATSL

SEQ ID NO: 91113 - protein, 15 aa, Mycobacterium tuberculosis
RNRDQSNALKATSLR

SEQ ID NO: 91114 - protein, 15 aa, Mycobacterium tuberculosis
NRDQSNALKATSLRE

SEQ ID NO: 91115 - protein, 15 aa, Mycobacterium tuberculosis
RDQSNALKATSLREA

SEQ ID NO: 91116 - protein, 15 aa, Mycobacterium tuberculosis
DQSNALKATSLREAG

SEQ ID NO: 91117 - protein, 15 aa, Mycobacterium tuberculosis
QSNALKATSLREAGG

SEQ ID NO: 91118 - protein, 15 aa, Mycobacterium tuberculosis
SNALKATSLREAGGE

SEQ ID NO: 91119 - protein, 15 aa, Mycobacterium tuberculosis
NALKATSLREAGGEE

SEQ ID NO: 91120 - protein, 15 aa, Mycobacterium tuberculosis
ALKATSLREAGGEEL

SEQ ID NO: 91121 - protein, 15 aa, Mycobacterium tuberculosis
LKATSLREAGGEELD

SEQ ID NO: 91122 - protein, 15 aa, Mycobacterium tuberculosis
KATSLREAGGEELDE

SEQ ID NO: 91123 - protein, 15 aa, Mycobacterium tuberculosis
ATSLREAGGEELDEC

SEQ ID NO: 91124 - protein, 15 aa, Mycobacterium tuberculosis
TSLREAGGEELDECE

SEQ ID NO: 91125 - protein, 15 aa, Mycobacterium tuberculosis
SLREAGGEELDECEF

SEQ ID NO: 91126 - protein, 15 aa, Mycobacterium tuberculosis
LREAGGEELDECEFE

SEQ ID NO: 91127 - protein, 15 aa, Mycobacterium tuberculosis
REAGGEELDECEFEL

SEQ ID NO: 91128 - protein, 15 aa, Mycobacterium tuberculosis
EAGGEELDECEFELA

SEQ ID NO: 91129 - protein, 15 aa, Mycobacterium tuberculosis
AGGEELDECEFELAL

SEQ ID NO: 91130 - protein, 15 aa, Mycobacterium tuberculosis
GGEELDECEFELALA

SEQ ID NO: 91131 - protein, 15 aa, Mycobacterium tuberculosis
GEELDECEFELALAH

SEQ ID NO: 91132 - protein, 15 aa, Mycobacterium tuberculosis
EELDECEFELALAHL

SEQ ID NO: 91133 - protein, 15 aa, Mycobacterium tuberculosis
ELDECEFELALAHLR

SEQ ID NO: 91134 - protein, 15 aa, Mycobacterium tuberculosis
LDECEFELALAHLRV

SEQ ID NO: 91135 - protein, 15 aa, Mycobacterium tuberculosis
DECEFELALAHLRVP

SEQ ID NO: 91136 - protein, 15 aa, Mycobacterium tuberculosis
ECEFELALAHLRVPE

SEQ ID NO: 91137 - protein, 15 aa, Mycobacterium tuberculosis
CEFELALAHLRVPEL

SEQ ID NO: 91138 - protein, 15 aa, Mycobacterium tuberculosis
EFELALAHLRVPELV

SEQ ID NO: 91139 - protein, 16 aa, Mycobacterium tuberculosis
MTGGATGALPRTMKEG

SEQ ID NO: 91140 - protein, 16 aa, Mycobacterium tuberculosis
TGGATGALPRTMKEGW

SEQ ID NO: 91141 - protein, 16 aa, Mycobacterium tuberculosis
GGATGALPRTMKEGWI

SEQ ID NO: 91142 - protein, 16 aa, Mycobacterium tuberculosis
GATGALPRTMKEGWIV

SEQ ID NO: 91143 - protein, 16 aa, Mycobacterium tuberculosis
ATGALPRTMKEGWIVY

SEQ ID NO: 91144 - protein, 16 aa, Mycobacterium tuberculosis
TGALPRTMKEGWIVYA

SEQ ID NO: 91145 - protein, 16 aa, Mycobacterium tuberculosis
GALPRTMKEGWIVYAR

SEQ ID NO: 91146 - protein, 16 aa, Mycobacterium tuberculosis
ALPRTMKEGWIVYARS

SEQ ID NO: 91147 - protein, 16 aa, Mycobacterium tuberculosis
LPRTMKEGWIVYARST

SEQ ID NO: 91148 - protein, 16 aa, Mycobacterium tuberculosis
PRTMKEGWIVYARSTT

SEQ ID NO: 91149 - protein, 16 aa, Mycobacterium tuberculosis
RTMKEGWIVYARSTTI

SEQ ID NO: 91150 - protein, 16 aa, Mycobacterium tuberculosis
TMKEGWIVYARSTTIQ

SEQ ID NO: 91151 - protein, 16 aa, Mycobacterium tuberculosis
MKEGWIVYARSTTIQA

SEQ ID NO: 91152 - protein, 16 aa, Mycobacterium tuberculosis
KEGWIVYARSTTIQAQ

SEQ ID NO: 91153 - protein, 16 aa, Mycobacterium tuberculosis
EGWIVYARSTTIQAQS

SEQ ID NO: 91154 - protein, 16 aa, Mycobacterium tuberculosis
GWIVYARSTTIQAQSE

SEQ ID NO: 91155 - protein, 16 aa, Mycobacterium tuberculosis
WIVYARSTTIQAQSEC

SEQ ID NO: 91156 - protein, 16 aa, Mycobacterium tuberculosis
IVYARSTTIQAQSECI

SEQ ID NO: 91157 - protein, 16 aa, Mycobacterium tuberculosis
VYARSTTIQAQSECID

SEQ ID NO: 91158 - protein, 16 aa, Mycobacterium tuberculosis
YARSTTIQAQSECIDT

SEQ ID NO: 91159 - protein, 16 aa, Mycobacterium tuberculosis
ARSTTIQAQSECIDTG

SEQ ID NO: 91160 - protein, 16 aa, Mycobacterium tuberculosis
RSTTIQAQSECIDTGI

SEQ ID NO: 91161 - protein, 16 aa, Mycobacterium tuberculosis
STTIQAQSECIDTGIA

SEQ ID NO: 91162 - protein, 16 aa, Mycobacterium tuberculosis
TTIQAQSECIDTGIAH

SEQ ID NO: 91163 - protein, 16 aa, Mycobacterium tuberculosis
TIQAQSECIDTGIAHV

SEQ ID NO: 91164 - protein, 16 aa, Mycobacterium tuberculosis
IQAQSECIDTGIAHVR

SEQ ID NO: 91165 - protein, 16 aa, Mycobacterium tuberculosis
QAQSECIDTGIAHVRD

SEQ ID NO: 91166 - protein, 16 aa, Mycobacterium tuberculosis
AQSECIDTGIAHVRDV

SEQ ID NO: 91167 - protein, 16 aa, Mycobacterium tuberculosis
QSECIDTGIAHVRDVV

SEQ ID NO: 91168 - protein, 16 aa, Mycobacterium tuberculosis
SECIDTGIAHVRDVVM

SEQ ID NO: 91169 - protein, 16 aa, Mycobacterium tuberculosis
ECIDTGIAHVRDVVMP

SEQ ID NO: 91170 - protein, 16 aa, Mycobacterium tuberculosis
CIDTGIAHVRDVVMPA

SEQ ID NO: 91171 - protein, 16 aa, Mycobacterium tuberculosis
IDTGIAHVRDVVMPAL

SEQ ID NO: 91172 - protein, 16 aa, Mycobacterium tuberculosis
DTGIAHVRDVVMPALQ

SEQ ID NO: 91173 - protein, 16 aa, Mycobacterium tuberculosis
TGIAHVRDVVMPALQG

SEQ ID NO: 91174 - protein, 16 aa, Mycobacterium tuberculosis
GIAHVRDVVMPALQGM

SEQ ID NO: 91175 - protein, 16 aa, Mycobacterium tuberculosis
IAHVRDVVMPALQGMD

SEQ ID NO: 91176 - protein, 16 aa, Mycobacterium tuberculosis
AHVRDVVMPALQGMDG

SEQ ID NO: 91177 - protein, 16 aa, Mycobacterium tuberculosis
HVRDVVMPALQGMDGC

SEQ ID NO: 91178 - protein, 16 aa, Mycobacterium tuberculosis
VRDVVMPALQGMDGCI

SEQ ID NO: 91179 - protein, 16 aa, Mycobacterium tuberculosis
RDVVMPALQGMDGCIG

SEQ ID NO: 91180 - protein, 16 aa, Mycobacterium tuberculosis
DVVMPALQGMDGCIGV

SEQ ID NO: 91181 - protein, 16 aa, Mycobacterium tuberculosis
VVMPALQGMDGCIGVS

SEQ ID NO: 91182 - protein, 16 aa, Mycobacterium tuberculosis
VMPALQGMDGCIGVSL

SEQ ID NO: 91183 - protein, 16 aa, Mycobacterium tuberculosis
MPALQGMDGCIGVSLL

SEQ ID NO: 91184 - protein, 16 aa, Mycobacterium tuberculosis
PALQGMDGCIGVSLLV

SEQ ID NO: 91185 - protein, 16 aa, Mycobacterium tuberculosis
ALQGMDGCIGVSLLVD

SEQ ID NO: 91186 - protein, 16 aa, Mycobacterium tuberculosis
LQGMDGCIGVSLLVDR

SEQ ID NO: 91187 - protein, 16 aa, Mycobacterium tuberculosis
QGMDGCIGVSLLVDRQ

SEQ ID NO: 91188 - protein, 16 aa, Mycobacterium tuberculosis
GMDGCIGVSLLVDRQS

SEQ ID NO: 91189 - protein, 16 aa, Mycobacterium tuberculosis
MDGCIGVSLLVDRQSG

SEQ ID NO: 91190 - protein, 16 aa, Mycobacterium tuberculosis
DGCIGVSLLVDRQSGR

SEQ ID NO: 91191 - protein, 16 aa, Mycobacterium tuberculosis
GCIGVSLLVDRQSGRC

SEQ ID NO: 91192 - protein, 16 aa, Mycobacterium tuberculosis
CIGVSLLVDRQSGRCI

SEQ ID NO: 91193 - protein, 16 aa, Mycobacterium tuberculosis
IGVSLLVDRQSGRCIA

SEQ ID NO: 91194 - protein, 16 aa, Mycobacterium tuberculosis
GVSLLVDRQSGRCIAT

SEQ ID NO: 91195 - protein, 16 aa, Mycobacterium tuberculosis
VSLLVDRQSGRCIATS

SEQ ID NO: 91196 - protein, 16 aa, Mycobacterium tuberculosis
SLLVDRQSGRCIATSA

SEQ ID NO: 91197 - protein, 16 aa, Mycobacterium tuberculosis
LLVDRQSGRCIATSAW

SEQ ID NO: 91198 - protein, 16 aa, Mycobacterium tuberculosis
LVDRQSGRCIATSAWE

SEQ ID NO: 91199 - protein, 16 aa, Mycobacterium tuberculosis
VDRQSGRCIATSAWET

SEQ ID NO: 91200 - protein, 16 aa, Mycobacterium tuberculosis
DRQSGRCIATSAWETA

SEQ ID NO: 91201 - protein, 16 aa, Mycobacterium tuberculosis
RQSGRCIATSAWETAE

SEQ ID NO: 91202 - protein, 16 aa, Mycobacterium tuberculosis
QSGRCIATSAWETAEA

SEQ ID NO: 91203 - protein, 16 aa, Mycobacterium tuberculosis
SGRCIATSAWETAEAM

SEQ ID NO: 91204 - protein, 16 aa, Mycobacterium tuberculosis
GRCIATSAWETAEAMH

SEQ ID NO: 91205 - protein, 16 aa, Mycobacterium tuberculosis
RCIATSAWETAEAMHA

SEQ ID NO: 91206 - protein, 16 aa, Mycobacterium tuberculosis
CIATSAWETAEAMHAS

SEQ ID NO: 91207 - protein, 16 aa, Mycobacterium tuberculosis
IATSAWETAEAMHASR

SEQ ID NO: 91208 - protein, 16 aa, Mycobacterium tuberculosis
ATSAWETAEAMHASRE

SEQ ID NO: 91209 - protein, 16 aa, Mycobacterium tuberculosis
TSAWETAEAMHASREQ

SEQ ID NO: 91210 - protein, 16 aa, Mycobacterium tuberculosis
SAWETAEAMHASREQV

SEQ ID NO: 91211 - protein, 16 aa, Mycobacterium tuberculosis
AWETAEAMHASREQVT

SEQ ID NO: 91212 - protein, 16 aa, Mycobacterium tuberculosis
WETAEAMHASREQVTP

SEQ ID NO: 91213 - protein, 16 aa, Mycobacterium tuberculosis
ETAEAMHASREQVTPI

SEQ ID NO: 91214 - protein, 16 aa, Mycobacterium tuberculosis
TAEAMHASREQVTPIR

SEQ ID NO: 91215 - protein, 16 aa, Mycobacterium tuberculosis
AEAMHASREQVTPIRD

SEQ ID NO: 91216 - protein, 16 aa, Mycobacterium tuberculosis
EAMHASREQVTPIRDR

SEQ ID NO: 91217 - protein, 16 aa, Mycobacterium tuberculosis
AMHASREQVTPIRDRC

SEQ ID NO: 91218 - protein, 16 aa, Mycobacterium tuberculosis
MHASREQVTPIRDRCA

SEQ ID NO: 91219 - protein, 16 aa, Mycobacterium tuberculosis
HASREQVTPIRDRCAE

SEQ ID NO: 91220 - protein, 16 aa, Mycobacterium tuberculosis
ASREQVTPIRDRCAEM

SEQ ID NO: 91221 - protein, 16 aa, Mycobacterium tuberculosis
SREQVTPIRDRCAEMF

SEQ ID NO: 91222 - protein, 16 aa, Mycobacterium tuberculosis
REQVTPIRDRCAEMFG

SEQ ID NO: 91223 - protein, 16 aa, Mycobacterium tuberculosis
EQVTPIRDRCAEMFGG

SEQ ID NO: 91224 - protein, 16 aa, Mycobacterium tuberculosis
QVTPIRDRCAEMFGGT

SEQ ID NO: 91225 - protein, 16 aa, Mycobacterium tuberculosis
VTPIRDRCAEMFGGTP

SEQ ID NO: 91226 - protein, 16 aa, Mycobacterium tuberculosis
TPIRDRCAEMFGGTPA

SEQ ID NO: 91227 - protein, 16 aa, Mycobacterium tuberculosis
PIRDRCAEMFGGTPAV

SEQ ID NO: 91228 - protein, 16 aa, Mycobacterium tuberculosis
IRDRCAEMFGGTPAVE

SEQ ID NO: 91229 - protein, 16 aa, Mycobacterium tuberculosis
RDRCAEMFGGTPAVEE

SEQ ID NO: 91230 - protein, 16 aa, Mycobacterium tuberculosis
DRCAEMFGGTPAVEEW

SEQ ID NO: 91231 - protein, 16 aa, Mycobacterium tuberculosis
RCAEMFGGTPAVEEWE

SEQ ID NO: 91232 - protein, 16 aa, Mycobacterium tuberculosis
CAEMFGGTPAVEEWEI

SEQ ID NO: 91233 - protein, 16 aa, Mycobacterium tuberculosis
AEMFGGTPAVEEWEIA

SEQ ID NO: 91234 - protein, 16 aa, Mycobacterium tuberculosis
EMFGGTPAVEEWEIAA

SEQ ID NO: 91235 - protein, 16 aa, Mycobacterium tuberculosis
MFGGTPAVEEWEIAAM

SEQ ID NO: 91236 - protein, 16 aa, Mycobacterium tuberculosis
FGGTPAVEEWEIAAMH

SEQ ID NO: 91237 - protein, 16 aa, Mycobacterium tuberculosis
GGTPAVEEWEIAAMHR

SEQ ID NO: 91238 - protein, 16 aa, Mycobacterium tuberculosis
GTPAVEEWEIAAMHRD

SEQ ID NO: 91239 - protein, 16 aa, Mycobacterium tuberculosis
TPAVEEWEIAAMHRDH

SEQ ID NO: 91240 - protein, 16 aa, Mycobacterium tuberculosis
PAVEEWEIAAMHRDHR

SEQ ID NO: 91241 - protein, 16 aa, Mycobacterium tuberculosis
AVEEWEIAAMHRDHRS

SEQ ID NO: 91242 - protein, 16 aa, Mycobacterium tuberculosis
VEEWEIAAMHRDHRSA

SEQ ID NO: 91243 - protein, 16 aa, Mycobacterium tuberculosis
EEWEIAAMHRDHRSAE

SEQ ID NO: 91244 - protein, 16 aa, Mycobacterium tuberculosis
EWEIAAMHRDHRSAEG

SEQ ID NO: 91245 - protein, 16 aa, Mycobacterium tuberculosis
WEIAAMHRDHRSAEGA

SEQ ID NO: 91246 - protein, 16 aa, Mycobacterium tuberculosis
EIAAMHRDHRSAEGAC

SEQ ID NO: 91247 - protein, 16 aa, Mycobacterium tuberculosis
IAAMHRDHRSAEGACV

SEQ ID NO: 91248 - protein, 16 aa, Mycobacterium tuberculosis
AAMHRDHRSAEGACVR

SEQ ID NO: 91249 - protein, 16 aa, Mycobacterium tuberculosis
AMHRDHRSAEGACVRA

SEQ ID NO: 91250 - protein, 16 aa, Mycobacterium tuberculosis
MHRDHRSAEGACVRAT

SEQ ID NO: 91251 - protein, 16 aa, Mycobacterium tuberculosis
HRDHRSAEGACVRATW

SEQ ID NO: 91252 - protein, 16 aa, Mycobacterium tuberculosis
RDHRSAEGACVRATWV

SEQ ID NO: 91253 - protein, 16 aa, Mycobacterium tuberculosis
DHRSAEGACVRATWVK

SEQ ID NO: 91254 - protein, 16 aa, Mycobacterium tuberculosis
HRSAEGACVRATWVKV

SEQ ID NO: 91255 - protein, 16 aa, Mycobacterium tuberculosis
RSAEGACVRATWVKVP

SEQ ID NO: 91256 - protein, 16 aa, Mycobacterium tuberculosis
SAEGACVRATWVKVPA

SEQ ID NO: 91257 - protein, 16 aa, Mycobacterium tuberculosis
AEGACVRATWVKVPAD

SEQ ID NO: 91258 - protein, 16 aa, Mycobacterium tuberculosis
EGACVRATWVKVPADQ

SEQ ID NO: 91259 - protein, 16 aa, Mycobacterium tuberculosis
GACVRATWVKVPADQV

SEQ ID NO: 91260 - protein, 16 aa, Mycobacterium tuberculosis
ACVRATWVKVPADQVD

SEQ ID NO: 91261 - protein, 16 aa, Mycobacterium tuberculosis
CVRATWVKVPADQVDQ

SEQ ID NO: 91262 - protein, 16 aa, Mycobacterium tuberculosis
VRATWVKVPADQVDQG

SEQ ID NO: 91263 - protein, 16 aa, Mycobacterium tuberculosis
RATWVKVPADQVDQGI

SEQ ID NO: 91264 - protein, 16 aa, Mycobacterium tuberculosis
ATWVKVPADQVDQGIE

SEQ ID NO: 91265 - protein, 16 aa, Mycobacterium tuberculosis
TWVKVPADQVDQGIEY

SEQ ID NO: 91266 - protein, 16 aa, Mycobacterium tuberculosis
WVKVPADQVDQGIEYY

SEQ ID NO: 91267 - protein, 16 aa, Mycobacterium tuberculosis
VKVPADQVDQGIEYYK

SEQ ID NO: 91268 - protein, 16 aa, Mycobacterium tuberculosis
KVPADQVDQGIEYYKS

SEQ ID NO: 91269 - protein, 16 aa, Mycobacterium tuberculosis
VPADQVDQGIEYYKSS

SEQ ID NO: 91270 - protein, 16 aa, Mycobacterium tuberculosis
PADQVDQGIEYYKSSV

SEQ ID NO: 91271 - protein, 16 aa, Mycobacterium tuberculosis
ADQVDQGIEYYKSSVL

SEQ ID NO: 91272 - protein, 16 aa, Mycobacterium tuberculosis
DQVDQGIEYYKSSVLP

SEQ ID NO: 91273 - protein, 16 aa, Mycobacterium tuberculosis
QVDQGIEYYKSSVLPQ

SEQ ID NO: 91274 - protein, 16 aa, Mycobacterium tuberculosis
VDQGIEYYKSSVLPQI

SEQ ID NO: 91275 - protein, 16 aa, Mycobacterium tuberculosis
DQGIEYYKSSVLPQIE

SEQ ID NO: 91276 - protein, 16 aa, Mycobacterium tuberculosis
QGIEYYKSSVLPQIEG

SEQ ID NO: 91277 - protein, 16 aa, Mycobacterium tuberculosis
GIEYYKSSVLPQIEGL

SEQ ID NO: 91278 - protein, 16 aa, Mycobacterium tuberculosis
IEYYKSSVLPQIEGLD

SEQ ID NO: 91279 - protein, 16 aa, Mycobacterium tuberculosis
EYYKSSVLPQIEGLDG

SEQ ID NO: 91280 - protein, 16 aa, Mycobacterium tuberculosis
YYKSSVLPQIEGLDGF

SEQ ID NO: 91281 - protein, 16 aa, Mycobacterium tuberculosis
YKSSVLPQIEGLDGFC

SEQ ID NO: 91282 - protein, 16 aa, Mycobacterium tuberculosis
KSSVLPQIEGLDGFCS

SEQ ID NO: 91283 - protein, 16 aa, Mycobacterium tuberculosis
SSVLPQIEGLDGFCSA

SEQ ID NO: 91284 - protein, 16 aa, Mycobacterium tuberculosis
SVLPQIEGLDGFCSAS

SEQ ID NO: 91285 - protein, 16 aa, Mycobacterium tuberculosis
VLPQIEGLDGFCSASL

SEQ ID NO: 91286 - protein, 16 aa, Mycobacterium tuberculosis
LPQIEGLDGFCSASLL

SEQ ID NO: 91287 - protein, 16 aa, Mycobacterium tuberculosis
PQIEGLDGFCSASLLV

SEQ ID NO: 91288 - protein, 16 aa, Mycobacterium tuberculosis
QIEGLDGFCSASLLVD

SEQ ID NO: 91289 - protein, 16 aa, Mycobacterium tuberculosis
IEGLDGFCSASLLVDR

SEQ ID NO: 91290 - protein, 16 aa, Mycobacterium tuberculosis
EGLDGFCSASLLVDRT

SEQ ID NO: 91291 - protein, 16 aa, Mycobacterium tuberculosis
GLDGFCSASLLVDRTS

SEQ ID NO: 91292 - protein, 16 aa, Mycobacterium tuberculosis
LDGFCSASLLVDRTSG

SEQ ID NO: 91293 - protein, 16 aa, Mycobacterium tuberculosis
DGFCSASLLVDRTSGR

SEQ ID NO: 91294 - protein, 16 aa, Mycobacterium tuberculosis
GFCSASLLVDRTSGRA

SEQ ID NO: 91295 - protein, 16 aa, Mycobacterium tuberculosis
FCSASLLVDRTSGRAV

SEQ ID NO: 91296 - protein, 16 aa, Mycobacterium tuberculosis
CSASLLVDRTSGRAVS

SEQ ID NO: 91297 - protein, 16 aa, Mycobacterium tuberculosis
SASLLVDRTSGRAVSS

SEQ ID NO: 91298 - protein, 16 aa, Mycobacterium tuberculosis
ASLLVDRTSGRAVSSA

SEQ ID NO: 91299 - protein, 16 aa, Mycobacterium tuberculosis
SLLVDRTSGRAVSSAT

SEQ ID NO: 91300 - protein, 16 aa, Mycobacterium tuberculosis
LLVDRTSGRAVSSATF

SEQ ID NO: 91301 - protein, 16 aa, Mycobacterium tuberculosis
LVDRTSGRAVSSATFD

SEQ ID NO: 91302 - protein, 16 aa, Mycobacterium tuberculosis
VDRTSGRAVSSATFDS

SEQ ID NO: 91303 - protein, 16 aa, Mycobacterium tuberculosis
DRTSGRAVSSATFDSF

SEQ ID NO: 91304 - protein, 16 aa, Mycobacterium tuberculosis
RTSGRAVSSATFDSFD

SEQ ID NO: 91305 - protein, 16 aa, Mycobacterium tuberculosis
TSGRAVSSATFDSFDA

SEQ ID NO: 91306 - protein, 16 aa, Mycobacterium tuberculosis
SGRAVSSATFDSFDAM

SEQ ID NO: 91307 - protein, 16 aa, Mycobacterium tuberculosis
GRAVSSATFDSFDAME

SEQ ID NO: 91308 - protein, 16 aa, Mycobacterium tuberculosis
RAVSSATFDSFDAMER

SEQ ID NO: 91309 - protein, 16 aa, Mycobacterium tuberculosis
AVSSATFDSFDAMERN

SEQ ID NO: 91310 - protein, 16 aa, Mycobacterium tuberculosis
VSSATFDSFDAMERNR

SEQ ID NO: 91311 - protein, 16 aa, Mycobacterium tuberculosis
SSATFDSFDAMERNRD

SEQ ID NO: 91312 - protein, 16 aa, Mycobacterium tuberculosis
SATFDSFDAMERNRDQ

SEQ ID NO: 91313 - protein, 16 aa, Mycobacterium tuberculosis
ATFDSFDAMERNRDQS

SEQ ID NO: 91314 - protein, 16 aa, Mycobacterium tuberculosis
TFDSFDAMERNRDQSN

SEQ ID NO: 91315 - protein, 16 aa, Mycobacterium tuberculosis
FDSFDAMERNRDQSNA

SEQ ID NO: 91316 - protein, 16 aa, Mycobacterium tuberculosis
DSFDAMERNRDQSNAL

SEQ ID NO: 91317 - protein, 16 aa, Mycobacterium tuberculosis
SFDAMERNRDQSNALK

SEQ ID NO: 91318 - protein, 16 aa, Mycobacterium tuberculosis
FDAMERNRDQSNALKA

SEQ ID NO: 91319 - protein, 16 aa, Mycobacterium tuberculosis
DAMERNRDQSNALKAT

SEQ ID NO: 91320 - protein, 16 aa, Mycobacterium tuberculosis
AMERNRDQSNALKATS

SEQ ID NO: 91321 - protein, 16 aa, Mycobacterium tuberculosis
MERNRDQSNALKATSL

SEQ ID NO: 91322 - protein, 16 aa, Mycobacterium tuberculosis
ERNRDQSNALKATSLR

SEQ ID NO: 91323 - protein, 16 aa, Mycobacterium tuberculosis
RNRDQSNALKATSLRE

SEQ ID NO: 91324 - protein, 16 aa, Mycobacterium tuberculosis
NRDQSNALKATSLREA

SEQ ID NO: 91325 - protein, 16 aa, Mycobacterium tuberculosis
RDQSNALKATSLREAG

SEQ ID NO: 91326 - protein, 16 aa, Mycobacterium tuberculosis
DQSNALKATSLREAGG

SEQ ID NO: 91327 - protein, 16 aa, Mycobacterium tuberculosis
QSNALKATSLREAGGE

SEQ ID NO: 91328 - protein, 16 aa, Mycobacterium tuberculosis
SNALKATSLREAGGEE

SEQ ID NO: 91329 - protein, 16 aa, Mycobacterium tuberculosis
NALKATSLREAGGEEL

SEQ ID NO: 91330 - protein, 16 aa, Mycobacterium tuberculosis
ALKATSLREAGGEELD

SEQ ID NO: 91331 - protein, 16 aa, Mycobacterium tuberculosis
LKATSLREAGGEELDE

SEQ ID NO: 91332 - protein, 16 aa, Mycobacterium tuberculosis
KATSLREAGGEELDEC

SEQ ID NO: 91333 - protein, 16 aa, Mycobacterium tuberculosis
ATSLREAGGEELDECE

SEQ ID NO: 91334 - protein, 16 aa, Mycobacterium tuberculosis
TSLREAGGEELDECEF

SEQ ID NO: 91335 - protein, 16 aa, Mycobacterium tuberculosis
SLREAGGEELDECEFE

SEQ ID NO: 91336 - protein, 16 aa, Mycobacterium tuberculosis
LREAGGEELDECEFEL

SEQ ID NO: 91337 - protein, 16 aa, Mycobacterium tuberculosis
REAGGEELDECEFELA

SEQ ID NO: 91338 - protein, 16 aa, Mycobacterium tuberculosis
EAGGEELDECEFELAL

SEQ ID NO: 91339 - protein, 16 aa, Mycobacterium tuberculosis
AGGEELDECEFELALA

SEQ ID NO: 91340 - protein, 16 aa, Mycobacterium tuberculosis
GGEELDECEFELALAH

SEQ ID NO: 91341 - protein, 16 aa, Mycobacterium tuberculosis
GEELDECEFELALAHL

SEQ ID NO: 91342 - protein, 16 aa, Mycobacterium tuberculosis
EELDECEFELALAHLR

SEQ ID NO: 91343 - protein, 16 aa, Mycobacterium tuberculosis
ELDECEFELALAHLRV

SEQ ID NO: 91344 - protein, 16 aa, Mycobacterium tuberculosis
LDECEFELALAHLRVP

SEQ ID NO: 91345 - protein, 16 aa, Mycobacterium tuberculosis
DECEFELALAHLRVPE

SEQ ID NO: 91346 - protein, 16 aa, Mycobacterium tuberculosis
ECEFELALAHLRVPEL

SEQ ID NO: 91347 - protein, 16 aa, Mycobacterium tuberculosis
CEFELALAHLRVPELV

SEQ ID NO: 91348 - protein, 13 aa, Mycobacterium tuberculosis
MPGSAGWRKVFGG

SEQ ID NO: 91349 - protein, 13 aa, Mycobacterium tuberculosis
PGSAGWRKVFGGT

SEQ ID NO: 91350 - protein, 13 aa, Mycobacterium tuberculosis
GSAGWRKVFGGTG

SEQ ID NO: 91351 - protein, 13 aa, Mycobacterium tuberculosis
SAGWRKVFGGTGG

SEQ ID NO: 91352 - protein, 13 aa, Mycobacterium tuberculosis
AGWRKVFGGTGGA

SEQ ID NO: 91353 - protein, 13 aa, Mycobacterium tuberculosis
GWRKVFGGTGGAT

SEQ ID NO: 91354 - protein, 13 aa, Mycobacterium tuberculosis
WRKVFGGTGGATG

SEQ ID NO: 91355 - protein, 13 aa, Mycobacterium tuberculosis
RKVFGGTGGATGA

SEQ ID NO: 91356 - protein, 13 aa, Mycobacterium tuberculosis
KVFGGTGGATGAL

SEQ ID NO: 91357 - protein, 13 aa, Mycobacterium tuberculosis
VFGGTGGATGALP

SEQ ID NO: 91358 - protein, 13 aa, Mycobacterium tuberculosis
FGGTGGATGALPR

SEQ ID NO: 91359 - protein, 13 aa, Mycobacterium tuberculosis
GGTGGATGALPRH

SEQ ID NO: 91360 - protein, 13 aa, Mycobacterium tuberculosis
GTGGATGALPRHG

SEQ ID NO: 91361 - protein, 13 aa, Mycobacterium tuberculosis
TGGATGALPRHGR

SEQ ID NO: 91362 - protein, 13 aa, Mycobacterium tuberculosis
GGATGALPRHGRG

SEQ ID NO: 91363 - protein, 13 aa, Mycobacterium tuberculosis
GATGALPRHGRGS

SEQ ID NO: 91364 - protein, 13 aa, Mycobacterium tuberculosis
ATGALPRHGRGSI

SEQ ID NO: 91365 - protein, 13 aa, Mycobacterium tuberculosis
TGALPRHGRGSIV

SEQ ID NO: 91366 - protein, 13 aa, Mycobacterium tuberculosis
GALPRHGRGSIVY

SEQ ID NO: 91367 - protein, 13 aa, Mycobacterium tuberculosis
ALPRHGRGSIVYA

SEQ ID NO: 91368 - protein, 13 aa, Mycobacterium tuberculosis
LPRHGRGSIVYAR

SEQ ID NO: 91369 - protein, 13 aa, Mycobacterium tuberculosis
PRHGRGSIVYARS

SEQ ID NO: 91370 - protein, 13 aa, Mycobacterium tuberculosis
RHGRGSIVYARST

SEQ ID NO: 91371 - protein, 13 aa, Mycobacterium tuberculosis
HGRGSIVYARSTT

SEQ ID NO: 91372 - protein, 13 aa, Mycobacterium tuberculosis
GRGSIVYARSTTI

SEQ ID NO: 91373 - protein, 13 aa, Mycobacterium tuberculosis
RGSIVYARSTTIE

SEQ ID NO: 91374 - protein, 13 aa, Mycobacterium tuberculosis
GSIVYARSTTIEA

SEQ ID NO: 91375 - protein, 13 aa, Mycobacterium tuberculosis
SIVYARSTTIEAQ

SEQ ID NO: 91376 - protein, 13 aa, Mycobacterium tuberculosis
IVYARSTTIEAQP

SEQ ID NO: 91377 - protein, 13 aa, Mycobacterium tuberculosis
VYARSTTIEAQPL

SEQ ID NO: 91378 - protein, 13 aa, Mycobacterium tuberculosis
YARSTTIEAQPLS

SEQ ID NO: 91379 - protein, 13 aa, Mycobacterium tuberculosis
ARSTTIEAQPLSV

SEQ ID NO: 91380 - protein, 13 aa, Mycobacterium tuberculosis
RSTTIEAQPLSVD

SEQ ID NO: 91381 - protein, 13 aa, Mycobacterium tuberculosis
STTIEAQPLSVDI

SEQ ID NO: 91382 - protein, 13 aa, Mycobacterium tuberculosis
TTIEAQPLSVDIG

SEQ ID NO: 91383 - protein, 13 aa, Mycobacterium tuberculosis
TIEAQPLSVDIGI

SEQ ID NO: 91384 - protein, 13 aa, Mycobacterium tuberculosis
IEAQPLSVDIGIA

SEQ ID NO: 91385 - protein, 13 aa, Mycobacterium tuberculosis
EAQPLSVDIGIAH

SEQ ID NO: 91386 - protein, 13 aa, Mycobacterium tuberculosis
AQPLSVDIGIAHV

SEQ ID NO: 91387 - protein, 13 aa, Mycobacterium tuberculosis
QPLSVDIGIAHVR

SEQ ID NO: 91388 - protein, 13 aa, Mycobacterium tuberculosis
PLSVDIGIAHVRD

SEQ ID NO: 91389 - protein, 13 aa, Mycobacterium tuberculosis
LSVDIGIAHVRDV

SEQ ID NO: 91390 - protein, 13 aa, Mycobacterium tuberculosis
SVDIGIAHVRDVV

SEQ ID NO: 91391 - protein, 13 aa, Mycobacterium tuberculosis
VDIGIAHVRDVVM

SEQ ID NO: 91392 - protein, 13 aa, Mycobacterium tuberculosis
DIGIAHVRDVVMP

SEQ ID NO: 91393 - protein, 13 aa, Mycobacterium tuberculosis
IGIAHVRDVVMPA

SEQ ID NO: 91394 - protein, 13 aa, Mycobacterium tuberculosis
GIAHVRDVVMPAL

SEQ ID NO: 91395 - protein, 13 aa, Mycobacterium tuberculosis
IAHVRDVVMPALQ

SEQ ID NO: 91396 - protein, 13 aa, Mycobacterium tuberculosis
AHVRDVVMPALQE

SEQ ID NO: 91397 - protein, 13 aa, Mycobacterium tuberculosis
HVRDVVMPALQEI

SEQ ID NO: 91398 - protein, 13 aa, Mycobacterium tuberculosis
VRDVVMPALQEID

SEQ ID NO: 91399 - protein, 13 aa, Mycobacterium tuberculosis
RDVVMPALQEIDG

SEQ ID NO: 91400 - protein, 13 aa, Mycobacterium tuberculosis
DVVMPALQEIDGC

SEQ ID NO: 91401 - protein, 13 aa, Mycobacterium tuberculosis
VVMPALQEIDGCV

SEQ ID NO: 91402 - protein, 13 aa, Mycobacterium tuberculosis
VMPALQEIDGCVG

SEQ ID NO: 91403 - protein, 13 aa, Mycobacterium tuberculosis
MPALQEIDGCVGV

SEQ ID NO: 91404 - protein, 13 aa, Mycobacterium tuberculosis
PALQEIDGCVGVS

SEQ ID NO: 91405 - protein, 13 aa, Mycobacterium tuberculosis
ALQEIDGCVGVSL

SEQ ID NO: 91406 - protein, 13 aa, Mycobacterium tuberculosis
LQEIDGCVGVSLL

SEQ ID NO: 91407 - protein, 13 aa, Mycobacterium tuberculosis
QEIDGCVGVSLLV

SEQ ID NO: 91408 - protein, 13 aa, Mycobacterium tuberculosis
EIDGCVGVSLLVD

SEQ ID NO: 91409 - protein, 13 aa, Mycobacterium tuberculosis
IDGCVGVSLLVDR

SEQ ID NO: 91410 - protein, 13 aa, Mycobacterium tuberculosis
DGCVGVSLLVDRQ

SEQ ID NO: 91411 - protein, 13 aa, Mycobacterium tuberculosis
GCVGVSLLVDRQS

SEQ ID NO: 91412 - protein, 13 aa, Mycobacterium tuberculosis
CVGVSLLVDRQSG

SEQ ID NO: 91413 - protein, 13 aa, Mycobacterium tuberculosis
VGVSLLVDRQSGR

SEQ ID NO: 91414 - protein, 13 aa, Mycobacterium tuberculosis
GVSLLVDRQSGRC

SEQ ID NO: 91415 - protein, 13 aa, Mycobacterium tuberculosis
VSLLVDRQSGRCI

SEQ ID NO: 91416 - protein, 13 aa, Mycobacterium tuberculosis
SLLVDRQSGRCIA

SEQ ID NO: 91417 - protein, 13 aa, Mycobacterium tuberculosis
LLVDRQSGRCIAT

SEQ ID NO: 91418 - protein, 13 aa, Mycobacterium tuberculosis
LVDRQSGRCIATS

SEQ ID NO: 91419 - protein, 13 aa, Mycobacterium tuberculosis
VDRQSGRCIATSA

SEQ ID NO: 91420 - protein, 13 aa, Mycobacterium tuberculosis
DRQSGRCIATSAW

SEQ ID NO: 91421 - protein, 13 aa, Mycobacterium tuberculosis
RQSGRCIATSAWE

SEQ ID NO: 91422 - protein, 13 aa, Mycobacterium tuberculosis
QSGRCIATSAWET

SEQ ID NO: 91423 - protein, 13 aa, Mycobacterium tuberculosis
SGRCIATSAWETL

SEQ ID NO: 91424 - protein, 13 aa, Mycobacterium tuberculosis
GRCIATSAWETLE

SEQ ID NO: 91425 - protein, 13 aa, Mycobacterium tuberculosis
RCIATSAWETLEA

SEQ ID NO: 91426 - protein, 13 aa, Mycobacterium tuberculosis
CIATSAWETLEAM

SEQ ID NO: 91427 - protein, 13 aa, Mycobacterium tuberculosis
IATSAWETLEAMR

SEQ ID NO: 91428 - protein, 13 aa, Mycobacterium tuberculosis
ATSAWETLEAMRA

SEQ ID NO: 91429 - protein, 13 aa, Mycobacterium tuberculosis
TSAWETLEAMRAS

SEQ ID NO: 91430 - protein, 13 aa, Mycobacterium tuberculosis
SAWETLEAMRASV

SEQ ID NO: 91431 - protein, 13 aa, Mycobacterium tuberculosis
AWETLEAMRASVE

SEQ ID NO: 91432 - protein, 13 aa, Mycobacterium tuberculosis
WETLEAMRASVER

SEQ ID NO: 91433 - protein, 13 aa, Mycobacterium tuberculosis
ETLEAMRASVERV

SEQ ID NO: 91434 - protein, 13 aa, Mycobacterium tuberculosis
TLEAMRASVERVA

SEQ ID NO: 91435 - protein, 13 aa, Mycobacterium tuberculosis
LEAMRASVERVAP

SEQ ID NO: 91436 - protein, 13 aa, Mycobacterium tuberculosis
EAMRASVERVAPI

SEQ ID NO: 91437 - protein, 13 aa, Mycobacterium tuberculosis
AMRASVERVAPIR

SEQ ID NO: 91438 - protein, 13 aa, Mycobacterium tuberculosis
MRASVERVAPIRD

SEQ ID NO: 91439 - protein, 13 aa, Mycobacterium tuberculosis
RASVERVAPIRDR

SEQ ID NO: 91440 - protein, 13 aa, Mycobacterium tuberculosis
ASVERVAPIRDRA

SEQ ID NO: 91441 - protein, 13 aa, Mycobacterium tuberculosis
SVERVAPIRDRAA

SEQ ID NO: 91442 - protein, 13 aa, Mycobacterium tuberculosis
VERVAPIRDRAAL

SEQ ID NO: 91443 - protein, 13 aa, Mycobacterium tuberculosis
ERVAPIRDRAALM

SEQ ID NO: 91444 - protein, 13 aa, Mycobacterium tuberculosis
RVAPIRDRAALMF

SEQ ID NO: 91445 - protein, 13 aa, Mycobacterium tuberculosis
VAPIRDRAALMFA

SEQ ID NO: 91446 - protein, 13 aa, Mycobacterium tuberculosis
APIRDRAALMFAG

SEQ ID NO: 91447 - protein, 13 aa, Mycobacterium tuberculosis
PIRDRAALMFAGS

SEQ ID NO: 91448 - protein, 13 aa, Mycobacterium tuberculosis
IRDRAALMFAGSA

SEQ ID NO: 91449 - protein, 13 aa, Mycobacterium tuberculosis
RDRAALMFAGSAR

SEQ ID NO: 91450 - protein, 13 aa, Mycobacterium tuberculosis
DRAALMFAGSARV

SEQ ID NO: 91451 - protein, 13 aa, Mycobacterium tuberculosis
RAALMFAGSARVE

SEQ ID NO: 91452 - protein, 13 aa, Mycobacterium tuberculosis
AALMFAGSARVEE

SEQ ID NO: 91453 - protein, 13 aa, Mycobacterium tuberculosis
ALMFAGSARVEEW

SEQ ID NO: 91454 - protein, 13 aa, Mycobacterium tuberculosis
LMFAGSARVEEWD

SEQ ID NO: 91455 - protein, 13 aa, Mycobacterium tuberculosis
MFAGSARVEEWDI

SEQ ID NO: 91456 - protein, 13 aa, Mycobacterium tuberculosis
FAGSARVEEWDIA

SEQ ID NO: 91457 - protein, 13 aa, Mycobacterium tuberculosis
AGSARVEEWDIAL

SEQ ID NO: 91458 - protein, 13 aa, Mycobacterium tuberculosis
GSARVEEWDIALL

SEQ ID NO: 91459 - protein, 13 aa, Mycobacterium tuberculosis
SARVEEWDIALLH

SEQ ID NO: 91460 - protein, 13 aa, Mycobacterium tuberculosis
ARVEEWDIALLHR

SEQ ID NO: 91461 - protein, 13 aa, Mycobacterium tuberculosis
RVEEWDIALLHRD

SEQ ID NO: 91462 - protein, 13 aa, Mycobacterium tuberculosis
VEEWDIALLHRDH

SEQ ID NO: 91463 - protein, 13 aa, Mycobacterium tuberculosis
EEWDIALLHRDHP

SEQ ID NO: 91464 - protein, 13 aa, Mycobacterium tuberculosis
EWDIALLHRDHPS

SEQ ID NO: 91465 - protein, 13 aa, Mycobacterium tuberculosis
WDIALLHRDHPSH

SEQ ID NO: 91466 - protein, 13 aa, Mycobacterium tuberculosis
DIALLHRDHPSHE

SEQ ID NO: 91467 - protein, 13 aa, Mycobacterium tuberculosis
IALLHRDHPSHEG

SEQ ID NO: 91468 - protein, 13 aa, Mycobacterium tuberculosis
ALLHRDHPSHEGA

SEQ ID NO: 91469 - protein, 13 aa, Mycobacterium tuberculosis
LLHRDHPSHEGAC

SEQ ID NO: 91470 - protein, 13 aa, Mycobacterium tuberculosis
LHRDHPSHEGACV

SEQ ID NO: 91471 - protein, 13 aa, Mycobacterium tuberculosis
HRDHPSHEGACVR

SEQ ID NO: 91472 - protein, 13 aa, Mycobacterium tuberculosis
RDHPSHEGACVRA

SEQ ID NO: 91473 - protein, 13 aa, Mycobacterium tuberculosis
DHPSHEGACVRAT

SEQ ID NO: 91474 - protein, 13 aa, Mycobacterium tuberculosis
HPSHEGACVRATW

SEQ ID NO: 91475 - protein, 13 aa, Mycobacterium tuberculosis
PSHEGACVRATWL

SEQ ID NO: 91476 - protein, 13 aa, Mycobacterium tuberculosis
SHEGACVRATWLK

SEQ ID NO: 91477 - protein, 13 aa, Mycobacterium tuberculosis
HEGACVRATWLKV

SEQ ID NO: 91478 - protein, 13 aa, Mycobacterium tuberculosis
EGACVRATWLKVV

SEQ ID NO: 91479 - protein, 13 aa, Mycobacterium tuberculosis
GACVRATWLKVVP

SEQ ID NO: 91480 - protein, 13 aa, Mycobacterium tuberculosis
ACVRATWLKVVPD

SEQ ID NO: 91481 - protein, 13 aa, Mycobacterium tuberculosis
CVRATWLKVVPDQ

SEQ ID NO: 91482 - protein, 13 aa, Mycobacterium tuberculosis
VRATWLKVVPDQL

SEQ ID NO: 91483 - protein, 13 aa, Mycobacterium tuberculosis
RATWLKVVPDQLG

SEQ ID NO: 91484 - protein, 13 aa, Mycobacterium tuberculosis
ATWLKVVPDQLGR

SEQ ID NO: 91485 - protein, 13 aa, Mycobacterium tuberculosis
TWLKVVPDQLGRS

SEQ ID NO: 91486 - protein, 13 aa, Mycobacterium tuberculosis
WLKVVPDQLGRSL

SEQ ID NO: 91487 - protein, 13 aa, Mycobacterium tuberculosis
LKVVPDQLGRSLE

SEQ ID NO: 91488 - protein, 13 aa, Mycobacterium tuberculosis
KVVPDQLGRSLEF

SEQ ID NO: 91489 - protein, 13 aa, Mycobacterium tuberculosis
VVPDQLGRSLEFY

SEQ ID NO: 91490 - protein, 13 aa, Mycobacterium tuberculosis
VPDQLGRSLEFYR

SEQ ID NO: 91491 - protein, 13 aa, Mycobacterium tuberculosis
PDQLGRSLEFYRT

SEQ ID NO: 91492 - protein, 13 aa, Mycobacterium tuberculosis
DQLGRSLEFYRTS

SEQ ID NO: 91493 - protein, 13 aa, Mycobacterium tuberculosis
QLGRSLEFYRTSV

SEQ ID NO: 91494 - protein, 13 aa, Mycobacterium tuberculosis
LGRSLEFYRTSVL

SEQ ID NO: 91495 - protein, 13 aa, Mycobacterium tuberculosis
GRSLEFYRTSVLP

SEQ ID NO: 91496 - protein, 13 aa, Mycobacterium tuberculosis
RSLEFYRTSVLPE

SEQ ID NO: 91497 - protein, 13 aa, Mycobacterium tuberculosis
SLEFYRTSVLPEL

SEQ ID NO: 91498 - protein, 13 aa, Mycobacterium tuberculosis
LEFYRTSVLPELE

SEQ ID NO: 91499 - protein, 13 aa, Mycobacterium tuberculosis
EFYRTSVLPELES

SEQ ID NO: 91500 - protein, 13 aa, Mycobacterium tuberculosis
FYRTSVLPELESL

SEQ ID NO: 91501 - protein, 13 aa, Mycobacterium tuberculosis
YRTSVLPELESLD

SEQ ID NO: 91502 - protein, 13 aa, Mycobacterium tuberculosis
RTSVLPELESLDG

SEQ ID NO: 91503 - protein, 13 aa, Mycobacterium tuberculosis
TSVLPELESLDGF

SEQ ID NO: 91504 - protein, 13 aa, Mycobacterium tuberculosis
SVLPELESLDGFC

SEQ ID NO: 91505 - protein, 13 aa, Mycobacterium tuberculosis
VLPELESLDGFCS

SEQ ID NO: 91506 - protein, 13 aa, Mycobacterium tuberculosis
LPELESLDGFCSA

SEQ ID NO: 91507 - protein, 13 aa, Mycobacterium tuberculosis
PELESLDGFCSAS

SEQ ID NO: 91508 - protein, 13 aa, Mycobacterium tuberculosis
ELESLDGFCSASL

SEQ ID NO: 91509 - protein, 13 aa, Mycobacterium tuberculosis
LESLDGFCSASLM

SEQ ID NO: 91510 - protein, 13 aa, Mycobacterium tuberculosis
ESLDGFCSASLMV

SEQ ID NO: 91511 - protein, 13 aa, Mycobacterium tuberculosis
SLDGFCSASLMVD

SEQ ID NO: 91512 - protein, 13 aa, Mycobacterium tuberculosis
LDGFCSASLMVDH

SEQ ID NO: 91513 - protein, 13 aa, Mycobacterium tuberculosis
DGFCSASLMVDHP

SEQ ID NO: 91514 - protein, 13 aa, Mycobacterium tuberculosis
GFCSASLMVDHPA

SEQ ID NO: 91515 - protein, 13 aa, Mycobacterium tuberculosis
FCSASLMVDHPAC

SEQ ID NO: 91516 - protein, 13 aa, Mycobacterium tuberculosis
CSASLMVDHPACR

SEQ ID NO: 91517 - protein, 13 aa, Mycobacterium tuberculosis
SASLMVDHPACRR

SEQ ID NO: 91518 - protein, 13 aa, Mycobacterium tuberculosis
ASLMVDHPACRRA

SEQ ID NO: 91519 - protein, 13 aa, Mycobacterium tuberculosis
SLMVDHPACRRAV

SEQ ID NO: 91520 - protein, 13 aa, Mycobacterium tuberculosis
LMVDHPACRRAVS

SEQ ID NO: 91521 - protein, 13 aa, Mycobacterium tuberculosis
MVDHPACRRAVSC

SEQ ID NO: 91522 - protein, 13 aa, Mycobacterium tuberculosis
VDHPACRRAVSCS

SEQ ID NO: 91523 - protein, 13 aa, Mycobacterium tuberculosis
DHPACRRAVSCST

SEQ ID NO: 91524 - protein, 13 aa, Mycobacterium tuberculosis
HPACRRAVSCSTF

SEQ ID NO: 91525 - protein, 13 aa, Mycobacterium tuberculosis
PACRRAVSCSTFD

SEQ ID NO: 91526 - protein, 13 aa, Mycobacterium tuberculosis
ACRRAVSCSTFDS

SEQ ID NO: 91527 - protein, 13 aa, Mycobacterium tuberculosis
CRRAVSCSTFDSM

SEQ ID NO: 91528 - protein, 13 aa, Mycobacterium tuberculosis
RRAVSCSTFDSMD

SEQ ID NO: 91529 - protein, 13 aa, Mycobacterium tuberculosis
RAVSCSTFDSMDA

SEQ ID NO: 91530 - protein, 13 aa, Mycobacterium tuberculosis
AVSCSTFDSMDAM

SEQ ID NO: 91531 - protein, 13 aa, Mycobacterium tuberculosis
VSCSTFDSMDAMA

SEQ ID NO: 91532 - protein, 13 aa, Mycobacterium tuberculosis
SCSTFDSMDAMAR

SEQ ID NO: 91533 - protein, 13 aa, Mycobacterium tuberculosis
CSTFDSMDAMARN

SEQ ID NO: 91534 - protein, 13 aa, Mycobacterium tuberculosis
STFDSMDAMARNR

SEQ ID NO: 91535 - protein, 13 aa, Mycobacterium tuberculosis
TFDSMDAMARNRD

SEQ ID NO: 91536 - protein, 13 aa, Mycobacterium tuberculosis
FDSMDAMARNRDR

SEQ ID NO: 91537 - protein, 13 aa, Mycobacterium tuberculosis
DSMDAMARNRDRA

SEQ ID NO: 91538 - protein, 13 aa, Mycobacterium tuberculosis
SMDAMARNRDRAS

SEQ ID NO: 91539 - protein, 13 aa, Mycobacterium tuberculosis
MDAMARNRDRASE

SEQ ID NO: 91540 - protein, 13 aa, Mycobacterium tuberculosis
DAMARNRDRASEL

SEQ ID NO: 91541 - protein, 13 aa, Mycobacterium tuberculosis
AMARNRDRASELR

SEQ ID NO: 91542 - protein, 13 aa, Mycobacterium tuberculosis
MARNRDRASELRS

SEQ ID NO: 91543 - protein, 13 aa, Mycobacterium tuberculosis
ARNRDRASELRSR

SEQ ID NO: 91544 - protein, 13 aa, Mycobacterium tuberculosis
RNRDRASELRSRR

SEQ ID NO: 91545 - protein, 13 aa, Mycobacterium tuberculosis
NRDRASELRSRRV

SEQ ID NO: 91546 - protein, 13 aa, Mycobacterium tuberculosis
RDRASELRSRRVR

SEQ ID NO: 91547 - protein, 13 aa, Mycobacterium tuberculosis
DRASELRSRRVRE

SEQ ID NO: 91548 - protein, 13 aa, Mycobacterium tuberculosis
RASELRSRRVREL

SEQ ID NO: 91549 - protein, 13 aa, Mycobacterium tuberculosis
ASELRSRRVRELG

SEQ ID NO: 91550 - protein, 13 aa, Mycobacterium tuberculosis
SELRSRRVRELGA

SEQ ID NO: 91551 - protein, 13 aa, Mycobacterium tuberculosis
ELRSRRVRELGAE

SEQ ID NO: 91552 - protein, 13 aa, Mycobacterium tuberculosis
LRSRRVRELGAEV

SEQ ID NO: 91553 - protein, 13 aa, Mycobacterium tuberculosis
RSRRVRELGAEVL

SEQ ID NO: 91554 - protein, 13 aa, Mycobacterium tuberculosis
SRRVRELGAEVLD

SEQ ID NO: 91555 - protein, 13 aa, Mycobacterium tuberculosis
RRVRELGAEVLDV

SEQ ID NO: 91556 - protein, 13 aa, Mycobacterium tuberculosis
RVRELGAEVLDVA

SEQ ID NO: 91557 - protein, 13 aa, Mycobacterium tuberculosis
VRELGAEVLDVAE

SEQ ID NO: 91558 - protein, 13 aa, Mycobacterium tuberculosis
RELGAEVLDVAEF

SEQ ID NO: 91559 - protein, 13 aa, Mycobacterium tuberculosis
ELGAEVLDVAEFE

SEQ ID NO: 91560 - protein, 13 aa, Mycobacterium tuberculosis
LGAEVLDVAEFEL

SEQ ID NO: 91561 - protein, 13 aa, Mycobacterium tuberculosis
GAEVLDVAEFELA

SEQ ID NO: 91562 - protein, 13 aa, Mycobacterium tuberculosis
AEVLDVAEFELAI

SEQ ID NO: 91563 - protein, 13 aa, Mycobacterium tuberculosis
EVLDVAEFELAIA

SEQ ID NO: 91564 - protein, 13 aa, Mycobacterium tuberculosis
VLDVAEFELAIAH

SEQ ID NO: 91565 - protein, 13 aa, Mycobacterium tuberculosis
LDVAEFELAIAHL

SEQ ID NO: 91566 - protein, 13 aa, Mycobacterium tuberculosis
DVAEFELAIAHLR

SEQ ID NO: 91567 - protein, 13 aa, Mycobacterium tuberculosis
VAEFELAIAHLRV

SEQ ID NO: 91568 - protein, 13 aa, Mycobacterium tuberculosis
AEFELAIAHLRVP

SEQ ID NO: 91569 - protein, 13 aa, Mycobacterium tuberculosis
EFELAIAHLRVPE

SEQ ID NO: 91570 - protein, 13 aa, Mycobacterium tuberculosis
FELAIAHLRVPEL

SEQ ID NO: 91571 - protein, 13 aa, Mycobacterium tuberculosis
ELAIAHLRVPELV

SEQ ID NO: 91572 - protein, 14 aa, Mycobacterium tuberculosis
MPGSAGWRKVFGGT

SEQ ID NO: 91573 - protein, 14 aa, Mycobacterium tuberculosis
PGSAGWRKVFGGTG

SEQ ID NO: 91574 - protein, 14 aa, Mycobacterium tuberculosis
GSAGWRKVFGGTGG

SEQ ID NO: 91575 - protein, 14 aa, Mycobacterium tuberculosis
SAGWRKVFGGTGGA

SEQ ID NO: 91576 - protein, 14 aa, Mycobacterium tuberculosis
AGWRKVFGGTGGAT

SEQ ID NO: 91577 - protein, 14 aa, Mycobacterium tuberculosis
GWRKVFGGTGGATG

SEQ ID NO: 91578 - protein, 14 aa, Mycobacterium tuberculosis
WRKVFGGTGGATGA

SEQ ID NO: 91579 - protein, 14 aa, Mycobacterium tuberculosis
RKVFGGTGGATGAL

SEQ ID NO: 91580 - protein, 14 aa, Mycobacterium tuberculosis
KVFGGTGGATGALP

SEQ ID NO: 91581 - protein, 14 aa, Mycobacterium tuberculosis
VFGGTGGATGALPR

SEQ ID NO: 91582 - protein, 14 aa, Mycobacterium tuberculosis
FGGTGGATGALPRH

SEQ ID NO: 91583 - protein, 14 aa, Mycobacterium tuberculosis
GGTGGATGALPRHG

SEQ ID NO: 91584 - protein, 14 aa, Mycobacterium tuberculosis
GTGGATGALPRHGR

SEQ ID NO: 91585 - protein, 14 aa, Mycobacterium tuberculosis
TGGATGALPRHGRG

SEQ ID NO: 91586 - protein, 14 aa, Mycobacterium tuberculosis
GGATGALPRHGRGS

SEQ ID NO: 91587 - protein, 14 aa, Mycobacterium tuberculosis
GATGALPRHGRGSI

SEQ ID NO: 91588 - protein, 14 aa, Mycobacterium tuberculosis
ATGALPRHGRGSIV

SEQ ID NO: 91589 - protein, 14 aa, Mycobacterium tuberculosis
TGALPRHGRGSIVY

SEQ ID NO: 91590 - protein, 14 aa, Mycobacterium tuberculosis
GALPRHGRGSIVYA

SEQ ID NO: 91591 - protein, 14 aa, Mycobacterium tuberculosis
ALPRHGRGSIVYAR

SEQ ID NO: 91592 - protein, 14 aa, Mycobacterium tuberculosis
LPRHGRGSIVYARS

SEQ ID NO: 91593 - protein, 14 aa, Mycobacterium tuberculosis
PRHGRGSIVYARST

SEQ ID NO: 91594 - protein, 14 aa, Mycobacterium tuberculosis
RHGRGSIVYARSTT

SEQ ID NO: 91595 - protein, 14 aa, Mycobacterium tuberculosis
HGRGSIVYARSTTI

SEQ ID NO: 91596 - protein, 14 aa, Mycobacterium tuberculosis
GRGSIVYARSTTIE

SEQ ID NO: 91597 - protein, 14 aa, Mycobacterium tuberculosis
RGSIVYARSTTIEA

SEQ ID NO: 91598 - protein, 14 aa, Mycobacterium tuberculosis
GSIVYARSTTIEAQ

SEQ ID NO: 91599 - protein, 14 aa, Mycobacterium tuberculosis
SIVYARSTTIEAQP

SEQ ID NO: 91600 - protein, 14 aa, Mycobacterium tuberculosis
IVYARSTTIEAQPL

SEQ ID NO: 91601 - protein, 14 aa, Mycobacterium tuberculosis
VYARSTTIEAQPLS

SEQ ID NO: 91602 - protein, 14 aa, Mycobacterium tuberculosis
YARSTTIEAQPLSV

SEQ ID NO: 91603 - protein, 14 aa, Mycobacterium tuberculosis
ARSTTIEAQPLSVD

SEQ ID NO: 91604 - protein, 14 aa, Mycobacterium tuberculosis
RSTTIEAQPLSVDI

SEQ ID NO: 91605 - protein, 14 aa, Mycobacterium tuberculosis
STTIEAQPLSVDIG

SEQ ID NO: 91606 - protein, 14 aa, Mycobacterium tuberculosis
TTIEAQPLSVDIGI

SEQ ID NO: 91607 - protein, 14 aa, Mycobacterium tuberculosis
TIEAQPLSVDIGIA

SEQ ID NO: 91608 - protein, 14 aa, Mycobacterium tuberculosis
IEAQPLSVDIGIAH

SEQ ID NO: 91609 - protein, 14 aa, Mycobacterium tuberculosis
EAQPLSVDIGIAHV

SEQ ID NO: 91610 - protein, 14 aa, Mycobacterium tuberculosis
AQPLSVDIGIAHVR

SEQ ID NO: 91611 - protein, 14 aa, Mycobacterium tuberculosis
QPLSVDIGIAHVRD

SEQ ID NO: 91612 - protein, 14 aa, Mycobacterium tuberculosis
PLSVDIGIAHVRDV

SEQ ID NO: 91613 - protein, 14 aa, Mycobacterium tuberculosis
LSVDIGIAHVRDVV

SEQ ID NO: 91614 - protein, 14 aa, Mycobacterium tuberculosis
SVDIGIAHVRDVVM

SEQ ID NO: 91615 - protein, 14 aa, Mycobacterium tuberculosis
VDIGIAHVRDVVMP

SEQ ID NO: 91616 - protein, 14 aa, Mycobacterium tuberculosis
DIGIAHVRDVVMPA

SEQ ID NO: 91617 - protein, 14 aa, Mycobacterium tuberculosis
IGIAHVRDVVMPAL

SEQ ID NO: 91618 - protein, 14 aa, Mycobacterium tuberculosis
GIAHVRDVVMPALQ

SEQ ID NO: 91619 - protein, 14 aa, Mycobacterium tuberculosis
IAHVRDVVMPALQE

SEQ ID NO: 91620 - protein, 14 aa, Mycobacterium tuberculosis
AHVRDVVMPALQEI

SEQ ID NO: 91621 - protein, 14 aa, Mycobacterium tuberculosis
HVRDVVMPALQEID

SEQ ID NO: 91622 - protein, 14 aa, Mycobacterium tuberculosis
VRDVVMPALQEIDG

SEQ ID NO: 91623 - protein, 14 aa, Mycobacterium tuberculosis
RDVVMPALQEIDGC

SEQ ID NO: 91624 - protein, 14 aa, Mycobacterium tuberculosis
DVVMPALQEIDGCV

SEQ ID NO: 91625 - protein, 14 aa, Mycobacterium tuberculosis
VVMPALQEIDGCVG

SEQ ID NO: 91626 - protein, 14 aa, Mycobacterium tuberculosis
VMPALQEIDGCVGV

SEQ ID NO: 91627 - protein, 14 aa, Mycobacterium tuberculosis
MPALQEIDGCVGVS

SEQ ID NO: 91628 - protein, 14 aa, Mycobacterium tuberculosis
PALQEIDGCVGVSL

SEQ ID NO: 91629 - protein, 14 aa, Mycobacterium tuberculosis
ALQEIDGCVGVSLL

SEQ ID NO: 91630 - protein, 14 aa, Mycobacterium tuberculosis
LQEIDGCVGVSLLV

SEQ ID NO: 91631 - protein, 14 aa, Mycobacterium tuberculosis
QEIDGCVGVSLLVD

SEQ ID NO: 91632 - protein, 14 aa, Mycobacterium tuberculosis
EIDGCVGVSLLVDR

SEQ ID NO: 91633 - protein, 14 aa, Mycobacterium tuberculosis
IDGCVGVSLLVDRQ

SEQ ID NO: 91634 - protein, 14 aa, Mycobacterium tuberculosis
DGCVGVSLLVDRQS

SEQ ID NO: 91635 - protein, 14 aa, Mycobacterium tuberculosis
GCVGVSLLVDRQSG

SEQ ID NO: 91636 - protein, 14 aa, Mycobacterium tuberculosis
CVGVSLLVDRQSGR

SEQ ID NO: 91637 - protein, 14 aa, Mycobacterium tuberculosis
VGVSLLVDRQSGRC

SEQ ID NO: 91638 - protein, 14 aa, Mycobacterium tuberculosis
GVSLLVDRQSGRCI

SEQ ID NO: 91639 - protein, 14 aa, Mycobacterium tuberculosis
VSLLVDRQSGRCIA

SEQ ID NO: 91640 - protein, 14 aa, Mycobacterium tuberculosis
SLLVDRQSGRCIAT

SEQ ID NO: 91641 - protein, 14 aa, Mycobacterium tuberculosis
LLVDRQSGRCIATS

SEQ ID NO: 91642 - protein, 14 aa, Mycobacterium tuberculosis
LVDRQSGRCIATSA

SEQ ID NO: 91643 - protein, 14 aa, Mycobacterium tuberculosis
VDRQSGRCIATSAW

SEQ ID NO: 91644 - protein, 14 aa, Mycobacterium tuberculosis
DRQSGRCIATSAWE

SEQ ID NO: 91645 - protein, 14 aa, Mycobacterium tuberculosis
RQSGRCIATSAWET

SEQ ID NO: 91646 - protein, 14 aa, Mycobacterium tuberculosis
QSGRCIATSAWETL

SEQ ID NO: 91647 - protein, 14 aa, Mycobacterium tuberculosis
SGRCIATSAWETLE

SEQ ID NO: 91648 - protein, 14 aa, Mycobacterium tuberculosis
GRCIATSAWETLEA

SEQ ID NO: 91649 - protein, 14 aa, Mycobacterium tuberculosis
RCIATSAWETLEAM

SEQ ID NO: 91650 - protein, 14 aa, Mycobacterium tuberculosis
CIATSAWETLEAMR

SEQ ID NO: 91651 - protein, 14 aa, Mycobacterium tuberculosis
IATSAWETLEAMRA

SEQ ID NO: 91652 - protein, 14 aa, Mycobacterium tuberculosis
ATSAWETLEAMRAS

SEQ ID NO: 91653 - protein, 14 aa, Mycobacterium tuberculosis
TSAWETLEAMRASV

SEQ ID NO: 91654 - protein, 14 aa, Mycobacterium tuberculosis
SAWETLEAMRASVE

SEQ ID NO: 91655 - protein, 14 aa, Mycobacterium tuberculosis
AWETLEAMRASVER

SEQ ID NO: 91656 - protein, 14 aa, Mycobacterium tuberculosis
WETLEAMRASVERV

SEQ ID NO: 91657 - protein, 14 aa, Mycobacterium tuberculosis
ETLEAMRASVERVA

SEQ ID NO: 91658 - protein, 14 aa, Mycobacterium tuberculosis
TLEAMRASVERVAP

SEQ ID NO: 91659 - protein, 14 aa, Mycobacterium tuberculosis
LEAMRASVERVAPI

SEQ ID NO: 91660 - protein, 14 aa, Mycobacterium tuberculosis
EAMRASVERVAPIR

SEQ ID NO: 91661 - protein, 14 aa, Mycobacterium tuberculosis
AMRASVERVAPIRD

SEQ ID NO: 91662 - protein, 14 aa, Mycobacterium tuberculosis
MRASVERVAPIRDR

SEQ ID NO: 91663 - protein, 14 aa, Mycobacterium tuberculosis
RASVERVAPIRDRA

SEQ ID NO: 91664 - protein, 14 aa, Mycobacterium tuberculosis
ASVERVAPIRDRAA

SEQ ID NO: 91665 - protein, 14 aa, Mycobacterium tuberculosis
SVERVAPIRDRAAL

SEQ ID NO: 91666 - protein, 14 aa, Mycobacterium tuberculosis
VERVAPIRDRAALM

SEQ ID NO: 91667 - protein, 14 aa, Mycobacterium tuberculosis
ERVAPIRDRAALMF

SEQ ID NO: 91668 - protein, 14 aa, Mycobacterium tuberculosis
RVAPIRDRAALMFA

SEQ ID NO: 91669 - protein, 14 aa, Mycobacterium tuberculosis
VAPIRDRAALMFAG

SEQ ID NO: 91670 - protein, 14 aa, Mycobacterium tuberculosis
APIRDRAALMFAGS

SEQ ID NO: 91671 - protein, 14 aa, Mycobacterium tuberculosis
PIRDRAALMFAGSA

SEQ ID NO: 91672 - protein, 14 aa, Mycobacterium tuberculosis
IRDRAALMFAGSAR

SEQ ID NO: 91673 - protein, 14 aa, Mycobacterium tuberculosis
RDRAALMFAGSARV

SEQ ID NO: 91674 - protein, 14 aa, Mycobacterium tuberculosis
DRAALMFAGSARVE

SEQ ID NO: 91675 - protein, 14 aa, Mycobacterium tuberculosis
RAALMFAGSARVEE

SEQ ID NO: 91676 - protein, 14 aa, Mycobacterium tuberculosis
AALMFAGSARVEEW

SEQ ID NO: 91677 - protein, 14 aa, Mycobacterium tuberculosis
ALMFAGSARVEEWD

SEQ ID NO: 91678 - protein, 14 aa, Mycobacterium tuberculosis
LMFAGSARVEEWDI

SEQ ID NO: 91679 - protein, 14 aa, Mycobacterium tuberculosis
MFAGSARVEEWDIA

SEQ ID NO: 91680 - protein, 14 aa, Mycobacterium tuberculosis
FAGSARVEEWDIAL

SEQ ID NO: 91681 - protein, 14 aa, Mycobacterium tuberculosis
AGSARVEEWDIALL

SEQ ID NO: 91682 - protein, 14 aa, Mycobacterium tuberculosis
GSARVEEWDIALLH

SEQ ID NO: 91683 - protein, 14 aa, Mycobacterium tuberculosis
SARVEEWDIALLHR

SEQ ID NO: 91684 - protein, 14 aa, Mycobacterium tuberculosis
ARVEEWDIALLHRD

SEQ ID NO: 91685 - protein, 14 aa, Mycobacterium tuberculosis
RVEEWDIALLHRDH

SEQ ID NO: 91686 - protein, 14 aa, Mycobacterium tuberculosis
VEEWDIALLHRDHP

SEQ ID NO: 91687 - protein, 14 aa, Mycobacterium tuberculosis
EEWDIALLHRDHPS

SEQ ID NO: 91688 - protein, 14 aa, Mycobacterium tuberculosis
EWDIALLHRDHPSH

SEQ ID NO: 91689 - protein, 14 aa, Mycobacterium tuberculosis
WDIALLHRDHPSHE

SEQ ID NO: 91690 - protein, 14 aa, Mycobacterium tuberculosis
DIALLHRDHPSHEG

SEQ ID NO: 91691 - protein, 14 aa, Mycobacterium tuberculosis
IALLHRDHPSHEGA

SEQ ID NO: 91692 - protein, 14 aa, Mycobacterium tuberculosis
ALLHRDHPSHEGAC

SEQ ID NO: 91693 - protein, 14 aa, Mycobacterium tuberculosis
LLHRDHPSHEGACV

SEQ ID NO: 91694 - protein, 14 aa, Mycobacterium tuberculosis
LHRDHPSHEGACVR

SEQ ID NO: 91695 - protein, 14 aa, Mycobacterium tuberculosis
HRDHPSHEGACVRA

SEQ ID NO: 91696 - protein, 14 aa, Mycobacterium tuberculosis
RDHPSHEGACVRAT

SEQ ID NO: 91697 - protein, 14 aa, Mycobacterium tuberculosis
DHPSHEGACVRATW

SEQ ID NO: 91698 - protein, 14 aa, Mycobacterium tuberculosis
HPSHEGACVRATWL

SEQ ID NO: 91699 - protein, 14 aa, Mycobacterium tuberculosis
PSHEGACVRATWLK

SEQ ID NO: 91700 - protein, 14 aa, Mycobacterium tuberculosis
SHEGACVRATWLKV

SEQ ID NO: 91701 - protein, 14 aa, Mycobacterium tuberculosis
HEGACVRATWLKVV

SEQ ID NO: 91702 - protein, 14 aa, Mycobacterium tuberculosis
EGACVRATWLKVVP

SEQ ID NO: 91703 - protein, 14 aa, Mycobacterium tuberculosis
GACVRATWLKVVPD

SEQ ID NO: 91704 - protein, 14 aa, Mycobacterium tuberculosis
ACVRATWLKVVPDQ

SEQ ID NO: 91705 - protein, 14 aa, Mycobacterium tuberculosis
CVRATWLKVVPDQL

SEQ ID NO: 91706 - protein, 14 aa, Mycobacterium tuberculosis
VRATWLKVVPDQLG

SEQ ID NO: 91707 - protein, 14 aa, Mycobacterium tuberculosis
RATWLKVVPDQLGR

SEQ ID NO: 91708 - protein, 14 aa, Mycobacterium tuberculosis
ATWLKVVPDQLGRS

SEQ ID NO: 91709 - protein, 14 aa, Mycobacterium tuberculosis
TWLKVVPDQLGRSL

SEQ ID NO: 91710 - protein, 14 aa, Mycobacterium tuberculosis
WLKVVPDQLGRSLE

SEQ ID NO: 91711 - protein, 14 aa, Mycobacterium tuberculosis
LKVVPDQLGRSLEF

SEQ ID NO: 91712 - protein, 14 aa, Mycobacterium tuberculosis
KVVPDQLGRSLEFY

SEQ ID NO: 91713 - protein, 14 aa, Mycobacterium tuberculosis
VVPDQLGRSLEFYR

SEQ ID NO: 91714 - protein, 14 aa, Mycobacterium tuberculosis
VPDQLGRSLEFYRT

SEQ ID NO: 91715 - protein, 14 aa, Mycobacterium tuberculosis
PDQLGRSLEFYRTS

SEQ ID NO: 91716 - protein, 14 aa, Mycobacterium tuberculosis
DQLGRSLEFYRTSV

SEQ ID NO: 91717 - protein, 14 aa, Mycobacterium tuberculosis
QLGRSLEFYRTSVL

SEQ ID NO: 91718 - protein, 14 aa, Mycobacterium tuberculosis
LGRSLEFYRTSVLP

SEQ ID NO: 91719 - protein, 14 aa, Mycobacterium tuberculosis
GRSLEFYRTSVLPE

SEQ ID NO: 91720 - protein, 14 aa, Mycobacterium tuberculosis
RSLEFYRTSVLPEL

SEQ ID NO: 91721 - protein, 14 aa, Mycobacterium tuberculosis
SLEFYRTSVLPELE

SEQ ID NO: 91722 - protein, 14 aa, Mycobacterium tuberculosis
LEFYRTSVLPELES

SEQ ID NO: 91723 - protein, 14 aa, Mycobacterium tuberculosis
EFYRTSVLPELESL

SEQ ID NO: 91724 - protein, 14 aa, Mycobacterium tuberculosis
FYRTSVLPELESLD

SEQ ID NO: 91725 - protein, 14 aa, Mycobacterium tuberculosis
YRTSVLPELESLDG

SEQ ID NO: 91726 - protein, 14 aa, Mycobacterium tuberculosis
RTSVLPELESLDGF

SEQ ID NO: 91727 - protein, 14 aa, Mycobacterium tuberculosis
TSVLPELESLDGFC

SEQ ID NO: 91728 - protein, 14 aa, Mycobacterium tuberculosis
SVLPELESLDGFCS

SEQ ID NO: 91729 - protein, 14 aa, Mycobacterium tuberculosis
VLPELESLDGFCSA

SEQ ID NO: 91730 - protein, 14 aa, Mycobacterium tuberculosis
LPELESLDGFCSAS

SEQ ID NO: 91731 - protein, 14 aa, Mycobacterium tuberculosis
PELESLDGFCSASL

SEQ ID NO: 91732 - protein, 14 aa, Mycobacterium tuberculosis
ELESLDGFCSASLM

SEQ ID NO: 91733 - protein, 14 aa, Mycobacterium tuberculosis
LESLDGFCSASLMV

SEQ ID NO: 91734 - protein, 14 aa, Mycobacterium tuberculosis
ESLDGFCSASLMVD

SEQ ID NO: 91735 - protein, 14 aa, Mycobacterium tuberculosis
SLDGFCSASLMVDH

SEQ ID NO: 91736 - protein, 14 aa, Mycobacterium tuberculosis
LDGFCSASLMVDHP

SEQ ID NO: 91737 - protein, 14 aa, Mycobacterium tuberculosis
DGFCSASLMVDHPA

SEQ ID NO: 91738 - protein, 14 aa, Mycobacterium tuberculosis
GFCSASLMVDHPAC

SEQ ID NO: 91739 - protein, 14 aa, Mycobacterium tuberculosis
FCSASLMVDHPACR

SEQ ID NO: 91740 - protein, 14 aa, Mycobacterium tuberculosis
CSASLMVDHPACRR

SEQ ID NO: 91741 - protein, 14 aa, Mycobacterium tuberculosis
SASLMVDHPACRRA

SEQ ID NO: 91742 - protein, 14 aa, Mycobacterium tuberculosis
ASLMVDHPACRRAV

SEQ ID NO: 91743 - protein, 14 aa, Mycobacterium tuberculosis
SLMVDHPACRRAVS

SEQ ID NO: 91744 - protein, 14 aa, Mycobacterium tuberculosis
LMVDHPACRRAVSC

SEQ ID NO: 91745 - protein, 14 aa, Mycobacterium tuberculosis
MVDHPACRRAVSCS

SEQ ID NO: 91746 - protein, 14 aa, Mycobacterium tuberculosis
VDHPACRRAVSCST

SEQ ID NO: 91747 - protein, 14 aa, Mycobacterium tuberculosis
DHPACRRAVSCSTF

SEQ ID NO: 91748 - protein, 14 aa, Mycobacterium tuberculosis
HPACRRAVSCSTFD

SEQ ID NO: 91749 - protein, 14 aa, Mycobacterium tuberculosis
PACRRAVSCSTFDS

SEQ ID NO: 91750 - protein, 14 aa, Mycobacterium tuberculosis
ACRRAVSCSTFDSM

SEQ ID NO: 91751 - protein, 14 aa, Mycobacterium tuberculosis
CRRAVSCSTFDSMD

SEQ ID NO: 91752 - protein, 14 aa, Mycobacterium tuberculosis
RRAVSCSTFDSMDA

SEQ ID NO: 91753 - protein, 14 aa, Mycobacterium tuberculosis
RAVSCSTFDSMDAM

SEQ ID NO: 91754 - protein, 14 aa, Mycobacterium tuberculosis
AVSCSTFDSMDAMA

SEQ ID NO: 91755 - protein, 14 aa, Mycobacterium tuberculosis
VSCSTFDSMDAMAR

SEQ ID NO: 91756 - protein, 14 aa, Mycobacterium tuberculosis
SCSTFDSMDAMARN

SEQ ID NO: 91757 - protein, 14 aa, Mycobacterium tuberculosis
CSTFDSMDAMARNR

SEQ ID NO: 91758 - protein, 14 aa, Mycobacterium tuberculosis
STFDSMDAMARNRD

SEQ ID NO: 91759 - protein, 14 aa, Mycobacterium tuberculosis
TFDSMDAMARNRDR

SEQ ID NO: 91760 - protein, 14 aa, Mycobacterium tuberculosis
FDSMDAMARNRDRA

SEQ ID NO: 91761 - protein, 14 aa, Mycobacterium tuberculosis
DSMDAMARNRDRAS

SEQ ID NO: 91762 - protein, 14 aa, Mycobacterium tuberculosis
SMDAMARNRDRASE

SEQ ID NO: 91763 - protein, 14 aa, Mycobacterium tuberculosis
MDAMARNRDRASEL

SEQ ID NO: 91764 - protein, 14 aa, Mycobacterium tuberculosis
DAMARNRDRASELR

SEQ ID NO: 91765 - protein, 14 aa, Mycobacterium tuberculosis
AMARNRDRASELRS

SEQ ID NO: 91766 - protein, 14 aa, Mycobacterium tuberculosis
MARNRDRASELRSR

SEQ ID NO: 91767 - protein, 14 aa, Mycobacterium tuberculosis
ARNRDRASELRSRR

SEQ ID NO: 91768 - protein, 14 aa, Mycobacterium tuberculosis
RNRDRASELRSRRV

SEQ ID NO: 91769 - protein, 14 aa, Mycobacterium tuberculosis
NRDRASELRSRRVR

SEQ ID NO: 91770 - protein, 14 aa, Mycobacterium tuberculosis
RDRASELRSRRVRE

SEQ ID NO: 91771 - protein, 14 aa, Mycobacterium tuberculosis
DRASELRSRRVREL

SEQ ID NO: 91772 - protein, 14 aa, Mycobacterium tuberculosis
RASELRSRRVRELG

SEQ ID NO: 91773 - protein, 14 aa, Mycobacterium tuberculosis
ASELRSRRVRELGA

SEQ ID NO: 91774 - protein, 14 aa, Mycobacterium tuberculosis
SELRSRRVRELGAE

SEQ ID NO: 91775 - protein, 14 aa, Mycobacterium tuberculosis
ELRSRRVRELGAEV

SEQ ID NO: 91776 - protein, 14 aa, Mycobacterium tuberculosis
LRSRRVRELGAEVL

SEQ ID NO: 91777 - protein, 14 aa, Mycobacterium tuberculosis
RSRRVRELGAEVLD

SEQ ID NO: 91778 - protein, 14 aa, Mycobacterium tuberculosis
SRRVRELGAEVLDV

SEQ ID NO: 91779 - protein, 14 aa, Mycobacterium tuberculosis
RRVRELGAEVLDVA

SEQ ID NO: 91780 - protein, 14 aa, Mycobacterium tuberculosis
RVRELGAEVLDVAE

SEQ ID NO: 91781 - protein, 14 aa, Mycobacterium tuberculosis
VRELGAEVLDVAEF

SEQ ID NO: 91782 - protein, 14 aa, Mycobacterium tuberculosis
RELGAEVLDVAEFE

SEQ ID NO: 91783 - protein, 14 aa, Mycobacterium tuberculosis
ELGAEVLDVAEFEL

SEQ ID NO: 91784 - protein, 14 aa, Mycobacterium tuberculosis
LGAEVLDVAEFELA

SEQ ID NO: 91785 - protein, 14 aa, Mycobacterium tuberculosis
GAEVLDVAEFELAI

SEQ ID NO: 91786 - protein, 14 aa, Mycobacterium tuberculosis
AEVLDVAEFELAIA

SEQ ID NO: 91787 - protein, 14 aa, Mycobacterium tuberculosis
EVLDVAEFELAIAH

SEQ ID NO: 91788 - protein, 14 aa, Mycobacterium tuberculosis
VLDVAEFELAIAHL

SEQ ID NO: 91789 - protein, 14 aa, Mycobacterium tuberculosis
LDVAEFELAIAHLR

SEQ ID NO: 91790 - protein, 14 aa, Mycobacterium tuberculosis
DVAEFELAIAHLRV

SEQ ID NO: 91791 - protein, 14 aa, Mycobacterium tuberculosis
VAEFELAIAHLRVP

SEQ ID NO: 91792 - protein, 14 aa, Mycobacterium tuberculosis
AEFELAIAHLRVPE

SEQ ID NO: 91793 - protein, 14 aa, Mycobacterium tuberculosis
EFELAIAHLRVPEL

SEQ ID NO: 91794 - protein, 14 aa, Mycobacterium tuberculosis
FELAIAHLRVPELV

SEQ ID NO: 91795 - protein, 15 aa, Mycobacterium tuberculosis
MPGSAGWRKVFGGTG

SEQ ID NO: 91796 - protein, 15 aa, Mycobacterium tuberculosis
PGSAGWRKVFGGTGG

SEQ ID NO: 91797 - protein, 15 aa, Mycobacterium tuberculosis
GSAGWRKVFGGTGGA

SEQ ID NO: 91798 - protein, 15 aa, Mycobacterium tuberculosis
SAGWRKVFGGTGGAT

SEQ ID NO: 91799 - protein, 15 aa, Mycobacterium tuberculosis
AGWRKVFGGTGGATG

SEQ ID NO: 91800 - protein, 15 aa, Mycobacterium tuberculosis
GWRKVFGGTGGATGA

SEQ ID NO: 91801 - protein, 15 aa, Mycobacterium tuberculosis
WRKVFGGTGGATGAL

SEQ ID NO: 91802 - protein, 15 aa, Mycobacterium tuberculosis
RKVFGGTGGATGALP

SEQ ID NO: 91803 - protein, 15 aa, Mycobacterium tuberculosis
KVFGGTGGATGALPR

SEQ ID NO: 91804 - protein, 15 aa, Mycobacterium tuberculosis
VFGGTGGATGALPRH

SEQ ID NO: 91805 - protein, 15 aa, Mycobacterium tuberculosis
FGGTGGATGALPRHG

SEQ ID NO: 91806 - protein, 15 aa, Mycobacterium tuberculosis
GGTGGATGALPRHGR

SEQ ID NO: 91807 - protein, 15 aa, Mycobacterium tuberculosis
GTGGATGALPRHGRG

SEQ ID NO: 91808 - protein, 15 aa, Mycobacterium tuberculosis
TGGATGALPRHGRGS

SEQ ID NO: 91809 - protein, 15 aa, Mycobacterium tuberculosis
GGATGALPRHGRGSI

SEQ ID NO: 91810 - protein, 15 aa, Mycobacterium tuberculosis
GATGALPRHGRGSIV

SEQ ID NO: 91811 - protein, 15 aa, Mycobacterium tuberculosis
ATGALPRHGRGSIVY

SEQ ID NO: 91812 - protein, 15 aa, Mycobacterium tuberculosis
TGALPRHGRGSIVYA

SEQ ID NO: 91813 - protein, 15 aa, Mycobacterium tuberculosis
GALPRHGRGSIVYAR

SEQ ID NO: 91814 - protein, 15 aa, Mycobacterium tuberculosis
ALPRHGRGSIVYARS

SEQ ID NO: 91815 - protein, 15 aa, Mycobacterium tuberculosis
LPRHGRGSIVYARST

SEQ ID NO: 91816 - protein, 15 aa, Mycobacterium tuberculosis
PRHGRGSIVYARSTT

SEQ ID NO: 91817 - protein, 15 aa, Mycobacterium tuberculosis
RHGRGSIVYARSTTI

SEQ ID NO: 91818 - protein, 15 aa, Mycobacterium tuberculosis
HGRGSIVYARSTTIE

SEQ ID NO: 91819 - protein, 15 aa, Mycobacterium tuberculosis
GRGSIVYARSTTIEA

SEQ ID NO: 91820 - protein, 15 aa, Mycobacterium tuberculosis
RGSIVYARSTTIEAQ

SEQ ID NO: 91821 - protein, 15 aa, Mycobacterium tuberculosis
GSIVYARSTTIEAQP

SEQ ID NO: 91822 - protein, 15 aa, Mycobacterium tuberculosis
SIVYARSTTIEAQPL

SEQ ID NO: 91823 - protein, 15 aa, Mycobacterium tuberculosis
IVYARSTTIEAQPLS

SEQ ID NO: 91824 - protein, 15 aa, Mycobacterium tuberculosis
VYARSTTIEAQPLSV

SEQ ID NO: 91825 - protein, 15 aa, Mycobacterium tuberculosis
YARSTTIEAQPLSVD

SEQ ID NO: 91826 - protein, 15 aa, Mycobacterium tuberculosis
ARSTTIEAQPLSVDI

SEQ ID NO: 91827 - protein, 15 aa, Mycobacterium tuberculosis
RSTTIEAQPLSVDIG

SEQ ID NO: 91828 - protein, 15 aa, Mycobacterium tuberculosis
STTIEAQPLSVDIGI

SEQ ID NO: 91829 - protein, 15 aa, Mycobacterium tuberculosis
TTIEAQPLSVDIGIA

SEQ ID NO: 91830 - protein, 15 aa, Mycobacterium tuberculosis
TIEAQPLSVDIGIAH

SEQ ID NO: 91831 - protein, 15 aa, Mycobacterium tuberculosis
IEAQPLSVDIGIAHV

SEQ ID NO: 91832 - protein, 15 aa, Mycobacterium tuberculosis
EAQPLSVDIGIAHVR

SEQ ID NO: 91833 - protein, 15 aa, Mycobacterium tuberculosis
AQPLSVDIGIAHVRD

SEQ ID NO: 91834 - protein, 15 aa, Mycobacterium tuberculosis
QPLSVDIGIAHVRDV

SEQ ID NO: 91835 - protein, 15 aa, Mycobacterium tuberculosis
PLSVDIGIAHVRDVV

SEQ ID NO: 91836 - protein, 15 aa, Mycobacterium tuberculosis
LSVDIGIAHVRDVVM

SEQ ID NO: 91837 - protein, 15 aa, Mycobacterium tuberculosis
SVDIGIAHVRDVVMP

SEQ ID NO: 91838 - protein, 15 aa, Mycobacterium tuberculosis
VDIGIAHVRDVVMPA

SEQ ID NO: 91839 - protein, 15 aa, Mycobacterium tuberculosis
DIGIAHVRDVVMPAL

SEQ ID NO: 91840 - protein, 15 aa, Mycobacterium tuberculosis
IGIAHVRDVVMPALQ

SEQ ID NO: 91841 - protein, 15 aa, Mycobacterium tuberculosis
GIAHVRDVVMPALQE

SEQ ID NO: 91842 - protein, 15 aa, Mycobacterium tuberculosis
IAHVRDVVMPALQEI

SEQ ID NO: 91843 - protein, 15 aa, Mycobacterium tuberculosis
AHVRDVVMPALQEID

SEQ ID NO: 91844 - protein, 15 aa, Mycobacterium tuberculosis
HVRDVVMPALQEIDG

SEQ ID NO: 91845 - protein, 15 aa, Mycobacterium tuberculosis
VRDVVMPALQEIDGC

SEQ ID NO: 91846 - protein, 15 aa, Mycobacterium tuberculosis
RDVVMPALQEIDGCV

SEQ ID NO: 91847 - protein, 15 aa, Mycobacterium tuberculosis
DVVMPALQEIDGCVG

SEQ ID NO: 91848 - protein, 15 aa, Mycobacterium tuberculosis
VVMPALQEIDGCVGV

SEQ ID NO: 91849 - protein, 15 aa, Mycobacterium tuberculosis
VMPALQEIDGCVGVS

SEQ ID NO: 91850 - protein, 15 aa, Mycobacterium tuberculosis
MPALQEIDGCVGVSL

SEQ ID NO: 91851 - protein, 15 aa, Mycobacterium tuberculosis
PALQEIDGCVGVSLL

SEQ ID NO: 91852 - protein, 15 aa, Mycobacterium tuberculosis
ALQEIDGCVGVSLLV

SEQ ID NO: 91853 - protein, 15 aa, Mycobacterium tuberculosis
LQEIDGCVGVSLLVD

SEQ ID NO: 91854 - protein, 15 aa, Mycobacterium tuberculosis
QEIDGCVGVSLLVDR

SEQ ID NO: 91855 - protein, 15 aa, Mycobacterium tuberculosis
EIDGCVGVSLLVDRQ

SEQ ID NO: 91856 - protein, 15 aa, Mycobacterium tuberculosis
IDGCVGVSLLVDRQS

SEQ ID NO: 91857 - protein, 15 aa, Mycobacterium tuberculosis
DGCVGVSLLVDRQSG

SEQ ID NO: 91858 - protein, 15 aa, Mycobacterium tuberculosis
GCVGVSLLVDRQSGR

SEQ ID NO: 91859 - protein, 15 aa, Mycobacterium tuberculosis
CVGVSLLVDRQSGRC

SEQ ID NO: 91860 - protein, 15 aa, Mycobacterium tuberculosis
VGVSLLVDRQSGRCI

SEQ ID NO: 91861 - protein, 15 aa, Mycobacterium tuberculosis
GVSLLVDRQSGRCIA

SEQ ID NO: 91862 - protein, 15 aa, Mycobacterium tuberculosis
VSLLVDRQSGRCIAT

SEQ ID NO: 91863 - protein, 15 aa, Mycobacterium tuberculosis
SLLVDRQSGRCIATS

SEQ ID NO: 91864 - protein, 15 aa, Mycobacterium tuberculosis
LLVDRQSGRCIATSA

SEQ ID NO: 91865 - protein, 15 aa, Mycobacterium tuberculosis
LVDRQSGRCIATSAW

SEQ ID NO: 91866 - protein, 15 aa, Mycobacterium tuberculosis
VDRQSGRCIATSAWE

SEQ ID NO: 91867 - protein, 15 aa, Mycobacterium tuberculosis
DRQSGRCIATSAWET

SEQ ID NO: 91868 - protein, 15 aa, Mycobacterium tuberculosis
RQSGRCIATSAWETL

SEQ ID NO: 91869 - protein, 15 aa, Mycobacterium tuberculosis
QSGRCIATSAWETLE

SEQ ID NO: 91870 - protein, 15 aa, Mycobacterium tuberculosis
SGRCIATSAWETLEA

SEQ ID NO: 91871 - protein, 15 aa, Mycobacterium tuberculosis
GRCIATSAWETLEAM

SEQ ID NO: 91872 - protein, 15 aa, Mycobacterium tuberculosis
RCIATSAWETLEAMR

SEQ ID NO: 91873 - protein, 15 aa, Mycobacterium tuberculosis
CIATSAWETLEAMRA

SEQ ID NO: 91874 - protein, 15 aa, Mycobacterium tuberculosis
IATSAWETLEAMRAS

SEQ ID NO: 91875 - protein, 15 aa, Mycobacterium tuberculosis
ATSAWETLEAMRASV

SEQ ID NO: 91876 - protein, 15 aa, Mycobacterium tuberculosis
TSAWETLEAMRASVE

SEQ ID NO: 91877 - protein, 15 aa, Mycobacterium tuberculosis
SAWETLEAMRASVER

SEQ ID NO: 91878 - protein, 15 aa, Mycobacterium tuberculosis
AWETLEAMRASVERV

SEQ ID NO: 91879 - protein, 15 aa, Mycobacterium tuberculosis
WETLEAMRASVERVA

SEQ ID NO: 91880 - protein, 15 aa, Mycobacterium tuberculosis
ETLEAMRASVERVAP

SEQ ID NO: 91881 - protein, 15 aa, Mycobacterium tuberculosis
TLEAMRASVERVAPI

SEQ ID NO: 91882 - protein, 15 aa, Mycobacterium tuberculosis
LEAMRASVERVAPIR

SEQ ID NO: 91883 - protein, 15 aa, Mycobacterium tuberculosis
EAMRASVERVAPIRD

SEQ ID NO: 91884 - protein, 15 aa, Mycobacterium tuberculosis
AMRASVERVAPIRDR

SEQ ID NO: 91885 - protein, 15 aa, Mycobacterium tuberculosis
MRASVERVAPIRDRA

SEQ ID NO: 91886 - protein, 15 aa, Mycobacterium tuberculosis
RASVERVAPIRDRAA

SEQ ID NO: 91887 - protein, 15 aa, Mycobacterium tuberculosis
ASVERVAPIRDRAAL

SEQ ID NO: 91888 - protein, 15 aa, Mycobacterium tuberculosis
SVERVAPIRDRAALM

SEQ ID NO: 91889 - protein, 15 aa, Mycobacterium tuberculosis
VERVAPIRDRAALMF

SEQ ID NO: 91890 - protein, 15 aa, Mycobacterium tuberculosis
ERVAPIRDRAALMFA

SEQ ID NO: 91891 - protein, 15 aa, Mycobacterium tuberculosis
RVAPIRDRAALMFAG

SEQ ID NO: 91892 - protein, 15 aa, Mycobacterium tuberculosis
VAPIRDRAALMFAGS

SEQ ID NO: 91893 - protein, 15 aa, Mycobacterium tuberculosis
APIRDRAALMFAGSA

SEQ ID NO: 91894 - protein, 15 aa, Mycobacterium tuberculosis
PIRDRAALMFAGSAR

SEQ ID NO: 91895 - protein, 15 aa, Mycobacterium tuberculosis
IRDRAALMFAGSARV

SEQ ID NO: 91896 - protein, 15 aa, Mycobacterium tuberculosis
RDRAALMFAGSARVE

SEQ ID NO: 91897 - protein, 15 aa, Mycobacterium tuberculosis
DRAALMFAGSARVEE

SEQ ID NO: 91898 - protein, 15 aa, Mycobacterium tuberculosis
RAALMFAGSARVEEW

SEQ ID NO: 91899 - protein, 15 aa, Mycobacterium tuberculosis
AALMFAGSARVEEWD

SEQ ID NO: 91900 - protein, 15 aa, Mycobacterium tuberculosis
ALMFAGSARVEEWDI

SEQ ID NO: 91901 - protein, 15 aa, Mycobacterium tuberculosis
LMFAGSARVEEWDIA

SEQ ID NO: 91902 - protein, 15 aa, Mycobacterium tuberculosis
MFAGSARVEEWDIAL

SEQ ID NO: 91903 - protein, 15 aa, Mycobacterium tuberculosis
FAGSARVEEWDIALL

SEQ ID NO: 91904 - protein, 15 aa, Mycobacterium tuberculosis
AGSARVEEWDIALLH

SEQ ID NO: 91905 - protein, 15 aa, Mycobacterium tuberculosis
GSARVEEWDIALLHR

SEQ ID NO: 91906 - protein, 15 aa, Mycobacterium tuberculosis
SARVEEWDIALLHRD

SEQ ID NO: 91907 - protein, 15 aa, Mycobacterium tuberculosis
ARVEEWDIALLHRDH

SEQ ID NO: 91908 - protein, 15 aa, Mycobacterium tuberculosis
RVEEWDIALLHRDHP

SEQ ID NO: 91909 - protein, 15 aa, Mycobacterium tuberculosis
VEEWDIALLHRDHPS

SEQ ID NO: 91910 - protein, 15 aa, Mycobacterium tuberculosis
EEWDIALLHRDHPSH

SEQ ID NO: 91911 - protein, 15 aa, Mycobacterium tuberculosis
EWDIALLHRDHPSHE

SEQ ID NO: 91912 - protein, 15 aa, Mycobacterium tuberculosis
WDIALLHRDHPSHEG

SEQ ID NO: 91913 - protein, 15 aa, Mycobacterium tuberculosis
DIALLHRDHPSHEGA

SEQ ID NO: 91914 - protein, 15 aa, Mycobacterium tuberculosis
IALLHRDHPSHEGAC

SEQ ID NO: 91915 - protein, 15 aa, Mycobacterium tuberculosis
ALLHRDHPSHEGACV

SEQ ID NO: 91916 - protein, 15 aa, Mycobacterium tuberculosis
LLHRDHPSHEGACVR

SEQ ID NO: 91917 - protein, 15 aa, Mycobacterium tuberculosis
LHRDHPSHEGACVRA

SEQ ID NO: 91918 - protein, 15 aa, Mycobacterium tuberculosis
HRDHPSHEGACVRAT

SEQ ID NO: 91919 - protein, 15 aa, Mycobacterium tuberculosis
RDHPSHEGACVRATW

SEQ ID NO: 91920 - protein, 15 aa, Mycobacterium tuberculosis
DHPSHEGACVRATWL

SEQ ID NO: 91921 - protein, 15 aa, Mycobacterium tuberculosis
HPSHEGACVRATWLK

SEQ ID NO: 91922 - protein, 15 aa, Mycobacterium tuberculosis
PSHEGACVRATWLKV

SEQ ID NO: 91923 - protein, 15 aa, Mycobacterium tuberculosis
SHEGACVRATWLKVV

SEQ ID NO: 91924 - protein, 15 aa, Mycobacterium tuberculosis
HEGACVRATWLKVVP

SEQ ID NO: 91925 - protein, 15 aa, Mycobacterium tuberculosis
EGACVRATWLKVVPD

SEQ ID NO: 91926 - protein, 15 aa, Mycobacterium tuberculosis
GACVRATWLKVVPDQ

SEQ ID NO: 91927 - protein, 15 aa, Mycobacterium tuberculosis
ACVRATWLKVVPDQL

SEQ ID NO: 91928 - protein, 15 aa, Mycobacterium tuberculosis
CVRATWLKVVPDQLG

SEQ ID NO: 91929 - protein, 15 aa, Mycobacterium tuberculosis
VRATWLKVVPDQLGR

SEQ ID NO: 91930 - protein, 15 aa, Mycobacterium tuberculosis
RATWLKVVPDQLGRS

SEQ ID NO: 91931 - protein, 15 aa, Mycobacterium tuberculosis
ATWLKVVPDQLGRSL

SEQ ID NO: 91932 - protein, 15 aa, Mycobacterium tuberculosis
TWLKVVPDQLGRSLE

SEQ ID NO: 91933 - protein, 15 aa, Mycobacterium tuberculosis
WLKVVPDQLGRSLEF

SEQ ID NO: 91934 - protein, 15 aa, Mycobacterium tuberculosis
LKVVPDQLGRSLEFY

SEQ ID NO: 91935 - protein, 15 aa, Mycobacterium tuberculosis
KVVPDQLGRSLEFYR

SEQ ID NO: 91936 - protein, 15 aa, Mycobacterium tuberculosis
VVPDQLGRSLEFYRT

SEQ ID NO: 91937 - protein, 15 aa, Mycobacterium tuberculosis
VPDQLGRSLEFYRTS

SEQ ID NO: 91938 - protein, 15 aa, Mycobacterium tuberculosis
PDQLGRSLEFYRTSV

SEQ ID NO: 91939 - protein, 15 aa, Mycobacterium tuberculosis
DQLGRSLEFYRTSVL

SEQ ID NO: 91940 - protein, 15 aa, Mycobacterium tuberculosis
QLGRSLEFYRTSVLP

SEQ ID NO: 91941 - protein, 15 aa, Mycobacterium tuberculosis
LGRSLEFYRTSVLPE

SEQ ID NO: 91942 - protein, 15 aa, Mycobacterium tuberculosis
GRSLEFYRTSVLPEL

SEQ ID NO: 91943 - protein, 15 aa, Mycobacterium tuberculosis
RSLEFYRTSVLPELE

SEQ ID NO: 91944 - protein, 15 aa, Mycobacterium tuberculosis
SLEFYRTSVLPELES

SEQ ID NO: 91945 - protein, 15 aa, Mycobacterium tuberculosis
LEFYRTSVLPELESL

SEQ ID NO: 91946 - protein, 15 aa, Mycobacterium tuberculosis
EFYRTSVLPELESLD

SEQ ID NO: 91947 - protein, 15 aa, Mycobacterium tuberculosis
FYRTSVLPELESLDG

SEQ ID NO: 91948 - protein, 15 aa, Mycobacterium tuberculosis
YRTSVLPELESLDGF

SEQ ID NO: 91949 - protein, 15 aa, Mycobacterium tuberculosis
RTSVLPELESLDGFC

SEQ ID NO: 91950 - protein, 15 aa, Mycobacterium tuberculosis
TSVLPELESLDGFCS

SEQ ID NO: 91951 - protein, 15 aa, Mycobacterium tuberculosis
SVLPELESLDGFCSA

SEQ ID NO: 91952 - protein, 15 aa, Mycobacterium tuberculosis
VLPELESLDGFCSAS

SEQ ID NO: 91953 - protein, 15 aa, Mycobacterium tuberculosis
LPELESLDGFCSASL

SEQ ID NO: 91954 - protein, 15 aa, Mycobacterium tuberculosis
PELESLDGFCSASLM

SEQ ID NO: 91955 - protein, 15 aa, Mycobacterium tuberculosis
ELESLDGFCSASLMV

SEQ ID NO: 91956 - protein, 15 aa, Mycobacterium tuberculosis
LESLDGFCSASLMVD

SEQ ID NO: 91957 - protein, 15 aa, Mycobacterium tuberculosis
ESLDGFCSASLMVDH

SEQ ID NO: 91958 - protein, 15 aa, Mycobacterium tuberculosis
SLDGFCSASLMVDHP

SEQ ID NO: 91959 - protein, 15 aa, Mycobacterium tuberculosis
LDGFCSASLMVDHPA

SEQ ID NO: 91960 - protein, 15 aa, Mycobacterium tuberculosis
DGFCSASLMVDHPAC

SEQ ID NO: 91961 - protein, 15 aa, Mycobacterium tuberculosis
GFCSASLMVDHPACR

SEQ ID NO: 91962 - protein, 15 aa, Mycobacterium tuberculosis
FCSASLMVDHPACRR

SEQ ID NO: 91963 - protein, 15 aa, Mycobacterium tuberculosis
CSASLMVDHPACRRA

SEQ ID NO: 91964 - protein, 15 aa, Mycobacterium tuberculosis
SASLMVDHPACRRAV

SEQ ID NO: 91965 - protein, 15 aa, Mycobacterium tuberculosis
ASLMVDHPACRRAVS

SEQ ID NO: 91966 - protein, 15 aa, Mycobacterium tuberculosis
SLMVDHPACRRAVSC

SEQ ID NO: 91967 - protein, 15 aa, Mycobacterium tuberculosis
LMVDHPACRRAVSCS

SEQ ID NO: 91968 - protein, 15 aa, Mycobacterium tuberculosis
MVDHPACRRAVSCST

SEQ ID NO: 91969 - protein, 15 aa, Mycobacterium tuberculosis
VDHPACRRAVSCSTF

SEQ ID NO: 91970 - protein, 15 aa, Mycobacterium tuberculosis
DHPACRRAVSCSTFD

SEQ ID NO: 91971 - protein, 15 aa, Mycobacterium tuberculosis
HPACRRAVSCSTFDS

SEQ ID NO: 91972 - protein, 15 aa, Mycobacterium tuberculosis
PACRRAVSCSTFDSM

SEQ ID NO: 91973 - protein, 15 aa, Mycobacterium tuberculosis
ACRRAVSCSTFDSMD

SEQ ID NO: 91974 - protein, 15 aa, Mycobacterium tuberculosis
CRRAVSCSTFDSMDA

SEQ ID NO: 91975 - protein, 15 aa, Mycobacterium tuberculosis
RRAVSCSTFDSMDAM

SEQ ID NO: 91976 - protein, 15 aa, Mycobacterium tuberculosis
RAVSCSTFDSMDAMA

SEQ ID NO: 91977 - protein, 15 aa, Mycobacterium tuberculosis
AVSCSTFDSMDAMAR

SEQ ID NO: 91978 - protein, 15 aa, Mycobacterium tuberculosis
VSCSTFDSMDAMARN

SEQ ID NO: 91979 - protein, 15 aa, Mycobacterium tuberculosis
SCSTFDSMDAMARNR

SEQ ID NO: 91980 - protein, 15 aa, Mycobacterium tuberculosis
CSTFDSMDAMARNRD

SEQ ID NO: 91981 - protein, 15 aa, Mycobacterium tuberculosis
STFDSMDAMARNRDR

SEQ ID NO: 91982 - protein, 15 aa, Mycobacterium tuberculosis
TFDSMDAMARNRDRA

SEQ ID NO: 91983 - protein, 15 aa, Mycobacterium tuberculosis
FDSMDAMARNRDRAS

SEQ ID NO: 91984 - protein, 15 aa, Mycobacterium tuberculosis
DSMDAMARNRDRASE

SEQ ID NO: 91985 - protein, 15 aa, Mycobacterium tuberculosis
SMDAMARNRDRASEL

SEQ ID NO: 91986 - protein, 15 aa, Mycobacterium tuberculosis
MDAMARNRDRASELR

SEQ ID NO: 91987 - protein, 15 aa, Mycobacterium tuberculosis
DAMARNRDRASELRS

SEQ ID NO: 91988 - protein, 15 aa, Mycobacterium tuberculosis
AMARNRDRASELRSR

SEQ ID NO: 91989 - protein, 15 aa, Mycobacterium tuberculosis
MARNRDRASELRSRR

SEQ ID NO: 91990 - protein, 15 aa, Mycobacterium tuberculosis
ARNRDRASELRSRRV

SEQ ID NO: 91991 - protein, 15 aa, Mycobacterium tuberculosis
RNRDRASELRSRRVR

SEQ ID NO: 91992 - protein, 15 aa, Mycobacterium tuberculosis
NRDRASELRSRRVRE

SEQ ID NO: 91993 - protein, 15 aa, Mycobacterium tuberculosis
RDRASELRSRRVREL

SEQ ID NO: 91994 - protein, 15 aa, Mycobacterium tuberculosis
DRASELRSRRVRELG

SEQ ID NO: 91995 - protein, 15 aa, Mycobacterium tuberculosis
RASELRSRRVRELGA

SEQ ID NO: 91996 - protein, 15 aa, Mycobacterium tuberculosis
ASELRSRRVRELGAE

SEQ ID NO: 91997 - protein, 15 aa, Mycobacterium tuberculosis
SELRSRRVRELGAEV

SEQ ID NO: 91998 - protein, 15 aa, Mycobacterium tuberculosis
ELRSRRVRELGAEVL

SEQ ID NO: 91999 - protein, 15 aa, Mycobacterium tuberculosis
LRSRRVRELGAEVLD

SEQ ID NO: 92000 - protein, 15 aa, Mycobacterium tuberculosis
RSRRVRELGAEVLDV

SEQ ID NO: 92001 - protein, 15 aa, Mycobacterium tuberculosis
SRRVRELGAEVLDVA

SEQ ID NO: 92002 - protein, 15 aa, Mycobacterium tuberculosis
RRVRELGAEVLDVAE

SEQ ID NO: 92003 - protein, 15 aa, Mycobacterium tuberculosis
RVRELGAEVLDVAEF

SEQ ID NO: 92004 - protein, 15 aa, Mycobacterium tuberculosis
VRELGAEVLDVAEFE

SEQ ID NO: 92005 - protein, 15 aa, Mycobacterium tuberculosis
RELGAEVLDVAEFEL

SEQ ID NO: 92006 - protein, 15 aa, Mycobacterium tuberculosis
ELGAEVLDVAEFELA

SEQ ID NO: 92007 - protein, 15 aa, Mycobacterium tuberculosis
LGAEVLDVAEFELAI

SEQ ID NO: 92008 - protein, 15 aa, Mycobacterium tuberculosis
GAEVLDVAEFELAIA

SEQ ID NO: 92009 - protein, 15 aa, Mycobacterium tuberculosis
AEVLDVAEFELAIAH

SEQ ID NO: 92010 - protein, 15 aa, Mycobacterium tuberculosis
EVLDVAEFELAIAHL

SEQ ID NO: 92011 - protein, 15 aa, Mycobacterium tuberculosis
VLDVAEFELAIAHLR

SEQ ID NO: 92012 - protein, 15 aa, Mycobacterium tuberculosis
LDVAEFELAIAHLRV

SEQ ID NO: 92013 - protein, 15 aa, Mycobacterium tuberculosis
DVAEFELAIAHLRVP

SEQ ID NO: 92014 - protein, 15 aa, Mycobacterium tuberculosis
VAEFELAIAHLRVPE

SEQ ID NO: 92015 - protein, 15 aa, Mycobacterium tuberculosis
AEFELAIAHLRVPEL

SEQ ID NO: 92016 - protein, 15 aa, Mycobacterium tuberculosis
EFELAIAHLRVPELV

SEQ ID NO: 92017 - protein, 16 aa, Mycobacterium tuberculosis
MPGSAGWRKVFGGTGG

SEQ ID NO: 92018 - protein, 16 aa, Mycobacterium tuberculosis
PGSAGWRKVFGGTGGA

SEQ ID NO: 92019 - protein, 16 aa, Mycobacterium tuberculosis
GSAGWRKVFGGTGGAT

SEQ ID NO: 92020 - protein, 16 aa, Mycobacterium tuberculosis
SAGWRKVFGGTGGATG

SEQ ID NO: 92021 - protein, 16 aa, Mycobacterium tuberculosis
AGWRKVFGGTGGATGA

SEQ ID NO: 92022 - protein, 16 aa, Mycobacterium tuberculosis
GWRKVFGGTGGATGAL

SEQ ID NO: 92023 - protein, 16 aa, Mycobacterium tuberculosis
WRKVFGGTGGATGALP

SEQ ID NO: 92024 - protein, 16 aa, Mycobacterium tuberculosis
RKVFGGTGGATGALPR

SEQ ID NO: 92025 - protein, 16 aa, Mycobacterium tuberculosis
KVFGGTGGATGALPRH

SEQ ID NO: 92026 - protein, 16 aa, Mycobacterium tuberculosis
VFGGTGGATGALPRHG

SEQ ID NO: 92027 - protein, 16 aa, Mycobacterium tuberculosis
FGGTGGATGALPRHGR

SEQ ID NO: 92028 - protein, 16 aa, Mycobacterium tuberculosis
GGTGGATGALPRHGRG

SEQ ID NO: 92029 - protein, 16 aa, Mycobacterium tuberculosis
GTGGATGALPRHGRGS

SEQ ID NO: 92030 - protein, 16 aa, Mycobacterium tuberculosis
TGGATGALPRHGRGSI

SEQ ID NO: 92031 - protein, 16 aa, Mycobacterium tuberculosis
GGATGALPRHGRGSIV

SEQ ID NO: 92032 - protein, 16 aa, Mycobacterium tuberculosis
GATGALPRHGRGSIVY

SEQ ID NO: 92033 - protein, 16 aa, Mycobacterium tuberculosis
ATGALPRHGRGSIVYA

SEQ ID NO: 92034 - protein, 16 aa, Mycobacterium tuberculosis
TGALPRHGRGSIVYAR

SEQ ID NO: 92035 - protein, 16 aa, Mycobacterium tuberculosis
GALPRHGRGSIVYARS

SEQ ID NO: 92036 - protein, 16 aa, Mycobacterium tuberculosis
ALPRHGRGSIVYARST

SEQ ID NO: 92037 - protein, 16 aa, Mycobacterium tuberculosis
LPRHGRGSIVYARSTT

SEQ ID NO: 92038 - protein, 16 aa, Mycobacterium tuberculosis
PRHGRGSIVYARSTTI

SEQ ID NO: 92039 - protein, 16 aa, Mycobacterium tuberculosis
RHGRGSIVYARSTTIE

SEQ ID NO: 92040 - protein, 16 aa, Mycobacterium tuberculosis
HGRGSIVYARSTTIEA

SEQ ID NO: 92041 - protein, 16 aa, Mycobacterium tuberculosis
GRGSIVYARSTTIEAQ

SEQ ID NO: 92042 - protein, 16 aa, Mycobacterium tuberculosis
RGSIVYARSTTIEAQP

SEQ ID NO: 92043 - protein, 16 aa, Mycobacterium tuberculosis
GSIVYARSTTIEAQPL

SEQ ID NO: 92044 - protein, 16 aa, Mycobacterium tuberculosis
SIVYARSTTIEAQPLS

SEQ ID NO: 92045 - protein, 16 aa, Mycobacterium tuberculosis
IVYARSTTIEAQPLSV

SEQ ID NO: 92046 - protein, 16 aa, Mycobacterium tuberculosis
VYARSTTIEAQPLSVD

SEQ ID NO: 92047 - protein, 16 aa, Mycobacterium tuberculosis
YARSTTIEAQPLSVDI

SEQ ID NO: 92048 - protein, 16 aa, Mycobacterium tuberculosis
ARSTTIEAQPLSVDIG

SEQ ID NO: 92049 - protein, 16 aa, Mycobacterium tuberculosis
RSTTIEAQPLSVDIGI

SEQ ID NO: 92050 - protein, 16 aa, Mycobacterium tuberculosis
STTIEAQPLSVDIGIA

SEQ ID NO: 92051 - protein, 16 aa, Mycobacterium tuberculosis
TTIEAQPLSVDIGIAH

SEQ ID NO: 92052 - protein, 16 aa, Mycobacterium tuberculosis
TIEAQPLSVDIGIAHV

SEQ ID NO: 92053 - protein, 16 aa, Mycobacterium tuberculosis
IEAQPLSVDIGIAHVR

SEQ ID NO: 92054 - protein, 16 aa, Mycobacterium tuberculosis
EAQPLSVDIGIAHVRD

SEQ ID NO: 92055 - protein, 16 aa, Mycobacterium tuberculosis
AQPLSVDIGIAHVRDV

SEQ ID NO: 92056 - protein, 16 aa, Mycobacterium tuberculosis
QPLSVDIGIAHVRDVV

SEQ ID NO: 92057 - protein, 16 aa, Mycobacterium tuberculosis
PLSVDIGIAHVRDVVM

SEQ ID NO: 92058 - protein, 16 aa, Mycobacterium tuberculosis
LSVDIGIAHVRDVVMP

SEQ ID NO: 92059 - protein, 16 aa, Mycobacterium tuberculosis
SVDIGIAHVRDVVMPA

SEQ ID NO: 92060 - protein, 16 aa, Mycobacterium tuberculosis
VDIGIAHVRDVVMPAL

SEQ ID NO: 92061 - protein, 16 aa, Mycobacterium tuberculosis
DIGIAHVRDVVMPALQ

SEQ ID NO: 92062 - protein, 16 aa, Mycobacterium tuberculosis
IGIAHVRDVVMPALQE

SEQ ID NO: 92063 - protein, 16 aa, Mycobacterium tuberculosis
GIAHVRDVVMPALQEI

SEQ ID NO: 92064 - protein, 16 aa, Mycobacterium tuberculosis
IAHVRDVVMPALQEID

SEQ ID NO: 92065 - protein, 16 aa, Mycobacterium tuberculosis
AHVRDVVMPALQEIDG

SEQ ID NO: 92066 - protein, 16 aa, Mycobacterium tuberculosis
HVRDVVMPALQEIDGC

SEQ ID NO: 92067 - protein, 16 aa, Mycobacterium tuberculosis
VRDVVMPALQEIDGCV

SEQ ID NO: 92068 - protein, 16 aa, Mycobacterium tuberculosis
RDVVMPALQEIDGCVG

SEQ ID NO: 92069 - protein, 16 aa, Mycobacterium tuberculosis
DVVMPALQEIDGCVGV

SEQ ID NO: 92070 - protein, 16 aa, Mycobacterium tuberculosis
VVMPALQEIDGCVGVS

SEQ ID NO: 92071 - protein, 16 aa, Mycobacterium tuberculosis
VMPALQEIDGCVGVSL

SEQ ID NO: 92072 - protein, 16 aa, Mycobacterium tuberculosis
MPALQEIDGCVGVSLL

SEQ ID NO: 92073 - protein, 16 aa, Mycobacterium tuberculosis
PALQEIDGCVGVSLLV

SEQ ID NO: 92074 - protein, 16 aa, Mycobacterium tuberculosis
ALQEIDGCVGVSLLVD

SEQ ID NO: 92075 - protein, 16 aa, Mycobacterium tuberculosis
LQEIDGCVGVSLLVDR

SEQ ID NO: 92076 - protein, 16 aa, Mycobacterium tuberculosis
QEIDGCVGVSLLVDRQ

SEQ ID NO: 92077 - protein, 16 aa, Mycobacterium tuberculosis
EIDGCVGVSLLVDRQS

SEQ ID NO: 92078 - protein, 16 aa, Mycobacterium tuberculosis
IDGCVGVSLLVDRQSG

SEQ ID NO: 92079 - protein, 16 aa, Mycobacterium tuberculosis
DGCVGVSLLVDRQSGR

SEQ ID NO: 92080 - protein, 16 aa, Mycobacterium tuberculosis
GCVGVSLLVDRQSGRC

SEQ ID NO: 92081 - protein, 16 aa, Mycobacterium tuberculosis
CVGVSLLVDRQSGRCI

SEQ ID NO: 92082 - protein, 16 aa, Mycobacterium tuberculosis
VGVSLLVDRQSGRCIA

SEQ ID NO: 92083 - protein, 16 aa, Mycobacterium tuberculosis
GVSLLVDRQSGRCIAT

SEQ ID NO: 92084 - protein, 16 aa, Mycobacterium tuberculosis
VSLLVDRQSGRCIATS

SEQ ID NO: 92085 - protein, 16 aa, Mycobacterium tuberculosis
SLLVDRQSGRCIATSA

SEQ ID NO: 92086 - protein, 16 aa, Mycobacterium tuberculosis
LLVDRQSGRCIATSAW

SEQ ID NO: 92087 - protein, 16 aa, Mycobacterium tuberculosis
LVDRQSGRCIATSAWE

SEQ ID NO: 92088 - protein, 16 aa, Mycobacterium tuberculosis
VDRQSGRCIATSAWET

SEQ ID NO: 92089 - protein, 16 aa, Mycobacterium tuberculosis
DRQSGRCIATSAWETL

SEQ ID NO: 92090 - protein, 16 aa, Mycobacterium tuberculosis
RQSGRCIATSAWETLE

SEQ ID NO: 92091 - protein, 16 aa, Mycobacterium tuberculosis
QSGRCIATSAWETLEA

SEQ ID NO: 92092 - protein, 16 aa, Mycobacterium tuberculosis
SGRCIATSAWETLEAM

SEQ ID NO: 92093 - protein, 16 aa, Mycobacterium tuberculosis
GRCIATSAWETLEAMR

SEQ ID NO: 92094 - protein, 16 aa, Mycobacterium tuberculosis
RCIATSAWETLEAMRA

SEQ ID NO: 92095 - protein, 16 aa, Mycobacterium tuberculosis
CIATSAWETLEAMRAS

SEQ ID NO: 92096 - protein, 16 aa, Mycobacterium tuberculosis
IATSAWETLEAMRASV

SEQ ID NO: 92097 - protein, 16 aa, Mycobacterium tuberculosis
ATSAWETLEAMRASVE

SEQ ID NO: 92098 - protein, 16 aa, Mycobacterium tuberculosis
TSAWETLEAMRASVER

SEQ ID NO: 92099 - protein, 16 aa, Mycobacterium tuberculosis
SAWETLEAMRASVERV

SEQ ID NO: 92100 - protein, 16 aa, Mycobacterium tuberculosis
AWETLEAMRASVERVA

SEQ ID NO: 92101 - protein, 16 aa, Mycobacterium tuberculosis
WETLEAMRASVERVAP

SEQ ID NO: 92102 - protein, 16 aa, Mycobacterium tuberculosis
ETLEAMRASVERVAPI

SEQ ID NO: 92103 - protein, 16 aa, Mycobacterium tuberculosis
TLEAMRASVERVAPIR

SEQ ID NO: 92104 - protein, 16 aa, Mycobacterium tuberculosis
LEAMRASVERVAPIRD

SEQ ID NO: 92105 - protein, 16 aa, Mycobacterium tuberculosis
EAMRASVERVAPIRDR

SEQ ID NO: 92106 - protein, 16 aa, Mycobacterium tuberculosis
AMRASVERVAPIRDRA

SEQ ID NO: 92107 - protein, 16 aa, Mycobacterium tuberculosis
MRASVERVAPIRDRAA

SEQ ID NO: 92108 - protein, 16 aa, Mycobacterium tuberculosis
RASVERVAPIRDRAAL

SEQ ID NO: 92109 - protein, 16 aa, Mycobacterium tuberculosis
ASVERVAPIRDRAALM

SEQ ID NO: 92110 - protein, 16 aa, Mycobacterium tuberculosis
SVERVAPIRDRAALMF

SEQ ID NO: 92111 - protein, 16 aa, Mycobacterium tuberculosis
VERVAPIRDRAALMFA

SEQ ID NO: 92112 - protein, 16 aa, Mycobacterium tuberculosis
ERVAPIRDRAALMFAG

SEQ ID NO: 92113 - protein, 16 aa, Mycobacterium tuberculosis
RVAPIRDRAALMFAGS

SEQ ID NO: 92114 - protein, 16 aa, Mycobacterium tuberculosis
VAPIRDRAALMFAGSA

SEQ ID NO: 92115 - protein, 16 aa, Mycobacterium tuberculosis
APIRDRAALMFAGSAR

SEQ ID NO: 92116 - protein, 16 aa, Mycobacterium tuberculosis
PIRDRAALMFAGSARV

SEQ ID NO: 92117 - protein, 16 aa, Mycobacterium tuberculosis
IRDRAALMFAGSARVE

SEQ ID NO: 92118 - protein, 16 aa, Mycobacterium tuberculosis
RDRAALMFAGSARVEE

SEQ ID NO: 92119 - protein, 16 aa, Mycobacterium tuberculosis
DRAALMFAGSARVEEW

SEQ ID NO: 92120 - protein, 16 aa, Mycobacterium tuberculosis
RAALMFAGSARVEEWD

SEQ ID NO: 92121 - protein, 16 aa, Mycobacterium tuberculosis
AALMFAGSARVEEWDI

SEQ ID NO: 92122 - protein, 16 aa, Mycobacterium tuberculosis
ALMFAGSARVEEWDIA

SEQ ID NO: 92123 - protein, 16 aa, Mycobacterium tuberculosis
LMFAGSARVEEWDIAL

SEQ ID NO: 92124 - protein, 16 aa, Mycobacterium tuberculosis
MFAGSARVEEWDIALL

SEQ ID NO: 92125 - protein, 16 aa, Mycobacterium tuberculosis
FAGSARVEEWDIALLH

SEQ ID NO: 92126 - protein, 16 aa, Mycobacterium tuberculosis
AGSARVEEWDIALLHR

SEQ ID NO: 92127 - protein, 16 aa, Mycobacterium tuberculosis
GSARVEEWDIALLHRD

SEQ ID NO: 92128 - protein, 16 aa, Mycobacterium tuberculosis
SARVEEWDIALLHRDH

SEQ ID NO: 92129 - protein, 16 aa, Mycobacterium tuberculosis
ARVEEWDIALLHRDHP

SEQ ID NO: 92130 - protein, 16 aa, Mycobacterium tuberculosis
RVEEWDIALLHRDHPS

SEQ ID NO: 92131 - protein, 16 aa, Mycobacterium tuberculosis
VEEWDIALLHRDHPSH

SEQ ID NO: 92132 - protein, 16 aa, Mycobacterium tuberculosis
EEWDIALLHRDHPSHE

SEQ ID NO: 92133 - protein, 16 aa, Mycobacterium tuberculosis
EWDIALLHRDHPSHEG

SEQ ID NO: 92134 - protein, 16 aa, Mycobacterium tuberculosis
WDIALLHRDHPSHEGA

SEQ ID NO: 92135 - protein, 16 aa, Mycobacterium tuberculosis
DIALLHRDHPSHEGAC

SEQ ID NO: 92136 - protein, 16 aa, Mycobacterium tuberculosis
IALLHRDHPSHEGACV

SEQ ID NO: 92137 - protein, 16 aa, Mycobacterium tuberculosis
ALLHRDHPSHEGACVR

SEQ ID NO: 92138 - protein, 16 aa, Mycobacterium tuberculosis
LLHRDHPSHEGACVRA

SEQ ID NO: 92139 - protein, 16 aa, Mycobacterium tuberculosis
LHRDHPSHEGACVRAT

SEQ ID NO: 92140 - protein, 16 aa, Mycobacterium tuberculosis
HRDHPSHEGACVRATW

SEQ ID NO: 92141 - protein, 16 aa, Mycobacterium tuberculosis
RDHPSHEGACVRATWL

SEQ ID NO: 92142 - protein, 16 aa, Mycobacterium tuberculosis
DHPSHEGACVRATWLK

SEQ ID NO: 92143 - protein, 16 aa, Mycobacterium tuberculosis
HPSHEGACVRATWLKV

SEQ ID NO: 92144 - protein, 16 aa, Mycobacterium tuberculosis
PSHEGACVRATWLKVV

SEQ ID NO: 92145 - protein, 16 aa, Mycobacterium tuberculosis
SHEGACVRATWLKVVP

SEQ ID NO: 92146 - protein, 16 aa, Mycobacterium tuberculosis
HEGACVRATWLKVVPD

SEQ ID NO: 92147 - protein, 16 aa, Mycobacterium tuberculosis
EGACVRATWLKVVPDQ

SEQ ID NO: 92148 - protein, 16 aa, Mycobacterium tuberculosis
GACVRATWLKVVPDQL

SEQ ID NO: 92149 - protein, 16 aa, Mycobacterium tuberculosis
ACVRATWLKVVPDQLG

SEQ ID NO: 92150 - protein, 16 aa, Mycobacterium tuberculosis
CVRATWLKVVPDQLGR

SEQ ID NO: 92151 - protein, 16 aa, Mycobacterium tuberculosis
VRATWLKVVPDQLGRS

SEQ ID NO: 92152 - protein, 16 aa, Mycobacterium tuberculosis
RATWLKVVPDQLGRSL

SEQ ID NO: 92153 - protein, 16 aa, Mycobacterium tuberculosis
ATWLKVVPDQLGRSLE

SEQ ID NO: 92154 - protein, 16 aa, Mycobacterium tuberculosis
TWLKVVPDQLGRSLEF

SEQ ID NO: 92155 - protein, 16 aa, Mycobacterium tuberculosis
WLKVVPDQLGRSLEFY

SEQ ID NO: 92156 - protein, 16 aa, Mycobacterium tuberculosis
LKVVPDQLGRSLEFYR

SEQ ID NO: 92157 - protein, 16 aa, Mycobacterium tuberculosis
KVVPDQLGRSLEFYRT

SEQ ID NO: 92158 - protein, 16 aa, Mycobacterium tuberculosis
VVPDQLGRSLEFYRTS

SEQ ID NO: 92159 - protein, 16 aa, Mycobacterium tuberculosis
VPDQLGRSLEFYRTSV

SEQ ID NO: 92160 - protein, 16 aa, Mycobacterium tuberculosis
PDQLGRSLEFYRTSVL

SEQ ID NO: 92161 - protein, 16 aa, Mycobacterium tuberculosis
DQLGRSLEFYRTSVLP

SEQ ID NO: 92162 - protein, 16 aa, Mycobacterium tuberculosis
QLGRSLEFYRTSVLPE

SEQ ID NO: 92163 - protein, 16 aa, Mycobacterium tuberculosis
LGRSLEFYRTSVLPEL

SEQ ID NO: 92164 - protein, 16 aa, Mycobacterium tuberculosis
GRSLEFYRTSVLPELE

SEQ ID NO: 92165 - protein, 16 aa, Mycobacterium tuberculosis
RSLEFYRTSVLPELES

SEQ ID NO: 92166 - protein, 16 aa, Mycobacterium tuberculosis
SLEFYRTSVLPELESL

SEQ ID NO: 92167 - protein, 16 aa, Mycobacterium tuberculosis
LEFYRTSVLPELESLD

SEQ ID NO: 92168 - protein, 16 aa, Mycobacterium tuberculosis
EFYRTSVLPELESLDG

SEQ ID NO: 92169 - protein, 16 aa, Mycobacterium tuberculosis
FYRTSVLPELESLDGF

SEQ ID NO: 92170 - protein, 16 aa, Mycobacterium tuberculosis
YRTSVLPELESLDGFC

SEQ ID NO: 92171 - protein, 16 aa, Mycobacterium tuberculosis
RTSVLPELESLDGFCS

SEQ ID NO: 92172 - protein, 16 aa, Mycobacterium tuberculosis
TSVLPELESLDGFCSA

SEQ ID NO: 92173 - protein, 16 aa, Mycobacterium tuberculosis
SVLPELESLDGFCSAS

SEQ ID NO: 92174 - protein, 16 aa, Mycobacterium tuberculosis
VLPELESLDGFCSASL

SEQ ID NO: 92175 - protein, 16 aa, Mycobacterium tuberculosis
LPELESLDGFCSASLM

SEQ ID NO: 92176 - protein, 16 aa, Mycobacterium tuberculosis
PELESLDGFCSASLMV

SEQ ID NO: 92177 - protein, 16 aa, Mycobacterium tuberculosis
ELESLDGFCSASLMVD

SEQ ID NO: 92178 - protein, 16 aa, Mycobacterium tuberculosis
LESLDGFCSASLMVDH

SEQ ID NO: 92179 - protein, 16 aa, Mycobacterium tuberculosis
ESLDGFCSASLMVDHP

SEQ ID NO: 92180 - protein, 16 aa, Mycobacterium tuberculosis
SLDGFCSASLMVDHPA

SEQ ID NO: 92181 - protein, 16 aa, Mycobacterium tuberculosis
LDGFCSASLMVDHPAC

SEQ ID NO: 92182 - protein, 16 aa, Mycobacterium tuberculosis
DGFCSASLMVDHPACR

SEQ ID NO: 92183 - protein, 16 aa, Mycobacterium tuberculosis
GFCSASLMVDHPACRR

SEQ ID NO: 92184 - protein, 16 aa, Mycobacterium tuberculosis
FCSASLMVDHPACRRA

SEQ ID NO: 92185 - protein, 16 aa, Mycobacterium tuberculosis
CSASLMVDHPACRRAV

SEQ ID NO: 92186 - protein, 16 aa, Mycobacterium tuberculosis
SASLMVDHPACRRAVS

SEQ ID NO: 92187 - protein, 16 aa, Mycobacterium tuberculosis
ASLMVDHPACRRAVSC

SEQ ID NO: 92188 - protein, 16 aa, Mycobacterium tuberculosis
SLMVDHPACRRAVSCS

SEQ ID NO: 92189 - protein, 16 aa, Mycobacterium tuberculosis
LMVDHPACRRAVSCST

SEQ ID NO: 92190 - protein, 16 aa, Mycobacterium tuberculosis
MVDHPACRRAVSCSTF

SEQ ID NO: 92191 - protein, 16 aa, Mycobacterium tuberculosis
VDHPACRRAVSCSTFD

SEQ ID NO: 92192 - protein, 16 aa, Mycobacterium tuberculosis
DHPACRRAVSCSTFDS

SEQ ID NO: 92193 - protein, 16 aa, Mycobacterium tuberculosis
HPACRRAVSCSTFDSM

SEQ ID NO: 92194 - protein, 16 aa, Mycobacterium tuberculosis
PACRRAVSCSTFDSMD

SEQ ID NO: 92195 - protein, 16 aa, Mycobacterium tuberculosis
ACRRAVSCSTFDSMDA

SEQ ID NO: 92196 - protein, 16 aa, Mycobacterium tuberculosis
CRRAVSCSTFDSMDAM

SEQ ID NO: 92197 - protein, 16 aa, Mycobacterium tuberculosis
RRAVSCSTFDSMDAMA

SEQ ID NO: 92198 - protein, 16 aa, Mycobacterium tuberculosis
RAVSCSTFDSMDAMAR

SEQ ID NO: 92199 - protein, 16 aa, Mycobacterium tuberculosis
AVSCSTFDSMDAMARN

SEQ ID NO: 92200 - protein, 16 aa, Mycobacterium tuberculosis
VSCSTFDSMDAMARNR

SEQ ID NO: 92201 - protein, 16 aa, Mycobacterium tuberculosis
SCSTFDSMDAMARNRD

SEQ ID NO: 92202 - protein, 16 aa, Mycobacterium tuberculosis
CSTFDSMDAMARNRDR

SEQ ID NO: 92203 - protein, 16 aa, Mycobacterium tuberculosis
STFDSMDAMARNRDRA

SEQ ID NO: 92204 - protein, 16 aa, Mycobacterium tuberculosis
TFDSMDAMARNRDRAS

SEQ ID NO: 92205 - protein, 16 aa, Mycobacterium tuberculosis
FDSMDAMARNRDRASE

SEQ ID NO: 92206 - protein, 16 aa, Mycobacterium tuberculosis
DSMDAMARNRDRASEL

SEQ ID NO: 92207 - protein, 16 aa, Mycobacterium tuberculosis
SMDAMARNRDRASELR

SEQ ID NO: 92208 - protein, 16 aa, Mycobacterium tuberculosis
MDAMARNRDRASELRS

SEQ ID NO: 92209 - protein, 16 aa, Mycobacterium tuberculosis
DAMARNRDRASELRSR

SEQ ID NO: 92210 - protein, 16 aa, Mycobacterium tuberculosis
AMARNRDRASELRSRR

SEQ ID NO: 92211 - protein, 16 aa, Mycobacterium tuberculosis
MARNRDRASELRSRRV

SEQ ID NO: 92212 - protein, 16 aa, Mycobacterium tuberculosis
ARNRDRASELRSRRVR

SEQ ID NO: 92213 - protein, 16 aa, Mycobacterium tuberculosis
RNRDRASELRSRRVRE

SEQ ID NO: 92214 - protein, 16 aa, Mycobacterium tuberculosis
NRDRASELRSRRVREL

SEQ ID NO: 92215 - protein, 16 aa, Mycobacterium tuberculosis
RDRASELRSRRVRELG

SEQ ID NO: 92216 - protein, 16 aa, Mycobacterium tuberculosis
DRASELRSRRVRELGA

SEQ ID NO: 92217 - protein, 16 aa, Mycobacterium tuberculosis
RASELRSRRVRELGAE

SEQ ID NO: 92218 - protein, 16 aa, Mycobacterium tuberculosis
ASELRSRRVRELGAEV

SEQ ID NO: 92219 - protein, 16 aa, Mycobacterium tuberculosis
SELRSRRVRELGAEVL

SEQ ID NO: 92220 - protein, 16 aa, Mycobacterium tuberculosis
ELRSRRVRELGAEVLD

SEQ ID NO: 92221 - protein, 16 aa, Mycobacterium tuberculosis
LRSRRVRELGAEVLDV

SEQ ID NO: 92222 - protein, 16 aa, Mycobacterium tuberculosis
RSRRVRELGAEVLDVA

SEQ ID NO: 92223 - protein, 16 aa, Mycobacterium tuberculosis
SRRVRELGAEVLDVAE

SEQ ID NO: 92224 - protein, 16 aa, Mycobacterium tuberculosis
RRVRELGAEVLDVAEF

SEQ ID NO: 92225 - protein, 16 aa, Mycobacterium tuberculosis
RVRELGAEVLDVAEFE

SEQ ID NO: 92226 - protein, 16 aa, Mycobacterium tuberculosis
VRELGAEVLDVAEFEL

SEQ ID NO: 92227 - protein, 16 aa, Mycobacterium tuberculosis
RELGAEVLDVAEFELA

SEQ ID NO: 92228 - protein, 16 aa, Mycobacterium tuberculosis
ELGAEVLDVAEFELAI

SEQ ID NO: 92229 - protein, 16 aa, Mycobacterium tuberculosis
LGAEVLDVAEFELAIA

SEQ ID NO: 92230 - protein, 16 aa, Mycobacterium tuberculosis
GAEVLDVAEFELAIAH

SEQ ID NO: 92231 - protein, 16 aa, Mycobacterium tuberculosis
AEVLDVAEFELAIAHL

SEQ ID NO: 92232 - protein, 16 aa, Mycobacterium tuberculosis
EVLDVAEFELAIAHLR

SEQ ID NO: 92233 - protein, 16 aa, Mycobacterium tuberculosis
VLDVAEFELAIAHLRV

SEQ ID NO: 92234 - protein, 16 aa, Mycobacterium tuberculosis
LDVAEFELAIAHLRVP

SEQ ID NO: 92235 - protein, 16 aa, Mycobacterium tuberculosis
DVAEFELAIAHLRVPE

SEQ ID NO: 92236 - protein, 16 aa, Mycobacterium tuberculosis
VAEFELAIAHLRVPEL

SEQ ID NO: 92237 - protein, 16 aa, Mycobacterium tuberculosis
AEFELAIAHLRVPELV

SEQ ID NO: 92238 - protein, 13 aa, Mycobacterium tuberculosis
MTHKRTKRQPAIA

SEQ ID NO: 92239 - protein, 13 aa, Mycobacterium tuberculosis
THKRTKRQPAIAA

SEQ ID NO: 92240 - protein, 13 aa, Mycobacterium tuberculosis
HKRTKRQPAIAAG

SEQ ID NO: 92241 - protein, 13 aa, Mycobacterium tuberculosis
KRTKRQPAIAAGL

SEQ ID NO: 92242 - protein, 13 aa, Mycobacterium tuberculosis
RTKRQPAIAAGLN

SEQ ID NO: 92243 - protein, 13 aa, Mycobacterium tuberculosis
TKRQPAIAAGLNA

SEQ ID NO: 92244 - protein, 13 aa, Mycobacterium tuberculosis
KRQPAIAAGLNAP

SEQ ID NO: 92245 - protein, 13 aa, Mycobacterium tuberculosis
RQPAIAAGLNAPR

SEQ ID NO: 92246 - protein, 13 aa, Mycobacterium tuberculosis
QPAIAAGLNAPRR

SEQ ID NO: 92247 - protein, 13 aa, Mycobacterium tuberculosis
PAIAAGLNAPRRN

SEQ ID NO: 92248 - protein, 13 aa, Mycobacterium tuberculosis
AIAAGLNAPRRNR

SEQ ID NO: 92249 - protein, 13 aa, Mycobacterium tuberculosis
IAAGLNAPRRNRV

SEQ ID NO: 92250 - protein, 13 aa, Mycobacterium tuberculosis
AAGLNAPRRNRVG

SEQ ID NO: 92251 - protein, 13 aa, Mycobacterium tuberculosis
AGLNAPRRNRVGR

SEQ ID NO: 92252 - protein, 13 aa, Mycobacterium tuberculosis
GLNAPRRNRVGRQ

SEQ ID NO: 92253 - protein, 13 aa, Mycobacterium tuberculosis
LNAPRRNRVGRQH

SEQ ID NO: 92254 - protein, 13 aa, Mycobacterium tuberculosis
NAPRRNRVGRQHG

SEQ ID NO: 92255 - protein, 13 aa, Mycobacterium tuberculosis
APRRNRVGRQHGW

SEQ ID NO: 92256 - protein, 13 aa, Mycobacterium tuberculosis
PRRNRVGRQHGWP

SEQ ID NO: 92257 - protein, 13 aa, Mycobacterium tuberculosis
RRNRVGRQHGWPA

SEQ ID NO: 92258 - protein, 13 aa, Mycobacterium tuberculosis
RNRVGRQHGWPAD

SEQ ID NO: 92259 - protein, 13 aa, Mycobacterium tuberculosis
NRVGRQHGWPADV

SEQ ID NO: 92260 - protein, 13 aa, Mycobacterium tuberculosis
RVGRQHGWPADVP

SEQ ID NO: 92261 - protein, 13 aa, Mycobacterium tuberculosis
VGRQHGWPADVPS

SEQ ID NO: 92262 - protein, 13 aa, Mycobacterium tuberculosis
GRQHGWPADVPSA

SEQ ID NO: 92263 - protein, 13 aa, Mycobacterium tuberculosis
RQHGWPADVPSAE

SEQ ID NO: 92264 - protein, 13 aa, Mycobacterium tuberculosis
QHGWPADVPSAEQ

SEQ ID NO: 92265 - protein, 13 aa, Mycobacterium tuberculosis
HGWPADVPSAEQR

SEQ ID NO: 92266 - protein, 13 aa, Mycobacterium tuberculosis
GWPADVPSAEQRR

SEQ ID NO: 92267 - protein, 13 aa, Mycobacterium tuberculosis
WPADVPSAEQRRA

SEQ ID NO: 92268 - protein, 13 aa, Mycobacterium tuberculosis
PADVPSAEQRRAQ

SEQ ID NO: 92269 - protein, 13 aa, Mycobacterium tuberculosis
ADVPSAEQRRAQR

SEQ ID NO: 92270 - protein, 13 aa, Mycobacterium tuberculosis
DVPSAEQRRAQRQ

SEQ ID NO: 92271 - protein, 13 aa, Mycobacterium tuberculosis
VPSAEQRRAQRQR

SEQ ID NO: 92272 - protein, 13 aa, Mycobacterium tuberculosis
PSAEQRRAQRQRD

SEQ ID NO: 92273 - protein, 13 aa, Mycobacterium tuberculosis
SAEQRRAQRQRDL

SEQ ID NO: 92274 - protein, 13 aa, Mycobacterium tuberculosis
AEQRRAQRQRDLE

SEQ ID NO: 92275 - protein, 13 aa, Mycobacterium tuberculosis
EQRRAQRQRDLEA

SEQ ID NO: 92276 - protein, 13 aa, Mycobacterium tuberculosis
QRRAQRQRDLEAI

SEQ ID NO: 92277 - protein, 13 aa, Mycobacterium tuberculosis
RRAQRQRDLEAIR

SEQ ID NO: 92278 - protein, 13 aa, Mycobacterium tuberculosis
RAQRQRDLEAIRR

SEQ ID NO: 92279 - protein, 13 aa, Mycobacterium tuberculosis
AQRQRDLEAIRRA

SEQ ID NO: 92280 - protein, 13 aa, Mycobacterium tuberculosis
QRQRDLEAIRRAY

SEQ ID NO: 92281 - protein, 13 aa, Mycobacterium tuberculosis
RQRDLEAIRRAYA

SEQ ID NO: 92282 - protein, 13 aa, Mycobacterium tuberculosis
QRDLEAIRRAYAE

SEQ ID NO: 92283 - protein, 13 aa, Mycobacterium tuberculosis
RDLEAIRRAYAEM

SEQ ID NO: 92284 - protein, 13 aa, Mycobacterium tuberculosis
DLEAIRRAYAEMV

SEQ ID NO: 92285 - protein, 13 aa, Mycobacterium tuberculosis
LEAIRRAYAEMVA

SEQ ID NO: 92286 - protein, 13 aa, Mycobacterium tuberculosis
EAIRRAYAEMVAT

SEQ ID NO: 92287 - protein, 13 aa, Mycobacterium tuberculosis
AIRRAYAEMVATS

SEQ ID NO: 92288 - protein, 13 aa, Mycobacterium tuberculosis
IRRAYAEMVATSH

SEQ ID NO: 92289 - protein, 13 aa, Mycobacterium tuberculosis
RRAYAEMVATSHE

SEQ ID NO: 92290 - protein, 13 aa, Mycobacterium tuberculosis
RAYAEMVATSHEI

SEQ ID NO: 92291 - protein, 13 aa, Mycobacterium tuberculosis
AYAEMVATSHEID

SEQ ID NO: 92292 - protein, 13 aa, Mycobacterium tuberculosis
YAEMVATSHEIDD

SEQ ID NO: 92293 - protein, 13 aa, Mycobacterium tuberculosis
AEMVATSHEIDDD

SEQ ID NO: 92294 - protein, 13 aa, Mycobacterium tuberculosis
EMVATSHEIDDDT

SEQ ID NO: 92295 - protein, 13 aa, Mycobacterium tuberculosis
MVATSHEIDDDTA

SEQ ID NO: 92296 - protein, 13 aa, Mycobacterium tuberculosis
VATSHEIDDDTAE

SEQ ID NO: 92297 - protein, 13 aa, Mycobacterium tuberculosis
ATSHEIDDDTAEL

SEQ ID NO: 92298 - protein, 13 aa, Mycobacterium tuberculosis
TSHEIDDDTAELA

SEQ ID NO: 92299 - protein, 13 aa, Mycobacterium tuberculosis
SHEIDDDTAELAL

SEQ ID NO: 92300 - protein, 13 aa, Mycobacterium tuberculosis
HEIDDDTAELALL

SEQ ID NO: 92301 - protein, 13 aa, Mycobacterium tuberculosis
EIDDDTAELALLS

SEQ ID NO: 92302 - protein, 13 aa, Mycobacterium tuberculosis
IDDDTAELALLSM

SEQ ID NO: 92303 - protein, 13 aa, Mycobacterium tuberculosis
DDDTAELALLSMH

SEQ ID NO: 92304 - protein, 13 aa, Mycobacterium tuberculosis
DDTAELALLSMHL

SEQ ID NO: 92305 - protein, 13 aa, Mycobacterium tuberculosis
DTAELALLSMHLD

SEQ ID NO: 92306 - protein, 13 aa, Mycobacterium tuberculosis
TAELALLSMHLDD

SEQ ID NO: 92307 - protein, 13 aa, Mycobacterium tuberculosis
AELALLSMHLDDE

SEQ ID NO: 92308 - protein, 13 aa, Mycobacterium tuberculosis
ELALLSMHLDDEQ

SEQ ID NO: 92309 - protein, 13 aa, Mycobacterium tuberculosis
LALLSMHLDDEQR

SEQ ID NO: 92310 - protein, 13 aa, Mycobacterium tuberculosis
ALLSMHLDDEQRR

SEQ ID NO: 92311 - protein, 13 aa, Mycobacterium tuberculosis
LLSMHLDDEQRRL

SEQ ID NO: 92312 - protein, 13 aa, Mycobacterium tuberculosis
LSMHLDDEQRRLE

SEQ ID NO: 92313 - protein, 13 aa, Mycobacterium tuberculosis
SMHLDDEQRRLEA

SEQ ID NO: 92314 - protein, 13 aa, Mycobacterium tuberculosis
MHLDDEQRRLEAG

SEQ ID NO: 92315 - protein, 13 aa, Mycobacterium tuberculosis
HLDDEQRRLEAGM

SEQ ID NO: 92316 - protein, 13 aa, Mycobacterium tuberculosis
LDDEQRRLEAGMK

SEQ ID NO: 92317 - protein, 13 aa, Mycobacterium tuberculosis
DDEQRRLEAGMKL

SEQ ID NO: 92318 - protein, 13 aa, Mycobacterium tuberculosis
DEQRRLEAGMKLG

SEQ ID NO: 92319 - protein, 13 aa, Mycobacterium tuberculosis
EQRRLEAGMKLGW

SEQ ID NO: 92320 - protein, 13 aa, Mycobacterium tuberculosis
QRRLEAGMKLGWH

SEQ ID NO: 92321 - protein, 13 aa, Mycobacterium tuberculosis
RRLEAGMKLGWHP

SEQ ID NO: 92322 - protein, 13 aa, Mycobacterium tuberculosis
RLEAGMKLGWHPY

SEQ ID NO: 92323 - protein, 13 aa, Mycobacterium tuberculosis
LEAGMKLGWHPYH

SEQ ID NO: 92324 - protein, 13 aa, Mycobacterium tuberculosis
EAGMKLGWHPYHF

SEQ ID NO: 92325 - protein, 13 aa, Mycobacterium tuberculosis
AGMKLGWHPYHFP

SEQ ID NO: 92326 - protein, 13 aa, Mycobacterium tuberculosis
GMKLGWHPYHFPD

SEQ ID NO: 92327 - protein, 13 aa, Mycobacterium tuberculosis
MKLGWHPYHFPDE

SEQ ID NO: 92328 - protein, 13 aa, Mycobacterium tuberculosis
KLGWHPYHFPDEP

SEQ ID NO: 92329 - protein, 13 aa, Mycobacterium tuberculosis
LGWHPYHFPDEPD

SEQ ID NO: 92330 - protein, 13 aa, Mycobacterium tuberculosis
GWHPYHFPDEPDS

SEQ ID NO: 92331 - protein, 13 aa, Mycobacterium tuberculosis
WHPYHFPDEPDSK

SEQ ID NO: 92332 - protein, 13 aa, Mycobacterium tuberculosis
HPYHFPDEPDSKQ

SEQ ID NO: 92333 - protein, 14 aa, Mycobacterium tuberculosis
MTHKRTKRQPAIAA

SEQ ID NO: 92334 - protein, 14 aa, Mycobacterium tuberculosis
THKRTKRQPAIAAG

SEQ ID NO: 92335 - protein, 14 aa, Mycobacterium tuberculosis
HKRTKRQPAIAAGL

SEQ ID NO: 92336 - protein, 14 aa, Mycobacterium tuberculosis
KRTKRQPAIAAGLN

SEQ ID NO: 92337 - protein, 14 aa, Mycobacterium tuberculosis
RTKRQPAIAAGLNA

SEQ ID NO: 92338 - protein, 14 aa, Mycobacterium tuberculosis
TKRQPAIAAGLNAP

SEQ ID NO: 92339 - protein, 14 aa, Mycobacterium tuberculosis
KRQPAIAAGLNAPR

SEQ ID NO: 92340 - protein, 14 aa, Mycobacterium tuberculosis
RQPAIAAGLNAPRR

SEQ ID NO: 92341 - protein, 14 aa, Mycobacterium tuberculosis
QPAIAAGLNAPRRN

SEQ ID NO: 92342 - protein, 14 aa, Mycobacterium tuberculosis
PAIAAGLNAPRRNR

SEQ ID NO: 92343 - protein, 14 aa, Mycobacterium tuberculosis
AIAAGLNAPRRNRV

SEQ ID NO: 92344 - protein, 14 aa, Mycobacterium tuberculosis
IAAGLNAPRRNRVG

SEQ ID NO: 92345 - protein, 14 aa, Mycobacterium tuberculosis
AAGLNAPRRNRVGR

SEQ ID NO: 92346 - protein, 14 aa, Mycobacterium tuberculosis
AGLNAPRRNRVGRQ

SEQ ID NO: 92347 - protein, 14 aa, Mycobacterium tuberculosis
GLNAPRRNRVGRQH

SEQ ID NO: 92348 - protein, 14 aa, Mycobacterium tuberculosis
LNAPRRNRVGRQHG

SEQ ID NO: 92349 - protein, 14 aa, Mycobacterium tuberculosis
NAPRRNRVGRQHGW

SEQ ID NO: 92350 - protein, 14 aa, Mycobacterium tuberculosis
APRRNRVGRQHGWP

SEQ ID NO: 92351 - protein, 14 aa, Mycobacterium tuberculosis
PRRNRVGRQHGWPA

SEQ ID NO: 92352 - protein, 14 aa, Mycobacterium tuberculosis
RRNRVGRQHGWPAD

SEQ ID NO: 92353 - protein, 14 aa, Mycobacterium tuberculosis
RNRVGRQHGWPADV

SEQ ID NO: 92354 - protein, 14 aa, Mycobacterium tuberculosis
NRVGRQHGWPADVP

SEQ ID NO: 92355 - protein, 14 aa, Mycobacterium tuberculosis
RVGRQHGWPADVPS

SEQ ID NO: 92356 - protein, 14 aa, Mycobacterium tuberculosis
VGRQHGWPADVPSA

SEQ ID NO: 92357 - protein, 14 aa, Mycobacterium tuberculosis
GRQHGWPADVPSAE

SEQ ID NO: 92358 - protein, 14 aa, Mycobacterium tuberculosis
RQHGWPADVPSAEQ

SEQ ID NO: 92359 - protein, 14 aa, Mycobacterium tuberculosis
QHGWPADVPSAEQR

SEQ ID NO: 92360 - protein, 14 aa, Mycobacterium tuberculosis
HGWPADVPSAEQRR

SEQ ID NO: 92361 - protein, 14 aa, Mycobacterium tuberculosis
GWPADVPSAEQRRA

SEQ ID NO: 92362 - protein, 14 aa, Mycobacterium tuberculosis
WPADVPSAEQRRAQ

SEQ ID NO: 92363 - protein, 14 aa, Mycobacterium tuberculosis
PADVPSAEQRRAQR

SEQ ID NO: 92364 - protein, 14 aa, Mycobacterium tuberculosis
ADVPSAEQRRAQRQ

SEQ ID NO: 92365 - protein, 14 aa, Mycobacterium tuberculosis
DVPSAEQRRAQRQR

SEQ ID NO: 92366 - protein, 14 aa, Mycobacterium tuberculosis
VPSAEQRRAQRQRD

SEQ ID NO: 92367 - protein, 14 aa, Mycobacterium tuberculosis
PSAEQRRAQRQRDL

SEQ ID NO: 92368 - protein, 14 aa, Mycobacterium tuberculosis
SAEQRRAQRQRDLE

SEQ ID NO: 92369 - protein, 14 aa, Mycobacterium tuberculosis
AEQRRAQRQRDLEA

SEQ ID NO: 92370 - protein, 14 aa, Mycobacterium tuberculosis
EQRRAQRQRDLEAI

SEQ ID NO: 92371 - protein, 14 aa, Mycobacterium tuberculosis
QRRAQRQRDLEAIR

SEQ ID NO: 92372 - protein, 14 aa, Mycobacterium tuberculosis
RRAQRQRDLEAIRR

SEQ ID NO: 92373 - protein, 14 aa, Mycobacterium tuberculosis
RAQRQRDLEAIRRA

SEQ ID NO: 92374 - protein, 14 aa, Mycobacterium tuberculosis
AQRQRDLEAIRRAY

SEQ ID NO: 92375 - protein, 14 aa, Mycobacterium tuberculosis
QRQRDLEAIRRAYA

SEQ ID NO: 92376 - protein, 14 aa, Mycobacterium tuberculosis
RQRDLEAIRRAYAE

SEQ ID NO: 92377 - protein, 14 aa, Mycobacterium tuberculosis
QRDLEAIRRAYAEM

SEQ ID NO: 92378 - protein, 14 aa, Mycobacterium tuberculosis
RDLEAIRRAYAEMV

SEQ ID NO: 92379 - protein, 14 aa, Mycobacterium tuberculosis
DLEAIRRAYAEMVA

SEQ ID NO: 92380 - protein, 14 aa, Mycobacterium tuberculosis
LEAIRRAYAEMVAT

SEQ ID NO: 92381 - protein, 14 aa, Mycobacterium tuberculosis
EAIRRAYAEMVATS

SEQ ID NO: 92382 - protein, 14 aa, Mycobacterium tuberculosis
AIRRAYAEMVATSH

SEQ ID NO: 92383 - protein, 14 aa, Mycobacterium tuberculosis
IRRAYAEMVATSHE

SEQ ID NO: 92384 - protein, 14 aa, Mycobacterium tuberculosis
RRAYAEMVATSHEI

SEQ ID NO: 92385 - protein, 14 aa, Mycobacterium tuberculosis
RAYAEMVATSHEID

SEQ ID NO: 92386 - protein, 14 aa, Mycobacterium tuberculosis
AYAEMVATSHEIDD

SEQ ID NO: 92387 - protein, 14 aa, Mycobacterium tuberculosis
YAEMVATSHEIDDD

SEQ ID NO: 92388 - protein, 14 aa, Mycobacterium tuberculosis
AEMVATSHEIDDDT

SEQ ID NO: 92389 - protein, 14 aa, Mycobacterium tuberculosis
EMVATSHEIDDDTA

SEQ ID NO: 92390 - protein, 14 aa, Mycobacterium tuberculosis
MVATSHEIDDDTAE

SEQ ID NO: 92391 - protein, 14 aa, Mycobacterium tuberculosis
VATSHEIDDDTAEL

SEQ ID NO: 92392 - protein, 14 aa, Mycobacterium tuberculosis
ATSHEIDDDTAELA

SEQ ID NO: 92393 - protein, 14 aa, Mycobacterium tuberculosis
TSHEIDDDTAELAL

SEQ ID NO: 92394 - protein, 14 aa, Mycobacterium tuberculosis
SHEIDDDTAELALL

SEQ ID NO: 92395 - protein, 14 aa, Mycobacterium tuberculosis
HEIDDDTAELALLS

SEQ ID NO: 92396 - protein, 14 aa, Mycobacterium tuberculosis
EIDDDTAELALLSM

SEQ ID NO: 92397 - protein, 14 aa, Mycobacterium tuberculosis
IDDDTAELALLSMH

SEQ ID NO: 92398 - protein, 14 aa, Mycobacterium tuberculosis
DDDTAELALLSMHL

SEQ ID NO: 92399 - protein, 14 aa, Mycobacterium tuberculosis
DDTAELALLSMHLD

SEQ ID NO: 92400 - protein, 14 aa, Mycobacterium tuberculosis
DTAELALLSMHLDD

SEQ ID NO: 92401 - protein, 14 aa, Mycobacterium tuberculosis
TAELALLSMHLDDE

SEQ ID NO: 92402 - protein, 14 aa, Mycobacterium tuberculosis
AELALLSMHLDDEQ

SEQ ID NO: 92403 - protein, 14 aa, Mycobacterium tuberculosis
ELALLSMHLDDEQR

SEQ ID NO: 92404 - protein, 14 aa, Mycobacterium tuberculosis
LALLSMHLDDEQRR

SEQ ID NO: 92405 - protein, 14 aa, Mycobacterium tuberculosis
ALLSMHLDDEQRRL

SEQ ID NO: 92406 - protein, 14 aa, Mycobacterium tuberculosis
LLSMHLDDEQRRLE

SEQ ID NO: 92407 - protein, 14 aa, Mycobacterium tuberculosis
LSMHLDDEQRRLEA

SEQ ID NO: 92408 - protein, 14 aa, Mycobacterium tuberculosis
SMHLDDEQRRLEAG

SEQ ID NO: 92409 - protein, 14 aa, Mycobacterium tuberculosis
MHLDDEQRRLEAGM

SEQ ID NO: 92410 - protein, 14 aa, Mycobacterium tuberculosis
HLDDEQRRLEAGMK

SEQ ID NO: 92411 - protein, 14 aa, Mycobacterium tuberculosis
LDDEQRRLEAGMKL

SEQ ID NO: 92412 - protein, 14 aa, Mycobacterium tuberculosis
DDEQRRLEAGMKLG

SEQ ID NO: 92413 - protein, 14 aa, Mycobacterium tuberculosis
DEQRRLEAGMKLGW

SEQ ID NO: 92414 - protein, 14 aa, Mycobacterium tuberculosis
EQRRLEAGMKLGWH

SEQ ID NO: 92415 - protein, 14 aa, Mycobacterium tuberculosis
QRRLEAGMKLGWHP

SEQ ID NO: 92416 - protein, 14 aa, Mycobacterium tuberculosis
RRLEAGMKLGWHPY

SEQ ID NO: 92417 - protein, 14 aa, Mycobacterium tuberculosis
RLEAGMKLGWHPYH

SEQ ID NO: 92418 - protein, 14 aa, Mycobacterium tuberculosis
LEAGMKLGWHPYHF

SEQ ID NO: 92419 - protein, 14 aa, Mycobacterium tuberculosis
EAGMKLGWHPYHFP

SEQ ID NO: 92420 - protein, 14 aa, Mycobacterium tuberculosis
AGMKLGWHPYHFPD

SEQ ID NO: 92421 - protein, 14 aa, Mycobacterium tuberculosis
GMKLGWHPYHFPDE

SEQ ID NO: 92422 - protein, 14 aa, Mycobacterium tuberculosis
MKLGWHPYHFPDEP

SEQ ID NO: 92423 - protein, 14 aa, Mycobacterium tuberculosis
KLGWHPYHFPDEPD

SEQ ID NO: 92424 - protein, 14 aa, Mycobacterium tuberculosis
LGWHPYHFPDEPDS

SEQ ID NO: 92425 - protein, 14 aa, Mycobacterium tuberculosis
GWHPYHFPDEPDSK

SEQ ID NO: 92426 - protein, 14 aa, Mycobacterium tuberculosis
WHPYHFPDEPDSKQ

SEQ ID NO: 92427 - protein, 15 aa, Mycobacterium tuberculosis
MTHKRTKRQPAIAAG

SEQ ID NO: 92428 - protein, 15 aa, Mycobacterium tuberculosis
THKRTKRQPAIAAGL

SEQ ID NO: 92429 - protein, 15 aa, Mycobacterium tuberculosis
HKRTKRQPAIAAGLN

SEQ ID NO: 92430 - protein, 15 aa, Mycobacterium tuberculosis
KRTKRQPAIAAGLNA

SEQ ID NO: 92431 - protein, 15 aa, Mycobacterium tuberculosis
RTKRQPAIAAGLNAP

SEQ ID NO: 92432 - protein, 15 aa, Mycobacterium tuberculosis
TKRQPAIAAGLNAPR

SEQ ID NO: 92433 - protein, 15 aa, Mycobacterium tuberculosis
KRQPAIAAGLNAPRR

SEQ ID NO: 92434 - protein, 15 aa, Mycobacterium tuberculosis
RQPAIAAGLNAPRRN

SEQ ID NO: 92435 - protein, 15 aa, Mycobacterium tuberculosis
QPAIAAGLNAPRRNR

SEQ ID NO: 92436 - protein, 15 aa, Mycobacterium tuberculosis
PAIAAGLNAPRRNRV

SEQ ID NO: 92437 - protein, 15 aa, Mycobacterium tuberculosis
AIAAGLNAPRRNRVG

SEQ ID NO: 92438 - protein, 15 aa, Mycobacterium tuberculosis
IAAGLNAPRRNRVGR

SEQ ID NO: 92439 - protein, 15 aa, Mycobacterium tuberculosis
AAGLNAPRRNRVGRQ

SEQ ID NO: 92440 - protein, 15 aa, Mycobacterium tuberculosis
AGLNAPRRNRVGRQH

SEQ ID NO: 92441 - protein, 15 aa, Mycobacterium tuberculosis
GLNAPRRNRVGRQHG

SEQ ID NO: 92442 - protein, 15 aa, Mycobacterium tuberculosis
LNAPRRNRVGRQHGW

SEQ ID NO: 92443 - protein, 15 aa, Mycobacterium tuberculosis
NAPRRNRVGRQHGWP

SEQ ID NO: 92444 - protein, 15 aa, Mycobacterium tuberculosis
APRRNRVGRQHGWPA

SEQ ID NO: 92445 - protein, 15 aa, Mycobacterium tuberculosis
PRRNRVGRQHGWPAD

SEQ ID NO: 92446 - protein, 15 aa, Mycobacterium tuberculosis
RRNRVGRQHGWPADV

SEQ ID NO: 92447 - protein, 15 aa, Mycobacterium tuberculosis
RNRVGRQHGWPADVP

SEQ ID NO: 92448 - protein, 15 aa, Mycobacterium tuberculosis
NRVGRQHGWPADVPS

SEQ ID NO: 92449 - protein, 15 aa, Mycobacterium tuberculosis
RVGRQHGWPADVPSA

SEQ ID NO: 92450 - protein, 15 aa, Mycobacterium tuberculosis
VGRQHGWPADVPSAE

SEQ ID NO: 92451 - protein, 15 aa, Mycobacterium tuberculosis
GRQHGWPADVPSAEQ

SEQ ID NO: 92452 - protein, 15 aa, Mycobacterium tuberculosis
RQHGWPADVPSAEQR

SEQ ID NO: 92453 - protein, 15 aa, Mycobacterium tuberculosis
QHGWPADVPSAEQRR

SEQ ID NO: 92454 - protein, 15 aa, Mycobacterium tuberculosis
HGWPADVPSAEQRRA

SEQ ID NO: 92455 - protein, 15 aa, Mycobacterium tuberculosis
GWPADVPSAEQRRAQ

SEQ ID NO: 92456 - protein, 15 aa, Mycobacterium tuberculosis
WPADVPSAEQRRAQR

SEQ ID NO: 92457 - protein, 15 aa, Mycobacterium tuberculosis
PADVPSAEQRRAQRQ

SEQ ID NO: 92458 - protein, 15 aa, Mycobacterium tuberculosis
ADVPSAEQRRAQRQR

SEQ ID NO: 92459 - protein, 15 aa, Mycobacterium tuberculosis
DVPSAEQRRAQRQRD

SEQ ID NO: 92460 - protein, 15 aa, Mycobacterium tuberculosis
VPSAEQRRAQRQRDL

SEQ ID NO: 92461 - protein, 15 aa, Mycobacterium tuberculosis
PSAEQRRAQRQRDLE

SEQ ID NO: 92462 - protein, 15 aa, Mycobacterium tuberculosis
SAEQRRAQRQRDLEA

SEQ ID NO: 92463 - protein, 15 aa, Mycobacterium tuberculosis
AEQRRAQRQRDLEAI

SEQ ID NO: 92464 - protein, 15 aa, Mycobacterium tuberculosis
EQRRAQRQRDLEAIR

SEQ ID NO: 92465 - protein, 15 aa, Mycobacterium tuberculosis
QRRAQRQRDLEAIRR

SEQ ID NO: 92466 - protein, 15 aa, Mycobacterium tuberculosis
RRAQRQRDLEAIRRA

SEQ ID NO: 92467 - protein, 15 aa, Mycobacterium tuberculosis
RAQRQRDLEAIRRAY

SEQ ID NO: 92468 - protein, 15 aa, Mycobacterium tuberculosis
AQRQRDLEAIRRAYA

SEQ ID NO: 92469 - protein, 15 aa, Mycobacterium tuberculosis
QRQRDLEAIRRAYAE

SEQ ID NO: 92470 - protein, 15 aa, Mycobacterium tuberculosis
RQRDLEAIRRAYAEM

SEQ ID NO: 92471 - protein, 15 aa, Mycobacterium tuberculosis
QRDLEAIRRAYAEMV

SEQ ID NO: 92472 - protein, 15 aa, Mycobacterium tuberculosis
RDLEAIRRAYAEMVA

SEQ ID NO: 92473 - protein, 15 aa, Mycobacterium tuberculosis
DLEAIRRAYAEMVAT

SEQ ID NO: 92474 - protein, 15 aa, Mycobacterium tuberculosis
LEAIRRAYAEMVATS

SEQ ID NO: 92475 - protein, 15 aa, Mycobacterium tuberculosis
EAIRRAYAEMVATSH

SEQ ID NO: 92476 - protein, 15 aa, Mycobacterium tuberculosis
AIRRAYAEMVATSHE

SEQ ID NO: 92477 - protein, 15 aa, Mycobacterium tuberculosis
IRRAYAEMVATSHEI

SEQ ID NO: 92478 - protein, 15 aa, Mycobacterium tuberculosis
RRAYAEMVATSHEID

SEQ ID NO: 92479 - protein, 15 aa, Mycobacterium tuberculosis
RAYAEMVATSHEIDD

SEQ ID NO: 92480 - protein, 15 aa, Mycobacterium tuberculosis
AYAEMVATSHEIDDD

SEQ ID NO: 92481 - protein, 15 aa, Mycobacterium tuberculosis
YAEMVATSHEIDDDT

SEQ ID NO: 92482 - protein, 15 aa, Mycobacterium tuberculosis
AEMVATSHEIDDDTA

SEQ ID NO: 92483 - protein, 15 aa, Mycobacterium tuberculosis
EMVATSHEIDDDTAE

SEQ ID NO: 92484 - protein, 15 aa, Mycobacterium tuberculosis
MVATSHEIDDDTAEL

SEQ ID NO: 92485 - protein, 15 aa, Mycobacterium tuberculosis
VATSHEIDDDTAELA

SEQ ID NO: 92486 - protein, 15 aa, Mycobacterium tuberculosis
ATSHEIDDDTAELAL

SEQ ID NO: 92487 - protein, 15 aa, Mycobacterium tuberculosis
TSHEIDDDTAELALL

SEQ ID NO: 92488 - protein, 15 aa, Mycobacterium tuberculosis
SHEIDDDTAELALLS

SEQ ID NO: 92489 - protein, 15 aa, Mycobacterium tuberculosis
HEIDDDTAELALLSM

SEQ ID NO: 92490 - protein, 15 aa, Mycobacterium tuberculosis
EIDDDTAELALLSMH

SEQ ID NO: 92491 - protein, 15 aa, Mycobacterium tuberculosis
IDDDTAELALLSMHL

SEQ ID NO: 92492 - protein, 15 aa, Mycobacterium tuberculosis
DDDTAELALLSMHLD

SEQ ID NO: 92493 - protein, 15 aa, Mycobacterium tuberculosis
DDTAELALLSMHLDD

SEQ ID NO: 92494 - protein, 15 aa, Mycobacterium tuberculosis
DTAELALLSMHLDDE

SEQ ID NO: 92495 - protein, 15 aa, Mycobacterium tuberculosis
TAELALLSMHLDDEQ

SEQ ID NO: 92496 - protein, 15 aa, Mycobacterium tuberculosis
AELALLSMHLDDEQR

SEQ ID NO: 92497 - protein, 15 aa, Mycobacterium tuberculosis
ELALLSMHLDDEQRR

SEQ ID NO: 92498 - protein, 15 aa, Mycobacterium tuberculosis
LALLSMHLDDEQRRL

SEQ ID NO: 92499 - protein, 15 aa, Mycobacterium tuberculosis
ALLSMHLDDEQRRLE

SEQ ID NO: 92500 - protein, 15 aa, Mycobacterium tuberculosis
LLSMHLDDEQRRLEA

SEQ ID NO: 92501 - protein, 15 aa, Mycobacterium tuberculosis
LSMHLDDEQRRLEAG

SEQ ID NO: 92502 - protein, 15 aa, Mycobacterium tuberculosis
SMHLDDEQRRLEAGM

SEQ ID NO: 92503 - protein, 15 aa, Mycobacterium tuberculosis
MHLDDEQRRLEAGMK

SEQ ID NO: 92504 - protein, 15 aa, Mycobacterium tuberculosis
HLDDEQRRLEAGMKL

SEQ ID NO: 92505 - protein, 15 aa, Mycobacterium tuberculosis
LDDEQRRLEAGMKLG

SEQ ID NO: 92506 - protein, 15 aa, Mycobacterium tuberculosis
DDEQRRLEAGMKLGW

SEQ ID NO: 92507 - protein, 15 aa, Mycobacterium tuberculosis
DEQRRLEAGMKLGWH

SEQ ID NO: 92508 - protein, 15 aa, Mycobacterium tuberculosis
EQRRLEAGMKLGWHP

SEQ ID NO: 92509 - protein, 15 aa, Mycobacterium tuberculosis
QRRLEAGMKLGWHPY

SEQ ID NO: 92510 - protein, 15 aa, Mycobacterium tuberculosis
RRLEAGMKLGWHPYH

SEQ ID NO: 92511 - protein, 15 aa, Mycobacterium tuberculosis
RLEAGMKLGWHPYHF

SEQ ID NO: 92512 - protein, 15 aa, Mycobacterium tuberculosis
LEAGMKLGWHPYHFP

SEQ ID NO: 92513 - protein, 15 aa, Mycobacterium tuberculosis
EAGMKLGWHPYHFPD

SEQ ID NO: 92514 - protein, 15 aa, Mycobacterium tuberculosis
AGMKLGWHPYHFPDE

SEQ ID NO: 92515 - protein, 15 aa, Mycobacterium tuberculosis
GMKLGWHPYHFPDEP

SEQ ID NO: 92516 - protein, 15 aa, Mycobacterium tuberculosis
MKLGWHPYHFPDEPD

SEQ ID NO: 92517 - protein, 15 aa, Mycobacterium tuberculosis
KLGWHPYHFPDEPDS

SEQ ID NO: 92518 - protein, 15 aa, Mycobacterium tuberculosis
LGWHPYHFPDEPDSK

SEQ ID NO: 92519 - protein, 15 aa, Mycobacterium tuberculosis
GWHPYHFPDEPDSKQ

SEQ ID NO: 92520 - protein, 16 aa, Mycobacterium tuberculosis
MTHKRTKRQPAIAAGL

SEQ ID NO: 92521 - protein, 16 aa, Mycobacterium tuberculosis
THKRTKRQPAIAAGLN

SEQ ID NO: 92522 - protein, 16 aa, Mycobacterium tuberculosis
HKRTKRQPAIAAGLNA

SEQ ID NO: 92523 - protein, 16 aa, Mycobacterium tuberculosis
KRTKRQPAIAAGLNAP

SEQ ID NO: 92524 - protein, 16 aa, Mycobacterium tuberculosis
RTKRQPAIAAGLNAPR

SEQ ID NO: 92525 - protein, 16 aa, Mycobacterium tuberculosis
TKRQPAIAAGLNAPRR

SEQ ID NO: 92526 - protein, 16 aa, Mycobacterium tuberculosis
KRQPAIAAGLNAPRRN

SEQ ID NO: 92527 - protein, 16 aa, Mycobacterium tuberculosis
RQPAIAAGLNAPRRNR

SEQ ID NO: 92528 - protein, 16 aa, Mycobacterium tuberculosis
QPAIAAGLNAPRRNRV

SEQ ID NO: 92529 - protein, 16 aa, Mycobacterium tuberculosis
PAIAAGLNAPRRNRVG

SEQ ID NO: 92530 - protein, 16 aa, Mycobacterium tuberculosis
AIAAGLNAPRRNRVGR

SEQ ID NO: 92531 - protein, 16 aa, Mycobacterium tuberculosis
IAAGLNAPRRNRVGRQ

SEQ ID NO: 92532 - protein, 16 aa, Mycobacterium tuberculosis
AAGLNAPRRNRVGRQH

SEQ ID NO: 92533 - protein, 16 aa, Mycobacterium tuberculosis
AGLNAPRRNRVGRQHG

SEQ ID NO: 92534 - protein, 16 aa, Mycobacterium tuberculosis
GLNAPRRNRVGRQHGW

SEQ ID NO: 92535 - protein, 16 aa, Mycobacterium tuberculosis
LNAPRRNRVGRQHGWP

SEQ ID NO: 92536 - protein, 16 aa, Mycobacterium tuberculosis
NAPRRNRVGRQHGWPA

SEQ ID NO: 92537 - protein, 16 aa, Mycobacterium tuberculosis
APRRNRVGRQHGWPAD

SEQ ID NO: 92538 - protein, 16 aa, Mycobacterium tuberculosis
PRRNRVGRQHGWPADV

SEQ ID NO: 92539 - protein, 16 aa, Mycobacterium tuberculosis
RRNRVGRQHGWPADVP

SEQ ID NO: 92540 - protein, 16 aa, Mycobacterium tuberculosis
RNRVGRQHGWPADVPS

SEQ ID NO: 92541 - protein, 16 aa, Mycobacterium tuberculosis
NRVGRQHGWPADVPSA

SEQ ID NO: 92542 - protein, 16 aa, Mycobacterium tuberculosis
RVGRQHGWPADVPSAE

SEQ ID NO: 92543 - protein, 16 aa, Mycobacterium tuberculosis
VGRQHGWPADVPSAEQ

SEQ ID NO: 92544 - protein, 16 aa, Mycobacterium tuberculosis
GRQHGWPADVPSAEQR

SEQ ID NO: 92545 - protein, 16 aa, Mycobacterium tuberculosis
RQHGWPADVPSAEQRR

SEQ ID NO: 92546 - protein, 16 aa, Mycobacterium tuberculosis
QHGWPADVPSAEQRRA

SEQ ID NO: 92547 - protein, 16 aa, Mycobacterium tuberculosis
HGWPADVPSAEQRRAQ

SEQ ID NO: 92548 - protein, 16 aa, Mycobacterium tuberculosis
GWPADVPSAEQRRAQR

SEQ ID NO: 92549 - protein, 16 aa, Mycobacterium tuberculosis
WPADVPSAEQRRAQRQ

SEQ ID NO: 92550 - protein, 16 aa, Mycobacterium tuberculosis
PADVPSAEQRRAQRQR

SEQ ID NO: 92551 - protein, 16 aa, Mycobacterium tuberculosis
ADVPSAEQRRAQRQRD

SEQ ID NO: 92552 - protein, 16 aa, Mycobacterium tuberculosis
DVPSAEQRRAQRQRDL

SEQ ID NO: 92553 - protein, 16 aa, Mycobacterium tuberculosis
VPSAEQRRAQRQRDLE

SEQ ID NO: 92554 - protein, 16 aa, Mycobacterium tuberculosis
PSAEQRRAQRQRDLEA

SEQ ID NO: 92555 - protein, 16 aa, Mycobacterium tuberculosis
SAEQRRAQRQRDLEAI

SEQ ID NO: 92556 - protein, 16 aa, Mycobacterium tuberculosis
AEQRRAQRQRDLEAIR

SEQ ID NO: 92557 - protein, 16 aa, Mycobacterium tuberculosis
EQRRAQRQRDLEAIRR

SEQ ID NO: 92558 - protein, 16 aa, Mycobacterium tuberculosis
QRRAQRQRDLEAIRRA

SEQ ID NO: 92559 - protein, 16 aa, Mycobacterium tuberculosis
RRAQRQRDLEAIRRAY

SEQ ID NO: 92560 - protein, 16 aa, Mycobacterium tuberculosis
RAQRQRDLEAIRRAYA

SEQ ID NO: 92561 - protein, 16 aa, Mycobacterium tuberculosis
AQRQRDLEAIRRAYAE

SEQ ID NO: 92562 - protein, 16 aa, Mycobacterium tuberculosis
QRQRDLEAIRRAYAEM

SEQ ID NO: 92563 - protein, 16 aa, Mycobacterium tuberculosis
RQRDLEAIRRAYAEMV

SEQ ID NO: 92564 - protein, 16 aa, Mycobacterium tuberculosis
QRDLEAIRRAYAEMVA

SEQ ID NO: 92565 - protein, 16 aa, Mycobacterium tuberculosis
RDLEAIRRAYAEMVAT

SEQ ID NO: 92566 - protein, 16 aa, Mycobacterium tuberculosis
DLEAIRRAYAEMVATS

SEQ ID NO: 92567 - protein, 16 aa, Mycobacterium tuberculosis
LEAIRRAYAEMVATSH

SEQ ID NO: 92568 - protein, 16 aa, Mycobacterium tuberculosis
EAIRRAYAEMVATSHE

SEQ ID NO: 92569 - protein, 16 aa, Mycobacterium tuberculosis
AIRRAYAEMVATSHEI

SEQ ID NO: 92570 - protein, 16 aa, Mycobacterium tuberculosis
IRRAYAEMVATSHEID

SEQ ID NO: 92571 - protein, 16 aa, Mycobacterium tuberculosis
RRAYAEMVATSHEIDD

SEQ ID NO: 92572 - protein, 16 aa, Mycobacterium tuberculosis
RAYAEMVATSHEIDDD

SEQ ID NO: 92573 - protein, 16 aa, Mycobacterium tuberculosis
AYAEMVATSHEIDDDT

SEQ ID NO: 92574 - protein, 16 aa, Mycobacterium tuberculosis
YAEMVATSHEIDDDTA

SEQ ID NO: 92575 - protein, 16 aa, Mycobacterium tuberculosis
AEMVATSHEIDDDTAE

SEQ ID NO: 92576 - protein, 16 aa, Mycobacterium tuberculosis
EMVATSHEIDDDTAEL

SEQ ID NO: 92577 - protein, 16 aa, Mycobacterium tuberculosis
MVATSHEIDDDTAELA

SEQ ID NO: 92578 - protein, 16 aa, Mycobacterium tuberculosis
VATSHEIDDDTAELAL

SEQ ID NO: 92579 - protein, 16 aa, Mycobacterium tuberculosis
ATSHEIDDDTAELALL

SEQ ID NO: 92580 - protein, 16 aa, Mycobacterium tuberculosis
TSHEIDDDTAELALLS

SEQ ID NO: 92581 - protein, 16 aa, Mycobacterium tuberculosis
SHEIDDDTAELALLSM

SEQ ID NO: 92582 - protein, 16 aa, Mycobacterium tuberculosis
HEIDDDTAELALLSMH

SEQ ID NO: 92583 - protein, 16 aa, Mycobacterium tuberculosis
EIDDDTAELALLSMHL

SEQ ID NO: 92584 - protein, 16 aa, Mycobacterium tuberculosis
IDDDTAELALLSMHLD

SEQ ID NO: 92585 - protein, 16 aa, Mycobacterium tuberculosis
DDDTAELALLSMHLDD

SEQ ID NO: 92586 - protein, 16 aa, Mycobacterium tuberculosis
DDTAELALLSMHLDDE

SEQ ID NO: 92587 - protein, 16 aa, Mycobacterium tuberculosis
DTAELALLSMHLDDEQ

SEQ ID NO: 92588 - protein, 16 aa, Mycobacterium tuberculosis
TAELALLSMHLDDEQR

SEQ ID NO: 92589 - protein, 16 aa, Mycobacterium tuberculosis
AELALLSMHLDDEQRR

SEQ ID NO: 92590 - protein, 16 aa, Mycobacterium tuberculosis
ELALLSMHLDDEQRRL

SEQ ID NO: 92591 - protein, 16 aa, Mycobacterium tuberculosis
LALLSMHLDDEQRRLE

SEQ ID NO: 92592 - protein, 16 aa, Mycobacterium tuberculosis
ALLSMHLDDEQRRLEA

SEQ ID NO: 92593 - protein, 16 aa, Mycobacterium tuberculosis
LLSMHLDDEQRRLEAG

SEQ ID NO: 92594 - protein, 16 aa, Mycobacterium tuberculosis
LSMHLDDEQRRLEAGM

SEQ ID NO: 92595 - protein, 16 aa, Mycobacterium tuberculosis
SMHLDDEQRRLEAGMK

SEQ ID NO: 92596 - protein, 16 aa, Mycobacterium tuberculosis
MHLDDEQRRLEAGMKL

SEQ ID NO: 92597 - protein, 16 aa, Mycobacterium tuberculosis
HLDDEQRRLEAGMKLG

SEQ ID NO: 92598 - protein, 16 aa, Mycobacterium tuberculosis
LDDEQRRLEAGMKLGW

SEQ ID NO: 92599 - protein, 16 aa, Mycobacterium tuberculosis
DDEQRRLEAGMKLGWH

SEQ ID NO: 92600 - protein, 16 aa, Mycobacterium tuberculosis
DEQRRLEAGMKLGWHP

SEQ ID NO: 92601 - protein, 16 aa, Mycobacterium tuberculosis
EQRRLEAGMKLGWHPY

SEQ ID NO: 92602 - protein, 16 aa, Mycobacterium tuberculosis
QRRLEAGMKLGWHPYH

SEQ ID NO: 92603 - protein, 16 aa, Mycobacterium tuberculosis
RRLEAGMKLGWHPYHF

SEQ ID NO: 92604 - protein, 16 aa, Mycobacterium tuberculosis
RLEAGMKLGWHPYHFP

SEQ ID NO: 92605 - protein, 16 aa, Mycobacterium tuberculosis
LEAGMKLGWHPYHFPD

SEQ ID NO: 92606 - protein, 16 aa, Mycobacterium tuberculosis
EAGMKLGWHPYHFPDE

SEQ ID NO: 92607 - protein, 16 aa, Mycobacterium tuberculosis
AGMKLGWHPYHFPDEP

SEQ ID NO: 92608 - protein, 16 aa, Mycobacterium tuberculosis
GMKLGWHPYHFPDEPD

SEQ ID NO: 92609 - protein, 16 aa, Mycobacterium tuberculosis
MKLGWHPYHFPDEPDS

SEQ ID NO: 92610 - protein, 16 aa, Mycobacterium tuberculosis
KLGWHPYHFPDEPDSK

SEQ ID NO: 92611 - protein, 16 aa, Mycobacterium tuberculosis
LGWHPYHFPDEPDSKQ

SEQ ID NO: 92612 - protein, 13 aa, Mycobacterium tuberculosis
MSGHALAARTLLA

SEQ ID NO: 92613 - protein, 13 aa, Mycobacterium tuberculosis
SGHALAARTLLAA

SEQ ID NO: 92614 - protein, 13 aa, Mycobacterium tuberculosis
GHALAARTLLAAA

SEQ ID NO: 92615 - protein, 13 aa, Mycobacterium tuberculosis
HALAARTLLAAAD

SEQ ID NO: 92616 - protein, 13 aa, Mycobacterium tuberculosis
ALAARTLLAAADE

SEQ ID NO: 92617 - protein, 13 aa, Mycobacterium tuberculosis
LAARTLLAAADEL

SEQ ID NO: 92618 - protein, 13 aa, Mycobacterium tuberculosis
AARTLLAAADELV

SEQ ID NO: 92619 - protein, 13 aa, Mycobacterium tuberculosis
ARTLLAAADELVG

SEQ ID NO: 92620 - protein, 13 aa, Mycobacterium tuberculosis
RTLLAAADELVGG

SEQ ID NO: 92621 - protein, 13 aa, Mycobacterium tuberculosis
TLLAAADELVGGP

SEQ ID NO: 92622 - protein, 13 aa, Mycobacterium tuberculosis
LLAAADELVGGPP

SEQ ID NO: 92623 - protein, 13 aa, Mycobacterium tuberculosis
LAAADELVGGPPV

SEQ ID NO: 92624 - protein, 13 aa, Mycobacterium tuberculosis
AAADELVGGPPVE

SEQ ID NO: 92625 - protein, 13 aa, Mycobacterium tuberculosis
AADELVGGPPVEA

SEQ ID NO: 92626 - protein, 13 aa, Mycobacterium tuberculosis
ADELVGGPPVEAS

SEQ ID NO: 92627 - protein, 13 aa, Mycobacterium tuberculosis
DELVGGPPVEASA

SEQ ID NO: 92628 - protein, 13 aa, Mycobacterium tuberculosis
ELVGGPPVEASAA

SEQ ID NO: 92629 - protein, 13 aa, Mycobacterium tuberculosis
LVGGPPVEASAAA

SEQ ID NO: 92630 - protein, 13 aa, Mycobacterium tuberculosis
VGGPPVEASAAAL

SEQ ID NO: 92631 - protein, 13 aa, Mycobacterium tuberculosis
GGPPVEASAAALA

SEQ ID NO: 92632 - protein, 13 aa, Mycobacterium tuberculosis
GPPVEASAAALAG

SEQ ID NO: 92633 - protein, 13 aa, Mycobacterium tuberculosis
PPVEASAAALAGD

SEQ ID NO: 92634 - protein, 13 aa, Mycobacterium tuberculosis
PVEASAAALAGDA

SEQ ID NO: 92635 - protein, 13 aa, Mycobacterium tuberculosis
VEASAAALAGDAA

SEQ ID NO: 92636 - protein, 13 aa, Mycobacterium tuberculosis
EASAAALAGDAAG

SEQ ID NO: 92637 - protein, 13 aa, Mycobacterium tuberculosis
ASAAALAGDAAGA

SEQ ID NO: 92638 - protein, 13 aa, Mycobacterium tuberculosis
SAAALAGDAAGAW

SEQ ID NO: 92639 - protein, 13 aa, Mycobacterium tuberculosis
AAALAGDAAGAWR

SEQ ID NO: 92640 - protein, 13 aa, Mycobacterium tuberculosis
AALAGDAAGAWRT

SEQ ID NO: 92641 - protein, 13 aa, Mycobacterium tuberculosis
ALAGDAAGAWRTA

SEQ ID NO: 92642 - protein, 13 aa, Mycobacterium tuberculosis
LAGDAAGAWRTAA

SEQ ID NO: 92643 - protein, 13 aa, Mycobacterium tuberculosis
AGDAAGAWRTAAV

SEQ ID NO: 92644 - protein, 13 aa, Mycobacterium tuberculosis
GDAAGAWRTAAVE

SEQ ID NO: 92645 - protein, 13 aa, Mycobacterium tuberculosis
DAAGAWRTAAVEL

SEQ ID NO: 92646 - protein, 13 aa, Mycobacterium tuberculosis
AAGAWRTAAVELA

SEQ ID NO: 92647 - protein, 13 aa, Mycobacterium tuberculosis
AGAWRTAAVELAR

SEQ ID NO: 92648 - protein, 13 aa, Mycobacterium tuberculosis
GAWRTAAVELARA

SEQ ID NO: 92649 - protein, 13 aa, Mycobacterium tuberculosis
AWRTAAVELARAL

SEQ ID NO: 92650 - protein, 13 aa, Mycobacterium tuberculosis
WRTAAVELARALV

SEQ ID NO: 92651 - protein, 13 aa, Mycobacterium tuberculosis
RTAAVELARALVR

SEQ ID NO: 92652 - protein, 13 aa, Mycobacterium tuberculosis
TAAVELARALVRA

SEQ ID NO: 92653 - protein, 13 aa, Mycobacterium tuberculosis
AAVELARALVRAV

SEQ ID NO: 92654 - protein, 13 aa, Mycobacterium tuberculosis
AVELARALVRAVA

SEQ ID NO: 92655 - protein, 13 aa, Mycobacterium tuberculosis
VELARALVRAVAE

SEQ ID NO: 92656 - protein, 13 aa, Mycobacterium tuberculosis
ELARALVRAVAES

SEQ ID NO: 92657 - protein, 13 aa, Mycobacterium tuberculosis
LARALVRAVAESH

SEQ ID NO: 92658 - protein, 13 aa, Mycobacterium tuberculosis
ARALVRAVAESHG

SEQ ID NO: 92659 - protein, 13 aa, Mycobacterium tuberculosis
RALVRAVAESHGV

SEQ ID NO: 92660 - protein, 13 aa, Mycobacterium tuberculosis
ALVRAVAESHGVA

SEQ ID NO: 92661 - protein, 13 aa, Mycobacterium tuberculosis
LVRAVAESHGVAA

SEQ ID NO: 92662 - protein, 13 aa, Mycobacterium tuberculosis
VRAVAESHGVAAV

SEQ ID NO: 92663 - protein, 13 aa, Mycobacterium tuberculosis
RAVAESHGVAAVL

SEQ ID NO: 92664 - protein, 13 aa, Mycobacterium tuberculosis
AVAESHGVAAVLF

SEQ ID NO: 92665 - protein, 13 aa, Mycobacterium tuberculosis
VAESHGVAAVLFA

SEQ ID NO: 92666 - protein, 13 aa, Mycobacterium tuberculosis
AESHGVAAVLFAA

SEQ ID NO: 92667 - protein, 13 aa, Mycobacterium tuberculosis
ESHGVAAVLFAAT

SEQ ID NO: 92668 - protein, 13 aa, Mycobacterium tuberculosis
SHGVAAVLFAATA

SEQ ID NO: 92669 - protein, 13 aa, Mycobacterium tuberculosis
HGVAAVLFAATAA

SEQ ID NO: 92670 - protein, 13 aa, Mycobacterium tuberculosis
GVAAVLFAATAAA

SEQ ID NO: 92671 - protein, 13 aa, Mycobacterium tuberculosis
VAAVLFAATAAAA

SEQ ID NO: 92672 - protein, 13 aa, Mycobacterium tuberculosis
AAVLFAATAAAAA

SEQ ID NO: 92673 - protein, 13 aa, Mycobacterium tuberculosis
AVLFAATAAAAAA

SEQ ID NO: 92674 - protein, 13 aa, Mycobacterium tuberculosis
VLFAATAAAAAAV

SEQ ID NO: 92675 - protein, 13 aa, Mycobacterium tuberculosis
LFAATAAAAAAVD

SEQ ID NO: 92676 - protein, 13 aa, Mycobacterium tuberculosis
FAATAAAAAAVDR

SEQ ID NO: 92677 - protein, 13 aa, Mycobacterium tuberculosis
AATAAAAAAVDRG

SEQ ID NO: 92678 - protein, 13 aa, Mycobacterium tuberculosis
ATAAAAAAVDRGD

SEQ ID NO: 92679 - protein, 13 aa, Mycobacterium tuberculosis
TAAAAAAVDRGDP

SEQ ID NO: 92680 - protein, 13 aa, Mycobacterium tuberculosis
AAAAAAVDRGDPP

SEQ ID NO: 92681 - protein, 14 aa, Mycobacterium tuberculosis
MSGHALAARTLLAA

SEQ ID NO: 92682 - protein, 14 aa, Mycobacterium tuberculosis
SGHALAARTLLAAA

SEQ ID NO: 92683 - protein, 14 aa, Mycobacterium tuberculosis
GHALAARTLLAAAD

SEQ ID NO: 92684 - protein, 14 aa, Mycobacterium tuberculosis
HALAARTLLAAADE

SEQ ID NO: 92685 - protein, 14 aa, Mycobacterium tuberculosis
ALAARTLLAAADEL

SEQ ID NO: 92686 - protein, 14 aa, Mycobacterium tuberculosis
LAARTLLAAADELV

SEQ ID NO: 92687 - protein, 14 aa, Mycobacterium tuberculosis
AARTLLAAADELVG

SEQ ID NO: 92688 - protein, 14 aa, Mycobacterium tuberculosis
ARTLLAAADELVGG

SEQ ID NO: 92689 - protein, 14 aa, Mycobacterium tuberculosis
RTLLAAADELVGGP

SEQ ID NO: 92690 - protein, 14 aa, Mycobacterium tuberculosis
TLLAAADELVGGPP

SEQ ID NO: 92691 - protein, 14 aa, Mycobacterium tuberculosis
LLAAADELVGGPPV

SEQ ID NO: 92692 - protein, 14 aa, Mycobacterium tuberculosis
LAAADELVGGPPVE

SEQ ID NO: 92693 - protein, 14 aa, Mycobacterium tuberculosis
AAADELVGGPPVEA

SEQ ID NO: 92694 - protein, 14 aa, Mycobacterium tuberculosis
AADELVGGPPVEAS

SEQ ID NO: 92695 - protein, 14 aa, Mycobacterium tuberculosis
ADELVGGPPVEASA

SEQ ID NO: 92696 - protein, 14 aa, Mycobacterium tuberculosis
DELVGGPPVEASAA

SEQ ID NO: 92697 - protein, 14 aa, Mycobacterium tuberculosis
ELVGGPPVEASAAA

SEQ ID NO: 92698 - protein, 14 aa, Mycobacterium tuberculosis
LVGGPPVEASAAAL

SEQ ID NO: 92699 - protein, 14 aa, Mycobacterium tuberculosis
VGGPPVEASAAALA

SEQ ID NO: 92700 - protein, 14 aa, Mycobacterium tuberculosis
GGPPVEASAAALAG

SEQ ID NO: 92701 - protein, 14 aa, Mycobacterium tuberculosis
GPPVEASAAALAGD

SEQ ID NO: 92702 - protein, 14 aa, Mycobacterium tuberculosis
PPVEASAAALAGDA

SEQ ID NO: 92703 - protein, 14 aa, Mycobacterium tuberculosis
PVEASAAALAGDAA

SEQ ID NO: 92704 - protein, 14 aa, Mycobacterium tuberculosis
VEASAAALAGDAAG

SEQ ID NO: 92705 - protein, 14 aa, Mycobacterium tuberculosis
EASAAALAGDAAGA

SEQ ID NO: 92706 - protein, 14 aa, Mycobacterium tuberculosis
ASAAALAGDAAGAW

SEQ ID NO: 92707 - protein, 14 aa, Mycobacterium tuberculosis
SAAALAGDAAGAWR

SEQ ID NO: 92708 - protein, 14 aa, Mycobacterium tuberculosis
AAALAGDAAGAWRT

SEQ ID NO: 92709 - protein, 14 aa, Mycobacterium tuberculosis
AALAGDAAGAWRTA

SEQ ID NO: 92710 - protein, 14 aa, Mycobacterium tuberculosis
ALAGDAAGAWRTAA

SEQ ID NO: 92711 - protein, 14 aa, Mycobacterium tuberculosis
LAGDAAGAWRTAAV

SEQ ID NO: 92712 - protein, 14 aa, Mycobacterium tuberculosis
AGDAAGAWRTAAVE

SEQ ID NO: 92713 - protein, 14 aa, Mycobacterium tuberculosis
GDAAGAWRTAAVEL

SEQ ID NO: 92714 - protein, 14 aa, Mycobacterium tuberculosis
DAAGAWRTAAVELA

SEQ ID NO: 92715 - protein, 14 aa, Mycobacterium tuberculosis
AAGAWRTAAVELAR

SEQ ID NO: 92716 - protein, 14 aa, Mycobacterium tuberculosis
AGAWRTAAVELARA

SEQ ID NO: 92717 - protein, 14 aa, Mycobacterium tuberculosis
GAWRTAAVELARAL

SEQ ID NO: 92718 - protein, 14 aa, Mycobacterium tuberculosis
AWRTAAVELARALV

SEQ ID NO: 92719 - protein, 14 aa, Mycobacterium tuberculosis
WRTAAVELARALVR

SEQ ID NO: 92720 - protein, 14 aa, Mycobacterium tuberculosis
RTAAVELARALVRA

SEQ ID NO: 92721 - protein, 14 aa, Mycobacterium tuberculosis
TAAVELARALVRAV

SEQ ID NO: 92722 - protein, 14 aa, Mycobacterium tuberculosis
AAVELARALVRAVA

SEQ ID NO: 92723 - protein, 14 aa, Mycobacterium tuberculosis
AVELARALVRAVAE

SEQ ID NO: 92724 - protein, 14 aa, Mycobacterium tuberculosis
VELARALVRAVAES

SEQ ID NO: 92725 - protein, 14 aa, Mycobacterium tuberculosis
ELARALVRAVAESH

SEQ ID NO: 92726 - protein, 14 aa, Mycobacterium tuberculosis
LARALVRAVAESHG

SEQ ID NO: 92727 - protein, 14 aa, Mycobacterium tuberculosis
ARALVRAVAESHGV

SEQ ID NO: 92728 - protein, 14 aa, Mycobacterium tuberculosis
RALVRAVAESHGVA

SEQ ID NO: 92729 - protein, 14 aa, Mycobacterium tuberculosis
ALVRAVAESHGVAA

SEQ ID NO: 92730 - protein, 14 aa, Mycobacterium tuberculosis
LVRAVAESHGVAAV

SEQ ID NO: 92731 - protein, 14 aa, Mycobacterium tuberculosis
VRAVAESHGVAAVL

SEQ ID NO: 92732 - protein, 14 aa, Mycobacterium tuberculosis
RAVAESHGVAAVLF

SEQ ID NO: 92733 - protein, 14 aa, Mycobacterium tuberculosis
AVAESHGVAAVLFA

SEQ ID NO: 92734 - protein, 14 aa, Mycobacterium tuberculosis
VAESHGVAAVLFAA

SEQ ID NO: 92735 - protein, 14 aa, Mycobacterium tuberculosis
AESHGVAAVLFAAT

SEQ ID NO: 92736 - protein, 14 aa, Mycobacterium tuberculosis
ESHGVAAVLFAATA

SEQ ID NO: 92737 - protein, 14 aa, Mycobacterium tuberculosis
SHGVAAVLFAATAA

SEQ ID NO: 92738 - protein, 14 aa, Mycobacterium tuberculosis
HGVAAVLFAATAAA

SEQ ID NO: 92739 - protein, 14 aa, Mycobacterium tuberculosis
GVAAVLFAATAAAA

SEQ ID NO: 92740 - protein, 14 aa, Mycobacterium tuberculosis
VAAVLFAATAAAAA

SEQ ID NO: 92741 - protein, 14 aa, Mycobacterium tuberculosis
AAVLFAATAAAAAA

SEQ ID NO: 92742 - protein, 14 aa, Mycobacterium tuberculosis
AVLFAATAAAAAAV

SEQ ID NO: 92743 - protein, 14 aa, Mycobacterium tuberculosis
VLFAATAAAAAAVD

SEQ ID NO: 92744 - protein, 14 aa, Mycobacterium tuberculosis
LFAATAAAAAAVDR

SEQ ID NO: 92745 - protein, 14 aa, Mycobacterium tuberculosis
FAATAAAAAAVDRG

SEQ ID NO: 92746 - protein, 14 aa, Mycobacterium tuberculosis
AATAAAAAAVDRGD

SEQ ID NO: 92747 - protein, 14 aa, Mycobacterium tuberculosis
ATAAAAAAVDRGDP

SEQ ID NO: 92748 - protein, 14 aa, Mycobacterium tuberculosis
TAAAAAAVDRGDPP

SEQ ID NO: 92749 - protein, 15 aa, Mycobacterium tuberculosis
MSGHALAARTLLAAA

SEQ ID NO: 92750 - protein, 15 aa, Mycobacterium tuberculosis
SGHALAARTLLAAAD

SEQ ID NO: 92751 - protein, 15 aa, Mycobacterium tuberculosis
GHALAARTLLAAADE

SEQ ID NO: 92752 - protein, 15 aa, Mycobacterium tuberculosis
HALAARTLLAAADEL

SEQ ID NO: 92753 - protein, 15 aa, Mycobacterium tuberculosis
ALAARTLLAAADELV

SEQ ID NO: 92754 - protein, 15 aa, Mycobacterium tuberculosis
LAARTLLAAADELVG

SEQ ID NO: 92755 - protein, 15 aa, Mycobacterium tuberculosis
AARTLLAAADELVGG

SEQ ID NO: 92756 - protein, 15 aa, Mycobacterium tuberculosis
ARTLLAAADELVGGP

SEQ ID NO: 92757 - protein, 15 aa, Mycobacterium tuberculosis
RTLLAAADELVGGPP

SEQ ID NO: 92758 - protein, 15 aa, Mycobacterium tuberculosis
TLLAAADELVGGPPV

SEQ ID NO: 92759 - protein, 15 aa, Mycobacterium tuberculosis
LLAAADELVGGPPVE

SEQ ID NO: 92760 - protein, 15 aa, Mycobacterium tuberculosis
LAAADELVGGPPVEA

SEQ ID NO: 92761 - protein, 15 aa, Mycobacterium tuberculosis
AAADELVGGPPVEAS

SEQ ID NO: 92762 - protein, 15 aa, Mycobacterium tuberculosis
AADELVGGPPVEASA

SEQ ID NO: 92763 - protein, 15 aa, Mycobacterium tuberculosis
ADELVGGPPVEASAA

SEQ ID NO: 92764 - protein, 15 aa, Mycobacterium tuberculosis
DELVGGPPVEASAAA

SEQ ID NO: 92765 - protein, 15 aa, Mycobacterium tuberculosis
ELVGGPPVEASAAAL

SEQ ID NO: 92766 - protein, 15 aa, Mycobacterium tuberculosis
LVGGPPVEASAAALA

SEQ ID NO: 92767 - protein, 15 aa, Mycobacterium tuberculosis
VGGPPVEASAAALAG

SEQ ID NO: 92768 - protein, 15 aa, Mycobacterium tuberculosis
GGPPVEASAAALAGD

SEQ ID NO: 92769 - protein, 15 aa, Mycobacterium tuberculosis
GPPVEASAAALAGDA

SEQ ID NO: 92770 - protein, 15 aa, Mycobacterium tuberculosis
PPVEASAAALAGDAA

SEQ ID NO: 92771 - protein, 15 aa, Mycobacterium tuberculosis
PVEASAAALAGDAAG

SEQ ID NO: 92772 - protein, 15 aa, Mycobacterium tuberculosis
VEASAAALAGDAAGA

SEQ ID NO: 92773 - protein, 15 aa, Mycobacterium tuberculosis
EASAAALAGDAAGAW

SEQ ID NO: 92774 - protein, 15 aa, Mycobacterium tuberculosis
ASAAALAGDAAGAWR

SEQ ID NO: 92775 - protein, 15 aa, Mycobacterium tuberculosis
SAAALAGDAAGAWRT

SEQ ID NO: 92776 - protein, 15 aa, Mycobacterium tuberculosis
AAALAGDAAGAWRTA

SEQ ID NO: 92777 - protein, 15 aa, Mycobacterium tuberculosis
AALAGDAAGAWRTAA

SEQ ID NO: 92778 - protein, 15 aa, Mycobacterium tuberculosis
ALAGDAAGAWRTAAV

SEQ ID NO: 92779 - protein, 15 aa, Mycobacterium tuberculosis
LAGDAAGAWRTAAVE

SEQ ID NO: 92780 - protein, 15 aa, Mycobacterium tuberculosis
AGDAAGAWRTAAVEL

SEQ ID NO: 92781 - protein, 15 aa, Mycobacterium tuberculosis
GDAAGAWRTAAVELA

SEQ ID NO: 92782 - protein, 15 aa, Mycobacterium tuberculosis
DAAGAWRTAAVELAR

SEQ ID NO: 92783 - protein, 15 aa, Mycobacterium tuberculosis
AAGAWRTAAVELARA

SEQ ID NO: 92784 - protein, 15 aa, Mycobacterium tuberculosis
AGAWRTAAVELARAL

SEQ ID NO: 92785 - protein, 15 aa, Mycobacterium tuberculosis
GAWRTAAVELARALV

SEQ ID NO: 92786 - protein, 15 aa, Mycobacterium tuberculosis
AWRTAAVELARALVR

SEQ ID NO: 92787 - protein, 15 aa, Mycobacterium tuberculosis
WRTAAVELARALVRA

SEQ ID NO: 92788 - protein, 15 aa, Mycobacterium tuberculosis
RTAAVELARALVRAV

SEQ ID NO: 92789 - protein, 15 aa, Mycobacterium tuberculosis
TAAVELARALVRAVA

SEQ ID NO: 92790 - protein, 15 aa, Mycobacterium tuberculosis
AAVELARALVRAVAE

SEQ ID NO: 92791 - protein, 15 aa, Mycobacterium tuberculosis
AVELARALVRAVAES

SEQ ID NO: 92792 - protein, 15 aa, Mycobacterium tuberculosis
VELARALVRAVAESH

SEQ ID NO: 92793 - protein, 15 aa, Mycobacterium tuberculosis
ELARALVRAVAESHG

SEQ ID NO: 92794 - protein, 15 aa, Mycobacterium tuberculosis
LARALVRAVAESHGV

SEQ ID NO: 92795 - protein, 15 aa, Mycobacterium tuberculosis
ARALVRAVAESHGVA

SEQ ID NO: 92796 - protein, 15 aa, Mycobacterium tuberculosis
RALVRAVAESHGVAA

SEQ ID NO: 92797 - protein, 15 aa, Mycobacterium tuberculosis
ALVRAVAESHGVAAV

SEQ ID NO: 92798 - protein, 15 aa, Mycobacterium tuberculosis
LVRAVAESHGVAAVL

SEQ ID NO: 92799 - protein, 15 aa, Mycobacterium tuberculosis
VRAVAESHGVAAVLF

SEQ ID NO: 92800 - protein, 15 aa, Mycobacterium tuberculosis
RAVAESHGVAAVLFA

SEQ ID NO: 92801 - protein, 15 aa, Mycobacterium tuberculosis
AVAESHGVAAVLFAA

SEQ ID NO: 92802 - protein, 15 aa, Mycobacterium tuberculosis
VAESHGVAAVLFAAT

SEQ ID NO: 92803 - protein, 15 aa, Mycobacterium tuberculosis
AESHGVAAVLFAATA

SEQ ID NO: 92804 - protein, 15 aa, Mycobacterium tuberculosis
ESHGVAAVLFAATAA

SEQ ID NO: 92805 - protein, 15 aa, Mycobacterium tuberculosis
SHGVAAVLFAATAAA

SEQ ID NO: 92806 - protein, 15 aa, Mycobacterium tuberculosis
HGVAAVLFAATAAAA

SEQ ID NO: 92807 - protein, 15 aa, Mycobacterium tuberculosis
GVAAVLFAATAAAAA

SEQ ID NO: 92808 - protein, 15 aa, Mycobacterium tuberculosis
VAAVLFAATAAAAAA

SEQ ID NO: 92809 - protein, 15 aa, Mycobacterium tuberculosis
AAVLFAATAAAAAAV

SEQ ID NO: 92810 - protein, 15 aa, Mycobacterium tuberculosis
AVLFAATAAAAAAVD

SEQ ID NO: 92811 - protein, 15 aa, Mycobacterium tuberculosis
VLFAATAAAAAAVDR

SEQ ID NO: 92812 - protein, 15 aa, Mycobacterium tuberculosis
LFAATAAAAAAVDRG

SEQ ID NO: 92813 - protein, 15 aa, Mycobacterium tuberculosis
FAATAAAAAAVDRGD

SEQ ID NO: 92814 - protein, 15 aa, Mycobacterium tuberculosis
AATAAAAAAVDRGDP

SEQ ID NO: 92815 - protein, 15 aa, Mycobacterium tuberculosis
ATAAAAAAVDRGDPP

SEQ ID NO: 92816 - protein, 16 aa, Mycobacterium tuberculosis
MSGHALAARTLLAAAD

SEQ ID NO: 92817 - protein, 16 aa, Mycobacterium tuberculosis
SGHALAARTLLAAADE

SEQ ID NO: 92818 - protein, 16 aa, Mycobacterium tuberculosis
GHALAARTLLAAADEL

SEQ ID NO: 92819 - protein, 16 aa, Mycobacterium tuberculosis
HALAARTLLAAADELV

SEQ ID NO: 92820 - protein, 16 aa, Mycobacterium tuberculosis
ALAARTLLAAADELVG

SEQ ID NO: 92821 - protein, 16 aa, Mycobacterium tuberculosis
LAARTLLAAADELVGG

SEQ ID NO: 92822 - protein, 16 aa, Mycobacterium tuberculosis
AARTLLAAADELVGGP

SEQ ID NO: 92823 - protein, 16 aa, Mycobacterium tuberculosis
ARTLLAAADELVGGPP

SEQ ID NO: 92824 - protein, 16 aa, Mycobacterium tuberculosis
RTLLAAADELVGGPPV

SEQ ID NO: 92825 - protein, 16 aa, Mycobacterium tuberculosis
TLLAAADELVGGPPVE

SEQ ID NO: 92826 - protein, 16 aa, Mycobacterium tuberculosis
LLAAADELVGGPPVEA

SEQ ID NO: 92827 - protein, 16 aa, Mycobacterium tuberculosis
LAAADELVGGPPVEAS

SEQ ID NO: 92828 - protein, 16 aa, Mycobacterium tuberculosis
AAADELVGGPPVEASA

SEQ ID NO: 92829 - protein, 16 aa, Mycobacterium tuberculosis
AADELVGGPPVEASAA

SEQ ID NO: 92830 - protein, 16 aa, Mycobacterium tuberculosis
ADELVGGPPVEASAAA

SEQ ID NO: 92831 - protein, 16 aa, Mycobacterium tuberculosis
DELVGGPPVEASAAAL

SEQ ID NO: 92832 - protein, 16 aa, Mycobacterium tuberculosis
ELVGGPPVEASAAALA

SEQ ID NO: 92833 - protein, 16 aa, Mycobacterium tuberculosis
LVGGPPVEASAAALAG

SEQ ID NO: 92834 - protein, 16 aa, Mycobacterium tuberculosis
VGGPPVEASAAALAGD

SEQ ID NO: 92835 - protein, 16 aa, Mycobacterium tuberculosis
GGPPVEASAAALAGDA

SEQ ID NO: 92836 - protein, 16 aa, Mycobacterium tuberculosis
GPPVEASAAALAGDAA

SEQ ID NO: 92837 - protein, 16 aa, Mycobacterium tuberculosis
PPVEASAAALAGDAAG

SEQ ID NO: 92838 - protein, 16 aa, Mycobacterium tuberculosis
PVEASAAALAGDAAGA

SEQ ID NO: 92839 - protein, 16 aa, Mycobacterium tuberculosis
VEASAAALAGDAAGAW

SEQ ID NO: 92840 - protein, 16 aa, Mycobacterium tuberculosis
EASAAALAGDAAGAWR

SEQ ID NO: 92841 - protein, 16 aa, Mycobacterium tuberculosis
ASAAALAGDAAGAWRT

SEQ ID NO: 92842 - protein, 16 aa, Mycobacterium tuberculosis
SAAALAGDAAGAWRTA

SEQ ID NO: 92843 - protein, 16 aa, Mycobacterium tuberculosis
AAALAGDAAGAWRTAA

SEQ ID NO: 92844 - protein, 16 aa, Mycobacterium tuberculosis
AALAGDAAGAWRTAAV

SEQ ID NO: 92845 - protein, 16 aa, Mycobacterium tuberculosis
ALAGDAAGAWRTAAVE

SEQ ID NO: 92846 - protein, 16 aa, Mycobacterium tuberculosis
LAGDAAGAWRTAAVEL

SEQ ID NO: 92847 - protein, 16 aa, Mycobacterium tuberculosis
AGDAAGAWRTAAVELA

SEQ ID NO: 92848 - protein, 16 aa, Mycobacterium tuberculosis
GDAAGAWRTAAVELAR

SEQ ID NO: 92849 - protein, 16 aa, Mycobacterium tuberculosis
DAAGAWRTAAVELARA

SEQ ID NO: 92850 - protein, 16 aa, Mycobacterium tuberculosis
AAGAWRTAAVELARAL

SEQ ID NO: 92851 - protein, 16 aa, Mycobacterium tuberculosis
AGAWRTAAVELARALV

SEQ ID NO: 92852 - protein, 16 aa, Mycobacterium tuberculosis
GAWRTAAVELARALVR

SEQ ID NO: 92853 - protein, 16 aa, Mycobacterium tuberculosis
AWRTAAVELARALVRA

SEQ ID NO: 92854 - protein, 16 aa, Mycobacterium tuberculosis
WRTAAVELARALVRAV

SEQ ID NO: 92855 - protein, 16 aa, Mycobacterium tuberculosis
RTAAVELARALVRAVA

SEQ ID NO: 92856 - protein, 16 aa, Mycobacterium tuberculosis
TAAVELARALVRAVAE

SEQ ID NO: 92857 - protein, 16 aa, Mycobacterium tuberculosis
AAVELARALVRAVAES

SEQ ID NO: 92858 - protein, 16 aa, Mycobacterium tuberculosis
AVELARALVRAVAESH

SEQ ID NO: 92859 - protein, 16 aa, Mycobacterium tuberculosis
VELARALVRAVAESHG

SEQ ID NO: 92860 - protein, 16 aa, Mycobacterium tuberculosis
ELARALVRAVAESHGV

SEQ ID NO: 92861 - protein, 16 aa, Mycobacterium tuberculosis
LARALVRAVAESHGVA

SEQ ID NO: 92862 - protein, 16 aa, Mycobacterium tuberculosis
ARALVRAVAESHGVAA

SEQ ID NO: 92863 - protein, 16 aa, Mycobacterium tuberculosis
RALVRAVAESHGVAAV

SEQ ID NO: 92864 - protein, 16 aa, Mycobacterium tuberculosis
ALVRAVAESHGVAAVL

SEQ ID NO: 92865 - protein, 16 aa, Mycobacterium tuberculosis
LVRAVAESHGVAAVLF

SEQ ID NO: 92866 - protein, 16 aa, Mycobacterium tuberculosis
VRAVAESHGVAAVLFA

SEQ ID NO: 92867 - protein, 16 aa, Mycobacterium tuberculosis
RAVAESHGVAAVLFAA

SEQ ID NO: 92868 - protein, 16 aa, Mycobacterium tuberculosis
AVAESHGVAAVLFAAT

SEQ ID NO: 92869 - protein, 16 aa, Mycobacterium tuberculosis
VAESHGVAAVLFAATA

SEQ ID NO: 92870 - protein, 16 aa, Mycobacterium tuberculosis
AESHGVAAVLFAATAA

SEQ ID NO: 92871 - protein, 16 aa, Mycobacterium tuberculosis
ESHGVAAVLFAATAAA

SEQ ID NO: 92872 - protein, 16 aa, Mycobacterium tuberculosis
SHGVAAVLFAATAAAA

SEQ ID NO: 92873 - protein, 16 aa, Mycobacterium tuberculosis
HGVAAVLFAATAAAAA

SEQ ID NO: 92874 - protein, 16 aa, Mycobacterium tuberculosis
GVAAVLFAATAAAAAA

SEQ ID NO: 92875 - protein, 16 aa, Mycobacterium tuberculosis
VAAVLFAATAAAAAAV

SEQ ID NO: 92876 - protein, 16 aa, Mycobacterium tuberculosis
AAVLFAATAAAAAAVD

SEQ ID NO: 92877 - protein, 16 aa, Mycobacterium tuberculosis
AVLFAATAAAAAAVDR

SEQ ID NO: 92878 - protein, 16 aa, Mycobacterium tuberculosis
VLFAATAAAAAAVDRG

SEQ ID NO: 92879 - protein, 16 aa, Mycobacterium tuberculosis
LFAATAAAAAAVDRGD

SEQ ID NO: 92880 - protein, 16 aa, Mycobacterium tuberculosis
FAATAAAAAAVDRGDP

SEQ ID NO: 92881 - protein, 16 aa, Mycobacterium tuberculosis
AATAAAAAAVDRGDPP

SEQ ID NO: 92882 - protein, 13 aa, Mycobacterium tuberculosis
MADIPYGRDYPDP

SEQ ID NO: 92883 - protein, 13 aa, Mycobacterium tuberculosis
ADIPYGRDYPDPI

SEQ ID NO: 92884 - protein, 13 aa, Mycobacterium tuberculosis
DIPYGRDYPDPIW

SEQ ID NO: 92885 - protein, 13 aa, Mycobacterium tuberculosis
IPYGRDYPDPIWC

SEQ ID NO: 92886 - protein, 13 aa, Mycobacterium tuberculosis
PYGRDYPDPIWCD

SEQ ID NO: 92887 - protein, 13 aa, Mycobacterium tuberculosis
YGRDYPDPIWCDE

SEQ ID NO: 92888 - protein, 13 aa, Mycobacterium tuberculosis
GRDYPDPIWCDED

SEQ ID NO: 92889 - protein, 13 aa, Mycobacterium tuberculosis
RDYPDPIWCDEDG

SEQ ID NO: 92890 - protein, 13 aa, Mycobacterium tuberculosis
DYPDPIWCDEDGQ

SEQ ID NO: 92891 - protein, 13 aa, Mycobacterium tuberculosis
YPDPIWCDEDGQP

SEQ ID NO: 92892 - protein, 13 aa, Mycobacterium tuberculosis
PDPIWCDEDGQPM

SEQ ID NO: 92893 - protein, 13 aa, Mycobacterium tuberculosis
DPIWCDEDGQPMP

SEQ ID NO: 92894 - protein, 13 aa, Mycobacterium tuberculosis
PIWCDEDGQPMPP

SEQ ID NO: 92895 - protein, 13 aa, Mycobacterium tuberculosis
IWCDEDGQPMPPV

SEQ ID NO: 92896 - protein, 13 aa, Mycobacterium tuberculosis
WCDEDGQPMPPVG

SEQ ID NO: 92897 - protein, 13 aa, Mycobacterium tuberculosis
CDEDGQPMPPVGA

SEQ ID NO: 92898 - protein, 13 aa, Mycobacterium tuberculosis
DEDGQPMPPVGAE

SEQ ID NO: 92899 - protein, 13 aa, Mycobacterium tuberculosis
EDGQPMPPVGAEL

SEQ ID NO: 92900 - protein, 13 aa, Mycobacterium tuberculosis
DGQPMPPVGAELL

SEQ ID NO: 92901 - protein, 13 aa, Mycobacterium tuberculosis
GQPMPPVGAELLD

SEQ ID NO: 92902 - protein, 13 aa, Mycobacterium tuberculosis
QPMPPVGAELLDD

SEQ ID NO: 92903 - protein, 13 aa, Mycobacterium tuberculosis
PMPPVGAELLDDI

SEQ ID NO: 92904 - protein, 13 aa, Mycobacterium tuberculosis
MPPVGAELLDDIR

SEQ ID NO: 92905 - protein, 13 aa, Mycobacterium tuberculosis
PPVGAELLDDIRA

SEQ ID NO: 92906 - protein, 13 aa, Mycobacterium tuberculosis
PVGAELLDDIRAF

SEQ ID NO: 92907 - protein, 13 aa, Mycobacterium tuberculosis
VGAELLDDIRAFL

SEQ ID NO: 92908 - protein, 13 aa, Mycobacterium tuberculosis
GAELLDDIRAFLR

SEQ ID NO: 92909 - protein, 13 aa, Mycobacterium tuberculosis
AELLDDIRAFLRR

SEQ ID NO: 92910 - protein, 13 aa, Mycobacterium tuberculosis
ELLDDIRAFLRRF

SEQ ID NO: 92911 - protein, 13 aa, Mycobacterium tuberculosis
LLDDIRAFLRRFV

SEQ ID NO: 92912 - protein, 13 aa, Mycobacterium tuberculosis
LDDIRAFLRRFVV

SEQ ID NO: 92913 - protein, 13 aa, Mycobacterium tuberculosis
DDIRAFLRRFVVY

SEQ ID NO: 92914 - protein, 13 aa, Mycobacterium tuberculosis
DIRAFLRRFVVYP

SEQ ID NO: 92915 - protein, 13 aa, Mycobacterium tuberculosis
IRAFLRRFVVYPS

SEQ ID NO: 92916 - protein, 13 aa, Mycobacterium tuberculosis
RAFLRRFVVYPSD

SEQ ID NO: 92917 - protein, 13 aa, Mycobacterium tuberculosis
AFLRRFVVYPSDH

SEQ ID NO: 92918 - protein, 13 aa, Mycobacterium tuberculosis
FLRRFVVYPSDHE

SEQ ID NO: 92919 - protein, 13 aa, Mycobacterium tuberculosis
LRRFVVYPSDHEL

SEQ ID NO: 92920 - protein, 13 aa, Mycobacterium tuberculosis
RRFVVYPSDHELI

SEQ ID NO: 92921 - protein, 13 aa, Mycobacterium tuberculosis
RFVVYPSDHELIA

SEQ ID NO: 92922 - protein, 13 aa, Mycobacterium tuberculosis
FVVYPSDHELIAH

SEQ ID NO: 92923 - protein, 13 aa, Mycobacterium tuberculosis
VVYPSDHELIAHT

SEQ ID NO: 92924 - protein, 13 aa, Mycobacterium tuberculosis
VYPSDHELIAHTL

SEQ ID NO: 92925 - protein, 13 aa, Mycobacterium tuberculosis
YPSDHELIAHTLW

SEQ ID NO: 92926 - protein, 13 aa, Mycobacterium tuberculosis
PSDHELIAHTLWI

SEQ ID NO: 92927 - protein, 13 aa, Mycobacterium tuberculosis
SDHELIAHTLWIA

SEQ ID NO: 92928 - protein, 13 aa, Mycobacterium tuberculosis
DHELIAHTLWIAH

SEQ ID NO: 92929 - protein, 13 aa, Mycobacterium tuberculosis
HELIAHTLWIAHC

SEQ ID NO: 92930 - protein, 13 aa, Mycobacterium tuberculosis
ELIAHTLWIAHCW

SEQ ID NO: 92931 - protein, 13 aa, Mycobacterium tuberculosis
LIAHTLWIAHCWF

SEQ ID NO: 92932 - protein, 13 aa, Mycobacterium tuberculosis
IAHTLWIAHCWFM

SEQ ID NO: 92933 - protein, 13 aa, Mycobacterium tuberculosis
AHTLWIAHCWFME

SEQ ID NO: 92934 - protein, 13 aa, Mycobacterium tuberculosis
HTLWIAHCWFMEA

SEQ ID NO: 92935 - protein, 13 aa, Mycobacterium tuberculosis
TLWIAHCWFMEAW

SEQ ID NO: 92936 - protein, 13 aa, Mycobacterium tuberculosis
LWIAHCWFMEAWD

SEQ ID NO: 92937 - protein, 13 aa, Mycobacterium tuberculosis
WIAHCWFMEAWDS

SEQ ID NO: 92938 - protein, 13 aa, Mycobacterium tuberculosis
IAHCWFMEAWDST

SEQ ID NO: 92939 - protein, 13 aa, Mycobacterium tuberculosis
AHCWFMEAWDSTP

SEQ ID NO: 92940 - protein, 13 aa, Mycobacterium tuberculosis
HCWFMEAWDSTPR

SEQ ID NO: 92941 - protein, 13 aa, Mycobacterium tuberculosis
CWFMEAWDSTPRI

SEQ ID NO: 92942 - protein, 13 aa, Mycobacterium tuberculosis
WFMEAWDSTPRIA

SEQ ID NO: 92943 - protein, 13 aa, Mycobacterium tuberculosis
FMEAWDSTPRIAF

SEQ ID NO: 92944 - protein, 13 aa, Mycobacterium tuberculosis
MEAWDSTPRIAFL

SEQ ID NO: 92945 - protein, 13 aa, Mycobacterium tuberculosis
EAWDSTPRIAFLS

SEQ ID NO: 92946 - protein, 13 aa, Mycobacterium tuberculosis
AWDSTPRIAFLSP

SEQ ID NO: 92947 - protein, 13 aa, Mycobacterium tuberculosis
WDSTPRIAFLSPE

SEQ ID NO: 92948 - protein, 13 aa, Mycobacterium tuberculosis
DSTPRIAFLSPEP

SEQ ID NO: 92949 - protein, 13 aa, Mycobacterium tuberculosis
STPRIAFLSPEPG

SEQ ID NO: 92950 - protein, 13 aa, Mycobacterium tuberculosis
TPRIAFLSPEPGS

SEQ ID NO: 92951 - protein, 13 aa, Mycobacterium tuberculosis
PRIAFLSPEPGSG

SEQ ID NO: 92952 - protein, 13 aa, Mycobacterium tuberculosis
RIAFLSPEPGSGK

SEQ ID NO: 92953 - protein, 13 aa, Mycobacterium tuberculosis
IAFLSPEPGSGKS

SEQ ID NO: 92954 - protein, 13 aa, Mycobacterium tuberculosis
AFLSPEPGSGKSR

SEQ ID NO: 92955 - protein, 13 aa, Mycobacterium tuberculosis
FLSPEPGSGKSRA

SEQ ID NO: 92956 - protein, 13 aa, Mycobacterium tuberculosis
LSPEPGSGKSRAL

SEQ ID NO: 92957 - protein, 13 aa, Mycobacterium tuberculosis
SPEPGSGKSRALE

SEQ ID NO: 92958 - protein, 13 aa, Mycobacterium tuberculosis
PEPGSGKSRALEV

SEQ ID NO: 92959 - protein, 13 aa, Mycobacterium tuberculosis
EPGSGKSRALEVT

SEQ ID NO: 92960 - protein, 13 aa, Mycobacterium tuberculosis
PGSGKSRALEVTE

SEQ ID NO: 92961 - protein, 13 aa, Mycobacterium tuberculosis
GSGKSRALEVTEP

SEQ ID NO: 92962 - protein, 13 aa, Mycobacterium tuberculosis
SGKSRALEVTEPL

SEQ ID NO: 92963 - protein, 13 aa, Mycobacterium tuberculosis
GKSRALEVTEPLV

SEQ ID NO: 92964 - protein, 13 aa, Mycobacterium tuberculosis
KSRALEVTEPLVP

SEQ ID NO: 92965 - protein, 13 aa, Mycobacterium tuberculosis
SRALEVTEPLVPR

SEQ ID NO: 92966 - protein, 13 aa, Mycobacterium tuberculosis
RALEVTEPLVPRP

SEQ ID NO: 92967 - protein, 13 aa, Mycobacterium tuberculosis
ALEVTEPLVPRPV

SEQ ID NO: 92968 - protein, 13 aa, Mycobacterium tuberculosis
LEVTEPLVPRPVH

SEQ ID NO: 92969 - protein, 13 aa, Mycobacterium tuberculosis
EVTEPLVPRPVHA

SEQ ID NO: 92970 - protein, 13 aa, Mycobacterium tuberculosis
VTEPLVPRPVHAI

SEQ ID NO: 92971 - protein, 13 aa, Mycobacterium tuberculosis
TEPLVPRPVHAIN

SEQ ID NO: 92972 - protein, 13 aa, Mycobacterium tuberculosis
EPLVPRPVHAINC

SEQ ID NO: 92973 - protein, 13 aa, Mycobacterium tuberculosis
PLVPRPVHAINCT

SEQ ID NO: 92974 - protein, 13 aa, Mycobacterium tuberculosis
LVPRPVHAINCTP

SEQ ID NO: 92975 - protein, 13 aa, Mycobacterium tuberculosis
VPRPVHAINCTPA

SEQ ID NO: 92976 - protein, 13 aa, Mycobacterium tuberculosis
PRPVHAINCTPAY

SEQ ID NO: 92977 - protein, 13 aa, Mycobacterium tuberculosis
RPVHAINCTPAYL

SEQ ID NO: 92978 - protein, 13 aa, Mycobacterium tuberculosis
PVHAINCTPAYLF

SEQ ID NO: 92979 - protein, 13 aa, Mycobacterium tuberculosis
VHAINCTPAYLFR

SEQ ID NO: 92980 - protein, 13 aa, Mycobacterium tuberculosis
HAINCTPAYLFRR

SEQ ID NO: 92981 - protein, 13 aa, Mycobacterium tuberculosis
AINCTPAYLFRRV

SEQ ID NO: 92982 - protein, 13 aa, Mycobacterium tuberculosis
INCTPAYLFRRVA

SEQ ID NO: 92983 - protein, 13 aa, Mycobacterium tuberculosis
NCTPAYLFRRVAD

SEQ ID NO: 92984 - protein, 13 aa, Mycobacterium tuberculosis
CTPAYLFRRVADP

SEQ ID NO: 92985 - protein, 13 aa, Mycobacterium tuberculosis
TPAYLFRRVADPV

SEQ ID NO: 92986 - protein, 13 aa, Mycobacterium tuberculosis
PAYLFRRVADPVG

SEQ ID NO: 92987 - protein, 13 aa, Mycobacterium tuberculosis
AYLFRRVADPVGR

SEQ ID NO: 92988 - protein, 13 aa, Mycobacterium tuberculosis
YLFRRVADPVGRP

SEQ ID NO: 92989 - protein, 13 aa, Mycobacterium tuberculosis
LFRRVADPVGRPT

SEQ ID NO: 92990 - protein, 13 aa, Mycobacterium tuberculosis
FRRVADPVGRPTV

SEQ ID NO: 92991 - protein, 13 aa, Mycobacterium tuberculosis
RRVADPVGRPTVL

SEQ ID NO: 92992 - protein, 13 aa, Mycobacterium tuberculosis
RVADPVGRPTVLY

SEQ ID NO: 92993 - protein, 13 aa, Mycobacterium tuberculosis
VADPVGRPTVLYD

SEQ ID NO: 92994 - protein, 13 aa, Mycobacterium tuberculosis
ADPVGRPTVLYDE

SEQ ID NO: 92995 - protein, 13 aa, Mycobacterium tuberculosis
DPVGRPTVLYDEC

SEQ ID NO: 92996 - protein, 13 aa, Mycobacterium tuberculosis
PVGRPTVLYDECD

SEQ ID NO: 92997 - protein, 13 aa, Mycobacterium tuberculosis
VGRPTVLYDECDT

SEQ ID NO: 92998 - protein, 13 aa, Mycobacterium tuberculosis
GRPTVLYDECDTL

SEQ ID NO: 92999 - protein, 13 aa, Mycobacterium tuberculosis
RPTVLYDECDTLF

SEQ ID NO: 93000 - protein, 13 aa, Mycobacterium tuberculosis
PTVLYDECDTLFG

SEQ ID NO: 93001 - protein, 13 aa, Mycobacterium tuberculosis
TVLYDECDTLFGP

SEQ ID NO: 93002 - protein, 13 aa, Mycobacterium tuberculosis
VLYDECDTLFGPK

SEQ ID NO: 93003 - protein, 13 aa, Mycobacterium tuberculosis
LYDECDTLFGPKA

SEQ ID NO: 93004 - protein, 13 aa, Mycobacterium tuberculosis
YDECDTLFGPKAK

SEQ ID NO: 93005 - protein, 13 aa, Mycobacterium tuberculosis
DECDTLFGPKAKE

SEQ ID NO: 93006 - protein, 13 aa, Mycobacterium tuberculosis
ECDTLFGPKAKEH

SEQ ID NO: 93007 - protein, 13 aa, Mycobacterium tuberculosis
CDTLFGPKAKEHE

SEQ ID NO: 93008 - protein, 13 aa, Mycobacterium tuberculosis
DTLFGPKAKEHEE

SEQ ID NO: 93009 - protein, 13 aa, Mycobacterium tuberculosis
TLFGPKAKEHEEI

SEQ ID NO: 93010 - protein, 13 aa, Mycobacterium tuberculosis
LFGPKAKEHEEIR

SEQ ID NO: 93011 - protein, 13 aa, Mycobacterium tuberculosis
FGPKAKEHEEIRG

SEQ ID NO: 93012 - protein, 13 aa, Mycobacterium tuberculosis
GPKAKEHEEIRGV

SEQ ID NO: 93013 - protein, 13 aa, Mycobacterium tuberculosis
PKAKEHEEIRGVI

SEQ ID NO: 93014 - protein, 13 aa, Mycobacterium tuberculosis
KAKEHEEIRGVIN

SEQ ID NO: 93015 - protein, 13 aa, Mycobacterium tuberculosis
AKEHEEIRGVINA

SEQ ID NO: 93016 - protein, 13 aa, Mycobacterium tuberculosis
KEHEEIRGVINAG

SEQ ID NO: 93017 - protein, 13 aa, Mycobacterium tuberculosis
EHEEIRGVINAGH

SEQ ID NO: 93018 - protein, 13 aa, Mycobacterium tuberculosis
HEEIRGVINAGHR

SEQ ID NO: 93019 - protein, 13 aa, Mycobacterium tuberculosis
EEIRGVINAGHRK

SEQ ID NO: 93020 - protein, 13 aa, Mycobacterium tuberculosis
EIRGVINAGHRKG

SEQ ID NO: 93021 - protein, 13 aa, Mycobacterium tuberculosis
IRGVINAGHRKGA

SEQ ID NO: 93022 - protein, 13 aa, Mycobacterium tuberculosis
RGVINAGHRKGAV

SEQ ID NO: 93023 - protein, 13 aa, Mycobacterium tuberculosis
GVINAGHRKGAVA

SEQ ID NO: 93024 - protein, 13 aa, Mycobacterium tuberculosis
VINAGHRKGAVAG

SEQ ID NO: 93025 - protein, 13 aa, Mycobacterium tuberculosis
INAGHRKGAVAGR

SEQ ID NO: 93026 - protein, 13 aa, Mycobacterium tuberculosis
NAGHRKGAVAGRC

SEQ ID NO: 93027 - protein, 13 aa, Mycobacterium tuberculosis
AGHRKGAVAGRCV

SEQ ID NO: 93028 - protein, 13 aa, Mycobacterium tuberculosis
GHRKGAVAGRCVI

SEQ ID NO: 93029 - protein, 13 aa, Mycobacterium tuberculosis
HRKGAVAGRCVIR

SEQ ID NO: 93030 - protein, 13 aa, Mycobacterium tuberculosis
RKGAVAGRCVIRG

SEQ ID NO: 93031 - protein, 13 aa, Mycobacterium tuberculosis
KGAVAGRCVIRGK

SEQ ID NO: 93032 - protein, 13 aa, Mycobacterium tuberculosis
GAVAGRCVIRGKI

SEQ ID NO: 93033 - protein, 13 aa, Mycobacterium tuberculosis
AVAGRCVIRGKIV

SEQ ID NO: 93034 - protein, 13 aa, Mycobacterium tuberculosis
VAGRCVIRGKIVE

SEQ ID NO: 93035 - protein, 13 aa, Mycobacterium tuberculosis
AGRCVIRGKIVET

SEQ ID NO: 93036 - protein, 13 aa, Mycobacterium tuberculosis
GRCVIRGKIVETE

SEQ ID NO: 93037 - protein, 13 aa, Mycobacterium tuberculosis
RCVIRGKIVETEE

SEQ ID NO: 93038 - protein, 13 aa, Mycobacterium tuberculosis
CVIRGKIVETEEL

SEQ ID NO: 93039 - protein, 13 aa, Mycobacterium tuberculosis
VIRGKIVETEELP

SEQ ID NO: 93040 - protein, 13 aa, Mycobacterium tuberculosis
IRGKIVETEELPA

SEQ ID NO: 93041 - protein, 13 aa, Mycobacterium tuberculosis
RGKIVETEELPAY

SEQ ID NO: 93042 - protein, 13 aa, Mycobacterium tuberculosis
GKIVETEELPAYC

SEQ ID NO: 93043 - protein, 13 aa, Mycobacterium tuberculosis
KIVETEELPAYCA

SEQ ID NO: 93044 - protein, 13 aa, Mycobacterium tuberculosis
IVETEELPAYCAV

SEQ ID NO: 93045 - protein, 13 aa, Mycobacterium tuberculosis
VETEELPAYCAVA

SEQ ID NO: 93046 - protein, 13 aa, Mycobacterium tuberculosis
ETEELPAYCAVAL

SEQ ID NO: 93047 - protein, 13 aa, Mycobacterium tuberculosis
TEELPAYCAVALA

SEQ ID NO: 93048 - protein, 13 aa, Mycobacterium tuberculosis
EELPAYCAVALAG

SEQ ID NO: 93049 - protein, 13 aa, Mycobacterium tuberculosis
ELPAYCAVALAGL

SEQ ID NO: 93050 - protein, 13 aa, Mycobacterium tuberculosis
LPAYCAVALAGLD

SEQ ID NO: 93051 - protein, 13 aa, Mycobacterium tuberculosis
PAYCAVALAGLDD

SEQ ID NO: 93052 - protein, 13 aa, Mycobacterium tuberculosis
AYCAVALAGLDDL

SEQ ID NO: 93053 - protein, 13 aa, Mycobacterium tuberculosis
YCAVALAGLDDLP

SEQ ID NO: 93054 - protein, 13 aa, Mycobacterium tuberculosis
CAVALAGLDDLPD

SEQ ID NO: 93055 - protein, 13 aa, Mycobacterium tuberculosis
AVALAGLDDLPDT

SEQ ID NO: 93056 - protein, 13 aa, Mycobacterium tuberculosis
VALAGLDDLPDTI

SEQ ID NO: 93057 - protein, 13 aa, Mycobacterium tuberculosis
ALAGLDDLPDTIM

SEQ ID NO: 93058 - protein, 13 aa, Mycobacterium tuberculosis
LAGLDDLPDTIMS

SEQ ID NO: 93059 - protein, 13 aa, Mycobacterium tuberculosis
AGLDDLPDTIMSR

SEQ ID NO: 93060 - protein, 13 aa, Mycobacterium tuberculosis
GLDDLPDTIMSRS

SEQ ID NO: 93061 - protein, 13 aa, Mycobacterium tuberculosis
LDDLPDTIMSRSI

SEQ ID NO: 93062 - protein, 13 aa, Mycobacterium tuberculosis
DDLPDTIMSRSIV

SEQ ID NO: 93063 - protein, 13 aa, Mycobacterium tuberculosis
DLPDTIMSRSIVV

SEQ ID NO: 93064 - protein, 13 aa, Mycobacterium tuberculosis
LPDTIMSRSIVVR

SEQ ID NO: 93065 - protein, 13 aa, Mycobacterium tuberculosis
PDTIMSRSIVVRM

SEQ ID NO: 93066 - protein, 13 aa, Mycobacterium tuberculosis
DTIMSRSIVVRMR

SEQ ID NO: 93067 - protein, 13 aa, Mycobacterium tuberculosis
TIMSRSIVVRMRR

SEQ ID NO: 93068 - protein, 13 aa, Mycobacterium tuberculosis
IMSRSIVVRMRRR

SEQ ID NO: 93069 - protein, 13 aa, Mycobacterium tuberculosis
MSRSIVVRMRRRA

SEQ ID NO: 93070 - protein, 13 aa, Mycobacterium tuberculosis
SRSIVVRMRRRAP

SEQ ID NO: 93071 - protein, 13 aa, Mycobacterium tuberculosis
RSIVVRMRRRAPT

SEQ ID NO: 93072 - protein, 13 aa, Mycobacterium tuberculosis
SIVVRMRRRAPTE

SEQ ID NO: 93073 - protein, 13 aa, Mycobacterium tuberculosis
IVVRMRRRAPTEP

SEQ ID NO: 93074 - protein, 13 aa, Mycobacterium tuberculosis
VVRMRRRAPTEPV

SEQ ID NO: 93075 - protein, 13 aa, Mycobacterium tuberculosis
VRMRRRAPTEPVE

SEQ ID NO: 93076 - protein, 13 aa, Mycobacterium tuberculosis
RMRRRAPTEPVEP

SEQ ID NO: 93077 - protein, 13 aa, Mycobacterium tuberculosis
MRRRAPTEPVEPW

SEQ ID NO: 93078 - protein, 13 aa, Mycobacterium tuberculosis
RRRAPTEPVEPWR

SEQ ID NO: 93079 - protein, 13 aa, Mycobacterium tuberculosis
RRAPTEPVEPWRP

SEQ ID NO: 93080 - protein, 13 aa, Mycobacterium tuberculosis
RAPTEPVEPWRPR

SEQ ID NO: 93081 - protein, 13 aa, Mycobacterium tuberculosis
APTEPVEPWRPRV

SEQ ID NO: 93082 - protein, 13 aa, Mycobacterium tuberculosis
PTEPVEPWRPRVN

SEQ ID NO: 93083 - protein, 13 aa, Mycobacterium tuberculosis
TEPVEPWRPRVNG

SEQ ID NO: 93084 - protein, 13 aa, Mycobacterium tuberculosis
EPVEPWRPRVNGP

SEQ ID NO: 93085 - protein, 13 aa, Mycobacterium tuberculosis
PVEPWRPRVNGPE

SEQ ID NO: 93086 - protein, 13 aa, Mycobacterium tuberculosis
VEPWRPRVNGPEA

SEQ ID NO: 93087 - protein, 13 aa, Mycobacterium tuberculosis
EPWRPRVNGPEAE

SEQ ID NO: 93088 - protein, 13 aa, Mycobacterium tuberculosis
PWRPRVNGPEAEK

SEQ ID NO: 93089 - protein, 13 aa, Mycobacterium tuberculosis
WRPRVNGPEAEKL

SEQ ID NO: 93090 - protein, 13 aa, Mycobacterium tuberculosis
RPRVNGPEAEKLH

SEQ ID NO: 93091 - protein, 13 aa, Mycobacterium tuberculosis
PRVNGPEAEKLHD

SEQ ID NO: 93092 - protein, 13 aa, Mycobacterium tuberculosis
RVNGPEAEKLHDR

SEQ ID NO: 93093 - protein, 13 aa, Mycobacterium tuberculosis
VNGPEAEKLHDRL

SEQ ID NO: 93094 - protein, 13 aa, Mycobacterium tuberculosis
NGPEAEKLHDRLA

SEQ ID NO: 93095 - protein, 13 aa, Mycobacterium tuberculosis
GPEAEKLHDRLAN

SEQ ID NO: 93096 - protein, 13 aa, Mycobacterium tuberculosis
PEAEKLHDRLANW

SEQ ID NO: 93097 - protein, 13 aa, Mycobacterium tuberculosis
EAEKLHDRLANWA

SEQ ID NO: 93098 - protein, 13 aa, Mycobacterium tuberculosis
AEKLHDRLANWAA

SEQ ID NO: 93099 - protein, 13 aa, Mycobacterium tuberculosis
EKLHDRLANWAAA

SEQ ID NO: 93100 - protein, 13 aa, Mycobacterium tuberculosis
KLHDRLANWAAAI

SEQ ID NO: 93101 - protein, 13 aa, Mycobacterium tuberculosis
LHDRLANWAAAIN

SEQ ID NO: 93102 - protein, 13 aa, Mycobacterium tuberculosis
HDRLANWAAAINP

SEQ ID NO: 93103 - protein, 13 aa, Mycobacterium tuberculosis
DRLANWAAAINPL

SEQ ID NO: 93104 - protein, 13 aa, Mycobacterium tuberculosis
RLANWAAAINPLE

SEQ ID NO: 93105 - protein, 13 aa, Mycobacterium tuberculosis
LANWAAAINPLES

SEQ ID NO: 93106 - protein, 13 aa, Mycobacterium tuberculosis
ANWAAAINPLESG

SEQ ID NO: 93107 - protein, 13 aa, Mycobacterium tuberculosis
NWAAAINPLESGW

SEQ ID NO: 93108 - protein, 13 aa, Mycobacterium tuberculosis
WAAAINPLESGWP

SEQ ID NO: 93109 - protein, 13 aa, Mycobacterium tuberculosis
AAAINPLESGWPA

SEQ ID NO: 93110 - protein, 13 aa, Mycobacterium tuberculosis
AAINPLESGWPAM

SEQ ID NO: 93111 - protein, 13 aa, Mycobacterium tuberculosis
AINPLESGWPAMP

SEQ ID NO: 93112 - protein, 13 aa, Mycobacterium tuberculosis
INPLESGWPAMPD

SEQ ID NO: 93113 - protein, 13 aa, Mycobacterium tuberculosis
NPLESGWPAMPDG

SEQ ID NO: 93114 - protein, 13 aa, Mycobacterium tuberculosis
PLESGWPAMPDGV

SEQ ID NO: 93115 - protein, 13 aa, Mycobacterium tuberculosis
LESGWPAMPDGVT

SEQ ID NO: 93116 - protein, 13 aa, Mycobacterium tuberculosis
ESGWPAMPDGVTD

SEQ ID NO: 93117 - protein, 13 aa, Mycobacterium tuberculosis
SGWPAMPDGVTDR

SEQ ID NO: 93118 - protein, 13 aa, Mycobacterium tuberculosis
GWPAMPDGVTDRR

SEQ ID NO: 93119 - protein, 13 aa, Mycobacterium tuberculosis
WPAMPDGVTDRRA

SEQ ID NO: 93120 - protein, 13 aa, Mycobacterium tuberculosis
PAMPDGVTDRRAD

SEQ ID NO: 93121 - protein, 13 aa, Mycobacterium tuberculosis
AMPDGVTDRRADV

SEQ ID NO: 93122 - protein, 13 aa, Mycobacterium tuberculosis
MPDGVTDRRADVW

SEQ ID NO: 93123 - protein, 13 aa, Mycobacterium tuberculosis
PDGVTDRRADVWE

SEQ ID NO: 93124 - protein, 13 aa, Mycobacterium tuberculosis
DGVTDRRADVWES

SEQ ID NO: 93125 - protein, 13 aa, Mycobacterium tuberculosis
GVTDRRADVWESL

SEQ ID NO: 93126 - protein, 13 aa, Mycobacterium tuberculosis
VTDRRADVWESLV

SEQ ID NO: 93127 - protein, 13 aa, Mycobacterium tuberculosis
TDRRADVWESLVA

SEQ ID NO: 93128 - protein, 13 aa, Mycobacterium tuberculosis
DRRADVWESLVAV

SEQ ID NO: 93129 - protein, 13 aa, Mycobacterium tuberculosis
RRADVWESLVAVA

SEQ ID NO: 93130 - protein, 13 aa, Mycobacterium tuberculosis
RADVWESLVAVAD

SEQ ID NO: 93131 - protein, 13 aa, Mycobacterium tuberculosis
ADVWESLVAVADT

SEQ ID NO: 93132 - protein, 13 aa, Mycobacterium tuberculosis
DVWESLVAVADTA

SEQ ID NO: 93133 - protein, 13 aa, Mycobacterium tuberculosis
VWESLVAVADTAG

SEQ ID NO: 93134 - protein, 13 aa, Mycobacterium tuberculosis
WESLVAVADTAGG

SEQ ID NO: 93135 - protein, 13 aa, Mycobacterium tuberculosis
ESLVAVADTAGGH

SEQ ID NO: 93136 - protein, 13 aa, Mycobacterium tuberculosis
SLVAVADTAGGHW

SEQ ID NO: 93137 - protein, 13 aa, Mycobacterium tuberculosis
LVAVADTAGGHWP

SEQ ID NO: 93138 - protein, 13 aa, Mycobacterium tuberculosis
VAVADTAGGHWPK

SEQ ID NO: 93139 - protein, 13 aa, Mycobacterium tuberculosis
AVADTAGGHWPKT

SEQ ID NO: 93140 - protein, 13 aa, Mycobacterium tuberculosis
VADTAGGHWPKTA

SEQ ID NO: 93141 - protein, 13 aa, Mycobacterium tuberculosis
ADTAGGHWPKTAR

SEQ ID NO: 93142 - protein, 13 aa, Mycobacterium tuberculosis
DTAGGHWPKTARA

SEQ ID NO: 93143 - protein, 13 aa, Mycobacterium tuberculosis
TAGGHWPKTARAT

SEQ ID NO: 93144 - protein, 13 aa, Mycobacterium tuberculosis
AGGHWPKTARATA

SEQ ID NO: 93145 - protein, 13 aa, Mycobacterium tuberculosis
GGHWPKTARATAE

SEQ ID NO: 93146 - protein, 13 aa, Mycobacterium tuberculosis
GHWPKTARATAET

SEQ ID NO: 93147 - protein, 13 aa, Mycobacterium tuberculosis
HWPKTARATAETD

SEQ ID NO: 93148 - protein, 13 aa, Mycobacterium tuberculosis
WPKTARATAETDA

SEQ ID NO: 93149 - protein, 13 aa, Mycobacterium tuberculosis
PKTARATAETDAT

SEQ ID NO: 93150 - protein, 13 aa, Mycobacterium tuberculosis
KTARATAETDATA

SEQ ID NO: 93151 - protein, 13 aa, Mycobacterium tuberculosis
TARATAETDATAN

SEQ ID NO: 93152 - protein, 13 aa, Mycobacterium tuberculosis
ARATAETDATANR

SEQ ID NO: 93153 - protein, 13 aa, Mycobacterium tuberculosis
RATAETDATANRG

SEQ ID NO: 93154 - protein, 13 aa, Mycobacterium tuberculosis
ATAETDATANRGA

SEQ ID NO: 93155 - protein, 13 aa, Mycobacterium tuberculosis
TAETDATANRGAK

SEQ ID NO: 93156 - protein, 13 aa, Mycobacterium tuberculosis
AETDATANRGAKP

SEQ ID NO: 93157 - protein, 13 aa, Mycobacterium tuberculosis
ETDATANRGAKPS

SEQ ID NO: 93158 - protein, 13 aa, Mycobacterium tuberculosis
TDATANRGAKPSI

SEQ ID NO: 93159 - protein, 13 aa, Mycobacterium tuberculosis
DATANRGAKPSIG

SEQ ID NO: 93160 - protein, 13 aa, Mycobacterium tuberculosis
ATANRGAKPSIGV

SEQ ID NO: 93161 - protein, 13 aa, Mycobacterium tuberculosis
TANRGAKPSIGVL

SEQ ID NO: 93162 - protein, 13 aa, Mycobacterium tuberculosis
ANRGAKPSIGVLL

SEQ ID NO: 93163 - protein, 13 aa, Mycobacterium tuberculosis
NRGAKPSIGVLLL

SEQ ID NO: 93164 - protein, 13 aa, Mycobacterium tuberculosis
RGAKPSIGVLLLR

SEQ ID NO: 93165 - protein, 13 aa, Mycobacterium tuberculosis
GAKPSIGVLLLRD

SEQ ID NO: 93166 - protein, 13 aa, Mycobacterium tuberculosis
AKPSIGVLLLRDI

SEQ ID NO: 93167 - protein, 13 aa, Mycobacterium tuberculosis
KPSIGVLLLRDIR

SEQ ID NO: 93168 - protein, 13 aa, Mycobacterium tuberculosis
PSIGVLLLRDIRR

SEQ ID NO: 93169 - protein, 13 aa, Mycobacterium tuberculosis
SIGVLLLRDIRRV

SEQ ID NO: 93170 - protein, 13 aa, Mycobacterium tuberculosis
IGVLLLRDIRRVF

SEQ ID NO: 93171 - protein, 13 aa, Mycobacterium tuberculosis
GVLLLRDIRRVFS

SEQ ID NO: 93172 - protein, 13 aa, Mycobacterium tuberculosis
VLLLRDIRRVFSD

SEQ ID NO: 93173 - protein, 13 aa, Mycobacterium tuberculosis
LLLRDIRRVFSDR

SEQ ID NO: 93174 - protein, 13 aa, Mycobacterium tuberculosis
LLRDIRRVFSDRD

SEQ ID NO: 93175 - protein, 13 aa, Mycobacterium tuberculosis
LRDIRRVFSDRDR

SEQ ID NO: 93176 - protein, 13 aa, Mycobacterium tuberculosis
RDIRRVFSDRDRM

SEQ ID NO: 93177 - protein, 13 aa, Mycobacterium tuberculosis
DIRRVFSDRDRMR

SEQ ID NO: 93178 - protein, 13 aa, Mycobacterium tuberculosis
IRRVFSDRDRMRT

SEQ ID NO: 93179 - protein, 13 aa, Mycobacterium tuberculosis
RRVFSDRDRMRTS

SEQ ID NO: 93180 - protein, 13 aa, Mycobacterium tuberculosis
RVFSDRDRMRTSD

SEQ ID NO: 93181 - protein, 13 aa, Mycobacterium tuberculosis
VFSDRDRMRTSDI

SEQ ID NO: 93182 - protein, 13 aa, Mycobacterium tuberculosis
FSDRDRMRTSDIL

SEQ ID NO: 93183 - protein, 13 aa, Mycobacterium tuberculosis
SDRDRMRTSDILT

SEQ ID NO: 93184 - protein, 13 aa, Mycobacterium tuberculosis
DRDRMRTSDILTG

SEQ ID NO: 93185 - protein, 13 aa, Mycobacterium tuberculosis
RDRMRTSDILTGL

SEQ ID NO: 93186 - protein, 13 aa, Mycobacterium tuberculosis
DRMRTSDILTGLN

SEQ ID NO: 93187 - protein, 13 aa, Mycobacterium tuberculosis
RMRTSDILTGLNR

SEQ ID NO: 93188 - protein, 13 aa, Mycobacterium tuberculosis
MRTSDILTGLNRM

SEQ ID NO: 93189 - protein, 13 aa, Mycobacterium tuberculosis
RTSDILTGLNRME

SEQ ID NO: 93190 - protein, 13 aa, Mycobacterium tuberculosis
TSDILTGLNRMEE

SEQ ID NO: 93191 - protein, 13 aa, Mycobacterium tuberculosis
SDILTGLNRMEEG

SEQ ID NO: 93192 - protein, 13 aa, Mycobacterium tuberculosis
DILTGLNRMEEGP

SEQ ID NO: 93193 - protein, 13 aa, Mycobacterium tuberculosis
ILTGLNRMEEGPW

SEQ ID NO: 93194 - protein, 13 aa, Mycobacterium tuberculosis
LTGLNRMEEGPWG

SEQ ID NO: 93195 - protein, 13 aa, Mycobacterium tuberculosis
TGLNRMEEGPWGS

SEQ ID NO: 93196 - protein, 13 aa, Mycobacterium tuberculosis
GLNRMEEGPWGSI

SEQ ID NO: 93197 - protein, 13 aa, Mycobacterium tuberculosis
LNRMEEGPWGSIR

SEQ ID NO: 93198 - protein, 13 aa, Mycobacterium tuberculosis
NRMEEGPWGSIRR

SEQ ID NO: 93199 - protein, 13 aa, Mycobacterium tuberculosis
RMEEGPWGSIRRG

SEQ ID NO: 93200 - protein, 13 aa, Mycobacterium tuberculosis
MEEGPWGSIRRGD

SEQ ID NO: 93201 - protein, 13 aa, Mycobacterium tuberculosis
EEGPWGSIRRGDP

SEQ ID NO: 93202 - protein, 13 aa, Mycobacterium tuberculosis
EGPWGSIRRGDPL

SEQ ID NO: 93203 - protein, 13 aa, Mycobacterium tuberculosis
GPWGSIRRGDPLD

SEQ ID NO: 93204 - protein, 13 aa, Mycobacterium tuberculosis
PWGSIRRGDPLDA

SEQ ID NO: 93205 - protein, 13 aa, Mycobacterium tuberculosis
WGSIRRGDPLDAR

SEQ ID NO: 93206 - protein, 13 aa, Mycobacterium tuberculosis
GSIRRGDPLDARG

SEQ ID NO: 93207 - protein, 13 aa, Mycobacterium tuberculosis
SIRRGDPLDARGL

SEQ ID NO: 93208 - protein, 13 aa, Mycobacterium tuberculosis
IRRGDPLDARGLA

SEQ ID NO: 93209 - protein, 13 aa, Mycobacterium tuberculosis
RRGDPLDARGLAT

SEQ ID NO: 93210 - protein, 13 aa, Mycobacterium tuberculosis
RGDPLDARGLATR

SEQ ID NO: 93211 - protein, 13 aa, Mycobacterium tuberculosis
GDPLDARGLATRL

SEQ ID NO: 93212 - protein, 13 aa, Mycobacterium tuberculosis
DPLDARGLATRLG

SEQ ID NO: 93213 - protein, 13 aa, Mycobacterium tuberculosis
PLDARGLATRLGR

SEQ ID NO: 93214 - protein, 13 aa, Mycobacterium tuberculosis
LDARGLATRLGRY

SEQ ID NO: 93215 - protein, 13 aa, Mycobacterium tuberculosis
DARGLATRLGRYG

SEQ ID NO: 93216 - protein, 13 aa, Mycobacterium tuberculosis
ARGLATRLGRYGI

SEQ ID NO: 93217 - protein, 13 aa, Mycobacterium tuberculosis
RGLATRLGRYGIG

SEQ ID NO: 93218 - protein, 13 aa, Mycobacterium tuberculosis
GLATRLGRYGIGP

SEQ ID NO: 93219 - protein, 13 aa, Mycobacterium tuberculosis
LATRLGRYGIGPK

SEQ ID NO: 93220 - protein, 13 aa, Mycobacterium tuberculosis
ATRLGRYGIGPKF

SEQ ID NO: 93221 - protein, 13 aa, Mycobacterium tuberculosis
TRLGRYGIGPKFQ

SEQ ID NO: 93222 - protein, 13 aa, Mycobacterium tuberculosis
RLGRYGIGPKFQH

SEQ ID NO: 93223 - protein, 13 aa, Mycobacterium tuberculosis
LGRYGIGPKFQHS

SEQ ID NO: 93224 - protein, 13 aa, Mycobacterium tuberculosis
GRYGIGPKFQHSG

SEQ ID NO: 93225 - protein, 13 aa, Mycobacterium tuberculosis
RYGIGPKFQHSGG

SEQ ID NO: 93226 - protein, 13 aa, Mycobacterium tuberculosis
YGIGPKFQHSGGE

SEQ ID NO: 93227 - protein, 13 aa, Mycobacterium tuberculosis
GIGPKFQHSGGEP

SEQ ID NO: 93228 - protein, 13 aa, Mycobacterium tuberculosis
IGPKFQHSGGEPP

SEQ ID NO: 93229 - protein, 13 aa, Mycobacterium tuberculosis
GPKFQHSGGEPPY

SEQ ID NO: 93230 - protein, 13 aa, Mycobacterium tuberculosis
PKFQHSGGEPPYK

SEQ ID NO: 93231 - protein, 13 aa, Mycobacterium tuberculosis
KFQHSGGEPPYKG

SEQ ID NO: 93232 - protein, 13 aa, Mycobacterium tuberculosis
FQHSGGEPPYKGY

SEQ ID NO: 93233 - protein, 13 aa, Mycobacterium tuberculosis
QHSGGEPPYKGYS

SEQ ID NO: 93234 - protein, 13 aa, Mycobacterium tuberculosis
HSGGEPPYKGYSR

SEQ ID NO: 93235 - protein, 13 aa, Mycobacterium tuberculosis
SGGEPPYKGYSRT

SEQ ID NO: 93236 - protein, 13 aa, Mycobacterium tuberculosis
GGEPPYKGYSRTQ

SEQ ID NO: 93237 - protein, 13 aa, Mycobacterium tuberculosis
GEPPYKGYSRTQF

SEQ ID NO: 93238 - protein, 13 aa, Mycobacterium tuberculosis
EPPYKGYSRTQFE

SEQ ID NO: 93239 - protein, 13 aa, Mycobacterium tuberculosis
PPYKGYSRTQFED

SEQ ID NO: 93240 - protein, 13 aa, Mycobacterium tuberculosis
PYKGYSRTQFEDA

SEQ ID NO: 93241 - protein, 13 aa, Mycobacterium tuberculosis
YKGYSRTQFEDAW

SEQ ID NO: 93242 - protein, 13 aa, Mycobacterium tuberculosis
KGYSRTQFEDAWS

SEQ ID NO: 93243 - protein, 13 aa, Mycobacterium tuberculosis
GYSRTQFEDAWSR

SEQ ID NO: 93244 - protein, 13 aa, Mycobacterium tuberculosis
YSRTQFEDAWSRY

SEQ ID NO: 93245 - protein, 13 aa, Mycobacterium tuberculosis
SRTQFEDAWSRYL

SEQ ID NO: 93246 - protein, 13 aa, Mycobacterium tuberculosis
RTQFEDAWSRYLS

SEQ ID NO: 93247 - protein, 13 aa, Mycobacterium tuberculosis
TQFEDAWSRYLSA

SEQ ID NO: 93248 - protein, 13 aa, Mycobacterium tuberculosis
QFEDAWSRYLSAD

SEQ ID NO: 93249 - protein, 13 aa, Mycobacterium tuberculosis
FEDAWSRYLSADD

SEQ ID NO: 93250 - protein, 13 aa, Mycobacterium tuberculosis
EDAWSRYLSADDE

SEQ ID NO: 93251 - protein, 13 aa, Mycobacterium tuberculosis
DAWSRYLSADDET

SEQ ID NO: 93252 - protein, 13 aa, Mycobacterium tuberculosis
AWSRYLSADDETP

SEQ ID NO: 93253 - protein, 13 aa, Mycobacterium tuberculosis
WSRYLSADDETPE

SEQ ID NO: 93254 - protein, 13 aa, Mycobacterium tuberculosis
SRYLSADDETPEE

SEQ ID NO: 93255 - protein, 13 aa, Mycobacterium tuberculosis
RYLSADDETPEER

SEQ ID NO: 93256 - protein, 13 aa, Mycobacterium tuberculosis
YLSADDETPEERD

SEQ ID NO: 93257 - protein, 13 aa, Mycobacterium tuberculosis
LSADDETPEERDL

SEQ ID NO: 93258 - protein, 13 aa, Mycobacterium tuberculosis
SADDETPEERDLS

SEQ ID NO: 93259 - protein, 13 aa, Mycobacterium tuberculosis
ADDETPEERDLSV

SEQ ID NO: 93260 - protein, 13 aa, Mycobacterium tuberculosis
DDETPEERDLSVS

SEQ ID NO: 93261 - protein, 13 aa, Mycobacterium tuberculosis
DETPEERDLSVSA

SEQ ID NO: 93262 - protein, 13 aa, Mycobacterium tuberculosis
ETPEERDLSVSAV

SEQ ID NO: 93263 - protein, 13 aa, Mycobacterium tuberculosis
TPEERDLSVSAVS

SEQ ID NO: 93264 - protein, 13 aa, Mycobacterium tuberculosis
PEERDLSVSAVSA

SEQ ID NO: 93265 - protein, 13 aa, Mycobacterium tuberculosis
EERDLSVSAVSAV

SEQ ID NO: 93266 - protein, 13 aa, Mycobacterium tuberculosis
ERDLSVSAVSAVS

SEQ ID NO: 93267 - protein, 13 aa, Mycobacterium tuberculosis
RDLSVSAVSAVSP

SEQ ID NO: 93268 - protein, 13 aa, Mycobacterium tuberculosis
DLSVSAVSAVSPP

SEQ ID NO: 93269 - protein, 13 aa, Mycobacterium tuberculosis
LSVSAVSAVSPPV

SEQ ID NO: 93270 - protein, 13 aa, Mycobacterium tuberculosis
SVSAVSAVSPPVG

SEQ ID NO: 93271 - protein, 13 aa, Mycobacterium tuberculosis
VSAVSAVSPPVGD

SEQ ID NO: 93272 - protein, 13 aa, Mycobacterium tuberculosis
SAVSAVSPPVGDP

SEQ ID NO: 93273 - protein, 13 aa, Mycobacterium tuberculosis
AVSAVSPPVGDPG

SEQ ID NO: 93274 - protein, 13 aa, Mycobacterium tuberculosis
VSAVSPPVGDPGD

SEQ ID NO: 93275 - protein, 13 aa, Mycobacterium tuberculosis
SAVSPPVGDPGDA

SEQ ID NO: 93276 - protein, 13 aa, Mycobacterium tuberculosis
AVSPPVGDPGDAT

SEQ ID NO: 93277 - protein, 13 aa, Mycobacterium tuberculosis
VSPPVGDPGDATG

SEQ ID NO: 93278 - protein, 13 aa, Mycobacterium tuberculosis
SPPVGDPGDATGA

SEQ ID NO: 93279 - protein, 13 aa, Mycobacterium tuberculosis
PPVGDPGDATGAT

SEQ ID NO: 93280 - protein, 13 aa, Mycobacterium tuberculosis
PVGDPGDATGATD

SEQ ID NO: 93281 - protein, 13 aa, Mycobacterium tuberculosis
VGDPGDATGATDA

SEQ ID NO: 93282 - protein, 13 aa, Mycobacterium tuberculosis
GDPGDATGATDAT

SEQ ID NO: 93283 - protein, 13 aa, Mycobacterium tuberculosis
DPGDATGATDATD

SEQ ID NO: 93284 - protein, 13 aa, Mycobacterium tuberculosis
PGDATGATDATDL

SEQ ID NO: 93285 - protein, 13 aa, Mycobacterium tuberculosis
GDATGATDATDLP

SEQ ID NO: 93286 - protein, 13 aa, Mycobacterium tuberculosis
DATGATDATDLPE

SEQ ID NO: 93287 - protein, 13 aa, Mycobacterium tuberculosis
ATGATDATDLPEA

SEQ ID NO: 93288 - protein, 13 aa, Mycobacterium tuberculosis
TGATDATDLPEAG

SEQ ID NO: 93289 - protein, 13 aa, Mycobacterium tuberculosis
GATDATDLPEAGD

SEQ ID NO: 93290 - protein, 13 aa, Mycobacterium tuberculosis
ATDATDLPEAGDL

SEQ ID NO: 93291 - protein, 13 aa, Mycobacterium tuberculosis
TDATDLPEAGDLP

SEQ ID NO: 93292 - protein, 13 aa, Mycobacterium tuberculosis
DATDLPEAGDLPY

SEQ ID NO: 93293 - protein, 13 aa, Mycobacterium tuberculosis
ATDLPEAGDLPYE

SEQ ID NO: 93294 - protein, 13 aa, Mycobacterium tuberculosis
TDLPEAGDLPYEP

SEQ ID NO: 93295 - protein, 13 aa, Mycobacterium tuberculosis
DLPEAGDLPYEPP

SEQ ID NO: 93296 - protein, 13 aa, Mycobacterium tuberculosis
LPEAGDLPYEPPA

SEQ ID NO: 93297 - protein, 13 aa, Mycobacterium tuberculosis
PEAGDLPYEPPAP

SEQ ID NO: 93298 - protein, 13 aa, Mycobacterium tuberculosis
EAGDLPYEPPAPN

SEQ ID NO: 93299 - protein, 13 aa, Mycobacterium tuberculosis
AGDLPYEPPAPNG

SEQ ID NO: 93300 - protein, 13 aa, Mycobacterium tuberculosis
GDLPYEPPAPNGH

SEQ ID NO: 93301 - protein, 13 aa, Mycobacterium tuberculosis
DLPYEPPAPNGHP

SEQ ID NO: 93302 - protein, 13 aa, Mycobacterium tuberculosis
LPYEPPAPNGHPN

SEQ ID NO: 93303 - protein, 13 aa, Mycobacterium tuberculosis
PYEPPAPNGHPNG

SEQ ID NO: 93304 - protein, 13 aa, Mycobacterium tuberculosis
YEPPAPNGHPNGD

SEQ ID NO: 93305 - protein, 13 aa, Mycobacterium tuberculosis
EPPAPNGHPNGDA

SEQ ID NO: 93306 - protein, 13 aa, Mycobacterium tuberculosis
PPAPNGHPNGDAP

SEQ ID NO: 93307 - protein, 13 aa, Mycobacterium tuberculosis
PAPNGHPNGDAPL

SEQ ID NO: 93308 - protein, 13 aa, Mycobacterium tuberculosis
APNGHPNGDAPLC

SEQ ID NO: 93309 - protein, 13 aa, Mycobacterium tuberculosis
PNGHPNGDAPLCS

SEQ ID NO: 93310 - protein, 13 aa, Mycobacterium tuberculosis
NGHPNGDAPLCSG

SEQ ID NO: 93311 - protein, 13 aa, Mycobacterium tuberculosis
GHPNGDAPLCSGP

SEQ ID NO: 93312 - protein, 13 aa, Mycobacterium tuberculosis
HPNGDAPLCSGPG

SEQ ID NO: 93313 - protein, 13 aa, Mycobacterium tuberculosis
PNGDAPLCSGPGC

SEQ ID NO: 93314 - protein, 13 aa, Mycobacterium tuberculosis
NGDAPLCSGPGCP

SEQ ID NO: 93315 - protein, 13 aa, Mycobacterium tuberculosis
GDAPLCSGPGCPN

SEQ ID NO: 93316 - protein, 13 aa, Mycobacterium tuberculosis
DAPLCSGPGCPNK

SEQ ID NO: 93317 - protein, 13 aa, Mycobacterium tuberculosis
APLCSGPGCPNKL

SEQ ID NO: 93318 - protein, 13 aa, Mycobacterium tuberculosis
PLCSGPGCPNKLL

SEQ ID NO: 93319 - protein, 13 aa, Mycobacterium tuberculosis
LCSGPGCPNKLLS

SEQ ID NO: 93320 - protein, 13 aa, Mycobacterium tuberculosis
CSGPGCPNKLLST

SEQ ID NO: 93321 - protein, 13 aa, Mycobacterium tuberculosis
SGPGCPNKLLSTE

SEQ ID NO: 93322 - protein, 13 aa, Mycobacterium tuberculosis
GPGCPNKLLSTEA

SEQ ID NO: 93323 - protein, 13 aa, Mycobacterium tuberculosis
PGCPNKLLSTEAK

SEQ ID NO: 93324 - protein, 13 aa, Mycobacterium tuberculosis
GCPNKLLSTEAKA

SEQ ID NO: 93325 - protein, 13 aa, Mycobacterium tuberculosis
CPNKLLSTEAKAA

SEQ ID NO: 93326 - protein, 13 aa, Mycobacterium tuberculosis
PNKLLSTEAKAAG

SEQ ID NO: 93327 - protein, 13 aa, Mycobacterium tuberculosis
NKLLSTEAKAAGK

SEQ ID NO: 93328 - protein, 13 aa, Mycobacterium tuberculosis
KLLSTEAKAAGKC

SEQ ID NO: 93329 - protein, 13 aa, Mycobacterium tuberculosis
LLSTEAKAAGKCR

SEQ ID NO: 93330 - protein, 13 aa, Mycobacterium tuberculosis
LSTEAKAAGKCRP

SEQ ID NO: 93331 - protein, 13 aa, Mycobacterium tuberculosis
STEAKAAGKCRPC

SEQ ID NO: 93332 - protein, 13 aa, Mycobacterium tuberculosis
TEAKAAGKCRPCR

SEQ ID NO: 93333 - protein, 13 aa, Mycobacterium tuberculosis
EAKAAGKCRPCRG

SEQ ID NO: 93334 - protein, 13 aa, Mycobacterium tuberculosis
AKAAGKCRPCRGR

SEQ ID NO: 93335 - protein, 13 aa, Mycobacterium tuberculosis
KAAGKCRPCRGRA

SEQ ID NO: 93336 - protein, 13 aa, Mycobacterium tuberculosis
AAGKCRPCRGRAA

SEQ ID NO: 93337 - protein, 13 aa, Mycobacterium tuberculosis
AGKCRPCRGRAAA

SEQ ID NO: 93338 - protein, 13 aa, Mycobacterium tuberculosis
GKCRPCRGRAAAS

SEQ ID NO: 93339 - protein, 13 aa, Mycobacterium tuberculosis
KCRPCRGRAAASA

SEQ ID NO: 93340 - protein, 13 aa, Mycobacterium tuberculosis
CRPCRGRAAASAR

SEQ ID NO: 93341 - protein, 13 aa, Mycobacterium tuberculosis
RPCRGRAAASARD

SEQ ID NO: 93342 - protein, 13 aa, Mycobacterium tuberculosis
PCRGRAAASARDG

SEQ ID NO: 93343 - protein, 13 aa, Mycobacterium tuberculosis
CRGRAAASARDGA

SEQ ID NO: 93344 - protein, 13 aa, Mycobacterium tuberculosis
RGRAAASARDGAR

SEQ ID NO: 93345 - protein, 14 aa, Mycobacterium tuberculosis
MADIPYGRDYPDPI

SEQ ID NO: 93346 - protein, 14 aa, Mycobacterium tuberculosis
ADIPYGRDYPDPIW

SEQ ID NO: 93347 - protein, 14 aa, Mycobacterium tuberculosis
DIPYGRDYPDPIWC

SEQ ID NO: 93348 - protein, 14 aa, Mycobacterium tuberculosis
IPYGRDYPDPIWCD

SEQ ID NO: 93349 - protein, 14 aa, Mycobacterium tuberculosis
PYGRDYPDPIWCDE

SEQ ID NO: 93350 - protein, 14 aa, Mycobacterium tuberculosis
YGRDYPDPIWCDED

SEQ ID NO: 93351 - protein, 14 aa, Mycobacterium tuberculosis
GRDYPDPIWCDEDG

SEQ ID NO: 93352 - protein, 14 aa, Mycobacterium tuberculosis
RDYPDPIWCDEDGQ

SEQ ID NO: 93353 - protein, 14 aa, Mycobacterium tuberculosis
DYPDPIWCDEDGQP

SEQ ID NO: 93354 - protein, 14 aa, Mycobacterium tuberculosis
YPDPIWCDEDGQPM

SEQ ID NO: 93355 - protein, 14 aa, Mycobacterium tuberculosis
PDPIWCDEDGQPMP

SEQ ID NO: 93356 - protein, 14 aa, Mycobacterium tuberculosis
DPIWCDEDGQPMPP

SEQ ID NO: 93357 - protein, 14 aa, Mycobacterium tuberculosis
PIWCDEDGQPMPPV

SEQ ID NO: 93358 - protein, 14 aa, Mycobacterium tuberculosis
IWCDEDGQPMPPVG

SEQ ID NO: 93359 - protein, 14 aa, Mycobacterium tuberculosis
WCDEDGQPMPPVGA

SEQ ID NO: 93360 - protein, 14 aa, Mycobacterium tuberculosis
CDEDGQPMPPVGAE

SEQ ID NO: 93361 - protein, 14 aa, Mycobacterium tuberculosis
DEDGQPMPPVGAEL

SEQ ID NO: 93362 - protein, 14 aa, Mycobacterium tuberculosis
EDGQPMPPVGAELL

SEQ ID NO: 93363 - protein, 14 aa, Mycobacterium tuberculosis
DGQPMPPVGAELLD

SEQ ID NO: 93364 - protein, 14 aa, Mycobacterium tuberculosis
GQPMPPVGAELLDD

SEQ ID NO: 93365 - protein, 14 aa, Mycobacterium tuberculosis
QPMPPVGAELLDDI

SEQ ID NO: 93366 - protein, 14 aa, Mycobacterium tuberculosis
PMPPVGAELLDDIR

SEQ ID NO: 93367 - protein, 14 aa, Mycobacterium tuberculosis
MPPVGAELLDDIRA

SEQ ID NO: 93368 - protein, 14 aa, Mycobacterium tuberculosis
PPVGAELLDDIRAF

SEQ ID NO: 93369 - protein, 14 aa, Mycobacterium tuberculosis
PVGAELLDDIRAFL

SEQ ID NO: 93370 - protein, 14 aa, Mycobacterium tuberculosis
VGAELLDDIRAFLR

SEQ ID NO: 93371 - protein, 14 aa, Mycobacterium tuberculosis
GAELLDDIRAFLRR

SEQ ID NO: 93372 - protein, 14 aa, Mycobacterium tuberculosis
AELLDDIRAFLRRF

SEQ ID NO: 93373 - protein, 14 aa, Mycobacterium tuberculosis
ELLDDIRAFLRRFV

SEQ ID NO: 93374 - protein, 14 aa, Mycobacterium tuberculosis
LLDDIRAFLRRFVV

SEQ ID NO: 93375 - protein, 14 aa, Mycobacterium tuberculosis
LDDIRAFLRRFVVY

SEQ ID NO: 93376 - protein, 14 aa, Mycobacterium tuberculosis
DDIRAFLRRFVVYP

SEQ ID NO: 93377 - protein, 14 aa, Mycobacterium tuberculosis
DIRAFLRRFVVYPS

SEQ ID NO: 93378 - protein, 14 aa, Mycobacterium tuberculosis
IRAFLRRFVVYPSD

SEQ ID NO: 93379 - protein, 14 aa, Mycobacterium tuberculosis
RAFLRRFVVYPSDH

SEQ ID NO: 93380 - protein, 14 aa, Mycobacterium tuberculosis
AFLRRFVVYPSDHE

SEQ ID NO: 93381 - protein, 14 aa, Mycobacterium tuberculosis
FLRRFVVYPSDHEL

SEQ ID NO: 93382 - protein, 14 aa, Mycobacterium tuberculosis
LRRFVVYPSDHELI

SEQ ID NO: 93383 - protein, 14 aa, Mycobacterium tuberculosis
RRFVVYPSDHELIA

SEQ ID NO: 93384 - protein, 14 aa, Mycobacterium tuberculosis
RFVVYPSDHELIAH

SEQ ID NO: 93385 - protein, 14 aa, Mycobacterium tuberculosis
FVVYPSDHELIAHT

SEQ ID NO: 93386 - protein, 14 aa, Mycobacterium tuberculosis
VVYPSDHELIAHTL

SEQ ID NO: 93387 - protein, 14 aa, Mycobacterium tuberculosis
VYPSDHELIAHTLW

SEQ ID NO: 93388 - protein, 14 aa, Mycobacterium tuberculosis
YPSDHELIAHTLWI

SEQ ID NO: 93389 - protein, 14 aa, Mycobacterium tuberculosis
PSDHELIAHTLWIA

SEQ ID NO: 93390 - protein, 14 aa, Mycobacterium tuberculosis
SDHELIAHTLWIAH

SEQ ID NO: 93391 - protein, 14 aa, Mycobacterium tuberculosis
DHELIAHTLWIAHC

SEQ ID NO: 93392 - protein, 14 aa, Mycobacterium tuberculosis
HELIAHTLWIAHCW

SEQ ID NO: 93393 - protein, 14 aa, Mycobacterium tuberculosis
ELIAHTLWIAHCWF

SEQ ID NO: 93394 - protein, 14 aa, Mycobacterium tuberculosis
LIAHTLWIAHCWFM

SEQ ID NO: 93395 - protein, 14 aa, Mycobacterium tuberculosis
IAHTLWIAHCWFME

SEQ ID NO: 93396 - protein, 14 aa, Mycobacterium tuberculosis
AHTLWIAHCWFMEA

SEQ ID NO: 93397 - protein, 14 aa, Mycobacterium tuberculosis
HTLWIAHCWFMEAW

SEQ ID NO: 93398 - protein, 14 aa, Mycobacterium tuberculosis
TLWIAHCWFMEAWD

SEQ ID NO: 93399 - protein, 14 aa, Mycobacterium tuberculosis
LWIAHCWFMEAWDS

SEQ ID NO: 93400 - protein, 14 aa, Mycobacterium tuberculosis
WIAHCWFMEAWDST

SEQ ID NO: 93401 - protein, 14 aa, Mycobacterium tuberculosis
IAHCWFMEAWDSTP

SEQ ID NO: 93402 - protein, 14 aa, Mycobacterium tuberculosis
AHCWFMEAWDSTPR

SEQ ID NO: 93403 - protein, 14 aa, Mycobacterium tuberculosis
HCWFMEAWDSTPRI

SEQ ID NO: 93404 - protein, 14 aa, Mycobacterium tuberculosis
CWFMEAWDSTPRIA

SEQ ID NO: 93405 - protein, 14 aa, Mycobacterium tuberculosis
WFMEAWDSTPRIAF

SEQ ID NO: 93406 - protein, 14 aa, Mycobacterium tuberculosis
FMEAWDSTPRIAFL

SEQ ID NO: 93407 - protein, 14 aa, Mycobacterium tuberculosis
MEAWDSTPRIAFLS

SEQ ID NO: 93408 - protein, 14 aa, Mycobacterium tuberculosis
EAWDSTPRIAFLSP

SEQ ID NO: 93409 - protein, 14 aa, Mycobacterium tuberculosis
AWDSTPRIAFLSPE

SEQ ID NO: 93410 - protein, 14 aa, Mycobacterium tuberculosis
WDSTPRIAFLSPEP

SEQ ID NO: 93411 - protein, 14 aa, Mycobacterium tuberculosis
DSTPRIAFLSPEPG

SEQ ID NO: 93412 - protein, 14 aa, Mycobacterium tuberculosis
STPRIAFLSPEPGS

SEQ ID NO: 93413 - protein, 14 aa, Mycobacterium tuberculosis
TPRIAFLSPEPGSG

SEQ ID NO: 93414 - protein, 14 aa, Mycobacterium tuberculosis
PRIAFLSPEPGSGK

SEQ ID NO: 93415 - protein, 14 aa, Mycobacterium tuberculosis
RIAFLSPEPGSGKS

SEQ ID NO: 93416 - protein, 14 aa, Mycobacterium tuberculosis
IAFLSPEPGSGKSR

SEQ ID NO: 93417 - protein, 14 aa, Mycobacterium tuberculosis
AFLSPEPGSGKSRA

SEQ ID NO: 93418 - protein, 14 aa, Mycobacterium tuberculosis
FLSPEPGSGKSRAL

SEQ ID NO: 93419 - protein, 14 aa, Mycobacterium tuberculosis
LSPEPGSGKSRALE

SEQ ID NO: 93420 - protein, 14 aa, Mycobacterium tuberculosis
SPEPGSGKSRALEV

SEQ ID NO: 93421 - protein, 14 aa, Mycobacterium tuberculosis
PEPGSGKSRALEVT

SEQ ID NO: 93422 - protein, 14 aa, Mycobacterium tuberculosis
EPGSGKSRALEVTE

SEQ ID NO: 93423 - protein, 14 aa, Mycobacterium tuberculosis
PGSGKSRALEVTEP

SEQ ID NO: 93424 - protein, 14 aa, Mycobacterium tuberculosis
GSGKSRALEVTEPL

SEQ ID NO: 93425 - protein, 14 aa, Mycobacterium tuberculosis
SGKSRALEVTEPLV

SEQ ID NO: 93426 - protein, 14 aa, Mycobacterium tuberculosis
GKSRALEVTEPLVP

SEQ ID NO: 93427 - protein, 14 aa, Mycobacterium tuberculosis
KSRALEVTEPLVPR

SEQ ID NO: 93428 - protein, 14 aa, Mycobacterium tuberculosis
SRALEVTEPLVPRP

SEQ ID NO: 93429 - protein, 14 aa, Mycobacterium tuberculosis
RALEVTEPLVPRPV

SEQ ID NO: 93430 - protein, 14 aa, Mycobacterium tuberculosis
ALEVTEPLVPRPVH

SEQ ID NO: 93431 - protein, 14 aa, Mycobacterium tuberculosis
LEVTEPLVPRPVHA

SEQ ID NO: 93432 - protein, 14 aa, Mycobacterium tuberculosis
EVTEPLVPRPVHAI

SEQ ID NO: 93433 - protein, 14 aa, Mycobacterium tuberculosis
VTEPLVPRPVHAIN

SEQ ID NO: 93434 - protein, 14 aa, Mycobacterium tuberculosis
TEPLVPRPVHAINC

SEQ ID NO: 93435 - protein, 14 aa, Mycobacterium tuberculosis
EPLVPRPVHAINCT

SEQ ID NO: 93436 - protein, 14 aa, Mycobacterium tuberculosis
PLVPRPVHAINCTP

SEQ ID NO: 93437 - protein, 14 aa, Mycobacterium tuberculosis
LVPRPVHAINCTPA

SEQ ID NO: 93438 - protein, 14 aa, Mycobacterium tuberculosis
VPRPVHAINCTPAY

SEQ ID NO: 93439 - protein, 14 aa, Mycobacterium tuberculosis
PRPVHAINCTPAYL

SEQ ID NO: 93440 - protein, 14 aa, Mycobacterium tuberculosis
RPVHAINCTPAYLF

SEQ ID NO: 93441 - protein, 14 aa, Mycobacterium tuberculosis
PVHAINCTPAYLFR

SEQ ID NO: 93442 - protein, 14 aa, Mycobacterium tuberculosis
VHAINCTPAYLFRR

SEQ ID NO: 93443 - protein, 14 aa, Mycobacterium tuberculosis
HAINCTPAYLFRRV

SEQ ID NO: 93444 - protein, 14 aa, Mycobacterium tuberculosis
AINCTPAYLFRRVA

SEQ ID NO: 93445 - protein, 14 aa, Mycobacterium tuberculosis
INCTPAYLFRRVAD

SEQ ID NO: 93446 - protein, 14 aa, Mycobacterium tuberculosis
NCTPAYLFRRVADP

SEQ ID NO: 93447 - protein, 14 aa, Mycobacterium tuberculosis
CTPAYLFRRVADPV

SEQ ID NO: 93448 - protein, 14 aa, Mycobacterium tuberculosis
TPAYLFRRVADPVG

SEQ ID NO: 93449 - protein, 14 aa, Mycobacterium tuberculosis
PAYLFRRVADPVGR

SEQ ID NO: 93450 - protein, 14 aa, Mycobacterium tuberculosis
AYLFRRVADPVGRP

SEQ ID NO: 93451 - protein, 14 aa, Mycobacterium tuberculosis
YLFRRVADPVGRPT

SEQ ID NO: 93452 - protein, 14 aa, Mycobacterium tuberculosis
LFRRVADPVGRPTV

SEQ ID NO: 93453 - protein, 14 aa, Mycobacterium tuberculosis
FRRVADPVGRPTVL

SEQ ID NO: 93454 - protein, 14 aa, Mycobacterium tuberculosis
RRVADPVGRPTVLY

SEQ ID NO: 93455 - protein, 14 aa, Mycobacterium tuberculosis
RVADPVGRPTVLYD

SEQ ID NO: 93456 - protein, 14 aa, Mycobacterium tuberculosis
VADPVGRPTVLYDE

SEQ ID NO: 93457 - protein, 14 aa, Mycobacterium tuberculosis
ADPVGRPTVLYDEC

SEQ ID NO: 93458 - protein, 14 aa, Mycobacterium tuberculosis
DPVGRPTVLYDECD

SEQ ID NO: 93459 - protein, 14 aa, Mycobacterium tuberculosis
PVGRPTVLYDECDT

SEQ ID NO: 93460 - protein, 14 aa, Mycobacterium tuberculosis
VGRPTVLYDECDTL

SEQ ID NO: 93461 - protein, 14 aa, Mycobacterium tuberculosis
GRPTVLYDECDTLF

SEQ ID NO: 93462 - protein, 14 aa, Mycobacterium tuberculosis
RPTVLYDECDTLFG

SEQ ID NO: 93463 - protein, 14 aa, Mycobacterium tuberculosis
PTVLYDECDTLFGP

SEQ ID NO: 93464 - protein, 14 aa, Mycobacterium tuberculosis
TVLYDECDTLFGPK

SEQ ID NO: 93465 - protein, 14 aa, Mycobacterium tuberculosis
VLYDECDTLFGPKA

SEQ ID NO: 93466 - protein, 14 aa, Mycobacterium tuberculosis
LYDECDTLFGPKAK

SEQ ID NO: 93467 - protein, 14 aa, Mycobacterium tuberculosis
YDECDTLFGPKAKE

SEQ ID NO: 93468 - protein, 14 aa, Mycobacterium tuberculosis
DECDTLFGPKAKEH

SEQ ID NO: 93469 - protein, 14 aa, Mycobacterium tuberculosis
ECDTLFGPKAKEHE

SEQ ID NO: 93470 - protein, 14 aa, Mycobacterium tuberculosis
CDTLFGPKAKEHEE

SEQ ID NO: 93471 - protein, 14 aa, Mycobacterium tuberculosis
DTLFGPKAKEHEEI

SEQ ID NO: 93472 - protein, 14 aa, Mycobacterium tuberculosis
TLFGPKAKEHEEIR

SEQ ID NO: 93473 - protein, 14 aa, Mycobacterium tuberculosis
LFGPKAKEHEEIRG

SEQ ID NO: 93474 - protein, 14 aa, Mycobacterium tuberculosis
FGPKAKEHEEIRGV

SEQ ID NO: 93475 - protein, 14 aa, Mycobacterium tuberculosis
GPKAKEHEEIRGVI

SEQ ID NO: 93476 - protein, 14 aa, Mycobacterium tuberculosis
PKAKEHEEIRGVIN

SEQ ID NO: 93477 - protein, 14 aa, Mycobacterium tuberculosis
KAKEHEEIRGVINA

SEQ ID NO: 93478 - protein, 14 aa, Mycobacterium tuberculosis
AKEHEEIRGVINAG

SEQ ID NO: 93479 - protein, 14 aa, Mycobacterium tuberculosis
KEHEEIRGVINAGH

SEQ ID NO: 93480 - protein, 14 aa, Mycobacterium tuberculosis
EHEEIRGVINAGHR

SEQ ID NO: 93481 - protein, 14 aa, Mycobacterium tuberculosis
HEEIRGVINAGHRK

SEQ ID NO: 93482 - protein, 14 aa, Mycobacterium tuberculosis
EEIRGVINAGHRKG

SEQ ID NO: 93483 - protein, 14 aa, Mycobacterium tuberculosis
EIRGVINAGHRKGA

SEQ ID NO: 93484 - protein, 14 aa, Mycobacterium tuberculosis
IRGVINAGHRKGAV

SEQ ID NO: 93485 - protein, 14 aa, Mycobacterium tuberculosis
RGVINAGHRKGAVA

SEQ ID NO: 93486 - protein, 14 aa, Mycobacterium tuberculosis
GVINAGHRKGAVAG

SEQ ID NO: 93487 - protein, 14 aa, Mycobacterium tuberculosis
VINAGHRKGAVAGR

SEQ ID NO: 93488 - protein, 14 aa, Mycobacterium tuberculosis
INAGHRKGAVAGRC

SEQ ID NO: 93489 - protein, 14 aa, Mycobacterium tuberculosis
NAGHRKGAVAGRCV

SEQ ID NO: 93490 - protein, 14 aa, Mycobacterium tuberculosis
AGHRKGAVAGRCVI

SEQ ID NO: 93491 - protein, 14 aa, Mycobacterium tuberculosis
GHRKGAVAGRCVIR

SEQ ID NO: 93492 - protein, 14 aa, Mycobacterium tuberculosis
HRKGAVAGRCVIRG

SEQ ID NO: 93493 - protein, 14 aa, Mycobacterium tuberculosis
RKGAVAGRCVIRGK

SEQ ID NO: 93494 - protein, 14 aa, Mycobacterium tuberculosis
KGAVAGRCVIRGKI

SEQ ID NO: 93495 - protein, 14 aa, Mycobacterium tuberculosis
GAVAGRCVIRGKIV

SEQ ID NO: 93496 - protein, 14 aa, Mycobacterium tuberculosis
AVAGRCVIRGKIVE

SEQ ID NO: 93497 - protein, 14 aa, Mycobacterium tuberculosis
VAGRCVIRGKIVET

SEQ ID NO: 93498 - protein, 14 aa, Mycobacterium tuberculosis
AGRCVIRGKIVETE

SEQ ID NO: 93499 - protein, 14 aa, Mycobacterium tuberculosis
GRCVIRGKIVETEE

SEQ ID NO: 93500 - protein, 14 aa, Mycobacterium tuberculosis
RCVIRGKIVETEEL

SEQ ID NO: 93501 - protein, 14 aa, Mycobacterium tuberculosis
CVIRGKIVETEELP

SEQ ID NO: 93502 - protein, 14 aa, Mycobacterium tuberculosis
VIRGKIVETEELPA

SEQ ID NO: 93503 - protein, 14 aa, Mycobacterium tuberculosis
IRGKIVETEELPAY

SEQ ID NO: 93504 - protein, 14 aa, Mycobacterium tuberculosis
RGKIVETEELPAYC

SEQ ID NO: 93505 - protein, 14 aa, Mycobacterium tuberculosis
GKIVETEELPAYCA

SEQ ID NO: 93506 - protein, 14 aa, Mycobacterium tuberculosis
KIVETEELPAYCAV

SEQ ID NO: 93507 - protein, 14 aa, Mycobacterium tuberculosis
IVETEELPAYCAVA

SEQ ID NO: 93508 - protein, 14 aa, Mycobacterium tuberculosis
VETEELPAYCAVAL

SEQ ID NO: 93509 - protein, 14 aa, Mycobacterium tuberculosis
ETEELPAYCAVALA

SEQ ID NO: 93510 - protein, 14 aa, Mycobacterium tuberculosis
TEELPAYCAVALAG

SEQ ID NO: 93511 - protein, 14 aa, Mycobacterium tuberculosis
EELPAYCAVALAGL

SEQ ID NO: 93512 - protein, 14 aa, Mycobacterium tuberculosis
ELPAYCAVALAGLD

SEQ ID NO: 93513 - protein, 14 aa, Mycobacterium tuberculosis
LPAYCAVALAGLDD

SEQ ID NO: 93514 - protein, 14 aa, Mycobacterium tuberculosis
PAYCAVALAGLDDL

SEQ ID NO: 93515 - protein, 14 aa, Mycobacterium tuberculosis
AYCAVALAGLDDLP

SEQ ID NO: 93516 - protein, 14 aa, Mycobacterium tuberculosis
YCAVALAGLDDLPD

SEQ ID NO: 93517 - protein, 14 aa, Mycobacterium tuberculosis
CAVALAGLDDLPDT

SEQ ID NO: 93518 - protein, 14 aa, Mycobacterium tuberculosis
AVALAGLDDLPDTI

SEQ ID NO: 93519 - protein, 14 aa, Mycobacterium tuberculosis
VALAGLDDLPDTIM

SEQ ID NO: 93520 - protein, 14 aa, Mycobacterium tuberculosis
ALAGLDDLPDTIMS

SEQ ID NO: 93521 - protein, 14 aa, Mycobacterium tuberculosis
LAGLDDLPDTIMSR

SEQ ID NO: 93522 - protein, 14 aa, Mycobacterium tuberculosis
AGLDDLPDTIMSRS

SEQ ID NO: 93523 - protein, 14 aa, Mycobacterium tuberculosis
GLDDLPDTIMSRSI

SEQ ID NO: 93524 - protein, 14 aa, Mycobacterium tuberculosis
LDDLPDTIMSRSIV

SEQ ID NO: 93525 - protein, 14 aa, Mycobacterium tuberculosis
DDLPDTIMSRSIVV

SEQ ID NO: 93526 - protein, 14 aa, Mycobacterium tuberculosis
DLPDTIMSRSIVVR

SEQ ID NO: 93527 - protein, 14 aa, Mycobacterium tuberculosis
LPDTIMSRSIVVRM

SEQ ID NO: 93528 - protein, 14 aa, Mycobacterium tuberculosis
PDTIMSRSIVVRMR

SEQ ID NO: 93529 - protein, 14 aa, Mycobacterium tuberculosis
DTIMSRSIVVRMRR

SEQ ID NO: 93530 - protein, 14 aa, Mycobacterium tuberculosis
TIMSRSIVVRMRRR

SEQ ID NO: 93531 - protein, 14 aa, Mycobacterium tuberculosis
IMSRSIVVRMRRRA

SEQ ID NO: 93532 - protein, 14 aa, Mycobacterium tuberculosis
MSRSIVVRMRRRAP

SEQ ID NO: 93533 - protein, 14 aa, Mycobacterium tuberculosis
SRSIVVRMRRRAPT

SEQ ID NO: 93534 - protein, 14 aa, Mycobacterium tuberculosis
RSIVVRMRRRAPTE

SEQ ID NO: 93535 - protein, 14 aa, Mycobacterium tuberculosis
SIVVRMRRRAPTEP

SEQ ID NO: 93536 - protein, 14 aa, Mycobacterium tuberculosis
IVVRMRRRAPTEPV

SEQ ID NO: 93537 - protein, 14 aa, Mycobacterium tuberculosis
VVRMRRRAPTEPVE

SEQ ID NO: 93538 - protein, 14 aa, Mycobacterium tuberculosis
VRMRRRAPTEPVEP

SEQ ID NO: 93539 - protein, 14 aa, Mycobacterium tuberculosis
RMRRRAPTEPVEPW

SEQ ID NO: 93540 - protein, 14 aa, Mycobacterium tuberculosis
MRRRAPTEPVEPWR

SEQ ID NO: 93541 - protein, 14 aa, Mycobacterium tuberculosis
RRRAPTEPVEPWRP

SEQ ID NO: 93542 - protein, 14 aa, Mycobacterium tuberculosis
RRAPTEPVEPWRPR

SEQ ID NO: 93543 - protein, 14 aa, Mycobacterium tuberculosis
RAPTEPVEPWRPRV

SEQ ID NO: 93544 - protein, 14 aa, Mycobacterium tuberculosis
APTEPVEPWRPRVN

SEQ ID NO: 93545 - protein, 14 aa, Mycobacterium tuberculosis
PTEPVEPWRPRVNG

SEQ ID NO: 93546 - protein, 14 aa, Mycobacterium tuberculosis
TEPVEPWRPRVNGP

SEQ ID NO: 93547 - protein, 14 aa, Mycobacterium tuberculosis
EPVEPWRPRVNGPE

SEQ ID NO: 93548 - protein, 14 aa, Mycobacterium tuberculosis
PVEPWRPRVNGPEA

SEQ ID NO: 93549 - protein, 14 aa, Mycobacterium tuberculosis
VEPWRPRVNGPEAE

SEQ ID NO: 93550 - protein, 14 aa, Mycobacterium tuberculosis
EPWRPRVNGPEAEK

SEQ ID NO: 93551 - protein, 14 aa, Mycobacterium tuberculosis
PWRPRVNGPEAEKL

SEQ ID NO: 93552 - protein, 14 aa, Mycobacterium tuberculosis
WRPRVNGPEAEKLH

SEQ ID NO: 93553 - protein, 14 aa, Mycobacterium tuberculosis
RPRVNGPEAEKLHD

SEQ ID NO: 93554 - protein, 14 aa, Mycobacterium tuberculosis
PRVNGPEAEKLHDR

SEQ ID NO: 93555 - protein, 14 aa, Mycobacterium tuberculosis
RVNGPEAEKLHDRL

SEQ ID NO: 93556 - protein, 14 aa, Mycobacterium tuberculosis
VNGPEAEKLHDRLA

SEQ ID NO: 93557 - protein, 14 aa, Mycobacterium tuberculosis
NGPEAEKLHDRLAN

SEQ ID NO: 93558 - protein, 14 aa, Mycobacterium tuberculosis
GPEAEKLHDRLANW

SEQ ID NO: 93559 - protein, 14 aa, Mycobacterium tuberculosis
PEAEKLHDRLANWA

SEQ ID NO: 93560 - protein, 14 aa, Mycobacterium tuberculosis
EAEKLHDRLANWAA

SEQ ID NO: 93561 - protein, 14 aa, Mycobacterium tuberculosis
AEKLHDRLANWAAA

SEQ ID NO: 93562 - protein, 14 aa, Mycobacterium tuberculosis
EKLHDRLANWAAAI

SEQ ID NO: 93563 - protein, 14 aa, Mycobacterium tuberculosis
KLHDRLANWAAAIN

SEQ ID NO: 93564 - protein, 14 aa, Mycobacterium tuberculosis
LHDRLANWAAAINP

SEQ ID NO: 93565 - protein, 14 aa, Mycobacterium tuberculosis
HDRLANWAAAINPL

SEQ ID NO: 93566 - protein, 14 aa, Mycobacterium tuberculosis
DRLANWAAAINPLE

SEQ ID NO: 93567 - protein, 14 aa, Mycobacterium tuberculosis
RLANWAAAINPLES

SEQ ID NO: 93568 - protein, 14 aa, Mycobacterium tuberculosis
LANWAAAINPLESG

SEQ ID NO: 93569 - protein, 14 aa, Mycobacterium tuberculosis
ANWAAAINPLESGW

SEQ ID NO: 93570 - protein, 14 aa, Mycobacterium tuberculosis
NWAAAINPLESGWP

SEQ ID NO: 93571 - protein, 14 aa, Mycobacterium tuberculosis
WAAAINPLESGWPA

SEQ ID NO: 93572 - protein, 14 aa, Mycobacterium tuberculosis
AAAINPLESGWPAM

SEQ ID NO: 93573 - protein, 14 aa, Mycobacterium tuberculosis
AAINPLESGWPAMP

SEQ ID NO: 93574 - protein, 14 aa, Mycobacterium tuberculosis
AINPLESGWPAMPD

SEQ ID NO: 93575 - protein, 14 aa, Mycobacterium tuberculosis
INPLESGWPAMPDG

SEQ ID NO: 93576 - protein, 14 aa, Mycobacterium tuberculosis
NPLESGWPAMPDGV

SEQ ID NO: 93577 - protein, 14 aa, Mycobacterium tuberculosis
PLESGWPAMPDGVT

SEQ ID NO: 93578 - protein, 14 aa, Mycobacterium tuberculosis
LESGWPAMPDGVTD

SEQ ID NO: 93579 - protein, 14 aa, Mycobacterium tuberculosis
ESGWPAMPDGVTDR

SEQ ID NO: 93580 - protein, 14 aa, Mycobacterium tuberculosis
SGWPAMPDGVTDRR

SEQ ID NO: 93581 - protein, 14 aa, Mycobacterium tuberculosis
GWPAMPDGVTDRRA

SEQ ID NO: 93582 - protein, 14 aa, Mycobacterium tuberculosis
WPAMPDGVTDRRAD

SEQ ID NO: 93583 - protein, 14 aa, Mycobacterium tuberculosis
PAMPDGVTDRRADV

SEQ ID NO: 93584 - protein, 14 aa, Mycobacterium tuberculosis
AMPDGVTDRRADVW

SEQ ID NO: 93585 - protein, 14 aa, Mycobacterium tuberculosis
MPDGVTDRRADVWE

SEQ ID NO: 93586 - protein, 14 aa, Mycobacterium tuberculosis
PDGVTDRRADVWES

SEQ ID NO: 93587 - protein, 14 aa, Mycobacterium tuberculosis
DGVTDRRADVWESL

SEQ ID NO: 93588 - protein, 14 aa, Mycobacterium tuberculosis
GVTDRRADVWESLV

SEQ ID NO: 93589 - protein, 14 aa, Mycobacterium tuberculosis
VTDRRADVWESLVA

SEQ ID NO: 93590 - protein, 14 aa, Mycobacterium tuberculosis
TDRRADVWESLVAV

SEQ ID NO: 93591 - protein, 14 aa, Mycobacterium tuberculosis
DRRADVWESLVAVA

SEQ ID NO: 93592 - protein, 14 aa, Mycobacterium tuberculosis
RRADVWESLVAVAD

SEQ ID NO: 93593 - protein, 14 aa, Mycobacterium tuberculosis
RADVWESLVAVADT

SEQ ID NO: 93594 - protein, 14 aa, Mycobacterium tuberculosis
ADVWESLVAVADTA

SEQ ID NO: 93595 - protein, 14 aa, Mycobacterium tuberculosis
DVWESLVAVADTAG

SEQ ID NO: 93596 - protein, 14 aa, Mycobacterium tuberculosis
VWESLVAVADTAGG

SEQ ID NO: 93597 - protein, 14 aa, Mycobacterium tuberculosis
WESLVAVADTAGGH

SEQ ID NO: 93598 - protein, 14 aa, Mycobacterium tuberculosis
ESLVAVADTAGGHW

SEQ ID NO: 93599 - protein, 14 aa, Mycobacterium tuberculosis
SLVAVADTAGGHWP

SEQ ID NO: 93600 - protein, 14 aa, Mycobacterium tuberculosis
LVAVADTAGGHWPK

SEQ ID NO: 93601 - protein, 14 aa, Mycobacterium tuberculosis
VAVADTAGGHWPKT

SEQ ID NO: 93602 - protein, 14 aa, Mycobacterium tuberculosis
AVADTAGGHWPKTA

SEQ ID NO: 93603 - protein, 14 aa, Mycobacterium tuberculosis
VADTAGGHWPKTAR

SEQ ID NO: 93604 - protein, 14 aa, Mycobacterium tuberculosis
ADTAGGHWPKTARA

SEQ ID NO: 93605 - protein, 14 aa, Mycobacterium tuberculosis
DTAGGHWPKTARAT

SEQ ID NO: 93606 - protein, 14 aa, Mycobacterium tuberculosis
TAGGHWPKTARATA

SEQ ID NO: 93607 - protein, 14 aa, Mycobacterium tuberculosis
AGGHWPKTARATAE

SEQ ID NO: 93608 - protein, 14 aa, Mycobacterium tuberculosis
GGHWPKTARATAET

SEQ ID NO: 93609 - protein, 14 aa, Mycobacterium tuberculosis
GHWPKTARATAETD

SEQ ID NO: 93610 - protein, 14 aa, Mycobacterium tuberculosis
HWPKTARATAETDA

SEQ ID NO: 93611 - protein, 14 aa, Mycobacterium tuberculosis
WPKTARATAETDAT

SEQ ID NO: 93612 - protein, 14 aa, Mycobacterium tuberculosis
PKTARATAETDATA

SEQ ID NO: 93613 - protein, 14 aa, Mycobacterium tuberculosis
KTARATAETDATAN

SEQ ID NO: 93614 - protein, 14 aa, Mycobacterium tuberculosis
TARATAETDATANR

SEQ ID NO: 93615 - protein, 14 aa, Mycobacterium tuberculosis
ARATAETDATANRG

SEQ ID NO: 93616 - protein, 14 aa, Mycobacterium tuberculosis
RATAETDATANRGA

SEQ ID NO: 93617 - protein, 14 aa, Mycobacterium tuberculosis
ATAETDATANRGAK

SEQ ID NO: 93618 - protein, 14 aa, Mycobacterium tuberculosis
TAETDATANRGAKP

SEQ ID NO: 93619 - protein, 14 aa, Mycobacterium tuberculosis
AETDATANRGAKPS

SEQ ID NO: 93620 - protein, 14 aa, Mycobacterium tuberculosis
ETDATANRGAKPSI

SEQ ID NO: 93621 - protein, 14 aa, Mycobacterium tuberculosis
TDATANRGAKPSIG

SEQ ID NO: 93622 - protein, 14 aa, Mycobacterium tuberculosis
DATANRGAKPSIGV

SEQ ID NO: 93623 - protein, 14 aa, Mycobacterium tuberculosis
ATANRGAKPSIGVL

SEQ ID NO: 93624 - protein, 14 aa, Mycobacterium tuberculosis
TANRGAKPSIGVLL

SEQ ID NO: 93625 - protein, 14 aa, Mycobacterium tuberculosis
ANRGAKPSIGVLLL

SEQ ID NO: 93626 - protein, 14 aa, Mycobacterium tuberculosis
NRGAKPSIGVLLLR

SEQ ID NO: 93627 - protein, 14 aa, Mycobacterium tuberculosis
RGAKPSIGVLLLRD

SEQ ID NO: 93628 - protein, 14 aa, Mycobacterium tuberculosis
GAKPSIGVLLLRDI

SEQ ID NO: 93629 - protein, 14 aa, Mycobacterium tuberculosis
AKPSIGVLLLRDIR

SEQ ID NO: 93630 - protein, 14 aa, Mycobacterium tuberculosis
KPSIGVLLLRDIRR

SEQ ID NO: 93631 - protein, 14 aa, Mycobacterium tuberculosis
PSIGVLLLRDIRRV

SEQ ID NO: 93632 - protein, 14 aa, Mycobacterium tuberculosis
SIGVLLLRDIRRVF

SEQ ID NO: 93633 - protein, 14 aa, Mycobacterium tuberculosis
IGVLLLRDIRRVFS

SEQ ID NO: 93634 - protein, 14 aa, Mycobacterium tuberculosis
GVLLLRDIRRVFSD

SEQ ID NO: 93635 - protein, 14 aa, Mycobacterium tuberculosis
VLLLRDIRRVFSDR

SEQ ID NO: 93636 - protein, 14 aa, Mycobacterium tuberculosis
LLLRDIRRVFSDRD

SEQ ID NO: 93637 - protein, 14 aa, Mycobacterium tuberculosis
LLRDIRRVFSDRDR

SEQ ID NO: 93638 - protein, 14 aa, Mycobacterium tuberculosis
LRDIRRVFSDRDRM

SEQ ID NO: 93639 - protein, 14 aa, Mycobacterium tuberculosis
RDIRRVFSDRDRMR

SEQ ID NO: 93640 - protein, 14 aa, Mycobacterium tuberculosis
DIRRVFSDRDRMRT

SEQ ID NO: 93641 - protein, 14 aa, Mycobacterium tuberculosis
IRRVFSDRDRMRTS

SEQ ID NO: 93642 - protein, 14 aa, Mycobacterium tuberculosis
RRVFSDRDRMRTSD

SEQ ID NO: 93643 - protein, 14 aa, Mycobacterium tuberculosis
RVFSDRDRMRTSDI

SEQ ID NO: 93644 - protein, 14 aa, Mycobacterium tuberculosis
VFSDRDRMRTSDIL

SEQ ID NO: 93645 - protein, 14 aa, Mycobacterium tuberculosis
FSDRDRMRTSDILT

SEQ ID NO: 93646 - protein, 14 aa, Mycobacterium tuberculosis
SDRDRMRTSDILTG

SEQ ID NO: 93647 - protein, 14 aa, Mycobacterium tuberculosis
DRDRMRTSDILTGL

SEQ ID NO: 93648 - protein, 14 aa, Mycobacterium tuberculosis
RDRMRTSDILTGLN

SEQ ID NO: 93649 - protein, 14 aa, Mycobacterium tuberculosis
DRMRTSDILTGLNR

SEQ ID NO: 93650 - protein, 14 aa, Mycobacterium tuberculosis
RMRTSDILTGLNRM

SEQ ID NO: 93651 - protein, 14 aa, Mycobacterium tuberculosis
MRTSDILTGLNRME

SEQ ID NO: 93652 - protein, 14 aa, Mycobacterium tuberculosis
RTSDILTGLNRMEE

SEQ ID NO: 93653 - protein, 14 aa, Mycobacterium tuberculosis
TSDILTGLNRMEEG

SEQ ID NO: 93654 - protein, 14 aa, Mycobacterium tuberculosis
SDILTGLNRMEEGP

SEQ ID NO: 93655 - protein, 14 aa, Mycobacterium tuberculosis
DILTGLNRMEEGPW

SEQ ID NO: 93656 - protein, 14 aa, Mycobacterium tuberculosis
ILTGLNRMEEGPWG

SEQ ID NO: 93657 - protein, 14 aa, Mycobacterium tuberculosis
LTGLNRMEEGPWGS

SEQ ID NO: 93658 - protein, 14 aa, Mycobacterium tuberculosis
TGLNRMEEGPWGSI

SEQ ID NO: 93659 - protein, 14 aa, Mycobacterium tuberculosis
GLNRMEEGPWGSIR

SEQ ID NO: 93660 - protein, 14 aa, Mycobacterium tuberculosis
LNRMEEGPWGSIRR

SEQ ID NO: 93661 - protein, 14 aa, Mycobacterium tuberculosis
NRMEEGPWGSIRRG

SEQ ID NO: 93662 - protein, 14 aa, Mycobacterium tuberculosis
RMEEGPWGSIRRGD

SEQ ID NO: 93663 - protein, 14 aa, Mycobacterium tuberculosis
MEEGPWGSIRRGDP

SEQ ID NO: 93664 - protein, 14 aa, Mycobacterium tuberculosis
EEGPWGSIRRGDPL

SEQ ID NO: 93665 - protein, 14 aa, Mycobacterium tuberculosis
EGPWGSIRRGDPLD

SEQ ID NO: 93666 - protein, 14 aa, Mycobacterium tuberculosis
GPWGSIRRGDPLDA

SEQ ID NO: 93667 - protein, 14 aa, Mycobacterium tuberculosis
PWGSIRRGDPLDAR

SEQ ID NO: 93668 - protein, 14 aa, Mycobacterium tuberculosis
WGSIRRGDPLDARG

SEQ ID NO: 93669 - protein, 14 aa, Mycobacterium tuberculosis
GSIRRGDPLDARGL

SEQ ID NO: 93670 - protein, 14 aa, Mycobacterium tuberculosis
SIRRGDPLDARGLA

SEQ ID NO: 93671 - protein, 14 aa, Mycobacterium tuberculosis
IRRGDPLDARGLAT

SEQ ID NO: 93672 - protein, 14 aa, Mycobacterium tuberculosis
RRGDPLDARGLATR

SEQ ID NO: 93673 - protein, 14 aa, Mycobacterium tuberculosis
RGDPLDARGLATRL

SEQ ID NO: 93674 - protein, 14 aa, Mycobacterium tuberculosis
GDPLDARGLATRLG

SEQ ID NO: 93675 - protein, 14 aa, Mycobacterium tuberculosis
DPLDARGLATRLGR

SEQ ID NO: 93676 - protein, 14 aa, Mycobacterium tuberculosis
PLDARGLATRLGRY

SEQ ID NO: 93677 - protein, 14 aa, Mycobacterium tuberculosis
LDARGLATRLGRYG

SEQ ID NO: 93678 - protein, 14 aa, Mycobacterium tuberculosis
DARGLATRLGRYGI

SEQ ID NO: 93679 - protein, 14 aa, Mycobacterium tuberculosis
ARGLATRLGRYGIG

SEQ ID NO: 93680 - protein, 14 aa, Mycobacterium tuberculosis
RGLATRLGRYGIGP

SEQ ID NO: 93681 - protein, 14 aa, Mycobacterium tuberculosis
GLATRLGRYGIGPK

SEQ ID NO: 93682 - protein, 14 aa, Mycobacterium tuberculosis
LATRLGRYGIGPKF

SEQ ID NO: 93683 - protein, 14 aa, Mycobacterium tuberculosis
ATRLGRYGIGPKFQ

SEQ ID NO: 93684 - protein, 14 aa, Mycobacterium tuberculosis
TRLGRYGIGPKFQH

SEQ ID NO: 93685 - protein, 14 aa, Mycobacterium tuberculosis
RLGRYGIGPKFQHS

SEQ ID NO: 93686 - protein, 14 aa, Mycobacterium tuberculosis
LGRYGIGPKFQHSG

SEQ ID NO: 93687 - protein, 14 aa, Mycobacterium tuberculosis
GRYGIGPKFQHSGG

SEQ ID NO: 93688 - protein, 14 aa, Mycobacterium tuberculosis
RYGIGPKFQHSGGE

SEQ ID NO: 93689 - protein, 14 aa, Mycobacterium tuberculosis
YGIGPKFQHSGGEP

SEQ ID NO: 93690 - protein, 14 aa, Mycobacterium tuberculosis
GIGPKFQHSGGEPP

SEQ ID NO: 93691 - protein, 14 aa, Mycobacterium tuberculosis
IGPKFQHSGGEPPY

SEQ ID NO: 93692 - protein, 14 aa, Mycobacterium tuberculosis
GPKFQHSGGEPPYK

SEQ ID NO: 93693 - protein, 14 aa, Mycobacterium tuberculosis
PKFQHSGGEPPYKG

SEQ ID NO: 93694 - protein, 14 aa, Mycobacterium tuberculosis
KFQHSGGEPPYKGY

SEQ ID NO: 93695 - protein, 14 aa, Mycobacterium tuberculosis
FQHSGGEPPYKGYS

SEQ ID NO: 93696 - protein, 14 aa, Mycobacterium tuberculosis
QHSGGEPPYKGYSR

SEQ ID NO: 93697 - protein, 14 aa, Mycobacterium tuberculosis
HSGGEPPYKGYSRT

SEQ ID NO: 93698 - protein, 14 aa, Mycobacterium tuberculosis
SGGEPPYKGYSRTQ

SEQ ID NO: 93699 - protein, 14 aa, Mycobacterium tuberculosis
GGEPPYKGYSRTQF

SEQ ID NO: 93700 - protein, 14 aa, Mycobacterium tuberculosis
GEPPYKGYSRTQFE

SEQ ID NO: 93701 - protein, 14 aa, Mycobacterium tuberculosis
EPPYKGYSRTQFED

SEQ ID NO: 93702 - protein, 14 aa, Mycobacterium tuberculosis
PPYKGYSRTQFEDA

SEQ ID NO: 93703 - protein, 14 aa, Mycobacterium tuberculosis
PYKGYSRTQFEDAW

SEQ ID NO: 93704 - protein, 14 aa, Mycobacterium tuberculosis
YKGYSRTQFEDAWS

SEQ ID NO: 93705 - protein, 14 aa, Mycobacterium tuberculosis
KGYSRTQFEDAWSR

SEQ ID NO: 93706 - protein, 14 aa, Mycobacterium tuberculosis
GYSRTQFEDAWSRY

SEQ ID NO: 93707 - protein, 14 aa, Mycobacterium tuberculosis
YSRTQFEDAWSRYL

SEQ ID NO: 93708 - protein, 14 aa, Mycobacterium tuberculosis
SRTQFEDAWSRYLS

SEQ ID NO: 93709 - protein, 14 aa, Mycobacterium tuberculosis
RTQFEDAWSRYLSA

SEQ ID NO: 93710 - protein, 14 aa, Mycobacterium tuberculosis
TQFEDAWSRYLSAD

SEQ ID NO: 93711 - protein, 14 aa, Mycobacterium tuberculosis
QFEDAWSRYLSADD

SEQ ID NO: 93712 - protein, 14 aa, Mycobacterium tuberculosis
FEDAWSRYLSADDE

SEQ ID NO: 93713 - protein, 14 aa, Mycobacterium tuberculosis
EDAWSRYLSADDET

SEQ ID NO: 93714 - protein, 14 aa, Mycobacterium tuberculosis
DAWSRYLSADDETP

SEQ ID NO: 93715 - protein, 14 aa, Mycobacterium tuberculosis
AWSRYLSADDETPE

SEQ ID NO: 93716 - protein, 14 aa, Mycobacterium tuberculosis
WSRYLSADDETPEE

SEQ ID NO: 93717 - protein, 14 aa, Mycobacterium tuberculosis
SRYLSADDETPEER

SEQ ID NO: 93718 - protein, 14 aa, Mycobacterium tuberculosis
RYLSADDETPEERD

SEQ ID NO: 93719 - protein, 14 aa, Mycobacterium tuberculosis
YLSADDETPEERDL

SEQ ID NO: 93720 - protein, 14 aa, Mycobacterium tuberculosis
LSADDETPEERDLS

SEQ ID NO: 93721 - protein, 14 aa, Mycobacterium tuberculosis
SADDETPEERDLSV

SEQ ID NO: 93722 - protein, 14 aa, Mycobacterium tuberculosis
ADDETPEERDLSVS

SEQ ID NO: 93723 - protein, 14 aa, Mycobacterium tuberculosis
DDETPEERDLSVSA

SEQ ID NO: 93724 - protein, 14 aa, Mycobacterium tuberculosis
DETPEERDLSVSAV

SEQ ID NO: 93725 - protein, 14 aa, Mycobacterium tuberculosis
ETPEERDLSVSAVS

SEQ ID NO: 93726 - protein, 14 aa, Mycobacterium tuberculosis
TPEERDLSVSAVSA

SEQ ID NO: 93727 - protein, 14 aa, Mycobacterium tuberculosis
PEERDLSVSAVSAV

SEQ ID NO: 93728 - protein, 14 aa, Mycobacterium tuberculosis
EERDLSVSAVSAVS

SEQ ID NO: 93729 - protein, 14 aa, Mycobacterium tuberculosis
ERDLSVSAVSAVSP

SEQ ID NO: 93730 - protein, 14 aa, Mycobacterium tuberculosis
RDLSVSAVSAVSPP

SEQ ID NO: 93731 - protein, 14 aa, Mycobacterium tuberculosis
DLSVSAVSAVSPPV

SEQ ID NO: 93732 - protein, 14 aa, Mycobacterium tuberculosis
LSVSAVSAVSPPVG

SEQ ID NO: 93733 - protein, 14 aa, Mycobacterium tuberculosis
SVSAVSAVSPPVGD

SEQ ID NO: 93734 - protein, 14 aa, Mycobacterium tuberculosis
VSAVSAVSPPVGDP

SEQ ID NO: 93735 - protein, 14 aa, Mycobacterium tuberculosis
SAVSAVSPPVGDPG

SEQ ID NO: 93736 - protein, 14 aa, Mycobacterium tuberculosis
AVSAVSPPVGDPGD

SEQ ID NO: 93737 - protein, 14 aa, Mycobacterium tuberculosis
VSAVSPPVGDPGDA

SEQ ID NO: 93738 - protein, 14 aa, Mycobacterium tuberculosis
SAVSPPVGDPGDAT

SEQ ID NO: 93739 - protein, 14 aa, Mycobacterium tuberculosis
AVSPPVGDPGDATG

SEQ ID NO: 93740 - protein, 14 aa, Mycobacterium tuberculosis
VSPPVGDPGDATGA

SEQ ID NO: 93741 - protein, 14 aa, Mycobacterium tuberculosis
SPPVGDPGDATGAT

SEQ ID NO: 93742 - protein, 14 aa, Mycobacterium tuberculosis
PPVGDPGDATGATD

SEQ ID NO: 93743 - protein, 14 aa, Mycobacterium tuberculosis
PVGDPGDATGATDA

SEQ ID NO: 93744 - protein, 14 aa, Mycobacterium tuberculosis
VGDPGDATGATDAT

SEQ ID NO: 93745 - protein, 14 aa, Mycobacterium tuberculosis
GDPGDATGATDATD

SEQ ID NO: 93746 - protein, 14 aa, Mycobacterium tuberculosis
DPGDATGATDATDL

SEQ ID NO: 93747 - protein, 14 aa, Mycobacterium tuberculosis
PGDATGATDATDLP

SEQ ID NO: 93748 - protein, 14 aa, Mycobacterium tuberculosis
GDATGATDATDLPE

SEQ ID NO: 93749 - protein, 14 aa, Mycobacterium tuberculosis
DATGATDATDLPEA

SEQ ID NO: 93750 - protein, 14 aa, Mycobacterium tuberculosis
ATGATDATDLPEAG

SEQ ID NO: 93751 - protein, 14 aa, Mycobacterium tuberculosis
TGATDATDLPEAGD

SEQ ID NO: 93752 - protein, 14 aa, Mycobacterium tuberculosis
GATDATDLPEAGDL

SEQ ID NO: 93753 - protein, 14 aa, Mycobacterium tuberculosis
ATDATDLPEAGDLP

SEQ ID NO: 93754 - protein, 14 aa, Mycobacterium tuberculosis
TDATDLPEAGDLPY

SEQ ID NO: 93755 - protein, 14 aa, Mycobacterium tuberculosis
DATDLPEAGDLPYE

SEQ ID NO: 93756 - protein, 14 aa, Mycobacterium tuberculosis
ATDLPEAGDLPYEP

SEQ ID NO: 93757 - protein, 14 aa, Mycobacterium tuberculosis
TDLPEAGDLPYEPP

SEQ ID NO: 93758 - protein, 14 aa, Mycobacterium tuberculosis
DLPEAGDLPYEPPA

SEQ ID NO: 93759 - protein, 14 aa, Mycobacterium tuberculosis
LPEAGDLPYEPPAP

SEQ ID NO: 93760 - protein, 14 aa, Mycobacterium tuberculosis
PEAGDLPYEPPAPN

SEQ ID NO: 93761 - protein, 14 aa, Mycobacterium tuberculosis
EAGDLPYEPPAPNG

SEQ ID NO: 93762 - protein, 14 aa, Mycobacterium tuberculosis
AGDLPYEPPAPNGH

SEQ ID NO: 93763 - protein, 14 aa, Mycobacterium tuberculosis
GDLPYEPPAPNGHP

SEQ ID NO: 93764 - protein, 14 aa, Mycobacterium tuberculosis
DLPYEPPAPNGHPN

SEQ ID NO: 93765 - protein, 14 aa, Mycobacterium tuberculosis
LPYEPPAPNGHPNG

SEQ ID NO: 93766 - protein, 14 aa, Mycobacterium tuberculosis
PYEPPAPNGHPNGD

SEQ ID NO: 93767 - protein, 14 aa, Mycobacterium tuberculosis
YEPPAPNGHPNGDA

SEQ ID NO: 93768 - protein, 14 aa, Mycobacterium tuberculosis
EPPAPNGHPNGDAP

SEQ ID NO: 93769 - protein, 14 aa, Mycobacterium tuberculosis
PPAPNGHPNGDAPL

SEQ ID NO: 93770 - protein, 14 aa, Mycobacterium tuberculosis
PAPNGHPNGDAPLC

SEQ ID NO: 93771 - protein, 14 aa, Mycobacterium tuberculosis
APNGHPNGDAPLCS

SEQ ID NO: 93772 - protein, 14 aa, Mycobacterium tuberculosis
PNGHPNGDAPLCSG

SEQ ID NO: 93773 - protein, 14 aa, Mycobacterium tuberculosis
NGHPNGDAPLCSGP

SEQ ID NO: 93774 - protein, 14 aa, Mycobacterium tuberculosis
GHPNGDAPLCSGPG

SEQ ID NO: 93775 - protein, 14 aa, Mycobacterium tuberculosis
HPNGDAPLCSGPGC

SEQ ID NO: 93776 - protein, 14 aa, Mycobacterium tuberculosis
PNGDAPLCSGPGCP

SEQ ID NO: 93777 - protein, 14 aa, Mycobacterium tuberculosis
NGDAPLCSGPGCPN

SEQ ID NO: 93778 - protein, 14 aa, Mycobacterium tuberculosis
GDAPLCSGPGCPNK

SEQ ID NO: 93779 - protein, 14 aa, Mycobacterium tuberculosis
DAPLCSGPGCPNKL

SEQ ID NO: 93780 - protein, 14 aa, Mycobacterium tuberculosis
APLCSGPGCPNKLL

SEQ ID NO: 93781 - protein, 14 aa, Mycobacterium tuberculosis
PLCSGPGCPNKLLS

SEQ ID NO: 93782 - protein, 14 aa, Mycobacterium tuberculosis
LCSGPGCPNKLLST

SEQ ID NO: 93783 - protein, 14 aa, Mycobacterium tuberculosis
CSGPGCPNKLLSTE

SEQ ID NO: 93784 - protein, 14 aa, Mycobacterium tuberculosis
SGPGCPNKLLSTEA

SEQ ID NO: 93785 - protein, 14 aa, Mycobacterium tuberculosis
GPGCPNKLLSTEAK

SEQ ID NO: 93786 - protein, 14 aa, Mycobacterium tuberculosis
PGCPNKLLSTEAKA

SEQ ID NO: 93787 - protein, 14 aa, Mycobacterium tuberculosis
GCPNKLLSTEAKAA

SEQ ID NO: 93788 - protein, 14 aa, Mycobacterium tuberculosis
CPNKLLSTEAKAAG

SEQ ID NO: 93789 - protein, 14 aa, Mycobacterium tuberculosis
PNKLLSTEAKAAGK

SEQ ID NO: 93790 - protein, 14 aa, Mycobacterium tuberculosis
NKLLSTEAKAAGKC

SEQ ID NO: 93791 - protein, 14 aa, Mycobacterium tuberculosis
KLLSTEAKAAGKCR

SEQ ID NO: 93792 - protein, 14 aa, Mycobacterium tuberculosis
LLSTEAKAAGKCRP

SEQ ID NO: 93793 - protein, 14 aa, Mycobacterium tuberculosis
LSTEAKAAGKCRPC

SEQ ID NO: 93794 - protein, 14 aa, Mycobacterium tuberculosis
STEAKAAGKCRPCR

SEQ ID NO: 93795 - protein, 14 aa, Mycobacterium tuberculosis
TEAKAAGKCRPCRG

SEQ ID NO: 93796 - protein, 14 aa, Mycobacterium tuberculosis
EAKAAGKCRPCRGR

SEQ ID NO: 93797 - protein, 14 aa, Mycobacterium tuberculosis
AKAAGKCRPCRGRA

SEQ ID NO: 93798 - protein, 14 aa, Mycobacterium tuberculosis
KAAGKCRPCRGRAA

SEQ ID NO: 93799 - protein, 14 aa, Mycobacterium tuberculosis
AAGKCRPCRGRAAA

SEQ ID NO: 93800 - protein, 14 aa, Mycobacterium tuberculosis
AGKCRPCRGRAAAS

SEQ ID NO: 93801 - protein, 14 aa, Mycobacterium tuberculosis
GKCRPCRGRAAASA

SEQ ID NO: 93802 - protein, 14 aa, Mycobacterium tuberculosis
KCRPCRGRAAASAR

SEQ ID NO: 93803 - protein, 14 aa, Mycobacterium tuberculosis
CRPCRGRAAASARD

SEQ ID NO: 93804 - protein, 14 aa, Mycobacterium tuberculosis
RPCRGRAAASARDG

SEQ ID NO: 93805 - protein, 14 aa, Mycobacterium tuberculosis
PCRGRAAASARDGA

SEQ ID NO: 93806 - protein, 14 aa, Mycobacterium tuberculosis
CRGRAAASARDGAR

SEQ ID NO: 93807 - protein, 15 aa, Mycobacterium tuberculosis
MADIPYGRDYPDPIW

SEQ ID NO: 93808 - protein, 15 aa, Mycobacterium tuberculosis
ADIPYGRDYPDPIWC

SEQ ID NO: 93809 - protein, 15 aa, Mycobacterium tuberculosis
DIPYGRDYPDPIWCD

SEQ ID NO: 93810 - protein, 15 aa, Mycobacterium tuberculosis
IPYGRDYPDPIWCDE

SEQ ID NO: 93811 - protein, 15 aa, Mycobacterium tuberculosis
PYGRDYPDPIWCDED

SEQ ID NO: 93812 - protein, 15 aa, Mycobacterium tuberculosis
YGRDYPDPIWCDEDG

SEQ ID NO: 93813 - protein, 15 aa, Mycobacterium tuberculosis
GRDYPDPIWCDEDGQ

SEQ ID NO: 93814 - protein, 15 aa, Mycobacterium tuberculosis
RDYPDPIWCDEDGQP

SEQ ID NO: 93815 - protein, 15 aa, Mycobacterium tuberculosis
DYPDPIWCDEDGQPM

SEQ ID NO: 93816 - protein, 15 aa, Mycobacterium tuberculosis
YPDPIWCDEDGQPMP

SEQ ID NO: 93817 - protein, 15 aa, Mycobacterium tuberculosis
PDPIWCDEDGQPMPP

SEQ ID NO: 93818 - protein, 15 aa, Mycobacterium tuberculosis
DPIWCDEDGQPMPPV

SEQ ID NO: 93819 - protein, 15 aa, Mycobacterium tuberculosis
PIWCDEDGQPMPPVG

SEQ ID NO: 93820 - protein, 15 aa, Mycobacterium tuberculosis
IWCDEDGQPMPPVGA

SEQ ID NO: 93821 - protein, 15 aa, Mycobacterium tuberculosis
WCDEDGQPMPPVGAE

SEQ ID NO: 93822 - protein, 15 aa, Mycobacterium tuberculosis
CDEDGQPMPPVGAEL

SEQ ID NO: 93823 - protein, 15 aa, Mycobacterium tuberculosis
DEDGQPMPPVGAELL

SEQ ID NO: 93824 - protein, 15 aa, Mycobacterium tuberculosis
EDGQPMPPVGAELLD

SEQ ID NO: 93825 - protein, 15 aa, Mycobacterium tuberculosis
DGQPMPPVGAELLDD

SEQ ID NO: 93826 - protein, 15 aa, Mycobacterium tuberculosis
GQPMPPVGAELLDDI

SEQ ID NO: 93827 - protein, 15 aa, Mycobacterium tuberculosis
QPMPPVGAELLDDIR

SEQ ID NO: 93828 - protein, 15 aa, Mycobacterium tuberculosis
PMPPVGAELLDDIRA

SEQ ID NO: 93829 - protein, 15 aa, Mycobacterium tuberculosis
MPPVGAELLDDIRAF

SEQ ID NO: 93830 - protein, 15 aa, Mycobacterium tuberculosis
PPVGAELLDDIRAFL

SEQ ID NO: 93831 - protein, 15 aa, Mycobacterium tuberculosis
PVGAELLDDIRAFLR

SEQ ID NO: 93832 - protein, 15 aa, Mycobacterium tuberculosis
VGAELLDDIRAFLRR

SEQ ID NO: 93833 - protein, 15 aa, Mycobacterium tuberculosis
GAELLDDIRAFLRRF

SEQ ID NO: 93834 - protein, 15 aa, Mycobacterium tuberculosis
AELLDDIRAFLRRFV

SEQ ID NO: 93835 - protein, 15 aa, Mycobacterium tuberculosis
ELLDDIRAFLRRFVV

SEQ ID NO: 93836 - protein, 15 aa, Mycobacterium tuberculosis
LLDDIRAFLRRFVVY

SEQ ID NO: 93837 - protein, 15 aa, Mycobacterium tuberculosis
LDDIRAFLRRFVVYP

SEQ ID NO: 93838 - protein, 15 aa, Mycobacterium tuberculosis
DDIRAFLRRFVVYPS

SEQ ID NO: 93839 - protein, 15 aa, Mycobacterium tuberculosis
DIRAFLRRFVVYPSD

SEQ ID NO: 93840 - protein, 15 aa, Mycobacterium tuberculosis
IRAFLRRFVVYPSDH

SEQ ID NO: 93841 - protein, 15 aa, Mycobacterium tuberculosis
RAFLRRFVVYPSDHE

SEQ ID NO: 93842 - protein, 15 aa, Mycobacterium tuberculosis
AFLRRFVVYPSDHEL

SEQ ID NO: 93843 - protein, 15 aa, Mycobacterium tuberculosis
FLRRFVVYPSDHELI

SEQ ID NO: 93844 - protein, 15 aa, Mycobacterium tuberculosis
LRRFVVYPSDHELIA

SEQ ID NO: 93845 - protein, 15 aa, Mycobacterium tuberculosis
RRFVVYPSDHELIAH

SEQ ID NO: 93846 - protein, 15 aa, Mycobacterium tuberculosis
RFVVYPSDHELIAHT

SEQ ID NO: 93847 - protein, 15 aa, Mycobacterium tuberculosis
FVVYPSDHELIAHTL

SEQ ID NO: 93848 - protein, 15 aa, Mycobacterium tuberculosis
VVYPSDHELIAHTLW

SEQ ID NO: 93849 - protein, 15 aa, Mycobacterium tuberculosis
VYPSDHELIAHTLWI

SEQ ID NO: 93850 - protein, 15 aa, Mycobacterium tuberculosis
YPSDHELIAHTLWIA

SEQ ID NO: 93851 - protein, 15 aa, Mycobacterium tuberculosis
PSDHELIAHTLWIAH

SEQ ID NO: 93852 - protein, 15 aa, Mycobacterium tuberculosis
SDHELIAHTLWIAHC

SEQ ID NO: 93853 - protein, 15 aa, Mycobacterium tuberculosis
DHELIAHTLWIAHCW

SEQ ID NO: 93854 - protein, 15 aa, Mycobacterium tuberculosis
HELIAHTLWIAHCWF

SEQ ID NO: 93855 - protein, 15 aa, Mycobacterium tuberculosis
ELIAHTLWIAHCWFM

SEQ ID NO: 93856 - protein, 15 aa, Mycobacterium tuberculosis
LIAHTLWIAHCWFME

SEQ ID NO: 93857 - protein, 15 aa, Mycobacterium tuberculosis
IAHTLWIAHCWFMEA

SEQ ID NO: 93858 - protein, 15 aa, Mycobacterium tuberculosis
AHTLWIAHCWFMEAW

SEQ ID NO: 93859 - protein, 15 aa, Mycobacterium tuberculosis
HTLWIAHCWFMEAWD

SEQ ID NO: 93860 - protein, 15 aa, Mycobacterium tuberculosis
TLWIAHCWFMEAWDS

SEQ ID NO: 93861 - protein, 15 aa, Mycobacterium tuberculosis
LWIAHCWFMEAWDST

SEQ ID NO: 93862 - protein, 15 aa, Mycobacterium tuberculosis
WIAHCWFMEAWDSTP

SEQ ID NO: 93863 - protein, 15 aa, Mycobacterium tuberculosis
IAHCWFMEAWDSTPR

SEQ ID NO: 93864 - protein, 15 aa, Mycobacterium tuberculosis
AHCWFMEAWDSTPRI

SEQ ID NO: 93865 - protein, 15 aa, Mycobacterium tuberculosis
HCWFMEAWDSTPRIA

SEQ ID NO: 93866 - protein, 15 aa, Mycobacterium tuberculosis
CWFMEAWDSTPRIAF

SEQ ID NO: 93867 - protein, 15 aa, Mycobacterium tuberculosis
WFMEAWDSTPRIAFL

SEQ ID NO: 93868 - protein, 15 aa, Mycobacterium tuberculosis
FMEAWDSTPRIAFLS

SEQ ID NO: 93869 - protein, 15 aa, Mycobacterium tuberculosis
MEAWDSTPRIAFLSP

SEQ ID NO: 93870 - protein, 15 aa, Mycobacterium tuberculosis
EAWDSTPRIAFLSPE

SEQ ID NO: 93871 - protein, 15 aa, Mycobacterium tuberculosis
AWDSTPRIAFLSPEP

SEQ ID NO: 93872 - protein, 15 aa, Mycobacterium tuberculosis
WDSTPRIAFLSPEPG

SEQ ID NO: 93873 - protein, 15 aa, Mycobacterium tuberculosis
DSTPRIAFLSPEPGS

SEQ ID NO: 93874 - protein, 15 aa, Mycobacterium tuberculosis
STPRIAFLSPEPGSG

SEQ ID NO: 93875 - protein, 15 aa, Mycobacterium tuberculosis
TPRIAFLSPEPGSGK

SEQ ID NO: 93876 - protein, 15 aa, Mycobacterium tuberculosis
PRIAFLSPEPGSGKS

SEQ ID NO: 93877 - protein, 15 aa, Mycobacterium tuberculosis
RIAFLSPEPGSGKSR

SEQ ID NO: 93878 - protein, 15 aa, Mycobacterium tuberculosis
IAFLSPEPGSGKSRA

SEQ ID NO: 93879 - protein, 15 aa, Mycobacterium tuberculosis
AFLSPEPGSGKSRAL

SEQ ID NO: 93880 - protein, 15 aa, Mycobacterium tuberculosis
FLSPEPGSGKSRALE

SEQ ID NO: 93881 - protein, 15 aa, Mycobacterium tuberculosis
LSPEPGSGKSRALEV

SEQ ID NO: 93882 - protein, 15 aa, Mycobacterium tuberculosis
SPEPGSGKSRALEVT

SEQ ID NO: 93883 - protein, 15 aa, Mycobacterium tuberculosis
PEPGSGKSRALEVTE

SEQ ID NO: 93884 - protein, 15 aa, Mycobacterium tuberculosis
EPGSGKSRALEVTEP

SEQ ID NO: 93885 - protein, 15 aa, Mycobacterium tuberculosis
PGSGKSRALEVTEPL

SEQ ID NO: 93886 - protein, 15 aa, Mycobacterium tuberculosis
GSGKSRALEVTEPLV

SEQ ID NO: 93887 - protein, 15 aa, Mycobacterium tuberculosis
SGKSRALEVTEPLVP

SEQ ID NO: 93888 - protein, 15 aa, Mycobacterium tuberculosis
GKSRALEVTEPLVPR

SEQ ID NO: 93889 - protein, 15 aa, Mycobacterium tuberculosis
KSRALEVTEPLVPRP

SEQ ID NO: 93890 - protein, 15 aa, Mycobacterium tuberculosis
SRALEVTEPLVPRPV

SEQ ID NO: 93891 - protein, 15 aa, Mycobacterium tuberculosis
RALEVTEPLVPRPVH

SEQ ID NO: 93892 - protein, 15 aa, Mycobacterium tuberculosis
ALEVTEPLVPRPVHA

SEQ ID NO: 93893 - protein, 15 aa, Mycobacterium tuberculosis
LEVTEPLVPRPVHAI

SEQ ID NO: 93894 - protein, 15 aa, Mycobacterium tuberculosis
EVTEPLVPRPVHAIN

SEQ ID NO: 93895 - protein, 15 aa, Mycobacterium tuberculosis
VTEPLVPRPVHAINC

SEQ ID NO: 93896 - protein, 15 aa, Mycobacterium tuberculosis
TEPLVPRPVHAINCT

SEQ ID NO: 93897 - protein, 15 aa, Mycobacterium tuberculosis
EPLVPRPVHAINCTP

SEQ ID NO: 93898 - protein, 15 aa, Mycobacterium tuberculosis
PLVPRPVHAINCTPA

SEQ ID NO: 93899 - protein, 15 aa, Mycobacterium tuberculosis
LVPRPVHAINCTPAY

SEQ ID NO: 93900 - protein, 15 aa, Mycobacterium tuberculosis
VPRPVHAINCTPAYL

SEQ ID NO: 93901 - protein, 15 aa, Mycobacterium tuberculosis
PRPVHAINCTPAYLF

SEQ ID NO: 93902 - protein, 15 aa, Mycobacterium tuberculosis
RPVHAINCTPAYLFR

SEQ ID NO: 93903 - protein, 15 aa, Mycobacterium tuberculosis
PVHAINCTPAYLFRR

SEQ ID NO: 93904 - protein, 15 aa, Mycobacterium tuberculosis
VHAINCTPAYLFRRV

SEQ ID NO: 93905 - protein, 15 aa, Mycobacterium tuberculosis
HAINCTPAYLFRRVA

SEQ ID NO: 93906 - protein, 15 aa, Mycobacterium tuberculosis
AINCTPAYLFRRVAD

SEQ ID NO: 93907 - protein, 15 aa, Mycobacterium tuberculosis
INCTPAYLFRRVADP

SEQ ID NO: 93908 - protein, 15 aa, Mycobacterium tuberculosis
NCTPAYLFRRVADPV

SEQ ID NO: 93909 - protein, 15 aa, Mycobacterium tuberculosis
CTPAYLFRRVADPVG

SEQ ID NO: 93910 - protein, 15 aa, Mycobacterium tuberculosis
TPAYLFRRVADPVGR

SEQ ID NO: 93911 - protein, 15 aa, Mycobacterium tuberculosis
PAYLFRRVADPVGRP

SEQ ID NO: 93912 - protein, 15 aa, Mycobacterium tuberculosis
AYLFRRVADPVGRPT

SEQ ID NO: 93913 - protein, 15 aa, Mycobacterium tuberculosis
YLFRRVADPVGRPTV

SEQ ID NO: 93914 - protein, 15 aa, Mycobacterium tuberculosis
LFRRVADPVGRPTVL

SEQ ID NO: 93915 - protein, 15 aa, Mycobacterium tuberculosis
FRRVADPVGRPTVLY

SEQ ID NO: 93916 - protein, 15 aa, Mycobacterium tuberculosis
RRVADPVGRPTVLYD

SEQ ID NO: 93917 - protein, 15 aa, Mycobacterium tuberculosis
RVADPVGRPTVLYDE

SEQ ID NO: 93918 - protein, 15 aa, Mycobacterium tuberculosis
VADPVGRPTVLYDEC

SEQ ID NO: 93919 - protein, 15 aa, Mycobacterium tuberculosis
ADPVGRPTVLYDECD

SEQ ID NO: 93920 - protein, 15 aa, Mycobacterium tuberculosis
DPVGRPTVLYDECDT

SEQ ID NO: 93921 - protein, 15 aa, Mycobacterium tuberculosis
PVGRPTVLYDECDTL

SEQ ID NO: 93922 - protein, 15 aa, Mycobacterium tuberculosis
VGRPTVLYDECDTLF

SEQ ID NO: 93923 - protein, 15 aa, Mycobacterium tuberculosis
GRPTVLYDECDTLFG

SEQ ID NO: 93924 - protein, 15 aa, Mycobacterium tuberculosis
RPTVLYDECDTLFGP

SEQ ID NO: 93925 - protein, 15 aa, Mycobacterium tuberculosis
PTVLYDECDTLFGPK

SEQ ID NO: 93926 - protein, 15 aa, Mycobacterium tuberculosis
TVLYDECDTLFGPKA

SEQ ID NO: 93927 - protein, 15 aa, Mycobacterium tuberculosis
VLYDECDTLFGPKAK

SEQ ID NO: 93928 - protein, 15 aa, Mycobacterium tuberculosis
LYDECDTLFGPKAKE

SEQ ID NO: 93929 - protein, 15 aa, Mycobacterium tuberculosis
YDECDTLFGPKAKEH

SEQ ID NO: 93930 - protein, 15 aa, Mycobacterium tuberculosis
DECDTLFGPKAKEHE

SEQ ID NO: 93931 - protein, 15 aa, Mycobacterium tuberculosis
ECDTLFGPKAKEHEE

SEQ ID NO: 93932 - protein, 15 aa, Mycobacterium tuberculosis
CDTLFGPKAKEHEEI

SEQ ID NO: 93933 - protein, 15 aa, Mycobacterium tuberculosis
DTLFGPKAKEHEEIR

SEQ ID NO: 93934 - protein, 15 aa, Mycobacterium tuberculosis
TLFGPKAKEHEEIRG

SEQ ID NO: 93935 - protein, 15 aa, Mycobacterium tuberculosis
LFGPKAKEHEEIRGV

SEQ ID NO: 93936 - protein, 15 aa, Mycobacterium tuberculosis
FGPKAKEHEEIRGVI

SEQ ID NO: 93937 - protein, 15 aa, Mycobacterium tuberculosis
GPKAKEHEEIRGVIN

SEQ ID NO: 93938 - protein, 15 aa, Mycobacterium tuberculosis
PKAKEHEEIRGVINA

SEQ ID NO: 93939 - protein, 15 aa, Mycobacterium tuberculosis
KAKEHEEIRGVINAG

SEQ ID NO: 93940 - protein, 15 aa, Mycobacterium tuberculosis
AKEHEEIRGVINAGH

SEQ ID NO: 93941 - protein, 15 aa, Mycobacterium tuberculosis
KEHEEIRGVINAGHR

SEQ ID NO: 93942 - protein, 15 aa, Mycobacterium tuberculosis
EHEEIRGVINAGHRK

SEQ ID NO: 93943 - protein, 15 aa, Mycobacterium tuberculosis
HEEIRGVINAGHRKG

SEQ ID NO: 93944 - protein, 15 aa, Mycobacterium tuberculosis
EEIRGVINAGHRKGA

SEQ ID NO: 93945 - protein, 15 aa, Mycobacterium tuberculosis
EIRGVINAGHRKGAV

SEQ ID NO: 93946 - protein, 15 aa, Mycobacterium tuberculosis
IRGVINAGHRKGAVA

SEQ ID NO: 93947 - protein, 15 aa, Mycobacterium tuberculosis
RGVINAGHRKGAVAG

SEQ ID NO: 93948 - protein, 15 aa, Mycobacterium tuberculosis
GVINAGHRKGAVAGR

SEQ ID NO: 93949 - protein, 15 aa, Mycobacterium tuberculosis
VINAGHRKGAVAGRC

SEQ ID NO: 93950 - protein, 15 aa, Mycobacterium tuberculosis
INAGHRKGAVAGRCV

SEQ ID NO: 93951 - protein, 15 aa, Mycobacterium tuberculosis
NAGHRKGAVAGRCVI

SEQ ID NO: 93952 - protein, 15 aa, Mycobacterium tuberculosis
AGHRKGAVAGRCVIR

SEQ ID NO: 93953 - protein, 15 aa, Mycobacterium tuberculosis
GHRKGAVAGRCVIRG

SEQ ID NO: 93954 - protein, 15 aa, Mycobacterium tuberculosis
HRKGAVAGRCVIRGK

SEQ ID NO: 93955 - protein, 15 aa, Mycobacterium tuberculosis
RKGAVAGRCVIRGKI

SEQ ID NO: 93956 - protein, 15 aa, Mycobacterium tuberculosis
KGAVAGRCVIRGKIV

SEQ ID NO: 93957 - protein, 15 aa, Mycobacterium tuberculosis
GAVAGRCVIRGKIVE

SEQ ID NO: 93958 - protein, 15 aa, Mycobacterium tuberculosis
AVAGRCVIRGKIVET

SEQ ID NO: 93959 - protein, 15 aa, Mycobacterium tuberculosis
VAGRCVIRGKIVETE

SEQ ID NO: 93960 - protein, 15 aa, Mycobacterium tuberculosis
AGRCVIRGKIVETEE

SEQ ID NO: 93961 - protein, 15 aa, Mycobacterium tuberculosis
GRCVIRGKIVETEEL

SEQ ID NO: 93962 - protein, 15 aa, Mycobacterium tuberculosis
RCVIRGKIVETEELP

SEQ ID NO: 93963 - protein, 15 aa, Mycobacterium tuberculosis
CVIRGKIVETEELPA

SEQ ID NO: 93964 - protein, 15 aa, Mycobacterium tuberculosis
VIRGKIVETEELPAY

SEQ ID NO: 93965 - protein, 15 aa, Mycobacterium tuberculosis
IRGKIVETEELPAYC

SEQ ID NO: 93966 - protein, 15 aa, Mycobacterium tuberculosis
RGKIVETEELPAYCA

SEQ ID NO: 93967 - protein, 15 aa, Mycobacterium tuberculosis
GKIVETEELPAYCAV

SEQ ID NO: 93968 - protein, 15 aa, Mycobacterium tuberculosis
KIVETEELPAYCAVA

SEQ ID NO: 93969 - protein, 15 aa, Mycobacterium tuberculosis
IVETEELPAYCAVAL

SEQ ID NO: 93970 - protein, 15 aa, Mycobacterium tuberculosis
VETEELPAYCAVALA

SEQ ID NO: 93971 - protein, 15 aa, Mycobacterium tuberculosis
ETEELPAYCAVALAG

SEQ ID NO: 93972 - protein, 15 aa, Mycobacterium tuberculosis
TEELPAYCAVALAGL

SEQ ID NO: 93973 - protein, 15 aa, Mycobacterium tuberculosis
EELPAYCAVALAGLD

SEQ ID NO: 93974 - protein, 15 aa, Mycobacterium tuberculosis
ELPAYCAVALAGLDD

SEQ ID NO: 93975 - protein, 15 aa, Mycobacterium tuberculosis
LPAYCAVALAGLDDL

SEQ ID NO: 93976 - protein, 15 aa, Mycobacterium tuberculosis
PAYCAVALAGLDDLP

SEQ ID NO: 93977 - protein, 15 aa, Mycobacterium tuberculosis
AYCAVALAGLDDLPD

SEQ ID NO: 93978 - protein, 15 aa, Mycobacterium tuberculosis
YCAVALAGLDDLPDT

SEQ ID NO: 93979 - protein, 15 aa, Mycobacterium tuberculosis
CAVALAGLDDLPDTI

SEQ ID NO: 93980 - protein, 15 aa, Mycobacterium tuberculosis
AVALAGLDDLPDTIM

SEQ ID NO: 93981 - protein, 15 aa, Mycobacterium tuberculosis
VALAGLDDLPDTIMS

SEQ ID NO: 93982 - protein, 15 aa, Mycobacterium tuberculosis
ALAGLDDLPDTIMSR

SEQ ID NO: 93983 - protein, 15 aa, Mycobacterium tuberculosis
LAGLDDLPDTIMSRS

SEQ ID NO: 93984 - protein, 15 aa, Mycobacterium tuberculosis
AGLDDLPDTIMSRSI

SEQ ID NO: 93985 - protein, 15 aa, Mycobacterium tuberculosis
GLDDLPDTIMSRSIV

SEQ ID NO: 93986 - protein, 15 aa, Mycobacterium tuberculosis
LDDLPDTIMSRSIVV

SEQ ID NO: 93987 - protein, 15 aa, Mycobacterium tuberculosis
DDLPDTIMSRSIVVR

SEQ ID NO: 93988 - protein, 15 aa, Mycobacterium tuberculosis
DLPDTIMSRSIVVRM

SEQ ID NO: 93989 - protein, 15 aa, Mycobacterium tuberculosis
LPDTIMSRSIVVRMR

SEQ ID NO: 93990 - protein, 15 aa, Mycobacterium tuberculosis
PDTIMSRSIVVRMRR

SEQ ID NO: 93991 - protein, 15 aa, Mycobacterium tuberculosis
DTIMSRSIVVRMRRR

SEQ ID NO: 93992 - protein, 15 aa, Mycobacterium tuberculosis
TIMSRSIVVRMRRRA

SEQ ID NO: 93993 - protein, 15 aa, Mycobacterium tuberculosis
IMSRSIVVRMRRRAP

SEQ ID NO: 93994 - protein, 15 aa, Mycobacterium tuberculosis
MSRSIVVRMRRRAPT

SEQ ID NO: 93995 - protein, 15 aa, Mycobacterium tuberculosis
SRSIVVRMRRRAPTE

SEQ ID NO: 93996 - protein, 15 aa, Mycobacterium tuberculosis
RSIVVRMRRRAPTEP

SEQ ID NO: 93997 - protein, 15 aa, Mycobacterium tuberculosis
SIVVRMRRRAPTEPV

SEQ ID NO: 93998 - protein, 15 aa, Mycobacterium tuberculosis
IVVRMRRRAPTEPVE

SEQ ID NO: 93999 - protein, 15 aa, Mycobacterium tuberculosis
VVRMRRRAPTEPVEP

SEQ ID NO: 94000 - protein, 15 aa, Mycobacterium tuberculosis
VRMRRRAPTEPVEPW

SEQ ID NO: 94001 - protein, 15 aa, Mycobacterium tuberculosis
RMRRRAPTEPVEPWR

SEQ ID NO: 94002 - protein, 15 aa, Mycobacterium tuberculosis
MRRRAPTEPVEPWRP

SEQ ID NO: 94003 - protein, 15 aa, Mycobacterium tuberculosis
RRRAPTEPVEPWRPR

SEQ ID NO: 94004 - protein, 15 aa, Mycobacterium tuberculosis
RRAPTEPVEPWRPRV

SEQ ID NO: 94005 - protein, 15 aa, Mycobacterium tuberculosis
RAPTEPVEPWRPRVN

SEQ ID NO: 94006 - protein, 15 aa, Mycobacterium tuberculosis
APTEPVEPWRPRVNG

SEQ ID NO: 94007 - protein, 15 aa, Mycobacterium tuberculosis
PTEPVEPWRPRVNGP

SEQ ID NO: 94008 - protein, 15 aa, Mycobacterium tuberculosis
TEPVEPWRPRVNGPE

SEQ ID NO: 94009 - protein, 15 aa, Mycobacterium tuberculosis
EPVEPWRPRVNGPEA

SEQ ID NO: 94010 - protein, 15 aa, Mycobacterium tuberculosis
PVEPWRPRVNGPEAE

SEQ ID NO: 94011 - protein, 15 aa, Mycobacterium tuberculosis
VEPWRPRVNGPEAEK

SEQ ID NO: 94012 - protein, 15 aa, Mycobacterium tuberculosis
EPWRPRVNGPEAEKL

SEQ ID NO: 94013 - protein, 15 aa, Mycobacterium tuberculosis
PWRPRVNGPEAEKLH

SEQ ID NO: 94014 - protein, 15 aa, Mycobacterium tuberculosis
WRPRVNGPEAEKLHD

SEQ ID NO: 94015 - protein, 15 aa, Mycobacterium tuberculosis
RPRVNGPEAEKLHDR

SEQ ID NO: 94016 - protein, 15 aa, Mycobacterium tuberculosis
PRVNGPEAEKLHDRL

SEQ ID NO: 94017 - protein, 15 aa, Mycobacterium tuberculosis
RVNGPEAEKLHDRLA

SEQ ID NO: 94018 - protein, 15 aa, Mycobacterium tuberculosis
VNGPEAEKLHDRLAN

SEQ ID NO: 94019 - protein, 15 aa, Mycobacterium tuberculosis
NGPEAEKLHDRLANW

SEQ ID NO: 94020 - protein, 15 aa, Mycobacterium tuberculosis
GPEAEKLHDRLANWA

SEQ ID NO: 94021 - protein, 15 aa, Mycobacterium tuberculosis
PEAEKLHDRLANWAA

SEQ ID NO: 94022 - protein, 15 aa, Mycobacterium tuberculosis
EAEKLHDRLANWAAA

SEQ ID NO: 94023 - protein, 15 aa, Mycobacterium tuberculosis
AEKLHDRLANWAAAI

SEQ ID NO: 94024 - protein, 15 aa, Mycobacterium tuberculosis
EKLHDRLANWAAAIN

SEQ ID NO: 94025 - protein, 15 aa, Mycobacterium tuberculosis
KLHDRLANWAAAINP

SEQ ID NO: 94026 - protein, 15 aa, Mycobacterium tuberculosis
LHDRLANWAAAINPL

SEQ ID NO: 94027 - protein, 15 aa, Mycobacterium tuberculosis
HDRLANWAAAINPLE

SEQ ID NO: 94028 - protein, 15 aa, Mycobacterium tuberculosis
DRLANWAAAINPLES

SEQ ID NO: 94029 - protein, 15 aa, Mycobacterium tuberculosis
RLANWAAAINPLESG

SEQ ID NO: 94030 - protein, 15 aa, Mycobacterium tuberculosis
LANWAAAINPLESGW

SEQ ID NO: 94031 - protein, 15 aa, Mycobacterium tuberculosis
ANWAAAINPLESGWP

SEQ ID NO: 94032 - protein, 15 aa, Mycobacterium tuberculosis
NWAAAINPLESGWPA

SEQ ID NO: 94033 - protein, 15 aa, Mycobacterium tuberculosis
WAAAINPLESGWPAM

SEQ ID NO: 94034 - protein, 15 aa, Mycobacterium tuberculosis
AAAINPLESGWPAMP

SEQ ID NO: 94035 - protein, 15 aa, Mycobacterium tuberculosis
AAINPLESGWPAMPD

SEQ ID NO: 94036 - protein, 15 aa, Mycobacterium tuberculosis
AINPLESGWPAMPDG

SEQ ID NO: 94037 - protein, 15 aa, Mycobacterium tuberculosis
INPLESGWPAMPDGV

SEQ ID NO: 94038 - protein, 15 aa, Mycobacterium tuberculosis
NPLESGWPAMPDGVT

SEQ ID NO: 94039 - protein, 15 aa, Mycobacterium tuberculosis
PLESGWPAMPDGVTD

SEQ ID NO: 94040 - protein, 15 aa, Mycobacterium tuberculosis
LESGWPAMPDGVTDR

SEQ ID NO: 94041 - protein, 15 aa, Mycobacterium tuberculosis
ESGWPAMPDGVTDRR

SEQ ID NO: 94042 - protein, 15 aa, Mycobacterium tuberculosis
SGWPAMPDGVTDRRA

SEQ ID NO: 94043 - protein, 15 aa, Mycobacterium tuberculosis
GWPAMPDGVTDRRAD

SEQ ID NO: 94044 - protein, 15 aa, Mycobacterium tuberculosis
WPAMPDGVTDRRADV

SEQ ID NO: 94045 - protein, 15 aa, Mycobacterium tuberculosis
PAMPDGVTDRRADVW

SEQ ID NO: 94046 - protein, 15 aa, Mycobacterium tuberculosis
AMPDGVTDRRADVWE

SEQ ID NO: 94047 - protein, 15 aa, Mycobacterium tuberculosis
MPDGVTDRRADVWES

SEQ ID NO: 94048 - protein, 15 aa, Mycobacterium tuberculosis
PDGVTDRRADVWESL

SEQ ID NO: 94049 - protein, 15 aa, Mycobacterium tuberculosis
DGVTDRRADVWESLV

SEQ ID NO: 94050 - protein, 15 aa, Mycobacterium tuberculosis
GVTDRRADVWESLVA

SEQ ID NO: 94051 - protein, 15 aa, Mycobacterium tuberculosis
VTDRRADVWESLVAV

SEQ ID NO: 94052 - protein, 15 aa, Mycobacterium tuberculosis
TDRRADVWESLVAVA

SEQ ID NO: 94053 - protein, 15 aa, Mycobacterium tuberculosis
DRRADVWESLVAVAD

SEQ ID NO: 94054 - protein, 15 aa, Mycobacterium tuberculosis
RRADVWESLVAVADT

SEQ ID NO: 94055 - protein, 15 aa, Mycobacterium tuberculosis
RADVWESLVAVADTA

SEQ ID NO: 94056 - protein, 15 aa, Mycobacterium tuberculosis
ADVWESLVAVADTAG

SEQ ID NO: 94057 - protein, 15 aa, Mycobacterium tuberculosis
DVWESLVAVADTAGG

SEQ ID NO: 94058 - protein, 15 aa, Mycobacterium tuberculosis
VWESLVAVADTAGGH

SEQ ID NO: 94059 - protein, 15 aa, Mycobacterium tuberculosis
WESLVAVADTAGGHW

SEQ ID NO: 94060 - protein, 15 aa, Mycobacterium tuberculosis
ESLVAVADTAGGHWP

SEQ ID NO: 94061 - protein, 15 aa, Mycobacterium tuberculosis
SLVAVADTAGGHWPK

SEQ ID NO: 94062 - protein, 15 aa, Mycobacterium tuberculosis
LVAVADTAGGHWPKT

SEQ ID NO: 94063 - protein, 15 aa, Mycobacterium tuberculosis
VAVADTAGGHWPKTA

SEQ ID NO: 94064 - protein, 15 aa, Mycobacterium tuberculosis
AVADTAGGHWPKTAR

SEQ ID NO: 94065 - protein, 15 aa, Mycobacterium tuberculosis
VADTAGGHWPKTARA

SEQ ID NO: 94066 - protein, 15 aa, Mycobacterium tuberculosis
ADTAGGHWPKTARAT

SEQ ID NO: 94067 - protein, 15 aa, Mycobacterium tuberculosis
DTAGGHWPKTARATA

SEQ ID NO: 94068 - protein, 15 aa, Mycobacterium tuberculosis
TAGGHWPKTARATAE

SEQ ID NO: 94069 - protein, 15 aa, Mycobacterium tuberculosis
AGGHWPKTARATAET

SEQ ID NO: 94070 - protein, 15 aa, Mycobacterium tuberculosis
GGHWPKTARATAETD

SEQ ID NO: 94071 - protein, 15 aa, Mycobacterium tuberculosis
GHWPKTARATAETDA

SEQ ID NO: 94072 - protein, 15 aa, Mycobacterium tuberculosis
HWPKTARATAETDAT

SEQ ID NO: 94073 - protein, 15 aa, Mycobacterium tuberculosis
WPKTARATAETDATA

SEQ ID NO: 94074 - protein, 15 aa, Mycobacterium tuberculosis
PKTARATAETDATAN

SEQ ID NO: 94075 - protein, 15 aa, Mycobacterium tuberculosis
KTARATAETDATANR

SEQ ID NO: 94076 - protein, 15 aa, Mycobacterium tuberculosis
TARATAETDATANRG

SEQ ID NO: 94077 - protein, 15 aa, Mycobacterium tuberculosis
ARATAETDATANRGA

SEQ ID NO: 94078 - protein, 15 aa, Mycobacterium tuberculosis
RATAETDATANRGAK

SEQ ID NO: 94079 - protein, 15 aa, Mycobacterium tuberculosis
ATAETDATANRGAKP

SEQ ID NO: 94080 - protein, 15 aa, Mycobacterium tuberculosis
TAETDATANRGAKPS

SEQ ID NO: 94081 - protein, 15 aa, Mycobacterium tuberculosis
AETDATANRGAKPSI

SEQ ID NO: 94082 - protein, 15 aa, Mycobacterium tuberculosis
ETDATANRGAKPSIG

SEQ ID NO: 94083 - protein, 15 aa, Mycobacterium tuberculosis
TDATANRGAKPSIGV

SEQ ID NO: 94084 - protein, 15 aa, Mycobacterium tuberculosis
DATANRGAKPSIGVL

SEQ ID NO: 94085 - protein, 15 aa, Mycobacterium tuberculosis
ATANRGAKPSIGVLL

SEQ ID NO: 94086 - protein, 15 aa, Mycobacterium tuberculosis
TANRGAKPSIGVLLL

SEQ ID NO: 94087 - protein, 15 aa, Mycobacterium tuberculosis
ANRGAKPSIGVLLLR

SEQ ID NO: 94088 - protein, 15 aa, Mycobacterium tuberculosis
NRGAKPSIGVLLLRD

SEQ ID NO: 94089 - protein, 15 aa, Mycobacterium tuberculosis
RGAKPSIGVLLLRDI

SEQ ID NO: 94090 - protein, 15 aa, Mycobacterium tuberculosis
GAKPSIGVLLLRDIR

SEQ ID NO: 94091 - protein, 15 aa, Mycobacterium tuberculosis
AKPSIGVLLLRDIRR

SEQ ID NO: 94092 - protein, 15 aa, Mycobacterium tuberculosis
KPSIGVLLLRDIRRV

SEQ ID NO: 94093 - protein, 15 aa, Mycobacterium tuberculosis
PSIGVLLLRDIRRVF

SEQ ID NO: 94094 - protein, 15 aa, Mycobacterium tuberculosis
SIGVLLLRDIRRVFS

SEQ ID NO: 94095 - protein, 15 aa, Mycobacterium tuberculosis
IGVLLLRDIRRVFSD

SEQ ID NO: 94096 - protein, 15 aa, Mycobacterium tuberculosis
GVLLLRDIRRVFSDR

SEQ ID NO: 94097 - protein, 15 aa, Mycobacterium tuberculosis
VLLLRDIRRVFSDRD

SEQ ID NO: 94098 - protein, 15 aa, Mycobacterium tuberculosis
LLLRDIRRVFSDRDR

SEQ ID NO: 94099 - protein, 15 aa, Mycobacterium tuberculosis
LLRDIRRVFSDRDRM

SEQ ID NO: 94100 - protein, 15 aa, Mycobacterium tuberculosis
LRDIRRVFSDRDRMR

SEQ ID NO: 94101 - protein, 15 aa, Mycobacterium tuberculosis
RDIRRVFSDRDRMRT

SEQ ID NO: 94102 - protein, 15 aa, Mycobacterium tuberculosis
DIRRVFSDRDRMRTS

SEQ ID NO: 94103 - protein, 15 aa, Mycobacterium tuberculosis
IRRVFSDRDRMRTSD

SEQ ID NO: 94104 - protein, 15 aa, Mycobacterium tuberculosis
RRVFSDRDRMRTSDI

SEQ ID NO: 94105 - protein, 15 aa, Mycobacterium tuberculosis
RVFSDRDRMRTSDIL

SEQ ID NO: 94106 - protein, 15 aa, Mycobacterium tuberculosis
VFSDRDRMRTSDILT

SEQ ID NO: 94107 - protein, 15 aa, Mycobacterium tuberculosis
FSDRDRMRTSDILTG

SEQ ID NO: 94108 - protein, 15 aa, Mycobacterium tuberculosis
SDRDRMRTSDILTGL

SEQ ID NO: 94109 - protein, 15 aa, Mycobacterium tuberculosis
DRDRMRTSDILTGLN

SEQ ID NO: 94110 - protein, 15 aa, Mycobacterium tuberculosis
RDRMRTSDILTGLNR

SEQ ID NO: 94111 - protein, 15 aa, Mycobacterium tuberculosis
DRMRTSDILTGLNRM

SEQ ID NO: 94112 - protein, 15 aa, Mycobacterium tuberculosis
RMRTSDILTGLNRME

SEQ ID NO: 94113 - protein, 15 aa, Mycobacterium tuberculosis
MRTSDILTGLNRMEE

SEQ ID NO: 94114 - protein, 15 aa, Mycobacterium tuberculosis
RTSDILTGLNRMEEG

SEQ ID NO: 94115 - protein, 15 aa, Mycobacterium tuberculosis
TSDILTGLNRMEEGP

SEQ ID NO: 94116 - protein, 15 aa, Mycobacterium tuberculosis
SDILTGLNRMEEGPW

SEQ ID NO: 94117 - protein, 15 aa, Mycobacterium tuberculosis
DILTGLNRMEEGPWG

SEQ ID NO: 94118 - protein, 15 aa, Mycobacterium tuberculosis
ILTGLNRMEEGPWGS

SEQ ID NO: 94119 - protein, 15 aa, Mycobacterium tuberculosis
LTGLNRMEEGPWGSI

SEQ ID NO: 94120 - protein, 15 aa, Mycobacterium tuberculosis
TGLNRMEEGPWGSIR

SEQ ID NO: 94121 - protein, 15 aa, Mycobacterium tuberculosis
GLNRMEEGPWGSIRR

SEQ ID NO: 94122 - protein, 15 aa, Mycobacterium tuberculosis
LNRMEEGPWGSIRRG

SEQ ID NO: 94123 - protein, 15 aa, Mycobacterium tuberculosis
NRMEEGPWGSIRRGD

SEQ ID NO: 94124 - protein, 15 aa, Mycobacterium tuberculosis
RMEEGPWGSIRRGDP

SEQ ID NO: 94125 - protein, 15 aa, Mycobacterium tuberculosis
MEEGPWGSIRRGDPL

SEQ ID NO: 94126 - protein, 15 aa, Mycobacterium tuberculosis
EEGPWGSIRRGDPLD

SEQ ID NO: 94127 - protein, 15 aa, Mycobacterium tuberculosis
EGPWGSIRRGDPLDA

SEQ ID NO: 94128 - protein, 15 aa, Mycobacterium tuberculosis
GPWGSIRRGDPLDAR

SEQ ID NO: 94129 - protein, 15 aa, Mycobacterium tuberculosis
PWGSIRRGDPLDARG

SEQ ID NO: 94130 - protein, 15 aa, Mycobacterium tuberculosis
WGSIRRGDPLDARGL

SEQ ID NO: 94131 - protein, 15 aa, Mycobacterium tuberculosis
GSIRRGDPLDARGLA

SEQ ID NO: 94132 - protein, 15 aa, Mycobacterium tuberculosis
SIRRGDPLDARGLAT

SEQ ID NO: 94133 - protein, 15 aa, Mycobacterium tuberculosis
IRRGDPLDARGLATR

SEQ ID NO: 94134 - protein, 15 aa, Mycobacterium tuberculosis
RRGDPLDARGLATRL

SEQ ID NO: 94135 - protein, 15 aa, Mycobacterium tuberculosis
RGDPLDARGLATRLG

SEQ ID NO: 94136 - protein, 15 aa, Mycobacterium tuberculosis
GDPLDARGLATRLGR

SEQ ID NO: 94137 - protein, 15 aa, Mycobacterium tuberculosis
DPLDARGLATRLGRY

SEQ ID NO: 94138 - protein, 15 aa, Mycobacterium tuberculosis
PLDARGLATRLGRYG

SEQ ID NO: 94139 - protein, 15 aa, Mycobacterium tuberculosis
LDARGLATRLGRYGI

SEQ ID NO: 94140 - protein, 15 aa, Mycobacterium tuberculosis
DARGLATRLGRYGIG

SEQ ID NO: 94141 - protein, 15 aa, Mycobacterium tuberculosis
ARGLATRLGRYGIGP

SEQ ID NO: 94142 - protein, 15 aa, Mycobacterium tuberculosis
RGLATRLGRYGIGPK

SEQ ID NO: 94143 - protein, 15 aa, Mycobacterium tuberculosis
GLATRLGRYGIGPKF

SEQ ID NO: 94144 - protein, 15 aa, Mycobacterium tuberculosis
LATRLGRYGIGPKFQ

SEQ ID NO: 94145 - protein, 15 aa, Mycobacterium tuberculosis
ATRLGRYGIGPKFQH

SEQ ID NO: 94146 - protein, 15 aa, Mycobacterium tuberculosis
TRLGRYGIGPKFQHS

SEQ ID NO: 94147 - protein, 15 aa, Mycobacterium tuberculosis
RLGRYGIGPKFQHSG

SEQ ID NO: 94148 - protein, 15 aa, Mycobacterium tuberculosis
LGRYGIGPKFQHSGG

SEQ ID NO: 94149 - protein, 15 aa, Mycobacterium tuberculosis
GRYGIGPKFQHSGGE

SEQ ID NO: 94150 - protein, 15 aa, Mycobacterium tuberculosis
RYGIGPKFQHSGGEP

SEQ ID NO: 94151 - protein, 15 aa, Mycobacterium tuberculosis
YGIGPKFQHSGGEPP

SEQ ID NO: 94152 - protein, 15 aa, Mycobacterium tuberculosis
GIGPKFQHSGGEPPY

SEQ ID NO: 94153 - protein, 15 aa, Mycobacterium tuberculosis
IGPKFQHSGGEPPYK

SEQ ID NO: 94154 - protein, 15 aa, Mycobacterium tuberculosis
GPKFQHSGGEPPYKG

SEQ ID NO: 94155 - protein, 15 aa, Mycobacterium tuberculosis
PKFQHSGGEPPYKGY

SEQ ID NO: 94156 - protein, 15 aa, Mycobacterium tuberculosis
KFQHSGGEPPYKGYS

SEQ ID NO: 94157 - protein, 15 aa, Mycobacterium tuberculosis
FQHSGGEPPYKGYSR

SEQ ID NO: 94158 - protein, 15 aa, Mycobacterium tuberculosis
QHSGGEPPYKGYSRT

SEQ ID NO: 94159 - protein, 15 aa, Mycobacterium tuberculosis
HSGGEPPYKGYSRTQ

SEQ ID NO: 94160 - protein, 15 aa, Mycobacterium tuberculosis
SGGEPPYKGYSRTQF

SEQ ID NO: 94161 - protein, 15 aa, Mycobacterium tuberculosis
GGEPPYKGYSRTQFE

SEQ ID NO: 94162 - protein, 15 aa, Mycobacterium tuberculosis
GEPPYKGYSRTQFED

SEQ ID NO: 94163 - protein, 15 aa, Mycobacterium tuberculosis
EPPYKGYSRTQFEDA

SEQ ID NO: 94164 - protein, 15 aa, Mycobacterium tuberculosis
PPYKGYSRTQFEDAW

SEQ ID NO: 94165 - protein, 15 aa, Mycobacterium tuberculosis
PYKGYSRTQFEDAWS

SEQ ID NO: 94166 - protein, 15 aa, Mycobacterium tuberculosis
YKGYSRTQFEDAWSR

SEQ ID NO: 94167 - protein, 15 aa, Mycobacterium tuberculosis
KGYSRTQFEDAWSRY

SEQ ID NO: 94168 - protein, 15 aa, Mycobacterium tuberculosis
GYSRTQFEDAWSRYL

SEQ ID NO: 94169 - protein, 15 aa, Mycobacterium tuberculosis
YSRTQFEDAWSRYLS

SEQ ID NO: 94170 - protein, 15 aa, Mycobacterium tuberculosis
SRTQFEDAWSRYLSA

SEQ ID NO: 94171 - protein, 15 aa, Mycobacterium tuberculosis
RTQFEDAWSRYLSAD

SEQ ID NO: 94172 - protein, 15 aa, Mycobacterium tuberculosis
TQFEDAWSRYLSADD

SEQ ID NO: 94173 - protein, 15 aa, Mycobacterium tuberculosis
QFEDAWSRYLSADDE

SEQ ID NO: 94174 - protein, 15 aa, Mycobacterium tuberculosis
FEDAWSRYLSADDET

SEQ ID NO: 94175 - protein, 15 aa, Mycobacterium tuberculosis
EDAWSRYLSADDETP

SEQ ID NO: 94176 - protein, 15 aa, Mycobacterium tuberculosis
DAWSRYLSADDETPE

SEQ ID NO: 94177 - protein, 15 aa, Mycobacterium tuberculosis
AWSRYLSADDETPEE

SEQ ID NO: 94178 - protein, 15 aa, Mycobacterium tuberculosis
WSRYLSADDETPEER

SEQ ID NO: 94179 - protein, 15 aa, Mycobacterium tuberculosis
SRYLSADDETPEERD

SEQ ID NO: 94180 - protein, 15 aa, Mycobacterium tuberculosis
RYLSADDETPEERDL

SEQ ID NO: 94181 - protein, 15 aa, Mycobacterium tuberculosis
YLSADDETPEERDLS

SEQ ID NO: 94182 - protein, 15 aa, Mycobacterium tuberculosis
LSADDETPEERDLSV

SEQ ID NO: 94183 - protein, 15 aa, Mycobacterium tuberculosis
SADDETPEERDLSVS

SEQ ID NO: 94184 - protein, 15 aa, Mycobacterium tuberculosis
ADDETPEERDLSVSA

SEQ ID NO: 94185 - protein, 15 aa, Mycobacterium tuberculosis
DDETPEERDLSVSAV

SEQ ID NO: 94186 - protein, 15 aa, Mycobacterium tuberculosis
DETPEERDLSVSAVS

SEQ ID NO: 94187 - protein, 15 aa, Mycobacterium tuberculosis
ETPEERDLSVSAVSA

SEQ ID NO: 94188 - protein, 15 aa, Mycobacterium tuberculosis
TPEERDLSVSAVSAV

SEQ ID NO: 94189 - protein, 15 aa, Mycobacterium tuberculosis
PEERDLSVSAVSAVS

SEQ ID NO: 94190 - protein, 15 aa, Mycobacterium tuberculosis
EERDLSVSAVSAVSP

SEQ ID NO: 94191 - protein, 15 aa, Mycobacterium tuberculosis
ERDLSVSAVSAVSPP

SEQ ID NO: 94192 - protein, 15 aa, Mycobacterium tuberculosis
RDLSVSAVSAVSPPV

SEQ ID NO: 94193 - protein, 15 aa, Mycobacterium tuberculosis
DLSVSAVSAVSPPVG

SEQ ID NO: 94194 - protein, 15 aa, Mycobacterium tuberculosis
LSVSAVSAVSPPVGD

SEQ ID NO: 94195 - protein, 15 aa, Mycobacterium tuberculosis
SVSAVSAVSPPVGDP

SEQ ID NO: 94196 - protein, 15 aa, Mycobacterium tuberculosis
VSAVSAVSPPVGDPG

SEQ ID NO: 94197 - protein, 15 aa, Mycobacterium tuberculosis
SAVSAVSPPVGDPGD

SEQ ID NO: 94198 - protein, 15 aa, Mycobacterium tuberculosis
AVSAVSPPVGDPGDA

SEQ ID NO: 94199 - protein, 15 aa, Mycobacterium tuberculosis
VSAVSPPVGDPGDAT

SEQ ID NO: 94200 - protein, 15 aa, Mycobacterium tuberculosis
SAVSPPVGDPGDATG

SEQ ID NO: 94201 - protein, 15 aa, Mycobacterium tuberculosis
AVSPPVGDPGDATGA

SEQ ID NO: 94202 - protein, 15 aa, Mycobacterium tuberculosis
VSPPVGDPGDATGAT

SEQ ID NO: 94203 - protein, 15 aa, Mycobacterium tuberculosis
SPPVGDPGDATGATD

SEQ ID NO: 94204 - protein, 15 aa, Mycobacterium tuberculosis
PPVGDPGDATGATDA

SEQ ID NO: 94205 - protein, 15 aa, Mycobacterium tuberculosis
PVGDPGDATGATDAT

SEQ ID NO: 94206 - protein, 15 aa, Mycobacterium tuberculosis
VGDPGDATGATDATD

SEQ ID NO: 94207 - protein, 15 aa, Mycobacterium tuberculosis
GDPGDATGATDATDL

SEQ ID NO: 94208 - protein, 15 aa, Mycobacterium tuberculosis
DPGDATGATDATDLP

SEQ ID NO: 94209 - protein, 15 aa, Mycobacterium tuberculosis
PGDATGATDATDLPE

SEQ ID NO: 94210 - protein, 15 aa, Mycobacterium tuberculosis
GDATGATDATDLPEA

SEQ ID NO: 94211 - protein, 15 aa, Mycobacterium tuberculosis
DATGATDATDLPEAG

SEQ ID NO: 94212 - protein, 15 aa, Mycobacterium tuberculosis
ATGATDATDLPEAGD

SEQ ID NO: 94213 - protein, 15 aa, Mycobacterium tuberculosis
TGATDATDLPEAGDL

SEQ ID NO: 94214 - protein, 15 aa, Mycobacterium tuberculosis
GATDATDLPEAGDLP

SEQ ID NO: 94215 - protein, 15 aa, Mycobacterium tuberculosis
ATDATDLPEAGDLPY

SEQ ID NO: 94216 - protein, 15 aa, Mycobacterium tuberculosis
TDATDLPEAGDLPYE

SEQ ID NO: 94217 - protein, 15 aa, Mycobacterium tuberculosis
DATDLPEAGDLPYEP

SEQ ID NO: 94218 - protein, 15 aa, Mycobacterium tuberculosis
ATDLPEAGDLPYEPP

SEQ ID NO: 94219 - protein, 15 aa, Mycobacterium tuberculosis
TDLPEAGDLPYEPPA

SEQ ID NO: 94220 - protein, 15 aa, Mycobacterium tuberculosis
DLPEAGDLPYEPPAP

SEQ ID NO: 94221 - protein, 15 aa, Mycobacterium tuberculosis
LPEAGDLPYEPPAPN

SEQ ID NO: 94222 - protein, 15 aa, Mycobacterium tuberculosis
PEAGDLPYEPPAPNG

SEQ ID NO: 94223 - protein, 15 aa, Mycobacterium tuberculosis
EAGDLPYEPPAPNGH

SEQ ID NO: 94224 - protein, 15 aa, Mycobacterium tuberculosis
AGDLPYEPPAPNGHP

SEQ ID NO: 94225 - protein, 15 aa, Mycobacterium tuberculosis
GDLPYEPPAPNGHPN

SEQ ID NO: 94226 - protein, 15 aa, Mycobacterium tuberculosis
DLPYEPPAPNGHPNG

SEQ ID NO: 94227 - protein, 15 aa, Mycobacterium tuberculosis
LPYEPPAPNGHPNGD

SEQ ID NO: 94228 - protein, 15 aa, Mycobacterium tuberculosis
PYEPPAPNGHPNGDA

SEQ ID NO: 94229 - protein, 15 aa, Mycobacterium tuberculosis
YEPPAPNGHPNGDAP

SEQ ID NO: 94230 - protein, 15 aa, Mycobacterium tuberculosis
EPPAPNGHPNGDAPL

SEQ ID NO: 94231 - protein, 15 aa, Mycobacterium tuberculosis
PPAPNGHPNGDAPLC

SEQ ID NO: 94232 - protein, 15 aa, Mycobacterium tuberculosis
PAPNGHPNGDAPLCS

SEQ ID NO: 94233 - protein, 15 aa, Mycobacterium tuberculosis
APNGHPNGDAPLCSG

SEQ ID NO: 94234 - protein, 15 aa, Mycobacterium tuberculosis
PNGHPNGDAPLCSGP

SEQ ID NO: 94235 - protein, 15 aa, Mycobacterium tuberculosis
NGHPNGDAPLCSGPG

SEQ ID NO: 94236 - protein, 15 aa, Mycobacterium tuberculosis
GHPNGDAPLCSGPGC

SEQ ID NO: 94237 - protein, 15 aa, Mycobacterium tuberculosis
HPNGDAPLCSGPGCP

SEQ ID NO: 94238 - protein, 15 aa, Mycobacterium tuberculosis
PNGDAPLCSGPGCPN

SEQ ID NO: 94239 - protein, 15 aa, Mycobacterium tuberculosis
NGDAPLCSGPGCPNK

SEQ ID NO: 94240 - protein, 15 aa, Mycobacterium tuberculosis
GDAPLCSGPGCPNKL

SEQ ID NO: 94241 - protein, 15 aa, Mycobacterium tuberculosis
DAPLCSGPGCPNKLL

SEQ ID NO: 94242 - protein, 15 aa, Mycobacterium tuberculosis
APLCSGPGCPNKLLS

SEQ ID NO: 94243 - protein, 15 aa, Mycobacterium tuberculosis
PLCSGPGCPNKLLST

SEQ ID NO: 94244 - protein, 15 aa, Mycobacterium tuberculosis
LCSGPGCPNKLLSTE

SEQ ID NO: 94245 - protein, 15 aa, Mycobacterium tuberculosis
CSGPGCPNKLLSTEA

SEQ ID NO: 94246 - protein, 15 aa, Mycobacterium tuberculosis
SGPGCPNKLLSTEAK

SEQ ID NO: 94247 - protein, 15 aa, Mycobacterium tuberculosis
GPGCPNKLLSTEAKA

SEQ ID NO: 94248 - protein, 15 aa, Mycobacterium tuberculosis
PGCPNKLLSTEAKAA

SEQ ID NO: 94249 - protein, 15 aa, Mycobacterium tuberculosis
GCPNKLLSTEAKAAG

SEQ ID NO: 94250 - protein, 15 aa, Mycobacterium tuberculosis
CPNKLLSTEAKAAGK

SEQ ID NO: 94251 - protein, 15 aa, Mycobacterium tuberculosis
PNKLLSTEAKAAGKC

SEQ ID NO: 94252 - protein, 15 aa, Mycobacterium tuberculosis
NKLLSTEAKAAGKCR

SEQ ID NO: 94253 - protein, 15 aa, Mycobacterium tuberculosis
KLLSTEAKAAGKCRP

SEQ ID NO: 94254 - protein, 15 aa, Mycobacterium tuberculosis
LLSTEAKAAGKCRPC

SEQ ID NO: 94255 - protein, 15 aa, Mycobacterium tuberculosis
LSTEAKAAGKCRPCR

SEQ ID NO: 94256 - protein, 15 aa, Mycobacterium tuberculosis
STEAKAAGKCRPCRG

SEQ ID NO: 94257 - protein, 15 aa, Mycobacterium tuberculosis
TEAKAAGKCRPCRGR

SEQ ID NO: 94258 - protein, 15 aa, Mycobacterium tuberculosis
EAKAAGKCRPCRGRA

SEQ ID NO: 94259 - protein, 15 aa, Mycobacterium tuberculosis
AKAAGKCRPCRGRAA

SEQ ID NO: 94260 - protein, 15 aa, Mycobacterium tuberculosis
KAAGKCRPCRGRAAA

SEQ ID NO: 94261 - protein, 15 aa, Mycobacterium tuberculosis
AAGKCRPCRGRAAAS

SEQ ID NO: 94262 - protein, 15 aa, Mycobacterium tuberculosis
AGKCRPCRGRAAASA

SEQ ID NO: 94263 - protein, 15 aa, Mycobacterium tuberculosis
GKCRPCRGRAAASAR

SEQ ID NO: 94264 - protein, 15 aa, Mycobacterium tuberculosis
KCRPCRGRAAASARD

SEQ ID NO: 94265 - protein, 15 aa, Mycobacterium tuberculosis
CRPCRGRAAASARDG

SEQ ID NO: 94266 - protein, 15 aa, Mycobacterium tuberculosis
RPCRGRAAASARDGA

SEQ ID NO: 94267 - protein, 15 aa, Mycobacterium tuberculosis
PCRGRAAASARDGAR

SEQ ID NO: 94268 - protein, 16 aa, Mycobacterium tuberculosis
MADIPYGRDYPDPIWC

SEQ ID NO: 94269 - protein, 16 aa, Mycobacterium tuberculosis
ADIPYGRDYPDPIWCD

SEQ ID NO: 94270 - protein, 16 aa, Mycobacterium tuberculosis
DIPYGRDYPDPIWCDE

SEQ ID NO: 94271 - protein, 16 aa, Mycobacterium tuberculosis
IPYGRDYPDPIWCDED

SEQ ID NO: 94272 - protein, 16 aa, Mycobacterium tuberculosis
PYGRDYPDPIWCDEDG

SEQ ID NO: 94273 - protein, 16 aa, Mycobacterium tuberculosis
YGRDYPDPIWCDEDGQ

SEQ ID NO: 94274 - protein, 16 aa, Mycobacterium tuberculosis
GRDYPDPIWCDEDGQP

SEQ ID NO: 94275 - protein, 16 aa, Mycobacterium tuberculosis
RDYPDPIWCDEDGQPM

SEQ ID NO: 94276 - protein, 16 aa, Mycobacterium tuberculosis
DYPDPIWCDEDGQPMP

SEQ ID NO: 94277 - protein, 16 aa, Mycobacterium tuberculosis
YPDPIWCDEDGQPMPP

SEQ ID NO: 94278 - protein, 16 aa, Mycobacterium tuberculosis
PDPIWCDEDGQPMPPV

SEQ ID NO: 94279 - protein, 16 aa, Mycobacterium tuberculosis
DPIWCDEDGQPMPPVG

SEQ ID NO: 94280 - protein, 16 aa, Mycobacterium tuberculosis
PIWCDEDGQPMPPVGA

SEQ ID NO: 94281 - protein, 16 aa, Mycobacterium tuberculosis
IWCDEDGQPMPPVGAE

SEQ ID NO: 94282 - protein, 16 aa, Mycobacterium tuberculosis
WCDEDGQPMPPVGAEL

SEQ ID NO: 94283 - protein, 16 aa, Mycobacterium tuberculosis
CDEDGQPMPPVGAELL

SEQ ID NO: 94284 - protein, 16 aa, Mycobacterium tuberculosis
DEDGQPMPPVGAELLD

SEQ ID NO: 94285 - protein, 16 aa, Mycobacterium tuberculosis
EDGQPMPPVGAELLDD

SEQ ID NO: 94286 - protein, 16 aa, Mycobacterium tuberculosis
DGQPMPPVGAELLDDI

SEQ ID NO: 94287 - protein, 16 aa, Mycobacterium tuberculosis
GQPMPPVGAELLDDIR

SEQ ID NO: 94288 - protein, 16 aa, Mycobacterium tuberculosis
QPMPPVGAELLDDIRA

SEQ ID NO: 94289 - protein, 16 aa, Mycobacterium tuberculosis
PMPPVGAELLDDIRAF

SEQ ID NO: 94290 - protein, 16 aa, Mycobacterium tuberculosis
MPPVGAELLDDIRAFL

SEQ ID NO: 94291 - protein, 16 aa, Mycobacterium tuberculosis
PPVGAELLDDIRAFLR

SEQ ID NO: 94292 - protein, 16 aa, Mycobacterium tuberculosis
PVGAELLDDIRAFLRR

SEQ ID NO: 94293 - protein, 16 aa, Mycobacterium tuberculosis
VGAELLDDIRAFLRRF

SEQ ID NO: 94294 - protein, 16 aa, Mycobacterium tuberculosis
GAELLDDIRAFLRRFV

SEQ ID NO: 94295 - protein, 16 aa, Mycobacterium tuberculosis
AELLDDIRAFLRRFVV

SEQ ID NO: 94296 - protein, 16 aa, Mycobacterium tuberculosis
ELLDDIRAFLRRFVVY

SEQ ID NO: 94297 - protein, 16 aa, Mycobacterium tuberculosis
LLDDIRAFLRRFVVYP

SEQ ID NO: 94298 - protein, 16 aa, Mycobacterium tuberculosis
LDDIRAFLRRFVVYPS

SEQ ID NO: 94299 - protein, 16 aa, Mycobacterium tuberculosis
DDIRAFLRRFVVYPSD

SEQ ID NO: 94300 - protein, 16 aa, Mycobacterium tuberculosis
DIRAFLRRFVVYPSDH

SEQ ID NO: 94301 - protein, 16 aa, Mycobacterium tuberculosis
IRAFLRRFVVYPSDHE

SEQ ID NO: 94302 - protein, 16 aa, Mycobacterium tuberculosis
RAFLRRFVVYPSDHEL

SEQ ID NO: 94303 - protein, 16 aa, Mycobacterium tuberculosis
AFLRRFVVYPSDHELI

SEQ ID NO: 94304 - protein, 16 aa, Mycobacterium tuberculosis
FLRRFVVYPSDHELIA

SEQ ID NO: 94305 - protein, 16 aa, Mycobacterium tuberculosis
LRRFVVYPSDHELIAH

SEQ ID NO: 94306 - protein, 16 aa, Mycobacterium tuberculosis
RRFVVYPSDHELIAHT

SEQ ID NO: 94307 - protein, 16 aa, Mycobacterium tuberculosis
RFVVYPSDHELIAHTL

SEQ ID NO: 94308 - protein, 16 aa, Mycobacterium tuberculosis
FVVYPSDHELIAHTLW

SEQ ID NO: 94309 - protein, 16 aa, Mycobacterium tuberculosis
VVYPSDHELIAHTLWI

SEQ ID NO: 94310 - protein, 16 aa, Mycobacterium tuberculosis
VYPSDHELIAHTLWIA

SEQ ID NO: 94311 - protein, 16 aa, Mycobacterium tuberculosis
YPSDHELIAHTLWIAH

SEQ ID NO: 94312 - protein, 16 aa, Mycobacterium tuberculosis
PSDHELIAHTLWIAHC

SEQ ID NO: 94313 - protein, 16 aa, Mycobacterium tuberculosis
SDHELIAHTLWIAHCW

SEQ ID NO: 94314 - protein, 16 aa, Mycobacterium tuberculosis
DHELIAHTLWIAHCWF

SEQ ID NO: 94315 - protein, 16 aa, Mycobacterium tuberculosis
HELIAHTLWIAHCWFM

SEQ ID NO: 94316 - protein, 16 aa, Mycobacterium tuberculosis
ELIAHTLWIAHCWFME

SEQ ID NO: 94317 - protein, 16 aa, Mycobacterium tuberculosis
LIAHTLWIAHCWFMEA

SEQ ID NO: 94318 - protein, 16 aa, Mycobacterium tuberculosis
IAHTLWIAHCWFMEAW

SEQ ID NO: 94319 - protein, 16 aa, Mycobacterium tuberculosis
AHTLWIAHCWFMEAWD

SEQ ID NO: 94320 - protein, 16 aa, Mycobacterium tuberculosis
HTLWIAHCWFMEAWDS

SEQ ID NO: 94321 - protein, 16 aa, Mycobacterium tuberculosis
TLWIAHCWFMEAWDST

SEQ ID NO: 94322 - protein, 16 aa, Mycobacterium tuberculosis
LWIAHCWFMEAWDSTP

SEQ ID NO: 94323 - protein, 16 aa, Mycobacterium tuberculosis
WIAHCWFMEAWDSTPR

SEQ ID NO: 94324 - protein, 16 aa, Mycobacterium tuberculosis
IAHCWFMEAWDSTPRI

SEQ ID NO: 94325 - protein, 16 aa, Mycobacterium tuberculosis
AHCWFMEAWDSTPRIA

SEQ ID NO: 94326 - protein, 16 aa, Mycobacterium tuberculosis
HCWFMEAWDSTPRIAF

SEQ ID NO: 94327 - protein, 16 aa, Mycobacterium tuberculosis
CWFMEAWDSTPRIAFL

SEQ ID NO: 94328 - protein, 16 aa, Mycobacterium tuberculosis
WFMEAWDSTPRIAFLS

SEQ ID NO: 94329 - protein, 16 aa, Mycobacterium tuberculosis
FMEAWDSTPRIAFLSP

SEQ ID NO: 94330 - protein, 16 aa, Mycobacterium tuberculosis
MEAWDSTPRIAFLSPE

SEQ ID NO: 94331 - protein, 16 aa, Mycobacterium tuberculosis
EAWDSTPRIAFLSPEP

SEQ ID NO: 94332 - protein, 16 aa, Mycobacterium tuberculosis
AWDSTPRIAFLSPEPG

SEQ ID NO: 94333 - protein, 16 aa, Mycobacterium tuberculosis
WDSTPRIAFLSPEPGS

SEQ ID NO: 94334 - protein, 16 aa, Mycobacterium tuberculosis
DSTPRIAFLSPEPGSG

SEQ ID NO: 94335 - protein, 16 aa, Mycobacterium tuberculosis
STPRIAFLSPEPGSGK

SEQ ID NO: 94336 - protein, 16 aa, Mycobacterium tuberculosis
TPRIAFLSPEPGSGKS

SEQ ID NO: 94337 - protein, 16 aa, Mycobacterium tuberculosis
PRIAFLSPEPGSGKSR

SEQ ID NO: 94338 - protein, 16 aa, Mycobacterium tuberculosis
RIAFLSPEPGSGKSRA

SEQ ID NO: 94339 - protein, 16 aa, Mycobacterium tuberculosis
IAFLSPEPGSGKSRAL

SEQ ID NO: 94340 - protein, 16 aa, Mycobacterium tuberculosis
AFLSPEPGSGKSRALE

SEQ ID NO: 94341 - protein, 16 aa, Mycobacterium tuberculosis
FLSPEPGSGKSRALEV

SEQ ID NO: 94342 - protein, 16 aa, Mycobacterium tuberculosis
LSPEPGSGKSRALEVT

SEQ ID NO: 94343 - protein, 16 aa, Mycobacterium tuberculosis
SPEPGSGKSRALEVTE

SEQ ID NO: 94344 - protein, 16 aa, Mycobacterium tuberculosis
PEPGSGKSRALEVTEP

SEQ ID NO: 94345 - protein, 16 aa, Mycobacterium tuberculosis
EPGSGKSRALEVTEPL

SEQ ID NO: 94346 - protein, 16 aa, Mycobacterium tuberculosis
PGSGKSRALEVTEPLV

SEQ ID NO: 94347 - protein, 16 aa, Mycobacterium tuberculosis
GSGKSRALEVTEPLVP

SEQ ID NO: 94348 - protein, 16 aa, Mycobacterium tuberculosis
SGKSRALEVTEPLVPR

SEQ ID NO: 94349 - protein, 16 aa, Mycobacterium tuberculosis
GKSRALEVTEPLVPRP

SEQ ID NO: 94350 - protein, 16 aa, Mycobacterium tuberculosis
KSRALEVTEPLVPRPV

SEQ ID NO: 94351 - protein, 16 aa, Mycobacterium tuberculosis
SRALEVTEPLVPRPVH

SEQ ID NO: 94352 - protein, 16 aa, Mycobacterium tuberculosis
RALEVTEPLVPRPVHA

SEQ ID NO: 94353 - protein, 16 aa, Mycobacterium tuberculosis
ALEVTEPLVPRPVHAI

SEQ ID NO: 94354 - protein, 16 aa, Mycobacterium tuberculosis
LEVTEPLVPRPVHAIN

SEQ ID NO: 94355 - protein, 16 aa, Mycobacterium tuberculosis
EVTEPLVPRPVHAINC

SEQ ID NO: 94356 - protein, 16 aa, Mycobacterium tuberculosis
VTEPLVPRPVHAINCT

SEQ ID NO: 94357 - protein, 16 aa, Mycobacterium tuberculosis
TEPLVPRPVHAINCTP

SEQ ID NO: 94358 - protein, 16 aa, Mycobacterium tuberculosis
EPLVPRPVHAINCTPA

SEQ ID NO: 94359 - protein, 16 aa, Mycobacterium tuberculosis
PLVPRPVHAINCTPAY

SEQ ID NO: 94360 - protein, 16 aa, Mycobacterium tuberculosis
LVPRPVHAINCTPAYL

SEQ ID NO: 94361 - protein, 16 aa, Mycobacterium tuberculosis
VPRPVHAINCTPAYLF

SEQ ID NO: 94362 - protein, 16 aa, Mycobacterium tuberculosis
PRPVHAINCTPAYLFR

SEQ ID NO: 94363 - protein, 16 aa, Mycobacterium tuberculosis
RPVHAINCTPAYLFRR

SEQ ID NO: 94364 - protein, 16 aa, Mycobacterium tuberculosis
PVHAINCTPAYLFRRV

SEQ ID NO: 94365 - protein, 16 aa, Mycobacterium tuberculosis
VHAINCTPAYLFRRVA

SEQ ID NO: 94366 - protein, 16 aa, Mycobacterium tuberculosis
HAINCTPAYLFRRVAD

SEQ ID NO: 94367 - protein, 16 aa, Mycobacterium tuberculosis
AINCTPAYLFRRVADP

SEQ ID NO: 94368 - protein, 16 aa, Mycobacterium tuberculosis
INCTPAYLFRRVADPV

SEQ ID NO: 94369 - protein, 16 aa, Mycobacterium tuberculosis
NCTPAYLFRRVADPVG

SEQ ID NO: 94370 - protein, 16 aa, Mycobacterium tuberculosis
CTPAYLFRRVADPVGR

SEQ ID NO: 94371 - protein, 16 aa, Mycobacterium tuberculosis
TPAYLFRRVADPVGRP

SEQ ID NO: 94372 - protein, 16 aa, Mycobacterium tuberculosis
PAYLFRRVADPVGRPT

SEQ ID NO: 94373 - protein, 16 aa, Mycobacterium tuberculosis
AYLFRRVADPVGRPTV

SEQ ID NO: 94374 - protein, 16 aa, Mycobacterium tuberculosis
YLFRRVADPVGRPTVL

SEQ ID NO: 94375 - protein, 16 aa, Mycobacterium tuberculosis
LFRRVADPVGRPTVLY

SEQ ID NO: 94376 - protein, 16 aa, Mycobacterium tuberculosis
FRRVADPVGRPTVLYD

SEQ ID NO: 94377 - protein, 16 aa, Mycobacterium tuberculosis
RRVADPVGRPTVLYDE

SEQ ID NO: 94378 - protein, 16 aa, Mycobacterium tuberculosis
RVADPVGRPTVLYDEC

SEQ ID NO: 94379 - protein, 16 aa, Mycobacterium tuberculosis
VADPVGRPTVLYDECD

SEQ ID NO: 94380 - protein, 16 aa, Mycobacterium tuberculosis
ADPVGRPTVLYDECDT

SEQ ID NO: 94381 - protein, 16 aa, Mycobacterium tuberculosis
DPVGRPTVLYDECDTL

SEQ ID NO: 94382 - protein, 16 aa, Mycobacterium tuberculosis
PVGRPTVLYDECDTLF

SEQ ID NO: 94383 - protein, 16 aa, Mycobacterium tuberculosis
VGRPTVLYDECDTLFG

SEQ ID NO: 94384 - protein, 16 aa, Mycobacterium tuberculosis
GRPTVLYDECDTLFGP

SEQ ID NO: 94385 - protein, 16 aa, Mycobacterium tuberculosis
RPTVLYDECDTLFGPK

SEQ ID NO: 94386 - protein, 16 aa, Mycobacterium tuberculosis
PTVLYDECDTLFGPKA

SEQ ID NO: 94387 - protein, 16 aa, Mycobacterium tuberculosis
TVLYDECDTLFGPKAK

SEQ ID NO: 94388 - protein, 16 aa, Mycobacterium tuberculosis
VLYDECDTLFGPKAKE

SEQ ID NO: 94389 - protein, 16 aa, Mycobacterium tuberculosis
LYDECDTLFGPKAKEH

SEQ ID NO: 94390 - protein, 16 aa, Mycobacterium tuberculosis
YDECDTLFGPKAKEHE

SEQ ID NO: 94391 - protein, 16 aa, Mycobacterium tuberculosis
DECDTLFGPKAKEHEE

SEQ ID NO: 94392 - protein, 16 aa, Mycobacterium tuberculosis
ECDTLFGPKAKEHEEI

SEQ ID NO: 94393 - protein, 16 aa, Mycobacterium tuberculosis
CDTLFGPKAKEHEEIR

SEQ ID NO: 94394 - protein, 16 aa, Mycobacterium tuberculosis
DTLFGPKAKEHEEIRG

SEQ ID NO: 94395 - protein, 16 aa, Mycobacterium tuberculosis
TLFGPKAKEHEEIRGV

SEQ ID NO: 94396 - protein, 16 aa, Mycobacterium tuberculosis
LFGPKAKEHEEIRGVI

SEQ ID NO: 94397 - protein, 16 aa, Mycobacterium tuberculosis
FGPKAKEHEEIRGVIN

SEQ ID NO: 94398 - protein, 16 aa, Mycobacterium tuberculosis
GPKAKEHEEIRGVINA

SEQ ID NO: 94399 - protein, 16 aa, Mycobacterium tuberculosis
PKAKEHEEIRGVINAG

SEQ ID NO: 94400 - protein, 16 aa, Mycobacterium tuberculosis
KAKEHEEIRGVINAGH

SEQ ID NO: 94401 - protein, 16 aa, Mycobacterium tuberculosis
AKEHEEIRGVINAGHR

SEQ ID NO: 94402 - protein, 16 aa, Mycobacterium tuberculosis
KEHEEIRGVINAGHRK

SEQ ID NO: 94403 - protein, 16 aa, Mycobacterium tuberculosis
EHEEIRGVINAGHRKG

SEQ ID NO: 94404 - protein, 16 aa, Mycobacterium tuberculosis
HEEIRGVINAGHRKGA

SEQ ID NO: 94405 - protein, 16 aa, Mycobacterium tuberculosis
EEIRGVINAGHRKGAV

SEQ ID NO: 94406 - protein, 16 aa, Mycobacterium tuberculosis
EIRGVINAGHRKGAVA

SEQ ID NO: 94407 - protein, 16 aa, Mycobacterium tuberculosis
IRGVINAGHRKGAVAG

SEQ ID NO: 94408 - protein, 16 aa, Mycobacterium tuberculosis
RGVINAGHRKGAVAGR

SEQ ID NO: 94409 - protein, 16 aa, Mycobacterium tuberculosis
GVINAGHRKGAVAGRC

SEQ ID NO: 94410 - protein, 16 aa, Mycobacterium tuberculosis
VINAGHRKGAVAGRCV

SEQ ID NO: 94411 - protein, 16 aa, Mycobacterium tuberculosis
INAGHRKGAVAGRCVI

SEQ ID NO: 94412 - protein, 16 aa, Mycobacterium tuberculosis
NAGHRKGAVAGRCVIR

SEQ ID NO: 94413 - protein, 16 aa, Mycobacterium tuberculosis
AGHRKGAVAGRCVIRG

SEQ ID NO: 94414 - protein, 16 aa, Mycobacterium tuberculosis
GHRKGAVAGRCVIRGK

SEQ ID NO: 94415 - protein, 16 aa, Mycobacterium tuberculosis
HRKGAVAGRCVIRGKI

SEQ ID NO: 94416 - protein, 16 aa, Mycobacterium tuberculosis
RKGAVAGRCVIRGKIV

SEQ ID NO: 94417 - protein, 16 aa, Mycobacterium tuberculosis
KGAVAGRCVIRGKIVE

SEQ ID NO: 94418 - protein, 16 aa, Mycobacterium tuberculosis
GAVAGRCVIRGKIVET

SEQ ID NO: 94419 - protein, 16 aa, Mycobacterium tuberculosis
AVAGRCVIRGKIVETE

SEQ ID NO: 94420 - protein, 16 aa, Mycobacterium tuberculosis
VAGRCVIRGKIVETEE

SEQ ID NO: 94421 - protein, 16 aa, Mycobacterium tuberculosis
AGRCVIRGKIVETEEL

SEQ ID NO: 94422 - protein, 16 aa, Mycobacterium tuberculosis
GRCVIRGKIVETEELP

SEQ ID NO: 94423 - protein, 16 aa, Mycobacterium tuberculosis
RCVIRGKIVETEELPA

SEQ ID NO: 94424 - protein, 16 aa, Mycobacterium tuberculosis
CVIRGKIVETEELPAY

SEQ ID NO: 94425 - protein, 16 aa, Mycobacterium tuberculosis
VIRGKIVETEELPAYC

SEQ ID NO: 94426 - protein, 16 aa, Mycobacterium tuberculosis
IRGKIVETEELPAYCA

SEQ ID NO: 94427 - protein, 16 aa, Mycobacterium tuberculosis
RGKIVETEELPAYCAV

SEQ ID NO: 94428 - protein, 16 aa, Mycobacterium tuberculosis
GKIVETEELPAYCAVA

SEQ ID NO: 94429 - protein, 16 aa, Mycobacterium tuberculosis
KIVETEELPAYCAVAL

SEQ ID NO: 94430 - protein, 16 aa, Mycobacterium tuberculosis
IVETEELPAYCAVALA

SEQ ID NO: 94431 - protein, 16 aa, Mycobacterium tuberculosis
VETEELPAYCAVALAG

SEQ ID NO: 94432 - protein, 16 aa, Mycobacterium tuberculosis
ETEELPAYCAVALAGL

SEQ ID NO: 94433 - protein, 16 aa, Mycobacterium tuberculosis
TEELPAYCAVALAGLD

SEQ ID NO: 94434 - protein, 16 aa, Mycobacterium tuberculosis
EELPAYCAVALAGLDD

SEQ ID NO: 94435 - protein, 16 aa, Mycobacterium tuberculosis
ELPAYCAVALAGLDDL

SEQ ID NO: 94436 - protein, 16 aa, Mycobacterium tuberculosis
LPAYCAVALAGLDDLP

SEQ ID NO: 94437 - protein, 16 aa, Mycobacterium tuberculosis
PAYCAVALAGLDDLPD

SEQ ID NO: 94438 - protein, 16 aa, Mycobacterium tuberculosis
AYCAVALAGLDDLPDT

SEQ ID NO: 94439 - protein, 16 aa, Mycobacterium tuberculosis
YCAVALAGLDDLPDTI

SEQ ID NO: 94440 - protein, 16 aa, Mycobacterium tuberculosis
CAVALAGLDDLPDTIM

SEQ ID NO: 94441 - protein, 16 aa, Mycobacterium tuberculosis
AVALAGLDDLPDTIMS

SEQ ID NO: 94442 - protein, 16 aa, Mycobacterium tuberculosis
VALAGLDDLPDTIMSR

SEQ ID NO: 94443 - protein, 16 aa, Mycobacterium tuberculosis
ALAGLDDLPDTIMSRS

SEQ ID NO: 94444 - protein, 16 aa, Mycobacterium tuberculosis
LAGLDDLPDTIMSRSI

SEQ ID NO: 94445 - protein, 16 aa, Mycobacterium tuberculosis
AGLDDLPDTIMSRSIV

SEQ ID NO: 94446 - protein, 16 aa, Mycobacterium tuberculosis
GLDDLPDTIMSRSIVV

SEQ ID NO: 94447 - protein, 16 aa, Mycobacterium tuberculosis
LDDLPDTIMSRSIVVR

SEQ ID NO: 94448 - protein, 16 aa, Mycobacterium tuberculosis
DDLPDTIMSRSIVVRM

SEQ ID NO: 94449 - protein, 16 aa, Mycobacterium tuberculosis
DLPDTIMSRSIVVRMR

SEQ ID NO: 94450 - protein, 16 aa, Mycobacterium tuberculosis
LPDTIMSRSIVVRMRR

SEQ ID NO: 94451 - protein, 16 aa, Mycobacterium tuberculosis
PDTIMSRSIVVRMRRR

SEQ ID NO: 94452 - protein, 16 aa, Mycobacterium tuberculosis
DTIMSRSIVVRMRRRA

SEQ ID NO: 94453 - protein, 16 aa, Mycobacterium tuberculosis
TIMSRSIVVRMRRRAP

SEQ ID NO: 94454 - protein, 16 aa, Mycobacterium tuberculosis
IMSRSIVVRMRRRAPT

SEQ ID NO: 94455 - protein, 16 aa, Mycobacterium tuberculosis
MSRSIVVRMRRRAPTE

SEQ ID NO: 94456 - protein, 16 aa, Mycobacterium tuberculosis
SRSIVVRMRRRAPTEP

SEQ ID NO: 94457 - protein, 16 aa, Mycobacterium tuberculosis
RSIVVRMRRRAPTEPV

SEQ ID NO: 94458 - protein, 16 aa, Mycobacterium tuberculosis
SIVVRMRRRAPTEPVE

SEQ ID NO: 94459 - protein, 16 aa, Mycobacterium tuberculosis
IVVRMRRRAPTEPVEP

SEQ ID NO: 94460 - protein, 16 aa, Mycobacterium tuberculosis
VVRMRRRAPTEPVEPW

SEQ ID NO: 94461 - protein, 16 aa, Mycobacterium tuberculosis
VRMRRRAPTEPVEPWR

SEQ ID NO: 94462 - protein, 16 aa, Mycobacterium tuberculosis
RMRRRAPTEPVEPWRP

SEQ ID NO: 94463 - protein, 16 aa, Mycobacterium tuberculosis
MRRRAPTEPVEPWRPR

SEQ ID NO: 94464 - protein, 16 aa, Mycobacterium tuberculosis
RRRAPTEPVEPWRPRV

SEQ ID NO: 94465 - protein, 16 aa, Mycobacterium tuberculosis
RRAPTEPVEPWRPRVN

SEQ ID NO: 94466 - protein, 16 aa, Mycobacterium tuberculosis
RAPTEPVEPWRPRVNG

SEQ ID NO: 94467 - protein, 16 aa, Mycobacterium tuberculosis
APTEPVEPWRPRVNGP

SEQ ID NO: 94468 - protein, 16 aa, Mycobacterium tuberculosis
PTEPVEPWRPRVNGPE

SEQ ID NO: 94469 - protein, 16 aa, Mycobacterium tuberculosis
TEPVEPWRPRVNGPEA

SEQ ID NO: 94470 - protein, 16 aa, Mycobacterium tuberculosis
EPVEPWRPRVNGPEAE

SEQ ID NO: 94471 - protein, 16 aa, Mycobacterium tuberculosis
PVEPWRPRVNGPEAEK

SEQ ID NO: 94472 - protein, 16 aa, Mycobacterium tuberculosis
VEPWRPRVNGPEAEKL

SEQ ID NO: 94473 - protein, 16 aa, Mycobacterium tuberculosis
EPWRPRVNGPEAEKLH

SEQ ID NO: 94474 - protein, 16 aa, Mycobacterium tuberculosis
PWRPRVNGPEAEKLHD

SEQ ID NO: 94475 - protein, 16 aa, Mycobacterium tuberculosis
WRPRVNGPEAEKLHDR

SEQ ID NO: 94476 - protein, 16 aa, Mycobacterium tuberculosis
RPRVNGPEAEKLHDRL

SEQ ID NO: 94477 - protein, 16 aa, Mycobacterium tuberculosis
PRVNGPEAEKLHDRLA

SEQ ID NO: 94478 - protein, 16 aa, Mycobacterium tuberculosis
RVNGPEAEKLHDRLAN

SEQ ID NO: 94479 - protein, 16 aa, Mycobacterium tuberculosis
VNGPEAEKLHDRLANW

SEQ ID NO: 94480 - protein, 16 aa, Mycobacterium tuberculosis
NGPEAEKLHDRLANWA

SEQ ID NO: 94481 - protein, 16 aa, Mycobacterium tuberculosis
GPEAEKLHDRLANWAA

SEQ ID NO: 94482 - protein, 16 aa, Mycobacterium tuberculosis
PEAEKLHDRLANWAAA

SEQ ID NO: 94483 - protein, 16 aa, Mycobacterium tuberculosis
EAEKLHDRLANWAAAI

SEQ ID NO: 94484 - protein, 16 aa, Mycobacterium tuberculosis
AEKLHDRLANWAAAIN

SEQ ID NO: 94485 - protein, 16 aa, Mycobacterium tuberculosis
EKLHDRLANWAAAINP

SEQ ID NO: 94486 - protein, 16 aa, Mycobacterium tuberculosis
KLHDRLANWAAAINPL

SEQ ID NO: 94487 - protein, 16 aa, Mycobacterium tuberculosis
LHDRLANWAAAINPLE

SEQ ID NO: 94488 - protein, 16 aa, Mycobacterium tuberculosis
HDRLANWAAAINPLES

SEQ ID NO: 94489 - protein, 16 aa, Mycobacterium tuberculosis
DRLANWAAAINPLESG

SEQ ID NO: 94490 - protein, 16 aa, Mycobacterium tuberculosis
RLANWAAAINPLESGW

SEQ ID NO: 94491 - protein, 16 aa, Mycobacterium tuberculosis
LANWAAAINPLESGWP

SEQ ID NO: 94492 - protein, 16 aa, Mycobacterium tuberculosis
ANWAAAINPLESGWPA

SEQ ID NO: 94493 - protein, 16 aa, Mycobacterium tuberculosis
NWAAAINPLESGWPAM

SEQ ID NO: 94494 - protein, 16 aa, Mycobacterium tuberculosis
WAAAINPLESGWPAMP

SEQ ID NO: 94495 - protein, 16 aa, Mycobacterium tuberculosis
AAAINPLESGWPAMPD

SEQ ID NO: 94496 - protein, 16 aa, Mycobacterium tuberculosis
AAINPLESGWPAMPDG

SEQ ID NO: 94497 - protein, 16 aa, Mycobacterium tuberculosis
AINPLESGWPAMPDGV

SEQ ID NO: 94498 - protein, 16 aa, Mycobacterium tuberculosis
INPLESGWPAMPDGVT

SEQ ID NO: 94499 - protein, 16 aa, Mycobacterium tuberculosis
NPLESGWPAMPDGVTD

SEQ ID NO: 94500 - protein, 16 aa, Mycobacterium tuberculosis
PLESGWPAMPDGVTDR

SEQ ID NO: 94501 - protein, 16 aa, Mycobacterium tuberculosis
LESGWPAMPDGVTDRR

SEQ ID NO: 94502 - protein, 16 aa, Mycobacterium tuberculosis
ESGWPAMPDGVTDRRA

SEQ ID NO: 94503 - protein, 16 aa, Mycobacterium tuberculosis
SGWPAMPDGVTDRRAD

SEQ ID NO: 94504 - protein, 16 aa, Mycobacterium tuberculosis
GWPAMPDGVTDRRADV

SEQ ID NO: 94505 - protein, 16 aa, Mycobacterium tuberculosis
WPAMPDGVTDRRADVW

SEQ ID NO: 94506 - protein, 16 aa, Mycobacterium tuberculosis
PAMPDGVTDRRADVWE

SEQ ID NO: 94507 - protein, 16 aa, Mycobacterium tuberculosis
AMPDGVTDRRADVWES

SEQ ID NO: 94508 - protein, 16 aa, Mycobacterium tuberculosis
MPDGVTDRRADVWESL

SEQ ID NO: 94509 - protein, 16 aa, Mycobacterium tuberculosis
PDGVTDRRADVWESLV

SEQ ID NO: 94510 - protein, 16 aa, Mycobacterium tuberculosis
DGVTDRRADVWESLVA

SEQ ID NO: 94511 - protein, 16 aa, Mycobacterium tuberculosis
GVTDRRADVWESLVAV

SEQ ID NO: 94512 - protein, 16 aa, Mycobacterium tuberculosis
VTDRRADVWESLVAVA

SEQ ID NO: 94513 - protein, 16 aa, Mycobacterium tuberculosis
TDRRADVWESLVAVAD

SEQ ID NO: 94514 - protein, 16 aa, Mycobacterium tuberculosis
DRRADVWESLVAVADT

SEQ ID NO: 94515 - protein, 16 aa, Mycobacterium tuberculosis
RRADVWESLVAVADTA

SEQ ID NO: 94516 - protein, 16 aa, Mycobacterium tuberculosis
RADVWESLVAVADTAG

SEQ ID NO: 94517 - protein, 16 aa, Mycobacterium tuberculosis
ADVWESLVAVADTAGG

SEQ ID NO: 94518 - protein, 16 aa, Mycobacterium tuberculosis
DVWESLVAVADTAGGH

SEQ ID NO: 94519 - protein, 16 aa, Mycobacterium tuberculosis
VWESLVAVADTAGGHW

SEQ ID NO: 94520 - protein, 16 aa, Mycobacterium tuberculosis
WESLVAVADTAGGHWP

SEQ ID NO: 94521 - protein, 16 aa, Mycobacterium tuberculosis
ESLVAVADTAGGHWPK

SEQ ID NO: 94522 - protein, 16 aa, Mycobacterium tuberculosis
SLVAVADTAGGHWPKT

SEQ ID NO: 94523 - protein, 16 aa, Mycobacterium tuberculosis
LVAVADTAGGHWPKTA

SEQ ID NO: 94524 - protein, 16 aa, Mycobacterium tuberculosis
VAVADTAGGHWPKTAR

SEQ ID NO: 94525 - protein, 16 aa, Mycobacterium tuberculosis
AVADTAGGHWPKTARA

SEQ ID NO: 94526 - protein, 16 aa, Mycobacterium tuberculosis
VADTAGGHWPKTARAT

SEQ ID NO: 94527 - protein, 16 aa, Mycobacterium tuberculosis
ADTAGGHWPKTARATA

SEQ ID NO: 94528 - protein, 16 aa, Mycobacterium tuberculosis
DTAGGHWPKTARATAE

SEQ ID NO: 94529 - protein, 16 aa, Mycobacterium tuberculosis
TAGGHWPKTARATAET

SEQ ID NO: 94530 - protein, 16 aa, Mycobacterium tuberculosis
AGGHWPKTARATAETD

SEQ ID NO: 94531 - protein, 16 aa, Mycobacterium tuberculosis
GGHWPKTARATAETDA

SEQ ID NO: 94532 - protein, 16 aa, Mycobacterium tuberculosis
GHWPKTARATAETDAT

SEQ ID NO: 94533 - protein, 16 aa, Mycobacterium tuberculosis
HWPKTARATAETDATA

SEQ ID NO: 94534 - protein, 16 aa, Mycobacterium tuberculosis
WPKTARATAETDATAN

SEQ ID NO: 94535 - protein, 16 aa, Mycobacterium tuberculosis
PKTARATAETDATANR

SEQ ID NO: 94536 - protein, 16 aa, Mycobacterium tuberculosis
KTARATAETDATANRG

SEQ ID NO: 94537 - protein, 16 aa, Mycobacterium tuberculosis
TARATAETDATANRGA

SEQ ID NO: 94538 - protein, 16 aa, Mycobacterium tuberculosis
ARATAETDATANRGAK

SEQ ID NO: 94539 - protein, 16 aa, Mycobacterium tuberculosis
RATAETDATANRGAKP

SEQ ID NO: 94540 - protein, 16 aa, Mycobacterium tuberculosis
ATAETDATANRGAKPS

SEQ ID NO: 94541 - protein, 16 aa, Mycobacterium tuberculosis
TAETDATANRGAKPSI

SEQ ID NO: 94542 - protein, 16 aa, Mycobacterium tuberculosis
AETDATANRGAKPSIG

SEQ ID NO: 94543 - protein, 16 aa, Mycobacterium tuberculosis
ETDATANRGAKPSIGV

SEQ ID NO: 94544 - protein, 16 aa, Mycobacterium tuberculosis
TDATANRGAKPSIGVL

SEQ ID NO: 94545 - protein, 16 aa, Mycobacterium tuberculosis
DATANRGAKPSIGVLL

SEQ ID NO: 94546 - protein, 16 aa, Mycobacterium tuberculosis
ATANRGAKPSIGVLLL

SEQ ID NO: 94547 - protein, 16 aa, Mycobacterium tuberculosis
TANRGAKPSIGVLLLR

SEQ ID NO: 94548 - protein, 16 aa, Mycobacterium tuberculosis
ANRGAKPSIGVLLLRD

SEQ ID NO: 94549 - protein, 16 aa, Mycobacterium tuberculosis
NRGAKPSIGVLLLRDI

SEQ ID NO: 94550 - protein, 16 aa, Mycobacterium tuberculosis
RGAKPSIGVLLLRDIR

SEQ ID NO: 94551 - protein, 16 aa, Mycobacterium tuberculosis
GAKPSIGVLLLRDIRR

SEQ ID NO: 94552 - protein, 16 aa, Mycobacterium tuberculosis
AKPSIGVLLLRDIRRV

SEQ ID NO: 94553 - protein, 16 aa, Mycobacterium tuberculosis
KPSIGVLLLRDIRRVF

SEQ ID NO: 94554 - protein, 16 aa, Mycobacterium tuberculosis
PSIGVLLLRDIRRVFS

SEQ ID NO: 94555 - protein, 16 aa, Mycobacterium tuberculosis
SIGVLLLRDIRRVFSD

SEQ ID NO: 94556 - protein, 16 aa, Mycobacterium tuberculosis
IGVLLLRDIRRVFSDR

SEQ ID NO: 94557 - protein, 16 aa, Mycobacterium tuberculosis
GVLLLRDIRRVFSDRD

SEQ ID NO: 94558 - protein, 16 aa, Mycobacterium tuberculosis
VLLLRDIRRVFSDRDR

SEQ ID NO: 94559 - protein, 16 aa, Mycobacterium tuberculosis
LLLRDIRRVFSDRDRM

SEQ ID NO: 94560 - protein, 16 aa, Mycobacterium tuberculosis
LLRDIRRVFSDRDRMR

SEQ ID NO: 94561 - protein, 16 aa, Mycobacterium tuberculosis
LRDIRRVFSDRDRMRT

SEQ ID NO: 94562 - protein, 16 aa, Mycobacterium tuberculosis
RDIRRVFSDRDRMRTS

SEQ ID NO: 94563 - protein, 16 aa, Mycobacterium tuberculosis
DIRRVFSDRDRMRTSD

SEQ ID NO: 94564 - protein, 16 aa, Mycobacterium tuberculosis
IRRVFSDRDRMRTSDI

SEQ ID NO: 94565 - protein, 16 aa, Mycobacterium tuberculosis
RRVFSDRDRMRTSDIL

SEQ ID NO: 94566 - protein, 16 aa, Mycobacterium tuberculosis
RVFSDRDRMRTSDILT

SEQ ID NO: 94567 - protein, 16 aa, Mycobacterium tuberculosis
VFSDRDRMRTSDILTG

SEQ ID NO: 94568 - protein, 16 aa, Mycobacterium tuberculosis
FSDRDRMRTSDILTGL

SEQ ID NO: 94569 - protein, 16 aa, Mycobacterium tuberculosis
SDRDRMRTSDILTGLN

SEQ ID NO: 94570 - protein, 16 aa, Mycobacterium tuberculosis
DRDRMRTSDILTGLNR

SEQ ID NO: 94571 - protein, 16 aa, Mycobacterium tuberculosis
RDRMRTSDILTGLNRM

SEQ ID NO: 94572 - protein, 16 aa, Mycobacterium tuberculosis
DRMRTSDILTGLNRME

SEQ ID NO: 94573 - protein, 16 aa, Mycobacterium tuberculosis
RMRTSDILTGLNRMEE

SEQ ID NO: 94574 - protein, 16 aa, Mycobacterium tuberculosis
MRTSDILTGLNRMEEG

SEQ ID NO: 94575 - protein, 16 aa, Mycobacterium tuberculosis
RTSDILTGLNRMEEGP

SEQ ID NO: 94576 - protein, 16 aa, Mycobacterium tuberculosis
TSDILTGLNRMEEGPW

SEQ ID NO: 94577 - protein, 16 aa, Mycobacterium tuberculosis
SDILTGLNRMEEGPWG

SEQ ID NO: 94578 - protein, 16 aa, Mycobacterium tuberculosis
DILTGLNRMEEGPWGS

SEQ ID NO: 94579 - protein, 16 aa, Mycobacterium tuberculosis
ILTGLNRMEEGPWGSI

SEQ ID NO: 94580 - protein, 16 aa, Mycobacterium tuberculosis
LTGLNRMEEGPWGSIR

SEQ ID NO: 94581 - protein, 16 aa, Mycobacterium tuberculosis
TGLNRMEEGPWGSIRR

SEQ ID NO: 94582 - protein, 16 aa, Mycobacterium tuberculosis
GLNRMEEGPWGSIRRG

SEQ ID NO: 94583 - protein, 16 aa, Mycobacterium tuberculosis
LNRMEEGPWGSIRRGD

SEQ ID NO: 94584 - protein, 16 aa, Mycobacterium tuberculosis
NRMEEGPWGSIRRGDP

SEQ ID NO: 94585 - protein, 16 aa, Mycobacterium tuberculosis
RMEEGPWGSIRRGDPL

SEQ ID NO: 94586 - protein, 16 aa, Mycobacterium tuberculosis
MEEGPWGSIRRGDPLD

SEQ ID NO: 94587 - protein, 16 aa, Mycobacterium tuberculosis
EEGPWGSIRRGDPLDA

SEQ ID NO: 94588 - protein, 16 aa, Mycobacterium tuberculosis
EGPWGSIRRGDPLDAR

SEQ ID NO: 94589 - protein, 16 aa, Mycobacterium tuberculosis
GPWGSIRRGDPLDARG

SEQ ID NO: 94590 - protein, 16 aa, Mycobacterium tuberculosis
PWGSIRRGDPLDARGL

SEQ ID NO: 94591 - protein, 16 aa, Mycobacterium tuberculosis
WGSIRRGDPLDARGLA

SEQ ID NO: 94592 - protein, 16 aa, Mycobacterium tuberculosis
GSIRRGDPLDARGLAT

SEQ ID NO: 94593 - protein, 16 aa, Mycobacterium tuberculosis
SIRRGDPLDARGLATR

SEQ ID NO: 94594 - protein, 16 aa, Mycobacterium tuberculosis
IRRGDPLDARGLATRL

SEQ ID NO: 94595 - protein, 16 aa, Mycobacterium tuberculosis
RRGDPLDARGLATRLG

SEQ ID NO: 94596 - protein, 16 aa, Mycobacterium tuberculosis
RGDPLDARGLATRLGR

SEQ ID NO: 94597 - protein, 16 aa, Mycobacterium tuberculosis
GDPLDARGLATRLGRY

SEQ ID NO: 94598 - protein, 16 aa, Mycobacterium tuberculosis
DPLDARGLATRLGRYG

SEQ ID NO: 94599 - protein, 16 aa, Mycobacterium tuberculosis
PLDARGLATRLGRYGI

SEQ ID NO: 94600 - protein, 16 aa, Mycobacterium tuberculosis
LDARGLATRLGRYGIG

SEQ ID NO: 94601 - protein, 16 aa, Mycobacterium tuberculosis
DARGLATRLGRYGIGP

SEQ ID NO: 94602 - protein, 16 aa, Mycobacterium tuberculosis
ARGLATRLGRYGIGPK

SEQ ID NO: 94603 - protein, 16 aa, Mycobacterium tuberculosis
RGLATRLGRYGIGPKF

SEQ ID NO: 94604 - protein, 16 aa, Mycobacterium tuberculosis
GLATRLGRYGIGPKFQ

SEQ ID NO: 94605 - protein, 16 aa, Mycobacterium tuberculosis
LATRLGRYGIGPKFQH

SEQ ID NO: 94606 - protein, 16 aa, Mycobacterium tuberculosis
ATRLGRYGIGPKFQHS

SEQ ID NO: 94607 - protein, 16 aa, Mycobacterium tuberculosis
TRLGRYGIGPKFQHSG

SEQ ID NO: 94608 - protein, 16 aa, Mycobacterium tuberculosis
RLGRYGIGPKFQHSGG

SEQ ID NO: 94609 - protein, 16 aa, Mycobacterium tuberculosis
LGRYGIGPKFQHSGGE

SEQ ID NO: 94610 - protein, 16 aa, Mycobacterium tuberculosis
GRYGIGPKFQHSGGEP

SEQ ID NO: 94611 - protein, 16 aa, Mycobacterium tuberculosis
RYGIGPKFQHSGGEPP

SEQ ID NO: 94612 - protein, 16 aa, Mycobacterium tuberculosis
YGIGPKFQHSGGEPPY

SEQ ID NO: 94613 - protein, 16 aa, Mycobacterium tuberculosis
GIGPKFQHSGGEPPYK

SEQ ID NO: 94614 - protein, 16 aa, Mycobacterium tuberculosis
IGPKFQHSGGEPPYKG

SEQ ID NO: 94615 - protein, 16 aa, Mycobacterium tuberculosis
GPKFQHSGGEPPYKGY

SEQ ID NO: 94616 - protein, 16 aa, Mycobacterium tuberculosis
PKFQHSGGEPPYKGYS

SEQ ID NO: 94617 - protein, 16 aa, Mycobacterium tuberculosis
KFQHSGGEPPYKGYSR

SEQ ID NO: 94618 - protein, 16 aa, Mycobacterium tuberculosis
FQHSGGEPPYKGYSRT

SEQ ID NO: 94619 - protein, 16 aa, Mycobacterium tuberculosis
QHSGGEPPYKGYSRTQ

SEQ ID NO: 94620 - protein, 16 aa, Mycobacterium tuberculosis
HSGGEPPYKGYSRTQF

SEQ ID NO: 94621 - protein, 16 aa, Mycobacterium tuberculosis
SGGEPPYKGYSRTQFE

SEQ ID NO: 94622 - protein, 16 aa, Mycobacterium tuberculosis
GGEPPYKGYSRTQFED

SEQ ID NO: 94623 - protein, 16 aa, Mycobacterium tuberculosis
GEPPYKGYSRTQFEDA

SEQ ID NO: 94624 - protein, 16 aa, Mycobacterium tuberculosis
EPPYKGYSRTQFEDAW

SEQ ID NO: 94625 - protein, 16 aa, Mycobacterium tuberculosis
PPYKGYSRTQFEDAWS

SEQ ID NO: 94626 - protein, 16 aa, Mycobacterium tuberculosis
PYKGYSRTQFEDAWSR

SEQ ID NO: 94627 - protein, 16 aa, Mycobacterium tuberculosis
YKGYSRTQFEDAWSRY

SEQ ID NO: 94628 - protein, 16 aa, Mycobacterium tuberculosis
KGYSRTQFEDAWSRYL

SEQ ID NO: 94629 - protein, 16 aa, Mycobacterium tuberculosis
GYSRTQFEDAWSRYLS

SEQ ID NO: 94630 - protein, 16 aa, Mycobacterium tuberculosis
YSRTQFEDAWSRYLSA

SEQ ID NO: 94631 - protein, 16 aa, Mycobacterium tuberculosis
SRTQFEDAWSRYLSAD

SEQ ID NO: 94632 - protein, 16 aa, Mycobacterium tuberculosis
RTQFEDAWSRYLSADD

SEQ ID NO: 94633 - protein, 16 aa, Mycobacterium tuberculosis
TQFEDAWSRYLSADDE

SEQ ID NO: 94634 - protein, 16 aa, Mycobacterium tuberculosis
QFEDAWSRYLSADDET

SEQ ID NO: 94635 - protein, 16 aa, Mycobacterium tuberculosis
FEDAWSRYLSADDETP

SEQ ID NO: 94636 - protein, 16 aa, Mycobacterium tuberculosis
EDAWSRYLSADDETPE

SEQ ID NO: 94637 - protein, 16 aa, Mycobacterium tuberculosis
DAWSRYLSADDETPEE

SEQ ID NO: 94638 - protein, 16 aa, Mycobacterium tuberculosis
AWSRYLSADDETPEER

SEQ ID NO: 94639 - protein, 16 aa, Mycobacterium tuberculosis
WSRYLSADDETPEERD

SEQ ID NO: 94640 - protein, 16 aa, Mycobacterium tuberculosis
SRYLSADDETPEERDL

SEQ ID NO: 94641 - protein, 16 aa, Mycobacterium tuberculosis
RYLSADDETPEERDLS

SEQ ID NO: 94642 - protein, 16 aa, Mycobacterium tuberculosis
YLSADDETPEERDLSV

SEQ ID NO: 94643 - protein, 16 aa, Mycobacterium tuberculosis
LSADDETPEERDLSVS

SEQ ID NO: 94644 - protein, 16 aa, Mycobacterium tuberculosis
SADDETPEERDLSVSA

SEQ ID NO: 94645 - protein, 16 aa, Mycobacterium tuberculosis
ADDETPEERDLSVSAV

SEQ ID NO: 94646 - protein, 16 aa, Mycobacterium tuberculosis
DDETPEERDLSVSAVS

SEQ ID NO: 94647 - protein, 16 aa, Mycobacterium tuberculosis
DETPEERDLSVSAVSA

SEQ ID NO: 94648 - protein, 16 aa, Mycobacterium tuberculosis
ETPEERDLSVSAVSAV

SEQ ID NO: 94649 - protein, 16 aa, Mycobacterium tuberculosis
TPEERDLSVSAVSAVS

SEQ ID NO: 94650 - protein, 16 aa, Mycobacterium tuberculosis
PEERDLSVSAVSAVSP

SEQ ID NO: 94651 - protein, 16 aa, Mycobacterium tuberculosis
EERDLSVSAVSAVSPP

SEQ ID NO: 94652 - protein, 16 aa, Mycobacterium tuberculosis
ERDLSVSAVSAVSPPV

SEQ ID NO: 94653 - protein, 16 aa, Mycobacterium tuberculosis
RDLSVSAVSAVSPPVG

SEQ ID NO: 94654 - protein, 16 aa, Mycobacterium tuberculosis
DLSVSAVSAVSPPVGD

SEQ ID NO: 94655 - protein, 16 aa, Mycobacterium tuberculosis
LSVSAVSAVSPPVGDP

SEQ ID NO: 94656 - protein, 16 aa, Mycobacterium tuberculosis
SVSAVSAVSPPVGDPG

SEQ ID NO: 94657 - protein, 16 aa, Mycobacterium tuberculosis
VSAVSAVSPPVGDPGD

SEQ ID NO: 94658 - protein, 16 aa, Mycobacterium tuberculosis
SAVSAVSPPVGDPGDA

SEQ ID NO: 94659 - protein, 16 aa, Mycobacterium tuberculosis
AVSAVSPPVGDPGDAT

SEQ ID NO: 94660 - protein, 16 aa, Mycobacterium tuberculosis
VSAVSPPVGDPGDATG

SEQ ID NO: 94661 - protein, 16 aa, Mycobacterium tuberculosis
SAVSPPVGDPGDATGA

SEQ ID NO: 94662 - protein, 16 aa, Mycobacterium tuberculosis
AVSPPVGDPGDATGAT

SEQ ID NO: 94663 - protein, 16 aa, Mycobacterium tuberculosis
VSPPVGDPGDATGATD

SEQ ID NO: 94664 - protein, 16 aa, Mycobacterium tuberculosis
SPPVGDPGDATGATDA

SEQ ID NO: 94665 - protein, 16 aa, Mycobacterium tuberculosis
PPVGDPGDATGATDAT

SEQ ID NO: 94666 - protein, 16 aa, Mycobacterium tuberculosis
PVGDPGDATGATDATD

SEQ ID NO: 94667 - protein, 16 aa, Mycobacterium tuberculosis
VGDPGDATGATDATDL

SEQ ID NO: 94668 - protein, 16 aa, Mycobacterium tuberculosis
GDPGDATGATDATDLP

SEQ ID NO: 94669 - protein, 16 aa, Mycobacterium tuberculosis
DPGDATGATDATDLPE

SEQ ID NO: 94670 - protein, 16 aa, Mycobacterium tuberculosis
PGDATGATDATDLPEA

SEQ ID NO: 94671 - protein, 16 aa, Mycobacterium tuberculosis
GDATGATDATDLPEAG

SEQ ID NO: 94672 - protein, 16 aa, Mycobacterium tuberculosis
DATGATDATDLPEAGD

SEQ ID NO: 94673 - protein, 16 aa, Mycobacterium tuberculosis
ATGATDATDLPEAGDL

SEQ ID NO: 94674 - protein, 16 aa, Mycobacterium tuberculosis
TGATDATDLPEAGDLP

SEQ ID NO: 94675 - protein, 16 aa, Mycobacterium tuberculosis
GATDATDLPEAGDLPY

SEQ ID NO: 94676 - protein, 16 aa, Mycobacterium tuberculosis
ATDATDLPEAGDLPYE

SEQ ID NO: 94677 - protein, 16 aa, Mycobacterium tuberculosis
TDATDLPEAGDLPYEP

SEQ ID NO: 94678 - protein, 16 aa, Mycobacterium tuberculosis
DATDLPEAGDLPYEPP

SEQ ID NO: 94679 - protein, 16 aa, Mycobacterium tuberculosis
ATDLPEAGDLPYEPPA

SEQ ID NO: 94680 - protein, 16 aa, Mycobacterium tuberculosis
TDLPEAGDLPYEPPAP

SEQ ID NO: 94681 - protein, 16 aa, Mycobacterium tuberculosis
DLPEAGDLPYEPPAPN

SEQ ID NO: 94682 - protein, 16 aa, Mycobacterium tuberculosis
LPEAGDLPYEPPAPNG

SEQ ID NO: 94683 - protein, 16 aa, Mycobacterium tuberculosis
PEAGDLPYEPPAPNGH

SEQ ID NO: 94684 - protein, 16 aa, Mycobacterium tuberculosis
EAGDLPYEPPAPNGHP

SEQ ID NO: 94685 - protein, 16 aa, Mycobacterium tuberculosis
AGDLPYEPPAPNGHPN

SEQ ID NO: 94686 - protein, 16 aa, Mycobacterium tuberculosis
GDLPYEPPAPNGHPNG

SEQ ID NO: 94687 - protein, 16 aa, Mycobacterium tuberculosis
DLPYEPPAPNGHPNGD

SEQ ID NO: 94688 - protein, 16 aa, Mycobacterium tuberculosis
LPYEPPAPNGHPNGDA

SEQ ID NO: 94689 - protein, 16 aa, Mycobacterium tuberculosis
PYEPPAPNGHPNGDAP

SEQ ID NO: 94690 - protein, 16 aa, Mycobacterium tuberculosis
YEPPAPNGHPNGDAPL

SEQ ID NO: 94691 - protein, 16 aa, Mycobacterium tuberculosis
EPPAPNGHPNGDAPLC

SEQ ID NO: 94692 - protein, 16 aa, Mycobacterium tuberculosis
PPAPNGHPNGDAPLCS

SEQ ID NO: 94693 - protein, 16 aa, Mycobacterium tuberculosis
PAPNGHPNGDAPLCSG

SEQ ID NO: 94694 - protein, 16 aa, Mycobacterium tuberculosis
APNGHPNGDAPLCSGP

SEQ ID NO: 94695 - protein, 16 aa, Mycobacterium tuberculosis
PNGHPNGDAPLCSGPG

SEQ ID NO: 94696 - protein, 16 aa, Mycobacterium tuberculosis
NGHPNGDAPLCSGPGC

SEQ ID NO: 94697 - protein, 16 aa, Mycobacterium tuberculosis
GHPNGDAPLCSGPGCP

SEQ ID NO: 94698 - protein, 16 aa, Mycobacterium tuberculosis
HPNGDAPLCSGPGCPN

SEQ ID NO: 94699 - protein, 16 aa, Mycobacterium tuberculosis
PNGDAPLCSGPGCPNK

SEQ ID NO: 94700 - protein, 16 aa, Mycobacterium tuberculosis
NGDAPLCSGPGCPNKL

SEQ ID NO: 94701 - protein, 16 aa, Mycobacterium tuberculosis
GDAPLCSGPGCPNKLL

SEQ ID NO: 94702 - protein, 16 aa, Mycobacterium tuberculosis
DAPLCSGPGCPNKLLS

SEQ ID NO: 94703 - protein, 16 aa, Mycobacterium tuberculosis
APLCSGPGCPNKLLST

SEQ ID NO: 94704 - protein, 16 aa, Mycobacterium tuberculosis
PLCSGPGCPNKLLSTE

SEQ ID NO: 94705 - protein, 16 aa, Mycobacterium tuberculosis
LCSGPGCPNKLLSTEA

SEQ ID NO: 94706 - protein, 16 aa, Mycobacterium tuberculosis
CSGPGCPNKLLSTEAK

SEQ ID NO: 94707 - protein, 16 aa, Mycobacterium tuberculosis
SGPGCPNKLLSTEAKA

SEQ ID NO: 94708 - protein, 16 aa, Mycobacterium tuberculosis
GPGCPNKLLSTEAKAA

SEQ ID NO: 94709 - protein, 16 aa, Mycobacterium tuberculosis
PGCPNKLLSTEAKAAG

SEQ ID NO: 94710 - protein, 16 aa, Mycobacterium tuberculosis
GCPNKLLSTEAKAAGK

SEQ ID NO: 94711 - protein, 16 aa, Mycobacterium tuberculosis
CPNKLLSTEAKAAGKC

SEQ ID NO: 94712 - protein, 16 aa, Mycobacterium tuberculosis
PNKLLSTEAKAAGKCR

SEQ ID NO: 94713 - protein, 16 aa, Mycobacterium tuberculosis
NKLLSTEAKAAGKCRP

SEQ ID NO: 94714 - protein, 16 aa, Mycobacterium tuberculosis
KLLSTEAKAAGKCRPC

SEQ ID NO: 94715 - protein, 16 aa, Mycobacterium tuberculosis
LLSTEAKAAGKCRPCR

SEQ ID NO: 94716 - protein, 16 aa, Mycobacterium tuberculosis
LSTEAKAAGKCRPCRG

SEQ ID NO: 94717 - protein, 16 aa, Mycobacterium tuberculosis
STEAKAAGKCRPCRGR

SEQ ID NO: 94718 - protein, 16 aa, Mycobacterium tuberculosis
TEAKAAGKCRPCRGRA

SEQ ID NO: 94719 - protein, 16 aa, Mycobacterium tuberculosis
EAKAAGKCRPCRGRAA

SEQ ID NO: 94720 - protein, 16 aa, Mycobacterium tuberculosis
AKAAGKCRPCRGRAAA

SEQ ID NO: 94721 - protein, 16 aa, Mycobacterium tuberculosis
KAAGKCRPCRGRAAAS

SEQ ID NO: 94722 - protein, 16 aa, Mycobacterium tuberculosis
AAGKCRPCRGRAAASA

SEQ ID NO: 94723 - protein, 16 aa, Mycobacterium tuberculosis
AGKCRPCRGRAAASAR

SEQ ID NO: 94724 - protein, 16 aa, Mycobacterium tuberculosis
GKCRPCRGRAAASARD

SEQ ID NO: 94725 - protein, 16 aa, Mycobacterium tuberculosis
KCRPCRGRAAASARDG

SEQ ID NO: 94726 - protein, 16 aa, Mycobacterium tuberculosis
CRPCRGRAAASARDGA

SEQ ID NO: 94727 - protein, 16 aa, Mycobacterium tuberculosis
RPCRGRAAASARDGAR

SEQ ID NO: 94728 - protein, 13 aa, Mycobacterium tuberculosis
MTAVGGSPPTRRC

SEQ ID NO: 94729 - protein, 13 aa, Mycobacterium tuberculosis
TAVGGSPPTRRCP

SEQ ID NO: 94730 - protein, 13 aa, Mycobacterium tuberculosis
AVGGSPPTRRCPA

SEQ ID NO: 94731 - protein, 13 aa, Mycobacterium tuberculosis
VGGSPPTRRCPAT

SEQ ID NO: 94732 - protein, 13 aa, Mycobacterium tuberculosis
GGSPPTRRCPATE

SEQ ID NO: 94733 - protein, 13 aa, Mycobacterium tuberculosis
GSPPTRRCPATED

SEQ ID NO: 94734 - protein, 13 aa, Mycobacterium tuberculosis
SPPTRRCPATEDR

SEQ ID NO: 94735 - protein, 13 aa, Mycobacterium tuberculosis
PPTRRCPATEDRA

SEQ ID NO: 94736 - protein, 13 aa, Mycobacterium tuberculosis
PTRRCPATEDRAP

SEQ ID NO: 94737 - protein, 13 aa, Mycobacterium tuberculosis
TRRCPATEDRAPA

SEQ ID NO: 94738 - protein, 13 aa, Mycobacterium tuberculosis
RRCPATEDRAPAT

SEQ ID NO: 94739 - protein, 13 aa, Mycobacterium tuberculosis
RCPATEDRAPATV

SEQ ID NO: 94740 - protein, 13 aa, Mycobacterium tuberculosis
CPATEDRAPATVA

SEQ ID NO: 94741 - protein, 13 aa, Mycobacterium tuberculosis
PATEDRAPATVAT

SEQ ID NO: 94742 - protein, 13 aa, Mycobacterium tuberculosis
ATEDRAPATVATP

SEQ ID NO: 94743 - protein, 13 aa, Mycobacterium tuberculosis
TEDRAPATVATPS

SEQ ID NO: 94744 - protein, 13 aa, Mycobacterium tuberculosis
EDRAPATVATPSS

SEQ ID NO: 94745 - protein, 13 aa, Mycobacterium tuberculosis
DRAPATVATPSST

SEQ ID NO: 94746 - protein, 13 aa, Mycobacterium tuberculosis
RAPATVATPSSTD

SEQ ID NO: 94747 - protein, 13 aa, Mycobacterium tuberculosis
APATVATPSSTDP

SEQ ID NO: 94748 - protein, 13 aa, Mycobacterium tuberculosis
PATVATPSSTDPT

SEQ ID NO: 94749 - protein, 13 aa, Mycobacterium tuberculosis
ATVATPSSTDPTA

SEQ ID NO: 94750 - protein, 13 aa, Mycobacterium tuberculosis
TVATPSSTDPTAS

SEQ ID NO: 94751 - protein, 13 aa, Mycobacterium tuberculosis
VATPSSTDPTASR

SEQ ID NO: 94752 - protein, 13 aa, Mycobacterium tuberculosis
ATPSSTDPTASRA

SEQ ID NO: 94753 - protein, 13 aa, Mycobacterium tuberculosis
TPSSTDPTASRAV

SEQ ID NO: 94754 - protein, 13 aa, Mycobacterium tuberculosis
PSSTDPTASRAVS

SEQ ID NO: 94755 - protein, 13 aa, Mycobacterium tuberculosis
SSTDPTASRAVSW

SEQ ID NO: 94756 - protein, 13 aa, Mycobacterium tuberculosis
STDPTASRAVSWW

SEQ ID NO: 94757 - protein, 13 aa, Mycobacterium tuberculosis
TDPTASRAVSWWS

SEQ ID NO: 94758 - protein, 13 aa, Mycobacterium tuberculosis
DPTASRAVSWWSV

SEQ ID NO: 94759 - protein, 13 aa, Mycobacterium tuberculosis
PTASRAVSWWSVH

SEQ ID NO: 94760 - protein, 13 aa, Mycobacterium tuberculosis
TASRAVSWWSVHE

SEQ ID NO: 94761 - protein, 13 aa, Mycobacterium tuberculosis
ASRAVSWWSVHEY

SEQ ID NO: 94762 - protein, 13 aa, Mycobacterium tuberculosis
SRAVSWWSVHEYV

SEQ ID NO: 94763 - protein, 13 aa, Mycobacterium tuberculosis
RAVSWWSVHEYVA

SEQ ID NO: 94764 - protein, 13 aa, Mycobacterium tuberculosis
AVSWWSVHEYVAP

SEQ ID NO: 94765 - protein, 13 aa, Mycobacterium tuberculosis
VSWWSVHEYVAPT

SEQ ID NO: 94766 - protein, 13 aa, Mycobacterium tuberculosis
SWWSVHEYVAPTL

SEQ ID NO: 94767 - protein, 13 aa, Mycobacterium tuberculosis
WWSVHEYVAPTLA

SEQ ID NO: 94768 - protein, 13 aa, Mycobacterium tuberculosis
WSVHEYVAPTLAA

SEQ ID NO: 94769 - protein, 13 aa, Mycobacterium tuberculosis
SVHEYVAPTLAAA

SEQ ID NO: 94770 - protein, 13 aa, Mycobacterium tuberculosis
VHEYVAPTLAAAV

SEQ ID NO: 94771 - protein, 13 aa, Mycobacterium tuberculosis
HEYVAPTLAAAVE

SEQ ID NO: 94772 - protein, 13 aa, Mycobacterium tuberculosis
EYVAPTLAAAVEW

SEQ ID NO: 94773 - protein, 13 aa, Mycobacterium tuberculosis
YVAPTLAAAVEWP

SEQ ID NO: 94774 - protein, 13 aa, Mycobacterium tuberculosis
VAPTLAAAVEWPM

SEQ ID NO: 94775 - protein, 13 aa, Mycobacterium tuberculosis
APTLAAAVEWPMA

SEQ ID NO: 94776 - protein, 13 aa, Mycobacterium tuberculosis
PTLAAAVEWPMAG

SEQ ID NO: 94777 - protein, 13 aa, Mycobacterium tuberculosis
TLAAAVEWPMAGT

SEQ ID NO: 94778 - protein, 13 aa, Mycobacterium tuberculosis
LAAAVEWPMAGTP

SEQ ID NO: 94779 - protein, 13 aa, Mycobacterium tuberculosis
AAAVEWPMAGTPA

SEQ ID NO: 94780 - protein, 13 aa, Mycobacterium tuberculosis
AAVEWPMAGTPAW

SEQ ID NO: 94781 - protein, 13 aa, Mycobacterium tuberculosis
AVEWPMAGTPAWC

SEQ ID NO: 94782 - protein, 13 aa, Mycobacterium tuberculosis
VEWPMAGTPAWCD

SEQ ID NO: 94783 - protein, 13 aa, Mycobacterium tuberculosis
EWPMAGTPAWCDL

SEQ ID NO: 94784 - protein, 13 aa, Mycobacterium tuberculosis
WPMAGTPAWCDLD

SEQ ID NO: 94785 - protein, 13 aa, Mycobacterium tuberculosis
PMAGTPAWCDLDD

SEQ ID NO: 94786 - protein, 13 aa, Mycobacterium tuberculosis
MAGTPAWCDLDDT

SEQ ID NO: 94787 - protein, 13 aa, Mycobacterium tuberculosis
AGTPAWCDLDDTD

SEQ ID NO: 94788 - protein, 13 aa, Mycobacterium tuberculosis
GTPAWCDLDDTDP

SEQ ID NO: 94789 - protein, 13 aa, Mycobacterium tuberculosis
TPAWCDLDDTDPV

SEQ ID NO: 94790 - protein, 13 aa, Mycobacterium tuberculosis
PAWCDLDDTDPVK

SEQ ID NO: 94791 - protein, 13 aa, Mycobacterium tuberculosis
AWCDLDDTDPVKW

SEQ ID NO: 94792 - protein, 13 aa, Mycobacterium tuberculosis
WCDLDDTDPVKWA

SEQ ID NO: 94793 - protein, 13 aa, Mycobacterium tuberculosis
CDLDDTDPVKWAA

SEQ ID NO: 94794 - protein, 13 aa, Mycobacterium tuberculosis
DLDDTDPVKWAAI

SEQ ID NO: 94795 - protein, 13 aa, Mycobacterium tuberculosis
LDDTDPVKWAAIC

SEQ ID NO: 94796 - protein, 13 aa, Mycobacterium tuberculosis
DDTDPVKWAAICD

SEQ ID NO: 94797 - protein, 13 aa, Mycobacterium tuberculosis
DTDPVKWAAICDA

SEQ ID NO: 94798 - protein, 13 aa, Mycobacterium tuberculosis
TDPVKWAAICDAA

SEQ ID NO: 94799 - protein, 13 aa, Mycobacterium tuberculosis
DPVKWAAICDAAR

SEQ ID NO: 94800 - protein, 13 aa, Mycobacterium tuberculosis
PVKWAAICDAARH

SEQ ID NO: 94801 - protein, 13 aa, Mycobacterium tuberculosis
VKWAAICDAARHW

SEQ ID NO: 94802 - protein, 13 aa, Mycobacterium tuberculosis
KWAAICDAARHWA

SEQ ID NO: 94803 - protein, 13 aa, Mycobacterium tuberculosis
WAAICDAARHWAL

SEQ ID NO: 94804 - protein, 13 aa, Mycobacterium tuberculosis
AAICDAARHWALR

SEQ ID NO: 94805 - protein, 13 aa, Mycobacterium tuberculosis
AICDAARHWALRV

SEQ ID NO: 94806 - protein, 13 aa, Mycobacterium tuberculosis
ICDAARHWALRVE

SEQ ID NO: 94807 - protein, 13 aa, Mycobacterium tuberculosis
CDAARHWALRVET

SEQ ID NO: 94808 - protein, 13 aa, Mycobacterium tuberculosis
DAARHWALRVETC

SEQ ID NO: 94809 - protein, 13 aa, Mycobacterium tuberculosis
AARHWALRVETCQ

SEQ ID NO: 94810 - protein, 13 aa, Mycobacterium tuberculosis
ARHWALRVETCQA

SEQ ID NO: 94811 - protein, 13 aa, Mycobacterium tuberculosis
RHWALRVETCQAA

SEQ ID NO: 94812 - protein, 13 aa, Mycobacterium tuberculosis
HWALRVETCQAAS

SEQ ID NO: 94813 - protein, 13 aa, Mycobacterium tuberculosis
WALRVETCQAASA

SEQ ID NO: 94814 - protein, 13 aa, Mycobacterium tuberculosis
ALRVETCQAASAE

SEQ ID NO: 94815 - protein, 13 aa, Mycobacterium tuberculosis
LRVETCQAASAEA

SEQ ID NO: 94816 - protein, 13 aa, Mycobacterium tuberculosis
RVETCQAASAEAS

SEQ ID NO: 94817 - protein, 13 aa, Mycobacterium tuberculosis
VETCQAASAEASR

SEQ ID NO: 94818 - protein, 13 aa, Mycobacterium tuberculosis
ETCQAASAEASRD

SEQ ID NO: 94819 - protein, 13 aa, Mycobacterium tuberculosis
TCQAASAEASRDV

SEQ ID NO: 94820 - protein, 13 aa, Mycobacterium tuberculosis
CQAASAEASRDVS

SEQ ID NO: 94821 - protein, 13 aa, Mycobacterium tuberculosis
QAASAEASRDVSA

SEQ ID NO: 94822 - protein, 13 aa, Mycobacterium tuberculosis
AASAEASRDVSAA

SEQ ID NO: 94823 - protein, 13 aa, Mycobacterium tuberculosis
ASAEASRDVSAAA

SEQ ID NO: 94824 - protein, 13 aa, Mycobacterium tuberculosis
SAEASRDVSAAAD

SEQ ID NO: 94825 - protein, 13 aa, Mycobacterium tuberculosis
AEASRDVSAAADW

SEQ ID NO: 94826 - protein, 13 aa, Mycobacterium tuberculosis
EASRDVSAAADWP

SEQ ID NO: 94827 - protein, 13 aa, Mycobacterium tuberculosis
ASRDVSAAADWPA

SEQ ID NO: 94828 - protein, 13 aa, Mycobacterium tuberculosis
SRDVSAAADWPAV

SEQ ID NO: 94829 - protein, 13 aa, Mycobacterium tuberculosis
RDVSAAADWPAVS

SEQ ID NO: 94830 - protein, 13 aa, Mycobacterium tuberculosis
DVSAAADWPAVSR

SEQ ID NO: 94831 - protein, 13 aa, Mycobacterium tuberculosis
VSAAADWPAVSRE

SEQ ID NO: 94832 - protein, 13 aa, Mycobacterium tuberculosis
SAAADWPAVSREI

SEQ ID NO: 94833 - protein, 13 aa, Mycobacterium tuberculosis
AAADWPAVSREIQ

SEQ ID NO: 94834 - protein, 13 aa, Mycobacterium tuberculosis
AADWPAVSREIQR

SEQ ID NO: 94835 - protein, 13 aa, Mycobacterium tuberculosis
ADWPAVSREIQRR

SEQ ID NO: 94836 - protein, 13 aa, Mycobacterium tuberculosis
DWPAVSREIQRRR

SEQ ID NO: 94837 - protein, 13 aa, Mycobacterium tuberculosis
WPAVSREIQRRRD

SEQ ID NO: 94838 - protein, 13 aa, Mycobacterium tuberculosis
PAVSREIQRRRDA

SEQ ID NO: 94839 - protein, 13 aa, Mycobacterium tuberculosis
AVSREIQRRRDAY

SEQ ID NO: 94840 - protein, 13 aa, Mycobacterium tuberculosis
VSREIQRRRDAYI

SEQ ID NO: 94841 - protein, 13 aa, Mycobacterium tuberculosis
SREIQRRRDAYIR

SEQ ID NO: 94842 - protein, 13 aa, Mycobacterium tuberculosis
REIQRRRDAYIRR

SEQ ID NO: 94843 - protein, 13 aa, Mycobacterium tuberculosis
EIQRRRDAYIRRV

SEQ ID NO: 94844 - protein, 13 aa, Mycobacterium tuberculosis
IQRRRDAYIRRVV

SEQ ID NO: 94845 - protein, 13 aa, Mycobacterium tuberculosis
QRRRDAYIRRVVV

SEQ ID NO: 94846 - protein, 14 aa, Mycobacterium tuberculosis
MTAVGGSPPTRRCP

SEQ ID NO: 94847 - protein, 14 aa, Mycobacterium tuberculosis
TAVGGSPPTRRCPA

SEQ ID NO: 94848 - protein, 14 aa, Mycobacterium tuberculosis
AVGGSPPTRRCPAT

SEQ ID NO: 94849 - protein, 14 aa, Mycobacterium tuberculosis
VGGSPPTRRCPATE

SEQ ID NO: 94850 - protein, 14 aa, Mycobacterium tuberculosis
GGSPPTRRCPATED

SEQ ID NO: 94851 - protein, 14 aa, Mycobacterium tuberculosis
GSPPTRRCPATEDR

SEQ ID NO: 94852 - protein, 14 aa, Mycobacterium tuberculosis
SPPTRRCPATEDRA

SEQ ID NO: 94853 - protein, 14 aa, Mycobacterium tuberculosis
PPTRRCPATEDRAP

SEQ ID NO: 94854 - protein, 14 aa, Mycobacterium tuberculosis
PTRRCPATEDRAPA

SEQ ID NO: 94855 - protein, 14 aa, Mycobacterium tuberculosis
TRRCPATEDRAPAT

SEQ ID NO: 94856 - protein, 14 aa, Mycobacterium tuberculosis
RRCPATEDRAPATV

SEQ ID NO: 94857 - protein, 14 aa, Mycobacterium tuberculosis
RCPATEDRAPATVA

SEQ ID NO: 94858 - protein, 14 aa, Mycobacterium tuberculosis
CPATEDRAPATVAT

SEQ ID NO: 94859 - protein, 14 aa, Mycobacterium tuberculosis
PATEDRAPATVATP

SEQ ID NO: 94860 - protein, 14 aa, Mycobacterium tuberculosis
ATEDRAPATVATPS

SEQ ID NO: 94861 - protein, 14 aa, Mycobacterium tuberculosis
TEDRAPATVATPSS

SEQ ID NO: 94862 - protein, 14 aa, Mycobacterium tuberculosis
EDRAPATVATPSST

SEQ ID NO: 94863 - protein, 14 aa, Mycobacterium tuberculosis
DRAPATVATPSSTD

SEQ ID NO: 94864 - protein, 14 aa, Mycobacterium tuberculosis
RAPATVATPSSTDP

SEQ ID NO: 94865 - protein, 14 aa, Mycobacterium tuberculosis
APATVATPSSTDPT

SEQ ID NO: 94866 - protein, 14 aa, Mycobacterium tuberculosis
PATVATPSSTDPTA

SEQ ID NO: 94867 - protein, 14 aa, Mycobacterium tuberculosis
ATVATPSSTDPTAS

SEQ ID NO: 94868 - protein, 14 aa, Mycobacterium tuberculosis
TVATPSSTDPTASR

SEQ ID NO: 94869 - protein, 14 aa, Mycobacterium tuberculosis
VATPSSTDPTASRA

SEQ ID NO: 94870 - protein, 14 aa, Mycobacterium tuberculosis
ATPSSTDPTASRAV

SEQ ID NO: 94871 - protein, 14 aa, Mycobacterium tuberculosis
TPSSTDPTASRAVS

SEQ ID NO: 94872 - protein, 14 aa, Mycobacterium tuberculosis
PSSTDPTASRAVSW

SEQ ID NO: 94873 - protein, 14 aa, Mycobacterium tuberculosis
SSTDPTASRAVSWW

SEQ ID NO: 94874 - protein, 14 aa, Mycobacterium tuberculosis
STDPTASRAVSWWS

SEQ ID NO: 94875 - protein, 14 aa, Mycobacterium tuberculosis
TDPTASRAVSWWSV

SEQ ID NO: 94876 - protein, 14 aa, Mycobacterium tuberculosis
DPTASRAVSWWSVH

SEQ ID NO: 94877 - protein, 14 aa, Mycobacterium tuberculosis
PTASRAVSWWSVHE

SEQ ID NO: 94878 - protein, 14 aa, Mycobacterium tuberculosis
TASRAVSWWSVHEY

SEQ ID NO: 94879 - protein, 14 aa, Mycobacterium tuberculosis
ASRAVSWWSVHEYV

SEQ ID NO: 94880 - protein, 14 aa, Mycobacterium tuberculosis
SRAVSWWSVHEYVA

SEQ ID NO: 94881 - protein, 14 aa, Mycobacterium tuberculosis
RAVSWWSVHEYVAP

SEQ ID NO: 94882 - protein, 14 aa, Mycobacterium tuberculosis
AVSWWSVHEYVAPT

SEQ ID NO: 94883 - protein, 14 aa, Mycobacterium tuberculosis
VSWWSVHEYVAPTL

SEQ ID NO: 94884 - protein, 14 aa, Mycobacterium tuberculosis
SWWSVHEYVAPTLA

SEQ ID NO: 94885 - protein, 14 aa, Mycobacterium tuberculosis
WWSVHEYVAPTLAA

SEQ ID NO: 94886 - protein, 14 aa, Mycobacterium tuberculosis
WSVHEYVAPTLAAA

SEQ ID NO: 94887 - protein, 14 aa, Mycobacterium tuberculosis
SVHEYVAPTLAAAV

SEQ ID NO: 94888 - protein, 14 aa, Mycobacterium tuberculosis
VHEYVAPTLAAAVE

SEQ ID NO: 94889 - protein, 14 aa, Mycobacterium tuberculosis
HEYVAPTLAAAVEW

SEQ ID NO: 94890 - protein, 14 aa, Mycobacterium tuberculosis
EYVAPTLAAAVEWP

SEQ ID NO: 94891 - protein, 14 aa, Mycobacterium tuberculosis
YVAPTLAAAVEWPM

SEQ ID NO: 94892 - protein, 14 aa, Mycobacterium tuberculosis
VAPTLAAAVEWPMA

SEQ ID NO: 94893 - protein, 14 aa, Mycobacterium tuberculosis
APTLAAAVEWPMAG

SEQ ID NO: 94894 - protein, 14 aa, Mycobacterium tuberculosis
PTLAAAVEWPMAGT

SEQ ID NO: 94895 - protein, 14 aa, Mycobacterium tuberculosis
TLAAAVEWPMAGTP

SEQ ID NO: 94896 - protein, 14 aa, Mycobacterium tuberculosis
LAAAVEWPMAGTPA

SEQ ID NO: 94897 - protein, 14 aa, Mycobacterium tuberculosis
AAAVEWPMAGTPAW

SEQ ID NO: 94898 - protein, 14 aa, Mycobacterium tuberculosis
AAVEWPMAGTPAWC

SEQ ID NO: 94899 - protein, 14 aa, Mycobacterium tuberculosis
AVEWPMAGTPAWCD

SEQ ID NO: 94900 - protein, 14 aa, Mycobacterium tuberculosis
VEWPMAGTPAWCDL

SEQ ID NO: 94901 - protein, 14 aa, Mycobacterium tuberculosis
EWPMAGTPAWCDLD

SEQ ID NO: 94902 - protein, 14 aa, Mycobacterium tuberculosis
WPMAGTPAWCDLDD

SEQ ID NO: 94903 - protein, 14 aa, Mycobacterium tuberculosis
PMAGTPAWCDLDDT

SEQ ID NO: 94904 - protein, 14 aa, Mycobacterium tuberculosis
MAGTPAWCDLDDTD

SEQ ID NO: 94905 - protein, 14 aa, Mycobacterium tuberculosis
AGTPAWCDLDDTDP

SEQ ID NO: 94906 - protein, 14 aa, Mycobacterium tuberculosis
GTPAWCDLDDTDPV

SEQ ID NO: 94907 - protein, 14 aa, Mycobacterium tuberculosis
TPAWCDLDDTDPVK

SEQ ID NO: 94908 - protein, 14 aa, Mycobacterium tuberculosis
PAWCDLDDTDPVKW

SEQ ID NO: 94909 - protein, 14 aa, Mycobacterium tuberculosis
AWCDLDDTDPVKWA

SEQ ID NO: 94910 - protein, 14 aa, Mycobacterium tuberculosis
WCDLDDTDPVKWAA

SEQ ID NO: 94911 - protein, 14 aa, Mycobacterium tuberculosis
CDLDDTDPVKWAAI

SEQ ID NO: 94912 - protein, 14 aa, Mycobacterium tuberculosis
DLDDTDPVKWAAIC

SEQ ID NO: 94913 - protein, 14 aa, Mycobacterium tuberculosis
LDDTDPVKWAAICD

SEQ ID NO: 94914 - protein, 14 aa, Mycobacterium tuberculosis
DDTDPVKWAAICDA

SEQ ID NO: 94915 - protein, 14 aa, Mycobacterium tuberculosis
DTDPVKWAAICDAA

SEQ ID NO: 94916 - protein, 14 aa, Mycobacterium tuberculosis
TDPVKWAAICDAAR

SEQ ID NO: 94917 - protein, 14 aa, Mycobacterium tuberculosis
DPVKWAAICDAARH

SEQ ID NO: 94918 - protein, 14 aa, Mycobacterium tuberculosis
PVKWAAICDAARHW

SEQ ID NO: 94919 - protein, 14 aa, Mycobacterium tuberculosis
VKWAAICDAARHWA

SEQ ID NO: 94920 - protein, 14 aa, Mycobacterium tuberculosis
KWAAICDAARHWAL

SEQ ID NO: 94921 - protein, 14 aa, Mycobacterium tuberculosis
WAAICDAARHWALR

SEQ ID NO: 94922 - protein, 14 aa, Mycobacterium tuberculosis
AAICDAARHWALRV

SEQ ID NO: 94923 - protein, 14 aa, Mycobacterium tuberculosis
AICDAARHWALRVE

SEQ ID NO: 94924 - protein, 14 aa, Mycobacterium tuberculosis
ICDAARHWALRVET

SEQ ID NO: 94925 - protein, 14 aa, Mycobacterium tuberculosis
CDAARHWALRVETC

SEQ ID NO: 94926 - protein, 14 aa, Mycobacterium tuberculosis
DAARHWALRVETCQ

SEQ ID NO: 94927 - protein, 14 aa, Mycobacterium tuberculosis
AARHWALRVETCQA

SEQ ID NO: 94928 - protein, 14 aa, Mycobacterium tuberculosis
ARHWALRVETCQAA

SEQ ID NO: 94929 - protein, 14 aa, Mycobacterium tuberculosis
RHWALRVETCQAAS

SEQ ID NO: 94930 - protein, 14 aa, Mycobacterium tuberculosis
HWALRVETCQAASA

SEQ ID NO: 94931 - protein, 14 aa, Mycobacterium tuberculosis
WALRVETCQAASAE

SEQ ID NO: 94932 - protein, 14 aa, Mycobacterium tuberculosis
ALRVETCQAASAEA

SEQ ID NO: 94933 - protein, 14 aa, Mycobacterium tuberculosis
LRVETCQAASAEAS

SEQ ID NO: 94934 - protein, 14 aa, Mycobacterium tuberculosis
RVETCQAASAEASR

SEQ ID NO: 94935 - protein, 14 aa, Mycobacterium tuberculosis
VETCQAASAEASRD

SEQ ID NO: 94936 - protein, 14 aa, Mycobacterium tuberculosis
ETCQAASAEASRDV

SEQ ID NO: 94937 - protein, 14 aa, Mycobacterium tuberculosis
TCQAASAEASRDVS

SEQ ID NO: 94938 - protein, 14 aa, Mycobacterium tuberculosis
CQAASAEASRDVSA

SEQ ID NO: 94939 - protein, 14 aa, Mycobacterium tuberculosis
QAASAEASRDVSAA

SEQ ID NO: 94940 - protein, 14 aa, Mycobacterium tuberculosis
AASAEASRDVSAAA

SEQ ID NO: 94941 - protein, 14 aa, Mycobacterium tuberculosis
ASAEASRDVSAAAD

SEQ ID NO: 94942 - protein, 14 aa, Mycobacterium tuberculosis
SAEASRDVSAAADW

SEQ ID NO: 94943 - protein, 14 aa, Mycobacterium tuberculosis
AEASRDVSAAADWP

SEQ ID NO: 94944 - protein, 14 aa, Mycobacterium tuberculosis
EASRDVSAAADWPA

SEQ ID NO: 94945 - protein, 14 aa, Mycobacterium tuberculosis
ASRDVSAAADWPAV

SEQ ID NO: 94946 - protein, 14 aa, Mycobacterium tuberculosis
SRDVSAAADWPAVS

SEQ ID NO: 94947 - protein, 14 aa, Mycobacterium tuberculosis
RDVSAAADWPAVSR

SEQ ID NO: 94948 - protein, 14 aa, Mycobacterium tuberculosis
DVSAAADWPAVSRE

SEQ ID NO: 94949 - protein, 14 aa, Mycobacterium tuberculosis
VSAAADWPAVSREI

SEQ ID NO: 94950 - protein, 14 aa, Mycobacterium tuberculosis
SAAADWPAVSREIQ

SEQ ID NO: 94951 - protein, 14 aa, Mycobacterium tuberculosis
AAADWPAVSREIQR

SEQ ID NO: 94952 - protein, 14 aa, Mycobacterium tuberculosis
AADWPAVSREIQRR

SEQ ID NO: 94953 - protein, 14 aa, Mycobacterium tuberculosis
ADWPAVSREIQRRR

SEQ ID NO: 94954 - protein, 14 aa, Mycobacterium tuberculosis
DWPAVSREIQRRRD

SEQ ID NO: 94955 - protein, 14 aa, Mycobacterium tuberculosis
WPAVSREIQRRRDA

SEQ ID NO: 94956 - protein, 14 aa, Mycobacterium tuberculosis
PAVSREIQRRRDAY

SEQ ID NO: 94957 - protein, 14 aa, Mycobacterium tuberculosis
AVSREIQRRRDAYI

SEQ ID NO: 94958 - protein, 14 aa, Mycobacterium tuberculosis
VSREIQRRRDAYIR

SEQ ID NO: 94959 - protein, 14 aa, Mycobacterium tuberculosis
SREIQRRRDAYIRR

SEQ ID NO: 94960 - protein, 14 aa, Mycobacterium tuberculosis
REIQRRRDAYIRRV

SEQ ID NO: 94961 - protein, 14 aa, Mycobacterium tuberculosis
EIQRRRDAYIRRVV

SEQ ID NO: 94962 - protein, 14 aa, Mycobacterium tuberculosis
IQRRRDAYIRRVVV

SEQ ID NO: 94963 - protein, 15 aa, Mycobacterium tuberculosis
MTAVGGSPPTRRCPA

SEQ ID NO: 94964 - protein, 15 aa, Mycobacterium tuberculosis
TAVGGSPPTRRCPAT

SEQ ID NO: 94965 - protein, 15 aa, Mycobacterium tuberculosis
AVGGSPPTRRCPATE

SEQ ID NO: 94966 - protein, 15 aa, Mycobacterium tuberculosis
VGGSPPTRRCPATED

SEQ ID NO: 94967 - protein, 15 aa, Mycobacterium tuberculosis
GGSPPTRRCPATEDR

SEQ ID NO: 94968 - protein, 15 aa, Mycobacterium tuberculosis
GSPPTRRCPATEDRA

SEQ ID NO: 94969 - protein, 15 aa, Mycobacterium tuberculosis
SPPTRRCPATEDRAP

SEQ ID NO: 94970 - protein, 15 aa, Mycobacterium tuberculosis
PPTRRCPATEDRAPA

SEQ ID NO: 94971 - protein, 15 aa, Mycobacterium tuberculosis
PTRRCPATEDRAPAT

SEQ ID NO: 94972 - protein, 15 aa, Mycobacterium tuberculosis
TRRCPATEDRAPATV

SEQ ID NO: 94973 - protein, 15 aa, Mycobacterium tuberculosis
RRCPATEDRAPATVA

SEQ ID NO: 94974 - protein, 15 aa, Mycobacterium tuberculosis
RCPATEDRAPATVAT

SEQ ID NO: 94975 - protein, 15 aa, Mycobacterium tuberculosis
CPATEDRAPATVATP

SEQ ID NO: 94976 - protein, 15 aa, Mycobacterium tuberculosis
PATEDRAPATVATPS

SEQ ID NO: 94977 - protein, 15 aa, Mycobacterium tuberculosis
ATEDRAPATVATPSS

SEQ ID NO: 94978 - protein, 15 aa, Mycobacterium tuberculosis
TEDRAPATVATPSST

SEQ ID NO: 94979 - protein, 15 aa, Mycobacterium tuberculosis
EDRAPATVATPSSTD

SEQ ID NO: 94980 - protein, 15 aa, Mycobacterium tuberculosis
DRAPATVATPSSTDP

SEQ ID NO: 94981 - protein, 15 aa, Mycobacterium tuberculosis
RAPATVATPSSTDPT

SEQ ID NO: 94982 - protein, 15 aa, Mycobacterium tuberculosis
APATVATPSSTDPTA

SEQ ID NO: 94983 - protein, 15 aa, Mycobacterium tuberculosis
PATVATPSSTDPTAS

SEQ ID NO: 94984 - protein, 15 aa, Mycobacterium tuberculosis
ATVATPSSTDPTASR

SEQ ID NO: 94985 - protein, 15 aa, Mycobacterium tuberculosis
TVATPSSTDPTASRA

SEQ ID NO: 94986 - protein, 15 aa, Mycobacterium tuberculosis
VATPSSTDPTASRAV

SEQ ID NO: 94987 - protein, 15 aa, Mycobacterium tuberculosis
ATPSSTDPTASRAVS

SEQ ID NO: 94988 - protein, 15 aa, Mycobacterium tuberculosis
TPSSTDPTASRAVSW

SEQ ID NO: 94989 - protein, 15 aa, Mycobacterium tuberculosis
PSSTDPTASRAVSWW

SEQ ID NO: 94990 - protein, 15 aa, Mycobacterium tuberculosis
SSTDPTASRAVSWWS

SEQ ID NO: 94991 - protein, 15 aa, Mycobacterium tuberculosis
STDPTASRAVSWWSV

SEQ ID NO: 94992 - protein, 15 aa, Mycobacterium tuberculosis
TDPTASRAVSWWSVH

SEQ ID NO: 94993 - protein, 15 aa, Mycobacterium tuberculosis
DPTASRAVSWWSVHE

SEQ ID NO: 94994 - protein, 15 aa, Mycobacterium tuberculosis
PTASRAVSWWSVHEY

SEQ ID NO: 94995 - protein, 15 aa, Mycobacterium tuberculosis
TASRAVSWWSVHEYV

SEQ ID NO: 94996 - protein, 15 aa, Mycobacterium tuberculosis
ASRAVSWWSVHEYVA

SEQ ID NO: 94997 - protein, 15 aa, Mycobacterium tuberculosis
SRAVSWWSVHEYVAP

SEQ ID NO: 94998 - protein, 15 aa, Mycobacterium tuberculosis
RAVSWWSVHEYVAPT

SEQ ID NO: 94999 - protein, 15 aa, Mycobacterium tuberculosis
AVSWWSVHEYVAPTL

SEQ ID NO: 95000 - protein, 15 aa, Mycobacterium tuberculosis
VSWWSVHEYVAPTLA

SEQ ID NO: 95001 - protein, 15 aa, Mycobacterium tuberculosis
SWWSVHEYVAPTLAA

SEQ ID NO: 95002 - protein, 15 aa, Mycobacterium tuberculosis
WWSVHEYVAPTLAAA

SEQ ID NO: 95003 - protein, 15 aa, Mycobacterium tuberculosis
WSVHEYVAPTLAAAV

SEQ ID NO: 95004 - protein, 15 aa, Mycobacterium tuberculosis
SVHEYVAPTLAAAVE

SEQ ID NO: 95005 - protein, 15 aa, Mycobacterium tuberculosis
VHEYVAPTLAAAVEW

SEQ ID NO: 95006 - protein, 15 aa, Mycobacterium tuberculosis
HEYVAPTLAAAVEWP

SEQ ID NO: 95007 - protein, 15 aa, Mycobacterium tuberculosis
EYVAPTLAAAVEWPM

SEQ ID NO: 95008 - protein, 15 aa, Mycobacterium tuberculosis
YVAPTLAAAVEWPMA

SEQ ID NO: 95009 - protein, 15 aa, Mycobacterium tuberculosis
VAPTLAAAVEWPMAG

SEQ ID NO: 95010 - protein, 15 aa, Mycobacterium tuberculosis
APTLAAAVEWPMAGT

SEQ ID NO: 95011 - protein, 15 aa, Mycobacterium tuberculosis
PTLAAAVEWPMAGTP

SEQ ID NO: 95012 - protein, 15 aa, Mycobacterium tuberculosis
TLAAAVEWPMAGTPA

SEQ ID NO: 95013 - protein, 15 aa, Mycobacterium tuberculosis
LAAAVEWPMAGTPAW

SEQ ID NO: 95014 - protein, 15 aa, Mycobacterium tuberculosis
AAAVEWPMAGTPAWC

SEQ ID NO: 95015 - protein, 15 aa, Mycobacterium tuberculosis
AAVEWPMAGTPAWCD

SEQ ID NO: 95016 - protein, 15 aa, Mycobacterium tuberculosis
AVEWPMAGTPAWCDL

SEQ ID NO: 95017 - protein, 15 aa, Mycobacterium tuberculosis
VEWPMAGTPAWCDLD

SEQ ID NO: 95018 - protein, 15 aa, Mycobacterium tuberculosis
EWPMAGTPAWCDLDD

SEQ ID NO: 95019 - protein, 15 aa, Mycobacterium tuberculosis
WPMAGTPAWCDLDDT

SEQ ID NO: 95020 - protein, 15 aa, Mycobacterium tuberculosis
PMAGTPAWCDLDDTD

SEQ ID NO: 95021 - protein, 15 aa, Mycobacterium tuberculosis
MAGTPAWCDLDDTDP

SEQ ID NO: 95022 - protein, 15 aa, Mycobacterium tuberculosis
AGTPAWCDLDDTDPV

SEQ ID NO: 95023 - protein, 15 aa, Mycobacterium tuberculosis
GTPAWCDLDDTDPVK

SEQ ID NO: 95024 - protein, 15 aa, Mycobacterium tuberculosis
TPAWCDLDDTDPVKW

SEQ ID NO: 95025 - protein, 15 aa, Mycobacterium tuberculosis
PAWCDLDDTDPVKWA

SEQ ID NO: 95026 - protein, 15 aa, Mycobacterium tuberculosis
AWCDLDDTDPVKWAA

SEQ ID NO: 95027 - protein, 15 aa, Mycobacterium tuberculosis
WCDLDDTDPVKWAAI

SEQ ID NO: 95028 - protein, 15 aa, Mycobacterium tuberculosis
CDLDDTDPVKWAAIC

SEQ ID NO: 95029 - protein, 15 aa, Mycobacterium tuberculosis
DLDDTDPVKWAAICD

SEQ ID NO: 95030 - protein, 15 aa, Mycobacterium tuberculosis
LDDTDPVKWAAICDA

SEQ ID NO: 95031 - protein, 15 aa, Mycobacterium tuberculosis
DDTDPVKWAAICDAA

SEQ ID NO: 95032 - protein, 15 aa, Mycobacterium tuberculosis
DTDPVKWAAICDAAR

SEQ ID NO: 95033 - protein, 15 aa, Mycobacterium tuberculosis
TDPVKWAAICDAARH

SEQ ID NO: 95034 - protein, 15 aa, Mycobacterium tuberculosis
DPVKWAAICDAARHW

SEQ ID NO: 95035 - protein, 15 aa, Mycobacterium tuberculosis
PVKWAAICDAARHWA

SEQ ID NO: 95036 - protein, 15 aa, Mycobacterium tuberculosis
VKWAAICDAARHWAL

SEQ ID NO: 95037 - protein, 15 aa, Mycobacterium tuberculosis
KWAAICDAARHWALR

SEQ ID NO: 95038 - protein, 15 aa, Mycobacterium tuberculosis
WAAICDAARHWALRV

SEQ ID NO: 95039 - protein, 15 aa, Mycobacterium tuberculosis
AAICDAARHWALRVE

SEQ ID NO: 95040 - protein, 15 aa, Mycobacterium tuberculosis
AICDAARHWALRVET

SEQ ID NO: 95041 - protein, 15 aa, Mycobacterium tuberculosis
ICDAARHWALRVETC

SEQ ID NO: 95042 - protein, 15 aa, Mycobacterium tuberculosis
CDAARHWALRVETCQ

SEQ ID NO: 95043 - protein, 15 aa, Mycobacterium tuberculosis
DAARHWALRVETCQA

SEQ ID NO: 95044 - protein, 15 aa, Mycobacterium tuberculosis
AARHWALRVETCQAA

SEQ ID NO: 95045 - protein, 15 aa, Mycobacterium tuberculosis
ARHWALRVETCQAAS

SEQ ID NO: 95046 - protein, 15 aa, Mycobacterium tuberculosis
RHWALRVETCQAASA

SEQ ID NO: 95047 - protein, 15 aa, Mycobacterium tuberculosis
HWALRVETCQAASAE

SEQ ID NO: 95048 - protein, 15 aa, Mycobacterium tuberculosis
WALRVETCQAASAEA

SEQ ID NO: 95049 - protein, 15 aa, Mycobacterium tuberculosis
ALRVETCQAASAEAS

SEQ ID NO: 95050 - protein, 15 aa, Mycobacterium tuberculosis
LRVETCQAASAEASR

SEQ ID NO: 95051 - protein, 15 aa, Mycobacterium tuberculosis
RVETCQAASAEASRD

SEQ ID NO: 95052 - protein, 15 aa, Mycobacterium tuberculosis
VETCQAASAEASRDV

SEQ ID NO: 95053 - protein, 15 aa, Mycobacterium tuberculosis
ETCQAASAEASRDVS

SEQ ID NO: 95054 - protein, 15 aa, Mycobacterium tuberculosis
TCQAASAEASRDVSA

SEQ ID NO: 95055 - protein, 15 aa, Mycobacterium tuberculosis
CQAASAEASRDVSAA

SEQ ID NO: 95056 - protein, 15 aa, Mycobacterium tuberculosis
QAASAEASRDVSAAA

SEQ ID NO: 95057 - protein, 15 aa, Mycobacterium tuberculosis
AASAEASRDVSAAAD

SEQ ID NO: 95058 - protein, 15 aa, Mycobacterium tuberculosis
ASAEASRDVSAAADW

SEQ ID NO: 95059 - protein, 15 aa, Mycobacterium tuberculosis
SAEASRDVSAAADWP

SEQ ID NO: 95060 - protein, 15 aa, Mycobacterium tuberculosis
AEASRDVSAAADWPA

SEQ ID NO: 95061 - protein, 15 aa, Mycobacterium tuberculosis
EASRDVSAAADWPAV

SEQ ID NO: 95062 - protein, 15 aa, Mycobacterium tuberculosis
ASRDVSAAADWPAVS

SEQ ID NO: 95063 - protein, 15 aa, Mycobacterium tuberculosis
SRDVSAAADWPAVSR

SEQ ID NO: 95064 - protein, 15 aa, Mycobacterium tuberculosis
RDVSAAADWPAVSRE

SEQ ID NO: 95065 - protein, 15 aa, Mycobacterium tuberculosis
DVSAAADWPAVSREI

SEQ ID NO: 95066 - protein, 15 aa, Mycobacterium tuberculosis
VSAAADWPAVSREIQ

SEQ ID NO: 95067 - protein, 15 aa, Mycobacterium tuberculosis
SAAADWPAVSREIQR

SEQ ID NO: 95068 - protein, 15 aa, Mycobacterium tuberculosis
AAADWPAVSREIQRR

SEQ ID NO: 95069 - protein, 15 aa, Mycobacterium tuberculosis
AADWPAVSREIQRRR

SEQ ID NO: 95070 - protein, 15 aa, Mycobacterium tuberculosis
ADWPAVSREIQRRRD

SEQ ID NO: 95071 - protein, 15 aa, Mycobacterium tuberculosis
DWPAVSREIQRRRDA

SEQ ID NO: 95072 - protein, 15 aa, Mycobacterium tuberculosis
WPAVSREIQRRRDAY

SEQ ID NO: 95073 - protein, 15 aa, Mycobacterium tuberculosis
PAVSREIQRRRDAYI

SEQ ID NO: 95074 - protein, 15 aa, Mycobacterium tuberculosis
AVSREIQRRRDAYIR

SEQ ID NO: 95075 - protein, 15 aa, Mycobacterium tuberculosis
VSREIQRRRDAYIRR

SEQ ID NO: 95076 - protein, 15 aa, Mycobacterium tuberculosis
SREIQRRRDAYIRRV

SEQ ID NO: 95077 - protein, 15 aa, Mycobacterium tuberculosis
REIQRRRDAYIRRVV

SEQ ID NO: 95078 - protein, 15 aa, Mycobacterium tuberculosis
EIQRRRDAYIRRVVV

SEQ ID NO: 95079 - protein, 16 aa, Mycobacterium tuberculosis
MTAVGGSPPTRRCPAT

SEQ ID NO: 95080 - protein, 16 aa, Mycobacterium tuberculosis
TAVGGSPPTRRCPATE

SEQ ID NO: 95081 - protein, 16 aa, Mycobacterium tuberculosis
AVGGSPPTRRCPATED

SEQ ID NO: 95082 - protein, 16 aa, Mycobacterium tuberculosis
VGGSPPTRRCPATEDR

SEQ ID NO: 95083 - protein, 16 aa, Mycobacterium tuberculosis
GGSPPTRRCPATEDRA

SEQ ID NO: 95084 - protein, 16 aa, Mycobacterium tuberculosis
GSPPTRRCPATEDRAP

SEQ ID NO: 95085 - protein, 16 aa, Mycobacterium tuberculosis
SPPTRRCPATEDRAPA

SEQ ID NO: 95086 - protein, 16 aa, Mycobacterium tuberculosis
PPTRRCPATEDRAPAT

SEQ ID NO: 95087 - protein, 16 aa, Mycobacterium tuberculosis
PTRRCPATEDRAPATV

SEQ ID NO: 95088 - protein, 16 aa, Mycobacterium tuberculosis
TRRCPATEDRAPATVA

SEQ ID NO: 95089 - protein, 16 aa, Mycobacterium tuberculosis
RRCPATEDRAPATVAT

SEQ ID NO: 95090 - protein, 16 aa, Mycobacterium tuberculosis
RCPATEDRAPATVATP

SEQ ID NO: 95091 - protein, 16 aa, Mycobacterium tuberculosis
CPATEDRAPATVATPS

SEQ ID NO: 95092 - protein, 16 aa, Mycobacterium tuberculosis
PATEDRAPATVATPSS

SEQ ID NO: 95093 - protein, 16 aa, Mycobacterium tuberculosis
ATEDRAPATVATPSST

SEQ ID NO: 95094 - protein, 16 aa, Mycobacterium tuberculosis
TEDRAPATVATPSSTD

SEQ ID NO: 95095 - protein, 16 aa, Mycobacterium tuberculosis
EDRAPATVATPSSTDP

SEQ ID NO: 95096 - protein, 16 aa, Mycobacterium tuberculosis
DRAPATVATPSSTDPT

SEQ ID NO: 95097 - protein, 16 aa, Mycobacterium tuberculosis
RAPATVATPSSTDPTA

SEQ ID NO: 95098 - protein, 16 aa, Mycobacterium tuberculosis
APATVATPSSTDPTAS

SEQ ID NO: 95099 - protein, 16 aa, Mycobacterium tuberculosis
PATVATPSSTDPTASR

SEQ ID NO: 95100 - protein, 16 aa, Mycobacterium tuberculosis
ATVATPSSTDPTASRA

SEQ ID NO: 95101 - protein, 16 aa, Mycobacterium tuberculosis
TVATPSSTDPTASRAV

SEQ ID NO: 95102 - protein, 16 aa, Mycobacterium tuberculosis
VATPSSTDPTASRAVS

SEQ ID NO: 95103 - protein, 16 aa, Mycobacterium tuberculosis
ATPSSTDPTASRAVSW

SEQ ID NO: 95104 - protein, 16 aa, Mycobacterium tuberculosis
TPSSTDPTASRAVSWW

SEQ ID NO: 95105 - protein, 16 aa, Mycobacterium tuberculosis
PSSTDPTASRAVSWWS

SEQ ID NO: 95106 - protein, 16 aa, Mycobacterium tuberculosis
SSTDPTASRAVSWWSV

SEQ ID NO: 95107 - protein, 16 aa, Mycobacterium tuberculosis
STDPTASRAVSWWSVH

SEQ ID NO: 95108 - protein, 16 aa, Mycobacterium tuberculosis
TDPTASRAVSWWSVHE

SEQ ID NO: 95109 - protein, 16 aa, Mycobacterium tuberculosis
DPTASRAVSWWSVHEY

SEQ ID NO: 95110 - protein, 16 aa, Mycobacterium tuberculosis
PTASRAVSWWSVHEYV

SEQ ID NO: 95111 - protein, 16 aa, Mycobacterium tuberculosis
TASRAVSWWSVHEYVA

SEQ ID NO: 95112 - protein, 16 aa, Mycobacterium tuberculosis
ASRAVSWWSVHEYVAP

SEQ ID NO: 95113 - protein, 16 aa, Mycobacterium tuberculosis
SRAVSWWSVHEYVAPT

SEQ ID NO: 95114 - protein, 16 aa, Mycobacterium tuberculosis
RAVSWWSVHEYVAPTL

SEQ ID NO: 95115 - protein, 16 aa, Mycobacterium tuberculosis
AVSWWSVHEYVAPTLA

SEQ ID NO: 95116 - protein, 16 aa, Mycobacterium tuberculosis
VSWWSVHEYVAPTLAA

SEQ ID NO: 95117 - protein, 16 aa, Mycobacterium tuberculosis
SWWSVHEYVAPTLAAA

SEQ ID NO: 95118 - protein, 16 aa, Mycobacterium tuberculosis
WWSVHEYVAPTLAAAV

SEQ ID NO: 95119 - protein, 16 aa, Mycobacterium tuberculosis
WSVHEYVAPTLAAAVE

SEQ ID NO: 95120 - protein, 16 aa, Mycobacterium tuberculosis
SVHEYVAPTLAAAVEW

SEQ ID NO: 95121 - protein, 16 aa, Mycobacterium tuberculosis
VHEYVAPTLAAAVEWP

SEQ ID NO: 95122 - protein, 16 aa, Mycobacterium tuberculosis
HEYVAPTLAAAVEWPM

SEQ ID NO: 95123 - protein, 16 aa, Mycobacterium tuberculosis
EYVAPTLAAAVEWPMA

SEQ ID NO: 95124 - protein, 16 aa, Mycobacterium tuberculosis
YVAPTLAAAVEWPMAG

SEQ ID NO: 95125 - protein, 16 aa, Mycobacterium tuberculosis
VAPTLAAAVEWPMAGT

SEQ ID NO: 95126 - protein, 16 aa, Mycobacterium tuberculosis
APTLAAAVEWPMAGTP

SEQ ID NO: 95127 - protein, 16 aa, Mycobacterium tuberculosis
PTLAAAVEWPMAGTPA

SEQ ID NO: 95128 - protein, 16 aa, Mycobacterium tuberculosis
TLAAAVEWPMAGTPAW

SEQ ID NO: 95129 - protein, 16 aa, Mycobacterium tuberculosis
LAAAVEWPMAGTPAWC

SEQ ID NO: 95130 - protein, 16 aa, Mycobacterium tuberculosis
AAAVEWPMAGTPAWCD

SEQ ID NO: 95131 - protein, 16 aa, Mycobacterium tuberculosis
AAVEWPMAGTPAWCDL

SEQ ID NO: 95132 - protein, 16 aa, Mycobacterium tuberculosis
AVEWPMAGTPAWCDLD

SEQ ID NO: 95133 - protein, 16 aa, Mycobacterium tuberculosis
VEWPMAGTPAWCDLDD

SEQ ID NO: 95134 - protein, 16 aa, Mycobacterium tuberculosis
EWPMAGTPAWCDLDDT

SEQ ID NO: 95135 - protein, 16 aa, Mycobacterium tuberculosis
WPMAGTPAWCDLDDTD

SEQ ID NO: 95136 - protein, 16 aa, Mycobacterium tuberculosis
PMAGTPAWCDLDDTDP

SEQ ID NO: 95137 - protein, 16 aa, Mycobacterium tuberculosis
MAGTPAWCDLDDTDPV

SEQ ID NO: 95138 - protein, 16 aa, Mycobacterium tuberculosis
AGTPAWCDLDDTDPVK

SEQ ID NO: 95139 - protein, 16 aa, Mycobacterium tuberculosis
GTPAWCDLDDTDPVKW

SEQ ID NO: 95140 - protein, 16 aa, Mycobacterium tuberculosis
TPAWCDLDDTDPVKWA

SEQ ID NO: 95141 - protein, 16 aa, Mycobacterium tuberculosis
PAWCDLDDTDPVKWAA

SEQ ID NO: 95142 - protein, 16 aa, Mycobacterium tuberculosis
AWCDLDDTDPVKWAAI

SEQ ID NO: 95143 - protein, 16 aa, Mycobacterium tuberculosis
WCDLDDTDPVKWAAIC

SEQ ID NO: 95144 - protein, 16 aa, Mycobacterium tuberculosis
CDLDDTDPVKWAAICD

SEQ ID NO: 95145 - protein, 16 aa, Mycobacterium tuberculosis
DLDDTDPVKWAAICDA

SEQ ID NO: 95146 - protein, 16 aa, Mycobacterium tuberculosis
LDDTDPVKWAAICDAA

SEQ ID NO: 95147 - protein, 16 aa, Mycobacterium tuberculosis
DDTDPVKWAAICDAAR

SEQ ID NO: 95148 - protein, 16 aa, Mycobacterium tuberculosis
DTDPVKWAAICDAARH

SEQ ID NO: 95149 - protein, 16 aa, Mycobacterium tuberculosis
TDPVKWAAICDAARHW

SEQ ID NO: 95150 - protein, 16 aa, Mycobacterium tuberculosis
DPVKWAAICDAARHWA

SEQ ID NO: 95151 - protein, 16 aa, Mycobacterium tuberculosis
PVKWAAICDAARHWAL

SEQ ID NO: 95152 - protein, 16 aa, Mycobacterium tuberculosis
VKWAAICDAARHWALR

SEQ ID NO: 95153 - protein, 16 aa, Mycobacterium tuberculosis
KWAAICDAARHWALRV

SEQ ID NO: 95154 - protein, 16 aa, Mycobacterium tuberculosis
WAAICDAARHWALRVE

SEQ ID NO: 95155 - protein, 16 aa, Mycobacterium tuberculosis
AAICDAARHWALRVET

SEQ ID NO: 95156 - protein, 16 aa, Mycobacterium tuberculosis
AICDAARHWALRVETC

SEQ ID NO: 95157 - protein, 16 aa, Mycobacterium tuberculosis
ICDAARHWALRVETCQ

SEQ ID NO: 95158 - protein, 16 aa, Mycobacterium tuberculosis
CDAARHWALRVETCQA

SEQ ID NO: 95159 - protein, 16 aa, Mycobacterium tuberculosis
DAARHWALRVETCQAA

SEQ ID NO: 95160 - protein, 16 aa, Mycobacterium tuberculosis
AARHWALRVETCQAAS

SEQ ID NO: 95161 - protein, 16 aa, Mycobacterium tuberculosis
ARHWALRVETCQAASA

SEQ ID NO: 95162 - protein, 16 aa, Mycobacterium tuberculosis
RHWALRVETCQAASAE

SEQ ID NO: 95163 - protein, 16 aa, Mycobacterium tuberculosis
HWALRVETCQAASAEA

SEQ ID NO: 95164 - protein, 16 aa, Mycobacterium tuberculosis
WALRVETCQAASAEAS

SEQ ID NO: 95165 - protein, 16 aa, Mycobacterium tuberculosis
ALRVETCQAASAEASR

SEQ ID NO: 95166 - protein, 16 aa, Mycobacterium tuberculosis
LRVETCQAASAEASRD

SEQ ID NO: 95167 - protein, 16 aa, Mycobacterium tuberculosis
RVETCQAASAEASRDV

SEQ ID NO: 95168 - protein, 16 aa, Mycobacterium tuberculosis
VETCQAASAEASRDVS

SEQ ID NO: 95169 - protein, 16 aa, Mycobacterium tuberculosis
ETCQAASAEASRDVSA

SEQ ID NO: 95170 - protein, 16 aa, Mycobacterium tuberculosis
TCQAASAEASRDVSAA

SEQ ID NO: 95171 - protein, 16 aa, Mycobacterium tuberculosis
CQAASAEASRDVSAAA

SEQ ID NO: 95172 - protein, 16 aa, Mycobacterium tuberculosis
QAASAEASRDVSAAAD

SEQ ID NO: 95173 - protein, 16 aa, Mycobacterium tuberculosis
AASAEASRDVSAAADW

SEQ ID NO: 95174 - protein, 16 aa, Mycobacterium tuberculosis
ASAEASRDVSAAADWP

SEQ ID NO: 95175 - protein, 16 aa, Mycobacterium tuberculosis
SAEASRDVSAAADWPA

SEQ ID NO: 95176 - protein, 16 aa, Mycobacterium tuberculosis
AEASRDVSAAADWPAV

SEQ ID NO: 95177 - protein, 16 aa, Mycobacterium tuberculosis
EASRDVSAAADWPAVS

SEQ ID NO: 95178 - protein, 16 aa, Mycobacterium tuberculosis
ASRDVSAAADWPAVSR

SEQ ID NO: 95179 - protein, 16 aa, Mycobacterium tuberculosis
SRDVSAAADWPAVSRE

SEQ ID NO: 95180 - protein, 16 aa, Mycobacterium tuberculosis
RDVSAAADWPAVSREI

SEQ ID NO: 95181 - protein, 16 aa, Mycobacterium tuberculosis
DVSAAADWPAVSREIQ

SEQ ID NO: 95182 - protein, 16 aa, Mycobacterium tuberculosis
VSAAADWPAVSREIQR

SEQ ID NO: 95183 - protein, 16 aa, Mycobacterium tuberculosis
SAAADWPAVSREIQRR

SEQ ID NO: 95184 - protein, 16 aa, Mycobacterium tuberculosis
AAADWPAVSREIQRRR

SEQ ID NO: 95185 - protein, 16 aa, Mycobacterium tuberculosis
AADWPAVSREIQRRRD

SEQ ID NO: 95186 - protein, 16 aa, Mycobacterium tuberculosis
ADWPAVSREIQRRRDA

SEQ ID NO: 95187 - protein, 16 aa, Mycobacterium tuberculosis
DWPAVSREIQRRRDAY

SEQ ID NO: 95188 - protein, 16 aa, Mycobacterium tuberculosis
WPAVSREIQRRRDAYI

SEQ ID NO: 95189 - protein, 16 aa, Mycobacterium tuberculosis
PAVSREIQRRRDAYIR

SEQ ID NO: 95190 - protein, 16 aa, Mycobacterium tuberculosis
AVSREIQRRRDAYIRR

SEQ ID NO: 95191 - protein, 16 aa, Mycobacterium tuberculosis
VSREIQRRRDAYIRRV

SEQ ID NO: 95192 - protein, 16 aa, Mycobacterium tuberculosis
SREIQRRRDAYIRRVV

SEQ ID NO: 95193 - protein, 16 aa, Mycobacterium tuberculosis
REIQRRRDAYIRRVVV

SEQ ID NO: 95194 - protein, 13 aa, Mycobacterium tuberculosis
MCAFPSPSLGWTV

SEQ ID NO: 95195 - protein, 13 aa, Mycobacterium tuberculosis
CAFPSPSLGWTVS

SEQ ID NO: 95196 - protein, 13 aa, Mycobacterium tuberculosis
AFPSPSLGWTVSH

SEQ ID NO: 95197 - protein, 13 aa, Mycobacterium tuberculosis
FPSPSLGWTVSHE

SEQ ID NO: 95198 - protein, 13 aa, Mycobacterium tuberculosis
PSPSLGWTVSHET

SEQ ID NO: 95199 - protein, 13 aa, Mycobacterium tuberculosis
SPSLGWTVSHETE

SEQ ID NO: 95200 - protein, 13 aa, Mycobacterium tuberculosis
PSLGWTVSHETER

SEQ ID NO: 95201 - protein, 13 aa, Mycobacterium tuberculosis
SLGWTVSHETERP

SEQ ID NO: 95202 - protein, 13 aa, Mycobacterium tuberculosis
LGWTVSHETERPG

SEQ ID NO: 95203 - protein, 13 aa, Mycobacterium tuberculosis
GWTVSHETERPGM

SEQ ID NO: 95204 - protein, 13 aa, Mycobacterium tuberculosis
WTVSHETERPGMA

SEQ ID NO: 95205 - protein, 13 aa, Mycobacterium tuberculosis
TVSHETERPGMAD

SEQ ID NO: 95206 - protein, 13 aa, Mycobacterium tuberculosis
VSHETERPGMADA

SEQ ID NO: 95207 - protein, 13 aa, Mycobacterium tuberculosis
SHETERPGMADAP

SEQ ID NO: 95208 - protein, 13 aa, Mycobacterium tuberculosis
HETERPGMADAPP

SEQ ID NO: 95209 - protein, 13 aa, Mycobacterium tuberculosis
ETERPGMADAPPL

SEQ ID NO: 95210 - protein, 13 aa, Mycobacterium tuberculosis
TERPGMADAPPLS

SEQ ID NO: 95211 - protein, 13 aa, Mycobacterium tuberculosis
ERPGMADAPPLSR

SEQ ID NO: 95212 - protein, 13 aa, Mycobacterium tuberculosis
RPGMADAPPLSRR

SEQ ID NO: 95213 - protein, 13 aa, Mycobacterium tuberculosis
PGMADAPPLSRRY

SEQ ID NO: 95214 - protein, 13 aa, Mycobacterium tuberculosis
GMADAPPLSRRYI

SEQ ID NO: 95215 - protein, 13 aa, Mycobacterium tuberculosis
MADAPPLSRRYIT

SEQ ID NO: 95216 - protein, 13 aa, Mycobacterium tuberculosis
ADAPPLSRRYITI

SEQ ID NO: 95217 - protein, 13 aa, Mycobacterium tuberculosis
DAPPLSRRYITIS

SEQ ID NO: 95218 - protein, 13 aa, Mycobacterium tuberculosis
APPLSRRYITISE

SEQ ID NO: 95219 - protein, 13 aa, Mycobacterium tuberculosis
PPLSRRYITISEA

SEQ ID NO: 95220 - protein, 13 aa, Mycobacterium tuberculosis
PLSRRYITISEAA

SEQ ID NO: 95221 - protein, 13 aa, Mycobacterium tuberculosis
LSRRYITISEAAE

SEQ ID NO: 95222 - protein, 13 aa, Mycobacterium tuberculosis
SRRYITISEAAEY

SEQ ID NO: 95223 - protein, 13 aa, Mycobacterium tuberculosis
RRYITISEAAEYL

SEQ ID NO: 95224 - protein, 13 aa, Mycobacterium tuberculosis
RYITISEAAEYLA

SEQ ID NO: 95225 - protein, 13 aa, Mycobacterium tuberculosis
YITISEAAEYLAV

SEQ ID NO: 95226 - protein, 13 aa, Mycobacterium tuberculosis
ITISEAAEYLAVT

SEQ ID NO: 95227 - protein, 13 aa, Mycobacterium tuberculosis
TISEAAEYLAVTD

SEQ ID NO: 95228 - protein, 13 aa, Mycobacterium tuberculosis
ISEAAEYLAVTDR

SEQ ID NO: 95229 - protein, 13 aa, Mycobacterium tuberculosis
SEAAEYLAVTDRT

SEQ ID NO: 95230 - protein, 13 aa, Mycobacterium tuberculosis
EAAEYLAVTDRTV

SEQ ID NO: 95231 - protein, 13 aa, Mycobacterium tuberculosis
AAEYLAVTDRTVR

SEQ ID NO: 95232 - protein, 13 aa, Mycobacterium tuberculosis
AEYLAVTDRTVRQ

SEQ ID NO: 95233 - protein, 13 aa, Mycobacterium tuberculosis
EYLAVTDRTVRQM

SEQ ID NO: 95234 - protein, 13 aa, Mycobacterium tuberculosis
YLAVTDRTVRQMI

SEQ ID NO: 95235 - protein, 13 aa, Mycobacterium tuberculosis
LAVTDRTVRQMIA

SEQ ID NO: 95236 - protein, 13 aa, Mycobacterium tuberculosis
AVTDRTVRQMIAD

SEQ ID NO: 95237 - protein, 13 aa, Mycobacterium tuberculosis
VTDRTVRQMIADG

SEQ ID NO: 95238 - protein, 13 aa, Mycobacterium tuberculosis
TDRTVRQMIADGR

SEQ ID NO: 95239 - protein, 13 aa, Mycobacterium tuberculosis
DRTVRQMIADGRL

SEQ ID NO: 95240 - protein, 13 aa, Mycobacterium tuberculosis
RTVRQMIADGRLR

SEQ ID NO: 95241 - protein, 13 aa, Mycobacterium tuberculosis
TVRQMIADGRLRG

SEQ ID NO: 95242 - protein, 13 aa, Mycobacterium tuberculosis
VRQMIADGRLRGY

SEQ ID NO: 95243 - protein, 13 aa, Mycobacterium tuberculosis
RQMIADGRLRGYR

SEQ ID NO: 95244 - protein, 13 aa, Mycobacterium tuberculosis
QMIADGRLRGYRS

SEQ ID NO: 95245 - protein, 13 aa, Mycobacterium tuberculosis
MIADGRLRGYRSG

SEQ ID NO: 95246 - protein, 13 aa, Mycobacterium tuberculosis
IADGRLRGYRSGT

SEQ ID NO: 95247 - protein, 13 aa, Mycobacterium tuberculosis
ADGRLRGYRSGTR

SEQ ID NO: 95248 - protein, 13 aa, Mycobacterium tuberculosis
DGRLRGYRSGTRL

SEQ ID NO: 95249 - protein, 13 aa, Mycobacterium tuberculosis
GRLRGYRSGTRLV

SEQ ID NO: 95250 - protein, 13 aa, Mycobacterium tuberculosis
RLRGYRSGTRLVR

SEQ ID NO: 95251 - protein, 13 aa, Mycobacterium tuberculosis
LRGYRSGTRLVRL

SEQ ID NO: 95252 - protein, 13 aa, Mycobacterium tuberculosis
RGYRSGTRLVRLR

SEQ ID NO: 95253 - protein, 13 aa, Mycobacterium tuberculosis
GYRSGTRLVRLRR

SEQ ID NO: 95254 - protein, 13 aa, Mycobacterium tuberculosis
YRSGTRLVRLRRD

SEQ ID NO: 95255 - protein, 13 aa, Mycobacterium tuberculosis
RSGTRLVRLRRDE

SEQ ID NO: 95256 - protein, 13 aa, Mycobacterium tuberculosis
SGTRLVRLRRDEV

SEQ ID NO: 95257 - protein, 13 aa, Mycobacterium tuberculosis
GTRLVRLRRDEVD

SEQ ID NO: 95258 - protein, 13 aa, Mycobacterium tuberculosis
TRLVRLRRDEVDG

SEQ ID NO: 95259 - protein, 13 aa, Mycobacterium tuberculosis
RLVRLRRDEVDGA

SEQ ID NO: 95260 - protein, 13 aa, Mycobacterium tuberculosis
LVRLRRDEVDGAM

SEQ ID NO: 95261 - protein, 13 aa, Mycobacterium tuberculosis
VRLRRDEVDGAMH

SEQ ID NO: 95262 - protein, 13 aa, Mycobacterium tuberculosis
RLRRDEVDGAMHP

SEQ ID NO: 95263 - protein, 13 aa, Mycobacterium tuberculosis
LRRDEVDGAMHPF

SEQ ID NO: 95264 - protein, 13 aa, Mycobacterium tuberculosis
RRDEVDGAMHPFG

SEQ ID NO: 95265 - protein, 13 aa, Mycobacterium tuberculosis
RDEVDGAMHPFGG

SEQ ID NO: 95266 - protein, 13 aa, Mycobacterium tuberculosis
DEVDGAMHPFGGA

SEQ ID NO: 95267 - protein, 13 aa, Mycobacterium tuberculosis
EVDGAMHPFGGAA

SEQ ID NO: 95268 - protein, 14 aa, Mycobacterium tuberculosis
MCAFPSPSLGWTVS

SEQ ID NO: 95269 - protein, 14 aa, Mycobacterium tuberculosis
CAFPSPSLGWTVSH

SEQ ID NO: 95270 - protein, 14 aa, Mycobacterium tuberculosis
AFPSPSLGWTVSHE

SEQ ID NO: 95271 - protein, 14 aa, Mycobacterium tuberculosis
FPSPSLGWTVSHET

SEQ ID NO: 95272 - protein, 14 aa, Mycobacterium tuberculosis
PSPSLGWTVSHETE

SEQ ID NO: 95273 - protein, 14 aa, Mycobacterium tuberculosis
SPSLGWTVSHETER

SEQ ID NO: 95274 - protein, 14 aa, Mycobacterium tuberculosis
PSLGWTVSHETERP

SEQ ID NO: 95275 - protein, 14 aa, Mycobacterium tuberculosis
SLGWTVSHETERPG

SEQ ID NO: 95276 - protein, 14 aa, Mycobacterium tuberculosis
LGWTVSHETERPGM

SEQ ID NO: 95277 - protein, 14 aa, Mycobacterium tuberculosis
GWTVSHETERPGMA

SEQ ID NO: 95278 - protein, 14 aa, Mycobacterium tuberculosis
WTVSHETERPGMAD

SEQ ID NO: 95279 - protein, 14 aa, Mycobacterium tuberculosis
TVSHETERPGMADA

SEQ ID NO: 95280 - protein, 14 aa, Mycobacterium tuberculosis
VSHETERPGMADAP

SEQ ID NO: 95281 - protein, 14 aa, Mycobacterium tuberculosis
SHETERPGMADAPP

SEQ ID NO: 95282 - protein, 14 aa, Mycobacterium tuberculosis
HETERPGMADAPPL

SEQ ID NO: 95283 - protein, 14 aa, Mycobacterium tuberculosis
ETERPGMADAPPLS

SEQ ID NO: 95284 - protein, 14 aa, Mycobacterium tuberculosis
TERPGMADAPPLSR

SEQ ID NO: 95285 - protein, 14 aa, Mycobacterium tuberculosis
ERPGMADAPPLSRR

SEQ ID NO: 95286 - protein, 14 aa, Mycobacterium tuberculosis
RPGMADAPPLSRRY

SEQ ID NO: 95287 - protein, 14 aa, Mycobacterium tuberculosis
PGMADAPPLSRRYI

SEQ ID NO: 95288 - protein, 14 aa, Mycobacterium tuberculosis
GMADAPPLSRRYIT

SEQ ID NO: 95289 - protein, 14 aa, Mycobacterium tuberculosis
MADAPPLSRRYITI

SEQ ID NO: 95290 - protein, 14 aa, Mycobacterium tuberculosis
ADAPPLSRRYITIS

SEQ ID NO: 95291 - protein, 14 aa, Mycobacterium tuberculosis
DAPPLSRRYITISE

SEQ ID NO: 95292 - protein, 14 aa, Mycobacterium tuberculosis
APPLSRRYITISEA

SEQ ID NO: 95293 - protein, 14 aa, Mycobacterium tuberculosis
PPLSRRYITISEAA

SEQ ID NO: 95294 - protein, 14 aa, Mycobacterium tuberculosis
PLSRRYITISEAAE

SEQ ID NO: 95295 - protein, 14 aa, Mycobacterium tuberculosis
LSRRYITISEAAEY

SEQ ID NO: 95296 - protein, 14 aa, Mycobacterium tuberculosis
SRRYITISEAAEYL

SEQ ID NO: 95297 - protein, 14 aa, Mycobacterium tuberculosis
RRYITISEAAEYLA

SEQ ID NO: 95298 - protein, 14 aa, Mycobacterium tuberculosis
RYITISEAAEYLAV

SEQ ID NO: 95299 - protein, 14 aa, Mycobacterium tuberculosis
YITISEAAEYLAVT

SEQ ID NO: 95300 - protein, 14 aa, Mycobacterium tuberculosis
ITISEAAEYLAVTD

SEQ ID NO: 95301 - protein, 14 aa, Mycobacterium tuberculosis
TISEAAEYLAVTDR

SEQ ID NO: 95302 - protein, 14 aa, Mycobacterium tuberculosis
ISEAAEYLAVTDRT

SEQ ID NO: 95303 - protein, 14 aa, Mycobacterium tuberculosis
SEAAEYLAVTDRTV

SEQ ID NO: 95304 - protein, 14 aa, Mycobacterium tuberculosis
EAAEYLAVTDRTVR

SEQ ID NO: 95305 - protein, 14 aa, Mycobacterium tuberculosis
AAEYLAVTDRTVRQ

SEQ ID NO: 95306 - protein, 14 aa, Mycobacterium tuberculosis
AEYLAVTDRTVRQM

SEQ ID NO: 95307 - protein, 14 aa, Mycobacterium tuberculosis
EYLAVTDRTVRQMI

SEQ ID NO: 95308 - protein, 14 aa, Mycobacterium tuberculosis
YLAVTDRTVRQMIA

SEQ ID NO: 95309 - protein, 14 aa, Mycobacterium tuberculosis
LAVTDRTVRQMIAD

SEQ ID NO: 95310 - protein, 14 aa, Mycobacterium tuberculosis
AVTDRTVRQMIADG

SEQ ID NO: 95311 - protein, 14 aa, Mycobacterium tuberculosis
VTDRTVRQMIADGR

SEQ ID NO: 95312 - protein, 14 aa, Mycobacterium tuberculosis
TDRTVRQMIADGRL

SEQ ID NO: 95313 - protein, 14 aa, Mycobacterium tuberculosis
DRTVRQMIADGRLR

SEQ ID NO: 95314 - protein, 14 aa, Mycobacterium tuberculosis
RTVRQMIADGRLRG

SEQ ID NO: 95315 - protein, 14 aa, Mycobacterium tuberculosis
TVRQMIADGRLRGY

SEQ ID NO: 95316 - protein, 14 aa, Mycobacterium tuberculosis
VRQMIADGRLRGYR

SEQ ID NO: 95317 - protein, 14 aa, Mycobacterium tuberculosis
RQMIADGRLRGYRS

SEQ ID NO: 95318 - protein, 14 aa, Mycobacterium tuberculosis
QMIADGRLRGYRSG

SEQ ID NO: 95319 - protein, 14 aa, Mycobacterium tuberculosis
MIADGRLRGYRSGT

SEQ ID NO: 95320 - protein, 14 aa, Mycobacterium tuberculosis
IADGRLRGYRSGTR

SEQ ID NO: 95321 - protein, 14 aa, Mycobacterium tuberculosis
ADGRLRGYRSGTRL

SEQ ID NO: 95322 - protein, 14 aa, Mycobacterium tuberculosis
DGRLRGYRSGTRLV

SEQ ID NO: 95323 - protein, 14 aa, Mycobacterium tuberculosis
GRLRGYRSGTRLVR

SEQ ID NO: 95324 - protein, 14 aa, Mycobacterium tuberculosis
RLRGYRSGTRLVRL

SEQ ID NO: 95325 - protein, 14 aa, Mycobacterium tuberculosis
LRGYRSGTRLVRLR

SEQ ID NO: 95326 - protein, 14 aa, Mycobacterium tuberculosis
RGYRSGTRLVRLRR

SEQ ID NO: 95327 - protein, 14 aa, Mycobacterium tuberculosis
GYRSGTRLVRLRRD

SEQ ID NO: 95328 - protein, 14 aa, Mycobacterium tuberculosis
YRSGTRLVRLRRDE

SEQ ID NO: 95329 - protein, 14 aa, Mycobacterium tuberculosis
RSGTRLVRLRRDEV

SEQ ID NO: 95330 - protein, 14 aa, Mycobacterium tuberculosis
SGTRLVRLRRDEVD

SEQ ID NO: 95331 - protein, 14 aa, Mycobacterium tuberculosis
GTRLVRLRRDEVDG

SEQ ID NO: 95332 - protein, 14 aa, Mycobacterium tuberculosis
TRLVRLRRDEVDGA

SEQ ID NO: 95333 - protein, 14 aa, Mycobacterium tuberculosis
RLVRLRRDEVDGAM

SEQ ID NO: 95334 - protein, 14 aa, Mycobacterium tuberculosis
LVRLRRDEVDGAMH

SEQ ID NO: 95335 - protein, 14 aa, Mycobacterium tuberculosis
VRLRRDEVDGAMHP

SEQ ID NO: 95336 - protein, 14 aa, Mycobacterium tuberculosis
RLRRDEVDGAMHPF

SEQ ID NO: 95337 - protein, 14 aa, Mycobacterium tuberculosis
LRRDEVDGAMHPFG

SEQ ID NO: 95338 - protein, 14 aa, Mycobacterium tuberculosis
RRDEVDGAMHPFGG

SEQ ID NO: 95339 - protein, 14 aa, Mycobacterium tuberculosis
RDEVDGAMHPFGGA

SEQ ID NO: 95340 - protein, 14 aa, Mycobacterium tuberculosis
DEVDGAMHPFGGAA

SEQ ID NO: 95341 - protein, 15 aa, Mycobacterium tuberculosis
MCAFPSPSLGWTVSH

SEQ ID NO: 95342 - protein, 15 aa, Mycobacterium tuberculosis
CAFPSPSLGWTVSHE

SEQ ID NO: 95343 - protein, 15 aa, Mycobacterium tuberculosis
AFPSPSLGWTVSHET

SEQ ID NO: 95344 - protein, 15 aa, Mycobacterium tuberculosis
FPSPSLGWTVSHETE

SEQ ID NO: 95345 - protein, 15 aa, Mycobacterium tuberculosis
PSPSLGWTVSHETER

SEQ ID NO: 95346 - protein, 15 aa, Mycobacterium tuberculosis
SPSLGWTVSHETERP

SEQ ID NO: 95347 - protein, 15 aa, Mycobacterium tuberculosis
PSLGWTVSHETERPG

SEQ ID NO: 95348 - protein, 15 aa, Mycobacterium tuberculosis
SLGWTVSHETERPGM

SEQ ID NO: 95349 - protein, 15 aa, Mycobacterium tuberculosis
LGWTVSHETERPGMA

SEQ ID NO: 95350 - protein, 15 aa, Mycobacterium tuberculosis
GWTVSHETERPGMAD

SEQ ID NO: 95351 - protein, 15 aa, Mycobacterium tuberculosis
WTVSHETERPGMADA

SEQ ID NO: 95352 - protein, 15 aa, Mycobacterium tuberculosis
TVSHETERPGMADAP

SEQ ID NO: 95353 - protein, 15 aa, Mycobacterium tuberculosis
VSHETERPGMADAPP

SEQ ID NO: 95354 - protein, 15 aa, Mycobacterium tuberculosis
SHETERPGMADAPPL

SEQ ID NO: 95355 - protein, 15 aa, Mycobacterium tuberculosis
HETERPGMADAPPLS

SEQ ID NO: 95356 - protein, 15 aa, Mycobacterium tuberculosis
ETERPGMADAPPLSR

SEQ ID NO: 95357 - protein, 15 aa, Mycobacterium tuberculosis
TERPGMADAPPLSRR

SEQ ID NO: 95358 - protein, 15 aa, Mycobacterium tuberculosis
ERPGMADAPPLSRRY

SEQ ID NO: 95359 - protein, 15 aa, Mycobacterium tuberculosis
RPGMADAPPLSRRYI

SEQ ID NO: 95360 - protein, 15 aa, Mycobacterium tuberculosis
PGMADAPPLSRRYIT

SEQ ID NO: 95361 - protein, 15 aa, Mycobacterium tuberculosis
GMADAPPLSRRYITI

SEQ ID NO: 95362 - protein, 15 aa, Mycobacterium tuberculosis
MADAPPLSRRYITIS

SEQ ID NO: 95363 - protein, 15 aa, Mycobacterium tuberculosis
ADAPPLSRRYITISE

SEQ ID NO: 95364 - protein, 15 aa, Mycobacterium tuberculosis
DAPPLSRRYITISEA

SEQ ID NO: 95365 - protein, 15 aa, Mycobacterium tuberculosis
APPLSRRYITISEAA

SEQ ID NO: 95366 - protein, 15 aa, Mycobacterium tuberculosis
PPLSRRYITISEAAE

SEQ ID NO: 95367 - protein, 15 aa, Mycobacterium tuberculosis
PLSRRYITISEAAEY

SEQ ID NO: 95368 - protein, 15 aa, Mycobacterium tuberculosis
LSRRYITISEAAEYL

SEQ ID NO: 95369 - protein, 15 aa, Mycobacterium tuberculosis
SRRYITISEAAEYLA

SEQ ID NO: 95370 - protein, 15 aa, Mycobacterium tuberculosis
RRYITISEAAEYLAV

SEQ ID NO: 95371 - protein, 15 aa, Mycobacterium tuberculosis
RYITISEAAEYLAVT

SEQ ID NO: 95372 - protein, 15 aa, Mycobacterium tuberculosis
YITISEAAEYLAVTD

SEQ ID NO: 95373 - protein, 15 aa, Mycobacterium tuberculosis
ITISEAAEYLAVTDR

SEQ ID NO: 95374 - protein, 15 aa, Mycobacterium tuberculosis
TISEAAEYLAVTDRT

SEQ ID NO: 95375 - protein, 15 aa, Mycobacterium tuberculosis
ISEAAEYLAVTDRTV

SEQ ID NO: 95376 - protein, 15 aa, Mycobacterium tuberculosis
SEAAEYLAVTDRTVR

SEQ ID NO: 95377 - protein, 15 aa, Mycobacterium tuberculosis
EAAEYLAVTDRTVRQ

SEQ ID NO: 95378 - protein, 15 aa, Mycobacterium tuberculosis
AAEYLAVTDRTVRQM

SEQ ID NO: 95379 - protein, 15 aa, Mycobacterium tuberculosis
AEYLAVTDRTVRQMI

SEQ ID NO: 95380 - protein, 15 aa, Mycobacterium tuberculosis
EYLAVTDRTVRQMIA

SEQ ID NO: 95381 - protein, 15 aa, Mycobacterium tuberculosis
YLAVTDRTVRQMIAD

SEQ ID NO: 95382 - protein, 15 aa, Mycobacterium tuberculosis
LAVTDRTVRQMIADG

SEQ ID NO: 95383 - protein, 15 aa, Mycobacterium tuberculosis
AVTDRTVRQMIADGR

SEQ ID NO: 95384 - protein, 15 aa, Mycobacterium tuberculosis
VTDRTVRQMIADGRL

SEQ ID NO: 95385 - protein, 15 aa, Mycobacterium tuberculosis
TDRTVRQMIADGRLR

SEQ ID NO: 95386 - protein, 15 aa, Mycobacterium tuberculosis
DRTVRQMIADGRLRG

SEQ ID NO: 95387 - protein, 15 aa, Mycobacterium tuberculosis
RTVRQMIADGRLRGY

SEQ ID NO: 95388 - protein, 15 aa, Mycobacterium tuberculosis
TVRQMIADGRLRGYR

SEQ ID NO: 95389 - protein, 15 aa, Mycobacterium tuberculosis
VRQMIADGRLRGYRS

SEQ ID NO: 95390 - protein, 15 aa, Mycobacterium tuberculosis
RQMIADGRLRGYRSG

SEQ ID NO: 95391 - protein, 15 aa, Mycobacterium tuberculosis
QMIADGRLRGYRSGT

SEQ ID NO: 95392 - protein, 15 aa, Mycobacterium tuberculosis
MIADGRLRGYRSGTR

SEQ ID NO: 95393 - protein, 15 aa, Mycobacterium tuberculosis
IADGRLRGYRSGTRL

SEQ ID NO: 95394 - protein, 15 aa, Mycobacterium tuberculosis
ADGRLRGYRSGTRLV

SEQ ID NO: 95395 - protein, 15 aa, Mycobacterium tuberculosis
DGRLRGYRSGTRLVR

SEQ ID NO: 95396 - protein, 15 aa, Mycobacterium tuberculosis
GRLRGYRSGTRLVRL

SEQ ID NO: 95397 - protein, 15 aa, Mycobacterium tuberculosis
RLRGYRSGTRLVRLR

SEQ ID NO: 95398 - protein, 15 aa, Mycobacterium tuberculosis
LRGYRSGTRLVRLRR

SEQ ID NO: 95399 - protein, 15 aa, Mycobacterium tuberculosis
RGYRSGTRLVRLRRD

SEQ ID NO: 95400 - protein, 15 aa, Mycobacterium tuberculosis
GYRSGTRLVRLRRDE

SEQ ID NO: 95401 - protein, 15 aa, Mycobacterium tuberculosis
YRSGTRLVRLRRDEV

SEQ ID NO: 95402 - protein, 15 aa, Mycobacterium tuberculosis
RSGTRLVRLRRDEVD

SEQ ID NO: 95403 - protein, 15 aa, Mycobacterium tuberculosis
SGTRLVRLRRDEVDG

SEQ ID NO: 95404 - protein, 15 aa, Mycobacterium tuberculosis
GTRLVRLRRDEVDGA

SEQ ID NO: 95405 - protein, 15 aa, Mycobacterium tuberculosis
TRLVRLRRDEVDGAM

SEQ ID NO: 95406 - protein, 15 aa, Mycobacterium tuberculosis
RLVRLRRDEVDGAMH

SEQ ID NO: 95407 - protein, 15 aa, Mycobacterium tuberculosis
LVRLRRDEVDGAMHP

SEQ ID NO: 95408 - protein, 15 aa, Mycobacterium tuberculosis
VRLRRDEVDGAMHPF

SEQ ID NO: 95409 - protein, 15 aa, Mycobacterium tuberculosis
RLRRDEVDGAMHPFG

SEQ ID NO: 95410 - protein, 15 aa, Mycobacterium tuberculosis
LRRDEVDGAMHPFGG

SEQ ID NO: 95411 - protein, 15 aa, Mycobacterium tuberculosis
RRDEVDGAMHPFGGA

SEQ ID NO: 95412 - protein, 15 aa, Mycobacterium tuberculosis
RDEVDGAMHPFGGAA

SEQ ID NO: 95413 - protein, 16 aa, Mycobacterium tuberculosis
MCAFPSPSLGWTVSHE

SEQ ID NO: 95414 - protein, 16 aa, Mycobacterium tuberculosis
CAFPSPSLGWTVSHET

SEQ ID NO: 95415 - protein, 16 aa, Mycobacterium tuberculosis
AFPSPSLGWTVSHETE

SEQ ID NO: 95416 - protein, 16 aa, Mycobacterium tuberculosis
FPSPSLGWTVSHETER

SEQ ID NO: 95417 - protein, 16 aa, Mycobacterium tuberculosis
PSPSLGWTVSHETERP

SEQ ID NO: 95418 - protein, 16 aa, Mycobacterium tuberculosis
SPSLGWTVSHETERPG

SEQ ID NO: 95419 - protein, 16 aa, Mycobacterium tuberculosis
PSLGWTVSHETERPGM

SEQ ID NO: 95420 - protein, 16 aa, Mycobacterium tuberculosis
SLGWTVSHETERPGMA

SEQ ID NO: 95421 - protein, 16 aa, Mycobacterium tuberculosis
LGWTVSHETERPGMAD

SEQ ID NO: 95422 - protein, 16 aa, Mycobacterium tuberculosis
GWTVSHETERPGMADA

SEQ ID NO: 95423 - protein, 16 aa, Mycobacterium tuberculosis
WTVSHETERPGMADAP

SEQ ID NO: 95424 - protein, 16 aa, Mycobacterium tuberculosis
TVSHETERPGMADAPP

SEQ ID NO: 95425 - protein, 16 aa, Mycobacterium tuberculosis
VSHETERPGMADAPPL

SEQ ID NO: 95426 - protein, 16 aa, Mycobacterium tuberculosis
SHETERPGMADAPPLS

SEQ ID NO: 95427 - protein, 16 aa, Mycobacterium tuberculosis
HETERPGMADAPPLSR

SEQ ID NO: 95428 - protein, 16 aa, Mycobacterium tuberculosis
ETERPGMADAPPLSRR

SEQ ID NO: 95429 - protein, 16 aa, Mycobacterium tuberculosis
TERPGMADAPPLSRRY

SEQ ID NO: 95430 - protein, 16 aa, Mycobacterium tuberculosis
ERPGMADAPPLSRRYI

SEQ ID NO: 95431 - protein, 16 aa, Mycobacterium tuberculosis
RPGMADAPPLSRRYIT

SEQ ID NO: 95432 - protein, 16 aa, Mycobacterium tuberculosis
PGMADAPPLSRRYITI

SEQ ID NO: 95433 - protein, 16 aa, Mycobacterium tuberculosis
GMADAPPLSRRYITIS

SEQ ID NO: 95434 - protein, 16 aa, Mycobacterium tuberculosis
MADAPPLSRRYITISE

SEQ ID NO: 95435 - protein, 16 aa, Mycobacterium tuberculosis
ADAPPLSRRYITISEA

SEQ ID NO: 95436 - protein, 16 aa, Mycobacterium tuberculosis
DAPPLSRRYITISEAA

SEQ ID NO: 95437 - protein, 16 aa, Mycobacterium tuberculosis
APPLSRRYITISEAAE

SEQ ID NO: 95438 - protein, 16 aa, Mycobacterium tuberculosis
PPLSRRYITISEAAEY

SEQ ID NO: 95439 - protein, 16 aa, Mycobacterium tuberculosis
PLSRRYITISEAAEYL

SEQ ID NO: 95440 - protein, 16 aa, Mycobacterium tuberculosis
LSRRYITISEAAEYLA

SEQ ID NO: 95441 - protein, 16 aa, Mycobacterium tuberculosis
SRRYITISEAAEYLAV

SEQ ID NO: 95442 - protein, 16 aa, Mycobacterium tuberculosis
RRYITISEAAEYLAVT

SEQ ID NO: 95443 - protein, 16 aa, Mycobacterium tuberculosis
RYITISEAAEYLAVTD

SEQ ID NO: 95444 - protein, 16 aa, Mycobacterium tuberculosis
YITISEAAEYLAVTDR

SEQ ID NO: 95445 - protein, 16 aa, Mycobacterium tuberculosis
ITISEAAEYLAVTDRT

SEQ ID NO: 95446 - protein, 16 aa, Mycobacterium tuberculosis
TISEAAEYLAVTDRTV

SEQ ID NO: 95447 - protein, 16 aa, Mycobacterium tuberculosis
ISEAAEYLAVTDRTVR

SEQ ID NO: 95448 - protein, 16 aa, Mycobacterium tuberculosis
SEAAEYLAVTDRTVRQ

SEQ ID NO: 95449 - protein, 16 aa, Mycobacterium tuberculosis
EAAEYLAVTDRTVRQM

SEQ ID NO: 95450 - protein, 16 aa, Mycobacterium tuberculosis
AAEYLAVTDRTVRQMI

SEQ ID NO: 95451 - protein, 16 aa, Mycobacterium tuberculosis
AEYLAVTDRTVRQMIA

SEQ ID NO: 95452 - protein, 16 aa, Mycobacterium tuberculosis
EYLAVTDRTVRQMIAD

SEQ ID NO: 95453 - protein, 16 aa, Mycobacterium tuberculosis
YLAVTDRTVRQMIADG

SEQ ID NO: 95454 - protein, 16 aa, Mycobacterium tuberculosis
LAVTDRTVRQMIADGR

SEQ ID NO: 95455 - protein, 16 aa, Mycobacterium tuberculosis
AVTDRTVRQMIADGRL

SEQ ID NO: 95456 - protein, 16 aa, Mycobacterium tuberculosis
VTDRTVRQMIADGRLR

SEQ ID NO: 95457 - protein, 16 aa, Mycobacterium tuberculosis
TDRTVRQMIADGRLRG

SEQ ID NO: 95458 - protein, 16 aa, Mycobacterium tuberculosis
DRTVRQMIADGRLRGY

SEQ ID NO: 95459 - protein, 16 aa, Mycobacterium tuberculosis
RTVRQMIADGRLRGYR

SEQ ID NO: 95460 - protein, 16 aa, Mycobacterium tuberculosis
TVRQMIADGRLRGYRS

SEQ ID NO: 95461 - protein, 16 aa, Mycobacterium tuberculosis
VRQMIADGRLRGYRSG

SEQ ID NO: 95462 - protein, 16 aa, Mycobacterium tuberculosis
RQMIADGRLRGYRSGT

SEQ ID NO: 95463 - protein, 16 aa, Mycobacterium tuberculosis
QMIADGRLRGYRSGTR

SEQ ID NO: 95464 - protein, 16 aa, Mycobacterium tuberculosis
MIADGRLRGYRSGTRL

SEQ ID NO: 95465 - protein, 16 aa, Mycobacterium tuberculosis
IADGRLRGYRSGTRLV

SEQ ID NO: 95466 - protein, 16 aa, Mycobacterium tuberculosis
ADGRLRGYRSGTRLVR

SEQ ID NO: 95467 - protein, 16 aa, Mycobacterium tuberculosis
DGRLRGYRSGTRLVRL

SEQ ID NO: 95468 - protein, 16 aa, Mycobacterium tuberculosis
GRLRGYRSGTRLVRLR

SEQ ID NO: 95469 - protein, 16 aa, Mycobacterium tuberculosis
RLRGYRSGTRLVRLRR

SEQ ID NO: 95470 - protein, 16 aa, Mycobacterium tuberculosis
LRGYRSGTRLVRLRRD

SEQ ID NO: 95471 - protein, 16 aa, Mycobacterium tuberculosis
RGYRSGTRLVRLRRDE

SEQ ID NO: 95472 - protein, 16 aa, Mycobacterium tuberculosis
GYRSGTRLVRLRRDEV

SEQ ID NO: 95473 - protein, 16 aa, Mycobacterium tuberculosis
YRSGTRLVRLRRDEVD

SEQ ID NO: 95474 - protein, 16 aa, Mycobacterium tuberculosis
RSGTRLVRLRRDEVDG

SEQ ID NO: 95475 - protein, 16 aa, Mycobacterium tuberculosis
SGTRLVRLRRDEVDGA

SEQ ID NO: 95476 - protein, 16 aa, Mycobacterium tuberculosis
GTRLVRLRRDEVDGAM

SEQ ID NO: 95477 - protein, 16 aa, Mycobacterium tuberculosis
TRLVRLRRDEVDGAMH

SEQ ID NO: 95478 - protein, 16 aa, Mycobacterium tuberculosis
RLVRLRRDEVDGAMHP

SEQ ID NO: 95479 - protein, 16 aa, Mycobacterium tuberculosis
LVRLRRDEVDGAMHPF

SEQ ID NO: 95480 - protein, 16 aa, Mycobacterium tuberculosis
VRLRRDEVDGAMHPFG

SEQ ID NO: 95481 - protein, 16 aa, Mycobacterium tuberculosis
RLRRDEVDGAMHPFGG

SEQ ID NO: 95482 - protein, 16 aa, Mycobacterium tuberculosis
LRRDEVDGAMHPFGGA

SEQ ID NO: 95483 - protein, 16 aa, Mycobacterium tuberculosis
RRDEVDGAMHPFGGAA

SEQ ID NO: 95484 - protein, 13 aa, Mycobacterium tuberculosis
MADAVKYVVMCNC

SEQ ID NO: 95485 - protein, 13 aa, Mycobacterium tuberculosis
ADAVKYVVMCNCD

SEQ ID NO: 95486 - protein, 13 aa, Mycobacterium tuberculosis
DAVKYVVMCNCDD

SEQ ID NO: 95487 - protein, 13 aa, Mycobacterium tuberculosis
AVKYVVMCNCDDE

SEQ ID NO: 95488 - protein, 13 aa, Mycobacterium tuberculosis
VKYVVMCNCDDEP

SEQ ID NO: 95489 - protein, 13 aa, Mycobacterium tuberculosis
KYVVMCNCDDEPG

SEQ ID NO: 95490 - protein, 13 aa, Mycobacterium tuberculosis
YVVMCNCDDEPGA

SEQ ID NO: 95491 - protein, 13 aa, Mycobacterium tuberculosis
VVMCNCDDEPGAL

SEQ ID NO: 95492 - protein, 13 aa, Mycobacterium tuberculosis
VMCNCDDEPGALI

SEQ ID NO: 95493 - protein, 13 aa, Mycobacterium tuberculosis
MCNCDDEPGALII

SEQ ID NO: 95494 - protein, 13 aa, Mycobacterium tuberculosis
CNCDDEPGALIIA

SEQ ID NO: 95495 - protein, 13 aa, Mycobacterium tuberculosis
NCDDEPGALIIAW

SEQ ID NO: 95496 - protein, 13 aa, Mycobacterium tuberculosis
CDDEPGALIIAWI

SEQ ID NO: 95497 - protein, 13 aa, Mycobacterium tuberculosis
DDEPGALIIAWID

SEQ ID NO: 95498 - protein, 13 aa, Mycobacterium tuberculosis
DEPGALIIAWIDD

SEQ ID NO: 95499 - protein, 13 aa, Mycobacterium tuberculosis
EPGALIIAWIDDE

SEQ ID NO: 95500 - protein, 13 aa, Mycobacterium tuberculosis
PGALIIAWIDDER

SEQ ID NO: 95501 - protein, 13 aa, Mycobacterium tuberculosis
GALIIAWIDDERP

SEQ ID NO: 95502 - protein, 13 aa, Mycobacterium tuberculosis
ALIIAWIDDERPA

SEQ ID NO: 95503 - protein, 13 aa, Mycobacterium tuberculosis
LIIAWIDDERPAG

SEQ ID NO: 95504 - protein, 13 aa, Mycobacterium tuberculosis
IIAWIDDERPAGG

SEQ ID NO: 95505 - protein, 13 aa, Mycobacterium tuberculosis
IAWIDDERPAGGH

SEQ ID NO: 95506 - protein, 13 aa, Mycobacterium tuberculosis
AWIDDERPAGGHI

SEQ ID NO: 95507 - protein, 13 aa, Mycobacterium tuberculosis
WIDDERPAGGHIQ

SEQ ID NO: 95508 - protein, 13 aa, Mycobacterium tuberculosis
IDDERPAGGHIQM

SEQ ID NO: 95509 - protein, 13 aa, Mycobacterium tuberculosis
DDERPAGGHIQMR

SEQ ID NO: 95510 - protein, 13 aa, Mycobacterium tuberculosis
DERPAGGHIQMRS

SEQ ID NO: 95511 - protein, 13 aa, Mycobacterium tuberculosis
ERPAGGHIQMRSN

SEQ ID NO: 95512 - protein, 13 aa, Mycobacterium tuberculosis
RPAGGHIQMRSNT

SEQ ID NO: 95513 - protein, 13 aa, Mycobacterium tuberculosis
PAGGHIQMRSNTR

SEQ ID NO: 95514 - protein, 13 aa, Mycobacterium tuberculosis
AGGHIQMRSNTRF

SEQ ID NO: 95515 - protein, 13 aa, Mycobacterium tuberculosis
GGHIQMRSNTRFT

SEQ ID NO: 95516 - protein, 13 aa, Mycobacterium tuberculosis
GHIQMRSNTRFTE

SEQ ID NO: 95517 - protein, 13 aa, Mycobacterium tuberculosis
HIQMRSNTRFTET

SEQ ID NO: 95518 - protein, 13 aa, Mycobacterium tuberculosis
IQMRSNTRFTETQ

SEQ ID NO: 95519 - protein, 13 aa, Mycobacterium tuberculosis
QMRSNTRFTETQW

SEQ ID NO: 95520 - protein, 13 aa, Mycobacterium tuberculosis
MRSNTRFTETQWG

SEQ ID NO: 95521 - protein, 13 aa, Mycobacterium tuberculosis
RSNTRFTETQWGR

SEQ ID NO: 95522 - protein, 13 aa, Mycobacterium tuberculosis
SNTRFTETQWGRH

SEQ ID NO: 95523 - protein, 13 aa, Mycobacterium tuberculosis
NTRFTETQWGRHI

SEQ ID NO: 95524 - protein, 13 aa, Mycobacterium tuberculosis
TRFTETQWGRHIE

SEQ ID NO: 95525 - protein, 13 aa, Mycobacterium tuberculosis
RFTETQWGRHIEW

SEQ ID NO: 95526 - protein, 13 aa, Mycobacterium tuberculosis
FTETQWGRHIEWK

SEQ ID NO: 95527 - protein, 13 aa, Mycobacterium tuberculosis
TETQWGRHIEWKL

SEQ ID NO: 95528 - protein, 13 aa, Mycobacterium tuberculosis
ETQWGRHIEWKLE

SEQ ID NO: 95529 - protein, 13 aa, Mycobacterium tuberculosis
TQWGRHIEWKLEC

SEQ ID NO: 95530 - protein, 13 aa, Mycobacterium tuberculosis
QWGRHIEWKLECR

SEQ ID NO: 95531 - protein, 13 aa, Mycobacterium tuberculosis
WGRHIEWKLECRA

SEQ ID NO: 95532 - protein, 13 aa, Mycobacterium tuberculosis
GRHIEWKLECRAC

SEQ ID NO: 95533 - protein, 13 aa, Mycobacterium tuberculosis
RHIEWKLECRACR

SEQ ID NO: 95534 - protein, 13 aa, Mycobacterium tuberculosis
HIEWKLECRACRK

SEQ ID NO: 95535 - protein, 13 aa, Mycobacterium tuberculosis
IEWKLECRACRKY

SEQ ID NO: 95536 - protein, 13 aa, Mycobacterium tuberculosis
EWKLECRACRKYA

SEQ ID NO: 95537 - protein, 13 aa, Mycobacterium tuberculosis
WKLECRACRKYAP

SEQ ID NO: 95538 - protein, 13 aa, Mycobacterium tuberculosis
KLECRACRKYAPI

SEQ ID NO: 95539 - protein, 13 aa, Mycobacterium tuberculosis
LECRACRKYAPIS

SEQ ID NO: 95540 - protein, 13 aa, Mycobacterium tuberculosis
ECRACRKYAPISE

SEQ ID NO: 95541 - protein, 13 aa, Mycobacterium tuberculosis
CRACRKYAPISEM

SEQ ID NO: 95542 - protein, 13 aa, Mycobacterium tuberculosis
RACRKYAPISEMT

SEQ ID NO: 95543 - protein, 13 aa, Mycobacterium tuberculosis
ACRKYAPISEMTA

SEQ ID NO: 95544 - protein, 13 aa, Mycobacterium tuberculosis
CRKYAPISEMTAA

SEQ ID NO: 95545 - protein, 13 aa, Mycobacterium tuberculosis
RKYAPISEMTAAA

SEQ ID NO: 95546 - protein, 13 aa, Mycobacterium tuberculosis
KYAPISEMTAAAI

SEQ ID NO: 95547 - protein, 13 aa, Mycobacterium tuberculosis
YAPISEMTAAAIL

SEQ ID NO: 95548 - protein, 13 aa, Mycobacterium tuberculosis
APISEMTAAAILD

SEQ ID NO: 95549 - protein, 13 aa, Mycobacterium tuberculosis
PISEMTAAAILDG

SEQ ID NO: 95550 - protein, 13 aa, Mycobacterium tuberculosis
ISEMTAAAILDGF

SEQ ID NO: 95551 - protein, 13 aa, Mycobacterium tuberculosis
SEMTAAAILDGFG

SEQ ID NO: 95552 - protein, 13 aa, Mycobacterium tuberculosis
EMTAAAILDGFGA

SEQ ID NO: 95553 - protein, 13 aa, Mycobacterium tuberculosis
MTAAAILDGFGAK

SEQ ID NO: 95554 - protein, 13 aa, Mycobacterium tuberculosis
TAAAILDGFGAKL

SEQ ID NO: 95555 - protein, 13 aa, Mycobacterium tuberculosis
AAAILDGFGAKLH

SEQ ID NO: 95556 - protein, 13 aa, Mycobacterium tuberculosis
AAILDGFGAKLHE

SEQ ID NO: 95557 - protein, 13 aa, Mycobacterium tuberculosis
AILDGFGAKLHEL

SEQ ID NO: 95558 - protein, 13 aa, Mycobacterium tuberculosis
ILDGFGAKLHELR

SEQ ID NO: 95559 - protein, 13 aa, Mycobacterium tuberculosis
LDGFGAKLHELRT

SEQ ID NO: 95560 - protein, 13 aa, Mycobacterium tuberculosis
DGFGAKLHELRTS

SEQ ID NO: 95561 - protein, 13 aa, Mycobacterium tuberculosis
GFGAKLHELRTST

SEQ ID NO: 95562 - protein, 13 aa, Mycobacterium tuberculosis
FGAKLHELRTSTI

SEQ ID NO: 95563 - protein, 13 aa, Mycobacterium tuberculosis
GAKLHELRTSTIP

SEQ ID NO: 95564 - protein, 13 aa, Mycobacterium tuberculosis
AKLHELRTSTIPD

SEQ ID NO: 95565 - protein, 13 aa, Mycobacterium tuberculosis
KLHELRTSTIPDA

SEQ ID NO: 95566 - protein, 13 aa, Mycobacterium tuberculosis
LHELRTSTIPDAD

SEQ ID NO: 95567 - protein, 13 aa, Mycobacterium tuberculosis
HELRTSTIPDADD

SEQ ID NO: 95568 - protein, 13 aa, Mycobacterium tuberculosis
ELRTSTIPDADDP

SEQ ID NO: 95569 - protein, 13 aa, Mycobacterium tuberculosis
LRTSTIPDADDPS

SEQ ID NO: 95570 - protein, 13 aa, Mycobacterium tuberculosis
RTSTIPDADDPSI

SEQ ID NO: 95571 - protein, 13 aa, Mycobacterium tuberculosis
TSTIPDADDPSIA

SEQ ID NO: 95572 - protein, 13 aa, Mycobacterium tuberculosis
STIPDADDPSIAE

SEQ ID NO: 95573 - protein, 13 aa, Mycobacterium tuberculosis
TIPDADDPSIAEA

SEQ ID NO: 95574 - protein, 13 aa, Mycobacterium tuberculosis
IPDADDPSIAEAR

SEQ ID NO: 95575 - protein, 13 aa, Mycobacterium tuberculosis
PDADDPSIAEARH

SEQ ID NO: 95576 - protein, 13 aa, Mycobacterium tuberculosis
DADDPSIAEARHV

SEQ ID NO: 95577 - protein, 13 aa, Mycobacterium tuberculosis
ADDPSIAEARHVI

SEQ ID NO: 95578 - protein, 13 aa, Mycobacterium tuberculosis
DDPSIAEARHVIP

SEQ ID NO: 95579 - protein, 13 aa, Mycobacterium tuberculosis
DPSIAEARHVIPF

SEQ ID NO: 95580 - protein, 13 aa, Mycobacterium tuberculosis
PSIAEARHVIPFS

SEQ ID NO: 95581 - protein, 13 aa, Mycobacterium tuberculosis
SIAEARHVIPFSA

SEQ ID NO: 95582 - protein, 13 aa, Mycobacterium tuberculosis
IAEARHVIPFSAL

SEQ ID NO: 95583 - protein, 13 aa, Mycobacterium tuberculosis
AEARHVIPFSALC

SEQ ID NO: 95584 - protein, 13 aa, Mycobacterium tuberculosis
EARHVIPFSALCL

SEQ ID NO: 95585 - protein, 13 aa, Mycobacterium tuberculosis
ARHVIPFSALCLR

SEQ ID NO: 95586 - protein, 13 aa, Mycobacterium tuberculosis
RHVIPFSALCLRL

SEQ ID NO: 95587 - protein, 13 aa, Mycobacterium tuberculosis
HVIPFSALCLRLS

SEQ ID NO: 95588 - protein, 13 aa, Mycobacterium tuberculosis
VIPFSALCLRLSQ

SEQ ID NO: 95589 - protein, 13 aa, Mycobacterium tuberculosis
IPFSALCLRLSQL

SEQ ID NO: 95590 - protein, 13 aa, Mycobacterium tuberculosis
PFSALCLRLSQLG

SEQ ID NO: 95591 - protein, 13 aa, Mycobacterium tuberculosis
FSALCLRLSQLGG

SEQ ID NO: 95592 - protein, 14 aa, Mycobacterium tuberculosis
MADAVKYVVMCNCD

SEQ ID NO: 95593 - protein, 14 aa, Mycobacterium tuberculosis
ADAVKYVVMCNCDD

SEQ ID NO: 95594 - protein, 14 aa, Mycobacterium tuberculosis
DAVKYVVMCNCDDE

SEQ ID NO: 95595 - protein, 14 aa, Mycobacterium tuberculosis
AVKYVVMCNCDDEP

SEQ ID NO: 95596 - protein, 14 aa, Mycobacterium tuberculosis
VKYVVMCNCDDEPG

SEQ ID NO: 95597 - protein, 14 aa, Mycobacterium tuberculosis
KYVVMCNCDDEPGA

SEQ ID NO: 95598 - protein, 14 aa, Mycobacterium tuberculosis
YVVMCNCDDEPGAL

SEQ ID NO: 95599 - protein, 14 aa, Mycobacterium tuberculosis
VVMCNCDDEPGALI

SEQ ID NO: 95600 - protein, 14 aa, Mycobacterium tuberculosis
VMCNCDDEPGALII

SEQ ID NO: 95601 - protein, 14 aa, Mycobacterium tuberculosis
MCNCDDEPGALIIA

SEQ ID NO: 95602 - protein, 14 aa, Mycobacterium tuberculosis
CNCDDEPGALIIAW

SEQ ID NO: 95603 - protein, 14 aa, Mycobacterium tuberculosis
NCDDEPGALIIAWI

SEQ ID NO: 95604 - protein, 14 aa, Mycobacterium tuberculosis
CDDEPGALIIAWID

SEQ ID NO: 95605 - protein, 14 aa, Mycobacterium tuberculosis
DDEPGALIIAWIDD

SEQ ID NO: 95606 - protein, 14 aa, Mycobacterium tuberculosis
DEPGALIIAWIDDE

SEQ ID NO: 95607 - protein, 14 aa, Mycobacterium tuberculosis
EPGALIIAWIDDER

SEQ ID NO: 95608 - protein, 14 aa, Mycobacterium tuberculosis
PGALIIAWIDDERP

SEQ ID NO: 95609 - protein, 14 aa, Mycobacterium tuberculosis
GALIIAWIDDERPA

SEQ ID NO: 95610 - protein, 14 aa, Mycobacterium tuberculosis
ALIIAWIDDERPAG

SEQ ID NO: 95611 - protein, 14 aa, Mycobacterium tuberculosis
LIIAWIDDERPAGG

SEQ ID NO: 95612 - protein, 14 aa, Mycobacterium tuberculosis
IIAWIDDERPAGGH

SEQ ID NO: 95613 - protein, 14 aa, Mycobacterium tuberculosis
IAWIDDERPAGGHI

SEQ ID NO: 95614 - protein, 14 aa, Mycobacterium tuberculosis
AWIDDERPAGGHIQ

SEQ ID NO: 95615 - protein, 14 aa, Mycobacterium tuberculosis
WIDDERPAGGHIQM

SEQ ID NO: 95616 - protein, 14 aa, Mycobacterium tuberculosis
IDDERPAGGHIQMR

SEQ ID NO: 95617 - protein, 14 aa, Mycobacterium tuberculosis
DDERPAGGHIQMRS

SEQ ID NO: 95618 - protein, 14 aa, Mycobacterium tuberculosis
DERPAGGHIQMRSN

SEQ ID NO: 95619 - protein, 14 aa, Mycobacterium tuberculosis
ERPAGGHIQMRSNT

SEQ ID NO: 95620 - protein, 14 aa, Mycobacterium tuberculosis
RPAGGHIQMRSNTR

SEQ ID NO: 95621 - protein, 14 aa, Mycobacterium tuberculosis
PAGGHIQMRSNTRF

SEQ ID NO: 95622 - protein, 14 aa, Mycobacterium tuberculosis
AGGHIQMRSNTRFT

SEQ ID NO: 95623 - protein, 14 aa, Mycobacterium tuberculosis
GGHIQMRSNTRFTE

SEQ ID NO: 95624 - protein, 14 aa, Mycobacterium tuberculosis
GHIQMRSNTRFTET

SEQ ID NO: 95625 - protein, 14 aa, Mycobacterium tuberculosis
HIQMRSNTRFTETQ

SEQ ID NO: 95626 - protein, 14 aa, Mycobacterium tuberculosis
IQMRSNTRFTETQW

SEQ ID NO: 95627 - protein, 14 aa, Mycobacterium tuberculosis
QMRSNTRFTETQWG

SEQ ID NO: 95628 - protein, 14 aa, Mycobacterium tuberculosis
MRSNTRFTETQWGR

SEQ ID NO: 95629 - protein, 14 aa, Mycobacterium tuberculosis
RSNTRFTETQWGRH

SEQ ID NO: 95630 - protein, 14 aa, Mycobacterium tuberculosis
SNTRFTETQWGRHI

SEQ ID NO: 95631 - protein, 14 aa, Mycobacterium tuberculosis
NTRFTETQWGRHIE

SEQ ID NO: 95632 - protein, 14 aa, Mycobacterium tuberculosis
TRFTETQWGRHIEW

SEQ ID NO: 95633 - protein, 14 aa, Mycobacterium tuberculosis
RFTETQWGRHIEWK

SEQ ID NO: 95634 - protein, 14 aa, Mycobacterium tuberculosis
FTETQWGRHIEWKL

SEQ ID NO: 95635 - protein, 14 aa, Mycobacterium tuberculosis
TETQWGRHIEWKLE

SEQ ID NO: 95636 - protein, 14 aa, Mycobacterium tuberculosis
ETQWGRHIEWKLEC

SEQ ID NO: 95637 - protein, 14 aa, Mycobacterium tuberculosis
TQWGRHIEWKLECR

SEQ ID NO: 95638 - protein, 14 aa, Mycobacterium tuberculosis
QWGRHIEWKLECRA

SEQ ID NO: 95639 - protein, 14 aa, Mycobacterium tuberculosis
WGRHIEWKLECRAC

SEQ ID NO: 95640 - protein, 14 aa, Mycobacterium tuberculosis
GRHIEWKLECRACR

SEQ ID NO: 95641 - protein, 14 aa, Mycobacterium tuberculosis
RHIEWKLECRACRK

SEQ ID NO: 95642 - protein, 14 aa, Mycobacterium tuberculosis
HIEWKLECRACRKY

SEQ ID NO: 95643 - protein, 14 aa, Mycobacterium tuberculosis
IEWKLECRACRKYA

SEQ ID NO: 95644 - protein, 14 aa, Mycobacterium tuberculosis
EWKLECRACRKYAP

SEQ ID NO: 95645 - protein, 14 aa, Mycobacterium tuberculosis
WKLECRACRKYAPI

SEQ ID NO: 95646 - protein, 14 aa, Mycobacterium tuberculosis
KLECRACRKYAPIS

SEQ ID NO: 95647 - protein, 14 aa, Mycobacterium tuberculosis
LECRACRKYAPISE

SEQ ID NO: 95648 - protein, 14 aa, Mycobacterium tuberculosis
ECRACRKYAPISEM

SEQ ID NO: 95649 - protein, 14 aa, Mycobacterium tuberculosis
CRACRKYAPISEMT

SEQ ID NO: 95650 - protein, 14 aa, Mycobacterium tuberculosis
RACRKYAPISEMTA

SEQ ID NO: 95651 - protein, 14 aa, Mycobacterium tuberculosis
ACRKYAPISEMTAA

SEQ ID NO: 95652 - protein, 14 aa, Mycobacterium tuberculosis
CRKYAPISEMTAAA

SEQ ID NO: 95653 - protein, 14 aa, Mycobacterium tuberculosis
RKYAPISEMTAAAI

SEQ ID NO: 95654 - protein, 14 aa, Mycobacterium tuberculosis
KYAPISEMTAAAIL

SEQ ID NO: 95655 - protein, 14 aa, Mycobacterium tuberculosis
YAPISEMTAAAILD

SEQ ID NO: 95656 - protein, 14 aa, Mycobacterium tuberculosis
APISEMTAAAILDG

SEQ ID NO: 95657 - protein, 14 aa, Mycobacterium tuberculosis
PISEMTAAAILDGF

SEQ ID NO: 95658 - protein, 14 aa, Mycobacterium tuberculosis
ISEMTAAAILDGFG

SEQ ID NO: 95659 - protein, 14 aa, Mycobacterium tuberculosis
SEMTAAAILDGFGA

SEQ ID NO: 95660 - protein, 14 aa, Mycobacterium tuberculosis
EMTAAAILDGFGAK

SEQ ID NO: 95661 - protein, 14 aa, Mycobacterium tuberculosis
MTAAAILDGFGAKL

SEQ ID NO: 95662 - protein, 14 aa, Mycobacterium tuberculosis
TAAAILDGFGAKLH

SEQ ID NO: 95663 - protein, 14 aa, Mycobacterium tuberculosis
AAAILDGFGAKLHE

SEQ ID NO: 95664 - protein, 14 aa, Mycobacterium tuberculosis
AAILDGFGAKLHEL

SEQ ID NO: 95665 - protein, 14 aa, Mycobacterium tuberculosis
AILDGFGAKLHELR

SEQ ID NO: 95666 - protein, 14 aa, Mycobacterium tuberculosis
ILDGFGAKLHELRT

SEQ ID NO: 95667 - protein, 14 aa, Mycobacterium tuberculosis
LDGFGAKLHELRTS

SEQ ID NO: 95668 - protein, 14 aa, Mycobacterium tuberculosis
DGFGAKLHELRTST

SEQ ID NO: 95669 - protein, 14 aa, Mycobacterium tuberculosis
GFGAKLHELRTSTI

SEQ ID NO: 95670 - protein, 14 aa, Mycobacterium tuberculosis
FGAKLHELRTSTIP

SEQ ID NO: 95671 - protein, 14 aa, Mycobacterium tuberculosis
GAKLHELRTSTIPD

SEQ ID NO: 95672 - protein, 14 aa, Mycobacterium tuberculosis
AKLHELRTSTIPDA

SEQ ID NO: 95673 - protein, 14 aa, Mycobacterium tuberculosis
KLHELRTSTIPDAD

SEQ ID NO: 95674 - protein, 14 aa, Mycobacterium tuberculosis
LHELRTSTIPDADD

SEQ ID NO: 95675 - protein, 14 aa, Mycobacterium tuberculosis
HELRTSTIPDADDP

SEQ ID NO: 95676 - protein, 14 aa, Mycobacterium tuberculosis
ELRTSTIPDADDPS

SEQ ID NO: 95677 - protein, 14 aa, Mycobacterium tuberculosis
LRTSTIPDADDPSI

SEQ ID NO: 95678 - protein, 14 aa, Mycobacterium tuberculosis
RTSTIPDADDPSIA

SEQ ID NO: 95679 - protein, 14 aa, Mycobacterium tuberculosis
TSTIPDADDPSIAE

SEQ ID NO: 95680 - protein, 14 aa, Mycobacterium tuberculosis
STIPDADDPSIAEA

SEQ ID NO: 95681 - protein, 14 aa, Mycobacterium tuberculosis
TIPDADDPSIAEAR

SEQ ID NO: 95682 - protein, 14 aa, Mycobacterium tuberculosis
IPDADDPSIAEARH

SEQ ID NO: 95683 - protein, 14 aa, Mycobacterium tuberculosis
PDADDPSIAEARHV

SEQ ID NO: 95684 - protein, 14 aa, Mycobacterium tuberculosis
DADDPSIAEARHVI

SEQ ID NO: 95685 - protein, 14 aa, Mycobacterium tuberculosis
ADDPSIAEARHVIP

SEQ ID NO: 95686 - protein, 14 aa, Mycobacterium tuberculosis
DDPSIAEARHVIPF

SEQ ID NO: 95687 - protein, 14 aa, Mycobacterium tuberculosis
DPSIAEARHVIPFS

SEQ ID NO: 95688 - protein, 14 aa, Mycobacterium tuberculosis
PSIAEARHVIPFSA

SEQ ID NO: 95689 - protein, 14 aa, Mycobacterium tuberculosis
SIAEARHVIPFSAL

SEQ ID NO: 95690 - protein, 14 aa, Mycobacterium tuberculosis
IAEARHVIPFSALC

SEQ ID NO: 95691 - protein, 14 aa, Mycobacterium tuberculosis
AEARHVIPFSALCL

SEQ ID NO: 95692 - protein, 14 aa, Mycobacterium tuberculosis
EARHVIPFSALCLR

SEQ ID NO: 95693 - protein, 14 aa, Mycobacterium tuberculosis
ARHVIPFSALCLRL

SEQ ID NO: 95694 - protein, 14 aa, Mycobacterium tuberculosis
RHVIPFSALCLRLS

SEQ ID NO: 95695 - protein, 14 aa, Mycobacterium tuberculosis
HVIPFSALCLRLSQ

SEQ ID NO: 95696 - protein, 14 aa, Mycobacterium tuberculosis
VIPFSALCLRLSQL

SEQ ID NO: 95697 - protein, 14 aa, Mycobacterium tuberculosis
IPFSALCLRLSQLG

SEQ ID NO: 95698 - protein, 14 aa, Mycobacterium tuberculosis
PFSALCLRLSQLGG

SEQ ID NO: 95699 - protein, 15 aa, Mycobacterium tuberculosis
MADAVKYVVMCNCDD

SEQ ID NO: 95700 - protein, 15 aa, Mycobacterium tuberculosis
ADAVKYVVMCNCDDE

SEQ ID NO: 95701 - protein, 15 aa, Mycobacterium tuberculosis
DAVKYVVMCNCDDEP

SEQ ID NO: 95702 - protein, 15 aa, Mycobacterium tuberculosis
AVKYVVMCNCDDEPG

SEQ ID NO: 95703 - protein, 15 aa, Mycobacterium tuberculosis
VKYVVMCNCDDEPGA

SEQ ID NO: 95704 - protein, 15 aa, Mycobacterium tuberculosis
KYVVMCNCDDEPGAL

SEQ ID NO: 95705 - protein, 15 aa, Mycobacterium tuberculosis
YVVMCNCDDEPGALI

SEQ ID NO: 95706 - protein, 15 aa, Mycobacterium tuberculosis
VVMCNCDDEPGALII

SEQ ID NO: 95707 - protein, 15 aa, Mycobacterium tuberculosis
VMCNCDDEPGALIIA

SEQ ID NO: 95708 - protein, 15 aa, Mycobacterium tuberculosis
MCNCDDEPGALIIAW

SEQ ID NO: 95709 - protein, 15 aa, Mycobacterium tuberculosis
CNCDDEPGALIIAWI

SEQ ID NO: 95710 - protein, 15 aa, Mycobacterium tuberculosis
NCDDEPGALIIAWID

SEQ ID NO: 95711 - protein, 15 aa, Mycobacterium tuberculosis
CDDEPGALIIAWIDD

SEQ ID NO: 95712 - protein, 15 aa, Mycobacterium tuberculosis
DDEPGALIIAWIDDE

SEQ ID NO: 95713 - protein, 15 aa, Mycobacterium tuberculosis
DEPGALIIAWIDDER

SEQ ID NO: 95714 - protein, 15 aa, Mycobacterium tuberculosis
EPGALIIAWIDDERP

SEQ ID NO: 95715 - protein, 15 aa, Mycobacterium tuberculosis
PGALIIAWIDDERPA

SEQ ID NO: 95716 - protein, 15 aa, Mycobacterium tuberculosis
GALIIAWIDDERPAG

SEQ ID NO: 95717 - protein, 15 aa, Mycobacterium tuberculosis
ALIIAWIDDERPAGG

SEQ ID NO: 95718 - protein, 15 aa, Mycobacterium tuberculosis
LIIAWIDDERPAGGH

SEQ ID NO: 95719 - protein, 15 aa, Mycobacterium tuberculosis
IIAWIDDERPAGGHI

SEQ ID NO: 95720 - protein, 15 aa, Mycobacterium tuberculosis
IAWIDDERPAGGHIQ

SEQ ID NO: 95721 - protein, 15 aa, Mycobacterium tuberculosis
AWIDDERPAGGHIQM

SEQ ID NO: 95722 - protein, 15 aa, Mycobacterium tuberculosis
WIDDERPAGGHIQMR

SEQ ID NO: 95723 - protein, 15 aa, Mycobacterium tuberculosis
IDDERPAGGHIQMRS

SEQ ID NO: 95724 - protein, 15 aa, Mycobacterium tuberculosis
DDERPAGGHIQMRSN

SEQ ID NO: 95725 - protein, 15 aa, Mycobacterium tuberculosis
DERPAGGHIQMRSNT

SEQ ID NO: 95726 - protein, 15 aa, Mycobacterium tuberculosis
ERPAGGHIQMRSNTR

SEQ ID NO: 95727 - protein, 15 aa, Mycobacterium tuberculosis
RPAGGHIQMRSNTRF

SEQ ID NO: 95728 - protein, 15 aa, Mycobacterium tuberculosis
PAGGHIQMRSNTRFT

SEQ ID NO: 95729 - protein, 15 aa, Mycobacterium tuberculosis
AGGHIQMRSNTRFTE

SEQ ID NO: 95730 - protein, 15 aa, Mycobacterium tuberculosis
GGHIQMRSNTRFTET

SEQ ID NO: 95731 - protein, 15 aa, Mycobacterium tuberculosis
GHIQMRSNTRFTETQ

SEQ ID NO: 95732 - protein, 15 aa, Mycobacterium tuberculosis
HIQMRSNTRFTETQW

SEQ ID NO: 95733 - protein, 15 aa, Mycobacterium tuberculosis
IQMRSNTRFTETQWG

SEQ ID NO: 95734 - protein, 15 aa, Mycobacterium tuberculosis
QMRSNTRFTETQWGR

SEQ ID NO: 95735 - protein, 15 aa, Mycobacterium tuberculosis
MRSNTRFTETQWGRH

SEQ ID NO: 95736 - protein, 15 aa, Mycobacterium tuberculosis
RSNTRFTETQWGRHI

SEQ ID NO: 95737 - protein, 15 aa, Mycobacterium tuberculosis
SNTRFTETQWGRHIE

SEQ ID NO: 95738 - protein, 15 aa, Mycobacterium tuberculosis
NTRFTETQWGRHIEW

SEQ ID NO: 95739 - protein, 15 aa, Mycobacterium tuberculosis
TRFTETQWGRHIEWK

SEQ ID NO: 95740 - protein, 15 aa, Mycobacterium tuberculosis
RFTETQWGRHIEWKL

SEQ ID NO: 95741 - protein, 15 aa, Mycobacterium tuberculosis
FTETQWGRHIEWKLE

SEQ ID NO: 95742 - protein, 15 aa, Mycobacterium tuberculosis
TETQWGRHIEWKLEC

SEQ ID NO: 95743 - protein, 15 aa, Mycobacterium tuberculosis
ETQWGRHIEWKLECR

SEQ ID NO: 95744 - protein, 15 aa, Mycobacterium tuberculosis
TQWGRHIEWKLECRA

SEQ ID NO: 95745 - protein, 15 aa, Mycobacterium tuberculosis
QWGRHIEWKLECRAC

SEQ ID NO: 95746 - protein, 15 aa, Mycobacterium tuberculosis
WGRHIEWKLECRACR

SEQ ID NO: 95747 - protein, 15 aa, Mycobacterium tuberculosis
GRHIEWKLECRACRK

SEQ ID NO: 95748 - protein, 15 aa, Mycobacterium tuberculosis
RHIEWKLECRACRKY

SEQ ID NO: 95749 - protein, 15 aa, Mycobacterium tuberculosis
HIEWKLECRACRKYA

SEQ ID NO: 95750 - protein, 15 aa, Mycobacterium tuberculosis
IEWKLECRACRKYAP

SEQ ID NO: 95751 - protein, 15 aa, Mycobacterium tuberculosis
EWKLECRACRKYAPI

SEQ ID NO: 95752 - protein, 15 aa, Mycobacterium tuberculosis
WKLECRACRKYAPIS

SEQ ID NO: 95753 - protein, 15 aa, Mycobacterium tuberculosis
KLECRACRKYAPISE

SEQ ID NO: 95754 - protein, 15 aa, Mycobacterium tuberculosis
LECRACRKYAPISEM

SEQ ID NO: 95755 - protein, 15 aa, Mycobacterium tuberculosis
ECRACRKYAPISEMT

SEQ ID NO: 95756 - protein, 15 aa, Mycobacterium tuberculosis
CRACRKYAPISEMTA

SEQ ID NO: 95757 - protein, 15 aa, Mycobacterium tuberculosis
RACRKYAPISEMTAA

SEQ ID NO: 95758 - protein, 15 aa, Mycobacterium tuberculosis
ACRKYAPISEMTAAA

SEQ ID NO: 95759 - protein, 15 aa, Mycobacterium tuberculosis
CRKYAPISEMTAAAI

SEQ ID NO: 95760 - protein, 15 aa, Mycobacterium tuberculosis
RKYAPISEMTAAAIL

SEQ ID NO: 95761 - protein, 15 aa, Mycobacterium tuberculosis
KYAPISEMTAAAILD

SEQ ID NO: 95762 - protein, 15 aa, Mycobacterium tuberculosis
YAPISEMTAAAILDG

SEQ ID NO: 95763 - protein, 15 aa, Mycobacterium tuberculosis
APISEMTAAAILDGF

SEQ ID NO: 95764 - protein, 15 aa, Mycobacterium tuberculosis
PISEMTAAAILDGFG

SEQ ID NO: 95765 - protein, 15 aa, Mycobacterium tuberculosis
ISEMTAAAILDGFGA

SEQ ID NO: 95766 - protein, 15 aa, Mycobacterium tuberculosis
SEMTAAAILDGFGAK

SEQ ID NO: 95767 - protein, 15 aa, Mycobacterium tuberculosis
EMTAAAILDGFGAKL

SEQ ID NO: 95768 - protein, 15 aa, Mycobacterium tuberculosis
MTAAAILDGFGAKLH

SEQ ID NO: 95769 - protein, 15 aa, Mycobacterium tuberculosis
TAAAILDGFGAKLHE

SEQ ID NO: 95770 - protein, 15 aa, Mycobacterium tuberculosis
AAAILDGFGAKLHEL

SEQ ID NO: 95771 - protein, 15 aa, Mycobacterium tuberculosis
AAILDGFGAKLHELR

SEQ ID NO: 95772 - protein, 15 aa, Mycobacterium tuberculosis
AILDGFGAKLHELRT

SEQ ID NO: 95773 - protein, 15 aa, Mycobacterium tuberculosis
ILDGFGAKLHELRTS

SEQ ID NO: 95774 - protein, 15 aa, Mycobacterium tuberculosis
LDGFGAKLHELRTST

SEQ ID NO: 95775 - protein, 15 aa, Mycobacterium tuberculosis
DGFGAKLHELRTSTI

SEQ ID NO: 95776 - protein, 15 aa, Mycobacterium tuberculosis
GFGAKLHELRTSTIP

SEQ ID NO: 95777 - protein, 15 aa, Mycobacterium tuberculosis
FGAKLHELRTSTIPD

SEQ ID NO: 95778 - protein, 15 aa, Mycobacterium tuberculosis
GAKLHELRTSTIPDA

SEQ ID NO: 95779 - protein, 15 aa, Mycobacterium tuberculosis
AKLHELRTSTIPDAD

SEQ ID NO: 95780 - protein, 15 aa, Mycobacterium tuberculosis
KLHELRTSTIPDADD

SEQ ID NO: 95781 - protein, 15 aa, Mycobacterium tuberculosis
LHELRTSTIPDADDP

SEQ ID NO: 95782 - protein, 15 aa, Mycobacterium tuberculosis
HELRTSTIPDADDPS

SEQ ID NO: 95783 - protein, 15 aa, Mycobacterium tuberculosis
ELRTSTIPDADDPSI

SEQ ID NO: 95784 - protein, 15 aa, Mycobacterium tuberculosis
LRTSTIPDADDPSIA

SEQ ID NO: 95785 - protein, 15 aa, Mycobacterium tuberculosis
RTSTIPDADDPSIAE

SEQ ID NO: 95786 - protein, 15 aa, Mycobacterium tuberculosis
TSTIPDADDPSIAEA

SEQ ID NO: 95787 - protein, 15 aa, Mycobacterium tuberculosis
STIPDADDPSIAEAR

SEQ ID NO: 95788 - protein, 15 aa, Mycobacterium tuberculosis
TIPDADDPSIAEARH

SEQ ID NO: 95789 - protein, 15 aa, Mycobacterium tuberculosis
IPDADDPSIAEARHV

SEQ ID NO: 95790 - protein, 15 aa, Mycobacterium tuberculosis
PDADDPSIAEARHVI

SEQ ID NO: 95791 - protein, 15 aa, Mycobacterium tuberculosis
DADDPSIAEARHVIP

SEQ ID NO: 95792 - protein, 15 aa, Mycobacterium tuberculosis
ADDPSIAEARHVIPF

SEQ ID NO: 95793 - protein, 15 aa, Mycobacterium tuberculosis
DDPSIAEARHVIPFS

SEQ ID NO: 95794 - protein, 15 aa, Mycobacterium tuberculosis
DPSIAEARHVIPFSA

SEQ ID NO: 95795 - protein, 15 aa, Mycobacterium tuberculosis
PSIAEARHVIPFSAL

SEQ ID NO: 95796 - protein, 15 aa, Mycobacterium tuberculosis
SIAEARHVIPFSALC

SEQ ID NO: 95797 - protein, 15 aa, Mycobacterium tuberculosis
IAEARHVIPFSALCL

SEQ ID NO: 95798 - protein, 15 aa, Mycobacterium tuberculosis
AEARHVIPFSALCLR

SEQ ID NO: 95799 - protein, 15 aa, Mycobacterium tuberculosis
EARHVIPFSALCLRL

SEQ ID NO: 95800 - protein, 15 aa, Mycobacterium tuberculosis
ARHVIPFSALCLRLS

SEQ ID NO: 95801 - protein, 15 aa, Mycobacterium tuberculosis
RHVIPFSALCLRLSQ

SEQ ID NO: 95802 - protein, 15 aa, Mycobacterium tuberculosis
HVIPFSALCLRLSQL

SEQ ID NO: 95803 - protein, 15 aa, Mycobacterium tuberculosis
VIPFSALCLRLSQLG

SEQ ID NO: 95804 - protein, 15 aa, Mycobacterium tuberculosis
IPFSALCLRLSQLGG

SEQ ID NO: 95805 - protein, 16 aa, Mycobacterium tuberculosis
MADAVKYVVMCNCDDE

SEQ ID NO: 95806 - protein, 16 aa, Mycobacterium tuberculosis
ADAVKYVVMCNCDDEP

SEQ ID NO: 95807 - protein, 16 aa, Mycobacterium tuberculosis
DAVKYVVMCNCDDEPG

SEQ ID NO: 95808 - protein, 16 aa, Mycobacterium tuberculosis
AVKYVVMCNCDDEPGA

SEQ ID NO: 95809 - protein, 16 aa, Mycobacterium tuberculosis
VKYVVMCNCDDEPGAL

SEQ ID NO: 95810 - protein, 16 aa, Mycobacterium tuberculosis
KYVVMCNCDDEPGALI

SEQ ID NO: 95811 - protein, 16 aa, Mycobacterium tuberculosis
YVVMCNCDDEPGALII

SEQ ID NO: 95812 - protein, 16 aa, Mycobacterium tuberculosis
VVMCNCDDEPGALIIA

SEQ ID NO: 95813 - protein, 16 aa, Mycobacterium tuberculosis
VMCNCDDEPGALIIAW

SEQ ID NO: 95814 - protein, 16 aa, Mycobacterium tuberculosis
MCNCDDEPGALIIAWI

SEQ ID NO: 95815 - protein, 16 aa, Mycobacterium tuberculosis
CNCDDEPGALIIAWID

SEQ ID NO: 95816 - protein, 16 aa, Mycobacterium tuberculosis
NCDDEPGALIIAWIDD

SEQ ID NO: 95817 - protein, 16 aa, Mycobacterium tuberculosis
CDDEPGALIIAWIDDE

SEQ ID NO: 95818 - protein, 16 aa, Mycobacterium tuberculosis
DDEPGALIIAWIDDER

SEQ ID NO: 95819 - protein, 16 aa, Mycobacterium tuberculosis
DEPGALIIAWIDDERP

SEQ ID NO: 95820 - protein, 16 aa, Mycobacterium tuberculosis
EPGALIIAWIDDERPA

SEQ ID NO: 95821 - protein, 16 aa, Mycobacterium tuberculosis
PGALIIAWIDDERPAG

SEQ ID NO: 95822 - protein, 16 aa, Mycobacterium tuberculosis
GALIIAWIDDERPAGG

SEQ ID NO: 95823 - protein, 16 aa, Mycobacterium tuberculosis
ALIIAWIDDERPAGGH

SEQ ID NO: 95824 - protein, 16 aa, Mycobacterium tuberculosis
LIIAWIDDERPAGGHI

SEQ ID NO: 95825 - protein, 16 aa, Mycobacterium tuberculosis
IIAWIDDERPAGGHIQ

SEQ ID NO: 95826 - protein, 16 aa, Mycobacterium tuberculosis
IAWIDDERPAGGHIQM

SEQ ID NO: 95827 - protein, 16 aa, Mycobacterium tuberculosis
AWIDDERPAGGHIQMR

SEQ ID NO: 95828 - protein, 16 aa, Mycobacterium tuberculosis
WIDDERPAGGHIQMRS

SEQ ID NO: 95829 - protein, 16 aa, Mycobacterium tuberculosis
IDDERPAGGHIQMRSN

SEQ ID NO: 95830 - protein, 16 aa, Mycobacterium tuberculosis
DDERPAGGHIQMRSNT

SEQ ID NO: 95831 - protein, 16 aa, Mycobacterium tuberculosis
DERPAGGHIQMRSNTR

SEQ ID NO: 95832 - protein, 16 aa, Mycobacterium tuberculosis
ERPAGGHIQMRSNTRF

SEQ ID NO: 95833 - protein, 16 aa, Mycobacterium tuberculosis
RPAGGHIQMRSNTRFT

SEQ ID NO: 95834 - protein, 16 aa, Mycobacterium tuberculosis
PAGGHIQMRSNTRFTE

SEQ ID NO: 95835 - protein, 16 aa, Mycobacterium tuberculosis
AGGHIQMRSNTRFTET

SEQ ID NO: 95836 - protein, 16 aa, Mycobacterium tuberculosis
GGHIQMRSNTRFTETQ

SEQ ID NO: 95837 - protein, 16 aa, Mycobacterium tuberculosis
GHIQMRSNTRFTETQW

SEQ ID NO: 95838 - protein, 16 aa, Mycobacterium tuberculosis
HIQMRSNTRFTETQWG

SEQ ID NO: 95839 - protein, 16 aa, Mycobacterium tuberculosis
IQMRSNTRFTETQWGR

SEQ ID NO: 95840 - protein, 16 aa, Mycobacterium tuberculosis
QMRSNTRFTETQWGRH

SEQ ID NO: 95841 - protein, 16 aa, Mycobacterium tuberculosis
MRSNTRFTETQWGRHI

SEQ ID NO: 95842 - protein, 16 aa, Mycobacterium tuberculosis
RSNTRFTETQWGRHIE

SEQ ID NO: 95843 - protein, 16 aa, Mycobacterium tuberculosis
SNTRFTETQWGRHIEW

SEQ ID NO: 95844 - protein, 16 aa, Mycobacterium tuberculosis
NTRFTETQWGRHIEWK

SEQ ID NO: 95845 - protein, 16 aa, Mycobacterium tuberculosis
TRFTETQWGRHIEWKL

SEQ ID NO: 95846 - protein, 16 aa, Mycobacterium tuberculosis
RFTETQWGRHIEWKLE

SEQ ID NO: 95847 - protein, 16 aa, Mycobacterium tuberculosis
FTETQWGRHIEWKLEC

SEQ ID NO: 95848 - protein, 16 aa, Mycobacterium tuberculosis
TETQWGRHIEWKLECR

SEQ ID NO: 95849 - protein, 16 aa, Mycobacterium tuberculosis
ETQWGRHIEWKLECRA

SEQ ID NO: 95850 - protein, 16 aa, Mycobacterium tuberculosis
TQWGRHIEWKLECRAC

SEQ ID NO: 95851 - protein, 16 aa, Mycobacterium tuberculosis
QWGRHIEWKLECRACR

SEQ ID NO: 95852 - protein, 16 aa, Mycobacterium tuberculosis
WGRHIEWKLECRACRK

SEQ ID NO: 95853 - protein, 16 aa, Mycobacterium tuberculosis
GRHIEWKLECRACRKY

SEQ ID NO: 95854 - protein, 16 aa, Mycobacterium tuberculosis
RHIEWKLECRACRKYA

SEQ ID NO: 95855 - protein, 16 aa, Mycobacterium tuberculosis
HIEWKLECRACRKYAP

SEQ ID NO: 95856 - protein, 16 aa, Mycobacterium tuberculosis
IEWKLECRACRKYAPI

SEQ ID NO: 95857 - protein, 16 aa, Mycobacterium tuberculosis
EWKLECRACRKYAPIS

SEQ ID NO: 95858 - protein, 16 aa, Mycobacterium tuberculosis
WKLECRACRKYAPISE

SEQ ID NO: 95859 - protein, 16 aa, Mycobacterium tuberculosis
KLECRACRKYAPISEM

SEQ ID NO: 95860 - protein, 16 aa, Mycobacterium tuberculosis
LECRACRKYAPISEMT

SEQ ID NO: 95861 - protein, 16 aa, Mycobacterium tuberculosis
ECRACRKYAPISEMTA

SEQ ID NO: 95862 - protein, 16 aa, Mycobacterium tuberculosis
CRACRKYAPISEMTAA

SEQ ID NO: 95863 - protein, 16 aa, Mycobacterium tuberculosis
RACRKYAPISEMTAAA

SEQ ID NO: 95864 - protein, 16 aa, Mycobacterium tuberculosis
ACRKYAPISEMTAAAI

SEQ ID NO: 95865 - protein, 16 aa, Mycobacterium tuberculosis
CRKYAPISEMTAAAIL

SEQ ID NO: 95866 - protein, 16 aa, Mycobacterium tuberculosis
RKYAPISEMTAAAILD

SEQ ID NO: 95867 - protein, 16 aa, Mycobacterium tuberculosis
KYAPISEMTAAAILDG

SEQ ID NO: 95868 - protein, 16 aa, Mycobacterium tuberculosis
YAPISEMTAAAILDGF

SEQ ID NO: 95869 - protein, 16 aa, Mycobacterium tuberculosis
APISEMTAAAILDGFG

SEQ ID NO: 95870 - protein, 16 aa, Mycobacterium tuberculosis
PISEMTAAAILDGFGA

SEQ ID NO: 95871 - protein, 16 aa, Mycobacterium tuberculosis
ISEMTAAAILDGFGAK

SEQ ID NO: 95872 - protein, 16 aa, Mycobacterium tuberculosis
SEMTAAAILDGFGAKL

SEQ ID NO: 95873 - protein, 16 aa, Mycobacterium tuberculosis
EMTAAAILDGFGAKLH

SEQ ID NO: 95874 - protein, 16 aa, Mycobacterium tuberculosis
MTAAAILDGFGAKLHE

SEQ ID NO: 95875 - protein, 16 aa, Mycobacterium tuberculosis
TAAAILDGFGAKLHEL

SEQ ID NO: 95876 - protein, 16 aa, Mycobacterium tuberculosis
AAAILDGFGAKLHELR

SEQ ID NO: 95877 - protein, 16 aa, Mycobacterium tuberculosis
AAILDGFGAKLHELRT

SEQ ID NO: 95878 - protein, 16 aa, Mycobacterium tuberculosis
AILDGFGAKLHELRTS

SEQ ID NO: 95879 - protein, 16 aa, Mycobacterium tuberculosis
ILDGFGAKLHELRTST

SEQ ID NO: 95880 - protein, 16 aa, Mycobacterium tuberculosis
LDGFGAKLHELRTSTI

SEQ ID NO: 95881 - protein, 16 aa, Mycobacterium tuberculosis
DGFGAKLHELRTSTIP

SEQ ID NO: 95882 - protein, 16 aa, Mycobacterium tuberculosis
GFGAKLHELRTSTIPD

SEQ ID NO: 95883 - protein, 16 aa, Mycobacterium tuberculosis
FGAKLHELRTSTIPDA

SEQ ID NO: 95884 - protein, 16 aa, Mycobacterium tuberculosis
GAKLHELRTSTIPDAD

SEQ ID NO: 95885 - protein, 16 aa, Mycobacterium tuberculosis
AKLHELRTSTIPDADD

SEQ ID NO: 95886 - protein, 16 aa, Mycobacterium tuberculosis
KLHELRTSTIPDADDP

SEQ ID NO: 95887 - protein, 16 aa, Mycobacterium tuberculosis
LHELRTSTIPDADDPS

SEQ ID NO: 95888 - protein, 16 aa, Mycobacterium tuberculosis
HELRTSTIPDADDPSI

SEQ ID NO: 95889 - protein, 16 aa, Mycobacterium tuberculosis
ELRTSTIPDADDPSIA

SEQ ID NO: 95890 - protein, 16 aa, Mycobacterium tuberculosis
LRTSTIPDADDPSIAE

SEQ ID NO: 95891 - protein, 16 aa, Mycobacterium tuberculosis
RTSTIPDADDPSIAEA

SEQ ID NO: 95892 - protein, 16 aa, Mycobacterium tuberculosis
TSTIPDADDPSIAEAR

SEQ ID NO: 95893 - protein, 16 aa, Mycobacterium tuberculosis
STIPDADDPSIAEARH

SEQ ID NO: 95894 - protein, 16 aa, Mycobacterium tuberculosis
TIPDADDPSIAEARHV

SEQ ID NO: 95895 - protein, 16 aa, Mycobacterium tuberculosis
IPDADDPSIAEARHVI

SEQ ID NO: 95896 - protein, 16 aa, Mycobacterium tuberculosis
PDADDPSIAEARHVIP

SEQ ID NO: 95897 - protein, 16 aa, Mycobacterium tuberculosis
DADDPSIAEARHVIPF

SEQ ID NO: 95898 - protein, 16 aa, Mycobacterium tuberculosis
ADDPSIAEARHVIPFS

SEQ ID NO: 95899 - protein, 16 aa, Mycobacterium tuberculosis
DDPSIAEARHVIPFSA

SEQ ID NO: 95900 - protein, 16 aa, Mycobacterium tuberculosis
DPSIAEARHVIPFSAL

SEQ ID NO: 95901 - protein, 16 aa, Mycobacterium tuberculosis
PSIAEARHVIPFSALC

SEQ ID NO: 95902 - protein, 16 aa, Mycobacterium tuberculosis
SIAEARHVIPFSALCL

SEQ ID NO: 95903 - protein, 16 aa, Mycobacterium tuberculosis
IAEARHVIPFSALCLR

SEQ ID NO: 95904 - protein, 16 aa, Mycobacterium tuberculosis
AEARHVIPFSALCLRL

SEQ ID NO: 95905 - protein, 16 aa, Mycobacterium tuberculosis
EARHVIPFSALCLRLS

SEQ ID NO: 95906 - protein, 16 aa, Mycobacterium tuberculosis
ARHVIPFSALCLRLSQ

SEQ ID NO: 95907 - protein, 16 aa, Mycobacterium tuberculosis
RHVIPFSALCLRLSQL

SEQ ID NO: 95908 - protein, 16 aa, Mycobacterium tuberculosis
HVIPFSALCLRLSQLG

SEQ ID NO: 95909 - protein, 16 aa, Mycobacterium tuberculosis
VIPFSALCLRLSQLGG

SEQ ID NO: 95910 - protein, 13 aa, Mycobacterium tuberculosis
MTQTGKRQRRKFG

SEQ ID NO: 95911 - protein, 13 aa, Mycobacterium tuberculosis
TQTGKRQRRKFGR

SEQ ID NO: 95912 - protein, 13 aa, Mycobacterium tuberculosis
QTGKRQRRKFGRI

SEQ ID NO: 95913 - protein, 13 aa, Mycobacterium tuberculosis
TGKRQRRKFGRIR

SEQ ID NO: 95914 - protein, 13 aa, Mycobacterium tuberculosis
GKRQRRKFGRIRQ

SEQ ID NO: 95915 - protein, 13 aa, Mycobacterium tuberculosis
KRQRRKFGRIRQF

SEQ ID NO: 95916 - protein, 13 aa, Mycobacterium tuberculosis
RQRRKFGRIRQFN

SEQ ID NO: 95917 - protein, 13 aa, Mycobacterium tuberculosis
QRRKFGRIRQFNS

SEQ ID NO: 95918 - protein, 13 aa, Mycobacterium tuberculosis
RRKFGRIRQFNSG

SEQ ID NO: 95919 - protein, 13 aa, Mycobacterium tuberculosis
RKFGRIRQFNSGR

SEQ ID NO: 95920 - protein, 13 aa, Mycobacterium tuberculosis
KFGRIRQFNSGRW

SEQ ID NO: 95921 - protein, 13 aa, Mycobacterium tuberculosis
FGRIRQFNSGRWQ

SEQ ID NO: 95922 - protein, 13 aa, Mycobacterium tuberculosis
GRIRQFNSGRWQA

SEQ ID NO: 95923 - protein, 13 aa, Mycobacterium tuberculosis
RIRQFNSGRWQAS

SEQ ID NO: 95924 - protein, 13 aa, Mycobacterium tuberculosis
IRQFNSGRWQASY

SEQ ID NO: 95925 - protein, 13 aa, Mycobacterium tuberculosis
RQFNSGRWQASYT

SEQ ID NO: 95926 - protein, 13 aa, Mycobacterium tuberculosis
QFNSGRWQASYTG

SEQ ID NO: 95927 - protein, 13 aa, Mycobacterium tuberculosis
FNSGRWQASYTGP

SEQ ID NO: 95928 - protein, 13 aa, Mycobacterium tuberculosis
NSGRWQASYTGPD

SEQ ID NO: 95929 - protein, 13 aa, Mycobacterium tuberculosis
SGRWQASYTGPDG

SEQ ID NO: 95930 - protein, 13 aa, Mycobacterium tuberculosis
GRWQASYTGPDGR

SEQ ID NO: 95931 - protein, 13 aa, Mycobacterium tuberculosis
RWQASYTGPDGRV

SEQ ID NO: 95932 - protein, 13 aa, Mycobacterium tuberculosis
WQASYTGPDGRVY

SEQ ID NO: 95933 - protein, 13 aa, Mycobacterium tuberculosis
QASYTGPDGRVYI

SEQ ID NO: 95934 - protein, 13 aa, Mycobacterium tuberculosis
ASYTGPDGRVYIA

SEQ ID NO: 95935 - protein, 13 aa, Mycobacterium tuberculosis
SYTGPDGRVYIAP

SEQ ID NO: 95936 - protein, 13 aa, Mycobacterium tuberculosis
YTGPDGRVYIAPK

SEQ ID NO: 95937 - protein, 13 aa, Mycobacterium tuberculosis
TGPDGRVYIAPKT

SEQ ID NO: 95938 - protein, 13 aa, Mycobacterium tuberculosis
GPDGRVYIAPKTF

SEQ ID NO: 95939 - protein, 13 aa, Mycobacterium tuberculosis
PDGRVYIAPKTFN

SEQ ID NO: 95940 - protein, 13 aa, Mycobacterium tuberculosis
DGRVYIAPKTFNA

SEQ ID NO: 95941 - protein, 13 aa, Mycobacterium tuberculosis
GRVYIAPKTFNAK

SEQ ID NO: 95942 - protein, 13 aa, Mycobacterium tuberculosis
RVYIAPKTFNAKI

SEQ ID NO: 95943 - protein, 13 aa, Mycobacterium tuberculosis
VYIAPKTFNAKID

SEQ ID NO: 95944 - protein, 13 aa, Mycobacterium tuberculosis
YIAPKTFNAKIDA

SEQ ID NO: 95945 - protein, 13 aa, Mycobacterium tuberculosis
IAPKTFNAKIDAE

SEQ ID NO: 95946 - protein, 13 aa, Mycobacterium tuberculosis
APKTFNAKIDAEA

SEQ ID NO: 95947 - protein, 13 aa, Mycobacterium tuberculosis
PKTFNAKIDAEAW

SEQ ID NO: 95948 - protein, 13 aa, Mycobacterium tuberculosis
KTFNAKIDAEAWL

SEQ ID NO: 95949 - protein, 13 aa, Mycobacterium tuberculosis
TFNAKIDAEAWLT

SEQ ID NO: 95950 - protein, 13 aa, Mycobacterium tuberculosis
FNAKIDAEAWLTD

SEQ ID NO: 95951 - protein, 13 aa, Mycobacterium tuberculosis
NAKIDAEAWLTDR

SEQ ID NO: 95952 - protein, 13 aa, Mycobacterium tuberculosis
AKIDAEAWLTDRR

SEQ ID NO: 95953 - protein, 13 aa, Mycobacterium tuberculosis
KIDAEAWLTDRRR

SEQ ID NO: 95954 - protein, 13 aa, Mycobacterium tuberculosis
IDAEAWLTDRRRE

SEQ ID NO: 95955 - protein, 13 aa, Mycobacterium tuberculosis
DAEAWLTDRRREI

SEQ ID NO: 95956 - protein, 13 aa, Mycobacterium tuberculosis
AEAWLTDRRREID

SEQ ID NO: 95957 - protein, 13 aa, Mycobacterium tuberculosis
EAWLTDRRREIDR

SEQ ID NO: 95958 - protein, 13 aa, Mycobacterium tuberculosis
AWLTDRRREIDRQ

SEQ ID NO: 95959 - protein, 13 aa, Mycobacterium tuberculosis
WLTDRRREIDRQL

SEQ ID NO: 95960 - protein, 13 aa, Mycobacterium tuberculosis
LTDRRREIDRQLW

SEQ ID NO: 95961 - protein, 13 aa, Mycobacterium tuberculosis
TDRRREIDRQLWS

SEQ ID NO: 95962 - protein, 13 aa, Mycobacterium tuberculosis
DRRREIDRQLWSP

SEQ ID NO: 95963 - protein, 13 aa, Mycobacterium tuberculosis
RRREIDRQLWSPA

SEQ ID NO: 95964 - protein, 13 aa, Mycobacterium tuberculosis
RREIDRQLWSPAS

SEQ ID NO: 95965 - protein, 13 aa, Mycobacterium tuberculosis
REIDRQLWSPASG

SEQ ID NO: 95966 - protein, 13 aa, Mycobacterium tuberculosis
EIDRQLWSPASGQ

SEQ ID NO: 95967 - protein, 13 aa, Mycobacterium tuberculosis
IDRQLWSPASGQE

SEQ ID NO: 95968 - protein, 13 aa, Mycobacterium tuberculosis
DRQLWSPASGQED

SEQ ID NO: 95969 - protein, 13 aa, Mycobacterium tuberculosis
RQLWSPASGQEDR

SEQ ID NO: 95970 - protein, 13 aa, Mycobacterium tuberculosis
QLWSPASGQEDRP

SEQ ID NO: 95971 - protein, 13 aa, Mycobacterium tuberculosis
LWSPASGQEDRPG

SEQ ID NO: 95972 - protein, 13 aa, Mycobacterium tuberculosis
WSPASGQEDRPGA

SEQ ID NO: 95973 - protein, 13 aa, Mycobacterium tuberculosis
SPASGQEDRPGAP

SEQ ID NO: 95974 - protein, 13 aa, Mycobacterium tuberculosis
PASGQEDRPGAPF

SEQ ID NO: 95975 - protein, 13 aa, Mycobacterium tuberculosis
ASGQEDRPGAPFG

SEQ ID NO: 95976 - protein, 13 aa, Mycobacterium tuberculosis
SGQEDRPGAPFGE

SEQ ID NO: 95977 - protein, 13 aa, Mycobacterium tuberculosis
GQEDRPGAPFGEY

SEQ ID NO: 95978 - protein, 13 aa, Mycobacterium tuberculosis
QEDRPGAPFGEYA

SEQ ID NO: 95979 - protein, 13 aa, Mycobacterium tuberculosis
EDRPGAPFGEYAE

SEQ ID NO: 95980 - protein, 13 aa, Mycobacterium tuberculosis
DRPGAPFGEYAEG

SEQ ID NO: 95981 - protein, 13 aa, Mycobacterium tuberculosis
RPGAPFGEYAEGW

SEQ ID NO: 95982 - protein, 13 aa, Mycobacterium tuberculosis
PGAPFGEYAEGWL

SEQ ID NO: 95983 - protein, 13 aa, Mycobacterium tuberculosis
GAPFGEYAEGWLK

SEQ ID NO: 95984 - protein, 13 aa, Mycobacterium tuberculosis
APFGEYAEGWLKQ

SEQ ID NO: 95985 - protein, 13 aa, Mycobacterium tuberculosis
PFGEYAEGWLKQR

SEQ ID NO: 95986 - protein, 13 aa, Mycobacterium tuberculosis
FGEYAEGWLKQRG

SEQ ID NO: 95987 - protein, 13 aa, Mycobacterium tuberculosis
GEYAEGWLKQRGI

SEQ ID NO: 95988 - protein, 13 aa, Mycobacterium tuberculosis
EYAEGWLKQRGIK

SEQ ID NO: 95989 - protein, 13 aa, Mycobacterium tuberculosis
YAEGWLKQRGIKD

SEQ ID NO: 95990 - protein, 13 aa, Mycobacterium tuberculosis
AEGWLKQRGIKDR

SEQ ID NO: 95991 - protein, 13 aa, Mycobacterium tuberculosis
EGWLKQRGIKDRT

SEQ ID NO: 95992 - protein, 13 aa, Mycobacterium tuberculosis
GWLKQRGIKDRTR

SEQ ID NO: 95993 - protein, 13 aa, Mycobacterium tuberculosis
WLKQRGIKDRTRA

SEQ ID NO: 95994 - protein, 13 aa, Mycobacterium tuberculosis
LKQRGIKDRTRAH

SEQ ID NO: 95995 - protein, 13 aa, Mycobacterium tuberculosis
KQRGIKDRTRAHY

SEQ ID NO: 95996 - protein, 13 aa, Mycobacterium tuberculosis
QRGIKDRTRAHYR

SEQ ID NO: 95997 - protein, 13 aa, Mycobacterium tuberculosis
RGIKDRTRAHYRK

SEQ ID NO: 95998 - protein, 13 aa, Mycobacterium tuberculosis
GIKDRTRAHYRKL

SEQ ID NO: 95999 - protein, 13 aa, Mycobacterium tuberculosis
IKDRTRAHYRKLL

SEQ ID NO: 96000 - protein, 13 aa, Mycobacterium tuberculosis
KDRTRAHYRKLLD

SEQ ID NO: 96001 - protein, 13 aa, Mycobacterium tuberculosis
DRTRAHYRKLLDN

SEQ ID NO: 96002 - protein, 13 aa, Mycobacterium tuberculosis
RTRAHYRKLLDNH

SEQ ID NO: 96003 - protein, 13 aa, Mycobacterium tuberculosis
TRAHYRKLLDNHI

SEQ ID NO: 96004 - protein, 13 aa, Mycobacterium tuberculosis
RAHYRKLLDNHIL

SEQ ID NO: 96005 - protein, 13 aa, Mycobacterium tuberculosis
AHYRKLLDNHILA

SEQ ID NO: 96006 - protein, 13 aa, Mycobacterium tuberculosis
HYRKLLDNHILAT

SEQ ID NO: 96007 - protein, 13 aa, Mycobacterium tuberculosis
YRKLLDNHILATF

SEQ ID NO: 96008 - protein, 13 aa, Mycobacterium tuberculosis
RKLLDNHILATFA

SEQ ID NO: 96009 - protein, 13 aa, Mycobacterium tuberculosis
KLLDNHILATFAD

SEQ ID NO: 96010 - protein, 13 aa, Mycobacterium tuberculosis
LLDNHILATFADT

SEQ ID NO: 96011 - protein, 13 aa, Mycobacterium tuberculosis
LDNHILATFADTD

SEQ ID NO: 96012 - protein, 13 aa, Mycobacterium tuberculosis
DNHILATFADTDL

SEQ ID NO: 96013 - protein, 13 aa, Mycobacterium tuberculosis
NHILATFADTDLR

SEQ ID NO: 96014 - protein, 13 aa, Mycobacterium tuberculosis
HILATFADTDLRD

SEQ ID NO: 96015 - protein, 13 aa, Mycobacterium tuberculosis
ILATFADTDLRDI

SEQ ID NO: 96016 - protein, 13 aa, Mycobacterium tuberculosis
LATFADTDLRDIT

SEQ ID NO: 96017 - protein, 13 aa, Mycobacterium tuberculosis
ATFADTDLRDITP

SEQ ID NO: 96018 - protein, 13 aa, Mycobacterium tuberculosis
TFADTDLRDITPA

SEQ ID NO: 96019 - protein, 13 aa, Mycobacterium tuberculosis
FADTDLRDITPAA

SEQ ID NO: 96020 - protein, 13 aa, Mycobacterium tuberculosis
ADTDLRDITPAAV

SEQ ID NO: 96021 - protein, 13 aa, Mycobacterium tuberculosis
DTDLRDITPAAVR

SEQ ID NO: 96022 - protein, 13 aa, Mycobacterium tuberculosis
TDLRDITPAAVRR

SEQ ID NO: 96023 - protein, 13 aa, Mycobacterium tuberculosis
DLRDITPAAVRRW

SEQ ID NO: 96024 - protein, 13 aa, Mycobacterium tuberculosis
LRDITPAAVRRWY

SEQ ID NO: 96025 - protein, 13 aa, Mycobacterium tuberculosis
RDITPAAVRRWYA

SEQ ID NO: 96026 - protein, 13 aa, Mycobacterium tuberculosis
DITPAAVRRWYAT

SEQ ID NO: 96027 - protein, 13 aa, Mycobacterium tuberculosis
ITPAAVRRWYATT

SEQ ID NO: 96028 - protein, 13 aa, Mycobacterium tuberculosis
TPAAVRRWYATTA

SEQ ID NO: 96029 - protein, 13 aa, Mycobacterium tuberculosis
PAAVRRWYATTAV

SEQ ID NO: 96030 - protein, 13 aa, Mycobacterium tuberculosis
AAVRRWYATTAVG

SEQ ID NO: 96031 - protein, 13 aa, Mycobacterium tuberculosis
AVRRWYATTAVGT

SEQ ID NO: 96032 - protein, 13 aa, Mycobacterium tuberculosis
VRRWYATTAVGTP

SEQ ID NO: 96033 - protein, 13 aa, Mycobacterium tuberculosis
RRWYATTAVGTPT

SEQ ID NO: 96034 - protein, 13 aa, Mycobacterium tuberculosis
RWYATTAVGTPTM

SEQ ID NO: 96035 - protein, 13 aa, Mycobacterium tuberculosis
WYATTAVGTPTMR

SEQ ID NO: 96036 - protein, 13 aa, Mycobacterium tuberculosis
YATTAVGTPTMRA

SEQ ID NO: 96037 - protein, 13 aa, Mycobacterium tuberculosis
ATTAVGTPTMRAH

SEQ ID NO: 96038 - protein, 13 aa, Mycobacterium tuberculosis
TTAVGTPTMRAHS

SEQ ID NO: 96039 - protein, 13 aa, Mycobacterium tuberculosis
TAVGTPTMRAHSY

SEQ ID NO: 96040 - protein, 13 aa, Mycobacterium tuberculosis
AVGTPTMRAHSYS

SEQ ID NO: 96041 - protein, 13 aa, Mycobacterium tuberculosis
VGTPTMRAHSYSL

SEQ ID NO: 96042 - protein, 13 aa, Mycobacterium tuberculosis
GTPTMRAHSYSLL

SEQ ID NO: 96043 - protein, 13 aa, Mycobacterium tuberculosis
TPTMRAHSYSLLR

SEQ ID NO: 96044 - protein, 13 aa, Mycobacterium tuberculosis
PTMRAHSYSLLRA

SEQ ID NO: 96045 - protein, 13 aa, Mycobacterium tuberculosis
TMRAHSYSLLRAI

SEQ ID NO: 96046 - protein, 13 aa, Mycobacterium tuberculosis
MRAHSYSLLRAIM

SEQ ID NO: 96047 - protein, 13 aa, Mycobacterium tuberculosis
RAHSYSLLRAIMQ

SEQ ID NO: 96048 - protein, 13 aa, Mycobacterium tuberculosis
AHSYSLLRAIMQT

SEQ ID NO: 96049 - protein, 13 aa, Mycobacterium tuberculosis
HSYSLLRAIMQTA

SEQ ID NO: 96050 - protein, 13 aa, Mycobacterium tuberculosis
SYSLLRAIMQTAL

SEQ ID NO: 96051 - protein, 13 aa, Mycobacterium tuberculosis
YSLLRAIMQTALA

SEQ ID NO: 96052 - protein, 13 aa, Mycobacterium tuberculosis
SLLRAIMQTALAD

SEQ ID NO: 96053 - protein, 13 aa, Mycobacterium tuberculosis
LLRAIMQTALADD

SEQ ID NO: 96054 - protein, 13 aa, Mycobacterium tuberculosis
LRAIMQTALADDL

SEQ ID NO: 96055 - protein, 13 aa, Mycobacterium tuberculosis
RAIMQTALADDLI

SEQ ID NO: 96056 - protein, 13 aa, Mycobacterium tuberculosis
AIMQTALADDLID

SEQ ID NO: 96057 - protein, 13 aa, Mycobacterium tuberculosis
IMQTALADDLIDS

SEQ ID NO: 96058 - protein, 13 aa, Mycobacterium tuberculosis
MQTALADDLIDSN

SEQ ID NO: 96059 - protein, 13 aa, Mycobacterium tuberculosis
QTALADDLIDSNP

SEQ ID NO: 96060 - protein, 13 aa, Mycobacterium tuberculosis
TALADDLIDSNPC

SEQ ID NO: 96061 - protein, 13 aa, Mycobacterium tuberculosis
ALADDLIDSNPCR

SEQ ID NO: 96062 - protein, 13 aa, Mycobacterium tuberculosis
LADDLIDSNPCRI

SEQ ID NO: 96063 - protein, 13 aa, Mycobacterium tuberculosis
ADDLIDSNPCRIS

SEQ ID NO: 96064 - protein, 13 aa, Mycobacterium tuberculosis
DDLIDSNPCRISG

SEQ ID NO: 96065 - protein, 13 aa, Mycobacterium tuberculosis
DLIDSNPCRISGA

SEQ ID NO: 96066 - protein, 13 aa, Mycobacterium tuberculosis
LIDSNPCRISGAS

SEQ ID NO: 96067 - protein, 13 aa, Mycobacterium tuberculosis
IDSNPCRISGAST

SEQ ID NO: 96068 - protein, 13 aa, Mycobacterium tuberculosis
DSNPCRISGASTA

SEQ ID NO: 96069 - protein, 13 aa, Mycobacterium tuberculosis
SNPCRISGASTAR

SEQ ID NO: 96070 - protein, 13 aa, Mycobacterium tuberculosis
NPCRISGASTARR

SEQ ID NO: 96071 - protein, 13 aa, Mycobacterium tuberculosis
PCRISGASTARRV

SEQ ID NO: 96072 - protein, 13 aa, Mycobacterium tuberculosis
CRISGASTARRVH

SEQ ID NO: 96073 - protein, 13 aa, Mycobacterium tuberculosis
RISGASTARRVHK

SEQ ID NO: 96074 - protein, 13 aa, Mycobacterium tuberculosis
ISGASTARRVHKI

SEQ ID NO: 96075 - protein, 13 aa, Mycobacterium tuberculosis
SGASTARRVHKIR

SEQ ID NO: 96076 - protein, 13 aa, Mycobacterium tuberculosis
GASTARRVHKIRP

SEQ ID NO: 96077 - protein, 13 aa, Mycobacterium tuberculosis
ASTARRVHKIRPA

SEQ ID NO: 96078 - protein, 13 aa, Mycobacterium tuberculosis
STARRVHKIRPAT

SEQ ID NO: 96079 - protein, 13 aa, Mycobacterium tuberculosis
TARRVHKIRPATL

SEQ ID NO: 96080 - protein, 13 aa, Mycobacterium tuberculosis
ARRVHKIRPATLD

SEQ ID NO: 96081 - protein, 13 aa, Mycobacterium tuberculosis
RRVHKIRPATLDE

SEQ ID NO: 96082 - protein, 13 aa, Mycobacterium tuberculosis
RVHKIRPATLDEL

SEQ ID NO: 96083 - protein, 13 aa, Mycobacterium tuberculosis
VHKIRPATLDELE

SEQ ID NO: 96084 - protein, 13 aa, Mycobacterium tuberculosis
HKIRPATLDELET

SEQ ID NO: 96085 - protein, 13 aa, Mycobacterium tuberculosis
KIRPATLDELETI

SEQ ID NO: 96086 - protein, 13 aa, Mycobacterium tuberculosis
IRPATLDELETIT

SEQ ID NO: 96087 - protein, 13 aa, Mycobacterium tuberculosis
RPATLDELETITK

SEQ ID NO: 96088 - protein, 13 aa, Mycobacterium tuberculosis
PATLDELETITKA

SEQ ID NO: 96089 - protein, 13 aa, Mycobacterium tuberculosis
ATLDELETITKAM

SEQ ID NO: 96090 - protein, 13 aa, Mycobacterium tuberculosis
TLDELETITKAMP

SEQ ID NO: 96091 - protein, 13 aa, Mycobacterium tuberculosis
LDELETITKAMPD

SEQ ID NO: 96092 - protein, 13 aa, Mycobacterium tuberculosis
DELETITKAMPDP

SEQ ID NO: 96093 - protein, 13 aa, Mycobacterium tuberculosis
ELETITKAMPDPY

SEQ ID NO: 96094 - protein, 13 aa, Mycobacterium tuberculosis
LETITKAMPDPYQ

SEQ ID NO: 96095 - protein, 13 aa, Mycobacterium tuberculosis
ETITKAMPDPYQA

SEQ ID NO: 96096 - protein, 13 aa, Mycobacterium tuberculosis
TITKAMPDPYQAF

SEQ ID NO: 96097 - protein, 13 aa, Mycobacterium tuberculosis
ITKAMPDPYQAFV

SEQ ID NO: 96098 - protein, 13 aa, Mycobacterium tuberculosis
TKAMPDPYQAFVL

SEQ ID NO: 96099 - protein, 13 aa, Mycobacterium tuberculosis
KAMPDPYQAFVLM

SEQ ID NO: 96100 - protein, 13 aa, Mycobacterium tuberculosis
AMPDPYQAFVLMA

SEQ ID NO: 96101 - protein, 13 aa, Mycobacterium tuberculosis
MPDPYQAFVLMAA

SEQ ID NO: 96102 - protein, 13 aa, Mycobacterium tuberculosis
PDPYQAFVLMAAW

SEQ ID NO: 96103 - protein, 13 aa, Mycobacterium tuberculosis
DPYQAFVLMAAWL

SEQ ID NO: 96104 - protein, 13 aa, Mycobacterium tuberculosis
PYQAFVLMAAWLA

SEQ ID NO: 96105 - protein, 13 aa, Mycobacterium tuberculosis
YQAFVLMAAWLAM

SEQ ID NO: 96106 - protein, 13 aa, Mycobacterium tuberculosis
QAFVLMAAWLAMR

SEQ ID NO: 96107 - protein, 13 aa, Mycobacterium tuberculosis
AFVLMAAWLAMRY

SEQ ID NO: 96108 - protein, 13 aa, Mycobacterium tuberculosis
FVLMAAWLAMRYG

SEQ ID NO: 96109 - protein, 13 aa, Mycobacterium tuberculosis
VLMAAWLAMRYGE

SEQ ID NO: 96110 - protein, 13 aa, Mycobacterium tuberculosis
LMAAWLAMRYGEL

SEQ ID NO: 96111 - protein, 13 aa, Mycobacterium tuberculosis
MAAWLAMRYGELT

SEQ ID NO: 96112 - protein, 13 aa, Mycobacterium tuberculosis
AAWLAMRYGELTE

SEQ ID NO: 96113 - protein, 13 aa, Mycobacterium tuberculosis
AWLAMRYGELTEL

SEQ ID NO: 96114 - protein, 13 aa, Mycobacterium tuberculosis
WLAMRYGELTELR

SEQ ID NO: 96115 - protein, 13 aa, Mycobacterium tuberculosis
LAMRYGELTELRR

SEQ ID NO: 96116 - protein, 13 aa, Mycobacterium tuberculosis
AMRYGELTELRRK

SEQ ID NO: 96117 - protein, 13 aa, Mycobacterium tuberculosis
MRYGELTELRRKD

SEQ ID NO: 96118 - protein, 13 aa, Mycobacterium tuberculosis
RYGELTELRRKDI

SEQ ID NO: 96119 - protein, 13 aa, Mycobacterium tuberculosis
YGELTELRRKDID

SEQ ID NO: 96120 - protein, 13 aa, Mycobacterium tuberculosis
GELTELRRKDIDL

SEQ ID NO: 96121 - protein, 13 aa, Mycobacterium tuberculosis
ELTELRRKDIDLH

SEQ ID NO: 96122 - protein, 13 aa, Mycobacterium tuberculosis
LTELRRKDIDLHG

SEQ ID NO: 96123 - protein, 13 aa, Mycobacterium tuberculosis
TELRRKDIDLHGE

SEQ ID NO: 96124 - protein, 13 aa, Mycobacterium tuberculosis
ELRRKDIDLHGEV

SEQ ID NO: 96125 - protein, 13 aa, Mycobacterium tuberculosis
LRRKDIDLHGEVA

SEQ ID NO: 96126 - protein, 13 aa, Mycobacterium tuberculosis
RRKDIDLHGEVAR

SEQ ID NO: 96127 - protein, 13 aa, Mycobacterium tuberculosis
RKDIDLHGEVARV

SEQ ID NO: 96128 - protein, 13 aa, Mycobacterium tuberculosis
KDIDLHGEVARVR

SEQ ID NO: 96129 - protein, 13 aa, Mycobacterium tuberculosis
DIDLHGEVARVRR

SEQ ID NO: 96130 - protein, 13 aa, Mycobacterium tuberculosis
IDLHGEVARVRRA

SEQ ID NO: 96131 - protein, 13 aa, Mycobacterium tuberculosis
DLHGEVARVRRAV

SEQ ID NO: 96132 - protein, 13 aa, Mycobacterium tuberculosis
LHGEVARVRRAVV

SEQ ID NO: 96133 - protein, 13 aa, Mycobacterium tuberculosis
HGEVARVRRAVVR

SEQ ID NO: 96134 - protein, 13 aa, Mycobacterium tuberculosis
GEVARVRRAVVRV

SEQ ID NO: 96135 - protein, 13 aa, Mycobacterium tuberculosis
EVARVRRAVVRVG

SEQ ID NO: 96136 - protein, 13 aa, Mycobacterium tuberculosis
VARVRRAVVRVGE

SEQ ID NO: 96137 - protein, 13 aa, Mycobacterium tuberculosis
ARVRRAVVRVGEG

SEQ ID NO: 96138 - protein, 13 aa, Mycobacterium tuberculosis
RVRRAVVRVGEGF

SEQ ID NO: 96139 - protein, 13 aa, Mycobacterium tuberculosis
VRRAVVRVGEGFK

SEQ ID NO: 96140 - protein, 13 aa, Mycobacterium tuberculosis
RRAVVRVGEGFKV

SEQ ID NO: 96141 - protein, 13 aa, Mycobacterium tuberculosis
RAVVRVGEGFKVT

SEQ ID NO: 96142 - protein, 13 aa, Mycobacterium tuberculosis
AVVRVGEGFKVTT

SEQ ID NO: 96143 - protein, 13 aa, Mycobacterium tuberculosis
VVRVGEGFKVTTP

SEQ ID NO: 96144 - protein, 13 aa, Mycobacterium tuberculosis
VRVGEGFKVTTPK

SEQ ID NO: 96145 - protein, 13 aa, Mycobacterium tuberculosis
RVGEGFKVTTPKS

SEQ ID NO: 96146 - protein, 13 aa, Mycobacterium tuberculosis
VGEGFKVTTPKSD

SEQ ID NO: 96147 - protein, 13 aa, Mycobacterium tuberculosis
GEGFKVTTPKSDA

SEQ ID NO: 96148 - protein, 13 aa, Mycobacterium tuberculosis
EGFKVTTPKSDAG

SEQ ID NO: 96149 - protein, 13 aa, Mycobacterium tuberculosis
GFKVTTPKSDAGV

SEQ ID NO: 96150 - protein, 13 aa, Mycobacterium tuberculosis
FKVTTPKSDAGVR

SEQ ID NO: 96151 - protein, 13 aa, Mycobacterium tuberculosis
KVTTPKSDAGVRD

SEQ ID NO: 96152 - protein, 13 aa, Mycobacterium tuberculosis
VTTPKSDAGVRDI

SEQ ID NO: 96153 - protein, 13 aa, Mycobacterium tuberculosis
TTPKSDAGVRDIS

SEQ ID NO: 96154 - protein, 13 aa, Mycobacterium tuberculosis
TPKSDAGVRDISI

SEQ ID NO: 96155 - protein, 13 aa, Mycobacterium tuberculosis
PKSDAGVRDISIP

SEQ ID NO: 96156 - protein, 13 aa, Mycobacterium tuberculosis
KSDAGVRDISIPP

SEQ ID NO: 96157 - protein, 13 aa, Mycobacterium tuberculosis
SDAGVRDISIPPH

SEQ ID NO: 96158 - protein, 13 aa, Mycobacterium tuberculosis
DAGVRDISIPPHL

SEQ ID NO: 96159 - protein, 13 aa, Mycobacterium tuberculosis
AGVRDISIPPHLI

SEQ ID NO: 96160 - protein, 13 aa, Mycobacterium tuberculosis
GVRDISIPPHLIP

SEQ ID NO: 96161 - protein, 13 aa, Mycobacterium tuberculosis
VRDISIPPHLIPA

SEQ ID NO: 96162 - protein, 13 aa, Mycobacterium tuberculosis
RDISIPPHLIPAI

SEQ ID NO: 96163 - protein, 13 aa, Mycobacterium tuberculosis
DISIPPHLIPAIE

SEQ ID NO: 96164 - protein, 13 aa, Mycobacterium tuberculosis
ISIPPHLIPAIED

SEQ ID NO: 96165 - protein, 13 aa, Mycobacterium tuberculosis
SIPPHLIPAIEDH

SEQ ID NO: 96166 - protein, 13 aa, Mycobacterium tuberculosis
IPPHLIPAIEDHL

SEQ ID NO: 96167 - protein, 13 aa, Mycobacterium tuberculosis
PPHLIPAIEDHLH

SEQ ID NO: 96168 - protein, 13 aa, Mycobacterium tuberculosis
PHLIPAIEDHLHK

SEQ ID NO: 96169 - protein, 13 aa, Mycobacterium tuberculosis
HLIPAIEDHLHKH

SEQ ID NO: 96170 - protein, 13 aa, Mycobacterium tuberculosis
LIPAIEDHLHKHV

SEQ ID NO: 96171 - protein, 13 aa, Mycobacterium tuberculosis
IPAIEDHLHKHVN

SEQ ID NO: 96172 - protein, 13 aa, Mycobacterium tuberculosis
PAIEDHLHKHVNP

SEQ ID NO: 96173 - protein, 13 aa, Mycobacterium tuberculosis
AIEDHLHKHVNPG

SEQ ID NO: 96174 - protein, 13 aa, Mycobacterium tuberculosis
IEDHLHKHVNPGR

SEQ ID NO: 96175 - protein, 13 aa, Mycobacterium tuberculosis
EDHLHKHVNPGRE

SEQ ID NO: 96176 - protein, 13 aa, Mycobacterium tuberculosis
DHLHKHVNPGRES

SEQ ID NO: 96177 - protein, 13 aa, Mycobacterium tuberculosis
HLHKHVNPGRESL

SEQ ID NO: 96178 - protein, 13 aa, Mycobacterium tuberculosis
LHKHVNPGRESLL

SEQ ID NO: 96179 - protein, 13 aa, Mycobacterium tuberculosis
HKHVNPGRESLLF

SEQ ID NO: 96180 - protein, 13 aa, Mycobacterium tuberculosis
KHVNPGRESLLFP

SEQ ID NO: 96181 - protein, 13 aa, Mycobacterium tuberculosis
HVNPGRESLLFPS

SEQ ID NO: 96182 - protein, 13 aa, Mycobacterium tuberculosis
VNPGRESLLFPSV

SEQ ID NO: 96183 - protein, 13 aa, Mycobacterium tuberculosis
NPGRESLLFPSVN

SEQ ID NO: 96184 - protein, 13 aa, Mycobacterium tuberculosis
PGRESLLFPSVND

SEQ ID NO: 96185 - protein, 13 aa, Mycobacterium tuberculosis
GRESLLFPSVNDP

SEQ ID NO: 96186 - protein, 13 aa, Mycobacterium tuberculosis
RESLLFPSVNDPN

SEQ ID NO: 96187 - protein, 13 aa, Mycobacterium tuberculosis
ESLLFPSVNDPNR

SEQ ID NO: 96188 - protein, 13 aa, Mycobacterium tuberculosis
SLLFPSVNDPNRH

SEQ ID NO: 96189 - protein, 13 aa, Mycobacterium tuberculosis
LLFPSVNDPNRHL

SEQ ID NO: 96190 - protein, 13 aa, Mycobacterium tuberculosis
LFPSVNDPNRHLA

SEQ ID NO: 96191 - protein, 13 aa, Mycobacterium tuberculosis
FPSVNDPNRHLAP

SEQ ID NO: 96192 - protein, 13 aa, Mycobacterium tuberculosis
PSVNDPNRHLAPS

SEQ ID NO: 96193 - protein, 13 aa, Mycobacterium tuberculosis
SVNDPNRHLAPSA

SEQ ID NO: 96194 - protein, 13 aa, Mycobacterium tuberculosis
VNDPNRHLAPSAL

SEQ ID NO: 96195 - protein, 13 aa, Mycobacterium tuberculosis
NDPNRHLAPSALY

SEQ ID NO: 96196 - protein, 13 aa, Mycobacterium tuberculosis
DPNRHLAPSALYR

SEQ ID NO: 96197 - protein, 13 aa, Mycobacterium tuberculosis
PNRHLAPSALYRM

SEQ ID NO: 96198 - protein, 13 aa, Mycobacterium tuberculosis
NRHLAPSALYRMF

SEQ ID NO: 96199 - protein, 13 aa, Mycobacterium tuberculosis
RHLAPSALYRMFY

SEQ ID NO: 96200 - protein, 13 aa, Mycobacterium tuberculosis
HLAPSALYRMFYK

SEQ ID NO: 96201 - protein, 13 aa, Mycobacterium tuberculosis
LAPSALYRMFYKA

SEQ ID NO: 96202 - protein, 13 aa, Mycobacterium tuberculosis
APSALYRMFYKAR

SEQ ID NO: 96203 - protein, 13 aa, Mycobacterium tuberculosis
PSALYRMFYKARK

SEQ ID NO: 96204 - protein, 13 aa, Mycobacterium tuberculosis
SALYRMFYKARKA

SEQ ID NO: 96205 - protein, 13 aa, Mycobacterium tuberculosis
ALYRMFYKARKAA

SEQ ID NO: 96206 - protein, 13 aa, Mycobacterium tuberculosis
LYRMFYKARKAAG

SEQ ID NO: 96207 - protein, 13 aa, Mycobacterium tuberculosis
YRMFYKARKAAGR

SEQ ID NO: 96208 - protein, 13 aa, Mycobacterium tuberculosis
RMFYKARKAAGRP

SEQ ID NO: 96209 - protein, 13 aa, Mycobacterium tuberculosis
MFYKARKAAGRPD

SEQ ID NO: 96210 - protein, 13 aa, Mycobacterium tuberculosis
FYKARKAAGRPDL

SEQ ID NO: 96211 - protein, 13 aa, Mycobacterium tuberculosis
YKARKAAGRPDLR

SEQ ID NO: 96212 - protein, 13 aa, Mycobacterium tuberculosis
KARKAAGRPDLRV

SEQ ID NO: 96213 - protein, 13 aa, Mycobacterium tuberculosis
ARKAAGRPDLRVH

SEQ ID NO: 96214 - protein, 13 aa, Mycobacterium tuberculosis
RKAAGRPDLRVHD

SEQ ID NO: 96215 - protein, 13 aa, Mycobacterium tuberculosis
KAAGRPDLRVHDL

SEQ ID NO: 96216 - protein, 13 aa, Mycobacterium tuberculosis
AAGRPDLRVHDLR

SEQ ID NO: 96217 - protein, 13 aa, Mycobacterium tuberculosis
AGRPDLRVHDLRH

SEQ ID NO: 96218 - protein, 13 aa, Mycobacterium tuberculosis
GRPDLRVHDLRHS

SEQ ID NO: 96219 - protein, 13 aa, Mycobacterium tuberculosis
RPDLRVHDLRHSG

SEQ ID NO: 96220 - protein, 13 aa, Mycobacterium tuberculosis
PDLRVHDLRHSGA

SEQ ID NO: 96221 - protein, 13 aa, Mycobacterium tuberculosis
DLRVHDLRHSGAV

SEQ ID NO: 96222 - protein, 13 aa, Mycobacterium tuberculosis
LRVHDLRHSGAVL

SEQ ID NO: 96223 - protein, 13 aa, Mycobacterium tuberculosis
RVHDLRHSGAVLA

SEQ ID NO: 96224 - protein, 13 aa, Mycobacterium tuberculosis
VHDLRHSGAVLAA

SEQ ID NO: 96225 - protein, 13 aa, Mycobacterium tuberculosis
HDLRHSGAVLAAS

SEQ ID NO: 96226 - protein, 13 aa, Mycobacterium tuberculosis
DLRHSGAVLAAST

SEQ ID NO: 96227 - protein, 13 aa, Mycobacterium tuberculosis
LRHSGAVLAASTG

SEQ ID NO: 96228 - protein, 13 aa, Mycobacterium tuberculosis
RHSGAVLAASTGA

SEQ ID NO: 96229 - protein, 13 aa, Mycobacterium tuberculosis
HSGAVLAASTGAT

SEQ ID NO: 96230 - protein, 13 aa, Mycobacterium tuberculosis
SGAVLAASTGATL

SEQ ID NO: 96231 - protein, 13 aa, Mycobacterium tuberculosis
GAVLAASTGATLA

SEQ ID NO: 96232 - protein, 13 aa, Mycobacterium tuberculosis
AVLAASTGATLAE

SEQ ID NO: 96233 - protein, 13 aa, Mycobacterium tuberculosis
VLAASTGATLAEL

SEQ ID NO: 96234 - protein, 13 aa, Mycobacterium tuberculosis
LAASTGATLAELM

SEQ ID NO: 96235 - protein, 13 aa, Mycobacterium tuberculosis
AASTGATLAELMQ

SEQ ID NO: 96236 - protein, 13 aa, Mycobacterium tuberculosis
ASTGATLAELMQR

SEQ ID NO: 96237 - protein, 13 aa, Mycobacterium tuberculosis
STGATLAELMQRL

SEQ ID NO: 96238 - protein, 13 aa, Mycobacterium tuberculosis
TGATLAELMQRLG

SEQ ID NO: 96239 - protein, 13 aa, Mycobacterium tuberculosis
GATLAELMQRLGH

SEQ ID NO: 96240 - protein, 13 aa, Mycobacterium tuberculosis
ATLAELMQRLGHS

SEQ ID NO: 96241 - protein, 13 aa, Mycobacterium tuberculosis
TLAELMQRLGHST

SEQ ID NO: 96242 - protein, 13 aa, Mycobacterium tuberculosis
LAELMQRLGHSTA

SEQ ID NO: 96243 - protein, 13 aa, Mycobacterium tuberculosis
AELMQRLGHSTAG

SEQ ID NO: 96244 - protein, 13 aa, Mycobacterium tuberculosis
ELMQRLGHSTAGA

SEQ ID NO: 96245 - protein, 13 aa, Mycobacterium tuberculosis
LMQRLGHSTAGAA

SEQ ID NO: 96246 - protein, 13 aa, Mycobacterium tuberculosis
MQRLGHSTAGAAL

SEQ ID NO: 96247 - protein, 13 aa, Mycobacterium tuberculosis
QRLGHSTAGAALR

SEQ ID NO: 96248 - protein, 13 aa, Mycobacterium tuberculosis
RLGHSTAGAALRY

SEQ ID NO: 96249 - protein, 13 aa, Mycobacterium tuberculosis
LGHSTAGAALRYQ

SEQ ID NO: 96250 - protein, 13 aa, Mycobacterium tuberculosis
GHSTAGAALRYQH

SEQ ID NO: 96251 - protein, 13 aa, Mycobacterium tuberculosis
HSTAGAALRYQHA

SEQ ID NO: 96252 - protein, 13 aa, Mycobacterium tuberculosis
STAGAALRYQHAA

SEQ ID NO: 96253 - protein, 13 aa, Mycobacterium tuberculosis
TAGAALRYQHAAK

SEQ ID NO: 96254 - protein, 13 aa, Mycobacterium tuberculosis
AGAALRYQHAAKG

SEQ ID NO: 96255 - protein, 13 aa, Mycobacterium tuberculosis
GAALRYQHAAKGR

SEQ ID NO: 96256 - protein, 13 aa, Mycobacterium tuberculosis
AALRYQHAAKGRD

SEQ ID NO: 96257 - protein, 13 aa, Mycobacterium tuberculosis
ALRYQHAAKGRDR

SEQ ID NO: 96258 - protein, 13 aa, Mycobacterium tuberculosis
LRYQHAAKGRDRE

SEQ ID NO: 96259 - protein, 13 aa, Mycobacterium tuberculosis
RYQHAAKGRDREI

SEQ ID NO: 96260 - protein, 13 aa, Mycobacterium tuberculosis
YQHAAKGRDREIA

SEQ ID NO: 96261 - protein, 13 aa, Mycobacterium tuberculosis
QHAAKGRDREIAA

SEQ ID NO: 96262 - protein, 13 aa, Mycobacterium tuberculosis
HAAKGRDREIAAL

SEQ ID NO: 96263 - protein, 13 aa, Mycobacterium tuberculosis
AAKGRDREIAALL

SEQ ID NO: 96264 - protein, 13 aa, Mycobacterium tuberculosis
AKGRDREIAALLS

SEQ ID NO: 96265 - protein, 13 aa, Mycobacterium tuberculosis
KGRDREIAALLSK

SEQ ID NO: 96266 - protein, 13 aa, Mycobacterium tuberculosis
GRDREIAALLSKL

SEQ ID NO: 96267 - protein, 13 aa, Mycobacterium tuberculosis
RDREIAALLSKLA

SEQ ID NO: 96268 - protein, 13 aa, Mycobacterium tuberculosis
DREIAALLSKLAE

SEQ ID NO: 96269 - protein, 13 aa, Mycobacterium tuberculosis
REIAALLSKLAEN

SEQ ID NO: 96270 - protein, 13 aa, Mycobacterium tuberculosis
EIAALLSKLAENQ

SEQ ID NO: 96271 - protein, 13 aa, Mycobacterium tuberculosis
IAALLSKLAENQE

SEQ ID NO: 96272 - protein, 13 aa, Mycobacterium tuberculosis
AALLSKLAENQEM

SEQ ID NO: 96273 - protein, 14 aa, Mycobacterium tuberculosis
MTQTGKRQRRKFGR

SEQ ID NO: 96274 - protein, 14 aa, Mycobacterium tuberculosis
TQTGKRQRRKFGRI

SEQ ID NO: 96275 - protein, 14 aa, Mycobacterium tuberculosis
QTGKRQRRKFGRIR

SEQ ID NO: 96276 - protein, 14 aa, Mycobacterium tuberculosis
TGKRQRRKFGRIRQ

SEQ ID NO: 96277 - protein, 14 aa, Mycobacterium tuberculosis
GKRQRRKFGRIRQF

SEQ ID NO: 96278 - protein, 14 aa, Mycobacterium tuberculosis
KRQRRKFGRIRQFN

SEQ ID NO: 96279 - protein, 14 aa, Mycobacterium tuberculosis
RQRRKFGRIRQFNS

SEQ ID NO: 96280 - protein, 14 aa, Mycobacterium tuberculosis
QRRKFGRIRQFNSG

SEQ ID NO: 96281 - protein, 14 aa, Mycobacterium tuberculosis
RRKFGRIRQFNSGR

SEQ ID NO: 96282 - protein, 14 aa, Mycobacterium tuberculosis
RKFGRIRQFNSGRW

SEQ ID NO: 96283 - protein, 14 aa, Mycobacterium tuberculosis
KFGRIRQFNSGRWQ

SEQ ID NO: 96284 - protein, 14 aa, Mycobacterium tuberculosis
FGRIRQFNSGRWQA

SEQ ID NO: 96285 - protein, 14 aa, Mycobacterium tuberculosis
GRIRQFNSGRWQAS

SEQ ID NO: 96286 - protein, 14 aa, Mycobacterium tuberculosis
RIRQFNSGRWQASY

SEQ ID NO: 96287 - protein, 14 aa, Mycobacterium tuberculosis
IRQFNSGRWQASYT

SEQ ID NO: 96288 - protein, 14 aa, Mycobacterium tuberculosis
RQFNSGRWQASYTG

SEQ ID NO: 96289 - protein, 14 aa, Mycobacterium tuberculosis
QFNSGRWQASYTGP

SEQ ID NO: 96290 - protein, 14 aa, Mycobacterium tuberculosis
FNSGRWQASYTGPD

SEQ ID NO: 96291 - protein, 14 aa, Mycobacterium tuberculosis
NSGRWQASYTGPDG

SEQ ID NO: 96292 - protein, 14 aa, Mycobacterium tuberculosis
SGRWQASYTGPDGR

SEQ ID NO: 96293 - protein, 14 aa, Mycobacterium tuberculosis
GRWQASYTGPDGRV

SEQ ID NO: 96294 - protein, 14 aa, Mycobacterium tuberculosis
RWQASYTGPDGRVY

SEQ ID NO: 96295 - protein, 14 aa, Mycobacterium tuberculosis
WQASYTGPDGRVYI

SEQ ID NO: 96296 - protein, 14 aa, Mycobacterium tuberculosis
QASYTGPDGRVYIA

SEQ ID NO: 96297 - protein, 14 aa, Mycobacterium tuberculosis
ASYTGPDGRVYIAP

SEQ ID NO: 96298 - protein, 14 aa, Mycobacterium tuberculosis
SYTGPDGRVYIAPK

SEQ ID NO: 96299 - protein, 14 aa, Mycobacterium tuberculosis
YTGPDGRVYIAPKT

SEQ ID NO: 96300 - protein, 14 aa, Mycobacterium tuberculosis
TGPDGRVYIAPKTF

SEQ ID NO: 96301 - protein, 14 aa, Mycobacterium tuberculosis
GPDGRVYIAPKTFN

SEQ ID NO: 96302 - protein, 14 aa, Mycobacterium tuberculosis
PDGRVYIAPKTFNA

SEQ ID NO: 96303 - protein, 14 aa, Mycobacterium tuberculosis
DGRVYIAPKTFNAK

SEQ ID NO: 96304 - protein, 14 aa, Mycobacterium tuberculosis
GRVYIAPKTFNAKI

SEQ ID NO: 96305 - protein, 14 aa, Mycobacterium tuberculosis
RVYIAPKTFNAKID

SEQ ID NO: 96306 - protein, 14 aa, Mycobacterium tuberculosis
VYIAPKTFNAKIDA

SEQ ID NO: 96307 - protein, 14 aa, Mycobacterium tuberculosis
YIAPKTFNAKIDAE

SEQ ID NO: 96308 - protein, 14 aa, Mycobacterium tuberculosis
IAPKTFNAKIDAEA

SEQ ID NO: 96309 - protein, 14 aa, Mycobacterium tuberculosis
APKTFNAKIDAEAW

SEQ ID NO: 96310 - protein, 14 aa, Mycobacterium tuberculosis
PKTFNAKIDAEAWL

SEQ ID NO: 96311 - protein, 14 aa, Mycobacterium tuberculosis
KTFNAKIDAEAWLT

SEQ ID NO: 96312 - protein, 14 aa, Mycobacterium tuberculosis
TFNAKIDAEAWLTD

SEQ ID NO: 96313 - protein, 14 aa, Mycobacterium tuberculosis
FNAKIDAEAWLTDR

SEQ ID NO: 96314 - protein, 14 aa, Mycobacterium tuberculosis
NAKIDAEAWLTDRR

SEQ ID NO: 96315 - protein, 14 aa, Mycobacterium tuberculosis
AKIDAEAWLTDRRR

SEQ ID NO: 96316 - protein, 14 aa, Mycobacterium tuberculosis
KIDAEAWLTDRRRE

SEQ ID NO: 96317 - protein, 14 aa, Mycobacterium tuberculosis
IDAEAWLTDRRREI

SEQ ID NO: 96318 - protein, 14 aa, Mycobacterium tuberculosis
DAEAWLTDRRREID

SEQ ID NO: 96319 - protein, 14 aa, Mycobacterium tuberculosis
AEAWLTDRRREIDR

SEQ ID NO: 96320 - protein, 14 aa, Mycobacterium tuberculosis
EAWLTDRRREIDRQ

SEQ ID NO: 96321 - protein, 14 aa, Mycobacterium tuberculosis
AWLTDRRREIDRQL

SEQ ID NO: 96322 - protein, 14 aa, Mycobacterium tuberculosis
WLTDRRREIDRQLW

SEQ ID NO: 96323 - protein, 14 aa, Mycobacterium tuberculosis
LTDRRREIDRQLWS

SEQ ID NO: 96324 - protein, 14 aa, Mycobacterium tuberculosis
TDRRREIDRQLWSP

SEQ ID NO: 96325 - protein, 14 aa, Mycobacterium tuberculosis
DRRREIDRQLWSPA

SEQ ID NO: 96326 - protein, 14 aa, Mycobacterium tuberculosis
RRREIDRQLWSPAS

SEQ ID NO: 96327 - protein, 14 aa, Mycobacterium tuberculosis
RREIDRQLWSPASG

SEQ ID NO: 96328 - protein, 14 aa, Mycobacterium tuberculosis
REIDRQLWSPASGQ

SEQ ID NO: 96329 - protein, 14 aa, Mycobacterium tuberculosis
EIDRQLWSPASGQE

SEQ ID NO: 96330 - protein, 14 aa, Mycobacterium tuberculosis
IDRQLWSPASGQED

SEQ ID NO: 96331 - protein, 14 aa, Mycobacterium tuberculosis
DRQLWSPASGQEDR

SEQ ID NO: 96332 - protein, 14 aa, Mycobacterium tuberculosis
RQLWSPASGQEDRP

SEQ ID NO: 96333 - protein, 14 aa, Mycobacterium tuberculosis
QLWSPASGQEDRPG

SEQ ID NO: 96334 - protein, 14 aa, Mycobacterium tuberculosis
LWSPASGQEDRPGA

SEQ ID NO: 96335 - protein, 14 aa, Mycobacterium tuberculosis
WSPASGQEDRPGAP

SEQ ID NO: 96336 - protein, 14 aa, Mycobacterium tuberculosis
SPASGQEDRPGAPF

SEQ ID NO: 96337 - protein, 14 aa, Mycobacterium tuberculosis
PASGQEDRPGAPFG

SEQ ID NO: 96338 - protein, 14 aa, Mycobacterium tuberculosis
ASGQEDRPGAPFGE

SEQ ID NO: 96339 - protein, 14 aa, Mycobacterium tuberculosis
SGQEDRPGAPFGEY

SEQ ID NO: 96340 - protein, 14 aa, Mycobacterium tuberculosis
GQEDRPGAPFGEYA

SEQ ID NO: 96341 - protein, 14 aa, Mycobacterium tuberculosis
QEDRPGAPFGEYAE

SEQ ID NO: 96342 - protein, 14 aa, Mycobacterium tuberculosis
EDRPGAPFGEYAEG

SEQ ID NO: 96343 - protein, 14 aa, Mycobacterium tuberculosis
DRPGAPFGEYAEGW

SEQ ID NO: 96344 - protein, 14 aa, Mycobacterium tuberculosis
RPGAPFGEYAEGWL

SEQ ID NO: 96345 - protein, 14 aa, Mycobacterium tuberculosis
PGAPFGEYAEGWLK

SEQ ID NO: 96346 - protein, 14 aa, Mycobacterium tuberculosis
GAPFGEYAEGWLKQ

SEQ ID NO: 96347 - protein, 14 aa, Mycobacterium tuberculosis
APFGEYAEGWLKQR

SEQ ID NO: 96348 - protein, 14 aa, Mycobacterium tuberculosis
PFGEYAEGWLKQRG

SEQ ID NO: 96349 - protein, 14 aa, Mycobacterium tuberculosis
FGEYAEGWLKQRGI

SEQ ID NO: 96350 - protein, 14 aa, Mycobacterium tuberculosis
GEYAEGWLKQRGIK

SEQ ID NO: 96351 - protein, 14 aa, Mycobacterium tuberculosis
EYAEGWLKQRGIKD

SEQ ID NO: 96352 - protein, 14 aa, Mycobacterium tuberculosis
YAEGWLKQRGIKDR

SEQ ID NO: 96353 - protein, 14 aa, Mycobacterium tuberculosis
AEGWLKQRGIKDRT

SEQ ID NO: 96354 - protein, 14 aa, Mycobacterium tuberculosis
EGWLKQRGIKDRTR

SEQ ID NO: 96355 - protein, 14 aa, Mycobacterium tuberculosis
GWLKQRGIKDRTRA

SEQ ID NO: 96356 - protein, 14 aa, Mycobacterium tuberculosis
WLKQRGIKDRTRAH

SEQ ID NO: 96357 - protein, 14 aa, Mycobacterium tuberculosis
LKQRGIKDRTRAHY

SEQ ID NO: 96358 - protein, 14 aa, Mycobacterium tuberculosis
KQRGIKDRTRAHYR

SEQ ID NO: 96359 - protein, 14 aa, Mycobacterium tuberculosis
QRGIKDRTRAHYRK

SEQ ID NO: 96360 - protein, 14 aa, Mycobacterium tuberculosis
RGIKDRTRAHYRKL

SEQ ID NO: 96361 - protein, 14 aa, Mycobacterium tuberculosis
GIKDRTRAHYRKLL

SEQ ID NO: 96362 - protein, 14 aa, Mycobacterium tuberculosis
IKDRTRAHYRKLLD

SEQ ID NO: 96363 - protein, 14 aa, Mycobacterium tuberculosis
KDRTRAHYRKLLDN

SEQ ID NO: 96364 - protein, 14 aa, Mycobacterium tuberculosis
DRTRAHYRKLLDNH

SEQ ID NO: 96365 - protein, 14 aa, Mycobacterium tuberculosis
RTRAHYRKLLDNHI

SEQ ID NO: 96366 - protein, 14 aa, Mycobacterium tuberculosis
TRAHYRKLLDNHIL

SEQ ID NO: 96367 - protein, 14 aa, Mycobacterium tuberculosis
RAHYRKLLDNHILA

SEQ ID NO: 96368 - protein, 14 aa, Mycobacterium tuberculosis
AHYRKLLDNHILAT

SEQ ID NO: 96369 - protein, 14 aa, Mycobacterium tuberculosis
HYRKLLDNHILATF

SEQ ID NO: 96370 - protein, 14 aa, Mycobacterium tuberculosis
YRKLLDNHILATFA

SEQ ID NO: 96371 - protein, 14 aa, Mycobacterium tuberculosis
RKLLDNHILATFAD

SEQ ID NO: 96372 - protein, 14 aa, Mycobacterium tuberculosis
KLLDNHILATFADT

SEQ ID NO: 96373 - protein, 14 aa, Mycobacterium tuberculosis
LLDNHILATFADTD

SEQ ID NO: 96374 - protein, 14 aa, Mycobacterium tuberculosis
LDNHILATFADTDL

SEQ ID NO: 96375 - protein, 14 aa, Mycobacterium tuberculosis
DNHILATFADTDLR

SEQ ID NO: 96376 - protein, 14 aa, Mycobacterium tuberculosis
NHILATFADTDLRD

SEQ ID NO: 96377 - protein, 14 aa, Mycobacterium tuberculosis
HILATFADTDLRDI

SEQ ID NO: 96378 - protein, 14 aa, Mycobacterium tuberculosis
ILATFADTDLRDIT

SEQ ID NO: 96379 - protein, 14 aa, Mycobacterium tuberculosis
LATFADTDLRDITP

SEQ ID NO: 96380 - protein, 14 aa, Mycobacterium tuberculosis
ATFADTDLRDITPA

SEQ ID NO: 96381 - protein, 14 aa, Mycobacterium tuberculosis
TFADTDLRDITPAA

SEQ ID NO: 96382 - protein, 14 aa, Mycobacterium tuberculosis
FADTDLRDITPAAV

SEQ ID NO: 96383 - protein, 14 aa, Mycobacterium tuberculosis
ADTDLRDITPAAVR

SEQ ID NO: 96384 - protein, 14 aa, Mycobacterium tuberculosis
DTDLRDITPAAVRR

SEQ ID NO: 96385 - protein, 14 aa, Mycobacterium tuberculosis
TDLRDITPAAVRRW

SEQ ID NO: 96386 - protein, 14 aa, Mycobacterium tuberculosis
DLRDITPAAVRRWY

SEQ ID NO: 96387 - protein, 14 aa, Mycobacterium tuberculosis
LRDITPAAVRRWYA

SEQ ID NO: 96388 - protein, 14 aa, Mycobacterium tuberculosis
RDITPAAVRRWYAT

SEQ ID NO: 96389 - protein, 14 aa, Mycobacterium tuberculosis
DITPAAVRRWYATT

SEQ ID NO: 96390 - protein, 14 aa, Mycobacterium tuberculosis
ITPAAVRRWYATTA

SEQ ID NO: 96391 - protein, 14 aa, Mycobacterium tuberculosis
TPAAVRRWYATTAV

SEQ ID NO: 96392 - protein, 14 aa, Mycobacterium tuberculosis
PAAVRRWYATTAVG

SEQ ID NO: 96393 - protein, 14 aa, Mycobacterium tuberculosis
AAVRRWYATTAVGT

SEQ ID NO: 96394 - protein, 14 aa, Mycobacterium tuberculosis
AVRRWYATTAVGTP

SEQ ID NO: 96395 - protein, 14 aa, Mycobacterium tuberculosis
VRRWYATTAVGTPT

SEQ ID NO: 96396 - protein, 14 aa, Mycobacterium tuberculosis
RRWYATTAVGTPTM

SEQ ID NO: 96397 - protein, 14 aa, Mycobacterium tuberculosis
RWYATTAVGTPTMR

SEQ ID NO: 96398 - protein, 14 aa, Mycobacterium tuberculosis
WYATTAVGTPTMRA

SEQ ID NO: 96399 - protein, 14 aa, Mycobacterium tuberculosis
YATTAVGTPTMRAH

SEQ ID NO: 96400 - protein, 14 aa, Mycobacterium tuberculosis
ATTAVGTPTMRAHS

SEQ ID NO: 96401 - protein, 14 aa, Mycobacterium tuberculosis
TTAVGTPTMRAHSY

SEQ ID NO: 96402 - protein, 14 aa, Mycobacterium tuberculosis
TAVGTPTMRAHSYS

SEQ ID NO: 96403 - protein, 14 aa, Mycobacterium tuberculosis
AVGTPTMRAHSYSL

SEQ ID NO: 96404 - protein, 14 aa, Mycobacterium tuberculosis
VGTPTMRAHSYSLL

SEQ ID NO: 96405 - protein, 14 aa, Mycobacterium tuberculosis
GTPTMRAHSYSLLR

SEQ ID NO: 96406 - protein, 14 aa, Mycobacterium tuberculosis
TPTMRAHSYSLLRA

SEQ ID NO: 96407 - protein, 14 aa, Mycobacterium tuberculosis
PTMRAHSYSLLRAI

SEQ ID NO: 96408 - protein, 14 aa, Mycobacterium tuberculosis
TMRAHSYSLLRAIM

SEQ ID NO: 96409 - protein, 14 aa, Mycobacterium tuberculosis
MRAHSYSLLRAIMQ

SEQ ID NO: 96410 - protein, 14 aa, Mycobacterium tuberculosis
RAHSYSLLRAIMQT

SEQ ID NO: 96411 - protein, 14 aa, Mycobacterium tuberculosis
AHSYSLLRAIMQTA

SEQ ID NO: 96412 - protein, 14 aa, Mycobacterium tuberculosis
HSYSLLRAIMQTAL

SEQ ID NO: 96413 - protein, 14 aa, Mycobacterium tuberculosis
SYSLLRAIMQTALA

SEQ ID NO: 96414 - protein, 14 aa, Mycobacterium tuberculosis
YSLLRAIMQTALAD

SEQ ID NO: 96415 - protein, 14 aa, Mycobacterium tuberculosis
SLLRAIMQTALADD

SEQ ID NO: 96416 - protein, 14 aa, Mycobacterium tuberculosis
LLRAIMQTALADDL

SEQ ID NO: 96417 - protein, 14 aa, Mycobacterium tuberculosis
LRAIMQTALADDLI

SEQ ID NO: 96418 - protein, 14 aa, Mycobacterium tuberculosis
RAIMQTALADDLID

SEQ ID NO: 96419 - protein, 14 aa, Mycobacterium tuberculosis
AIMQTALADDLIDS

SEQ ID NO: 96420 - protein, 14 aa, Mycobacterium tuberculosis
IMQTALADDLIDSN

SEQ ID NO: 96421 - protein, 14 aa, Mycobacterium tuberculosis
MQTALADDLIDSNP

SEQ ID NO: 96422 - protein, 14 aa, Mycobacterium tuberculosis
QTALADDLIDSNPC

SEQ ID NO: 96423 - protein, 14 aa, Mycobacterium tuberculosis
TALADDLIDSNPCR

SEQ ID NO: 96424 - protein, 14 aa, Mycobacterium tuberculosis
ALADDLIDSNPCRI

SEQ ID NO: 96425 - protein, 14 aa, Mycobacterium tuberculosis
LADDLIDSNPCRIS

SEQ ID NO: 96426 - protein, 14 aa, Mycobacterium tuberculosis
ADDLIDSNPCRISG

SEQ ID NO: 96427 - protein, 14 aa, Mycobacterium tuberculosis
DDLIDSNPCRISGA

SEQ ID NO: 96428 - protein, 14 aa, Mycobacterium tuberculosis
DLIDSNPCRISGAS

SEQ ID NO: 96429 - protein, 14 aa, Mycobacterium tuberculosis
LIDSNPCRISGAST

SEQ ID NO: 96430 - protein, 14 aa, Mycobacterium tuberculosis
IDSNPCRISGASTA

SEQ ID NO: 96431 - protein, 14 aa, Mycobacterium tuberculosis
DSNPCRISGASTAR

SEQ ID NO: 96432 - protein, 14 aa, Mycobacterium tuberculosis
SNPCRISGASTARR

SEQ ID NO: 96433 - protein, 14 aa, Mycobacterium tuberculosis
NPCRISGASTARRV

SEQ ID NO: 96434 - protein, 14 aa, Mycobacterium tuberculosis
PCRISGASTARRVH

SEQ ID NO: 96435 - protein, 14 aa, Mycobacterium tuberculosis
CRISGASTARRVHK

SEQ ID NO: 96436 - protein, 14 aa, Mycobacterium tuberculosis
RISGASTARRVHKI

SEQ ID NO: 96437 - protein, 14 aa, Mycobacterium tuberculosis
ISGASTARRVHKIR

SEQ ID NO: 96438 - protein, 14 aa, Mycobacterium tuberculosis
SGASTARRVHKIRP

SEQ ID NO: 96439 - protein, 14 aa, Mycobacterium tuberculosis
GASTARRVHKIRPA

SEQ ID NO: 96440 - protein, 14 aa, Mycobacterium tuberculosis
ASTARRVHKIRPAT

SEQ ID NO: 96441 - protein, 14 aa, Mycobacterium tuberculosis
STARRVHKIRPATL

SEQ ID NO: 96442 - protein, 14 aa, Mycobacterium tuberculosis
TARRVHKIRPATLD

SEQ ID NO: 96443 - protein, 14 aa, Mycobacterium tuberculosis
ARRVHKIRPATLDE

SEQ ID NO: 96444 - protein, 14 aa, Mycobacterium tuberculosis
RRVHKIRPATLDEL

SEQ ID NO: 96445 - protein, 14 aa, Mycobacterium tuberculosis
RVHKIRPATLDELE

SEQ ID NO: 96446 - protein, 14 aa, Mycobacterium tuberculosis
VHKIRPATLDELET

SEQ ID NO: 96447 - protein, 14 aa, Mycobacterium tuberculosis
HKIRPATLDELETI

SEQ ID NO: 96448 - protein, 14 aa, Mycobacterium tuberculosis
KIRPATLDELETIT

SEQ ID NO: 96449 - protein, 14 aa, Mycobacterium tuberculosis
IRPATLDELETITK

SEQ ID NO: 96450 - protein, 14 aa, Mycobacterium tuberculosis
RPATLDELETITKA

SEQ ID NO: 96451 - protein, 14 aa, Mycobacterium tuberculosis
PATLDELETITKAM

SEQ ID NO: 96452 - protein, 14 aa, Mycobacterium tuberculosis
ATLDELETITKAMP

SEQ ID NO: 96453 - protein, 14 aa, Mycobacterium tuberculosis
TLDELETITKAMPD

SEQ ID NO: 96454 - protein, 14 aa, Mycobacterium tuberculosis
LDELETITKAMPDP

SEQ ID NO: 96455 - protein, 14 aa, Mycobacterium tuberculosis
DELETITKAMPDPY

SEQ ID NO: 96456 - protein, 14 aa, Mycobacterium tuberculosis
ELETITKAMPDPYQ

SEQ ID NO: 96457 - protein, 14 aa, Mycobacterium tuberculosis
LETITKAMPDPYQA

SEQ ID NO: 96458 - protein, 14 aa, Mycobacterium tuberculosis
ETITKAMPDPYQAF

SEQ ID NO: 96459 - protein, 14 aa, Mycobacterium tuberculosis
TITKAMPDPYQAFV

SEQ ID NO: 96460 - protein, 14 aa, Mycobacterium tuberculosis
ITKAMPDPYQAFVL

SEQ ID NO: 96461 - protein, 14 aa, Mycobacterium tuberculosis
TKAMPDPYQAFVLM

SEQ ID NO: 96462 - protein, 14 aa, Mycobacterium tuberculosis
KAMPDPYQAFVLMA

SEQ ID NO: 96463 - protein, 14 aa, Mycobacterium tuberculosis
AMPDPYQAFVLMAA

SEQ ID NO: 96464 - protein, 14 aa, Mycobacterium tuberculosis
MPDPYQAFVLMAAW

SEQ ID NO: 96465 - protein, 14 aa, Mycobacterium tuberculosis
PDPYQAFVLMAAWL

SEQ ID NO: 96466 - protein, 14 aa, Mycobacterium tuberculosis
DPYQAFVLMAAWLA

SEQ ID NO: 96467 - protein, 14 aa, Mycobacterium tuberculosis
PYQAFVLMAAWLAM

SEQ ID NO: 96468 - protein, 14 aa, Mycobacterium tuberculosis
YQAFVLMAAWLAMR

SEQ ID NO: 96469 - protein, 14 aa, Mycobacterium tuberculosis
QAFVLMAAWLAMRY

SEQ ID NO: 96470 - protein, 14 aa, Mycobacterium tuberculosis
AFVLMAAWLAMRYG

SEQ ID NO: 96471 - protein, 14 aa, Mycobacterium tuberculosis
FVLMAAWLAMRYGE

SEQ ID NO: 96472 - protein, 14 aa, Mycobacterium tuberculosis
VLMAAWLAMRYGEL

SEQ ID NO: 96473 - protein, 14 aa, Mycobacterium tuberculosis
LMAAWLAMRYGELT

SEQ ID NO: 96474 - protein, 14 aa, Mycobacterium tuberculosis
MAAWLAMRYGELTE

SEQ ID NO: 96475 - protein, 14 aa, Mycobacterium tuberculosis
AAWLAMRYGELTEL

SEQ ID NO: 96476 - protein, 14 aa, Mycobacterium tuberculosis
AWLAMRYGELTELR

SEQ ID NO: 96477 - protein, 14 aa, Mycobacterium tuberculosis
WLAMRYGELTELRR

SEQ ID NO: 96478 - protein, 14 aa, Mycobacterium tuberculosis
LAMRYGELTELRRK

SEQ ID NO: 96479 - protein, 14 aa, Mycobacterium tuberculosis
AMRYGELTELRRKD

SEQ ID NO: 96480 - protein, 14 aa, Mycobacterium tuberculosis
MRYGELTELRRKDI

SEQ ID NO: 96481 - protein, 14 aa, Mycobacterium tuberculosis
RYGELTELRRKDID

SEQ ID NO: 96482 - protein, 14 aa, Mycobacterium tuberculosis
YGELTELRRKDIDL

SEQ ID NO: 96483 - protein, 14 aa, Mycobacterium tuberculosis
GELTELRRKDIDLH

SEQ ID NO: 96484 - protein, 14 aa, Mycobacterium tuberculosis
ELTELRRKDIDLHG

SEQ ID NO: 96485 - protein, 14 aa, Mycobacterium tuberculosis
LTELRRKDIDLHGE

SEQ ID NO: 96486 - protein, 14 aa, Mycobacterium tuberculosis
TELRRKDIDLHGEV

SEQ ID NO: 96487 - protein, 14 aa, Mycobacterium tuberculosis
ELRRKDIDLHGEVA

SEQ ID NO: 96488 - protein, 14 aa, Mycobacterium tuberculosis
LRRKDIDLHGEVAR

SEQ ID NO: 96489 - protein, 14 aa, Mycobacterium tuberculosis
RRKDIDLHGEVARV

SEQ ID NO: 96490 - protein, 14 aa, Mycobacterium tuberculosis
RKDIDLHGEVARVR

SEQ ID NO: 96491 - protein, 14 aa, Mycobacterium tuberculosis
KDIDLHGEVARVRR

SEQ ID NO: 96492 - protein, 14 aa, Mycobacterium tuberculosis
DIDLHGEVARVRRA

SEQ ID NO: 96493 - protein, 14 aa, Mycobacterium tuberculosis
IDLHGEVARVRRAV

SEQ ID NO: 96494 - protein, 14 aa, Mycobacterium tuberculosis
DLHGEVARVRRAVV

SEQ ID NO: 96495 - protein, 14 aa, Mycobacterium tuberculosis
LHGEVARVRRAVVR

SEQ ID NO: 96496 - protein, 14 aa, Mycobacterium tuberculosis
HGEVARVRRAVVRV

SEQ ID NO: 96497 - protein, 14 aa, Mycobacterium tuberculosis
GEVARVRRAVVRVG

SEQ ID NO: 96498 - protein, 14 aa, Mycobacterium tuberculosis
EVARVRRAVVRVGE

SEQ ID NO: 96499 - protein, 14 aa, Mycobacterium tuberculosis
VARVRRAVVRVGEG

SEQ ID NO: 96500 - protein, 14 aa, Mycobacterium tuberculosis
ARVRRAVVRVGEGF

SEQ ID NO: 96501 - protein, 14 aa, Mycobacterium tuberculosis
RVRRAVVRVGEGFK

SEQ ID NO: 96502 - protein, 14 aa, Mycobacterium tuberculosis
VRRAVVRVGEGFKV

SEQ ID NO: 96503 - protein, 14 aa, Mycobacterium tuberculosis
RRAVVRVGEGFKVT

SEQ ID NO: 96504 - protein, 14 aa, Mycobacterium tuberculosis
RAVVRVGEGFKVTT

SEQ ID NO: 96505 - protein, 14 aa, Mycobacterium tuberculosis
AVVRVGEGFKVTTP

SEQ ID NO: 96506 - protein, 14 aa, Mycobacterium tuberculosis
VVRVGEGFKVTTPK

SEQ ID NO: 96507 - protein, 14 aa, Mycobacterium tuberculosis
VRVGEGFKVTTPKS

SEQ ID NO: 96508 - protein, 14 aa, Mycobacterium tuberculosis
RVGEGFKVTTPKSD

SEQ ID NO: 96509 - protein, 14 aa, Mycobacterium tuberculosis
VGEGFKVTTPKSDA

SEQ ID NO: 96510 - protein, 14 aa, Mycobacterium tuberculosis
GEGFKVTTPKSDAG

SEQ ID NO: 96511 - protein, 14 aa, Mycobacterium tuberculosis
EGFKVTTPKSDAGV

SEQ ID NO: 96512 - protein, 14 aa, Mycobacterium tuberculosis
GFKVTTPKSDAGVR

SEQ ID NO: 96513 - protein, 14 aa, Mycobacterium tuberculosis
FKVTTPKSDAGVRD

SEQ ID NO: 96514 - protein, 14 aa, Mycobacterium tuberculosis
KVTTPKSDAGVRDI

SEQ ID NO: 96515 - protein, 14 aa, Mycobacterium tuberculosis
VTTPKSDAGVRDIS

SEQ ID NO: 96516 - protein, 14 aa, Mycobacterium tuberculosis
TTPKSDAGVRDISI

SEQ ID NO: 96517 - protein, 14 aa, Mycobacterium tuberculosis
TPKSDAGVRDISIP

SEQ ID NO: 96518 - protein, 14 aa, Mycobacterium tuberculosis
PKSDAGVRDISIPP

SEQ ID NO: 96519 - protein, 14 aa, Mycobacterium tuberculosis
KSDAGVRDISIPPH

SEQ ID NO: 96520 - protein, 14 aa, Mycobacterium tuberculosis
SDAGVRDISIPPHL

SEQ ID NO: 96521 - protein, 14 aa, Mycobacterium tuberculosis
DAGVRDISIPPHLI

SEQ ID NO: 96522 - protein, 14 aa, Mycobacterium tuberculosis
AGVRDISIPPHLIP

SEQ ID NO: 96523 - protein, 14 aa, Mycobacterium tuberculosis
GVRDISIPPHLIPA

SEQ ID NO: 96524 - protein, 14 aa, Mycobacterium tuberculosis
VRDISIPPHLIPAI

SEQ ID NO: 96525 - protein, 14 aa, Mycobacterium tuberculosis
RDISIPPHLIPAIE

SEQ ID NO: 96526 - protein, 14 aa, Mycobacterium tuberculosis
DISIPPHLIPAIED

SEQ ID NO: 96527 - protein, 14 aa, Mycobacterium tuberculosis
ISIPPHLIPAIEDH

SEQ ID NO: 96528 - protein, 14 aa, Mycobacterium tuberculosis
SIPPHLIPAIEDHL

SEQ ID NO: 96529 - protein, 14 aa, Mycobacterium tuberculosis
IPPHLIPAIEDHLH

SEQ ID NO: 96530 - protein, 14 aa, Mycobacterium tuberculosis
PPHLIPAIEDHLHK

SEQ ID NO: 96531 - protein, 14 aa, Mycobacterium tuberculosis
PHLIPAIEDHLHKH

SEQ ID NO: 96532 - protein, 14 aa, Mycobacterium tuberculosis
HLIPAIEDHLHKHV

SEQ ID NO: 96533 - protein, 14 aa, Mycobacterium tuberculosis
LIPAIEDHLHKHVN

SEQ ID NO: 96534 - protein, 14 aa, Mycobacterium tuberculosis
IPAIEDHLHKHVNP

SEQ ID NO: 96535 - protein, 14 aa, Mycobacterium tuberculosis
PAIEDHLHKHVNPG

SEQ ID NO: 96536 - protein, 14 aa, Mycobacterium tuberculosis
AIEDHLHKHVNPGR

SEQ ID NO: 96537 - protein, 14 aa, Mycobacterium tuberculosis
IEDHLHKHVNPGRE

SEQ ID NO: 96538 - protein, 14 aa, Mycobacterium tuberculosis
EDHLHKHVNPGRES

SEQ ID NO: 96539 - protein, 14 aa, Mycobacterium tuberculosis
DHLHKHVNPGRESL

SEQ ID NO: 96540 - protein, 14 aa, Mycobacterium tuberculosis
HLHKHVNPGRESLL

SEQ ID NO: 96541 - protein, 14 aa, Mycobacterium tuberculosis
LHKHVNPGRESLLF

SEQ ID NO: 96542 - protein, 14 aa, Mycobacterium tuberculosis
HKHVNPGRESLLFP

SEQ ID NO: 96543 - protein, 14 aa, Mycobacterium tuberculosis
KHVNPGRESLLFPS

SEQ ID NO: 96544 - protein, 14 aa, Mycobacterium tuberculosis
HVNPGRESLLFPSV

SEQ ID NO: 96545 - protein, 14 aa, Mycobacterium tuberculosis
VNPGRESLLFPSVN

SEQ ID NO: 96546 - protein, 14 aa, Mycobacterium tuberculosis
NPGRESLLFPSVND

SEQ ID NO: 96547 - protein, 14 aa, Mycobacterium tuberculosis
PGRESLLFPSVNDP

SEQ ID NO: 96548 - protein, 14 aa, Mycobacterium tuberculosis
GRESLLFPSVNDPN

SEQ ID NO: 96549 - protein, 14 aa, Mycobacterium tuberculosis
RESLLFPSVNDPNR

SEQ ID NO: 96550 - protein, 14 aa, Mycobacterium tuberculosis
ESLLFPSVNDPNRH

SEQ ID NO: 96551 - protein, 14 aa, Mycobacterium tuberculosis
SLLFPSVNDPNRHL

SEQ ID NO: 96552 - protein, 14 aa, Mycobacterium tuberculosis
LLFPSVNDPNRHLA

SEQ ID NO: 96553 - protein, 14 aa, Mycobacterium tuberculosis
LFPSVNDPNRHLAP

SEQ ID NO: 96554 - protein, 14 aa, Mycobacterium tuberculosis
FPSVNDPNRHLAPS

SEQ ID NO: 96555 - protein, 14 aa, Mycobacterium tuberculosis
PSVNDPNRHLAPSA

SEQ ID NO: 96556 - protein, 14 aa, Mycobacterium tuberculosis
SVNDPNRHLAPSAL

SEQ ID NO: 96557 - protein, 14 aa, Mycobacterium tuberculosis
VNDPNRHLAPSALY

SEQ ID NO: 96558 - protein, 14 aa, Mycobacterium tuberculosis
NDPNRHLAPSALYR

SEQ ID NO: 96559 - protein, 14 aa, Mycobacterium tuberculosis
DPNRHLAPSALYRM

SEQ ID NO: 96560 - protein, 14 aa, Mycobacterium tuberculosis
PNRHLAPSALYRMF

SEQ ID NO: 96561 - protein, 14 aa, Mycobacterium tuberculosis
NRHLAPSALYRMFY

SEQ ID NO: 96562 - protein, 14 aa, Mycobacterium tuberculosis
RHLAPSALYRMFYK

SEQ ID NO: 96563 - protein, 14 aa, Mycobacterium tuberculosis
HLAPSALYRMFYKA

SEQ ID NO: 96564 - protein, 14 aa, Mycobacterium tuberculosis
LAPSALYRMFYKAR

SEQ ID NO: 96565 - protein, 14 aa, Mycobacterium tuberculosis
APSALYRMFYKARK

SEQ ID NO: 96566 - protein, 14 aa, Mycobacterium tuberculosis
PSALYRMFYKARKA

SEQ ID NO: 96567 - protein, 14 aa, Mycobacterium tuberculosis
SALYRMFYKARKAA

SEQ ID NO: 96568 - protein, 14 aa, Mycobacterium tuberculosis
ALYRMFYKARKAAG

SEQ ID NO: 96569 - protein, 14 aa, Mycobacterium tuberculosis
LYRMFYKARKAAGR

SEQ ID NO: 96570 - protein, 14 aa, Mycobacterium tuberculosis
YRMFYKARKAAGRP

SEQ ID NO: 96571 - protein, 14 aa, Mycobacterium tuberculosis
RMFYKARKAAGRPD

SEQ ID NO: 96572 - protein, 14 aa, Mycobacterium tuberculosis
MFYKARKAAGRPDL

SEQ ID NO: 96573 - protein, 14 aa, Mycobacterium tuberculosis
FYKARKAAGRPDLR

SEQ ID NO: 96574 - protein, 14 aa, Mycobacterium tuberculosis
YKARKAAGRPDLRV

SEQ ID NO: 96575 - protein, 14 aa, Mycobacterium tuberculosis
KARKAAGRPDLRVH

SEQ ID NO: 96576 - protein, 14 aa, Mycobacterium tuberculosis
ARKAAGRPDLRVHD

SEQ ID NO: 96577 - protein, 14 aa, Mycobacterium tuberculosis
RKAAGRPDLRVHDL

SEQ ID NO: 96578 - protein, 14 aa, Mycobacterium tuberculosis
KAAGRPDLRVHDLR

SEQ ID NO: 96579 - protein, 14 aa, Mycobacterium tuberculosis
AAGRPDLRVHDLRH

SEQ ID NO: 96580 - protein, 14 aa, Mycobacterium tuberculosis
AGRPDLRVHDLRHS

SEQ ID NO: 96581 - protein, 14 aa, Mycobacterium tuberculosis
GRPDLRVHDLRHSG

SEQ ID NO: 96582 - protein, 14 aa, Mycobacterium tuberculosis
RPDLRVHDLRHSGA

SEQ ID NO: 96583 - protein, 14 aa, Mycobacterium tuberculosis
PDLRVHDLRHSGAV

SEQ ID NO: 96584 - protein, 14 aa, Mycobacterium tuberculosis
DLRVHDLRHSGAVL

SEQ ID NO: 96585 - protein, 14 aa, Mycobacterium tuberculosis
LRVHDLRHSGAVLA

SEQ ID NO: 96586 - protein, 14 aa, Mycobacterium tuberculosis
RVHDLRHSGAVLAA

SEQ ID NO: 96587 - protein, 14 aa, Mycobacterium tuberculosis
VHDLRHSGAVLAAS

SEQ ID NO: 96588 - protein, 14 aa, Mycobacterium tuberculosis
HDLRHSGAVLAAST

SEQ ID NO: 96589 - protein, 14 aa, Mycobacterium tuberculosis
DLRHSGAVLAASTG

SEQ ID NO: 96590 - protein, 14 aa, Mycobacterium tuberculosis
LRHSGAVLAASTGA

SEQ ID NO: 96591 - protein, 14 aa, Mycobacterium tuberculosis
RHSGAVLAASTGAT

SEQ ID NO: 96592 - protein, 14 aa, Mycobacterium tuberculosis
HSGAVLAASTGATL

SEQ ID NO: 96593 - protein, 14 aa, Mycobacterium tuberculosis
SGAVLAASTGATLA

SEQ ID NO: 96594 - protein, 14 aa, Mycobacterium tuberculosis
GAVLAASTGATLAE

SEQ ID NO: 96595 - protein, 14 aa, Mycobacterium tuberculosis
AVLAASTGATLAEL

SEQ ID NO: 96596 - protein, 14 aa, Mycobacterium tuberculosis
VLAASTGATLAELM

SEQ ID NO: 96597 - protein, 14 aa, Mycobacterium tuberculosis
LAASTGATLAELMQ

SEQ ID NO: 96598 - protein, 14 aa, Mycobacterium tuberculosis
AASTGATLAELMQR

SEQ ID NO: 96599 - protein, 14 aa, Mycobacterium tuberculosis
ASTGATLAELMQRL

SEQ ID NO: 96600 - protein, 14 aa, Mycobacterium tuberculosis
STGATLAELMQRLG

SEQ ID NO: 96601 - protein, 14 aa, Mycobacterium tuberculosis
TGATLAELMQRLGH

SEQ ID NO: 96602 - protein, 14 aa, Mycobacterium tuberculosis
GATLAELMQRLGHS

SEQ ID NO: 96603 - protein, 14 aa, Mycobacterium tuberculosis
ATLAELMQRLGHST

SEQ ID NO: 96604 - protein, 14 aa, Mycobacterium tuberculosis
TLAELMQRLGHSTA

SEQ ID NO: 96605 - protein, 14 aa, Mycobacterium tuberculosis
LAELMQRLGHSTAG

SEQ ID NO: 96606 - protein, 14 aa, Mycobacterium tuberculosis
AELMQRLGHSTAGA

SEQ ID NO: 96607 - protein, 14 aa, Mycobacterium tuberculosis
ELMQRLGHSTAGAA

SEQ ID NO: 96608 - protein, 14 aa, Mycobacterium tuberculosis
LMQRLGHSTAGAAL

SEQ ID NO: 96609 - protein, 14 aa, Mycobacterium tuberculosis
MQRLGHSTAGAALR

SEQ ID NO: 96610 - protein, 14 aa, Mycobacterium tuberculosis
QRLGHSTAGAALRY

SEQ ID NO: 96611 - protein, 14 aa, Mycobacterium tuberculosis
RLGHSTAGAALRYQ

SEQ ID NO: 96612 - protein, 14 aa, Mycobacterium tuberculosis
LGHSTAGAALRYQH

SEQ ID NO: 96613 - protein, 14 aa, Mycobacterium tuberculosis
GHSTAGAALRYQHA

SEQ ID NO: 96614 - protein, 14 aa, Mycobacterium tuberculosis
HSTAGAALRYQHAA

SEQ ID NO: 96615 - protein, 14 aa, Mycobacterium tuberculosis
STAGAALRYQHAAK

SEQ ID NO: 96616 - protein, 14 aa, Mycobacterium tuberculosis
TAGAALRYQHAAKG

SEQ ID NO: 96617 - protein, 14 aa, Mycobacterium tuberculosis
AGAALRYQHAAKGR

SEQ ID NO: 96618 - protein, 14 aa, Mycobacterium tuberculosis
GAALRYQHAAKGRD

SEQ ID NO: 96619 - protein, 14 aa, Mycobacterium tuberculosis
AALRYQHAAKGRDR

SEQ ID NO: 96620 - protein, 14 aa, Mycobacterium tuberculosis
ALRYQHAAKGRDRE

SEQ ID NO: 96621 - protein, 14 aa, Mycobacterium tuberculosis
LRYQHAAKGRDREI

SEQ ID NO: 96622 - protein, 14 aa, Mycobacterium tuberculosis
RYQHAAKGRDREIA

SEQ ID NO: 96623 - protein, 14 aa, Mycobacterium tuberculosis
YQHAAKGRDREIAA

SEQ ID NO: 96624 - protein, 14 aa, Mycobacterium tuberculosis
QHAAKGRDREIAAL

SEQ ID NO: 96625 - protein, 14 aa, Mycobacterium tuberculosis
HAAKGRDREIAALL

SEQ ID NO: 96626 - protein, 14 aa, Mycobacterium tuberculosis
AAKGRDREIAALLS

SEQ ID NO: 96627 - protein, 14 aa, Mycobacterium tuberculosis
AKGRDREIAALLSK

SEQ ID NO: 96628 - protein, 14 aa, Mycobacterium tuberculosis
KGRDREIAALLSKL

SEQ ID NO: 96629 - protein, 14 aa, Mycobacterium tuberculosis
GRDREIAALLSKLA

SEQ ID NO: 96630 - protein, 14 aa, Mycobacterium tuberculosis
RDREIAALLSKLAE

SEQ ID NO: 96631 - protein, 14 aa, Mycobacterium tuberculosis
DREIAALLSKLAEN

SEQ ID NO: 96632 - protein, 14 aa, Mycobacterium tuberculosis
REIAALLSKLAENQ

SEQ ID NO: 96633 - protein, 14 aa, Mycobacterium tuberculosis
EIAALLSKLAENQE

SEQ ID NO: 96634 - protein, 14 aa, Mycobacterium tuberculosis
IAALLSKLAENQEM

SEQ ID NO: 96635 - protein, 15 aa, Mycobacterium tuberculosis
MTQTGKRQRRKFGRI

SEQ ID NO: 96636 - protein, 15 aa, Mycobacterium tuberculosis
TQTGKRQRRKFGRIR

SEQ ID NO: 96637 - protein, 15 aa, Mycobacterium tuberculosis
QTGKRQRRKFGRIRQ

SEQ ID NO: 96638 - protein, 15 aa, Mycobacterium tuberculosis
TGKRQRRKFGRIRQF

SEQ ID NO: 96639 - protein, 15 aa, Mycobacterium tuberculosis
GKRQRRKFGRIRQFN

SEQ ID NO: 96640 - protein, 15 aa, Mycobacterium tuberculosis
KRQRRKFGRIRQFNS

SEQ ID NO: 96641 - protein, 15 aa, Mycobacterium tuberculosis
RQRRKFGRIRQFNSG

SEQ ID NO: 96642 - protein, 15 aa, Mycobacterium tuberculosis
QRRKFGRIRQFNSGR

SEQ ID NO: 96643 - protein, 15 aa, Mycobacterium tuberculosis
RRKFGRIRQFNSGRW

SEQ ID NO: 96644 - protein, 15 aa, Mycobacterium tuberculosis
RKFGRIRQFNSGRWQ

SEQ ID NO: 96645 - protein, 15 aa, Mycobacterium tuberculosis
KFGRIRQFNSGRWQA

SEQ ID NO: 96646 - protein, 15 aa, Mycobacterium tuberculosis
FGRIRQFNSGRWQAS

SEQ ID NO: 96647 - protein, 15 aa, Mycobacterium tuberculosis
GRIRQFNSGRWQASY

SEQ ID NO: 96648 - protein, 15 aa, Mycobacterium tuberculosis
RIRQFNSGRWQASYT

SEQ ID NO: 96649 - protein, 15 aa, Mycobacterium tuberculosis
IRQFNSGRWQASYTG

SEQ ID NO: 96650 - protein, 15 aa, Mycobacterium tuberculosis
RQFNSGRWQASYTGP

SEQ ID NO: 96651 - protein, 15 aa, Mycobacterium tuberculosis
QFNSGRWQASYTGPD

SEQ ID NO: 96652 - protein, 15 aa, Mycobacterium tuberculosis
FNSGRWQASYTGPDG

SEQ ID NO: 96653 - protein, 15 aa, Mycobacterium tuberculosis
NSGRWQASYTGPDGR

SEQ ID NO: 96654 - protein, 15 aa, Mycobacterium tuberculosis
SGRWQASYTGPDGRV

SEQ ID NO: 96655 - protein, 15 aa, Mycobacterium tuberculosis
GRWQASYTGPDGRVY

SEQ ID NO: 96656 - protein, 15 aa, Mycobacterium tuberculosis
RWQASYTGPDGRVYI

SEQ ID NO: 96657 - protein, 15 aa, Mycobacterium tuberculosis
WQASYTGPDGRVYIA

SEQ ID NO: 96658 - protein, 15 aa, Mycobacterium tuberculosis
QASYTGPDGRVYIAP

SEQ ID NO: 96659 - protein, 15 aa, Mycobacterium tuberculosis
ASYTGPDGRVYIAPK

SEQ ID NO: 96660 - protein, 15 aa, Mycobacterium tuberculosis
SYTGPDGRVYIAPKT

SEQ ID NO: 96661 - protein, 15 aa, Mycobacterium tuberculosis
YTGPDGRVYIAPKTF

SEQ ID NO: 96662 - protein, 15 aa, Mycobacterium tuberculosis
TGPDGRVYIAPKTFN

SEQ ID NO: 96663 - protein, 15 aa, Mycobacterium tuberculosis
GPDGRVYIAPKTFNA

SEQ ID NO: 96664 - protein, 15 aa, Mycobacterium tuberculosis
PDGRVYIAPKTFNAK

SEQ ID NO: 96665 - protein, 15 aa, Mycobacterium tuberculosis
DGRVYIAPKTFNAKI

SEQ ID NO: 96666 - protein, 15 aa, Mycobacterium tuberculosis
GRVYIAPKTFNAKID

SEQ ID NO: 96667 - protein, 15 aa, Mycobacterium tuberculosis
RVYIAPKTFNAKIDA

SEQ ID NO: 96668 - protein, 15 aa, Mycobacterium tuberculosis
VYIAPKTFNAKIDAE

SEQ ID NO: 96669 - protein, 15 aa, Mycobacterium tuberculosis
YIAPKTFNAKIDAEA

SEQ ID NO: 96670 - protein, 15 aa, Mycobacterium tuberculosis
IAPKTFNAKIDAEAW

SEQ ID NO: 96671 - protein, 15 aa, Mycobacterium tuberculosis
APKTFNAKIDAEAWL

SEQ ID NO: 96672 - protein, 15 aa, Mycobacterium tuberculosis
PKTFNAKIDAEAWLT

SEQ ID NO: 96673 - protein, 15 aa, Mycobacterium tuberculosis
KTFNAKIDAEAWLTD

SEQ ID NO: 96674 - protein, 15 aa, Mycobacterium tuberculosis
TFNAKIDAEAWLTDR

SEQ ID NO: 96675 - protein, 15 aa, Mycobacterium tuberculosis
FNAKIDAEAWLTDRR

SEQ ID NO: 96676 - protein, 15 aa, Mycobacterium tuberculosis
NAKIDAEAWLTDRRR

SEQ ID NO: 96677 - protein, 15 aa, Mycobacterium tuberculosis
AKIDAEAWLTDRRRE

SEQ ID NO: 96678 - protein, 15 aa, Mycobacterium tuberculosis
KIDAEAWLTDRRREI

SEQ ID NO: 96679 - protein, 15 aa, Mycobacterium tuberculosis
IDAEAWLTDRRREID

SEQ ID NO: 96680 - protein, 15 aa, Mycobacterium tuberculosis
DAEAWLTDRRREIDR

SEQ ID NO: 96681 - protein, 15 aa, Mycobacterium tuberculosis
AEAWLTDRRREIDRQ

SEQ ID NO: 96682 - protein, 15 aa, Mycobacterium tuberculosis
EAWLTDRRREIDRQL

SEQ ID NO: 96683 - protein, 15 aa, Mycobacterium tuberculosis
AWLTDRRREIDRQLW

SEQ ID NO: 96684 - protein, 15 aa, Mycobacterium tuberculosis
WLTDRRREIDRQLWS

SEQ ID NO: 96685 - protein, 15 aa, Mycobacterium tuberculosis
LTDRRREIDRQLWSP

SEQ ID NO: 96686 - protein, 15 aa, Mycobacterium tuberculosis
TDRRREIDRQLWSPA

SEQ ID NO: 96687 - protein, 15 aa, Mycobacterium tuberculosis
DRRREIDRQLWSPAS

SEQ ID NO: 96688 - protein, 15 aa, Mycobacterium tuberculosis
RRREIDRQLWSPASG

SEQ ID NO: 96689 - protein, 15 aa, Mycobacterium tuberculosis
RREIDRQLWSPASGQ

SEQ ID NO: 96690 - protein, 15 aa, Mycobacterium tuberculosis
REIDRQLWSPASGQE

SEQ ID NO: 96691 - protein, 15 aa, Mycobacterium tuberculosis
EIDRQLWSPASGQED

SEQ ID NO: 96692 - protein, 15 aa, Mycobacterium tuberculosis
IDRQLWSPASGQEDR

SEQ ID NO: 96693 - protein, 15 aa, Mycobacterium tuberculosis
DRQLWSPASGQEDRP

SEQ ID NO: 96694 - protein, 15 aa, Mycobacterium tuberculosis
RQLWSPASGQEDRPG

SEQ ID NO: 96695 - protein, 15 aa, Mycobacterium tuberculosis
QLWSPASGQEDRPGA

SEQ ID NO: 96696 - protein, 15 aa, Mycobacterium tuberculosis
LWSPASGQEDRPGAP

SEQ ID NO: 96697 - protein, 15 aa, Mycobacterium tuberculosis
WSPASGQEDRPGAPF

SEQ ID NO: 96698 - protein, 15 aa, Mycobacterium tuberculosis
SPASGQEDRPGAPFG

SEQ ID NO: 96699 - protein, 15 aa, Mycobacterium tuberculosis
PASGQEDRPGAPFGE

SEQ ID NO: 96700 - protein, 15 aa, Mycobacterium tuberculosis
ASGQEDRPGAPFGEY

SEQ ID NO: 96701 - protein, 15 aa, Mycobacterium tuberculosis
SGQEDRPGAPFGEYA

SEQ ID NO: 96702 - protein, 15 aa, Mycobacterium tuberculosis
GQEDRPGAPFGEYAE

SEQ ID NO: 96703 - protein, 15 aa, Mycobacterium tuberculosis
QEDRPGAPFGEYAEG

SEQ ID NO: 96704 - protein, 15 aa, Mycobacterium tuberculosis
EDRPGAPFGEYAEGW

SEQ ID NO: 96705 - protein, 15 aa, Mycobacterium tuberculosis
DRPGAPFGEYAEGWL

SEQ ID NO: 96706 - protein, 15 aa, Mycobacterium tuberculosis
RPGAPFGEYAEGWLK

SEQ ID NO: 96707 - protein, 15 aa, Mycobacterium tuberculosis
PGAPFGEYAEGWLKQ

SEQ ID NO: 96708 - protein, 15 aa, Mycobacterium tuberculosis
GAPFGEYAEGWLKQR

SEQ ID NO: 96709 - protein, 15 aa, Mycobacterium tuberculosis
APFGEYAEGWLKQRG

SEQ ID NO: 96710 - protein, 15 aa, Mycobacterium tuberculosis
PFGEYAEGWLKQRGI

SEQ ID NO: 96711 - protein, 15 aa, Mycobacterium tuberculosis
FGEYAEGWLKQRGIK

SEQ ID NO: 96712 - protein, 15 aa, Mycobacterium tuberculosis
GEYAEGWLKQRGIKD

SEQ ID NO: 96713 - protein, 15 aa, Mycobacterium tuberculosis
EYAEGWLKQRGIKDR

SEQ ID NO: 96714 - protein, 15 aa, Mycobacterium tuberculosis
YAEGWLKQRGIKDRT

SEQ ID NO: 96715 - protein, 15 aa, Mycobacterium tuberculosis
AEGWLKQRGIKDRTR

SEQ ID NO: 96716 - protein, 15 aa, Mycobacterium tuberculosis
EGWLKQRGIKDRTRA

SEQ ID NO: 96717 - protein, 15 aa, Mycobacterium tuberculosis
GWLKQRGIKDRTRAH

SEQ ID NO: 96718 - protein, 15 aa, Mycobacterium tuberculosis
WLKQRGIKDRTRAHY

SEQ ID NO: 96719 - protein, 15 aa, Mycobacterium tuberculosis
LKQRGIKDRTRAHYR

SEQ ID NO: 96720 - protein, 15 aa, Mycobacterium tuberculosis
KQRGIKDRTRAHYRK

SEQ ID NO: 96721 - protein, 15 aa, Mycobacterium tuberculosis
QRGIKDRTRAHYRKL

SEQ ID NO: 96722 - protein, 15 aa, Mycobacterium tuberculosis
RGIKDRTRAHYRKLL

SEQ ID NO: 96723 - protein, 15 aa, Mycobacterium tuberculosis
GIKDRTRAHYRKLLD

SEQ ID NO: 96724 - protein, 15 aa, Mycobacterium tuberculosis
IKDRTRAHYRKLLDN

SEQ ID NO: 96725 - protein, 15 aa, Mycobacterium tuberculosis
KDRTRAHYRKLLDNH

SEQ ID NO: 96726 - protein, 15 aa, Mycobacterium tuberculosis
DRTRAHYRKLLDNHI

SEQ ID NO: 96727 - protein, 15 aa, Mycobacterium tuberculosis
RTRAHYRKLLDNHIL

SEQ ID NO: 96728 - protein, 15 aa, Mycobacterium tuberculosis
TRAHYRKLLDNHILA

SEQ ID NO: 96729 - protein, 15 aa, Mycobacterium tuberculosis
RAHYRKLLDNHILAT

SEQ ID NO: 96730 - protein, 15 aa, Mycobacterium tuberculosis
AHYRKLLDNHILATF

SEQ ID NO: 96731 - protein, 15 aa, Mycobacterium tuberculosis
HYRKLLDNHILATFA

SEQ ID NO: 96732 - protein, 15 aa, Mycobacterium tuberculosis
YRKLLDNHILATFAD

SEQ ID NO: 96733 - protein, 15 aa, Mycobacterium tuberculosis
RKLLDNHILATFADT

SEQ ID NO: 96734 - protein, 15 aa, Mycobacterium tuberculosis
KLLDNHILATFADTD

SEQ ID NO: 96735 - protein, 15 aa, Mycobacterium tuberculosis
LLDNHILATFADTDL

SEQ ID NO: 96736 - protein, 15 aa, Mycobacterium tuberculosis
LDNHILATFADTDLR

SEQ ID NO: 96737 - protein, 15 aa, Mycobacterium tuberculosis
DNHILATFADTDLRD

SEQ ID NO: 96738 - protein, 15 aa, Mycobacterium tuberculosis
NHILATFADTDLRDI

SEQ ID NO: 96739 - protein, 15 aa, Mycobacterium tuberculosis
HILATFADTDLRDIT

SEQ ID NO: 96740 - protein, 15 aa, Mycobacterium tuberculosis
ILATFADTDLRDITP

SEQ ID NO: 96741 - protein, 15 aa, Mycobacterium tuberculosis
LATFADTDLRDITPA

SEQ ID NO: 96742 - protein, 15 aa, Mycobacterium tuberculosis
ATFADTDLRDITPAA

SEQ ID NO: 96743 - protein, 15 aa, Mycobacterium tuberculosis
TFADTDLRDITPAAV

SEQ ID NO: 96744 - protein, 15 aa, Mycobacterium tuberculosis
FADTDLRDITPAAVR

SEQ ID NO: 96745 - protein, 15 aa, Mycobacterium tuberculosis
ADTDLRDITPAAVRR

SEQ ID NO: 96746 - protein, 15 aa, Mycobacterium tuberculosis
DTDLRDITPAAVRRW

SEQ ID NO: 96747 - protein, 15 aa, Mycobacterium tuberculosis
TDLRDITPAAVRRWY

SEQ ID NO: 96748 - protein, 15 aa, Mycobacterium tuberculosis
DLRDITPAAVRRWYA

SEQ ID NO: 96749 - protein, 15 aa, Mycobacterium tuberculosis
LRDITPAAVRRWYAT

SEQ ID NO: 96750 - protein, 15 aa, Mycobacterium tuberculosis
RDITPAAVRRWYATT

SEQ ID NO: 96751 - protein, 15 aa, Mycobacterium tuberculosis
DITPAAVRRWYATTA

SEQ ID NO: 96752 - protein, 15 aa, Mycobacterium tuberculosis
ITPAAVRRWYATTAV

SEQ ID NO: 96753 - protein, 15 aa, Mycobacterium tuberculosis
TPAAVRRWYATTAVG

SEQ ID NO: 96754 - protein, 15 aa, Mycobacterium tuberculosis
PAAVRRWYATTAVGT

SEQ ID NO: 96755 - protein, 15 aa, Mycobacterium tuberculosis
AAVRRWYATTAVGTP

SEQ ID NO: 96756 - protein, 15 aa, Mycobacterium tuberculosis
AVRRWYATTAVGTPT

SEQ ID NO: 96757 - protein, 15 aa, Mycobacterium tuberculosis
VRRWYATTAVGTPTM

SEQ ID NO: 96758 - protein, 15 aa, Mycobacterium tuberculosis
RRWYATTAVGTPTMR

SEQ ID NO: 96759 - protein, 15 aa, Mycobacterium tuberculosis
RWYATTAVGTPTMRA

SEQ ID NO: 96760 - protein, 15 aa, Mycobacterium tuberculosis
WYATTAVGTPTMRAH

SEQ ID NO: 96761 - protein, 15 aa, Mycobacterium tuberculosis
YATTAVGTPTMRAHS

SEQ ID NO: 96762 - protein, 15 aa, Mycobacterium tuberculosis
ATTAVGTPTMRAHSY

SEQ ID NO: 96763 - protein, 15 aa, Mycobacterium tuberculosis
TTAVGTPTMRAHSYS

SEQ ID NO: 96764 - protein, 15 aa, Mycobacterium tuberculosis
TAVGTPTMRAHSYSL

SEQ ID NO: 96765 - protein, 15 aa, Mycobacterium tuberculosis
AVGTPTMRAHSYSLL

SEQ ID NO: 96766 - protein, 15 aa, Mycobacterium tuberculosis
VGTPTMRAHSYSLLR

SEQ ID NO: 96767 - protein, 15 aa, Mycobacterium tuberculosis
GTPTMRAHSYSLLRA

SEQ ID NO: 96768 - protein, 15 aa, Mycobacterium tuberculosis
TPTMRAHSYSLLRAI

SEQ ID NO: 96769 - protein, 15 aa, Mycobacterium tuberculosis
PTMRAHSYSLLRAIM

SEQ ID NO: 96770 - protein, 15 aa, Mycobacterium tuberculosis
TMRAHSYSLLRAIMQ

SEQ ID NO: 96771 - protein, 15 aa, Mycobacterium tuberculosis
MRAHSYSLLRAIMQT

SEQ ID NO: 96772 - protein, 15 aa, Mycobacterium tuberculosis
RAHSYSLLRAIMQTA

SEQ ID NO: 96773 - protein, 15 aa, Mycobacterium tuberculosis
AHSYSLLRAIMQTAL

SEQ ID NO: 96774 - protein, 15 aa, Mycobacterium tuberculosis
HSYSLLRAIMQTALA

SEQ ID NO: 96775 - protein, 15 aa, Mycobacterium tuberculosis
SYSLLRAIMQTALAD

SEQ ID NO: 96776 - protein, 15 aa, Mycobacterium tuberculosis
YSLLRAIMQTALADD

SEQ ID NO: 96777 - protein, 15 aa, Mycobacterium tuberculosis
SLLRAIMQTALADDL

SEQ ID NO: 96778 - protein, 15 aa, Mycobacterium tuberculosis
LLRAIMQTALADDLI

SEQ ID NO: 96779 - protein, 15 aa, Mycobacterium tuberculosis
LRAIMQTALADDLID

SEQ ID NO: 96780 - protein, 15 aa, Mycobacterium tuberculosis
RAIMQTALADDLIDS

SEQ ID NO: 96781 - protein, 15 aa, Mycobacterium tuberculosis
AIMQTALADDLIDSN

SEQ ID NO: 96782 - protein, 15 aa, Mycobacterium tuberculosis
IMQTALADDLIDSNP

SEQ ID NO: 96783 - protein, 15 aa, Mycobacterium tuberculosis
MQTALADDLIDSNPC

SEQ ID NO: 96784 - protein, 15 aa, Mycobacterium tuberculosis
QTALADDLIDSNPCR

SEQ ID NO: 96785 - protein, 15 aa, Mycobacterium tuberculosis
TALADDLIDSNPCRI

SEQ ID NO: 96786 - protein, 15 aa, Mycobacterium tuberculosis
ALADDLIDSNPCRIS

SEQ ID NO: 96787 - protein, 15 aa, Mycobacterium tuberculosis
LADDLIDSNPCRISG

SEQ ID NO: 96788 - protein, 15 aa, Mycobacterium tuberculosis
ADDLIDSNPCRISGA

SEQ ID NO: 96789 - protein, 15 aa, Mycobacterium tuberculosis
DDLIDSNPCRISGAS

SEQ ID NO: 96790 - protein, 15 aa, Mycobacterium tuberculosis
DLIDSNPCRISGAST

SEQ ID NO: 96791 - protein, 15 aa, Mycobacterium tuberculosis
LIDSNPCRISGASTA

SEQ ID NO: 96792 - protein, 15 aa, Mycobacterium tuberculosis
IDSNPCRISGASTAR

SEQ ID NO: 96793 - protein, 15 aa, Mycobacterium tuberculosis
DSNPCRISGASTARR

SEQ ID NO: 96794 - protein, 15 aa, Mycobacterium tuberculosis
SNPCRISGASTARRV

SEQ ID NO: 96795 - protein, 15 aa, Mycobacterium tuberculosis
NPCRISGASTARRVH

SEQ ID NO: 96796 - protein, 15 aa, Mycobacterium tuberculosis
PCRISGASTARRVHK

SEQ ID NO: 96797 - protein, 15 aa, Mycobacterium tuberculosis
CRISGASTARRVHKI

SEQ ID NO: 96798 - protein, 15 aa, Mycobacterium tuberculosis
RISGASTARRVHKIR

SEQ ID NO: 96799 - protein, 15 aa, Mycobacterium tuberculosis
ISGASTARRVHKIRP

SEQ ID NO: 96800 - protein, 15 aa, Mycobacterium tuberculosis
SGASTARRVHKIRPA

SEQ ID NO: 96801 - protein, 15 aa, Mycobacterium tuberculosis
GASTARRVHKIRPAT

SEQ ID NO: 96802 - protein, 15 aa, Mycobacterium tuberculosis
ASTARRVHKIRPATL

SEQ ID NO: 96803 - protein, 15 aa, Mycobacterium tuberculosis
STARRVHKIRPATLD

SEQ ID NO: 96804 - protein, 15 aa, Mycobacterium tuberculosis
TARRVHKIRPATLDE

SEQ ID NO: 96805 - protein, 15 aa, Mycobacterium tuberculosis
ARRVHKIRPATLDEL

SEQ ID NO: 96806 - protein, 15 aa, Mycobacterium tuberculosis
RRVHKIRPATLDELE

SEQ ID NO: 96807 - protein, 15 aa, Mycobacterium tuberculosis
RVHKIRPATLDELET

SEQ ID NO: 96808 - protein, 15 aa, Mycobacterium tuberculosis
VHKIRPATLDELETI

SEQ ID NO: 96809 - protein, 15 aa, Mycobacterium tuberculosis
HKIRPATLDELETIT

SEQ ID NO: 96810 - protein, 15 aa, Mycobacterium tuberculosis
KIRPATLDELETITK

SEQ ID NO: 96811 - protein, 15 aa, Mycobacterium tuberculosis
IRPATLDELETITKA

SEQ ID NO: 96812 - protein, 15 aa, Mycobacterium tuberculosis
RPATLDELETITKAM

SEQ ID NO: 96813 - protein, 15 aa, Mycobacterium tuberculosis
PATLDELETITKAMP

SEQ ID NO: 96814 - protein, 15 aa, Mycobacterium tuberculosis
ATLDELETITKAMPD

SEQ ID NO: 96815 - protein, 15 aa, Mycobacterium tuberculosis
TLDELETITKAMPDP

SEQ ID NO: 96816 - protein, 15 aa, Mycobacterium tuberculosis
LDELETITKAMPDPY

SEQ ID NO: 96817 - protein, 15 aa, Mycobacterium tuberculosis
DELETITKAMPDPYQ

SEQ ID NO: 96818 - protein, 15 aa, Mycobacterium tuberculosis
ELETITKAMPDPYQA

SEQ ID NO: 96819 - protein, 15 aa, Mycobacterium tuberculosis
LETITKAMPDPYQAF

SEQ ID NO: 96820 - protein, 15 aa, Mycobacterium tuberculosis
ETITKAMPDPYQAFV

SEQ ID NO: 96821 - protein, 15 aa, Mycobacterium tuberculosis
TITKAMPDPYQAFVL

SEQ ID NO: 96822 - protein, 15 aa, Mycobacterium tuberculosis
ITKAMPDPYQAFVLM

SEQ ID NO: 96823 - protein, 15 aa, Mycobacterium tuberculosis
TKAMPDPYQAFVLMA

SEQ ID NO: 96824 - protein, 15 aa, Mycobacterium tuberculosis
KAMPDPYQAFVLMAA

SEQ ID NO: 96825 - protein, 15 aa, Mycobacterium tuberculosis
AMPDPYQAFVLMAAW

SEQ ID NO: 96826 - protein, 15 aa, Mycobacterium tuberculosis
MPDPYQAFVLMAAWL

SEQ ID NO: 96827 - protein, 15 aa, Mycobacterium tuberculosis
PDPYQAFVLMAAWLA

SEQ ID NO: 96828 - protein, 15 aa, Mycobacterium tuberculosis
DPYQAFVLMAAWLAM

SEQ ID NO: 96829 - protein, 15 aa, Mycobacterium tuberculosis
PYQAFVLMAAWLAMR

SEQ ID NO: 96830 - protein, 15 aa, Mycobacterium tuberculosis
YQAFVLMAAWLAMRY

SEQ ID NO: 96831 - protein, 15 aa, Mycobacterium tuberculosis
QAFVLMAAWLAMRYG

SEQ ID NO: 96832 - protein, 15 aa, Mycobacterium tuberculosis
AFVLMAAWLAMRYGE

SEQ ID NO: 96833 - protein, 15 aa, Mycobacterium tuberculosis
FVLMAAWLAMRYGEL

SEQ ID NO: 96834 - protein, 15 aa, Mycobacterium tuberculosis
VLMAAWLAMRYGELT

SEQ ID NO: 96835 - protein, 15 aa, Mycobacterium tuberculosis
LMAAWLAMRYGELTE

SEQ ID NO: 96836 - protein, 15 aa, Mycobacterium tuberculosis
MAAWLAMRYGELTEL

SEQ ID NO: 96837 - protein, 15 aa, Mycobacterium tuberculosis
AAWLAMRYGELTELR

SEQ ID NO: 96838 - protein, 15 aa, Mycobacterium tuberculosis
AWLAMRYGELTELRR

SEQ ID NO: 96839 - protein, 15 aa, Mycobacterium tuberculosis
WLAMRYGELTELRRK

SEQ ID NO: 96840 - protein, 15 aa, Mycobacterium tuberculosis
LAMRYGELTELRRKD

SEQ ID NO: 96841 - protein, 15 aa, Mycobacterium tuberculosis
AMRYGELTELRRKDI

SEQ ID NO: 96842 - protein, 15 aa, Mycobacterium tuberculosis
MRYGELTELRRKDID

SEQ ID NO: 96843 - protein, 15 aa, Mycobacterium tuberculosis
RYGELTELRRKDIDL

SEQ ID NO: 96844 - protein, 15 aa, Mycobacterium tuberculosis
YGELTELRRKDIDLH

SEQ ID NO: 96845 - protein, 15 aa, Mycobacterium tuberculosis
GELTELRRKDIDLHG

SEQ ID NO: 96846 - protein, 15 aa, Mycobacterium tuberculosis
ELTELRRKDIDLHGE

SEQ ID NO: 96847 - protein, 15 aa, Mycobacterium tuberculosis
LTELRRKDIDLHGEV

SEQ ID NO: 96848 - protein, 15 aa, Mycobacterium tuberculosis
TELRRKDIDLHGEVA

SEQ ID NO: 96849 - protein, 15 aa, Mycobacterium tuberculosis
ELRRKDIDLHGEVAR

SEQ ID NO: 96850 - protein, 15 aa, Mycobacterium tuberculosis
LRRKDIDLHGEVARV

SEQ ID NO: 96851 - protein, 15 aa, Mycobacterium tuberculosis
RRKDIDLHGEVARVR

SEQ ID NO: 96852 - protein, 15 aa, Mycobacterium tuberculosis
RKDIDLHGEVARVRR

SEQ ID NO: 96853 - protein, 15 aa, Mycobacterium tuberculosis
KDIDLHGEVARVRRA

SEQ ID NO: 96854 - protein, 15 aa, Mycobacterium tuberculosis
DIDLHGEVARVRRAV

SEQ ID NO: 96855 - protein, 15 aa, Mycobacterium tuberculosis
IDLHGEVARVRRAVV

SEQ ID NO: 96856 - protein, 15 aa, Mycobacterium tuberculosis
DLHGEVARVRRAVVR

SEQ ID NO: 96857 - protein, 15 aa, Mycobacterium tuberculosis
LHGEVARVRRAVVRV

SEQ ID NO: 96858 - protein, 15 aa, Mycobacterium tuberculosis
HGEVARVRRAVVRVG

SEQ ID NO: 96859 - protein, 15 aa, Mycobacterium tuberculosis
GEVARVRRAVVRVGE

SEQ ID NO: 96860 - protein, 15 aa, Mycobacterium tuberculosis
EVARVRRAVVRVGEG

SEQ ID NO: 96861 - protein, 15 aa, Mycobacterium tuberculosis
VARVRRAVVRVGEGF

SEQ ID NO: 96862 - protein, 15 aa, Mycobacterium tuberculosis
ARVRRAVVRVGEGFK

SEQ ID NO: 96863 - protein, 15 aa, Mycobacterium tuberculosis
RVRRAVVRVGEGFKV

SEQ ID NO: 96864 - protein, 15 aa, Mycobacterium tuberculosis
VRRAVVRVGEGFKVT

SEQ ID NO: 96865 - protein, 15 aa, Mycobacterium tuberculosis
RRAVVRVGEGFKVTT

SEQ ID NO: 96866 - protein, 15 aa, Mycobacterium tuberculosis
RAVVRVGEGFKVTTP

SEQ ID NO: 96867 - protein, 15 aa, Mycobacterium tuberculosis
AVVRVGEGFKVTTPK

SEQ ID NO: 96868 - protein, 15 aa, Mycobacterium tuberculosis
VVRVGEGFKVTTPKS

SEQ ID NO: 96869 - protein, 15 aa, Mycobacterium tuberculosis
VRVGEGFKVTTPKSD

SEQ ID NO: 96870 - protein, 15 aa, Mycobacterium tuberculosis
RVGEGFKVTTPKSDA

SEQ ID NO: 96871 - protein, 15 aa, Mycobacterium tuberculosis
VGEGFKVTTPKSDAG

SEQ ID NO: 96872 - protein, 15 aa, Mycobacterium tuberculosis
GEGFKVTTPKSDAGV

SEQ ID NO: 96873 - protein, 15 aa, Mycobacterium tuberculosis
EGFKVTTPKSDAGVR

SEQ ID NO: 96874 - protein, 15 aa, Mycobacterium tuberculosis
GFKVTTPKSDAGVRD

SEQ ID NO: 96875 - protein, 15 aa, Mycobacterium tuberculosis
FKVTTPKSDAGVRDI

SEQ ID NO: 96876 - protein, 15 aa, Mycobacterium tuberculosis
KVTTPKSDAGVRDIS

SEQ ID NO: 96877 - protein, 15 aa, Mycobacterium tuberculosis
VTTPKSDAGVRDISI

SEQ ID NO: 96878 - protein, 15 aa, Mycobacterium tuberculosis
TTPKSDAGVRDISIP

SEQ ID NO: 96879 - protein, 15 aa, Mycobacterium tuberculosis
TPKSDAGVRDISIPP

SEQ ID NO: 96880 - protein, 15 aa, Mycobacterium tuberculosis
PKSDAGVRDISIPPH

SEQ ID NO: 96881 - protein, 15 aa, Mycobacterium tuberculosis
KSDAGVRDISIPPHL

SEQ ID NO: 96882 - protein, 15 aa, Mycobacterium tuberculosis
SDAGVRDISIPPHLI

SEQ ID NO: 96883 - protein, 15 aa, Mycobacterium tuberculosis
DAGVRDISIPPHLIP

SEQ ID NO: 96884 - protein, 15 aa, Mycobacterium tuberculosis
AGVRDISIPPHLIPA

SEQ ID NO: 96885 - protein, 15 aa, Mycobacterium tuberculosis
GVRDISIPPHLIPAI

SEQ ID NO: 96886 - protein, 15 aa, Mycobacterium tuberculosis
VRDISIPPHLIPAIE

SEQ ID NO: 96887 - protein, 15 aa, Mycobacterium tuberculosis
RDISIPPHLIPAIED

SEQ ID NO: 96888 - protein, 15 aa, Mycobacterium tuberculosis
DISIPPHLIPAIEDH

SEQ ID NO: 96889 - protein, 15 aa, Mycobacterium tuberculosis
ISIPPHLIPAIEDHL

SEQ ID NO: 96890 - protein, 15 aa, Mycobacterium tuberculosis
SIPPHLIPAIEDHLH

SEQ ID NO: 96891 - protein, 15 aa, Mycobacterium tuberculosis
IPPHLIPAIEDHLHK

SEQ ID NO: 96892 - protein, 15 aa, Mycobacterium tuberculosis
PPHLIPAIEDHLHKH

SEQ ID NO: 96893 - protein, 15 aa, Mycobacterium tuberculosis
PHLIPAIEDHLHKHV

SEQ ID NO: 96894 - protein, 15 aa, Mycobacterium tuberculosis
HLIPAIEDHLHKHVN

SEQ ID NO: 96895 - protein, 15 aa, Mycobacterium tuberculosis
LIPAIEDHLHKHVNP

SEQ ID NO: 96896 - protein, 15 aa, Mycobacterium tuberculosis
IPAIEDHLHKHVNPG

SEQ ID NO: 96897 - protein, 15 aa, Mycobacterium tuberculosis
PAIEDHLHKHVNPGR

SEQ ID NO: 96898 - protein, 15 aa, Mycobacterium tuberculosis
AIEDHLHKHVNPGRE

SEQ ID NO: 96899 - protein, 15 aa, Mycobacterium tuberculosis
IEDHLHKHVNPGRES

SEQ ID NO: 96900 - protein, 15 aa, Mycobacterium tuberculosis
EDHLHKHVNPGRESL

SEQ ID NO: 96901 - protein, 15 aa, Mycobacterium tuberculosis
DHLHKHVNPGRESLL

SEQ ID NO: 96902 - protein, 15 aa, Mycobacterium tuberculosis
HLHKHVNPGRESLLF

SEQ ID NO: 96903 - protein, 15 aa, Mycobacterium tuberculosis
LHKHVNPGRESLLFP

SEQ ID NO: 96904 - protein, 15 aa, Mycobacterium tuberculosis
HKHVNPGRESLLFPS

SEQ ID NO: 96905 - protein, 15 aa, Mycobacterium tuberculosis
KHVNPGRESLLFPSV

SEQ ID NO: 96906 - protein, 15 aa, Mycobacterium tuberculosis
HVNPGRESLLFPSVN

SEQ ID NO: 96907 - protein, 15 aa, Mycobacterium tuberculosis
VNPGRESLLFPSVND

SEQ ID NO: 96908 - protein, 15 aa, Mycobacterium tuberculosis
NPGRESLLFPSVNDP

SEQ ID NO: 96909 - protein, 15 aa, Mycobacterium tuberculosis
PGRESLLFPSVNDPN

SEQ ID NO: 96910 - protein, 15 aa, Mycobacterium tuberculosis
GRESLLFPSVNDPNR

SEQ ID NO: 96911 - protein, 15 aa, Mycobacterium tuberculosis
RESLLFPSVNDPNRH

SEQ ID NO: 96912 - protein, 15 aa, Mycobacterium tuberculosis
ESLLFPSVNDPNRHL

SEQ ID NO: 96913 - protein, 15 aa, Mycobacterium tuberculosis
SLLFPSVNDPNRHLA

SEQ ID NO: 96914 - protein, 15 aa, Mycobacterium tuberculosis
LLFPSVNDPNRHLAP

SEQ ID NO: 96915 - protein, 15 aa, Mycobacterium tuberculosis
LFPSVNDPNRHLAPS

SEQ ID NO: 96916 - protein, 15 aa, Mycobacterium tuberculosis
FPSVNDPNRHLAPSA

SEQ ID NO: 96917 - protein, 15 aa, Mycobacterium tuberculosis
PSVNDPNRHLAPSAL

SEQ ID NO: 96918 - protein, 15 aa, Mycobacterium tuberculosis
SVNDPNRHLAPSALY

SEQ ID NO: 96919 - protein, 15 aa, Mycobacterium tuberculosis
VNDPNRHLAPSALYR

SEQ ID NO: 96920 - protein, 15 aa, Mycobacterium tuberculosis
NDPNRHLAPSALYRM

SEQ ID NO: 96921 - protein, 15 aa, Mycobacterium tuberculosis
DPNRHLAPSALYRMF

SEQ ID NO: 96922 - protein, 15 aa, Mycobacterium tuberculosis
PNRHLAPSALYRMFY

SEQ ID NO: 96923 - protein, 15 aa, Mycobacterium tuberculosis
NRHLAPSALYRMFYK

SEQ ID NO: 96924 - protein, 15 aa, Mycobacterium tuberculosis
RHLAPSALYRMFYKA

SEQ ID NO: 96925 - protein, 15 aa, Mycobacterium tuberculosis
HLAPSALYRMFYKAR

SEQ ID NO: 96926 - protein, 15 aa, Mycobacterium tuberculosis
LAPSALYRMFYKARK

SEQ ID NO: 96927 - protein, 15 aa, Mycobacterium tuberculosis
APSALYRMFYKARKA

SEQ ID NO: 96928 - protein, 15 aa, Mycobacterium tuberculosis
PSALYRMFYKARKAA

SEQ ID NO: 96929 - protein, 15 aa, Mycobacterium tuberculosis
SALYRMFYKARKAAG

SEQ ID NO: 96930 - protein, 15 aa, Mycobacterium tuberculosis
ALYRMFYKARKAAGR

SEQ ID NO: 96931 - protein, 15 aa, Mycobacterium tuberculosis
LYRMFYKARKAAGRP

SEQ ID NO: 96932 - protein, 15 aa, Mycobacterium tuberculosis
YRMFYKARKAAGRPD

SEQ ID NO: 96933 - protein, 15 aa, Mycobacterium tuberculosis
RMFYKARKAAGRPDL

SEQ ID NO: 96934 - protein, 15 aa, Mycobacterium tuberculosis
MFYKARKAAGRPDLR

SEQ ID NO: 96935 - protein, 15 aa, Mycobacterium tuberculosis
FYKARKAAGRPDLRV

SEQ ID NO: 96936 - protein, 15 aa, Mycobacterium tuberculosis
YKARKAAGRPDLRVH

SEQ ID NO: 96937 - protein, 15 aa, Mycobacterium tuberculosis
KARKAAGRPDLRVHD

SEQ ID NO: 96938 - protein, 15 aa, Mycobacterium tuberculosis
ARKAAGRPDLRVHDL

SEQ ID NO: 96939 - protein, 15 aa, Mycobacterium tuberculosis
RKAAGRPDLRVHDLR

SEQ ID NO: 96940 - protein, 15 aa, Mycobacterium tuberculosis
KAAGRPDLRVHDLRH

SEQ ID NO: 96941 - protein, 15 aa, Mycobacterium tuberculosis
AAGRPDLRVHDLRHS

SEQ ID NO: 96942 - protein, 15 aa, Mycobacterium tuberculosis
AGRPDLRVHDLRHSG

SEQ ID NO: 96943 - protein, 15 aa, Mycobacterium tuberculosis
GRPDLRVHDLRHSGA

SEQ ID NO: 96944 - protein, 15 aa, Mycobacterium tuberculosis
RPDLRVHDLRHSGAV

SEQ ID NO: 96945 - protein, 15 aa, Mycobacterium tuberculosis
PDLRVHDLRHSGAVL

SEQ ID NO: 96946 - protein, 15 aa, Mycobacterium tuberculosis
DLRVHDLRHSGAVLA

SEQ ID NO: 96947 - protein, 15 aa, Mycobacterium tuberculosis
LRVHDLRHSGAVLAA

SEQ ID NO: 96948 - protein, 15 aa, Mycobacterium tuberculosis
RVHDLRHSGAVLAAS

SEQ ID NO: 96949 - protein, 15 aa, Mycobacterium tuberculosis
VHDLRHSGAVLAAST

SEQ ID NO: 96950 - protein, 15 aa, Mycobacterium tuberculosis
HDLRHSGAVLAASTG

SEQ ID NO: 96951 - protein, 15 aa, Mycobacterium tuberculosis
DLRHSGAVLAASTGA

SEQ ID NO: 96952 - protein, 15 aa, Mycobacterium tuberculosis
LRHSGAVLAASTGAT

SEQ ID NO: 96953 - protein, 15 aa, Mycobacterium tuberculosis
RHSGAVLAASTGATL

SEQ ID NO: 96954 - protein, 15 aa, Mycobacterium tuberculosis
HSGAVLAASTGATLA

SEQ ID NO: 96955 - protein, 15 aa, Mycobacterium tuberculosis
SGAVLAASTGATLAE

SEQ ID NO: 96956 - protein, 15 aa, Mycobacterium tuberculosis
GAVLAASTGATLAEL

SEQ ID NO: 96957 - protein, 15 aa, Mycobacterium tuberculosis
AVLAASTGATLAELM

SEQ ID NO: 96958 - protein, 15 aa, Mycobacterium tuberculosis
VLAASTGATLAELMQ

SEQ ID NO: 96959 - protein, 15 aa, Mycobacterium tuberculosis
LAASTGATLAELMQR

SEQ ID NO: 96960 - protein, 15 aa, Mycobacterium tuberculosis
AASTGATLAELMQRL

SEQ ID NO: 96961 - protein, 15 aa, Mycobacterium tuberculosis
ASTGATLAELMQRLG

SEQ ID NO: 96962 - protein, 15 aa, Mycobacterium tuberculosis
STGATLAELMQRLGH

SEQ ID NO: 96963 - protein, 15 aa, Mycobacterium tuberculosis
TGATLAELMQRLGHS

SEQ ID NO: 96964 - protein, 15 aa, Mycobacterium tuberculosis
GATLAELMQRLGHST

SEQ ID NO: 96965 - protein, 15 aa, Mycobacterium tuberculosis
ATLAELMQRLGHSTA

SEQ ID NO: 96966 - protein, 15 aa, Mycobacterium tuberculosis
TLAELMQRLGHSTAG

SEQ ID NO: 96967 - protein, 15 aa, Mycobacterium tuberculosis
LAELMQRLGHSTAGA

SEQ ID NO: 96968 - protein, 15 aa, Mycobacterium tuberculosis
AELMQRLGHSTAGAA

SEQ ID NO: 96969 - protein, 15 aa, Mycobacterium tuberculosis
ELMQRLGHSTAGAAL

SEQ ID NO: 96970 - protein, 15 aa, Mycobacterium tuberculosis
LMQRLGHSTAGAALR

SEQ ID NO: 96971 - protein, 15 aa, Mycobacterium tuberculosis
MQRLGHSTAGAALRY

SEQ ID NO: 96972 - protein, 15 aa, Mycobacterium tuberculosis
QRLGHSTAGAALRYQ

SEQ ID NO: 96973 - protein, 15 aa, Mycobacterium tuberculosis
RLGHSTAGAALRYQH

SEQ ID NO: 96974 - protein, 15 aa, Mycobacterium tuberculosis
LGHSTAGAALRYQHA

SEQ ID NO: 96975 - protein, 15 aa, Mycobacterium tuberculosis
GHSTAGAALRYQHAA

SEQ ID NO: 96976 - protein, 15 aa, Mycobacterium tuberculosis
HSTAGAALRYQHAAK

SEQ ID NO: 96977 - protein, 15 aa, Mycobacterium tuberculosis
STAGAALRYQHAAKG

SEQ ID NO: 96978 - protein, 15 aa, Mycobacterium tuberculosis
TAGAALRYQHAAKGR

SEQ ID NO: 96979 - protein, 15 aa, Mycobacterium tuberculosis
AGAALRYQHAAKGRD

SEQ ID NO: 96980 - protein, 15 aa, Mycobacterium tuberculosis
GAALRYQHAAKGRDR

SEQ ID NO: 96981 - protein, 15 aa, Mycobacterium tuberculosis
AALRYQHAAKGRDRE

SEQ ID NO: 96982 - protein, 15 aa, Mycobacterium tuberculosis
ALRYQHAAKGRDREI

SEQ ID NO: 96983 - protein, 15 aa, Mycobacterium tuberculosis
LRYQHAAKGRDREIA

SEQ ID NO: 96984 - protein, 15 aa, Mycobacterium tuberculosis
RYQHAAKGRDREIAA

SEQ ID NO: 96985 - protein, 15 aa, Mycobacterium tuberculosis
YQHAAKGRDREIAAL

SEQ ID NO: 96986 - protein, 15 aa, Mycobacterium tuberculosis
QHAAKGRDREIAALL

SEQ ID NO: 96987 - protein, 15 aa, Mycobacterium tuberculosis
HAAKGRDREIAALLS

SEQ ID NO: 96988 - protein, 15 aa, Mycobacterium tuberculosis
AAKGRDREIAALLSK

SEQ ID NO: 96989 - protein, 15 aa, Mycobacterium tuberculosis
AKGRDREIAALLSKL

SEQ ID NO: 96990 - protein, 15 aa, Mycobacterium tuberculosis
KGRDREIAALLSKLA

SEQ ID NO: 96991 - protein, 15 aa, Mycobacterium tuberculosis
GRDREIAALLSKLAE

SEQ ID NO: 96992 - protein, 15 aa, Mycobacterium tuberculosis
RDREIAALLSKLAEN

SEQ ID NO: 96993 - protein, 15 aa, Mycobacterium tuberculosis
DREIAALLSKLAENQ

SEQ ID NO: 96994 - protein, 15 aa, Mycobacterium tuberculosis
REIAALLSKLAENQE

SEQ ID NO: 96995 - protein, 15 aa, Mycobacterium tuberculosis
EIAALLSKLAENQEM

SEQ ID NO: 96996 - protein, 16 aa, Mycobacterium tuberculosis
MTQTGKRQRRKFGRIR

SEQ ID NO: 96997 - protein, 16 aa, Mycobacterium tuberculosis
TQTGKRQRRKFGRIRQ

SEQ ID NO: 96998 - protein, 16 aa, Mycobacterium tuberculosis
QTGKRQRRKFGRIRQF

SEQ ID NO: 96999 - protein, 16 aa, Mycobacterium tuberculosis
TGKRQRRKFGRIRQFN

SEQ ID NO: 97000 - protein, 16 aa, Mycobacterium tuberculosis
GKRQRRKFGRIRQFNS

SEQ ID NO: 97001 - protein, 16 aa, Mycobacterium tuberculosis
KRQRRKFGRIRQFNSG

SEQ ID NO: 97002 - protein, 16 aa, Mycobacterium tuberculosis
RQRRKFGRIRQFNSGR

SEQ ID NO: 97003 - protein, 16 aa, Mycobacterium tuberculosis
QRRKFGRIRQFNSGRW

SEQ ID NO: 97004 - protein, 16 aa, Mycobacterium tuberculosis
RRKFGRIRQFNSGRWQ

SEQ ID NO: 97005 - protein, 16 aa, Mycobacterium tuberculosis
RKFGRIRQFNSGRWQA

SEQ ID NO: 97006 - protein, 16 aa, Mycobacterium tuberculosis
KFGRIRQFNSGRWQAS

SEQ ID NO: 97007 - protein, 16 aa, Mycobacterium tuberculosis
FGRIRQFNSGRWQASY

SEQ ID NO: 97008 - protein, 16 aa, Mycobacterium tuberculosis
GRIRQFNSGRWQASYT

SEQ ID NO: 97009 - protein, 16 aa, Mycobacterium tuberculosis
RIRQFNSGRWQASYTG

SEQ ID NO: 97010 - protein, 16 aa, Mycobacterium tuberculosis
IRQFNSGRWQASYTGP

SEQ ID NO: 97011 - protein, 16 aa, Mycobacterium tuberculosis
RQFNSGRWQASYTGPD

SEQ ID NO: 97012 - protein, 16 aa, Mycobacterium tuberculosis
QFNSGRWQASYTGPDG

SEQ ID NO: 97013 - protein, 16 aa, Mycobacterium tuberculosis
FNSGRWQASYTGPDGR

SEQ ID NO: 97014 - protein, 16 aa, Mycobacterium tuberculosis
NSGRWQASYTGPDGRV

SEQ ID NO: 97015 - protein, 16 aa, Mycobacterium tuberculosis
SGRWQASYTGPDGRVY

SEQ ID NO: 97016 - protein, 16 aa, Mycobacterium tuberculosis
GRWQASYTGPDGRVYI

SEQ ID NO: 97017 - protein, 16 aa, Mycobacterium tuberculosis
RWQASYTGPDGRVYIA

SEQ ID NO: 97018 - protein, 16 aa, Mycobacterium tuberculosis
WQASYTGPDGRVYIAP

SEQ ID NO: 97019 - protein, 16 aa, Mycobacterium tuberculosis
QASYTGPDGRVYIAPK

SEQ ID NO: 97020 - protein, 16 aa, Mycobacterium tuberculosis
ASYTGPDGRVYIAPKT

SEQ ID NO: 97021 - protein, 16 aa, Mycobacterium tuberculosis
SYTGPDGRVYIAPKTF

SEQ ID NO: 97022 - protein, 16 aa, Mycobacterium tuberculosis
YTGPDGRVYIAPKTFN

SEQ ID NO: 97023 - protein, 16 aa, Mycobacterium tuberculosis
TGPDGRVYIAPKTFNA

SEQ ID NO: 97024 - protein, 16 aa, Mycobacterium tuberculosis
GPDGRVYIAPKTFNAK

SEQ ID NO: 97025 - protein, 16 aa, Mycobacterium tuberculosis
PDGRVYIAPKTFNAKI

SEQ ID NO: 97026 - protein, 16 aa, Mycobacterium tuberculosis
DGRVYIAPKTFNAKID

SEQ ID NO: 97027 - protein, 16 aa, Mycobacterium tuberculosis
GRVYIAPKTFNAKIDA

SEQ ID NO: 97028 - protein, 16 aa, Mycobacterium tuberculosis
RVYIAPKTFNAKIDAE

SEQ ID NO: 97029 - protein, 16 aa, Mycobacterium tuberculosis
VYIAPKTFNAKIDAEA

SEQ ID NO: 97030 - protein, 16 aa, Mycobacterium tuberculosis
YIAPKTFNAKIDAEAW

SEQ ID NO: 97031 - protein, 16 aa, Mycobacterium tuberculosis
IAPKTFNAKIDAEAWL

SEQ ID NO: 97032 - protein, 16 aa, Mycobacterium tuberculosis
APKTFNAKIDAEAWLT

SEQ ID NO: 97033 - protein, 16 aa, Mycobacterium tuberculosis
PKTFNAKIDAEAWLTD

SEQ ID NO: 97034 - protein, 16 aa, Mycobacterium tuberculosis
KTFNAKIDAEAWLTDR

SEQ ID NO: 97035 - protein, 16 aa, Mycobacterium tuberculosis
TFNAKIDAEAWLTDRR

SEQ ID NO: 97036 - protein, 16 aa, Mycobacterium tuberculosis
FNAKIDAEAWLTDRRR

SEQ ID NO: 97037 - protein, 16 aa, Mycobacterium tuberculosis
NAKIDAEAWLTDRRRE

SEQ ID NO: 97038 - protein, 16 aa, Mycobacterium tuberculosis
AKIDAEAWLTDRRREI

SEQ ID NO: 97039 - protein, 16 aa, Mycobacterium tuberculosis
KIDAEAWLTDRRREID

SEQ ID NO: 97040 - protein, 16 aa, Mycobacterium tuberculosis
IDAEAWLTDRRREIDR

SEQ ID NO: 97041 - protein, 16 aa, Mycobacterium tuberculosis
DAEAWLTDRRREIDRQ

SEQ ID NO: 97042 - protein, 16 aa, Mycobacterium tuberculosis
AEAWLTDRRREIDRQL

SEQ ID NO: 97043 - protein, 16 aa, Mycobacterium tuberculosis
EAWLTDRRREIDRQLW

SEQ ID NO: 97044 - protein, 16 aa, Mycobacterium tuberculosis
AWLTDRRREIDRQLWS

SEQ ID NO: 97045 - protein, 16 aa, Mycobacterium tuberculosis
WLTDRRREIDRQLWSP

SEQ ID NO: 97046 - protein, 16 aa, Mycobacterium tuberculosis
LTDRRREIDRQLWSPA

SEQ ID NO: 97047 - protein, 16 aa, Mycobacterium tuberculosis
TDRRREIDRQLWSPAS

SEQ ID NO: 97048 - protein, 16 aa, Mycobacterium tuberculosis
DRRREIDRQLWSPASG

SEQ ID NO: 97049 - protein, 16 aa, Mycobacterium tuberculosis
RRREIDRQLWSPASGQ

SEQ ID NO: 97050 - protein, 16 aa, Mycobacterium tuberculosis
RREIDRQLWSPASGQE

SEQ ID NO: 97051 - protein, 16 aa, Mycobacterium tuberculosis
REIDRQLWSPASGQED

SEQ ID NO: 97052 - protein, 16 aa, Mycobacterium tuberculosis
EIDRQLWSPASGQEDR

SEQ ID NO: 97053 - protein, 16 aa, Mycobacterium tuberculosis
IDRQLWSPASGQEDRP

SEQ ID NO: 97054 - protein, 16 aa, Mycobacterium tuberculosis
DRQLWSPASGQEDRPG

SEQ ID NO: 97055 - protein, 16 aa, Mycobacterium tuberculosis
RQLWSPASGQEDRPGA

SEQ ID NO: 97056 - protein, 16 aa, Mycobacterium tuberculosis
QLWSPASGQEDRPGAP

SEQ ID NO: 97057 - protein, 16 aa, Mycobacterium tuberculosis
LWSPASGQEDRPGAPF

SEQ ID NO: 97058 - protein, 16 aa, Mycobacterium tuberculosis
WSPASGQEDRPGAPFG

SEQ ID NO: 97059 - protein, 16 aa, Mycobacterium tuberculosis
SPASGQEDRPGAPFGE

SEQ ID NO: 97060 - protein, 16 aa, Mycobacterium tuberculosis
PASGQEDRPGAPFGEY

SEQ ID NO: 97061 - protein, 16 aa, Mycobacterium tuberculosis
ASGQEDRPGAPFGEYA

SEQ ID NO: 97062 - protein, 16 aa, Mycobacterium tuberculosis
SGQEDRPGAPFGEYAE

SEQ ID NO: 97063 - protein, 16 aa, Mycobacterium tuberculosis
GQEDRPGAPFGEYAEG

SEQ ID NO: 97064 - protein, 16 aa, Mycobacterium tuberculosis
QEDRPGAPFGEYAEGW

SEQ ID NO: 97065 - protein, 16 aa, Mycobacterium tuberculosis
EDRPGAPFGEYAEGWL

SEQ ID NO: 97066 - protein, 16 aa, Mycobacterium tuberculosis
DRPGAPFGEYAEGWLK

SEQ ID NO: 97067 - protein, 16 aa, Mycobacterium tuberculosis
RPGAPFGEYAEGWLKQ

SEQ ID NO: 97068 - protein, 16 aa, Mycobacterium tuberculosis
PGAPFGEYAEGWLKQR

SEQ ID NO: 97069 - protein, 16 aa, Mycobacterium tuberculosis
GAPFGEYAEGWLKQRG

SEQ ID NO: 97070 - protein, 16 aa, Mycobacterium tuberculosis
APFGEYAEGWLKQRGI

SEQ ID NO: 97071 - protein, 16 aa, Mycobacterium tuberculosis
PFGEYAEGWLKQRGIK

SEQ ID NO: 97072 - protein, 16 aa, Mycobacterium tuberculosis
FGEYAEGWLKQRGIKD

SEQ ID NO: 97073 - protein, 16 aa, Mycobacterium tuberculosis
GEYAEGWLKQRGIKDR

SEQ ID NO: 97074 - protein, 16 aa, Mycobacterium tuberculosis
EYAEGWLKQRGIKDRT

SEQ ID NO: 97075 - protein, 16 aa, Mycobacterium tuberculosis
YAEGWLKQRGIKDRTR

SEQ ID NO: 97076 - protein, 16 aa, Mycobacterium tuberculosis
AEGWLKQRGIKDRTRA

SEQ ID NO: 97077 - protein, 16 aa, Mycobacterium tuberculosis
EGWLKQRGIKDRTRAH

SEQ ID NO: 97078 - protein, 16 aa, Mycobacterium tuberculosis
GWLKQRGIKDRTRAHY

SEQ ID NO: 97079 - protein, 16 aa, Mycobacterium tuberculosis
WLKQRGIKDRTRAHYR

SEQ ID NO: 97080 - protein, 16 aa, Mycobacterium tuberculosis
LKQRGIKDRTRAHYRK

SEQ ID NO: 97081 - protein, 16 aa, Mycobacterium tuberculosis
KQRGIKDRTRAHYRKL

SEQ ID NO: 97082 - protein, 16 aa, Mycobacterium tuberculosis
QRGIKDRTRAHYRKLL

SEQ ID NO: 97083 - protein, 16 aa, Mycobacterium tuberculosis
RGIKDRTRAHYRKLLD

SEQ ID NO: 97084 - protein, 16 aa, Mycobacterium tuberculosis
GIKDRTRAHYRKLLDN

SEQ ID NO: 97085 - protein, 16 aa, Mycobacterium tuberculosis
IKDRTRAHYRKLLDNH

SEQ ID NO: 97086 - protein, 16 aa, Mycobacterium tuberculosis
KDRTRAHYRKLLDNHI

SEQ ID NO: 97087 - protein, 16 aa, Mycobacterium tuberculosis
DRTRAHYRKLLDNHIL

SEQ ID NO: 97088 - protein, 16 aa, Mycobacterium tuberculosis
RTRAHYRKLLDNHILA

SEQ ID NO: 97089 - protein, 16 aa, Mycobacterium tuberculosis
TRAHYRKLLDNHILAT

SEQ ID NO: 97090 - protein, 16 aa, Mycobacterium tuberculosis
RAHYRKLLDNHILATF

SEQ ID NO: 97091 - protein, 16 aa, Mycobacterium tuberculosis
AHYRKLLDNHILATFA

SEQ ID NO: 97092 - protein, 16 aa, Mycobacterium tuberculosis
HYRKLLDNHILATFAD

SEQ ID NO: 97093 - protein, 16 aa, Mycobacterium tuberculosis
YRKLLDNHILATFADT

SEQ ID NO: 97094 - protein, 16 aa, Mycobacterium tuberculosis
RKLLDNHILATFADTD

SEQ ID NO: 97095 - protein, 16 aa, Mycobacterium tuberculosis
KLLDNHILATFADTDL

SEQ ID NO: 97096 - protein, 16 aa, Mycobacterium tuberculosis
LLDNHILATFADTDLR

SEQ ID NO: 97097 - protein, 16 aa, Mycobacterium tuberculosis
LDNHILATFADTDLRD

SEQ ID NO: 97098 - protein, 16 aa, Mycobacterium tuberculosis
DNHILATFADTDLRDI

SEQ ID NO: 97099 - protein, 16 aa, Mycobacterium tuberculosis
NHILATFADTDLRDIT

SEQ ID NO: 97100 - protein, 16 aa, Mycobacterium tuberculosis
HILATFADTDLRDITP

SEQ ID NO: 97101 - protein, 16 aa, Mycobacterium tuberculosis
ILATFADTDLRDITPA

SEQ ID NO: 97102 - protein, 16 aa, Mycobacterium tuberculosis
LATFADTDLRDITPAA

SEQ ID NO: 97103 - protein, 16 aa, Mycobacterium tuberculosis
ATFADTDLRDITPAAV

SEQ ID NO: 97104 - protein, 16 aa, Mycobacterium tuberculosis
TFADTDLRDITPAAVR

SEQ ID NO: 97105 - protein, 16 aa, Mycobacterium tuberculosis
FADTDLRDITPAAVRR

SEQ ID NO: 97106 - protein, 16 aa, Mycobacterium tuberculosis
ADTDLRDITPAAVRRW

SEQ ID NO: 97107 - protein, 16 aa, Mycobacterium tuberculosis
DTDLRDITPAAVRRWY

SEQ ID NO: 97108 - protein, 16 aa, Mycobacterium tuberculosis
TDLRDITPAAVRRWYA

SEQ ID NO: 97109 - protein, 16 aa, Mycobacterium tuberculosis
DLRDITPAAVRRWYAT

SEQ ID NO: 97110 - protein, 16 aa, Mycobacterium tuberculosis
LRDITPAAVRRWYATT

SEQ ID NO: 97111 - protein, 16 aa, Mycobacterium tuberculosis
RDITPAAVRRWYATTA

SEQ ID NO: 97112 - protein, 16 aa, Mycobacterium tuberculosis
DITPAAVRRWYATTAV

SEQ ID NO: 97113 - protein, 16 aa, Mycobacterium tuberculosis
ITPAAVRRWYATTAVG

SEQ ID NO: 97114 - protein, 16 aa, Mycobacterium tuberculosis
TPAAVRRWYATTAVGT

SEQ ID NO: 97115 - protein, 16 aa, Mycobacterium tuberculosis
PAAVRRWYATTAVGTP

SEQ ID NO: 97116 - protein, 16 aa, Mycobacterium tuberculosis
AAVRRWYATTAVGTPT

SEQ ID NO: 97117 - protein, 16 aa, Mycobacterium tuberculosis
AVRRWYATTAVGTPTM

SEQ ID NO: 97118 - protein, 16 aa, Mycobacterium tuberculosis
VRRWYATTAVGTPTMR

SEQ ID NO: 97119 - protein, 16 aa, Mycobacterium tuberculosis
RRWYATTAVGTPTMRA

SEQ ID NO: 97120 - protein, 16 aa, Mycobacterium tuberculosis
RWYATTAVGTPTMRAH

SEQ ID NO: 97121 - protein, 16 aa, Mycobacterium tuberculosis
WYATTAVGTPTMRAHS

SEQ ID NO: 97122 - protein, 16 aa, Mycobacterium tuberculosis
YATTAVGTPTMRAHSY

SEQ ID NO: 97123 - protein, 16 aa, Mycobacterium tuberculosis
ATTAVGTPTMRAHSYS

SEQ ID NO: 97124 - protein, 16 aa, Mycobacterium tuberculosis
TTAVGTPTMRAHSYSL

SEQ ID NO: 97125 - protein, 16 aa, Mycobacterium tuberculosis
TAVGTPTMRAHSYSLL

SEQ ID NO: 97126 - protein, 16 aa, Mycobacterium tuberculosis
AVGTPTMRAHSYSLLR

SEQ ID NO: 97127 - protein, 16 aa, Mycobacterium tuberculosis
VGTPTMRAHSYSLLRA

SEQ ID NO: 97128 - protein, 16 aa, Mycobacterium tuberculosis
GTPTMRAHSYSLLRAI

SEQ ID NO: 97129 - protein, 16 aa, Mycobacterium tuberculosis
TPTMRAHSYSLLRAIM

SEQ ID NO: 97130 - protein, 16 aa, Mycobacterium tuberculosis
PTMRAHSYSLLRAIMQ

SEQ ID NO: 97131 - protein, 16 aa, Mycobacterium tuberculosis
TMRAHSYSLLRAIMQT

SEQ ID NO: 97132 - protein, 16 aa, Mycobacterium tuberculosis
MRAHSYSLLRAIMQTA

SEQ ID NO: 97133 - protein, 16 aa, Mycobacterium tuberculosis
RAHSYSLLRAIMQTAL

SEQ ID NO: 97134 - protein, 16 aa, Mycobacterium tuberculosis
AHSYSLLRAIMQTALA

SEQ ID NO: 97135 - protein, 16 aa, Mycobacterium tuberculosis
HSYSLLRAIMQTALAD

SEQ ID NO: 97136 - protein, 16 aa, Mycobacterium tuberculosis
SYSLLRAIMQTALADD

SEQ ID NO: 97137 - protein, 16 aa, Mycobacterium tuberculosis
YSLLRAIMQTALADDL

SEQ ID NO: 97138 - protein, 16 aa, Mycobacterium tuberculosis
SLLRAIMQTALADDLI

SEQ ID NO: 97139 - protein, 16 aa, Mycobacterium tuberculosis
LLRAIMQTALADDLID

SEQ ID NO: 97140 - protein, 16 aa, Mycobacterium tuberculosis
LRAIMQTALADDLIDS

SEQ ID NO: 97141 - protein, 16 aa, Mycobacterium tuberculosis
RAIMQTALADDLIDSN

SEQ ID NO: 97142 - protein, 16 aa, Mycobacterium tuberculosis
AIMQTALADDLIDSNP

SEQ ID NO: 97143 - protein, 16 aa, Mycobacterium tuberculosis
IMQTALADDLIDSNPC

SEQ ID NO: 97144 - protein, 16 aa, Mycobacterium tuberculosis
MQTALADDLIDSNPCR

SEQ ID NO: 97145 - protein, 16 aa, Mycobacterium tuberculosis
QTALADDLIDSNPCRI

SEQ ID NO: 97146 - protein, 16 aa, Mycobacterium tuberculosis
TALADDLIDSNPCRIS

SEQ ID NO: 97147 - protein, 16 aa, Mycobacterium tuberculosis
ALADDLIDSNPCRISG

SEQ ID NO: 97148 - protein, 16 aa, Mycobacterium tuberculosis
LADDLIDSNPCRISGA

SEQ ID NO: 97149 - protein, 16 aa, Mycobacterium tuberculosis
ADDLIDSNPCRISGAS

SEQ ID NO: 97150 - protein, 16 aa, Mycobacterium tuberculosis
DDLIDSNPCRISGAST

SEQ ID NO: 97151 - protein, 16 aa, Mycobacterium tuberculosis
DLIDSNPCRISGASTA

SEQ ID NO: 97152 - protein, 16 aa, Mycobacterium tuberculosis
LIDSNPCRISGASTAR

SEQ ID NO: 97153 - protein, 16 aa, Mycobacterium tuberculosis
IDSNPCRISGASTARR

SEQ ID NO: 97154 - protein, 16 aa, Mycobacterium tuberculosis
DSNPCRISGASTARRV

SEQ ID NO: 97155 - protein, 16 aa, Mycobacterium tuberculosis
SNPCRISGASTARRVH

SEQ ID NO: 97156 - protein, 16 aa, Mycobacterium tuberculosis
NPCRISGASTARRVHK

SEQ ID NO: 97157 - protein, 16 aa, Mycobacterium tuberculosis
PCRISGASTARRVHKI

SEQ ID NO: 97158 - protein, 16 aa, Mycobacterium tuberculosis
CRISGASTARRVHKIR

SEQ ID NO: 97159 - protein, 16 aa, Mycobacterium tuberculosis
RISGASTARRVHKIRP

SEQ ID NO: 97160 - protein, 16 aa, Mycobacterium tuberculosis
ISGASTARRVHKIRPA

SEQ ID NO: 97161 - protein, 16 aa, Mycobacterium tuberculosis
SGASTARRVHKIRPAT

SEQ ID NO: 97162 - protein, 16 aa, Mycobacterium tuberculosis
GASTARRVHKIRPATL

SEQ ID NO: 97163 - protein, 16 aa, Mycobacterium tuberculosis
ASTARRVHKIRPATLD

SEQ ID NO: 97164 - protein, 16 aa, Mycobacterium tuberculosis
STARRVHKIRPATLDE

SEQ ID NO: 97165 - protein, 16 aa, Mycobacterium tuberculosis
TARRVHKIRPATLDEL

SEQ ID NO: 97166 - protein, 16 aa, Mycobacterium tuberculosis
ARRVHKIRPATLDELE

SEQ ID NO: 97167 - protein, 16 aa, Mycobacterium tuberculosis
RRVHKIRPATLDELET

SEQ ID NO: 97168 - protein, 16 aa, Mycobacterium tuberculosis
RVHKIRPATLDELETI

SEQ ID NO: 97169 - protein, 16 aa, Mycobacterium tuberculosis
VHKIRPATLDELETIT

SEQ ID NO: 97170 - protein, 16 aa, Mycobacterium tuberculosis
HKIRPATLDELETITK

SEQ ID NO: 97171 - protein, 16 aa, Mycobacterium tuberculosis
KIRPATLDELETITKA

SEQ ID NO: 97172 - protein, 16 aa, Mycobacterium tuberculosis
IRPATLDELETITKAM

SEQ ID NO: 97173 - protein, 16 aa, Mycobacterium tuberculosis
RPATLDELETITKAMP

SEQ ID NO: 97174 - protein, 16 aa, Mycobacterium tuberculosis
PATLDELETITKAMPD

SEQ ID NO: 97175 - protein, 16 aa, Mycobacterium tuberculosis
ATLDELETITKAMPDP

SEQ ID NO: 97176 - protein, 16 aa, Mycobacterium tuberculosis
TLDELETITKAMPDPY

SEQ ID NO: 97177 - protein, 16 aa, Mycobacterium tuberculosis
LDELETITKAMPDPYQ

SEQ ID NO: 97178 - protein, 16 aa, Mycobacterium tuberculosis
DELETITKAMPDPYQA

SEQ ID NO: 97179 - protein, 16 aa, Mycobacterium tuberculosis
ELETITKAMPDPYQAF

SEQ ID NO: 97180 - protein, 16 aa, Mycobacterium tuberculosis
LETITKAMPDPYQAFV

SEQ ID NO: 97181 - protein, 16 aa, Mycobacterium tuberculosis
ETITKAMPDPYQAFVL

SEQ ID NO: 97182 - protein, 16 aa, Mycobacterium tuberculosis
TITKAMPDPYQAFVLM

SEQ ID NO: 97183 - protein, 16 aa, Mycobacterium tuberculosis
ITKAMPDPYQAFVLMA

SEQ ID NO: 97184 - protein, 16 aa, Mycobacterium tuberculosis
TKAMPDPYQAFVLMAA

SEQ ID NO: 97185 - protein, 16 aa, Mycobacterium tuberculosis
KAMPDPYQAFVLMAAW

SEQ ID NO: 97186 - protein, 16 aa, Mycobacterium tuberculosis
AMPDPYQAFVLMAAWL

SEQ ID NO: 97187 - protein, 16 aa, Mycobacterium tuberculosis
MPDPYQAFVLMAAWLA

SEQ ID NO: 97188 - protein, 16 aa, Mycobacterium tuberculosis
PDPYQAFVLMAAWLAM

SEQ ID NO: 97189 - protein, 16 aa, Mycobacterium tuberculosis
DPYQAFVLMAAWLAMR

SEQ ID NO: 97190 - protein, 16 aa, Mycobacterium tuberculosis
PYQAFVLMAAWLAMRY

SEQ ID NO: 97191 - protein, 16 aa, Mycobacterium tuberculosis
YQAFVLMAAWLAMRYG

SEQ ID NO: 97192 - protein, 16 aa, Mycobacterium tuberculosis
QAFVLMAAWLAMRYGE

SEQ ID NO: 97193 - protein, 16 aa, Mycobacterium tuberculosis
AFVLMAAWLAMRYGEL

SEQ ID NO: 97194 - protein, 16 aa, Mycobacterium tuberculosis
FVLMAAWLAMRYGELT

SEQ ID NO: 97195 - protein, 16 aa, Mycobacterium tuberculosis
VLMAAWLAMRYGELTE

SEQ ID NO: 97196 - protein, 16 aa, Mycobacterium tuberculosis
LMAAWLAMRYGELTEL

SEQ ID NO: 97197 - protein, 16 aa, Mycobacterium tuberculosis
MAAWLAMRYGELTELR

SEQ ID NO: 97198 - protein, 16 aa, Mycobacterium tuberculosis
AAWLAMRYGELTELRR

SEQ ID NO: 97199 - protein, 16 aa, Mycobacterium tuberculosis
AWLAMRYGELTELRRK

SEQ ID NO: 97200 - protein, 16 aa, Mycobacterium tuberculosis
WLAMRYGELTELRRKD

SEQ ID NO: 97201 - protein, 16 aa, Mycobacterium tuberculosis
LAMRYGELTELRRKDI

SEQ ID NO: 97202 - protein, 16 aa, Mycobacterium tuberculosis
AMRYGELTELRRKDID

SEQ ID NO: 97203 - protein, 16 aa, Mycobacterium tuberculosis
MRYGELTELRRKDIDL

SEQ ID NO: 97204 - protein, 16 aa, Mycobacterium tuberculosis
RYGELTELRRKDIDLH

SEQ ID NO: 97205 - protein, 16 aa, Mycobacterium tuberculosis
YGELTELRRKDIDLHG

SEQ ID NO: 97206 - protein, 16 aa, Mycobacterium tuberculosis
GELTELRRKDIDLHGE

SEQ ID NO: 97207 - protein, 16 aa, Mycobacterium tuberculosis
ELTELRRKDIDLHGEV

SEQ ID NO: 97208 - protein, 16 aa, Mycobacterium tuberculosis
LTELRRKDIDLHGEVA

SEQ ID NO: 97209 - protein, 16 aa, Mycobacterium tuberculosis
TELRRKDIDLHGEVAR

SEQ ID NO: 97210 - protein, 16 aa, Mycobacterium tuberculosis
ELRRKDIDLHGEVARV

SEQ ID NO: 97211 - protein, 16 aa, Mycobacterium tuberculosis
LRRKDIDLHGEVARVR

SEQ ID NO: 97212 - protein, 16 aa, Mycobacterium tuberculosis
RRKDIDLHGEVARVRR

SEQ ID NO: 97213 - protein, 16 aa, Mycobacterium tuberculosis
RKDIDLHGEVARVRRA

SEQ ID NO: 97214 - protein, 16 aa, Mycobacterium tuberculosis
KDIDLHGEVARVRRAV

SEQ ID NO: 97215 - protein, 16 aa, Mycobacterium tuberculosis
DIDLHGEVARVRRAVV

SEQ ID NO: 97216 - protein, 16 aa, Mycobacterium tuberculosis
IDLHGEVARVRRAVVR

SEQ ID NO: 97217 - protein, 16 aa, Mycobacterium tuberculosis
DLHGEVARVRRAVVRV

SEQ ID NO: 97218 - protein, 16 aa, Mycobacterium tuberculosis
LHGEVARVRRAVVRVG

SEQ ID NO: 97219 - protein, 16 aa, Mycobacterium tuberculosis
HGEVARVRRAVVRVGE

SEQ ID NO: 97220 - protein, 16 aa, Mycobacterium tuberculosis
GEVARVRRAVVRVGEG

SEQ ID NO: 97221 - protein, 16 aa, Mycobacterium tuberculosis
EVARVRRAVVRVGEGF

SEQ ID NO: 97222 - protein, 16 aa, Mycobacterium tuberculosis
VARVRRAVVRVGEGFK

SEQ ID NO: 97223 - protein, 16 aa, Mycobacterium tuberculosis
ARVRRAVVRVGEGFKV

SEQ ID NO: 97224 - protein, 16 aa, Mycobacterium tuberculosis
RVRRAVVRVGEGFKVT

SEQ ID NO: 97225 - protein, 16 aa, Mycobacterium tuberculosis
VRRAVVRVGEGFKVTT

SEQ ID NO: 97226 - protein, 16 aa, Mycobacterium tuberculosis
RRAVVRVGEGFKVTTP

SEQ ID NO: 97227 - protein, 16 aa, Mycobacterium tuberculosis
RAVVRVGEGFKVTTPK

SEQ ID NO: 97228 - protein, 16 aa, Mycobacterium tuberculosis
AVVRVGEGFKVTTPKS

SEQ ID NO: 97229 - protein, 16 aa, Mycobacterium tuberculosis
VVRVGEGFKVTTPKSD

SEQ ID NO: 97230 - protein, 16 aa, Mycobacterium tuberculosis
VRVGEGFKVTTPKSDA

SEQ ID NO: 97231 - protein, 16 aa, Mycobacterium tuberculosis
RVGEGFKVTTPKSDAG

SEQ ID NO: 97232 - protein, 16 aa, Mycobacterium tuberculosis
VGEGFKVTTPKSDAGV

SEQ ID NO: 97233 - protein, 16 aa, Mycobacterium tuberculosis
GEGFKVTTPKSDAGVR

SEQ ID NO: 97234 - protein, 16 aa, Mycobacterium tuberculosis
EGFKVTTPKSDAGVRD

SEQ ID NO: 97235 - protein, 16 aa, Mycobacterium tuberculosis
GFKVTTPKSDAGVRDI

SEQ ID NO: 97236 - protein, 16 aa, Mycobacterium tuberculosis
FKVTTPKSDAGVRDIS

SEQ ID NO: 97237 - protein, 16 aa, Mycobacterium tuberculosis
KVTTPKSDAGVRDISI

SEQ ID NO: 97238 - protein, 16 aa, Mycobacterium tuberculosis
VTTPKSDAGVRDISIP

SEQ ID NO: 97239 - protein, 16 aa, Mycobacterium tuberculosis
TTPKSDAGVRDISIPP

SEQ ID NO: 97240 - protein, 16 aa, Mycobacterium tuberculosis
TPKSDAGVRDISIPPH

SEQ ID NO: 97241 - protein, 16 aa, Mycobacterium tuberculosis
PKSDAGVRDISIPPHL

SEQ ID NO: 97242 - protein, 16 aa, Mycobacterium tuberculosis
KSDAGVRDISIPPHLI

SEQ ID NO: 97243 - protein, 16 aa, Mycobacterium tuberculosis
SDAGVRDISIPPHLIP

SEQ ID NO: 97244 - protein, 16 aa, Mycobacterium tuberculosis
DAGVRDISIPPHLIPA

SEQ ID NO: 97245 - protein, 16 aa, Mycobacterium tuberculosis
AGVRDISIPPHLIPAI

SEQ ID NO: 97246 - protein, 16 aa, Mycobacterium tuberculosis
GVRDISIPPHLIPAIE

SEQ ID NO: 97247 - protein, 16 aa, Mycobacterium tuberculosis
VRDISIPPHLIPAIED

SEQ ID NO: 97248 - protein, 16 aa, Mycobacterium tuberculosis
RDISIPPHLIPAIEDH

SEQ ID NO: 97249 - protein, 16 aa, Mycobacterium tuberculosis
DISIPPHLIPAIEDHL

SEQ ID NO: 97250 - protein, 16 aa, Mycobacterium tuberculosis
ISIPPHLIPAIEDHLH

SEQ ID NO: 97251 - protein, 16 aa, Mycobacterium tuberculosis
SIPPHLIPAIEDHLHK

SEQ ID NO: 97252 - protein, 16 aa, Mycobacterium tuberculosis
IPPHLIPAIEDHLHKH

SEQ ID NO: 97253 - protein, 16 aa, Mycobacterium tuberculosis
PPHLIPAIEDHLHKHV

SEQ ID NO: 97254 - protein, 16 aa, Mycobacterium tuberculosis
PHLIPAIEDHLHKHVN

SEQ ID NO: 97255 - protein, 16 aa, Mycobacterium tuberculosis
HLIPAIEDHLHKHVNP

SEQ ID NO: 97256 - protein, 16 aa, Mycobacterium tuberculosis
LIPAIEDHLHKHVNPG

SEQ ID NO: 97257 - protein, 16 aa, Mycobacterium tuberculosis
IPAIEDHLHKHVNPGR

SEQ ID NO: 97258 - protein, 16 aa, Mycobacterium tuberculosis
PAIEDHLHKHVNPGRE

SEQ ID NO: 97259 - protein, 16 aa, Mycobacterium tuberculosis
AIEDHLHKHVNPGRES

SEQ ID NO: 97260 - protein, 16 aa, Mycobacterium tuberculosis
IEDHLHKHVNPGRESL

SEQ ID NO: 97261 - protein, 16 aa, Mycobacterium tuberculosis
EDHLHKHVNPGRESLL

SEQ ID NO: 97262 - protein, 16 aa, Mycobacterium tuberculosis
DHLHKHVNPGRESLLF

SEQ ID NO: 97263 - protein, 16 aa, Mycobacterium tuberculosis
HLHKHVNPGRESLLFP

SEQ ID NO: 97264 - protein, 16 aa, Mycobacterium tuberculosis
LHKHVNPGRESLLFPS

SEQ ID NO: 97265 - protein, 16 aa, Mycobacterium tuberculosis
HKHVNPGRESLLFPSV

SEQ ID NO: 97266 - protein, 16 aa, Mycobacterium tuberculosis
KHVNPGRESLLFPSVN

SEQ ID NO: 97267 - protein, 16 aa, Mycobacterium tuberculosis
HVNPGRESLLFPSVND

SEQ ID NO: 97268 - protein, 16 aa, Mycobacterium tuberculosis
VNPGRESLLFPSVNDP

SEQ ID NO: 97269 - protein, 16 aa, Mycobacterium tuberculosis
NPGRESLLFPSVNDPN

SEQ ID NO: 97270 - protein, 16 aa, Mycobacterium tuberculosis
PGRESLLFPSVNDPNR

SEQ ID NO: 97271 - protein, 16 aa, Mycobacterium tuberculosis
GRESLLFPSVNDPNRH

SEQ ID NO: 97272 - protein, 16 aa, Mycobacterium tuberculosis
RESLLFPSVNDPNRHL

SEQ ID NO: 97273 - protein, 16 aa, Mycobacterium tuberculosis
ESLLFPSVNDPNRHLA

SEQ ID NO: 97274 - protein, 16 aa, Mycobacterium tuberculosis
SLLFPSVNDPNRHLAP

SEQ ID NO: 97275 - protein, 16 aa, Mycobacterium tuberculosis
LLFPSVNDPNRHLAPS

SEQ ID NO: 97276 - protein, 16 aa, Mycobacterium tuberculosis
LFPSVNDPNRHLAPSA

SEQ ID NO: 97277 - protein, 16 aa, Mycobacterium tuberculosis
FPSVNDPNRHLAPSAL

SEQ ID NO: 97278 - protein, 16 aa, Mycobacterium tuberculosis
PSVNDPNRHLAPSALY

SEQ ID NO: 97279 - protein, 16 aa, Mycobacterium tuberculosis
SVNDPNRHLAPSALYR

SEQ ID NO: 97280 - protein, 16 aa, Mycobacterium tuberculosis
VNDPNRHLAPSALYRM

SEQ ID NO: 97281 - protein, 16 aa, Mycobacterium tuberculosis
NDPNRHLAPSALYRMF

SEQ ID NO: 97282 - protein, 16 aa, Mycobacterium tuberculosis
DPNRHLAPSALYRMFY

SEQ ID NO: 97283 - protein, 16 aa, Mycobacterium tuberculosis
PNRHLAPSALYRMFYK

SEQ ID NO: 97284 - protein, 16 aa, Mycobacterium tuberculosis
NRHLAPSALYRMFYKA

SEQ ID NO: 97285 - protein, 16 aa, Mycobacterium tuberculosis
RHLAPSALYRMFYKAR

SEQ ID NO: 97286 - protein, 16 aa, Mycobacterium tuberculosis
HLAPSALYRMFYKARK

SEQ ID NO: 97287 - protein, 16 aa, Mycobacterium tuberculosis
LAPSALYRMFYKARKA

SEQ ID NO: 97288 - protein, 16 aa, Mycobacterium tuberculosis
APSALYRMFYKARKAA

SEQ ID NO: 97289 - protein, 16 aa, Mycobacterium tuberculosis
PSALYRMFYKARKAAG

SEQ ID NO: 97290 - protein, 16 aa, Mycobacterium tuberculosis
SALYRMFYKARKAAGR

SEQ ID NO: 97291 - protein, 16 aa, Mycobacterium tuberculosis
ALYRMFYKARKAAGRP

SEQ ID NO: 97292 - protein, 16 aa, Mycobacterium tuberculosis
LYRMFYKARKAAGRPD

SEQ ID NO: 97293 - protein, 16 aa, Mycobacterium tuberculosis
YRMFYKARKAAGRPDL

SEQ ID NO: 97294 - protein, 16 aa, Mycobacterium tuberculosis
RMFYKARKAAGRPDLR

SEQ ID NO: 97295 - protein, 16 aa, Mycobacterium tuberculosis
MFYKARKAAGRPDLRV

SEQ ID NO: 97296 - protein, 16 aa, Mycobacterium tuberculosis
FYKARKAAGRPDLRVH

SEQ ID NO: 97297 - protein, 16 aa, Mycobacterium tuberculosis
YKARKAAGRPDLRVHD

SEQ ID NO: 97298 - protein, 16 aa, Mycobacterium tuberculosis
KARKAAGRPDLRVHDL

SEQ ID NO: 97299 - protein, 16 aa, Mycobacterium tuberculosis
ARKAAGRPDLRVHDLR

SEQ ID NO: 97300 - protein, 16 aa, Mycobacterium tuberculosis
RKAAGRPDLRVHDLRH

SEQ ID NO: 97301 - protein, 16 aa, Mycobacterium tuberculosis
KAAGRPDLRVHDLRHS

SEQ ID NO: 97302 - protein, 16 aa, Mycobacterium tuberculosis
AAGRPDLRVHDLRHSG

SEQ ID NO: 97303 - protein, 16 aa, Mycobacterium tuberculosis
AGRPDLRVHDLRHSGA

SEQ ID NO: 97304 - protein, 16 aa, Mycobacterium tuberculosis
GRPDLRVHDLRHSGAV

SEQ ID NO: 97305 - protein, 16 aa, Mycobacterium tuberculosis
RPDLRVHDLRHSGAVL

SEQ ID NO: 97306 - protein, 16 aa, Mycobacterium tuberculosis
PDLRVHDLRHSGAVLA

SEQ ID NO: 97307 - protein, 16 aa, Mycobacterium tuberculosis
DLRVHDLRHSGAVLAA

SEQ ID NO: 97308 - protein, 16 aa, Mycobacterium tuberculosis
LRVHDLRHSGAVLAAS

SEQ ID NO: 97309 - protein, 16 aa, Mycobacterium tuberculosis
RVHDLRHSGAVLAAST

SEQ ID NO: 97310 - protein, 16 aa, Mycobacterium tuberculosis
VHDLRHSGAVLAASTG

SEQ ID NO: 97311 - protein, 16 aa, Mycobacterium tuberculosis
HDLRHSGAVLAASTGA

SEQ ID NO: 97312 - protein, 16 aa, Mycobacterium tuberculosis
DLRHSGAVLAASTGAT

SEQ ID NO: 97313 - protein, 16 aa, Mycobacterium tuberculosis
LRHSGAVLAASTGATL

SEQ ID NO: 97314 - protein, 16 aa, Mycobacterium tuberculosis
RHSGAVLAASTGATLA

SEQ ID NO: 97315 - protein, 16 aa, Mycobacterium tuberculosis
HSGAVLAASTGATLAE

SEQ ID NO: 97316 - protein, 16 aa, Mycobacterium tuberculosis
SGAVLAASTGATLAEL

SEQ ID NO: 97317 - protein, 16 aa, Mycobacterium tuberculosis
GAVLAASTGATLAELM

SEQ ID NO: 97318 - protein, 16 aa, Mycobacterium tuberculosis
AVLAASTGATLAELMQ

SEQ ID NO: 97319 - protein, 16 aa, Mycobacterium tuberculosis
VLAASTGATLAELMQR

SEQ ID NO: 97320 - protein, 16 aa, Mycobacterium tuberculosis
LAASTGATLAELMQRL

SEQ ID NO: 97321 - protein, 16 aa, Mycobacterium tuberculosis
AASTGATLAELMQRLG

SEQ ID NO: 97322 - protein, 16 aa, Mycobacterium tuberculosis
ASTGATLAELMQRLGH

SEQ ID NO: 97323 - protein, 16 aa, Mycobacterium tuberculosis
STGATLAELMQRLGHS

SEQ ID NO: 97324 - protein, 16 aa, Mycobacterium tuberculosis
TGATLAELMQRLGHST

SEQ ID NO: 97325 - protein, 16 aa, Mycobacterium tuberculosis
GATLAELMQRLGHSTA

SEQ ID NO: 97326 - protein, 16 aa, Mycobacterium tuberculosis
ATLAELMQRLGHSTAG

SEQ ID NO: 97327 - protein, 16 aa, Mycobacterium tuberculosis
TLAELMQRLGHSTAGA

SEQ ID NO: 97328 - protein, 16 aa, Mycobacterium tuberculosis
LAELMQRLGHSTAGAA

SEQ ID NO: 97329 - protein, 16 aa, Mycobacterium tuberculosis
AELMQRLGHSTAGAAL

SEQ ID NO: 97330 - protein, 16 aa, Mycobacterium tuberculosis
ELMQRLGHSTAGAALR

SEQ ID NO: 97331 - protein, 16 aa, Mycobacterium tuberculosis
LMQRLGHSTAGAALRY

SEQ ID NO: 97332 - protein, 16 aa, Mycobacterium tuberculosis
MQRLGHSTAGAALRYQ

SEQ ID NO: 97333 - protein, 16 aa, Mycobacterium tuberculosis
QRLGHSTAGAALRYQH

SEQ ID NO: 97334 - protein, 16 aa, Mycobacterium tuberculosis
RLGHSTAGAALRYQHA

SEQ ID NO: 97335 - protein, 16 aa, Mycobacterium tuberculosis
LGHSTAGAALRYQHAA

SEQ ID NO: 97336 - protein, 16 aa, Mycobacterium tuberculosis
GHSTAGAALRYQHAAK

SEQ ID NO: 97337 - protein, 16 aa, Mycobacterium tuberculosis
HSTAGAALRYQHAAKG

SEQ ID NO: 97338 - protein, 16 aa, Mycobacterium tuberculosis
STAGAALRYQHAAKGR

SEQ ID NO: 97339 - protein, 16 aa, Mycobacterium tuberculosis
TAGAALRYQHAAKGRD

SEQ ID NO: 97340 - protein, 16 aa, Mycobacterium tuberculosis
AGAALRYQHAAKGRDR

SEQ ID NO: 97341 - protein, 16 aa, Mycobacterium tuberculosis
GAALRYQHAAKGRDRE

SEQ ID NO: 97342 - protein, 16 aa, Mycobacterium tuberculosis
AALRYQHAAKGRDREI

SEQ ID NO: 97343 - protein, 16 aa, Mycobacterium tuberculosis
ALRYQHAAKGRDREIA

SEQ ID NO: 97344 - protein, 16 aa, Mycobacterium tuberculosis
LRYQHAAKGRDREIAA

SEQ ID NO: 97345 - protein, 16 aa, Mycobacterium tuberculosis
RYQHAAKGRDREIAAL

SEQ ID NO: 97346 - protein, 16 aa, Mycobacterium tuberculosis
YQHAAKGRDREIAALL

SEQ ID NO: 97347 - protein, 16 aa, Mycobacterium tuberculosis
QHAAKGRDREIAALLS

SEQ ID NO: 97348 - protein, 16 aa, Mycobacterium tuberculosis
HAAKGRDREIAALLSK

SEQ ID NO: 97349 - protein, 16 aa, Mycobacterium tuberculosis
AAKGRDREIAALLSKL

SEQ ID NO: 97350 - protein, 16 aa, Mycobacterium tuberculosis
AKGRDREIAALLSKLA

SEQ ID NO: 97351 - protein, 16 aa, Mycobacterium tuberculosis
KGRDREIAALLSKLAE

SEQ ID NO: 97352 - protein, 16 aa, Mycobacterium tuberculosis
GRDREIAALLSKLAEN

SEQ ID NO: 97353 - protein, 16 aa, Mycobacterium tuberculosis
RDREIAALLSKLAENQ

SEQ ID NO: 97354 - protein, 16 aa, Mycobacterium tuberculosis
DREIAALLSKLAENQE

SEQ ID NO: 97355 - protein, 16 aa, Mycobacterium tuberculosis
REIAALLSKLAENQEM

SEQ ID NO: 97356 - protein, 13 aa, Mycobacterium tuberculosis
MIAGVDQALAATG

SEQ ID NO: 97357 - protein, 13 aa, Mycobacterium tuberculosis
IAGVDQALAATGQ

SEQ ID NO: 97358 - protein, 13 aa, Mycobacterium tuberculosis
AGVDQALAATGQA

SEQ ID NO: 97359 - protein, 13 aa, Mycobacterium tuberculosis
GVDQALAATGQAS

SEQ ID NO: 97360 - protein, 13 aa, Mycobacterium tuberculosis
VDQALAATGQASQ

SEQ ID NO: 97361 - protein, 13 aa, Mycobacterium tuberculosis
DQALAATGQASQR

SEQ ID NO: 97362 - protein, 13 aa, Mycobacterium tuberculosis
QALAATGQASQRA

SEQ ID NO: 97363 - protein, 13 aa, Mycobacterium tuberculosis
ALAATGQASQRAA

SEQ ID NO: 97364 - protein, 13 aa, Mycobacterium tuberculosis
LAATGQASQRAAG

SEQ ID NO: 97365 - protein, 13 aa, Mycobacterium tuberculosis
AATGQASQRAAGA

SEQ ID NO: 97366 - protein, 13 aa, Mycobacterium tuberculosis
ATGQASQRAAGAS

SEQ ID NO: 97367 - protein, 13 aa, Mycobacterium tuberculosis
TGQASQRAAGASG

SEQ ID NO: 97368 - protein, 13 aa, Mycobacterium tuberculosis
GQASQRAAGASGG

SEQ ID NO: 97369 - protein, 13 aa, Mycobacterium tuberculosis
QASQRAAGASGGV

SEQ ID NO: 97370 - protein, 13 aa, Mycobacterium tuberculosis
ASQRAAGASGGVT

SEQ ID NO: 97371 - protein, 13 aa, Mycobacterium tuberculosis
SQRAAGASGGVTV

SEQ ID NO: 97372 - protein, 13 aa, Mycobacterium tuberculosis
QRAAGASGGVTVG

SEQ ID NO: 97373 - protein, 13 aa, Mycobacterium tuberculosis
RAAGASGGVTVGV

SEQ ID NO: 97374 - protein, 13 aa, Mycobacterium tuberculosis
AAGASGGVTVGVG

SEQ ID NO: 97375 - protein, 13 aa, Mycobacterium tuberculosis
AGASGGVTVGVGV

SEQ ID NO: 97376 - protein, 13 aa, Mycobacterium tuberculosis
GASGGVTVGVGVG

SEQ ID NO: 97377 - protein, 13 aa, Mycobacterium tuberculosis
ASGGVTVGVGVGT

SEQ ID NO: 97378 - protein, 13 aa, Mycobacterium tuberculosis
SGGVTVGVGVGTE

SEQ ID NO: 97379 - protein, 13 aa, Mycobacterium tuberculosis
GGVTVGVGVGTEQ

SEQ ID NO: 97380 - protein, 13 aa, Mycobacterium tuberculosis
GVTVGVGVGTEQR

SEQ ID NO: 97381 - protein, 13 aa, Mycobacterium tuberculosis
VTVGVGVGTEQRN

SEQ ID NO: 97382 - protein, 13 aa, Mycobacterium tuberculosis
TVGVGVGTEQRNL

SEQ ID NO: 97383 - protein, 13 aa, Mycobacterium tuberculosis
VGVGVGTEQRNLS

SEQ ID NO: 97384 - protein, 13 aa, Mycobacterium tuberculosis
GVGVGTEQRNLSV

SEQ ID NO: 97385 - protein, 13 aa, Mycobacterium tuberculosis
VGVGTEQRNLSVV

SEQ ID NO: 97386 - protein, 13 aa, Mycobacterium tuberculosis
GVGTEQRNLSVVA

SEQ ID NO: 97387 - protein, 13 aa, Mycobacterium tuberculosis
VGTEQRNLSVVAP

SEQ ID NO: 97388 - protein, 13 aa, Mycobacterium tuberculosis
GTEQRNLSVVAPS

SEQ ID NO: 97389 - protein, 13 aa, Mycobacterium tuberculosis
TEQRNLSVVAPSQ

SEQ ID NO: 97390 - protein, 13 aa, Mycobacterium tuberculosis
EQRNLSVVAPSQF

SEQ ID NO: 97391 - protein, 13 aa, Mycobacterium tuberculosis
QRNLSVVAPSQFT

SEQ ID NO: 97392 - protein, 13 aa, Mycobacterium tuberculosis
RNLSVVAPSQFTF

SEQ ID NO: 97393 - protein, 13 aa, Mycobacterium tuberculosis
NLSVVAPSQFTFS

SEQ ID NO: 97394 - protein, 13 aa, Mycobacterium tuberculosis
LSVVAPSQFTFSS

SEQ ID NO: 97395 - protein, 13 aa, Mycobacterium tuberculosis
SVVAPSQFTFSSR

SEQ ID NO: 97396 - protein, 13 aa, Mycobacterium tuberculosis
VVAPSQFTFSSRS

SEQ ID NO: 97397 - protein, 13 aa, Mycobacterium tuberculosis
VAPSQFTFSSRSP

SEQ ID NO: 97398 - protein, 13 aa, Mycobacterium tuberculosis
APSQFTFSSRSPD

SEQ ID NO: 97399 - protein, 13 aa, Mycobacterium tuberculosis
PSQFTFSSRSPDF

SEQ ID NO: 97400 - protein, 13 aa, Mycobacterium tuberculosis
SQFTFSSRSPDFV

SEQ ID NO: 97401 - protein, 13 aa, Mycobacterium tuberculosis
QFTFSSRSPDFVD

SEQ ID NO: 97402 - protein, 13 aa, Mycobacterium tuberculosis
FTFSSRSPDFVDE

SEQ ID NO: 97403 - protein, 13 aa, Mycobacterium tuberculosis
TFSSRSPDFVDET

SEQ ID NO: 97404 - protein, 13 aa, Mycobacterium tuberculosis
FSSRSPDFVDETA

SEQ ID NO: 97405 - protein, 13 aa, Mycobacterium tuberculosis
SSRSPDFVDETAG

SEQ ID NO: 97406 - protein, 13 aa, Mycobacterium tuberculosis
SRSPDFVDETAGQ

SEQ ID NO: 97407 - protein, 13 aa, Mycobacterium tuberculosis
RSPDFVDETAGQS

SEQ ID NO: 97408 - protein, 13 aa, Mycobacterium tuberculosis
SPDFVDETAGQSW

SEQ ID NO: 97409 - protein, 13 aa, Mycobacterium tuberculosis
PDFVDETAGQSWC

SEQ ID NO: 97410 - protein, 13 aa, Mycobacterium tuberculosis
DFVDETAGQSWCA

SEQ ID NO: 97411 - protein, 13 aa, Mycobacterium tuberculosis
FVDETAGQSWCAI

SEQ ID NO: 97412 - protein, 13 aa, Mycobacterium tuberculosis
VDETAGQSWCAIL

SEQ ID NO: 97413 - protein, 13 aa, Mycobacterium tuberculosis
DETAGQSWCAILG

SEQ ID NO: 97414 - protein, 13 aa, Mycobacterium tuberculosis
ETAGQSWCAILGL

SEQ ID NO: 97415 - protein, 13 aa, Mycobacterium tuberculosis
TAGQSWCAILGLN

SEQ ID NO: 97416 - protein, 13 aa, Mycobacterium tuberculosis
AGQSWCAILGLNQ

SEQ ID NO: 97417 - protein, 13 aa, Mycobacterium tuberculosis
GQSWCAILGLNQF

SEQ ID NO: 97418 - protein, 13 aa, Mycobacterium tuberculosis
QSWCAILGLNQFH

SEQ ID NO: 97419 - protein, 14 aa, Mycobacterium tuberculosis
MIAGVDQALAATGQ

SEQ ID NO: 97420 - protein, 14 aa, Mycobacterium tuberculosis
IAGVDQALAATGQA

SEQ ID NO: 97421 - protein, 14 aa, Mycobacterium tuberculosis
AGVDQALAATGQAS

SEQ ID NO: 97422 - protein, 14 aa, Mycobacterium tuberculosis
GVDQALAATGQASQ

SEQ ID NO: 97423 - protein, 14 aa, Mycobacterium tuberculosis
VDQALAATGQASQR

SEQ ID NO: 97424 - protein, 14 aa, Mycobacterium tuberculosis
DQALAATGQASQRA

SEQ ID NO: 97425 - protein, 14 aa, Mycobacterium tuberculosis
QALAATGQASQRAA

SEQ ID NO: 97426 - protein, 14 aa, Mycobacterium tuberculosis
ALAATGQASQRAAG

SEQ ID NO: 97427 - protein, 14 aa, Mycobacterium tuberculosis
LAATGQASQRAAGA

SEQ ID NO: 97428 - protein, 14 aa, Mycobacterium tuberculosis
AATGQASQRAAGAS

SEQ ID NO: 97429 - protein, 14 aa, Mycobacterium tuberculosis
ATGQASQRAAGASG

SEQ ID NO: 97430 - protein, 14 aa, Mycobacterium tuberculosis
TGQASQRAAGASGG

SEQ ID NO: 97431 - protein, 14 aa, Mycobacterium tuberculosis
GQASQRAAGASGGV

SEQ ID NO: 97432 - protein, 14 aa, Mycobacterium tuberculosis
QASQRAAGASGGVT

SEQ ID NO: 97433 - protein, 14 aa, Mycobacterium tuberculosis
ASQRAAGASGGVTV

SEQ ID NO: 97434 - protein, 14 aa, Mycobacterium tuberculosis
SQRAAGASGGVTVG

SEQ ID NO: 97435 - protein, 14 aa, Mycobacterium tuberculosis
QRAAGASGGVTVGV

SEQ ID NO: 97436 - protein, 14 aa, Mycobacterium tuberculosis
RAAGASGGVTVGVG

SEQ ID NO: 97437 - protein, 14 aa, Mycobacterium tuberculosis
AAGASGGVTVGVGV

SEQ ID NO: 97438 - protein, 14 aa, Mycobacterium tuberculosis
AGASGGVTVGVGVG

SEQ ID NO: 97439 - protein, 14 aa, Mycobacterium tuberculosis
GASGGVTVGVGVGT

SEQ ID NO: 97440 - protein, 14 aa, Mycobacterium tuberculosis
ASGGVTVGVGVGTE

SEQ ID NO: 97441 - protein, 14 aa, Mycobacterium tuberculosis
SGGVTVGVGVGTEQ

SEQ ID NO: 97442 - protein, 14 aa, Mycobacterium tuberculosis
GGVTVGVGVGTEQR

SEQ ID NO: 97443 - protein, 14 aa, Mycobacterium tuberculosis
GVTVGVGVGTEQRN

SEQ ID NO: 97444 - protein, 14 aa, Mycobacterium tuberculosis
VTVGVGVGTEQRNL

SEQ ID NO: 97445 - protein, 14 aa, Mycobacterium tuberculosis
TVGVGVGTEQRNLS

SEQ ID NO: 97446 - protein, 14 aa, Mycobacterium tuberculosis
VGVGVGTEQRNLSV

SEQ ID NO: 97447 - protein, 14 aa, Mycobacterium tuberculosis
GVGVGTEQRNLSVV

SEQ ID NO: 97448 - protein, 14 aa, Mycobacterium tuberculosis
VGVGTEQRNLSVVA

SEQ ID NO: 97449 - protein, 14 aa, Mycobacterium tuberculosis
GVGTEQRNLSVVAP

SEQ ID NO: 97450 - protein, 14 aa, Mycobacterium tuberculosis
VGTEQRNLSVVAPS

SEQ ID NO: 97451 - protein, 14 aa, Mycobacterium tuberculosis
GTEQRNLSVVAPSQ

SEQ ID NO: 97452 - protein, 14 aa, Mycobacterium tuberculosis
TEQRNLSVVAPSQF

SEQ ID NO: 97453 - protein, 14 aa, Mycobacterium tuberculosis
EQRNLSVVAPSQFT

SEQ ID NO: 97454 - protein, 14 aa, Mycobacterium tuberculosis
QRNLSVVAPSQFTF

SEQ ID NO: 97455 - protein, 14 aa, Mycobacterium tuberculosis
RNLSVVAPSQFTFS

SEQ ID NO: 97456 - protein, 14 aa, Mycobacterium tuberculosis
NLSVVAPSQFTFSS

SEQ ID NO: 97457 - protein, 14 aa, Mycobacterium tuberculosis
LSVVAPSQFTFSSR

SEQ ID NO: 97458 - protein, 14 aa, Mycobacterium tuberculosis
SVVAPSQFTFSSRS

SEQ ID NO: 97459 - protein, 14 aa, Mycobacterium tuberculosis
VVAPSQFTFSSRSP

SEQ ID NO: 97460 - protein, 14 aa, Mycobacterium tuberculosis
VAPSQFTFSSRSPD

SEQ ID NO: 97461 - protein, 14 aa, Mycobacterium tuberculosis
APSQFTFSSRSPDF

SEQ ID NO: 97462 - protein, 14 aa, Mycobacterium tuberculosis
PSQFTFSSRSPDFV

SEQ ID NO: 97463 - protein, 14 aa, Mycobacterium tuberculosis
SQFTFSSRSPDFVD

SEQ ID NO: 97464 - protein, 14 aa, Mycobacterium tuberculosis
QFTFSSRSPDFVDE

SEQ ID NO: 97465 - protein, 14 aa, Mycobacterium tuberculosis
FTFSSRSPDFVDET

SEQ ID NO: 97466 - protein, 14 aa, Mycobacterium tuberculosis
TFSSRSPDFVDETA

SEQ ID NO: 97467 - protein, 14 aa, Mycobacterium tuberculosis
FSSRSPDFVDETAG

SEQ ID NO: 97468 - protein, 14 aa, Mycobacterium tuberculosis
SSRSPDFVDETAGQ

SEQ ID NO: 97469 - protein, 14 aa, Mycobacterium tuberculosis
SRSPDFVDETAGQS

SEQ ID NO: 97470 - protein, 14 aa, Mycobacterium tuberculosis
RSPDFVDETAGQSW

SEQ ID NO: 97471 - protein, 14 aa, Mycobacterium tuberculosis
SPDFVDETAGQSWC

SEQ ID NO: 97472 - protein, 14 aa, Mycobacterium tuberculosis
PDFVDETAGQSWCA

SEQ ID NO: 97473 - protein, 14 aa, Mycobacterium tuberculosis
DFVDETAGQSWCAI

SEQ ID NO: 97474 - protein, 14 aa, Mycobacterium tuberculosis
FVDETAGQSWCAIL

SEQ ID NO: 97475 - protein, 14 aa, Mycobacterium tuberculosis
VDETAGQSWCAILG

SEQ ID NO: 97476 - protein, 14 aa, Mycobacterium tuberculosis
DETAGQSWCAILGL

SEQ ID NO: 97477 - protein, 14 aa, Mycobacterium tuberculosis
ETAGQSWCAILGLN

SEQ ID NO: 97478 - protein, 14 aa, Mycobacterium tuberculosis
TAGQSWCAILGLNQ

SEQ ID NO: 97479 - protein, 14 aa, Mycobacterium tuberculosis
AGQSWCAILGLNQF

SEQ ID NO: 97480 - protein, 14 aa, Mycobacterium tuberculosis
GQSWCAILGLNQFH

SEQ ID NO: 97481 - protein, 15 aa, Mycobacterium tuberculosis
MIAGVDQALAATGQA

SEQ ID NO: 97482 - protein, 15 aa, Mycobacterium tuberculosis
IAGVDQALAATGQAS

SEQ ID NO: 97483 - protein, 15 aa, Mycobacterium tuberculosis
AGVDQALAATGQASQ

SEQ ID NO: 97484 - protein, 15 aa, Mycobacterium tuberculosis
GVDQALAATGQASQR

SEQ ID NO: 97485 - protein, 15 aa, Mycobacterium tuberculosis
VDQALAATGQASQRA

SEQ ID NO: 97486 - protein, 15 aa, Mycobacterium tuberculosis
DQALAATGQASQRAA

SEQ ID NO: 97487 - protein, 15 aa, Mycobacterium tuberculosis
QALAATGQASQRAAG

SEQ ID NO: 97488 - protein, 15 aa, Mycobacterium tuberculosis
ALAATGQASQRAAGA

SEQ ID NO: 97489 - protein, 15 aa, Mycobacterium tuberculosis
LAATGQASQRAAGAS

SEQ ID NO: 97490 - protein, 15 aa, Mycobacterium tuberculosis
AATGQASQRAAGASG

SEQ ID NO: 97491 - protein, 15 aa, Mycobacterium tuberculosis
ATGQASQRAAGASGG

SEQ ID NO: 97492 - protein, 15 aa, Mycobacterium tuberculosis
TGQASQRAAGASGGV

SEQ ID NO: 97493 - protein, 15 aa, Mycobacterium tuberculosis
GQASQRAAGASGGVT

SEQ ID NO: 97494 - protein, 15 aa, Mycobacterium tuberculosis
QASQRAAGASGGVTV

SEQ ID NO: 97495 - protein, 15 aa, Mycobacterium tuberculosis
ASQRAAGASGGVTVG

SEQ ID NO: 97496 - protein, 15 aa, Mycobacterium tuberculosis
SQRAAGASGGVTVGV

SEQ ID NO: 97497 - protein, 15 aa, Mycobacterium tuberculosis
QRAAGASGGVTVGVG

SEQ ID NO: 97498 - protein, 15 aa, Mycobacterium tuberculosis
RAAGASGGVTVGVGV

SEQ ID NO: 97499 - protein, 15 aa, Mycobacterium tuberculosis
AAGASGGVTVGVGVG

SEQ ID NO: 97500 - protein, 15 aa, Mycobacterium tuberculosis
AGASGGVTVGVGVGT

SEQ ID NO: 97501 - protein, 15 aa, Mycobacterium tuberculosis
GASGGVTVGVGVGTE

SEQ ID NO: 97502 - protein, 15 aa, Mycobacterium tuberculosis
ASGGVTVGVGVGTEQ

SEQ ID NO: 97503 - protein, 15 aa, Mycobacterium tuberculosis
SGGVTVGVGVGTEQR

SEQ ID NO: 97504 - protein, 15 aa, Mycobacterium tuberculosis
GGVTVGVGVGTEQRN

SEQ ID NO: 97505 - protein, 15 aa, Mycobacterium tuberculosis
GVTVGVGVGTEQRNL

SEQ ID NO: 97506 - protein, 15 aa, Mycobacterium tuberculosis
VTVGVGVGTEQRNLS

SEQ ID NO: 97507 - protein, 15 aa, Mycobacterium tuberculosis
TVGVGVGTEQRNLSV

SEQ ID NO: 97508 - protein, 15 aa, Mycobacterium tuberculosis
VGVGVGTEQRNLSVV

SEQ ID NO: 97509 - protein, 15 aa, Mycobacterium tuberculosis
GVGVGTEQRNLSVVA

SEQ ID NO: 97510 - protein, 15 aa, Mycobacterium tuberculosis
VGVGTEQRNLSVVAP

SEQ ID NO: 97511 - protein, 15 aa, Mycobacterium tuberculosis
GVGTEQRNLSVVAPS

SEQ ID NO: 97512 - protein, 15 aa, Mycobacterium tuberculosis
VGTEQRNLSVVAPSQ

SEQ ID NO: 97513 - protein, 15 aa, Mycobacterium tuberculosis
GTEQRNLSVVAPSQF

SEQ ID NO: 97514 - protein, 15 aa, Mycobacterium tuberculosis
TEQRNLSVVAPSQFT

SEQ ID NO: 97515 - protein, 15 aa, Mycobacterium tuberculosis
EQRNLSVVAPSQFTF

SEQ ID NO: 97516 - protein, 15 aa, Mycobacterium tuberculosis
QRNLSVVAPSQFTFS

SEQ ID NO: 97517 - protein, 15 aa, Mycobacterium tuberculosis
RNLSVVAPSQFTFSS

SEQ ID NO: 97518 - protein, 15 aa, Mycobacterium tuberculosis
NLSVVAPSQFTFSSR

SEQ ID NO: 97519 - protein, 15 aa, Mycobacterium tuberculosis
LSVVAPSQFTFSSRS

SEQ ID NO: 97520 - protein, 15 aa, Mycobacterium tuberculosis
SVVAPSQFTFSSRSP

SEQ ID NO: 97521 - protein, 15 aa, Mycobacterium tuberculosis
VVAPSQFTFSSRSPD

SEQ ID NO: 97522 - protein, 15 aa, Mycobacterium tuberculosis
VAPSQFTFSSRSPDF

SEQ ID NO: 97523 - protein, 15 aa, Mycobacterium tuberculosis
APSQFTFSSRSPDFV

SEQ ID NO: 97524 - protein, 15 aa, Mycobacterium tuberculosis
PSQFTFSSRSPDFVD

SEQ ID NO: 97525 - protein, 15 aa, Mycobacterium tuberculosis
SQFTFSSRSPDFVDE

SEQ ID NO: 97526 - protein, 15 aa, Mycobacterium tuberculosis
QFTFSSRSPDFVDET

SEQ ID NO: 97527 - protein, 15 aa, Mycobacterium tuberculosis
FTFSSRSPDFVDETA

SEQ ID NO: 97528 - protein, 15 aa, Mycobacterium tuberculosis
TFSSRSPDFVDETAG

SEQ ID NO: 97529 - protein, 15 aa, Mycobacterium tuberculosis
FSSRSPDFVDETAGQ

SEQ ID NO: 97530 - protein, 15 aa, Mycobacterium tuberculosis
SSRSPDFVDETAGQS

SEQ ID NO: 97531 - protein, 15 aa, Mycobacterium tuberculosis
SRSPDFVDETAGQSW

SEQ ID NO: 97532 - protein, 15 aa, Mycobacterium tuberculosis
RSPDFVDETAGQSWC

SEQ ID NO: 97533 - protein, 15 aa, Mycobacterium tuberculosis
SPDFVDETAGQSWCA

SEQ ID NO: 97534 - protein, 15 aa, Mycobacterium tuberculosis
PDFVDETAGQSWCAI

SEQ ID NO: 97535 - protein, 15 aa, Mycobacterium tuberculosis
DFVDETAGQSWCAIL

SEQ ID NO: 97536 - protein, 15 aa, Mycobacterium tuberculosis
FVDETAGQSWCAILG

SEQ ID NO: 97537 - protein, 15 aa, Mycobacterium tuberculosis
VDETAGQSWCAILGL

SEQ ID NO: 97538 - protein, 15 aa, Mycobacterium tuberculosis
DETAGQSWCAILGLN

SEQ ID NO: 97539 - protein, 15 aa, Mycobacterium tuberculosis
ETAGQSWCAILGLNQ

SEQ ID NO: 97540 - protein, 15 aa, Mycobacterium tuberculosis
TAGQSWCAILGLNQF

SEQ ID NO: 97541 - protein, 15 aa, Mycobacterium tuberculosis
AGQSWCAILGLNQFH

SEQ ID NO: 97542 - protein, 16 aa, Mycobacterium tuberculosis
MIAGVDQALAATGQAS

SEQ ID NO: 97543 - protein, 16 aa, Mycobacterium tuberculosis
IAGVDQALAATGQASQ

SEQ ID NO: 97544 - protein, 16 aa, Mycobacterium tuberculosis
AGVDQALAATGQASQR

SEQ ID NO: 97545 - protein, 16 aa, Mycobacterium tuberculosis
GVDQALAATGQASQRA

SEQ ID NO: 97546 - protein, 16 aa, Mycobacterium tuberculosis
VDQALAATGQASQRAA

SEQ ID NO: 97547 - protein, 16 aa, Mycobacterium tuberculosis
DQALAATGQASQRAAG

SEQ ID NO: 97548 - protein, 16 aa, Mycobacterium tuberculosis
QALAATGQASQRAAGA

SEQ ID NO: 97549 - protein, 16 aa, Mycobacterium tuberculosis
ALAATGQASQRAAGAS

SEQ ID NO: 97550 - protein, 16 aa, Mycobacterium tuberculosis
LAATGQASQRAAGASG

SEQ ID NO: 97551 - protein, 16 aa, Mycobacterium tuberculosis
AATGQASQRAAGASGG

SEQ ID NO: 97552 - protein, 16 aa, Mycobacterium tuberculosis
ATGQASQRAAGASGGV

SEQ ID NO: 97553 - protein, 16 aa, Mycobacterium tuberculosis
TGQASQRAAGASGGVT

SEQ ID NO: 97554 - protein, 16 aa, Mycobacterium tuberculosis
GQASQRAAGASGGVTV

SEQ ID NO: 97555 - protein, 16 aa, Mycobacterium tuberculosis
QASQRAAGASGGVTVG

SEQ ID NO: 97556 - protein, 16 aa, Mycobacterium tuberculosis
ASQRAAGASGGVTVGV

SEQ ID NO: 97557 - protein, 16 aa, Mycobacterium tuberculosis
SQRAAGASGGVTVGVG

SEQ ID NO: 97558 - protein, 16 aa, Mycobacterium tuberculosis
QRAAGASGGVTVGVGV

SEQ ID NO: 97559 - protein, 16 aa, Mycobacterium tuberculosis
RAAGASGGVTVGVGVG

SEQ ID NO: 97560 - protein, 16 aa, Mycobacterium tuberculosis
AAGASGGVTVGVGVGT

SEQ ID NO: 97561 - protein, 16 aa, Mycobacterium tuberculosis
AGASGGVTVGVGVGTE

SEQ ID NO: 97562 - protein, 16 aa, Mycobacterium tuberculosis
GASGGVTVGVGVGTEQ

SEQ ID NO: 97563 - protein, 16 aa, Mycobacterium tuberculosis
ASGGVTVGVGVGTEQR

SEQ ID NO: 97564 - protein, 16 aa, Mycobacterium tuberculosis
SGGVTVGVGVGTEQRN

SEQ ID NO: 97565 - protein, 16 aa, Mycobacterium tuberculosis
GGVTVGVGVGTEQRNL

SEQ ID NO: 97566 - protein, 16 aa, Mycobacterium tuberculosis
GVTVGVGVGTEQRNLS

SEQ ID NO: 97567 - protein, 16 aa, Mycobacterium tuberculosis
VTVGVGVGTEQRNLSV

SEQ ID NO: 97568 - protein, 16 aa, Mycobacterium tuberculosis
TVGVGVGTEQRNLSVV

SEQ ID NO: 97569 - protein, 16 aa, Mycobacterium tuberculosis
VGVGVGTEQRNLSVVA

SEQ ID NO: 97570 - protein, 16 aa, Mycobacterium tuberculosis
GVGVGTEQRNLSVVAP

SEQ ID NO: 97571 - protein, 16 aa, Mycobacterium tuberculosis
VGVGTEQRNLSVVAPS

SEQ ID NO: 97572 - protein, 16 aa, Mycobacterium tuberculosis
GVGTEQRNLSVVAPSQ

SEQ ID NO: 97573 - protein, 16 aa, Mycobacterium tuberculosis
VGTEQRNLSVVAPSQF

SEQ ID NO: 97574 - protein, 16 aa, Mycobacterium tuberculosis
GTEQRNLSVVAPSQFT

SEQ ID NO: 97575 - protein, 16 aa, Mycobacterium tuberculosis
TEQRNLSVVAPSQFTF

SEQ ID NO: 97576 - protein, 16 aa, Mycobacterium tuberculosis
EQRNLSVVAPSQFTFS

SEQ ID NO: 97577 - protein, 16 aa, Mycobacterium tuberculosis
QRNLSVVAPSQFTFSS

SEQ ID NO: 97578 - protein, 16 aa, Mycobacterium tuberculosis
RNLSVVAPSQFTFSSR

SEQ ID NO: 97579 - protein, 16 aa, Mycobacterium tuberculosis
NLSVVAPSQFTFSSRS

SEQ ID NO: 97580 - protein, 16 aa, Mycobacterium tuberculosis
LSVVAPSQFTFSSRSP

SEQ ID NO: 97581 - protein, 16 aa, Mycobacterium tuberculosis
SVVAPSQFTFSSRSPD

SEQ ID NO: 97582 - protein, 16 aa, Mycobacterium tuberculosis
VVAPSQFTFSSRSPDF

SEQ ID NO: 97583 - protein, 16 aa, Mycobacterium tuberculosis
VAPSQFTFSSRSPDFV

SEQ ID NO: 97584 - protein, 16 aa, Mycobacterium tuberculosis
APSQFTFSSRSPDFVD

SEQ ID NO: 97585 - protein, 16 aa, Mycobacterium tuberculosis
PSQFTFSSRSPDFVDE

SEQ ID NO: 97586 - protein, 16 aa, Mycobacterium tuberculosis
SQFTFSSRSPDFVDET

SEQ ID NO: 97587 - protein, 16 aa, Mycobacterium tuberculosis
QFTFSSRSPDFVDETA

SEQ ID NO: 97588 - protein, 16 aa, Mycobacterium tuberculosis
FTFSSRSPDFVDETAG

SEQ ID NO: 97589 - protein, 16 aa, Mycobacterium tuberculosis
TFSSRSPDFVDETAGQ

SEQ ID NO: 97590 - protein, 16 aa, Mycobacterium tuberculosis
FSSRSPDFVDETAGQS

SEQ ID NO: 97591 - protein, 16 aa, Mycobacterium tuberculosis
SSRSPDFVDETAGQSW

SEQ ID NO: 97592 - protein, 16 aa, Mycobacterium tuberculosis
SRSPDFVDETAGQSWC

SEQ ID NO: 97593 - protein, 16 aa, Mycobacterium tuberculosis
RSPDFVDETAGQSWCA

SEQ ID NO: 97594 - protein, 16 aa, Mycobacterium tuberculosis
SPDFVDETAGQSWCAI

SEQ ID NO: 97595 - protein, 16 aa, Mycobacterium tuberculosis
PDFVDETAGQSWCAIL

SEQ ID NO: 97596 - protein, 16 aa, Mycobacterium tuberculosis
DFVDETAGQSWCAILG

SEQ ID NO: 97597 - protein, 16 aa, Mycobacterium tuberculosis
FVDETAGQSWCAILGL

SEQ ID NO: 97598 - protein, 16 aa, Mycobacterium tuberculosis
VDETAGQSWCAILGLN

SEQ ID NO: 97599 - protein, 16 aa, Mycobacterium tuberculosis
DETAGQSWCAILGLNQ

SEQ ID NO: 97600 - protein, 16 aa, Mycobacterium tuberculosis
ETAGQSWCAILGLNQF

SEQ ID NO: 97601 - protein, 16 aa, Mycobacterium tuberculosis
TAGQSWCAILGLNQFH

SEQ ID NO: 97602 - protein, 13 aa, Mycobacterium tuberculosis
MRARSDAGGQSVK

SEQ ID NO: 97603 - protein, 13 aa, Mycobacterium tuberculosis
RARSDAGGQSVKS

SEQ ID NO: 97604 - protein, 13 aa, Mycobacterium tuberculosis
ARSDAGGQSVKSR

SEQ ID NO: 97605 - protein, 13 aa, Mycobacterium tuberculosis
RSDAGGQSVKSRT

SEQ ID NO: 97606 - protein, 13 aa, Mycobacterium tuberculosis
SDAGGQSVKSRTS

SEQ ID NO: 97607 - protein, 13 aa, Mycobacterium tuberculosis
DAGGQSVKSRTSN

SEQ ID NO: 97608 - protein, 13 aa, Mycobacterium tuberculosis
AGGQSVKSRTSNR

SEQ ID NO: 97609 - protein, 13 aa, Mycobacterium tuberculosis
GGQSVKSRTSNRS

SEQ ID NO: 97610 - protein, 13 aa, Mycobacterium tuberculosis
GQSVKSRTSNRSR

SEQ ID NO: 97611 - protein, 13 aa, Mycobacterium tuberculosis
QSVKSRTSNRSRS

SEQ ID NO: 97612 - protein, 13 aa, Mycobacterium tuberculosis
SVKSRTSNRSRSS

SEQ ID NO: 97613 - protein, 13 aa, Mycobacterium tuberculosis
VKSRTSNRSRSSR

SEQ ID NO: 97614 - protein, 13 aa, Mycobacterium tuberculosis
KSRTSNRSRSSRR

SEQ ID NO: 97615 - protein, 13 aa, Mycobacterium tuberculosis
SRTSNRSRSSRRS

SEQ ID NO: 97616 - protein, 13 aa, Mycobacterium tuberculosis
RTSNRSRSSRRSR

SEQ ID NO: 97617 - protein, 13 aa, Mycobacterium tuberculosis
TSNRSRSSRRSRV

SEQ ID NO: 97618 - protein, 13 aa, Mycobacterium tuberculosis
SNRSRSSRRSRVR

SEQ ID NO: 97619 - protein, 13 aa, Mycobacterium tuberculosis
NRSRSSRRSRVRS

SEQ ID NO: 97620 - protein, 13 aa, Mycobacterium tuberculosis
RSRSSRRSRVRSS

SEQ ID NO: 97621 - protein, 13 aa, Mycobacterium tuberculosis
SRSSRRSRVRSSI

SEQ ID NO: 97622 - protein, 13 aa, Mycobacterium tuberculosis
RSSRRSRVRSSIS

SEQ ID NO: 97623 - protein, 13 aa, Mycobacterium tuberculosis
SSRRSRVRSSISA

SEQ ID NO: 97624 - protein, 13 aa, Mycobacterium tuberculosis
SRRSRVRSSISAL

SEQ ID NO: 97625 - protein, 13 aa, Mycobacterium tuberculosis
RRSRVRSSISALV

SEQ ID NO: 97626 - protein, 13 aa, Mycobacterium tuberculosis
RSRVRSSISALVD

SEQ ID NO: 97627 - protein, 13 aa, Mycobacterium tuberculosis
SRVRSSISALVDN

SEQ ID NO: 97628 - protein, 13 aa, Mycobacterium tuberculosis
RVRSSISALVDNP

SEQ ID NO: 97629 - protein, 13 aa, Mycobacterium tuberculosis
VRSSISALVDNPQ

SEQ ID NO: 97630 - protein, 13 aa, Mycobacterium tuberculosis
RSSISALVDNPQA

SEQ ID NO: 97631 - protein, 13 aa, Mycobacterium tuberculosis
SSISALVDNPQAR

SEQ ID NO: 97632 - protein, 13 aa, Mycobacterium tuberculosis
SISALVDNPQARP

SEQ ID NO: 97633 - protein, 13 aa, Mycobacterium tuberculosis
ISALVDNPQARPR

SEQ ID NO: 97634 - protein, 13 aa, Mycobacterium tuberculosis
SALVDNPQARPRE

SEQ ID NO: 97635 - protein, 13 aa, Mycobacterium tuberculosis
ALVDNPQARPREL

SEQ ID NO: 97636 - protein, 13 aa, Mycobacterium tuberculosis
LVDNPQARPRELP

SEQ ID NO: 97637 - protein, 13 aa, Mycobacterium tuberculosis
VDNPQARPRELPV

SEQ ID NO: 97638 - protein, 13 aa, Mycobacterium tuberculosis
DNPQARPRELPVL

SEQ ID NO: 97639 - protein, 13 aa, Mycobacterium tuberculosis
NPQARPRELPVLC

SEQ ID NO: 97640 - protein, 13 aa, Mycobacterium tuberculosis
PQARPRELPVLCG

SEQ ID NO: 97641 - protein, 13 aa, Mycobacterium tuberculosis
QARPRELPVLCGW

SEQ ID NO: 97642 - protein, 13 aa, Mycobacterium tuberculosis
ARPRELPVLCGWP

SEQ ID NO: 97643 - protein, 13 aa, Mycobacterium tuberculosis
RPRELPVLCGWPV

SEQ ID NO: 97644 - protein, 13 aa, Mycobacterium tuberculosis
PRELPVLCGWPVV

SEQ ID NO: 97645 - protein, 13 aa, Mycobacterium tuberculosis
RELPVLCGWPVVR

SEQ ID NO: 97646 - protein, 13 aa, Mycobacterium tuberculosis
ELPVLCGWPVVRV

SEQ ID NO: 97647 - protein, 13 aa, Mycobacterium tuberculosis
LPVLCGWPVVRVE

SEQ ID NO: 97648 - protein, 13 aa, Mycobacterium tuberculosis
PVLCGWPVVRVEP

SEQ ID NO: 97649 - protein, 13 aa, Mycobacterium tuberculosis
VLCGWPVVRVEPV

SEQ ID NO: 97650 - protein, 13 aa, Mycobacterium tuberculosis
LCGWPVVRVEPVC

SEQ ID NO: 97651 - protein, 13 aa, Mycobacterium tuberculosis
CGWPVVRVEPVCE

SEQ ID NO: 97652 - protein, 13 aa, Mycobacterium tuberculosis
GWPVVRVEPVCEF

SEQ ID NO: 97653 - protein, 13 aa, Mycobacterium tuberculosis
WPVVRVEPVCEFV

SEQ ID NO: 97654 - protein, 13 aa, Mycobacterium tuberculosis
PVVRVEPVCEFVP

SEQ ID NO: 97655 - protein, 13 aa, Mycobacterium tuberculosis
VVRVEPVCEFVPE

SEQ ID NO: 97656 - protein, 13 aa, Mycobacterium tuberculosis
VRVEPVCEFVPEP

SEQ ID NO: 97657 - protein, 13 aa, Mycobacterium tuberculosis
RVEPVCEFVPEPV

SEQ ID NO: 97658 - protein, 13 aa, Mycobacterium tuberculosis
VEPVCEFVPEPVC

SEQ ID NO: 97659 - protein, 13 aa, Mycobacterium tuberculosis
EPVCEFVPEPVCG

SEQ ID NO: 97660 - protein, 13 aa, Mycobacterium tuberculosis
PVCEFVPEPVCGQ

SEQ ID NO: 97661 - protein, 13 aa, Mycobacterium tuberculosis
VCEFVPEPVCGQA

SEQ ID NO: 97662 - protein, 13 aa, Mycobacterium tuberculosis
CEFVPEPVCGQAE

SEQ ID NO: 97663 - protein, 13 aa, Mycobacterium tuberculosis
EFVPEPVCGQAEV

SEQ ID NO: 97664 - protein, 13 aa, Mycobacterium tuberculosis
FVPEPVCGQAEVL

SEQ ID NO: 97665 - protein, 13 aa, Mycobacterium tuberculosis
VPEPVCGQAEVLG

SEQ ID NO: 97666 - protein, 13 aa, Mycobacterium tuberculosis
PEPVCGQAEVLGE

SEQ ID NO: 97667 - protein, 13 aa, Mycobacterium tuberculosis
EPVCGQAEVLGEP

SEQ ID NO: 97668 - protein, 13 aa, Mycobacterium tuberculosis
PVCGQAEVLGEPA

SEQ ID NO: 97669 - protein, 13 aa, Mycobacterium tuberculosis
VCGQAEVLGEPAA

SEQ ID NO: 97670 - protein, 13 aa, Mycobacterium tuberculosis
CGQAEVLGEPAAA

SEQ ID NO: 97671 - protein, 13 aa, Mycobacterium tuberculosis
GQAEVLGEPAAAH

SEQ ID NO: 97672 - protein, 13 aa, Mycobacterium tuberculosis
QAEVLGEPAAAHR

SEQ ID NO: 97673 - protein, 13 aa, Mycobacterium tuberculosis
AEVLGEPAAAHRV

SEQ ID NO: 97674 - protein, 13 aa, Mycobacterium tuberculosis
EVLGEPAAAHRVT

SEQ ID NO: 97675 - protein, 13 aa, Mycobacterium tuberculosis
VLGEPAAAHRVTS

SEQ ID NO: 97676 - protein, 13 aa, Mycobacterium tuberculosis
LGEPAAAHRVTSA

SEQ ID NO: 97677 - protein, 13 aa, Mycobacterium tuberculosis
GEPAAAHRVTSAR

SEQ ID NO: 97678 - protein, 13 aa, Mycobacterium tuberculosis
EPAAAHRVTSARR

SEQ ID NO: 97679 - protein, 13 aa, Mycobacterium tuberculosis
PAAAHRVTSARRS

SEQ ID NO: 97680 - protein, 13 aa, Mycobacterium tuberculosis
AAAHRVTSARRSP

SEQ ID NO: 97681 - protein, 13 aa, Mycobacterium tuberculosis
AAHRVTSARRSPS

SEQ ID NO: 97682 - protein, 13 aa, Mycobacterium tuberculosis
AHRVTSARRSPST

SEQ ID NO: 97683 - protein, 13 aa, Mycobacterium tuberculosis
HRVTSARRSPSTT

SEQ ID NO: 97684 - protein, 13 aa, Mycobacterium tuberculosis
RVTSARRSPSTTV

SEQ ID NO: 97685 - protein, 13 aa, Mycobacterium tuberculosis
VTSARRSPSTTVC

SEQ ID NO: 97686 - protein, 13 aa, Mycobacterium tuberculosis
TSARRSPSTTVCS

SEQ ID NO: 97687 - protein, 13 aa, Mycobacterium tuberculosis
SARRSPSTTVCSR

SEQ ID NO: 97688 - protein, 13 aa, Mycobacterium tuberculosis
ARRSPSTTVCSRS

SEQ ID NO: 97689 - protein, 13 aa, Mycobacterium tuberculosis
RRSPSTTVCSRSQ

SEQ ID NO: 97690 - protein, 13 aa, Mycobacterium tuberculosis
RSPSTTVCSRSQK

SEQ ID NO: 97691 - protein, 13 aa, Mycobacterium tuberculosis
SPSTTVCSRSQKA

SEQ ID NO: 97692 - protein, 13 aa, Mycobacterium tuberculosis
PSTTVCSRSQKAS

SEQ ID NO: 97693 - protein, 13 aa, Mycobacterium tuberculosis
STTVCSRSQKASA

SEQ ID NO: 97694 - protein, 13 aa, Mycobacterium tuberculosis
TTVCSRSQKASAV

SEQ ID NO: 97695 - protein, 13 aa, Mycobacterium tuberculosis
TVCSRSQKASAVV

SEQ ID NO: 97696 - protein, 13 aa, Mycobacterium tuberculosis
VCSRSQKASAVVI

SEQ ID NO: 97697 - protein, 13 aa, Mycobacterium tuberculosis
CSRSQKASAVVIS

SEQ ID NO: 97698 - protein, 13 aa, Mycobacterium tuberculosis
SRSQKASAVVISS

SEQ ID NO: 97699 - protein, 13 aa, Mycobacterium tuberculosis
RSQKASAVVISSV

SEQ ID NO: 97700 - protein, 13 aa, Mycobacterium tuberculosis
SQKASAVVISSVS

SEQ ID NO: 97701 - protein, 13 aa, Mycobacterium tuberculosis
QKASAVVISSVSS

SEQ ID NO: 97702 - protein, 13 aa, Mycobacterium tuberculosis
KASAVVISSVSSV

SEQ ID NO: 97703 - protein, 13 aa, Mycobacterium tuberculosis
ASAVVISSVSSVA

SEQ ID NO: 97704 - protein, 13 aa, Mycobacterium tuberculosis
SAVVISSVSSVAR

SEQ ID NO: 97705 - protein, 13 aa, Mycobacterium tuberculosis
AVVISSVSSVARV

SEQ ID NO: 97706 - protein, 13 aa, Mycobacterium tuberculosis
VVISSVSSVARVR

SEQ ID NO: 97707 - protein, 13 aa, Mycobacterium tuberculosis
VISSVSSVARVRR

SEQ ID NO: 97708 - protein, 13 aa, Mycobacterium tuberculosis
ISSVSSVARVRRA

SEQ ID NO: 97709 - protein, 13 aa, Mycobacterium tuberculosis
SSVSSVARVRRAS

SEQ ID NO: 97710 - protein, 13 aa, Mycobacterium tuberculosis
SVSSVARVRRASV

SEQ ID NO: 97711 - protein, 13 aa, Mycobacterium tuberculosis
VSSVARVRRASVS

SEQ ID NO: 97712 - protein, 13 aa, Mycobacterium tuberculosis
SSVARVRRASVSS

SEQ ID NO: 97713 - protein, 13 aa, Mycobacterium tuberculosis
SVARVRRASVSSV

SEQ ID NO: 97714 - protein, 13 aa, Mycobacterium tuberculosis
VARVRRASVSSVD

SEQ ID NO: 97715 - protein, 13 aa, Mycobacterium tuberculosis
ARVRRASVSSVDA

SEQ ID NO: 97716 - protein, 13 aa, Mycobacterium tuberculosis
RVRRASVSSVDAT

SEQ ID NO: 97717 - protein, 13 aa, Mycobacterium tuberculosis
VRRASVSSVDATT

SEQ ID NO: 97718 - protein, 13 aa, Mycobacterium tuberculosis
RRASVSSVDATTA

SEQ ID NO: 97719 - protein, 14 aa, Mycobacterium tuberculosis
MRARSDAGGQSVKS

SEQ ID NO: 97720 - protein, 14 aa, Mycobacterium tuberculosis
RARSDAGGQSVKSR

SEQ ID NO: 97721 - protein, 14 aa, Mycobacterium tuberculosis
ARSDAGGQSVKSRT

SEQ ID NO: 97722 - protein, 14 aa, Mycobacterium tuberculosis
RSDAGGQSVKSRTS

SEQ ID NO: 97723 - protein, 14 aa, Mycobacterium tuberculosis
SDAGGQSVKSRTSN

SEQ ID NO: 97724 - protein, 14 aa, Mycobacterium tuberculosis
DAGGQSVKSRTSNR

SEQ ID NO: 97725 - protein, 14 aa, Mycobacterium tuberculosis
AGGQSVKSRTSNRS

SEQ ID NO: 97726 - protein, 14 aa, Mycobacterium tuberculosis
GGQSVKSRTSNRSR

SEQ ID NO: 97727 - protein, 14 aa, Mycobacterium tuberculosis
GQSVKSRTSNRSRS

SEQ ID NO: 97728 - protein, 14 aa, Mycobacterium tuberculosis
QSVKSRTSNRSRSS

SEQ ID NO: 97729 - protein, 14 aa, Mycobacterium tuberculosis
SVKSRTSNRSRSSR

SEQ ID NO: 97730 - protein, 14 aa, Mycobacterium tuberculosis
VKSRTSNRSRSSRR

SEQ ID NO: 97731 - protein, 14 aa, Mycobacterium tuberculosis
KSRTSNRSRSSRRS

SEQ ID NO: 97732 - protein, 14 aa, Mycobacterium tuberculosis
SRTSNRSRSSRRSR

SEQ ID NO: 97733 - protein, 14 aa, Mycobacterium tuberculosis
RTSNRSRSSRRSRV

SEQ ID NO: 97734 - protein, 14 aa, Mycobacterium tuberculosis
TSNRSRSSRRSRVR

SEQ ID NO: 97735 - protein, 14 aa, Mycobacterium tuberculosis
SNRSRSSRRSRVRS

SEQ ID NO: 97736 - protein, 14 aa, Mycobacterium tuberculosis
NRSRSSRRSRVRSS

SEQ ID NO: 97737 - protein, 14 aa, Mycobacterium tuberculosis
RSRSSRRSRVRSSI

SEQ ID NO: 97738 - protein, 14 aa, Mycobacterium tuberculosis
SRSSRRSRVRSSIS

SEQ ID NO: 97739 - protein, 14 aa, Mycobacterium tuberculosis
RSSRRSRVRSSISA

SEQ ID NO: 97740 - protein, 14 aa, Mycobacterium tuberculosis
SSRRSRVRSSISAL

SEQ ID NO: 97741 - protein, 14 aa, Mycobacterium tuberculosis
SRRSRVRSSISALV

SEQ ID NO: 97742 - protein, 14 aa, Mycobacterium tuberculosis
RRSRVRSSISALVD

SEQ ID NO: 97743 - protein, 14 aa, Mycobacterium tuberculosis
RSRVRSSISALVDN

SEQ ID NO: 97744 - protein, 14 aa, Mycobacterium tuberculosis
SRVRSSISALVDNP

SEQ ID NO: 97745 - protein, 14 aa, Mycobacterium tuberculosis
RVRSSISALVDNPQ

SEQ ID NO: 97746 - protein, 14 aa, Mycobacterium tuberculosis
VRSSISALVDNPQA

SEQ ID NO: 97747 - protein, 14 aa, Mycobacterium tuberculosis
RSSISALVDNPQAR

SEQ ID NO: 97748 - protein, 14 aa, Mycobacterium tuberculosis
SSISALVDNPQARP

SEQ ID NO: 97749 - protein, 14 aa, Mycobacterium tuberculosis
SISALVDNPQARPR

SEQ ID NO: 97750 - protein, 14 aa, Mycobacterium tuberculosis
ISALVDNPQARPRE

SEQ ID NO: 97751 - protein, 14 aa, Mycobacterium tuberculosis
SALVDNPQARPREL

SEQ ID NO: 97752 - protein, 14 aa, Mycobacterium tuberculosis
ALVDNPQARPRELP

SEQ ID NO: 97753 - protein, 14 aa, Mycobacterium tuberculosis
LVDNPQARPRELPV

SEQ ID NO: 97754 - protein, 14 aa, Mycobacterium tuberculosis
VDNPQARPRELPVL

SEQ ID NO: 97755 - protein, 14 aa, Mycobacterium tuberculosis
DNPQARPRELPVLC

SEQ ID NO: 97756 - protein, 14 aa, Mycobacterium tuberculosis
NPQARPRELPVLCG

SEQ ID NO: 97757 - protein, 14 aa, Mycobacterium tuberculosis
PQARPRELPVLCGW

SEQ ID NO: 97758 - protein, 14 aa, Mycobacterium tuberculosis
QARPRELPVLCGWP

SEQ ID NO: 97759 - protein, 14 aa, Mycobacterium tuberculosis
ARPRELPVLCGWPV

SEQ ID NO: 97760 - protein, 14 aa, Mycobacterium tuberculosis
RPRELPVLCGWPVV

SEQ ID NO: 97761 - protein, 14 aa, Mycobacterium tuberculosis
PRELPVLCGWPVVR

SEQ ID NO: 97762 - protein, 14 aa, Mycobacterium tuberculosis
RELPVLCGWPVVRV

SEQ ID NO: 97763 - protein, 14 aa, Mycobacterium tuberculosis
ELPVLCGWPVVRVE

SEQ ID NO: 97764 - protein, 14 aa, Mycobacterium tuberculosis
LPVLCGWPVVRVEP

SEQ ID NO: 97765 - protein, 14 aa, Mycobacterium tuberculosis
PVLCGWPVVRVEPV

SEQ ID NO: 97766 - protein, 14 aa, Mycobacterium tuberculosis
VLCGWPVVRVEPVC

SEQ ID NO: 97767 - protein, 14 aa, Mycobacterium tuberculosis
LCGWPVVRVEPVCE

SEQ ID NO: 97768 - protein, 14 aa, Mycobacterium tuberculosis
CGWPVVRVEPVCEF

SEQ ID NO: 97769 - protein, 14 aa, Mycobacterium tuberculosis
GWPVVRVEPVCEFV

SEQ ID NO: 97770 - protein, 14 aa, Mycobacterium tuberculosis
WPVVRVEPVCEFVP

SEQ ID NO: 97771 - protein, 14 aa, Mycobacterium tuberculosis
PVVRVEPVCEFVPE

SEQ ID NO: 97772 - protein, 14 aa, Mycobacterium tuberculosis
VVRVEPVCEFVPEP

SEQ ID NO: 97773 - protein, 14 aa, Mycobacterium tuberculosis
VRVEPVCEFVPEPV

SEQ ID NO: 97774 - protein, 14 aa, Mycobacterium tuberculosis
RVEPVCEFVPEPVC

SEQ ID NO: 97775 - protein, 14 aa, Mycobacterium tuberculosis
VEPVCEFVPEPVCG

SEQ ID NO: 97776 - protein, 14 aa, Mycobacterium tuberculosis
EPVCEFVPEPVCGQ

SEQ ID NO: 97777 - protein, 14 aa, Mycobacterium tuberculosis
PVCEFVPEPVCGQA

SEQ ID NO: 97778 - protein, 14 aa, Mycobacterium tuberculosis
VCEFVPEPVCGQAE

SEQ ID NO: 97779 - protein, 14 aa, Mycobacterium tuberculosis
CEFVPEPVCGQAEV

SEQ ID NO: 97780 - protein, 14 aa, Mycobacterium tuberculosis
EFVPEPVCGQAEVL

SEQ ID NO: 97781 - protein, 14 aa, Mycobacterium tuberculosis
FVPEPVCGQAEVLG

SEQ ID NO: 97782 - protein, 14 aa, Mycobacterium tuberculosis
VPEPVCGQAEVLGE

SEQ ID NO: 97783 - protein, 14 aa, Mycobacterium tuberculosis
PEPVCGQAEVLGEP

SEQ ID NO: 97784 - protein, 14 aa, Mycobacterium tuberculosis
EPVCGQAEVLGEPA

SEQ ID NO: 97785 - protein, 14 aa, Mycobacterium tuberculosis
PVCGQAEVLGEPAA

SEQ ID NO: 97786 - protein, 14 aa, Mycobacterium tuberculosis
VCGQAEVLGEPAAA

SEQ ID NO: 97787 - protein, 14 aa, Mycobacterium tuberculosis
CGQAEVLGEPAAAH

SEQ ID NO: 97788 - protein, 14 aa, Mycobacterium tuberculosis
GQAEVLGEPAAAHR

SEQ ID NO: 97789 - protein, 14 aa, Mycobacterium tuberculosis
QAEVLGEPAAAHRV

SEQ ID NO: 97790 - protein, 14 aa, Mycobacterium tuberculosis
AEVLGEPAAAHRVT

SEQ ID NO: 97791 - protein, 14 aa, Mycobacterium tuberculosis
EVLGEPAAAHRVTS

SEQ ID NO: 97792 - protein, 14 aa, Mycobacterium tuberculosis
VLGEPAAAHRVTSA

SEQ ID NO: 97793 - protein, 14 aa, Mycobacterium tuberculosis
LGEPAAAHRVTSAR

SEQ ID NO: 97794 - protein, 14 aa, Mycobacterium tuberculosis
GEPAAAHRVTSARR

SEQ ID NO: 97795 - protein, 14 aa, Mycobacterium tuberculosis
EPAAAHRVTSARRS

SEQ ID NO: 97796 - protein, 14 aa, Mycobacterium tuberculosis
PAAAHRVTSARRSP

SEQ ID NO: 97797 - protein, 14 aa, Mycobacterium tuberculosis
AAAHRVTSARRSPS

SEQ ID NO: 97798 - protein, 14 aa, Mycobacterium tuberculosis
AAHRVTSARRSPST

SEQ ID NO: 97799 - protein, 14 aa, Mycobacterium tuberculosis
AHRVTSARRSPSTT

SEQ ID NO: 97800 - protein, 14 aa, Mycobacterium tuberculosis
HRVTSARRSPSTTV

SEQ ID NO: 97801 - protein, 14 aa, Mycobacterium tuberculosis
RVTSARRSPSTTVC

SEQ ID NO: 97802 - protein, 14 aa, Mycobacterium tuberculosis
VTSARRSPSTTVCS

SEQ ID NO: 97803 - protein, 14 aa, Mycobacterium tuberculosis
TSARRSPSTTVCSR

SEQ ID NO: 97804 - protein, 14 aa, Mycobacterium tuberculosis
SARRSPSTTVCSRS

SEQ ID NO: 97805 - protein, 14 aa, Mycobacterium tuberculosis
ARRSPSTTVCSRSQ

SEQ ID NO: 97806 - protein, 14 aa, Mycobacterium tuberculosis
RRSPSTTVCSRSQK

SEQ ID NO: 97807 - protein, 14 aa, Mycobacterium tuberculosis
RSPSTTVCSRSQKA

SEQ ID NO: 97808 - protein, 14 aa, Mycobacterium tuberculosis
SPSTTVCSRSQKAS

SEQ ID NO: 97809 - protein, 14 aa, Mycobacterium tuberculosis
PSTTVCSRSQKASA

SEQ ID NO: 97810 - protein, 14 aa, Mycobacterium tuberculosis
STTVCSRSQKASAV

SEQ ID NO: 97811 - protein, 14 aa, Mycobacterium tuberculosis
TTVCSRSQKASAVV

SEQ ID NO: 97812 - protein, 14 aa, Mycobacterium tuberculosis
TVCSRSQKASAVVI

SEQ ID NO: 97813 - protein, 14 aa, Mycobacterium tuberculosis
VCSRSQKASAVVIS

SEQ ID NO: 97814 - protein, 14 aa, Mycobacterium tuberculosis
CSRSQKASAVVISS

SEQ ID NO: 97815 - protein, 14 aa, Mycobacterium tuberculosis
SRSQKASAVVISSV

SEQ ID NO: 97816 - protein, 14 aa, Mycobacterium tuberculosis
RSQKASAVVISSVS

SEQ ID NO: 97817 - protein, 14 aa, Mycobacterium tuberculosis
SQKASAVVISSVSS

SEQ ID NO: 97818 - protein, 14 aa, Mycobacterium tuberculosis
QKASAVVISSVSSV

SEQ ID NO: 97819 - protein, 14 aa, Mycobacterium tuberculosis
KASAVVISSVSSVA

SEQ ID NO: 97820 - protein, 14 aa, Mycobacterium tuberculosis
ASAVVISSVSSVAR

SEQ ID NO: 97821 - protein, 14 aa, Mycobacterium tuberculosis
SAVVISSVSSVARV

SEQ ID NO: 97822 - protein, 14 aa, Mycobacterium tuberculosis
AVVISSVSSVARVR

SEQ ID NO: 97823 - protein, 14 aa, Mycobacterium tuberculosis
VVISSVSSVARVRR

SEQ ID NO: 97824 - protein, 14 aa, Mycobacterium tuberculosis
VISSVSSVARVRRA

SEQ ID NO: 97825 - protein, 14 aa, Mycobacterium tuberculosis
ISSVSSVARVRRAS

SEQ ID NO: 97826 - protein, 14 aa, Mycobacterium tuberculosis
SSVSSVARVRRASV

SEQ ID NO: 97827 - protein, 14 aa, Mycobacterium tuberculosis
SVSSVARVRRASVS

SEQ ID NO: 97828 - protein, 14 aa, Mycobacterium tuberculosis
VSSVARVRRASVSS

SEQ ID NO: 97829 - protein, 14 aa, Mycobacterium tuberculosis
SSVARVRRASVSSV

SEQ ID NO: 97830 - protein, 14 aa, Mycobacterium tuberculosis
SVARVRRASVSSVD

SEQ ID NO: 97831 - protein, 14 aa, Mycobacterium tuberculosis
VARVRRASVSSVDA

SEQ ID NO: 97832 - protein, 14 aa, Mycobacterium tuberculosis
ARVRRASVSSVDAT

SEQ ID NO: 97833 - protein, 14 aa, Mycobacterium tuberculosis
RVRRASVSSVDATT

SEQ ID NO: 97834 - protein, 14 aa, Mycobacterium tuberculosis
VRRASVSSVDATTA

SEQ ID NO: 97835 - protein, 15 aa, Mycobacterium tuberculosis
MRARSDAGGQSVKSR

SEQ ID NO: 97836 - protein, 15 aa, Mycobacterium tuberculosis
RARSDAGGQSVKSRT

SEQ ID NO: 97837 - protein, 15 aa, Mycobacterium tuberculosis
ARSDAGGQSVKSRTS

SEQ ID NO: 97838 - protein, 15 aa, Mycobacterium tuberculosis
RSDAGGQSVKSRTSN

SEQ ID NO: 97839 - protein, 15 aa, Mycobacterium tuberculosis
SDAGGQSVKSRTSNR

SEQ ID NO: 97840 - protein, 15 aa, Mycobacterium tuberculosis
DAGGQSVKSRTSNRS

SEQ ID NO: 97841 - protein, 15 aa, Mycobacterium tuberculosis
AGGQSVKSRTSNRSR

SEQ ID NO: 97842 - protein, 15 aa, Mycobacterium tuberculosis
GGQSVKSRTSNRSRS

SEQ ID NO: 97843 - protein, 15 aa, Mycobacterium tuberculosis
GQSVKSRTSNRSRSS

SEQ ID NO: 97844 - protein, 15 aa, Mycobacterium tuberculosis
QSVKSRTSNRSRSSR

SEQ ID NO: 97845 - protein, 15 aa, Mycobacterium tuberculosis
SVKSRTSNRSRSSRR

SEQ ID NO: 97846 - protein, 15 aa, Mycobacterium tuberculosis
VKSRTSNRSRSSRRS

SEQ ID NO: 97847 - protein, 15 aa, Mycobacterium tuberculosis
KSRTSNRSRSSRRSR

SEQ ID NO: 97848 - protein, 15 aa, Mycobacterium tuberculosis
SRTSNRSRSSRRSRV

SEQ ID NO: 97849 - protein, 15 aa, Mycobacterium tuberculosis
RTSNRSRSSRRSRVR

SEQ ID NO: 97850 - protein, 15 aa, Mycobacterium tuberculosis
TSNRSRSSRRSRVRS

SEQ ID NO: 97851 - protein, 15 aa, Mycobacterium tuberculosis
SNRSRSSRRSRVRSS

SEQ ID NO: 97852 - protein, 15 aa, Mycobacterium tuberculosis
NRSRSSRRSRVRSSI

SEQ ID NO: 97853 - protein, 15 aa, Mycobacterium tuberculosis
RSRSSRRSRVRSSIS

SEQ ID NO: 97854 - protein, 15 aa, Mycobacterium tuberculosis
SRSSRRSRVRSSISA

SEQ ID NO: 97855 - protein, 15 aa, Mycobacterium tuberculosis
RSSRRSRVRSSISAL

SEQ ID NO: 97856 - protein, 15 aa, Mycobacterium tuberculosis
SSRRSRVRSSISALV

SEQ ID NO: 97857 - protein, 15 aa, Mycobacterium tuberculosis
SRRSRVRSSISALVD

SEQ ID NO: 97858 - protein, 15 aa, Mycobacterium tuberculosis
RRSRVRSSISALVDN

SEQ ID NO: 97859 - protein, 15 aa, Mycobacterium tuberculosis
RSRVRSSISALVDNP

SEQ ID NO: 97860 - protein, 15 aa, Mycobacterium tuberculosis
SRVRSSISALVDNPQ

SEQ ID NO: 97861 - protein, 15 aa, Mycobacterium tuberculosis
RVRSSISALVDNPQA

SEQ ID NO: 97862 - protein, 15 aa, Mycobacterium tuberculosis
VRSSISALVDNPQAR

SEQ ID NO: 97863 - protein, 15 aa, Mycobacterium tuberculosis
RSSISALVDNPQARP

SEQ ID NO: 97864 - protein, 15 aa, Mycobacterium tuberculosis
SSISALVDNPQARPR

SEQ ID NO: 97865 - protein, 15 aa, Mycobacterium tuberculosis
SISALVDNPQARPRE

SEQ ID NO: 97866 - protein, 15 aa, Mycobacterium tuberculosis
ISALVDNPQARPREL

SEQ ID NO: 97867 - protein, 15 aa, Mycobacterium tuberculosis
SALVDNPQARPRELP

SEQ ID NO: 97868 - protein, 15 aa, Mycobacterium tuberculosis
ALVDNPQARPRELPV

SEQ ID NO: 97869 - protein, 15 aa, Mycobacterium tuberculosis
LVDNPQARPRELPVL

SEQ ID NO: 97870 - protein, 15 aa, Mycobacterium tuberculosis
VDNPQARPRELPVLC

SEQ ID NO: 97871 - protein, 15 aa, Mycobacterium tuberculosis
DNPQARPRELPVLCG

SEQ ID NO: 97872 - protein, 15 aa, Mycobacterium tuberculosis
NPQARPRELPVLCGW

SEQ ID NO: 97873 - protein, 15 aa, Mycobacterium tuberculosis
PQARPRELPVLCGWP

SEQ ID NO: 97874 - protein, 15 aa, Mycobacterium tuberculosis
QARPRELPVLCGWPV

SEQ ID NO: 97875 - protein, 15 aa, Mycobacterium tuberculosis
ARPRELPVLCGWPVV

SEQ ID NO: 97876 - protein, 15 aa, Mycobacterium tuberculosis
RPRELPVLCGWPVVR

SEQ ID NO: 97877 - protein, 15 aa, Mycobacterium tuberculosis
PRELPVLCGWPVVRV

SEQ ID NO: 97878 - protein, 15 aa, Mycobacterium tuberculosis
RELPVLCGWPVVRVE

SEQ ID NO: 97879 - protein, 15 aa, Mycobacterium tuberculosis
ELPVLCGWPVVRVEP

SEQ ID NO: 97880 - protein, 15 aa, Mycobacterium tuberculosis
LPVLCGWPVVRVEPV

SEQ ID NO: 97881 - protein, 15 aa, Mycobacterium tuberculosis
PVLCGWPVVRVEPVC

SEQ ID NO: 97882 - protein, 15 aa, Mycobacterium tuberculosis
VLCGWPVVRVEPVCE

SEQ ID NO: 97883 - protein, 15 aa, Mycobacterium tuberculosis
LCGWPVVRVEPVCEF

SEQ ID NO: 97884 - protein, 15 aa, Mycobacterium tuberculosis
CGWPVVRVEPVCEFV

SEQ ID NO: 97885 - protein, 15 aa, Mycobacterium tuberculosis
GWPVVRVEPVCEFVP

SEQ ID NO: 97886 - protein, 15 aa, Mycobacterium tuberculosis
WPVVRVEPVCEFVPE

SEQ ID NO: 97887 - protein, 15 aa, Mycobacterium tuberculosis
PVVRVEPVCEFVPEP

SEQ ID NO: 97888 - protein, 15 aa, Mycobacterium tuberculosis
VVRVEPVCEFVPEPV

SEQ ID NO: 97889 - protein, 15 aa, Mycobacterium tuberculosis
VRVEPVCEFVPEPVC

SEQ ID NO: 97890 - protein, 15 aa, Mycobacterium tuberculosis
RVEPVCEFVPEPVCG

SEQ ID NO: 97891 - protein, 15 aa, Mycobacterium tuberculosis
VEPVCEFVPEPVCGQ

SEQ ID NO: 97892 - protein, 15 aa, Mycobacterium tuberculosis
EPVCEFVPEPVCGQA

SEQ ID NO: 97893 - protein, 15 aa, Mycobacterium tuberculosis
PVCEFVPEPVCGQAE

SEQ ID NO: 97894 - protein, 15 aa, Mycobacterium tuberculosis
VCEFVPEPVCGQAEV

SEQ ID NO: 97895 - protein, 15 aa, Mycobacterium tuberculosis
CEFVPEPVCGQAEVL

SEQ ID NO: 97896 - protein, 15 aa, Mycobacterium tuberculosis
EFVPEPVCGQAEVLG

SEQ ID NO: 97897 - protein, 15 aa, Mycobacterium tuberculosis
FVPEPVCGQAEVLGE

SEQ ID NO: 97898 - protein, 15 aa, Mycobacterium tuberculosis
VPEPVCGQAEVLGEP

SEQ ID NO: 97899 - protein, 15 aa, Mycobacterium tuberculosis
PEPVCGQAEVLGEPA

SEQ ID NO: 97900 - protein, 15 aa, Mycobacterium tuberculosis
EPVCGQAEVLGEPAA

SEQ ID NO: 97901 - protein, 15 aa, Mycobacterium tuberculosis
PVCGQAEVLGEPAAA

SEQ ID NO: 97902 - protein, 15 aa, Mycobacterium tuberculosis
VCGQAEVLGEPAAAH

SEQ ID NO: 97903 - protein, 15 aa, Mycobacterium tuberculosis
CGQAEVLGEPAAAHR

SEQ ID NO: 97904 - protein, 15 aa, Mycobacterium tuberculosis
GQAEVLGEPAAAHRV

SEQ ID NO: 97905 - protein, 15 aa, Mycobacterium tuberculosis
QAEVLGEPAAAHRVT

SEQ ID NO: 97906 - protein, 15 aa, Mycobacterium tuberculosis
AEVLGEPAAAHRVTS

SEQ ID NO: 97907 - protein, 15 aa, Mycobacterium tuberculosis
EVLGEPAAAHRVTSA

SEQ ID NO: 97908 - protein, 15 aa, Mycobacterium tuberculosis
VLGEPAAAHRVTSAR

SEQ ID NO: 97909 - protein, 15 aa, Mycobacterium tuberculosis
LGEPAAAHRVTSARR

SEQ ID NO: 97910 - protein, 15 aa, Mycobacterium tuberculosis
GEPAAAHRVTSARRS

SEQ ID NO: 97911 - protein, 15 aa, Mycobacterium tuberculosis
EPAAAHRVTSARRSP

SEQ ID NO: 97912 - protein, 15 aa, Mycobacterium tuberculosis
PAAAHRVTSARRSPS

SEQ ID NO: 97913 - protein, 15 aa, Mycobacterium tuberculosis
AAAHRVTSARRSPST

SEQ ID NO: 97914 - protein, 15 aa, Mycobacterium tuberculosis
AAHRVTSARRSPSTT

SEQ ID NO: 97915 - protein, 15 aa, Mycobacterium tuberculosis
AHRVTSARRSPSTTV

SEQ ID NO: 97916 - protein, 15 aa, Mycobacterium tuberculosis
HRVTSARRSPSTTVC

SEQ ID NO: 97917 - protein, 15 aa, Mycobacterium tuberculosis
RVTSARRSPSTTVCS

SEQ ID NO: 97918 - protein, 15 aa, Mycobacterium tuberculosis
VTSARRSPSTTVCSR

SEQ ID NO: 97919 - protein, 15 aa, Mycobacterium tuberculosis
TSARRSPSTTVCSRS

SEQ ID NO: 97920 - protein, 15 aa, Mycobacterium tuberculosis
SARRSPSTTVCSRSQ

SEQ ID NO: 97921 - protein, 15 aa, Mycobacterium tuberculosis
ARRSPSTTVCSRSQK

SEQ ID NO: 97922 - protein, 15 aa, Mycobacterium tuberculosis
RRSPSTTVCSRSQKA

SEQ ID NO: 97923 - protein, 15 aa, Mycobacterium tuberculosis
RSPSTTVCSRSQKAS

SEQ ID NO: 97924 - protein, 15 aa, Mycobacterium tuberculosis
SPSTTVCSRSQKASA

SEQ ID NO: 97925 - protein, 15 aa, Mycobacterium tuberculosis
PSTTVCSRSQKASAV

SEQ ID NO: 97926 - protein, 15 aa, Mycobacterium tuberculosis
STTVCSRSQKASAVV

SEQ ID NO: 97927 - protein, 15 aa, Mycobacterium tuberculosis
TTVCSRSQKASAVVI

SEQ ID NO: 97928 - protein, 15 aa, Mycobacterium tuberculosis
TVCSRSQKASAVVIS

SEQ ID NO: 97929 - protein, 15 aa, Mycobacterium tuberculosis
VCSRSQKASAVVISS

SEQ ID NO: 97930 - protein, 15 aa, Mycobacterium tuberculosis
CSRSQKASAVVISSV

SEQ ID NO: 97931 - protein, 15 aa, Mycobacterium tuberculosis
SRSQKASAVVISSVS

SEQ ID NO: 97932 - protein, 15 aa, Mycobacterium tuberculosis
RSQKASAVVISSVSS

SEQ ID NO: 97933 - protein, 15 aa, Mycobacterium tuberculosis
SQKASAVVISSVSSV

SEQ ID NO: 97934 - protein, 15 aa, Mycobacterium tuberculosis
QKASAVVISSVSSVA

SEQ ID NO: 97935 - protein, 15 aa, Mycobacterium tuberculosis
KASAVVISSVSSVAR

SEQ ID NO: 97936 - protein, 15 aa, Mycobacterium tuberculosis
ASAVVISSVSSVARV

SEQ ID NO: 97937 - protein, 15 aa, Mycobacterium tuberculosis
SAVVISSVSSVARVR

SEQ ID NO: 97938 - protein, 15 aa, Mycobacterium tuberculosis
AVVISSVSSVARVRR

SEQ ID NO: 97939 - protein, 15 aa, Mycobacterium tuberculosis
VVISSVSSVARVRRA

SEQ ID NO: 97940 - protein, 15 aa, Mycobacterium tuberculosis
VISSVSSVARVRRAS

SEQ ID NO: 97941 - protein, 15 aa, Mycobacterium tuberculosis
ISSVSSVARVRRASV

SEQ ID NO: 97942 - protein, 15 aa, Mycobacterium tuberculosis
SSVSSVARVRRASVS

SEQ ID NO: 97943 - protein, 15 aa, Mycobacterium tuberculosis
SVSSVARVRRASVSS

SEQ ID NO: 97944 - protein, 15 aa, Mycobacterium tuberculosis
VSSVARVRRASVSSV

SEQ ID NO: 97945 - protein, 15 aa, Mycobacterium tuberculosis
SSVARVRRASVSSVD

SEQ ID NO: 97946 - protein, 15 aa, Mycobacterium tuberculosis
SVARVRRASVSSVDA

SEQ ID NO: 97947 - protein, 15 aa, Mycobacterium tuberculosis
VARVRRASVSSVDAT

SEQ ID NO: 97948 - protein, 15 aa, Mycobacterium tuberculosis
ARVRRASVSSVDATT

SEQ ID NO: 97949 - protein, 15 aa, Mycobacterium tuberculosis
RVRRASVSSVDATTA

SEQ ID NO: 97950 - protein, 16 aa, Mycobacterium tuberculosis
MRARSDAGGQSVKSRT

SEQ ID NO: 97951 - protein, 16 aa, Mycobacterium tuberculosis
RARSDAGGQSVKSRTS

SEQ ID NO: 97952 - protein, 16 aa, Mycobacterium tuberculosis
ARSDAGGQSVKSRTSN

SEQ ID NO: 97953 - protein, 16 aa, Mycobacterium tuberculosis
RSDAGGQSVKSRTSNR

SEQ ID NO: 97954 - protein, 16 aa, Mycobacterium tuberculosis
SDAGGQSVKSRTSNRS

SEQ ID NO: 97955 - protein, 16 aa, Mycobacterium tuberculosis
DAGGQSVKSRTSNRSR

SEQ ID NO: 97956 - protein, 16 aa, Mycobacterium tuberculosis
AGGQSVKSRTSNRSRS

SEQ ID NO: 97957 - protein, 16 aa, Mycobacterium tuberculosis
GGQSVKSRTSNRSRSS

SEQ ID NO: 97958 - protein, 16 aa, Mycobacterium tuberculosis
GQSVKSRTSNRSRSSR

SEQ ID NO: 97959 - protein, 16 aa, Mycobacterium tuberculosis
QSVKSRTSNRSRSSRR

SEQ ID NO: 97960 - protein, 16 aa, Mycobacterium tuberculosis
SVKSRTSNRSRSSRRS

SEQ ID NO: 97961 - protein, 16 aa, Mycobacterium tuberculosis
VKSRTSNRSRSSRRSR

SEQ ID NO: 97962 - protein, 16 aa, Mycobacterium tuberculosis
KSRTSNRSRSSRRSRV

SEQ ID NO: 97963 - protein, 16 aa, Mycobacterium tuberculosis
SRTSNRSRSSRRSRVR

SEQ ID NO: 97964 - protein, 16 aa, Mycobacterium tuberculosis
RTSNRSRSSRRSRVRS

SEQ ID NO: 97965 - protein, 16 aa, Mycobacterium tuberculosis
TSNRSRSSRRSRVRSS

SEQ ID NO: 97966 - protein, 16 aa, Mycobacterium tuberculosis
SNRSRSSRRSRVRSSI

SEQ ID NO: 97967 - protein, 16 aa, Mycobacterium tuberculosis
NRSRSSRRSRVRSSIS

SEQ ID NO: 97968 - protein, 16 aa, Mycobacterium tuberculosis
RSRSSRRSRVRSSISA

SEQ ID NO: 97969 - protein, 16 aa, Mycobacterium tuberculosis
SRSSRRSRVRSSISAL

SEQ ID NO: 97970 - protein, 16 aa, Mycobacterium tuberculosis
RSSRRSRVRSSISALV

SEQ ID NO: 97971 - protein, 16 aa, Mycobacterium tuberculosis
SSRRSRVRSSISALVD

SEQ ID NO: 97972 - protein, 16 aa, Mycobacterium tuberculosis
SRRSRVRSSISALVDN

SEQ ID NO: 97973 - protein, 16 aa, Mycobacterium tuberculosis
RRSRVRSSISALVDNP

SEQ ID NO: 97974 - protein, 16 aa, Mycobacterium tuberculosis
RSRVRSSISALVDNPQ

SEQ ID NO: 97975 - protein, 16 aa, Mycobacterium tuberculosis
SRVRSSISALVDNPQA

SEQ ID NO: 97976 - protein, 16 aa, Mycobacterium tuberculosis
RVRSSISALVDNPQAR

SEQ ID NO: 97977 - protein, 16 aa, Mycobacterium tuberculosis
VRSSISALVDNPQARP

SEQ ID NO: 97978 - protein, 16 aa, Mycobacterium tuberculosis
RSSISALVDNPQARPR

SEQ ID NO: 97979 - protein, 16 aa, Mycobacterium tuberculosis
SSISALVDNPQARPRE

SEQ ID NO: 97980 - protein, 16 aa, Mycobacterium tuberculosis
SISALVDNPQARPREL

SEQ ID NO: 97981 - protein, 16 aa, Mycobacterium tuberculosis
ISALVDNPQARPRELP

SEQ ID NO: 97982 - protein, 16 aa, Mycobacterium tuberculosis
SALVDNPQARPRELPV

SEQ ID NO: 97983 - protein, 16 aa, Mycobacterium tuberculosis
ALVDNPQARPRELPVL

SEQ ID NO: 97984 - protein, 16 aa, Mycobacterium tuberculosis
LVDNPQARPRELPVLC

SEQ ID NO: 97985 - protein, 16 aa, Mycobacterium tuberculosis
VDNPQARPRELPVLCG

SEQ ID NO: 97986 - protein, 16 aa, Mycobacterium tuberculosis
DNPQARPRELPVLCGW

SEQ ID NO: 97987 - protein, 16 aa, Mycobacterium tuberculosis
NPQARPRELPVLCGWP

SEQ ID NO: 97988 - protein, 16 aa, Mycobacterium tuberculosis
PQARPRELPVLCGWPV

SEQ ID NO: 97989 - protein, 16 aa, Mycobacterium tuberculosis
QARPRELPVLCGWPVV

SEQ ID NO: 97990 - protein, 16 aa, Mycobacterium tuberculosis
ARPRELPVLCGWPVVR

SEQ ID NO: 97991 - protein, 16 aa, Mycobacterium tuberculosis
RPRELPVLCGWPVVRV

SEQ ID NO: 97992 - protein, 16 aa, Mycobacterium tuberculosis
PRELPVLCGWPVVRVE

SEQ ID NO: 97993 - protein, 16 aa, Mycobacterium tuberculosis
RELPVLCGWPVVRVEP

SEQ ID NO: 97994 - protein, 16 aa, Mycobacterium tuberculosis
ELPVLCGWPVVRVEPV

SEQ ID NO: 97995 - protein, 16 aa, Mycobacterium tuberculosis
LPVLCGWPVVRVEPVC

SEQ ID NO: 97996 - protein, 16 aa, Mycobacterium tuberculosis
PVLCGWPVVRVEPVCE

SEQ ID NO: 97997 - protein, 16 aa, Mycobacterium tuberculosis
VLCGWPVVRVEPVCEF

SEQ ID NO: 97998 - protein, 16 aa, Mycobacterium tuberculosis
LCGWPVVRVEPVCEFV

SEQ ID NO: 97999 - protein, 16 aa, Mycobacterium tuberculosis
CGWPVVRVEPVCEFVP

SEQ ID NO: 98000 - protein, 16 aa, Mycobacterium tuberculosis
GWPVVRVEPVCEFVPE

SEQ ID NO: 98001 - protein, 16 aa, Mycobacterium tuberculosis
WPVVRVEPVCEFVPEP

SEQ ID NO: 98002 - protein, 16 aa, Mycobacterium tuberculosis
PVVRVEPVCEFVPEPV

SEQ ID NO: 98003 - protein, 16 aa, Mycobacterium tuberculosis
VVRVEPVCEFVPEPVC

SEQ ID NO: 98004 - protein, 16 aa, Mycobacterium tuberculosis
VRVEPVCEFVPEPVCG

SEQ ID NO: 98005 - protein, 16 aa, Mycobacterium tuberculosis
RVEPVCEFVPEPVCGQ

SEQ ID NO: 98006 - protein, 16 aa, Mycobacterium tuberculosis
VEPVCEFVPEPVCGQA

SEQ ID NO: 98007 - protein, 16 aa, Mycobacterium tuberculosis
EPVCEFVPEPVCGQAE

SEQ ID NO: 98008 - protein, 16 aa, Mycobacterium tuberculosis
PVCEFVPEPVCGQAEV

SEQ ID NO: 98009 - protein, 16 aa, Mycobacterium tuberculosis
VCEFVPEPVCGQAEVL

SEQ ID NO: 98010 - protein, 16 aa, Mycobacterium tuberculosis
CEFVPEPVCGQAEVLG

SEQ ID NO: 98011 - protein, 16 aa, Mycobacterium tuberculosis
EFVPEPVCGQAEVLGE

SEQ ID NO: 98012 - protein, 16 aa, Mycobacterium tuberculosis
FVPEPVCGQAEVLGEP

SEQ ID NO: 98013 - protein, 16 aa, Mycobacterium tuberculosis
VPEPVCGQAEVLGEPA

SEQ ID NO: 98014 - protein, 16 aa, Mycobacterium tuberculosis
PEPVCGQAEVLGEPAA

SEQ ID NO: 98015 - protein, 16 aa, Mycobacterium tuberculosis
EPVCGQAEVLGEPAAA

SEQ ID NO: 98016 - protein, 16 aa, Mycobacterium tuberculosis
PVCGQAEVLGEPAAAH

SEQ ID NO: 98017 - protein, 16 aa, Mycobacterium tuberculosis
VCGQAEVLGEPAAAHR

SEQ ID NO: 98018 - protein, 16 aa, Mycobacterium tuberculosis
CGQAEVLGEPAAAHRV

SEQ ID NO: 98019 - protein, 16 aa, Mycobacterium tuberculosis
GQAEVLGEPAAAHRVT

SEQ ID NO: 98020 - protein, 16 aa, Mycobacterium tuberculosis
QAEVLGEPAAAHRVTS

SEQ ID NO: 98021 - protein, 16 aa, Mycobacterium tuberculosis
AEVLGEPAAAHRVTSA

SEQ ID NO: 98022 - protein, 16 aa, Mycobacterium tuberculosis
EVLGEPAAAHRVTSAR

SEQ ID NO: 98023 - protein, 16 aa, Mycobacterium tuberculosis
VLGEPAAAHRVTSARR

SEQ ID NO: 98024 - protein, 16 aa, Mycobacterium tuberculosis
LGEPAAAHRVTSARRS

SEQ ID NO: 98025 - protein, 16 aa, Mycobacterium tuberculosis
GEPAAAHRVTSARRSP

SEQ ID NO: 98026 - protein, 16 aa, Mycobacterium tuberculosis
EPAAAHRVTSARRSPS

SEQ ID NO: 98027 - protein, 16 aa, Mycobacterium tuberculosis
PAAAHRVTSARRSPST

SEQ ID NO: 98028 - protein, 16 aa, Mycobacterium tuberculosis
AAAHRVTSARRSPSTT

SEQ ID NO: 98029 - protein, 16 aa, Mycobacterium tuberculosis
AAHRVTSARRSPSTTV

SEQ ID NO: 98030 - protein, 16 aa, Mycobacterium tuberculosis
AHRVTSARRSPSTTVC

SEQ ID NO: 98031 - protein, 16 aa, Mycobacterium tuberculosis
HRVTSARRSPSTTVCS

SEQ ID NO: 98032 - protein, 16 aa, Mycobacterium tuberculosis
RVTSARRSPSTTVCSR

SEQ ID NO: 98033 - protein, 16 aa, Mycobacterium tuberculosis
VTSARRSPSTTVCSRS

SEQ ID NO: 98034 - protein, 16 aa, Mycobacterium tuberculosis
TSARRSPSTTVCSRSQ

SEQ ID NO: 98035 - protein, 16 aa, Mycobacterium tuberculosis
SARRSPSTTVCSRSQK

SEQ ID NO: 98036 - protein, 16 aa, Mycobacterium tuberculosis
ARRSPSTTVCSRSQKA

SEQ ID NO: 98037 - protein, 16 aa, Mycobacterium tuberculosis
RRSPSTTVCSRSQKAS

SEQ ID NO: 98038 - protein, 16 aa, Mycobacterium tuberculosis
RSPSTTVCSRSQKASA

SEQ ID NO: 98039 - protein, 16 aa, Mycobacterium tuberculosis
SPSTTVCSRSQKASAV

SEQ ID NO: 98040 - protein, 16 aa, Mycobacterium tuberculosis
PSTTVCSRSQKASAVV

SEQ ID NO: 98041 - protein, 16 aa, Mycobacterium tuberculosis
STTVCSRSQKASAVVI

SEQ ID NO: 98042 - protein, 16 aa, Mycobacterium tuberculosis
TTVCSRSQKASAVVIS

SEQ ID NO: 98043 - protein, 16 aa, Mycobacterium tuberculosis
TVCSRSQKASAVVISS

SEQ ID NO: 98044 - protein, 16 aa, Mycobacterium tuberculosis
VCSRSQKASAVVISSV

SEQ ID NO: 98045 - protein, 16 aa, Mycobacterium tuberculosis
CSRSQKASAVVISSVS

SEQ ID NO: 98046 - protein, 16 aa, Mycobacterium tuberculosis
SRSQKASAVVISSVSS

SEQ ID NO: 98047 - protein, 16 aa, Mycobacterium tuberculosis
RSQKASAVVISSVSSV

SEQ ID NO: 98048 - protein, 16 aa, Mycobacterium tuberculosis
SQKASAVVISSVSSVA

SEQ ID NO: 98049 - protein, 16 aa, Mycobacterium tuberculosis
QKASAVVISSVSSVAR

SEQ ID NO: 98050 - protein, 16 aa, Mycobacterium tuberculosis
KASAVVISSVSSVARV

SEQ ID NO: 98051 - protein, 16 aa, Mycobacterium tuberculosis
ASAVVISSVSSVARVR

SEQ ID NO: 98052 - protein, 16 aa, Mycobacterium tuberculosis
SAVVISSVSSVARVRR

SEQ ID NO: 98053 - protein, 16 aa, Mycobacterium tuberculosis
AVVISSVSSVARVRRA

SEQ ID NO: 98054 - protein, 16 aa, Mycobacterium tuberculosis
VVISSVSSVARVRRAS

SEQ ID NO: 98055 - protein, 16 aa, Mycobacterium tuberculosis
VISSVSSVARVRRASV

SEQ ID NO: 98056 - protein, 16 aa, Mycobacterium tuberculosis
ISSVSSVARVRRASVS

SEQ ID NO: 98057 - protein, 16 aa, Mycobacterium tuberculosis
SSVSSVARVRRASVSS

SEQ ID NO: 98058 - protein, 16 aa, Mycobacterium tuberculosis
SVSSVARVRRASVSSV

SEQ ID NO: 98059 - protein, 16 aa, Mycobacterium tuberculosis
VSSVARVRRASVSSVD

SEQ ID NO: 98060 - protein, 16 aa, Mycobacterium tuberculosis
SSVARVRRASVSSVDA

SEQ ID NO: 98061 - protein, 16 aa, Mycobacterium tuberculosis
SVARVRRASVSSVDAT

SEQ ID NO: 98062 - protein, 16 aa, Mycobacterium tuberculosis
VARVRRASVSSVDATT

SEQ ID NO: 98063 - protein, 16 aa, Mycobacterium tuberculosis
ARVRRASVSSVDATTA

SEQ ID NO: 98064 - protein, 13 aa, Mycobacterium tuberculosis
MDDLTRLRRELLD

SEQ ID NO: 98065 - protein, 13 aa, Mycobacterium tuberculosis
DDLTRLRRELLDR

SEQ ID NO: 98066 - protein, 13 aa, Mycobacterium tuberculosis
DLTRLRRELLDRF

SEQ ID NO: 98067 - protein, 13 aa, Mycobacterium tuberculosis
LTRLRRELLDRFD

SEQ ID NO: 98068 - protein, 13 aa, Mycobacterium tuberculosis
TRLRRELLDRFDV

SEQ ID NO: 98069 - protein, 13 aa, Mycobacterium tuberculosis
RLRRELLDRFDVR

SEQ ID NO: 98070 - protein, 13 aa, Mycobacterium tuberculosis
LRRELLDRFDVRD

SEQ ID NO: 98071 - protein, 13 aa, Mycobacterium tuberculosis
RRELLDRFDVRDF

SEQ ID NO: 98072 - protein, 13 aa, Mycobacterium tuberculosis
RELLDRFDVRDFT

SEQ ID NO: 98073 - protein, 13 aa, Mycobacterium tuberculosis
ELLDRFDVRDFTD

SEQ ID NO: 98074 - protein, 13 aa, Mycobacterium tuberculosis
LLDRFDVRDFTDW

SEQ ID NO: 98075 - protein, 13 aa, Mycobacterium tuberculosis
LDRFDVRDFTDWP

SEQ ID NO: 98076 - protein, 13 aa, Mycobacterium tuberculosis
DRFDVRDFTDWPP

SEQ ID NO: 98077 - protein, 13 aa, Mycobacterium tuberculosis
RFDVRDFTDWPPA

SEQ ID NO: 98078 - protein, 13 aa, Mycobacterium tuberculosis
FDVRDFTDWPPAS

SEQ ID NO: 98079 - protein, 13 aa, Mycobacterium tuberculosis
DVRDFTDWPPASL

SEQ ID NO: 98080 - protein, 13 aa, Mycobacterium tuberculosis
VRDFTDWPPASLR

SEQ ID NO: 98081 - protein, 13 aa, Mycobacterium tuberculosis
RDFTDWPPASLRA

SEQ ID NO: 98082 - protein, 13 aa, Mycobacterium tuberculosis
DFTDWPPASLRAL

SEQ ID NO: 98083 - protein, 13 aa, Mycobacterium tuberculosis
FTDWPPASLRALI

SEQ ID NO: 98084 - protein, 13 aa, Mycobacterium tuberculosis
TDWPPASLRALIA

SEQ ID NO: 98085 - protein, 13 aa, Mycobacterium tuberculosis
DWPPASLRALIAT

SEQ ID NO: 98086 - protein, 13 aa, Mycobacterium tuberculosis
WPPASLRALIATY

SEQ ID NO: 98087 - protein, 13 aa, Mycobacterium tuberculosis
PPASLRALIATYD

SEQ ID NO: 98088 - protein, 13 aa, Mycobacterium tuberculosis
PASLRALIATYDP

SEQ ID NO: 98089 - protein, 13 aa, Mycobacterium tuberculosis
ASLRALIATYDPW

SEQ ID NO: 98090 - protein, 13 aa, Mycobacterium tuberculosis
SLRALIATYDPWI

SEQ ID NO: 98091 - protein, 13 aa, Mycobacterium tuberculosis
LRALIATYDPWID

SEQ ID NO: 98092 - protein, 13 aa, Mycobacterium tuberculosis
RALIATYDPWIDM

SEQ ID NO: 98093 - protein, 13 aa, Mycobacterium tuberculosis
ALIATYDPWIDMT

SEQ ID NO: 98094 - protein, 13 aa, Mycobacterium tuberculosis
LIATYDPWIDMTA

SEQ ID NO: 98095 - protein, 13 aa, Mycobacterium tuberculosis
IATYDPWIDMTAS

SEQ ID NO: 98096 - protein, 13 aa, Mycobacterium tuberculosis
ATYDPWIDMTASP

SEQ ID NO: 98097 - protein, 13 aa, Mycobacterium tuberculosis
TYDPWIDMTASPP

SEQ ID NO: 98098 - protein, 13 aa, Mycobacterium tuberculosis
YDPWIDMTASPPQ

SEQ ID NO: 98099 - protein, 13 aa, Mycobacterium tuberculosis
DPWIDMTASPPQP

SEQ ID NO: 98100 - protein, 13 aa, Mycobacterium tuberculosis
PWIDMTASPPQPV

SEQ ID NO: 98101 - protein, 13 aa, Mycobacterium tuberculosis
WIDMTASPPQPVS

SEQ ID NO: 98102 - protein, 13 aa, Mycobacterium tuberculosis
IDMTASPPQPVSP

SEQ ID NO: 98103 - protein, 13 aa, Mycobacterium tuberculosis
DMTASPPQPVSPG

SEQ ID NO: 98104 - protein, 13 aa, Mycobacterium tuberculosis
MTASPPQPVSPGG

SEQ ID NO: 98105 - protein, 13 aa, Mycobacterium tuberculosis
TASPPQPVSPGGP

SEQ ID NO: 98106 - protein, 13 aa, Mycobacterium tuberculosis
ASPPQPVSPGGPR

SEQ ID NO: 98107 - protein, 13 aa, Mycobacterium tuberculosis
SPPQPVSPGGPRL

SEQ ID NO: 98108 - protein, 13 aa, Mycobacterium tuberculosis
PPQPVSPGGPRLR

SEQ ID NO: 98109 - protein, 13 aa, Mycobacterium tuberculosis
PQPVSPGGPRLRL

SEQ ID NO: 98110 - protein, 13 aa, Mycobacterium tuberculosis
QPVSPGGPRLRLV

SEQ ID NO: 98111 - protein, 13 aa, Mycobacterium tuberculosis
PVSPGGPRLRLVR

SEQ ID NO: 98112 - protein, 13 aa, Mycobacterium tuberculosis
VSPGGPRLRLVRL

SEQ ID NO: 98113 - protein, 13 aa, Mycobacterium tuberculosis
SPGGPRLRLVRLT

SEQ ID NO: 98114 - protein, 13 aa, Mycobacterium tuberculosis
PGGPRLRLVRLTT

SEQ ID NO: 98115 - protein, 13 aa, Mycobacterium tuberculosis
GGPRLRLVRLTTN

SEQ ID NO: 98116 - protein, 13 aa, Mycobacterium tuberculosis
GPRLRLVRLTTNP

SEQ ID NO: 98117 - protein, 13 aa, Mycobacterium tuberculosis
PRLRLVRLTTNPS

SEQ ID NO: 98118 - protein, 13 aa, Mycobacterium tuberculosis
RLRLVRLTTNPSA

SEQ ID NO: 98119 - protein, 13 aa, Mycobacterium tuberculosis
LRLVRLTTNPSAR

SEQ ID NO: 98120 - protein, 13 aa, Mycobacterium tuberculosis
RLVRLTTNPSARA

SEQ ID NO: 98121 - protein, 13 aa, Mycobacterium tuberculosis
LVRLTTNPSARAA

SEQ ID NO: 98122 - protein, 13 aa, Mycobacterium tuberculosis
VRLTTNPSARAAP

SEQ ID NO: 98123 - protein, 13 aa, Mycobacterium tuberculosis
RLTTNPSARAAPI

SEQ ID NO: 98124 - protein, 13 aa, Mycobacterium tuberculosis
LTTNPSARAAPIG

SEQ ID NO: 98125 - protein, 13 aa, Mycobacterium tuberculosis
TTNPSARAAPIGN

SEQ ID NO: 98126 - protein, 13 aa, Mycobacterium tuberculosis
TNPSARAAPIGNG

SEQ ID NO: 98127 - protein, 13 aa, Mycobacterium tuberculosis
NPSARAAPIGNGG

SEQ ID NO: 98128 - protein, 13 aa, Mycobacterium tuberculosis
PSARAAPIGNGGD

SEQ ID NO: 98129 - protein, 13 aa, Mycobacterium tuberculosis
SARAAPIGNGGDS

SEQ ID NO: 98130 - protein, 13 aa, Mycobacterium tuberculosis
ARAAPIGNGGDSS

SEQ ID NO: 98131 - protein, 13 aa, Mycobacterium tuberculosis
RAAPIGNGGDSSV

SEQ ID NO: 98132 - protein, 13 aa, Mycobacterium tuberculosis
AAPIGNGGDSSVC

SEQ ID NO: 98133 - protein, 13 aa, Mycobacterium tuberculosis
APIGNGGDSSVCA

SEQ ID NO: 98134 - protein, 13 aa, Mycobacterium tuberculosis
PIGNGGDSSVCAG

SEQ ID NO: 98135 - protein, 13 aa, Mycobacterium tuberculosis
IGNGGDSSVCAGE

SEQ ID NO: 98136 - protein, 13 aa, Mycobacterium tuberculosis
GNGGDSSVCAGEK

SEQ ID NO: 98137 - protein, 13 aa, Mycobacterium tuberculosis
NGGDSSVCAGEKQ

SEQ ID NO: 98138 - protein, 13 aa, Mycobacterium tuberculosis
GGDSSVCAGEKQC

SEQ ID NO: 98139 - protein, 13 aa, Mycobacterium tuberculosis
GDSSVCAGEKQCR

SEQ ID NO: 98140 - protein, 13 aa, Mycobacterium tuberculosis
DSSVCAGEKQCRP

SEQ ID NO: 98141 - protein, 13 aa, Mycobacterium tuberculosis
SSVCAGEKQCRPP

SEQ ID NO: 98142 - protein, 14 aa, Mycobacterium tuberculosis
MDDLTRLRRELLDR

SEQ ID NO: 98143 - protein, 14 aa, Mycobacterium tuberculosis
DDLTRLRRELLDRF

SEQ ID NO: 98144 - protein, 14 aa, Mycobacterium tuberculosis
DLTRLRRELLDRFD

SEQ ID NO: 98145 - protein, 14 aa, Mycobacterium tuberculosis
LTRLRRELLDRFDV

SEQ ID NO: 98146 - protein, 14 aa, Mycobacterium tuberculosis
TRLRRELLDRFDVR

SEQ ID NO: 98147 - protein, 14 aa, Mycobacterium tuberculosis
RLRRELLDRFDVRD

SEQ ID NO: 98148 - protein, 14 aa, Mycobacterium tuberculosis
LRRELLDRFDVRDF

SEQ ID NO: 98149 - protein, 14 aa, Mycobacterium tuberculosis
RRELLDRFDVRDFT

SEQ ID NO: 98150 - protein, 14 aa, Mycobacterium tuberculosis
RELLDRFDVRDFTD

SEQ ID NO: 98151 - protein, 14 aa, Mycobacterium tuberculosis
ELLDRFDVRDFTDW

SEQ ID NO: 98152 - protein, 14 aa, Mycobacterium tuberculosis
LLDRFDVRDFTDWP

SEQ ID NO: 98153 - protein, 14 aa, Mycobacterium tuberculosis
LDRFDVRDFTDWPP

SEQ ID NO: 98154 - protein, 14 aa, Mycobacterium tuberculosis
DRFDVRDFTDWPPA

SEQ ID NO: 98155 - protein, 14 aa, Mycobacterium tuberculosis
RFDVRDFTDWPPAS

SEQ ID NO: 98156 - protein, 14 aa, Mycobacterium tuberculosis
FDVRDFTDWPPASL

SEQ ID NO: 98157 - protein, 14 aa, Mycobacterium tuberculosis
DVRDFTDWPPASLR

SEQ ID NO: 98158 - protein, 14 aa, Mycobacterium tuberculosis
VRDFTDWPPASLRA

SEQ ID NO: 98159 - protein, 14 aa, Mycobacterium tuberculosis
RDFTDWPPASLRAL

SEQ ID NO: 98160 - protein, 14 aa, Mycobacterium tuberculosis
DFTDWPPASLRALI

SEQ ID NO: 98161 - protein, 14 aa, Mycobacterium tuberculosis
FTDWPPASLRALIA

SEQ ID NO: 98162 - protein, 14 aa, Mycobacterium tuberculosis
TDWPPASLRALIAT

SEQ ID NO: 98163 - protein, 14 aa, Mycobacterium tuberculosis
DWPPASLRALIATY

SEQ ID NO: 98164 - protein, 14 aa, Mycobacterium tuberculosis
WPPASLRALIATYD

SEQ ID NO: 98165 - protein, 14 aa, Mycobacterium tuberculosis
PPASLRALIATYDP

SEQ ID NO: 98166 - protein, 14 aa, Mycobacterium tuberculosis
PASLRALIATYDPW

SEQ ID NO: 98167 - protein, 14 aa, Mycobacterium tuberculosis
ASLRALIATYDPWI

SEQ ID NO: 98168 - protein, 14 aa, Mycobacterium tuberculosis
SLRALIATYDPWID

SEQ ID NO: 98169 - protein, 14 aa, Mycobacterium tuberculosis
LRALIATYDPWIDM

SEQ ID NO: 98170 - protein, 14 aa, Mycobacterium tuberculosis
RALIATYDPWIDMT

SEQ ID NO: 98171 - protein, 14 aa, Mycobacterium tuberculosis
ALIATYDPWIDMTA

SEQ ID NO: 98172 - protein, 14 aa, Mycobacterium tuberculosis
LIATYDPWIDMTAS

SEQ ID NO: 98173 - protein, 14 aa, Mycobacterium tuberculosis
IATYDPWIDMTASP

SEQ ID NO: 98174 - protein, 14 aa, Mycobacterium tuberculosis
ATYDPWIDMTASPP

SEQ ID NO: 98175 - protein, 14 aa, Mycobacterium tuberculosis
TYDPWIDMTASPPQ

SEQ ID NO: 98176 - protein, 14 aa, Mycobacterium tuberculosis
YDPWIDMTASPPQP

SEQ ID NO: 98177 - protein, 14 aa, Mycobacterium tuberculosis
DPWIDMTASPPQPV

SEQ ID NO: 98178 - protein, 14 aa, Mycobacterium tuberculosis
PWIDMTASPPQPVS

SEQ ID NO: 98179 - protein, 14 aa, Mycobacterium tuberculosis
WIDMTASPPQPVSP

SEQ ID NO: 98180 - protein, 14 aa, Mycobacterium tuberculosis
IDMTASPPQPVSPG

SEQ ID NO: 98181 - protein, 14 aa, Mycobacterium tuberculosis
DMTASPPQPVSPGG

SEQ ID NO: 98182 - protein, 14 aa, Mycobacterium tuberculosis
MTASPPQPVSPGGP

SEQ ID NO: 98183 - protein, 14 aa, Mycobacterium tuberculosis
TASPPQPVSPGGPR

SEQ ID NO: 98184 - protein, 14 aa, Mycobacterium tuberculosis
ASPPQPVSPGGPRL

SEQ ID NO: 98185 - protein, 14 aa, Mycobacterium tuberculosis
SPPQPVSPGGPRLR

SEQ ID NO: 98186 - protein, 14 aa, Mycobacterium tuberculosis
PPQPVSPGGPRLRL

SEQ ID NO: 98187 - protein, 14 aa, Mycobacterium tuberculosis
PQPVSPGGPRLRLV

SEQ ID NO: 98188 - protein, 14 aa, Mycobacterium tuberculosis
QPVSPGGPRLRLVR

SEQ ID NO: 98189 - protein, 14 aa, Mycobacterium tuberculosis
PVSPGGPRLRLVRL

SEQ ID NO: 98190 - protein, 14 aa, Mycobacterium tuberculosis
VSPGGPRLRLVRLT

SEQ ID NO: 98191 - protein, 14 aa, Mycobacterium tuberculosis
SPGGPRLRLVRLTT

SEQ ID NO: 98192 - protein, 14 aa, Mycobacterium tuberculosis
PGGPRLRLVRLTTN

SEQ ID NO: 98193 - protein, 14 aa, Mycobacterium tuberculosis
GGPRLRLVRLTTNP

SEQ ID NO: 98194 - protein, 14 aa, Mycobacterium tuberculosis
GPRLRLVRLTTNPS

SEQ ID NO: 98195 - protein, 14 aa, Mycobacterium tuberculosis
PRLRLVRLTTNPSA

SEQ ID NO: 98196 - protein, 14 aa, Mycobacterium tuberculosis
RLRLVRLTTNPSAR

SEQ ID NO: 98197 - protein, 14 aa, Mycobacterium tuberculosis
LRLVRLTTNPSARA

SEQ ID NO: 98198 - protein, 14 aa, Mycobacterium tuberculosis
RLVRLTTNPSARAA

SEQ ID NO: 98199 - protein, 14 aa, Mycobacterium tuberculosis
LVRLTTNPSARAAP

SEQ ID NO: 98200 - protein, 14 aa, Mycobacterium tuberculosis
VRLTTNPSARAAPI

SEQ ID NO: 98201 - protein, 14 aa, Mycobacterium tuberculosis
RLTTNPSARAAPIG

SEQ ID NO: 98202 - protein, 14 aa, Mycobacterium tuberculosis
LTTNPSARAAPIGN

SEQ ID NO: 98203 - protein, 14 aa, Mycobacterium tuberculosis
TTNPSARAAPIGNG

SEQ ID NO: 98204 - protein, 14 aa, Mycobacterium tuberculosis
TNPSARAAPIGNGG

SEQ ID NO: 98205 - protein, 14 aa, Mycobacterium tuberculosis
NPSARAAPIGNGGD

SEQ ID NO: 98206 - protein, 14 aa, Mycobacterium tuberculosis
PSARAAPIGNGGDS

SEQ ID NO: 98207 - protein, 14 aa, Mycobacterium tuberculosis
SARAAPIGNGGDSS

SEQ ID NO: 98208 - protein, 14 aa, Mycobacterium tuberculosis
ARAAPIGNGGDSSV

SEQ ID NO: 98209 - protein, 14 aa, Mycobacterium tuberculosis
RAAPIGNGGDSSVC

SEQ ID NO: 98210 - protein, 14 aa, Mycobacterium tuberculosis
AAPIGNGGDSSVCA

SEQ ID NO: 98211 - protein, 14 aa, Mycobacterium tuberculosis
APIGNGGDSSVCAG

SEQ ID NO: 98212 - protein, 14 aa, Mycobacterium tuberculosis
PIGNGGDSSVCAGE

SEQ ID NO: 98213 - protein, 14 aa, Mycobacterium tuberculosis
IGNGGDSSVCAGEK

SEQ ID NO: 98214 - protein, 14 aa, Mycobacterium tuberculosis
GNGGDSSVCAGEKQ

SEQ ID NO: 98215 - protein, 14 aa, Mycobacterium tuberculosis
NGGDSSVCAGEKQC

SEQ ID NO: 98216 - protein, 14 aa, Mycobacterium tuberculosis
GGDSSVCAGEKQCR

SEQ ID NO: 98217 - protein, 14 aa, Mycobacterium tuberculosis
GDSSVCAGEKQCRP

SEQ ID NO: 98218 - protein, 14 aa, Mycobacterium tuberculosis
DSSVCAGEKQCRPP

SEQ ID NO: 98219 - protein, 15 aa, Mycobacterium tuberculosis
MDDLTRLRRELLDRF

SEQ ID NO: 98220 - protein, 15 aa, Mycobacterium tuberculosis
DDLTRLRRELLDRFD

SEQ ID NO: 98221 - protein, 15 aa, Mycobacterium tuberculosis
DLTRLRRELLDRFDV

SEQ ID NO: 98222 - protein, 15 aa, Mycobacterium tuberculosis
LTRLRRELLDRFDVR

SEQ ID NO: 98223 - protein, 15 aa, Mycobacterium tuberculosis
TRLRRELLDRFDVRD

SEQ ID NO: 98224 - protein, 15 aa, Mycobacterium tuberculosis
RLRRELLDRFDVRDF

SEQ ID NO: 98225 - protein, 15 aa, Mycobacterium tuberculosis
LRRELLDRFDVRDFT

SEQ ID NO: 98226 - protein, 15 aa, Mycobacterium tuberculosis
RRELLDRFDVRDFTD

SEQ ID NO: 98227 - protein, 15 aa, Mycobacterium tuberculosis
RELLDRFDVRDFTDW

SEQ ID NO: 98228 - protein, 15 aa, Mycobacterium tuberculosis
ELLDRFDVRDFTDWP

SEQ ID NO: 98229 - protein, 15 aa, Mycobacterium tuberculosis
LLDRFDVRDFTDWPP

SEQ ID NO: 98230 - protein, 15 aa, Mycobacterium tuberculosis
LDRFDVRDFTDWPPA

SEQ ID NO: 98231 - protein, 15 aa, Mycobacterium tuberculosis
DRFDVRDFTDWPPAS

SEQ ID NO: 98232 - protein, 15 aa, Mycobacterium tuberculosis
RFDVRDFTDWPPASL

SEQ ID NO: 98233 - protein, 15 aa, Mycobacterium tuberculosis
FDVRDFTDWPPASLR

SEQ ID NO: 98234 - protein, 15 aa, Mycobacterium tuberculosis
DVRDFTDWPPASLRA

SEQ ID NO: 98235 - protein, 15 aa, Mycobacterium tuberculosis
VRDFTDWPPASLRAL

SEQ ID NO: 98236 - protein, 15 aa, Mycobacterium tuberculosis
RDFTDWPPASLRALI

SEQ ID NO: 98237 - protein, 15 aa, Mycobacterium tuberculosis
DFTDWPPASLRALIA

SEQ ID NO: 98238 - protein, 15 aa, Mycobacterium tuberculosis
FTDWPPASLRALIAT

SEQ ID NO: 98239 - protein, 15 aa, Mycobacterium tuberculosis
TDWPPASLRALIATY

SEQ ID NO: 98240 - protein, 15 aa, Mycobacterium tuberculosis
DWPPASLRALIATYD

SEQ ID NO: 98241 - protein, 15 aa, Mycobacterium tuberculosis
WPPASLRALIATYDP

SEQ ID NO: 98242 - protein, 15 aa, Mycobacterium tuberculosis
PPASLRALIATYDPW

SEQ ID NO: 98243 - protein, 15 aa, Mycobacterium tuberculosis
PASLRALIATYDPWI

SEQ ID NO: 98244 - protein, 15 aa, Mycobacterium tuberculosis
ASLRALIATYDPWID

SEQ ID NO: 98245 - protein, 15 aa, Mycobacterium tuberculosis
SLRALIATYDPWIDM

SEQ ID NO: 98246 - protein, 15 aa, Mycobacterium tuberculosis
LRALIATYDPWIDMT

SEQ ID NO: 98247 - protein, 15 aa, Mycobacterium tuberculosis
RALIATYDPWIDMTA

SEQ ID NO: 98248 - protein, 15 aa, Mycobacterium tuberculosis
ALIATYDPWIDMTAS

SEQ ID NO: 98249 - protein, 15 aa, Mycobacterium tuberculosis
LIATYDPWIDMTASP

SEQ ID NO: 98250 - protein, 15 aa, Mycobacterium tuberculosis
IATYDPWIDMTASPP

SEQ ID NO: 98251 - protein, 15 aa, Mycobacterium tuberculosis
ATYDPWIDMTASPPQ

SEQ ID NO: 98252 - protein, 15 aa, Mycobacterium tuberculosis
TYDPWIDMTASPPQP

SEQ ID NO: 98253 - protein, 15 aa, Mycobacterium tuberculosis
YDPWIDMTASPPQPV

SEQ ID NO: 98254 - protein, 15 aa, Mycobacterium tuberculosis
DPWIDMTASPPQPVS

SEQ ID NO: 98255 - protein, 15 aa, Mycobacterium tuberculosis
PWIDMTASPPQPVSP

SEQ ID NO: 98256 - protein, 15 aa, Mycobacterium tuberculosis
WIDMTASPPQPVSPG

SEQ ID NO: 98257 - protein, 15 aa, Mycobacterium tuberculosis
IDMTASPPQPVSPGG

SEQ ID NO: 98258 - protein, 15 aa, Mycobacterium tuberculosis
DMTASPPQPVSPGGP

SEQ ID NO: 98259 - protein, 15 aa, Mycobacterium tuberculosis
MTASPPQPVSPGGPR

SEQ ID NO: 98260 - protein, 15 aa, Mycobacterium tuberculosis
TASPPQPVSPGGPRL

SEQ ID NO: 98261 - protein, 15 aa, Mycobacterium tuberculosis
ASPPQPVSPGGPRLR

SEQ ID NO: 98262 - protein, 15 aa, Mycobacterium tuberculosis
SPPQPVSPGGPRLRL

SEQ ID NO: 98263 - protein, 15 aa, Mycobacterium tuberculosis
PPQPVSPGGPRLRLV

SEQ ID NO: 98264 - protein, 15 aa, Mycobacterium tuberculosis
PQPVSPGGPRLRLVR

SEQ ID NO: 98265 - protein, 15 aa, Mycobacterium tuberculosis
QPVSPGGPRLRLVRL

SEQ ID NO: 98266 - protein, 15 aa, Mycobacterium tuberculosis
PVSPGGPRLRLVRLT

SEQ ID NO: 98267 - protein, 15 aa, Mycobacterium tuberculosis
VSPGGPRLRLVRLTT

SEQ ID NO: 98268 - protein, 15 aa, Mycobacterium tuberculosis
SPGGPRLRLVRLTTN

SEQ ID NO: 98269 - protein, 15 aa, Mycobacterium tuberculosis
PGGPRLRLVRLTTNP

SEQ ID NO: 98270 - protein, 15 aa, Mycobacterium tuberculosis
GGPRLRLVRLTTNPS

SEQ ID NO: 98271 - protein, 15 aa, Mycobacterium tuberculosis
GPRLRLVRLTTNPSA

SEQ ID NO: 98272 - protein, 15 aa, Mycobacterium tuberculosis
PRLRLVRLTTNPSAR

SEQ ID NO: 98273 - protein, 15 aa, Mycobacterium tuberculosis
RLRLVRLTTNPSARA

SEQ ID NO: 98274 - protein, 15 aa, Mycobacterium tuberculosis
LRLVRLTTNPSARAA

SEQ ID NO: 98275 - protein, 15 aa, Mycobacterium tuberculosis
RLVRLTTNPSARAAP

SEQ ID NO: 98276 - protein, 15 aa, Mycobacterium tuberculosis
LVRLTTNPSARAAPI

SEQ ID NO: 98277 - protein, 15 aa, Mycobacterium tuberculosis
VRLTTNPSARAAPIG

SEQ ID NO: 98278 - protein, 15 aa, Mycobacterium tuberculosis
RLTTNPSARAAPIGN

SEQ ID NO: 98279 - protein, 15 aa, Mycobacterium tuberculosis
LTTNPSARAAPIGNG

SEQ ID NO: 98280 - protein, 15 aa, Mycobacterium tuberculosis
TTNPSARAAPIGNGG

SEQ ID NO: 98281 - protein, 15 aa, Mycobacterium tuberculosis
TNPSARAAPIGNGGD

SEQ ID NO: 98282 - protein, 15 aa, Mycobacterium tuberculosis
NPSARAAPIGNGGDS

SEQ ID NO: 98283 - protein, 15 aa, Mycobacterium tuberculosis
PSARAAPIGNGGDSS

SEQ ID NO: 98284 - protein, 15 aa, Mycobacterium tuberculosis
SARAAPIGNGGDSSV

SEQ ID NO: 98285 - protein, 15 aa, Mycobacterium tuberculosis
ARAAPIGNGGDSSVC

SEQ ID NO: 98286 - protein, 15 aa, Mycobacterium tuberculosis
RAAPIGNGGDSSVCA

SEQ ID NO: 98287 - protein, 15 aa, Mycobacterium tuberculosis
AAPIGNGGDSSVCAG

SEQ ID NO: 98288 - protein, 15 aa, Mycobacterium tuberculosis
APIGNGGDSSVCAGE

SEQ ID NO: 98289 - protein, 15 aa, Mycobacterium tuberculosis
PIGNGGDSSVCAGEK

SEQ ID NO: 98290 - protein, 15 aa, Mycobacterium tuberculosis
IGNGGDSSVCAGEKQ

SEQ ID NO: 98291 - protein, 15 aa, Mycobacterium tuberculosis
GNGGDSSVCAGEKQC

SEQ ID NO: 98292 - protein, 15 aa, Mycobacterium tuberculosis
NGGDSSVCAGEKQCR

SEQ ID NO: 98293 - protein, 15 aa, Mycobacterium tuberculosis
GGDSSVCAGEKQCRP

SEQ ID NO: 98294 - protein, 15 aa, Mycobacterium tuberculosis
GDSSVCAGEKQCRPP

SEQ ID NO: 98295 - protein, 16 aa, Mycobacterium tuberculosis
MDDLTRLRRELLDRFD

SEQ ID NO: 98296 - protein, 16 aa, Mycobacterium tuberculosis
DDLTRLRRELLDRFDV

SEQ ID NO: 98297 - protein, 16 aa, Mycobacterium tuberculosis
DLTRLRRELLDRFDVR

SEQ ID NO: 98298 - protein, 16 aa, Mycobacterium tuberculosis
LTRLRRELLDRFDVRD

SEQ ID NO: 98299 - protein, 16 aa, Mycobacterium tuberculosis
TRLRRELLDRFDVRDF

SEQ ID NO: 98300 - protein, 16 aa, Mycobacterium tuberculosis
RLRRELLDRFDVRDFT

SEQ ID NO: 98301 - protein, 16 aa, Mycobacterium tuberculosis
LRRELLDRFDVRDFTD

SEQ ID NO: 98302 - protein, 16 aa, Mycobacterium tuberculosis
RRELLDRFDVRDFTDW

SEQ ID NO: 98303 - protein, 16 aa, Mycobacterium tuberculosis
RELLDRFDVRDFTDWP

SEQ ID NO: 98304 - protein, 16 aa, Mycobacterium tuberculosis
ELLDRFDVRDFTDWPP

SEQ ID NO: 98305 - protein, 16 aa, Mycobacterium tuberculosis
LLDRFDVRDFTDWPPA

SEQ ID NO: 98306 - protein, 16 aa, Mycobacterium tuberculosis
LDRFDVRDFTDWPPAS

SEQ ID NO: 98307 - protein, 16 aa, Mycobacterium tuberculosis
DRFDVRDFTDWPPASL

SEQ ID NO: 98308 - protein, 16 aa, Mycobacterium tuberculosis
RFDVRDFTDWPPASLR

SEQ ID NO: 98309 - protein, 16 aa, Mycobacterium tuberculosis
FDVRDFTDWPPASLRA

SEQ ID NO: 98310 - protein, 16 aa, Mycobacterium tuberculosis
DVRDFTDWPPASLRAL

SEQ ID NO: 98311 - protein, 16 aa, Mycobacterium tuberculosis
VRDFTDWPPASLRALI

SEQ ID NO: 98312 - protein, 16 aa, Mycobacterium tuberculosis
RDFTDWPPASLRALIA

SEQ ID NO: 98313 - protein, 16 aa, Mycobacterium tuberculosis
DFTDWPPASLRALIAT

SEQ ID NO: 98314 - protein, 16 aa, Mycobacterium tuberculosis
FTDWPPASLRALIATY

SEQ ID NO: 98315 - protein, 16 aa, Mycobacterium tuberculosis
TDWPPASLRALIATYD

SEQ ID NO: 98316 - protein, 16 aa, Mycobacterium tuberculosis
DWPPASLRALIATYDP

SEQ ID NO: 98317 - protein, 16 aa, Mycobacterium tuberculosis
WPPASLRALIATYDPW

SEQ ID NO: 98318 - protein, 16 aa, Mycobacterium tuberculosis
PPASLRALIATYDPWI

SEQ ID NO: 98319 - protein, 16 aa, Mycobacterium tuberculosis
PASLRALIATYDPWID

SEQ ID NO: 98320 - protein, 16 aa, Mycobacterium tuberculosis
ASLRALIATYDPWIDM

SEQ ID NO: 98321 - protein, 16 aa, Mycobacterium tuberculosis
SLRALIATYDPWIDMT

SEQ ID NO: 98322 - protein, 16 aa, Mycobacterium tuberculosis
LRALIATYDPWIDMTA

SEQ ID NO: 98323 - protein, 16 aa, Mycobacterium tuberculosis
RALIATYDPWIDMTAS

SEQ ID NO: 98324 - protein, 16 aa, Mycobacterium tuberculosis
ALIATYDPWIDMTASP

SEQ ID NO: 98325 - protein, 16 aa, Mycobacterium tuberculosis
LIATYDPWIDMTASPP

SEQ ID NO: 98326 - protein, 16 aa, Mycobacterium tuberculosis
IATYDPWIDMTASPPQ

SEQ ID NO: 98327 - protein, 16 aa, Mycobacterium tuberculosis
ATYDPWIDMTASPPQP

SEQ ID NO: 98328 - protein, 16 aa, Mycobacterium tuberculosis
TYDPWIDMTASPPQPV

SEQ ID NO: 98329 - protein, 16 aa, Mycobacterium tuberculosis
YDPWIDMTASPPQPVS

SEQ ID NO: 98330 - protein, 16 aa, Mycobacterium tuberculosis
DPWIDMTASPPQPVSP

SEQ ID NO: 98331 - protein, 16 aa, Mycobacterium tuberculosis
PWIDMTASPPQPVSPG

SEQ ID NO: 98332 - protein, 16 aa, Mycobacterium tuberculosis
WIDMTASPPQPVSPGG

SEQ ID NO: 98333 - protein, 16 aa, Mycobacterium tuberculosis
IDMTASPPQPVSPGGP

SEQ ID NO: 98334 - protein, 16 aa, Mycobacterium tuberculosis
DMTASPPQPVSPGGPR

SEQ ID NO: 98335 - protein, 16 aa, Mycobacterium tuberculosis
MTASPPQPVSPGGPRL

SEQ ID NO: 98336 - protein, 16 aa, Mycobacterium tuberculosis
TASPPQPVSPGGPRLR

SEQ ID NO: 98337 - protein, 16 aa, Mycobacterium tuberculosis
ASPPQPVSPGGPRLRL

SEQ ID NO: 98338 - protein, 16 aa, Mycobacterium tuberculosis
SPPQPVSPGGPRLRLV

SEQ ID NO: 98339 - protein, 16 aa, Mycobacterium tuberculosis
PPQPVSPGGPRLRLVR

SEQ ID NO: 98340 - protein, 16 aa, Mycobacterium tuberculosis
PQPVSPGGPRLRLVRL

SEQ ID NO: 98341 - protein, 16 aa, Mycobacterium tuberculosis
QPVSPGGPRLRLVRLT

SEQ ID NO: 98342 - protein, 16 aa, Mycobacterium tuberculosis
PVSPGGPRLRLVRLTT

SEQ ID NO: 98343 - protein, 16 aa, Mycobacterium tuberculosis
VSPGGPRLRLVRLTTN

SEQ ID NO: 98344 - protein, 16 aa, Mycobacterium tuberculosis
SPGGPRLRLVRLTTNP

SEQ ID NO: 98345 - protein, 16 aa, Mycobacterium tuberculosis
PGGPRLRLVRLTTNPS

SEQ ID NO: 98346 - protein, 16 aa, Mycobacterium tuberculosis
GGPRLRLVRLTTNPSA

SEQ ID NO: 98347 - protein, 16 aa, Mycobacterium tuberculosis
GPRLRLVRLTTNPSAR

SEQ ID NO: 98348 - protein, 16 aa, Mycobacterium tuberculosis
PRLRLVRLTTNPSARA

SEQ ID NO: 98349 - protein, 16 aa, Mycobacterium tuberculosis
RLRLVRLTTNPSARAA

SEQ ID NO: 98350 - protein, 16 aa, Mycobacterium tuberculosis
LRLVRLTTNPSARAAP

SEQ ID NO: 98351 - protein, 16 aa, Mycobacterium tuberculosis
RLVRLTTNPSARAAPI

SEQ ID NO: 98352 - protein, 16 aa, Mycobacterium tuberculosis
LVRLTTNPSARAAPIG

SEQ ID NO: 98353 - protein, 16 aa, Mycobacterium tuberculosis
VRLTTNPSARAAPIGN

SEQ ID NO: 98354 - protein, 16 aa, Mycobacterium tuberculosis
RLTTNPSARAAPIGNG

SEQ ID NO: 98355 - protein, 16 aa, Mycobacterium tuberculosis
LTTNPSARAAPIGNGG

SEQ ID NO: 98356 - protein, 16 aa, Mycobacterium tuberculosis
TTNPSARAAPIGNGGD

SEQ ID NO: 98357 - protein, 16 aa, Mycobacterium tuberculosis
TNPSARAAPIGNGGDS

SEQ ID NO: 98358 - protein, 16 aa, Mycobacterium tuberculosis
NPSARAAPIGNGGDSS

SEQ ID NO: 98359 - protein, 16 aa, Mycobacterium tuberculosis
PSARAAPIGNGGDSSV

SEQ ID NO: 98360 - protein, 16 aa, Mycobacterium tuberculosis
SARAAPIGNGGDSSVC

SEQ ID NO: 98361 - protein, 16 aa, Mycobacterium tuberculosis
ARAAPIGNGGDSSVCA

SEQ ID NO: 98362 - protein, 16 aa, Mycobacterium tuberculosis
RAAPIGNGGDSSVCAG

SEQ ID NO: 98363 - protein, 16 aa, Mycobacterium tuberculosis
AAPIGNGGDSSVCAGE

SEQ ID NO: 98364 - protein, 16 aa, Mycobacterium tuberculosis
APIGNGGDSSVCAGEK

SEQ ID NO: 98365 - protein, 16 aa, Mycobacterium tuberculosis
PIGNGGDSSVCAGEKQ

SEQ ID NO: 98366 - protein, 16 aa, Mycobacterium tuberculosis
IGNGGDSSVCAGEKQC

SEQ ID NO: 98367 - protein, 16 aa, Mycobacterium tuberculosis
GNGGDSSVCAGEKQCR

SEQ ID NO: 98368 - protein, 16 aa, Mycobacterium tuberculosis
NGGDSSVCAGEKQCRP

SEQ ID NO: 98369 - protein, 16 aa, Mycobacterium tuberculosis
GGDSSVCAGEKQCRPP

SEQ ID NO: 98370 - protein, 13 aa, Mycobacterium tuberculosis
MEVRASARKHGIN

SEQ ID NO: 98371 - protein, 13 aa, Mycobacterium tuberculosis
EVRASARKHGIND

SEQ ID NO: 98372 - protein, 13 aa, Mycobacterium tuberculosis
VRASARKHGINDD

SEQ ID NO: 98373 - protein, 13 aa, Mycobacterium tuberculosis
RASARKHGINDDA

SEQ ID NO: 98374 - protein, 13 aa, Mycobacterium tuberculosis
ASARKHGINDDAM

SEQ ID NO: 98375 - protein, 13 aa, Mycobacterium tuberculosis
SARKHGINDDAML

SEQ ID NO: 98376 - protein, 13 aa, Mycobacterium tuberculosis
ARKHGINDDAMLH

SEQ ID NO: 98377 - protein, 13 aa, Mycobacterium tuberculosis
RKHGINDDAMLHA

SEQ ID NO: 98378 - protein, 13 aa, Mycobacterium tuberculosis
KHGINDDAMLHAY

SEQ ID NO: 98379 - protein, 13 aa, Mycobacterium tuberculosis
HGINDDAMLHAYR

SEQ ID NO: 98380 - protein, 13 aa, Mycobacterium tuberculosis
GINDDAMLHAYRN

SEQ ID NO: 98381 - protein, 13 aa, Mycobacterium tuberculosis
INDDAMLHAYRNA

SEQ ID NO: 98382 - protein, 13 aa, Mycobacterium tuberculosis
NDDAMLHAYRNAL

SEQ ID NO: 98383 - protein, 13 aa, Mycobacterium tuberculosis
DDAMLHAYRNALR

SEQ ID NO: 98384 - protein, 13 aa, Mycobacterium tuberculosis
DAMLHAYRNALRY

SEQ ID NO: 98385 - protein, 13 aa, Mycobacterium tuberculosis
AMLHAYRNALRYV

SEQ ID NO: 98386 - protein, 13 aa, Mycobacterium tuberculosis
MLHAYRNALRYVE

SEQ ID NO: 98387 - protein, 13 aa, Mycobacterium tuberculosis
LHAYRNALRYVEL

SEQ ID NO: 98388 - protein, 13 aa, Mycobacterium tuberculosis
HAYRNALRYVELE

SEQ ID NO: 98389 - protein, 13 aa, Mycobacterium tuberculosis
AYRNALRYVELEY

SEQ ID NO: 98390 - protein, 13 aa, Mycobacterium tuberculosis
YRNALRYVELEYH

SEQ ID NO: 98391 - protein, 13 aa, Mycobacterium tuberculosis
RNALRYVELEYHG

SEQ ID NO: 98392 - protein, 13 aa, Mycobacterium tuberculosis
NALRYVELEYHGE

SEQ ID NO: 98393 - protein, 13 aa, Mycobacterium tuberculosis
ALRYVELEYHGEV

SEQ ID NO: 98394 - protein, 13 aa, Mycobacterium tuberculosis
LRYVELEYHGEVQ

SEQ ID NO: 98395 - protein, 13 aa, Mycobacterium tuberculosis
RYVELEYHGEVQL

SEQ ID NO: 98396 - protein, 13 aa, Mycobacterium tuberculosis
YVELEYHGEVQLL

SEQ ID NO: 98397 - protein, 13 aa, Mycobacterium tuberculosis
VELEYHGEVQLLV

SEQ ID NO: 98398 - protein, 13 aa, Mycobacterium tuberculosis
ELEYHGEVQLLVI

SEQ ID NO: 98399 - protein, 13 aa, Mycobacterium tuberculosis
LEYHGEVQLLVIG

SEQ ID NO: 98400 - protein, 13 aa, Mycobacterium tuberculosis
EYHGEVQLLVIGP

SEQ ID NO: 98401 - protein, 13 aa, Mycobacterium tuberculosis
YHGEVQLLVIGPD

SEQ ID NO: 98402 - protein, 13 aa, Mycobacterium tuberculosis
HGEVQLLVIGPDQ

SEQ ID NO: 98403 - protein, 13 aa, Mycobacterium tuberculosis
GEVQLLVIGPDQT

SEQ ID NO: 98404 - protein, 13 aa, Mycobacterium tuberculosis
EVQLLVIGPDQTG

SEQ ID NO: 98405 - protein, 13 aa, Mycobacterium tuberculosis
VQLLVIGPDQTGR

SEQ ID NO: 98406 - protein, 13 aa, Mycobacterium tuberculosis
QLLVIGPDQTGRL

SEQ ID NO: 98407 - protein, 13 aa, Mycobacterium tuberculosis
LLVIGPDQTGRLL

SEQ ID NO: 98408 - protein, 13 aa, Mycobacterium tuberculosis
LVIGPDQTGRLLE

SEQ ID NO: 98409 - protein, 13 aa, Mycobacterium tuberculosis
VIGPDQTGRLLEL

SEQ ID NO: 98410 - protein, 13 aa, Mycobacterium tuberculosis
IGPDQTGRLLELV

SEQ ID NO: 98411 - protein, 13 aa, Mycobacterium tuberculosis
GPDQTGRLLELVI

SEQ ID NO: 98412 - protein, 13 aa, Mycobacterium tuberculosis
PDQTGRLLELVIP

SEQ ID NO: 98413 - protein, 13 aa, Mycobacterium tuberculosis
DQTGRLLELVIPA

SEQ ID NO: 98414 - protein, 13 aa, Mycobacterium tuberculosis
QTGRLLELVIPAD

SEQ ID NO: 98415 - protein, 13 aa, Mycobacterium tuberculosis
TGRLLELVIPADE

SEQ ID NO: 98416 - protein, 13 aa, Mycobacterium tuberculosis
GRLLELVIPADEP

SEQ ID NO: 98417 - protein, 13 aa, Mycobacterium tuberculosis
RLLELVIPADEPP

SEQ ID NO: 98418 - protein, 13 aa, Mycobacterium tuberculosis
LLELVIPADEPPR

SEQ ID NO: 98419 - protein, 13 aa, Mycobacterium tuberculosis
LELVIPADEPPRI

SEQ ID NO: 98420 - protein, 13 aa, Mycobacterium tuberculosis
ELVIPADEPPRII

SEQ ID NO: 98421 - protein, 13 aa, Mycobacterium tuberculosis
LVIPADEPPRIIH

SEQ ID NO: 98422 - protein, 13 aa, Mycobacterium tuberculosis
VIPADEPPRIIHA

SEQ ID NO: 98423 - protein, 13 aa, Mycobacterium tuberculosis
IPADEPPRIIHAN

SEQ ID NO: 98424 - protein, 13 aa, Mycobacterium tuberculosis
PADEPPRIIHANV

SEQ ID NO: 98425 - protein, 13 aa, Mycobacterium tuberculosis
ADEPPRIIHANVL

SEQ ID NO: 98426 - protein, 13 aa, Mycobacterium tuberculosis
DEPPRIIHANVLR

SEQ ID NO: 98427 - protein, 13 aa, Mycobacterium tuberculosis
EPPRIIHANVLRP

SEQ ID NO: 98428 - protein, 13 aa, Mycobacterium tuberculosis
PPRIIHANVLRPK

SEQ ID NO: 98429 - protein, 13 aa, Mycobacterium tuberculosis
PRIIHANVLRPKF

SEQ ID NO: 98430 - protein, 13 aa, Mycobacterium tuberculosis
RIIHANVLRPKFY

SEQ ID NO: 98431 - protein, 13 aa, Mycobacterium tuberculosis
IIHANVLRPKFYD

SEQ ID NO: 98432 - protein, 13 aa, Mycobacterium tuberculosis
IHANVLRPKFYDY

SEQ ID NO: 98433 - protein, 13 aa, Mycobacterium tuberculosis
HANVLRPKFYDYL

SEQ ID NO: 98434 - protein, 13 aa, Mycobacterium tuberculosis
ANVLRPKFYDYLR

SEQ ID NO: 98435 - protein, 14 aa, Mycobacterium tuberculosis
MEVRASARKHGIND

SEQ ID NO: 98436 - protein, 14 aa, Mycobacterium tuberculosis
EVRASARKHGINDD

SEQ ID NO: 98437 - protein, 14 aa, Mycobacterium tuberculosis
VRASARKHGINDDA

SEQ ID NO: 98438 - protein, 14 aa, Mycobacterium tuberculosis
RASARKHGINDDAM

SEQ ID NO: 98439 - protein, 14 aa, Mycobacterium tuberculosis
ASARKHGINDDAML

SEQ ID NO: 98440 - protein, 14 aa, Mycobacterium tuberculosis
SARKHGINDDAMLH

SEQ ID NO: 98441 - protein, 14 aa, Mycobacterium tuberculosis
ARKHGINDDAMLHA

SEQ ID NO: 98442 - protein, 14 aa, Mycobacterium tuberculosis
RKHGINDDAMLHAY

SEQ ID NO: 98443 - protein, 14 aa, Mycobacterium tuberculosis
KHGINDDAMLHAYR

SEQ ID NO: 98444 - protein, 14 aa, Mycobacterium tuberculosis
HGINDDAMLHAYRN

SEQ ID NO: 98445 - protein, 14 aa, Mycobacterium tuberculosis
GINDDAMLHAYRNA

SEQ ID NO: 98446 - protein, 14 aa, Mycobacterium tuberculosis
INDDAMLHAYRNAL

SEQ ID NO: 98447 - protein, 14 aa, Mycobacterium tuberculosis
NDDAMLHAYRNALR

SEQ ID NO: 98448 - protein, 14 aa, Mycobacterium tuberculosis
DDAMLHAYRNALRY

SEQ ID NO: 98449 - protein, 14 aa, Mycobacterium tuberculosis
DAMLHAYRNALRYV

SEQ ID NO: 98450 - protein, 14 aa, Mycobacterium tuberculosis
AMLHAYRNALRYVE

SEQ ID NO: 98451 - protein, 14 aa, Mycobacterium tuberculosis
MLHAYRNALRYVEL

SEQ ID NO: 98452 - protein, 14 aa, Mycobacterium tuberculosis
LHAYRNALRYVELE

SEQ ID NO: 98453 - protein, 14 aa, Mycobacterium tuberculosis
HAYRNALRYVELEY

SEQ ID NO: 98454 - protein, 14 aa, Mycobacterium tuberculosis
AYRNALRYVELEYH

SEQ ID NO: 98455 - protein, 14 aa, Mycobacterium tuberculosis
YRNALRYVELEYHG

SEQ ID NO: 98456 - protein, 14 aa, Mycobacterium tuberculosis
RNALRYVELEYHGE

SEQ ID NO: 98457 - protein, 14 aa, Mycobacterium tuberculosis
NALRYVELEYHGEV

SEQ ID NO: 98458 - protein, 14 aa, Mycobacterium tuberculosis
ALRYVELEYHGEVQ

SEQ ID NO: 98459 - protein, 14 aa, Mycobacterium tuberculosis
LRYVELEYHGEVQL

SEQ ID NO: 98460 - protein, 14 aa, Mycobacterium tuberculosis
RYVELEYHGEVQLL

SEQ ID NO: 98461 - protein, 14 aa, Mycobacterium tuberculosis
YVELEYHGEVQLLV

SEQ ID NO: 98462 - protein, 14 aa, Mycobacterium tuberculosis
VELEYHGEVQLLVI

SEQ ID NO: 98463 - protein, 14 aa, Mycobacterium tuberculosis
ELEYHGEVQLLVIG

SEQ ID NO: 98464 - protein, 14 aa, Mycobacterium tuberculosis
LEYHGEVQLLVIGP

SEQ ID NO: 98465 - protein, 14 aa, Mycobacterium tuberculosis
EYHGEVQLLVIGPD

SEQ ID NO: 98466 - protein, 14 aa, Mycobacterium tuberculosis
YHGEVQLLVIGPDQ

SEQ ID NO: 98467 - protein, 14 aa, Mycobacterium tuberculosis
HGEVQLLVIGPDQT

SEQ ID NO: 98468 - protein, 14 aa, Mycobacterium tuberculosis
GEVQLLVIGPDQTG

SEQ ID NO: 98469 - protein, 14 aa, Mycobacterium tuberculosis
EVQLLVIGPDQTGR

SEQ ID NO: 98470 - protein, 14 aa, Mycobacterium tuberculosis
VQLLVIGPDQTGRL

SEQ ID NO: 98471 - protein, 14 aa, Mycobacterium tuberculosis
QLLVIGPDQTGRLL

SEQ ID NO: 98472 - protein, 14 aa, Mycobacterium tuberculosis
LLVIGPDQTGRLLE

SEQ ID NO: 98473 - protein, 14 aa, Mycobacterium tuberculosis
LVIGPDQTGRLLEL

SEQ ID NO: 98474 - protein, 14 aa, Mycobacterium tuberculosis
VIGPDQTGRLLELV

SEQ ID NO: 98475 - protein, 14 aa, Mycobacterium tuberculosis
IGPDQTGRLLELVI

SEQ ID NO: 98476 - protein, 14 aa, Mycobacterium tuberculosis
GPDQTGRLLELVIP

SEQ ID NO: 98477 - protein, 14 aa, Mycobacterium tuberculosis
PDQTGRLLELVIPA

SEQ ID NO: 98478 - protein, 14 aa, Mycobacterium tuberculosis
DQTGRLLELVIPAD

SEQ ID NO: 98479 - protein, 14 aa, Mycobacterium tuberculosis
QTGRLLELVIPADE

SEQ ID NO: 98480 - protein, 14 aa, Mycobacterium tuberculosis
TGRLLELVIPADEP

SEQ ID NO: 98481 - protein, 14 aa, Mycobacterium tuberculosis
GRLLELVIPADEPP

SEQ ID NO: 98482 - protein, 14 aa, Mycobacterium tuberculosis
RLLELVIPADEPPR

SEQ ID NO: 98483 - protein, 14 aa, Mycobacterium tuberculosis
LLELVIPADEPPRI

SEQ ID NO: 98484 - protein, 14 aa, Mycobacterium tuberculosis
LELVIPADEPPRII

SEQ ID NO: 98485 - protein, 14 aa, Mycobacterium tuberculosis
ELVIPADEPPRIIH

SEQ ID NO: 98486 - protein, 14 aa, Mycobacterium tuberculosis
LVIPADEPPRIIHA

SEQ ID NO: 98487 - protein, 14 aa, Mycobacterium tuberculosis
VIPADEPPRIIHAN

SEQ ID NO: 98488 - protein, 14 aa, Mycobacterium tuberculosis
IPADEPPRIIHANV

SEQ ID NO: 98489 - protein, 14 aa, Mycobacterium tuberculosis
PADEPPRIIHANVL

SEQ ID NO: 98490 - protein, 14 aa, Mycobacterium tuberculosis
ADEPPRIIHANVLR

SEQ ID NO: 98491 - protein, 14 aa, Mycobacterium tuberculosis
DEPPRIIHANVLRP

SEQ ID NO: 98492 - protein, 14 aa, Mycobacterium tuberculosis
EPPRIIHANVLRPK

SEQ ID NO: 98493 - protein, 14 aa, Mycobacterium tuberculosis
PPRIIHANVLRPKF

SEQ ID NO: 98494 - protein, 14 aa, Mycobacterium tuberculosis
PRIIHANVLRPKFY

SEQ ID NO: 98495 - protein, 14 aa, Mycobacterium tuberculosis
RIIHANVLRPKFYD

SEQ ID NO: 98496 - protein, 14 aa, Mycobacterium tuberculosis
IIHANVLRPKFYDY

SEQ ID NO: 98497 - protein, 14 aa, Mycobacterium tuberculosis
IHANVLRPKFYDYL

SEQ ID NO: 98498 - protein, 14 aa, Mycobacterium tuberculosis
HANVLRPKFYDYLR

SEQ ID NO: 98499 - protein, 15 aa, Mycobacterium tuberculosis
MEVRASARKHGINDD

SEQ ID NO: 98500 - protein, 15 aa, Mycobacterium tuberculosis
EVRASARKHGINDDA

SEQ ID NO: 98501 - protein, 15 aa, Mycobacterium tuberculosis
VRASARKHGINDDAM

SEQ ID NO: 98502 - protein, 15 aa, Mycobacterium tuberculosis
RASARKHGINDDAML

SEQ ID NO: 98503 - protein, 15 aa, Mycobacterium tuberculosis
ASARKHGINDDAMLH

SEQ ID NO: 98504 - protein, 15 aa, Mycobacterium tuberculosis
SARKHGINDDAMLHA

SEQ ID NO: 98505 - protein, 15 aa, Mycobacterium tuberculosis
ARKHGINDDAMLHAY

SEQ ID NO: 98506 - protein, 15 aa, Mycobacterium tuberculosis
RKHGINDDAMLHAYR

SEQ ID NO: 98507 - protein, 15 aa, Mycobacterium tuberculosis
KHGINDDAMLHAYRN

SEQ ID NO: 98508 - protein, 15 aa, Mycobacterium tuberculosis
HGINDDAMLHAYRNA

SEQ ID NO: 98509 - protein, 15 aa, Mycobacterium tuberculosis
GINDDAMLHAYRNAL

SEQ ID NO: 98510 - protein, 15 aa, Mycobacterium tuberculosis
INDDAMLHAYRNALR

SEQ ID NO: 98511 - protein, 15 aa, Mycobacterium tuberculosis
NDDAMLHAYRNALRY

SEQ ID NO: 98512 - protein, 15 aa, Mycobacterium tuberculosis
DDAMLHAYRNALRYV

SEQ ID NO: 98513 - protein, 15 aa, Mycobacterium tuberculosis
DAMLHAYRNALRYVE

SEQ ID NO: 98514 - protein, 15 aa, Mycobacterium tuberculosis
AMLHAYRNALRYVEL

SEQ ID NO: 98515 - protein, 15 aa, Mycobacterium tuberculosis
MLHAYRNALRYVELE

SEQ ID NO: 98516 - protein, 15 aa, Mycobacterium tuberculosis
LHAYRNALRYVELEY

SEQ ID NO: 98517 - protein, 15 aa, Mycobacterium tuberculosis
HAYRNALRYVELEYH

SEQ ID NO: 98518 - protein, 15 aa, Mycobacterium tuberculosis
AYRNALRYVELEYHG

SEQ ID NO: 98519 - protein, 15 aa, Mycobacterium tuberculosis
YRNALRYVELEYHGE

SEQ ID NO: 98520 - protein, 15 aa, Mycobacterium tuberculosis
RNALRYVELEYHGEV

SEQ ID NO: 98521 - protein, 15 aa, Mycobacterium tuberculosis
NALRYVELEYHGEVQ

SEQ ID NO: 98522 - protein, 15 aa, Mycobacterium tuberculosis
ALRYVELEYHGEVQL

SEQ ID NO: 98523 - protein, 15 aa, Mycobacterium tuberculosis
LRYVELEYHGEVQLL

SEQ ID NO: 98524 - protein, 15 aa, Mycobacterium tuberculosis
RYVELEYHGEVQLLV

SEQ ID NO: 98525 - protein, 15 aa, Mycobacterium tuberculosis
YVELEYHGEVQLLVI

SEQ ID NO: 98526 - protein, 15 aa, Mycobacterium tuberculosis
VELEYHGEVQLLVIG

SEQ ID NO: 98527 - protein, 15 aa, Mycobacterium tuberculosis
ELEYHGEVQLLVIGP

SEQ ID NO: 98528 - protein, 15 aa, Mycobacterium tuberculosis
LEYHGEVQLLVIGPD

SEQ ID NO: 98529 - protein, 15 aa, Mycobacterium tuberculosis
EYHGEVQLLVIGPDQ

SEQ ID NO: 98530 - protein, 15 aa, Mycobacterium tuberculosis
YHGEVQLLVIGPDQT

SEQ ID NO: 98531 - protein, 15 aa, Mycobacterium tuberculosis
HGEVQLLVIGPDQTG

SEQ ID NO: 98532 - protein, 15 aa, Mycobacterium tuberculosis
GEVQLLVIGPDQTGR

SEQ ID NO: 98533 - protein, 15 aa, Mycobacterium tuberculosis
EVQLLVIGPDQTGRL

SEQ ID NO: 98534 - protein, 15 aa, Mycobacterium tuberculosis
VQLLVIGPDQTGRLL

SEQ ID NO: 98535 - protein, 15 aa, Mycobacterium tuberculosis
QLLVIGPDQTGRLLE

SEQ ID NO: 98536 - protein, 15 aa, Mycobacterium tuberculosis
LLVIGPDQTGRLLEL

SEQ ID NO: 98537 - protein, 15 aa, Mycobacterium tuberculosis
LVIGPDQTGRLLELV

SEQ ID NO: 98538 - protein, 15 aa, Mycobacterium tuberculosis
VIGPDQTGRLLELVI

SEQ ID NO: 98539 - protein, 15 aa, Mycobacterium tuberculosis
IGPDQTGRLLELVIP

SEQ ID NO: 98540 - protein, 15 aa, Mycobacterium tuberculosis
GPDQTGRLLELVIPA

SEQ ID NO: 98541 - protein, 15 aa, Mycobacterium tuberculosis
PDQTGRLLELVIPAD

SEQ ID NO: 98542 - protein, 15 aa, Mycobacterium tuberculosis
DQTGRLLELVIPADE

SEQ ID NO: 98543 - protein, 15 aa, Mycobacterium tuberculosis
QTGRLLELVIPADEP

SEQ ID NO: 98544 - protein, 15 aa, Mycobacterium tuberculosis
TGRLLELVIPADEPP

SEQ ID NO: 98545 - protein, 15 aa, Mycobacterium tuberculosis
GRLLELVIPADEPPR

SEQ ID NO: 98546 - protein, 15 aa, Mycobacterium tuberculosis
RLLELVIPADEPPRI

SEQ ID NO: 98547 - protein, 15 aa, Mycobacterium tuberculosis
LLELVIPADEPPRII

SEQ ID NO: 98548 - protein, 15 aa, Mycobacterium tuberculosis
LELVIPADEPPRIIH

SEQ ID NO: 98549 - protein, 15 aa, Mycobacterium tuberculosis
ELVIPADEPPRIIHA

SEQ ID NO: 98550 - protein, 15 aa, Mycobacterium tuberculosis
LVIPADEPPRIIHAN

SEQ ID NO: 98551 - protein, 15 aa, Mycobacterium tuberculosis
VIPADEPPRIIHANV

SEQ ID NO: 98552 - protein, 15 aa, Mycobacterium tuberculosis
IPADEPPRIIHANVL

SEQ ID NO: 98553 - protein, 15 aa, Mycobacterium tuberculosis
PADEPPRIIHANVLR

SEQ ID NO: 98554 - protein, 15 aa, Mycobacterium tuberculosis
ADEPPRIIHANVLRP

SEQ ID NO: 98555 - protein, 15 aa, Mycobacterium tuberculosis
DEPPRIIHANVLRPK

SEQ ID NO: 98556 - protein, 15 aa, Mycobacterium tuberculosis
EPPRIIHANVLRPKF

SEQ ID NO: 98557 - protein, 15 aa, Mycobacterium tuberculosis
PPRIIHANVLRPKFY

SEQ ID NO: 98558 - protein, 15 aa, Mycobacterium tuberculosis
PRIIHANVLRPKFYD

SEQ ID NO: 98559 - protein, 15 aa, Mycobacterium tuberculosis
RIIHANVLRPKFYDY

SEQ ID NO: 98560 - protein, 15 aa, Mycobacterium tuberculosis
IIHANVLRPKFYDYL

SEQ ID NO: 98561 - protein, 15 aa, Mycobacterium tuberculosis
IHANVLRPKFYDYLR

SEQ ID NO: 98562 - protein, 16 aa, Mycobacterium tuberculosis
MEVRASARKHGINDDA

SEQ ID NO: 98563 - protein, 16 aa, Mycobacterium tuberculosis
EVRASARKHGINDDAM

SEQ ID NO: 98564 - protein, 16 aa, Mycobacterium tuberculosis
VRASARKHGINDDAML

SEQ ID NO: 98565 - protein, 16 aa, Mycobacterium tuberculosis
RASARKHGINDDAMLH

SEQ ID NO: 98566 - protein, 16 aa, Mycobacterium tuberculosis
ASARKHGINDDAMLHA

SEQ ID NO: 98567 - protein, 16 aa, Mycobacterium tuberculosis
SARKHGINDDAMLHAY

SEQ ID NO: 98568 - protein, 16 aa, Mycobacterium tuberculosis
ARKHGINDDAMLHAYR

SEQ ID NO: 98569 - protein, 16 aa, Mycobacterium tuberculosis
RKHGINDDAMLHAYRN

SEQ ID NO: 98570 - protein, 16 aa, Mycobacterium tuberculosis
KHGINDDAMLHAYRNA

SEQ ID NO: 98571 - protein, 16 aa, Mycobacterium tuberculosis
HGINDDAMLHAYRNAL

SEQ ID NO: 98572 - protein, 16 aa, Mycobacterium tuberculosis
GINDDAMLHAYRNALR

SEQ ID NO: 98573 - protein, 16 aa, Mycobacterium tuberculosis
INDDAMLHAYRNALRY

SEQ ID NO: 98574 - protein, 16 aa, Mycobacterium tuberculosis
NDDAMLHAYRNALRYV

SEQ ID NO: 98575 - protein, 16 aa, Mycobacterium tuberculosis
DDAMLHAYRNALRYVE

SEQ ID NO: 98576 - protein, 16 aa, Mycobacterium tuberculosis
DAMLHAYRNALRYVEL

SEQ ID NO: 98577 - protein, 16 aa, Mycobacterium tuberculosis
AMLHAYRNALRYVELE

SEQ ID NO: 98578 - protein, 16 aa, Mycobacterium tuberculosis
MLHAYRNALRYVELEY

SEQ ID NO: 98579 - protein, 16 aa, Mycobacterium tuberculosis
LHAYRNALRYVELEYH

SEQ ID NO: 98580 - protein, 16 aa, Mycobacterium tuberculosis
HAYRNALRYVELEYHG

SEQ ID NO: 98581 - protein, 16 aa, Mycobacterium tuberculosis
AYRNALRYVELEYHGE

SEQ ID NO: 98582 - protein, 16 aa, Mycobacterium tuberculosis
YRNALRYVELEYHGEV

SEQ ID NO: 98583 - protein, 16 aa, Mycobacterium tuberculosis
RNALRYVELEYHGEVQ

SEQ ID NO: 98584 - protein, 16 aa, Mycobacterium tuberculosis
NALRYVELEYHGEVQL

SEQ ID NO: 98585 - protein, 16 aa, Mycobacterium tuberculosis
ALRYVELEYHGEVQLL

SEQ ID NO: 98586 - protein, 16 aa, Mycobacterium tuberculosis
LRYVELEYHGEVQLLV

SEQ ID NO: 98587 - protein, 16 aa, Mycobacterium tuberculosis
RYVELEYHGEVQLLVI

SEQ ID NO: 98588 - protein, 16 aa, Mycobacterium tuberculosis
YVELEYHGEVQLLVIG

SEQ ID NO: 98589 - protein, 16 aa, Mycobacterium tuberculosis
VELEYHGEVQLLVIGP

SEQ ID NO: 98590 - protein, 16 aa, Mycobacterium tuberculosis
ELEYHGEVQLLVIGPD

SEQ ID NO: 98591 - protein, 16 aa, Mycobacterium tuberculosis
LEYHGEVQLLVIGPDQ

SEQ ID NO: 98592 - protein, 16 aa, Mycobacterium tuberculosis
EYHGEVQLLVIGPDQT

SEQ ID NO: 98593 - protein, 16 aa, Mycobacterium tuberculosis
YHGEVQLLVIGPDQTG

SEQ ID NO: 98594 - protein, 16 aa, Mycobacterium tuberculosis
HGEVQLLVIGPDQTGR

SEQ ID NO: 98595 - protein, 16 aa, Mycobacterium tuberculosis
GEVQLLVIGPDQTGRL

SEQ ID NO: 98596 - protein, 16 aa, Mycobacterium tuberculosis
EVQLLVIGPDQTGRLL

SEQ ID NO: 98597 - protein, 16 aa, Mycobacterium tuberculosis
VQLLVIGPDQTGRLLE

SEQ ID NO: 98598 - protein, 16 aa, Mycobacterium tuberculosis
QLLVIGPDQTGRLLEL

SEQ ID NO: 98599 - protein, 16 aa, Mycobacterium tuberculosis
LLVIGPDQTGRLLELV

SEQ ID NO: 98600 - protein, 16 aa, Mycobacterium tuberculosis
LVIGPDQTGRLLELVI

SEQ ID NO: 98601 - protein, 16 aa, Mycobacterium tuberculosis
VIGPDQTGRLLELVIP

SEQ ID NO: 98602 - protein, 16 aa, Mycobacterium tuberculosis
IGPDQTGRLLELVIPA

SEQ ID NO: 98603 - protein, 16 aa, Mycobacterium tuberculosis
GPDQTGRLLELVIPAD

SEQ ID NO: 98604 - protein, 16 aa, Mycobacterium tuberculosis
PDQTGRLLELVIPADE

SEQ ID NO: 98605 - protein, 16 aa, Mycobacterium tuberculosis
DQTGRLLELVIPADEP

SEQ ID NO: 98606 - protein, 16 aa, Mycobacterium tuberculosis
QTGRLLELVIPADEPP

SEQ ID NO: 98607 - protein, 16 aa, Mycobacterium tuberculosis
TGRLLELVIPADEPPR

SEQ ID NO: 98608 - protein, 16 aa, Mycobacterium tuberculosis
GRLLELVIPADEPPRI

SEQ ID NO: 98609 - protein, 16 aa, Mycobacterium tuberculosis
RLLELVIPADEPPRII

SEQ ID NO: 98610 - protein, 16 aa, Mycobacterium tuberculosis
LLELVIPADEPPRIIH

SEQ ID NO: 98611 - protein, 16 aa, Mycobacterium tuberculosis
LELVIPADEPPRIIHA

SEQ ID NO: 98612 - protein, 16 aa, Mycobacterium tuberculosis
ELVIPADEPPRIIHAN

SEQ ID NO: 98613 - protein, 16 aa, Mycobacterium tuberculosis
LVIPADEPPRIIHANV

SEQ ID NO: 98614 - protein, 16 aa, Mycobacterium tuberculosis
VIPADEPPRIIHANVL

SEQ ID NO: 98615 - protein, 16 aa, Mycobacterium tuberculosis
IPADEPPRIIHANVLR

SEQ ID NO: 98616 - protein, 16 aa, Mycobacterium tuberculosis
PADEPPRIIHANVLRP

SEQ ID NO: 98617 - protein, 16 aa, Mycobacterium tuberculosis
ADEPPRIIHANVLRPK

SEQ ID NO: 98618 - protein, 16 aa, Mycobacterium tuberculosis
DEPPRIIHANVLRPKF

SEQ ID NO: 98619 - protein, 16 aa, Mycobacterium tuberculosis
EPPRIIHANVLRPKFY

SEQ ID NO: 98620 - protein, 16 aa, Mycobacterium tuberculosis
PPRIIHANVLRPKFYD

SEQ ID NO: 98621 - protein, 16 aa, Mycobacterium tuberculosis
PRIIHANVLRPKFYDY

SEQ ID NO: 98622 - protein, 16 aa, Mycobacterium tuberculosis
RIIHANVLRPKFYDYL

SEQ ID NO: 98623 - protein, 16 aa, Mycobacterium tuberculosis
IIHANVLRPKFYDYLR

SEQ ID NO: 98624 - protein, 13 aa, Mycobacterium tuberculosis
MSVGFVTPVGVRW

SEQ ID NO: 98625 - protein, 13 aa, Mycobacterium tuberculosis
SVGFVTPVGVRWS

SEQ ID NO: 98626 - protein, 13 aa, Mycobacterium tuberculosis
VGFVTPVGVRWSD

SEQ ID NO: 98627 - protein, 13 aa, Mycobacterium tuberculosis
GFVTPVGVRWSDI

SEQ ID NO: 98628 - protein, 13 aa, Mycobacterium tuberculosis
FVTPVGVRWSDID

SEQ ID NO: 98629 - protein, 13 aa, Mycobacterium tuberculosis
VTPVGVRWSDIDM

SEQ ID NO: 98630 - protein, 13 aa, Mycobacterium tuberculosis
TPVGVRWSDIDMY

SEQ ID NO: 98631 - protein, 13 aa, Mycobacterium tuberculosis
PVGVRWSDIDMYQ

SEQ ID NO: 98632 - protein, 13 aa, Mycobacterium tuberculosis
VGVRWSDIDMYQH

SEQ ID NO: 98633 - protein, 13 aa, Mycobacterium tuberculosis
GVRWSDIDMYQHV

SEQ ID NO: 98634 - protein, 13 aa, Mycobacterium tuberculosis
VRWSDIDMYQHVN

SEQ ID NO: 98635 - protein, 13 aa, Mycobacterium tuberculosis
RWSDIDMYQHVNH

SEQ ID NO: 98636 - protein, 13 aa, Mycobacterium tuberculosis
WSDIDMYQHVNHA

SEQ ID NO: 98637 - protein, 13 aa, Mycobacterium tuberculosis
SDIDMYQHVNHAT

SEQ ID NO: 98638 - protein, 13 aa, Mycobacterium tuberculosis
DIDMYQHVNHATM

SEQ ID NO: 98639 - protein, 13 aa, Mycobacterium tuberculosis
IDMYQHVNHATMV

SEQ ID NO: 98640 - protein, 13 aa, Mycobacterium tuberculosis
DMYQHVNHATMVT

SEQ ID NO: 98641 - protein, 13 aa, Mycobacterium tuberculosis
MYQHVNHATMVTI

SEQ ID NO: 98642 - protein, 13 aa, Mycobacterium tuberculosis
YQHVNHATMVTIL

SEQ ID NO: 98643 - protein, 13 aa, Mycobacterium tuberculosis
QHVNHATMVTILE

SEQ ID NO: 98644 - protein, 13 aa, Mycobacterium tuberculosis
HVNHATMVTILEE

SEQ ID NO: 98645 - protein, 13 aa, Mycobacterium tuberculosis
VNHATMVTILEEA

SEQ ID NO: 98646 - protein, 13 aa, Mycobacterium tuberculosis
NHATMVTILEEAR

SEQ ID NO: 98647 - protein, 13 aa, Mycobacterium tuberculosis
HATMVTILEEARV

SEQ ID NO: 98648 - protein, 13 aa, Mycobacterium tuberculosis
ATMVTILEEARVP

SEQ ID NO: 98649 - protein, 13 aa, Mycobacterium tuberculosis
TMVTILEEARVPF

SEQ ID NO: 98650 - protein, 13 aa, Mycobacterium tuberculosis
MVTILEEARVPFL

SEQ ID NO: 98651 - protein, 13 aa, Mycobacterium tuberculosis
VTILEEARVPFLK

SEQ ID NO: 98652 - protein, 13 aa, Mycobacterium tuberculosis
TILEEARVPFLKD

SEQ ID NO: 98653 - protein, 13 aa, Mycobacterium tuberculosis
ILEEARVPFLKDA

SEQ ID NO: 98654 - protein, 13 aa, Mycobacterium tuberculosis
LEEARVPFLKDAF

SEQ ID NO: 98655 - protein, 13 aa, Mycobacterium tuberculosis
EEARVPFLKDAFG

SEQ ID NO: 98656 - protein, 13 aa, Mycobacterium tuberculosis
EARVPFLKDAFGA

SEQ ID NO: 98657 - protein, 13 aa, Mycobacterium tuberculosis
ARVPFLKDAFGAD

SEQ ID NO: 98658 - protein, 13 aa, Mycobacterium tuberculosis
RVPFLKDAFGADI

SEQ ID NO: 98659 - protein, 13 aa, Mycobacterium tuberculosis
VPFLKDAFGADIT

SEQ ID NO: 98660 - protein, 13 aa, Mycobacterium tuberculosis
PFLKDAFGADITS

SEQ ID NO: 98661 - protein, 13 aa, Mycobacterium tuberculosis
FLKDAFGADITST

SEQ ID NO: 98662 - protein, 13 aa, Mycobacterium tuberculosis
LKDAFGADITSTG

SEQ ID NO: 98663 - protein, 13 aa, Mycobacterium tuberculosis
KDAFGADITSTGL

SEQ ID NO: 98664 - protein, 13 aa, Mycobacterium tuberculosis
DAFGADITSTGLL

SEQ ID NO: 98665 - protein, 13 aa, Mycobacterium tuberculosis
AFGADITSTGLLI

SEQ ID NO: 98666 - protein, 13 aa, Mycobacterium tuberculosis
FGADITSTGLLIA

SEQ ID NO: 98667 - protein, 13 aa, Mycobacterium tuberculosis
GADITSTGLLIAD

SEQ ID NO: 98668 - protein, 13 aa, Mycobacterium tuberculosis
ADITSTGLLIADV

SEQ ID NO: 98669 - protein, 13 aa, Mycobacterium tuberculosis
DITSTGLLIADVR

SEQ ID NO: 98670 - protein, 13 aa, Mycobacterium tuberculosis
ITSTGLLIADVRV

SEQ ID NO: 98671 - protein, 13 aa, Mycobacterium tuberculosis
TSTGLLIADVRVT

SEQ ID NO: 98672 - protein, 13 aa, Mycobacterium tuberculosis
STGLLIADVRVTY

SEQ ID NO: 98673 - protein, 13 aa, Mycobacterium tuberculosis
TGLLIADVRVTYK

SEQ ID NO: 98674 - protein, 13 aa, Mycobacterium tuberculosis
GLLIADVRVTYKG

SEQ ID NO: 98675 - protein, 13 aa, Mycobacterium tuberculosis
LLIADVRVTYKGQ

SEQ ID NO: 98676 - protein, 13 aa, Mycobacterium tuberculosis
LIADVRVTYKGQL

SEQ ID NO: 98677 - protein, 13 aa, Mycobacterium tuberculosis
IADVRVTYKGQLR

SEQ ID NO: 98678 - protein, 13 aa, Mycobacterium tuberculosis
ADVRVTYKGQLRL

SEQ ID NO: 98679 - protein, 13 aa, Mycobacterium tuberculosis
DVRVTYKGQLRLS

SEQ ID NO: 98680 - protein, 13 aa, Mycobacterium tuberculosis
VRVTYKGQLRLSD

SEQ ID NO: 98681 - protein, 13 aa, Mycobacterium tuberculosis
RVTYKGQLRLSDS

SEQ ID NO: 98682 - protein, 13 aa, Mycobacterium tuberculosis
VTYKGQLRLSDSP

SEQ ID NO: 98683 - protein, 13 aa, Mycobacterium tuberculosis
TYKGQLRLSDSPL

SEQ ID NO: 98684 - protein, 13 aa, Mycobacterium tuberculosis
YKGQLRLSDSPLQ

SEQ ID NO: 98685 - protein, 13 aa, Mycobacterium tuberculosis
KGQLRLSDSPLQV

SEQ ID NO: 98686 - protein, 13 aa, Mycobacterium tuberculosis
GQLRLSDSPLQVT

SEQ ID NO: 98687 - protein, 13 aa, Mycobacterium tuberculosis
QLRLSDSPLQVTI

SEQ ID NO: 98688 - protein, 13 aa, Mycobacterium tuberculosis
LRLSDSPLQVTIW

SEQ ID NO: 98689 - protein, 13 aa, Mycobacterium tuberculosis
RLSDSPLQVTIWT

SEQ ID NO: 98690 - protein, 13 aa, Mycobacterium tuberculosis
LSDSPLQVTIWTK

SEQ ID NO: 98691 - protein, 13 aa, Mycobacterium tuberculosis
SDSPLQVTIWTKR

SEQ ID NO: 98692 - protein, 13 aa, Mycobacterium tuberculosis
DSPLQVTIWTKRL

SEQ ID NO: 98693 - protein, 13 aa, Mycobacterium tuberculosis
SPLQVTIWTKRLR

SEQ ID NO: 98694 - protein, 13 aa, Mycobacterium tuberculosis
PLQVTIWTKRLRA

SEQ ID NO: 98695 - protein, 13 aa, Mycobacterium tuberculosis
LQVTIWTKRLRAV

SEQ ID NO: 98696 - protein, 13 aa, Mycobacterium tuberculosis
QVTIWTKRLRAVD

SEQ ID NO: 98697 - protein, 13 aa, Mycobacterium tuberculosis
VTIWTKRLRAVDF

SEQ ID NO: 98698 - protein, 13 aa, Mycobacterium tuberculosis
TIWTKRLRAVDFT

SEQ ID NO: 98699 - protein, 13 aa, Mycobacterium tuberculosis
IWTKRLRAVDFTL

SEQ ID NO: 98700 - protein, 13 aa, Mycobacterium tuberculosis
WTKRLRAVDFTLG

SEQ ID NO: 98701 - protein, 13 aa, Mycobacterium tuberculosis
TKRLRAVDFTLGY

SEQ ID NO: 98702 - protein, 13 aa, Mycobacterium tuberculosis
KRLRAVDFTLGYE

SEQ ID NO: 98703 - protein, 13 aa, Mycobacterium tuberculosis
RLRAVDFTLGYEV

SEQ ID NO: 98704 - protein, 13 aa, Mycobacterium tuberculosis
LRAVDFTLGYEVR

SEQ ID NO: 98705 - protein, 13 aa, Mycobacterium tuberculosis
RAVDFTLGYEVRS

SEQ ID NO: 98706 - protein, 13 aa, Mycobacterium tuberculosis
AVDFTLGYEVRSV

SEQ ID NO: 98707 - protein, 13 aa, Mycobacterium tuberculosis
VDFTLGYEVRSVN

SEQ ID NO: 98708 - protein, 13 aa, Mycobacterium tuberculosis
DFTLGYEVRSVNA

SEQ ID NO: 98709 - protein, 13 aa, Mycobacterium tuberculosis
FTLGYEVRSVNAE

SEQ ID NO: 98710 - protein, 13 aa, Mycobacterium tuberculosis
TLGYEVRSVNAEP

SEQ ID NO: 98711 - protein, 13 aa, Mycobacterium tuberculosis
LGYEVRSVNAEPD

SEQ ID NO: 98712 - protein, 13 aa, Mycobacterium tuberculosis
GYEVRSVNAEPDS

SEQ ID NO: 98713 - protein, 13 aa, Mycobacterium tuberculosis
YEVRSVNAEPDSR

SEQ ID NO: 98714 - protein, 13 aa, Mycobacterium tuberculosis
EVRSVNAEPDSRP

SEQ ID NO: 98715 - protein, 13 aa, Mycobacterium tuberculosis
VRSVNAEPDSRPA

SEQ ID NO: 98716 - protein, 13 aa, Mycobacterium tuberculosis
RSVNAEPDSRPAV

SEQ ID NO: 98717 - protein, 13 aa, Mycobacterium tuberculosis
SVNAEPDSRPAVI

SEQ ID NO: 98718 - protein, 13 aa, Mycobacterium tuberculosis
VNAEPDSRPAVIA

SEQ ID NO: 98719 - protein, 13 aa, Mycobacterium tuberculosis
NAEPDSRPAVIAE

SEQ ID NO: 98720 - protein, 13 aa, Mycobacterium tuberculosis
AEPDSRPAVIAES

SEQ ID NO: 98721 - protein, 13 aa, Mycobacterium tuberculosis
EPDSRPAVIAESQ

SEQ ID NO: 98722 - protein, 13 aa, Mycobacterium tuberculosis
PDSRPAVIAESQL

SEQ ID NO: 98723 - protein, 13 aa, Mycobacterium tuberculosis
DSRPAVIAESQLA

SEQ ID NO: 98724 - protein, 13 aa, Mycobacterium tuberculosis
SRPAVIAESQLAA

SEQ ID NO: 98725 - protein, 13 aa, Mycobacterium tuberculosis
RPAVIAESQLAAF

SEQ ID NO: 98726 - protein, 13 aa, Mycobacterium tuberculosis
PAVIAESQLAAFH

SEQ ID NO: 98727 - protein, 13 aa, Mycobacterium tuberculosis
AVIAESQLAAFHI

SEQ ID NO: 98728 - protein, 13 aa, Mycobacterium tuberculosis
VIAESQLAAFHIE

SEQ ID NO: 98729 - protein, 13 aa, Mycobacterium tuberculosis
IAESQLAAFHIEE

SEQ ID NO: 98730 - protein, 13 aa, Mycobacterium tuberculosis
AESQLAAFHIEEQ

SEQ ID NO: 98731 - protein, 13 aa, Mycobacterium tuberculosis
ESQLAAFHIEEQR

SEQ ID NO: 98732 - protein, 13 aa, Mycobacterium tuberculosis
SQLAAFHIEEQRL

SEQ ID NO: 98733 - protein, 13 aa, Mycobacterium tuberculosis
QLAAFHIEEQRLV

SEQ ID NO: 98734 - protein, 13 aa, Mycobacterium tuberculosis
LAAFHIEEQRLVR

SEQ ID NO: 98735 - protein, 13 aa, Mycobacterium tuberculosis
AAFHIEEQRLVRL

SEQ ID NO: 98736 - protein, 13 aa, Mycobacterium tuberculosis
AFHIEEQRLVRLS

SEQ ID NO: 98737 - protein, 13 aa, Mycobacterium tuberculosis
FHIEEQRLVRLSP

SEQ ID NO: 98738 - protein, 13 aa, Mycobacterium tuberculosis
HIEEQRLVRLSPH

SEQ ID NO: 98739 - protein, 13 aa, Mycobacterium tuberculosis
IEEQRLVRLSPHH

SEQ ID NO: 98740 - protein, 13 aa, Mycobacterium tuberculosis
EEQRLVRLSPHHR

SEQ ID NO: 98741 - protein, 13 aa, Mycobacterium tuberculosis
EQRLVRLSPHHRE

SEQ ID NO: 98742 - protein, 13 aa, Mycobacterium tuberculosis
QRLVRLSPHHREY

SEQ ID NO: 98743 - protein, 13 aa, Mycobacterium tuberculosis
RLVRLSPHHREYL

SEQ ID NO: 98744 - protein, 13 aa, Mycobacterium tuberculosis
LVRLSPHHREYLQ

SEQ ID NO: 98745 - protein, 13 aa, Mycobacterium tuberculosis
VRLSPHHREYLQR

SEQ ID NO: 98746 - protein, 13 aa, Mycobacterium tuberculosis
RLSPHHREYLQRW

SEQ ID NO: 98747 - protein, 13 aa, Mycobacterium tuberculosis
LSPHHREYLQRWF

SEQ ID NO: 98748 - protein, 13 aa, Mycobacterium tuberculosis
SPHHREYLQRWFR

SEQ ID NO: 98749 - protein, 13 aa, Mycobacterium tuberculosis
PHHREYLQRWFRG

SEQ ID NO: 98750 - protein, 14 aa, Mycobacterium tuberculosis
MSVGFVTPVGVRWS

SEQ ID NO: 98751 - protein, 14 aa, Mycobacterium tuberculosis
SVGFVTPVGVRWSD

SEQ ID NO: 98752 - protein, 14 aa, Mycobacterium tuberculosis
VGFVTPVGVRWSDI

SEQ ID NO: 98753 - protein, 14 aa, Mycobacterium tuberculosis
GFVTPVGVRWSDID

SEQ ID NO: 98754 - protein, 14 aa, Mycobacterium tuberculosis
FVTPVGVRWSDIDM

SEQ ID NO: 98755 - protein, 14 aa, Mycobacterium tuberculosis
VTPVGVRWSDIDMY

SEQ ID NO: 98756 - protein, 14 aa, Mycobacterium tuberculosis
TPVGVRWSDIDMYQ

SEQ ID NO: 98757 - protein, 14 aa, Mycobacterium tuberculosis
PVGVRWSDIDMYQH

SEQ ID NO: 98758 - protein, 14 aa, Mycobacterium tuberculosis
VGVRWSDIDMYQHV

SEQ ID NO: 98759 - protein, 14 aa, Mycobacterium tuberculosis
GVRWSDIDMYQHVN

SEQ ID NO: 98760 - protein, 14 aa, Mycobacterium tuberculosis
VRWSDIDMYQHVNH

SEQ ID NO: 98761 - protein, 14 aa, Mycobacterium tuberculosis
RWSDIDMYQHVNHA

SEQ ID NO: 98762 - protein, 14 aa, Mycobacterium tuberculosis
WSDIDMYQHVNHAT

SEQ ID NO: 98763 - protein, 14 aa, Mycobacterium tuberculosis
SDIDMYQHVNHATM

SEQ ID NO: 98764 - protein, 14 aa, Mycobacterium tuberculosis
DIDMYQHVNHATMV

SEQ ID NO: 98765 - protein, 14 aa, Mycobacterium tuberculosis
IDMYQHVNHATMVT

SEQ ID NO: 98766 - protein, 14 aa, Mycobacterium tuberculosis
DMYQHVNHATMVTI

SEQ ID NO: 98767 - protein, 14 aa, Mycobacterium tuberculosis
MYQHVNHATMVTIL

SEQ ID NO: 98768 - protein, 14 aa, Mycobacterium tuberculosis
YQHVNHATMVTILE

SEQ ID NO: 98769 - protein, 14 aa, Mycobacterium tuberculosis
QHVNHATMVTILEE

SEQ ID NO: 98770 - protein, 14 aa, Mycobacterium tuberculosis
HVNHATMVTILEEA

SEQ ID NO: 98771 - protein, 14 aa, Mycobacterium tuberculosis
VNHATMVTILEEAR

SEQ ID NO: 98772 - protein, 14 aa, Mycobacterium tuberculosis
NHATMVTILEEARV

SEQ ID NO: 98773 - protein, 14 aa, Mycobacterium tuberculosis
HATMVTILEEARVP

SEQ ID NO: 98774 - protein, 14 aa, Mycobacterium tuberculosis
ATMVTILEEARVPF

SEQ ID NO: 98775 - protein, 14 aa, Mycobacterium tuberculosis
TMVTILEEARVPFL

SEQ ID NO: 98776 - protein, 14 aa, Mycobacterium tuberculosis
MVTILEEARVPFLK

SEQ ID NO: 98777 - protein, 14 aa, Mycobacterium tuberculosis
VTILEEARVPFLKD

SEQ ID NO: 98778 - protein, 14 aa, Mycobacterium tuberculosis
TILEEARVPFLKDA

SEQ ID NO: 98779 - protein, 14 aa, Mycobacterium tuberculosis
ILEEARVPFLKDAF

SEQ ID NO: 98780 - protein, 14 aa, Mycobacterium tuberculosis
LEEARVPFLKDAFG

SEQ ID NO: 98781 - protein, 14 aa, Mycobacterium tuberculosis
EEARVPFLKDAFGA

SEQ ID NO: 98782 - protein, 14 aa, Mycobacterium tuberculosis
EARVPFLKDAFGAD

SEQ ID NO: 98783 - protein, 14 aa, Mycobacterium tuberculosis
ARVPFLKDAFGADI

SEQ ID NO: 98784 - protein, 14 aa, Mycobacterium tuberculosis
RVPFLKDAFGADIT

SEQ ID NO: 98785 - protein, 14 aa, Mycobacterium tuberculosis
VPFLKDAFGADITS

SEQ ID NO: 98786 - protein, 14 aa, Mycobacterium tuberculosis
PFLKDAFGADITST

SEQ ID NO: 98787 - protein, 14 aa, Mycobacterium tuberculosis
FLKDAFGADITSTG

SEQ ID NO: 98788 - protein, 14 aa, Mycobacterium tuberculosis
LKDAFGADITSTGL

SEQ ID NO: 98789 - protein, 14 aa, Mycobacterium tuberculosis
KDAFGADITSTGLL

SEQ ID NO: 98790 - protein, 14 aa, Mycobacterium tuberculosis
DAFGADITSTGLLI

SEQ ID NO: 98791 - protein, 14 aa, Mycobacterium tuberculosis
AFGADITSTGLLIA

SEQ ID NO: 98792 - protein, 14 aa, Mycobacterium tuberculosis
FGADITSTGLLIAD

SEQ ID NO: 98793 - protein, 14 aa, Mycobacterium tuberculosis
GADITSTGLLIADV

SEQ ID NO: 98794 - protein, 14 aa, Mycobacterium tuberculosis
ADITSTGLLIADVR

SEQ ID NO: 98795 - protein, 14 aa, Mycobacterium tuberculosis
DITSTGLLIADVRV

SEQ ID NO: 98796 - protein, 14 aa, Mycobacterium tuberculosis
ITSTGLLIADVRVT

SEQ ID NO: 98797 - protein, 14 aa, Mycobacterium tuberculosis
TSTGLLIADVRVTY

SEQ ID NO: 98798 - protein, 14 aa, Mycobacterium tuberculosis
STGLLIADVRVTYK

SEQ ID NO: 98799 - protein, 14 aa, Mycobacterium tuberculosis
TGLLIADVRVTYKG

SEQ ID NO: 98800 - protein, 14 aa, Mycobacterium tuberculosis
GLLIADVRVTYKGQ

SEQ ID NO: 98801 - protein, 14 aa, Mycobacterium tuberculosis
LLIADVRVTYKGQL

SEQ ID NO: 98802 - protein, 14 aa, Mycobacterium tuberculosis
LIADVRVTYKGQLR

SEQ ID NO: 98803 - protein, 14 aa, Mycobacterium tuberculosis
IADVRVTYKGQLRL

SEQ ID NO: 98804 - protein, 14 aa, Mycobacterium tuberculosis
ADVRVTYKGQLRLS

SEQ ID NO: 98805 - protein, 14 aa, Mycobacterium tuberculosis
DVRVTYKGQLRLSD

SEQ ID NO: 98806 - protein, 14 aa, Mycobacterium tuberculosis
VRVTYKGQLRLSDS

SEQ ID NO: 98807 - protein, 14 aa, Mycobacterium tuberculosis
RVTYKGQLRLSDSP

SEQ ID NO: 98808 - protein, 14 aa, Mycobacterium tuberculosis
VTYKGQLRLSDSPL

SEQ ID NO: 98809 - protein, 14 aa, Mycobacterium tuberculosis
TYKGQLRLSDSPLQ

SEQ ID NO: 98810 - protein, 14 aa, Mycobacterium tuberculosis
YKGQLRLSDSPLQV

SEQ ID NO: 98811 - protein, 14 aa, Mycobacterium tuberculosis
KGQLRLSDSPLQVT

SEQ ID NO: 98812 - protein, 14 aa, Mycobacterium tuberculosis
GQLRLSDSPLQVTI

SEQ ID NO: 98813 - protein, 14 aa, Mycobacterium tuberculosis
QLRLSDSPLQVTIW

SEQ ID NO: 98814 - protein, 14 aa, Mycobacterium tuberculosis
LRLSDSPLQVTIWT

SEQ ID NO: 98815 - protein, 14 aa, Mycobacterium tuberculosis
RLSDSPLQVTIWTK

SEQ ID NO: 98816 - protein, 14 aa, Mycobacterium tuberculosis
LSDSPLQVTIWTKR

SEQ ID NO: 98817 - protein, 14 aa, Mycobacterium tuberculosis
SDSPLQVTIWTKRL

SEQ ID NO: 98818 - protein, 14 aa, Mycobacterium tuberculosis
DSPLQVTIWTKRLR

SEQ ID NO: 98819 - protein, 14 aa, Mycobacterium tuberculosis
SPLQVTIWTKRLRA

SEQ ID NO: 98820 - protein, 14 aa, Mycobacterium tuberculosis
PLQVTIWTKRLRAV

SEQ ID NO: 98821 - protein, 14 aa, Mycobacterium tuberculosis
LQVTIWTKRLRAVD

SEQ ID NO: 98822 - protein, 14 aa, Mycobacterium tuberculosis
QVTIWTKRLRAVDF

SEQ ID NO: 98823 - protein, 14 aa, Mycobacterium tuberculosis
VTIWTKRLRAVDFT

SEQ ID NO: 98824 - protein, 14 aa, Mycobacterium tuberculosis
TIWTKRLRAVDFTL

SEQ ID NO: 98825 - protein, 14 aa, Mycobacterium tuberculosis
IWTKRLRAVDFTLG

SEQ ID NO: 98826 - protein, 14 aa, Mycobacterium tuberculosis
WTKRLRAVDFTLGY

SEQ ID NO: 98827 - protein, 14 aa, Mycobacterium tuberculosis
TKRLRAVDFTLGYE

SEQ ID NO: 98828 - protein, 14 aa, Mycobacterium tuberculosis
KRLRAVDFTLGYEV

SEQ ID NO: 98829 - protein, 14 aa, Mycobacterium tuberculosis
RLRAVDFTLGYEVR

SEQ ID NO: 98830 - protein, 14 aa, Mycobacterium tuberculosis
LRAVDFTLGYEVRS

SEQ ID NO: 98831 - protein, 14 aa, Mycobacterium tuberculosis
RAVDFTLGYEVRSV

SEQ ID NO: 98832 - protein, 14 aa, Mycobacterium tuberculosis
AVDFTLGYEVRSVN

SEQ ID NO: 98833 - protein, 14 aa, Mycobacterium tuberculosis
VDFTLGYEVRSVNA

SEQ ID NO: 98834 - protein, 14 aa, Mycobacterium tuberculosis
DFTLGYEVRSVNAE

SEQ ID NO: 98835 - protein, 14 aa, Mycobacterium tuberculosis
FTLGYEVRSVNAEP

SEQ ID NO: 98836 - protein, 14 aa, Mycobacterium tuberculosis
TLGYEVRSVNAEPD

SEQ ID NO: 98837 - protein, 14 aa, Mycobacterium tuberculosis
LGYEVRSVNAEPDS

SEQ ID NO: 98838 - protein, 14 aa, Mycobacterium tuberculosis
GYEVRSVNAEPDSR

SEQ ID NO: 98839 - protein, 14 aa, Mycobacterium tuberculosis
YEVRSVNAEPDSRP

SEQ ID NO: 98840 - protein, 14 aa, Mycobacterium tuberculosis
EVRSVNAEPDSRPA

SEQ ID NO: 98841 - protein, 14 aa, Mycobacterium tuberculosis
VRSVNAEPDSRPAV

SEQ ID NO: 98842 - protein, 14 aa, Mycobacterium tuberculosis
RSVNAEPDSRPAVI

SEQ ID NO: 98843 - protein, 14 aa, Mycobacterium tuberculosis
SVNAEPDSRPAVIA

SEQ ID NO: 98844 - protein, 14 aa, Mycobacterium tuberculosis
VNAEPDSRPAVIAE

SEQ ID NO: 98845 - protein, 14 aa, Mycobacterium tuberculosis
NAEPDSRPAVIAES

SEQ ID NO: 98846 - protein, 14 aa, Mycobacterium tuberculosis
AEPDSRPAVIAESQ

SEQ ID NO: 98847 - protein, 14 aa, Mycobacterium tuberculosis
EPDSRPAVIAESQL

SEQ ID NO: 98848 - protein, 14 aa, Mycobacterium tuberculosis
PDSRPAVIAESQLA

SEQ ID NO: 98849 - protein, 14 aa, Mycobacterium tuberculosis
DSRPAVIAESQLAA

SEQ ID NO: 98850 - protein, 14 aa, Mycobacterium tuberculosis
SRPAVIAESQLAAF

SEQ ID NO: 98851 - protein, 14 aa, Mycobacterium tuberculosis
RPAVIAESQLAAFH

SEQ ID NO: 98852 - protein, 14 aa, Mycobacterium tuberculosis
PAVIAESQLAAFHI

SEQ ID NO: 98853 - protein, 14 aa, Mycobacterium tuberculosis
AVIAESQLAAFHIE

SEQ ID NO: 98854 - protein, 14 aa, Mycobacterium tuberculosis
VIAESQLAAFHIEE

SEQ ID NO: 98855 - protein, 14 aa, Mycobacterium tuberculosis
IAESQLAAFHIEEQ

SEQ ID NO: 98856 - protein, 14 aa, Mycobacterium tuberculosis
AESQLAAFHIEEQR

SEQ ID NO: 98857 - protein, 14 aa, Mycobacterium tuberculosis
ESQLAAFHIEEQRL

SEQ ID NO: 98858 - protein, 14 aa, Mycobacterium tuberculosis
SQLAAFHIEEQRLV

SEQ ID NO: 98859 - protein, 14 aa, Mycobacterium tuberculosis
QLAAFHIEEQRLVR

SEQ ID NO: 98860 - protein, 14 aa, Mycobacterium tuberculosis
LAAFHIEEQRLVRL

SEQ ID NO: 98861 - protein, 14 aa, Mycobacterium tuberculosis
AAFHIEEQRLVRLS

SEQ ID NO: 98862 - protein, 14 aa, Mycobacterium tuberculosis
AFHIEEQRLVRLSP

SEQ ID NO: 98863 - protein, 14 aa, Mycobacterium tuberculosis
FHIEEQRLVRLSPH

SEQ ID NO: 98864 - protein, 14 aa, Mycobacterium tuberculosis
HIEEQRLVRLSPHH

SEQ ID NO: 98865 - protein, 14 aa, Mycobacterium tuberculosis
IEEQRLVRLSPHHR

SEQ ID NO: 98866 - protein, 14 aa, Mycobacterium tuberculosis
EEQRLVRLSPHHRE

SEQ ID NO: 98867 - protein, 14 aa, Mycobacterium tuberculosis
EQRLVRLSPHHREY

SEQ ID NO: 98868 - protein, 14 aa, Mycobacterium tuberculosis
QRLVRLSPHHREYL

SEQ ID NO: 98869 - protein, 14 aa, Mycobacterium tuberculosis
RLVRLSPHHREYLQ

SEQ ID NO: 98870 - protein, 14 aa, Mycobacterium tuberculosis
LVRLSPHHREYLQR

SEQ ID NO: 98871 - protein, 14 aa, Mycobacterium tuberculosis
VRLSPHHREYLQRW

SEQ ID NO: 98872 - protein, 14 aa, Mycobacterium tuberculosis
RLSPHHREYLQRWF

SEQ ID NO: 98873 - protein, 14 aa, Mycobacterium tuberculosis
LSPHHREYLQRWFR

SEQ ID NO: 98874 - protein, 14 aa, Mycobacterium tuberculosis
SPHHREYLQRWFRG

SEQ ID NO: 98875 - protein, 15 aa, Mycobacterium tuberculosis
MSVGFVTPVGVRWSD

SEQ ID NO: 98876 - protein, 15 aa, Mycobacterium tuberculosis
SVGFVTPVGVRWSDI

SEQ ID NO: 98877 - protein, 15 aa, Mycobacterium tuberculosis
VGFVTPVGVRWSDID

SEQ ID NO: 98878 - protein, 15 aa, Mycobacterium tuberculosis
GFVTPVGVRWSDIDM

SEQ ID NO: 98879 - protein, 15 aa, Mycobacterium tuberculosis
FVTPVGVRWSDIDMY

SEQ ID NO: 98880 - protein, 15 aa, Mycobacterium tuberculosis
VTPVGVRWSDIDMYQ

SEQ ID NO: 98881 - protein, 15 aa, Mycobacterium tuberculosis
TPVGVRWSDIDMYQH

SEQ ID NO: 98882 - protein, 15 aa, Mycobacterium tuberculosis
PVGVRWSDIDMYQHV

SEQ ID NO: 98883 - protein, 15 aa, Mycobacterium tuberculosis
VGVRWSDIDMYQHVN

SEQ ID NO: 98884 - protein, 15 aa, Mycobacterium tuberculosis
GVRWSDIDMYQHVNH

SEQ ID NO: 98885 - protein, 15 aa, Mycobacterium tuberculosis
VRWSDIDMYQHVNHA

SEQ ID NO: 98886 - protein, 15 aa, Mycobacterium tuberculosis
RWSDIDMYQHVNHAT

SEQ ID NO: 98887 - protein, 15 aa, Mycobacterium tuberculosis
WSDIDMYQHVNHATM

SEQ ID NO: 98888 - protein, 15 aa, Mycobacterium tuberculosis
SDIDMYQHVNHATMV

SEQ ID NO: 98889 - protein, 15 aa, Mycobacterium tuberculosis
DIDMYQHVNHATMVT

SEQ ID NO: 98890 - protein, 15 aa, Mycobacterium tuberculosis
IDMYQHVNHATMVTI

SEQ ID NO: 98891 - protein, 15 aa, Mycobacterium tuberculosis
DMYQHVNHATMVTIL

SEQ ID NO: 98892 - protein, 15 aa, Mycobacterium tuberculosis
MYQHVNHATMVTILE

SEQ ID NO: 98893 - protein, 15 aa, Mycobacterium tuberculosis
YQHVNHATMVTILEE

SEQ ID NO: 98894 - protein, 15 aa, Mycobacterium tuberculosis
QHVNHATMVTILEEA

SEQ ID NO: 98895 - protein, 15 aa, Mycobacterium tuberculosis
HVNHATMVTILEEAR

SEQ ID NO: 98896 - protein, 15 aa, Mycobacterium tuberculosis
VNHATMVTILEEARV

SEQ ID NO: 98897 - protein, 15 aa, Mycobacterium tuberculosis
NHATMVTILEEARVP

SEQ ID NO: 98898 - protein, 15 aa, Mycobacterium tuberculosis
HATMVTILEEARVPF

SEQ ID NO: 98899 - protein, 15 aa, Mycobacterium tuberculosis
ATMVTILEEARVPFL

SEQ ID NO: 98900 - protein, 15 aa, Mycobacterium tuberculosis
TMVTILEEARVPFLK

SEQ ID NO: 98901 - protein, 15 aa, Mycobacterium tuberculosis
MVTILEEARVPFLKD

SEQ ID NO: 98902 - protein, 15 aa, Mycobacterium tuberculosis
VTILEEARVPFLKDA

SEQ ID NO: 98903 - protein, 15 aa, Mycobacterium tuberculosis
TILEEARVPFLKDAF

SEQ ID NO: 98904 - protein, 15 aa, Mycobacterium tuberculosis
ILEEARVPFLKDAFG

SEQ ID NO: 98905 - protein, 15 aa, Mycobacterium tuberculosis
LEEARVPFLKDAFGA

SEQ ID NO: 98906 - protein, 15 aa, Mycobacterium tuberculosis
EEARVPFLKDAFGAD

SEQ ID NO: 98907 - protein, 15 aa, Mycobacterium tuberculosis
EARVPFLKDAFGADI

SEQ ID NO: 98908 - protein, 15 aa, Mycobacterium tuberculosis
ARVPFLKDAFGADIT

SEQ ID NO: 98909 - protein, 15 aa, Mycobacterium tuberculosis
RVPFLKDAFGADITS

SEQ ID NO: 98910 - protein, 15 aa, Mycobacterium tuberculosis
VPFLKDAFGADITST

SEQ ID NO: 98911 - protein, 15 aa, Mycobacterium tuberculosis
PFLKDAFGADITSTG

SEQ ID NO: 98912 - protein, 15 aa, Mycobacterium tuberculosis
FLKDAFGADITSTGL

SEQ ID NO: 98913 - protein, 15 aa, Mycobacterium tuberculosis
LKDAFGADITSTGLL

SEQ ID NO: 98914 - protein, 15 aa, Mycobacterium tuberculosis
KDAFGADITSTGLLI

SEQ ID NO: 98915 - protein, 15 aa, Mycobacterium tuberculosis
DAFGADITSTGLLIA

SEQ ID NO: 98916 - protein, 15 aa, Mycobacterium tuberculosis
AFGADITSTGLLIAD

SEQ ID NO: 98917 - protein, 15 aa, Mycobacterium tuberculosis
FGADITSTGLLIADV

SEQ ID NO: 98918 - protein, 15 aa, Mycobacterium tuberculosis
GADITSTGLLIADVR

SEQ ID NO: 98919 - protein, 15 aa, Mycobacterium tuberculosis
ADITSTGLLIADVRV

SEQ ID NO: 98920 - protein, 15 aa, Mycobacterium tuberculosis
DITSTGLLIADVRVT

SEQ ID NO: 98921 - protein, 15 aa, Mycobacterium tuberculosis
ITSTGLLIADVRVTY

SEQ ID NO: 98922 - protein, 15 aa, Mycobacterium tuberculosis
TSTGLLIADVRVTYK

SEQ ID NO: 98923 - protein, 15 aa, Mycobacterium tuberculosis
STGLLIADVRVTYKG

SEQ ID NO: 98924 - protein, 15 aa, Mycobacterium tuberculosis
TGLLIADVRVTYKGQ

SEQ ID NO: 98925 - protein, 15 aa, Mycobacterium tuberculosis
GLLIADVRVTYKGQL

SEQ ID NO: 98926 - protein, 15 aa, Mycobacterium tuberculosis
LLIADVRVTYKGQLR

SEQ ID NO: 98927 - protein, 15 aa, Mycobacterium tuberculosis
LIADVRVTYKGQLRL

SEQ ID NO: 98928 - protein, 15 aa, Mycobacterium tuberculosis
IADVRVTYKGQLRLS

SEQ ID NO: 98929 - protein, 15 aa, Mycobacterium tuberculosis
ADVRVTYKGQLRLSD

SEQ ID NO: 98930 - protein, 15 aa, Mycobacterium tuberculosis
DVRVTYKGQLRLSDS

SEQ ID NO: 98931 - protein, 15 aa, Mycobacterium tuberculosis
VRVTYKGQLRLSDSP

SEQ ID NO: 98932 - protein, 15 aa, Mycobacterium tuberculosis
RVTYKGQLRLSDSPL

SEQ ID NO: 98933 - protein, 15 aa, Mycobacterium tuberculosis
VTYKGQLRLSDSPLQ

SEQ ID NO: 98934 - protein, 15 aa, Mycobacterium tuberculosis
TYKGQLRLSDSPLQV

SEQ ID NO: 98935 - protein, 15 aa, Mycobacterium tuberculosis
YKGQLRLSDSPLQVT

SEQ ID NO: 98936 - protein, 15 aa, Mycobacterium tuberculosis
KGQLRLSDSPLQVTI

SEQ ID NO: 98937 - protein, 15 aa, Mycobacterium tuberculosis
GQLRLSDSPLQVTIW

SEQ ID NO: 98938 - protein, 15 aa, Mycobacterium tuberculosis
QLRLSDSPLQVTIWT

SEQ ID NO: 98939 - protein, 15 aa, Mycobacterium tuberculosis
LRLSDSPLQVTIWTK

SEQ ID NO: 98940 - protein, 15 aa, Mycobacterium tuberculosis
RLSDSPLQVTIWTKR

SEQ ID NO: 98941 - protein, 15 aa, Mycobacterium tuberculosis
LSDSPLQVTIWTKRL

SEQ ID NO: 98942 - protein, 15 aa, Mycobacterium tuberculosis
SDSPLQVTIWTKRLR

SEQ ID NO: 98943 - protein, 15 aa, Mycobacterium tuberculosis
DSPLQVTIWTKRLRA

SEQ ID NO: 98944 - protein, 15 aa, Mycobacterium tuberculosis
SPLQVTIWTKRLRAV

SEQ ID NO: 98945 - protein, 15 aa, Mycobacterium tuberculosis
PLQVTIWTKRLRAVD

SEQ ID NO: 98946 - protein, 15 aa, Mycobacterium tuberculosis
LQVTIWTKRLRAVDF

SEQ ID NO: 98947 - protein, 15 aa, Mycobacterium tuberculosis
QVTIWTKRLRAVDFT

SEQ ID NO: 98948 - protein, 15 aa, Mycobacterium tuberculosis
VTIWTKRLRAVDFTL

SEQ ID NO: 98949 - protein, 15 aa, Mycobacterium tuberculosis
TIWTKRLRAVDFTLG

SEQ ID NO: 98950 - protein, 15 aa, Mycobacterium tuberculosis
IWTKRLRAVDFTLGY

SEQ ID NO: 98951 - protein, 15 aa, Mycobacterium tuberculosis
WTKRLRAVDFTLGYE

SEQ ID NO: 98952 - protein, 15 aa, Mycobacterium tuberculosis
TKRLRAVDFTLGYEV

SEQ ID NO: 98953 - protein, 15 aa, Mycobacterium tuberculosis
KRLRAVDFTLGYEVR

SEQ ID NO: 98954 - protein, 15 aa, Mycobacterium tuberculosis
RLRAVDFTLGYEVRS

SEQ ID NO: 98955 - protein, 15 aa, Mycobacterium tuberculosis
LRAVDFTLGYEVRSV

SEQ ID NO: 98956 - protein, 15 aa, Mycobacterium tuberculosis
RAVDFTLGYEVRSVN

SEQ ID NO: 98957 - protein, 15 aa, Mycobacterium tuberculosis
AVDFTLGYEVRSVNA

SEQ ID NO: 98958 - protein, 15 aa, Mycobacterium tuberculosis
VDFTLGYEVRSVNAE

SEQ ID NO: 98959 - protein, 15 aa, Mycobacterium tuberculosis
DFTLGYEVRSVNAEP

SEQ ID NO: 98960 - protein, 15 aa, Mycobacterium tuberculosis
FTLGYEVRSVNAEPD

SEQ ID NO: 98961 - protein, 15 aa, Mycobacterium tuberculosis
TLGYEVRSVNAEPDS

SEQ ID NO: 98962 - protein, 15 aa, Mycobacterium tuberculosis
LGYEVRSVNAEPDSR

SEQ ID NO: 98963 - protein, 15 aa, Mycobacterium tuberculosis
GYEVRSVNAEPDSRP

SEQ ID NO: 98964 - protein, 15 aa, Mycobacterium tuberculosis
YEVRSVNAEPDSRPA

SEQ ID NO: 98965 - protein, 15 aa, Mycobacterium tuberculosis
EVRSVNAEPDSRPAV

SEQ ID NO: 98966 - protein, 15 aa, Mycobacterium tuberculosis
VRSVNAEPDSRPAVI

SEQ ID NO: 98967 - protein, 15 aa, Mycobacterium tuberculosis
RSVNAEPDSRPAVIA

SEQ ID NO: 98968 - protein, 15 aa, Mycobacterium tuberculosis
SVNAEPDSRPAVIAE

SEQ ID NO: 98969 - protein, 15 aa, Mycobacterium tuberculosis
VNAEPDSRPAVIAES

SEQ ID NO: 98970 - protein, 15 aa, Mycobacterium tuberculosis
NAEPDSRPAVIAESQ

SEQ ID NO: 98971 - protein, 15 aa, Mycobacterium tuberculosis
AEPDSRPAVIAESQL

SEQ ID NO: 98972 - protein, 15 aa, Mycobacterium tuberculosis
EPDSRPAVIAESQLA

SEQ ID NO: 98973 - protein, 15 aa, Mycobacterium tuberculosis
PDSRPAVIAESQLAA

SEQ ID NO: 98974 - protein, 15 aa, Mycobacterium tuberculosis
DSRPAVIAESQLAAF

SEQ ID NO: 98975 - protein, 15 aa, Mycobacterium tuberculosis
SRPAVIAESQLAAFH

SEQ ID NO: 98976 - protein, 15 aa, Mycobacterium tuberculosis
RPAVIAESQLAAFHI

SEQ ID NO: 98977 - protein, 15 aa, Mycobacterium tuberculosis
PAVIAESQLAAFHIE

SEQ ID NO: 98978 - protein, 15 aa, Mycobacterium tuberculosis
AVIAESQLAAFHIEE

SEQ ID NO: 98979 - protein, 15 aa, Mycobacterium tuberculosis
VIAESQLAAFHIEEQ

SEQ ID NO: 98980 - protein, 15 aa, Mycobacterium tuberculosis
IAESQLAAFHIEEQR

SEQ ID NO: 98981 - protein, 15 aa, Mycobacterium tuberculosis
AESQLAAFHIEEQRL

SEQ ID NO: 98982 - protein, 15 aa, Mycobacterium tuberculosis
ESQLAAFHIEEQRLV

SEQ ID NO: 98983 - protein, 15 aa, Mycobacterium tuberculosis
SQLAAFHIEEQRLVR

SEQ ID NO: 98984 - protein, 15 aa, Mycobacterium tuberculosis
QLAAFHIEEQRLVRL

SEQ ID NO: 98985 - protein, 15 aa, Mycobacterium tuberculosis
LAAFHIEEQRLVRLS

SEQ ID NO: 98986 - protein, 15 aa, Mycobacterium tuberculosis
AAFHIEEQRLVRLSP

SEQ ID NO: 98987 - protein, 15 aa, Mycobacterium tuberculosis
AFHIEEQRLVRLSPH

SEQ ID NO: 98988 - protein, 15 aa, Mycobacterium tuberculosis
FHIEEQRLVRLSPHH

SEQ ID NO: 98989 - protein, 15 aa, Mycobacterium tuberculosis
HIEEQRLVRLSPHHR

SEQ ID NO: 98990 - protein, 15 aa, Mycobacterium tuberculosis
IEEQRLVRLSPHHRE

SEQ ID NO: 98991 - protein, 15 aa, Mycobacterium tuberculosis
EEQRLVRLSPHHREY

SEQ ID NO: 98992 - protein, 15 aa, Mycobacterium tuberculosis
EQRLVRLSPHHREYL

SEQ ID NO: 98993 - protein, 15 aa, Mycobacterium tuberculosis
QRLVRLSPHHREYLQ

SEQ ID NO: 98994 - protein, 15 aa, Mycobacterium tuberculosis
RLVRLSPHHREYLQR

SEQ ID NO: 98995 - protein, 15 aa, Mycobacterium tuberculosis
LVRLSPHHREYLQRW

SEQ ID NO: 98996 - protein, 15 aa, Mycobacterium tuberculosis
VRLSPHHREYLQRWF

SEQ ID NO: 98997 - protein, 15 aa, Mycobacterium tuberculosis
RLSPHHREYLQRWFR

SEQ ID NO: 98998 - protein, 15 aa, Mycobacterium tuberculosis
LSPHHREYLQRWFRG

SEQ ID NO: 98999 - protein, 16 aa, Mycobacterium tuberculosis
MSVGFVTPVGVRWSDI

SEQ ID NO: 99000 - protein, 16 aa, Mycobacterium tuberculosis
SVGFVTPVGVRWSDID

SEQ ID NO: 99001 - protein, 16 aa, Mycobacterium tuberculosis
VGFVTPVGVRWSDIDM

SEQ ID NO: 99002 - protein, 16 aa, Mycobacterium tuberculosis
GFVTPVGVRWSDIDMY

SEQ ID NO: 99003 - protein, 16 aa, Mycobacterium tuberculosis
FVTPVGVRWSDIDMYQ

SEQ ID NO: 99004 - protein, 16 aa, Mycobacterium tuberculosis
VTPVGVRWSDIDMYQH

SEQ ID NO: 99005 - protein, 16 aa, Mycobacterium tuberculosis
TPVGVRWSDIDMYQHV

SEQ ID NO: 99006 - protein, 16 aa, Mycobacterium tuberculosis
PVGVRWSDIDMYQHVN

SEQ ID NO: 99007 - protein, 16 aa, Mycobacterium tuberculosis
VGVRWSDIDMYQHVNH

SEQ ID NO: 99008 - protein, 16 aa, Mycobacterium tuberculosis
GVRWSDIDMYQHVNHA

SEQ ID NO: 99009 - protein, 16 aa, Mycobacterium tuberculosis
VRWSDIDMYQHVNHAT

SEQ ID NO: 99010 - protein, 16 aa, Mycobacterium tuberculosis
RWSDIDMYQHVNHATM

SEQ ID NO: 99011 - protein, 16 aa, Mycobacterium tuberculosis
WSDIDMYQHVNHATMV

SEQ ID NO: 99012 - protein, 16 aa, Mycobacterium tuberculosis
SDIDMYQHVNHATMVT

SEQ ID NO: 99013 - protein, 16 aa, Mycobacterium tuberculosis
DIDMYQHVNHATMVTI

SEQ ID NO: 99014 - protein, 16 aa, Mycobacterium tuberculosis
IDMYQHVNHATMVTIL

SEQ ID NO: 99015 - protein, 16 aa, Mycobacterium tuberculosis
DMYQHVNHATMVTILE

SEQ ID NO: 99016 - protein, 16 aa, Mycobacterium tuberculosis
MYQHVNHATMVTILEE

SEQ ID NO: 99017 - protein, 16 aa, Mycobacterium tuberculosis
YQHVNHATMVTILEEA

SEQ ID NO: 99018 - protein, 16 aa, Mycobacterium tuberculosis
QHVNHATMVTILEEAR

SEQ ID NO: 99019 - protein, 16 aa, Mycobacterium tuberculosis
HVNHATMVTILEEARV

SEQ ID NO: 99020 - protein, 16 aa, Mycobacterium tuberculosis
VNHATMVTILEEARVP

SEQ ID NO: 99021 - protein, 16 aa, Mycobacterium tuberculosis
NHATMVTILEEARVPF

SEQ ID NO: 99022 - protein, 16 aa, Mycobacterium tuberculosis
HATMVTILEEARVPFL

SEQ ID NO: 99023 - protein, 16 aa, Mycobacterium tuberculosis
ATMVTILEEARVPFLK

SEQ ID NO: 99024 - protein, 16 aa, Mycobacterium tuberculosis
TMVTILEEARVPFLKD

SEQ ID NO: 99025 - protein, 16 aa, Mycobacterium tuberculosis
MVTILEEARVPFLKDA

SEQ ID NO: 99026 - protein, 16 aa, Mycobacterium tuberculosis
VTILEEARVPFLKDAF

SEQ ID NO: 99027 - protein, 16 aa, Mycobacterium tuberculosis
TILEEARVPFLKDAFG

SEQ ID NO: 99028 - protein, 16 aa, Mycobacterium tuberculosis
ILEEARVPFLKDAFGA

SEQ ID NO: 99029 - protein, 16 aa, Mycobacterium tuberculosis
LEEARVPFLKDAFGAD

SEQ ID NO: 99030 - protein, 16 aa, Mycobacterium tuberculosis
EEARVPFLKDAFGADI

SEQ ID NO: 99031 - protein, 16 aa, Mycobacterium tuberculosis
EARVPFLKDAFGADIT

SEQ ID NO: 99032 - protein, 16 aa, Mycobacterium tuberculosis
ARVPFLKDAFGADITS

SEQ ID NO: 99033 - protein, 16 aa, Mycobacterium tuberculosis
RVPFLKDAFGADITST

SEQ ID NO: 99034 - protein, 16 aa, Mycobacterium tuberculosis
VPFLKDAFGADITSTG

SEQ ID NO: 99035 - protein, 16 aa, Mycobacterium tuberculosis
PFLKDAFGADITSTGL

SEQ ID NO: 99036 - protein, 16 aa, Mycobacterium tuberculosis
FLKDAFGADITSTGLL

SEQ ID NO: 99037 - protein, 16 aa, Mycobacterium tuberculosis
LKDAFGADITSTGLLI

SEQ ID NO: 99038 - protein, 16 aa, Mycobacterium tuberculosis
KDAFGADITSTGLLIA

SEQ ID NO: 99039 - protein, 16 aa, Mycobacterium tuberculosis
DAFGADITSTGLLIAD

SEQ ID NO: 99040 - protein, 16 aa, Mycobacterium tuberculosis
AFGADITSTGLLIADV

SEQ ID NO: 99041 - protein, 16 aa, Mycobacterium tuberculosis
FGADITSTGLLIADVR

SEQ ID NO: 99042 - protein, 16 aa, Mycobacterium tuberculosis
GADITSTGLLIADVRV

SEQ ID NO: 99043 - protein, 16 aa, Mycobacterium tuberculosis
ADITSTGLLIADVRVT

SEQ ID NO: 99044 - protein, 16 aa, Mycobacterium tuberculosis
DITSTGLLIADVRVTY

SEQ ID NO: 99045 - protein, 16 aa, Mycobacterium tuberculosis
ITSTGLLIADVRVTYK

SEQ ID NO: 99046 - protein, 16 aa, Mycobacterium tuberculosis
TSTGLLIADVRVTYKG

SEQ ID NO: 99047 - protein, 16 aa, Mycobacterium tuberculosis
STGLLIADVRVTYKGQ

SEQ ID NO: 99048 - protein, 16 aa, Mycobacterium tuberculosis
TGLLIADVRVTYKGQL

SEQ ID NO: 99049 - protein, 16 aa, Mycobacterium tuberculosis
GLLIADVRVTYKGQLR

SEQ ID NO: 99050 - protein, 16 aa, Mycobacterium tuberculosis
LLIADVRVTYKGQLRL

SEQ ID NO: 99051 - protein, 16 aa, Mycobacterium tuberculosis
LIADVRVTYKGQLRLS

SEQ ID NO: 99052 - protein, 16 aa, Mycobacterium tuberculosis
IADVRVTYKGQLRLSD

SEQ ID NO: 99053 - protein, 16 aa, Mycobacterium tuberculosis
ADVRVTYKGQLRLSDS

SEQ ID NO: 99054 - protein, 16 aa, Mycobacterium tuberculosis
DVRVTYKGQLRLSDSP

SEQ ID NO: 99055 - protein, 16 aa, Mycobacterium tuberculosis
VRVTYKGQLRLSDSPL

SEQ ID NO: 99056 - protein, 16 aa, Mycobacterium tuberculosis
RVTYKGQLRLSDSPLQ

SEQ ID NO: 99057 - protein, 16 aa, Mycobacterium tuberculosis
VTYKGQLRLSDSPLQV

SEQ ID NO: 99058 - protein, 16 aa, Mycobacterium tuberculosis
TYKGQLRLSDSPLQVT

SEQ ID NO: 99059 - protein, 16 aa, Mycobacterium tuberculosis
YKGQLRLSDSPLQVTI

SEQ ID NO: 99060 - protein, 16 aa, Mycobacterium tuberculosis
KGQLRLSDSPLQVTIW

SEQ ID NO: 99061 - protein, 16 aa, Mycobacterium tuberculosis
GQLRLSDSPLQVTIWT

SEQ ID NO: 99062 - protein, 16 aa, Mycobacterium tuberculosis
QLRLSDSPLQVTIWTK

SEQ ID NO: 99063 - protein, 16 aa, Mycobacterium tuberculosis
LRLSDSPLQVTIWTKR

SEQ ID NO: 99064 - protein, 16 aa, Mycobacterium tuberculosis
RLSDSPLQVTIWTKRL

SEQ ID NO: 99065 - protein, 16 aa, Mycobacterium tuberculosis
LSDSPLQVTIWTKRLR

SEQ ID NO: 99066 - protein, 16 aa, Mycobacterium tuberculosis
SDSPLQVTIWTKRLRA

SEQ ID NO: 99067 - protein, 16 aa, Mycobacterium tuberculosis
DSPLQVTIWTKRLRAV

SEQ ID NO: 99068 - protein, 16 aa, Mycobacterium tuberculosis
SPLQVTIWTKRLRAVD

SEQ ID NO: 99069 - protein, 16 aa, Mycobacterium tuberculosis
PLQVTIWTKRLRAVDF

SEQ ID NO: 99070 - protein, 16 aa, Mycobacterium tuberculosis
LQVTIWTKRLRAVDFT

SEQ ID NO: 99071 - protein, 16 aa, Mycobacterium tuberculosis
QVTIWTKRLRAVDFTL

SEQ ID NO: 99072 - protein, 16 aa, Mycobacterium tuberculosis
VTIWTKRLRAVDFTLG

SEQ ID NO: 99073 - protein, 16 aa, Mycobacterium tuberculosis
TIWTKRLRAVDFTLGY

SEQ ID NO: 99074 - protein, 16 aa, Mycobacterium tuberculosis
IWTKRLRAVDFTLGYE

SEQ ID NO: 99075 - protein, 16 aa, Mycobacterium tuberculosis
WTKRLRAVDFTLGYEV

SEQ ID NO: 99076 - protein, 16 aa, Mycobacterium tuberculosis
TKRLRAVDFTLGYEVR

SEQ ID NO: 99077 - protein, 16 aa, Mycobacterium tuberculosis
KRLRAVDFTLGYEVRS

SEQ ID NO: 99078 - protein, 16 aa, Mycobacterium tuberculosis
RLRAVDFTLGYEVRSV

SEQ ID NO: 99079 - protein, 16 aa, Mycobacterium tuberculosis
LRAVDFTLGYEVRSVN

SEQ ID NO: 99080 - protein, 16 aa, Mycobacterium tuberculosis
RAVDFTLGYEVRSVNA

SEQ ID NO: 99081 - protein, 16 aa, Mycobacterium tuberculosis
AVDFTLGYEVRSVNAE

SEQ ID NO: 99082 - protein, 16 aa, Mycobacterium tuberculosis
VDFTLGYEVRSVNAEP

SEQ ID NO: 99083 - protein, 16 aa, Mycobacterium tuberculosis
DFTLGYEVRSVNAEPD

SEQ ID NO: 99084 - protein, 16 aa, Mycobacterium tuberculosis
FTLGYEVRSVNAEPDS

SEQ ID NO: 99085 - protein, 16 aa, Mycobacterium tuberculosis
TLGYEVRSVNAEPDSR

SEQ ID NO: 99086 - protein, 16 aa, Mycobacterium tuberculosis
LGYEVRSVNAEPDSRP

SEQ ID NO: 99087 - protein, 16 aa, Mycobacterium tuberculosis
GYEVRSVNAEPDSRPA

SEQ ID NO: 99088 - protein, 16 aa, Mycobacterium tuberculosis
YEVRSVNAEPDSRPAV

SEQ ID NO: 99089 - protein, 16 aa, Mycobacterium tuberculosis
EVRSVNAEPDSRPAVI

SEQ ID NO: 99090 - protein, 16 aa, Mycobacterium tuberculosis
VRSVNAEPDSRPAVIA

SEQ ID NO: 99091 - protein, 16 aa, Mycobacterium tuberculosis
RSVNAEPDSRPAVIAE

SEQ ID NO: 99092 - protein, 16 aa, Mycobacterium tuberculosis
SVNAEPDSRPAVIAES

SEQ ID NO: 99093 - protein, 16 aa, Mycobacterium tuberculosis
VNAEPDSRPAVIAESQ

SEQ ID NO: 99094 - protein, 16 aa, Mycobacterium tuberculosis
NAEPDSRPAVIAESQL

SEQ ID NO: 99095 - protein, 16 aa, Mycobacterium tuberculosis
AEPDSRPAVIAESQLA

SEQ ID NO: 99096 - protein, 16 aa, Mycobacterium tuberculosis
EPDSRPAVIAESQLAA

SEQ ID NO: 99097 - protein, 16 aa, Mycobacterium tuberculosis
PDSRPAVIAESQLAAF

SEQ ID NO: 99098 - protein, 16 aa, Mycobacterium tuberculosis
DSRPAVIAESQLAAFH

SEQ ID NO: 99099 - protein, 16 aa, Mycobacterium tuberculosis
SRPAVIAESQLAAFHI

SEQ ID NO: 99100 - protein, 16 aa, Mycobacterium tuberculosis
RPAVIAESQLAAFHIE

SEQ ID NO: 99101 - protein, 16 aa, Mycobacterium tuberculosis
PAVIAESQLAAFHIEE

SEQ ID NO: 99102 - protein, 16 aa, Mycobacterium tuberculosis
AVIAESQLAAFHIEEQ

SEQ ID NO: 99103 - protein, 16 aa, Mycobacterium tuberculosis
VIAESQLAAFHIEEQR

SEQ ID NO: 99104 - protein, 16 aa, Mycobacterium tuberculosis
IAESQLAAFHIEEQRL

SEQ ID NO: 99105 - protein, 16 aa, Mycobacterium tuberculosis
AESQLAAFHIEEQRLV

SEQ ID NO: 99106 - protein, 16 aa, Mycobacterium tuberculosis
ESQLAAFHIEEQRLVR

SEQ ID NO: 99107 - protein, 16 aa, Mycobacterium tuberculosis
SQLAAFHIEEQRLVRL

SEQ ID NO: 99108 - protein, 16 aa, Mycobacterium tuberculosis
QLAAFHIEEQRLVRLS

SEQ ID NO: 99109 - protein, 16 aa, Mycobacterium tuberculosis
LAAFHIEEQRLVRLSP

SEQ ID NO: 99110 - protein, 16 aa, Mycobacterium tuberculosis
AAFHIEEQRLVRLSPH

SEQ ID NO: 99111 - protein, 16 aa, Mycobacterium tuberculosis
AFHIEEQRLVRLSPHH

SEQ ID NO: 99112 - protein, 16 aa, Mycobacterium tuberculosis
FHIEEQRLVRLSPHHR

SEQ ID NO: 99113 - protein, 16 aa, Mycobacterium tuberculosis
HIEEQRLVRLSPHHRE

SEQ ID NO: 99114 - protein, 16 aa, Mycobacterium tuberculosis
IEEQRLVRLSPHHREY

SEQ ID NO: 99115 - protein, 16 aa, Mycobacterium tuberculosis
EEQRLVRLSPHHREYL

SEQ ID NO: 99116 - protein, 16 aa, Mycobacterium tuberculosis
EQRLVRLSPHHREYLQ

SEQ ID NO: 99117 - protein, 16 aa, Mycobacterium tuberculosis
QRLVRLSPHHREYLQR

SEQ ID NO: 99118 - protein, 16 aa, Mycobacterium tuberculosis
RLVRLSPHHREYLQRW

SEQ ID NO: 99119 - protein, 16 aa, Mycobacterium tuberculosis
LVRLSPHHREYLQRWF

SEQ ID NO: 99120 - protein, 16 aa, Mycobacterium tuberculosis
VRLSPHHREYLQRWFR

SEQ ID NO: 99121 - protein, 16 aa, Mycobacterium tuberculosis
RLSPHHREYLQRWFRG

SEQ ID NO: 99122 - protein, 13 aa, Mycobacterium tuberculosis
MSQIMYNYPAMMA

SEQ ID NO: 99123 - protein, 13 aa, Mycobacterium tuberculosis
SQIMYNYPAMMAH

SEQ ID NO: 99124 - protein, 13 aa, Mycobacterium tuberculosis
QIMYNYPAMMAHA

SEQ ID NO: 99125 - protein, 13 aa, Mycobacterium tuberculosis
IMYNYPAMMAHAG

SEQ ID NO: 99126 - protein, 13 aa, Mycobacterium tuberculosis
MYNYPAMMAHAGD

SEQ ID NO: 99127 - protein, 13 aa, Mycobacterium tuberculosis
YNYPAMMAHAGDM

SEQ ID NO: 99128 - protein, 13 aa, Mycobacterium tuberculosis
NYPAMMAHAGDMA

SEQ ID NO: 99129 - protein, 13 aa, Mycobacterium tuberculosis
YPAMMAHAGDMAG

SEQ ID NO: 99130 - protein, 13 aa, Mycobacterium tuberculosis
PAMMAHAGDMAGY

SEQ ID NO: 99131 - protein, 13 aa, Mycobacterium tuberculosis
AMMAHAGDMAGYA

SEQ ID NO: 99132 - protein, 13 aa, Mycobacterium tuberculosis
MMAHAGDMAGYAG

SEQ ID NO: 99133 - protein, 13 aa, Mycobacterium tuberculosis
MAHAGDMAGYAGT

SEQ ID NO: 99134 - protein, 13 aa, Mycobacterium tuberculosis
AHAGDMAGYAGTL

SEQ ID NO: 99135 - protein, 13 aa, Mycobacterium tuberculosis
HAGDMAGYAGTLQ

SEQ ID NO: 99136 - protein, 13 aa, Mycobacterium tuberculosis
AGDMAGYAGTLQS

SEQ ID NO: 99137 - protein, 13 aa, Mycobacterium tuberculosis
GDMAGYAGTLQSL

SEQ ID NO: 99138 - protein, 13 aa, Mycobacterium tuberculosis
DMAGYAGTLQSLG

SEQ ID NO: 99139 - protein, 13 aa, Mycobacterium tuberculosis
MAGYAGTLQSLGA

SEQ ID NO: 99140 - protein, 13 aa, Mycobacterium tuberculosis
AGYAGTLQSLGAD

SEQ ID NO: 99141 - protein, 13 aa, Mycobacterium tuberculosis
GYAGTLQSLGADI

SEQ ID NO: 99142 - protein, 13 aa, Mycobacterium tuberculosis
YAGTLQSLGADIA

SEQ ID NO: 99143 - protein, 13 aa, Mycobacterium tuberculosis
AGTLQSLGADIAS

SEQ ID NO: 99144 - protein, 13 aa, Mycobacterium tuberculosis
GTLQSLGADIASE

SEQ ID NO: 99145 - protein, 13 aa, Mycobacterium tuberculosis
TLQSLGADIASEQ

SEQ ID NO: 99146 - protein, 13 aa, Mycobacterium tuberculosis
LQSLGADIASEQA

SEQ ID NO: 99147 - protein, 13 aa, Mycobacterium tuberculosis
QSLGADIASEQAV

SEQ ID NO: 99148 - protein, 13 aa, Mycobacterium tuberculosis
SLGADIASEQAVL

SEQ ID NO: 99149 - protein, 13 aa, Mycobacterium tuberculosis
LGADIASEQAVLS

SEQ ID NO: 99150 - protein, 13 aa, Mycobacterium tuberculosis
GADIASEQAVLSS

SEQ ID NO: 99151 - protein, 13 aa, Mycobacterium tuberculosis
ADIASEQAVLSSA

SEQ ID NO: 99152 - protein, 13 aa, Mycobacterium tuberculosis
DIASEQAVLSSAW

SEQ ID NO: 99153 - protein, 13 aa, Mycobacterium tuberculosis
IASEQAVLSSAWQ

SEQ ID NO: 99154 - protein, 13 aa, Mycobacterium tuberculosis
ASEQAVLSSAWQG

SEQ ID NO: 99155 - protein, 13 aa, Mycobacterium tuberculosis
SEQAVLSSAWQGD

SEQ ID NO: 99156 - protein, 13 aa, Mycobacterium tuberculosis
EQAVLSSAWQGDT

SEQ ID NO: 99157 - protein, 13 aa, Mycobacterium tuberculosis
QAVLSSAWQGDTG

SEQ ID NO: 99158 - protein, 13 aa, Mycobacterium tuberculosis
AVLSSAWQGDTGI

SEQ ID NO: 99159 - protein, 13 aa, Mycobacterium tuberculosis
VLSSAWQGDTGIT

SEQ ID NO: 99160 - protein, 13 aa, Mycobacterium tuberculosis
LSSAWQGDTGITY

SEQ ID NO: 99161 - protein, 13 aa, Mycobacterium tuberculosis
SSAWQGDTGITYQ

SEQ ID NO: 99162 - protein, 13 aa, Mycobacterium tuberculosis
SAWQGDTGITYQG

SEQ ID NO: 99163 - protein, 13 aa, Mycobacterium tuberculosis
AWQGDTGITYQGW

SEQ ID NO: 99164 - protein, 13 aa, Mycobacterium tuberculosis
WQGDTGITYQGWQ

SEQ ID NO: 99165 - protein, 13 aa, Mycobacterium tuberculosis
QGDTGITYQGWQT

SEQ ID NO: 99166 - protein, 13 aa, Mycobacterium tuberculosis
GDTGITYQGWQTQ

SEQ ID NO: 99167 - protein, 13 aa, Mycobacterium tuberculosis
DTGITYQGWQTQW

SEQ ID NO: 99168 - protein, 13 aa, Mycobacterium tuberculosis
TGITYQGWQTQWN

SEQ ID NO: 99169 - protein, 13 aa, Mycobacterium tuberculosis
GITYQGWQTQWNQ

SEQ ID NO: 99170 - protein, 13 aa, Mycobacterium tuberculosis
ITYQGWQTQWNQA

SEQ ID NO: 99171 - protein, 13 aa, Mycobacterium tuberculosis
TYQGWQTQWNQAL

SEQ ID NO: 99172 - protein, 13 aa, Mycobacterium tuberculosis
YQGWQTQWNQALE

SEQ ID NO: 99173 - protein, 13 aa, Mycobacterium tuberculosis
QGWQTQWNQALED

SEQ ID NO: 99174 - protein, 13 aa, Mycobacterium tuberculosis
GWQTQWNQALEDL

SEQ ID NO: 99175 - protein, 13 aa, Mycobacterium tuberculosis
WQTQWNQALEDLV

SEQ ID NO: 99176 - protein, 13 aa, Mycobacterium tuberculosis
QTQWNQALEDLVR

SEQ ID NO: 99177 - protein, 13 aa, Mycobacterium tuberculosis
TQWNQALEDLVRA

SEQ ID NO: 99178 - protein, 13 aa, Mycobacterium tuberculosis
QWNQALEDLVRAY

SEQ ID NO: 99179 - protein, 13 aa, Mycobacterium tuberculosis
WNQALEDLVRAYQ

SEQ ID NO: 99180 - protein, 13 aa, Mycobacterium tuberculosis
NQALEDLVRAYQS

SEQ ID NO: 99181 - protein, 13 aa, Mycobacterium tuberculosis
QALEDLVRAYQSM

SEQ ID NO: 99182 - protein, 13 aa, Mycobacterium tuberculosis
ALEDLVRAYQSMS

SEQ ID NO: 99183 - protein, 13 aa, Mycobacterium tuberculosis
LEDLVRAYQSMSG

SEQ ID NO: 99184 - protein, 13 aa, Mycobacterium tuberculosis
EDLVRAYQSMSGT

SEQ ID NO: 99185 - protein, 13 aa, Mycobacterium tuberculosis
DLVRAYQSMSGTH

SEQ ID NO: 99186 - protein, 13 aa, Mycobacterium tuberculosis
LVRAYQSMSGTHE

SEQ ID NO: 99187 - protein, 13 aa, Mycobacterium tuberculosis
VRAYQSMSGTHES

SEQ ID NO: 99188 - protein, 13 aa, Mycobacterium tuberculosis
RAYQSMSGTHESN

SEQ ID NO: 99189 - protein, 13 aa, Mycobacterium tuberculosis
AYQSMSGTHESNT

SEQ ID NO: 99190 - protein, 13 aa, Mycobacterium tuberculosis
YQSMSGTHESNTM

SEQ ID NO: 99191 - protein, 13 aa, Mycobacterium tuberculosis
QSMSGTHESNTMA

SEQ ID NO: 99192 - protein, 13 aa, Mycobacterium tuberculosis
SMSGTHESNTMAM

SEQ ID NO: 99193 - protein, 13 aa, Mycobacterium tuberculosis
MSGTHESNTMAML

SEQ ID NO: 99194 - protein, 13 aa, Mycobacterium tuberculosis
SGTHESNTMAMLA

SEQ ID NO: 99195 - protein, 13 aa, Mycobacterium tuberculosis
GTHESNTMAMLAR

SEQ ID NO: 99196 - protein, 13 aa, Mycobacterium tuberculosis
THESNTMAMLARD

SEQ ID NO: 99197 - protein, 13 aa, Mycobacterium tuberculosis
HESNTMAMLARDG

SEQ ID NO: 99198 - protein, 13 aa, Mycobacterium tuberculosis
ESNTMAMLARDGA

SEQ ID NO: 99199 - protein, 13 aa, Mycobacterium tuberculosis
SNTMAMLARDGAE

SEQ ID NO: 99200 - protein, 13 aa, Mycobacterium tuberculosis
NTMAMLARDGAEA

SEQ ID NO: 99201 - protein, 13 aa, Mycobacterium tuberculosis
TMAMLARDGAEAA

SEQ ID NO: 99202 - protein, 13 aa, Mycobacterium tuberculosis
MAMLARDGAEAAK

SEQ ID NO: 99203 - protein, 13 aa, Mycobacterium tuberculosis
AMLARDGAEAAKW

SEQ ID NO: 99204 - protein, 13 aa, Mycobacterium tuberculosis
MLARDGAEAAKWG

SEQ ID NO: 99205 - protein, 13 aa, Mycobacterium tuberculosis
LARDGAEAAKWGG

SEQ ID NO: 99206 - protein, 14 aa, Mycobacterium tuberculosis
MSQIMYNYPAMMAH

SEQ ID NO: 99207 - protein, 14 aa, Mycobacterium tuberculosis
SQIMYNYPAMMAHA

SEQ ID NO: 99208 - protein, 14 aa, Mycobacterium tuberculosis
QIMYNYPAMMAHAG

SEQ ID NO: 99209 - protein, 14 aa, Mycobacterium tuberculosis
IMYNYPAMMAHAGD

SEQ ID NO: 99210 - protein, 14 aa, Mycobacterium tuberculosis
MYNYPAMMAHAGDM

SEQ ID NO: 99211 - protein, 14 aa, Mycobacterium tuberculosis
YNYPAMMAHAGDMA

SEQ ID NO: 99212 - protein, 14 aa, Mycobacterium tuberculosis
NYPAMMAHAGDMAG

SEQ ID NO: 99213 - protein, 14 aa, Mycobacterium tuberculosis
YPAMMAHAGDMAGY

SEQ ID NO: 99214 - protein, 14 aa, Mycobacterium tuberculosis
PAMMAHAGDMAGYA

SEQ ID NO: 99215 - protein, 14 aa, Mycobacterium tuberculosis
AMMAHAGDMAGYAG

SEQ ID NO: 99216 - protein, 14 aa, Mycobacterium tuberculosis
MMAHAGDMAGYAGT

SEQ ID NO: 99217 - protein, 14 aa, Mycobacterium tuberculosis
MAHAGDMAGYAGTL

SEQ ID NO: 99218 - protein, 14 aa, Mycobacterium tuberculosis
AHAGDMAGYAGTLQ

SEQ ID NO: 99219 - protein, 14 aa, Mycobacterium tuberculosis
HAGDMAGYAGTLQS

SEQ ID NO: 99220 - protein, 14 aa, Mycobacterium tuberculosis
AGDMAGYAGTLQSL

SEQ ID NO: 99221 - protein, 14 aa, Mycobacterium tuberculosis
GDMAGYAGTLQSLG

SEQ ID NO: 99222 - protein, 14 aa, Mycobacterium tuberculosis
DMAGYAGTLQSLGA

SEQ ID NO: 99223 - protein, 14 aa, Mycobacterium tuberculosis
MAGYAGTLQSLGAD

SEQ ID NO: 99224 - protein, 14 aa, Mycobacterium tuberculosis
AGYAGTLQSLGADI

SEQ ID NO: 99225 - protein, 14 aa, Mycobacterium tuberculosis
GYAGTLQSLGADIA

SEQ ID NO: 99226 - protein, 14 aa, Mycobacterium tuberculosis
YAGTLQSLGADIAS

SEQ ID NO: 99227 - protein, 14 aa, Mycobacterium tuberculosis
AGTLQSLGADIASE

SEQ ID NO: 99228 - protein, 14 aa, Mycobacterium tuberculosis
GTLQSLGADIASEQ

SEQ ID NO: 99229 - protein, 14 aa, Mycobacterium tuberculosis
TLQSLGADIASEQA

SEQ ID NO: 99230 - protein, 14 aa, Mycobacterium tuberculosis
LQSLGADIASEQAV

SEQ ID NO: 99231 - protein, 14 aa, Mycobacterium tuberculosis
QSLGADIASEQAVL

SEQ ID NO: 99232 - protein, 14 aa, Mycobacterium tuberculosis
SLGADIASEQAVLS

SEQ ID NO: 99233 - protein, 14 aa, Mycobacterium tuberculosis
LGADIASEQAVLSS

SEQ ID NO: 99234 - protein, 14 aa, Mycobacterium tuberculosis
GADIASEQAVLSSA

SEQ ID NO: 99235 - protein, 14 aa, Mycobacterium tuberculosis
ADIASEQAVLSSAW

SEQ ID NO: 99236 - protein, 14 aa, Mycobacterium tuberculosis
DIASEQAVLSSAWQ

SEQ ID NO: 99237 - protein, 14 aa, Mycobacterium tuberculosis
IASEQAVLSSAWQG

SEQ ID NO: 99238 - protein, 14 aa, Mycobacterium tuberculosis
ASEQAVLSSAWQGD

SEQ ID NO: 99239 - protein, 14 aa, Mycobacterium tuberculosis
SEQAVLSSAWQGDT

SEQ ID NO: 99240 - protein, 14 aa, Mycobacterium tuberculosis
EQAVLSSAWQGDTG

SEQ ID NO: 99241 - protein, 14 aa, Mycobacterium tuberculosis
QAVLSSAWQGDTGI

SEQ ID NO: 99242 - protein, 14 aa, Mycobacterium tuberculosis
AVLSSAWQGDTGIT

SEQ ID NO: 99243 - protein, 14 aa, Mycobacterium tuberculosis
VLSSAWQGDTGITY

SEQ ID NO: 99244 - protein, 14 aa, Mycobacterium tuberculosis
LSSAWQGDTGITYQ

SEQ ID NO: 99245 - protein, 14 aa, Mycobacterium tuberculosis
SSAWQGDTGITYQG

SEQ ID NO: 99246 - protein, 14 aa, Mycobacterium tuberculosis
SAWQGDTGITYQGW

SEQ ID NO: 99247 - protein, 14 aa, Mycobacterium tuberculosis
AWQGDTGITYQGWQ

SEQ ID NO: 99248 - protein, 14 aa, Mycobacterium tuberculosis
WQGDTGITYQGWQT

SEQ ID NO: 99249 - protein, 14 aa, Mycobacterium tuberculosis
QGDTGITYQGWQTQ

SEQ ID NO: 99250 - protein, 14 aa, Mycobacterium tuberculosis
GDTGITYQGWQTQW

SEQ ID NO: 99251 - protein, 14 aa, Mycobacterium tuberculosis
DTGITYQGWQTQWN

SEQ ID NO: 99252 - protein, 14 aa, Mycobacterium tuberculosis
TGITYQGWQTQWNQ

SEQ ID NO: 99253 - protein, 14 aa, Mycobacterium tuberculosis
GITYQGWQTQWNQA

SEQ ID NO: 99254 - protein, 14 aa, Mycobacterium tuberculosis
ITYQGWQTQWNQAL

SEQ ID NO: 99255 - protein, 14 aa, Mycobacterium tuberculosis
TYQGWQTQWNQALE

SEQ ID NO: 99256 - protein, 14 aa, Mycobacterium tuberculosis
YQGWQTQWNQALED

SEQ ID NO: 99257 - protein, 14 aa, Mycobacterium tuberculosis
QGWQTQWNQALEDL

SEQ ID NO: 99258 - protein, 14 aa, Mycobacterium tuberculosis
GWQTQWNQALEDLV

SEQ ID NO: 99259 - protein, 14 aa, Mycobacterium tuberculosis
WQTQWNQALEDLVR

SEQ ID NO: 99260 - protein, 14 aa, Mycobacterium tuberculosis
QTQWNQALEDLVRA

SEQ ID NO: 99261 - protein, 14 aa, Mycobacterium tuberculosis
TQWNQALEDLVRAY

SEQ ID NO: 99262 - protein, 14 aa, Mycobacterium tuberculosis
QWNQALEDLVRAYQ

SEQ ID NO: 99263 - protein, 14 aa, Mycobacterium tuberculosis
WNQALEDLVRAYQS

SEQ ID NO: 99264 - protein, 14 aa, Mycobacterium tuberculosis
NQALEDLVRAYQSM

SEQ ID NO: 99265 - protein, 14 aa, Mycobacterium tuberculosis
QALEDLVRAYQSMS

SEQ ID NO: 99266 - protein, 14 aa, Mycobacterium tuberculosis
ALEDLVRAYQSMSG

SEQ ID NO: 99267 - protein, 14 aa, Mycobacterium tuberculosis
LEDLVRAYQSMSGT

SEQ ID NO: 99268 - protein, 14 aa, Mycobacterium tuberculosis
EDLVRAYQSMSGTH

SEQ ID NO: 99269 - protein, 14 aa, Mycobacterium tuberculosis
DLVRAYQSMSGTHE

SEQ ID NO: 99270 - protein, 14 aa, Mycobacterium tuberculosis
LVRAYQSMSGTHES

SEQ ID NO: 99271 - protein, 14 aa, Mycobacterium tuberculosis
VRAYQSMSGTHESN

SEQ ID NO: 99272 - protein, 14 aa, Mycobacterium tuberculosis
RAYQSMSGTHESNT

SEQ ID NO: 99273 - protein, 14 aa, Mycobacterium tuberculosis
AYQSMSGTHESNTM

SEQ ID NO: 99274 - protein, 14 aa, Mycobacterium tuberculosis
YQSMSGTHESNTMA

SEQ ID NO: 99275 - protein, 14 aa, Mycobacterium tuberculosis
QSMSGTHESNTMAM

SEQ ID NO: 99276 - protein, 14 aa, Mycobacterium tuberculosis
SMSGTHESNTMAML

SEQ ID NO: 99277 - protein, 14 aa, Mycobacterium tuberculosis
MSGTHESNTMAMLA

SEQ ID NO: 99278 - protein, 14 aa, Mycobacterium tuberculosis
SGTHESNTMAMLAR

SEQ ID NO: 99279 - protein, 14 aa, Mycobacterium tuberculosis
GTHESNTMAMLARD

SEQ ID NO: 99280 - protein, 14 aa, Mycobacterium tuberculosis
THESNTMAMLARDG

SEQ ID NO: 99281 - protein, 14 aa, Mycobacterium tuberculosis
HESNTMAMLARDGA

SEQ ID NO: 99282 - protein, 14 aa, Mycobacterium tuberculosis
ESNTMAMLARDGAE

SEQ ID NO: 99283 - protein, 14 aa, Mycobacterium tuberculosis
SNTMAMLARDGAEA

SEQ ID NO: 99284 - protein, 14 aa, Mycobacterium tuberculosis
NTMAMLARDGAEAA

SEQ ID NO: 99285 - protein, 14 aa, Mycobacterium tuberculosis
TMAMLARDGAEAAK

SEQ ID NO: 99286 - protein, 14 aa, Mycobacterium tuberculosis
MAMLARDGAEAAKW

SEQ ID NO: 99287 - protein, 14 aa, Mycobacterium tuberculosis
AMLARDGAEAAKWG

SEQ ID NO: 99288 - protein, 14 aa, Mycobacterium tuberculosis
MLARDGAEAAKWGG

SEQ ID NO: 99289 - protein, 15 aa, Mycobacterium tuberculosis
MSQIMYNYPAMMAHA

SEQ ID NO: 99290 - protein, 15 aa, Mycobacterium tuberculosis
SQIMYNYPAMMAHAG

SEQ ID NO: 99291 - protein, 15 aa, Mycobacterium tuberculosis
QIMYNYPAMMAHAGD

SEQ ID NO: 99292 - protein, 15 aa, Mycobacterium tuberculosis
IMYNYPAMMAHAGDM

SEQ ID NO: 99293 - protein, 15 aa, Mycobacterium tuberculosis
MYNYPAMMAHAGDMA

SEQ ID NO: 99294 - protein, 15 aa, Mycobacterium tuberculosis
YNYPAMMAHAGDMAG

SEQ ID NO: 99295 - protein, 15 aa, Mycobacterium tuberculosis
NYPAMMAHAGDMAGY

SEQ ID NO: 99296 - protein, 15 aa, Mycobacterium tuberculosis
YPAMMAHAGDMAGYA

SEQ ID NO: 99297 - protein, 15 aa, Mycobacterium tuberculosis
PAMMAHAGDMAGYAG

SEQ ID NO: 99298 - protein, 15 aa, Mycobacterium tuberculosis
AMMAHAGDMAGYAGT

SEQ ID NO: 99299 - protein, 15 aa, Mycobacterium tuberculosis
MMAHAGDMAGYAGTL

SEQ ID NO: 99300 - protein, 15 aa, Mycobacterium tuberculosis
MAHAGDMAGYAGTLQ

SEQ ID NO: 99301 - protein, 15 aa, Mycobacterium tuberculosis
AHAGDMAGYAGTLQS

SEQ ID NO: 99302 - protein, 15 aa, Mycobacterium tuberculosis
HAGDMAGYAGTLQSL

SEQ ID NO: 99303 - protein, 15 aa, Mycobacterium tuberculosis
AGDMAGYAGTLQSLG

SEQ ID NO: 99304 - protein, 15 aa, Mycobacterium tuberculosis
GDMAGYAGTLQSLGA

SEQ ID NO: 99305 - protein, 15 aa, Mycobacterium tuberculosis
DMAGYAGTLQSLGAD

SEQ ID NO: 99306 - protein, 15 aa, Mycobacterium tuberculosis
MAGYAGTLQSLGADI

SEQ ID NO: 99307 - protein, 15 aa, Mycobacterium tuberculosis
AGYAGTLQSLGADIA

SEQ ID NO: 99308 - protein, 15 aa, Mycobacterium tuberculosis
GYAGTLQSLGADIAS

SEQ ID NO: 99309 - protein, 15 aa, Mycobacterium tuberculosis
YAGTLQSLGADIASE

SEQ ID NO: 99310 - protein, 15 aa, Mycobacterium tuberculosis
AGTLQSLGADIASEQ

SEQ ID NO: 99311 - protein, 15 aa, Mycobacterium tuberculosis
GTLQSLGADIASEQA

SEQ ID NO: 99312 - protein, 15 aa, Mycobacterium tuberculosis
TLQSLGADIASEQAV

SEQ ID NO: 99313 - protein, 15 aa, Mycobacterium tuberculosis
LQSLGADIASEQAVL

SEQ ID NO: 99314 - protein, 15 aa, Mycobacterium tuberculosis
QSLGADIASEQAVLS

SEQ ID NO: 99315 - protein, 15 aa, Mycobacterium tuberculosis
SLGADIASEQAVLSS

SEQ ID NO: 99316 - protein, 15 aa, Mycobacterium tuberculosis
LGADIASEQAVLSSA

SEQ ID NO: 99317 - protein, 15 aa, Mycobacterium tuberculosis
GADIASEQAVLSSAW

SEQ ID NO: 99318 - protein, 15 aa, Mycobacterium tuberculosis
ADIASEQAVLSSAWQ

SEQ ID NO: 99319 - protein, 15 aa, Mycobacterium tuberculosis
DIASEQAVLSSAWQG

SEQ ID NO: 99320 - protein, 15 aa, Mycobacterium tuberculosis
IASEQAVLSSAWQGD

SEQ ID NO: 99321 - protein, 15 aa, Mycobacterium tuberculosis
ASEQAVLSSAWQGDT

SEQ ID NO: 99322 - protein, 15 aa, Mycobacterium tuberculosis
SEQAVLSSAWQGDTG

SEQ ID NO: 99323 - protein, 15 aa, Mycobacterium tuberculosis
EQAVLSSAWQGDTGI

SEQ ID NO: 99324 - protein, 15 aa, Mycobacterium tuberculosis
QAVLSSAWQGDTGIT

SEQ ID NO: 99325 - protein, 15 aa, Mycobacterium tuberculosis
AVLSSAWQGDTGITY

SEQ ID NO: 99326 - protein, 15 aa, Mycobacterium tuberculosis
VLSSAWQGDTGITYQ

SEQ ID NO: 99327 - protein, 15 aa, Mycobacterium tuberculosis
LSSAWQGDTGITYQG

SEQ ID NO: 99328 - protein, 15 aa, Mycobacterium tuberculosis
SSAWQGDTGITYQGW

SEQ ID NO: 99329 - protein, 15 aa, Mycobacterium tuberculosis
SAWQGDTGITYQGWQ

SEQ ID NO: 99330 - protein, 15 aa, Mycobacterium tuberculosis
AWQGDTGITYQGWQT

SEQ ID NO: 99331 - protein, 15 aa, Mycobacterium tuberculosis
WQGDTGITYQGWQTQ

SEQ ID NO: 99332 - protein, 15 aa, Mycobacterium tuberculosis
QGDTGITYQGWQTQW

SEQ ID NO: 99333 - protein, 15 aa, Mycobacterium tuberculosis
GDTGITYQGWQTQWN

SEQ ID NO: 99334 - protein, 15 aa, Mycobacterium tuberculosis
DTGITYQGWQTQWNQ

SEQ ID NO: 99335 - protein, 15 aa, Mycobacterium tuberculosis
TGITYQGWQTQWNQA

SEQ ID NO: 99336 - protein, 15 aa, Mycobacterium tuberculosis
GITYQGWQTQWNQAL

SEQ ID NO: 99337 - protein, 15 aa, Mycobacterium tuberculosis
ITYQGWQTQWNQALE

SEQ ID NO: 99338 - protein, 15 aa, Mycobacterium tuberculosis
TYQGWQTQWNQALED

SEQ ID NO: 99339 - protein, 15 aa, Mycobacterium tuberculosis
YQGWQTQWNQALEDL

SEQ ID NO: 99340 - protein, 15 aa, Mycobacterium tuberculosis
QGWQTQWNQALEDLV

SEQ ID NO: 99341 - protein, 15 aa, Mycobacterium tuberculosis
GWQTQWNQALEDLVR

SEQ ID NO: 99342 - protein, 15 aa, Mycobacterium tuberculosis
WQTQWNQALEDLVRA

SEQ ID NO: 99343 - protein, 15 aa, Mycobacterium tuberculosis
QTQWNQALEDLVRAY

SEQ ID NO: 99344 - protein, 15 aa, Mycobacterium tuberculosis
TQWNQALEDLVRAYQ

SEQ ID NO: 99345 - protein, 15 aa, Mycobacterium tuberculosis
QWNQALEDLVRAYQS

SEQ ID NO: 99346 - protein, 15 aa, Mycobacterium tuberculosis
WNQALEDLVRAYQSM

SEQ ID NO: 99347 - protein, 15 aa, Mycobacterium tuberculosis
NQALEDLVRAYQSMS

SEQ ID NO: 99348 - protein, 15 aa, Mycobacterium tuberculosis
QALEDLVRAYQSMSG

SEQ ID NO: 99349 - protein, 15 aa, Mycobacterium tuberculosis
ALEDLVRAYQSMSGT

SEQ ID NO: 99350 - protein, 15 aa, Mycobacterium tuberculosis
LEDLVRAYQSMSGTH

SEQ ID NO: 99351 - protein, 15 aa, Mycobacterium tuberculosis
EDLVRAYQSMSGTHE

SEQ ID NO: 99352 - protein, 15 aa, Mycobacterium tuberculosis
DLVRAYQSMSGTHES

SEQ ID NO: 99353 - protein, 15 aa, Mycobacterium tuberculosis
LVRAYQSMSGTHESN

SEQ ID NO: 99354 - protein, 15 aa, Mycobacterium tuberculosis
VRAYQSMSGTHESNT

SEQ ID NO: 99355 - protein, 15 aa, Mycobacterium tuberculosis
RAYQSMSGTHESNTM

SEQ ID NO: 99356 - protein, 15 aa, Mycobacterium tuberculosis
AYQSMSGTHESNTMA

SEQ ID NO: 99357 - protein, 15 aa, Mycobacterium tuberculosis
YQSMSGTHESNTMAM

SEQ ID NO: 99358 - protein, 15 aa, Mycobacterium tuberculosis
QSMSGTHESNTMAML

SEQ ID NO: 99359 - protein, 15 aa, Mycobacterium tuberculosis
SMSGTHESNTMAMLA

SEQ ID NO: 99360 - protein, 15 aa, Mycobacterium tuberculosis
MSGTHESNTMAMLAR

SEQ ID NO: 99361 - protein, 15 aa, Mycobacterium tuberculosis
SGTHESNTMAMLARD

SEQ ID NO: 99362 - protein, 15 aa, Mycobacterium tuberculosis
GTHESNTMAMLARDG

SEQ ID NO: 99363 - protein, 15 aa, Mycobacterium tuberculosis
THESNTMAMLARDGA

SEQ ID NO: 99364 - protein, 15 aa, Mycobacterium tuberculosis
HESNTMAMLARDGAE

SEQ ID NO: 99365 - protein, 15 aa, Mycobacterium tuberculosis
ESNTMAMLARDGAEA

SEQ ID NO: 99366 - protein, 15 aa, Mycobacterium tuberculosis
SNTMAMLARDGAEAA

SEQ ID NO: 99367 - protein, 15 aa, Mycobacterium tuberculosis
NTMAMLARDGAEAAK

SEQ ID NO: 99368 - protein, 15 aa, Mycobacterium tuberculosis
TMAMLARDGAEAAKW

SEQ ID NO: 99369 - protein, 15 aa, Mycobacterium tuberculosis
MAMLARDGAEAAKWG

SEQ ID NO: 99370 - protein, 15 aa, Mycobacterium tuberculosis
AMLARDGAEAAKWGG

SEQ ID NO: 99371 - protein, 16 aa, Mycobacterium tuberculosis
MSQIMYNYPAMMAHAG

SEQ ID NO: 99372 - protein, 16 aa, Mycobacterium tuberculosis
SQIMYNYPAMMAHAGD

SEQ ID NO: 99373 - protein, 16 aa, Mycobacterium tuberculosis
QIMYNYPAMMAHAGDM

SEQ ID NO: 99374 - protein, 16 aa, Mycobacterium tuberculosis
IMYNYPAMMAHAGDMA

SEQ ID NO: 99375 - protein, 16 aa, Mycobacterium tuberculosis
MYNYPAMMAHAGDMAG

SEQ ID NO: 99376 - protein, 16 aa, Mycobacterium tuberculosis
YNYPAMMAHAGDMAGY

SEQ ID NO: 99377 - protein, 16 aa, Mycobacterium tuberculosis
NYPAMMAHAGDMAGYA

SEQ ID NO: 99378 - protein, 16 aa, Mycobacterium tuberculosis
YPAMMAHAGDMAGYAG

SEQ ID NO: 99379 - protein, 16 aa, Mycobacterium tuberculosis
PAMMAHAGDMAGYAGT

SEQ ID NO: 99380 - protein, 16 aa, Mycobacterium tuberculosis
AMMAHAGDMAGYAGTL

SEQ ID NO: 99381 - protein, 16 aa, Mycobacterium tuberculosis
MMAHAGDMAGYAGTLQ

SEQ ID NO: 99382 - protein, 16 aa, Mycobacterium tuberculosis
MAHAGDMAGYAGTLQS

SEQ ID NO: 99383 - protein, 16 aa, Mycobacterium tuberculosis
AHAGDMAGYAGTLQSL

SEQ ID NO: 99384 - protein, 16 aa, Mycobacterium tuberculosis
HAGDMAGYAGTLQSLG

SEQ ID NO: 99385 - protein, 16 aa, Mycobacterium tuberculosis
AGDMAGYAGTLQSLGA

SEQ ID NO: 99386 - protein, 16 aa, Mycobacterium tuberculosis
GDMAGYAGTLQSLGAD

SEQ ID NO: 99387 - protein, 16 aa, Mycobacterium tuberculosis
DMAGYAGTLQSLGADI

SEQ ID NO: 99388 - protein, 16 aa, Mycobacterium tuberculosis
MAGYAGTLQSLGADIA

SEQ ID NO: 99389 - protein, 16 aa, Mycobacterium tuberculosis
AGYAGTLQSLGADIAS

SEQ ID NO: 99390 - protein, 16 aa, Mycobacterium tuberculosis
GYAGTLQSLGADIASE

SEQ ID NO: 99391 - protein, 16 aa, Mycobacterium tuberculosis
YAGTLQSLGADIASEQ

SEQ ID NO: 99392 - protein, 16 aa, Mycobacterium tuberculosis
AGTLQSLGADIASEQA

SEQ ID NO: 99393 - protein, 16 aa, Mycobacterium tuberculosis
GTLQSLGADIASEQAV

SEQ ID NO: 99394 - protein, 16 aa, Mycobacterium tuberculosis
TLQSLGADIASEQAVL

SEQ ID NO: 99395 - protein, 16 aa, Mycobacterium tuberculosis
LQSLGADIASEQAVLS

SEQ ID NO: 99396 - protein, 16 aa, Mycobacterium tuberculosis
QSLGADIASEQAVLSS

SEQ ID NO: 99397 - protein, 16 aa, Mycobacterium tuberculosis
SLGADIASEQAVLSSA

SEQ ID NO: 99398 - protein, 16 aa, Mycobacterium tuberculosis
LGADIASEQAVLSSAW

SEQ ID NO: 99399 - protein, 16 aa, Mycobacterium tuberculosis
GADIASEQAVLSSAWQ

SEQ ID NO: 99400 - protein, 16 aa, Mycobacterium tuberculosis
ADIASEQAVLSSAWQG

SEQ ID NO: 99401 - protein, 16 aa, Mycobacterium tuberculosis
DIASEQAVLSSAWQGD

SEQ ID NO: 99402 - protein, 16 aa, Mycobacterium tuberculosis
IASEQAVLSSAWQGDT

SEQ ID NO: 99403 - protein, 16 aa, Mycobacterium tuberculosis
ASEQAVLSSAWQGDTG

SEQ ID NO: 99404 - protein, 16 aa, Mycobacterium tuberculosis
SEQAVLSSAWQGDTGI

SEQ ID NO: 99405 - protein, 16 aa, Mycobacterium tuberculosis
EQAVLSSAWQGDTGIT

SEQ ID NO: 99406 - protein, 16 aa, Mycobacterium tuberculosis
QAVLSSAWQGDTGITY

SEQ ID NO: 99407 - protein, 16 aa, Mycobacterium tuberculosis
AVLSSAWQGDTGITYQ

SEQ ID NO: 99408 - protein, 16 aa, Mycobacterium tuberculosis
VLSSAWQGDTGITYQG

SEQ ID NO: 99409 - protein, 16 aa, Mycobacterium tuberculosis
LSSAWQGDTGITYQGW

SEQ ID NO: 99410 - protein, 16 aa, Mycobacterium tuberculosis
SSAWQGDTGITYQGWQ

SEQ ID NO: 99411 - protein, 16 aa, Mycobacterium tuberculosis
SAWQGDTGITYQGWQT

SEQ ID NO: 99412 - protein, 16 aa, Mycobacterium tuberculosis
AWQGDTGITYQGWQTQ

SEQ ID NO: 99413 - protein, 16 aa, Mycobacterium tuberculosis
WQGDTGITYQGWQTQW

SEQ ID NO: 99414 - protein, 16 aa, Mycobacterium tuberculosis
QGDTGITYQGWQTQWN

SEQ ID NO: 99415 - protein, 16 aa, Mycobacterium tuberculosis
GDTGITYQGWQTQWNQ

SEQ ID NO: 99416 - protein, 16 aa, Mycobacterium tuberculosis
DTGITYQGWQTQWNQA

SEQ ID NO: 99417 - protein, 16 aa, Mycobacterium tuberculosis
TGITYQGWQTQWNQAL

SEQ ID NO: 99418 - protein, 16 aa, Mycobacterium tuberculosis
GITYQGWQTQWNQALE

SEQ ID NO: 99419 - protein, 16 aa, Mycobacterium tuberculosis
ITYQGWQTQWNQALED

SEQ ID NO: 99420 - protein, 16 aa, Mycobacterium tuberculosis
TYQGWQTQWNQALEDL

SEQ ID NO: 99421 - protein, 16 aa, Mycobacterium tuberculosis
YQGWQTQWNQALEDLV

SEQ ID NO: 99422 - protein, 16 aa, Mycobacterium tuberculosis
QGWQTQWNQALEDLVR

SEQ ID NO: 99423 - protein, 16 aa, Mycobacterium tuberculosis
GWQTQWNQALEDLVRA

SEQ ID NO: 99424 - protein, 16 aa, Mycobacterium tuberculosis
WQTQWNQALEDLVRAY

SEQ ID NO: 99425 - protein, 16 aa, Mycobacterium tuberculosis
QTQWNQALEDLVRAYQ

SEQ ID NO: 99426 - protein, 16 aa, Mycobacterium tuberculosis
TQWNQALEDLVRAYQS

SEQ ID NO: 99427 - protein, 16 aa, Mycobacterium tuberculosis
QWNQALEDLVRAYQSM

SEQ ID NO: 99428 - protein, 16 aa, Mycobacterium tuberculosis
WNQALEDLVRAYQSMS

SEQ ID NO: 99429 - protein, 16 aa, Mycobacterium tuberculosis
NQALEDLVRAYQSMSG

SEQ ID NO: 99430 - protein, 16 aa, Mycobacterium tuberculosis
QALEDLVRAYQSMSGT

SEQ ID NO: 99431 - protein, 16 aa, Mycobacterium tuberculosis
ALEDLVRAYQSMSGTH

SEQ ID NO: 99432 - protein, 16 aa, Mycobacterium tuberculosis
LEDLVRAYQSMSGTHE

SEQ ID NO: 99433 - protein, 16 aa, Mycobacterium tuberculosis
EDLVRAYQSMSGTHES

SEQ ID NO: 99434 - protein, 16 aa, Mycobacterium tuberculosis
DLVRAYQSMSGTHESN

SEQ ID NO: 99435 - protein, 16 aa, Mycobacterium tuberculosis
LVRAYQSMSGTHESNT

SEQ ID NO: 99436 - protein, 16 aa, Mycobacterium tuberculosis
VRAYQSMSGTHESNTM

SEQ ID NO: 99437 - protein, 16 aa, Mycobacterium tuberculosis
RAYQSMSGTHESNTMA

SEQ ID NO: 99438 - protein, 16 aa, Mycobacterium tuberculosis
AYQSMSGTHESNTMAM

SEQ ID NO: 99439 - protein, 16 aa, Mycobacterium tuberculosis
YQSMSGTHESNTMAML

SEQ ID NO: 99440 - protein, 16 aa, Mycobacterium tuberculosis
QSMSGTHESNTMAMLA

SEQ ID NO: 99441 - protein, 16 aa, Mycobacterium tuberculosis
SMSGTHESNTMAMLAR

SEQ ID NO: 99442 - protein, 16 aa, Mycobacterium tuberculosis
MSGTHESNTMAMLARD

SEQ ID NO: 99443 - protein, 16 aa, Mycobacterium tuberculosis
SGTHESNTMAMLARDG

SEQ ID NO: 99444 - protein, 16 aa, Mycobacterium tuberculosis
GTHESNTMAMLARDGA

SEQ ID NO: 99445 - protein, 16 aa, Mycobacterium tuberculosis
THESNTMAMLARDGAE

SEQ ID NO: 99446 - protein, 16 aa, Mycobacterium tuberculosis
HESNTMAMLARDGAEA

SEQ ID NO: 99447 - protein, 16 aa, Mycobacterium tuberculosis
ESNTMAMLARDGAEAA

SEQ ID NO: 99448 - protein, 16 aa, Mycobacterium tuberculosis
SNTMAMLARDGAEAAK

SEQ ID NO: 99449 - protein, 16 aa, Mycobacterium tuberculosis
NTMAMLARDGAEAAKW

SEQ ID NO: 99450 - protein, 16 aa, Mycobacterium tuberculosis
TMAMLARDGAEAAKWG

SEQ ID NO: 99451 - protein, 16 aa, Mycobacterium tuberculosis
MAMLARDGAEAAKWGG

SEQ ID NO: 99452 - protein, 13 aa, Mycobacterium tuberculosis
MSLLDAHIPQLIA

SEQ ID NO: 99453 - protein, 13 aa, Mycobacterium tuberculosis
SLLDAHIPQLIAS

SEQ ID NO: 99454 - protein, 13 aa, Mycobacterium tuberculosis
LLDAHIPQLIASH

SEQ ID NO: 99455 - protein, 13 aa, Mycobacterium tuberculosis
LDAHIPQLIASHT

SEQ ID NO: 99456 - protein, 13 aa, Mycobacterium tuberculosis
DAHIPQLIASHTA

SEQ ID NO: 99457 - protein, 13 aa, Mycobacterium tuberculosis
AHIPQLIASHTAF

SEQ ID NO: 99458 - protein, 13 aa, Mycobacterium tuberculosis
HIPQLIASHTAFA

SEQ ID NO: 99459 - protein, 13 aa, Mycobacterium tuberculosis
IPQLIASHTAFAA

SEQ ID NO: 99460 - protein, 13 aa, Mycobacterium tuberculosis
PQLIASHTAFAAK

SEQ ID NO: 99461 - protein, 13 aa, Mycobacterium tuberculosis
QLIASHTAFAAKA

SEQ ID NO: 99462 - protein, 13 aa, Mycobacterium tuberculosis
LIASHTAFAAKAG

SEQ ID NO: 99463 - protein, 13 aa, Mycobacterium tuberculosis
IASHTAFAAKAGL

SEQ ID NO: 99464 - protein, 13 aa, Mycobacterium tuberculosis
ASHTAFAAKAGLM

SEQ ID NO: 99465 - protein, 13 aa, Mycobacterium tuberculosis
SHTAFAAKAGLMR

SEQ ID NO: 99466 - protein, 13 aa, Mycobacterium tuberculosis
HTAFAAKAGLMRH

SEQ ID NO: 99467 - protein, 13 aa, Mycobacterium tuberculosis
TAFAAKAGLMRHT

SEQ ID NO: 99468 - protein, 13 aa, Mycobacterium tuberculosis
AFAAKAGLMRHTI

SEQ ID NO: 99469 - protein, 13 aa, Mycobacterium tuberculosis
FAAKAGLMRHTIG

SEQ ID NO: 99470 - protein, 13 aa, Mycobacterium tuberculosis
AAKAGLMRHTIGQ

SEQ ID NO: 99471 - protein, 13 aa, Mycobacterium tuberculosis
AKAGLMRHTIGQA

SEQ ID NO: 99472 - protein, 13 aa, Mycobacterium tuberculosis
KAGLMRHTIGQAE

SEQ ID NO: 99473 - protein, 13 aa, Mycobacterium tuberculosis
AGLMRHTIGQAEQ

SEQ ID NO: 99474 - protein, 13 aa, Mycobacterium tuberculosis
GLMRHTIGQAEQQ

SEQ ID NO: 99475 - protein, 13 aa, Mycobacterium tuberculosis
LMRHTIGQAEQQA

SEQ ID NO: 99476 - protein, 13 aa, Mycobacterium tuberculosis
MRHTIGQAEQQAM

SEQ ID NO: 99477 - protein, 13 aa, Mycobacterium tuberculosis
RHTIGQAEQQAMS

SEQ ID NO: 99478 - protein, 13 aa, Mycobacterium tuberculosis
HTIGQAEQQAMSA

SEQ ID NO: 99479 - protein, 13 aa, Mycobacterium tuberculosis
TIGQAEQQAMSAQ

SEQ ID NO: 99480 - protein, 13 aa, Mycobacterium tuberculosis
IGQAEQQAMSAQA

SEQ ID NO: 99481 - protein, 13 aa, Mycobacterium tuberculosis
GQAEQQAMSAQAF

SEQ ID NO: 99482 - protein, 13 aa, Mycobacterium tuberculosis
QAEQQAMSAQAFH

SEQ ID NO: 99483 - protein, 13 aa, Mycobacterium tuberculosis
AEQQAMSAQAFHQ

SEQ ID NO: 99484 - protein, 13 aa, Mycobacterium tuberculosis
EQQAMSAQAFHQG

SEQ ID NO: 99485 - protein, 13 aa, Mycobacterium tuberculosis
QQAMSAQAFHQGE

SEQ ID NO: 99486 - protein, 13 aa, Mycobacterium tuberculosis
QAMSAQAFHQGES

SEQ ID NO: 99487 - protein, 13 aa, Mycobacterium tuberculosis
AMSAQAFHQGESA

SEQ ID NO: 99488 - protein, 13 aa, Mycobacterium tuberculosis
MSAQAFHQGESAA

SEQ ID NO: 99489 - protein, 13 aa, Mycobacterium tuberculosis
SAQAFHQGESAAA

SEQ ID NO: 99490 - protein, 13 aa, Mycobacterium tuberculosis
AQAFHQGESAAAF

SEQ ID NO: 99491 - protein, 13 aa, Mycobacterium tuberculosis
QAFHQGESAAAFQ

SEQ ID NO: 99492 - protein, 13 aa, Mycobacterium tuberculosis
AFHQGESAAAFQG

SEQ ID NO: 99493 - protein, 13 aa, Mycobacterium tuberculosis
FHQGESAAAFQGA

SEQ ID NO: 99494 - protein, 13 aa, Mycobacterium tuberculosis
HQGESAAAFQGAH

SEQ ID NO: 99495 - protein, 13 aa, Mycobacterium tuberculosis
QGESAAAFQGAHA

SEQ ID NO: 99496 - protein, 13 aa, Mycobacterium tuberculosis
GESAAAFQGAHAR

SEQ ID NO: 99497 - protein, 13 aa, Mycobacterium tuberculosis
ESAAAFQGAHARF

SEQ ID NO: 99498 - protein, 13 aa, Mycobacterium tuberculosis
SAAAFQGAHARFV

SEQ ID NO: 99499 - protein, 13 aa, Mycobacterium tuberculosis
AAAFQGAHARFVA

SEQ ID NO: 99500 - protein, 13 aa, Mycobacterium tuberculosis
AAFQGAHARFVAA

SEQ ID NO: 99501 - protein, 13 aa, Mycobacterium tuberculosis
AFQGAHARFVAAA

SEQ ID NO: 99502 - protein, 13 aa, Mycobacterium tuberculosis
FQGAHARFVAAAA

SEQ ID NO: 99503 - protein, 13 aa, Mycobacterium tuberculosis
QGAHARFVAAAAK

SEQ ID NO: 99504 - protein, 13 aa, Mycobacterium tuberculosis
GAHARFVAAAAKV

SEQ ID NO: 99505 - protein, 13 aa, Mycobacterium tuberculosis
AHARFVAAAAKVN

SEQ ID NO: 99506 - protein, 13 aa, Mycobacterium tuberculosis
HARFVAAAAKVNT

SEQ ID NO: 99507 - protein, 13 aa, Mycobacterium tuberculosis
ARFVAAAAKVNTL

SEQ ID NO: 99508 - protein, 13 aa, Mycobacterium tuberculosis
RFVAAAAKVNTLL

SEQ ID NO: 99509 - protein, 13 aa, Mycobacterium tuberculosis
FVAAAAKVNTLLD

SEQ ID NO: 99510 - protein, 13 aa, Mycobacterium tuberculosis
VAAAAKVNTLLDI

SEQ ID NO: 99511 - protein, 13 aa, Mycobacterium tuberculosis
AAAAKVNTLLDIA

SEQ ID NO: 99512 - protein, 13 aa, Mycobacterium tuberculosis
AAAKVNTLLDIAQ

SEQ ID NO: 99513 - protein, 13 aa, Mycobacterium tuberculosis
AAKVNTLLDIAQA

SEQ ID NO: 99514 - protein, 13 aa, Mycobacterium tuberculosis
AKVNTLLDIAQAN

SEQ ID NO: 99515 - protein, 13 aa, Mycobacterium tuberculosis
KVNTLLDIAQANL

SEQ ID NO: 99516 - protein, 13 aa, Mycobacterium tuberculosis
VNTLLDIAQANLG

SEQ ID NO: 99517 - protein, 13 aa, Mycobacterium tuberculosis
NTLLDIAQANLGE

SEQ ID NO: 99518 - protein, 13 aa, Mycobacterium tuberculosis
TLLDIAQANLGEA

SEQ ID NO: 99519 - protein, 13 aa, Mycobacterium tuberculosis
LLDIAQANLGEAA

SEQ ID NO: 99520 - protein, 13 aa, Mycobacterium tuberculosis
LDIAQANLGEAAG

SEQ ID NO: 99521 - protein, 13 aa, Mycobacterium tuberculosis
DIAQANLGEAAGT

SEQ ID NO: 99522 - protein, 13 aa, Mycobacterium tuberculosis
IAQANLGEAAGTY

SEQ ID NO: 99523 - protein, 13 aa, Mycobacterium tuberculosis
AQANLGEAAGTYV

SEQ ID NO: 99524 - protein, 13 aa, Mycobacterium tuberculosis
QANLGEAAGTYVA

SEQ ID NO: 99525 - protein, 13 aa, Mycobacterium tuberculosis
ANLGEAAGTYVAA

SEQ ID NO: 99526 - protein, 13 aa, Mycobacterium tuberculosis
NLGEAAGTYVAAD

SEQ ID NO: 99527 - protein, 13 aa, Mycobacterium tuberculosis
LGEAAGTYVAADA

SEQ ID NO: 99528 - protein, 13 aa, Mycobacterium tuberculosis
GEAAGTYVAADAA

SEQ ID NO: 99529 - protein, 13 aa, Mycobacterium tuberculosis
EAAGTYVAADAAA

SEQ ID NO: 99530 - protein, 13 aa, Mycobacterium tuberculosis
AAGTYVAADAAAA

SEQ ID NO: 99531 - protein, 13 aa, Mycobacterium tuberculosis
AGTYVAADAAAAS

SEQ ID NO: 99532 - protein, 13 aa, Mycobacterium tuberculosis
GTYVAADAAAASS

SEQ ID NO: 99533 - protein, 13 aa, Mycobacterium tuberculosis
TYVAADAAAASSY

SEQ ID NO: 99534 - protein, 13 aa, Mycobacterium tuberculosis
YVAADAAAASSYT

SEQ ID NO: 99535 - protein, 13 aa, Mycobacterium tuberculosis
VAADAAAASSYTG

SEQ ID NO: 99536 - protein, 13 aa, Mycobacterium tuberculosis
AADAAAASSYTGF

SEQ ID NO: 99537 - protein, 14 aa, Mycobacterium tuberculosis
MSLLDAHIPQLIAS

SEQ ID NO: 99538 - protein, 14 aa, Mycobacterium tuberculosis
SLLDAHIPQLIASH

SEQ ID NO: 99539 - protein, 14 aa, Mycobacterium tuberculosis
LLDAHIPQLIASHT

SEQ ID NO: 99540 - protein, 14 aa, Mycobacterium tuberculosis
LDAHIPQLIASHTA

SEQ ID NO: 99541 - protein, 14 aa, Mycobacterium tuberculosis
DAHIPQLIASHTAF

SEQ ID NO: 99542 - protein, 14 aa, Mycobacterium tuberculosis
AHIPQLIASHTAFA

SEQ ID NO: 99543 - protein, 14 aa, Mycobacterium tuberculosis
HIPQLIASHTAFAA

SEQ ID NO: 99544 - protein, 14 aa, Mycobacterium tuberculosis
IPQLIASHTAFAAK

SEQ ID NO: 99545 - protein, 14 aa, Mycobacterium tuberculosis
PQLIASHTAFAAKA

SEQ ID NO: 99546 - protein, 14 aa, Mycobacterium tuberculosis
QLIASHTAFAAKAG

SEQ ID NO: 99547 - protein, 14 aa, Mycobacterium tuberculosis
LIASHTAFAAKAGL

SEQ ID NO: 99548 - protein, 14 aa, Mycobacterium tuberculosis
IASHTAFAAKAGLM

SEQ ID NO: 99549 - protein, 14 aa, Mycobacterium tuberculosis
ASHTAFAAKAGLMR

SEQ ID NO: 99550 - protein, 14 aa, Mycobacterium tuberculosis
SHTAFAAKAGLMRH

SEQ ID NO: 99551 - protein, 14 aa, Mycobacterium tuberculosis
HTAFAAKAGLMRHT

SEQ ID NO: 99552 - protein, 14 aa, Mycobacterium tuberculosis
TAFAAKAGLMRHTI

SEQ ID NO: 99553 - protein, 14 aa, Mycobacterium tuberculosis
AFAAKAGLMRHTIG

SEQ ID NO: 99554 - protein, 14 aa, Mycobacterium tuberculosis
FAAKAGLMRHTIGQ

SEQ ID NO: 99555 - protein, 14 aa, Mycobacterium tuberculosis
AAKAGLMRHTIGQA

SEQ ID NO: 99556 - protein, 14 aa, Mycobacterium tuberculosis
AKAGLMRHTIGQAE

SEQ ID NO: 99557 - protein, 14 aa, Mycobacterium tuberculosis
KAGLMRHTIGQAEQ

SEQ ID NO: 99558 - protein, 14 aa, Mycobacterium tuberculosis
AGLMRHTIGQAEQQ

SEQ ID NO: 99559 - protein, 14 aa, Mycobacterium tuberculosis
GLMRHTIGQAEQQA

SEQ ID NO: 99560 - protein, 14 aa, Mycobacterium tuberculosis
LMRHTIGQAEQQAM

SEQ ID NO: 99561 - protein, 14 aa, Mycobacterium tuberculosis
MRHTIGQAEQQAMS

SEQ ID NO: 99562 - protein, 14 aa, Mycobacterium tuberculosis
RHTIGQAEQQAMSA

SEQ ID NO: 99563 - protein, 14 aa, Mycobacterium tuberculosis
HTIGQAEQQAMSAQ

SEQ ID NO: 99564 - protein, 14 aa, Mycobacterium tuberculosis
TIGQAEQQAMSAQA

SEQ ID NO: 99565 - protein, 14 aa, Mycobacterium tuberculosis
IGQAEQQAMSAQAF

SEQ ID NO: 99566 - protein, 14 aa, Mycobacterium tuberculosis
GQAEQQAMSAQAFH

SEQ ID NO: 99567 - protein, 14 aa, Mycobacterium tuberculosis
QAEQQAMSAQAFHQ

SEQ ID NO: 99568 - protein, 14 aa, Mycobacterium tuberculosis
AEQQAMSAQAFHQG

SEQ ID NO: 99569 - protein, 14 aa, Mycobacterium tuberculosis
EQQAMSAQAFHQGE

SEQ ID NO: 99570 - protein, 14 aa, Mycobacterium tuberculosis
QQAMSAQAFHQGES

SEQ ID NO: 99571 - protein, 14 aa, Mycobacterium tuberculosis
QAMSAQAFHQGESA

SEQ ID NO: 99572 - protein, 14 aa, Mycobacterium tuberculosis
AMSAQAFHQGESAA

SEQ ID NO: 99573 - protein, 14 aa, Mycobacterium tuberculosis
MSAQAFHQGESAAA

SEQ ID NO: 99574 - protein, 14 aa, Mycobacterium tuberculosis
SAQAFHQGESAAAF

SEQ ID NO: 99575 - protein, 14 aa, Mycobacterium tuberculosis
AQAFHQGESAAAFQ

SEQ ID NO: 99576 - protein, 14 aa, Mycobacterium tuberculosis
QAFHQGESAAAFQG

SEQ ID NO: 99577 - protein, 14 aa, Mycobacterium tuberculosis
AFHQGESAAAFQGA

SEQ ID NO: 99578 - protein, 14 aa, Mycobacterium tuberculosis
FHQGESAAAFQGAH

SEQ ID NO: 99579 - protein, 14 aa, Mycobacterium tuberculosis
HQGESAAAFQGAHA

SEQ ID NO: 99580 - protein, 14 aa, Mycobacterium tuberculosis
QGESAAAFQGAHAR

SEQ ID NO: 99581 - protein, 14 aa, Mycobacterium tuberculosis
GESAAAFQGAHARF

SEQ ID NO: 99582 - protein, 14 aa, Mycobacterium tuberculosis
ESAAAFQGAHARFV

SEQ ID NO: 99583 - protein, 14 aa, Mycobacterium tuberculosis
SAAAFQGAHARFVA

SEQ ID NO: 99584 - protein, 14 aa, Mycobacterium tuberculosis
AAAFQGAHARFVAA

SEQ ID NO: 99585 - protein, 14 aa, Mycobacterium tuberculosis
AAFQGAHARFVAAA

SEQ ID NO: 99586 - protein, 14 aa, Mycobacterium tuberculosis
AFQGAHARFVAAAA

SEQ ID NO: 99587 - protein, 14 aa, Mycobacterium tuberculosis
FQGAHARFVAAAAK

SEQ ID NO: 99588 - protein, 14 aa, Mycobacterium tuberculosis
QGAHARFVAAAAKV

SEQ ID NO: 99589 - protein, 14 aa, Mycobacterium tuberculosis
GAHARFVAAAAKVN

SEQ ID NO: 99590 - protein, 14 aa, Mycobacterium tuberculosis
AHARFVAAAAKVNT

SEQ ID NO: 99591 - protein, 14 aa, Mycobacterium tuberculosis
HARFVAAAAKVNTL

SEQ ID NO: 99592 - protein, 14 aa, Mycobacterium tuberculosis
ARFVAAAAKVNTLL

SEQ ID NO: 99593 - protein, 14 aa, Mycobacterium tuberculosis
RFVAAAAKVNTLLD

SEQ ID NO: 99594 - protein, 14 aa, Mycobacterium tuberculosis
FVAAAAKVNTLLDI

SEQ ID NO: 99595 - protein, 14 aa, Mycobacterium tuberculosis
VAAAAKVNTLLDIA

SEQ ID NO: 99596 - protein, 14 aa, Mycobacterium tuberculosis
AAAAKVNTLLDIAQ

SEQ ID NO: 99597 - protein, 14 aa, Mycobacterium tuberculosis
AAAKVNTLLDIAQA

SEQ ID NO: 99598 - protein, 14 aa, Mycobacterium tuberculosis
AAKVNTLLDIAQAN

SEQ ID NO: 99599 - protein, 14 aa, Mycobacterium tuberculosis
AKVNTLLDIAQANL

SEQ ID NO: 99600 - protein, 14 aa, Mycobacterium tuberculosis
KVNTLLDIAQANLG

SEQ ID NO: 99601 - protein, 14 aa, Mycobacterium tuberculosis
VNTLLDIAQANLGE

SEQ ID NO: 99602 - protein, 14 aa, Mycobacterium tuberculosis
NTLLDIAQANLGEA

SEQ ID NO: 99603 - protein, 14 aa, Mycobacterium tuberculosis
TLLDIAQANLGEAA

SEQ ID NO: 99604 - protein, 14 aa, Mycobacterium tuberculosis
LLDIAQANLGEAAG

SEQ ID NO: 99605 - protein, 14 aa, Mycobacterium tuberculosis
LDIAQANLGEAAGT

SEQ ID NO: 99606 - protein, 14 aa, Mycobacterium tuberculosis
DIAQANLGEAAGTY

SEQ ID NO: 99607 - protein, 14 aa, Mycobacterium tuberculosis
IAQANLGEAAGTYV

SEQ ID NO: 99608 - protein, 14 aa, Mycobacterium tuberculosis
AQANLGEAAGTYVA

SEQ ID NO: 99609 - protein, 14 aa, Mycobacterium tuberculosis
QANLGEAAGTYVAA

SEQ ID NO: 99610 - protein, 14 aa, Mycobacterium tuberculosis
ANLGEAAGTYVAAD

SEQ ID NO: 99611 - protein, 14 aa, Mycobacterium tuberculosis
NLGEAAGTYVAADA

SEQ ID NO: 99612 - protein, 14 aa, Mycobacterium tuberculosis
LGEAAGTYVAADAA

SEQ ID NO: 99613 - protein, 14 aa, Mycobacterium tuberculosis
GEAAGTYVAADAAA

SEQ ID NO: 99614 - protein, 14 aa, Mycobacterium tuberculosis
EAAGTYVAADAAAA

SEQ ID NO: 99615 - protein, 14 aa, Mycobacterium tuberculosis
AAGTYVAADAAAAS

SEQ ID NO: 99616 - protein, 14 aa, Mycobacterium tuberculosis
AGTYVAADAAAASS

SEQ ID NO: 99617 - protein, 14 aa, Mycobacterium tuberculosis
GTYVAADAAAASSY

SEQ ID NO: 99618 - protein, 14 aa, Mycobacterium tuberculosis
TYVAADAAAASSYT

SEQ ID NO: 99619 - protein, 14 aa, Mycobacterium tuberculosis
YVAADAAAASSYTG

SEQ ID NO: 99620 - protein, 14 aa, Mycobacterium tuberculosis
VAADAAAASSYTGF

SEQ ID NO: 99621 - protein, 15 aa, Mycobacterium tuberculosis
MSLLDAHIPQLIASH

SEQ ID NO: 99622 - protein, 15 aa, Mycobacterium tuberculosis
SLLDAHIPQLIASHT

SEQ ID NO: 99623 - protein, 15 aa, Mycobacterium tuberculosis
LLDAHIPQLIASHTA

SEQ ID NO: 99624 - protein, 15 aa, Mycobacterium tuberculosis
LDAHIPQLIASHTAF

SEQ ID NO: 99625 - protein, 15 aa, Mycobacterium tuberculosis
DAHIPQLIASHTAFA

SEQ ID NO: 99626 - protein, 15 aa, Mycobacterium tuberculosis
AHIPQLIASHTAFAA

SEQ ID NO: 99627 - protein, 15 aa, Mycobacterium tuberculosis
HIPQLIASHTAFAAK

SEQ ID NO: 99628 - protein, 15 aa, Mycobacterium tuberculosis
IPQLIASHTAFAAKA

SEQ ID NO: 99629 - protein, 15 aa, Mycobacterium tuberculosis
PQLIASHTAFAAKAG

SEQ ID NO: 99630 - protein, 15 aa, Mycobacterium tuberculosis
QLIASHTAFAAKAGL

SEQ ID NO: 99631 - protein, 15 aa, Mycobacterium tuberculosis
LIASHTAFAAKAGLM

SEQ ID NO: 99632 - protein, 15 aa, Mycobacterium tuberculosis
IASHTAFAAKAGLMR

SEQ ID NO: 99633 - protein, 15 aa, Mycobacterium tuberculosis
ASHTAFAAKAGLMRH

SEQ ID NO: 99634 - protein, 15 aa, Mycobacterium tuberculosis
SHTAFAAKAGLMRHT

SEQ ID NO: 99635 - protein, 15 aa, Mycobacterium tuberculosis
HTAFAAKAGLMRHTI

SEQ ID NO: 99636 - protein, 15 aa, Mycobacterium tuberculosis
TAFAAKAGLMRHTIG

SEQ ID NO: 99637 - protein, 15 aa, Mycobacterium tuberculosis
AFAAKAGLMRHTIGQ

SEQ ID NO: 99638 - protein, 15 aa, Mycobacterium tuberculosis
FAAKAGLMRHTIGQA

SEQ ID NO: 99639 - protein, 15 aa, Mycobacterium tuberculosis
AAKAGLMRHTIGQAE

SEQ ID NO: 99640 - protein, 15 aa, Mycobacterium tuberculosis
AKAGLMRHTIGQAEQ

SEQ ID NO: 99641 - protein, 15 aa, Mycobacterium tuberculosis
KAGLMRHTIGQAEQQ

SEQ ID NO: 99642 - protein, 15 aa, Mycobacterium tuberculosis
AGLMRHTIGQAEQQA

SEQ ID NO: 99643 - protein, 15 aa, Mycobacterium tuberculosis
GLMRHTIGQAEQQAM

SEQ ID NO: 99644 - protein, 15 aa, Mycobacterium tuberculosis
LMRHTIGQAEQQAMS

SEQ ID NO: 99645 - protein, 15 aa, Mycobacterium tuberculosis
MRHTIGQAEQQAMSA

SEQ ID NO: 99646 - protein, 15 aa, Mycobacterium tuberculosis
RHTIGQAEQQAMSAQ

SEQ ID NO: 99647 - protein, 15 aa, Mycobacterium tuberculosis
HTIGQAEQQAMSAQA

SEQ ID NO: 99648 - protein, 15 aa, Mycobacterium tuberculosis
TIGQAEQQAMSAQAF

SEQ ID NO: 99649 - protein, 15 aa, Mycobacterium tuberculosis
IGQAEQQAMSAQAFH

SEQ ID NO: 99650 - protein, 15 aa, Mycobacterium tuberculosis
GQAEQQAMSAQAFHQ

SEQ ID NO: 99651 - protein, 15 aa, Mycobacterium tuberculosis
QAEQQAMSAQAFHQG

SEQ ID NO: 99652 - protein, 15 aa, Mycobacterium tuberculosis
AEQQAMSAQAFHQGE

SEQ ID NO: 99653 - protein, 15 aa, Mycobacterium tuberculosis
EQQAMSAQAFHQGES

SEQ ID NO: 99654 - protein, 15 aa, Mycobacterium tuberculosis
QQAMSAQAFHQGESA

SEQ ID NO: 99655 - protein, 15 aa, Mycobacterium tuberculosis
QAMSAQAFHQGESAA

SEQ ID NO: 99656 - protein, 15 aa, Mycobacterium tuberculosis
AMSAQAFHQGESAAA

SEQ ID NO: 99657 - protein, 15 aa, Mycobacterium tuberculosis
MSAQAFHQGESAAAF

SEQ ID NO: 99658 - protein, 15 aa, Mycobacterium tuberculosis
SAQAFHQGESAAAFQ

SEQ ID NO: 99659 - protein, 15 aa, Mycobacterium tuberculosis
AQAFHQGESAAAFQG

SEQ ID NO: 99660 - protein, 15 aa, Mycobacterium tuberculosis
QAFHQGESAAAFQGA

SEQ ID NO: 99661 - protein, 15 aa, Mycobacterium tuberculosis
AFHQGESAAAFQGAH

SEQ ID NO: 99662 - protein, 15 aa, Mycobacterium tuberculosis
FHQGESAAAFQGAHA

SEQ ID NO: 99663 - protein, 15 aa, Mycobacterium tuberculosis
HQGESAAAFQGAHAR

SEQ ID NO: 99664 - protein, 15 aa, Mycobacterium tuberculosis
QGESAAAFQGAHARF

SEQ ID NO: 99665 - protein, 15 aa, Mycobacterium tuberculosis
GESAAAFQGAHARFV

SEQ ID NO: 99666 - protein, 15 aa, Mycobacterium tuberculosis
ESAAAFQGAHARFVA

SEQ ID NO: 99667 - protein, 15 aa, Mycobacterium tuberculosis
SAAAFQGAHARFVAA

SEQ ID NO: 99668 - protein, 15 aa, Mycobacterium tuberculosis
AAAFQGAHARFVAAA

SEQ ID NO: 99669 - protein, 15 aa, Mycobacterium tuberculosis
AAFQGAHARFVAAAA

SEQ ID NO: 99670 - protein, 15 aa, Mycobacterium tuberculosis
AFQGAHARFVAAAAK

SEQ ID NO: 99671 - protein, 15 aa, Mycobacterium tuberculosis
FQGAHARFVAAAAKV

SEQ ID NO: 99672 - protein, 15 aa, Mycobacterium tuberculosis
QGAHARFVAAAAKVN

SEQ ID NO: 99673 - protein, 15 aa, Mycobacterium tuberculosis
GAHARFVAAAAKVNT

SEQ ID NO: 99674 - protein, 15 aa, Mycobacterium tuberculosis
AHARFVAAAAKVNTL

SEQ ID NO: 99675 - protein, 15 aa, Mycobacterium tuberculosis
HARFVAAAAKVNTLL

SEQ ID NO: 99676 - protein, 15 aa, Mycobacterium tuberculosis
ARFVAAAAKVNTLLD

SEQ ID NO: 99677 - protein, 15 aa, Mycobacterium tuberculosis
RFVAAAAKVNTLLDI

SEQ ID NO: 99678 - protein, 15 aa, Mycobacterium tuberculosis
FVAAAAKVNTLLDIA

SEQ ID NO: 99679 - protein, 15 aa, Mycobacterium tuberculosis
VAAAAKVNTLLDIAQ

SEQ ID NO: 99680 - protein, 15 aa, Mycobacterium tuberculosis
AAAAKVNTLLDIAQA

SEQ ID NO: 99681 - protein, 15 aa, Mycobacterium tuberculosis
AAAKVNTLLDIAQAN

SEQ ID NO: 99682 - protein, 15 aa, Mycobacterium tuberculosis
AAKVNTLLDIAQANL

SEQ ID NO: 99683 - protein, 15 aa, Mycobacterium tuberculosis
AKVNTLLDIAQANLG

SEQ ID NO: 99684 - protein, 15 aa, Mycobacterium tuberculosis
KVNTLLDIAQANLGE

SEQ ID NO: 99685 - protein, 15 aa, Mycobacterium tuberculosis
VNTLLDIAQANLGEA

SEQ ID NO: 99686 - protein, 15 aa, Mycobacterium tuberculosis
NTLLDIAQANLGEAA

SEQ ID NO: 99687 - protein, 15 aa, Mycobacterium tuberculosis
TLLDIAQANLGEAAG

SEQ ID NO: 99688 - protein, 15 aa, Mycobacterium tuberculosis
LLDIAQANLGEAAGT

SEQ ID NO: 99689 - protein, 15 aa, Mycobacterium tuberculosis
LDIAQANLGEAAGTY

SEQ ID NO: 99690 - protein, 15 aa, Mycobacterium tuberculosis
DIAQANLGEAAGTYV

SEQ ID NO: 99691 - protein, 15 aa, Mycobacterium tuberculosis
IAQANLGEAAGTYVA

SEQ ID NO: 99692 - protein, 15 aa, Mycobacterium tuberculosis
AQANLGEAAGTYVAA

SEQ ID NO: 99693 - protein, 15 aa, Mycobacterium tuberculosis
QANLGEAAGTYVAAD

SEQ ID NO: 99694 - protein, 15 aa, Mycobacterium tuberculosis
ANLGEAAGTYVAADA

SEQ ID NO: 99695 - protein, 15 aa, Mycobacterium tuberculosis
NLGEAAGTYVAADAA

SEQ ID NO: 99696 - protein, 15 aa, Mycobacterium tuberculosis
LGEAAGTYVAADAAA

SEQ ID NO: 99697 - protein, 15 aa, Mycobacterium tuberculosis
GEAAGTYVAADAAAA

SEQ ID NO: 99698 - protein, 15 aa, Mycobacterium tuberculosis
EAAGTYVAADAAAAS

SEQ ID NO: 99699 - protein, 15 aa, Mycobacterium tuberculosis
AAGTYVAADAAAASS

SEQ ID NO: 99700 - protein, 15 aa, Mycobacterium tuberculosis
AGTYVAADAAAASSY

SEQ ID NO: 99701 - protein, 15 aa, Mycobacterium tuberculosis
GTYVAADAAAASSYT

SEQ ID NO: 99702 - protein, 15 aa, Mycobacterium tuberculosis
TYVAADAAAASSYTG

SEQ ID NO: 99703 - protein, 15 aa, Mycobacterium tuberculosis
YVAADAAAASSYTGF

SEQ ID NO: 99704 - protein, 16 aa, Mycobacterium tuberculosis
MSLLDAHIPQLIASHT

SEQ ID NO: 99705 - protein, 16 aa, Mycobacterium tuberculosis
SLLDAHIPQLIASHTA

SEQ ID NO: 99706 - protein, 16 aa, Mycobacterium tuberculosis
LLDAHIPQLIASHTAF

SEQ ID NO: 99707 - protein, 16 aa, Mycobacterium tuberculosis
LDAHIPQLIASHTAFA

SEQ ID NO: 99708 - protein, 16 aa, Mycobacterium tuberculosis
DAHIPQLIASHTAFAA

SEQ ID NO: 99709 - protein, 16 aa, Mycobacterium tuberculosis
AHIPQLIASHTAFAAK

SEQ ID NO: 99710 - protein, 16 aa, Mycobacterium tuberculosis
HIPQLIASHTAFAAKA

SEQ ID NO: 99711 - protein, 16 aa, Mycobacterium tuberculosis
IPQLIASHTAFAAKAG

SEQ ID NO: 99712 - protein, 16 aa, Mycobacterium tuberculosis
PQLIASHTAFAAKAGL

SEQ ID NO: 99713 - protein, 16 aa, Mycobacterium tuberculosis
QLIASHTAFAAKAGLM

SEQ ID NO: 99714 - protein, 16 aa, Mycobacterium tuberculosis
LIASHTAFAAKAGLMR

SEQ ID NO: 99715 - protein, 16 aa, Mycobacterium tuberculosis
IASHTAFAAKAGLMRH

SEQ ID NO: 99716 - protein, 16 aa, Mycobacterium tuberculosis
ASHTAFAAKAGLMRHT

SEQ ID NO: 99717 - protein, 16 aa, Mycobacterium tuberculosis
SHTAFAAKAGLMRHTI

SEQ ID NO: 99718 - protein, 16 aa, Mycobacterium tuberculosis
HTAFAAKAGLMRHTIG

SEQ ID NO: 99719 - protein, 16 aa, Mycobacterium tuberculosis
TAFAAKAGLMRHTIGQ

SEQ ID NO: 99720 - protein, 16 aa, Mycobacterium tuberculosis
AFAAKAGLMRHTIGQA

SEQ ID NO: 99721 - protein, 16 aa, Mycobacterium tuberculosis
FAAKAGLMRHTIGQAE

SEQ ID NO: 99722 - protein, 16 aa, Mycobacterium tuberculosis
AAKAGLMRHTIGQAEQ

SEQ ID NO: 99723 - protein, 16 aa, Mycobacterium tuberculosis
AKAGLMRHTIGQAEQQ

SEQ ID NO: 99724 - protein, 16 aa, Mycobacterium tuberculosis
KAGLMRHTIGQAEQQA

SEQ ID NO: 99725 - protein, 16 aa, Mycobacterium tuberculosis
AGLMRHTIGQAEQQAM

SEQ ID NO: 99726 - protein, 16 aa, Mycobacterium tuberculosis
GLMRHTIGQAEQQAMS

SEQ ID NO: 99727 - protein, 16 aa, Mycobacterium tuberculosis
LMRHTIGQAEQQAMSA

SEQ ID NO: 99728 - protein, 16 aa, Mycobacterium tuberculosis
MRHTIGQAEQQAMSAQ

SEQ ID NO: 99729 - protein, 16 aa, Mycobacterium tuberculosis
RHTIGQAEQQAMSAQA

SEQ ID NO: 99730 - protein, 16 aa, Mycobacterium tuberculosis
HTIGQAEQQAMSAQAF

SEQ ID NO: 99731 - protein, 16 aa, Mycobacterium tuberculosis
TIGQAEQQAMSAQAFH

SEQ ID NO: 99732 - protein, 16 aa, Mycobacterium tuberculosis
IGQAEQQAMSAQAFHQ

SEQ ID NO: 99733 - protein, 16 aa, Mycobacterium tuberculosis
GQAEQQAMSAQAFHQG

SEQ ID NO: 99734 - protein, 16 aa, Mycobacterium tuberculosis
QAEQQAMSAQAFHQGE

SEQ ID NO: 99735 - protein, 16 aa, Mycobacterium tuberculosis
AEQQAMSAQAFHQGES

SEQ ID NO: 99736 - protein, 16 aa, Mycobacterium tuberculosis
EQQAMSAQAFHQGESA

SEQ ID NO: 99737 - protein, 16 aa, Mycobacterium tuberculosis
QQAMSAQAFHQGESAA

SEQ ID NO: 99738 - protein, 16 aa, Mycobacterium tuberculosis
QAMSAQAFHQGESAAA

SEQ ID NO: 99739 - protein, 16 aa, Mycobacterium tuberculosis
AMSAQAFHQGESAAAF

SEQ ID NO: 99740 - protein, 16 aa, Mycobacterium tuberculosis
MSAQAFHQGESAAAFQ

SEQ ID NO: 99741 - protein, 16 aa, Mycobacterium tuberculosis
SAQAFHQGESAAAFQG

SEQ ID NO: 99742 - protein, 16 aa, Mycobacterium tuberculosis
AQAFHQGESAAAFQGA

SEQ ID NO: 99743 - protein, 16 aa, Mycobacterium tuberculosis
QAFHQGESAAAFQGAH

SEQ ID NO: 99744 - protein, 16 aa, Mycobacterium tuberculosis
AFHQGESAAAFQGAHA

SEQ ID NO: 99745 - protein, 16 aa, Mycobacterium tuberculosis
FHQGESAAAFQGAHAR

SEQ ID NO: 99746 - protein, 16 aa, Mycobacterium tuberculosis
HQGESAAAFQGAHARF

SEQ ID NO: 99747 - protein, 16 aa, Mycobacterium tuberculosis
QGESAAAFQGAHARFV

SEQ ID NO: 99748 - protein, 16 aa, Mycobacterium tuberculosis
GESAAAFQGAHARFVA

SEQ ID NO: 99749 - protein, 16 aa, Mycobacterium tuberculosis
ESAAAFQGAHARFVAA

SEQ ID NO: 99750 - protein, 16 aa, Mycobacterium tuberculosis
SAAAFQGAHARFVAAA

SEQ ID NO: 99751 - protein, 16 aa, Mycobacterium tuberculosis
AAAFQGAHARFVAAAA

SEQ ID NO: 99752 - protein, 16 aa, Mycobacterium tuberculosis
AAFQGAHARFVAAAAK

SEQ ID NO: 99753 - protein, 16 aa, Mycobacterium tuberculosis
AFQGAHARFVAAAAKV

SEQ ID NO: 99754 - protein, 16 aa, Mycobacterium tuberculosis
FQGAHARFVAAAAKVN

SEQ ID NO: 99755 - protein, 16 aa, Mycobacterium tuberculosis
QGAHARFVAAAAKVNT

SEQ ID NO: 99756 - protein, 16 aa, Mycobacterium tuberculosis
GAHARFVAAAAKVNTL

SEQ ID NO: 99757 - protein, 16 aa, Mycobacterium tuberculosis
AHARFVAAAAKVNTLL

SEQ ID NO: 99758 - protein, 16 aa, Mycobacterium tuberculosis
HARFVAAAAKVNTLLD

SEQ ID NO: 99759 - protein, 16 aa, Mycobacterium tuberculosis
ARFVAAAAKVNTLLDI

SEQ ID NO: 99760 - protein, 16 aa, Mycobacterium tuberculosis
RFVAAAAKVNTLLDIA

SEQ ID NO: 99761 - protein, 16 aa, Mycobacterium tuberculosis
FVAAAAKVNTLLDIAQ

SEQ ID NO: 99762 - protein, 16 aa, Mycobacterium tuberculosis
VAAAAKVNTLLDIAQA

SEQ ID NO: 99763 - protein, 16 aa, Mycobacterium tuberculosis
AAAAKVNTLLDIAQAN

SEQ ID NO: 99764 - protein, 16 aa, Mycobacterium tuberculosis
AAAKVNTLLDIAQANL

SEQ ID NO: 99765 - protein, 16 aa, Mycobacterium tuberculosis
AAKVNTLLDIAQANLG

SEQ ID NO: 99766 - protein, 16 aa, Mycobacterium tuberculosis
AKVNTLLDIAQANLGE

SEQ ID NO: 99767 - protein, 16 aa, Mycobacterium tuberculosis
KVNTLLDIAQANLGEA

SEQ ID NO: 99768 - protein, 16 aa, Mycobacterium tuberculosis
VNTLLDIAQANLGEAA

SEQ ID NO: 99769 - protein, 16 aa, Mycobacterium tuberculosis
NTLLDIAQANLGEAAG

SEQ ID NO: 99770 - protein, 16 aa, Mycobacterium tuberculosis
TLLDIAQANLGEAAGT

SEQ ID NO: 99771 - protein, 16 aa, Mycobacterium tuberculosis
LLDIAQANLGEAAGTY

SEQ ID NO: 99772 - protein, 16 aa, Mycobacterium tuberculosis
LDIAQANLGEAAGTYV

SEQ ID NO: 99773 - protein, 16 aa, Mycobacterium tuberculosis
DIAQANLGEAAGTYVA

SEQ ID NO: 99774 - protein, 16 aa, Mycobacterium tuberculosis
IAQANLGEAAGTYVAA

SEQ ID NO: 99775 - protein, 16 aa, Mycobacterium tuberculosis
AQANLGEAAGTYVAAD

SEQ ID NO: 99776 - protein, 16 aa, Mycobacterium tuberculosis
QANLGEAAGTYVAADA

SEQ ID NO: 99777 - protein, 16 aa, Mycobacterium tuberculosis
ANLGEAAGTYVAADAA

SEQ ID NO: 99778 - protein, 16 aa, Mycobacterium tuberculosis
NLGEAAGTYVAADAAA

SEQ ID NO: 99779 - protein, 16 aa, Mycobacterium tuberculosis
LGEAAGTYVAADAAAA

SEQ ID NO: 99780 - protein, 16 aa, Mycobacterium tuberculosis
GEAAGTYVAADAAAAS

SEQ ID NO: 99781 - protein, 16 aa, Mycobacterium tuberculosis
EAAGTYVAADAAAASS

SEQ ID NO: 99782 - protein, 16 aa, Mycobacterium tuberculosis
AAGTYVAADAAAASSY

SEQ ID NO: 99783 - protein, 16 aa, Mycobacterium tuberculosis
AGTYVAADAAAASSYT

SEQ ID NO: 99784 - protein, 16 aa, Mycobacterium tuberculosis
GTYVAADAAAASSYTG

SEQ ID NO: 99785 - protein, 16 aa, Mycobacterium tuberculosis
TYVAADAAAASSYTGF

SEQ ID NO: 99786 - protein, 13 aa, Mycobacterium tuberculosis
MADSDLPTKGRQR

SEQ ID NO: 99787 - protein, 13 aa, Mycobacterium tuberculosis
ADSDLPTKGRQRG

SEQ ID NO: 99788 - protein, 13 aa, Mycobacterium tuberculosis
DSDLPTKGRQRGV

SEQ ID NO: 99789 - protein, 13 aa, Mycobacterium tuberculosis
SDLPTKGRQRGVR

SEQ ID NO: 99790 - protein, 13 aa, Mycobacterium tuberculosis
DLPTKGRQRGVRA

SEQ ID NO: 99791 - protein, 13 aa, Mycobacterium tuberculosis
LPTKGRQRGVRAV

SEQ ID NO: 99792 - protein, 13 aa, Mycobacterium tuberculosis
PTKGRQRGVRAVE

SEQ ID NO: 99793 - protein, 13 aa, Mycobacterium tuberculosis
TKGRQRGVRAVEL

SEQ ID NO: 99794 - protein, 13 aa, Mycobacterium tuberculosis
KGRQRGVRAVELN

SEQ ID NO: 99795 - protein, 13 aa, Mycobacterium tuberculosis
GRQRGVRAVELNV

SEQ ID NO: 99796 - protein, 13 aa, Mycobacterium tuberculosis
RQRGVRAVELNVA

SEQ ID NO: 99797 - protein, 13 aa, Mycobacterium tuberculosis
QRGVRAVELNVAA

SEQ ID NO: 99798 - protein, 13 aa, Mycobacterium tuberculosis
RGVRAVELNVAAR

SEQ ID NO: 99799 - protein, 13 aa, Mycobacterium tuberculosis
GVRAVELNVAARL

SEQ ID NO: 99800 - protein, 13 aa, Mycobacterium tuberculosis
VRAVELNVAARLE

SEQ ID NO: 99801 - protein, 13 aa, Mycobacterium tuberculosis
RAVELNVAARLEN

SEQ ID NO: 99802 - protein, 13 aa, Mycobacterium tuberculosis
AVELNVAARLENL

SEQ ID NO: 99803 - protein, 13 aa, Mycobacterium tuberculosis
VELNVAARLENLA

SEQ ID NO: 99804 - protein, 13 aa, Mycobacterium tuberculosis
ELNVAARLENLAL

SEQ ID NO: 99805 - protein, 13 aa, Mycobacterium tuberculosis
LNVAARLENLALL

SEQ ID NO: 99806 - protein, 13 aa, Mycobacterium tuberculosis
NVAARLENLALLR

SEQ ID NO: 99807 - protein, 13 aa, Mycobacterium tuberculosis
VAARLENLALLRT

SEQ ID NO: 99808 - protein, 13 aa, Mycobacterium tuberculosis
AARLENLALLRTL

SEQ ID NO: 99809 - protein, 13 aa, Mycobacterium tuberculosis
ARLENLALLRTLV

SEQ ID NO: 99810 - protein, 13 aa, Mycobacterium tuberculosis
RLENLALLRTLVG

SEQ ID NO: 99811 - protein, 13 aa, Mycobacterium tuberculosis
LENLALLRTLVGA

SEQ ID NO: 99812 - protein, 13 aa, Mycobacterium tuberculosis
ENLALLRTLVGAI

SEQ ID NO: 99813 - protein, 13 aa, Mycobacterium tuberculosis
NLALLRTLVGAIG

SEQ ID NO: 99814 - protein, 13 aa, Mycobacterium tuberculosis
LALLRTLVGAIGT

SEQ ID NO: 99815 - protein, 13 aa, Mycobacterium tuberculosis
ALLRTLVGAIGTF

SEQ ID NO: 99816 - protein, 13 aa, Mycobacterium tuberculosis
LLRTLVGAIGTFE

SEQ ID NO: 99817 - protein, 13 aa, Mycobacterium tuberculosis
LRTLVGAIGTFED

SEQ ID NO: 99818 - protein, 13 aa, Mycobacterium tuberculosis
RTLVGAIGTFEDL

SEQ ID NO: 99819 - protein, 13 aa, Mycobacterium tuberculosis
TLVGAIGTFEDLD

SEQ ID NO: 99820 - protein, 13 aa, Mycobacterium tuberculosis
LVGAIGTFEDLDF

SEQ ID NO: 99821 - protein, 13 aa, Mycobacterium tuberculosis
VGAIGTFEDLDFD

SEQ ID NO: 99822 - protein, 13 aa, Mycobacterium tuberculosis
GAIGTFEDLDFDA

SEQ ID NO: 99823 - protein, 13 aa, Mycobacterium tuberculosis
AIGTFEDLDFDAV

SEQ ID NO: 99824 - protein, 13 aa, Mycobacterium tuberculosis
IGTFEDLDFDAVA

SEQ ID NO: 99825 - protein, 13 aa, Mycobacterium tuberculosis
GTFEDLDFDAVAD

SEQ ID NO: 99826 - protein, 13 aa, Mycobacterium tuberculosis
TFEDLDFDAVADL

SEQ ID NO: 99827 - protein, 13 aa, Mycobacterium tuberculosis
FEDLDFDAVADLR

SEQ ID NO: 99828 - protein, 13 aa, Mycobacterium tuberculosis
EDLDFDAVADLRL

SEQ ID NO: 99829 - protein, 13 aa, Mycobacterium tuberculosis
DLDFDAVADLRLA

SEQ ID NO: 99830 - protein, 13 aa, Mycobacterium tuberculosis
LDFDAVADLRLAV

SEQ ID NO: 99831 - protein, 13 aa, Mycobacterium tuberculosis
DFDAVADLRLAVD

SEQ ID NO: 99832 - protein, 13 aa, Mycobacterium tuberculosis
FDAVADLRLAVDE

SEQ ID NO: 99833 - protein, 13 aa, Mycobacterium tuberculosis
DAVADLRLAVDEV

SEQ ID NO: 99834 - protein, 13 aa, Mycobacterium tuberculosis
AVADLRLAVDEVC

SEQ ID NO: 99835 - protein, 13 aa, Mycobacterium tuberculosis
VADLRLAVDEVCT

SEQ ID NO: 99836 - protein, 13 aa, Mycobacterium tuberculosis
ADLRLAVDEVCTR

SEQ ID NO: 99837 - protein, 13 aa, Mycobacterium tuberculosis
DLRLAVDEVCTRL

SEQ ID NO: 99838 - protein, 13 aa, Mycobacterium tuberculosis
LRLAVDEVCTRLI

SEQ ID NO: 99839 - protein, 13 aa, Mycobacterium tuberculosis
RLAVDEVCTRLIR

SEQ ID NO: 99840 - protein, 13 aa, Mycobacterium tuberculosis
LAVDEVCTRLIRS

SEQ ID NO: 99841 - protein, 13 aa, Mycobacterium tuberculosis
AVDEVCTRLIRSA

SEQ ID NO: 99842 - protein, 13 aa, Mycobacterium tuberculosis
VDEVCTRLIRSAL

SEQ ID NO: 99843 - protein, 13 aa, Mycobacterium tuberculosis
DEVCTRLIRSALP

SEQ ID NO: 99844 - protein, 13 aa, Mycobacterium tuberculosis
EVCTRLIRSALPD

SEQ ID NO: 99845 - protein, 13 aa, Mycobacterium tuberculosis
VCTRLIRSALPDA

SEQ ID NO: 99846 - protein, 13 aa, Mycobacterium tuberculosis
CTRLIRSALPDAT

SEQ ID NO: 99847 - protein, 13 aa, Mycobacterium tuberculosis
TRLIRSALPDATL

SEQ ID NO: 99848 - protein, 13 aa, Mycobacterium tuberculosis
RLIRSALPDATLR

SEQ ID NO: 99849 - protein, 13 aa, Mycobacterium tuberculosis
LIRSALPDATLRL

SEQ ID NO: 99850 - protein, 13 aa, Mycobacterium tuberculosis
IRSALPDATLRLV

SEQ ID NO: 99851 - protein, 13 aa, Mycobacterium tuberculosis
RSALPDATLRLVV

SEQ ID NO: 99852 - protein, 13 aa, Mycobacterium tuberculosis
SALPDATLRLVVD

SEQ ID NO: 99853 - protein, 13 aa, Mycobacterium tuberculosis
ALPDATLRLVVDP

SEQ ID NO: 99854 - protein, 13 aa, Mycobacterium tuberculosis
LPDATLRLVVDPR

SEQ ID NO: 99855 - protein, 13 aa, Mycobacterium tuberculosis
PDATLRLVVDPRK

SEQ ID NO: 99856 - protein, 13 aa, Mycobacterium tuberculosis
DATLRLVVDPRKD

SEQ ID NO: 99857 - protein, 13 aa, Mycobacterium tuberculosis
ATLRLVVDPRKDE

SEQ ID NO: 99858 - protein, 13 aa, Mycobacterium tuberculosis
TLRLVVDPRKDEV

SEQ ID NO: 99859 - protein, 13 aa, Mycobacterium tuberculosis
LRLVVDPRKDEVV

SEQ ID NO: 99860 - protein, 13 aa, Mycobacterium tuberculosis
RLVVDPRKDEVVV

SEQ ID NO: 99861 - protein, 13 aa, Mycobacterium tuberculosis
LVVDPRKDEVVVE

SEQ ID NO: 99862 - protein, 13 aa, Mycobacterium tuberculosis
VVDPRKDEVVVEA

SEQ ID NO: 99863 - protein, 13 aa, Mycobacterium tuberculosis
VDPRKDEVVVEAS

SEQ ID NO: 99864 - protein, 13 aa, Mycobacterium tuberculosis
DPRKDEVVVEASA

SEQ ID NO: 99865 - protein, 13 aa, Mycobacterium tuberculosis
PRKDEVVVEASAA

SEQ ID NO: 99866 - protein, 13 aa, Mycobacterium tuberculosis
RKDEVVVEASAAC

SEQ ID NO: 99867 - protein, 13 aa, Mycobacterium tuberculosis
KDEVVVEASAACD

SEQ ID NO: 99868 - protein, 13 aa, Mycobacterium tuberculosis
DEVVVEASAACDT

SEQ ID NO: 99869 - protein, 13 aa, Mycobacterium tuberculosis
EVVVEASAACDTH

SEQ ID NO: 99870 - protein, 13 aa, Mycobacterium tuberculosis
VVVEASAACDTHD

SEQ ID NO: 99871 - protein, 13 aa, Mycobacterium tuberculosis
VVEASAACDTHDV

SEQ ID NO: 99872 - protein, 13 aa, Mycobacterium tuberculosis
VEASAACDTHDVV

SEQ ID NO: 99873 - protein, 13 aa, Mycobacterium tuberculosis
EASAACDTHDVVA

SEQ ID NO: 99874 - protein, 13 aa, Mycobacterium tuberculosis
ASAACDTHDVVAP

SEQ ID NO: 99875 - protein, 13 aa, Mycobacterium tuberculosis
SAACDTHDVVAPG

SEQ ID NO: 99876 - protein, 13 aa, Mycobacterium tuberculosis
AACDTHDVVAPGS

SEQ ID NO: 99877 - protein, 13 aa, Mycobacterium tuberculosis
ACDTHDVVAPGSF

SEQ ID NO: 99878 - protein, 13 aa, Mycobacterium tuberculosis
CDTHDVVAPGSFS

SEQ ID NO: 99879 - protein, 13 aa, Mycobacterium tuberculosis
DTHDVVAPGSFSW

SEQ ID NO: 99880 - protein, 13 aa, Mycobacterium tuberculosis
THDVVAPGSFSWH

SEQ ID NO: 99881 - protein, 13 aa, Mycobacterium tuberculosis
HDVVAPGSFSWHV

SEQ ID NO: 99882 - protein, 13 aa, Mycobacterium tuberculosis
DVVAPGSFSWHVL

SEQ ID NO: 99883 - protein, 13 aa, Mycobacterium tuberculosis
VVAPGSFSWHVLT

SEQ ID NO: 99884 - protein, 13 aa, Mycobacterium tuberculosis
VAPGSFSWHVLTA

SEQ ID NO: 99885 - protein, 13 aa, Mycobacterium tuberculosis
APGSFSWHVLTAL

SEQ ID NO: 99886 - protein, 13 aa, Mycobacterium tuberculosis
PGSFSWHVLTALA

SEQ ID NO: 99887 - protein, 13 aa, Mycobacterium tuberculosis
GSFSWHVLTALAD

SEQ ID NO: 99888 - protein, 13 aa, Mycobacterium tuberculosis
SFSWHVLTALADD

SEQ ID NO: 99889 - protein, 13 aa, Mycobacterium tuberculosis
FSWHVLTALADDV

SEQ ID NO: 99890 - protein, 13 aa, Mycobacterium tuberculosis
SWHVLTALADDVQ

SEQ ID NO: 99891 - protein, 13 aa, Mycobacterium tuberculosis
WHVLTALADDVQT

SEQ ID NO: 99892 - protein, 13 aa, Mycobacterium tuberculosis
HVLTALADDVQTF

SEQ ID NO: 99893 - protein, 13 aa, Mycobacterium tuberculosis
VLTALADDVQTFH

SEQ ID NO: 99894 - protein, 13 aa, Mycobacterium tuberculosis
LTALADDVQTFHD

SEQ ID NO: 99895 - protein, 13 aa, Mycobacterium tuberculosis
TALADDVQTFHDG

SEQ ID NO: 99896 - protein, 13 aa, Mycobacterium tuberculosis
ALADDVQTFHDGR

SEQ ID NO: 99897 - protein, 13 aa, Mycobacterium tuberculosis
LADDVQTFHDGRQ

SEQ ID NO: 99898 - protein, 13 aa, Mycobacterium tuberculosis
ADDVQTFHDGRQP

SEQ ID NO: 99899 - protein, 13 aa, Mycobacterium tuberculosis
DDVQTFHDGRQPD

SEQ ID NO: 99900 - protein, 13 aa, Mycobacterium tuberculosis
DVQTFHDGRQPDV

SEQ ID NO: 99901 - protein, 13 aa, Mycobacterium tuberculosis
VQTFHDGRQPDVA

SEQ ID NO: 99902 - protein, 13 aa, Mycobacterium tuberculosis
QTFHDGRQPDVAG

SEQ ID NO: 99903 - protein, 13 aa, Mycobacterium tuberculosis
TFHDGRQPDVAGS

SEQ ID NO: 99904 - protein, 13 aa, Mycobacterium tuberculosis
FHDGRQPDVAGSV

SEQ ID NO: 99905 - protein, 13 aa, Mycobacterium tuberculosis
HDGRQPDVAGSVF

SEQ ID NO: 99906 - protein, 13 aa, Mycobacterium tuberculosis
DGRQPDVAGSVFG

SEQ ID NO: 99907 - protein, 13 aa, Mycobacterium tuberculosis
GRQPDVAGSVFGI

SEQ ID NO: 99908 - protein, 13 aa, Mycobacterium tuberculosis
RQPDVAGSVFGIT

SEQ ID NO: 99909 - protein, 13 aa, Mycobacterium tuberculosis
QPDVAGSVFGITL

SEQ ID NO: 99910 - protein, 13 aa, Mycobacterium tuberculosis
PDVAGSVFGITLT

SEQ ID NO: 99911 - protein, 13 aa, Mycobacterium tuberculosis
DVAGSVFGITLTA

SEQ ID NO: 99912 - protein, 13 aa, Mycobacterium tuberculosis
VAGSVFGITLTAR

SEQ ID NO: 99913 - protein, 13 aa, Mycobacterium tuberculosis
AGSVFGITLTARR

SEQ ID NO: 99914 - protein, 13 aa, Mycobacterium tuberculosis
GSVFGITLTARRA

SEQ ID NO: 99915 - protein, 13 aa, Mycobacterium tuberculosis
SVFGITLTARRAA

SEQ ID NO: 99916 - protein, 13 aa, Mycobacterium tuberculosis
VFGITLTARRAAS

SEQ ID NO: 99917 - protein, 13 aa, Mycobacterium tuberculosis
FGITLTARRAASS

SEQ ID NO: 99918 - protein, 13 aa, Mycobacterium tuberculosis
GITLTARRAASSR

SEQ ID NO: 99919 - protein, 14 aa, Mycobacterium tuberculosis
MADSDLPTKGRQRG

SEQ ID NO: 99920 - protein, 14 aa, Mycobacterium tuberculosis
ADSDLPTKGRQRGV

SEQ ID NO: 99921 - protein, 14 aa, Mycobacterium tuberculosis
DSDLPTKGRQRGVR

SEQ ID NO: 99922 - protein, 14 aa, Mycobacterium tuberculosis
SDLPTKGRQRGVRA

SEQ ID NO: 99923 - protein, 14 aa, Mycobacterium tuberculosis
DLPTKGRQRGVRAV

SEQ ID NO: 99924 - protein, 14 aa, Mycobacterium tuberculosis
LPTKGRQRGVRAVE

SEQ ID NO: 99925 - protein, 14 aa, Mycobacterium tuberculosis
PTKGRQRGVRAVEL

SEQ ID NO: 99926 - protein, 14 aa, Mycobacterium tuberculosis
TKGRQRGVRAVELN

SEQ ID NO: 99927 - protein, 14 aa, Mycobacterium tuberculosis
KGRQRGVRAVELNV

SEQ ID NO: 99928 - protein, 14 aa, Mycobacterium tuberculosis
GRQRGVRAVELNVA

SEQ ID NO: 99929 - protein, 14 aa, Mycobacterium tuberculosis
RQRGVRAVELNVAA

SEQ ID NO: 99930 - protein, 14 aa, Mycobacterium tuberculosis
QRGVRAVELNVAAR

SEQ ID NO: 99931 - protein, 14 aa, Mycobacterium tuberculosis
RGVRAVELNVAARL

SEQ ID NO: 99932 - protein, 14 aa, Mycobacterium tuberculosis
GVRAVELNVAARLE

SEQ ID NO: 99933 - protein, 14 aa, Mycobacterium tuberculosis
VRAVELNVAARLEN

SEQ ID NO: 99934 - protein, 14 aa, Mycobacterium tuberculosis
RAVELNVAARLENL

SEQ ID NO: 99935 - protein, 14 aa, Mycobacterium tuberculosis
AVELNVAARLENLA

SEQ ID NO: 99936 - protein, 14 aa, Mycobacterium tuberculosis
VELNVAARLENLAL

SEQ ID NO: 99937 - protein, 14 aa, Mycobacterium tuberculosis
ELNVAARLENLALL

SEQ ID NO: 99938 - protein, 14 aa, Mycobacterium tuberculosis
LNVAARLENLALLR

SEQ ID NO: 99939 - protein, 14 aa, Mycobacterium tuberculosis
NVAARLENLALLRT

SEQ ID NO: 99940 - protein, 14 aa, Mycobacterium tuberculosis
VAARLENLALLRTL

SEQ ID NO: 99941 - protein, 14 aa, Mycobacterium tuberculosis
AARLENLALLRTLV

SEQ ID NO: 99942 - protein, 14 aa, Mycobacterium tuberculosis
ARLENLALLRTLVG

SEQ ID NO: 99943 - protein, 14 aa, Mycobacterium tuberculosis
RLENLALLRTLVGA

SEQ ID NO: 99944 - protein, 14 aa, Mycobacterium tuberculosis
LENLALLRTLVGAI

SEQ ID NO: 99945 - protein, 14 aa, Mycobacterium tuberculosis
ENLALLRTLVGAIG

SEQ ID NO: 99946 - protein, 14 aa, Mycobacterium tuberculosis
NLALLRTLVGAIGT

SEQ ID NO: 99947 - protein, 14 aa, Mycobacterium tuberculosis
LALLRTLVGAIGTF

SEQ ID NO: 99948 - protein, 14 aa, Mycobacterium tuberculosis
ALLRTLVGAIGTFE

SEQ ID NO: 99949 - protein, 14 aa, Mycobacterium tuberculosis
LLRTLVGAIGTFED

SEQ ID NO: 99950 - protein, 14 aa, Mycobacterium tuberculosis
LRTLVGAIGTFEDL

SEQ ID NO: 99951 - protein, 14 aa, Mycobacterium tuberculosis
RTLVGAIGTFEDLD

SEQ ID NO: 99952 - protein, 14 aa, Mycobacterium tuberculosis
TLVGAIGTFEDLDF

SEQ ID NO: 99953 - protein, 14 aa, Mycobacterium tuberculosis
LVGAIGTFEDLDFD

SEQ ID NO: 99954 - protein, 14 aa, Mycobacterium tuberculosis
VGAIGTFEDLDFDA

SEQ ID NO: 99955 - protein, 14 aa, Mycobacterium tuberculosis
GAIGTFEDLDFDAV

SEQ ID NO: 99956 - protein, 14 aa, Mycobacterium tuberculosis
AIGTFEDLDFDAVA

SEQ ID NO: 99957 - protein, 14 aa, Mycobacterium tuberculosis
IGTFEDLDFDAVAD

SEQ ID NO: 99958 - protein, 14 aa, Mycobacterium tuberculosis
GTFEDLDFDAVADL

SEQ ID NO: 99959 - protein, 14 aa, Mycobacterium tuberculosis
TFEDLDFDAVADLR

SEQ ID NO: 99960 - protein, 14 aa, Mycobacterium tuberculosis
FEDLDFDAVADLRL

SEQ ID NO: 99961 - protein, 14 aa, Mycobacterium tuberculosis
EDLDFDAVADLRLA

SEQ ID NO: 99962 - protein, 14 aa, Mycobacterium tuberculosis
DLDFDAVADLRLAV

SEQ ID NO: 99963 - protein, 14 aa, Mycobacterium tuberculosis
LDFDAVADLRLAVD

SEQ ID NO: 99964 - protein, 14 aa, Mycobacterium tuberculosis
DFDAVADLRLAVDE

SEQ ID NO: 99965 - protein, 14 aa, Mycobacterium tuberculosis
FDAVADLRLAVDEV

SEQ ID NO: 99966 - protein, 14 aa, Mycobacterium tuberculosis
DAVADLRLAVDEVC

SEQ ID NO: 99967 - protein, 14 aa, Mycobacterium tuberculosis
AVADLRLAVDEVCT

SEQ ID NO: 99968 - protein, 14 aa, Mycobacterium tuberculosis
VADLRLAVDEVCTR

SEQ ID NO: 99969 - protein, 14 aa, Mycobacterium tuberculosis
ADLRLAVDEVCTRL

SEQ ID NO: 99970 - protein, 14 aa, Mycobacterium tuberculosis
DLRLAVDEVCTRLI

SEQ ID NO: 99971 - protein, 14 aa, Mycobacterium tuberculosis
LRLAVDEVCTRLIR

SEQ ID NO: 99972 - protein, 14 aa, Mycobacterium tuberculosis
RLAVDEVCTRLIRS

SEQ ID NO: 99973 - protein, 14 aa, Mycobacterium tuberculosis
LAVDEVCTRLIRSA

SEQ ID NO: 99974 - protein, 14 aa, Mycobacterium tuberculosis
AVDEVCTRLIRSAL

SEQ ID NO: 99975 - protein, 14 aa, Mycobacterium tuberculosis
VDEVCTRLIRSALP

SEQ ID NO: 99976 - protein, 14 aa, Mycobacterium tuberculosis
DEVCTRLIRSALPD

SEQ ID NO: 99977 - protein, 14 aa, Mycobacterium tuberculosis
EVCTRLIRSALPDA

SEQ ID NO: 99978 - protein, 14 aa, Mycobacterium tuberculosis
VCTRLIRSALPDAT

SEQ ID NO: 99979 - protein, 14 aa, Mycobacterium tuberculosis
CTRLIRSALPDATL

SEQ ID NO: 99980 - protein, 14 aa, Mycobacterium tuberculosis
TRLIRSALPDATLR

SEQ ID NO: 99981 - protein, 14 aa, Mycobacterium tuberculosis
RLIRSALPDATLRL

SEQ ID NO: 99982 - protein, 14 aa, Mycobacterium tuberculosis
LIRSALPDATLRLV

SEQ ID NO: 99983 - protein, 14 aa, Mycobacterium tuberculosis
IRSALPDATLRLVV

SEQ ID NO: 99984 - protein, 14 aa, Mycobacterium tuberculosis
RSALPDATLRLVVD

SEQ ID NO: 99985 - protein, 14 aa, Mycobacterium tuberculosis
SALPDATLRLVVDP

SEQ ID NO: 99986 - protein, 14 aa, Mycobacterium tuberculosis
ALPDATLRLVVDPR

SEQ ID NO: 99987 - protein, 14 aa, Mycobacterium tuberculosis
LPDATLRLVVDPRK

SEQ ID NO: 99988 - protein, 14 aa, Mycobacterium tuberculosis
PDATLRLVVDPRKD

SEQ ID NO: 99989 - protein, 14 aa, Mycobacterium tuberculosis
DATLRLVVDPRKDE

SEQ ID NO: 99990 - protein, 14 aa, Mycobacterium tuberculosis
ATLRLVVDPRKDEV

SEQ ID NO: 99991 - protein, 14 aa, Mycobacterium tuberculosis
TLRLVVDPRKDEVV

SEQ ID NO: 99992 - protein, 14 aa, Mycobacterium tuberculosis
LRLVVDPRKDEVVV

SEQ ID NO: 99993 - protein, 14 aa, Mycobacterium tuberculosis
RLVVDPRKDEVVVE

SEQ ID NO: 99994 - protein, 14 aa, Mycobacterium tuberculosis
LVVDPRKDEVVVEA

SEQ ID NO: 99995 - protein, 14 aa, Mycobacterium tuberculosis
VVDPRKDEVVVEAS

SEQ ID NO: 99996 - protein, 14 aa, Mycobacterium tuberculosis
VDPRKDEVVVEASA

SEQ ID NO: 99997 - protein, 14 aa, Mycobacterium tuberculosis
DPRKDEVVVEASAA

SEQ ID NO: 99998 - protein, 14 aa, Mycobacterium tuberculosis
PRKDEVVVEASAAC

SEQ ID NO: 99999 - protein, 14 aa, Mycobacterium tuberculosis
RKDEVVVEASAACD

SEQ ID NO: 100000 - protein, 14 aa, Mycobacterium tuberculosis
KDEVVVEASAACDT

SEQ ID NO: 100001 - protein, 14 aa, Mycobacterium tuberculosis
DEVVVEASAACDTH

SEQ ID NO: 100002 - protein, 14 aa, Mycobacterium tuberculosis
EVVVEASAACDTHD

SEQ ID NO: 100003 - protein, 14 aa, Mycobacterium tuberculosis
VVVEASAACDTHDV

SEQ ID NO: 100004 - protein, 14 aa, Mycobacterium tuberculosis
VVEASAACDTHDVV

SEQ ID NO: 100005 - protein, 14 aa, Mycobacterium tuberculosis
VEASAACDTHDVVA

SEQ ID NO: 100006 - protein, 14 aa, Mycobacterium tuberculosis
EASAACDTHDVVAP

SEQ ID NO: 100007 - protein, 14 aa, Mycobacterium tuberculosis
ASAACDTHDVVAPG

SEQ ID NO: 100008 - protein, 14 aa, Mycobacterium tuberculosis
SAACDTHDVVAPGS

SEQ ID NO: 100009 - protein, 14 aa, Mycobacterium tuberculosis
AACDTHDVVAPGSF

SEQ ID NO: 100010 - protein, 14 aa, Mycobacterium tuberculosis
ACDTHDVVAPGSFS

SEQ ID NO: 100011 - protein, 14 aa, Mycobacterium tuberculosis
CDTHDVVAPGSFSW

SEQ ID NO: 100012 - protein, 14 aa, Mycobacterium tuberculosis
DTHDVVAPGSFSWH

SEQ ID NO: 100013 - protein, 14 aa, Mycobacterium tuberculosis
THDVVAPGSFSWHV

SEQ ID NO: 100014 - protein, 14 aa, Mycobacterium tuberculosis
HDVVAPGSFSWHVL

SEQ ID NO: 100015 - protein, 14 aa, Mycobacterium tuberculosis
DVVAPGSFSWHVLT

SEQ ID NO: 100016 - protein, 14 aa, Mycobacterium tuberculosis
VVAPGSFSWHVLTA

SEQ ID NO: 100017 - protein, 14 aa, Mycobacterium tuberculosis
VAPGSFSWHVLTAL

SEQ ID NO: 100018 - protein, 14 aa, Mycobacterium tuberculosis
APGSFSWHVLTALA

SEQ ID NO: 100019 - protein, 14 aa, Mycobacterium tuberculosis
PGSFSWHVLTALAD

SEQ ID NO: 100020 - protein, 14 aa, Mycobacterium tuberculosis
GSFSWHVLTALADD

SEQ ID NO: 100021 - protein, 14 aa, Mycobacterium tuberculosis
SFSWHVLTALADDV

SEQ ID NO: 100022 - protein, 14 aa, Mycobacterium tuberculosis
FSWHVLTALADDVQ

SEQ ID NO: 100023 - protein, 14 aa, Mycobacterium tuberculosis
SWHVLTALADDVQT

SEQ ID NO: 100024 - protein, 14 aa, Mycobacterium tuberculosis
WHVLTALADDVQTF

SEQ ID NO: 100025 - protein, 14 aa, Mycobacterium tuberculosis
HVLTALADDVQTFH

SEQ ID NO: 100026 - protein, 14 aa, Mycobacterium tuberculosis
VLTALADDVQTFHD

SEQ ID NO: 100027 - protein, 14 aa, Mycobacterium tuberculosis
LTALADDVQTFHDG

SEQ ID NO: 100028 - protein, 14 aa, Mycobacterium tuberculosis
TALADDVQTFHDGR

SEQ ID NO: 100029 - protein, 14 aa, Mycobacterium tuberculosis
ALADDVQTFHDGRQ

SEQ ID NO: 100030 - protein, 14 aa, Mycobacterium tuberculosis
LADDVQTFHDGRQP

SEQ ID NO: 100031 - protein, 14 aa, Mycobacterium tuberculosis
ADDVQTFHDGRQPD

SEQ ID NO: 100032 - protein, 14 aa, Mycobacterium tuberculosis
DDVQTFHDGRQPDV

SEQ ID NO: 100033 - protein, 14 aa, Mycobacterium tuberculosis
DVQTFHDGRQPDVA

SEQ ID NO: 100034 - protein, 14 aa, Mycobacterium tuberculosis
VQTFHDGRQPDVAG

SEQ ID NO: 100035 - protein, 14 aa, Mycobacterium tuberculosis
QTFHDGRQPDVAGS

SEQ ID NO: 100036 - protein, 14 aa, Mycobacterium tuberculosis
TFHDGRQPDVAGSV

SEQ ID NO: 100037 - protein, 14 aa, Mycobacterium tuberculosis
FHDGRQPDVAGSVF

SEQ ID NO: 100038 - protein, 14 aa, Mycobacterium tuberculosis
HDGRQPDVAGSVFG

SEQ ID NO: 100039 - protein, 14 aa, Mycobacterium tuberculosis
DGRQPDVAGSVFGI

SEQ ID NO: 100040 - protein, 14 aa, Mycobacterium tuberculosis
GRQPDVAGSVFGIT

SEQ ID NO: 100041 - protein, 14 aa, Mycobacterium tuberculosis
RQPDVAGSVFGITL

SEQ ID NO: 100042 - protein, 14 aa, Mycobacterium tuberculosis
QPDVAGSVFGITLT

SEQ ID NO: 100043 - protein, 14 aa, Mycobacterium tuberculosis
PDVAGSVFGITLTA

SEQ ID NO: 100044 - protein, 14 aa, Mycobacterium tuberculosis
DVAGSVFGITLTAR

SEQ ID NO: 100045 - protein, 14 aa, Mycobacterium tuberculosis
VAGSVFGITLTARR

SEQ ID NO: 100046 - protein, 14 aa, Mycobacterium tuberculosis
AGSVFGITLTARRA

SEQ ID NO: 100047 - protein, 14 aa, Mycobacterium tuberculosis
GSVFGITLTARRAA

SEQ ID NO: 100048 - protein, 14 aa, Mycobacterium tuberculosis
SVFGITLTARRAAS

SEQ ID NO: 100049 - protein, 14 aa, Mycobacterium tuberculosis
VFGITLTARRAASS

SEQ ID NO: 100050 - protein, 14 aa, Mycobacterium tuberculosis
FGITLTARRAASSR

SEQ ID NO: 100051 - protein, 15 aa, Mycobacterium tuberculosis
MADSDLPTKGRQRGV

SEQ ID NO: 100052 - protein, 15 aa, Mycobacterium tuberculosis
ADSDLPTKGRQRGVR

SEQ ID NO: 100053 - protein, 15 aa, Mycobacterium tuberculosis
DSDLPTKGRQRGVRA

SEQ ID NO: 100054 - protein, 15 aa, Mycobacterium tuberculosis
SDLPTKGRQRGVRAV

SEQ ID NO: 100055 - protein, 15 aa, Mycobacterium tuberculosis
DLPTKGRQRGVRAVE

SEQ ID NO: 100056 - protein, 15 aa, Mycobacterium tuberculosis
LPTKGRQRGVRAVEL

SEQ ID NO: 100057 - protein, 15 aa, Mycobacterium tuberculosis
PTKGRQRGVRAVELN

SEQ ID NO: 100058 - protein, 15 aa, Mycobacterium tuberculosis
TKGRQRGVRAVELNV

SEQ ID NO: 100059 - protein, 15 aa, Mycobacterium tuberculosis
KGRQRGVRAVELNVA

SEQ ID NO: 100060 - protein, 15 aa, Mycobacterium tuberculosis
GRQRGVRAVELNVAA

SEQ ID NO: 100061 - protein, 15 aa, Mycobacterium tuberculosis
RQRGVRAVELNVAAR

SEQ ID NO: 100062 - protein, 15 aa, Mycobacterium tuberculosis
QRGVRAVELNVAARL

SEQ ID NO: 100063 - protein, 15 aa, Mycobacterium tuberculosis
RGVRAVELNVAARLE

SEQ ID NO: 100064 - protein, 15 aa, Mycobacterium tuberculosis
GVRAVELNVAARLEN

SEQ ID NO: 100065 - protein, 15 aa, Mycobacterium tuberculosis
VRAVELNVAARLENL

SEQ ID NO: 100066 - protein, 15 aa, Mycobacterium tuberculosis
RAVELNVAARLENLA

SEQ ID NO: 100067 - protein, 15 aa, Mycobacterium tuberculosis
AVELNVAARLENLAL

SEQ ID NO: 100068 - protein, 15 aa, Mycobacterium tuberculosis
VELNVAARLENLALL

SEQ ID NO: 100069 - protein, 15 aa, Mycobacterium tuberculosis
ELNVAARLENLALLR

SEQ ID NO: 100070 - protein, 15 aa, Mycobacterium tuberculosis
LNVAARLENLALLRT

SEQ ID NO: 100071 - protein, 15 aa, Mycobacterium tuberculosis
NVAARLENLALLRTL

SEQ ID NO: 100072 - protein, 15 aa, Mycobacterium tuberculosis
VAARLENLALLRTLV

SEQ ID NO: 100073 - protein, 15 aa, Mycobacterium tuberculosis
AARLENLALLRTLVG

SEQ ID NO: 100074 - protein, 15 aa, Mycobacterium tuberculosis
ARLENLALLRTLVGA

SEQ ID NO: 100075 - protein, 15 aa, Mycobacterium tuberculosis
RLENLALLRTLVGAI

SEQ ID NO: 100076 - protein, 15 aa, Mycobacterium tuberculosis
LENLALLRTLVGAIG

SEQ ID NO: 100077 - protein, 15 aa, Mycobacterium tuberculosis
ENLALLRTLVGAIGT

SEQ ID NO: 100078 - protein, 15 aa, Mycobacterium tuberculosis
NLALLRTLVGAIGTF

SEQ ID NO: 100079 - protein, 15 aa, Mycobacterium tuberculosis
LALLRTLVGAIGTFE

SEQ ID NO: 100080 - protein, 15 aa, Mycobacterium tuberculosis
ALLRTLVGAIGTFED

SEQ ID NO: 100081 - protein, 15 aa, Mycobacterium tuberculosis
LLRTLVGAIGTFEDL

SEQ ID NO: 100082 - protein, 15 aa, Mycobacterium tuberculosis
LRTLVGAIGTFEDLD

SEQ ID NO: 100083 - protein, 15 aa, Mycobacterium tuberculosis
RTLVGAIGTFEDLDF

SEQ ID NO: 100084 - protein, 15 aa, Mycobacterium tuberculosis
TLVGAIGTFEDLDFD

SEQ ID NO: 100085 - protein, 15 aa, Mycobacterium tuberculosis
LVGAIGTFEDLDFDA

SEQ ID NO: 100086 - protein, 15 aa, Mycobacterium tuberculosis
VGAIGTFEDLDFDAV

SEQ ID NO: 100087 - protein, 15 aa, Mycobacterium tuberculosis
GAIGTFEDLDFDAVA

SEQ ID NO: 100088 - protein, 15 aa, Mycobacterium tuberculosis
AIGTFEDLDFDAVAD

SEQ ID NO: 100089 - protein, 15 aa, Mycobacterium tuberculosis
IGTFEDLDFDAVADL

SEQ ID NO: 100090 - protein, 15 aa, Mycobacterium tuberculosis
GTFEDLDFDAVADLR

SEQ ID NO: 100091 - protein, 15 aa, Mycobacterium tuberculosis
TFEDLDFDAVADLRL

SEQ ID NO: 100092 - protein, 15 aa, Mycobacterium tuberculosis
FEDLDFDAVADLRLA

SEQ ID NO: 100093 - protein, 15 aa, Mycobacterium tuberculosis
EDLDFDAVADLRLAV

SEQ ID NO: 100094 - protein, 15 aa, Mycobacterium tuberculosis
DLDFDAVADLRLAVD

SEQ ID NO: 100095 - protein, 15 aa, Mycobacterium tuberculosis
LDFDAVADLRLAVDE

SEQ ID NO: 100096 - protein, 15 aa, Mycobacterium tuberculosis
DFDAVADLRLAVDEV

SEQ ID NO: 100097 - protein, 15 aa, Mycobacterium tuberculosis
FDAVADLRLAVDEVC

SEQ ID NO: 100098 - protein, 15 aa, Mycobacterium tuberculosis
DAVADLRLAVDEVCT

SEQ ID NO: 100099 - protein, 15 aa, Mycobacterium tuberculosis
AVADLRLAVDEVCTR

SEQ ID NO: 100100 - protein, 15 aa, Mycobacterium tuberculosis
VADLRLAVDEVCTRL

SEQ ID NO: 100101 - protein, 15 aa, Mycobacterium tuberculosis
ADLRLAVDEVCTRLI

SEQ ID NO: 100102 - protein, 15 aa, Mycobacterium tuberculosis
DLRLAVDEVCTRLIR

SEQ ID NO: 100103 - protein, 15 aa, Mycobacterium tuberculosis
LRLAVDEVCTRLIRS

SEQ ID NO: 100104 - protein, 15 aa, Mycobacterium tuberculosis
RLAVDEVCTRLIRSA

SEQ ID NO: 100105 - protein, 15 aa, Mycobacterium tuberculosis
LAVDEVCTRLIRSAL

SEQ ID NO: 100106 - protein, 15 aa, Mycobacterium tuberculosis
AVDEVCTRLIRSALP

SEQ ID NO: 100107 - protein, 15 aa, Mycobacterium tuberculosis
VDEVCTRLIRSALPD

SEQ ID NO: 100108 - protein, 15 aa, Mycobacterium tuberculosis
DEVCTRLIRSALPDA

SEQ ID NO: 100109 - protein, 15 aa, Mycobacterium tuberculosis
EVCTRLIRSALPDAT

SEQ ID NO: 100110 - protein, 15 aa, Mycobacterium tuberculosis
VCTRLIRSALPDATL

SEQ ID NO: 100111 - protein, 15 aa, Mycobacterium tuberculosis
CTRLIRSALPDATLR

SEQ ID NO: 100112 - protein, 15 aa, Mycobacterium tuberculosis
TRLIRSALPDATLRL

SEQ ID NO: 100113 - protein, 15 aa, Mycobacterium tuberculosis
RLIRSALPDATLRLV

SEQ ID NO: 100114 - protein, 15 aa, Mycobacterium tuberculosis
LIRSALPDATLRLVV

SEQ ID NO: 100115 - protein, 15 aa, Mycobacterium tuberculosis
IRSALPDATLRLVVD

SEQ ID NO: 100116 - protein, 15 aa, Mycobacterium tuberculosis
RSALPDATLRLVVDP

SEQ ID NO: 100117 - protein, 15 aa, Mycobacterium tuberculosis
SALPDATLRLVVDPR

SEQ ID NO: 100118 - protein, 15 aa, Mycobacterium tuberculosis
ALPDATLRLVVDPRK

SEQ ID NO: 100119 - protein, 15 aa, Mycobacterium tuberculosis
LPDATLRLVVDPRKD

SEQ ID NO: 100120 - protein, 15 aa, Mycobacterium tuberculosis
PDATLRLVVDPRKDE

SEQ ID NO: 100121 - protein, 15 aa, Mycobacterium tuberculosis
DATLRLVVDPRKDEV

SEQ ID NO: 100122 - protein, 15 aa, Mycobacterium tuberculosis
ATLRLVVDPRKDEVV

SEQ ID NO: 100123 - protein, 15 aa, Mycobacterium tuberculosis
TLRLVVDPRKDEVVV

SEQ ID NO: 100124 - protein, 15 aa, Mycobacterium tuberculosis
LRLVVDPRKDEVVVE

SEQ ID NO: 100125 - protein, 15 aa, Mycobacterium tuberculosis
RLVVDPRKDEVVVEA

SEQ ID NO: 100126 - protein, 15 aa, Mycobacterium tuberculosis
LVVDPRKDEVVVEAS

SEQ ID NO: 100127 - protein, 15 aa, Mycobacterium tuberculosis
VVDPRKDEVVVEASA

SEQ ID NO: 100128 - protein, 15 aa, Mycobacterium tuberculosis
VDPRKDEVVVEASAA

SEQ ID NO: 100129 - protein, 15 aa, Mycobacterium tuberculosis
DPRKDEVVVEASAAC

SEQ ID NO: 100130 - protein, 15 aa, Mycobacterium tuberculosis
PRKDEVVVEASAACD

SEQ ID NO: 100131 - protein, 15 aa, Mycobacterium tuberculosis
RKDEVVVEASAACDT

SEQ ID NO: 100132 - protein, 15 aa, Mycobacterium tuberculosis
KDEVVVEASAACDTH

SEQ ID NO: 100133 - protein, 15 aa, Mycobacterium tuberculosis
DEVVVEASAACDTHD

SEQ ID NO: 100134 - protein, 15 aa, Mycobacterium tuberculosis
EVVVEASAACDTHDV

SEQ ID NO: 100135 - protein, 15 aa, Mycobacterium tuberculosis
VVVEASAACDTHDVV

SEQ ID NO: 100136 - protein, 15 aa, Mycobacterium tuberculosis
VVEASAACDTHDVVA

SEQ ID NO: 100137 - protein, 15 aa, Mycobacterium tuberculosis
VEASAACDTHDVVAP

SEQ ID NO: 100138 - protein, 15 aa, Mycobacterium tuberculosis
EASAACDTHDVVAPG

SEQ ID NO: 100139 - protein, 15 aa, Mycobacterium tuberculosis
ASAACDTHDVVAPGS

SEQ ID NO: 100140 - protein, 15 aa, Mycobacterium tuberculosis
SAACDTHDVVAPGSF

SEQ ID NO: 100141 - protein, 15 aa, Mycobacterium tuberculosis
AACDTHDVVAPGSFS

SEQ ID NO: 100142 - protein, 15 aa, Mycobacterium tuberculosis
ACDTHDVVAPGSFSW

SEQ ID NO: 100143 - protein, 15 aa, Mycobacterium tuberculosis
CDTHDVVAPGSFSWH

SEQ ID NO: 100144 - protein, 15 aa, Mycobacterium tuberculosis
DTHDVVAPGSFSWHV

SEQ ID NO: 100145 - protein, 15 aa, Mycobacterium tuberculosis
THDVVAPGSFSWHVL

SEQ ID NO: 100146 - protein, 15 aa, Mycobacterium tuberculosis
HDVVAPGSFSWHVLT

SEQ ID NO: 100147 - protein, 15 aa, Mycobacterium tuberculosis
DVVAPGSFSWHVLTA

SEQ ID NO: 100148 - protein, 15 aa, Mycobacterium tuberculosis
VVAPGSFSWHVLTAL

SEQ ID NO: 100149 - protein, 15 aa, Mycobacterium tuberculosis
VAPGSFSWHVLTALA

SEQ ID NO: 100150 - protein, 15 aa, Mycobacterium tuberculosis
APGSFSWHVLTALAD

SEQ ID NO: 100151 - protein, 15 aa, Mycobacterium tuberculosis
PGSFSWHVLTALADD

SEQ ID NO: 100152 - protein, 15 aa, Mycobacterium tuberculosis
GSFSWHVLTALADDV

SEQ ID NO: 100153 - protein, 15 aa, Mycobacterium tuberculosis
SFSWHVLTALADDVQ

SEQ ID NO: 100154 - protein, 15 aa, Mycobacterium tuberculosis
FSWHVLTALADDVQT

SEQ ID NO: 100155 - protein, 15 aa, Mycobacterium tuberculosis
SWHVLTALADDVQTF

SEQ ID NO: 100156 - protein, 15 aa, Mycobacterium tuberculosis
WHVLTALADDVQTFH

SEQ ID NO: 100157 - protein, 15 aa, Mycobacterium tuberculosis
HVLTALADDVQTFHD

SEQ ID NO: 100158 - protein, 15 aa, Mycobacterium tuberculosis
VLTALADDVQTFHDG

SEQ ID NO: 100159 - protein, 15 aa, Mycobacterium tuberculosis
LTALADDVQTFHDGR

SEQ ID NO: 100160 - protein, 15 aa, Mycobacterium tuberculosis
TALADDVQTFHDGRQ

SEQ ID NO: 100161 - protein, 15 aa, Mycobacterium tuberculosis
ALADDVQTFHDGRQP

SEQ ID NO: 100162 - protein, 15 aa, Mycobacterium tuberculosis
LADDVQTFHDGRQPD

SEQ ID NO: 100163 - protein, 15 aa, Mycobacterium tuberculosis
ADDVQTFHDGRQPDV

SEQ ID NO: 100164 - protein, 15 aa, Mycobacterium tuberculosis
DDVQTFHDGRQPDVA

SEQ ID NO: 100165 - protein, 15 aa, Mycobacterium tuberculosis
DVQTFHDGRQPDVAG

SEQ ID NO: 100166 - protein, 15 aa, Mycobacterium tuberculosis
VQTFHDGRQPDVAGS

SEQ ID NO: 100167 - protein, 15 aa, Mycobacterium tuberculosis
QTFHDGRQPDVAGSV

SEQ ID NO: 100168 - protein, 15 aa, Mycobacterium tuberculosis
TFHDGRQPDVAGSVF

SEQ ID NO: 100169 - protein, 15 aa, Mycobacterium tuberculosis
FHDGRQPDVAGSVFG

SEQ ID NO: 100170 - protein, 15 aa, Mycobacterium tuberculosis
HDGRQPDVAGSVFGI

SEQ ID NO: 100171 - protein, 15 aa, Mycobacterium tuberculosis
DGRQPDVAGSVFGIT

SEQ ID NO: 100172 - protein, 15 aa, Mycobacterium tuberculosis
GRQPDVAGSVFGITL

SEQ ID NO: 100173 - protein, 15 aa, Mycobacterium tuberculosis
RQPDVAGSVFGITLT

SEQ ID NO: 100174 - protein, 15 aa, Mycobacterium tuberculosis
QPDVAGSVFGITLTA

SEQ ID NO: 100175 - protein, 15 aa, Mycobacterium tuberculosis
PDVAGSVFGITLTAR

SEQ ID NO: 100176 - protein, 15 aa, Mycobacterium tuberculosis
DVAGSVFGITLTARR

SEQ ID NO: 100177 - protein, 15 aa, Mycobacterium tuberculosis
VAGSVFGITLTARRA

SEQ ID NO: 100178 - protein, 15 aa, Mycobacterium tuberculosis
AGSVFGITLTARRAA

SEQ ID NO: 100179 - protein, 15 aa, Mycobacterium tuberculosis
GSVFGITLTARRAAS

SEQ ID NO: 100180 - protein, 15 aa, Mycobacterium tuberculosis
SVFGITLTARRAASS

SEQ ID NO: 100181 - protein, 15 aa, Mycobacterium tuberculosis
VFGITLTARRAASSR

SEQ ID NO: 100182 - protein, 16 aa, Mycobacterium tuberculosis
MADSDLPTKGRQRGVR

SEQ ID NO: 100183 - protein, 16 aa, Mycobacterium tuberculosis
ADSDLPTKGRQRGVRA

SEQ ID NO: 100184 - protein, 16 aa, Mycobacterium tuberculosis
DSDLPTKGRQRGVRAV

SEQ ID NO: 100185 - protein, 16 aa, Mycobacterium tuberculosis
SDLPTKGRQRGVRAVE

SEQ ID NO: 100186 - protein, 16 aa, Mycobacterium tuberculosis
DLPTKGRQRGVRAVEL

SEQ ID NO: 100187 - protein, 16 aa, Mycobacterium tuberculosis
LPTKGRQRGVRAVELN

SEQ ID NO: 100188 - protein, 16 aa, Mycobacterium tuberculosis
PTKGRQRGVRAVELNV

SEQ ID NO: 100189 - protein, 16 aa, Mycobacterium tuberculosis
TKGRQRGVRAVELNVA

SEQ ID NO: 100190 - protein, 16 aa, Mycobacterium tuberculosis
KGRQRGVRAVELNVAA

SEQ ID NO: 100191 - protein, 16 aa, Mycobacterium tuberculosis
GRQRGVRAVELNVAAR

SEQ ID NO: 100192 - protein, 16 aa, Mycobacterium tuberculosis
RQRGVRAVELNVAARL

SEQ ID NO: 100193 - protein, 16 aa, Mycobacterium tuberculosis
QRGVRAVELNVAARLE

SEQ ID NO: 100194 - protein, 16 aa, Mycobacterium tuberculosis
RGVRAVELNVAARLEN

SEQ ID NO: 100195 - protein, 16 aa, Mycobacterium tuberculosis
GVRAVELNVAARLENL

SEQ ID NO: 100196 - protein, 16 aa, Mycobacterium tuberculosis
VRAVELNVAARLENLA

SEQ ID NO: 100197 - protein, 16 aa, Mycobacterium tuberculosis
RAVELNVAARLENLAL

SEQ ID NO: 100198 - protein, 16 aa, Mycobacterium tuberculosis
AVELNVAARLENLALL

SEQ ID NO: 100199 - protein, 16 aa, Mycobacterium tuberculosis
VELNVAARLENLALLR

SEQ ID NO: 100200 - protein, 16 aa, Mycobacterium tuberculosis
ELNVAARLENLALLRT

SEQ ID NO: 100201 - protein, 16 aa, Mycobacterium tuberculosis
LNVAARLENLALLRTL

SEQ ID NO: 100202 - protein, 16 aa, Mycobacterium tuberculosis
NVAARLENLALLRTLV

SEQ ID NO: 100203 - protein, 16 aa, Mycobacterium tuberculosis
VAARLENLALLRTLVG

SEQ ID NO: 100204 - protein, 16 aa, Mycobacterium tuberculosis
AARLENLALLRTLVGA

SEQ ID NO: 100205 - protein, 16 aa, Mycobacterium tuberculosis
ARLENLALLRTLVGAI

SEQ ID NO: 100206 - protein, 16 aa, Mycobacterium tuberculosis
RLENLALLRTLVGAIG

SEQ ID NO: 100207 - protein, 16 aa, Mycobacterium tuberculosis
LENLALLRTLVGAIGT

SEQ ID NO: 100208 - protein, 16 aa, Mycobacterium tuberculosis
ENLALLRTLVGAIGTF

SEQ ID NO: 100209 - protein, 16 aa, Mycobacterium tuberculosis
NLALLRTLVGAIGTFE

SEQ ID NO: 100210 - protein, 16 aa, Mycobacterium tuberculosis
LALLRTLVGAIGTFED

SEQ ID NO: 100211 - protein, 16 aa, Mycobacterium tuberculosis
ALLRTLVGAIGTFEDL

SEQ ID NO: 100212 - protein, 16 aa, Mycobacterium tuberculosis
LLRTLVGAIGTFEDLD

SEQ ID NO: 100213 - protein, 16 aa, Mycobacterium tuberculosis
LRTLVGAIGTFEDLDF

SEQ ID NO: 100214 - protein, 16 aa, Mycobacterium tuberculosis
RTLVGAIGTFEDLDFD

SEQ ID NO: 100215 - protein, 16 aa, Mycobacterium tuberculosis
TLVGAIGTFEDLDFDA

SEQ ID NO: 100216 - protein, 16 aa, Mycobacterium tuberculosis
LVGAIGTFEDLDFDAV

SEQ ID NO: 100217 - protein, 16 aa, Mycobacterium tuberculosis
VGAIGTFEDLDFDAVA

SEQ ID NO: 100218 - protein, 16 aa, Mycobacterium tuberculosis
GAIGTFEDLDFDAVAD

SEQ ID NO: 100219 - protein, 16 aa, Mycobacterium tuberculosis
AIGTFEDLDFDAVADL

SEQ ID NO: 100220 - protein, 16 aa, Mycobacterium tuberculosis
IGTFEDLDFDAVADLR

SEQ ID NO: 100221 - protein, 16 aa, Mycobacterium tuberculosis
GTFEDLDFDAVADLRL

SEQ ID NO: 100222 - protein, 16 aa, Mycobacterium tuberculosis
TFEDLDFDAVADLRLA

SEQ ID NO: 100223 - protein, 16 aa, Mycobacterium tuberculosis
FEDLDFDAVADLRLAV

SEQ ID NO: 100224 - protein, 16 aa, Mycobacterium tuberculosis
EDLDFDAVADLRLAVD

SEQ ID NO: 100225 - protein, 16 aa, Mycobacterium tuberculosis
DLDFDAVADLRLAVDE

SEQ ID NO: 100226 - protein, 16 aa, Mycobacterium tuberculosis
LDFDAVADLRLAVDEV

SEQ ID NO: 100227 - protein, 16 aa, Mycobacterium tuberculosis
DFDAVADLRLAVDEVC

SEQ ID NO: 100228 - protein, 16 aa, Mycobacterium tuberculosis
FDAVADLRLAVDEVCT

SEQ ID NO: 100229 - protein, 16 aa, Mycobacterium tuberculosis
DAVADLRLAVDEVCTR

SEQ ID NO: 100230 - protein, 16 aa, Mycobacterium tuberculosis
AVADLRLAVDEVCTRL

SEQ ID NO: 100231 - protein, 16 aa, Mycobacterium tuberculosis
VADLRLAVDEVCTRLI

SEQ ID NO: 100232 - protein, 16 aa, Mycobacterium tuberculosis
ADLRLAVDEVCTRLIR

SEQ ID NO: 100233 - protein, 16 aa, Mycobacterium tuberculosis
DLRLAVDEVCTRLIRS

SEQ ID NO: 100234 - protein, 16 aa, Mycobacterium tuberculosis
LRLAVDEVCTRLIRSA

SEQ ID NO: 100235 - protein, 16 aa, Mycobacterium tuberculosis
RLAVDEVCTRLIRSAL

SEQ ID NO: 100236 - protein, 16 aa, Mycobacterium tuberculosis
LAVDEVCTRLIRSALP

SEQ ID NO: 100237 - protein, 16 aa, Mycobacterium tuberculosis
AVDEVCTRLIRSALPD

SEQ ID NO: 100238 - protein, 16 aa, Mycobacterium tuberculosis
VDEVCTRLIRSALPDA

SEQ ID NO: 100239 - protein, 16 aa, Mycobacterium tuberculosis
DEVCTRLIRSALPDAT

SEQ ID NO: 100240 - protein, 16 aa, Mycobacterium tuberculosis
EVCTRLIRSALPDATL

SEQ ID NO: 100241 - protein, 16 aa, Mycobacterium tuberculosis
VCTRLIRSALPDATLR

SEQ ID NO: 100242 - protein, 16 aa, Mycobacterium tuberculosis
CTRLIRSALPDATLRL

SEQ ID NO: 100243 - protein, 16 aa, Mycobacterium tuberculosis
TRLIRSALPDATLRLV

SEQ ID NO: 100244 - protein, 16 aa, Mycobacterium tuberculosis
RLIRSALPDATLRLVV

SEQ ID NO: 100245 - protein, 16 aa, Mycobacterium tuberculosis
LIRSALPDATLRLVVD

SEQ ID NO: 100246 - protein, 16 aa, Mycobacterium tuberculosis
IRSALPDATLRLVVDP

SEQ ID NO: 100247 - protein, 16 aa, Mycobacterium tuberculosis
RSALPDATLRLVVDPR

SEQ ID NO: 100248 - protein, 16 aa, Mycobacterium tuberculosis
SALPDATLRLVVDPRK

SEQ ID NO: 100249 - protein, 16 aa, Mycobacterium tuberculosis
ALPDATLRLVVDPRKD

SEQ ID NO: 100250 - protein, 16 aa, Mycobacterium tuberculosis
LPDATLRLVVDPRKDE

SEQ ID NO: 100251 - protein, 16 aa, Mycobacterium tuberculosis
PDATLRLVVDPRKDEV

SEQ ID NO: 100252 - protein, 16 aa, Mycobacterium tuberculosis
DATLRLVVDPRKDEVV

SEQ ID NO: 100253 - protein, 16 aa, Mycobacterium tuberculosis
ATLRLVVDPRKDEVVV

SEQ ID NO: 100254 - protein, 16 aa, Mycobacterium tuberculosis
TLRLVVDPRKDEVVVE

SEQ ID NO: 100255 - protein, 16 aa, Mycobacterium tuberculosis
LRLVVDPRKDEVVVEA

SEQ ID NO: 100256 - protein, 16 aa, Mycobacterium tuberculosis
RLVVDPRKDEVVVEAS

SEQ ID NO: 100257 - protein, 16 aa, Mycobacterium tuberculosis
LVVDPRKDEVVVEASA

SEQ ID NO: 100258 - protein, 16 aa, Mycobacterium tuberculosis
VVDPRKDEVVVEASAA

SEQ ID NO: 100259 - protein, 16 aa, Mycobacterium tuberculosis
VDPRKDEVVVEASAAC

SEQ ID NO: 100260 - protein, 16 aa, Mycobacterium tuberculosis
DPRKDEVVVEASAACD

SEQ ID NO: 100261 - protein, 16 aa, Mycobacterium tuberculosis
PRKDEVVVEASAACDT

SEQ ID NO: 100262 - protein, 16 aa, Mycobacterium tuberculosis
RKDEVVVEASAACDTH

SEQ ID NO: 100263 - protein, 16 aa, Mycobacterium tuberculosis
KDEVVVEASAACDTHD

SEQ ID NO: 100264 - protein, 16 aa, Mycobacterium tuberculosis
DEVVVEASAACDTHDV

SEQ ID NO: 100265 - protein, 16 aa, Mycobacterium tuberculosis
EVVVEASAACDTHDVV

SEQ ID NO: 100266 - protein, 16 aa, Mycobacterium tuberculosis
VVVEASAACDTHDVVA

SEQ ID NO: 100267 - protein, 16 aa, Mycobacterium tuberculosis
VVEASAACDTHDVVAP

SEQ ID NO: 100268 - protein, 16 aa, Mycobacterium tuberculosis
VEASAACDTHDVVAPG

SEQ ID NO: 100269 - protein, 16 aa, Mycobacterium tuberculosis
EASAACDTHDVVAPGS

SEQ ID NO: 100270 - protein, 16 aa, Mycobacterium tuberculosis
ASAACDTHDVVAPGSF

SEQ ID NO: 100271 - protein, 16 aa, Mycobacterium tuberculosis
SAACDTHDVVAPGSFS

SEQ ID NO: 100272 - protein, 16 aa, Mycobacterium tuberculosis
AACDTHDVVAPGSFSW

SEQ ID NO: 100273 - protein, 16 aa, Mycobacterium tuberculosis
ACDTHDVVAPGSFSWH

SEQ ID NO: 100274 - protein, 16 aa, Mycobacterium tuberculosis
CDTHDVVAPGSFSWHV

SEQ ID NO: 100275 - protein, 16 aa, Mycobacterium tuberculosis
DTHDVVAPGSFSWHVL

SEQ ID NO: 100276 - protein, 16 aa, Mycobacterium tuberculosis
THDVVAPGSFSWHVLT

SEQ ID NO: 100277 - protein, 16 aa, Mycobacterium tuberculosis
HDVVAPGSFSWHVLTA

SEQ ID NO: 100278 - protein, 16 aa, Mycobacterium tuberculosis
DVVAPGSFSWHVLTAL

SEQ ID NO: 100279 - protein, 16 aa, Mycobacterium tuberculosis
VVAPGSFSWHVLTALA

SEQ ID NO: 100280 - protein, 16 aa, Mycobacterium tuberculosis
VAPGSFSWHVLTALAD

SEQ ID NO: 100281 - protein, 16 aa, Mycobacterium tuberculosis
APGSFSWHVLTALADD

SEQ ID NO: 100282 - protein, 16 aa, Mycobacterium tuberculosis
PGSFSWHVLTALADDV

SEQ ID NO: 100283 - protein, 16 aa, Mycobacterium tuberculosis
GSFSWHVLTALADDVQ

SEQ ID NO: 100284 - protein, 16 aa, Mycobacterium tuberculosis
SFSWHVLTALADDVQT

SEQ ID NO: 100285 - protein, 16 aa, Mycobacterium tuberculosis
FSWHVLTALADDVQTF

SEQ ID NO: 100286 - protein, 16 aa, Mycobacterium tuberculosis
SWHVLTALADDVQTFH

SEQ ID NO: 100287 - protein, 16 aa, Mycobacterium tuberculosis
WHVLTALADDVQTFHD

SEQ ID NO: 100288 - protein, 16 aa, Mycobacterium tuberculosis
HVLTALADDVQTFHDG

SEQ ID NO: 100289 - protein, 16 aa, Mycobacterium tuberculosis
VLTALADDVQTFHDGR

SEQ ID NO: 100290 - protein, 16 aa, Mycobacterium tuberculosis
LTALADDVQTFHDGRQ

SEQ ID NO: 100291 - protein, 16 aa, Mycobacterium tuberculosis
TALADDVQTFHDGRQP

SEQ ID NO: 100292 - protein, 16 aa, Mycobacterium tuberculosis
ALADDVQTFHDGRQPD

SEQ ID NO: 100293 - protein, 16 aa, Mycobacterium tuberculosis
LADDVQTFHDGRQPDV

SEQ ID NO: 100294 - protein, 16 aa, Mycobacterium tuberculosis
ADDVQTFHDGRQPDVA

SEQ ID NO: 100295 - protein, 16 aa, Mycobacterium tuberculosis
DDVQTFHDGRQPDVAG

SEQ ID NO: 100296 - protein, 16 aa, Mycobacterium tuberculosis
DVQTFHDGRQPDVAGS

SEQ ID NO: 100297 - protein, 16 aa, Mycobacterium tuberculosis
VQTFHDGRQPDVAGSV

SEQ ID NO: 100298 - protein, 16 aa, Mycobacterium tuberculosis
QTFHDGRQPDVAGSVF

SEQ ID NO: 100299 - protein, 16 aa, Mycobacterium tuberculosis
TFHDGRQPDVAGSVFG

SEQ ID NO: 100300 - protein, 16 aa, Mycobacterium tuberculosis
FHDGRQPDVAGSVFGI

SEQ ID NO: 100301 - protein, 16 aa, Mycobacterium tuberculosis
HDGRQPDVAGSVFGIT

SEQ ID NO: 100302 - protein, 16 aa, Mycobacterium tuberculosis
DGRQPDVAGSVFGITL

SEQ ID NO: 100303 - protein, 16 aa, Mycobacterium tuberculosis
GRQPDVAGSVFGITLT

SEQ ID NO: 100304 - protein, 16 aa, Mycobacterium tuberculosis
RQPDVAGSVFGITLTA

SEQ ID NO: 100305 - protein, 16 aa, Mycobacterium tuberculosis
QPDVAGSVFGITLTAR

SEQ ID NO: 100306 - protein, 16 aa, Mycobacterium tuberculosis
PDVAGSVFGITLTARR

SEQ ID NO: 100307 - protein, 16 aa, Mycobacterium tuberculosis
DVAGSVFGITLTARRA

SEQ ID NO: 100308 - protein, 16 aa, Mycobacterium tuberculosis
VAGSVFGITLTARRAA

SEQ ID NO: 100309 - protein, 16 aa, Mycobacterium tuberculosis
AGSVFGITLTARRAAS

SEQ ID NO: 100310 - protein, 16 aa, Mycobacterium tuberculosis
GSVFGITLTARRAASS

SEQ ID NO: 100311 - protein, 16 aa, Mycobacterium tuberculosis
SVFGITLTARRAASSR

SEQ ID NO: 100312 - protein, 13 aa, Mycobacterium tuberculosis
MGQIPPQPVRRVL

SEQ ID NO: 100313 - protein, 13 aa, Mycobacterium tuberculosis
GQIPPQPVRRVLP

SEQ ID NO: 100314 - protein, 13 aa, Mycobacterium tuberculosis
QIPPQPVRRVLPL

SEQ ID NO: 100315 - protein, 13 aa, Mycobacterium tuberculosis
IPPQPVRRVLPLM

SEQ ID NO: 100316 - protein, 13 aa, Mycobacterium tuberculosis
PPQPVRRVLPLMV

SEQ ID NO: 100317 - protein, 13 aa, Mycobacterium tuberculosis
PQPVRRVLPLMVV

SEQ ID NO: 100318 - protein, 13 aa, Mycobacterium tuberculosis
QPVRRVLPLMVVP

SEQ ID NO: 100319 - protein, 13 aa, Mycobacterium tuberculosis
PVRRVLPLMVVPG

SEQ ID NO: 100320 - protein, 13 aa, Mycobacterium tuberculosis
VRRVLPLMVVPGN

SEQ ID NO: 100321 - protein, 13 aa, Mycobacterium tuberculosis
RRVLPLMVVPGNG

SEQ ID NO: 100322 - protein, 13 aa, Mycobacterium tuberculosis
RVLPLMVVPGNGQ

SEQ ID NO: 100323 - protein, 13 aa, Mycobacterium tuberculosis
VLPLMVVPGNGQK

SEQ ID NO: 100324 - protein, 13 aa, Mycobacterium tuberculosis
LPLMVVPGNGQKW

SEQ ID NO: 100325 - protein, 13 aa, Mycobacterium tuberculosis
PLMVVPGNGQKWR

SEQ ID NO: 100326 - protein, 13 aa, Mycobacterium tuberculosis
LMVVPGNGQKWRN

SEQ ID NO: 100327 - protein, 13 aa, Mycobacterium tuberculosis
MVVPGNGQKWRNR

SEQ ID NO: 100328 - protein, 13 aa, Mycobacterium tuberculosis
VVPGNGQKWRNRT

SEQ ID NO: 100329 - protein, 13 aa, Mycobacterium tuberculosis
VPGNGQKWRNRTE

SEQ ID NO: 100330 - protein, 13 aa, Mycobacterium tuberculosis
PGNGQKWRNRTET

SEQ ID NO: 100331 - protein, 13 aa, Mycobacterium tuberculosis
GNGQKWRNRTETE

SEQ ID NO: 100332 - protein, 13 aa, Mycobacterium tuberculosis
NGQKWRNRTETEE

SEQ ID NO: 100333 - protein, 13 aa, Mycobacterium tuberculosis
GQKWRNRTETEEA

SEQ ID NO: 100334 - protein, 13 aa, Mycobacterium tuberculosis
QKWRNRTETEEAM

SEQ ID NO: 100335 - protein, 13 aa, Mycobacterium tuberculosis
KWRNRTETEEAMG

SEQ ID NO: 100336 - protein, 13 aa, Mycobacterium tuberculosis
WRNRTETEEAMGD

SEQ ID NO: 100337 - protein, 13 aa, Mycobacterium tuberculosis
RNRTETEEAMGDT

SEQ ID NO: 100338 - protein, 13 aa, Mycobacterium tuberculosis
NRTETEEAMGDTY

SEQ ID NO: 100339 - protein, 13 aa, Mycobacterium tuberculosis
RTETEEAMGDTYR

SEQ ID NO: 100340 - protein, 13 aa, Mycobacterium tuberculosis
TETEEAMGDTYRD

SEQ ID NO: 100341 - protein, 13 aa, Mycobacterium tuberculosis
ETEEAMGDTYRDP

SEQ ID NO: 100342 - protein, 13 aa, Mycobacterium tuberculosis
TEEAMGDTYRDPV

SEQ ID NO: 100343 - protein, 13 aa, Mycobacterium tuberculosis
EEAMGDTYRDPVD

SEQ ID NO: 100344 - protein, 13 aa, Mycobacterium tuberculosis
EAMGDTYRDPVDH

SEQ ID NO: 100345 - protein, 13 aa, Mycobacterium tuberculosis
AMGDTYRDPVDHL

SEQ ID NO: 100346 - protein, 13 aa, Mycobacterium tuberculosis
MGDTYRDPVDHLR

SEQ ID NO: 100347 - protein, 13 aa, Mycobacterium tuberculosis
GDTYRDPVDHLRT

SEQ ID NO: 100348 - protein, 13 aa, Mycobacterium tuberculosis
DTYRDPVDHLRTT

SEQ ID NO: 100349 - protein, 13 aa, Mycobacterium tuberculosis
TYRDPVDHLRTTR

SEQ ID NO: 100350 - protein, 13 aa, Mycobacterium tuberculosis
YRDPVDHLRTTRP

SEQ ID NO: 100351 - protein, 13 aa, Mycobacterium tuberculosis
RDPVDHLRTTRPL

SEQ ID NO: 100352 - protein, 13 aa, Mycobacterium tuberculosis
DPVDHLRTTRPLA

SEQ ID NO: 100353 - protein, 13 aa, Mycobacterium tuberculosis
PVDHLRTTRPLAG

SEQ ID NO: 100354 - protein, 13 aa, Mycobacterium tuberculosis
VDHLRTTRPLAGE

SEQ ID NO: 100355 - protein, 13 aa, Mycobacterium tuberculosis
DHLRTTRPLAGES

SEQ ID NO: 100356 - protein, 13 aa, Mycobacterium tuberculosis
HLRTTRPLAGESL

SEQ ID NO: 100357 - protein, 13 aa, Mycobacterium tuberculosis
LRTTRPLAGESLI

SEQ ID NO: 100358 - protein, 13 aa, Mycobacterium tuberculosis
RTTRPLAGESLID

SEQ ID NO: 100359 - protein, 13 aa, Mycobacterium tuberculosis
TTRPLAGESLIDV

SEQ ID NO: 100360 - protein, 13 aa, Mycobacterium tuberculosis
TRPLAGESLIDVV

SEQ ID NO: 100361 - protein, 13 aa, Mycobacterium tuberculosis
RPLAGESLIDVVH

SEQ ID NO: 100362 - protein, 13 aa, Mycobacterium tuberculosis
PLAGESLIDVVHW

SEQ ID NO: 100363 - protein, 13 aa, Mycobacterium tuberculosis
LAGESLIDVVHWP

SEQ ID NO: 100364 - protein, 13 aa, Mycobacterium tuberculosis
AGESLIDVVHWPG

SEQ ID NO: 100365 - protein, 13 aa, Mycobacterium tuberculosis
GESLIDVVHWPGY

SEQ ID NO: 100366 - protein, 13 aa, Mycobacterium tuberculosis
ESLIDVVHWPGYL

SEQ ID NO: 100367 - protein, 13 aa, Mycobacterium tuberculosis
SLIDVVHWPGYLL

SEQ ID NO: 100368 - protein, 13 aa, Mycobacterium tuberculosis
LIDVVHWPGYLLI

SEQ ID NO: 100369 - protein, 13 aa, Mycobacterium tuberculosis
IDVVHWPGYLLIV

SEQ ID NO: 100370 - protein, 13 aa, Mycobacterium tuberculosis
DVVHWPGYLLIVA

SEQ ID NO: 100371 - protein, 13 aa, Mycobacterium tuberculosis
VVHWPGYLLIVAG

SEQ ID NO: 100372 - protein, 13 aa, Mycobacterium tuberculosis
VHWPGYLLIVAGV

SEQ ID NO: 100373 - protein, 13 aa, Mycobacterium tuberculosis
HWPGYLLIVAGVV

SEQ ID NO: 100374 - protein, 13 aa, Mycobacterium tuberculosis
WPGYLLIVAGVVG

SEQ ID NO: 100375 - protein, 13 aa, Mycobacterium tuberculosis
PGYLLIVAGVVGG

SEQ ID NO: 100376 - protein, 13 aa, Mycobacterium tuberculosis
GYLLIVAGVVGGV

SEQ ID NO: 100377 - protein, 13 aa, Mycobacterium tuberculosis
YLLIVAGVVGGVG

SEQ ID NO: 100378 - protein, 13 aa, Mycobacterium tuberculosis
LLIVAGVVGGVGA

SEQ ID NO: 100379 - protein, 13 aa, Mycobacterium tuberculosis
LIVAGVVGGVGAL

SEQ ID NO: 100380 - protein, 13 aa, Mycobacterium tuberculosis
IVAGVVGGVGALA

SEQ ID NO: 100381 - protein, 13 aa, Mycobacterium tuberculosis
VAGVVGGVGALAA

SEQ ID NO: 100382 - protein, 13 aa, Mycobacterium tuberculosis
AGVVGGVGALAAF

SEQ ID NO: 100383 - protein, 13 aa, Mycobacterium tuberculosis
GVVGGVGALAAFG

SEQ ID NO: 100384 - protein, 13 aa, Mycobacterium tuberculosis
VVGGVGALAAFGT

SEQ ID NO: 100385 - protein, 13 aa, Mycobacterium tuberculosis
VGGVGALAAFGTG

SEQ ID NO: 100386 - protein, 13 aa, Mycobacterium tuberculosis
GGVGALAAFGTGH

SEQ ID NO: 100387 - protein, 13 aa, Mycobacterium tuberculosis
GVGALAAFGTGHH

SEQ ID NO: 100388 - protein, 13 aa, Mycobacterium tuberculosis
VGALAAFGTGHHA

SEQ ID NO: 100389 - protein, 13 aa, Mycobacterium tuberculosis
GALAAFGTGHHAE

SEQ ID NO: 100390 - protein, 13 aa, Mycobacterium tuberculosis
ALAAFGTGHHAEG

SEQ ID NO: 100391 - protein, 13 aa, Mycobacterium tuberculosis
LAAFGTGHHAEGM

SEQ ID NO: 100392 - protein, 13 aa, Mycobacterium tuberculosis
AAFGTGHHAEGMT

SEQ ID NO: 100393 - protein, 13 aa, Mycobacterium tuberculosis
AFGTGHHAEGMTF

SEQ ID NO: 100394 - protein, 13 aa, Mycobacterium tuberculosis
FGTGHHAEGMTFG

SEQ ID NO: 100395 - protein, 13 aa, Mycobacterium tuberculosis
GTGHHAEGMTFGV

SEQ ID NO: 100396 - protein, 13 aa, Mycobacterium tuberculosis
TGHHAEGMTFGVV

SEQ ID NO: 100397 - protein, 13 aa, Mycobacterium tuberculosis
GHHAEGMTFGVVA

SEQ ID NO: 100398 - protein, 13 aa, Mycobacterium tuberculosis
HHAEGMTFGVVAI

SEQ ID NO: 100399 - protein, 13 aa, Mycobacterium tuberculosis
HAEGMTFGVVAIV

SEQ ID NO: 100400 - protein, 13 aa, Mycobacterium tuberculosis
AEGMTFGVVAIVV

SEQ ID NO: 100401 - protein, 13 aa, Mycobacterium tuberculosis
EGMTFGVVAIVVT

SEQ ID NO: 100402 - protein, 13 aa, Mycobacterium tuberculosis
GMTFGVVAIVVTV

SEQ ID NO: 100403 - protein, 13 aa, Mycobacterium tuberculosis
MTFGVVAIVVTVV

SEQ ID NO: 100404 - protein, 13 aa, Mycobacterium tuberculosis
TFGVVAIVVTVVG

SEQ ID NO: 100405 - protein, 13 aa, Mycobacterium tuberculosis
FGVVAIVVTVVGL

SEQ ID NO: 100406 - protein, 13 aa, Mycobacterium tuberculosis
GVVAIVVTVVGLA

SEQ ID NO: 100407 - protein, 13 aa, Mycobacterium tuberculosis
VVAIVVTVVGLAW

SEQ ID NO: 100408 - protein, 13 aa, Mycobacterium tuberculosis
VAIVVTVVGLAWL

SEQ ID NO: 100409 - protein, 13 aa, Mycobacterium tuberculosis
AIVVTVVGLAWLA

SEQ ID NO: 100410 - protein, 13 aa, Mycobacterium tuberculosis
IVVTVVGLAWLAF

SEQ ID NO: 100411 - protein, 13 aa, Mycobacterium tuberculosis
VVTVVGLAWLAFE

SEQ ID NO: 100412 - protein, 13 aa, Mycobacterium tuberculosis
VTVVGLAWLAFEH

SEQ ID NO: 100413 - protein, 13 aa, Mycobacterium tuberculosis
TVVGLAWLAFEHR

SEQ ID NO: 100414 - protein, 13 aa, Mycobacterium tuberculosis
VVGLAWLAFEHRR

SEQ ID NO: 100415 - protein, 13 aa, Mycobacterium tuberculosis
VGLAWLAFEHRRI

SEQ ID NO: 100416 - protein, 13 aa, Mycobacterium tuberculosis
GLAWLAFEHRRIR

SEQ ID NO: 100417 - protein, 13 aa, Mycobacterium tuberculosis
LAWLAFEHRRIRK

SEQ ID NO: 100418 - protein, 13 aa, Mycobacterium tuberculosis
AWLAFEHRRIRKI

SEQ ID NO: 100419 - protein, 13 aa, Mycobacterium tuberculosis
WLAFEHRRIRKIA

SEQ ID NO: 100420 - protein, 13 aa, Mycobacterium tuberculosis
LAFEHRRIRKIAD

SEQ ID NO: 100421 - protein, 13 aa, Mycobacterium tuberculosis
AFEHRRIRKIADR

SEQ ID NO: 100422 - protein, 13 aa, Mycobacterium tuberculosis
FEHRRIRKIADRW

SEQ ID NO: 100423 - protein, 13 aa, Mycobacterium tuberculosis
EHRRIRKIADRWY

SEQ ID NO: 100424 - protein, 13 aa, Mycobacterium tuberculosis
HRRIRKIADRWYT

SEQ ID NO: 100425 - protein, 13 aa, Mycobacterium tuberculosis
RRIRKIADRWYTE

SEQ ID NO: 100426 - protein, 13 aa, Mycobacterium tuberculosis
RIRKIADRWYTEH

SEQ ID NO: 100427 - protein, 13 aa, Mycobacterium tuberculosis
IRKIADRWYTEHP

SEQ ID NO: 100428 - protein, 13 aa, Mycobacterium tuberculosis
RKIADRWYTEHPE

SEQ ID NO: 100429 - protein, 13 aa, Mycobacterium tuberculosis
KIADRWYTEHPEV

SEQ ID NO: 100430 - protein, 13 aa, Mycobacterium tuberculosis
IADRWYTEHPEVR

SEQ ID NO: 100431 - protein, 13 aa, Mycobacterium tuberculosis
ADRWYTEHPEVRR

SEQ ID NO: 100432 - protein, 13 aa, Mycobacterium tuberculosis
DRWYTEHPEVRRQ

SEQ ID NO: 100433 - protein, 13 aa, Mycobacterium tuberculosis
RWYTEHPEVRRQR

SEQ ID NO: 100434 - protein, 13 aa, Mycobacterium tuberculosis
WYTEHPEVRRQRL

SEQ ID NO: 100435 - protein, 13 aa, Mycobacterium tuberculosis
YTEHPEVRRQRLA

SEQ ID NO: 100436 - protein, 13 aa, Mycobacterium tuberculosis
TEHPEVRRQRLAG

SEQ ID NO: 100437 - protein, 14 aa, Mycobacterium tuberculosis
MGQIPPQPVRRVLP

SEQ ID NO: 100438 - protein, 14 aa, Mycobacterium tuberculosis
GQIPPQPVRRVLPL

SEQ ID NO: 100439 - protein, 14 aa, Mycobacterium tuberculosis
QIPPQPVRRVLPLM

SEQ ID NO: 100440 - protein, 14 aa, Mycobacterium tuberculosis
IPPQPVRRVLPLMV

SEQ ID NO: 100441 - protein, 14 aa, Mycobacterium tuberculosis
PPQPVRRVLPLMVV

SEQ ID NO: 100442 - protein, 14 aa, Mycobacterium tuberculosis
PQPVRRVLPLMVVP

SEQ ID NO: 100443 - protein, 14 aa, Mycobacterium tuberculosis
QPVRRVLPLMVVPG

SEQ ID NO: 100444 - protein, 14 aa, Mycobacterium tuberculosis
PVRRVLPLMVVPGN

SEQ ID NO: 100445 - protein, 14 aa, Mycobacterium tuberculosis
VRRVLPLMVVPGNG

SEQ ID NO: 100446 - protein, 14 aa, Mycobacterium tuberculosis
RRVLPLMVVPGNGQ

SEQ ID NO: 100447 - protein, 14 aa, Mycobacterium tuberculosis
RVLPLMVVPGNGQK

SEQ ID NO: 100448 - protein, 14 aa, Mycobacterium tuberculosis
VLPLMVVPGNGQKW

SEQ ID NO: 100449 - protein, 14 aa, Mycobacterium tuberculosis
LPLMVVPGNGQKWR

SEQ ID NO: 100450 - protein, 14 aa, Mycobacterium tuberculosis
PLMVVPGNGQKWRN

SEQ ID NO: 100451 - protein, 14 aa, Mycobacterium tuberculosis
LMVVPGNGQKWRNR

SEQ ID NO: 100452 - protein, 14 aa, Mycobacterium tuberculosis
MVVPGNGQKWRNRT

SEQ ID NO: 100453 - protein, 14 aa, Mycobacterium tuberculosis
VVPGNGQKWRNRTE

SEQ ID NO: 100454 - protein, 14 aa, Mycobacterium tuberculosis
VPGNGQKWRNRTET

SEQ ID NO: 100455 - protein, 14 aa, Mycobacterium tuberculosis
PGNGQKWRNRTETE

SEQ ID NO: 100456 - protein, 14 aa, Mycobacterium tuberculosis
GNGQKWRNRTETEE

SEQ ID NO: 100457 - protein, 14 aa, Mycobacterium tuberculosis
NGQKWRNRTETEEA

SEQ ID NO: 100458 - protein, 14 aa, Mycobacterium tuberculosis
GQKWRNRTETEEAM

SEQ ID NO: 100459 - protein, 14 aa, Mycobacterium tuberculosis
QKWRNRTETEEAMG

SEQ ID NO: 100460 - protein, 14 aa, Mycobacterium tuberculosis
KWRNRTETEEAMGD

SEQ ID NO: 100461 - protein, 14 aa, Mycobacterium tuberculosis
WRNRTETEEAMGDT

SEQ ID NO: 100462 - protein, 14 aa, Mycobacterium tuberculosis
RNRTETEEAMGDTY

SEQ ID NO: 100463 - protein, 14 aa, Mycobacterium tuberculosis
NRTETEEAMGDTYR

SEQ ID NO: 100464 - protein, 14 aa, Mycobacterium tuberculosis
RTETEEAMGDTYRD

SEQ ID NO: 100465 - protein, 14 aa, Mycobacterium tuberculosis
TETEEAMGDTYRDP

SEQ ID NO: 100466 - protein, 14 aa, Mycobacterium tuberculosis
ETEEAMGDTYRDPV

SEQ ID NO: 100467 - protein, 14 aa, Mycobacterium tuberculosis
TEEAMGDTYRDPVD

SEQ ID NO: 100468 - protein, 14 aa, Mycobacterium tuberculosis
EEAMGDTYRDPVDH

SEQ ID NO: 100469 - protein, 14 aa, Mycobacterium tuberculosis
EAMGDTYRDPVDHL

SEQ ID NO: 100470 - protein, 14 aa, Mycobacterium tuberculosis
AMGDTYRDPVDHLR

SEQ ID NO: 100471 - protein, 14 aa, Mycobacterium tuberculosis
MGDTYRDPVDHLRT

SEQ ID NO: 100472 - protein, 14 aa, Mycobacterium tuberculosis
GDTYRDPVDHLRTT

SEQ ID NO: 100473 - protein, 14 aa, Mycobacterium tuberculosis
DTYRDPVDHLRTTR

SEQ ID NO: 100474 - protein, 14 aa, Mycobacterium tuberculosis
TYRDPVDHLRTTRP

SEQ ID NO: 100475 - protein, 14 aa, Mycobacterium tuberculosis
YRDPVDHLRTTRPL

SEQ ID NO: 100476 - protein, 14 aa, Mycobacterium tuberculosis
RDPVDHLRTTRPLA

SEQ ID NO: 100477 - protein, 14 aa, Mycobacterium tuberculosis
DPVDHLRTTRPLAG

SEQ ID NO: 100478 - protein, 14 aa, Mycobacterium tuberculosis
PVDHLRTTRPLAGE

SEQ ID NO: 100479 - protein, 14 aa, Mycobacterium tuberculosis
VDHLRTTRPLAGES

SEQ ID NO: 100480 - protein, 14 aa, Mycobacterium tuberculosis
DHLRTTRPLAGESL

SEQ ID NO: 100481 - protein, 14 aa, Mycobacterium tuberculosis
HLRTTRPLAGESLI

SEQ ID NO: 100482 - protein, 14 aa, Mycobacterium tuberculosis
LRTTRPLAGESLID

SEQ ID NO: 100483 - protein, 14 aa, Mycobacterium tuberculosis
RTTRPLAGESLIDV

SEQ ID NO: 100484 - protein, 14 aa, Mycobacterium tuberculosis
TTRPLAGESLIDVV

SEQ ID NO: 100485 - protein, 14 aa, Mycobacterium tuberculosis
TRPLAGESLIDVVH

SEQ ID NO: 100486 - protein, 14 aa, Mycobacterium tuberculosis
RPLAGESLIDVVHW

SEQ ID NO: 100487 - protein, 14 aa, Mycobacterium tuberculosis
PLAGESLIDVVHWP

SEQ ID NO: 100488 - protein, 14 aa, Mycobacterium tuberculosis
LAGESLIDVVHWPG

SEQ ID NO: 100489 - protein, 14 aa, Mycobacterium tuberculosis
AGESLIDVVHWPGY

SEQ ID NO: 100490 - protein, 14 aa, Mycobacterium tuberculosis
GESLIDVVHWPGYL

SEQ ID NO: 100491 - protein, 14 aa, Mycobacterium tuberculosis
ESLIDVVHWPGYLL

SEQ ID NO: 100492 - protein, 14 aa, Mycobacterium tuberculosis
SLIDVVHWPGYLLI

SEQ ID NO: 100493 - protein, 14 aa, Mycobacterium tuberculosis
LIDVVHWPGYLLIV

SEQ ID NO: 100494 - protein, 14 aa, Mycobacterium tuberculosis
IDVVHWPGYLLIVA

SEQ ID NO: 100495 - protein, 14 aa, Mycobacterium tuberculosis
DVVHWPGYLLIVAG

SEQ ID NO: 100496 - protein, 14 aa, Mycobacterium tuberculosis
VVHWPGYLLIVAGV

SEQ ID NO: 100497 - protein, 14 aa, Mycobacterium tuberculosis
VHWPGYLLIVAGVV

SEQ ID NO: 100498 - protein, 14 aa, Mycobacterium tuberculosis
HWPGYLLIVAGVVG

SEQ ID NO: 100499 - protein, 14 aa, Mycobacterium tuberculosis
WPGYLLIVAGVVGG

SEQ ID NO: 100500 - protein, 14 aa, Mycobacterium tuberculosis
PGYLLIVAGVVGGV

SEQ ID NO: 100501 - protein, 14 aa, Mycobacterium tuberculosis
GYLLIVAGVVGGVG

SEQ ID NO: 100502 - protein, 14 aa, Mycobacterium tuberculosis
YLLIVAGVVGGVGA

SEQ ID NO: 100503 - protein, 14 aa, Mycobacterium tuberculosis
LLIVAGVVGGVGAL

SEQ ID NO: 100504 - protein, 14 aa, Mycobacterium tuberculosis
LIVAGVVGGVGALA

SEQ ID NO: 100505 - protein, 14 aa, Mycobacterium tuberculosis
IVAGVVGGVGALAA

SEQ ID NO: 100506 - protein, 14 aa, Mycobacterium tuberculosis
VAGVVGGVGALAAF

SEQ ID NO: 100507 - protein, 14 aa, Mycobacterium tuberculosis
AGVVGGVGALAAFG

SEQ ID NO: 100508 - protein, 14 aa, Mycobacterium tuberculosis
GVVGGVGALAAFGT

SEQ ID NO: 100509 - protein, 14 aa, Mycobacterium tuberculosis
VVGGVGALAAFGTG

SEQ ID NO: 100510 - protein, 14 aa, Mycobacterium tuberculosis
VGGVGALAAFGTGH

SEQ ID NO: 100511 - protein, 14 aa, Mycobacterium tuberculosis
GGVGALAAFGTGHH

SEQ ID NO: 100512 - protein, 14 aa, Mycobacterium tuberculosis
GVGALAAFGTGHHA

SEQ ID NO: 100513 - protein, 14 aa, Mycobacterium tuberculosis
VGALAAFGTGHHAE

SEQ ID NO: 100514 - protein, 14 aa, Mycobacterium tuberculosis
GALAAFGTGHHAEG

SEQ ID NO: 100515 - protein, 14 aa, Mycobacterium tuberculosis
ALAAFGTGHHAEGM

SEQ ID NO: 100516 - protein, 14 aa, Mycobacterium tuberculosis
LAAFGTGHHAEGMT

SEQ ID NO: 100517 - protein, 14 aa, Mycobacterium tuberculosis
AAFGTGHHAEGMTF

SEQ ID NO: 100518 - protein, 14 aa, Mycobacterium tuberculosis
AFGTGHHAEGMTFG

SEQ ID NO: 100519 - protein, 14 aa, Mycobacterium tuberculosis
FGTGHHAEGMTFGV

SEQ ID NO: 100520 - protein, 14 aa, Mycobacterium tuberculosis
GTGHHAEGMTFGVV

SEQ ID NO: 100521 - protein, 14 aa, Mycobacterium tuberculosis
TGHHAEGMTFGVVA

SEQ ID NO: 100522 - protein, 14 aa, Mycobacterium tuberculosis
GHHAEGMTFGVVAI

SEQ ID NO: 100523 - protein, 14 aa, Mycobacterium tuberculosis
HHAEGMTFGVVAIV

SEQ ID NO: 100524 - protein, 14 aa, Mycobacterium tuberculosis
HAEGMTFGVVAIVV

SEQ ID NO: 100525 - protein, 14 aa, Mycobacterium tuberculosis
AEGMTFGVVAIVVT

SEQ ID NO: 100526 - protein, 14 aa, Mycobacterium tuberculosis
EGMTFGVVAIVVTV

SEQ ID NO: 100527 - protein, 14 aa, Mycobacterium tuberculosis
GMTFGVVAIVVTVV

SEQ ID NO: 100528 - protein, 14 aa, Mycobacterium tuberculosis
MTFGVVAIVVTVVG

SEQ ID NO: 100529 - protein, 14 aa, Mycobacterium tuberculosis
TFGVVAIVVTVVGL

SEQ ID NO: 100530 - protein, 14 aa, Mycobacterium tuberculosis
FGVVAIVVTVVGLA

SEQ ID NO: 100531 - protein, 14 aa, Mycobacterium tuberculosis
GVVAIVVTVVGLAW

SEQ ID NO: 100532 - protein, 14 aa, Mycobacterium tuberculosis
VVAIVVTVVGLAWL

SEQ ID NO: 100533 - protein, 14 aa, Mycobacterium tuberculosis
VAIVVTVVGLAWLA

SEQ ID NO: 100534 - protein, 14 aa, Mycobacterium tuberculosis
AIVVTVVGLAWLAF

SEQ ID NO: 100535 - protein, 14 aa, Mycobacterium tuberculosis
IVVTVVGLAWLAFE

SEQ ID NO: 100536 - protein, 14 aa, Mycobacterium tuberculosis
VVTVVGLAWLAFEH

SEQ ID NO: 100537 - protein, 14 aa, Mycobacterium tuberculosis
VTVVGLAWLAFEHR

SEQ ID NO: 100538 - protein, 14 aa, Mycobacterium tuberculosis
TVVGLAWLAFEHRR

SEQ ID NO: 100539 - protein, 14 aa, Mycobacterium tuberculosis
VVGLAWLAFEHRRI

SEQ ID NO: 100540 - protein, 14 aa, Mycobacterium tuberculosis
VGLAWLAFEHRRIR

SEQ ID NO: 100541 - protein, 14 aa, Mycobacterium tuberculosis
GLAWLAFEHRRIRK

SEQ ID NO: 100542 - protein, 14 aa, Mycobacterium tuberculosis
LAWLAFEHRRIRKI

SEQ ID NO: 100543 - protein, 14 aa, Mycobacterium tuberculosis
AWLAFEHRRIRKIA

SEQ ID NO: 100544 - protein, 14 aa, Mycobacterium tuberculosis
WLAFEHRRIRKIAD

SEQ ID NO: 100545 - protein, 14 aa, Mycobacterium tuberculosis
LAFEHRRIRKIADR

SEQ ID NO: 100546 - protein, 14 aa, Mycobacterium tuberculosis
AFEHRRIRKIADRW

SEQ ID NO: 100547 - protein, 14 aa, Mycobacterium tuberculosis
FEHRRIRKIADRWY

SEQ ID NO: 100548 - protein, 14 aa, Mycobacterium tuberculosis
EHRRIRKIADRWYT

SEQ ID NO: 100549 - protein, 14 aa, Mycobacterium tuberculosis
HRRIRKIADRWYTE

SEQ ID NO: 100550 - protein, 14 aa, Mycobacterium tuberculosis
RRIRKIADRWYTEH

SEQ ID NO: 100551 - protein, 14 aa, Mycobacterium tuberculosis
RIRKIADRWYTEHP

SEQ ID NO: 100552 - protein, 14 aa, Mycobacterium tuberculosis
IRKIADRWYTEHPE

SEQ ID NO: 100553 - protein, 14 aa, Mycobacterium tuberculosis
RKIADRWYTEHPEV

SEQ ID NO: 100554 - protein, 14 aa, Mycobacterium tuberculosis
KIADRWYTEHPEVR

SEQ ID NO: 100555 - protein, 14 aa, Mycobacterium tuberculosis
IADRWYTEHPEVRR

SEQ ID NO: 100556 - protein, 14 aa, Mycobacterium tuberculosis
ADRWYTEHPEVRRQ

SEQ ID NO: 100557 - protein, 14 aa, Mycobacterium tuberculosis
DRWYTEHPEVRRQR

SEQ ID NO: 100558 - protein, 14 aa, Mycobacterium tuberculosis
RWYTEHPEVRRQRL

SEQ ID NO: 100559 - protein, 14 aa, Mycobacterium tuberculosis
WYTEHPEVRRQRLA

SEQ ID NO: 100560 - protein, 14 aa, Mycobacterium tuberculosis
YTEHPEVRRQRLAG

SEQ ID NO: 100561 - protein, 15 aa, Mycobacterium tuberculosis
MGQIPPQPVRRVLPL

SEQ ID NO: 100562 - protein, 15 aa, Mycobacterium tuberculosis
GQIPPQPVRRVLPLM

SEQ ID NO: 100563 - protein, 15 aa, Mycobacterium tuberculosis
QIPPQPVRRVLPLMV

SEQ ID NO: 100564 - protein, 15 aa, Mycobacterium tuberculosis
IPPQPVRRVLPLMVV

SEQ ID NO: 100565 - protein, 15 aa, Mycobacterium tuberculosis
PPQPVRRVLPLMVVP

SEQ ID NO: 100566 - protein, 15 aa, Mycobacterium tuberculosis
PQPVRRVLPLMVVPG

SEQ ID NO: 100567 - protein, 15 aa, Mycobacterium tuberculosis
QPVRRVLPLMVVPGN

SEQ ID NO: 100568 - protein, 15 aa, Mycobacterium tuberculosis
PVRRVLPLMVVPGNG

SEQ ID NO: 100569 - protein, 15 aa, Mycobacterium tuberculosis
VRRVLPLMVVPGNGQ

SEQ ID NO: 100570 - protein, 15 aa, Mycobacterium tuberculosis
RRVLPLMVVPGNGQK

SEQ ID NO: 100571 - protein, 15 aa, Mycobacterium tuberculosis
RVLPLMVVPGNGQKW

SEQ ID NO: 100572 - protein, 15 aa, Mycobacterium tuberculosis
VLPLMVVPGNGQKWR

SEQ ID NO: 100573 - protein, 15 aa, Mycobacterium tuberculosis
LPLMVVPGNGQKWRN

SEQ ID NO: 100574 - protein, 15 aa, Mycobacterium tuberculosis
PLMVVPGNGQKWRNR

SEQ ID NO: 100575 - protein, 15 aa, Mycobacterium tuberculosis
LMVVPGNGQKWRNRT

SEQ ID NO: 100576 - protein, 15 aa, Mycobacterium tuberculosis
MVVPGNGQKWRNRTE

SEQ ID NO: 100577 - protein, 15 aa, Mycobacterium tuberculosis
VVPGNGQKWRNRTET

SEQ ID NO: 100578 - protein, 15 aa, Mycobacterium tuberculosis
VPGNGQKWRNRTETE

SEQ ID NO: 100579 - protein, 15 aa, Mycobacterium tuberculosis
PGNGQKWRNRTETEE

SEQ ID NO: 100580 - protein, 15 aa, Mycobacterium tuberculosis
GNGQKWRNRTETEEA

SEQ ID NO: 100581 - protein, 15 aa, Mycobacterium tuberculosis
NGQKWRNRTETEEAM

SEQ ID NO: 100582 - protein, 15 aa, Mycobacterium tuberculosis
GQKWRNRTETEEAMG

SEQ ID NO: 100583 - protein, 15 aa, Mycobacterium tuberculosis
QKWRNRTETEEAMGD

SEQ ID NO: 100584 - protein, 15 aa, Mycobacterium tuberculosis
KWRNRTETEEAMGDT

SEQ ID NO: 100585 - protein, 15 aa, Mycobacterium tuberculosis
WRNRTETEEAMGDTY

SEQ ID NO: 100586 - protein, 15 aa, Mycobacterium tuberculosis
RNRTETEEAMGDTYR

SEQ ID NO: 100587 - protein, 15 aa, Mycobacterium tuberculosis
NRTETEEAMGDTYRD

SEQ ID NO: 100588 - protein, 15 aa, Mycobacterium tuberculosis
RTETEEAMGDTYRDP

SEQ ID NO: 100589 - protein, 15 aa, Mycobacterium tuberculosis
TETEEAMGDTYRDPV

SEQ ID NO: 100590 - protein, 15 aa, Mycobacterium tuberculosis
ETEEAMGDTYRDPVD

SEQ ID NO: 100591 - protein, 15 aa, Mycobacterium tuberculosis
TEEAMGDTYRDPVDH

SEQ ID NO: 100592 - protein, 15 aa, Mycobacterium tuberculosis
EEAMGDTYRDPVDHL

SEQ ID NO: 100593 - protein, 15 aa, Mycobacterium tuberculosis
EAMGDTYRDPVDHLR

SEQ ID NO: 100594 - protein, 15 aa, Mycobacterium tuberculosis
AMGDTYRDPVDHLRT

SEQ ID NO: 100595 - protein, 15 aa, Mycobacterium tuberculosis
MGDTYRDPVDHLRTT

SEQ ID NO: 100596 - protein, 15 aa, Mycobacterium tuberculosis
GDTYRDPVDHLRTTR

SEQ ID NO: 100597 - protein, 15 aa, Mycobacterium tuberculosis
DTYRDPVDHLRTTRP

SEQ ID NO: 100598 - protein, 15 aa, Mycobacterium tuberculosis
TYRDPVDHLRTTRPL

SEQ ID NO: 100599 - protein, 15 aa, Mycobacterium tuberculosis
YRDPVDHLRTTRPLA

SEQ ID NO: 100600 - protein, 15 aa, Mycobacterium tuberculosis
RDPVDHLRTTRPLAG

SEQ ID NO: 100601 - protein, 15 aa, Mycobacterium tuberculosis
DPVDHLRTTRPLAGE

SEQ ID NO: 100602 - protein, 15 aa, Mycobacterium tuberculosis
PVDHLRTTRPLAGES

SEQ ID NO: 100603 - protein, 15 aa, Mycobacterium tuberculosis
VDHLRTTRPLAGESL

SEQ ID NO: 100604 - protein, 15 aa, Mycobacterium tuberculosis
DHLRTTRPLAGESLI

SEQ ID NO: 100605 - protein, 15 aa, Mycobacterium tuberculosis
HLRTTRPLAGESLID

SEQ ID NO: 100606 - protein, 15 aa, Mycobacterium tuberculosis
LRTTRPLAGESLIDV

SEQ ID NO: 100607 - protein, 15 aa, Mycobacterium tuberculosis
RTTRPLAGESLIDVV

SEQ ID NO: 100608 - protein, 15 aa, Mycobacterium tuberculosis
TTRPLAGESLIDVVH

SEQ ID NO: 100609 - protein, 15 aa, Mycobacterium tuberculosis
TRPLAGESLIDVVHW

SEQ ID NO: 100610 - protein, 15 aa, Mycobacterium tuberculosis
RPLAGESLIDVVHWP

SEQ ID NO: 100611 - protein, 15 aa, Mycobacterium tuberculosis
PLAGESLIDVVHWPG

SEQ ID NO: 100612 - protein, 15 aa, Mycobacterium tuberculosis
LAGESLIDVVHWPGY

SEQ ID NO: 100613 - protein, 15 aa, Mycobacterium tuberculosis
AGESLIDVVHWPGYL

SEQ ID NO: 100614 - protein, 15 aa, Mycobacterium tuberculosis
GESLIDVVHWPGYLL

SEQ ID NO: 100615 - protein, 15 aa, Mycobacterium tuberculosis
ESLIDVVHWPGYLLI

SEQ ID NO: 100616 - protein, 15 aa, Mycobacterium tuberculosis
SLIDVVHWPGYLLIV

SEQ ID NO: 100617 - protein, 15 aa, Mycobacterium tuberculosis
LIDVVHWPGYLLIVA

SEQ ID NO: 100618 - protein, 15 aa, Mycobacterium tuberculosis
IDVVHWPGYLLIVAG

SEQ ID NO: 100619 - protein, 15 aa, Mycobacterium tuberculosis
DVVHWPGYLLIVAGV

SEQ ID NO: 100620 - protein, 15 aa, Mycobacterium tuberculosis
VVHWPGYLLIVAGVV

SEQ ID NO: 100621 - protein, 15 aa, Mycobacterium tuberculosis
VHWPGYLLIVAGVVG

SEQ ID NO: 100622 - protein, 15 aa, Mycobacterium tuberculosis
HWPGYLLIVAGVVGG

SEQ ID NO: 100623 - protein, 15 aa, Mycobacterium tuberculosis
WPGYLLIVAGVVGGV

SEQ ID NO: 100624 - protein, 15 aa, Mycobacterium tuberculosis
PGYLLIVAGVVGGVG

SEQ ID NO: 100625 - protein, 15 aa, Mycobacterium tuberculosis
GYLLIVAGVVGGVGA

SEQ ID NO: 100626 - protein, 15 aa, Mycobacterium tuberculosis
YLLIVAGVVGGVGAL

SEQ ID NO: 100627 - protein, 15 aa, Mycobacterium tuberculosis
LLIVAGVVGGVGALA

SEQ ID NO: 100628 - protein, 15 aa, Mycobacterium tuberculosis
LIVAGVVGGVGALAA

SEQ ID NO: 100629 - protein, 15 aa, Mycobacterium tuberculosis
IVAGVVGGVGALAAF

SEQ ID NO: 100630 - protein, 15 aa, Mycobacterium tuberculosis
VAGVVGGVGALAAFG

SEQ ID NO: 100631 - protein, 15 aa, Mycobacterium tuberculosis
AGVVGGVGALAAFGT

SEQ ID NO: 100632 - protein, 15 aa, Mycobacterium tuberculosis
GVVGGVGALAAFGTG

SEQ ID NO: 100633 - protein, 15 aa, Mycobacterium tuberculosis
VVGGVGALAAFGTGH

SEQ ID NO: 100634 - protein, 15 aa, Mycobacterium tuberculosis
VGGVGALAAFGTGHH

SEQ ID NO: 100635 - protein, 15 aa, Mycobacterium tuberculosis
GGVGALAAFGTGHHA

SEQ ID NO: 100636 - protein, 15 aa, Mycobacterium tuberculosis
GVGALAAFGTGHHAE

SEQ ID NO: 100637 - protein, 15 aa, Mycobacterium tuberculosis
VGALAAFGTGHHAEG

SEQ ID NO: 100638 - protein, 15 aa, Mycobacterium tuberculosis
GALAAFGTGHHAEGM

SEQ ID NO: 100639 - protein, 15 aa, Mycobacterium tuberculosis
ALAAFGTGHHAEGMT

SEQ ID NO: 100640 - protein, 15 aa, Mycobacterium tuberculosis
LAAFGTGHHAEGMTF

SEQ ID NO: 100641 - protein, 15 aa, Mycobacterium tuberculosis
AAFGTGHHAEGMTFG

SEQ ID NO: 100642 - protein, 15 aa, Mycobacterium tuberculosis
AFGTGHHAEGMTFGV

SEQ ID NO: 100643 - protein, 15 aa, Mycobacterium tuberculosis
FGTGHHAEGMTFGVV

SEQ ID NO: 100644 - protein, 15 aa, Mycobacterium tuberculosis
GTGHHAEGMTFGVVA

SEQ ID NO: 100645 - protein, 15 aa, Mycobacterium tuberculosis
TGHHAEGMTFGVVAI

SEQ ID NO: 100646 - protein, 15 aa, Mycobacterium tuberculosis
GHHAEGMTFGVVAIV

SEQ ID NO: 100647 - protein, 15 aa, Mycobacterium tuberculosis
HHAEGMTFGVVAIVV

SEQ ID NO: 100648 - protein, 15 aa, Mycobacterium tuberculosis
HAEGMTFGVVAIVVT

SEQ ID NO: 100649 - protein, 15 aa, Mycobacterium tuberculosis
AEGMTFGVVAIVVTV

SEQ ID NO: 100650 - protein, 15 aa, Mycobacterium tuberculosis
EGMTFGVVAIVVTVV

SEQ ID NO: 100651 - protein, 15 aa, Mycobacterium tuberculosis
GMTFGVVAIVVTVVG

SEQ ID NO: 100652 - protein, 15 aa, Mycobacterium tuberculosis
MTFGVVAIVVTVVGL

SEQ ID NO: 100653 - protein, 15 aa, Mycobacterium tuberculosis
TFGVVAIVVTVVGLA

SEQ ID NO: 100654 - protein, 15 aa, Mycobacterium tuberculosis
FGVVAIVVTVVGLAW

SEQ ID NO: 100655 - protein, 15 aa, Mycobacterium tuberculosis
GVVAIVVTVVGLAWL

SEQ ID NO: 100656 - protein, 15 aa, Mycobacterium tuberculosis
VVAIVVTVVGLAWLA

SEQ ID NO: 100657 - protein, 15 aa, Mycobacterium tuberculosis
VAIVVTVVGLAWLAF

SEQ ID NO: 100658 - protein, 15 aa, Mycobacterium tuberculosis
AIVVTVVGLAWLAFE

SEQ ID NO: 100659 - protein, 15 aa, Mycobacterium tuberculosis
IVVTVVGLAWLAFEH

SEQ ID NO: 100660 - protein, 15 aa, Mycobacterium tuberculosis
VVTVVGLAWLAFEHR

SEQ ID NO: 100661 - protein, 15 aa, Mycobacterium tuberculosis
VTVVGLAWLAFEHRR

SEQ ID NO: 100662 - protein, 15 aa, Mycobacterium tuberculosis
TVVGLAWLAFEHRRI

SEQ ID NO: 100663 - protein, 15 aa, Mycobacterium tuberculosis
VVGLAWLAFEHRRIR

SEQ ID NO: 100664 - protein, 15 aa, Mycobacterium tuberculosis
VGLAWLAFEHRRIRK

SEQ ID NO: 100665 - protein, 15 aa, Mycobacterium tuberculosis
GLAWLAFEHRRIRKI

SEQ ID NO: 100666 - protein, 15 aa, Mycobacterium tuberculosis
LAWLAFEHRRIRKIA

SEQ ID NO: 100667 - protein, 15 aa, Mycobacterium tuberculosis
AWLAFEHRRIRKIAD

SEQ ID NO: 100668 - protein, 15 aa, Mycobacterium tuberculosis
WLAFEHRRIRKIADR

SEQ ID NO: 100669 - protein, 15 aa, Mycobacterium tuberculosis
LAFEHRRIRKIADRW

SEQ ID NO: 100670 - protein, 15 aa, Mycobacterium tuberculosis
AFEHRRIRKIADRWY

SEQ ID NO: 100671 - protein, 15 aa, Mycobacterium tuberculosis
FEHRRIRKIADRWYT

SEQ ID NO: 100672 - protein, 15 aa, Mycobacterium tuberculosis
EHRRIRKIADRWYTE

SEQ ID NO: 100673 - protein, 15 aa, Mycobacterium tuberculosis
HRRIRKIADRWYTEH

SEQ ID NO: 100674 - protein, 15 aa, Mycobacterium tuberculosis
RRIRKIADRWYTEHP

SEQ ID NO: 100675 - protein, 15 aa, Mycobacterium tuberculosis
RIRKIADRWYTEHPE

SEQ ID NO: 100676 - protein, 15 aa, Mycobacterium tuberculosis
IRKIADRWYTEHPEV

SEQ ID NO: 100677 - protein, 15 aa, Mycobacterium tuberculosis
RKIADRWYTEHPEVR

SEQ ID NO: 100678 - protein, 15 aa, Mycobacterium tuberculosis
KIADRWYTEHPEVRR

SEQ ID NO: 100679 - protein, 15 aa, Mycobacterium tuberculosis
IADRWYTEHPEVRRQ

SEQ ID NO: 100680 - protein, 15 aa, Mycobacterium tuberculosis
ADRWYTEHPEVRRQR

SEQ ID NO: 100681 - protein, 15 aa, Mycobacterium tuberculosis
DRWYTEHPEVRRQRL

SEQ ID NO: 100682 - protein, 15 aa, Mycobacterium tuberculosis
RWYTEHPEVRRQRLA

SEQ ID NO: 100683 - protein, 15 aa, Mycobacterium tuberculosis
WYTEHPEVRRQRLAG

SEQ ID NO: 100684 - protein, 16 aa, Mycobacterium tuberculosis
MGQIPPQPVRRVLPLM

SEQ ID NO: 100685 - protein, 16 aa, Mycobacterium tuberculosis
GQIPPQPVRRVLPLMV

SEQ ID NO: 100686 - protein, 16 aa, Mycobacterium tuberculosis
QIPPQPVRRVLPLMVV

SEQ ID NO: 100687 - protein, 16 aa, Mycobacterium tuberculosis
IPPQPVRRVLPLMVVP

SEQ ID NO: 100688 - protein, 16 aa, Mycobacterium tuberculosis
PPQPVRRVLPLMVVPG

SEQ ID NO: 100689 - protein, 16 aa, Mycobacterium tuberculosis
PQPVRRVLPLMVVPGN

SEQ ID NO: 100690 - protein, 16 aa, Mycobacterium tuberculosis
QPVRRVLPLMVVPGNG

SEQ ID NO: 100691 - protein, 16 aa, Mycobacterium tuberculosis
PVRRVLPLMVVPGNGQ

SEQ ID NO: 100692 - protein, 16 aa, Mycobacterium tuberculosis
VRRVLPLMVVPGNGQK

SEQ ID NO: 100693 - protein, 16 aa, Mycobacterium tuberculosis
RRVLPLMVVPGNGQKW

SEQ ID NO: 100694 - protein, 16 aa, Mycobacterium tuberculosis
RVLPLMVVPGNGQKWR

SEQ ID NO: 100695 - protein, 16 aa, Mycobacterium tuberculosis
VLPLMVVPGNGQKWRN

SEQ ID NO: 100696 - protein, 16 aa, Mycobacterium tuberculosis
LPLMVVPGNGQKWRNR

SEQ ID NO: 100697 - protein, 16 aa, Mycobacterium tuberculosis
PLMVVPGNGQKWRNRT

SEQ ID NO: 100698 - protein, 16 aa, Mycobacterium tuberculosis
LMVVPGNGQKWRNRTE

SEQ ID NO: 100699 - protein, 16 aa, Mycobacterium tuberculosis
MVVPGNGQKWRNRTET

SEQ ID NO: 100700 - protein, 16 aa, Mycobacterium tuberculosis
VVPGNGQKWRNRTETE

SEQ ID NO: 100701 - protein, 16 aa, Mycobacterium tuberculosis
VPGNGQKWRNRTETEE

SEQ ID NO: 100702 - protein, 16 aa, Mycobacterium tuberculosis
PGNGQKWRNRTETEEA

SEQ ID NO: 100703 - protein, 16 aa, Mycobacterium tuberculosis
GNGQKWRNRTETEEAM

SEQ ID NO: 100704 - protein, 16 aa, Mycobacterium tuberculosis
NGQKWRNRTETEEAMG

SEQ ID NO: 100705 - protein, 16 aa, Mycobacterium tuberculosis
GQKWRNRTETEEAMGD

SEQ ID NO: 100706 - protein, 16 aa, Mycobacterium tuberculosis
QKWRNRTETEEAMGDT

SEQ ID NO: 100707 - protein, 16 aa, Mycobacterium tuberculosis
KWRNRTETEEAMGDTY

SEQ ID NO: 100708 - protein, 16 aa, Mycobacterium tuberculosis
WRNRTETEEAMGDTYR

SEQ ID NO: 100709 - protein, 16 aa, Mycobacterium tuberculosis
RNRTETEEAMGDTYRD

SEQ ID NO: 100710 - protein, 16 aa, Mycobacterium tuberculosis
NRTETEEAMGDTYRDP

SEQ ID NO: 100711 - protein, 16 aa, Mycobacterium tuberculosis
RTETEEAMGDTYRDPV

SEQ ID NO: 100712 - protein, 16 aa, Mycobacterium tuberculosis
TETEEAMGDTYRDPVD

SEQ ID NO: 100713 - protein, 16 aa, Mycobacterium tuberculosis
ETEEAMGDTYRDPVDH

SEQ ID NO: 100714 - protein, 16 aa, Mycobacterium tuberculosis
TEEAMGDTYRDPVDHL

SEQ ID NO: 100715 - protein, 16 aa, Mycobacterium tuberculosis
EEAMGDTYRDPVDHLR

SEQ ID NO: 100716 - protein, 16 aa, Mycobacterium tuberculosis
EAMGDTYRDPVDHLRT

SEQ ID NO: 100717 - protein, 16 aa, Mycobacterium tuberculosis
AMGDTYRDPVDHLRTT

SEQ ID NO: 100718 - protein, 16 aa, Mycobacterium tuberculosis
MGDTYRDPVDHLRTTR

SEQ ID NO: 100719 - protein, 16 aa, Mycobacterium tuberculosis
GDTYRDPVDHLRTTRP

SEQ ID NO: 100720 - protein, 16 aa, Mycobacterium tuberculosis
DTYRDPVDHLRTTRPL

SEQ ID NO: 100721 - protein, 16 aa, Mycobacterium tuberculosis
TYRDPVDHLRTTRPLA

SEQ ID NO: 100722 - protein, 16 aa, Mycobacterium tuberculosis
YRDPVDHLRTTRPLAG

SEQ ID NO: 100723 - protein, 16 aa, Mycobacterium tuberculosis
RDPVDHLRTTRPLAGE

SEQ ID NO: 100724 - protein, 16 aa, Mycobacterium tuberculosis
DPVDHLRTTRPLAGES

SEQ ID NO: 100725 - protein, 16 aa, Mycobacterium tuberculosis
PVDHLRTTRPLAGESL

SEQ ID NO: 100726 - protein, 16 aa, Mycobacterium tuberculosis
VDHLRTTRPLAGESLI

SEQ ID NO: 100727 - protein, 16 aa, Mycobacterium tuberculosis
DHLRTTRPLAGESLID

SEQ ID NO: 100728 - protein, 16 aa, Mycobacterium tuberculosis
HLRTTRPLAGESLIDV

SEQ ID NO: 100729 - protein, 16 aa, Mycobacterium tuberculosis
LRTTRPLAGESLIDVV

SEQ ID NO: 100730 - protein, 16 aa, Mycobacterium tuberculosis
RTTRPLAGESLIDVVH

SEQ ID NO: 100731 - protein, 16 aa, Mycobacterium tuberculosis
TTRPLAGESLIDVVHW

SEQ ID NO: 100732 - protein, 16 aa, Mycobacterium tuberculosis
TRPLAGESLIDVVHWP

SEQ ID NO: 100733 - protein, 16 aa, Mycobacterium tuberculosis
RPLAGESLIDVVHWPG

SEQ ID NO: 100734 - protein, 16 aa, Mycobacterium tuberculosis
PLAGESLIDVVHWPGY

SEQ ID NO: 100735 - protein, 16 aa, Mycobacterium tuberculosis
LAGESLIDVVHWPGYL

SEQ ID NO: 100736 - protein, 16 aa, Mycobacterium tuberculosis
AGESLIDVVHWPGYLL

SEQ ID NO: 100737 - protein, 16 aa, Mycobacterium tuberculosis
GESLIDVVHWPGYLLI

SEQ ID NO: 100738 - protein, 16 aa, Mycobacterium tuberculosis
ESLIDVVHWPGYLLIV

SEQ ID NO: 100739 - protein, 16 aa, Mycobacterium tuberculosis
SLIDVVHWPGYLLIVA

SEQ ID NO: 100740 - protein, 16 aa, Mycobacterium tuberculosis
LIDVVHWPGYLLIVAG

SEQ ID NO: 100741 - protein, 16 aa, Mycobacterium tuberculosis
IDVVHWPGYLLIVAGV

SEQ ID NO: 100742 - protein, 16 aa, Mycobacterium tuberculosis
DVVHWPGYLLIVAGVV

SEQ ID NO: 100743 - protein, 16 aa, Mycobacterium tuberculosis
VVHWPGYLLIVAGVVG

SEQ ID NO: 100744 - protein, 16 aa, Mycobacterium tuberculosis
VHWPGYLLIVAGVVGG

SEQ ID NO: 100745 - protein, 16 aa, Mycobacterium tuberculosis
HWPGYLLIVAGVVGGV

SEQ ID NO: 100746 - protein, 16 aa, Mycobacterium tuberculosis
WPGYLLIVAGVVGGVG

SEQ ID NO: 100747 - protein, 16 aa, Mycobacterium tuberculosis
PGYLLIVAGVVGGVGA

SEQ ID NO: 100748 - protein, 16 aa, Mycobacterium tuberculosis
GYLLIVAGVVGGVGAL

SEQ ID NO: 100749 - protein, 16 aa, Mycobacterium tuberculosis
YLLIVAGVVGGVGALA

SEQ ID NO: 100750 - protein, 16 aa, Mycobacterium tuberculosis
LLIVAGVVGGVGALAA

SEQ ID NO: 100751 - protein, 16 aa, Mycobacterium tuberculosis
LIVAGVVGGVGALAAF

SEQ ID NO: 100752 - protein, 16 aa, Mycobacterium tuberculosis
IVAGVVGGVGALAAFG

SEQ ID NO: 100753 - protein, 16 aa, Mycobacterium tuberculosis
VAGVVGGVGALAAFGT

SEQ ID NO: 100754 - protein, 16 aa, Mycobacterium tuberculosis
AGVVGGVGALAAFGTG

SEQ ID NO: 100755 - protein, 16 aa, Mycobacterium tuberculosis
GVVGGVGALAAFGTGH

SEQ ID NO: 100756 - protein, 16 aa, Mycobacterium tuberculosis
VVGGVGALAAFGTGHH

SEQ ID NO: 100757 - protein, 16 aa, Mycobacterium tuberculosis
VGGVGALAAFGTGHHA

SEQ ID NO: 100758 - protein, 16 aa, Mycobacterium tuberculosis
GGVGALAAFGTGHHAE

SEQ ID NO: 100759 - protein, 16 aa, Mycobacterium tuberculosis
GVGALAAFGTGHHAEG

SEQ ID NO: 100760 - protein, 16 aa, Mycobacterium tuberculosis
VGALAAFGTGHHAEGM

SEQ ID NO: 100761 - protein, 16 aa, Mycobacterium tuberculosis
GALAAFGTGHHAEGMT

SEQ ID NO: 100762 - protein, 16 aa, Mycobacterium tuberculosis
ALAAFGTGHHAEGMTF

SEQ ID NO: 100763 - protein, 16 aa, Mycobacterium tuberculosis
LAAFGTGHHAEGMTFG

SEQ ID NO: 100764 - protein, 16 aa, Mycobacterium tuberculosis
AAFGTGHHAEGMTFGV

SEQ ID NO: 100765 - protein, 16 aa, Mycobacterium tuberculosis
AFGTGHHAEGMTFGVV

SEQ ID NO: 100766 - protein, 16 aa, Mycobacterium tuberculosis
FGTGHHAEGMTFGVVA

SEQ ID NO: 100767 - protein, 16 aa, Mycobacterium tuberculosis
GTGHHAEGMTFGVVAI

SEQ ID NO: 100768 - protein, 16 aa, Mycobacterium tuberculosis
TGHHAEGMTFGVVAIV

SEQ ID NO: 100769 - protein, 16 aa, Mycobacterium tuberculosis
GHHAEGMTFGVVAIVV

SEQ ID NO: 100770 - protein, 16 aa, Mycobacterium tuberculosis
HHAEGMTFGVVAIVVT

SEQ ID NO: 100771 - protein, 16 aa, Mycobacterium tuberculosis
HAEGMTFGVVAIVVTV

SEQ ID NO: 100772 - protein, 16 aa, Mycobacterium tuberculosis
AEGMTFGVVAIVVTVV

SEQ ID NO: 100773 - protein, 16 aa, Mycobacterium tuberculosis
EGMTFGVVAIVVTVVG

SEQ ID NO: 100774 - protein, 16 aa, Mycobacterium tuberculosis
GMTFGVVAIVVTVVGL

SEQ ID NO: 100775 - protein, 16 aa, Mycobacterium tuberculosis
MTFGVVAIVVTVVGLA

SEQ ID NO: 100776 - protein, 16 aa, Mycobacterium tuberculosis
TFGVVAIVVTVVGLAW

SEQ ID NO: 100777 - protein, 16 aa, Mycobacterium tuberculosis
FGVVAIVVTVVGLAWL

SEQ ID NO: 100778 - protein, 16 aa, Mycobacterium tuberculosis
GVVAIVVTVVGLAWLA

SEQ ID NO: 100779 - protein, 16 aa, Mycobacterium tuberculosis
VVAIVVTVVGLAWLAF

SEQ ID NO: 100780 - protein, 16 aa, Mycobacterium tuberculosis
VAIVVTVVGLAWLAFE

SEQ ID NO: 100781 - protein, 16 aa, Mycobacterium tuberculosis
AIVVTVVGLAWLAFEH

SEQ ID NO: 100782 - protein, 16 aa, Mycobacterium tuberculosis
IVVTVVGLAWLAFEHR

SEQ ID NO: 100783 - protein, 16 aa, Mycobacterium tuberculosis
VVTVVGLAWLAFEHRR

SEQ ID NO: 100784 - protein, 16 aa, Mycobacterium tuberculosis
VTVVGLAWLAFEHRRI

SEQ ID NO: 100785 - protein, 16 aa, Mycobacterium tuberculosis
TVVGLAWLAFEHRRIR

SEQ ID NO: 100786 - protein, 16 aa, Mycobacterium tuberculosis
VVGLAWLAFEHRRIRK

SEQ ID NO: 100787 - protein, 16 aa, Mycobacterium tuberculosis
VGLAWLAFEHRRIRKI

SEQ ID NO: 100788 - protein, 16 aa, Mycobacterium tuberculosis
GLAWLAFEHRRIRKIA

SEQ ID NO: 100789 - protein, 16 aa, Mycobacterium tuberculosis
LAWLAFEHRRIRKIAD

SEQ ID NO: 100790 - protein, 16 aa, Mycobacterium tuberculosis
AWLAFEHRRIRKIADR

SEQ ID NO: 100791 - protein, 16 aa, Mycobacterium tuberculosis
WLAFEHRRIRKIADRW

SEQ ID NO: 100792 - protein, 16 aa, Mycobacterium tuberculosis
LAFEHRRIRKIADRWY

SEQ ID NO: 100793 - protein, 16 aa, Mycobacterium tuberculosis
AFEHRRIRKIADRWYT

SEQ ID NO: 100794 - protein, 16 aa, Mycobacterium tuberculosis
FEHRRIRKIADRWYTE

SEQ ID NO: 100795 - protein, 16 aa, Mycobacterium tuberculosis
EHRRIRKIADRWYTEH

SEQ ID NO: 100796 - protein, 16 aa, Mycobacterium tuberculosis
HRRIRKIADRWYTEHP

SEQ ID NO: 100797 - protein, 16 aa, Mycobacterium tuberculosis
RRIRKIADRWYTEHPE

SEQ ID NO: 100798 - protein, 16 aa, Mycobacterium tuberculosis
RIRKIADRWYTEHPEV

SEQ ID NO: 100799 - protein, 16 aa, Mycobacterium tuberculosis
IRKIADRWYTEHPEVR

SEQ ID NO: 100800 - protein, 16 aa, Mycobacterium tuberculosis
RKIADRWYTEHPEVRR

SEQ ID NO: 100801 - protein, 16 aa, Mycobacterium tuberculosis
KIADRWYTEHPEVRRQ

SEQ ID NO: 100802 - protein, 16 aa, Mycobacterium tuberculosis
IADRWYTEHPEVRRQR

SEQ ID NO: 100803 - protein, 16 aa, Mycobacterium tuberculosis
ADRWYTEHPEVRRQRL

SEQ ID NO: 100804 - protein, 16 aa, Mycobacterium tuberculosis
DRWYTEHPEVRRQRLA

SEQ ID NO: 100805 - protein, 16 aa, Mycobacterium tuberculosis
RWYTEHPEVRRQRLAG

SEQ ID NO: 100806 - protein, 13 aa, Mycobacterium tuberculosis
MHEVGGPSRGDRL

SEQ ID NO: 100807 - protein, 13 aa, Mycobacterium tuberculosis
HEVGGPSRGDRLG

SEQ ID NO: 100808 - protein, 13 aa, Mycobacterium tuberculosis
EVGGPSRGDRLGR

SEQ ID NO: 100809 - protein, 13 aa, Mycobacterium tuberculosis
VGGPSRGDRLGRD

SEQ ID NO: 100810 - protein, 13 aa, Mycobacterium tuberculosis
GGPSRGDRLGRDD

SEQ ID NO: 100811 - protein, 13 aa, Mycobacterium tuberculosis
GPSRGDRLGRDDS

SEQ ID NO: 100812 - protein, 13 aa, Mycobacterium tuberculosis
PSRGDRLGRDDSE

SEQ ID NO: 100813 - protein, 13 aa, Mycobacterium tuberculosis
SRGDRLGRDDSEV

SEQ ID NO: 100814 - protein, 13 aa, Mycobacterium tuberculosis
RGDRLGRDDSEVH

SEQ ID NO: 100815 - protein, 13 aa, Mycobacterium tuberculosis
GDRLGRDDSEVHS

SEQ ID NO: 100816 - protein, 13 aa, Mycobacterium tuberculosis
DRLGRDDSEVHSA

SEQ ID NO: 100817 - protein, 13 aa, Mycobacterium tuberculosis
RLGRDDSEVHSAI

SEQ ID NO: 100818 - protein, 13 aa, Mycobacterium tuberculosis
LGRDDSEVHSAIR

SEQ ID NO: 100819 - protein, 13 aa, Mycobacterium tuberculosis
GRDDSEVHSAIRF

SEQ ID NO: 100820 - protein, 13 aa, Mycobacterium tuberculosis
RDDSEVHSAIRFA

SEQ ID NO: 100821 - protein, 13 aa, Mycobacterium tuberculosis
DDSEVHSAIRFAV

SEQ ID NO: 100822 - protein, 13 aa, Mycobacterium tuberculosis
DSEVHSAIRFAVV

SEQ ID NO: 100823 - protein, 13 aa, Mycobacterium tuberculosis
SEVHSAIRFAVVA

SEQ ID NO: 100824 - protein, 13 aa, Mycobacterium tuberculosis
EVHSAIRFAVVAA

SEQ ID NO: 100825 - protein, 13 aa, Mycobacterium tuberculosis
VHSAIRFAVVAAV

SEQ ID NO: 100826 - protein, 13 aa, Mycobacterium tuberculosis
HSAIRFAVVAAVV

SEQ ID NO: 100827 - protein, 13 aa, Mycobacterium tuberculosis
SAIRFAVVAAVVG

SEQ ID NO: 100828 - protein, 13 aa, Mycobacterium tuberculosis
AIRFAVVAAVVGV

SEQ ID NO: 100829 - protein, 13 aa, Mycobacterium tuberculosis
IRFAVVAAVVGVG

SEQ ID NO: 100830 - protein, 13 aa, Mycobacterium tuberculosis
RFAVVAAVVGVGF

SEQ ID NO: 100831 - protein, 13 aa, Mycobacterium tuberculosis
FAVVAAVVGVGFL

SEQ ID NO: 100832 - protein, 13 aa, Mycobacterium tuberculosis
AVVAAVVGVGFLI

SEQ ID NO: 100833 - protein, 13 aa, Mycobacterium tuberculosis
VVAAVVGVGFLIM

SEQ ID NO: 100834 - protein, 13 aa, Mycobacterium tuberculosis
VAAVVGVGFLIMG

SEQ ID NO: 100835 - protein, 13 aa, Mycobacterium tuberculosis
AAVVGVGFLIMGA

SEQ ID NO: 100836 - protein, 13 aa, Mycobacterium tuberculosis
AVVGVGFLIMGAL

SEQ ID NO: 100837 - protein, 13 aa, Mycobacterium tuberculosis
VVGVGFLIMGALL

SEQ ID NO: 100838 - protein, 13 aa, Mycobacterium tuberculosis
VGVGFLIMGALLV

SEQ ID NO: 100839 - protein, 13 aa, Mycobacterium tuberculosis
GVGFLIMGALLVS

SEQ ID NO: 100840 - protein, 13 aa, Mycobacterium tuberculosis
VGFLIMGALLVST

SEQ ID NO: 100841 - protein, 13 aa, Mycobacterium tuberculosis
GFLIMGALLVSTC

SEQ ID NO: 100842 - protein, 13 aa, Mycobacterium tuberculosis
FLIMGALLVSTCS

SEQ ID NO: 100843 - protein, 13 aa, Mycobacterium tuberculosis
LIMGALLVSTCSG

SEQ ID NO: 100844 - protein, 13 aa, Mycobacterium tuberculosis
IMGALLVSTCSGV

SEQ ID NO: 100845 - protein, 13 aa, Mycobacterium tuberculosis
MGALLVSTCSGVD

SEQ ID NO: 100846 - protein, 13 aa, Mycobacterium tuberculosis
GALLVSTCSGVDT

SEQ ID NO: 100847 - protein, 13 aa, Mycobacterium tuberculosis
ALLVSTCSGVDTA

SEQ ID NO: 100848 - protein, 13 aa, Mycobacterium tuberculosis
LLVSTCSGVDTAA

SEQ ID NO: 100849 - protein, 13 aa, Mycobacterium tuberculosis
LVSTCSGVDTAAC

SEQ ID NO: 100850 - protein, 13 aa, Mycobacterium tuberculosis
VSTCSGVDTAACG

SEQ ID NO: 100851 - protein, 13 aa, Mycobacterium tuberculosis
STCSGVDTAACGP

SEQ ID NO: 100852 - protein, 13 aa, Mycobacterium tuberculosis
TCSGVDTAACGPP

SEQ ID NO: 100853 - protein, 13 aa, Mycobacterium tuberculosis
CSGVDTAACGPPQ

SEQ ID NO: 100854 - protein, 13 aa, Mycobacterium tuberculosis
SGVDTAACGPPQR

SEQ ID NO: 100855 - protein, 13 aa, Mycobacterium tuberculosis
GVDTAACGPPQRI

SEQ ID NO: 100856 - protein, 13 aa, Mycobacterium tuberculosis
VDTAACGPPQRIL

SEQ ID NO: 100857 - protein, 13 aa, Mycobacterium tuberculosis
DTAACGPPQRILL

SEQ ID NO: 100858 - protein, 13 aa, Mycobacterium tuberculosis
TAACGPPQRILLA

SEQ ID NO: 100859 - protein, 13 aa, Mycobacterium tuberculosis
AACGPPQRILLAL

SEQ ID NO: 100860 - protein, 13 aa, Mycobacterium tuberculosis
ACGPPQRILLALG

SEQ ID NO: 100861 - protein, 13 aa, Mycobacterium tuberculosis
CGPPQRILLALGG

SEQ ID NO: 100862 - protein, 13 aa, Mycobacterium tuberculosis
GPPQRILLALGGP

SEQ ID NO: 100863 - protein, 13 aa, Mycobacterium tuberculosis
PPQRILLALGGPL

SEQ ID NO: 100864 - protein, 13 aa, Mycobacterium tuberculosis
PQRILLALGGPLI

SEQ ID NO: 100865 - protein, 13 aa, Mycobacterium tuberculosis
QRILLALGGPLIL

SEQ ID NO: 100866 - protein, 13 aa, Mycobacterium tuberculosis
RILLALGGPLILC

SEQ ID NO: 100867 - protein, 13 aa, Mycobacterium tuberculosis
ILLALGGPLILCA

SEQ ID NO: 100868 - protein, 13 aa, Mycobacterium tuberculosis
LLALGGPLILCAA

SEQ ID NO: 100869 - protein, 13 aa, Mycobacterium tuberculosis
LALGGPLILCAAG

SEQ ID NO: 100870 - protein, 13 aa, Mycobacterium tuberculosis
ALGGPLILCAAGL

SEQ ID NO: 100871 - protein, 13 aa, Mycobacterium tuberculosis
LGGPLILCAAGLW

SEQ ID NO: 100872 - protein, 13 aa, Mycobacterium tuberculosis
GGPLILCAAGLWA

SEQ ID NO: 100873 - protein, 13 aa, Mycobacterium tuberculosis
GPLILCAAGLWAF

SEQ ID NO: 100874 - protein, 13 aa, Mycobacterium tuberculosis
PLILCAAGLWAFL

SEQ ID NO: 100875 - protein, 13 aa, Mycobacterium tuberculosis
LILCAAGLWAFLR

SEQ ID NO: 100876 - protein, 13 aa, Mycobacterium tuberculosis
ILCAAGLWAFLRT

SEQ ID NO: 100877 - protein, 13 aa, Mycobacterium tuberculosis
LCAAGLWAFLRTY

SEQ ID NO: 100878 - protein, 13 aa, Mycobacterium tuberculosis
CAAGLWAFLRTYR

SEQ ID NO: 100879 - protein, 13 aa, Mycobacterium tuberculosis
AAGLWAFLRTYRV

SEQ ID NO: 100880 - protein, 13 aa, Mycobacterium tuberculosis
AGLWAFLRTYRVW

SEQ ID NO: 100881 - protein, 13 aa, Mycobacterium tuberculosis
GLWAFLRTYRVWR

SEQ ID NO: 100882 - protein, 13 aa, Mycobacterium tuberculosis
LWAFLRTYRVWRA

SEQ ID NO: 100883 - protein, 13 aa, Mycobacterium tuberculosis
WAFLRTYRVWRAE

SEQ ID NO: 100884 - protein, 13 aa, Mycobacterium tuberculosis
AFLRTYRVWRAEG

SEQ ID NO: 100885 - protein, 13 aa, Mycobacterium tuberculosis
FLRTYRVWRAEGT

SEQ ID NO: 100886 - protein, 13 aa, Mycobacterium tuberculosis
LRTYRVWRAEGTW

SEQ ID NO: 100887 - protein, 13 aa, Mycobacterium tuberculosis
RTYRVWRAEGTWW

SEQ ID NO: 100888 - protein, 13 aa, Mycobacterium tuberculosis
TYRVWRAEGTWWG

SEQ ID NO: 100889 - protein, 13 aa, Mycobacterium tuberculosis
YRVWRAEGTWWGW

SEQ ID NO: 100890 - protein, 13 aa, Mycobacterium tuberculosis
RVWRAEGTWWGWH

SEQ ID NO: 100891 - protein, 13 aa, Mycobacterium tuberculosis
VWRAEGTWWGWHG

SEQ ID NO: 100892 - protein, 13 aa, Mycobacterium tuberculosis
WRAEGTWWGWHGA

SEQ ID NO: 100893 - protein, 13 aa, Mycobacterium tuberculosis
RAEGTWWGWHGAG

SEQ ID NO: 100894 - protein, 13 aa, Mycobacterium tuberculosis
AEGTWWGWHGAGW

SEQ ID NO: 100895 - protein, 13 aa, Mycobacterium tuberculosis
EGTWWGWHGAGWF

SEQ ID NO: 100896 - protein, 13 aa, Mycobacterium tuberculosis
GTWWGWHGAGWFL

SEQ ID NO: 100897 - protein, 13 aa, Mycobacterium tuberculosis
TWWGWHGAGWFLL

SEQ ID NO: 100898 - protein, 13 aa, Mycobacterium tuberculosis
WWGWHGAGWFLLT

SEQ ID NO: 100899 - protein, 13 aa, Mycobacterium tuberculosis
WGWHGAGWFLLTL

SEQ ID NO: 100900 - protein, 13 aa, Mycobacterium tuberculosis
GWHGAGWFLLTLM

SEQ ID NO: 100901 - protein, 13 aa, Mycobacterium tuberculosis
WHGAGWFLLTLMV

SEQ ID NO: 100902 - protein, 13 aa, Mycobacterium tuberculosis
HGAGWFLLTLMVL

SEQ ID NO: 100903 - protein, 13 aa, Mycobacterium tuberculosis
GAGWFLLTLMVLT

SEQ ID NO: 100904 - protein, 13 aa, Mycobacterium tuberculosis
AGWFLLTLMVLTL

SEQ ID NO: 100905 - protein, 13 aa, Mycobacterium tuberculosis
GWFLLTLMVLTLC

SEQ ID NO: 100906 - protein, 13 aa, Mycobacterium tuberculosis
WFLLTLMVLTLCI

SEQ ID NO: 100907 - protein, 13 aa, Mycobacterium tuberculosis
FLLTLMVLTLCIG

SEQ ID NO: 100908 - protein, 13 aa, Mycobacterium tuberculosis
LLTLMVLTLCIGV

SEQ ID NO: 100909 - protein, 13 aa, Mycobacterium tuberculosis
LTLMVLTLCIGVP

SEQ ID NO: 100910 - protein, 13 aa, Mycobacterium tuberculosis
TLMVLTLCIGVPP

SEQ ID NO: 100911 - protein, 13 aa, Mycobacterium tuberculosis
LMVLTLCIGVPPI

SEQ ID NO: 100912 - protein, 13 aa, Mycobacterium tuberculosis
MVLTLCIGVPPIA

SEQ ID NO: 100913 - protein, 13 aa, Mycobacterium tuberculosis
VLTLCIGVPPIAG

SEQ ID NO: 100914 - protein, 13 aa, Mycobacterium tuberculosis
LTLCIGVPPIAGP

SEQ ID NO: 100915 - protein, 13 aa, Mycobacterium tuberculosis
TLCIGVPPIAGPV

SEQ ID NO: 100916 - protein, 13 aa, Mycobacterium tuberculosis
LCIGVPPIAGPVM

SEQ ID NO: 100917 - protein, 13 aa, Mycobacterium tuberculosis
CIGVPPIAGPVMA

SEQ ID NO: 100918 - protein, 13 aa, Mycobacterium tuberculosis
IGVPPIAGPVMAP

SEQ ID NO: 100919 - protein, 14 aa, Mycobacterium tuberculosis
MHEVGGPSRGDRLG

SEQ ID NO: 100920 - protein, 14 aa, Mycobacterium tuberculosis
HEVGGPSRGDRLGR

SEQ ID NO: 100921 - protein, 14 aa, Mycobacterium tuberculosis
EVGGPSRGDRLGRD

SEQ ID NO: 100922 - protein, 14 aa, Mycobacterium tuberculosis
VGGPSRGDRLGRDD

SEQ ID NO: 100923 - protein, 14 aa, Mycobacterium tuberculosis
GGPSRGDRLGRDDS

SEQ ID NO: 100924 - protein, 14 aa, Mycobacterium tuberculosis
GPSRGDRLGRDDSE

SEQ ID NO: 100925 - protein, 14 aa, Mycobacterium tuberculosis
PSRGDRLGRDDSEV

SEQ ID NO: 100926 - protein, 14 aa, Mycobacterium tuberculosis
SRGDRLGRDDSEVH

SEQ ID NO: 100927 - protein, 14 aa, Mycobacterium tuberculosis
RGDRLGRDDSEVHS

SEQ ID NO: 100928 - protein, 14 aa, Mycobacterium tuberculosis
GDRLGRDDSEVHSA

SEQ ID NO: 100929 - protein, 14 aa, Mycobacterium tuberculosis
DRLGRDDSEVHSAI

SEQ ID NO: 100930 - protein, 14 aa, Mycobacterium tuberculosis
RLGRDDSEVHSAIR

SEQ ID NO: 100931 - protein, 14 aa, Mycobacterium tuberculosis
LGRDDSEVHSAIRF

SEQ ID NO: 100932 - protein, 14 aa, Mycobacterium tuberculosis
GRDDSEVHSAIRFA

SEQ ID NO: 100933 - protein, 14 aa, Mycobacterium tuberculosis
RDDSEVHSAIRFAV

SEQ ID NO: 100934 - protein, 14 aa, Mycobacterium tuberculosis
DDSEVHSAIRFAVV

SEQ ID NO: 100935 - protein, 14 aa, Mycobacterium tuberculosis
DSEVHSAIRFAVVA

SEQ ID NO: 100936 - protein, 14 aa, Mycobacterium tuberculosis
SEVHSAIRFAVVAA

SEQ ID NO: 100937 - protein, 14 aa, Mycobacterium tuberculosis
EVHSAIRFAVVAAV

SEQ ID NO: 100938 - protein, 14 aa, Mycobacterium tuberculosis
VHSAIRFAVVAAVV

SEQ ID NO: 100939 - protein, 14 aa, Mycobacterium tuberculosis
HSAIRFAVVAAVVG

SEQ ID NO: 100940 - protein, 14 aa, Mycobacterium tuberculosis
SAIRFAVVAAVVGV

SEQ ID NO: 100941 - protein, 14 aa, Mycobacterium tuberculosis
AIRFAVVAAVVGVG

SEQ ID NO: 100942 - protein, 14 aa, Mycobacterium tuberculosis
IRFAVVAAVVGVGF

SEQ ID NO: 100943 - protein, 14 aa, Mycobacterium tuberculosis
RFAVVAAVVGVGFL

SEQ ID NO: 100944 - protein, 14 aa, Mycobacterium tuberculosis
FAVVAAVVGVGFLI

SEQ ID NO: 100945 - protein, 14 aa, Mycobacterium tuberculosis
AVVAAVVGVGFLIM

SEQ ID NO: 100946 - protein, 14 aa, Mycobacterium tuberculosis
VVAAVVGVGFLIMG

SEQ ID NO: 100947 - protein, 14 aa, Mycobacterium tuberculosis
VAAVVGVGFLIMGA

SEQ ID NO: 100948 - protein, 14 aa, Mycobacterium tuberculosis
AAVVGVGFLIMGAL

SEQ ID NO: 100949 - protein, 14 aa, Mycobacterium tuberculosis
AVVGVGFLIMGALL

SEQ ID NO: 100950 - protein, 14 aa, Mycobacterium tuberculosis
VVGVGFLIMGALLV

SEQ ID NO: 100951 - protein, 14 aa, Mycobacterium tuberculosis
VGVGFLIMGALLVS

SEQ ID NO: 100952 - protein, 14 aa, Mycobacterium tuberculosis
GVGFLIMGALLVST

SEQ ID NO: 100953 - protein, 14 aa, Mycobacterium tuberculosis
VGFLIMGALLVSTC

SEQ ID NO: 100954 - protein, 14 aa, Mycobacterium tuberculosis
GFLIMGALLVSTCS

SEQ ID NO: 100955 - protein, 14 aa, Mycobacterium tuberculosis
FLIMGALLVSTCSG

SEQ ID NO: 100956 - protein, 14 aa, Mycobacterium tuberculosis
LIMGALLVSTCSGV

SEQ ID NO: 100957 - protein, 14 aa, Mycobacterium tuberculosis
IMGALLVSTCSGVD

SEQ ID NO: 100958 - protein, 14 aa, Mycobacterium tuberculosis
MGALLVSTCSGVDT

SEQ ID NO: 100959 - protein, 14 aa, Mycobacterium tuberculosis
GALLVSTCSGVDTA

SEQ ID NO: 100960 - protein, 14 aa, Mycobacterium tuberculosis
ALLVSTCSGVDTAA

SEQ ID NO: 100961 - protein, 14 aa, Mycobacterium tuberculosis
LLVSTCSGVDTAAC

SEQ ID NO: 100962 - protein, 14 aa, Mycobacterium tuberculosis
LVSTCSGVDTAACG

SEQ ID NO: 100963 - protein, 14 aa, Mycobacterium tuberculosis
VSTCSGVDTAACGP

SEQ ID NO: 100964 - protein, 14 aa, Mycobacterium tuberculosis
STCSGVDTAACGPP

SEQ ID NO: 100965 - protein, 14 aa, Mycobacterium tuberculosis
TCSGVDTAACGPPQ

SEQ ID NO: 100966 - protein, 14 aa, Mycobacterium tuberculosis
CSGVDTAACGPPQR

SEQ ID NO: 100967 - protein, 14 aa, Mycobacterium tuberculosis
SGVDTAACGPPQRI

SEQ ID NO: 100968 - protein, 14 aa, Mycobacterium tuberculosis
GVDTAACGPPQRIL

SEQ ID NO: 100969 - protein, 14 aa, Mycobacterium tuberculosis
VDTAACGPPQRILL

SEQ ID NO: 100970 - protein, 14 aa, Mycobacterium tuberculosis
DTAACGPPQRILLA

SEQ ID NO: 100971 - protein, 14 aa, Mycobacterium tuberculosis
TAACGPPQRILLAL

SEQ ID NO: 100972 - protein, 14 aa, Mycobacterium tuberculosis
AACGPPQRILLALG

SEQ ID NO: 100973 - protein, 14 aa, Mycobacterium tuberculosis
ACGPPQRILLALGG

SEQ ID NO: 100974 - protein, 14 aa, Mycobacterium tuberculosis
CGPPQRILLALGGP

SEQ ID NO: 100975 - protein, 14 aa, Mycobacterium tuberculosis
GPPQRILLALGGPL

SEQ ID NO: 100976 - protein, 14 aa, Mycobacterium tuberculosis
PPQRILLALGGPLI

SEQ ID NO: 100977 - protein, 14 aa, Mycobacterium tuberculosis
PQRILLALGGPLIL

SEQ ID NO: 100978 - protein, 14 aa, Mycobacterium tuberculosis
QRILLALGGPLILC

SEQ ID NO: 100979 - protein, 14 aa, Mycobacterium tuberculosis
RILLALGGPLILCA

SEQ ID NO: 100980 - protein, 14 aa, Mycobacterium tuberculosis
ILLALGGPLILCAA

SEQ ID NO: 100981 - protein, 14 aa, Mycobacterium tuberculosis
LLALGGPLILCAAG

SEQ ID NO: 100982 - protein, 14 aa, Mycobacterium tuberculosis
LALGGPLILCAAGL

SEQ ID NO: 100983 - protein, 14 aa, Mycobacterium tuberculosis
ALGGPLILCAAGLW

SEQ ID NO: 100984 - protein, 14 aa, Mycobacterium tuberculosis
LGGPLILCAAGLWA

SEQ ID NO: 100985 - protein, 14 aa, Mycobacterium tuberculosis
GGPLILCAAGLWAF

SEQ ID NO: 100986 - protein, 14 aa, Mycobacterium tuberculosis
GPLILCAAGLWAFL

SEQ ID NO: 100987 - protein, 14 aa, Mycobacterium tuberculosis
PLILCAAGLWAFLR

SEQ ID NO: 100988 - protein, 14 aa, Mycobacterium tuberculosis
LILCAAGLWAFLRT

SEQ ID NO: 100989 - protein, 14 aa, Mycobacterium tuberculosis
ILCAAGLWAFLRTY

SEQ ID NO: 100990 - protein, 14 aa, Mycobacterium tuberculosis
LCAAGLWAFLRTYR

SEQ ID NO: 100991 - protein, 14 aa, Mycobacterium tuberculosis
CAAGLWAFLRTYRV

SEQ ID NO: 100992 - protein, 14 aa, Mycobacterium tuberculosis
AAGLWAFLRTYRVW

SEQ ID NO: 100993 - protein, 14 aa, Mycobacterium tuberculosis
AGLWAFLRTYRVWR

SEQ ID NO: 100994 - protein, 14 aa, Mycobacterium tuberculosis
GLWAFLRTYRVWRA

SEQ ID NO: 100995 - protein, 14 aa, Mycobacterium tuberculosis
LWAFLRTYRVWRAE

SEQ ID NO: 100996 - protein, 14 aa, Mycobacterium tuberculosis
WAFLRTYRVWRAEG

SEQ ID NO: 100997 - protein, 14 aa, Mycobacterium tuberculosis
AFLRTYRVWRAEGT

SEQ ID NO: 100998 - protein, 14 aa, Mycobacterium tuberculosis
FLRTYRVWRAEGTW

SEQ ID NO: 100999 - protein, 14 aa, Mycobacterium tuberculosis
LRTYRVWRAEGTWW

SEQ ID NO: 101000 - protein, 14 aa, Mycobacterium tuberculosis
RTYRVWRAEGTWWG

SEQ ID NO: 101001 - protein, 14 aa, Mycobacterium tuberculosis
TYRVWRAEGTWWGW

SEQ ID NO: 101002 - protein, 14 aa, Mycobacterium tuberculosis
YRVWRAEGTWWGWH

SEQ ID NO: 101003 - protein, 14 aa, Mycobacterium tuberculosis
RVWRAEGTWWGWHG

SEQ ID NO: 101004 - protein, 14 aa, Mycobacterium tuberculosis
VWRAEGTWWGWHGA

SEQ ID NO: 101005 - protein, 14 aa, Mycobacterium tuberculosis
WRAEGTWWGWHGAG

SEQ ID NO: 101006 - protein, 14 aa, Mycobacterium tuberculosis
RAEGTWWGWHGAGW

SEQ ID NO: 101007 - protein, 14 aa, Mycobacterium tuberculosis
AEGTWWGWHGAGWF

SEQ ID NO: 101008 - protein, 14 aa, Mycobacterium tuberculosis
EGTWWGWHGAGWFL

SEQ ID NO: 101009 - protein, 14 aa, Mycobacterium tuberculosis
GTWWGWHGAGWFLL

SEQ ID NO: 101010 - protein, 14 aa, Mycobacterium tuberculosis
TWWGWHGAGWFLLT

SEQ ID NO: 101011 - protein, 14 aa, Mycobacterium tuberculosis
WWGWHGAGWFLLTL

SEQ ID NO: 101012 - protein, 14 aa, Mycobacterium tuberculosis
WGWHGAGWFLLTLM

SEQ ID NO: 101013 - protein, 14 aa, Mycobacterium tuberculosis
GWHGAGWFLLTLMV

SEQ ID NO: 101014 - protein, 14 aa, Mycobacterium tuberculosis
WHGAGWFLLTLMVL

SEQ ID NO: 101015 - protein, 14 aa, Mycobacterium tuberculosis
HGAGWFLLTLMVLT

SEQ ID NO: 101016 - protein, 14 aa, Mycobacterium tuberculosis
GAGWFLLTLMVLTL

SEQ ID NO: 101017 - protein, 14 aa, Mycobacterium tuberculosis
AGWFLLTLMVLTLC

SEQ ID NO: 101018 - protein, 14 aa, Mycobacterium tuberculosis
GWFLLTLMVLTLCI

SEQ ID NO: 101019 - protein, 14 aa, Mycobacterium tuberculosis
WFLLTLMVLTLCIG

SEQ ID NO: 101020 - protein, 14 aa, Mycobacterium tuberculosis
FLLTLMVLTLCIGV

SEQ ID NO: 101021 - protein, 14 aa, Mycobacterium tuberculosis
LLTLMVLTLCIGVP

SEQ ID NO: 101022 - protein, 14 aa, Mycobacterium tuberculosis
LTLMVLTLCIGVPP

SEQ ID NO: 101023 - protein, 14 aa, Mycobacterium tuberculosis
TLMVLTLCIGVPPI

SEQ ID NO: 101024 - protein, 14 aa, Mycobacterium tuberculosis
LMVLTLCIGVPPIA

SEQ ID NO: 101025 - protein, 14 aa, Mycobacterium tuberculosis
MVLTLCIGVPPIAG

SEQ ID NO: 101026 - protein, 14 aa, Mycobacterium tuberculosis
VLTLCIGVPPIAGP

SEQ ID NO: 101027 - protein, 14 aa, Mycobacterium tuberculosis
LTLCIGVPPIAGPV

SEQ ID NO: 101028 - protein, 14 aa, Mycobacterium tuberculosis
TLCIGVPPIAGPVM

SEQ ID NO: 101029 - protein, 14 aa, Mycobacterium tuberculosis
LCIGVPPIAGPVMA

SEQ ID NO: 101030 - protein, 14 aa, Mycobacterium tuberculosis
CIGVPPIAGPVMAP

SEQ ID NO: 101031 - protein, 15 aa, Mycobacterium tuberculosis
MHEVGGPSRGDRLGR

SEQ ID NO: 101032 - protein, 15 aa, Mycobacterium tuberculosis
HEVGGPSRGDRLGRD

SEQ ID NO: 101033 - protein, 15 aa, Mycobacterium tuberculosis
EVGGPSRGDRLGRDD

SEQ ID NO: 101034 - protein, 15 aa, Mycobacterium tuberculosis
VGGPSRGDRLGRDDS

SEQ ID NO: 101035 - protein, 15 aa, Mycobacterium tuberculosis
GGPSRGDRLGRDDSE

SEQ ID NO: 101036 - protein, 15 aa, Mycobacterium tuberculosis
GPSRGDRLGRDDSEV

SEQ ID NO: 101037 - protein, 15 aa, Mycobacterium tuberculosis
PSRGDRLGRDDSEVH

SEQ ID NO: 101038 - protein, 15 aa, Mycobacterium tuberculosis
SRGDRLGRDDSEVHS

SEQ ID NO: 101039 - protein, 15 aa, Mycobacterium tuberculosis
RGDRLGRDDSEVHSA

SEQ ID NO: 101040 - protein, 15 aa, Mycobacterium tuberculosis
GDRLGRDDSEVHSAI

SEQ ID NO: 101041 - protein, 15 aa, Mycobacterium tuberculosis
DRLGRDDSEVHSAIR

SEQ ID NO: 101042 - protein, 15 aa, Mycobacterium tuberculosis
RLGRDDSEVHSAIRF

SEQ ID NO: 101043 - protein, 15 aa, Mycobacterium tuberculosis
LGRDDSEVHSAIRFA

SEQ ID NO: 101044 - protein, 15 aa, Mycobacterium tuberculosis
GRDDSEVHSAIRFAV

SEQ ID NO: 101045 - protein, 15 aa, Mycobacterium tuberculosis
RDDSEVHSAIRFAVV

SEQ ID NO: 101046 - protein, 15 aa, Mycobacterium tuberculosis
DDSEVHSAIRFAVVA

SEQ ID NO: 101047 - protein, 15 aa, Mycobacterium tuberculosis
DSEVHSAIRFAVVAA

SEQ ID NO: 101048 - protein, 15 aa, Mycobacterium tuberculosis
SEVHSAIRFAVVAAV

SEQ ID NO: 101049 - protein, 15 aa, Mycobacterium tuberculosis
EVHSAIRFAVVAAVV

SEQ ID NO: 101050 - protein, 15 aa, Mycobacterium tuberculosis
VHSAIRFAVVAAVVG

SEQ ID NO: 101051 - protein, 15 aa, Mycobacterium tuberculosis
HSAIRFAVVAAVVGV

SEQ ID NO: 101052 - protein, 15 aa, Mycobacterium tuberculosis
SAIRFAVVAAVVGVG

SEQ ID NO: 101053 - protein, 15 aa, Mycobacterium tuberculosis
AIRFAVVAAVVGVGF

SEQ ID NO: 101054 - protein, 15 aa, Mycobacterium tuberculosis
IRFAVVAAVVGVGFL

SEQ ID NO: 101055 - protein, 15 aa, Mycobacterium tuberculosis
RFAVVAAVVGVGFLI

SEQ ID NO: 101056 - protein, 15 aa, Mycobacterium tuberculosis
FAVVAAVVGVGFLIM

SEQ ID NO: 101057 - protein, 15 aa, Mycobacterium tuberculosis
AVVAAVVGVGFLIMG

SEQ ID NO: 101058 - protein, 15 aa, Mycobacterium tuberculosis
VVAAVVGVGFLIMGA

SEQ ID NO: 101059 - protein, 15 aa, Mycobacterium tuberculosis
VAAVVGVGFLIMGAL

SEQ ID NO: 101060 - protein, 15 aa, Mycobacterium tuberculosis
AAVVGVGFLIMGALL

SEQ ID NO: 101061 - protein, 15 aa, Mycobacterium tuberculosis
AVVGVGFLIMGALLV

SEQ ID NO: 101062 - protein, 15 aa, Mycobacterium tuberculosis
VVGVGFLIMGALLVS

SEQ ID NO: 101063 - protein, 15 aa, Mycobacterium tuberculosis
VGVGFLIMGALLVST

SEQ ID NO: 101064 - protein, 15 aa, Mycobacterium tuberculosis
GVGFLIMGALLVSTC

SEQ ID NO: 101065 - protein, 15 aa, Mycobacterium tuberculosis
VGFLIMGALLVSTCS

SEQ ID NO: 101066 - protein, 15 aa, Mycobacterium tuberculosis
GFLIMGALLVSTCSG

SEQ ID NO: 101067 - protein, 15 aa, Mycobacterium tuberculosis
FLIMGALLVSTCSGV

SEQ ID NO: 101068 - protein, 15 aa, Mycobacterium tuberculosis
LIMGALLVSTCSGVD

SEQ ID NO: 101069 - protein, 15 aa, Mycobacterium tuberculosis
IMGALLVSTCSGVDT

SEQ ID NO: 101070 - protein, 15 aa, Mycobacterium tuberculosis
MGALLVSTCSGVDTA

SEQ ID NO: 101071 - protein, 15 aa, Mycobacterium tuberculosis
GALLVSTCSGVDTAA

SEQ ID NO: 101072 - protein, 15 aa, Mycobacterium tuberculosis
ALLVSTCSGVDTAAC

SEQ ID NO: 101073 - protein, 15 aa, Mycobacterium tuberculosis
LLVSTCSGVDTAACG

SEQ ID NO: 101074 - protein, 15 aa, Mycobacterium tuberculosis
LVSTCSGVDTAACGP

SEQ ID NO: 101075 - protein, 15 aa, Mycobacterium tuberculosis
VSTCSGVDTAACGPP

SEQ ID NO: 101076 - protein, 15 aa, Mycobacterium tuberculosis
STCSGVDTAACGPPQ

SEQ ID NO: 101077 - protein, 15 aa, Mycobacterium tuberculosis
TCSGVDTAACGPPQR

SEQ ID NO: 101078 - protein, 15 aa, Mycobacterium tuberculosis
CSGVDTAACGPPQRI

SEQ ID NO: 101079 - protein, 15 aa, Mycobacterium tuberculosis
SGVDTAACGPPQRIL

SEQ ID NO: 101080 - protein, 15 aa, Mycobacterium tuberculosis
GVDTAACGPPQRILL

SEQ ID NO: 101081 - protein, 15 aa, Mycobacterium tuberculosis
VDTAACGPPQRILLA

SEQ ID NO: 101082 - protein, 15 aa, Mycobacterium tuberculosis
DTAACGPPQRILLAL

SEQ ID NO: 101083 - protein, 15 aa, Mycobacterium tuberculosis
TAACGPPQRILLALG

SEQ ID NO: 101084 - protein, 15 aa, Mycobacterium tuberculosis
AACGPPQRILLALGG

SEQ ID NO: 101085 - protein, 15 aa, Mycobacterium tuberculosis
ACGPPQRILLALGGP

SEQ ID NO: 101086 - protein, 15 aa, Mycobacterium tuberculosis
CGPPQRILLALGGPL

SEQ ID NO: 101087 - protein, 15 aa, Mycobacterium tuberculosis
GPPQRILLALGGPLI

SEQ ID NO: 101088 - protein, 15 aa, Mycobacterium tuberculosis
PPQRILLALGGPLIL

SEQ ID NO: 101089 - protein, 15 aa, Mycobacterium tuberculosis
PQRILLALGGPLILC

SEQ ID NO: 101090 - protein, 15 aa, Mycobacterium tuberculosis
QRILLALGGPLILCA

SEQ ID NO: 101091 - protein, 15 aa, Mycobacterium tuberculosis
RILLALGGPLILCAA

SEQ ID NO: 101092 - protein, 15 aa, Mycobacterium tuberculosis
ILLALGGPLILCAAG

SEQ ID NO: 101093 - protein, 15 aa, Mycobacterium tuberculosis
LLALGGPLILCAAGL

SEQ ID NO: 101094 - protein, 15 aa, Mycobacterium tuberculosis
LALGGPLILCAAGLW

SEQ ID NO: 101095 - protein, 15 aa, Mycobacterium tuberculosis
ALGGPLILCAAGLWA

SEQ ID NO: 101096 - protein, 15 aa, Mycobacterium tuberculosis
LGGPLILCAAGLWAF

SEQ ID NO: 101097 - protein, 15 aa, Mycobacterium tuberculosis
GGPLILCAAGLWAFL

SEQ ID NO: 101098 - protein, 15 aa, Mycobacterium tuberculosis
GPLILCAAGLWAFLR

SEQ ID NO: 101099 - protein, 15 aa, Mycobacterium tuberculosis
PLILCAAGLWAFLRT

SEQ ID NO: 101100 - protein, 15 aa, Mycobacterium tuberculosis
LILCAAGLWAFLRTY

SEQ ID NO: 101101 - protein, 15 aa, Mycobacterium tuberculosis
ILCAAGLWAFLRTYR

SEQ ID NO: 101102 - protein, 15 aa, Mycobacterium tuberculosis
LCAAGLWAFLRTYRV

SEQ ID NO: 101103 - protein, 15 aa, Mycobacterium tuberculosis
CAAGLWAFLRTYRVW

SEQ ID NO: 101104 - protein, 15 aa, Mycobacterium tuberculosis
AAGLWAFLRTYRVWR

SEQ ID NO: 101105 - protein, 15 aa, Mycobacterium tuberculosis
AGLWAFLRTYRVWRA

SEQ ID NO: 101106 - protein, 15 aa, Mycobacterium tuberculosis
GLWAFLRTYRVWRAE

SEQ ID NO: 101107 - protein, 15 aa, Mycobacterium tuberculosis
LWAFLRTYRVWRAEG

SEQ ID NO: 101108 - protein, 15 aa, Mycobacterium tuberculosis
WAFLRTYRVWRAEGT

SEQ ID NO: 101109 - protein, 15 aa, Mycobacterium tuberculosis
AFLRTYRVWRAEGTW

SEQ ID NO: 101110 - protein, 15 aa, Mycobacterium tuberculosis
FLRTYRVWRAEGTWW

SEQ ID NO: 101111 - protein, 15 aa, Mycobacterium tuberculosis
LRTYRVWRAEGTWWG

SEQ ID NO: 101112 - protein, 15 aa, Mycobacterium tuberculosis
RTYRVWRAEGTWWGW

SEQ ID NO: 101113 - protein, 15 aa, Mycobacterium tuberculosis
TYRVWRAEGTWWGWH

SEQ ID NO: 101114 - protein, 15 aa, Mycobacterium tuberculosis
YRVWRAEGTWWGWHG

SEQ ID NO: 101115 - protein, 15 aa, Mycobacterium tuberculosis
RVWRAEGTWWGWHGA

SEQ ID NO: 101116 - protein, 15 aa, Mycobacterium tuberculosis
VWRAEGTWWGWHGAG

SEQ ID NO: 101117 - protein, 15 aa, Mycobacterium tuberculosis
WRAEGTWWGWHGAGW

SEQ ID NO: 101118 - protein, 15 aa, Mycobacterium tuberculosis
RAEGTWWGWHGAGWF

SEQ ID NO: 101119 - protein, 15 aa, Mycobacterium tuberculosis
AEGTWWGWHGAGWFL

SEQ ID NO: 101120 - protein, 15 aa, Mycobacterium tuberculosis
EGTWWGWHGAGWFLL

SEQ ID NO: 101121 - protein, 15 aa, Mycobacterium tuberculosis
GTWWGWHGAGWFLLT

SEQ ID NO: 101122 - protein, 15 aa, Mycobacterium tuberculosis
TWWGWHGAGWFLLTL

SEQ ID NO: 101123 - protein, 15 aa, Mycobacterium tuberculosis
WWGWHGAGWFLLTLM

SEQ ID NO: 101124 - protein, 15 aa, Mycobacterium tuberculosis
WGWHGAGWFLLTLMV

SEQ ID NO: 101125 - protein, 15 aa, Mycobacterium tuberculosis
GWHGAGWFLLTLMVL

SEQ ID NO: 101126 - protein, 15 aa, Mycobacterium tuberculosis
WHGAGWFLLTLMVLT

SEQ ID NO: 101127 - protein, 15 aa, Mycobacterium tuberculosis
HGAGWFLLTLMVLTL

SEQ ID NO: 101128 - protein, 15 aa, Mycobacterium tuberculosis
GAGWFLLTLMVLTLC

SEQ ID NO: 101129 - protein, 15 aa, Mycobacterium tuberculosis
AGWFLLTLMVLTLCI

SEQ ID NO: 101130 - protein, 15 aa, Mycobacterium tuberculosis
GWFLLTLMVLTLCIG

SEQ ID NO: 101131 - protein, 15 aa, Mycobacterium tuberculosis
WFLLTLMVLTLCIGV

SEQ ID NO: 101132 - protein, 15 aa, Mycobacterium tuberculosis
FLLTLMVLTLCIGVP

SEQ ID NO: 101133 - protein, 15 aa, Mycobacterium tuberculosis
LLTLMVLTLCIGVPP

SEQ ID NO: 101134 - protein, 15 aa, Mycobacterium tuberculosis
LTLMVLTLCIGVPPI

SEQ ID NO: 101135 - protein, 15 aa, Mycobacterium tuberculosis
TLMVLTLCIGVPPIA

SEQ ID NO: 101136 - protein, 15 aa, Mycobacterium tuberculosis
LMVLTLCIGVPPIAG

SEQ ID NO: 101137 - protein, 15 aa, Mycobacterium tuberculosis
MVLTLCIGVPPIAGP

SEQ ID NO: 101138 - protein, 15 aa, Mycobacterium tuberculosis
VLTLCIGVPPIAGPV

SEQ ID NO: 101139 - protein, 15 aa, Mycobacterium tuberculosis
LTLCIGVPPIAGPVM

SEQ ID NO: 101140 - protein, 15 aa, Mycobacterium tuberculosis
TLCIGVPPIAGPVMA

SEQ ID NO: 101141 - protein, 15 aa, Mycobacterium tuberculosis
LCIGVPPIAGPVMAP

SEQ ID NO: 101142 - protein, 16 aa, Mycobacterium tuberculosis
MHEVGGPSRGDRLGRD

SEQ ID NO: 101143 - protein, 16 aa, Mycobacterium tuberculosis
HEVGGPSRGDRLGRDD

SEQ ID NO: 101144 - protein, 16 aa, Mycobacterium tuberculosis
EVGGPSRGDRLGRDDS

SEQ ID NO: 101145 - protein, 16 aa, Mycobacterium tuberculosis
VGGPSRGDRLGRDDSE

SEQ ID NO: 101146 - protein, 16 aa, Mycobacterium tuberculosis
GGPSRGDRLGRDDSEV

SEQ ID NO: 101147 - protein, 16 aa, Mycobacterium tuberculosis
GPSRGDRLGRDDSEVH

SEQ ID NO: 101148 - protein, 16 aa, Mycobacterium tuberculosis
PSRGDRLGRDDSEVHS

SEQ ID NO: 101149 - protein, 16 aa, Mycobacterium tuberculosis
SRGDRLGRDDSEVHSA

SEQ ID NO: 101150 - protein, 16 aa, Mycobacterium tuberculosis
RGDRLGRDDSEVHSAI

SEQ ID NO: 101151 - protein, 16 aa, Mycobacterium tuberculosis
GDRLGRDDSEVHSAIR

SEQ ID NO: 101152 - protein, 16 aa, Mycobacterium tuberculosis
DRLGRDDSEVHSAIRF

SEQ ID NO: 101153 - protein, 16 aa, Mycobacterium tuberculosis
RLGRDDSEVHSAIRFA

SEQ ID NO: 101154 - protein, 16 aa, Mycobacterium tuberculosis
LGRDDSEVHSAIRFAV

SEQ ID NO: 101155 - protein, 16 aa, Mycobacterium tuberculosis
GRDDSEVHSAIRFAVV

SEQ ID NO: 101156 - protein, 16 aa, Mycobacterium tuberculosis
RDDSEVHSAIRFAVVA

SEQ ID NO: 101157 - protein, 16 aa, Mycobacterium tuberculosis
DDSEVHSAIRFAVVAA

SEQ ID NO: 101158 - protein, 16 aa, Mycobacterium tuberculosis
DSEVHSAIRFAVVAAV

SEQ ID NO: 101159 - protein, 16 aa, Mycobacterium tuberculosis
SEVHSAIRFAVVAAVV

SEQ ID NO: 101160 - protein, 16 aa, Mycobacterium tuberculosis
EVHSAIRFAVVAAVVG

SEQ ID NO: 101161 - protein, 16 aa, Mycobacterium tuberculosis
VHSAIRFAVVAAVVGV

SEQ ID NO: 101162 - protein, 16 aa, Mycobacterium tuberculosis
HSAIRFAVVAAVVGVG

SEQ ID NO: 101163 - protein, 16 aa, Mycobacterium tuberculosis
SAIRFAVVAAVVGVGF

SEQ ID NO: 101164 - protein, 16 aa, Mycobacterium tuberculosis
AIRFAVVAAVVGVGFL

SEQ ID NO: 101165 - protein, 16 aa, Mycobacterium tuberculosis
IRFAVVAAVVGVGFLI

SEQ ID NO: 101166 - protein, 16 aa, Mycobacterium tuberculosis
RFAVVAAVVGVGFLIM

SEQ ID NO: 101167 - protein, 16 aa, Mycobacterium tuberculosis
FAVVAAVVGVGFLIMG

SEQ ID NO: 101168 - protein, 16 aa, Mycobacterium tuberculosis
AVVAAVVGVGFLIMGA

SEQ ID NO: 101169 - protein, 16 aa, Mycobacterium tuberculosis
VVAAVVGVGFLIMGAL

SEQ ID NO: 101170 - protein, 16 aa, Mycobacterium tuberculosis
VAAVVGVGFLIMGALL

SEQ ID NO: 101171 - protein, 16 aa, Mycobacterium tuberculosis
AAVVGVGFLIMGALLV

SEQ ID NO: 101172 - protein, 16 aa, Mycobacterium tuberculosis
AVVGVGFLIMGALLVS

SEQ ID NO: 101173 - protein, 16 aa, Mycobacterium tuberculosis
VVGVGFLIMGALLVST

SEQ ID NO: 101174 - protein, 16 aa, Mycobacterium tuberculosis
VGVGFLIMGALLVSTC

SEQ ID NO: 101175 - protein, 16 aa, Mycobacterium tuberculosis
GVGFLIMGALLVSTCS

SEQ ID NO: 101176 - protein, 16 aa, Mycobacterium tuberculosis
VGFLIMGALLVSTCSG

SEQ ID NO: 101177 - protein, 16 aa, Mycobacterium tuberculosis
GFLIMGALLVSTCSGV

SEQ ID NO: 101178 - protein, 16 aa, Mycobacterium tuberculosis
FLIMGALLVSTCSGVD

SEQ ID NO: 101179 - protein, 16 aa, Mycobacterium tuberculosis
LIMGALLVSTCSGVDT

SEQ ID NO: 101180 - protein, 16 aa, Mycobacterium tuberculosis
IMGALLVSTCSGVDTA

SEQ ID NO: 101181 - protein, 16 aa, Mycobacterium tuberculosis
MGALLVSTCSGVDTAA

SEQ ID NO: 101182 - protein, 16 aa, Mycobacterium tuberculosis
GALLVSTCSGVDTAAC

SEQ ID NO: 101183 - protein, 16 aa, Mycobacterium tuberculosis
ALLVSTCSGVDTAACG

SEQ ID NO: 101184 - protein, 16 aa, Mycobacterium tuberculosis
LLVSTCSGVDTAACGP

SEQ ID NO: 101185 - protein, 16 aa, Mycobacterium tuberculosis
LVSTCSGVDTAACGPP

SEQ ID NO: 101186 - protein, 16 aa, Mycobacterium tuberculosis
VSTCSGVDTAACGPPQ

SEQ ID NO: 101187 - protein, 16 aa, Mycobacterium tuberculosis
STCSGVDTAACGPPQR

SEQ ID NO: 101188 - protein, 16 aa, Mycobacterium tuberculosis
TCSGVDTAACGPPQRI

SEQ ID NO: 101189 - protein, 16 aa, Mycobacterium tuberculosis
CSGVDTAACGPPQRIL

SEQ ID NO: 101190 - protein, 16 aa, Mycobacterium tuberculosis
SGVDTAACGPPQRILL

SEQ ID NO: 101191 - protein, 16 aa, Mycobacterium tuberculosis
GVDTAACGPPQRILLA

SEQ ID NO: 101192 - protein, 16 aa, Mycobacterium tuberculosis
VDTAACGPPQRILLAL

SEQ ID NO: 101193 - protein, 16 aa, Mycobacterium tuberculosis
DTAACGPPQRILLALG

SEQ ID NO: 101194 - protein, 16 aa, Mycobacterium tuberculosis
TAACGPPQRILLALGG

SEQ ID NO: 101195 - protein, 16 aa, Mycobacterium tuberculosis
AACGPPQRILLALGGP

SEQ ID NO: 101196 - protein, 16 aa, Mycobacterium tuberculosis
ACGPPQRILLALGGPL

SEQ ID NO: 101197 - protein, 16 aa, Mycobacterium tuberculosis
CGPPQRILLALGGPLI

SEQ ID NO: 101198 - protein, 16 aa, Mycobacterium tuberculosis
GPPQRILLALGGPLIL

SEQ ID NO: 101199 - protein, 16 aa, Mycobacterium tuberculosis
PPQRILLALGGPLILC

SEQ ID NO: 101200 - protein, 16 aa, Mycobacterium tuberculosis
PQRILLALGGPLILCA

SEQ ID NO: 101201 - protein, 16 aa, Mycobacterium tuberculosis
QRILLALGGPLILCAA

SEQ ID NO: 101202 - protein, 16 aa, Mycobacterium tuberculosis
RILLALGGPLILCAAG

SEQ ID NO: 101203 - protein, 16 aa, Mycobacterium tuberculosis
ILLALGGPLILCAAGL

SEQ ID NO: 101204 - protein, 16 aa, Mycobacterium tuberculosis
LLALGGPLILCAAGLW

SEQ ID NO: 101205 - protein, 16 aa, Mycobacterium tuberculosis
LALGGPLILCAAGLWA

SEQ ID NO: 101206 - protein, 16 aa, Mycobacterium tuberculosis
ALGGPLILCAAGLWAF

SEQ ID NO: 101207 - protein, 16 aa, Mycobacterium tuberculosis
LGGPLILCAAGLWAFL

SEQ ID NO: 101208 - protein, 16 aa, Mycobacterium tuberculosis
GGPLILCAAGLWAFLR

SEQ ID NO: 101209 - protein, 16 aa, Mycobacterium tuberculosis
GPLILCAAGLWAFLRT

SEQ ID NO: 101210 - protein, 16 aa, Mycobacterium tuberculosis
PLILCAAGLWAFLRTY

SEQ ID NO: 101211 - protein, 16 aa, Mycobacterium tuberculosis
LILCAAGLWAFLRTYR

SEQ ID NO: 101212 - protein, 16 aa, Mycobacterium tuberculosis
ILCAAGLWAFLRTYRV

SEQ ID NO: 101213 - protein, 16 aa, Mycobacterium tuberculosis
LCAAGLWAFLRTYRVW

SEQ ID NO: 101214 - protein, 16 aa, Mycobacterium tuberculosis
CAAGLWAFLRTYRVWR

SEQ ID NO: 101215 - protein, 16 aa, Mycobacterium tuberculosis
AAGLWAFLRTYRVWRA

SEQ ID NO: 101216 - protein, 16 aa, Mycobacterium tuberculosis
AGLWAFLRTYRVWRAE

SEQ ID NO: 101217 - protein, 16 aa, Mycobacterium tuberculosis
GLWAFLRTYRVWRAEG

SEQ ID NO: 101218 - protein, 16 aa, Mycobacterium tuberculosis
LWAFLRTYRVWRAEGT

SEQ ID NO: 101219 - protein, 16 aa, Mycobacterium tuberculosis
WAFLRTYRVWRAEGTW

SEQ ID NO: 101220 - protein, 16 aa, Mycobacterium tuberculosis
AFLRTYRVWRAEGTWW

SEQ ID NO: 101221 - protein, 16 aa, Mycobacterium tuberculosis
FLRTYRVWRAEGTWWG

SEQ ID NO: 101222 - protein, 16 aa, Mycobacterium tuberculosis
LRTYRVWRAEGTWWGW

SEQ ID NO: 101223 - protein, 16 aa, Mycobacterium tuberculosis
RTYRVWRAEGTWWGWH

SEQ ID NO: 101224 - protein, 16 aa, Mycobacterium tuberculosis
TYRVWRAEGTWWGWHG

SEQ ID NO: 101225 - protein, 16 aa, Mycobacterium tuberculosis
YRVWRAEGTWWGWHGA

SEQ ID NO: 101226 - protein, 16 aa, Mycobacterium tuberculosis
RVWRAEGTWWGWHGAG

SEQ ID NO: 101227 - protein, 16 aa, Mycobacterium tuberculosis
VWRAEGTWWGWHGAGW

SEQ ID NO: 101228 - protein, 16 aa, Mycobacterium tuberculosis
WRAEGTWWGWHGAGWF

SEQ ID NO: 101229 - protein, 16 aa, Mycobacterium tuberculosis
RAEGTWWGWHGAGWFL

SEQ ID NO: 101230 - protein, 16 aa, Mycobacterium tuberculosis
AEGTWWGWHGAGWFLL

SEQ ID NO: 101231 - protein, 16 aa, Mycobacterium tuberculosis
EGTWWGWHGAGWFLLT

SEQ ID NO: 101232 - protein, 16 aa, Mycobacterium tuberculosis
GTWWGWHGAGWFLLTL

SEQ ID NO: 101233 - protein, 16 aa, Mycobacterium tuberculosis
TWWGWHGAGWFLLTLM

SEQ ID NO: 101234 - protein, 16 aa, Mycobacterium tuberculosis
WWGWHGAGWFLLTLMV

SEQ ID NO: 101235 - protein, 16 aa, Mycobacterium tuberculosis
WGWHGAGWFLLTLMVL

SEQ ID NO: 101236 - protein, 16 aa, Mycobacterium tuberculosis
GWHGAGWFLLTLMVLT

SEQ ID NO: 101237 - protein, 16 aa, Mycobacterium tuberculosis
WHGAGWFLLTLMVLTL

SEQ ID NO: 101238 - protein, 16 aa, Mycobacterium tuberculosis
HGAGWFLLTLMVLTLC

SEQ ID NO: 101239 - protein, 16 aa, Mycobacterium tuberculosis
GAGWFLLTLMVLTLCI

SEQ ID NO: 101240 - protein, 16 aa, Mycobacterium tuberculosis
AGWFLLTLMVLTLCIG

SEQ ID NO: 101241 - protein, 16 aa, Mycobacterium tuberculosis
GWFLLTLMVLTLCIGV

SEQ ID NO: 101242 - protein, 16 aa, Mycobacterium tuberculosis
WFLLTLMVLTLCIGVP

SEQ ID NO: 101243 - protein, 16 aa, Mycobacterium tuberculosis
FLLTLMVLTLCIGVPP

SEQ ID NO: 101244 - protein, 16 aa, Mycobacterium tuberculosis
LLTLMVLTLCIGVPPI

SEQ ID NO: 101245 - protein, 16 aa, Mycobacterium tuberculosis
LTLMVLTLCIGVPPIA

SEQ ID NO: 101246 - protein, 16 aa, Mycobacterium tuberculosis
TLMVLTLCIGVPPIAG

SEQ ID NO: 101247 - protein, 16 aa, Mycobacterium tuberculosis
LMVLTLCIGVPPIAGP

SEQ ID NO: 101248 - protein, 16 aa, Mycobacterium tuberculosis
MVLTLCIGVPPIAGPV

SEQ ID NO: 101249 - protein, 16 aa, Mycobacterium tuberculosis
VLTLCIGVPPIAGPVM

SEQ ID NO: 101250 - protein, 16 aa, Mycobacterium tuberculosis
LTLCIGVPPIAGPVMA

SEQ ID NO: 101251 - protein, 16 aa, Mycobacterium tuberculosis
TLCIGVPPIAGPVMAP

SEQ ID NO: 101252 - protein, 13 aa, Mycobacterium tuberculosis
MAAVVKSVALAGR

SEQ ID NO: 101253 - protein, 13 aa, Mycobacterium tuberculosis
AAVVKSVALAGRP

SEQ ID NO: 101254 - protein, 13 aa, Mycobacterium tuberculosis
AVVKSVALAGRPT

SEQ ID NO: 101255 - protein, 13 aa, Mycobacterium tuberculosis
VVKSVALAGRPTT

SEQ ID NO: 101256 - protein, 13 aa, Mycobacterium tuberculosis
VKSVALAGRPTTP

SEQ ID NO: 101257 - protein, 13 aa, Mycobacterium tuberculosis
KSVALAGRPTTPD

SEQ ID NO: 101258 - protein, 13 aa, Mycobacterium tuberculosis
SVALAGRPTTPDR

SEQ ID NO: 101259 - protein, 13 aa, Mycobacterium tuberculosis
VALAGRPTTPDRV

SEQ ID NO: 101260 - protein, 13 aa, Mycobacterium tuberculosis
ALAGRPTTPDRVH

SEQ ID NO: 101261 - protein, 13 aa, Mycobacterium tuberculosis
LAGRPTTPDRVHE

SEQ ID NO: 101262 - protein, 13 aa, Mycobacterium tuberculosis
AGRPTTPDRVHEV

SEQ ID NO: 101263 - protein, 13 aa, Mycobacterium tuberculosis
GRPTTPDRVHEVL

SEQ ID NO: 101264 - protein, 13 aa, Mycobacterium tuberculosis
RPTTPDRVHEVLG

SEQ ID NO: 101265 - protein, 13 aa, Mycobacterium tuberculosis
PTTPDRVHEVLGR

SEQ ID NO: 101266 - protein, 13 aa, Mycobacterium tuberculosis
TTPDRVHEVLGRS

SEQ ID NO: 101267 - protein, 13 aa, Mycobacterium tuberculosis
TPDRVHEVLGRSM

SEQ ID NO: 101268 - protein, 13 aa, Mycobacterium tuberculosis
PDRVHEVLGRSML

SEQ ID NO: 101269 - protein, 13 aa, Mycobacterium tuberculosis
DRVHEVLGRSMLV

SEQ ID NO: 101270 - protein, 13 aa, Mycobacterium tuberculosis
RVHEVLGRSMLVD

SEQ ID NO: 101271 - protein, 13 aa, Mycobacterium tuberculosis
VHEVLGRSMLVDG

SEQ ID NO: 101272 - protein, 13 aa, Mycobacterium tuberculosis
HEVLGRSMLVDGL

SEQ ID NO: 101273 - protein, 13 aa, Mycobacterium tuberculosis
EVLGRSMLVDGLD

SEQ ID NO: 101274 - protein, 13 aa, Mycobacterium tuberculosis
VLGRSMLVDGLDI

SEQ ID NO: 101275 - protein, 13 aa, Mycobacterium tuberculosis
LGRSMLVDGLDIV

SEQ ID NO: 101276 - protein, 13 aa, Mycobacterium tuberculosis
GRSMLVDGLDIVL

SEQ ID NO: 101277 - protein, 13 aa, Mycobacterium tuberculosis
RSMLVDGLDIVLD

SEQ ID NO: 101278 - protein, 13 aa, Mycobacterium tuberculosis
SMLVDGLDIVLDL

SEQ ID NO: 101279 - protein, 13 aa, Mycobacterium tuberculosis
MLVDGLDIVLDLT

SEQ ID NO: 101280 - protein, 13 aa, Mycobacterium tuberculosis
LVDGLDIVLDLTR

SEQ ID NO: 101281 - protein, 13 aa, Mycobacterium tuberculosis
VDGLDIVLDLTRS

SEQ ID NO: 101282 - protein, 13 aa, Mycobacterium tuberculosis
DGLDIVLDLTRSG

SEQ ID NO: 101283 - protein, 13 aa, Mycobacterium tuberculosis
GLDIVLDLTRSGG

SEQ ID NO: 101284 - protein, 13 aa, Mycobacterium tuberculosis
LDIVLDLTRSGGS

SEQ ID NO: 101285 - protein, 13 aa, Mycobacterium tuberculosis
DIVLDLTRSGGSY

SEQ ID NO: 101286 - protein, 13 aa, Mycobacterium tuberculosis
IVLDLTRSGGSYL

SEQ ID NO: 101287 - protein, 13 aa, Mycobacterium tuberculosis
VLDLTRSGGSYLV

SEQ ID NO: 101288 - protein, 13 aa, Mycobacterium tuberculosis
LDLTRSGGSYLVD

SEQ ID NO: 101289 - protein, 13 aa, Mycobacterium tuberculosis
DLTRSGGSYLVDA

SEQ ID NO: 101290 - protein, 13 aa, Mycobacterium tuberculosis
LTRSGGSYLVDAI

SEQ ID NO: 101291 - protein, 13 aa, Mycobacterium tuberculosis
TRSGGSYLVDAIT

SEQ ID NO: 101292 - protein, 13 aa, Mycobacterium tuberculosis
RSGGSYLVDAITG

SEQ ID NO: 101293 - protein, 13 aa, Mycobacterium tuberculosis
SGGSYLVDAITGR

SEQ ID NO: 101294 - protein, 13 aa, Mycobacterium tuberculosis
GGSYLVDAITGRR

SEQ ID NO: 101295 - protein, 13 aa, Mycobacterium tuberculosis
GSYLVDAITGRRY

SEQ ID NO: 101296 - protein, 13 aa, Mycobacterium tuberculosis
SYLVDAITGRRYL

SEQ ID NO: 101297 - protein, 13 aa, Mycobacterium tuberculosis
YLVDAITGRRYLD

SEQ ID NO: 101298 - protein, 13 aa, Mycobacterium tuberculosis
LVDAITGRRYLDM

SEQ ID NO: 101299 - protein, 13 aa, Mycobacterium tuberculosis
VDAITGRRYLDMF

SEQ ID NO: 101300 - protein, 13 aa, Mycobacterium tuberculosis
DAITGRRYLDMFT

SEQ ID NO: 101301 - protein, 13 aa, Mycobacterium tuberculosis
AITGRRYLDMFTF

SEQ ID NO: 101302 - protein, 13 aa, Mycobacterium tuberculosis
ITGRRYLDMFTFV

SEQ ID NO: 101303 - protein, 13 aa, Mycobacterium tuberculosis
TGRRYLDMFTFVA

SEQ ID NO: 101304 - protein, 13 aa, Mycobacterium tuberculosis
GRRYLDMFTFVAS

SEQ ID NO: 101305 - protein, 13 aa, Mycobacterium tuberculosis
RRYLDMFTFVASS

SEQ ID NO: 101306 - protein, 13 aa, Mycobacterium tuberculosis
RYLDMFTFVASSA

SEQ ID NO: 101307 - protein, 13 aa, Mycobacterium tuberculosis
YLDMFTFVASSAL

SEQ ID NO: 101308 - protein, 13 aa, Mycobacterium tuberculosis
LDMFTFVASSALG

SEQ ID NO: 101309 - protein, 13 aa, Mycobacterium tuberculosis
DMFTFVASSALGM

SEQ ID NO: 101310 - protein, 13 aa, Mycobacterium tuberculosis
MFTFVASSALGMN

SEQ ID NO: 101311 - protein, 13 aa, Mycobacterium tuberculosis
FTFVASSALGMNP

SEQ ID NO: 101312 - protein, 13 aa, Mycobacterium tuberculosis
TFVASSALGMNPP

SEQ ID NO: 101313 - protein, 13 aa, Mycobacterium tuberculosis
FVASSALGMNPPA

SEQ ID NO: 101314 - protein, 13 aa, Mycobacterium tuberculosis
VASSALGMNPPAL

SEQ ID NO: 101315 - protein, 13 aa, Mycobacterium tuberculosis
ASSALGMNPPALV

SEQ ID NO: 101316 - protein, 13 aa, Mycobacterium tuberculosis
SSALGMNPPALVD

SEQ ID NO: 101317 - protein, 13 aa, Mycobacterium tuberculosis
SALGMNPPALVDD

SEQ ID NO: 101318 - protein, 13 aa, Mycobacterium tuberculosis
ALGMNPPALVDDR

SEQ ID NO: 101319 - protein, 13 aa, Mycobacterium tuberculosis
LGMNPPALVDDRE

SEQ ID NO: 101320 - protein, 13 aa, Mycobacterium tuberculosis
GMNPPALVDDREF

SEQ ID NO: 101321 - protein, 13 aa, Mycobacterium tuberculosis
MNPPALVDDREFH

SEQ ID NO: 101322 - protein, 13 aa, Mycobacterium tuberculosis
NPPALVDDREFHA

SEQ ID NO: 101323 - protein, 13 aa, Mycobacterium tuberculosis
PPALVDDREFHAE

SEQ ID NO: 101324 - protein, 13 aa, Mycobacterium tuberculosis
PALVDDREFHAEL

SEQ ID NO: 101325 - protein, 13 aa, Mycobacterium tuberculosis
ALVDDREFHAELM

SEQ ID NO: 101326 - protein, 13 aa, Mycobacterium tuberculosis
LVDDREFHAELMQ

SEQ ID NO: 101327 - protein, 13 aa, Mycobacterium tuberculosis
VDDREFHAELMQA

SEQ ID NO: 101328 - protein, 13 aa, Mycobacterium tuberculosis
DDREFHAELMQAA

SEQ ID NO: 101329 - protein, 13 aa, Mycobacterium tuberculosis
DREFHAELMQAAL

SEQ ID NO: 101330 - protein, 13 aa, Mycobacterium tuberculosis
REFHAELMQAALN

SEQ ID NO: 101331 - protein, 13 aa, Mycobacterium tuberculosis
EFHAELMQAALNK

SEQ ID NO: 101332 - protein, 13 aa, Mycobacterium tuberculosis
FHAELMQAALNKP

SEQ ID NO: 101333 - protein, 13 aa, Mycobacterium tuberculosis
HAELMQAALNKPS

SEQ ID NO: 101334 - protein, 13 aa, Mycobacterium tuberculosis
AELMQAALNKPSN

SEQ ID NO: 101335 - protein, 13 aa, Mycobacterium tuberculosis
ELMQAALNKPSNS

SEQ ID NO: 101336 - protein, 13 aa, Mycobacterium tuberculosis
LMQAALNKPSNSD

SEQ ID NO: 101337 - protein, 13 aa, Mycobacterium tuberculosis
MQAALNKPSNSDV

SEQ ID NO: 101338 - protein, 13 aa, Mycobacterium tuberculosis
QAALNKPSNSDVY

SEQ ID NO: 101339 - protein, 13 aa, Mycobacterium tuberculosis
AALNKPSNSDVYS

SEQ ID NO: 101340 - protein, 13 aa, Mycobacterium tuberculosis
ALNKPSNSDVYSV

SEQ ID NO: 101341 - protein, 13 aa, Mycobacterium tuberculosis
LNKPSNSDVYSVA

SEQ ID NO: 101342 - protein, 13 aa, Mycobacterium tuberculosis
NKPSNSDVYSVAM

SEQ ID NO: 101343 - protein, 13 aa, Mycobacterium tuberculosis
KPSNSDVYSVAMA

SEQ ID NO: 101344 - protein, 13 aa, Mycobacterium tuberculosis
PSNSDVYSVAMAR

SEQ ID NO: 101345 - protein, 13 aa, Mycobacterium tuberculosis
SNSDVYSVAMARF

SEQ ID NO: 101346 - protein, 13 aa, Mycobacterium tuberculosis
NSDVYSVAMARFV

SEQ ID NO: 101347 - protein, 13 aa, Mycobacterium tuberculosis
SDVYSVAMARFVE

SEQ ID NO: 101348 - protein, 13 aa, Mycobacterium tuberculosis
DVYSVAMARFVET

SEQ ID NO: 101349 - protein, 13 aa, Mycobacterium tuberculosis
VYSVAMARFVETF

SEQ ID NO: 101350 - protein, 13 aa, Mycobacterium tuberculosis
YSVAMARFVETFA

SEQ ID NO: 101351 - protein, 13 aa, Mycobacterium tuberculosis
SVAMARFVETFAR

SEQ ID NO: 101352 - protein, 13 aa, Mycobacterium tuberculosis
VAMARFVETFARV

SEQ ID NO: 101353 - protein, 13 aa, Mycobacterium tuberculosis
AMARFVETFARVL

SEQ ID NO: 101354 - protein, 13 aa, Mycobacterium tuberculosis
MARFVETFARVLG

SEQ ID NO: 101355 - protein, 13 aa, Mycobacterium tuberculosis
ARFVETFARVLGD

SEQ ID NO: 101356 - protein, 13 aa, Mycobacterium tuberculosis
RFVETFARVLGDP

SEQ ID NO: 101357 - protein, 13 aa, Mycobacterium tuberculosis
FVETFARVLGDPA

SEQ ID NO: 101358 - protein, 13 aa, Mycobacterium tuberculosis
VETFARVLGDPAL

SEQ ID NO: 101359 - protein, 13 aa, Mycobacterium tuberculosis
ETFARVLGDPALP

SEQ ID NO: 101360 - protein, 13 aa, Mycobacterium tuberculosis
TFARVLGDPALPH

SEQ ID NO: 101361 - protein, 13 aa, Mycobacterium tuberculosis
FARVLGDPALPHL

SEQ ID NO: 101362 - protein, 13 aa, Mycobacterium tuberculosis
ARVLGDPALPHLF

SEQ ID NO: 101363 - protein, 13 aa, Mycobacterium tuberculosis
RVLGDPALPHLFF

SEQ ID NO: 101364 - protein, 13 aa, Mycobacterium tuberculosis
VLGDPALPHLFFV

SEQ ID NO: 101365 - protein, 13 aa, Mycobacterium tuberculosis
LGDPALPHLFFVE

SEQ ID NO: 101366 - protein, 13 aa, Mycobacterium tuberculosis
GDPALPHLFFVEG

SEQ ID NO: 101367 - protein, 13 aa, Mycobacterium tuberculosis
DPALPHLFFVEGG

SEQ ID NO: 101368 - protein, 13 aa, Mycobacterium tuberculosis
PALPHLFFVEGGA

SEQ ID NO: 101369 - protein, 13 aa, Mycobacterium tuberculosis
ALPHLFFVEGGAL

SEQ ID NO: 101370 - protein, 13 aa, Mycobacterium tuberculosis
LPHLFFVEGGALA

SEQ ID NO: 101371 - protein, 13 aa, Mycobacterium tuberculosis
PHLFFVEGGALAV

SEQ ID NO: 101372 - protein, 13 aa, Mycobacterium tuberculosis
HLFFVEGGALAVE

SEQ ID NO: 101373 - protein, 13 aa, Mycobacterium tuberculosis
LFFVEGGALAVEN

SEQ ID NO: 101374 - protein, 13 aa, Mycobacterium tuberculosis
FFVEGGALAVENA

SEQ ID NO: 101375 - protein, 13 aa, Mycobacterium tuberculosis
FVEGGALAVENAL

SEQ ID NO: 101376 - protein, 13 aa, Mycobacterium tuberculosis
VEGGALAVENALK

SEQ ID NO: 101377 - protein, 13 aa, Mycobacterium tuberculosis
EGGALAVENALKA

SEQ ID NO: 101378 - protein, 13 aa, Mycobacterium tuberculosis
GGALAVENALKAA

SEQ ID NO: 101379 - protein, 13 aa, Mycobacterium tuberculosis
GALAVENALKAAF

SEQ ID NO: 101380 - protein, 13 aa, Mycobacterium tuberculosis
ALAVENALKAAFD

SEQ ID NO: 101381 - protein, 13 aa, Mycobacterium tuberculosis
LAVENALKAAFDW

SEQ ID NO: 101382 - protein, 13 aa, Mycobacterium tuberculosis
AVENALKAAFDWK

SEQ ID NO: 101383 - protein, 13 aa, Mycobacterium tuberculosis
VENALKAAFDWKS

SEQ ID NO: 101384 - protein, 13 aa, Mycobacterium tuberculosis
ENALKAAFDWKSR

SEQ ID NO: 101385 - protein, 13 aa, Mycobacterium tuberculosis
NALKAAFDWKSRH

SEQ ID NO: 101386 - protein, 13 aa, Mycobacterium tuberculosis
ALKAAFDWKSRHN

SEQ ID NO: 101387 - protein, 13 aa, Mycobacterium tuberculosis
LKAAFDWKSRHNQ

SEQ ID NO: 101388 - protein, 13 aa, Mycobacterium tuberculosis
KAAFDWKSRHNQA

SEQ ID NO: 101389 - protein, 13 aa, Mycobacterium tuberculosis
AAFDWKSRHNQAH

SEQ ID NO: 101390 - protein, 13 aa, Mycobacterium tuberculosis
AFDWKSRHNQAHG

SEQ ID NO: 101391 - protein, 13 aa, Mycobacterium tuberculosis
FDWKSRHNQAHGI

SEQ ID NO: 101392 - protein, 13 aa, Mycobacterium tuberculosis
DWKSRHNQAHGID

SEQ ID NO: 101393 - protein, 13 aa, Mycobacterium tuberculosis
WKSRHNQAHGIDP

SEQ ID NO: 101394 - protein, 13 aa, Mycobacterium tuberculosis
KSRHNQAHGIDPA

SEQ ID NO: 101395 - protein, 13 aa, Mycobacterium tuberculosis
SRHNQAHGIDPAL

SEQ ID NO: 101396 - protein, 13 aa, Mycobacterium tuberculosis
RHNQAHGIDPALG

SEQ ID NO: 101397 - protein, 13 aa, Mycobacterium tuberculosis
HNQAHGIDPALGT

SEQ ID NO: 101398 - protein, 13 aa, Mycobacterium tuberculosis
NQAHGIDPALGTQ

SEQ ID NO: 101399 - protein, 13 aa, Mycobacterium tuberculosis
QAHGIDPALGTQV

SEQ ID NO: 101400 - protein, 13 aa, Mycobacterium tuberculosis
AHGIDPALGTQVL

SEQ ID NO: 101401 - protein, 13 aa, Mycobacterium tuberculosis
HGIDPALGTQVLH

SEQ ID NO: 101402 - protein, 13 aa, Mycobacterium tuberculosis
GIDPALGTQVLHL

SEQ ID NO: 101403 - protein, 13 aa, Mycobacterium tuberculosis
IDPALGTQVLHLR

SEQ ID NO: 101404 - protein, 13 aa, Mycobacterium tuberculosis
DPALGTQVLHLRG

SEQ ID NO: 101405 - protein, 13 aa, Mycobacterium tuberculosis
PALGTQVLHLRGA

SEQ ID NO: 101406 - protein, 13 aa, Mycobacterium tuberculosis
ALGTQVLHLRGAF

SEQ ID NO: 101407 - protein, 13 aa, Mycobacterium tuberculosis
LGTQVLHLRGAFH

SEQ ID NO: 101408 - protein, 13 aa, Mycobacterium tuberculosis
GTQVLHLRGAFHG

SEQ ID NO: 101409 - protein, 13 aa, Mycobacterium tuberculosis
TQVLHLRGAFHGR

SEQ ID NO: 101410 - protein, 13 aa, Mycobacterium tuberculosis
QVLHLRGAFHGRS

SEQ ID NO: 101411 - protein, 13 aa, Mycobacterium tuberculosis
VLHLRGAFHGRSG

SEQ ID NO: 101412 - protein, 13 aa, Mycobacterium tuberculosis
LHLRGAFHGRSGY

SEQ ID NO: 101413 - protein, 13 aa, Mycobacterium tuberculosis
HLRGAFHGRSGYT

SEQ ID NO: 101414 - protein, 13 aa, Mycobacterium tuberculosis
LRGAFHGRSGYTL

SEQ ID NO: 101415 - protein, 13 aa, Mycobacterium tuberculosis
RGAFHGRSGYTLS

SEQ ID NO: 101416 - protein, 13 aa, Mycobacterium tuberculosis
GAFHGRSGYTLSL

SEQ ID NO: 101417 - protein, 13 aa, Mycobacterium tuberculosis
AFHGRSGYTLSLT

SEQ ID NO: 101418 - protein, 13 aa, Mycobacterium tuberculosis
FHGRSGYTLSLTN

SEQ ID NO: 101419 - protein, 13 aa, Mycobacterium tuberculosis
HGRSGYTLSLTNT

SEQ ID NO: 101420 - protein, 13 aa, Mycobacterium tuberculosis
GRSGYTLSLTNTK

SEQ ID NO: 101421 - protein, 13 aa, Mycobacterium tuberculosis
RSGYTLSLTNTKP

SEQ ID NO: 101422 - protein, 13 aa, Mycobacterium tuberculosis
SGYTLSLTNTKPT

SEQ ID NO: 101423 - protein, 13 aa, Mycobacterium tuberculosis
GYTLSLTNTKPTI

SEQ ID NO: 101424 - protein, 13 aa, Mycobacterium tuberculosis
YTLSLTNTKPTIT

SEQ ID NO: 101425 - protein, 13 aa, Mycobacterium tuberculosis
TLSLTNTKPTITA

SEQ ID NO: 101426 - protein, 13 aa, Mycobacterium tuberculosis
LSLTNTKPTITAR

SEQ ID NO: 101427 - protein, 13 aa, Mycobacterium tuberculosis
SLTNTKPTITARF

SEQ ID NO: 101428 - protein, 13 aa, Mycobacterium tuberculosis
LTNTKPTITARFP

SEQ ID NO: 101429 - protein, 13 aa, Mycobacterium tuberculosis
TNTKPTITARFPK

SEQ ID NO: 101430 - protein, 13 aa, Mycobacterium tuberculosis
NTKPTITARFPKF

SEQ ID NO: 101431 - protein, 13 aa, Mycobacterium tuberculosis
TKPTITARFPKFD

SEQ ID NO: 101432 - protein, 13 aa, Mycobacterium tuberculosis
KPTITARFPKFDW

SEQ ID NO: 101433 - protein, 13 aa, Mycobacterium tuberculosis
PTITARFPKFDWP

SEQ ID NO: 101434 - protein, 13 aa, Mycobacterium tuberculosis
TITARFPKFDWPR

SEQ ID NO: 101435 - protein, 13 aa, Mycobacterium tuberculosis
ITARFPKFDWPRI

SEQ ID NO: 101436 - protein, 13 aa, Mycobacterium tuberculosis
TARFPKFDWPRID

SEQ ID NO: 101437 - protein, 13 aa, Mycobacterium tuberculosis
ARFPKFDWPRIDA

SEQ ID NO: 101438 - protein, 13 aa, Mycobacterium tuberculosis
RFPKFDWPRIDAP

SEQ ID NO: 101439 - protein, 13 aa, Mycobacterium tuberculosis
FPKFDWPRIDAPY

SEQ ID NO: 101440 - protein, 13 aa, Mycobacterium tuberculosis
PKFDWPRIDAPYM

SEQ ID NO: 101441 - protein, 13 aa, Mycobacterium tuberculosis
KFDWPRIDAPYMR

SEQ ID NO: 101442 - protein, 13 aa, Mycobacterium tuberculosis
FDWPRIDAPYMRP

SEQ ID NO: 101443 - protein, 13 aa, Mycobacterium tuberculosis
DWPRIDAPYMRPG

SEQ ID NO: 101444 - protein, 13 aa, Mycobacterium tuberculosis
WPRIDAPYMRPGL

SEQ ID NO: 101445 - protein, 13 aa, Mycobacterium tuberculosis
PRIDAPYMRPGLD

SEQ ID NO: 101446 - protein, 13 aa, Mycobacterium tuberculosis
RIDAPYMRPGLDE

SEQ ID NO: 101447 - protein, 13 aa, Mycobacterium tuberculosis
IDAPYMRPGLDEP

SEQ ID NO: 101448 - protein, 13 aa, Mycobacterium tuberculosis
DAPYMRPGLDEPA

SEQ ID NO: 101449 - protein, 13 aa, Mycobacterium tuberculosis
APYMRPGLDEPAM

SEQ ID NO: 101450 - protein, 13 aa, Mycobacterium tuberculosis
PYMRPGLDEPAMA

SEQ ID NO: 101451 - protein, 13 aa, Mycobacterium tuberculosis
YMRPGLDEPAMAA

SEQ ID NO: 101452 - protein, 13 aa, Mycobacterium tuberculosis
MRPGLDEPAMAAL

SEQ ID NO: 101453 - protein, 13 aa, Mycobacterium tuberculosis
RPGLDEPAMAALE

SEQ ID NO: 101454 - protein, 13 aa, Mycobacterium tuberculosis
PGLDEPAMAALEA

SEQ ID NO: 101455 - protein, 13 aa, Mycobacterium tuberculosis
GLDEPAMAALEAE

SEQ ID NO: 101456 - protein, 13 aa, Mycobacterium tuberculosis
LDEPAMAALEAEA

SEQ ID NO: 101457 - protein, 13 aa, Mycobacterium tuberculosis
DEPAMAALEAEAL

SEQ ID NO: 101458 - protein, 13 aa, Mycobacterium tuberculosis
EPAMAALEAEALR

SEQ ID NO: 101459 - protein, 13 aa, Mycobacterium tuberculosis
PAMAALEAEALRQ

SEQ ID NO: 101460 - protein, 13 aa, Mycobacterium tuberculosis
AMAALEAEALRQA

SEQ ID NO: 101461 - protein, 13 aa, Mycobacterium tuberculosis
MAALEAEALRQAR

SEQ ID NO: 101462 - protein, 13 aa, Mycobacterium tuberculosis
AALEAEALRQARA

SEQ ID NO: 101463 - protein, 13 aa, Mycobacterium tuberculosis
ALEAEALRQARAA

SEQ ID NO: 101464 - protein, 13 aa, Mycobacterium tuberculosis
LEAEALRQARAAF

SEQ ID NO: 101465 - protein, 13 aa, Mycobacterium tuberculosis
EAEALRQARAAFE

SEQ ID NO: 101466 - protein, 13 aa, Mycobacterium tuberculosis
AEALRQARAAFET

SEQ ID NO: 101467 - protein, 13 aa, Mycobacterium tuberculosis
EALRQARAAFETR

SEQ ID NO: 101468 - protein, 13 aa, Mycobacterium tuberculosis
ALRQARAAFETRP

SEQ ID NO: 101469 - protein, 13 aa, Mycobacterium tuberculosis
LRQARAAFETRPH

SEQ ID NO: 101470 - protein, 13 aa, Mycobacterium tuberculosis
RQARAAFETRPHD

SEQ ID NO: 101471 - protein, 13 aa, Mycobacterium tuberculosis
QARAAFETRPHDI

SEQ ID NO: 101472 - protein, 13 aa, Mycobacterium tuberculosis
ARAAFETRPHDIA

SEQ ID NO: 101473 - protein, 13 aa, Mycobacterium tuberculosis
RAAFETRPHDIAC

SEQ ID NO: 101474 - protein, 13 aa, Mycobacterium tuberculosis
AAFETRPHDIACF

SEQ ID NO: 101475 - protein, 13 aa, Mycobacterium tuberculosis
AFETRPHDIACFV

SEQ ID NO: 101476 - protein, 13 aa, Mycobacterium tuberculosis
FETRPHDIACFVA

SEQ ID NO: 101477 - protein, 13 aa, Mycobacterium tuberculosis
ETRPHDIACFVAE

SEQ ID NO: 101478 - protein, 13 aa, Mycobacterium tuberculosis
TRPHDIACFVAEP

SEQ ID NO: 101479 - protein, 13 aa, Mycobacterium tuberculosis
RPHDIACFVAEPI

SEQ ID NO: 101480 - protein, 13 aa, Mycobacterium tuberculosis
PHDIACFVAEPIQ

SEQ ID NO: 101481 - protein, 13 aa, Mycobacterium tuberculosis
HDIACFVAEPIQG

SEQ ID NO: 101482 - protein, 13 aa, Mycobacterium tuberculosis
DIACFVAEPIQGE

SEQ ID NO: 101483 - protein, 13 aa, Mycobacterium tuberculosis
IACFVAEPIQGEG

SEQ ID NO: 101484 - protein, 13 aa, Mycobacterium tuberculosis
ACFVAEPIQGEGG

SEQ ID NO: 101485 - protein, 13 aa, Mycobacterium tuberculosis
CFVAEPIQGEGGD

SEQ ID NO: 101486 - protein, 13 aa, Mycobacterium tuberculosis
FVAEPIQGEGGDR

SEQ ID NO: 101487 - protein, 13 aa, Mycobacterium tuberculosis
VAEPIQGEGGDRH

SEQ ID NO: 101488 - protein, 13 aa, Mycobacterium tuberculosis
AEPIQGEGGDRHF

SEQ ID NO: 101489 - protein, 13 aa, Mycobacterium tuberculosis
EPIQGEGGDRHFR

SEQ ID NO: 101490 - protein, 13 aa, Mycobacterium tuberculosis
PIQGEGGDRHFRP

SEQ ID NO: 101491 - protein, 13 aa, Mycobacterium tuberculosis
IQGEGGDRHFRPE

SEQ ID NO: 101492 - protein, 13 aa, Mycobacterium tuberculosis
QGEGGDRHFRPEF

SEQ ID NO: 101493 - protein, 13 aa, Mycobacterium tuberculosis
GEGGDRHFRPEFF

SEQ ID NO: 101494 - protein, 13 aa, Mycobacterium tuberculosis
EGGDRHFRPEFFA

SEQ ID NO: 101495 - protein, 13 aa, Mycobacterium tuberculosis
GGDRHFRPEFFAA

SEQ ID NO: 101496 - protein, 13 aa, Mycobacterium tuberculosis
GDRHFRPEFFAAM

SEQ ID NO: 101497 - protein, 13 aa, Mycobacterium tuberculosis
DRHFRPEFFAAMR

SEQ ID NO: 101498 - protein, 13 aa, Mycobacterium tuberculosis
RHFRPEFFAAMRE

SEQ ID NO: 101499 - protein, 13 aa, Mycobacterium tuberculosis
HFRPEFFAAMREL

SEQ ID NO: 101500 - protein, 13 aa, Mycobacterium tuberculosis
FRPEFFAAMRELC

SEQ ID NO: 101501 - protein, 13 aa, Mycobacterium tuberculosis
RPEFFAAMRELCD

SEQ ID NO: 101502 - protein, 13 aa, Mycobacterium tuberculosis
PEFFAAMRELCDE

SEQ ID NO: 101503 - protein, 13 aa, Mycobacterium tuberculosis
EFFAAMRELCDEF

SEQ ID NO: 101504 - protein, 13 aa, Mycobacterium tuberculosis
FFAAMRELCDEFD

SEQ ID NO: 101505 - protein, 13 aa, Mycobacterium tuberculosis
FAAMRELCDEFDA

SEQ ID NO: 101506 - protein, 13 aa, Mycobacterium tuberculosis
AAMRELCDEFDAL

SEQ ID NO: 101507 - protein, 13 aa, Mycobacterium tuberculosis
AMRELCDEFDALL

SEQ ID NO: 101508 - protein, 13 aa, Mycobacterium tuberculosis
MRELCDEFDALLI

SEQ ID NO: 101509 - protein, 13 aa, Mycobacterium tuberculosis
RELCDEFDALLIF

SEQ ID NO: 101510 - protein, 13 aa, Mycobacterium tuberculosis
ELCDEFDALLIFD

SEQ ID NO: 101511 - protein, 13 aa, Mycobacterium tuberculosis
LCDEFDALLIFDE

SEQ ID NO: 101512 - protein, 13 aa, Mycobacterium tuberculosis
CDEFDALLIFDEV

SEQ ID NO: 101513 - protein, 13 aa, Mycobacterium tuberculosis
DEFDALLIFDEVQ

SEQ ID NO: 101514 - protein, 13 aa, Mycobacterium tuberculosis
EFDALLIFDEVQT

SEQ ID NO: 101515 - protein, 13 aa, Mycobacterium tuberculosis
FDALLIFDEVQTG

SEQ ID NO: 101516 - protein, 13 aa, Mycobacterium tuberculosis
DALLIFDEVQTGC

SEQ ID NO: 101517 - protein, 13 aa, Mycobacterium tuberculosis
ALLIFDEVQTGCG

SEQ ID NO: 101518 - protein, 13 aa, Mycobacterium tuberculosis
LLIFDEVQTGCGL

SEQ ID NO: 101519 - protein, 13 aa, Mycobacterium tuberculosis
LIFDEVQTGCGLT

SEQ ID NO: 101520 - protein, 13 aa, Mycobacterium tuberculosis
IFDEVQTGCGLTG

SEQ ID NO: 101521 - protein, 13 aa, Mycobacterium tuberculosis
FDEVQTGCGLTGT

SEQ ID NO: 101522 - protein, 13 aa, Mycobacterium tuberculosis
DEVQTGCGLTGTA

SEQ ID NO: 101523 - protein, 13 aa, Mycobacterium tuberculosis
EVQTGCGLTGTAW

SEQ ID NO: 101524 - protein, 13 aa, Mycobacterium tuberculosis
VQTGCGLTGTAWA

SEQ ID NO: 101525 - protein, 13 aa, Mycobacterium tuberculosis
QTGCGLTGTAWAY

SEQ ID NO: 101526 - protein, 13 aa, Mycobacterium tuberculosis
TGCGLTGTAWAYQ

SEQ ID NO: 101527 - protein, 13 aa, Mycobacterium tuberculosis
GCGLTGTAWAYQQ

SEQ ID NO: 101528 - protein, 13 aa, Mycobacterium tuberculosis
CGLTGTAWAYQQL

SEQ ID NO: 101529 - protein, 13 aa, Mycobacterium tuberculosis
GLTGTAWAYQQLD

SEQ ID NO: 101530 - protein, 13 aa, Mycobacterium tuberculosis
LTGTAWAYQQLDV

SEQ ID NO: 101531 - protein, 13 aa, Mycobacterium tuberculosis
TGTAWAYQQLDVA

SEQ ID NO: 101532 - protein, 13 aa, Mycobacterium tuberculosis
GTAWAYQQLDVAP

SEQ ID NO: 101533 - protein, 13 aa, Mycobacterium tuberculosis
TAWAYQQLDVAPD

SEQ ID NO: 101534 - protein, 13 aa, Mycobacterium tuberculosis
AWAYQQLDVAPDI

SEQ ID NO: 101535 - protein, 13 aa, Mycobacterium tuberculosis
WAYQQLDVAPDIV

SEQ ID NO: 101536 - protein, 13 aa, Mycobacterium tuberculosis
AYQQLDVAPDIVA

SEQ ID NO: 101537 - protein, 13 aa, Mycobacterium tuberculosis
YQQLDVAPDIVAF

SEQ ID NO: 101538 - protein, 13 aa, Mycobacterium tuberculosis
QQLDVAPDIVAFG

SEQ ID NO: 101539 - protein, 13 aa, Mycobacterium tuberculosis
QLDVAPDIVAFGK

SEQ ID NO: 101540 - protein, 13 aa, Mycobacterium tuberculosis
LDVAPDIVAFGKK

SEQ ID NO: 101541 - protein, 13 aa, Mycobacterium tuberculosis
DVAPDIVAFGKKT

SEQ ID NO: 101542 - protein, 13 aa, Mycobacterium tuberculosis
VAPDIVAFGKKTQ

SEQ ID NO: 101543 - protein, 13 aa, Mycobacterium tuberculosis
APDIVAFGKKTQV

SEQ ID NO: 101544 - protein, 13 aa, Mycobacterium tuberculosis
PDIVAFGKKTQVC

SEQ ID NO: 101545 - protein, 13 aa, Mycobacterium tuberculosis
DIVAFGKKTQVCG

SEQ ID NO: 101546 - protein, 13 aa, Mycobacterium tuberculosis
IVAFGKKTQVCGV

SEQ ID NO: 101547 - protein, 13 aa, Mycobacterium tuberculosis
VAFGKKTQVCGVM

SEQ ID NO: 101548 - protein, 13 aa, Mycobacterium tuberculosis
AFGKKTQVCGVMA

SEQ ID NO: 101549 - protein, 13 aa, Mycobacterium tuberculosis
FGKKTQVCGVMAG

SEQ ID NO: 101550 - protein, 13 aa, Mycobacterium tuberculosis
GKKTQVCGVMAGR

SEQ ID NO: 101551 - protein, 13 aa, Mycobacterium tuberculosis
KKTQVCGVMAGRR

SEQ ID NO: 101552 - protein, 13 aa, Mycobacterium tuberculosis
KTQVCGVMAGRRV

SEQ ID NO: 101553 - protein, 13 aa, Mycobacterium tuberculosis
TQVCGVMAGRRVD

SEQ ID NO: 101554 - protein, 13 aa, Mycobacterium tuberculosis
QVCGVMAGRRVDE

SEQ ID NO: 101555 - protein, 13 aa, Mycobacterium tuberculosis
VCGVMAGRRVDEV

SEQ ID NO: 101556 - protein, 13 aa, Mycobacterium tuberculosis
CGVMAGRRVDEVA

SEQ ID NO: 101557 - protein, 13 aa, Mycobacterium tuberculosis
GVMAGRRVDEVAD

SEQ ID NO: 101558 - protein, 13 aa, Mycobacterium tuberculosis
VMAGRRVDEVADN

SEQ ID NO: 101559 - protein, 13 aa, Mycobacterium tuberculosis
MAGRRVDEVADNV

SEQ ID NO: 101560 - protein, 13 aa, Mycobacterium tuberculosis
AGRRVDEVADNVF

SEQ ID NO: 101561 - protein, 13 aa, Mycobacterium tuberculosis
GRRVDEVADNVFA

SEQ ID NO: 101562 - protein, 13 aa, Mycobacterium tuberculosis
RRVDEVADNVFAV

SEQ ID NO: 101563 - protein, 13 aa, Mycobacterium tuberculosis
RVDEVADNVFAVP

SEQ ID NO: 101564 - protein, 13 aa, Mycobacterium tuberculosis
VDEVADNVFAVPS

SEQ ID NO: 101565 - protein, 13 aa, Mycobacterium tuberculosis
DEVADNVFAVPSR

SEQ ID NO: 101566 - protein, 13 aa, Mycobacterium tuberculosis
EVADNVFAVPSRL

SEQ ID NO: 101567 - protein, 13 aa, Mycobacterium tuberculosis
VADNVFAVPSRLN

SEQ ID NO: 101568 - protein, 13 aa, Mycobacterium tuberculosis
ADNVFAVPSRLNS

SEQ ID NO: 101569 - protein, 13 aa, Mycobacterium tuberculosis
DNVFAVPSRLNST

SEQ ID NO: 101570 - protein, 13 aa, Mycobacterium tuberculosis
NVFAVPSRLNSTW

SEQ ID NO: 101571 - protein, 13 aa, Mycobacterium tuberculosis
VFAVPSRLNSTWG

SEQ ID NO: 101572 - protein, 13 aa, Mycobacterium tuberculosis
FAVPSRLNSTWGG

SEQ ID NO: 101573 - protein, 13 aa, Mycobacterium tuberculosis
AVPSRLNSTWGGN

SEQ ID NO: 101574 - protein, 13 aa, Mycobacterium tuberculosis
VPSRLNSTWGGNL

SEQ ID NO: 101575 - protein, 13 aa, Mycobacterium tuberculosis
PSRLNSTWGGNLT

SEQ ID NO: 101576 - protein, 13 aa, Mycobacterium tuberculosis
SRLNSTWGGNLTD

SEQ ID NO: 101577 - protein, 13 aa, Mycobacterium tuberculosis
RLNSTWGGNLTDM

SEQ ID NO: 101578 - protein, 13 aa, Mycobacterium tuberculosis
LNSTWGGNLTDMV

SEQ ID NO: 101579 - protein, 13 aa, Mycobacterium tuberculosis
NSTWGGNLTDMVR

SEQ ID NO: 101580 - protein, 13 aa, Mycobacterium tuberculosis
STWGGNLTDMVRA

SEQ ID NO: 101581 - protein, 13 aa, Mycobacterium tuberculosis
TWGGNLTDMVRAR

SEQ ID NO: 101582 - protein, 13 aa, Mycobacterium tuberculosis
WGGNLTDMVRARR

SEQ ID NO: 101583 - protein, 13 aa, Mycobacterium tuberculosis
GGNLTDMVRARRI

SEQ ID NO: 101584 - protein, 13 aa, Mycobacterium tuberculosis
GNLTDMVRARRIL

SEQ ID NO: 101585 - protein, 13 aa, Mycobacterium tuberculosis
NLTDMVRARRILE

SEQ ID NO: 101586 - protein, 13 aa, Mycobacterium tuberculosis
LTDMVRARRILEV

SEQ ID NO: 101587 - protein, 13 aa, Mycobacterium tuberculosis
TDMVRARRILEVI

SEQ ID NO: 101588 - protein, 13 aa, Mycobacterium tuberculosis
DMVRARRILEVIE

SEQ ID NO: 101589 - protein, 13 aa, Mycobacterium tuberculosis
MVRARRILEVIEA

SEQ ID NO: 101590 - protein, 13 aa, Mycobacterium tuberculosis
VRARRILEVIEAE

SEQ ID NO: 101591 - protein, 13 aa, Mycobacterium tuberculosis
RARRILEVIEAEG

SEQ ID NO: 101592 - protein, 13 aa, Mycobacterium tuberculosis
ARRILEVIEAEGL

SEQ ID NO: 101593 - protein, 13 aa, Mycobacterium tuberculosis
RRILEVIEAEGLF

SEQ ID NO: 101594 - protein, 13 aa, Mycobacterium tuberculosis
RILEVIEAEGLFE

SEQ ID NO: 101595 - protein, 13 aa, Mycobacterium tuberculosis
ILEVIEAEGLFER

SEQ ID NO: 101596 - protein, 13 aa, Mycobacterium tuberculosis
LEVIEAEGLFERA

SEQ ID NO: 101597 - protein, 13 aa, Mycobacterium tuberculosis
EVIEAEGLFERAV

SEQ ID NO: 101598 - protein, 13 aa, Mycobacterium tuberculosis
VIEAEGLFERAVQ

SEQ ID NO: 101599 - protein, 13 aa, Mycobacterium tuberculosis
IEAEGLFERAVQH

SEQ ID NO: 101600 - protein, 13 aa, Mycobacterium tuberculosis
EAEGLFERAVQHG

SEQ ID NO: 101601 - protein, 13 aa, Mycobacterium tuberculosis
AEGLFERAVQHGK

SEQ ID NO: 101602 - protein, 13 aa, Mycobacterium tuberculosis
EGLFERAVQHGKY

SEQ ID NO: 101603 - protein, 13 aa, Mycobacterium tuberculosis
GLFERAVQHGKYL

SEQ ID NO: 101604 - protein, 13 aa, Mycobacterium tuberculosis
LFERAVQHGKYLR

SEQ ID NO: 101605 - protein, 13 aa, Mycobacterium tuberculosis
FERAVQHGKYLRA

SEQ ID NO: 101606 - protein, 13 aa, Mycobacterium tuberculosis
ERAVQHGKYLRAR

SEQ ID NO: 101607 - protein, 13 aa, Mycobacterium tuberculosis
RAVQHGKYLRARL

SEQ ID NO: 101608 - protein, 13 aa, Mycobacterium tuberculosis
AVQHGKYLRARLD

SEQ ID NO: 101609 - protein, 13 aa, Mycobacterium tuberculosis
VQHGKYLRARLDE

SEQ ID NO: 101610 - protein, 13 aa, Mycobacterium tuberculosis
QHGKYLRARLDEL

SEQ ID NO: 101611 - protein, 13 aa, Mycobacterium tuberculosis
HGKYLRARLDELA

SEQ ID NO: 101612 - protein, 13 aa, Mycobacterium tuberculosis
GKYLRARLDELAA

SEQ ID NO: 101613 - protein, 13 aa, Mycobacterium tuberculosis
KYLRARLDELAAD

SEQ ID NO: 101614 - protein, 13 aa, Mycobacterium tuberculosis
YLRARLDELAADF

SEQ ID NO: 101615 - protein, 13 aa, Mycobacterium tuberculosis
LRARLDELAADFP

SEQ ID NO: 101616 - protein, 13 aa, Mycobacterium tuberculosis
RARLDELAADFPA

SEQ ID NO: 101617 - protein, 13 aa, Mycobacterium tuberculosis
ARLDELAADFPAV

SEQ ID NO: 101618 - protein, 13 aa, Mycobacterium tuberculosis
RLDELAADFPAVV

SEQ ID NO: 101619 - protein, 13 aa, Mycobacterium tuberculosis
LDELAADFPAVVL

SEQ ID NO: 101620 - protein, 13 aa, Mycobacterium tuberculosis
DELAADFPAVVLD

SEQ ID NO: 101621 - protein, 13 aa, Mycobacterium tuberculosis
ELAADFPAVVLDP

SEQ ID NO: 101622 - protein, 13 aa, Mycobacterium tuberculosis
LAADFPAVVLDPR

SEQ ID NO: 101623 - protein, 13 aa, Mycobacterium tuberculosis
AADFPAVVLDPRG

SEQ ID NO: 101624 - protein, 13 aa, Mycobacterium tuberculosis
ADFPAVVLDPRGR

SEQ ID NO: 101625 - protein, 13 aa, Mycobacterium tuberculosis
DFPAVVLDPRGRG

SEQ ID NO: 101626 - protein, 13 aa, Mycobacterium tuberculosis
FPAVVLDPRGRGL

SEQ ID NO: 101627 - protein, 13 aa, Mycobacterium tuberculosis
PAVVLDPRGRGLM

SEQ ID NO: 101628 - protein, 13 aa, Mycobacterium tuberculosis
AVVLDPRGRGLMC

SEQ ID NO: 101629 - protein, 13 aa, Mycobacterium tuberculosis
VVLDPRGRGLMCA

SEQ ID NO: 101630 - protein, 13 aa, Mycobacterium tuberculosis
VLDPRGRGLMCAF

SEQ ID NO: 101631 - protein, 13 aa, Mycobacterium tuberculosis
LDPRGRGLMCAFS

SEQ ID NO: 101632 - protein, 13 aa, Mycobacterium tuberculosis
DPRGRGLMCAFSL

SEQ ID NO: 101633 - protein, 13 aa, Mycobacterium tuberculosis
PRGRGLMCAFSLP

SEQ ID NO: 101634 - protein, 13 aa, Mycobacterium tuberculosis
RGRGLMCAFSLPT

SEQ ID NO: 101635 - protein, 13 aa, Mycobacterium tuberculosis
GRGLMCAFSLPTT

SEQ ID NO: 101636 - protein, 13 aa, Mycobacterium tuberculosis
RGLMCAFSLPTTA

SEQ ID NO: 101637 - protein, 13 aa, Mycobacterium tuberculosis
GLMCAFSLPTTAD

SEQ ID NO: 101638 - protein, 13 aa, Mycobacterium tuberculosis
LMCAFSLPTTADR

SEQ ID NO: 101639 - protein, 13 aa, Mycobacterium tuberculosis
MCAFSLPTTADRD

SEQ ID NO: 101640 - protein, 13 aa, Mycobacterium tuberculosis
CAFSLPTTADRDE

SEQ ID NO: 101641 - protein, 13 aa, Mycobacterium tuberculosis
AFSLPTTADRDEL

SEQ ID NO: 101642 - protein, 13 aa, Mycobacterium tuberculosis
FSLPTTADRDELI

SEQ ID NO: 101643 - protein, 13 aa, Mycobacterium tuberculosis
SLPTTADRDELIR

SEQ ID NO: 101644 - protein, 13 aa, Mycobacterium tuberculosis
LPTTADRDELIRQ

SEQ ID NO: 101645 - protein, 13 aa, Mycobacterium tuberculosis
PTTADRDELIRQL

SEQ ID NO: 101646 - protein, 13 aa, Mycobacterium tuberculosis
TTADRDELIRQLW

SEQ ID NO: 101647 - protein, 13 aa, Mycobacterium tuberculosis
TADRDELIRQLWQ

SEQ ID NO: 101648 - protein, 13 aa, Mycobacterium tuberculosis
ADRDELIRQLWQR

SEQ ID NO: 101649 - protein, 13 aa, Mycobacterium tuberculosis
DRDELIRQLWQRA

SEQ ID NO: 101650 - protein, 13 aa, Mycobacterium tuberculosis
RDELIRQLWQRAV

SEQ ID NO: 101651 - protein, 13 aa, Mycobacterium tuberculosis
DELIRQLWQRAVI

SEQ ID NO: 101652 - protein, 13 aa, Mycobacterium tuberculosis
ELIRQLWQRAVIV

SEQ ID NO: 101653 - protein, 13 aa, Mycobacterium tuberculosis
LIRQLWQRAVIVL

SEQ ID NO: 101654 - protein, 13 aa, Mycobacterium tuberculosis
IRQLWQRAVIVLP

SEQ ID NO: 101655 - protein, 13 aa, Mycobacterium tuberculosis
RQLWQRAVIVLPA

SEQ ID NO: 101656 - protein, 13 aa, Mycobacterium tuberculosis
QLWQRAVIVLPAG

SEQ ID NO: 101657 - protein, 13 aa, Mycobacterium tuberculosis
LWQRAVIVLPAGA

SEQ ID NO: 101658 - protein, 13 aa, Mycobacterium tuberculosis
WQRAVIVLPAGAD

SEQ ID NO: 101659 - protein, 13 aa, Mycobacterium tuberculosis
QRAVIVLPAGADT

SEQ ID NO: 101660 - protein, 13 aa, Mycobacterium tuberculosis
RAVIVLPAGADTV

SEQ ID NO: 101661 - protein, 13 aa, Mycobacterium tuberculosis
AVIVLPAGADTVR

SEQ ID NO: 101662 - protein, 13 aa, Mycobacterium tuberculosis
VIVLPAGADTVRF

SEQ ID NO: 101663 - protein, 13 aa, Mycobacterium tuberculosis
IVLPAGADTVRFR

SEQ ID NO: 101664 - protein, 13 aa, Mycobacterium tuberculosis
VLPAGADTVRFRP

SEQ ID NO: 101665 - protein, 13 aa, Mycobacterium tuberculosis
LPAGADTVRFRPP

SEQ ID NO: 101666 - protein, 13 aa, Mycobacterium tuberculosis
PAGADTVRFRPPL

SEQ ID NO: 101667 - protein, 13 aa, Mycobacterium tuberculosis
AGADTVRFRPPLT

SEQ ID NO: 101668 - protein, 13 aa, Mycobacterium tuberculosis
GADTVRFRPPLTV

SEQ ID NO: 101669 - protein, 13 aa, Mycobacterium tuberculosis
ADTVRFRPPLTVS

SEQ ID NO: 101670 - protein, 13 aa, Mycobacterium tuberculosis
DTVRFRPPLTVST

SEQ ID NO: 101671 - protein, 13 aa, Mycobacterium tuberculosis
TVRFRPPLTVSTA

SEQ ID NO: 101672 - protein, 13 aa, Mycobacterium tuberculosis
VRFRPPLTVSTAE

SEQ ID NO: 101673 - protein, 13 aa, Mycobacterium tuberculosis
RFRPPLTVSTAEI

SEQ ID NO: 101674 - protein, 13 aa, Mycobacterium tuberculosis
FRPPLTVSTAEID

SEQ ID NO: 101675 - protein, 13 aa, Mycobacterium tuberculosis
RPPLTVSTAEIDA

SEQ ID NO: 101676 - protein, 13 aa, Mycobacterium tuberculosis
PPLTVSTAEIDAA

SEQ ID NO: 101677 - protein, 13 aa, Mycobacterium tuberculosis
PLTVSTAEIDAAI

SEQ ID NO: 101678 - protein, 13 aa, Mycobacterium tuberculosis
LTVSTAEIDAAIA

SEQ ID NO: 101679 - protein, 13 aa, Mycobacterium tuberculosis
TVSTAEIDAAIAA

SEQ ID NO: 101680 - protein, 13 aa, Mycobacterium tuberculosis
VSTAEIDAAIAAV

SEQ ID NO: 101681 - protein, 13 aa, Mycobacterium tuberculosis
STAEIDAAIAAVR

SEQ ID NO: 101682 - protein, 13 aa, Mycobacterium tuberculosis
TAEIDAAIAAVRS

SEQ ID NO: 101683 - protein, 13 aa, Mycobacterium tuberculosis
AEIDAAIAAVRSA

SEQ ID NO: 101684 - protein, 13 aa, Mycobacterium tuberculosis
EIDAAIAAVRSAL

SEQ ID NO: 101685 - protein, 13 aa, Mycobacterium tuberculosis
IDAAIAAVRSALP

SEQ ID NO: 101686 - protein, 13 aa, Mycobacterium tuberculosis
DAAIAAVRSALPV

SEQ ID NO: 101687 - protein, 13 aa, Mycobacterium tuberculosis
AAIAAVRSALPVV

SEQ ID NO: 101688 - protein, 13 aa, Mycobacterium tuberculosis
AIAAVRSALPVVT

SEQ ID NO: 101689 - protein, 14 aa, Mycobacterium tuberculosis
MAAVVKSVALAGRP

SEQ ID NO: 101690 - protein, 14 aa, Mycobacterium tuberculosis
AAVVKSVALAGRPT

SEQ ID NO: 101691 - protein, 14 aa, Mycobacterium tuberculosis
AVVKSVALAGRPTT

SEQ ID NO: 101692 - protein, 14 aa, Mycobacterium tuberculosis
VVKSVALAGRPTTP

SEQ ID NO: 101693 - protein, 14 aa, Mycobacterium tuberculosis
VKSVALAGRPTTPD

SEQ ID NO: 101694 - protein, 14 aa, Mycobacterium tuberculosis
KSVALAGRPTTPDR

SEQ ID NO: 101695 - protein, 14 aa, Mycobacterium tuberculosis
SVALAGRPTTPDRV

SEQ ID NO: 101696 - protein, 14 aa, Mycobacterium tuberculosis
VALAGRPTTPDRVH

SEQ ID NO: 101697 - protein, 14 aa, Mycobacterium tuberculosis
ALAGRPTTPDRVHE

SEQ ID NO: 101698 - protein, 14 aa, Mycobacterium tuberculosis
LAGRPTTPDRVHEV

SEQ ID NO: 101699 - protein, 14 aa, Mycobacterium tuberculosis
AGRPTTPDRVHEVL

SEQ ID NO: 101700 - protein, 14 aa, Mycobacterium tuberculosis
GRPTTPDRVHEVLG

SEQ ID NO: 101701 - protein, 14 aa, Mycobacterium tuberculosis
RPTTPDRVHEVLGR

SEQ ID NO: 101702 - protein, 14 aa, Mycobacterium tuberculosis
PTTPDRVHEVLGRS

SEQ ID NO: 101703 - protein, 14 aa, Mycobacterium tuberculosis
TTPDRVHEVLGRSM

SEQ ID NO: 101704 - protein, 14 aa, Mycobacterium tuberculosis
TPDRVHEVLGRSML

SEQ ID NO: 101705 - protein, 14 aa, Mycobacterium tuberculosis
PDRVHEVLGRSMLV

SEQ ID NO: 101706 - protein, 14 aa, Mycobacterium tuberculosis
DRVHEVLGRSMLVD

SEQ ID NO: 101707 - protein, 14 aa, Mycobacterium tuberculosis
RVHEVLGRSMLVDG

SEQ ID NO: 101708 - protein, 14 aa, Mycobacterium tuberculosis
VHEVLGRSMLVDGL

SEQ ID NO: 101709 - protein, 14 aa, Mycobacterium tuberculosis
HEVLGRSMLVDGLD

SEQ ID NO: 101710 - protein, 14 aa, Mycobacterium tuberculosis
EVLGRSMLVDGLDI

SEQ ID NO: 101711 - protein, 14 aa, Mycobacterium tuberculosis
VLGRSMLVDGLDIV

SEQ ID NO: 101712 - protein, 14 aa, Mycobacterium tuberculosis
LGRSMLVDGLDIVL

SEQ ID NO: 101713 - protein, 14 aa, Mycobacterium tuberculosis
GRSMLVDGLDIVLD

SEQ ID NO: 101714 - protein, 14 aa, Mycobacterium tuberculosis
RSMLVDGLDIVLDL

SEQ ID NO: 101715 - protein, 14 aa, Mycobacterium tuberculosis
SMLVDGLDIVLDLT

SEQ ID NO: 101716 - protein, 14 aa, Mycobacterium tuberculosis
MLVDGLDIVLDLTR

SEQ ID NO: 101717 - protein, 14 aa, Mycobacterium tuberculosis
LVDGLDIVLDLTRS

SEQ ID NO: 101718 - protein, 14 aa, Mycobacterium tuberculosis
VDGLDIVLDLTRSG

SEQ ID NO: 101719 - protein, 14 aa, Mycobacterium tuberculosis
DGLDIVLDLTRSGG

SEQ ID NO: 101720 - protein, 14 aa, Mycobacterium tuberculosis
GLDIVLDLTRSGGS

SEQ ID NO: 101721 - protein, 14 aa, Mycobacterium tuberculosis
LDIVLDLTRSGGSY

SEQ ID NO: 101722 - protein, 14 aa, Mycobacterium tuberculosis
DIVLDLTRSGGSYL

SEQ ID NO: 101723 - protein, 14 aa, Mycobacterium tuberculosis
IVLDLTRSGGSYLV

SEQ ID NO: 101724 - protein, 14 aa, Mycobacterium tuberculosis
VLDLTRSGGSYLVD

SEQ ID NO: 101725 - protein, 14 aa, Mycobacterium tuberculosis
LDLTRSGGSYLVDA

SEQ ID NO: 101726 - protein, 14 aa, Mycobacterium tuberculosis
DLTRSGGSYLVDAI

SEQ ID NO: 101727 - protein, 14 aa, Mycobacterium tuberculosis
LTRSGGSYLVDAIT

SEQ ID NO: 101728 - protein, 14 aa, Mycobacterium tuberculosis
TRSGGSYLVDAITG

SEQ ID NO: 101729 - protein, 14 aa, Mycobacterium tuberculosis
RSGGSYLVDAITGR

SEQ ID NO: 101730 - protein, 14 aa, Mycobacterium tuberculosis
SGGSYLVDAITGRR

SEQ ID NO: 101731 - protein, 14 aa, Mycobacterium tuberculosis
GGSYLVDAITGRRY

SEQ ID NO: 101732 - protein, 14 aa, Mycobacterium tuberculosis
GSYLVDAITGRRYL

SEQ ID NO: 101733 - protein, 14 aa, Mycobacterium tuberculosis
SYLVDAITGRRYLD

SEQ ID NO: 101734 - protein, 14 aa, Mycobacterium tuberculosis
YLVDAITGRRYLDM

SEQ ID NO: 101735 - protein, 14 aa, Mycobacterium tuberculosis
LVDAITGRRYLDMF

SEQ ID NO: 101736 - protein, 14 aa, Mycobacterium tuberculosis
VDAITGRRYLDMFT

SEQ ID NO: 101737 - protein, 14 aa, Mycobacterium tuberculosis
DAITGRRYLDMFTF

SEQ ID NO: 101738 - protein, 14 aa, Mycobacterium tuberculosis
AITGRRYLDMFTFV

SEQ ID NO: 101739 - protein, 14 aa, Mycobacterium tuberculosis
ITGRRYLDMFTFVA

SEQ ID NO: 101740 - protein, 14 aa, Mycobacterium tuberculosis
TGRRYLDMFTFVAS

SEQ ID NO: 101741 - protein, 14 aa, Mycobacterium tuberculosis
GRRYLDMFTFVASS

SEQ ID NO: 101742 - protein, 14 aa, Mycobacterium tuberculosis
RRYLDMFTFVASSA

SEQ ID NO: 101743 - protein, 14 aa, Mycobacterium tuberculosis
RYLDMFTFVASSAL

SEQ ID NO: 101744 - protein, 14 aa, Mycobacterium tuberculosis
YLDMFTFVASSALG

SEQ ID NO: 101745 - protein, 14 aa, Mycobacterium tuberculosis
LDMFTFVASSALGM

SEQ ID NO: 101746 - protein, 14 aa, Mycobacterium tuberculosis
DMFTFVASSALGMN

SEQ ID NO: 101747 - protein, 14 aa, Mycobacterium tuberculosis
MFTFVASSALGMNP

SEQ ID NO: 101748 - protein, 14 aa, Mycobacterium tuberculosis
FTFVASSALGMNPP

SEQ ID NO: 101749 - protein, 14 aa, Mycobacterium tuberculosis
TFVASSALGMNPPA

SEQ ID NO: 101750 - protein, 14 aa, Mycobacterium tuberculosis
FVASSALGMNPPAL

SEQ ID NO: 101751 - protein, 14 aa, Mycobacterium tuberculosis
VASSALGMNPPALV

SEQ ID NO: 101752 - protein, 14 aa, Mycobacterium tuberculosis
ASSALGMNPPALVD

SEQ ID NO: 101753 - protein, 14 aa, Mycobacterium tuberculosis
SSALGMNPPALVDD

SEQ ID NO: 101754 - protein, 14 aa, Mycobacterium tuberculosis
SALGMNPPALVDDR

SEQ ID NO: 101755 - protein, 14 aa, Mycobacterium tuberculosis
ALGMNPPALVDDRE

SEQ ID NO: 101756 - protein, 14 aa, Mycobacterium tuberculosis
LGMNPPALVDDREF

SEQ ID NO: 101757 - protein, 14 aa, Mycobacterium tuberculosis
GMNPPALVDDREFH

SEQ ID NO: 101758 - protein, 14 aa, Mycobacterium tuberculosis
MNPPALVDDREFHA

SEQ ID NO: 101759 - protein, 14 aa, Mycobacterium tuberculosis
NPPALVDDREFHAE

SEQ ID NO: 101760 - protein, 14 aa, Mycobacterium tuberculosis
PPALVDDREFHAEL

SEQ ID NO: 101761 - protein, 14 aa, Mycobacterium tuberculosis
PALVDDREFHAELM

SEQ ID NO: 101762 - protein, 14 aa, Mycobacterium tuberculosis
ALVDDREFHAELMQ

SEQ ID NO: 101763 - protein, 14 aa, Mycobacterium tuberculosis
LVDDREFHAELMQA

SEQ ID NO: 101764 - protein, 14 aa, Mycobacterium tuberculosis
VDDREFHAELMQAA

SEQ ID NO: 101765 - protein, 14 aa, Mycobacterium tuberculosis
DDREFHAELMQAAL

SEQ ID NO: 101766 - protein, 14 aa, Mycobacterium tuberculosis
DREFHAELMQAALN

SEQ ID NO: 101767 - protein, 14 aa, Mycobacterium tuberculosis
REFHAELMQAALNK

SEQ ID NO: 101768 - protein, 14 aa, Mycobacterium tuberculosis
EFHAELMQAALNKP

SEQ ID NO: 101769 - protein, 14 aa, Mycobacterium tuberculosis
FHAELMQAALNKPS

SEQ ID NO: 101770 - protein, 14 aa, Mycobacterium tuberculosis
HAELMQAALNKPSN

SEQ ID NO: 101771 - protein, 14 aa, Mycobacterium tuberculosis
AELMQAALNKPSNS

SEQ ID NO: 101772 - protein, 14 aa, Mycobacterium tuberculosis
ELMQAALNKPSNSD

SEQ ID NO: 101773 - protein, 14 aa, Mycobacterium tuberculosis
LMQAALNKPSNSDV

SEQ ID NO: 101774 - protein, 14 aa, Mycobacterium tuberculosis
MQAALNKPSNSDVY

SEQ ID NO: 101775 - protein, 14 aa, Mycobacterium tuberculosis
QAALNKPSNSDVYS

SEQ ID NO: 101776 - protein, 14 aa, Mycobacterium tuberculosis
AALNKPSNSDVYSV

SEQ ID NO: 101777 - protein, 14 aa, Mycobacterium tuberculosis
ALNKPSNSDVYSVA

SEQ ID NO: 101778 - protein, 14 aa, Mycobacterium tuberculosis
LNKPSNSDVYSVAM

SEQ ID NO: 101779 - protein, 14 aa, Mycobacterium tuberculosis
NKPSNSDVYSVAMA

SEQ ID NO: 101780 - protein, 14 aa, Mycobacterium tuberculosis
KPSNSDVYSVAMAR

SEQ ID NO: 101781 - protein, 14 aa, Mycobacterium tuberculosis
PSNSDVYSVAMARF

SEQ ID NO: 101782 - protein, 14 aa, Mycobacterium tuberculosis
SNSDVYSVAMARFV

SEQ ID NO: 101783 - protein, 14 aa, Mycobacterium tuberculosis
NSDVYSVAMARFVE

SEQ ID NO: 101784 - protein, 14 aa, Mycobacterium tuberculosis
SDVYSVAMARFVET

SEQ ID NO: 101785 - protein, 14 aa, Mycobacterium tuberculosis
DVYSVAMARFVETF

SEQ ID NO: 101786 - protein, 14 aa, Mycobacterium tuberculosis
VYSVAMARFVETFA

SEQ ID NO: 101787 - protein, 14 aa, Mycobacterium tuberculosis
YSVAMARFVETFAR

SEQ ID NO: 101788 - protein, 14 aa, Mycobacterium tuberculosis
SVAMARFVETFARV

SEQ ID NO: 101789 - protein, 14 aa, Mycobacterium tuberculosis
VAMARFVETFARVL

SEQ ID NO: 101790 - protein, 14 aa, Mycobacterium tuberculosis
AMARFVETFARVLG

SEQ ID NO: 101791 - protein, 14 aa, Mycobacterium tuberculosis
MARFVETFARVLGD

SEQ ID NO: 101792 - protein, 14 aa, Mycobacterium tuberculosis
ARFVETFARVLGDP

SEQ ID NO: 101793 - protein, 14 aa, Mycobacterium tuberculosis
RFVETFARVLGDPA

SEQ ID NO: 101794 - protein, 14 aa, Mycobacterium tuberculosis
FVETFARVLGDPAL

SEQ ID NO: 101795 - protein, 14 aa, Mycobacterium tuberculosis
VETFARVLGDPALP

SEQ ID NO: 101796 - protein, 14 aa, Mycobacterium tuberculosis
ETFARVLGDPALPH

SEQ ID NO: 101797 - protein, 14 aa, Mycobacterium tuberculosis
TFARVLGDPALPHL

SEQ ID NO: 101798 - protein, 14 aa, Mycobacterium tuberculosis
FARVLGDPALPHLF

SEQ ID NO: 101799 - protein, 14 aa, Mycobacterium tuberculosis
ARVLGDPALPHLFF

SEQ ID NO: 101800 - protein, 14 aa, Mycobacterium tuberculosis
RVLGDPALPHLFFV

SEQ ID NO: 101801 - protein, 14 aa, Mycobacterium tuberculosis
VLGDPALPHLFFVE

SEQ ID NO: 101802 - protein, 14 aa, Mycobacterium tuberculosis
LGDPALPHLFFVEG

SEQ ID NO: 101803 - protein, 14 aa, Mycobacterium tuberculosis
GDPALPHLFFVEGG

SEQ ID NO: 101804 - protein, 14 aa, Mycobacterium tuberculosis
DPALPHLFFVEGGA

SEQ ID NO: 101805 - protein, 14 aa, Mycobacterium tuberculosis
PALPHLFFVEGGAL

SEQ ID NO: 101806 - protein, 14 aa, Mycobacterium tuberculosis
ALPHLFFVEGGALA

SEQ ID NO: 101807 - protein, 14 aa, Mycobacterium tuberculosis
LPHLFFVEGGALAV

SEQ ID NO: 101808 - protein, 14 aa, Mycobacterium tuberculosis
PHLFFVEGGALAVE

SEQ ID NO: 101809 - protein, 14 aa, Mycobacterium tuberculosis
HLFFVEGGALAVEN

SEQ ID NO: 101810 - protein, 14 aa, Mycobacterium tuberculosis
LFFVEGGALAVENA

SEQ ID NO: 101811 - protein, 14 aa, Mycobacterium tuberculosis
FFVEGGALAVENAL

SEQ ID NO: 101812 - protein, 14 aa, Mycobacterium tuberculosis
FVEGGALAVENALK

SEQ ID NO: 101813 - protein, 14 aa, Mycobacterium tuberculosis
VEGGALAVENALKA

SEQ ID NO: 101814 - protein, 14 aa, Mycobacterium tuberculosis
EGGALAVENALKAA

SEQ ID NO: 101815 - protein, 14 aa, Mycobacterium tuberculosis
GGALAVENALKAAF

SEQ ID NO: 101816 - protein, 14 aa, Mycobacterium tuberculosis
GALAVENALKAAFD

SEQ ID NO: 101817 - protein, 14 aa, Mycobacterium tuberculosis
ALAVENALKAAFDW

SEQ ID NO: 101818 - protein, 14 aa, Mycobacterium tuberculosis
LAVENALKAAFDWK

SEQ ID NO: 101819 - protein, 14 aa, Mycobacterium tuberculosis
AVENALKAAFDWKS

SEQ ID NO: 101820 - protein, 14 aa, Mycobacterium tuberculosis
VENALKAAFDWKSR

SEQ ID NO: 101821 - protein, 14 aa, Mycobacterium tuberculosis
ENALKAAFDWKSRH

SEQ ID NO: 101822 - protein, 14 aa, Mycobacterium tuberculosis
NALKAAFDWKSRHN

SEQ ID NO: 101823 - protein, 14 aa, Mycobacterium tuberculosis
ALKAAFDWKSRHNQ

SEQ ID NO: 101824 - protein, 14 aa, Mycobacterium tuberculosis
LKAAFDWKSRHNQA

SEQ ID NO: 101825 - protein, 14 aa, Mycobacterium tuberculosis
KAAFDWKSRHNQAH

SEQ ID NO: 101826 - protein, 14 aa, Mycobacterium tuberculosis
AAFDWKSRHNQAHG

SEQ ID NO: 101827 - protein, 14 aa, Mycobacterium tuberculosis
AFDWKSRHNQAHGI

SEQ ID NO: 101828 - protein, 14 aa, Mycobacterium tuberculosis
FDWKSRHNQAHGID

SEQ ID NO: 101829 - protein, 14 aa, Mycobacterium tuberculosis
DWKSRHNQAHGIDP

SEQ ID NO: 101830 - protein, 14 aa, Mycobacterium tuberculosis
WKSRHNQAHGIDPA

SEQ ID NO: 101831 - protein, 14 aa, Mycobacterium tuberculosis
KSRHNQAHGIDPAL

SEQ ID NO: 101832 - protein, 14 aa, Mycobacterium tuberculosis
SRHNQAHGIDPALG

SEQ ID NO: 101833 - protein, 14 aa, Mycobacterium tuberculosis
RHNQAHGIDPALGT

SEQ ID NO: 101834 - protein, 14 aa, Mycobacterium tuberculosis
HNQAHGIDPALGTQ

SEQ ID NO: 101835 - protein, 14 aa, Mycobacterium tuberculosis
NQAHGIDPALGTQV

SEQ ID NO: 101836 - protein, 14 aa, Mycobacterium tuberculosis
QAHGIDPALGTQVL

SEQ ID NO: 101837 - protein, 14 aa, Mycobacterium tuberculosis
AHGIDPALGTQVLH

SEQ ID NO: 101838 - protein, 14 aa, Mycobacterium tuberculosis
HGIDPALGTQVLHL

SEQ ID NO: 101839 - protein, 14 aa, Mycobacterium tuberculosis
GIDPALGTQVLHLR

SEQ ID NO: 101840 - protein, 14 aa, Mycobacterium tuberculosis
IDPALGTQVLHLRG

SEQ ID NO: 101841 - protein, 14 aa, Mycobacterium tuberculosis
DPALGTQVLHLRGA

SEQ ID NO: 101842 - protein, 14 aa, Mycobacterium tuberculosis
PALGTQVLHLRGAF

SEQ ID NO: 101843 - protein, 14 aa, Mycobacterium tuberculosis
ALGTQVLHLRGAFH

SEQ ID NO: 101844 - protein, 14 aa, Mycobacterium tuberculosis
LGTQVLHLRGAFHG

SEQ ID NO: 101845 - protein, 14 aa, Mycobacterium tuberculosis
GTQVLHLRGAFHGR

SEQ ID NO: 101846 - protein, 14 aa, Mycobacterium tuberculosis
TQVLHLRGAFHGRS

SEQ ID NO: 101847 - protein, 14 aa, Mycobacterium tuberculosis
QVLHLRGAFHGRSG

SEQ ID NO: 101848 - protein, 14 aa, Mycobacterium tuberculosis
VLHLRGAFHGRSGY

SEQ ID NO: 101849 - protein, 14 aa, Mycobacterium tuberculosis
LHLRGAFHGRSGYT

SEQ ID NO: 101850 - protein, 14 aa, Mycobacterium tuberculosis
HLRGAFHGRSGYTL

SEQ ID NO: 101851 - protein, 14 aa, Mycobacterium tuberculosis
LRGAFHGRSGYTLS

SEQ ID NO: 101852 - protein, 14 aa, Mycobacterium tuberculosis
RGAFHGRSGYTLSL

SEQ ID NO: 101853 - protein, 14 aa, Mycobacterium tuberculosis
GAFHGRSGYTLSLT

SEQ ID NO: 101854 - protein, 14 aa, Mycobacterium tuberculosis
AFHGRSGYTLSLTN

SEQ ID NO: 101855 - protein, 14 aa, Mycobacterium tuberculosis
FHGRSGYTLSLTNT

SEQ ID NO: 101856 - protein, 14 aa, Mycobacterium tuberculosis
HGRSGYTLSLTNTK

SEQ ID NO: 101857 - protein, 14 aa, Mycobacterium tuberculosis
GRSGYTLSLTNTKP

SEQ ID NO: 101858 - protein, 14 aa, Mycobacterium tuberculosis
RSGYTLSLTNTKPT

SEQ ID NO: 101859 - protein, 14 aa, Mycobacterium tuberculosis
SGYTLSLTNTKPTI

SEQ ID NO: 101860 - protein, 14 aa, Mycobacterium tuberculosis
GYTLSLTNTKPTIT

SEQ ID NO: 101861 - protein, 14 aa, Mycobacterium tuberculosis
YTLSLTNTKPTITA

SEQ ID NO: 101862 - protein, 14 aa, Mycobacterium tuberculosis
TLSLTNTKPTITAR

SEQ ID NO: 101863 - protein, 14 aa, Mycobacterium tuberculosis
LSLTNTKPTITARF

SEQ ID NO: 101864 - protein, 14 aa, Mycobacterium tuberculosis
SLTNTKPTITARFP

SEQ ID NO: 101865 - protein, 14 aa, Mycobacterium tuberculosis
LTNTKPTITARFPK

SEQ ID NO: 101866 - protein, 14 aa, Mycobacterium tuberculosis
TNTKPTITARFPKF

SEQ ID NO: 101867 - protein, 14 aa, Mycobacterium tuberculosis
NTKPTITARFPKFD

SEQ ID NO: 101868 - protein, 14 aa, Mycobacterium tuberculosis
TKPTITARFPKFDW

SEQ ID NO: 101869 - protein, 14 aa, Mycobacterium tuberculosis
KPTITARFPKFDWP

SEQ ID NO: 101870 - protein, 14 aa, Mycobacterium tuberculosis
PTITARFPKFDWPR

SEQ ID NO: 101871 - protein, 14 aa, Mycobacterium tuberculosis
TITARFPKFDWPRI

SEQ ID NO: 101872 - protein, 14 aa, Mycobacterium tuberculosis
ITARFPKFDWPRID

SEQ ID NO: 101873 - protein, 14 aa, Mycobacterium tuberculosis
TARFPKFDWPRIDA

SEQ ID NO: 101874 - protein, 14 aa, Mycobacterium tuberculosis
ARFPKFDWPRIDAP

SEQ ID NO: 101875 - protein, 14 aa, Mycobacterium tuberculosis
RFPKFDWPRIDAPY

SEQ ID NO: 101876 - protein, 14 aa, Mycobacterium tuberculosis
FPKFDWPRIDAPYM

SEQ ID NO: 101877 - protein, 14 aa, Mycobacterium tuberculosis
PKFDWPRIDAPYMR

SEQ ID NO: 101878 - protein, 14 aa, Mycobacterium tuberculosis
KFDWPRIDAPYMRP

SEQ ID NO: 101879 - protein, 14 aa, Mycobacterium tuberculosis
FDWPRIDAPYMRPG

SEQ ID NO: 101880 - protein, 14 aa, Mycobacterium tuberculosis
DWPRIDAPYMRPGL

SEQ ID NO: 101881 - protein, 14 aa, Mycobacterium tuberculosis
WPRIDAPYMRPGLD

SEQ ID NO: 101882 - protein, 14 aa, Mycobacterium tuberculosis
PRIDAPYMRPGLDE

SEQ ID NO: 101883 - protein, 14 aa, Mycobacterium tuberculosis
RIDAPYMRPGLDEP

SEQ ID NO: 101884 - protein, 14 aa, Mycobacterium tuberculosis
IDAPYMRPGLDEPA

SEQ ID NO: 101885 - protein, 14 aa, Mycobacterium tuberculosis
DAPYMRPGLDEPAM

SEQ ID NO: 101886 - protein, 14 aa, Mycobacterium tuberculosis
APYMRPGLDEPAMA

SEQ ID NO: 101887 - protein, 14 aa, Mycobacterium tuberculosis
PYMRPGLDEPAMAA

SEQ ID NO: 101888 - protein, 14 aa, Mycobacterium tuberculosis
YMRPGLDEPAMAAL

SEQ ID NO: 101889 - protein, 14 aa, Mycobacterium tuberculosis
MRPGLDEPAMAALE

SEQ ID NO: 101890 - protein, 14 aa, Mycobacterium tuberculosis
RPGLDEPAMAALEA

SEQ ID NO: 101891 - protein, 14 aa, Mycobacterium tuberculosis
PGLDEPAMAALEAE

SEQ ID NO: 101892 - protein, 14 aa, Mycobacterium tuberculosis
GLDEPAMAALEAEA

SEQ ID NO: 101893 - protein, 14 aa, Mycobacterium tuberculosis
LDEPAMAALEAEAL

SEQ ID NO: 101894 - protein, 14 aa, Mycobacterium tuberculosis
DEPAMAALEAEALR

SEQ ID NO: 101895 - protein, 14 aa, Mycobacterium tuberculosis
EPAMAALEAEALRQ

SEQ ID NO: 101896 - protein, 14 aa, Mycobacterium tuberculosis
PAMAALEAEALRQA

SEQ ID NO: 101897 - protein, 14 aa, Mycobacterium tuberculosis
AMAALEAEALRQAR

SEQ ID NO: 101898 - protein, 14 aa, Mycobacterium tuberculosis
MAALEAEALRQARA

SEQ ID NO: 101899 - protein, 14 aa, Mycobacterium tuberculosis
AALEAEALRQARAA

SEQ ID NO: 101900 - protein, 14 aa, Mycobacterium tuberculosis
ALEAEALRQARAAF

SEQ ID NO: 101901 - protein, 14 aa, Mycobacterium tuberculosis
LEAEALRQARAAFE

SEQ ID NO: 101902 - protein, 14 aa, Mycobacterium tuberculosis
EAEALRQARAAFET

SEQ ID NO: 101903 - protein, 14 aa, Mycobacterium tuberculosis
AEALRQARAAFETR

SEQ ID NO: 101904 - protein, 14 aa, Mycobacterium tuberculosis
EALRQARAAFETRP

SEQ ID NO: 101905 - protein, 14 aa, Mycobacterium tuberculosis
ALRQARAAFETRPH

SEQ ID NO: 101906 - protein, 14 aa, Mycobacterium tuberculosis
LRQARAAFETRPHD

SEQ ID NO: 101907 - protein, 14 aa, Mycobacterium tuberculosis
RQARAAFETRPHDI

SEQ ID NO: 101908 - protein, 14 aa, Mycobacterium tuberculosis
QARAAFETRPHDIA

SEQ ID NO: 101909 - protein, 14 aa, Mycobacterium tuberculosis
ARAAFETRPHDIAC

SEQ ID NO: 101910 - protein, 14 aa, Mycobacterium tuberculosis
RAAFETRPHDIACF

SEQ ID NO: 101911 - protein, 14 aa, Mycobacterium tuberculosis
AAFETRPHDIACFV

SEQ ID NO: 101912 - protein, 14 aa, Mycobacterium tuberculosis
AFETRPHDIACFVA

SEQ ID NO: 101913 - protein, 14 aa, Mycobacterium tuberculosis
FETRPHDIACFVAE

SEQ ID NO: 101914 - protein, 14 aa, Mycobacterium tuberculosis
ETRPHDIACFVAEP

SEQ ID NO: 101915 - protein, 14 aa, Mycobacterium tuberculosis
TRPHDIACFVAEPI

SEQ ID NO: 101916 - protein, 14 aa, Mycobacterium tuberculosis
RPHDIACFVAEPIQ

SEQ ID NO: 101917 - protein, 14 aa, Mycobacterium tuberculosis
PHDIACFVAEPIQG

SEQ ID NO: 101918 - protein, 14 aa, Mycobacterium tuberculosis
HDIACFVAEPIQGE

SEQ ID NO: 101919 - protein, 14 aa, Mycobacterium tuberculosis
DIACFVAEPIQGEG

SEQ ID NO: 101920 - protein, 14 aa, Mycobacterium tuberculosis
IACFVAEPIQGEGG

SEQ ID NO: 101921 - protein, 14 aa, Mycobacterium tuberculosis
ACFVAEPIQGEGGD

SEQ ID NO: 101922 - protein, 14 aa, Mycobacterium tuberculosis
CFVAEPIQGEGGDR

SEQ ID NO: 101923 - protein, 14 aa, Mycobacterium tuberculosis
FVAEPIQGEGGDRH

SEQ ID NO: 101924 - protein, 14 aa, Mycobacterium tuberculosis
VAEPIQGEGGDRHF

SEQ ID NO: 101925 - protein, 14 aa, Mycobacterium tuberculosis
AEPIQGEGGDRHFR

SEQ ID NO: 101926 - protein, 14 aa, Mycobacterium tuberculosis
EPIQGEGGDRHFRP

SEQ ID NO: 101927 - protein, 14 aa, Mycobacterium tuberculosis
PIQGEGGDRHFRPE

SEQ ID NO: 101928 - protein, 14 aa, Mycobacterium tuberculosis
IQGEGGDRHFRPEF

SEQ ID NO: 101929 - protein, 14 aa, Mycobacterium tuberculosis
QGEGGDRHFRPEFF

SEQ ID NO: 101930 - protein, 14 aa, Mycobacterium tuberculosis
GEGGDRHFRPEFFA

SEQ ID NO: 101931 - protein, 14 aa, Mycobacterium tuberculosis
EGGDRHFRPEFFAA

SEQ ID NO: 101932 - protein, 14 aa, Mycobacterium tuberculosis
GGDRHFRPEFFAAM

SEQ ID NO: 101933 - protein, 14 aa, Mycobacterium tuberculosis
GDRHFRPEFFAAMR

SEQ ID NO: 101934 - protein, 14 aa, Mycobacterium tuberculosis
DRHFRPEFFAAMRE

SEQ ID NO: 101935 - protein, 14 aa, Mycobacterium tuberculosis
RHFRPEFFAAMREL

SEQ ID NO: 101936 - protein, 14 aa, Mycobacterium tuberculosis
HFRPEFFAAMRELC

SEQ ID NO: 101937 - protein, 14 aa, Mycobacterium tuberculosis
FRPEFFAAMRELCD

SEQ ID NO: 101938 - protein, 14 aa, Mycobacterium tuberculosis
RPEFFAAMRELCDE

SEQ ID NO: 101939 - protein, 14 aa, Mycobacterium tuberculosis
PEFFAAMRELCDEF

SEQ ID NO: 101940 - protein, 14 aa, Mycobacterium tuberculosis
EFFAAMRELCDEFD

SEQ ID NO: 101941 - protein, 14 aa, Mycobacterium tuberculosis
FFAAMRELCDEFDA

SEQ ID NO: 101942 - protein, 14 aa, Mycobacterium tuberculosis
FAAMRELCDEFDAL

SEQ ID NO: 101943 - protein, 14 aa, Mycobacterium tuberculosis
AAMRELCDEFDALL

SEQ ID NO: 101944 - protein, 14 aa, Mycobacterium tuberculosis
AMRELCDEFDALLI

SEQ ID NO: 101945 - protein, 14 aa, Mycobacterium tuberculosis
MRELCDEFDALLIF

SEQ ID NO: 101946 - protein, 14 aa, Mycobacterium tuberculosis
RELCDEFDALLIFD

SEQ ID NO: 101947 - protein, 14 aa, Mycobacterium tuberculosis
ELCDEFDALLIFDE

SEQ ID NO: 101948 - protein, 14 aa, Mycobacterium tuberculosis
LCDEFDALLIFDEV

SEQ ID NO: 101949 - protein, 14 aa, Mycobacterium tuberculosis
CDEFDALLIFDEVQ

SEQ ID NO: 101950 - protein, 14 aa, Mycobacterium tuberculosis
DEFDALLIFDEVQT

SEQ ID NO: 101951 - protein, 14 aa, Mycobacterium tuberculosis
EFDALLIFDEVQTG

SEQ ID NO: 101952 - protein, 14 aa, Mycobacterium tuberculosis
FDALLIFDEVQTGC

SEQ ID NO: 101953 - protein, 14 aa, Mycobacterium tuberculosis
DALLIFDEVQTGCG

SEQ ID NO: 101954 - protein, 14 aa, Mycobacterium tuberculosis
ALLIFDEVQTGCGL

SEQ ID NO: 101955 - protein, 14 aa, Mycobacterium tuberculosis
LLIFDEVQTGCGLT

SEQ ID NO: 101956 - protein, 14 aa, Mycobacterium tuberculosis
LIFDEVQTGCGLTG

SEQ ID NO: 101957 - protein, 14 aa, Mycobacterium tuberculosis
IFDEVQTGCGLTGT

SEQ ID NO: 101958 - protein, 14 aa, Mycobacterium tuberculosis
FDEVQTGCGLTGTA

SEQ ID NO: 101959 - protein, 14 aa, Mycobacterium tuberculosis
DEVQTGCGLTGTAW

SEQ ID NO: 101960 - protein, 14 aa, Mycobacterium tuberculosis
EVQTGCGLTGTAWA

SEQ ID NO: 101961 - protein, 14 aa, Mycobacterium tuberculosis
VQTGCGLTGTAWAY

SEQ ID NO: 101962 - protein, 14 aa, Mycobacterium tuberculosis
QTGCGLTGTAWAYQ

SEQ ID NO: 101963 - protein, 14 aa, Mycobacterium tuberculosis
TGCGLTGTAWAYQQ

SEQ ID NO: 101964 - protein, 14 aa, Mycobacterium tuberculosis
GCGLTGTAWAYQQL

SEQ ID NO: 101965 - protein, 14 aa, Mycobacterium tuberculosis
CGLTGTAWAYQQLD

SEQ ID NO: 101966 - protein, 14 aa, Mycobacterium tuberculosis
GLTGTAWAYQQLDV

SEQ ID NO: 101967 - protein, 14 aa, Mycobacterium tuberculosis
LTGTAWAYQQLDVA

SEQ ID NO: 101968 - protein, 14 aa, Mycobacterium tuberculosis
TGTAWAYQQLDVAP

SEQ ID NO: 101969 - protein, 14 aa, Mycobacterium tuberculosis
GTAWAYQQLDVAPD

SEQ ID NO: 101970 - protein, 14 aa, Mycobacterium tuberculosis
TAWAYQQLDVAPDI

SEQ ID NO: 101971 - protein, 14 aa, Mycobacterium tuberculosis
AWAYQQLDVAPDIV

SEQ ID NO: 101972 - protein, 14 aa, Mycobacterium tuberculosis
WAYQQLDVAPDIVA

SEQ ID NO: 101973 - protein, 14 aa, Mycobacterium tuberculosis
AYQQLDVAPDIVAF

SEQ ID NO: 101974 - protein, 14 aa, Mycobacterium tuberculosis
YQQLDVAPDIVAFG

SEQ ID NO: 101975 - protein, 14 aa, Mycobacterium tuberculosis
QQLDVAPDIVAFGK

SEQ ID NO: 101976 - protein, 14 aa, Mycobacterium tuberculosis
QLDVAPDIVAFGKK

SEQ ID NO: 101977 - protein, 14 aa, Mycobacterium tuberculosis
LDVAPDIVAFGKKT

SEQ ID NO: 101978 - protein, 14 aa, Mycobacterium tuberculosis
DVAPDIVAFGKKTQ

SEQ ID NO: 101979 - protein, 14 aa, Mycobacterium tuberculosis
VAPDIVAFGKKTQV

SEQ ID NO: 101980 - protein, 14 aa, Mycobacterium tuberculosis
APDIVAFGKKTQVC

SEQ ID NO: 101981 - protein, 14 aa, Mycobacterium tuberculosis
PDIVAFGKKTQVCG

SEQ ID NO: 101982 - protein, 14 aa, Mycobacterium tuberculosis
DIVAFGKKTQVCGV

SEQ ID NO: 101983 - protein, 14 aa, Mycobacterium tuberculosis
IVAFGKKTQVCGVM

SEQ ID NO: 101984 - protein, 14 aa, Mycobacterium tuberculosis
VAFGKKTQVCGVMA

SEQ ID NO: 101985 - protein, 14 aa, Mycobacterium tuberculosis
AFGKKTQVCGVMAG

SEQ ID NO: 101986 - protein, 14 aa, Mycobacterium tuberculosis
FGKKTQVCGVMAGR

SEQ ID NO: 101987 - protein, 14 aa, Mycobacterium tuberculosis
GKKTQVCGVMAGRR

SEQ ID NO: 101988 - protein, 14 aa, Mycobacterium tuberculosis
KKTQVCGVMAGRRV

SEQ ID NO: 101989 - protein, 14 aa, Mycobacterium tuberculosis
KTQVCGVMAGRRVD

SEQ ID NO: 101990 - protein, 14 aa, Mycobacterium tuberculosis
TQVCGVMAGRRVDE

SEQ ID NO: 101991 - protein, 14 aa, Mycobacterium tuberculosis
QVCGVMAGRRVDEV

SEQ ID NO: 101992 - protein, 14 aa, Mycobacterium tuberculosis
VCGVMAGRRVDEVA

SEQ ID NO: 101993 - protein, 14 aa, Mycobacterium tuberculosis
CGVMAGRRVDEVAD

SEQ ID NO: 101994 - protein, 14 aa, Mycobacterium tuberculosis
GVMAGRRVDEVADN

SEQ ID NO: 101995 - protein, 14 aa, Mycobacterium tuberculosis
VMAGRRVDEVADNV

SEQ ID NO: 101996 - protein, 14 aa, Mycobacterium tuberculosis
MAGRRVDEVADNVF

SEQ ID NO: 101997 - protein, 14 aa, Mycobacterium tuberculosis
AGRRVDEVADNVFA

SEQ ID NO: 101998 - protein, 14 aa, Mycobacterium tuberculosis
GRRVDEVADNVFAV

SEQ ID NO: 101999 - protein, 14 aa, Mycobacterium tuberculosis
RRVDEVADNVFAVP

SEQ ID NO: 102000 - protein, 14 aa, Mycobacterium tuberculosis
RVDEVADNVFAVPS

SEQ ID NO: 102001 - protein, 14 aa, Mycobacterium tuberculosis
VDEVADNVFAVPSR

SEQ ID NO: 102002 - protein, 14 aa, Mycobacterium tuberculosis
DEVADNVFAVPSRL

SEQ ID NO: 102003 - protein, 14 aa, Mycobacterium tuberculosis
EVADNVFAVPSRLN

SEQ ID NO: 102004 - protein, 14 aa, Mycobacterium tuberculosis
VADNVFAVPSRLNS

SEQ ID NO: 102005 - protein, 14 aa, Mycobacterium tuberculosis
ADNVFAVPSRLNST

SEQ ID NO: 102006 - protein, 14 aa, Mycobacterium tuberculosis
DNVFAVPSRLNSTW

SEQ ID NO: 102007 - protein, 14 aa, Mycobacterium tuberculosis
NVFAVPSRLNSTWG

SEQ ID NO: 102008 - protein, 14 aa, Mycobacterium tuberculosis
VFAVPSRLNSTWGG

SEQ ID NO: 102009 - protein, 14 aa, Mycobacterium tuberculosis
FAVPSRLNSTWGGN

SEQ ID NO: 102010 - protein, 14 aa, Mycobacterium tuberculosis
AVPSRLNSTWGGNL

SEQ ID NO: 102011 - protein, 14 aa, Mycobacterium tuberculosis
VPSRLNSTWGGNLT

SEQ ID NO: 102012 - protein, 14 aa, Mycobacterium tuberculosis
PSRLNSTWGGNLTD

SEQ ID NO: 102013 - protein, 14 aa, Mycobacterium tuberculosis
SRLNSTWGGNLTDM

SEQ ID NO: 102014 - protein, 14 aa, Mycobacterium tuberculosis
RLNSTWGGNLTDMV

SEQ ID NO: 102015 - protein, 14 aa, Mycobacterium tuberculosis
LNSTWGGNLTDMVR

SEQ ID NO: 102016 - protein, 14 aa, Mycobacterium tuberculosis
NSTWGGNLTDMVRA

SEQ ID NO: 102017 - protein, 14 aa, Mycobacterium tuberculosis
STWGGNLTDMVRAR

SEQ ID NO: 102018 - protein, 14 aa, Mycobacterium tuberculosis
TWGGNLTDMVRARR

SEQ ID NO: 102019 - protein, 14 aa, Mycobacterium tuberculosis
WGGNLTDMVRARRI

SEQ ID NO: 102020 - protein, 14 aa, Mycobacterium tuberculosis
GGNLTDMVRARRIL

SEQ ID NO: 102021 - protein, 14 aa, Mycobacterium tuberculosis
GNLTDMVRARRILE

SEQ ID NO: 102022 - protein, 14 aa, Mycobacterium tuberculosis
NLTDMVRARRILEV

SEQ ID NO: 102023 - protein, 14 aa, Mycobacterium tuberculosis
LTDMVRARRILEVI

SEQ ID NO: 102024 - protein, 14 aa, Mycobacterium tuberculosis
TDMVRARRILEVIE

SEQ ID NO: 102025 - protein, 14 aa, Mycobacterium tuberculosis
DMVRARRILEVIEA

SEQ ID NO: 102026 - protein, 14 aa, Mycobacterium tuberculosis
MVRARRILEVIEAE

SEQ ID NO: 102027 - protein, 14 aa, Mycobacterium tuberculosis
VRARRILEVIEAEG

SEQ ID NO: 102028 - protein, 14 aa, Mycobacterium tuberculosis
RARRILEVIEAEGL

SEQ ID NO: 102029 - protein, 14 aa, Mycobacterium tuberculosis
ARRILEVIEAEGLF

SEQ ID NO: 102030 - protein, 14 aa, Mycobacterium tuberculosis
RRILEVIEAEGLFE

SEQ ID NO: 102031 - protein, 14 aa, Mycobacterium tuberculosis
RILEVIEAEGLFER

SEQ ID NO: 102032 - protein, 14 aa, Mycobacterium tuberculosis
ILEVIEAEGLFERA

SEQ ID NO: 102033 - protein, 14 aa, Mycobacterium tuberculosis
LEVIEAEGLFERAV

SEQ ID NO: 102034 - protein, 14 aa, Mycobacterium tuberculosis
EVIEAEGLFERAVQ

SEQ ID NO: 102035 - protein, 14 aa, Mycobacterium tuberculosis
VIEAEGLFERAVQH

SEQ ID NO: 102036 - protein, 14 aa, Mycobacterium tuberculosis
IEAEGLFERAVQHG

SEQ ID NO: 102037 - protein, 14 aa, Mycobacterium tuberculosis
EAEGLFERAVQHGK

SEQ ID NO: 102038 - protein, 14 aa, Mycobacterium tuberculosis
AEGLFERAVQHGKY

SEQ ID NO: 102039 - protein, 14 aa, Mycobacterium tuberculosis
EGLFERAVQHGKYL

SEQ ID NO: 102040 - protein, 14 aa, Mycobacterium tuberculosis
GLFERAVQHGKYLR

SEQ ID NO: 102041 - protein, 14 aa, Mycobacterium tuberculosis
LFERAVQHGKYLRA

SEQ ID NO: 102042 - protein, 14 aa, Mycobacterium tuberculosis
FERAVQHGKYLRAR

SEQ ID NO: 102043 - protein, 14 aa, Mycobacterium tuberculosis
ERAVQHGKYLRARL

SEQ ID NO: 102044 - protein, 14 aa, Mycobacterium tuberculosis
RAVQHGKYLRARLD

SEQ ID NO: 102045 - protein, 14 aa, Mycobacterium tuberculosis
AVQHGKYLRARLDE

SEQ ID NO: 102046 - protein, 14 aa, Mycobacterium tuberculosis
VQHGKYLRARLDEL

SEQ ID NO: 102047 - protein, 14 aa, Mycobacterium tuberculosis
QHGKYLRARLDELA

SEQ ID NO: 102048 - protein, 14 aa, Mycobacterium tuberculosis
HGKYLRARLDELAA

SEQ ID NO: 102049 - protein, 14 aa, Mycobacterium tuberculosis
GKYLRARLDELAAD

SEQ ID NO: 102050 - protein, 14 aa, Mycobacterium tuberculosis
KYLRARLDELAADF

SEQ ID NO: 102051 - protein, 14 aa, Mycobacterium tuberculosis
YLRARLDELAADFP

SEQ ID NO: 102052 - protein, 14 aa, Mycobacterium tuberculosis
LRARLDELAADFPA

SEQ ID NO: 102053 - protein, 14 aa, Mycobacterium tuberculosis
RARLDELAADFPAV

SEQ ID NO: 102054 - protein, 14 aa, Mycobacterium tuberculosis
ARLDELAADFPAVV

SEQ ID NO: 102055 - protein, 14 aa, Mycobacterium tuberculosis
RLDELAADFPAVVL

SEQ ID NO: 102056 - protein, 14 aa, Mycobacterium tuberculosis
LDELAADFPAVVLD

SEQ ID NO: 102057 - protein, 14 aa, Mycobacterium tuberculosis
DELAADFPAVVLDP

SEQ ID NO: 102058 - protein, 14 aa, Mycobacterium tuberculosis
ELAADFPAVVLDPR

SEQ ID NO: 102059 - protein, 14 aa, Mycobacterium tuberculosis
LAADFPAVVLDPRG

SEQ ID NO: 102060 - protein, 14 aa, Mycobacterium tuberculosis
AADFPAVVLDPRGR

SEQ ID NO: 102061 - protein, 14 aa, Mycobacterium tuberculosis
ADFPAVVLDPRGRG

SEQ ID NO: 102062 - protein, 14 aa, Mycobacterium tuberculosis
DFPAVVLDPRGRGL

SEQ ID NO: 102063 - protein, 14 aa, Mycobacterium tuberculosis
FPAVVLDPRGRGLM

SEQ ID NO: 102064 - protein, 14 aa, Mycobacterium tuberculosis
PAVVLDPRGRGLMC

SEQ ID NO: 102065 - protein, 14 aa, Mycobacterium tuberculosis
AVVLDPRGRGLMCA

SEQ ID NO: 102066 - protein, 14 aa, Mycobacterium tuberculosis
VVLDPRGRGLMCAF

SEQ ID NO: 102067 - protein, 14 aa, Mycobacterium tuberculosis
VLDPRGRGLMCAFS

SEQ ID NO: 102068 - protein, 14 aa, Mycobacterium tuberculosis
LDPRGRGLMCAFSL

SEQ ID NO: 102069 - protein, 14 aa, Mycobacterium tuberculosis
DPRGRGLMCAFSLP

SEQ ID NO: 102070 - protein, 14 aa, Mycobacterium tuberculosis
PRGRGLMCAFSLPT

SEQ ID NO: 102071 - protein, 14 aa, Mycobacterium tuberculosis
RGRGLMCAFSLPTT

SEQ ID NO: 102072 - protein, 14 aa, Mycobacterium tuberculosis
GRGLMCAFSLPTTA

SEQ ID NO: 102073 - protein, 14 aa, Mycobacterium tuberculosis
RGLMCAFSLPTTAD

SEQ ID NO: 102074 - protein, 14 aa, Mycobacterium tuberculosis
GLMCAFSLPTTADR

SEQ ID NO: 102075 - protein, 14 aa, Mycobacterium tuberculosis
LMCAFSLPTTADRD

SEQ ID NO: 102076 - protein, 14 aa, Mycobacterium tuberculosis
MCAFSLPTTADRDE

SEQ ID NO: 102077 - protein, 14 aa, Mycobacterium tuberculosis
CAFSLPTTADRDEL

SEQ ID NO: 102078 - protein, 14 aa, Mycobacterium tuberculosis
AFSLPTTADRDELI

SEQ ID NO: 102079 - protein, 14 aa, Mycobacterium tuberculosis
FSLPTTADRDELIR

SEQ ID NO: 102080 - protein, 14 aa, Mycobacterium tuberculosis
SLPTTADRDELIRQ

SEQ ID NO: 102081 - protein, 14 aa, Mycobacterium tuberculosis
LPTTADRDELIRQL

SEQ ID NO: 102082 - protein, 14 aa, Mycobacterium tuberculosis
PTTADRDELIRQLW

SEQ ID NO: 102083 - protein, 14 aa, Mycobacterium tuberculosis
TTADRDELIRQLWQ

SEQ ID NO: 102084 - protein, 14 aa, Mycobacterium tuberculosis
TADRDELIRQLWQR

SEQ ID NO: 102085 - protein, 14 aa, Mycobacterium tuberculosis
ADRDELIRQLWQRA

SEQ ID NO: 102086 - protein, 14 aa, Mycobacterium tuberculosis
DRDELIRQLWQRAV

SEQ ID NO: 102087 - protein, 14 aa, Mycobacterium tuberculosis
RDELIRQLWQRAVI

SEQ ID NO: 102088 - protein, 14 aa, Mycobacterium tuberculosis
DELIRQLWQRAVIV

SEQ ID NO: 102089 - protein, 14 aa, Mycobacterium tuberculosis
ELIRQLWQRAVIVL

SEQ ID NO: 102090 - protein, 14 aa, Mycobacterium tuberculosis
LIRQLWQRAVIVLP

SEQ ID NO: 102091 - protein, 14 aa, Mycobacterium tuberculosis
IRQLWQRAVIVLPA

SEQ ID NO: 102092 - protein, 14 aa, Mycobacterium tuberculosis
RQLWQRAVIVLPAG

SEQ ID NO: 102093 - protein, 14 aa, Mycobacterium tuberculosis
QLWQRAVIVLPAGA

SEQ ID NO: 102094 - protein, 14 aa, Mycobacterium tuberculosis
LWQRAVIVLPAGAD

SEQ ID NO: 102095 - protein, 14 aa, Mycobacterium tuberculosis
WQRAVIVLPAGADT

SEQ ID NO: 102096 - protein, 14 aa, Mycobacterium tuberculosis
QRAVIVLPAGADTV

SEQ ID NO: 102097 - protein, 14 aa, Mycobacterium tuberculosis
RAVIVLPAGADTVR

SEQ ID NO: 102098 - protein, 14 aa, Mycobacterium tuberculosis
AVIVLPAGADTVRF

SEQ ID NO: 102099 - protein, 14 aa, Mycobacterium tuberculosis
VIVLPAGADTVRFR

SEQ ID NO: 102100 - protein, 14 aa, Mycobacterium tuberculosis
IVLPAGADTVRFRP

SEQ ID NO: 102101 - protein, 14 aa, Mycobacterium tuberculosis
VLPAGADTVRFRPP

SEQ ID NO: 102102 - protein, 14 aa, Mycobacterium tuberculosis
LPAGADTVRFRPPL

SEQ ID NO: 102103 - protein, 14 aa, Mycobacterium tuberculosis
PAGADTVRFRPPLT

SEQ ID NO: 102104 - protein, 14 aa, Mycobacterium tuberculosis
AGADTVRFRPPLTV

SEQ ID NO: 102105 - protein, 14 aa, Mycobacterium tuberculosis
GADTVRFRPPLTVS

SEQ ID NO: 102106 - protein, 14 aa, Mycobacterium tuberculosis
ADTVRFRPPLTVST

SEQ ID NO: 102107 - protein, 14 aa, Mycobacterium tuberculosis
DTVRFRPPLTVSTA

SEQ ID NO: 102108 - protein, 14 aa, Mycobacterium tuberculosis
TVRFRPPLTVSTAE

SEQ ID NO: 102109 - protein, 14 aa, Mycobacterium tuberculosis
VRFRPPLTVSTAEI

SEQ ID NO: 102110 - protein, 14 aa, Mycobacterium tuberculosis
RFRPPLTVSTAEID

SEQ ID NO: 102111 - protein, 14 aa, Mycobacterium tuberculosis
FRPPLTVSTAEIDA

SEQ ID NO: 102112 - protein, 14 aa, Mycobacterium tuberculosis
RPPLTVSTAEIDAA

SEQ ID NO: 102113 - protein, 14 aa, Mycobacterium tuberculosis
PPLTVSTAEIDAAI

SEQ ID NO: 102114 - protein, 14 aa, Mycobacterium tuberculosis
PLTVSTAEIDAAIA

SEQ ID NO: 102115 - protein, 14 aa, Mycobacterium tuberculosis
LTVSTAEIDAAIAA

SEQ ID NO: 102116 - protein, 14 aa, Mycobacterium tuberculosis
TVSTAEIDAAIAAV

SEQ ID NO: 102117 - protein, 14 aa, Mycobacterium tuberculosis
VSTAEIDAAIAAVR

SEQ ID NO: 102118 - protein, 14 aa, Mycobacterium tuberculosis
STAEIDAAIAAVRS

SEQ ID NO: 102119 - protein, 14 aa, Mycobacterium tuberculosis
TAEIDAAIAAVRSA

SEQ ID NO: 102120 - protein, 14 aa, Mycobacterium tuberculosis
AEIDAAIAAVRSAL

SEQ ID NO: 102121 - protein, 14 aa, Mycobacterium tuberculosis
EIDAAIAAVRSALP

SEQ ID NO: 102122 - protein, 14 aa, Mycobacterium tuberculosis
IDAAIAAVRSALPV

SEQ ID NO: 102123 - protein, 14 aa, Mycobacterium tuberculosis
DAAIAAVRSALPVV

SEQ ID NO: 102124 - protein, 14 aa, Mycobacterium tuberculosis
AAIAAVRSALPVVT

SEQ ID NO: 102125 - protein, 15 aa, Mycobacterium tuberculosis
MAAVVKSVALAGRPT

SEQ ID NO: 102126 - protein, 15 aa, Mycobacterium tuberculosis
AAVVKSVALAGRPTT

SEQ ID NO: 102127 - protein, 15 aa, Mycobacterium tuberculosis
AVVKSVALAGRPTTP

SEQ ID NO: 102128 - protein, 15 aa, Mycobacterium tuberculosis
VVKSVALAGRPTTPD

SEQ ID NO: 102129 - protein, 15 aa, Mycobacterium tuberculosis
VKSVALAGRPTTPDR

SEQ ID NO: 102130 - protein, 15 aa, Mycobacterium tuberculosis
KSVALAGRPTTPDRV

SEQ ID NO: 102131 - protein, 15 aa, Mycobacterium tuberculosis
SVALAGRPTTPDRVH

SEQ ID NO: 102132 - protein, 15 aa, Mycobacterium tuberculosis
VALAGRPTTPDRVHE

SEQ ID NO: 102133 - protein, 15 aa, Mycobacterium tuberculosis
ALAGRPTTPDRVHEV

SEQ ID NO: 102134 - protein, 15 aa, Mycobacterium tuberculosis
LAGRPTTPDRVHEVL

SEQ ID NO: 102135 - protein, 15 aa, Mycobacterium tuberculosis
AGRPTTPDRVHEVLG

SEQ ID NO: 102136 - protein, 15 aa, Mycobacterium tuberculosis
GRPTTPDRVHEVLGR

SEQ ID NO: 102137 - protein, 15 aa, Mycobacterium tuberculosis
RPTTPDRVHEVLGRS

SEQ ID NO: 102138 - protein, 15 aa, Mycobacterium tuberculosis
PTTPDRVHEVLGRSM

SEQ ID NO: 102139 - protein, 15 aa, Mycobacterium tuberculosis
TTPDRVHEVLGRSML

SEQ ID NO: 102140 - protein, 15 aa, Mycobacterium tuberculosis
TPDRVHEVLGRSMLV

SEQ ID NO: 102141 - protein, 15 aa, Mycobacterium tuberculosis
PDRVHEVLGRSMLVD

SEQ ID NO: 102142 - protein, 15 aa, Mycobacterium tuberculosis
DRVHEVLGRSMLVDG

SEQ ID NO: 102143 - protein, 15 aa, Mycobacterium tuberculosis
RVHEVLGRSMLVDGL

SEQ ID NO: 102144 - protein, 15 aa, Mycobacterium tuberculosis
VHEVLGRSMLVDGLD

SEQ ID NO: 102145 - protein, 15 aa, Mycobacterium tuberculosis
HEVLGRSMLVDGLDI

SEQ ID NO: 102146 - protein, 15 aa, Mycobacterium tuberculosis
EVLGRSMLVDGLDIV

SEQ ID NO: 102147 - protein, 15 aa, Mycobacterium tuberculosis
VLGRSMLVDGLDIVL

SEQ ID NO: 102148 - protein, 15 aa, Mycobacterium tuberculosis
LGRSMLVDGLDIVLD

SEQ ID NO: 102149 - protein, 15 aa, Mycobacterium tuberculosis
GRSMLVDGLDIVLDL

SEQ ID NO: 102150 - protein, 15 aa, Mycobacterium tuberculosis
RSMLVDGLDIVLDLT

SEQ ID NO: 102151 - protein, 15 aa, Mycobacterium tuberculosis
SMLVDGLDIVLDLTR

SEQ ID NO: 102152 - protein, 15 aa, Mycobacterium tuberculosis
MLVDGLDIVLDLTRS

SEQ ID NO: 102153 - protein, 15 aa, Mycobacterium tuberculosis
LVDGLDIVLDLTRSG

SEQ ID NO: 102154 - protein, 15 aa, Mycobacterium tuberculosis
VDGLDIVLDLTRSGG

SEQ ID NO: 102155 - protein, 15 aa, Mycobacterium tuberculosis
DGLDIVLDLTRSGGS

SEQ ID NO: 102156 - protein, 15 aa, Mycobacterium tuberculosis
GLDIVLDLTRSGGSY

SEQ ID NO: 102157 - protein, 15 aa, Mycobacterium tuberculosis
LDIVLDLTRSGGSYL

SEQ ID NO: 102158 - protein, 15 aa, Mycobacterium tuberculosis
DIVLDLTRSGGSYLV

SEQ ID NO: 102159 - protein, 15 aa, Mycobacterium tuberculosis
IVLDLTRSGGSYLVD

SEQ ID NO: 102160 - protein, 15 aa, Mycobacterium tuberculosis
VLDLTRSGGSYLVDA

SEQ ID NO: 102161 - protein, 15 aa, Mycobacterium tuberculosis
LDLTRSGGSYLVDAI

SEQ ID NO: 102162 - protein, 15 aa, Mycobacterium tuberculosis
DLTRSGGSYLVDAIT

SEQ ID NO: 102163 - protein, 15 aa, Mycobacterium tuberculosis
LTRSGGSYLVDAITG

SEQ ID NO: 102164 - protein, 15 aa, Mycobacterium tuberculosis
TRSGGSYLVDAITGR

SEQ ID NO: 102165 - protein, 15 aa, Mycobacterium tuberculosis
RSGGSYLVDAITGRR

SEQ ID NO: 102166 - protein, 15 aa, Mycobacterium tuberculosis
SGGSYLVDAITGRRY

SEQ ID NO: 102167 - protein, 15 aa, Mycobacterium tuberculosis
GGSYLVDAITGRRYL

SEQ ID NO: 102168 - protein, 15 aa, Mycobacterium tuberculosis
GSYLVDAITGRRYLD

SEQ ID NO: 102169 - protein, 15 aa, Mycobacterium tuberculosis
SYLVDAITGRRYLDM

SEQ ID NO: 102170 - protein, 15 aa, Mycobacterium tuberculosis
YLVDAITGRRYLDMF

SEQ ID NO: 102171 - protein, 15 aa, Mycobacterium tuberculosis
LVDAITGRRYLDMFT

SEQ ID NO: 102172 - protein, 15 aa, Mycobacterium tuberculosis
VDAITGRRYLDMFTF

SEQ ID NO: 102173 - protein, 15 aa, Mycobacterium tuberculosis
DAITGRRYLDMFTFV

SEQ ID NO: 102174 - protein, 15 aa, Mycobacterium tuberculosis
AITGRRYLDMFTFVA

SEQ ID NO: 102175 - protein, 15 aa, Mycobacterium tuberculosis
ITGRRYLDMFTFVAS

SEQ ID NO: 102176 - protein, 15 aa, Mycobacterium tuberculosis
TGRRYLDMFTFVASS

SEQ ID NO: 102177 - protein, 15 aa, Mycobacterium tuberculosis
GRRYLDMFTFVASSA

SEQ ID NO: 102178 - protein, 15 aa, Mycobacterium tuberculosis
RRYLDMFTFVASSAL

SEQ ID NO: 102179 - protein, 15 aa, Mycobacterium tuberculosis
RYLDMFTFVASSALG

SEQ ID NO: 102180 - protein, 15 aa, Mycobacterium tuberculosis
YLDMFTFVASSALGM

SEQ ID NO: 102181 - protein, 15 aa, Mycobacterium tuberculosis
LDMFTFVASSALGMN

SEQ ID NO: 102182 - protein, 15 aa, Mycobacterium tuberculosis
DMFTFVASSALGMNP

SEQ ID NO: 102183 - protein, 15 aa, Mycobacterium tuberculosis
MFTFVASSALGMNPP

SEQ ID NO: 102184 - protein, 15 aa, Mycobacterium tuberculosis
FTFVASSALGMNPPA

SEQ ID NO: 102185 - protein, 15 aa, Mycobacterium tuberculosis
TFVASSALGMNPPAL

SEQ ID NO: 102186 - protein, 15 aa, Mycobacterium tuberculosis
FVASSALGMNPPALV

SEQ ID NO: 102187 - protein, 15 aa, Mycobacterium tuberculosis
VASSALGMNPPALVD

SEQ ID NO: 102188 - protein, 15 aa, Mycobacterium tuberculosis
ASSALGMNPPALVDD

SEQ ID NO: 102189 - protein, 15 aa, Mycobacterium tuberculosis
SSALGMNPPALVDDR

SEQ ID NO: 102190 - protein, 15 aa, Mycobacterium tuberculosis
SALGMNPPALVDDRE

SEQ ID NO: 102191 - protein, 15 aa, Mycobacterium tuberculosis
ALGMNPPALVDDREF

SEQ ID NO: 102192 - protein, 15 aa, Mycobacterium tuberculosis
LGMNPPALVDDREFH

SEQ ID NO: 102193 - protein, 15 aa, Mycobacterium tuberculosis
GMNPPALVDDREFHA

SEQ ID NO: 102194 - protein, 15 aa, Mycobacterium tuberculosis
MNPPALVDDREFHAE

SEQ ID NO: 102195 - protein, 15 aa, Mycobacterium tuberculosis
NPPALVDDREFHAEL

SEQ ID NO: 102196 - protein, 15 aa, Mycobacterium tuberculosis
PPALVDDREFHAELM

SEQ ID NO: 102197 - protein, 15 aa, Mycobacterium tuberculosis
PALVDDREFHAELMQ

SEQ ID NO: 102198 - protein, 15 aa, Mycobacterium tuberculosis
ALVDDREFHAELMQA

SEQ ID NO: 102199 - protein, 15 aa, Mycobacterium tuberculosis
LVDDREFHAELMQAA

SEQ ID NO: 102200 - protein, 15 aa, Mycobacterium tuberculosis
VDDREFHAELMQAAL

SEQ ID NO: 102201 - protein, 15 aa, Mycobacterium tuberculosis
DDREFHAELMQAALN

SEQ ID NO: 102202 - protein, 15 aa, Mycobacterium tuberculosis
DREFHAELMQAALNK

SEQ ID NO: 102203 - protein, 15 aa, Mycobacterium tuberculosis
REFHAELMQAALNKP

SEQ ID NO: 102204 - protein, 15 aa, Mycobacterium tuberculosis
EFHAELMQAALNKPS

SEQ ID NO: 102205 - protein, 15 aa, Mycobacterium tuberculosis
FHAELMQAALNKPSN

SEQ ID NO: 102206 - protein, 15 aa, Mycobacterium tuberculosis
HAELMQAALNKPSNS

SEQ ID NO: 102207 - protein, 15 aa, Mycobacterium tuberculosis
AELMQAALNKPSNSD

SEQ ID NO: 102208 - protein, 15 aa, Mycobacterium tuberculosis
ELMQAALNKPSNSDV

SEQ ID NO: 102209 - protein, 15 aa, Mycobacterium tuberculosis
LMQAALNKPSNSDVY

SEQ ID NO: 102210 - protein, 15 aa, Mycobacterium tuberculosis
MQAALNKPSNSDVYS

SEQ ID NO: 102211 - protein, 15 aa, Mycobacterium tuberculosis
QAALNKPSNSDVYSV

SEQ ID NO: 102212 - protein, 15 aa, Mycobacterium tuberculosis
AALNKPSNSDVYSVA

SEQ ID NO: 102213 - protein, 15 aa, Mycobacterium tuberculosis
ALNKPSNSDVYSVAM

SEQ ID NO: 102214 - protein, 15 aa, Mycobacterium tuberculosis
LNKPSNSDVYSVAMA

SEQ ID NO: 102215 - protein, 15 aa, Mycobacterium tuberculosis
NKPSNSDVYSVAMAR

SEQ ID NO: 102216 - protein, 15 aa, Mycobacterium tuberculosis
KPSNSDVYSVAMARF

SEQ ID NO: 102217 - protein, 15 aa, Mycobacterium tuberculosis
PSNSDVYSVAMARFV

SEQ ID NO: 102218 - protein, 15 aa, Mycobacterium tuberculosis
SNSDVYSVAMARFVE

SEQ ID NO: 102219 - protein, 15 aa, Mycobacterium tuberculosis
NSDVYSVAMARFVET

SEQ ID NO: 102220 - protein, 15 aa, Mycobacterium tuberculosis
SDVYSVAMARFVETF

SEQ ID NO: 102221 - protein, 15 aa, Mycobacterium tuberculosis
DVYSVAMARFVETFA

SEQ ID NO: 102222 - protein, 15 aa, Mycobacterium tuberculosis
VYSVAMARFVETFAR

SEQ ID NO: 102223 - protein, 15 aa, Mycobacterium tuberculosis
YSVAMARFVETFARV

SEQ ID NO: 102224 - protein, 15 aa, Mycobacterium tuberculosis
SVAMARFVETFARVL

SEQ ID NO: 102225 - protein, 15 aa, Mycobacterium tuberculosis
VAMARFVETFARVLG

SEQ ID NO: 102226 - protein, 15 aa, Mycobacterium tuberculosis
AMARFVETFARVLGD

SEQ ID NO: 102227 - protein, 15 aa, Mycobacterium tuberculosis
MARFVETFARVLGDP

SEQ ID NO: 102228 - protein, 15 aa, Mycobacterium tuberculosis
ARFVETFARVLGDPA

SEQ ID NO: 102229 - protein, 15 aa, Mycobacterium tuberculosis
RFVETFARVLGDPAL

SEQ ID NO: 102230 - protein, 15 aa, Mycobacterium tuberculosis
FVETFARVLGDPALP

SEQ ID NO: 102231 - protein, 15 aa, Mycobacterium tuberculosis
VETFARVLGDPALPH

SEQ ID NO: 102232 - protein, 15 aa, Mycobacterium tuberculosis
ETFARVLGDPALPHL

SEQ ID NO: 102233 - protein, 15 aa, Mycobacterium tuberculosis
TFARVLGDPALPHLF

SEQ ID NO: 102234 - protein, 15 aa, Mycobacterium tuberculosis
FARVLGDPALPHLFF

SEQ ID NO: 102235 - protein, 15 aa, Mycobacterium tuberculosis
ARVLGDPALPHLFFV

SEQ ID NO: 102236 - protein, 15 aa, Mycobacterium tuberculosis
RVLGDPALPHLFFVE

SEQ ID NO: 102237 - protein, 15 aa, Mycobacterium tuberculosis
VLGDPALPHLFFVEG

SEQ ID NO: 102238 - protein, 15 aa, Mycobacterium tuberculosis
LGDPALPHLFFVEGG

SEQ ID NO: 102239 - protein, 15 aa, Mycobacterium tuberculosis
GDPALPHLFFVEGGA

SEQ ID NO: 102240 - protein, 15 aa, Mycobacterium tuberculosis
DPALPHLFFVEGGAL

SEQ ID NO: 102241 - protein, 15 aa, Mycobacterium tuberculosis
PALPHLFFVEGGALA

SEQ ID NO: 102242 - protein, 15 aa, Mycobacterium tuberculosis
ALPHLFFVEGGALAV

SEQ ID NO: 102243 - protein, 15 aa, Mycobacterium tuberculosis
LPHLFFVEGGALAVE

SEQ ID NO: 102244 - protein, 15 aa, Mycobacterium tuberculosis
PHLFFVEGGALAVEN

SEQ ID NO: 102245 - protein, 15 aa, Mycobacterium tuberculosis
HLFFVEGGALAVENA

SEQ ID NO: 102246 - protein, 15 aa, Mycobacterium tuberculosis
LFFVEGGALAVENAL

SEQ ID NO: 102247 - protein, 15 aa, Mycobacterium tuberculosis
FFVEGGALAVENALK

SEQ ID NO: 102248 - protein, 15 aa, Mycobacterium tuberculosis
FVEGGALAVENALKA

SEQ ID NO: 102249 - protein, 15 aa, Mycobacterium tuberculosis
VEGGALAVENALKAA

SEQ ID NO: 102250 - protein, 15 aa, Mycobacterium tuberculosis
EGGALAVENALKAAF

SEQ ID NO: 102251 - protein, 15 aa, Mycobacterium tuberculosis
GGALAVENALKAAFD

SEQ ID NO: 102252 - protein, 15 aa, Mycobacterium tuberculosis
GALAVENALKAAFDW

SEQ ID NO: 102253 - protein, 15 aa, Mycobacterium tuberculosis
ALAVENALKAAFDWK

SEQ ID NO: 102254 - protein, 15 aa, Mycobacterium tuberculosis
LAVENALKAAFDWKS

SEQ ID NO: 102255 - protein, 15 aa, Mycobacterium tuberculosis
AVENALKAAFDWKSR

SEQ ID NO: 102256 - protein, 15 aa, Mycobacterium tuberculosis
VENALKAAFDWKSRH

SEQ ID NO: 102257 - protein, 15 aa, Mycobacterium tuberculosis
ENALKAAFDWKSRHN

SEQ ID NO: 102258 - protein, 15 aa, Mycobacterium tuberculosis
NALKAAFDWKSRHNQ

SEQ ID NO: 102259 - protein, 15 aa, Mycobacterium tuberculosis
ALKAAFDWKSRHNQA

SEQ ID NO: 102260 - protein, 15 aa, Mycobacterium tuberculosis
LKAAFDWKSRHNQAH

SEQ ID NO: 102261 - protein, 15 aa, Mycobacterium tuberculosis
KAAFDWKSRHNQAHG

SEQ ID NO: 102262 - protein, 15 aa, Mycobacterium tuberculosis
AAFDWKSRHNQAHGI

SEQ ID NO: 102263 - protein, 15 aa, Mycobacterium tuberculosis
AFDWKSRHNQAHGID

SEQ ID NO: 102264 - protein, 15 aa, Mycobacterium tuberculosis
FDWKSRHNQAHGIDP

SEQ ID NO: 102265 - protein, 15 aa, Mycobacterium tuberculosis
DWKSRHNQAHGIDPA

SEQ ID NO: 102266 - protein, 15 aa, Mycobacterium tuberculosis
WKSRHNQAHGIDPAL

SEQ ID NO: 102267 - protein, 15 aa, Mycobacterium tuberculosis
KSRHNQAHGIDPALG

SEQ ID NO: 102268 - protein, 15 aa, Mycobacterium tuberculosis
SRHNQAHGIDPALGT

SEQ ID NO: 102269 - protein, 15 aa, Mycobacterium tuberculosis
RHNQAHGIDPALGTQ

SEQ ID NO: 102270 - protein, 15 aa, Mycobacterium tuberculosis
HNQAHGIDPALGTQV

SEQ ID NO: 102271 - protein, 15 aa, Mycobacterium tuberculosis
NQAHGIDPALGTQVL

SEQ ID NO: 102272 - protein, 15 aa, Mycobacterium tuberculosis
QAHGIDPALGTQVLH

SEQ ID NO: 102273 - protein, 15 aa, Mycobacterium tuberculosis
AHGIDPALGTQVLHL

SEQ ID NO: 102274 - protein, 15 aa, Mycobacterium tuberculosis
HGIDPALGTQVLHLR

SEQ ID NO: 102275 - protein, 15 aa, Mycobacterium tuberculosis
GIDPALGTQVLHLRG

SEQ ID NO: 102276 - protein, 15 aa, Mycobacterium tuberculosis
IDPALGTQVLHLRGA

SEQ ID NO: 102277 - protein, 15 aa, Mycobacterium tuberculosis
DPALGTQVLHLRGAF

SEQ ID NO: 102278 - protein, 15 aa, Mycobacterium tuberculosis
PALGTQVLHLRGAFH

SEQ ID NO: 102279 - protein, 15 aa, Mycobacterium tuberculosis
ALGTQVLHLRGAFHG

SEQ ID NO: 102280 - protein, 15 aa, Mycobacterium tuberculosis
LGTQVLHLRGAFHGR

SEQ ID NO: 102281 - protein, 15 aa, Mycobacterium tuberculosis
GTQVLHLRGAFHGRS

SEQ ID NO: 102282 - protein, 15 aa, Mycobacterium tuberculosis
TQVLHLRGAFHGRSG

SEQ ID NO: 102283 - protein, 15 aa, Mycobacterium tuberculosis
QVLHLRGAFHGRSGY

SEQ ID NO: 102284 - protein, 15 aa, Mycobacterium tuberculosis
VLHLRGAFHGRSGYT

SEQ ID NO: 102285 - protein, 15 aa, Mycobacterium tuberculosis
LHLRGAFHGRSGYTL

SEQ ID NO: 102286 - protein, 15 aa, Mycobacterium tuberculosis
HLRGAFHGRSGYTLS

SEQ ID NO: 102287 - protein, 15 aa, Mycobacterium tuberculosis
LRGAFHGRSGYTLSL

SEQ ID NO: 102288 - protein, 15 aa, Mycobacterium tuberculosis
RGAFHGRSGYTLSLT

SEQ ID NO: 102289 - protein, 15 aa, Mycobacterium tuberculosis
GAFHGRSGYTLSLTN

SEQ ID NO: 102290 - protein, 15 aa, Mycobacterium tuberculosis
AFHGRSGYTLSLTNT

SEQ ID NO: 102291 - protein, 15 aa, Mycobacterium tuberculosis
FHGRSGYTLSLTNTK

SEQ ID NO: 102292 - protein, 15 aa, Mycobacterium tuberculosis
HGRSGYTLSLTNTKP

SEQ ID NO: 102293 - protein, 15 aa, Mycobacterium tuberculosis
GRSGYTLSLTNTKPT

SEQ ID NO: 102294 - protein, 15 aa, Mycobacterium tuberculosis
RSGYTLSLTNTKPTI

SEQ ID NO: 102295 - protein, 15 aa, Mycobacterium tuberculosis
SGYTLSLTNTKPTIT

SEQ ID NO: 102296 - protein, 15 aa, Mycobacterium tuberculosis
GYTLSLTNTKPTITA

SEQ ID NO: 102297 - protein, 15 aa, Mycobacterium tuberculosis
YTLSLTNTKPTITAR

SEQ ID NO: 102298 - protein, 15 aa, Mycobacterium tuberculosis
TLSLTNTKPTITARF

SEQ ID NO: 102299 - protein, 15 aa, Mycobacterium tuberculosis
LSLTNTKPTITARFP

SEQ ID NO: 102300 - protein, 15 aa, Mycobacterium tuberculosis
SLTNTKPTITARFPK

SEQ ID NO: 102301 - protein, 15 aa, Mycobacterium tuberculosis
LTNTKPTITARFPKF

SEQ ID NO: 102302 - protein, 15 aa, Mycobacterium tuberculosis
TNTKPTITARFPKFD

SEQ ID NO: 102303 - protein, 15 aa, Mycobacterium tuberculosis
NTKPTITARFPKFDW

SEQ ID NO: 102304 - protein, 15 aa, Mycobacterium tuberculosis
TKPTITARFPKFDWP

SEQ ID NO: 102305 - protein, 15 aa, Mycobacterium tuberculosis
KPTITARFPKFDWPR

SEQ ID NO: 102306 - protein, 15 aa, Mycobacterium tuberculosis
PTITARFPKFDWPRI

SEQ ID NO: 102307 - protein, 15 aa, Mycobacterium tuberculosis
TITARFPKFDWPRID

SEQ ID NO: 102308 - protein, 15 aa, Mycobacterium tuberculosis
ITARFPKFDWPRIDA

SEQ ID NO: 102309 - protein, 15 aa, Mycobacterium tuberculosis
TARFPKFDWPRIDAP

SEQ ID NO: 102310 - protein, 15 aa, Mycobacterium tuberculosis
ARFPKFDWPRIDAPY

SEQ ID NO: 102311 - protein, 15 aa, Mycobacterium tuberculosis
RFPKFDWPRIDAPYM

SEQ ID NO: 102312 - protein, 15 aa, Mycobacterium tuberculosis
FPKFDWPRIDAPYMR

SEQ ID NO: 102313 - protein, 15 aa, Mycobacterium tuberculosis
PKFDWPRIDAPYMRP

SEQ ID NO: 102314 - protein, 15 aa, Mycobacterium tuberculosis
KFDWPRIDAPYMRPG

SEQ ID NO: 102315 - protein, 15 aa, Mycobacterium tuberculosis
FDWPRIDAPYMRPGL

SEQ ID NO: 102316 - protein, 15 aa, Mycobacterium tuberculosis
DWPRIDAPYMRPGLD

SEQ ID NO: 102317 - protein, 15 aa, Mycobacterium tuberculosis
WPRIDAPYMRPGLDE

SEQ ID NO: 102318 - protein, 15 aa, Mycobacterium tuberculosis
PRIDAPYMRPGLDEP

SEQ ID NO: 102319 - protein, 15 aa, Mycobacterium tuberculosis
RIDAPYMRPGLDEPA

SEQ ID NO: 102320 - protein, 15 aa, Mycobacterium tuberculosis
IDAPYMRPGLDEPAM

SEQ ID NO: 102321 - protein, 15 aa, Mycobacterium tuberculosis
DAPYMRPGLDEPAMA

SEQ ID NO: 102322 - protein, 15 aa, Mycobacterium tuberculosis
APYMRPGLDEPAMAA

SEQ ID NO: 102323 - protein, 15 aa, Mycobacterium tuberculosis
PYMRPGLDEPAMAAL

SEQ ID NO: 102324 - protein, 15 aa, Mycobacterium tuberculosis
YMRPGLDEPAMAALE

SEQ ID NO: 102325 - protein, 15 aa, Mycobacterium tuberculosis
MRPGLDEPAMAALEA

SEQ ID NO: 102326 - protein, 15 aa, Mycobacterium tuberculosis
RPGLDEPAMAALEAE

SEQ ID NO: 102327 - protein, 15 aa, Mycobacterium tuberculosis
PGLDEPAMAALEAEA

SEQ ID NO: 102328 - protein, 15 aa, Mycobacterium tuberculosis
GLDEPAMAALEAEAL

SEQ ID NO: 102329 - protein, 15 aa, Mycobacterium tuberculosis
LDEPAMAALEAEALR

SEQ ID NO: 102330 - protein, 15 aa, Mycobacterium tuberculosis
DEPAMAALEAEALRQ

SEQ ID NO: 102331 - protein, 15 aa, Mycobacterium tuberculosis
EPAMAALEAEALRQA

SEQ ID NO: 102332 - protein, 15 aa, Mycobacterium tuberculosis
PAMAALEAEALRQAR

SEQ ID NO: 102333 - protein, 15 aa, Mycobacterium tuberculosis
AMAALEAEALRQARA

SEQ ID NO: 102334 - protein, 15 aa, Mycobacterium tuberculosis
MAALEAEALRQARAA

SEQ ID NO: 102335 - protein, 15 aa, Mycobacterium tuberculosis
AALEAEALRQARAAF

SEQ ID NO: 102336 - protein, 15 aa, Mycobacterium tuberculosis
ALEAEALRQARAAFE

SEQ ID NO: 102337 - protein, 15 aa, Mycobacterium tuberculosis
LEAEALRQARAAFET

SEQ ID NO: 102338 - protein, 15 aa, Mycobacterium tuberculosis
EAEALRQARAAFETR

SEQ ID NO: 102339 - protein, 15 aa, Mycobacterium tuberculosis
AEALRQARAAFETRP

SEQ ID NO: 102340 - protein, 15 aa, Mycobacterium tuberculosis
EALRQARAAFETRPH

SEQ ID NO: 102341 - protein, 15 aa, Mycobacterium tuberculosis
ALRQARAAFETRPHD

SEQ ID NO: 102342 - protein, 15 aa, Mycobacterium tuberculosis
LRQARAAFETRPHDI

SEQ ID NO: 102343 - protein, 15 aa, Mycobacterium tuberculosis
RQARAAFETRPHDIA

SEQ ID NO: 102344 - protein, 15 aa, Mycobacterium tuberculosis
QARAAFETRPHDIAC

SEQ ID NO: 102345 - protein, 15 aa, Mycobacterium tuberculosis
ARAAFETRPHDIACF

SEQ ID NO: 102346 - protein, 15 aa, Mycobacterium tuberculosis
RAAFETRPHDIACFV

SEQ ID NO: 102347 - protein, 15 aa, Mycobacterium tuberculosis
AAFETRPHDIACFVA

SEQ ID NO: 102348 - protein, 15 aa, Mycobacterium tuberculosis
AFETRPHDIACFVAE

SEQ ID NO: 102349 - protein, 15 aa, Mycobacterium tuberculosis
FETRPHDIACFVAEP

SEQ ID NO: 102350 - protein, 15 aa, Mycobacterium tuberculosis
ETRPHDIACFVAEPI

SEQ ID NO: 102351 - protein, 15 aa, Mycobacterium tuberculosis
TRPHDIACFVAEPIQ

SEQ ID NO: 102352 - protein, 15 aa, Mycobacterium tuberculosis
RPHDIACFVAEPIQG

SEQ ID NO: 102353 - protein, 15 aa, Mycobacterium tuberculosis
PHDIACFVAEPIQGE

SEQ ID NO: 102354 - protein, 15 aa, Mycobacterium tuberculosis
HDIACFVAEPIQGEG

SEQ ID NO: 102355 - protein, 15 aa, Mycobacterium tuberculosis
DIACFVAEPIQGEGG

SEQ ID NO: 102356 - protein, 15 aa, Mycobacterium tuberculosis
IACFVAEPIQGEGGD

SEQ ID NO: 102357 - protein, 15 aa, Mycobacterium tuberculosis
ACFVAEPIQGEGGDR

SEQ ID NO: 102358 - protein, 15 aa, Mycobacterium tuberculosis
CFVAEPIQGEGGDRH

SEQ ID NO: 102359 - protein, 15 aa, Mycobacterium tuberculosis
FVAEPIQGEGGDRHF

SEQ ID NO: 102360 - protein, 15 aa, Mycobacterium tuberculosis
VAEPIQGEGGDRHFR

SEQ ID NO: 102361 - protein, 15 aa, Mycobacterium tuberculosis
AEPIQGEGGDRHFRP

SEQ ID NO: 102362 - protein, 15 aa, Mycobacterium tuberculosis
EPIQGEGGDRHFRPE

SEQ ID NO: 102363 - protein, 15 aa, Mycobacterium tuberculosis
PIQGEGGDRHFRPEF

SEQ ID NO: 102364 - protein, 15 aa, Mycobacterium tuberculosis
IQGEGGDRHFRPEFF

SEQ ID NO: 102365 - protein, 15 aa, Mycobacterium tuberculosis
QGEGGDRHFRPEFFA

SEQ ID NO: 102366 - protein, 15 aa, Mycobacterium tuberculosis
GEGGDRHFRPEFFAA

SEQ ID NO: 102367 - protein, 15 aa, Mycobacterium tuberculosis
EGGDRHFRPEFFAAM

SEQ ID NO: 102368 - protein, 15 aa, Mycobacterium tuberculosis
GGDRHFRPEFFAAMR

SEQ ID NO: 102369 - protein, 15 aa, Mycobacterium tuberculosis
GDRHFRPEFFAAMRE

SEQ ID NO: 102370 - protein, 15 aa, Mycobacterium tuberculosis
DRHFRPEFFAAMREL

SEQ ID NO: 102371 - protein, 15 aa, Mycobacterium tuberculosis
RHFRPEFFAAMRELC

SEQ ID NO: 102372 - protein, 15 aa, Mycobacterium tuberculosis
HFRPEFFAAMRELCD

SEQ ID NO: 102373 - protein, 15 aa, Mycobacterium tuberculosis
FRPEFFAAMRELCDE

SEQ ID NO: 102374 - protein, 15 aa, Mycobacterium tuberculosis
RPEFFAAMRELCDEF

SEQ ID NO: 102375 - protein, 15 aa, Mycobacterium tuberculosis
PEFFAAMRELCDEFD

SEQ ID NO: 102376 - protein, 15 aa, Mycobacterium tuberculosis
EFFAAMRELCDEFDA

SEQ ID NO: 102377 - protein, 15 aa, Mycobacterium tuberculosis
FFAAMRELCDEFDAL

SEQ ID NO: 102378 - protein, 15 aa, Mycobacterium tuberculosis
FAAMRELCDEFDALL

SEQ ID NO: 102379 - protein, 15 aa, Mycobacterium tuberculosis
AAMRELCDEFDALLI

SEQ ID NO: 102380 - protein, 15 aa, Mycobacterium tuberculosis
AMRELCDEFDALLIF

SEQ ID NO: 102381 - protein, 15 aa, Mycobacterium tuberculosis
MRELCDEFDALLIFD

SEQ ID NO: 102382 - protein, 15 aa, Mycobacterium tuberculosis
RELCDEFDALLIFDE

SEQ ID NO: 102383 - protein, 15 aa, Mycobacterium tuberculosis
ELCDEFDALLIFDEV

SEQ ID NO: 102384 - protein, 15 aa, Mycobacterium tuberculosis
LCDEFDALLIFDEVQ

SEQ ID NO: 102385 - protein, 15 aa, Mycobacterium tuberculosis
CDEFDALLIFDEVQT

SEQ ID NO: 102386 - protein, 15 aa, Mycobacterium tuberculosis
DEFDALLIFDEVQTG

SEQ ID NO: 102387 - protein, 15 aa, Mycobacterium tuberculosis
EFDALLIFDEVQTGC

SEQ ID NO: 102388 - protein, 15 aa, Mycobacterium tuberculosis
FDALLIFDEVQTGCG

SEQ ID NO: 102389 - protein, 15 aa, Mycobacterium tuberculosis
DALLIFDEVQTGCGL

SEQ ID NO: 102390 - protein, 15 aa, Mycobacterium tuberculosis
ALLIFDEVQTGCGLT

SEQ ID NO: 102391 - protein, 15 aa, Mycobacterium tuberculosis
LLIFDEVQTGCGLTG

SEQ ID NO: 102392 - protein, 15 aa, Mycobacterium tuberculosis
LIFDEVQTGCGLTGT

SEQ ID NO: 102393 - protein, 15 aa, Mycobacterium tuberculosis
IFDEVQTGCGLTGTA

SEQ ID NO: 102394 - protein, 15 aa, Mycobacterium tuberculosis
FDEVQTGCGLTGTAW

SEQ ID NO: 102395 - protein, 15 aa, Mycobacterium tuberculosis
DEVQTGCGLTGTAWA

SEQ ID NO: 102396 - protein, 15 aa, Mycobacterium tuberculosis
EVQTGCGLTGTAWAY

SEQ ID NO: 102397 - protein, 15 aa, Mycobacterium tuberculosis
VQTGCGLTGTAWAYQ

SEQ ID NO: 102398 - protein, 15 aa, Mycobacterium tuberculosis
QTGCGLTGTAWAYQQ

SEQ ID NO: 102399 - protein, 15 aa, Mycobacterium tuberculosis
TGCGLTGTAWAYQQL

SEQ ID NO: 102400 - protein, 15 aa, Mycobacterium tuberculosis
GCGLTGTAWAYQQLD

SEQ ID NO: 102401 - protein, 15 aa, Mycobacterium tuberculosis
CGLTGTAWAYQQLDV

SEQ ID NO: 102402 - protein, 15 aa, Mycobacterium tuberculosis
GLTGTAWAYQQLDVA

SEQ ID NO: 102403 - protein, 15 aa, Mycobacterium tuberculosis
LTGTAWAYQQLDVAP

SEQ ID NO: 102404 - protein, 15 aa, Mycobacterium tuberculosis
TGTAWAYQQLDVAPD

SEQ ID NO: 102405 - protein, 15 aa, Mycobacterium tuberculosis
GTAWAYQQLDVAPDI

SEQ ID NO: 102406 - protein, 15 aa, Mycobacterium tuberculosis
TAWAYQQLDVAPDIV

SEQ ID NO: 102407 - protein, 15 aa, Mycobacterium tuberculosis
AWAYQQLDVAPDIVA

SEQ ID NO: 102408 - protein, 15 aa, Mycobacterium tuberculosis
WAYQQLDVAPDIVAF

SEQ ID NO: 102409 - protein, 15 aa, Mycobacterium tuberculosis
AYQQLDVAPDIVAFG

SEQ ID NO: 102410 - protein, 15 aa, Mycobacterium tuberculosis
YQQLDVAPDIVAFGK

SEQ ID NO: 102411 - protein, 15 aa, Mycobacterium tuberculosis
QQLDVAPDIVAFGKK

SEQ ID NO: 102412 - protein, 15 aa, Mycobacterium tuberculosis
QLDVAPDIVAFGKKT

SEQ ID NO: 102413 - protein, 15 aa, Mycobacterium tuberculosis
LDVAPDIVAFGKKTQ

SEQ ID NO: 102414 - protein, 15 aa, Mycobacterium tuberculosis
DVAPDIVAFGKKTQV

SEQ ID NO: 102415 - protein, 15 aa, Mycobacterium tuberculosis
VAPDIVAFGKKTQVC

SEQ ID NO: 102416 - protein, 15 aa, Mycobacterium tuberculosis
APDIVAFGKKTQVCG

SEQ ID NO: 102417 - protein, 15 aa, Mycobacterium tuberculosis
PDIVAFGKKTQVCGV

SEQ ID NO: 102418 - protein, 15 aa, Mycobacterium tuberculosis
DIVAFGKKTQVCGVM

SEQ ID NO: 102419 - protein, 15 aa, Mycobacterium tuberculosis
IVAFGKKTQVCGVMA

SEQ ID NO: 102420 - protein, 15 aa, Mycobacterium tuberculosis
VAFGKKTQVCGVMAG

SEQ ID NO: 102421 - protein, 15 aa, Mycobacterium tuberculosis
AFGKKTQVCGVMAGR

SEQ ID NO: 102422 - protein, 15 aa, Mycobacterium tuberculosis
FGKKTQVCGVMAGRR

SEQ ID NO: 102423 - protein, 15 aa, Mycobacterium tuberculosis
GKKTQVCGVMAGRRV

SEQ ID NO: 102424 - protein, 15 aa, Mycobacterium tuberculosis
KKTQVCGVMAGRRVD

SEQ ID NO: 102425 - protein, 15 aa, Mycobacterium tuberculosis
KTQVCGVMAGRRVDE

SEQ ID NO: 102426 - protein, 15 aa, Mycobacterium tuberculosis
TQVCGVMAGRRVDEV

SEQ ID NO: 102427 - protein, 15 aa, Mycobacterium tuberculosis
QVCGVMAGRRVDEVA

SEQ ID NO: 102428 - protein, 15 aa, Mycobacterium tuberculosis
VCGVMAGRRVDEVAD

SEQ ID NO: 102429 - protein, 15 aa, Mycobacterium tuberculosis
CGVMAGRRVDEVADN

SEQ ID NO: 102430 - protein, 15 aa, Mycobacterium tuberculosis
GVMAGRRVDEVADNV

SEQ ID NO: 102431 - protein, 15 aa, Mycobacterium tuberculosis
VMAGRRVDEVADNVF

SEQ ID NO: 102432 - protein, 15 aa, Mycobacterium tuberculosis
MAGRRVDEVADNVFA

SEQ ID NO: 102433 - protein, 15 aa, Mycobacterium tuberculosis
AGRRVDEVADNVFAV

SEQ ID NO: 102434 - protein, 15 aa, Mycobacterium tuberculosis
GRRVDEVADNVFAVP

SEQ ID NO: 102435 - protein, 15 aa, Mycobacterium tuberculosis
RRVDEVADNVFAVPS

SEQ ID NO: 102436 - protein, 15 aa, Mycobacterium tuberculosis
RVDEVADNVFAVPSR

SEQ ID NO: 102437 - protein, 15 aa, Mycobacterium tuberculosis
VDEVADNVFAVPSRL

SEQ ID NO: 102438 - protein, 15 aa, Mycobacterium tuberculosis
DEVADNVFAVPSRLN

SEQ ID NO: 102439 - protein, 15 aa, Mycobacterium tuberculosis
EVADNVFAVPSRLNS

SEQ ID NO: 102440 - protein, 15 aa, Mycobacterium tuberculosis
VADNVFAVPSRLNST

SEQ ID NO: 102441 - protein, 15 aa, Mycobacterium tuberculosis
ADNVFAVPSRLNSTW

SEQ ID NO: 102442 - protein, 15 aa, Mycobacterium tuberculosis
DNVFAVPSRLNSTWG

SEQ ID NO: 102443 - protein, 15 aa, Mycobacterium tuberculosis
NVFAVPSRLNSTWGG

SEQ ID NO: 102444 - protein, 15 aa, Mycobacterium tuberculosis
VFAVPSRLNSTWGGN

SEQ ID NO: 102445 - protein, 15 aa, Mycobacterium tuberculosis
FAVPSRLNSTWGGNL

SEQ ID NO: 102446 - protein, 15 aa, Mycobacterium tuberculosis
AVPSRLNSTWGGNLT

SEQ ID NO: 102447 - protein, 15 aa, Mycobacterium tuberculosis
VPSRLNSTWGGNLTD

SEQ ID NO: 102448 - protein, 15 aa, Mycobacterium tuberculosis
PSRLNSTWGGNLTDM

SEQ ID NO: 102449 - protein, 15 aa, Mycobacterium tuberculosis
SRLNSTWGGNLTDMV

SEQ ID NO: 102450 - protein, 15 aa, Mycobacterium tuberculosis
RLNSTWGGNLTDMVR

SEQ ID NO: 102451 - protein, 15 aa, Mycobacterium tuberculosis
LNSTWGGNLTDMVRA

SEQ ID NO: 102452 - protein, 15 aa, Mycobacterium tuberculosis
NSTWGGNLTDMVRAR

SEQ ID NO: 102453 - protein, 15 aa, Mycobacterium tuberculosis
STWGGNLTDMVRARR

SEQ ID NO: 102454 - protein, 15 aa, Mycobacterium tuberculosis
TWGGNLTDMVRARRI

SEQ ID NO: 102455 - protein, 15 aa, Mycobacterium tuberculosis
WGGNLTDMVRARRIL

SEQ ID NO: 102456 - protein, 15 aa, Mycobacterium tuberculosis
GGNLTDMVRARRILE

SEQ ID NO: 102457 - protein, 15 aa, Mycobacterium tuberculosis
GNLTDMVRARRILEV

SEQ ID NO: 102458 - protein, 15 aa, Mycobacterium tuberculosis
NLTDMVRARRILEVI

SEQ ID NO: 102459 - protein, 15 aa, Mycobacterium tuberculosis
LTDMVRARRILEVIE

SEQ ID NO: 102460 - protein, 15 aa, Mycobacterium tuberculosis
TDMVRARRILEVIEA

SEQ ID NO: 102461 - protein, 15 aa, Mycobacterium tuberculosis
DMVRARRILEVIEAE

SEQ ID NO: 102462 - protein, 15 aa, Mycobacterium tuberculosis
MVRARRILEVIEAEG

SEQ ID NO: 102463 - protein, 15 aa, Mycobacterium tuberculosis
VRARRILEVIEAEGL

SEQ ID NO: 102464 - protein, 15 aa, Mycobacterium tuberculosis
RARRILEVIEAEGLF

SEQ ID NO: 102465 - protein, 15 aa, Mycobacterium tuberculosis
ARRILEVIEAEGLFE

SEQ ID NO: 102466 - protein, 15 aa, Mycobacterium tuberculosis
RRILEVIEAEGLFER

SEQ ID NO: 102467 - protein, 15 aa, Mycobacterium tuberculosis
RILEVIEAEGLFERA

SEQ ID NO: 102468 - protein, 15 aa, Mycobacterium tuberculosis
ILEVIEAEGLFERAV

SEQ ID NO: 102469 - protein, 15 aa, Mycobacterium tuberculosis
LEVIEAEGLFERAVQ

SEQ ID NO: 102470 - protein, 15 aa, Mycobacterium tuberculosis
EVIEAEGLFERAVQH

SEQ ID NO: 102471 - protein, 15 aa, Mycobacterium tuberculosis
VIEAEGLFERAVQHG

SEQ ID NO: 102472 - protein, 15 aa, Mycobacterium tuberculosis
IEAEGLFERAVQHGK

SEQ ID NO: 102473 - protein, 15 aa, Mycobacterium tuberculosis
EAEGLFERAVQHGKY

SEQ ID NO: 102474 - protein, 15 aa, Mycobacterium tuberculosis
AEGLFERAVQHGKYL

SEQ ID NO: 102475 - protein, 15 aa, Mycobacterium tuberculosis
EGLFERAVQHGKYLR

SEQ ID NO: 102476 - protein, 15 aa, Mycobacterium tuberculosis
GLFERAVQHGKYLRA

SEQ ID NO: 102477 - protein, 15 aa, Mycobacterium tuberculosis
LFERAVQHGKYLRAR

SEQ ID NO: 102478 - protein, 15 aa, Mycobacterium tuberculosis
FERAVQHGKYLRARL

SEQ ID NO: 102479 - protein, 15 aa, Mycobacterium tuberculosis
ERAVQHGKYLRARLD

SEQ ID NO: 102480 - protein, 15 aa, Mycobacterium tuberculosis
RAVQHGKYLRARLDE

SEQ ID NO: 102481 - protein, 15 aa, Mycobacterium tuberculosis
AVQHGKYLRARLDEL

SEQ ID NO: 102482 - protein, 15 aa, Mycobacterium tuberculosis
VQHGKYLRARLDELA

SEQ ID NO: 102483 - protein, 15 aa, Mycobacterium tuberculosis
QHGKYLRARLDELAA

SEQ ID NO: 102484 - protein, 15 aa, Mycobacterium tuberculosis
HGKYLRARLDELAAD

SEQ ID NO: 102485 - protein, 15 aa, Mycobacterium tuberculosis
GKYLRARLDELAADF

SEQ ID NO: 102486 - protein, 15 aa, Mycobacterium tuberculosis
KYLRARLDELAADFP

SEQ ID NO: 102487 - protein, 15 aa, Mycobacterium tuberculosis
YLRARLDELAADFPA

SEQ ID NO: 102488 - protein, 15 aa, Mycobacterium tuberculosis
LRARLDELAADFPAV

SEQ ID NO: 102489 - protein, 15 aa, Mycobacterium tuberculosis
RARLDELAADFPAVV

SEQ ID NO: 102490 - protein, 15 aa, Mycobacterium tuberculosis
ARLDELAADFPAVVL

SEQ ID NO: 102491 - protein, 15 aa, Mycobacterium tuberculosis
RLDELAADFPAVVLD

SEQ ID NO: 102492 - protein, 15 aa, Mycobacterium tuberculosis
LDELAADFPAVVLDP

SEQ ID NO: 102493 - protein, 15 aa, Mycobacterium tuberculosis
DELAADFPAVVLDPR

SEQ ID NO: 102494 - protein, 15 aa, Mycobacterium tuberculosis
ELAADFPAVVLDPRG

SEQ ID NO: 102495 - protein, 15 aa, Mycobacterium tuberculosis
LAADFPAVVLDPRGR

SEQ ID NO: 102496 - protein, 15 aa, Mycobacterium tuberculosis
AADFPAVVLDPRGRG

SEQ ID NO: 102497 - protein, 15 aa, Mycobacterium tuberculosis
ADFPAVVLDPRGRGL

SEQ ID NO: 102498 - protein, 15 aa, Mycobacterium tuberculosis
DFPAVVLDPRGRGLM

SEQ ID NO: 102499 - protein, 15 aa, Mycobacterium tuberculosis
FPAVVLDPRGRGLMC

SEQ ID NO: 102500 - protein, 15 aa, Mycobacterium tuberculosis
PAVVLDPRGRGLMCA

SEQ ID NO: 102501 - protein, 15 aa, Mycobacterium tuberculosis
AVVLDPRGRGLMCAF

SEQ ID NO: 102502 - protein, 15 aa, Mycobacterium tuberculosis
VVLDPRGRGLMCAFS

SEQ ID NO: 102503 - protein, 15 aa, Mycobacterium tuberculosis
VLDPRGRGLMCAFSL

SEQ ID NO: 102504 - protein, 15 aa, Mycobacterium tuberculosis
LDPRGRGLMCAFSLP

SEQ ID NO: 102505 - protein, 15 aa, Mycobacterium tuberculosis
DPRGRGLMCAFSLPT

SEQ ID NO: 102506 - protein, 15 aa, Mycobacterium tuberculosis
PRGRGLMCAFSLPTT

SEQ ID NO: 102507 - protein, 15 aa, Mycobacterium tuberculosis
RGRGLMCAFSLPTTA

SEQ ID NO: 102508 - protein, 15 aa, Mycobacterium tuberculosis
GRGLMCAFSLPTTAD

SEQ ID NO: 102509 - protein, 15 aa, Mycobacterium tuberculosis
RGLMCAFSLPTTADR

SEQ ID NO: 102510 - protein, 15 aa, Mycobacterium tuberculosis
GLMCAFSLPTTADRD

SEQ ID NO: 102511 - protein, 15 aa, Mycobacterium tuberculosis
LMCAFSLPTTADRDE

SEQ ID NO: 102512 - protein, 15 aa, Mycobacterium tuberculosis
MCAFSLPTTADRDEL

SEQ ID NO: 102513 - protein, 15 aa, Mycobacterium tuberculosis
CAFSLPTTADRDELI

SEQ ID NO: 102514 - protein, 15 aa, Mycobacterium tuberculosis
AFSLPTTADRDELIR

SEQ ID NO: 102515 - protein, 15 aa, Mycobacterium tuberculosis
FSLPTTADRDELIRQ

SEQ ID NO: 102516 - protein, 15 aa, Mycobacterium tuberculosis
SLPTTADRDELIRQL

SEQ ID NO: 102517 - protein, 15 aa, Mycobacterium tuberculosis
LPTTADRDELIRQLW

SEQ ID NO: 102518 - protein, 15 aa, Mycobacterium tuberculosis
PTTADRDELIRQLWQ

SEQ ID NO: 102519 - protein, 15 aa, Mycobacterium tuberculosis
TTADRDELIRQLWQR

SEQ ID NO: 102520 - protein, 15 aa, Mycobacterium tuberculosis
TADRDELIRQLWQRA

SEQ ID NO: 102521 - protein, 15 aa, Mycobacterium tuberculosis
ADRDELIRQLWQRAV

SEQ ID NO: 102522 - protein, 15 aa, Mycobacterium tuberculosis
DRDELIRQLWQRAVI

SEQ ID NO: 102523 - protein, 15 aa, Mycobacterium tuberculosis
RDELIRQLWQRAVIV

SEQ ID NO: 102524 - protein, 15 aa, Mycobacterium tuberculosis
DELIRQLWQRAVIVL

SEQ ID NO: 102525 - protein, 15 aa, Mycobacterium tuberculosis
ELIRQLWQRAVIVLP

SEQ ID NO: 102526 - protein, 15 aa, Mycobacterium tuberculosis
LIRQLWQRAVIVLPA

SEQ ID NO: 102527 - protein, 15 aa, Mycobacterium tuberculosis
IRQLWQRAVIVLPAG

SEQ ID NO: 102528 - protein, 15 aa, Mycobacterium tuberculosis
RQLWQRAVIVLPAGA

SEQ ID NO: 102529 - protein, 15 aa, Mycobacterium tuberculosis
QLWQRAVIVLPAGAD

SEQ ID NO: 102530 - protein, 15 aa, Mycobacterium tuberculosis
LWQRAVIVLPAGADT

SEQ ID NO: 102531 - protein, 15 aa, Mycobacterium tuberculosis
WQRAVIVLPAGADTV

SEQ ID NO: 102532 - protein, 15 aa, Mycobacterium tuberculosis
QRAVIVLPAGADTVR

SEQ ID NO: 102533 - protein, 15 aa, Mycobacterium tuberculosis
RAVIVLPAGADTVRF

SEQ ID NO: 102534 - protein, 15 aa, Mycobacterium tuberculosis
AVIVLPAGADTVRFR

SEQ ID NO: 102535 - protein, 15 aa, Mycobacterium tuberculosis
VIVLPAGADTVRFRP

SEQ ID NO: 102536 - protein, 15 aa, Mycobacterium tuberculosis
IVLPAGADTVRFRPP

SEQ ID NO: 102537 - protein, 15 aa, Mycobacterium tuberculosis
VLPAGADTVRFRPPL

SEQ ID NO: 102538 - protein, 15 aa, Mycobacterium tuberculosis
LPAGADTVRFRPPLT

SEQ ID NO: 102539 - protein, 15 aa, Mycobacterium tuberculosis
PAGADTVRFRPPLTV

SEQ ID NO: 102540 - protein, 15 aa, Mycobacterium tuberculosis
AGADTVRFRPPLTVS

SEQ ID NO: 102541 - protein, 15 aa, Mycobacterium tuberculosis
GADTVRFRPPLTVST

SEQ ID NO: 102542 - protein, 15 aa, Mycobacterium tuberculosis
ADTVRFRPPLTVSTA

SEQ ID NO: 102543 - protein, 15 aa, Mycobacterium tuberculosis
DTVRFRPPLTVSTAE

SEQ ID NO: 102544 - protein, 15 aa, Mycobacterium tuberculosis
TVRFRPPLTVSTAEI

SEQ ID NO: 102545 - protein, 15 aa, Mycobacterium tuberculosis
VRFRPPLTVSTAEID

SEQ ID NO: 102546 - protein, 15 aa, Mycobacterium tuberculosis
RFRPPLTVSTAEIDA

SEQ ID NO: 102547 - protein, 15 aa, Mycobacterium tuberculosis
FRPPLTVSTAEIDAA

SEQ ID NO: 102548 - protein, 15 aa, Mycobacterium tuberculosis
RPPLTVSTAEIDAAI

SEQ ID NO: 102549 - protein, 15 aa, Mycobacterium tuberculosis
PPLTVSTAEIDAAIA

SEQ ID NO: 102550 - protein, 15 aa, Mycobacterium tuberculosis
PLTVSTAEIDAAIAA

SEQ ID NO: 102551 - protein, 15 aa, Mycobacterium tuberculosis
LTVSTAEIDAAIAAV

SEQ ID NO: 102552 - protein, 15 aa, Mycobacterium tuberculosis
TVSTAEIDAAIAAVR

SEQ ID NO: 102553 - protein, 15 aa, Mycobacterium tuberculosis
VSTAEIDAAIAAVRS

SEQ ID NO: 102554 - protein, 15 aa, Mycobacterium tuberculosis
STAEIDAAIAAVRSA

SEQ ID NO: 102555 - protein, 15 aa, Mycobacterium tuberculosis
TAEIDAAIAAVRSAL

SEQ ID NO: 102556 - protein, 15 aa, Mycobacterium tuberculosis
AEIDAAIAAVRSALP

SEQ ID NO: 102557 - protein, 15 aa, Mycobacterium tuberculosis
EIDAAIAAVRSALPV

SEQ ID NO: 102558 - protein, 15 aa, Mycobacterium tuberculosis
IDAAIAAVRSALPVV

SEQ ID NO: 102559 - protein, 15 aa, Mycobacterium tuberculosis
DAAIAAVRSALPVVT

SEQ ID NO: 102560 - protein, 16 aa, Mycobacterium tuberculosis
MAAVVKSVALAGRPTT

SEQ ID NO: 102561 - protein, 16 aa, Mycobacterium tuberculosis
AAVVKSVALAGRPTTP

SEQ ID NO: 102562 - protein, 16 aa, Mycobacterium tuberculosis
AVVKSVALAGRPTTPD

SEQ ID NO: 102563 - protein, 16 aa, Mycobacterium tuberculosis
VVKSVALAGRPTTPDR

SEQ ID NO: 102564 - protein, 16 aa, Mycobacterium tuberculosis
VKSVALAGRPTTPDRV

SEQ ID NO: 102565 - protein, 16 aa, Mycobacterium tuberculosis
KSVALAGRPTTPDRVH

SEQ ID NO: 102566 - protein, 16 aa, Mycobacterium tuberculosis
SVALAGRPTTPDRVHE

SEQ ID NO: 102567 - protein, 16 aa, Mycobacterium tuberculosis
VALAGRPTTPDRVHEV

SEQ ID NO: 102568 - protein, 16 aa, Mycobacterium tuberculosis
ALAGRPTTPDRVHEVL

SEQ ID NO: 102569 - protein, 16 aa, Mycobacterium tuberculosis
LAGRPTTPDRVHEVLG

SEQ ID NO: 102570 - protein, 16 aa, Mycobacterium tuberculosis
AGRPTTPDRVHEVLGR

SEQ ID NO: 102571 - protein, 16 aa, Mycobacterium tuberculosis
GRPTTPDRVHEVLGRS

SEQ ID NO: 102572 - protein, 16 aa, Mycobacterium tuberculosis
RPTTPDRVHEVLGRSM

SEQ ID NO: 102573 - protein, 16 aa, Mycobacterium tuberculosis
PTTPDRVHEVLGRSML

SEQ ID NO: 102574 - protein, 16 aa, Mycobacterium tuberculosis
TTPDRVHEVLGRSMLV

SEQ ID NO: 102575 - protein, 16 aa, Mycobacterium tuberculosis
TPDRVHEVLGRSMLVD

SEQ ID NO: 102576 - protein, 16 aa, Mycobacterium tuberculosis
PDRVHEVLGRSMLVDG

SEQ ID NO: 102577 - protein, 16 aa, Mycobacterium tuberculosis
DRVHEVLGRSMLVDGL

SEQ ID NO: 102578 - protein, 16 aa, Mycobacterium tuberculosis
RVHEVLGRSMLVDGLD

SEQ ID NO: 102579 - protein, 16 aa, Mycobacterium tuberculosis
VHEVLGRSMLVDGLDI

SEQ ID NO: 102580 - protein, 16 aa, Mycobacterium tuberculosis
HEVLGRSMLVDGLDIV

SEQ ID NO: 102581 - protein, 16 aa, Mycobacterium tuberculosis
EVLGRSMLVDGLDIVL

SEQ ID NO: 102582 - protein, 16 aa, Mycobacterium tuberculosis
VLGRSMLVDGLDIVLD

SEQ ID NO: 102583 - protein, 16 aa, Mycobacterium tuberculosis
LGRSMLVDGLDIVLDL

SEQ ID NO: 102584 - protein, 16 aa, Mycobacterium tuberculosis
GRSMLVDGLDIVLDLT

SEQ ID NO: 102585 - protein, 16 aa, Mycobacterium tuberculosis
RSMLVDGLDIVLDLTR

SEQ ID NO: 102586 - protein, 16 aa, Mycobacterium tuberculosis
SMLVDGLDIVLDLTRS

SEQ ID NO: 102587 - protein, 16 aa, Mycobacterium tuberculosis
MLVDGLDIVLDLTRSG

SEQ ID NO: 102588 - protein, 16 aa, Mycobacterium tuberculosis
LVDGLDIVLDLTRSGG

SEQ ID NO: 102589 - protein, 16 aa, Mycobacterium tuberculosis
VDGLDIVLDLTRSGGS

SEQ ID NO: 102590 - protein, 16 aa, Mycobacterium tuberculosis
DGLDIVLDLTRSGGSY

SEQ ID NO: 102591 - protein, 16 aa, Mycobacterium tuberculosis
GLDIVLDLTRSGGSYL

SEQ ID NO: 102592 - protein, 16 aa, Mycobacterium tuberculosis
LDIVLDLTRSGGSYLV

SEQ ID NO: 102593 - protein, 16 aa, Mycobacterium tuberculosis
DIVLDLTRSGGSYLVD

SEQ ID NO: 102594 - protein, 16 aa, Mycobacterium tuberculosis
IVLDLTRSGGSYLVDA

SEQ ID NO: 102595 - protein, 16 aa, Mycobacterium tuberculosis
VLDLTRSGGSYLVDAI

SEQ ID NO: 102596 - protein, 16 aa, Mycobacterium tuberculosis
LDLTRSGGSYLVDAIT

SEQ ID NO: 102597 - protein, 16 aa, Mycobacterium tuberculosis
DLTRSGGSYLVDAITG

SEQ ID NO: 102598 - protein, 16 aa, Mycobacterium tuberculosis
LTRSGGSYLVDAITGR

SEQ ID NO: 102599 - protein, 16 aa, Mycobacterium tuberculosis
TRSGGSYLVDAITGRR

SEQ ID NO: 102600 - protein, 16 aa, Mycobacterium tuberculosis
RSGGSYLVDAITGRRY

SEQ ID NO: 102601 - protein, 16 aa, Mycobacterium tuberculosis
SGGSYLVDAITGRRYL

SEQ ID NO: 102602 - protein, 16 aa, Mycobacterium tuberculosis
GGSYLVDAITGRRYLD

SEQ ID NO: 102603 - protein, 16 aa, Mycobacterium tuberculosis
GSYLVDAITGRRYLDM

SEQ ID NO: 102604 - protein, 16 aa, Mycobacterium tuberculosis
SYLVDAITGRRYLDMF

SEQ ID NO: 102605 - protein, 16 aa, Mycobacterium tuberculosis
YLVDAITGRRYLDMFT

SEQ ID NO: 102606 - protein, 16 aa, Mycobacterium tuberculosis
LVDAITGRRYLDMFTF

SEQ ID NO: 102607 - protein, 16 aa, Mycobacterium tuberculosis
VDAITGRRYLDMFTFV

SEQ ID NO: 102608 - protein, 16 aa, Mycobacterium tuberculosis
DAITGRRYLDMFTFVA

SEQ ID NO: 102609 - protein, 16 aa, Mycobacterium tuberculosis
AITGRRYLDMFTFVAS

SEQ ID NO: 102610 - protein, 16 aa, Mycobacterium tuberculosis
ITGRRYLDMFTFVASS

SEQ ID NO: 102611 - protein, 16 aa, Mycobacterium tuberculosis
TGRRYLDMFTFVASSA

SEQ ID NO: 102612 - protein, 16 aa, Mycobacterium tuberculosis
GRRYLDMFTFVASSAL

SEQ ID NO: 102613 - protein, 16 aa, Mycobacterium tuberculosis
RRYLDMFTFVASSALG

SEQ ID NO: 102614 - protein, 16 aa, Mycobacterium tuberculosis
RYLDMFTFVASSALGM

SEQ ID NO: 102615 - protein, 16 aa, Mycobacterium tuberculosis
YLDMFTFVASSALGMN

SEQ ID NO: 102616 - protein, 16 aa, Mycobacterium tuberculosis
LDMFTFVASSALGMNP

SEQ ID NO: 102617 - protein, 16 aa, Mycobacterium tuberculosis
DMFTFVASSALGMNPP

SEQ ID NO: 102618 - protein, 16 aa, Mycobacterium tuberculosis
MFTFVASSALGMNPPA

SEQ ID NO: 102619 - protein, 16 aa, Mycobacterium tuberculosis
FTFVASSALGMNPPAL

SEQ ID NO: 102620 - protein, 16 aa, Mycobacterium tuberculosis
TFVASSALGMNPPALV

SEQ ID NO: 102621 - protein, 16 aa, Mycobacterium tuberculosis
FVASSALGMNPPALVD

SEQ ID NO: 102622 - protein, 16 aa, Mycobacterium tuberculosis
VASSALGMNPPALVDD

SEQ ID NO: 102623 - protein, 16 aa, Mycobacterium tuberculosis
ASSALGMNPPALVDDR

SEQ ID NO: 102624 - protein, 16 aa, Mycobacterium tuberculosis
SSALGMNPPALVDDRE

SEQ ID NO: 102625 - protein, 16 aa, Mycobacterium tuberculosis
SALGMNPPALVDDREF

SEQ ID NO: 102626 - protein, 16 aa, Mycobacterium tuberculosis
ALGMNPPALVDDREFH

SEQ ID NO: 102627 - protein, 16 aa, Mycobacterium tuberculosis
LGMNPPALVDDREFHA

SEQ ID NO: 102628 - protein, 16 aa, Mycobacterium tuberculosis
GMNPPALVDDREFHAE

SEQ ID NO: 102629 - protein, 16 aa, Mycobacterium tuberculosis
MNPPALVDDREFHAEL

SEQ ID NO: 102630 - protein, 16 aa, Mycobacterium tuberculosis
NPPALVDDREFHAELM

SEQ ID NO: 102631 - protein, 16 aa, Mycobacterium tuberculosis
PPALVDDREFHAELMQ

SEQ ID NO: 102632 - protein, 16 aa, Mycobacterium tuberculosis
PALVDDREFHAELMQA

SEQ ID NO: 102633 - protein, 16 aa, Mycobacterium tuberculosis
ALVDDREFHAELMQAA

SEQ ID NO: 102634 - protein, 16 aa, Mycobacterium tuberculosis
LVDDREFHAELMQAAL

SEQ ID NO: 102635 - protein, 16 aa, Mycobacterium tuberculosis
VDDREFHAELMQAALN

SEQ ID NO: 102636 - protein, 16 aa, Mycobacterium tuberculosis
DDREFHAELMQAALNK

SEQ ID NO: 102637 - protein, 16 aa, Mycobacterium tuberculosis
DREFHAELMQAALNKP

SEQ ID NO: 102638 - protein, 16 aa, Mycobacterium tuberculosis
REFHAELMQAALNKPS

SEQ ID NO: 102639 - protein, 16 aa, Mycobacterium tuberculosis
EFHAELMQAALNKPSN

SEQ ID NO: 102640 - protein, 16 aa, Mycobacterium tuberculosis
FHAELMQAALNKPSNS

SEQ ID NO: 102641 - protein, 16 aa, Mycobacterium tuberculosis
HAELMQAALNKPSNSD

SEQ ID NO: 102642 - protein, 16 aa, Mycobacterium tuberculosis
AELMQAALNKPSNSDV

SEQ ID NO: 102643 - protein, 16 aa, Mycobacterium tuberculosis
ELMQAALNKPSNSDVY

SEQ ID NO: 102644 - protein, 16 aa, Mycobacterium tuberculosis
LMQAALNKPSNSDVYS

SEQ ID NO: 102645 - protein, 16 aa, Mycobacterium tuberculosis
MQAALNKPSNSDVYSV

SEQ ID NO: 102646 - protein, 16 aa, Mycobacterium tuberculosis
QAALNKPSNSDVYSVA

SEQ ID NO: 102647 - protein, 16 aa, Mycobacterium tuberculosis
AALNKPSNSDVYSVAM

SEQ ID NO: 102648 - protein, 16 aa, Mycobacterium tuberculosis
ALNKPSNSDVYSVAMA

SEQ ID NO: 102649 - protein, 16 aa, Mycobacterium tuberculosis
LNKPSNSDVYSVAMAR

SEQ ID NO: 102650 - protein, 16 aa, Mycobacterium tuberculosis
NKPSNSDVYSVAMARF

SEQ ID NO: 102651 - protein, 16 aa, Mycobacterium tuberculosis
KPSNSDVYSVAMARFV

SEQ ID NO: 102652 - protein, 16 aa, Mycobacterium tuberculosis
PSNSDVYSVAMARFVE

SEQ ID NO: 102653 - protein, 16 aa, Mycobacterium tuberculosis
SNSDVYSVAMARFVET

SEQ ID NO: 102654 - protein, 16 aa, Mycobacterium tuberculosis
NSDVYSVAMARFVETF

SEQ ID NO: 102655 - protein, 16 aa, Mycobacterium tuberculosis
SDVYSVAMARFVETFA

SEQ ID NO: 102656 - protein, 16 aa, Mycobacterium tuberculosis
DVYSVAMARFVETFAR

SEQ ID NO: 102657 - protein, 16 aa, Mycobacterium tuberculosis
VYSVAMARFVETFARV

SEQ ID NO: 102658 - protein, 16 aa, Mycobacterium tuberculosis
YSVAMARFVETFARVL

SEQ ID NO: 102659 - protein, 16 aa, Mycobacterium tuberculosis
SVAMARFVETFARVLG

SEQ ID NO: 102660 - protein, 16 aa, Mycobacterium tuberculosis
VAMARFVETFARVLGD

SEQ ID NO: 102661 - protein, 16 aa, Mycobacterium tuberculosis
AMARFVETFARVLGDP

SEQ ID NO: 102662 - protein, 16 aa, Mycobacterium tuberculosis
MARFVETFARVLGDPA

SEQ ID NO: 102663 - protein, 16 aa, Mycobacterium tuberculosis
ARFVETFARVLGDPAL

SEQ ID NO: 102664 - protein, 16 aa, Mycobacterium tuberculosis
RFVETFARVLGDPALP

SEQ ID NO: 102665 - protein, 16 aa, Mycobacterium tuberculosis
FVETFARVLGDPALPH

SEQ ID NO: 102666 - protein, 16 aa, Mycobacterium tuberculosis
VETFARVLGDPALPHL

SEQ ID NO: 102667 - protein, 16 aa, Mycobacterium tuberculosis
ETFARVLGDPALPHLF

SEQ ID NO: 102668 - protein, 16 aa, Mycobacterium tuberculosis
TFARVLGDPALPHLFF

SEQ ID NO: 102669 - protein, 16 aa, Mycobacterium tuberculosis
FARVLGDPALPHLFFV

SEQ ID NO: 102670 - protein, 16 aa, Mycobacterium tuberculosis
ARVLGDPALPHLFFVE

SEQ ID NO: 102671 - protein, 16 aa, Mycobacterium tuberculosis
RVLGDPALPHLFFVEG

SEQ ID NO: 102672 - protein, 16 aa, Mycobacterium tuberculosis
VLGDPALPHLFFVEGG

SEQ ID NO: 102673 - protein, 16 aa, Mycobacterium tuberculosis
LGDPALPHLFFVEGGA

SEQ ID NO: 102674 - protein, 16 aa, Mycobacterium tuberculosis
GDPALPHLFFVEGGAL

SEQ ID NO: 102675 - protein, 16 aa, Mycobacterium tuberculosis
DPALPHLFFVEGGALA

SEQ ID NO: 102676 - protein, 16 aa, Mycobacterium tuberculosis
PALPHLFFVEGGALAV

SEQ ID NO: 102677 - protein, 16 aa, Mycobacterium tuberculosis
ALPHLFFVEGGALAVE

SEQ ID NO: 102678 - protein, 16 aa, Mycobacterium tuberculosis
LPHLFFVEGGALAVEN

SEQ ID NO: 102679 - protein, 16 aa, Mycobacterium tuberculosis
PHLFFVEGGALAVENA

SEQ ID NO: 102680 - protein, 16 aa, Mycobacterium tuberculosis
HLFFVEGGALAVENAL

SEQ ID NO: 102681 - protein, 16 aa, Mycobacterium tuberculosis
LFFVEGGALAVENALK

SEQ ID NO: 102682 - protein, 16 aa, Mycobacterium tuberculosis
FFVEGGALAVENALKA

SEQ ID NO: 102683 - protein, 16 aa, Mycobacterium tuberculosis
FVEGGALAVENALKAA

SEQ ID NO: 102684 - protein, 16 aa, Mycobacterium tuberculosis
VEGGALAVENALKAAF

SEQ ID NO: 102685 - protein, 16 aa, Mycobacterium tuberculosis
EGGALAVENALKAAFD

SEQ ID NO: 102686 - protein, 16 aa, Mycobacterium tuberculosis
GGALAVENALKAAFDW

SEQ ID NO: 102687 - protein, 16 aa, Mycobacterium tuberculosis
GALAVENALKAAFDWK

SEQ ID NO: 102688 - protein, 16 aa, Mycobacterium tuberculosis
ALAVENALKAAFDWKS

SEQ ID NO: 102689 - protein, 16 aa, Mycobacterium tuberculosis
LAVENALKAAFDWKSR

SEQ ID NO: 102690 - protein, 16 aa, Mycobacterium tuberculosis
AVENALKAAFDWKSRH

SEQ ID NO: 102691 - protein, 16 aa, Mycobacterium tuberculosis
VENALKAAFDWKSRHN

SEQ ID NO: 102692 - protein, 16 aa, Mycobacterium tuberculosis
ENALKAAFDWKSRHNQ

SEQ ID NO: 102693 - protein, 16 aa, Mycobacterium tuberculosis
NALKAAFDWKSRHNQA

SEQ ID NO: 102694 - protein, 16 aa, Mycobacterium tuberculosis
ALKAAFDWKSRHNQAH

SEQ ID NO: 102695 - protein, 16 aa, Mycobacterium tuberculosis
LKAAFDWKSRHNQAHG

SEQ ID NO: 102696 - protein, 16 aa, Mycobacterium tuberculosis
KAAFDWKSRHNQAHGI

SEQ ID NO: 102697 - protein, 16 aa, Mycobacterium tuberculosis
AAFDWKSRHNQAHGID

SEQ ID NO: 102698 - protein, 16 aa, Mycobacterium tuberculosis
AFDWKSRHNQAHGIDP

SEQ ID NO: 102699 - protein, 16 aa, Mycobacterium tuberculosis
FDWKSRHNQAHGIDPA

SEQ ID NO: 102700 - protein, 16 aa, Mycobacterium tuberculosis
DWKSRHNQAHGIDPAL

SEQ ID NO: 102701 - protein, 16 aa, Mycobacterium tuberculosis
WKSRHNQAHGIDPALG

SEQ ID NO: 102702 - protein, 16 aa, Mycobacterium tuberculosis
KSRHNQAHGIDPALGT

SEQ ID NO: 102703 - protein, 16 aa, Mycobacterium tuberculosis
SRHNQAHGIDPALGTQ

SEQ ID NO: 102704 - protein, 16 aa, Mycobacterium tuberculosis
RHNQAHGIDPALGTQV

SEQ ID NO: 102705 - protein, 16 aa, Mycobacterium tuberculosis
HNQAHGIDPALGTQVL

SEQ ID NO: 102706 - protein, 16 aa, Mycobacterium tuberculosis
NQAHGIDPALGTQVLH

SEQ ID NO: 102707 - protein, 16 aa, Mycobacterium tuberculosis
QAHGIDPALGTQVLHL

SEQ ID NO: 102708 - protein, 16 aa, Mycobacterium tuberculosis
AHGIDPALGTQVLHLR

SEQ ID NO: 102709 - protein, 16 aa, Mycobacterium tuberculosis
HGIDPALGTQVLHLRG

SEQ ID NO: 102710 - protein, 16 aa, Mycobacterium tuberculosis
GIDPALGTQVLHLRGA

SEQ ID NO: 102711 - protein, 16 aa, Mycobacterium tuberculosis
IDPALGTQVLHLRGAF

SEQ ID NO: 102712 - protein, 16 aa, Mycobacterium tuberculosis
DPALGTQVLHLRGAFH

SEQ ID NO: 102713 - protein, 16 aa, Mycobacterium tuberculosis
PALGTQVLHLRGAFHG

SEQ ID NO: 102714 - protein, 16 aa, Mycobacterium tuberculosis
ALGTQVLHLRGAFHGR

SEQ ID NO: 102715 - protein, 16 aa, Mycobacterium tuberculosis
LGTQVLHLRGAFHGRS

SEQ ID NO: 102716 - protein, 16 aa, Mycobacterium tuberculosis
GTQVLHLRGAFHGRSG

SEQ ID NO: 102717 - protein, 16 aa, Mycobacterium tuberculosis
TQVLHLRGAFHGRSGY

SEQ ID NO: 102718 - protein, 16 aa, Mycobacterium tuberculosis
QVLHLRGAFHGRSGYT

SEQ ID NO: 102719 - protein, 16 aa, Mycobacterium tuberculosis
VLHLRGAFHGRSGYTL

SEQ ID NO: 102720 - protein, 16 aa, Mycobacterium tuberculosis
LHLRGAFHGRSGYTLS

SEQ ID NO: 102721 - protein, 16 aa, Mycobacterium tuberculosis
HLRGAFHGRSGYTLSL

SEQ ID NO: 102722 - protein, 16 aa, Mycobacterium tuberculosis
LRGAFHGRSGYTLSLT

SEQ ID NO: 102723 - protein, 16 aa, Mycobacterium tuberculosis
RGAFHGRSGYTLSLTN

SEQ ID NO: 102724 - protein, 16 aa, Mycobacterium tuberculosis
GAFHGRSGYTLSLTNT

SEQ ID NO: 102725 - protein, 16 aa, Mycobacterium tuberculosis
AFHGRSGYTLSLTNTK

SEQ ID NO: 102726 - protein, 16 aa, Mycobacterium tuberculosis
FHGRSGYTLSLTNTKP

SEQ ID NO: 102727 - protein, 16 aa, Mycobacterium tuberculosis
HGRSGYTLSLTNTKPT

SEQ ID NO: 102728 - protein, 16 aa, Mycobacterium tuberculosis
GRSGYTLSLTNTKPTI

SEQ ID NO: 102729 - protein, 16 aa, Mycobacterium tuberculosis
RSGYTLSLTNTKPTIT

SEQ ID NO: 102730 - protein, 16 aa, Mycobacterium tuberculosis
SGYTLSLTNTKPTITA

SEQ ID NO: 102731 - protein, 16 aa, Mycobacterium tuberculosis
GYTLSLTNTKPTITAR

SEQ ID NO: 102732 - protein, 16 aa, Mycobacterium tuberculosis
YTLSLTNTKPTITARF

SEQ ID NO: 102733 - protein, 16 aa, Mycobacterium tuberculosis
TLSLTNTKPTITARFP

SEQ ID NO: 102734 - protein, 16 aa, Mycobacterium tuberculosis
LSLTNTKPTITARFPK

SEQ ID NO: 102735 - protein, 16 aa, Mycobacterium tuberculosis
SLTNTKPTITARFPKF

SEQ ID NO: 102736 - protein, 16 aa, Mycobacterium tuberculosis
LTNTKPTITARFPKFD

SEQ ID NO: 102737 - protein, 16 aa, Mycobacterium tuberculosis
TNTKPTITARFPKFDW

SEQ ID NO: 102738 - protein, 16 aa, Mycobacterium tuberculosis
NTKPTITARFPKFDWP

SEQ ID NO: 102739 - protein, 16 aa, Mycobacterium tuberculosis
TKPTITARFPKFDWPR

SEQ ID NO: 102740 - protein, 16 aa, Mycobacterium tuberculosis
KPTITARFPKFDWPRI

SEQ ID NO: 102741 - protein, 16 aa, Mycobacterium tuberculosis
PTITARFPKFDWPRID

SEQ ID NO: 102742 - protein, 16 aa, Mycobacterium tuberculosis
TITARFPKFDWPRIDA

SEQ ID NO: 102743 - protein, 16 aa, Mycobacterium tuberculosis
ITARFPKFDWPRIDAP

SEQ ID NO: 102744 - protein, 16 aa, Mycobacterium tuberculosis
TARFPKFDWPRIDAPY

SEQ ID NO: 102745 - protein, 16 aa, Mycobacterium tuberculosis
ARFPKFDWPRIDAPYM

SEQ ID NO: 102746 - protein, 16 aa, Mycobacterium tuberculosis
RFPKFDWPRIDAPYMR

SEQ ID NO: 102747 - protein, 16 aa, Mycobacterium tuberculosis
FPKFDWPRIDAPYMRP

SEQ ID NO: 102748 - protein, 16 aa, Mycobacterium tuberculosis
PKFDWPRIDAPYMRPG

SEQ ID NO: 102749 - protein, 16 aa, Mycobacterium tuberculosis
KFDWPRIDAPYMRPGL

SEQ ID NO: 102750 - protein, 16 aa, Mycobacterium tuberculosis
FDWPRIDAPYMRPGLD

SEQ ID NO: 102751 - protein, 16 aa, Mycobacterium tuberculosis
DWPRIDAPYMRPGLDE

SEQ ID NO: 102752 - protein, 16 aa, Mycobacterium tuberculosis
WPRIDAPYMRPGLDEP

SEQ ID NO: 102753 - protein, 16 aa, Mycobacterium tuberculosis
PRIDAPYMRPGLDEPA

SEQ ID NO: 102754 - protein, 16 aa, Mycobacterium tuberculosis
RIDAPYMRPGLDEPAM

SEQ ID NO: 102755 - protein, 16 aa, Mycobacterium tuberculosis
IDAPYMRPGLDEPAMA

SEQ ID NO: 102756 - protein, 16 aa, Mycobacterium tuberculosis
DAPYMRPGLDEPAMAA

SEQ ID NO: 102757 - protein, 16 aa, Mycobacterium tuberculosis
APYMRPGLDEPAMAAL

SEQ ID NO: 102758 - protein, 16 aa, Mycobacterium tuberculosis
PYMRPGLDEPAMAALE

SEQ ID NO: 102759 - protein, 16 aa, Mycobacterium tuberculosis
YMRPGLDEPAMAALEA

SEQ ID NO: 102760 - protein, 16 aa, Mycobacterium tuberculosis
MRPGLDEPAMAALEAE

SEQ ID NO: 102761 - protein, 16 aa, Mycobacterium tuberculosis
RPGLDEPAMAALEAEA

SEQ ID NO: 102762 - protein, 16 aa, Mycobacterium tuberculosis
PGLDEPAMAALEAEAL

SEQ ID NO: 102763 - protein, 16 aa, Mycobacterium tuberculosis
GLDEPAMAALEAEALR

SEQ ID NO: 102764 - protein, 16 aa, Mycobacterium tuberculosis
LDEPAMAALEAEALRQ

SEQ ID NO: 102765 - protein, 16 aa, Mycobacterium tuberculosis
DEPAMAALEAEALRQA

SEQ ID NO: 102766 - protein, 16 aa, Mycobacterium tuberculosis
EPAMAALEAEALRQAR

SEQ ID NO: 102767 - protein, 16 aa, Mycobacterium tuberculosis
PAMAALEAEALRQARA

SEQ ID NO: 102768 - protein, 16 aa, Mycobacterium tuberculosis
AMAALEAEALRQARAA

SEQ ID NO: 102769 - protein, 16 aa, Mycobacterium tuberculosis
MAALEAEALRQARAAF

SEQ ID NO: 102770 - protein, 16 aa, Mycobacterium tuberculosis
AALEAEALRQARAAFE

SEQ ID NO: 102771 - protein, 16 aa, Mycobacterium tuberculosis
ALEAEALRQARAAFET

SEQ ID NO: 102772 - protein, 16 aa, Mycobacterium tuberculosis
LEAEALRQARAAFETR

SEQ ID NO: 102773 - protein, 16 aa, Mycobacterium tuberculosis
EAEALRQARAAFETRP

SEQ ID NO: 102774 - protein, 16 aa, Mycobacterium tuberculosis
AEALRQARAAFETRPH

SEQ ID NO: 102775 - protein, 16 aa, Mycobacterium tuberculosis
EALRQARAAFETRPHD

SEQ ID NO: 102776 - protein, 16 aa, Mycobacterium tuberculosis
ALRQARAAFETRPHDI

SEQ ID NO: 102777 - protein, 16 aa, Mycobacterium tuberculosis
LRQARAAFETRPHDIA

SEQ ID NO: 102778 - protein, 16 aa, Mycobacterium tuberculosis
RQARAAFETRPHDIAC

SEQ ID NO: 102779 - protein, 16 aa, Mycobacterium tuberculosis
QARAAFETRPHDIACF

SEQ ID NO: 102780 - protein, 16 aa, Mycobacterium tuberculosis
ARAAFETRPHDIACFV

SEQ ID NO: 102781 - protein, 16 aa, Mycobacterium tuberculosis
RAAFETRPHDIACFVA

SEQ ID NO: 102782 - protein, 16 aa, Mycobacterium tuberculosis
AAFETRPHDIACFVAE

SEQ ID NO: 102783 - protein, 16 aa, Mycobacterium tuberculosis
AFETRPHDIACFVAEP

SEQ ID NO: 102784 - protein, 16 aa, Mycobacterium tuberculosis
FETRPHDIACFVAEPI

SEQ ID NO: 102785 - protein, 16 aa, Mycobacterium tuberculosis
ETRPHDIACFVAEPIQ

SEQ ID NO: 102786 - protein, 16 aa, Mycobacterium tuberculosis
TRPHDIACFVAEPIQG

SEQ ID NO: 102787 - protein, 16 aa, Mycobacterium tuberculosis
RPHDIACFVAEPIQGE

SEQ ID NO: 102788 - protein, 16 aa, Mycobacterium tuberculosis
PHDIACFVAEPIQGEG

SEQ ID NO: 102789 - protein, 16 aa, Mycobacterium tuberculosis
HDIACFVAEPIQGEGG

SEQ ID NO: 102790 - protein, 16 aa, Mycobacterium tuberculosis
DIACFVAEPIQGEGGD

SEQ ID NO: 102791 - protein, 16 aa, Mycobacterium tuberculosis
IACFVAEPIQGEGGDR

SEQ ID NO: 102792 - protein, 16 aa, Mycobacterium tuberculosis
ACFVAEPIQGEGGDRH

SEQ ID NO: 102793 - protein, 16 aa, Mycobacterium tuberculosis
CFVAEPIQGEGGDRHF

SEQ ID NO: 102794 - protein, 16 aa, Mycobacterium tuberculosis
FVAEPIQGEGGDRHFR

SEQ ID NO: 102795 - protein, 16 aa, Mycobacterium tuberculosis
VAEPIQGEGGDRHFRP

SEQ ID NO: 102796 - protein, 16 aa, Mycobacterium tuberculosis
AEPIQGEGGDRHFRPE

SEQ ID NO: 102797 - protein, 16 aa, Mycobacterium tuberculosis
EPIQGEGGDRHFRPEF

SEQ ID NO: 102798 - protein, 16 aa, Mycobacterium tuberculosis
PIQGEGGDRHFRPEFF

SEQ ID NO: 102799 - protein, 16 aa, Mycobacterium tuberculosis
IQGEGGDRHFRPEFFA

SEQ ID NO: 102800 - protein, 16 aa, Mycobacterium tuberculosis
QGEGGDRHFRPEFFAA

SEQ ID NO: 102801 - protein, 16 aa, Mycobacterium tuberculosis
GEGGDRHFRPEFFAAM

SEQ ID NO: 102802 - protein, 16 aa, Mycobacterium tuberculosis
EGGDRHFRPEFFAAMR

SEQ ID NO: 102803 - protein, 16 aa, Mycobacterium tuberculosis
GGDRHFRPEFFAAMRE

SEQ ID NO: 102804 - protein, 16 aa, Mycobacterium tuberculosis
GDRHFRPEFFAAMREL

SEQ ID NO: 102805 - protein, 16 aa, Mycobacterium tuberculosis
DRHFRPEFFAAMRELC

SEQ ID NO: 102806 - protein, 16 aa, Mycobacterium tuberculosis
RHFRPEFFAAMRELCD

SEQ ID NO: 102807 - protein, 16 aa, Mycobacterium tuberculosis
HFRPEFFAAMRELCDE

SEQ ID NO: 102808 - protein, 16 aa, Mycobacterium tuberculosis
FRPEFFAAMRELCDEF

SEQ ID NO: 102809 - protein, 16 aa, Mycobacterium tuberculosis
RPEFFAAMRELCDEFD

SEQ ID NO: 102810 - protein, 16 aa, Mycobacterium tuberculosis
PEFFAAMRELCDEFDA

SEQ ID NO: 102811 - protein, 16 aa, Mycobacterium tuberculosis
EFFAAMRELCDEFDAL

SEQ ID NO: 102812 - protein, 16 aa, Mycobacterium tuberculosis
FFAAMRELCDEFDALL

SEQ ID NO: 102813 - protein, 16 aa, Mycobacterium tuberculosis
FAAMRELCDEFDALLI

SEQ ID NO: 102814 - protein, 16 aa, Mycobacterium tuberculosis
AAMRELCDEFDALLIF

SEQ ID NO: 102815 - protein, 16 aa, Mycobacterium tuberculosis
AMRELCDEFDALLIFD

SEQ ID NO: 102816 - protein, 16 aa, Mycobacterium tuberculosis
MRELCDEFDALLIFDE

SEQ ID NO: 102817 - protein, 16 aa, Mycobacterium tuberculosis
RELCDEFDALLIFDEV

SEQ ID NO: 102818 - protein, 16 aa, Mycobacterium tuberculosis
ELCDEFDALLIFDEVQ

SEQ ID NO: 102819 - protein, 16 aa, Mycobacterium tuberculosis
LCDEFDALLIFDEVQT

SEQ ID NO: 102820 - protein, 16 aa, Mycobacterium tuberculosis
CDEFDALLIFDEVQTG

SEQ ID NO: 102821 - protein, 16 aa, Mycobacterium tuberculosis
DEFDALLIFDEVQTGC

SEQ ID NO: 102822 - protein, 16 aa, Mycobacterium tuberculosis
EFDALLIFDEVQTGCG

SEQ ID NO: 102823 - protein, 16 aa, Mycobacterium tuberculosis
FDALLIFDEVQTGCGL

SEQ ID NO: 102824 - protein, 16 aa, Mycobacterium tuberculosis
DALLIFDEVQTGCGLT

SEQ ID NO: 102825 - protein, 16 aa, Mycobacterium tuberculosis
ALLIFDEVQTGCGLTG

SEQ ID NO: 102826 - protein, 16 aa, Mycobacterium tuberculosis
LLIFDEVQTGCGLTGT

SEQ ID NO: 102827 - protein, 16 aa, Mycobacterium tuberculosis
LIFDEVQTGCGLTGTA

SEQ ID NO: 102828 - protein, 16 aa, Mycobacterium tuberculosis
IFDEVQTGCGLTGTAW

SEQ ID NO: 102829 - protein, 16 aa, Mycobacterium tuberculosis
FDEVQTGCGLTGTAWA

SEQ ID NO: 102830 - protein, 16 aa, Mycobacterium tuberculosis
DEVQTGCGLTGTAWAY

SEQ ID NO: 102831 - protein, 16 aa, Mycobacterium tuberculosis
EVQTGCGLTGTAWAYQ

SEQ ID NO: 102832 - protein, 16 aa, Mycobacterium tuberculosis
VQTGCGLTGTAWAYQQ

SEQ ID NO: 102833 - protein, 16 aa, Mycobacterium tuberculosis
QTGCGLTGTAWAYQQL

SEQ ID NO: 102834 - protein, 16 aa, Mycobacterium tuberculosis
TGCGLTGTAWAYQQLD

SEQ ID NO: 102835 - protein, 16 aa, Mycobacterium tuberculosis
GCGLTGTAWAYQQLDV

SEQ ID NO: 102836 - protein, 16 aa, Mycobacterium tuberculosis
CGLTGTAWAYQQLDVA

SEQ ID NO: 102837 - protein, 16 aa, Mycobacterium tuberculosis
GLTGTAWAYQQLDVAP

SEQ ID NO: 102838 - protein, 16 aa, Mycobacterium tuberculosis
LTGTAWAYQQLDVAPD

SEQ ID NO: 102839 - protein, 16 aa, Mycobacterium tuberculosis
TGTAWAYQQLDVAPDI

SEQ ID NO: 102840 - protein, 16 aa, Mycobacterium tuberculosis
GTAWAYQQLDVAPDIV

SEQ ID NO: 102841 - protein, 16 aa, Mycobacterium tuberculosis
TAWAYQQLDVAPDIVA

SEQ ID NO: 102842 - protein, 16 aa, Mycobacterium tuberculosis
AWAYQQLDVAPDIVAF

SEQ ID NO: 102843 - protein, 16 aa, Mycobacterium tuberculosis
WAYQQLDVAPDIVAFG

SEQ ID NO: 102844 - protein, 16 aa, Mycobacterium tuberculosis
AYQQLDVAPDIVAFGK

SEQ ID NO: 102845 - protein, 16 aa, Mycobacterium tuberculosis
YQQLDVAPDIVAFGKK

SEQ ID NO: 102846 - protein, 16 aa, Mycobacterium tuberculosis
QQLDVAPDIVAFGKKT

SEQ ID NO: 102847 - protein, 16 aa, Mycobacterium tuberculosis
QLDVAPDIVAFGKKTQ

SEQ ID NO: 102848 - protein, 16 aa, Mycobacterium tuberculosis
LDVAPDIVAFGKKTQV

SEQ ID NO: 102849 - protein, 16 aa, Mycobacterium tuberculosis
DVAPDIVAFGKKTQVC

SEQ ID NO: 102850 - protein, 16 aa, Mycobacterium tuberculosis
VAPDIVAFGKKTQVCG

SEQ ID NO: 102851 - protein, 16 aa, Mycobacterium tuberculosis
APDIVAFGKKTQVCGV

SEQ ID NO: 102852 - protein, 16 aa, Mycobacterium tuberculosis
PDIVAFGKKTQVCGVM

SEQ ID NO: 102853 - protein, 16 aa, Mycobacterium tuberculosis
DIVAFGKKTQVCGVMA

SEQ ID NO: 102854 - protein, 16 aa, Mycobacterium tuberculosis
IVAFGKKTQVCGVMAG

SEQ ID NO: 102855 - protein, 16 aa, Mycobacterium tuberculosis
VAFGKKTQVCGVMAGR

SEQ ID NO: 102856 - protein, 16 aa, Mycobacterium tuberculosis
AFGKKTQVCGVMAGRR

SEQ ID NO: 102857 - protein, 16 aa, Mycobacterium tuberculosis
FGKKTQVCGVMAGRRV

SEQ ID NO: 102858 - protein, 16 aa, Mycobacterium tuberculosis
GKKTQVCGVMAGRRVD

SEQ ID NO: 102859 - protein, 16 aa, Mycobacterium tuberculosis
KKTQVCGVMAGRRVDE

SEQ ID NO: 102860 - protein, 16 aa, Mycobacterium tuberculosis
KTQVCGVMAGRRVDEV

SEQ ID NO: 102861 - protein, 16 aa, Mycobacterium tuberculosis
TQVCGVMAGRRVDEVA

SEQ ID NO: 102862 - protein, 16 aa, Mycobacterium tuberculosis
QVCGVMAGRRVDEVAD

SEQ ID NO: 102863 - protein, 16 aa, Mycobacterium tuberculosis
VCGVMAGRRVDEVADN

SEQ ID NO: 102864 - protein, 16 aa, Mycobacterium tuberculosis
CGVMAGRRVDEVADNV

SEQ ID NO: 102865 - protein, 16 aa, Mycobacterium tuberculosis
GVMAGRRVDEVADNVF

SEQ ID NO: 102866 - protein, 16 aa, Mycobacterium tuberculosis
VMAGRRVDEVADNVFA

SEQ ID NO: 102867 - protein, 16 aa, Mycobacterium tuberculosis
MAGRRVDEVADNVFAV

SEQ ID NO: 102868 - protein, 16 aa, Mycobacterium tuberculosis
AGRRVDEVADNVFAVP

SEQ ID NO: 102869 - protein, 16 aa, Mycobacterium tuberculosis
GRRVDEVADNVFAVPS

SEQ ID NO: 102870 - protein, 16 aa, Mycobacterium tuberculosis
RRVDEVADNVFAVPSR

SEQ ID NO: 102871 - protein, 16 aa, Mycobacterium tuberculosis
RVDEVADNVFAVPSRL

SEQ ID NO: 102872 - protein, 16 aa, Mycobacterium tuberculosis
VDEVADNVFAVPSRLN

SEQ ID NO: 102873 - protein, 16 aa, Mycobacterium tuberculosis
DEVADNVFAVPSRLNS

SEQ ID NO: 102874 - protein, 16 aa, Mycobacterium tuberculosis
EVADNVFAVPSRLNST

SEQ ID NO: 102875 - protein, 16 aa, Mycobacterium tuberculosis
VADNVFAVPSRLNSTW

SEQ ID NO: 102876 - protein, 16 aa, Mycobacterium tuberculosis
ADNVFAVPSRLNSTWG

SEQ ID NO: 102877 - protein, 16 aa, Mycobacterium tuberculosis
DNVFAVPSRLNSTWGG

SEQ ID NO: 102878 - protein, 16 aa, Mycobacterium tuberculosis
NVFAVPSRLNSTWGGN

SEQ ID NO: 102879 - protein, 16 aa, Mycobacterium tuberculosis
VFAVPSRLNSTWGGNL

SEQ ID NO: 102880 - protein, 16 aa, Mycobacterium tuberculosis
FAVPSRLNSTWGGNLT

SEQ ID NO: 102881 - protein, 16 aa, Mycobacterium tuberculosis
AVPSRLNSTWGGNLTD

SEQ ID NO: 102882 - protein, 16 aa, Mycobacterium tuberculosis
VPSRLNSTWGGNLTDM

SEQ ID NO: 102883 - protein, 16 aa, Mycobacterium tuberculosis
PSRLNSTWGGNLTDMV

SEQ ID NO: 102884 - protein, 16 aa, Mycobacterium tuberculosis
SRLNSTWGGNLTDMVR

SEQ ID NO: 102885 - protein, 16 aa, Mycobacterium tuberculosis
RLNSTWGGNLTDMVRA

SEQ ID NO: 102886 - protein, 16 aa, Mycobacterium tuberculosis
LNSTWGGNLTDMVRAR

SEQ ID NO: 102887 - protein, 16 aa, Mycobacterium tuberculosis
NSTWGGNLTDMVRARR

SEQ ID NO: 102888 - protein, 16 aa, Mycobacterium tuberculosis
STWGGNLTDMVRARRI

SEQ ID NO: 102889 - protein, 16 aa, Mycobacterium tuberculosis
TWGGNLTDMVRARRIL

SEQ ID NO: 102890 - protein, 16 aa, Mycobacterium tuberculosis
WGGNLTDMVRARRILE

SEQ ID NO: 102891 - protein, 16 aa, Mycobacterium tuberculosis
GGNLTDMVRARRILEV

SEQ ID NO: 102892 - protein, 16 aa, Mycobacterium tuberculosis
GNLTDMVRARRILEVI

SEQ ID NO: 102893 - protein, 16 aa, Mycobacterium tuberculosis
NLTDMVRARRILEVIE

SEQ ID NO: 102894 - protein, 16 aa, Mycobacterium tuberculosis
LTDMVRARRILEVIEA

SEQ ID NO: 102895 - protein, 16 aa, Mycobacterium tuberculosis
TDMVRARRILEVIEAE

SEQ ID NO: 102896 - protein, 16 aa, Mycobacterium tuberculosis
DMVRARRILEVIEAEG

SEQ ID NO: 102897 - protein, 16 aa, Mycobacterium tuberculosis
MVRARRILEVIEAEGL

SEQ ID NO: 102898 - protein, 16 aa, Mycobacterium tuberculosis
VRARRILEVIEAEGLF

SEQ ID NO: 102899 - protein, 16 aa, Mycobacterium tuberculosis
RARRILEVIEAEGLFE

SEQ ID NO: 102900 - protein, 16 aa, Mycobacterium tuberculosis
ARRILEVIEAEGLFER

SEQ ID NO: 102901 - protein, 16 aa, Mycobacterium tuberculosis
RRILEVIEAEGLFERA

SEQ ID NO: 102902 - protein, 16 aa, Mycobacterium tuberculosis
RILEVIEAEGLFERAV

SEQ ID NO: 102903 - protein, 16 aa, Mycobacterium tuberculosis
ILEVIEAEGLFERAVQ

SEQ ID NO: 102904 - protein, 16 aa, Mycobacterium tuberculosis
LEVIEAEGLFERAVQH

SEQ ID NO: 102905 - protein, 16 aa, Mycobacterium tuberculosis
EVIEAEGLFERAVQHG

SEQ ID NO: 102906 - protein, 16 aa, Mycobacterium tuberculosis
VIEAEGLFERAVQHGK

SEQ ID NO: 102907 - protein, 16 aa, Mycobacterium tuberculosis
IEAEGLFERAVQHGKY

SEQ ID NO: 102908 - protein, 16 aa, Mycobacterium tuberculosis
EAEGLFERAVQHGKYL

SEQ ID NO: 102909 - protein, 16 aa, Mycobacterium tuberculosis
AEGLFERAVQHGKYLR

SEQ ID NO: 102910 - protein, 16 aa, Mycobacterium tuberculosis
EGLFERAVQHGKYLRA

SEQ ID NO: 102911 - protein, 16 aa, Mycobacterium tuberculosis
GLFERAVQHGKYLRAR

SEQ ID NO: 102912 - protein, 16 aa, Mycobacterium tuberculosis
LFERAVQHGKYLRARL

SEQ ID NO: 102913 - protein, 16 aa, Mycobacterium tuberculosis
FERAVQHGKYLRARLD

SEQ ID NO: 102914 - protein, 16 aa, Mycobacterium tuberculosis
ERAVQHGKYLRARLDE

SEQ ID NO: 102915 - protein, 16 aa, Mycobacterium tuberculosis
RAVQHGKYLRARLDEL

SEQ ID NO: 102916 - protein, 16 aa, Mycobacterium tuberculosis
AVQHGKYLRARLDELA

SEQ ID NO: 102917 - protein, 16 aa, Mycobacterium tuberculosis
VQHGKYLRARLDELAA

SEQ ID NO: 102918 - protein, 16 aa, Mycobacterium tuberculosis
QHGKYLRARLDELAAD

SEQ ID NO: 102919 - protein, 16 aa, Mycobacterium tuberculosis
HGKYLRARLDELAADF

SEQ ID NO: 102920 - protein, 16 aa, Mycobacterium tuberculosis
GKYLRARLDELAADFP

SEQ ID NO: 102921 - protein, 16 aa, Mycobacterium tuberculosis
KYLRARLDELAADFPA

SEQ ID NO: 102922 - protein, 16 aa, Mycobacterium tuberculosis
YLRARLDELAADFPAV

SEQ ID NO: 102923 - protein, 16 aa, Mycobacterium tuberculosis
LRARLDELAADFPAVV

SEQ ID NO: 102924 - protein, 16 aa, Mycobacterium tuberculosis
RARLDELAADFPAVVL

SEQ ID NO: 102925 - protein, 16 aa, Mycobacterium tuberculosis
ARLDELAADFPAVVLD

SEQ ID NO: 102926 - protein, 16 aa, Mycobacterium tuberculosis
RLDELAADFPAVVLDP

SEQ ID NO: 102927 - protein, 16 aa, Mycobacterium tuberculosis
LDELAADFPAVVLDPR

SEQ ID NO: 102928 - protein, 16 aa, Mycobacterium tuberculosis
DELAADFPAVVLDPRG

SEQ ID NO: 102929 - protein, 16 aa, Mycobacterium tuberculosis
ELAADFPAVVLDPRGR

SEQ ID NO: 102930 - protein, 16 aa, Mycobacterium tuberculosis
LAADFPAVVLDPRGRG

SEQ ID NO: 102931 - protein, 16 aa, Mycobacterium tuberculosis
AADFPAVVLDPRGRGL

SEQ ID NO: 102932 - protein, 16 aa, Mycobacterium tuberculosis
ADFPAVVLDPRGRGLM

SEQ ID NO: 102933 - protein, 16 aa, Mycobacterium tuberculosis
DFPAVVLDPRGRGLMC

SEQ ID NO: 102934 - protein, 16 aa, Mycobacterium tuberculosis
FPAVVLDPRGRGLMCA

SEQ ID NO: 102935 - protein, 16 aa, Mycobacterium tuberculosis
PAVVLDPRGRGLMCAF

SEQ ID NO: 102936 - protein, 16 aa, Mycobacterium tuberculosis
AVVLDPRGRGLMCAFS

SEQ ID NO: 102937 - protein, 16 aa, Mycobacterium tuberculosis
VVLDPRGRGLMCAFSL

SEQ ID NO: 102938 - protein, 16 aa, Mycobacterium tuberculosis
VLDPRGRGLMCAFSLP

SEQ ID NO: 102939 - protein, 16 aa, Mycobacterium tuberculosis
LDPRGRGLMCAFSLPT

SEQ ID NO: 102940 - protein, 16 aa, Mycobacterium tuberculosis
DPRGRGLMCAFSLPTT

SEQ ID NO: 102941 - protein, 16 aa, Mycobacterium tuberculosis
PRGRGLMCAFSLPTTA

SEQ ID NO: 102942 - protein, 16 aa, Mycobacterium tuberculosis
RGRGLMCAFSLPTTAD

SEQ ID NO: 102943 - protein, 16 aa, Mycobacterium tuberculosis
GRGLMCAFSLPTTADR

SEQ ID NO: 102944 - protein, 16 aa, Mycobacterium tuberculosis
RGLMCAFSLPTTADRD

SEQ ID NO: 102945 - protein, 16 aa, Mycobacterium tuberculosis
GLMCAFSLPTTADRDE

SEQ ID NO: 102946 - protein, 16 aa, Mycobacterium tuberculosis
LMCAFSLPTTADRDEL

SEQ ID NO: 102947 - protein, 16 aa, Mycobacterium tuberculosis
MCAFSLPTTADRDELI

SEQ ID NO: 102948 - protein, 16 aa, Mycobacterium tuberculosis
CAFSLPTTADRDELIR

SEQ ID NO: 102949 - protein, 16 aa, Mycobacterium tuberculosis
AFSLPTTADRDELIRQ

SEQ ID NO: 102950 - protein, 16 aa, Mycobacterium tuberculosis
FSLPTTADRDELIRQL

SEQ ID NO: 102951 - protein, 16 aa, Mycobacterium tuberculosis
SLPTTADRDELIRQLW

SEQ ID NO: 102952 - protein, 16 aa, Mycobacterium tuberculosis
LPTTADRDELIRQLWQ

SEQ ID NO: 102953 - protein, 16 aa, Mycobacterium tuberculosis
PTTADRDELIRQLWQR

SEQ ID NO: 102954 - protein, 16 aa, Mycobacterium tuberculosis
TTADRDELIRQLWQRA

SEQ ID NO: 102955 - protein, 16 aa, Mycobacterium tuberculosis
TADRDELIRQLWQRAV

SEQ ID NO: 102956 - protein, 16 aa, Mycobacterium tuberculosis
ADRDELIRQLWQRAVI

SEQ ID NO: 102957 - protein, 16 aa, Mycobacterium tuberculosis
DRDELIRQLWQRAVIV

SEQ ID NO: 102958 - protein, 16 aa, Mycobacterium tuberculosis
RDELIRQLWQRAVIVL

SEQ ID NO: 102959 - protein, 16 aa, Mycobacterium tuberculosis
DELIRQLWQRAVIVLP

SEQ ID NO: 102960 - protein, 16 aa, Mycobacterium tuberculosis
ELIRQLWQRAVIVLPA

SEQ ID NO: 102961 - protein, 16 aa, Mycobacterium tuberculosis
LIRQLWQRAVIVLPAG

SEQ ID NO: 102962 - protein, 16 aa, Mycobacterium tuberculosis
IRQLWQRAVIVLPAGA

SEQ ID NO: 102963 - protein, 16 aa, Mycobacterium tuberculosis
RQLWQRAVIVLPAGAD

SEQ ID NO: 102964 - protein, 16 aa, Mycobacterium tuberculosis
QLWQRAVIVLPAGADT

SEQ ID NO: 102965 - protein, 16 aa, Mycobacterium tuberculosis
LWQRAVIVLPAGADTV

SEQ ID NO: 102966 - protein, 16 aa, Mycobacterium tuberculosis
WQRAVIVLPAGADTVR

SEQ ID NO: 102967 - protein, 16 aa, Mycobacterium tuberculosis
QRAVIVLPAGADTVRF

SEQ ID NO: 102968 - protein, 16 aa, Mycobacterium tuberculosis
RAVIVLPAGADTVRFR

SEQ ID NO: 102969 - protein, 16 aa, Mycobacterium tuberculosis
AVIVLPAGADTVRFRP

SEQ ID NO: 102970 - protein, 16 aa, Mycobacterium tuberculosis
VIVLPAGADTVRFRPP

SEQ ID NO: 102971 - protein, 16 aa, Mycobacterium tuberculosis
IVLPAGADTVRFRPPL

SEQ ID NO: 102972 - protein, 16 aa, Mycobacterium tuberculosis
VLPAGADTVRFRPPLT

SEQ ID NO: 102973 - protein, 16 aa, Mycobacterium tuberculosis
LPAGADTVRFRPPLTV

SEQ ID NO: 102974 - protein, 16 aa, Mycobacterium tuberculosis
PAGADTVRFRPPLTVS

SEQ ID NO: 102975 - protein, 16 aa, Mycobacterium tuberculosis
AGADTVRFRPPLTVST

SEQ ID NO: 102976 - protein, 16 aa, Mycobacterium tuberculosis
GADTVRFRPPLTVSTA

SEQ ID NO: 102977 - protein, 16 aa, Mycobacterium tuberculosis
ADTVRFRPPLTVSTAE

SEQ ID NO: 102978 - protein, 16 aa, Mycobacterium tuberculosis
DTVRFRPPLTVSTAEI

SEQ ID NO: 102979 - protein, 16 aa, Mycobacterium tuberculosis
TVRFRPPLTVSTAEID

SEQ ID NO: 102980 - protein, 16 aa, Mycobacterium tuberculosis
VRFRPPLTVSTAEIDA

SEQ ID NO: 102981 - protein, 16 aa, Mycobacterium tuberculosis
RFRPPLTVSTAEIDAA

SEQ ID NO: 102982 - protein, 16 aa, Mycobacterium tuberculosis
FRPPLTVSTAEIDAAI

SEQ ID NO: 102983 - protein, 16 aa, Mycobacterium tuberculosis
RPPLTVSTAEIDAAIA

SEQ ID NO: 102984 - protein, 16 aa, Mycobacterium tuberculosis
PPLTVSTAEIDAAIAA

SEQ ID NO: 102985 - protein, 16 aa, Mycobacterium tuberculosis
PLTVSTAEIDAAIAAV

SEQ ID NO: 102986 - protein, 16 aa, Mycobacterium tuberculosis
LTVSTAEIDAAIAAVR

SEQ ID NO: 102987 - protein, 16 aa, Mycobacterium tuberculosis
TVSTAEIDAAIAAVRS

SEQ ID NO: 102988 - protein, 16 aa, Mycobacterium tuberculosis
VSTAEIDAAIAAVRSA

SEQ ID NO: 102989 - protein, 16 aa, Mycobacterium tuberculosis
STAEIDAAIAAVRSAL

SEQ ID NO: 102990 - protein, 16 aa, Mycobacterium tuberculosis
TAEIDAAIAAVRSALP

SEQ ID NO: 102991 - protein, 16 aa, Mycobacterium tuberculosis
AEIDAAIAAVRSALPV

SEQ ID NO: 102992 - protein, 16 aa, Mycobacterium tuberculosis
EIDAAIAAVRSALPVV

SEQ ID NO: 102993 - protein, 16 aa, Mycobacterium tuberculosis
IDAAIAAVRSALPVVT

SEQ ID NO: 102994 - protein, 13 aa, Mycobacterium tuberculosis
MNEALDDIDRILV

SEQ ID NO: 102995 - protein, 13 aa, Mycobacterium tuberculosis
NEALDDIDRILVR

SEQ ID NO: 102996 - protein, 13 aa, Mycobacterium tuberculosis
EALDDIDRILVRE

SEQ ID NO: 102997 - protein, 13 aa, Mycobacterium tuberculosis
ALDDIDRILVREL

SEQ ID NO: 102998 - protein, 13 aa, Mycobacterium tuberculosis
LDDIDRILVRELA

SEQ ID NO: 102999 - protein, 13 aa, Mycobacterium tuberculosis
DDIDRILVRELAA

SEQ ID NO: 103000 - protein, 13 aa, Mycobacterium tuberculosis
DIDRILVRELAAD

SEQ ID NO: 103001 - protein, 13 aa, Mycobacterium tuberculosis
IDRILVRELAADG

SEQ ID NO: 103002 - protein, 13 aa, Mycobacterium tuberculosis
DRILVRELAADGR

SEQ ID NO: 103003 - protein, 13 aa, Mycobacterium tuberculosis
RILVRELAADGRA

SEQ ID NO: 103004 - protein, 13 aa, Mycobacterium tuberculosis
ILVRELAADGRAT

SEQ ID NO: 103005 - protein, 13 aa, Mycobacterium tuberculosis
LVRELAADGRATL

SEQ ID NO: 103006 - protein, 13 aa, Mycobacterium tuberculosis
VRELAADGRATLS

SEQ ID NO: 103007 - protein, 13 aa, Mycobacterium tuberculosis
RELAADGRATLSE

SEQ ID NO: 103008 - protein, 13 aa, Mycobacterium tuberculosis
ELAADGRATLSEL

SEQ ID NO: 103009 - protein, 13 aa, Mycobacterium tuberculosis
LAADGRATLSELA

SEQ ID NO: 103010 - protein, 13 aa, Mycobacterium tuberculosis
AADGRATLSELAT

SEQ ID NO: 103011 - protein, 13 aa, Mycobacterium tuberculosis
ADGRATLSELATR

SEQ ID NO: 103012 - protein, 13 aa, Mycobacterium tuberculosis
DGRATLSELATRA

SEQ ID NO: 103013 - protein, 13 aa, Mycobacterium tuberculosis
GRATLSELATRAG

SEQ ID NO: 103014 - protein, 13 aa, Mycobacterium tuberculosis
RATLSELATRAGL

SEQ ID NO: 103015 - protein, 13 aa, Mycobacterium tuberculosis
ATLSELATRAGLS

SEQ ID NO: 103016 - protein, 13 aa, Mycobacterium tuberculosis
TLSELATRAGLSV

SEQ ID NO: 103017 - protein, 13 aa, Mycobacterium tuberculosis
LSELATRAGLSVS

SEQ ID NO: 103018 - protein, 13 aa, Mycobacterium tuberculosis
SELATRAGLSVSA

SEQ ID NO: 103019 - protein, 13 aa, Mycobacterium tuberculosis
ELATRAGLSVSAV

SEQ ID NO: 103020 - protein, 13 aa, Mycobacterium tuberculosis
LATRAGLSVSAVQ

SEQ ID NO: 103021 - protein, 13 aa, Mycobacterium tuberculosis
ATRAGLSVSAVQS

SEQ ID NO: 103022 - protein, 13 aa, Mycobacterium tuberculosis
TRAGLSVSAVQSR

SEQ ID NO: 103023 - protein, 13 aa, Mycobacterium tuberculosis
RAGLSVSAVQSRV

SEQ ID NO: 103024 - protein, 13 aa, Mycobacterium tuberculosis
AGLSVSAVQSRVR

SEQ ID NO: 103025 - protein, 13 aa, Mycobacterium tuberculosis
GLSVSAVQSRVRR

SEQ ID NO: 103026 - protein, 13 aa, Mycobacterium tuberculosis
LSVSAVQSRVRRL

SEQ ID NO: 103027 - protein, 13 aa, Mycobacterium tuberculosis
SVSAVQSRVRRLE

SEQ ID NO: 103028 - protein, 13 aa, Mycobacterium tuberculosis
VSAVQSRVRRLES

SEQ ID NO: 103029 - protein, 13 aa, Mycobacterium tuberculosis
SAVQSRVRRLESR

SEQ ID NO: 103030 - protein, 13 aa, Mycobacterium tuberculosis
AVQSRVRRLESRG

SEQ ID NO: 103031 - protein, 13 aa, Mycobacterium tuberculosis
VQSRVRRLESRGV

SEQ ID NO: 103032 - protein, 13 aa, Mycobacterium tuberculosis
QSRVRRLESRGVV

SEQ ID NO: 103033 - protein, 13 aa, Mycobacterium tuberculosis
SRVRRLESRGVVQ

SEQ ID NO: 103034 - protein, 13 aa, Mycobacterium tuberculosis
RVRRLESRGVVQG

SEQ ID NO: 103035 - protein, 13 aa, Mycobacterium tuberculosis
VRRLESRGVVQGY

SEQ ID NO: 103036 - protein, 13 aa, Mycobacterium tuberculosis
RRLESRGVVQGYS

SEQ ID NO: 103037 - protein, 13 aa, Mycobacterium tuberculosis
RLESRGVVQGYSA

SEQ ID NO: 103038 - protein, 13 aa, Mycobacterium tuberculosis
LESRGVVQGYSAR

SEQ ID NO: 103039 - protein, 13 aa, Mycobacterium tuberculosis
ESRGVVQGYSARI

SEQ ID NO: 103040 - protein, 13 aa, Mycobacterium tuberculosis
SRGVVQGYSARIN

SEQ ID NO: 103041 - protein, 13 aa, Mycobacterium tuberculosis
RGVVQGYSARINP

SEQ ID NO: 103042 - protein, 13 aa, Mycobacterium tuberculosis
GVVQGYSARINPE

SEQ ID NO: 103043 - protein, 13 aa, Mycobacterium tuberculosis
VVQGYSARINPEA

SEQ ID NO: 103044 - protein, 13 aa, Mycobacterium tuberculosis
VQGYSARINPEAV

SEQ ID NO: 103045 - protein, 13 aa, Mycobacterium tuberculosis
QGYSARINPEAVG

SEQ ID NO: 103046 - protein, 13 aa, Mycobacterium tuberculosis
GYSARINPEAVGH

SEQ ID NO: 103047 - protein, 13 aa, Mycobacterium tuberculosis
YSARINPEAVGHL

SEQ ID NO: 103048 - protein, 13 aa, Mycobacterium tuberculosis
SARINPEAVGHLL

SEQ ID NO: 103049 - protein, 13 aa, Mycobacterium tuberculosis
ARINPEAVGHLLS

SEQ ID NO: 103050 - protein, 13 aa, Mycobacterium tuberculosis
RINPEAVGHLLSA

SEQ ID NO: 103051 - protein, 13 aa, Mycobacterium tuberculosis
INPEAVGHLLSAF

SEQ ID NO: 103052 - protein, 13 aa, Mycobacterium tuberculosis
NPEAVGHLLSAFV

SEQ ID NO: 103053 - protein, 13 aa, Mycobacterium tuberculosis
PEAVGHLLSAFVA

SEQ ID NO: 103054 - protein, 13 aa, Mycobacterium tuberculosis
EAVGHLLSAFVAI

SEQ ID NO: 103055 - protein, 13 aa, Mycobacterium tuberculosis
AVGHLLSAFVAIT

SEQ ID NO: 103056 - protein, 13 aa, Mycobacterium tuberculosis
VGHLLSAFVAITP

SEQ ID NO: 103057 - protein, 13 aa, Mycobacterium tuberculosis
GHLLSAFVAITPL

SEQ ID NO: 103058 - protein, 13 aa, Mycobacterium tuberculosis
HLLSAFVAITPLD

SEQ ID NO: 103059 - protein, 13 aa, Mycobacterium tuberculosis
LLSAFVAITPLDP

SEQ ID NO: 103060 - protein, 13 aa, Mycobacterium tuberculosis
LSAFVAITPLDPS

SEQ ID NO: 103061 - protein, 13 aa, Mycobacterium tuberculosis
SAFVAITPLDPSQ

SEQ ID NO: 103062 - protein, 13 aa, Mycobacterium tuberculosis
AFVAITPLDPSQP

SEQ ID NO: 103063 - protein, 13 aa, Mycobacterium tuberculosis
FVAITPLDPSQPD

SEQ ID NO: 103064 - protein, 13 aa, Mycobacterium tuberculosis
VAITPLDPSQPDD

SEQ ID NO: 103065 - protein, 13 aa, Mycobacterium tuberculosis
AITPLDPSQPDDA

SEQ ID NO: 103066 - protein, 13 aa, Mycobacterium tuberculosis
ITPLDPSQPDDAP

SEQ ID NO: 103067 - protein, 13 aa, Mycobacterium tuberculosis
TPLDPSQPDDAPA

SEQ ID NO: 103068 - protein, 13 aa, Mycobacterium tuberculosis
PLDPSQPDDAPAR

SEQ ID NO: 103069 - protein, 13 aa, Mycobacterium tuberculosis
LDPSQPDDAPARL

SEQ ID NO: 103070 - protein, 13 aa, Mycobacterium tuberculosis
DPSQPDDAPARLE

SEQ ID NO: 103071 - protein, 13 aa, Mycobacterium tuberculosis
PSQPDDAPARLEH

SEQ ID NO: 103072 - protein, 13 aa, Mycobacterium tuberculosis
SQPDDAPARLEHI

SEQ ID NO: 103073 - protein, 13 aa, Mycobacterium tuberculosis
QPDDAPARLEHIE

SEQ ID NO: 103074 - protein, 13 aa, Mycobacterium tuberculosis
PDDAPARLEHIEE

SEQ ID NO: 103075 - protein, 13 aa, Mycobacterium tuberculosis
DDAPARLEHIEEV

SEQ ID NO: 103076 - protein, 13 aa, Mycobacterium tuberculosis
DAPARLEHIEEVE

SEQ ID NO: 103077 - protein, 13 aa, Mycobacterium tuberculosis
APARLEHIEEVES

SEQ ID NO: 103078 - protein, 13 aa, Mycobacterium tuberculosis
PARLEHIEEVESC

SEQ ID NO: 103079 - protein, 13 aa, Mycobacterium tuberculosis
ARLEHIEEVESCY

SEQ ID NO: 103080 - protein, 13 aa, Mycobacterium tuberculosis
RLEHIEEVESCYS

SEQ ID NO: 103081 - protein, 13 aa, Mycobacterium tuberculosis
LEHIEEVESCYSV

SEQ ID NO: 103082 - protein, 13 aa, Mycobacterium tuberculosis
EHIEEVESCYSVA

SEQ ID NO: 103083 - protein, 13 aa, Mycobacterium tuberculosis
HIEEVESCYSVAG

SEQ ID NO: 103084 - protein, 13 aa, Mycobacterium tuberculosis
IEEVESCYSVAGE

SEQ ID NO: 103085 - protein, 13 aa, Mycobacterium tuberculosis
EEVESCYSVAGEE

SEQ ID NO: 103086 - protein, 13 aa, Mycobacterium tuberculosis
EVESCYSVAGEES

SEQ ID NO: 103087 - protein, 13 aa, Mycobacterium tuberculosis
VESCYSVAGEESY

SEQ ID NO: 103088 - protein, 13 aa, Mycobacterium tuberculosis
ESCYSVAGEESYV

SEQ ID NO: 103089 - protein, 13 aa, Mycobacterium tuberculosis
SCYSVAGEESYVL

SEQ ID NO: 103090 - protein, 13 aa, Mycobacterium tuberculosis
CYSVAGEESYVLL

SEQ ID NO: 103091 - protein, 13 aa, Mycobacterium tuberculosis
YSVAGEESYVLLV

SEQ ID NO: 103092 - protein, 13 aa, Mycobacterium tuberculosis
SVAGEESYVLLVR

SEQ ID NO: 103093 - protein, 13 aa, Mycobacterium tuberculosis
VAGEESYVLLVRV

SEQ ID NO: 103094 - protein, 13 aa, Mycobacterium tuberculosis
AGEESYVLLVRVA

SEQ ID NO: 103095 - protein, 13 aa, Mycobacterium tuberculosis
GEESYVLLVRVAS

SEQ ID NO: 103096 - protein, 13 aa, Mycobacterium tuberculosis
EESYVLLVRVASA

SEQ ID NO: 103097 - protein, 13 aa, Mycobacterium tuberculosis
ESYVLLVRVASAR

SEQ ID NO: 103098 - protein, 13 aa, Mycobacterium tuberculosis
SYVLLVRVASARA

SEQ ID NO: 103099 - protein, 13 aa, Mycobacterium tuberculosis
YVLLVRVASARAL

SEQ ID NO: 103100 - protein, 13 aa, Mycobacterium tuberculosis
VLLVRVASARALE

SEQ ID NO: 103101 - protein, 13 aa, Mycobacterium tuberculosis
LLVRVASARALED

SEQ ID NO: 103102 - protein, 13 aa, Mycobacterium tuberculosis
LVRVASARALEDL

SEQ ID NO: 103103 - protein, 13 aa, Mycobacterium tuberculosis
VRVASARALEDLL

SEQ ID NO: 103104 - protein, 13 aa, Mycobacterium tuberculosis
RVASARALEDLLQ

SEQ ID NO: 103105 - protein, 13 aa, Mycobacterium tuberculosis
VASARALEDLLQR

SEQ ID NO: 103106 - protein, 13 aa, Mycobacterium tuberculosis
ASARALEDLLQRI

SEQ ID NO: 103107 - protein, 13 aa, Mycobacterium tuberculosis
SARALEDLLQRIR

SEQ ID NO: 103108 - protein, 13 aa, Mycobacterium tuberculosis
ARALEDLLQRIRT

SEQ ID NO: 103109 - protein, 13 aa, Mycobacterium tuberculosis
RALEDLLQRIRTT

SEQ ID NO: 103110 - protein, 13 aa, Mycobacterium tuberculosis
ALEDLLQRIRTTA

SEQ ID NO: 103111 - protein, 13 aa, Mycobacterium tuberculosis
LEDLLQRIRTTAN

SEQ ID NO: 103112 - protein, 13 aa, Mycobacterium tuberculosis
EDLLQRIRTTANV

SEQ ID NO: 103113 - protein, 13 aa, Mycobacterium tuberculosis
DLLQRIRTTANVR

SEQ ID NO: 103114 - protein, 13 aa, Mycobacterium tuberculosis
LLQRIRTTANVRT

SEQ ID NO: 103115 - protein, 13 aa, Mycobacterium tuberculosis
LQRIRTTANVRTR

SEQ ID NO: 103116 - protein, 13 aa, Mycobacterium tuberculosis
QRIRTTANVRTRS

SEQ ID NO: 103117 - protein, 13 aa, Mycobacterium tuberculosis
RIRTTANVRTRST

SEQ ID NO: 103118 - protein, 13 aa, Mycobacterium tuberculosis
IRTTANVRTRSTI

SEQ ID NO: 103119 - protein, 13 aa, Mycobacterium tuberculosis
RTTANVRTRSTII

SEQ ID NO: 103120 - protein, 13 aa, Mycobacterium tuberculosis
TTANVRTRSTIIL

SEQ ID NO: 103121 - protein, 13 aa, Mycobacterium tuberculosis
TANVRTRSTIILN

SEQ ID NO: 103122 - protein, 13 aa, Mycobacterium tuberculosis
ANVRTRSTIILNT

SEQ ID NO: 103123 - protein, 13 aa, Mycobacterium tuberculosis
NVRTRSTIILNTF

SEQ ID NO: 103124 - protein, 13 aa, Mycobacterium tuberculosis
VRTRSTIILNTFY

SEQ ID NO: 103125 - protein, 13 aa, Mycobacterium tuberculosis
RTRSTIILNTFYS

SEQ ID NO: 103126 - protein, 13 aa, Mycobacterium tuberculosis
TRSTIILNTFYSD

SEQ ID NO: 103127 - protein, 13 aa, Mycobacterium tuberculosis
RSTIILNTFYSDR

SEQ ID NO: 103128 - protein, 13 aa, Mycobacterium tuberculosis
STIILNTFYSDRQ

SEQ ID NO: 103129 - protein, 13 aa, Mycobacterium tuberculosis
TIILNTFYSDRQH

SEQ ID NO: 103130 - protein, 13 aa, Mycobacterium tuberculosis
IILNTFYSDRQHI

SEQ ID NO: 103131 - protein, 13 aa, Mycobacterium tuberculosis
ILNTFYSDRQHIP

SEQ ID NO: 103132 - protein, 14 aa, Mycobacterium tuberculosis
MNEALDDIDRILVR

SEQ ID NO: 103133 - protein, 14 aa, Mycobacterium tuberculosis
NEALDDIDRILVRE

SEQ ID NO: 103134 - protein, 14 aa, Mycobacterium tuberculosis
EALDDIDRILVREL

SEQ ID NO: 103135 - protein, 14 aa, Mycobacterium tuberculosis
ALDDIDRILVRELA

SEQ ID NO: 103136 - protein, 14 aa, Mycobacterium tuberculosis
LDDIDRILVRELAA

SEQ ID NO: 103137 - protein, 14 aa, Mycobacterium tuberculosis
DDIDRILVRELAAD

SEQ ID NO: 103138 - protein, 14 aa, Mycobacterium tuberculosis
DIDRILVRELAADG

SEQ ID NO: 103139 - protein, 14 aa, Mycobacterium tuberculosis
IDRILVRELAADGR

SEQ ID NO: 103140 - protein, 14 aa, Mycobacterium tuberculosis
DRILVRELAADGRA

SEQ ID NO: 103141 - protein, 14 aa, Mycobacterium tuberculosis
RILVRELAADGRAT

SEQ ID NO: 103142 - protein, 14 aa, Mycobacterium tuberculosis
ILVRELAADGRATL

SEQ ID NO: 103143 - protein, 14 aa, Mycobacterium tuberculosis
LVRELAADGRATLS

SEQ ID NO: 103144 - protein, 14 aa, Mycobacterium tuberculosis
VRELAADGRATLSE

SEQ ID NO: 103145 - protein, 14 aa, Mycobacterium tuberculosis
RELAADGRATLSEL

SEQ ID NO: 103146 - protein, 14 aa, Mycobacterium tuberculosis
ELAADGRATLSELA

SEQ ID NO: 103147 - protein, 14 aa, Mycobacterium tuberculosis
LAADGRATLSELAT

SEQ ID NO: 103148 - protein, 14 aa, Mycobacterium tuberculosis
AADGRATLSELATR

SEQ ID NO: 103149 - protein, 14 aa, Mycobacterium tuberculosis
ADGRATLSELATRA

SEQ ID NO: 103150 - protein, 14 aa, Mycobacterium tuberculosis
DGRATLSELATRAG

SEQ ID NO: 103151 - protein, 14 aa, Mycobacterium tuberculosis
GRATLSELATRAGL

SEQ ID NO: 103152 - protein, 14 aa, Mycobacterium tuberculosis
RATLSELATRAGLS

SEQ ID NO: 103153 - protein, 14 aa, Mycobacterium tuberculosis
ATLSELATRAGLSV

SEQ ID NO: 103154 - protein, 14 aa, Mycobacterium tuberculosis
TLSELATRAGLSVS

SEQ ID NO: 103155 - protein, 14 aa, Mycobacterium tuberculosis
LSELATRAGLSVSA

SEQ ID NO: 103156 - protein, 14 aa, Mycobacterium tuberculosis
SELATRAGLSVSAV

SEQ ID NO: 103157 - protein, 14 aa, Mycobacterium tuberculosis
ELATRAGLSVSAVQ

SEQ ID NO: 103158 - protein, 14 aa, Mycobacterium tuberculosis
LATRAGLSVSAVQS

SEQ ID NO: 103159 - protein, 14 aa, Mycobacterium tuberculosis
ATRAGLSVSAVQSR

SEQ ID NO: 103160 - protein, 14 aa, Mycobacterium tuberculosis
TRAGLSVSAVQSRV

SEQ ID NO: 103161 - protein, 14 aa, Mycobacterium tuberculosis
RAGLSVSAVQSRVR

SEQ ID NO: 103162 - protein, 14 aa, Mycobacterium tuberculosis
AGLSVSAVQSRVRR

SEQ ID NO: 103163 - protein, 14 aa, Mycobacterium tuberculosis
GLSVSAVQSRVRRL

SEQ ID NO: 103164 - protein, 14 aa, Mycobacterium tuberculosis
LSVSAVQSRVRRLE

SEQ ID NO: 103165 - protein, 14 aa, Mycobacterium tuberculosis
SVSAVQSRVRRLES

SEQ ID NO: 103166 - protein, 14 aa, Mycobacterium tuberculosis
VSAVQSRVRRLESR

SEQ ID NO: 103167 - protein, 14 aa, Mycobacterium tuberculosis
SAVQSRVRRLESRG

SEQ ID NO: 103168 - protein, 14 aa, Mycobacterium tuberculosis
AVQSRVRRLESRGV

SEQ ID NO: 103169 - protein, 14 aa, Mycobacterium tuberculosis
VQSRVRRLESRGVV

SEQ ID NO: 103170 - protein, 14 aa, Mycobacterium tuberculosis
QSRVRRLESRGVVQ

SEQ ID NO: 103171 - protein, 14 aa, Mycobacterium tuberculosis
SRVRRLESRGVVQG

SEQ ID NO: 103172 - protein, 14 aa, Mycobacterium tuberculosis
RVRRLESRGVVQGY

SEQ ID NO: 103173 - protein, 14 aa, Mycobacterium tuberculosis
VRRLESRGVVQGYS

SEQ ID NO: 103174 - protein, 14 aa, Mycobacterium tuberculosis
RRLESRGVVQGYSA

SEQ ID NO: 103175 - protein, 14 aa, Mycobacterium tuberculosis
RLESRGVVQGYSAR

SEQ ID NO: 103176 - protein, 14 aa, Mycobacterium tuberculosis
LESRGVVQGYSARI

SEQ ID NO: 103177 - protein, 14 aa, Mycobacterium tuberculosis
ESRGVVQGYSARIN

SEQ ID NO: 103178 - protein, 14 aa, Mycobacterium tuberculosis
SRGVVQGYSARINP

SEQ ID NO: 103179 - protein, 14 aa, Mycobacterium tuberculosis
RGVVQGYSARINPE

SEQ ID NO: 103180 - protein, 14 aa, Mycobacterium tuberculosis
GVVQGYSARINPEA

SEQ ID NO: 103181 - protein, 14 aa, Mycobacterium tuberculosis
VVQGYSARINPEAV

SEQ ID NO: 103182 - protein, 14 aa, Mycobacterium tuberculosis
VQGYSARINPEAVG

SEQ ID NO: 103183 - protein, 14 aa, Mycobacterium tuberculosis
QGYSARINPEAVGH

SEQ ID NO: 103184 - protein, 14 aa, Mycobacterium tuberculosis
GYSARINPEAVGHL

SEQ ID NO: 103185 - protein, 14 aa, Mycobacterium tuberculosis
YSARINPEAVGHLL

SEQ ID NO: 103186 - protein, 14 aa, Mycobacterium tuberculosis
SARINPEAVGHLLS

SEQ ID NO: 103187 - protein, 14 aa, Mycobacterium tuberculosis
ARINPEAVGHLLSA

SEQ ID NO: 103188 - protein, 14 aa, Mycobacterium tuberculosis
RINPEAVGHLLSAF

SEQ ID NO: 103189 - protein, 14 aa, Mycobacterium tuberculosis
INPEAVGHLLSAFV

SEQ ID NO: 103190 - protein, 14 aa, Mycobacterium tuberculosis
NPEAVGHLLSAFVA

SEQ ID NO: 103191 - protein, 14 aa, Mycobacterium tuberculosis
PEAVGHLLSAFVAI

SEQ ID NO: 103192 - protein, 14 aa, Mycobacterium tuberculosis
EAVGHLLSAFVAIT

SEQ ID NO: 103193 - protein, 14 aa, Mycobacterium tuberculosis
AVGHLLSAFVAITP

SEQ ID NO: 103194 - protein, 14 aa, Mycobacterium tuberculosis
VGHLLSAFVAITPL

SEQ ID NO: 103195 - protein, 14 aa, Mycobacterium tuberculosis
GHLLSAFVAITPLD

SEQ ID NO: 103196 - protein, 14 aa, Mycobacterium tuberculosis
HLLSAFVAITPLDP

SEQ ID NO: 103197 - protein, 14 aa, Mycobacterium tuberculosis
LLSAFVAITPLDPS

SEQ ID NO: 103198 - protein, 14 aa, Mycobacterium tuberculosis
LSAFVAITPLDPSQ

SEQ ID NO: 103199 - protein, 14 aa, Mycobacterium tuberculosis
SAFVAITPLDPSQP

SEQ ID NO: 103200 - protein, 14 aa, Mycobacterium tuberculosis
AFVAITPLDPSQPD

SEQ ID NO: 103201 - protein, 14 aa, Mycobacterium tuberculosis
FVAITPLDPSQPDD

SEQ ID NO: 103202 - protein, 14 aa, Mycobacterium tuberculosis
VAITPLDPSQPDDA

SEQ ID NO: 103203 - protein, 14 aa, Mycobacterium tuberculosis
AITPLDPSQPDDAP

SEQ ID NO: 103204 - protein, 14 aa, Mycobacterium tuberculosis
ITPLDPSQPDDAPA

SEQ ID NO: 103205 - protein, 14 aa, Mycobacterium tuberculosis
TPLDPSQPDDAPAR

SEQ ID NO: 103206 - protein, 14 aa, Mycobacterium tuberculosis
PLDPSQPDDAPARL

SEQ ID NO: 103207 - protein, 14 aa, Mycobacterium tuberculosis
LDPSQPDDAPARLE

SEQ ID NO: 103208 - protein, 14 aa, Mycobacterium tuberculosis
DPSQPDDAPARLEH

SEQ ID NO: 103209 - protein, 14 aa, Mycobacterium tuberculosis
PSQPDDAPARLEHI

SEQ ID NO: 103210 - protein, 14 aa, Mycobacterium tuberculosis
SQPDDAPARLEHIE

SEQ ID NO: 103211 - protein, 14 aa, Mycobacterium tuberculosis
QPDDAPARLEHIEE

SEQ ID NO: 103212 - protein, 14 aa, Mycobacterium tuberculosis
PDDAPARLEHIEEV

SEQ ID NO: 103213 - protein, 14 aa, Mycobacterium tuberculosis
DDAPARLEHIEEVE

SEQ ID NO: 103214 - protein, 14 aa, Mycobacterium tuberculosis
DAPARLEHIEEVES

SEQ ID NO: 103215 - protein, 14 aa, Mycobacterium tuberculosis
APARLEHIEEVESC

SEQ ID NO: 103216 - protein, 14 aa, Mycobacterium tuberculosis
PARLEHIEEVESCY

SEQ ID NO: 103217 - protein, 14 aa, Mycobacterium tuberculosis
ARLEHIEEVESCYS

SEQ ID NO: 103218 - protein, 14 aa, Mycobacterium tuberculosis
RLEHIEEVESCYSV

SEQ ID NO: 103219 - protein, 14 aa, Mycobacterium tuberculosis
LEHIEEVESCYSVA

SEQ ID NO: 103220 - protein, 14 aa, Mycobacterium tuberculosis
EHIEEVESCYSVAG

SEQ ID NO: 103221 - protein, 14 aa, Mycobacterium tuberculosis
HIEEVESCYSVAGE

SEQ ID NO: 103222 - protein, 14 aa, Mycobacterium tuberculosis
IEEVESCYSVAGEE

SEQ ID NO: 103223 - protein, 14 aa, Mycobacterium tuberculosis
EEVESCYSVAGEES

SEQ ID NO: 103224 - protein, 14 aa, Mycobacterium tuberculosis
EVESCYSVAGEESY

SEQ ID NO: 103225 - protein, 14 aa, Mycobacterium tuberculosis
VESCYSVAGEESYV

SEQ ID NO: 103226 - protein, 14 aa, Mycobacterium tuberculosis
ESCYSVAGEESYVL

SEQ ID NO: 103227 - protein, 14 aa, Mycobacterium tuberculosis
SCYSVAGEESYVLL

SEQ ID NO: 103228 - protein, 14 aa, Mycobacterium tuberculosis
CYSVAGEESYVLLV

SEQ ID NO: 103229 - protein, 14 aa, Mycobacterium tuberculosis
YSVAGEESYVLLVR

SEQ ID NO: 103230 - protein, 14 aa, Mycobacterium tuberculosis
SVAGEESYVLLVRV

SEQ ID NO: 103231 - protein, 14 aa, Mycobacterium tuberculosis
VAGEESYVLLVRVA

SEQ ID NO: 103232 - protein, 14 aa, Mycobacterium tuberculosis
AGEESYVLLVRVAS

SEQ ID NO: 103233 - protein, 14 aa, Mycobacterium tuberculosis
GEESYVLLVRVASA

SEQ ID NO: 103234 - protein, 14 aa, Mycobacterium tuberculosis
EESYVLLVRVASAR

SEQ ID NO: 103235 - protein, 14 aa, Mycobacterium tuberculosis
ESYVLLVRVASARA

SEQ ID NO: 103236 - protein, 14 aa, Mycobacterium tuberculosis
SYVLLVRVASARAL

SEQ ID NO: 103237 - protein, 14 aa, Mycobacterium tuberculosis
YVLLVRVASARALE

SEQ ID NO: 103238 - protein, 14 aa, Mycobacterium tuberculosis
VLLVRVASARALED

SEQ ID NO: 103239 - protein, 14 aa, Mycobacterium tuberculosis
LLVRVASARALEDL

SEQ ID NO: 103240 - protein, 14 aa, Mycobacterium tuberculosis
LVRVASARALEDLL

SEQ ID NO: 103241 - protein, 14 aa, Mycobacterium tuberculosis
VRVASARALEDLLQ

SEQ ID NO: 103242 - protein, 14 aa, Mycobacterium tuberculosis
RVASARALEDLLQR

SEQ ID NO: 103243 - protein, 14 aa, Mycobacterium tuberculosis
VASARALEDLLQRI

SEQ ID NO: 103244 - protein, 14 aa, Mycobacterium tuberculosis
ASARALEDLLQRIR

SEQ ID NO: 103245 - protein, 14 aa, Mycobacterium tuberculosis
SARALEDLLQRIRT

SEQ ID NO: 103246 - protein, 14 aa, Mycobacterium tuberculosis
ARALEDLLQRIRTT

SEQ ID NO: 103247 - protein, 14 aa, Mycobacterium tuberculosis
RALEDLLQRIRTTA

SEQ ID NO: 103248 - protein, 14 aa, Mycobacterium tuberculosis
ALEDLLQRIRTTAN

SEQ ID NO: 103249 - protein, 14 aa, Mycobacterium tuberculosis
LEDLLQRIRTTANV

SEQ ID NO: 103250 - protein, 14 aa, Mycobacterium tuberculosis
EDLLQRIRTTANVR

SEQ ID NO: 103251 - protein, 14 aa, Mycobacterium tuberculosis
DLLQRIRTTANVRT

SEQ ID NO: 103252 - protein, 14 aa, Mycobacterium tuberculosis
LLQRIRTTANVRTR

SEQ ID NO: 103253 - protein, 14 aa, Mycobacterium tuberculosis
LQRIRTTANVRTRS

SEQ ID NO: 103254 - protein, 14 aa, Mycobacterium tuberculosis
QRIRTTANVRTRST

SEQ ID NO: 103255 - protein, 14 aa, Mycobacterium tuberculosis
RIRTTANVRTRSTI

SEQ ID NO: 103256 - protein, 14 aa, Mycobacterium tuberculosis
IRTTANVRTRSTII

SEQ ID NO: 103257 - protein, 14 aa, Mycobacterium tuberculosis
RTTANVRTRSTIIL

SEQ ID NO: 103258 - protein, 14 aa, Mycobacterium tuberculosis
TTANVRTRSTIILN

SEQ ID NO: 103259 - protein, 14 aa, Mycobacterium tuberculosis
TANVRTRSTIILNT

SEQ ID NO: 103260 - protein, 14 aa, Mycobacterium tuberculosis
ANVRTRSTIILNTF

SEQ ID NO: 103261 - protein, 14 aa, Mycobacterium tuberculosis
NVRTRSTIILNTFY

SEQ ID NO: 103262 - protein, 14 aa, Mycobacterium tuberculosis
VRTRSTIILNTFYS

SEQ ID NO: 103263 - protein, 14 aa, Mycobacterium tuberculosis
RTRSTIILNTFYSD

SEQ ID NO: 103264 - protein, 14 aa, Mycobacterium tuberculosis
TRSTIILNTFYSDR

SEQ ID NO: 103265 - protein, 14 aa, Mycobacterium tuberculosis
RSTIILNTFYSDRQ

SEQ ID NO: 103266 - protein, 14 aa, Mycobacterium tuberculosis
STIILNTFYSDRQH

SEQ ID NO: 103267 - protein, 14 aa, Mycobacterium tuberculosis
TIILNTFYSDRQHI

SEQ ID NO: 103268 - protein, 14 aa, Mycobacterium tuberculosis
IILNTFYSDRQHIP

SEQ ID NO: 103269 - protein, 15 aa, Mycobacterium tuberculosis
MNEALDDIDRILVRE

SEQ ID NO: 103270 - protein, 15 aa, Mycobacterium tuberculosis
NEALDDIDRILVREL

SEQ ID NO: 103271 - protein, 15 aa, Mycobacterium tuberculosis
EALDDIDRILVRELA

SEQ ID NO: 103272 - protein, 15 aa, Mycobacterium tuberculosis
ALDDIDRILVRELAA

SEQ ID NO: 103273 - protein, 15 aa, Mycobacterium tuberculosis
LDDIDRILVRELAAD

SEQ ID NO: 103274 - protein, 15 aa, Mycobacterium tuberculosis
DDIDRILVRELAADG

SEQ ID NO: 103275 - protein, 15 aa, Mycobacterium tuberculosis
DIDRILVRELAADGR

SEQ ID NO: 103276 - protein, 15 aa, Mycobacterium tuberculosis
IDRILVRELAADGRA

SEQ ID NO: 103277 - protein, 15 aa, Mycobacterium tuberculosis
DRILVRELAADGRAT

SEQ ID NO: 103278 - protein, 15 aa, Mycobacterium tuberculosis
RILVRELAADGRATL

SEQ ID NO: 103279 - protein, 15 aa, Mycobacterium tuberculosis
ILVRELAADGRATLS

SEQ ID NO: 103280 - protein, 15 aa, Mycobacterium tuberculosis
LVRELAADGRATLSE

SEQ ID NO: 103281 - protein, 15 aa, Mycobacterium tuberculosis
VRELAADGRATLSEL

SEQ ID NO: 103282 - protein, 15 aa, Mycobacterium tuberculosis
RELAADGRATLSELA

SEQ ID NO: 103283 - protein, 15 aa, Mycobacterium tuberculosis
ELAADGRATLSELAT

SEQ ID NO: 103284 - protein, 15 aa, Mycobacterium tuberculosis
LAADGRATLSELATR

SEQ ID NO: 103285 - protein, 15 aa, Mycobacterium tuberculosis
AADGRATLSELATRA

SEQ ID NO: 103286 - protein, 15 aa, Mycobacterium tuberculosis
ADGRATLSELATRAG

SEQ ID NO: 103287 - protein, 15 aa, Mycobacterium tuberculosis
DGRATLSELATRAGL

SEQ ID NO: 103288 - protein, 15 aa, Mycobacterium tuberculosis
GRATLSELATRAGLS

SEQ ID NO: 103289 - protein, 15 aa, Mycobacterium tuberculosis
RATLSELATRAGLSV

SEQ ID NO: 103290 - protein, 15 aa, Mycobacterium tuberculosis
ATLSELATRAGLSVS

SEQ ID NO: 103291 - protein, 15 aa, Mycobacterium tuberculosis
TLSELATRAGLSVSA

SEQ ID NO: 103292 - protein, 15 aa, Mycobacterium tuberculosis
LSELATRAGLSVSAV

SEQ ID NO: 103293 - protein, 15 aa, Mycobacterium tuberculosis
SELATRAGLSVSAVQ

SEQ ID NO: 103294 - protein, 15 aa, Mycobacterium tuberculosis
ELATRAGLSVSAVQS

SEQ ID NO: 103295 - protein, 15 aa, Mycobacterium tuberculosis
LATRAGLSVSAVQSR

SEQ ID NO: 103296 - protein, 15 aa, Mycobacterium tuberculosis
ATRAGLSVSAVQSRV

SEQ ID NO: 103297 - protein, 15 aa, Mycobacterium tuberculosis
TRAGLSVSAVQSRVR

SEQ ID NO: 103298 - protein, 15 aa, Mycobacterium tuberculosis
RAGLSVSAVQSRVRR

SEQ ID NO: 103299 - protein, 15 aa, Mycobacterium tuberculosis
AGLSVSAVQSRVRRL

SEQ ID NO: 103300 - protein, 15 aa, Mycobacterium tuberculosis
GLSVSAVQSRVRRLE

SEQ ID NO: 103301 - protein, 15 aa, Mycobacterium tuberculosis
LSVSAVQSRVRRLES

SEQ ID NO: 103302 - protein, 15 aa, Mycobacterium tuberculosis
SVSAVQSRVRRLESR

SEQ ID NO: 103303 - protein, 15 aa, Mycobacterium tuberculosis
VSAVQSRVRRLESRG

SEQ ID NO: 103304 - protein, 15 aa, Mycobacterium tuberculosis
SAVQSRVRRLESRGV

SEQ ID NO: 103305 - protein, 15 aa, Mycobacterium tuberculosis
AVQSRVRRLESRGVV

SEQ ID NO: 103306 - protein, 15 aa, Mycobacterium tuberculosis
VQSRVRRLESRGVVQ

SEQ ID NO: 103307 - protein, 15 aa, Mycobacterium tuberculosis
QSRVRRLESRGVVQG

SEQ ID NO: 103308 - protein, 15 aa, Mycobacterium tuberculosis
SRVRRLESRGVVQGY

SEQ ID NO: 103309 - protein, 15 aa, Mycobacterium tuberculosis
RVRRLESRGVVQGYS

SEQ ID NO: 103310 - protein, 15 aa, Mycobacterium tuberculosis
VRRLESRGVVQGYSA

SEQ ID NO: 103311 - protein, 15 aa, Mycobacterium tuberculosis
RRLESRGVVQGYSAR

SEQ ID NO: 103312 - protein, 15 aa, Mycobacterium tuberculosis
RLESRGVVQGYSARI

SEQ ID NO: 103313 - protein, 15 aa, Mycobacterium tuberculosis
LESRGVVQGYSARIN

SEQ ID NO: 103314 - protein, 15 aa, Mycobacterium tuberculosis
ESRGVVQGYSARINP

SEQ ID NO: 103315 - protein, 15 aa, Mycobacterium tuberculosis
SRGVVQGYSARINPE

SEQ ID NO: 103316 - protein, 15 aa, Mycobacterium tuberculosis
RGVVQGYSARINPEA

SEQ ID NO: 103317 - protein, 15 aa, Mycobacterium tuberculosis
GVVQGYSARINPEAV

SEQ ID NO: 103318 - protein, 15 aa, Mycobacterium tuberculosis
VVQGYSARINPEAVG

SEQ ID NO: 103319 - protein, 15 aa, Mycobacterium tuberculosis
VQGYSARINPEAVGH

SEQ ID NO: 103320 - protein, 15 aa, Mycobacterium tuberculosis
QGYSARINPEAVGHL

SEQ ID NO: 103321 - protein, 15 aa, Mycobacterium tuberculosis
GYSARINPEAVGHLL

SEQ ID NO: 103322 - protein, 15 aa, Mycobacterium tuberculosis
YSARINPEAVGHLLS

SEQ ID NO: 103323 - protein, 15 aa, Mycobacterium tuberculosis
SARINPEAVGHLLSA

SEQ ID NO: 103324 - protein, 15 aa, Mycobacterium tuberculosis
ARINPEAVGHLLSAF

SEQ ID NO: 103325 - protein, 15 aa, Mycobacterium tuberculosis
RINPEAVGHLLSAFV

SEQ ID NO: 103326 - protein, 15 aa, Mycobacterium tuberculosis
INPEAVGHLLSAFVA

SEQ ID NO: 103327 - protein, 15 aa, Mycobacterium tuberculosis
NPEAVGHLLSAFVAI

SEQ ID NO: 103328 - protein, 15 aa, Mycobacterium tuberculosis
PEAVGHLLSAFVAIT

SEQ ID NO: 103329 - protein, 15 aa, Mycobacterium tuberculosis
EAVGHLLSAFVAITP

SEQ ID NO: 103330 - protein, 15 aa, Mycobacterium tuberculosis
AVGHLLSAFVAITPL

SEQ ID NO: 103331 - protein, 15 aa, Mycobacterium tuberculosis
VGHLLSAFVAITPLD

SEQ ID NO: 103332 - protein, 15 aa, Mycobacterium tuberculosis
GHLLSAFVAITPLDP

SEQ ID NO: 103333 - protein, 15 aa, Mycobacterium tuberculosis
HLLSAFVAITPLDPS

SEQ ID NO: 103334 - protein, 15 aa, Mycobacterium tuberculosis
LLSAFVAITPLDPSQ

SEQ ID NO: 103335 - protein, 15 aa, Mycobacterium tuberculosis
LSAFVAITPLDPSQP

SEQ ID NO: 103336 - protein, 15 aa, Mycobacterium tuberculosis
SAFVAITPLDPSQPD

SEQ ID NO: 103337 - protein, 15 aa, Mycobacterium tuberculosis
AFVAITPLDPSQPDD

SEQ ID NO: 103338 - protein, 15 aa, Mycobacterium tuberculosis
FVAITPLDPSQPDDA

SEQ ID NO: 103339 - protein, 15 aa, Mycobacterium tuberculosis
VAITPLDPSQPDDAP

SEQ ID NO: 103340 - protein, 15 aa, Mycobacterium tuberculosis
AITPLDPSQPDDAPA

SEQ ID NO: 103341 - protein, 15 aa, Mycobacterium tuberculosis
ITPLDPSQPDDAPAR

SEQ ID NO: 103342 - protein, 15 aa, Mycobacterium tuberculosis
TPLDPSQPDDAPARL

SEQ ID NO: 103343 - protein, 15 aa, Mycobacterium tuberculosis
PLDPSQPDDAPARLE

SEQ ID NO: 103344 - protein, 15 aa, Mycobacterium tuberculosis
LDPSQPDDAPARLEH

SEQ ID NO: 103345 - protein, 15 aa, Mycobacterium tuberculosis
DPSQPDDAPARLEHI

SEQ ID NO: 103346 - protein, 15 aa, Mycobacterium tuberculosis
PSQPDDAPARLEHIE

SEQ ID NO: 103347 - protein, 15 aa, Mycobacterium tuberculosis
SQPDDAPARLEHIEE

SEQ ID NO: 103348 - protein, 15 aa, Mycobacterium tuberculosis
QPDDAPARLEHIEEV

SEQ ID NO: 103349 - protein, 15 aa, Mycobacterium tuberculosis
PDDAPARLEHIEEVE

SEQ ID NO: 103350 - protein, 15 aa, Mycobacterium tuberculosis
DDAPARLEHIEEVES

SEQ ID NO: 103351 - protein, 15 aa, Mycobacterium tuberculosis
DAPARLEHIEEVESC

SEQ ID NO: 103352 - protein, 15 aa, Mycobacterium tuberculosis
APARLEHIEEVESCY

SEQ ID NO: 103353 - protein, 15 aa, Mycobacterium tuberculosis
PARLEHIEEVESCYS

SEQ ID NO: 103354 - protein, 15 aa, Mycobacterium tuberculosis
ARLEHIEEVESCYSV

SEQ ID NO: 103355 - protein, 15 aa, Mycobacterium tuberculosis
RLEHIEEVESCYSVA

SEQ ID NO: 103356 - protein, 15 aa, Mycobacterium tuberculosis
LEHIEEVESCYSVAG

SEQ ID NO: 103357 - protein, 15 aa, Mycobacterium tuberculosis
EHIEEVESCYSVAGE

SEQ ID NO: 103358 - protein, 15 aa, Mycobacterium tuberculosis
HIEEVESCYSVAGEE

SEQ ID NO: 103359 - protein, 15 aa, Mycobacterium tuberculosis
IEEVESCYSVAGEES

SEQ ID NO: 103360 - protein, 15 aa, Mycobacterium tuberculosis
EEVESCYSVAGEESY

SEQ ID NO: 103361 - protein, 15 aa, Mycobacterium tuberculosis
EVESCYSVAGEESYV

SEQ ID NO: 103362 - protein, 15 aa, Mycobacterium tuberculosis
VESCYSVAGEESYVL

SEQ ID NO: 103363 - protein, 15 aa, Mycobacterium tuberculosis
ESCYSVAGEESYVLL

SEQ ID NO: 103364 - protein, 15 aa, Mycobacterium tuberculosis
SCYSVAGEESYVLLV

SEQ ID NO: 103365 - protein, 15 aa, Mycobacterium tuberculosis
CYSVAGEESYVLLVR

SEQ ID NO: 103366 - protein, 15 aa, Mycobacterium tuberculosis
YSVAGEESYVLLVRV

SEQ ID NO: 103367 - protein, 15 aa, Mycobacterium tuberculosis
SVAGEESYVLLVRVA

SEQ ID NO: 103368 - protein, 15 aa, Mycobacterium tuberculosis
VAGEESYVLLVRVAS

SEQ ID NO: 103369 - protein, 15 aa, Mycobacterium tuberculosis
AGEESYVLLVRVASA

SEQ ID NO: 103370 - protein, 15 aa, Mycobacterium tuberculosis
GEESYVLLVRVASAR

SEQ ID NO: 103371 - protein, 15 aa, Mycobacterium tuberculosis
EESYVLLVRVASARA

SEQ ID NO: 103372 - protein, 15 aa, Mycobacterium tuberculosis
ESYVLLVRVASARAL

SEQ ID NO: 103373 - protein, 15 aa, Mycobacterium tuberculosis
SYVLLVRVASARALE

SEQ ID NO: 103374 - protein, 15 aa, Mycobacterium tuberculosis
YVLLVRVASARALED

SEQ ID NO: 103375 - protein, 15 aa, Mycobacterium tuberculosis
VLLVRVASARALEDL

SEQ ID NO: 103376 - protein, 15 aa, Mycobacterium tuberculosis
LLVRVASARALEDLL

SEQ ID NO: 103377 - protein, 15 aa, Mycobacterium tuberculosis
LVRVASARALEDLLQ

SEQ ID NO: 103378 - protein, 15 aa, Mycobacterium tuberculosis
VRVASARALEDLLQR

SEQ ID NO: 103379 - protein, 15 aa, Mycobacterium tuberculosis
RVASARALEDLLQRI

SEQ ID NO: 103380 - protein, 15 aa, Mycobacterium tuberculosis
VASARALEDLLQRIR

SEQ ID NO: 103381 - protein, 15 aa, Mycobacterium tuberculosis
ASARALEDLLQRIRT

SEQ ID NO: 103382 - protein, 15 aa, Mycobacterium tuberculosis
SARALEDLLQRIRTT

SEQ ID NO: 103383 - protein, 15 aa, Mycobacterium tuberculosis
ARALEDLLQRIRTTA

SEQ ID NO: 103384 - protein, 15 aa, Mycobacterium tuberculosis
RALEDLLQRIRTTAN

SEQ ID NO: 103385 - protein, 15 aa, Mycobacterium tuberculosis
ALEDLLQRIRTTANV

SEQ ID NO: 103386 - protein, 15 aa, Mycobacterium tuberculosis
LEDLLQRIRTTANVR

SEQ ID NO: 103387 - protein, 15 aa, Mycobacterium tuberculosis
EDLLQRIRTTANVRT

SEQ ID NO: 103388 - protein, 15 aa, Mycobacterium tuberculosis
DLLQRIRTTANVRTR

SEQ ID NO: 103389 - protein, 15 aa, Mycobacterium tuberculosis
LLQRIRTTANVRTRS

SEQ ID NO: 103390 - protein, 15 aa, Mycobacterium tuberculosis
LQRIRTTANVRTRST

SEQ ID NO: 103391 - protein, 15 aa, Mycobacterium tuberculosis
QRIRTTANVRTRSTI

SEQ ID NO: 103392 - protein, 15 aa, Mycobacterium tuberculosis
RIRTTANVRTRSTII

SEQ ID NO: 103393 - protein, 15 aa, Mycobacterium tuberculosis
IRTTANVRTRSTIIL

SEQ ID NO: 103394 - protein, 15 aa, Mycobacterium tuberculosis
RTTANVRTRSTIILN

SEQ ID NO: 103395 - protein, 15 aa, Mycobacterium tuberculosis
TTANVRTRSTIILNT

SEQ ID NO: 103396 - protein, 15 aa, Mycobacterium tuberculosis
TANVRTRSTIILNTF

SEQ ID NO: 103397 - protein, 15 aa, Mycobacterium tuberculosis
ANVRTRSTIILNTFY

SEQ ID NO: 103398 - protein, 15 aa, Mycobacterium tuberculosis
NVRTRSTIILNTFYS

SEQ ID NO: 103399 - protein, 15 aa, Mycobacterium tuberculosis
VRTRSTIILNTFYSD

SEQ ID NO: 103400 - protein, 15 aa, Mycobacterium tuberculosis
RTRSTIILNTFYSDR

SEQ ID NO: 103401 - protein, 15 aa, Mycobacterium tuberculosis
TRSTIILNTFYSDRQ

SEQ ID NO: 103402 - protein, 15 aa, Mycobacterium tuberculosis
RSTIILNTFYSDRQH

SEQ ID NO: 103403 - protein, 15 aa, Mycobacterium tuberculosis
STIILNTFYSDRQHI

SEQ ID NO: 103404 - protein, 15 aa, Mycobacterium tuberculosis
TIILNTFYSDRQHIP

SEQ ID NO: 103405 - protein, 16 aa, Mycobacterium tuberculosis
MNEALDDIDRILVREL

SEQ ID NO: 103406 - protein, 16 aa, Mycobacterium tuberculosis
NEALDDIDRILVRELA

SEQ ID NO: 103407 - protein, 16 aa, Mycobacterium tuberculosis
EALDDIDRILVRELAA

SEQ ID NO: 103408 - protein, 16 aa, Mycobacterium tuberculosis
ALDDIDRILVRELAAD

SEQ ID NO: 103409 - protein, 16 aa, Mycobacterium tuberculosis
LDDIDRILVRELAADG

SEQ ID NO: 103410 - protein, 16 aa, Mycobacterium tuberculosis
DDIDRILVRELAADGR

SEQ ID NO: 103411 - protein, 16 aa, Mycobacterium tuberculosis
DIDRILVRELAADGRA

SEQ ID NO: 103412 - protein, 16 aa, Mycobacterium tuberculosis
IDRILVRELAADGRAT

SEQ ID NO: 103413 - protein, 16 aa, Mycobacterium tuberculosis
DRILVRELAADGRATL

SEQ ID NO: 103414 - protein, 16 aa, Mycobacterium tuberculosis
RILVRELAADGRATLS

SEQ ID NO: 103415 - protein, 16 aa, Mycobacterium tuberculosis
ILVRELAADGRATLSE

SEQ ID NO: 103416 - protein, 16 aa, Mycobacterium tuberculosis
LVRELAADGRATLSEL

SEQ ID NO: 103417 - protein, 16 aa, Mycobacterium tuberculosis
VRELAADGRATLSELA

SEQ ID NO: 103418 - protein, 16 aa, Mycobacterium tuberculosis
RELAADGRATLSELAT

SEQ ID NO: 103419 - protein, 16 aa, Mycobacterium tuberculosis
ELAADGRATLSELATR

SEQ ID NO: 103420 - protein, 16 aa, Mycobacterium tuberculosis
LAADGRATLSELATRA

SEQ ID NO: 103421 - protein, 16 aa, Mycobacterium tuberculosis
AADGRATLSELATRAG

SEQ ID NO: 103422 - protein, 16 aa, Mycobacterium tuberculosis
ADGRATLSELATRAGL

SEQ ID NO: 103423 - protein, 16 aa, Mycobacterium tuberculosis
DGRATLSELATRAGLS

SEQ ID NO: 103424 - protein, 16 aa, Mycobacterium tuberculosis
GRATLSELATRAGLSV

SEQ ID NO: 103425 - protein, 16 aa, Mycobacterium tuberculosis
RATLSELATRAGLSVS

SEQ ID NO: 103426 - protein, 16 aa, Mycobacterium tuberculosis
ATLSELATRAGLSVSA

SEQ ID NO: 103427 - protein, 16 aa, Mycobacterium tuberculosis
TLSELATRAGLSVSAV

SEQ ID NO: 103428 - protein, 16 aa, Mycobacterium tuberculosis
LSELATRAGLSVSAVQ

SEQ ID NO: 103429 - protein, 16 aa, Mycobacterium tuberculosis
SELATRAGLSVSAVQS

SEQ ID NO: 103430 - protein, 16 aa, Mycobacterium tuberculosis
ELATRAGLSVSAVQSR

SEQ ID NO: 103431 - protein, 16 aa, Mycobacterium tuberculosis
LATRAGLSVSAVQSRV

SEQ ID NO: 103432 - protein, 16 aa, Mycobacterium tuberculosis
ATRAGLSVSAVQSRVR

SEQ ID NO: 103433 - protein, 16 aa, Mycobacterium tuberculosis
TRAGLSVSAVQSRVRR

SEQ ID NO: 103434 - protein, 16 aa, Mycobacterium tuberculosis
RAGLSVSAVQSRVRRL

SEQ ID NO: 103435 - protein, 16 aa, Mycobacterium tuberculosis
AGLSVSAVQSRVRRLE

SEQ ID NO: 103436 - protein, 16 aa, Mycobacterium tuberculosis
GLSVSAVQSRVRRLES

SEQ ID NO: 103437 - protein, 16 aa, Mycobacterium tuberculosis
LSVSAVQSRVRRLESR

SEQ ID NO: 103438 - protein, 16 aa, Mycobacterium tuberculosis
SVSAVQSRVRRLESRG

SEQ ID NO: 103439 - protein, 16 aa, Mycobacterium tuberculosis
VSAVQSRVRRLESRGV

SEQ ID NO: 103440 - protein, 16 aa, Mycobacterium tuberculosis
SAVQSRVRRLESRGVV

SEQ ID NO: 103441 - protein, 16 aa, Mycobacterium tuberculosis
AVQSRVRRLESRGVVQ

SEQ ID NO: 103442 - protein, 16 aa, Mycobacterium tuberculosis
VQSRVRRLESRGVVQG

SEQ ID NO: 103443 - protein, 16 aa, Mycobacterium tuberculosis
QSRVRRLESRGVVQGY

SEQ ID NO: 103444 - protein, 16 aa, Mycobacterium tuberculosis
SRVRRLESRGVVQGYS

SEQ ID NO: 103445 - protein, 16 aa, Mycobacterium tuberculosis
RVRRLESRGVVQGYSA

SEQ ID NO: 103446 - protein, 16 aa, Mycobacterium tuberculosis
VRRLESRGVVQGYSAR

SEQ ID NO: 103447 - protein, 16 aa, Mycobacterium tuberculosis
RRLESRGVVQGYSARI

SEQ ID NO: 103448 - protein, 16 aa, Mycobacterium tuberculosis
RLESRGVVQGYSARIN

SEQ ID NO: 103449 - protein, 16 aa, Mycobacterium tuberculosis
LESRGVVQGYSARINP

SEQ ID NO: 103450 - protein, 16 aa, Mycobacterium tuberculosis
ESRGVVQGYSARINPE

SEQ ID NO: 103451 - protein, 16 aa, Mycobacterium tuberculosis
SRGVVQGYSARINPEA

SEQ ID NO: 103452 - protein, 16 aa, Mycobacterium tuberculosis
RGVVQGYSARINPEAV

SEQ ID NO: 103453 - protein, 16 aa, Mycobacterium tuberculosis
GVVQGYSARINPEAVG

SEQ ID NO: 103454 - protein, 16 aa, Mycobacterium tuberculosis
VVQGYSARINPEAVGH

SEQ ID NO: 103455 - protein, 16 aa, Mycobacterium tuberculosis
VQGYSARINPEAVGHL

SEQ ID NO: 103456 - protein, 16 aa, Mycobacterium tuberculosis
QGYSARINPEAVGHLL

SEQ ID NO: 103457 - protein, 16 aa, Mycobacterium tuberculosis
GYSARINPEAVGHLLS

SEQ ID NO: 103458 - protein, 16 aa, Mycobacterium tuberculosis
YSARINPEAVGHLLSA

SEQ ID NO: 103459 - protein, 16 aa, Mycobacterium tuberculosis
SARINPEAVGHLLSAF

SEQ ID NO: 103460 - protein, 16 aa, Mycobacterium tuberculosis
ARINPEAVGHLLSAFV

SEQ ID NO: 103461 - protein, 16 aa, Mycobacterium tuberculosis
RINPEAVGHLLSAFVA

SEQ ID NO: 103462 - protein, 16 aa, Mycobacterium tuberculosis
INPEAVGHLLSAFVAI

SEQ ID NO: 103463 - protein, 16 aa, Mycobacterium tuberculosis
NPEAVGHLLSAFVAIT

SEQ ID NO: 103464 - protein, 16 aa, Mycobacterium tuberculosis
PEAVGHLLSAFVAITP

SEQ ID NO: 103465 - protein, 16 aa, Mycobacterium tuberculosis
EAVGHLLSAFVAITPL

SEQ ID NO: 103466 - protein, 16 aa, Mycobacterium tuberculosis
AVGHLLSAFVAITPLD

SEQ ID NO: 103467 - protein, 16 aa, Mycobacterium tuberculosis
VGHLLSAFVAITPLDP

SEQ ID NO: 103468 - protein, 16 aa, Mycobacterium tuberculosis
GHLLSAFVAITPLDPS

SEQ ID NO: 103469 - protein, 16 aa, Mycobacterium tuberculosis
HLLSAFVAITPLDPSQ

SEQ ID NO: 103470 - protein, 16 aa, Mycobacterium tuberculosis
LLSAFVAITPLDPSQP

SEQ ID NO: 103471 - protein, 16 aa, Mycobacterium tuberculosis
LSAFVAITPLDPSQPD

SEQ ID NO: 103472 - protein, 16 aa, Mycobacterium tuberculosis
SAFVAITPLDPSQPDD

SEQ ID NO: 103473 - protein, 16 aa, Mycobacterium tuberculosis
AFVAITPLDPSQPDDA

SEQ ID NO: 103474 - protein, 16 aa, Mycobacterium tuberculosis
FVAITPLDPSQPDDAP

SEQ ID NO: 103475 - protein, 16 aa, Mycobacterium tuberculosis
VAITPLDPSQPDDAPA

SEQ ID NO: 103476 - protein, 16 aa, Mycobacterium tuberculosis
AITPLDPSQPDDAPAR

SEQ ID NO: 103477 - protein, 16 aa, Mycobacterium tuberculosis
ITPLDPSQPDDAPARL

SEQ ID NO: 103478 - protein, 16 aa, Mycobacterium tuberculosis
TPLDPSQPDDAPARLE

SEQ ID NO: 103479 - protein, 16 aa, Mycobacterium tuberculosis
PLDPSQPDDAPARLEH

SEQ ID NO: 103480 - protein, 16 aa, Mycobacterium tuberculosis
LDPSQPDDAPARLEHI

SEQ ID NO: 103481 - protein, 16 aa, Mycobacterium tuberculosis
DPSQPDDAPARLEHIE

SEQ ID NO: 103482 - protein, 16 aa, Mycobacterium tuberculosis
PSQPDDAPARLEHIEE

SEQ ID NO: 103483 - protein, 16 aa, Mycobacterium tuberculosis
SQPDDAPARLEHIEEV

SEQ ID NO: 103484 - protein, 16 aa, Mycobacterium tuberculosis
QPDDAPARLEHIEEVE

SEQ ID NO: 103485 - protein, 16 aa, Mycobacterium tuberculosis
PDDAPARLEHIEEVES

SEQ ID NO: 103486 - protein, 16 aa, Mycobacterium tuberculosis
DDAPARLEHIEEVESC

SEQ ID NO: 103487 - protein, 16 aa, Mycobacterium tuberculosis
DAPARLEHIEEVESCY

SEQ ID NO: 103488 - protein, 16 aa, Mycobacterium tuberculosis
APARLEHIEEVESCYS

SEQ ID NO: 103489 - protein, 16 aa, Mycobacterium tuberculosis
PARLEHIEEVESCYSV

SEQ ID NO: 103490 - protein, 16 aa, Mycobacterium tuberculosis
ARLEHIEEVESCYSVA

SEQ ID NO: 103491 - protein, 16 aa, Mycobacterium tuberculosis
RLEHIEEVESCYSVAG

SEQ ID NO: 103492 - protein, 16 aa, Mycobacterium tuberculosis
LEHIEEVESCYSVAGE

SEQ ID NO: 103493 - protein, 16 aa, Mycobacterium tuberculosis
EHIEEVESCYSVAGEE

SEQ ID NO: 103494 - protein, 16 aa, Mycobacterium tuberculosis
HIEEVESCYSVAGEES

SEQ ID NO: 103495 - protein, 16 aa, Mycobacterium tuberculosis
IEEVESCYSVAGEESY

SEQ ID NO: 103496 - protein, 16 aa, Mycobacterium tuberculosis
EEVESCYSVAGEESYV

SEQ ID NO: 103497 - protein, 16 aa, Mycobacterium tuberculosis
EVESCYSVAGEESYVL

SEQ ID NO: 103498 - protein, 16 aa, Mycobacterium tuberculosis
VESCYSVAGEESYVLL

SEQ ID NO: 103499 - protein, 16 aa, Mycobacterium tuberculosis
ESCYSVAGEESYVLLV

SEQ ID NO: 103500 - protein, 16 aa, Mycobacterium tuberculosis
SCYSVAGEESYVLLVR

SEQ ID NO: 103501 - protein, 16 aa, Mycobacterium tuberculosis
CYSVAGEESYVLLVRV

SEQ ID NO: 103502 - protein, 16 aa, Mycobacterium tuberculosis
YSVAGEESYVLLVRVA

SEQ ID NO: 103503 - protein, 16 aa, Mycobacterium tuberculosis
SVAGEESYVLLVRVAS

SEQ ID NO: 103504 - protein, 16 aa, Mycobacterium tuberculosis
VAGEESYVLLVRVASA

SEQ ID NO: 103505 - protein, 16 aa, Mycobacterium tuberculosis
AGEESYVLLVRVASAR

SEQ ID NO: 103506 - protein, 16 aa, Mycobacterium tuberculosis
GEESYVLLVRVASARA

SEQ ID NO: 103507 - protein, 16 aa, Mycobacterium tuberculosis
EESYVLLVRVASARAL

SEQ ID NO: 103508 - protein, 16 aa, Mycobacterium tuberculosis
ESYVLLVRVASARALE

SEQ ID NO: 103509 - protein, 16 aa, Mycobacterium tuberculosis
SYVLLVRVASARALED

SEQ ID NO: 103510 - protein, 16 aa, Mycobacterium tuberculosis
YVLLVRVASARALEDL

SEQ ID NO: 103511 - protein, 16 aa, Mycobacterium tuberculosis
VLLVRVASARALEDLL

SEQ ID NO: 103512 - protein, 16 aa, Mycobacterium tuberculosis
LLVRVASARALEDLLQ

SEQ ID NO: 103513 - protein, 16 aa, Mycobacterium tuberculosis
LVRVASARALEDLLQR

SEQ ID NO: 103514 - protein, 16 aa, Mycobacterium tuberculosis
VRVASARALEDLLQRI

SEQ ID NO: 103515 - protein, 16 aa, Mycobacterium tuberculosis
RVASARALEDLLQRIR

SEQ ID NO: 103516 - protein, 16 aa, Mycobacterium tuberculosis
VASARALEDLLQRIRT

SEQ ID NO: 103517 - protein, 16 aa, Mycobacterium tuberculosis
ASARALEDLLQRIRTT

SEQ ID NO: 103518 - protein, 16 aa, Mycobacterium tuberculosis
SARALEDLLQRIRTTA

SEQ ID NO: 103519 - protein, 16 aa, Mycobacterium tuberculosis
ARALEDLLQRIRTTAN

SEQ ID NO: 103520 - protein, 16 aa, Mycobacterium tuberculosis
RALEDLLQRIRTTANV

SEQ ID NO: 103521 - protein, 16 aa, Mycobacterium tuberculosis
ALEDLLQRIRTTANVR

SEQ ID NO: 103522 - protein, 16 aa, Mycobacterium tuberculosis
LEDLLQRIRTTANVRT

SEQ ID NO: 103523 - protein, 16 aa, Mycobacterium tuberculosis
EDLLQRIRTTANVRTR

SEQ ID NO: 103524 - protein, 16 aa, Mycobacterium tuberculosis
DLLQRIRTTANVRTRS

SEQ ID NO: 103525 - protein, 16 aa, Mycobacterium tuberculosis
LLQRIRTTANVRTRST

SEQ ID NO: 103526 - protein, 16 aa, Mycobacterium tuberculosis
LQRIRTTANVRTRSTI

SEQ ID NO: 103527 - protein, 16 aa, Mycobacterium tuberculosis
QRIRTTANVRTRSTII

SEQ ID NO: 103528 - protein, 16 aa, Mycobacterium tuberculosis
RIRTTANVRTRSTIIL

SEQ ID NO: 103529 - protein, 16 aa, Mycobacterium tuberculosis
IRTTANVRTRSTIILN

SEQ ID NO: 103530 - protein, 16 aa, Mycobacterium tuberculosis
RTTANVRTRSTIILNT

SEQ ID NO: 103531 - protein, 16 aa, Mycobacterium tuberculosis
TTANVRTRSTIILNTF

SEQ ID NO: 103532 - protein, 16 aa, Mycobacterium tuberculosis
TANVRTRSTIILNTFY

SEQ ID NO: 103533 - protein, 16 aa, Mycobacterium tuberculosis
ANVRTRSTIILNTFYS

SEQ ID NO: 103534 - protein, 16 aa, Mycobacterium tuberculosis
NVRTRSTIILNTFYSD

SEQ ID NO: 103535 - protein, 16 aa, Mycobacterium tuberculosis
VRTRSTIILNTFYSDR

SEQ ID NO: 103536 - protein, 16 aa, Mycobacterium tuberculosis
RTRSTIILNTFYSDRQ

SEQ ID NO: 103537 - protein, 16 aa, Mycobacterium tuberculosis
TRSTIILNTFYSDRQH

SEQ ID NO: 103538 - protein, 16 aa, Mycobacterium tuberculosis
RSTIILNTFYSDRQHI

SEQ ID NO: 103539 - protein, 16 aa, Mycobacterium tuberculosis
STIILNTFYSDRQHIP

SEQ ID NO: 103540 - protein, 13 aa, Mycobacterium tuberculosis
MNADPVLSYNFDA

SEQ ID NO: 103541 - protein, 13 aa, Mycobacterium tuberculosis
NADPVLSYNFDAI

SEQ ID NO: 103542 - protein, 13 aa, Mycobacterium tuberculosis
ADPVLSYNFDAIE

SEQ ID NO: 103543 - protein, 13 aa, Mycobacterium tuberculosis
DPVLSYNFDAIEY

SEQ ID NO: 103544 - protein, 13 aa, Mycobacterium tuberculosis
PVLSYNFDAIEYS

SEQ ID NO: 103545 - protein, 13 aa, Mycobacterium tuberculosis
VLSYNFDAIEYSV

SEQ ID NO: 103546 - protein, 13 aa, Mycobacterium tuberculosis
LSYNFDAIEYSVR

SEQ ID NO: 103547 - protein, 13 aa, Mycobacterium tuberculosis
SYNFDAIEYSVRQ

SEQ ID NO: 103548 - protein, 13 aa, Mycobacterium tuberculosis
YNFDAIEYSVRQE

SEQ ID NO: 103549 - protein, 13 aa, Mycobacterium tuberculosis
NFDAIEYSVRQEI

SEQ ID NO: 103550 - protein, 13 aa, Mycobacterium tuberculosis
FDAIEYSVRQEIH

SEQ ID NO: 103551 - protein, 13 aa, Mycobacterium tuberculosis
DAIEYSVRQEIHT

SEQ ID NO: 103552 - protein, 13 aa, Mycobacterium tuberculosis
AIEYSVRQEIHTT

SEQ ID NO: 103553 - protein, 13 aa, Mycobacterium tuberculosis
IEYSVRQEIHTTA

SEQ ID NO: 103554 - protein, 13 aa, Mycobacterium tuberculosis
EYSVRQEIHTTAA

SEQ ID NO: 103555 - protein, 13 aa, Mycobacterium tuberculosis
YSVRQEIHTTAAR

SEQ ID NO: 103556 - protein, 13 aa, Mycobacterium tuberculosis
SVRQEIHTTAARF

SEQ ID NO: 103557 - protein, 13 aa, Mycobacterium tuberculosis
VRQEIHTTAARFN

SEQ ID NO: 103558 - protein, 13 aa, Mycobacterium tuberculosis
RQEIHTTAARFNA

SEQ ID NO: 103559 - protein, 13 aa, Mycobacterium tuberculosis
QEIHTTAARFNAA

SEQ ID NO: 103560 - protein, 13 aa, Mycobacterium tuberculosis
EIHTTAARFNAAL

SEQ ID NO: 103561 - protein, 13 aa, Mycobacterium tuberculosis
IHTTAARFNAALQ

SEQ ID NO: 103562 - protein, 13 aa, Mycobacterium tuberculosis
HTTAARFNAALQE

SEQ ID NO: 103563 - protein, 13 aa, Mycobacterium tuberculosis
TTAARFNAALQEL

SEQ ID NO: 103564 - protein, 13 aa, Mycobacterium tuberculosis
TAARFNAALQELR

SEQ ID NO: 103565 - protein, 13 aa, Mycobacterium tuberculosis
AARFNAALQELRS

SEQ ID NO: 103566 - protein, 13 aa, Mycobacterium tuberculosis
ARFNAALQELRSQ

SEQ ID NO: 103567 - protein, 13 aa, Mycobacterium tuberculosis
RFNAALQELRSQI

SEQ ID NO: 103568 - protein, 13 aa, Mycobacterium tuberculosis
FNAALQELRSQIA

SEQ ID NO: 103569 - protein, 13 aa, Mycobacterium tuberculosis
NAALQELRSQIAP

SEQ ID NO: 103570 - protein, 13 aa, Mycobacterium tuberculosis
AALQELRSQIAPL

SEQ ID NO: 103571 - protein, 13 aa, Mycobacterium tuberculosis
ALQELRSQIAPLQ

SEQ ID NO: 103572 - protein, 13 aa, Mycobacterium tuberculosis
LQELRSQIAPLQQ

SEQ ID NO: 103573 - protein, 13 aa, Mycobacterium tuberculosis
QELRSQIAPLQQL

SEQ ID NO: 103574 - protein, 13 aa, Mycobacterium tuberculosis
ELRSQIAPLQQLW

SEQ ID NO: 103575 - protein, 13 aa, Mycobacterium tuberculosis
LRSQIAPLQQLWT

SEQ ID NO: 103576 - protein, 13 aa, Mycobacterium tuberculosis
RSQIAPLQQLWTR

SEQ ID NO: 103577 - protein, 13 aa, Mycobacterium tuberculosis
SQIAPLQQLWTRE

SEQ ID NO: 103578 - protein, 13 aa, Mycobacterium tuberculosis
QIAPLQQLWTREA

SEQ ID NO: 103579 - protein, 13 aa, Mycobacterium tuberculosis
IAPLQQLWTREAA

SEQ ID NO: 103580 - protein, 13 aa, Mycobacterium tuberculosis
APLQQLWTREAAA

SEQ ID NO: 103581 - protein, 13 aa, Mycobacterium tuberculosis
PLQQLWTREAAAA

SEQ ID NO: 103582 - protein, 13 aa, Mycobacterium tuberculosis
LQQLWTREAAAAY

SEQ ID NO: 103583 - protein, 13 aa, Mycobacterium tuberculosis
QQLWTREAAAAYH

SEQ ID NO: 103584 - protein, 13 aa, Mycobacterium tuberculosis
QLWTREAAAAYHA

SEQ ID NO: 103585 - protein, 13 aa, Mycobacterium tuberculosis
LWTREAAAAYHAE

SEQ ID NO: 103586 - protein, 13 aa, Mycobacterium tuberculosis
WTREAAAAYHAEQ

SEQ ID NO: 103587 - protein, 13 aa, Mycobacterium tuberculosis
TREAAAAYHAEQL

SEQ ID NO: 103588 - protein, 13 aa, Mycobacterium tuberculosis
REAAAAYHAEQLK

SEQ ID NO: 103589 - protein, 13 aa, Mycobacterium tuberculosis
EAAAAYHAEQLKW

SEQ ID NO: 103590 - protein, 13 aa, Mycobacterium tuberculosis
AAAAYHAEQLKWH

SEQ ID NO: 103591 - protein, 13 aa, Mycobacterium tuberculosis
AAAYHAEQLKWHQ

SEQ ID NO: 103592 - protein, 13 aa, Mycobacterium tuberculosis
AAYHAEQLKWHQA

SEQ ID NO: 103593 - protein, 13 aa, Mycobacterium tuberculosis
AYHAEQLKWHQAA

SEQ ID NO: 103594 - protein, 13 aa, Mycobacterium tuberculosis
YHAEQLKWHQAAS

SEQ ID NO: 103595 - protein, 13 aa, Mycobacterium tuberculosis
HAEQLKWHQAASA

SEQ ID NO: 103596 - protein, 13 aa, Mycobacterium tuberculosis
AEQLKWHQAASAL

SEQ ID NO: 103597 - protein, 13 aa, Mycobacterium tuberculosis
EQLKWHQAASALN

SEQ ID NO: 103598 - protein, 13 aa, Mycobacterium tuberculosis
QLKWHQAASALNE

SEQ ID NO: 103599 - protein, 13 aa, Mycobacterium tuberculosis
LKWHQAASALNEI

SEQ ID NO: 103600 - protein, 13 aa, Mycobacterium tuberculosis
KWHQAASALNEIL

SEQ ID NO: 103601 - protein, 13 aa, Mycobacterium tuberculosis
WHQAASALNEILI

SEQ ID NO: 103602 - protein, 13 aa, Mycobacterium tuberculosis
HQAASALNEILID

SEQ ID NO: 103603 - protein, 13 aa, Mycobacterium tuberculosis
QAASALNEILIDL

SEQ ID NO: 103604 - protein, 13 aa, Mycobacterium tuberculosis
AASALNEILIDLG

SEQ ID NO: 103605 - protein, 13 aa, Mycobacterium tuberculosis
ASALNEILIDLGN

SEQ ID NO: 103606 - protein, 13 aa, Mycobacterium tuberculosis
SALNEILIDLGNA

SEQ ID NO: 103607 - protein, 13 aa, Mycobacterium tuberculosis
ALNEILIDLGNAV

SEQ ID NO: 103608 - protein, 13 aa, Mycobacterium tuberculosis
LNEILIDLGNAVR

SEQ ID NO: 103609 - protein, 13 aa, Mycobacterium tuberculosis
NEILIDLGNAVRH

SEQ ID NO: 103610 - protein, 13 aa, Mycobacterium tuberculosis
EILIDLGNAVRHG

SEQ ID NO: 103611 - protein, 13 aa, Mycobacterium tuberculosis
ILIDLGNAVRHGA

SEQ ID NO: 103612 - protein, 13 aa, Mycobacterium tuberculosis
LIDLGNAVRHGAD

SEQ ID NO: 103613 - protein, 13 aa, Mycobacterium tuberculosis
IDLGNAVRHGADD

SEQ ID NO: 103614 - protein, 13 aa, Mycobacterium tuberculosis
DLGNAVRHGADDV

SEQ ID NO: 103615 - protein, 13 aa, Mycobacterium tuberculosis
LGNAVRHGADDVA

SEQ ID NO: 103616 - protein, 13 aa, Mycobacterium tuberculosis
GNAVRHGADDVAH

SEQ ID NO: 103617 - protein, 13 aa, Mycobacterium tuberculosis
NAVRHGADDVAHA

SEQ ID NO: 103618 - protein, 13 aa, Mycobacterium tuberculosis
AVRHGADDVAHAD

SEQ ID NO: 103619 - protein, 13 aa, Mycobacterium tuberculosis
VRHGADDVAHADR

SEQ ID NO: 103620 - protein, 13 aa, Mycobacterium tuberculosis
RHGADDVAHADRR

SEQ ID NO: 103621 - protein, 13 aa, Mycobacterium tuberculosis
HGADDVAHADRRA

SEQ ID NO: 103622 - protein, 13 aa, Mycobacterium tuberculosis
GADDVAHADRRAA

SEQ ID NO: 103623 - protein, 13 aa, Mycobacterium tuberculosis
ADDVAHADRRAAG

SEQ ID NO: 103624 - protein, 13 aa, Mycobacterium tuberculosis
DDVAHADRRAAGA

SEQ ID NO: 103625 - protein, 13 aa, Mycobacterium tuberculosis
DVAHADRRAAGAW

SEQ ID NO: 103626 - protein, 13 aa, Mycobacterium tuberculosis
VAHADRRAAGAWA

SEQ ID NO: 103627 - protein, 13 aa, Mycobacterium tuberculosis
AHADRRAAGAWAR

SEQ ID NO: 103628 - protein, 14 aa, Mycobacterium tuberculosis
MNADPVLSYNFDAI

SEQ ID NO: 103629 - protein, 14 aa, Mycobacterium tuberculosis
NADPVLSYNFDAIE

SEQ ID NO: 103630 - protein, 14 aa, Mycobacterium tuberculosis
ADPVLSYNFDAIEY

SEQ ID NO: 103631 - protein, 14 aa, Mycobacterium tuberculosis
DPVLSYNFDAIEYS

SEQ ID NO: 103632 - protein, 14 aa, Mycobacterium tuberculosis
PVLSYNFDAIEYSV

SEQ ID NO: 103633 - protein, 14 aa, Mycobacterium tuberculosis
VLSYNFDAIEYSVR

SEQ ID NO: 103634 - protein, 14 aa, Mycobacterium tuberculosis
LSYNFDAIEYSVRQ

SEQ ID NO: 103635 - protein, 14 aa, Mycobacterium tuberculosis
SYNFDAIEYSVRQE

SEQ ID NO: 103636 - protein, 14 aa, Mycobacterium tuberculosis
YNFDAIEYSVRQEI

SEQ ID NO: 103637 - protein, 14 aa, Mycobacterium tuberculosis
NFDAIEYSVRQEIH

SEQ ID NO: 103638 - protein, 14 aa, Mycobacterium tuberculosis
FDAIEYSVRQEIHT

SEQ ID NO: 103639 - protein, 14 aa, Mycobacterium tuberculosis
DAIEYSVRQEIHTT

SEQ ID NO: 103640 - protein, 14 aa, Mycobacterium tuberculosis
AIEYSVRQEIHTTA

SEQ ID NO: 103641 - protein, 14 aa, Mycobacterium tuberculosis
IEYSVRQEIHTTAA

SEQ ID NO: 103642 - protein, 14 aa, Mycobacterium tuberculosis
EYSVRQEIHTTAAR

SEQ ID NO: 103643 - protein, 14 aa, Mycobacterium tuberculosis
YSVRQEIHTTAARF

SEQ ID NO: 103644 - protein, 14 aa, Mycobacterium tuberculosis
SVRQEIHTTAARFN

SEQ ID NO: 103645 - protein, 14 aa, Mycobacterium tuberculosis
VRQEIHTTAARFNA

SEQ ID NO: 103646 - protein, 14 aa, Mycobacterium tuberculosis
RQEIHTTAARFNAA

SEQ ID NO: 103647 - protein, 14 aa, Mycobacterium tuberculosis
QEIHTTAARFNAAL

SEQ ID NO: 103648 - protein, 14 aa, Mycobacterium tuberculosis
EIHTTAARFNAALQ

SEQ ID NO: 103649 - protein, 14 aa, Mycobacterium tuberculosis
IHTTAARFNAALQE

SEQ ID NO: 103650 - protein, 14 aa, Mycobacterium tuberculosis
HTTAARFNAALQEL

SEQ ID NO: 103651 - protein, 14 aa, Mycobacterium tuberculosis
TTAARFNAALQELR

SEQ ID NO: 103652 - protein, 14 aa, Mycobacterium tuberculosis
TAARFNAALQELRS

SEQ ID NO: 103653 - protein, 14 aa, Mycobacterium tuberculosis
AARFNAALQELRSQ

SEQ ID NO: 103654 - protein, 14 aa, Mycobacterium tuberculosis
ARFNAALQELRSQI

SEQ ID NO: 103655 - protein, 14 aa, Mycobacterium tuberculosis
RFNAALQELRSQIA

SEQ ID NO: 103656 - protein, 14 aa, Mycobacterium tuberculosis
FNAALQELRSQIAP

SEQ ID NO: 103657 - protein, 14 aa, Mycobacterium tuberculosis
NAALQELRSQIAPL

SEQ ID NO: 103658 - protein, 14 aa, Mycobacterium tuberculosis
AALQELRSQIAPLQ

SEQ ID NO: 103659 - protein, 14 aa, Mycobacterium tuberculosis
ALQELRSQIAPLQQ

SEQ ID NO: 103660 - protein, 14 aa, Mycobacterium tuberculosis
LQELRSQIAPLQQL

SEQ ID NO: 103661 - protein, 14 aa, Mycobacterium tuberculosis
QELRSQIAPLQQLW

SEQ ID NO: 103662 - protein, 14 aa, Mycobacterium tuberculosis
ELRSQIAPLQQLWT

SEQ ID NO: 103663 - protein, 14 aa, Mycobacterium tuberculosis
LRSQIAPLQQLWTR

SEQ ID NO: 103664 - protein, 14 aa, Mycobacterium tuberculosis
RSQIAPLQQLWTRE

SEQ ID NO: 103665 - protein, 14 aa, Mycobacterium tuberculosis
SQIAPLQQLWTREA

SEQ ID NO: 103666 - protein, 14 aa, Mycobacterium tuberculosis
QIAPLQQLWTREAA

SEQ ID NO: 103667 - protein, 14 aa, Mycobacterium tuberculosis
IAPLQQLWTREAAA

SEQ ID NO: 103668 - protein, 14 aa, Mycobacterium tuberculosis
APLQQLWTREAAAA

SEQ ID NO: 103669 - protein, 14 aa, Mycobacterium tuberculosis
PLQQLWTREAAAAY

SEQ ID NO: 103670 - protein, 14 aa, Mycobacterium tuberculosis
LQQLWTREAAAAYH

SEQ ID NO: 103671 - protein, 14 aa, Mycobacterium tuberculosis
QQLWTREAAAAYHA

SEQ ID NO: 103672 - protein, 14 aa, Mycobacterium tuberculosis
QLWTREAAAAYHAE

SEQ ID NO: 103673 - protein, 14 aa, Mycobacterium tuberculosis
LWTREAAAAYHAEQ

SEQ ID NO: 103674 - protein, 14 aa, Mycobacterium tuberculosis
WTREAAAAYHAEQL

SEQ ID NO: 103675 - protein, 14 aa, Mycobacterium tuberculosis
TREAAAAYHAEQLK

SEQ ID NO: 103676 - protein, 14 aa, Mycobacterium tuberculosis
REAAAAYHAEQLKW

SEQ ID NO: 103677 - protein, 14 aa, Mycobacterium tuberculosis
EAAAAYHAEQLKWH

SEQ ID NO: 103678 - protein, 14 aa, Mycobacterium tuberculosis
AAAAYHAEQLKWHQ

SEQ ID NO: 103679 - protein, 14 aa, Mycobacterium tuberculosis
AAAYHAEQLKWHQA

SEQ ID NO: 103680 - protein, 14 aa, Mycobacterium tuberculosis
AAYHAEQLKWHQAA

SEQ ID NO: 103681 - protein, 14 aa, Mycobacterium tuberculosis
AYHAEQLKWHQAAS

SEQ ID NO: 103682 - protein, 14 aa, Mycobacterium tuberculosis
YHAEQLKWHQAASA

SEQ ID NO: 103683 - protein, 14 aa, Mycobacterium tuberculosis
HAEQLKWHQAASAL

SEQ ID NO: 103684 - protein, 14 aa, Mycobacterium tuberculosis
AEQLKWHQAASALN

SEQ ID NO: 103685 - protein, 14 aa, Mycobacterium tuberculosis
EQLKWHQAASALNE

SEQ ID NO: 103686 - protein, 14 aa, Mycobacterium tuberculosis
QLKWHQAASALNEI

SEQ ID NO: 103687 - protein, 14 aa, Mycobacterium tuberculosis
LKWHQAASALNEIL

SEQ ID NO: 103688 - protein, 14 aa, Mycobacterium tuberculosis
KWHQAASALNEILI

SEQ ID NO: 103689 - protein, 14 aa, Mycobacterium tuberculosis
WHQAASALNEILID

SEQ ID NO: 103690 - protein, 14 aa, Mycobacterium tuberculosis
HQAASALNEILIDL

SEQ ID NO: 103691 - protein, 14 aa, Mycobacterium tuberculosis
QAASALNEILIDLG

SEQ ID NO: 103692 - protein, 14 aa, Mycobacterium tuberculosis
AASALNEILIDLGN

SEQ ID NO: 103693 - protein, 14 aa, Mycobacterium tuberculosis
ASALNEILIDLGNA

SEQ ID NO: 103694 - protein, 14 aa, Mycobacterium tuberculosis
SALNEILIDLGNAV

SEQ ID NO: 103695 - protein, 14 aa, Mycobacterium tuberculosis
ALNEILIDLGNAVR

SEQ ID NO: 103696 - protein, 14 aa, Mycobacterium tuberculosis
LNEILIDLGNAVRH

SEQ ID NO: 103697 - protein, 14 aa, Mycobacterium tuberculosis
NEILIDLGNAVRHG

SEQ ID NO: 103698 - protein, 14 aa, Mycobacterium tuberculosis
EILIDLGNAVRHGA

SEQ ID NO: 103699 - protein, 14 aa, Mycobacterium tuberculosis
ILIDLGNAVRHGAD

SEQ ID NO: 103700 - protein, 14 aa, Mycobacterium tuberculosis
LIDLGNAVRHGADD

SEQ ID NO: 103701 - protein, 14 aa, Mycobacterium tuberculosis
IDLGNAVRHGADDV

SEQ ID NO: 103702 - protein, 14 aa, Mycobacterium tuberculosis
DLGNAVRHGADDVA

SEQ ID NO: 103703 - protein, 14 aa, Mycobacterium tuberculosis
LGNAVRHGADDVAH

SEQ ID NO: 103704 - protein, 14 aa, Mycobacterium tuberculosis
GNAVRHGADDVAHA

SEQ ID NO: 103705 - protein, 14 aa, Mycobacterium tuberculosis
NAVRHGADDVAHAD

SEQ ID NO: 103706 - protein, 14 aa, Mycobacterium tuberculosis
AVRHGADDVAHADR

SEQ ID NO: 103707 - protein, 14 aa, Mycobacterium tuberculosis
VRHGADDVAHADRR

SEQ ID NO: 103708 - protein, 14 aa, Mycobacterium tuberculosis
RHGADDVAHADRRA

SEQ ID NO: 103709 - protein, 14 aa, Mycobacterium tuberculosis
HGADDVAHADRRAA

SEQ ID NO: 103710 - protein, 14 aa, Mycobacterium tuberculosis
GADDVAHADRRAAG

SEQ ID NO: 103711 - protein, 14 aa, Mycobacterium tuberculosis
ADDVAHADRRAAGA

SEQ ID NO: 103712 - protein, 14 aa, Mycobacterium tuberculosis
DDVAHADRRAAGAW

SEQ ID NO: 103713 - protein, 14 aa, Mycobacterium tuberculosis
DVAHADRRAAGAWA

SEQ ID NO: 103714 - protein, 14 aa, Mycobacterium tuberculosis
VAHADRRAAGAWAR

SEQ ID NO: 103715 - protein, 15 aa, Mycobacterium tuberculosis
MNADPVLSYNFDAIE

SEQ ID NO: 103716 - protein, 15 aa, Mycobacterium tuberculosis
NADPVLSYNFDAIEY

SEQ ID NO: 103717 - protein, 15 aa, Mycobacterium tuberculosis
ADPVLSYNFDAIEYS

SEQ ID NO: 103718 - protein, 15 aa, Mycobacterium tuberculosis
DPVLSYNFDAIEYSV

SEQ ID NO: 103719 - protein, 15 aa, Mycobacterium tuberculosis
PVLSYNFDAIEYSVR

SEQ ID NO: 103720 - protein, 15 aa, Mycobacterium tuberculosis
VLSYNFDAIEYSVRQ

SEQ ID NO: 103721 - protein, 15 aa, Mycobacterium tuberculosis
LSYNFDAIEYSVRQE

SEQ ID NO: 103722 - protein, 15 aa, Mycobacterium tuberculosis
SYNFDAIEYSVRQEI

SEQ ID NO: 103723 - protein, 15 aa, Mycobacterium tuberculosis
YNFDAIEYSVRQEIH

SEQ ID NO: 103724 - protein, 15 aa, Mycobacterium tuberculosis
NFDAIEYSVRQEIHT

SEQ ID NO: 103725 - protein, 15 aa, Mycobacterium tuberculosis
FDAIEYSVRQEIHTT

SEQ ID NO: 103726 - protein, 15 aa, Mycobacterium tuberculosis
DAIEYSVRQEIHTTA

SEQ ID NO: 103727 - protein, 15 aa, Mycobacterium tuberculosis
AIEYSVRQEIHTTAA

SEQ ID NO: 103728 - protein, 15 aa, Mycobacterium tuberculosis
IEYSVRQEIHTTAAR

SEQ ID NO: 103729 - protein, 15 aa, Mycobacterium tuberculosis
EYSVRQEIHTTAARF

SEQ ID NO: 103730 - protein, 15 aa, Mycobacterium tuberculosis
YSVRQEIHTTAARFN

SEQ ID NO: 103731 - protein, 15 aa, Mycobacterium tuberculosis
SVRQEIHTTAARFNA

SEQ ID NO: 103732 - protein, 15 aa, Mycobacterium tuberculosis
VRQEIHTTAARFNAA

SEQ ID NO: 103733 - protein, 15 aa, Mycobacterium tuberculosis
RQEIHTTAARFNAAL

SEQ ID NO: 103734 - protein, 15 aa, Mycobacterium tuberculosis
QEIHTTAARFNAALQ

SEQ ID NO: 103735 - protein, 15 aa, Mycobacterium tuberculosis
EIHTTAARFNAALQE

SEQ ID NO: 103736 - protein, 15 aa, Mycobacterium tuberculosis
IHTTAARFNAALQEL

SEQ ID NO: 103737 - protein, 15 aa, Mycobacterium tuberculosis
HTTAARFNAALQELR

SEQ ID NO: 103738 - protein, 15 aa, Mycobacterium tuberculosis
TTAARFNAALQELRS

SEQ ID NO: 103739 - protein, 15 aa, Mycobacterium tuberculosis
TAARFNAALQELRSQ

SEQ ID NO: 103740 - protein, 15 aa, Mycobacterium tuberculosis
AARFNAALQELRSQI

SEQ ID NO: 103741 - protein, 15 aa, Mycobacterium tuberculosis
ARFNAALQELRSQIA

SEQ ID NO: 103742 - protein, 15 aa, Mycobacterium tuberculosis
RFNAALQELRSQIAP

SEQ ID NO: 103743 - protein, 15 aa, Mycobacterium tuberculosis
FNAALQELRSQIAPL

SEQ ID NO: 103744 - protein, 15 aa, Mycobacterium tuberculosis
NAALQELRSQIAPLQ

SEQ ID NO: 103745 - protein, 15 aa, Mycobacterium tuberculosis
AALQELRSQIAPLQQ

SEQ ID NO: 103746 - protein, 15 aa, Mycobacterium tuberculosis
ALQELRSQIAPLQQL

SEQ ID NO: 103747 - protein, 15 aa, Mycobacterium tuberculosis
LQELRSQIAPLQQLW

SEQ ID NO: 103748 - protein, 15 aa, Mycobacterium tuberculosis
QELRSQIAPLQQLWT

SEQ ID NO: 103749 - protein, 15 aa, Mycobacterium tuberculosis
ELRSQIAPLQQLWTR

SEQ ID NO: 103750 - protein, 15 aa, Mycobacterium tuberculosis
LRSQIAPLQQLWTRE

SEQ ID NO: 103751 - protein, 15 aa, Mycobacterium tuberculosis
RSQIAPLQQLWTREA

SEQ ID NO: 103752 - protein, 15 aa, Mycobacterium tuberculosis
SQIAPLQQLWTREAA

SEQ ID NO: 103753 - protein, 15 aa, Mycobacterium tuberculosis
QIAPLQQLWTREAAA

SEQ ID NO: 103754 - protein, 15 aa, Mycobacterium tuberculosis
IAPLQQLWTREAAAA

SEQ ID NO: 103755 - protein, 15 aa, Mycobacterium tuberculosis
APLQQLWTREAAAAY

SEQ ID NO: 103756 - protein, 15 aa, Mycobacterium tuberculosis
PLQQLWTREAAAAYH

SEQ ID NO: 103757 - protein, 15 aa, Mycobacterium tuberculosis
LQQLWTREAAAAYHA

SEQ ID NO: 103758 - protein, 15 aa, Mycobacterium tuberculosis
QQLWTREAAAAYHAE

SEQ ID NO: 103759 - protein, 15 aa, Mycobacterium tuberculosis
QLWTREAAAAYHAEQ

SEQ ID NO: 103760 - protein, 15 aa, Mycobacterium tuberculosis
LWTREAAAAYHAEQL

SEQ ID NO: 103761 - protein, 15 aa, Mycobacterium tuberculosis
WTREAAAAYHAEQLK

SEQ ID NO: 103762 - protein, 15 aa, Mycobacterium tuberculosis
TREAAAAYHAEQLKW

SEQ ID NO: 103763 - protein, 15 aa, Mycobacterium tuberculosis
REAAAAYHAEQLKWH

SEQ ID NO: 103764 - protein, 15 aa, Mycobacterium tuberculosis
EAAAAYHAEQLKWHQ

SEQ ID NO: 103765 - protein, 15 aa, Mycobacterium tuberculosis
AAAAYHAEQLKWHQA

SEQ ID NO: 103766 - protein, 15 aa, Mycobacterium tuberculosis
AAAYHAEQLKWHQAA

SEQ ID NO: 103767 - protein, 15 aa, Mycobacterium tuberculosis
AAYHAEQLKWHQAAS

SEQ ID NO: 103768 - protein, 15 aa, Mycobacterium tuberculosis
AYHAEQLKWHQAASA

SEQ ID NO: 103769 - protein, 15 aa, Mycobacterium tuberculosis
YHAEQLKWHQAASAL

SEQ ID NO: 103770 - protein, 15 aa, Mycobacterium tuberculosis
HAEQLKWHQAASALN

SEQ ID NO: 103771 - protein, 15 aa, Mycobacterium tuberculosis
AEQLKWHQAASALNE

SEQ ID NO: 103772 - protein, 15 aa, Mycobacterium tuberculosis
EQLKWHQAASALNEI

SEQ ID NO: 103773 - protein, 15 aa, Mycobacterium tuberculosis
QLKWHQAASALNEIL

SEQ ID NO: 103774 - protein, 15 aa, Mycobacterium tuberculosis
LKWHQAASALNEILI

SEQ ID NO: 103775 - protein, 15 aa, Mycobacterium tuberculosis
KWHQAASALNEILID

SEQ ID NO: 103776 - protein, 15 aa, Mycobacterium tuberculosis
WHQAASALNEILIDL

SEQ ID NO: 103777 - protein, 15 aa, Mycobacterium tuberculosis
HQAASALNEILIDLG

SEQ ID NO: 103778 - protein, 15 aa, Mycobacterium tuberculosis
QAASALNEILIDLGN

SEQ ID NO: 103779 - protein, 15 aa, Mycobacterium tuberculosis
AASALNEILIDLGNA

SEQ ID NO: 103780 - protein, 15 aa, Mycobacterium tuberculosis
ASALNEILIDLGNAV

SEQ ID NO: 103781 - protein, 15 aa, Mycobacterium tuberculosis
SALNEILIDLGNAVR

SEQ ID NO: 103782 - protein, 15 aa, Mycobacterium tuberculosis
ALNEILIDLGNAVRH

SEQ ID NO: 103783 - protein, 15 aa, Mycobacterium tuberculosis
LNEILIDLGNAVRHG

SEQ ID NO: 103784 - protein, 15 aa, Mycobacterium tuberculosis
NEILIDLGNAVRHGA

SEQ ID NO: 103785 - protein, 15 aa, Mycobacterium tuberculosis
EILIDLGNAVRHGAD

SEQ ID NO: 103786 - protein, 15 aa, Mycobacterium tuberculosis
ILIDLGNAVRHGADD

SEQ ID NO: 103787 - protein, 15 aa, Mycobacterium tuberculosis
LIDLGNAVRHGADDV

SEQ ID NO: 103788 - protein, 15 aa, Mycobacterium tuberculosis
IDLGNAVRHGADDVA

SEQ ID NO: 103789 - protein, 15 aa, Mycobacterium tuberculosis
DLGNAVRHGADDVAH

SEQ ID NO: 103790 - protein, 15 aa, Mycobacterium tuberculosis
LGNAVRHGADDVAHA

SEQ ID NO: 103791 - protein, 15 aa, Mycobacterium tuberculosis
GNAVRHGADDVAHAD

SEQ ID NO: 103792 - protein, 15 aa, Mycobacterium tuberculosis
NAVRHGADDVAHADR

SEQ ID NO: 103793 - protein, 15 aa, Mycobacterium tuberculosis
AVRHGADDVAHADRR

SEQ ID NO: 103794 - protein, 15 aa, Mycobacterium tuberculosis
VRHGADDVAHADRRA

SEQ ID NO: 103795 - protein, 15 aa, Mycobacterium tuberculosis
RHGADDVAHADRRAA

SEQ ID NO: 103796 - protein, 15 aa, Mycobacterium tuberculosis
HGADDVAHADRRAAG

SEQ ID NO: 103797 - protein, 15 aa, Mycobacterium tuberculosis
GADDVAHADRRAAGA

SEQ ID NO: 103798 - protein, 15 aa, Mycobacterium tuberculosis
ADDVAHADRRAAGAW

SEQ ID NO: 103799 - protein, 15 aa, Mycobacterium tuberculosis
DDVAHADRRAAGAWA

SEQ ID NO: 103800 - protein, 15 aa, Mycobacterium tuberculosis
DVAHADRRAAGAWAR

SEQ ID NO: 103801 - protein, 16 aa, Mycobacterium tuberculosis
MNADPVLSYNFDAIEY

SEQ ID NO: 103802 - protein, 16 aa, Mycobacterium tuberculosis
NADPVLSYNFDAIEYS

SEQ ID NO: 103803 - protein, 16 aa, Mycobacterium tuberculosis
ADPVLSYNFDAIEYSV

SEQ ID NO: 103804 - protein, 16 aa, Mycobacterium tuberculosis
DPVLSYNFDAIEYSVR

SEQ ID NO: 103805 - protein, 16 aa, Mycobacterium tuberculosis
PVLSYNFDAIEYSVRQ

SEQ ID NO: 103806 - protein, 16 aa, Mycobacterium tuberculosis
VLSYNFDAIEYSVRQE

SEQ ID NO: 103807 - protein, 16 aa, Mycobacterium tuberculosis
LSYNFDAIEYSVRQEI

SEQ ID NO: 103808 - protein, 16 aa, Mycobacterium tuberculosis
SYNFDAIEYSVRQEIH

SEQ ID NO: 103809 - protein, 16 aa, Mycobacterium tuberculosis
YNFDAIEYSVRQEIHT

SEQ ID NO: 103810 - protein, 16 aa, Mycobacterium tuberculosis
NFDAIEYSVRQEIHTT

SEQ ID NO: 103811 - protein, 16 aa, Mycobacterium tuberculosis
FDAIEYSVRQEIHTTA

SEQ ID NO: 103812 - protein, 16 aa, Mycobacterium tuberculosis
DAIEYSVRQEIHTTAA

SEQ ID NO: 103813 - protein, 16 aa, Mycobacterium tuberculosis
AIEYSVRQEIHTTAAR

SEQ ID NO: 103814 - protein, 16 aa, Mycobacterium tuberculosis
IEYSVRQEIHTTAARF

SEQ ID NO: 103815 - protein, 16 aa, Mycobacterium tuberculosis
EYSVRQEIHTTAARFN

SEQ ID NO: 103816 - protein, 16 aa, Mycobacterium tuberculosis
YSVRQEIHTTAARFNA

SEQ ID NO: 103817 - protein, 16 aa, Mycobacterium tuberculosis
SVRQEIHTTAARFNAA

SEQ ID NO: 103818 - protein, 16 aa, Mycobacterium tuberculosis
VRQEIHTTAARFNAAL

SEQ ID NO: 103819 - protein, 16 aa, Mycobacterium tuberculosis
RQEIHTTAARFNAALQ

SEQ ID NO: 103820 - protein, 16 aa, Mycobacterium tuberculosis
QEIHTTAARFNAALQE

SEQ ID NO: 103821 - protein, 16 aa, Mycobacterium tuberculosis
EIHTTAARFNAALQEL

SEQ ID NO: 103822 - protein, 16 aa, Mycobacterium tuberculosis
IHTTAARFNAALQELR

SEQ ID NO: 103823 - protein, 16 aa, Mycobacterium tuberculosis
HTTAARFNAALQELRS

SEQ ID NO: 103824 - protein, 16 aa, Mycobacterium tuberculosis
TTAARFNAALQELRSQ

SEQ ID NO: 103825 - protein, 16 aa, Mycobacterium tuberculosis
TAARFNAALQELRSQI

SEQ ID NO: 103826 - protein, 16 aa, Mycobacterium tuberculosis
AARFNAALQELRSQIA

SEQ ID NO: 103827 - protein, 16 aa, Mycobacterium tuberculosis
ARFNAALQELRSQIAP

SEQ ID NO: 103828 - protein, 16 aa, Mycobacterium tuberculosis
RFNAALQELRSQIAPL

SEQ ID NO: 103829 - protein, 16 aa, Mycobacterium tuberculosis
FNAALQELRSQIAPLQ

SEQ ID NO: 103830 - protein, 16 aa, Mycobacterium tuberculosis
NAALQELRSQIAPLQQ

SEQ ID NO: 103831 - protein, 16 aa, Mycobacterium tuberculosis
AALQELRSQIAPLQQL

SEQ ID NO: 103832 - protein, 16 aa, Mycobacterium tuberculosis
ALQELRSQIAPLQQLW

SEQ ID NO: 103833 - protein, 16 aa, Mycobacterium tuberculosis
LQELRSQIAPLQQLWT

SEQ ID NO: 103834 - protein, 16 aa, Mycobacterium tuberculosis
QELRSQIAPLQQLWTR

SEQ ID NO: 103835 - protein, 16 aa, Mycobacterium tuberculosis
ELRSQIAPLQQLWTRE

SEQ ID NO: 103836 - protein, 16 aa, Mycobacterium tuberculosis
LRSQIAPLQQLWTREA

SEQ ID NO: 103837 - protein, 16 aa, Mycobacterium tuberculosis
RSQIAPLQQLWTREAA

SEQ ID NO: 103838 - protein, 16 aa, Mycobacterium tuberculosis
SQIAPLQQLWTREAAA

SEQ ID NO: 103839 - protein, 16 aa, Mycobacterium tuberculosis
QIAPLQQLWTREAAAA

SEQ ID NO: 103840 - protein, 16 aa, Mycobacterium tuberculosis
IAPLQQLWTREAAAAY

SEQ ID NO: 103841 - protein, 16 aa, Mycobacterium tuberculosis
APLQQLWTREAAAAYH

SEQ ID NO: 103842 - protein, 16 aa, Mycobacterium tuberculosis
PLQQLWTREAAAAYHA

SEQ ID NO: 103843 - protein, 16 aa, Mycobacterium tuberculosis
LQQLWTREAAAAYHAE

SEQ ID NO: 103844 - protein, 16 aa, Mycobacterium tuberculosis
QQLWTREAAAAYHAEQ

SEQ ID NO: 103845 - protein, 16 aa, Mycobacterium tuberculosis
QLWTREAAAAYHAEQL

SEQ ID NO: 103846 - protein, 16 aa, Mycobacterium tuberculosis
LWTREAAAAYHAEQLK

SEQ ID NO: 103847 - protein, 16 aa, Mycobacterium tuberculosis
WTREAAAAYHAEQLKW

SEQ ID NO: 103848 - protein, 16 aa, Mycobacterium tuberculosis
TREAAAAYHAEQLKWH

SEQ ID NO: 103849 - protein, 16 aa, Mycobacterium tuberculosis
REAAAAYHAEQLKWHQ

SEQ ID NO: 103850 - protein, 16 aa, Mycobacterium tuberculosis
EAAAAYHAEQLKWHQA

SEQ ID NO: 103851 - protein, 16 aa, Mycobacterium tuberculosis
AAAAYHAEQLKWHQAA

SEQ ID NO: 103852 - protein, 16 aa, Mycobacterium tuberculosis
AAAYHAEQLKWHQAAS

SEQ ID NO: 103853 - protein, 16 aa, Mycobacterium tuberculosis
AAYHAEQLKWHQAASA

SEQ ID NO: 103854 - protein, 16 aa, Mycobacterium tuberculosis
AYHAEQLKWHQAASAL

SEQ ID NO: 103855 - protein, 16 aa, Mycobacterium tuberculosis
YHAEQLKWHQAASALN

SEQ ID NO: 103856 - protein, 16 aa, Mycobacterium tuberculosis
HAEQLKWHQAASALNE

SEQ ID NO: 103857 - protein, 16 aa, Mycobacterium tuberculosis
AEQLKWHQAASALNEI

SEQ ID NO: 103858 - protein, 16 aa, Mycobacterium tuberculosis
EQLKWHQAASALNEIL

SEQ ID NO: 103859 - protein, 16 aa, Mycobacterium tuberculosis
QLKWHQAASALNEILI

SEQ ID NO: 103860 - protein, 16 aa, Mycobacterium tuberculosis
LKWHQAASALNEILID

SEQ ID NO: 103861 - protein, 16 aa, Mycobacterium tuberculosis
KWHQAASALNEILIDL

SEQ ID NO: 103862 - protein, 16 aa, Mycobacterium tuberculosis
WHQAASALNEILIDLG

SEQ ID NO: 103863 - protein, 16 aa, Mycobacterium tuberculosis
HQAASALNEILIDLGN

SEQ ID NO: 103864 - protein, 16 aa, Mycobacterium tuberculosis
QAASALNEILIDLGNA

SEQ ID NO: 103865 - protein, 16 aa, Mycobacterium tuberculosis
AASALNEILIDLGNAV

SEQ ID NO: 103866 - protein, 16 aa, Mycobacterium tuberculosis
ASALNEILIDLGNAVR

SEQ ID NO: 103867 - protein, 16 aa, Mycobacterium tuberculosis
SALNEILIDLGNAVRH

SEQ ID NO: 103868 - protein, 16 aa, Mycobacterium tuberculosis
ALNEILIDLGNAVRHG

SEQ ID NO: 103869 - protein, 16 aa, Mycobacterium tuberculosis
LNEILIDLGNAVRHGA

SEQ ID NO: 103870 - protein, 16 aa, Mycobacterium tuberculosis
NEILIDLGNAVRHGAD

SEQ ID NO: 103871 - protein, 16 aa, Mycobacterium tuberculosis
EILIDLGNAVRHGADD

SEQ ID NO: 103872 - protein, 16 aa, Mycobacterium tuberculosis
ILIDLGNAVRHGADDV

SEQ ID NO: 103873 - protein, 16 aa, Mycobacterium tuberculosis
LIDLGNAVRHGADDVA

SEQ ID NO: 103874 - protein, 16 aa, Mycobacterium tuberculosis
IDLGNAVRHGADDVAH

SEQ ID NO: 103875 - protein, 16 aa, Mycobacterium tuberculosis
DLGNAVRHGADDVAHA

SEQ ID NO: 103876 - protein, 16 aa, Mycobacterium tuberculosis
LGNAVRHGADDVAHAD

SEQ ID NO: 103877 - protein, 16 aa, Mycobacterium tuberculosis
GNAVRHGADDVAHADR

SEQ ID NO: 103878 - protein, 16 aa, Mycobacterium tuberculosis
NAVRHGADDVAHADRR

SEQ ID NO: 103879 - protein, 16 aa, Mycobacterium tuberculosis
AVRHGADDVAHADRRA

SEQ ID NO: 103880 - protein, 16 aa, Mycobacterium tuberculosis
VRHGADDVAHADRRAA

SEQ ID NO: 103881 - protein, 16 aa, Mycobacterium tuberculosis
RHGADDVAHADRRAAG

SEQ ID NO: 103882 - protein, 16 aa, Mycobacterium tuberculosis
HGADDVAHADRRAAGA

SEQ ID NO: 103883 - protein, 16 aa, Mycobacterium tuberculosis
GADDVAHADRRAAGAW

SEQ ID NO: 103884 - protein, 16 aa, Mycobacterium tuberculosis
ADDVAHADRRAAGAWA

SEQ ID NO: 103885 - protein, 16 aa, Mycobacterium tuberculosis
DDVAHADRRAAGAWAR

SEQ ID NO: 103886 - protein, 13 aa, Mycobacterium tuberculosis
MVEPGRIGGNQTR

SEQ ID NO: 103887 - protein, 13 aa, Mycobacterium tuberculosis
VEPGRIGGNQTRL

SEQ ID NO: 103888 - protein, 13 aa, Mycobacterium tuberculosis
EPGRIGGNQTRLA

SEQ ID NO: 103889 - protein, 13 aa, Mycobacterium tuberculosis
PGRIGGNQTRLAA

SEQ ID NO: 103890 - protein, 13 aa, Mycobacterium tuberculosis
GRIGGNQTRLAAV

SEQ ID NO: 103891 - protein, 13 aa, Mycobacterium tuberculosis
RIGGNQTRLAAVL

SEQ ID NO: 103892 - protein, 13 aa, Mycobacterium tuberculosis
IGGNQTRLAAVLL

SEQ ID NO: 103893 - protein, 13 aa, Mycobacterium tuberculosis
GGNQTRLAAVLLD

SEQ ID NO: 103894 - protein, 13 aa, Mycobacterium tuberculosis
GNQTRLAAVLLDV

SEQ ID NO: 103895 - protein, 13 aa, Mycobacterium tuberculosis
NQTRLAAVLLDVS

SEQ ID NO: 103896 - protein, 13 aa, Mycobacterium tuberculosis
QTRLAAVLLDVST

SEQ ID NO: 103897 - protein, 13 aa, Mycobacterium tuberculosis
TRLAAVLLDVSTP

SEQ ID NO: 103898 - protein, 13 aa, Mycobacterium tuberculosis
RLAAVLLDVSTPN

SEQ ID NO: 103899 - protein, 13 aa, Mycobacterium tuberculosis
LAAVLLDVSTPNT

SEQ ID NO: 103900 - protein, 13 aa, Mycobacterium tuberculosis
AAVLLDVSTPNTL

SEQ ID NO: 103901 - protein, 13 aa, Mycobacterium tuberculosis
AVLLDVSTPNTLN

SEQ ID NO: 103902 - protein, 13 aa, Mycobacterium tuberculosis
VLLDVSTPNTLNA

SEQ ID NO: 103903 - protein, 13 aa, Mycobacterium tuberculosis
LLDVSTPNTLNAD

SEQ ID NO: 103904 - protein, 13 aa, Mycobacterium tuberculosis
LDVSTPNTLNADF

SEQ ID NO: 103905 - protein, 13 aa, Mycobacterium tuberculosis
DVSTPNTLNADFD

SEQ ID NO: 103906 - protein, 13 aa, Mycobacterium tuberculosis
VSTPNTLNADFDL

SEQ ID NO: 103907 - protein, 13 aa, Mycobacterium tuberculosis
STPNTLNADFDLM

SEQ ID NO: 103908 - protein, 13 aa, Mycobacterium tuberculosis
TPNTLNADFDLMR

SEQ ID NO: 103909 - protein, 13 aa, Mycobacterium tuberculosis
PNTLNADFDLMRS

SEQ ID NO: 103910 - protein, 13 aa, Mycobacterium tuberculosis
NTLNADFDLMRSV

SEQ ID NO: 103911 - protein, 13 aa, Mycobacterium tuberculosis
TLNADFDLMRSVA

SEQ ID NO: 103912 - protein, 13 aa, Mycobacterium tuberculosis
LNADFDLMRSVAG

SEQ ID NO: 103913 - protein, 13 aa, Mycobacterium tuberculosis
NADFDLMRSVAGI

SEQ ID NO: 103914 - protein, 13 aa, Mycobacterium tuberculosis
ADFDLMRSVAGIT

SEQ ID NO: 103915 - protein, 13 aa, Mycobacterium tuberculosis
DFDLMRSVAGITD

SEQ ID NO: 103916 - protein, 13 aa, Mycobacterium tuberculosis
FDLMRSVAGITDA

SEQ ID NO: 103917 - protein, 13 aa, Mycobacterium tuberculosis
DLMRSVAGITDAR

SEQ ID NO: 103918 - protein, 13 aa, Mycobacterium tuberculosis
LMRSVAGITDARN

SEQ ID NO: 103919 - protein, 13 aa, Mycobacterium tuberculosis
MRSVAGITDARNE

SEQ ID NO: 103920 - protein, 13 aa, Mycobacterium tuberculosis
RSVAGITDARNEE

SEQ ID NO: 103921 - protein, 13 aa, Mycobacterium tuberculosis
SVAGITDARNEEI

SEQ ID NO: 103922 - protein, 13 aa, Mycobacterium tuberculosis
VAGITDARNEEIR

SEQ ID NO: 103923 - protein, 13 aa, Mycobacterium tuberculosis
AGITDARNEEIRA

SEQ ID NO: 103924 - protein, 13 aa, Mycobacterium tuberculosis
GITDARNEEIRAM

SEQ ID NO: 103925 - protein, 13 aa, Mycobacterium tuberculosis
ITDARNEEIRAML

SEQ ID NO: 103926 - protein, 13 aa, Mycobacterium tuberculosis
TDARNEEIRAMLQ

SEQ ID NO: 103927 - protein, 13 aa, Mycobacterium tuberculosis
DARNEEIRAMLQA

SEQ ID NO: 103928 - protein, 13 aa, Mycobacterium tuberculosis
ARNEEIRAMLQAF

SEQ ID NO: 103929 - protein, 13 aa, Mycobacterium tuberculosis
RNEEIRAMLQAFI

SEQ ID NO: 103930 - protein, 13 aa, Mycobacterium tuberculosis
NEEIRAMLQAFIG

SEQ ID NO: 103931 - protein, 13 aa, Mycobacterium tuberculosis
EEIRAMLQAFIGR

SEQ ID NO: 103932 - protein, 13 aa, Mycobacterium tuberculosis
EIRAMLQAFIGRM

SEQ ID NO: 103933 - protein, 13 aa, Mycobacterium tuberculosis
IRAMLQAFIGRMS

SEQ ID NO: 103934 - protein, 13 aa, Mycobacterium tuberculosis
RAMLQAFIGRMSG

SEQ ID NO: 103935 - protein, 13 aa, Mycobacterium tuberculosis
AMLQAFIGRMSGV

SEQ ID NO: 103936 - protein, 13 aa, Mycobacterium tuberculosis
MLQAFIGRMSGVP

SEQ ID NO: 103937 - protein, 13 aa, Mycobacterium tuberculosis
LQAFIGRMSGVPP

SEQ ID NO: 103938 - protein, 13 aa, Mycobacterium tuberculosis
QAFIGRMSGVPPS

SEQ ID NO: 103939 - protein, 13 aa, Mycobacterium tuberculosis
AFIGRMSGVPPSV

SEQ ID NO: 103940 - protein, 13 aa, Mycobacterium tuberculosis
FIGRMSGVPPSVW

SEQ ID NO: 103941 - protein, 13 aa, Mycobacterium tuberculosis
IGRMSGVPPSVWG

SEQ ID NO: 103942 - protein, 13 aa, Mycobacterium tuberculosis
GRMSGVPPSVWGG

SEQ ID NO: 103943 - protein, 13 aa, Mycobacterium tuberculosis
RMSGVPPSVWGGL

SEQ ID NO: 103944 - protein, 13 aa, Mycobacterium tuberculosis
MSGVPPSVWGGLA

SEQ ID NO: 103945 - protein, 13 aa, Mycobacterium tuberculosis
SGVPPSVWGGLAA

SEQ ID NO: 103946 - protein, 13 aa, Mycobacterium tuberculosis
GVPPSVWGGLAAA

SEQ ID NO: 103947 - protein, 13 aa, Mycobacterium tuberculosis
VPPSVWGGLAAAR

SEQ ID NO: 103948 - protein, 13 aa, Mycobacterium tuberculosis
PPSVWGGLAAARF

SEQ ID NO: 103949 - protein, 13 aa, Mycobacterium tuberculosis
PSVWGGLAAARFQ

SEQ ID NO: 103950 - protein, 13 aa, Mycobacterium tuberculosis
SVWGGLAAARFQD

SEQ ID NO: 103951 - protein, 13 aa, Mycobacterium tuberculosis
VWGGLAAARFQDV

SEQ ID NO: 103952 - protein, 13 aa, Mycobacterium tuberculosis
WGGLAAARFQDVV

SEQ ID NO: 103953 - protein, 13 aa, Mycobacterium tuberculosis
GGLAAARFQDVVD

SEQ ID NO: 103954 - protein, 13 aa, Mycobacterium tuberculosis
GLAAARFQDVVDR

SEQ ID NO: 103955 - protein, 13 aa, Mycobacterium tuberculosis
LAAARFQDVVDRW

SEQ ID NO: 103956 - protein, 13 aa, Mycobacterium tuberculosis
AAARFQDVVDRWN

SEQ ID NO: 103957 - protein, 13 aa, Mycobacterium tuberculosis
AARFQDVVDRWNA

SEQ ID NO: 103958 - protein, 13 aa, Mycobacterium tuberculosis
ARFQDVVDRWNAE

SEQ ID NO: 103959 - protein, 13 aa, Mycobacterium tuberculosis
RFQDVVDRWNAES

SEQ ID NO: 103960 - protein, 13 aa, Mycobacterium tuberculosis
FQDVVDRWNAEST

SEQ ID NO: 103961 - protein, 13 aa, Mycobacterium tuberculosis
QDVVDRWNAESTR

SEQ ID NO: 103962 - protein, 13 aa, Mycobacterium tuberculosis
DVVDRWNAESTRL

SEQ ID NO: 103963 - protein, 13 aa, Mycobacterium tuberculosis
VVDRWNAESTRLY

SEQ ID NO: 103964 - protein, 13 aa, Mycobacterium tuberculosis
VDRWNAESTRLYH

SEQ ID NO: 103965 - protein, 13 aa, Mycobacterium tuberculosis
DRWNAESTRLYHV

SEQ ID NO: 103966 - protein, 13 aa, Mycobacterium tuberculosis
RWNAESTRLYHVL

SEQ ID NO: 103967 - protein, 13 aa, Mycobacterium tuberculosis
WNAESTRLYHVLH

SEQ ID NO: 103968 - protein, 13 aa, Mycobacterium tuberculosis
NAESTRLYHVLHA

SEQ ID NO: 103969 - protein, 13 aa, Mycobacterium tuberculosis
AESTRLYHVLHAI

SEQ ID NO: 103970 - protein, 13 aa, Mycobacterium tuberculosis
ESTRLYHVLHAIA

SEQ ID NO: 103971 - protein, 13 aa, Mycobacterium tuberculosis
STRLYHVLHAIAD

SEQ ID NO: 103972 - protein, 13 aa, Mycobacterium tuberculosis
TRLYHVLHAIADT

SEQ ID NO: 103973 - protein, 13 aa, Mycobacterium tuberculosis
RLYHVLHAIADTI

SEQ ID NO: 103974 - protein, 13 aa, Mycobacterium tuberculosis
LYHVLHAIADTIR

SEQ ID NO: 103975 - protein, 13 aa, Mycobacterium tuberculosis
YHVLHAIADTIRH

SEQ ID NO: 103976 - protein, 13 aa, Mycobacterium tuberculosis
HVLHAIADTIRHN

SEQ ID NO: 103977 - protein, 13 aa, Mycobacterium tuberculosis
VLHAIADTIRHNE

SEQ ID NO: 103978 - protein, 13 aa, Mycobacterium tuberculosis
LHAIADTIRHNEA

SEQ ID NO: 103979 - protein, 13 aa, Mycobacterium tuberculosis
HAIADTIRHNEAA

SEQ ID NO: 103980 - protein, 13 aa, Mycobacterium tuberculosis
AIADTIRHNEAAL

SEQ ID NO: 103981 - protein, 13 aa, Mycobacterium tuberculosis
IADTIRHNEAALR

SEQ ID NO: 103982 - protein, 13 aa, Mycobacterium tuberculosis
ADTIRHNEAALRE

SEQ ID NO: 103983 - protein, 13 aa, Mycobacterium tuberculosis
DTIRHNEAALREA

SEQ ID NO: 103984 - protein, 13 aa, Mycobacterium tuberculosis
TIRHNEAALREAG

SEQ ID NO: 103985 - protein, 13 aa, Mycobacterium tuberculosis
IRHNEAALREAGQ

SEQ ID NO: 103986 - protein, 13 aa, Mycobacterium tuberculosis
RHNEAALREAGQI

SEQ ID NO: 103987 - protein, 13 aa, Mycobacterium tuberculosis
HNEAALREAGQIH

SEQ ID NO: 103988 - protein, 13 aa, Mycobacterium tuberculosis
NEAALREAGQIHA

SEQ ID NO: 103989 - protein, 13 aa, Mycobacterium tuberculosis
EAALREAGQIHAR

SEQ ID NO: 103990 - protein, 13 aa, Mycobacterium tuberculosis
AALREAGQIHARH

SEQ ID NO: 103991 - protein, 13 aa, Mycobacterium tuberculosis
ALREAGQIHARHI

SEQ ID NO: 103992 - protein, 13 aa, Mycobacterium tuberculosis
LREAGQIHARHIA

SEQ ID NO: 103993 - protein, 13 aa, Mycobacterium tuberculosis
REAGQIHARHIAA

SEQ ID NO: 103994 - protein, 13 aa, Mycobacterium tuberculosis
EAGQIHARHIAAA

SEQ ID NO: 103995 - protein, 13 aa, Mycobacterium tuberculosis
AGQIHARHIAAAG

SEQ ID NO: 103996 - protein, 13 aa, Mycobacterium tuberculosis
GQIHARHIAAAGG

SEQ ID NO: 103997 - protein, 13 aa, Mycobacterium tuberculosis
QIHARHIAAAGGD

SEQ ID NO: 103998 - protein, 13 aa, Mycobacterium tuberculosis
IHARHIAAAGGDL

SEQ ID NO: 103999 - protein, 14 aa, Mycobacterium tuberculosis
MVEPGRIGGNQTRL

SEQ ID NO: 104000 - protein, 14 aa, Mycobacterium tuberculosis
VEPGRIGGNQTRLA

SEQ ID NO: 104001 - protein, 14 aa, Mycobacterium tuberculosis
EPGRIGGNQTRLAA

SEQ ID NO: 104002 - protein, 14 aa, Mycobacterium tuberculosis
PGRIGGNQTRLAAV

SEQ ID NO: 104003 - protein, 14 aa, Mycobacterium tuberculosis
GRIGGNQTRLAAVL

SEQ ID NO: 104004 - protein, 14 aa, Mycobacterium tuberculosis
RIGGNQTRLAAVLL

SEQ ID NO: 104005 - protein, 14 aa, Mycobacterium tuberculosis
IGGNQTRLAAVLLD

SEQ ID NO: 104006 - protein, 14 aa, Mycobacterium tuberculosis
GGNQTRLAAVLLDV

SEQ ID NO: 104007 - protein, 14 aa, Mycobacterium tuberculosis
GNQTRLAAVLLDVS

SEQ ID NO: 104008 - protein, 14 aa, Mycobacterium tuberculosis
NQTRLAAVLLDVST

SEQ ID NO: 104009 - protein, 14 aa, Mycobacterium tuberculosis
QTRLAAVLLDVSTP

SEQ ID NO: 104010 - protein, 14 aa, Mycobacterium tuberculosis
TRLAAVLLDVSTPN

SEQ ID NO: 104011 - protein, 14 aa, Mycobacterium tuberculosis
RLAAVLLDVSTPNT

SEQ ID NO: 104012 - protein, 14 aa, Mycobacterium tuberculosis
LAAVLLDVSTPNTL

SEQ ID NO: 104013 - protein, 14 aa, Mycobacterium tuberculosis
AAVLLDVSTPNTLN

SEQ ID NO: 104014 - protein, 14 aa, Mycobacterium tuberculosis
AVLLDVSTPNTLNA

SEQ ID NO: 104015 - protein, 14 aa, Mycobacterium tuberculosis
VLLDVSTPNTLNAD

SEQ ID NO: 104016 - protein, 14 aa, Mycobacterium tuberculosis
LLDVSTPNTLNADF

SEQ ID NO: 104017 - protein, 14 aa, Mycobacterium tuberculosis
LDVSTPNTLNADFD

SEQ ID NO: 104018 - protein, 14 aa, Mycobacterium tuberculosis
DVSTPNTLNADFDL

SEQ ID NO: 104019 - protein, 14 aa, Mycobacterium tuberculosis
VSTPNTLNADFDLM

SEQ ID NO: 104020 - protein, 14 aa, Mycobacterium tuberculosis
STPNTLNADFDLMR

SEQ ID NO: 104021 - protein, 14 aa, Mycobacterium tuberculosis
TPNTLNADFDLMRS

SEQ ID NO: 104022 - protein, 14 aa, Mycobacterium tuberculosis
PNTLNADFDLMRSV

SEQ ID NO: 104023 - protein, 14 aa, Mycobacterium tuberculosis
NTLNADFDLMRSVA

SEQ ID NO: 104024 - protein, 14 aa, Mycobacterium tuberculosis
TLNADFDLMRSVAG

SEQ ID NO: 104025 - protein, 14 aa, Mycobacterium tuberculosis
LNADFDLMRSVAGI

SEQ ID NO: 104026 - protein, 14 aa, Mycobacterium tuberculosis
NADFDLMRSVAGIT

SEQ ID NO: 104027 - protein, 14 aa, Mycobacterium tuberculosis
ADFDLMRSVAGITD

SEQ ID NO: 104028 - protein, 14 aa, Mycobacterium tuberculosis
DFDLMRSVAGITDA

SEQ ID NO: 104029 - protein, 14 aa, Mycobacterium tuberculosis
FDLMRSVAGITDAR

SEQ ID NO: 104030 - protein, 14 aa, Mycobacterium tuberculosis
DLMRSVAGITDARN

SEQ ID NO: 104031 - protein, 14 aa, Mycobacterium tuberculosis
LMRSVAGITDARNE

SEQ ID NO: 104032 - protein, 14 aa, Mycobacterium tuberculosis
MRSVAGITDARNEE

SEQ ID NO: 104033 - protein, 14 aa, Mycobacterium tuberculosis
RSVAGITDARNEEI

SEQ ID NO: 104034 - protein, 14 aa, Mycobacterium tuberculosis
SVAGITDARNEEIR

SEQ ID NO: 104035 - protein, 14 aa, Mycobacterium tuberculosis
VAGITDARNEEIRA

SEQ ID NO: 104036 - protein, 14 aa, Mycobacterium tuberculosis
AGITDARNEEIRAM

SEQ ID NO: 104037 - protein, 14 aa, Mycobacterium tuberculosis
GITDARNEEIRAML

SEQ ID NO: 104038 - protein, 14 aa, Mycobacterium tuberculosis
ITDARNEEIRAMLQ

SEQ ID NO: 104039 - protein, 14 aa, Mycobacterium tuberculosis
TDARNEEIRAMLQA

SEQ ID NO: 104040 - protein, 14 aa, Mycobacterium tuberculosis
DARNEEIRAMLQAF

SEQ ID NO: 104041 - protein, 14 aa, Mycobacterium tuberculosis
ARNEEIRAMLQAFI

SEQ ID NO: 104042 - protein, 14 aa, Mycobacterium tuberculosis
RNEEIRAMLQAFIG

SEQ ID NO: 104043 - protein, 14 aa, Mycobacterium tuberculosis
NEEIRAMLQAFIGR

SEQ ID NO: 104044 - protein, 14 aa, Mycobacterium tuberculosis
EEIRAMLQAFIGRM

SEQ ID NO: 104045 - protein, 14 aa, Mycobacterium tuberculosis
EIRAMLQAFIGRMS

SEQ ID NO: 104046 - protein, 14 aa, Mycobacterium tuberculosis
IRAMLQAFIGRMSG

SEQ ID NO: 104047 - protein, 14 aa, Mycobacterium tuberculosis
RAMLQAFIGRMSGV

SEQ ID NO: 104048 - protein, 14 aa, Mycobacterium tuberculosis
AMLQAFIGRMSGVP

SEQ ID NO: 104049 - protein, 14 aa, Mycobacterium tuberculosis
MLQAFIGRMSGVPP

SEQ ID NO: 104050 - protein, 14 aa, Mycobacterium tuberculosis
LQAFIGRMSGVPPS

SEQ ID NO: 104051 - protein, 14 aa, Mycobacterium tuberculosis
QAFIGRMSGVPPSV

SEQ ID NO: 104052 - protein, 14 aa, Mycobacterium tuberculosis
AFIGRMSGVPPSVW

SEQ ID NO: 104053 - protein, 14 aa, Mycobacterium tuberculosis
FIGRMSGVPPSVWG

SEQ ID NO: 104054 - protein, 14 aa, Mycobacterium tuberculosis
IGRMSGVPPSVWGG

SEQ ID NO: 104055 - protein, 14 aa, Mycobacterium tuberculosis
GRMSGVPPSVWGGL

SEQ ID NO: 104056 - protein, 14 aa, Mycobacterium tuberculosis
RMSGVPPSVWGGLA

SEQ ID NO: 104057 - protein, 14 aa, Mycobacterium tuberculosis
MSGVPPSVWGGLAA

SEQ ID NO: 104058 - protein, 14 aa, Mycobacterium tuberculosis
SGVPPSVWGGLAAA

SEQ ID NO: 104059 - protein, 14 aa, Mycobacterium tuberculosis
GVPPSVWGGLAAAR

SEQ ID NO: 104060 - protein, 14 aa, Mycobacterium tuberculosis
VPPSVWGGLAAARF

SEQ ID NO: 104061 - protein, 14 aa, Mycobacterium tuberculosis
PPSVWGGLAAARFQ

SEQ ID NO: 104062 - protein, 14 aa, Mycobacterium tuberculosis
PSVWGGLAAARFQD

SEQ ID NO: 104063 - protein, 14 aa, Mycobacterium tuberculosis
SVWGGLAAARFQDV

SEQ ID NO: 104064 - protein, 14 aa, Mycobacterium tuberculosis
VWGGLAAARFQDVV

SEQ ID NO: 104065 - protein, 14 aa, Mycobacterium tuberculosis
WGGLAAARFQDVVD

SEQ ID NO: 104066 - protein, 14 aa, Mycobacterium tuberculosis
GGLAAARFQDVVDR

SEQ ID NO: 104067 - protein, 14 aa, Mycobacterium tuberculosis
GLAAARFQDVVDRW

SEQ ID NO: 104068 - protein, 14 aa, Mycobacterium tuberculosis
LAAARFQDVVDRWN

SEQ ID NO: 104069 - protein, 14 aa, Mycobacterium tuberculosis
AAARFQDVVDRWNA

SEQ ID NO: 104070 - protein, 14 aa, Mycobacterium tuberculosis
AARFQDVVDRWNAE

SEQ ID NO: 104071 - protein, 14 aa, Mycobacterium tuberculosis
ARFQDVVDRWNAES

SEQ ID NO: 104072 - protein, 14 aa, Mycobacterium tuberculosis
RFQDVVDRWNAEST

SEQ ID NO: 104073 - protein, 14 aa, Mycobacterium tuberculosis
FQDVVDRWNAESTR

SEQ ID NO: 104074 - protein, 14 aa, Mycobacterium tuberculosis
QDVVDRWNAESTRL

SEQ ID NO: 104075 - protein, 14 aa, Mycobacterium tuberculosis
DVVDRWNAESTRLY

SEQ ID NO: 104076 - protein, 14 aa, Mycobacterium tuberculosis
VVDRWNAESTRLYH

SEQ ID NO: 104077 - protein, 14 aa, Mycobacterium tuberculosis
VDRWNAESTRLYHV

SEQ ID NO: 104078 - protein, 14 aa, Mycobacterium tuberculosis
DRWNAESTRLYHVL

SEQ ID NO: 104079 - protein, 14 aa, Mycobacterium tuberculosis
RWNAESTRLYHVLH

SEQ ID NO: 104080 - protein, 14 aa, Mycobacterium tuberculosis
WNAESTRLYHVLHA

SEQ ID NO: 104081 - protein, 14 aa, Mycobacterium tuberculosis
NAESTRLYHVLHAI

SEQ ID NO: 104082 - protein, 14 aa, Mycobacterium tuberculosis
AESTRLYHVLHAIA

SEQ ID NO: 104083 - protein, 14 aa, Mycobacterium tuberculosis
ESTRLYHVLHAIAD

SEQ ID NO: 104084 - protein, 14 aa, Mycobacterium tuberculosis
STRLYHVLHAIADT

SEQ ID NO: 104085 - protein, 14 aa, Mycobacterium tuberculosis
TRLYHVLHAIADTI

SEQ ID NO: 104086 - protein, 14 aa, Mycobacterium tuberculosis
RLYHVLHAIADTIR

SEQ ID NO: 104087 - protein, 14 aa, Mycobacterium tuberculosis
LYHVLHAIADTIRH

SEQ ID NO: 104088 - protein, 14 aa, Mycobacterium tuberculosis
YHVLHAIADTIRHN

SEQ ID NO: 104089 - protein, 14 aa, Mycobacterium tuberculosis
HVLHAIADTIRHNE

SEQ ID NO: 104090 - protein, 14 aa, Mycobacterium tuberculosis
VLHAIADTIRHNEA

SEQ ID NO: 104091 - protein, 14 aa, Mycobacterium tuberculosis
LHAIADTIRHNEAA

SEQ ID NO: 104092 - protein, 14 aa, Mycobacterium tuberculosis
HAIADTIRHNEAAL

SEQ ID NO: 104093 - protein, 14 aa, Mycobacterium tuberculosis
AIADTIRHNEAALR

SEQ ID NO: 104094 - protein, 14 aa, Mycobacterium tuberculosis
IADTIRHNEAALRE

SEQ ID NO: 104095 - protein, 14 aa, Mycobacterium tuberculosis
ADTIRHNEAALREA

SEQ ID NO: 104096 - protein, 14 aa, Mycobacterium tuberculosis
DTIRHNEAALREAG

SEQ ID NO: 104097 - protein, 14 aa, Mycobacterium tuberculosis
TIRHNEAALREAGQ

SEQ ID NO: 104098 - protein, 14 aa, Mycobacterium tuberculosis
IRHNEAALREAGQI

SEQ ID NO: 104099 - protein, 14 aa, Mycobacterium tuberculosis
RHNEAALREAGQIH

SEQ ID NO: 104100 - protein, 14 aa, Mycobacterium tuberculosis
HNEAALREAGQIHA

SEQ ID NO: 104101 - protein, 14 aa, Mycobacterium tuberculosis
NEAALREAGQIHAR

SEQ ID NO: 104102 - protein, 14 aa, Mycobacterium tuberculosis
EAALREAGQIHARH

SEQ ID NO: 104103 - protein, 14 aa, Mycobacterium tuberculosis
AALREAGQIHARHI

SEQ ID NO: 104104 - protein, 14 aa, Mycobacterium tuberculosis
ALREAGQIHARHIA

SEQ ID NO: 104105 - protein, 14 aa, Mycobacterium tuberculosis
LREAGQIHARHIAA

SEQ ID NO: 104106 - protein, 14 aa, Mycobacterium tuberculosis
REAGQIHARHIAAA

SEQ ID NO: 104107 - protein, 14 aa, Mycobacterium tuberculosis
EAGQIHARHIAAAG

SEQ ID NO: 104108 - protein, 14 aa, Mycobacterium tuberculosis
AGQIHARHIAAAGG

SEQ ID NO: 104109 - protein, 14 aa, Mycobacterium tuberculosis
GQIHARHIAAAGGD

SEQ ID NO: 104110 - protein, 14 aa, Mycobacterium tuberculosis
QIHARHIAAAGGDL

SEQ ID NO: 104111 - protein, 15 aa, Mycobacterium tuberculosis
MVEPGRIGGNQTRLA

SEQ ID NO: 104112 - protein, 15 aa, Mycobacterium tuberculosis
VEPGRIGGNQTRLAA

SEQ ID NO: 104113 - protein, 15 aa, Mycobacterium tuberculosis
EPGRIGGNQTRLAAV

SEQ ID NO: 104114 - protein, 15 aa, Mycobacterium tuberculosis
PGRIGGNQTRLAAVL

SEQ ID NO: 104115 - protein, 15 aa, Mycobacterium tuberculosis
GRIGGNQTRLAAVLL

SEQ ID NO: 104116 - protein, 15 aa, Mycobacterium tuberculosis
RIGGNQTRLAAVLLD

SEQ ID NO: 104117 - protein, 15 aa, Mycobacterium tuberculosis
IGGNQTRLAAVLLDV

SEQ ID NO: 104118 - protein, 15 aa, Mycobacterium tuberculosis
GGNQTRLAAVLLDVS

SEQ ID NO: 104119 - protein, 15 aa, Mycobacterium tuberculosis
GNQTRLAAVLLDVST

SEQ ID NO: 104120 - protein, 15 aa, Mycobacterium tuberculosis
NQTRLAAVLLDVSTP

SEQ ID NO: 104121 - protein, 15 aa, Mycobacterium tuberculosis
QTRLAAVLLDVSTPN

SEQ ID NO: 104122 - protein, 15 aa, Mycobacterium tuberculosis
TRLAAVLLDVSTPNT

SEQ ID NO: 104123 - protein, 15 aa, Mycobacterium tuberculosis
RLAAVLLDVSTPNTL

SEQ ID NO: 104124 - protein, 15 aa, Mycobacterium tuberculosis
LAAVLLDVSTPNTLN

SEQ ID NO: 104125 - protein, 15 aa, Mycobacterium tuberculosis
AAVLLDVSTPNTLNA

SEQ ID NO: 104126 - protein, 15 aa, Mycobacterium tuberculosis
AVLLDVSTPNTLNAD

SEQ ID NO: 104127 - protein, 15 aa, Mycobacterium tuberculosis
VLLDVSTPNTLNADF

SEQ ID NO: 104128 - protein, 15 aa, Mycobacterium tuberculosis
LLDVSTPNTLNADFD

SEQ ID NO: 104129 - protein, 15 aa, Mycobacterium tuberculosis
LDVSTPNTLNADFDL

SEQ ID NO: 104130 - protein, 15 aa, Mycobacterium tuberculosis
DVSTPNTLNADFDLM

SEQ ID NO: 104131 - protein, 15 aa, Mycobacterium tuberculosis
VSTPNTLNADFDLMR

SEQ ID NO: 104132 - protein, 15 aa, Mycobacterium tuberculosis
STPNTLNADFDLMRS

SEQ ID NO: 104133 - protein, 15 aa, Mycobacterium tuberculosis
TPNTLNADFDLMRSV

SEQ ID NO: 104134 - protein, 15 aa, Mycobacterium tuberculosis
PNTLNADFDLMRSVA

SEQ ID NO: 104135 - protein, 15 aa, Mycobacterium tuberculosis
NTLNADFDLMRSVAG

SEQ ID NO: 104136 - protein, 15 aa, Mycobacterium tuberculosis
TLNADFDLMRSVAGI

SEQ ID NO: 104137 - protein, 15 aa, Mycobacterium tuberculosis
LNADFDLMRSVAGIT

SEQ ID NO: 104138 - protein, 15 aa, Mycobacterium tuberculosis
NADFDLMRSVAGITD

SEQ ID NO: 104139 - protein, 15 aa, Mycobacterium tuberculosis
ADFDLMRSVAGITDA

SEQ ID NO: 104140 - protein, 15 aa, Mycobacterium tuberculosis
DFDLMRSVAGITDAR

SEQ ID NO: 104141 - protein, 15 aa, Mycobacterium tuberculosis
FDLMRSVAGITDARN

SEQ ID NO: 104142 - protein, 15 aa, Mycobacterium tuberculosis
DLMRSVAGITDARNE

SEQ ID NO: 104143 - protein, 15 aa, Mycobacterium tuberculosis
LMRSVAGITDARNEE

SEQ ID NO: 104144 - protein, 15 aa, Mycobacterium tuberculosis
MRSVAGITDARNEEI

SEQ ID NO: 104145 - protein, 15 aa, Mycobacterium tuberculosis
RSVAGITDARNEEIR

SEQ ID NO: 104146 - protein, 15 aa, Mycobacterium tuberculosis
SVAGITDARNEEIRA

SEQ ID NO: 104147 - protein, 15 aa, Mycobacterium tuberculosis
VAGITDARNEEIRAM

SEQ ID NO: 104148 - protein, 15 aa, Mycobacterium tuberculosis
AGITDARNEEIRAML

SEQ ID NO: 104149 - protein, 15 aa, Mycobacterium tuberculosis
GITDARNEEIRAMLQ

SEQ ID NO: 104150 - protein, 15 aa, Mycobacterium tuberculosis
ITDARNEEIRAMLQA

SEQ ID NO: 104151 - protein, 15 aa, Mycobacterium tuberculosis
TDARNEEIRAMLQAF

SEQ ID NO: 104152 - protein, 15 aa, Mycobacterium tuberculosis
DARNEEIRAMLQAFI

SEQ ID NO: 104153 - protein, 15 aa, Mycobacterium tuberculosis
ARNEEIRAMLQAFIG

SEQ ID NO: 104154 - protein, 15 aa, Mycobacterium tuberculosis
RNEEIRAMLQAFIGR

SEQ ID NO: 104155 - protein, 15 aa, Mycobacterium tuberculosis
NEEIRAMLQAFIGRM

SEQ ID NO: 104156 - protein, 15 aa, Mycobacterium tuberculosis
EEIRAMLQAFIGRMS

SEQ ID NO: 104157 - protein, 15 aa, Mycobacterium tuberculosis
EIRAMLQAFIGRMSG

SEQ ID NO: 104158 - protein, 15 aa, Mycobacterium tuberculosis
IRAMLQAFIGRMSGV

SEQ ID NO: 104159 - protein, 15 aa, Mycobacterium tuberculosis
RAMLQAFIGRMSGVP

SEQ ID NO: 104160 - protein, 15 aa, Mycobacterium tuberculosis
AMLQAFIGRMSGVPP

SEQ ID NO: 104161 - protein, 15 aa, Mycobacterium tuberculosis
MLQAFIGRMSGVPPS

SEQ ID NO: 104162 - protein, 15 aa, Mycobacterium tuberculosis
LQAFIGRMSGVPPSV

SEQ ID NO: 104163 - protein, 15 aa, Mycobacterium tuberculosis
QAFIGRMSGVPPSVW

SEQ ID NO: 104164 - protein, 15 aa, Mycobacterium tuberculosis
AFIGRMSGVPPSVWG

SEQ ID NO: 104165 - protein, 15 aa, Mycobacterium tuberculosis
FIGRMSGVPPSVWGG

SEQ ID NO: 104166 - protein, 15 aa, Mycobacterium tuberculosis
IGRMSGVPPSVWGGL

SEQ ID NO: 104167 - protein, 15 aa, Mycobacterium tuberculosis
GRMSGVPPSVWGGLA

SEQ ID NO: 104168 - protein, 15 aa, Mycobacterium tuberculosis
RMSGVPPSVWGGLAA

SEQ ID NO: 104169 - protein, 15 aa, Mycobacterium tuberculosis
MSGVPPSVWGGLAAA

SEQ ID NO: 104170 - protein, 15 aa, Mycobacterium tuberculosis
SGVPPSVWGGLAAAR

SEQ ID NO: 104171 - protein, 15 aa, Mycobacterium tuberculosis
GVPPSVWGGLAAARF

SEQ ID NO: 104172 - protein, 15 aa, Mycobacterium tuberculosis
VPPSVWGGLAAARFQ

SEQ ID NO: 104173 - protein, 15 aa, Mycobacterium tuberculosis
PPSVWGGLAAARFQD

SEQ ID NO: 104174 - protein, 15 aa, Mycobacterium tuberculosis
PSVWGGLAAARFQDV

SEQ ID NO: 104175 - protein, 15 aa, Mycobacterium tuberculosis
SVWGGLAAARFQDVV

SEQ ID NO: 104176 - protein, 15 aa, Mycobacterium tuberculosis
VWGGLAAARFQDVVD

SEQ ID NO: 104177 - protein, 15 aa, Mycobacterium tuberculosis
WGGLAAARFQDVVDR

SEQ ID NO: 104178 - protein, 15 aa, Mycobacterium tuberculosis
GGLAAARFQDVVDRW

SEQ ID NO: 104179 - protein, 15 aa, Mycobacterium tuberculosis
GLAAARFQDVVDRWN

SEQ ID NO: 104180 - protein, 15 aa, Mycobacterium tuberculosis
LAAARFQDVVDRWNA

SEQ ID NO: 104181 - protein, 15 aa, Mycobacterium tuberculosis
AAARFQDVVDRWNAE

SEQ ID NO: 104182 - protein, 15 aa, Mycobacterium tuberculosis
AARFQDVVDRWNAES

SEQ ID NO: 104183 - protein, 15 aa, Mycobacterium tuberculosis
ARFQDVVDRWNAEST

SEQ ID NO: 104184 - protein, 15 aa, Mycobacterium tuberculosis
RFQDVVDRWNAESTR

SEQ ID NO: 104185 - protein, 15 aa, Mycobacterium tuberculosis
FQDVVDRWNAESTRL

SEQ ID NO: 104186 - protein, 15 aa, Mycobacterium tuberculosis
QDVVDRWNAESTRLY

SEQ ID NO: 104187 - protein, 15 aa, Mycobacterium tuberculosis
DVVDRWNAESTRLYH

SEQ ID NO: 104188 - protein, 15 aa, Mycobacterium tuberculosis
VVDRWNAESTRLYHV

SEQ ID NO: 104189 - protein, 15 aa, Mycobacterium tuberculosis
VDRWNAESTRLYHVL

SEQ ID NO: 104190 - protein, 15 aa, Mycobacterium tuberculosis
DRWNAESTRLYHVLH

SEQ ID NO: 104191 - protein, 15 aa, Mycobacterium tuberculosis
RWNAESTRLYHVLHA

SEQ ID NO: 104192 - protein, 15 aa, Mycobacterium tuberculosis
WNAESTRLYHVLHAI

SEQ ID NO: 104193 - protein, 15 aa, Mycobacterium tuberculosis
NAESTRLYHVLHAIA

SEQ ID NO: 104194 - protein, 15 aa, Mycobacterium tuberculosis
AESTRLYHVLHAIAD

SEQ ID NO: 104195 - protein, 15 aa, Mycobacterium tuberculosis
ESTRLYHVLHAIADT

SEQ ID NO: 104196 - protein, 15 aa, Mycobacterium tuberculosis
STRLYHVLHAIADTI

SEQ ID NO: 104197 - protein, 15 aa, Mycobacterium tuberculosis
TRLYHVLHAIADTIR

SEQ ID NO: 104198 - protein, 15 aa, Mycobacterium tuberculosis
RLYHVLHAIADTIRH

SEQ ID NO: 104199 - protein, 15 aa, Mycobacterium tuberculosis
LYHVLHAIADTIRHN

SEQ ID NO: 104200 - protein, 15 aa, Mycobacterium tuberculosis
YHVLHAIADTIRHNE

SEQ ID NO: 104201 - protein, 15 aa, Mycobacterium tuberculosis
HVLHAIADTIRHNEA

SEQ ID NO: 104202 - protein, 15 aa, Mycobacterium tuberculosis
VLHAIADTIRHNEAA

SEQ ID NO: 104203 - protein, 15 aa, Mycobacterium tuberculosis
LHAIADTIRHNEAAL

SEQ ID NO: 104204 - protein, 15 aa, Mycobacterium tuberculosis
HAIADTIRHNEAALR

SEQ ID NO: 104205 - protein, 15 aa, Mycobacterium tuberculosis
AIADTIRHNEAALRE

SEQ ID NO: 104206 - protein, 15 aa, Mycobacterium tuberculosis
IADTIRHNEAALREA

SEQ ID NO: 104207 - protein, 15 aa, Mycobacterium tuberculosis
ADTIRHNEAALREAG

SEQ ID NO: 104208 - protein, 15 aa, Mycobacterium tuberculosis
DTIRHNEAALREAGQ

SEQ ID NO: 104209 - protein, 15 aa, Mycobacterium tuberculosis
TIRHNEAALREAGQI

SEQ ID NO: 104210 - protein, 15 aa, Mycobacterium tuberculosis
IRHNEAALREAGQIH

SEQ ID NO: 104211 - protein, 15 aa, Mycobacterium tuberculosis
RHNEAALREAGQIHA

SEQ ID NO: 104212 - protein, 15 aa, Mycobacterium tuberculosis
HNEAALREAGQIHAR

SEQ ID NO: 104213 - protein, 15 aa, Mycobacterium tuberculosis
NEAALREAGQIHARH

SEQ ID NO: 104214 - protein, 15 aa, Mycobacterium tuberculosis
EAALREAGQIHARHI

SEQ ID NO: 104215 - protein, 15 aa, Mycobacterium tuberculosis
AALREAGQIHARHIA

SEQ ID NO: 104216 - protein, 15 aa, Mycobacterium tuberculosis
ALREAGQIHARHIAA

SEQ ID NO: 104217 - protein, 15 aa, Mycobacterium tuberculosis
LREAGQIHARHIAAA

SEQ ID NO: 104218 - protein, 15 aa, Mycobacterium tuberculosis
REAGQIHARHIAAAG

SEQ ID NO: 104219 - protein, 15 aa, Mycobacterium tuberculosis
EAGQIHARHIAAAGG

SEQ ID NO: 104220 - protein, 15 aa, Mycobacterium tuberculosis
AGQIHARHIAAAGGD

SEQ ID NO: 104221 - protein, 15 aa, Mycobacterium tuberculosis
GQIHARHIAAAGGDL

SEQ ID NO: 104222 - protein, 16 aa, Mycobacterium tuberculosis
MVEPGRIGGNQTRLAA

SEQ ID NO: 104223 - protein, 16 aa, Mycobacterium tuberculosis
VEPGRIGGNQTRLAAV

SEQ ID NO: 104224 - protein, 16 aa, Mycobacterium tuberculosis
EPGRIGGNQTRLAAVL

SEQ ID NO: 104225 - protein, 16 aa, Mycobacterium tuberculosis
PGRIGGNQTRLAAVLL

SEQ ID NO: 104226 - protein, 16 aa, Mycobacterium tuberculosis
GRIGGNQTRLAAVLLD

SEQ ID NO: 104227 - protein, 16 aa, Mycobacterium tuberculosis
RIGGNQTRLAAVLLDV

SEQ ID NO: 104228 - protein, 16 aa, Mycobacterium tuberculosis
IGGNQTRLAAVLLDVS

SEQ ID NO: 104229 - protein, 16 aa, Mycobacterium tuberculosis
GGNQTRLAAVLLDVST

SEQ ID NO: 104230 - protein, 16 aa, Mycobacterium tuberculosis
GNQTRLAAVLLDVSTP

SEQ ID NO: 104231 - protein, 16 aa, Mycobacterium tuberculosis
NQTRLAAVLLDVSTPN

SEQ ID NO: 104232 - protein, 16 aa, Mycobacterium tuberculosis
QTRLAAVLLDVSTPNT

SEQ ID NO: 104233 - protein, 16 aa, Mycobacterium tuberculosis
TRLAAVLLDVSTPNTL

SEQ ID NO: 104234 - protein, 16 aa, Mycobacterium tuberculosis
RLAAVLLDVSTPNTLN

SEQ ID NO: 104235 - protein, 16 aa, Mycobacterium tuberculosis
LAAVLLDVSTPNTLNA

SEQ ID NO: 104236 - protein, 16 aa, Mycobacterium tuberculosis
AAVLLDVSTPNTLNAD

SEQ ID NO: 104237 - protein, 16 aa, Mycobacterium tuberculosis
AVLLDVSTPNTLNADF

SEQ ID NO: 104238 - protein, 16 aa, Mycobacterium tuberculosis
VLLDVSTPNTLNADFD

SEQ ID NO: 104239 - protein, 16 aa, Mycobacterium tuberculosis
LLDVSTPNTLNADFDL

SEQ ID NO: 104240 - protein, 16 aa, Mycobacterium tuberculosis
LDVSTPNTLNADFDLM

SEQ ID NO: 104241 - protein, 16 aa, Mycobacterium tuberculosis
DVSTPNTLNADFDLMR

SEQ ID NO: 104242 - protein, 16 aa, Mycobacterium tuberculosis
VSTPNTLNADFDLMRS

SEQ ID NO: 104243 - protein, 16 aa, Mycobacterium tuberculosis
STPNTLNADFDLMRSV

SEQ ID NO: 104244 - protein, 16 aa, Mycobacterium tuberculosis
TPNTLNADFDLMRSVA

SEQ ID NO: 104245 - protein, 16 aa, Mycobacterium tuberculosis
PNTLNADFDLMRSVAG

SEQ ID NO: 104246 - protein, 16 aa, Mycobacterium tuberculosis
NTLNADFDLMRSVAGI

SEQ ID NO: 104247 - protein, 16 aa, Mycobacterium tuberculosis
TLNADFDLMRSVAGIT

SEQ ID NO: 104248 - protein, 16 aa, Mycobacterium tuberculosis
LNADFDLMRSVAGITD

SEQ ID NO: 104249 - protein, 16 aa, Mycobacterium tuberculosis
NADFDLMRSVAGITDA

SEQ ID NO: 104250 - protein, 16 aa, Mycobacterium tuberculosis
ADFDLMRSVAGITDAR

SEQ ID NO: 104251 - protein, 16 aa, Mycobacterium tuberculosis
DFDLMRSVAGITDARN

SEQ ID NO: 104252 - protein, 16 aa, Mycobacterium tuberculosis
FDLMRSVAGITDARNE

SEQ ID NO: 104253 - protein, 16 aa, Mycobacterium tuberculosis
DLMRSVAGITDARNEE

SEQ ID NO: 104254 - protein, 16 aa, Mycobacterium tuberculosis
LMRSVAGITDARNEEI

SEQ ID NO: 104255 - protein, 16 aa, Mycobacterium tuberculosis
MRSVAGITDARNEEIR

SEQ ID NO: 104256 - protein, 16 aa, Mycobacterium tuberculosis
RSVAGITDARNEEIRA

SEQ ID NO: 104257 - protein, 16 aa, Mycobacterium tuberculosis
SVAGITDARNEEIRAM

SEQ ID NO: 104258 - protein, 16 aa, Mycobacterium tuberculosis
VAGITDARNEEIRAML

SEQ ID NO: 104259 - protein, 16 aa, Mycobacterium tuberculosis
AGITDARNEEIRAMLQ

SEQ ID NO: 104260 - protein, 16 aa, Mycobacterium tuberculosis
GITDARNEEIRAMLQA

SEQ ID NO: 104261 - protein, 16 aa, Mycobacterium tuberculosis
ITDARNEEIRAMLQAF

SEQ ID NO: 104262 - protein, 16 aa, Mycobacterium tuberculosis
TDARNEEIRAMLQAFI

SEQ ID NO: 104263 - protein, 16 aa, Mycobacterium tuberculosis
DARNEEIRAMLQAFIG

SEQ ID NO: 104264 - protein, 16 aa, Mycobacterium tuberculosis
ARNEEIRAMLQAFIGR

SEQ ID NO: 104265 - protein, 16 aa, Mycobacterium tuberculosis
RNEEIRAMLQAFIGRM

SEQ ID NO: 104266 - protein, 16 aa, Mycobacterium tuberculosis
NEEIRAMLQAFIGRMS

SEQ ID NO: 104267 - protein, 16 aa, Mycobacterium tuberculosis
EEIRAMLQAFIGRMSG

SEQ ID NO: 104268 - protein, 16 aa, Mycobacterium tuberculosis
EIRAMLQAFIGRMSGV

SEQ ID NO: 104269 - protein, 16 aa, Mycobacterium tuberculosis
IRAMLQAFIGRMSGVP

SEQ ID NO: 104270 - protein, 16 aa, Mycobacterium tuberculosis
RAMLQAFIGRMSGVPP

SEQ ID NO: 104271 - protein, 16 aa, Mycobacterium tuberculosis
AMLQAFIGRMSGVPPS

SEQ ID NO: 104272 - protein, 16 aa, Mycobacterium tuberculosis
MLQAFIGRMSGVPPSV

SEQ ID NO: 104273 - protein, 16 aa, Mycobacterium tuberculosis
LQAFIGRMSGVPPSVW

SEQ ID NO: 104274 - protein, 16 aa, Mycobacterium tuberculosis
QAFIGRMSGVPPSVWG

SEQ ID NO: 104275 - protein, 16 aa, Mycobacterium tuberculosis
AFIGRMSGVPPSVWGG

SEQ ID NO: 104276 - protein, 16 aa, Mycobacterium tuberculosis
FIGRMSGVPPSVWGGL

SEQ ID NO: 104277 - protein, 16 aa, Mycobacterium tuberculosis
IGRMSGVPPSVWGGLA

SEQ ID NO: 104278 - protein, 16 aa, Mycobacterium tuberculosis
GRMSGVPPSVWGGLAA

SEQ ID NO: 104279 - protein, 16 aa, Mycobacterium tuberculosis
RMSGVPPSVWGGLAAA

SEQ ID NO: 104280 - protein, 16 aa, Mycobacterium tuberculosis
MSGVPPSVWGGLAAAR

SEQ ID NO: 104281 - protein, 16 aa, Mycobacterium tuberculosis
SGVPPSVWGGLAAARF

SEQ ID NO: 104282 - protein, 16 aa, Mycobacterium tuberculosis
GVPPSVWGGLAAARFQ

SEQ ID NO: 104283 - protein, 16 aa, Mycobacterium tuberculosis
VPPSVWGGLAAARFQD

SEQ ID NO: 104284 - protein, 16 aa, Mycobacterium tuberculosis
PPSVWGGLAAARFQDV

SEQ ID NO: 104285 - protein, 16 aa, Mycobacterium tuberculosis
PSVWGGLAAARFQDVV

SEQ ID NO: 104286 - protein, 16 aa, Mycobacterium tuberculosis
SVWGGLAAARFQDVVD

SEQ ID NO: 104287 - protein, 16 aa, Mycobacterium tuberculosis
VWGGLAAARFQDVVDR

SEQ ID NO: 104288 - protein, 16 aa, Mycobacterium tuberculosis
WGGLAAARFQDVVDRW

SEQ ID NO: 104289 - protein, 16 aa, Mycobacterium tuberculosis
GGLAAARFQDVVDRWN

SEQ ID NO: 104290 - protein, 16 aa, Mycobacterium tuberculosis
GLAAARFQDVVDRWNA

SEQ ID NO: 104291 - protein, 16 aa, Mycobacterium tuberculosis
LAAARFQDVVDRWNAE

SEQ ID NO: 104292 - protein, 16 aa, Mycobacterium tuberculosis
AAARFQDVVDRWNAES

SEQ ID NO: 104293 - protein, 16 aa, Mycobacterium tuberculosis
AARFQDVVDRWNAEST

SEQ ID NO: 104294 - protein, 16 aa, Mycobacterium tuberculosis
ARFQDVVDRWNAESTR

SEQ ID NO: 104295 - protein, 16 aa, Mycobacterium tuberculosis
RFQDVVDRWNAESTRL

SEQ ID NO: 104296 - protein, 16 aa, Mycobacterium tuberculosis
FQDVVDRWNAESTRLY

SEQ ID NO: 104297 - protein, 16 aa, Mycobacterium tuberculosis
QDVVDRWNAESTRLYH

SEQ ID NO: 104298 - protein, 16 aa, Mycobacterium tuberculosis
DVVDRWNAESTRLYHV

SEQ ID NO: 104299 - protein, 16 aa, Mycobacterium tuberculosis
VVDRWNAESTRLYHVL

SEQ ID NO: 104300 - protein, 16 aa, Mycobacterium tuberculosis
VDRWNAESTRLYHVLH

SEQ ID NO: 104301 - protein, 16 aa, Mycobacterium tuberculosis
DRWNAESTRLYHVLHA

SEQ ID NO: 104302 - protein, 16 aa, Mycobacterium tuberculosis
RWNAESTRLYHVLHAI

SEQ ID NO: 104303 - protein, 16 aa, Mycobacterium tuberculosis
WNAESTRLYHVLHAIA

SEQ ID NO: 104304 - protein, 16 aa, Mycobacterium tuberculosis
NAESTRLYHVLHAIAD

SEQ ID NO: 104305 - protein, 16 aa, Mycobacterium tuberculosis
AESTRLYHVLHAIADT

SEQ ID NO: 104306 - protein, 16 aa, Mycobacterium tuberculosis
ESTRLYHVLHAIADTI

SEQ ID NO: 104307 - protein, 16 aa, Mycobacterium tuberculosis
STRLYHVLHAIADTIR

SEQ ID NO: 104308 - protein, 16 aa, Mycobacterium tuberculosis
TRLYHVLHAIADTIRH

SEQ ID NO: 104309 - protein, 16 aa, Mycobacterium tuberculosis
RLYHVLHAIADTIRHN

SEQ ID NO: 104310 - protein, 16 aa, Mycobacterium tuberculosis
LYHVLHAIADTIRHNE

SEQ ID NO: 104311 - protein, 16 aa, Mycobacterium tuberculosis
YHVLHAIADTIRHNEA

SEQ ID NO: 104312 - protein, 16 aa, Mycobacterium tuberculosis
HVLHAIADTIRHNEAA

SEQ ID NO: 104313 - protein, 16 aa, Mycobacterium tuberculosis
VLHAIADTIRHNEAAL

SEQ ID NO: 104314 - protein, 16 aa, Mycobacterium tuberculosis
LHAIADTIRHNEAALR

SEQ ID NO: 104315 - protein, 16 aa, Mycobacterium tuberculosis
HAIADTIRHNEAALRE

SEQ ID NO: 104316 - protein, 16 aa, Mycobacterium tuberculosis
AIADTIRHNEAALREA

SEQ ID NO: 104317 - protein, 16 aa, Mycobacterium tuberculosis
IADTIRHNEAALREAG

SEQ ID NO: 104318 - protein, 16 aa, Mycobacterium tuberculosis
ADTIRHNEAALREAGQ

SEQ ID NO: 104319 - protein, 16 aa, Mycobacterium tuberculosis
DTIRHNEAALREAGQI

SEQ ID NO: 104320 - protein, 16 aa, Mycobacterium tuberculosis
TIRHNEAALREAGQIH

SEQ ID NO: 104321 - protein, 16 aa, Mycobacterium tuberculosis
IRHNEAALREAGQIHA

SEQ ID NO: 104322 - protein, 16 aa, Mycobacterium tuberculosis
RHNEAALREAGQIHAR

SEQ ID NO: 104323 - protein, 16 aa, Mycobacterium tuberculosis
HNEAALREAGQIHARH

SEQ ID NO: 104324 - protein, 16 aa, Mycobacterium tuberculosis
NEAALREAGQIHARHI

SEQ ID NO: 104325 - protein, 16 aa, Mycobacterium tuberculosis
EAALREAGQIHARHIA

SEQ ID NO: 104326 - protein, 16 aa, Mycobacterium tuberculosis
AALREAGQIHARHIAA

SEQ ID NO: 104327 - protein, 16 aa, Mycobacterium tuberculosis
ALREAGQIHARHIAAA

SEQ ID NO: 104328 - protein, 16 aa, Mycobacterium tuberculosis
LREAGQIHARHIAAAG

SEQ ID NO: 104329 - protein, 16 aa, Mycobacterium tuberculosis
REAGQIHARHIAAAGG

SEQ ID NO: 104330 - protein, 16 aa, Mycobacterium tuberculosis
EAGQIHARHIAAAGGD

SEQ ID NO: 104331 - protein, 16 aa, Mycobacterium tuberculosis
AGQIHARHIAAAGGDL

SEQ ID NO: 104332 - protein, 13 aa, Mycobacterium tuberculosis
MSFTAQPEMLAAA

SEQ ID NO: 104333 - protein, 13 aa, Mycobacterium tuberculosis
SFTAQPEMLAAAA

SEQ ID NO: 104334 - protein, 13 aa, Mycobacterium tuberculosis
FTAQPEMLAAAAG

SEQ ID NO: 104335 - protein, 13 aa, Mycobacterium tuberculosis
TAQPEMLAAAAGE

SEQ ID NO: 104336 - protein, 13 aa, Mycobacterium tuberculosis
AQPEMLAAAAGEL

SEQ ID NO: 104337 - protein, 13 aa, Mycobacterium tuberculosis
QPEMLAAAAGELR

SEQ ID NO: 104338 - protein, 13 aa, Mycobacterium tuberculosis
PEMLAAAAGELRS

SEQ ID NO: 104339 - protein, 13 aa, Mycobacterium tuberculosis
EMLAAAAGELRSL

SEQ ID NO: 104340 - protein, 13 aa, Mycobacterium tuberculosis
MLAAAAGELRSLG

SEQ ID NO: 104341 - protein, 13 aa, Mycobacterium tuberculosis
LAAAAGELRSLGA

SEQ ID NO: 104342 - protein, 13 aa, Mycobacterium tuberculosis
AAAAGELRSLGAT

SEQ ID NO: 104343 - protein, 13 aa, Mycobacterium tuberculosis
AAAGELRSLGATL

SEQ ID NO: 104344 - protein, 13 aa, Mycobacterium tuberculosis
AAGELRSLGATLK

SEQ ID NO: 104345 - protein, 13 aa, Mycobacterium tuberculosis
AGELRSLGATLKA

SEQ ID NO: 104346 - protein, 13 aa, Mycobacterium tuberculosis
GELRSLGATLKAS

SEQ ID NO: 104347 - protein, 13 aa, Mycobacterium tuberculosis
ELRSLGATLKASN

SEQ ID NO: 104348 - protein, 13 aa, Mycobacterium tuberculosis
LRSLGATLKASNA

SEQ ID NO: 104349 - protein, 13 aa, Mycobacterium tuberculosis
RSLGATLKASNAA

SEQ ID NO: 104350 - protein, 13 aa, Mycobacterium tuberculosis
SLGATLKASNAAA

SEQ ID NO: 104351 - protein, 13 aa, Mycobacterium tuberculosis
LGATLKASNAAAA

SEQ ID NO: 104352 - protein, 13 aa, Mycobacterium tuberculosis
GATLKASNAAAAV

SEQ ID NO: 104353 - protein, 13 aa, Mycobacterium tuberculosis
ATLKASNAAAAVP

SEQ ID NO: 104354 - protein, 13 aa, Mycobacterium tuberculosis
TLKASNAAAAVPT

SEQ ID NO: 104355 - protein, 13 aa, Mycobacterium tuberculosis
LKASNAAAAVPTT

SEQ ID NO: 104356 - protein, 13 aa, Mycobacterium tuberculosis
KASNAAAAVPTTG

SEQ ID NO: 104357 - protein, 13 aa, Mycobacterium tuberculosis
ASNAAAAVPTTGV

SEQ ID NO: 104358 - protein, 13 aa, Mycobacterium tuberculosis
SNAAAAVPTTGVV

SEQ ID NO: 104359 - protein, 13 aa, Mycobacterium tuberculosis
NAAAAVPTTGVVP

SEQ ID NO: 104360 - protein, 13 aa, Mycobacterium tuberculosis
AAAAVPTTGVVPP

SEQ ID NO: 104361 - protein, 13 aa, Mycobacterium tuberculosis
AAAVPTTGVVPPA

SEQ ID NO: 104362 - protein, 13 aa, Mycobacterium tuberculosis
AAVPTTGVVPPAA

SEQ ID NO: 104363 - protein, 13 aa, Mycobacterium tuberculosis
AVPTTGVVPPAAD

SEQ ID NO: 104364 - protein, 13 aa, Mycobacterium tuberculosis
VPTTGVVPPAADE

SEQ ID NO: 104365 - protein, 13 aa, Mycobacterium tuberculosis
PTTGVVPPAADEV

SEQ ID NO: 104366 - protein, 13 aa, Mycobacterium tuberculosis
TTGVVPPAADEVS

SEQ ID NO: 104367 - protein, 13 aa, Mycobacterium tuberculosis
TGVVPPAADEVSL

SEQ ID NO: 104368 - protein, 13 aa, Mycobacterium tuberculosis
GVVPPAADEVSLL

SEQ ID NO: 104369 - protein, 13 aa, Mycobacterium tuberculosis
VVPPAADEVSLLL

SEQ ID NO: 104370 - protein, 13 aa, Mycobacterium tuberculosis
VPPAADEVSLLLA

SEQ ID NO: 104371 - protein, 13 aa, Mycobacterium tuberculosis
PPAADEVSLLLAT

SEQ ID NO: 104372 - protein, 13 aa, Mycobacterium tuberculosis
PAADEVSLLLATQ

SEQ ID NO: 104373 - protein, 13 aa, Mycobacterium tuberculosis
AADEVSLLLATQF

SEQ ID NO: 104374 - protein, 13 aa, Mycobacterium tuberculosis
ADEVSLLLATQFR

SEQ ID NO: 104375 - protein, 13 aa, Mycobacterium tuberculosis
DEVSLLLATQFRT

SEQ ID NO: 104376 - protein, 13 aa, Mycobacterium tuberculosis
EVSLLLATQFRTH

SEQ ID NO: 104377 - protein, 13 aa, Mycobacterium tuberculosis
VSLLLATQFRTHA

SEQ ID NO: 104378 - protein, 13 aa, Mycobacterium tuberculosis
SLLLATQFRTHAA

SEQ ID NO: 104379 - protein, 13 aa, Mycobacterium tuberculosis
LLLATQFRTHAAT

SEQ ID NO: 104380 - protein, 13 aa, Mycobacterium tuberculosis
LLATQFRTHAATY

SEQ ID NO: 104381 - protein, 13 aa, Mycobacterium tuberculosis
LATQFRTHAATYQ

SEQ ID NO: 104382 - protein, 13 aa, Mycobacterium tuberculosis
ATQFRTHAATYQT

SEQ ID NO: 104383 - protein, 13 aa, Mycobacterium tuberculosis
TQFRTHAATYQTA

SEQ ID NO: 104384 - protein, 13 aa, Mycobacterium tuberculosis
QFRTHAATYQTAS

SEQ ID NO: 104385 - protein, 13 aa, Mycobacterium tuberculosis
FRTHAATYQTASA

SEQ ID NO: 104386 - protein, 13 aa, Mycobacterium tuberculosis
RTHAATYQTASAK

SEQ ID NO: 104387 - protein, 13 aa, Mycobacterium tuberculosis
THAATYQTASAKA

SEQ ID NO: 104388 - protein, 13 aa, Mycobacterium tuberculosis
HAATYQTASAKAA

SEQ ID NO: 104389 - protein, 13 aa, Mycobacterium tuberculosis
AATYQTASAKAAV

SEQ ID NO: 104390 - protein, 13 aa, Mycobacterium tuberculosis
ATYQTASAKAAVI

SEQ ID NO: 104391 - protein, 13 aa, Mycobacterium tuberculosis
TYQTASAKAAVIH

SEQ ID NO: 104392 - protein, 13 aa, Mycobacterium tuberculosis
YQTASAKAAVIHE

SEQ ID NO: 104393 - protein, 13 aa, Mycobacterium tuberculosis
QTASAKAAVIHEQ

SEQ ID NO: 104394 - protein, 13 aa, Mycobacterium tuberculosis
TASAKAAVIHEQF

SEQ ID NO: 104395 - protein, 13 aa, Mycobacterium tuberculosis
ASAKAAVIHEQFV

SEQ ID NO: 104396 - protein, 13 aa, Mycobacterium tuberculosis
SAKAAVIHEQFVT

SEQ ID NO: 104397 - protein, 13 aa, Mycobacterium tuberculosis
AKAAVIHEQFVTT

SEQ ID NO: 104398 - protein, 13 aa, Mycobacterium tuberculosis
KAAVIHEQFVTTL

SEQ ID NO: 104399 - protein, 13 aa, Mycobacterium tuberculosis
AAVIHEQFVTTLA

SEQ ID NO: 104400 - protein, 13 aa, Mycobacterium tuberculosis
AVIHEQFVTTLAT

SEQ ID NO: 104401 - protein, 13 aa, Mycobacterium tuberculosis
VIHEQFVTTLATS

SEQ ID NO: 104402 - protein, 13 aa, Mycobacterium tuberculosis
IHEQFVTTLATSA

SEQ ID NO: 104403 - protein, 13 aa, Mycobacterium tuberculosis
HEQFVTTLATSAS

SEQ ID NO: 104404 - protein, 13 aa, Mycobacterium tuberculosis
EQFVTTLATSASS

SEQ ID NO: 104405 - protein, 13 aa, Mycobacterium tuberculosis
QFVTTLATSASSY

SEQ ID NO: 104406 - protein, 13 aa, Mycobacterium tuberculosis
FVTTLATSASSYA

SEQ ID NO: 104407 - protein, 13 aa, Mycobacterium tuberculosis
VTTLATSASSYAD

SEQ ID NO: 104408 - protein, 13 aa, Mycobacterium tuberculosis
TTLATSASSYADT

SEQ ID NO: 104409 - protein, 13 aa, Mycobacterium tuberculosis
TLATSASSYADTE

SEQ ID NO: 104410 - protein, 13 aa, Mycobacterium tuberculosis
LATSASSYADTEA

SEQ ID NO: 104411 - protein, 13 aa, Mycobacterium tuberculosis
ATSASSYADTEAA

SEQ ID NO: 104412 - protein, 13 aa, Mycobacterium tuberculosis
TSASSYADTEAAN

SEQ ID NO: 104413 - protein, 13 aa, Mycobacterium tuberculosis
SASSYADTEAANA

SEQ ID NO: 104414 - protein, 13 aa, Mycobacterium tuberculosis
ASSYADTEAANAV

SEQ ID NO: 104415 - protein, 13 aa, Mycobacterium tuberculosis
SSYADTEAANAVV

SEQ ID NO: 104416 - protein, 13 aa, Mycobacterium tuberculosis
SYADTEAANAVVT

SEQ ID NO: 104417 - protein, 13 aa, Mycobacterium tuberculosis
YADTEAANAVVTG

SEQ ID NO: 104418 - protein, 14 aa, Mycobacterium tuberculosis
MSFTAQPEMLAAAA

SEQ ID NO: 104419 - protein, 14 aa, Mycobacterium tuberculosis
SFTAQPEMLAAAAG

SEQ ID NO: 104420 - protein, 14 aa, Mycobacterium tuberculosis
FTAQPEMLAAAAGE

SEQ ID NO: 104421 - protein, 14 aa, Mycobacterium tuberculosis
TAQPEMLAAAAGEL

SEQ ID NO: 104422 - protein, 14 aa, Mycobacterium tuberculosis
AQPEMLAAAAGELR

SEQ ID NO: 104423 - protein, 14 aa, Mycobacterium tuberculosis
QPEMLAAAAGELRS

SEQ ID NO: 104424 - protein, 14 aa, Mycobacterium tuberculosis
PEMLAAAAGELRSL

SEQ ID NO: 104425 - protein, 14 aa, Mycobacterium tuberculosis
EMLAAAAGELRSLG

SEQ ID NO: 104426 - protein, 14 aa, Mycobacterium tuberculosis
MLAAAAGELRSLGA

SEQ ID NO: 104427 - protein, 14 aa, Mycobacterium tuberculosis
LAAAAGELRSLGAT

SEQ ID NO: 104428 - protein, 14 aa, Mycobacterium tuberculosis
AAAAGELRSLGATL

SEQ ID NO: 104429 - protein, 14 aa, Mycobacterium tuberculosis
AAAGELRSLGATLK

SEQ ID NO: 104430 - protein, 14 aa, Mycobacterium tuberculosis
AAGELRSLGATLKA

SEQ ID NO: 104431 - protein, 14 aa, Mycobacterium tuberculosis
AGELRSLGATLKAS

SEQ ID NO: 104432 - protein, 14 aa, Mycobacterium tuberculosis
GELRSLGATLKASN

SEQ ID NO: 104433 - protein, 14 aa, Mycobacterium tuberculosis
ELRSLGATLKASNA

SEQ ID NO: 104434 - protein, 14 aa, Mycobacterium tuberculosis
LRSLGATLKASNAA

SEQ ID NO: 104435 - protein, 14 aa, Mycobacterium tuberculosis
RSLGATLKASNAAA

SEQ ID NO: 104436 - protein, 14 aa, Mycobacterium tuberculosis
SLGATLKASNAAAA

SEQ ID NO: 104437 - protein, 14 aa, Mycobacterium tuberculosis
LGATLKASNAAAAV

SEQ ID NO: 104438 - protein, 14 aa, Mycobacterium tuberculosis
GATLKASNAAAAVP

SEQ ID NO: 104439 - protein, 14 aa, Mycobacterium tuberculosis
ATLKASNAAAAVPT

SEQ ID NO: 104440 - protein, 14 aa, Mycobacterium tuberculosis
TLKASNAAAAVPTT

SEQ ID NO: 104441 - protein, 14 aa, Mycobacterium tuberculosis
LKASNAAAAVPTTG

SEQ ID NO: 104442 - protein, 14 aa, Mycobacterium tuberculosis
KASNAAAAVPTTGV

SEQ ID NO: 104443 - protein, 14 aa, Mycobacterium tuberculosis
ASNAAAAVPTTGVV

SEQ ID NO: 104444 - protein, 14 aa, Mycobacterium tuberculosis
SNAAAAVPTTGVVP

SEQ ID NO: 104445 - protein, 14 aa, Mycobacterium tuberculosis
NAAAAVPTTGVVPP

SEQ ID NO: 104446 - protein, 14 aa, Mycobacterium tuberculosis
AAAAVPTTGVVPPA

SEQ ID NO: 104447 - protein, 14 aa, Mycobacterium tuberculosis
AAAVPTTGVVPPAA

SEQ ID NO: 104448 - protein, 14 aa, Mycobacterium tuberculosis
AAVPTTGVVPPAAD

SEQ ID NO: 104449 - protein, 14 aa, Mycobacterium tuberculosis
AVPTTGVVPPAADE

SEQ ID NO: 104450 - protein, 14 aa, Mycobacterium tuberculosis
VPTTGVVPPAADEV

SEQ ID NO: 104451 - protein, 14 aa, Mycobacterium tuberculosis
PTTGVVPPAADEVS

SEQ ID NO: 104452 - protein, 14 aa, Mycobacterium tuberculosis
TTGVVPPAADEVSL

SEQ ID NO: 104453 - protein, 14 aa, Mycobacterium tuberculosis
TGVVPPAADEVSLL

SEQ ID NO: 104454 - protein, 14 aa, Mycobacterium tuberculosis
GVVPPAADEVSLLL

SEQ ID NO: 104455 - protein, 14 aa, Mycobacterium tuberculosis
VVPPAADEVSLLLA

SEQ ID NO: 104456 - protein, 14 aa, Mycobacterium tuberculosis
VPPAADEVSLLLAT

SEQ ID NO: 104457 - protein, 14 aa, Mycobacterium tuberculosis
PPAADEVSLLLATQ

SEQ ID NO: 104458 - protein, 14 aa, Mycobacterium tuberculosis
PAADEVSLLLATQF

SEQ ID NO: 104459 - protein, 14 aa, Mycobacterium tuberculosis
AADEVSLLLATQFR

SEQ ID NO: 104460 - protein, 14 aa, Mycobacterium tuberculosis
ADEVSLLLATQFRT

SEQ ID NO: 104461 - protein, 14 aa, Mycobacterium tuberculosis
DEVSLLLATQFRTH

SEQ ID NO: 104462 - protein, 14 aa, Mycobacterium tuberculosis
EVSLLLATQFRTHA

SEQ ID NO: 104463 - protein, 14 aa, Mycobacterium tuberculosis
VSLLLATQFRTHAA

SEQ ID NO: 104464 - protein, 14 aa, Mycobacterium tuberculosis
SLLLATQFRTHAAT

SEQ ID NO: 104465 - protein, 14 aa, Mycobacterium tuberculosis
LLLATQFRTHAATY

SEQ ID NO: 104466 - protein, 14 aa, Mycobacterium tuberculosis
LLATQFRTHAATYQ

SEQ ID NO: 104467 - protein, 14 aa, Mycobacterium tuberculosis
LATQFRTHAATYQT

SEQ ID NO: 104468 - protein, 14 aa, Mycobacterium tuberculosis
ATQFRTHAATYQTA

SEQ ID NO: 104469 - protein, 14 aa, Mycobacterium tuberculosis
TQFRTHAATYQTAS

SEQ ID NO: 104470 - protein, 14 aa, Mycobacterium tuberculosis
QFRTHAATYQTASA

SEQ ID NO: 104471 - protein, 14 aa, Mycobacterium tuberculosis
FRTHAATYQTASAK

SEQ ID NO: 104472 - protein, 14 aa, Mycobacterium tuberculosis
RTHAATYQTASAKA

SEQ ID NO: 104473 - protein, 14 aa, Mycobacterium tuberculosis
THAATYQTASAKAA

SEQ ID NO: 104474 - protein, 14 aa, Mycobacterium tuberculosis
HAATYQTASAKAAV

SEQ ID NO: 104475 - protein, 14 aa, Mycobacterium tuberculosis
AATYQTASAKAAVI

SEQ ID NO: 104476 - protein, 14 aa, Mycobacterium tuberculosis
ATYQTASAKAAVIH

SEQ ID NO: 104477 - protein, 14 aa, Mycobacterium tuberculosis
TYQTASAKAAVIHE

SEQ ID NO: 104478 - protein, 14 aa, Mycobacterium tuberculosis
YQTASAKAAVIHEQ

SEQ ID NO: 104479 - protein, 14 aa, Mycobacterium tuberculosis
QTASAKAAVIHEQF

SEQ ID NO: 104480 - protein, 14 aa, Mycobacterium tuberculosis
TASAKAAVIHEQFV

SEQ ID NO: 104481 - protein, 14 aa, Mycobacterium tuberculosis
ASAKAAVIHEQFVT

SEQ ID NO: 104482 - protein, 14 aa, Mycobacterium tuberculosis
SAKAAVIHEQFVTT

SEQ ID NO: 104483 - protein, 14 aa, Mycobacterium tuberculosis
AKAAVIHEQFVTTL

SEQ ID NO: 104484 - protein, 14 aa, Mycobacterium tuberculosis
KAAVIHEQFVTTLA

SEQ ID NO: 104485 - protein, 14 aa, Mycobacterium tuberculosis
AAVIHEQFVTTLAT

SEQ ID NO: 104486 - protein, 14 aa, Mycobacterium tuberculosis
AVIHEQFVTTLATS

SEQ ID NO: 104487 - protein, 14 aa, Mycobacterium tuberculosis
VIHEQFVTTLATSA

SEQ ID NO: 104488 - protein, 14 aa, Mycobacterium tuberculosis
IHEQFVTTLATSAS

SEQ ID NO: 104489 - protein, 14 aa, Mycobacterium tuberculosis
HEQFVTTLATSASS

SEQ ID NO: 104490 - protein, 14 aa, Mycobacterium tuberculosis
EQFVTTLATSASSY

SEQ ID NO: 104491 - protein, 14 aa, Mycobacterium tuberculosis
QFVTTLATSASSYA

SEQ ID NO: 104492 - protein, 14 aa, Mycobacterium tuberculosis
FVTTLATSASSYAD

SEQ ID NO: 104493 - protein, 14 aa, Mycobacterium tuberculosis
VTTLATSASSYADT

SEQ ID NO: 104494 - protein, 14 aa, Mycobacterium tuberculosis
TTLATSASSYADTE

SEQ ID NO: 104495 - protein, 14 aa, Mycobacterium tuberculosis
TLATSASSYADTEA

SEQ ID NO: 104496 - protein, 14 aa, Mycobacterium tuberculosis
LATSASSYADTEAA

SEQ ID NO: 104497 - protein, 14 aa, Mycobacterium tuberculosis
ATSASSYADTEAAN

SEQ ID NO: 104498 - protein, 14 aa, Mycobacterium tuberculosis
TSASSYADTEAANA

SEQ ID NO: 104499 - protein, 14 aa, Mycobacterium tuberculosis
SASSYADTEAANAV

SEQ ID NO: 104500 - protein, 14 aa, Mycobacterium tuberculosis
ASSYADTEAANAVV

SEQ ID NO: 104501 - protein, 14 aa, Mycobacterium tuberculosis
SSYADTEAANAVVT

SEQ ID NO: 104502 - protein, 14 aa, Mycobacterium tuberculosis
SYADTEAANAVVTG

SEQ ID NO: 104503 - protein, 15 aa, Mycobacterium tuberculosis
MSFTAQPEMLAAAAG

SEQ ID NO: 104504 - protein, 15 aa, Mycobacterium tuberculosis
SFTAQPEMLAAAAGE

SEQ ID NO: 104505 - protein, 15 aa, Mycobacterium tuberculosis
FTAQPEMLAAAAGEL

SEQ ID NO: 104506 - protein, 15 aa, Mycobacterium tuberculosis
TAQPEMLAAAAGELR

SEQ ID NO: 104507 - protein, 15 aa, Mycobacterium tuberculosis
AQPEMLAAAAGELRS

SEQ ID NO: 104508 - protein, 15 aa, Mycobacterium tuberculosis
QPEMLAAAAGELRSL

SEQ ID NO: 104509 - protein, 15 aa, Mycobacterium tuberculosis
PEMLAAAAGELRSLG

SEQ ID NO: 104510 - protein, 15 aa, Mycobacterium tuberculosis
EMLAAAAGELRSLGA

SEQ ID NO: 104511 - protein, 15 aa, Mycobacterium tuberculosis
MLAAAAGELRSLGAT

SEQ ID NO: 104512 - protein, 15 aa, Mycobacterium tuberculosis
LAAAAGELRSLGATL

SEQ ID NO: 104513 - protein, 15 aa, Mycobacterium tuberculosis
AAAAGELRSLGATLK

SEQ ID NO: 104514 - protein, 15 aa, Mycobacterium tuberculosis
AAAGELRSLGATLKA

SEQ ID NO: 104515 - protein, 15 aa, Mycobacterium tuberculosis
AAGELRSLGATLKAS

SEQ ID NO: 104516 - protein, 15 aa, Mycobacterium tuberculosis
AGELRSLGATLKASN

SEQ ID NO: 104517 - protein, 15 aa, Mycobacterium tuberculosis
GELRSLGATLKASNA

SEQ ID NO: 104518 - protein, 15 aa, Mycobacterium tuberculosis
ELRSLGATLKASNAA

SEQ ID NO: 104519 - protein, 15 aa, Mycobacterium tuberculosis
LRSLGATLKASNAAA

SEQ ID NO: 104520 - protein, 15 aa, Mycobacterium tuberculosis
RSLGATLKASNAAAA

SEQ ID NO: 104521 - protein, 15 aa, Mycobacterium tuberculosis
SLGATLKASNAAAAV

SEQ ID NO: 104522 - protein, 15 aa, Mycobacterium tuberculosis
LGATLKASNAAAAVP

SEQ ID NO: 104523 - protein, 15 aa, Mycobacterium tuberculosis
GATLKASNAAAAVPT

SEQ ID NO: 104524 - protein, 15 aa, Mycobacterium tuberculosis
ATLKASNAAAAVPTT

SEQ ID NO: 104525 - protein, 15 aa, Mycobacterium tuberculosis
TLKASNAAAAVPTTG

SEQ ID NO: 104526 - protein, 15 aa, Mycobacterium tuberculosis
LKASNAAAAVPTTGV

SEQ ID NO: 104527 - protein, 15 aa, Mycobacterium tuberculosis
KASNAAAAVPTTGVV

SEQ ID NO: 104528 - protein, 15 aa, Mycobacterium tuberculosis
ASNAAAAVPTTGVVP

SEQ ID NO: 104529 - protein, 15 aa, Mycobacterium tuberculosis
SNAAAAVPTTGVVPP

SEQ ID NO: 104530 - protein, 15 aa, Mycobacterium tuberculosis
NAAAAVPTTGVVPPA

SEQ ID NO: 104531 - protein, 15 aa, Mycobacterium tuberculosis
AAAAVPTTGVVPPAA

SEQ ID NO: 104532 - protein, 15 aa, Mycobacterium tuberculosis
AAAVPTTGVVPPAAD

SEQ ID NO: 104533 - protein, 15 aa, Mycobacterium tuberculosis
AAVPTTGVVPPAADE

SEQ ID NO: 104534 - protein, 15 aa, Mycobacterium tuberculosis
AVPTTGVVPPAADEV

SEQ ID NO: 104535 - protein, 15 aa, Mycobacterium tuberculosis
VPTTGVVPPAADEVS

SEQ ID NO: 104536 - protein, 15 aa, Mycobacterium tuberculosis
PTTGVVPPAADEVSL

SEQ ID NO: 104537 - protein, 15 aa, Mycobacterium tuberculosis
TTGVVPPAADEVSLL

SEQ ID NO: 104538 - protein, 15 aa, Mycobacterium tuberculosis
TGVVPPAADEVSLLL

SEQ ID NO: 104539 - protein, 15 aa, Mycobacterium tuberculosis
GVVPPAADEVSLLLA

SEQ ID NO: 104540 - protein, 15 aa, Mycobacterium tuberculosis
VVPPAADEVSLLLAT

SEQ ID NO: 104541 - protein, 15 aa, Mycobacterium tuberculosis
VPPAADEVSLLLATQ

SEQ ID NO: 104542 - protein, 15 aa, Mycobacterium tuberculosis
PPAADEVSLLLATQF

SEQ ID NO: 104543 - protein, 15 aa, Mycobacterium tuberculosis
PAADEVSLLLATQFR

SEQ ID NO: 104544 - protein, 15 aa, Mycobacterium tuberculosis
AADEVSLLLATQFRT

SEQ ID NO: 104545 - protein, 15 aa, Mycobacterium tuberculosis
ADEVSLLLATQFRTH

SEQ ID NO: 104546 - protein, 15 aa, Mycobacterium tuberculosis
DEVSLLLATQFRTHA

SEQ ID NO: 104547 - protein, 15 aa, Mycobacterium tuberculosis
EVSLLLATQFRTHAA

SEQ ID NO: 104548 - protein, 15 aa, Mycobacterium tuberculosis
VSLLLATQFRTHAAT

SEQ ID NO: 104549 - protein, 15 aa, Mycobacterium tuberculosis
SLLLATQFRTHAATY

SEQ ID NO: 104550 - protein, 15 aa, Mycobacterium tuberculosis
LLLATQFRTHAATYQ

SEQ ID NO: 104551 - protein, 15 aa, Mycobacterium tuberculosis
LLATQFRTHAATYQT

SEQ ID NO: 104552 - protein, 15 aa, Mycobacterium tuberculosis
LATQFRTHAATYQTA

SEQ ID NO: 104553 - protein, 15 aa, Mycobacterium tuberculosis
ATQFRTHAATYQTAS

SEQ ID NO: 104554 - protein, 15 aa, Mycobacterium tuberculosis
TQFRTHAATYQTASA

SEQ ID NO: 104555 - protein, 15 aa, Mycobacterium tuberculosis
QFRTHAATYQTASAK

SEQ ID NO: 104556 - protein, 15 aa, Mycobacterium tuberculosis
FRTHAATYQTASAKA

SEQ ID NO: 104557 - protein, 15 aa, Mycobacterium tuberculosis
RTHAATYQTASAKAA

SEQ ID NO: 104558 - protein, 15 aa, Mycobacterium tuberculosis
THAATYQTASAKAAV

SEQ ID NO: 104559 - protein, 15 aa, Mycobacterium tuberculosis
HAATYQTASAKAAVI

SEQ ID NO: 104560 - protein, 15 aa, Mycobacterium tuberculosis
AATYQTASAKAAVIH

SEQ ID NO: 104561 - protein, 15 aa, Mycobacterium tuberculosis
ATYQTASAKAAVIHE

SEQ ID NO: 104562 - protein, 15 aa, Mycobacterium tuberculosis
TYQTASAKAAVIHEQ

SEQ ID NO: 104563 - protein, 15 aa, Mycobacterium tuberculosis
YQTASAKAAVIHEQF

SEQ ID NO: 104564 - protein, 15 aa, Mycobacterium tuberculosis
QTASAKAAVIHEQFV

SEQ ID NO: 104565 - protein, 15 aa, Mycobacterium tuberculosis
TASAKAAVIHEQFVT

SEQ ID NO: 104566 - protein, 15 aa, Mycobacterium tuberculosis
ASAKAAVIHEQFVTT

SEQ ID NO: 104567 - protein, 15 aa, Mycobacterium tuberculosis
SAKAAVIHEQFVTTL

SEQ ID NO: 104568 - protein, 15 aa, Mycobacterium tuberculosis
AKAAVIHEQFVTTLA

SEQ ID NO: 104569 - protein, 15 aa, Mycobacterium tuberculosis
KAAVIHEQFVTTLAT

SEQ ID NO: 104570 - protein, 15 aa, Mycobacterium tuberculosis
AAVIHEQFVTTLATS

SEQ ID NO: 104571 - protein, 15 aa, Mycobacterium tuberculosis
AVIHEQFVTTLATSA

SEQ ID NO: 104572 - protein, 15 aa, Mycobacterium tuberculosis
VIHEQFVTTLATSAS

SEQ ID NO: 104573 - protein, 15 aa, Mycobacterium tuberculosis
IHEQFVTTLATSASS

SEQ ID NO: 104574 - protein, 15 aa, Mycobacterium tuberculosis
HEQFVTTLATSASSY

SEQ ID NO: 104575 - protein, 15 aa, Mycobacterium tuberculosis
EQFVTTLATSASSYA

SEQ ID NO: 104576 - protein, 15 aa, Mycobacterium tuberculosis
QFVTTLATSASSYAD

SEQ ID NO: 104577 - protein, 15 aa, Mycobacterium tuberculosis
FVTTLATSASSYADT

SEQ ID NO: 104578 - protein, 15 aa, Mycobacterium tuberculosis
VTTLATSASSYADTE

SEQ ID NO: 104579 - protein, 15 aa, Mycobacterium tuberculosis
TTLATSASSYADTEA

SEQ ID NO: 104580 - protein, 15 aa, Mycobacterium tuberculosis
TLATSASSYADTEAA

SEQ ID NO: 104581 - protein, 15 aa, Mycobacterium tuberculosis
LATSASSYADTEAAN

SEQ ID NO: 104582 - protein, 15 aa, Mycobacterium tuberculosis
ATSASSYADTEAANA

SEQ ID NO: 104583 - protein, 15 aa, Mycobacterium tuberculosis
TSASSYADTEAANAV

SEQ ID NO: 104584 - protein, 15 aa, Mycobacterium tuberculosis
SASSYADTEAANAVV

SEQ ID NO: 104585 - protein, 15 aa, Mycobacterium tuberculosis
ASSYADTEAANAVVT

SEQ ID NO: 104586 - protein, 15 aa, Mycobacterium tuberculosis
SSYADTEAANAVVTG

SEQ ID NO: 104587 - protein, 16 aa, Mycobacterium tuberculosis
MSFTAQPEMLAAAAGE

SEQ ID NO: 104588 - protein, 16 aa, Mycobacterium tuberculosis
SFTAQPEMLAAAAGEL

SEQ ID NO: 104589 - protein, 16 aa, Mycobacterium tuberculosis
FTAQPEMLAAAAGELR

SEQ ID NO: 104590 - protein, 16 aa, Mycobacterium tuberculosis
TAQPEMLAAAAGELRS

SEQ ID NO: 104591 - protein, 16 aa, Mycobacterium tuberculosis
AQPEMLAAAAGELRSL

SEQ ID NO: 104592 - protein, 16 aa, Mycobacterium tuberculosis
QPEMLAAAAGELRSLG

SEQ ID NO: 104593 - protein, 16 aa, Mycobacterium tuberculosis
PEMLAAAAGELRSLGA

SEQ ID NO: 104594 - protein, 16 aa, Mycobacterium tuberculosis
EMLAAAAGELRSLGAT

SEQ ID NO: 104595 - protein, 16 aa, Mycobacterium tuberculosis
MLAAAAGELRSLGATL

SEQ ID NO: 104596 - protein, 16 aa, Mycobacterium tuberculosis
LAAAAGELRSLGATLK

SEQ ID NO: 104597 - protein, 16 aa, Mycobacterium tuberculosis
AAAAGELRSLGATLKA

SEQ ID NO: 104598 - protein, 16 aa, Mycobacterium tuberculosis
AAAGELRSLGATLKAS

SEQ ID NO: 104599 - protein, 16 aa, Mycobacterium tuberculosis
AAGELRSLGATLKASN

SEQ ID NO: 104600 - protein, 16 aa, Mycobacterium tuberculosis
AGELRSLGATLKASNA

SEQ ID NO: 104601 - protein, 16 aa, Mycobacterium tuberculosis
GELRSLGATLKASNAA

SEQ ID NO: 104602 - protein, 16 aa, Mycobacterium tuberculosis
ELRSLGATLKASNAAA

SEQ ID NO: 104603 - protein, 16 aa, Mycobacterium tuberculosis
LRSLGATLKASNAAAA

SEQ ID NO: 104604 - protein, 16 aa, Mycobacterium tuberculosis
RSLGATLKASNAAAAV

SEQ ID NO: 104605 - protein, 16 aa, Mycobacterium tuberculosis
SLGATLKASNAAAAVP

SEQ ID NO: 104606 - protein, 16 aa, Mycobacterium tuberculosis
LGATLKASNAAAAVPT

SEQ ID NO: 104607 - protein, 16 aa, Mycobacterium tuberculosis
GATLKASNAAAAVPTT

SEQ ID NO: 104608 - protein, 16 aa, Mycobacterium tuberculosis
ATLKASNAAAAVPTTG

SEQ ID NO: 104609 - protein, 16 aa, Mycobacterium tuberculosis
TLKASNAAAAVPTTGV

SEQ ID NO: 104610 - protein, 16 aa, Mycobacterium tuberculosis
LKASNAAAAVPTTGVV

SEQ ID NO: 104611 - protein, 16 aa, Mycobacterium tuberculosis
KASNAAAAVPTTGVVP

SEQ ID NO: 104612 - protein, 16 aa, Mycobacterium tuberculosis
ASNAAAAVPTTGVVPP

SEQ ID NO: 104613 - protein, 16 aa, Mycobacterium tuberculosis
SNAAAAVPTTGVVPPA

SEQ ID NO: 104614 - protein, 16 aa, Mycobacterium tuberculosis
NAAAAVPTTGVVPPAA

SEQ ID NO: 104615 - protein, 16 aa, Mycobacterium tuberculosis
AAAAVPTTGVVPPAAD

SEQ ID NO: 104616 - protein, 16 aa, Mycobacterium tuberculosis
AAAVPTTGVVPPAADE

SEQ ID NO: 104617 - protein, 16 aa, Mycobacterium tuberculosis
AAVPTTGVVPPAADEV

SEQ ID NO: 104618 - protein, 16 aa, Mycobacterium tuberculosis
AVPTTGVVPPAADEVS

SEQ ID NO: 104619 - protein, 16 aa, Mycobacterium tuberculosis
VPTTGVVPPAADEVSL

SEQ ID NO: 104620 - protein, 16 aa, Mycobacterium tuberculosis
PTTGVVPPAADEVSLL

SEQ ID NO: 104621 - protein, 16 aa, Mycobacterium tuberculosis
TTGVVPPAADEVSLLL

SEQ ID NO: 104622 - protein, 16 aa, Mycobacterium tuberculosis
TGVVPPAADEVSLLLA

SEQ ID NO: 104623 - protein, 16 aa, Mycobacterium tuberculosis
GVVPPAADEVSLLLAT

SEQ ID NO: 104624 - protein, 16 aa, Mycobacterium tuberculosis
VVPPAADEVSLLLATQ

SEQ ID NO: 104625 - protein, 16 aa, Mycobacterium tuberculosis
VPPAADEVSLLLATQF

SEQ ID NO: 104626 - protein, 16 aa, Mycobacterium tuberculosis
PPAADEVSLLLATQFR

SEQ ID NO: 104627 - protein, 16 aa, Mycobacterium tuberculosis
PAADEVSLLLATQFRT

SEQ ID NO: 104628 - protein, 16 aa, Mycobacterium tuberculosis
AADEVSLLLATQFRTH

SEQ ID NO: 104629 - protein, 16 aa, Mycobacterium tuberculosis
ADEVSLLLATQFRTHA

SEQ ID NO: 104630 - protein, 16 aa, Mycobacterium tuberculosis
DEVSLLLATQFRTHAA

SEQ ID NO: 104631 - protein, 16 aa, Mycobacterium tuberculosis
EVSLLLATQFRTHAAT

SEQ ID NO: 104632 - protein, 16 aa, Mycobacterium tuberculosis
VSLLLATQFRTHAATY

SEQ ID NO: 104633 - protein, 16 aa, Mycobacterium tuberculosis
SLLLATQFRTHAATYQ

SEQ ID NO: 104634 - protein, 16 aa, Mycobacterium tuberculosis
LLLATQFRTHAATYQT

SEQ ID NO: 104635 - protein, 16 aa, Mycobacterium tuberculosis
LLATQFRTHAATYQTA

SEQ ID NO: 104636 - protein, 16 aa, Mycobacterium tuberculosis
LATQFRTHAATYQTAS

SEQ ID NO: 104637 - protein, 16 aa, Mycobacterium tuberculosis
ATQFRTHAATYQTASA

SEQ ID NO: 104638 - protein, 16 aa, Mycobacterium tuberculosis
TQFRTHAATYQTASAK

SEQ ID NO: 104639 - protein, 16 aa, Mycobacterium tuberculosis
QFRTHAATYQTASAKA

SEQ ID NO: 104640 - protein, 16 aa, Mycobacterium tuberculosis
FRTHAATYQTASAKAA

SEQ ID NO: 104641 - protein, 16 aa, Mycobacterium tuberculosis
RTHAATYQTASAKAAV

SEQ ID NO: 104642 - protein, 16 aa, Mycobacterium tuberculosis
THAATYQTASAKAAVI

SEQ ID NO: 104643 - protein, 16 aa, Mycobacterium tuberculosis
HAATYQTASAKAAVIH

SEQ ID NO: 104644 - protein, 16 aa, Mycobacterium tuberculosis
AATYQTASAKAAVIHE

SEQ ID NO: 104645 - protein, 16 aa, Mycobacterium tuberculosis
ATYQTASAKAAVIHEQ

SEQ ID NO: 104646 - protein, 16 aa, Mycobacterium tuberculosis
TYQTASAKAAVIHEQF

SEQ ID NO: 104647 - protein, 16 aa, Mycobacterium tuberculosis
YQTASAKAAVIHEQFV

SEQ ID NO: 104648 - protein, 16 aa, Mycobacterium tuberculosis
QTASAKAAVIHEQFVT

SEQ ID NO: 104649 - protein, 16 aa, Mycobacterium tuberculosis
TASAKAAVIHEQFVTT

SEQ ID NO: 104650 - protein, 16 aa, Mycobacterium tuberculosis
ASAKAAVIHEQFVTTL

SEQ ID NO: 104651 - protein, 16 aa, Mycobacterium tuberculosis
SAKAAVIHEQFVTTLA

SEQ ID NO: 104652 - protein, 16 aa, Mycobacterium tuberculosis
AKAAVIHEQFVTTLAT

SEQ ID NO: 104653 - protein, 16 aa, Mycobacterium tuberculosis
KAAVIHEQFVTTLATS

SEQ ID NO: 104654 - protein, 16 aa, Mycobacterium tuberculosis
AAVIHEQFVTTLATSA

SEQ ID NO: 104655 - protein, 16 aa, Mycobacterium tuberculosis
AVIHEQFVTTLATSAS

SEQ ID NO: 104656 - protein, 16 aa, Mycobacterium tuberculosis
VIHEQFVTTLATSASS

SEQ ID NO: 104657 - protein, 16 aa, Mycobacterium tuberculosis
IHEQFVTTLATSASSY

SEQ ID NO: 104658 - protein, 16 aa, Mycobacterium tuberculosis
HEQFVTTLATSASSYA

SEQ ID NO: 104659 - protein, 16 aa, Mycobacterium tuberculosis
EQFVTTLATSASSYAD

SEQ ID NO: 104660 - protein, 16 aa, Mycobacterium tuberculosis
QFVTTLATSASSYADT

SEQ ID NO: 104661 - protein, 16 aa, Mycobacterium tuberculosis
FVTTLATSASSYADTE

SEQ ID NO: 104662 - protein, 16 aa, Mycobacterium tuberculosis
VTTLATSASSYADTEA

SEQ ID NO: 104663 - protein, 16 aa, Mycobacterium tuberculosis
TTLATSASSYADTEAA

SEQ ID NO: 104664 - protein, 16 aa, Mycobacterium tuberculosis
TLATSASSYADTEAAN

SEQ ID NO: 104665 - protein, 16 aa, Mycobacterium tuberculosis
LATSASSYADTEAANA

SEQ ID NO: 104666 - protein, 16 aa, Mycobacterium tuberculosis
ATSASSYADTEAANAV

SEQ ID NO: 104667 - protein, 16 aa, Mycobacterium tuberculosis
TSASSYADTEAANAVV

SEQ ID NO: 104668 - protein, 16 aa, Mycobacterium tuberculosis
SASSYADTEAANAVVT

SEQ ID NO: 104669 - protein, 16 aa, Mycobacterium tuberculosis
ASSYADTEAANAVVTG

SEQ ID NO: 104670 - protein, 13 aa, Mycobacterium tuberculosis
MTINYQFGDVDAH

SEQ ID NO: 104671 - protein, 13 aa, Mycobacterium tuberculosis
TINYQFGDVDAHG

SEQ ID NO: 104672 - protein, 13 aa, Mycobacterium tuberculosis
INYQFGDVDAHGA

SEQ ID NO: 104673 - protein, 13 aa, Mycobacterium tuberculosis
NYQFGDVDAHGAM

SEQ ID NO: 104674 - protein, 13 aa, Mycobacterium tuberculosis
YQFGDVDAHGAMI

SEQ ID NO: 104675 - protein, 13 aa, Mycobacterium tuberculosis
QFGDVDAHGAMIR

SEQ ID NO: 104676 - protein, 13 aa, Mycobacterium tuberculosis
FGDVDAHGAMIRA

SEQ ID NO: 104677 - protein, 13 aa, Mycobacterium tuberculosis
GDVDAHGAMIRAQ

SEQ ID NO: 104678 - protein, 13 aa, Mycobacterium tuberculosis
DVDAHGAMIRAQA

SEQ ID NO: 104679 - protein, 13 aa, Mycobacterium tuberculosis
VDAHGAMIRAQAG

SEQ ID NO: 104680 - protein, 13 aa, Mycobacterium tuberculosis
DAHGAMIRAQAGS

SEQ ID NO: 104681 - protein, 13 aa, Mycobacterium tuberculosis
AHGAMIRAQAGSL

SEQ ID NO: 104682 - protein, 13 aa, Mycobacterium tuberculosis
HGAMIRAQAGSLE

SEQ ID NO: 104683 - protein, 13 aa, Mycobacterium tuberculosis
GAMIRAQAGSLEA

SEQ ID NO: 104684 - protein, 13 aa, Mycobacterium tuberculosis
AMIRAQAGSLEAE

SEQ ID NO: 104685 - protein, 13 aa, Mycobacterium tuberculosis
MIRAQAGSLEAEH

SEQ ID NO: 104686 - protein, 13 aa, Mycobacterium tuberculosis
IRAQAGSLEAEHQ

SEQ ID NO: 104687 - protein, 13 aa, Mycobacterium tuberculosis
RAQAGSLEAEHQA

SEQ ID NO: 104688 - protein, 13 aa, Mycobacterium tuberculosis
AQAGSLEAEHQAI

SEQ ID NO: 104689 - protein, 13 aa, Mycobacterium tuberculosis
QAGSLEAEHQAII

SEQ ID NO: 104690 - protein, 13 aa, Mycobacterium tuberculosis
AGSLEAEHQAIIS

SEQ ID NO: 104691 - protein, 13 aa, Mycobacterium tuberculosis
GSLEAEHQAIISD

SEQ ID NO: 104692 - protein, 13 aa, Mycobacterium tuberculosis
SLEAEHQAIISDV

SEQ ID NO: 104693 - protein, 13 aa, Mycobacterium tuberculosis
LEAEHQAIISDVL

SEQ ID NO: 104694 - protein, 13 aa, Mycobacterium tuberculosis
EAEHQAIISDVLT

SEQ ID NO: 104695 - protein, 13 aa, Mycobacterium tuberculosis
AEHQAIISDVLTA

SEQ ID NO: 104696 - protein, 13 aa, Mycobacterium tuberculosis
EHQAIISDVLTAS

SEQ ID NO: 104697 - protein, 13 aa, Mycobacterium tuberculosis
HQAIISDVLTASD

SEQ ID NO: 104698 - protein, 13 aa, Mycobacterium tuberculosis
QAIISDVLTASDF

SEQ ID NO: 104699 - protein, 13 aa, Mycobacterium tuberculosis
AIISDVLTASDFW

SEQ ID NO: 104700 - protein, 13 aa, Mycobacterium tuberculosis
IISDVLTASDFWG

SEQ ID NO: 104701 - protein, 13 aa, Mycobacterium tuberculosis
ISDVLTASDFWGG

SEQ ID NO: 104702 - protein, 13 aa, Mycobacterium tuberculosis
SDVLTASDFWGGA

SEQ ID NO: 104703 - protein, 13 aa, Mycobacterium tuberculosis
DVLTASDFWGGAG

SEQ ID NO: 104704 - protein, 13 aa, Mycobacterium tuberculosis
VLTASDFWGGAGS

SEQ ID NO: 104705 - protein, 13 aa, Mycobacterium tuberculosis
LTASDFWGGAGSA

SEQ ID NO: 104706 - protein, 13 aa, Mycobacterium tuberculosis
TASDFWGGAGSAA

SEQ ID NO: 104707 - protein, 13 aa, Mycobacterium tuberculosis
ASDFWGGAGSAAC

SEQ ID NO: 104708 - protein, 13 aa, Mycobacterium tuberculosis
SDFWGGAGSAACQ

SEQ ID NO: 104709 - protein, 13 aa, Mycobacterium tuberculosis
DFWGGAGSAACQG

SEQ ID NO: 104710 - protein, 13 aa, Mycobacterium tuberculosis
FWGGAGSAACQGF

SEQ ID NO: 104711 - protein, 13 aa, Mycobacterium tuberculosis
WGGAGSAACQGFI

SEQ ID NO: 104712 - protein, 13 aa, Mycobacterium tuberculosis
GGAGSAACQGFIT

SEQ ID NO: 104713 - protein, 13 aa, Mycobacterium tuberculosis
GAGSAACQGFITQ

SEQ ID NO: 104714 - protein, 13 aa, Mycobacterium tuberculosis
AGSAACQGFITQL

SEQ ID NO: 104715 - protein, 13 aa, Mycobacterium tuberculosis
GSAACQGFITQLG

SEQ ID NO: 104716 - protein, 13 aa, Mycobacterium tuberculosis
SAACQGFITQLGR

SEQ ID NO: 104717 - protein, 13 aa, Mycobacterium tuberculosis
AACQGFITQLGRN

SEQ ID NO: 104718 - protein, 13 aa, Mycobacterium tuberculosis
ACQGFITQLGRNF

SEQ ID NO: 104719 - protein, 13 aa, Mycobacterium tuberculosis
CQGFITQLGRNFQ

SEQ ID NO: 104720 - protein, 13 aa, Mycobacterium tuberculosis
QGFITQLGRNFQV

SEQ ID NO: 104721 - protein, 13 aa, Mycobacterium tuberculosis
GFITQLGRNFQVI

SEQ ID NO: 104722 - protein, 13 aa, Mycobacterium tuberculosis
FITQLGRNFQVIY

SEQ ID NO: 104723 - protein, 13 aa, Mycobacterium tuberculosis
ITQLGRNFQVIYE

SEQ ID NO: 104724 - protein, 13 aa, Mycobacterium tuberculosis
TQLGRNFQVIYEQ

SEQ ID NO: 104725 - protein, 13 aa, Mycobacterium tuberculosis
QLGRNFQVIYEQA

SEQ ID NO: 104726 - protein, 13 aa, Mycobacterium tuberculosis
LGRNFQVIYEQAN

SEQ ID NO: 104727 - protein, 13 aa, Mycobacterium tuberculosis
GRNFQVIYEQANA

SEQ ID NO: 104728 - protein, 13 aa, Mycobacterium tuberculosis
RNFQVIYEQANAH

SEQ ID NO: 104729 - protein, 13 aa, Mycobacterium tuberculosis
NFQVIYEQANAHG

SEQ ID NO: 104730 - protein, 13 aa, Mycobacterium tuberculosis
FQVIYEQANAHGQ

SEQ ID NO: 104731 - protein, 13 aa, Mycobacterium tuberculosis
QVIYEQANAHGQK

SEQ ID NO: 104732 - protein, 13 aa, Mycobacterium tuberculosis
VIYEQANAHGQKV

SEQ ID NO: 104733 - protein, 13 aa, Mycobacterium tuberculosis
IYEQANAHGQKVQ

SEQ ID NO: 104734 - protein, 13 aa, Mycobacterium tuberculosis
YEQANAHGQKVQA

SEQ ID NO: 104735 - protein, 13 aa, Mycobacterium tuberculosis
EQANAHGQKVQAA

SEQ ID NO: 104736 - protein, 13 aa, Mycobacterium tuberculosis
QANAHGQKVQAAG

SEQ ID NO: 104737 - protein, 13 aa, Mycobacterium tuberculosis
ANAHGQKVQAAGN

SEQ ID NO: 104738 - protein, 13 aa, Mycobacterium tuberculosis
NAHGQKVQAAGNN

SEQ ID NO: 104739 - protein, 13 aa, Mycobacterium tuberculosis
AHGQKVQAAGNNM

SEQ ID NO: 104740 - protein, 13 aa, Mycobacterium tuberculosis
HGQKVQAAGNNMA

SEQ ID NO: 104741 - protein, 13 aa, Mycobacterium tuberculosis
GQKVQAAGNNMAQ

SEQ ID NO: 104742 - protein, 13 aa, Mycobacterium tuberculosis
QKVQAAGNNMAQT

SEQ ID NO: 104743 - protein, 13 aa, Mycobacterium tuberculosis
KVQAAGNNMAQTD

SEQ ID NO: 104744 - protein, 13 aa, Mycobacterium tuberculosis
VQAAGNNMAQTDS

SEQ ID NO: 104745 - protein, 13 aa, Mycobacterium tuberculosis
QAAGNNMAQTDSA

SEQ ID NO: 104746 - protein, 13 aa, Mycobacterium tuberculosis
AAGNNMAQTDSAV

SEQ ID NO: 104747 - protein, 13 aa, Mycobacterium tuberculosis
AGNNMAQTDSAVG

SEQ ID NO: 104748 - protein, 13 aa, Mycobacterium tuberculosis
GNNMAQTDSAVGS

SEQ ID NO: 104749 - protein, 13 aa, Mycobacterium tuberculosis
NNMAQTDSAVGSS

SEQ ID NO: 104750 - protein, 13 aa, Mycobacterium tuberculosis
NMAQTDSAVGSSW

SEQ ID NO: 104751 - protein, 13 aa, Mycobacterium tuberculosis
MAQTDSAVGSSWA

SEQ ID NO: 104752 - protein, 14 aa, Mycobacterium tuberculosis
MTINYQFGDVDAHG

SEQ ID NO: 104753 - protein, 14 aa, Mycobacterium tuberculosis
TINYQFGDVDAHGA

SEQ ID NO: 104754 - protein, 14 aa, Mycobacterium tuberculosis
INYQFGDVDAHGAM

SEQ ID NO: 104755 - protein, 14 aa, Mycobacterium tuberculosis
NYQFGDVDAHGAMI

SEQ ID NO: 104756 - protein, 14 aa, Mycobacterium tuberculosis
YQFGDVDAHGAMIR

SEQ ID NO: 104757 - protein, 14 aa, Mycobacterium tuberculosis
QFGDVDAHGAMIRA

SEQ ID NO: 104758 - protein, 14 aa, Mycobacterium tuberculosis
FGDVDAHGAMIRAQ

SEQ ID NO: 104759 - protein, 14 aa, Mycobacterium tuberculosis
GDVDAHGAMIRAQA

SEQ ID NO: 104760 - protein, 14 aa, Mycobacterium tuberculosis
DVDAHGAMIRAQAG

SEQ ID NO: 104761 - protein, 14 aa, Mycobacterium tuberculosis
VDAHGAMIRAQAGS

SEQ ID NO: 104762 - protein, 14 aa, Mycobacterium tuberculosis
DAHGAMIRAQAGSL

SEQ ID NO: 104763 - protein, 14 aa, Mycobacterium tuberculosis
AHGAMIRAQAGSLE

SEQ ID NO: 104764 - protein, 14 aa, Mycobacterium tuberculosis
HGAMIRAQAGSLEA

SEQ ID NO: 104765 - protein, 14 aa, Mycobacterium tuberculosis
GAMIRAQAGSLEAE

SEQ ID NO: 104766 - protein, 14 aa, Mycobacterium tuberculosis
AMIRAQAGSLEAEH

SEQ ID NO: 104767 - protein, 14 aa, Mycobacterium tuberculosis
MIRAQAGSLEAEHQ

SEQ ID NO: 104768 - protein, 14 aa, Mycobacterium tuberculosis
IRAQAGSLEAEHQA

SEQ ID NO: 104769 - protein, 14 aa, Mycobacterium tuberculosis
RAQAGSLEAEHQAI

SEQ ID NO: 104770 - protein, 14 aa, Mycobacterium tuberculosis
AQAGSLEAEHQAII

SEQ ID NO: 104771 - protein, 14 aa, Mycobacterium tuberculosis
QAGSLEAEHQAIIS

SEQ ID NO: 104772 - protein, 14 aa, Mycobacterium tuberculosis
AGSLEAEHQAIISD

SEQ ID NO: 104773 - protein, 14 aa, Mycobacterium tuberculosis
GSLEAEHQAIISDV

SEQ ID NO: 104774 - protein, 14 aa, Mycobacterium tuberculosis
SLEAEHQAIISDVL

SEQ ID NO: 104775 - protein, 14 aa, Mycobacterium tuberculosis
LEAEHQAIISDVLT

SEQ ID NO: 104776 - protein, 14 aa, Mycobacterium tuberculosis
EAEHQAIISDVLTA

SEQ ID NO: 104777 - protein, 14 aa, Mycobacterium tuberculosis
AEHQAIISDVLTAS

SEQ ID NO: 104778 - protein, 14 aa, Mycobacterium tuberculosis
EHQAIISDVLTASD

SEQ ID NO: 104779 - protein, 14 aa, Mycobacterium tuberculosis
HQAIISDVLTASDF

SEQ ID NO: 104780 - protein, 14 aa, Mycobacterium tuberculosis
QAIISDVLTASDFW

SEQ ID NO: 104781 - protein, 14 aa, Mycobacterium tuberculosis
AIISDVLTASDFWG

SEQ ID NO: 104782 - protein, 14 aa, Mycobacterium tuberculosis
IISDVLTASDFWGG

SEQ ID NO: 104783 - protein, 14 aa, Mycobacterium tuberculosis
ISDVLTASDFWGGA

SEQ ID NO: 104784 - protein, 14 aa, Mycobacterium tuberculosis
SDVLTASDFWGGAG

SEQ ID NO: 104785 - protein, 14 aa, Mycobacterium tuberculosis
DVLTASDFWGGAGS

SEQ ID NO: 104786 - protein, 14 aa, Mycobacterium tuberculosis
VLTASDFWGGAGSA

SEQ ID NO: 104787 - protein, 14 aa, Mycobacterium tuberculosis
LTASDFWGGAGSAA

SEQ ID NO: 104788 - protein, 14 aa, Mycobacterium tuberculosis
TASDFWGGAGSAAC

SEQ ID NO: 104789 - protein, 14 aa, Mycobacterium tuberculosis
ASDFWGGAGSAACQ

SEQ ID NO: 104790 - protein, 14 aa, Mycobacterium tuberculosis
SDFWGGAGSAACQG

SEQ ID NO: 104791 - protein, 14 aa, Mycobacterium tuberculosis
DFWGGAGSAACQGF

SEQ ID NO: 104792 - protein, 14 aa, Mycobacterium tuberculosis
FWGGAGSAACQGFI

SEQ ID NO: 104793 - protein, 14 aa, Mycobacterium tuberculosis
WGGAGSAACQGFIT

SEQ ID NO: 104794 - protein, 14 aa, Mycobacterium tuberculosis
GGAGSAACQGFITQ

SEQ ID NO: 104795 - protein, 14 aa, Mycobacterium tuberculosis
GAGSAACQGFITQL

SEQ ID NO: 104796 - protein, 14 aa, Mycobacterium tuberculosis
AGSAACQGFITQLG

SEQ ID NO: 104797 - protein, 14 aa, Mycobacterium tuberculosis
GSAACQGFITQLGR

SEQ ID NO: 104798 - protein, 14 aa, Mycobacterium tuberculosis
SAACQGFITQLGRN

SEQ ID NO: 104799 - protein, 14 aa, Mycobacterium tuberculosis
AACQGFITQLGRNF

SEQ ID NO: 104800 - protein, 14 aa, Mycobacterium tuberculosis
ACQGFITQLGRNFQ

SEQ ID NO: 104801 - protein, 14 aa, Mycobacterium tuberculosis
CQGFITQLGRNFQV

SEQ ID NO: 104802 - protein, 14 aa, Mycobacterium tuberculosis
QGFITQLGRNFQVI

SEQ ID NO: 104803 - protein, 14 aa, Mycobacterium tuberculosis
GFITQLGRNFQVIY

SEQ ID NO: 104804 - protein, 14 aa, Mycobacterium tuberculosis
FITQLGRNFQVIYE

SEQ ID NO: 104805 - protein, 14 aa, Mycobacterium tuberculosis
ITQLGRNFQVIYEQ

SEQ ID NO: 104806 - protein, 14 aa, Mycobacterium tuberculosis
TQLGRNFQVIYEQA

SEQ ID NO: 104807 - protein, 14 aa, Mycobacterium tuberculosis
QLGRNFQVIYEQAN

SEQ ID NO: 104808 - protein, 14 aa, Mycobacterium tuberculosis
LGRNFQVIYEQANA

SEQ ID NO: 104809 - protein, 14 aa, Mycobacterium tuberculosis
GRNFQVIYEQANAH

SEQ ID NO: 104810 - protein, 14 aa, Mycobacterium tuberculosis
RNFQVIYEQANAHG

SEQ ID NO: 104811 - protein, 14 aa, Mycobacterium tuberculosis
NFQVIYEQANAHGQ

SEQ ID NO: 104812 - protein, 14 aa, Mycobacterium tuberculosis
FQVIYEQANAHGQK

SEQ ID NO: 104813 - protein, 14 aa, Mycobacterium tuberculosis
QVIYEQANAHGQKV

SEQ ID NO: 104814 - protein, 14 aa, Mycobacterium tuberculosis
VIYEQANAHGQKVQ

SEQ ID NO: 104815 - protein, 14 aa, Mycobacterium tuberculosis
IYEQANAHGQKVQA

SEQ ID NO: 104816 - protein, 14 aa, Mycobacterium tuberculosis
YEQANAHGQKVQAA

SEQ ID NO: 104817 - protein, 14 aa, Mycobacterium tuberculosis
EQANAHGQKVQAAG

SEQ ID NO: 104818 - protein, 14 aa, Mycobacterium tuberculosis
QANAHGQKVQAAGN

SEQ ID NO: 104819 - protein, 14 aa, Mycobacterium tuberculosis
ANAHGQKVQAAGNN

SEQ ID NO: 104820 - protein, 14 aa, Mycobacterium tuberculosis
NAHGQKVQAAGNNM

SEQ ID NO: 104821 - protein, 14 aa, Mycobacterium tuberculosis
AHGQKVQAAGNNMA

SEQ ID NO: 104822 - protein, 14 aa, Mycobacterium tuberculosis
HGQKVQAAGNNMAQ

SEQ ID NO: 104823 - protein, 14 aa, Mycobacterium tuberculosis
GQKVQAAGNNMAQT

SEQ ID NO: 104824 - protein, 14 aa, Mycobacterium tuberculosis
QKVQAAGNNMAQTD

SEQ ID NO: 104825 - protein, 14 aa, Mycobacterium tuberculosis
KVQAAGNNMAQTDS

SEQ ID NO: 104826 - protein, 14 aa, Mycobacterium tuberculosis
VQAAGNNMAQTDSA

SEQ ID NO: 104827 - protein, 14 aa, Mycobacterium tuberculosis
QAAGNNMAQTDSAV

SEQ ID NO: 104828 - protein, 14 aa, Mycobacterium tuberculosis
AAGNNMAQTDSAVG

SEQ ID NO: 104829 - protein, 14 aa, Mycobacterium tuberculosis
AGNNMAQTDSAVGS

SEQ ID NO: 104830 - protein, 14 aa, Mycobacterium tuberculosis
GNNMAQTDSAVGSS

SEQ ID NO: 104831 - protein, 14 aa, Mycobacterium tuberculosis
NNMAQTDSAVGSSW

SEQ ID NO: 104832 - protein, 14 aa, Mycobacterium tuberculosis
NMAQTDSAVGSSWA

SEQ ID NO: 104833 - protein, 15 aa, Mycobacterium tuberculosis
MTINYQFGDVDAHGA

SEQ ID NO: 104834 - protein, 15 aa, Mycobacterium tuberculosis
TINYQFGDVDAHGAM

SEQ ID NO: 104835 - protein, 15 aa, Mycobacterium tuberculosis
INYQFGDVDAHGAMI

SEQ ID NO: 104836 - protein, 15 aa, Mycobacterium tuberculosis
NYQFGDVDAHGAMIR

SEQ ID NO: 104837 - protein, 15 aa, Mycobacterium tuberculosis
YQFGDVDAHGAMIRA

SEQ ID NO: 104838 - protein, 15 aa, Mycobacterium tuberculosis
QFGDVDAHGAMIRAQ

SEQ ID NO: 104839 - protein, 15 aa, Mycobacterium tuberculosis
FGDVDAHGAMIRAQA

SEQ ID NO: 104840 - protein, 15 aa, Mycobacterium tuberculosis
GDVDAHGAMIRAQAG

SEQ ID NO: 104841 - protein, 15 aa, Mycobacterium tuberculosis
DVDAHGAMIRAQAGS

SEQ ID NO: 104842 - protein, 15 aa, Mycobacterium tuberculosis
VDAHGAMIRAQAGSL

SEQ ID NO: 104843 - protein, 15 aa, Mycobacterium tuberculosis
DAHGAMIRAQAGSLE

SEQ ID NO: 104844 - protein, 15 aa, Mycobacterium tuberculosis
AHGAMIRAQAGSLEA

SEQ ID NO: 104845 - protein, 15 aa, Mycobacterium tuberculosis
HGAMIRAQAGSLEAE

SEQ ID NO: 104846 - protein, 15 aa, Mycobacterium tuberculosis
GAMIRAQAGSLEAEH

SEQ ID NO: 104847 - protein, 15 aa, Mycobacterium tuberculosis
AMIRAQAGSLEAEHQ

SEQ ID NO: 104848 - protein, 15 aa, Mycobacterium tuberculosis
MIRAQAGSLEAEHQA

SEQ ID NO: 104849 - protein, 15 aa, Mycobacterium tuberculosis
IRAQAGSLEAEHQAI

SEQ ID NO: 104850 - protein, 15 aa, Mycobacterium tuberculosis
RAQAGSLEAEHQAII

SEQ ID NO: 104851 - protein, 15 aa, Mycobacterium tuberculosis
AQAGSLEAEHQAIIS

SEQ ID NO: 104852 - protein, 15 aa, Mycobacterium tuberculosis
QAGSLEAEHQAIISD

SEQ ID NO: 104853 - protein, 15 aa, Mycobacterium tuberculosis
AGSLEAEHQAIISDV

SEQ ID NO: 104854 - protein, 15 aa, Mycobacterium tuberculosis
GSLEAEHQAIISDVL

SEQ ID NO: 104855 - protein, 15 aa, Mycobacterium tuberculosis
SLEAEHQAIISDVLT

SEQ ID NO: 104856 - protein, 15 aa, Mycobacterium tuberculosis
LEAEHQAIISDVLTA

SEQ ID NO: 104857 - protein, 15 aa, Mycobacterium tuberculosis
EAEHQAIISDVLTAS

SEQ ID NO: 104858 - protein, 15 aa, Mycobacterium tuberculosis
AEHQAIISDVLTASD

SEQ ID NO: 104859 - protein, 15 aa, Mycobacterium tuberculosis
EHQAIISDVLTASDF

SEQ ID NO: 104860 - protein, 15 aa, Mycobacterium tuberculosis
HQAIISDVLTASDFW

SEQ ID NO: 104861 - protein, 15 aa, Mycobacterium tuberculosis
QAIISDVLTASDFWG

SEQ ID NO: 104862 - protein, 15 aa, Mycobacterium tuberculosis
AIISDVLTASDFWGG

SEQ ID NO: 104863 - protein, 15 aa, Mycobacterium tuberculosis
IISDVLTASDFWGGA

SEQ ID NO: 104864 - protein, 15 aa, Mycobacterium tuberculosis
ISDVLTASDFWGGAG

SEQ ID NO: 104865 - protein, 15 aa, Mycobacterium tuberculosis
SDVLTASDFWGGAGS

SEQ ID NO: 104866 - protein, 15 aa, Mycobacterium tuberculosis
DVLTASDFWGGAGSA

SEQ ID NO: 104867 - protein, 15 aa, Mycobacterium tuberculosis
VLTASDFWGGAGSAA

SEQ ID NO: 104868 - protein, 15 aa, Mycobacterium tuberculosis
LTASDFWGGAGSAAC

SEQ ID NO: 104869 - protein, 15 aa, Mycobacterium tuberculosis
TASDFWGGAGSAACQ

SEQ ID NO: 104870 - protein, 15 aa, Mycobacterium tuberculosis
ASDFWGGAGSAACQG

SEQ ID NO: 104871 - protein, 15 aa, Mycobacterium tuberculosis
SDFWGGAGSAACQGF

SEQ ID NO: 104872 - protein, 15 aa, Mycobacterium tuberculosis
DFWGGAGSAACQGFI

SEQ ID NO: 104873 - protein, 15 aa, Mycobacterium tuberculosis
FWGGAGSAACQGFIT

SEQ ID NO: 104874 - protein, 15 aa, Mycobacterium tuberculosis
WGGAGSAACQGFITQ

SEQ ID NO: 104875 - protein, 15 aa, Mycobacterium tuberculosis
GGAGSAACQGFITQL

SEQ ID NO: 104876 - protein, 15 aa, Mycobacterium tuberculosis
GAGSAACQGFITQLG

SEQ ID NO: 104877 - protein, 15 aa, Mycobacterium tuberculosis
AGSAACQGFITQLGR

SEQ ID NO: 104878 - protein, 15 aa, Mycobacterium tuberculosis
GSAACQGFITQLGRN

SEQ ID NO: 104879 - protein, 15 aa, Mycobacterium tuberculosis
SAACQGFITQLGRNF

SEQ ID NO: 104880 - protein, 15 aa, Mycobacterium tuberculosis
AACQGFITQLGRNFQ

SEQ ID NO: 104881 - protein, 15 aa, Mycobacterium tuberculosis
ACQGFITQLGRNFQV

SEQ ID NO: 104882 - protein, 15 aa, Mycobacterium tuberculosis
CQGFITQLGRNFQVI

SEQ ID NO: 104883 - protein, 15 aa, Mycobacterium tuberculosis
QGFITQLGRNFQVIY

SEQ ID NO: 104884 - protein, 15 aa, Mycobacterium tuberculosis
GFITQLGRNFQVIYE

SEQ ID NO: 104885 - protein, 15 aa, Mycobacterium tuberculosis
FITQLGRNFQVIYEQ

SEQ ID NO: 104886 - protein, 15 aa, Mycobacterium tuberculosis
ITQLGRNFQVIYEQA

SEQ ID NO: 104887 - protein, 15 aa, Mycobacterium tuberculosis
TQLGRNFQVIYEQAN

SEQ ID NO: 104888 - protein, 15 aa, Mycobacterium tuberculosis
QLGRNFQVIYEQANA

SEQ ID NO: 104889 - protein, 15 aa, Mycobacterium tuberculosis
LGRNFQVIYEQANAH

SEQ ID NO: 104890 - protein, 15 aa, Mycobacterium tuberculosis
GRNFQVIYEQANAHG

SEQ ID NO: 104891 - protein, 15 aa, Mycobacterium tuberculosis
RNFQVIYEQANAHGQ

SEQ ID NO: 104892 - protein, 15 aa, Mycobacterium tuberculosis
NFQVIYEQANAHGQK

SEQ ID NO: 104893 - protein, 15 aa, Mycobacterium tuberculosis
FQVIYEQANAHGQKV

SEQ ID NO: 104894 - protein, 15 aa, Mycobacterium tuberculosis
QVIYEQANAHGQKVQ

SEQ ID NO: 104895 - protein, 15 aa, Mycobacterium tuberculosis
VIYEQANAHGQKVQA

SEQ ID NO: 104896 - protein, 15 aa, Mycobacterium tuberculosis
IYEQANAHGQKVQAA

SEQ ID NO: 104897 - protein, 15 aa, Mycobacterium tuberculosis
YEQANAHGQKVQAAG

SEQ ID NO: 104898 - protein, 15 aa, Mycobacterium tuberculosis
EQANAHGQKVQAAGN

SEQ ID NO: 104899 - protein, 15 aa, Mycobacterium tuberculosis
QANAHGQKVQAAGNN

SEQ ID NO: 104900 - protein, 15 aa, Mycobacterium tuberculosis
ANAHGQKVQAAGNNM

SEQ ID NO: 104901 - protein, 15 aa, Mycobacterium tuberculosis
NAHGQKVQAAGNNMA

SEQ ID NO: 104902 - protein, 15 aa, Mycobacterium tuberculosis
AHGQKVQAAGNNMAQ

SEQ ID NO: 104903 - protein, 15 aa, Mycobacterium tuberculosis
HGQKVQAAGNNMAQT

SEQ ID NO: 104904 - protein, 15 aa, Mycobacterium tuberculosis
GQKVQAAGNNMAQTD

SEQ ID NO: 104905 - protein, 15 aa, Mycobacterium tuberculosis
QKVQAAGNNMAQTDS

SEQ ID NO: 104906 - protein, 15 aa, Mycobacterium tuberculosis
KVQAAGNNMAQTDSA

SEQ ID NO: 104907 - protein, 15 aa, Mycobacterium tuberculosis
VQAAGNNMAQTDSAV

SEQ ID NO: 104908 - protein, 15 aa, Mycobacterium tuberculosis
QAAGNNMAQTDSAVG

SEQ ID NO: 104909 - protein, 15 aa, Mycobacterium tuberculosis
AAGNNMAQTDSAVGS

SEQ ID NO: 104910 - protein, 15 aa, Mycobacterium tuberculosis
AGNNMAQTDSAVGSS

SEQ ID NO: 104911 - protein, 15 aa, Mycobacterium tuberculosis
GNNMAQTDSAVGSSW

SEQ ID NO: 104912 - protein, 15 aa, Mycobacterium tuberculosis
NNMAQTDSAVGSSWA

SEQ ID NO: 104913 - protein, 16 aa, Mycobacterium tuberculosis
MTINYQFGDVDAHGAM

SEQ ID NO: 104914 - protein, 16 aa, Mycobacterium tuberculosis
TINYQFGDVDAHGAMI

SEQ ID NO: 104915 - protein, 16 aa, Mycobacterium tuberculosis
INYQFGDVDAHGAMIR

SEQ ID NO: 104916 - protein, 16 aa, Mycobacterium tuberculosis
NYQFGDVDAHGAMIRA

SEQ ID NO: 104917 - protein, 16 aa, Mycobacterium tuberculosis
YQFGDVDAHGAMIRAQ

SEQ ID NO: 104918 - protein, 16 aa, Mycobacterium tuberculosis
QFGDVDAHGAMIRAQA

SEQ ID NO: 104919 - protein, 16 aa, Mycobacterium tuberculosis
FGDVDAHGAMIRAQAG

SEQ ID NO: 104920 - protein, 16 aa, Mycobacterium tuberculosis
GDVDAHGAMIRAQAGS

SEQ ID NO: 104921 - protein, 16 aa, Mycobacterium tuberculosis
DVDAHGAMIRAQAGSL

SEQ ID NO: 104922 - protein, 16 aa, Mycobacterium tuberculosis
VDAHGAMIRAQAGSLE

SEQ ID NO: 104923 - protein, 16 aa, Mycobacterium tuberculosis
DAHGAMIRAQAGSLEA

SEQ ID NO: 104924 - protein, 16 aa, Mycobacterium tuberculosis
AHGAMIRAQAGSLEAE

SEQ ID NO: 104925 - protein, 16 aa, Mycobacterium tuberculosis
HGAMIRAQAGSLEAEH

SEQ ID NO: 104926 - protein, 16 aa, Mycobacterium tuberculosis
GAMIRAQAGSLEAEHQ

SEQ ID NO: 104927 - protein, 16 aa, Mycobacterium tuberculosis
AMIRAQAGSLEAEHQA

SEQ ID NO: 104928 - protein, 16 aa, Mycobacterium tuberculosis
MIRAQAGSLEAEHQAI

SEQ ID NO: 104929 - protein, 16 aa, Mycobacterium tuberculosis
IRAQAGSLEAEHQAII

SEQ ID NO: 104930 - protein, 16 aa, Mycobacterium tuberculosis
RAQAGSLEAEHQAIIS

SEQ ID NO: 104931 - protein, 16 aa, Mycobacterium tuberculosis
AQAGSLEAEHQAIISD

SEQ ID NO: 104932 - protein, 16 aa, Mycobacterium tuberculosis
QAGSLEAEHQAIISDV

SEQ ID NO: 104933 - protein, 16 aa, Mycobacterium tuberculosis
AGSLEAEHQAIISDVL

SEQ ID NO: 104934 - protein, 16 aa, Mycobacterium tuberculosis
GSLEAEHQAIISDVLT

SEQ ID NO: 104935 - protein, 16 aa, Mycobacterium tuberculosis
SLEAEHQAIISDVLTA

SEQ ID NO: 104936 - protein, 16 aa, Mycobacterium tuberculosis
LEAEHQAIISDVLTAS

SEQ ID NO: 104937 - protein, 16 aa, Mycobacterium tuberculosis
EAEHQAIISDVLTASD

SEQ ID NO: 104938 - protein, 16 aa, Mycobacterium tuberculosis
AEHQAIISDVLTASDF

SEQ ID NO: 104939 - protein, 16 aa, Mycobacterium tuberculosis
EHQAIISDVLTASDFW

SEQ ID NO: 104940 - protein, 16 aa, Mycobacterium tuberculosis
HQAIISDVLTASDFWG

SEQ ID NO: 104941 - protein, 16 aa, Mycobacterium tuberculosis
QAIISDVLTASDFWGG

SEQ ID NO: 104942 - protein, 16 aa, Mycobacterium tuberculosis
AIISDVLTASDFWGGA

SEQ ID NO: 104943 - protein, 16 aa, Mycobacterium tuberculosis
IISDVLTASDFWGGAG

SEQ ID NO: 104944 - protein, 16 aa, Mycobacterium tuberculosis
ISDVLTASDFWGGAGS

SEQ ID NO: 104945 - protein, 16 aa, Mycobacterium tuberculosis
SDVLTASDFWGGAGSA

SEQ ID NO: 104946 - protein, 16 aa, Mycobacterium tuberculosis
DVLTASDFWGGAGSAA

SEQ ID NO: 104947 - protein, 16 aa, Mycobacterium tuberculosis
VLTASDFWGGAGSAAC

SEQ ID NO: 104948 - protein, 16 aa, Mycobacterium tuberculosis
LTASDFWGGAGSAACQ

SEQ ID NO: 104949 - protein, 16 aa, Mycobacterium tuberculosis
TASDFWGGAGSAACQG

SEQ ID NO: 104950 - protein, 16 aa, Mycobacterium tuberculosis
ASDFWGGAGSAACQGF

SEQ ID NO: 104951 - protein, 16 aa, Mycobacterium tuberculosis
SDFWGGAGSAACQGFI

SEQ ID NO: 104952 - protein, 16 aa, Mycobacterium tuberculosis
DFWGGAGSAACQGFIT

SEQ ID NO: 104953 - protein, 16 aa, Mycobacterium tuberculosis
FWGGAGSAACQGFITQ

SEQ ID NO: 104954 - protein, 16 aa, Mycobacterium tuberculosis
WGGAGSAACQGFITQL

SEQ ID NO: 104955 - protein, 16 aa, Mycobacterium tuberculosis
GGAGSAACQGFITQLG

SEQ ID NO: 104956 - protein, 16 aa, Mycobacterium tuberculosis
GAGSAACQGFITQLGR

SEQ ID NO: 104957 - protein, 16 aa, Mycobacterium tuberculosis
AGSAACQGFITQLGRN

SEQ ID NO: 104958 - protein, 16 aa, Mycobacterium tuberculosis
GSAACQGFITQLGRNF

SEQ ID NO: 104959 - protein, 16 aa, Mycobacterium tuberculosis
SAACQGFITQLGRNFQ

SEQ ID NO: 104960 - protein, 16 aa, Mycobacterium tuberculosis
AACQGFITQLGRNFQV

SEQ ID NO: 104961 - protein, 16 aa, Mycobacterium tuberculosis
ACQGFITQLGRNFQVI

SEQ ID NO: 104962 - protein, 16 aa, Mycobacterium tuberculosis
CQGFITQLGRNFQVIY

SEQ ID NO: 104963 - protein, 16 aa, Mycobacterium tuberculosis
QGFITQLGRNFQVIYE

SEQ ID NO: 104964 - protein, 16 aa, Mycobacterium tuberculosis
GFITQLGRNFQVIYEQ

SEQ ID NO: 104965 - protein, 16 aa, Mycobacterium tuberculosis
FITQLGRNFQVIYEQA

SEQ ID NO: 104966 - protein, 16 aa, Mycobacterium tuberculosis
ITQLGRNFQVIYEQAN

SEQ ID NO: 104967 - protein, 16 aa, Mycobacterium tuberculosis
TQLGRNFQVIYEQANA

SEQ ID NO: 104968 - protein, 16 aa, Mycobacterium tuberculosis
QLGRNFQVIYEQANAH

SEQ ID NO: 104969 - protein, 16 aa, Mycobacterium tuberculosis
LGRNFQVIYEQANAHG

SEQ ID NO: 104970 - protein, 16 aa, Mycobacterium tuberculosis
GRNFQVIYEQANAHGQ

SEQ ID NO: 104971 - protein, 16 aa, Mycobacterium tuberculosis
RNFQVIYEQANAHGQK

SEQ ID NO: 104972 - protein, 16 aa, Mycobacterium tuberculosis
NFQVIYEQANAHGQKV

SEQ ID NO: 104973 - protein, 16 aa, Mycobacterium tuberculosis
FQVIYEQANAHGQKVQ

SEQ ID NO: 104974 - protein, 16 aa, Mycobacterium tuberculosis
QVIYEQANAHGQKVQA

SEQ ID NO: 104975 - protein, 16 aa, Mycobacterium tuberculosis
VIYEQANAHGQKVQAA

SEQ ID NO: 104976 - protein, 16 aa, Mycobacterium tuberculosis
IYEQANAHGQKVQAAG

SEQ ID NO: 104977 - protein, 16 aa, Mycobacterium tuberculosis
YEQANAHGQKVQAAGN

SEQ ID NO: 104978 - protein, 16 aa, Mycobacterium tuberculosis
EQANAHGQKVQAAGNN

SEQ ID NO: 104979 - protein, 16 aa, Mycobacterium tuberculosis
QANAHGQKVQAAGNNM

SEQ ID NO: 104980 - protein, 16 aa, Mycobacterium tuberculosis
ANAHGQKVQAAGNNMA

SEQ ID NO: 104981 - protein, 16 aa, Mycobacterium tuberculosis
NAHGQKVQAAGNNMAQ

SEQ ID NO: 104982 - protein, 16 aa, Mycobacterium tuberculosis
AHGQKVQAAGNNMAQT

SEQ ID NO: 104983 - protein, 16 aa, Mycobacterium tuberculosis
HGQKVQAAGNNMAQTD

SEQ ID NO: 104984 - protein, 16 aa, Mycobacterium tuberculosis
GQKVQAAGNNMAQTDS

SEQ ID NO: 104985 - protein, 16 aa, Mycobacterium tuberculosis
QKVQAAGNNMAQTDSA

SEQ ID NO: 104986 - protein, 16 aa, Mycobacterium tuberculosis
KVQAAGNNMAQTDSAV

SEQ ID NO: 104987 - protein, 16 aa, Mycobacterium tuberculosis
VQAAGNNMAQTDSAVG

SEQ ID NO: 104988 - protein, 16 aa, Mycobacterium tuberculosis
QAAGNNMAQTDSAVGS

SEQ ID NO: 104989 - protein, 16 aa, Mycobacterium tuberculosis
AAGNNMAQTDSAVGSS

SEQ ID NO: 104990 - protein, 16 aa, Mycobacterium tuberculosis
AGNNMAQTDSAVGSSW

SEQ ID NO: 104991 - protein, 16 aa, Mycobacterium tuberculosis
GNNMAQTDSAVGSSWA

SEQ ID NO: 104992 - protein, 13 aa, Mycobacterium tuberculosis
MTSRFMTDPHAMR

SEQ ID NO: 104993 - protein, 13 aa, Mycobacterium tuberculosis
TSRFMTDPHAMRD

SEQ ID NO: 104994 - protein, 13 aa, Mycobacterium tuberculosis
SRFMTDPHAMRDM

SEQ ID NO: 104995 - protein, 13 aa, Mycobacterium tuberculosis
RFMTDPHAMRDMA

SEQ ID NO: 104996 - protein, 13 aa, Mycobacterium tuberculosis
FMTDPHAMRDMAG

SEQ ID NO: 104997 - protein, 13 aa, Mycobacterium tuberculosis
MTDPHAMRDMAGR

SEQ ID NO: 104998 - protein, 13 aa, Mycobacterium tuberculosis
TDPHAMRDMAGRF

SEQ ID NO: 104999 - protein, 13 aa, Mycobacterium tuberculosis
DPHAMRDMAGRFE

SEQ ID NO: 105000 - protein, 13 aa, Mycobacterium tuberculosis
PHAMRDMAGRFEV

SEQ ID NO: 105001 - protein, 13 aa, Mycobacterium tuberculosis
HAMRDMAGRFEVH

SEQ ID NO: 105002 - protein, 13 aa, Mycobacterium tuberculosis
AMRDMAGRFEVHA

SEQ ID NO: 105003 - protein, 13 aa, Mycobacterium tuberculosis
MRDMAGRFEVHAQ

SEQ ID NO: 105004 - protein, 13 aa, Mycobacterium tuberculosis
RDMAGRFEVHAQT

SEQ ID NO: 105005 - protein, 13 aa, Mycobacterium tuberculosis
DMAGRFEVHAQTV

SEQ ID NO: 105006 - protein, 13 aa, Mycobacterium tuberculosis
MAGRFEVHAQTVE

SEQ ID NO: 105007 - protein, 13 aa, Mycobacterium tuberculosis
AGRFEVHAQTVED

SEQ ID NO: 105008 - protein, 13 aa, Mycobacterium tuberculosis
GRFEVHAQTVEDE

SEQ ID NO: 105009 - protein, 13 aa, Mycobacterium tuberculosis
RFEVHAQTVEDEA

SEQ ID NO: 105010 - protein, 13 aa, Mycobacterium tuberculosis
FEVHAQTVEDEAR

SEQ ID NO: 105011 - protein, 13 aa, Mycobacterium tuberculosis
EVHAQTVEDEARR

SEQ ID NO: 105012 - protein, 13 aa, Mycobacterium tuberculosis
VHAQTVEDEARRM

SEQ ID NO: 105013 - protein, 13 aa, Mycobacterium tuberculosis
HAQTVEDEARRMW

SEQ ID NO: 105014 - protein, 13 aa, Mycobacterium tuberculosis
AQTVEDEARRMWA

SEQ ID NO: 105015 - protein, 13 aa, Mycobacterium tuberculosis
QTVEDEARRMWAS

SEQ ID NO: 105016 - protein, 13 aa, Mycobacterium tuberculosis
TVEDEARRMWASA

SEQ ID NO: 105017 - protein, 13 aa, Mycobacterium tuberculosis
VEDEARRMWASAQ

SEQ ID NO: 105018 - protein, 13 aa, Mycobacterium tuberculosis
EDEARRMWASAQN

SEQ ID NO: 105019 - protein, 13 aa, Mycobacterium tuberculosis
DEARRMWASAQNI

SEQ ID NO: 105020 - protein, 13 aa, Mycobacterium tuberculosis
EARRMWASAQNIS

SEQ ID NO: 105021 - protein, 13 aa, Mycobacterium tuberculosis
ARRMWASAQNISG

SEQ ID NO: 105022 - protein, 13 aa, Mycobacterium tuberculosis
RRMWASAQNISGA

SEQ ID NO: 105023 - protein, 13 aa, Mycobacterium tuberculosis
RMWASAQNISGAG

SEQ ID NO: 105024 - protein, 13 aa, Mycobacterium tuberculosis
MWASAQNISGAGW

SEQ ID NO: 105025 - protein, 13 aa, Mycobacterium tuberculosis
WASAQNISGAGWS

SEQ ID NO: 105026 - protein, 13 aa, Mycobacterium tuberculosis
ASAQNISGAGWSG

SEQ ID NO: 105027 - protein, 13 aa, Mycobacterium tuberculosis
SAQNISGAGWSGM

SEQ ID NO: 105028 - protein, 13 aa, Mycobacterium tuberculosis
AQNISGAGWSGMA

SEQ ID NO: 105029 - protein, 13 aa, Mycobacterium tuberculosis
QNISGAGWSGMAE

SEQ ID NO: 105030 - protein, 13 aa, Mycobacterium tuberculosis
NISGAGWSGMAEA

SEQ ID NO: 105031 - protein, 13 aa, Mycobacterium tuberculosis
ISGAGWSGMAEAT

SEQ ID NO: 105032 - protein, 13 aa, Mycobacterium tuberculosis
SGAGWSGMAEATS

SEQ ID NO: 105033 - protein, 13 aa, Mycobacterium tuberculosis
GAGWSGMAEATSL

SEQ ID NO: 105034 - protein, 13 aa, Mycobacterium tuberculosis
AGWSGMAEATSLD

SEQ ID NO: 105035 - protein, 13 aa, Mycobacterium tuberculosis
GWSGMAEATSLDT

SEQ ID NO: 105036 - protein, 13 aa, Mycobacterium tuberculosis
WSGMAEATSLDTM

SEQ ID NO: 105037 - protein, 13 aa, Mycobacterium tuberculosis
SGMAEATSLDTMT

SEQ ID NO: 105038 - protein, 13 aa, Mycobacterium tuberculosis
GMAEATSLDTMTQ

SEQ ID NO: 105039 - protein, 13 aa, Mycobacterium tuberculosis
MAEATSLDTMTQM

SEQ ID NO: 105040 - protein, 13 aa, Mycobacterium tuberculosis
AEATSLDTMTQMN

SEQ ID NO: 105041 - protein, 13 aa, Mycobacterium tuberculosis
EATSLDTMTQMNQ

SEQ ID NO: 105042 - protein, 13 aa, Mycobacterium tuberculosis
ATSLDTMTQMNQA

SEQ ID NO: 105043 - protein, 13 aa, Mycobacterium tuberculosis
TSLDTMTQMNQAF

SEQ ID NO: 105044 - protein, 13 aa, Mycobacterium tuberculosis
SLDTMTQMNQAFR

SEQ ID NO: 105045 - protein, 13 aa, Mycobacterium tuberculosis
LDTMTQMNQAFRN

SEQ ID NO: 105046 - protein, 13 aa, Mycobacterium tuberculosis
DTMTQMNQAFRNI

SEQ ID NO: 105047 - protein, 13 aa, Mycobacterium tuberculosis
TMTQMNQAFRNIV

SEQ ID NO: 105048 - protein, 13 aa, Mycobacterium tuberculosis
MTQMNQAFRNIVN

SEQ ID NO: 105049 - protein, 13 aa, Mycobacterium tuberculosis
TQMNQAFRNIVNM

SEQ ID NO: 105050 - protein, 13 aa, Mycobacterium tuberculosis
QMNQAFRNIVNML

SEQ ID NO: 105051 - protein, 13 aa, Mycobacterium tuberculosis
MNQAFRNIVNMLH

SEQ ID NO: 105052 - protein, 13 aa, Mycobacterium tuberculosis
NQAFRNIVNMLHG

SEQ ID NO: 105053 - protein, 13 aa, Mycobacterium tuberculosis
QAFRNIVNMLHGV

SEQ ID NO: 105054 - protein, 13 aa, Mycobacterium tuberculosis
AFRNIVNMLHGVR

SEQ ID NO: 105055 - protein, 13 aa, Mycobacterium tuberculosis
FRNIVNMLHGVRD

SEQ ID NO: 105056 - protein, 13 aa, Mycobacterium tuberculosis
RNIVNMLHGVRDG

SEQ ID NO: 105057 - protein, 13 aa, Mycobacterium tuberculosis
NIVNMLHGVRDGL

SEQ ID NO: 105058 - protein, 13 aa, Mycobacterium tuberculosis
IVNMLHGVRDGLV

SEQ ID NO: 105059 - protein, 13 aa, Mycobacterium tuberculosis
VNMLHGVRDGLVR

SEQ ID NO: 105060 - protein, 13 aa, Mycobacterium tuberculosis
NMLHGVRDGLVRD

SEQ ID NO: 105061 - protein, 13 aa, Mycobacterium tuberculosis
MLHGVRDGLVRDA

SEQ ID NO: 105062 - protein, 13 aa, Mycobacterium tuberculosis
LHGVRDGLVRDAN

SEQ ID NO: 105063 - protein, 13 aa, Mycobacterium tuberculosis
HGVRDGLVRDANN

SEQ ID NO: 105064 - protein, 13 aa, Mycobacterium tuberculosis
GVRDGLVRDANNY

SEQ ID NO: 105065 - protein, 13 aa, Mycobacterium tuberculosis
VRDGLVRDANNYE

SEQ ID NO: 105066 - protein, 13 aa, Mycobacterium tuberculosis
RDGLVRDANNYEQ

SEQ ID NO: 105067 - protein, 13 aa, Mycobacterium tuberculosis
DGLVRDANNYEQQ

SEQ ID NO: 105068 - protein, 13 aa, Mycobacterium tuberculosis
GLVRDANNYEQQE

SEQ ID NO: 105069 - protein, 13 aa, Mycobacterium tuberculosis
LVRDANNYEQQEQ

SEQ ID NO: 105070 - protein, 13 aa, Mycobacterium tuberculosis
VRDANNYEQQEQA

SEQ ID NO: 105071 - protein, 13 aa, Mycobacterium tuberculosis
RDANNYEQQEQAS

SEQ ID NO: 105072 - protein, 13 aa, Mycobacterium tuberculosis
DANNYEQQEQASQ

SEQ ID NO: 105073 - protein, 13 aa, Mycobacterium tuberculosis
ANNYEQQEQASQQ

SEQ ID NO: 105074 - protein, 13 aa, Mycobacterium tuberculosis
NNYEQQEQASQQI

SEQ ID NO: 105075 - protein, 13 aa, Mycobacterium tuberculosis
NYEQQEQASQQIL

SEQ ID NO: 105076 - protein, 13 aa, Mycobacterium tuberculosis
YEQQEQASQQILS

SEQ ID NO: 105077 - protein, 13 aa, Mycobacterium tuberculosis
EQQEQASQQILSS

SEQ ID NO: 105078 - protein, 14 aa, Mycobacterium tuberculosis
MTSRFMTDPHAMRD

SEQ ID NO: 105079 - protein, 14 aa, Mycobacterium tuberculosis
TSRFMTDPHAMRDM

SEQ ID NO: 105080 - protein, 14 aa, Mycobacterium tuberculosis
SRFMTDPHAMRDMA

SEQ ID NO: 105081 - protein, 14 aa, Mycobacterium tuberculosis
RFMTDPHAMRDMAG

SEQ ID NO: 105082 - protein, 14 aa, Mycobacterium tuberculosis
FMTDPHAMRDMAGR

SEQ ID NO: 105083 - protein, 14 aa, Mycobacterium tuberculosis
MTDPHAMRDMAGRF

SEQ ID NO: 105084 - protein, 14 aa, Mycobacterium tuberculosis
TDPHAMRDMAGRFE

SEQ ID NO: 105085 - protein, 14 aa, Mycobacterium tuberculosis
DPHAMRDMAGRFEV

SEQ ID NO: 105086 - protein, 14 aa, Mycobacterium tuberculosis
PHAMRDMAGRFEVH

SEQ ID NO: 105087 - protein, 14 aa, Mycobacterium tuberculosis
HAMRDMAGRFEVHA

SEQ ID NO: 105088 - protein, 14 aa, Mycobacterium tuberculosis
AMRDMAGRFEVHAQ

SEQ ID NO: 105089 - protein, 14 aa, Mycobacterium tuberculosis
MRDMAGRFEVHAQT

SEQ ID NO: 105090 - protein, 14 aa, Mycobacterium tuberculosis
RDMAGRFEVHAQTV

SEQ ID NO: 105091 - protein, 14 aa, Mycobacterium tuberculosis
DMAGRFEVHAQTVE

SEQ ID NO: 105092 - protein, 14 aa, Mycobacterium tuberculosis
MAGRFEVHAQTVED

SEQ ID NO: 105093 - protein, 14 aa, Mycobacterium tuberculosis
AGRFEVHAQTVEDE

SEQ ID NO: 105094 - protein, 14 aa, Mycobacterium tuberculosis
GRFEVHAQTVEDEA

SEQ ID NO: 105095 - protein, 14 aa, Mycobacterium tuberculosis
RFEVHAQTVEDEAR

SEQ ID NO: 105096 - protein, 14 aa, Mycobacterium tuberculosis
FEVHAQTVEDEARR

SEQ ID NO: 105097 - protein, 14 aa, Mycobacterium tuberculosis
EVHAQTVEDEARRM

SEQ ID NO: 105098 - protein, 14 aa, Mycobacterium tuberculosis
VHAQTVEDEARRMW

SEQ ID NO: 105099 - protein, 14 aa, Mycobacterium tuberculosis
HAQTVEDEARRMWA

SEQ ID NO: 105100 - protein, 14 aa, Mycobacterium tuberculosis
AQTVEDEARRMWAS

SEQ ID NO: 105101 - protein, 14 aa, Mycobacterium tuberculosis
QTVEDEARRMWASA

SEQ ID NO: 105102 - protein, 14 aa, Mycobacterium tuberculosis
TVEDEARRMWASAQ

SEQ ID NO: 105103 - protein, 14 aa, Mycobacterium tuberculosis
VEDEARRMWASAQN

SEQ ID NO: 105104 - protein, 14 aa, Mycobacterium tuberculosis
EDEARRMWASAQNI

SEQ ID NO: 105105 - protein, 14 aa, Mycobacterium tuberculosis
DEARRMWASAQNIS

SEQ ID NO: 105106 - protein, 14 aa, Mycobacterium tuberculosis
EARRMWASAQNISG

SEQ ID NO: 105107 - protein, 14 aa, Mycobacterium tuberculosis
ARRMWASAQNISGA

SEQ ID NO: 105108 - protein, 14 aa, Mycobacterium tuberculosis
RRMWASAQNISGAG

SEQ ID NO: 105109 - protein, 14 aa, Mycobacterium tuberculosis
RMWASAQNISGAGW

SEQ ID NO: 105110 - protein, 14 aa, Mycobacterium tuberculosis
MWASAQNISGAGWS

SEQ ID NO: 105111 - protein, 14 aa, Mycobacterium tuberculosis
WASAQNISGAGWSG

SEQ ID NO: 105112 - protein, 14 aa, Mycobacterium tuberculosis
ASAQNISGAGWSGM

SEQ ID NO: 105113 - protein, 14 aa, Mycobacterium tuberculosis
SAQNISGAGWSGMA

SEQ ID NO: 105114 - protein, 14 aa, Mycobacterium tuberculosis
AQNISGAGWSGMAE

SEQ ID NO: 105115 - protein, 14 aa, Mycobacterium tuberculosis
QNISGAGWSGMAEA

SEQ ID NO: 105116 - protein, 14 aa, Mycobacterium tuberculosis
NISGAGWSGMAEAT

SEQ ID NO: 105117 - protein, 14 aa, Mycobacterium tuberculosis
ISGAGWSGMAEATS

SEQ ID NO: 105118 - protein, 14 aa, Mycobacterium tuberculosis
SGAGWSGMAEATSL

SEQ ID NO: 105119 - protein, 14 aa, Mycobacterium tuberculosis
GAGWSGMAEATSLD

SEQ ID NO: 105120 - protein, 14 aa, Mycobacterium tuberculosis
AGWSGMAEATSLDT

SEQ ID NO: 105121 - protein, 14 aa, Mycobacterium tuberculosis
GWSGMAEATSLDTM

SEQ ID NO: 105122 - protein, 14 aa, Mycobacterium tuberculosis
WSGMAEATSLDTMT

SEQ ID NO: 105123 - protein, 14 aa, Mycobacterium tuberculosis
SGMAEATSLDTMTQ

SEQ ID NO: 105124 - protein, 14 aa, Mycobacterium tuberculosis
GMAEATSLDTMTQM

SEQ ID NO: 105125 - protein, 14 aa, Mycobacterium tuberculosis
MAEATSLDTMTQMN

SEQ ID NO: 105126 - protein, 14 aa, Mycobacterium tuberculosis
AEATSLDTMTQMNQ

SEQ ID NO: 105127 - protein, 14 aa, Mycobacterium tuberculosis
EATSLDTMTQMNQA

SEQ ID NO: 105128 - protein, 14 aa, Mycobacterium tuberculosis
ATSLDTMTQMNQAF

SEQ ID NO: 105129 - protein, 14 aa, Mycobacterium tuberculosis
TSLDTMTQMNQAFR

SEQ ID NO: 105130 - protein, 14 aa, Mycobacterium tuberculosis
SLDTMTQMNQAFRN

SEQ ID NO: 105131 - protein, 14 aa, Mycobacterium tuberculosis
LDTMTQMNQAFRNI

SEQ ID NO: 105132 - protein, 14 aa, Mycobacterium tuberculosis
DTMTQMNQAFRNIV

SEQ ID NO: 105133 - protein, 14 aa, Mycobacterium tuberculosis
TMTQMNQAFRNIVN

SEQ ID NO: 105134 - protein, 14 aa, Mycobacterium tuberculosis
MTQMNQAFRNIVNM

SEQ ID NO: 105135 - protein, 14 aa, Mycobacterium tuberculosis
TQMNQAFRNIVNML

SEQ ID NO: 105136 - protein, 14 aa, Mycobacterium tuberculosis
QMNQAFRNIVNMLH

SEQ ID NO: 105137 - protein, 14 aa, Mycobacterium tuberculosis
MNQAFRNIVNMLHG

SEQ ID NO: 105138 - protein, 14 aa, Mycobacterium tuberculosis
NQAFRNIVNMLHGV

SEQ ID NO: 105139 - protein, 14 aa, Mycobacterium tuberculosis
QAFRNIVNMLHGVR

SEQ ID NO: 105140 - protein, 14 aa, Mycobacterium tuberculosis
AFRNIVNMLHGVRD

SEQ ID NO: 105141 - protein, 14 aa, Mycobacterium tuberculosis
FRNIVNMLHGVRDG

SEQ ID NO: 105142 - protein, 14 aa, Mycobacterium tuberculosis
RNIVNMLHGVRDGL

SEQ ID NO: 105143 - protein, 14 aa, Mycobacterium tuberculosis
NIVNMLHGVRDGLV

SEQ ID NO: 105144 - protein, 14 aa, Mycobacterium tuberculosis
IVNMLHGVRDGLVR

SEQ ID NO: 105145 - protein, 14 aa, Mycobacterium tuberculosis
VNMLHGVRDGLVRD

SEQ ID NO: 105146 - protein, 14 aa, Mycobacterium tuberculosis
NMLHGVRDGLVRDA

SEQ ID NO: 105147 - protein, 14 aa, Mycobacterium tuberculosis
MLHGVRDGLVRDAN

SEQ ID NO: 105148 - protein, 14 aa, Mycobacterium tuberculosis
LHGVRDGLVRDANN

SEQ ID NO: 105149 - protein, 14 aa, Mycobacterium tuberculosis
HGVRDGLVRDANNY

SEQ ID NO: 105150 - protein, 14 aa, Mycobacterium tuberculosis
GVRDGLVRDANNYE

SEQ ID NO: 105151 - protein, 14 aa, Mycobacterium tuberculosis
VRDGLVRDANNYEQ

SEQ ID NO: 105152 - protein, 14 aa, Mycobacterium tuberculosis
RDGLVRDANNYEQQ

SEQ ID NO: 105153 - protein, 14 aa, Mycobacterium tuberculosis
DGLVRDANNYEQQE

SEQ ID NO: 105154 - protein, 14 aa, Mycobacterium tuberculosis
GLVRDANNYEQQEQ

SEQ ID NO: 105155 - protein, 14 aa, Mycobacterium tuberculosis
LVRDANNYEQQEQA

SEQ ID NO: 105156 - protein, 14 aa, Mycobacterium tuberculosis
VRDANNYEQQEQAS

SEQ ID NO: 105157 - protein, 14 aa, Mycobacterium tuberculosis
RDANNYEQQEQASQ

SEQ ID NO: 105158 - protein, 14 aa, Mycobacterium tuberculosis
DANNYEQQEQASQQ

SEQ ID NO: 105159 - protein, 14 aa, Mycobacterium tuberculosis
ANNYEQQEQASQQI

SEQ ID NO: 105160 - protein, 14 aa, Mycobacterium tuberculosis
NNYEQQEQASQQIL

SEQ ID NO: 105161 - protein, 14 aa, Mycobacterium tuberculosis
NYEQQEQASQQILS

SEQ ID NO: 105162 - protein, 14 aa, Mycobacterium tuberculosis
YEQQEQASQQILSS

SEQ ID NO: 105163 - protein, 15 aa, Mycobacterium tuberculosis
MTSRFMTDPHAMRDM

SEQ ID NO: 105164 - protein, 15 aa, Mycobacterium tuberculosis
TSRFMTDPHAMRDMA

SEQ ID NO: 105165 - protein, 15 aa, Mycobacterium tuberculosis
SRFMTDPHAMRDMAG

SEQ ID NO: 105166 - protein, 15 aa, Mycobacterium tuberculosis
RFMTDPHAMRDMAGR

SEQ ID NO: 105167 - protein, 15 aa, Mycobacterium tuberculosis
FMTDPHAMRDMAGRF

SEQ ID NO: 105168 - protein, 15 aa, Mycobacterium tuberculosis
MTDPHAMRDMAGRFE

SEQ ID NO: 105169 - protein, 15 aa, Mycobacterium tuberculosis
TDPHAMRDMAGRFEV

SEQ ID NO: 105170 - protein, 15 aa, Mycobacterium tuberculosis
DPHAMRDMAGRFEVH

SEQ ID NO: 105171 - protein, 15 aa, Mycobacterium tuberculosis
PHAMRDMAGRFEVHA

SEQ ID NO: 105172 - protein, 15 aa, Mycobacterium tuberculosis
HAMRDMAGRFEVHAQ

SEQ ID NO: 105173 - protein, 15 aa, Mycobacterium tuberculosis
AMRDMAGRFEVHAQT

SEQ ID NO: 105174 - protein, 15 aa, Mycobacterium tuberculosis
MRDMAGRFEVHAQTV

SEQ ID NO: 105175 - protein, 15 aa, Mycobacterium tuberculosis
RDMAGRFEVHAQTVE

SEQ ID NO: 105176 - protein, 15 aa, Mycobacterium tuberculosis
DMAGRFEVHAQTVED

SEQ ID NO: 105177 - protein, 15 aa, Mycobacterium tuberculosis
MAGRFEVHAQTVEDE

SEQ ID NO: 105178 - protein, 15 aa, Mycobacterium tuberculosis
AGRFEVHAQTVEDEA

SEQ ID NO: 105179 - protein, 15 aa, Mycobacterium tuberculosis
GRFEVHAQTVEDEAR

SEQ ID NO: 105180 - protein, 15 aa, Mycobacterium tuberculosis
RFEVHAQTVEDEARR

SEQ ID NO: 105181 - protein, 15 aa, Mycobacterium tuberculosis
FEVHAQTVEDEARRM

SEQ ID NO: 105182 - protein, 15 aa, Mycobacterium tuberculosis
EVHAQTVEDEARRMW

SEQ ID NO: 105183 - protein, 15 aa, Mycobacterium tuberculosis
VHAQTVEDEARRMWA

SEQ ID NO: 105184 - protein, 15 aa, Mycobacterium tuberculosis
HAQTVEDEARRMWAS

SEQ ID NO: 105185 - protein, 15 aa, Mycobacterium tuberculosis
AQTVEDEARRMWASA

SEQ ID NO: 105186 - protein, 15 aa, Mycobacterium tuberculosis
QTVEDEARRMWASAQ

SEQ ID NO: 105187 - protein, 15 aa, Mycobacterium tuberculosis
TVEDEARRMWASAQN

SEQ ID NO: 105188 - protein, 15 aa, Mycobacterium tuberculosis
VEDEARRMWASAQNI

SEQ ID NO: 105189 - protein, 15 aa, Mycobacterium tuberculosis
EDEARRMWASAQNIS

SEQ ID NO: 105190 - protein, 15 aa, Mycobacterium tuberculosis
DEARRMWASAQNISG

SEQ ID NO: 105191 - protein, 15 aa, Mycobacterium tuberculosis
EARRMWASAQNISGA

SEQ ID NO: 105192 - protein, 15 aa, Mycobacterium tuberculosis
ARRMWASAQNISGAG

SEQ ID NO: 105193 - protein, 15 aa, Mycobacterium tuberculosis
RRMWASAQNISGAGW

SEQ ID NO: 105194 - protein, 15 aa, Mycobacterium tuberculosis
RMWASAQNISGAGWS

SEQ ID NO: 105195 - protein, 15 aa, Mycobacterium tuberculosis
MWASAQNISGAGWSG

SEQ ID NO: 105196 - protein, 15 aa, Mycobacterium tuberculosis
WASAQNISGAGWSGM

SEQ ID NO: 105197 - protein, 15 aa, Mycobacterium tuberculosis
ASAQNISGAGWSGMA

SEQ ID NO: 105198 - protein, 15 aa, Mycobacterium tuberculosis
SAQNISGAGWSGMAE

SEQ ID NO: 105199 - protein, 15 aa, Mycobacterium tuberculosis
AQNISGAGWSGMAEA

SEQ ID NO: 105200 - protein, 15 aa, Mycobacterium tuberculosis
QNISGAGWSGMAEAT

SEQ ID NO: 105201 - protein, 15 aa, Mycobacterium tuberculosis
NISGAGWSGMAEATS

SEQ ID NO: 105202 - protein, 15 aa, Mycobacterium tuberculosis
ISGAGWSGMAEATSL

SEQ ID NO: 105203 - protein, 15 aa, Mycobacterium tuberculosis
SGAGWSGMAEATSLD

SEQ ID NO: 105204 - protein, 15 aa, Mycobacterium tuberculosis
GAGWSGMAEATSLDT

SEQ ID NO: 105205 - protein, 15 aa, Mycobacterium tuberculosis
AGWSGMAEATSLDTM

SEQ ID NO: 105206 - protein, 15 aa, Mycobacterium tuberculosis
GWSGMAEATSLDTMT

SEQ ID NO: 105207 - protein, 15 aa, Mycobacterium tuberculosis
WSGMAEATSLDTMTQ

SEQ ID NO: 105208 - protein, 15 aa, Mycobacterium tuberculosis
SGMAEATSLDTMTQM

SEQ ID NO: 105209 - protein, 15 aa, Mycobacterium tuberculosis
GMAEATSLDTMTQMN

SEQ ID NO: 105210 - protein, 15 aa, Mycobacterium tuberculosis
MAEATSLDTMTQMNQ

SEQ ID NO: 105211 - protein, 15 aa, Mycobacterium tuberculosis
AEATSLDTMTQMNQA

SEQ ID NO: 105212 - protein, 15 aa, Mycobacterium tuberculosis
EATSLDTMTQMNQAF

SEQ ID NO: 105213 - protein, 15 aa, Mycobacterium tuberculosis
ATSLDTMTQMNQAFR

SEQ ID NO: 105214 - protein, 15 aa, Mycobacterium tuberculosis
TSLDTMTQMNQAFRN

SEQ ID NO: 105215 - protein, 15 aa, Mycobacterium tuberculosis
SLDTMTQMNQAFRNI

SEQ ID NO: 105216 - protein, 15 aa, Mycobacterium tuberculosis
LDTMTQMNQAFRNIV

SEQ ID NO: 105217 - protein, 15 aa, Mycobacterium tuberculosis
DTMTQMNQAFRNIVN

SEQ ID NO: 105218 - protein, 15 aa, Mycobacterium tuberculosis
TMTQMNQAFRNIVNM

SEQ ID NO: 105219 - protein, 15 aa, Mycobacterium tuberculosis
MTQMNQAFRNIVNML

SEQ ID NO: 105220 - protein, 15 aa, Mycobacterium tuberculosis
TQMNQAFRNIVNMLH

SEQ ID NO: 105221 - protein, 15 aa, Mycobacterium tuberculosis
QMNQAFRNIVNMLHG

SEQ ID NO: 105222 - protein, 15 aa, Mycobacterium tuberculosis
MNQAFRNIVNMLHGV

SEQ ID NO: 105223 - protein, 15 aa, Mycobacterium tuberculosis
NQAFRNIVNMLHGVR

SEQ ID NO: 105224 - protein, 15 aa, Mycobacterium tuberculosis
QAFRNIVNMLHGVRD

SEQ ID NO: 105225 - protein, 15 aa, Mycobacterium tuberculosis
AFRNIVNMLHGVRDG

SEQ ID NO: 105226 - protein, 15 aa, Mycobacterium tuberculosis
FRNIVNMLHGVRDGL

SEQ ID NO: 105227 - protein, 15 aa, Mycobacterium tuberculosis
RNIVNMLHGVRDGLV

SEQ ID NO: 105228 - protein, 15 aa, Mycobacterium tuberculosis
NIVNMLHGVRDGLVR

SEQ ID NO: 105229 - protein, 15 aa, Mycobacterium tuberculosis
IVNMLHGVRDGLVRD

SEQ ID NO: 105230 - protein, 15 aa, Mycobacterium tuberculosis
VNMLHGVRDGLVRDA

SEQ ID NO: 105231 - protein, 15 aa, Mycobacterium tuberculosis
NMLHGVRDGLVRDAN

SEQ ID NO: 105232 - protein, 15 aa, Mycobacterium tuberculosis
MLHGVRDGLVRDANN

SEQ ID NO: 105233 - protein, 15 aa, Mycobacterium tuberculosis
LHGVRDGLVRDANNY

SEQ ID NO: 105234 - protein, 15 aa, Mycobacterium tuberculosis
HGVRDGLVRDANNYE

SEQ ID NO: 105235 - protein, 15 aa, Mycobacterium tuberculosis
GVRDGLVRDANNYEQ

SEQ ID NO: 105236 - protein, 15 aa, Mycobacterium tuberculosis
VRDGLVRDANNYEQQ

SEQ ID NO: 105237 - protein, 15 aa, Mycobacterium tuberculosis
RDGLVRDANNYEQQE

SEQ ID NO: 105238 - protein, 15 aa, Mycobacterium tuberculosis
DGLVRDANNYEQQEQ

SEQ ID NO: 105239 - protein, 15 aa, Mycobacterium tuberculosis
GLVRDANNYEQQEQA

SEQ ID NO: 105240 - protein, 15 aa, Mycobacterium tuberculosis
LVRDANNYEQQEQAS

SEQ ID NO: 105241 - protein, 15 aa, Mycobacterium tuberculosis
VRDANNYEQQEQASQ

SEQ ID NO: 105242 - protein, 15 aa, Mycobacterium tuberculosis
RDANNYEQQEQASQQ

SEQ ID NO: 105243 - protein, 15 aa, Mycobacterium tuberculosis
DANNYEQQEQASQQI

SEQ ID NO: 105244 - protein, 15 aa, Mycobacterium tuberculosis
ANNYEQQEQASQQIL

SEQ ID NO: 105245 - protein, 15 aa, Mycobacterium tuberculosis
NNYEQQEQASQQILS

SEQ ID NO: 105246 - protein, 15 aa, Mycobacterium tuberculosis
NYEQQEQASQQILSS

SEQ ID NO: 105247 - protein, 16 aa, Mycobacterium tuberculosis
MTSRFMTDPHAMRDMA

SEQ ID NO: 105248 - protein, 16 aa, Mycobacterium tuberculosis
TSRFMTDPHAMRDMAG

SEQ ID NO: 105249 - protein, 16 aa, Mycobacterium tuberculosis
SRFMTDPHAMRDMAGR

SEQ ID NO: 105250 - protein, 16 aa, Mycobacterium tuberculosis
RFMTDPHAMRDMAGRF

SEQ ID NO: 105251 - protein, 16 aa, Mycobacterium tuberculosis
FMTDPHAMRDMAGRFE

SEQ ID NO: 105252 - protein, 16 aa, Mycobacterium tuberculosis
MTDPHAMRDMAGRFEV

SEQ ID NO: 105253 - protein, 16 aa, Mycobacterium tuberculosis
TDPHAMRDMAGRFEVH

SEQ ID NO: 105254 - protein, 16 aa, Mycobacterium tuberculosis
DPHAMRDMAGRFEVHA

SEQ ID NO: 105255 - protein, 16 aa, Mycobacterium tuberculosis
PHAMRDMAGRFEVHAQ

SEQ ID NO: 105256 - protein, 16 aa, Mycobacterium tuberculosis
HAMRDMAGRFEVHAQT

SEQ ID NO: 105257 - protein, 16 aa, Mycobacterium tuberculosis
AMRDMAGRFEVHAQTV

SEQ ID NO: 105258 - protein, 16 aa, Mycobacterium tuberculosis
MRDMAGRFEVHAQTVE

SEQ ID NO: 105259 - protein, 16 aa, Mycobacterium tuberculosis
RDMAGRFEVHAQTVED

SEQ ID NO: 105260 - protein, 16 aa, Mycobacterium tuberculosis
DMAGRFEVHAQTVEDE

SEQ ID NO: 105261 - protein, 16 aa, Mycobacterium tuberculosis
MAGRFEVHAQTVEDEA

SEQ ID NO: 105262 - protein, 16 aa, Mycobacterium tuberculosis
AGRFEVHAQTVEDEAR

SEQ ID NO: 105263 - protein, 16 aa, Mycobacterium tuberculosis
GRFEVHAQTVEDEARR

SEQ ID NO: 105264 - protein, 16 aa, Mycobacterium tuberculosis
RFEVHAQTVEDEARRM

SEQ ID NO: 105265 - protein, 16 aa, Mycobacterium tuberculosis
FEVHAQTVEDEARRMW

SEQ ID NO: 105266 - protein, 16 aa, Mycobacterium tuberculosis
EVHAQTVEDEARRMWA

SEQ ID NO: 105267 - protein, 16 aa, Mycobacterium tuberculosis
VHAQTVEDEARRMWAS

SEQ ID NO: 105268 - protein, 16 aa, Mycobacterium tuberculosis
HAQTVEDEARRMWASA

SEQ ID NO: 105269 - protein, 16 aa, Mycobacterium tuberculosis
AQTVEDEARRMWASAQ

SEQ ID NO: 105270 - protein, 16 aa, Mycobacterium tuberculosis
QTVEDEARRMWASAQN

SEQ ID NO: 105271 - protein, 16 aa, Mycobacterium tuberculosis
TVEDEARRMWASAQNI

SEQ ID NO: 105272 - protein, 16 aa, Mycobacterium tuberculosis
VEDEARRMWASAQNIS

SEQ ID NO: 105273 - protein, 16 aa, Mycobacterium tuberculosis
EDEARRMWASAQNISG

SEQ ID NO: 105274 - protein, 16 aa, Mycobacterium tuberculosis
DEARRMWASAQNISGA

SEQ ID NO: 105275 - protein, 16 aa, Mycobacterium tuberculosis
EARRMWASAQNISGAG

SEQ ID NO: 105276 - protein, 16 aa, Mycobacterium tuberculosis
ARRMWASAQNISGAGW

SEQ ID NO: 105277 - protein, 16 aa, Mycobacterium tuberculosis
RRMWASAQNISGAGWS

SEQ ID NO: 105278 - protein, 16 aa, Mycobacterium tuberculosis
RMWASAQNISGAGWSG

SEQ ID NO: 105279 - protein, 16 aa, Mycobacterium tuberculosis
MWASAQNISGAGWSGM

SEQ ID NO: 105280 - protein, 16 aa, Mycobacterium tuberculosis
WASAQNISGAGWSGMA

SEQ ID NO: 105281 - protein, 16 aa, Mycobacterium tuberculosis
ASAQNISGAGWSGMAE

SEQ ID NO: 105282 - protein, 16 aa, Mycobacterium tuberculosis
SAQNISGAGWSGMAEA

SEQ ID NO: 105283 - protein, 16 aa, Mycobacterium tuberculosis
AQNISGAGWSGMAEAT

SEQ ID NO: 105284 - protein, 16 aa, Mycobacterium tuberculosis
QNISGAGWSGMAEATS

SEQ ID NO: 105285 - protein, 16 aa, Mycobacterium tuberculosis
NISGAGWSGMAEATSL

SEQ ID NO: 105286 - protein, 16 aa, Mycobacterium tuberculosis
ISGAGWSGMAEATSLD

SEQ ID NO: 105287 - protein, 16 aa, Mycobacterium tuberculosis
SGAGWSGMAEATSLDT

SEQ ID NO: 105288 - protein, 16 aa, Mycobacterium tuberculosis
GAGWSGMAEATSLDTM

SEQ ID NO: 105289 - protein, 16 aa, Mycobacterium tuberculosis
AGWSGMAEATSLDTMT

SEQ ID NO: 105290 - protein, 16 aa, Mycobacterium tuberculosis
GWSGMAEATSLDTMTQ

SEQ ID NO: 105291 - protein, 16 aa, Mycobacterium tuberculosis
WSGMAEATSLDTMTQM

SEQ ID NO: 105292 - protein, 16 aa, Mycobacterium tuberculosis
SGMAEATSLDTMTQMN

SEQ ID NO: 105293 - protein, 16 aa, Mycobacterium tuberculosis
GMAEATSLDTMTQMNQ

SEQ ID NO: 105294 - protein, 16 aa, Mycobacterium tuberculosis
MAEATSLDTMTQMNQA

SEQ ID NO: 105295 - protein, 16 aa, Mycobacterium tuberculosis
AEATSLDTMTQMNQAF

SEQ ID NO: 105296 - protein, 16 aa, Mycobacterium tuberculosis
EATSLDTMTQMNQAFR

SEQ ID NO: 105297 - protein, 16 aa, Mycobacterium tuberculosis
ATSLDTMTQMNQAFRN

SEQ ID NO: 105298 - protein, 16 aa, Mycobacterium tuberculosis
TSLDTMTQMNQAFRNI

SEQ ID NO: 105299 - protein, 16 aa, Mycobacterium tuberculosis
SLDTMTQMNQAFRNIV

SEQ ID NO: 105300 - protein, 16 aa, Mycobacterium tuberculosis
LDTMTQMNQAFRNIVN

SEQ ID NO: 105301 - protein, 16 aa, Mycobacterium tuberculosis
DTMTQMNQAFRNIVNM

SEQ ID NO: 105302 - protein, 16 aa, Mycobacterium tuberculosis
TMTQMNQAFRNIVNML

SEQ ID NO: 105303 - protein, 16 aa, Mycobacterium tuberculosis
MTQMNQAFRNIVNMLH

SEQ ID NO: 105304 - protein, 16 aa, Mycobacterium tuberculosis
TQMNQAFRNIVNMLHG

SEQ ID NO: 105305 - protein, 16 aa, Mycobacterium tuberculosis
QMNQAFRNIVNMLHGV

SEQ ID NO: 105306 - protein, 16 aa, Mycobacterium tuberculosis
MNQAFRNIVNMLHGVR

SEQ ID NO: 105307 - protein, 16 aa, Mycobacterium tuberculosis
NQAFRNIVNMLHGVRD

SEQ ID NO: 105308 - protein, 16 aa, Mycobacterium tuberculosis
QAFRNIVNMLHGVRDG

SEQ ID NO: 105309 - protein, 16 aa, Mycobacterium tuberculosis
AFRNIVNMLHGVRDGL

SEQ ID NO: 105310 - protein, 16 aa, Mycobacterium tuberculosis
FRNIVNMLHGVRDGLV

SEQ ID NO: 105311 - protein, 16 aa, Mycobacterium tuberculosis
RNIVNMLHGVRDGLVR

SEQ ID NO: 105312 - protein, 16 aa, Mycobacterium tuberculosis
NIVNMLHGVRDGLVRD

SEQ ID NO: 105313 - protein, 16 aa, Mycobacterium tuberculosis
IVNMLHGVRDGLVRDA

SEQ ID NO: 105314 - protein, 16 aa, Mycobacterium tuberculosis
VNMLHGVRDGLVRDAN

SEQ ID NO: 105315 - protein, 16 aa, Mycobacterium tuberculosis
NMLHGVRDGLVRDANN

SEQ ID NO: 105316 - protein, 16 aa, Mycobacterium tuberculosis
MLHGVRDGLVRDANNY

SEQ ID NO: 105317 - protein, 16 aa, Mycobacterium tuberculosis
LHGVRDGLVRDANNYE

SEQ ID NO: 105318 - protein, 16 aa, Mycobacterium tuberculosis
HGVRDGLVRDANNYEQ

SEQ ID NO: 105319 - protein, 16 aa, Mycobacterium tuberculosis
GVRDGLVRDANNYEQQ

SEQ ID NO: 105320 - protein, 16 aa, Mycobacterium tuberculosis
VRDGLVRDANNYEQQE

SEQ ID NO: 105321 - protein, 16 aa, Mycobacterium tuberculosis
RDGLVRDANNYEQQEQ

SEQ ID NO: 105322 - protein, 16 aa, Mycobacterium tuberculosis
DGLVRDANNYEQQEQA

SEQ ID NO: 105323 - protein, 16 aa, Mycobacterium tuberculosis
GLVRDANNYEQQEQAS

SEQ ID NO: 105324 - protein, 16 aa, Mycobacterium tuberculosis
LVRDANNYEQQEQASQ

SEQ ID NO: 105325 - protein, 16 aa, Mycobacterium tuberculosis
VRDANNYEQQEQASQQ

SEQ ID NO: 105326 - protein, 16 aa, Mycobacterium tuberculosis
RDANNYEQQEQASQQI

SEQ ID NO: 105327 - protein, 16 aa, Mycobacterium tuberculosis
DANNYEQQEQASQQIL

SEQ ID NO: 105328 - protein, 16 aa, Mycobacterium tuberculosis
ANNYEQQEQASQQILS

SEQ ID NO: 105329 - protein, 16 aa, Mycobacterium tuberculosis
NNYEQQEQASQQILSS

SEQ ID NO: 105330 - protein, 13 aa, Mycobacterium tuberculosis
MFTLLVSWLLVAC

SEQ ID NO: 105331 - protein, 13 aa, Mycobacterium tuberculosis
FTLLVSWLLVACV

SEQ ID NO: 105332 - protein, 13 aa, Mycobacterium tuberculosis
TLLVSWLLVACVP

SEQ ID NO: 105333 - protein, 13 aa, Mycobacterium tuberculosis
LLVSWLLVACVPG

SEQ ID NO: 105334 - protein, 13 aa, Mycobacterium tuberculosis
LVSWLLVACVPGL

SEQ ID NO: 105335 - protein, 13 aa, Mycobacterium tuberculosis
VSWLLVACVPGLL

SEQ ID NO: 105336 - protein, 13 aa, Mycobacterium tuberculosis
SWLLVACVPGLLM

SEQ ID NO: 105337 - protein, 13 aa, Mycobacterium tuberculosis
WLLVACVPGLLML

SEQ ID NO: 105338 - protein, 13 aa, Mycobacterium tuberculosis
LLVACVPGLLMLA

SEQ ID NO: 105339 - protein, 13 aa, Mycobacterium tuberculosis
LVACVPGLLMLAT

SEQ ID NO: 105340 - protein, 13 aa, Mycobacterium tuberculosis
VACVPGLLMLATL

SEQ ID NO: 105341 - protein, 13 aa, Mycobacterium tuberculosis
ACVPGLLMLATLG

SEQ ID NO: 105342 - protein, 13 aa, Mycobacterium tuberculosis
CVPGLLMLATLGL

SEQ ID NO: 105343 - protein, 13 aa, Mycobacterium tuberculosis
VPGLLMLATLGLG

SEQ ID NO: 105344 - protein, 13 aa, Mycobacterium tuberculosis
PGLLMLATLGLGR

SEQ ID NO: 105345 - protein, 13 aa, Mycobacterium tuberculosis
GLLMLATLGLGRL

SEQ ID NO: 105346 - protein, 13 aa, Mycobacterium tuberculosis
LLMLATLGLGRLE

SEQ ID NO: 105347 - protein, 13 aa, Mycobacterium tuberculosis
LMLATLGLGRLER

SEQ ID NO: 105348 - protein, 13 aa, Mycobacterium tuberculosis
MLATLGLGRLERF

SEQ ID NO: 105349 - protein, 13 aa, Mycobacterium tuberculosis
LATLGLGRLERFL

SEQ ID NO: 105350 - protein, 13 aa, Mycobacterium tuberculosis
ATLGLGRLERFLA

SEQ ID NO: 105351 - protein, 13 aa, Mycobacterium tuberculosis
TLGLGRLERFLAR

SEQ ID NO: 105352 - protein, 13 aa, Mycobacterium tuberculosis
LGLGRLERFLARD

SEQ ID NO: 105353 - protein, 13 aa, Mycobacterium tuberculosis
GLGRLERFLARDT

SEQ ID NO: 105354 - protein, 13 aa, Mycobacterium tuberculosis
LGRLERFLARDTV

SEQ ID NO: 105355 - protein, 13 aa, Mycobacterium tuberculosis
GRLERFLARDTVT

SEQ ID NO: 105356 - protein, 13 aa, Mycobacterium tuberculosis
RLERFLARDTVTA

SEQ ID NO: 105357 - protein, 13 aa, Mycobacterium tuberculosis
LERFLARDTVTAT

SEQ ID NO: 105358 - protein, 13 aa, Mycobacterium tuberculosis
ERFLARDTVTATD

SEQ ID NO: 105359 - protein, 13 aa, Mycobacterium tuberculosis
RFLARDTVTATDV

SEQ ID NO: 105360 - protein, 13 aa, Mycobacterium tuberculosis
FLARDTVTATDVA

SEQ ID NO: 105361 - protein, 13 aa, Mycobacterium tuberculosis
LARDTVTATDVAE

SEQ ID NO: 105362 - protein, 13 aa, Mycobacterium tuberculosis
ARDTVTATDVAEF

SEQ ID NO: 105363 - protein, 13 aa, Mycobacterium tuberculosis
RDTVTATDVAEFL

SEQ ID NO: 105364 - protein, 13 aa, Mycobacterium tuberculosis
DTVTATDVAEFLE

SEQ ID NO: 105365 - protein, 13 aa, Mycobacterium tuberculosis
TVTATDVAEFLEQ

SEQ ID NO: 105366 - protein, 13 aa, Mycobacterium tuberculosis
VTATDVAEFLEQA

SEQ ID NO: 105367 - protein, 13 aa, Mycobacterium tuberculosis
TATDVAEFLEQAE

SEQ ID NO: 105368 - protein, 13 aa, Mycobacterium tuberculosis
ATDVAEFLEQAEA

SEQ ID NO: 105369 - protein, 13 aa, Mycobacterium tuberculosis
TDVAEFLEQAEAV

SEQ ID NO: 105370 - protein, 13 aa, Mycobacterium tuberculosis
DVAEFLEQAEAVD

SEQ ID NO: 105371 - protein, 13 aa, Mycobacterium tuberculosis
VAEFLEQAEAVDV

SEQ ID NO: 105372 - protein, 13 aa, Mycobacterium tuberculosis
AEFLEQAEAVDVH

SEQ ID NO: 105373 - protein, 13 aa, Mycobacterium tuberculosis
EFLEQAEAVDVHT

SEQ ID NO: 105374 - protein, 13 aa, Mycobacterium tuberculosis
FLEQAEAVDVHTL

SEQ ID NO: 105375 - protein, 13 aa, Mycobacterium tuberculosis
LEQAEAVDVHTLA

SEQ ID NO: 105376 - protein, 13 aa, Mycobacterium tuberculosis
EQAEAVDVHTLAR

SEQ ID NO: 105377 - protein, 13 aa, Mycobacterium tuberculosis
QAEAVDVHTLARN

SEQ ID NO: 105378 - protein, 13 aa, Mycobacterium tuberculosis
AEAVDVHTLARNG

SEQ ID NO: 105379 - protein, 13 aa, Mycobacterium tuberculosis
EAVDVHTLARNGM

SEQ ID NO: 105380 - protein, 13 aa, Mycobacterium tuberculosis
AVDVHTLARNGMP

SEQ ID NO: 105381 - protein, 13 aa, Mycobacterium tuberculosis
VDVHTLARNGMPE

SEQ ID NO: 105382 - protein, 13 aa, Mycobacterium tuberculosis
DVHTLARNGMPEA

SEQ ID NO: 105383 - protein, 13 aa, Mycobacterium tuberculosis
VHTLARNGMPEAL

SEQ ID NO: 105384 - protein, 13 aa, Mycobacterium tuberculosis
HTLARNGMPEALD

SEQ ID NO: 105385 - protein, 13 aa, Mycobacterium tuberculosis
TLARNGMPEALDY

SEQ ID NO: 105386 - protein, 13 aa, Mycobacterium tuberculosis
LARNGMPEALDYL

SEQ ID NO: 105387 - protein, 13 aa, Mycobacterium tuberculosis
ARNGMPEALDYLH

SEQ ID NO: 105388 - protein, 13 aa, Mycobacterium tuberculosis
RNGMPEALDYLHR

SEQ ID NO: 105389 - protein, 13 aa, Mycobacterium tuberculosis
NGMPEALDYLHRR

SEQ ID NO: 105390 - protein, 13 aa, Mycobacterium tuberculosis
GMPEALDYLHRRQ

SEQ ID NO: 105391 - protein, 13 aa, Mycobacterium tuberculosis
MPEALDYLHRRQA

SEQ ID NO: 105392 - protein, 13 aa, Mycobacterium tuberculosis
PEALDYLHRRQAR

SEQ ID NO: 105393 - protein, 13 aa, Mycobacterium tuberculosis
EALDYLHRRQARR

SEQ ID NO: 105394 - protein, 13 aa, Mycobacterium tuberculosis
ALDYLHRRQARRI

SEQ ID NO: 105395 - protein, 13 aa, Mycobacterium tuberculosis
LDYLHRRQARRIT

SEQ ID NO: 105396 - protein, 13 aa, Mycobacterium tuberculosis
DYLHRRQARRITD

SEQ ID NO: 105397 - protein, 13 aa, Mycobacterium tuberculosis
YLHRRQARRITDS

SEQ ID NO: 105398 - protein, 13 aa, Mycobacterium tuberculosis
LHRRQARRITDSP

SEQ ID NO: 105399 - protein, 13 aa, Mycobacterium tuberculosis
HRRQARRITDSPP

SEQ ID NO: 105400 - protein, 13 aa, Mycobacterium tuberculosis
RRQARRITDSPPL

SEQ ID NO: 105401 - protein, 13 aa, Mycobacterium tuberculosis
RQARRITDSPPLG

SEQ ID NO: 105402 - protein, 13 aa, Mycobacterium tuberculosis
QARRITDSPPLGS

SEQ ID NO: 105403 - protein, 13 aa, Mycobacterium tuberculosis
ARRITDSPPLGSG

SEQ ID NO: 105404 - protein, 13 aa, Mycobacterium tuberculosis
RRITDSPPLGSGA

SEQ ID NO: 105405 - protein, 13 aa, Mycobacterium tuberculosis
RITDSPPLGSGAG

SEQ ID NO: 105406 - protein, 13 aa, Mycobacterium tuberculosis
ITDSPPLGSGAGP

SEQ ID NO: 105407 - protein, 13 aa, Mycobacterium tuberculosis
TDSPPLGSGAGPR

SEQ ID NO: 105408 - protein, 13 aa, Mycobacterium tuberculosis
DSPPLGSGAGPRY

SEQ ID NO: 105409 - protein, 13 aa, Mycobacterium tuberculosis
SPPLGSGAGPRYA

SEQ ID NO: 105410 - protein, 13 aa, Mycobacterium tuberculosis
PPLGSGAGPRYAG

SEQ ID NO: 105411 - protein, 13 aa, Mycobacterium tuberculosis
PLGSGAGPRYAGP

SEQ ID NO: 105412 - protein, 13 aa, Mycobacterium tuberculosis
LGSGAGPRYAGPL

SEQ ID NO: 105413 - protein, 13 aa, Mycobacterium tuberculosis
GSGAGPRYAGPLF

SEQ ID NO: 105414 - protein, 13 aa, Mycobacterium tuberculosis
SGAGPRYAGPLFV

SEQ ID NO: 105415 - protein, 13 aa, Mycobacterium tuberculosis
GAGPRYAGPLFVT

SEQ ID NO: 105416 - protein, 13 aa, Mycobacterium tuberculosis
AGPRYAGPLFVTD

SEQ ID NO: 105417 - protein, 13 aa, Mycobacterium tuberculosis
GPRYAGPLFVTDL

SEQ ID NO: 105418 - protein, 13 aa, Mycobacterium tuberculosis
PRYAGPLFVTDLD

SEQ ID NO: 105419 - protein, 13 aa, Mycobacterium tuberculosis
RYAGPLFVTDLDS

SEQ ID NO: 105420 - protein, 13 aa, Mycobacterium tuberculosis
YAGPLFVTDLDSP

SEQ ID NO: 105421 - protein, 13 aa, Mycobacterium tuberculosis
AGPLFVTDLDSPV

SEQ ID NO: 105422 - protein, 13 aa, Mycobacterium tuberculosis
GPLFVTDLDSPVE

SEQ ID NO: 105423 - protein, 13 aa, Mycobacterium tuberculosis
PLFVTDLDSPVEP

SEQ ID NO: 105424 - protein, 13 aa, Mycobacterium tuberculosis
LFVTDLDSPVEPP

SEQ ID NO: 105425 - protein, 13 aa, Mycobacterium tuberculosis
FVTDLDSPVEPPR

SEQ ID NO: 105426 - protein, 13 aa, Mycobacterium tuberculosis
VTDLDSPVEPPRH

SEQ ID NO: 105427 - protein, 13 aa, Mycobacterium tuberculosis
TDLDSPVEPPRHG

SEQ ID NO: 105428 - protein, 13 aa, Mycobacterium tuberculosis
DLDSPVEPPRHGQ

SEQ ID NO: 105429 - protein, 13 aa, Mycobacterium tuberculosis
LDSPVEPPRHGQP

SEQ ID NO: 105430 - protein, 13 aa, Mycobacterium tuberculosis
DSPVEPPRHGQPN

SEQ ID NO: 105431 - protein, 13 aa, Mycobacterium tuberculosis
SPVEPPRHGQPNP

SEQ ID NO: 105432 - protein, 13 aa, Mycobacterium tuberculosis
PVEPPRHGQPNPQ

SEQ ID NO: 105433 - protein, 13 aa, Mycobacterium tuberculosis
VEPPRHGQPNPQF

SEQ ID NO: 105434 - protein, 13 aa, Mycobacterium tuberculosis
EPPRHGQPNPQFR

SEQ ID NO: 105435 - protein, 13 aa, Mycobacterium tuberculosis
PPRHGQPNPQFRT

SEQ ID NO: 105436 - protein, 13 aa, Mycobacterium tuberculosis
PRHGQPNPQFRTA

SEQ ID NO: 105437 - protein, 13 aa, Mycobacterium tuberculosis
RHGQPNPQFRTAR

SEQ ID NO: 105438 - protein, 13 aa, Mycobacterium tuberculosis
HGQPNPQFRTARH

SEQ ID NO: 105439 - protein, 13 aa, Mycobacterium tuberculosis
GQPNPQFRTARHA

SEQ ID NO: 105440 - protein, 13 aa, Mycobacterium tuberculosis
QPNPQFRTARHAN

SEQ ID NO: 105441 - protein, 13 aa, Mycobacterium tuberculosis
PNPQFRTARHANH

SEQ ID NO: 105442 - protein, 13 aa, Mycobacterium tuberculosis
NPQFRTARHANHV

SEQ ID NO: 105443 - protein, 14 aa, Mycobacterium tuberculosis
MFTLLVSWLLVACV

SEQ ID NO: 105444 - protein, 14 aa, Mycobacterium tuberculosis
FTLLVSWLLVACVP

SEQ ID NO: 105445 - protein, 14 aa, Mycobacterium tuberculosis
TLLVSWLLVACVPG

SEQ ID NO: 105446 - protein, 14 aa, Mycobacterium tuberculosis
LLVSWLLVACVPGL

SEQ ID NO: 105447 - protein, 14 aa, Mycobacterium tuberculosis
LVSWLLVACVPGLL

SEQ ID NO: 105448 - protein, 14 aa, Mycobacterium tuberculosis
VSWLLVACVPGLLM

SEQ ID NO: 105449 - protein, 14 aa, Mycobacterium tuberculosis
SWLLVACVPGLLML

SEQ ID NO: 105450 - protein, 14 aa, Mycobacterium tuberculosis
WLLVACVPGLLMLA

SEQ ID NO: 105451 - protein, 14 aa, Mycobacterium tuberculosis
LLVACVPGLLMLAT

SEQ ID NO: 105452 - protein, 14 aa, Mycobacterium tuberculosis
LVACVPGLLMLATL

SEQ ID NO: 105453 - protein, 14 aa, Mycobacterium tuberculosis
VACVPGLLMLATLG

SEQ ID NO: 105454 - protein, 14 aa, Mycobacterium tuberculosis
ACVPGLLMLATLGL

SEQ ID NO: 105455 - protein, 14 aa, Mycobacterium tuberculosis
CVPGLLMLATLGLG

SEQ ID NO: 105456 - protein, 14 aa, Mycobacterium tuberculosis
VPGLLMLATLGLGR

SEQ ID NO: 105457 - protein, 14 aa, Mycobacterium tuberculosis
PGLLMLATLGLGRL

SEQ ID NO: 105458 - protein, 14 aa, Mycobacterium tuberculosis
GLLMLATLGLGRLE

SEQ ID NO: 105459 - protein, 14 aa, Mycobacterium tuberculosis
LLMLATLGLGRLER

SEQ ID NO: 105460 - protein, 14 aa, Mycobacterium tuberculosis
LMLATLGLGRLERF

SEQ ID NO: 105461 - protein, 14 aa, Mycobacterium tuberculosis
MLATLGLGRLERFL

SEQ ID NO: 105462 - protein, 14 aa, Mycobacterium tuberculosis
LATLGLGRLERFLA

SEQ ID NO: 105463 - protein, 14 aa, Mycobacterium tuberculosis
ATLGLGRLERFLAR

SEQ ID NO: 105464 - protein, 14 aa, Mycobacterium tuberculosis
TLGLGRLERFLARD

SEQ ID NO: 105465 - protein, 14 aa, Mycobacterium tuberculosis
LGLGRLERFLARDT

SEQ ID NO: 105466 - protein, 14 aa, Mycobacterium tuberculosis
GLGRLERFLARDTV

SEQ ID NO: 105467 - protein, 14 aa, Mycobacterium tuberculosis
LGRLERFLARDTVT

SEQ ID NO: 105468 - protein, 14 aa, Mycobacterium tuberculosis
GRLERFLARDTVTA

SEQ ID NO: 105469 - protein, 14 aa, Mycobacterium tuberculosis
RLERFLARDTVTAT

SEQ ID NO: 105470 - protein, 14 aa, Mycobacterium tuberculosis
LERFLARDTVTATD

SEQ ID NO: 105471 - protein, 14 aa, Mycobacterium tuberculosis
ERFLARDTVTATDV

SEQ ID NO: 105472 - protein, 14 aa, Mycobacterium tuberculosis
RFLARDTVTATDVA

SEQ ID NO: 105473 - protein, 14 aa, Mycobacterium tuberculosis
FLARDTVTATDVAE

SEQ ID NO: 105474 - protein, 14 aa, Mycobacterium tuberculosis
LARDTVTATDVAEF

SEQ ID NO: 105475 - protein, 14 aa, Mycobacterium tuberculosis
ARDTVTATDVAEFL

SEQ ID NO: 105476 - protein, 14 aa, Mycobacterium tuberculosis
RDTVTATDVAEFLE

SEQ ID NO: 105477 - protein, 14 aa, Mycobacterium tuberculosis
DTVTATDVAEFLEQ

SEQ ID NO: 105478 - protein, 14 aa, Mycobacterium tuberculosis
TVTATDVAEFLEQA

SEQ ID NO: 105479 - protein, 14 aa, Mycobacterium tuberculosis
VTATDVAEFLEQAE

SEQ ID NO: 105480 - protein, 14 aa, Mycobacterium tuberculosis
TATDVAEFLEQAEA

SEQ ID NO: 105481 - protein, 14 aa, Mycobacterium tuberculosis
ATDVAEFLEQAEAV

SEQ ID NO: 105482 - protein, 14 aa, Mycobacterium tuberculosis
TDVAEFLEQAEAVD

SEQ ID NO: 105483 - protein, 14 aa, Mycobacterium tuberculosis
DVAEFLEQAEAVDV

SEQ ID NO: 105484 - protein, 14 aa, Mycobacterium tuberculosis
VAEFLEQAEAVDVH

SEQ ID NO: 105485 - protein, 14 aa, Mycobacterium tuberculosis
AEFLEQAEAVDVHT

SEQ ID NO: 105486 - protein, 14 aa, Mycobacterium tuberculosis
EFLEQAEAVDVHTL

SEQ ID NO: 105487 - protein, 14 aa, Mycobacterium tuberculosis
FLEQAEAVDVHTLA

SEQ ID NO: 105488 - protein, 14 aa, Mycobacterium tuberculosis
LEQAEAVDVHTLAR

SEQ ID NO: 105489 - protein, 14 aa, Mycobacterium tuberculosis
EQAEAVDVHTLARN

SEQ ID NO: 105490 - protein, 14 aa, Mycobacterium tuberculosis
QAEAVDVHTLARNG

SEQ ID NO: 105491 - protein, 14 aa, Mycobacterium tuberculosis
AEAVDVHTLARNGM

SEQ ID NO: 105492 - protein, 14 aa, Mycobacterium tuberculosis
EAVDVHTLARNGMP

SEQ ID NO: 105493 - protein, 14 aa, Mycobacterium tuberculosis
AVDVHTLARNGMPE

SEQ ID NO: 105494 - protein, 14 aa, Mycobacterium tuberculosis
VDVHTLARNGMPEA

SEQ ID NO: 105495 - protein, 14 aa, Mycobacterium tuberculosis
DVHTLARNGMPEAL

SEQ ID NO: 105496 - protein, 14 aa, Mycobacterium tuberculosis
VHTLARNGMPEALD

SEQ ID NO: 105497 - protein, 14 aa, Mycobacterium tuberculosis
HTLARNGMPEALDY

SEQ ID NO: 105498 - protein, 14 aa, Mycobacterium tuberculosis
TLARNGMPEALDYL

SEQ ID NO: 105499 - protein, 14 aa, Mycobacterium tuberculosis
LARNGMPEALDYLH

SEQ ID NO: 105500 - protein, 14 aa, Mycobacterium tuberculosis
ARNGMPEALDYLHR

SEQ ID NO: 105501 - protein, 14 aa, Mycobacterium tuberculosis
RNGMPEALDYLHRR

SEQ ID NO: 105502 - protein, 14 aa, Mycobacterium tuberculosis
NGMPEALDYLHRRQ

SEQ ID NO: 105503 - protein, 14 aa, Mycobacterium tuberculosis
GMPEALDYLHRRQA

SEQ ID NO: 105504 - protein, 14 aa, Mycobacterium tuberculosis
MPEALDYLHRRQAR

SEQ ID NO: 105505 - protein, 14 aa, Mycobacterium tuberculosis
PEALDYLHRRQARR

SEQ ID NO: 105506 - protein, 14 aa, Mycobacterium tuberculosis
EALDYLHRRQARRI

SEQ ID NO: 105507 - protein, 14 aa, Mycobacterium tuberculosis
ALDYLHRRQARRIT

SEQ ID NO: 105508 - protein, 14 aa, Mycobacterium tuberculosis
LDYLHRRQARRITD

SEQ ID NO: 105509 - protein, 14 aa, Mycobacterium tuberculosis
DYLHRRQARRITDS

SEQ ID NO: 105510 - protein, 14 aa, Mycobacterium tuberculosis
YLHRRQARRITDSP

SEQ ID NO: 105511 - protein, 14 aa, Mycobacterium tuberculosis
LHRRQARRITDSPP

SEQ ID NO: 105512 - protein, 14 aa, Mycobacterium tuberculosis
HRRQARRITDSPPL

SEQ ID NO: 105513 - protein, 14 aa, Mycobacterium tuberculosis
RRQARRITDSPPLG

SEQ ID NO: 105514 - protein, 14 aa, Mycobacterium tuberculosis
RQARRITDSPPLGS

SEQ ID NO: 105515 - protein, 14 aa, Mycobacterium tuberculosis
QARRITDSPPLGSG

SEQ ID NO: 105516 - protein, 14 aa, Mycobacterium tuberculosis
ARRITDSPPLGSGA

SEQ ID NO: 105517 - protein, 14 aa, Mycobacterium tuberculosis
RRITDSPPLGSGAG

SEQ ID NO: 105518 - protein, 14 aa, Mycobacterium tuberculosis
RITDSPPLGSGAGP

SEQ ID NO: 105519 - protein, 14 aa, Mycobacterium tuberculosis
ITDSPPLGSGAGPR

SEQ ID NO: 105520 - protein, 14 aa, Mycobacterium tuberculosis
TDSPPLGSGAGPRY

SEQ ID NO: 105521 - protein, 14 aa, Mycobacterium tuberculosis
DSPPLGSGAGPRYA

SEQ ID NO: 105522 - protein, 14 aa, Mycobacterium tuberculosis
SPPLGSGAGPRYAG

SEQ ID NO: 105523 - protein, 14 aa, Mycobacterium tuberculosis
PPLGSGAGPRYAGP

SEQ ID NO: 105524 - protein, 14 aa, Mycobacterium tuberculosis
PLGSGAGPRYAGPL

SEQ ID NO: 105525 - protein, 14 aa, Mycobacterium tuberculosis
LGSGAGPRYAGPLF

SEQ ID NO: 105526 - protein, 14 aa, Mycobacterium tuberculosis
GSGAGPRYAGPLFV

SEQ ID NO: 105527 - protein, 14 aa, Mycobacterium tuberculosis
SGAGPRYAGPLFVT

SEQ ID NO: 105528 - protein, 14 aa, Mycobacterium tuberculosis
GAGPRYAGPLFVTD

SEQ ID NO: 105529 - protein, 14 aa, Mycobacterium tuberculosis
AGPRYAGPLFVTDL

SEQ ID NO: 105530 - protein, 14 aa, Mycobacterium tuberculosis
GPRYAGPLFVTDLD

SEQ ID NO: 105531 - protein, 14 aa, Mycobacterium tuberculosis
PRYAGPLFVTDLDS

SEQ ID NO: 105532 - protein, 14 aa, Mycobacterium tuberculosis
RYAGPLFVTDLDSP

SEQ ID NO: 105533 - protein, 14 aa, Mycobacterium tuberculosis
YAGPLFVTDLDSPV

SEQ ID NO: 105534 - protein, 14 aa, Mycobacterium tuberculosis
AGPLFVTDLDSPVE

SEQ ID NO: 105535 - protein, 14 aa, Mycobacterium tuberculosis
GPLFVTDLDSPVEP

SEQ ID NO: 105536 - protein, 14 aa, Mycobacterium tuberculosis
PLFVTDLDSPVEPP

SEQ ID NO: 105537 - protein, 14 aa, Mycobacterium tuberculosis
LFVTDLDSPVEPPR

SEQ ID NO: 105538 - protein, 14 aa, Mycobacterium tuberculosis
FVTDLDSPVEPPRH

SEQ ID NO: 105539 - protein, 14 aa, Mycobacterium tuberculosis
VTDLDSPVEPPRHG

SEQ ID NO: 105540 - protein, 14 aa, Mycobacterium tuberculosis
TDLDSPVEPPRHGQ

SEQ ID NO: 105541 - protein, 14 aa, Mycobacterium tuberculosis
DLDSPVEPPRHGQP

SEQ ID NO: 105542 - protein, 14 aa, Mycobacterium tuberculosis
LDSPVEPPRHGQPN

SEQ ID NO: 105543 - protein, 14 aa, Mycobacterium tuberculosis
DSPVEPPRHGQPNP

SEQ ID NO: 105544 - protein, 14 aa, Mycobacterium tuberculosis
SPVEPPRHGQPNPQ

SEQ ID NO: 105545 - protein, 14 aa, Mycobacterium tuberculosis
PVEPPRHGQPNPQF

SEQ ID NO: 105546 - protein, 14 aa, Mycobacterium tuberculosis
VEPPRHGQPNPQFR

SEQ ID NO: 105547 - protein, 14 aa, Mycobacterium tuberculosis
EPPRHGQPNPQFRT

SEQ ID NO: 105548 - protein, 14 aa, Mycobacterium tuberculosis
PPRHGQPNPQFRTA

SEQ ID NO: 105549 - protein, 14 aa, Mycobacterium tuberculosis
PRHGQPNPQFRTAR

SEQ ID NO: 105550 - protein, 14 aa, Mycobacterium tuberculosis
RHGQPNPQFRTARH

SEQ ID NO: 105551 - protein, 14 aa, Mycobacterium tuberculosis
HGQPNPQFRTARHA

SEQ ID NO: 105552 - protein, 14 aa, Mycobacterium tuberculosis
GQPNPQFRTARHAN

SEQ ID NO: 105553 - protein, 14 aa, Mycobacterium tuberculosis
QPNPQFRTARHANH

SEQ ID NO: 105554 - protein, 14 aa, Mycobacterium tuberculosis
PNPQFRTARHANHV

SEQ ID NO: 105555 - protein, 15 aa, Mycobacterium tuberculosis
MFTLLVSWLLVACVP

SEQ ID NO: 105556 - protein, 15 aa, Mycobacterium tuberculosis
FTLLVSWLLVACVPG

SEQ ID NO: 105557 - protein, 15 aa, Mycobacterium tuberculosis
TLLVSWLLVACVPGL

SEQ ID NO: 105558 - protein, 15 aa, Mycobacterium tuberculosis
LLVSWLLVACVPGLL

SEQ ID NO: 105559 - protein, 15 aa, Mycobacterium tuberculosis
LVSWLLVACVPGLLM

SEQ ID NO: 105560 - protein, 15 aa, Mycobacterium tuberculosis
VSWLLVACVPGLLML

SEQ ID NO: 105561 - protein, 15 aa, Mycobacterium tuberculosis
SWLLVACVPGLLMLA

SEQ ID NO: 105562 - protein, 15 aa, Mycobacterium tuberculosis
WLLVACVPGLLMLAT

SEQ ID NO: 105563 - protein, 15 aa, Mycobacterium tuberculosis
LLVACVPGLLMLATL

SEQ ID NO: 105564 - protein, 15 aa, Mycobacterium tuberculosis
LVACVPGLLMLATLG

SEQ ID NO: 105565 - protein, 15 aa, Mycobacterium tuberculosis
VACVPGLLMLATLGL

SEQ ID NO: 105566 - protein, 15 aa, Mycobacterium tuberculosis
ACVPGLLMLATLGLG

SEQ ID NO: 105567 - protein, 15 aa, Mycobacterium tuberculosis
CVPGLLMLATLGLGR

SEQ ID NO: 105568 - protein, 15 aa, Mycobacterium tuberculosis
VPGLLMLATLGLGRL

SEQ ID NO: 105569 - protein, 15 aa, Mycobacterium tuberculosis
PGLLMLATLGLGRLE

SEQ ID NO: 105570 - protein, 15 aa, Mycobacterium tuberculosis
GLLMLATLGLGRLER

SEQ ID NO: 105571 - protein, 15 aa, Mycobacterium tuberculosis
LLMLATLGLGRLERF

SEQ ID NO: 105572 - protein, 15 aa, Mycobacterium tuberculosis
LMLATLGLGRLERFL

SEQ ID NO: 105573 - protein, 15 aa, Mycobacterium tuberculosis
MLATLGLGRLERFLA

SEQ ID NO: 105574 - protein, 15 aa, Mycobacterium tuberculosis
LATLGLGRLERFLAR

SEQ ID NO: 105575 - protein, 15 aa, Mycobacterium tuberculosis
ATLGLGRLERFLARD

SEQ ID NO: 105576 - protein, 15 aa, Mycobacterium tuberculosis
TLGLGRLERFLARDT

SEQ ID NO: 105577 - protein, 15 aa, Mycobacterium tuberculosis
LGLGRLERFLARDTV

SEQ ID NO: 105578 - protein, 15 aa, Mycobacterium tuberculosis
GLGRLERFLARDTVT

SEQ ID NO: 105579 - protein, 15 aa, Mycobacterium tuberculosis
LGRLERFLARDTVTA

SEQ ID NO: 105580 - protein, 15 aa, Mycobacterium tuberculosis
GRLERFLARDTVTAT

SEQ ID NO: 105581 - protein, 15 aa, Mycobacterium tuberculosis
RLERFLARDTVTATD

SEQ ID NO: 105582 - protein, 15 aa, Mycobacterium tuberculosis
LERFLARDTVTATDV

SEQ ID NO: 105583 - protein, 15 aa, Mycobacterium tuberculosis
ERFLARDTVTATDVA

SEQ ID NO: 105584 - protein, 15 aa, Mycobacterium tuberculosis
RFLARDTVTATDVAE

SEQ ID NO: 105585 - protein, 15 aa, Mycobacterium tuberculosis
FLARDTVTATDVAEF

SEQ ID NO: 105586 - protein, 15 aa, Mycobacterium tuberculosis
LARDTVTATDVAEFL

SEQ ID NO: 105587 - protein, 15 aa, Mycobacterium tuberculosis
ARDTVTATDVAEFLE

SEQ ID NO: 105588 - protein, 15 aa, Mycobacterium tuberculosis
RDTVTATDVAEFLEQ

SEQ ID NO: 105589 - protein, 15 aa, Mycobacterium tuberculosis
DTVTATDVAEFLEQA

SEQ ID NO: 105590 - protein, 15 aa, Mycobacterium tuberculosis
TVTATDVAEFLEQAE

SEQ ID NO: 105591 - protein, 15 aa, Mycobacterium tuberculosis
VTATDVAEFLEQAEA

SEQ ID NO: 105592 - protein, 15 aa, Mycobacterium tuberculosis
TATDVAEFLEQAEAV

SEQ ID NO: 105593 - protein, 15 aa, Mycobacterium tuberculosis
ATDVAEFLEQAEAVD

SEQ ID NO: 105594 - protein, 15 aa, Mycobacterium tuberculosis
TDVAEFLEQAEAVDV

SEQ ID NO: 105595 - protein, 15 aa, Mycobacterium tuberculosis
DVAEFLEQAEAVDVH

SEQ ID NO: 105596 - protein, 15 aa, Mycobacterium tuberculosis
VAEFLEQAEAVDVHT

SEQ ID NO: 105597 - protein, 15 aa, Mycobacterium tuberculosis
AEFLEQAEAVDVHTL

SEQ ID NO: 105598 - protein, 15 aa, Mycobacterium tuberculosis
EFLEQAEAVDVHTLA

SEQ ID NO: 105599 - protein, 15 aa, Mycobacterium tuberculosis
FLEQAEAVDVHTLAR

SEQ ID NO: 105600 - protein, 15 aa, Mycobacterium tuberculosis
LEQAEAVDVHTLARN

SEQ ID NO: 105601 - protein, 15 aa, Mycobacterium tuberculosis
EQAEAVDVHTLARNG

SEQ ID NO: 105602 - protein, 15 aa, Mycobacterium tuberculosis
QAEAVDVHTLARNGM

SEQ ID NO: 105603 - protein, 15 aa, Mycobacterium tuberculosis
AEAVDVHTLARNGMP

SEQ ID NO: 105604 - protein, 15 aa, Mycobacterium tuberculosis
EAVDVHTLARNGMPE

SEQ ID NO: 105605 - protein, 15 aa, Mycobacterium tuberculosis
AVDVHTLARNGMPEA

SEQ ID NO: 105606 - protein, 15 aa, Mycobacterium tuberculosis
VDVHTLARNGMPEAL

SEQ ID NO: 105607 - protein, 15 aa, Mycobacterium tuberculosis
DVHTLARNGMPEALD

SEQ ID NO: 105608 - protein, 15 aa, Mycobacterium tuberculosis
VHTLARNGMPEALDY

SEQ ID NO: 105609 - protein, 15 aa, Mycobacterium tuberculosis
HTLARNGMPEALDYL

SEQ ID NO: 105610 - protein, 15 aa, Mycobacterium tuberculosis
TLARNGMPEALDYLH

SEQ ID NO: 105611 - protein, 15 aa, Mycobacterium tuberculosis
LARNGMPEALDYLHR

SEQ ID NO: 105612 - protein, 15 aa, Mycobacterium tuberculosis
ARNGMPEALDYLHRR

SEQ ID NO: 105613 - protein, 15 aa, Mycobacterium tuberculosis
RNGMPEALDYLHRRQ

SEQ ID NO: 105614 - protein, 15 aa, Mycobacterium tuberculosis
NGMPEALDYLHRRQA

SEQ ID NO: 105615 - protein, 15 aa, Mycobacterium tuberculosis
GMPEALDYLHRRQAR

SEQ ID NO: 105616 - protein, 15 aa, Mycobacterium tuberculosis
MPEALDYLHRRQARR

SEQ ID NO: 105617 - protein, 15 aa, Mycobacterium tuberculosis
PEALDYLHRRQARRI

SEQ ID NO: 105618 - protein, 15 aa, Mycobacterium tuberculosis
EALDYLHRRQARRIT

SEQ ID NO: 105619 - protein, 15 aa, Mycobacterium tuberculosis
ALDYLHRRQARRITD

SEQ ID NO: 105620 - protein, 15 aa, Mycobacterium tuberculosis
LDYLHRRQARRITDS

SEQ ID NO: 105621 - protein, 15 aa, Mycobacterium tuberculosis
DYLHRRQARRITDSP

SEQ ID NO: 105622 - protein, 15 aa, Mycobacterium tuberculosis
YLHRRQARRITDSPP

SEQ ID NO: 105623 - protein, 15 aa, Mycobacterium tuberculosis
LHRRQARRITDSPPL

SEQ ID NO: 105624 - protein, 15 aa, Mycobacterium tuberculosis
HRRQARRITDSPPLG

SEQ ID NO: 105625 - protein, 15 aa, Mycobacterium tuberculosis
RRQARRITDSPPLGS

SEQ ID NO: 105626 - protein, 15 aa, Mycobacterium tuberculosis
RQARRITDSPPLGSG

SEQ ID NO: 105627 - protein, 15 aa, Mycobacterium tuberculosis
QARRITDSPPLGSGA

SEQ ID NO: 105628 - protein, 15 aa, Mycobacterium tuberculosis
ARRITDSPPLGSGAG

SEQ ID NO: 105629 - protein, 15 aa, Mycobacterium tuberculosis
RRITDSPPLGSGAGP

SEQ ID NO: 105630 - protein, 15 aa, Mycobacterium tuberculosis
RITDSPPLGSGAGPR

SEQ ID NO: 105631 - protein, 15 aa, Mycobacterium tuberculosis
ITDSPPLGSGAGPRY

SEQ ID NO: 105632 - protein, 15 aa, Mycobacterium tuberculosis
TDSPPLGSGAGPRYA

SEQ ID NO: 105633 - protein, 15 aa, Mycobacterium tuberculosis
DSPPLGSGAGPRYAG

SEQ ID NO: 105634 - protein, 15 aa, Mycobacterium tuberculosis
SPPLGSGAGPRYAGP

SEQ ID NO: 105635 - protein, 15 aa, Mycobacterium tuberculosis
PPLGSGAGPRYAGPL

SEQ ID NO: 105636 - protein, 15 aa, Mycobacterium tuberculosis
PLGSGAGPRYAGPLF

SEQ ID NO: 105637 - protein, 15 aa, Mycobacterium tuberculosis
LGSGAGPRYAGPLFV

SEQ ID NO: 105638 - protein, 15 aa, Mycobacterium tuberculosis
GSGAGPRYAGPLFVT

SEQ ID NO: 105639 - protein, 15 aa, Mycobacterium tuberculosis
SGAGPRYAGPLFVTD

SEQ ID NO: 105640 - protein, 15 aa, Mycobacterium tuberculosis
GAGPRYAGPLFVTDL

SEQ ID NO: 105641 - protein, 15 aa, Mycobacterium tuberculosis
AGPRYAGPLFVTDLD

SEQ ID NO: 105642 - protein, 15 aa, Mycobacterium tuberculosis
GPRYAGPLFVTDLDS

SEQ ID NO: 105643 - protein, 15 aa, Mycobacterium tuberculosis
PRYAGPLFVTDLDSP

SEQ ID NO: 105644 - protein, 15 aa, Mycobacterium tuberculosis
RYAGPLFVTDLDSPV

SEQ ID NO: 105645 - protein, 15 aa, Mycobacterium tuberculosis
YAGPLFVTDLDSPVE

SEQ ID NO: 105646 - protein, 15 aa, Mycobacterium tuberculosis
AGPLFVTDLDSPVEP

SEQ ID NO: 105647 - protein, 15 aa, Mycobacterium tuberculosis
GPLFVTDLDSPVEPP

SEQ ID NO: 105648 - protein, 15 aa, Mycobacterium tuberculosis
PLFVTDLDSPVEPPR

SEQ ID NO: 105649 - protein, 15 aa, Mycobacterium tuberculosis
LFVTDLDSPVEPPRH

SEQ ID NO: 105650 - protein, 15 aa, Mycobacterium tuberculosis
FVTDLDSPVEPPRHG

SEQ ID NO: 105651 - protein, 15 aa, Mycobacterium tuberculosis
VTDLDSPVEPPRHGQ

SEQ ID NO: 105652 - protein, 15 aa, Mycobacterium tuberculosis
TDLDSPVEPPRHGQP

SEQ ID NO: 105653 - protein, 15 aa, Mycobacterium tuberculosis
DLDSPVEPPRHGQPN

SEQ ID NO: 105654 - protein, 15 aa, Mycobacterium tuberculosis
LDSPVEPPRHGQPNP

SEQ ID NO: 105655 - protein, 15 aa, Mycobacterium tuberculosis
DSPVEPPRHGQPNPQ

SEQ ID NO: 105656 - protein, 15 aa, Mycobacterium tuberculosis
SPVEPPRHGQPNPQF

SEQ ID NO: 105657 - protein, 15 aa, Mycobacterium tuberculosis
PVEPPRHGQPNPQFR

SEQ ID NO: 105658 - protein, 15 aa, Mycobacterium tuberculosis
VEPPRHGQPNPQFRT

SEQ ID NO: 105659 - protein, 15 aa, Mycobacterium tuberculosis
EPPRHGQPNPQFRTA

SEQ ID NO: 105660 - protein, 15 aa, Mycobacterium tuberculosis
PPRHGQPNPQFRTAR

SEQ ID NO: 105661 - protein, 15 aa, Mycobacterium tuberculosis
PRHGQPNPQFRTARH

SEQ ID NO: 105662 - protein, 15 aa, Mycobacterium tuberculosis
RHGQPNPQFRTARHA

SEQ ID NO: 105663 - protein, 15 aa, Mycobacterium tuberculosis
HGQPNPQFRTARHAN

SEQ ID NO: 105664 - protein, 15 aa, Mycobacterium tuberculosis
GQPNPQFRTARHANH

SEQ ID NO: 105665 - protein, 15 aa, Mycobacterium tuberculosis
QPNPQFRTARHANHV

SEQ ID NO: 105666 - protein, 16 aa, Mycobacterium tuberculosis
MFTLLVSWLLVACVPG

SEQ ID NO: 105667 - protein, 16 aa, Mycobacterium tuberculosis
FTLLVSWLLVACVPGL

SEQ ID NO: 105668 - protein, 16 aa, Mycobacterium tuberculosis
TLLVSWLLVACVPGLL

SEQ ID NO: 105669 - protein, 16 aa, Mycobacterium tuberculosis
LLVSWLLVACVPGLLM

SEQ ID NO: 105670 - protein, 16 aa, Mycobacterium tuberculosis
LVSWLLVACVPGLLML

SEQ ID NO: 105671 - protein, 16 aa, Mycobacterium tuberculosis
VSWLLVACVPGLLMLA

SEQ ID NO: 105672 - protein, 16 aa, Mycobacterium tuberculosis
SWLLVACVPGLLMLAT

SEQ ID NO: 105673 - protein, 16 aa, Mycobacterium tuberculosis
WLLVACVPGLLMLATL

SEQ ID NO: 105674 - protein, 16 aa, Mycobacterium tuberculosis
LLVACVPGLLMLATLG

SEQ ID NO: 105675 - protein, 16 aa, Mycobacterium tuberculosis
LVACVPGLLMLATLGL

SEQ ID NO: 105676 - protein, 16 aa, Mycobacterium tuberculosis
VACVPGLLMLATLGLG

SEQ ID NO: 105677 - protein, 16 aa, Mycobacterium tuberculosis
ACVPGLLMLATLGLGR

SEQ ID NO: 105678 - protein, 16 aa, Mycobacterium tuberculosis
CVPGLLMLATLGLGRL

SEQ ID NO: 105679 - protein, 16 aa, Mycobacterium tuberculosis
VPGLLMLATLGLGRLE

SEQ ID NO: 105680 - protein, 16 aa, Mycobacterium tuberculosis
PGLLMLATLGLGRLER

SEQ ID NO: 105681 - protein, 16 aa, Mycobacterium tuberculosis
GLLMLATLGLGRLERF

SEQ ID NO: 105682 - protein, 16 aa, Mycobacterium tuberculosis
LLMLATLGLGRLERFL

SEQ ID NO: 105683 - protein, 16 aa, Mycobacterium tuberculosis
LMLATLGLGRLERFLA

SEQ ID NO: 105684 - protein, 16 aa, Mycobacterium tuberculosis
MLATLGLGRLERFLAR

SEQ ID NO: 105685 - protein, 16 aa, Mycobacterium tuberculosis
LATLGLGRLERFLARD

SEQ ID NO: 105686 - protein, 16 aa, Mycobacterium tuberculosis
ATLGLGRLERFLARDT

SEQ ID NO: 105687 - protein, 16 aa, Mycobacterium tuberculosis
TLGLGRLERFLARDTV

SEQ ID NO: 105688 - protein, 16 aa, Mycobacterium tuberculosis
LGLGRLERFLARDTVT

SEQ ID NO: 105689 - protein, 16 aa, Mycobacterium tuberculosis
GLGRLERFLARDTVTA

SEQ ID NO: 105690 - protein, 16 aa, Mycobacterium tuberculosis
LGRLERFLARDTVTAT

SEQ ID NO: 105691 - protein, 16 aa, Mycobacterium tuberculosis
GRLERFLARDTVTATD

SEQ ID NO: 105692 - protein, 16 aa, Mycobacterium tuberculosis
RLERFLARDTVTATDV

SEQ ID NO: 105693 - protein, 16 aa, Mycobacterium tuberculosis
LERFLARDTVTATDVA

SEQ ID NO: 105694 - protein, 16 aa, Mycobacterium tuberculosis
ERFLARDTVTATDVAE

SEQ ID NO: 105695 - protein, 16 aa, Mycobacterium tuberculosis
RFLARDTVTATDVAEF

SEQ ID NO: 105696 - protein, 16 aa, Mycobacterium tuberculosis
FLARDTVTATDVAEFL

SEQ ID NO: 105697 - protein, 16 aa, Mycobacterium tuberculosis
LARDTVTATDVAEFLE

SEQ ID NO: 105698 - protein, 16 aa, Mycobacterium tuberculosis
ARDTVTATDVAEFLEQ

SEQ ID NO: 105699 - protein, 16 aa, Mycobacterium tuberculosis
RDTVTATDVAEFLEQA

SEQ ID NO: 105700 - protein, 16 aa, Mycobacterium tuberculosis
DTVTATDVAEFLEQAE

SEQ ID NO: 105701 - protein, 16 aa, Mycobacterium tuberculosis
TVTATDVAEFLEQAEA

SEQ ID NO: 105702 - protein, 16 aa, Mycobacterium tuberculosis
VTATDVAEFLEQAEAV

SEQ ID NO: 105703 - protein, 16 aa, Mycobacterium tuberculosis
TATDVAEFLEQAEAVD

SEQ ID NO: 105704 - protein, 16 aa, Mycobacterium tuberculosis
ATDVAEFLEQAEAVDV

SEQ ID NO: 105705 - protein, 16 aa, Mycobacterium tuberculosis
TDVAEFLEQAEAVDVH

SEQ ID NO: 105706 - protein, 16 aa, Mycobacterium tuberculosis
DVAEFLEQAEAVDVHT

SEQ ID NO: 105707 - protein, 16 aa, Mycobacterium tuberculosis
VAEFLEQAEAVDVHTL

SEQ ID NO: 105708 - protein, 16 aa, Mycobacterium tuberculosis
AEFLEQAEAVDVHTLA

SEQ ID NO: 105709 - protein, 16 aa, Mycobacterium tuberculosis
EFLEQAEAVDVHTLAR

SEQ ID NO: 105710 - protein, 16 aa, Mycobacterium tuberculosis
FLEQAEAVDVHTLARN

SEQ ID NO: 105711 - protein, 16 aa, Mycobacterium tuberculosis
LEQAEAVDVHTLARNG

SEQ ID NO: 105712 - protein, 16 aa, Mycobacterium tuberculosis
EQAEAVDVHTLARNGM

SEQ ID NO: 105713 - protein, 16 aa, Mycobacterium tuberculosis
QAEAVDVHTLARNGMP

SEQ ID NO: 105714 - protein, 16 aa, Mycobacterium tuberculosis
AEAVDVHTLARNGMPE

SEQ ID NO: 105715 - protein, 16 aa, Mycobacterium tuberculosis
EAVDVHTLARNGMPEA

SEQ ID NO: 105716 - protein, 16 aa, Mycobacterium tuberculosis
AVDVHTLARNGMPEAL

SEQ ID NO: 105717 - protein, 16 aa, Mycobacterium tuberculosis
VDVHTLARNGMPEALD

SEQ ID NO: 105718 - protein, 16 aa, Mycobacterium tuberculosis
DVHTLARNGMPEALDY

SEQ ID NO: 105719 - protein, 16 aa, Mycobacterium tuberculosis
VHTLARNGMPEALDYL

SEQ ID NO: 105720 - protein, 16 aa, Mycobacterium tuberculosis
HTLARNGMPEALDYLH

SEQ ID NO: 105721 - protein, 16 aa, Mycobacterium tuberculosis
TLARNGMPEALDYLHR

SEQ ID NO: 105722 - protein, 16 aa, Mycobacterium tuberculosis
LARNGMPEALDYLHRR

SEQ ID NO: 105723 - protein, 16 aa, Mycobacterium tuberculosis
ARNGMPEALDYLHRRQ

SEQ ID NO: 105724 - protein, 16 aa, Mycobacterium tuberculosis
RNGMPEALDYLHRRQA

SEQ ID NO: 105725 - protein, 16 aa, Mycobacterium tuberculosis
NGMPEALDYLHRRQAR

SEQ ID NO: 105726 - protein, 16 aa, Mycobacterium tuberculosis
GMPEALDYLHRRQARR

SEQ ID NO: 105727 - protein, 16 aa, Mycobacterium tuberculosis
MPEALDYLHRRQARRI

SEQ ID NO: 105728 - protein, 16 aa, Mycobacterium tuberculosis
PEALDYLHRRQARRIT

SEQ ID NO: 105729 - protein, 16 aa, Mycobacterium tuberculosis
EALDYLHRRQARRITD

SEQ ID NO: 105730 - protein, 16 aa, Mycobacterium tuberculosis
ALDYLHRRQARRITDS

SEQ ID NO: 105731 - protein, 16 aa, Mycobacterium tuberculosis
LDYLHRRQARRITDSP

SEQ ID NO: 105732 - protein, 16 aa, Mycobacterium tuberculosis
DYLHRRQARRITDSPP

SEQ ID NO: 105733 - protein, 16 aa, Mycobacterium tuberculosis
YLHRRQARRITDSPPL

SEQ ID NO: 105734 - protein, 16 aa, Mycobacterium tuberculosis
LHRRQARRITDSPPLG

SEQ ID NO: 105735 - protein, 16 aa, Mycobacterium tuberculosis
HRRQARRITDSPPLGS

SEQ ID NO: 105736 - protein, 16 aa, Mycobacterium tuberculosis
RRQARRITDSPPLGSG

SEQ ID NO: 105737 - protein, 16 aa, Mycobacterium tuberculosis
RQARRITDSPPLGSGA

SEQ ID NO: 105738 - protein, 16 aa, Mycobacterium tuberculosis
QARRITDSPPLGSGAG

SEQ ID NO: 105739 - protein, 16 aa, Mycobacterium tuberculosis
ARRITDSPPLGSGAGP

SEQ ID NO: 105740 - protein, 16 aa, Mycobacterium tuberculosis
RRITDSPPLGSGAGPR

SEQ ID NO: 105741 - protein, 16 aa, Mycobacterium tuberculosis
RITDSPPLGSGAGPRY

SEQ ID NO: 105742 - protein, 16 aa, Mycobacterium tuberculosis
ITDSPPLGSGAGPRYA

SEQ ID NO: 105743 - protein, 16 aa, Mycobacterium tuberculosis
TDSPPLGSGAGPRYAG

SEQ ID NO: 105744 - protein, 16 aa, Mycobacterium tuberculosis
DSPPLGSGAGPRYAGP

SEQ ID NO: 105745 - protein, 16 aa, Mycobacterium tuberculosis
SPPLGSGAGPRYAGPL

SEQ ID NO: 105746 - protein, 16 aa, Mycobacterium tuberculosis
PPLGSGAGPRYAGPLF

SEQ ID NO: 105747 - protein, 16 aa, Mycobacterium tuberculosis
PLGSGAGPRYAGPLFV

SEQ ID NO: 105748 - protein, 16 aa, Mycobacterium tuberculosis
LGSGAGPRYAGPLFVT

SEQ ID NO: 105749 - protein, 16 aa, Mycobacterium tuberculosis
GSGAGPRYAGPLFVTD

SEQ ID NO: 105750 - protein, 16 aa, Mycobacterium tuberculosis
SGAGPRYAGPLFVTDL

SEQ ID NO: 105751 - protein, 16 aa, Mycobacterium tuberculosis
GAGPRYAGPLFVTDLD

SEQ ID NO: 105752 - protein, 16 aa, Mycobacterium tuberculosis
AGPRYAGPLFVTDLDS

SEQ ID NO: 105753 - protein, 16 aa, Mycobacterium tuberculosis
GPRYAGPLFVTDLDSP

SEQ ID NO: 105754 - protein, 16 aa, Mycobacterium tuberculosis
PRYAGPLFVTDLDSPV

SEQ ID NO: 105755 - protein, 16 aa, Mycobacterium tuberculosis
RYAGPLFVTDLDSPVE

SEQ ID NO: 105756 - protein, 16 aa, Mycobacterium tuberculosis
YAGPLFVTDLDSPVEP

SEQ ID NO: 105757 - protein, 16 aa, Mycobacterium tuberculosis
AGPLFVTDLDSPVEPP

SEQ ID NO: 105758 - protein, 16 aa, Mycobacterium tuberculosis
GPLFVTDLDSPVEPPR

SEQ ID NO: 105759 - protein, 16 aa, Mycobacterium tuberculosis
PLFVTDLDSPVEPPRH

SEQ ID NO: 105760 - protein, 16 aa, Mycobacterium tuberculosis
LFVTDLDSPVEPPRHG

SEQ ID NO: 105761 - protein, 16 aa, Mycobacterium tuberculosis
FVTDLDSPVEPPRHGQ

SEQ ID NO: 105762 - protein, 16 aa, Mycobacterium tuberculosis
VTDLDSPVEPPRHGQP

SEQ ID NO: 105763 - protein, 16 aa, Mycobacterium tuberculosis
TDLDSPVEPPRHGQPN

SEQ ID NO: 105764 - protein, 16 aa, Mycobacterium tuberculosis
DLDSPVEPPRHGQPNP

SEQ ID NO: 105765 - protein, 16 aa, Mycobacterium tuberculosis
LDSPVEPPRHGQPNPQ

SEQ ID NO: 105766 - protein, 16 aa, Mycobacterium tuberculosis
DSPVEPPRHGQPNPQF

SEQ ID NO: 105767 - protein, 16 aa, Mycobacterium tuberculosis
SPVEPPRHGQPNPQFR

SEQ ID NO: 105768 - protein, 16 aa, Mycobacterium tuberculosis
PVEPPRHGQPNPQFRT

SEQ ID NO: 105769 - protein, 16 aa, Mycobacterium tuberculosis
VEPPRHGQPNPQFRTA

SEQ ID NO: 105770 - protein, 16 aa, Mycobacterium tuberculosis
EPPRHGQPNPQFRTAR

SEQ ID NO: 105771 - protein, 16 aa, Mycobacterium tuberculosis
PPRHGQPNPQFRTARH

SEQ ID NO: 105772 - protein, 16 aa, Mycobacterium tuberculosis
PRHGQPNPQFRTARHA

SEQ ID NO: 105773 - protein, 16 aa, Mycobacterium tuberculosis
RHGQPNPQFRTARHAN

SEQ ID NO: 105774 - protein, 16 aa, Mycobacterium tuberculosis
HGQPNPQFRTARHANH

SEQ ID NO: 105775 - protein, 16 aa, Mycobacterium tuberculosis
GQPNPQFRTARHANHV

SEQ ID NO: 105776 - protein, 13 aa, Mycobacterium tuberculosis
MSLAWDVVSVDKP

SEQ ID NO: 105777 - protein, 13 aa, Mycobacterium tuberculosis
SLAWDVVSVDKPD

SEQ ID NO: 105778 - protein, 13 aa, Mycobacterium tuberculosis
LAWDVVSVDKPDD

SEQ ID NO: 105779 - protein, 13 aa, Mycobacterium tuberculosis
AWDVVSVDKPDDV

SEQ ID NO: 105780 - protein, 13 aa, Mycobacterium tuberculosis
WDVVSVDKPDDVN

SEQ ID NO: 105781 - protein, 13 aa, Mycobacterium tuberculosis
DVVSVDKPDDVNV

SEQ ID NO: 105782 - protein, 13 aa, Mycobacterium tuberculosis
VVSVDKPDDVNVV

SEQ ID NO: 105783 - protein, 13 aa, Mycobacterium tuberculosis
VSVDKPDDVNVVI

SEQ ID NO: 105784 - protein, 13 aa, Mycobacterium tuberculosis
SVDKPDDVNVVIG

SEQ ID NO: 105785 - protein, 13 aa, Mycobacterium tuberculosis
VDKPDDVNVVIGQ

SEQ ID NO: 105786 - protein, 13 aa, Mycobacterium tuberculosis
DKPDDVNVVIGQA

SEQ ID NO: 105787 - protein, 13 aa, Mycobacterium tuberculosis
KPDDVNVVIGQAH

SEQ ID NO: 105788 - protein, 13 aa, Mycobacterium tuberculosis
PDDVNVVIGQAHF

SEQ ID NO: 105789 - protein, 13 aa, Mycobacterium tuberculosis
DDVNVVIGQAHFI

SEQ ID NO: 105790 - protein, 13 aa, Mycobacterium tuberculosis
DVNVVIGQAHFIK

SEQ ID NO: 105791 - protein, 13 aa, Mycobacterium tuberculosis
VNVVIGQAHFIKA

SEQ ID NO: 105792 - protein, 13 aa, Mycobacterium tuberculosis
NVVIGQAHFIKAV

SEQ ID NO: 105793 - protein, 13 aa, Mycobacterium tuberculosis
VVIGQAHFIKAVE

SEQ ID NO: 105794 - protein, 13 aa, Mycobacterium tuberculosis
VIGQAHFIKAVED

SEQ ID NO: 105795 - protein, 13 aa, Mycobacterium tuberculosis
IGQAHFIKAVEDL

SEQ ID NO: 105796 - protein, 13 aa, Mycobacterium tuberculosis
GQAHFIKAVEDLH

SEQ ID NO: 105797 - protein, 13 aa, Mycobacterium tuberculosis
QAHFIKAVEDLHE

SEQ ID NO: 105798 - protein, 13 aa, Mycobacterium tuberculosis
AHFIKAVEDLHEA

SEQ ID NO: 105799 - protein, 13 aa, Mycobacterium tuberculosis
HFIKAVEDLHEAM

SEQ ID NO: 105800 - protein, 13 aa, Mycobacterium tuberculosis
FIKAVEDLHEAMV

SEQ ID NO: 105801 - protein, 13 aa, Mycobacterium tuberculosis
IKAVEDLHEAMVG

SEQ ID NO: 105802 - protein, 13 aa, Mycobacterium tuberculosis
KAVEDLHEAMVGV

SEQ ID NO: 105803 - protein, 13 aa, Mycobacterium tuberculosis
AVEDLHEAMVGVS

SEQ ID NO: 105804 - protein, 13 aa, Mycobacterium tuberculosis
VEDLHEAMVGVSP

SEQ ID NO: 105805 - protein, 13 aa, Mycobacterium tuberculosis
EDLHEAMVGVSPS

SEQ ID NO: 105806 - protein, 13 aa, Mycobacterium tuberculosis
DLHEAMVGVSPSL

SEQ ID NO: 105807 - protein, 13 aa, Mycobacterium tuberculosis
LHEAMVGVSPSLR

SEQ ID NO: 105808 - protein, 13 aa, Mycobacterium tuberculosis
HEAMVGVSPSLRF

SEQ ID NO: 105809 - protein, 13 aa, Mycobacterium tuberculosis
EAMVGVSPSLRFG

SEQ ID NO: 105810 - protein, 13 aa, Mycobacterium tuberculosis
AMVGVSPSLRFGL

SEQ ID NO: 105811 - protein, 13 aa, Mycobacterium tuberculosis
MVGVSPSLRFGLA

SEQ ID NO: 105812 - protein, 13 aa, Mycobacterium tuberculosis
VGVSPSLRFGLAF

SEQ ID NO: 105813 - protein, 13 aa, Mycobacterium tuberculosis
GVSPSLRFGLAFC

SEQ ID NO: 105814 - protein, 13 aa, Mycobacterium tuberculosis
VSPSLRFGLAFCE

SEQ ID NO: 105815 - protein, 13 aa, Mycobacterium tuberculosis
SPSLRFGLAFCEA

SEQ ID NO: 105816 - protein, 13 aa, Mycobacterium tuberculosis
PSLRFGLAFCEAS

SEQ ID NO: 105817 - protein, 13 aa, Mycobacterium tuberculosis
SLRFGLAFCEASG

SEQ ID NO: 105818 - protein, 13 aa, Mycobacterium tuberculosis
LRFGLAFCEASGP

SEQ ID NO: 105819 - protein, 13 aa, Mycobacterium tuberculosis
RFGLAFCEASGPR

SEQ ID NO: 105820 - protein, 13 aa, Mycobacterium tuberculosis
FGLAFCEASGPRL

SEQ ID NO: 105821 - protein, 13 aa, Mycobacterium tuberculosis
GLAFCEASGPRLV

SEQ ID NO: 105822 - protein, 13 aa, Mycobacterium tuberculosis
LAFCEASGPRLVR

SEQ ID NO: 105823 - protein, 13 aa, Mycobacterium tuberculosis
AFCEASGPRLVRH

SEQ ID NO: 105824 - protein, 13 aa, Mycobacterium tuberculosis
FCEASGPRLVRHT

SEQ ID NO: 105825 - protein, 13 aa, Mycobacterium tuberculosis
CEASGPRLVRHTG

SEQ ID NO: 105826 - protein, 13 aa, Mycobacterium tuberculosis
EASGPRLVRHTGN

SEQ ID NO: 105827 - protein, 13 aa, Mycobacterium tuberculosis
ASGPRLVRHTGND

SEQ ID NO: 105828 - protein, 13 aa, Mycobacterium tuberculosis
SGPRLVRHTGNDG

SEQ ID NO: 105829 - protein, 13 aa, Mycobacterium tuberculosis
GPRLVRHTGNDGD

SEQ ID NO: 105830 - protein, 13 aa, Mycobacterium tuberculosis
PRLVRHTGNDGDL

SEQ ID NO: 105831 - protein, 13 aa, Mycobacterium tuberculosis
RLVRHTGNDGDLV

SEQ ID NO: 105832 - protein, 13 aa, Mycobacterium tuberculosis
LVRHTGNDGDLVE

SEQ ID NO: 105833 - protein, 13 aa, Mycobacterium tuberculosis
VRHTGNDGDLVEL

SEQ ID NO: 105834 - protein, 13 aa, Mycobacterium tuberculosis
RHTGNDGDLVELA

SEQ ID NO: 105835 - protein, 13 aa, Mycobacterium tuberculosis
HTGNDGDLVELAT

SEQ ID NO: 105836 - protein, 13 aa, Mycobacterium tuberculosis
TGNDGDLVELATR

SEQ ID NO: 105837 - protein, 13 aa, Mycobacterium tuberculosis
GNDGDLVELATRT

SEQ ID NO: 105838 - protein, 13 aa, Mycobacterium tuberculosis
NDGDLVELATRTA

SEQ ID NO: 105839 - protein, 13 aa, Mycobacterium tuberculosis
DGDLVELATRTAL

SEQ ID NO: 105840 - protein, 13 aa, Mycobacterium tuberculosis
GDLVELATRTALA

SEQ ID NO: 105841 - protein, 13 aa, Mycobacterium tuberculosis
DLVELATRTALAI

SEQ ID NO: 105842 - protein, 13 aa, Mycobacterium tuberculosis
LVELATRTALAIA

SEQ ID NO: 105843 - protein, 13 aa, Mycobacterium tuberculosis
VELATRTALAIAA

SEQ ID NO: 105844 - protein, 13 aa, Mycobacterium tuberculosis
ELATRTALAIAAG

SEQ ID NO: 105845 - protein, 13 aa, Mycobacterium tuberculosis
LATRTALAIAAGH

SEQ ID NO: 105846 - protein, 13 aa, Mycobacterium tuberculosis
ATRTALAIAAGHS

SEQ ID NO: 105847 - protein, 13 aa, Mycobacterium tuberculosis
TRTALAIAAGHSF

SEQ ID NO: 105848 - protein, 13 aa, Mycobacterium tuberculosis
RTALAIAAGHSFV

SEQ ID NO: 105849 - protein, 13 aa, Mycobacterium tuberculosis
TALAIAAGHSFVI

SEQ ID NO: 105850 - protein, 13 aa, Mycobacterium tuberculosis
ALAIAAGHSFVIF

SEQ ID NO: 105851 - protein, 13 aa, Mycobacterium tuberculosis
LAIAAGHSFVIFL

SEQ ID NO: 105852 - protein, 13 aa, Mycobacterium tuberculosis
AIAAGHSFVIFLR

SEQ ID NO: 105853 - protein, 13 aa, Mycobacterium tuberculosis
IAAGHSFVIFLRE

SEQ ID NO: 105854 - protein, 13 aa, Mycobacterium tuberculosis
AAGHSFVIFLREG

SEQ ID NO: 105855 - protein, 13 aa, Mycobacterium tuberculosis
AGHSFVIFLREGF

SEQ ID NO: 105856 - protein, 13 aa, Mycobacterium tuberculosis
GHSFVIFLREGFP

SEQ ID NO: 105857 - protein, 13 aa, Mycobacterium tuberculosis
HSFVIFLREGFPI

SEQ ID NO: 105858 - protein, 13 aa, Mycobacterium tuberculosis
SFVIFLREGFPIN

SEQ ID NO: 105859 - protein, 13 aa, Mycobacterium tuberculosis
FVIFLREGFPINI

SEQ ID NO: 105860 - protein, 13 aa, Mycobacterium tuberculosis
VIFLREGFPINIL

SEQ ID NO: 105861 - protein, 13 aa, Mycobacterium tuberculosis
IFLREGFPINILN

SEQ ID NO: 105862 - protein, 13 aa, Mycobacterium tuberculosis
FLREGFPINILNP

SEQ ID NO: 105863 - protein, 13 aa, Mycobacterium tuberculosis
LREGFPINILNPV

SEQ ID NO: 105864 - protein, 13 aa, Mycobacterium tuberculosis
REGFPINILNPVQ

SEQ ID NO: 105865 - protein, 13 aa, Mycobacterium tuberculosis
EGFPINILNPVQA

SEQ ID NO: 105866 - protein, 13 aa, Mycobacterium tuberculosis
GFPINILNPVQAV

SEQ ID NO: 105867 - protein, 13 aa, Mycobacterium tuberculosis
FPINILNPVQAVP

SEQ ID NO: 105868 - protein, 13 aa, Mycobacterium tuberculosis
PINILNPVQAVPE

SEQ ID NO: 105869 - protein, 13 aa, Mycobacterium tuberculosis
INILNPVQAVPEV

SEQ ID NO: 105870 - protein, 13 aa, Mycobacterium tuberculosis
NILNPVQAVPEVC

SEQ ID NO: 105871 - protein, 13 aa, Mycobacterium tuberculosis
ILNPVQAVPEVCT

SEQ ID NO: 105872 - protein, 13 aa, Mycobacterium tuberculosis
LNPVQAVPEVCTI

SEQ ID NO: 105873 - protein, 13 aa, Mycobacterium tuberculosis
NPVQAVPEVCTIY

SEQ ID NO: 105874 - protein, 13 aa, Mycobacterium tuberculosis
PVQAVPEVCTIYC

SEQ ID NO: 105875 - protein, 13 aa, Mycobacterium tuberculosis
VQAVPEVCTIYCA

SEQ ID NO: 105876 - protein, 13 aa, Mycobacterium tuberculosis
QAVPEVCTIYCAT

SEQ ID NO: 105877 - protein, 13 aa, Mycobacterium tuberculosis
AVPEVCTIYCATA

SEQ ID NO: 105878 - protein, 13 aa, Mycobacterium tuberculosis
VPEVCTIYCATAN

SEQ ID NO: 105879 - protein, 13 aa, Mycobacterium tuberculosis
PEVCTIYCATANP

SEQ ID NO: 105880 - protein, 13 aa, Mycobacterium tuberculosis
EVCTIYCATANPV

SEQ ID NO: 105881 - protein, 13 aa, Mycobacterium tuberculosis
VCTIYCATANPVD

SEQ ID NO: 105882 - protein, 13 aa, Mycobacterium tuberculosis
CTIYCATANPVDV

SEQ ID NO: 105883 - protein, 13 aa, Mycobacterium tuberculosis
TIYCATANPVDVV

SEQ ID NO: 105884 - protein, 13 aa, Mycobacterium tuberculosis
IYCATANPVDVVV

SEQ ID NO: 105885 - protein, 13 aa, Mycobacterium tuberculosis
YCATANPVDVVVA

SEQ ID NO: 105886 - protein, 13 aa, Mycobacterium tuberculosis
CATANPVDVVVAV

SEQ ID NO: 105887 - protein, 13 aa, Mycobacterium tuberculosis
ATANPVDVVVAVT

SEQ ID NO: 105888 - protein, 13 aa, Mycobacterium tuberculosis
TANPVDVVVAVTP

SEQ ID NO: 105889 - protein, 13 aa, Mycobacterium tuberculosis
ANPVDVVVAVTPH

SEQ ID NO: 105890 - protein, 13 aa, Mycobacterium tuberculosis
NPVDVVVAVTPHG

SEQ ID NO: 105891 - protein, 13 aa, Mycobacterium tuberculosis
PVDVVVAVTPHGR

SEQ ID NO: 105892 - protein, 13 aa, Mycobacterium tuberculosis
VDVVVAVTPHGRG

SEQ ID NO: 105893 - protein, 13 aa, Mycobacterium tuberculosis
DVVVAVTPHGRGI

SEQ ID NO: 105894 - protein, 13 aa, Mycobacterium tuberculosis
VVVAVTPHGRGIV

SEQ ID NO: 105895 - protein, 13 aa, Mycobacterium tuberculosis
VVAVTPHGRGIVG

SEQ ID NO: 105896 - protein, 13 aa, Mycobacterium tuberculosis
VAVTPHGRGIVGV

SEQ ID NO: 105897 - protein, 13 aa, Mycobacterium tuberculosis
AVTPHGRGIVGVV

SEQ ID NO: 105898 - protein, 13 aa, Mycobacterium tuberculosis
VTPHGRGIVGVVD

SEQ ID NO: 105899 - protein, 13 aa, Mycobacterium tuberculosis
TPHGRGIVGVVDG

SEQ ID NO: 105900 - protein, 13 aa, Mycobacterium tuberculosis
PHGRGIVGVVDGQ

SEQ ID NO: 105901 - protein, 13 aa, Mycobacterium tuberculosis
HGRGIVGVVDGQT

SEQ ID NO: 105902 - protein, 13 aa, Mycobacterium tuberculosis
GRGIVGVVDGQTP

SEQ ID NO: 105903 - protein, 13 aa, Mycobacterium tuberculosis
RGIVGVVDGQTPL

SEQ ID NO: 105904 - protein, 13 aa, Mycobacterium tuberculosis
GIVGVVDGQTPLG

SEQ ID NO: 105905 - protein, 13 aa, Mycobacterium tuberculosis
IVGVVDGQTPLGV

SEQ ID NO: 105906 - protein, 13 aa, Mycobacterium tuberculosis
VGVVDGQTPLGVE

SEQ ID NO: 105907 - protein, 13 aa, Mycobacterium tuberculosis
GVVDGQTPLGVET

SEQ ID NO: 105908 - protein, 13 aa, Mycobacterium tuberculosis
VVDGQTPLGVETD

SEQ ID NO: 105909 - protein, 13 aa, Mycobacterium tuberculosis
VDGQTPLGVETDR

SEQ ID NO: 105910 - protein, 13 aa, Mycobacterium tuberculosis
DGQTPLGVETDRD

SEQ ID NO: 105911 - protein, 13 aa, Mycobacterium tuberculosis
GQTPLGVETDRDI

SEQ ID NO: 105912 - protein, 13 aa, Mycobacterium tuberculosis
QTPLGVETDRDIA

SEQ ID NO: 105913 - protein, 13 aa, Mycobacterium tuberculosis
TPLGVETDRDIAQ

SEQ ID NO: 105914 - protein, 13 aa, Mycobacterium tuberculosis
PLGVETDRDIAQR

SEQ ID NO: 105915 - protein, 13 aa, Mycobacterium tuberculosis
LGVETDRDIAQRR

SEQ ID NO: 105916 - protein, 13 aa, Mycobacterium tuberculosis
GVETDRDIAQRRD

SEQ ID NO: 105917 - protein, 13 aa, Mycobacterium tuberculosis
VETDRDIAQRRDL

SEQ ID NO: 105918 - protein, 13 aa, Mycobacterium tuberculosis
ETDRDIAQRRDLL

SEQ ID NO: 105919 - protein, 13 aa, Mycobacterium tuberculosis
TDRDIAQRRDLLR

SEQ ID NO: 105920 - protein, 13 aa, Mycobacterium tuberculosis
DRDIAQRRDLLRA

SEQ ID NO: 105921 - protein, 13 aa, Mycobacterium tuberculosis
RDIAQRRDLLRAI

SEQ ID NO: 105922 - protein, 13 aa, Mycobacterium tuberculosis
DIAQRRDLLRAIG

SEQ ID NO: 105923 - protein, 13 aa, Mycobacterium tuberculosis
IAQRRDLLRAIGY

SEQ ID NO: 105924 - protein, 13 aa, Mycobacterium tuberculosis
AQRRDLLRAIGYK

SEQ ID NO: 105925 - protein, 13 aa, Mycobacterium tuberculosis
QRRDLLRAIGYKL

SEQ ID NO: 105926 - protein, 14 aa, Mycobacterium tuberculosis
MSLAWDVVSVDKPD

SEQ ID NO: 105927 - protein, 14 aa, Mycobacterium tuberculosis
SLAWDVVSVDKPDD

SEQ ID NO: 105928 - protein, 14 aa, Mycobacterium tuberculosis
LAWDVVSVDKPDDV

SEQ ID NO: 105929 - protein, 14 aa, Mycobacterium tuberculosis
AWDVVSVDKPDDVN

SEQ ID NO: 105930 - protein, 14 aa, Mycobacterium tuberculosis
WDVVSVDKPDDVNV

SEQ ID NO: 105931 - protein, 14 aa, Mycobacterium tuberculosis
DVVSVDKPDDVNVV

SEQ ID NO: 105932 - protein, 14 aa, Mycobacterium tuberculosis
VVSVDKPDDVNVVI

SEQ ID NO: 105933 - protein, 14 aa, Mycobacterium tuberculosis
VSVDKPDDVNVVIG

SEQ ID NO: 105934 - protein, 14 aa, Mycobacterium tuberculosis
SVDKPDDVNVVIGQ

SEQ ID NO: 105935 - protein, 14 aa, Mycobacterium tuberculosis
VDKPDDVNVVIGQA

SEQ ID NO: 105936 - protein, 14 aa, Mycobacterium tuberculosis
DKPDDVNVVIGQAH

SEQ ID NO: 105937 - protein, 14 aa, Mycobacterium tuberculosis
KPDDVNVVIGQAHF

SEQ ID NO: 105938 - protein, 14 aa, Mycobacterium tuberculosis
PDDVNVVIGQAHFI

SEQ ID NO: 105939 - protein, 14 aa, Mycobacterium tuberculosis
DDVNVVIGQAHFIK

SEQ ID NO: 105940 - protein, 14 aa, Mycobacterium tuberculosis
DVNVVIGQAHFIKA

SEQ ID NO: 105941 - protein, 14 aa, Mycobacterium tuberculosis
VNVVIGQAHFIKAV

SEQ ID NO: 105942 - protein, 14 aa, Mycobacterium tuberculosis
NVVIGQAHFIKAVE

SEQ ID NO: 105943 - protein, 14 aa, Mycobacterium tuberculosis
VVIGQAHFIKAVED

SEQ ID NO: 105944 - protein, 14 aa, Mycobacterium tuberculosis
VIGQAHFIKAVEDL

SEQ ID NO: 105945 - protein, 14 aa, Mycobacterium tuberculosis
IGQAHFIKAVEDLH

SEQ ID NO: 105946 - protein, 14 aa, Mycobacterium tuberculosis
GQAHFIKAVEDLHE

SEQ ID NO: 105947 - protein, 14 aa, Mycobacterium tuberculosis
QAHFIKAVEDLHEA

SEQ ID NO: 105948 - protein, 14 aa, Mycobacterium tuberculosis
AHFIKAVEDLHEAM

SEQ ID NO: 105949 - protein, 14 aa, Mycobacterium tuberculosis
HFIKAVEDLHEAMV

SEQ ID NO: 105950 - protein, 14 aa, Mycobacterium tuberculosis
FIKAVEDLHEAMVG

SEQ ID NO: 105951 - protein, 14 aa, Mycobacterium tuberculosis
IKAVEDLHEAMVGV

SEQ ID NO: 105952 - protein, 14 aa, Mycobacterium tuberculosis
KAVEDLHEAMVGVS

SEQ ID NO: 105953 - protein, 14 aa, Mycobacterium tuberculosis
AVEDLHEAMVGVSP

SEQ ID NO: 105954 - protein, 14 aa, Mycobacterium tuberculosis
VEDLHEAMVGVSPS

SEQ ID NO: 105955 - protein, 14 aa, Mycobacterium tuberculosis
EDLHEAMVGVSPSL

SEQ ID NO: 105956 - protein, 14 aa, Mycobacterium tuberculosis
DLHEAMVGVSPSLR

SEQ ID NO: 105957 - protein, 14 aa, Mycobacterium tuberculosis
LHEAMVGVSPSLRF

SEQ ID NO: 105958 - protein, 14 aa, Mycobacterium tuberculosis
HEAMVGVSPSLRFG

SEQ ID NO: 105959 - protein, 14 aa, Mycobacterium tuberculosis
EAMVGVSPSLRFGL

SEQ ID NO: 105960 - protein, 14 aa, Mycobacterium tuberculosis
AMVGVSPSLRFGLA

SEQ ID NO: 105961 - protein, 14 aa, Mycobacterium tuberculosis
MVGVSPSLRFGLAF

SEQ ID NO: 105962 - protein, 14 aa, Mycobacterium tuberculosis
VGVSPSLRFGLAFC

SEQ ID NO: 105963 - protein, 14 aa, Mycobacterium tuberculosis
GVSPSLRFGLAFCE

SEQ ID NO: 105964 - protein, 14 aa, Mycobacterium tuberculosis
VSPSLRFGLAFCEA

SEQ ID NO: 105965 - protein, 14 aa, Mycobacterium tuberculosis
SPSLRFGLAFCEAS

SEQ ID NO: 105966 - protein, 14 aa, Mycobacterium tuberculosis
PSLRFGLAFCEASG

SEQ ID NO: 105967 - protein, 14 aa, Mycobacterium tuberculosis
SLRFGLAFCEASGP

SEQ ID NO: 105968 - protein, 14 aa, Mycobacterium tuberculosis
LRFGLAFCEASGPR

SEQ ID NO: 105969 - protein, 14 aa, Mycobacterium tuberculosis
RFGLAFCEASGPRL

SEQ ID NO: 105970 - protein, 14 aa, Mycobacterium tuberculosis
FGLAFCEASGPRLV

SEQ ID NO: 105971 - protein, 14 aa, Mycobacterium tuberculosis
GLAFCEASGPRLVR

SEQ ID NO: 105972 - protein, 14 aa, Mycobacterium tuberculosis
LAFCEASGPRLVRH

SEQ ID NO: 105973 - protein, 14 aa, Mycobacterium tuberculosis
AFCEASGPRLVRHT

SEQ ID NO: 105974 - protein, 14 aa, Mycobacterium tuberculosis
FCEASGPRLVRHTG

SEQ ID NO: 105975 - protein, 14 aa, Mycobacterium tuberculosis
CEASGPRLVRHTGN

SEQ ID NO: 105976 - protein, 14 aa, Mycobacterium tuberculosis
EASGPRLVRHTGND

SEQ ID NO: 105977 - protein, 14 aa, Mycobacterium tuberculosis
ASGPRLVRHTGNDG

SEQ ID NO: 105978 - protein, 14 aa, Mycobacterium tuberculosis
SGPRLVRHTGNDGD

SEQ ID NO: 105979 - protein, 14 aa, Mycobacterium tuberculosis
GPRLVRHTGNDGDL

SEQ ID NO: 105980 - protein, 14 aa, Mycobacterium tuberculosis
PRLVRHTGNDGDLV

SEQ ID NO: 105981 - protein, 14 aa, Mycobacterium tuberculosis
RLVRHTGNDGDLVE

SEQ ID NO: 105982 - protein, 14 aa, Mycobacterium tuberculosis
LVRHTGNDGDLVEL

SEQ ID NO: 105983 - protein, 14 aa, Mycobacterium tuberculosis
VRHTGNDGDLVELA

SEQ ID NO: 105984 - protein, 14 aa, Mycobacterium tuberculosis
RHTGNDGDLVELAT

SEQ ID NO: 105985 - protein, 14 aa, Mycobacterium tuberculosis
HTGNDGDLVELATR

SEQ ID NO: 105986 - protein, 14 aa, Mycobacterium tuberculosis
TGNDGDLVELATRT

SEQ ID NO: 105987 - protein, 14 aa, Mycobacterium tuberculosis
GNDGDLVELATRTA

SEQ ID NO: 105988 - protein, 14 aa, Mycobacterium tuberculosis
NDGDLVELATRTAL

SEQ ID NO: 105989 - protein, 14 aa, Mycobacterium tuberculosis
DGDLVELATRTALA

SEQ ID NO: 105990 - protein, 14 aa, Mycobacterium tuberculosis
GDLVELATRTALAI

SEQ ID NO: 105991 - protein, 14 aa, Mycobacterium tuberculosis
DLVELATRTALAIA

SEQ ID NO: 105992 - protein, 14 aa, Mycobacterium tuberculosis
LVELATRTALAIAA

SEQ ID NO: 105993 - protein, 14 aa, Mycobacterium tuberculosis
VELATRTALAIAAG

SEQ ID NO: 105994 - protein, 14 aa, Mycobacterium tuberculosis
ELATRTALAIAAGH

SEQ ID NO: 105995 - protein, 14 aa, Mycobacterium tuberculosis
LATRTALAIAAGHS

SEQ ID NO: 105996 - protein, 14 aa, Mycobacterium tuberculosis
ATRTALAIAAGHSF

SEQ ID NO: 105997 - protein, 14 aa, Mycobacterium tuberculosis
TRTALAIAAGHSFV

SEQ ID NO: 105998 - protein, 14 aa, Mycobacterium tuberculosis
RTALAIAAGHSFVI

SEQ ID NO: 105999 - protein, 14 aa, Mycobacterium tuberculosis
TALAIAAGHSFVIF

SEQ ID NO: 106000 - protein, 14 aa, Mycobacterium tuberculosis
ALAIAAGHSFVIFL

SEQ ID NO: 106001 - protein, 14 aa, Mycobacterium tuberculosis
LAIAAGHSFVIFLR

SEQ ID NO: 106002 - protein, 14 aa, Mycobacterium tuberculosis
AIAAGHSFVIFLRE

SEQ ID NO: 106003 - protein, 14 aa, Mycobacterium tuberculosis
IAAGHSFVIFLREG

SEQ ID NO: 106004 - protein, 14 aa, Mycobacterium tuberculosis
AAGHSFVIFLREGF

SEQ ID NO: 106005 - protein, 14 aa, Mycobacterium tuberculosis
AGHSFVIFLREGFP

SEQ ID NO: 106006 - protein, 14 aa, Mycobacterium tuberculosis
GHSFVIFLREGFPI

SEQ ID NO: 106007 - protein, 14 aa, Mycobacterium tuberculosis
HSFVIFLREGFPIN

SEQ ID NO: 106008 - protein, 14 aa, Mycobacterium tuberculosis
SFVIFLREGFPINI

SEQ ID NO: 106009 - protein, 14 aa, Mycobacterium tuberculosis
FVIFLREGFPINIL

SEQ ID NO: 106010 - protein, 14 aa, Mycobacterium tuberculosis
VIFLREGFPINILN

SEQ ID NO: 106011 - protein, 14 aa, Mycobacterium tuberculosis
IFLREGFPINILNP

SEQ ID NO: 106012 - protein, 14 aa, Mycobacterium tuberculosis
FLREGFPINILNPV

SEQ ID NO: 106013 - protein, 14 aa, Mycobacterium tuberculosis
LREGFPINILNPVQ

SEQ ID NO: 106014 - protein, 14 aa, Mycobacterium tuberculosis
REGFPINILNPVQA

SEQ ID NO: 106015 - protein, 14 aa, Mycobacterium tuberculosis
EGFPINILNPVQAV

SEQ ID NO: 106016 - protein, 14 aa, Mycobacterium tuberculosis
GFPINILNPVQAVP

SEQ ID NO: 106017 - protein, 14 aa, Mycobacterium tuberculosis
FPINILNPVQAVPE

SEQ ID NO: 106018 - protein, 14 aa, Mycobacterium tuberculosis
PINILNPVQAVPEV

SEQ ID NO: 106019 - protein, 14 aa, Mycobacterium tuberculosis
INILNPVQAVPEVC

SEQ ID NO: 106020 - protein, 14 aa, Mycobacterium tuberculosis
NILNPVQAVPEVCT

SEQ ID NO: 106021 - protein, 14 aa, Mycobacterium tuberculosis
ILNPVQAVPEVCTI

SEQ ID NO: 106022 - protein, 14 aa, Mycobacterium tuberculosis
LNPVQAVPEVCTIY

SEQ ID NO: 106023 - protein, 14 aa, Mycobacterium tuberculosis
NPVQAVPEVCTIYC

SEQ ID NO: 106024 - protein, 14 aa, Mycobacterium tuberculosis
PVQAVPEVCTIYCA

SEQ ID NO: 106025 - protein, 14 aa, Mycobacterium tuberculosis
VQAVPEVCTIYCAT

SEQ ID NO: 106026 - protein, 14 aa, Mycobacterium tuberculosis
QAVPEVCTIYCATA

SEQ ID NO: 106027 - protein, 14 aa, Mycobacterium tuberculosis
AVPEVCTIYCATAN

SEQ ID NO: 106028 - protein, 14 aa, Mycobacterium tuberculosis
VPEVCTIYCATANP

SEQ ID NO: 106029 - protein, 14 aa, Mycobacterium tuberculosis
PEVCTIYCATANPV

SEQ ID NO: 106030 - protein, 14 aa, Mycobacterium tuberculosis
EVCTIYCATANPVD

SEQ ID NO: 106031 - protein, 14 aa, Mycobacterium tuberculosis
VCTIYCATANPVDV

SEQ ID NO: 106032 - protein, 14 aa, Mycobacterium tuberculosis
CTIYCATANPVDVV

SEQ ID NO: 106033 - protein, 14 aa, Mycobacterium tuberculosis
TIYCATANPVDVVV

SEQ ID NO: 106034 - protein, 14 aa, Mycobacterium tuberculosis
IYCATANPVDVVVA

SEQ ID NO: 106035 - protein, 14 aa, Mycobacterium tuberculosis
YCATANPVDVVVAV

SEQ ID NO: 106036 - protein, 14 aa, Mycobacterium tuberculosis
CATANPVDVVVAVT

SEQ ID NO: 106037 - protein, 14 aa, Mycobacterium tuberculosis
ATANPVDVVVAVTP

SEQ ID NO: 106038 - protein, 14 aa, Mycobacterium tuberculosis
TANPVDVVVAVTPH

SEQ ID NO: 106039 - protein, 14 aa, Mycobacterium tuberculosis
ANPVDVVVAVTPHG

SEQ ID NO: 106040 - protein, 14 aa, Mycobacterium tuberculosis
NPVDVVVAVTPHGR

SEQ ID NO: 106041 - protein, 14 aa, Mycobacterium tuberculosis
PVDVVVAVTPHGRG

SEQ ID NO: 106042 - protein, 14 aa, Mycobacterium tuberculosis
VDVVVAVTPHGRGI

SEQ ID NO: 106043 - protein, 14 aa, Mycobacterium tuberculosis
DVVVAVTPHGRGIV

SEQ ID NO: 106044 - protein, 14 aa, Mycobacterium tuberculosis
VVVAVTPHGRGIVG

SEQ ID NO: 106045 - protein, 14 aa, Mycobacterium tuberculosis
VVAVTPHGRGIVGV

SEQ ID NO: 106046 - protein, 14 aa, Mycobacterium tuberculosis
VAVTPHGRGIVGVV

SEQ ID NO: 106047 - protein, 14 aa, Mycobacterium tuberculosis
AVTPHGRGIVGVVD

SEQ ID NO: 106048 - protein, 14 aa, Mycobacterium tuberculosis
VTPHGRGIVGVVDG

SEQ ID NO: 106049 - protein, 14 aa, Mycobacterium tuberculosis
TPHGRGIVGVVDGQ

SEQ ID NO: 106050 - protein, 14 aa, Mycobacterium tuberculosis
PHGRGIVGVVDGQT

SEQ ID NO: 106051 - protein, 14 aa, Mycobacterium tuberculosis
HGRGIVGVVDGQTP

SEQ ID NO: 106052 - protein, 14 aa, Mycobacterium tuberculosis
GRGIVGVVDGQTPL

SEQ ID NO: 106053 - protein, 14 aa, Mycobacterium tuberculosis
RGIVGVVDGQTPLG

SEQ ID NO: 106054 - protein, 14 aa, Mycobacterium tuberculosis
GIVGVVDGQTPLGV

SEQ ID NO: 106055 - protein, 14 aa, Mycobacterium tuberculosis
IVGVVDGQTPLGVE

SEQ ID NO: 106056 - protein, 14 aa, Mycobacterium tuberculosis
VGVVDGQTPLGVET

SEQ ID NO: 106057 - protein, 14 aa, Mycobacterium tuberculosis
GVVDGQTPLGVETD

SEQ ID NO: 106058 - protein, 14 aa, Mycobacterium tuberculosis
VVDGQTPLGVETDR

SEQ ID NO: 106059 - protein, 14 aa, Mycobacterium tuberculosis
VDGQTPLGVETDRD

SEQ ID NO: 106060 - protein, 14 aa, Mycobacterium tuberculosis
DGQTPLGVETDRDI

SEQ ID NO: 106061 - protein, 14 aa, Mycobacterium tuberculosis
GQTPLGVETDRDIA

SEQ ID NO: 106062 - protein, 14 aa, Mycobacterium tuberculosis
QTPLGVETDRDIAQ

SEQ ID NO: 106063 - protein, 14 aa, Mycobacterium tuberculosis
TPLGVETDRDIAQR

SEQ ID NO: 106064 - protein, 14 aa, Mycobacterium tuberculosis
PLGVETDRDIAQRR

SEQ ID NO: 106065 - protein, 14 aa, Mycobacterium tuberculosis
LGVETDRDIAQRRD

SEQ ID NO: 106066 - protein, 14 aa, Mycobacterium tuberculosis
GVETDRDIAQRRDL

SEQ ID NO: 106067 - protein, 14 aa, Mycobacterium tuberculosis
VETDRDIAQRRDLL

SEQ ID NO: 106068 - protein, 14 aa, Mycobacterium tuberculosis
ETDRDIAQRRDLLR

SEQ ID NO: 106069 - protein, 14 aa, Mycobacterium tuberculosis
TDRDIAQRRDLLRA

SEQ ID NO: 106070 - protein, 14 aa, Mycobacterium tuberculosis
DRDIAQRRDLLRAI

SEQ ID NO: 106071 - protein, 14 aa, Mycobacterium tuberculosis
RDIAQRRDLLRAIG

SEQ ID NO: 106072 - protein, 14 aa, Mycobacterium tuberculosis
DIAQRRDLLRAIGY

SEQ ID NO: 106073 - protein, 14 aa, Mycobacterium tuberculosis
IAQRRDLLRAIGYK

SEQ ID NO: 106074 - protein, 14 aa, Mycobacterium tuberculosis
AQRRDLLRAIGYKL

SEQ ID NO: 106075 - protein, 15 aa, Mycobacterium tuberculosis
MSLAWDVVSVDKPDD

SEQ ID NO: 106076 - protein, 15 aa, Mycobacterium tuberculosis
SLAWDVVSVDKPDDV

SEQ ID NO: 106077 - protein, 15 aa, Mycobacterium tuberculosis
LAWDVVSVDKPDDVN

SEQ ID NO: 106078 - protein, 15 aa, Mycobacterium tuberculosis
AWDVVSVDKPDDVNV

SEQ ID NO: 106079 - protein, 15 aa, Mycobacterium tuberculosis
WDVVSVDKPDDVNVV

SEQ ID NO: 106080 - protein, 15 aa, Mycobacterium tuberculosis
DVVSVDKPDDVNVVI

SEQ ID NO: 106081 - protein, 15 aa, Mycobacterium tuberculosis
VVSVDKPDDVNVVIG

SEQ ID NO: 106082 - protein, 15 aa, Mycobacterium tuberculosis
VSVDKPDDVNVVIGQ

SEQ ID NO: 106083 - protein, 15 aa, Mycobacterium tuberculosis
SVDKPDDVNVVIGQA

SEQ ID NO: 106084 - protein, 15 aa, Mycobacterium tuberculosis
VDKPDDVNVVIGQAH

SEQ ID NO: 106085 - protein, 15 aa, Mycobacterium tuberculosis
DKPDDVNVVIGQAHF

SEQ ID NO: 106086 - protein, 15 aa, Mycobacterium tuberculosis
KPDDVNVVIGQAHFI

SEQ ID NO: 106087 - protein, 15 aa, Mycobacterium tuberculosis
PDDVNVVIGQAHFIK

SEQ ID NO: 106088 - protein, 15 aa, Mycobacterium tuberculosis
DDVNVVIGQAHFIKA

SEQ ID NO: 106089 - protein, 15 aa, Mycobacterium tuberculosis
DVNVVIGQAHFIKAV

SEQ ID NO: 106090 - protein, 15 aa, Mycobacterium tuberculosis
VNVVIGQAHFIKAVE

SEQ ID NO: 106091 - protein, 15 aa, Mycobacterium tuberculosis
NVVIGQAHFIKAVED

SEQ ID NO: 106092 - protein, 15 aa, Mycobacterium tuberculosis
VVIGQAHFIKAVEDL

SEQ ID NO: 106093 - protein, 15 aa, Mycobacterium tuberculosis
VIGQAHFIKAVEDLH

SEQ ID NO: 106094 - protein, 15 aa, Mycobacterium tuberculosis
IGQAHFIKAVEDLHE

SEQ ID NO: 106095 - protein, 15 aa, Mycobacterium tuberculosis
GQAHFIKAVEDLHEA

SEQ ID NO: 106096 - protein, 15 aa, Mycobacterium tuberculosis
QAHFIKAVEDLHEAM

SEQ ID NO: 106097 - protein, 15 aa, Mycobacterium tuberculosis
AHFIKAVEDLHEAMV

SEQ ID NO: 106098 - protein, 15 aa, Mycobacterium tuberculosis
HFIKAVEDLHEAMVG

SEQ ID NO: 106099 - protein, 15 aa, Mycobacterium tuberculosis
FIKAVEDLHEAMVGV

SEQ ID NO: 106100 - protein, 15 aa, Mycobacterium tuberculosis
IKAVEDLHEAMVGVS

SEQ ID NO: 106101 - protein, 15 aa, Mycobacterium tuberculosis
KAVEDLHEAMVGVSP

SEQ ID NO: 106102 - protein, 15 aa, Mycobacterium tuberculosis
AVEDLHEAMVGVSPS

SEQ ID NO: 106103 - protein, 15 aa, Mycobacterium tuberculosis
VEDLHEAMVGVSPSL

SEQ ID NO: 106104 - protein, 15 aa, Mycobacterium tuberculosis
EDLHEAMVGVSPSLR

SEQ ID NO: 106105 - protein, 15 aa, Mycobacterium tuberculosis
DLHEAMVGVSPSLRF

SEQ ID NO: 106106 - protein, 15 aa, Mycobacterium tuberculosis
LHEAMVGVSPSLRFG

SEQ ID NO: 106107 - protein, 15 aa, Mycobacterium tuberculosis
HEAMVGVSPSLRFGL

SEQ ID NO: 106108 - protein, 15 aa, Mycobacterium tuberculosis
EAMVGVSPSLRFGLA

SEQ ID NO: 106109 - protein, 15 aa, Mycobacterium tuberculosis
AMVGVSPSLRFGLAF

SEQ ID NO: 106110 - protein, 15 aa, Mycobacterium tuberculosis
MVGVSPSLRFGLAFC

SEQ ID NO: 106111 - protein, 15 aa, Mycobacterium tuberculosis
VGVSPSLRFGLAFCE

SEQ ID NO: 106112 - protein, 15 aa, Mycobacterium tuberculosis
GVSPSLRFGLAFCEA

SEQ ID NO: 106113 - protein, 15 aa, Mycobacterium tuberculosis
VSPSLRFGLAFCEAS

SEQ ID NO: 106114 - protein, 15 aa, Mycobacterium tuberculosis
SPSLRFGLAFCEASG

SEQ ID NO: 106115 - protein, 15 aa, Mycobacterium tuberculosis
PSLRFGLAFCEASGP

SEQ ID NO: 106116 - protein, 15 aa, Mycobacterium tuberculosis
SLRFGLAFCEASGPR

SEQ ID NO: 106117 - protein, 15 aa, Mycobacterium tuberculosis
LRFGLAFCEASGPRL

SEQ ID NO: 106118 - protein, 15 aa, Mycobacterium tuberculosis
RFGLAFCEASGPRLV

SEQ ID NO: 106119 - protein, 15 aa, Mycobacterium tuberculosis
FGLAFCEASGPRLVR

SEQ ID NO: 106120 - protein, 15 aa, Mycobacterium tuberculosis
GLAFCEASGPRLVRH

SEQ ID NO: 106121 - protein, 15 aa, Mycobacterium tuberculosis
LAFCEASGPRLVRHT

SEQ ID NO: 106122 - protein, 15 aa, Mycobacterium tuberculosis
AFCEASGPRLVRHTG

SEQ ID NO: 106123 - protein, 15 aa, Mycobacterium tuberculosis
FCEASGPRLVRHTGN

SEQ ID NO: 106124 - protein, 15 aa, Mycobacterium tuberculosis
CEASGPRLVRHTGND

SEQ ID NO: 106125 - protein, 15 aa, Mycobacterium tuberculosis
EASGPRLVRHTGNDG

SEQ ID NO: 106126 - protein, 15 aa, Mycobacterium tuberculosis
ASGPRLVRHTGNDGD

SEQ ID NO: 106127 - protein, 15 aa, Mycobacterium tuberculosis
SGPRLVRHTGNDGDL

SEQ ID NO: 106128 - protein, 15 aa, Mycobacterium tuberculosis
GPRLVRHTGNDGDLV

SEQ ID NO: 106129 - protein, 15 aa, Mycobacterium tuberculosis
PRLVRHTGNDGDLVE

SEQ ID NO: 106130 - protein, 15 aa, Mycobacterium tuberculosis
RLVRHTGNDGDLVEL

SEQ ID NO: 106131 - protein, 15 aa, Mycobacterium tuberculosis
LVRHTGNDGDLVELA

SEQ ID NO: 106132 - protein, 15 aa, Mycobacterium tuberculosis
VRHTGNDGDLVELAT

SEQ ID NO: 106133 - protein, 15 aa, Mycobacterium tuberculosis
RHTGNDGDLVELATR

SEQ ID NO: 106134 - protein, 15 aa, Mycobacterium tuberculosis
HTGNDGDLVELATRT

SEQ ID NO: 106135 - protein, 15 aa, Mycobacterium tuberculosis
TGNDGDLVELATRTA

SEQ ID NO: 106136 - protein, 15 aa, Mycobacterium tuberculosis
GNDGDLVELATRTAL

SEQ ID NO: 106137 - protein, 15 aa, Mycobacterium tuberculosis
NDGDLVELATRTALA

SEQ ID NO: 106138 - protein, 15 aa, Mycobacterium tuberculosis
DGDLVELATRTALAI

SEQ ID NO: 106139 - protein, 15 aa, Mycobacterium tuberculosis
GDLVELATRTALAIA

SEQ ID NO: 106140 - protein, 15 aa, Mycobacterium tuberculosis
DLVELATRTALAIAA

SEQ ID NO: 106141 - protein, 15 aa, Mycobacterium tuberculosis
LVELATRTALAIAAG

SEQ ID NO: 106142 - protein, 15 aa, Mycobacterium tuberculosis
VELATRTALAIAAGH

SEQ ID NO: 106143 - protein, 15 aa, Mycobacterium tuberculosis
ELATRTALAIAAGHS

SEQ ID NO: 106144 - protein, 15 aa, Mycobacterium tuberculosis
LATRTALAIAAGHSF

SEQ ID NO: 106145 - protein, 15 aa, Mycobacterium tuberculosis
ATRTALAIAAGHSFV

SEQ ID NO: 106146 - protein, 15 aa, Mycobacterium tuberculosis
TRTALAIAAGHSFVI

SEQ ID NO: 106147 - protein, 15 aa, Mycobacterium tuberculosis
RTALAIAAGHSFVIF

SEQ ID NO: 106148 - protein, 15 aa, Mycobacterium tuberculosis
TALAIAAGHSFVIFL

SEQ ID NO: 106149 - protein, 15 aa, Mycobacterium tuberculosis
ALAIAAGHSFVIFLR

SEQ ID NO: 106150 - protein, 15 aa, Mycobacterium tuberculosis
LAIAAGHSFVIFLRE

SEQ ID NO: 106151 - protein, 15 aa, Mycobacterium tuberculosis
AIAAGHSFVIFLREG

SEQ ID NO: 106152 - protein, 15 aa, Mycobacterium tuberculosis
IAAGHSFVIFLREGF

SEQ ID NO: 106153 - protein, 15 aa, Mycobacterium tuberculosis
AAGHSFVIFLREGFP

SEQ ID NO: 106154 - protein, 15 aa, Mycobacterium tuberculosis
AGHSFVIFLREGFPI

SEQ ID NO: 106155 - protein, 15 aa, Mycobacterium tuberculosis
GHSFVIFLREGFPIN

SEQ ID NO: 106156 - protein, 15 aa, Mycobacterium tuberculosis
HSFVIFLREGFPINI

SEQ ID NO: 106157 - protein, 15 aa, Mycobacterium tuberculosis
SFVIFLREGFPINIL

SEQ ID NO: 106158 - protein, 15 aa, Mycobacterium tuberculosis
FVIFLREGFPINILN

SEQ ID NO: 106159 - protein, 15 aa, Mycobacterium tuberculosis
VIFLREGFPINILNP

SEQ ID NO: 106160 - protein, 15 aa, Mycobacterium tuberculosis
IFLREGFPINILNPV

SEQ ID NO: 106161 - protein, 15 aa, Mycobacterium tuberculosis
FLREGFPINILNPVQ

SEQ ID NO: 106162 - protein, 15 aa, Mycobacterium tuberculosis
LREGFPINILNPVQA

SEQ ID NO: 106163 - protein, 15 aa, Mycobacterium tuberculosis
REGFPINILNPVQAV

SEQ ID NO: 106164 - protein, 15 aa, Mycobacterium tuberculosis
EGFPINILNPVQAVP

SEQ ID NO: 106165 - protein, 15 aa, Mycobacterium tuberculosis
GFPINILNPVQAVPE

SEQ ID NO: 106166 - protein, 15 aa, Mycobacterium tuberculosis
FPINILNPVQAVPEV

SEQ ID NO: 106167 - protein, 15 aa, Mycobacterium tuberculosis
PINILNPVQAVPEVC

SEQ ID NO: 106168 - protein, 15 aa, Mycobacterium tuberculosis
INILNPVQAVPEVCT

SEQ ID NO: 106169 - protein, 15 aa, Mycobacterium tuberculosis
NILNPVQAVPEVCTI

SEQ ID NO: 106170 - protein, 15 aa, Mycobacterium tuberculosis
ILNPVQAVPEVCTIY

SEQ ID NO: 106171 - protein, 15 aa, Mycobacterium tuberculosis
LNPVQAVPEVCTIYC

SEQ ID NO: 106172 - protein, 15 aa, Mycobacterium tuberculosis
NPVQAVPEVCTIYCA

SEQ ID NO: 106173 - protein, 15 aa, Mycobacterium tuberculosis
PVQAVPEVCTIYCAT

SEQ ID NO: 106174 - protein, 15 aa, Mycobacterium tuberculosis
VQAVPEVCTIYCATA

SEQ ID NO: 106175 - protein, 15 aa, Mycobacterium tuberculosis
QAVPEVCTIYCATAN

SEQ ID NO: 106176 - protein, 15 aa, Mycobacterium tuberculosis
AVPEVCTIYCATANP

SEQ ID NO: 106177 - protein, 15 aa, Mycobacterium tuberculosis
VPEVCTIYCATANPV

SEQ ID NO: 106178 - protein, 15 aa, Mycobacterium tuberculosis
PEVCTIYCATANPVD

SEQ ID NO: 106179 - protein, 15 aa, Mycobacterium tuberculosis
EVCTIYCATANPVDV

SEQ ID NO: 106180 - protein, 15 aa, Mycobacterium tuberculosis
VCTIYCATANPVDVV

SEQ ID NO: 106181 - protein, 15 aa, Mycobacterium tuberculosis
CTIYCATANPVDVVV

SEQ ID NO: 106182 - protein, 15 aa, Mycobacterium tuberculosis
TIYCATANPVDVVVA

SEQ ID NO: 106183 - protein, 15 aa, Mycobacterium tuberculosis
IYCATANPVDVVVAV

SEQ ID NO: 106184 - protein, 15 aa, Mycobacterium tuberculosis
YCATANPVDVVVAVT

SEQ ID NO: 106185 - protein, 15 aa, Mycobacterium tuberculosis
CATANPVDVVVAVTP

SEQ ID NO: 106186 - protein, 15 aa, Mycobacterium tuberculosis
ATANPVDVVVAVTPH

SEQ ID NO: 106187 - protein, 15 aa, Mycobacterium tuberculosis
TANPVDVVVAVTPHG

SEQ ID NO: 106188 - protein, 15 aa, Mycobacterium tuberculosis
ANPVDVVVAVTPHGR

SEQ ID NO: 106189 - protein, 15 aa, Mycobacterium tuberculosis
NPVDVVVAVTPHGRG

SEQ ID NO: 106190 - protein, 15 aa, Mycobacterium tuberculosis
PVDVVVAVTPHGRGI

SEQ ID NO: 106191 - protein, 15 aa, Mycobacterium tuberculosis
VDVVVAVTPHGRGIV

SEQ ID NO: 106192 - protein, 15 aa, Mycobacterium tuberculosis
DVVVAVTPHGRGIVG

SEQ ID NO: 106193 - protein, 15 aa, Mycobacterium tuberculosis
VVVAVTPHGRGIVGV

SEQ ID NO: 106194 - protein, 15 aa, Mycobacterium tuberculosis
VVAVTPHGRGIVGVV

SEQ ID NO: 106195 - protein, 15 aa, Mycobacterium tuberculosis
VAVTPHGRGIVGVVD

SEQ ID NO: 106196 - protein, 15 aa, Mycobacterium tuberculosis
AVTPHGRGIVGVVDG

SEQ ID NO: 106197 - protein, 15 aa, Mycobacterium tuberculosis
VTPHGRGIVGVVDGQ

SEQ ID NO: 106198 - protein, 15 aa, Mycobacterium tuberculosis
TPHGRGIVGVVDGQT

SEQ ID NO: 106199 - protein, 15 aa, Mycobacterium tuberculosis
PHGRGIVGVVDGQTP

SEQ ID NO: 106200 - protein, 15 aa, Mycobacterium tuberculosis
HGRGIVGVVDGQTPL

SEQ ID NO: 106201 - protein, 15 aa, Mycobacterium tuberculosis
GRGIVGVVDGQTPLG

SEQ ID NO: 106202 - protein, 15 aa, Mycobacterium tuberculosis
RGIVGVVDGQTPLGV

SEQ ID NO: 106203 - protein, 15 aa, Mycobacterium tuberculosis
GIVGVVDGQTPLGVE

SEQ ID NO: 106204 - protein, 15 aa, Mycobacterium tuberculosis
IVGVVDGQTPLGVET

SEQ ID NO: 106205 - protein, 15 aa, Mycobacterium tuberculosis
VGVVDGQTPLGVETD

SEQ ID NO: 106206 - protein, 15 aa, Mycobacterium tuberculosis
GVVDGQTPLGVETDR

SEQ ID NO: 106207 - protein, 15 aa, Mycobacterium tuberculosis
VVDGQTPLGVETDRD

SEQ ID NO: 106208 - protein, 15 aa, Mycobacterium tuberculosis
VDGQTPLGVETDRDI

SEQ ID NO: 106209 - protein, 15 aa, Mycobacterium tuberculosis
DGQTPLGVETDRDIA

SEQ ID NO: 106210 - protein, 15 aa, Mycobacterium tuberculosis
GQTPLGVETDRDIAQ

SEQ ID NO: 106211 - protein, 15 aa, Mycobacterium tuberculosis
QTPLGVETDRDIAQR

SEQ ID NO: 106212 - protein, 15 aa, Mycobacterium tuberculosis
TPLGVETDRDIAQRR

SEQ ID NO: 106213 - protein, 15 aa, Mycobacterium tuberculosis
PLGVETDRDIAQRRD

SEQ ID NO: 106214 - protein, 15 aa, Mycobacterium tuberculosis
LGVETDRDIAQRRDL

SEQ ID NO: 106215 - protein, 15 aa, Mycobacterium tuberculosis
GVETDRDIAQRRDLL

SEQ ID NO: 106216 - protein, 15 aa, Mycobacterium tuberculosis
VETDRDIAQRRDLLR

SEQ ID NO: 106217 - protein, 15 aa, Mycobacterium tuberculosis
ETDRDIAQRRDLLRA

SEQ ID NO: 106218 - protein, 15 aa, Mycobacterium tuberculosis
TDRDIAQRRDLLRAI

SEQ ID NO: 106219 - protein, 15 aa, Mycobacterium tuberculosis
DRDIAQRRDLLRAIG

SEQ ID NO: 106220 - protein, 15 aa, Mycobacterium tuberculosis
RDIAQRRDLLRAIGY

SEQ ID NO: 106221 - protein, 15 aa, Mycobacterium tuberculosis
DIAQRRDLLRAIGYK

SEQ ID NO: 106222 - protein, 15 aa, Mycobacterium tuberculosis
IAQRRDLLRAIGYKL

SEQ ID NO: 106223 - protein, 16 aa, Mycobacterium tuberculosis
MSLAWDVVSVDKPDDV

SEQ ID NO: 106224 - protein, 16 aa, Mycobacterium tuberculosis
SLAWDVVSVDKPDDVN

SEQ ID NO: 106225 - protein, 16 aa, Mycobacterium tuberculosis
LAWDVVSVDKPDDVNV

SEQ ID NO: 106226 - protein, 16 aa, Mycobacterium tuberculosis
AWDVVSVDKPDDVNVV

SEQ ID NO: 106227 - protein, 16 aa, Mycobacterium tuberculosis
WDVVSVDKPDDVNVVI

SEQ ID NO: 106228 - protein, 16 aa, Mycobacterium tuberculosis
DVVSVDKPDDVNVVIG

SEQ ID NO: 106229 - protein, 16 aa, Mycobacterium tuberculosis
VVSVDKPDDVNVVIGQ

SEQ ID NO: 106230 - protein, 16 aa, Mycobacterium tuberculosis
VSVDKPDDVNVVIGQA

SEQ ID NO: 106231 - protein, 16 aa, Mycobacterium tuberculosis
SVDKPDDVNVVIGQAH

SEQ ID NO: 106232 - protein, 16 aa, Mycobacterium tuberculosis
VDKPDDVNVVIGQAHF

SEQ ID NO: 106233 - protein, 16 aa, Mycobacterium tuberculosis
DKPDDVNVVIGQAHFI

SEQ ID NO: 106234 - protein, 16 aa, Mycobacterium tuberculosis
KPDDVNVVIGQAHFIK

SEQ ID NO: 106235 - protein, 16 aa, Mycobacterium tuberculosis
PDDVNVVIGQAHFIKA

SEQ ID NO: 106236 - protein, 16 aa, Mycobacterium tuberculosis
DDVNVVIGQAHFIKAV

SEQ ID NO: 106237 - protein, 16 aa, Mycobacterium tuberculosis
DVNVVIGQAHFIKAVE

SEQ ID NO: 106238 - protein, 16 aa, Mycobacterium tuberculosis
VNVVIGQAHFIKAVED

SEQ ID NO: 106239 - protein, 16 aa, Mycobacterium tuberculosis
NVVIGQAHFIKAVEDL

SEQ ID NO: 106240 - protein, 16 aa, Mycobacterium tuberculosis
VVIGQAHFIKAVEDLH

SEQ ID NO: 106241 - protein, 16 aa, Mycobacterium tuberculosis
VIGQAHFIKAVEDLHE

SEQ ID NO: 106242 - protein, 16 aa, Mycobacterium tuberculosis
IGQAHFIKAVEDLHEA

SEQ ID NO: 106243 - protein, 16 aa, Mycobacterium tuberculosis
GQAHFIKAVEDLHEAM

SEQ ID NO: 106244 - protein, 16 aa, Mycobacterium tuberculosis
QAHFIKAVEDLHEAMV

SEQ ID NO: 106245 - protein, 16 aa, Mycobacterium tuberculosis
AHFIKAVEDLHEAMVG

SEQ ID NO: 106246 - protein, 16 aa, Mycobacterium tuberculosis
HFIKAVEDLHEAMVGV

SEQ ID NO: 106247 - protein, 16 aa, Mycobacterium tuberculosis
FIKAVEDLHEAMVGVS

SEQ ID NO: 106248 - protein, 16 aa, Mycobacterium tuberculosis
IKAVEDLHEAMVGVSP

SEQ ID NO: 106249 - protein, 16 aa, Mycobacterium tuberculosis
KAVEDLHEAMVGVSPS

SEQ ID NO: 106250 - protein, 16 aa, Mycobacterium tuberculosis
AVEDLHEAMVGVSPSL

SEQ ID NO: 106251 - protein, 16 aa, Mycobacterium tuberculosis
VEDLHEAMVGVSPSLR

SEQ ID NO: 106252 - protein, 16 aa, Mycobacterium tuberculosis
EDLHEAMVGVSPSLRF

SEQ ID NO: 106253 - protein, 16 aa, Mycobacterium tuberculosis
DLHEAMVGVSPSLRFG

SEQ ID NO: 106254 - protein, 16 aa, Mycobacterium tuberculosis
LHEAMVGVSPSLRFGL

SEQ ID NO: 106255 - protein, 16 aa, Mycobacterium tuberculosis
HEAMVGVSPSLRFGLA

SEQ ID NO: 106256 - protein, 16 aa, Mycobacterium tuberculosis
EAMVGVSPSLRFGLAF

SEQ ID NO: 106257 - protein, 16 aa, Mycobacterium tuberculosis
AMVGVSPSLRFGLAFC

SEQ ID NO: 106258 - protein, 16 aa, Mycobacterium tuberculosis
MVGVSPSLRFGLAFCE

SEQ ID NO: 106259 - protein, 16 aa, Mycobacterium tuberculosis
VGVSPSLRFGLAFCEA

SEQ ID NO: 106260 - protein, 16 aa, Mycobacterium tuberculosis
GVSPSLRFGLAFCEAS

SEQ ID NO: 106261 - protein, 16 aa, Mycobacterium tuberculosis
VSPSLRFGLAFCEASG

SEQ ID NO: 106262 - protein, 16 aa, Mycobacterium tuberculosis
SPSLRFGLAFCEASGP

SEQ ID NO: 106263 - protein, 16 aa, Mycobacterium tuberculosis
PSLRFGLAFCEASGPR

SEQ ID NO: 106264 - protein, 16 aa, Mycobacterium tuberculosis
SLRFGLAFCEASGPRL

SEQ ID NO: 106265 - protein, 16 aa, Mycobacterium tuberculosis
LRFGLAFCEASGPRLV

SEQ ID NO: 106266 - protein, 16 aa, Mycobacterium tuberculosis
RFGLAFCEASGPRLVR

SEQ ID NO: 106267 - protein, 16 aa, Mycobacterium tuberculosis
FGLAFCEASGPRLVRH

SEQ ID NO: 106268 - protein, 16 aa, Mycobacterium tuberculosis
GLAFCEASGPRLVRHT

SEQ ID NO: 106269 - protein, 16 aa, Mycobacterium tuberculosis
LAFCEASGPRLVRHTG

SEQ ID NO: 106270 - protein, 16 aa, Mycobacterium tuberculosis
AFCEASGPRLVRHTGN

SEQ ID NO: 106271 - protein, 16 aa, Mycobacterium tuberculosis
FCEASGPRLVRHTGND

SEQ ID NO: 106272 - protein, 16 aa, Mycobacterium tuberculosis
CEASGPRLVRHTGNDG

SEQ ID NO: 106273 - protein, 16 aa, Mycobacterium tuberculosis
EASGPRLVRHTGNDGD

SEQ ID NO: 106274 - protein, 16 aa, Mycobacterium tuberculosis
ASGPRLVRHTGNDGDL

SEQ ID NO: 106275 - protein, 16 aa, Mycobacterium tuberculosis
SGPRLVRHTGNDGDLV

SEQ ID NO: 106276 - protein, 16 aa, Mycobacterium tuberculosis
GPRLVRHTGNDGDLVE

SEQ ID NO: 106277 - protein, 16 aa, Mycobacterium tuberculosis
PRLVRHTGNDGDLVEL

SEQ ID NO: 106278 - protein, 16 aa, Mycobacterium tuberculosis
RLVRHTGNDGDLVELA

SEQ ID NO: 106279 - protein, 16 aa, Mycobacterium tuberculosis
LVRHTGNDGDLVELAT

SEQ ID NO: 106280 - protein, 16 aa, Mycobacterium tuberculosis
VRHTGNDGDLVELATR

SEQ ID NO: 106281 - protein, 16 aa, Mycobacterium tuberculosis
RHTGNDGDLVELATRT

SEQ ID NO: 106282 - protein, 16 aa, Mycobacterium tuberculosis
HTGNDGDLVELATRTA

SEQ ID NO: 106283 - protein, 16 aa, Mycobacterium tuberculosis
TGNDGDLVELATRTAL

SEQ ID NO: 106284 - protein, 16 aa, Mycobacterium tuberculosis
GNDGDLVELATRTALA

SEQ ID NO: 106285 - protein, 16 aa, Mycobacterium tuberculosis
NDGDLVELATRTALAI

SEQ ID NO: 106286 - protein, 16 aa, Mycobacterium tuberculosis
DGDLVELATRTALAIA

SEQ ID NO: 106287 - protein, 16 aa, Mycobacterium tuberculosis
GDLVELATRTALAIAA

SEQ ID NO: 106288 - protein, 16 aa, Mycobacterium tuberculosis
DLVELATRTALAIAAG

SEQ ID NO: 106289 - protein, 16 aa, Mycobacterium tuberculosis
LVELATRTALAIAAGH

SEQ ID NO: 106290 - protein, 16 aa, Mycobacterium tuberculosis
VELATRTALAIAAGHS

SEQ ID NO: 106291 - protein, 16 aa, Mycobacterium tuberculosis
ELATRTALAIAAGHSF

SEQ ID NO: 106292 - protein, 16 aa, Mycobacterium tuberculosis
LATRTALAIAAGHSFV

SEQ ID NO: 106293 - protein, 16 aa, Mycobacterium tuberculosis
ATRTALAIAAGHSFVI

SEQ ID NO: 106294 - protein, 16 aa, Mycobacterium tuberculosis
TRTALAIAAGHSFVIF

SEQ ID NO: 106295 - protein, 16 aa, Mycobacterium tuberculosis
RTALAIAAGHSFVIFL

SEQ ID NO: 106296 - protein, 16 aa, Mycobacterium tuberculosis
TALAIAAGHSFVIFLR

SEQ ID NO: 106297 - protein, 16 aa, Mycobacterium tuberculosis
ALAIAAGHSFVIFLRE

SEQ ID NO: 106298 - protein, 16 aa, Mycobacterium tuberculosis
LAIAAGHSFVIFLREG

SEQ ID NO: 106299 - protein, 16 aa, Mycobacterium tuberculosis
AIAAGHSFVIFLREGF

SEQ ID NO: 106300 - protein, 16 aa, Mycobacterium tuberculosis
IAAGHSFVIFLREGFP

SEQ ID NO: 106301 - protein, 16 aa, Mycobacterium tuberculosis
AAGHSFVIFLREGFPI

SEQ ID NO: 106302 - protein, 16 aa, Mycobacterium tuberculosis
AGHSFVIFLREGFPIN

SEQ ID NO: 106303 - protein, 16 aa, Mycobacterium tuberculosis
GHSFVIFLREGFPINI

SEQ ID NO: 106304 - protein, 16 aa, Mycobacterium tuberculosis
HSFVIFLREGFPINIL

SEQ ID NO: 106305 - protein, 16 aa, Mycobacterium tuberculosis
SFVIFLREGFPINILN

SEQ ID NO: 106306 - protein, 16 aa, Mycobacterium tuberculosis
FVIFLREGFPINILNP

SEQ ID NO: 106307 - protein, 16 aa, Mycobacterium tuberculosis
VIFLREGFPINILNPV

SEQ ID NO: 106308 - protein, 16 aa, Mycobacterium tuberculosis
IFLREGFPINILNPVQ

SEQ ID NO: 106309 - protein, 16 aa, Mycobacterium tuberculosis
FLREGFPINILNPVQA

SEQ ID NO: 106310 - protein, 16 aa, Mycobacterium tuberculosis
LREGFPINILNPVQAV

SEQ ID NO: 106311 - protein, 16 aa, Mycobacterium tuberculosis
REGFPINILNPVQAVP

SEQ ID NO: 106312 - protein, 16 aa, Mycobacterium tuberculosis
EGFPINILNPVQAVPE

SEQ ID NO: 106313 - protein, 16 aa, Mycobacterium tuberculosis
GFPINILNPVQAVPEV

SEQ ID NO: 106314 - protein, 16 aa, Mycobacterium tuberculosis
FPINILNPVQAVPEVC

SEQ ID NO: 106315 - protein, 16 aa, Mycobacterium tuberculosis
PINILNPVQAVPEVCT

SEQ ID NO: 106316 - protein, 16 aa, Mycobacterium tuberculosis
INILNPVQAVPEVCTI

SEQ ID NO: 106317 - protein, 16 aa, Mycobacterium tuberculosis
NILNPVQAVPEVCTIY

SEQ ID NO: 106318 - protein, 16 aa, Mycobacterium tuberculosis
ILNPVQAVPEVCTIYC

SEQ ID NO: 106319 - protein, 16 aa, Mycobacterium tuberculosis
LNPVQAVPEVCTIYCA

SEQ ID NO: 106320 - protein, 16 aa, Mycobacterium tuberculosis
NPVQAVPEVCTIYCAT

SEQ ID NO: 106321 - protein, 16 aa, Mycobacterium tuberculosis
PVQAVPEVCTIYCATA

SEQ ID NO: 106322 - protein, 16 aa, Mycobacterium tuberculosis
VQAVPEVCTIYCATAN

SEQ ID NO: 106323 - protein, 16 aa, Mycobacterium tuberculosis
QAVPEVCTIYCATANP

SEQ ID NO: 106324 - protein, 16 aa, Mycobacterium tuberculosis
AVPEVCTIYCATANPV

SEQ ID NO: 106325 - protein, 16 aa, Mycobacterium tuberculosis
VPEVCTIYCATANPVD

SEQ ID NO: 106326 - protein, 16 aa, Mycobacterium tuberculosis
PEVCTIYCATANPVDV

SEQ ID NO: 106327 - protein, 16 aa, Mycobacterium tuberculosis
EVCTIYCATANPVDVV

SEQ ID NO: 106328 - protein, 16 aa, Mycobacterium tuberculosis
VCTIYCATANPVDVVV

SEQ ID NO: 106329 - protein, 16 aa, Mycobacterium tuberculosis
CTIYCATANPVDVVVA

SEQ ID NO: 106330 - protein, 16 aa, Mycobacterium tuberculosis
TIYCATANPVDVVVAV

SEQ ID NO: 106331 - protein, 16 aa, Mycobacterium tuberculosis
IYCATANPVDVVVAVT

SEQ ID NO: 106332 - protein, 16 aa, Mycobacterium tuberculosis
YCATANPVDVVVAVTP

SEQ ID NO: 106333 - protein, 16 aa, Mycobacterium tuberculosis
CATANPVDVVVAVTPH

SEQ ID NO: 106334 - protein, 16 aa, Mycobacterium tuberculosis
ATANPVDVVVAVTPHG

SEQ ID NO: 106335 - protein, 16 aa, Mycobacterium tuberculosis
TANPVDVVVAVTPHGR

SEQ ID NO: 106336 - protein, 16 aa, Mycobacterium tuberculosis
ANPVDVVVAVTPHGRG

SEQ ID NO: 106337 - protein, 16 aa, Mycobacterium tuberculosis
NPVDVVVAVTPHGRGI

SEQ ID NO: 106338 - protein, 16 aa, Mycobacterium tuberculosis
PVDVVVAVTPHGRGIV

SEQ ID NO: 106339 - protein, 16 aa, Mycobacterium tuberculosis
VDVVVAVTPHGRGIVG

SEQ ID NO: 106340 - protein, 16 aa, Mycobacterium tuberculosis
DVVVAVTPHGRGIVGV

SEQ ID NO: 106341 - protein, 16 aa, Mycobacterium tuberculosis
VVVAVTPHGRGIVGVV

SEQ ID NO: 106342 - protein, 16 aa, Mycobacterium tuberculosis
VVAVTPHGRGIVGVVD

SEQ ID NO: 106343 - protein, 16 aa, Mycobacterium tuberculosis
VAVTPHGRGIVGVVDG

SEQ ID NO: 106344 - protein, 16 aa, Mycobacterium tuberculosis
AVTPHGRGIVGVVDGQ

SEQ ID NO: 106345 - protein, 16 aa, Mycobacterium tuberculosis
VTPHGRGIVGVVDGQT

SEQ ID NO: 106346 - protein, 16 aa, Mycobacterium tuberculosis
TPHGRGIVGVVDGQTP

SEQ ID NO: 106347 - protein, 16 aa, Mycobacterium tuberculosis
PHGRGIVGVVDGQTPL

SEQ ID NO: 106348 - protein, 16 aa, Mycobacterium tuberculosis
HGRGIVGVVDGQTPLG

SEQ ID NO: 106349 - protein, 16 aa, Mycobacterium tuberculosis
GRGIVGVVDGQTPLGV

SEQ ID NO: 106350 - protein, 16 aa, Mycobacterium tuberculosis
RGIVGVVDGQTPLGVE

SEQ ID NO: 106351 - protein, 16 aa, Mycobacterium tuberculosis
GIVGVVDGQTPLGVET

SEQ ID NO: 106352 - protein, 16 aa, Mycobacterium tuberculosis
IVGVVDGQTPLGVETD

SEQ ID NO: 106353 - protein, 16 aa, Mycobacterium tuberculosis
VGVVDGQTPLGVETDR

SEQ ID NO: 106354 - protein, 16 aa, Mycobacterium tuberculosis
GVVDGQTPLGVETDRD

SEQ ID NO: 106355 - protein, 16 aa, Mycobacterium tuberculosis
VVDGQTPLGVETDRDI

SEQ ID NO: 106356 - protein, 16 aa, Mycobacterium tuberculosis
VDGQTPLGVETDRDIA

SEQ ID NO: 106357 - protein, 16 aa, Mycobacterium tuberculosis
DGQTPLGVETDRDIAQ

SEQ ID NO: 106358 - protein, 16 aa, Mycobacterium tuberculosis
GQTPLGVETDRDIAQR

SEQ ID NO: 106359 - protein, 16 aa, Mycobacterium tuberculosis
QTPLGVETDRDIAQRR

SEQ ID NO: 106360 - protein, 16 aa, Mycobacterium tuberculosis
TPLGVETDRDIAQRRD

SEQ ID NO: 106361 - protein, 16 aa, Mycobacterium tuberculosis
PLGVETDRDIAQRRDL

SEQ ID NO: 106362 - protein, 16 aa, Mycobacterium tuberculosis
LGVETDRDIAQRRDLL

SEQ ID NO: 106363 - protein, 16 aa, Mycobacterium tuberculosis
GVETDRDIAQRRDLLR

SEQ ID NO: 106364 - protein, 16 aa, Mycobacterium tuberculosis
VETDRDIAQRRDLLRA

SEQ ID NO: 106365 - protein, 16 aa, Mycobacterium tuberculosis
ETDRDIAQRRDLLRAI

SEQ ID NO: 106366 - protein, 16 aa, Mycobacterium tuberculosis
TDRDIAQRRDLLRAIG

SEQ ID NO: 106367 - protein, 16 aa, Mycobacterium tuberculosis
DRDIAQRRDLLRAIGY

SEQ ID NO: 106368 - protein, 16 aa, Mycobacterium tuberculosis
RDIAQRRDLLRAIGYK

SEQ ID NO: 106369 - protein, 16 aa, Mycobacterium tuberculosis
DIAQRRDLLRAIGYKL

SEQ ID NO: 106370 - protein, 13 aa, Mycobacterium tuberculosis
MPNRRRRKLSTAM

SEQ ID NO: 106371 - protein, 13 aa, Mycobacterium tuberculosis
PNRRRRKLSTAMS

SEQ ID NO: 106372 - protein, 13 aa, Mycobacterium tuberculosis
NRRRRKLSTAMSA

SEQ ID NO: 106373 - protein, 13 aa, Mycobacterium tuberculosis
RRRRKLSTAMSAV

SEQ ID NO: 106374 - protein, 13 aa, Mycobacterium tuberculosis
RRRKLSTAMSAVA

SEQ ID NO: 106375 - protein, 13 aa, Mycobacterium tuberculosis
RRKLSTAMSAVAA

SEQ ID NO: 106376 - protein, 13 aa, Mycobacterium tuberculosis
RKLSTAMSAVAAL

SEQ ID NO: 106377 - protein, 13 aa, Mycobacterium tuberculosis
KLSTAMSAVAALA

SEQ ID NO: 106378 - protein, 13 aa, Mycobacterium tuberculosis
LSTAMSAVAALAV

SEQ ID NO: 106379 - protein, 13 aa, Mycobacterium tuberculosis
STAMSAVAALAVA

SEQ ID NO: 106380 - protein, 13 aa, Mycobacterium tuberculosis
TAMSAVAALAVAS

SEQ ID NO: 106381 - protein, 13 aa, Mycobacterium tuberculosis
AMSAVAALAVASP

SEQ ID NO: 106382 - protein, 13 aa, Mycobacterium tuberculosis
MSAVAALAVASPC

SEQ ID NO: 106383 - protein, 13 aa, Mycobacterium tuberculosis
SAVAALAVASPCA

SEQ ID NO: 106384 - protein, 13 aa, Mycobacterium tuberculosis
AVAALAVASPCAY

SEQ ID NO: 106385 - protein, 13 aa, Mycobacterium tuberculosis
VAALAVASPCAYF

SEQ ID NO: 106386 - protein, 13 aa, Mycobacterium tuberculosis
AALAVASPCAYFL

SEQ ID NO: 106387 - protein, 13 aa, Mycobacterium tuberculosis
ALAVASPCAYFLV

SEQ ID NO: 106388 - protein, 13 aa, Mycobacterium tuberculosis
LAVASPCAYFLVY

SEQ ID NO: 106389 - protein, 13 aa, Mycobacterium tuberculosis
AVASPCAYFLVYE

SEQ ID NO: 106390 - protein, 13 aa, Mycobacterium tuberculosis
VASPCAYFLVYES

SEQ ID NO: 106391 - protein, 13 aa, Mycobacterium tuberculosis
ASPCAYFLVYEST

SEQ ID NO: 106392 - protein, 13 aa, Mycobacterium tuberculosis
SPCAYFLVYESTE

SEQ ID NO: 106393 - protein, 13 aa, Mycobacterium tuberculosis
PCAYFLVYESTET

SEQ ID NO: 106394 - protein, 13 aa, Mycobacterium tuberculosis
CAYFLVYESTETT

SEQ ID NO: 106395 - protein, 13 aa, Mycobacterium tuberculosis
AYFLVYESTETTE

SEQ ID NO: 106396 - protein, 13 aa, Mycobacterium tuberculosis
YFLVYESTETTER

SEQ ID NO: 106397 - protein, 13 aa, Mycobacterium tuberculosis
FLVYESTETTERP

SEQ ID NO: 106398 - protein, 13 aa, Mycobacterium tuberculosis
LVYESTETTERPE

SEQ ID NO: 106399 - protein, 13 aa, Mycobacterium tuberculosis
VYESTETTERPEH

SEQ ID NO: 106400 - protein, 13 aa, Mycobacterium tuberculosis
YESTETTERPEHH

SEQ ID NO: 106401 - protein, 13 aa, Mycobacterium tuberculosis
ESTETTERPEHHE

SEQ ID NO: 106402 - protein, 13 aa, Mycobacterium tuberculosis
STETTERPEHHEF

SEQ ID NO: 106403 - protein, 13 aa, Mycobacterium tuberculosis
TETTERPEHHEFK

SEQ ID NO: 106404 - protein, 13 aa, Mycobacterium tuberculosis
ETTERPEHHEFKQ

SEQ ID NO: 106405 - protein, 13 aa, Mycobacterium tuberculosis
TTERPEHHEFKQA

SEQ ID NO: 106406 - protein, 13 aa, Mycobacterium tuberculosis
TERPEHHEFKQAA

SEQ ID NO: 106407 - protein, 13 aa, Mycobacterium tuberculosis
ERPEHHEFKQAAV

SEQ ID NO: 106408 - protein, 13 aa, Mycobacterium tuberculosis
RPEHHEFKQAAVL

SEQ ID NO: 106409 - protein, 13 aa, Mycobacterium tuberculosis
PEHHEFKQAAVLT

SEQ ID NO: 106410 - protein, 13 aa, Mycobacterium tuberculosis
EHHEFKQAAVLTD

SEQ ID NO: 106411 - protein, 13 aa, Mycobacterium tuberculosis
HHEFKQAAVLTDL

SEQ ID NO: 106412 - protein, 13 aa, Mycobacterium tuberculosis
HEFKQAAVLTDLP

SEQ ID NO: 106413 - protein, 13 aa, Mycobacterium tuberculosis
EFKQAAVLTDLPG

SEQ ID NO: 106414 - protein, 13 aa, Mycobacterium tuberculosis
FKQAAVLTDLPGE

SEQ ID NO: 106415 - protein, 13 aa, Mycobacterium tuberculosis
KQAAVLTDLPGEL

SEQ ID NO: 106416 - protein, 13 aa, Mycobacterium tuberculosis
QAAVLTDLPGELM

SEQ ID NO: 106417 - protein, 13 aa, Mycobacterium tuberculosis
AAVLTDLPGELMS

SEQ ID NO: 106418 - protein, 13 aa, Mycobacterium tuberculosis
AVLTDLPGELMSA

SEQ ID NO: 106419 - protein, 13 aa, Mycobacterium tuberculosis
VLTDLPGELMSAL

SEQ ID NO: 106420 - protein, 13 aa, Mycobacterium tuberculosis
LTDLPGELMSALS

SEQ ID NO: 106421 - protein, 13 aa, Mycobacterium tuberculosis
TDLPGELMSALSQ

SEQ ID NO: 106422 - protein, 13 aa, Mycobacterium tuberculosis
DLPGELMSALSQG

SEQ ID NO: 106423 - protein, 13 aa, Mycobacterium tuberculosis
LPGELMSALSQGL

SEQ ID NO: 106424 - protein, 13 aa, Mycobacterium tuberculosis
PGELMSALSQGLS

SEQ ID NO: 106425 - protein, 13 aa, Mycobacterium tuberculosis
GELMSALSQGLSQ

SEQ ID NO: 106426 - protein, 13 aa, Mycobacterium tuberculosis
ELMSALSQGLSQF

SEQ ID NO: 106427 - protein, 13 aa, Mycobacterium tuberculosis
LMSALSQGLSQFG

SEQ ID NO: 106428 - protein, 13 aa, Mycobacterium tuberculosis
MSALSQGLSQFGI

SEQ ID NO: 106429 - protein, 13 aa, Mycobacterium tuberculosis
SALSQGLSQFGIN

SEQ ID NO: 106430 - protein, 13 aa, Mycobacterium tuberculosis
ALSQGLSQFGINI

SEQ ID NO: 106431 - protein, 13 aa, Mycobacterium tuberculosis
LSQGLSQFGINIP

SEQ ID NO: 106432 - protein, 13 aa, Mycobacterium tuberculosis
SQGLSQFGINIPP

SEQ ID NO: 106433 - protein, 13 aa, Mycobacterium tuberculosis
QGLSQFGINIPPV

SEQ ID NO: 106434 - protein, 13 aa, Mycobacterium tuberculosis
GLSQFGINIPPVP

SEQ ID NO: 106435 - protein, 13 aa, Mycobacterium tuberculosis
LSQFGINIPPVPS

SEQ ID NO: 106436 - protein, 13 aa, Mycobacterium tuberculosis
SQFGINIPPVPSL

SEQ ID NO: 106437 - protein, 13 aa, Mycobacterium tuberculosis
QFGINIPPVPSLT

SEQ ID NO: 106438 - protein, 13 aa, Mycobacterium tuberculosis
FGINIPPVPSLTG

SEQ ID NO: 106439 - protein, 13 aa, Mycobacterium tuberculosis
GINIPPVPSLTGS

SEQ ID NO: 106440 - protein, 13 aa, Mycobacterium tuberculosis
INIPPVPSLTGSG

SEQ ID NO: 106441 - protein, 13 aa, Mycobacterium tuberculosis
NIPPVPSLTGSGD

SEQ ID NO: 106442 - protein, 13 aa, Mycobacterium tuberculosis
IPPVPSLTGSGDA

SEQ ID NO: 106443 - protein, 13 aa, Mycobacterium tuberculosis
PPVPSLTGSGDAS

SEQ ID NO: 106444 - protein, 13 aa, Mycobacterium tuberculosis
PVPSLTGSGDAST

SEQ ID NO: 106445 - protein, 13 aa, Mycobacterium tuberculosis
VPSLTGSGDASTG

SEQ ID NO: 106446 - protein, 13 aa, Mycobacterium tuberculosis
PSLTGSGDASTGL

SEQ ID NO: 106447 - protein, 13 aa, Mycobacterium tuberculosis
SLTGSGDASTGLT

SEQ ID NO: 106448 - protein, 13 aa, Mycobacterium tuberculosis
LTGSGDASTGLTG

SEQ ID NO: 106449 - protein, 13 aa, Mycobacterium tuberculosis
TGSGDASTGLTGP

SEQ ID NO: 106450 - protein, 13 aa, Mycobacterium tuberculosis
GSGDASTGLTGPG

SEQ ID NO: 106451 - protein, 13 aa, Mycobacterium tuberculosis
SGDASTGLTGPGL

SEQ ID NO: 106452 - protein, 13 aa, Mycobacterium tuberculosis
GDASTGLTGPGLT

SEQ ID NO: 106453 - protein, 13 aa, Mycobacterium tuberculosis
DASTGLTGPGLTS

SEQ ID NO: 106454 - protein, 13 aa, Mycobacterium tuberculosis
ASTGLTGPGLTSP

SEQ ID NO: 106455 - protein, 13 aa, Mycobacterium tuberculosis
STGLTGPGLTSPG

SEQ ID NO: 106456 - protein, 13 aa, Mycobacterium tuberculosis
TGLTGPGLTSPGL

SEQ ID NO: 106457 - protein, 13 aa, Mycobacterium tuberculosis
GLTGPGLTSPGLT

SEQ ID NO: 106458 - protein, 13 aa, Mycobacterium tuberculosis
LTGPGLTSPGLTS

SEQ ID NO: 106459 - protein, 13 aa, Mycobacterium tuberculosis
TGPGLTSPGLTSP

SEQ ID NO: 106460 - protein, 13 aa, Mycobacterium tuberculosis
GPGLTSPGLTSPG

SEQ ID NO: 106461 - protein, 13 aa, Mycobacterium tuberculosis
PGLTSPGLTSPGL

SEQ ID NO: 106462 - protein, 13 aa, Mycobacterium tuberculosis
GLTSPGLTSPGLT

SEQ ID NO: 106463 - protein, 13 aa, Mycobacterium tuberculosis
LTSPGLTSPGLTS

SEQ ID NO: 106464 - protein, 13 aa, Mycobacterium tuberculosis
TSPGLTSPGLTSP

SEQ ID NO: 106465 - protein, 13 aa, Mycobacterium tuberculosis
SPGLTSPGLTSPG

SEQ ID NO: 106466 - protein, 13 aa, Mycobacterium tuberculosis
PGLTSPGLTSPGL

SEQ ID NO: 106467 - protein, 13 aa, Mycobacterium tuberculosis
GLTSPGLTSPGLT

SEQ ID NO: 106468 - protein, 13 aa, Mycobacterium tuberculosis
LTSPGLTSPGLTD

SEQ ID NO: 106469 - protein, 13 aa, Mycobacterium tuberculosis
TSPGLTSPGLTDP

SEQ ID NO: 106470 - protein, 13 aa, Mycobacterium tuberculosis
SPGLTSPGLTDPA

SEQ ID NO: 106471 - protein, 13 aa, Mycobacterium tuberculosis
PGLTSPGLTDPAL

SEQ ID NO: 106472 - protein, 13 aa, Mycobacterium tuberculosis
GLTSPGLTDPALT

SEQ ID NO: 106473 - protein, 13 aa, Mycobacterium tuberculosis
LTSPGLTDPALTS

SEQ ID NO: 106474 - protein, 13 aa, Mycobacterium tuberculosis
TSPGLTDPALTSP

SEQ ID NO: 106475 - protein, 13 aa, Mycobacterium tuberculosis
SPGLTDPALTSPG

SEQ ID NO: 106476 - protein, 13 aa, Mycobacterium tuberculosis
PGLTDPALTSPGL

SEQ ID NO: 106477 - protein, 13 aa, Mycobacterium tuberculosis
GLTDPALTSPGLT

SEQ ID NO: 106478 - protein, 13 aa, Mycobacterium tuberculosis
LTDPALTSPGLTP

SEQ ID NO: 106479 - protein, 13 aa, Mycobacterium tuberculosis
TDPALTSPGLTPT

SEQ ID NO: 106480 - protein, 13 aa, Mycobacterium tuberculosis
DPALTSPGLTPTL

SEQ ID NO: 106481 - protein, 13 aa, Mycobacterium tuberculosis
PALTSPGLTPTLP

SEQ ID NO: 106482 - protein, 13 aa, Mycobacterium tuberculosis
ALTSPGLTPTLPG

SEQ ID NO: 106483 - protein, 13 aa, Mycobacterium tuberculosis
LTSPGLTPTLPGS

SEQ ID NO: 106484 - protein, 13 aa, Mycobacterium tuberculosis
TSPGLTPTLPGSL

SEQ ID NO: 106485 - protein, 13 aa, Mycobacterium tuberculosis
SPGLTPTLPGSLA

SEQ ID NO: 106486 - protein, 13 aa, Mycobacterium tuberculosis
PGLTPTLPGSLAA

SEQ ID NO: 106487 - protein, 13 aa, Mycobacterium tuberculosis
GLTPTLPGSLAAP

SEQ ID NO: 106488 - protein, 13 aa, Mycobacterium tuberculosis
LTPTLPGSLAAPG

SEQ ID NO: 106489 - protein, 13 aa, Mycobacterium tuberculosis
TPTLPGSLAAPGT

SEQ ID NO: 106490 - protein, 13 aa, Mycobacterium tuberculosis
PTLPGSLAAPGTT

SEQ ID NO: 106491 - protein, 13 aa, Mycobacterium tuberculosis
TLPGSLAAPGTTL

SEQ ID NO: 106492 - protein, 13 aa, Mycobacterium tuberculosis
LPGSLAAPGTTLA

SEQ ID NO: 106493 - protein, 13 aa, Mycobacterium tuberculosis
PGSLAAPGTTLAP

SEQ ID NO: 106494 - protein, 13 aa, Mycobacterium tuberculosis
GSLAAPGTTLAPT

SEQ ID NO: 106495 - protein, 13 aa, Mycobacterium tuberculosis
SLAAPGTTLAPTP

SEQ ID NO: 106496 - protein, 13 aa, Mycobacterium tuberculosis
LAAPGTTLAPTPG

SEQ ID NO: 106497 - protein, 13 aa, Mycobacterium tuberculosis
AAPGTTLAPTPGV

SEQ ID NO: 106498 - protein, 13 aa, Mycobacterium tuberculosis
APGTTLAPTPGVG

SEQ ID NO: 106499 - protein, 13 aa, Mycobacterium tuberculosis
PGTTLAPTPGVGA

SEQ ID NO: 106500 - protein, 13 aa, Mycobacterium tuberculosis
GTTLAPTPGVGAN

SEQ ID NO: 106501 - protein, 13 aa, Mycobacterium tuberculosis
TTLAPTPGVGANP

SEQ ID NO: 106502 - protein, 13 aa, Mycobacterium tuberculosis
TLAPTPGVGANPA

SEQ ID NO: 106503 - protein, 13 aa, Mycobacterium tuberculosis
LAPTPGVGANPAL

SEQ ID NO: 106504 - protein, 13 aa, Mycobacterium tuberculosis
APTPGVGANPALT

SEQ ID NO: 106505 - protein, 13 aa, Mycobacterium tuberculosis
PTPGVGANPALTN

SEQ ID NO: 106506 - protein, 13 aa, Mycobacterium tuberculosis
TPGVGANPALTNP

SEQ ID NO: 106507 - protein, 13 aa, Mycobacterium tuberculosis
PGVGANPALTNPA

SEQ ID NO: 106508 - protein, 13 aa, Mycobacterium tuberculosis
GVGANPALTNPAL

SEQ ID NO: 106509 - protein, 13 aa, Mycobacterium tuberculosis
VGANPALTNPALT

SEQ ID NO: 106510 - protein, 13 aa, Mycobacterium tuberculosis
GANPALTNPALTS

SEQ ID NO: 106511 - protein, 13 aa, Mycobacterium tuberculosis
ANPALTNPALTSP

SEQ ID NO: 106512 - protein, 13 aa, Mycobacterium tuberculosis
NPALTNPALTSPT

SEQ ID NO: 106513 - protein, 13 aa, Mycobacterium tuberculosis
PALTNPALTSPTG

SEQ ID NO: 106514 - protein, 13 aa, Mycobacterium tuberculosis
ALTNPALTSPTGA

SEQ ID NO: 106515 - protein, 13 aa, Mycobacterium tuberculosis
LTNPALTSPTGAT

SEQ ID NO: 106516 - protein, 13 aa, Mycobacterium tuberculosis
TNPALTSPTGATP

SEQ ID NO: 106517 - protein, 13 aa, Mycobacterium tuberculosis
NPALTSPTGATPG

SEQ ID NO: 106518 - protein, 13 aa, Mycobacterium tuberculosis
PALTSPTGATPGL

SEQ ID NO: 106519 - protein, 13 aa, Mycobacterium tuberculosis
ALTSPTGATPGLT

SEQ ID NO: 106520 - protein, 13 aa, Mycobacterium tuberculosis
LTSPTGATPGLTS

SEQ ID NO: 106521 - protein, 13 aa, Mycobacterium tuberculosis
TSPTGATPGLTSP

SEQ ID NO: 106522 - protein, 13 aa, Mycobacterium tuberculosis
SPTGATPGLTSPT

SEQ ID NO: 106523 - protein, 13 aa, Mycobacterium tuberculosis
PTGATPGLTSPTG

SEQ ID NO: 106524 - protein, 13 aa, Mycobacterium tuberculosis
TGATPGLTSPTGL

SEQ ID NO: 106525 - protein, 13 aa, Mycobacterium tuberculosis
GATPGLTSPTGLD

SEQ ID NO: 106526 - protein, 13 aa, Mycobacterium tuberculosis
ATPGLTSPTGLDP

SEQ ID NO: 106527 - protein, 13 aa, Mycobacterium tuberculosis
TPGLTSPTGLDPA

SEQ ID NO: 106528 - protein, 13 aa, Mycobacterium tuberculosis
PGLTSPTGLDPAL

SEQ ID NO: 106529 - protein, 13 aa, Mycobacterium tuberculosis
GLTSPTGLDPALG

SEQ ID NO: 106530 - protein, 13 aa, Mycobacterium tuberculosis
LTSPTGLDPALGG

SEQ ID NO: 106531 - protein, 13 aa, Mycobacterium tuberculosis
TSPTGLDPALGGA

SEQ ID NO: 106532 - protein, 13 aa, Mycobacterium tuberculosis
SPTGLDPALGGAN

SEQ ID NO: 106533 - protein, 13 aa, Mycobacterium tuberculosis
PTGLDPALGGANE

SEQ ID NO: 106534 - protein, 13 aa, Mycobacterium tuberculosis
TGLDPALGGANEI

SEQ ID NO: 106535 - protein, 13 aa, Mycobacterium tuberculosis
GLDPALGGANEIP

SEQ ID NO: 106536 - protein, 13 aa, Mycobacterium tuberculosis
LDPALGGANEIPI

SEQ ID NO: 106537 - protein, 13 aa, Mycobacterium tuberculosis
DPALGGANEIPIT

SEQ ID NO: 106538 - protein, 13 aa, Mycobacterium tuberculosis
PALGGANEIPITT

SEQ ID NO: 106539 - protein, 13 aa, Mycobacterium tuberculosis
ALGGANEIPITTP

SEQ ID NO: 106540 - protein, 13 aa, Mycobacterium tuberculosis
LGGANEIPITTPV

SEQ ID NO: 106541 - protein, 13 aa, Mycobacterium tuberculosis
GGANEIPITTPVG

SEQ ID NO: 106542 - protein, 13 aa, Mycobacterium tuberculosis
GANEIPITTPVGL

SEQ ID NO: 106543 - protein, 13 aa, Mycobacterium tuberculosis
ANEIPITTPVGLD

SEQ ID NO: 106544 - protein, 13 aa, Mycobacterium tuberculosis
NEIPITTPVGLDP

SEQ ID NO: 106545 - protein, 13 aa, Mycobacterium tuberculosis
EIPITTPVGLDPG

SEQ ID NO: 106546 - protein, 13 aa, Mycobacterium tuberculosis
IPITTPVGLDPGA

SEQ ID NO: 106547 - protein, 13 aa, Mycobacterium tuberculosis
PITTPVGLDPGAD

SEQ ID NO: 106548 - protein, 13 aa, Mycobacterium tuberculosis
ITTPVGLDPGADG

SEQ ID NO: 106549 - protein, 13 aa, Mycobacterium tuberculosis
TTPVGLDPGADGT

SEQ ID NO: 106550 - protein, 13 aa, Mycobacterium tuberculosis
TPVGLDPGADGTY

SEQ ID NO: 106551 - protein, 13 aa, Mycobacterium tuberculosis
PVGLDPGADGTYP

SEQ ID NO: 106552 - protein, 13 aa, Mycobacterium tuberculosis
VGLDPGADGTYPI

SEQ ID NO: 106553 - protein, 13 aa, Mycobacterium tuberculosis
GLDPGADGTYPIL

SEQ ID NO: 106554 - protein, 13 aa, Mycobacterium tuberculosis
LDPGADGTYPILG

SEQ ID NO: 106555 - protein, 13 aa, Mycobacterium tuberculosis
DPGADGTYPILGD

SEQ ID NO: 106556 - protein, 13 aa, Mycobacterium tuberculosis
PGADGTYPILGDP

SEQ ID NO: 106557 - protein, 13 aa, Mycobacterium tuberculosis
GADGTYPILGDPT

SEQ ID NO: 106558 - protein, 13 aa, Mycobacterium tuberculosis
ADGTYPILGDPTL

SEQ ID NO: 106559 - protein, 13 aa, Mycobacterium tuberculosis
DGTYPILGDPTLG

SEQ ID NO: 106560 - protein, 13 aa, Mycobacterium tuberculosis
GTYPILGDPTLGT

SEQ ID NO: 106561 - protein, 13 aa, Mycobacterium tuberculosis
TYPILGDPTLGTI

SEQ ID NO: 106562 - protein, 13 aa, Mycobacterium tuberculosis
YPILGDPTLGTIP

SEQ ID NO: 106563 - protein, 13 aa, Mycobacterium tuberculosis
PILGDPTLGTIPS

SEQ ID NO: 106564 - protein, 13 aa, Mycobacterium tuberculosis
ILGDPTLGTIPSS

SEQ ID NO: 106565 - protein, 13 aa, Mycobacterium tuberculosis
LGDPTLGTIPSSP

SEQ ID NO: 106566 - protein, 13 aa, Mycobacterium tuberculosis
GDPTLGTIPSSPA

SEQ ID NO: 106567 - protein, 13 aa, Mycobacterium tuberculosis
DPTLGTIPSSPAT

SEQ ID NO: 106568 - protein, 13 aa, Mycobacterium tuberculosis
PTLGTIPSSPATT

SEQ ID NO: 106569 - protein, 13 aa, Mycobacterium tuberculosis
TLGTIPSSPATTS

SEQ ID NO: 106570 - protein, 13 aa, Mycobacterium tuberculosis
LGTIPSSPATTST

SEQ ID NO: 106571 - protein, 13 aa, Mycobacterium tuberculosis
GTIPSSPATTSTG

SEQ ID NO: 106572 - protein, 13 aa, Mycobacterium tuberculosis
TIPSSPATTSTGG

SEQ ID NO: 106573 - protein, 13 aa, Mycobacterium tuberculosis
IPSSPATTSTGGG

SEQ ID NO: 106574 - protein, 13 aa, Mycobacterium tuberculosis
PSSPATTSTGGGG

SEQ ID NO: 106575 - protein, 13 aa, Mycobacterium tuberculosis
SSPATTSTGGGGL

SEQ ID NO: 106576 - protein, 13 aa, Mycobacterium tuberculosis
SPATTSTGGGGLV

SEQ ID NO: 106577 - protein, 13 aa, Mycobacterium tuberculosis
PATTSTGGGGLVN

SEQ ID NO: 106578 - protein, 13 aa, Mycobacterium tuberculosis
ATTSTGGGGLVND

SEQ ID NO: 106579 - protein, 13 aa, Mycobacterium tuberculosis
TTSTGGGGLVNDV

SEQ ID NO: 106580 - protein, 13 aa, Mycobacterium tuberculosis
TSTGGGGLVNDVM

SEQ ID NO: 106581 - protein, 13 aa, Mycobacterium tuberculosis
STGGGGLVNDVMQ

SEQ ID NO: 106582 - protein, 13 aa, Mycobacterium tuberculosis
TGGGGLVNDVMQV

SEQ ID NO: 106583 - protein, 13 aa, Mycobacterium tuberculosis
GGGGLVNDVMQVA

SEQ ID NO: 106584 - protein, 13 aa, Mycobacterium tuberculosis
GGGLVNDVMQVAN

SEQ ID NO: 106585 - protein, 13 aa, Mycobacterium tuberculosis
GGLVNDVMQVANE

SEQ ID NO: 106586 - protein, 13 aa, Mycobacterium tuberculosis
GLVNDVMQVANEL

SEQ ID NO: 106587 - protein, 13 aa, Mycobacterium tuberculosis
LVNDVMQVANELG

SEQ ID NO: 106588 - protein, 13 aa, Mycobacterium tuberculosis
VNDVMQVANELGA

SEQ ID NO: 106589 - protein, 13 aa, Mycobacterium tuberculosis
NDVMQVANELGAS

SEQ ID NO: 106590 - protein, 13 aa, Mycobacterium tuberculosis
DVMQVANELGASQ

SEQ ID NO: 106591 - protein, 13 aa, Mycobacterium tuberculosis
VMQVANELGASQA

SEQ ID NO: 106592 - protein, 13 aa, Mycobacterium tuberculosis
MQVANELGASQAI

SEQ ID NO: 106593 - protein, 13 aa, Mycobacterium tuberculosis
QVANELGASQAID

SEQ ID NO: 106594 - protein, 13 aa, Mycobacterium tuberculosis
VANELGASQAIDL

SEQ ID NO: 106595 - protein, 13 aa, Mycobacterium tuberculosis
ANELGASQAIDLL

SEQ ID NO: 106596 - protein, 13 aa, Mycobacterium tuberculosis
NELGASQAIDLLK

SEQ ID NO: 106597 - protein, 13 aa, Mycobacterium tuberculosis
ELGASQAIDLLKG

SEQ ID NO: 106598 - protein, 13 aa, Mycobacterium tuberculosis
LGASQAIDLLKGV

SEQ ID NO: 106599 - protein, 13 aa, Mycobacterium tuberculosis
GASQAIDLLKGVL

SEQ ID NO: 106600 - protein, 13 aa, Mycobacterium tuberculosis
ASQAIDLLKGVLM

SEQ ID NO: 106601 - protein, 13 aa, Mycobacterium tuberculosis
SQAIDLLKGVLMP

SEQ ID NO: 106602 - protein, 13 aa, Mycobacterium tuberculosis
QAIDLLKGVLMPS

SEQ ID NO: 106603 - protein, 13 aa, Mycobacterium tuberculosis
AIDLLKGVLMPSI

SEQ ID NO: 106604 - protein, 13 aa, Mycobacterium tuberculosis
IDLLKGVLMPSIM

SEQ ID NO: 106605 - protein, 13 aa, Mycobacterium tuberculosis
DLLKGVLMPSIMQ

SEQ ID NO: 106606 - protein, 13 aa, Mycobacterium tuberculosis
LLKGVLMPSIMQA

SEQ ID NO: 106607 - protein, 13 aa, Mycobacterium tuberculosis
LKGVLMPSIMQAV

SEQ ID NO: 106608 - protein, 13 aa, Mycobacterium tuberculosis
KGVLMPSIMQAVQ

SEQ ID NO: 106609 - protein, 13 aa, Mycobacterium tuberculosis
GVLMPSIMQAVQN

SEQ ID NO: 106610 - protein, 13 aa, Mycobacterium tuberculosis
VLMPSIMQAVQNG

SEQ ID NO: 106611 - protein, 13 aa, Mycobacterium tuberculosis
LMPSIMQAVQNGG

SEQ ID NO: 106612 - protein, 13 aa, Mycobacterium tuberculosis
MPSIMQAVQNGGA

SEQ ID NO: 106613 - protein, 13 aa, Mycobacterium tuberculosis
PSIMQAVQNGGAA

SEQ ID NO: 106614 - protein, 13 aa, Mycobacterium tuberculosis
SIMQAVQNGGAAA

SEQ ID NO: 106615 - protein, 13 aa, Mycobacterium tuberculosis
IMQAVQNGGAAAP

SEQ ID NO: 106616 - protein, 13 aa, Mycobacterium tuberculosis
MQAVQNGGAAAPA

SEQ ID NO: 106617 - protein, 13 aa, Mycobacterium tuberculosis
QAVQNGGAAAPAA

SEQ ID NO: 106618 - protein, 13 aa, Mycobacterium tuberculosis
AVQNGGAAAPAAS

SEQ ID NO: 106619 - protein, 13 aa, Mycobacterium tuberculosis
VQNGGAAAPAASP

SEQ ID NO: 106620 - protein, 13 aa, Mycobacterium tuberculosis
QNGGAAAPAASPP

SEQ ID NO: 106621 - protein, 13 aa, Mycobacterium tuberculosis
NGGAAAPAASPPV

SEQ ID NO: 106622 - protein, 13 aa, Mycobacterium tuberculosis
GGAAAPAASPPVP

SEQ ID NO: 106623 - protein, 13 aa, Mycobacterium tuberculosis
GAAAPAASPPVPP

SEQ ID NO: 106624 - protein, 13 aa, Mycobacterium tuberculosis
AAAPAASPPVPPI

SEQ ID NO: 106625 - protein, 13 aa, Mycobacterium tuberculosis
AAPAASPPVPPIP

SEQ ID NO: 106626 - protein, 13 aa, Mycobacterium tuberculosis
APAASPPVPPIPA

SEQ ID NO: 106627 - protein, 13 aa, Mycobacterium tuberculosis
PAASPPVPPIPAA

SEQ ID NO: 106628 - protein, 13 aa, Mycobacterium tuberculosis
AASPPVPPIPAAA

SEQ ID NO: 106629 - protein, 13 aa, Mycobacterium tuberculosis
ASPPVPPIPAAAA

SEQ ID NO: 106630 - protein, 13 aa, Mycobacterium tuberculosis
SPPVPPIPAAAAV

SEQ ID NO: 106631 - protein, 13 aa, Mycobacterium tuberculosis
PPVPPIPAAAAVP

SEQ ID NO: 106632 - protein, 13 aa, Mycobacterium tuberculosis
PVPPIPAAAAVPP

SEQ ID NO: 106633 - protein, 13 aa, Mycobacterium tuberculosis
VPPIPAAAAVPPT

SEQ ID NO: 106634 - protein, 13 aa, Mycobacterium tuberculosis
PPIPAAAAVPPTD

SEQ ID NO: 106635 - protein, 13 aa, Mycobacterium tuberculosis
PIPAAAAVPPTDP

SEQ ID NO: 106636 - protein, 13 aa, Mycobacterium tuberculosis
IPAAAAVPPTDPI

SEQ ID NO: 106637 - protein, 13 aa, Mycobacterium tuberculosis
PAAAAVPPTDPIT

SEQ ID NO: 106638 - protein, 13 aa, Mycobacterium tuberculosis
AAAAVPPTDPITV

SEQ ID NO: 106639 - protein, 13 aa, Mycobacterium tuberculosis
AAAVPPTDPITVP

SEQ ID NO: 106640 - protein, 13 aa, Mycobacterium tuberculosis
AAVPPTDPITVPV

SEQ ID NO: 106641 - protein, 13 aa, Mycobacterium tuberculosis
AVPPTDPITVPVA

SEQ ID NO: 106642 - protein, 14 aa, Mycobacterium tuberculosis
MPNRRRRKLSTAMS

SEQ ID NO: 106643 - protein, 14 aa, Mycobacterium tuberculosis
PNRRRRKLSTAMSA

SEQ ID NO: 106644 - protein, 14 aa, Mycobacterium tuberculosis
NRRRRKLSTAMSAV

SEQ ID NO: 106645 - protein, 14 aa, Mycobacterium tuberculosis
RRRRKLSTAMSAVA

SEQ ID NO: 106646 - protein, 14 aa, Mycobacterium tuberculosis
RRRKLSTAMSAVAA

SEQ ID NO: 106647 - protein, 14 aa, Mycobacterium tuberculosis
RRKLSTAMSAVAAL

SEQ ID NO: 106648 - protein, 14 aa, Mycobacterium tuberculosis
RKLSTAMSAVAALA

SEQ ID NO: 106649 - protein, 14 aa, Mycobacterium tuberculosis
KLSTAMSAVAALAV

SEQ ID NO: 106650 - protein, 14 aa, Mycobacterium tuberculosis
LSTAMSAVAALAVA

SEQ ID NO: 106651 - protein, 14 aa, Mycobacterium tuberculosis
STAMSAVAALAVAS

SEQ ID NO: 106652 - protein, 14 aa, Mycobacterium tuberculosis
TAMSAVAALAVASP

SEQ ID NO: 106653 - protein, 14 aa, Mycobacterium tuberculosis
AMSAVAALAVASPC

SEQ ID NO: 106654 - protein, 14 aa, Mycobacterium tuberculosis
MSAVAALAVASPCA

SEQ ID NO: 106655 - protein, 14 aa, Mycobacterium tuberculosis
SAVAALAVASPCAY

SEQ ID NO: 106656 - protein, 14 aa, Mycobacterium tuberculosis
AVAALAVASPCAYF

SEQ ID NO: 106657 - protein, 14 aa, Mycobacterium tuberculosis
VAALAVASPCAYFL

SEQ ID NO: 106658 - protein, 14 aa, Mycobacterium tuberculosis
AALAVASPCAYFLV

SEQ ID NO: 106659 - protein, 14 aa, Mycobacterium tuberculosis
ALAVASPCAYFLVY

SEQ ID NO: 106660 - protein, 14 aa, Mycobacterium tuberculosis
LAVASPCAYFLVYE

SEQ ID NO: 106661 - protein, 14 aa, Mycobacterium tuberculosis
AVASPCAYFLVYES

SEQ ID NO: 106662 - protein, 14 aa, Mycobacterium tuberculosis
VASPCAYFLVYEST

SEQ ID NO: 106663 - protein, 14 aa, Mycobacterium tuberculosis
ASPCAYFLVYESTE

SEQ ID NO: 106664 - protein, 14 aa, Mycobacterium tuberculosis
SPCAYFLVYESTET

SEQ ID NO: 106665 - protein, 14 aa, Mycobacterium tuberculosis
PCAYFLVYESTETT

SEQ ID NO: 106666 - protein, 14 aa, Mycobacterium tuberculosis
CAYFLVYESTETTE

SEQ ID NO: 106667 - protein, 14 aa, Mycobacterium tuberculosis
AYFLVYESTETTER

SEQ ID NO: 106668 - protein, 14 aa, Mycobacterium tuberculosis
YFLVYESTETTERP

SEQ ID NO: 106669 - protein, 14 aa, Mycobacterium tuberculosis
FLVYESTETTERPE

SEQ ID NO: 106670 - protein, 14 aa, Mycobacterium tuberculosis
LVYESTETTERPEH

SEQ ID NO: 106671 - protein, 14 aa, Mycobacterium tuberculosis
VYESTETTERPEHH

SEQ ID NO: 106672 - protein, 14 aa, Mycobacterium tuberculosis
YESTETTERPEHHE

SEQ ID NO: 106673 - protein, 14 aa, Mycobacterium tuberculosis
ESTETTERPEHHEF

SEQ ID NO: 106674 - protein, 14 aa, Mycobacterium tuberculosis
STETTERPEHHEFK

SEQ ID NO: 106675 - protein, 14 aa, Mycobacterium tuberculosis
TETTERPEHHEFKQ

SEQ ID NO: 106676 - protein, 14 aa, Mycobacterium tuberculosis
ETTERPEHHEFKQA

SEQ ID NO: 106677 - protein, 14 aa, Mycobacterium tuberculosis
TTERPEHHEFKQAA

SEQ ID NO: 106678 - protein, 14 aa, Mycobacterium tuberculosis
TERPEHHEFKQAAV

SEQ ID NO: 106679 - protein, 14 aa, Mycobacterium tuberculosis
ERPEHHEFKQAAVL

SEQ ID NO: 106680 - protein, 14 aa, Mycobacterium tuberculosis
RPEHHEFKQAAVLT

SEQ ID NO: 106681 - protein, 14 aa, Mycobacterium tuberculosis
PEHHEFKQAAVLTD

SEQ ID NO: 106682 - protein, 14 aa, Mycobacterium tuberculosis
EHHEFKQAAVLTDL

SEQ ID NO: 106683 - protein, 14 aa, Mycobacterium tuberculosis
HHEFKQAAVLTDLP

SEQ ID NO: 106684 - protein, 14 aa, Mycobacterium tuberculosis
HEFKQAAVLTDLPG

SEQ ID NO: 106685 - protein, 14 aa, Mycobacterium tuberculosis
EFKQAAVLTDLPGE

SEQ ID NO: 106686 - protein, 14 aa, Mycobacterium tuberculosis
FKQAAVLTDLPGEL

SEQ ID NO: 106687 - protein, 14 aa, Mycobacterium tuberculosis
KQAAVLTDLPGELM

SEQ ID NO: 106688 - protein, 14 aa, Mycobacterium tuberculosis
QAAVLTDLPGELMS

SEQ ID NO: 106689 - protein, 14 aa, Mycobacterium tuberculosis
AAVLTDLPGELMSA

SEQ ID NO: 106690 - protein, 14 aa, Mycobacterium tuberculosis
AVLTDLPGELMSAL

SEQ ID NO: 106691 - protein, 14 aa, Mycobacterium tuberculosis
VLTDLPGELMSALS

SEQ ID NO: 106692 - protein, 14 aa, Mycobacterium tuberculosis
LTDLPGELMSALSQ

SEQ ID NO: 106693 - protein, 14 aa, Mycobacterium tuberculosis
TDLPGELMSALSQG

SEQ ID NO: 106694 - protein, 14 aa, Mycobacterium tuberculosis
DLPGELMSALSQGL

SEQ ID NO: 106695 - protein, 14 aa, Mycobacterium tuberculosis
LPGELMSALSQGLS

SEQ ID NO: 106696 - protein, 14 aa, Mycobacterium tuberculosis
PGELMSALSQGLSQ

SEQ ID NO: 106697 - protein, 14 aa, Mycobacterium tuberculosis
GELMSALSQGLSQF

SEQ ID NO: 106698 - protein, 14 aa, Mycobacterium tuberculosis
ELMSALSQGLSQFG

SEQ ID NO: 106699 - protein, 14 aa, Mycobacterium tuberculosis
LMSALSQGLSQFGI

SEQ ID NO: 106700 - protein, 14 aa, Mycobacterium tuberculosis
MSALSQGLSQFGIN

SEQ ID NO: 106701 - protein, 14 aa, Mycobacterium tuberculosis
SALSQGLSQFGINI

SEQ ID NO: 106702 - protein, 14 aa, Mycobacterium tuberculosis
ALSQGLSQFGINIP

SEQ ID NO: 106703 - protein, 14 aa, Mycobacterium tuberculosis
LSQGLSQFGINIPP

SEQ ID NO: 106704 - protein, 14 aa, Mycobacterium tuberculosis
SQGLSQFGINIPPV

SEQ ID NO: 106705 - protein, 14 aa, Mycobacterium tuberculosis
QGLSQFGINIPPVP

SEQ ID NO: 106706 - protein, 14 aa, Mycobacterium tuberculosis
GLSQFGINIPPVPS

SEQ ID NO: 106707 - protein, 14 aa, Mycobacterium tuberculosis
LSQFGINIPPVPSL

SEQ ID NO: 106708 - protein, 14 aa, Mycobacterium tuberculosis
SQFGINIPPVPSLT

SEQ ID NO: 106709 - protein, 14 aa, Mycobacterium tuberculosis
QFGINIPPVPSLTG

SEQ ID NO: 106710 - protein, 14 aa, Mycobacterium tuberculosis
FGINIPPVPSLTGS

SEQ ID NO: 106711 - protein, 14 aa, Mycobacterium tuberculosis
GINIPPVPSLTGSG

SEQ ID NO: 106712 - protein, 14 aa, Mycobacterium tuberculosis
INIPPVPSLTGSGD

SEQ ID NO: 106713 - protein, 14 aa, Mycobacterium tuberculosis
NIPPVPSLTGSGDA

SEQ ID NO: 106714 - protein, 14 aa, Mycobacterium tuberculosis
IPPVPSLTGSGDAS

SEQ ID NO: 106715 - protein, 14 aa, Mycobacterium tuberculosis
PPVPSLTGSGDAST

SEQ ID NO: 106716 - protein, 14 aa, Mycobacterium tuberculosis
PVPSLTGSGDASTG

SEQ ID NO: 106717 - protein, 14 aa, Mycobacterium tuberculosis
VPSLTGSGDASTGL

SEQ ID NO: 106718 - protein, 14 aa, Mycobacterium tuberculosis
PSLTGSGDASTGLT

SEQ ID NO: 106719 - protein, 14 aa, Mycobacterium tuberculosis
SLTGSGDASTGLTG

SEQ ID NO: 106720 - protein, 14 aa, Mycobacterium tuberculosis
LTGSGDASTGLTGP

SEQ ID NO: 106721 - protein, 14 aa, Mycobacterium tuberculosis
TGSGDASTGLTGPG

SEQ ID NO: 106722 - protein, 14 aa, Mycobacterium tuberculosis
GSGDASTGLTGPGL

SEQ ID NO: 106723 - protein, 14 aa, Mycobacterium tuberculosis
SGDASTGLTGPGLT

SEQ ID NO: 106724 - protein, 14 aa, Mycobacterium tuberculosis
GDASTGLTGPGLTS

SEQ ID NO: 106725 - protein, 14 aa, Mycobacterium tuberculosis
DASTGLTGPGLTSP

SEQ ID NO: 106726 - protein, 14 aa, Mycobacterium tuberculosis
ASTGLTGPGLTSPG

SEQ ID NO: 106727 - protein, 14 aa, Mycobacterium tuberculosis
STGLTGPGLTSPGL

SEQ ID NO: 106728 - protein, 14 aa, Mycobacterium tuberculosis
TGLTGPGLTSPGLT

SEQ ID NO: 106729 - protein, 14 aa, Mycobacterium tuberculosis
GLTGPGLTSPGLTS

SEQ ID NO: 106730 - protein, 14 aa, Mycobacterium tuberculosis
LTGPGLTSPGLTSP

SEQ ID NO: 106731 - protein, 14 aa, Mycobacterium tuberculosis
TGPGLTSPGLTSPG

SEQ ID NO: 106732 - protein, 14 aa, Mycobacterium tuberculosis
GPGLTSPGLTSPGL

SEQ ID NO: 106733 - protein, 14 aa, Mycobacterium tuberculosis
PGLTSPGLTSPGLT

SEQ ID NO: 106734 - protein, 14 aa, Mycobacterium tuberculosis
GLTSPGLTSPGLTS

SEQ ID NO: 106735 - protein, 14 aa, Mycobacterium tuberculosis
LTSPGLTSPGLTSP

SEQ ID NO: 106736 - protein, 14 aa, Mycobacterium tuberculosis
TSPGLTSPGLTSPG

SEQ ID NO: 106737 - protein, 14 aa, Mycobacterium tuberculosis
SPGLTSPGLTSPGL

SEQ ID NO: 106738 - protein, 14 aa, Mycobacterium tuberculosis
PGLTSPGLTSPGLT

SEQ ID NO: 106739 - protein, 14 aa, Mycobacterium tuberculosis
GLTSPGLTSPGLTD

SEQ ID NO: 106740 - protein, 14 aa, Mycobacterium tuberculosis
LTSPGLTSPGLTDP

SEQ ID NO: 106741 - protein, 14 aa, Mycobacterium tuberculosis
TSPGLTSPGLTDPA

SEQ ID NO: 106742 - protein, 14 aa, Mycobacterium tuberculosis
SPGLTSPGLTDPAL

SEQ ID NO: 106743 - protein, 14 aa, Mycobacterium tuberculosis
PGLTSPGLTDPALT

SEQ ID NO: 106744 - protein, 14 aa, Mycobacterium tuberculosis
GLTSPGLTDPALTS

SEQ ID NO: 106745 - protein, 14 aa, Mycobacterium tuberculosis
LTSPGLTDPALTSP

SEQ ID NO: 106746 - protein, 14 aa, Mycobacterium tuberculosis
TSPGLTDPALTSPG

SEQ ID NO: 106747 - protein, 14 aa, Mycobacterium tuberculosis
SPGLTDPALTSPGL

SEQ ID NO: 106748 - protein, 14 aa, Mycobacterium tuberculosis
PGLTDPALTSPGLT

SEQ ID NO: 106749 - protein, 14 aa, Mycobacterium tuberculosis
GLTDPALTSPGLTP

SEQ ID NO: 106750 - protein, 14 aa, Mycobacterium tuberculosis
LTDPALTSPGLTPT

SEQ ID NO: 106751 - protein, 14 aa, Mycobacterium tuberculosis
TDPALTSPGLTPTL

SEQ ID NO: 106752 - protein, 14 aa, Mycobacterium tuberculosis
DPALTSPGLTPTLP

SEQ ID NO: 106753 - protein, 14 aa, Mycobacterium tuberculosis
PALTSPGLTPTLPG

SEQ ID NO: 106754 - protein, 14 aa, Mycobacterium tuberculosis
ALTSPGLTPTLPGS

SEQ ID NO: 106755 - protein, 14 aa, Mycobacterium tuberculosis
LTSPGLTPTLPGSL

SEQ ID NO: 106756 - protein, 14 aa, Mycobacterium tuberculosis
TSPGLTPTLPGSLA

SEQ ID NO: 106757 - protein, 14 aa, Mycobacterium tuberculosis
SPGLTPTLPGSLAA

SEQ ID NO: 106758 - protein, 14 aa, Mycobacterium tuberculosis
PGLTPTLPGSLAAP

SEQ ID NO: 106759 - protein, 14 aa, Mycobacterium tuberculosis
GLTPTLPGSLAAPG

SEQ ID NO: 106760 - protein, 14 aa, Mycobacterium tuberculosis
LTPTLPGSLAAPGT

SEQ ID NO: 106761 - protein, 14 aa, Mycobacterium tuberculosis
TPTLPGSLAAPGTT

SEQ ID NO: 106762 - protein, 14 aa, Mycobacterium tuberculosis
PTLPGSLAAPGTTL

SEQ ID NO: 106763 - protein, 14 aa, Mycobacterium tuberculosis
TLPGSLAAPGTTLA

SEQ ID NO: 106764 - protein, 14 aa, Mycobacterium tuberculosis
LPGSLAAPGTTLAP

SEQ ID NO: 106765 - protein, 14 aa, Mycobacterium tuberculosis
PGSLAAPGTTLAPT

SEQ ID NO: 106766 - protein, 14 aa, Mycobacterium tuberculosis
GSLAAPGTTLAPTP

SEQ ID NO: 106767 - protein, 14 aa, Mycobacterium tuberculosis
SLAAPGTTLAPTPG

SEQ ID NO: 106768 - protein, 14 aa, Mycobacterium tuberculosis
LAAPGTTLAPTPGV

SEQ ID NO: 106769 - protein, 14 aa, Mycobacterium tuberculosis
AAPGTTLAPTPGVG

SEQ ID NO: 106770 - protein, 14 aa, Mycobacterium tuberculosis
APGTTLAPTPGVGA

SEQ ID NO: 106771 - protein, 14 aa, Mycobacterium tuberculosis
PGTTLAPTPGVGAN

SEQ ID NO: 106772 - protein, 14 aa, Mycobacterium tuberculosis
GTTLAPTPGVGANP

SEQ ID NO: 106773 - protein, 14 aa, Mycobacterium tuberculosis
TTLAPTPGVGANPA

SEQ ID NO: 106774 - protein, 14 aa, Mycobacterium tuberculosis
TLAPTPGVGANPAL

SEQ ID NO: 106775 - protein, 14 aa, Mycobacterium tuberculosis
LAPTPGVGANPALT

SEQ ID NO: 106776 - protein, 14 aa, Mycobacterium tuberculosis
APTPGVGANPALTN

SEQ ID NO: 106777 - protein, 14 aa, Mycobacterium tuberculosis
PTPGVGANPALTNP

SEQ ID NO: 106778 - protein, 14 aa, Mycobacterium tuberculosis
TPGVGANPALTNPA

SEQ ID NO: 106779 - protein, 14 aa, Mycobacterium tuberculosis
PGVGANPALTNPAL

SEQ ID NO: 106780 - protein, 14 aa, Mycobacterium tuberculosis
GVGANPALTNPALT

SEQ ID NO: 106781 - protein, 14 aa, Mycobacterium tuberculosis
VGANPALTNPALTS

SEQ ID NO: 106782 - protein, 14 aa, Mycobacterium tuberculosis
GANPALTNPALTSP

SEQ ID NO: 106783 - protein, 14 aa, Mycobacterium tuberculosis
ANPALTNPALTSPT

SEQ ID NO: 106784 - protein, 14 aa, Mycobacterium tuberculosis
NPALTNPALTSPTG

SEQ ID NO: 106785 - protein, 14 aa, Mycobacterium tuberculosis
PALTNPALTSPTGA

SEQ ID NO: 106786 - protein, 14 aa, Mycobacterium tuberculosis
ALTNPALTSPTGAT

SEQ ID NO: 106787 - protein, 14 aa, Mycobacterium tuberculosis
LTNPALTSPTGATP

SEQ ID NO: 106788 - protein, 14 aa, Mycobacterium tuberculosis
TNPALTSPTGATPG

SEQ ID NO: 106789 - protein, 14 aa, Mycobacterium tuberculosis
NPALTSPTGATPGL

SEQ ID NO: 106790 - protein, 14 aa, Mycobacterium tuberculosis
PALTSPTGATPGLT

SEQ ID NO: 106791 - protein, 14 aa, Mycobacterium tuberculosis
ALTSPTGATPGLTS

SEQ ID NO: 106792 - protein, 14 aa, Mycobacterium tuberculosis
LTSPTGATPGLTSP

SEQ ID NO: 106793 - protein, 14 aa, Mycobacterium tuberculosis
TSPTGATPGLTSPT

SEQ ID NO: 106794 - protein, 14 aa, Mycobacterium tuberculosis
SPTGATPGLTSPTG

SEQ ID NO: 106795 - protein, 14 aa, Mycobacterium tuberculosis
PTGATPGLTSPTGL

SEQ ID NO: 106796 - protein, 14 aa, Mycobacterium tuberculosis
TGATPGLTSPTGLD

SEQ ID NO: 106797 - protein, 14 aa, Mycobacterium tuberculosis
GATPGLTSPTGLDP

SEQ ID NO: 106798 - protein, 14 aa, Mycobacterium tuberculosis
ATPGLTSPTGLDPA

SEQ ID NO: 106799 - protein, 14 aa, Mycobacterium tuberculosis
TPGLTSPTGLDPAL

SEQ ID NO: 106800 - protein, 14 aa, Mycobacterium tuberculosis
PGLTSPTGLDPALG

SEQ ID NO: 106801 - protein, 14 aa, Mycobacterium tuberculosis
GLTSPTGLDPALGG

SEQ ID NO: 106802 - protein, 14 aa, Mycobacterium tuberculosis
LTSPTGLDPALGGA

SEQ ID NO: 106803 - protein, 14 aa, Mycobacterium tuberculosis
TSPTGLDPALGGAN

SEQ ID NO: 106804 - protein, 14 aa, Mycobacterium tuberculosis
SPTGLDPALGGANE

SEQ ID NO: 106805 - protein, 14 aa, Mycobacterium tuberculosis
PTGLDPALGGANEI

SEQ ID NO: 106806 - protein, 14 aa, Mycobacterium tuberculosis
TGLDPALGGANEIP

SEQ ID NO: 106807 - protein, 14 aa, Mycobacterium tuberculosis
GLDPALGGANEIPI

SEQ ID NO: 106808 - protein, 14 aa, Mycobacterium tuberculosis
LDPALGGANEIPIT

SEQ ID NO: 106809 - protein, 14 aa, Mycobacterium tuberculosis
DPALGGANEIPITT

SEQ ID NO: 106810 - protein, 14 aa, Mycobacterium tuberculosis
PALGGANEIPITTP

SEQ ID NO: 106811 - protein, 14 aa, Mycobacterium tuberculosis
ALGGANEIPITTPV

SEQ ID NO: 106812 - protein, 14 aa, Mycobacterium tuberculosis
LGGANEIPITTPVG

SEQ ID NO: 106813 - protein, 14 aa, Mycobacterium tuberculosis
GGANEIPITTPVGL

SEQ ID NO: 106814 - protein, 14 aa, Mycobacterium tuberculosis
GANEIPITTPVGLD

SEQ ID NO: 106815 - protein, 14 aa, Mycobacterium tuberculosis
ANEIPITTPVGLDP

SEQ ID NO: 106816 - protein, 14 aa, Mycobacterium tuberculosis
NEIPITTPVGLDPG

SEQ ID NO: 106817 - protein, 14 aa, Mycobacterium tuberculosis
EIPITTPVGLDPGA

SEQ ID NO: 106818 - protein, 14 aa, Mycobacterium tuberculosis
IPITTPVGLDPGAD

SEQ ID NO: 106819 - protein, 14 aa, Mycobacterium tuberculosis
PITTPVGLDPGADG

SEQ ID NO: 106820 - protein, 14 aa, Mycobacterium tuberculosis
ITTPVGLDPGADGT

SEQ ID NO: 106821 - protein, 14 aa, Mycobacterium tuberculosis
TTPVGLDPGADGTY

SEQ ID NO: 106822 - protein, 14 aa, Mycobacterium tuberculosis
TPVGLDPGADGTYP

SEQ ID NO: 106823 - protein, 14 aa, Mycobacterium tuberculosis
PVGLDPGADGTYPI

SEQ ID NO: 106824 - protein, 14 aa, Mycobacterium tuberculosis
VGLDPGADGTYPIL

SEQ ID NO: 106825 - protein, 14 aa, Mycobacterium tuberculosis
GLDPGADGTYPILG

SEQ ID NO: 106826 - protein, 14 aa, Mycobacterium tuberculosis
LDPGADGTYPILGD

SEQ ID NO: 106827 - protein, 14 aa, Mycobacterium tuberculosis
DPGADGTYPILGDP

SEQ ID NO: 106828 - protein, 14 aa, Mycobacterium tuberculosis
PGADGTYPILGDPT

SEQ ID NO: 106829 - protein, 14 aa, Mycobacterium tuberculosis
GADGTYPILGDPTL

SEQ ID NO: 106830 - protein, 14 aa, Mycobacterium tuberculosis
ADGTYPILGDPTLG

SEQ ID NO: 106831 - protein, 14 aa, Mycobacterium tuberculosis
DGTYPILGDPTLGT

SEQ ID NO: 106832 - protein, 14 aa, Mycobacterium tuberculosis
GTYPILGDPTLGTI

SEQ ID NO: 106833 - protein, 14 aa, Mycobacterium tuberculosis
TYPILGDPTLGTIP

SEQ ID NO: 106834 - protein, 14 aa, Mycobacterium tuberculosis
YPILGDPTLGTIPS

SEQ ID NO: 106835 - protein, 14 aa, Mycobacterium tuberculosis
PILGDPTLGTIPSS

SEQ ID NO: 106836 - protein, 14 aa, Mycobacterium tuberculosis
ILGDPTLGTIPSSP

SEQ ID NO: 106837 - protein, 14 aa, Mycobacterium tuberculosis
LGDPTLGTIPSSPA

SEQ ID NO: 106838 - protein, 14 aa, Mycobacterium tuberculosis
GDPTLGTIPSSPAT

SEQ ID NO: 106839 - protein, 14 aa, Mycobacterium tuberculosis
DPTLGTIPSSPATT

SEQ ID NO: 106840 - protein, 14 aa, Mycobacterium tuberculosis
PTLGTIPSSPATTS

SEQ ID NO: 106841 - protein, 14 aa, Mycobacterium tuberculosis
TLGTIPSSPATTST

SEQ ID NO: 106842 - protein, 14 aa, Mycobacterium tuberculosis
LGTIPSSPATTSTG

SEQ ID NO: 106843 - protein, 14 aa, Mycobacterium tuberculosis
GTIPSSPATTSTGG

SEQ ID NO: 106844 - protein, 14 aa, Mycobacterium tuberculosis
TIPSSPATTSTGGG

SEQ ID NO: 106845 - protein, 14 aa, Mycobacterium tuberculosis
IPSSPATTSTGGGG

SEQ ID NO: 106846 - protein, 14 aa, Mycobacterium tuberculosis
PSSPATTSTGGGGL

SEQ ID NO: 106847 - protein, 14 aa, Mycobacterium tuberculosis
SSPATTSTGGGGLV

SEQ ID NO: 106848 - protein, 14 aa, Mycobacterium tuberculosis
SPATTSTGGGGLVN

SEQ ID NO: 106849 - protein, 14 aa, Mycobacterium tuberculosis
PATTSTGGGGLVND

SEQ ID NO: 106850 - protein, 14 aa, Mycobacterium tuberculosis
ATTSTGGGGLVNDV

SEQ ID NO: 106851 - protein, 14 aa, Mycobacterium tuberculosis
TTSTGGGGLVNDVM

SEQ ID NO: 106852 - protein, 14 aa, Mycobacterium tuberculosis
TSTGGGGLVNDVMQ

SEQ ID NO: 106853 - protein, 14 aa, Mycobacterium tuberculosis
STGGGGLVNDVMQV

SEQ ID NO: 106854 - protein, 14 aa, Mycobacterium tuberculosis
TGGGGLVNDVMQVA

SEQ ID NO: 106855 - protein, 14 aa, Mycobacterium tuberculosis
GGGGLVNDVMQVAN

SEQ ID NO: 106856 - protein, 14 aa, Mycobacterium tuberculosis
GGGLVNDVMQVANE

SEQ ID NO: 106857 - protein, 14 aa, Mycobacterium tuberculosis
GGLVNDVMQVANEL

SEQ ID NO: 106858 - protein, 14 aa, Mycobacterium tuberculosis
GLVNDVMQVANELG

SEQ ID NO: 106859 - protein, 14 aa, Mycobacterium tuberculosis
LVNDVMQVANELGA

SEQ ID NO: 106860 - protein, 14 aa, Mycobacterium tuberculosis
VNDVMQVANELGAS

SEQ ID NO: 106861 - protein, 14 aa, Mycobacterium tuberculosis
NDVMQVANELGASQ

SEQ ID NO: 106862 - protein, 14 aa, Mycobacterium tuberculosis
DVMQVANELGASQA

SEQ ID NO: 106863 - protein, 14 aa, Mycobacterium tuberculosis
VMQVANELGASQAI

SEQ ID NO: 106864 - protein, 14 aa, Mycobacterium tuberculosis
MQVANELGASQAID

SEQ ID NO: 106865 - protein, 14 aa, Mycobacterium tuberculosis
QVANELGASQAIDL

SEQ ID NO: 106866 - protein, 14 aa, Mycobacterium tuberculosis
VANELGASQAIDLL

SEQ ID NO: 106867 - protein, 14 aa, Mycobacterium tuberculosis
ANELGASQAIDLLK

SEQ ID NO: 106868 - protein, 14 aa, Mycobacterium tuberculosis
NELGASQAIDLLKG

SEQ ID NO: 106869 - protein, 14 aa, Mycobacterium tuberculosis
ELGASQAIDLLKGV

SEQ ID NO: 106870 - protein, 14 aa, Mycobacterium tuberculosis
LGASQAIDLLKGVL

SEQ ID NO: 106871 - protein, 14 aa, Mycobacterium tuberculosis
GASQAIDLLKGVLM

SEQ ID NO: 106872 - protein, 14 aa, Mycobacterium tuberculosis
ASQAIDLLKGVLMP

SEQ ID NO: 106873 - protein, 14 aa, Mycobacterium tuberculosis
SQAIDLLKGVLMPS

SEQ ID NO: 106874 - protein, 14 aa, Mycobacterium tuberculosis
QAIDLLKGVLMPSI

SEQ ID NO: 106875 - protein, 14 aa, Mycobacterium tuberculosis
AIDLLKGVLMPSIM

SEQ ID NO: 106876 - protein, 14 aa, Mycobacterium tuberculosis
IDLLKGVLMPSIMQ

SEQ ID NO: 106877 - protein, 14 aa, Mycobacterium tuberculosis
DLLKGVLMPSIMQA

SEQ ID NO: 106878 - protein, 14 aa, Mycobacterium tuberculosis
LLKGVLMPSIMQAV

SEQ ID NO: 106879 - protein, 14 aa, Mycobacterium tuberculosis
LKGVLMPSIMQAVQ

SEQ ID NO: 106880 - protein, 14 aa, Mycobacterium tuberculosis
KGVLMPSIMQAVQN

SEQ ID NO: 106881 - protein, 14 aa, Mycobacterium tuberculosis
GVLMPSIMQAVQNG

SEQ ID NO: 106882 - protein, 14 aa, Mycobacterium tuberculosis
VLMPSIMQAVQNGG

SEQ ID NO: 106883 - protein, 14 aa, Mycobacterium tuberculosis
LMPSIMQAVQNGGA

SEQ ID NO: 106884 - protein, 14 aa, Mycobacterium tuberculosis
MPSIMQAVQNGGAA

SEQ ID NO: 106885 - protein, 14 aa, Mycobacterium tuberculosis
PSIMQAVQNGGAAA

SEQ ID NO: 106886 - protein, 14 aa, Mycobacterium tuberculosis
SIMQAVQNGGAAAP

SEQ ID NO: 106887 - protein, 14 aa, Mycobacterium tuberculosis
IMQAVQNGGAAAPA

SEQ ID NO: 106888 - protein, 14 aa, Mycobacterium tuberculosis
MQAVQNGGAAAPAA

SEQ ID NO: 106889 - protein, 14 aa, Mycobacterium tuberculosis
QAVQNGGAAAPAAS

SEQ ID NO: 106890 - protein, 14 aa, Mycobacterium tuberculosis
AVQNGGAAAPAASP

SEQ ID NO: 106891 - protein, 14 aa, Mycobacterium tuberculosis
VQNGGAAAPAASPP

SEQ ID NO: 106892 - protein, 14 aa, Mycobacterium tuberculosis
QNGGAAAPAASPPV

SEQ ID NO: 106893 - protein, 14 aa, Mycobacterium tuberculosis
NGGAAAPAASPPVP

SEQ ID NO: 106894 - protein, 14 aa, Mycobacterium tuberculosis
GGAAAPAASPPVPP

SEQ ID NO: 106895 - protein, 14 aa, Mycobacterium tuberculosis
GAAAPAASPPVPPI

SEQ ID NO: 106896 - protein, 14 aa, Mycobacterium tuberculosis
AAAPAASPPVPPIP

SEQ ID NO: 106897 - protein, 14 aa, Mycobacterium tuberculosis
AAPAASPPVPPIPA

SEQ ID NO: 106898 - protein, 14 aa, Mycobacterium tuberculosis
APAASPPVPPIPAA

SEQ ID NO: 106899 - protein, 14 aa, Mycobacterium tuberculosis
PAASPPVPPIPAAA

SEQ ID NO: 106900 - protein, 14 aa, Mycobacterium tuberculosis
AASPPVPPIPAAAA

SEQ ID NO: 106901 - protein, 14 aa, Mycobacterium tuberculosis
ASPPVPPIPAAAAV

SEQ ID NO: 106902 - protein, 14 aa, Mycobacterium tuberculosis
SPPVPPIPAAAAVP

SEQ ID NO: 106903 - protein, 14 aa, Mycobacterium tuberculosis
PPVPPIPAAAAVPP

SEQ ID NO: 106904 - protein, 14 aa, Mycobacterium tuberculosis
PVPPIPAAAAVPPT

SEQ ID NO: 106905 - protein, 14 aa, Mycobacterium tuberculosis
VPPIPAAAAVPPTD

SEQ ID NO: 106906 - protein, 14 aa, Mycobacterium tuberculosis
PPIPAAAAVPPTDP

SEQ ID NO: 106907 - protein, 14 aa, Mycobacterium tuberculosis
PIPAAAAVPPTDPI

SEQ ID NO: 106908 - protein, 14 aa, Mycobacterium tuberculosis
IPAAAAVPPTDPIT

SEQ ID NO: 106909 - protein, 14 aa, Mycobacterium tuberculosis
PAAAAVPPTDPITV

SEQ ID NO: 106910 - protein, 14 aa, Mycobacterium tuberculosis
AAAAVPPTDPITVP

SEQ ID NO: 106911 - protein, 14 aa, Mycobacterium tuberculosis
AAAVPPTDPITVPV

SEQ ID NO: 106912 - protein, 14 aa, Mycobacterium tuberculosis
AAVPPTDPITVPVA

SEQ ID NO: 106913 - protein, 15 aa, Mycobacterium tuberculosis
MPNRRRRKLSTAMSA

SEQ ID NO: 106914 - protein, 15 aa, Mycobacterium tuberculosis
PNRRRRKLSTAMSAV

SEQ ID NO: 106915 - protein, 15 aa, Mycobacterium tuberculosis
NRRRRKLSTAMSAVA

SEQ ID NO: 106916 - protein, 15 aa, Mycobacterium tuberculosis
RRRRKLSTAMSAVAA

SEQ ID NO: 106917 - protein, 15 aa, Mycobacterium tuberculosis
RRRKLSTAMSAVAAL

SEQ ID NO: 106918 - protein, 15 aa, Mycobacterium tuberculosis
RRKLSTAMSAVAALA

SEQ ID NO: 106919 - protein, 15 aa, Mycobacterium tuberculosis
RKLSTAMSAVAALAV

SEQ ID NO: 106920 - protein, 15 aa, Mycobacterium tuberculosis
KLSTAMSAVAALAVA

SEQ ID NO: 106921 - protein, 15 aa, Mycobacterium tuberculosis
LSTAMSAVAALAVAS

SEQ ID NO: 106922 - protein, 15 aa, Mycobacterium tuberculosis
STAMSAVAALAVASP

SEQ ID NO: 106923 - protein, 15 aa, Mycobacterium tuberculosis
TAMSAVAALAVASPC

SEQ ID NO: 106924 - protein, 15 aa, Mycobacterium tuberculosis
AMSAVAALAVASPCA

SEQ ID NO: 106925 - protein, 15 aa, Mycobacterium tuberculosis
MSAVAALAVASPCAY

SEQ ID NO: 106926 - protein, 15 aa, Mycobacterium tuberculosis
SAVAALAVASPCAYF

SEQ ID NO: 106927 - protein, 15 aa, Mycobacterium tuberculosis
AVAALAVASPCAYFL

SEQ ID NO: 106928 - protein, 15 aa, Mycobacterium tuberculosis
VAALAVASPCAYFLV

SEQ ID NO: 106929 - protein, 15 aa, Mycobacterium tuberculosis
AALAVASPCAYFLVY

SEQ ID NO: 106930 - protein, 15 aa, Mycobacterium tuberculosis
ALAVASPCAYFLVYE

SEQ ID NO: 106931 - protein, 15 aa, Mycobacterium tuberculosis
LAVASPCAYFLVYES

SEQ ID NO: 106932 - protein, 15 aa, Mycobacterium tuberculosis
AVASPCAYFLVYEST

SEQ ID NO: 106933 - protein, 15 aa, Mycobacterium tuberculosis
VASPCAYFLVYESTE

SEQ ID NO: 106934 - protein, 15 aa, Mycobacterium tuberculosis
ASPCAYFLVYESTET

SEQ ID NO: 106935 - protein, 15 aa, Mycobacterium tuberculosis
SPCAYFLVYESTETT

SEQ ID NO: 106936 - protein, 15 aa, Mycobacterium tuberculosis
PCAYFLVYESTETTE

SEQ ID NO: 106937 - protein, 15 aa, Mycobacterium tuberculosis
CAYFLVYESTETTER

SEQ ID NO: 106938 - protein, 15 aa, Mycobacterium tuberculosis
AYFLVYESTETTERP

SEQ ID NO: 106939 - protein, 15 aa, Mycobacterium tuberculosis
YFLVYESTETTERPE

SEQ ID NO: 106940 - protein, 15 aa, Mycobacterium tuberculosis
FLVYESTETTERPEH

SEQ ID NO: 106941 - protein, 15 aa, Mycobacterium tuberculosis
LVYESTETTERPEHH

SEQ ID NO: 106942 - protein, 15 aa, Mycobacterium tuberculosis
VYESTETTERPEHHE

SEQ ID NO: 106943 - protein, 15 aa, Mycobacterium tuberculosis
YESTETTERPEHHEF

SEQ ID NO: 106944 - protein, 15 aa, Mycobacterium tuberculosis
ESTETTERPEHHEFK

SEQ ID NO: 106945 - protein, 15 aa, Mycobacterium tuberculosis
STETTERPEHHEFKQ

SEQ ID NO: 106946 - protein, 15 aa, Mycobacterium tuberculosis
TETTERPEHHEFKQA

SEQ ID NO: 106947 - protein, 15 aa, Mycobacterium tuberculosis
ETTERPEHHEFKQAA

SEQ ID NO: 106948 - protein, 15 aa, Mycobacterium tuberculosis
TTERPEHHEFKQAAV

SEQ ID NO: 106949 - protein, 15 aa, Mycobacterium tuberculosis
TERPEHHEFKQAAVL

SEQ ID NO: 106950 - protein, 15 aa, Mycobacterium tuberculosis
ERPEHHEFKQAAVLT

SEQ ID NO: 106951 - protein, 15 aa, Mycobacterium tuberculosis
RPEHHEFKQAAVLTD

SEQ ID NO: 106952 - protein, 15 aa, Mycobacterium tuberculosis
PEHHEFKQAAVLTDL

SEQ ID NO: 106953 - protein, 15 aa, Mycobacterium tuberculosis
EHHEFKQAAVLTDLP

SEQ ID NO: 106954 - protein, 15 aa, Mycobacterium tuberculosis
HHEFKQAAVLTDLPG

SEQ ID NO: 106955 - protein, 15 aa, Mycobacterium tuberculosis
HEFKQAAVLTDLPGE

SEQ ID NO: 106956 - protein, 15 aa, Mycobacterium tuberculosis
EFKQAAVLTDLPGEL

SEQ ID NO: 106957 - protein, 15 aa, Mycobacterium tuberculosis
FKQAAVLTDLPGELM

SEQ ID NO: 106958 - protein, 15 aa, Mycobacterium tuberculosis
KQAAVLTDLPGELMS

SEQ ID NO: 106959 - protein, 15 aa, Mycobacterium tuberculosis
QAAVLTDLPGELMSA

SEQ ID NO: 106960 - protein, 15 aa, Mycobacterium tuberculosis
AAVLTDLPGELMSAL

SEQ ID NO: 106961 - protein, 15 aa, Mycobacterium tuberculosis
AVLTDLPGELMSALS

SEQ ID NO: 106962 - protein, 15 aa, Mycobacterium tuberculosis
VLTDLPGELMSALSQ

SEQ ID NO: 106963 - protein, 15 aa, Mycobacterium tuberculosis
LTDLPGELMSALSQG

SEQ ID NO: 106964 - protein, 15 aa, Mycobacterium tuberculosis
TDLPGELMSALSQGL

SEQ ID NO: 106965 - protein, 15 aa, Mycobacterium tuberculosis
DLPGELMSALSQGLS

SEQ ID NO: 106966 - protein, 15 aa, Mycobacterium tuberculosis
LPGELMSALSQGLSQ

SEQ ID NO: 106967 - protein, 15 aa, Mycobacterium tuberculosis
PGELMSALSQGLSQF

SEQ ID NO: 106968 - protein, 15 aa, Mycobacterium tuberculosis
GELMSALSQGLSQFG

SEQ ID NO: 106969 - protein, 15 aa, Mycobacterium tuberculosis
ELMSALSQGLSQFGI

SEQ ID NO: 106970 - protein, 15 aa, Mycobacterium tuberculosis
LMSALSQGLSQFGIN

SEQ ID NO: 106971 - protein, 15 aa, Mycobacterium tuberculosis
MSALSQGLSQFGINI

SEQ ID NO: 106972 - protein, 15 aa, Mycobacterium tuberculosis
SALSQGLSQFGINIP

SEQ ID NO: 106973 - protein, 15 aa, Mycobacterium tuberculosis
ALSQGLSQFGINIPP

SEQ ID NO: 106974 - protein, 15 aa, Mycobacterium tuberculosis
LSQGLSQFGINIPPV

SEQ ID NO: 106975 - protein, 15 aa, Mycobacterium tuberculosis
SQGLSQFGINIPPVP

SEQ ID NO: 106976 - protein, 15 aa, Mycobacterium tuberculosis
QGLSQFGINIPPVPS

SEQ ID NO: 106977 - protein, 15 aa, Mycobacterium tuberculosis
GLSQFGINIPPVPSL

SEQ ID NO: 106978 - protein, 15 aa, Mycobacterium tuberculosis
LSQFGINIPPVPSLT

SEQ ID NO: 106979 - protein, 15 aa, Mycobacterium tuberculosis
SQFGINIPPVPSLTG

SEQ ID NO: 106980 - protein, 15 aa, Mycobacterium tuberculosis
QFGINIPPVPSLTGS

SEQ ID NO: 106981 - protein, 15 aa, Mycobacterium tuberculosis
FGINIPPVPSLTGSG

SEQ ID NO: 106982 - protein, 15 aa, Mycobacterium tuberculosis
GINIPPVPSLTGSGD

SEQ ID NO: 106983 - protein, 15 aa, Mycobacterium tuberculosis
INIPPVPSLTGSGDA

SEQ ID NO: 106984 - protein, 15 aa, Mycobacterium tuberculosis
NIPPVPSLTGSGDAS

SEQ ID NO: 106985 - protein, 15 aa, Mycobacterium tuberculosis
IPPVPSLTGSGDAST

SEQ ID NO: 106986 - protein, 15 aa, Mycobacterium tuberculosis
PPVPSLTGSGDASTG

SEQ ID NO: 106987 - protein, 15 aa, Mycobacterium tuberculosis
PVPSLTGSGDASTGL

SEQ ID NO: 106988 - protein, 15 aa, Mycobacterium tuberculosis
VPSLTGSGDASTGLT

SEQ ID NO: 106989 - protein, 15 aa, Mycobacterium tuberculosis
PSLTGSGDASTGLTG

SEQ ID NO: 106990 - protein, 15 aa, Mycobacterium tuberculosis
SLTGSGDASTGLTGP

SEQ ID NO: 106991 - protein, 15 aa, Mycobacterium tuberculosis
LTGSGDASTGLTGPG

SEQ ID NO: 106992 - protein, 15 aa, Mycobacterium tuberculosis
TGSGDASTGLTGPGL

SEQ ID NO: 106993 - protein, 15 aa, Mycobacterium tuberculosis
GSGDASTGLTGPGLT

SEQ ID NO: 106994 - protein, 15 aa, Mycobacterium tuberculosis
SGDASTGLTGPGLTS

SEQ ID NO: 106995 - protein, 15 aa, Mycobacterium tuberculosis
GDASTGLTGPGLTSP

SEQ ID NO: 106996 - protein, 15 aa, Mycobacterium tuberculosis
DASTGLTGPGLTSPG

SEQ ID NO: 106997 - protein, 15 aa, Mycobacterium tuberculosis
ASTGLTGPGLTSPGL

SEQ ID NO: 106998 - protein, 15 aa, Mycobacterium tuberculosis
STGLTGPGLTSPGLT

SEQ ID NO: 106999 - protein, 15 aa, Mycobacterium tuberculosis
TGLTGPGLTSPGLTS

SEQ ID NO: 107000 - protein, 15 aa, Mycobacterium tuberculosis
GLTGPGLTSPGLTSP

SEQ ID NO: 107001 - protein, 15 aa, Mycobacterium tuberculosis
LTGPGLTSPGLTSPG

SEQ ID NO: 107002 - protein, 15 aa, Mycobacterium tuberculosis
TGPGLTSPGLTSPGL

SEQ ID NO: 107003 - protein, 15 aa, Mycobacterium tuberculosis
GPGLTSPGLTSPGLT

SEQ ID NO: 107004 - protein, 15 aa, Mycobacterium tuberculosis
PGLTSPGLTSPGLTS

SEQ ID NO: 107005 - protein, 15 aa, Mycobacterium tuberculosis
GLTSPGLTSPGLTSP

SEQ ID NO: 107006 - protein, 15 aa, Mycobacterium tuberculosis
LTSPGLTSPGLTSPG

SEQ ID NO: 107007 - protein, 15 aa, Mycobacterium tuberculosis
TSPGLTSPGLTSPGL

SEQ ID NO: 107008 - protein, 15 aa, Mycobacterium tuberculosis
SPGLTSPGLTSPGLT

SEQ ID NO: 107009 - protein, 15 aa, Mycobacterium tuberculosis
PGLTSPGLTSPGLTD

SEQ ID NO: 107010 - protein, 15 aa, Mycobacterium tuberculosis
GLTSPGLTSPGLTDP

SEQ ID NO: 107011 - protein, 15 aa, Mycobacterium tuberculosis
LTSPGLTSPGLTDPA

SEQ ID NO: 107012 - protein, 15 aa, Mycobacterium tuberculosis
TSPGLTSPGLTDPAL

SEQ ID NO: 107013 - protein, 15 aa, Mycobacterium tuberculosis
SPGLTSPGLTDPALT

SEQ ID NO: 107014 - protein, 15 aa, Mycobacterium tuberculosis
PGLTSPGLTDPALTS

SEQ ID NO: 107015 - protein, 15 aa, Mycobacterium tuberculosis
GLTSPGLTDPALTSP

SEQ ID NO: 107016 - protein, 15 aa, Mycobacterium tuberculosis
LTSPGLTDPALTSPG

SEQ ID NO: 107017 - protein, 15 aa, Mycobacterium tuberculosis
TSPGLTDPALTSPGL

SEQ ID NO: 107018 - protein, 15 aa, Mycobacterium tuberculosis
SPGLTDPALTSPGLT

SEQ ID NO: 107019 - protein, 15 aa, Mycobacterium tuberculosis
PGLTDPALTSPGLTP

SEQ ID NO: 107020 - protein, 15 aa, Mycobacterium tuberculosis
GLTDPALTSPGLTPT

SEQ ID NO: 107021 - protein, 15 aa, Mycobacterium tuberculosis
LTDPALTSPGLTPTL

SEQ ID NO: 107022 - protein, 15 aa, Mycobacterium tuberculosis
TDPALTSPGLTPTLP

SEQ ID NO: 107023 - protein, 15 aa, Mycobacterium tuberculosis
DPALTSPGLTPTLPG

SEQ ID NO: 107024 - protein, 15 aa, Mycobacterium tuberculosis
PALTSPGLTPTLPGS

SEQ ID NO: 107025 - protein, 15 aa, Mycobacterium tuberculosis
ALTSPGLTPTLPGSL

SEQ ID NO: 107026 - protein, 15 aa, Mycobacterium tuberculosis
LTSPGLTPTLPGSLA

SEQ ID NO: 107027 - protein, 15 aa, Mycobacterium tuberculosis
TSPGLTPTLPGSLAA

SEQ ID NO: 107028 - protein, 15 aa, Mycobacterium tuberculosis
SPGLTPTLPGSLAAP

SEQ ID NO: 107029 - protein, 15 aa, Mycobacterium tuberculosis
PGLTPTLPGSLAAPG

SEQ ID NO: 107030 - protein, 15 aa, Mycobacterium tuberculosis
GLTPTLPGSLAAPGT

SEQ ID NO: 107031 - protein, 15 aa, Mycobacterium tuberculosis
LTPTLPGSLAAPGTT

SEQ ID NO: 107032 - protein, 15 aa, Mycobacterium tuberculosis
TPTLPGSLAAPGTTL

SEQ ID NO: 107033 - protein, 15 aa, Mycobacterium tuberculosis
PTLPGSLAAPGTTLA

SEQ ID NO: 107034 - protein, 15 aa, Mycobacterium tuberculosis
TLPGSLAAPGTTLAP

SEQ ID NO: 107035 - protein, 15 aa, Mycobacterium tuberculosis
LPGSLAAPGTTLAPT

SEQ ID NO: 107036 - protein, 15 aa, Mycobacterium tuberculosis
PGSLAAPGTTLAPTP

SEQ ID NO: 107037 - protein, 15 aa, Mycobacterium tuberculosis
GSLAAPGTTLAPTPG

SEQ ID NO: 107038 - protein, 15 aa, Mycobacterium tuberculosis
SLAAPGTTLAPTPGV

SEQ ID NO: 107039 - protein, 15 aa, Mycobacterium tuberculosis
LAAPGTTLAPTPGVG

SEQ ID NO: 107040 - protein, 15 aa, Mycobacterium tuberculosis
AAPGTTLAPTPGVGA

SEQ ID NO: 107041 - protein, 15 aa, Mycobacterium tuberculosis
APGTTLAPTPGVGAN

SEQ ID NO: 107042 - protein, 15 aa, Mycobacterium tuberculosis
PGTTLAPTPGVGANP

SEQ ID NO: 107043 - protein, 15 aa, Mycobacterium tuberculosis
GTTLAPTPGVGANPA

SEQ ID NO: 107044 - protein, 15 aa, Mycobacterium tuberculosis
TTLAPTPGVGANPAL

SEQ ID NO: 107045 - protein, 15 aa, Mycobacterium tuberculosis
TLAPTPGVGANPALT

SEQ ID NO: 107046 - protein, 15 aa, Mycobacterium tuberculosis
LAPTPGVGANPALTN

SEQ ID NO: 107047 - protein, 15 aa, Mycobacterium tuberculosis
APTPGVGANPALTNP

SEQ ID NO: 107048 - protein, 15 aa, Mycobacterium tuberculosis
PTPGVGANPALTNPA

SEQ ID NO: 107049 - protein, 15 aa, Mycobacterium tuberculosis
TPGVGANPALTNPAL

SEQ ID NO: 107050 - protein, 15 aa, Mycobacterium tuberculosis
PGVGANPALTNPALT

SEQ ID NO: 107051 - protein, 15 aa, Mycobacterium tuberculosis
GVGANPALTNPALTS

SEQ ID NO: 107052 - protein, 15 aa, Mycobacterium tuberculosis
VGANPALTNPALTSP

SEQ ID NO: 107053 - protein, 15 aa, Mycobacterium tuberculosis
GANPALTNPALTSPT

SEQ ID NO: 107054 - protein, 15 aa, Mycobacterium tuberculosis
ANPALTNPALTSPTG

SEQ ID NO: 107055 - protein, 15 aa, Mycobacterium tuberculosis
NPALTNPALTSPTGA

SEQ ID NO: 107056 - protein, 15 aa, Mycobacterium tuberculosis
PALTNPALTSPTGAT

SEQ ID NO: 107057 - protein, 15 aa, Mycobacterium tuberculosis
ALTNPALTSPTGATP

SEQ ID NO: 107058 - protein, 15 aa, Mycobacterium tuberculosis
LTNPALTSPTGATPG

SEQ ID NO: 107059 - protein, 15 aa, Mycobacterium tuberculosis
TNPALTSPTGATPGL

SEQ ID NO: 107060 - protein, 15 aa, Mycobacterium tuberculosis
NPALTSPTGATPGLT

SEQ ID NO: 107061 - protein, 15 aa, Mycobacterium tuberculosis
PALTSPTGATPGLTS

SEQ ID NO: 107062 - protein, 15 aa, Mycobacterium tuberculosis
ALTSPTGATPGLTSP

SEQ ID NO: 107063 - protein, 15 aa, Mycobacterium tuberculosis
LTSPTGATPGLTSPT

SEQ ID NO: 107064 - protein, 15 aa, Mycobacterium tuberculosis
TSPTGATPGLTSPTG

SEQ ID NO: 107065 - protein, 15 aa, Mycobacterium tuberculosis
SPTGATPGLTSPTGL

SEQ ID NO: 107066 - protein, 15 aa, Mycobacterium tuberculosis
PTGATPGLTSPTGLD

SEQ ID NO: 107067 - protein, 15 aa, Mycobacterium tuberculosis
TGATPGLTSPTGLDP

SEQ ID NO: 107068 - protein, 15 aa, Mycobacterium tuberculosis
GATPGLTSPTGLDPA

SEQ ID NO: 107069 - protein, 15 aa, Mycobacterium tuberculosis
ATPGLTSPTGLDPAL

SEQ ID NO: 107070 - protein, 15 aa, Mycobacterium tuberculosis
TPGLTSPTGLDPALG

SEQ ID NO: 107071 - protein, 15 aa, Mycobacterium tuberculosis
PGLTSPTGLDPALGG

SEQ ID NO: 107072 - protein, 15 aa, Mycobacterium tuberculosis
GLTSPTGLDPALGGA

SEQ ID NO: 107073 - protein, 15 aa, Mycobacterium tuberculosis
LTSPTGLDPALGGAN

SEQ ID NO: 107074 - protein, 15 aa, Mycobacterium tuberculosis
TSPTGLDPALGGANE

SEQ ID NO: 107075 - protein, 15 aa, Mycobacterium tuberculosis
SPTGLDPALGGANEI

SEQ ID NO: 107076 - protein, 15 aa, Mycobacterium tuberculosis
PTGLDPALGGANEIP

SEQ ID NO: 107077 - protein, 15 aa, Mycobacterium tuberculosis
TGLDPALGGANEIPI

SEQ ID NO: 107078 - protein, 15 aa, Mycobacterium tuberculosis
GLDPALGGANEIPIT

SEQ ID NO: 107079 - protein, 15 aa, Mycobacterium tuberculosis
LDPALGGANEIPITT

SEQ ID NO: 107080 - protein, 15 aa, Mycobacterium tuberculosis
DPALGGANEIPITTP

SEQ ID NO: 107081 - protein, 15 aa, Mycobacterium tuberculosis
PALGGANEIPITTPV

SEQ ID NO: 107082 - protein, 15 aa, Mycobacterium tuberculosis
ALGGANEIPITTPVG

SEQ ID NO: 107083 - protein, 15 aa, Mycobacterium tuberculosis
LGGANEIPITTPVGL

SEQ ID NO: 107084 - protein, 15 aa, Mycobacterium tuberculosis
GGANEIPITTPVGLD

SEQ ID NO: 107085 - protein, 15 aa, Mycobacterium tuberculosis
GANEIPITTPVGLDP

SEQ ID NO: 107086 - protein, 15 aa, Mycobacterium tuberculosis
ANEIPITTPVGLDPG

SEQ ID NO: 107087 - protein, 15 aa, Mycobacterium tuberculosis
NEIPITTPVGLDPGA

SEQ ID NO: 107088 - protein, 15 aa, Mycobacterium tuberculosis
EIPITTPVGLDPGAD

SEQ ID NO: 107089 - protein, 15 aa, Mycobacterium tuberculosis
IPITTPVGLDPGADG

SEQ ID NO: 107090 - protein, 15 aa, Mycobacterium tuberculosis
PITTPVGLDPGADGT

SEQ ID NO: 107091 - protein, 15 aa, Mycobacterium tuberculosis
ITTPVGLDPGADGTY

SEQ ID NO: 107092 - protein, 15 aa, Mycobacterium tuberculosis
TTPVGLDPGADGTYP

SEQ ID NO: 107093 - protein, 15 aa, Mycobacterium tuberculosis
TPVGLDPGADGTYPI

SEQ ID NO: 107094 - protein, 15 aa, Mycobacterium tuberculosis
PVGLDPGADGTYPIL

SEQ ID NO: 107095 - protein, 15 aa, Mycobacterium tuberculosis
VGLDPGADGTYPILG

SEQ ID NO: 107096 - protein, 15 aa, Mycobacterium tuberculosis
GLDPGADGTYPILGD

SEQ ID NO: 107097 - protein, 15 aa, Mycobacterium tuberculosis
LDPGADGTYPILGDP

SEQ ID NO: 107098 - protein, 15 aa, Mycobacterium tuberculosis
DPGADGTYPILGDPT

SEQ ID NO: 107099 - protein, 15 aa, Mycobacterium tuberculosis
PGADGTYPILGDPTL

SEQ ID NO: 107100 - protein, 15 aa, Mycobacterium tuberculosis
GADGTYPILGDPTLG

SEQ ID NO: 107101 - protein, 15 aa, Mycobacterium tuberculosis
ADGTYPILGDPTLGT

SEQ ID NO: 107102 - protein, 15 aa, Mycobacterium tuberculosis
DGTYPILGDPTLGTI

SEQ ID NO: 107103 - protein, 15 aa, Mycobacterium tuberculosis
GTYPILGDPTLGTIP

SEQ ID NO: 107104 - protein, 15 aa, Mycobacterium tuberculosis
TYPILGDPTLGTIPS

SEQ ID NO: 107105 - protein, 15 aa, Mycobacterium tuberculosis
YPILGDPTLGTIPSS

SEQ ID NO: 107106 - protein, 15 aa, Mycobacterium tuberculosis
PILGDPTLGTIPSSP

SEQ ID NO: 107107 - protein, 15 aa, Mycobacterium tuberculosis
ILGDPTLGTIPSSPA

SEQ ID NO: 107108 - protein, 15 aa, Mycobacterium tuberculosis
LGDPTLGTIPSSPAT

SEQ ID NO: 107109 - protein, 15 aa, Mycobacterium tuberculosis
GDPTLGTIPSSPATT

SEQ ID NO: 107110 - protein, 15 aa, Mycobacterium tuberculosis
DPTLGTIPSSPATTS

SEQ ID NO: 107111 - protein, 15 aa, Mycobacterium tuberculosis
PTLGTIPSSPATTST

SEQ ID NO: 107112 - protein, 15 aa, Mycobacterium tuberculosis
TLGTIPSSPATTSTG

SEQ ID NO: 107113 - protein, 15 aa, Mycobacterium tuberculosis
LGTIPSSPATTSTGG

SEQ ID NO: 107114 - protein, 15 aa, Mycobacterium tuberculosis
GTIPSSPATTSTGGG

SEQ ID NO: 107115 - protein, 15 aa, Mycobacterium tuberculosis
TIPSSPATTSTGGGG

SEQ ID NO: 107116 - protein, 15 aa, Mycobacterium tuberculosis
IPSSPATTSTGGGGL

SEQ ID NO: 107117 - protein, 15 aa, Mycobacterium tuberculosis
PSSPATTSTGGGGLV

SEQ ID NO: 107118 - protein, 15 aa, Mycobacterium tuberculosis
SSPATTSTGGGGLVN

SEQ ID NO: 107119 - protein, 15 aa, Mycobacterium tuberculosis
SPATTSTGGGGLVND

SEQ ID NO: 107120 - protein, 15 aa, Mycobacterium tuberculosis
PATTSTGGGGLVNDV

SEQ ID NO: 107121 - protein, 15 aa, Mycobacterium tuberculosis
ATTSTGGGGLVNDVM

SEQ ID NO: 107122 - protein, 15 aa, Mycobacterium tuberculosis
TTSTGGGGLVNDVMQ

SEQ ID NO: 107123 - protein, 15 aa, Mycobacterium tuberculosis
TSTGGGGLVNDVMQV

SEQ ID NO: 107124 - protein, 15 aa, Mycobacterium tuberculosis
STGGGGLVNDVMQVA

SEQ ID NO: 107125 - protein, 15 aa, Mycobacterium tuberculosis
TGGGGLVNDVMQVAN

SEQ ID NO: 107126 - protein, 15 aa, Mycobacterium tuberculosis
GGGGLVNDVMQVANE

SEQ ID NO: 107127 - protein, 15 aa, Mycobacterium tuberculosis
GGGLVNDVMQVANEL

SEQ ID NO: 107128 - protein, 15 aa, Mycobacterium tuberculosis
GGLVNDVMQVANELG

SEQ ID NO: 107129 - protein, 15 aa, Mycobacterium tuberculosis
GLVNDVMQVANELGA

SEQ ID NO: 107130 - protein, 15 aa, Mycobacterium tuberculosis
LVNDVMQVANELGAS

SEQ ID NO: 107131 - protein, 15 aa, Mycobacterium tuberculosis
VNDVMQVANELGASQ

SEQ ID NO: 107132 - protein, 15 aa, Mycobacterium tuberculosis
NDVMQVANELGASQA

SEQ ID NO: 107133 - protein, 15 aa, Mycobacterium tuberculosis
DVMQVANELGASQAI

SEQ ID NO: 107134 - protein, 15 aa, Mycobacterium tuberculosis
VMQVANELGASQAID

SEQ ID NO: 107135 - protein, 15 aa, Mycobacterium tuberculosis
MQVANELGASQAIDL

SEQ ID NO: 107136 - protein, 15 aa, Mycobacterium tuberculosis
QVANELGASQAIDLL

SEQ ID NO: 107137 - protein, 15 aa, Mycobacterium tuberculosis
VANELGASQAIDLLK

SEQ ID NO: 107138 - protein, 15 aa, Mycobacterium tuberculosis
ANELGASQAIDLLKG

SEQ ID NO: 107139 - protein, 15 aa, Mycobacterium tuberculosis
NELGASQAIDLLKGV

SEQ ID NO: 107140 - protein, 15 aa, Mycobacterium tuberculosis
ELGASQAIDLLKGVL

SEQ ID NO: 107141 - protein, 15 aa, Mycobacterium tuberculosis
LGASQAIDLLKGVLM

SEQ ID NO: 107142 - protein, 15 aa, Mycobacterium tuberculosis
GASQAIDLLKGVLMP

SEQ ID NO: 107143 - protein, 15 aa, Mycobacterium tuberculosis
ASQAIDLLKGVLMPS

SEQ ID NO: 107144 - protein, 15 aa, Mycobacterium tuberculosis
SQAIDLLKGVLMPSI

SEQ ID NO: 107145 - protein, 15 aa, Mycobacterium tuberculosis
QAIDLLKGVLMPSIM

SEQ ID NO: 107146 - protein, 15 aa, Mycobacterium tuberculosis
AIDLLKGVLMPSIMQ

SEQ ID NO: 107147 - protein, 15 aa, Mycobacterium tuberculosis
IDLLKGVLMPSIMQA

SEQ ID NO: 107148 - protein, 15 aa, Mycobacterium tuberculosis
DLLKGVLMPSIMQAV

SEQ ID NO: 107149 - protein, 15 aa, Mycobacterium tuberculosis
LLKGVLMPSIMQAVQ

SEQ ID NO: 107150 - protein, 15 aa, Mycobacterium tuberculosis
LKGVLMPSIMQAVQN

SEQ ID NO: 107151 - protein, 15 aa, Mycobacterium tuberculosis
KGVLMPSIMQAVQNG

SEQ ID NO: 107152 - protein, 15 aa, Mycobacterium tuberculosis
GVLMPSIMQAVQNGG

SEQ ID NO: 107153 - protein, 15 aa, Mycobacterium tuberculosis
VLMPSIMQAVQNGGA

SEQ ID NO: 107154 - protein, 15 aa, Mycobacterium tuberculosis
LMPSIMQAVQNGGAA

SEQ ID NO: 107155 - protein, 15 aa, Mycobacterium tuberculosis
MPSIMQAVQNGGAAA

SEQ ID NO: 107156 - protein, 15 aa, Mycobacterium tuberculosis
PSIMQAVQNGGAAAP

SEQ ID NO: 107157 - protein, 15 aa, Mycobacterium tuberculosis
SIMQAVQNGGAAAPA

SEQ ID NO: 107158 - protein, 15 aa, Mycobacterium tuberculosis
IMQAVQNGGAAAPAA

SEQ ID NO: 107159 - protein, 15 aa, Mycobacterium tuberculosis
MQAVQNGGAAAPAAS

SEQ ID NO: 107160 - protein, 15 aa, Mycobacterium tuberculosis
QAVQNGGAAAPAASP

SEQ ID NO: 107161 - protein, 15 aa, Mycobacterium tuberculosis
AVQNGGAAAPAASPP

SEQ ID NO: 107162 - protein, 15 aa, Mycobacterium tuberculosis
VQNGGAAAPAASPPV

SEQ ID NO: 107163 - protein, 15 aa, Mycobacterium tuberculosis
QNGGAAAPAASPPVP

SEQ ID NO: 107164 - protein, 15 aa, Mycobacterium tuberculosis
NGGAAAPAASPPVPP

SEQ ID NO: 107165 - protein, 15 aa, Mycobacterium tuberculosis
GGAAAPAASPPVPPI

SEQ ID NO: 107166 - protein, 15 aa, Mycobacterium tuberculosis
GAAAPAASPPVPPIP

SEQ ID NO: 107167 - protein, 15 aa, Mycobacterium tuberculosis
AAAPAASPPVPPIPA

SEQ ID NO: 107168 - protein, 15 aa, Mycobacterium tuberculosis
AAPAASPPVPPIPAA

SEQ ID NO: 107169 - protein, 15 aa, Mycobacterium tuberculosis
APAASPPVPPIPAAA

SEQ ID NO: 107170 - protein, 15 aa, Mycobacterium tuberculosis
PAASPPVPPIPAAAA

SEQ ID NO: 107171 - protein, 15 aa, Mycobacterium tuberculosis
AASPPVPPIPAAAAV

SEQ ID NO: 107172 - protein, 15 aa, Mycobacterium tuberculosis
ASPPVPPIPAAAAVP

SEQ ID NO: 107173 - protein, 15 aa, Mycobacterium tuberculosis
SPPVPPIPAAAAVPP

SEQ ID NO: 107174 - protein, 15 aa, Mycobacterium tuberculosis
PPVPPIPAAAAVPPT

SEQ ID NO: 107175 - protein, 15 aa, Mycobacterium tuberculosis
PVPPIPAAAAVPPTD

SEQ ID NO: 107176 - protein, 15 aa, Mycobacterium tuberculosis
VPPIPAAAAVPPTDP

SEQ ID NO: 107177 - protein, 15 aa, Mycobacterium tuberculosis
PPIPAAAAVPPTDPI

SEQ ID NO: 107178 - protein, 15 aa, Mycobacterium tuberculosis
PIPAAAAVPPTDPIT

SEQ ID NO: 107179 - protein, 15 aa, Mycobacterium tuberculosis
IPAAAAVPPTDPITV

SEQ ID NO: 107180 - protein, 15 aa, Mycobacterium tuberculosis
PAAAAVPPTDPITVP

SEQ ID NO: 107181 - protein, 15 aa, Mycobacterium tuberculosis
AAAAVPPTDPITVPV

SEQ ID NO: 107182 - protein, 15 aa, Mycobacterium tuberculosis
AAAVPPTDPITVPVA

SEQ ID NO: 107183 - protein, 16 aa, Mycobacterium tuberculosis
MPNRRRRKLSTAMSAV

SEQ ID NO: 107184 - protein, 16 aa, Mycobacterium tuberculosis
PNRRRRKLSTAMSAVA

SEQ ID NO: 107185 - protein, 16 aa, Mycobacterium tuberculosis
NRRRRKLSTAMSAVAA

SEQ ID NO: 107186 - protein, 16 aa, Mycobacterium tuberculosis
RRRRKLSTAMSAVAAL

SEQ ID NO: 107187 - protein, 16 aa, Mycobacterium tuberculosis
RRRKLSTAMSAVAALA

SEQ ID NO: 107188 - protein, 16 aa, Mycobacterium tuberculosis
RRKLSTAMSAVAALAV

SEQ ID NO: 107189 - protein, 16 aa, Mycobacterium tuberculosis
RKLSTAMSAVAALAVA

SEQ ID NO: 107190 - protein, 16 aa, Mycobacterium tuberculosis
KLSTAMSAVAALAVAS

SEQ ID NO: 107191 - protein, 16 aa, Mycobacterium tuberculosis
LSTAMSAVAALAVASP

SEQ ID NO: 107192 - protein, 16 aa, Mycobacterium tuberculosis
STAMSAVAALAVASPC

SEQ ID NO: 107193 - protein, 16 aa, Mycobacterium tuberculosis
TAMSAVAALAVASPCA

SEQ ID NO: 107194 - protein, 16 aa, Mycobacterium tuberculosis
AMSAVAALAVASPCAY

SEQ ID NO: 107195 - protein, 16 aa, Mycobacterium tuberculosis
MSAVAALAVASPCAYF

SEQ ID NO: 107196 - protein, 16 aa, Mycobacterium tuberculosis
SAVAALAVASPCAYFL

SEQ ID NO: 107197 - protein, 16 aa, Mycobacterium tuberculosis
AVAALAVASPCAYFLV

SEQ ID NO: 107198 - protein, 16 aa, Mycobacterium tuberculosis
VAALAVASPCAYFLVY

SEQ ID NO: 107199 - protein, 16 aa, Mycobacterium tuberculosis
AALAVASPCAYFLVYE

SEQ ID NO: 107200 - protein, 16 aa, Mycobacterium tuberculosis
ALAVASPCAYFLVYES

SEQ ID NO: 107201 - protein, 16 aa, Mycobacterium tuberculosis
LAVASPCAYFLVYEST

SEQ ID NO: 107202 - protein, 16 aa, Mycobacterium tuberculosis
AVASPCAYFLVYESTE

SEQ ID NO: 107203 - protein, 16 aa, Mycobacterium tuberculosis
VASPCAYFLVYESTET

SEQ ID NO: 107204 - protein, 16 aa, Mycobacterium tuberculosis
ASPCAYFLVYESTETT

SEQ ID NO: 107205 - protein, 16 aa, Mycobacterium tuberculosis
SPCAYFLVYESTETTE

SEQ ID NO: 107206 - protein, 16 aa, Mycobacterium tuberculosis
PCAYFLVYESTETTER

SEQ ID NO: 107207 - protein, 16 aa, Mycobacterium tuberculosis
CAYFLVYESTETTERP

SEQ ID NO: 107208 - protein, 16 aa, Mycobacterium tuberculosis
AYFLVYESTETTERPE

SEQ ID NO: 107209 - protein, 16 aa, Mycobacterium tuberculosis
YFLVYESTETTERPEH

SEQ ID NO: 107210 - protein, 16 aa, Mycobacterium tuberculosis
FLVYESTETTERPEHH

SEQ ID NO: 107211 - protein, 16 aa, Mycobacterium tuberculosis
LVYESTETTERPEHHE

SEQ ID NO: 107212 - protein, 16 aa, Mycobacterium tuberculosis
VYESTETTERPEHHEF

SEQ ID NO: 107213 - protein, 16 aa, Mycobacterium tuberculosis
YESTETTERPEHHEFK

SEQ ID NO: 107214 - protein, 16 aa, Mycobacterium tuberculosis
ESTETTERPEHHEFKQ

SEQ ID NO: 107215 - protein, 16 aa, Mycobacterium tuberculosis
STETTERPEHHEFKQA

SEQ ID NO: 107216 - protein, 16 aa, Mycobacterium tuberculosis
TETTERPEHHEFKQAA

SEQ ID NO: 107217 - protein, 16 aa, Mycobacterium tuberculosis
ETTERPEHHEFKQAAV

SEQ ID NO: 107218 - protein, 16 aa, Mycobacterium tuberculosis
TTERPEHHEFKQAAVL

SEQ ID NO: 107219 - protein, 16 aa, Mycobacterium tuberculosis
TERPEHHEFKQAAVLT

SEQ ID NO: 107220 - protein, 16 aa, Mycobacterium tuberculosis
ERPEHHEFKQAAVLTD

SEQ ID NO: 107221 - protein, 16 aa, Mycobacterium tuberculosis
RPEHHEFKQAAVLTDL

SEQ ID NO: 107222 - protein, 16 aa, Mycobacterium tuberculosis
PEHHEFKQAAVLTDLP

SEQ ID NO: 107223 - protein, 16 aa, Mycobacterium tuberculosis
EHHEFKQAAVLTDLPG

SEQ ID NO: 107224 - protein, 16 aa, Mycobacterium tuberculosis
HHEFKQAAVLTDLPGE

SEQ ID NO: 107225 - protein, 16 aa, Mycobacterium tuberculosis
HEFKQAAVLTDLPGEL

SEQ ID NO: 107226 - protein, 16 aa, Mycobacterium tuberculosis
EFKQAAVLTDLPGELM

SEQ ID NO: 107227 - protein, 16 aa, Mycobacterium tuberculosis
FKQAAVLTDLPGELMS

SEQ ID NO: 107228 - protein, 16 aa, Mycobacterium tuberculosis
KQAAVLTDLPGELMSA

SEQ ID NO: 107229 - protein, 16 aa, Mycobacterium tuberculosis
QAAVLTDLPGELMSAL

SEQ ID NO: 107230 - protein, 16 aa, Mycobacterium tuberculosis
AAVLTDLPGELMSALS

SEQ ID NO: 107231 - protein, 16 aa, Mycobacterium tuberculosis
AVLTDLPGELMSALSQ

SEQ ID NO: 107232 - protein, 16 aa, Mycobacterium tuberculosis
VLTDLPGELMSALSQG

SEQ ID NO: 107233 - protein, 16 aa, Mycobacterium tuberculosis
LTDLPGELMSALSQGL

SEQ ID NO: 107234 - protein, 16 aa, Mycobacterium tuberculosis
TDLPGELMSALSQGLS

SEQ ID NO: 107235 - protein, 16 aa, Mycobacterium tuberculosis
DLPGELMSALSQGLSQ

SEQ ID NO: 107236 - protein, 16 aa, Mycobacterium tuberculosis
LPGELMSALSQGLSQF

SEQ ID NO: 107237 - protein, 16 aa, Mycobacterium tuberculosis
PGELMSALSQGLSQFG

SEQ ID NO: 107238 - protein, 16 aa, Mycobacterium tuberculosis
GELMSALSQGLSQFGI

SEQ ID NO: 107239 - protein, 16 aa, Mycobacterium tuberculosis
ELMSALSQGLSQFGIN

SEQ ID NO: 107240 - protein, 16 aa, Mycobacterium tuberculosis
LMSALSQGLSQFGINI

SEQ ID NO: 107241 - protein, 16 aa, Mycobacterium tuberculosis
MSALSQGLSQFGINIP

SEQ ID NO: 107242 - protein, 16 aa, Mycobacterium tuberculosis
SALSQGLSQFGINIPP

SEQ ID NO: 107243 - protein, 16 aa, Mycobacterium tuberculosis
ALSQGLSQFGINIPPV

SEQ ID NO: 107244 - protein, 16 aa, Mycobacterium tuberculosis
LSQGLSQFGINIPPVP

SEQ ID NO: 107245 - protein, 16 aa, Mycobacterium tuberculosis
SQGLSQFGINIPPVPS

SEQ ID NO: 107246 - protein, 16 aa, Mycobacterium tuberculosis
QGLSQFGINIPPVPSL

SEQ ID NO: 107247 - protein, 16 aa, Mycobacterium tuberculosis
GLSQFGINIPPVPSLT

SEQ ID NO: 107248 - protein, 16 aa, Mycobacterium tuberculosis
LSQFGINIPPVPSLTG

SEQ ID NO: 107249 - protein, 16 aa, Mycobacterium tuberculosis
SQFGINIPPVPSLTGS

SEQ ID NO: 107250 - protein, 16 aa, Mycobacterium tuberculosis
QFGINIPPVPSLTGSG

SEQ ID NO: 107251 - protein, 16 aa, Mycobacterium tuberculosis
FGINIPPVPSLTGSGD

SEQ ID NO: 107252 - protein, 16 aa, Mycobacterium tuberculosis
GINIPPVPSLTGSGDA

SEQ ID NO: 107253 - protein, 16 aa, Mycobacterium tuberculosis
INIPPVPSLTGSGDAS

SEQ ID NO: 107254 - protein, 16 aa, Mycobacterium tuberculosis
NIPPVPSLTGSGDAST

SEQ ID NO: 107255 - protein, 16 aa, Mycobacterium tuberculosis
IPPVPSLTGSGDASTG

SEQ ID NO: 107256 - protein, 16 aa, Mycobacterium tuberculosis
PPVPSLTGSGDASTGL

SEQ ID NO: 107257 - protein, 16 aa, Mycobacterium tuberculosis
PVPSLTGSGDASTGLT

SEQ ID NO: 107258 - protein, 16 aa, Mycobacterium tuberculosis
VPSLTGSGDASTGLTG

SEQ ID NO: 107259 - protein, 16 aa, Mycobacterium tuberculosis
PSLTGSGDASTGLTGP

SEQ ID NO: 107260 - protein, 16 aa, Mycobacterium tuberculosis
SLTGSGDASTGLTGPG

SEQ ID NO: 107261 - protein, 16 aa, Mycobacterium tuberculosis
LTGSGDASTGLTGPGL

SEQ ID NO: 107262 - protein, 16 aa, Mycobacterium tuberculosis
TGSGDASTGLTGPGLT

SEQ ID NO: 107263 - protein, 16 aa, Mycobacterium tuberculosis
GSGDASTGLTGPGLTS

SEQ ID NO: 107264 - protein, 16 aa, Mycobacterium tuberculosis
SGDASTGLTGPGLTSP

SEQ ID NO: 107265 - protein, 16 aa, Mycobacterium tuberculosis
GDASTGLTGPGLTSPG

SEQ ID NO: 107266 - protein, 16 aa, Mycobacterium tuberculosis
DASTGLTGPGLTSPGL

SEQ ID NO: 107267 - protein, 16 aa, Mycobacterium tuberculosis
ASTGLTGPGLTSPGLT

SEQ ID NO: 107268 - protein, 16 aa, Mycobacterium tuberculosis
STGLTGPGLTSPGLTS

SEQ ID NO: 107269 - protein, 16 aa, Mycobacterium tuberculosis
TGLTGPGLTSPGLTSP

SEQ ID NO: 107270 - protein, 16 aa, Mycobacterium tuberculosis
GLTGPGLTSPGLTSPG

SEQ ID NO: 107271 - protein, 16 aa, Mycobacterium tuberculosis
LTGPGLTSPGLTSPGL

SEQ ID NO: 107272 - protein, 16 aa, Mycobacterium tuberculosis
TGPGLTSPGLTSPGLT

SEQ ID NO: 107273 - protein, 16 aa, Mycobacterium tuberculosis
GPGLTSPGLTSPGLTS

SEQ ID NO: 107274 - protein, 16 aa, Mycobacterium tuberculosis
PGLTSPGLTSPGLTSP

SEQ ID NO: 107275 - protein, 16 aa, Mycobacterium tuberculosis
GLTSPGLTSPGLTSPG

SEQ ID NO: 107276 - protein, 16 aa, Mycobacterium tuberculosis
LTSPGLTSPGLTSPGL

SEQ ID NO: 107277 - protein, 16 aa, Mycobacterium tuberculosis
TSPGLTSPGLTSPGLT

SEQ ID NO: 107278 - protein, 16 aa, Mycobacterium tuberculosis
SPGLTSPGLTSPGLTD

SEQ ID NO: 107279 - protein, 16 aa, Mycobacterium tuberculosis
PGLTSPGLTSPGLTDP

SEQ ID NO: 107280 - protein, 16 aa, Mycobacterium tuberculosis
GLTSPGLTSPGLTDPA

SEQ ID NO: 107281 - protein, 16 aa, Mycobacterium tuberculosis
LTSPGLTSPGLTDPAL

SEQ ID NO: 107282 - protein, 16 aa, Mycobacterium tuberculosis
TSPGLTSPGLTDPALT

SEQ ID NO: 107283 - protein, 16 aa, Mycobacterium tuberculosis
SPGLTSPGLTDPALTS

SEQ ID NO: 107284 - protein, 16 aa, Mycobacterium tuberculosis
PGLTSPGLTDPALTSP

SEQ ID NO: 107285 - protein, 16 aa, Mycobacterium tuberculosis
GLTSPGLTDPALTSPG

SEQ ID NO: 107286 - protein, 16 aa, Mycobacterium tuberculosis
LTSPGLTDPALTSPGL

SEQ ID NO: 107287 - protein, 16 aa, Mycobacterium tuberculosis
TSPGLTDPALTSPGLT

SEQ ID NO: 107288 - protein, 16 aa, Mycobacterium tuberculosis
SPGLTDPALTSPGLTP

SEQ ID NO: 107289 - protein, 16 aa, Mycobacterium tuberculosis
PGLTDPALTSPGLTPT

SEQ ID NO: 107290 - protein, 16 aa, Mycobacterium tuberculosis
GLTDPALTSPGLTPTL

SEQ ID NO: 107291 - protein, 16 aa, Mycobacterium tuberculosis
LTDPALTSPGLTPTLP

SEQ ID NO: 107292 - protein, 16 aa, Mycobacterium tuberculosis
TDPALTSPGLTPTLPG

SEQ ID NO: 107293 - protein, 16 aa, Mycobacterium tuberculosis
DPALTSPGLTPTLPGS

SEQ ID NO: 107294 - protein, 16 aa, Mycobacterium tuberculosis
PALTSPGLTPTLPGSL

SEQ ID NO: 107295 - protein, 16 aa, Mycobacterium tuberculosis
ALTSPGLTPTLPGSLA

SEQ ID NO: 107296 - protein, 16 aa, Mycobacterium tuberculosis
LTSPGLTPTLPGSLAA

SEQ ID NO: 107297 - protein, 16 aa, Mycobacterium tuberculosis
TSPGLTPTLPGSLAAP

SEQ ID NO: 107298 - protein, 16 aa, Mycobacterium tuberculosis
SPGLTPTLPGSLAAPG

SEQ ID NO: 107299 - protein, 16 aa, Mycobacterium tuberculosis
PGLTPTLPGSLAAPGT

SEQ ID NO: 107300 - protein, 16 aa, Mycobacterium tuberculosis
GLTPTLPGSLAAPGTT

SEQ ID NO: 107301 - protein, 16 aa, Mycobacterium tuberculosis
LTPTLPGSLAAPGTTL

SEQ ID NO: 107302 - protein, 16 aa, Mycobacterium tuberculosis
TPTLPGSLAAPGTTLA

SEQ ID NO: 107303 - protein, 16 aa, Mycobacterium tuberculosis
PTLPGSLAAPGTTLAP

SEQ ID NO: 107304 - protein, 16 aa, Mycobacterium tuberculosis
TLPGSLAAPGTTLAPT

SEQ ID NO: 107305 - protein, 16 aa, Mycobacterium tuberculosis
LPGSLAAPGTTLAPTP

SEQ ID NO: 107306 - protein, 16 aa, Mycobacterium tuberculosis
PGSLAAPGTTLAPTPG

SEQ ID NO: 107307 - protein, 16 aa, Mycobacterium tuberculosis
GSLAAPGTTLAPTPGV

SEQ ID NO: 107308 - protein, 16 aa, Mycobacterium tuberculosis
SLAAPGTTLAPTPGVG

SEQ ID NO: 107309 - protein, 16 aa, Mycobacterium tuberculosis
LAAPGTTLAPTPGVGA

SEQ ID NO: 107310 - protein, 16 aa, Mycobacterium tuberculosis
AAPGTTLAPTPGVGAN

SEQ ID NO: 107311 - protein, 16 aa, Mycobacterium tuberculosis
APGTTLAPTPGVGANP

SEQ ID NO: 107312 - protein, 16 aa, Mycobacterium tuberculosis
PGTTLAPTPGVGANPA

SEQ ID NO: 107313 - protein, 16 aa, Mycobacterium tuberculosis
GTTLAPTPGVGANPAL

SEQ ID NO: 107314 - protein, 16 aa, Mycobacterium tuberculosis
TTLAPTPGVGANPALT

SEQ ID NO: 107315 - protein, 16 aa, Mycobacterium tuberculosis
TLAPTPGVGANPALTN

SEQ ID NO: 107316 - protein, 16 aa, Mycobacterium tuberculosis
LAPTPGVGANPALTNP

SEQ ID NO: 107317 - protein, 16 aa, Mycobacterium tuberculosis
APTPGVGANPALTNPA

SEQ ID NO: 107318 - protein, 16 aa, Mycobacterium tuberculosis
PTPGVGANPALTNPAL

SEQ ID NO: 107319 - protein, 16 aa, Mycobacterium tuberculosis
TPGVGANPALTNPALT

SEQ ID NO: 107320 - protein, 16 aa, Mycobacterium tuberculosis
PGVGANPALTNPALTS

SEQ ID NO: 107321 - protein, 16 aa, Mycobacterium tuberculosis
GVGANPALTNPALTSP

SEQ ID NO: 107322 - protein, 16 aa, Mycobacterium tuberculosis
VGANPALTNPALTSPT

SEQ ID NO: 107323 - protein, 16 aa, Mycobacterium tuberculosis
GANPALTNPALTSPTG

SEQ ID NO: 107324 - protein, 16 aa, Mycobacterium tuberculosis
ANPALTNPALTSPTGA

SEQ ID NO: 107325 - protein, 16 aa, Mycobacterium tuberculosis
NPALTNPALTSPTGAT

SEQ ID NO: 107326 - protein, 16 aa, Mycobacterium tuberculosis
PALTNPALTSPTGATP

SEQ ID NO: 107327 - protein, 16 aa, Mycobacterium tuberculosis
ALTNPALTSPTGATPG

SEQ ID NO: 107328 - protein, 16 aa, Mycobacterium tuberculosis
LTNPALTSPTGATPGL

SEQ ID NO: 107329 - protein, 16 aa, Mycobacterium tuberculosis
TNPALTSPTGATPGLT

SEQ ID NO: 107330 - protein, 16 aa, Mycobacterium tuberculosis
NPALTSPTGATPGLTS

SEQ ID NO: 107331 - protein, 16 aa, Mycobacterium tuberculosis
PALTSPTGATPGLTSP

SEQ ID NO: 107332 - protein, 16 aa, Mycobacterium tuberculosis
ALTSPTGATPGLTSPT

SEQ ID NO: 107333 - protein, 16 aa, Mycobacterium tuberculosis
LTSPTGATPGLTSPTG

SEQ ID NO: 107334 - protein, 16 aa, Mycobacterium tuberculosis
TSPTGATPGLTSPTGL

SEQ ID NO: 107335 - protein, 16 aa, Mycobacterium tuberculosis
SPTGATPGLTSPTGLD

SEQ ID NO: 107336 - protein, 16 aa, Mycobacterium tuberculosis
PTGATPGLTSPTGLDP

SEQ ID NO: 107337 - protein, 16 aa, Mycobacterium tuberculosis
TGATPGLTSPTGLDPA

SEQ ID NO: 107338 - protein, 16 aa, Mycobacterium tuberculosis
GATPGLTSPTGLDPAL

SEQ ID NO: 107339 - protein, 16 aa, Mycobacterium tuberculosis
ATPGLTSPTGLDPALG

SEQ ID NO: 107340 - protein, 16 aa, Mycobacterium tuberculosis
TPGLTSPTGLDPALGG

SEQ ID NO: 107341 - protein, 16 aa, Mycobacterium tuberculosis
PGLTSPTGLDPALGGA

SEQ ID NO: 107342 - protein, 16 aa, Mycobacterium tuberculosis
GLTSPTGLDPALGGAN

SEQ ID NO: 107343 - protein, 16 aa, Mycobacterium tuberculosis
LTSPTGLDPALGGANE

SEQ ID NO: 107344 - protein, 16 aa, Mycobacterium tuberculosis
TSPTGLDPALGGANEI

SEQ ID NO: 107345 - protein, 16 aa, Mycobacterium tuberculosis
SPTGLDPALGGANEIP

SEQ ID NO: 107346 - protein, 16 aa, Mycobacterium tuberculosis
PTGLDPALGGANEIPI

SEQ ID NO: 107347 - protein, 16 aa, Mycobacterium tuberculosis
TGLDPALGGANEIPIT

SEQ ID NO: 107348 - protein, 16 aa, Mycobacterium tuberculosis
GLDPALGGANEIPITT

SEQ ID NO: 107349 - protein, 16 aa, Mycobacterium tuberculosis
LDPALGGANEIPITTP

SEQ ID NO: 107350 - protein, 16 aa, Mycobacterium tuberculosis
DPALGGANEIPITTPV

SEQ ID NO: 107351 - protein, 16 aa, Mycobacterium tuberculosis
PALGGANEIPITTPVG

SEQ ID NO: 107352 - protein, 16 aa, Mycobacterium tuberculosis
ALGGANEIPITTPVGL

SEQ ID NO: 107353 - protein, 16 aa, Mycobacterium tuberculosis
LGGANEIPITTPVGLD

SEQ ID NO: 107354 - protein, 16 aa, Mycobacterium tuberculosis
GGANEIPITTPVGLDP

SEQ ID NO: 107355 - protein, 16 aa, Mycobacterium tuberculosis
GANEIPITTPVGLDPG

SEQ ID NO: 107356 - protein, 16 aa, Mycobacterium tuberculosis
ANEIPITTPVGLDPGA

SEQ ID NO: 107357 - protein, 16 aa, Mycobacterium tuberculosis
NEIPITTPVGLDPGAD

SEQ ID NO: 107358 - protein, 16 aa, Mycobacterium tuberculosis
EIPITTPVGLDPGADG

SEQ ID NO: 107359 - protein, 16 aa, Mycobacterium tuberculosis
IPITTPVGLDPGADGT

SEQ ID NO: 107360 - protein, 16 aa, Mycobacterium tuberculosis
PITTPVGLDPGADGTY

SEQ ID NO: 107361 - protein, 16 aa, Mycobacterium tuberculosis
ITTPVGLDPGADGTYP

SEQ ID NO: 107362 - protein, 16 aa, Mycobacterium tuberculosis
TTPVGLDPGADGTYPI

SEQ ID NO: 107363 - protein, 16 aa, Mycobacterium tuberculosis
TPVGLDPGADGTYPIL

SEQ ID NO: 107364 - protein, 16 aa, Mycobacterium tuberculosis
PVGLDPGADGTYPILG

SEQ ID NO: 107365 - protein, 16 aa, Mycobacterium tuberculosis
VGLDPGADGTYPILGD

SEQ ID NO: 107366 - protein, 16 aa, Mycobacterium tuberculosis
GLDPGADGTYPILGDP

SEQ ID NO: 107367 - protein, 16 aa, Mycobacterium tuberculosis
LDPGADGTYPILGDPT

SEQ ID NO: 107368 - protein, 16 aa, Mycobacterium tuberculosis
DPGADGTYPILGDPTL

SEQ ID NO: 107369 - protein, 16 aa, Mycobacterium tuberculosis
PGADGTYPILGDPTLG

SEQ ID NO: 107370 - protein, 16 aa, Mycobacterium tuberculosis
GADGTYPILGDPTLGT

SEQ ID NO: 107371 - protein, 16 aa, Mycobacterium tuberculosis
ADGTYPILGDPTLGTI

SEQ ID NO: 107372 - protein, 16 aa, Mycobacterium tuberculosis
DGTYPILGDPTLGTIP

SEQ ID NO: 107373 - protein, 16 aa, Mycobacterium tuberculosis
GTYPILGDPTLGTIPS

SEQ ID NO: 107374 - protein, 16 aa, Mycobacterium tuberculosis
TYPILGDPTLGTIPSS

SEQ ID NO: 107375 - protein, 16 aa, Mycobacterium tuberculosis
YPILGDPTLGTIPSSP

SEQ ID NO: 107376 - protein, 16 aa, Mycobacterium tuberculosis
PILGDPTLGTIPSSPA

SEQ ID NO: 107377 - protein, 16 aa, Mycobacterium tuberculosis
ILGDPTLGTIPSSPAT

SEQ ID NO: 107378 - protein, 16 aa, Mycobacterium tuberculosis
LGDPTLGTIPSSPATT

SEQ ID NO: 107379 - protein, 16 aa, Mycobacterium tuberculosis
GDPTLGTIPSSPATTS

SEQ ID NO: 107380 - protein, 16 aa, Mycobacterium tuberculosis
DPTLGTIPSSPATTST

SEQ ID NO: 107381 - protein, 16 aa, Mycobacterium tuberculosis
PTLGTIPSSPATTSTG

SEQ ID NO: 107382 - protein, 16 aa, Mycobacterium tuberculosis
TLGTIPSSPATTSTGG

SEQ ID NO: 107383 - protein, 16 aa, Mycobacterium tuberculosis
LGTIPSSPATTSTGGG

SEQ ID NO: 107384 - protein, 16 aa, Mycobacterium tuberculosis
GTIPSSPATTSTGGGG

SEQ ID NO: 107385 - protein, 16 aa, Mycobacterium tuberculosis
TIPSSPATTSTGGGGL

SEQ ID NO: 107386 - protein, 16 aa, Mycobacterium tuberculosis
IPSSPATTSTGGGGLV

SEQ ID NO: 107387 - protein, 16 aa, Mycobacterium tuberculosis
PSSPATTSTGGGGLVN

SEQ ID NO: 107388 - protein, 16 aa, Mycobacterium tuberculosis
SSPATTSTGGGGLVND

SEQ ID NO: 107389 - protein, 16 aa, Mycobacterium tuberculosis
SPATTSTGGGGLVNDV

SEQ ID NO: 107390 - protein, 16 aa, Mycobacterium tuberculosis
PATTSTGGGGLVNDVM

SEQ ID NO: 107391 - protein, 16 aa, Mycobacterium tuberculosis
ATTSTGGGGLVNDVMQ

SEQ ID NO: 107392 - protein, 16 aa, Mycobacterium tuberculosis
TTSTGGGGLVNDVMQV

SEQ ID NO: 107393 - protein, 16 aa, Mycobacterium tuberculosis
TSTGGGGLVNDVMQVA

SEQ ID NO: 107394 - protein, 16 aa, Mycobacterium tuberculosis
STGGGGLVNDVMQVAN

SEQ ID NO: 107395 - protein, 16 aa, Mycobacterium tuberculosis
TGGGGLVNDVMQVANE

SEQ ID NO: 107396 - protein, 16 aa, Mycobacterium tuberculosis
GGGGLVNDVMQVANEL

SEQ ID NO: 107397 - protein, 16 aa, Mycobacterium tuberculosis
GGGLVNDVMQVANELG

SEQ ID NO: 107398 - protein, 16 aa, Mycobacterium tuberculosis
GGLVNDVMQVANELGA

SEQ ID NO: 107399 - protein, 16 aa, Mycobacterium tuberculosis
GLVNDVMQVANELGAS

SEQ ID NO: 107400 - protein, 16 aa, Mycobacterium tuberculosis
LVNDVMQVANELGASQ

SEQ ID NO: 107401 - protein, 16 aa, Mycobacterium tuberculosis
VNDVMQVANELGASQA

SEQ ID NO: 107402 - protein, 16 aa, Mycobacterium tuberculosis
NDVMQVANELGASQAI

SEQ ID NO: 107403 - protein, 16 aa, Mycobacterium tuberculosis
DVMQVANELGASQAID

SEQ ID NO: 107404 - protein, 16 aa, Mycobacterium tuberculosis
VMQVANELGASQAIDL

SEQ ID NO: 107405 - protein, 16 aa, Mycobacterium tuberculosis
MQVANELGASQAIDLL

SEQ ID NO: 107406 - protein, 16 aa, Mycobacterium tuberculosis
QVANELGASQAIDLLK

SEQ ID NO: 107407 - protein, 16 aa, Mycobacterium tuberculosis
VANELGASQAIDLLKG

SEQ ID NO: 107408 - protein, 16 aa, Mycobacterium tuberculosis
ANELGASQAIDLLKGV

SEQ ID NO: 107409 - protein, 16 aa, Mycobacterium tuberculosis
NELGASQAIDLLKGVL

SEQ ID NO: 107410 - protein, 16 aa, Mycobacterium tuberculosis
ELGASQAIDLLKGVLM

SEQ ID NO: 107411 - protein, 16 aa, Mycobacterium tuberculosis
LGASQAIDLLKGVLMP

SEQ ID NO: 107412 - protein, 16 aa, Mycobacterium tuberculosis
GASQAIDLLKGVLMPS

SEQ ID NO: 107413 - protein, 16 aa, Mycobacterium tuberculosis
ASQAIDLLKGVLMPSI

SEQ ID NO: 107414 - protein, 16 aa, Mycobacterium tuberculosis
SQAIDLLKGVLMPSIM

SEQ ID NO: 107415 - protein, 16 aa, Mycobacterium tuberculosis
QAIDLLKGVLMPSIMQ

SEQ ID NO: 107416 - protein, 16 aa, Mycobacterium tuberculosis
AIDLLKGVLMPSIMQA

SEQ ID NO: 107417 - protein, 16 aa, Mycobacterium tuberculosis
IDLLKGVLMPSIMQAV

SEQ ID NO: 107418 - protein, 16 aa, Mycobacterium tuberculosis
DLLKGVLMPSIMQAVQ

SEQ ID NO: 107419 - protein, 16 aa, Mycobacterium tuberculosis
LLKGVLMPSIMQAVQN

SEQ ID NO: 107420 - protein, 16 aa, Mycobacterium tuberculosis
LKGVLMPSIMQAVQNG

SEQ ID NO: 107421 - protein, 16 aa, Mycobacterium tuberculosis
KGVLMPSIMQAVQNGG

SEQ ID NO: 107422 - protein, 16 aa, Mycobacterium tuberculosis
GVLMPSIMQAVQNGGA

SEQ ID NO: 107423 - protein, 16 aa, Mycobacterium tuberculosis
VLMPSIMQAVQNGGAA

SEQ ID NO: 107424 - protein, 16 aa, Mycobacterium tuberculosis
LMPSIMQAVQNGGAAA

SEQ ID NO: 107425 - protein, 16 aa, Mycobacterium tuberculosis
MPSIMQAVQNGGAAAP

SEQ ID NO: 107426 - protein, 16 aa, Mycobacterium tuberculosis
PSIMQAVQNGGAAAPA

SEQ ID NO: 107427 - protein, 16 aa, Mycobacterium tuberculosis
SIMQAVQNGGAAAPAA

SEQ ID NO: 107428 - protein, 16 aa, Mycobacterium tuberculosis
IMQAVQNGGAAAPAAS

SEQ ID NO: 107429 - protein, 16 aa, Mycobacterium tuberculosis
MQAVQNGGAAAPAASP

SEQ ID NO: 107430 - protein, 16 aa, Mycobacterium tuberculosis
QAVQNGGAAAPAASPP

SEQ ID NO: 107431 - protein, 16 aa, Mycobacterium tuberculosis
AVQNGGAAAPAASPPV

SEQ ID NO: 107432 - protein, 16 aa, Mycobacterium tuberculosis
VQNGGAAAPAASPPVP

SEQ ID NO: 107433 - protein, 16 aa, Mycobacterium tuberculosis
QNGGAAAPAASPPVPP

SEQ ID NO: 107434 - protein, 16 aa, Mycobacterium tuberculosis
NGGAAAPAASPPVPPI

SEQ ID NO: 107435 - protein, 16 aa, Mycobacterium tuberculosis
GGAAAPAASPPVPPIP

SEQ ID NO: 107436 - protein, 16 aa, Mycobacterium tuberculosis
GAAAPAASPPVPPIPA

SEQ ID NO: 107437 - protein, 16 aa, Mycobacterium tuberculosis
AAAPAASPPVPPIPAA

SEQ ID NO: 107438 - protein, 16 aa, Mycobacterium tuberculosis
AAPAASPPVPPIPAAA

SEQ ID NO: 107439 - protein, 16 aa, Mycobacterium tuberculosis
APAASPPVPPIPAAAA

SEQ ID NO: 107440 - protein, 16 aa, Mycobacterium tuberculosis
PAASPPVPPIPAAAAV

SEQ ID NO: 107441 - protein, 16 aa, Mycobacterium tuberculosis
AASPPVPPIPAAAAVP

SEQ ID NO: 107442 - protein, 16 aa, Mycobacterium tuberculosis
ASPPVPPIPAAAAVPP

SEQ ID NO: 107443 - protein, 16 aa, Mycobacterium tuberculosis
SPPVPPIPAAAAVPPT

SEQ ID NO: 107444 - protein, 16 aa, Mycobacterium tuberculosis
PPVPPIPAAAAVPPTD

SEQ ID NO: 107445 - protein, 16 aa, Mycobacterium tuberculosis
PVPPIPAAAAVPPTDP

SEQ ID NO: 107446 - protein, 16 aa, Mycobacterium tuberculosis
VPPIPAAAAVPPTDPI

SEQ ID NO: 107447 - protein, 16 aa, Mycobacterium tuberculosis
PPIPAAAAVPPTDPIT

SEQ ID NO: 107448 - protein, 16 aa, Mycobacterium tuberculosis
PIPAAAAVPPTDPITV

SEQ ID NO: 107449 - protein, 16 aa, Mycobacterium tuberculosis
IPAAAAVPPTDPITVP

SEQ ID NO: 107450 - protein, 16 aa, Mycobacterium tuberculosis
PAAAAVPPTDPITVPV

SEQ ID NO: 107451 - protein, 16 aa, Mycobacterium tuberculosis
AAAAVPPTDPITVPVA

SEQ ID NO: 107452 - protein, 13 aa, Mycobacterium tuberculosis
MLWHAMPPELNTA

SEQ ID NO: 107453 - protein, 13 aa, Mycobacterium tuberculosis
LWHAMPPELNTAR

SEQ ID NO: 107454 - protein, 13 aa, Mycobacterium tuberculosis
WHAMPPELNTARL

SEQ ID NO: 107455 - protein, 13 aa, Mycobacterium tuberculosis
HAMPPELNTARLM

SEQ ID NO: 107456 - protein, 13 aa, Mycobacterium tuberculosis
AMPPELNTARLMA

SEQ ID NO: 107457 - protein, 13 aa, Mycobacterium tuberculosis
MPPELNTARLMAG

SEQ ID NO: 107458 - protein, 13 aa, Mycobacterium tuberculosis
PPELNTARLMAGA

SEQ ID NO: 107459 - protein, 13 aa, Mycobacterium tuberculosis
PELNTARLMAGAG

SEQ ID NO: 107460 - protein, 13 aa, Mycobacterium tuberculosis
ELNTARLMAGAGP

SEQ ID NO: 107461 - protein, 13 aa, Mycobacterium tuberculosis
LNTARLMAGAGPA

SEQ ID NO: 107462 - protein, 13 aa, Mycobacterium tuberculosis
NTARLMAGAGPAP

SEQ ID NO: 107463 - protein, 13 aa, Mycobacterium tuberculosis
TARLMAGAGPAPM

SEQ ID NO: 107464 - protein, 13 aa, Mycobacterium tuberculosis
ARLMAGAGPAPML

SEQ ID NO: 107465 - protein, 13 aa, Mycobacterium tuberculosis
RLMAGAGPAPMLA

SEQ ID NO: 107466 - protein, 13 aa, Mycobacterium tuberculosis
LMAGAGPAPMLAA

SEQ ID NO: 107467 - protein, 13 aa, Mycobacterium tuberculosis
MAGAGPAPMLAAA

SEQ ID NO: 107468 - protein, 13 aa, Mycobacterium tuberculosis
AGAGPAPMLAAAA

SEQ ID NO: 107469 - protein, 13 aa, Mycobacterium tuberculosis
GAGPAPMLAAAAG

SEQ ID NO: 107470 - protein, 13 aa, Mycobacterium tuberculosis
AGPAPMLAAAAGW

SEQ ID NO: 107471 - protein, 13 aa, Mycobacterium tuberculosis
GPAPMLAAAAGWQ

SEQ ID NO: 107472 - protein, 13 aa, Mycobacterium tuberculosis
PAPMLAAAAGWQT

SEQ ID NO: 107473 - protein, 13 aa, Mycobacterium tuberculosis
APMLAAAAGWQTL

SEQ ID NO: 107474 - protein, 13 aa, Mycobacterium tuberculosis
PMLAAAAGWQTLS

SEQ ID NO: 107475 - protein, 13 aa, Mycobacterium tuberculosis
MLAAAAGWQTLSA

SEQ ID NO: 107476 - protein, 13 aa, Mycobacterium tuberculosis
LAAAAGWQTLSAA

SEQ ID NO: 107477 - protein, 13 aa, Mycobacterium tuberculosis
AAAAGWQTLSAAL

SEQ ID NO: 107478 - protein, 13 aa, Mycobacterium tuberculosis
AAAGWQTLSAALD

SEQ ID NO: 107479 - protein, 13 aa, Mycobacterium tuberculosis
AAGWQTLSAALDA

SEQ ID NO: 107480 - protein, 13 aa, Mycobacterium tuberculosis
AGWQTLSAALDAQ

SEQ ID NO: 107481 - protein, 13 aa, Mycobacterium tuberculosis
GWQTLSAALDAQA

SEQ ID NO: 107482 - protein, 13 aa, Mycobacterium tuberculosis
WQTLSAALDAQAV

SEQ ID NO: 107483 - protein, 13 aa, Mycobacterium tuberculosis
QTLSAALDAQAVE

SEQ ID NO: 107484 - protein, 13 aa, Mycobacterium tuberculosis
TLSAALDAQAVEL

SEQ ID NO: 107485 - protein, 13 aa, Mycobacterium tuberculosis
LSAALDAQAVELT

SEQ ID NO: 107486 - protein, 13 aa, Mycobacterium tuberculosis
SAALDAQAVELTA

SEQ ID NO: 107487 - protein, 13 aa, Mycobacterium tuberculosis
AALDAQAVELTAR

SEQ ID NO: 107488 - protein, 13 aa, Mycobacterium tuberculosis
ALDAQAVELTARL

SEQ ID NO: 107489 - protein, 13 aa, Mycobacterium tuberculosis
LDAQAVELTARLN

SEQ ID NO: 107490 - protein, 13 aa, Mycobacterium tuberculosis
DAQAVELTARLNS

SEQ ID NO: 107491 - protein, 13 aa, Mycobacterium tuberculosis
AQAVELTARLNSL

SEQ ID NO: 107492 - protein, 13 aa, Mycobacterium tuberculosis
QAVELTARLNSLG

SEQ ID NO: 107493 - protein, 13 aa, Mycobacterium tuberculosis
AVELTARLNSLGE

SEQ ID NO: 107494 - protein, 13 aa, Mycobacterium tuberculosis
VELTARLNSLGEA

SEQ ID NO: 107495 - protein, 13 aa, Mycobacterium tuberculosis
ELTARLNSLGEAW

SEQ ID NO: 107496 - protein, 13 aa, Mycobacterium tuberculosis
LTARLNSLGEAWT

SEQ ID NO: 107497 - protein, 13 aa, Mycobacterium tuberculosis
TARLNSLGEAWTG

SEQ ID NO: 107498 - protein, 13 aa, Mycobacterium tuberculosis
ARLNSLGEAWTGG

SEQ ID NO: 107499 - protein, 13 aa, Mycobacterium tuberculosis
RLNSLGEAWTGGG

SEQ ID NO: 107500 - protein, 13 aa, Mycobacterium tuberculosis
LNSLGEAWTGGGS

SEQ ID NO: 107501 - protein, 13 aa, Mycobacterium tuberculosis
NSLGEAWTGGGSD

SEQ ID NO: 107502 - protein, 13 aa, Mycobacterium tuberculosis
SLGEAWTGGGSDK

SEQ ID NO: 107503 - protein, 13 aa, Mycobacterium tuberculosis
LGEAWTGGGSDKA

SEQ ID NO: 107504 - protein, 13 aa, Mycobacterium tuberculosis
GEAWTGGGSDKAL

SEQ ID NO: 107505 - protein, 13 aa, Mycobacterium tuberculosis
EAWTGGGSDKALA

SEQ ID NO: 107506 - protein, 13 aa, Mycobacterium tuberculosis
AWTGGGSDKALAA

SEQ ID NO: 107507 - protein, 13 aa, Mycobacterium tuberculosis
WTGGGSDKALAAA

SEQ ID NO: 107508 - protein, 13 aa, Mycobacterium tuberculosis
TGGGSDKALAAAT

SEQ ID NO: 107509 - protein, 13 aa, Mycobacterium tuberculosis
GGGSDKALAAATP

SEQ ID NO: 107510 - protein, 13 aa, Mycobacterium tuberculosis
GGSDKALAAATPM

SEQ ID NO: 107511 - protein, 13 aa, Mycobacterium tuberculosis
GSDKALAAATPMV

SEQ ID NO: 107512 - protein, 13 aa, Mycobacterium tuberculosis
SDKALAAATPMVV

SEQ ID NO: 107513 - protein, 13 aa, Mycobacterium tuberculosis
DKALAAATPMVVW

SEQ ID NO: 107514 - protein, 13 aa, Mycobacterium tuberculosis
KALAAATPMVVWL

SEQ ID NO: 107515 - protein, 13 aa, Mycobacterium tuberculosis
ALAAATPMVVWLQ

SEQ ID NO: 107516 - protein, 13 aa, Mycobacterium tuberculosis
LAAATPMVVWLQT

SEQ ID NO: 107517 - protein, 13 aa, Mycobacterium tuberculosis
AAATPMVVWLQTA

SEQ ID NO: 107518 - protein, 13 aa, Mycobacterium tuberculosis
AATPMVVWLQTAS

SEQ ID NO: 107519 - protein, 13 aa, Mycobacterium tuberculosis
ATPMVVWLQTAST

SEQ ID NO: 107520 - protein, 13 aa, Mycobacterium tuberculosis
TPMVVWLQTASTQ

SEQ ID NO: 107521 - protein, 13 aa, Mycobacterium tuberculosis
PMVVWLQTASTQA

SEQ ID NO: 107522 - protein, 13 aa, Mycobacterium tuberculosis
MVVWLQTASTQAK

SEQ ID NO: 107523 - protein, 13 aa, Mycobacterium tuberculosis
VVWLQTASTQAKT

SEQ ID NO: 107524 - protein, 13 aa, Mycobacterium tuberculosis
VWLQTASTQAKTR

SEQ ID NO: 107525 - protein, 13 aa, Mycobacterium tuberculosis
WLQTASTQAKTRA

SEQ ID NO: 107526 - protein, 13 aa, Mycobacterium tuberculosis
LQTASTQAKTRAM

SEQ ID NO: 107527 - protein, 13 aa, Mycobacterium tuberculosis
QTASTQAKTRAMQ

SEQ ID NO: 107528 - protein, 13 aa, Mycobacterium tuberculosis
TASTQAKTRAMQA

SEQ ID NO: 107529 - protein, 13 aa, Mycobacterium tuberculosis
ASTQAKTRAMQAT

SEQ ID NO: 107530 - protein, 13 aa, Mycobacterium tuberculosis
STQAKTRAMQATA

SEQ ID NO: 107531 - protein, 13 aa, Mycobacterium tuberculosis
TQAKTRAMQATAQ

SEQ ID NO: 107532 - protein, 13 aa, Mycobacterium tuberculosis
QAKTRAMQATAQA

SEQ ID NO: 107533 - protein, 13 aa, Mycobacterium tuberculosis
AKTRAMQATAQAA

SEQ ID NO: 107534 - protein, 13 aa, Mycobacterium tuberculosis
KTRAMQATAQAAA

SEQ ID NO: 107535 - protein, 13 aa, Mycobacterium tuberculosis
TRAMQATAQAAAY

SEQ ID NO: 107536 - protein, 13 aa, Mycobacterium tuberculosis
RAMQATAQAAAYT

SEQ ID NO: 107537 - protein, 13 aa, Mycobacterium tuberculosis
AMQATAQAAAYTQ

SEQ ID NO: 107538 - protein, 13 aa, Mycobacterium tuberculosis
MQATAQAAAYTQA

SEQ ID NO: 107539 - protein, 13 aa, Mycobacterium tuberculosis
QATAQAAAYTQAM

SEQ ID NO: 107540 - protein, 13 aa, Mycobacterium tuberculosis
ATAQAAAYTQAMA

SEQ ID NO: 107541 - protein, 13 aa, Mycobacterium tuberculosis
TAQAAAYTQAMAT

SEQ ID NO: 107542 - protein, 13 aa, Mycobacterium tuberculosis
AQAAAYTQAMATT

SEQ ID NO: 107543 - protein, 13 aa, Mycobacterium tuberculosis
QAAAYTQAMATTP

SEQ ID NO: 107544 - protein, 13 aa, Mycobacterium tuberculosis
AAAYTQAMATTPS

SEQ ID NO: 107545 - protein, 13 aa, Mycobacterium tuberculosis
AAYTQAMATTPSL

SEQ ID NO: 107546 - protein, 13 aa, Mycobacterium tuberculosis
AYTQAMATTPSLP

SEQ ID NO: 107547 - protein, 13 aa, Mycobacterium tuberculosis
YTQAMATTPSLPE

SEQ ID NO: 107548 - protein, 13 aa, Mycobacterium tuberculosis
TQAMATTPSLPEI

SEQ ID NO: 107549 - protein, 13 aa, Mycobacterium tuberculosis
QAMATTPSLPEIA

SEQ ID NO: 107550 - protein, 13 aa, Mycobacterium tuberculosis
AMATTPSLPEIAA

SEQ ID NO: 107551 - protein, 13 aa, Mycobacterium tuberculosis
MATTPSLPEIAAN

SEQ ID NO: 107552 - protein, 13 aa, Mycobacterium tuberculosis
ATTPSLPEIAANH

SEQ ID NO: 107553 - protein, 13 aa, Mycobacterium tuberculosis
TTPSLPEIAANHI

SEQ ID NO: 107554 - protein, 13 aa, Mycobacterium tuberculosis
TPSLPEIAANHIT

SEQ ID NO: 107555 - protein, 13 aa, Mycobacterium tuberculosis
PSLPEIAANHITQ

SEQ ID NO: 107556 - protein, 13 aa, Mycobacterium tuberculosis
SLPEIAANHITQA

SEQ ID NO: 107557 - protein, 13 aa, Mycobacterium tuberculosis
LPEIAANHITQAV

SEQ ID NO: 107558 - protein, 13 aa, Mycobacterium tuberculosis
PEIAANHITQAVL

SEQ ID NO: 107559 - protein, 13 aa, Mycobacterium tuberculosis
EIAANHITQAVLT

SEQ ID NO: 107560 - protein, 13 aa, Mycobacterium tuberculosis
IAANHITQAVLTA

SEQ ID NO: 107561 - protein, 13 aa, Mycobacterium tuberculosis
AANHITQAVLTAT

SEQ ID NO: 107562 - protein, 13 aa, Mycobacterium tuberculosis
ANHITQAVLTATN

SEQ ID NO: 107563 - protein, 13 aa, Mycobacterium tuberculosis
NHITQAVLTATNF

SEQ ID NO: 107564 - protein, 13 aa, Mycobacterium tuberculosis
HITQAVLTATNFF

SEQ ID NO: 107565 - protein, 13 aa, Mycobacterium tuberculosis
ITQAVLTATNFFG

SEQ ID NO: 107566 - protein, 13 aa, Mycobacterium tuberculosis
TQAVLTATNFFGI

SEQ ID NO: 107567 - protein, 13 aa, Mycobacterium tuberculosis
QAVLTATNFFGIN

SEQ ID NO: 107568 - protein, 13 aa, Mycobacterium tuberculosis
AVLTATNFFGINT

SEQ ID NO: 107569 - protein, 13 aa, Mycobacterium tuberculosis
VLTATNFFGINTI

SEQ ID NO: 107570 - protein, 13 aa, Mycobacterium tuberculosis
LTATNFFGINTIP

SEQ ID NO: 107571 - protein, 13 aa, Mycobacterium tuberculosis
TATNFFGINTIPI

SEQ ID NO: 107572 - protein, 13 aa, Mycobacterium tuberculosis
ATNFFGINTIPIA

SEQ ID NO: 107573 - protein, 13 aa, Mycobacterium tuberculosis
TNFFGINTIPIAL

SEQ ID NO: 107574 - protein, 13 aa, Mycobacterium tuberculosis
NFFGINTIPIALT

SEQ ID NO: 107575 - protein, 13 aa, Mycobacterium tuberculosis
FFGINTIPIALTE

SEQ ID NO: 107576 - protein, 13 aa, Mycobacterium tuberculosis
FGINTIPIALTEM

SEQ ID NO: 107577 - protein, 13 aa, Mycobacterium tuberculosis
GINTIPIALTEMD

SEQ ID NO: 107578 - protein, 13 aa, Mycobacterium tuberculosis
INTIPIALTEMDY

SEQ ID NO: 107579 - protein, 13 aa, Mycobacterium tuberculosis
NTIPIALTEMDYF

SEQ ID NO: 107580 - protein, 13 aa, Mycobacterium tuberculosis
TIPIALTEMDYFI

SEQ ID NO: 107581 - protein, 13 aa, Mycobacterium tuberculosis
IPIALTEMDYFIR

SEQ ID NO: 107582 - protein, 13 aa, Mycobacterium tuberculosis
PIALTEMDYFIRM

SEQ ID NO: 107583 - protein, 13 aa, Mycobacterium tuberculosis
IALTEMDYFIRMW

SEQ ID NO: 107584 - protein, 13 aa, Mycobacterium tuberculosis
ALTEMDYFIRMWN

SEQ ID NO: 107585 - protein, 13 aa, Mycobacterium tuberculosis
LTEMDYFIRMWNQ

SEQ ID NO: 107586 - protein, 13 aa, Mycobacterium tuberculosis
TEMDYFIRMWNQA

SEQ ID NO: 107587 - protein, 13 aa, Mycobacterium tuberculosis
EMDYFIRMWNQAA

SEQ ID NO: 107588 - protein, 13 aa, Mycobacterium tuberculosis
MDYFIRMWNQAAL

SEQ ID NO: 107589 - protein, 13 aa, Mycobacterium tuberculosis
DYFIRMWNQAALA

SEQ ID NO: 107590 - protein, 13 aa, Mycobacterium tuberculosis
YFIRMWNQAALAM

SEQ ID NO: 107591 - protein, 13 aa, Mycobacterium tuberculosis
FIRMWNQAALAME

SEQ ID NO: 107592 - protein, 13 aa, Mycobacterium tuberculosis
IRMWNQAALAMEV

SEQ ID NO: 107593 - protein, 13 aa, Mycobacterium tuberculosis
RMWNQAALAMEVY

SEQ ID NO: 107594 - protein, 13 aa, Mycobacterium tuberculosis
MWNQAALAMEVYQ

SEQ ID NO: 107595 - protein, 13 aa, Mycobacterium tuberculosis
WNQAALAMEVYQA

SEQ ID NO: 107596 - protein, 13 aa, Mycobacterium tuberculosis
NQAALAMEVYQAE

SEQ ID NO: 107597 - protein, 13 aa, Mycobacterium tuberculosis
QAALAMEVYQAET

SEQ ID NO: 107598 - protein, 13 aa, Mycobacterium tuberculosis
AALAMEVYQAETA

SEQ ID NO: 107599 - protein, 13 aa, Mycobacterium tuberculosis
ALAMEVYQAETAV

SEQ ID NO: 107600 - protein, 13 aa, Mycobacterium tuberculosis
LAMEVYQAETAVN

SEQ ID NO: 107601 - protein, 13 aa, Mycobacterium tuberculosis
AMEVYQAETAVNT

SEQ ID NO: 107602 - protein, 13 aa, Mycobacterium tuberculosis
MEVYQAETAVNTL

SEQ ID NO: 107603 - protein, 13 aa, Mycobacterium tuberculosis
EVYQAETAVNTLF

SEQ ID NO: 107604 - protein, 13 aa, Mycobacterium tuberculosis
VYQAETAVNTLFE

SEQ ID NO: 107605 - protein, 13 aa, Mycobacterium tuberculosis
YQAETAVNTLFEK

SEQ ID NO: 107606 - protein, 13 aa, Mycobacterium tuberculosis
QAETAVNTLFEKL

SEQ ID NO: 107607 - protein, 13 aa, Mycobacterium tuberculosis
AETAVNTLFEKLE

SEQ ID NO: 107608 - protein, 13 aa, Mycobacterium tuberculosis
ETAVNTLFEKLEP

SEQ ID NO: 107609 - protein, 13 aa, Mycobacterium tuberculosis
TAVNTLFEKLEPM

SEQ ID NO: 107610 - protein, 13 aa, Mycobacterium tuberculosis
AVNTLFEKLEPMA

SEQ ID NO: 107611 - protein, 13 aa, Mycobacterium tuberculosis
VNTLFEKLEPMAS

SEQ ID NO: 107612 - protein, 13 aa, Mycobacterium tuberculosis
NTLFEKLEPMASI

SEQ ID NO: 107613 - protein, 13 aa, Mycobacterium tuberculosis
TLFEKLEPMASIL

SEQ ID NO: 107614 - protein, 13 aa, Mycobacterium tuberculosis
LFEKLEPMASILD

SEQ ID NO: 107615 - protein, 13 aa, Mycobacterium tuberculosis
FEKLEPMASILDP

SEQ ID NO: 107616 - protein, 13 aa, Mycobacterium tuberculosis
EKLEPMASILDPG

SEQ ID NO: 107617 - protein, 13 aa, Mycobacterium tuberculosis
KLEPMASILDPGA

SEQ ID NO: 107618 - protein, 13 aa, Mycobacterium tuberculosis
LEPMASILDPGAS

SEQ ID NO: 107619 - protein, 13 aa, Mycobacterium tuberculosis
EPMASILDPGASQ

SEQ ID NO: 107620 - protein, 13 aa, Mycobacterium tuberculosis
PMASILDPGASQS

SEQ ID NO: 107621 - protein, 13 aa, Mycobacterium tuberculosis
MASILDPGASQST

SEQ ID NO: 107622 - protein, 13 aa, Mycobacterium tuberculosis
ASILDPGASQSTT

SEQ ID NO: 107623 - protein, 13 aa, Mycobacterium tuberculosis
SILDPGASQSTTN

SEQ ID NO: 107624 - protein, 13 aa, Mycobacterium tuberculosis
ILDPGASQSTTNP

SEQ ID NO: 107625 - protein, 13 aa, Mycobacterium tuberculosis
LDPGASQSTTNPI

SEQ ID NO: 107626 - protein, 13 aa, Mycobacterium tuberculosis
DPGASQSTTNPIF

SEQ ID NO: 107627 - protein, 13 aa, Mycobacterium tuberculosis
PGASQSTTNPIFG

SEQ ID NO: 107628 - protein, 13 aa, Mycobacterium tuberculosis
GASQSTTNPIFGM

SEQ ID NO: 107629 - protein, 13 aa, Mycobacterium tuberculosis
ASQSTTNPIFGMP

SEQ ID NO: 107630 - protein, 13 aa, Mycobacterium tuberculosis
SQSTTNPIFGMPS

SEQ ID NO: 107631 - protein, 13 aa, Mycobacterium tuberculosis
QSTTNPIFGMPSP

SEQ ID NO: 107632 - protein, 13 aa, Mycobacterium tuberculosis
STTNPIFGMPSPG

SEQ ID NO: 107633 - protein, 13 aa, Mycobacterium tuberculosis
TTNPIFGMPSPGS

SEQ ID NO: 107634 - protein, 13 aa, Mycobacterium tuberculosis
TNPIFGMPSPGSS

SEQ ID NO: 107635 - protein, 13 aa, Mycobacterium tuberculosis
NPIFGMPSPGSST

SEQ ID NO: 107636 - protein, 13 aa, Mycobacterium tuberculosis
PIFGMPSPGSSTP

SEQ ID NO: 107637 - protein, 13 aa, Mycobacterium tuberculosis
IFGMPSPGSSTPV

SEQ ID NO: 107638 - protein, 13 aa, Mycobacterium tuberculosis
FGMPSPGSSTPVG

SEQ ID NO: 107639 - protein, 13 aa, Mycobacterium tuberculosis
GMPSPGSSTPVGQ

SEQ ID NO: 107640 - protein, 13 aa, Mycobacterium tuberculosis
MPSPGSSTPVGQL

SEQ ID NO: 107641 - protein, 13 aa, Mycobacterium tuberculosis
PSPGSSTPVGQLP

SEQ ID NO: 107642 - protein, 13 aa, Mycobacterium tuberculosis
SPGSSTPVGQLPP

SEQ ID NO: 107643 - protein, 13 aa, Mycobacterium tuberculosis
PGSSTPVGQLPPA

SEQ ID NO: 107644 - protein, 13 aa, Mycobacterium tuberculosis
GSSTPVGQLPPAA

SEQ ID NO: 107645 - protein, 13 aa, Mycobacterium tuberculosis
SSTPVGQLPPAAT

SEQ ID NO: 107646 - protein, 13 aa, Mycobacterium tuberculosis
STPVGQLPPAATQ

SEQ ID NO: 107647 - protein, 13 aa, Mycobacterium tuberculosis
TPVGQLPPAATQT

SEQ ID NO: 107648 - protein, 13 aa, Mycobacterium tuberculosis
PVGQLPPAATQTL

SEQ ID NO: 107649 - protein, 13 aa, Mycobacterium tuberculosis
VGQLPPAATQTLG

SEQ ID NO: 107650 - protein, 13 aa, Mycobacterium tuberculosis
GQLPPAATQTLGQ

SEQ ID NO: 107651 - protein, 13 aa, Mycobacterium tuberculosis
QLPPAATQTLGQL

SEQ ID NO: 107652 - protein, 13 aa, Mycobacterium tuberculosis
LPPAATQTLGQLG

SEQ ID NO: 107653 - protein, 13 aa, Mycobacterium tuberculosis
PPAATQTLGQLGE

SEQ ID NO: 107654 - protein, 13 aa, Mycobacterium tuberculosis
PAATQTLGQLGEM

SEQ ID NO: 107655 - protein, 13 aa, Mycobacterium tuberculosis
AATQTLGQLGEMS

SEQ ID NO: 107656 - protein, 13 aa, Mycobacterium tuberculosis
ATQTLGQLGEMSG

SEQ ID NO: 107657 - protein, 13 aa, Mycobacterium tuberculosis
TQTLGQLGEMSGP

SEQ ID NO: 107658 - protein, 13 aa, Mycobacterium tuberculosis
QTLGQLGEMSGPM

SEQ ID NO: 107659 - protein, 13 aa, Mycobacterium tuberculosis
TLGQLGEMSGPMQ

SEQ ID NO: 107660 - protein, 13 aa, Mycobacterium tuberculosis
LGQLGEMSGPMQQ

SEQ ID NO: 107661 - protein, 13 aa, Mycobacterium tuberculosis
GQLGEMSGPMQQL

SEQ ID NO: 107662 - protein, 13 aa, Mycobacterium tuberculosis
QLGEMSGPMQQLT

SEQ ID NO: 107663 - protein, 13 aa, Mycobacterium tuberculosis
LGEMSGPMQQLTQ

SEQ ID NO: 107664 - protein, 13 aa, Mycobacterium tuberculosis
GEMSGPMQQLTQP

SEQ ID NO: 107665 - protein, 13 aa, Mycobacterium tuberculosis
EMSGPMQQLTQPL

SEQ ID NO: 107666 - protein, 13 aa, Mycobacterium tuberculosis
MSGPMQQLTQPLQ

SEQ ID NO: 107667 - protein, 13 aa, Mycobacterium tuberculosis
SGPMQQLTQPLQQ

SEQ ID NO: 107668 - protein, 13 aa, Mycobacterium tuberculosis
GPMQQLTQPLQQV

SEQ ID NO: 107669 - protein, 13 aa, Mycobacterium tuberculosis
PMQQLTQPLQQVT

SEQ ID NO: 107670 - protein, 13 aa, Mycobacterium tuberculosis
MQQLTQPLQQVTS

SEQ ID NO: 107671 - protein, 13 aa, Mycobacterium tuberculosis
QQLTQPLQQVTSL

SEQ ID NO: 107672 - protein, 13 aa, Mycobacterium tuberculosis
QLTQPLQQVTSLF

SEQ ID NO: 107673 - protein, 13 aa, Mycobacterium tuberculosis
LTQPLQQVTSLFS

SEQ ID NO: 107674 - protein, 13 aa, Mycobacterium tuberculosis
TQPLQQVTSLFSQ

SEQ ID NO: 107675 - protein, 13 aa, Mycobacterium tuberculosis
QPLQQVTSLFSQV

SEQ ID NO: 107676 - protein, 13 aa, Mycobacterium tuberculosis
PLQQVTSLFSQVG

SEQ ID NO: 107677 - protein, 13 aa, Mycobacterium tuberculosis
LQQVTSLFSQVGG

SEQ ID NO: 107678 - protein, 13 aa, Mycobacterium tuberculosis
QQVTSLFSQVGGT

SEQ ID NO: 107679 - protein, 13 aa, Mycobacterium tuberculosis
QVTSLFSQVGGTG

SEQ ID NO: 107680 - protein, 13 aa, Mycobacterium tuberculosis
VTSLFSQVGGTGG

SEQ ID NO: 107681 - protein, 13 aa, Mycobacterium tuberculosis
TSLFSQVGGTGGG

SEQ ID NO: 107682 - protein, 13 aa, Mycobacterium tuberculosis
SLFSQVGGTGGGN

SEQ ID NO: 107683 - protein, 13 aa, Mycobacterium tuberculosis
LFSQVGGTGGGNP

SEQ ID NO: 107684 - protein, 13 aa, Mycobacterium tuberculosis
FSQVGGTGGGNPA

SEQ ID NO: 107685 - protein, 13 aa, Mycobacterium tuberculosis
SQVGGTGGGNPAD

SEQ ID NO: 107686 - protein, 13 aa, Mycobacterium tuberculosis
QVGGTGGGNPADE

SEQ ID NO: 107687 - protein, 13 aa, Mycobacterium tuberculosis
VGGTGGGNPADEE

SEQ ID NO: 107688 - protein, 13 aa, Mycobacterium tuberculosis
GGTGGGNPADEEA

SEQ ID NO: 107689 - protein, 13 aa, Mycobacterium tuberculosis
GTGGGNPADEEAA

SEQ ID NO: 107690 - protein, 13 aa, Mycobacterium tuberculosis
TGGGNPADEEAAQ

SEQ ID NO: 107691 - protein, 13 aa, Mycobacterium tuberculosis
GGGNPADEEAAQM

SEQ ID NO: 107692 - protein, 13 aa, Mycobacterium tuberculosis
GGNPADEEAAQMG

SEQ ID NO: 107693 - protein, 13 aa, Mycobacterium tuberculosis
GNPADEEAAQMGL

SEQ ID NO: 107694 - protein, 13 aa, Mycobacterium tuberculosis
NPADEEAAQMGLL

SEQ ID NO: 107695 - protein, 13 aa, Mycobacterium tuberculosis
PADEEAAQMGLLG

SEQ ID NO: 107696 - protein, 13 aa, Mycobacterium tuberculosis
ADEEAAQMGLLGT

SEQ ID NO: 107697 - protein, 13 aa, Mycobacterium tuberculosis
DEEAAQMGLLGTS

SEQ ID NO: 107698 - protein, 13 aa, Mycobacterium tuberculosis
EEAAQMGLLGTSP

SEQ ID NO: 107699 - protein, 13 aa, Mycobacterium tuberculosis
EAAQMGLLGTSPL

SEQ ID NO: 107700 - protein, 13 aa, Mycobacterium tuberculosis
AAQMGLLGTSPLS

SEQ ID NO: 107701 - protein, 13 aa, Mycobacterium tuberculosis
AQMGLLGTSPLSN

SEQ ID NO: 107702 - protein, 13 aa, Mycobacterium tuberculosis
QMGLLGTSPLSNH

SEQ ID NO: 107703 - protein, 13 aa, Mycobacterium tuberculosis
MGLLGTSPLSNHP

SEQ ID NO: 107704 - protein, 13 aa, Mycobacterium tuberculosis
GLLGTSPLSNHPL

SEQ ID NO: 107705 - protein, 13 aa, Mycobacterium tuberculosis
LLGTSPLSNHPLA

SEQ ID NO: 107706 - protein, 13 aa, Mycobacterium tuberculosis
LGTSPLSNHPLAG

SEQ ID NO: 107707 - protein, 13 aa, Mycobacterium tuberculosis
GTSPLSNHPLAGG

SEQ ID NO: 107708 - protein, 13 aa, Mycobacterium tuberculosis
TSPLSNHPLAGGS

SEQ ID NO: 107709 - protein, 13 aa, Mycobacterium tuberculosis
SPLSNHPLAGGSG

SEQ ID NO: 107710 - protein, 13 aa, Mycobacterium tuberculosis
PLSNHPLAGGSGP

SEQ ID NO: 107711 - protein, 13 aa, Mycobacterium tuberculosis
LSNHPLAGGSGPS

SEQ ID NO: 107712 - protein, 13 aa, Mycobacterium tuberculosis
SNHPLAGGSGPSA

SEQ ID NO: 107713 - protein, 13 aa, Mycobacterium tuberculosis
NHPLAGGSGPSAG

SEQ ID NO: 107714 - protein, 13 aa, Mycobacterium tuberculosis
HPLAGGSGPSAGA

SEQ ID NO: 107715 - protein, 13 aa, Mycobacterium tuberculosis
PLAGGSGPSAGAG

SEQ ID NO: 107716 - protein, 13 aa, Mycobacterium tuberculosis
LAGGSGPSAGAGL

SEQ ID NO: 107717 - protein, 13 aa, Mycobacterium tuberculosis
AGGSGPSAGAGLL

SEQ ID NO: 107718 - protein, 13 aa, Mycobacterium tuberculosis
GGSGPSAGAGLLR

SEQ ID NO: 107719 - protein, 13 aa, Mycobacterium tuberculosis
GSGPSAGAGLLRA

SEQ ID NO: 107720 - protein, 13 aa, Mycobacterium tuberculosis
SGPSAGAGLLRAE

SEQ ID NO: 107721 - protein, 13 aa, Mycobacterium tuberculosis
GPSAGAGLLRAES

SEQ ID NO: 107722 - protein, 13 aa, Mycobacterium tuberculosis
PSAGAGLLRAESL

SEQ ID NO: 107723 - protein, 13 aa, Mycobacterium tuberculosis
SAGAGLLRAESLP

SEQ ID NO: 107724 - protein, 13 aa, Mycobacterium tuberculosis
AGAGLLRAESLPG

SEQ ID NO: 107725 - protein, 13 aa, Mycobacterium tuberculosis
GAGLLRAESLPGA

SEQ ID NO: 107726 - protein, 13 aa, Mycobacterium tuberculosis
AGLLRAESLPGAG

SEQ ID NO: 107727 - protein, 13 aa, Mycobacterium tuberculosis
GLLRAESLPGAGG

SEQ ID NO: 107728 - protein, 13 aa, Mycobacterium tuberculosis
LLRAESLPGAGGS

SEQ ID NO: 107729 - protein, 13 aa, Mycobacterium tuberculosis
LRAESLPGAGGSL

SEQ ID NO: 107730 - protein, 13 aa, Mycobacterium tuberculosis
RAESLPGAGGSLT

SEQ ID NO: 107731 - protein, 13 aa, Mycobacterium tuberculosis
AESLPGAGGSLTR

SEQ ID NO: 107732 - protein, 13 aa, Mycobacterium tuberculosis
ESLPGAGGSLTRT

SEQ ID NO: 107733 - protein, 13 aa, Mycobacterium tuberculosis
SLPGAGGSLTRTP

SEQ ID NO: 107734 - protein, 13 aa, Mycobacterium tuberculosis
LPGAGGSLTRTPL

SEQ ID NO: 107735 - protein, 13 aa, Mycobacterium tuberculosis
PGAGGSLTRTPLM

SEQ ID NO: 107736 - protein, 13 aa, Mycobacterium tuberculosis
GAGGSLTRTPLMS

SEQ ID NO: 107737 - protein, 13 aa, Mycobacterium tuberculosis
AGGSLTRTPLMSQ

SEQ ID NO: 107738 - protein, 13 aa, Mycobacterium tuberculosis
GGSLTRTPLMSQL

SEQ ID NO: 107739 - protein, 13 aa, Mycobacterium tuberculosis
GSLTRTPLMSQLI

SEQ ID NO: 107740 - protein, 13 aa, Mycobacterium tuberculosis
SLTRTPLMSQLIE

SEQ ID NO: 107741 - protein, 13 aa, Mycobacterium tuberculosis
LTRTPLMSQLIEK

SEQ ID NO: 107742 - protein, 13 aa, Mycobacterium tuberculosis
TRTPLMSQLIEKP

SEQ ID NO: 107743 - protein, 13 aa, Mycobacterium tuberculosis
RTPLMSQLIEKPV

SEQ ID NO: 107744 - protein, 13 aa, Mycobacterium tuberculosis
TPLMSQLIEKPVA

SEQ ID NO: 107745 - protein, 13 aa, Mycobacterium tuberculosis
PLMSQLIEKPVAP

SEQ ID NO: 107746 - protein, 13 aa, Mycobacterium tuberculosis
LMSQLIEKPVAPS

SEQ ID NO: 107747 - protein, 13 aa, Mycobacterium tuberculosis
MSQLIEKPVAPSV

SEQ ID NO: 107748 - protein, 13 aa, Mycobacterium tuberculosis
SQLIEKPVAPSVM

SEQ ID NO: 107749 - protein, 13 aa, Mycobacterium tuberculosis
QLIEKPVAPSVMP

SEQ ID NO: 107750 - protein, 13 aa, Mycobacterium tuberculosis
LIEKPVAPSVMPA

SEQ ID NO: 107751 - protein, 13 aa, Mycobacterium tuberculosis
IEKPVAPSVMPAA

SEQ ID NO: 107752 - protein, 13 aa, Mycobacterium tuberculosis
EKPVAPSVMPAAA

SEQ ID NO: 107753 - protein, 13 aa, Mycobacterium tuberculosis
KPVAPSVMPAAAA

SEQ ID NO: 107754 - protein, 13 aa, Mycobacterium tuberculosis
PVAPSVMPAAAAG

SEQ ID NO: 107755 - protein, 13 aa, Mycobacterium tuberculosis
VAPSVMPAAAAGS

SEQ ID NO: 107756 - protein, 13 aa, Mycobacterium tuberculosis
APSVMPAAAAGSS

SEQ ID NO: 107757 - protein, 13 aa, Mycobacterium tuberculosis
PSVMPAAAAGSSA

SEQ ID NO: 107758 - protein, 13 aa, Mycobacterium tuberculosis
SVMPAAAAGSSAT

SEQ ID NO: 107759 - protein, 13 aa, Mycobacterium tuberculosis
VMPAAAAGSSATG

SEQ ID NO: 107760 - protein, 13 aa, Mycobacterium tuberculosis
MPAAAAGSSATGG

SEQ ID NO: 107761 - protein, 13 aa, Mycobacterium tuberculosis
PAAAAGSSATGGA

SEQ ID NO: 107762 - protein, 13 aa, Mycobacterium tuberculosis
AAAAGSSATGGAA

SEQ ID NO: 107763 - protein, 13 aa, Mycobacterium tuberculosis
AAAGSSATGGAAP

SEQ ID NO: 107764 - protein, 13 aa, Mycobacterium tuberculosis
AAGSSATGGAAPV

SEQ ID NO: 107765 - protein, 13 aa, Mycobacterium tuberculosis
AGSSATGGAAPVG

SEQ ID NO: 107766 - protein, 13 aa, Mycobacterium tuberculosis
GSSATGGAAPVGA

SEQ ID NO: 107767 - protein, 13 aa, Mycobacterium tuberculosis
SSATGGAAPVGAG

SEQ ID NO: 107768 - protein, 13 aa, Mycobacterium tuberculosis
SATGGAAPVGAGA

SEQ ID NO: 107769 - protein, 13 aa, Mycobacterium tuberculosis
ATGGAAPVGAGAM

SEQ ID NO: 107770 - protein, 13 aa, Mycobacterium tuberculosis
TGGAAPVGAGAMG

SEQ ID NO: 107771 - protein, 13 aa, Mycobacterium tuberculosis
GGAAPVGAGAMGQ

SEQ ID NO: 107772 - protein, 13 aa, Mycobacterium tuberculosis
GAAPVGAGAMGQG

SEQ ID NO: 107773 - protein, 13 aa, Mycobacterium tuberculosis
AAPVGAGAMGQGA

SEQ ID NO: 107774 - protein, 13 aa, Mycobacterium tuberculosis
APVGAGAMGQGAQ

SEQ ID NO: 107775 - protein, 13 aa, Mycobacterium tuberculosis
PVGAGAMGQGAQS

SEQ ID NO: 107776 - protein, 13 aa, Mycobacterium tuberculosis
VGAGAMGQGAQSG

SEQ ID NO: 107777 - protein, 13 aa, Mycobacterium tuberculosis
GAGAMGQGAQSGG

SEQ ID NO: 107778 - protein, 13 aa, Mycobacterium tuberculosis
AGAMGQGAQSGGS

SEQ ID NO: 107779 - protein, 13 aa, Mycobacterium tuberculosis
GAMGQGAQSGGST

SEQ ID NO: 107780 - protein, 13 aa, Mycobacterium tuberculosis
AMGQGAQSGGSTR

SEQ ID NO: 107781 - protein, 13 aa, Mycobacterium tuberculosis
MGQGAQSGGSTRP

SEQ ID NO: 107782 - protein, 13 aa, Mycobacterium tuberculosis
GQGAQSGGSTRPG

SEQ ID NO: 107783 - protein, 13 aa, Mycobacterium tuberculosis
QGAQSGGSTRPGL

SEQ ID NO: 107784 - protein, 13 aa, Mycobacterium tuberculosis
GAQSGGSTRPGLV

SEQ ID NO: 107785 - protein, 13 aa, Mycobacterium tuberculosis
AQSGGSTRPGLVA

SEQ ID NO: 107786 - protein, 13 aa, Mycobacterium tuberculosis
QSGGSTRPGLVAP

SEQ ID NO: 107787 - protein, 13 aa, Mycobacterium tuberculosis
SGGSTRPGLVAPA

SEQ ID NO: 107788 - protein, 13 aa, Mycobacterium tuberculosis
GGSTRPGLVAPAP

SEQ ID NO: 107789 - protein, 13 aa, Mycobacterium tuberculosis
GSTRPGLVAPAPL

SEQ ID NO: 107790 - protein, 13 aa, Mycobacterium tuberculosis
STRPGLVAPAPLA

SEQ ID NO: 107791 - protein, 13 aa, Mycobacterium tuberculosis
TRPGLVAPAPLAQ

SEQ ID NO: 107792 - protein, 13 aa, Mycobacterium tuberculosis
RPGLVAPAPLAQE

SEQ ID NO: 107793 - protein, 13 aa, Mycobacterium tuberculosis
PGLVAPAPLAQER

SEQ ID NO: 107794 - protein, 13 aa, Mycobacterium tuberculosis
GLVAPAPLAQERE

SEQ ID NO: 107795 - protein, 13 aa, Mycobacterium tuberculosis
LVAPAPLAQEREE

SEQ ID NO: 107796 - protein, 13 aa, Mycobacterium tuberculosis
VAPAPLAQEREED

SEQ ID NO: 107797 - protein, 13 aa, Mycobacterium tuberculosis
APAPLAQEREEDD

SEQ ID NO: 107798 - protein, 13 aa, Mycobacterium tuberculosis
PAPLAQEREEDDE

SEQ ID NO: 107799 - protein, 13 aa, Mycobacterium tuberculosis
APLAQEREEDDED

SEQ ID NO: 107800 - protein, 13 aa, Mycobacterium tuberculosis
PLAQEREEDDEDD

SEQ ID NO: 107801 - protein, 13 aa, Mycobacterium tuberculosis
LAQEREEDDEDDW

SEQ ID NO: 107802 - protein, 13 aa, Mycobacterium tuberculosis
AQEREEDDEDDWD

SEQ ID NO: 107803 - protein, 13 aa, Mycobacterium tuberculosis
QEREEDDEDDWDE

SEQ ID NO: 107804 - protein, 13 aa, Mycobacterium tuberculosis
EREEDDEDDWDEE

SEQ ID NO: 107805 - protein, 13 aa, Mycobacterium tuberculosis
REEDDEDDWDEED

SEQ ID NO: 107806 - protein, 13 aa, Mycobacterium tuberculosis
EEDDEDDWDEEDD

SEQ ID NO: 107807 - protein, 13 aa, Mycobacterium tuberculosis
EDDEDDWDEEDDW

SEQ ID NO: 107808 - protein, 14 aa, Mycobacterium tuberculosis
MLWHAMPPELNTAR

SEQ ID NO: 107809 - protein, 14 aa, Mycobacterium tuberculosis
LWHAMPPELNTARL

SEQ ID NO: 107810 - protein, 14 aa, Mycobacterium tuberculosis
WHAMPPELNTARLM

SEQ ID NO: 107811 - protein, 14 aa, Mycobacterium tuberculosis
HAMPPELNTARLMA

SEQ ID NO: 107812 - protein, 14 aa, Mycobacterium tuberculosis
AMPPELNTARLMAG

SEQ ID NO: 107813 - protein, 14 aa, Mycobacterium tuberculosis
MPPELNTARLMAGA

SEQ ID NO: 107814 - protein, 14 aa, Mycobacterium tuberculosis
PPELNTARLMAGAG

SEQ ID NO: 107815 - protein, 14 aa, Mycobacterium tuberculosis
PELNTARLMAGAGP

SEQ ID NO: 107816 - protein, 14 aa, Mycobacterium tuberculosis
ELNTARLMAGAGPA

SEQ ID NO: 107817 - protein, 14 aa, Mycobacterium tuberculosis
LNTARLMAGAGPAP

SEQ ID NO: 107818 - protein, 14 aa, Mycobacterium tuberculosis
NTARLMAGAGPAPM

SEQ ID NO: 107819 - protein, 14 aa, Mycobacterium tuberculosis
TARLMAGAGPAPML

SEQ ID NO: 107820 - protein, 14 aa, Mycobacterium tuberculosis
ARLMAGAGPAPMLA

SEQ ID NO: 107821 - protein, 14 aa, Mycobacterium tuberculosis
RLMAGAGPAPMLAA

SEQ ID NO: 107822 - protein, 14 aa, Mycobacterium tuberculosis
LMAGAGPAPMLAAA

SEQ ID NO: 107823 - protein, 14 aa, Mycobacterium tuberculosis
MAGAGPAPMLAAAA

SEQ ID NO: 107824 - protein, 14 aa, Mycobacterium tuberculosis
AGAGPAPMLAAAAG

SEQ ID NO: 107825 - protein, 14 aa, Mycobacterium tuberculosis
GAGPAPMLAAAAGW

SEQ ID NO: 107826 - protein, 14 aa, Mycobacterium tuberculosis
AGPAPMLAAAAGWQ

SEQ ID NO: 107827 - protein, 14 aa, Mycobacterium tuberculosis
GPAPMLAAAAGWQT

SEQ ID NO: 107828 - protein, 14 aa, Mycobacterium tuberculosis
PAPMLAAAAGWQTL

SEQ ID NO: 107829 - protein, 14 aa, Mycobacterium tuberculosis
APMLAAAAGWQTLS

SEQ ID NO: 107830 - protein, 14 aa, Mycobacterium tuberculosis
PMLAAAAGWQTLSA

SEQ ID NO: 107831 - protein, 14 aa, Mycobacterium tuberculosis
MLAAAAGWQTLSAA

SEQ ID NO: 107832 - protein, 14 aa, Mycobacterium tuberculosis
LAAAAGWQTLSAAL

SEQ ID NO: 107833 - protein, 14 aa, Mycobacterium tuberculosis
AAAAGWQTLSAALD

SEQ ID NO: 107834 - protein, 14 aa, Mycobacterium tuberculosis
AAAGWQTLSAALDA

SEQ ID NO: 107835 - protein, 14 aa, Mycobacterium tuberculosis
AAGWQTLSAALDAQ

SEQ ID NO: 107836 - protein, 14 aa, Mycobacterium tuberculosis
AGWQTLSAALDAQA

SEQ ID NO: 107837 - protein, 14 aa, Mycobacterium tuberculosis
GWQTLSAALDAQAV

SEQ ID NO: 107838 - protein, 14 aa, Mycobacterium tuberculosis
WQTLSAALDAQAVE

SEQ ID NO: 107839 - protein, 14 aa, Mycobacterium tuberculosis
QTLSAALDAQAVEL

SEQ ID NO: 107840 - protein, 14 aa, Mycobacterium tuberculosis
TLSAALDAQAVELT

SEQ ID NO: 107841 - protein, 14 aa, Mycobacterium tuberculosis
LSAALDAQAVELTA

SEQ ID NO: 107842 - protein, 14 aa, Mycobacterium tuberculosis
SAALDAQAVELTAR

SEQ ID NO: 107843 - protein, 14 aa, Mycobacterium tuberculosis
AALDAQAVELTARL

SEQ ID NO: 107844 - protein, 14 aa, Mycobacterium tuberculosis
ALDAQAVELTARLN

SEQ ID NO: 107845 - protein, 14 aa, Mycobacterium tuberculosis
LDAQAVELTARLNS

SEQ ID NO: 107846 - protein, 14 aa, Mycobacterium tuberculosis
DAQAVELTARLNSL

SEQ ID NO: 107847 - protein, 14 aa, Mycobacterium tuberculosis
AQAVELTARLNSLG

SEQ ID NO: 107848 - protein, 14 aa, Mycobacterium tuberculosis
QAVELTARLNSLGE

SEQ ID NO: 107849 - protein, 14 aa, Mycobacterium tuberculosis
AVELTARLNSLGEA

SEQ ID NO: 107850 - protein, 14 aa, Mycobacterium tuberculosis
VELTARLNSLGEAW

SEQ ID NO: 107851 - protein, 14 aa, Mycobacterium tuberculosis
ELTARLNSLGEAWT

SEQ ID NO: 107852 - protein, 14 aa, Mycobacterium tuberculosis
LTARLNSLGEAWTG

SEQ ID NO: 107853 - protein, 14 aa, Mycobacterium tuberculosis
TARLNSLGEAWTGG

SEQ ID NO: 107854 - protein, 14 aa, Mycobacterium tuberculosis
ARLNSLGEAWTGGG

SEQ ID NO: 107855 - protein, 14 aa, Mycobacterium tuberculosis
RLNSLGEAWTGGGS

SEQ ID NO: 107856 - protein, 14 aa, Mycobacterium tuberculosis
LNSLGEAWTGGGSD

SEQ ID NO: 107857 - protein, 14 aa, Mycobacterium tuberculosis
NSLGEAWTGGGSDK

SEQ ID NO: 107858 - protein, 14 aa, Mycobacterium tuberculosis
SLGEAWTGGGSDKA

SEQ ID NO: 107859 - protein, 14 aa, Mycobacterium tuberculosis
LGEAWTGGGSDKAL

SEQ ID NO: 107860 - protein, 14 aa, Mycobacterium tuberculosis
GEAWTGGGSDKALA

SEQ ID NO: 107861 - protein, 14 aa, Mycobacterium tuberculosis
EAWTGGGSDKALAA

SEQ ID NO: 107862 - protein, 14 aa, Mycobacterium tuberculosis
AWTGGGSDKALAAA

SEQ ID NO: 107863 - protein, 14 aa, Mycobacterium tuberculosis
WTGGGSDKALAAAT

SEQ ID NO: 107864 - protein, 14 aa, Mycobacterium tuberculosis
TGGGSDKALAAATP

SEQ ID NO: 107865 - protein, 14 aa, Mycobacterium tuberculosis
GGGSDKALAAATPM

SEQ ID NO: 107866 - protein, 14 aa, Mycobacterium tuberculosis
GGSDKALAAATPMV

SEQ ID NO: 107867 - protein, 14 aa, Mycobacterium tuberculosis
GSDKALAAATPMVV

SEQ ID NO: 107868 - protein, 14 aa, Mycobacterium tuberculosis
SDKALAAATPMVVW

SEQ ID NO: 107869 - protein, 14 aa, Mycobacterium tuberculosis
DKALAAATPMVVWL

SEQ ID NO: 107870 - protein, 14 aa, Mycobacterium tuberculosis
KALAAATPMVVWLQ

SEQ ID NO: 107871 - protein, 14 aa, Mycobacterium tuberculosis
ALAAATPMVVWLQT

SEQ ID NO: 107872 - protein, 14 aa, Mycobacterium tuberculosis
LAAATPMVVWLQTA

SEQ ID NO: 107873 - protein, 14 aa, Mycobacterium tuberculosis
AAATPMVVWLQTAS

SEQ ID NO: 107874 - protein, 14 aa, Mycobacterium tuberculosis
AATPMVVWLQTAST

SEQ ID NO: 107875 - protein, 14 aa, Mycobacterium tuberculosis
ATPMVVWLQTASTQ

SEQ ID NO: 107876 - protein, 14 aa, Mycobacterium tuberculosis
TPMVVWLQTASTQA

SEQ ID NO: 107877 - protein, 14 aa, Mycobacterium tuberculosis
PMVVWLQTASTQAK

SEQ ID NO: 107878 - protein, 14 aa, Mycobacterium tuberculosis
MVVWLQTASTQAKT

SEQ ID NO: 107879 - protein, 14 aa, Mycobacterium tuberculosis
VVWLQTASTQAKTR

SEQ ID NO: 107880 - protein, 14 aa, Mycobacterium tuberculosis
VWLQTASTQAKTRA

SEQ ID NO: 107881 - protein, 14 aa, Mycobacterium tuberculosis
WLQTASTQAKTRAM

SEQ ID NO: 107882 - protein, 14 aa, Mycobacterium tuberculosis
LQTASTQAKTRAMQ

SEQ ID NO: 107883 - protein, 14 aa, Mycobacterium tuberculosis
QTASTQAKTRAMQA

SEQ ID NO: 107884 - protein, 14 aa, Mycobacterium tuberculosis
TASTQAKTRAMQAT

SEQ ID NO: 107885 - protein, 14 aa, Mycobacterium tuberculosis
ASTQAKTRAMQATA

SEQ ID NO: 107886 - protein, 14 aa, Mycobacterium tuberculosis
STQAKTRAMQATAQ

SEQ ID NO: 107887 - protein, 14 aa, Mycobacterium tuberculosis
TQAKTRAMQATAQA

SEQ ID NO: 107888 - protein, 14 aa, Mycobacterium tuberculosis
QAKTRAMQATAQAA

SEQ ID NO: 107889 - protein, 14 aa, Mycobacterium tuberculosis
AKTRAMQATAQAAA

SEQ ID NO: 107890 - protein, 14 aa, Mycobacterium tuberculosis
KTRAMQATAQAAAY

SEQ ID NO: 107891 - protein, 14 aa, Mycobacterium tuberculosis
TRAMQATAQAAAYT

SEQ ID NO: 107892 - protein, 14 aa, Mycobacterium tuberculosis
RAMQATAQAAAYTQ

SEQ ID NO: 107893 - protein, 14 aa, Mycobacterium tuberculosis
AMQATAQAAAYTQA

SEQ ID NO: 107894 - protein, 14 aa, Mycobacterium tuberculosis
MQATAQAAAYTQAM

SEQ ID NO: 107895 - protein, 14 aa, Mycobacterium tuberculosis
QATAQAAAYTQAMA

SEQ ID NO: 107896 - protein, 14 aa, Mycobacterium tuberculosis
ATAQAAAYTQAMAT

SEQ ID NO: 107897 - protein, 14 aa, Mycobacterium tuberculosis
TAQAAAYTQAMATT

SEQ ID NO: 107898 - protein, 14 aa, Mycobacterium tuberculosis
AQAAAYTQAMATTP

SEQ ID NO: 107899 - protein, 14 aa, Mycobacterium tuberculosis
QAAAYTQAMATTPS

SEQ ID NO: 107900 - protein, 14 aa, Mycobacterium tuberculosis
AAAYTQAMATTPSL

SEQ ID NO: 107901 - protein, 14 aa, Mycobacterium tuberculosis
AAYTQAMATTPSLP

SEQ ID NO: 107902 - protein, 14 aa, Mycobacterium tuberculosis
AYTQAMATTPSLPE

SEQ ID NO: 107903 - protein, 14 aa, Mycobacterium tuberculosis
YTQAMATTPSLPEI

SEQ ID NO: 107904 - protein, 14 aa, Mycobacterium tuberculosis
TQAMATTPSLPEIA

SEQ ID NO: 107905 - protein, 14 aa, Mycobacterium tuberculosis
QAMATTPSLPEIAA

SEQ ID NO: 107906 - protein, 14 aa, Mycobacterium tuberculosis
AMATTPSLPEIAAN

SEQ ID NO: 107907 - protein, 14 aa, Mycobacterium tuberculosis
MATTPSLPEIAANH

SEQ ID NO: 107908 - protein, 14 aa, Mycobacterium tuberculosis
ATTPSLPEIAANHI

SEQ ID NO: 107909 - protein, 14 aa, Mycobacterium tuberculosis
TTPSLPEIAANHIT

SEQ ID NO: 107910 - protein, 14 aa, Mycobacterium tuberculosis
TPSLPEIAANHITQ

SEQ ID NO: 107911 - protein, 14 aa, Mycobacterium tuberculosis
PSLPEIAANHITQA

SEQ ID NO: 107912 - protein, 14 aa, Mycobacterium tuberculosis
SLPEIAANHITQAV

SEQ ID NO: 107913 - protein, 14 aa, Mycobacterium tuberculosis
LPEIAANHITQAVL

SEQ ID NO: 107914 - protein, 14 aa, Mycobacterium tuberculosis
PEIAANHITQAVLT

SEQ ID NO: 107915 - protein, 14 aa, Mycobacterium tuberculosis
EIAANHITQAVLTA

SEQ ID NO: 107916 - protein, 14 aa, Mycobacterium tuberculosis
IAANHITQAVLTAT

SEQ ID NO: 107917 - protein, 14 aa, Mycobacterium tuberculosis
AANHITQAVLTATN

SEQ ID NO: 107918 - protein, 14 aa, Mycobacterium tuberculosis
ANHITQAVLTATNF

SEQ ID NO: 107919 - protein, 14 aa, Mycobacterium tuberculosis
NHITQAVLTATNFF

SEQ ID NO: 107920 - protein, 14 aa, Mycobacterium tuberculosis
HITQAVLTATNFFG

SEQ ID NO: 107921 - protein, 14 aa, Mycobacterium tuberculosis
ITQAVLTATNFFGI

SEQ ID NO: 107922 - protein, 14 aa, Mycobacterium tuberculosis
TQAVLTATNFFGIN

SEQ ID NO: 107923 - protein, 14 aa, Mycobacterium tuberculosis
QAVLTATNFFGINT

SEQ ID NO: 107924 - protein, 14 aa, Mycobacterium tuberculosis
AVLTATNFFGINTI

SEQ ID NO: 107925 - protein, 14 aa, Mycobacterium tuberculosis
VLTATNFFGINTIP

SEQ ID NO: 107926 - protein, 14 aa, Mycobacterium tuberculosis
LTATNFFGINTIPI

SEQ ID NO: 107927 - protein, 14 aa, Mycobacterium tuberculosis
TATNFFGINTIPIA

SEQ ID NO: 107928 - protein, 14 aa, Mycobacterium tuberculosis
ATNFFGINTIPIAL

SEQ ID NO: 107929 - protein, 14 aa, Mycobacterium tuberculosis
TNFFGINTIPIALT

SEQ ID NO: 107930 - protein, 14 aa, Mycobacterium tuberculosis
NFFGINTIPIALTE

SEQ ID NO: 107931 - protein, 14 aa, Mycobacterium tuberculosis
FFGINTIPIALTEM

SEQ ID NO: 107932 - protein, 14 aa, Mycobacterium tuberculosis
FGINTIPIALTEMD

SEQ ID NO: 107933 - protein, 14 aa, Mycobacterium tuberculosis
GINTIPIALTEMDY

SEQ ID NO: 107934 - protein, 14 aa, Mycobacterium tuberculosis
INTIPIALTEMDYF

SEQ ID NO: 107935 - protein, 14 aa, Mycobacterium tuberculosis
NTIPIALTEMDYFI

SEQ ID NO: 107936 - protein, 14 aa, Mycobacterium tuberculosis
TIPIALTEMDYFIR

SEQ ID NO: 107937 - protein, 14 aa, Mycobacterium tuberculosis
IPIALTEMDYFIRM

SEQ ID NO: 107938 - protein, 14 aa, Mycobacterium tuberculosis
PIALTEMDYFIRMW

SEQ ID NO: 107939 - protein, 14 aa, Mycobacterium tuberculosis
IALTEMDYFIRMWN

SEQ ID NO: 107940 - protein, 14 aa, Mycobacterium tuberculosis
ALTEMDYFIRMWNQ

SEQ ID NO: 107941 - protein, 14 aa, Mycobacterium tuberculosis
LTEMDYFIRMWNQA

SEQ ID NO: 107942 - protein, 14 aa, Mycobacterium tuberculosis
TEMDYFIRMWNQAA

SEQ ID NO: 107943 - protein, 14 aa, Mycobacterium tuberculosis
EMDYFIRMWNQAAL

SEQ ID NO: 107944 - protein, 14 aa, Mycobacterium tuberculosis
MDYFIRMWNQAALA

SEQ ID NO: 107945 - protein, 14 aa, Mycobacterium tuberculosis
DYFIRMWNQAALAM

SEQ ID NO: 107946 - protein, 14 aa, Mycobacterium tuberculosis
YFIRMWNQAALAME

SEQ ID NO: 107947 - protein, 14 aa, Mycobacterium tuberculosis
FIRMWNQAALAMEV

SEQ ID NO: 107948 - protein, 14 aa, Mycobacterium tuberculosis
IRMWNQAALAMEVY

SEQ ID NO: 107949 - protein, 14 aa, Mycobacterium tuberculosis
RMWNQAALAMEVYQ

SEQ ID NO: 107950 - protein, 14 aa, Mycobacterium tuberculosis
MWNQAALAMEVYQA

SEQ ID NO: 107951 - protein, 14 aa, Mycobacterium tuberculosis
WNQAALAMEVYQAE

SEQ ID NO: 107952 - protein, 14 aa, Mycobacterium tuberculosis
NQAALAMEVYQAET

SEQ ID NO: 107953 - protein, 14 aa, Mycobacterium tuberculosis
QAALAMEVYQAETA

SEQ ID NO: 107954 - protein, 14 aa, Mycobacterium tuberculosis
AALAMEVYQAETAV

SEQ ID NO: 107955 - protein, 14 aa, Mycobacterium tuberculosis
ALAMEVYQAETAVN

SEQ ID NO: 107956 - protein, 14 aa, Mycobacterium tuberculosis
LAMEVYQAETAVNT

SEQ ID NO: 107957 - protein, 14 aa, Mycobacterium tuberculosis
AMEVYQAETAVNTL

SEQ ID NO: 107958 - protein, 14 aa, Mycobacterium tuberculosis
MEVYQAETAVNTLF

SEQ ID NO: 107959 - protein, 14 aa, Mycobacterium tuberculosis
EVYQAETAVNTLFE

SEQ ID NO: 107960 - protein, 14 aa, Mycobacterium tuberculosis
VYQAETAVNTLFEK

SEQ ID NO: 107961 - protein, 14 aa, Mycobacterium tuberculosis
YQAETAVNTLFEKL

SEQ ID NO: 107962 - protein, 14 aa, Mycobacterium tuberculosis
QAETAVNTLFEKLE

SEQ ID NO: 107963 - protein, 14 aa, Mycobacterium tuberculosis
AETAVNTLFEKLEP

SEQ ID NO: 107964 - protein, 14 aa, Mycobacterium tuberculosis
ETAVNTLFEKLEPM

SEQ ID NO: 107965 - protein, 14 aa, Mycobacterium tuberculosis
TAVNTLFEKLEPMA

SEQ ID NO: 107966 - protein, 14 aa, Mycobacterium tuberculosis
AVNTLFEKLEPMAS

SEQ ID NO: 107967 - protein, 14 aa, Mycobacterium tuberculosis
VNTLFEKLEPMASI

SEQ ID NO: 107968 - protein, 14 aa, Mycobacterium tuberculosis
NTLFEKLEPMASIL

SEQ ID NO: 107969 - protein, 14 aa, Mycobacterium tuberculosis
TLFEKLEPMASILD

SEQ ID NO: 107970 - protein, 14 aa, Mycobacterium tuberculosis
LFEKLEPMASILDP

SEQ ID NO: 107971 - protein, 14 aa, Mycobacterium tuberculosis
FEKLEPMASILDPG

SEQ ID NO: 107972 - protein, 14 aa, Mycobacterium tuberculosis
EKLEPMASILDPGA

SEQ ID NO: 107973 - protein, 14 aa, Mycobacterium tuberculosis
KLEPMASILDPGAS

SEQ ID NO: 107974 - protein, 14 aa, Mycobacterium tuberculosis
LEPMASILDPGASQ

SEQ ID NO: 107975 - protein, 14 aa, Mycobacterium tuberculosis
EPMASILDPGASQS

SEQ ID NO: 107976 - protein, 14 aa, Mycobacterium tuberculosis
PMASILDPGASQST

SEQ ID NO: 107977 - protein, 14 aa, Mycobacterium tuberculosis
MASILDPGASQSTT

SEQ ID NO: 107978 - protein, 14 aa, Mycobacterium tuberculosis
ASILDPGASQSTTN

SEQ ID NO: 107979 - protein, 14 aa, Mycobacterium tuberculosis
SILDPGASQSTTNP

SEQ ID NO: 107980 - protein, 14 aa, Mycobacterium tuberculosis
ILDPGASQSTTNPI

SEQ ID NO: 107981 - protein, 14 aa, Mycobacterium tuberculosis
LDPGASQSTTNPIF

SEQ ID NO: 107982 - protein, 14 aa, Mycobacterium tuberculosis
DPGASQSTTNPIFG

SEQ ID NO: 107983 - protein, 14 aa, Mycobacterium tuberculosis
PGASQSTTNPIFGM

SEQ ID NO: 107984 - protein, 14 aa, Mycobacterium tuberculosis
GASQSTTNPIFGMP

SEQ ID NO: 107985 - protein, 14 aa, Mycobacterium tuberculosis
ASQSTTNPIFGMPS

SEQ ID NO: 107986 - protein, 14 aa, Mycobacterium tuberculosis
SQSTTNPIFGMPSP

SEQ ID NO: 107987 - protein, 14 aa, Mycobacterium tuberculosis
QSTTNPIFGMPSPG

SEQ ID NO: 107988 - protein, 14 aa, Mycobacterium tuberculosis
STTNPIFGMPSPGS

SEQ ID NO: 107989 - protein, 14 aa, Mycobacterium tuberculosis
TTNPIFGMPSPGSS

SEQ ID NO: 107990 - protein, 14 aa, Mycobacterium tuberculosis
TNPIFGMPSPGSST

SEQ ID NO: 107991 - protein, 14 aa, Mycobacterium tuberculosis
NPIFGMPSPGSSTP

SEQ ID NO: 107992 - protein, 14 aa, Mycobacterium tuberculosis
PIFGMPSPGSSTPV

SEQ ID NO: 107993 - protein, 14 aa, Mycobacterium tuberculosis
IFGMPSPGSSTPVG

SEQ ID NO: 107994 - protein, 14 aa, Mycobacterium tuberculosis
FGMPSPGSSTPVGQ

SEQ ID NO: 107995 - protein, 14 aa, Mycobacterium tuberculosis
GMPSPGSSTPVGQL

SEQ ID NO: 107996 - protein, 14 aa, Mycobacterium tuberculosis
MPSPGSSTPVGQLP

SEQ ID NO: 107997 - protein, 14 aa, Mycobacterium tuberculosis
PSPGSSTPVGQLPP

SEQ ID NO: 107998 - protein, 14 aa, Mycobacterium tuberculosis
SPGSSTPVGQLPPA

SEQ ID NO: 107999 - protein, 14 aa, Mycobacterium tuberculosis
PGSSTPVGQLPPAA

SEQ ID NO: 108000 - protein, 14 aa, Mycobacterium tuberculosis
GSSTPVGQLPPAAT

SEQ ID NO: 108001 - protein, 14 aa, Mycobacterium tuberculosis
SSTPVGQLPPAATQ

SEQ ID NO: 108002 - protein, 14 aa, Mycobacterium tuberculosis
STPVGQLPPAATQT

SEQ ID NO: 108003 - protein, 14 aa, Mycobacterium tuberculosis
TPVGQLPPAATQTL

SEQ ID NO: 108004 - protein, 14 aa, Mycobacterium tuberculosis
PVGQLPPAATQTLG

SEQ ID NO: 108005 - protein, 14 aa, Mycobacterium tuberculosis
VGQLPPAATQTLGQ

SEQ ID NO: 108006 - protein, 14 aa, Mycobacterium tuberculosis
GQLPPAATQTLGQL

SEQ ID NO: 108007 - protein, 14 aa, Mycobacterium tuberculosis
QLPPAATQTLGQLG

SEQ ID NO: 108008 - protein, 14 aa, Mycobacterium tuberculosis
LPPAATQTLGQLGE

SEQ ID NO: 108009 - protein, 14 aa, Mycobacterium tuberculosis
PPAATQTLGQLGEM

SEQ ID NO: 108010 - protein, 14 aa, Mycobacterium tuberculosis
PAATQTLGQLGEMS

SEQ ID NO: 108011 - protein, 14 aa, Mycobacterium tuberculosis
AATQTLGQLGEMSG

SEQ ID NO: 108012 - protein, 14 aa, Mycobacterium tuberculosis
ATQTLGQLGEMSGP

SEQ ID NO: 108013 - protein, 14 aa, Mycobacterium tuberculosis
TQTLGQLGEMSGPM

SEQ ID NO: 108014 - protein, 14 aa, Mycobacterium tuberculosis
QTLGQLGEMSGPMQ

SEQ ID NO: 108015 - protein, 14 aa, Mycobacterium tuberculosis
TLGQLGEMSGPMQQ

SEQ ID NO: 108016 - protein, 14 aa, Mycobacterium tuberculosis
LGQLGEMSGPMQQL

SEQ ID NO: 108017 - protein, 14 aa, Mycobacterium tuberculosis
GQLGEMSGPMQQLT

SEQ ID NO: 108018 - protein, 14 aa, Mycobacterium tuberculosis
QLGEMSGPMQQLTQ

SEQ ID NO: 108019 - protein, 14 aa, Mycobacterium tuberculosis
LGEMSGPMQQLTQP

SEQ ID NO: 108020 - protein, 14 aa, Mycobacterium tuberculosis
GEMSGPMQQLTQPL

SEQ ID NO: 108021 - protein, 14 aa, Mycobacterium tuberculosis
EMSGPMQQLTQPLQ

SEQ ID NO: 108022 - protein, 14 aa, Mycobacterium tuberculosis
MSGPMQQLTQPLQQ

SEQ ID NO: 108023 - protein, 14 aa, Mycobacterium tuberculosis
SGPMQQLTQPLQQV

SEQ ID NO: 108024 - protein, 14 aa, Mycobacterium tuberculosis
GPMQQLTQPLQQVT

SEQ ID NO: 108025 - protein, 14 aa, Mycobacterium tuberculosis
PMQQLTQPLQQVTS

SEQ ID NO: 108026 - protein, 14 aa, Mycobacterium tuberculosis
MQQLTQPLQQVTSL

SEQ ID NO: 108027 - protein, 14 aa, Mycobacterium tuberculosis
QQLTQPLQQVTSLF

SEQ ID NO: 108028 - protein, 14 aa, Mycobacterium tuberculosis
QLTQPLQQVTSLFS

SEQ ID NO: 108029 - protein, 14 aa, Mycobacterium tuberculosis
LTQPLQQVTSLFSQ

SEQ ID NO: 108030 - protein, 14 aa, Mycobacterium tuberculosis
TQPLQQVTSLFSQV

SEQ ID NO: 108031 - protein, 14 aa, Mycobacterium tuberculosis
QPLQQVTSLFSQVG

SEQ ID NO: 108032 - protein, 14 aa, Mycobacterium tuberculosis
PLQQVTSLFSQVGG

SEQ ID NO: 108033 - protein, 14 aa, Mycobacterium tuberculosis
LQQVTSLFSQVGGT

SEQ ID NO: 108034 - protein, 14 aa, Mycobacterium tuberculosis
QQVTSLFSQVGGTG

SEQ ID NO: 108035 - protein, 14 aa, Mycobacterium tuberculosis
QVTSLFSQVGGTGG

SEQ ID NO: 108036 - protein, 14 aa, Mycobacterium tuberculosis
VTSLFSQVGGTGGG

SEQ ID NO: 108037 - protein, 14 aa, Mycobacterium tuberculosis
TSLFSQVGGTGGGN

SEQ ID NO: 108038 - protein, 14 aa, Mycobacterium tuberculosis
SLFSQVGGTGGGNP

SEQ ID NO: 108039 - protein, 14 aa, Mycobacterium tuberculosis
LFSQVGGTGGGNPA

SEQ ID NO: 108040 - protein, 14 aa, Mycobacterium tuberculosis
FSQVGGTGGGNPAD

SEQ ID NO: 108041 - protein, 14 aa, Mycobacterium tuberculosis
SQVGGTGGGNPADE

SEQ ID NO: 108042 - protein, 14 aa, Mycobacterium tuberculosis
QVGGTGGGNPADEE

SEQ ID NO: 108043 - protein, 14 aa, Mycobacterium tuberculosis
VGGTGGGNPADEEA

SEQ ID NO: 108044 - protein, 14 aa, Mycobacterium tuberculosis
GGTGGGNPADEEAA

SEQ ID NO: 108045 - protein, 14 aa, Mycobacterium tuberculosis
GTGGGNPADEEAAQ

SEQ ID NO: 108046 - protein, 14 aa, Mycobacterium tuberculosis
TGGGNPADEEAAQM

SEQ ID NO: 108047 - protein, 14 aa, Mycobacterium tuberculosis
GGGNPADEEAAQMG

SEQ ID NO: 108048 - protein, 14 aa, Mycobacterium tuberculosis
GGNPADEEAAQMGL

SEQ ID NO: 108049 - protein, 14 aa, Mycobacterium tuberculosis
GNPADEEAAQMGLL

SEQ ID NO: 108050 - protein, 14 aa, Mycobacterium tuberculosis
NPADEEAAQMGLLG

SEQ ID NO: 108051 - protein, 14 aa, Mycobacterium tuberculosis
PADEEAAQMGLLGT

SEQ ID NO: 108052 - protein, 14 aa, Mycobacterium tuberculosis
ADEEAAQMGLLGTS

SEQ ID NO: 108053 - protein, 14 aa, Mycobacterium tuberculosis
DEEAAQMGLLGTSP

SEQ ID NO: 108054 - protein, 14 aa, Mycobacterium tuberculosis
EEAAQMGLLGTSPL

SEQ ID NO: 108055 - protein, 14 aa, Mycobacterium tuberculosis
EAAQMGLLGTSPLS

SEQ ID NO: 108056 - protein, 14 aa, Mycobacterium tuberculosis
AAQMGLLGTSPLSN

SEQ ID NO: 108057 - protein, 14 aa, Mycobacterium tuberculosis
AQMGLLGTSPLSNH

SEQ ID NO: 108058 - protein, 14 aa, Mycobacterium tuberculosis
QMGLLGTSPLSNHP

SEQ ID NO: 108059 - protein, 14 aa, Mycobacterium tuberculosis
MGLLGTSPLSNHPL

SEQ ID NO: 108060 - protein, 14 aa, Mycobacterium tuberculosis
GLLGTSPLSNHPLA

SEQ ID NO: 108061 - protein, 14 aa, Mycobacterium tuberculosis
LLGTSPLSNHPLAG

SEQ ID NO: 108062 - protein, 14 aa, Mycobacterium tuberculosis
LGTSPLSNHPLAGG

SEQ ID NO: 108063 - protein, 14 aa, Mycobacterium tuberculosis
GTSPLSNHPLAGGS

SEQ ID NO: 108064 - protein, 14 aa, Mycobacterium tuberculosis
TSPLSNHPLAGGSG

SEQ ID NO: 108065 - protein, 14 aa, Mycobacterium tuberculosis
SPLSNHPLAGGSGP

SEQ ID NO: 108066 - protein, 14 aa, Mycobacterium tuberculosis
PLSNHPLAGGSGPS

SEQ ID NO: 108067 - protein, 14 aa, Mycobacterium tuberculosis
LSNHPLAGGSGPSA

SEQ ID NO: 108068 - protein, 14 aa, Mycobacterium tuberculosis
SNHPLAGGSGPSAG

SEQ ID NO: 108069 - protein, 14 aa, Mycobacterium tuberculosis
NHPLAGGSGPSAGA

SEQ ID NO: 108070 - protein, 14 aa, Mycobacterium tuberculosis
HPLAGGSGPSAGAG

SEQ ID NO: 108071 - protein, 14 aa, Mycobacterium tuberculosis
PLAGGSGPSAGAGL

SEQ ID NO: 108072 - protein, 14 aa, Mycobacterium tuberculosis
LAGGSGPSAGAGLL

SEQ ID NO: 108073 - protein, 14 aa, Mycobacterium tuberculosis
AGGSGPSAGAGLLR

SEQ ID NO: 108074 - protein, 14 aa, Mycobacterium tuberculosis
GGSGPSAGAGLLRA

SEQ ID NO: 108075 - protein, 14 aa, Mycobacterium tuberculosis
GSGPSAGAGLLRAE

SEQ ID NO: 108076 - protein, 14 aa, Mycobacterium tuberculosis
SGPSAGAGLLRAES

SEQ ID NO: 108077 - protein, 14 aa, Mycobacterium tuberculosis
GPSAGAGLLRAESL

SEQ ID NO: 108078 - protein, 14 aa, Mycobacterium tuberculosis
PSAGAGLLRAESLP

SEQ ID NO: 108079 - protein, 14 aa, Mycobacterium tuberculosis
SAGAGLLRAESLPG

SEQ ID NO: 108080 - protein, 14 aa, Mycobacterium tuberculosis
AGAGLLRAESLPGA

SEQ ID NO: 108081 - protein, 14 aa, Mycobacterium tuberculosis
GAGLLRAESLPGAG

SEQ ID NO: 108082 - protein, 14 aa, Mycobacterium tuberculosis
AGLLRAESLPGAGG

SEQ ID NO: 108083 - protein, 14 aa, Mycobacterium tuberculosis
GLLRAESLPGAGGS

SEQ ID NO: 108084 - protein, 14 aa, Mycobacterium tuberculosis
LLRAESLPGAGGSL

SEQ ID NO: 108085 - protein, 14 aa, Mycobacterium tuberculosis
LRAESLPGAGGSLT

SEQ ID NO: 108086 - protein, 14 aa, Mycobacterium tuberculosis
RAESLPGAGGSLTR

SEQ ID NO: 108087 - protein, 14 aa, Mycobacterium tuberculosis
AESLPGAGGSLTRT

SEQ ID NO: 108088 - protein, 14 aa, Mycobacterium tuberculosis
ESLPGAGGSLTRTP

SEQ ID NO: 108089 - protein, 14 aa, Mycobacterium tuberculosis
SLPGAGGSLTRTPL

SEQ ID NO: 108090 - protein, 14 aa, Mycobacterium tuberculosis
LPGAGGSLTRTPLM

SEQ ID NO: 108091 - protein, 14 aa, Mycobacterium tuberculosis
PGAGGSLTRTPLMS

SEQ ID NO: 108092 - protein, 14 aa, Mycobacterium tuberculosis
GAGGSLTRTPLMSQ

SEQ ID NO: 108093 - protein, 14 aa, Mycobacterium tuberculosis
AGGSLTRTPLMSQL

SEQ ID NO: 108094 - protein, 14 aa, Mycobacterium tuberculosis
GGSLTRTPLMSQLI

SEQ ID NO: 108095 - protein, 14 aa, Mycobacterium tuberculosis
GSLTRTPLMSQLIE

SEQ ID NO: 108096 - protein, 14 aa, Mycobacterium tuberculosis
SLTRTPLMSQLIEK

SEQ ID NO: 108097 - protein, 14 aa, Mycobacterium tuberculosis
LTRTPLMSQLIEKP

SEQ ID NO: 108098 - protein, 14 aa, Mycobacterium tuberculosis
TRTPLMSQLIEKPV

SEQ ID NO: 108099 - protein, 14 aa, Mycobacterium tuberculosis
RTPLMSQLIEKPVA

SEQ ID NO: 108100 - protein, 14 aa, Mycobacterium tuberculosis
TPLMSQLIEKPVAP

SEQ ID NO: 108101 - protein, 14 aa, Mycobacterium tuberculosis
PLMSQLIEKPVAPS

SEQ ID NO: 108102 - protein, 14 aa, Mycobacterium tuberculosis
LMSQLIEKPVAPSV

SEQ ID NO: 108103 - protein, 14 aa, Mycobacterium tuberculosis
MSQLIEKPVAPSVM

SEQ ID NO: 108104 - protein, 14 aa, Mycobacterium tuberculosis
SQLIEKPVAPSVMP

SEQ ID NO: 108105 - protein, 14 aa, Mycobacterium tuberculosis
QLIEKPVAPSVMPA

SEQ ID NO: 108106 - protein, 14 aa, Mycobacterium tuberculosis
LIEKPVAPSVMPAA

SEQ ID NO: 108107 - protein, 14 aa, Mycobacterium tuberculosis
IEKPVAPSVMPAAA

SEQ ID NO: 108108 - protein, 14 aa, Mycobacterium tuberculosis
EKPVAPSVMPAAAA

SEQ ID NO: 108109 - protein, 14 aa, Mycobacterium tuberculosis
KPVAPSVMPAAAAG

SEQ ID NO: 108110 - protein, 14 aa, Mycobacterium tuberculosis
PVAPSVMPAAAAGS

SEQ ID NO: 108111 - protein, 14 aa, Mycobacterium tuberculosis
VAPSVMPAAAAGSS

SEQ ID NO: 108112 - protein, 14 aa, Mycobacterium tuberculosis
APSVMPAAAAGSSA

SEQ ID NO: 108113 - protein, 14 aa, Mycobacterium tuberculosis
PSVMPAAAAGSSAT

SEQ ID NO: 108114 - protein, 14 aa, Mycobacterium tuberculosis
SVMPAAAAGSSATG

SEQ ID NO: 108115 - protein, 14 aa, Mycobacterium tuberculosis
VMPAAAAGSSATGG

SEQ ID NO: 108116 - protein, 14 aa, Mycobacterium tuberculosis
MPAAAAGSSATGGA

SEQ ID NO: 108117 - protein, 14 aa, Mycobacterium tuberculosis
PAAAAGSSATGGAA

SEQ ID NO: 108118 - protein, 14 aa, Mycobacterium tuberculosis
AAAAGSSATGGAAP

SEQ ID NO: 108119 - protein, 14 aa, Mycobacterium tuberculosis
AAAGSSATGGAAPV

SEQ ID NO: 108120 - protein, 14 aa, Mycobacterium tuberculosis
AAGSSATGGAAPVG

SEQ ID NO: 108121 - protein, 14 aa, Mycobacterium tuberculosis
AGSSATGGAAPVGA

SEQ ID NO: 108122 - protein, 14 aa, Mycobacterium tuberculosis
GSSATGGAAPVGAG

SEQ ID NO: 108123 - protein, 14 aa, Mycobacterium tuberculosis
SSATGGAAPVGAGA

SEQ ID NO: 108124 - protein, 14 aa, Mycobacterium tuberculosis
SATGGAAPVGAGAM

SEQ ID NO: 108125 - protein, 14 aa, Mycobacterium tuberculosis
ATGGAAPVGAGAMG

SEQ ID NO: 108126 - protein, 14 aa, Mycobacterium tuberculosis
TGGAAPVGAGAMGQ

SEQ ID NO: 108127 - protein, 14 aa, Mycobacterium tuberculosis
GGAAPVGAGAMGQG

SEQ ID NO: 108128 - protein, 14 aa, Mycobacterium tuberculosis
GAAPVGAGAMGQGA

SEQ ID NO: 108129 - protein, 14 aa, Mycobacterium tuberculosis
AAPVGAGAMGQGAQ

SEQ ID NO: 108130 - protein, 14 aa, Mycobacterium tuberculosis
APVGAGAMGQGAQS

SEQ ID NO: 108131 - protein, 14 aa, Mycobacterium tuberculosis
PVGAGAMGQGAQSG

SEQ ID NO: 108132 - protein, 14 aa, Mycobacterium tuberculosis
VGAGAMGQGAQSGG

SEQ ID NO: 108133 - protein, 14 aa, Mycobacterium tuberculosis
GAGAMGQGAQSGGS

SEQ ID NO: 108134 - protein, 14 aa, Mycobacterium tuberculosis
AGAMGQGAQSGGST

SEQ ID NO: 108135 - protein, 14 aa, Mycobacterium tuberculosis
GAMGQGAQSGGSTR

SEQ ID NO: 108136 - protein, 14 aa, Mycobacterium tuberculosis
AMGQGAQSGGSTRP

SEQ ID NO: 108137 - protein, 14 aa, Mycobacterium tuberculosis
MGQGAQSGGSTRPG

SEQ ID NO: 108138 - protein, 14 aa, Mycobacterium tuberculosis
GQGAQSGGSTRPGL

SEQ ID NO: 108139 - protein, 14 aa, Mycobacterium tuberculosis
QGAQSGGSTRPGLV

SEQ ID NO: 108140 - protein, 14 aa, Mycobacterium tuberculosis
GAQSGGSTRPGLVA

SEQ ID NO: 108141 - protein, 14 aa, Mycobacterium tuberculosis
AQSGGSTRPGLVAP

SEQ ID NO: 108142 - protein, 14 aa, Mycobacterium tuberculosis
QSGGSTRPGLVAPA

SEQ ID NO: 108143 - protein, 14 aa, Mycobacterium tuberculosis
SGGSTRPGLVAPAP

SEQ ID NO: 108144 - protein, 14 aa, Mycobacterium tuberculosis
GGSTRPGLVAPAPL

SEQ ID NO: 108145 - protein, 14 aa, Mycobacterium tuberculosis
GSTRPGLVAPAPLA

SEQ ID NO: 108146 - protein, 14 aa, Mycobacterium tuberculosis
STRPGLVAPAPLAQ

SEQ ID NO: 108147 - protein, 14 aa, Mycobacterium tuberculosis
TRPGLVAPAPLAQE

SEQ ID NO: 108148 - protein, 14 aa, Mycobacterium tuberculosis
RPGLVAPAPLAQER

SEQ ID NO: 108149 - protein, 14 aa, Mycobacterium tuberculosis
PGLVAPAPLAQERE

SEQ ID NO: 108150 - protein, 14 aa, Mycobacterium tuberculosis
GLVAPAPLAQEREE

SEQ ID NO: 108151 - protein, 14 aa, Mycobacterium tuberculosis
LVAPAPLAQEREED

SEQ ID NO: 108152 - protein, 14 aa, Mycobacterium tuberculosis
VAPAPLAQEREEDD

SEQ ID NO: 108153 - protein, 14 aa, Mycobacterium tuberculosis
APAPLAQEREEDDE

SEQ ID NO: 108154 - protein, 14 aa, Mycobacterium tuberculosis
PAPLAQEREEDDED

SEQ ID NO: 108155 - protein, 14 aa, Mycobacterium tuberculosis
APLAQEREEDDEDD

SEQ ID NO: 108156 - protein, 14 aa, Mycobacterium tuberculosis
PLAQEREEDDEDDW

SEQ ID NO: 108157 - protein, 14 aa, Mycobacterium tuberculosis
LAQEREEDDEDDWD

SEQ ID NO: 108158 - protein, 14 aa, Mycobacterium tuberculosis
AQEREEDDEDDWDE

SEQ ID NO: 108159 - protein, 14 aa, Mycobacterium tuberculosis
QEREEDDEDDWDEE

SEQ ID NO: 108160 - protein, 14 aa, Mycobacterium tuberculosis
EREEDDEDDWDEED

SEQ ID NO: 108161 - protein, 14 aa, Mycobacterium tuberculosis
REEDDEDDWDEEDD

SEQ ID NO: 108162 - protein, 14 aa, Mycobacterium tuberculosis
EEDDEDDWDEEDDW

SEQ ID NO: 108163 - protein, 15 aa, Mycobacterium tuberculosis
MLWHAMPPELNTARL

SEQ ID NO: 108164 - protein, 15 aa, Mycobacterium tuberculosis
LWHAMPPELNTARLM

SEQ ID NO: 108165 - protein, 15 aa, Mycobacterium tuberculosis
WHAMPPELNTARLMA

SEQ ID NO: 108166 - protein, 15 aa, Mycobacterium tuberculosis
HAMPPELNTARLMAG

SEQ ID NO: 108167 - protein, 15 aa, Mycobacterium tuberculosis
AMPPELNTARLMAGA

SEQ ID NO: 108168 - protein, 15 aa, Mycobacterium tuberculosis
MPPELNTARLMAGAG

SEQ ID NO: 108169 - protein, 15 aa, Mycobacterium tuberculosis
PPELNTARLMAGAGP

SEQ ID NO: 108170 - protein, 15 aa, Mycobacterium tuberculosis
PELNTARLMAGAGPA

SEQ ID NO: 108171 - protein, 15 aa, Mycobacterium tuberculosis
ELNTARLMAGAGPAP

SEQ ID NO: 108172 - protein, 15 aa, Mycobacterium tuberculosis
LNTARLMAGAGPAPM

SEQ ID NO: 108173 - protein, 15 aa, Mycobacterium tuberculosis
NTARLMAGAGPAPML

SEQ ID NO: 108174 - protein, 15 aa, Mycobacterium tuberculosis
TARLMAGAGPAPMLA

SEQ ID NO: 108175 - protein, 15 aa, Mycobacterium tuberculosis
ARLMAGAGPAPMLAA

SEQ ID NO: 108176 - protein, 15 aa, Mycobacterium tuberculosis
RLMAGAGPAPMLAAA

SEQ ID NO: 108177 - protein, 15 aa, Mycobacterium tuberculosis
LMAGAGPAPMLAAAA

SEQ ID NO: 108178 - protein, 15 aa, Mycobacterium tuberculosis
MAGAGPAPMLAAAAG

SEQ ID NO: 108179 - protein, 15 aa, Mycobacterium tuberculosis
AGAGPAPMLAAAAGW

SEQ ID NO: 108180 - protein, 15 aa, Mycobacterium tuberculosis
GAGPAPMLAAAAGWQ

SEQ ID NO: 108181 - protein, 15 aa, Mycobacterium tuberculosis
AGPAPMLAAAAGWQT

SEQ ID NO: 108182 - protein, 15 aa, Mycobacterium tuberculosis
GPAPMLAAAAGWQTL

SEQ ID NO: 108183 - protein, 15 aa, Mycobacterium tuberculosis
PAPMLAAAAGWQTLS

SEQ ID NO: 108184 - protein, 15 aa, Mycobacterium tuberculosis
APMLAAAAGWQTLSA

SEQ ID NO: 108185 - protein, 15 aa, Mycobacterium tuberculosis
PMLAAAAGWQTLSAA

SEQ ID NO: 108186 - protein, 15 aa, Mycobacterium tuberculosis
MLAAAAGWQTLSAAL

SEQ ID NO: 108187 - protein, 15 aa, Mycobacterium tuberculosis
LAAAAGWQTLSAALD

SEQ ID NO: 108188 - protein, 15 aa, Mycobacterium tuberculosis
AAAAGWQTLSAALDA

SEQ ID NO: 108189 - protein, 15 aa, Mycobacterium tuberculosis
AAAGWQTLSAALDAQ

SEQ ID NO: 108190 - protein, 15 aa, Mycobacterium tuberculosis
AAGWQTLSAALDAQA

SEQ ID NO: 108191 - protein, 15 aa, Mycobacterium tuberculosis
AGWQTLSAALDAQAV

SEQ ID NO: 108192 - protein, 15 aa, Mycobacterium tuberculosis
GWQTLSAALDAQAVE

SEQ ID NO: 108193 - protein, 15 aa, Mycobacterium tuberculosis
WQTLSAALDAQAVEL

SEQ ID NO: 108194 - protein, 15 aa, Mycobacterium tuberculosis
QTLSAALDAQAVELT

SEQ ID NO: 108195 - protein, 15 aa, Mycobacterium tuberculosis
TLSAALDAQAVELTA

SEQ ID NO: 108196 - protein, 15 aa, Mycobacterium tuberculosis
LSAALDAQAVELTAR

SEQ ID NO: 108197 - protein, 15 aa, Mycobacterium tuberculosis
SAALDAQAVELTARL

SEQ ID NO: 108198 - protein, 15 aa, Mycobacterium tuberculosis
AALDAQAVELTARLN

SEQ ID NO: 108199 - protein, 15 aa, Mycobacterium tuberculosis
ALDAQAVELTARLNS

SEQ ID NO: 108200 - protein, 15 aa, Mycobacterium tuberculosis
LDAQAVELTARLNSL

SEQ ID NO: 108201 - protein, 15 aa, Mycobacterium tuberculosis
DAQAVELTARLNSLG

SEQ ID NO: 108202 - protein, 15 aa, Mycobacterium tuberculosis
AQAVELTARLNSLGE

SEQ ID NO: 108203 - protein, 15 aa, Mycobacterium tuberculosis
QAVELTARLNSLGEA

SEQ ID NO: 108204 - protein, 15 aa, Mycobacterium tuberculosis
AVELTARLNSLGEAW

SEQ ID NO: 108205 - protein, 15 aa, Mycobacterium tuberculosis
VELTARLNSLGEAWT

SEQ ID NO: 108206 - protein, 15 aa, Mycobacterium tuberculosis
ELTARLNSLGEAWTG

SEQ ID NO: 108207 - protein, 15 aa, Mycobacterium tuberculosis
LTARLNSLGEAWTGG

SEQ ID NO: 108208 - protein, 15 aa, Mycobacterium tuberculosis
TARLNSLGEAWTGGG

SEQ ID NO: 108209 - protein, 15 aa, Mycobacterium tuberculosis
ARLNSLGEAWTGGGS

SEQ ID NO: 108210 - protein, 15 aa, Mycobacterium tuberculosis
RLNSLGEAWTGGGSD

SEQ ID NO: 108211 - protein, 15 aa, Mycobacterium tuberculosis
LNSLGEAWTGGGSDK

SEQ ID NO: 108212 - protein, 15 aa, Mycobacterium tuberculosis
NSLGEAWTGGGSDKA

SEQ ID NO: 108213 - protein, 15 aa, Mycobacterium tuberculosis
SLGEAWTGGGSDKAL

SEQ ID NO: 108214 - protein, 15 aa, Mycobacterium tuberculosis
LGEAWTGGGSDKALA

SEQ ID NO: 108215 - protein, 15 aa, Mycobacterium tuberculosis
GEAWTGGGSDKALAA

SEQ ID NO: 108216 - protein, 15 aa, Mycobacterium tuberculosis
EAWTGGGSDKALAAA

SEQ ID NO: 108217 - protein, 15 aa, Mycobacterium tuberculosis
AWTGGGSDKALAAAT

SEQ ID NO: 108218 - protein, 15 aa, Mycobacterium tuberculosis
WTGGGSDKALAAATP

SEQ ID NO: 108219 - protein, 15 aa, Mycobacterium tuberculosis
TGGGSDKALAAATPM

SEQ ID NO: 108220 - protein, 15 aa, Mycobacterium tuberculosis
GGGSDKALAAATPMV

SEQ ID NO: 108221 - protein, 15 aa, Mycobacterium tuberculosis
GGSDKALAAATPMVV

SEQ ID NO: 108222 - protein, 15 aa, Mycobacterium tuberculosis
GSDKALAAATPMVVW

SEQ ID NO: 108223 - protein, 15 aa, Mycobacterium tuberculosis
SDKALAAATPMVVWL

SEQ ID NO: 108224 - protein, 15 aa, Mycobacterium tuberculosis
DKALAAATPMVVWLQ

SEQ ID NO: 108225 - protein, 15 aa, Mycobacterium tuberculosis
KALAAATPMVVWLQT

SEQ ID NO: 108226 - protein, 15 aa, Mycobacterium tuberculosis
ALAAATPMVVWLQTA

SEQ ID NO: 108227 - protein, 15 aa, Mycobacterium tuberculosis
LAAATPMVVWLQTAS

SEQ ID NO: 108228 - protein, 15 aa, Mycobacterium tuberculosis
AAATPMVVWLQTAST

SEQ ID NO: 108229 - protein, 15 aa, Mycobacterium tuberculosis
AATPMVVWLQTASTQ

SEQ ID NO: 108230 - protein, 15 aa, Mycobacterium tuberculosis
ATPMVVWLQTASTQA

SEQ ID NO: 108231 - protein, 15 aa, Mycobacterium tuberculosis
TPMVVWLQTASTQAK

SEQ ID NO: 108232 - protein, 15 aa, Mycobacterium tuberculosis
PMVVWLQTASTQAKT

SEQ ID NO: 108233 - protein, 15 aa, Mycobacterium tuberculosis
MVVWLQTASTQAKTR

SEQ ID NO: 108234 - protein, 15 aa, Mycobacterium tuberculosis
VVWLQTASTQAKTRA

SEQ ID NO: 108235 - protein, 15 aa, Mycobacterium tuberculosis
VWLQTASTQAKTRAM

SEQ ID NO: 108236 - protein, 15 aa, Mycobacterium tuberculosis
WLQTASTQAKTRAMQ

SEQ ID NO: 108237 - protein, 15 aa, Mycobacterium tuberculosis
LQTASTQAKTRAMQA

SEQ ID NO: 108238 - protein, 15 aa, Mycobacterium tuberculosis
QTASTQAKTRAMQAT

SEQ ID NO: 108239 - protein, 15 aa, Mycobacterium tuberculosis
TASTQAKTRAMQATA

SEQ ID NO: 108240 - protein, 15 aa, Mycobacterium tuberculosis
ASTQAKTRAMQATAQ

SEQ ID NO: 108241 - protein, 15 aa, Mycobacterium tuberculosis
STQAKTRAMQATAQA

SEQ ID NO: 108242 - protein, 15 aa, Mycobacterium tuberculosis
TQAKTRAMQATAQAA

SEQ ID NO: 108243 - protein, 15 aa, Mycobacterium tuberculosis
QAKTRAMQATAQAAA

SEQ ID NO: 108244 - protein, 15 aa, Mycobacterium tuberculosis
AKTRAMQATAQAAAY

SEQ ID NO: 108245 - protein, 15 aa, Mycobacterium tuberculosis
KTRAMQATAQAAAYT

SEQ ID NO: 108246 - protein, 15 aa, Mycobacterium tuberculosis
TRAMQATAQAAAYTQ

SEQ ID NO: 108247 - protein, 15 aa, Mycobacterium tuberculosis
RAMQATAQAAAYTQA

SEQ ID NO: 108248 - protein, 15 aa, Mycobacterium tuberculosis
AMQATAQAAAYTQAM

SEQ ID NO: 108249 - protein, 15 aa, Mycobacterium tuberculosis
MQATAQAAAYTQAMA

SEQ ID NO: 108250 - protein, 15 aa, Mycobacterium tuberculosis
QATAQAAAYTQAMAT

SEQ ID NO: 108251 - protein, 15 aa, Mycobacterium tuberculosis
ATAQAAAYTQAMATT

SEQ ID NO: 108252 - protein, 15 aa, Mycobacterium tuberculosis
TAQAAAYTQAMATTP

SEQ ID NO: 108253 - protein, 15 aa, Mycobacterium tuberculosis
AQAAAYTQAMATTPS

SEQ ID NO: 108254 - protein, 15 aa, Mycobacterium tuberculosis
QAAAYTQAMATTPSL

SEQ ID NO: 108255 - protein, 15 aa, Mycobacterium tuberculosis
AAAYTQAMATTPSLP

SEQ ID NO: 108256 - protein, 15 aa, Mycobacterium tuberculosis
AAYTQAMATTPSLPE

SEQ ID NO: 108257 - protein, 15 aa, Mycobacterium tuberculosis
AYTQAMATTPSLPEI

SEQ ID NO: 108258 - protein, 15 aa, Mycobacterium tuberculosis
YTQAMATTPSLPEIA

SEQ ID NO: 108259 - protein, 15 aa, Mycobacterium tuberculosis
TQAMATTPSLPEIAA

SEQ ID NO: 108260 - protein, 15 aa, Mycobacterium tuberculosis
QAMATTPSLPEIAAN

SEQ ID NO: 108261 - protein, 15 aa, Mycobacterium tuberculosis
AMATTPSLPEIAANH

SEQ ID NO: 108262 - protein, 15 aa, Mycobacterium tuberculosis
MATTPSLPEIAANHI

SEQ ID NO: 108263 - protein, 15 aa, Mycobacterium tuberculosis
ATTPSLPEIAANHIT

SEQ ID NO: 108264 - protein, 15 aa, Mycobacterium tuberculosis
TTPSLPEIAANHITQ

SEQ ID NO: 108265 - protein, 15 aa, Mycobacterium tuberculosis
TPSLPEIAANHITQA

SEQ ID NO: 108266 - protein, 15 aa, Mycobacterium tuberculosis
PSLPEIAANHITQAV

SEQ ID NO: 108267 - protein, 15 aa, Mycobacterium tuberculosis
SLPEIAANHITQAVL

SEQ ID NO: 108268 - protein, 15 aa, Mycobacterium tuberculosis
LPEIAANHITQAVLT

SEQ ID NO: 108269 - protein, 15 aa, Mycobacterium tuberculosis
PEIAANHITQAVLTA

SEQ ID NO: 108270 - protein, 15 aa, Mycobacterium tuberculosis
EIAANHITQAVLTAT

SEQ ID NO: 108271 - protein, 15 aa, Mycobacterium tuberculosis
IAANHITQAVLTATN

SEQ ID NO: 108272 - protein, 15 aa, Mycobacterium tuberculosis
AANHITQAVLTATNF

SEQ ID NO: 108273 - protein, 15 aa, Mycobacterium tuberculosis
ANHITQAVLTATNFF

SEQ ID NO: 108274 - protein, 15 aa, Mycobacterium tuberculosis
NHITQAVLTATNFFG

SEQ ID NO: 108275 - protein, 15 aa, Mycobacterium tuberculosis
HITQAVLTATNFFGI

SEQ ID NO: 108276 - protein, 15 aa, Mycobacterium tuberculosis
ITQAVLTATNFFGIN

SEQ ID NO: 108277 - protein, 15 aa, Mycobacterium tuberculosis
TQAVLTATNFFGINT

SEQ ID NO: 108278 - protein, 15 aa, Mycobacterium tuberculosis
QAVLTATNFFGINTI

SEQ ID NO: 108279 - protein, 15 aa, Mycobacterium tuberculosis
AVLTATNFFGINTIP

SEQ ID NO: 108280 - protein, 15 aa, Mycobacterium tuberculosis
VLTATNFFGINTIPI

SEQ ID NO: 108281 - protein, 15 aa, Mycobacterium tuberculosis
LTATNFFGINTIPIA

SEQ ID NO: 108282 - protein, 15 aa, Mycobacterium tuberculosis
TATNFFGINTIPIAL

SEQ ID NO: 108283 - protein, 15 aa, Mycobacterium tuberculosis
ATNFFGINTIPIALT

SEQ ID NO: 108284 - protein, 15 aa, Mycobacterium tuberculosis
TNFFGINTIPIALTE

SEQ ID NO: 108285 - protein, 15 aa, Mycobacterium tuberculosis
NFFGINTIPIALTEM

SEQ ID NO: 108286 - protein, 15 aa, Mycobacterium tuberculosis
FFGINTIPIALTEMD

SEQ ID NO: 108287 - protein, 15 aa, Mycobacterium tuberculosis
FGINTIPIALTEMDY

SEQ ID NO: 108288 - protein, 15 aa, Mycobacterium tuberculosis
GINTIPIALTEMDYF

SEQ ID NO: 108289 - protein, 15 aa, Mycobacterium tuberculosis
INTIPIALTEMDYFI

SEQ ID NO: 108290 - protein, 15 aa, Mycobacterium tuberculosis
NTIPIALTEMDYFIR

SEQ ID NO: 108291 - protein, 15 aa, Mycobacterium tuberculosis
TIPIALTEMDYFIRM

SEQ ID NO: 108292 - protein, 15 aa, Mycobacterium tuberculosis
IPIALTEMDYFIRMW

SEQ ID NO: 108293 - protein, 15 aa, Mycobacterium tuberculosis
PIALTEMDYFIRMWN

SEQ ID NO: 108294 - protein, 15 aa, Mycobacterium tuberculosis
IALTEMDYFIRMWNQ

SEQ ID NO: 108295 - protein, 15 aa, Mycobacterium tuberculosis
ALTEMDYFIRMWNQA

SEQ ID NO: 108296 - protein, 15 aa, Mycobacterium tuberculosis
LTEMDYFIRMWNQAA

SEQ ID NO: 108297 - protein, 15 aa, Mycobacterium tuberculosis
TEMDYFIRMWNQAAL

SEQ ID NO: 108298 - protein, 15 aa, Mycobacterium tuberculosis
EMDYFIRMWNQAALA

SEQ ID NO: 108299 - protein, 15 aa, Mycobacterium tuberculosis
MDYFIRMWNQAALAM

SEQ ID NO: 108300 - protein, 15 aa, Mycobacterium tuberculosis
DYFIRMWNQAALAME

SEQ ID NO: 108301 - protein, 15 aa, Mycobacterium tuberculosis
YFIRMWNQAALAMEV

SEQ ID NO: 108302 - protein, 15 aa, Mycobacterium tuberculosis
FIRMWNQAALAMEVY

SEQ ID NO: 108303 - protein, 15 aa, Mycobacterium tuberculosis
IRMWNQAALAMEVYQ

SEQ ID NO: 108304 - protein, 15 aa, Mycobacterium tuberculosis
RMWNQAALAMEVYQA

SEQ ID NO: 108305 - protein, 15 aa, Mycobacterium tuberculosis
MWNQAALAMEVYQAE

SEQ ID NO: 108306 - protein, 15 aa, Mycobacterium tuberculosis
WNQAALAMEVYQAET

SEQ ID NO: 108307 - protein, 15 aa, Mycobacterium tuberculosis
NQAALAMEVYQAETA

SEQ ID NO: 108308 - protein, 15 aa, Mycobacterium tuberculosis
QAALAMEVYQAETAV

SEQ ID NO: 108309 - protein, 15 aa, Mycobacterium tuberculosis
AALAMEVYQAETAVN

SEQ ID NO: 108310 - protein, 15 aa, Mycobacterium tuberculosis
ALAMEVYQAETAVNT

SEQ ID NO: 108311 - protein, 15 aa, Mycobacterium tuberculosis
LAMEVYQAETAVNTL

SEQ ID NO: 108312 - protein, 15 aa, Mycobacterium tuberculosis
AMEVYQAETAVNTLF

SEQ ID NO: 108313 - protein, 15 aa, Mycobacterium tuberculosis
MEVYQAETAVNTLFE

SEQ ID NO: 108314 - protein, 15 aa, Mycobacterium tuberculosis
EVYQAETAVNTLFEK

SEQ ID NO: 108315 - protein, 15 aa, Mycobacterium tuberculosis
VYQAETAVNTLFEKL

SEQ ID NO: 108316 - protein, 15 aa, Mycobacterium tuberculosis
YQAETAVNTLFEKLE

SEQ ID NO: 108317 - protein, 15 aa, Mycobacterium tuberculosis
QAETAVNTLFEKLEP

SEQ ID NO: 108318 - protein, 15 aa, Mycobacterium tuberculosis
AETAVNTLFEKLEPM

SEQ ID NO: 108319 - protein, 15 aa, Mycobacterium tuberculosis
ETAVNTLFEKLEPMA

SEQ ID NO: 108320 - protein, 15 aa, Mycobacterium tuberculosis
TAVNTLFEKLEPMAS

SEQ ID NO: 108321 - protein, 15 aa, Mycobacterium tuberculosis
AVNTLFEKLEPMASI

SEQ ID NO: 108322 - protein, 15 aa, Mycobacterium tuberculosis
VNTLFEKLEPMASIL

SEQ ID NO: 108323 - protein, 15 aa, Mycobacterium tuberculosis
NTLFEKLEPMASILD

SEQ ID NO: 108324 - protein, 15 aa, Mycobacterium tuberculosis
TLFEKLEPMASILDP

SEQ ID NO: 108325 - protein, 15 aa, Mycobacterium tuberculosis
LFEKLEPMASILDPG

SEQ ID NO: 108326 - protein, 15 aa, Mycobacterium tuberculosis
FEKLEPMASILDPGA

SEQ ID NO: 108327 - protein, 15 aa, Mycobacterium tuberculosis
EKLEPMASILDPGAS

SEQ ID NO: 108328 - protein, 15 aa, Mycobacterium tuberculosis
KLEPMASILDPGASQ

SEQ ID NO: 108329 - protein, 15 aa, Mycobacterium tuberculosis
LEPMASILDPGASQS

SEQ ID NO: 108330 - protein, 15 aa, Mycobacterium tuberculosis
EPMASILDPGASQST

SEQ ID NO: 108331 - protein, 15 aa, Mycobacterium tuberculosis
PMASILDPGASQSTT

SEQ ID NO: 108332 - protein, 15 aa, Mycobacterium tuberculosis
MASILDPGASQSTTN

SEQ ID NO: 108333 - protein, 15 aa, Mycobacterium tuberculosis
ASILDPGASQSTTNP

SEQ ID NO: 108334 - protein, 15 aa, Mycobacterium tuberculosis
SILDPGASQSTTNPI

SEQ ID NO: 108335 - protein, 15 aa, Mycobacterium tuberculosis
ILDPGASQSTTNPIF

SEQ ID NO: 108336 - protein, 15 aa, Mycobacterium tuberculosis
LDPGASQSTTNPIFG

SEQ ID NO: 108337 - protein, 15 aa, Mycobacterium tuberculosis
DPGASQSTTNPIFGM

SEQ ID NO: 108338 - protein, 15 aa, Mycobacterium tuberculosis
PGASQSTTNPIFGMP

SEQ ID NO: 108339 - protein, 15 aa, Mycobacterium tuberculosis
GASQSTTNPIFGMPS

SEQ ID NO: 108340 - protein, 15 aa, Mycobacterium tuberculosis
ASQSTTNPIFGMPSP

SEQ ID NO: 108341 - protein, 15 aa, Mycobacterium tuberculosis
SQSTTNPIFGMPSPG

SEQ ID NO: 108342 - protein, 15 aa, Mycobacterium tuberculosis
QSTTNPIFGMPSPGS

SEQ ID NO: 108343 - protein, 15 aa, Mycobacterium tuberculosis
STTNPIFGMPSPGSS

SEQ ID NO: 108344 - protein, 15 aa, Mycobacterium tuberculosis
TTNPIFGMPSPGSST

SEQ ID NO: 108345 - protein, 15 aa, Mycobacterium tuberculosis
TNPIFGMPSPGSSTP

SEQ ID NO: 108346 - protein, 15 aa, Mycobacterium tuberculosis
NPIFGMPSPGSSTPV

SEQ ID NO: 108347 - protein, 15 aa, Mycobacterium tuberculosis
PIFGMPSPGSSTPVG

SEQ ID NO: 108348 - protein, 15 aa, Mycobacterium tuberculosis
IFGMPSPGSSTPVGQ

SEQ ID NO: 108349 - protein, 15 aa, Mycobacterium tuberculosis
FGMPSPGSSTPVGQL

SEQ ID NO: 108350 - protein, 15 aa, Mycobacterium tuberculosis
GMPSPGSSTPVGQLP

SEQ ID NO: 108351 - protein, 15 aa, Mycobacterium tuberculosis
MPSPGSSTPVGQLPP

SEQ ID NO: 108352 - protein, 15 aa, Mycobacterium tuberculosis
PSPGSSTPVGQLPPA

SEQ ID NO: 108353 - protein, 15 aa, Mycobacterium tuberculosis
SPGSSTPVGQLPPAA

SEQ ID NO: 108354 - protein, 15 aa, Mycobacterium tuberculosis
PGSSTPVGQLPPAAT

SEQ ID NO: 108355 - protein, 15 aa, Mycobacterium tuberculosis
GSSTPVGQLPPAATQ

SEQ ID NO: 108356 - protein, 15 aa, Mycobacterium tuberculosis
SSTPVGQLPPAATQT

SEQ ID NO: 108357 - protein, 15 aa, Mycobacterium tuberculosis
STPVGQLPPAATQTL

SEQ ID NO: 108358 - protein, 15 aa, Mycobacterium tuberculosis
TPVGQLPPAATQTLG

SEQ ID NO: 108359 - protein, 15 aa, Mycobacterium tuberculosis
PVGQLPPAATQTLGQ

SEQ ID NO: 108360 - protein, 15 aa, Mycobacterium tuberculosis
VGQLPPAATQTLGQL

SEQ ID NO: 108361 - protein, 15 aa, Mycobacterium tuberculosis
GQLPPAATQTLGQLG

SEQ ID NO: 108362 - protein, 15 aa, Mycobacterium tuberculosis
QLPPAATQTLGQLGE

SEQ ID NO: 108363 - protein, 15 aa, Mycobacterium tuberculosis
LPPAATQTLGQLGEM

SEQ ID NO: 108364 - protein, 15 aa, Mycobacterium tuberculosis
PPAATQTLGQLGEMS

SEQ ID NO: 108365 - protein, 15 aa, Mycobacterium tuberculosis
PAATQTLGQLGEMSG

SEQ ID NO: 108366 - protein, 15 aa, Mycobacterium tuberculosis
AATQTLGQLGEMSGP

SEQ ID NO: 108367 - protein, 15 aa, Mycobacterium tuberculosis
ATQTLGQLGEMSGPM

SEQ ID NO: 108368 - protein, 15 aa, Mycobacterium tuberculosis
TQTLGQLGEMSGPMQ

SEQ ID NO: 108369 - protein, 15 aa, Mycobacterium tuberculosis
QTLGQLGEMSGPMQQ

SEQ ID NO: 108370 - protein, 15 aa, Mycobacterium tuberculosis
TLGQLGEMSGPMQQL

SEQ ID NO: 108371 - protein, 15 aa, Mycobacterium tuberculosis
LGQLGEMSGPMQQLT

SEQ ID NO: 108372 - protein, 15 aa, Mycobacterium tuberculosis
GQLGEMSGPMQQLTQ

SEQ ID NO: 108373 - protein, 15 aa, Mycobacterium tuberculosis
QLGEMSGPMQQLTQP

SEQ ID NO: 108374 - protein, 15 aa, Mycobacterium tuberculosis
LGEMSGPMQQLTQPL

SEQ ID NO: 108375 - protein, 15 aa, Mycobacterium tuberculosis
GEMSGPMQQLTQPLQ

SEQ ID NO: 108376 - protein, 15 aa, Mycobacterium tuberculosis
EMSGPMQQLTQPLQQ

SEQ ID NO: 108377 - protein, 15 aa, Mycobacterium tuberculosis
MSGPMQQLTQPLQQV

SEQ ID NO: 108378 - protein, 15 aa, Mycobacterium tuberculosis
SGPMQQLTQPLQQVT

SEQ ID NO: 108379 - protein, 15 aa, Mycobacterium tuberculosis
GPMQQLTQPLQQVTS

SEQ ID NO: 108380 - protein, 15 aa, Mycobacterium tuberculosis
PMQQLTQPLQQVTSL

SEQ ID NO: 108381 - protein, 15 aa, Mycobacterium tuberculosis
MQQLTQPLQQVTSLF

SEQ ID NO: 108382 - protein, 15 aa, Mycobacterium tuberculosis
QQLTQPLQQVTSLFS

SEQ ID NO: 108383 - protein, 15 aa, Mycobacterium tuberculosis
QLTQPLQQVTSLFSQ

SEQ ID NO: 108384 - protein, 15 aa, Mycobacterium tuberculosis
LTQPLQQVTSLFSQV

SEQ ID NO: 108385 - protein, 15 aa, Mycobacterium tuberculosis
TQPLQQVTSLFSQVG

SEQ ID NO: 108386 - protein, 15 aa, Mycobacterium tuberculosis
QPLQQVTSLFSQVGG

SEQ ID NO: 108387 - protein, 15 aa, Mycobacterium tuberculosis
PLQQVTSLFSQVGGT

SEQ ID NO: 108388 - protein, 15 aa, Mycobacterium tuberculosis
LQQVTSLFSQVGGTG

SEQ ID NO: 108389 - protein, 15 aa, Mycobacterium tuberculosis
QQVTSLFSQVGGTGG

SEQ ID NO: 108390 - protein, 15 aa, Mycobacterium tuberculosis
QVTSLFSQVGGTGGG

SEQ ID NO: 108391 - protein, 15 aa, Mycobacterium tuberculosis
VTSLFSQVGGTGGGN

SEQ ID NO: 108392 - protein, 15 aa, Mycobacterium tuberculosis
TSLFSQVGGTGGGNP

SEQ ID NO: 108393 - protein, 15 aa, Mycobacterium tuberculosis
SLFSQVGGTGGGNPA

SEQ ID NO: 108394 - protein, 15 aa, Mycobacterium tuberculosis
LFSQVGGTGGGNPAD

SEQ ID NO: 108395 - protein, 15 aa, Mycobacterium tuberculosis
FSQVGGTGGGNPADE

SEQ ID NO: 108396 - protein, 15 aa, Mycobacterium tuberculosis
SQVGGTGGGNPADEE

SEQ ID NO: 108397 - protein, 15 aa, Mycobacterium tuberculosis
QVGGTGGGNPADEEA

SEQ ID NO: 108398 - protein, 15 aa, Mycobacterium tuberculosis
VGGTGGGNPADEEAA

SEQ ID NO: 108399 - protein, 15 aa, Mycobacterium tuberculosis
GGTGGGNPADEEAAQ

SEQ ID NO: 108400 - protein, 15 aa, Mycobacterium tuberculosis
GTGGGNPADEEAAQM

SEQ ID NO: 108401 - protein, 15 aa, Mycobacterium tuberculosis
TGGGNPADEEAAQMG

SEQ ID NO: 108402 - protein, 15 aa, Mycobacterium tuberculosis
GGGNPADEEAAQMGL

SEQ ID NO: 108403 - protein, 15 aa, Mycobacterium tuberculosis
GGNPADEEAAQMGLL

SEQ ID NO: 108404 - protein, 15 aa, Mycobacterium tuberculosis
GNPADEEAAQMGLLG

SEQ ID NO: 108405 - protein, 15 aa, Mycobacterium tuberculosis
NPADEEAAQMGLLGT

SEQ ID NO: 108406 - protein, 15 aa, Mycobacterium tuberculosis
PADEEAAQMGLLGTS

SEQ ID NO: 108407 - protein, 15 aa, Mycobacterium tuberculosis
ADEEAAQMGLLGTSP

SEQ ID NO: 108408 - protein, 15 aa, Mycobacterium tuberculosis
DEEAAQMGLLGTSPL

SEQ ID NO: 108409 - protein, 15 aa, Mycobacterium tuberculosis
EEAAQMGLLGTSPLS

SEQ ID NO: 108410 - protein, 15 aa, Mycobacterium tuberculosis
EAAQMGLLGTSPLSN

SEQ ID NO: 108411 - protein, 15 aa, Mycobacterium tuberculosis
AAQMGLLGTSPLSNH

SEQ ID NO: 108412 - protein, 15 aa, Mycobacterium tuberculosis
AQMGLLGTSPLSNHP

SEQ ID NO: 108413 - protein, 15 aa, Mycobacterium tuberculosis
QMGLLGTSPLSNHPL

SEQ ID NO: 108414 - protein, 15 aa, Mycobacterium tuberculosis
MGLLGTSPLSNHPLA

SEQ ID NO: 108415 - protein, 15 aa, Mycobacterium tuberculosis
GLLGTSPLSNHPLAG

SEQ ID NO: 108416 - protein, 15 aa, Mycobacterium tuberculosis
LLGTSPLSNHPLAGG

SEQ ID NO: 108417 - protein, 15 aa, Mycobacterium tuberculosis
LGTSPLSNHPLAGGS

SEQ ID NO: 108418 - protein, 15 aa, Mycobacterium tuberculosis
GTSPLSNHPLAGGSG

SEQ ID NO: 108419 - protein, 15 aa, Mycobacterium tuberculosis
TSPLSNHPLAGGSGP

SEQ ID NO: 108420 - protein, 15 aa, Mycobacterium tuberculosis
SPLSNHPLAGGSGPS

SEQ ID NO: 108421 - protein, 15 aa, Mycobacterium tuberculosis
PLSNHPLAGGSGPSA

SEQ ID NO: 108422 - protein, 15 aa, Mycobacterium tuberculosis
LSNHPLAGGSGPSAG

SEQ ID NO: 108423 - protein, 15 aa, Mycobacterium tuberculosis
SNHPLAGGSGPSAGA

SEQ ID NO: 108424 - protein, 15 aa, Mycobacterium tuberculosis
NHPLAGGSGPSAGAG

SEQ ID NO: 108425 - protein, 15 aa, Mycobacterium tuberculosis
HPLAGGSGPSAGAGL

SEQ ID NO: 108426 - protein, 15 aa, Mycobacterium tuberculosis
PLAGGSGPSAGAGLL

SEQ ID NO: 108427 - protein, 15 aa, Mycobacterium tuberculosis
LAGGSGPSAGAGLLR

SEQ ID NO: 108428 - protein, 15 aa, Mycobacterium tuberculosis
AGGSGPSAGAGLLRA

SEQ ID NO: 108429 - protein, 15 aa, Mycobacterium tuberculosis
GGSGPSAGAGLLRAE

SEQ ID NO: 108430 - protein, 15 aa, Mycobacterium tuberculosis
GSGPSAGAGLLRAES

SEQ ID NO: 108431 - protein, 15 aa, Mycobacterium tuberculosis
SGPSAGAGLLRAESL

SEQ ID NO: 108432 - protein, 15 aa, Mycobacterium tuberculosis
GPSAGAGLLRAESLP

SEQ ID NO: 108433 - protein, 15 aa, Mycobacterium tuberculosis
PSAGAGLLRAESLPG

SEQ ID NO: 108434 - protein, 15 aa, Mycobacterium tuberculosis
SAGAGLLRAESLPGA

SEQ ID NO: 108435 - protein, 15 aa, Mycobacterium tuberculosis
AGAGLLRAESLPGAG

SEQ ID NO: 108436 - protein, 15 aa, Mycobacterium tuberculosis
GAGLLRAESLPGAGG

SEQ ID NO: 108437 - protein, 15 aa, Mycobacterium tuberculosis
AGLLRAESLPGAGGS

SEQ ID NO: 108438 - protein, 15 aa, Mycobacterium tuberculosis
GLLRAESLPGAGGSL

SEQ ID NO: 108439 - protein, 15 aa, Mycobacterium tuberculosis
LLRAESLPGAGGSLT

SEQ ID NO: 108440 - protein, 15 aa, Mycobacterium tuberculosis
LRAESLPGAGGSLTR

SEQ ID NO: 108441 - protein, 15 aa, Mycobacterium tuberculosis
RAESLPGAGGSLTRT

SEQ ID NO: 108442 - protein, 15 aa, Mycobacterium tuberculosis
AESLPGAGGSLTRTP

SEQ ID NO: 108443 - protein, 15 aa, Mycobacterium tuberculosis
ESLPGAGGSLTRTPL

SEQ ID NO: 108444 - protein, 15 aa, Mycobacterium tuberculosis
SLPGAGGSLTRTPLM

SEQ ID NO: 108445 - protein, 15 aa, Mycobacterium tuberculosis
LPGAGGSLTRTPLMS

SEQ ID NO: 108446 - protein, 15 aa, Mycobacterium tuberculosis
PGAGGSLTRTPLMSQ

SEQ ID NO: 108447 - protein, 15 aa, Mycobacterium tuberculosis
GAGGSLTRTPLMSQL

SEQ ID NO: 108448 - protein, 15 aa, Mycobacterium tuberculosis
AGGSLTRTPLMSQLI

SEQ ID NO: 108449 - protein, 15 aa, Mycobacterium tuberculosis
GGSLTRTPLMSQLIE

SEQ ID NO: 108450 - protein, 15 aa, Mycobacterium tuberculosis
GSLTRTPLMSQLIEK

SEQ ID NO: 108451 - protein, 15 aa, Mycobacterium tuberculosis
SLTRTPLMSQLIEKP

SEQ ID NO: 108452 - protein, 15 aa, Mycobacterium tuberculosis
LTRTPLMSQLIEKPV

SEQ ID NO: 108453 - protein, 15 aa, Mycobacterium tuberculosis
TRTPLMSQLIEKPVA

SEQ ID NO: 108454 - protein, 15 aa, Mycobacterium tuberculosis
RTPLMSQLIEKPVAP

SEQ ID NO: 108455 - protein, 15 aa, Mycobacterium tuberculosis
TPLMSQLIEKPVAPS

SEQ ID NO: 108456 - protein, 15 aa, Mycobacterium tuberculosis
PLMSQLIEKPVAPSV

SEQ ID NO: 108457 - protein, 15 aa, Mycobacterium tuberculosis
LMSQLIEKPVAPSVM

SEQ ID NO: 108458 - protein, 15 aa, Mycobacterium tuberculosis
MSQLIEKPVAPSVMP

SEQ ID NO: 108459 - protein, 15 aa, Mycobacterium tuberculosis
SQLIEKPVAPSVMPA

SEQ ID NO: 108460 - protein, 15 aa, Mycobacterium tuberculosis
QLIEKPVAPSVMPAA

SEQ ID NO: 108461 - protein, 15 aa, Mycobacterium tuberculosis
LIEKPVAPSVMPAAA

SEQ ID NO: 108462 - protein, 15 aa, Mycobacterium tuberculosis
IEKPVAPSVMPAAAA

SEQ ID NO: 108463 - protein, 15 aa, Mycobacterium tuberculosis
EKPVAPSVMPAAAAG

SEQ ID NO: 108464 - protein, 15 aa, Mycobacterium tuberculosis
KPVAPSVMPAAAAGS

SEQ ID NO: 108465 - protein, 15 aa, Mycobacterium tuberculosis
PVAPSVMPAAAAGSS

SEQ ID NO: 108466 - protein, 15 aa, Mycobacterium tuberculosis
VAPSVMPAAAAGSSA

SEQ ID NO: 108467 - protein, 15 aa, Mycobacterium tuberculosis
APSVMPAAAAGSSAT

SEQ ID NO: 108468 - protein, 15 aa, Mycobacterium tuberculosis
PSVMPAAAAGSSATG

SEQ ID NO: 108469 - protein, 15 aa, Mycobacterium tuberculosis
SVMPAAAAGSSATGG

SEQ ID NO: 108470 - protein, 15 aa, Mycobacterium tuberculosis
VMPAAAAGSSATGGA

SEQ ID NO: 108471 - protein, 15 aa, Mycobacterium tuberculosis
MPAAAAGSSATGGAA

SEQ ID NO: 108472 - protein, 15 aa, Mycobacterium tuberculosis
PAAAAGSSATGGAAP

SEQ ID NO: 108473 - protein, 15 aa, Mycobacterium tuberculosis
AAAAGSSATGGAAPV

SEQ ID NO: 108474 - protein, 15 aa, Mycobacterium tuberculosis
AAAGSSATGGAAPVG

SEQ ID NO: 108475 - protein, 15 aa, Mycobacterium tuberculosis
AAGSSATGGAAPVGA

SEQ ID NO: 108476 - protein, 15 aa, Mycobacterium tuberculosis
AGSSATGGAAPVGAG

SEQ ID NO: 108477 - protein, 15 aa, Mycobacterium tuberculosis
GSSATGGAAPVGAGA

SEQ ID NO: 108478 - protein, 15 aa, Mycobacterium tuberculosis
SSATGGAAPVGAGAM

SEQ ID NO: 108479 - protein, 15 aa, Mycobacterium tuberculosis
SATGGAAPVGAGAMG

SEQ ID NO: 108480 - protein, 15 aa, Mycobacterium tuberculosis
ATGGAAPVGAGAMGQ

SEQ ID NO: 108481 - protein, 15 aa, Mycobacterium tuberculosis
TGGAAPVGAGAMGQG

SEQ ID NO: 108482 - protein, 15 aa, Mycobacterium tuberculosis
GGAAPVGAGAMGQGA

SEQ ID NO: 108483 - protein, 15 aa, Mycobacterium tuberculosis
GAAPVGAGAMGQGAQ

SEQ ID NO: 108484 - protein, 15 aa, Mycobacterium tuberculosis
AAPVGAGAMGQGAQS

SEQ ID NO: 108485 - protein, 15 aa, Mycobacterium tuberculosis
APVGAGAMGQGAQSG

SEQ ID NO: 108486 - protein, 15 aa, Mycobacterium tuberculosis
PVGAGAMGQGAQSGG

SEQ ID NO: 108487 - protein, 15 aa, Mycobacterium tuberculosis
VGAGAMGQGAQSGGS

SEQ ID NO: 108488 - protein, 15 aa, Mycobacterium tuberculosis
GAGAMGQGAQSGGST

SEQ ID NO: 108489 - protein, 15 aa, Mycobacterium tuberculosis
AGAMGQGAQSGGSTR

SEQ ID NO: 108490 - protein, 15 aa, Mycobacterium tuberculosis
GAMGQGAQSGGSTRP

SEQ ID NO: 108491 - protein, 15 aa, Mycobacterium tuberculosis
AMGQGAQSGGSTRPG

SEQ ID NO: 108492 - protein, 15 aa, Mycobacterium tuberculosis
MGQGAQSGGSTRPGL

SEQ ID NO: 108493 - protein, 15 aa, Mycobacterium tuberculosis
GQGAQSGGSTRPGLV

SEQ ID NO: 108494 - protein, 15 aa, Mycobacterium tuberculosis
QGAQSGGSTRPGLVA

SEQ ID NO: 108495 - protein, 15 aa, Mycobacterium tuberculosis
GAQSGGSTRPGLVAP

SEQ ID NO: 108496 - protein, 15 aa, Mycobacterium tuberculosis
AQSGGSTRPGLVAPA

SEQ ID NO: 108497 - protein, 15 aa, Mycobacterium tuberculosis
QSGGSTRPGLVAPAP

SEQ ID NO: 108498 - protein, 15 aa, Mycobacterium tuberculosis
SGGSTRPGLVAPAPL

SEQ ID NO: 108499 - protein, 15 aa, Mycobacterium tuberculosis
GGSTRPGLVAPAPLA

SEQ ID NO: 108500 - protein, 15 aa, Mycobacterium tuberculosis
GSTRPGLVAPAPLAQ

SEQ ID NO: 108501 - protein, 15 aa, Mycobacterium tuberculosis
STRPGLVAPAPLAQE

SEQ ID NO: 108502 - protein, 15 aa, Mycobacterium tuberculosis
TRPGLVAPAPLAQER

SEQ ID NO: 108503 - protein, 15 aa, Mycobacterium tuberculosis
RPGLVAPAPLAQERE

SEQ ID NO: 108504 - protein, 15 aa, Mycobacterium tuberculosis
PGLVAPAPLAQEREE

SEQ ID NO: 108505 - protein, 15 aa, Mycobacterium tuberculosis
GLVAPAPLAQEREED

SEQ ID NO: 108506 - protein, 15 aa, Mycobacterium tuberculosis
LVAPAPLAQEREEDD

SEQ ID NO: 108507 - protein, 15 aa, Mycobacterium tuberculosis
VAPAPLAQEREEDDE

SEQ ID NO: 108508 - protein, 15 aa, Mycobacterium tuberculosis
APAPLAQEREEDDED

SEQ ID NO: 108509 - protein, 15 aa, Mycobacterium tuberculosis
PAPLAQEREEDDEDD

SEQ ID NO: 108510 - protein, 15 aa, Mycobacterium tuberculosis
APLAQEREEDDEDDW

SEQ ID NO: 108511 - protein, 15 aa, Mycobacterium tuberculosis
PLAQEREEDDEDDWD

SEQ ID NO: 108512 - protein, 15 aa, Mycobacterium tuberculosis
LAQEREEDDEDDWDE

SEQ ID NO: 108513 - protein, 15 aa, Mycobacterium tuberculosis
AQEREEDDEDDWDEE

SEQ ID NO: 108514 - protein, 15 aa, Mycobacterium tuberculosis
QEREEDDEDDWDEED

SEQ ID NO: 108515 - protein, 15 aa, Mycobacterium tuberculosis
EREEDDEDDWDEEDD

SEQ ID NO: 108516 - protein, 15 aa, Mycobacterium tuberculosis
REEDDEDDWDEEDDW

SEQ ID NO: 108517 - protein, 16 aa, Mycobacterium tuberculosis
MLWHAMPPELNTARLM

SEQ ID NO: 108518 - protein, 16 aa, Mycobacterium tuberculosis
LWHAMPPELNTARLMA

SEQ ID NO: 108519 - protein, 16 aa, Mycobacterium tuberculosis
WHAMPPELNTARLMAG

SEQ ID NO: 108520 - protein, 16 aa, Mycobacterium tuberculosis
HAMPPELNTARLMAGA

SEQ ID NO: 108521 - protein, 16 aa, Mycobacterium tuberculosis
AMPPELNTARLMAGAG

SEQ ID NO: 108522 - protein, 16 aa, Mycobacterium tuberculosis
MPPELNTARLMAGAGP

SEQ ID NO: 108523 - protein, 16 aa, Mycobacterium tuberculosis
PPELNTARLMAGAGPA

SEQ ID NO: 108524 - protein, 16 aa, Mycobacterium tuberculosis
PELNTARLMAGAGPAP

SEQ ID NO: 108525 - protein, 16 aa, Mycobacterium tuberculosis
ELNTARLMAGAGPAPM

SEQ ID NO: 108526 - protein, 16 aa, Mycobacterium tuberculosis
LNTARLMAGAGPAPML

SEQ ID NO: 108527 - protein, 16 aa, Mycobacterium tuberculosis
NTARLMAGAGPAPMLA

SEQ ID NO: 108528 - protein, 16 aa, Mycobacterium tuberculosis
TARLMAGAGPAPMLAA

SEQ ID NO: 108529 - protein, 16 aa, Mycobacterium tuberculosis
ARLMAGAGPAPMLAAA

SEQ ID NO: 108530 - protein, 16 aa, Mycobacterium tuberculosis
RLMAGAGPAPMLAAAA

SEQ ID NO: 108531 - protein, 16 aa, Mycobacterium tuberculosis
LMAGAGPAPMLAAAAG

SEQ ID NO: 108532 - protein, 16 aa, Mycobacterium tuberculosis
MAGAGPAPMLAAAAGW

SEQ ID NO: 108533 - protein, 16 aa, Mycobacterium tuberculosis
AGAGPAPMLAAAAGWQ

SEQ ID NO: 108534 - protein, 16 aa, Mycobacterium tuberculosis
GAGPAPMLAAAAGWQT

SEQ ID NO: 108535 - protein, 16 aa, Mycobacterium tuberculosis
AGPAPMLAAAAGWQTL

SEQ ID NO: 108536 - protein, 16 aa, Mycobacterium tuberculosis
GPAPMLAAAAGWQTLS

SEQ ID NO: 108537 - protein, 16 aa, Mycobacterium tuberculosis
PAPMLAAAAGWQTLSA

SEQ ID NO: 108538 - protein, 16 aa, Mycobacterium tuberculosis
APMLAAAAGWQTLSAA

SEQ ID NO: 108539 - protein, 16 aa, Mycobacterium tuberculosis
PMLAAAAGWQTLSAAL

SEQ ID NO: 108540 - protein, 16 aa, Mycobacterium tuberculosis
MLAAAAGWQTLSAALD

SEQ ID NO: 108541 - protein, 16 aa, Mycobacterium tuberculosis
LAAAAGWQTLSAALDA

SEQ ID NO: 108542 - protein, 16 aa, Mycobacterium tuberculosis
AAAAGWQTLSAALDAQ

SEQ ID NO: 108543 - protein, 16 aa, Mycobacterium tuberculosis
AAAGWQTLSAALDAQA

SEQ ID NO: 108544 - protein, 16 aa, Mycobacterium tuberculosis
AAGWQTLSAALDAQAV

SEQ ID NO: 108545 - protein, 16 aa, Mycobacterium tuberculosis
AGWQTLSAALDAQAVE

SEQ ID NO: 108546 - protein, 16 aa, Mycobacterium tuberculosis
GWQTLSAALDAQAVEL

SEQ ID NO: 108547 - protein, 16 aa, Mycobacterium tuberculosis
WQTLSAALDAQAVELT

SEQ ID NO: 108548 - protein, 16 aa, Mycobacterium tuberculosis
QTLSAALDAQAVELTA

SEQ ID NO: 108549 - protein, 16 aa, Mycobacterium tuberculosis
TLSAALDAQAVELTAR

SEQ ID NO: 108550 - protein, 16 aa, Mycobacterium tuberculosis
LSAALDAQAVELTARL

SEQ ID NO: 108551 - protein, 16 aa, Mycobacterium tuberculosis
SAALDAQAVELTARLN

SEQ ID NO: 108552 - protein, 16 aa, Mycobacterium tuberculosis
AALDAQAVELTARLNS

SEQ ID NO: 108553 - protein, 16 aa, Mycobacterium tuberculosis
ALDAQAVELTARLNSL

SEQ ID NO: 108554 - protein, 16 aa, Mycobacterium tuberculosis
LDAQAVELTARLNSLG

SEQ ID NO: 108555 - protein, 16 aa, Mycobacterium tuberculosis
DAQAVELTARLNSLGE

SEQ ID NO: 108556 - protein, 16 aa, Mycobacterium tuberculosis
AQAVELTARLNSLGEA

SEQ ID NO: 108557 - protein, 16 aa, Mycobacterium tuberculosis
QAVELTARLNSLGEAW

SEQ ID NO: 108558 - protein, 16 aa, Mycobacterium tuberculosis
AVELTARLNSLGEAWT

SEQ ID NO: 108559 - protein, 16 aa, Mycobacterium tuberculosis
VELTARLNSLGEAWTG

SEQ ID NO: 108560 - protein, 16 aa, Mycobacterium tuberculosis
ELTARLNSLGEAWTGG

SEQ ID NO: 108561 - protein, 16 aa, Mycobacterium tuberculosis
LTARLNSLGEAWTGGG

SEQ ID NO: 108562 - protein, 16 aa, Mycobacterium tuberculosis
TARLNSLGEAWTGGGS

SEQ ID NO: 108563 - protein, 16 aa, Mycobacterium tuberculosis
ARLNSLGEAWTGGGSD

SEQ ID NO: 108564 - protein, 16 aa, Mycobacterium tuberculosis
RLNSLGEAWTGGGSDK

SEQ ID NO: 108565 - protein, 16 aa, Mycobacterium tuberculosis
LNSLGEAWTGGGSDKA

SEQ ID NO: 108566 - protein, 16 aa, Mycobacterium tuberculosis
NSLGEAWTGGGSDKAL

SEQ ID NO: 108567 - protein, 16 aa, Mycobacterium tuberculosis
SLGEAWTGGGSDKALA

SEQ ID NO: 108568 - protein, 16 aa, Mycobacterium tuberculosis
LGEAWTGGGSDKALAA

SEQ ID NO: 108569 - protein, 16 aa, Mycobacterium tuberculosis
GEAWTGGGSDKALAAA

SEQ ID NO: 108570 - protein, 16 aa, Mycobacterium tuberculosis
EAWTGGGSDKALAAAT

SEQ ID NO: 108571 - protein, 16 aa, Mycobacterium tuberculosis
AWTGGGSDKALAAATP

SEQ ID NO: 108572 - protein, 16 aa, Mycobacterium tuberculosis
WTGGGSDKALAAATPM

SEQ ID NO: 108573 - protein, 16 aa, Mycobacterium tuberculosis
TGGGSDKALAAATPMV

SEQ ID NO: 108574 - protein, 16 aa, Mycobacterium tuberculosis
GGGSDKALAAATPMVV

SEQ ID NO: 108575 - protein, 16 aa, Mycobacterium tuberculosis
GGSDKALAAATPMVVW

SEQ ID NO: 108576 - protein, 16 aa, Mycobacterium tuberculosis
GSDKALAAATPMVVWL

SEQ ID NO: 108577 - protein, 16 aa, Mycobacterium tuberculosis
SDKALAAATPMVVWLQ

SEQ ID NO: 108578 - protein, 16 aa, Mycobacterium tuberculosis
DKALAAATPMVVWLQT

SEQ ID NO: 108579 - protein, 16 aa, Mycobacterium tuberculosis
KALAAATPMVVWLQTA

SEQ ID NO: 108580 - protein, 16 aa, Mycobacterium tuberculosis
ALAAATPMVVWLQTAS

SEQ ID NO: 108581 - protein, 16 aa, Mycobacterium tuberculosis
LAAATPMVVWLQTAST

SEQ ID NO: 108582 - protein, 16 aa, Mycobacterium tuberculosis
AAATPMVVWLQTASTQ

SEQ ID NO: 108583 - protein, 16 aa, Mycobacterium tuberculosis
AATPMVVWLQTASTQA

SEQ ID NO: 108584 - protein, 16 aa, Mycobacterium tuberculosis
ATPMVVWLQTASTQAK

SEQ ID NO: 108585 - protein, 16 aa, Mycobacterium tuberculosis
TPMVVWLQTASTQAKT

SEQ ID NO: 108586 - protein, 16 aa, Mycobacterium tuberculosis
PMVVWLQTASTQAKTR

SEQ ID NO: 108587 - protein, 16 aa, Mycobacterium tuberculosis
MVVWLQTASTQAKTRA

SEQ ID NO: 108588 - protein, 16 aa, Mycobacterium tuberculosis
VVWLQTASTQAKTRAM

SEQ ID NO: 108589 - protein, 16 aa, Mycobacterium tuberculosis
VWLQTASTQAKTRAMQ

SEQ ID NO: 108590 - protein, 16 aa, Mycobacterium tuberculosis
WLQTASTQAKTRAMQA

SEQ ID NO: 108591 - protein, 16 aa, Mycobacterium tuberculosis
LQTASTQAKTRAMQAT

SEQ ID NO: 108592 - protein, 16 aa, Mycobacterium tuberculosis
QTASTQAKTRAMQATA

SEQ ID NO: 108593 - protein, 16 aa, Mycobacterium tuberculosis
TASTQAKTRAMQATAQ

SEQ ID NO: 108594 - protein, 16 aa, Mycobacterium tuberculosis
ASTQAKTRAMQATAQA

SEQ ID NO: 108595 - protein, 16 aa, Mycobacterium tuberculosis
STQAKTRAMQATAQAA

SEQ ID NO: 108596 - protein, 16 aa, Mycobacterium tuberculosis
TQAKTRAMQATAQAAA

SEQ ID NO: 108597 - protein, 16 aa, Mycobacterium tuberculosis
QAKTRAMQATAQAAAY

SEQ ID NO: 108598 - protein, 16 aa, Mycobacterium tuberculosis
AKTRAMQATAQAAAYT

SEQ ID NO: 108599 - protein, 16 aa, Mycobacterium tuberculosis
KTRAMQATAQAAAYTQ

SEQ ID NO: 108600 - protein, 16 aa, Mycobacterium tuberculosis
TRAMQATAQAAAYTQA

SEQ ID NO: 108601 - protein, 16 aa, Mycobacterium tuberculosis
RAMQATAQAAAYTQAM

SEQ ID NO: 108602 - protein, 16 aa, Mycobacterium tuberculosis
AMQATAQAAAYTQAMA

SEQ ID NO: 108603 - protein, 16 aa, Mycobacterium tuberculosis
MQATAQAAAYTQAMAT

SEQ ID NO: 108604 - protein, 16 aa, Mycobacterium tuberculosis
QATAQAAAYTQAMATT

SEQ ID NO: 108605 - protein, 16 aa, Mycobacterium tuberculosis
ATAQAAAYTQAMATTP

SEQ ID NO: 108606 - protein, 16 aa, Mycobacterium tuberculosis
TAQAAAYTQAMATTPS

SEQ ID NO: 108607 - protein, 16 aa, Mycobacterium tuberculosis
AQAAAYTQAMATTPSL

SEQ ID NO: 108608 - protein, 16 aa, Mycobacterium tuberculosis
QAAAYTQAMATTPSLP

SEQ ID NO: 108609 - protein, 16 aa, Mycobacterium tuberculosis
AAAYTQAMATTPSLPE

SEQ ID NO: 108610 - protein, 16 aa, Mycobacterium tuberculosis
AAYTQAMATTPSLPEI

SEQ ID NO: 108611 - protein, 16 aa, Mycobacterium tuberculosis
AYTQAMATTPSLPEIA

SEQ ID NO: 108612 - protein, 16 aa, Mycobacterium tuberculosis
YTQAMATTPSLPEIAA

SEQ ID NO: 108613 - protein, 16 aa, Mycobacterium tuberculosis
TQAMATTPSLPEIAAN

SEQ ID NO: 108614 - protein, 16 aa, Mycobacterium tuberculosis
QAMATTPSLPEIAANH

SEQ ID NO: 108615 - protein, 16 aa, Mycobacterium tuberculosis
AMATTPSLPEIAANHI

SEQ ID NO: 108616 - protein, 16 aa, Mycobacterium tuberculosis
MATTPSLPEIAANHIT

SEQ ID NO: 108617 - protein, 16 aa, Mycobacterium tuberculosis
ATTPSLPEIAANHITQ

SEQ ID NO: 108618 - protein, 16 aa, Mycobacterium tuberculosis
TTPSLPEIAANHITQA

SEQ ID NO: 108619 - protein, 16 aa, Mycobacterium tuberculosis
TPSLPEIAANHITQAV

SEQ ID NO: 108620 - protein, 16 aa, Mycobacterium tuberculosis
PSLPEIAANHITQAVL

SEQ ID NO: 108621 - protein, 16 aa, Mycobacterium tuberculosis
SLPEIAANHITQAVLT

SEQ ID NO: 108622 - protein, 16 aa, Mycobacterium tuberculosis
LPEIAANHITQAVLTA

SEQ ID NO: 108623 - protein, 16 aa, Mycobacterium tuberculosis
PEIAANHITQAVLTAT

SEQ ID NO: 108624 - protein, 16 aa, Mycobacterium tuberculosis
EIAANHITQAVLTATN

SEQ ID NO: 108625 - protein, 16 aa, Mycobacterium tuberculosis
IAANHITQAVLTATNF

SEQ ID NO: 108626 - protein, 16 aa, Mycobacterium tuberculosis
AANHITQAVLTATNFF

SEQ ID NO: 108627 - protein, 16 aa, Mycobacterium tuberculosis
ANHITQAVLTATNFFG

SEQ ID NO: 108628 - protein, 16 aa, Mycobacterium tuberculosis
NHITQAVLTATNFFGI

SEQ ID NO: 108629 - protein, 16 aa, Mycobacterium tuberculosis
HITQAVLTATNFFGIN

SEQ ID NO: 108630 - protein, 16 aa, Mycobacterium tuberculosis
ITQAVLTATNFFGINT

SEQ ID NO: 108631 - protein, 16 aa, Mycobacterium tuberculosis
TQAVLTATNFFGINTI

SEQ ID NO: 108632 - protein, 16 aa, Mycobacterium tuberculosis
QAVLTATNFFGINTIP

SEQ ID NO: 108633 - protein, 16 aa, Mycobacterium tuberculosis
AVLTATNFFGINTIPI

SEQ ID NO: 108634 - protein, 16 aa, Mycobacterium tuberculosis
VLTATNFFGINTIPIA

SEQ ID NO: 108635 - protein, 16 aa, Mycobacterium tuberculosis
LTATNFFGINTIPIAL

SEQ ID NO: 108636 - protein, 16 aa, Mycobacterium tuberculosis
TATNFFGINTIPIALT

SEQ ID NO: 108637 - protein, 16 aa, Mycobacterium tuberculosis
ATNFFGINTIPIALTE

SEQ ID NO: 108638 - protein, 16 aa, Mycobacterium tuberculosis
TNFFGINTIPIALTEM

SEQ ID NO: 108639 - protein, 16 aa, Mycobacterium tuberculosis
NFFGINTIPIALTEMD

SEQ ID NO: 108640 - protein, 16 aa, Mycobacterium tuberculosis
FFGINTIPIALTEMDY

SEQ ID NO: 108641 - protein, 16 aa, Mycobacterium tuberculosis
FGINTIPIALTEMDYF

SEQ ID NO: 108642 - protein, 16 aa, Mycobacterium tuberculosis
GINTIPIALTEMDYFI

SEQ ID NO: 108643 - protein, 16 aa, Mycobacterium tuberculosis
INTIPIALTEMDYFIR

SEQ ID NO: 108644 - protein, 16 aa, Mycobacterium tuberculosis
NTIPIALTEMDYFIRM

SEQ ID NO: 108645 - protein, 16 aa, Mycobacterium tuberculosis
TIPIALTEMDYFIRMW

SEQ ID NO: 108646 - protein, 16 aa, Mycobacterium tuberculosis
IPIALTEMDYFIRMWN

SEQ ID NO: 108647 - protein, 16 aa, Mycobacterium tuberculosis
PIALTEMDYFIRMWNQ

SEQ ID NO: 108648 - protein, 16 aa, Mycobacterium tuberculosis
IALTEMDYFIRMWNQA

SEQ ID NO: 108649 - protein, 16 aa, Mycobacterium tuberculosis
ALTEMDYFIRMWNQAA

SEQ ID NO: 108650 - protein, 16 aa, Mycobacterium tuberculosis
LTEMDYFIRMWNQAAL

SEQ ID NO: 108651 - protein, 16 aa, Mycobacterium tuberculosis
TEMDYFIRMWNQAALA

SEQ ID NO: 108652 - protein, 16 aa, Mycobacterium tuberculosis
EMDYFIRMWNQAALAM

SEQ ID NO: 108653 - protein, 16 aa, Mycobacterium tuberculosis
MDYFIRMWNQAALAME

SEQ ID NO: 108654 - protein, 16 aa, Mycobacterium tuberculosis
DYFIRMWNQAALAMEV

SEQ ID NO: 108655 - protein, 16 aa, Mycobacterium tuberculosis
YFIRMWNQAALAMEVY

SEQ ID NO: 108656 - protein, 16 aa, Mycobacterium tuberculosis
FIRMWNQAALAMEVYQ

SEQ ID NO: 108657 - protein, 16 aa, Mycobacterium tuberculosis
IRMWNQAALAMEVYQA

SEQ ID NO: 108658 - protein, 16 aa, Mycobacterium tuberculosis
RMWNQAALAMEVYQAE

SEQ ID NO: 108659 - protein, 16 aa, Mycobacterium tuberculosis
MWNQAALAMEVYQAET

SEQ ID NO: 108660 - protein, 16 aa, Mycobacterium tuberculosis
WNQAALAMEVYQAETA

SEQ ID NO: 108661 - protein, 16 aa, Mycobacterium tuberculosis
NQAALAMEVYQAETAV

SEQ ID NO: 108662 - protein, 16 aa, Mycobacterium tuberculosis
QAALAMEVYQAETAVN

SEQ ID NO: 108663 - protein, 16 aa, Mycobacterium tuberculosis
AALAMEVYQAETAVNT

SEQ ID NO: 108664 - protein, 16 aa, Mycobacterium tuberculosis
ALAMEVYQAETAVNTL

SEQ ID NO: 108665 - protein, 16 aa, Mycobacterium tuberculosis
LAMEVYQAETAVNTLF

SEQ ID NO: 108666 - protein, 16 aa, Mycobacterium tuberculosis
AMEVYQAETAVNTLFE

SEQ ID NO: 108667 - protein, 16 aa, Mycobacterium tuberculosis
MEVYQAETAVNTLFEK

SEQ ID NO: 108668 - protein, 16 aa, Mycobacterium tuberculosis
EVYQAETAVNTLFEKL

SEQ ID NO: 108669 - protein, 16 aa, Mycobacterium tuberculosis
VYQAETAVNTLFEKLE

SEQ ID NO: 108670 - protein, 16 aa, Mycobacterium tuberculosis
YQAETAVNTLFEKLEP

SEQ ID NO: 108671 - protein, 16 aa, Mycobacterium tuberculosis
QAETAVNTLFEKLEPM

SEQ ID NO: 108672 - protein, 16 aa, Mycobacterium tuberculosis
AETAVNTLFEKLEPMA

SEQ ID NO: 108673 - protein, 16 aa, Mycobacterium tuberculosis
ETAVNTLFEKLEPMAS

SEQ ID NO: 108674 - protein, 16 aa, Mycobacterium tuberculosis
TAVNTLFEKLEPMASI

SEQ ID NO: 108675 - protein, 16 aa, Mycobacterium tuberculosis
AVNTLFEKLEPMASIL

SEQ ID NO: 108676 - protein, 16 aa, Mycobacterium tuberculosis
VNTLFEKLEPMASILD

SEQ ID NO: 108677 - protein, 16 aa, Mycobacterium tuberculosis
NTLFEKLEPMASILDP

SEQ ID NO: 108678 - protein, 16 aa, Mycobacterium tuberculosis
TLFEKLEPMASILDPG

SEQ ID NO: 108679 - protein, 16 aa, Mycobacterium tuberculosis
LFEKLEPMASILDPGA

SEQ ID NO: 108680 - protein, 16 aa, Mycobacterium tuberculosis
FEKLEPMASILDPGAS

SEQ ID NO: 108681 - protein, 16 aa, Mycobacterium tuberculosis
EKLEPMASILDPGASQ

SEQ ID NO: 108682 - protein, 16 aa, Mycobacterium tuberculosis
KLEPMASILDPGASQS

SEQ ID NO: 108683 - protein, 16 aa, Mycobacterium tuberculosis
LEPMASILDPGASQST

SEQ ID NO: 108684 - protein, 16 aa, Mycobacterium tuberculosis
EPMASILDPGASQSTT

SEQ ID NO: 108685 - protein, 16 aa, Mycobacterium tuberculosis
PMASILDPGASQSTTN

SEQ ID NO: 108686 - protein, 16 aa, Mycobacterium tuberculosis
MASILDPGASQSTTNP

SEQ ID NO: 108687 - protein, 16 aa, Mycobacterium tuberculosis
ASILDPGASQSTTNPI

SEQ ID NO: 108688 - protein, 16 aa, Mycobacterium tuberculosis
SILDPGASQSTTNPIF

SEQ ID NO: 108689 - protein, 16 aa, Mycobacterium tuberculosis
ILDPGASQSTTNPIFG

SEQ ID NO: 108690 - protein, 16 aa, Mycobacterium tuberculosis
LDPGASQSTTNPIFGM

SEQ ID NO: 108691 - protein, 16 aa, Mycobacterium tuberculosis
DPGASQSTTNPIFGMP

SEQ ID NO: 108692 - protein, 16 aa, Mycobacterium tuberculosis
PGASQSTTNPIFGMPS

SEQ ID NO: 108693 - protein, 16 aa, Mycobacterium tuberculosis
GASQSTTNPIFGMPSP

SEQ ID NO: 108694 - protein, 16 aa, Mycobacterium tuberculosis
ASQSTTNPIFGMPSPG

SEQ ID NO: 108695 - protein, 16 aa, Mycobacterium tuberculosis
SQSTTNPIFGMPSPGS

SEQ ID NO: 108696 - protein, 16 aa, Mycobacterium tuberculosis
QSTTNPIFGMPSPGSS

SEQ ID NO: 108697 - protein, 16 aa, Mycobacterium tuberculosis
STTNPIFGMPSPGSST

SEQ ID NO: 108698 - protein, 16 aa, Mycobacterium tuberculosis
TTNPIFGMPSPGSSTP

SEQ ID NO: 108699 - protein, 16 aa, Mycobacterium tuberculosis
TNPIFGMPSPGSSTPV

SEQ ID NO: 108700 - protein, 16 aa, Mycobacterium tuberculosis
NPIFGMPSPGSSTPVG

SEQ ID NO: 108701 - protein, 16 aa, Mycobacterium tuberculosis
PIFGMPSPGSSTPVGQ

SEQ ID NO: 108702 - protein, 16 aa, Mycobacterium tuberculosis
IFGMPSPGSSTPVGQL

SEQ ID NO: 108703 - protein, 16 aa, Mycobacterium tuberculosis
FGMPSPGSSTPVGQLP

SEQ ID NO: 108704 - protein, 16 aa, Mycobacterium tuberculosis
GMPSPGSSTPVGQLPP

SEQ ID NO: 108705 - protein, 16 aa, Mycobacterium tuberculosis
MPSPGSSTPVGQLPPA

SEQ ID NO: 108706 - protein, 16 aa, Mycobacterium tuberculosis
PSPGSSTPVGQLPPAA

SEQ ID NO: 108707 - protein, 16 aa, Mycobacterium tuberculosis
SPGSSTPVGQLPPAAT

SEQ ID NO: 108708 - protein, 16 aa, Mycobacterium tuberculosis
PGSSTPVGQLPPAATQ

SEQ ID NO: 108709 - protein, 16 aa, Mycobacterium tuberculosis
GSSTPVGQLPPAATQT

SEQ ID NO: 108710 - protein, 16 aa, Mycobacterium tuberculosis
SSTPVGQLPPAATQTL

SEQ ID NO: 108711 - protein, 16 aa, Mycobacterium tuberculosis
STPVGQLPPAATQTLG

SEQ ID NO: 108712 - protein, 16 aa, Mycobacterium tuberculosis
TPVGQLPPAATQTLGQ

SEQ ID NO: 108713 - protein, 16 aa, Mycobacterium tuberculosis
PVGQLPPAATQTLGQL

SEQ ID NO: 108714 - protein, 16 aa, Mycobacterium tuberculosis
VGQLPPAATQTLGQLG

SEQ ID NO: 108715 - protein, 16 aa, Mycobacterium tuberculosis
GQLPPAATQTLGQLGE

SEQ ID NO: 108716 - protein, 16 aa, Mycobacterium tuberculosis
QLPPAATQTLGQLGEM

SEQ ID NO: 108717 - protein, 16 aa, Mycobacterium tuberculosis
LPPAATQTLGQLGEMS

SEQ ID NO: 108718 - protein, 16 aa, Mycobacterium tuberculosis
PPAATQTLGQLGEMSG

SEQ ID NO: 108719 - protein, 16 aa, Mycobacterium tuberculosis
PAATQTLGQLGEMSGP

SEQ ID NO: 108720 - protein, 16 aa, Mycobacterium tuberculosis
AATQTLGQLGEMSGPM

SEQ ID NO: 108721 - protein, 16 aa, Mycobacterium tuberculosis
ATQTLGQLGEMSGPMQ

SEQ ID NO: 108722 - protein, 16 aa, Mycobacterium tuberculosis
TQTLGQLGEMSGPMQQ

SEQ ID NO: 108723 - protein, 16 aa, Mycobacterium tuberculosis
QTLGQLGEMSGPMQQL

SEQ ID NO: 108724 - protein, 16 aa, Mycobacterium tuberculosis
TLGQLGEMSGPMQQLT

SEQ ID NO: 108725 - protein, 16 aa, Mycobacterium tuberculosis
LGQLGEMSGPMQQLTQ

SEQ ID NO: 108726 - protein, 16 aa, Mycobacterium tuberculosis
GQLGEMSGPMQQLTQP

SEQ ID NO: 108727 - protein, 16 aa, Mycobacterium tuberculosis
QLGEMSGPMQQLTQPL

SEQ ID NO: 108728 - protein, 16 aa, Mycobacterium tuberculosis
LGEMSGPMQQLTQPLQ

SEQ ID NO: 108729 - protein, 16 aa, Mycobacterium tuberculosis
GEMSGPMQQLTQPLQQ

SEQ ID NO: 108730 - protein, 16 aa, Mycobacterium tuberculosis
EMSGPMQQLTQPLQQV

SEQ ID NO: 108731 - protein, 16 aa, Mycobacterium tuberculosis
MSGPMQQLTQPLQQVT

SEQ ID NO: 108732 - protein, 16 aa, Mycobacterium tuberculosis
SGPMQQLTQPLQQVTS

SEQ ID NO: 108733 - protein, 16 aa, Mycobacterium tuberculosis
GPMQQLTQPLQQVTSL

SEQ ID NO: 108734 - protein, 16 aa, Mycobacterium tuberculosis
PMQQLTQPLQQVTSLF

SEQ ID NO: 108735 - protein, 16 aa, Mycobacterium tuberculosis
MQQLTQPLQQVTSLFS

SEQ ID NO: 108736 - protein, 16 aa, Mycobacterium tuberculosis
QQLTQPLQQVTSLFSQ

SEQ ID NO: 108737 - protein, 16 aa, Mycobacterium tuberculosis
QLTQPLQQVTSLFSQV

SEQ ID NO: 108738 - protein, 16 aa, Mycobacterium tuberculosis
LTQPLQQVTSLFSQVG

SEQ ID NO: 108739 - protein, 16 aa, Mycobacterium tuberculosis
TQPLQQVTSLFSQVGG

SEQ ID NO: 108740 - protein, 16 aa, Mycobacterium tuberculosis
QPLQQVTSLFSQVGGT

SEQ ID NO: 108741 - protein, 16 aa, Mycobacterium tuberculosis
PLQQVTSLFSQVGGTG

SEQ ID NO: 108742 - protein, 16 aa, Mycobacterium tuberculosis
LQQVTSLFSQVGGTGG

SEQ ID NO: 108743 - protein, 16 aa, Mycobacterium tuberculosis
QQVTSLFSQVGGTGGG

SEQ ID NO: 108744 - protein, 16 aa, Mycobacterium tuberculosis
QVTSLFSQVGGTGGGN

SEQ ID NO: 108745 - protein, 16 aa, Mycobacterium tuberculosis
VTSLFSQVGGTGGGNP

SEQ ID NO: 108746 - protein, 16 aa, Mycobacterium tuberculosis
TSLFSQVGGTGGGNPA

SEQ ID NO: 108747 - protein, 16 aa, Mycobacterium tuberculosis
SLFSQVGGTGGGNPAD

SEQ ID NO: 108748 - protein, 16 aa, Mycobacterium tuberculosis
LFSQVGGTGGGNPADE

SEQ ID NO: 108749 - protein, 16 aa, Mycobacterium tuberculosis
FSQVGGTGGGNPADEE

SEQ ID NO: 108750 - protein, 16 aa, Mycobacterium tuberculosis
SQVGGTGGGNPADEEA

SEQ ID NO: 108751 - protein, 16 aa, Mycobacterium tuberculosis
QVGGTGGGNPADEEAA

SEQ ID NO: 108752 - protein, 16 aa, Mycobacterium tuberculosis
VGGTGGGNPADEEAAQ

SEQ ID NO: 108753 - protein, 16 aa, Mycobacterium tuberculosis
GGTGGGNPADEEAAQM

SEQ ID NO: 108754 - protein, 16 aa, Mycobacterium tuberculosis
GTGGGNPADEEAAQMG

SEQ ID NO: 108755 - protein, 16 aa, Mycobacterium tuberculosis
TGGGNPADEEAAQMGL

SEQ ID NO: 108756 - protein, 16 aa, Mycobacterium tuberculosis
GGGNPADEEAAQMGLL

SEQ ID NO: 108757 - protein, 16 aa, Mycobacterium tuberculosis
GGNPADEEAAQMGLLG

SEQ ID NO: 108758 - protein, 16 aa, Mycobacterium tuberculosis
GNPADEEAAQMGLLGT

SEQ ID NO: 108759 - protein, 16 aa, Mycobacterium tuberculosis
NPADEEAAQMGLLGTS

SEQ ID NO: 108760 - protein, 16 aa, Mycobacterium tuberculosis
PADEEAAQMGLLGTSP

SEQ ID NO: 108761 - protein, 16 aa, Mycobacterium tuberculosis
ADEEAAQMGLLGTSPL

SEQ ID NO: 108762 - protein, 16 aa, Mycobacterium tuberculosis
DEEAAQMGLLGTSPLS

SEQ ID NO: 108763 - protein, 16 aa, Mycobacterium tuberculosis
EEAAQMGLLGTSPLSN

SEQ ID NO: 108764 - protein, 16 aa, Mycobacterium tuberculosis
EAAQMGLLGTSPLSNH

SEQ ID NO: 108765 - protein, 16 aa, Mycobacterium tuberculosis
AAQMGLLGTSPLSNHP

SEQ ID NO: 108766 - protein, 16 aa, Mycobacterium tuberculosis
AQMGLLGTSPLSNHPL

SEQ ID NO: 108767 - protein, 16 aa, Mycobacterium tuberculosis
QMGLLGTSPLSNHPLA

SEQ ID NO: 108768 - protein, 16 aa, Mycobacterium tuberculosis
MGLLGTSPLSNHPLAG

SEQ ID NO: 108769 - protein, 16 aa, Mycobacterium tuberculosis
GLLGTSPLSNHPLAGG

SEQ ID NO: 108770 - protein, 16 aa, Mycobacterium tuberculosis
LLGTSPLSNHPLAGGS

SEQ ID NO: 108771 - protein, 16 aa, Mycobacterium tuberculosis
LGTSPLSNHPLAGGSG

SEQ ID NO: 108772 - protein, 16 aa, Mycobacterium tuberculosis
GTSPLSNHPLAGGSGP

SEQ ID NO: 108773 - protein, 16 aa, Mycobacterium tuberculosis
TSPLSNHPLAGGSGPS

SEQ ID NO: 108774 - protein, 16 aa, Mycobacterium tuberculosis
SPLSNHPLAGGSGPSA

SEQ ID NO: 108775 - protein, 16 aa, Mycobacterium tuberculosis
PLSNHPLAGGSGPSAG

SEQ ID NO: 108776 - protein, 16 aa, Mycobacterium tuberculosis
LSNHPLAGGSGPSAGA

SEQ ID NO: 108777 - protein, 16 aa, Mycobacterium tuberculosis
SNHPLAGGSGPSAGAG

SEQ ID NO: 108778 - protein, 16 aa, Mycobacterium tuberculosis
NHPLAGGSGPSAGAGL

SEQ ID NO: 108779 - protein, 16 aa, Mycobacterium tuberculosis
HPLAGGSGPSAGAGLL

SEQ ID NO: 108780 - protein, 16 aa, Mycobacterium tuberculosis
PLAGGSGPSAGAGLLR

SEQ ID NO: 108781 - protein, 16 aa, Mycobacterium tuberculosis
LAGGSGPSAGAGLLRA

SEQ ID NO: 108782 - protein, 16 aa, Mycobacterium tuberculosis
AGGSGPSAGAGLLRAE

SEQ ID NO: 108783 - protein, 16 aa, Mycobacterium tuberculosis
GGSGPSAGAGLLRAES

SEQ ID NO: 108784 - protein, 16 aa, Mycobacterium tuberculosis
GSGPSAGAGLLRAESL

SEQ ID NO: 108785 - protein, 16 aa, Mycobacterium tuberculosis
SGPSAGAGLLRAESLP

SEQ ID NO: 108786 - protein, 16 aa, Mycobacterium tuberculosis
GPSAGAGLLRAESLPG

SEQ ID NO: 108787 - protein, 16 aa, Mycobacterium tuberculosis
PSAGAGLLRAESLPGA

SEQ ID NO: 108788 - protein, 16 aa, Mycobacterium tuberculosis
SAGAGLLRAESLPGAG

SEQ ID NO: 108789 - protein, 16 aa, Mycobacterium tuberculosis
AGAGLLRAESLPGAGG

SEQ ID NO: 108790 - protein, 16 aa, Mycobacterium tuberculosis
GAGLLRAESLPGAGGS

SEQ ID NO: 108791 - protein, 16 aa, Mycobacterium tuberculosis
AGLLRAESLPGAGGSL

SEQ ID NO: 108792 - protein, 16 aa, Mycobacterium tuberculosis
GLLRAESLPGAGGSLT

SEQ ID NO: 108793 - protein, 16 aa, Mycobacterium tuberculosis
LLRAESLPGAGGSLTR

SEQ ID NO: 108794 - protein, 16 aa, Mycobacterium tuberculosis
LRAESLPGAGGSLTRT

SEQ ID NO: 108795 - protein, 16 aa, Mycobacterium tuberculosis
RAESLPGAGGSLTRTP

SEQ ID NO: 108796 - protein, 16 aa, Mycobacterium tuberculosis
AESLPGAGGSLTRTPL

SEQ ID NO: 108797 - protein, 16 aa, Mycobacterium tuberculosis
ESLPGAGGSLTRTPLM

SEQ ID NO: 108798 - protein, 16 aa, Mycobacterium tuberculosis
SLPGAGGSLTRTPLMS

SEQ ID NO: 108799 - protein, 16 aa, Mycobacterium tuberculosis
LPGAGGSLTRTPLMSQ

SEQ ID NO: 108800 - protein, 16 aa, Mycobacterium tuberculosis
PGAGGSLTRTPLMSQL

SEQ ID NO: 108801 - protein, 16 aa, Mycobacterium tuberculosis
GAGGSLTRTPLMSQLI

SEQ ID NO: 108802 - protein, 16 aa, Mycobacterium tuberculosis
AGGSLTRTPLMSQLIE

SEQ ID NO: 108803 - protein, 16 aa, Mycobacterium tuberculosis
GGSLTRTPLMSQLIEK

SEQ ID NO: 108804 - protein, 16 aa, Mycobacterium tuberculosis
GSLTRTPLMSQLIEKP

SEQ ID NO: 108805 - protein, 16 aa, Mycobacterium tuberculosis
SLTRTPLMSQLIEKPV

SEQ ID NO: 108806 - protein, 16 aa, Mycobacterium tuberculosis
LTRTPLMSQLIEKPVA

SEQ ID NO: 108807 - protein, 16 aa, Mycobacterium tuberculosis
TRTPLMSQLIEKPVAP

SEQ ID NO: 108808 - protein, 16 aa, Mycobacterium tuberculosis
RTPLMSQLIEKPVAPS

SEQ ID NO: 108809 - protein, 16 aa, Mycobacterium tuberculosis
TPLMSQLIEKPVAPSV

SEQ ID NO: 108810 - protein, 16 aa, Mycobacterium tuberculosis
PLMSQLIEKPVAPSVM

SEQ ID NO: 108811 - protein, 16 aa, Mycobacterium tuberculosis
LMSQLIEKPVAPSVMP

SEQ ID NO: 108812 - protein, 16 aa, Mycobacterium tuberculosis
MSQLIEKPVAPSVMPA

SEQ ID NO: 108813 - protein, 16 aa, Mycobacterium tuberculosis
SQLIEKPVAPSVMPAA

SEQ ID NO: 108814 - protein, 16 aa, Mycobacterium tuberculosis
QLIEKPVAPSVMPAAA

SEQ ID NO: 108815 - protein, 16 aa, Mycobacterium tuberculosis
LIEKPVAPSVMPAAAA

SEQ ID NO: 108816 - protein, 16 aa, Mycobacterium tuberculosis
IEKPVAPSVMPAAAAG

SEQ ID NO: 108817 - protein, 16 aa, Mycobacterium tuberculosis
EKPVAPSVMPAAAAGS

SEQ ID NO: 108818 - protein, 16 aa, Mycobacterium tuberculosis
KPVAPSVMPAAAAGSS

SEQ ID NO: 108819 - protein, 16 aa, Mycobacterium tuberculosis
PVAPSVMPAAAAGSSA

SEQ ID NO: 108820 - protein, 16 aa, Mycobacterium tuberculosis
VAPSVMPAAAAGSSAT

SEQ ID NO: 108821 - protein, 16 aa, Mycobacterium tuberculosis
APSVMPAAAAGSSATG

SEQ ID NO: 108822 - protein, 16 aa, Mycobacterium tuberculosis
PSVMPAAAAGSSATGG

SEQ ID NO: 108823 - protein, 16 aa, Mycobacterium tuberculosis
SVMPAAAAGSSATGGA

SEQ ID NO: 108824 - protein, 16 aa, Mycobacterium tuberculosis
VMPAAAAGSSATGGAA

SEQ ID NO: 108825 - protein, 16 aa, Mycobacterium tuberculosis
MPAAAAGSSATGGAAP

SEQ ID NO: 108826 - protein, 16 aa, Mycobacterium tuberculosis
PAAAAGSSATGGAAPV

SEQ ID NO: 108827 - protein, 16 aa, Mycobacterium tuberculosis
AAAAGSSATGGAAPVG

SEQ ID NO: 108828 - protein, 16 aa, Mycobacterium tuberculosis
AAAGSSATGGAAPVGA

SEQ ID NO: 108829 - protein, 16 aa, Mycobacterium tuberculosis
AAGSSATGGAAPVGAG

SEQ ID NO: 108830 - protein, 16 aa, Mycobacterium tuberculosis
AGSSATGGAAPVGAGA

SEQ ID NO: 108831 - protein, 16 aa, Mycobacterium tuberculosis
GSSATGGAAPVGAGAM

SEQ ID NO: 108832 - protein, 16 aa, Mycobacterium tuberculosis
SSATGGAAPVGAGAMG

SEQ ID NO: 108833 - protein, 16 aa, Mycobacterium tuberculosis
SATGGAAPVGAGAMGQ

SEQ ID NO: 108834 - protein, 16 aa, Mycobacterium tuberculosis
ATGGAAPVGAGAMGQG

SEQ ID NO: 108835 - protein, 16 aa, Mycobacterium tuberculosis
TGGAAPVGAGAMGQGA

SEQ ID NO: 108836 - protein, 16 aa, Mycobacterium tuberculosis
GGAAPVGAGAMGQGAQ

SEQ ID NO: 108837 - protein, 16 aa, Mycobacterium tuberculosis
GAAPVGAGAMGQGAQS

SEQ ID NO: 108838 - protein, 16 aa, Mycobacterium tuberculosis
AAPVGAGAMGQGAQSG

SEQ ID NO: 108839 - protein, 16 aa, Mycobacterium tuberculosis
APVGAGAMGQGAQSGG

SEQ ID NO: 108840 - protein, 16 aa, Mycobacterium tuberculosis
PVGAGAMGQGAQSGGS

SEQ ID NO: 108841 - protein, 16 aa, Mycobacterium tuberculosis
VGAGAMGQGAQSGGST

SEQ ID NO: 108842 - protein, 16 aa, Mycobacterium tuberculosis
GAGAMGQGAQSGGSTR

SEQ ID NO: 108843 - protein, 16 aa, Mycobacterium tuberculosis
AGAMGQGAQSGGSTRP

SEQ ID NO: 108844 - protein, 16 aa, Mycobacterium tuberculosis
GAMGQGAQSGGSTRPG

SEQ ID NO: 108845 - protein, 16 aa, Mycobacterium tuberculosis
AMGQGAQSGGSTRPGL

SEQ ID NO: 108846 - protein, 16 aa, Mycobacterium tuberculosis
MGQGAQSGGSTRPGLV

SEQ ID NO: 108847 - protein, 16 aa, Mycobacterium tuberculosis
GQGAQSGGSTRPGLVA

SEQ ID NO: 108848 - protein, 16 aa, Mycobacterium tuberculosis
QGAQSGGSTRPGLVAP

SEQ ID NO: 108849 - protein, 16 aa, Mycobacterium tuberculosis
GAQSGGSTRPGLVAPA

SEQ ID NO: 108850 - protein, 16 aa, Mycobacterium tuberculosis
AQSGGSTRPGLVAPAP

SEQ ID NO: 108851 - protein, 16 aa, Mycobacterium tuberculosis
QSGGSTRPGLVAPAPL

SEQ ID NO: 108852 - protein, 16 aa, Mycobacterium tuberculosis
SGGSTRPGLVAPAPLA

SEQ ID NO: 108853 - protein, 16 aa, Mycobacterium tuberculosis
GGSTRPGLVAPAPLAQ

SEQ ID NO: 108854 - protein, 16 aa, Mycobacterium tuberculosis
GSTRPGLVAPAPLAQE

SEQ ID NO: 108855 - protein, 16 aa, Mycobacterium tuberculosis
STRPGLVAPAPLAQER

SEQ ID NO: 108856 - protein, 16 aa, Mycobacterium tuberculosis
TRPGLVAPAPLAQERE

SEQ ID NO: 108857 - protein, 16 aa, Mycobacterium tuberculosis
RPGLVAPAPLAQEREE

SEQ ID NO: 108858 - protein, 16 aa, Mycobacterium tuberculosis
PGLVAPAPLAQEREED

SEQ ID NO: 108859 - protein, 16 aa, Mycobacterium tuberculosis
GLVAPAPLAQEREEDD

SEQ ID NO: 108860 - protein, 16 aa, Mycobacterium tuberculosis
LVAPAPLAQEREEDDE

SEQ ID NO: 108861 - protein, 16 aa, Mycobacterium tuberculosis
VAPAPLAQEREEDDED

SEQ ID NO: 108862 - protein, 16 aa, Mycobacterium tuberculosis
APAPLAQEREEDDEDD

SEQ ID NO: 108863 - protein, 16 aa, Mycobacterium tuberculosis
PAPLAQEREEDDEDDW

SEQ ID NO: 108864 - protein, 16 aa, Mycobacterium tuberculosis
APLAQEREEDDEDDWD

SEQ ID NO: 108865 - protein, 16 aa, Mycobacterium tuberculosis
PLAQEREEDDEDDWDE

SEQ ID NO: 108866 - protein, 16 aa, Mycobacterium tuberculosis
LAQEREEDDEDDWDEE

SEQ ID NO: 108867 - protein, 16 aa, Mycobacterium tuberculosis
AQEREEDDEDDWDEED

SEQ ID NO: 108868 - protein, 16 aa, Mycobacterium tuberculosis
QEREEDDEDDWDEEDD

SEQ ID NO: 108869 - protein, 16 aa, Mycobacterium tuberculosis
EREEDDEDDWDEEDDW

SEQ ID NO: 108870 - protein, 13 aa, Mycobacterium tuberculosis
MAEMKTDAATLAQ

SEQ ID NO: 108871 - protein, 13 aa, Mycobacterium tuberculosis
AEMKTDAATLAQE

SEQ ID NO: 108872 - protein, 13 aa, Mycobacterium tuberculosis
EMKTDAATLAQEA

SEQ ID NO: 108873 - protein, 13 aa, Mycobacterium tuberculosis
MKTDAATLAQEAG

SEQ ID NO: 108874 - protein, 13 aa, Mycobacterium tuberculosis
KTDAATLAQEAGN

SEQ ID NO: 108875 - protein, 13 aa, Mycobacterium tuberculosis
TDAATLAQEAGNF

SEQ ID NO: 108876 - protein, 13 aa, Mycobacterium tuberculosis
DAATLAQEAGNFE

SEQ ID NO: 108877 - protein, 13 aa, Mycobacterium tuberculosis
AATLAQEAGNFER

SEQ ID NO: 108878 - protein, 13 aa, Mycobacterium tuberculosis
ATLAQEAGNFERI

SEQ ID NO: 108879 - protein, 13 aa, Mycobacterium tuberculosis
TLAQEAGNFERIS

SEQ ID NO: 108880 - protein, 13 aa, Mycobacterium tuberculosis
LAQEAGNFERISG

SEQ ID NO: 108881 - protein, 13 aa, Mycobacterium tuberculosis
AQEAGNFERISGD

SEQ ID NO: 108882 - protein, 13 aa, Mycobacterium tuberculosis
QEAGNFERISGDL

SEQ ID NO: 108883 - protein, 13 aa, Mycobacterium tuberculosis
EAGNFERISGDLK

SEQ ID NO: 108884 - protein, 13 aa, Mycobacterium tuberculosis
AGNFERISGDLKT

SEQ ID NO: 108885 - protein, 13 aa, Mycobacterium tuberculosis
GNFERISGDLKTQ

SEQ ID NO: 108886 - protein, 13 aa, Mycobacterium tuberculosis
NFERISGDLKTQI

SEQ ID NO: 108887 - protein, 13 aa, Mycobacterium tuberculosis
FERISGDLKTQID

SEQ ID NO: 108888 - protein, 13 aa, Mycobacterium tuberculosis
ERISGDLKTQIDQ

SEQ ID NO: 108889 - protein, 13 aa, Mycobacterium tuberculosis
RISGDLKTQIDQV

SEQ ID NO: 108890 - protein, 13 aa, Mycobacterium tuberculosis
ISGDLKTQIDQVE

SEQ ID NO: 108891 - protein, 13 aa, Mycobacterium tuberculosis
SGDLKTQIDQVES

SEQ ID NO: 108892 - protein, 13 aa, Mycobacterium tuberculosis
GDLKTQIDQVEST

SEQ ID NO: 108893 - protein, 13 aa, Mycobacterium tuberculosis
DLKTQIDQVESTA

SEQ ID NO: 108894 - protein, 13 aa, Mycobacterium tuberculosis
LKTQIDQVESTAG

SEQ ID NO: 108895 - protein, 13 aa, Mycobacterium tuberculosis
KTQIDQVESTAGS

SEQ ID NO: 108896 - protein, 13 aa, Mycobacterium tuberculosis
TQIDQVESTAGSL

SEQ ID NO: 108897 - protein, 13 aa, Mycobacterium tuberculosis
QIDQVESTAGSLQ

SEQ ID NO: 108898 - protein, 13 aa, Mycobacterium tuberculosis
IDQVESTAGSLQG

SEQ ID NO: 108899 - protein, 13 aa, Mycobacterium tuberculosis
DQVESTAGSLQGQ

SEQ ID NO: 108900 - protein, 13 aa, Mycobacterium tuberculosis
QVESTAGSLQGQW

SEQ ID NO: 108901 - protein, 13 aa, Mycobacterium tuberculosis
VESTAGSLQGQWR

SEQ ID NO: 108902 - protein, 13 aa, Mycobacterium tuberculosis
ESTAGSLQGQWRG

SEQ ID NO: 108903 - protein, 13 aa, Mycobacterium tuberculosis
STAGSLQGQWRGA

SEQ ID NO: 108904 - protein, 13 aa, Mycobacterium tuberculosis
TAGSLQGQWRGAA

SEQ ID NO: 108905 - protein, 13 aa, Mycobacterium tuberculosis
AGSLQGQWRGAAG

SEQ ID NO: 108906 - protein, 13 aa, Mycobacterium tuberculosis
GSLQGQWRGAAGT

SEQ ID NO: 108907 - protein, 13 aa, Mycobacterium tuberculosis
SLQGQWRGAAGTA

SEQ ID NO: 108908 - protein, 13 aa, Mycobacterium tuberculosis
LQGQWRGAAGTAA

SEQ ID NO: 108909 - protein, 13 aa, Mycobacterium tuberculosis
QGQWRGAAGTAAQ

SEQ ID NO: 108910 - protein, 13 aa, Mycobacterium tuberculosis
GQWRGAAGTAAQA

SEQ ID NO: 108911 - protein, 13 aa, Mycobacterium tuberculosis
QWRGAAGTAAQAA

SEQ ID NO: 108912 - protein, 13 aa, Mycobacterium tuberculosis
WRGAAGTAAQAAV

SEQ ID NO: 108913 - protein, 13 aa, Mycobacterium tuberculosis
RGAAGTAAQAAVV

SEQ ID NO: 108914 - protein, 13 aa, Mycobacterium tuberculosis
GAAGTAAQAAVVR

SEQ ID NO: 108915 - protein, 13 aa, Mycobacterium tuberculosis
AAGTAAQAAVVRF

SEQ ID NO: 108916 - protein, 13 aa, Mycobacterium tuberculosis
AGTAAQAAVVRFQ

SEQ ID NO: 108917 - protein, 13 aa, Mycobacterium tuberculosis
GTAAQAAVVRFQE

SEQ ID NO: 108918 - protein, 13 aa, Mycobacterium tuberculosis
TAAQAAVVRFQEA

SEQ ID NO: 108919 - protein, 13 aa, Mycobacterium tuberculosis
AAQAAVVRFQEAA

SEQ ID NO: 108920 - protein, 13 aa, Mycobacterium tuberculosis
AQAAVVRFQEAAN

SEQ ID NO: 108921 - protein, 13 aa, Mycobacterium tuberculosis
QAAVVRFQEAANK

SEQ ID NO: 108922 - protein, 13 aa, Mycobacterium tuberculosis
AAVVRFQEAANKQ

SEQ ID NO: 108923 - protein, 13 aa, Mycobacterium tuberculosis
AVVRFQEAANKQK

SEQ ID NO: 108924 - protein, 13 aa, Mycobacterium tuberculosis
VVRFQEAANKQKQ

SEQ ID NO: 108925 - protein, 13 aa, Mycobacterium tuberculosis
VRFQEAANKQKQE

SEQ ID NO: 108926 - protein, 13 aa, Mycobacterium tuberculosis
RFQEAANKQKQEL

SEQ ID NO: 108927 - protein, 13 aa, Mycobacterium tuberculosis
FQEAANKQKQELD

SEQ ID NO: 108928 - protein, 13 aa, Mycobacterium tuberculosis
QEAANKQKQELDE

SEQ ID NO: 108929 - protein, 13 aa, Mycobacterium tuberculosis
EAANKQKQELDEI

SEQ ID NO: 108930 - protein, 13 aa, Mycobacterium tuberculosis
AANKQKQELDEIS

SEQ ID NO: 108931 - protein, 13 aa, Mycobacterium tuberculosis
ANKQKQELDEIST

SEQ ID NO: 108932 - protein, 13 aa, Mycobacterium tuberculosis
NKQKQELDEISTN

SEQ ID NO: 108933 - protein, 13 aa, Mycobacterium tuberculosis
KQKQELDEISTNI

SEQ ID NO: 108934 - protein, 13 aa, Mycobacterium tuberculosis
QKQELDEISTNIR

SEQ ID NO: 108935 - protein, 13 aa, Mycobacterium tuberculosis
KQELDEISTNIRQ

SEQ ID NO: 108936 - protein, 13 aa, Mycobacterium tuberculosis
QELDEISTNIRQA

SEQ ID NO: 108937 - protein, 13 aa, Mycobacterium tuberculosis
ELDEISTNIRQAG

SEQ ID NO: 108938 - protein, 13 aa, Mycobacterium tuberculosis
LDEISTNIRQAGV

SEQ ID NO: 108939 - protein, 13 aa, Mycobacterium tuberculosis
DEISTNIRQAGVQ

SEQ ID NO: 108940 - protein, 13 aa, Mycobacterium tuberculosis
EISTNIRQAGVQY

SEQ ID NO: 108941 - protein, 13 aa, Mycobacterium tuberculosis
ISTNIRQAGVQYS

SEQ ID NO: 108942 - protein, 13 aa, Mycobacterium tuberculosis
STNIRQAGVQYSR

SEQ ID NO: 108943 - protein, 13 aa, Mycobacterium tuberculosis
TNIRQAGVQYSRA

SEQ ID NO: 108944 - protein, 13 aa, Mycobacterium tuberculosis
NIRQAGVQYSRAD

SEQ ID NO: 108945 - protein, 13 aa, Mycobacterium tuberculosis
IRQAGVQYSRADE

SEQ ID NO: 108946 - protein, 13 aa, Mycobacterium tuberculosis
RQAGVQYSRADEE

SEQ ID NO: 108947 - protein, 13 aa, Mycobacterium tuberculosis
QAGVQYSRADEEQ

SEQ ID NO: 108948 - protein, 13 aa, Mycobacterium tuberculosis
AGVQYSRADEEQQ

SEQ ID NO: 108949 - protein, 13 aa, Mycobacterium tuberculosis
GVQYSRADEEQQQ

SEQ ID NO: 108950 - protein, 13 aa, Mycobacterium tuberculosis
VQYSRADEEQQQA

SEQ ID NO: 108951 - protein, 13 aa, Mycobacterium tuberculosis
QYSRADEEQQQAL

SEQ ID NO: 108952 - protein, 13 aa, Mycobacterium tuberculosis
YSRADEEQQQALS

SEQ ID NO: 108953 - protein, 13 aa, Mycobacterium tuberculosis
SRADEEQQQALSS

SEQ ID NO: 108954 - protein, 13 aa, Mycobacterium tuberculosis
RADEEQQQALSSQ

SEQ ID NO: 108955 - protein, 13 aa, Mycobacterium tuberculosis
ADEEQQQALSSQM

SEQ ID NO: 108956 - protein, 13 aa, Mycobacterium tuberculosis
DEEQQQALSSQMG

SEQ ID NO: 108957 - protein, 13 aa, Mycobacterium tuberculosis
EEQQQALSSQMGF

SEQ ID NO: 108958 - protein, 14 aa, Mycobacterium tuberculosis
MAEMKTDAATLAQE

SEQ ID NO: 108959 - protein, 14 aa, Mycobacterium tuberculosis
AEMKTDAATLAQEA

SEQ ID NO: 108960 - protein, 14 aa, Mycobacterium tuberculosis
EMKTDAATLAQEAG

SEQ ID NO: 108961 - protein, 14 aa, Mycobacterium tuberculosis
MKTDAATLAQEAGN

SEQ ID NO: 108962 - protein, 14 aa, Mycobacterium tuberculosis
KTDAATLAQEAGNF

SEQ ID NO: 108963 - protein, 14 aa, Mycobacterium tuberculosis
TDAATLAQEAGNFE

SEQ ID NO: 108964 - protein, 14 aa, Mycobacterium tuberculosis
DAATLAQEAGNFER

SEQ ID NO: 108965 - protein, 14 aa, Mycobacterium tuberculosis
AATLAQEAGNFERI

SEQ ID NO: 108966 - protein, 14 aa, Mycobacterium tuberculosis
ATLAQEAGNFERIS

SEQ ID NO: 108967 - protein, 14 aa, Mycobacterium tuberculosis
TLAQEAGNFERISG

SEQ ID NO: 108968 - protein, 14 aa, Mycobacterium tuberculosis
LAQEAGNFERISGD

SEQ ID NO: 108969 - protein, 14 aa, Mycobacterium tuberculosis
AQEAGNFERISGDL

SEQ ID NO: 108970 - protein, 14 aa, Mycobacterium tuberculosis
QEAGNFERISGDLK

SEQ ID NO: 108971 - protein, 14 aa, Mycobacterium tuberculosis
EAGNFERISGDLKT

SEQ ID NO: 108972 - protein, 14 aa, Mycobacterium tuberculosis
AGNFERISGDLKTQ

SEQ ID NO: 108973 - protein, 14 aa, Mycobacterium tuberculosis
GNFERISGDLKTQI

SEQ ID NO: 108974 - protein, 14 aa, Mycobacterium tuberculosis
NFERISGDLKTQID

SEQ ID NO: 108975 - protein, 14 aa, Mycobacterium tuberculosis
FERISGDLKTQIDQ

SEQ ID NO: 108976 - protein, 14 aa, Mycobacterium tuberculosis
ERISGDLKTQIDQV

SEQ ID NO: 108977 - protein, 14 aa, Mycobacterium tuberculosis
RISGDLKTQIDQVE

SEQ ID NO: 108978 - protein, 14 aa, Mycobacterium tuberculosis
ISGDLKTQIDQVES

SEQ ID NO: 108979 - protein, 14 aa, Mycobacterium tuberculosis
SGDLKTQIDQVEST

SEQ ID NO: 108980 - protein, 14 aa, Mycobacterium tuberculosis
GDLKTQIDQVESTA

SEQ ID NO: 108981 - protein, 14 aa, Mycobacterium tuberculosis
DLKTQIDQVESTAG

SEQ ID NO: 108982 - protein, 14 aa, Mycobacterium tuberculosis
LKTQIDQVESTAGS

SEQ ID NO: 108983 - protein, 14 aa, Mycobacterium tuberculosis
KTQIDQVESTAGSL

SEQ ID NO: 108984 - protein, 14 aa, Mycobacterium tuberculosis
TQIDQVESTAGSLQ

SEQ ID NO: 108985 - protein, 14 aa, Mycobacterium tuberculosis
QIDQVESTAGSLQG

SEQ ID NO: 108986 - protein, 14 aa, Mycobacterium tuberculosis
IDQVESTAGSLQGQ

SEQ ID NO: 108987 - protein, 14 aa, Mycobacterium tuberculosis
DQVESTAGSLQGQW

SEQ ID NO: 108988 - protein, 14 aa, Mycobacterium tuberculosis
QVESTAGSLQGQWR

SEQ ID NO: 108989 - protein, 14 aa, Mycobacterium tuberculosis
VESTAGSLQGQWRG

SEQ ID NO: 108990 - protein, 14 aa, Mycobacterium tuberculosis
ESTAGSLQGQWRGA

SEQ ID NO: 108991 - protein, 14 aa, Mycobacterium tuberculosis
STAGSLQGQWRGAA

SEQ ID NO: 108992 - protein, 14 aa, Mycobacterium tuberculosis
TAGSLQGQWRGAAG

SEQ ID NO: 108993 - protein, 14 aa, Mycobacterium tuberculosis
AGSLQGQWRGAAGT

SEQ ID NO: 108994 - protein, 14 aa, Mycobacterium tuberculosis
GSLQGQWRGAAGTA

SEQ ID NO: 108995 - protein, 14 aa, Mycobacterium tuberculosis
SLQGQWRGAAGTAA

SEQ ID NO: 108996 - protein, 14 aa, Mycobacterium tuberculosis
LQGQWRGAAGTAAQ

SEQ ID NO: 108997 - protein, 14 aa, Mycobacterium tuberculosis
QGQWRGAAGTAAQA

SEQ ID NO: 108998 - protein, 14 aa, Mycobacterium tuberculosis
GQWRGAAGTAAQAA

SEQ ID NO: 108999 - protein, 14 aa, Mycobacterium tuberculosis
QWRGAAGTAAQAAV

SEQ ID NO: 109000 - protein, 14 aa, Mycobacterium tuberculosis
WRGAAGTAAQAAVV

SEQ ID NO: 109001 - protein, 14 aa, Mycobacterium tuberculosis
RGAAGTAAQAAVVR

SEQ ID NO: 109002 - protein, 14 aa, Mycobacterium tuberculosis
GAAGTAAQAAVVRF

SEQ ID NO: 109003 - protein, 14 aa, Mycobacterium tuberculosis
AAGTAAQAAVVRFQ

SEQ ID NO: 109004 - protein, 14 aa, Mycobacterium tuberculosis
AGTAAQAAVVRFQE

SEQ ID NO: 109005 - protein, 14 aa, Mycobacterium tuberculosis
GTAAQAAVVRFQEA

SEQ ID NO: 109006 - protein, 14 aa, Mycobacterium tuberculosis
TAAQAAVVRFQEAA

SEQ ID NO: 109007 - protein, 14 aa, Mycobacterium tuberculosis
AAQAAVVRFQEAAN

SEQ ID NO: 109008 - protein, 14 aa, Mycobacterium tuberculosis
AQAAVVRFQEAANK

SEQ ID NO: 109009 - protein, 14 aa, Mycobacterium tuberculosis
QAAVVRFQEAANKQ

SEQ ID NO: 109010 - protein, 14 aa, Mycobacterium tuberculosis
AAVVRFQEAANKQK

SEQ ID NO: 109011 - protein, 14 aa, Mycobacterium tuberculosis
AVVRFQEAANKQKQ

SEQ ID NO: 109012 - protein, 14 aa, Mycobacterium tuberculosis
VVRFQEAANKQKQE

SEQ ID NO: 109013 - protein, 14 aa, Mycobacterium tuberculosis
VRFQEAANKQKQEL

SEQ ID NO: 109014 - protein, 14 aa, Mycobacterium tuberculosis
RFQEAANKQKQELD

SEQ ID NO: 109015 - protein, 14 aa, Mycobacterium tuberculosis
FQEAANKQKQELDE

SEQ ID NO: 109016 - protein, 14 aa, Mycobacterium tuberculosis
QEAANKQKQELDEI

SEQ ID NO: 109017 - protein, 14 aa, Mycobacterium tuberculosis
EAANKQKQELDEIS

SEQ ID NO: 109018 - protein, 14 aa, Mycobacterium tuberculosis
AANKQKQELDEIST

SEQ ID NO: 109019 - protein, 14 aa, Mycobacterium tuberculosis
ANKQKQELDEISTN

SEQ ID NO: 109020 - protein, 14 aa, Mycobacterium tuberculosis
NKQKQELDEISTNI

SEQ ID NO: 109021 - protein, 14 aa, Mycobacterium tuberculosis
KQKQELDEISTNIR

SEQ ID NO: 109022 - protein, 14 aa, Mycobacterium tuberculosis
QKQELDEISTNIRQ

SEQ ID NO: 109023 - protein, 14 aa, Mycobacterium tuberculosis
KQELDEISTNIRQA

SEQ ID NO: 109024 - protein, 14 aa, Mycobacterium tuberculosis
QELDEISTNIRQAG

SEQ ID NO: 109025 - protein, 14 aa, Mycobacterium tuberculosis
ELDEISTNIRQAGV

SEQ ID NO: 109026 - protein, 14 aa, Mycobacterium tuberculosis
LDEISTNIRQAGVQ

SEQ ID NO: 109027 - protein, 14 aa, Mycobacterium tuberculosis
DEISTNIRQAGVQY

SEQ ID NO: 109028 - protein, 14 aa, Mycobacterium tuberculosis
EISTNIRQAGVQYS

SEQ ID NO: 109029 - protein, 14 aa, Mycobacterium tuberculosis
ISTNIRQAGVQYSR

SEQ ID NO: 109030 - protein, 14 aa, Mycobacterium tuberculosis
STNIRQAGVQYSRA

SEQ ID NO: 109031 - protein, 14 aa, Mycobacterium tuberculosis
TNIRQAGVQYSRAD

SEQ ID NO: 109032 - protein, 14 aa, Mycobacterium tuberculosis
NIRQAGVQYSRADE

SEQ ID NO: 109033 - protein, 14 aa, Mycobacterium tuberculosis
IRQAGVQYSRADEE

SEQ ID NO: 109034 - protein, 14 aa, Mycobacterium tuberculosis
RQAGVQYSRADEEQ

SEQ ID NO: 109035 - protein, 14 aa, Mycobacterium tuberculosis
QAGVQYSRADEEQQ

SEQ ID NO: 109036 - protein, 14 aa, Mycobacterium tuberculosis
AGVQYSRADEEQQQ

SEQ ID NO: 109037 - protein, 14 aa, Mycobacterium tuberculosis
GVQYSRADEEQQQA

SEQ ID NO: 109038 - protein, 14 aa, Mycobacterium tuberculosis
VQYSRADEEQQQAL

SEQ ID NO: 109039 - protein, 14 aa, Mycobacterium tuberculosis
QYSRADEEQQQALS

SEQ ID NO: 109040 - protein, 14 aa, Mycobacterium tuberculosis
YSRADEEQQQALSS

SEQ ID NO: 109041 - protein, 14 aa, Mycobacterium tuberculosis
SRADEEQQQALSSQ

SEQ ID NO: 109042 - protein, 14 aa, Mycobacterium tuberculosis
RADEEQQQALSSQM

SEQ ID NO: 109043 - protein, 14 aa, Mycobacterium tuberculosis
ADEEQQQALSSQMG

SEQ ID NO: 109044 - protein, 14 aa, Mycobacterium tuberculosis
DEEQQQALSSQMGF

SEQ ID NO: 109045 - protein, 15 aa, Mycobacterium tuberculosis
MAEMKTDAATLAQEA

SEQ ID NO: 109046 - protein, 15 aa, Mycobacterium tuberculosis
AEMKTDAATLAQEAG

SEQ ID NO: 109047 - protein, 15 aa, Mycobacterium tuberculosis
EMKTDAATLAQEAGN

SEQ ID NO: 109048 - protein, 15 aa, Mycobacterium tuberculosis
MKTDAATLAQEAGNF

SEQ ID NO: 109049 - protein, 15 aa, Mycobacterium tuberculosis
KTDAATLAQEAGNFE

SEQ ID NO: 109050 - protein, 15 aa, Mycobacterium tuberculosis
TDAATLAQEAGNFER

SEQ ID NO: 109051 - protein, 15 aa, Mycobacterium tuberculosis
DAATLAQEAGNFERI

SEQ ID NO: 109052 - protein, 15 aa, Mycobacterium tuberculosis
AATLAQEAGNFERIS

SEQ ID NO: 109053 - protein, 15 aa, Mycobacterium tuberculosis
ATLAQEAGNFERISG

SEQ ID NO: 109054 - protein, 15 aa, Mycobacterium tuberculosis
TLAQEAGNFERISGD

SEQ ID NO: 109055 - protein, 15 aa, Mycobacterium tuberculosis
LAQEAGNFERISGDL

SEQ ID NO: 109056 - protein, 15 aa, Mycobacterium tuberculosis
AQEAGNFERISGDLK

SEQ ID NO: 109057 - protein, 15 aa, Mycobacterium tuberculosis
QEAGNFERISGDLKT

SEQ ID NO: 109058 - protein, 15 aa, Mycobacterium tuberculosis
EAGNFERISGDLKTQ

SEQ ID NO: 109059 - protein, 15 aa, Mycobacterium tuberculosis
AGNFERISGDLKTQI

SEQ ID NO: 109060 - protein, 15 aa, Mycobacterium tuberculosis
GNFERISGDLKTQID

SEQ ID NO: 109061 - protein, 15 aa, Mycobacterium tuberculosis
NFERISGDLKTQIDQ

SEQ ID NO: 109062 - protein, 15 aa, Mycobacterium tuberculosis
FERISGDLKTQIDQV

SEQ ID NO: 109063 - protein, 15 aa, Mycobacterium tuberculosis
ERISGDLKTQIDQVE

SEQ ID NO: 109064 - protein, 15 aa, Mycobacterium tuberculosis
RISGDLKTQIDQVES

SEQ ID NO: 109065 - protein, 15 aa, Mycobacterium tuberculosis
ISGDLKTQIDQVEST

SEQ ID NO: 109066 - protein, 15 aa, Mycobacterium tuberculosis
SGDLKTQIDQVESTA

SEQ ID NO: 109067 - protein, 15 aa, Mycobacterium tuberculosis
GDLKTQIDQVESTAG

SEQ ID NO: 109068 - protein, 15 aa, Mycobacterium tuberculosis
DLKTQIDQVESTAGS

SEQ ID NO: 109069 - protein, 15 aa, Mycobacterium tuberculosis
LKTQIDQVESTAGSL

SEQ ID NO: 109070 - protein, 15 aa, Mycobacterium tuberculosis
KTQIDQVESTAGSLQ

SEQ ID NO: 109071 - protein, 15 aa, Mycobacterium tuberculosis
TQIDQVESTAGSLQG

SEQ ID NO: 109072 - protein, 15 aa, Mycobacterium tuberculosis
QIDQVESTAGSLQGQ

SEQ ID NO: 109073 - protein, 15 aa, Mycobacterium tuberculosis
IDQVESTAGSLQGQW

SEQ ID NO: 109074 - protein, 15 aa, Mycobacterium tuberculosis
DQVESTAGSLQGQWR

SEQ ID NO: 109075 - protein, 15 aa, Mycobacterium tuberculosis
QVESTAGSLQGQWRG

SEQ ID NO: 109076 - protein, 15 aa, Mycobacterium tuberculosis
VESTAGSLQGQWRGA

SEQ ID NO: 109077 - protein, 15 aa, Mycobacterium tuberculosis
ESTAGSLQGQWRGAA

SEQ ID NO: 109078 - protein, 15 aa, Mycobacterium tuberculosis
STAGSLQGQWRGAAG

SEQ ID NO: 109079 - protein, 15 aa, Mycobacterium tuberculosis
TAGSLQGQWRGAAGT

SEQ ID NO: 109080 - protein, 15 aa, Mycobacterium tuberculosis
AGSLQGQWRGAAGTA

SEQ ID NO: 109081 - protein, 15 aa, Mycobacterium tuberculosis
GSLQGQWRGAAGTAA

SEQ ID NO: 109082 - protein, 15 aa, Mycobacterium tuberculosis
SLQGQWRGAAGTAAQ

SEQ ID NO: 109083 - protein, 15 aa, Mycobacterium tuberculosis
LQGQWRGAAGTAAQA

SEQ ID NO: 109084 - protein, 15 aa, Mycobacterium tuberculosis
QGQWRGAAGTAAQAA

SEQ ID NO: 109085 - protein, 15 aa, Mycobacterium tuberculosis
GQWRGAAGTAAQAAV

SEQ ID NO: 109086 - protein, 15 aa, Mycobacterium tuberculosis
QWRGAAGTAAQAAVV

SEQ ID NO: 109087 - protein, 15 aa, Mycobacterium tuberculosis
WRGAAGTAAQAAVVR

SEQ ID NO: 109088 - protein, 15 aa, Mycobacterium tuberculosis
RGAAGTAAQAAVVRF

SEQ ID NO: 109089 - protein, 15 aa, Mycobacterium tuberculosis
GAAGTAAQAAVVRFQ

SEQ ID NO: 109090 - protein, 15 aa, Mycobacterium tuberculosis
AAGTAAQAAVVRFQE

SEQ ID NO: 109091 - protein, 15 aa, Mycobacterium tuberculosis
AGTAAQAAVVRFQEA

SEQ ID NO: 109092 - protein, 15 aa, Mycobacterium tuberculosis
GTAAQAAVVRFQEAA

SEQ ID NO: 109093 - protein, 15 aa, Mycobacterium tuberculosis
TAAQAAVVRFQEAAN

SEQ ID NO: 109094 - protein, 15 aa, Mycobacterium tuberculosis
AAQAAVVRFQEAANK

SEQ ID NO: 109095 - protein, 15 aa, Mycobacterium tuberculosis
AQAAVVRFQEAANKQ

SEQ ID NO: 109096 - protein, 15 aa, Mycobacterium tuberculosis
QAAVVRFQEAANKQK

SEQ ID NO: 109097 - protein, 15 aa, Mycobacterium tuberculosis
AAVVRFQEAANKQKQ

SEQ ID NO: 109098 - protein, 15 aa, Mycobacterium tuberculosis
AVVRFQEAANKQKQE

SEQ ID NO: 109099 - protein, 15 aa, Mycobacterium tuberculosis
VVRFQEAANKQKQEL

SEQ ID NO: 109100 - protein, 15 aa, Mycobacterium tuberculosis
VRFQEAANKQKQELD

SEQ ID NO: 109101 - protein, 15 aa, Mycobacterium tuberculosis
RFQEAANKQKQELDE

SEQ ID NO: 109102 - protein, 15 aa, Mycobacterium tuberculosis
FQEAANKQKQELDEI

SEQ ID NO: 109103 - protein, 15 aa, Mycobacterium tuberculosis
QEAANKQKQELDEIS

SEQ ID NO: 109104 - protein, 15 aa, Mycobacterium tuberculosis
EAANKQKQELDEIST

SEQ ID NO: 109105 - protein, 15 aa, Mycobacterium tuberculosis
AANKQKQELDEISTN

SEQ ID NO: 109106 - protein, 15 aa, Mycobacterium tuberculosis
ANKQKQELDEISTNI

SEQ ID NO: 109107 - protein, 15 aa, Mycobacterium tuberculosis
NKQKQELDEISTNIR

SEQ ID NO: 109108 - protein, 15 aa, Mycobacterium tuberculosis
KQKQELDEISTNIRQ

SEQ ID NO: 109109 - protein, 15 aa, Mycobacterium tuberculosis
QKQELDEISTNIRQA

SEQ ID NO: 109110 - protein, 15 aa, Mycobacterium tuberculosis
KQELDEISTNIRQAG

SEQ ID NO: 109111 - protein, 15 aa, Mycobacterium tuberculosis
QELDEISTNIRQAGV

SEQ ID NO: 109112 - protein, 15 aa, Mycobacterium tuberculosis
ELDEISTNIRQAGVQ

SEQ ID NO: 109113 - protein, 15 aa, Mycobacterium tuberculosis
LDEISTNIRQAGVQY

SEQ ID NO: 109114 - protein, 15 aa, Mycobacterium tuberculosis
DEISTNIRQAGVQYS

SEQ ID NO: 109115 - protein, 15 aa, Mycobacterium tuberculosis
EISTNIRQAGVQYSR

SEQ ID NO: 109116 - protein, 15 aa, Mycobacterium tuberculosis
ISTNIRQAGVQYSRA

SEQ ID NO: 109117 - protein, 15 aa, Mycobacterium tuberculosis
STNIRQAGVQYSRAD

SEQ ID NO: 109118 - protein, 15 aa, Mycobacterium tuberculosis
TNIRQAGVQYSRADE

SEQ ID NO: 109119 - protein, 15 aa, Mycobacterium tuberculosis
NIRQAGVQYSRADEE

SEQ ID NO: 109120 - protein, 15 aa, Mycobacterium tuberculosis
IRQAGVQYSRADEEQ

SEQ ID NO: 109121 - protein, 15 aa, Mycobacterium tuberculosis
RQAGVQYSRADEEQQ

SEQ ID NO: 109122 - protein, 15 aa, Mycobacterium tuberculosis
QAGVQYSRADEEQQQ

SEQ ID NO: 109123 - protein, 15 aa, Mycobacterium tuberculosis
AGVQYSRADEEQQQA

SEQ ID NO: 109124 - protein, 15 aa, Mycobacterium tuberculosis
GVQYSRADEEQQQAL

SEQ ID NO: 109125 - protein, 15 aa, Mycobacterium tuberculosis
VQYSRADEEQQQALS

SEQ ID NO: 109126 - protein, 15 aa, Mycobacterium tuberculosis
QYSRADEEQQQALSS

SEQ ID NO: 109127 - protein, 15 aa, Mycobacterium tuberculosis
YSRADEEQQQALSSQ

SEQ ID NO: 109128 - protein, 15 aa, Mycobacterium tuberculosis
SRADEEQQQALSSQM

SEQ ID NO: 109129 - protein, 15 aa, Mycobacterium tuberculosis
RADEEQQQALSSQMG

SEQ ID NO: 109130 - protein, 15 aa, Mycobacterium tuberculosis
ADEEQQQALSSQMGF

SEQ ID NO: 109131 - protein, 16 aa, Mycobacterium tuberculosis
MAEMKTDAATLAQEAG

SEQ ID NO: 109132 - protein, 16 aa, Mycobacterium tuberculosis
AEMKTDAATLAQEAGN

SEQ ID NO: 109133 - protein, 16 aa, Mycobacterium tuberculosis
EMKTDAATLAQEAGNF

SEQ ID NO: 109134 - protein, 16 aa, Mycobacterium tuberculosis
MKTDAATLAQEAGNFE

SEQ ID NO: 109135 - protein, 16 aa, Mycobacterium tuberculosis
KTDAATLAQEAGNFER

SEQ ID NO: 109136 - protein, 16 aa, Mycobacterium tuberculosis
TDAATLAQEAGNFERI

SEQ ID NO: 109137 - protein, 16 aa, Mycobacterium tuberculosis
DAATLAQEAGNFERIS

SEQ ID NO: 109138 - protein, 16 aa, Mycobacterium tuberculosis
AATLAQEAGNFERISG

SEQ ID NO: 109139 - protein, 16 aa, Mycobacterium tuberculosis
ATLAQEAGNFERISGD

SEQ ID NO: 109140 - protein, 16 aa, Mycobacterium tuberculosis
TLAQEAGNFERISGDL

SEQ ID NO: 109141 - protein, 16 aa, Mycobacterium tuberculosis
LAQEAGNFERISGDLK

SEQ ID NO: 109142 - protein, 16 aa, Mycobacterium tuberculosis
AQEAGNFERISGDLKT

SEQ ID NO: 109143 - protein, 16 aa, Mycobacterium tuberculosis
QEAGNFERISGDLKTQ

SEQ ID NO: 109144 - protein, 16 aa, Mycobacterium tuberculosis
EAGNFERISGDLKTQI

SEQ ID NO: 109145 - protein, 16 aa, Mycobacterium tuberculosis
AGNFERISGDLKTQID

SEQ ID NO: 109146 - protein, 16 aa, Mycobacterium tuberculosis
GNFERISGDLKTQIDQ

SEQ ID NO: 109147 - protein, 16 aa, Mycobacterium tuberculosis
NFERISGDLKTQIDQV

SEQ ID NO: 109148 - protein, 16 aa, Mycobacterium tuberculosis
FERISGDLKTQIDQVE

SEQ ID NO: 109149 - protein, 16 aa, Mycobacterium tuberculosis
ERISGDLKTQIDQVES

SEQ ID NO: 109150 - protein, 16 aa, Mycobacterium tuberculosis
RISGDLKTQIDQVEST

SEQ ID NO: 109151 - protein, 16 aa, Mycobacterium tuberculosis
ISGDLKTQIDQVESTA

SEQ ID NO: 109152 - protein, 16 aa, Mycobacterium tuberculosis
SGDLKTQIDQVESTAG

SEQ ID NO: 109153 - protein, 16 aa, Mycobacterium tuberculosis
GDLKTQIDQVESTAGS

SEQ ID NO: 109154 - protein, 16 aa, Mycobacterium tuberculosis
DLKTQIDQVESTAGSL

SEQ ID NO: 109155 - protein, 16 aa, Mycobacterium tuberculosis
LKTQIDQVESTAGSLQ

SEQ ID NO: 109156 - protein, 16 aa, Mycobacterium tuberculosis
KTQIDQVESTAGSLQG

SEQ ID NO: 109157 - protein, 16 aa, Mycobacterium tuberculosis
TQIDQVESTAGSLQGQ

SEQ ID NO: 109158 - protein, 16 aa, Mycobacterium tuberculosis
QIDQVESTAGSLQGQW

SEQ ID NO: 109159 - protein, 16 aa, Mycobacterium tuberculosis
IDQVESTAGSLQGQWR

SEQ ID NO: 109160 - protein, 16 aa, Mycobacterium tuberculosis
DQVESTAGSLQGQWRG

SEQ ID NO: 109161 - protein, 16 aa, Mycobacterium tuberculosis
QVESTAGSLQGQWRGA

SEQ ID NO: 109162 - protein, 16 aa, Mycobacterium tuberculosis
VESTAGSLQGQWRGAA

SEQ ID NO: 109163 - protein, 16 aa, Mycobacterium tuberculosis
ESTAGSLQGQWRGAAG

SEQ ID NO: 109164 - protein, 16 aa, Mycobacterium tuberculosis
STAGSLQGQWRGAAGT

SEQ ID NO: 109165 - protein, 16 aa, Mycobacterium tuberculosis
TAGSLQGQWRGAAGTA

SEQ ID NO: 109166 - protein, 16 aa, Mycobacterium tuberculosis
AGSLQGQWRGAAGTAA

SEQ ID NO: 109167 - protein, 16 aa, Mycobacterium tuberculosis
GSLQGQWRGAAGTAAQ

SEQ ID NO: 109168 - protein, 16 aa, Mycobacterium tuberculosis
SLQGQWRGAAGTAAQA

SEQ ID NO: 109169 - protein, 16 aa, Mycobacterium tuberculosis
LQGQWRGAAGTAAQAA

SEQ ID NO: 109170 - protein, 16 aa, Mycobacterium tuberculosis
QGQWRGAAGTAAQAAV

SEQ ID NO: 109171 - protein, 16 aa, Mycobacterium tuberculosis
GQWRGAAGTAAQAAVV

SEQ ID NO: 109172 - protein, 16 aa, Mycobacterium tuberculosis
QWRGAAGTAAQAAVVR

SEQ ID NO: 109173 - protein, 16 aa, Mycobacterium tuberculosis
WRGAAGTAAQAAVVRF

SEQ ID NO: 109174 - protein, 16 aa, Mycobacterium tuberculosis
RGAAGTAAQAAVVRFQ

SEQ ID NO: 109175 - protein, 16 aa, Mycobacterium tuberculosis
GAAGTAAQAAVVRFQE

SEQ ID NO: 109176 - protein, 16 aa, Mycobacterium tuberculosis
AAGTAAQAAVVRFQEA

SEQ ID NO: 109177 - protein, 16 aa, Mycobacterium tuberculosis
AGTAAQAAVVRFQEAA

SEQ ID NO: 109178 - protein, 16 aa, Mycobacterium tuberculosis
GTAAQAAVVRFQEAAN

SEQ ID NO: 109179 - protein, 16 aa, Mycobacterium tuberculosis
TAAQAAVVRFQEAANK

SEQ ID NO: 109180 - protein, 16 aa, Mycobacterium tuberculosis
AAQAAVVRFQEAANKQ

SEQ ID NO: 109181 - protein, 16 aa, Mycobacterium tuberculosis
AQAAVVRFQEAANKQK

SEQ ID NO: 109182 - protein, 16 aa, Mycobacterium tuberculosis
QAAVVRFQEAANKQKQ

SEQ ID NO: 109183 - protein, 16 aa, Mycobacterium tuberculosis
AAVVRFQEAANKQKQE

SEQ ID NO: 109184 - protein, 16 aa, Mycobacterium tuberculosis
AVVRFQEAANKQKQEL

SEQ ID NO: 109185 - protein, 16 aa, Mycobacterium tuberculosis
VVRFQEAANKQKQELD

SEQ ID NO: 109186 - protein, 16 aa, Mycobacterium tuberculosis
VRFQEAANKQKQELDE

SEQ ID NO: 109187 - protein, 16 aa, Mycobacterium tuberculosis
RFQEAANKQKQELDEI

SEQ ID NO: 109188 - protein, 16 aa, Mycobacterium tuberculosis
FQEAANKQKQELDEIS

SEQ ID NO: 109189 - protein, 16 aa, Mycobacterium tuberculosis
QEAANKQKQELDEIST

SEQ ID NO: 109190 - protein, 16 aa, Mycobacterium tuberculosis
EAANKQKQELDEISTN

SEQ ID NO: 109191 - protein, 16 aa, Mycobacterium tuberculosis
AANKQKQELDEISTNI

SEQ ID NO: 109192 - protein, 16 aa, Mycobacterium tuberculosis
ANKQKQELDEISTNIR

SEQ ID NO: 109193 - protein, 16 aa, Mycobacterium tuberculosis
NKQKQELDEISTNIRQ

SEQ ID NO: 109194 - protein, 16 aa, Mycobacterium tuberculosis
KQKQELDEISTNIRQA

SEQ ID NO: 109195 - protein, 16 aa, Mycobacterium tuberculosis
QKQELDEISTNIRQAG

SEQ ID NO: 109196 - protein, 16 aa, Mycobacterium tuberculosis
KQELDEISTNIRQAGV

SEQ ID NO: 109197 - protein, 16 aa, Mycobacterium tuberculosis
QELDEISTNIRQAGVQ

SEQ ID NO: 109198 - protein, 16 aa, Mycobacterium tuberculosis
ELDEISTNIRQAGVQY

SEQ ID NO: 109199 - protein, 16 aa, Mycobacterium tuberculosis
LDEISTNIRQAGVQYS

SEQ ID NO: 109200 - protein, 16 aa, Mycobacterium tuberculosis
DEISTNIRQAGVQYSR

SEQ ID NO: 109201 - protein, 16 aa, Mycobacterium tuberculosis
EISTNIRQAGVQYSRA

SEQ ID NO: 109202 - protein, 16 aa, Mycobacterium tuberculosis
ISTNIRQAGVQYSRAD

SEQ ID NO: 109203 - protein, 16 aa, Mycobacterium tuberculosis
STNIRQAGVQYSRADE

SEQ ID NO: 109204 - protein, 16 aa, Mycobacterium tuberculosis
TNIRQAGVQYSRADEE

SEQ ID NO: 109205 - protein, 16 aa, Mycobacterium tuberculosis
NIRQAGVQYSRADEEQ

SEQ ID NO: 109206 - protein, 16 aa, Mycobacterium tuberculosis
IRQAGVQYSRADEEQQ

SEQ ID NO: 109207 - protein, 16 aa, Mycobacterium tuberculosis
RQAGVQYSRADEEQQQ

SEQ ID NO: 109208 - protein, 16 aa, Mycobacterium tuberculosis
QAGVQYSRADEEQQQA

SEQ ID NO: 109209 - protein, 16 aa, Mycobacterium tuberculosis
AGVQYSRADEEQQQAL

SEQ ID NO: 109210 - protein, 16 aa, Mycobacterium tuberculosis
GVQYSRADEEQQQALS

SEQ ID NO: 109211 - protein, 16 aa, Mycobacterium tuberculosis
VQYSRADEEQQQALSS

SEQ ID NO: 109212 - protein, 16 aa, Mycobacterium tuberculosis
QYSRADEEQQQALSSQ

SEQ ID NO: 109213 - protein, 16 aa, Mycobacterium tuberculosis
YSRADEEQQQALSSQM

SEQ ID NO: 109214 - protein, 16 aa, Mycobacterium tuberculosis
SRADEEQQQALSSQMG

SEQ ID NO: 109215 - protein, 16 aa, Mycobacterium tuberculosis
RADEEQQQALSSQMGF

SEQ ID NO: 109216 - protein, 13 aa, Mycobacterium tuberculosis
MTEQQWNFAGIEA

SEQ ID NO: 109217 - protein, 13 aa, Mycobacterium tuberculosis
TEQQWNFAGIEAA

SEQ ID NO: 109218 - protein, 13 aa, Mycobacterium tuberculosis
EQQWNFAGIEAAA

SEQ ID NO: 109219 - protein, 13 aa, Mycobacterium tuberculosis
QQWNFAGIEAAAS

SEQ ID NO: 109220 - protein, 13 aa, Mycobacterium tuberculosis
QWNFAGIEAAASA

SEQ ID NO: 109221 - protein, 13 aa, Mycobacterium tuberculosis
WNFAGIEAAASAI

SEQ ID NO: 109222 - protein, 13 aa, Mycobacterium tuberculosis
NFAGIEAAASAIQ

SEQ ID NO: 109223 - protein, 13 aa, Mycobacterium tuberculosis
FAGIEAAASAIQG

SEQ ID NO: 109224 - protein, 13 aa, Mycobacterium tuberculosis
AGIEAAASAIQGN

SEQ ID NO: 109225 - protein, 13 aa, Mycobacterium tuberculosis
GIEAAASAIQGNV

SEQ ID NO: 109226 - protein, 13 aa, Mycobacterium tuberculosis
IEAAASAIQGNVT

SEQ ID NO: 109227 - protein, 13 aa, Mycobacterium tuberculosis
EAAASAIQGNVTS

SEQ ID NO: 109228 - protein, 13 aa, Mycobacterium tuberculosis
AAASAIQGNVTSI

SEQ ID NO: 109229 - protein, 13 aa, Mycobacterium tuberculosis
AASAIQGNVTSIH

SEQ ID NO: 109230 - protein, 13 aa, Mycobacterium tuberculosis
ASAIQGNVTSIHS

SEQ ID NO: 109231 - protein, 13 aa, Mycobacterium tuberculosis
SAIQGNVTSIHSL

SEQ ID NO: 109232 - protein, 13 aa, Mycobacterium tuberculosis
AIQGNVTSIHSLL

SEQ ID NO: 109233 - protein, 13 aa, Mycobacterium tuberculosis
IQGNVTSIHSLLD

SEQ ID NO: 109234 - protein, 13 aa, Mycobacterium tuberculosis
QGNVTSIHSLLDE

SEQ ID NO: 109235 - protein, 13 aa, Mycobacterium tuberculosis
GNVTSIHSLLDEG

SEQ ID NO: 109236 - protein, 13 aa, Mycobacterium tuberculosis
NVTSIHSLLDEGK

SEQ ID NO: 109237 - protein, 13 aa, Mycobacterium tuberculosis
VTSIHSLLDEGKQ

SEQ ID NO: 109238 - protein, 13 aa, Mycobacterium tuberculosis
TSIHSLLDEGKQS

SEQ ID NO: 109239 - protein, 13 aa, Mycobacterium tuberculosis
SIHSLLDEGKQSL

SEQ ID NO: 109240 - protein, 13 aa, Mycobacterium tuberculosis
IHSLLDEGKQSLT

SEQ ID NO: 109241 - protein, 13 aa, Mycobacterium tuberculosis
HSLLDEGKQSLTK

SEQ ID NO: 109242 - protein, 13 aa, Mycobacterium tuberculosis
SLLDEGKQSLTKL

SEQ ID NO: 109243 - protein, 13 aa, Mycobacterium tuberculosis
LLDEGKQSLTKLA

SEQ ID NO: 109244 - protein, 13 aa, Mycobacterium tuberculosis
LDEGKQSLTKLAA

SEQ ID NO: 109245 - protein, 13 aa, Mycobacterium tuberculosis
DEGKQSLTKLAAA

SEQ ID NO: 109246 - protein, 13 aa, Mycobacterium tuberculosis
EGKQSLTKLAAAW

SEQ ID NO: 109247 - protein, 13 aa, Mycobacterium tuberculosis
GKQSLTKLAAAWG

SEQ ID NO: 109248 - protein, 13 aa, Mycobacterium tuberculosis
KQSLTKLAAAWGG

SEQ ID NO: 109249 - protein, 13 aa, Mycobacterium tuberculosis
QSLTKLAAAWGGS

SEQ ID NO: 109250 - protein, 13 aa, Mycobacterium tuberculosis
SLTKLAAAWGGSG

SEQ ID NO: 109251 - protein, 13 aa, Mycobacterium tuberculosis
LTKLAAAWGGSGS

SEQ ID NO: 109252 - protein, 13 aa, Mycobacterium tuberculosis
TKLAAAWGGSGSE

SEQ ID NO: 109253 - protein, 13 aa, Mycobacterium tuberculosis
KLAAAWGGSGSEA

SEQ ID NO: 109254 - protein, 13 aa, Mycobacterium tuberculosis
LAAAWGGSGSEAY

SEQ ID NO: 109255 - protein, 13 aa, Mycobacterium tuberculosis
AAAWGGSGSEAYQ

SEQ ID NO: 109256 - protein, 13 aa, Mycobacterium tuberculosis
AAWGGSGSEAYQG

SEQ ID NO: 109257 - protein, 13 aa, Mycobacterium tuberculosis
AWGGSGSEAYQGV

SEQ ID NO: 109258 - protein, 13 aa, Mycobacterium tuberculosis
WGGSGSEAYQGVQ

SEQ ID NO: 109259 - protein, 13 aa, Mycobacterium tuberculosis
GGSGSEAYQGVQQ

SEQ ID NO: 109260 - protein, 13 aa, Mycobacterium tuberculosis
GSGSEAYQGVQQK

SEQ ID NO: 109261 - protein, 13 aa, Mycobacterium tuberculosis
SGSEAYQGVQQKW

SEQ ID NO: 109262 - protein, 13 aa, Mycobacterium tuberculosis
GSEAYQGVQQKWD

SEQ ID NO: 109263 - protein, 13 aa, Mycobacterium tuberculosis
SEAYQGVQQKWDA

SEQ ID NO: 109264 - protein, 13 aa, Mycobacterium tuberculosis
EAYQGVQQKWDAT

SEQ ID NO: 109265 - protein, 13 aa, Mycobacterium tuberculosis
AYQGVQQKWDATA

SEQ ID NO: 109266 - protein, 13 aa, Mycobacterium tuberculosis
YQGVQQKWDATAT

SEQ ID NO: 109267 - protein, 13 aa, Mycobacterium tuberculosis
QGVQQKWDATATE

SEQ ID NO: 109268 - protein, 13 aa, Mycobacterium tuberculosis
GVQQKWDATATEL

SEQ ID NO: 109269 - protein, 13 aa, Mycobacterium tuberculosis
VQQKWDATATELN

SEQ ID NO: 109270 - protein, 13 aa, Mycobacterium tuberculosis
QQKWDATATELNN

SEQ ID NO: 109271 - protein, 13 aa, Mycobacterium tuberculosis
QKWDATATELNNA

SEQ ID NO: 109272 - protein, 13 aa, Mycobacterium tuberculosis
KWDATATELNNAL

SEQ ID NO: 109273 - protein, 13 aa, Mycobacterium tuberculosis
WDATATELNNALQ

SEQ ID NO: 109274 - protein, 13 aa, Mycobacterium tuberculosis
DATATELNNALQN

SEQ ID NO: 109275 - protein, 13 aa, Mycobacterium tuberculosis
ATATELNNALQNL

SEQ ID NO: 109276 - protein, 13 aa, Mycobacterium tuberculosis
TATELNNALQNLA

SEQ ID NO: 109277 - protein, 13 aa, Mycobacterium tuberculosis
ATELNNALQNLAR

SEQ ID NO: 109278 - protein, 13 aa, Mycobacterium tuberculosis
TELNNALQNLART

SEQ ID NO: 109279 - protein, 13 aa, Mycobacterium tuberculosis
ELNNALQNLARTI

SEQ ID NO: 109280 - protein, 13 aa, Mycobacterium tuberculosis
LNNALQNLARTIS

SEQ ID NO: 109281 - protein, 13 aa, Mycobacterium tuberculosis
NNALQNLARTISE

SEQ ID NO: 109282 - protein, 13 aa, Mycobacterium tuberculosis
NALQNLARTISEA

SEQ ID NO: 109283 - protein, 13 aa, Mycobacterium tuberculosis
ALQNLARTISEAG

SEQ ID NO: 109284 - protein, 13 aa, Mycobacterium tuberculosis
LQNLARTISEAGQ

SEQ ID NO: 109285 - protein, 13 aa, Mycobacterium tuberculosis
QNLARTISEAGQA

SEQ ID NO: 109286 - protein, 13 aa, Mycobacterium tuberculosis
NLARTISEAGQAM

SEQ ID NO: 109287 - protein, 13 aa, Mycobacterium tuberculosis
LARTISEAGQAMA

SEQ ID NO: 109288 - protein, 13 aa, Mycobacterium tuberculosis
ARTISEAGQAMAS

SEQ ID NO: 109289 - protein, 13 aa, Mycobacterium tuberculosis
RTISEAGQAMAST

SEQ ID NO: 109290 - protein, 13 aa, Mycobacterium tuberculosis
TISEAGQAMASTE

SEQ ID NO: 109291 - protein, 13 aa, Mycobacterium tuberculosis
ISEAGQAMASTEG

SEQ ID NO: 109292 - protein, 13 aa, Mycobacterium tuberculosis
SEAGQAMASTEGN

SEQ ID NO: 109293 - protein, 13 aa, Mycobacterium tuberculosis
EAGQAMASTEGNV

SEQ ID NO: 109294 - protein, 13 aa, Mycobacterium tuberculosis
AGQAMASTEGNVT

SEQ ID NO: 109295 - protein, 13 aa, Mycobacterium tuberculosis
GQAMASTEGNVTG

SEQ ID NO: 109296 - protein, 13 aa, Mycobacterium tuberculosis
QAMASTEGNVTGM

SEQ ID NO: 109297 - protein, 13 aa, Mycobacterium tuberculosis
AMASTEGNVTGMF

SEQ ID NO: 109298 - protein, 13 aa, Mycobacterium tuberculosis
MASTEGNVTGMFA

SEQ ID NO: 109299 - protein, 14 aa, Mycobacterium tuberculosis
MTEQQWNFAGIEAA

SEQ ID NO: 109300 - protein, 14 aa, Mycobacterium tuberculosis
TEQQWNFAGIEAAA

SEQ ID NO: 109301 - protein, 14 aa, Mycobacterium tuberculosis
EQQWNFAGIEAAAS

SEQ ID NO: 109302 - protein, 14 aa, Mycobacterium tuberculosis
QQWNFAGIEAAASA

SEQ ID NO: 109303 - protein, 14 aa, Mycobacterium tuberculosis
QWNFAGIEAAASAI

SEQ ID NO: 109304 - protein, 14 aa, Mycobacterium tuberculosis
WNFAGIEAAASAIQ

SEQ ID NO: 109305 - protein, 14 aa, Mycobacterium tuberculosis
NFAGIEAAASAIQG

SEQ ID NO: 109306 - protein, 14 aa, Mycobacterium tuberculosis
FAGIEAAASAIQGN

SEQ ID NO: 109307 - protein, 14 aa, Mycobacterium tuberculosis
AGIEAAASAIQGNV

SEQ ID NO: 109308 - protein, 14 aa, Mycobacterium tuberculosis
GIEAAASAIQGNVT

SEQ ID NO: 109309 - protein, 14 aa, Mycobacterium tuberculosis
IEAAASAIQGNVTS

SEQ ID NO: 109310 - protein, 14 aa, Mycobacterium tuberculosis
EAAASAIQGNVTSI

SEQ ID NO: 109311 - protein, 14 aa, Mycobacterium tuberculosis
AAASAIQGNVTSIH

SEQ ID NO: 109312 - protein, 14 aa, Mycobacterium tuberculosis
AASAIQGNVTSIHS

SEQ ID NO: 109313 - protein, 14 aa, Mycobacterium tuberculosis
ASAIQGNVTSIHSL

SEQ ID NO: 109314 - protein, 14 aa, Mycobacterium tuberculosis
SAIQGNVTSIHSLL

SEQ ID NO: 109315 - protein, 14 aa, Mycobacterium tuberculosis
AIQGNVTSIHSLLD

SEQ ID NO: 109316 - protein, 14 aa, Mycobacterium tuberculosis
IQGNVTSIHSLLDE

SEQ ID NO: 109317 - protein, 14 aa, Mycobacterium tuberculosis
QGNVTSIHSLLDEG

SEQ ID NO: 109318 - protein, 14 aa, Mycobacterium tuberculosis
GNVTSIHSLLDEGK

SEQ ID NO: 109319 - protein, 14 aa, Mycobacterium tuberculosis
NVTSIHSLLDEGKQ

SEQ ID NO: 109320 - protein, 14 aa, Mycobacterium tuberculosis
VTSIHSLLDEGKQS

SEQ ID NO: 109321 - protein, 14 aa, Mycobacterium tuberculosis
TSIHSLLDEGKQSL

SEQ ID NO: 109322 - protein, 14 aa, Mycobacterium tuberculosis
SIHSLLDEGKQSLT

SEQ ID NO: 109323 - protein, 14 aa, Mycobacterium tuberculosis
IHSLLDEGKQSLTK

SEQ ID NO: 109324 - protein, 14 aa, Mycobacterium tuberculosis
HSLLDEGKQSLTKL

SEQ ID NO: 109325 - protein, 14 aa, Mycobacterium tuberculosis
SLLDEGKQSLTKLA

SEQ ID NO: 109326 - protein, 14 aa, Mycobacterium tuberculosis
LLDEGKQSLTKLAA

SEQ ID NO: 109327 - protein, 14 aa, Mycobacterium tuberculosis
LDEGKQSLTKLAAA

SEQ ID NO: 109328 - protein, 14 aa, Mycobacterium tuberculosis
DEGKQSLTKLAAAW

SEQ ID NO: 109329 - protein, 14 aa, Mycobacterium tuberculosis
EGKQSLTKLAAAWG

SEQ ID NO: 109330 - protein, 14 aa, Mycobacterium tuberculosis
GKQSLTKLAAAWGG

SEQ ID NO: 109331 - protein, 14 aa, Mycobacterium tuberculosis
KQSLTKLAAAWGGS

SEQ ID NO: 109332 - protein, 14 aa, Mycobacterium tuberculosis
QSLTKLAAAWGGSG

SEQ ID NO: 109333 - protein, 14 aa, Mycobacterium tuberculosis
SLTKLAAAWGGSGS

SEQ ID NO: 109334 - protein, 14 aa, Mycobacterium tuberculosis
LTKLAAAWGGSGSE

SEQ ID NO: 109335 - protein, 14 aa, Mycobacterium tuberculosis
TKLAAAWGGSGSEA

SEQ ID NO: 109336 - protein, 14 aa, Mycobacterium tuberculosis
KLAAAWGGSGSEAY

SEQ ID NO: 109337 - protein, 14 aa, Mycobacterium tuberculosis
LAAAWGGSGSEAYQ

SEQ ID NO: 109338 - protein, 14 aa, Mycobacterium tuberculosis
AAAWGGSGSEAYQG

SEQ ID NO: 109339 - protein, 14 aa, Mycobacterium tuberculosis
AAWGGSGSEAYQGV

SEQ ID NO: 109340 - protein, 14 aa, Mycobacterium tuberculosis
AWGGSGSEAYQGVQ

SEQ ID NO: 109341 - protein, 14 aa, Mycobacterium tuberculosis
WGGSGSEAYQGVQQ

SEQ ID NO: 109342 - protein, 14 aa, Mycobacterium tuberculosis
GGSGSEAYQGVQQK

SEQ ID NO: 109343 - protein, 14 aa, Mycobacterium tuberculosis
GSGSEAYQGVQQKW

SEQ ID NO: 109344 - protein, 14 aa, Mycobacterium tuberculosis
SGSEAYQGVQQKWD

SEQ ID NO: 109345 - protein, 14 aa, Mycobacterium tuberculosis
GSEAYQGVQQKWDA

SEQ ID NO: 109346 - protein, 14 aa, Mycobacterium tuberculosis
SEAYQGVQQKWDAT

SEQ ID NO: 109347 - protein, 14 aa, Mycobacterium tuberculosis
EAYQGVQQKWDATA

SEQ ID NO: 109348 - protein, 14 aa, Mycobacterium tuberculosis
AYQGVQQKWDATAT

SEQ ID NO: 109349 - protein, 14 aa, Mycobacterium tuberculosis
YQGVQQKWDATATE

SEQ ID NO: 109350 - protein, 14 aa, Mycobacterium tuberculosis
QGVQQKWDATATEL

SEQ ID NO: 109351 - protein, 14 aa, Mycobacterium tuberculosis
GVQQKWDATATELN

SEQ ID NO: 109352 - protein, 14 aa, Mycobacterium tuberculosis
VQQKWDATATELNN

SEQ ID NO: 109353 - protein, 14 aa, Mycobacterium tuberculosis
QQKWDATATELNNA

SEQ ID NO: 109354 - protein, 14 aa, Mycobacterium tuberculosis
QKWDATATELNNAL

SEQ ID NO: 109355 - protein, 14 aa, Mycobacterium tuberculosis
KWDATATELNNALQ

SEQ ID NO: 109356 - protein, 14 aa, Mycobacterium tuberculosis
WDATATELNNALQN

SEQ ID NO: 109357 - protein, 14 aa, Mycobacterium tuberculosis
DATATELNNALQNL

SEQ ID NO: 109358 - protein, 14 aa, Mycobacterium tuberculosis
ATATELNNALQNLA

SEQ ID NO: 109359 - protein, 14 aa, Mycobacterium tuberculosis
TATELNNALQNLAR

SEQ ID NO: 109360 - protein, 14 aa, Mycobacterium tuberculosis
ATELNNALQNLART

SEQ ID NO: 109361 - protein, 14 aa, Mycobacterium tuberculosis
TELNNALQNLARTI

SEQ ID NO: 109362 - protein, 14 aa, Mycobacterium tuberculosis
ELNNALQNLARTIS

SEQ ID NO: 109363 - protein, 14 aa, Mycobacterium tuberculosis
LNNALQNLARTISE

SEQ ID NO: 109364 - protein, 14 aa, Mycobacterium tuberculosis
NNALQNLARTISEA

SEQ ID NO: 109365 - protein, 14 aa, Mycobacterium tuberculosis
NALQNLARTISEAG

SEQ ID NO: 109366 - protein, 14 aa, Mycobacterium tuberculosis
ALQNLARTISEAGQ

SEQ ID NO: 109367 - protein, 14 aa, Mycobacterium tuberculosis
LQNLARTISEAGQA

SEQ ID NO: 109368 - protein, 14 aa, Mycobacterium tuberculosis
QNLARTISEAGQAM

SEQ ID NO: 109369 - protein, 14 aa, Mycobacterium tuberculosis
NLARTISEAGQAMA

SEQ ID NO: 109370 - protein, 14 aa, Mycobacterium tuberculosis
LARTISEAGQAMAS

SEQ ID NO: 109371 - protein, 14 aa, Mycobacterium tuberculosis
ARTISEAGQAMAST

SEQ ID NO: 109372 - protein, 14 aa, Mycobacterium tuberculosis
RTISEAGQAMASTE

SEQ ID NO: 109373 - protein, 14 aa, Mycobacterium tuberculosis
TISEAGQAMASTEG

SEQ ID NO: 109374 - protein, 14 aa, Mycobacterium tuberculosis
ISEAGQAMASTEGN

SEQ ID NO: 109375 - protein, 14 aa, Mycobacterium tuberculosis
SEAGQAMASTEGNV

SEQ ID NO: 109376 - protein, 14 aa, Mycobacterium tuberculosis
EAGQAMASTEGNVT

SEQ ID NO: 109377 - protein, 14 aa, Mycobacterium tuberculosis
AGQAMASTEGNVTG

SEQ ID NO: 109378 - protein, 14 aa, Mycobacterium tuberculosis
GQAMASTEGNVTGM

SEQ ID NO: 109379 - protein, 14 aa, Mycobacterium tuberculosis
QAMASTEGNVTGMF

SEQ ID NO: 109380 - protein, 14 aa, Mycobacterium tuberculosis
AMASTEGNVTGMFA

SEQ ID NO: 109381 - protein, 15 aa, Mycobacterium tuberculosis
MTEQQWNFAGIEAAA

SEQ ID NO: 109382 - protein, 15 aa, Mycobacterium tuberculosis
TEQQWNFAGIEAAAS

SEQ ID NO: 109383 - protein, 15 aa, Mycobacterium tuberculosis
EQQWNFAGIEAAASA

SEQ ID NO: 109384 - protein, 15 aa, Mycobacterium tuberculosis
QQWNFAGIEAAASAI

SEQ ID NO: 109385 - protein, 15 aa, Mycobacterium tuberculosis
QWNFAGIEAAASAIQ

SEQ ID NO: 109386 - protein, 15 aa, Mycobacterium tuberculosis
WNFAGIEAAASAIQG

SEQ ID NO: 109387 - protein, 15 aa, Mycobacterium tuberculosis
NFAGIEAAASAIQGN

SEQ ID NO: 109388 - protein, 15 aa, Mycobacterium tuberculosis
FAGIEAAASAIQGNV

SEQ ID NO: 109389 - protein, 15 aa, Mycobacterium tuberculosis
AGIEAAASAIQGNVT

SEQ ID NO: 109390 - protein, 15 aa, Mycobacterium tuberculosis
GIEAAASAIQGNVTS

SEQ ID NO: 109391 - protein, 15 aa, Mycobacterium tuberculosis
IEAAASAIQGNVTSI

SEQ ID NO: 109392 - protein, 15 aa, Mycobacterium tuberculosis
EAAASAIQGNVTSIH

SEQ ID NO: 109393 - protein, 15 aa, Mycobacterium tuberculosis
AAASAIQGNVTSIHS

SEQ ID NO: 109394 - protein, 15 aa, Mycobacterium tuberculosis
AASAIQGNVTSIHSL

SEQ ID NO: 109395 - protein, 15 aa, Mycobacterium tuberculosis
ASAIQGNVTSIHSLL

SEQ ID NO: 109396 - protein, 15 aa, Mycobacterium tuberculosis
SAIQGNVTSIHSLLD

SEQ ID NO: 109397 - protein, 15 aa, Mycobacterium tuberculosis
AIQGNVTSIHSLLDE

SEQ ID NO: 109398 - protein, 15 aa, Mycobacterium tuberculosis
IQGNVTSIHSLLDEG

SEQ ID NO: 109399 - protein, 15 aa, Mycobacterium tuberculosis
QGNVTSIHSLLDEGK

SEQ ID NO: 109400 - protein, 15 aa, Mycobacterium tuberculosis
GNVTSIHSLLDEGKQ

SEQ ID NO: 109401 - protein, 15 aa, Mycobacterium tuberculosis
NVTSIHSLLDEGKQS

SEQ ID NO: 109402 - protein, 15 aa, Mycobacterium tuberculosis
VTSIHSLLDEGKQSL

SEQ ID NO: 109403 - protein, 15 aa, Mycobacterium tuberculosis
TSIHSLLDEGKQSLT

SEQ ID NO: 109404 - protein, 15 aa, Mycobacterium tuberculosis
SIHSLLDEGKQSLTK

SEQ ID NO: 109405 - protein, 15 aa, Mycobacterium tuberculosis
IHSLLDEGKQSLTKL

SEQ ID NO: 109406 - protein, 15 aa, Mycobacterium tuberculosis
HSLLDEGKQSLTKLA

SEQ ID NO: 109407 - protein, 15 aa, Mycobacterium tuberculosis
SLLDEGKQSLTKLAA

SEQ ID NO: 109408 - protein, 15 aa, Mycobacterium tuberculosis
LLDEGKQSLTKLAAA

SEQ ID NO: 109409 - protein, 15 aa, Mycobacterium tuberculosis
LDEGKQSLTKLAAAW

SEQ ID NO: 109410 - protein, 15 aa, Mycobacterium tuberculosis
DEGKQSLTKLAAAWG

SEQ ID NO: 109411 - protein, 15 aa, Mycobacterium tuberculosis
EGKQSLTKLAAAWGG

SEQ ID NO: 109412 - protein, 15 aa, Mycobacterium tuberculosis
GKQSLTKLAAAWGGS

SEQ ID NO: 109413 - protein, 15 aa, Mycobacterium tuberculosis
KQSLTKLAAAWGGSG

SEQ ID NO: 109414 - protein, 15 aa, Mycobacterium tuberculosis
QSLTKLAAAWGGSGS

SEQ ID NO: 109415 - protein, 15 aa, Mycobacterium tuberculosis
SLTKLAAAWGGSGSE

SEQ ID NO: 109416 - protein, 15 aa, Mycobacterium tuberculosis
LTKLAAAWGGSGSEA

SEQ ID NO: 109417 - protein, 15 aa, Mycobacterium tuberculosis
TKLAAAWGGSGSEAY

SEQ ID NO: 109418 - protein, 15 aa, Mycobacterium tuberculosis
KLAAAWGGSGSEAYQ

SEQ ID NO: 109419 - protein, 15 aa, Mycobacterium tuberculosis
LAAAWGGSGSEAYQG

SEQ ID NO: 109420 - protein, 15 aa, Mycobacterium tuberculosis
AAAWGGSGSEAYQGV

SEQ ID NO: 109421 - protein, 15 aa, Mycobacterium tuberculosis
AAWGGSGSEAYQGVQ

SEQ ID NO: 109422 - protein, 15 aa, Mycobacterium tuberculosis
AWGGSGSEAYQGVQQ

SEQ ID NO: 109423 - protein, 15 aa, Mycobacterium tuberculosis
WGGSGSEAYQGVQQK

SEQ ID NO: 109424 - protein, 15 aa, Mycobacterium tuberculosis
GGSGSEAYQGVQQKW

SEQ ID NO: 109425 - protein, 15 aa, Mycobacterium tuberculosis
GSGSEAYQGVQQKWD

SEQ ID NO: 109426 - protein, 15 aa, Mycobacterium tuberculosis
SGSEAYQGVQQKWDA

SEQ ID NO: 109427 - protein, 15 aa, Mycobacterium tuberculosis
GSEAYQGVQQKWDAT

SEQ ID NO: 109428 - protein, 15 aa, Mycobacterium tuberculosis
SEAYQGVQQKWDATA

SEQ ID NO: 109429 - protein, 15 aa, Mycobacterium tuberculosis
EAYQGVQQKWDATAT

SEQ ID NO: 109430 - protein, 15 aa, Mycobacterium tuberculosis
AYQGVQQKWDATATE

SEQ ID NO: 109431 - protein, 15 aa, Mycobacterium tuberculosis
YQGVQQKWDATATEL

SEQ ID NO: 109432 - protein, 15 aa, Mycobacterium tuberculosis
QGVQQKWDATATELN

SEQ ID NO: 109433 - protein, 15 aa, Mycobacterium tuberculosis
GVQQKWDATATELNN

SEQ ID NO: 109434 - protein, 15 aa, Mycobacterium tuberculosis
VQQKWDATATELNNA

SEQ ID NO: 109435 - protein, 15 aa, Mycobacterium tuberculosis
QQKWDATATELNNAL

SEQ ID NO: 109436 - protein, 15 aa, Mycobacterium tuberculosis
QKWDATATELNNALQ

SEQ ID NO: 109437 - protein, 15 aa, Mycobacterium tuberculosis
KWDATATELNNALQN

SEQ ID NO: 109438 - protein, 15 aa, Mycobacterium tuberculosis
WDATATELNNALQNL

SEQ ID NO: 109439 - protein, 15 aa, Mycobacterium tuberculosis
DATATELNNALQNLA

SEQ ID NO: 109440 - protein, 15 aa, Mycobacterium tuberculosis
ATATELNNALQNLAR

SEQ ID NO: 109441 - protein, 15 aa, Mycobacterium tuberculosis
TATELNNALQNLART

SEQ ID NO: 109442 - protein, 15 aa, Mycobacterium tuberculosis
ATELNNALQNLARTI

SEQ ID NO: 109443 - protein, 15 aa, Mycobacterium tuberculosis
TELNNALQNLARTIS

SEQ ID NO: 109444 - protein, 15 aa, Mycobacterium tuberculosis
ELNNALQNLARTISE

SEQ ID NO: 109445 - protein, 15 aa, Mycobacterium tuberculosis
LNNALQNLARTISEA

SEQ ID NO: 109446 - protein, 15 aa, Mycobacterium tuberculosis
NNALQNLARTISEAG

SEQ ID NO: 109447 - protein, 15 aa, Mycobacterium tuberculosis
NALQNLARTISEAGQ

SEQ ID NO: 109448 - protein, 15 aa, Mycobacterium tuberculosis
ALQNLARTISEAGQA

SEQ ID NO: 109449 - protein, 15 aa, Mycobacterium tuberculosis
LQNLARTISEAGQAM

SEQ ID NO: 109450 - protein, 15 aa, Mycobacterium tuberculosis
QNLARTISEAGQAMA

SEQ ID NO: 109451 - protein, 15 aa, Mycobacterium tuberculosis
NLARTISEAGQAMAS

SEQ ID NO: 109452 - protein, 15 aa, Mycobacterium tuberculosis
LARTISEAGQAMAST

SEQ ID NO: 109453 - protein, 15 aa, Mycobacterium tuberculosis
ARTISEAGQAMASTE

SEQ ID NO: 109454 - protein, 15 aa, Mycobacterium tuberculosis
RTISEAGQAMASTEG

SEQ ID NO: 109455 - protein, 15 aa, Mycobacterium tuberculosis
TISEAGQAMASTEGN

SEQ ID NO: 109456 - protein, 15 aa, Mycobacterium tuberculosis
ISEAGQAMASTEGNV

SEQ ID NO: 109457 - protein, 15 aa, Mycobacterium tuberculosis
SEAGQAMASTEGNVT

SEQ ID NO: 109458 - protein, 15 aa, Mycobacterium tuberculosis
EAGQAMASTEGNVTG

SEQ ID NO: 109459 - protein, 15 aa, Mycobacterium tuberculosis
AGQAMASTEGNVTGM

SEQ ID NO: 109460 - protein, 15 aa, Mycobacterium tuberculosis
GQAMASTEGNVTGMF

SEQ ID NO: 109461 - protein, 15 aa, Mycobacterium tuberculosis
QAMASTEGNVTGMFA

SEQ ID NO: 109462 - protein, 16 aa, Mycobacterium tuberculosis
MTEQQWNFAGIEAAAS

SEQ ID NO: 109463 - protein, 16 aa, Mycobacterium tuberculosis
TEQQWNFAGIEAAASA

SEQ ID NO: 109464 - protein, 16 aa, Mycobacterium tuberculosis
EQQWNFAGIEAAASAI

SEQ ID NO: 109465 - protein, 16 aa, Mycobacterium tuberculosis
QQWNFAGIEAAASAIQ

SEQ ID NO: 109466 - protein, 16 aa, Mycobacterium tuberculosis
QWNFAGIEAAASAIQG

SEQ ID NO: 109467 - protein, 16 aa, Mycobacterium tuberculosis
WNFAGIEAAASAIQGN

SEQ ID NO: 109468 - protein, 16 aa, Mycobacterium tuberculosis
NFAGIEAAASAIQGNV

SEQ ID NO: 109469 - protein, 16 aa, Mycobacterium tuberculosis
FAGIEAAASAIQGNVT

SEQ ID NO: 109470 - protein, 16 aa, Mycobacterium tuberculosis
AGIEAAASAIQGNVTS

SEQ ID NO: 109471 - protein, 16 aa, Mycobacterium tuberculosis
GIEAAASAIQGNVTSI

SEQ ID NO: 109472 - protein, 16 aa, Mycobacterium tuberculosis
IEAAASAIQGNVTSIH

SEQ ID NO: 109473 - protein, 16 aa, Mycobacterium tuberculosis
EAAASAIQGNVTSIHS

SEQ ID NO: 109474 - protein, 16 aa, Mycobacterium tuberculosis
AAASAIQGNVTSIHSL

SEQ ID NO: 109475 - protein, 16 aa, Mycobacterium tuberculosis
AASAIQGNVTSIHSLL

SEQ ID NO: 109476 - protein, 16 aa, Mycobacterium tuberculosis
ASAIQGNVTSIHSLLD

SEQ ID NO: 109477 - protein, 16 aa, Mycobacterium tuberculosis
SAIQGNVTSIHSLLDE

SEQ ID NO: 109478 - protein, 16 aa, Mycobacterium tuberculosis
AIQGNVTSIHSLLDEG

SEQ ID NO: 109479 - protein, 16 aa, Mycobacterium tuberculosis
IQGNVTSIHSLLDEGK

SEQ ID NO: 109480 - protein, 16 aa, Mycobacterium tuberculosis
QGNVTSIHSLLDEGKQ

SEQ ID NO: 109481 - protein, 16 aa, Mycobacterium tuberculosis
GNVTSIHSLLDEGKQS

SEQ ID NO: 109482 - protein, 16 aa, Mycobacterium tuberculosis
NVTSIHSLLDEGKQSL

SEQ ID NO: 109483 - protein, 16 aa, Mycobacterium tuberculosis
VTSIHSLLDEGKQSLT

SEQ ID NO: 109484 - protein, 16 aa, Mycobacterium tuberculosis
TSIHSLLDEGKQSLTK

SEQ ID NO: 109485 - protein, 16 aa, Mycobacterium tuberculosis
SIHSLLDEGKQSLTKL

SEQ ID NO: 109486 - protein, 16 aa, Mycobacterium tuberculosis
IHSLLDEGKQSLTKLA

SEQ ID NO: 109487 - protein, 16 aa, Mycobacterium tuberculosis
HSLLDEGKQSLTKLAA

SEQ ID NO: 109488 - protein, 16 aa, Mycobacterium tuberculosis
SLLDEGKQSLTKLAAA

SEQ ID NO: 109489 - protein, 16 aa, Mycobacterium tuberculosis
LLDEGKQSLTKLAAAW

SEQ ID NO: 109490 - protein, 16 aa, Mycobacterium tuberculosis
LDEGKQSLTKLAAAWG

SEQ ID NO: 109491 - protein, 16 aa, Mycobacterium tuberculosis
DEGKQSLTKLAAAWGG

SEQ ID NO: 109492 - protein, 16 aa, Mycobacterium tuberculosis
EGKQSLTKLAAAWGGS

SEQ ID NO: 109493 - protein, 16 aa, Mycobacterium tuberculosis
GKQSLTKLAAAWGGSG

SEQ ID NO: 109494 - protein, 16 aa, Mycobacterium tuberculosis
KQSLTKLAAAWGGSGS

SEQ ID NO: 109495 - protein, 16 aa, Mycobacterium tuberculosis
QSLTKLAAAWGGSGSE

SEQ ID NO: 109496 - protein, 16 aa, Mycobacterium tuberculosis
SLTKLAAAWGGSGSEA

SEQ ID NO: 109497 - protein, 16 aa, Mycobacterium tuberculosis
LTKLAAAWGGSGSEAY

SEQ ID NO: 109498 - protein, 16 aa, Mycobacterium tuberculosis
TKLAAAWGGSGSEAYQ

SEQ ID NO: 109499 - protein, 16 aa, Mycobacterium tuberculosis
KLAAAWGGSGSEAYQG

SEQ ID NO: 109500 - protein, 16 aa, Mycobacterium tuberculosis
LAAAWGGSGSEAYQGV

SEQ ID NO: 109501 - protein, 16 aa, Mycobacterium tuberculosis
AAAWGGSGSEAYQGVQ

SEQ ID NO: 109502 - protein, 16 aa, Mycobacterium tuberculosis
AAWGGSGSEAYQGVQQ

SEQ ID NO: 109503 - protein, 16 aa, Mycobacterium tuberculosis
AWGGSGSEAYQGVQQK

SEQ ID NO: 109504 - protein, 16 aa, Mycobacterium tuberculosis
WGGSGSEAYQGVQQKW

SEQ ID NO: 109505 - protein, 16 aa, Mycobacterium tuberculosis
GGSGSEAYQGVQQKWD

SEQ ID NO: 109506 - protein, 16 aa, Mycobacterium tuberculosis
GSGSEAYQGVQQKWDA

SEQ ID NO: 109507 - protein, 16 aa, Mycobacterium tuberculosis
SGSEAYQGVQQKWDAT

SEQ ID NO: 109508 - protein, 16 aa, Mycobacterium tuberculosis
GSEAYQGVQQKWDATA

SEQ ID NO: 109509 - protein, 16 aa, Mycobacterium tuberculosis
SEAYQGVQQKWDATAT

SEQ ID NO: 109510 - protein, 16 aa, Mycobacterium tuberculosis
EAYQGVQQKWDATATE

SEQ ID NO: 109511 - protein, 16 aa, Mycobacterium tuberculosis
AYQGVQQKWDATATEL

SEQ ID NO: 109512 - protein, 16 aa, Mycobacterium tuberculosis
YQGVQQKWDATATELN

SEQ ID NO: 109513 - protein, 16 aa, Mycobacterium tuberculosis
QGVQQKWDATATELNN

SEQ ID NO: 109514 - protein, 16 aa, Mycobacterium tuberculosis
GVQQKWDATATELNNA

SEQ ID NO: 109515 - protein, 16 aa, Mycobacterium tuberculosis
VQQKWDATATELNNAL

SEQ ID NO: 109516 - protein, 16 aa, Mycobacterium tuberculosis
QQKWDATATELNNALQ

SEQ ID NO: 109517 - protein, 16 aa, Mycobacterium tuberculosis
QKWDATATELNNALQN

SEQ ID NO: 109518 - protein, 16 aa, Mycobacterium tuberculosis
KWDATATELNNALQNL

SEQ ID NO: 109519 - protein, 16 aa, Mycobacterium tuberculosis
WDATATELNNALQNLA

SEQ ID NO: 109520 - protein, 16 aa, Mycobacterium tuberculosis
DATATELNNALQNLAR

SEQ ID NO: 109521 - protein, 16 aa, Mycobacterium tuberculosis
ATATELNNALQNLART

SEQ ID NO: 109522 - protein, 16 aa, Mycobacterium tuberculosis
TATELNNALQNLARTI

SEQ ID NO: 109523 - protein, 16 aa, Mycobacterium tuberculosis
ATELNNALQNLARTIS

SEQ ID NO: 109524 - protein, 16 aa, Mycobacterium tuberculosis
TELNNALQNLARTISE

SEQ ID NO: 109525 - protein, 16 aa, Mycobacterium tuberculosis
ELNNALQNLARTISEA

SEQ ID NO: 109526 - protein, 16 aa, Mycobacterium tuberculosis
LNNALQNLARTISEAG

SEQ ID NO: 109527 - protein, 16 aa, Mycobacterium tuberculosis
NNALQNLARTISEAGQ

SEQ ID NO: 109528 - protein, 16 aa, Mycobacterium tuberculosis
NALQNLARTISEAGQA

SEQ ID NO: 109529 - protein, 16 aa, Mycobacterium tuberculosis
ALQNLARTISEAGQAM

SEQ ID NO: 109530 - protein, 16 aa, Mycobacterium tuberculosis
LQNLARTISEAGQAMA

SEQ ID NO: 109531 - protein, 16 aa, Mycobacterium tuberculosis
QNLARTISEAGQAMAS

SEQ ID NO: 109532 - protein, 16 aa, Mycobacterium tuberculosis
NLARTISEAGQAMAST

SEQ ID NO: 109533 - protein, 16 aa, Mycobacterium tuberculosis
LARTISEAGQAMASTE

SEQ ID NO: 109534 - protein, 16 aa, Mycobacterium tuberculosis
ARTISEAGQAMASTEG

SEQ ID NO: 109535 - protein, 16 aa, Mycobacterium tuberculosis
RTISEAGQAMASTEGN

SEQ ID NO: 109536 - protein, 16 aa, Mycobacterium tuberculosis
TISEAGQAMASTEGNV

SEQ ID NO: 109537 - protein, 16 aa, Mycobacterium tuberculosis
ISEAGQAMASTEGNVT

SEQ ID NO: 109538 - protein, 16 aa, Mycobacterium tuberculosis
SEAGQAMASTEGNVTG

SEQ ID NO: 109539 - protein, 16 aa, Mycobacterium tuberculosis
EAGQAMASTEGNVTGM

SEQ ID NO: 109540 - protein, 16 aa, Mycobacterium tuberculosis
AGQAMASTEGNVTGMF

SEQ ID NO: 109541 - protein, 16 aa, Mycobacterium tuberculosis
GQAMASTEGNVTGMFA

SEQ ID NO: 109542 - protein, 13 aa, Mycobacterium tuberculosis
MAEPLAVDPTGLS

SEQ ID NO: 109543 - protein, 13 aa, Mycobacterium tuberculosis
AEPLAVDPTGLSA

SEQ ID NO: 109544 - protein, 13 aa, Mycobacterium tuberculosis
EPLAVDPTGLSAA

SEQ ID NO: 109545 - protein, 13 aa, Mycobacterium tuberculosis
PLAVDPTGLSAAA

SEQ ID NO: 109546 - protein, 13 aa, Mycobacterium tuberculosis
LAVDPTGLSAAAA

SEQ ID NO: 109547 - protein, 13 aa, Mycobacterium tuberculosis
AVDPTGLSAAAAK

SEQ ID NO: 109548 - protein, 13 aa, Mycobacterium tuberculosis
VDPTGLSAAAAKL

SEQ ID NO: 109549 - protein, 13 aa, Mycobacterium tuberculosis
DPTGLSAAAAKLA

SEQ ID NO: 109550 - protein, 13 aa, Mycobacterium tuberculosis
PTGLSAAAAKLAG

SEQ ID NO: 109551 - protein, 13 aa, Mycobacterium tuberculosis
TGLSAAAAKLAGL

SEQ ID NO: 109552 - protein, 13 aa, Mycobacterium tuberculosis
GLSAAAAKLAGLV

SEQ ID NO: 109553 - protein, 13 aa, Mycobacterium tuberculosis
LSAAAAKLAGLVF

SEQ ID NO: 109554 - protein, 13 aa, Mycobacterium tuberculosis
SAAAAKLAGLVFP

SEQ ID NO: 109555 - protein, 13 aa, Mycobacterium tuberculosis
AAAAKLAGLVFPQ

SEQ ID NO: 109556 - protein, 13 aa, Mycobacterium tuberculosis
AAAKLAGLVFPQP

SEQ ID NO: 109557 - protein, 13 aa, Mycobacterium tuberculosis
AAKLAGLVFPQPP

SEQ ID NO: 109558 - protein, 13 aa, Mycobacterium tuberculosis
AKLAGLVFPQPPA

SEQ ID NO: 109559 - protein, 13 aa, Mycobacterium tuberculosis
KLAGLVFPQPPAP

SEQ ID NO: 109560 - protein, 13 aa, Mycobacterium tuberculosis
LAGLVFPQPPAPI

SEQ ID NO: 109561 - protein, 13 aa, Mycobacterium tuberculosis
AGLVFPQPPAPIA

SEQ ID NO: 109562 - protein, 13 aa, Mycobacterium tuberculosis
GLVFPQPPAPIAV

SEQ ID NO: 109563 - protein, 13 aa, Mycobacterium tuberculosis
LVFPQPPAPIAVS

SEQ ID NO: 109564 - protein, 13 aa, Mycobacterium tuberculosis
VFPQPPAPIAVSG

SEQ ID NO: 109565 - protein, 13 aa, Mycobacterium tuberculosis
FPQPPAPIAVSGT

SEQ ID NO: 109566 - protein, 13 aa, Mycobacterium tuberculosis
PQPPAPIAVSGTD

SEQ ID NO: 109567 - protein, 13 aa, Mycobacterium tuberculosis
QPPAPIAVSGTDS

SEQ ID NO: 109568 - protein, 13 aa, Mycobacterium tuberculosis
PPAPIAVSGTDSV

SEQ ID NO: 109569 - protein, 13 aa, Mycobacterium tuberculosis
PAPIAVSGTDSVV

SEQ ID NO: 109570 - protein, 13 aa, Mycobacterium tuberculosis
APIAVSGTDSVVA

SEQ ID NO: 109571 - protein, 13 aa, Mycobacterium tuberculosis
PIAVSGTDSVVAA

SEQ ID NO: 109572 - protein, 13 aa, Mycobacterium tuberculosis
IAVSGTDSVVAAI

SEQ ID NO: 109573 - protein, 13 aa, Mycobacterium tuberculosis
AVSGTDSVVAAIN

SEQ ID NO: 109574 - protein, 13 aa, Mycobacterium tuberculosis
VSGTDSVVAAINE

SEQ ID NO: 109575 - protein, 13 aa, Mycobacterium tuberculosis
SGTDSVVAAINET

SEQ ID NO: 109576 - protein, 13 aa, Mycobacterium tuberculosis
GTDSVVAAINETM

SEQ ID NO: 109577 - protein, 13 aa, Mycobacterium tuberculosis
TDSVVAAINETMP

SEQ ID NO: 109578 - protein, 13 aa, Mycobacterium tuberculosis
DSVVAAINETMPS

SEQ ID NO: 109579 - protein, 13 aa, Mycobacterium tuberculosis
SVVAAINETMPSI

SEQ ID NO: 109580 - protein, 13 aa, Mycobacterium tuberculosis
VVAAINETMPSIE

SEQ ID NO: 109581 - protein, 13 aa, Mycobacterium tuberculosis
VAAINETMPSIES

SEQ ID NO: 109582 - protein, 13 aa, Mycobacterium tuberculosis
AAINETMPSIESL

SEQ ID NO: 109583 - protein, 13 aa, Mycobacterium tuberculosis
AINETMPSIESLV

SEQ ID NO: 109584 - protein, 13 aa, Mycobacterium tuberculosis
INETMPSIESLVS

SEQ ID NO: 109585 - protein, 13 aa, Mycobacterium tuberculosis
NETMPSIESLVSD

SEQ ID NO: 109586 - protein, 13 aa, Mycobacterium tuberculosis
ETMPSIESLVSDG

SEQ ID NO: 109587 - protein, 13 aa, Mycobacterium tuberculosis
TMPSIESLVSDGL

SEQ ID NO: 109588 - protein, 13 aa, Mycobacterium tuberculosis
MPSIESLVSDGLP

SEQ ID NO: 109589 - protein, 13 aa, Mycobacterium tuberculosis
PSIESLVSDGLPG

SEQ ID NO: 109590 - protein, 13 aa, Mycobacterium tuberculosis
SIESLVSDGLPGV

SEQ ID NO: 109591 - protein, 13 aa, Mycobacterium tuberculosis
IESLVSDGLPGVK

SEQ ID NO: 109592 - protein, 13 aa, Mycobacterium tuberculosis
ESLVSDGLPGVKA

SEQ ID NO: 109593 - protein, 13 aa, Mycobacterium tuberculosis
SLVSDGLPGVKAA

SEQ ID NO: 109594 - protein, 13 aa, Mycobacterium tuberculosis
LVSDGLPGVKAAL

SEQ ID NO: 109595 - protein, 13 aa, Mycobacterium tuberculosis
VSDGLPGVKAALT

SEQ ID NO: 109596 - protein, 13 aa, Mycobacterium tuberculosis
SDGLPGVKAALTR

SEQ ID NO: 109597 - protein, 13 aa, Mycobacterium tuberculosis
DGLPGVKAALTRT

SEQ ID NO: 109598 - protein, 13 aa, Mycobacterium tuberculosis
GLPGVKAALTRTA

SEQ ID NO: 109599 - protein, 13 aa, Mycobacterium tuberculosis
LPGVKAALTRTAS

SEQ ID NO: 109600 - protein, 13 aa, Mycobacterium tuberculosis
PGVKAALTRTASN

SEQ ID NO: 109601 - protein, 13 aa, Mycobacterium tuberculosis
GVKAALTRTASNM

SEQ ID NO: 109602 - protein, 13 aa, Mycobacterium tuberculosis
VKAALTRTASNMN

SEQ ID NO: 109603 - protein, 13 aa, Mycobacterium tuberculosis
KAALTRTASNMNA

SEQ ID NO: 109604 - protein, 13 aa, Mycobacterium tuberculosis
AALTRTASNMNAA

SEQ ID NO: 109605 - protein, 13 aa, Mycobacterium tuberculosis
ALTRTASNMNAAA

SEQ ID NO: 109606 - protein, 13 aa, Mycobacterium tuberculosis
LTRTASNMNAAAD

SEQ ID NO: 109607 - protein, 13 aa, Mycobacterium tuberculosis
TRTASNMNAAADV

SEQ ID NO: 109608 - protein, 13 aa, Mycobacterium tuberculosis
RTASNMNAAADVY

SEQ ID NO: 109609 - protein, 13 aa, Mycobacterium tuberculosis
TASNMNAAADVYA

SEQ ID NO: 109610 - protein, 13 aa, Mycobacterium tuberculosis
ASNMNAAADVYAK

SEQ ID NO: 109611 - protein, 13 aa, Mycobacterium tuberculosis
SNMNAAADVYAKT

SEQ ID NO: 109612 - protein, 13 aa, Mycobacterium tuberculosis
NMNAAADVYAKTD

SEQ ID NO: 109613 - protein, 13 aa, Mycobacterium tuberculosis
MNAAADVYAKTDQ

SEQ ID NO: 109614 - protein, 13 aa, Mycobacterium tuberculosis
NAAADVYAKTDQS

SEQ ID NO: 109615 - protein, 13 aa, Mycobacterium tuberculosis
AAADVYAKTDQSL

SEQ ID NO: 109616 - protein, 13 aa, Mycobacterium tuberculosis
AADVYAKTDQSLG

SEQ ID NO: 109617 - protein, 13 aa, Mycobacterium tuberculosis
ADVYAKTDQSLGT

SEQ ID NO: 109618 - protein, 13 aa, Mycobacterium tuberculosis
DVYAKTDQSLGTS

SEQ ID NO: 109619 - protein, 13 aa, Mycobacterium tuberculosis
VYAKTDQSLGTSL

SEQ ID NO: 109620 - protein, 13 aa, Mycobacterium tuberculosis
YAKTDQSLGTSLS

SEQ ID NO: 109621 - protein, 13 aa, Mycobacterium tuberculosis
AKTDQSLGTSLSQ

SEQ ID NO: 109622 - protein, 13 aa, Mycobacterium tuberculosis
KTDQSLGTSLSQY

SEQ ID NO: 109623 - protein, 13 aa, Mycobacterium tuberculosis
TDQSLGTSLSQYA

SEQ ID NO: 109624 - protein, 13 aa, Mycobacterium tuberculosis
DQSLGTSLSQYAF

SEQ ID NO: 109625 - protein, 13 aa, Mycobacterium tuberculosis
QSLGTSLSQYAFG

SEQ ID NO: 109626 - protein, 13 aa, Mycobacterium tuberculosis
SLGTSLSQYAFGS

SEQ ID NO: 109627 - protein, 13 aa, Mycobacterium tuberculosis
LGTSLSQYAFGSS

SEQ ID NO: 109628 - protein, 13 aa, Mycobacterium tuberculosis
GTSLSQYAFGSSG

SEQ ID NO: 109629 - protein, 13 aa, Mycobacterium tuberculosis
TSLSQYAFGSSGE

SEQ ID NO: 109630 - protein, 13 aa, Mycobacterium tuberculosis
SLSQYAFGSSGEG

SEQ ID NO: 109631 - protein, 13 aa, Mycobacterium tuberculosis
LSQYAFGSSGEGL

SEQ ID NO: 109632 - protein, 13 aa, Mycobacterium tuberculosis
SQYAFGSSGEGLA

SEQ ID NO: 109633 - protein, 13 aa, Mycobacterium tuberculosis
QYAFGSSGEGLAG

SEQ ID NO: 109634 - protein, 13 aa, Mycobacterium tuberculosis
YAFGSSGEGLAGV

SEQ ID NO: 109635 - protein, 13 aa, Mycobacterium tuberculosis
AFGSSGEGLAGVA

SEQ ID NO: 109636 - protein, 13 aa, Mycobacterium tuberculosis
FGSSGEGLAGVAS

SEQ ID NO: 109637 - protein, 13 aa, Mycobacterium tuberculosis
GSSGEGLAGVASV

SEQ ID NO: 109638 - protein, 13 aa, Mycobacterium tuberculosis
SSGEGLAGVASVG

SEQ ID NO: 109639 - protein, 13 aa, Mycobacterium tuberculosis
SGEGLAGVASVGG

SEQ ID NO: 109640 - protein, 13 aa, Mycobacterium tuberculosis
GEGLAGVASVGGQ

SEQ ID NO: 109641 - protein, 13 aa, Mycobacterium tuberculosis
EGLAGVASVGGQP

SEQ ID NO: 109642 - protein, 13 aa, Mycobacterium tuberculosis
GLAGVASVGGQPS

SEQ ID NO: 109643 - protein, 13 aa, Mycobacterium tuberculosis
LAGVASVGGQPSQ

SEQ ID NO: 109644 - protein, 13 aa, Mycobacterium tuberculosis
AGVASVGGQPSQA

SEQ ID NO: 109645 - protein, 13 aa, Mycobacterium tuberculosis
GVASVGGQPSQAT

SEQ ID NO: 109646 - protein, 13 aa, Mycobacterium tuberculosis
VASVGGQPSQATQ

SEQ ID NO: 109647 - protein, 13 aa, Mycobacterium tuberculosis
ASVGGQPSQATQL

SEQ ID NO: 109648 - protein, 13 aa, Mycobacterium tuberculosis
SVGGQPSQATQLL

SEQ ID NO: 109649 - protein, 13 aa, Mycobacterium tuberculosis
VGGQPSQATQLLS

SEQ ID NO: 109650 - protein, 13 aa, Mycobacterium tuberculosis
GGQPSQATQLLST

SEQ ID NO: 109651 - protein, 13 aa, Mycobacterium tuberculosis
GQPSQATQLLSTP

SEQ ID NO: 109652 - protein, 13 aa, Mycobacterium tuberculosis
QPSQATQLLSTPV

SEQ ID NO: 109653 - protein, 13 aa, Mycobacterium tuberculosis
PSQATQLLSTPVS

SEQ ID NO: 109654 - protein, 13 aa, Mycobacterium tuberculosis
SQATQLLSTPVSQ

SEQ ID NO: 109655 - protein, 13 aa, Mycobacterium tuberculosis
QATQLLSTPVSQV

SEQ ID NO: 109656 - protein, 13 aa, Mycobacterium tuberculosis
ATQLLSTPVSQVT

SEQ ID NO: 109657 - protein, 13 aa, Mycobacterium tuberculosis
TQLLSTPVSQVTT

SEQ ID NO: 109658 - protein, 13 aa, Mycobacterium tuberculosis
QLLSTPVSQVTTQ

SEQ ID NO: 109659 - protein, 13 aa, Mycobacterium tuberculosis
LLSTPVSQVTTQL

SEQ ID NO: 109660 - protein, 13 aa, Mycobacterium tuberculosis
LSTPVSQVTTQLG

SEQ ID NO: 109661 - protein, 13 aa, Mycobacterium tuberculosis
STPVSQVTTQLGE

SEQ ID NO: 109662 - protein, 13 aa, Mycobacterium tuberculosis
TPVSQVTTQLGET

SEQ ID NO: 109663 - protein, 13 aa, Mycobacterium tuberculosis
PVSQVTTQLGETA

SEQ ID NO: 109664 - protein, 13 aa, Mycobacterium tuberculosis
VSQVTTQLGETAA

SEQ ID NO: 109665 - protein, 13 aa, Mycobacterium tuberculosis
SQVTTQLGETAAE

SEQ ID NO: 109666 - protein, 13 aa, Mycobacterium tuberculosis
QVTTQLGETAAEL

SEQ ID NO: 109667 - protein, 13 aa, Mycobacterium tuberculosis
VTTQLGETAAELA

SEQ ID NO: 109668 - protein, 13 aa, Mycobacterium tuberculosis
TTQLGETAAELAP

SEQ ID NO: 109669 - protein, 13 aa, Mycobacterium tuberculosis
TQLGETAAELAPR

SEQ ID NO: 109670 - protein, 13 aa, Mycobacterium tuberculosis
QLGETAAELAPRV

SEQ ID NO: 109671 - protein, 13 aa, Mycobacterium tuberculosis
LGETAAELAPRVV

SEQ ID NO: 109672 - protein, 13 aa, Mycobacterium tuberculosis
GETAAELAPRVVA

SEQ ID NO: 109673 - protein, 13 aa, Mycobacterium tuberculosis
ETAAELAPRVVAT

SEQ ID NO: 109674 - protein, 13 aa, Mycobacterium tuberculosis
TAAELAPRVVATV

SEQ ID NO: 109675 - protein, 13 aa, Mycobacterium tuberculosis
AAELAPRVVATVP

SEQ ID NO: 109676 - protein, 13 aa, Mycobacterium tuberculosis
AELAPRVVATVPQ

SEQ ID NO: 109677 - protein, 13 aa, Mycobacterium tuberculosis
ELAPRVVATVPQL

SEQ ID NO: 109678 - protein, 13 aa, Mycobacterium tuberculosis
LAPRVVATVPQLV

SEQ ID NO: 109679 - protein, 13 aa, Mycobacterium tuberculosis
APRVVATVPQLVQ

SEQ ID NO: 109680 - protein, 13 aa, Mycobacterium tuberculosis
PRVVATVPQLVQL

SEQ ID NO: 109681 - protein, 13 aa, Mycobacterium tuberculosis
RVVATVPQLVQLA

SEQ ID NO: 109682 - protein, 13 aa, Mycobacterium tuberculosis
VVATVPQLVQLAP

SEQ ID NO: 109683 - protein, 13 aa, Mycobacterium tuberculosis
VATVPQLVQLAPH

SEQ ID NO: 109684 - protein, 13 aa, Mycobacterium tuberculosis
ATVPQLVQLAPHA

SEQ ID NO: 109685 - protein, 13 aa, Mycobacterium tuberculosis
TVPQLVQLAPHAV

SEQ ID NO: 109686 - protein, 13 aa, Mycobacterium tuberculosis
VPQLVQLAPHAVQ

SEQ ID NO: 109687 - protein, 13 aa, Mycobacterium tuberculosis
PQLVQLAPHAVQM

SEQ ID NO: 109688 - protein, 13 aa, Mycobacterium tuberculosis
QLVQLAPHAVQMS

SEQ ID NO: 109689 - protein, 13 aa, Mycobacterium tuberculosis
LVQLAPHAVQMSQ

SEQ ID NO: 109690 - protein, 13 aa, Mycobacterium tuberculosis
VQLAPHAVQMSQN

SEQ ID NO: 109691 - protein, 13 aa, Mycobacterium tuberculosis
QLAPHAVQMSQNA

SEQ ID NO: 109692 - protein, 13 aa, Mycobacterium tuberculosis
LAPHAVQMSQNAS

SEQ ID NO: 109693 - protein, 13 aa, Mycobacterium tuberculosis
APHAVQMSQNASP

SEQ ID NO: 109694 - protein, 13 aa, Mycobacterium tuberculosis
PHAVQMSQNASPI

SEQ ID NO: 109695 - protein, 13 aa, Mycobacterium tuberculosis
HAVQMSQNASPIA

SEQ ID NO: 109696 - protein, 13 aa, Mycobacterium tuberculosis
AVQMSQNASPIAQ

SEQ ID NO: 109697 - protein, 13 aa, Mycobacterium tuberculosis
VQMSQNASPIAQT

SEQ ID NO: 109698 - protein, 13 aa, Mycobacterium tuberculosis
QMSQNASPIAQTI

SEQ ID NO: 109699 - protein, 13 aa, Mycobacterium tuberculosis
MSQNASPIAQTIS

SEQ ID NO: 109700 - protein, 13 aa, Mycobacterium tuberculosis
SQNASPIAQTISQ

SEQ ID NO: 109701 - protein, 13 aa, Mycobacterium tuberculosis
QNASPIAQTISQT

SEQ ID NO: 109702 - protein, 13 aa, Mycobacterium tuberculosis
NASPIAQTISQTA

SEQ ID NO: 109703 - protein, 13 aa, Mycobacterium tuberculosis
ASPIAQTISQTAQ

SEQ ID NO: 109704 - protein, 13 aa, Mycobacterium tuberculosis
SPIAQTISQTAQQ

SEQ ID NO: 109705 - protein, 13 aa, Mycobacterium tuberculosis
PIAQTISQTAQQA

SEQ ID NO: 109706 - protein, 13 aa, Mycobacterium tuberculosis
IAQTISQTAQQAA

SEQ ID NO: 109707 - protein, 13 aa, Mycobacterium tuberculosis
AQTISQTAQQAAQ

SEQ ID NO: 109708 - protein, 13 aa, Mycobacterium tuberculosis
QTISQTAQQAAQS

SEQ ID NO: 109709 - protein, 13 aa, Mycobacterium tuberculosis
TISQTAQQAAQSA

SEQ ID NO: 109710 - protein, 13 aa, Mycobacterium tuberculosis
ISQTAQQAAQSAQ

SEQ ID NO: 109711 - protein, 13 aa, Mycobacterium tuberculosis
SQTAQQAAQSAQG

SEQ ID NO: 109712 - protein, 13 aa, Mycobacterium tuberculosis
QTAQQAAQSAQGG

SEQ ID NO: 109713 - protein, 13 aa, Mycobacterium tuberculosis
TAQQAAQSAQGGS

SEQ ID NO: 109714 - protein, 13 aa, Mycobacterium tuberculosis
AQQAAQSAQGGSG

SEQ ID NO: 109715 - protein, 13 aa, Mycobacterium tuberculosis
QQAAQSAQGGSGP

SEQ ID NO: 109716 - protein, 13 aa, Mycobacterium tuberculosis
QAAQSAQGGSGPM

SEQ ID NO: 109717 - protein, 13 aa, Mycobacterium tuberculosis
AAQSAQGGSGPMP

SEQ ID NO: 109718 - protein, 13 aa, Mycobacterium tuberculosis
AQSAQGGSGPMPA

SEQ ID NO: 109719 - protein, 13 aa, Mycobacterium tuberculosis
QSAQGGSGPMPAQ

SEQ ID NO: 109720 - protein, 13 aa, Mycobacterium tuberculosis
SAQGGSGPMPAQL

SEQ ID NO: 109721 - protein, 13 aa, Mycobacterium tuberculosis
AQGGSGPMPAQLA

SEQ ID NO: 109722 - protein, 13 aa, Mycobacterium tuberculosis
QGGSGPMPAQLAS

SEQ ID NO: 109723 - protein, 13 aa, Mycobacterium tuberculosis
GGSGPMPAQLASA

SEQ ID NO: 109724 - protein, 13 aa, Mycobacterium tuberculosis
GSGPMPAQLASAE

SEQ ID NO: 109725 - protein, 13 aa, Mycobacterium tuberculosis
SGPMPAQLASAEK

SEQ ID NO: 109726 - protein, 13 aa, Mycobacterium tuberculosis
GPMPAQLASAEKP

SEQ ID NO: 109727 - protein, 13 aa, Mycobacterium tuberculosis
PMPAQLASAEKPA

SEQ ID NO: 109728 - protein, 13 aa, Mycobacterium tuberculosis
MPAQLASAEKPAT

SEQ ID NO: 109729 - protein, 13 aa, Mycobacterium tuberculosis
PAQLASAEKPATE

SEQ ID NO: 109730 - protein, 13 aa, Mycobacterium tuberculosis
AQLASAEKPATEQ

SEQ ID NO: 109731 - protein, 13 aa, Mycobacterium tuberculosis
QLASAEKPATEQA

SEQ ID NO: 109732 - protein, 13 aa, Mycobacterium tuberculosis
LASAEKPATEQAE

SEQ ID NO: 109733 - protein, 13 aa, Mycobacterium tuberculosis
ASAEKPATEQAEP

SEQ ID NO: 109734 - protein, 13 aa, Mycobacterium tuberculosis
SAEKPATEQAEPV

SEQ ID NO: 109735 - protein, 13 aa, Mycobacterium tuberculosis
AEKPATEQAEPVH

SEQ ID NO: 109736 - protein, 13 aa, Mycobacterium tuberculosis
EKPATEQAEPVHE

SEQ ID NO: 109737 - protein, 13 aa, Mycobacterium tuberculosis
KPATEQAEPVHEV

SEQ ID NO: 109738 - protein, 13 aa, Mycobacterium tuberculosis
PATEQAEPVHEVT

SEQ ID NO: 109739 - protein, 13 aa, Mycobacterium tuberculosis
ATEQAEPVHEVTN

SEQ ID NO: 109740 - protein, 13 aa, Mycobacterium tuberculosis
TEQAEPVHEVTND

SEQ ID NO: 109741 - protein, 13 aa, Mycobacterium tuberculosis
EQAEPVHEVTNDD

SEQ ID NO: 109742 - protein, 13 aa, Mycobacterium tuberculosis
QAEPVHEVTNDDQ

SEQ ID NO: 109743 - protein, 13 aa, Mycobacterium tuberculosis
AEPVHEVTNDDQG

SEQ ID NO: 109744 - protein, 13 aa, Mycobacterium tuberculosis
EPVHEVTNDDQGD

SEQ ID NO: 109745 - protein, 13 aa, Mycobacterium tuberculosis
PVHEVTNDDQGDQ

SEQ ID NO: 109746 - protein, 13 aa, Mycobacterium tuberculosis
VHEVTNDDQGDQG

SEQ ID NO: 109747 - protein, 13 aa, Mycobacterium tuberculosis
HEVTNDDQGDQGD

SEQ ID NO: 109748 - protein, 13 aa, Mycobacterium tuberculosis
EVTNDDQGDQGDV

SEQ ID NO: 109749 - protein, 13 aa, Mycobacterium tuberculosis
VTNDDQGDQGDVQ

SEQ ID NO: 109750 - protein, 13 aa, Mycobacterium tuberculosis
TNDDQGDQGDVQP

SEQ ID NO: 109751 - protein, 13 aa, Mycobacterium tuberculosis
NDDQGDQGDVQPA

SEQ ID NO: 109752 - protein, 13 aa, Mycobacterium tuberculosis
DDQGDQGDVQPAE

SEQ ID NO: 109753 - protein, 13 aa, Mycobacterium tuberculosis
DQGDQGDVQPAEV

SEQ ID NO: 109754 - protein, 13 aa, Mycobacterium tuberculosis
QGDQGDVQPAEVV

SEQ ID NO: 109755 - protein, 13 aa, Mycobacterium tuberculosis
GDQGDVQPAEVVA

SEQ ID NO: 109756 - protein, 13 aa, Mycobacterium tuberculosis
DQGDVQPAEVVAA

SEQ ID NO: 109757 - protein, 13 aa, Mycobacterium tuberculosis
QGDVQPAEVVAAA

SEQ ID NO: 109758 - protein, 13 aa, Mycobacterium tuberculosis
GDVQPAEVVAAAR

SEQ ID NO: 109759 - protein, 13 aa, Mycobacterium tuberculosis
DVQPAEVVAAARD

SEQ ID NO: 109760 - protein, 13 aa, Mycobacterium tuberculosis
VQPAEVVAAARDE

SEQ ID NO: 109761 - protein, 13 aa, Mycobacterium tuberculosis
QPAEVVAAARDEG

SEQ ID NO: 109762 - protein, 13 aa, Mycobacterium tuberculosis
PAEVVAAARDEGA

SEQ ID NO: 109763 - protein, 13 aa, Mycobacterium tuberculosis
AEVVAAARDEGAG

SEQ ID NO: 109764 - protein, 13 aa, Mycobacterium tuberculosis
EVVAAARDEGAGA

SEQ ID NO: 109765 - protein, 13 aa, Mycobacterium tuberculosis
VVAAARDEGAGAS

SEQ ID NO: 109766 - protein, 13 aa, Mycobacterium tuberculosis
VAAARDEGAGASP

SEQ ID NO: 109767 - protein, 13 aa, Mycobacterium tuberculosis
AAARDEGAGASPG

SEQ ID NO: 109768 - protein, 13 aa, Mycobacterium tuberculosis
AARDEGAGASPGQ

SEQ ID NO: 109769 - protein, 13 aa, Mycobacterium tuberculosis
ARDEGAGASPGQQ

SEQ ID NO: 109770 - protein, 13 aa, Mycobacterium tuberculosis
RDEGAGASPGQQP

SEQ ID NO: 109771 - protein, 13 aa, Mycobacterium tuberculosis
DEGAGASPGQQPG

SEQ ID NO: 109772 - protein, 13 aa, Mycobacterium tuberculosis
EGAGASPGQQPGG

SEQ ID NO: 109773 - protein, 13 aa, Mycobacterium tuberculosis
GAGASPGQQPGGG

SEQ ID NO: 109774 - protein, 13 aa, Mycobacterium tuberculosis
AGASPGQQPGGGV

SEQ ID NO: 109775 - protein, 13 aa, Mycobacterium tuberculosis
GASPGQQPGGGVP

SEQ ID NO: 109776 - protein, 13 aa, Mycobacterium tuberculosis
ASPGQQPGGGVPA

SEQ ID NO: 109777 - protein, 13 aa, Mycobacterium tuberculosis
SPGQQPGGGVPAQ

SEQ ID NO: 109778 - protein, 13 aa, Mycobacterium tuberculosis
PGQQPGGGVPAQA

SEQ ID NO: 109779 - protein, 13 aa, Mycobacterium tuberculosis
GQQPGGGVPAQAM

SEQ ID NO: 109780 - protein, 13 aa, Mycobacterium tuberculosis
QQPGGGVPAQAMD

SEQ ID NO: 109781 - protein, 13 aa, Mycobacterium tuberculosis
QPGGGVPAQAMDT

SEQ ID NO: 109782 - protein, 13 aa, Mycobacterium tuberculosis
PGGGVPAQAMDTG

SEQ ID NO: 109783 - protein, 13 aa, Mycobacterium tuberculosis
GGGVPAQAMDTGA

SEQ ID NO: 109784 - protein, 13 aa, Mycobacterium tuberculosis
GGVPAQAMDTGAG

SEQ ID NO: 109785 - protein, 13 aa, Mycobacterium tuberculosis
GVPAQAMDTGAGA

SEQ ID NO: 109786 - protein, 13 aa, Mycobacterium tuberculosis
VPAQAMDTGAGAR

SEQ ID NO: 109787 - protein, 13 aa, Mycobacterium tuberculosis
PAQAMDTGAGARP

SEQ ID NO: 109788 - protein, 13 aa, Mycobacterium tuberculosis
AQAMDTGAGARPA

SEQ ID NO: 109789 - protein, 13 aa, Mycobacterium tuberculosis
QAMDTGAGARPAA

SEQ ID NO: 109790 - protein, 13 aa, Mycobacterium tuberculosis
AMDTGAGARPAAS

SEQ ID NO: 109791 - protein, 13 aa, Mycobacterium tuberculosis
MDTGAGARPAASP

SEQ ID NO: 109792 - protein, 13 aa, Mycobacterium tuberculosis
DTGAGARPAASPL

SEQ ID NO: 109793 - protein, 13 aa, Mycobacterium tuberculosis
TGAGARPAASPLA

SEQ ID NO: 109794 - protein, 13 aa, Mycobacterium tuberculosis
GAGARPAASPLAA

SEQ ID NO: 109795 - protein, 13 aa, Mycobacterium tuberculosis
AGARPAASPLAAP

SEQ ID NO: 109796 - protein, 13 aa, Mycobacterium tuberculosis
GARPAASPLAAPV

SEQ ID NO: 109797 - protein, 13 aa, Mycobacterium tuberculosis
ARPAASPLAAPVD

SEQ ID NO: 109798 - protein, 13 aa, Mycobacterium tuberculosis
RPAASPLAAPVDP

SEQ ID NO: 109799 - protein, 13 aa, Mycobacterium tuberculosis
PAASPLAAPVDPS

SEQ ID NO: 109800 - protein, 13 aa, Mycobacterium tuberculosis
AASPLAAPVDPST

SEQ ID NO: 109801 - protein, 13 aa, Mycobacterium tuberculosis
ASPLAAPVDPSTP

SEQ ID NO: 109802 - protein, 13 aa, Mycobacterium tuberculosis
SPLAAPVDPSTPA

SEQ ID NO: 109803 - protein, 13 aa, Mycobacterium tuberculosis
PLAAPVDPSTPAP

SEQ ID NO: 109804 - protein, 13 aa, Mycobacterium tuberculosis
LAAPVDPSTPAPS

SEQ ID NO: 109805 - protein, 13 aa, Mycobacterium tuberculosis
AAPVDPSTPAPST

SEQ ID NO: 109806 - protein, 13 aa, Mycobacterium tuberculosis
APVDPSTPAPSTT

SEQ ID NO: 109807 - protein, 13 aa, Mycobacterium tuberculosis
PVDPSTPAPSTTT

SEQ ID NO: 109808 - protein, 13 aa, Mycobacterium tuberculosis
VDPSTPAPSTTTT

SEQ ID NO: 109809 - protein, 13 aa, Mycobacterium tuberculosis
DPSTPAPSTTTTL

SEQ ID NO: 109810 - protein, 14 aa, Mycobacterium tuberculosis
MAEPLAVDPTGLSA

SEQ ID NO: 109811 - protein, 14 aa, Mycobacterium tuberculosis
AEPLAVDPTGLSAA

SEQ ID NO: 109812 - protein, 14 aa, Mycobacterium tuberculosis
EPLAVDPTGLSAAA

SEQ ID NO: 109813 - protein, 14 aa, Mycobacterium tuberculosis
PLAVDPTGLSAAAA

SEQ ID NO: 109814 - protein, 14 aa, Mycobacterium tuberculosis
LAVDPTGLSAAAAK

SEQ ID NO: 109815 - protein, 14 aa, Mycobacterium tuberculosis
AVDPTGLSAAAAKL

SEQ ID NO: 109816 - protein, 14 aa, Mycobacterium tuberculosis
VDPTGLSAAAAKLA

SEQ ID NO: 109817 - protein, 14 aa, Mycobacterium tuberculosis
DPTGLSAAAAKLAG

SEQ ID NO: 109818 - protein, 14 aa, Mycobacterium tuberculosis
PTGLSAAAAKLAGL

SEQ ID NO: 109819 - protein, 14 aa, Mycobacterium tuberculosis
TGLSAAAAKLAGLV

SEQ ID NO: 109820 - protein, 14 aa, Mycobacterium tuberculosis
GLSAAAAKLAGLVF

SEQ ID NO: 109821 - protein, 14 aa, Mycobacterium tuberculosis
LSAAAAKLAGLVFP

SEQ ID NO: 109822 - protein, 14 aa, Mycobacterium tuberculosis
SAAAAKLAGLVFPQ

SEQ ID NO: 109823 - protein, 14 aa, Mycobacterium tuberculosis
AAAAKLAGLVFPQP

SEQ ID NO: 109824 - protein, 14 aa, Mycobacterium tuberculosis
AAAKLAGLVFPQPP

SEQ ID NO: 109825 - protein, 14 aa, Mycobacterium tuberculosis
AAKLAGLVFPQPPA

SEQ ID NO: 109826 - protein, 14 aa, Mycobacterium tuberculosis
AKLAGLVFPQPPAP

SEQ ID NO: 109827 - protein, 14 aa, Mycobacterium tuberculosis
KLAGLVFPQPPAPI

SEQ ID NO: 109828 - protein, 14 aa, Mycobacterium tuberculosis
LAGLVFPQPPAPIA

SEQ ID NO: 109829 - protein, 14 aa, Mycobacterium tuberculosis
AGLVFPQPPAPIAV

SEQ ID NO: 109830 - protein, 14 aa, Mycobacterium tuberculosis
GLVFPQPPAPIAVS

SEQ ID NO: 109831 - protein, 14 aa, Mycobacterium tuberculosis
LVFPQPPAPIAVSG

SEQ ID NO: 109832 - protein, 14 aa, Mycobacterium tuberculosis
VFPQPPAPIAVSGT

SEQ ID NO: 109833 - protein, 14 aa, Mycobacterium tuberculosis
FPQPPAPIAVSGTD

SEQ ID NO: 109834 - protein, 14 aa, Mycobacterium tuberculosis
PQPPAPIAVSGTDS

SEQ ID NO: 109835 - protein, 14 aa, Mycobacterium tuberculosis
QPPAPIAVSGTDSV

SEQ ID NO: 109836 - protein, 14 aa, Mycobacterium tuberculosis
PPAPIAVSGTDSVV

SEQ ID NO: 109837 - protein, 14 aa, Mycobacterium tuberculosis
PAPIAVSGTDSVVA

SEQ ID NO: 109838 - protein, 14 aa, Mycobacterium tuberculosis
APIAVSGTDSVVAA

SEQ ID NO: 109839 - protein, 14 aa, Mycobacterium tuberculosis
PIAVSGTDSVVAAI

SEQ ID NO: 109840 - protein, 14 aa, Mycobacterium tuberculosis
IAVSGTDSVVAAIN

SEQ ID NO: 109841 - protein, 14 aa, Mycobacterium tuberculosis
AVSGTDSVVAAINE

SEQ ID NO: 109842 - protein, 14 aa, Mycobacterium tuberculosis
VSGTDSVVAAINET

SEQ ID NO: 109843 - protein, 14 aa, Mycobacterium tuberculosis
SGTDSVVAAINETM

SEQ ID NO: 109844 - protein, 14 aa, Mycobacterium tuberculosis
GTDSVVAAINETMP

SEQ ID NO: 109845 - protein, 14 aa, Mycobacterium tuberculosis
TDSVVAAINETMPS

SEQ ID NO: 109846 - protein, 14 aa, Mycobacterium tuberculosis
DSVVAAINETMPSI

SEQ ID NO: 109847 - protein, 14 aa, Mycobacterium tuberculosis
SVVAAINETMPSIE

SEQ ID NO: 109848 - protein, 14 aa, Mycobacterium tuberculosis
VVAAINETMPSIES

SEQ ID NO: 109849 - protein, 14 aa, Mycobacterium tuberculosis
VAAINETMPSIESL

SEQ ID NO: 109850 - protein, 14 aa, Mycobacterium tuberculosis
AAINETMPSIESLV

SEQ ID NO: 109851 - protein, 14 aa, Mycobacterium tuberculosis
AINETMPSIESLVS

SEQ ID NO: 109852 - protein, 14 aa, Mycobacterium tuberculosis
INETMPSIESLVSD

SEQ ID NO: 109853 - protein, 14 aa, Mycobacterium tuberculosis
NETMPSIESLVSDG

SEQ ID NO: 109854 - protein, 14 aa, Mycobacterium tuberculosis
ETMPSIESLVSDGL

SEQ ID NO: 109855 - protein, 14 aa, Mycobacterium tuberculosis
TMPSIESLVSDGLP

SEQ ID NO: 109856 - protein, 14 aa, Mycobacterium tuberculosis
MPSIESLVSDGLPG

SEQ ID NO: 109857 - protein, 14 aa, Mycobacterium tuberculosis
PSIESLVSDGLPGV

SEQ ID NO: 109858 - protein, 14 aa, Mycobacterium tuberculosis
SIESLVSDGLPGVK

SEQ ID NO: 109859 - protein, 14 aa, Mycobacterium tuberculosis
IESLVSDGLPGVKA

SEQ ID NO: 109860 - protein, 14 aa, Mycobacterium tuberculosis
ESLVSDGLPGVKAA

SEQ ID NO: 109861 - protein, 14 aa, Mycobacterium tuberculosis
SLVSDGLPGVKAAL

SEQ ID NO: 109862 - protein, 14 aa, Mycobacterium tuberculosis
LVSDGLPGVKAALT

SEQ ID NO: 109863 - protein, 14 aa, Mycobacterium tuberculosis
VSDGLPGVKAALTR

SEQ ID NO: 109864 - protein, 14 aa, Mycobacterium tuberculosis
SDGLPGVKAALTRT

SEQ ID NO: 109865 - protein, 14 aa, Mycobacterium tuberculosis
DGLPGVKAALTRTA

SEQ ID NO: 109866 - protein, 14 aa, Mycobacterium tuberculosis
GLPGVKAALTRTAS

SEQ ID NO: 109867 - protein, 14 aa, Mycobacterium tuberculosis
LPGVKAALTRTASN

SEQ ID NO: 109868 - protein, 14 aa, Mycobacterium tuberculosis
PGVKAALTRTASNM

SEQ ID NO: 109869 - protein, 14 aa, Mycobacterium tuberculosis
GVKAALTRTASNMN

SEQ ID NO: 109870 - protein, 14 aa, Mycobacterium tuberculosis
VKAALTRTASNMNA

SEQ ID NO: 109871 - protein, 14 aa, Mycobacterium tuberculosis
KAALTRTASNMNAA

SEQ ID NO: 109872 - protein, 14 aa, Mycobacterium tuberculosis
AALTRTASNMNAAA

SEQ ID NO: 109873 - protein, 14 aa, Mycobacterium tuberculosis
ALTRTASNMNAAAD

SEQ ID NO: 109874 - protein, 14 aa, Mycobacterium tuberculosis
LTRTASNMNAAADV

SEQ ID NO: 109875 - protein, 14 aa, Mycobacterium tuberculosis
TRTASNMNAAADVY

SEQ ID NO: 109876 - protein, 14 aa, Mycobacterium tuberculosis
RTASNMNAAADVYA

SEQ ID NO: 109877 - protein, 14 aa, Mycobacterium tuberculosis
TASNMNAAADVYAK

SEQ ID NO: 109878 - protein, 14 aa, Mycobacterium tuberculosis
ASNMNAAADVYAKT

SEQ ID NO: 109879 - protein, 14 aa, Mycobacterium tuberculosis
SNMNAAADVYAKTD

SEQ ID NO: 109880 - protein, 14 aa, Mycobacterium tuberculosis
NMNAAADVYAKTDQ

SEQ ID NO: 109881 - protein, 14 aa, Mycobacterium tuberculosis
MNAAADVYAKTDQS

SEQ ID NO: 109882 - protein, 14 aa, Mycobacterium tuberculosis
NAAADVYAKTDQSL

SEQ ID NO: 109883 - protein, 14 aa, Mycobacterium tuberculosis
AAADVYAKTDQSLG

SEQ ID NO: 109884 - protein, 14 aa, Mycobacterium tuberculosis
AADVYAKTDQSLGT

SEQ ID NO: 109885 - protein, 14 aa, Mycobacterium tuberculosis
ADVYAKTDQSLGTS

SEQ ID NO: 109886 - protein, 14 aa, Mycobacterium tuberculosis
DVYAKTDQSLGTSL

SEQ ID NO: 109887 - protein, 14 aa, Mycobacterium tuberculosis
VYAKTDQSLGTSLS

SEQ ID NO: 109888 - protein, 14 aa, Mycobacterium tuberculosis
YAKTDQSLGTSLSQ

SEQ ID NO: 109889 - protein, 14 aa, Mycobacterium tuberculosis
AKTDQSLGTSLSQY

SEQ ID NO: 109890 - protein, 14 aa, Mycobacterium tuberculosis
KTDQSLGTSLSQYA

SEQ ID NO: 109891 - protein, 14 aa, Mycobacterium tuberculosis
TDQSLGTSLSQYAF

SEQ ID NO: 109892 - protein, 14 aa, Mycobacterium tuberculosis
DQSLGTSLSQYAFG

SEQ ID NO: 109893 - protein, 14 aa, Mycobacterium tuberculosis
QSLGTSLSQYAFGS

SEQ ID NO: 109894 - protein, 14 aa, Mycobacterium tuberculosis
SLGTSLSQYAFGSS

SEQ ID NO: 109895 - protein, 14 aa, Mycobacterium tuberculosis
LGTSLSQYAFGSSG

SEQ ID NO: 109896 - protein, 14 aa, Mycobacterium tuberculosis
GTSLSQYAFGSSGE

SEQ ID NO: 109897 - protein, 14 aa, Mycobacterium tuberculosis
TSLSQYAFGSSGEG

SEQ ID NO: 109898 - protein, 14 aa, Mycobacterium tuberculosis
SLSQYAFGSSGEGL

SEQ ID NO: 109899 - protein, 14 aa, Mycobacterium tuberculosis
LSQYAFGSSGEGLA

SEQ ID NO: 109900 - protein, 14 aa, Mycobacterium tuberculosis
SQYAFGSSGEGLAG

SEQ ID NO: 109901 - protein, 14 aa, Mycobacterium tuberculosis
QYAFGSSGEGLAGV

SEQ ID NO: 109902 - protein, 14 aa, Mycobacterium tuberculosis
YAFGSSGEGLAGVA

SEQ ID NO: 109903 - protein, 14 aa, Mycobacterium tuberculosis
AFGSSGEGLAGVAS

SEQ ID NO: 109904 - protein, 14 aa, Mycobacterium tuberculosis
FGSSGEGLAGVASV

SEQ ID NO: 109905 - protein, 14 aa, Mycobacterium tuberculosis
GSSGEGLAGVASVG

SEQ ID NO: 109906 - protein, 14 aa, Mycobacterium tuberculosis
SSGEGLAGVASVGG

SEQ ID NO: 109907 - protein, 14 aa, Mycobacterium tuberculosis
SGEGLAGVASVGGQ

SEQ ID NO: 109908 - protein, 14 aa, Mycobacterium tuberculosis
GEGLAGVASVGGQP

SEQ ID NO: 109909 - protein, 14 aa, Mycobacterium tuberculosis
EGLAGVASVGGQPS

SEQ ID NO: 109910 - protein, 14 aa, Mycobacterium tuberculosis
GLAGVASVGGQPSQ

SEQ ID NO: 109911 - protein, 14 aa, Mycobacterium tuberculosis
LAGVASVGGQPSQA

SEQ ID NO: 109912 - protein, 14 aa, Mycobacterium tuberculosis
AGVASVGGQPSQAT

SEQ ID NO: 109913 - protein, 14 aa, Mycobacterium tuberculosis
GVASVGGQPSQATQ

SEQ ID NO: 109914 - protein, 14 aa, Mycobacterium tuberculosis
VASVGGQPSQATQL

SEQ ID NO: 109915 - protein, 14 aa, Mycobacterium tuberculosis
ASVGGQPSQATQLL

SEQ ID NO: 109916 - protein, 14 aa, Mycobacterium tuberculosis
SVGGQPSQATQLLS

SEQ ID NO: 109917 - protein, 14 aa, Mycobacterium tuberculosis
VGGQPSQATQLLST

SEQ ID NO: 109918 - protein, 14 aa, Mycobacterium tuberculosis
GGQPSQATQLLSTP

SEQ ID NO: 109919 - protein, 14 aa, Mycobacterium tuberculosis
GQPSQATQLLSTPV

SEQ ID NO: 109920 - protein, 14 aa, Mycobacterium tuberculosis
QPSQATQLLSTPVS

SEQ ID NO: 109921 - protein, 14 aa, Mycobacterium tuberculosis
PSQATQLLSTPVSQ

SEQ ID NO: 109922 - protein, 14 aa, Mycobacterium tuberculosis
SQATQLLSTPVSQV

SEQ ID NO: 109923 - protein, 14 aa, Mycobacterium tuberculosis
QATQLLSTPVSQVT

SEQ ID NO: 109924 - protein, 14 aa, Mycobacterium tuberculosis
ATQLLSTPVSQVTT

SEQ ID NO: 109925 - protein, 14 aa, Mycobacterium tuberculosis
TQLLSTPVSQVTTQ

SEQ ID NO: 109926 - protein, 14 aa, Mycobacterium tuberculosis
QLLSTPVSQVTTQL

SEQ ID NO: 109927 - protein, 14 aa, Mycobacterium tuberculosis
LLSTPVSQVTTQLG

SEQ ID NO: 109928 - protein, 14 aa, Mycobacterium tuberculosis
LSTPVSQVTTQLGE

SEQ ID NO: 109929 - protein, 14 aa, Mycobacterium tuberculosis
STPVSQVTTQLGET

SEQ ID NO: 109930 - protein, 14 aa, Mycobacterium tuberculosis
TPVSQVTTQLGETA

SEQ ID NO: 109931 - protein, 14 aa, Mycobacterium tuberculosis
PVSQVTTQLGETAA

SEQ ID NO: 109932 - protein, 14 aa, Mycobacterium tuberculosis
VSQVTTQLGETAAE

SEQ ID NO: 109933 - protein, 14 aa, Mycobacterium tuberculosis
SQVTTQLGETAAEL

SEQ ID NO: 109934 - protein, 14 aa, Mycobacterium tuberculosis
QVTTQLGETAAELA

SEQ ID NO: 109935 - protein, 14 aa, Mycobacterium tuberculosis
VTTQLGETAAELAP

SEQ ID NO: 109936 - protein, 14 aa, Mycobacterium tuberculosis
TTQLGETAAELAPR

SEQ ID NO: 109937 - protein, 14 aa, Mycobacterium tuberculosis
TQLGETAAELAPRV

SEQ ID NO: 109938 - protein, 14 aa, Mycobacterium tuberculosis
QLGETAAELAPRVV

SEQ ID NO: 109939 - protein, 14 aa, Mycobacterium tuberculosis
LGETAAELAPRVVA

SEQ ID NO: 109940 - protein, 14 aa, Mycobacterium tuberculosis
GETAAELAPRVVAT

SEQ ID NO: 109941 - protein, 14 aa, Mycobacterium tuberculosis
ETAAELAPRVVATV

SEQ ID NO: 109942 - protein, 14 aa, Mycobacterium tuberculosis
TAAELAPRVVATVP

SEQ ID NO: 109943 - protein, 14 aa, Mycobacterium tuberculosis
AAELAPRVVATVPQ

SEQ ID NO: 109944 - protein, 14 aa, Mycobacterium tuberculosis
AELAPRVVATVPQL

SEQ ID NO: 109945 - protein, 14 aa, Mycobacterium tuberculosis
ELAPRVVATVPQLV

SEQ ID NO: 109946 - protein, 14 aa, Mycobacterium tuberculosis
LAPRVVATVPQLVQ

SEQ ID NO: 109947 - protein, 14 aa, Mycobacterium tuberculosis
APRVVATVPQLVQL

SEQ ID NO: 109948 - protein, 14 aa, Mycobacterium tuberculosis
PRVVATVPQLVQLA

SEQ ID NO: 109949 - protein, 14 aa, Mycobacterium tuberculosis
RVVATVPQLVQLAP

SEQ ID NO: 109950 - protein, 14 aa, Mycobacterium tuberculosis
VVATVPQLVQLAPH

SEQ ID NO: 109951 - protein, 14 aa, Mycobacterium tuberculosis
VATVPQLVQLAPHA

SEQ ID NO: 109952 - protein, 14 aa, Mycobacterium tuberculosis
ATVPQLVQLAPHAV

SEQ ID NO: 109953 - protein, 14 aa, Mycobacterium tuberculosis
TVPQLVQLAPHAVQ

SEQ ID NO: 109954 - protein, 14 aa, Mycobacterium tuberculosis
VPQLVQLAPHAVQM

SEQ ID NO: 109955 - protein, 14 aa, Mycobacterium tuberculosis
PQLVQLAPHAVQMS

SEQ ID NO: 109956 - protein, 14 aa, Mycobacterium tuberculosis
QLVQLAPHAVQMSQ

SEQ ID NO: 109957 - protein, 14 aa, Mycobacterium tuberculosis
LVQLAPHAVQMSQN

SEQ ID NO: 109958 - protein, 14 aa, Mycobacterium tuberculosis
VQLAPHAVQMSQNA

SEQ ID NO: 109959 - protein, 14 aa, Mycobacterium tuberculosis
QLAPHAVQMSQNAS

SEQ ID NO: 109960 - protein, 14 aa, Mycobacterium tuberculosis
LAPHAVQMSQNASP

SEQ ID NO: 109961 - protein, 14 aa, Mycobacterium tuberculosis
APHAVQMSQNASPI

SEQ ID NO: 109962 - protein, 14 aa, Mycobacterium tuberculosis
PHAVQMSQNASPIA

SEQ ID NO: 109963 - protein, 14 aa, Mycobacterium tuberculosis
HAVQMSQNASPIAQ

SEQ ID NO: 109964 - protein, 14 aa, Mycobacterium tuberculosis
AVQMSQNASPIAQT

SEQ ID NO: 109965 - protein, 14 aa, Mycobacterium tuberculosis
VQMSQNASPIAQTI

SEQ ID NO: 109966 - protein, 14 aa, Mycobacterium tuberculosis
QMSQNASPIAQTIS

SEQ ID NO: 109967 - protein, 14 aa, Mycobacterium tuberculosis
MSQNASPIAQTISQ

SEQ ID NO: 109968 - protein, 14 aa, Mycobacterium tuberculosis
SQNASPIAQTISQT

SEQ ID NO: 109969 - protein, 14 aa, Mycobacterium tuberculosis
QNASPIAQTISQTA

SEQ ID NO: 109970 - protein, 14 aa, Mycobacterium tuberculosis
NASPIAQTISQTAQ

SEQ ID NO: 109971 - protein, 14 aa, Mycobacterium tuberculosis
ASPIAQTISQTAQQ

SEQ ID NO: 109972 - protein, 14 aa, Mycobacterium tuberculosis
SPIAQTISQTAQQA

SEQ ID NO: 109973 - protein, 14 aa, Mycobacterium tuberculosis
PIAQTISQTAQQAA

SEQ ID NO: 109974 - protein, 14 aa, Mycobacterium tuberculosis
IAQTISQTAQQAAQ

SEQ ID NO: 109975 - protein, 14 aa, Mycobacterium tuberculosis
AQTISQTAQQAAQS

SEQ ID NO: 109976 - protein, 14 aa, Mycobacterium tuberculosis
QTISQTAQQAAQSA

SEQ ID NO: 109977 - protein, 14 aa, Mycobacterium tuberculosis
TISQTAQQAAQSAQ

SEQ ID NO: 109978 - protein, 14 aa, Mycobacterium tuberculosis
ISQTAQQAAQSAQG

SEQ ID NO: 109979 - protein, 14 aa, Mycobacterium tuberculosis
SQTAQQAAQSAQGG

SEQ ID NO: 109980 - protein, 14 aa, Mycobacterium tuberculosis
QTAQQAAQSAQGGS

SEQ ID NO: 109981 - protein, 14 aa, Mycobacterium tuberculosis
TAQQAAQSAQGGSG

SEQ ID NO: 109982 - protein, 14 aa, Mycobacterium tuberculosis
AQQAAQSAQGGSGP

SEQ ID NO: 109983 - protein, 14 aa, Mycobacterium tuberculosis
QQAAQSAQGGSGPM

SEQ ID NO: 109984 - protein, 14 aa, Mycobacterium tuberculosis
QAAQSAQGGSGPMP

SEQ ID NO: 109985 - protein, 14 aa, Mycobacterium tuberculosis
AAQSAQGGSGPMPA

SEQ ID NO: 109986 - protein, 14 aa, Mycobacterium tuberculosis
AQSAQGGSGPMPAQ

SEQ ID NO: 109987 - protein, 14 aa, Mycobacterium tuberculosis
QSAQGGSGPMPAQL

SEQ ID NO: 109988 - protein, 14 aa, Mycobacterium tuberculosis
SAQGGSGPMPAQLA

SEQ ID NO: 109989 - protein, 14 aa, Mycobacterium tuberculosis
AQGGSGPMPAQLAS

SEQ ID NO: 109990 - protein, 14 aa, Mycobacterium tuberculosis
QGGSGPMPAQLASA

SEQ ID NO: 109991 - protein, 14 aa, Mycobacterium tuberculosis
GGSGPMPAQLASAE

SEQ ID NO: 109992 - protein, 14 aa, Mycobacterium tuberculosis
GSGPMPAQLASAEK

SEQ ID NO: 109993 - protein, 14 aa, Mycobacterium tuberculosis
SGPMPAQLASAEKP

SEQ ID NO: 109994 - protein, 14 aa, Mycobacterium tuberculosis
GPMPAQLASAEKPA

SEQ ID NO: 109995 - protein, 14 aa, Mycobacterium tuberculosis
PMPAQLASAEKPAT

SEQ ID NO: 109996 - protein, 14 aa, Mycobacterium tuberculosis
MPAQLASAEKPATE

SEQ ID NO: 109997 - protein, 14 aa, Mycobacterium tuberculosis
PAQLASAEKPATEQ

SEQ ID NO: 109998 - protein, 14 aa, Mycobacterium tuberculosis
AQLASAEKPATEQA

SEQ ID NO: 109999 - protein, 14 aa, Mycobacterium tuberculosis
QLASAEKPATEQAE

SEQ ID NO: 110000 - protein, 14 aa, Mycobacterium tuberculosis
LASAEKPATEQAEP

SEQ ID NO: 110001 - protein, 14 aa, Mycobacterium tuberculosis
ASAEKPATEQAEPV

SEQ ID NO: 110002 - protein, 14 aa, Mycobacterium tuberculosis
SAEKPATEQAEPVH

SEQ ID NO: 110003 - protein, 14 aa, Mycobacterium tuberculosis
AEKPATEQAEPVHE

SEQ ID NO: 110004 - protein, 14 aa, Mycobacterium tuberculosis
EKPATEQAEPVHEV

SEQ ID NO: 110005 - protein, 14 aa, Mycobacterium tuberculosis
KPATEQAEPVHEVT

SEQ ID NO: 110006 - protein, 14 aa, Mycobacterium tuberculosis
PATEQAEPVHEVTN

SEQ ID NO: 110007 - protein, 14 aa, Mycobacterium tuberculosis
ATEQAEPVHEVTND

SEQ ID NO: 110008 - protein, 14 aa, Mycobacterium tuberculosis
TEQAEPVHEVTNDD

SEQ ID NO: 110009 - protein, 14 aa, Mycobacterium tuberculosis
EQAEPVHEVTNDDQ

SEQ ID NO: 110010 - protein, 14 aa, Mycobacterium tuberculosis
QAEPVHEVTNDDQG

SEQ ID NO: 110011 - protein, 14 aa, Mycobacterium tuberculosis
AEPVHEVTNDDQGD

SEQ ID NO: 110012 - protein, 14 aa, Mycobacterium tuberculosis
EPVHEVTNDDQGDQ

SEQ ID NO: 110013 - protein, 14 aa, Mycobacterium tuberculosis
PVHEVTNDDQGDQG

SEQ ID NO: 110014 - protein, 14 aa, Mycobacterium tuberculosis
VHEVTNDDQGDQGD

SEQ ID NO: 110015 - protein, 14 aa, Mycobacterium tuberculosis
HEVTNDDQGDQGDV

SEQ ID NO: 110016 - protein, 14 aa, Mycobacterium tuberculosis
EVTNDDQGDQGDVQ

SEQ ID NO: 110017 - protein, 14 aa, Mycobacterium tuberculosis
VTNDDQGDQGDVQP

SEQ ID NO: 110018 - protein, 14 aa, Mycobacterium tuberculosis
TNDDQGDQGDVQPA

SEQ ID NO: 110019 - protein, 14 aa, Mycobacterium tuberculosis
NDDQGDQGDVQPAE

SEQ ID NO: 110020 - protein, 14 aa, Mycobacterium tuberculosis
DDQGDQGDVQPAEV

SEQ ID NO: 110021 - protein, 14 aa, Mycobacterium tuberculosis
DQGDQGDVQPAEVV

SEQ ID NO: 110022 - protein, 14 aa, Mycobacterium tuberculosis
QGDQGDVQPAEVVA

SEQ ID NO: 110023 - protein, 14 aa, Mycobacterium tuberculosis
GDQGDVQPAEVVAA

SEQ ID NO: 110024 - protein, 14 aa, Mycobacterium tuberculosis
DQGDVQPAEVVAAA

SEQ ID NO: 110025 - protein, 14 aa, Mycobacterium tuberculosis
QGDVQPAEVVAAAR

SEQ ID NO: 110026 - protein, 14 aa, Mycobacterium tuberculosis
GDVQPAEVVAAARD

SEQ ID NO: 110027 - protein, 14 aa, Mycobacterium tuberculosis
DVQPAEVVAAARDE

SEQ ID NO: 110028 - protein, 14 aa, Mycobacterium tuberculosis
VQPAEVVAAARDEG

SEQ ID NO: 110029 - protein, 14 aa, Mycobacterium tuberculosis
QPAEVVAAARDEGA

SEQ ID NO: 110030 - protein, 14 aa, Mycobacterium tuberculosis
PAEVVAAARDEGAG

SEQ ID NO: 110031 - protein, 14 aa, Mycobacterium tuberculosis
AEVVAAARDEGAGA

SEQ ID NO: 110032 - protein, 14 aa, Mycobacterium tuberculosis
EVVAAARDEGAGAS

SEQ ID NO: 110033 - protein, 14 aa, Mycobacterium tuberculosis
VVAAARDEGAGASP

SEQ ID NO: 110034 - protein, 14 aa, Mycobacterium tuberculosis
VAAARDEGAGASPG

SEQ ID NO: 110035 - protein, 14 aa, Mycobacterium tuberculosis
AAARDEGAGASPGQ

SEQ ID NO: 110036 - protein, 14 aa, Mycobacterium tuberculosis
AARDEGAGASPGQQ

SEQ ID NO: 110037 - protein, 14 aa, Mycobacterium tuberculosis
ARDEGAGASPGQQP

SEQ ID NO: 110038 - protein, 14 aa, Mycobacterium tuberculosis
RDEGAGASPGQQPG

SEQ ID NO: 110039 - protein, 14 aa, Mycobacterium tuberculosis
DEGAGASPGQQPGG

SEQ ID NO: 110040 - protein, 14 aa, Mycobacterium tuberculosis
EGAGASPGQQPGGG

SEQ ID NO: 110041 - protein, 14 aa, Mycobacterium tuberculosis
GAGASPGQQPGGGV

SEQ ID NO: 110042 - protein, 14 aa, Mycobacterium tuberculosis
AGASPGQQPGGGVP

SEQ ID NO: 110043 - protein, 14 aa, Mycobacterium tuberculosis
GASPGQQPGGGVPA

SEQ ID NO: 110044 - protein, 14 aa, Mycobacterium tuberculosis
ASPGQQPGGGVPAQ

SEQ ID NO: 110045 - protein, 14 aa, Mycobacterium tuberculosis
SPGQQPGGGVPAQA

SEQ ID NO: 110046 - protein, 14 aa, Mycobacterium tuberculosis
PGQQPGGGVPAQAM

SEQ ID NO: 110047 - protein, 14 aa, Mycobacterium tuberculosis
GQQPGGGVPAQAMD

SEQ ID NO: 110048 - protein, 14 aa, Mycobacterium tuberculosis
QQPGGGVPAQAMDT

SEQ ID NO: 110049 - protein, 14 aa, Mycobacterium tuberculosis
QPGGGVPAQAMDTG

SEQ ID NO: 110050 - protein, 14 aa, Mycobacterium tuberculosis
PGGGVPAQAMDTGA

SEQ ID NO: 110051 - protein, 14 aa, Mycobacterium tuberculosis
GGGVPAQAMDTGAG

SEQ ID NO: 110052 - protein, 14 aa, Mycobacterium tuberculosis
GGVPAQAMDTGAGA

SEQ ID NO: 110053 - protein, 14 aa, Mycobacterium tuberculosis
GVPAQAMDTGAGAR

SEQ ID NO: 110054 - protein, 14 aa, Mycobacterium tuberculosis
VPAQAMDTGAGARP

SEQ ID NO: 110055 - protein, 14 aa, Mycobacterium tuberculosis
PAQAMDTGAGARPA

SEQ ID NO: 110056 - protein, 14 aa, Mycobacterium tuberculosis
AQAMDTGAGARPAA

SEQ ID NO: 110057 - protein, 14 aa, Mycobacterium tuberculosis
QAMDTGAGARPAAS

SEQ ID NO: 110058 - protein, 14 aa, Mycobacterium tuberculosis
AMDTGAGARPAASP

SEQ ID NO: 110059 - protein, 14 aa, Mycobacterium tuberculosis
MDTGAGARPAASPL

SEQ ID NO: 110060 - protein, 14 aa, Mycobacterium tuberculosis
DTGAGARPAASPLA

SEQ ID NO: 110061 - protein, 14 aa, Mycobacterium tuberculosis
TGAGARPAASPLAA

SEQ ID NO: 110062 - protein, 14 aa, Mycobacterium tuberculosis
GAGARPAASPLAAP

SEQ ID NO: 110063 - protein, 14 aa, Mycobacterium tuberculosis
AGARPAASPLAAPV

SEQ ID NO: 110064 - protein, 14 aa, Mycobacterium tuberculosis
GARPAASPLAAPVD

SEQ ID NO: 110065 - protein, 14 aa, Mycobacterium tuberculosis
ARPAASPLAAPVDP

SEQ ID NO: 110066 - protein, 14 aa, Mycobacterium tuberculosis
RPAASPLAAPVDPS

SEQ ID NO: 110067 - protein, 14 aa, Mycobacterium tuberculosis
PAASPLAAPVDPST

SEQ ID NO: 110068 - protein, 14 aa, Mycobacterium tuberculosis
AASPLAAPVDPSTP

SEQ ID NO: 110069 - protein, 14 aa, Mycobacterium tuberculosis
ASPLAAPVDPSTPA

SEQ ID NO: 110070 - protein, 14 aa, Mycobacterium tuberculosis
SPLAAPVDPSTPAP

SEQ ID NO: 110071 - protein, 14 aa, Mycobacterium tuberculosis
PLAAPVDPSTPAPS

SEQ ID NO: 110072 - protein, 14 aa, Mycobacterium tuberculosis
LAAPVDPSTPAPST

SEQ ID NO: 110073 - protein, 14 aa, Mycobacterium tuberculosis
AAPVDPSTPAPSTT

SEQ ID NO: 110074 - protein, 14 aa, Mycobacterium tuberculosis
APVDPSTPAPSTTT

SEQ ID NO: 110075 - protein, 14 aa, Mycobacterium tuberculosis
PVDPSTPAPSTTTT

SEQ ID NO: 110076 - protein, 14 aa, Mycobacterium tuberculosis
VDPSTPAPSTTTTL

SEQ ID NO: 110077 - protein, 15 aa, Mycobacterium tuberculosis
MAEPLAVDPTGLSAA

SEQ ID NO: 110078 - protein, 15 aa, Mycobacterium tuberculosis
AEPLAVDPTGLSAAA

SEQ ID NO: 110079 - protein, 15 aa, Mycobacterium tuberculosis
EPLAVDPTGLSAAAA

SEQ ID NO: 110080 - protein, 15 aa, Mycobacterium tuberculosis
PLAVDPTGLSAAAAK

SEQ ID NO: 110081 - protein, 15 aa, Mycobacterium tuberculosis
LAVDPTGLSAAAAKL

SEQ ID NO: 110082 - protein, 15 aa, Mycobacterium tuberculosis
AVDPTGLSAAAAKLA

SEQ ID NO: 110083 - protein, 15 aa, Mycobacterium tuberculosis
VDPTGLSAAAAKLAG

SEQ ID NO: 110084 - protein, 15 aa, Mycobacterium tuberculosis
DPTGLSAAAAKLAGL

SEQ ID NO: 110085 - protein, 15 aa, Mycobacterium tuberculosis
PTGLSAAAAKLAGLV

SEQ ID NO: 110086 - protein, 15 aa, Mycobacterium tuberculosis
TGLSAAAAKLAGLVF

SEQ ID NO: 110087 - protein, 15 aa, Mycobacterium tuberculosis
GLSAAAAKLAGLVFP

SEQ ID NO: 110088 - protein, 15 aa, Mycobacterium tuberculosis
LSAAAAKLAGLVFPQ

SEQ ID NO: 110089 - protein, 15 aa, Mycobacterium tuberculosis
SAAAAKLAGLVFPQP

SEQ ID NO: 110090 - protein, 15 aa, Mycobacterium tuberculosis
AAAAKLAGLVFPQPP

SEQ ID NO: 110091 - protein, 15 aa, Mycobacterium tuberculosis
AAAKLAGLVFPQPPA

SEQ ID NO: 110092 - protein, 15 aa, Mycobacterium tuberculosis
AAKLAGLVFPQPPAP

SEQ ID NO: 110093 - protein, 15 aa, Mycobacterium tuberculosis
AKLAGLVFPQPPAPI

SEQ ID NO: 110094 - protein, 15 aa, Mycobacterium tuberculosis
KLAGLVFPQPPAPIA

SEQ ID NO: 110095 - protein, 15 aa, Mycobacterium tuberculosis
LAGLVFPQPPAPIAV

SEQ ID NO: 110096 - protein, 15 aa, Mycobacterium tuberculosis
AGLVFPQPPAPIAVS

SEQ ID NO: 110097 - protein, 15 aa, Mycobacterium tuberculosis
GLVFPQPPAPIAVSG

SEQ ID NO: 110098 - protein, 15 aa, Mycobacterium tuberculosis
LVFPQPPAPIAVSGT

SEQ ID NO: 110099 - protein, 15 aa, Mycobacterium tuberculosis
VFPQPPAPIAVSGTD

SEQ ID NO: 110100 - protein, 15 aa, Mycobacterium tuberculosis
FPQPPAPIAVSGTDS

SEQ ID NO: 110101 - protein, 15 aa, Mycobacterium tuberculosis
PQPPAPIAVSGTDSV

SEQ ID NO: 110102 - protein, 15 aa, Mycobacterium tuberculosis
QPPAPIAVSGTDSVV

SEQ ID NO: 110103 - protein, 15 aa, Mycobacterium tuberculosis
PPAPIAVSGTDSVVA

SEQ ID NO: 110104 - protein, 15 aa, Mycobacterium tuberculosis
PAPIAVSGTDSVVAA

SEQ ID NO: 110105 - protein, 15 aa, Mycobacterium tuberculosis
APIAVSGTDSVVAAI

SEQ ID NO: 110106 - protein, 15 aa, Mycobacterium tuberculosis
PIAVSGTDSVVAAIN

SEQ ID NO: 110107 - protein, 15 aa, Mycobacterium tuberculosis
IAVSGTDSVVAAINE

SEQ ID NO: 110108 - protein, 15 aa, Mycobacterium tuberculosis
AVSGTDSVVAAINET

SEQ ID NO: 110109 - protein, 15 aa, Mycobacterium tuberculosis
VSGTDSVVAAINETM

SEQ ID NO: 110110 - protein, 15 aa, Mycobacterium tuberculosis
SGTDSVVAAINETMP

SEQ ID NO: 110111 - protein, 15 aa, Mycobacterium tuberculosis
GTDSVVAAINETMPS

SEQ ID NO: 110112 - protein, 15 aa, Mycobacterium tuberculosis
TDSVVAAINETMPSI

SEQ ID NO: 110113 - protein, 15 aa, Mycobacterium tuberculosis
DSVVAAINETMPSIE

SEQ ID NO: 110114 - protein, 15 aa, Mycobacterium tuberculosis
SVVAAINETMPSIES

SEQ ID NO: 110115 - protein, 15 aa, Mycobacterium tuberculosis
VVAAINETMPSIESL

SEQ ID NO: 110116 - protein, 15 aa, Mycobacterium tuberculosis
VAAINETMPSIESLV

SEQ ID NO: 110117 - protein, 15 aa, Mycobacterium tuberculosis
AAINETMPSIESLVS

SEQ ID NO: 110118 - protein, 15 aa, Mycobacterium tuberculosis
AINETMPSIESLVSD

SEQ ID NO: 110119 - protein, 15 aa, Mycobacterium tuberculosis
INETMPSIESLVSDG

SEQ ID NO: 110120 - protein, 15 aa, Mycobacterium tuberculosis
NETMPSIESLVSDGL

SEQ ID NO: 110121 - protein, 15 aa, Mycobacterium tuberculosis
ETMPSIESLVSDGLP

SEQ ID NO: 110122 - protein, 15 aa, Mycobacterium tuberculosis
TMPSIESLVSDGLPG

SEQ ID NO: 110123 - protein, 15 aa, Mycobacterium tuberculosis
MPSIESLVSDGLPGV

SEQ ID NO: 110124 - protein, 15 aa, Mycobacterium tuberculosis
PSIESLVSDGLPGVK

SEQ ID NO: 110125 - protein, 15 aa, Mycobacterium tuberculosis
SIESLVSDGLPGVKA

SEQ ID NO: 110126 - protein, 15 aa, Mycobacterium tuberculosis
IESLVSDGLPGVKAA

SEQ ID NO: 110127 - protein, 15 aa, Mycobacterium tuberculosis
ESLVSDGLPGVKAAL

SEQ ID NO: 110128 - protein, 15 aa, Mycobacterium tuberculosis
SLVSDGLPGVKAALT

SEQ ID NO: 110129 - protein, 15 aa, Mycobacterium tuberculosis
LVSDGLPGVKAALTR

SEQ ID NO: 110130 - protein, 15 aa, Mycobacterium tuberculosis
VSDGLPGVKAALTRT

SEQ ID NO: 110131 - protein, 15 aa, Mycobacterium tuberculosis
SDGLPGVKAALTRTA

SEQ ID NO: 110132 - protein, 15 aa, Mycobacterium tuberculosis
DGLPGVKAALTRTAS

SEQ ID NO: 110133 - protein, 15 aa, Mycobacterium tuberculosis
GLPGVKAALTRTASN

SEQ ID NO: 110134 - protein, 15 aa, Mycobacterium tuberculosis
LPGVKAALTRTASNM

SEQ ID NO: 110135 - protein, 15 aa, Mycobacterium tuberculosis
PGVKAALTRTASNMN

SEQ ID NO: 110136 - protein, 15 aa, Mycobacterium tuberculosis
GVKAALTRTASNMNA

SEQ ID NO: 110137 - protein, 15 aa, Mycobacterium tuberculosis
VKAALTRTASNMNAA

SEQ ID NO: 110138 - protein, 15 aa, Mycobacterium tuberculosis
KAALTRTASNMNAAA

SEQ ID NO: 110139 - protein, 15 aa, Mycobacterium tuberculosis
AALTRTASNMNAAAD

SEQ ID NO: 110140 - protein, 15 aa, Mycobacterium tuberculosis
ALTRTASNMNAAADV

SEQ ID NO: 110141 - protein, 15 aa, Mycobacterium tuberculosis
LTRTASNMNAAADVY

SEQ ID NO: 110142 - protein, 15 aa, Mycobacterium tuberculosis
TRTASNMNAAADVYA

SEQ ID NO: 110143 - protein, 15 aa, Mycobacterium tuberculosis
RTASNMNAAADVYAK

SEQ ID NO: 110144 - protein, 15 aa, Mycobacterium tuberculosis
TASNMNAAADVYAKT

SEQ ID NO: 110145 - protein, 15 aa, Mycobacterium tuberculosis
ASNMNAAADVYAKTD

SEQ ID NO: 110146 - protein, 15 aa, Mycobacterium tuberculosis
SNMNAAADVYAKTDQ

SEQ ID NO: 110147 - protein, 15 aa, Mycobacterium tuberculosis
NMNAAADVYAKTDQS

SEQ ID NO: 110148 - protein, 15 aa, Mycobacterium tuberculosis
MNAAADVYAKTDQSL

SEQ ID NO: 110149 - protein, 15 aa, Mycobacterium tuberculosis
NAAADVYAKTDQSLG

SEQ ID NO: 110150 - protein, 15 aa, Mycobacterium tuberculosis
AAADVYAKTDQSLGT

SEQ ID NO: 110151 - protein, 15 aa, Mycobacterium tuberculosis
AADVYAKTDQSLGTS

SEQ ID NO: 110152 - protein, 15 aa, Mycobacterium tuberculosis
ADVYAKTDQSLGTSL

SEQ ID NO: 110153 - protein, 15 aa, Mycobacterium tuberculosis
DVYAKTDQSLGTSLS

SEQ ID NO: 110154 - protein, 15 aa, Mycobacterium tuberculosis
VYAKTDQSLGTSLSQ

SEQ ID NO: 110155 - protein, 15 aa, Mycobacterium tuberculosis
YAKTDQSLGTSLSQY

SEQ ID NO: 110156 - protein, 15 aa, Mycobacterium tuberculosis
AKTDQSLGTSLSQYA

SEQ ID NO: 110157 - protein, 15 aa, Mycobacterium tuberculosis
KTDQSLGTSLSQYAF

SEQ ID NO: 110158 - protein, 15 aa, Mycobacterium tuberculosis
TDQSLGTSLSQYAFG

SEQ ID NO: 110159 - protein, 15 aa, Mycobacterium tuberculosis
DQSLGTSLSQYAFGS

SEQ ID NO: 110160 - protein, 15 aa, Mycobacterium tuberculosis
QSLGTSLSQYAFGSS

SEQ ID NO: 110161 - protein, 15 aa, Mycobacterium tuberculosis
SLGTSLSQYAFGSSG

SEQ ID NO: 110162 - protein, 15 aa, Mycobacterium tuberculosis
LGTSLSQYAFGSSGE

SEQ ID NO: 110163 - protein, 15 aa, Mycobacterium tuberculosis
GTSLSQYAFGSSGEG

SEQ ID NO: 110164 - protein, 15 aa, Mycobacterium tuberculosis
TSLSQYAFGSSGEGL

SEQ ID NO: 110165 - protein, 15 aa, Mycobacterium tuberculosis
SLSQYAFGSSGEGLA

SEQ ID NO: 110166 - protein, 15 aa, Mycobacterium tuberculosis
LSQYAFGSSGEGLAG

SEQ ID NO: 110167 - protein, 15 aa, Mycobacterium tuberculosis
SQYAFGSSGEGLAGV

SEQ ID NO: 110168 - protein, 15 aa, Mycobacterium tuberculosis
QYAFGSSGEGLAGVA

SEQ ID NO: 110169 - protein, 15 aa, Mycobacterium tuberculosis
YAFGSSGEGLAGVAS

SEQ ID NO: 110170 - protein, 15 aa, Mycobacterium tuberculosis
AFGSSGEGLAGVASV

SEQ ID NO: 110171 - protein, 15 aa, Mycobacterium tuberculosis
FGSSGEGLAGVASVG

SEQ ID NO: 110172 - protein, 15 aa, Mycobacterium tuberculosis
GSSGEGLAGVASVGG

SEQ ID NO: 110173 - protein, 15 aa, Mycobacterium tuberculosis
SSGEGLAGVASVGGQ

SEQ ID NO: 110174 - protein, 15 aa, Mycobacterium tuberculosis
SGEGLAGVASVGGQP

SEQ ID NO: 110175 - protein, 15 aa, Mycobacterium tuberculosis
GEGLAGVASVGGQPS

SEQ ID NO: 110176 - protein, 15 aa, Mycobacterium tuberculosis
EGLAGVASVGGQPSQ

SEQ ID NO: 110177 - protein, 15 aa, Mycobacterium tuberculosis
GLAGVASVGGQPSQA

SEQ ID NO: 110178 - protein, 15 aa, Mycobacterium tuberculosis
LAGVASVGGQPSQAT

SEQ ID NO: 110179 - protein, 15 aa, Mycobacterium tuberculosis
AGVASVGGQPSQATQ

SEQ ID NO: 110180 - protein, 15 aa, Mycobacterium tuberculosis
GVASVGGQPSQATQL

SEQ ID NO: 110181 - protein, 15 aa, Mycobacterium tuberculosis
VASVGGQPSQATQLL

SEQ ID NO: 110182 - protein, 15 aa, Mycobacterium tuberculosis
ASVGGQPSQATQLLS

SEQ ID NO: 110183 - protein, 15 aa, Mycobacterium tuberculosis
SVGGQPSQATQLLST

SEQ ID NO: 110184 - protein, 15 aa, Mycobacterium tuberculosis
VGGQPSQATQLLSTP

SEQ ID NO: 110185 - protein, 15 aa, Mycobacterium tuberculosis
GGQPSQATQLLSTPV

SEQ ID NO: 110186 - protein, 15 aa, Mycobacterium tuberculosis
GQPSQATQLLSTPVS

SEQ ID NO: 110187 - protein, 15 aa, Mycobacterium tuberculosis
QPSQATQLLSTPVSQ

SEQ ID NO: 110188 - protein, 15 aa, Mycobacterium tuberculosis
PSQATQLLSTPVSQV

SEQ ID NO: 110189 - protein, 15 aa, Mycobacterium tuberculosis
SQATQLLSTPVSQVT

SEQ ID NO: 110190 - protein, 15 aa, Mycobacterium tuberculosis
QATQLLSTPVSQVTT

SEQ ID NO: 110191 - protein, 15 aa, Mycobacterium tuberculosis
ATQLLSTPVSQVTTQ

SEQ ID NO: 110192 - protein, 15 aa, Mycobacterium tuberculosis
TQLLSTPVSQVTTQL

SEQ ID NO: 110193 - protein, 15 aa, Mycobacterium tuberculosis
QLLSTPVSQVTTQLG

SEQ ID NO: 110194 - protein, 15 aa, Mycobacterium tuberculosis
LLSTPVSQVTTQLGE

SEQ ID NO: 110195 - protein, 15 aa, Mycobacterium tuberculosis
LSTPVSQVTTQLGET

SEQ ID NO: 110196 - protein, 15 aa, Mycobacterium tuberculosis
STPVSQVTTQLGETA

SEQ ID NO: 110197 - protein, 15 aa, Mycobacterium tuberculosis
TPVSQVTTQLGETAA

SEQ ID NO: 110198 - protein, 15 aa, Mycobacterium tuberculosis
PVSQVTTQLGETAAE

SEQ ID NO: 110199 - protein, 15 aa, Mycobacterium tuberculosis
VSQVTTQLGETAAEL

SEQ ID NO: 110200 - protein, 15 aa, Mycobacterium tuberculosis
SQVTTQLGETAAELA

SEQ ID NO: 110201 - protein, 15 aa, Mycobacterium tuberculosis
QVTTQLGETAAELAP

SEQ ID NO: 110202 - protein, 15 aa, Mycobacterium tuberculosis
VTTQLGETAAELAPR

SEQ ID NO: 110203 - protein, 15 aa, Mycobacterium tuberculosis
TTQLGETAAELAPRV

SEQ ID NO: 110204 - protein, 15 aa, Mycobacterium tuberculosis
TQLGETAAELAPRVV

SEQ ID NO: 110205 - protein, 15 aa, Mycobacterium tuberculosis
QLGETAAELAPRVVA

SEQ ID NO: 110206 - protein, 15 aa, Mycobacterium tuberculosis
LGETAAELAPRVVAT

SEQ ID NO: 110207 - protein, 15 aa, Mycobacterium tuberculosis
GETAAELAPRVVATV

SEQ ID NO: 110208 - protein, 15 aa, Mycobacterium tuberculosis
ETAAELAPRVVATVP

SEQ ID NO: 110209 - protein, 15 aa, Mycobacterium tuberculosis
TAAELAPRVVATVPQ

SEQ ID NO: 110210 - protein, 15 aa, Mycobacterium tuberculosis
AAELAPRVVATVPQL

SEQ ID NO: 110211 - protein, 15 aa, Mycobacterium tuberculosis
AELAPRVVATVPQLV

SEQ ID NO: 110212 - protein, 15 aa, Mycobacterium tuberculosis
ELAPRVVATVPQLVQ

SEQ ID NO: 110213 - protein, 15 aa, Mycobacterium tuberculosis
LAPRVVATVPQLVQL

SEQ ID NO: 110214 - protein, 15 aa, Mycobacterium tuberculosis
APRVVATVPQLVQLA

SEQ ID NO: 110215 - protein, 15 aa, Mycobacterium tuberculosis
PRVVATVPQLVQLAP

SEQ ID NO: 110216 - protein, 15 aa, Mycobacterium tuberculosis
RVVATVPQLVQLAPH

SEQ ID NO: 110217 - protein, 15 aa, Mycobacterium tuberculosis
VVATVPQLVQLAPHA

SEQ ID NO: 110218 - protein, 15 aa, Mycobacterium tuberculosis
VATVPQLVQLAPHAV

SEQ ID NO: 110219 - protein, 15 aa, Mycobacterium tuberculosis
ATVPQLVQLAPHAVQ

SEQ ID NO: 110220 - protein, 15 aa, Mycobacterium tuberculosis
TVPQLVQLAPHAVQM

SEQ ID NO: 110221 - protein, 15 aa, Mycobacterium tuberculosis
VPQLVQLAPHAVQMS

SEQ ID NO: 110222 - protein, 15 aa, Mycobacterium tuberculosis
PQLVQLAPHAVQMSQ

SEQ ID NO: 110223 - protein, 15 aa, Mycobacterium tuberculosis
QLVQLAPHAVQMSQN

SEQ ID NO: 110224 - protein, 15 aa, Mycobacterium tuberculosis
LVQLAPHAVQMSQNA

SEQ ID NO: 110225 - protein, 15 aa, Mycobacterium tuberculosis
VQLAPHAVQMSQNAS

SEQ ID NO: 110226 - protein, 15 aa, Mycobacterium tuberculosis
QLAPHAVQMSQNASP

SEQ ID NO: 110227 - protein, 15 aa, Mycobacterium tuberculosis
LAPHAVQMSQNASPI

SEQ ID NO: 110228 - protein, 15 aa, Mycobacterium tuberculosis
APHAVQMSQNASPIA

SEQ ID NO: 110229 - protein, 15 aa, Mycobacterium tuberculosis
PHAVQMSQNASPIAQ

SEQ ID NO: 110230 - protein, 15 aa, Mycobacterium tuberculosis
HAVQMSQNASPIAQT

SEQ ID NO: 110231 - protein, 15 aa, Mycobacterium tuberculosis
AVQMSQNASPIAQTI

SEQ ID NO: 110232 - protein, 15 aa, Mycobacterium tuberculosis
VQMSQNASPIAQTIS

SEQ ID NO: 110233 - protein, 15 aa, Mycobacterium tuberculosis
QMSQNASPIAQTISQ

SEQ ID NO: 110234 - protein, 15 aa, Mycobacterium tuberculosis
MSQNASPIAQTISQT

SEQ ID NO: 110235 - protein, 15 aa, Mycobacterium tuberculosis
SQNASPIAQTISQTA

SEQ ID NO: 110236 - protein, 15 aa, Mycobacterium tuberculosis
QNASPIAQTISQTAQ

SEQ ID NO: 110237 - protein, 15 aa, Mycobacterium tuberculosis
NASPIAQTISQTAQQ

SEQ ID NO: 110238 - protein, 15 aa, Mycobacterium tuberculosis
ASPIAQTISQTAQQA

SEQ ID NO: 110239 - protein, 15 aa, Mycobacterium tuberculosis
SPIAQTISQTAQQAA

SEQ ID NO: 110240 - protein, 15 aa, Mycobacterium tuberculosis
PIAQTISQTAQQAAQ

SEQ ID NO: 110241 - protein, 15 aa, Mycobacterium tuberculosis
IAQTISQTAQQAAQS

SEQ ID NO: 110242 - protein, 15 aa, Mycobacterium tuberculosis
AQTISQTAQQAAQSA

SEQ ID NO: 110243 - protein, 15 aa, Mycobacterium tuberculosis
QTISQTAQQAAQSAQ

SEQ ID NO: 110244 - protein, 15 aa, Mycobacterium tuberculosis
TISQTAQQAAQSAQG

SEQ ID NO: 110245 - protein, 15 aa, Mycobacterium tuberculosis
ISQTAQQAAQSAQGG

SEQ ID NO: 110246 - protein, 15 aa, Mycobacterium tuberculosis
SQTAQQAAQSAQGGS

SEQ ID NO: 110247 - protein, 15 aa, Mycobacterium tuberculosis
QTAQQAAQSAQGGSG

SEQ ID NO: 110248 - protein, 15 aa, Mycobacterium tuberculosis
TAQQAAQSAQGGSGP

SEQ ID NO: 110249 - protein, 15 aa, Mycobacterium tuberculosis
AQQAAQSAQGGSGPM

SEQ ID NO: 110250 - protein, 15 aa, Mycobacterium tuberculosis
QQAAQSAQGGSGPMP

SEQ ID NO: 110251 - protein, 15 aa, Mycobacterium tuberculosis
QAAQSAQGGSGPMPA

SEQ ID NO: 110252 - protein, 15 aa, Mycobacterium tuberculosis
AAQSAQGGSGPMPAQ

SEQ ID NO: 110253 - protein, 15 aa, Mycobacterium tuberculosis
AQSAQGGSGPMPAQL

SEQ ID NO: 110254 - protein, 15 aa, Mycobacterium tuberculosis
QSAQGGSGPMPAQLA

SEQ ID NO: 110255 - protein, 15 aa, Mycobacterium tuberculosis
SAQGGSGPMPAQLAS

SEQ ID NO: 110256 - protein, 15 aa, Mycobacterium tuberculosis
AQGGSGPMPAQLASA

SEQ ID NO: 110257 - protein, 15 aa, Mycobacterium tuberculosis
QGGSGPMPAQLASAE

SEQ ID NO: 110258 - protein, 15 aa, Mycobacterium tuberculosis
GGSGPMPAQLASAEK

SEQ ID NO: 110259 - protein, 15 aa, Mycobacterium tuberculosis
GSGPMPAQLASAEKP

SEQ ID NO: 110260 - protein, 15 aa, Mycobacterium tuberculosis
SGPMPAQLASAEKPA

SEQ ID NO: 110261 - protein, 15 aa, Mycobacterium tuberculosis
GPMPAQLASAEKPAT

SEQ ID NO: 110262 - protein, 15 aa, Mycobacterium tuberculosis
PMPAQLASAEKPATE

SEQ ID NO: 110263 - protein, 15 aa, Mycobacterium tuberculosis
MPAQLASAEKPATEQ

SEQ ID NO: 110264 - protein, 15 aa, Mycobacterium tuberculosis
PAQLASAEKPATEQA

SEQ ID NO: 110265 - protein, 15 aa, Mycobacterium tuberculosis
AQLASAEKPATEQAE

SEQ ID NO: 110266 - protein, 15 aa, Mycobacterium tuberculosis
QLASAEKPATEQAEP

SEQ ID NO: 110267 - protein, 15 aa, Mycobacterium tuberculosis
LASAEKPATEQAEPV

SEQ ID NO: 110268 - protein, 15 aa, Mycobacterium tuberculosis
ASAEKPATEQAEPVH

SEQ ID NO: 110269 - protein, 15 aa, Mycobacterium tuberculosis
SAEKPATEQAEPVHE

SEQ ID NO: 110270 - protein, 15 aa, Mycobacterium tuberculosis
AEKPATEQAEPVHEV

SEQ ID NO: 110271 - protein, 15 aa, Mycobacterium tuberculosis
EKPATEQAEPVHEVT

SEQ ID NO: 110272 - protein, 15 aa, Mycobacterium tuberculosis
KPATEQAEPVHEVTN

SEQ ID NO: 110273 - protein, 15 aa, Mycobacterium tuberculosis
PATEQAEPVHEVTND

SEQ ID NO: 110274 - protein, 15 aa, Mycobacterium tuberculosis
ATEQAEPVHEVTNDD

SEQ ID NO: 110275 - protein, 15 aa, Mycobacterium tuberculosis
TEQAEPVHEVTNDDQ

SEQ ID NO: 110276 - protein, 15 aa, Mycobacterium tuberculosis
EQAEPVHEVTNDDQG

SEQ ID NO: 110277 - protein, 15 aa, Mycobacterium tuberculosis
QAEPVHEVTNDDQGD

SEQ ID NO: 110278 - protein, 15 aa, Mycobacterium tuberculosis
AEPVHEVTNDDQGDQ

SEQ ID NO: 110279 - protein, 15 aa, Mycobacterium tuberculosis
EPVHEVTNDDQGDQG

SEQ ID NO: 110280 - protein, 15 aa, Mycobacterium tuberculosis
PVHEVTNDDQGDQGD

SEQ ID NO: 110281 - protein, 15 aa, Mycobacterium tuberculosis
VHEVTNDDQGDQGDV

SEQ ID NO: 110282 - protein, 15 aa, Mycobacterium tuberculosis
HEVTNDDQGDQGDVQ

SEQ ID NO: 110283 - protein, 15 aa, Mycobacterium tuberculosis
EVTNDDQGDQGDVQP

SEQ ID NO: 110284 - protein, 15 aa, Mycobacterium tuberculosis
VTNDDQGDQGDVQPA

SEQ ID NO: 110285 - protein, 15 aa, Mycobacterium tuberculosis
TNDDQGDQGDVQPAE

SEQ ID NO: 110286 - protein, 15 aa, Mycobacterium tuberculosis
NDDQGDQGDVQPAEV

SEQ ID NO: 110287 - protein, 15 aa, Mycobacterium tuberculosis
DDQGDQGDVQPAEVV

SEQ ID NO: 110288 - protein, 15 aa, Mycobacterium tuberculosis
DQGDQGDVQPAEVVA

SEQ ID NO: 110289 - protein, 15 aa, Mycobacterium tuberculosis
QGDQGDVQPAEVVAA

SEQ ID NO: 110290 - protein, 15 aa, Mycobacterium tuberculosis
GDQGDVQPAEVVAAA

SEQ ID NO: 110291 - protein, 15 aa, Mycobacterium tuberculosis
DQGDVQPAEVVAAAR

SEQ ID NO: 110292 - protein, 15 aa, Mycobacterium tuberculosis
QGDVQPAEVVAAARD

SEQ ID NO: 110293 - protein, 15 aa, Mycobacterium tuberculosis
GDVQPAEVVAAARDE

SEQ ID NO: 110294 - protein, 15 aa, Mycobacterium tuberculosis
DVQPAEVVAAARDEG

SEQ ID NO: 110295 - protein, 15 aa, Mycobacterium tuberculosis
VQPAEVVAAARDEGA

SEQ ID NO: 110296 - protein, 15 aa, Mycobacterium tuberculosis
QPAEVVAAARDEGAG

SEQ ID NO: 110297 - protein, 15 aa, Mycobacterium tuberculosis
PAEVVAAARDEGAGA

SEQ ID NO: 110298 - protein, 15 aa, Mycobacterium tuberculosis
AEVVAAARDEGAGAS

SEQ ID NO: 110299 - protein, 15 aa, Mycobacterium tuberculosis
EVVAAARDEGAGASP

SEQ ID NO: 110300 - protein, 15 aa, Mycobacterium tuberculosis
VVAAARDEGAGASPG

SEQ ID NO: 110301 - protein, 15 aa, Mycobacterium tuberculosis
VAAARDEGAGASPGQ

SEQ ID NO: 110302 - protein, 15 aa, Mycobacterium tuberculosis
AAARDEGAGASPGQQ

SEQ ID NO: 110303 - protein, 15 aa, Mycobacterium tuberculosis
AARDEGAGASPGQQP

SEQ ID NO: 110304 - protein, 15 aa, Mycobacterium tuberculosis
ARDEGAGASPGQQPG

SEQ ID NO: 110305 - protein, 15 aa, Mycobacterium tuberculosis
RDEGAGASPGQQPGG

SEQ ID NO: 110306 - protein, 15 aa, Mycobacterium tuberculosis
DEGAGASPGQQPGGG

SEQ ID NO: 110307 - protein, 15 aa, Mycobacterium tuberculosis
EGAGASPGQQPGGGV

SEQ ID NO: 110308 - protein, 15 aa, Mycobacterium tuberculosis
GAGASPGQQPGGGVP

SEQ ID NO: 110309 - protein, 15 aa, Mycobacterium tuberculosis
AGASPGQQPGGGVPA

SEQ ID NO: 110310 - protein, 15 aa, Mycobacterium tuberculosis
GASPGQQPGGGVPAQ

SEQ ID NO: 110311 - protein, 15 aa, Mycobacterium tuberculosis
ASPGQQPGGGVPAQA

SEQ ID NO: 110312 - protein, 15 aa, Mycobacterium tuberculosis
SPGQQPGGGVPAQAM

SEQ ID NO: 110313 - protein, 15 aa, Mycobacterium tuberculosis
PGQQPGGGVPAQAMD

SEQ ID NO: 110314 - protein, 15 aa, Mycobacterium tuberculosis
GQQPGGGVPAQAMDT

SEQ ID NO: 110315 - protein, 15 aa, Mycobacterium tuberculosis
QQPGGGVPAQAMDTG

SEQ ID NO: 110316 - protein, 15 aa, Mycobacterium tuberculosis
QPGGGVPAQAMDTGA

SEQ ID NO: 110317 - protein, 15 aa, Mycobacterium tuberculosis
PGGGVPAQAMDTGAG

SEQ ID NO: 110318 - protein, 15 aa, Mycobacterium tuberculosis
GGGVPAQAMDTGAGA

SEQ ID NO: 110319 - protein, 15 aa, Mycobacterium tuberculosis
GGVPAQAMDTGAGAR

SEQ ID NO: 110320 - protein, 15 aa, Mycobacterium tuberculosis
GVPAQAMDTGAGARP

SEQ ID NO: 110321 - protein, 15 aa, Mycobacterium tuberculosis
VPAQAMDTGAGARPA

SEQ ID NO: 110322 - protein, 15 aa, Mycobacterium tuberculosis
PAQAMDTGAGARPAA

SEQ ID NO: 110323 - protein, 15 aa, Mycobacterium tuberculosis
AQAMDTGAGARPAAS

SEQ ID NO: 110324 - protein, 15 aa, Mycobacterium tuberculosis
QAMDTGAGARPAASP

SEQ ID NO: 110325 - protein, 15 aa, Mycobacterium tuberculosis
AMDTGAGARPAASPL

SEQ ID NO: 110326 - protein, 15 aa, Mycobacterium tuberculosis
MDTGAGARPAASPLA

SEQ ID NO: 110327 - protein, 15 aa, Mycobacterium tuberculosis
DTGAGARPAASPLAA

SEQ ID NO: 110328 - protein, 15 aa, Mycobacterium tuberculosis
TGAGARPAASPLAAP

SEQ ID NO: 110329 - protein, 15 aa, Mycobacterium tuberculosis
GAGARPAASPLAAPV

SEQ ID NO: 110330 - protein, 15 aa, Mycobacterium tuberculosis
AGARPAASPLAAPVD

SEQ ID NO: 110331 - protein, 15 aa, Mycobacterium tuberculosis
GARPAASPLAAPVDP

SEQ ID NO: 110332 - protein, 15 aa, Mycobacterium tuberculosis
ARPAASPLAAPVDPS

SEQ ID NO: 110333 - protein, 15 aa, Mycobacterium tuberculosis
RPAASPLAAPVDPST

SEQ ID NO: 110334 - protein, 15 aa, Mycobacterium tuberculosis
PAASPLAAPVDPSTP

SEQ ID NO: 110335 - protein, 15 aa, Mycobacterium tuberculosis
AASPLAAPVDPSTPA

SEQ ID NO: 110336 - protein, 15 aa, Mycobacterium tuberculosis
ASPLAAPVDPSTPAP

SEQ ID NO: 110337 - protein, 15 aa, Mycobacterium tuberculosis
SPLAAPVDPSTPAPS

SEQ ID NO: 110338 - protein, 15 aa, Mycobacterium tuberculosis
PLAAPVDPSTPAPST

SEQ ID NO: 110339 - protein, 15 aa, Mycobacterium tuberculosis
LAAPVDPSTPAPSTT

SEQ ID NO: 110340 - protein, 15 aa, Mycobacterium tuberculosis
AAPVDPSTPAPSTTT

SEQ ID NO: 110341 - protein, 15 aa, Mycobacterium tuberculosis
APVDPSTPAPSTTTT

SEQ ID NO: 110342 - protein, 15 aa, Mycobacterium tuberculosis
PVDPSTPAPSTTTTL

SEQ ID NO: 110343 - protein, 16 aa, Mycobacterium tuberculosis
MAEPLAVDPTGLSAAA

SEQ ID NO: 110344 - protein, 16 aa, Mycobacterium tuberculosis
AEPLAVDPTGLSAAAA

SEQ ID NO: 110345 - protein, 16 aa, Mycobacterium tuberculosis
EPLAVDPTGLSAAAAK

SEQ ID NO: 110346 - protein, 16 aa, Mycobacterium tuberculosis
PLAVDPTGLSAAAAKL

SEQ ID NO: 110347 - protein, 16 aa, Mycobacterium tuberculosis
LAVDPTGLSAAAAKLA

SEQ ID NO: 110348 - protein, 16 aa, Mycobacterium tuberculosis
AVDPTGLSAAAAKLAG

SEQ ID NO: 110349 - protein, 16 aa, Mycobacterium tuberculosis
VDPTGLSAAAAKLAGL

SEQ ID NO: 110350 - protein, 16 aa, Mycobacterium tuberculosis
DPTGLSAAAAKLAGLV

SEQ ID NO: 110351 - protein, 16 aa, Mycobacterium tuberculosis
PTGLSAAAAKLAGLVF

SEQ ID NO: 110352 - protein, 16 aa, Mycobacterium tuberculosis
TGLSAAAAKLAGLVFP

SEQ ID NO: 110353 - protein, 16 aa, Mycobacterium tuberculosis
GLSAAAAKLAGLVFPQ

SEQ ID NO: 110354 - protein, 16 aa, Mycobacterium tuberculosis
LSAAAAKLAGLVFPQP

SEQ ID NO: 110355 - protein, 16 aa, Mycobacterium tuberculosis
SAAAAKLAGLVFPQPP

SEQ ID NO: 110356 - protein, 16 aa, Mycobacterium tuberculosis
AAAAKLAGLVFPQPPA

SEQ ID NO: 110357 - protein, 16 aa, Mycobacterium tuberculosis
AAAKLAGLVFPQPPAP

SEQ ID NO: 110358 - protein, 16 aa, Mycobacterium tuberculosis
AAKLAGLVFPQPPAPI

SEQ ID NO: 110359 - protein, 16 aa, Mycobacterium tuberculosis
AKLAGLVFPQPPAPIA

SEQ ID NO: 110360 - protein, 16 aa, Mycobacterium tuberculosis
KLAGLVFPQPPAPIAV

SEQ ID NO: 110361 - protein, 16 aa, Mycobacterium tuberculosis
LAGLVFPQPPAPIAVS

SEQ ID NO: 110362 - protein, 16 aa, Mycobacterium tuberculosis
AGLVFPQPPAPIAVSG

SEQ ID NO: 110363 - protein, 16 aa, Mycobacterium tuberculosis
GLVFPQPPAPIAVSGT

SEQ ID NO: 110364 - protein, 16 aa, Mycobacterium tuberculosis
LVFPQPPAPIAVSGTD

SEQ ID NO: 110365 - protein, 16 aa, Mycobacterium tuberculosis
VFPQPPAPIAVSGTDS

SEQ ID NO: 110366 - protein, 16 aa, Mycobacterium tuberculosis
FPQPPAPIAVSGTDSV

SEQ ID NO: 110367 - protein, 16 aa, Mycobacterium tuberculosis
PQPPAPIAVSGTDSVV

SEQ ID NO: 110368 - protein, 16 aa, Mycobacterium tuberculosis
QPPAPIAVSGTDSVVA

SEQ ID NO: 110369 - protein, 16 aa, Mycobacterium tuberculosis
PPAPIAVSGTDSVVAA

SEQ ID NO: 110370 - protein, 16 aa, Mycobacterium tuberculosis
PAPIAVSGTDSVVAAI

SEQ ID NO: 110371 - protein, 16 aa, Mycobacterium tuberculosis
APIAVSGTDSVVAAIN

SEQ ID NO: 110372 - protein, 16 aa, Mycobacterium tuberculosis
PIAVSGTDSVVAAINE

SEQ ID NO: 110373 - protein, 16 aa, Mycobacterium tuberculosis
IAVSGTDSVVAAINET

SEQ ID NO: 110374 - protein, 16 aa, Mycobacterium tuberculosis
AVSGTDSVVAAINETM

SEQ ID NO: 110375 - protein, 16 aa, Mycobacterium tuberculosis
VSGTDSVVAAINETMP

SEQ ID NO: 110376 - protein, 16 aa, Mycobacterium tuberculosis
SGTDSVVAAINETMPS

SEQ ID NO: 110377 - protein, 16 aa, Mycobacterium tuberculosis
GTDSVVAAINETMPSI

SEQ ID NO: 110378 - protein, 16 aa, Mycobacterium tuberculosis
TDSVVAAINETMPSIE

SEQ ID NO: 110379 - protein, 16 aa, Mycobacterium tuberculosis
DSVVAAINETMPSIES

SEQ ID NO: 110380 - protein, 16 aa, Mycobacterium tuberculosis
SVVAAINETMPSIESL

SEQ ID NO: 110381 - protein, 16 aa, Mycobacterium tuberculosis
VVAAINETMPSIESLV

SEQ ID NO: 110382 - protein, 16 aa, Mycobacterium tuberculosis
VAAINETMPSIESLVS

SEQ ID NO: 110383 - protein, 16 aa, Mycobacterium tuberculosis
AAINETMPSIESLVSD

SEQ ID NO: 110384 - protein, 16 aa, Mycobacterium tuberculosis
AINETMPSIESLVSDG

SEQ ID NO: 110385 - protein, 16 aa, Mycobacterium tuberculosis
INETMPSIESLVSDGL

SEQ ID NO: 110386 - protein, 16 aa, Mycobacterium tuberculosis
NETMPSIESLVSDGLP

SEQ ID NO: 110387 - protein, 16 aa, Mycobacterium tuberculosis
ETMPSIESLVSDGLPG

SEQ ID NO: 110388 - protein, 16 aa, Mycobacterium tuberculosis
TMPSIESLVSDGLPGV

SEQ ID NO: 110389 - protein, 16 aa, Mycobacterium tuberculosis
MPSIESLVSDGLPGVK

SEQ ID NO: 110390 - protein, 16 aa, Mycobacterium tuberculosis
PSIESLVSDGLPGVKA

SEQ ID NO: 110391 - protein, 16 aa, Mycobacterium tuberculosis
SIESLVSDGLPGVKAA

SEQ ID NO: 110392 - protein, 16 aa, Mycobacterium tuberculosis
IESLVSDGLPGVKAAL

SEQ ID NO: 110393 - protein, 16 aa, Mycobacterium tuberculosis
ESLVSDGLPGVKAALT

SEQ ID NO: 110394 - protein, 16 aa, Mycobacterium tuberculosis
SLVSDGLPGVKAALTR

SEQ ID NO: 110395 - protein, 16 aa, Mycobacterium tuberculosis
LVSDGLPGVKAALTRT

SEQ ID NO: 110396 - protein, 16 aa, Mycobacterium tuberculosis
VSDGLPGVKAALTRTA

SEQ ID NO: 110397 - protein, 16 aa, Mycobacterium tuberculosis
SDGLPGVKAALTRTAS

SEQ ID NO: 110398 - protein, 16 aa, Mycobacterium tuberculosis
DGLPGVKAALTRTASN

SEQ ID NO: 110399 - protein, 16 aa, Mycobacterium tuberculosis
GLPGVKAALTRTASNM

SEQ ID NO: 110400 - protein, 16 aa, Mycobacterium tuberculosis
LPGVKAALTRTASNMN

SEQ ID NO: 110401 - protein, 16 aa, Mycobacterium tuberculosis
PGVKAALTRTASNMNA

SEQ ID NO: 110402 - protein, 16 aa, Mycobacterium tuberculosis
GVKAALTRTASNMNAA

SEQ ID NO: 110403 - protein, 16 aa, Mycobacterium tuberculosis
VKAALTRTASNMNAAA

SEQ ID NO: 110404 - protein, 16 aa, Mycobacterium tuberculosis
KAALTRTASNMNAAAD

SEQ ID NO: 110405 - protein, 16 aa, Mycobacterium tuberculosis
AALTRTASNMNAAADV

SEQ ID NO: 110406 - protein, 16 aa, Mycobacterium tuberculosis
ALTRTASNMNAAADVY

SEQ ID NO: 110407 - protein, 16 aa, Mycobacterium tuberculosis
LTRTASNMNAAADVYA

SEQ ID NO: 110408 - protein, 16 aa, Mycobacterium tuberculosis
TRTASNMNAAADVYAK

SEQ ID NO: 110409 - protein, 16 aa, Mycobacterium tuberculosis
RTASNMNAAADVYAKT

SEQ ID NO: 110410 - protein, 16 aa, Mycobacterium tuberculosis
TASNMNAAADVYAKTD

SEQ ID NO: 110411 - protein, 16 aa, Mycobacterium tuberculosis
ASNMNAAADVYAKTDQ

SEQ ID NO: 110412 - protein, 16 aa, Mycobacterium tuberculosis
SNMNAAADVYAKTDQS

SEQ ID NO: 110413 - protein, 16 aa, Mycobacterium tuberculosis
NMNAAADVYAKTDQSL

SEQ ID NO: 110414 - protein, 16 aa, Mycobacterium tuberculosis
MNAAADVYAKTDQSLG

SEQ ID NO: 110415 - protein, 16 aa, Mycobacterium tuberculosis
NAAADVYAKTDQSLGT

SEQ ID NO: 110416 - protein, 16 aa, Mycobacterium tuberculosis
AAADVYAKTDQSLGTS

SEQ ID NO: 110417 - protein, 16 aa, Mycobacterium tuberculosis
AADVYAKTDQSLGTSL

SEQ ID NO: 110418 - protein, 16 aa, Mycobacterium tuberculosis
ADVYAKTDQSLGTSLS

SEQ ID NO: 110419 - protein, 16 aa, Mycobacterium tuberculosis
DVYAKTDQSLGTSLSQ

SEQ ID NO: 110420 - protein, 16 aa, Mycobacterium tuberculosis
VYAKTDQSLGTSLSQY

SEQ ID NO: 110421 - protein, 16 aa, Mycobacterium tuberculosis
YAKTDQSLGTSLSQYA

SEQ ID NO: 110422 - protein, 16 aa, Mycobacterium tuberculosis
AKTDQSLGTSLSQYAF

SEQ ID NO: 110423 - protein, 16 aa, Mycobacterium tuberculosis
KTDQSLGTSLSQYAFG

SEQ ID NO: 110424 - protein, 16 aa, Mycobacterium tuberculosis
TDQSLGTSLSQYAFGS

SEQ ID NO: 110425 - protein, 16 aa, Mycobacterium tuberculosis
DQSLGTSLSQYAFGSS

SEQ ID NO: 110426 - protein, 16 aa, Mycobacterium tuberculosis
QSLGTSLSQYAFGSSG

SEQ ID NO: 110427 - protein, 16 aa, Mycobacterium tuberculosis
SLGTSLSQYAFGSSGE

SEQ ID NO: 110428 - protein, 16 aa, Mycobacterium tuberculosis
LGTSLSQYAFGSSGEG

SEQ ID NO: 110429 - protein, 16 aa, Mycobacterium tuberculosis
GTSLSQYAFGSSGEGL

SEQ ID NO: 110430 - protein, 16 aa, Mycobacterium tuberculosis
TSLSQYAFGSSGEGLA

SEQ ID NO: 110431 - protein, 16 aa, Mycobacterium tuberculosis
SLSQYAFGSSGEGLAG

SEQ ID NO: 110432 - protein, 16 aa, Mycobacterium tuberculosis
LSQYAFGSSGEGLAGV

SEQ ID NO: 110433 - protein, 16 aa, Mycobacterium tuberculosis
SQYAFGSSGEGLAGVA

SEQ ID NO: 110434 - protein, 16 aa, Mycobacterium tuberculosis
QYAFGSSGEGLAGVAS

SEQ ID NO: 110435 - protein, 16 aa, Mycobacterium tuberculosis
YAFGSSGEGLAGVASV

SEQ ID NO: 110436 - protein, 16 aa, Mycobacterium tuberculosis
AFGSSGEGLAGVASVG

SEQ ID NO: 110437 - protein, 16 aa, Mycobacterium tuberculosis
FGSSGEGLAGVASVGG

SEQ ID NO: 110438 - protein, 16 aa, Mycobacterium tuberculosis
GSSGEGLAGVASVGGQ

SEQ ID NO: 110439 - protein, 16 aa, Mycobacterium tuberculosis
SSGEGLAGVASVGGQP

SEQ ID NO: 110440 - protein, 16 aa, Mycobacterium tuberculosis
SGEGLAGVASVGGQPS

SEQ ID NO: 110441 - protein, 16 aa, Mycobacterium tuberculosis
GEGLAGVASVGGQPSQ

SEQ ID NO: 110442 - protein, 16 aa, Mycobacterium tuberculosis
EGLAGVASVGGQPSQA

SEQ ID NO: 110443 - protein, 16 aa, Mycobacterium tuberculosis
GLAGVASVGGQPSQAT

SEQ ID NO: 110444 - protein, 16 aa, Mycobacterium tuberculosis
LAGVASVGGQPSQATQ

SEQ ID NO: 110445 - protein, 16 aa, Mycobacterium tuberculosis
AGVASVGGQPSQATQL

SEQ ID NO: 110446 - protein, 16 aa, Mycobacterium tuberculosis
GVASVGGQPSQATQLL

SEQ ID NO: 110447 - protein, 16 aa, Mycobacterium tuberculosis
VASVGGQPSQATQLLS

SEQ ID NO: 110448 - protein, 16 aa, Mycobacterium tuberculosis
ASVGGQPSQATQLLST

SEQ ID NO: 110449 - protein, 16 aa, Mycobacterium tuberculosis
SVGGQPSQATQLLSTP

SEQ ID NO: 110450 - protein, 16 aa, Mycobacterium tuberculosis
VGGQPSQATQLLSTPV

SEQ ID NO: 110451 - protein, 16 aa, Mycobacterium tuberculosis
GGQPSQATQLLSTPVS

SEQ ID NO: 110452 - protein, 16 aa, Mycobacterium tuberculosis
GQPSQATQLLSTPVSQ

SEQ ID NO: 110453 - protein, 16 aa, Mycobacterium tuberculosis
QPSQATQLLSTPVSQV

SEQ ID NO: 110454 - protein, 16 aa, Mycobacterium tuberculosis
PSQATQLLSTPVSQVT

SEQ ID NO: 110455 - protein, 16 aa, Mycobacterium tuberculosis
SQATQLLSTPVSQVTT

SEQ ID NO: 110456 - protein, 16 aa, Mycobacterium tuberculosis
QATQLLSTPVSQVTTQ

SEQ ID NO: 110457 - protein, 16 aa, Mycobacterium tuberculosis
ATQLLSTPVSQVTTQL

SEQ ID NO: 110458 - protein, 16 aa, Mycobacterium tuberculosis
TQLLSTPVSQVTTQLG

SEQ ID NO: 110459 - protein, 16 aa, Mycobacterium tuberculosis
QLLSTPVSQVTTQLGE

SEQ ID NO: 110460 - protein, 16 aa, Mycobacterium tuberculosis
LLSTPVSQVTTQLGET

SEQ ID NO: 110461 - protein, 16 aa, Mycobacterium tuberculosis
LSTPVSQVTTQLGETA

SEQ ID NO: 110462 - protein, 16 aa, Mycobacterium tuberculosis
STPVSQVTTQLGETAA

SEQ ID NO: 110463 - protein, 16 aa, Mycobacterium tuberculosis
TPVSQVTTQLGETAAE

SEQ ID NO: 110464 - protein, 16 aa, Mycobacterium tuberculosis
PVSQVTTQLGETAAEL

SEQ ID NO: 110465 - protein, 16 aa, Mycobacterium tuberculosis
VSQVTTQLGETAAELA

SEQ ID NO: 110466 - protein, 16 aa, Mycobacterium tuberculosis
SQVTTQLGETAAELAP

SEQ ID NO: 110467 - protein, 16 aa, Mycobacterium tuberculosis
QVTTQLGETAAELAPR

SEQ ID NO: 110468 - protein, 16 aa, Mycobacterium tuberculosis
VTTQLGETAAELAPRV

SEQ ID NO: 110469 - protein, 16 aa, Mycobacterium tuberculosis
TTQLGETAAELAPRVV

SEQ ID NO: 110470 - protein, 16 aa, Mycobacterium tuberculosis
TQLGETAAELAPRVVA

SEQ ID NO: 110471 - protein, 16 aa, Mycobacterium tuberculosis
QLGETAAELAPRVVAT

SEQ ID NO: 110472 - protein, 16 aa, Mycobacterium tuberculosis
LGETAAELAPRVVATV

SEQ ID NO: 110473 - protein, 16 aa, Mycobacterium tuberculosis
GETAAELAPRVVATVP

SEQ ID NO: 110474 - protein, 16 aa, Mycobacterium tuberculosis
ETAAELAPRVVATVPQ

SEQ ID NO: 110475 - protein, 16 aa, Mycobacterium tuberculosis
TAAELAPRVVATVPQL

SEQ ID NO: 110476 - protein, 16 aa, Mycobacterium tuberculosis
AAELAPRVVATVPQLV

SEQ ID NO: 110477 - protein, 16 aa, Mycobacterium tuberculosis
AELAPRVVATVPQLVQ

SEQ ID NO: 110478 - protein, 16 aa, Mycobacterium tuberculosis
ELAPRVVATVPQLVQL

SEQ ID NO: 110479 - protein, 16 aa, Mycobacterium tuberculosis
LAPRVVATVPQLVQLA

SEQ ID NO: 110480 - protein, 16 aa, Mycobacterium tuberculosis
APRVVATVPQLVQLAP

SEQ ID NO: 110481 - protein, 16 aa, Mycobacterium tuberculosis
PRVVATVPQLVQLAPH

SEQ ID NO: 110482 - protein, 16 aa, Mycobacterium tuberculosis
RVVATVPQLVQLAPHA

SEQ ID NO: 110483 - protein, 16 aa, Mycobacterium tuberculosis
VVATVPQLVQLAPHAV

SEQ ID NO: 110484 - protein, 16 aa, Mycobacterium tuberculosis
VATVPQLVQLAPHAVQ

SEQ ID NO: 110485 - protein, 16 aa, Mycobacterium tuberculosis
ATVPQLVQLAPHAVQM

SEQ ID NO: 110486 - protein, 16 aa, Mycobacterium tuberculosis
TVPQLVQLAPHAVQMS

SEQ ID NO: 110487 - protein, 16 aa, Mycobacterium tuberculosis
VPQLVQLAPHAVQMSQ

SEQ ID NO: 110488 - protein, 16 aa, Mycobacterium tuberculosis
PQLVQLAPHAVQMSQN

SEQ ID NO: 110489 - protein, 16 aa, Mycobacterium tuberculosis
QLVQLAPHAVQMSQNA

SEQ ID NO: 110490 - protein, 16 aa, Mycobacterium tuberculosis
LVQLAPHAVQMSQNAS

SEQ ID NO: 110491 - protein, 16 aa, Mycobacterium tuberculosis
VQLAPHAVQMSQNASP

SEQ ID NO: 110492 - protein, 16 aa, Mycobacterium tuberculosis
QLAPHAVQMSQNASPI

SEQ ID NO: 110493 - protein, 16 aa, Mycobacterium tuberculosis
LAPHAVQMSQNASPIA

SEQ ID NO: 110494 - protein, 16 aa, Mycobacterium tuberculosis
APHAVQMSQNASPIAQ

SEQ ID NO: 110495 - protein, 16 aa, Mycobacterium tuberculosis
PHAVQMSQNASPIAQT

SEQ ID NO: 110496 - protein, 16 aa, Mycobacterium tuberculosis
HAVQMSQNASPIAQTI

SEQ ID NO: 110497 - protein, 16 aa, Mycobacterium tuberculosis
AVQMSQNASPIAQTIS

SEQ ID NO: 110498 - protein, 16 aa, Mycobacterium tuberculosis
VQMSQNASPIAQTISQ

SEQ ID NO: 110499 - protein, 16 aa, Mycobacterium tuberculosis
QMSQNASPIAQTISQT

SEQ ID NO: 110500 - protein, 16 aa, Mycobacterium tuberculosis
MSQNASPIAQTISQTA

SEQ ID NO: 110501 - protein, 16 aa, Mycobacterium tuberculosis
SQNASPIAQTISQTAQ

SEQ ID NO: 110502 - protein, 16 aa, Mycobacterium tuberculosis
QNASPIAQTISQTAQQ

SEQ ID NO: 110503 - protein, 16 aa, Mycobacterium tuberculosis
NASPIAQTISQTAQQA

SEQ ID NO: 110504 - protein, 16 aa, Mycobacterium tuberculosis
ASPIAQTISQTAQQAA

SEQ ID NO: 110505 - protein, 16 aa, Mycobacterium tuberculosis
SPIAQTISQTAQQAAQ

SEQ ID NO: 110506 - protein, 16 aa, Mycobacterium tuberculosis
PIAQTISQTAQQAAQS

SEQ ID NO: 110507 - protein, 16 aa, Mycobacterium tuberculosis
IAQTISQTAQQAAQSA

SEQ ID NO: 110508 - protein, 16 aa, Mycobacterium tuberculosis
AQTISQTAQQAAQSAQ

SEQ ID NO: 110509 - protein, 16 aa, Mycobacterium tuberculosis
QTISQTAQQAAQSAQG

SEQ ID NO: 110510 - protein, 16 aa, Mycobacterium tuberculosis
TISQTAQQAAQSAQGG

SEQ ID NO: 110511 - protein, 16 aa, Mycobacterium tuberculosis
ISQTAQQAAQSAQGGS

SEQ ID NO: 110512 - protein, 16 aa, Mycobacterium tuberculosis
SQTAQQAAQSAQGGSG

SEQ ID NO: 110513 - protein, 16 aa, Mycobacterium tuberculosis
QTAQQAAQSAQGGSGP

SEQ ID NO: 110514 - protein, 16 aa, Mycobacterium tuberculosis
TAQQAAQSAQGGSGPM

SEQ ID NO: 110515 - protein, 16 aa, Mycobacterium tuberculosis
AQQAAQSAQGGSGPMP

SEQ ID NO: 110516 - protein, 16 aa, Mycobacterium tuberculosis
QQAAQSAQGGSGPMPA

SEQ ID NO: 110517 - protein, 16 aa, Mycobacterium tuberculosis
QAAQSAQGGSGPMPAQ

SEQ ID NO: 110518 - protein, 16 aa, Mycobacterium tuberculosis
AAQSAQGGSGPMPAQL

SEQ ID NO: 110519 - protein, 16 aa, Mycobacterium tuberculosis
AQSAQGGSGPMPAQLA

SEQ ID NO: 110520 - protein, 16 aa, Mycobacterium tuberculosis
QSAQGGSGPMPAQLAS

SEQ ID NO: 110521 - protein, 16 aa, Mycobacterium tuberculosis
SAQGGSGPMPAQLASA

SEQ ID NO: 110522 - protein, 16 aa, Mycobacterium tuberculosis
AQGGSGPMPAQLASAE

SEQ ID NO: 110523 - protein, 16 aa, Mycobacterium tuberculosis
QGGSGPMPAQLASAEK

SEQ ID NO: 110524 - protein, 16 aa, Mycobacterium tuberculosis
GGSGPMPAQLASAEKP

SEQ ID NO: 110525 - protein, 16 aa, Mycobacterium tuberculosis
GSGPMPAQLASAEKPA

SEQ ID NO: 110526 - protein, 16 aa, Mycobacterium tuberculosis
SGPMPAQLASAEKPAT

SEQ ID NO: 110527 - protein, 16 aa, Mycobacterium tuberculosis
GPMPAQLASAEKPATE

SEQ ID NO: 110528 - protein, 16 aa, Mycobacterium tuberculosis
PMPAQLASAEKPATEQ

SEQ ID NO: 110529 - protein, 16 aa, Mycobacterium tuberculosis
MPAQLASAEKPATEQA

SEQ ID NO: 110530 - protein, 16 aa, Mycobacterium tuberculosis
PAQLASAEKPATEQAE

SEQ ID NO: 110531 - protein, 16 aa, Mycobacterium tuberculosis
AQLASAEKPATEQAEP

SEQ ID NO: 110532 - protein, 16 aa, Mycobacterium tuberculosis
QLASAEKPATEQAEPV

SEQ ID NO: 110533 - protein, 16 aa, Mycobacterium tuberculosis
LASAEKPATEQAEPVH

SEQ ID NO: 110534 - protein, 16 aa, Mycobacterium tuberculosis
ASAEKPATEQAEPVHE

SEQ ID NO: 110535 - protein, 16 aa, Mycobacterium tuberculosis
SAEKPATEQAEPVHEV

SEQ ID NO: 110536 - protein, 16 aa, Mycobacterium tuberculosis
AEKPATEQAEPVHEVT

SEQ ID NO: 110537 - protein, 16 aa, Mycobacterium tuberculosis
EKPATEQAEPVHEVTN

SEQ ID NO: 110538 - protein, 16 aa, Mycobacterium tuberculosis
KPATEQAEPVHEVTND

SEQ ID NO: 110539 - protein, 16 aa, Mycobacterium tuberculosis
PATEQAEPVHEVTNDD

SEQ ID NO: 110540 - protein, 16 aa, Mycobacterium tuberculosis
ATEQAEPVHEVTNDDQ

SEQ ID NO: 110541 - protein, 16 aa, Mycobacterium tuberculosis
TEQAEPVHEVTNDDQG

SEQ ID NO: 110542 - protein, 16 aa, Mycobacterium tuberculosis
EQAEPVHEVTNDDQGD

SEQ ID NO: 110543 - protein, 16 aa, Mycobacterium tuberculosis
QAEPVHEVTNDDQGDQ

SEQ ID NO: 110544 - protein, 16 aa, Mycobacterium tuberculosis
AEPVHEVTNDDQGDQG

SEQ ID NO: 110545 - protein, 16 aa, Mycobacterium tuberculosis
EPVHEVTNDDQGDQGD

SEQ ID NO: 110546 - protein, 16 aa, Mycobacterium tuberculosis
PVHEVTNDDQGDQGDV

SEQ ID NO: 110547 - protein, 16 aa, Mycobacterium tuberculosis
VHEVTNDDQGDQGDVQ

SEQ ID NO: 110548 - protein, 16 aa, Mycobacterium tuberculosis
HEVTNDDQGDQGDVQP

SEQ ID NO: 110549 - protein, 16 aa, Mycobacterium tuberculosis
EVTNDDQGDQGDVQPA

SEQ ID NO: 110550 - protein, 16 aa, Mycobacterium tuberculosis
VTNDDQGDQGDVQPAE

SEQ ID NO: 110551 - protein, 16 aa, Mycobacterium tuberculosis
TNDDQGDQGDVQPAEV

SEQ ID NO: 110552 - protein, 16 aa, Mycobacterium tuberculosis
NDDQGDQGDVQPAEVV

SEQ ID NO: 110553 - protein, 16 aa, Mycobacterium tuberculosis
DDQGDQGDVQPAEVVA

SEQ ID NO: 110554 - protein, 16 aa, Mycobacterium tuberculosis
DQGDQGDVQPAEVVAA

SEQ ID NO: 110555 - protein, 16 aa, Mycobacterium tuberculosis
QGDQGDVQPAEVVAAA

SEQ ID NO: 110556 - protein, 16 aa, Mycobacterium tuberculosis
GDQGDVQPAEVVAAAR

SEQ ID NO: 110557 - protein, 16 aa, Mycobacterium tuberculosis
DQGDVQPAEVVAAARD

SEQ ID NO: 110558 - protein, 16 aa, Mycobacterium tuberculosis
QGDVQPAEVVAAARDE

SEQ ID NO: 110559 - protein, 16 aa, Mycobacterium tuberculosis
GDVQPAEVVAAARDEG

SEQ ID NO: 110560 - protein, 16 aa, Mycobacterium tuberculosis
DVQPAEVVAAARDEGA

SEQ ID NO: 110561 - protein, 16 aa, Mycobacterium tuberculosis
VQPAEVVAAARDEGAG

SEQ ID NO: 110562 - protein, 16 aa, Mycobacterium tuberculosis
QPAEVVAAARDEGAGA

SEQ ID NO: 110563 - protein, 16 aa, Mycobacterium tuberculosis
PAEVVAAARDEGAGAS

SEQ ID NO: 110564 - protein, 16 aa, Mycobacterium tuberculosis
AEVVAAARDEGAGASP

SEQ ID NO: 110565 - protein, 16 aa, Mycobacterium tuberculosis
EVVAAARDEGAGASPG

SEQ ID NO: 110566 - protein, 16 aa, Mycobacterium tuberculosis
VVAAARDEGAGASPGQ

SEQ ID NO: 110567 - protein, 16 aa, Mycobacterium tuberculosis
VAAARDEGAGASPGQQ

SEQ ID NO: 110568 - protein, 16 aa, Mycobacterium tuberculosis
AAARDEGAGASPGQQP

SEQ ID NO: 110569 - protein, 16 aa, Mycobacterium tuberculosis
AARDEGAGASPGQQPG

SEQ ID NO: 110570 - protein, 16 aa, Mycobacterium tuberculosis
ARDEGAGASPGQQPGG

SEQ ID NO: 110571 - protein, 16 aa, Mycobacterium tuberculosis
RDEGAGASPGQQPGGG

SEQ ID NO: 110572 - protein, 16 aa, Mycobacterium tuberculosis
DEGAGASPGQQPGGGV

SEQ ID NO: 110573 - protein, 16 aa, Mycobacterium tuberculosis
EGAGASPGQQPGGGVP

SEQ ID NO: 110574 - protein, 16 aa, Mycobacterium tuberculosis
GAGASPGQQPGGGVPA

SEQ ID NO: 110575 - protein, 16 aa, Mycobacterium tuberculosis
AGASPGQQPGGGVPAQ

SEQ ID NO: 110576 - protein, 16 aa, Mycobacterium tuberculosis
GASPGQQPGGGVPAQA

SEQ ID NO: 110577 - protein, 16 aa, Mycobacterium tuberculosis
ASPGQQPGGGVPAQAM

SEQ ID NO: 110578 - protein, 16 aa, Mycobacterium tuberculosis
SPGQQPGGGVPAQAMD

SEQ ID NO: 110579 - protein, 16 aa, Mycobacterium tuberculosis
PGQQPGGGVPAQAMDT

SEQ ID NO: 110580 - protein, 16 aa, Mycobacterium tuberculosis
GQQPGGGVPAQAMDTG

SEQ ID NO: 110581 - protein, 16 aa, Mycobacterium tuberculosis
QQPGGGVPAQAMDTGA

SEQ ID NO: 110582 - protein, 16 aa, Mycobacterium tuberculosis
QPGGGVPAQAMDTGAG

SEQ ID NO: 110583 - protein, 16 aa, Mycobacterium tuberculosis
PGGGVPAQAMDTGAGA

SEQ ID NO: 110584 - protein, 16 aa, Mycobacterium tuberculosis
GGGVPAQAMDTGAGAR

SEQ ID NO: 110585 - protein, 16 aa, Mycobacterium tuberculosis
GGVPAQAMDTGAGARP

SEQ ID NO: 110586 - protein, 16 aa, Mycobacterium tuberculosis
GVPAQAMDTGAGARPA

SEQ ID NO: 110587 - protein, 16 aa, Mycobacterium tuberculosis
VPAQAMDTGAGARPAA

SEQ ID NO: 110588 - protein, 16 aa, Mycobacterium tuberculosis
PAQAMDTGAGARPAAS

SEQ ID NO: 110589 - protein, 16 aa, Mycobacterium tuberculosis
AQAMDTGAGARPAASP

SEQ ID NO: 110590 - protein, 16 aa, Mycobacterium tuberculosis
QAMDTGAGARPAASPL

SEQ ID NO: 110591 - protein, 16 aa, Mycobacterium tuberculosis
AMDTGAGARPAASPLA

SEQ ID NO: 110592 - protein, 16 aa, Mycobacterium tuberculosis
MDTGAGARPAASPLAA

SEQ ID NO: 110593 - protein, 16 aa, Mycobacterium tuberculosis
DTGAGARPAASPLAAP

SEQ ID NO: 110594 - protein, 16 aa, Mycobacterium tuberculosis
TGAGARPAASPLAAPV

SEQ ID NO: 110595 - protein, 16 aa, Mycobacterium tuberculosis
GAGARPAASPLAAPVD

SEQ ID NO: 110596 - protein, 16 aa, Mycobacterium tuberculosis
AGARPAASPLAAPVDP

SEQ ID NO: 110597 - protein, 16 aa, Mycobacterium tuberculosis
GARPAASPLAAPVDPS

SEQ ID NO: 110598 - protein, 16 aa, Mycobacterium tuberculosis
ARPAASPLAAPVDPST

SEQ ID NO: 110599 - protein, 16 aa, Mycobacterium tuberculosis
RPAASPLAAPVDPSTP

SEQ ID NO: 110600 - protein, 16 aa, Mycobacterium tuberculosis
PAASPLAAPVDPSTPA

SEQ ID NO: 110601 - protein, 16 aa, Mycobacterium tuberculosis
AASPLAAPVDPSTPAP

SEQ ID NO: 110602 - protein, 16 aa, Mycobacterium tuberculosis
ASPLAAPVDPSTPAPS

SEQ ID NO: 110603 - protein, 16 aa, Mycobacterium tuberculosis
SPLAAPVDPSTPAPST

SEQ ID NO: 110604 - protein, 16 aa, Mycobacterium tuberculosis
PLAAPVDPSTPAPSTT

SEQ ID NO: 110605 - protein, 16 aa, Mycobacterium tuberculosis
LAAPVDPSTPAPSTTT

SEQ ID NO: 110606 - protein, 16 aa, Mycobacterium tuberculosis
AAPVDPSTPAPSTTTT

SEQ ID NO: 110607 - protein, 16 aa, Mycobacterium tuberculosis
APVDPSTPAPSTTTTL

SEQ ID NO: 110608 - protein, 13 aa, Mycobacterium tuberculosis
MSITRPTGSYARQ

SEQ ID NO: 110609 - protein, 13 aa, Mycobacterium tuberculosis
SITRPTGSYARQM

SEQ ID NO: 110610 - protein, 13 aa, Mycobacterium tuberculosis
ITRPTGSYARQML

SEQ ID NO: 110611 - protein, 13 aa, Mycobacterium tuberculosis
TRPTGSYARQMLD

SEQ ID NO: 110612 - protein, 13 aa, Mycobacterium tuberculosis
RPTGSYARQMLDP

SEQ ID NO: 110613 - protein, 13 aa, Mycobacterium tuberculosis
PTGSYARQMLDPG

SEQ ID NO: 110614 - protein, 13 aa, Mycobacterium tuberculosis
TGSYARQMLDPGG

SEQ ID NO: 110615 - protein, 13 aa, Mycobacterium tuberculosis
GSYARQMLDPGGW

SEQ ID NO: 110616 - protein, 13 aa, Mycobacterium tuberculosis
SYARQMLDPGGWV

SEQ ID NO: 110617 - protein, 13 aa, Mycobacterium tuberculosis
YARQMLDPGGWVE

SEQ ID NO: 110618 - protein, 13 aa, Mycobacterium tuberculosis
ARQMLDPGGWVEA

SEQ ID NO: 110619 - protein, 13 aa, Mycobacterium tuberculosis
RQMLDPGGWVEAD

SEQ ID NO: 110620 - protein, 13 aa, Mycobacterium tuberculosis
QMLDPGGWVEADE

SEQ ID NO: 110621 - protein, 13 aa, Mycobacterium tuberculosis
MLDPGGWVEADED

SEQ ID NO: 110622 - protein, 13 aa, Mycobacterium tuberculosis
LDPGGWVEADEDT

SEQ ID NO: 110623 - protein, 13 aa, Mycobacterium tuberculosis
DPGGWVEADEDTF

SEQ ID NO: 110624 - protein, 13 aa, Mycobacterium tuberculosis
PGGWVEADEDTFY

SEQ ID NO: 110625 - protein, 13 aa, Mycobacterium tuberculosis
GGWVEADEDTFYD

SEQ ID NO: 110626 - protein, 13 aa, Mycobacterium tuberculosis
GWVEADEDTFYDR

SEQ ID NO: 110627 - protein, 13 aa, Mycobacterium tuberculosis
WVEADEDTFYDRA

SEQ ID NO: 110628 - protein, 13 aa, Mycobacterium tuberculosis
VEADEDTFYDRAQ

SEQ ID NO: 110629 - protein, 13 aa, Mycobacterium tuberculosis
EADEDTFYDRAQE

SEQ ID NO: 110630 - protein, 13 aa, Mycobacterium tuberculosis
ADEDTFYDRAQEY

SEQ ID NO: 110631 - protein, 13 aa, Mycobacterium tuberculosis
DEDTFYDRAQEYS

SEQ ID NO: 110632 - protein, 13 aa, Mycobacterium tuberculosis
EDTFYDRAQEYSQ

SEQ ID NO: 110633 - protein, 13 aa, Mycobacterium tuberculosis
DTFYDRAQEYSQV

SEQ ID NO: 110634 - protein, 13 aa, Mycobacterium tuberculosis
TFYDRAQEYSQVL

SEQ ID NO: 110635 - protein, 13 aa, Mycobacterium tuberculosis
FYDRAQEYSQVLQ

SEQ ID NO: 110636 - protein, 13 aa, Mycobacterium tuberculosis
YDRAQEYSQVLQR

SEQ ID NO: 110637 - protein, 13 aa, Mycobacterium tuberculosis
DRAQEYSQVLQRV

SEQ ID NO: 110638 - protein, 13 aa, Mycobacterium tuberculosis
RAQEYSQVLQRVT

SEQ ID NO: 110639 - protein, 13 aa, Mycobacterium tuberculosis
AQEYSQVLQRVTD

SEQ ID NO: 110640 - protein, 13 aa, Mycobacterium tuberculosis
QEYSQVLQRVTDV

SEQ ID NO: 110641 - protein, 13 aa, Mycobacterium tuberculosis
EYSQVLQRVTDVL

SEQ ID NO: 110642 - protein, 13 aa, Mycobacterium tuberculosis
YSQVLQRVTDVLD

SEQ ID NO: 110643 - protein, 13 aa, Mycobacterium tuberculosis
SQVLQRVTDVLDT

SEQ ID NO: 110644 - protein, 13 aa, Mycobacterium tuberculosis
QVLQRVTDVLDTC

SEQ ID NO: 110645 - protein, 13 aa, Mycobacterium tuberculosis
VLQRVTDVLDTCR

SEQ ID NO: 110646 - protein, 13 aa, Mycobacterium tuberculosis
LQRVTDVLDTCRQ

SEQ ID NO: 110647 - protein, 13 aa, Mycobacterium tuberculosis
QRVTDVLDTCRQQ

SEQ ID NO: 110648 - protein, 13 aa, Mycobacterium tuberculosis
RVTDVLDTCRQQK

SEQ ID NO: 110649 - protein, 13 aa, Mycobacterium tuberculosis
VTDVLDTCRQQKG

SEQ ID NO: 110650 - protein, 13 aa, Mycobacterium tuberculosis
TDVLDTCRQQKGH

SEQ ID NO: 110651 - protein, 13 aa, Mycobacterium tuberculosis
DVLDTCRQQKGHV

SEQ ID NO: 110652 - protein, 13 aa, Mycobacterium tuberculosis
VLDTCRQQKGHVF

SEQ ID NO: 110653 - protein, 13 aa, Mycobacterium tuberculosis
LDTCRQQKGHVFE

SEQ ID NO: 110654 - protein, 13 aa, Mycobacterium tuberculosis
DTCRQQKGHVFEG

SEQ ID NO: 110655 - protein, 13 aa, Mycobacterium tuberculosis
TCRQQKGHVFEGG

SEQ ID NO: 110656 - protein, 13 aa, Mycobacterium tuberculosis
CRQQKGHVFEGGL

SEQ ID NO: 110657 - protein, 13 aa, Mycobacterium tuberculosis
RQQKGHVFEGGLW

SEQ ID NO: 110658 - protein, 13 aa, Mycobacterium tuberculosis
QQKGHVFEGGLWS

SEQ ID NO: 110659 - protein, 13 aa, Mycobacterium tuberculosis
QKGHVFEGGLWSG

SEQ ID NO: 110660 - protein, 13 aa, Mycobacterium tuberculosis
KGHVFEGGLWSGG

SEQ ID NO: 110661 - protein, 13 aa, Mycobacterium tuberculosis
GHVFEGGLWSGGA

SEQ ID NO: 110662 - protein, 13 aa, Mycobacterium tuberculosis
HVFEGGLWSGGAA

SEQ ID NO: 110663 - protein, 13 aa, Mycobacterium tuberculosis
VFEGGLWSGGAAN

SEQ ID NO: 110664 - protein, 13 aa, Mycobacterium tuberculosis
FEGGLWSGGAANA

SEQ ID NO: 110665 - protein, 13 aa, Mycobacterium tuberculosis
EGGLWSGGAANAA

SEQ ID NO: 110666 - protein, 13 aa, Mycobacterium tuberculosis
GGLWSGGAANAAN

SEQ ID NO: 110667 - protein, 13 aa, Mycobacterium tuberculosis
GLWSGGAANAANG

SEQ ID NO: 110668 - protein, 13 aa, Mycobacterium tuberculosis
LWSGGAANAANGA

SEQ ID NO: 110669 - protein, 13 aa, Mycobacterium tuberculosis
WSGGAANAANGAL

SEQ ID NO: 110670 - protein, 13 aa, Mycobacterium tuberculosis
SGGAANAANGALG

SEQ ID NO: 110671 - protein, 13 aa, Mycobacterium tuberculosis
GGAANAANGALGA

SEQ ID NO: 110672 - protein, 13 aa, Mycobacterium tuberculosis
GAANAANGALGAN

SEQ ID NO: 110673 - protein, 13 aa, Mycobacterium tuberculosis
AANAANGALGANI

SEQ ID NO: 110674 - protein, 13 aa, Mycobacterium tuberculosis
ANAANGALGANIN

SEQ ID NO: 110675 - protein, 13 aa, Mycobacterium tuberculosis
NAANGALGANINQ

SEQ ID NO: 110676 - protein, 13 aa, Mycobacterium tuberculosis
AANGALGANINQL

SEQ ID NO: 110677 - protein, 13 aa, Mycobacterium tuberculosis
ANGALGANINQLM

SEQ ID NO: 110678 - protein, 13 aa, Mycobacterium tuberculosis
NGALGANINQLMT

SEQ ID NO: 110679 - protein, 13 aa, Mycobacterium tuberculosis
GALGANINQLMTL

SEQ ID NO: 110680 - protein, 13 aa, Mycobacterium tuberculosis
ALGANINQLMTLQ

SEQ ID NO: 110681 - protein, 13 aa, Mycobacterium tuberculosis
LGANINQLMTLQD

SEQ ID NO: 110682 - protein, 13 aa, Mycobacterium tuberculosis
GANINQLMTLQDY

SEQ ID NO: 110683 - protein, 13 aa, Mycobacterium tuberculosis
ANINQLMTLQDYL

SEQ ID NO: 110684 - protein, 13 aa, Mycobacterium tuberculosis
NINQLMTLQDYLA

SEQ ID NO: 110685 - protein, 13 aa, Mycobacterium tuberculosis
INQLMTLQDYLAT

SEQ ID NO: 110686 - protein, 13 aa, Mycobacterium tuberculosis
NQLMTLQDYLATV

SEQ ID NO: 110687 - protein, 13 aa, Mycobacterium tuberculosis
QLMTLQDYLATVI

SEQ ID NO: 110688 - protein, 13 aa, Mycobacterium tuberculosis
LMTLQDYLATVIT

SEQ ID NO: 110689 - protein, 13 aa, Mycobacterium tuberculosis
MTLQDYLATVITW

SEQ ID NO: 110690 - protein, 13 aa, Mycobacterium tuberculosis
TLQDYLATVITWH

SEQ ID NO: 110691 - protein, 13 aa, Mycobacterium tuberculosis
LQDYLATVITWHR

SEQ ID NO: 110692 - protein, 13 aa, Mycobacterium tuberculosis
QDYLATVITWHRH

SEQ ID NO: 110693 - protein, 13 aa, Mycobacterium tuberculosis
DYLATVITWHRHI

SEQ ID NO: 110694 - protein, 13 aa, Mycobacterium tuberculosis
YLATVITWHRHIA

SEQ ID NO: 110695 - protein, 13 aa, Mycobacterium tuberculosis
LATVITWHRHIAG

SEQ ID NO: 110696 - protein, 13 aa, Mycobacterium tuberculosis
ATVITWHRHIAGL

SEQ ID NO: 110697 - protein, 13 aa, Mycobacterium tuberculosis
TVITWHRHIAGLI

SEQ ID NO: 110698 - protein, 13 aa, Mycobacterium tuberculosis
VITWHRHIAGLIE

SEQ ID NO: 110699 - protein, 13 aa, Mycobacterium tuberculosis
ITWHRHIAGLIEQ

SEQ ID NO: 110700 - protein, 13 aa, Mycobacterium tuberculosis
TWHRHIAGLIEQA

SEQ ID NO: 110701 - protein, 13 aa, Mycobacterium tuberculosis
WHRHIAGLIEQAK

SEQ ID NO: 110702 - protein, 13 aa, Mycobacterium tuberculosis
HRHIAGLIEQAKS

SEQ ID NO: 110703 - protein, 13 aa, Mycobacterium tuberculosis
RHIAGLIEQAKSD

SEQ ID NO: 110704 - protein, 13 aa, Mycobacterium tuberculosis
HIAGLIEQAKSDI

SEQ ID NO: 110705 - protein, 13 aa, Mycobacterium tuberculosis
IAGLIEQAKSDIG

SEQ ID NO: 110706 - protein, 13 aa, Mycobacterium tuberculosis
AGLIEQAKSDIGN

SEQ ID NO: 110707 - protein, 13 aa, Mycobacterium tuberculosis
GLIEQAKSDIGNN

SEQ ID NO: 110708 - protein, 13 aa, Mycobacterium tuberculosis
LIEQAKSDIGNNV

SEQ ID NO: 110709 - protein, 13 aa, Mycobacterium tuberculosis
IEQAKSDIGNNVD

SEQ ID NO: 110710 - protein, 13 aa, Mycobacterium tuberculosis
EQAKSDIGNNVDG

SEQ ID NO: 110711 - protein, 13 aa, Mycobacterium tuberculosis
QAKSDIGNNVDGA

SEQ ID NO: 110712 - protein, 13 aa, Mycobacterium tuberculosis
AKSDIGNNVDGAQ

SEQ ID NO: 110713 - protein, 13 aa, Mycobacterium tuberculosis
KSDIGNNVDGAQR

SEQ ID NO: 110714 - protein, 13 aa, Mycobacterium tuberculosis
SDIGNNVDGAQRE

SEQ ID NO: 110715 - protein, 13 aa, Mycobacterium tuberculosis
DIGNNVDGAQREI

SEQ ID NO: 110716 - protein, 13 aa, Mycobacterium tuberculosis
IGNNVDGAQREID

SEQ ID NO: 110717 - protein, 13 aa, Mycobacterium tuberculosis
GNNVDGAQREIDI

SEQ ID NO: 110718 - protein, 13 aa, Mycobacterium tuberculosis
NNVDGAQREIDIL

SEQ ID NO: 110719 - protein, 13 aa, Mycobacterium tuberculosis
NVDGAQREIDILE

SEQ ID NO: 110720 - protein, 13 aa, Mycobacterium tuberculosis
VDGAQREIDILEN

SEQ ID NO: 110721 - protein, 13 aa, Mycobacterium tuberculosis
DGAQREIDILEND

SEQ ID NO: 110722 - protein, 13 aa, Mycobacterium tuberculosis
GAQREIDILENDP

SEQ ID NO: 110723 - protein, 13 aa, Mycobacterium tuberculosis
AQREIDILENDPS

SEQ ID NO: 110724 - protein, 13 aa, Mycobacterium tuberculosis
QREIDILENDPSL

SEQ ID NO: 110725 - protein, 13 aa, Mycobacterium tuberculosis
REIDILENDPSLD

SEQ ID NO: 110726 - protein, 13 aa, Mycobacterium tuberculosis
EIDILENDPSLDA

SEQ ID NO: 110727 - protein, 13 aa, Mycobacterium tuberculosis
IDILENDPSLDAD

SEQ ID NO: 110728 - protein, 13 aa, Mycobacterium tuberculosis
DILENDPSLDADE

SEQ ID NO: 110729 - protein, 13 aa, Mycobacterium tuberculosis
ILENDPSLDADER

SEQ ID NO: 110730 - protein, 13 aa, Mycobacterium tuberculosis
LENDPSLDADERH

SEQ ID NO: 110731 - protein, 13 aa, Mycobacterium tuberculosis
ENDPSLDADERHT

SEQ ID NO: 110732 - protein, 13 aa, Mycobacterium tuberculosis
NDPSLDADERHTA

SEQ ID NO: 110733 - protein, 13 aa, Mycobacterium tuberculosis
DPSLDADERHTAI

SEQ ID NO: 110734 - protein, 13 aa, Mycobacterium tuberculosis
PSLDADERHTAIN

SEQ ID NO: 110735 - protein, 13 aa, Mycobacterium tuberculosis
SLDADERHTAINS

SEQ ID NO: 110736 - protein, 13 aa, Mycobacterium tuberculosis
LDADERHTAINSL

SEQ ID NO: 110737 - protein, 13 aa, Mycobacterium tuberculosis
DADERHTAINSLV

SEQ ID NO: 110738 - protein, 13 aa, Mycobacterium tuberculosis
ADERHTAINSLVT

SEQ ID NO: 110739 - protein, 13 aa, Mycobacterium tuberculosis
DERHTAINSLVTA

SEQ ID NO: 110740 - protein, 13 aa, Mycobacterium tuberculosis
ERHTAINSLVTAT

SEQ ID NO: 110741 - protein, 13 aa, Mycobacterium tuberculosis
RHTAINSLVTATH

SEQ ID NO: 110742 - protein, 13 aa, Mycobacterium tuberculosis
HTAINSLVTATHG

SEQ ID NO: 110743 - protein, 13 aa, Mycobacterium tuberculosis
TAINSLVTATHGA

SEQ ID NO: 110744 - protein, 13 aa, Mycobacterium tuberculosis
AINSLVTATHGAN

SEQ ID NO: 110745 - protein, 13 aa, Mycobacterium tuberculosis
INSLVTATHGANV

SEQ ID NO: 110746 - protein, 13 aa, Mycobacterium tuberculosis
NSLVTATHGANVS

SEQ ID NO: 110747 - protein, 13 aa, Mycobacterium tuberculosis
SLVTATHGANVSL

SEQ ID NO: 110748 - protein, 13 aa, Mycobacterium tuberculosis
LVTATHGANVSLV

SEQ ID NO: 110749 - protein, 13 aa, Mycobacterium tuberculosis
VTATHGANVSLVA

SEQ ID NO: 110750 - protein, 13 aa, Mycobacterium tuberculosis
TATHGANVSLVAE

SEQ ID NO: 110751 - protein, 13 aa, Mycobacterium tuberculosis
ATHGANVSLVAET

SEQ ID NO: 110752 - protein, 13 aa, Mycobacterium tuberculosis
THGANVSLVAETA

SEQ ID NO: 110753 - protein, 13 aa, Mycobacterium tuberculosis
HGANVSLVAETAE

SEQ ID NO: 110754 - protein, 13 aa, Mycobacterium tuberculosis
GANVSLVAETAER

SEQ ID NO: 110755 - protein, 13 aa, Mycobacterium tuberculosis
ANVSLVAETAERV

SEQ ID NO: 110756 - protein, 13 aa, Mycobacterium tuberculosis
NVSLVAETAERVL

SEQ ID NO: 110757 - protein, 13 aa, Mycobacterium tuberculosis
VSLVAETAERVLE

SEQ ID NO: 110758 - protein, 13 aa, Mycobacterium tuberculosis
SLVAETAERVLES

SEQ ID NO: 110759 - protein, 13 aa, Mycobacterium tuberculosis
LVAETAERVLESK

SEQ ID NO: 110760 - protein, 13 aa, Mycobacterium tuberculosis
VAETAERVLESKN

SEQ ID NO: 110761 - protein, 13 aa, Mycobacterium tuberculosis
AETAERVLESKNW

SEQ ID NO: 110762 - protein, 13 aa, Mycobacterium tuberculosis
ETAERVLESKNWK

SEQ ID NO: 110763 - protein, 13 aa, Mycobacterium tuberculosis
TAERVLESKNWKP

SEQ ID NO: 110764 - protein, 13 aa, Mycobacterium tuberculosis
AERVLESKNWKPP

SEQ ID NO: 110765 - protein, 13 aa, Mycobacterium tuberculosis
ERVLESKNWKPPK

SEQ ID NO: 110766 - protein, 13 aa, Mycobacterium tuberculosis
RVLESKNWKPPKN

SEQ ID NO: 110767 - protein, 13 aa, Mycobacterium tuberculosis
VLESKNWKPPKNA

SEQ ID NO: 110768 - protein, 13 aa, Mycobacterium tuberculosis
LESKNWKPPKNAL

SEQ ID NO: 110769 - protein, 13 aa, Mycobacterium tuberculosis
ESKNWKPPKNALE

SEQ ID NO: 110770 - protein, 13 aa, Mycobacterium tuberculosis
SKNWKPPKNALED

SEQ ID NO: 110771 - protein, 13 aa, Mycobacterium tuberculosis
KNWKPPKNALEDL

SEQ ID NO: 110772 - protein, 13 aa, Mycobacterium tuberculosis
NWKPPKNALEDLL

SEQ ID NO: 110773 - protein, 13 aa, Mycobacterium tuberculosis
WKPPKNALEDLLQ

SEQ ID NO: 110774 - protein, 13 aa, Mycobacterium tuberculosis
KPPKNALEDLLQQ

SEQ ID NO: 110775 - protein, 13 aa, Mycobacterium tuberculosis
PPKNALEDLLQQK

SEQ ID NO: 110776 - protein, 13 aa, Mycobacterium tuberculosis
PKNALEDLLQQKS

SEQ ID NO: 110777 - protein, 13 aa, Mycobacterium tuberculosis
KNALEDLLQQKSP

SEQ ID NO: 110778 - protein, 13 aa, Mycobacterium tuberculosis
NALEDLLQQKSPP

SEQ ID NO: 110779 - protein, 13 aa, Mycobacterium tuberculosis
ALEDLLQQKSPPP

SEQ ID NO: 110780 - protein, 13 aa, Mycobacterium tuberculosis
LEDLLQQKSPPPP

SEQ ID NO: 110781 - protein, 13 aa, Mycobacterium tuberculosis
EDLLQQKSPPPPD

SEQ ID NO: 110782 - protein, 13 aa, Mycobacterium tuberculosis
DLLQQKSPPPPDV

SEQ ID NO: 110783 - protein, 13 aa, Mycobacterium tuberculosis
LLQQKSPPPPDVP

SEQ ID NO: 110784 - protein, 13 aa, Mycobacterium tuberculosis
LQQKSPPPPDVPT

SEQ ID NO: 110785 - protein, 13 aa, Mycobacterium tuberculosis
QQKSPPPPDVPTL

SEQ ID NO: 110786 - protein, 13 aa, Mycobacterium tuberculosis
QKSPPPPDVPTLV

SEQ ID NO: 110787 - protein, 13 aa, Mycobacterium tuberculosis
KSPPPPDVPTLVV

SEQ ID NO: 110788 - protein, 13 aa, Mycobacterium tuberculosis
SPPPPDVPTLVVP

SEQ ID NO: 110789 - protein, 13 aa, Mycobacterium tuberculosis
PPPPDVPTLVVPS

SEQ ID NO: 110790 - protein, 13 aa, Mycobacterium tuberculosis
PPPDVPTLVVPSP

SEQ ID NO: 110791 - protein, 13 aa, Mycobacterium tuberculosis
PPDVPTLVVPSPG

SEQ ID NO: 110792 - protein, 13 aa, Mycobacterium tuberculosis
PDVPTLVVPSPGT

SEQ ID NO: 110793 - protein, 13 aa, Mycobacterium tuberculosis
DVPTLVVPSPGTP

SEQ ID NO: 110794 - protein, 13 aa, Mycobacterium tuberculosis
VPTLVVPSPGTPG

SEQ ID NO: 110795 - protein, 13 aa, Mycobacterium tuberculosis
PTLVVPSPGTPGT

SEQ ID NO: 110796 - protein, 13 aa, Mycobacterium tuberculosis
TLVVPSPGTPGTP

SEQ ID NO: 110797 - protein, 13 aa, Mycobacterium tuberculosis
LVVPSPGTPGTPG

SEQ ID NO: 110798 - protein, 13 aa, Mycobacterium tuberculosis
VVPSPGTPGTPGT

SEQ ID NO: 110799 - protein, 13 aa, Mycobacterium tuberculosis
VPSPGTPGTPGTP

SEQ ID NO: 110800 - protein, 13 aa, Mycobacterium tuberculosis
PSPGTPGTPGTPI

SEQ ID NO: 110801 - protein, 13 aa, Mycobacterium tuberculosis
SPGTPGTPGTPIT

SEQ ID NO: 110802 - protein, 13 aa, Mycobacterium tuberculosis
PGTPGTPGTPITP

SEQ ID NO: 110803 - protein, 13 aa, Mycobacterium tuberculosis
GTPGTPGTPITPG

SEQ ID NO: 110804 - protein, 13 aa, Mycobacterium tuberculosis
TPGTPGTPITPGT

SEQ ID NO: 110805 - protein, 13 aa, Mycobacterium tuberculosis
PGTPGTPITPGTP

SEQ ID NO: 110806 - protein, 13 aa, Mycobacterium tuberculosis
GTPGTPITPGTPI

SEQ ID NO: 110807 - protein, 13 aa, Mycobacterium tuberculosis
TPGTPITPGTPIT

SEQ ID NO: 110808 - protein, 13 aa, Mycobacterium tuberculosis
PGTPITPGTPITP

SEQ ID NO: 110809 - protein, 13 aa, Mycobacterium tuberculosis
GTPITPGTPITPG

SEQ ID NO: 110810 - protein, 13 aa, Mycobacterium tuberculosis
TPITPGTPITPGT

SEQ ID NO: 110811 - protein, 13 aa, Mycobacterium tuberculosis
PITPGTPITPGTP

SEQ ID NO: 110812 - protein, 13 aa, Mycobacterium tuberculosis
ITPGTPITPGTPI

SEQ ID NO: 110813 - protein, 13 aa, Mycobacterium tuberculosis
TPGTPITPGTPIT

SEQ ID NO: 110814 - protein, 13 aa, Mycobacterium tuberculosis
PGTPITPGTPITP

SEQ ID NO: 110815 - protein, 13 aa, Mycobacterium tuberculosis
GTPITPGTPITPI

SEQ ID NO: 110816 - protein, 13 aa, Mycobacterium tuberculosis
TPITPGTPITPIP

SEQ ID NO: 110817 - protein, 13 aa, Mycobacterium tuberculosis
PITPGTPITPIPG

SEQ ID NO: 110818 - protein, 13 aa, Mycobacterium tuberculosis
ITPGTPITPIPGA

SEQ ID NO: 110819 - protein, 13 aa, Mycobacterium tuberculosis
TPGTPITPIPGAP

SEQ ID NO: 110820 - protein, 13 aa, Mycobacterium tuberculosis
PGTPITPIPGAPV

SEQ ID NO: 110821 - protein, 13 aa, Mycobacterium tuberculosis
GTPITPIPGAPVT

SEQ ID NO: 110822 - protein, 13 aa, Mycobacterium tuberculosis
TPITPIPGAPVTP

SEQ ID NO: 110823 - protein, 13 aa, Mycobacterium tuberculosis
PITPIPGAPVTPI

SEQ ID NO: 110824 - protein, 13 aa, Mycobacterium tuberculosis
ITPIPGAPVTPIT

SEQ ID NO: 110825 - protein, 13 aa, Mycobacterium tuberculosis
TPIPGAPVTPITP

SEQ ID NO: 110826 - protein, 13 aa, Mycobacterium tuberculosis
PIPGAPVTPITPT

SEQ ID NO: 110827 - protein, 13 aa, Mycobacterium tuberculosis
IPGAPVTPITPTP

SEQ ID NO: 110828 - protein, 13 aa, Mycobacterium tuberculosis
PGAPVTPITPTPG

SEQ ID NO: 110829 - protein, 13 aa, Mycobacterium tuberculosis
GAPVTPITPTPGT

SEQ ID NO: 110830 - protein, 13 aa, Mycobacterium tuberculosis
APVTPITPTPGTP

SEQ ID NO: 110831 - protein, 13 aa, Mycobacterium tuberculosis
PVTPITPTPGTPV

SEQ ID NO: 110832 - protein, 13 aa, Mycobacterium tuberculosis
VTPITPTPGTPVT

SEQ ID NO: 110833 - protein, 13 aa, Mycobacterium tuberculosis
TPITPTPGTPVTP

SEQ ID NO: 110834 - protein, 13 aa, Mycobacterium tuberculosis
PITPTPGTPVTPV

SEQ ID NO: 110835 - protein, 13 aa, Mycobacterium tuberculosis
ITPTPGTPVTPVT

SEQ ID NO: 110836 - protein, 13 aa, Mycobacterium tuberculosis
TPTPGTPVTPVTP

SEQ ID NO: 110837 - protein, 13 aa, Mycobacterium tuberculosis
PTPGTPVTPVTPG

SEQ ID NO: 110838 - protein, 13 aa, Mycobacterium tuberculosis
TPGTPVTPVTPGK

SEQ ID NO: 110839 - protein, 13 aa, Mycobacterium tuberculosis
PGTPVTPVTPGKP

SEQ ID NO: 110840 - protein, 13 aa, Mycobacterium tuberculosis
GTPVTPVTPGKPV

SEQ ID NO: 110841 - protein, 13 aa, Mycobacterium tuberculosis
TPVTPVTPGKPVT

SEQ ID NO: 110842 - protein, 13 aa, Mycobacterium tuberculosis
PVTPVTPGKPVTP

SEQ ID NO: 110843 - protein, 13 aa, Mycobacterium tuberculosis
VTPVTPGKPVTPV

SEQ ID NO: 110844 - protein, 13 aa, Mycobacterium tuberculosis
TPVTPGKPVTPVT

SEQ ID NO: 110845 - protein, 13 aa, Mycobacterium tuberculosis
PVTPGKPVTPVTP

SEQ ID NO: 110846 - protein, 13 aa, Mycobacterium tuberculosis
VTPGKPVTPVTPV

SEQ ID NO: 110847 - protein, 13 aa, Mycobacterium tuberculosis
TPGKPVTPVTPVK

SEQ ID NO: 110848 - protein, 13 aa, Mycobacterium tuberculosis
PGKPVTPVTPVKP

SEQ ID NO: 110849 - protein, 13 aa, Mycobacterium tuberculosis
GKPVTPVTPVKPG

SEQ ID NO: 110850 - protein, 13 aa, Mycobacterium tuberculosis
KPVTPVTPVKPGT

SEQ ID NO: 110851 - protein, 13 aa, Mycobacterium tuberculosis
PVTPVTPVKPGTP

SEQ ID NO: 110852 - protein, 13 aa, Mycobacterium tuberculosis
VTPVTPVKPGTPG

SEQ ID NO: 110853 - protein, 13 aa, Mycobacterium tuberculosis
TPVTPVKPGTPGE

SEQ ID NO: 110854 - protein, 13 aa, Mycobacterium tuberculosis
PVTPVKPGTPGEP

SEQ ID NO: 110855 - protein, 13 aa, Mycobacterium tuberculosis
VTPVKPGTPGEPT

SEQ ID NO: 110856 - protein, 13 aa, Mycobacterium tuberculosis
TPVKPGTPGEPTP

SEQ ID NO: 110857 - protein, 13 aa, Mycobacterium tuberculosis
PVKPGTPGEPTPI

SEQ ID NO: 110858 - protein, 13 aa, Mycobacterium tuberculosis
VKPGTPGEPTPIT

SEQ ID NO: 110859 - protein, 13 aa, Mycobacterium tuberculosis
KPGTPGEPTPITP

SEQ ID NO: 110860 - protein, 13 aa, Mycobacterium tuberculosis
PGTPGEPTPITPV

SEQ ID NO: 110861 - protein, 13 aa, Mycobacterium tuberculosis
GTPGEPTPITPVT

SEQ ID NO: 110862 - protein, 13 aa, Mycobacterium tuberculosis
TPGEPTPITPVTP

SEQ ID NO: 110863 - protein, 13 aa, Mycobacterium tuberculosis
PGEPTPITPVTPP

SEQ ID NO: 110864 - protein, 13 aa, Mycobacterium tuberculosis
GEPTPITPVTPPV

SEQ ID NO: 110865 - protein, 13 aa, Mycobacterium tuberculosis
EPTPITPVTPPVA

SEQ ID NO: 110866 - protein, 13 aa, Mycobacterium tuberculosis
PTPITPVTPPVAP

SEQ ID NO: 110867 - protein, 13 aa, Mycobacterium tuberculosis
TPITPVTPPVAPA

SEQ ID NO: 110868 - protein, 13 aa, Mycobacterium tuberculosis
PITPVTPPVAPAT

SEQ ID NO: 110869 - protein, 13 aa, Mycobacterium tuberculosis
ITPVTPPVAPATP

SEQ ID NO: 110870 - protein, 13 aa, Mycobacterium tuberculosis
TPVTPPVAPATPA

SEQ ID NO: 110871 - protein, 13 aa, Mycobacterium tuberculosis
PVTPPVAPATPAT

SEQ ID NO: 110872 - protein, 13 aa, Mycobacterium tuberculosis
VTPPVAPATPATP

SEQ ID NO: 110873 - protein, 13 aa, Mycobacterium tuberculosis
TPPVAPATPATPA

SEQ ID NO: 110874 - protein, 13 aa, Mycobacterium tuberculosis
PPVAPATPATPAT

SEQ ID NO: 110875 - protein, 13 aa, Mycobacterium tuberculosis
PVAPATPATPATP

SEQ ID NO: 110876 - protein, 13 aa, Mycobacterium tuberculosis
VAPATPATPATPV

SEQ ID NO: 110877 - protein, 13 aa, Mycobacterium tuberculosis
APATPATPATPVT

SEQ ID NO: 110878 - protein, 13 aa, Mycobacterium tuberculosis
PATPATPATPVTP

SEQ ID NO: 110879 - protein, 13 aa, Mycobacterium tuberculosis
ATPATPATPVTPA

SEQ ID NO: 110880 - protein, 13 aa, Mycobacterium tuberculosis
TPATPATPVTPAP

SEQ ID NO: 110881 - protein, 13 aa, Mycobacterium tuberculosis
PATPATPVTPAPA

SEQ ID NO: 110882 - protein, 13 aa, Mycobacterium tuberculosis
ATPATPVTPAPAP

SEQ ID NO: 110883 - protein, 13 aa, Mycobacterium tuberculosis
TPATPVTPAPAPH

SEQ ID NO: 110884 - protein, 13 aa, Mycobacterium tuberculosis
PATPVTPAPAPHP

SEQ ID NO: 110885 - protein, 13 aa, Mycobacterium tuberculosis
ATPVTPAPAPHPQ

SEQ ID NO: 110886 - protein, 13 aa, Mycobacterium tuberculosis
TPVTPAPAPHPQP

SEQ ID NO: 110887 - protein, 13 aa, Mycobacterium tuberculosis
PVTPAPAPHPQPA

SEQ ID NO: 110888 - protein, 13 aa, Mycobacterium tuberculosis
VTPAPAPHPQPAP

SEQ ID NO: 110889 - protein, 13 aa, Mycobacterium tuberculosis
TPAPAPHPQPAPA

SEQ ID NO: 110890 - protein, 13 aa, Mycobacterium tuberculosis
PAPAPHPQPAPAP

SEQ ID NO: 110891 - protein, 13 aa, Mycobacterium tuberculosis
APAPHPQPAPAPA

SEQ ID NO: 110892 - protein, 13 aa, Mycobacterium tuberculosis
PAPHPQPAPAPAP

SEQ ID NO: 110893 - protein, 13 aa, Mycobacterium tuberculosis
APHPQPAPAPAPS

SEQ ID NO: 110894 - protein, 13 aa, Mycobacterium tuberculosis
PHPQPAPAPAPSP

SEQ ID NO: 110895 - protein, 13 aa, Mycobacterium tuberculosis
HPQPAPAPAPSPG

SEQ ID NO: 110896 - protein, 13 aa, Mycobacterium tuberculosis
PQPAPAPAPSPGP

SEQ ID NO: 110897 - protein, 13 aa, Mycobacterium tuberculosis
QPAPAPAPSPGPQ

SEQ ID NO: 110898 - protein, 13 aa, Mycobacterium tuberculosis
PAPAPAPSPGPQP

SEQ ID NO: 110899 - protein, 13 aa, Mycobacterium tuberculosis
APAPAPSPGPQPV

SEQ ID NO: 110900 - protein, 13 aa, Mycobacterium tuberculosis
PAPAPSPGPQPVT

SEQ ID NO: 110901 - protein, 13 aa, Mycobacterium tuberculosis
APAPSPGPQPVTP

SEQ ID NO: 110902 - protein, 13 aa, Mycobacterium tuberculosis
PAPSPGPQPVTPA

SEQ ID NO: 110903 - protein, 13 aa, Mycobacterium tuberculosis
APSPGPQPVTPAT

SEQ ID NO: 110904 - protein, 13 aa, Mycobacterium tuberculosis
PSPGPQPVTPATP

SEQ ID NO: 110905 - protein, 13 aa, Mycobacterium tuberculosis
SPGPQPVTPATPG

SEQ ID NO: 110906 - protein, 13 aa, Mycobacterium tuberculosis
PGPQPVTPATPGP

SEQ ID NO: 110907 - protein, 13 aa, Mycobacterium tuberculosis
GPQPVTPATPGPS

SEQ ID NO: 110908 - protein, 13 aa, Mycobacterium tuberculosis
PQPVTPATPGPSG

SEQ ID NO: 110909 - protein, 13 aa, Mycobacterium tuberculosis
QPVTPATPGPSGP

SEQ ID NO: 110910 - protein, 13 aa, Mycobacterium tuberculosis
PVTPATPGPSGPA

SEQ ID NO: 110911 - protein, 13 aa, Mycobacterium tuberculosis
VTPATPGPSGPAT

SEQ ID NO: 110912 - protein, 13 aa, Mycobacterium tuberculosis
TPATPGPSGPATP

SEQ ID NO: 110913 - protein, 13 aa, Mycobacterium tuberculosis
PATPGPSGPATPG

SEQ ID NO: 110914 - protein, 13 aa, Mycobacterium tuberculosis
ATPGPSGPATPGT

SEQ ID NO: 110915 - protein, 13 aa, Mycobacterium tuberculosis
TPGPSGPATPGTP

SEQ ID NO: 110916 - protein, 13 aa, Mycobacterium tuberculosis
PGPSGPATPGTPG

SEQ ID NO: 110917 - protein, 13 aa, Mycobacterium tuberculosis
GPSGPATPGTPGG

SEQ ID NO: 110918 - protein, 13 aa, Mycobacterium tuberculosis
PSGPATPGTPGGE

SEQ ID NO: 110919 - protein, 13 aa, Mycobacterium tuberculosis
SGPATPGTPGGEP

SEQ ID NO: 110920 - protein, 13 aa, Mycobacterium tuberculosis
GPATPGTPGGEPA

SEQ ID NO: 110921 - protein, 13 aa, Mycobacterium tuberculosis
PATPGTPGGEPAP

SEQ ID NO: 110922 - protein, 13 aa, Mycobacterium tuberculosis
ATPGTPGGEPAPH

SEQ ID NO: 110923 - protein, 13 aa, Mycobacterium tuberculosis
TPGTPGGEPAPHV

SEQ ID NO: 110924 - protein, 13 aa, Mycobacterium tuberculosis
PGTPGGEPAPHVK

SEQ ID NO: 110925 - protein, 13 aa, Mycobacterium tuberculosis
GTPGGEPAPHVKP

SEQ ID NO: 110926 - protein, 13 aa, Mycobacterium tuberculosis
TPGGEPAPHVKPA

SEQ ID NO: 110927 - protein, 13 aa, Mycobacterium tuberculosis
PGGEPAPHVKPAA

SEQ ID NO: 110928 - protein, 13 aa, Mycobacterium tuberculosis
GGEPAPHVKPAAL

SEQ ID NO: 110929 - protein, 13 aa, Mycobacterium tuberculosis
GEPAPHVKPAALA

SEQ ID NO: 110930 - protein, 13 aa, Mycobacterium tuberculosis
EPAPHVKPAALAE

SEQ ID NO: 110931 - protein, 13 aa, Mycobacterium tuberculosis
PAPHVKPAALAEQ

SEQ ID NO: 110932 - protein, 13 aa, Mycobacterium tuberculosis
APHVKPAALAEQP

SEQ ID NO: 110933 - protein, 13 aa, Mycobacterium tuberculosis
PHVKPAALAEQPG

SEQ ID NO: 110934 - protein, 13 aa, Mycobacterium tuberculosis
HVKPAALAEQPGV

SEQ ID NO: 110935 - protein, 13 aa, Mycobacterium tuberculosis
VKPAALAEQPGVP

SEQ ID NO: 110936 - protein, 13 aa, Mycobacterium tuberculosis
KPAALAEQPGVPG

SEQ ID NO: 110937 - protein, 13 aa, Mycobacterium tuberculosis
PAALAEQPGVPGQ

SEQ ID NO: 110938 - protein, 13 aa, Mycobacterium tuberculosis
AALAEQPGVPGQH

SEQ ID NO: 110939 - protein, 13 aa, Mycobacterium tuberculosis
ALAEQPGVPGQHA

SEQ ID NO: 110940 - protein, 13 aa, Mycobacterium tuberculosis
LAEQPGVPGQHAG

SEQ ID NO: 110941 - protein, 13 aa, Mycobacterium tuberculosis
AEQPGVPGQHAGG

SEQ ID NO: 110942 - protein, 13 aa, Mycobacterium tuberculosis
EQPGVPGQHAGGG

SEQ ID NO: 110943 - protein, 13 aa, Mycobacterium tuberculosis
QPGVPGQHAGGGT

SEQ ID NO: 110944 - protein, 13 aa, Mycobacterium tuberculosis
PGVPGQHAGGGTQ

SEQ ID NO: 110945 - protein, 13 aa, Mycobacterium tuberculosis
GVPGQHAGGGTQS

SEQ ID NO: 110946 - protein, 13 aa, Mycobacterium tuberculosis
VPGQHAGGGTQSG

SEQ ID NO: 110947 - protein, 13 aa, Mycobacterium tuberculosis
PGQHAGGGTQSGP

SEQ ID NO: 110948 - protein, 13 aa, Mycobacterium tuberculosis
GQHAGGGTQSGPA

SEQ ID NO: 110949 - protein, 13 aa, Mycobacterium tuberculosis
QHAGGGTQSGPAH

SEQ ID NO: 110950 - protein, 13 aa, Mycobacterium tuberculosis
HAGGGTQSGPAHA

SEQ ID NO: 110951 - protein, 13 aa, Mycobacterium tuberculosis
AGGGTQSGPAHAD

SEQ ID NO: 110952 - protein, 13 aa, Mycobacterium tuberculosis
GGGTQSGPAHADE

SEQ ID NO: 110953 - protein, 13 aa, Mycobacterium tuberculosis
GGTQSGPAHADES

SEQ ID NO: 110954 - protein, 13 aa, Mycobacterium tuberculosis
GTQSGPAHADESA

SEQ ID NO: 110955 - protein, 13 aa, Mycobacterium tuberculosis
TQSGPAHADESAA

SEQ ID NO: 110956 - protein, 13 aa, Mycobacterium tuberculosis
QSGPAHADESAAS

SEQ ID NO: 110957 - protein, 13 aa, Mycobacterium tuberculosis
SGPAHADESAASV

SEQ ID NO: 110958 - protein, 13 aa, Mycobacterium tuberculosis
GPAHADESAASVT

SEQ ID NO: 110959 - protein, 13 aa, Mycobacterium tuberculosis
PAHADESAASVTP

SEQ ID NO: 110960 - protein, 13 aa, Mycobacterium tuberculosis
AHADESAASVTPA

SEQ ID NO: 110961 - protein, 13 aa, Mycobacterium tuberculosis
HADESAASVTPAA

SEQ ID NO: 110962 - protein, 13 aa, Mycobacterium tuberculosis
ADESAASVTPAAA

SEQ ID NO: 110963 - protein, 13 aa, Mycobacterium tuberculosis
DESAASVTPAAAS

SEQ ID NO: 110964 - protein, 13 aa, Mycobacterium tuberculosis
ESAASVTPAAASG

SEQ ID NO: 110965 - protein, 13 aa, Mycobacterium tuberculosis
SAASVTPAAASGV

SEQ ID NO: 110966 - protein, 13 aa, Mycobacterium tuberculosis
AASVTPAAASGVP

SEQ ID NO: 110967 - protein, 13 aa, Mycobacterium tuberculosis
ASVTPAAASGVPG

SEQ ID NO: 110968 - protein, 13 aa, Mycobacterium tuberculosis
SVTPAAASGVPGA

SEQ ID NO: 110969 - protein, 13 aa, Mycobacterium tuberculosis
VTPAAASGVPGAR

SEQ ID NO: 110970 - protein, 13 aa, Mycobacterium tuberculosis
TPAAASGVPGARA

SEQ ID NO: 110971 - protein, 13 aa, Mycobacterium tuberculosis
PAAASGVPGARAA

SEQ ID NO: 110972 - protein, 13 aa, Mycobacterium tuberculosis
AAASGVPGARAAA

SEQ ID NO: 110973 - protein, 13 aa, Mycobacterium tuberculosis
AASGVPGARAAAA

SEQ ID NO: 110974 - protein, 13 aa, Mycobacterium tuberculosis
ASGVPGARAAAAA

SEQ ID NO: 110975 - protein, 13 aa, Mycobacterium tuberculosis
SGVPGARAAAAAP

SEQ ID NO: 110976 - protein, 13 aa, Mycobacterium tuberculosis
GVPGARAAAAAPS

SEQ ID NO: 110977 - protein, 13 aa, Mycobacterium tuberculosis
VPGARAAAAAPSG

SEQ ID NO: 110978 - protein, 13 aa, Mycobacterium tuberculosis
PGARAAAAAPSGT

SEQ ID NO: 110979 - protein, 13 aa, Mycobacterium tuberculosis
GARAAAAAPSGTA

SEQ ID NO: 110980 - protein, 13 aa, Mycobacterium tuberculosis
ARAAAAAPSGTAV

SEQ ID NO: 110981 - protein, 13 aa, Mycobacterium tuberculosis
RAAAAAPSGTAVG

SEQ ID NO: 110982 - protein, 13 aa, Mycobacterium tuberculosis
AAAAAPSGTAVGA

SEQ ID NO: 110983 - protein, 13 aa, Mycobacterium tuberculosis
AAAAPSGTAVGAG

SEQ ID NO: 110984 - protein, 13 aa, Mycobacterium tuberculosis
AAAPSGTAVGAGA

SEQ ID NO: 110985 - protein, 13 aa, Mycobacterium tuberculosis
AAPSGTAVGAGAR

SEQ ID NO: 110986 - protein, 13 aa, Mycobacterium tuberculosis
APSGTAVGAGARS

SEQ ID NO: 110987 - protein, 13 aa, Mycobacterium tuberculosis
PSGTAVGAGARSS

SEQ ID NO: 110988 - protein, 13 aa, Mycobacterium tuberculosis
SGTAVGAGARSSV

SEQ ID NO: 110989 - protein, 13 aa, Mycobacterium tuberculosis
GTAVGAGARSSVG

SEQ ID NO: 110990 - protein, 13 aa, Mycobacterium tuberculosis
TAVGAGARSSVGT

SEQ ID NO: 110991 - protein, 13 aa, Mycobacterium tuberculosis
AVGAGARSSVGTA

SEQ ID NO: 110992 - protein, 13 aa, Mycobacterium tuberculosis
VGAGARSSVGTAA

SEQ ID NO: 110993 - protein, 13 aa, Mycobacterium tuberculosis
GAGARSSVGTAAA

SEQ ID NO: 110994 - protein, 13 aa, Mycobacterium tuberculosis
AGARSSVGTAAAS

SEQ ID NO: 110995 - protein, 13 aa, Mycobacterium tuberculosis
GARSSVGTAAASG

SEQ ID NO: 110996 - protein, 13 aa, Mycobacterium tuberculosis
ARSSVGTAAASGA

SEQ ID NO: 110997 - protein, 13 aa, Mycobacterium tuberculosis
RSSVGTAAASGAG

SEQ ID NO: 110998 - protein, 13 aa, Mycobacterium tuberculosis
SSVGTAAASGAGS

SEQ ID NO: 110999 - protein, 13 aa, Mycobacterium tuberculosis
SVGTAAASGAGSH

SEQ ID NO: 111000 - protein, 13 aa, Mycobacterium tuberculosis
VGTAAASGAGSHA

SEQ ID NO: 111001 - protein, 13 aa, Mycobacterium tuberculosis
GTAAASGAGSHAA

SEQ ID NO: 111002 - protein, 13 aa, Mycobacterium tuberculosis
TAAASGAGSHAAT

SEQ ID NO: 111003 - protein, 13 aa, Mycobacterium tuberculosis
AAASGAGSHAATG

SEQ ID NO: 111004 - protein, 13 aa, Mycobacterium tuberculosis
AASGAGSHAATGR

SEQ ID NO: 111005 - protein, 13 aa, Mycobacterium tuberculosis
ASGAGSHAATGRA

SEQ ID NO: 111006 - protein, 13 aa, Mycobacterium tuberculosis
SGAGSHAATGRAP

SEQ ID NO: 111007 - protein, 13 aa, Mycobacterium tuberculosis
GAGSHAATGRAPV

SEQ ID NO: 111008 - protein, 13 aa, Mycobacterium tuberculosis
AGSHAATGRAPVA

SEQ ID NO: 111009 - protein, 13 aa, Mycobacterium tuberculosis
GSHAATGRAPVAT

SEQ ID NO: 111010 - protein, 13 aa, Mycobacterium tuberculosis
SHAATGRAPVATS

SEQ ID NO: 111011 - protein, 13 aa, Mycobacterium tuberculosis
HAATGRAPVATSD

SEQ ID NO: 111012 - protein, 13 aa, Mycobacterium tuberculosis
AATGRAPVATSDK

SEQ ID NO: 111013 - protein, 13 aa, Mycobacterium tuberculosis
ATGRAPVATSDKA

SEQ ID NO: 111014 - protein, 13 aa, Mycobacterium tuberculosis
TGRAPVATSDKAA

SEQ ID NO: 111015 - protein, 13 aa, Mycobacterium tuberculosis
GRAPVATSDKAAA

SEQ ID NO: 111016 - protein, 13 aa, Mycobacterium tuberculosis
RAPVATSDKAAAP

SEQ ID NO: 111017 - protein, 13 aa, Mycobacterium tuberculosis
APVATSDKAAAPS

SEQ ID NO: 111018 - protein, 13 aa, Mycobacterium tuberculosis
PVATSDKAAAPST

SEQ ID NO: 111019 - protein, 13 aa, Mycobacterium tuberculosis
VATSDKAAAPSTR

SEQ ID NO: 111020 - protein, 13 aa, Mycobacterium tuberculosis
ATSDKAAAPSTRA

SEQ ID NO: 111021 - protein, 13 aa, Mycobacterium tuberculosis
TSDKAAAPSTRAA

SEQ ID NO: 111022 - protein, 13 aa, Mycobacterium tuberculosis
SDKAAAPSTRAAS

SEQ ID NO: 111023 - protein, 13 aa, Mycobacterium tuberculosis
DKAAAPSTRAASA

SEQ ID NO: 111024 - protein, 13 aa, Mycobacterium tuberculosis
KAAAPSTRAASAR

SEQ ID NO: 111025 - protein, 13 aa, Mycobacterium tuberculosis
AAAPSTRAASART

SEQ ID NO: 111026 - protein, 13 aa, Mycobacterium tuberculosis
AAPSTRAASARTA

SEQ ID NO: 111027 - protein, 13 aa, Mycobacterium tuberculosis
APSTRAASARTAP

SEQ ID NO: 111028 - protein, 13 aa, Mycobacterium tuberculosis
PSTRAASARTAPP

SEQ ID NO: 111029 - protein, 13 aa, Mycobacterium tuberculosis
STRAASARTAPPA

SEQ ID NO: 111030 - protein, 13 aa, Mycobacterium tuberculosis
TRAASARTAPPAR

SEQ ID NO: 111031 - protein, 13 aa, Mycobacterium tuberculosis
RAASARTAPPARP

SEQ ID NO: 111032 - protein, 13 aa, Mycobacterium tuberculosis
AASARTAPPARPP

SEQ ID NO: 111033 - protein, 13 aa, Mycobacterium tuberculosis
ASARTAPPARPPS

SEQ ID NO: 111034 - protein, 13 aa, Mycobacterium tuberculosis
SARTAPPARPPST

SEQ ID NO: 111035 - protein, 13 aa, Mycobacterium tuberculosis
ARTAPPARPPSTD

SEQ ID NO: 111036 - protein, 13 aa, Mycobacterium tuberculosis
RTAPPARPPSTDH

SEQ ID NO: 111037 - protein, 13 aa, Mycobacterium tuberculosis
TAPPARPPSTDHI

SEQ ID NO: 111038 - protein, 13 aa, Mycobacterium tuberculosis
APPARPPSTDHID

SEQ ID NO: 111039 - protein, 13 aa, Mycobacterium tuberculosis
PPARPPSTDHIDK

SEQ ID NO: 111040 - protein, 13 aa, Mycobacterium tuberculosis
PARPPSTDHIDKP

SEQ ID NO: 111041 - protein, 13 aa, Mycobacterium tuberculosis
ARPPSTDHIDKPD

SEQ ID NO: 111042 - protein, 13 aa, Mycobacterium tuberculosis
RPPSTDHIDKPDR

SEQ ID NO: 111043 - protein, 13 aa, Mycobacterium tuberculosis
PPSTDHIDKPDRS

SEQ ID NO: 111044 - protein, 13 aa, Mycobacterium tuberculosis
PSTDHIDKPDRSE

SEQ ID NO: 111045 - protein, 13 aa, Mycobacterium tuberculosis
STDHIDKPDRSES

SEQ ID NO: 111046 - protein, 13 aa, Mycobacterium tuberculosis
TDHIDKPDRSESA

SEQ ID NO: 111047 - protein, 13 aa, Mycobacterium tuberculosis
DHIDKPDRSESAD

SEQ ID NO: 111048 - protein, 13 aa, Mycobacterium tuberculosis
HIDKPDRSESADD

SEQ ID NO: 111049 - protein, 13 aa, Mycobacterium tuberculosis
IDKPDRSESADDG

SEQ ID NO: 111050 - protein, 13 aa, Mycobacterium tuberculosis
DKPDRSESADDGT

SEQ ID NO: 111051 - protein, 13 aa, Mycobacterium tuberculosis
KPDRSESADDGTP

SEQ ID NO: 111052 - protein, 13 aa, Mycobacterium tuberculosis
PDRSESADDGTPV

SEQ ID NO: 111053 - protein, 13 aa, Mycobacterium tuberculosis
DRSESADDGTPVS

SEQ ID NO: 111054 - protein, 13 aa, Mycobacterium tuberculosis
RSESADDGTPVSM

SEQ ID NO: 111055 - protein, 13 aa, Mycobacterium tuberculosis
SESADDGTPVSMI

SEQ ID NO: 111056 - protein, 13 aa, Mycobacterium tuberculosis
ESADDGTPVSMIP

SEQ ID NO: 111057 - protein, 13 aa, Mycobacterium tuberculosis
SADDGTPVSMIPV

SEQ ID NO: 111058 - protein, 13 aa, Mycobacterium tuberculosis
ADDGTPVSMIPVS

SEQ ID NO: 111059 - protein, 13 aa, Mycobacterium tuberculosis
DDGTPVSMIPVSA

SEQ ID NO: 111060 - protein, 13 aa, Mycobacterium tuberculosis
DGTPVSMIPVSAA

SEQ ID NO: 111061 - protein, 13 aa, Mycobacterium tuberculosis
GTPVSMIPVSAAR

SEQ ID NO: 111062 - protein, 13 aa, Mycobacterium tuberculosis
TPVSMIPVSAARA

SEQ ID NO: 111063 - protein, 13 aa, Mycobacterium tuberculosis
PVSMIPVSAARAA

SEQ ID NO: 111064 - protein, 13 aa, Mycobacterium tuberculosis
VSMIPVSAARAAR

SEQ ID NO: 111065 - protein, 13 aa, Mycobacterium tuberculosis
SMIPVSAARAARD

SEQ ID NO: 111066 - protein, 13 aa, Mycobacterium tuberculosis
MIPVSAARAARDA

SEQ ID NO: 111067 - protein, 13 aa, Mycobacterium tuberculosis
IPVSAARAARDAA

SEQ ID NO: 111068 - protein, 13 aa, Mycobacterium tuberculosis
PVSAARAARDAAT

SEQ ID NO: 111069 - protein, 13 aa, Mycobacterium tuberculosis
VSAARAARDAATA

SEQ ID NO: 111070 - protein, 13 aa, Mycobacterium tuberculosis
SAARAARDAATAA

SEQ ID NO: 111071 - protein, 13 aa, Mycobacterium tuberculosis
AARAARDAATAAA

SEQ ID NO: 111072 - protein, 13 aa, Mycobacterium tuberculosis
ARAARDAATAAAS

SEQ ID NO: 111073 - protein, 13 aa, Mycobacterium tuberculosis
RAARDAATAAASA

SEQ ID NO: 111074 - protein, 13 aa, Mycobacterium tuberculosis
AARDAATAAASAR

SEQ ID NO: 111075 - protein, 13 aa, Mycobacterium tuberculosis
ARDAATAAASARQ

SEQ ID NO: 111076 - protein, 13 aa, Mycobacterium tuberculosis
RDAATAAASARQR

SEQ ID NO: 111077 - protein, 13 aa, Mycobacterium tuberculosis
DAATAAASARQRG

SEQ ID NO: 111078 - protein, 13 aa, Mycobacterium tuberculosis
AATAAASARQRGR

SEQ ID NO: 111079 - protein, 13 aa, Mycobacterium tuberculosis
ATAAASARQRGRG

SEQ ID NO: 111080 - protein, 13 aa, Mycobacterium tuberculosis
TAAASARQRGRGD

SEQ ID NO: 111081 - protein, 13 aa, Mycobacterium tuberculosis
AAASARQRGRGDA

SEQ ID NO: 111082 - protein, 13 aa, Mycobacterium tuberculosis
AASARQRGRGDAL

SEQ ID NO: 111083 - protein, 13 aa, Mycobacterium tuberculosis
ASARQRGRGDALR

SEQ ID NO: 111084 - protein, 13 aa, Mycobacterium tuberculosis
SARQRGRGDALRL

SEQ ID NO: 111085 - protein, 13 aa, Mycobacterium tuberculosis
ARQRGRGDALRLA

SEQ ID NO: 111086 - protein, 13 aa, Mycobacterium tuberculosis
RQRGRGDALRLAR

SEQ ID NO: 111087 - protein, 13 aa, Mycobacterium tuberculosis
QRGRGDALRLARR

SEQ ID NO: 111088 - protein, 13 aa, Mycobacterium tuberculosis
RGRGDALRLARRI

SEQ ID NO: 111089 - protein, 13 aa, Mycobacterium tuberculosis
GRGDALRLARRIA

SEQ ID NO: 111090 - protein, 13 aa, Mycobacterium tuberculosis
RGDALRLARRIAA

SEQ ID NO: 111091 - protein, 13 aa, Mycobacterium tuberculosis
GDALRLARRIAAA

SEQ ID NO: 111092 - protein, 13 aa, Mycobacterium tuberculosis
DALRLARRIAAAL

SEQ ID NO: 111093 - protein, 13 aa, Mycobacterium tuberculosis
ALRLARRIAAALN

SEQ ID NO: 111094 - protein, 13 aa, Mycobacterium tuberculosis
LRLARRIAAALNA

SEQ ID NO: 111095 - protein, 13 aa, Mycobacterium tuberculosis
RLARRIAAALNAS

SEQ ID NO: 111096 - protein, 13 aa, Mycobacterium tuberculosis
LARRIAAALNASD

SEQ ID NO: 111097 - protein, 13 aa, Mycobacterium tuberculosis
ARRIAAALNASDN

SEQ ID NO: 111098 - protein, 13 aa, Mycobacterium tuberculosis
RRIAAALNASDNN

SEQ ID NO: 111099 - protein, 13 aa, Mycobacterium tuberculosis
RIAAALNASDNNA

SEQ ID NO: 111100 - protein, 13 aa, Mycobacterium tuberculosis
IAAALNASDNNAG

SEQ ID NO: 111101 - protein, 13 aa, Mycobacterium tuberculosis
AAALNASDNNAGD

SEQ ID NO: 111102 - protein, 13 aa, Mycobacterium tuberculosis
AALNASDNNAGDY

SEQ ID NO: 111103 - protein, 13 aa, Mycobacterium tuberculosis
ALNASDNNAGDYG

SEQ ID NO: 111104 - protein, 13 aa, Mycobacterium tuberculosis
LNASDNNAGDYGF

SEQ ID NO: 111105 - protein, 13 aa, Mycobacterium tuberculosis
NASDNNAGDYGFF

SEQ ID NO: 111106 - protein, 13 aa, Mycobacterium tuberculosis
ASDNNAGDYGFFW

SEQ ID NO: 111107 - protein, 13 aa, Mycobacterium tuberculosis
SDNNAGDYGFFWI

SEQ ID NO: 111108 - protein, 13 aa, Mycobacterium tuberculosis
DNNAGDYGFFWIT

SEQ ID NO: 111109 - protein, 13 aa, Mycobacterium tuberculosis
NNAGDYGFFWITA

SEQ ID NO: 111110 - protein, 13 aa, Mycobacterium tuberculosis
NAGDYGFFWITAV

SEQ ID NO: 111111 - protein, 13 aa, Mycobacterium tuberculosis
AGDYGFFWITAVT

SEQ ID NO: 111112 - protein, 13 aa, Mycobacterium tuberculosis
GDYGFFWITAVTT

SEQ ID NO: 111113 - protein, 13 aa, Mycobacterium tuberculosis
DYGFFWITAVTTD

SEQ ID NO: 111114 - protein, 13 aa, Mycobacterium tuberculosis
YGFFWITAVTTDG

SEQ ID NO: 111115 - protein, 13 aa, Mycobacterium tuberculosis
GFFWITAVTTDGS

SEQ ID NO: 111116 - protein, 13 aa, Mycobacterium tuberculosis
FFWITAVTTDGSI

SEQ ID NO: 111117 - protein, 13 aa, Mycobacterium tuberculosis
FWITAVTTDGSIV

SEQ ID NO: 111118 - protein, 13 aa, Mycobacterium tuberculosis
WITAVTTDGSIVV

SEQ ID NO: 111119 - protein, 13 aa, Mycobacterium tuberculosis
ITAVTTDGSIVVA

SEQ ID NO: 111120 - protein, 13 aa, Mycobacterium tuberculosis
TAVTTDGSIVVAN

SEQ ID NO: 111121 - protein, 13 aa, Mycobacterium tuberculosis
AVTTDGSIVVANS

SEQ ID NO: 111122 - protein, 13 aa, Mycobacterium tuberculosis
VTTDGSIVVANSY

SEQ ID NO: 111123 - protein, 13 aa, Mycobacterium tuberculosis
TTDGSIVVANSYG

SEQ ID NO: 111124 - protein, 13 aa, Mycobacterium tuberculosis
TDGSIVVANSYGL

SEQ ID NO: 111125 - protein, 13 aa, Mycobacterium tuberculosis
DGSIVVANSYGLA

SEQ ID NO: 111126 - protein, 13 aa, Mycobacterium tuberculosis
GSIVVANSYGLAY

SEQ ID NO: 111127 - protein, 13 aa, Mycobacterium tuberculosis
SIVVANSYGLAYI

SEQ ID NO: 111128 - protein, 13 aa, Mycobacterium tuberculosis
IVVANSYGLAYIP

SEQ ID NO: 111129 - protein, 13 aa, Mycobacterium tuberculosis
VVANSYGLAYIPD

SEQ ID NO: 111130 - protein, 13 aa, Mycobacterium tuberculosis
VANSYGLAYIPDG

SEQ ID NO: 111131 - protein, 13 aa, Mycobacterium tuberculosis
ANSYGLAYIPDGM

SEQ ID NO: 111132 - protein, 13 aa, Mycobacterium tuberculosis
NSYGLAYIPDGME

SEQ ID NO: 111133 - protein, 13 aa, Mycobacterium tuberculosis
SYGLAYIPDGMEL

SEQ ID NO: 111134 - protein, 13 aa, Mycobacterium tuberculosis
YGLAYIPDGMELP

SEQ ID NO: 111135 - protein, 13 aa, Mycobacterium tuberculosis
GLAYIPDGMELPN

SEQ ID NO: 111136 - protein, 13 aa, Mycobacterium tuberculosis
LAYIPDGMELPNK

SEQ ID NO: 111137 - protein, 13 aa, Mycobacterium tuberculosis
AYIPDGMELPNKV

SEQ ID NO: 111138 - protein, 13 aa, Mycobacterium tuberculosis
YIPDGMELPNKVY

SEQ ID NO: 111139 - protein, 13 aa, Mycobacterium tuberculosis
IPDGMELPNKVYL

SEQ ID NO: 111140 - protein, 13 aa, Mycobacterium tuberculosis
PDGMELPNKVYLA

SEQ ID NO: 111141 - protein, 13 aa, Mycobacterium tuberculosis
DGMELPNKVYLAS

SEQ ID NO: 111142 - protein, 13 aa, Mycobacterium tuberculosis
GMELPNKVYLASA

SEQ ID NO: 111143 - protein, 13 aa, Mycobacterium tuberculosis
MELPNKVYLASAD

SEQ ID NO: 111144 - protein, 13 aa, Mycobacterium tuberculosis
ELPNKVYLASADH

SEQ ID NO: 111145 - protein, 13 aa, Mycobacterium tuberculosis
LPNKVYLASADHA

SEQ ID NO: 111146 - protein, 13 aa, Mycobacterium tuberculosis
PNKVYLASADHAI

SEQ ID NO: 111147 - protein, 13 aa, Mycobacterium tuberculosis
NKVYLASADHAIP

SEQ ID NO: 111148 - protein, 13 aa, Mycobacterium tuberculosis
KVYLASADHAIPV

SEQ ID NO: 111149 - protein, 13 aa, Mycobacterium tuberculosis
VYLASADHAIPVD

SEQ ID NO: 111150 - protein, 13 aa, Mycobacterium tuberculosis
YLASADHAIPVDE

SEQ ID NO: 111151 - protein, 13 aa, Mycobacterium tuberculosis
LASADHAIPVDEI

SEQ ID NO: 111152 - protein, 13 aa, Mycobacterium tuberculosis
ASADHAIPVDEIA

SEQ ID NO: 111153 - protein, 13 aa, Mycobacterium tuberculosis
SADHAIPVDEIAR

SEQ ID NO: 111154 - protein, 13 aa, Mycobacterium tuberculosis
ADHAIPVDEIARC

SEQ ID NO: 111155 - protein, 13 aa, Mycobacterium tuberculosis
DHAIPVDEIARCA

SEQ ID NO: 111156 - protein, 13 aa, Mycobacterium tuberculosis
HAIPVDEIARCAT

SEQ ID NO: 111157 - protein, 13 aa, Mycobacterium tuberculosis
AIPVDEIARCATY

SEQ ID NO: 111158 - protein, 13 aa, Mycobacterium tuberculosis
IPVDEIARCATYP

SEQ ID NO: 111159 - protein, 13 aa, Mycobacterium tuberculosis
PVDEIARCATYPV

SEQ ID NO: 111160 - protein, 13 aa, Mycobacterium tuberculosis
VDEIARCATYPVL

SEQ ID NO: 111161 - protein, 13 aa, Mycobacterium tuberculosis
DEIARCATYPVLA

SEQ ID NO: 111162 - protein, 13 aa, Mycobacterium tuberculosis
EIARCATYPVLAV

SEQ ID NO: 111163 - protein, 13 aa, Mycobacterium tuberculosis
IARCATYPVLAVQ

SEQ ID NO: 111164 - protein, 13 aa, Mycobacterium tuberculosis
ARCATYPVLAVQA

SEQ ID NO: 111165 - protein, 13 aa, Mycobacterium tuberculosis
RCATYPVLAVQAW

SEQ ID NO: 111166 - protein, 13 aa, Mycobacterium tuberculosis
CATYPVLAVQAWA

SEQ ID NO: 111167 - protein, 13 aa, Mycobacterium tuberculosis
ATYPVLAVQAWAA

SEQ ID NO: 111168 - protein, 13 aa, Mycobacterium tuberculosis
TYPVLAVQAWAAF

SEQ ID NO: 111169 - protein, 13 aa, Mycobacterium tuberculosis
YPVLAVQAWAAFH

SEQ ID NO: 111170 - protein, 13 aa, Mycobacterium tuberculosis
PVLAVQAWAAFHD

SEQ ID NO: 111171 - protein, 13 aa, Mycobacterium tuberculosis
VLAVQAWAAFHDM

SEQ ID NO: 111172 - protein, 13 aa, Mycobacterium tuberculosis
LAVQAWAAFHDMT

SEQ ID NO: 111173 - protein, 13 aa, Mycobacterium tuberculosis
AVQAWAAFHDMTL

SEQ ID NO: 111174 - protein, 13 aa, Mycobacterium tuberculosis
VQAWAAFHDMTLR

SEQ ID NO: 111175 - protein, 13 aa, Mycobacterium tuberculosis
QAWAAFHDMTLRA

SEQ ID NO: 111176 - protein, 13 aa, Mycobacterium tuberculosis
AWAAFHDMTLRAV

SEQ ID NO: 111177 - protein, 13 aa, Mycobacterium tuberculosis
WAAFHDMTLRAVI

SEQ ID NO: 111178 - protein, 13 aa, Mycobacterium tuberculosis
AAFHDMTLRAVIG

SEQ ID NO: 111179 - protein, 13 aa, Mycobacterium tuberculosis
AFHDMTLRAVIGT

SEQ ID NO: 111180 - protein, 13 aa, Mycobacterium tuberculosis
FHDMTLRAVIGTA

SEQ ID NO: 111181 - protein, 13 aa, Mycobacterium tuberculosis
HDMTLRAVIGTAE

SEQ ID NO: 111182 - protein, 13 aa, Mycobacterium tuberculosis
DMTLRAVIGTAEQ

SEQ ID NO: 111183 - protein, 13 aa, Mycobacterium tuberculosis
MTLRAVIGTAEQL

SEQ ID NO: 111184 - protein, 13 aa, Mycobacterium tuberculosis
TLRAVIGTAEQLA

SEQ ID NO: 111185 - protein, 13 aa, Mycobacterium tuberculosis
LRAVIGTAEQLAS

SEQ ID NO: 111186 - protein, 13 aa, Mycobacterium tuberculosis
RAVIGTAEQLASS

SEQ ID NO: 111187 - protein, 13 aa, Mycobacterium tuberculosis
AVIGTAEQLASSD

SEQ ID NO: 111188 - protein, 13 aa, Mycobacterium tuberculosis
VIGTAEQLASSDP

SEQ ID NO: 111189 - protein, 13 aa, Mycobacterium tuberculosis
IGTAEQLASSDPG

SEQ ID NO: 111190 - protein, 13 aa, Mycobacterium tuberculosis
GTAEQLASSDPGV

SEQ ID NO: 111191 - protein, 13 aa, Mycobacterium tuberculosis
TAEQLASSDPGVA

SEQ ID NO: 111192 - protein, 13 aa, Mycobacterium tuberculosis
AEQLASSDPGVAK

SEQ ID NO: 111193 - protein, 13 aa, Mycobacterium tuberculosis
EQLASSDPGVAKI

SEQ ID NO: 111194 - protein, 13 aa, Mycobacterium tuberculosis
QLASSDPGVAKIV

SEQ ID NO: 111195 - protein, 13 aa, Mycobacterium tuberculosis
LASSDPGVAKIVL

SEQ ID NO: 111196 - protein, 13 aa, Mycobacterium tuberculosis
ASSDPGVAKIVLE

SEQ ID NO: 111197 - protein, 13 aa, Mycobacterium tuberculosis
SSDPGVAKIVLEP

SEQ ID NO: 111198 - protein, 13 aa, Mycobacterium tuberculosis
SDPGVAKIVLEPD

SEQ ID NO: 111199 - protein, 13 aa, Mycobacterium tuberculosis
DPGVAKIVLEPDD

SEQ ID NO: 111200 - protein, 13 aa, Mycobacterium tuberculosis
PGVAKIVLEPDDI

SEQ ID NO: 111201 - protein, 13 aa, Mycobacterium tuberculosis
GVAKIVLEPDDIP

SEQ ID NO: 111202 - protein, 13 aa, Mycobacterium tuberculosis
VAKIVLEPDDIPE

SEQ ID NO: 111203 - protein, 13 aa, Mycobacterium tuberculosis
AKIVLEPDDIPES

SEQ ID NO: 111204 - protein, 13 aa, Mycobacterium tuberculosis
KIVLEPDDIPESG

SEQ ID NO: 111205 - protein, 13 aa, Mycobacterium tuberculosis
IVLEPDDIPESGK

SEQ ID NO: 111206 - protein, 13 aa, Mycobacterium tuberculosis
VLEPDDIPESGKM

SEQ ID NO: 111207 - protein, 13 aa, Mycobacterium tuberculosis
LEPDDIPESGKMT

SEQ ID NO: 111208 - protein, 13 aa, Mycobacterium tuberculosis
EPDDIPESGKMTG

SEQ ID NO: 111209 - protein, 13 aa, Mycobacterium tuberculosis
PDDIPESGKMTGR

SEQ ID NO: 111210 - protein, 13 aa, Mycobacterium tuberculosis
DDIPESGKMTGRS

SEQ ID NO: 111211 - protein, 13 aa, Mycobacterium tuberculosis
DIPESGKMTGRSR

SEQ ID NO: 111212 - protein, 13 aa, Mycobacterium tuberculosis
IPESGKMTGRSRL

SEQ ID NO: 111213 - protein, 13 aa, Mycobacterium tuberculosis
PESGKMTGRSRLE

SEQ ID NO: 111214 - protein, 13 aa, Mycobacterium tuberculosis
ESGKMTGRSRLEV

SEQ ID NO: 111215 - protein, 13 aa, Mycobacterium tuberculosis
SGKMTGRSRLEVV

SEQ ID NO: 111216 - protein, 13 aa, Mycobacterium tuberculosis
GKMTGRSRLEVVD

SEQ ID NO: 111217 - protein, 13 aa, Mycobacterium tuberculosis
KMTGRSRLEVVDP

SEQ ID NO: 111218 - protein, 13 aa, Mycobacterium tuberculosis
MTGRSRLEVVDPS

SEQ ID NO: 111219 - protein, 13 aa, Mycobacterium tuberculosis
TGRSRLEVVDPSA

SEQ ID NO: 111220 - protein, 13 aa, Mycobacterium tuberculosis
GRSRLEVVDPSAA

SEQ ID NO: 111221 - protein, 13 aa, Mycobacterium tuberculosis
RSRLEVVDPSAAA

SEQ ID NO: 111222 - protein, 13 aa, Mycobacterium tuberculosis
SRLEVVDPSAAAQ

SEQ ID NO: 111223 - protein, 13 aa, Mycobacterium tuberculosis
RLEVVDPSAAAQL

SEQ ID NO: 111224 - protein, 13 aa, Mycobacterium tuberculosis
LEVVDPSAAAQLA

SEQ ID NO: 111225 - protein, 13 aa, Mycobacterium tuberculosis
EVVDPSAAAQLAD

SEQ ID NO: 111226 - protein, 13 aa, Mycobacterium tuberculosis
VVDPSAAAQLADT

SEQ ID NO: 111227 - protein, 13 aa, Mycobacterium tuberculosis
VDPSAAAQLADTT

SEQ ID NO: 111228 - protein, 13 aa, Mycobacterium tuberculosis
DPSAAAQLADTTD

SEQ ID NO: 111229 - protein, 13 aa, Mycobacterium tuberculosis
PSAAAQLADTTDQ

SEQ ID NO: 111230 - protein, 13 aa, Mycobacterium tuberculosis
SAAAQLADTTDQR

SEQ ID NO: 111231 - protein, 13 aa, Mycobacterium tuberculosis
AAAQLADTTDQRL

SEQ ID NO: 111232 - protein, 13 aa, Mycobacterium tuberculosis
AAQLADTTDQRLL

SEQ ID NO: 111233 - protein, 13 aa, Mycobacterium tuberculosis
AQLADTTDQRLLD

SEQ ID NO: 111234 - protein, 13 aa, Mycobacterium tuberculosis
QLADTTDQRLLDL

SEQ ID NO: 111235 - protein, 13 aa, Mycobacterium tuberculosis
LADTTDQRLLDLL

SEQ ID NO: 111236 - protein, 13 aa, Mycobacterium tuberculosis
ADTTDQRLLDLLP

SEQ ID NO: 111237 - protein, 13 aa, Mycobacterium tuberculosis
DTTDQRLLDLLPP

SEQ ID NO: 111238 - protein, 13 aa, Mycobacterium tuberculosis
TTDQRLLDLLPPA

SEQ ID NO: 111239 - protein, 13 aa, Mycobacterium tuberculosis
TDQRLLDLLPPAP

SEQ ID NO: 111240 - protein, 13 aa, Mycobacterium tuberculosis
DQRLLDLLPPAPV

SEQ ID NO: 111241 - protein, 13 aa, Mycobacterium tuberculosis
QRLLDLLPPAPVD

SEQ ID NO: 111242 - protein, 13 aa, Mycobacterium tuberculosis
RLLDLLPPAPVDV

SEQ ID NO: 111243 - protein, 13 aa, Mycobacterium tuberculosis
LLDLLPPAPVDVN

SEQ ID NO: 111244 - protein, 13 aa, Mycobacterium tuberculosis
LDLLPPAPVDVNP

SEQ ID NO: 111245 - protein, 13 aa, Mycobacterium tuberculosis
DLLPPAPVDVNPP

SEQ ID NO: 111246 - protein, 13 aa, Mycobacterium tuberculosis
LLPPAPVDVNPPG

SEQ ID NO: 111247 - protein, 13 aa, Mycobacterium tuberculosis
LPPAPVDVNPPGD

SEQ ID NO: 111248 - protein, 13 aa, Mycobacterium tuberculosis
PPAPVDVNPPGDE

SEQ ID NO: 111249 - protein, 13 aa, Mycobacterium tuberculosis
PAPVDVNPPGDER

SEQ ID NO: 111250 - protein, 13 aa, Mycobacterium tuberculosis
APVDVNPPGDERH

SEQ ID NO: 111251 - protein, 13 aa, Mycobacterium tuberculosis
PVDVNPPGDERHM

SEQ ID NO: 111252 - protein, 13 aa, Mycobacterium tuberculosis
VDVNPPGDERHML

SEQ ID NO: 111253 - protein, 13 aa, Mycobacterium tuberculosis
DVNPPGDERHMLW

SEQ ID NO: 111254 - protein, 13 aa, Mycobacterium tuberculosis
VNPPGDERHMLWF

SEQ ID NO: 111255 - protein, 13 aa, Mycobacterium tuberculosis
NPPGDERHMLWFE

SEQ ID NO: 111256 - protein, 13 aa, Mycobacterium tuberculosis
PPGDERHMLWFEL

SEQ ID NO: 111257 - protein, 13 aa, Mycobacterium tuberculosis
PGDERHMLWFELM

SEQ ID NO: 111258 - protein, 13 aa, Mycobacterium tuberculosis
GDERHMLWFELMK

SEQ ID NO: 111259 - protein, 13 aa, Mycobacterium tuberculosis
DERHMLWFELMKP

SEQ ID NO: 111260 - protein, 13 aa, Mycobacterium tuberculosis
ERHMLWFELMKPM

SEQ ID NO: 111261 - protein, 13 aa, Mycobacterium tuberculosis
RHMLWFELMKPMT

SEQ ID NO: 111262 - protein, 13 aa, Mycobacterium tuberculosis
HMLWFELMKPMTS

SEQ ID NO: 111263 - protein, 13 aa, Mycobacterium tuberculosis
MLWFELMKPMTST

SEQ ID NO: 111264 - protein, 13 aa, Mycobacterium tuberculosis
LWFELMKPMTSTA

SEQ ID NO: 111265 - protein, 13 aa, Mycobacterium tuberculosis
WFELMKPMTSTAT

SEQ ID NO: 111266 - protein, 13 aa, Mycobacterium tuberculosis
FELMKPMTSTATG

SEQ ID NO: 111267 - protein, 13 aa, Mycobacterium tuberculosis
ELMKPMTSTATGR

SEQ ID NO: 111268 - protein, 13 aa, Mycobacterium tuberculosis
LMKPMTSTATGRE

SEQ ID NO: 111269 - protein, 13 aa, Mycobacterium tuberculosis
MKPMTSTATGREA

SEQ ID NO: 111270 - protein, 13 aa, Mycobacterium tuberculosis
KPMTSTATGREAA

SEQ ID NO: 111271 - protein, 13 aa, Mycobacterium tuberculosis
PMTSTATGREAAH

SEQ ID NO: 111272 - protein, 13 aa, Mycobacterium tuberculosis
MTSTATGREAAHL

SEQ ID NO: 111273 - protein, 13 aa, Mycobacterium tuberculosis
TSTATGREAAHLR

SEQ ID NO: 111274 - protein, 13 aa, Mycobacterium tuberculosis
STATGREAAHLRA

SEQ ID NO: 111275 - protein, 13 aa, Mycobacterium tuberculosis
TATGREAAHLRAF

SEQ ID NO: 111276 - protein, 13 aa, Mycobacterium tuberculosis
ATGREAAHLRAFR

SEQ ID NO: 111277 - protein, 13 aa, Mycobacterium tuberculosis
TGREAAHLRAFRA

SEQ ID NO: 111278 - protein, 13 aa, Mycobacterium tuberculosis
GREAAHLRAFRAY

SEQ ID NO: 111279 - protein, 13 aa, Mycobacterium tuberculosis
REAAHLRAFRAYA

SEQ ID NO: 111280 - protein, 13 aa, Mycobacterium tuberculosis
EAAHLRAFRAYAA

SEQ ID NO: 111281 - protein, 13 aa, Mycobacterium tuberculosis
AAHLRAFRAYAAH

SEQ ID NO: 111282 - protein, 13 aa, Mycobacterium tuberculosis
AHLRAFRAYAAHS

SEQ ID NO: 111283 - protein, 13 aa, Mycobacterium tuberculosis
HLRAFRAYAAHSQ

SEQ ID NO: 111284 - protein, 13 aa, Mycobacterium tuberculosis
LRAFRAYAAHSQE

SEQ ID NO: 111285 - protein, 13 aa, Mycobacterium tuberculosis
RAFRAYAAHSQEI

SEQ ID NO: 111286 - protein, 13 aa, Mycobacterium tuberculosis
AFRAYAAHSQEIA

SEQ ID NO: 111287 - protein, 13 aa, Mycobacterium tuberculosis
FRAYAAHSQEIAL

SEQ ID NO: 111288 - protein, 13 aa, Mycobacterium tuberculosis
RAYAAHSQEIALH

SEQ ID NO: 111289 - protein, 13 aa, Mycobacterium tuberculosis
AYAAHSQEIALHQ

SEQ ID NO: 111290 - protein, 13 aa, Mycobacterium tuberculosis
YAAHSQEIALHQA

SEQ ID NO: 111291 - protein, 13 aa, Mycobacterium tuberculosis
AAHSQEIALHQAH

SEQ ID NO: 111292 - protein, 13 aa, Mycobacterium tuberculosis
AHSQEIALHQAHT

SEQ ID NO: 111293 - protein, 13 aa, Mycobacterium tuberculosis
HSQEIALHQAHTA

SEQ ID NO: 111294 - protein, 13 aa, Mycobacterium tuberculosis
SQEIALHQAHTAT

SEQ ID NO: 111295 - protein, 13 aa, Mycobacterium tuberculosis
QEIALHQAHTATD

SEQ ID NO: 111296 - protein, 13 aa, Mycobacterium tuberculosis
EIALHQAHTATDA

SEQ ID NO: 111297 - protein, 13 aa, Mycobacterium tuberculosis
IALHQAHTATDAA

SEQ ID NO: 111298 - protein, 13 aa, Mycobacterium tuberculosis
ALHQAHTATDAAV

SEQ ID NO: 111299 - protein, 13 aa, Mycobacterium tuberculosis
LHQAHTATDAAVQ

SEQ ID NO: 111300 - protein, 13 aa, Mycobacterium tuberculosis
HQAHTATDAAVQR

SEQ ID NO: 111301 - protein, 13 aa, Mycobacterium tuberculosis
QAHTATDAAVQRV

SEQ ID NO: 111302 - protein, 13 aa, Mycobacterium tuberculosis
AHTATDAAVQRVA

SEQ ID NO: 111303 - protein, 13 aa, Mycobacterium tuberculosis
HTATDAAVQRVAV

SEQ ID NO: 111304 - protein, 13 aa, Mycobacterium tuberculosis
TATDAAVQRVAVA

SEQ ID NO: 111305 - protein, 13 aa, Mycobacterium tuberculosis
ATDAAVQRVAVAD

SEQ ID NO: 111306 - protein, 13 aa, Mycobacterium tuberculosis
TDAAVQRVAVADW

SEQ ID NO: 111307 - protein, 13 aa, Mycobacterium tuberculosis
DAAVQRVAVADWL

SEQ ID NO: 111308 - protein, 13 aa, Mycobacterium tuberculosis
AAVQRVAVADWLY

SEQ ID NO: 111309 - protein, 13 aa, Mycobacterium tuberculosis
AVQRVAVADWLYW

SEQ ID NO: 111310 - protein, 13 aa, Mycobacterium tuberculosis
VQRVAVADWLYWQ

SEQ ID NO: 111311 - protein, 13 aa, Mycobacterium tuberculosis
QRVAVADWLYWQY

SEQ ID NO: 111312 - protein, 13 aa, Mycobacterium tuberculosis
RVAVADWLYWQYV

SEQ ID NO: 111313 - protein, 13 aa, Mycobacterium tuberculosis
VAVADWLYWQYVT

SEQ ID NO: 111314 - protein, 13 aa, Mycobacterium tuberculosis
AVADWLYWQYVTG

SEQ ID NO: 111315 - protein, 13 aa, Mycobacterium tuberculosis
VADWLYWQYVTGL

SEQ ID NO: 111316 - protein, 13 aa, Mycobacterium tuberculosis
ADWLYWQYVTGLL

SEQ ID NO: 111317 - protein, 13 aa, Mycobacterium tuberculosis
DWLYWQYVTGLLD

SEQ ID NO: 111318 - protein, 13 aa, Mycobacterium tuberculosis
WLYWQYVTGLLDR

SEQ ID NO: 111319 - protein, 13 aa, Mycobacterium tuberculosis
LYWQYVTGLLDRA

SEQ ID NO: 111320 - protein, 13 aa, Mycobacterium tuberculosis
YWQYVTGLLDRAL

SEQ ID NO: 111321 - protein, 13 aa, Mycobacterium tuberculosis
WQYVTGLLDRALA

SEQ ID NO: 111322 - protein, 13 aa, Mycobacterium tuberculosis
QYVTGLLDRALAA

SEQ ID NO: 111323 - protein, 13 aa, Mycobacterium tuberculosis
YVTGLLDRALAAA

SEQ ID NO: 111324 - protein, 13 aa, Mycobacterium tuberculosis
VTGLLDRALAAAC

SEQ ID NO: 111325 - protein, 14 aa, Mycobacterium tuberculosis
MSITRPTGSYARQM

SEQ ID NO: 111326 - protein, 14 aa, Mycobacterium tuberculosis
SITRPTGSYARQML

SEQ ID NO: 111327 - protein, 14 aa, Mycobacterium tuberculosis
ITRPTGSYARQMLD

SEQ ID NO: 111328 - protein, 14 aa, Mycobacterium tuberculosis
TRPTGSYARQMLDP

SEQ ID NO: 111329 - protein, 14 aa, Mycobacterium tuberculosis
RPTGSYARQMLDPG

SEQ ID NO: 111330 - protein, 14 aa, Mycobacterium tuberculosis
PTGSYARQMLDPGG

SEQ ID NO: 111331 - protein, 14 aa, Mycobacterium tuberculosis
TGSYARQMLDPGGW

SEQ ID NO: 111332 - protein, 14 aa, Mycobacterium tuberculosis
GSYARQMLDPGGWV

SEQ ID NO: 111333 - protein, 14 aa, Mycobacterium tuberculosis
SYARQMLDPGGWVE

SEQ ID NO: 111334 - protein, 14 aa, Mycobacterium tuberculosis
YARQMLDPGGWVEA

SEQ ID NO: 111335 - protein, 14 aa, Mycobacterium tuberculosis
ARQMLDPGGWVEAD

SEQ ID NO: 111336 - protein, 14 aa, Mycobacterium tuberculosis
RQMLDPGGWVEADE

SEQ ID NO: 111337 - protein, 14 aa, Mycobacterium tuberculosis
QMLDPGGWVEADED

SEQ ID NO: 111338 - protein, 14 aa, Mycobacterium tuberculosis
MLDPGGWVEADEDT

SEQ ID NO: 111339 - protein, 14 aa, Mycobacterium tuberculosis
LDPGGWVEADEDTF

SEQ ID NO: 111340 - protein, 14 aa, Mycobacterium tuberculosis
DPGGWVEADEDTFY

SEQ ID NO: 111341 - protein, 14 aa, Mycobacterium tuberculosis
PGGWVEADEDTFYD

SEQ ID NO: 111342 - protein, 14 aa, Mycobacterium tuberculosis
GGWVEADEDTFYDR

SEQ ID NO: 111343 - protein, 14 aa, Mycobacterium tuberculosis
GWVEADEDTFYDRA

SEQ ID NO: 111344 - protein, 14 aa, Mycobacterium tuberculosis
WVEADEDTFYDRAQ

SEQ ID NO: 111345 - protein, 14 aa, Mycobacterium tuberculosis
VEADEDTFYDRAQE

SEQ ID NO: 111346 - protein, 14 aa, Mycobacterium tuberculosis
EADEDTFYDRAQEY

SEQ ID NO: 111347 - protein, 14 aa, Mycobacterium tuberculosis
ADEDTFYDRAQEYS

SEQ ID NO: 111348 - protein, 14 aa, Mycobacterium tuberculosis
DEDTFYDRAQEYSQ

SEQ ID NO: 111349 - protein, 14 aa, Mycobacterium tuberculosis
EDTFYDRAQEYSQV

SEQ ID NO: 111350 - protein, 14 aa, Mycobacterium tuberculosis
DTFYDRAQEYSQVL

SEQ ID NO: 111351 - protein, 14 aa, Mycobacterium tuberculosis
TFYDRAQEYSQVLQ

SEQ ID NO: 111352 - protein, 14 aa, Mycobacterium tuberculosis
FYDRAQEYSQVLQR

SEQ ID NO: 111353 - protein, 14 aa, Mycobacterium tuberculosis
YDRAQEYSQVLQRV

SEQ ID NO: 111354 - protein, 14 aa, Mycobacterium tuberculosis
DRAQEYSQVLQRVT

SEQ ID NO: 111355 - protein, 14 aa, Mycobacterium tuberculosis
RAQEYSQVLQRVTD

SEQ ID NO: 111356 - protein, 14 aa, Mycobacterium tuberculosis
AQEYSQVLQRVTDV

SEQ ID NO: 111357 - protein, 14 aa, Mycobacterium tuberculosis
QEYSQVLQRVTDVL

SEQ ID NO: 111358 - protein, 14 aa, Mycobacterium tuberculosis
EYSQVLQRVTDVLD

SEQ ID NO: 111359 - protein, 14 aa, Mycobacterium tuberculosis
YSQVLQRVTDVLDT

SEQ ID NO: 111360 - protein, 14 aa, Mycobacterium tuberculosis
SQVLQRVTDVLDTC

SEQ ID NO: 111361 - protein, 14 aa, Mycobacterium tuberculosis
QVLQRVTDVLDTCR

SEQ ID NO: 111362 - protein, 14 aa, Mycobacterium tuberculosis
VLQRVTDVLDTCRQ

SEQ ID NO: 111363 - protein, 14 aa, Mycobacterium tuberculosis
LQRVTDVLDTCRQQ

SEQ ID NO: 111364 - protein, 14 aa, Mycobacterium tuberculosis
QRVTDVLDTCRQQK

SEQ ID NO: 111365 - protein, 14 aa, Mycobacterium tuberculosis
RVTDVLDTCRQQKG

SEQ ID NO: 111366 - protein, 14 aa, Mycobacterium tuberculosis
VTDVLDTCRQQKGH

SEQ ID NO: 111367 - protein, 14 aa, Mycobacterium tuberculosis
TDVLDTCRQQKGHV

SEQ ID NO: 111368 - protein, 14 aa, Mycobacterium tuberculosis
DVLDTCRQQKGHVF

SEQ ID NO: 111369 - protein, 14 aa, Mycobacterium tuberculosis
VLDTCRQQKGHVFE

SEQ ID NO: 111370 - protein, 14 aa, Mycobacterium tuberculosis
LDTCRQQKGHVFEG

SEQ ID NO: 111371 - protein, 14 aa, Mycobacterium tuberculosis
DTCRQQKGHVFEGG

SEQ ID NO: 111372 - protein, 14 aa, Mycobacterium tuberculosis
TCRQQKGHVFEGGL

SEQ ID NO: 111373 - protein, 14 aa, Mycobacterium tuberculosis
CRQQKGHVFEGGLW

SEQ ID NO: 111374 - protein, 14 aa, Mycobacterium tuberculosis
RQQKGHVFEGGLWS

SEQ ID NO: 111375 - protein, 14 aa, Mycobacterium tuberculosis
QQKGHVFEGGLWSG

SEQ ID NO: 111376 - protein, 14 aa, Mycobacterium tuberculosis
QKGHVFEGGLWSGG

SEQ ID NO: 111377 - protein, 14 aa, Mycobacterium tuberculosis
KGHVFEGGLWSGGA

SEQ ID NO: 111378 - protein, 14 aa, Mycobacterium tuberculosis
GHVFEGGLWSGGAA

SEQ ID NO: 111379 - protein, 14 aa, Mycobacterium tuberculosis
HVFEGGLWSGGAAN

SEQ ID NO: 111380 - protein, 14 aa, Mycobacterium tuberculosis
VFEGGLWSGGAANA

SEQ ID NO: 111381 - protein, 14 aa, Mycobacterium tuberculosis
FEGGLWSGGAANAA

SEQ ID NO: 111382 - protein, 14 aa, Mycobacterium tuberculosis
EGGLWSGGAANAAN

SEQ ID NO: 111383 - protein, 14 aa, Mycobacterium tuberculosis
GGLWSGGAANAANG

SEQ ID NO: 111384 - protein, 14 aa, Mycobacterium tuberculosis
GLWSGGAANAANGA

SEQ ID NO: 111385 - protein, 14 aa, Mycobacterium tuberculosis
LWSGGAANAANGAL

SEQ ID NO: 111386 - protein, 14 aa, Mycobacterium tuberculosis
WSGGAANAANGALG

SEQ ID NO: 111387 - protein, 14 aa, Mycobacterium tuberculosis
SGGAANAANGALGA

SEQ ID NO: 111388 - protein, 14 aa, Mycobacterium tuberculosis
GGAANAANGALGAN

SEQ ID NO: 111389 - protein, 14 aa, Mycobacterium tuberculosis
GAANAANGALGANI

SEQ ID NO: 111390 - protein, 14 aa, Mycobacterium tuberculosis
AANAANGALGANIN

SEQ ID NO: 111391 - protein, 14 aa, Mycobacterium tuberculosis
ANAANGALGANINQ

SEQ ID NO: 111392 - protein, 14 aa, Mycobacterium tuberculosis
NAANGALGANINQL

SEQ ID NO: 111393 - protein, 14 aa, Mycobacterium tuberculosis
AANGALGANINQLM

SEQ ID NO: 111394 - protein, 14 aa, Mycobacterium tuberculosis
ANGALGANINQLMT

SEQ ID NO: 111395 - protein, 14 aa, Mycobacterium tuberculosis
NGALGANINQLMTL

SEQ ID NO: 111396 - protein, 14 aa, Mycobacterium tuberculosis
GALGANINQLMTLQ

SEQ ID NO: 111397 - protein, 14 aa, Mycobacterium tuberculosis
ALGANINQLMTLQD

SEQ ID NO: 111398 - protein, 14 aa, Mycobacterium tuberculosis
LGANINQLMTLQDY

SEQ ID NO: 111399 - protein, 14 aa, Mycobacterium tuberculosis
GANINQLMTLQDYL

SEQ ID NO: 111400 - protein, 14 aa, Mycobacterium tuberculosis
ANINQLMTLQDYLA

SEQ ID NO: 111401 - protein, 14 aa, Mycobacterium tuberculosis
NINQLMTLQDYLAT

SEQ ID NO: 111402 - protein, 14 aa, Mycobacterium tuberculosis
INQLMTLQDYLATV

SEQ ID NO: 111403 - protein, 14 aa, Mycobacterium tuberculosis
NQLMTLQDYLATVI

SEQ ID NO: 111404 - protein, 14 aa, Mycobacterium tuberculosis
QLMTLQDYLATVIT

SEQ ID NO: 111405 - protein, 14 aa, Mycobacterium tuberculosis
LMTLQDYLATVITW

SEQ ID NO: 111406 - protein, 14 aa, Mycobacterium tuberculosis
MTLQDYLATVITWH

SEQ ID NO: 111407 - protein, 14 aa, Mycobacterium tuberculosis
TLQDYLATVITWHR

SEQ ID NO: 111408 - protein, 14 aa, Mycobacterium tuberculosis
LQDYLATVITWHRH

SEQ ID NO: 111409 - protein, 14 aa, Mycobacterium tuberculosis
QDYLATVITWHRHI

SEQ ID NO: 111410 - protein, 14 aa, Mycobacterium tuberculosis
DYLATVITWHRHIA

SEQ ID NO: 111411 - protein, 14 aa, Mycobacterium tuberculosis
YLATVITWHRHIAG

SEQ ID NO: 111412 - protein, 14 aa, Mycobacterium tuberculosis
LATVITWHRHIAGL

SEQ ID NO: 111413 - protein, 14 aa, Mycobacterium tuberculosis
ATVITWHRHIAGLI

SEQ ID NO: 111414 - protein, 14 aa, Mycobacterium tuberculosis
TVITWHRHIAGLIE

SEQ ID NO: 111415 - protein, 14 aa, Mycobacterium tuberculosis
VITWHRHIAGLIEQ

SEQ ID NO: 111416 - protein, 14 aa, Mycobacterium tuberculosis
ITWHRHIAGLIEQA

SEQ ID NO: 111417 - protein, 14 aa, Mycobacterium tuberculosis
TWHRHIAGLIEQAK

SEQ ID NO: 111418 - protein, 14 aa, Mycobacterium tuberculosis
WHRHIAGLIEQAKS

SEQ ID NO: 111419 - protein, 14 aa, Mycobacterium tuberculosis
HRHIAGLIEQAKSD

SEQ ID NO: 111420 - protein, 14 aa, Mycobacterium tuberculosis
RHIAGLIEQAKSDI

SEQ ID NO: 111421 - protein, 14 aa, Mycobacterium tuberculosis
HIAGLIEQAKSDIG

SEQ ID NO: 111422 - protein, 14 aa, Mycobacterium tuberculosis
IAGLIEQAKSDIGN

SEQ ID NO: 111423 - protein, 14 aa, Mycobacterium tuberculosis
AGLIEQAKSDIGNN

SEQ ID NO: 111424 - protein, 14 aa, Mycobacterium tuberculosis
GLIEQAKSDIGNNV

SEQ ID NO: 111425 - protein, 14 aa, Mycobacterium tuberculosis
LIEQAKSDIGNNVD

SEQ ID NO: 111426 - protein, 14 aa, Mycobacterium tuberculosis
IEQAKSDIGNNVDG

SEQ ID NO: 111427 - protein, 14 aa, Mycobacterium tuberculosis
EQAKSDIGNNVDGA

SEQ ID NO: 111428 - protein, 14 aa, Mycobacterium tuberculosis
QAKSDIGNNVDGAQ

SEQ ID NO: 111429 - protein, 14 aa, Mycobacterium tuberculosis
AKSDIGNNVDGAQR

SEQ ID NO: 111430 - protein, 14 aa, Mycobacterium tuberculosis
KSDIGNNVDGAQRE

SEQ ID NO: 111431 - protein, 14 aa, Mycobacterium tuberculosis
SDIGNNVDGAQREI

SEQ ID NO: 111432 - protein, 14 aa, Mycobacterium tuberculosis
DIGNNVDGAQREID

SEQ ID NO: 111433 - protein, 14 aa, Mycobacterium tuberculosis
IGNNVDGAQREIDI

SEQ ID NO: 111434 - protein, 14 aa, Mycobacterium tuberculosis
GNNVDGAQREIDIL

SEQ ID NO: 111435 - protein, 14 aa, Mycobacterium tuberculosis
NNVDGAQREIDILE

SEQ ID NO: 111436 - protein, 14 aa, Mycobacterium tuberculosis
NVDGAQREIDILEN

SEQ ID NO: 111437 - protein, 14 aa, Mycobacterium tuberculosis
VDGAQREIDILEND

SEQ ID NO: 111438 - protein, 14 aa, Mycobacterium tuberculosis
DGAQREIDILENDP

SEQ ID NO: 111439 - protein, 14 aa, Mycobacterium tuberculosis
GAQREIDILENDPS

SEQ ID NO: 111440 - protein, 14 aa, Mycobacterium tuberculosis
AQREIDILENDPSL

SEQ ID NO: 111441 - protein, 14 aa, Mycobacterium tuberculosis
QREIDILENDPSLD

SEQ ID NO: 111442 - protein, 14 aa, Mycobacterium tuberculosis
REIDILENDPSLDA

SEQ ID NO: 111443 - protein, 14 aa, Mycobacterium tuberculosis
EIDILENDPSLDAD

SEQ ID NO: 111444 - protein, 14 aa, Mycobacterium tuberculosis
IDILENDPSLDADE

SEQ ID NO: 111445 - protein, 14 aa, Mycobacterium tuberculosis
DILENDPSLDADER

SEQ ID NO: 111446 - protein, 14 aa, Mycobacterium tuberculosis
ILENDPSLDADERH

SEQ ID NO: 111447 - protein, 14 aa, Mycobacterium tuberculosis
LENDPSLDADERHT

SEQ ID NO: 111448 - protein, 14 aa, Mycobacterium tuberculosis
ENDPSLDADERHTA

SEQ ID NO: 111449 - protein, 14 aa, Mycobacterium tuberculosis
NDPSLDADERHTAI

SEQ ID NO: 111450 - protein, 14 aa, Mycobacterium tuberculosis
DPSLDADERHTAIN

SEQ ID NO: 111451 - protein, 14 aa, Mycobacterium tuberculosis
PSLDADERHTAINS

SEQ ID NO: 111452 - protein, 14 aa, Mycobacterium tuberculosis
SLDADERHTAINSL

SEQ ID NO: 111453 - protein, 14 aa, Mycobacterium tuberculosis
LDADERHTAINSLV

SEQ ID NO: 111454 - protein, 14 aa, Mycobacterium tuberculosis
DADERHTAINSLVT

SEQ ID NO: 111455 - protein, 14 aa, Mycobacterium tuberculosis
ADERHTAINSLVTA

SEQ ID NO: 111456 - protein, 14 aa, Mycobacterium tuberculosis
DERHTAINSLVTAT

SEQ ID NO: 111457 - protein, 14 aa, Mycobacterium tuberculosis
ERHTAINSLVTATH

SEQ ID NO: 111458 - protein, 14 aa, Mycobacterium tuberculosis
RHTAINSLVTATHG

SEQ ID NO: 111459 - protein, 14 aa, Mycobacterium tuberculosis
HTAINSLVTATHGA

SEQ ID NO: 111460 - protein, 14 aa, Mycobacterium tuberculosis
TAINSLVTATHGAN

SEQ ID NO: 111461 - protein, 14 aa, Mycobacterium tuberculosis
AINSLVTATHGANV

SEQ ID NO: 111462 - protein, 14 aa, Mycobacterium tuberculosis
INSLVTATHGANVS

SEQ ID NO: 111463 - protein, 14 aa, Mycobacterium tuberculosis
NSLVTATHGANVSL

SEQ ID NO: 111464 - protein, 14 aa, Mycobacterium tuberculosis
SLVTATHGANVSLV

SEQ ID NO: 111465 - protein, 14 aa, Mycobacterium tuberculosis
LVTATHGANVSLVA

SEQ ID NO: 111466 - protein, 14 aa, Mycobacterium tuberculosis
VTATHGANVSLVAE

SEQ ID NO: 111467 - protein, 14 aa, Mycobacterium tuberculosis
TATHGANVSLVAET

SEQ ID NO: 111468 - protein, 14 aa, Mycobacterium tuberculosis
ATHGANVSLVAETA

SEQ ID NO: 111469 - protein, 14 aa, Mycobacterium tuberculosis
THGANVSLVAETAE

SEQ ID NO: 111470 - protein, 14 aa, Mycobacterium tuberculosis
HGANVSLVAETAER

SEQ ID NO: 111471 - protein, 14 aa, Mycobacterium tuberculosis
GANVSLVAETAERV

SEQ ID NO: 111472 - protein, 14 aa, Mycobacterium tuberculosis
ANVSLVAETAERVL

SEQ ID NO: 111473 - protein, 14 aa, Mycobacterium tuberculosis
NVSLVAETAERVLE

SEQ ID NO: 111474 - protein, 14 aa, Mycobacterium tuberculosis
VSLVAETAERVLES

SEQ ID NO: 111475 - protein, 14 aa, Mycobacterium tuberculosis
SLVAETAERVLESK

SEQ ID NO: 111476 - protein, 14 aa, Mycobacterium tuberculosis
LVAETAERVLESKN

SEQ ID NO: 111477 - protein, 14 aa, Mycobacterium tuberculosis
VAETAERVLESKNW

SEQ ID NO: 111478 - protein, 14 aa, Mycobacterium tuberculosis
AETAERVLESKNWK

SEQ ID NO: 111479 - protein, 14 aa, Mycobacterium tuberculosis
ETAERVLESKNWKP

SEQ ID NO: 111480 - protein, 14 aa, Mycobacterium tuberculosis
TAERVLESKNWKPP

SEQ ID NO: 111481 - protein, 14 aa, Mycobacterium tuberculosis
AERVLESKNWKPPK

SEQ ID NO: 111482 - protein, 14 aa, Mycobacterium tuberculosis
ERVLESKNWKPPKN

SEQ ID NO: 111483 - protein, 14 aa, Mycobacterium tuberculosis
RVLESKNWKPPKNA

SEQ ID NO: 111484 - protein, 14 aa, Mycobacterium tuberculosis
VLESKNWKPPKNAL

SEQ ID NO: 111485 - protein, 14 aa, Mycobacterium tuberculosis
LESKNWKPPKNALE

SEQ ID NO: 111486 - protein, 14 aa, Mycobacterium tuberculosis
ESKNWKPPKNALED

SEQ ID NO: 111487 - protein, 14 aa, Mycobacterium tuberculosis
SKNWKPPKNALEDL

SEQ ID NO: 111488 - protein, 14 aa, Mycobacterium tuberculosis
KNWKPPKNALEDLL

SEQ ID NO: 111489 - protein, 14 aa, Mycobacterium tuberculosis
NWKPPKNALEDLLQ

SEQ ID NO: 111490 - protein, 14 aa, Mycobacterium tuberculosis
WKPPKNALEDLLQQ

SEQ ID NO: 111491 - protein, 14 aa, Mycobacterium tuberculosis
KPPKNALEDLLQQK

SEQ ID NO: 111492 - protein, 14 aa, Mycobacterium tuberculosis
PPKNALEDLLQQKS

SEQ ID NO: 111493 - protein, 14 aa, Mycobacterium tuberculosis
PKNALEDLLQQKSP

SEQ ID NO: 111494 - protein, 14 aa, Mycobacterium tuberculosis
KNALEDLLQQKSPP

SEQ ID NO: 111495 - protein, 14 aa, Mycobacterium tuberculosis
NALEDLLQQKSPPP

SEQ ID NO: 111496 - protein, 14 aa, Mycobacterium tuberculosis
ALEDLLQQKSPPPP

SEQ ID NO: 111497 - protein, 14 aa, Mycobacterium tuberculosis
LEDLLQQKSPPPPD

SEQ ID NO: 111498 - protein, 14 aa, Mycobacterium tuberculosis
EDLLQQKSPPPPDV

SEQ ID NO: 111499 - protein, 14 aa, Mycobacterium tuberculosis
DLLQQKSPPPPDVP

SEQ ID NO: 111500 - protein, 14 aa, Mycobacterium tuberculosis
LLQQKSPPPPDVPT

SEQ ID NO: 111501 - protein, 14 aa, Mycobacterium tuberculosis
LQQKSPPPPDVPTL

SEQ ID NO: 111502 - protein, 14 aa, Mycobacterium tuberculosis
QQKSPPPPDVPTLV

SEQ ID NO: 111503 - protein, 14 aa, Mycobacterium tuberculosis
QKSPPPPDVPTLVV

SEQ ID NO: 111504 - protein, 14 aa, Mycobacterium tuberculosis
KSPPPPDVPTLVVP

SEQ ID NO: 111505 - protein, 14 aa, Mycobacterium tuberculosis
SPPPPDVPTLVVPS

SEQ ID NO: 111506 - protein, 14 aa, Mycobacterium tuberculosis
PPPPDVPTLVVPSP

SEQ ID NO: 111507 - protein, 14 aa, Mycobacterium tuberculosis
PPPDVPTLVVPSPG

SEQ ID NO: 111508 - protein, 14 aa, Mycobacterium tuberculosis
PPDVPTLVVPSPGT

SEQ ID NO: 111509 - protein, 14 aa, Mycobacterium tuberculosis
PDVPTLVVPSPGTP

SEQ ID NO: 111510 - protein, 14 aa, Mycobacterium tuberculosis
DVPTLVVPSPGTPG

SEQ ID NO: 111511 - protein, 14 aa, Mycobacterium tuberculosis
VPTLVVPSPGTPGT

SEQ ID NO: 111512 - protein, 14 aa, Mycobacterium tuberculosis
PTLVVPSPGTPGTP

SEQ ID NO: 111513 - protein, 14 aa, Mycobacterium tuberculosis
TLVVPSPGTPGTPG

SEQ ID NO: 111514 - protein, 14 aa, Mycobacterium tuberculosis
LVVPSPGTPGTPGT

SEQ ID NO: 111515 - protein, 14 aa, Mycobacterium tuberculosis
VVPSPGTPGTPGTP

SEQ ID NO: 111516 - protein, 14 aa, Mycobacterium tuberculosis
VPSPGTPGTPGTPI

SEQ ID NO: 111517 - protein, 14 aa, Mycobacterium tuberculosis
PSPGTPGTPGTPIT

SEQ ID NO: 111518 - protein, 14 aa, Mycobacterium tuberculosis
SPGTPGTPGTPITP

SEQ ID NO: 111519 - protein, 14 aa, Mycobacterium tuberculosis
PGTPGTPGTPITPG

SEQ ID NO: 111520 - protein, 14 aa, Mycobacterium tuberculosis
GTPGTPGTPITPGT

SEQ ID NO: 111521 - protein, 14 aa, Mycobacterium tuberculosis
TPGTPGTPITPGTP

SEQ ID NO: 111522 - protein, 14 aa, Mycobacterium tuberculosis
PGTPGTPITPGTPI

SEQ ID NO: 111523 - protein, 14 aa, Mycobacterium tuberculosis
GTPGTPITPGTPIT

SEQ ID NO: 111524 - protein, 14 aa, Mycobacterium tuberculosis
TPGTPITPGTPITP

SEQ ID NO: 111525 - protein, 14 aa, Mycobacterium tuberculosis
PGTPITPGTPITPG

SEQ ID NO: 111526 - protein, 14 aa, Mycobacterium tuberculosis
GTPITPGTPITPGT

SEQ ID NO: 111527 - protein, 14 aa, Mycobacterium tuberculosis
TPITPGTPITPGTP

SEQ ID NO: 111528 - protein, 14 aa, Mycobacterium tuberculosis
PITPGTPITPGTPI

SEQ ID NO: 111529 - protein, 14 aa, Mycobacterium tuberculosis
ITPGTPITPGTPIT

SEQ ID NO: 111530 - protein, 14 aa, Mycobacterium tuberculosis
TPGTPITPGTPITP

SEQ ID NO: 111531 - protein, 14 aa, Mycobacterium tuberculosis
PGTPITPGTPITPI

SEQ ID NO: 111532 - protein, 14 aa, Mycobacterium tuberculosis
GTPITPGTPITPIP

SEQ ID NO: 111533 - protein, 14 aa, Mycobacterium tuberculosis
TPITPGTPITPIPG

SEQ ID NO: 111534 - protein, 14 aa, Mycobacterium tuberculosis
PITPGTPITPIPGA

SEQ ID NO: 111535 - protein, 14 aa, Mycobacterium tuberculosis
ITPGTPITPIPGAP

SEQ ID NO: 111536 - protein, 14 aa, Mycobacterium tuberculosis
TPGTPITPIPGAPV

SEQ ID NO: 111537 - protein, 14 aa, Mycobacterium tuberculosis
PGTPITPIPGAPVT

SEQ ID NO: 111538 - protein, 14 aa, Mycobacterium tuberculosis
GTPITPIPGAPVTP

SEQ ID NO: 111539 - protein, 14 aa, Mycobacterium tuberculosis
TPITPIPGAPVTPI

SEQ ID NO: 111540 - protein, 14 aa, Mycobacterium tuberculosis
PITPIPGAPVTPIT

SEQ ID NO: 111541 - protein, 14 aa, Mycobacterium tuberculosis
ITPIPGAPVTPITP

SEQ ID NO: 111542 - protein, 14 aa, Mycobacterium tuberculosis
TPIPGAPVTPITPT

SEQ ID NO: 111543 - protein, 14 aa, Mycobacterium tuberculosis
PIPGAPVTPITPTP

SEQ ID NO: 111544 - protein, 14 aa, Mycobacterium tuberculosis
IPGAPVTPITPTPG

SEQ ID NO: 111545 - protein, 14 aa, Mycobacterium tuberculosis
PGAPVTPITPTPGT

SEQ ID NO: 111546 - protein, 14 aa, Mycobacterium tuberculosis
GAPVTPITPTPGTP

SEQ ID NO: 111547 - protein, 14 aa, Mycobacterium tuberculosis
APVTPITPTPGTPV

SEQ ID NO: 111548 - protein, 14 aa, Mycobacterium tuberculosis
PVTPITPTPGTPVT

SEQ ID NO: 111549 - protein, 14 aa, Mycobacterium tuberculosis
VTPITPTPGTPVTP

SEQ ID NO: 111550 - protein, 14 aa, Mycobacterium tuberculosis
TPITPTPGTPVTPV

SEQ ID NO: 111551 - protein, 14 aa, Mycobacterium tuberculosis
PITPTPGTPVTPVT

SEQ ID NO: 111552 - protein, 14 aa, Mycobacterium tuberculosis
ITPTPGTPVTPVTP

SEQ ID NO: 111553 - protein, 14 aa, Mycobacterium tuberculosis
TPTPGTPVTPVTPG

SEQ ID NO: 111554 - protein, 14 aa, Mycobacterium tuberculosis
PTPGTPVTPVTPGK

SEQ ID NO: 111555 - protein, 14 aa, Mycobacterium tuberculosis
TPGTPVTPVTPGKP

SEQ ID NO: 111556 - protein, 14 aa, Mycobacterium tuberculosis
PGTPVTPVTPGKPV

SEQ ID NO: 111557 - protein, 14 aa, Mycobacterium tuberculosis
GTPVTPVTPGKPVT

SEQ ID NO: 111558 - protein, 14 aa, Mycobacterium tuberculosis
TPVTPVTPGKPVTP

SEQ ID NO: 111559 - protein, 14 aa, Mycobacterium tuberculosis
PVTPVTPGKPVTPV

SEQ ID NO: 111560 - protein, 14 aa, Mycobacterium tuberculosis
VTPVTPGKPVTPVT

SEQ ID NO: 111561 - protein, 14 aa, Mycobacterium tuberculosis
TPVTPGKPVTPVTP

SEQ ID NO: 111562 - protein, 14 aa, Mycobacterium tuberculosis
PVTPGKPVTPVTPV

SEQ ID NO: 111563 - protein, 14 aa, Mycobacterium tuberculosis
VTPGKPVTPVTPVK

SEQ ID NO: 111564 - protein, 14 aa, Mycobacterium tuberculosis
TPGKPVTPVTPVKP

SEQ ID NO: 111565 - protein, 14 aa, Mycobacterium tuberculosis
PGKPVTPVTPVKPG

SEQ ID NO: 111566 - protein, 14 aa, Mycobacterium tuberculosis
GKPVTPVTPVKPGT

SEQ ID NO: 111567 - protein, 14 aa, Mycobacterium tuberculosis
KPVTPVTPVKPGTP

SEQ ID NO: 111568 - protein, 14 aa, Mycobacterium tuberculosis
PVTPVTPVKPGTPG

SEQ ID NO: 111569 - protein, 14 aa, Mycobacterium tuberculosis
VTPVTPVKPGTPGE

SEQ ID NO: 111570 - protein, 14 aa, Mycobacterium tuberculosis
TPVTPVKPGTPGEP

SEQ ID NO: 111571 - protein, 14 aa, Mycobacterium tuberculosis
PVTPVKPGTPGEPT

SEQ ID NO: 111572 - protein, 14 aa, Mycobacterium tuberculosis
VTPVKPGTPGEPTP

SEQ ID NO: 111573 - protein, 14 aa, Mycobacterium tuberculosis
TPVKPGTPGEPTPI

SEQ ID NO: 111574 - protein, 14 aa, Mycobacterium tuberculosis
PVKPGTPGEPTPIT

SEQ ID NO: 111575 - protein, 14 aa, Mycobacterium tuberculosis
VKPGTPGEPTPITP

SEQ ID NO: 111576 - protein, 14 aa, Mycobacterium tuberculosis
KPGTPGEPTPITPV

SEQ ID NO: 111577 - protein, 14 aa, Mycobacterium tuberculosis
PGTPGEPTPITPVT

SEQ ID NO: 111578 - protein, 14 aa, Mycobacterium tuberculosis
GTPGEPTPITPVTP

SEQ ID NO: 111579 - protein, 14 aa, Mycobacterium tuberculosis
TPGEPTPITPVTPP

SEQ ID NO: 111580 - protein, 14 aa, Mycobacterium tuberculosis
PGEPTPITPVTPPV

SEQ ID NO: 111581 - protein, 14 aa, Mycobacterium tuberculosis
GEPTPITPVTPPVA

SEQ ID NO: 111582 - protein, 14 aa, Mycobacterium tuberculosis
EPTPITPVTPPVAP

SEQ ID NO: 111583 - protein, 14 aa, Mycobacterium tuberculosis
PTPITPVTPPVAPA

SEQ ID NO: 111584 - protein, 14 aa, Mycobacterium tuberculosis
TPITPVTPPVAPAT

SEQ ID NO: 111585 - protein, 14 aa, Mycobacterium tuberculosis
PITPVTPPVAPATP

SEQ ID NO: 111586 - protein, 14 aa, Mycobacterium tuberculosis
ITPVTPPVAPATPA

SEQ ID NO: 111587 - protein, 14 aa, Mycobacterium tuberculosis
TPVTPPVAPATPAT

SEQ ID NO: 111588 - protein, 14 aa, Mycobacterium tuberculosis
PVTPPVAPATPATP

SEQ ID NO: 111589 - protein, 14 aa, Mycobacterium tuberculosis
VTPPVAPATPATPA

SEQ ID NO: 111590 - protein, 14 aa, Mycobacterium tuberculosis
TPPVAPATPATPAT

SEQ ID NO: 111591 - protein, 14 aa, Mycobacterium tuberculosis
PPVAPATPATPATP

SEQ ID NO: 111592 - protein, 14 aa, Mycobacterium tuberculosis
PVAPATPATPATPV

SEQ ID NO: 111593 - protein, 14 aa, Mycobacterium tuberculosis
VAPATPATPATPVT

SEQ ID NO: 111594 - protein, 14 aa, Mycobacterium tuberculosis
APATPATPATPVTP

SEQ ID NO: 111595 - protein, 14 aa, Mycobacterium tuberculosis
PATPATPATPVTPA

SEQ ID NO: 111596 - protein, 14 aa, Mycobacterium tuberculosis
ATPATPATPVTPAP

SEQ ID NO: 111597 - protein, 14 aa, Mycobacterium tuberculosis
TPATPATPVTPAPA

SEQ ID NO: 111598 - protein, 14 aa, Mycobacterium tuberculosis
PATPATPVTPAPAP

SEQ ID NO: 111599 - protein, 14 aa, Mycobacterium tuberculosis
ATPATPVTPAPAPH

SEQ ID NO: 111600 - protein, 14 aa, Mycobacterium tuberculosis
TPATPVTPAPAPHP

SEQ ID NO: 111601 - protein, 14 aa, Mycobacterium tuberculosis
PATPVTPAPAPHPQ

SEQ ID NO: 111602 - protein, 14 aa, Mycobacterium tuberculosis
ATPVTPAPAPHPQP

SEQ ID NO: 111603 - protein, 14 aa, Mycobacterium tuberculosis
TPVTPAPAPHPQPA

SEQ ID NO: 111604 - protein, 14 aa, Mycobacterium tuberculosis
PVTPAPAPHPQPAP

SEQ ID NO: 111605 - protein, 14 aa, Mycobacterium tuberculosis
VTPAPAPHPQPAPA

SEQ ID NO: 111606 - protein, 14 aa, Mycobacterium tuberculosis
TPAPAPHPQPAPAP

SEQ ID NO: 111607 - protein, 14 aa, Mycobacterium tuberculosis
PAPAPHPQPAPAPA

SEQ ID NO: 111608 - protein, 14 aa, Mycobacterium tuberculosis
APAPHPQPAPAPAP

SEQ ID NO: 111609 - protein, 14 aa, Mycobacterium tuberculosis
PAPHPQPAPAPAPS

SEQ ID NO: 111610 - protein, 14 aa, Mycobacterium tuberculosis
APHPQPAPAPAPSP

SEQ ID NO: 111611 - protein, 14 aa, Mycobacterium tuberculosis
PHPQPAPAPAPSPG

SEQ ID NO: 111612 - protein, 14 aa, Mycobacterium tuberculosis
HPQPAPAPAPSPGP

SEQ ID NO: 111613 - protein, 14 aa, Mycobacterium tuberculosis
PQPAPAPAPSPGPQ

SEQ ID NO: 111614 - protein, 14 aa, Mycobacterium tuberculosis
QPAPAPAPSPGPQP

SEQ ID NO: 111615 - protein, 14 aa, Mycobacterium tuberculosis
PAPAPAPSPGPQPV

SEQ ID NO: 111616 - protein, 14 aa, Mycobacterium tuberculosis
APAPAPSPGPQPVT

SEQ ID NO: 111617 - protein, 14 aa, Mycobacterium tuberculosis
PAPAPSPGPQPVTP

SEQ ID NO: 111618 - protein, 14 aa, Mycobacterium tuberculosis
APAPSPGPQPVTPA

SEQ ID NO: 111619 - protein, 14 aa, Mycobacterium tuberculosis
PAPSPGPQPVTPAT

SEQ ID NO: 111620 - protein, 14 aa, Mycobacterium tuberculosis
APSPGPQPVTPATP

SEQ ID NO: 111621 - protein, 14 aa, Mycobacterium tuberculosis
PSPGPQPVTPATPG

SEQ ID NO: 111622 - protein, 14 aa, Mycobacterium tuberculosis
SPGPQPVTPATPGP

SEQ ID NO: 111623 - protein, 14 aa, Mycobacterium tuberculosis
PGPQPVTPATPGPS

SEQ ID NO: 111624 - protein, 14 aa, Mycobacterium tuberculosis
GPQPVTPATPGPSG

SEQ ID NO: 111625 - protein, 14 aa, Mycobacterium tuberculosis
PQPVTPATPGPSGP

SEQ ID NO: 111626 - protein, 14 aa, Mycobacterium tuberculosis
QPVTPATPGPSGPA

SEQ ID NO: 111627 - protein, 14 aa, Mycobacterium tuberculosis
PVTPATPGPSGPAT

SEQ ID NO: 111628 - protein, 14 aa, Mycobacterium tuberculosis
VTPATPGPSGPATP

SEQ ID NO: 111629 - protein, 14 aa, Mycobacterium tuberculosis
TPATPGPSGPATPG

SEQ ID NO: 111630 - protein, 14 aa, Mycobacterium tuberculosis
PATPGPSGPATPGT

SEQ ID NO: 111631 - protein, 14 aa, Mycobacterium tuberculosis
ATPGPSGPATPGTP

SEQ ID NO: 111632 - protein, 14 aa, Mycobacterium tuberculosis
TPGPSGPATPGTPG

SEQ ID NO: 111633 - protein, 14 aa, Mycobacterium tuberculosis
PGPSGPATPGTPGG

SEQ ID NO: 111634 - protein, 14 aa, Mycobacterium tuberculosis
GPSGPATPGTPGGE

SEQ ID NO: 111635 - protein, 14 aa, Mycobacterium tuberculosis
PSGPATPGTPGGEP

SEQ ID NO: 111636 - protein, 14 aa, Mycobacterium tuberculosis
SGPATPGTPGGEPA

SEQ ID NO: 111637 - protein, 14 aa, Mycobacterium tuberculosis
GPATPGTPGGEPAP

SEQ ID NO: 111638 - protein, 14 aa, Mycobacterium tuberculosis
PATPGTPGGEPAPH

SEQ ID NO: 111639 - protein, 14 aa, Mycobacterium tuberculosis
ATPGTPGGEPAPHV

SEQ ID NO: 111640 - protein, 14 aa, Mycobacterium tuberculosis
TPGTPGGEPAPHVK

SEQ ID NO: 111641 - protein, 14 aa, Mycobacterium tuberculosis
PGTPGGEPAPHVKP

SEQ ID NO: 111642 - protein, 14 aa, Mycobacterium tuberculosis
GTPGGEPAPHVKPA

SEQ ID NO: 111643 - protein, 14 aa, Mycobacterium tuberculosis
TPGGEPAPHVKPAA

SEQ ID NO: 111644 - protein, 14 aa, Mycobacterium tuberculosis
PGGEPAPHVKPAAL

SEQ ID NO: 111645 - protein, 14 aa, Mycobacterium tuberculosis
GGEPAPHVKPAALA

SEQ ID NO: 111646 - protein, 14 aa, Mycobacterium tuberculosis
GEPAPHVKPAALAE

SEQ ID NO: 111647 - protein, 14 aa, Mycobacterium tuberculosis
EPAPHVKPAALAEQ

SEQ ID NO: 111648 - protein, 14 aa, Mycobacterium tuberculosis
PAPHVKPAALAEQP

SEQ ID NO: 111649 - protein, 14 aa, Mycobacterium tuberculosis
APHVKPAALAEQPG

SEQ ID NO: 111650 - protein, 14 aa, Mycobacterium tuberculosis
PHVKPAALAEQPGV

SEQ ID NO: 111651 - protein, 14 aa, Mycobacterium tuberculosis
HVKPAALAEQPGVP

SEQ ID NO: 111652 - protein, 14 aa, Mycobacterium tuberculosis
VKPAALAEQPGVPG

SEQ ID NO: 111653 - protein, 14 aa, Mycobacterium tuberculosis
KPAALAEQPGVPGQ

SEQ ID NO: 111654 - protein, 14 aa, Mycobacterium tuberculosis
PAALAEQPGVPGQH

SEQ ID NO: 111655 - protein, 14 aa, Mycobacterium tuberculosis
AALAEQPGVPGQHA

SEQ ID NO: 111656 - protein, 14 aa, Mycobacterium tuberculosis
ALAEQPGVPGQHAG

SEQ ID NO: 111657 - protein, 14 aa, Mycobacterium tuberculosis
LAEQPGVPGQHAGG

SEQ ID NO: 111658 - protein, 14 aa, Mycobacterium tuberculosis
AEQPGVPGQHAGGG

SEQ ID NO: 111659 - protein, 14 aa, Mycobacterium tuberculosis
EQPGVPGQHAGGGT

SEQ ID NO: 111660 - protein, 14 aa, Mycobacterium tuberculosis
QPGVPGQHAGGGTQ

SEQ ID NO: 111661 - protein, 14 aa, Mycobacterium tuberculosis
PGVPGQHAGGGTQS

SEQ ID NO: 111662 - protein, 14 aa, Mycobacterium tuberculosis
GVPGQHAGGGTQSG

SEQ ID NO: 111663 - protein, 14 aa, Mycobacterium tuberculosis
VPGQHAGGGTQSGP

SEQ ID NO: 111664 - protein, 14 aa, Mycobacterium tuberculosis
PGQHAGGGTQSGPA

SEQ ID NO: 111665 - protein, 14 aa, Mycobacterium tuberculosis
GQHAGGGTQSGPAH

SEQ ID NO: 111666 - protein, 14 aa, Mycobacterium tuberculosis
QHAGGGTQSGPAHA

SEQ ID NO: 111667 - protein, 14 aa, Mycobacterium tuberculosis
HAGGGTQSGPAHAD

SEQ ID NO: 111668 - protein, 14 aa, Mycobacterium tuberculosis
AGGGTQSGPAHADE

SEQ ID NO: 111669 - protein, 14 aa, Mycobacterium tuberculosis
GGGTQSGPAHADES

SEQ ID NO: 111670 - protein, 14 aa, Mycobacterium tuberculosis
GGTQSGPAHADESA

SEQ ID NO: 111671 - protein, 14 aa, Mycobacterium tuberculosis
GTQSGPAHADESAA

SEQ ID NO: 111672 - protein, 14 aa, Mycobacterium tuberculosis
TQSGPAHADESAAS

SEQ ID NO: 111673 - protein, 14 aa, Mycobacterium tuberculosis
QSGPAHADESAASV

SEQ ID NO: 111674 - protein, 14 aa, Mycobacterium tuberculosis
SGPAHADESAASVT

SEQ ID NO: 111675 - protein, 14 aa, Mycobacterium tuberculosis
GPAHADESAASVTP

SEQ ID NO: 111676 - protein, 14 aa, Mycobacterium tuberculosis
PAHADESAASVTPA

SEQ ID NO: 111677 - protein, 14 aa, Mycobacterium tuberculosis
AHADESAASVTPAA

SEQ ID NO: 111678 - protein, 14 aa, Mycobacterium tuberculosis
HADESAASVTPAAA

SEQ ID NO: 111679 - protein, 14 aa, Mycobacterium tuberculosis
ADESAASVTPAAAS

SEQ ID NO: 111680 - protein, 14 aa, Mycobacterium tuberculosis
DESAASVTPAAASG

SEQ ID NO: 111681 - protein, 14 aa, Mycobacterium tuberculosis
ESAASVTPAAASGV

SEQ ID NO: 111682 - protein, 14 aa, Mycobacterium tuberculosis
SAASVTPAAASGVP

SEQ ID NO: 111683 - protein, 14 aa, Mycobacterium tuberculosis
AASVTPAAASGVPG

SEQ ID NO: 111684 - protein, 14 aa, Mycobacterium tuberculosis
ASVTPAAASGVPGA

SEQ ID NO: 111685 - protein, 14 aa, Mycobacterium tuberculosis
SVTPAAASGVPGAR

SEQ ID NO: 111686 - protein, 14 aa, Mycobacterium tuberculosis
VTPAAASGVPGARA

SEQ ID NO: 111687 - protein, 14 aa, Mycobacterium tuberculosis
TPAAASGVPGARAA

SEQ ID NO: 111688 - protein, 14 aa, Mycobacterium tuberculosis
PAAASGVPGARAAA

SEQ ID NO: 111689 - protein, 14 aa, Mycobacterium tuberculosis
AAASGVPGARAAAA

SEQ ID NO: 111690 - protein, 14 aa, Mycobacterium tuberculosis
AASGVPGARAAAAA

SEQ ID NO: 111691 - protein, 14 aa, Mycobacterium tuberculosis
ASGVPGARAAAAAP

SEQ ID NO: 111692 - protein, 14 aa, Mycobacterium tuberculosis
SGVPGARAAAAAPS

SEQ ID NO: 111693 - protein, 14 aa, Mycobacterium tuberculosis
GVPGARAAAAAPSG

SEQ ID NO: 111694 - protein, 14 aa, Mycobacterium tuberculosis
VPGARAAAAAPSGT

SEQ ID NO: 111695 - protein, 14 aa, Mycobacterium tuberculosis
PGARAAAAAPSGTA

SEQ ID NO: 111696 - protein, 14 aa, Mycobacterium tuberculosis
GARAAAAAPSGTAV

SEQ ID NO: 111697 - protein, 14 aa, Mycobacterium tuberculosis
ARAAAAAPSGTAVG

SEQ ID NO: 111698 - protein, 14 aa, Mycobacterium tuberculosis
RAAAAAPSGTAVGA

SEQ ID NO: 111699 - protein, 14 aa, Mycobacterium tuberculosis
AAAAAPSGTAVGAG

SEQ ID NO: 111700 - protein, 14 aa, Mycobacterium tuberculosis
AAAAPSGTAVGAGA

SEQ ID NO: 111701 - protein, 14 aa, Mycobacterium tuberculosis
AAAPSGTAVGAGAR

SEQ ID NO: 111702 - protein, 14 aa, Mycobacterium tuberculosis
AAPSGTAVGAGARS

SEQ ID NO: 111703 - protein, 14 aa, Mycobacterium tuberculosis
APSGTAVGAGARSS

SEQ ID NO: 111704 - protein, 14 aa, Mycobacterium tuberculosis
PSGTAVGAGARSSV

SEQ ID NO: 111705 - protein, 14 aa, Mycobacterium tuberculosis
SGTAVGAGARSSVG

SEQ ID NO: 111706 - protein, 14 aa, Mycobacterium tuberculosis
GTAVGAGARSSVGT

SEQ ID NO: 111707 - protein, 14 aa, Mycobacterium tuberculosis
TAVGAGARSSVGTA

SEQ ID NO: 111708 - protein, 14 aa, Mycobacterium tuberculosis
AVGAGARSSVGTAA

SEQ ID NO: 111709 - protein, 14 aa, Mycobacterium tuberculosis
VGAGARSSVGTAAA

SEQ ID NO: 111710 - protein, 14 aa, Mycobacterium tuberculosis
GAGARSSVGTAAAS

SEQ ID NO: 111711 - protein, 14 aa, Mycobacterium tuberculosis
AGARSSVGTAAASG

SEQ ID NO: 111712 - protein, 14 aa, Mycobacterium tuberculosis
GARSSVGTAAASGA

SEQ ID NO: 111713 - protein, 14 aa, Mycobacterium tuberculosis
ARSSVGTAAASGAG

SEQ ID NO: 111714 - protein, 14 aa, Mycobacterium tuberculosis
RSSVGTAAASGAGS

SEQ ID NO: 111715 - protein, 14 aa, Mycobacterium tuberculosis
SSVGTAAASGAGSH

SEQ ID NO: 111716 - protein, 14 aa, Mycobacterium tuberculosis
SVGTAAASGAGSHA

SEQ ID NO: 111717 - protein, 14 aa, Mycobacterium tuberculosis
VGTAAASGAGSHAA

SEQ ID NO: 111718 - protein, 14 aa, Mycobacterium tuberculosis
GTAAASGAGSHAAT

SEQ ID NO: 111719 - protein, 14 aa, Mycobacterium tuberculosis
TAAASGAGSHAATG

SEQ ID NO: 111720 - protein, 14 aa, Mycobacterium tuberculosis
AAASGAGSHAATGR

SEQ ID NO: 111721 - protein, 14 aa, Mycobacterium tuberculosis
AASGAGSHAATGRA

SEQ ID NO: 111722 - protein, 14 aa, Mycobacterium tuberculosis
ASGAGSHAATGRAP

SEQ ID NO: 111723 - protein, 14 aa, Mycobacterium tuberculosis
SGAGSHAATGRAPV

SEQ ID NO: 111724 - protein, 14 aa, Mycobacterium tuberculosis
GAGSHAATGRAPVA

SEQ ID NO: 111725 - protein, 14 aa, Mycobacterium tuberculosis
AGSHAATGRAPVAT

SEQ ID NO: 111726 - protein, 14 aa, Mycobacterium tuberculosis
GSHAATGRAPVATS

SEQ ID NO: 111727 - protein, 14 aa, Mycobacterium tuberculosis
SHAATGRAPVATSD

SEQ ID NO: 111728 - protein, 14 aa, Mycobacterium tuberculosis
HAATGRAPVATSDK

SEQ ID NO: 111729 - protein, 14 aa, Mycobacterium tuberculosis
AATGRAPVATSDKA

SEQ ID NO: 111730 - protein, 14 aa, Mycobacterium tuberculosis
ATGRAPVATSDKAA

SEQ ID NO: 111731 - protein, 14 aa, Mycobacterium tuberculosis
TGRAPVATSDKAAA

SEQ ID NO: 111732 - protein, 14 aa, Mycobacterium tuberculosis
GRAPVATSDKAAAP

SEQ ID NO: 111733 - protein, 14 aa, Mycobacterium tuberculosis
RAPVATSDKAAAPS

SEQ ID NO: 111734 - protein, 14 aa, Mycobacterium tuberculosis
APVATSDKAAAPST

SEQ ID NO: 111735 - protein, 14 aa, Mycobacterium tuberculosis
PVATSDKAAAPSTR

SEQ ID NO: 111736 - protein, 14 aa, Mycobacterium tuberculosis
VATSDKAAAPSTRA

SEQ ID NO: 111737 - protein, 14 aa, Mycobacterium tuberculosis
ATSDKAAAPSTRAA

SEQ ID NO: 111738 - protein, 14 aa, Mycobacterium tuberculosis
TSDKAAAPSTRAAS

SEQ ID NO: 111739 - protein, 14 aa, Mycobacterium tuberculosis
SDKAAAPSTRAASA

SEQ ID NO: 111740 - protein, 14 aa, Mycobacterium tuberculosis
DKAAAPSTRAASAR

SEQ ID NO: 111741 - protein, 14 aa, Mycobacterium tuberculosis
KAAAPSTRAASART

SEQ ID NO: 111742 - protein, 14 aa, Mycobacterium tuberculosis
AAAPSTRAASARTA

SEQ ID NO: 111743 - protein, 14 aa, Mycobacterium tuberculosis
AAPSTRAASARTAP

SEQ ID NO: 111744 - protein, 14 aa, Mycobacterium tuberculosis
APSTRAASARTAPP

SEQ ID NO: 111745 - protein, 14 aa, Mycobacterium tuberculosis
PSTRAASARTAPPA

SEQ ID NO: 111746 - protein, 14 aa, Mycobacterium tuberculosis
STRAASARTAPPAR

SEQ ID NO: 111747 - protein, 14 aa, Mycobacterium tuberculosis
TRAASARTAPPARP

SEQ ID NO: 111748 - protein, 14 aa, Mycobacterium tuberculosis
RAASARTAPPARPP

SEQ ID NO: 111749 - protein, 14 aa, Mycobacterium tuberculosis
AASARTAPPARPPS

SEQ ID NO: 111750 - protein, 14 aa, Mycobacterium tuberculosis
ASARTAPPARPPST

SEQ ID NO: 111751 - protein, 14 aa, Mycobacterium tuberculosis
SARTAPPARPPSTD

SEQ ID NO: 111752 - protein, 14 aa, Mycobacterium tuberculosis
ARTAPPARPPSTDH

SEQ ID NO: 111753 - protein, 14 aa, Mycobacterium tuberculosis
RTAPPARPPSTDHI

SEQ ID NO: 111754 - protein, 14 aa, Mycobacterium tuberculosis
TAPPARPPSTDHID

SEQ ID NO: 111755 - protein, 14 aa, Mycobacterium tuberculosis
APPARPPSTDHIDK

SEQ ID NO: 111756 - protein, 14 aa, Mycobacterium tuberculosis
PPARPPSTDHIDKP

SEQ ID NO: 111757 - protein, 14 aa, Mycobacterium tuberculosis
PARPPSTDHIDKPD

SEQ ID NO: 111758 - protein, 14 aa, Mycobacterium tuberculosis
ARPPSTDHIDKPDR

SEQ ID NO: 111759 - protein, 14 aa, Mycobacterium tuberculosis
RPPSTDHIDKPDRS

SEQ ID NO: 111760 - protein, 14 aa, Mycobacterium tuberculosis
PPSTDHIDKPDRSE

SEQ ID NO: 111761 - protein, 14 aa, Mycobacterium tuberculosis
PSTDHIDKPDRSES

SEQ ID NO: 111762 - protein, 14 aa, Mycobacterium tuberculosis
STDHIDKPDRSESA

SEQ ID NO: 111763 - protein, 14 aa, Mycobacterium tuberculosis
TDHIDKPDRSESAD

SEQ ID NO: 111764 - protein, 14 aa, Mycobacterium tuberculosis
DHIDKPDRSESADD

SEQ ID NO: 111765 - protein, 14 aa, Mycobacterium tuberculosis
HIDKPDRSESADDG

SEQ ID NO: 111766 - protein, 14 aa, Mycobacterium tuberculosis
IDKPDRSESADDGT

SEQ ID NO: 111767 - protein, 14 aa, Mycobacterium tuberculosis
DKPDRSESADDGTP

SEQ ID NO: 111768 - protein, 14 aa, Mycobacterium tuberculosis
KPDRSESADDGTPV

SEQ ID NO: 111769 - protein, 14 aa, Mycobacterium tuberculosis
PDRSESADDGTPVS

SEQ ID NO: 111770 - protein, 14 aa, Mycobacterium tuberculosis
DRSESADDGTPVSM

SEQ ID NO: 111771 - protein, 14 aa, Mycobacterium tuberculosis
RSESADDGTPVSMI

SEQ ID NO: 111772 - protein, 14 aa, Mycobacterium tuberculosis
SESADDGTPVSMIP

SEQ ID NO: 111773 - protein, 14 aa, Mycobacterium tuberculosis
ESADDGTPVSMIPV

SEQ ID NO: 111774 - protein, 14 aa, Mycobacterium tuberculosis
SADDGTPVSMIPVS

SEQ ID NO: 111775 - protein, 14 aa, Mycobacterium tuberculosis
ADDGTPVSMIPVSA

SEQ ID NO: 111776 - protein, 14 aa, Mycobacterium tuberculosis
DDGTPVSMIPVSAA

SEQ ID NO: 111777 - protein, 14 aa, Mycobacterium tuberculosis
DGTPVSMIPVSAAR

SEQ ID NO: 111778 - protein, 14 aa, Mycobacterium tuberculosis
GTPVSMIPVSAARA

SEQ ID NO: 111779 - protein, 14 aa, Mycobacterium tuberculosis
TPVSMIPVSAARAA

SEQ ID NO: 111780 - protein, 14 aa, Mycobacterium tuberculosis
PVSMIPVSAARAAR

SEQ ID NO: 111781 - protein, 14 aa, Mycobacterium tuberculosis
VSMIPVSAARAARD

SEQ ID NO: 111782 - protein, 14 aa, Mycobacterium tuberculosis
SMIPVSAARAARDA

SEQ ID NO: 111783 - protein, 14 aa, Mycobacterium tuberculosis
MIPVSAARAARDAA

SEQ ID NO: 111784 - protein, 14 aa, Mycobacterium tuberculosis
IPVSAARAARDAAT

SEQ ID NO: 111785 - protein, 14 aa, Mycobacterium tuberculosis
PVSAARAARDAATA

SEQ ID NO: 111786 - protein, 14 aa, Mycobacterium tuberculosis
VSAARAARDAATAA

SEQ ID NO: 111787 - protein, 14 aa, Mycobacterium tuberculosis
SAARAARDAATAAA

SEQ ID NO: 111788 - protein, 14 aa, Mycobacterium tuberculosis
AARAARDAATAAAS

SEQ ID NO: 111789 - protein, 14 aa, Mycobacterium tuberculosis
ARAARDAATAAASA

SEQ ID NO: 111790 - protein, 14 aa, Mycobacterium tuberculosis
RAARDAATAAASAR

SEQ ID NO: 111791 - protein, 14 aa, Mycobacterium tuberculosis
AARDAATAAASARQ

SEQ ID NO: 111792 - protein, 14 aa, Mycobacterium tuberculosis
ARDAATAAASARQR

SEQ ID NO: 111793 - protein, 14 aa, Mycobacterium tuberculosis
RDAATAAASARQRG

SEQ ID NO: 111794 - protein, 14 aa, Mycobacterium tuberculosis
DAATAAASARQRGR

SEQ ID NO: 111795 - protein, 14 aa, Mycobacterium tuberculosis
AATAAASARQRGRG

SEQ ID NO: 111796 - protein, 14 aa, Mycobacterium tuberculosis
ATAAASARQRGRGD

SEQ ID NO: 111797 - protein, 14 aa, Mycobacterium tuberculosis
TAAASARQRGRGDA

SEQ ID NO: 111798 - protein, 14 aa, Mycobacterium tuberculosis
AAASARQRGRGDAL

SEQ ID NO: 111799 - protein, 14 aa, Mycobacterium tuberculosis
AASARQRGRGDALR

SEQ ID NO: 111800 - protein, 14 aa, Mycobacterium tuberculosis
ASARQRGRGDALRL

SEQ ID NO: 111801 - protein, 14 aa, Mycobacterium tuberculosis
SARQRGRGDALRLA

SEQ ID NO: 111802 - protein, 14 aa, Mycobacterium tuberculosis
ARQRGRGDALRLAR

SEQ ID NO: 111803 - protein, 14 aa, Mycobacterium tuberculosis
RQRGRGDALRLARR

SEQ ID NO: 111804 - protein, 14 aa, Mycobacterium tuberculosis
QRGRGDALRLARRI

SEQ ID NO: 111805 - protein, 14 aa, Mycobacterium tuberculosis
RGRGDALRLARRIA

SEQ ID NO: 111806 - protein, 14 aa, Mycobacterium tuberculosis
GRGDALRLARRIAA

SEQ ID NO: 111807 - protein, 14 aa, Mycobacterium tuberculosis
RGDALRLARRIAAA

SEQ ID NO: 111808 - protein, 14 aa, Mycobacterium tuberculosis
GDALRLARRIAAAL

SEQ ID NO: 111809 - protein, 14 aa, Mycobacterium tuberculosis
DALRLARRIAAALN

SEQ ID NO: 111810 - protein, 14 aa, Mycobacterium tuberculosis
ALRLARRIAAALNA

SEQ ID NO: 111811 - protein, 14 aa, Mycobacterium tuberculosis
LRLARRIAAALNAS

SEQ ID NO: 111812 - protein, 14 aa, Mycobacterium tuberculosis
RLARRIAAALNASD

SEQ ID NO: 111813 - protein, 14 aa, Mycobacterium tuberculosis
LARRIAAALNASDN

SEQ ID NO: 111814 - protein, 14 aa, Mycobacterium tuberculosis
ARRIAAALNASDNN

SEQ ID NO: 111815 - protein, 14 aa, Mycobacterium tuberculosis
RRIAAALNASDNNA

SEQ ID NO: 111816 - protein, 14 aa, Mycobacterium tuberculosis
RIAAALNASDNNAG

SEQ ID NO: 111817 - protein, 14 aa, Mycobacterium tuberculosis
IAAALNASDNNAGD

SEQ ID NO: 111818 - protein, 14 aa, Mycobacterium tuberculosis
AAALNASDNNAGDY

SEQ ID NO: 111819 - protein, 14 aa, Mycobacterium tuberculosis
AALNASDNNAGDYG

SEQ ID NO: 111820 - protein, 14 aa, Mycobacterium tuberculosis
ALNASDNNAGDYGF

SEQ ID NO: 111821 - protein, 14 aa, Mycobacterium tuberculosis
LNASDNNAGDYGFF

SEQ ID NO: 111822 - protein, 14 aa, Mycobacterium tuberculosis
NASDNNAGDYGFFW

SEQ ID NO: 111823 - protein, 14 aa, Mycobacterium tuberculosis
ASDNNAGDYGFFWI

SEQ ID NO: 111824 - protein, 14 aa, Mycobacterium tuberculosis
SDNNAGDYGFFWIT

SEQ ID NO: 111825 - protein, 14 aa, Mycobacterium tuberculosis
DNNAGDYGFFWITA

SEQ ID NO: 111826 - protein, 14 aa, Mycobacterium tuberculosis
NNAGDYGFFWITAV

SEQ ID NO: 111827 - protein, 14 aa, Mycobacterium tuberculosis
NAGDYGFFWITAVT

SEQ ID NO: 111828 - protein, 14 aa, Mycobacterium tuberculosis
AGDYGFFWITAVTT

SEQ ID NO: 111829 - protein, 14 aa, Mycobacterium tuberculosis
GDYGFFWITAVTTD

SEQ ID NO: 111830 - protein, 14 aa, Mycobacterium tuberculosis
DYGFFWITAVTTDG

SEQ ID NO: 111831 - protein, 14 aa, Mycobacterium tuberculosis
YGFFWITAVTTDGS

SEQ ID NO: 111832 - protein, 14 aa, Mycobacterium tuberculosis
GFFWITAVTTDGSI

SEQ ID NO: 111833 - protein, 14 aa, Mycobacterium tuberculosis
FFWITAVTTDGSIV

SEQ ID NO: 111834 - protein, 14 aa, Mycobacterium tuberculosis
FWITAVTTDGSIVV

SEQ ID NO: 111835 - protein, 14 aa, Mycobacterium tuberculosis
WITAVTTDGSIVVA

SEQ ID NO: 111836 - protein, 14 aa, Mycobacterium tuberculosis
ITAVTTDGSIVVAN

SEQ ID NO: 111837 - protein, 14 aa, Mycobacterium tuberculosis
TAVTTDGSIVVANS

SEQ ID NO: 111838 - protein, 14 aa, Mycobacterium tuberculosis
AVTTDGSIVVANSY

SEQ ID NO: 111839 - protein, 14 aa, Mycobacterium tuberculosis
VTTDGSIVVANSYG

SEQ ID NO: 111840 - protein, 14 aa, Mycobacterium tuberculosis
TTDGSIVVANSYGL

SEQ ID NO: 111841 - protein, 14 aa, Mycobacterium tuberculosis
TDGSIVVANSYGLA

SEQ ID NO: 111842 - protein, 14 aa, Mycobacterium tuberculosis
DGSIVVANSYGLAY

SEQ ID NO: 111843 - protein, 14 aa, Mycobacterium tuberculosis
GSIVVANSYGLAYI

SEQ ID NO: 111844 - protein, 14 aa, Mycobacterium tuberculosis
SIVVANSYGLAYIP

SEQ ID NO: 111845 - protein, 14 aa, Mycobacterium tuberculosis
IVVANSYGLAYIPD

SEQ ID NO: 111846 - protein, 14 aa, Mycobacterium tuberculosis
VVANSYGLAYIPDG

SEQ ID NO: 111847 - protein, 14 aa, Mycobacterium tuberculosis
VANSYGLAYIPDGM

SEQ ID NO: 111848 - protein, 14 aa, Mycobacterium tuberculosis
ANSYGLAYIPDGME

SEQ ID NO: 111849 - protein, 14 aa, Mycobacterium tuberculosis
NSYGLAYIPDGMEL

SEQ ID NO: 111850 - protein, 14 aa, Mycobacterium tuberculosis
SYGLAYIPDGMELP

SEQ ID NO: 111851 - protein, 14 aa, Mycobacterium tuberculosis
YGLAYIPDGMELPN

SEQ ID NO: 111852 - protein, 14 aa, Mycobacterium tuberculosis
GLAYIPDGMELPNK

SEQ ID NO: 111853 - protein, 14 aa, Mycobacterium tuberculosis
LAYIPDGMELPNKV

SEQ ID NO: 111854 - protein, 14 aa, Mycobacterium tuberculosis
AYIPDGMELPNKVY

SEQ ID NO: 111855 - protein, 14 aa, Mycobacterium tuberculosis
YIPDGMELPNKVYL

SEQ ID NO: 111856 - protein, 14 aa, Mycobacterium tuberculosis
IPDGMELPNKVYLA

SEQ ID NO: 111857 - protein, 14 aa, Mycobacterium tuberculosis
PDGMELPNKVYLAS

SEQ ID NO: 111858 - protein, 14 aa, Mycobacterium tuberculosis
DGMELPNKVYLASA

SEQ ID NO: 111859 - protein, 14 aa, Mycobacterium tuberculosis
GMELPNKVYLASAD

SEQ ID NO: 111860 - protein, 14 aa, Mycobacterium tuberculosis
MELPNKVYLASADH

SEQ ID NO: 111861 - protein, 14 aa, Mycobacterium tuberculosis
ELPNKVYLASADHA

SEQ ID NO: 111862 - protein, 14 aa, Mycobacterium tuberculosis
LPNKVYLASADHAI

SEQ ID NO: 111863 - protein, 14 aa, Mycobacterium tuberculosis
PNKVYLASADHAIP

SEQ ID NO: 111864 - protein, 14 aa, Mycobacterium tuberculosis
NKVYLASADHAIPV

SEQ ID NO: 111865 - protein, 14 aa, Mycobacterium tuberculosis
KVYLASADHAIPVD

SEQ ID NO: 111866 - protein, 14 aa, Mycobacterium tuberculosis
VYLASADHAIPVDE

SEQ ID NO: 111867 - protein, 14 aa, Mycobacterium tuberculosis
YLASADHAIPVDEI

SEQ ID NO: 111868 - protein, 14 aa, Mycobacterium tuberculosis
LASADHAIPVDEIA

SEQ ID NO: 111869 - protein, 14 aa, Mycobacterium tuberculosis
ASADHAIPVDEIAR

SEQ ID NO: 111870 - protein, 14 aa, Mycobacterium tuberculosis
SADHAIPVDEIARC

SEQ ID NO: 111871 - protein, 14 aa, Mycobacterium tuberculosis
ADHAIPVDEIARCA

SEQ ID NO: 111872 - protein, 14 aa, Mycobacterium tuberculosis
DHAIPVDEIARCAT

SEQ ID NO: 111873 - protein, 14 aa, Mycobacterium tuberculosis
HAIPVDEIARCATY

SEQ ID NO: 111874 - protein, 14 aa, Mycobacterium tuberculosis
AIPVDEIARCATYP

SEQ ID NO: 111875 - protein, 14 aa, Mycobacterium tuberculosis
IPVDEIARCATYPV

SEQ ID NO: 111876 - protein, 14 aa, Mycobacterium tuberculosis
PVDEIARCATYPVL

SEQ ID NO: 111877 - protein, 14 aa, Mycobacterium tuberculosis
VDEIARCATYPVLA

SEQ ID NO: 111878 - protein, 14 aa, Mycobacterium tuberculosis
DEIARCATYPVLAV

SEQ ID NO: 111879 - protein, 14 aa, Mycobacterium tuberculosis
EIARCATYPVLAVQ

SEQ ID NO: 111880 - protein, 14 aa, Mycobacterium tuberculosis
IARCATYPVLAVQA

SEQ ID NO: 111881 - protein, 14 aa, Mycobacterium tuberculosis
ARCATYPVLAVQAW

SEQ ID NO: 111882 - protein, 14 aa, Mycobacterium tuberculosis
RCATYPVLAVQAWA

SEQ ID NO: 111883 - protein, 14 aa, Mycobacterium tuberculosis
CATYPVLAVQAWAA

SEQ ID NO: 111884 - protein, 14 aa, Mycobacterium tuberculosis
ATYPVLAVQAWAAF

SEQ ID NO: 111885 - protein, 14 aa, Mycobacterium tuberculosis
TYPVLAVQAWAAFH

SEQ ID NO: 111886 - protein, 14 aa, Mycobacterium tuberculosis
YPVLAVQAWAAFHD

SEQ ID NO: 111887 - protein, 14 aa, Mycobacterium tuberculosis
PVLAVQAWAAFHDM

SEQ ID NO: 111888 - protein, 14 aa, Mycobacterium tuberculosis
VLAVQAWAAFHDMT

SEQ ID NO: 111889 - protein, 14 aa, Mycobacterium tuberculosis
LAVQAWAAFHDMTL

SEQ ID NO: 111890 - protein, 14 aa, Mycobacterium tuberculosis
AVQAWAAFHDMTLR

SEQ ID NO: 111891 - protein, 14 aa, Mycobacterium tuberculosis
VQAWAAFHDMTLRA

SEQ ID NO: 111892 - protein, 14 aa, Mycobacterium tuberculosis
QAWAAFHDMTLRAV

SEQ ID NO: 111893 - protein, 14 aa, Mycobacterium tuberculosis
AWAAFHDMTLRAVI

SEQ ID NO: 111894 - protein, 14 aa, Mycobacterium tuberculosis
WAAFHDMTLRAVIG

SEQ ID NO: 111895 - protein, 14 aa, Mycobacterium tuberculosis
AAFHDMTLRAVIGT

SEQ ID NO: 111896 - protein, 14 aa, Mycobacterium tuberculosis
AFHDMTLRAVIGTA

SEQ ID NO: 111897 - protein, 14 aa, Mycobacterium tuberculosis
FHDMTLRAVIGTAE

SEQ ID NO: 111898 - protein, 14 aa, Mycobacterium tuberculosis
HDMTLRAVIGTAEQ

SEQ ID NO: 111899 - protein, 14 aa, Mycobacterium tuberculosis
DMTLRAVIGTAEQL

SEQ ID NO: 111900 - protein, 14 aa, Mycobacterium tuberculosis
MTLRAVIGTAEQLA

SEQ ID NO: 111901 - protein, 14 aa, Mycobacterium tuberculosis
TLRAVIGTAEQLAS

SEQ ID NO: 111902 - protein, 14 aa, Mycobacterium tuberculosis
LRAVIGTAEQLASS

SEQ ID NO: 111903 - protein, 14 aa, Mycobacterium tuberculosis
RAVIGTAEQLASSD

SEQ ID NO: 111904 - protein, 14 aa, Mycobacterium tuberculosis
AVIGTAEQLASSDP

SEQ ID NO: 111905 - protein, 14 aa, Mycobacterium tuberculosis
VIGTAEQLASSDPG

SEQ ID NO: 111906 - protein, 14 aa, Mycobacterium tuberculosis
IGTAEQLASSDPGV

SEQ ID NO: 111907 - protein, 14 aa, Mycobacterium tuberculosis
GTAEQLASSDPGVA

SEQ ID NO: 111908 - protein, 14 aa, Mycobacterium tuberculosis
TAEQLASSDPGVAK

SEQ ID NO: 111909 - protein, 14 aa, Mycobacterium tuberculosis
AEQLASSDPGVAKI

SEQ ID NO: 111910 - protein, 14 aa, Mycobacterium tuberculosis
EQLASSDPGVAKIV

SEQ ID NO: 111911 - protein, 14 aa, Mycobacterium tuberculosis
QLASSDPGVAKIVL

SEQ ID NO: 111912 - protein, 14 aa, Mycobacterium tuberculosis
LASSDPGVAKIVLE

SEQ ID NO: 111913 - protein, 14 aa, Mycobacterium tuberculosis
ASSDPGVAKIVLEP

SEQ ID NO: 111914 - protein, 14 aa, Mycobacterium tuberculosis
SSDPGVAKIVLEPD

SEQ ID NO: 111915 - protein, 14 aa, Mycobacterium tuberculosis
SDPGVAKIVLEPDD

SEQ ID NO: 111916 - protein, 14 aa, Mycobacterium tuberculosis
DPGVAKIVLEPDDI

SEQ ID NO: 111917 - protein, 14 aa, Mycobacterium tuberculosis
PGVAKIVLEPDDIP

SEQ ID NO: 111918 - protein, 14 aa, Mycobacterium tuberculosis
GVAKIVLEPDDIPE

SEQ ID NO: 111919 - protein, 14 aa, Mycobacterium tuberculosis
VAKIVLEPDDIPES

SEQ ID NO: 111920 - protein, 14 aa, Mycobacterium tuberculosis
AKIVLEPDDIPESG

SEQ ID NO: 111921 - protein, 14 aa, Mycobacterium tuberculosis
KIVLEPDDIPESGK

SEQ ID NO: 111922 - protein, 14 aa, Mycobacterium tuberculosis
IVLEPDDIPESGKM

SEQ ID NO: 111923 - protein, 14 aa, Mycobacterium tuberculosis
VLEPDDIPESGKMT

SEQ ID NO: 111924 - protein, 14 aa, Mycobacterium tuberculosis
LEPDDIPESGKMTG

SEQ ID NO: 111925 - protein, 14 aa, Mycobacterium tuberculosis
EPDDIPESGKMTGR

SEQ ID NO: 111926 - protein, 14 aa, Mycobacterium tuberculosis
PDDIPESGKMTGRS

SEQ ID NO: 111927 - protein, 14 aa, Mycobacterium tuberculosis
DDIPESGKMTGRSR

SEQ ID NO: 111928 - protein, 14 aa, Mycobacterium tuberculosis
DIPESGKMTGRSRL

SEQ ID NO: 111929 - protein, 14 aa, Mycobacterium tuberculosis
IPESGKMTGRSRLE

SEQ ID NO: 111930 - protein, 14 aa, Mycobacterium tuberculosis
PESGKMTGRSRLEV

SEQ ID NO: 111931 - protein, 14 aa, Mycobacterium tuberculosis
ESGKMTGRSRLEVV

SEQ ID NO: 111932 - protein, 14 aa, Mycobacterium tuberculosis
SGKMTGRSRLEVVD

SEQ ID NO: 111933 - protein, 14 aa, Mycobacterium tuberculosis
GKMTGRSRLEVVDP

SEQ ID NO: 111934 - protein, 14 aa, Mycobacterium tuberculosis
KMTGRSRLEVVDPS

SEQ ID NO: 111935 - protein, 14 aa, Mycobacterium tuberculosis
MTGRSRLEVVDPSA

SEQ ID NO: 111936 - protein, 14 aa, Mycobacterium tuberculosis
TGRSRLEVVDPSAA

SEQ ID NO: 111937 - protein, 14 aa, Mycobacterium tuberculosis
GRSRLEVVDPSAAA

SEQ ID NO: 111938 - protein, 14 aa, Mycobacterium tuberculosis
RSRLEVVDPSAAAQ

SEQ ID NO: 111939 - protein, 14 aa, Mycobacterium tuberculosis
SRLEVVDPSAAAQL

SEQ ID NO: 111940 - protein, 14 aa, Mycobacterium tuberculosis
RLEVVDPSAAAQLA

SEQ ID NO: 111941 - protein, 14 aa, Mycobacterium tuberculosis
LEVVDPSAAAQLAD

SEQ ID NO: 111942 - protein, 14 aa, Mycobacterium tuberculosis
EVVDPSAAAQLADT

SEQ ID NO: 111943 - protein, 14 aa, Mycobacterium tuberculosis
VVDPSAAAQLADTT

SEQ ID NO: 111944 - protein, 14 aa, Mycobacterium tuberculosis
VDPSAAAQLADTTD

SEQ ID NO: 111945 - protein, 14 aa, Mycobacterium tuberculosis
DPSAAAQLADTTDQ

SEQ ID NO: 111946 - protein, 14 aa, Mycobacterium tuberculosis
PSAAAQLADTTDQR

SEQ ID NO: 111947 - protein, 14 aa, Mycobacterium tuberculosis
SAAAQLADTTDQRL

SEQ ID NO: 111948 - protein, 14 aa, Mycobacterium tuberculosis
AAAQLADTTDQRLL

SEQ ID NO: 111949 - protein, 14 aa, Mycobacterium tuberculosis
AAQLADTTDQRLLD

SEQ ID NO: 111950 - protein, 14 aa, Mycobacterium tuberculosis
AQLADTTDQRLLDL

SEQ ID NO: 111951 - protein, 14 aa, Mycobacterium tuberculosis
QLADTTDQRLLDLL

SEQ ID NO: 111952 - protein, 14 aa, Mycobacterium tuberculosis
LADTTDQRLLDLLP

SEQ ID NO: 111953 - protein, 14 aa, Mycobacterium tuberculosis
ADTTDQRLLDLLPP

SEQ ID NO: 111954 - protein, 14 aa, Mycobacterium tuberculosis
DTTDQRLLDLLPPA

SEQ ID NO: 111955 - protein, 14 aa, Mycobacterium tuberculosis
TTDQRLLDLLPPAP

SEQ ID NO: 111956 - protein, 14 aa, Mycobacterium tuberculosis
TDQRLLDLLPPAPV

SEQ ID NO: 111957 - protein, 14 aa, Mycobacterium tuberculosis
DQRLLDLLPPAPVD

SEQ ID NO: 111958 - protein, 14 aa, Mycobacterium tuberculosis
QRLLDLLPPAPVDV

SEQ ID NO: 111959 - protein, 14 aa, Mycobacterium tuberculosis
RLLDLLPPAPVDVN

SEQ ID NO: 111960 - protein, 14 aa, Mycobacterium tuberculosis
LLDLLPPAPVDVNP

SEQ ID NO: 111961 - protein, 14 aa, Mycobacterium tuberculosis
LDLLPPAPVDVNPP

SEQ ID NO: 111962 - protein, 14 aa, Mycobacterium tuberculosis
DLLPPAPVDVNPPG

SEQ ID NO: 111963 - protein, 14 aa, Mycobacterium tuberculosis
LLPPAPVDVNPPGD

SEQ ID NO: 111964 - protein, 14 aa, Mycobacterium tuberculosis
LPPAPVDVNPPGDE

SEQ ID NO: 111965 - protein, 14 aa, Mycobacterium tuberculosis
PPAPVDVNPPGDER

SEQ ID NO: 111966 - protein, 14 aa, Mycobacterium tuberculosis
PAPVDVNPPGDERH

SEQ ID NO: 111967 - protein, 14 aa, Mycobacterium tuberculosis
APVDVNPPGDERHM

SEQ ID NO: 111968 - protein, 14 aa, Mycobacterium tuberculosis
PVDVNPPGDERHML

SEQ ID NO: 111969 - protein, 14 aa, Mycobacterium tuberculosis
VDVNPPGDERHMLW

SEQ ID NO: 111970 - protein, 14 aa, Mycobacterium tuberculosis
DVNPPGDERHMLWF

SEQ ID NO: 111971 - protein, 14 aa, Mycobacterium tuberculosis
VNPPGDERHMLWFE

SEQ ID NO: 111972 - protein, 14 aa, Mycobacterium tuberculosis
NPPGDERHMLWFEL

SEQ ID NO: 111973 - protein, 14 aa, Mycobacterium tuberculosis
PPGDERHMLWFELM

SEQ ID NO: 111974 - protein, 14 aa, Mycobacterium tuberculosis
PGDERHMLWFELMK

SEQ ID NO: 111975 - protein, 14 aa, Mycobacterium tuberculosis
GDERHMLWFELMKP

SEQ ID NO: 111976 - protein, 14 aa, Mycobacterium tuberculosis
DERHMLWFELMKPM

SEQ ID NO: 111977 - protein, 14 aa, Mycobacterium tuberculosis
ERHMLWFELMKPMT

SEQ ID NO: 111978 - protein, 14 aa, Mycobacterium tuberculosis
RHMLWFELMKPMTS

SEQ ID NO: 111979 - protein, 14 aa, Mycobacterium tuberculosis
HMLWFELMKPMTST

SEQ ID NO: 111980 - protein, 14 aa, Mycobacterium tuberculosis
MLWFELMKPMTSTA

SEQ ID NO: 111981 - protein, 14 aa, Mycobacterium tuberculosis
LWFELMKPMTSTAT

SEQ ID NO: 111982 - protein, 14 aa, Mycobacterium tuberculosis
WFELMKPMTSTATG

SEQ ID NO: 111983 - protein, 14 aa, Mycobacterium tuberculosis
FELMKPMTSTATGR

SEQ ID NO: 111984 - protein, 14 aa, Mycobacterium tuberculosis
ELMKPMTSTATGRE

SEQ ID NO: 111985 - protein, 14 aa, Mycobacterium tuberculosis
LMKPMTSTATGREA

SEQ ID NO: 111986 - protein, 14 aa, Mycobacterium tuberculosis
MKPMTSTATGREAA

SEQ ID NO: 111987 - protein, 14 aa, Mycobacterium tuberculosis
KPMTSTATGREAAH

SEQ ID NO: 111988 - protein, 14 aa, Mycobacterium tuberculosis
PMTSTATGREAAHL

SEQ ID NO: 111989 - protein, 14 aa, Mycobacterium tuberculosis
MTSTATGREAAHLR

SEQ ID NO: 111990 - protein, 14 aa, Mycobacterium tuberculosis
TSTATGREAAHLRA

SEQ ID NO: 111991 - protein, 14 aa, Mycobacterium tuberculosis
STATGREAAHLRAF

SEQ ID NO: 111992 - protein, 14 aa, Mycobacterium tuberculosis
TATGREAAHLRAFR

SEQ ID NO: 111993 - protein, 14 aa, Mycobacterium tuberculosis
ATGREAAHLRAFRA

SEQ ID NO: 111994 - protein, 14 aa, Mycobacterium tuberculosis
TGREAAHLRAFRAY

SEQ ID NO: 111995 - protein, 14 aa, Mycobacterium tuberculosis
GREAAHLRAFRAYA

SEQ ID NO: 111996 - protein, 14 aa, Mycobacterium tuberculosis
REAAHLRAFRAYAA

SEQ ID NO: 111997 - protein, 14 aa, Mycobacterium tuberculosis
EAAHLRAFRAYAAH

SEQ ID NO: 111998 - protein, 14 aa, Mycobacterium tuberculosis
AAHLRAFRAYAAHS

SEQ ID NO: 111999 - protein, 14 aa, Mycobacterium tuberculosis
AHLRAFRAYAAHSQ

SEQ ID NO: 112000 - protein, 14 aa, Mycobacterium tuberculosis
HLRAFRAYAAHSQE

SEQ ID NO: 112001 - protein, 14 aa, Mycobacterium tuberculosis
LRAFRAYAAHSQEI

SEQ ID NO: 112002 - protein, 14 aa, Mycobacterium tuberculosis
RAFRAYAAHSQEIA

SEQ ID NO: 112003 - protein, 14 aa, Mycobacterium tuberculosis
AFRAYAAHSQEIAL

SEQ ID NO: 112004 - protein, 14 aa, Mycobacterium tuberculosis
FRAYAAHSQEIALH

SEQ ID NO: 112005 - protein, 14 aa, Mycobacterium tuberculosis
RAYAAHSQEIALHQ

SEQ ID NO: 112006 - protein, 14 aa, Mycobacterium tuberculosis
AYAAHSQEIALHQA

SEQ ID NO: 112007 - protein, 14 aa, Mycobacterium tuberculosis
YAAHSQEIALHQAH

SEQ ID NO: 112008 - protein, 14 aa, Mycobacterium tuberculosis
AAHSQEIALHQAHT

SEQ ID NO: 112009 - protein, 14 aa, Mycobacterium tuberculosis
AHSQEIALHQAHTA

SEQ ID NO: 112010 - protein, 14 aa, Mycobacterium tuberculosis
HSQEIALHQAHTAT

SEQ ID NO: 112011 - protein, 14 aa, Mycobacterium tuberculosis
SQEIALHQAHTATD

SEQ ID NO: 112012 - protein, 14 aa, Mycobacterium tuberculosis
QEIALHQAHTATDA

SEQ ID NO: 112013 - protein, 14 aa, Mycobacterium tuberculosis
EIALHQAHTATDAA

SEQ ID NO: 112014 - protein, 14 aa, Mycobacterium tuberculosis
IALHQAHTATDAAV

SEQ ID NO: 112015 - protein, 14 aa, Mycobacterium tuberculosis
ALHQAHTATDAAVQ

SEQ ID NO: 112016 - protein, 14 aa, Mycobacterium tuberculosis
LHQAHTATDAAVQR

SEQ ID NO: 112017 - protein, 14 aa, Mycobacterium tuberculosis
HQAHTATDAAVQRV

SEQ ID NO: 112018 - protein, 14 aa, Mycobacterium tuberculosis
QAHTATDAAVQRVA

SEQ ID NO: 112019 - protein, 14 aa, Mycobacterium tuberculosis
AHTATDAAVQRVAV

SEQ ID NO: 112020 - protein, 14 aa, Mycobacterium tuberculosis
HTATDAAVQRVAVA

SEQ ID NO: 112021 - protein, 14 aa, Mycobacterium tuberculosis
TATDAAVQRVAVAD

SEQ ID NO: 112022 - protein, 14 aa, Mycobacterium tuberculosis
ATDAAVQRVAVADW

SEQ ID NO: 112023 - protein, 14 aa, Mycobacterium tuberculosis
TDAAVQRVAVADWL

SEQ ID NO: 112024 - protein, 14 aa, Mycobacterium tuberculosis
DAAVQRVAVADWLY

SEQ ID NO: 112025 - protein, 14 aa, Mycobacterium tuberculosis
AAVQRVAVADWLYW

SEQ ID NO: 112026 - protein, 14 aa, Mycobacterium tuberculosis
AVQRVAVADWLYWQ

SEQ ID NO: 112027 - protein, 14 aa, Mycobacterium tuberculosis
VQRVAVADWLYWQY

SEQ ID NO: 112028 - protein, 14 aa, Mycobacterium tuberculosis
QRVAVADWLYWQYV

SEQ ID NO: 112029 - protein, 14 aa, Mycobacterium tuberculosis
RVAVADWLYWQYVT

SEQ ID NO: 112030 - protein, 14 aa, Mycobacterium tuberculosis
VAVADWLYWQYVTG

SEQ ID NO: 112031 - protein, 14 aa, Mycobacterium tuberculosis
AVADWLYWQYVTGL

SEQ ID NO: 112032 - protein, 14 aa, Mycobacterium tuberculosis
VADWLYWQYVTGLL

SEQ ID NO: 112033 - protein, 14 aa, Mycobacterium tuberculosis
ADWLYWQYVTGLLD

SEQ ID NO: 112034 - protein, 14 aa, Mycobacterium tuberculosis
DWLYWQYVTGLLDR

SEQ ID NO: 112035 - protein, 14 aa, Mycobacterium tuberculosis
WLYWQYVTGLLDRA

SEQ ID NO: 112036 - protein, 14 aa, Mycobacterium tuberculosis
LYWQYVTGLLDRAL

SEQ ID NO: 112037 - protein, 14 aa, Mycobacterium tuberculosis
YWQYVTGLLDRALA

SEQ ID NO: 112038 - protein, 14 aa, Mycobacterium tuberculosis
WQYVTGLLDRALAA

SEQ ID NO: 112039 - protein, 14 aa, Mycobacterium tuberculosis
QYVTGLLDRALAAA

SEQ ID NO: 112040 - protein, 14 aa, Mycobacterium tuberculosis
YVTGLLDRALAAAC

SEQ ID NO: 112041 - protein, 15 aa, Mycobacterium tuberculosis
MSITRPTGSYARQML

SEQ ID NO: 112042 - protein, 15 aa, Mycobacterium tuberculosis
SITRPTGSYARQMLD

SEQ ID NO: 112043 - protein, 15 aa, Mycobacterium tuberculosis
ITRPTGSYARQMLDP

SEQ ID NO: 112044 - protein, 15 aa, Mycobacterium tuberculosis
TRPTGSYARQMLDPG

SEQ ID NO: 112045 - protein, 15 aa, Mycobacterium tuberculosis
RPTGSYARQMLDPGG

SEQ ID NO: 112046 - protein, 15 aa, Mycobacterium tuberculosis
PTGSYARQMLDPGGW

SEQ ID NO: 112047 - protein, 15 aa, Mycobacterium tuberculosis
TGSYARQMLDPGGWV

SEQ ID NO: 112048 - protein, 15 aa, Mycobacterium tuberculosis
GSYARQMLDPGGWVE

SEQ ID NO: 112049 - protein, 15 aa, Mycobacterium tuberculosis
SYARQMLDPGGWVEA

SEQ ID NO: 112050 - protein, 15 aa, Mycobacterium tuberculosis
YARQMLDPGGWVEAD

SEQ ID NO: 112051 - protein, 15 aa, Mycobacterium tuberculosis
ARQMLDPGGWVEADE

SEQ ID NO: 112052 - protein, 15 aa, Mycobacterium tuberculosis
RQMLDPGGWVEADED

SEQ ID NO: 112053 - protein, 15 aa, Mycobacterium tuberculosis
QMLDPGGWVEADEDT

SEQ ID NO: 112054 - protein, 15 aa, Mycobacterium tuberculosis
MLDPGGWVEADEDTF

SEQ ID NO: 112055 - protein, 15 aa, Mycobacterium tuberculosis
LDPGGWVEADEDTFY

SEQ ID NO: 112056 - protein, 15 aa, Mycobacterium tuberculosis
DPGGWVEADEDTFYD

SEQ ID NO: 112057 - protein, 15 aa, Mycobacterium tuberculosis
PGGWVEADEDTFYDR

SEQ ID NO: 112058 - protein, 15 aa, Mycobacterium tuberculosis
GGWVEADEDTFYDRA

SEQ ID NO: 112059 - protein, 15 aa, Mycobacterium tuberculosis
GWVEADEDTFYDRAQ

SEQ ID NO: 112060 - protein, 15 aa, Mycobacterium tuberculosis
WVEADEDTFYDRAQE

SEQ ID NO: 112061 - protein, 15 aa, Mycobacterium tuberculosis
VEADEDTFYDRAQEY

SEQ ID NO: 112062 - protein, 15 aa, Mycobacterium tuberculosis
EADEDTFYDRAQEYS

SEQ ID NO: 112063 - protein, 15 aa, Mycobacterium tuberculosis
ADEDTFYDRAQEYSQ

SEQ ID NO: 112064 - protein, 15 aa, Mycobacterium tuberculosis
DEDTFYDRAQEYSQV

SEQ ID NO: 112065 - protein, 15 aa, Mycobacterium tuberculosis
EDTFYDRAQEYSQVL

SEQ ID NO: 112066 - protein, 15 aa, Mycobacterium tuberculosis
DTFYDRAQEYSQVLQ

SEQ ID NO: 112067 - protein, 15 aa, Mycobacterium tuberculosis
TFYDRAQEYSQVLQR

SEQ ID NO: 112068 - protein, 15 aa, Mycobacterium tuberculosis
FYDRAQEYSQVLQRV

SEQ ID NO: 112069 - protein, 15 aa, Mycobacterium tuberculosis
YDRAQEYSQVLQRVT

SEQ ID NO: 112070 - protein, 15 aa, Mycobacterium tuberculosis
DRAQEYSQVLQRVTD

SEQ ID NO: 112071 - protein, 15 aa, Mycobacterium tuberculosis
RAQEYSQVLQRVTDV

SEQ ID NO: 112072 - protein, 15 aa, Mycobacterium tuberculosis
AQEYSQVLQRVTDVL

SEQ ID NO: 112073 - protein, 15 aa, Mycobacterium tuberculosis
QEYSQVLQRVTDVLD

SEQ ID NO: 112074 - protein, 15 aa, Mycobacterium tuberculosis
EYSQVLQRVTDVLDT

SEQ ID NO: 112075 - protein, 15 aa, Mycobacterium tuberculosis
YSQVLQRVTDVLDTC

SEQ ID NO: 112076 - protein, 15 aa, Mycobacterium tuberculosis
SQVLQRVTDVLDTCR

SEQ ID NO: 112077 - protein, 15 aa, Mycobacterium tuberculosis
QVLQRVTDVLDTCRQ

SEQ ID NO: 112078 - protein, 15 aa, Mycobacterium tuberculosis
VLQRVTDVLDTCRQQ

SEQ ID NO: 112079 - protein, 15 aa, Mycobacterium tuberculosis
LQRVTDVLDTCRQQK

SEQ ID NO: 112080 - protein, 15 aa, Mycobacterium tuberculosis
QRVTDVLDTCRQQKG

SEQ ID NO: 112081 - protein, 15 aa, Mycobacterium tuberculosis
RVTDVLDTCRQQKGH

SEQ ID NO: 112082 - protein, 15 aa, Mycobacterium tuberculosis
VTDVLDTCRQQKGHV

SEQ ID NO: 112083 - protein, 15 aa, Mycobacterium tuberculosis
TDVLDTCRQQKGHVF

SEQ ID NO: 112084 - protein, 15 aa, Mycobacterium tuberculosis
DVLDTCRQQKGHVFE

SEQ ID NO: 112085 - protein, 15 aa, Mycobacterium tuberculosis
VLDTCRQQKGHVFEG

SEQ ID NO: 112086 - protein, 15 aa, Mycobacterium tuberculosis
LDTCRQQKGHVFEGG

SEQ ID NO: 112087 - protein, 15 aa, Mycobacterium tuberculosis
DTCRQQKGHVFEGGL

SEQ ID NO: 112088 - protein, 15 aa, Mycobacterium tuberculosis
TCRQQKGHVFEGGLW

SEQ ID NO: 112089 - protein, 15 aa, Mycobacterium tuberculosis
CRQQKGHVFEGGLWS

SEQ ID NO: 112090 - protein, 15 aa, Mycobacterium tuberculosis
RQQKGHVFEGGLWSG

SEQ ID NO: 112091 - protein, 15 aa, Mycobacterium tuberculosis
QQKGHVFEGGLWSGG

SEQ ID NO: 112092 - protein, 15 aa, Mycobacterium tuberculosis
QKGHVFEGGLWSGGA

SEQ ID NO: 112093 - protein, 15 aa, Mycobacterium tuberculosis
KGHVFEGGLWSGGAA

SEQ ID NO: 112094 - protein, 15 aa, Mycobacterium tuberculosis
GHVFEGGLWSGGAAN

SEQ ID NO: 112095 - protein, 15 aa, Mycobacterium tuberculosis
HVFEGGLWSGGAANA

SEQ ID NO: 112096 - protein, 15 aa, Mycobacterium tuberculosis
VFEGGLWSGGAANAA

SEQ ID NO: 112097 - protein, 15 aa, Mycobacterium tuberculosis
FEGGLWSGGAANAAN

SEQ ID NO: 112098 - protein, 15 aa, Mycobacterium tuberculosis
EGGLWSGGAANAANG

SEQ ID NO: 112099 - protein, 15 aa, Mycobacterium tuberculosis
GGLWSGGAANAANGA

SEQ ID NO: 112100 - protein, 15 aa, Mycobacterium tuberculosis
GLWSGGAANAANGAL

SEQ ID NO: 112101 - protein, 15 aa, Mycobacterium tuberculosis
LWSGGAANAANGALG

SEQ ID NO: 112102 - protein, 15 aa, Mycobacterium tuberculosis
WSGGAANAANGALGA

SEQ ID NO: 112103 - protein, 15 aa, Mycobacterium tuberculosis
SGGAANAANGALGAN

SEQ ID NO: 112104 - protein, 15 aa, Mycobacterium tuberculosis
GGAANAANGALGANI

SEQ ID NO: 112105 - protein, 15 aa, Mycobacterium tuberculosis
GAANAANGALGANIN

SEQ ID NO: 112106 - protein, 15 aa, Mycobacterium tuberculosis
AANAANGALGANINQ

SEQ ID NO: 112107 - protein, 15 aa, Mycobacterium tuberculosis
ANAANGALGANINQL

SEQ ID NO: 112108 - protein, 15 aa, Mycobacterium tuberculosis
NAANGALGANINQLM

SEQ ID NO: 112109 - protein, 15 aa, Mycobacterium tuberculosis
AANGALGANINQLMT

SEQ ID NO: 112110 - protein, 15 aa, Mycobacterium tuberculosis
ANGALGANINQLMTL

SEQ ID NO: 112111 - protein, 15 aa, Mycobacterium tuberculosis
NGALGANINQLMTLQ

SEQ ID NO: 112112 - protein, 15 aa, Mycobacterium tuberculosis
GALGANINQLMTLQD

SEQ ID NO: 112113 - protein, 15 aa, Mycobacterium tuberculosis
ALGANINQLMTLQDY

SEQ ID NO: 112114 - protein, 15 aa, Mycobacterium tuberculosis
LGANINQLMTLQDYL

SEQ ID NO: 112115 - protein, 15 aa, Mycobacterium tuberculosis
GANINQLMTLQDYLA

SEQ ID NO: 112116 - protein, 15 aa, Mycobacterium tuberculosis
ANINQLMTLQDYLAT

SEQ ID NO: 112117 - protein, 15 aa, Mycobacterium tuberculosis
NINQLMTLQDYLATV

SEQ ID NO: 112118 - protein, 15 aa, Mycobacterium tuberculosis
INQLMTLQDYLATVI

SEQ ID NO: 112119 - protein, 15 aa, Mycobacterium tuberculosis
NQLMTLQDYLATVIT

SEQ ID NO: 112120 - protein, 15 aa, Mycobacterium tuberculosis
QLMTLQDYLATVITW

SEQ ID NO: 112121 - protein, 15 aa, Mycobacterium tuberculosis
LMTLQDYLATVITWH

SEQ ID NO: 112122 - protein, 15 aa, Mycobacterium tuberculosis
MTLQDYLATVITWHR

SEQ ID NO: 112123 - protein, 15 aa, Mycobacterium tuberculosis
TLQDYLATVITWHRH

SEQ ID NO: 112124 - protein, 15 aa, Mycobacterium tuberculosis
LQDYLATVITWHRHI

SEQ ID NO: 112125 - protein, 15 aa, Mycobacterium tuberculosis
QDYLATVITWHRHIA

SEQ ID NO: 112126 - protein, 15 aa, Mycobacterium tuberculosis
DYLATVITWHRHIAG

SEQ ID NO: 112127 - protein, 15 aa, Mycobacterium tuberculosis
YLATVITWHRHIAGL

SEQ ID NO: 112128 - protein, 15 aa, Mycobacterium tuberculosis
LATVITWHRHIAGLI

SEQ ID NO: 112129 - protein, 15 aa, Mycobacterium tuberculosis
ATVITWHRHIAGLIE

SEQ ID NO: 112130 - protein, 15 aa, Mycobacterium tuberculosis
TVITWHRHIAGLIEQ

SEQ ID NO: 112131 - protein, 15 aa, Mycobacterium tuberculosis
VITWHRHIAGLIEQA

SEQ ID NO: 112132 - protein, 15 aa, Mycobacterium tuberculosis
ITWHRHIAGLIEQAK

SEQ ID NO: 112133 - protein, 15 aa, Mycobacterium tuberculosis
TWHRHIAGLIEQAKS

SEQ ID NO: 112134 - protein, 15 aa, Mycobacterium tuberculosis
WHRHIAGLIEQAKSD

SEQ ID NO: 112135 - protein, 15 aa, Mycobacterium tuberculosis
HRHIAGLIEQAKSDI

SEQ ID NO: 112136 - protein, 15 aa, Mycobacterium tuberculosis
RHIAGLIEQAKSDIG

SEQ ID NO: 112137 - protein, 15 aa, Mycobacterium tuberculosis
HIAGLIEQAKSDIGN

SEQ ID NO: 112138 - protein, 15 aa, Mycobacterium tuberculosis
IAGLIEQAKSDIGNN

SEQ ID NO: 112139 - protein, 15 aa, Mycobacterium tuberculosis
AGLIEQAKSDIGNNV

SEQ ID NO: 112140 - protein, 15 aa, Mycobacterium tuberculosis
GLIEQAKSDIGNNVD

SEQ ID NO: 112141 - protein, 15 aa, Mycobacterium tuberculosis
LIEQAKSDIGNNVDG

SEQ ID NO: 112142 - protein, 15 aa, Mycobacterium tuberculosis
IEQAKSDIGNNVDGA

SEQ ID NO: 112143 - protein, 15 aa, Mycobacterium tuberculosis
EQAKSDIGNNVDGAQ

SEQ ID NO: 112144 - protein, 15 aa, Mycobacterium tuberculosis
QAKSDIGNNVDGAQR

SEQ ID NO: 112145 - protein, 15 aa, Mycobacterium tuberculosis
AKSDIGNNVDGAQRE

SEQ ID NO: 112146 - protein, 15 aa, Mycobacterium tuberculosis
KSDIGNNVDGAQREI

SEQ ID NO: 112147 - protein, 15 aa, Mycobacterium tuberculosis
SDIGNNVDGAQREID

SEQ ID NO: 112148 - protein, 15 aa, Mycobacterium tuberculosis
DIGNNVDGAQREIDI

SEQ ID NO: 112149 - protein, 15 aa, Mycobacterium tuberculosis
IGNNVDGAQREIDIL

SEQ ID NO: 112150 - protein, 15 aa, Mycobacterium tuberculosis
GNNVDGAQREIDILE

SEQ ID NO: 112151 - protein, 15 aa, Mycobacterium tuberculosis
NNVDGAQREIDILEN

SEQ ID NO: 112152 - protein, 15 aa, Mycobacterium tuberculosis
NVDGAQREIDILEND

SEQ ID NO: 112153 - protein, 15 aa, Mycobacterium tuberculosis
VDGAQREIDILENDP

SEQ ID NO: 112154 - protein, 15 aa, Mycobacterium tuberculosis
DGAQREIDILENDPS

SEQ ID NO: 112155 - protein, 15 aa, Mycobacterium tuberculosis
GAQREIDILENDPSL

SEQ ID NO: 112156 - protein, 15 aa, Mycobacterium tuberculosis
AQREIDILENDPSLD

SEQ ID NO: 112157 - protein, 15 aa, Mycobacterium tuberculosis
QREIDILENDPSLDA

SEQ ID NO: 112158 - protein, 15 aa, Mycobacterium tuberculosis
REIDILENDPSLDAD

SEQ ID NO: 112159 - protein, 15 aa, Mycobacterium tuberculosis
EIDILENDPSLDADE

SEQ ID NO: 112160 - protein, 15 aa, Mycobacterium tuberculosis
IDILENDPSLDADER

SEQ ID NO: 112161 - protein, 15 aa, Mycobacterium tuberculosis
DILENDPSLDADERH

SEQ ID NO: 112162 - protein, 15 aa, Mycobacterium tuberculosis
ILENDPSLDADERHT

SEQ ID NO: 112163 - protein, 15 aa, Mycobacterium tuberculosis
LENDPSLDADERHTA

SEQ ID NO: 112164 - protein, 15 aa, Mycobacterium tuberculosis
ENDPSLDADERHTAI

SEQ ID NO: 112165 - protein, 15 aa, Mycobacterium tuberculosis
NDPSLDADERHTAIN

SEQ ID NO: 112166 - protein, 15 aa, Mycobacterium tuberculosis
DPSLDADERHTAINS

SEQ ID NO: 112167 - protein, 15 aa, Mycobacterium tuberculosis
PSLDADERHTAINSL

SEQ ID NO: 112168 - protein, 15 aa, Mycobacterium tuberculosis
SLDADERHTAINSLV

SEQ ID NO: 112169 - protein, 15 aa, Mycobacterium tuberculosis
LDADERHTAINSLVT

SEQ ID NO: 112170 - protein, 15 aa, Mycobacterium tuberculosis
DADERHTAINSLVTA

SEQ ID NO: 112171 - protein, 15 aa, Mycobacterium tuberculosis
ADERHTAINSLVTAT

SEQ ID NO: 112172 - protein, 15 aa, Mycobacterium tuberculosis
DERHTAINSLVTATH

SEQ ID NO: 112173 - protein, 15 aa, Mycobacterium tuberculosis
ERHTAINSLVTATHG

SEQ ID NO: 112174 - protein, 15 aa, Mycobacterium tuberculosis
RHTAINSLVTATHGA

SEQ ID NO: 112175 - protein, 15 aa, Mycobacterium tuberculosis
HTAINSLVTATHGAN

SEQ ID NO: 112176 - protein, 15 aa, Mycobacterium tuberculosis
TAINSLVTATHGANV

SEQ ID NO: 112177 - protein, 15 aa, Mycobacterium tuberculosis
AINSLVTATHGANVS

SEQ ID NO: 112178 - protein, 15 aa, Mycobacterium tuberculosis
INSLVTATHGANVSL

SEQ ID NO: 112179 - protein, 15 aa, Mycobacterium tuberculosis
NSLVTATHGANVSLV

SEQ ID NO: 112180 - protein, 15 aa, Mycobacterium tuberculosis
SLVTATHGANVSLVA

SEQ ID NO: 112181 - protein, 15 aa, Mycobacterium tuberculosis
LVTATHGANVSLVAE

SEQ ID NO: 112182 - protein, 15 aa, Mycobacterium tuberculosis
VTATHGANVSLVAET

SEQ ID NO: 112183 - protein, 15 aa, Mycobacterium tuberculosis
TATHGANVSLVAETA

SEQ ID NO: 112184 - protein, 15 aa, Mycobacterium tuberculosis
ATHGANVSLVAETAE

SEQ ID NO: 112185 - protein, 15 aa, Mycobacterium tuberculosis
THGANVSLVAETAER

SEQ ID NO: 112186 - protein, 15 aa, Mycobacterium tuberculosis
HGANVSLVAETAERV

SEQ ID NO: 112187 - protein, 15 aa, Mycobacterium tuberculosis
GANVSLVAETAERVL

SEQ ID NO: 112188 - protein, 15 aa, Mycobacterium tuberculosis
ANVSLVAETAERVLE

SEQ ID NO: 112189 - protein, 15 aa, Mycobacterium tuberculosis
NVSLVAETAERVLES

SEQ ID NO: 112190 - protein, 15 aa, Mycobacterium tuberculosis
VSLVAETAERVLESK

SEQ ID NO: 112191 - protein, 15 aa, Mycobacterium tuberculosis
SLVAETAERVLESKN

SEQ ID NO: 112192 - protein, 15 aa, Mycobacterium tuberculosis
LVAETAERVLESKNW

SEQ ID NO: 112193 - protein, 15 aa, Mycobacterium tuberculosis
VAETAERVLESKNWK

SEQ ID NO: 112194 - protein, 15 aa, Mycobacterium tuberculosis
AETAERVLESKNWKP

SEQ ID NO: 112195 - protein, 15 aa, Mycobacterium tuberculosis
ETAERVLESKNWKPP

SEQ ID NO: 112196 - protein, 15 aa, Mycobacterium tuberculosis
TAERVLESKNWKPPK

SEQ ID NO: 112197 - protein, 15 aa, Mycobacterium tuberculosis
AERVLESKNWKPPKN

SEQ ID NO: 112198 - protein, 15 aa, Mycobacterium tuberculosis
ERVLESKNWKPPKNA

SEQ ID NO: 112199 - protein, 15 aa, Mycobacterium tuberculosis
RVLESKNWKPPKNAL

SEQ ID NO: 112200 - protein, 15 aa, Mycobacterium tuberculosis
VLESKNWKPPKNALE

SEQ ID NO: 112201 - protein, 15 aa, Mycobacterium tuberculosis
LESKNWKPPKNALED

SEQ ID NO: 112202 - protein, 15 aa, Mycobacterium tuberculosis
ESKNWKPPKNALEDL

SEQ ID NO: 112203 - protein, 15 aa, Mycobacterium tuberculosis
SKNWKPPKNALEDLL

SEQ ID NO: 112204 - protein, 15 aa, Mycobacterium tuberculosis
KNWKPPKNALEDLLQ

SEQ ID NO: 112205 - protein, 15 aa, Mycobacterium tuberculosis
NWKPPKNALEDLLQQ

SEQ ID NO: 112206 - protein, 15 aa, Mycobacterium tuberculosis
WKPPKNALEDLLQQK

SEQ ID NO: 112207 - protein, 15 aa, Mycobacterium tuberculosis
KPPKNALEDLLQQKS

SEQ ID NO: 112208 - protein, 15 aa, Mycobacterium tuberculosis
PPKNALEDLLQQKSP

SEQ ID NO: 112209 - protein, 15 aa, Mycobacterium tuberculosis
PKNALEDLLQQKSPP

SEQ ID NO: 112210 - protein, 15 aa, Mycobacterium tuberculosis
KNALEDLLQQKSPPP

SEQ ID NO: 112211 - protein, 15 aa, Mycobacterium tuberculosis
NALEDLLQQKSPPPP

SEQ ID NO: 112212 - protein, 15 aa, Mycobacterium tuberculosis
ALEDLLQQKSPPPPD

SEQ ID NO: 112213 - protein, 15 aa, Mycobacterium tuberculosis
LEDLLQQKSPPPPDV

SEQ ID NO: 112214 - protein, 15 aa, Mycobacterium tuberculosis
EDLLQQKSPPPPDVP

SEQ ID NO: 112215 - protein, 15 aa, Mycobacterium tuberculosis
DLLQQKSPPPPDVPT

SEQ ID NO: 112216 - protein, 15 aa, Mycobacterium tuberculosis
LLQQKSPPPPDVPTL

SEQ ID NO: 112217 - protein, 15 aa, Mycobacterium tuberculosis
LQQKSPPPPDVPTLV

SEQ ID NO: 112218 - protein, 15 aa, Mycobacterium tuberculosis
QQKSPPPPDVPTLVV

SEQ ID NO: 112219 - protein, 15 aa, Mycobacterium tuberculosis
QKSPPPPDVPTLVVP

SEQ ID NO: 112220 - protein, 15 aa, Mycobacterium tuberculosis
KSPPPPDVPTLVVPS

SEQ ID NO: 112221 - protein, 15 aa, Mycobacterium tuberculosis
SPPPPDVPTLVVPSP

SEQ ID NO: 112222 - protein, 15 aa, Mycobacterium tuberculosis
PPPPDVPTLVVPSPG

SEQ ID NO: 112223 - protein, 15 aa, Mycobacterium tuberculosis
PPPDVPTLVVPSPGT

SEQ ID NO: 112224 - protein, 15 aa, Mycobacterium tuberculosis
PPDVPTLVVPSPGTP

SEQ ID NO: 112225 - protein, 15 aa, Mycobacterium tuberculosis
PDVPTLVVPSPGTPG

SEQ ID NO: 112226 - protein, 15 aa, Mycobacterium tuberculosis
DVPTLVVPSPGTPGT

SEQ ID NO: 112227 - protein, 15 aa, Mycobacterium tuberculosis
VPTLVVPSPGTPGTP

SEQ ID NO: 112228 - protein, 15 aa, Mycobacterium tuberculosis
PTLVVPSPGTPGTPG

SEQ ID NO: 112229 - protein, 15 aa, Mycobacterium tuberculosis
TLVVPSPGTPGTPGT

SEQ ID NO: 112230 - protein, 15 aa, Mycobacterium tuberculosis
LVVPSPGTPGTPGTP

SEQ ID NO: 112231 - protein, 15 aa, Mycobacterium tuberculosis
VVPSPGTPGTPGTPI

SEQ ID NO: 112232 - protein, 15 aa, Mycobacterium tuberculosis
VPSPGTPGTPGTPIT

SEQ ID NO: 112233 - protein, 15 aa, Mycobacterium tuberculosis
PSPGTPGTPGTPITP

SEQ ID NO: 112234 - protein, 15 aa, Mycobacterium tuberculosis
SPGTPGTPGTPITPG

SEQ ID NO: 112235 - protein, 15 aa, Mycobacterium tuberculosis
PGTPGTPGTPITPGT

SEQ ID NO: 112236 - protein, 15 aa, Mycobacterium tuberculosis
GTPGTPGTPITPGTP

SEQ ID NO: 112237 - protein, 15 aa, Mycobacterium tuberculosis
TPGTPGTPITPGTPI

SEQ ID NO: 112238 - protein, 15 aa, Mycobacterium tuberculosis
PGTPGTPITPGTPIT

SEQ ID NO: 112239 - protein, 15 aa, Mycobacterium tuberculosis
GTPGTPITPGTPITP

SEQ ID NO: 112240 - protein, 15 aa, Mycobacterium tuberculosis
TPGTPITPGTPITPG

SEQ ID NO: 112241 - protein, 15 aa, Mycobacterium tuberculosis
PGTPITPGTPITPGT

SEQ ID NO: 112242 - protein, 15 aa, Mycobacterium tuberculosis
GTPITPGTPITPGTP

SEQ ID NO: 112243 - protein, 15 aa, Mycobacterium tuberculosis
TPITPGTPITPGTPI

SEQ ID NO: 112244 - protein, 15 aa, Mycobacterium tuberculosis
PITPGTPITPGTPIT

SEQ ID NO: 112245 - protein, 15 aa, Mycobacterium tuberculosis
ITPGTPITPGTPITP

SEQ ID NO: 112246 - protein, 15 aa, Mycobacterium tuberculosis
TPGTPITPGTPITPI

SEQ ID NO: 112247 - protein, 15 aa, Mycobacterium tuberculosis
PGTPITPGTPITPIP

SEQ ID NO: 112248 - protein, 15 aa, Mycobacterium tuberculosis
GTPITPGTPITPIPG

SEQ ID NO: 112249 - protein, 15 aa, Mycobacterium tuberculosis
TPITPGTPITPIPGA

SEQ ID NO: 112250 - protein, 15 aa, Mycobacterium tuberculosis
PITPGTPITPIPGAP

SEQ ID NO: 112251 - protein, 15 aa, Mycobacterium tuberculosis
ITPGTPITPIPGAPV

SEQ ID NO: 112252 - protein, 15 aa, Mycobacterium tuberculosis
TPGTPITPIPGAPVT

SEQ ID NO: 112253 - protein, 15 aa, Mycobacterium tuberculosis
PGTPITPIPGAPVTP

SEQ ID NO: 112254 - protein, 15 aa, Mycobacterium tuberculosis
GTPITPIPGAPVTPI

SEQ ID NO: 112255 - protein, 15 aa, Mycobacterium tuberculosis
TPITPIPGAPVTPIT

SEQ ID NO: 112256 - protein, 15 aa, Mycobacterium tuberculosis
PITPIPGAPVTPITP

SEQ ID NO: 112257 - protein, 15 aa, Mycobacterium tuberculosis
ITPIPGAPVTPITPT

SEQ ID NO: 112258 - protein, 15 aa, Mycobacterium tuberculosis
TPIPGAPVTPITPTP

SEQ ID NO: 112259 - protein, 15 aa, Mycobacterium tuberculosis
PIPGAPVTPITPTPG

SEQ ID NO: 112260 - protein, 15 aa, Mycobacterium tuberculosis
IPGAPVTPITPTPGT

SEQ ID NO: 112261 - protein, 15 aa, Mycobacterium tuberculosis
PGAPVTPITPTPGTP

SEQ ID NO: 112262 - protein, 15 aa, Mycobacterium tuberculosis
GAPVTPITPTPGTPV

SEQ ID NO: 112263 - protein, 15 aa, Mycobacterium tuberculosis
APVTPITPTPGTPVT

SEQ ID NO: 112264 - protein, 15 aa, Mycobacterium tuberculosis
PVTPITPTPGTPVTP

SEQ ID NO: 112265 - protein, 15 aa, Mycobacterium tuberculosis
VTPITPTPGTPVTPV

SEQ ID NO: 112266 - protein, 15 aa, Mycobacterium tuberculosis
TPITPTPGTPVTPVT

SEQ ID NO: 112267 - protein, 15 aa, Mycobacterium tuberculosis
PITPTPGTPVTPVTP

SEQ ID NO: 112268 - protein, 15 aa, Mycobacterium tuberculosis
ITPTPGTPVTPVTPG

SEQ ID NO: 112269 - protein, 15 aa, Mycobacterium tuberculosis
TPTPGTPVTPVTPGK

SEQ ID NO: 112270 - protein, 15 aa, Mycobacterium tuberculosis
PTPGTPVTPVTPGKP

SEQ ID NO: 112271 - protein, 15 aa, Mycobacterium tuberculosis
TPGTPVTPVTPGKPV

SEQ ID NO: 112272 - protein, 15 aa, Mycobacterium tuberculosis
PGTPVTPVTPGKPVT

SEQ ID NO: 112273 - protein, 15 aa, Mycobacterium tuberculosis
GTPVTPVTPGKPVTP

SEQ ID NO: 112274 - protein, 15 aa, Mycobacterium tuberculosis
TPVTPVTPGKPVTPV

SEQ ID NO: 112275 - protein, 15 aa, Mycobacterium tuberculosis
PVTPVTPGKPVTPVT

SEQ ID NO: 112276 - protein, 15 aa, Mycobacterium tuberculosis
VTPVTPGKPVTPVTP

SEQ ID NO: 112277 - protein, 15 aa, Mycobacterium tuberculosis
TPVTPGKPVTPVTPV

SEQ ID NO: 112278 - protein, 15 aa, Mycobacterium tuberculosis
PVTPGKPVTPVTPVK

SEQ ID NO: 112279 - protein, 15 aa, Mycobacterium tuberculosis
VTPGKPVTPVTPVKP

SEQ ID NO: 112280 - protein, 15 aa, Mycobacterium tuberculosis
TPGKPVTPVTPVKPG

SEQ ID NO: 112281 - protein, 15 aa, Mycobacterium tuberculosis
PGKPVTPVTPVKPGT

SEQ ID NO: 112282 - protein, 15 aa, Mycobacterium tuberculosis
GKPVTPVTPVKPGTP

SEQ ID NO: 112283 - protein, 15 aa, Mycobacterium tuberculosis
KPVTPVTPVKPGTPG

SEQ ID NO: 112284 - protein, 15 aa, Mycobacterium tuberculosis
PVTPVTPVKPGTPGE

SEQ ID NO: 112285 - protein, 15 aa, Mycobacterium tuberculosis
VTPVTPVKPGTPGEP

SEQ ID NO: 112286 - protein, 15 aa, Mycobacterium tuberculosis
TPVTPVKPGTPGEPT

SEQ ID NO: 112287 - protein, 15 aa, Mycobacterium tuberculosis
PVTPVKPGTPGEPTP

SEQ ID NO: 112288 - protein, 15 aa, Mycobacterium tuberculosis
VTPVKPGTPGEPTPI

SEQ ID NO: 112289 - protein, 15 aa, Mycobacterium tuberculosis
TPVKPGTPGEPTPIT

SEQ ID NO: 112290 - protein, 15 aa, Mycobacterium tuberculosis
PVKPGTPGEPTPITP

SEQ ID NO: 112291 - protein, 15 aa, Mycobacterium tuberculosis
VKPGTPGEPTPITPV

SEQ ID NO: 112292 - protein, 15 aa, Mycobacterium tuberculosis
KPGTPGEPTPITPVT

SEQ ID NO: 112293 - protein, 15 aa, Mycobacterium tuberculosis
PGTPGEPTPITPVTP

SEQ ID NO: 112294 - protein, 15 aa, Mycobacterium tuberculosis
GTPGEPTPITPVTPP

SEQ ID NO: 112295 - protein, 15 aa, Mycobacterium tuberculosis
TPGEPTPITPVTPPV

SEQ ID NO: 112296 - protein, 15 aa, Mycobacterium tuberculosis
PGEPTPITPVTPPVA

SEQ ID NO: 112297 - protein, 15 aa, Mycobacterium tuberculosis
GEPTPITPVTPPVAP

SEQ ID NO: 112298 - protein, 15 aa, Mycobacterium tuberculosis
EPTPITPVTPPVAPA

SEQ ID NO: 112299 - protein, 15 aa, Mycobacterium tuberculosis
PTPITPVTPPVAPAT

SEQ ID NO: 112300 - protein, 15 aa, Mycobacterium tuberculosis
TPITPVTPPVAPATP

SEQ ID NO: 112301 - protein, 15 aa, Mycobacterium tuberculosis
PITPVTPPVAPATPA

SEQ ID NO: 112302 - protein, 15 aa, Mycobacterium tuberculosis
ITPVTPPVAPATPAT

SEQ ID NO: 112303 - protein, 15 aa, Mycobacterium tuberculosis
TPVTPPVAPATPATP

SEQ ID NO: 112304 - protein, 15 aa, Mycobacterium tuberculosis
PVTPPVAPATPATPA

SEQ ID NO: 112305 - protein, 15 aa, Mycobacterium tuberculosis
VTPPVAPATPATPAT

SEQ ID NO: 112306 - protein, 15 aa, Mycobacterium tuberculosis
TPPVAPATPATPATP

SEQ ID NO: 112307 - protein, 15 aa, Mycobacterium tuberculosis
PPVAPATPATPATPV

SEQ ID NO: 112308 - protein, 15 aa, Mycobacterium tuberculosis
PVAPATPATPATPVT

SEQ ID NO: 112309 - protein, 15 aa, Mycobacterium tuberculosis
VAPATPATPATPVTP

SEQ ID NO: 112310 - protein, 15 aa, Mycobacterium tuberculosis
APATPATPATPVTPA

SEQ ID NO: 112311 - protein, 15 aa, Mycobacterium tuberculosis
PATPATPATPVTPAP

SEQ ID NO: 112312 - protein, 15 aa, Mycobacterium tuberculosis
ATPATPATPVTPAPA

SEQ ID NO: 112313 - protein, 15 aa, Mycobacterium tuberculosis
TPATPATPVTPAPAP

SEQ ID NO: 112314 - protein, 15 aa, Mycobacterium tuberculosis
PATPATPVTPAPAPH

SEQ ID NO: 112315 - protein, 15 aa, Mycobacterium tuberculosis
ATPATPVTPAPAPHP

SEQ ID NO: 112316 - protein, 15 aa, Mycobacterium tuberculosis
TPATPVTPAPAPHPQ

SEQ ID NO: 112317 - protein, 15 aa, Mycobacterium tuberculosis
PATPVTPAPAPHPQP

SEQ ID NO: 112318 - protein, 15 aa, Mycobacterium tuberculosis
ATPVTPAPAPHPQPA

SEQ ID NO: 112319 - protein, 15 aa, Mycobacterium tuberculosis
TPVTPAPAPHPQPAP

SEQ ID NO: 112320 - protein, 15 aa, Mycobacterium tuberculosis
PVTPAPAPHPQPAPA

SEQ ID NO: 112321 - protein, 15 aa, Mycobacterium tuberculosis
VTPAPAPHPQPAPAP

SEQ ID NO: 112322 - protein, 15 aa, Mycobacterium tuberculosis
TPAPAPHPQPAPAPA

SEQ ID NO: 112323 - protein, 15 aa, Mycobacterium tuberculosis
PAPAPHPQPAPAPAP

SEQ ID NO: 112324 - protein, 15 aa, Mycobacterium tuberculosis
APAPHPQPAPAPAPS

SEQ ID NO: 112325 - protein, 15 aa, Mycobacterium tuberculosis
PAPHPQPAPAPAPSP

SEQ ID NO: 112326 - protein, 15 aa, Mycobacterium tuberculosis
APHPQPAPAPAPSPG

SEQ ID NO: 112327 - protein, 15 aa, Mycobacterium tuberculosis
PHPQPAPAPAPSPGP

SEQ ID NO: 112328 - protein, 15 aa, Mycobacterium tuberculosis
HPQPAPAPAPSPGPQ

SEQ ID NO: 112329 - protein, 15 aa, Mycobacterium tuberculosis
PQPAPAPAPSPGPQP

SEQ ID NO: 112330 - protein, 15 aa, Mycobacterium tuberculosis
QPAPAPAPSPGPQPV

SEQ ID NO: 112331 - protein, 15 aa, Mycobacterium tuberculosis
PAPAPAPSPGPQPVT

SEQ ID NO: 112332 - protein, 15 aa, Mycobacterium tuberculosis
APAPAPSPGPQPVTP

SEQ ID NO: 112333 - protein, 15 aa, Mycobacterium tuberculosis
PAPAPSPGPQPVTPA

SEQ ID NO: 112334 - protein, 15 aa, Mycobacterium tuberculosis
APAPSPGPQPVTPAT

SEQ ID NO: 112335 - protein, 15 aa, Mycobacterium tuberculosis
PAPSPGPQPVTPATP

SEQ ID NO: 112336 - protein, 15 aa, Mycobacterium tuberculosis
APSPGPQPVTPATPG

SEQ ID NO: 112337 - protein, 15 aa, Mycobacterium tuberculosis
PSPGPQPVTPATPGP

SEQ ID NO: 112338 - protein, 15 aa, Mycobacterium tuberculosis
SPGPQPVTPATPGPS

SEQ ID NO: 112339 - protein, 15 aa, Mycobacterium tuberculosis
PGPQPVTPATPGPSG

SEQ ID NO: 112340 - protein, 15 aa, Mycobacterium tuberculosis
GPQPVTPATPGPSGP

SEQ ID NO: 112341 - protein, 15 aa, Mycobacterium tuberculosis
PQPVTPATPGPSGPA

SEQ ID NO: 112342 - protein, 15 aa, Mycobacterium tuberculosis
QPVTPATPGPSGPAT

SEQ ID NO: 112343 - protein, 15 aa, Mycobacterium tuberculosis
PVTPATPGPSGPATP

SEQ ID NO: 112344 - protein, 15 aa, Mycobacterium tuberculosis
VTPATPGPSGPATPG

SEQ ID NO: 112345 - protein, 15 aa, Mycobacterium tuberculosis
TPATPGPSGPATPGT

SEQ ID NO: 112346 - protein, 15 aa, Mycobacterium tuberculosis
PATPGPSGPATPGTP

SEQ ID NO: 112347 - protein, 15 aa, Mycobacterium tuberculosis
ATPGPSGPATPGTPG

SEQ ID NO: 112348 - protein, 15 aa, Mycobacterium tuberculosis
TPGPSGPATPGTPGG

SEQ ID NO: 112349 - protein, 15 aa, Mycobacterium tuberculosis
PGPSGPATPGTPGGE

SEQ ID NO: 112350 - protein, 15 aa, Mycobacterium tuberculosis
GPSGPATPGTPGGEP

SEQ ID NO: 112351 - protein, 15 aa, Mycobacterium tuberculosis
PSGPATPGTPGGEPA

SEQ ID NO: 112352 - protein, 15 aa, Mycobacterium tuberculosis
SGPATPGTPGGEPAP

SEQ ID NO: 112353 - protein, 15 aa, Mycobacterium tuberculosis
GPATPGTPGGEPAPH

SEQ ID NO: 112354 - protein, 15 aa, Mycobacterium tuberculosis
PATPGTPGGEPAPHV

SEQ ID NO: 112355 - protein, 15 aa, Mycobacterium tuberculosis
ATPGTPGGEPAPHVK

SEQ ID NO: 112356 - protein, 15 aa, Mycobacterium tuberculosis
TPGTPGGEPAPHVKP

SEQ ID NO: 112357 - protein, 15 aa, Mycobacterium tuberculosis
PGTPGGEPAPHVKPA

SEQ ID NO: 112358 - protein, 15 aa, Mycobacterium tuberculosis
GTPGGEPAPHVKPAA

SEQ ID NO: 112359 - protein, 15 aa, Mycobacterium tuberculosis
TPGGEPAPHVKPAAL

SEQ ID NO: 112360 - protein, 15 aa, Mycobacterium tuberculosis
PGGEPAPHVKPAALA

SEQ ID NO: 112361 - protein, 15 aa, Mycobacterium tuberculosis
GGEPAPHVKPAALAE

SEQ ID NO: 112362 - protein, 15 aa, Mycobacterium tuberculosis
GEPAPHVKPAALAEQ

SEQ ID NO: 112363 - protein, 15 aa, Mycobacterium tuberculosis
EPAPHVKPAALAEQP

SEQ ID NO: 112364 - protein, 15 aa, Mycobacterium tuberculosis
PAPHVKPAALAEQPG

SEQ ID NO: 112365 - protein, 15 aa, Mycobacterium tuberculosis
APHVKPAALAEQPGV

SEQ ID NO: 112366 - protein, 15 aa, Mycobacterium tuberculosis
PHVKPAALAEQPGVP

SEQ ID NO: 112367 - protein, 15 aa, Mycobacterium tuberculosis
HVKPAALAEQPGVPG

SEQ ID NO: 112368 - protein, 15 aa, Mycobacterium tuberculosis
VKPAALAEQPGVPGQ

SEQ ID NO: 112369 - protein, 15 aa, Mycobacterium tuberculosis
KPAALAEQPGVPGQH

SEQ ID NO: 112370 - protein, 15 aa, Mycobacterium tuberculosis
PAALAEQPGVPGQHA

SEQ ID NO: 112371 - protein, 15 aa, Mycobacterium tuberculosis
AALAEQPGVPGQHAG

SEQ ID NO: 112372 - protein, 15 aa, Mycobacterium tuberculosis
ALAEQPGVPGQHAGG

SEQ ID NO: 112373 - protein, 15 aa, Mycobacterium tuberculosis
LAEQPGVPGQHAGGG

SEQ ID NO: 112374 - protein, 15 aa, Mycobacterium tuberculosis
AEQPGVPGQHAGGGT

SEQ ID NO: 112375 - protein, 15 aa, Mycobacterium tuberculosis
EQPGVPGQHAGGGTQ

SEQ ID NO: 112376 - protein, 15 aa, Mycobacterium tuberculosis
QPGVPGQHAGGGTQS

SEQ ID NO: 112377 - protein, 15 aa, Mycobacterium tuberculosis
PGVPGQHAGGGTQSG

SEQ ID NO: 112378 - protein, 15 aa, Mycobacterium tuberculosis
GVPGQHAGGGTQSGP

SEQ ID NO: 112379 - protein, 15 aa, Mycobacterium tuberculosis
VPGQHAGGGTQSGPA

SEQ ID NO: 112380 - protein, 15 aa, Mycobacterium tuberculosis
PGQHAGGGTQSGPAH

SEQ ID NO: 112381 - protein, 15 aa, Mycobacterium tuberculosis
GQHAGGGTQSGPAHA

SEQ ID NO: 112382 - protein, 15 aa, Mycobacterium tuberculosis
QHAGGGTQSGPAHAD

SEQ ID NO: 112383 - protein, 15 aa, Mycobacterium tuberculosis
HAGGGTQSGPAHADE

SEQ ID NO: 112384 - protein, 15 aa, Mycobacterium tuberculosis
AGGGTQSGPAHADES

SEQ ID NO: 112385 - protein, 15 aa, Mycobacterium tuberculosis
GGGTQSGPAHADESA

SEQ ID NO: 112386 - protein, 15 aa, Mycobacterium tuberculosis
GGTQSGPAHADESAA

SEQ ID NO: 112387 - protein, 15 aa, Mycobacterium tuberculosis
GTQSGPAHADESAAS

SEQ ID NO: 112388 - protein, 15 aa, Mycobacterium tuberculosis
TQSGPAHADESAASV

SEQ ID NO: 112389 - protein, 15 aa, Mycobacterium tuberculosis
QSGPAHADESAASVT

SEQ ID NO: 112390 - protein, 15 aa, Mycobacterium tuberculosis
SGPAHADESAASVTP

SEQ ID NO: 112391 - protein, 15 aa, Mycobacterium tuberculosis
GPAHADESAASVTPA

SEQ ID NO: 112392 - protein, 15 aa, Mycobacterium tuberculosis
PAHADESAASVTPAA

SEQ ID NO: 112393 - protein, 15 aa, Mycobacterium tuberculosis
AHADESAASVTPAAA

SEQ ID NO: 112394 - protein, 15 aa, Mycobacterium tuberculosis
HADESAASVTPAAAS

SEQ ID NO: 112395 - protein, 15 aa, Mycobacterium tuberculosis
ADESAASVTPAAASG

SEQ ID NO: 112396 - protein, 15 aa, Mycobacterium tuberculosis
DESAASVTPAAASGV

SEQ ID NO: 112397 - protein, 15 aa, Mycobacterium tuberculosis
ESAASVTPAAASGVP

SEQ ID NO: 112398 - protein, 15 aa, Mycobacterium tuberculosis
SAASVTPAAASGVPG

SEQ ID NO: 112399 - protein, 15 aa, Mycobacterium tuberculosis
AASVTPAAASGVPGA

SEQ ID NO: 112400 - protein, 15 aa, Mycobacterium tuberculosis
ASVTPAAASGVPGAR

SEQ ID NO: 112401 - protein, 15 aa, Mycobacterium tuberculosis
SVTPAAASGVPGARA

SEQ ID NO: 112402 - protein, 15 aa, Mycobacterium tuberculosis
VTPAAASGVPGARAA

SEQ ID NO: 112403 - protein, 15 aa, Mycobacterium tuberculosis
TPAAASGVPGARAAA

SEQ ID NO: 112404 - protein, 15 aa, Mycobacterium tuberculosis
PAAASGVPGARAAAA

SEQ ID NO: 112405 - protein, 15 aa, Mycobacterium tuberculosis
AAASGVPGARAAAAA

SEQ ID NO: 112406 - protein, 15 aa, Mycobacterium tuberculosis
AASGVPGARAAAAAP

SEQ ID NO: 112407 - protein, 15 aa, Mycobacterium tuberculosis
ASGVPGARAAAAAPS

SEQ ID NO: 112408 - protein, 15 aa, Mycobacterium tuberculosis
SGVPGARAAAAAPSG

SEQ ID NO: 112409 - protein, 15 aa, Mycobacterium tuberculosis
GVPGARAAAAAPSGT

SEQ ID NO: 112410 - protein, 15 aa, Mycobacterium tuberculosis
VPGARAAAAAPSGTA

SEQ ID NO: 112411 - protein, 15 aa, Mycobacterium tuberculosis
PGARAAAAAPSGTAV

SEQ ID NO: 112412 - protein, 15 aa, Mycobacterium tuberculosis
GARAAAAAPSGTAVG

SEQ ID NO: 112413 - protein, 15 aa, Mycobacterium tuberculosis
ARAAAAAPSGTAVGA

SEQ ID NO: 112414 - protein, 15 aa, Mycobacterium tuberculosis
RAAAAAPSGTAVGAG

SEQ ID NO: 112415 - protein, 15 aa, Mycobacterium tuberculosis
AAAAAPSGTAVGAGA

SEQ ID NO: 112416 - protein, 15 aa, Mycobacterium tuberculosis
AAAAPSGTAVGAGAR

SEQ ID NO: 112417 - protein, 15 aa, Mycobacterium tuberculosis
AAAPSGTAVGAGARS

SEQ ID NO: 112418 - protein, 15 aa, Mycobacterium tuberculosis
AAPSGTAVGAGARSS

SEQ ID NO: 112419 - protein, 15 aa, Mycobacterium tuberculosis
APSGTAVGAGARSSV

SEQ ID NO: 112420 - protein, 15 aa, Mycobacterium tuberculosis
PSGTAVGAGARSSVG

SEQ ID NO: 112421 - protein, 15 aa, Mycobacterium tuberculosis
SGTAVGAGARSSVGT

SEQ ID NO: 112422 - protein, 15 aa, Mycobacterium tuberculosis
GTAVGAGARSSVGTA

SEQ ID NO: 112423 - protein, 15 aa, Mycobacterium tuberculosis
TAVGAGARSSVGTAA

SEQ ID NO: 112424 - protein, 15 aa, Mycobacterium tuberculosis
AVGAGARSSVGTAAA

SEQ ID NO: 112425 - protein, 15 aa, Mycobacterium tuberculosis
VGAGARSSVGTAAAS

SEQ ID NO: 112426 - protein, 15 aa, Mycobacterium tuberculosis
GAGARSSVGTAAASG

SEQ ID NO: 112427 - protein, 15 aa, Mycobacterium tuberculosis
AGARSSVGTAAASGA

SEQ ID NO: 112428 - protein, 15 aa, Mycobacterium tuberculosis
GARSSVGTAAASGAG

SEQ ID NO: 112429 - protein, 15 aa, Mycobacterium tuberculosis
ARSSVGTAAASGAGS

SEQ ID NO: 112430 - protein, 15 aa, Mycobacterium tuberculosis
RSSVGTAAASGAGSH

SEQ ID NO: 112431 - protein, 15 aa, Mycobacterium tuberculosis
SSVGTAAASGAGSHA

SEQ ID NO: 112432 - protein, 15 aa, Mycobacterium tuberculosis
SVGTAAASGAGSHAA

SEQ ID NO: 112433 - protein, 15 aa, Mycobacterium tuberculosis
VGTAAASGAGSHAAT

SEQ ID NO: 112434 - protein, 15 aa, Mycobacterium tuberculosis
GTAAASGAGSHAATG

SEQ ID NO: 112435 - protein, 15 aa, Mycobacterium tuberculosis
TAAASGAGSHAATGR

SEQ ID NO: 112436 - protein, 15 aa, Mycobacterium tuberculosis
AAASGAGSHAATGRA

SEQ ID NO: 112437 - protein, 15 aa, Mycobacterium tuberculosis
AASGAGSHAATGRAP

SEQ ID NO: 112438 - protein, 15 aa, Mycobacterium tuberculosis
ASGAGSHAATGRAPV

SEQ ID NO: 112439 - protein, 15 aa, Mycobacterium tuberculosis
SGAGSHAATGRAPVA

SEQ ID NO: 112440 - protein, 15 aa, Mycobacterium tuberculosis
GAGSHAATGRAPVAT

SEQ ID NO: 112441 - protein, 15 aa, Mycobacterium tuberculosis
AGSHAATGRAPVATS

SEQ ID NO: 112442 - protein, 15 aa, Mycobacterium tuberculosis
GSHAATGRAPVATSD

SEQ ID NO: 112443 - protein, 15 aa, Mycobacterium tuberculosis
SHAATGRAPVATSDK

SEQ ID NO: 112444 - protein, 15 aa, Mycobacterium tuberculosis
HAATGRAPVATSDKA

SEQ ID NO: 112445 - protein, 15 aa, Mycobacterium tuberculosis
AATGRAPVATSDKAA

SEQ ID NO: 112446 - protein, 15 aa, Mycobacterium tuberculosis
ATGRAPVATSDKAAA

SEQ ID NO: 112447 - protein, 15 aa, Mycobacterium tuberculosis
TGRAPVATSDKAAAP

SEQ ID NO: 112448 - protein, 15 aa, Mycobacterium tuberculosis
GRAPVATSDKAAAPS

SEQ ID NO: 112449 - protein, 15 aa, Mycobacterium tuberculosis
RAPVATSDKAAAPST

SEQ ID NO: 112450 - protein, 15 aa, Mycobacterium tuberculosis
APVATSDKAAAPSTR

SEQ ID NO: 112451 - protein, 15 aa, Mycobacterium tuberculosis
PVATSDKAAAPSTRA

SEQ ID NO: 112452 - protein, 15 aa, Mycobacterium tuberculosis
VATSDKAAAPSTRAA

SEQ ID NO: 112453 - protein, 15 aa, Mycobacterium tuberculosis
ATSDKAAAPSTRAAS

SEQ ID NO: 112454 - protein, 15 aa, Mycobacterium tuberculosis
TSDKAAAPSTRAASA

SEQ ID NO: 112455 - protein, 15 aa, Mycobacterium tuberculosis
SDKAAAPSTRAASAR

SEQ ID NO: 112456 - protein, 15 aa, Mycobacterium tuberculosis
DKAAAPSTRAASART

SEQ ID NO: 112457 - protein, 15 aa, Mycobacterium tuberculosis
KAAAPSTRAASARTA

SEQ ID NO: 112458 - protein, 15 aa, Mycobacterium tuberculosis
AAAPSTRAASARTAP

SEQ ID NO: 112459 - protein, 15 aa, Mycobacterium tuberculosis
AAPSTRAASARTAPP

SEQ ID NO: 112460 - protein, 15 aa, Mycobacterium tuberculosis
APSTRAASARTAPPA

SEQ ID NO: 112461 - protein, 15 aa, Mycobacterium tuberculosis
PSTRAASARTAPPAR

SEQ ID NO: 112462 - protein, 15 aa, Mycobacterium tuberculosis
STRAASARTAPPARP

SEQ ID NO: 112463 - protein, 15 aa, Mycobacterium tuberculosis
TRAASARTAPPARPP

SEQ ID NO: 112464 - protein, 15 aa, Mycobacterium tuberculosis
RAASARTAPPARPPS

SEQ ID NO: 112465 - protein, 15 aa, Mycobacterium tuberculosis
AASARTAPPARPPST

SEQ ID NO: 112466 - protein, 15 aa, Mycobacterium tuberculosis
ASARTAPPARPPSTD

SEQ ID NO: 112467 - protein, 15 aa, Mycobacterium tuberculosis
SARTAPPARPPSTDH

SEQ ID NO: 112468 - protein, 15 aa, Mycobacterium tuberculosis
ARTAPPARPPSTDHI

SEQ ID NO: 112469 - protein, 15 aa, Mycobacterium tuberculosis
RTAPPARPPSTDHID

SEQ ID NO: 112470 - protein, 15 aa, Mycobacterium tuberculosis
TAPPARPPSTDHIDK

SEQ ID NO: 112471 - protein, 15 aa, Mycobacterium tuberculosis
APPARPPSTDHIDKP

SEQ ID NO: 112472 - protein, 15 aa, Mycobacterium tuberculosis
PPARPPSTDHIDKPD

SEQ ID NO: 112473 - protein, 15 aa, Mycobacterium tuberculosis
PARPPSTDHIDKPDR

SEQ ID NO: 112474 - protein, 15 aa, Mycobacterium tuberculosis
ARPPSTDHIDKPDRS

SEQ ID NO: 112475 - protein, 15 aa, Mycobacterium tuberculosis
RPPSTDHIDKPDRSE

SEQ ID NO: 112476 - protein, 15 aa, Mycobacterium tuberculosis
PPSTDHIDKPDRSES

SEQ ID NO: 112477 - protein, 15 aa, Mycobacterium tuberculosis
PSTDHIDKPDRSESA

SEQ ID NO: 112478 - protein, 15 aa, Mycobacterium tuberculosis
STDHIDKPDRSESAD

SEQ ID NO: 112479 - protein, 15 aa, Mycobacterium tuberculosis
TDHIDKPDRSESADD

SEQ ID NO: 112480 - protein, 15 aa, Mycobacterium tuberculosis
DHIDKPDRSESADDG

SEQ ID NO: 112481 - protein, 15 aa, Mycobacterium tuberculosis
HIDKPDRSESADDGT

SEQ ID NO: 112482 - protein, 15 aa, Mycobacterium tuberculosis
IDKPDRSESADDGTP

SEQ ID NO: 112483 - protein, 15 aa, Mycobacterium tuberculosis
DKPDRSESADDGTPV

SEQ ID NO: 112484 - protein, 15 aa, Mycobacterium tuberculosis
KPDRSESADDGTPVS

SEQ ID NO: 112485 - protein, 15 aa, Mycobacterium tuberculosis
PDRSESADDGTPVSM

SEQ ID NO: 112486 - protein, 15 aa, Mycobacterium tuberculosis
DRSESADDGTPVSMI

SEQ ID NO: 112487 - protein, 15 aa, Mycobacterium tuberculosis
RSESADDGTPVSMIP

SEQ ID NO: 112488 - protein, 15 aa, Mycobacterium tuberculosis
SESADDGTPVSMIPV

SEQ ID NO: 112489 - protein, 15 aa, Mycobacterium tuberculosis
ESADDGTPVSMIPVS

SEQ ID NO: 112490 - protein, 15 aa, Mycobacterium tuberculosis
SADDGTPVSMIPVSA

SEQ ID NO: 112491 - protein, 15 aa, Mycobacterium tuberculosis
ADDGTPVSMIPVSAA

SEQ ID NO: 112492 - protein, 15 aa, Mycobacterium tuberculosis
DDGTPVSMIPVSAAR

SEQ ID NO: 112493 - protein, 15 aa, Mycobacterium tuberculosis
DGTPVSMIPVSAARA

SEQ ID NO: 112494 - protein, 15 aa, Mycobacterium tuberculosis
GTPVSMIPVSAARAA

SEQ ID NO: 112495 - protein, 15 aa, Mycobacterium tuberculosis
TPVSMIPVSAARAAR

SEQ ID NO: 112496 - protein, 15 aa, Mycobacterium tuberculosis
PVSMIPVSAARAARD

SEQ ID NO: 112497 - protein, 15 aa, Mycobacterium tuberculosis
VSMIPVSAARAARDA

SEQ ID NO: 112498 - protein, 15 aa, Mycobacterium tuberculosis
SMIPVSAARAARDAA

SEQ ID NO: 112499 - protein, 15 aa, Mycobacterium tuberculosis
MIPVSAARAARDAAT

SEQ ID NO: 112500 - protein, 15 aa, Mycobacterium tuberculosis
IPVSAARAARDAATA

SEQ ID NO: 112501 - protein, 15 aa, Mycobacterium tuberculosis
PVSAARAARDAATAA

SEQ ID NO: 112502 - protein, 15 aa, Mycobacterium tuberculosis
VSAARAARDAATAAA

SEQ ID NO: 112503 - protein, 15 aa, Mycobacterium tuberculosis
SAARAARDAATAAAS

SEQ ID NO: 112504 - protein, 15 aa, Mycobacterium tuberculosis
AARAARDAATAAASA

SEQ ID NO: 112505 - protein, 15 aa, Mycobacterium tuberculosis
ARAARDAATAAASAR

SEQ ID NO: 112506 - protein, 15 aa, Mycobacterium tuberculosis
RAARDAATAAASARQ

SEQ ID NO: 112507 - protein, 15 aa, Mycobacterium tuberculosis
AARDAATAAASARQR

SEQ ID NO: 112508 - protein, 15 aa, Mycobacterium tuberculosis
ARDAATAAASARQRG

SEQ ID NO: 112509 - protein, 15 aa, Mycobacterium tuberculosis
RDAATAAASARQRGR

SEQ ID NO: 112510 - protein, 15 aa, Mycobacterium tuberculosis
DAATAAASARQRGRG

SEQ ID NO: 112511 - protein, 15 aa, Mycobacterium tuberculosis
AATAAASARQRGRGD

SEQ ID NO: 112512 - protein, 15 aa, Mycobacterium tuberculosis
ATAAASARQRGRGDA

SEQ ID NO: 112513 - protein, 15 aa, Mycobacterium tuberculosis
TAAASARQRGRGDAL

SEQ ID NO: 112514 - protein, 15 aa, Mycobacterium tuberculosis
AAASARQRGRGDALR

SEQ ID NO: 112515 - protein, 15 aa, Mycobacterium tuberculosis
AASARQRGRGDALRL

SEQ ID NO: 112516 - protein, 15 aa, Mycobacterium tuberculosis
ASARQRGRGDALRLA

SEQ ID NO: 112517 - protein, 15 aa, Mycobacterium tuberculosis
SARQRGRGDALRLAR

SEQ ID NO: 112518 - protein, 15 aa, Mycobacterium tuberculosis
ARQRGRGDALRLARR

SEQ ID NO: 112519 - protein, 15 aa, Mycobacterium tuberculosis
RQRGRGDALRLARRI

SEQ ID NO: 112520 - protein, 15 aa, Mycobacterium tuberculosis
QRGRGDALRLARRIA

SEQ ID NO: 112521 - protein, 15 aa, Mycobacterium tuberculosis
RGRGDALRLARRIAA

SEQ ID NO: 112522 - protein, 15 aa, Mycobacterium tuberculosis
GRGDALRLARRIAAA

SEQ ID NO: 112523 - protein, 15 aa, Mycobacterium tuberculosis
RGDALRLARRIAAAL

SEQ ID NO: 112524 - protein, 15 aa, Mycobacterium tuberculosis
GDALRLARRIAAALN

SEQ ID NO: 112525 - protein, 15 aa, Mycobacterium tuberculosis
DALRLARRIAAALNA

SEQ ID NO: 112526 - protein, 15 aa, Mycobacterium tuberculosis
ALRLARRIAAALNAS

SEQ ID NO: 112527 - protein, 15 aa, Mycobacterium tuberculosis
LRLARRIAAALNASD

SEQ ID NO: 112528 - protein, 15 aa, Mycobacterium tuberculosis
RLARRIAAALNASDN

SEQ ID NO: 112529 - protein, 15 aa, Mycobacterium tuberculosis
LARRIAAALNASDNN

SEQ ID NO: 112530 - protein, 15 aa, Mycobacterium tuberculosis
ARRIAAALNASDNNA

SEQ ID NO: 112531 - protein, 15 aa, Mycobacterium tuberculosis
RRIAAALNASDNNAG

SEQ ID NO: 112532 - protein, 15 aa, Mycobacterium tuberculosis
RIAAALNASDNNAGD

SEQ ID NO: 112533 - protein, 15 aa, Mycobacterium tuberculosis
IAAALNASDNNAGDY

SEQ ID NO: 112534 - protein, 15 aa, Mycobacterium tuberculosis
AAALNASDNNAGDYG

SEQ ID NO: 112535 - protein, 15 aa, Mycobacterium tuberculosis
AALNASDNNAGDYGF

SEQ ID NO: 112536 - protein, 15 aa, Mycobacterium tuberculosis
ALNASDNNAGDYGFF

SEQ ID NO: 112537 - protein, 15 aa, Mycobacterium tuberculosis
LNASDNNAGDYGFFW

SEQ ID NO: 112538 - protein, 15 aa, Mycobacterium tuberculosis
NASDNNAGDYGFFWI

SEQ ID NO: 112539 - protein, 15 aa, Mycobacterium tuberculosis
ASDNNAGDYGFFWIT

SEQ ID NO: 112540 - protein, 15 aa, Mycobacterium tuberculosis
SDNNAGDYGFFWITA

SEQ ID NO: 112541 - protein, 15 aa, Mycobacterium tuberculosis
DNNAGDYGFFWITAV

SEQ ID NO: 112542 - protein, 15 aa, Mycobacterium tuberculosis
NNAGDYGFFWITAVT

SEQ ID NO: 112543 - protein, 15 aa, Mycobacterium tuberculosis
NAGDYGFFWITAVTT

SEQ ID NO: 112544 - protein, 15 aa, Mycobacterium tuberculosis
AGDYGFFWITAVTTD

SEQ ID NO: 112545 - protein, 15 aa, Mycobacterium tuberculosis
GDYGFFWITAVTTDG

SEQ ID NO: 112546 - protein, 15 aa, Mycobacterium tuberculosis
DYGFFWITAVTTDGS

SEQ ID NO: 112547 - protein, 15 aa, Mycobacterium tuberculosis
YGFFWITAVTTDGSI

SEQ ID NO: 112548 - protein, 15 aa, Mycobacterium tuberculosis
GFFWITAVTTDGSIV

SEQ ID NO: 112549 - protein, 15 aa, Mycobacterium tuberculosis
FFWITAVTTDGSIVV

SEQ ID NO: 112550 - protein, 15 aa, Mycobacterium tuberculosis
FWITAVTTDGSIVVA

SEQ ID NO: 112551 - protein, 15 aa, Mycobacterium tuberculosis
WITAVTTDGSIVVAN

SEQ ID NO: 112552 - protein, 15 aa, Mycobacterium tuberculosis
ITAVTTDGSIVVANS

SEQ ID NO: 112553 - protein, 15 aa, Mycobacterium tuberculosis
TAVTTDGSIVVANSY

SEQ ID NO: 112554 - protein, 15 aa, Mycobacterium tuberculosis
AVTTDGSIVVANSYG

SEQ ID NO: 112555 - protein, 15 aa, Mycobacterium tuberculosis
VTTDGSIVVANSYGL

SEQ ID NO: 112556 - protein, 15 aa, Mycobacterium tuberculosis
TTDGSIVVANSYGLA

SEQ ID NO: 112557 - protein, 15 aa, Mycobacterium tuberculosis
TDGSIVVANSYGLAY

SEQ ID NO: 112558 - protein, 15 aa, Mycobacterium tuberculosis
DGSIVVANSYGLAYI

SEQ ID NO: 112559 - protein, 15 aa, Mycobacterium tuberculosis
GSIVVANSYGLAYIP

SEQ ID NO: 112560 - protein, 15 aa, Mycobacterium tuberculosis
SIVVANSYGLAYIPD

SEQ ID NO: 112561 - protein, 15 aa, Mycobacterium tuberculosis
IVVANSYGLAYIPDG

SEQ ID NO: 112562 - protein, 15 aa, Mycobacterium tuberculosis
VVANSYGLAYIPDGM

SEQ ID NO: 112563 - protein, 15 aa, Mycobacterium tuberculosis
VANSYGLAYIPDGME

SEQ ID NO: 112564 - protein, 15 aa, Mycobacterium tuberculosis
ANSYGLAYIPDGMEL

SEQ ID NO: 112565 - protein, 15 aa, Mycobacterium tuberculosis
NSYGLAYIPDGMELP

SEQ ID NO: 112566 - protein, 15 aa, Mycobacterium tuberculosis
SYGLAYIPDGMELPN

SEQ ID NO: 112567 - protein, 15 aa, Mycobacterium tuberculosis
YGLAYIPDGMELPNK

SEQ ID NO: 112568 - protein, 15 aa, Mycobacterium tuberculosis
GLAYIPDGMELPNKV

SEQ ID NO: 112569 - protein, 15 aa, Mycobacterium tuberculosis
LAYIPDGMELPNKVY

SEQ ID NO: 112570 - protein, 15 aa, Mycobacterium tuberculosis
AYIPDGMELPNKVYL

SEQ ID NO: 112571 - protein, 15 aa, Mycobacterium tuberculosis
YIPDGMELPNKVYLA

SEQ ID NO: 112572 - protein, 15 aa, Mycobacterium tuberculosis
IPDGMELPNKVYLAS

SEQ ID NO: 112573 - protein, 15 aa, Mycobacterium tuberculosis
PDGMELPNKVYLASA

SEQ ID NO: 112574 - protein, 15 aa, Mycobacterium tuberculosis
DGMELPNKVYLASAD

SEQ ID NO: 112575 - protein, 15 aa, Mycobacterium tuberculosis
GMELPNKVYLASADH

SEQ ID NO: 112576 - protein, 15 aa, Mycobacterium tuberculosis
MELPNKVYLASADHA

SEQ ID NO: 112577 - protein, 15 aa, Mycobacterium tuberculosis
ELPNKVYLASADHAI

SEQ ID NO: 112578 - protein, 15 aa, Mycobacterium tuberculosis
LPNKVYLASADHAIP

SEQ ID NO: 112579 - protein, 15 aa, Mycobacterium tuberculosis
PNKVYLASADHAIPV

SEQ ID NO: 112580 - protein, 15 aa, Mycobacterium tuberculosis
NKVYLASADHAIPVD

SEQ ID NO: 112581 - protein, 15 aa, Mycobacterium tuberculosis
KVYLASADHAIPVDE

SEQ ID NO: 112582 - protein, 15 aa, Mycobacterium tuberculosis
VYLASADHAIPVDEI

SEQ ID NO: 112583 - protein, 15 aa, Mycobacterium tuberculosis
YLASADHAIPVDEIA

SEQ ID NO: 112584 - protein, 15 aa, Mycobacterium tuberculosis
LASADHAIPVDEIAR

SEQ ID NO: 112585 - protein, 15 aa, Mycobacterium tuberculosis
ASADHAIPVDEIARC

SEQ ID NO: 112586 - protein, 15 aa, Mycobacterium tuberculosis
SADHAIPVDEIARCA

SEQ ID NO: 112587 - protein, 15 aa, Mycobacterium tuberculosis
ADHAIPVDEIARCAT

SEQ ID NO: 112588 - protein, 15 aa, Mycobacterium tuberculosis
DHAIPVDEIARCATY

SEQ ID NO: 112589 - protein, 15 aa, Mycobacterium tuberculosis
HAIPVDEIARCATYP

SEQ ID NO: 112590 - protein, 15 aa, Mycobacterium tuberculosis
AIPVDEIARCATYPV

SEQ ID NO: 112591 - protein, 15 aa, Mycobacterium tuberculosis
IPVDEIARCATYPVL

SEQ ID NO: 112592 - protein, 15 aa, Mycobacterium tuberculosis
PVDEIARCATYPVLA

SEQ ID NO: 112593 - protein, 15 aa, Mycobacterium tuberculosis
VDEIARCATYPVLAV

SEQ ID NO: 112594 - protein, 15 aa, Mycobacterium tuberculosis
DEIARCATYPVLAVQ

SEQ ID NO: 112595 - protein, 15 aa, Mycobacterium tuberculosis
EIARCATYPVLAVQA

SEQ ID NO: 112596 - protein, 15 aa, Mycobacterium tuberculosis
IARCATYPVLAVQAW

SEQ ID NO: 112597 - protein, 15 aa, Mycobacterium tuberculosis
ARCATYPVLAVQAWA

SEQ ID NO: 112598 - protein, 15 aa, Mycobacterium tuberculosis
RCATYPVLAVQAWAA

SEQ ID NO: 112599 - protein, 15 aa, Mycobacterium tuberculosis
CATYPVLAVQAWAAF

SEQ ID NO: 112600 - protein, 15 aa, Mycobacterium tuberculosis
ATYPVLAVQAWAAFH

SEQ ID NO: 112601 - protein, 15 aa, Mycobacterium tuberculosis
TYPVLAVQAWAAFHD

SEQ ID NO: 112602 - protein, 15 aa, Mycobacterium tuberculosis
YPVLAVQAWAAFHDM

SEQ ID NO: 112603 - protein, 15 aa, Mycobacterium tuberculosis
PVLAVQAWAAFHDMT

SEQ ID NO: 112604 - protein, 15 aa, Mycobacterium tuberculosis
VLAVQAWAAFHDMTL

SEQ ID NO: 112605 - protein, 15 aa, Mycobacterium tuberculosis
LAVQAWAAFHDMTLR

SEQ ID NO: 112606 - protein, 15 aa, Mycobacterium tuberculosis
AVQAWAAFHDMTLRA

SEQ ID NO: 112607 - protein, 15 aa, Mycobacterium tuberculosis
VQAWAAFHDMTLRAV

SEQ ID NO: 112608 - protein, 15 aa, Mycobacterium tuberculosis
QAWAAFHDMTLRAVI

SEQ ID NO: 112609 - protein, 15 aa, Mycobacterium tuberculosis
AWAAFHDMTLRAVIG

SEQ ID NO: 112610 - protein, 15 aa, Mycobacterium tuberculosis
WAAFHDMTLRAVIGT

SEQ ID NO: 112611 - protein, 15 aa, Mycobacterium tuberculosis
AAFHDMTLRAVIGTA

SEQ ID NO: 112612 - protein, 15 aa, Mycobacterium tuberculosis
AFHDMTLRAVIGTAE

SEQ ID NO: 112613 - protein, 15 aa, Mycobacterium tuberculosis
FHDMTLRAVIGTAEQ

SEQ ID NO: 112614 - protein, 15 aa, Mycobacterium tuberculosis
HDMTLRAVIGTAEQL

SEQ ID NO: 112615 - protein, 15 aa, Mycobacterium tuberculosis
DMTLRAVIGTAEQLA

SEQ ID NO: 112616 - protein, 15 aa, Mycobacterium tuberculosis
MTLRAVIGTAEQLAS

SEQ ID NO: 112617 - protein, 15 aa, Mycobacterium tuberculosis
TLRAVIGTAEQLASS

SEQ ID NO: 112618 - protein, 15 aa, Mycobacterium tuberculosis
LRAVIGTAEQLASSD

SEQ ID NO: 112619 - protein, 15 aa, Mycobacterium tuberculosis
RAVIGTAEQLASSDP

SEQ ID NO: 112620 - protein, 15 aa, Mycobacterium tuberculosis
AVIGTAEQLASSDPG

SEQ ID NO: 112621 - protein, 15 aa, Mycobacterium tuberculosis
VIGTAEQLASSDPGV

SEQ ID NO: 112622 - protein, 15 aa, Mycobacterium tuberculosis
IGTAEQLASSDPGVA

SEQ ID NO: 112623 - protein, 15 aa, Mycobacterium tuberculosis
GTAEQLASSDPGVAK

SEQ ID NO: 112624 - protein, 15 aa, Mycobacterium tuberculosis
TAEQLASSDPGVAKI

SEQ ID NO: 112625 - protein, 15 aa, Mycobacterium tuberculosis
AEQLASSDPGVAKIV

SEQ ID NO: 112626 - protein, 15 aa, Mycobacterium tuberculosis
EQLASSDPGVAKIVL

SEQ ID NO: 112627 - protein, 15 aa, Mycobacterium tuberculosis
QLASSDPGVAKIVLE

SEQ ID NO: 112628 - protein, 15 aa, Mycobacterium tuberculosis
LASSDPGVAKIVLEP

SEQ ID NO: 112629 - protein, 15 aa, Mycobacterium tuberculosis
ASSDPGVAKIVLEPD

SEQ ID NO: 112630 - protein, 15 aa, Mycobacterium tuberculosis
SSDPGVAKIVLEPDD

SEQ ID NO: 112631 - protein, 15 aa, Mycobacterium tuberculosis
SDPGVAKIVLEPDDI

SEQ ID NO: 112632 - protein, 15 aa, Mycobacterium tuberculosis
DPGVAKIVLEPDDIP

SEQ ID NO: 112633 - protein, 15 aa, Mycobacterium tuberculosis
PGVAKIVLEPDDIPE

SEQ ID NO: 112634 - protein, 15 aa, Mycobacterium tuberculosis
GVAKIVLEPDDIPES

SEQ ID NO: 112635 - protein, 15 aa, Mycobacterium tuberculosis
VAKIVLEPDDIPESG

SEQ ID NO: 112636 - protein, 15 aa, Mycobacterium tuberculosis
AKIVLEPDDIPESGK

SEQ ID NO: 112637 - protein, 15 aa, Mycobacterium tuberculosis
KIVLEPDDIPESGKM

SEQ ID NO: 112638 - protein, 15 aa, Mycobacterium tuberculosis
IVLEPDDIPESGKMT

SEQ ID NO: 112639 - protein, 15 aa, Mycobacterium tuberculosis
VLEPDDIPESGKMTG

SEQ ID NO: 112640 - protein, 15 aa, Mycobacterium tuberculosis
LEPDDIPESGKMTGR

SEQ ID NO: 112641 - protein, 15 aa, Mycobacterium tuberculosis
EPDDIPESGKMTGRS

SEQ ID NO: 112642 - protein, 15 aa, Mycobacterium tuberculosis
PDDIPESGKMTGRSR

SEQ ID NO: 112643 - protein, 15 aa, Mycobacterium tuberculosis
DDIPESGKMTGRSRL

SEQ ID NO: 112644 - protein, 15 aa, Mycobacterium tuberculosis
DIPESGKMTGRSRLE

SEQ ID NO: 112645 - protein, 15 aa, Mycobacterium tuberculosis
IPESGKMTGRSRLEV

SEQ ID NO: 112646 - protein, 15 aa, Mycobacterium tuberculosis
PESGKMTGRSRLEVV

SEQ ID NO: 112647 - protein, 15 aa, Mycobacterium tuberculosis
ESGKMTGRSRLEVVD

SEQ ID NO: 112648 - protein, 15 aa, Mycobacterium tuberculosis
SGKMTGRSRLEVVDP

SEQ ID NO: 112649 - protein, 15 aa, Mycobacterium tuberculosis
GKMTGRSRLEVVDPS

SEQ ID NO: 112650 - protein, 15 aa, Mycobacterium tuberculosis
KMTGRSRLEVVDPSA

SEQ ID NO: 112651 - protein, 15 aa, Mycobacterium tuberculosis
MTGRSRLEVVDPSAA

SEQ ID NO: 112652 - protein, 15 aa, Mycobacterium tuberculosis
TGRSRLEVVDPSAAA

SEQ ID NO: 112653 - protein, 15 aa, Mycobacterium tuberculosis
GRSRLEVVDPSAAAQ

SEQ ID NO: 112654 - protein, 15 aa, Mycobacterium tuberculosis
RSRLEVVDPSAAAQL

SEQ ID NO: 112655 - protein, 15 aa, Mycobacterium tuberculosis
SRLEVVDPSAAAQLA

SEQ ID NO: 112656 - protein, 15 aa, Mycobacterium tuberculosis
RLEVVDPSAAAQLAD

SEQ ID NO: 112657 - protein, 15 aa, Mycobacterium tuberculosis
LEVVDPSAAAQLADT

SEQ ID NO: 112658 - protein, 15 aa, Mycobacterium tuberculosis
EVVDPSAAAQLADTT

SEQ ID NO: 112659 - protein, 15 aa, Mycobacterium tuberculosis
VVDPSAAAQLADTTD

SEQ ID NO: 112660 - protein, 15 aa, Mycobacterium tuberculosis
VDPSAAAQLADTTDQ

SEQ ID NO: 112661 - protein, 15 aa, Mycobacterium tuberculosis
DPSAAAQLADTTDQR

SEQ ID NO: 112662 - protein, 15 aa, Mycobacterium tuberculosis
PSAAAQLADTTDQRL

SEQ ID NO: 112663 - protein, 15 aa, Mycobacterium tuberculosis
SAAAQLADTTDQRLL

SEQ ID NO: 112664 - protein, 15 aa, Mycobacterium tuberculosis
AAAQLADTTDQRLLD

SEQ ID NO: 112665 - protein, 15 aa, Mycobacterium tuberculosis
AAQLADTTDQRLLDL

SEQ ID NO: 112666 - protein, 15 aa, Mycobacterium tuberculosis
AQLADTTDQRLLDLL

SEQ ID NO: 112667 - protein, 15 aa, Mycobacterium tuberculosis
QLADTTDQRLLDLLP

SEQ ID NO: 112668 - protein, 15 aa, Mycobacterium tuberculosis
LADTTDQRLLDLLPP

SEQ ID NO: 112669 - protein, 15 aa, Mycobacterium tuberculosis
ADTTDQRLLDLLPPA

SEQ ID NO: 112670 - protein, 15 aa, Mycobacterium tuberculosis
DTTDQRLLDLLPPAP

SEQ ID NO: 112671 - protein, 15 aa, Mycobacterium tuberculosis
TTDQRLLDLLPPAPV

SEQ ID NO: 112672 - protein, 15 aa, Mycobacterium tuberculosis
TDQRLLDLLPPAPVD

SEQ ID NO: 112673 - protein, 15 aa, Mycobacterium tuberculosis
DQRLLDLLPPAPVDV

SEQ ID NO: 112674 - protein, 15 aa, Mycobacterium tuberculosis
QRLLDLLPPAPVDVN

SEQ ID NO: 112675 - protein, 15 aa, Mycobacterium tuberculosis
RLLDLLPPAPVDVNP

SEQ ID NO: 112676 - protein, 15 aa, Mycobacterium tuberculosis
LLDLLPPAPVDVNPP

SEQ ID NO: 112677 - protein, 15 aa, Mycobacterium tuberculosis
LDLLPPAPVDVNPPG

SEQ ID NO: 112678 - protein, 15 aa, Mycobacterium tuberculosis
DLLPPAPVDVNPPGD

SEQ ID NO: 112679 - protein, 15 aa, Mycobacterium tuberculosis
LLPPAPVDVNPPGDE

SEQ ID NO: 112680 - protein, 15 aa, Mycobacterium tuberculosis
LPPAPVDVNPPGDER

SEQ ID NO: 112681 - protein, 15 aa, Mycobacterium tuberculosis
PPAPVDVNPPGDERH

SEQ ID NO: 112682 - protein, 15 aa, Mycobacterium tuberculosis
PAPVDVNPPGDERHM

SEQ ID NO: 112683 - protein, 15 aa, Mycobacterium tuberculosis
APVDVNPPGDERHML

SEQ ID NO: 112684 - protein, 15 aa, Mycobacterium tuberculosis
PVDVNPPGDERHMLW

SEQ ID NO: 112685 - protein, 15 aa, Mycobacterium tuberculosis
VDVNPPGDERHMLWF

SEQ ID NO: 112686 - protein, 15 aa, Mycobacterium tuberculosis
DVNPPGDERHMLWFE

SEQ ID NO: 112687 - protein, 15 aa, Mycobacterium tuberculosis
VNPPGDERHMLWFEL

SEQ ID NO: 112688 - protein, 15 aa, Mycobacterium tuberculosis
NPPGDERHMLWFELM

SEQ ID NO: 112689 - protein, 15 aa, Mycobacterium tuberculosis
PPGDERHMLWFELMK

SEQ ID NO: 112690 - protein, 15 aa, Mycobacterium tuberculosis
PGDERHMLWFELMKP

SEQ ID NO: 112691 - protein, 15 aa, Mycobacterium tuberculosis
GDERHMLWFELMKPM

SEQ ID NO: 112692 - protein, 15 aa, Mycobacterium tuberculosis
DERHMLWFELMKPMT

SEQ ID NO: 112693 - protein, 15 aa, Mycobacterium tuberculosis
ERHMLWFELMKPMTS

SEQ ID NO: 112694 - protein, 15 aa, Mycobacterium tuberculosis
RHMLWFELMKPMTST

SEQ ID NO: 112695 - protein, 15 aa, Mycobacterium tuberculosis
HMLWFELMKPMTSTA

SEQ ID NO: 112696 - protein, 15 aa, Mycobacterium tuberculosis
MLWFELMKPMTSTAT

SEQ ID NO: 112697 - protein, 15 aa, Mycobacterium tuberculosis
LWFELMKPMTSTATG

SEQ ID NO: 112698 - protein, 15 aa, Mycobacterium tuberculosis
WFELMKPMTSTATGR

SEQ ID NO: 112699 - protein, 15 aa, Mycobacterium tuberculosis
FELMKPMTSTATGRE

SEQ ID NO: 112700 - protein, 15 aa, Mycobacterium tuberculosis
ELMKPMTSTATGREA

SEQ ID NO: 112701 - protein, 15 aa, Mycobacterium tuberculosis
LMKPMTSTATGREAA

SEQ ID NO: 112702 - protein, 15 aa, Mycobacterium tuberculosis
MKPMTSTATGREAAH

SEQ ID NO: 112703 - protein, 15 aa, Mycobacterium tuberculosis
KPMTSTATGREAAHL

SEQ ID NO: 112704 - protein, 15 aa, Mycobacterium tuberculosis
PMTSTATGREAAHLR

SEQ ID NO: 112705 - protein, 15 aa, Mycobacterium tuberculosis
MTSTATGREAAHLRA

SEQ ID NO: 112706 - protein, 15 aa, Mycobacterium tuberculosis
TSTATGREAAHLRAF

SEQ ID NO: 112707 - protein, 15 aa, Mycobacterium tuberculosis
STATGREAAHLRAFR

SEQ ID NO: 112708 - protein, 15 aa, Mycobacterium tuberculosis
TATGREAAHLRAFRA

SEQ ID NO: 112709 - protein, 15 aa, Mycobacterium tuberculosis
ATGREAAHLRAFRAY

SEQ ID NO: 112710 - protein, 15 aa, Mycobacterium tuberculosis
TGREAAHLRAFRAYA

SEQ ID NO: 112711 - protein, 15 aa, Mycobacterium tuberculosis
GREAAHLRAFRAYAA

SEQ ID NO: 112712 - protein, 15 aa, Mycobacterium tuberculosis
REAAHLRAFRAYAAH

SEQ ID NO: 112713 - protein, 15 aa, Mycobacterium tuberculosis
EAAHLRAFRAYAAHS

SEQ ID NO: 112714 - protein, 15 aa, Mycobacterium tuberculosis
AAHLRAFRAYAAHSQ

SEQ ID NO: 112715 - protein, 15 aa, Mycobacterium tuberculosis
AHLRAFRAYAAHSQE

SEQ ID NO: 112716 - protein, 15 aa, Mycobacterium tuberculosis
HLRAFRAYAAHSQEI

SEQ ID NO: 112717 - protein, 15 aa, Mycobacterium tuberculosis
LRAFRAYAAHSQEIA

SEQ ID NO: 112718 - protein, 15 aa, Mycobacterium tuberculosis
RAFRAYAAHSQEIAL

SEQ ID NO: 112719 - protein, 15 aa, Mycobacterium tuberculosis
AFRAYAAHSQEIALH

SEQ ID NO: 112720 - protein, 15 aa, Mycobacterium tuberculosis
FRAYAAHSQEIALHQ

SEQ ID NO: 112721 - protein, 15 aa, Mycobacterium tuberculosis
RAYAAHSQEIALHQA

SEQ ID NO: 112722 - protein, 15 aa, Mycobacterium tuberculosis
AYAAHSQEIALHQAH

SEQ ID NO: 112723 - protein, 15 aa, Mycobacterium tuberculosis
YAAHSQEIALHQAHT

SEQ ID NO: 112724 - protein, 15 aa, Mycobacterium tuberculosis
AAHSQEIALHQAHTA

SEQ ID NO: 112725 - protein, 15 aa, Mycobacterium tuberculosis
AHSQEIALHQAHTAT

SEQ ID NO: 112726 - protein, 15 aa, Mycobacterium tuberculosis
HSQEIALHQAHTATD

SEQ ID NO: 112727 - protein, 15 aa, Mycobacterium tuberculosis
SQEIALHQAHTATDA

SEQ ID NO: 112728 - protein, 15 aa, Mycobacterium tuberculosis
QEIALHQAHTATDAA

SEQ ID NO: 112729 - protein, 15 aa, Mycobacterium tuberculosis
EIALHQAHTATDAAV

SEQ ID NO: 112730 - protein, 15 aa, Mycobacterium tuberculosis
IALHQAHTATDAAVQ

SEQ ID NO: 112731 - protein, 15 aa, Mycobacterium tuberculosis
ALHQAHTATDAAVQR

SEQ ID NO: 112732 - protein, 15 aa, Mycobacterium tuberculosis
LHQAHTATDAAVQRV

SEQ ID NO: 112733 - protein, 15 aa, Mycobacterium tuberculosis
HQAHTATDAAVQRVA

SEQ ID NO: 112734 - protein, 15 aa, Mycobacterium tuberculosis
QAHTATDAAVQRVAV

SEQ ID NO: 112735 - protein, 15 aa, Mycobacterium tuberculosis
AHTATDAAVQRVAVA

SEQ ID NO: 112736 - protein, 15 aa, Mycobacterium tuberculosis
HTATDAAVQRVAVAD

SEQ ID NO: 112737 - protein, 15 aa, Mycobacterium tuberculosis
TATDAAVQRVAVADW

SEQ ID NO: 112738 - protein, 15 aa, Mycobacterium tuberculosis
ATDAAVQRVAVADWL

SEQ ID NO: 112739 - protein, 15 aa, Mycobacterium tuberculosis
TDAAVQRVAVADWLY

SEQ ID NO: 112740 - protein, 15 aa, Mycobacterium tuberculosis
DAAVQRVAVADWLYW

SEQ ID NO: 112741 - protein, 15 aa, Mycobacterium tuberculosis
AAVQRVAVADWLYWQ

SEQ ID NO: 112742 - protein, 15 aa, Mycobacterium tuberculosis
AVQRVAVADWLYWQY

SEQ ID NO: 112743 - protein, 15 aa, Mycobacterium tuberculosis
VQRVAVADWLYWQYV

SEQ ID NO: 112744 - protein, 15 aa, Mycobacterium tuberculosis
QRVAVADWLYWQYVT

SEQ ID NO: 112745 - protein, 15 aa, Mycobacterium tuberculosis
RVAVADWLYWQYVTG

SEQ ID NO: 112746 - protein, 15 aa, Mycobacterium tuberculosis
VAVADWLYWQYVTGL

SEQ ID NO: 112747 - protein, 15 aa, Mycobacterium tuberculosis
AVADWLYWQYVTGLL

SEQ ID NO: 112748 - protein, 15 aa, Mycobacterium tuberculosis
VADWLYWQYVTGLLD

SEQ ID NO: 112749 - protein, 15 aa, Mycobacterium tuberculosis
ADWLYWQYVTGLLDR

SEQ ID NO: 112750 - protein, 15 aa, Mycobacterium tuberculosis
DWLYWQYVTGLLDRA

SEQ ID NO: 112751 - protein, 15 aa, Mycobacterium tuberculosis
WLYWQYVTGLLDRAL

SEQ ID NO: 112752 - protein, 15 aa, Mycobacterium tuberculosis
LYWQYVTGLLDRALA

SEQ ID NO: 112753 - protein, 15 aa, Mycobacterium tuberculosis
YWQYVTGLLDRALAA

SEQ ID NO: 112754 - protein, 15 aa, Mycobacterium tuberculosis
WQYVTGLLDRALAAA

SEQ ID NO: 112755 - protein, 15 aa, Mycobacterium tuberculosis
QYVTGLLDRALAAAC

SEQ ID NO: 112756 - protein, 16 aa, Mycobacterium tuberculosis
MSITRPTGSYARQMLD

SEQ ID NO: 112757 - protein, 16 aa, Mycobacterium tuberculosis
SITRPTGSYARQMLDP

SEQ ID NO: 112758 - protein, 16 aa, Mycobacterium tuberculosis
ITRPTGSYARQMLDPG

SEQ ID NO: 112759 - protein, 16 aa, Mycobacterium tuberculosis
TRPTGSYARQMLDPGG

SEQ ID NO: 112760 - protein, 16 aa, Mycobacterium tuberculosis
RPTGSYARQMLDPGGW

SEQ ID NO: 112761 - protein, 16 aa, Mycobacterium tuberculosis
PTGSYARQMLDPGGWV

SEQ ID NO: 112762 - protein, 16 aa, Mycobacterium tuberculosis
TGSYARQMLDPGGWVE

SEQ ID NO: 112763 - protein, 16 aa, Mycobacterium tuberculosis
GSYARQMLDPGGWVEA

SEQ ID NO: 112764 - protein, 16 aa, Mycobacterium tuberculosis
SYARQMLDPGGWVEAD

SEQ ID NO: 112765 - protein, 16 aa, Mycobacterium tuberculosis
YARQMLDPGGWVEADE

SEQ ID NO: 112766 - protein, 16 aa, Mycobacterium tuberculosis
ARQMLDPGGWVEADED

SEQ ID NO: 112767 - protein, 16 aa, Mycobacterium tuberculosis
RQMLDPGGWVEADEDT

SEQ ID NO: 112768 - protein, 16 aa, Mycobacterium tuberculosis
QMLDPGGWVEADEDTF

SEQ ID NO: 112769 - protein, 16 aa, Mycobacterium tuberculosis
MLDPGGWVEADEDTFY

SEQ ID NO: 112770 - protein, 16 aa, Mycobacterium tuberculosis
LDPGGWVEADEDTFYD

SEQ ID NO: 112771 - protein, 16 aa, Mycobacterium tuberculosis
DPGGWVEADEDTFYDR

SEQ ID NO: 112772 - protein, 16 aa, Mycobacterium tuberculosis
PGGWVEADEDTFYDRA

SEQ ID NO: 112773 - protein, 16 aa, Mycobacterium tuberculosis
GGWVEADEDTFYDRAQ

SEQ ID NO: 112774 - protein, 16 aa, Mycobacterium tuberculosis
GWVEADEDTFYDRAQE

SEQ ID NO: 112775 - protein, 16 aa, Mycobacterium tuberculosis
WVEADEDTFYDRAQEY

SEQ ID NO: 112776 - protein, 16 aa, Mycobacterium tuberculosis
VEADEDTFYDRAQEYS

SEQ ID NO: 112777 - protein, 16 aa, Mycobacterium tuberculosis
EADEDTFYDRAQEYSQ

SEQ ID NO: 112778 - protein, 16 aa, Mycobacterium tuberculosis
ADEDTFYDRAQEYSQV

SEQ ID NO: 112779 - protein, 16 aa, Mycobacterium tuberculosis
DEDTFYDRAQEYSQVL

SEQ ID NO: 112780 - protein, 16 aa, Mycobacterium tuberculosis
EDTFYDRAQEYSQVLQ

SEQ ID NO: 112781 - protein, 16 aa, Mycobacterium tuberculosis
DTFYDRAQEYSQVLQR

SEQ ID NO: 112782 - protein, 16 aa, Mycobacterium tuberculosis
TFYDRAQEYSQVLQRV

SEQ ID NO: 112783 - protein, 16 aa, Mycobacterium tuberculosis
FYDRAQEYSQVLQRVT

SEQ ID NO: 112784 - protein, 16 aa, Mycobacterium tuberculosis
YDRAQEYSQVLQRVTD

SEQ ID NO: 112785 - protein, 16 aa, Mycobacterium tuberculosis
DRAQEYSQVLQRVTDV

SEQ ID NO: 112786 - protein, 16 aa, Mycobacterium tuberculosis
RAQEYSQVLQRVTDVL

SEQ ID NO: 112787 - protein, 16 aa, Mycobacterium tuberculosis
AQEYSQVLQRVTDVLD

SEQ ID NO: 112788 - protein, 16 aa, Mycobacterium tuberculosis
QEYSQVLQRVTDVLDT

SEQ ID NO: 112789 - protein, 16 aa, Mycobacterium tuberculosis
EYSQVLQRVTDVLDTC

SEQ ID NO: 112790 - protein, 16 aa, Mycobacterium tuberculosis
YSQVLQRVTDVLDTCR

SEQ ID NO: 112791 - protein, 16 aa, Mycobacterium tuberculosis
SQVLQRVTDVLDTCRQ

SEQ ID NO: 112792 - protein, 16 aa, Mycobacterium tuberculosis
QVLQRVTDVLDTCRQQ

SEQ ID NO: 112793 - protein, 16 aa, Mycobacterium tuberculosis
VLQRVTDVLDTCRQQK

SEQ ID NO: 112794 - protein, 16 aa, Mycobacterium tuberculosis
LQRVTDVLDTCRQQKG

SEQ ID NO: 112795 - protein, 16 aa, Mycobacterium tuberculosis
QRVTDVLDTCRQQKGH

SEQ ID NO: 112796 - protein, 16 aa, Mycobacterium tuberculosis
RVTDVLDTCRQQKGHV

SEQ ID NO: 112797 - protein, 16 aa, Mycobacterium tuberculosis
VTDVLDTCRQQKGHVF

SEQ ID NO: 112798 - protein, 16 aa, Mycobacterium tuberculosis
TDVLDTCRQQKGHVFE

SEQ ID NO: 112799 - protein, 16 aa, Mycobacterium tuberculosis
DVLDTCRQQKGHVFEG

SEQ ID NO: 112800 - protein, 16 aa, Mycobacterium tuberculosis
VLDTCRQQKGHVFEGG

SEQ ID NO: 112801 - protein, 16 aa, Mycobacterium tuberculosis
LDTCRQQKGHVFEGGL

SEQ ID NO: 112802 - protein, 16 aa, Mycobacterium tuberculosis
DTCRQQKGHVFEGGLW

SEQ ID NO: 112803 - protein, 16 aa, Mycobacterium tuberculosis
TCRQQKGHVFEGGLWS

SEQ ID NO: 112804 - protein, 16 aa, Mycobacterium tuberculosis
CRQQKGHVFEGGLWSG

SEQ ID NO: 112805 - protein, 16 aa, Mycobacterium tuberculosis
RQQKGHVFEGGLWSGG

SEQ ID NO: 112806 - protein, 16 aa, Mycobacterium tuberculosis
QQKGHVFEGGLWSGGA

SEQ ID NO: 112807 - protein, 16 aa, Mycobacterium tuberculosis
QKGHVFEGGLWSGGAA

SEQ ID NO: 112808 - protein, 16 aa, Mycobacterium tuberculosis
KGHVFEGGLWSGGAAN

SEQ ID NO: 112809 - protein, 16 aa, Mycobacterium tuberculosis
GHVFEGGLWSGGAANA

SEQ ID NO: 112810 - protein, 16 aa, Mycobacterium tuberculosis
HVFEGGLWSGGAANAA

SEQ ID NO: 112811 - protein, 16 aa, Mycobacterium tuberculosis
VFEGGLWSGGAANAAN

SEQ ID NO: 112812 - protein, 16 aa, Mycobacterium tuberculosis
FEGGLWSGGAANAANG

SEQ ID NO: 112813 - protein, 16 aa, Mycobacterium tuberculosis
EGGLWSGGAANAANGA

SEQ ID NO: 112814 - protein, 16 aa, Mycobacterium tuberculosis
GGLWSGGAANAANGAL

SEQ ID NO: 112815 - protein, 16 aa, Mycobacterium tuberculosis
GLWSGGAANAANGALG

SEQ ID NO: 112816 - protein, 16 aa, Mycobacterium tuberculosis
LWSGGAANAANGALGA

SEQ ID NO: 112817 - protein, 16 aa, Mycobacterium tuberculosis
WSGGAANAANGALGAN

SEQ ID NO: 112818 - protein, 16 aa, Mycobacterium tuberculosis
SGGAANAANGALGANI

SEQ ID NO: 112819 - protein, 16 aa, Mycobacterium tuberculosis
GGAANAANGALGANIN

SEQ ID NO: 112820 - protein, 16 aa, Mycobacterium tuberculosis
GAANAANGALGANINQ

SEQ ID NO: 112821 - protein, 16 aa, Mycobacterium tuberculosis
AANAANGALGANINQL

SEQ ID NO: 112822 - protein, 16 aa, Mycobacterium tuberculosis
ANAANGALGANINQLM

SEQ ID NO: 112823 - protein, 16 aa, Mycobacterium tuberculosis
NAANGALGANINQLMT

SEQ ID NO: 112824 - protein, 16 aa, Mycobacterium tuberculosis
AANGALGANINQLMTL

SEQ ID NO: 112825 - protein, 16 aa, Mycobacterium tuberculosis
ANGALGANINQLMTLQ

SEQ ID NO: 112826 - protein, 16 aa, Mycobacterium tuberculosis
NGALGANINQLMTLQD

SEQ ID NO: 112827 - protein, 16 aa, Mycobacterium tuberculosis
GALGANINQLMTLQDY

SEQ ID NO: 112828 - protein, 16 aa, Mycobacterium tuberculosis
ALGANINQLMTLQDYL

SEQ ID NO: 112829 - protein, 16 aa, Mycobacterium tuberculosis
LGANINQLMTLQDYLA

SEQ ID NO: 112830 - protein, 16 aa, Mycobacterium tuberculosis
GANINQLMTLQDYLAT

SEQ ID NO: 112831 - protein, 16 aa, Mycobacterium tuberculosis
ANINQLMTLQDYLATV

SEQ ID NO: 112832 - protein, 16 aa, Mycobacterium tuberculosis
NINQLMTLQDYLATVI

SEQ ID NO: 112833 - protein, 16 aa, Mycobacterium tuberculosis
INQLMTLQDYLATVIT

SEQ ID NO: 112834 - protein, 16 aa, Mycobacterium tuberculosis
NQLMTLQDYLATVITW

SEQ ID NO: 112835 - protein, 16 aa, Mycobacterium tuberculosis
QLMTLQDYLATVITWH

SEQ ID NO: 112836 - protein, 16 aa, Mycobacterium tuberculosis
LMTLQDYLATVITWHR

SEQ ID NO: 112837 - protein, 16 aa, Mycobacterium tuberculosis
MTLQDYLATVITWHRH

SEQ ID NO: 112838 - protein, 16 aa, Mycobacterium tuberculosis
TLQDYLATVITWHRHI

SEQ ID NO: 112839 - protein, 16 aa, Mycobacterium tuberculosis
LQDYLATVITWHRHIA

SEQ ID NO: 112840 - protein, 16 aa, Mycobacterium tuberculosis
QDYLATVITWHRHIAG

SEQ ID NO: 112841 - protein, 16 aa, Mycobacterium tuberculosis
DYLATVITWHRHIAGL

SEQ ID NO: 112842 - protein, 16 aa, Mycobacterium tuberculosis
YLATVITWHRHIAGLI

SEQ ID NO: 112843 - protein, 16 aa, Mycobacterium tuberculosis
LATVITWHRHIAGLIE

SEQ ID NO: 112844 - protein, 16 aa, Mycobacterium tuberculosis
ATVITWHRHIAGLIEQ

SEQ ID NO: 112845 - protein, 16 aa, Mycobacterium tuberculosis
TVITWHRHIAGLIEQA

SEQ ID NO: 112846 - protein, 16 aa, Mycobacterium tuberculosis
VITWHRHIAGLIEQAK

SEQ ID NO: 112847 - protein, 16 aa, Mycobacterium tuberculosis
ITWHRHIAGLIEQAKS

SEQ ID NO: 112848 - protein, 16 aa, Mycobacterium tuberculosis
TWHRHIAGLIEQAKSD

SEQ ID NO: 112849 - protein, 16 aa, Mycobacterium tuberculosis
WHRHIAGLIEQAKSDI

SEQ ID NO: 112850 - protein, 16 aa, Mycobacterium tuberculosis
HRHIAGLIEQAKSDIG

SEQ ID NO: 112851 - protein, 16 aa, Mycobacterium tuberculosis
RHIAGLIEQAKSDIGN

SEQ ID NO: 112852 - protein, 16 aa, Mycobacterium tuberculosis
HIAGLIEQAKSDIGNN

SEQ ID NO: 112853 - protein, 16 aa, Mycobacterium tuberculosis
IAGLIEQAKSDIGNNV

SEQ ID NO: 112854 - protein, 16 aa, Mycobacterium tuberculosis
AGLIEQAKSDIGNNVD

SEQ ID NO: 112855 - protein, 16 aa, Mycobacterium tuberculosis
GLIEQAKSDIGNNVDG

SEQ ID NO: 112856 - protein, 16 aa, Mycobacterium tuberculosis
LIEQAKSDIGNNVDGA

SEQ ID NO: 112857 - protein, 16 aa, Mycobacterium tuberculosis
IEQAKSDIGNNVDGAQ

SEQ ID NO: 112858 - protein, 16 aa, Mycobacterium tuberculosis
EQAKSDIGNNVDGAQR

SEQ ID NO: 112859 - protein, 16 aa, Mycobacterium tuberculosis
QAKSDIGNNVDGAQRE

SEQ ID NO: 112860 - protein, 16 aa, Mycobacterium tuberculosis
AKSDIGNNVDGAQREI

SEQ ID NO: 112861 - protein, 16 aa, Mycobacterium tuberculosis
KSDIGNNVDGAQREID

SEQ ID NO: 112862 - protein, 16 aa, Mycobacterium tuberculosis
SDIGNNVDGAQREIDI

SEQ ID NO: 112863 - protein, 16 aa, Mycobacterium tuberculosis
DIGNNVDGAQREIDIL

SEQ ID NO: 112864 - protein, 16 aa, Mycobacterium tuberculosis
IGNNVDGAQREIDILE

SEQ ID NO: 112865 - protein, 16 aa, Mycobacterium tuberculosis
GNNVDGAQREIDILEN

SEQ ID NO: 112866 - protein, 16 aa, Mycobacterium tuberculosis
NNVDGAQREIDILEND

SEQ ID NO: 112867 - protein, 16 aa, Mycobacterium tuberculosis
NVDGAQREIDILENDP

SEQ ID NO: 112868 - protein, 16 aa, Mycobacterium tuberculosis
VDGAQREIDILENDPS

SEQ ID NO: 112869 - protein, 16 aa, Mycobacterium tuberculosis
DGAQREIDILENDPSL

SEQ ID NO: 112870 - protein, 16 aa, Mycobacterium tuberculosis
GAQREIDILENDPSLD

SEQ ID NO: 112871 - protein, 16 aa, Mycobacterium tuberculosis
AQREIDILENDPSLDA

SEQ ID NO: 112872 - protein, 16 aa, Mycobacterium tuberculosis
QREIDILENDPSLDAD

SEQ ID NO: 112873 - protein, 16 aa, Mycobacterium tuberculosis
REIDILENDPSLDADE

SEQ ID NO: 112874 - protein, 16 aa, Mycobacterium tuberculosis
EIDILENDPSLDADER

SEQ ID NO: 112875 - protein, 16 aa, Mycobacterium tuberculosis
IDILENDPSLDADERH

SEQ ID NO: 112876 - protein, 16 aa, Mycobacterium tuberculosis
DILENDPSLDADERHT

SEQ ID NO: 112877 - protein, 16 aa, Mycobacterium tuberculosis
ILENDPSLDADERHTA

SEQ ID NO: 112878 - protein, 16 aa, Mycobacterium tuberculosis
LENDPSLDADERHTAI

SEQ ID NO: 112879 - protein, 16 aa, Mycobacterium tuberculosis
ENDPSLDADERHTAIN

SEQ ID NO: 112880 - protein, 16 aa, Mycobacterium tuberculosis
NDPSLDADERHTAINS

SEQ ID NO: 112881 - protein, 16 aa, Mycobacterium tuberculosis
DPSLDADERHTAINSL

SEQ ID NO: 112882 - protein, 16 aa, Mycobacterium tuberculosis
PSLDADERHTAINSLV

SEQ ID NO: 112883 - protein, 16 aa, Mycobacterium tuberculosis
SLDADERHTAINSLVT

SEQ ID NO: 112884 - protein, 16 aa, Mycobacterium tuberculosis
LDADERHTAINSLVTA

SEQ ID NO: 112885 - protein, 16 aa, Mycobacterium tuberculosis
DADERHTAINSLVTAT

SEQ ID NO: 112886 - protein, 16 aa, Mycobacterium tuberculosis
ADERHTAINSLVTATH

SEQ ID NO: 112887 - protein, 16 aa, Mycobacterium tuberculosis
DERHTAINSLVTATHG

SEQ ID NO: 112888 - protein, 16 aa, Mycobacterium tuberculosis
ERHTAINSLVTATHGA

SEQ ID NO: 112889 - protein, 16 aa, Mycobacterium tuberculosis
RHTAINSLVTATHGAN

SEQ ID NO: 112890 - protein, 16 aa, Mycobacterium tuberculosis
HTAINSLVTATHGANV

SEQ ID NO: 112891 - protein, 16 aa, Mycobacterium tuberculosis
TAINSLVTATHGANVS

SEQ ID NO: 112892 - protein, 16 aa, Mycobacterium tuberculosis
AINSLVTATHGANVSL

SEQ ID NO: 112893 - protein, 16 aa, Mycobacterium tuberculosis
INSLVTATHGANVSLV

SEQ ID NO: 112894 - protein, 16 aa, Mycobacterium tuberculosis
NSLVTATHGANVSLVA

SEQ ID NO: 112895 - protein, 16 aa, Mycobacterium tuberculosis
SLVTATHGANVSLVAE

SEQ ID NO: 112896 - protein, 16 aa, Mycobacterium tuberculosis
LVTATHGANVSLVAET

SEQ ID NO: 112897 - protein, 16 aa, Mycobacterium tuberculosis
VTATHGANVSLVAETA

SEQ ID NO: 112898 - protein, 16 aa, Mycobacterium tuberculosis
TATHGANVSLVAETAE

SEQ ID NO: 112899 - protein, 16 aa, Mycobacterium tuberculosis
ATHGANVSLVAETAER

SEQ ID NO: 112900 - protein, 16 aa, Mycobacterium tuberculosis
THGANVSLVAETAERV

SEQ ID NO: 112901 - protein, 16 aa, Mycobacterium tuberculosis
HGANVSLVAETAERVL

SEQ ID NO: 112902 - protein, 16 aa, Mycobacterium tuberculosis
GANVSLVAETAERVLE

SEQ ID NO: 112903 - protein, 16 aa, Mycobacterium tuberculosis
ANVSLVAETAERVLES

SEQ ID NO: 112904 - protein, 16 aa, Mycobacterium tuberculosis
NVSLVAETAERVLESK

SEQ ID NO: 112905 - protein, 16 aa, Mycobacterium tuberculosis
VSLVAETAERVLESKN

SEQ ID NO: 112906 - protein, 16 aa, Mycobacterium tuberculosis
SLVAETAERVLESKNW

SEQ ID NO: 112907 - protein, 16 aa, Mycobacterium tuberculosis
LVAETAERVLESKNWK

SEQ ID NO: 112908 - protein, 16 aa, Mycobacterium tuberculosis
VAETAERVLESKNWKP

SEQ ID NO: 112909 - protein, 16 aa, Mycobacterium tuberculosis
AETAERVLESKNWKPP

SEQ ID NO: 112910 - protein, 16 aa, Mycobacterium tuberculosis
ETAERVLESKNWKPPK

SEQ ID NO: 112911 - protein, 16 aa, Mycobacterium tuberculosis
TAERVLESKNWKPPKN

SEQ ID NO: 112912 - protein, 16 aa, Mycobacterium tuberculosis
AERVLESKNWKPPKNA

SEQ ID NO: 112913 - protein, 16 aa, Mycobacterium tuberculosis
ERVLESKNWKPPKNAL

SEQ ID NO: 112914 - protein, 16 aa, Mycobacterium tuberculosis
RVLESKNWKPPKNALE

SEQ ID NO: 112915 - protein, 16 aa, Mycobacterium tuberculosis
VLESKNWKPPKNALED

SEQ ID NO: 112916 - protein, 16 aa, Mycobacterium tuberculosis
LESKNWKPPKNALEDL

SEQ ID NO: 112917 - protein, 16 aa, Mycobacterium tuberculosis
ESKNWKPPKNALEDLL

SEQ ID NO: 112918 - protein, 16 aa, Mycobacterium tuberculosis
SKNWKPPKNALEDLLQ

SEQ ID NO: 112919 - protein, 16 aa, Mycobacterium tuberculosis
KNWKPPKNALEDLLQQ

SEQ ID NO: 112920 - protein, 16 aa, Mycobacterium tuberculosis
NWKPPKNALEDLLQQK

SEQ ID NO: 112921 - protein, 16 aa, Mycobacterium tuberculosis
WKPPKNALEDLLQQKS

SEQ ID NO: 112922 - protein, 16 aa, Mycobacterium tuberculosis
KPPKNALEDLLQQKSP

SEQ ID NO: 112923 - protein, 16 aa, Mycobacterium tuberculosis
PPKNALEDLLQQKSPP

SEQ ID NO: 112924 - protein, 16 aa, Mycobacterium tuberculosis
PKNALEDLLQQKSPPP

SEQ ID NO: 112925 - protein, 16 aa, Mycobacterium tuberculosis
KNALEDLLQQKSPPPP

SEQ ID NO: 112926 - protein, 16 aa, Mycobacterium tuberculosis
NALEDLLQQKSPPPPD

SEQ ID NO: 112927 - protein, 16 aa, Mycobacterium tuberculosis
ALEDLLQQKSPPPPDV

SEQ ID NO: 112928 - protein, 16 aa, Mycobacterium tuberculosis
LEDLLQQKSPPPPDVP

SEQ ID NO: 112929 - protein, 16 aa, Mycobacterium tuberculosis
EDLLQQKSPPPPDVPT

SEQ ID NO: 112930 - protein, 16 aa, Mycobacterium tuberculosis
DLLQQKSPPPPDVPTL

SEQ ID NO: 112931 - protein, 16 aa, Mycobacterium tuberculosis
LLQQKSPPPPDVPTLV

SEQ ID NO: 112932 - protein, 16 aa, Mycobacterium tuberculosis
LQQKSPPPPDVPTLVV

SEQ ID NO: 112933 - protein, 16 aa, Mycobacterium tuberculosis
QQKSPPPPDVPTLVVP

SEQ ID NO: 112934 - protein, 16 aa, Mycobacterium tuberculosis
QKSPPPPDVPTLVVPS

SEQ ID NO: 112935 - protein, 16 aa, Mycobacterium tuberculosis
KSPPPPDVPTLVVPSP

SEQ ID NO: 112936 - protein, 16 aa, Mycobacterium tuberculosis
SPPPPDVPTLVVPSPG

SEQ ID NO: 112937 - protein, 16 aa, Mycobacterium tuberculosis
PPPPDVPTLVVPSPGT

SEQ ID NO: 112938 - protein, 16 aa, Mycobacterium tuberculosis
PPPDVPTLVVPSPGTP

SEQ ID NO: 112939 - protein, 16 aa, Mycobacterium tuberculosis
PPDVPTLVVPSPGTPG

SEQ ID NO: 112940 - protein, 16 aa, Mycobacterium tuberculosis
PDVPTLVVPSPGTPGT

SEQ ID NO: 112941 - protein, 16 aa, Mycobacterium tuberculosis
DVPTLVVPSPGTPGTP

SEQ ID NO: 112942 - protein, 16 aa, Mycobacterium tuberculosis
VPTLVVPSPGTPGTPG

SEQ ID NO: 112943 - protein, 16 aa, Mycobacterium tuberculosis
PTLVVPSPGTPGTPGT

SEQ ID NO: 112944 - protein, 16 aa, Mycobacterium tuberculosis
TLVVPSPGTPGTPGTP

SEQ ID NO: 112945 - protein, 16 aa, Mycobacterium tuberculosis
LVVPSPGTPGTPGTPI

SEQ ID NO: 112946 - protein, 16 aa, Mycobacterium tuberculosis
VVPSPGTPGTPGTPIT

SEQ ID NO: 112947 - protein, 16 aa, Mycobacterium tuberculosis
VPSPGTPGTPGTPITP

SEQ ID NO: 112948 - protein, 16 aa, Mycobacterium tuberculosis
PSPGTPGTPGTPITPG

SEQ ID NO: 112949 - protein, 16 aa, Mycobacterium tuberculosis
SPGTPGTPGTPITPGT

SEQ ID NO: 112950 - protein, 16 aa, Mycobacterium tuberculosis
PGTPGTPGTPITPGTP

SEQ ID NO: 112951 - protein, 16 aa, Mycobacterium tuberculosis
GTPGTPGTPITPGTPI

SEQ ID NO: 112952 - protein, 16 aa, Mycobacterium tuberculosis
TPGTPGTPITPGTPIT

SEQ ID NO: 112953 - protein, 16 aa, Mycobacterium tuberculosis
PGTPGTPITPGTPITP

SEQ ID NO: 112954 - protein, 16 aa, Mycobacterium tuberculosis
GTPGTPITPGTPITPG

SEQ ID NO: 112955 - protein, 16 aa, Mycobacterium tuberculosis
TPGTPITPGTPITPGT

SEQ ID NO: 112956 - protein, 16 aa, Mycobacterium tuberculosis
PGTPITPGTPITPGTP

SEQ ID NO: 112957 - protein, 16 aa, Mycobacterium tuberculosis
GTPITPGTPITPGTPI

SEQ ID NO: 112958 - protein, 16 aa, Mycobacterium tuberculosis
TPITPGTPITPGTPIT

SEQ ID NO: 112959 - protein, 16 aa, Mycobacterium tuberculosis
PITPGTPITPGTPITP

SEQ ID NO: 112960 - protein, 16 aa, Mycobacterium tuberculosis
ITPGTPITPGTPITPI

SEQ ID NO: 112961 - protein, 16 aa, Mycobacterium tuberculosis
TPGTPITPGTPITPIP

SEQ ID NO: 112962 - protein, 16 aa, Mycobacterium tuberculosis
PGTPITPGTPITPIPG

SEQ ID NO: 112963 - protein, 16 aa, Mycobacterium tuberculosis
GTPITPGTPITPIPGA

SEQ ID NO: 112964 - protein, 16 aa, Mycobacterium tuberculosis
TPITPGTPITPIPGAP

SEQ ID NO: 112965 - protein, 16 aa, Mycobacterium tuberculosis
PITPGTPITPIPGAPV

SEQ ID NO: 112966 - protein, 16 aa, Mycobacterium tuberculosis
ITPGTPITPIPGAPVT

SEQ ID NO: 112967 - protein, 16 aa, Mycobacterium tuberculosis
TPGTPITPIPGAPVTP

SEQ ID NO: 112968 - protein, 16 aa, Mycobacterium tuberculosis
PGTPITPIPGAPVTPI

SEQ ID NO: 112969 - protein, 16 aa, Mycobacterium tuberculosis
GTPITPIPGAPVTPIT

SEQ ID NO: 112970 - protein, 16 aa, Mycobacterium tuberculosis
TPITPIPGAPVTPITP

SEQ ID NO: 112971 - protein, 16 aa, Mycobacterium tuberculosis
PITPIPGAPVTPITPT

SEQ ID NO: 112972 - protein, 16 aa, Mycobacterium tuberculosis
ITPIPGAPVTPITPTP

SEQ ID NO: 112973 - protein, 16 aa, Mycobacterium tuberculosis
TPIPGAPVTPITPTPG

SEQ ID NO: 112974 - protein, 16 aa, Mycobacterium tuberculosis
PIPGAPVTPITPTPGT

SEQ ID NO: 112975 - protein, 16 aa, Mycobacterium tuberculosis
IPGAPVTPITPTPGTP

SEQ ID NO: 112976 - protein, 16 aa, Mycobacterium tuberculosis
PGAPVTPITPTPGTPV

SEQ ID NO: 112977 - protein, 16 aa, Mycobacterium tuberculosis
GAPVTPITPTPGTPVT

SEQ ID NO: 112978 - protein, 16 aa, Mycobacterium tuberculosis
APVTPITPTPGTPVTP

SEQ ID NO: 112979 - protein, 16 aa, Mycobacterium tuberculosis
PVTPITPTPGTPVTPV

SEQ ID NO: 112980 - protein, 16 aa, Mycobacterium tuberculosis
VTPITPTPGTPVTPVT

SEQ ID NO: 112981 - protein, 16 aa, Mycobacterium tuberculosis
TPITPTPGTPVTPVTP

SEQ ID NO: 112982 - protein, 16 aa, Mycobacterium tuberculosis
PITPTPGTPVTPVTPG

SEQ ID NO: 112983 - protein, 16 aa, Mycobacterium tuberculosis
ITPTPGTPVTPVTPGK

SEQ ID NO: 112984 - protein, 16 aa, Mycobacterium tuberculosis
TPTPGTPVTPVTPGKP

SEQ ID NO: 112985 - protein, 16 aa, Mycobacterium tuberculosis
PTPGTPVTPVTPGKPV

SEQ ID NO: 112986 - protein, 16 aa, Mycobacterium tuberculosis
TPGTPVTPVTPGKPVT

SEQ ID NO: 112987 - protein, 16 aa, Mycobacterium tuberculosis
PGTPVTPVTPGKPVTP

SEQ ID NO: 112988 - protein, 16 aa, Mycobacterium tuberculosis
GTPVTPVTPGKPVTPV

SEQ ID NO: 112989 - protein, 16 aa, Mycobacterium tuberculosis
TPVTPVTPGKPVTPVT

SEQ ID NO: 112990 - protein, 16 aa, Mycobacterium tuberculosis
PVTPVTPGKPVTPVTP

SEQ ID NO: 112991 - protein, 16 aa, Mycobacterium tuberculosis
VTPVTPGKPVTPVTPV

SEQ ID NO: 112992 - protein, 16 aa, Mycobacterium tuberculosis
TPVTPGKPVTPVTPVK

SEQ ID NO: 112993 - protein, 16 aa, Mycobacterium tuberculosis
PVTPGKPVTPVTPVKP

SEQ ID NO: 112994 - protein, 16 aa, Mycobacterium tuberculosis
VTPGKPVTPVTPVKPG

SEQ ID NO: 112995 - protein, 16 aa, Mycobacterium tuberculosis
TPGKPVTPVTPVKPGT

SEQ ID NO: 112996 - protein, 16 aa, Mycobacterium tuberculosis
PGKPVTPVTPVKPGTP

SEQ ID NO: 112997 - protein, 16 aa, Mycobacterium tuberculosis
GKPVTPVTPVKPGTPG

SEQ ID NO: 112998 - protein, 16 aa, Mycobacterium tuberculosis
KPVTPVTPVKPGTPGE

SEQ ID NO: 112999 - protein, 16 aa, Mycobacterium tuberculosis
PVTPVTPVKPGTPGEP

SEQ ID NO: 113000 - protein, 16 aa, Mycobacterium tuberculosis
VTPVTPVKPGTPGEPT

SEQ ID NO: 113001 - protein, 16 aa, Mycobacterium tuberculosis
TPVTPVKPGTPGEPTP

SEQ ID NO: 113002 - protein, 16 aa, Mycobacterium tuberculosis
PVTPVKPGTPGEPTPI

SEQ ID NO: 113003 - protein, 16 aa, Mycobacterium tuberculosis
VTPVKPGTPGEPTPIT

SEQ ID NO: 113004 - protein, 16 aa, Mycobacterium tuberculosis
TPVKPGTPGEPTPITP

SEQ ID NO: 113005 - protein, 16 aa, Mycobacterium tuberculosis
PVKPGTPGEPTPITPV

SEQ ID NO: 113006 - protein, 16 aa, Mycobacterium tuberculosis
VKPGTPGEPTPITPVT

SEQ ID NO: 113007 - protein, 16 aa, Mycobacterium tuberculosis
KPGTPGEPTPITPVTP

SEQ ID NO: 113008 - protein, 16 aa, Mycobacterium tuberculosis
PGTPGEPTPITPVTPP

SEQ ID NO: 113009 - protein, 16 aa, Mycobacterium tuberculosis
GTPGEPTPITPVTPPV

SEQ ID NO: 113010 - protein, 16 aa, Mycobacterium tuberculosis
TPGEPTPITPVTPPVA

SEQ ID NO: 113011 - protein, 16 aa, Mycobacterium tuberculosis
PGEPTPITPVTPPVAP

SEQ ID NO: 113012 - protein, 16 aa, Mycobacterium tuberculosis
GEPTPITPVTPPVAPA

SEQ ID NO: 113013 - protein, 16 aa, Mycobacterium tuberculosis
EPTPITPVTPPVAPAT

SEQ ID NO: 113014 - protein, 16 aa, Mycobacterium tuberculosis
PTPITPVTPPVAPATP

SEQ ID NO: 113015 - protein, 16 aa, Mycobacterium tuberculosis
TPITPVTPPVAPATPA

SEQ ID NO: 113016 - protein, 16 aa, Mycobacterium tuberculosis
PITPVTPPVAPATPAT

SEQ ID NO: 113017 - protein, 16 aa, Mycobacterium tuberculosis
ITPVTPPVAPATPATP

SEQ ID NO: 113018 - protein, 16 aa, Mycobacterium tuberculosis
TPVTPPVAPATPATPA

SEQ ID NO: 113019 - protein, 16 aa, Mycobacterium tuberculosis
PVTPPVAPATPATPAT

SEQ ID NO: 113020 - protein, 16 aa, Mycobacterium tuberculosis
VTPPVAPATPATPATP

SEQ ID NO: 113021 - protein, 16 aa, Mycobacterium tuberculosis
TPPVAPATPATPATPV

SEQ ID NO: 113022 - protein, 16 aa, Mycobacterium tuberculosis
PPVAPATPATPATPVT

SEQ ID NO: 113023 - protein, 16 aa, Mycobacterium tuberculosis
PVAPATPATPATPVTP

SEQ ID NO: 113024 - protein, 16 aa, Mycobacterium tuberculosis
VAPATPATPATPVTPA

SEQ ID NO: 113025 - protein, 16 aa, Mycobacterium tuberculosis
APATPATPATPVTPAP

SEQ ID NO: 113026 - protein, 16 aa, Mycobacterium tuberculosis
PATPATPATPVTPAPA

SEQ ID NO: 113027 - protein, 16 aa, Mycobacterium tuberculosis
ATPATPATPVTPAPAP

SEQ ID NO: 113028 - protein, 16 aa, Mycobacterium tuberculosis
TPATPATPVTPAPAPH

SEQ ID NO: 113029 - protein, 16 aa, Mycobacterium tuberculosis
PATPATPVTPAPAPHP

SEQ ID NO: 113030 - protein, 16 aa, Mycobacterium tuberculosis
ATPATPVTPAPAPHPQ

SEQ ID NO: 113031 - protein, 16 aa, Mycobacterium tuberculosis
TPATPVTPAPAPHPQP

SEQ ID NO: 113032 - protein, 16 aa, Mycobacterium tuberculosis
PATPVTPAPAPHPQPA

SEQ ID NO: 113033 - protein, 16 aa, Mycobacterium tuberculosis
ATPVTPAPAPHPQPAP

SEQ ID NO: 113034 - protein, 16 aa, Mycobacterium tuberculosis
TPVTPAPAPHPQPAPA

SEQ ID NO: 113035 - protein, 16 aa, Mycobacterium tuberculosis
PVTPAPAPHPQPAPAP

SEQ ID NO: 113036 - protein, 16 aa, Mycobacterium tuberculosis
VTPAPAPHPQPAPAPA

SEQ ID NO: 113037 - protein, 16 aa, Mycobacterium tuberculosis
TPAPAPHPQPAPAPAP

SEQ ID NO: 113038 - protein, 16 aa, Mycobacterium tuberculosis
PAPAPHPQPAPAPAPS

SEQ ID NO: 113039 - protein, 16 aa, Mycobacterium tuberculosis
APAPHPQPAPAPAPSP

SEQ ID NO: 113040 - protein, 16 aa, Mycobacterium tuberculosis
PAPHPQPAPAPAPSPG

SEQ ID NO: 113041 - protein, 16 aa, Mycobacterium tuberculosis
APHPQPAPAPAPSPGP

SEQ ID NO: 113042 - protein, 16 aa, Mycobacterium tuberculosis
PHPQPAPAPAPSPGPQ

SEQ ID NO: 113043 - protein, 16 aa, Mycobacterium tuberculosis
HPQPAPAPAPSPGPQP

SEQ ID NO: 113044 - protein, 16 aa, Mycobacterium tuberculosis
PQPAPAPAPSPGPQPV

SEQ ID NO: 113045 - protein, 16 aa, Mycobacterium tuberculosis
QPAPAPAPSPGPQPVT

SEQ ID NO: 113046 - protein, 16 aa, Mycobacterium tuberculosis
PAPAPAPSPGPQPVTP

SEQ ID NO: 113047 - protein, 16 aa, Mycobacterium tuberculosis
APAPAPSPGPQPVTPA

SEQ ID NO: 113048 - protein, 16 aa, Mycobacterium tuberculosis
PAPAPSPGPQPVTPAT

SEQ ID NO: 113049 - protein, 16 aa, Mycobacterium tuberculosis
APAPSPGPQPVTPATP

SEQ ID NO: 113050 - protein, 16 aa, Mycobacterium tuberculosis
PAPSPGPQPVTPATPG

SEQ ID NO: 113051 - protein, 16 aa, Mycobacterium tuberculosis
APSPGPQPVTPATPGP

SEQ ID NO: 113052 - protein, 16 aa, Mycobacterium tuberculosis
PSPGPQPVTPATPGPS

SEQ ID NO: 113053 - protein, 16 aa, Mycobacterium tuberculosis
SPGPQPVTPATPGPSG

SEQ ID NO: 113054 - protein, 16 aa, Mycobacterium tuberculosis
PGPQPVTPATPGPSGP

SEQ ID NO: 113055 - protein, 16 aa, Mycobacterium tuberculosis
GPQPVTPATPGPSGPA

SEQ ID NO: 113056 - protein, 16 aa, Mycobacterium tuberculosis
PQPVTPATPGPSGPAT

SEQ ID NO: 113057 - protein, 16 aa, Mycobacterium tuberculosis
QPVTPATPGPSGPATP

SEQ ID NO: 113058 - protein, 16 aa, Mycobacterium tuberculosis
PVTPATPGPSGPATPG

SEQ ID NO: 113059 - protein, 16 aa, Mycobacterium tuberculosis
VTPATPGPSGPATPGT

SEQ ID NO: 113060 - protein, 16 aa, Mycobacterium tuberculosis
TPATPGPSGPATPGTP

SEQ ID NO: 113061 - protein, 16 aa, Mycobacterium tuberculosis
PATPGPSGPATPGTPG

SEQ ID NO: 113062 - protein, 16 aa, Mycobacterium tuberculosis
ATPGPSGPATPGTPGG

SEQ ID NO: 113063 - protein, 16 aa, Mycobacterium tuberculosis
TPGPSGPATPGTPGGE

SEQ ID NO: 113064 - protein, 16 aa, Mycobacterium tuberculosis
PGPSGPATPGTPGGEP

SEQ ID NO: 113065 - protein, 16 aa, Mycobacterium tuberculosis
GPSGPATPGTPGGEPA

SEQ ID NO: 113066 - protein, 16 aa, Mycobacterium tuberculosis
PSGPATPGTPGGEPAP

SEQ ID NO: 113067 - protein, 16 aa, Mycobacterium tuberculosis
SGPATPGTPGGEPAPH

SEQ ID NO: 113068 - protein, 16 aa, Mycobacterium tuberculosis
GPATPGTPGGEPAPHV

SEQ ID NO: 113069 - protein, 16 aa, Mycobacterium tuberculosis
PATPGTPGGEPAPHVK

SEQ ID NO: 113070 - protein, 16 aa, Mycobacterium tuberculosis
ATPGTPGGEPAPHVKP

SEQ ID NO: 113071 - protein, 16 aa, Mycobacterium tuberculosis
TPGTPGGEPAPHVKPA

SEQ ID NO: 113072 - protein, 16 aa, Mycobacterium tuberculosis
PGTPGGEPAPHVKPAA

SEQ ID NO: 113073 - protein, 16 aa, Mycobacterium tuberculosis
GTPGGEPAPHVKPAAL

SEQ ID NO: 113074 - protein, 16 aa, Mycobacterium tuberculosis
TPGGEPAPHVKPAALA

SEQ ID NO: 113075 - protein, 16 aa, Mycobacterium tuberculosis
PGGEPAPHVKPAALAE

SEQ ID NO: 113076 - protein, 16 aa, Mycobacterium tuberculosis
GGEPAPHVKPAALAEQ

SEQ ID NO: 113077 - protein, 16 aa, Mycobacterium tuberculosis
GEPAPHVKPAALAEQP

SEQ ID NO: 113078 - protein, 16 aa, Mycobacterium tuberculosis
EPAPHVKPAALAEQPG

SEQ ID NO: 113079 - protein, 16 aa, Mycobacterium tuberculosis
PAPHVKPAALAEQPGV

SEQ ID NO: 113080 - protein, 16 aa, Mycobacterium tuberculosis
APHVKPAALAEQPGVP

SEQ ID NO: 113081 - protein, 16 aa, Mycobacterium tuberculosis
PHVKPAALAEQPGVPG

SEQ ID NO: 113082 - protein, 16 aa, Mycobacterium tuberculosis
HVKPAALAEQPGVPGQ

SEQ ID NO: 113083 - protein, 16 aa, Mycobacterium tuberculosis
VKPAALAEQPGVPGQH

SEQ ID NO: 113084 - protein, 16 aa, Mycobacterium tuberculosis
KPAALAEQPGVPGQHA

SEQ ID NO: 113085 - protein, 16 aa, Mycobacterium tuberculosis
PAALAEQPGVPGQHAG

SEQ ID NO: 113086 - protein, 16 aa, Mycobacterium tuberculosis
AALAEQPGVPGQHAGG

SEQ ID NO: 113087 - protein, 16 aa, Mycobacterium tuberculosis
ALAEQPGVPGQHAGGG

SEQ ID NO: 113088 - protein, 16 aa, Mycobacterium tuberculosis
LAEQPGVPGQHAGGGT

SEQ ID NO: 113089 - protein, 16 aa, Mycobacterium tuberculosis
AEQPGVPGQHAGGGTQ

SEQ ID NO: 113090 - protein, 16 aa, Mycobacterium tuberculosis
EQPGVPGQHAGGGTQS

SEQ ID NO: 113091 - protein, 16 aa, Mycobacterium tuberculosis
QPGVPGQHAGGGTQSG

SEQ ID NO: 113092 - protein, 16 aa, Mycobacterium tuberculosis
PGVPGQHAGGGTQSGP

SEQ ID NO: 113093 - protein, 16 aa, Mycobacterium tuberculosis
GVPGQHAGGGTQSGPA

SEQ ID NO: 113094 - protein, 16 aa, Mycobacterium tuberculosis
VPGQHAGGGTQSGPAH

SEQ ID NO: 113095 - protein, 16 aa, Mycobacterium tuberculosis
PGQHAGGGTQSGPAHA

SEQ ID NO: 113096 - protein, 16 aa, Mycobacterium tuberculosis
GQHAGGGTQSGPAHAD

SEQ ID NO: 113097 - protein, 16 aa, Mycobacterium tuberculosis
QHAGGGTQSGPAHADE

SEQ ID NO: 113098 - protein, 16 aa, Mycobacterium tuberculosis
HAGGGTQSGPAHADES

SEQ ID NO: 113099 - protein, 16 aa, Mycobacterium tuberculosis
AGGGTQSGPAHADESA

SEQ ID NO: 113100 - protein, 16 aa, Mycobacterium tuberculosis
GGGTQSGPAHADESAA

SEQ ID NO: 113101 - protein, 16 aa, Mycobacterium tuberculosis
GGTQSGPAHADESAAS

SEQ ID NO: 113102 - protein, 16 aa, Mycobacterium tuberculosis
GTQSGPAHADESAASV

SEQ ID NO: 113103 - protein, 16 aa, Mycobacterium tuberculosis
TQSGPAHADESAASVT

SEQ ID NO: 113104 - protein, 16 aa, Mycobacterium tuberculosis
QSGPAHADESAASVTP

SEQ ID NO: 113105 - protein, 16 aa, Mycobacterium tuberculosis
SGPAHADESAASVTPA

SEQ ID NO: 113106 - protein, 16 aa, Mycobacterium tuberculosis
GPAHADESAASVTPAA

SEQ ID NO: 113107 - protein, 16 aa, Mycobacterium tuberculosis
PAHADESAASVTPAAA

SEQ ID NO: 113108 - protein, 16 aa, Mycobacterium tuberculosis
AHADESAASVTPAAAS

SEQ ID NO: 113109 - protein, 16 aa, Mycobacterium tuberculosis
HADESAASVTPAAASG

SEQ ID NO: 113110 - protein, 16 aa, Mycobacterium tuberculosis
ADESAASVTPAAASGV

SEQ ID NO: 113111 - protein, 16 aa, Mycobacterium tuberculosis
DESAASVTPAAASGVP

SEQ ID NO: 113112 - protein, 16 aa, Mycobacterium tuberculosis
ESAASVTPAAASGVPG

SEQ ID NO: 113113 - protein, 16 aa, Mycobacterium tuberculosis
SAASVTPAAASGVPGA

SEQ ID NO: 113114 - protein, 16 aa, Mycobacterium tuberculosis
AASVTPAAASGVPGAR

SEQ ID NO: 113115 - protein, 16 aa, Mycobacterium tuberculosis
ASVTPAAASGVPGARA

SEQ ID NO: 113116 - protein, 16 aa, Mycobacterium tuberculosis
SVTPAAASGVPGARAA

SEQ ID NO: 113117 - protein, 16 aa, Mycobacterium tuberculosis
VTPAAASGVPGARAAA

SEQ ID NO: 113118 - protein, 16 aa, Mycobacterium tuberculosis
TPAAASGVPGARAAAA

SEQ ID NO: 113119 - protein, 16 aa, Mycobacterium tuberculosis
PAAASGVPGARAAAAA

SEQ ID NO: 113120 - protein, 16 aa, Mycobacterium tuberculosis
AAASGVPGARAAAAAP

SEQ ID NO: 113121 - protein, 16 aa, Mycobacterium tuberculosis
AASGVPGARAAAAAPS

SEQ ID NO: 113122 - protein, 16 aa, Mycobacterium tuberculosis
ASGVPGARAAAAAPSG

SEQ ID NO: 113123 - protein, 16 aa, Mycobacterium tuberculosis
SGVPGARAAAAAPSGT

SEQ ID NO: 113124 - protein, 16 aa, Mycobacterium tuberculosis
GVPGARAAAAAPSGTA

SEQ ID NO: 113125 - protein, 16 aa, Mycobacterium tuberculosis
VPGARAAAAAPSGTAV

SEQ ID NO: 113126 - protein, 16 aa, Mycobacterium tuberculosis
PGARAAAAAPSGTAVG

SEQ ID NO: 113127 - protein, 16 aa, Mycobacterium tuberculosis
GARAAAAAPSGTAVGA

SEQ ID NO: 113128 - protein, 16 aa, Mycobacterium tuberculosis
ARAAAAAPSGTAVGAG

SEQ ID NO: 113129 - protein, 16 aa, Mycobacterium tuberculosis
RAAAAAPSGTAVGAGA

SEQ ID NO: 113130 - protein, 16 aa, Mycobacterium tuberculosis
AAAAAPSGTAVGAGAR

SEQ ID NO: 113131 - protein, 16 aa, Mycobacterium tuberculosis
AAAAPSGTAVGAGARS

SEQ ID NO: 113132 - protein, 16 aa, Mycobacterium tuberculosis
AAAPSGTAVGAGARSS

SEQ ID NO: 113133 - protein, 16 aa, Mycobacterium tuberculosis
AAPSGTAVGAGARSSV

SEQ ID NO: 113134 - protein, 16 aa, Mycobacterium tuberculosis
APSGTAVGAGARSSVG

SEQ ID NO: 113135 - protein, 16 aa, Mycobacterium tuberculosis
PSGTAVGAGARSSVGT

SEQ ID NO: 113136 - protein, 16 aa, Mycobacterium tuberculosis
SGTAVGAGARSSVGTA

SEQ ID NO: 113137 - protein, 16 aa, Mycobacterium tuberculosis
GTAVGAGARSSVGTAA

SEQ ID NO: 113138 - protein, 16 aa, Mycobacterium tuberculosis
TAVGAGARSSVGTAAA

SEQ ID NO: 113139 - protein, 16 aa, Mycobacterium tuberculosis
AVGAGARSSVGTAAAS

SEQ ID NO: 113140 - protein, 16 aa, Mycobacterium tuberculosis
VGAGARSSVGTAAASG

SEQ ID NO: 113141 - protein, 16 aa, Mycobacterium tuberculosis
GAGARSSVGTAAASGA

SEQ ID NO: 113142 - protein, 16 aa, Mycobacterium tuberculosis
AGARSSVGTAAASGAG

SEQ ID NO: 113143 - protein, 16 aa, Mycobacterium tuberculosis
GARSSVGTAAASGAGS

SEQ ID NO: 113144 - protein, 16 aa, Mycobacterium tuberculosis
ARSSVGTAAASGAGSH

SEQ ID NO: 113145 - protein, 16 aa, Mycobacterium tuberculosis
RSSVGTAAASGAGSHA

SEQ ID NO: 113146 - protein, 16 aa, Mycobacterium tuberculosis
SSVGTAAASGAGSHAA

SEQ ID NO: 113147 - protein, 16 aa, Mycobacterium tuberculosis
SVGTAAASGAGSHAAT

SEQ ID NO: 113148 - protein, 16 aa, Mycobacterium tuberculosis
VGTAAASGAGSHAATG

SEQ ID NO: 113149 - protein, 16 aa, Mycobacterium tuberculosis
GTAAASGAGSHAATGR

SEQ ID NO: 113150 - protein, 16 aa, Mycobacterium tuberculosis
TAAASGAGSHAATGRA

SEQ ID NO: 113151 - protein, 16 aa, Mycobacterium tuberculosis
AAASGAGSHAATGRAP

SEQ ID NO: 113152 - protein, 16 aa, Mycobacterium tuberculosis
AASGAGSHAATGRAPV

SEQ ID NO: 113153 - protein, 16 aa, Mycobacterium tuberculosis
ASGAGSHAATGRAPVA

SEQ ID NO: 113154 - protein, 16 aa, Mycobacterium tuberculosis
SGAGSHAATGRAPVAT

SEQ ID NO: 113155 - protein, 16 aa, Mycobacterium tuberculosis
GAGSHAATGRAPVATS

SEQ ID NO: 113156 - protein, 16 aa, Mycobacterium tuberculosis
AGSHAATGRAPVATSD

SEQ ID NO: 113157 - protein, 16 aa, Mycobacterium tuberculosis
GSHAATGRAPVATSDK

SEQ ID NO: 113158 - protein, 16 aa, Mycobacterium tuberculosis
SHAATGRAPVATSDKA

SEQ ID NO: 113159 - protein, 16 aa, Mycobacterium tuberculosis
HAATGRAPVATSDKAA

SEQ ID NO: 113160 - protein, 16 aa, Mycobacterium tuberculosis
AATGRAPVATSDKAAA

SEQ ID NO: 113161 - protein, 16 aa, Mycobacterium tuberculosis
ATGRAPVATSDKAAAP

SEQ ID NO: 113162 - protein, 16 aa, Mycobacterium tuberculosis
TGRAPVATSDKAAAPS

SEQ ID NO: 113163 - protein, 16 aa, Mycobacterium tuberculosis
GRAPVATSDKAAAPST

SEQ ID NO: 113164 - protein, 16 aa, Mycobacterium tuberculosis
RAPVATSDKAAAPSTR

SEQ ID NO: 113165 - protein, 16 aa, Mycobacterium tuberculosis
APVATSDKAAAPSTRA

SEQ ID NO: 113166 - protein, 16 aa, Mycobacterium tuberculosis
PVATSDKAAAPSTRAA

SEQ ID NO: 113167 - protein, 16 aa, Mycobacterium tuberculosis
VATSDKAAAPSTRAAS

SEQ ID NO: 113168 - protein, 16 aa, Mycobacterium tuberculosis
ATSDKAAAPSTRAASA

SEQ ID NO: 113169 - protein, 16 aa, Mycobacterium tuberculosis
TSDKAAAPSTRAASAR

SEQ ID NO: 113170 - protein, 16 aa, Mycobacterium tuberculosis
SDKAAAPSTRAASART

SEQ ID NO: 113171 - protein, 16 aa, Mycobacterium tuberculosis
DKAAAPSTRAASARTA

SEQ ID NO: 113172 - protein, 16 aa, Mycobacterium tuberculosis
KAAAPSTRAASARTAP

SEQ ID NO: 113173 - protein, 16 aa, Mycobacterium tuberculosis
AAAPSTRAASARTAPP

SEQ ID NO: 113174 - protein, 16 aa, Mycobacterium tuberculosis
AAPSTRAASARTAPPA

SEQ ID NO: 113175 - protein, 16 aa, Mycobacterium tuberculosis
APSTRAASARTAPPAR

SEQ ID NO: 113176 - protein, 16 aa, Mycobacterium tuberculosis
PSTRAASARTAPPARP

SEQ ID NO: 113177 - protein, 16 aa, Mycobacterium tuberculosis
STRAASARTAPPARPP

SEQ ID NO: 113178 - protein, 16 aa, Mycobacterium tuberculosis
TRAASARTAPPARPPS

SEQ ID NO: 113179 - protein, 16 aa, Mycobacterium tuberculosis
RAASARTAPPARPPST

SEQ ID NO: 113180 - protein, 16 aa, Mycobacterium tuberculosis
AASARTAPPARPPSTD

SEQ ID NO: 113181 - protein, 16 aa, Mycobacterium tuberculosis
ASARTAPPARPPSTDH

SEQ ID NO: 113182 - protein, 16 aa, Mycobacterium tuberculosis
SARTAPPARPPSTDHI

SEQ ID NO: 113183 - protein, 16 aa, Mycobacterium tuberculosis
ARTAPPARPPSTDHID

SEQ ID NO: 113184 - protein, 16 aa, Mycobacterium tuberculosis
RTAPPARPPSTDHIDK

SEQ ID NO: 113185 - protein, 16 aa, Mycobacterium tuberculosis
TAPPARPPSTDHIDKP

SEQ ID NO: 113186 - protein, 16 aa, Mycobacterium tuberculosis
APPARPPSTDHIDKPD

SEQ ID NO: 113187 - protein, 16 aa, Mycobacterium tuberculosis
PPARPPSTDHIDKPDR

SEQ ID NO: 113188 - protein, 16 aa, Mycobacterium tuberculosis
PARPPSTDHIDKPDRS

SEQ ID NO: 113189 - protein, 16 aa, Mycobacterium tuberculosis
ARPPSTDHIDKPDRSE

SEQ ID NO: 113190 - protein, 16 aa, Mycobacterium tuberculosis
RPPSTDHIDKPDRSES

SEQ ID NO: 113191 - protein, 16 aa, Mycobacterium tuberculosis
PPSTDHIDKPDRSESA

SEQ ID NO: 113192 - protein, 16 aa, Mycobacterium tuberculosis
PSTDHIDKPDRSESAD

SEQ ID NO: 113193 - protein, 16 aa, Mycobacterium tuberculosis
STDHIDKPDRSESADD

SEQ ID NO: 113194 - protein, 16 aa, Mycobacterium tuberculosis
TDHIDKPDRSESADDG

SEQ ID NO: 113195 - protein, 16 aa, Mycobacterium tuberculosis
DHIDKPDRSESADDGT

SEQ ID NO: 113196 - protein, 16 aa, Mycobacterium tuberculosis
HIDKPDRSESADDGTP

SEQ ID NO: 113197 - protein, 16 aa, Mycobacterium tuberculosis
IDKPDRSESADDGTPV

SEQ ID NO: 113198 - protein, 16 aa, Mycobacterium tuberculosis
DKPDRSESADDGTPVS

SEQ ID NO: 113199 - protein, 16 aa, Mycobacterium tuberculosis
KPDRSESADDGTPVSM

SEQ ID NO: 113200 - protein, 16 aa, Mycobacterium tuberculosis
PDRSESADDGTPVSMI

SEQ ID NO: 113201 - protein, 16 aa, Mycobacterium tuberculosis
DRSESADDGTPVSMIP

SEQ ID NO: 113202 - protein, 16 aa, Mycobacterium tuberculosis
RSESADDGTPVSMIPV

SEQ ID NO: 113203 - protein, 16 aa, Mycobacterium tuberculosis
SESADDGTPVSMIPVS

SEQ ID NO: 113204 - protein, 16 aa, Mycobacterium tuberculosis
ESADDGTPVSMIPVSA

SEQ ID NO: 113205 - protein, 16 aa, Mycobacterium tuberculosis
SADDGTPVSMIPVSAA

SEQ ID NO: 113206 - protein, 16 aa, Mycobacterium tuberculosis
ADDGTPVSMIPVSAAR

SEQ ID NO: 113207 - protein, 16 aa, Mycobacterium tuberculosis
DDGTPVSMIPVSAARA

SEQ ID NO: 113208 - protein, 16 aa, Mycobacterium tuberculosis
DGTPVSMIPVSAARAA

SEQ ID NO: 113209 - protein, 16 aa, Mycobacterium tuberculosis
GTPVSMIPVSAARAAR

SEQ ID NO: 113210 - protein, 16 aa, Mycobacterium tuberculosis
TPVSMIPVSAARAARD

SEQ ID NO: 113211 - protein, 16 aa, Mycobacterium tuberculosis
PVSMIPVSAARAARDA

SEQ ID NO: 113212 - protein, 16 aa, Mycobacterium tuberculosis
VSMIPVSAARAARDAA

SEQ ID NO: 113213 - protein, 16 aa, Mycobacterium tuberculosis
SMIPVSAARAARDAAT

SEQ ID NO: 113214 - protein, 16 aa, Mycobacterium tuberculosis
MIPVSAARAARDAATA

SEQ ID NO: 113215 - protein, 16 aa, Mycobacterium tuberculosis
IPVSAARAARDAATAA

SEQ ID NO: 113216 - protein, 16 aa, Mycobacterium tuberculosis
PVSAARAARDAATAAA

SEQ ID NO: 113217 - protein, 16 aa, Mycobacterium tuberculosis
VSAARAARDAATAAAS

SEQ ID NO: 113218 - protein, 16 aa, Mycobacterium tuberculosis
SAARAARDAATAAASA

SEQ ID NO: 113219 - protein, 16 aa, Mycobacterium tuberculosis
AARAARDAATAAASAR

SEQ ID NO: 113220 - protein, 16 aa, Mycobacterium tuberculosis
ARAARDAATAAASARQ

SEQ ID NO: 113221 - protein, 16 aa, Mycobacterium tuberculosis
RAARDAATAAASARQR

SEQ ID NO: 113222 - protein, 16 aa, Mycobacterium tuberculosis
AARDAATAAASARQRG

SEQ ID NO: 113223 - protein, 16 aa, Mycobacterium tuberculosis
ARDAATAAASARQRGR

SEQ ID NO: 113224 - protein, 16 aa, Mycobacterium tuberculosis
RDAATAAASARQRGRG

SEQ ID NO: 113225 - protein, 16 aa, Mycobacterium tuberculosis
DAATAAASARQRGRGD

SEQ ID NO: 113226 - protein, 16 aa, Mycobacterium tuberculosis
AATAAASARQRGRGDA

SEQ ID NO: 113227 - protein, 16 aa, Mycobacterium tuberculosis
ATAAASARQRGRGDAL

SEQ ID NO: 113228 - protein, 16 aa, Mycobacterium tuberculosis
TAAASARQRGRGDALR

SEQ ID NO: 113229 - protein, 16 aa, Mycobacterium tuberculosis
AAASARQRGRGDALRL

SEQ ID NO: 113230 - protein, 16 aa, Mycobacterium tuberculosis
AASARQRGRGDALRLA

SEQ ID NO: 113231 - protein, 16 aa, Mycobacterium tuberculosis
ASARQRGRGDALRLAR

SEQ ID NO: 113232 - protein, 16 aa, Mycobacterium tuberculosis
SARQRGRGDALRLARR

SEQ ID NO: 113233 - protein, 16 aa, Mycobacterium tuberculosis
ARQRGRGDALRLARRI

SEQ ID NO: 113234 - protein, 16 aa, Mycobacterium tuberculosis
RQRGRGDALRLARRIA

SEQ ID NO: 113235 - protein, 16 aa, Mycobacterium tuberculosis
QRGRGDALRLARRIAA

SEQ ID NO: 113236 - protein, 16 aa, Mycobacterium tuberculosis
RGRGDALRLARRIAAA

SEQ ID NO: 113237 - protein, 16 aa, Mycobacterium tuberculosis
GRGDALRLARRIAAAL

SEQ ID NO: 113238 - protein, 16 aa, Mycobacterium tuberculosis
RGDALRLARRIAAALN

SEQ ID NO: 113239 - protein, 16 aa, Mycobacterium tuberculosis
GDALRLARRIAAALNA

SEQ ID NO: 113240 - protein, 16 aa, Mycobacterium tuberculosis
DALRLARRIAAALNAS

SEQ ID NO: 113241 - protein, 16 aa, Mycobacterium tuberculosis
ALRLARRIAAALNASD

SEQ ID NO: 113242 - protein, 16 aa, Mycobacterium tuberculosis
LRLARRIAAALNASDN

SEQ ID NO: 113243 - protein, 16 aa, Mycobacterium tuberculosis
RLARRIAAALNASDNN

SEQ ID NO: 113244 - protein, 16 aa, Mycobacterium tuberculosis
LARRIAAALNASDNNA

SEQ ID NO: 113245 - protein, 16 aa, Mycobacterium tuberculosis
ARRIAAALNASDNNAG

SEQ ID NO: 113246 - protein, 16 aa, Mycobacterium tuberculosis
RRIAAALNASDNNAGD

SEQ ID NO: 113247 - protein, 16 aa, Mycobacterium tuberculosis
RIAAALNASDNNAGDY

SEQ ID NO: 113248 - protein, 16 aa, Mycobacterium tuberculosis
IAAALNASDNNAGDYG

SEQ ID NO: 113249 - protein, 16 aa, Mycobacterium tuberculosis
AAALNASDNNAGDYGF

SEQ ID NO: 113250 - protein, 16 aa, Mycobacterium tuberculosis
AALNASDNNAGDYGFF

SEQ ID NO: 113251 - protein, 16 aa, Mycobacterium tuberculosis
ALNASDNNAGDYGFFW

SEQ ID NO: 113252 - protein, 16 aa, Mycobacterium tuberculosis
LNASDNNAGDYGFFWI

SEQ ID NO: 113253 - protein, 16 aa, Mycobacterium tuberculosis
NASDNNAGDYGFFWIT

SEQ ID NO: 113254 - protein, 16 aa, Mycobacterium tuberculosis
ASDNNAGDYGFFWITA

SEQ ID NO: 113255 - protein, 16 aa, Mycobacterium tuberculosis
SDNNAGDYGFFWITAV

SEQ ID NO: 113256 - protein, 16 aa, Mycobacterium tuberculosis
DNNAGDYGFFWITAVT

SEQ ID NO: 113257 - protein, 16 aa, Mycobacterium tuberculosis
NNAGDYGFFWITAVTT

SEQ ID NO: 113258 - protein, 16 aa, Mycobacterium tuberculosis
NAGDYGFFWITAVTTD

SEQ ID NO: 113259 - protein, 16 aa, Mycobacterium tuberculosis
AGDYGFFWITAVTTDG

SEQ ID NO: 113260 - protein, 16 aa, Mycobacterium tuberculosis
GDYGFFWITAVTTDGS

SEQ ID NO: 113261 - protein, 16 aa, Mycobacterium tuberculosis
DYGFFWITAVTTDGSI

SEQ ID NO: 113262 - protein, 16 aa, Mycobacterium tuberculosis
YGFFWITAVTTDGSIV

SEQ ID NO: 113263 - protein, 16 aa, Mycobacterium tuberculosis
GFFWITAVTTDGSIVV

SEQ ID NO: 113264 - protein, 16 aa, Mycobacterium tuberculosis
FFWITAVTTDGSIVVA

SEQ ID NO: 113265 - protein, 16 aa, Mycobacterium tuberculosis
FWITAVTTDGSIVVAN

SEQ ID NO: 113266 - protein, 16 aa, Mycobacterium tuberculosis
WITAVTTDGSIVVANS

SEQ ID NO: 113267 - protein, 16 aa, Mycobacterium tuberculosis
ITAVTTDGSIVVANSY

SEQ ID NO: 113268 - protein, 16 aa, Mycobacterium tuberculosis
TAVTTDGSIVVANSYG

SEQ ID NO: 113269 - protein, 16 aa, Mycobacterium tuberculosis
AVTTDGSIVVANSYGL

SEQ ID NO: 113270 - protein, 16 aa, Mycobacterium tuberculosis
VTTDGSIVVANSYGLA

SEQ ID NO: 113271 - protein, 16 aa, Mycobacterium tuberculosis
TTDGSIVVANSYGLAY

SEQ ID NO: 113272 - protein, 16 aa, Mycobacterium tuberculosis
TDGSIVVANSYGLAYI

SEQ ID NO: 113273 - protein, 16 aa, Mycobacterium tuberculosis
DGSIVVANSYGLAYIP

SEQ ID NO: 113274 - protein, 16 aa, Mycobacterium tuberculosis
GSIVVANSYGLAYIPD

SEQ ID NO: 113275 - protein, 16 aa, Mycobacterium tuberculosis
SIVVANSYGLAYIPDG

SEQ ID NO: 113276 - protein, 16 aa, Mycobacterium tuberculosis
IVVANSYGLAYIPDGM

SEQ ID NO: 113277 - protein, 16 aa, Mycobacterium tuberculosis
VVANSYGLAYIPDGME

SEQ ID NO: 113278 - protein, 16 aa, Mycobacterium tuberculosis
VANSYGLAYIPDGMEL

SEQ ID NO: 113279 - protein, 16 aa, Mycobacterium tuberculosis
ANSYGLAYIPDGMELP

SEQ ID NO: 113280 - protein, 16 aa, Mycobacterium tuberculosis
NSYGLAYIPDGMELPN

SEQ ID NO: 113281 - protein, 16 aa, Mycobacterium tuberculosis
SYGLAYIPDGMELPNK

SEQ ID NO: 113282 - protein, 16 aa, Mycobacterium tuberculosis
YGLAYIPDGMELPNKV

SEQ ID NO: 113283 - protein, 16 aa, Mycobacterium tuberculosis
GLAYIPDGMELPNKVY

SEQ ID NO: 113284 - protein, 16 aa, Mycobacterium tuberculosis
LAYIPDGMELPNKVYL

SEQ ID NO: 113285 - protein, 16 aa, Mycobacterium tuberculosis
AYIPDGMELPNKVYLA

SEQ ID NO: 113286 - protein, 16 aa, Mycobacterium tuberculosis
YIPDGMELPNKVYLAS

SEQ ID NO: 113287 - protein, 16 aa, Mycobacterium tuberculosis
IPDGMELPNKVYLASA

SEQ ID NO: 113288 - protein, 16 aa, Mycobacterium tuberculosis
PDGMELPNKVYLASAD

SEQ ID NO: 113289 - protein, 16 aa, Mycobacterium tuberculosis
DGMELPNKVYLASADH

SEQ ID NO: 113290 - protein, 16 aa, Mycobacterium tuberculosis
GMELPNKVYLASADHA

SEQ ID NO: 113291 - protein, 16 aa, Mycobacterium tuberculosis
MELPNKVYLASADHAI

SEQ ID NO: 113292 - protein, 16 aa, Mycobacterium tuberculosis
ELPNKVYLASADHAIP

SEQ ID NO: 113293 - protein, 16 aa, Mycobacterium tuberculosis
LPNKVYLASADHAIPV

SEQ ID NO: 113294 - protein, 16 aa, Mycobacterium tuberculosis
PNKVYLASADHAIPVD

SEQ ID NO: 113295 - protein, 16 aa, Mycobacterium tuberculosis
NKVYLASADHAIPVDE

SEQ ID NO: 113296 - protein, 16 aa, Mycobacterium tuberculosis
KVYLASADHAIPVDEI

SEQ ID NO: 113297 - protein, 16 aa, Mycobacterium tuberculosis
VYLASADHAIPVDEIA

SEQ ID NO: 113298 - protein, 16 aa, Mycobacterium tuberculosis
YLASADHAIPVDEIAR

SEQ ID NO: 113299 - protein, 16 aa, Mycobacterium tuberculosis
LASADHAIPVDEIARC

SEQ ID NO: 113300 - protein, 16 aa, Mycobacterium tuberculosis
ASADHAIPVDEIARCA

SEQ ID NO: 113301 - protein, 16 aa, Mycobacterium tuberculosis
SADHAIPVDEIARCAT

SEQ ID NO: 113302 - protein, 16 aa, Mycobacterium tuberculosis
ADHAIPVDEIARCATY

SEQ ID NO: 113303 - protein, 16 aa, Mycobacterium tuberculosis
DHAIPVDEIARCATYP

SEQ ID NO: 113304 - protein, 16 aa, Mycobacterium tuberculosis
HAIPVDEIARCATYPV

SEQ ID NO: 113305 - protein, 16 aa, Mycobacterium tuberculosis
AIPVDEIARCATYPVL

SEQ ID NO: 113306 - protein, 16 aa, Mycobacterium tuberculosis
IPVDEIARCATYPVLA

SEQ ID NO: 113307 - protein, 16 aa, Mycobacterium tuberculosis
PVDEIARCATYPVLAV

SEQ ID NO: 113308 - protein, 16 aa, Mycobacterium tuberculosis
VDEIARCATYPVLAVQ

SEQ ID NO: 113309 - protein, 16 aa, Mycobacterium tuberculosis
DEIARCATYPVLAVQA

SEQ ID NO: 113310 - protein, 16 aa, Mycobacterium tuberculosis
EIARCATYPVLAVQAW

SEQ ID NO: 113311 - protein, 16 aa, Mycobacterium tuberculosis
IARCATYPVLAVQAWA

SEQ ID NO: 113312 - protein, 16 aa, Mycobacterium tuberculosis
ARCATYPVLAVQAWAA

SEQ ID NO: 113313 - protein, 16 aa, Mycobacterium tuberculosis
RCATYPVLAVQAWAAF

SEQ ID NO: 113314 - protein, 16 aa, Mycobacterium tuberculosis
CATYPVLAVQAWAAFH

SEQ ID NO: 113315 - protein, 16 aa, Mycobacterium tuberculosis
ATYPVLAVQAWAAFHD

SEQ ID NO: 113316 - protein, 16 aa, Mycobacterium tuberculosis
TYPVLAVQAWAAFHDM

SEQ ID NO: 113317 - protein, 16 aa, Mycobacterium tuberculosis
YPVLAVQAWAAFHDMT

SEQ ID NO: 113318 - protein, 16 aa, Mycobacterium tuberculosis
PVLAVQAWAAFHDMTL

SEQ ID NO: 113319 - protein, 16 aa, Mycobacterium tuberculosis
VLAVQAWAAFHDMTLR

SEQ ID NO: 113320 - protein, 16 aa, Mycobacterium tuberculosis
LAVQAWAAFHDMTLRA

SEQ ID NO: 113321 - protein, 16 aa, Mycobacterium tuberculosis
AVQAWAAFHDMTLRAV

SEQ ID NO: 113322 - protein, 16 aa, Mycobacterium tuberculosis
VQAWAAFHDMTLRAVI

SEQ ID NO: 113323 - protein, 16 aa, Mycobacterium tuberculosis
QAWAAFHDMTLRAVIG

SEQ ID NO: 113324 - protein, 16 aa, Mycobacterium tuberculosis
AWAAFHDMTLRAVIGT

SEQ ID NO: 113325 - protein, 16 aa, Mycobacterium tuberculosis
WAAFHDMTLRAVIGTA

SEQ ID NO: 113326 - protein, 16 aa, Mycobacterium tuberculosis
AAFHDMTLRAVIGTAE

SEQ ID NO: 113327 - protein, 16 aa, Mycobacterium tuberculosis
AFHDMTLRAVIGTAEQ

SEQ ID NO: 113328 - protein, 16 aa, Mycobacterium tuberculosis
FHDMTLRAVIGTAEQL

SEQ ID NO: 113329 - protein, 16 aa, Mycobacterium tuberculosis
HDMTLRAVIGTAEQLA

SEQ ID NO: 113330 - protein, 16 aa, Mycobacterium tuberculosis
DMTLRAVIGTAEQLAS

SEQ ID NO: 113331 - protein, 16 aa, Mycobacterium tuberculosis
MTLRAVIGTAEQLASS

SEQ ID NO: 113332 - protein, 16 aa, Mycobacterium tuberculosis
TLRAVIGTAEQLASSD

SEQ ID NO: 113333 - protein, 16 aa, Mycobacterium tuberculosis
LRAVIGTAEQLASSDP

SEQ ID NO: 113334 - protein, 16 aa, Mycobacterium tuberculosis
RAVIGTAEQLASSDPG

SEQ ID NO: 113335 - protein, 16 aa, Mycobacterium tuberculosis
AVIGTAEQLASSDPGV

SEQ ID NO: 113336 - protein, 16 aa, Mycobacterium tuberculosis
VIGTAEQLASSDPGVA

SEQ ID NO: 113337 - protein, 16 aa, Mycobacterium tuberculosis
IGTAEQLASSDPGVAK

SEQ ID NO: 113338 - protein, 16 aa, Mycobacterium tuberculosis
GTAEQLASSDPGVAKI

SEQ ID NO: 113339 - protein, 16 aa, Mycobacterium tuberculosis
TAEQLASSDPGVAKIV

SEQ ID NO: 113340 - protein, 16 aa, Mycobacterium tuberculosis
AEQLASSDPGVAKIVL

SEQ ID NO: 113341 - protein, 16 aa, Mycobacterium tuberculosis
EQLASSDPGVAKIVLE

SEQ ID NO: 113342 - protein, 16 aa, Mycobacterium tuberculosis
QLASSDPGVAKIVLEP

SEQ ID NO: 113343 - protein, 16 aa, Mycobacterium tuberculosis
LASSDPGVAKIVLEPD

SEQ ID NO: 113344 - protein, 16 aa, Mycobacterium tuberculosis
ASSDPGVAKIVLEPDD

SEQ ID NO: 113345 - protein, 16 aa, Mycobacterium tuberculosis
SSDPGVAKIVLEPDDI

SEQ ID NO: 113346 - protein, 16 aa, Mycobacterium tuberculosis
SDPGVAKIVLEPDDIP

SEQ ID NO: 113347 - protein, 16 aa, Mycobacterium tuberculosis
DPGVAKIVLEPDDIPE

SEQ ID NO: 113348 - protein, 16 aa, Mycobacterium tuberculosis
PGVAKIVLEPDDIPES

SEQ ID NO: 113349 - protein, 16 aa, Mycobacterium tuberculosis
GVAKIVLEPDDIPESG

SEQ ID NO: 113350 - protein, 16 aa, Mycobacterium tuberculosis
VAKIVLEPDDIPESGK

SEQ ID NO: 113351 - protein, 16 aa, Mycobacterium tuberculosis
AKIVLEPDDIPESGKM

SEQ ID NO: 113352 - protein, 16 aa, Mycobacterium tuberculosis
KIVLEPDDIPESGKMT

SEQ ID NO: 113353 - protein, 16 aa, Mycobacterium tuberculosis
IVLEPDDIPESGKMTG

SEQ ID NO: 113354 - protein, 16 aa, Mycobacterium tuberculosis
VLEPDDIPESGKMTGR

SEQ ID NO: 113355 - protein, 16 aa, Mycobacterium tuberculosis
LEPDDIPESGKMTGRS

SEQ ID NO: 113356 - protein, 16 aa, Mycobacterium tuberculosis
EPDDIPESGKMTGRSR

SEQ ID NO: 113357 - protein, 16 aa, Mycobacterium tuberculosis
PDDIPESGKMTGRSRL

SEQ ID NO: 113358 - protein, 16 aa, Mycobacterium tuberculosis
DDIPESGKMTGRSRLE

SEQ ID NO: 113359 - protein, 16 aa, Mycobacterium tuberculosis
DIPESGKMTGRSRLEV

SEQ ID NO: 113360 - protein, 16 aa, Mycobacterium tuberculosis
IPESGKMTGRSRLEVV

SEQ ID NO: 113361 - protein, 16 aa, Mycobacterium tuberculosis
PESGKMTGRSRLEVVD

SEQ ID NO: 113362 - protein, 16 aa, Mycobacterium tuberculosis
ESGKMTGRSRLEVVDP

SEQ ID NO: 113363 - protein, 16 aa, Mycobacterium tuberculosis
SGKMTGRSRLEVVDPS

SEQ ID NO: 113364 - protein, 16 aa, Mycobacterium tuberculosis
GKMTGRSRLEVVDPSA

SEQ ID NO: 113365 - protein, 16 aa, Mycobacterium tuberculosis
KMTGRSRLEVVDPSAA

SEQ ID NO: 113366 - protein, 16 aa, Mycobacterium tuberculosis
MTGRSRLEVVDPSAAA

SEQ ID NO: 113367 - protein, 16 aa, Mycobacterium tuberculosis
TGRSRLEVVDPSAAAQ

SEQ ID NO: 113368 - protein, 16 aa, Mycobacterium tuberculosis
GRSRLEVVDPSAAAQL

SEQ ID NO: 113369 - protein, 16 aa, Mycobacterium tuberculosis
RSRLEVVDPSAAAQLA

SEQ ID NO: 113370 - protein, 16 aa, Mycobacterium tuberculosis
SRLEVVDPSAAAQLAD

SEQ ID NO: 113371 - protein, 16 aa, Mycobacterium tuberculosis
RLEVVDPSAAAQLADT

SEQ ID NO: 113372 - protein, 16 aa, Mycobacterium tuberculosis
LEVVDPSAAAQLADTT

SEQ ID NO: 113373 - protein, 16 aa, Mycobacterium tuberculosis
EVVDPSAAAQLADTTD

SEQ ID NO: 113374 - protein, 16 aa, Mycobacterium tuberculosis
VVDPSAAAQLADTTDQ

SEQ ID NO: 113375 - protein, 16 aa, Mycobacterium tuberculosis
VDPSAAAQLADTTDQR

SEQ ID NO: 113376 - protein, 16 aa, Mycobacterium tuberculosis
DPSAAAQLADTTDQRL

SEQ ID NO: 113377 - protein, 16 aa, Mycobacterium tuberculosis
PSAAAQLADTTDQRLL

SEQ ID NO: 113378 - protein, 16 aa, Mycobacterium tuberculosis
SAAAQLADTTDQRLLD

SEQ ID NO: 113379 - protein, 16 aa, Mycobacterium tuberculosis
AAAQLADTTDQRLLDL

SEQ ID NO: 113380 - protein, 16 aa, Mycobacterium tuberculosis
AAQLADTTDQRLLDLL

SEQ ID NO: 113381 - protein, 16 aa, Mycobacterium tuberculosis
AQLADTTDQRLLDLLP

SEQ ID NO: 113382 - protein, 16 aa, Mycobacterium tuberculosis
QLADTTDQRLLDLLPP

SEQ ID NO: 113383 - protein, 16 aa, Mycobacterium tuberculosis
LADTTDQRLLDLLPPA

SEQ ID NO: 113384 - protein, 16 aa, Mycobacterium tuberculosis
ADTTDQRLLDLLPPAP

SEQ ID NO: 113385 - protein, 16 aa, Mycobacterium tuberculosis
DTTDQRLLDLLPPAPV

SEQ ID NO: 113386 - protein, 16 aa, Mycobacterium tuberculosis
TTDQRLLDLLPPAPVD

SEQ ID NO: 113387 - protein, 16 aa, Mycobacterium tuberculosis
TDQRLLDLLPPAPVDV

SEQ ID NO: 113388 - protein, 16 aa, Mycobacterium tuberculosis
DQRLLDLLPPAPVDVN

SEQ ID NO: 113389 - protein, 16 aa, Mycobacterium tuberculosis
QRLLDLLPPAPVDVNP

SEQ ID NO: 113390 - protein, 16 aa, Mycobacterium tuberculosis
RLLDLLPPAPVDVNPP

SEQ ID NO: 113391 - protein, 16 aa, Mycobacterium tuberculosis
LLDLLPPAPVDVNPPG

SEQ ID NO: 113392 - protein, 16 aa, Mycobacterium tuberculosis
LDLLPPAPVDVNPPGD

SEQ ID NO: 113393 - protein, 16 aa, Mycobacterium tuberculosis
DLLPPAPVDVNPPGDE

SEQ ID NO: 113394 - protein, 16 aa, Mycobacterium tuberculosis
LLPPAPVDVNPPGDER

SEQ ID NO: 113395 - protein, 16 aa, Mycobacterium tuberculosis
LPPAPVDVNPPGDERH

SEQ ID NO: 113396 - protein, 16 aa, Mycobacterium tuberculosis
PPAPVDVNPPGDERHM

SEQ ID NO: 113397 - protein, 16 aa, Mycobacterium tuberculosis
PAPVDVNPPGDERHML

SEQ ID NO: 113398 - protein, 16 aa, Mycobacterium tuberculosis
APVDVNPPGDERHMLW

SEQ ID NO: 113399 - protein, 16 aa, Mycobacterium tuberculosis
PVDVNPPGDERHMLWF

SEQ ID NO: 113400 - protein, 16 aa, Mycobacterium tuberculosis
VDVNPPGDERHMLWFE

SEQ ID NO: 113401 - protein, 16 aa, Mycobacterium tuberculosis
DVNPPGDERHMLWFEL

SEQ ID NO: 113402 - protein, 16 aa, Mycobacterium tuberculosis
VNPPGDERHMLWFELM

SEQ ID NO: 113403 - protein, 16 aa, Mycobacterium tuberculosis
NPPGDERHMLWFELMK

SEQ ID NO: 113404 - protein, 16 aa, Mycobacterium tuberculosis
PPGDERHMLWFELMKP

SEQ ID NO: 113405 - protein, 16 aa, Mycobacterium tuberculosis
PGDERHMLWFELMKPM

SEQ ID NO: 113406 - protein, 16 aa, Mycobacterium tuberculosis
GDERHMLWFELMKPMT

SEQ ID NO: 113407 - protein, 16 aa, Mycobacterium tuberculosis
DERHMLWFELMKPMTS

SEQ ID NO: 113408 - protein, 16 aa, Mycobacterium tuberculosis
ERHMLWFELMKPMTST

SEQ ID NO: 113409 - protein, 16 aa, Mycobacterium tuberculosis
RHMLWFELMKPMTSTA

SEQ ID NO: 113410 - protein, 16 aa, Mycobacterium tuberculosis
HMLWFELMKPMTSTAT

SEQ ID NO: 113411 - protein, 16 aa, Mycobacterium tuberculosis
MLWFELMKPMTSTATG

SEQ ID NO: 113412 - protein, 16 aa, Mycobacterium tuberculosis
LWFELMKPMTSTATGR

SEQ ID NO: 113413 - protein, 16 aa, Mycobacterium tuberculosis
WFELMKPMTSTATGRE

SEQ ID NO: 113414 - protein, 16 aa, Mycobacterium tuberculosis
FELMKPMTSTATGREA

SEQ ID NO: 113415 - protein, 16 aa, Mycobacterium tuberculosis
ELMKPMTSTATGREAA

SEQ ID NO: 113416 - protein, 16 aa, Mycobacterium tuberculosis
LMKPMTSTATGREAAH

SEQ ID NO: 113417 - protein, 16 aa, Mycobacterium tuberculosis
MKPMTSTATGREAAHL

SEQ ID NO: 113418 - protein, 16 aa, Mycobacterium tuberculosis
KPMTSTATGREAAHLR

SEQ ID NO: 113419 - protein, 16 aa, Mycobacterium tuberculosis
PMTSTATGREAAHLRA

SEQ ID NO: 113420 - protein, 16 aa, Mycobacterium tuberculosis
MTSTATGREAAHLRAF

SEQ ID NO: 113421 - protein, 16 aa, Mycobacterium tuberculosis
TSTATGREAAHLRAFR

SEQ ID NO: 113422 - protein, 16 aa, Mycobacterium tuberculosis
STATGREAAHLRAFRA

SEQ ID NO: 113423 - protein, 16 aa, Mycobacterium tuberculosis
TATGREAAHLRAFRAY

SEQ ID NO: 113424 - protein, 16 aa, Mycobacterium tuberculosis
ATGREAAHLRAFRAYA

SEQ ID NO: 113425 - protein, 16 aa, Mycobacterium tuberculosis
TGREAAHLRAFRAYAA

SEQ ID NO: 113426 - protein, 16 aa, Mycobacterium tuberculosis
GREAAHLRAFRAYAAH

SEQ ID NO: 113427 - protein, 16 aa, Mycobacterium tuberculosis
REAAHLRAFRAYAAHS

SEQ ID NO: 113428 - protein, 16 aa, Mycobacterium tuberculosis
EAAHLRAFRAYAAHSQ

SEQ ID NO: 113429 - protein, 16 aa, Mycobacterium tuberculosis
AAHLRAFRAYAAHSQE

SEQ ID NO: 113430 - protein, 16 aa, Mycobacterium tuberculosis
AHLRAFRAYAAHSQEI

SEQ ID NO: 113431 - protein, 16 aa, Mycobacterium tuberculosis
HLRAFRAYAAHSQEIA

SEQ ID NO: 113432 - protein, 16 aa, Mycobacterium tuberculosis
LRAFRAYAAHSQEIAL

SEQ ID NO: 113433 - protein, 16 aa, Mycobacterium tuberculosis
RAFRAYAAHSQEIALH

SEQ ID NO: 113434 - protein, 16 aa, Mycobacterium tuberculosis
AFRAYAAHSQEIALHQ

SEQ ID NO: 113435 - protein, 16 aa, Mycobacterium tuberculosis
FRAYAAHSQEIALHQA

SEQ ID NO: 113436 - protein, 16 aa, Mycobacterium tuberculosis
RAYAAHSQEIALHQAH

SEQ ID NO: 113437 - protein, 16 aa, Mycobacterium tuberculosis
AYAAHSQEIALHQAHT

SEQ ID NO: 113438 - protein, 16 aa, Mycobacterium tuberculosis
YAAHSQEIALHQAHTA

SEQ ID NO: 113439 - protein, 16 aa, Mycobacterium tuberculosis
AAHSQEIALHQAHTAT

SEQ ID NO: 113440 - protein, 16 aa, Mycobacterium tuberculosis
AHSQEIALHQAHTATD

SEQ ID NO: 113441 - protein, 16 aa, Mycobacterium tuberculosis
HSQEIALHQAHTATDA

SEQ ID NO: 113442 - protein, 16 aa, Mycobacterium tuberculosis
SQEIALHQAHTATDAA

SEQ ID NO: 113443 - protein, 16 aa, Mycobacterium tuberculosis
QEIALHQAHTATDAAV

SEQ ID NO: 113444 - protein, 16 aa, Mycobacterium tuberculosis
EIALHQAHTATDAAVQ

SEQ ID NO: 113445 - protein, 16 aa, Mycobacterium tuberculosis
IALHQAHTATDAAVQR

SEQ ID NO: 113446 - protein, 16 aa, Mycobacterium tuberculosis
ALHQAHTATDAAVQRV

SEQ ID NO: 113447 - protein, 16 aa, Mycobacterium tuberculosis
LHQAHTATDAAVQRVA

SEQ ID NO: 113448 - protein, 16 aa, Mycobacterium tuberculosis
HQAHTATDAAVQRVAV

SEQ ID NO: 113449 - protein, 16 aa, Mycobacterium tuberculosis
QAHTATDAAVQRVAVA

SEQ ID NO: 113450 - protein, 16 aa, Mycobacterium tuberculosis
AHTATDAAVQRVAVAD

SEQ ID NO: 113451 - protein, 16 aa, Mycobacterium tuberculosis
HTATDAAVQRVAVADW

SEQ ID NO: 113452 - protein, 16 aa, Mycobacterium tuberculosis
TATDAAVQRVAVADWL

SEQ ID NO: 113453 - protein, 16 aa, Mycobacterium tuberculosis
ATDAAVQRVAVADWLY

SEQ ID NO: 113454 - protein, 16 aa, Mycobacterium tuberculosis
TDAAVQRVAVADWLYW

SEQ ID NO: 113455 - protein, 16 aa, Mycobacterium tuberculosis
DAAVQRVAVADWLYWQ

SEQ ID NO: 113456 - protein, 16 aa, Mycobacterium tuberculosis
AAVQRVAVADWLYWQY

SEQ ID NO: 113457 - protein, 16 aa, Mycobacterium tuberculosis
AVQRVAVADWLYWQYV

SEQ ID NO: 113458 - protein, 16 aa, Mycobacterium tuberculosis
VQRVAVADWLYWQYVT

SEQ ID NO: 113459 - protein, 16 aa, Mycobacterium tuberculosis
QRVAVADWLYWQYVTG

SEQ ID NO: 113460 - protein, 16 aa, Mycobacterium tuberculosis
RVAVADWLYWQYVTGL

SEQ ID NO: 113461 - protein, 16 aa, Mycobacterium tuberculosis
VAVADWLYWQYVTGLL

SEQ ID NO: 113462 - protein, 16 aa, Mycobacterium tuberculosis
AVADWLYWQYVTGLLD

SEQ ID NO: 113463 - protein, 16 aa, Mycobacterium tuberculosis
VADWLYWQYVTGLLDR

SEQ ID NO: 113464 - protein, 16 aa, Mycobacterium tuberculosis
ADWLYWQYVTGLLDRA

SEQ ID NO: 113465 - protein, 16 aa, Mycobacterium tuberculosis
DWLYWQYVTGLLDRAL

SEQ ID NO: 113466 - protein, 16 aa, Mycobacterium tuberculosis
WLYWQYVTGLLDRALA

SEQ ID NO: 113467 - protein, 16 aa, Mycobacterium tuberculosis
LYWQYVTGLLDRALAA

SEQ ID NO: 113468 - protein, 16 aa, Mycobacterium tuberculosis
YWQYVTGLLDRALAAA

SEQ ID NO: 113469 - protein, 16 aa, Mycobacterium tuberculosis
WQYVTGLLDRALAAAC

SEQ ID NO: 113470 - protein, 13 aa, Mycobacterium tuberculosis
MSDQITYNPGAVS

SEQ ID NO: 113471 - protein, 13 aa, Mycobacterium tuberculosis
SDQITYNPGAVSD

SEQ ID NO: 113472 - protein, 13 aa, Mycobacterium tuberculosis
DQITYNPGAVSDF

SEQ ID NO: 113473 - protein, 13 aa, Mycobacterium tuberculosis
QITYNPGAVSDFA

SEQ ID NO: 113474 - protein, 13 aa, Mycobacterium tuberculosis
ITYNPGAVSDFAS

SEQ ID NO: 113475 - protein, 13 aa, Mycobacterium tuberculosis
TYNPGAVSDFASD

SEQ ID NO: 113476 - protein, 13 aa, Mycobacterium tuberculosis
YNPGAVSDFASDV

SEQ ID NO: 113477 - protein, 13 aa, Mycobacterium tuberculosis
NPGAVSDFASDVG

SEQ ID NO: 113478 - protein, 13 aa, Mycobacterium tuberculosis
PGAVSDFASDVGS

SEQ ID NO: 113479 - protein, 13 aa, Mycobacterium tuberculosis
GAVSDFASDVGSR

SEQ ID NO: 113480 - protein, 13 aa, Mycobacterium tuberculosis
AVSDFASDVGSRA

SEQ ID NO: 113481 - protein, 13 aa, Mycobacterium tuberculosis
VSDFASDVGSRAG

SEQ ID NO: 113482 - protein, 13 aa, Mycobacterium tuberculosis
SDFASDVGSRAGQ

SEQ ID NO: 113483 - protein, 13 aa, Mycobacterium tuberculosis
DFASDVGSRAGQL

SEQ ID NO: 113484 - protein, 13 aa, Mycobacterium tuberculosis
FASDVGSRAGQLH

SEQ ID NO: 113485 - protein, 13 aa, Mycobacterium tuberculosis
ASDVGSRAGQLHM

SEQ ID NO: 113486 - protein, 13 aa, Mycobacterium tuberculosis
SDVGSRAGQLHMI

SEQ ID NO: 113487 - protein, 13 aa, Mycobacterium tuberculosis
DVGSRAGQLHMIY

SEQ ID NO: 113488 - protein, 13 aa, Mycobacterium tuberculosis
VGSRAGQLHMIYE

SEQ ID NO: 113489 - protein, 13 aa, Mycobacterium tuberculosis
GSRAGQLHMIYED

SEQ ID NO: 113490 - protein, 13 aa, Mycobacterium tuberculosis
SRAGQLHMIYEDT

SEQ ID NO: 113491 - protein, 13 aa, Mycobacterium tuberculosis
RAGQLHMIYEDTA

SEQ ID NO: 113492 - protein, 13 aa, Mycobacterium tuberculosis
AGQLHMIYEDTAS

SEQ ID NO: 113493 - protein, 13 aa, Mycobacterium tuberculosis
GQLHMIYEDTASK

SEQ ID NO: 113494 - protein, 13 aa, Mycobacterium tuberculosis
QLHMIYEDTASKT

SEQ ID NO: 113495 - protein, 13 aa, Mycobacterium tuberculosis
LHMIYEDTASKTN

SEQ ID NO: 113496 - protein, 13 aa, Mycobacterium tuberculosis
HMIYEDTASKTNA

SEQ ID NO: 113497 - protein, 13 aa, Mycobacterium tuberculosis
MIYEDTASKTNAL

SEQ ID NO: 113498 - protein, 13 aa, Mycobacterium tuberculosis
IYEDTASKTNALQ

SEQ ID NO: 113499 - protein, 13 aa, Mycobacterium tuberculosis
YEDTASKTNALQE

SEQ ID NO: 113500 - protein, 13 aa, Mycobacterium tuberculosis
EDTASKTNALQEF

SEQ ID NO: 113501 - protein, 13 aa, Mycobacterium tuberculosis
DTASKTNALQEFF

SEQ ID NO: 113502 - protein, 13 aa, Mycobacterium tuberculosis
TASKTNALQEFFA

SEQ ID NO: 113503 - protein, 13 aa, Mycobacterium tuberculosis
ASKTNALQEFFAG

SEQ ID NO: 113504 - protein, 13 aa, Mycobacterium tuberculosis
SKTNALQEFFAGH

SEQ ID NO: 113505 - protein, 13 aa, Mycobacterium tuberculosis
KTNALQEFFAGHG

SEQ ID NO: 113506 - protein, 13 aa, Mycobacterium tuberculosis
TNALQEFFAGHGA

SEQ ID NO: 113507 - protein, 13 aa, Mycobacterium tuberculosis
NALQEFFAGHGAQ

SEQ ID NO: 113508 - protein, 13 aa, Mycobacterium tuberculosis
ALQEFFAGHGAQG

SEQ ID NO: 113509 - protein, 13 aa, Mycobacterium tuberculosis
LQEFFAGHGAQGF

SEQ ID NO: 113510 - protein, 13 aa, Mycobacterium tuberculosis
QEFFAGHGAQGFF

SEQ ID NO: 113511 - protein, 13 aa, Mycobacterium tuberculosis
EFFAGHGAQGFFD

SEQ ID NO: 113512 - protein, 13 aa, Mycobacterium tuberculosis
FFAGHGAQGFFDA

SEQ ID NO: 113513 - protein, 13 aa, Mycobacterium tuberculosis
FAGHGAQGFFDAQ

SEQ ID NO: 113514 - protein, 13 aa, Mycobacterium tuberculosis
AGHGAQGFFDAQA

SEQ ID NO: 113515 - protein, 13 aa, Mycobacterium tuberculosis
GHGAQGFFDAQAQ

SEQ ID NO: 113516 - protein, 13 aa, Mycobacterium tuberculosis
HGAQGFFDAQAQM

SEQ ID NO: 113517 - protein, 13 aa, Mycobacterium tuberculosis
GAQGFFDAQAQML

SEQ ID NO: 113518 - protein, 13 aa, Mycobacterium tuberculosis
AQGFFDAQAQMLS

SEQ ID NO: 113519 - protein, 13 aa, Mycobacterium tuberculosis
QGFFDAQAQMLSG

SEQ ID NO: 113520 - protein, 13 aa, Mycobacterium tuberculosis
GFFDAQAQMLSGL

SEQ ID NO: 113521 - protein, 13 aa, Mycobacterium tuberculosis
FFDAQAQMLSGLQ

SEQ ID NO: 113522 - protein, 13 aa, Mycobacterium tuberculosis
FDAQAQMLSGLQG

SEQ ID NO: 113523 - protein, 13 aa, Mycobacterium tuberculosis
DAQAQMLSGLQGL

SEQ ID NO: 113524 - protein, 13 aa, Mycobacterium tuberculosis
AQAQMLSGLQGLI

SEQ ID NO: 113525 - protein, 13 aa, Mycobacterium tuberculosis
QAQMLSGLQGLIE

SEQ ID NO: 113526 - protein, 13 aa, Mycobacterium tuberculosis
AQMLSGLQGLIET

SEQ ID NO: 113527 - protein, 13 aa, Mycobacterium tuberculosis
QMLSGLQGLIETV

SEQ ID NO: 113528 - protein, 13 aa, Mycobacterium tuberculosis
MLSGLQGLIETVG

SEQ ID NO: 113529 - protein, 13 aa, Mycobacterium tuberculosis
LSGLQGLIETVGQ

SEQ ID NO: 113530 - protein, 13 aa, Mycobacterium tuberculosis
SGLQGLIETVGQH

SEQ ID NO: 113531 - protein, 13 aa, Mycobacterium tuberculosis
GLQGLIETVGQHG

SEQ ID NO: 113532 - protein, 13 aa, Mycobacterium tuberculosis
LQGLIETVGQHGT

SEQ ID NO: 113533 - protein, 13 aa, Mycobacterium tuberculosis
QGLIETVGQHGTT

SEQ ID NO: 113534 - protein, 13 aa, Mycobacterium tuberculosis
GLIETVGQHGTTT

SEQ ID NO: 113535 - protein, 13 aa, Mycobacterium tuberculosis
LIETVGQHGTTTG

SEQ ID NO: 113536 - protein, 13 aa, Mycobacterium tuberculosis
IETVGQHGTTTGH

SEQ ID NO: 113537 - protein, 13 aa, Mycobacterium tuberculosis
ETVGQHGTTTGHV

SEQ ID NO: 113538 - protein, 13 aa, Mycobacterium tuberculosis
TVGQHGTTTGHVL

SEQ ID NO: 113539 - protein, 13 aa, Mycobacterium tuberculosis
VGQHGTTTGHVLD

SEQ ID NO: 113540 - protein, 13 aa, Mycobacterium tuberculosis
GQHGTTTGHVLDN

SEQ ID NO: 113541 - protein, 13 aa, Mycobacterium tuberculosis
QHGTTTGHVLDNA

SEQ ID NO: 113542 - protein, 13 aa, Mycobacterium tuberculosis
HGTTTGHVLDNAI

SEQ ID NO: 113543 - protein, 13 aa, Mycobacterium tuberculosis
GTTTGHVLDNAIG

SEQ ID NO: 113544 - protein, 13 aa, Mycobacterium tuberculosis
TTTGHVLDNAIGT

SEQ ID NO: 113545 - protein, 13 aa, Mycobacterium tuberculosis
TTGHVLDNAIGTD

SEQ ID NO: 113546 - protein, 13 aa, Mycobacterium tuberculosis
TGHVLDNAIGTDQ

SEQ ID NO: 113547 - protein, 13 aa, Mycobacterium tuberculosis
GHVLDNAIGTDQA

SEQ ID NO: 113548 - protein, 13 aa, Mycobacterium tuberculosis
HVLDNAIGTDQAI

SEQ ID NO: 113549 - protein, 13 aa, Mycobacterium tuberculosis
VLDNAIGTDQAIA

SEQ ID NO: 113550 - protein, 13 aa, Mycobacterium tuberculosis
LDNAIGTDQAIAG

SEQ ID NO: 113551 - protein, 13 aa, Mycobacterium tuberculosis
DNAIGTDQAIAGL

SEQ ID NO: 113552 - protein, 13 aa, Mycobacterium tuberculosis
NAIGTDQAIAGLF

SEQ ID NO: 113553 - protein, 14 aa, Mycobacterium tuberculosis
MSDQITYNPGAVSD

SEQ ID NO: 113554 - protein, 14 aa, Mycobacterium tuberculosis
SDQITYNPGAVSDF

SEQ ID NO: 113555 - protein, 14 aa, Mycobacterium tuberculosis
DQITYNPGAVSDFA

SEQ ID NO: 113556 - protein, 14 aa, Mycobacterium tuberculosis
QITYNPGAVSDFAS

SEQ ID NO: 113557 - protein, 14 aa, Mycobacterium tuberculosis
ITYNPGAVSDFASD

SEQ ID NO: 113558 - protein, 14 aa, Mycobacterium tuberculosis
TYNPGAVSDFASDV

SEQ ID NO: 113559 - protein, 14 aa, Mycobacterium tuberculosis
YNPGAVSDFASDVG

SEQ ID NO: 113560 - protein, 14 aa, Mycobacterium tuberculosis
NPGAVSDFASDVGS

SEQ ID NO: 113561 - protein, 14 aa, Mycobacterium tuberculosis
PGAVSDFASDVGSR

SEQ ID NO: 113562 - protein, 14 aa, Mycobacterium tuberculosis
GAVSDFASDVGSRA

SEQ ID NO: 113563 - protein, 14 aa, Mycobacterium tuberculosis
AVSDFASDVGSRAG

SEQ ID NO: 113564 - protein, 14 aa, Mycobacterium tuberculosis
VSDFASDVGSRAGQ

SEQ ID NO: 113565 - protein, 14 aa, Mycobacterium tuberculosis
SDFASDVGSRAGQL

SEQ ID NO: 113566 - protein, 14 aa, Mycobacterium tuberculosis
DFASDVGSRAGQLH

SEQ ID NO: 113567 - protein, 14 aa, Mycobacterium tuberculosis
FASDVGSRAGQLHM

SEQ ID NO: 113568 - protein, 14 aa, Mycobacterium tuberculosis
ASDVGSRAGQLHMI

SEQ ID NO: 113569 - protein, 14 aa, Mycobacterium tuberculosis
SDVGSRAGQLHMIY

SEQ ID NO: 113570 - protein, 14 aa, Mycobacterium tuberculosis
DVGSRAGQLHMIYE

SEQ ID NO: 113571 - protein, 14 aa, Mycobacterium tuberculosis
VGSRAGQLHMIYED

SEQ ID NO: 113572 - protein, 14 aa, Mycobacterium tuberculosis
GSRAGQLHMIYEDT

SEQ ID NO: 113573 - protein, 14 aa, Mycobacterium tuberculosis
SRAGQLHMIYEDTA

SEQ ID NO: 113574 - protein, 14 aa, Mycobacterium tuberculosis
RAGQLHMIYEDTAS

SEQ ID NO: 113575 - protein, 14 aa, Mycobacterium tuberculosis
AGQLHMIYEDTASK

SEQ ID NO: 113576 - protein, 14 aa, Mycobacterium tuberculosis
GQLHMIYEDTASKT

SEQ ID NO: 113577 - protein, 14 aa, Mycobacterium tuberculosis
QLHMIYEDTASKTN

SEQ ID NO: 113578 - protein, 14 aa, Mycobacterium tuberculosis
LHMIYEDTASKTNA

SEQ ID NO: 113579 - protein, 14 aa, Mycobacterium tuberculosis
HMIYEDTASKTNAL

SEQ ID NO: 113580 - protein, 14 aa, Mycobacterium tuberculosis
MIYEDTASKTNALQ

SEQ ID NO: 113581 - protein, 14 aa, Mycobacterium tuberculosis
IYEDTASKTNALQE

SEQ ID NO: 113582 - protein, 14 aa, Mycobacterium tuberculosis
YEDTASKTNALQEF

SEQ ID NO: 113583 - protein, 14 aa, Mycobacterium tuberculosis
EDTASKTNALQEFF

SEQ ID NO: 113584 - protein, 14 aa, Mycobacterium tuberculosis
DTASKTNALQEFFA

SEQ ID NO: 113585 - protein, 14 aa, Mycobacterium tuberculosis
TASKTNALQEFFAG

SEQ ID NO: 113586 - protein, 14 aa, Mycobacterium tuberculosis
ASKTNALQEFFAGH

SEQ ID NO: 113587 - protein, 14 aa, Mycobacterium tuberculosis
SKTNALQEFFAGHG

SEQ ID NO: 113588 - protein, 14 aa, Mycobacterium tuberculosis
KTNALQEFFAGHGA

SEQ ID NO: 113589 - protein, 14 aa, Mycobacterium tuberculosis
TNALQEFFAGHGAQ

SEQ ID NO: 113590 - protein, 14 aa, Mycobacterium tuberculosis
NALQEFFAGHGAQG

SEQ ID NO: 113591 - protein, 14 aa, Mycobacterium tuberculosis
ALQEFFAGHGAQGF

SEQ ID NO: 113592 - protein, 14 aa, Mycobacterium tuberculosis
LQEFFAGHGAQGFF

SEQ ID NO: 113593 - protein, 14 aa, Mycobacterium tuberculosis
QEFFAGHGAQGFFD

SEQ ID NO: 113594 - protein, 14 aa, Mycobacterium tuberculosis
EFFAGHGAQGFFDA

SEQ ID NO: 113595 - protein, 14 aa, Mycobacterium tuberculosis
FFAGHGAQGFFDAQ

SEQ ID NO: 113596 - protein, 14 aa, Mycobacterium tuberculosis
FAGHGAQGFFDAQA

SEQ ID NO: 113597 - protein, 14 aa, Mycobacterium tuberculosis
AGHGAQGFFDAQAQ

SEQ ID NO: 113598 - protein, 14 aa, Mycobacterium tuberculosis
GHGAQGFFDAQAQM

SEQ ID NO: 113599 - protein, 14 aa, Mycobacterium tuberculosis
HGAQGFFDAQAQML

SEQ ID NO: 113600 - protein, 14 aa, Mycobacterium tuberculosis
GAQGFFDAQAQMLS

SEQ ID NO: 113601 - protein, 14 aa, Mycobacterium tuberculosis
AQGFFDAQAQMLSG

SEQ ID NO: 113602 - protein, 14 aa, Mycobacterium tuberculosis
QGFFDAQAQMLSGL

SEQ ID NO: 113603 - protein, 14 aa, Mycobacterium tuberculosis
GFFDAQAQMLSGLQ

SEQ ID NO: 113604 - protein, 14 aa, Mycobacterium tuberculosis
FFDAQAQMLSGLQG

SEQ ID NO: 113605 - protein, 14 aa, Mycobacterium tuberculosis
FDAQAQMLSGLQGL

SEQ ID NO: 113606 - protein, 14 aa, Mycobacterium tuberculosis
DAQAQMLSGLQGLI

SEQ ID NO: 113607 - protein, 14 aa, Mycobacterium tuberculosis
AQAQMLSGLQGLIE

SEQ ID NO: 113608 - protein, 14 aa, Mycobacterium tuberculosis
QAQMLSGLQGLIET

SEQ ID NO: 113609 - protein, 14 aa, Mycobacterium tuberculosis
AQMLSGLQGLIETV

SEQ ID NO: 113610 - protein, 14 aa, Mycobacterium tuberculosis
QMLSGLQGLIETVG

SEQ ID NO: 113611 - protein, 14 aa, Mycobacterium tuberculosis
MLSGLQGLIETVGQ

SEQ ID NO: 113612 - protein, 14 aa, Mycobacterium tuberculosis
LSGLQGLIETVGQH

SEQ ID NO: 113613 - protein, 14 aa, Mycobacterium tuberculosis
SGLQGLIETVGQHG

SEQ ID NO: 113614 - protein, 14 aa, Mycobacterium tuberculosis
GLQGLIETVGQHGT

SEQ ID NO: 113615 - protein, 14 aa, Mycobacterium tuberculosis
LQGLIETVGQHGTT

SEQ ID NO: 113616 - protein, 14 aa, Mycobacterium tuberculosis
QGLIETVGQHGTTT

SEQ ID NO: 113617 - protein, 14 aa, Mycobacterium tuberculosis
GLIETVGQHGTTTG

SEQ ID NO: 113618 - protein, 14 aa, Mycobacterium tuberculosis
LIETVGQHGTTTGH

SEQ ID NO: 113619 - protein, 14 aa, Mycobacterium tuberculosis
IETVGQHGTTTGHV

SEQ ID NO: 113620 - protein, 14 aa, Mycobacterium tuberculosis
ETVGQHGTTTGHVL

SEQ ID NO: 113621 - protein, 14 aa, Mycobacterium tuberculosis
TVGQHGTTTGHVLD

SEQ ID NO: 113622 - protein, 14 aa, Mycobacterium tuberculosis
VGQHGTTTGHVLDN

SEQ ID NO: 113623 - protein, 14 aa, Mycobacterium tuberculosis
GQHGTTTGHVLDNA

SEQ ID NO: 113624 - protein, 14 aa, Mycobacterium tuberculosis
QHGTTTGHVLDNAI

SEQ ID NO: 113625 - protein, 14 aa, Mycobacterium tuberculosis
HGTTTGHVLDNAIG

SEQ ID NO: 113626 - protein, 14 aa, Mycobacterium tuberculosis
GTTTGHVLDNAIGT

SEQ ID NO: 113627 - protein, 14 aa, Mycobacterium tuberculosis
TTTGHVLDNAIGTD

SEQ ID NO: 113628 - protein, 14 aa, Mycobacterium tuberculosis
TTGHVLDNAIGTDQ

SEQ ID NO: 113629 - protein, 14 aa, Mycobacterium tuberculosis
TGHVLDNAIGTDQA

SEQ ID NO: 113630 - protein, 14 aa, Mycobacterium tuberculosis
GHVLDNAIGTDQAI

SEQ ID NO: 113631 - protein, 14 aa, Mycobacterium tuberculosis
HVLDNAIGTDQAIA

SEQ ID NO: 113632 - protein, 14 aa, Mycobacterium tuberculosis
VLDNAIGTDQAIAG

SEQ ID NO: 113633 - protein, 14 aa, Mycobacterium tuberculosis
LDNAIGTDQAIAGL

SEQ ID NO: 113634 - protein, 14 aa, Mycobacterium tuberculosis
DNAIGTDQAIAGLF

SEQ ID NO: 113635 - protein, 15 aa, Mycobacterium tuberculosis
MSDQITYNPGAVSDF

SEQ ID NO: 113636 - protein, 15 aa, Mycobacterium tuberculosis
SDQITYNPGAVSDFA

SEQ ID NO: 113637 - protein, 15 aa, Mycobacterium tuberculosis
DQITYNPGAVSDFAS

SEQ ID NO: 113638 - protein, 15 aa, Mycobacterium tuberculosis
QITYNPGAVSDFASD

SEQ ID NO: 113639 - protein, 15 aa, Mycobacterium tuberculosis
ITYNPGAVSDFASDV

SEQ ID NO: 113640 - protein, 15 aa, Mycobacterium tuberculosis
TYNPGAVSDFASDVG

SEQ ID NO: 113641 - protein, 15 aa, Mycobacterium tuberculosis
YNPGAVSDFASDVGS

SEQ ID NO: 113642 - protein, 15 aa, Mycobacterium tuberculosis
NPGAVSDFASDVGSR

SEQ ID NO: 113643 - protein, 15 aa, Mycobacterium tuberculosis
PGAVSDFASDVGSRA

SEQ ID NO: 113644 - protein, 15 aa, Mycobacterium tuberculosis
GAVSDFASDVGSRAG

SEQ ID NO: 113645 - protein, 15 aa, Mycobacterium tuberculosis
AVSDFASDVGSRAGQ

SEQ ID NO: 113646 - protein, 15 aa, Mycobacterium tuberculosis
VSDFASDVGSRAGQL

SEQ ID NO: 113647 - protein, 15 aa, Mycobacterium tuberculosis
SDFASDVGSRAGQLH

SEQ ID NO: 113648 - protein, 15 aa, Mycobacterium tuberculosis
DFASDVGSRAGQLHM

SEQ ID NO: 113649 - protein, 15 aa, Mycobacterium tuberculosis
FASDVGSRAGQLHMI

SEQ ID NO: 113650 - protein, 15 aa, Mycobacterium tuberculosis
ASDVGSRAGQLHMIY

SEQ ID NO: 113651 - protein, 15 aa, Mycobacterium tuberculosis
SDVGSRAGQLHMIYE

SEQ ID NO: 113652 - protein, 15 aa, Mycobacterium tuberculosis
DVGSRAGQLHMIYED

SEQ ID NO: 113653 - protein, 15 aa, Mycobacterium tuberculosis
VGSRAGQLHMIYEDT

SEQ ID NO: 113654 - protein, 15 aa, Mycobacterium tuberculosis
GSRAGQLHMIYEDTA

SEQ ID NO: 113655 - protein, 15 aa, Mycobacterium tuberculosis
SRAGQLHMIYEDTAS

SEQ ID NO: 113656 - protein, 15 aa, Mycobacterium tuberculosis
RAGQLHMIYEDTASK

SEQ ID NO: 113657 - protein, 15 aa, Mycobacterium tuberculosis
AGQLHMIYEDTASKT

SEQ ID NO: 113658 - protein, 15 aa, Mycobacterium tuberculosis
GQLHMIYEDTASKTN

SEQ ID NO: 113659 - protein, 15 aa, Mycobacterium tuberculosis
QLHMIYEDTASKTNA

SEQ ID NO: 113660 - protein, 15 aa, Mycobacterium tuberculosis
LHMIYEDTASKTNAL

SEQ ID NO: 113661 - protein, 15 aa, Mycobacterium tuberculosis
HMIYEDTASKTNALQ

SEQ ID NO: 113662 - protein, 15 aa, Mycobacterium tuberculosis
MIYEDTASKTNALQE

SEQ ID NO: 113663 - protein, 15 aa, Mycobacterium tuberculosis
IYEDTASKTNALQEF

SEQ ID NO: 113664 - protein, 15 aa, Mycobacterium tuberculosis
YEDTASKTNALQEFF

SEQ ID NO: 113665 - protein, 15 aa, Mycobacterium tuberculosis
EDTASKTNALQEFFA

SEQ ID NO: 113666 - protein, 15 aa, Mycobacterium tuberculosis
DTASKTNALQEFFAG

SEQ ID NO: 113667 - protein, 15 aa, Mycobacterium tuberculosis
TASKTNALQEFFAGH

SEQ ID NO: 113668 - protein, 15 aa, Mycobacterium tuberculosis
ASKTNALQEFFAGHG

SEQ ID NO: 113669 - protein, 15 aa, Mycobacterium tuberculosis
SKTNALQEFFAGHGA

SEQ ID NO: 113670 - protein, 15 aa, Mycobacterium tuberculosis
KTNALQEFFAGHGAQ

SEQ ID NO: 113671 - protein, 15 aa, Mycobacterium tuberculosis
TNALQEFFAGHGAQG

SEQ ID NO: 113672 - protein, 15 aa, Mycobacterium tuberculosis
NALQEFFAGHGAQGF

SEQ ID NO: 113673 - protein, 15 aa, Mycobacterium tuberculosis
ALQEFFAGHGAQGFF

SEQ ID NO: 113674 - protein, 15 aa, Mycobacterium tuberculosis
LQEFFAGHGAQGFFD

SEQ ID NO: 113675 - protein, 15 aa, Mycobacterium tuberculosis
QEFFAGHGAQGFFDA

SEQ ID NO: 113676 - protein, 15 aa, Mycobacterium tuberculosis
EFFAGHGAQGFFDAQ

SEQ ID NO: 113677 - protein, 15 aa, Mycobacterium tuberculosis
FFAGHGAQGFFDAQA

SEQ ID NO: 113678 - protein, 15 aa, Mycobacterium tuberculosis
FAGHGAQGFFDAQAQ

SEQ ID NO: 113679 - protein, 15 aa, Mycobacterium tuberculosis
AGHGAQGFFDAQAQM

SEQ ID NO: 113680 - protein, 15 aa, Mycobacterium tuberculosis
GHGAQGFFDAQAQML

SEQ ID NO: 113681 - protein, 15 aa, Mycobacterium tuberculosis
HGAQGFFDAQAQMLS

SEQ ID NO: 113682 - protein, 15 aa, Mycobacterium tuberculosis
GAQGFFDAQAQMLSG

SEQ ID NO: 113683 - protein, 15 aa, Mycobacterium tuberculosis
AQGFFDAQAQMLSGL

SEQ ID NO: 113684 - protein, 15 aa, Mycobacterium tuberculosis
QGFFDAQAQMLSGLQ

SEQ ID NO: 113685 - protein, 15 aa, Mycobacterium tuberculosis
GFFDAQAQMLSGLQG

SEQ ID NO: 113686 - protein, 15 aa, Mycobacterium tuberculosis
FFDAQAQMLSGLQGL

SEQ ID NO: 113687 - protein, 15 aa, Mycobacterium tuberculosis
FDAQAQMLSGLQGLI

SEQ ID NO: 113688 - protein, 15 aa, Mycobacterium tuberculosis
DAQAQMLSGLQGLIE

SEQ ID NO: 113689 - protein, 15 aa, Mycobacterium tuberculosis
AQAQMLSGLQGLIET

SEQ ID NO: 113690 - protein, 15 aa, Mycobacterium tuberculosis
QAQMLSGLQGLIETV

SEQ ID NO: 113691 - protein, 15 aa, Mycobacterium tuberculosis
AQMLSGLQGLIETVG

SEQ ID NO: 113692 - protein, 15 aa, Mycobacterium tuberculosis
QMLSGLQGLIETVGQ

SEQ ID NO: 113693 - protein, 15 aa, Mycobacterium tuberculosis
MLSGLQGLIETVGQH

SEQ ID NO: 113694 - protein, 15 aa, Mycobacterium tuberculosis
LSGLQGLIETVGQHG

SEQ ID NO: 113695 - protein, 15 aa, Mycobacterium tuberculosis
SGLQGLIETVGQHGT

SEQ ID NO: 113696 - protein, 15 aa, Mycobacterium tuberculosis
GLQGLIETVGQHGTT

SEQ ID NO: 113697 - protein, 15 aa, Mycobacterium tuberculosis
LQGLIETVGQHGTTT

SEQ ID NO: 113698 - protein, 15 aa, Mycobacterium tuberculosis
QGLIETVGQHGTTTG

SEQ ID NO: 113699 - protein, 15 aa, Mycobacterium tuberculosis
GLIETVGQHGTTTGH

SEQ ID NO: 113700 - protein, 15 aa, Mycobacterium tuberculosis
LIETVGQHGTTTGHV

SEQ ID NO: 113701 - protein, 15 aa, Mycobacterium tuberculosis
IETVGQHGTTTGHVL

SEQ ID NO: 113702 - protein, 15 aa, Mycobacterium tuberculosis
ETVGQHGTTTGHVLD

SEQ ID NO: 113703 - protein, 15 aa, Mycobacterium tuberculosis
TVGQHGTTTGHVLDN

SEQ ID NO: 113704 - protein, 15 aa, Mycobacterium tuberculosis
VGQHGTTTGHVLDNA

SEQ ID NO: 113705 - protein, 15 aa, Mycobacterium tuberculosis
GQHGTTTGHVLDNAI

SEQ ID NO: 113706 - protein, 15 aa, Mycobacterium tuberculosis
QHGTTTGHVLDNAIG

SEQ ID NO: 113707 - protein, 15 aa, Mycobacterium tuberculosis
HGTTTGHVLDNAIGT

SEQ ID NO: 113708 - protein, 15 aa, Mycobacterium tuberculosis
GTTTGHVLDNAIGTD

SEQ ID NO: 113709 - protein, 15 aa, Mycobacterium tuberculosis
TTTGHVLDNAIGTDQ

SEQ ID NO: 113710 - protein, 15 aa, Mycobacterium tuberculosis
TTGHVLDNAIGTDQA

SEQ ID NO: 113711 - protein, 15 aa, Mycobacterium tuberculosis
TGHVLDNAIGTDQAI

SEQ ID NO: 113712 - protein, 15 aa, Mycobacterium tuberculosis
GHVLDNAIGTDQAIA

SEQ ID NO: 113713 - protein, 15 aa, Mycobacterium tuberculosis
HVLDNAIGTDQAIAG

SEQ ID NO: 113714 - protein, 15 aa, Mycobacterium tuberculosis
VLDNAIGTDQAIAGL

SEQ ID NO: 113715 - protein, 15 aa, Mycobacterium tuberculosis
LDNAIGTDQAIAGLF

SEQ ID NO: 113716 - protein, 16 aa, Mycobacterium tuberculosis
MSDQITYNPGAVSDFA

SEQ ID NO: 113717 - protein, 16 aa, Mycobacterium tuberculosis
SDQITYNPGAVSDFAS

SEQ ID NO: 113718 - protein, 16 aa, Mycobacterium tuberculosis
DQITYNPGAVSDFASD

SEQ ID NO: 113719 - protein, 16 aa, Mycobacterium tuberculosis
QITYNPGAVSDFASDV

SEQ ID NO: 113720 - protein, 16 aa, Mycobacterium tuberculosis
ITYNPGAVSDFASDVG

SEQ ID NO: 113721 - protein, 16 aa, Mycobacterium tuberculosis
TYNPGAVSDFASDVGS

SEQ ID NO: 113722 - protein, 16 aa, Mycobacterium tuberculosis
YNPGAVSDFASDVGSR

SEQ ID NO: 113723 - protein, 16 aa, Mycobacterium tuberculosis
NPGAVSDFASDVGSRA

SEQ ID NO: 113724 - protein, 16 aa, Mycobacterium tuberculosis
PGAVSDFASDVGSRAG

SEQ ID NO: 113725 - protein, 16 aa, Mycobacterium tuberculosis
GAVSDFASDVGSRAGQ

SEQ ID NO: 113726 - protein, 16 aa, Mycobacterium tuberculosis
AVSDFASDVGSRAGQL

SEQ ID NO: 113727 - protein, 16 aa, Mycobacterium tuberculosis
VSDFASDVGSRAGQLH

SEQ ID NO: 113728 - protein, 16 aa, Mycobacterium tuberculosis
SDFASDVGSRAGQLHM

SEQ ID NO: 113729 - protein, 16 aa, Mycobacterium tuberculosis
DFASDVGSRAGQLHMI

SEQ ID NO: 113730 - protein, 16 aa, Mycobacterium tuberculosis
FASDVGSRAGQLHMIY

SEQ ID NO: 113731 - protein, 16 aa, Mycobacterium tuberculosis
ASDVGSRAGQLHMIYE

SEQ ID NO: 113732 - protein, 16 aa, Mycobacterium tuberculosis
SDVGSRAGQLHMIYED

SEQ ID NO: 113733 - protein, 16 aa, Mycobacterium tuberculosis
DVGSRAGQLHMIYEDT

SEQ ID NO: 113734 - protein, 16 aa, Mycobacterium tuberculosis
VGSRAGQLHMIYEDTA

SEQ ID NO: 113735 - protein, 16 aa, Mycobacterium tuberculosis
GSRAGQLHMIYEDTAS

SEQ ID NO: 113736 - protein, 16 aa, Mycobacterium tuberculosis
SRAGQLHMIYEDTASK

SEQ ID NO: 113737 - protein, 16 aa, Mycobacterium tuberculosis
RAGQLHMIYEDTASKT

SEQ ID NO: 113738 - protein, 16 aa, Mycobacterium tuberculosis
AGQLHMIYEDTASKTN

SEQ ID NO: 113739 - protein, 16 aa, Mycobacterium tuberculosis
GQLHMIYEDTASKTNA

SEQ ID NO: 113740 - protein, 16 aa, Mycobacterium tuberculosis
QLHMIYEDTASKTNAL

SEQ ID NO: 113741 - protein, 16 aa, Mycobacterium tuberculosis
LHMIYEDTASKTNALQ

SEQ ID NO: 113742 - protein, 16 aa, Mycobacterium tuberculosis
HMIYEDTASKTNALQE

SEQ ID NO: 113743 - protein, 16 aa, Mycobacterium tuberculosis
MIYEDTASKTNALQEF

SEQ ID NO: 113744 - protein, 16 aa, Mycobacterium tuberculosis
IYEDTASKTNALQEFF

SEQ ID NO: 113745 - protein, 16 aa, Mycobacterium tuberculosis
YEDTASKTNALQEFFA

SEQ ID NO: 113746 - protein, 16 aa, Mycobacterium tuberculosis
EDTASKTNALQEFFAG

SEQ ID NO: 113747 - protein, 16 aa, Mycobacterium tuberculosis
DTASKTNALQEFFAGH

SEQ ID NO: 113748 - protein, 16 aa, Mycobacterium tuberculosis
TASKTNALQEFFAGHG

SEQ ID NO: 113749 - protein, 16 aa, Mycobacterium tuberculosis
ASKTNALQEFFAGHGA

SEQ ID NO: 113750 - protein, 16 aa, Mycobacterium tuberculosis
SKTNALQEFFAGHGAQ

SEQ ID NO: 113751 - protein, 16 aa, Mycobacterium tuberculosis
KTNALQEFFAGHGAQG

SEQ ID NO: 113752 - protein, 16 aa, Mycobacterium tuberculosis
TNALQEFFAGHGAQGF

SEQ ID NO: 113753 - protein, 16 aa, Mycobacterium tuberculosis
NALQEFFAGHGAQGFF

SEQ ID NO: 113754 - protein, 16 aa, Mycobacterium tuberculosis
ALQEFFAGHGAQGFFD

SEQ ID NO: 113755 - protein, 16 aa, Mycobacterium tuberculosis
LQEFFAGHGAQGFFDA

SEQ ID NO: 113756 - protein, 16 aa, Mycobacterium tuberculosis
QEFFAGHGAQGFFDAQ

SEQ ID NO: 113757 - protein, 16 aa, Mycobacterium tuberculosis
EFFAGHGAQGFFDAQA

SEQ ID NO: 113758 - protein, 16 aa, Mycobacterium tuberculosis
FFAGHGAQGFFDAQAQ

SEQ ID NO: 113759 - protein, 16 aa, Mycobacterium tuberculosis
FAGHGAQGFFDAQAQM

SEQ ID NO: 113760 - protein, 16 aa, Mycobacterium tuberculosis
AGHGAQGFFDAQAQML

SEQ ID NO: 113761 - protein, 16 aa, Mycobacterium tuberculosis
GHGAQGFFDAQAQMLS

SEQ ID NO: 113762 - protein, 16 aa, Mycobacterium tuberculosis
HGAQGFFDAQAQMLSG

SEQ ID NO: 113763 - protein, 16 aa, Mycobacterium tuberculosis
GAQGFFDAQAQMLSGL

SEQ ID NO: 113764 - protein, 16 aa, Mycobacterium tuberculosis
AQGFFDAQAQMLSGLQ

SEQ ID NO: 113765 - protein, 16 aa, Mycobacterium tuberculosis
QGFFDAQAQMLSGLQG

SEQ ID NO: 113766 - protein, 16 aa, Mycobacterium tuberculosis
GFFDAQAQMLSGLQGL

SEQ ID NO: 113767 - protein, 16 aa, Mycobacterium tuberculosis
FFDAQAQMLSGLQGLI

SEQ ID NO: 113768 - protein, 16 aa, Mycobacterium tuberculosis
FDAQAQMLSGLQGLIE

SEQ ID NO: 113769 - protein, 16 aa, Mycobacterium tuberculosis
DAQAQMLSGLQGLIET

SEQ ID NO: 113770 - protein, 16 aa, Mycobacterium tuberculosis
AQAQMLSGLQGLIETV

SEQ ID NO: 113771 - protein, 16 aa, Mycobacterium tuberculosis
QAQMLSGLQGLIETVG

SEQ ID NO: 113772 - protein, 16 aa, Mycobacterium tuberculosis
AQMLSGLQGLIETVGQ

SEQ ID NO: 113773 - protein, 16 aa, Mycobacterium tuberculosis
QMLSGLQGLIETVGQH

SEQ ID NO: 113774 - protein, 16 aa, Mycobacterium tuberculosis
MLSGLQGLIETVGQHG

SEQ ID NO: 113775 - protein, 16 aa, Mycobacterium tuberculosis
LSGLQGLIETVGQHGT

SEQ ID NO: 113776 - protein, 16 aa, Mycobacterium tuberculosis
SGLQGLIETVGQHGTT

SEQ ID NO: 113777 - protein, 16 aa, Mycobacterium tuberculosis
GLQGLIETVGQHGTTT

SEQ ID NO: 113778 - protein, 16 aa, Mycobacterium tuberculosis
LQGLIETVGQHGTTTG

SEQ ID NO: 113779 - protein, 16 aa, Mycobacterium tuberculosis
QGLIETVGQHGTTTGH

SEQ ID NO: 113780 - protein, 16 aa, Mycobacterium tuberculosis
GLIETVGQHGTTTGHV

SEQ ID NO: 113781 - protein, 16 aa, Mycobacterium tuberculosis
LIETVGQHGTTTGHVL

SEQ ID NO: 113782 - protein, 16 aa, Mycobacterium tuberculosis
IETVGQHGTTTGHVLD

SEQ ID NO: 113783 - protein, 16 aa, Mycobacterium tuberculosis
ETVGQHGTTTGHVLDN

SEQ ID NO: 113784 - protein, 16 aa, Mycobacterium tuberculosis
TVGQHGTTTGHVLDNA

SEQ ID NO: 113785 - protein, 16 aa, Mycobacterium tuberculosis
VGQHGTTTGHVLDNAI

SEQ ID NO: 113786 - protein, 16 aa, Mycobacterium tuberculosis
GQHGTTTGHVLDNAIG

SEQ ID NO: 113787 - protein, 16 aa, Mycobacterium tuberculosis
QHGTTTGHVLDNAIGT

SEQ ID NO: 113788 - protein, 16 aa, Mycobacterium tuberculosis
HGTTTGHVLDNAIGTD

SEQ ID NO: 113789 - protein, 16 aa, Mycobacterium tuberculosis
GTTTGHVLDNAIGTDQ

SEQ ID NO: 113790 - protein, 16 aa, Mycobacterium tuberculosis
TTTGHVLDNAIGTDQA

SEQ ID NO: 113791 - protein, 16 aa, Mycobacterium tuberculosis
TTGHVLDNAIGTDQAI

SEQ ID NO: 113792 - protein, 16 aa, Mycobacterium tuberculosis
TGHVLDNAIGTDQAIA

SEQ ID NO: 113793 - protein, 16 aa, Mycobacterium tuberculosis
GHVLDNAIGTDQAIAG

SEQ ID NO: 113794 - protein, 16 aa, Mycobacterium tuberculosis
HVLDNAIGTDQAIAGL

SEQ ID NO: 113795 - protein, 16 aa, Mycobacterium tuberculosis
VLDNAIGTDQAIAGLF

SEQ ID NO: 113796 - protein, 13 aa, Mycobacterium tuberculosis
MADTIQVTPQMLR

SEQ ID NO: 113797 - protein, 13 aa, Mycobacterium tuberculosis
ADTIQVTPQMLRS

SEQ ID NO: 113798 - protein, 13 aa, Mycobacterium tuberculosis
DTIQVTPQMLRST

SEQ ID NO: 113799 - protein, 13 aa, Mycobacterium tuberculosis
TIQVTPQMLRSTA

SEQ ID NO: 113800 - protein, 13 aa, Mycobacterium tuberculosis
IQVTPQMLRSTAN

SEQ ID NO: 113801 - protein, 13 aa, Mycobacterium tuberculosis
QVTPQMLRSTAND

SEQ ID NO: 113802 - protein, 13 aa, Mycobacterium tuberculosis
VTPQMLRSTANDI

SEQ ID NO: 113803 - protein, 13 aa, Mycobacterium tuberculosis
TPQMLRSTANDIQ

SEQ ID NO: 113804 - protein, 13 aa, Mycobacterium tuberculosis
PQMLRSTANDIQA

SEQ ID NO: 113805 - protein, 13 aa, Mycobacterium tuberculosis
QMLRSTANDIQAN

SEQ ID NO: 113806 - protein, 13 aa, Mycobacterium tuberculosis
MLRSTANDIQANM

SEQ ID NO: 113807 - protein, 13 aa, Mycobacterium tuberculosis
LRSTANDIQANME

SEQ ID NO: 113808 - protein, 13 aa, Mycobacterium tuberculosis
RSTANDIQANMEQ

SEQ ID NO: 113809 - protein, 13 aa, Mycobacterium tuberculosis
STANDIQANMEQA

SEQ ID NO: 113810 - protein, 13 aa, Mycobacterium tuberculosis
TANDIQANMEQAM

SEQ ID NO: 113811 - protein, 13 aa, Mycobacterium tuberculosis
ANDIQANMEQAMG

SEQ ID NO: 113812 - protein, 13 aa, Mycobacterium tuberculosis
NDIQANMEQAMGI

SEQ ID NO: 113813 - protein, 13 aa, Mycobacterium tuberculosis
DIQANMEQAMGIA

SEQ ID NO: 113814 - protein, 13 aa, Mycobacterium tuberculosis
IQANMEQAMGIAK

SEQ ID NO: 113815 - protein, 13 aa, Mycobacterium tuberculosis
QANMEQAMGIAKG

SEQ ID NO: 113816 - protein, 13 aa, Mycobacterium tuberculosis
ANMEQAMGIAKGY

SEQ ID NO: 113817 - protein, 13 aa, Mycobacterium tuberculosis
NMEQAMGIAKGYL

SEQ ID NO: 113818 - protein, 13 aa, Mycobacterium tuberculosis
MEQAMGIAKGYLA

SEQ ID NO: 113819 - protein, 13 aa, Mycobacterium tuberculosis
EQAMGIAKGYLAN

SEQ ID NO: 113820 - protein, 13 aa, Mycobacterium tuberculosis
QAMGIAKGYLANQ

SEQ ID NO: 113821 - protein, 13 aa, Mycobacterium tuberculosis
AMGIAKGYLANQE

SEQ ID NO: 113822 - protein, 13 aa, Mycobacterium tuberculosis
MGIAKGYLANQEN

SEQ ID NO: 113823 - protein, 13 aa, Mycobacterium tuberculosis
GIAKGYLANQENV

SEQ ID NO: 113824 - protein, 13 aa, Mycobacterium tuberculosis
IAKGYLANQENVM

SEQ ID NO: 113825 - protein, 13 aa, Mycobacterium tuberculosis
AKGYLANQENVMN

SEQ ID NO: 113826 - protein, 13 aa, Mycobacterium tuberculosis
KGYLANQENVMNP

SEQ ID NO: 113827 - protein, 13 aa, Mycobacterium tuberculosis
GYLANQENVMNPA

SEQ ID NO: 113828 - protein, 13 aa, Mycobacterium tuberculosis
YLANQENVMNPAT

SEQ ID NO: 113829 - protein, 13 aa, Mycobacterium tuberculosis
LANQENVMNPATW

SEQ ID NO: 113830 - protein, 13 aa, Mycobacterium tuberculosis
ANQENVMNPATWS

SEQ ID NO: 113831 - protein, 13 aa, Mycobacterium tuberculosis
NQENVMNPATWSG

SEQ ID NO: 113832 - protein, 13 aa, Mycobacterium tuberculosis
QENVMNPATWSGT

SEQ ID NO: 113833 - protein, 13 aa, Mycobacterium tuberculosis
ENVMNPATWSGTG

SEQ ID NO: 113834 - protein, 13 aa, Mycobacterium tuberculosis
NVMNPATWSGTGV

SEQ ID NO: 113835 - protein, 13 aa, Mycobacterium tuberculosis
VMNPATWSGTGVV

SEQ ID NO: 113836 - protein, 13 aa, Mycobacterium tuberculosis
MNPATWSGTGVVA

SEQ ID NO: 113837 - protein, 13 aa, Mycobacterium tuberculosis
NPATWSGTGVVAS

SEQ ID NO: 113838 - protein, 13 aa, Mycobacterium tuberculosis
PATWSGTGVVASH

SEQ ID NO: 113839 - protein, 13 aa, Mycobacterium tuberculosis
ATWSGTGVVASHM

SEQ ID NO: 113840 - protein, 13 aa, Mycobacterium tuberculosis
TWSGTGVVASHMT

SEQ ID NO: 113841 - protein, 13 aa, Mycobacterium tuberculosis
WSGTGVVASHMTA

SEQ ID NO: 113842 - protein, 13 aa, Mycobacterium tuberculosis
SGTGVVASHMTAT

SEQ ID NO: 113843 - protein, 13 aa, Mycobacterium tuberculosis
GTGVVASHMTATE

SEQ ID NO: 113844 - protein, 13 aa, Mycobacterium tuberculosis
TGVVASHMTATEI

SEQ ID NO: 113845 - protein, 13 aa, Mycobacterium tuberculosis
GVVASHMTATEIT

SEQ ID NO: 113846 - protein, 13 aa, Mycobacterium tuberculosis
VVASHMTATEITN

SEQ ID NO: 113847 - protein, 13 aa, Mycobacterium tuberculosis
VASHMTATEITNE

SEQ ID NO: 113848 - protein, 13 aa, Mycobacterium tuberculosis
ASHMTATEITNEL

SEQ ID NO: 113849 - protein, 13 aa, Mycobacterium tuberculosis
SHMTATEITNELN

SEQ ID NO: 113850 - protein, 13 aa, Mycobacterium tuberculosis
HMTATEITNELNK

SEQ ID NO: 113851 - protein, 13 aa, Mycobacterium tuberculosis
MTATEITNELNKV

SEQ ID NO: 113852 - protein, 13 aa, Mycobacterium tuberculosis
TATEITNELNKVL

SEQ ID NO: 113853 - protein, 13 aa, Mycobacterium tuberculosis
ATEITNELNKVLT

SEQ ID NO: 113854 - protein, 13 aa, Mycobacterium tuberculosis
TEITNELNKVLTG

SEQ ID NO: 113855 - protein, 13 aa, Mycobacterium tuberculosis
EITNELNKVLTGG

SEQ ID NO: 113856 - protein, 13 aa, Mycobacterium tuberculosis
ITNELNKVLTGGT

SEQ ID NO: 113857 - protein, 13 aa, Mycobacterium tuberculosis
TNELNKVLTGGTR

SEQ ID NO: 113858 - protein, 13 aa, Mycobacterium tuberculosis
NELNKVLTGGTRL

SEQ ID NO: 113859 - protein, 13 aa, Mycobacterium tuberculosis
ELNKVLTGGTRLA

SEQ ID NO: 113860 - protein, 13 aa, Mycobacterium tuberculosis
LNKVLTGGTRLAE

SEQ ID NO: 113861 - protein, 13 aa, Mycobacterium tuberculosis
NKVLTGGTRLAEG

SEQ ID NO: 113862 - protein, 13 aa, Mycobacterium tuberculosis
KVLTGGTRLAEGL

SEQ ID NO: 113863 - protein, 13 aa, Mycobacterium tuberculosis
VLTGGTRLAEGLV

SEQ ID NO: 113864 - protein, 13 aa, Mycobacterium tuberculosis
LTGGTRLAEGLVQ

SEQ ID NO: 113865 - protein, 13 aa, Mycobacterium tuberculosis
TGGTRLAEGLVQA

SEQ ID NO: 113866 - protein, 13 aa, Mycobacterium tuberculosis
GGTRLAEGLVQAA

SEQ ID NO: 113867 - protein, 13 aa, Mycobacterium tuberculosis
GTRLAEGLVQAAA

SEQ ID NO: 113868 - protein, 13 aa, Mycobacterium tuberculosis
TRLAEGLVQAAAL

SEQ ID NO: 113869 - protein, 13 aa, Mycobacterium tuberculosis
RLAEGLVQAAALM

SEQ ID NO: 113870 - protein, 13 aa, Mycobacterium tuberculosis
LAEGLVQAAALME

SEQ ID NO: 113871 - protein, 13 aa, Mycobacterium tuberculosis
AEGLVQAAALMEG

SEQ ID NO: 113872 - protein, 13 aa, Mycobacterium tuberculosis
EGLVQAAALMEGH

SEQ ID NO: 113873 - protein, 13 aa, Mycobacterium tuberculosis
GLVQAAALMEGHE

SEQ ID NO: 113874 - protein, 13 aa, Mycobacterium tuberculosis
LVQAAALMEGHEA

SEQ ID NO: 113875 - protein, 13 aa, Mycobacterium tuberculosis
VQAAALMEGHEAD

SEQ ID NO: 113876 - protein, 13 aa, Mycobacterium tuberculosis
QAAALMEGHEADS

SEQ ID NO: 113877 - protein, 13 aa, Mycobacterium tuberculosis
AAALMEGHEADSQ

SEQ ID NO: 113878 - protein, 13 aa, Mycobacterium tuberculosis
AALMEGHEADSQT

SEQ ID NO: 113879 - protein, 13 aa, Mycobacterium tuberculosis
ALMEGHEADSQTA

SEQ ID NO: 113880 - protein, 13 aa, Mycobacterium tuberculosis
LMEGHEADSQTAF

SEQ ID NO: 113881 - protein, 13 aa, Mycobacterium tuberculosis
MEGHEADSQTAFQ

SEQ ID NO: 113882 - protein, 13 aa, Mycobacterium tuberculosis
EGHEADSQTAFQA

SEQ ID NO: 113883 - protein, 13 aa, Mycobacterium tuberculosis
GHEADSQTAFQAL

SEQ ID NO: 113884 - protein, 13 aa, Mycobacterium tuberculosis
HEADSQTAFQALF

SEQ ID NO: 113885 - protein, 13 aa, Mycobacterium tuberculosis
EADSQTAFQALFG

SEQ ID NO: 113886 - protein, 13 aa, Mycobacterium tuberculosis
ADSQTAFQALFGA

SEQ ID NO: 113887 - protein, 13 aa, Mycobacterium tuberculosis
DSQTAFQALFGAS

SEQ ID NO: 113888 - protein, 13 aa, Mycobacterium tuberculosis
SQTAFQALFGASH

SEQ ID NO: 113889 - protein, 13 aa, Mycobacterium tuberculosis
QTAFQALFGASHG

SEQ ID NO: 113890 - protein, 13 aa, Mycobacterium tuberculosis
TAFQALFGASHGS

SEQ ID NO: 113891 - protein, 14 aa, Mycobacterium tuberculosis
MADTIQVTPQMLRS

SEQ ID NO: 113892 - protein, 14 aa, Mycobacterium tuberculosis
ADTIQVTPQMLRST

SEQ ID NO: 113893 - protein, 14 aa, Mycobacterium tuberculosis
DTIQVTPQMLRSTA

SEQ ID NO: 113894 - protein, 14 aa, Mycobacterium tuberculosis
TIQVTPQMLRSTAN

SEQ ID NO: 113895 - protein, 14 aa, Mycobacterium tuberculosis
IQVTPQMLRSTAND

SEQ ID NO: 113896 - protein, 14 aa, Mycobacterium tuberculosis
QVTPQMLRSTANDI

SEQ ID NO: 113897 - protein, 14 aa, Mycobacterium tuberculosis
VTPQMLRSTANDIQ

SEQ ID NO: 113898 - protein, 14 aa, Mycobacterium tuberculosis
TPQMLRSTANDIQA

SEQ ID NO: 113899 - protein, 14 aa, Mycobacterium tuberculosis
PQMLRSTANDIQAN

SEQ ID NO: 113900 - protein, 14 aa, Mycobacterium tuberculosis
QMLRSTANDIQANM

SEQ ID NO: 113901 - protein, 14 aa, Mycobacterium tuberculosis
MLRSTANDIQANME

SEQ ID NO: 113902 - protein, 14 aa, Mycobacterium tuberculosis
LRSTANDIQANMEQ

SEQ ID NO: 113903 - protein, 14 aa, Mycobacterium tuberculosis
RSTANDIQANMEQA

SEQ ID NO: 113904 - protein, 14 aa, Mycobacterium tuberculosis
STANDIQANMEQAM

SEQ ID NO: 113905 - protein, 14 aa, Mycobacterium tuberculosis
TANDIQANMEQAMG

SEQ ID NO: 113906 - protein, 14 aa, Mycobacterium tuberculosis
ANDIQANMEQAMGI

SEQ ID NO: 113907 - protein, 14 aa, Mycobacterium tuberculosis
NDIQANMEQAMGIA

SEQ ID NO: 113908 - protein, 14 aa, Mycobacterium tuberculosis
DIQANMEQAMGIAK

SEQ ID NO: 113909 - protein, 14 aa, Mycobacterium tuberculosis
IQANMEQAMGIAKG

SEQ ID NO: 113910 - protein, 14 aa, Mycobacterium tuberculosis
QANMEQAMGIAKGY

SEQ ID NO: 113911 - protein, 14 aa, Mycobacterium tuberculosis
ANMEQAMGIAKGYL

SEQ ID NO: 113912 - protein, 14 aa, Mycobacterium tuberculosis
NMEQAMGIAKGYLA

SEQ ID NO: 113913 - protein, 14 aa, Mycobacterium tuberculosis
MEQAMGIAKGYLAN

SEQ ID NO: 113914 - protein, 14 aa, Mycobacterium tuberculosis
EQAMGIAKGYLANQ

SEQ ID NO: 113915 - protein, 14 aa, Mycobacterium tuberculosis
QAMGIAKGYLANQE

SEQ ID NO: 113916 - protein, 14 aa, Mycobacterium tuberculosis
AMGIAKGYLANQEN

SEQ ID NO: 113917 - protein, 14 aa, Mycobacterium tuberculosis
MGIAKGYLANQENV

SEQ ID NO: 113918 - protein, 14 aa, Mycobacterium tuberculosis
GIAKGYLANQENVM

SEQ ID NO: 113919 - protein, 14 aa, Mycobacterium tuberculosis
IAKGYLANQENVMN

SEQ ID NO: 113920 - protein, 14 aa, Mycobacterium tuberculosis
AKGYLANQENVMNP

SEQ ID NO: 113921 - protein, 14 aa, Mycobacterium tuberculosis
KGYLANQENVMNPA

SEQ ID NO: 113922 - protein, 14 aa, Mycobacterium tuberculosis
GYLANQENVMNPAT

SEQ ID NO: 113923 - protein, 14 aa, Mycobacterium tuberculosis
YLANQENVMNPATW

SEQ ID NO: 113924 - protein, 14 aa, Mycobacterium tuberculosis
LANQENVMNPATWS

SEQ ID NO: 113925 - protein, 14 aa, Mycobacterium tuberculosis
ANQENVMNPATWSG

SEQ ID NO: 113926 - protein, 14 aa, Mycobacterium tuberculosis
NQENVMNPATWSGT

SEQ ID NO: 113927 - protein, 14 aa, Mycobacterium tuberculosis
QENVMNPATWSGTG

SEQ ID NO: 113928 - protein, 14 aa, Mycobacterium tuberculosis
ENVMNPATWSGTGV

SEQ ID NO: 113929 - protein, 14 aa, Mycobacterium tuberculosis
NVMNPATWSGTGVV

SEQ ID NO: 113930 - protein, 14 aa, Mycobacterium tuberculosis
VMNPATWSGTGVVA

SEQ ID NO: 113931 - protein, 14 aa, Mycobacterium tuberculosis
MNPATWSGTGVVAS

SEQ ID NO: 113932 - protein, 14 aa, Mycobacterium tuberculosis
NPATWSGTGVVASH

SEQ ID NO: 113933 - protein, 14 aa, Mycobacterium tuberculosis
PATWSGTGVVASHM

SEQ ID NO: 113934 - protein, 14 aa, Mycobacterium tuberculosis
ATWSGTGVVASHMT

SEQ ID NO: 113935 - protein, 14 aa, Mycobacterium tuberculosis
TWSGTGVVASHMTA

SEQ ID NO: 113936 - protein, 14 aa, Mycobacterium tuberculosis
WSGTGVVASHMTAT

SEQ ID NO: 113937 - protein, 14 aa, Mycobacterium tuberculosis
SGTGVVASHMTATE

SEQ ID NO: 113938 - protein, 14 aa, Mycobacterium tuberculosis
GTGVVASHMTATEI

SEQ ID NO: 113939 - protein, 14 aa, Mycobacterium tuberculosis
TGVVASHMTATEIT

SEQ ID NO: 113940 - protein, 14 aa, Mycobacterium tuberculosis
GVVASHMTATEITN

SEQ ID NO: 113941 - protein, 14 aa, Mycobacterium tuberculosis
VVASHMTATEITNE

SEQ ID NO: 113942 - protein, 14 aa, Mycobacterium tuberculosis
VASHMTATEITNEL

SEQ ID NO: 113943 - protein, 14 aa, Mycobacterium tuberculosis
ASHMTATEITNELN

SEQ ID NO: 113944 - protein, 14 aa, Mycobacterium tuberculosis
SHMTATEITNELNK

SEQ ID NO: 113945 - protein, 14 aa, Mycobacterium tuberculosis
HMTATEITNELNKV

SEQ ID NO: 113946 - protein, 14 aa, Mycobacterium tuberculosis
MTATEITNELNKVL

SEQ ID NO: 113947 - protein, 14 aa, Mycobacterium tuberculosis
TATEITNELNKVLT

SEQ ID NO: 113948 - protein, 14 aa, Mycobacterium tuberculosis
ATEITNELNKVLTG

SEQ ID NO: 113949 - protein, 14 aa, Mycobacterium tuberculosis
TEITNELNKVLTGG

SEQ ID NO: 113950 - protein, 14 aa, Mycobacterium tuberculosis
EITNELNKVLTGGT

SEQ ID NO: 113951 - protein, 14 aa, Mycobacterium tuberculosis
ITNELNKVLTGGTR

SEQ ID NO: 113952 - protein, 14 aa, Mycobacterium tuberculosis
TNELNKVLTGGTRL

SEQ ID NO: 113953 - protein, 14 aa, Mycobacterium tuberculosis
NELNKVLTGGTRLA

SEQ ID NO: 113954 - protein, 14 aa, Mycobacterium tuberculosis
ELNKVLTGGTRLAE

SEQ ID NO: 113955 - protein, 14 aa, Mycobacterium tuberculosis
LNKVLTGGTRLAEG

SEQ ID NO: 113956 - protein, 14 aa, Mycobacterium tuberculosis
NKVLTGGTRLAEGL

SEQ ID NO: 113957 - protein, 14 aa, Mycobacterium tuberculosis
KVLTGGTRLAEGLV

SEQ ID NO: 113958 - protein, 14 aa, Mycobacterium tuberculosis
VLTGGTRLAEGLVQ

SEQ ID NO: 113959 - protein, 14 aa, Mycobacterium tuberculosis
LTGGTRLAEGLVQA

SEQ ID NO: 113960 - protein, 14 aa, Mycobacterium tuberculosis
TGGTRLAEGLVQAA

SEQ ID NO: 113961 - protein, 14 aa, Mycobacterium tuberculosis
GGTRLAEGLVQAAA

SEQ ID NO: 113962 - protein, 14 aa, Mycobacterium tuberculosis
GTRLAEGLVQAAAL

SEQ ID NO: 113963 - protein, 14 aa, Mycobacterium tuberculosis
TRLAEGLVQAAALM

SEQ ID NO: 113964 - protein, 14 aa, Mycobacterium tuberculosis
RLAEGLVQAAALME

SEQ ID NO: 113965 - protein, 14 aa, Mycobacterium tuberculosis
LAEGLVQAAALMEG

SEQ ID NO: 113966 - protein, 14 aa, Mycobacterium tuberculosis
AEGLVQAAALMEGH

SEQ ID NO: 113967 - protein, 14 aa, Mycobacterium tuberculosis
EGLVQAAALMEGHE

SEQ ID NO: 113968 - protein, 14 aa, Mycobacterium tuberculosis
GLVQAAALMEGHEA

SEQ ID NO: 113969 - protein, 14 aa, Mycobacterium tuberculosis
LVQAAALMEGHEAD

SEQ ID NO: 113970 - protein, 14 aa, Mycobacterium tuberculosis
VQAAALMEGHEADS

SEQ ID NO: 113971 - protein, 14 aa, Mycobacterium tuberculosis
QAAALMEGHEADSQ

SEQ ID NO: 113972 - protein, 14 aa, Mycobacterium tuberculosis
AAALMEGHEADSQT

SEQ ID NO: 113973 - protein, 14 aa, Mycobacterium tuberculosis
AALMEGHEADSQTA

SEQ ID NO: 113974 - protein, 14 aa, Mycobacterium tuberculosis
ALMEGHEADSQTAF

SEQ ID NO: 113975 - protein, 14 aa, Mycobacterium tuberculosis
LMEGHEADSQTAFQ

SEQ ID NO: 113976 - protein, 14 aa, Mycobacterium tuberculosis
MEGHEADSQTAFQA

SEQ ID NO: 113977 - protein, 14 aa, Mycobacterium tuberculosis
EGHEADSQTAFQAL

SEQ ID NO: 113978 - protein, 14 aa, Mycobacterium tuberculosis
GHEADSQTAFQALF

SEQ ID NO: 113979 - protein, 14 aa, Mycobacterium tuberculosis
HEADSQTAFQALFG

SEQ ID NO: 113980 - protein, 14 aa, Mycobacterium tuberculosis
EADSQTAFQALFGA

SEQ ID NO: 113981 - protein, 14 aa, Mycobacterium tuberculosis
ADSQTAFQALFGAS

SEQ ID NO: 113982 - protein, 14 aa, Mycobacterium tuberculosis
DSQTAFQALFGASH

SEQ ID NO: 113983 - protein, 14 aa, Mycobacterium tuberculosis
SQTAFQALFGASHG

SEQ ID NO: 113984 - protein, 14 aa, Mycobacterium tuberculosis
QTAFQALFGASHGS

SEQ ID NO: 113985 - protein, 15 aa, Mycobacterium tuberculosis
MADTIQVTPQMLRST

SEQ ID NO: 113986 - protein, 15 aa, Mycobacterium tuberculosis
ADTIQVTPQMLRSTA

SEQ ID NO: 113987 - protein, 15 aa, Mycobacterium tuberculosis
DTIQVTPQMLRSTAN

SEQ ID NO: 113988 - protein, 15 aa, Mycobacterium tuberculosis
TIQVTPQMLRSTAND

SEQ ID NO: 113989 - protein, 15 aa, Mycobacterium tuberculosis
IQVTPQMLRSTANDI

SEQ ID NO: 113990 - protein, 15 aa, Mycobacterium tuberculosis
QVTPQMLRSTANDIQ

SEQ ID NO: 113991 - protein, 15 aa, Mycobacterium tuberculosis
VTPQMLRSTANDIQA

SEQ ID NO: 113992 - protein, 15 aa, Mycobacterium tuberculosis
TPQMLRSTANDIQAN

SEQ ID NO: 113993 - protein, 15 aa, Mycobacterium tuberculosis
PQMLRSTANDIQANM

SEQ ID NO: 113994 - protein, 15 aa, Mycobacterium tuberculosis
QMLRSTANDIQANME

SEQ ID NO: 113995 - protein, 15 aa, Mycobacterium tuberculosis
MLRSTANDIQANMEQ

SEQ ID NO: 113996 - protein, 15 aa, Mycobacterium tuberculosis
LRSTANDIQANMEQA

SEQ ID NO: 113997 - protein, 15 aa, Mycobacterium tuberculosis
RSTANDIQANMEQAM

SEQ ID NO: 113998 - protein, 15 aa, Mycobacterium tuberculosis
STANDIQANMEQAMG

SEQ ID NO: 113999 - protein, 15 aa, Mycobacterium tuberculosis
TANDIQANMEQAMGI

SEQ ID NO: 114000 - protein, 15 aa, Mycobacterium tuberculosis
ANDIQANMEQAMGIA

SEQ ID NO: 114001 - protein, 15 aa, Mycobacterium tuberculosis
NDIQANMEQAMGIAK

SEQ ID NO: 114002 - protein, 15 aa, Mycobacterium tuberculosis
DIQANMEQAMGIAKG

SEQ ID NO: 114003 - protein, 15 aa, Mycobacterium tuberculosis
IQANMEQAMGIAKGY

SEQ ID NO: 114004 - protein, 15 aa, Mycobacterium tuberculosis
QANMEQAMGIAKGYL

SEQ ID NO: 114005 - protein, 15 aa, Mycobacterium tuberculosis
ANMEQAMGIAKGYLA

SEQ ID NO: 114006 - protein, 15 aa, Mycobacterium tuberculosis
NMEQAMGIAKGYLAN

SEQ ID NO: 114007 - protein, 15 aa, Mycobacterium tuberculosis
MEQAMGIAKGYLANQ

SEQ ID NO: 114008 - protein, 15 aa, Mycobacterium tuberculosis
EQAMGIAKGYLANQE

SEQ ID NO: 114009 - protein, 15 aa, Mycobacterium tuberculosis
QAMGIAKGYLANQEN

SEQ ID NO: 114010 - protein, 15 aa, Mycobacterium tuberculosis
AMGIAKGYLANQENV

SEQ ID NO: 114011 - protein, 15 aa, Mycobacterium tuberculosis
MGIAKGYLANQENVM

SEQ ID NO: 114012 - protein, 15 aa, Mycobacterium tuberculosis
GIAKGYLANQENVMN

SEQ ID NO: 114013 - protein, 15 aa, Mycobacterium tuberculosis
IAKGYLANQENVMNP

SEQ ID NO: 114014 - protein, 15 aa, Mycobacterium tuberculosis
AKGYLANQENVMNPA

SEQ ID NO: 114015 - protein, 15 aa, Mycobacterium tuberculosis
KGYLANQENVMNPAT

SEQ ID NO: 114016 - protein, 15 aa, Mycobacterium tuberculosis
GYLANQENVMNPATW

SEQ ID NO: 114017 - protein, 15 aa, Mycobacterium tuberculosis
YLANQENVMNPATWS

SEQ ID NO: 114018 - protein, 15 aa, Mycobacterium tuberculosis
LANQENVMNPATWSG

SEQ ID NO: 114019 - protein, 15 aa, Mycobacterium tuberculosis
ANQENVMNPATWSGT

SEQ ID NO: 114020 - protein, 15 aa, Mycobacterium tuberculosis
NQENVMNPATWSGTG

SEQ ID NO: 114021 - protein, 15 aa, Mycobacterium tuberculosis
QENVMNPATWSGTGV

SEQ ID NO: 114022 - protein, 15 aa, Mycobacterium tuberculosis
ENVMNPATWSGTGVV

SEQ ID NO: 114023 - protein, 15 aa, Mycobacterium tuberculosis
NVMNPATWSGTGVVA

SEQ ID NO: 114024 - protein, 15 aa, Mycobacterium tuberculosis
VMNPATWSGTGVVAS

SEQ ID NO: 114025 - protein, 15 aa, Mycobacterium tuberculosis
MNPATWSGTGVVASH

SEQ ID NO: 114026 - protein, 15 aa, Mycobacterium tuberculosis
NPATWSGTGVVASHM

SEQ ID NO: 114027 - protein, 15 aa, Mycobacterium tuberculosis
PATWSGTGVVASHMT

SEQ ID NO: 114028 - protein, 15 aa, Mycobacterium tuberculosis
ATWSGTGVVASHMTA

SEQ ID NO: 114029 - protein, 15 aa, Mycobacterium tuberculosis
TWSGTGVVASHMTAT

SEQ ID NO: 114030 - protein, 15 aa, Mycobacterium tuberculosis
WSGTGVVASHMTATE

SEQ ID NO: 114031 - protein, 15 aa, Mycobacterium tuberculosis
SGTGVVASHMTATEI

SEQ ID NO: 114032 - protein, 15 aa, Mycobacterium tuberculosis
GTGVVASHMTATEIT

SEQ ID NO: 114033 - protein, 15 aa, Mycobacterium tuberculosis
TGVVASHMTATEITN

SEQ ID NO: 114034 - protein, 15 aa, Mycobacterium tuberculosis
GVVASHMTATEITNE

SEQ ID NO: 114035 - protein, 15 aa, Mycobacterium tuberculosis
VVASHMTATEITNEL

SEQ ID NO: 114036 - protein, 15 aa, Mycobacterium tuberculosis
VASHMTATEITNELN

SEQ ID NO: 114037 - protein, 15 aa, Mycobacterium tuberculosis
ASHMTATEITNELNK

SEQ ID NO: 114038 - protein, 15 aa, Mycobacterium tuberculosis
SHMTATEITNELNKV

SEQ ID NO: 114039 - protein, 15 aa, Mycobacterium tuberculosis
HMTATEITNELNKVL

SEQ ID NO: 114040 - protein, 15 aa, Mycobacterium tuberculosis
MTATEITNELNKVLT

SEQ ID NO: 114041 - protein, 15 aa, Mycobacterium tuberculosis
TATEITNELNKVLTG

SEQ ID NO: 114042 - protein, 15 aa, Mycobacterium tuberculosis
ATEITNELNKVLTGG

SEQ ID NO: 114043 - protein, 15 aa, Mycobacterium tuberculosis
TEITNELNKVLTGGT

SEQ ID NO: 114044 - protein, 15 aa, Mycobacterium tuberculosis
EITNELNKVLTGGTR

SEQ ID NO: 114045 - protein, 15 aa, Mycobacterium tuberculosis
ITNELNKVLTGGTRL

SEQ ID NO: 114046 - protein, 15 aa, Mycobacterium tuberculosis
TNELNKVLTGGTRLA

SEQ ID NO: 114047 - protein, 15 aa, Mycobacterium tuberculosis
NELNKVLTGGTRLAE

SEQ ID NO: 114048 - protein, 15 aa, Mycobacterium tuberculosis
ELNKVLTGGTRLAEG

SEQ ID NO: 114049 - protein, 15 aa, Mycobacterium tuberculosis
LNKVLTGGTRLAEGL

SEQ ID NO: 114050 - protein, 15 aa, Mycobacterium tuberculosis
NKVLTGGTRLAEGLV

SEQ ID NO: 114051 - protein, 15 aa, Mycobacterium tuberculosis
KVLTGGTRLAEGLVQ

SEQ ID NO: 114052 - protein, 15 aa, Mycobacterium tuberculosis
VLTGGTRLAEGLVQA

SEQ ID NO: 114053 - protein, 15 aa, Mycobacterium tuberculosis
LTGGTRLAEGLVQAA

SEQ ID NO: 114054 - protein, 15 aa, Mycobacterium tuberculosis
TGGTRLAEGLVQAAA

SEQ ID NO: 114055 - protein, 15 aa, Mycobacterium tuberculosis
GGTRLAEGLVQAAAL

SEQ ID NO: 114056 - protein, 15 aa, Mycobacterium tuberculosis
GTRLAEGLVQAAALM

SEQ ID NO: 114057 - protein, 15 aa, Mycobacterium tuberculosis
TRLAEGLVQAAALME

SEQ ID NO: 114058 - protein, 15 aa, Mycobacterium tuberculosis
RLAEGLVQAAALMEG

SEQ ID NO: 114059 - protein, 15 aa, Mycobacterium tuberculosis
LAEGLVQAAALMEGH

SEQ ID NO: 114060 - protein, 15 aa, Mycobacterium tuberculosis
AEGLVQAAALMEGHE

SEQ ID NO: 114061 - protein, 15 aa, Mycobacterium tuberculosis
EGLVQAAALMEGHEA

SEQ ID NO: 114062 - protein, 15 aa, Mycobacterium tuberculosis
GLVQAAALMEGHEAD

SEQ ID NO: 114063 - protein, 15 aa, Mycobacterium tuberculosis
LVQAAALMEGHEADS

SEQ ID NO: 114064 - protein, 15 aa, Mycobacterium tuberculosis
VQAAALMEGHEADSQ

SEQ ID NO: 114065 - protein, 15 aa, Mycobacterium tuberculosis
QAAALMEGHEADSQT

SEQ ID NO: 114066 - protein, 15 aa, Mycobacterium tuberculosis
AAALMEGHEADSQTA

SEQ ID NO: 114067 - protein, 15 aa, Mycobacterium tuberculosis
AALMEGHEADSQTAF

SEQ ID NO: 114068 - protein, 15 aa, Mycobacterium tuberculosis
ALMEGHEADSQTAFQ

SEQ ID NO: 114069 - protein, 15 aa, Mycobacterium tuberculosis
LMEGHEADSQTAFQA

SEQ ID NO: 114070 - protein, 15 aa, Mycobacterium tuberculosis
MEGHEADSQTAFQAL

SEQ ID NO: 114071 - protein, 15 aa, Mycobacterium tuberculosis
EGHEADSQTAFQALF

SEQ ID NO: 114072 - protein, 15 aa, Mycobacterium tuberculosis
GHEADSQTAFQALFG

SEQ ID NO: 114073 - protein, 15 aa, Mycobacterium tuberculosis
HEADSQTAFQALFGA

SEQ ID NO: 114074 - protein, 15 aa, Mycobacterium tuberculosis
EADSQTAFQALFGAS

SEQ ID NO: 114075 - protein, 15 aa, Mycobacterium tuberculosis
ADSQTAFQALFGASH

SEQ ID NO: 114076 - protein, 15 aa, Mycobacterium tuberculosis
DSQTAFQALFGASHG

SEQ ID NO: 114077 - protein, 15 aa, Mycobacterium tuberculosis
SQTAFQALFGASHGS

SEQ ID NO: 114078 - protein, 16 aa, Mycobacterium tuberculosis
MADTIQVTPQMLRSTA

SEQ ID NO: 114079 - protein, 16 aa, Mycobacterium tuberculosis
ADTIQVTPQMLRSTAN

SEQ ID NO: 114080 - protein, 16 aa, Mycobacterium tuberculosis
DTIQVTPQMLRSTAND

SEQ ID NO: 114081 - protein, 16 aa, Mycobacterium tuberculosis
TIQVTPQMLRSTANDI

SEQ ID NO: 114082 - protein, 16 aa, Mycobacterium tuberculosis
IQVTPQMLRSTANDIQ

SEQ ID NO: 114083 - protein, 16 aa, Mycobacterium tuberculosis
QVTPQMLRSTANDIQA

SEQ ID NO: 114084 - protein, 16 aa, Mycobacterium tuberculosis
VTPQMLRSTANDIQAN

SEQ ID NO: 114085 - protein, 16 aa, Mycobacterium tuberculosis
TPQMLRSTANDIQANM

SEQ ID NO: 114086 - protein, 16 aa, Mycobacterium tuberculosis
PQMLRSTANDIQANME

SEQ ID NO: 114087 - protein, 16 aa, Mycobacterium tuberculosis
QMLRSTANDIQANMEQ

SEQ ID NO: 114088 - protein, 16 aa, Mycobacterium tuberculosis
MLRSTANDIQANMEQA

SEQ ID NO: 114089 - protein, 16 aa, Mycobacterium tuberculosis
LRSTANDIQANMEQAM

SEQ ID NO: 114090 - protein, 16 aa, Mycobacterium tuberculosis
RSTANDIQANMEQAMG

SEQ ID NO: 114091 - protein, 16 aa, Mycobacterium tuberculosis
STANDIQANMEQAMGI

SEQ ID NO: 114092 - protein, 16 aa, Mycobacterium tuberculosis
TANDIQANMEQAMGIA

SEQ ID NO: 114093 - protein, 16 aa, Mycobacterium tuberculosis
ANDIQANMEQAMGIAK

SEQ ID NO: 114094 - protein, 16 aa, Mycobacterium tuberculosis
NDIQANMEQAMGIAKG

SEQ ID NO: 114095 - protein, 16 aa, Mycobacterium tuberculosis
DIQANMEQAMGIAKGY

SEQ ID NO: 114096 - protein, 16 aa, Mycobacterium tuberculosis
IQANMEQAMGIAKGYL

SEQ ID NO: 114097 - protein, 16 aa, Mycobacterium tuberculosis
QANMEQAMGIAKGYLA

SEQ ID NO: 114098 - protein, 16 aa, Mycobacterium tuberculosis
ANMEQAMGIAKGYLAN

SEQ ID NO: 114099 - protein, 16 aa, Mycobacterium tuberculosis
NMEQAMGIAKGYLANQ

SEQ ID NO: 114100 - protein, 16 aa, Mycobacterium tuberculosis
MEQAMGIAKGYLANQE

SEQ ID NO: 114101 - protein, 16 aa, Mycobacterium tuberculosis
EQAMGIAKGYLANQEN

SEQ ID NO: 114102 - protein, 16 aa, Mycobacterium tuberculosis
QAMGIAKGYLANQENV

SEQ ID NO: 114103 - protein, 16 aa, Mycobacterium tuberculosis
AMGIAKGYLANQENVM

SEQ ID NO: 114104 - protein, 16 aa, Mycobacterium tuberculosis
MGIAKGYLANQENVMN

SEQ ID NO: 114105 - protein, 16 aa, Mycobacterium tuberculosis
GIAKGYLANQENVMNP

SEQ ID NO: 114106 - protein, 16 aa, Mycobacterium tuberculosis
IAKGYLANQENVMNPA

SEQ ID NO: 114107 - protein, 16 aa, Mycobacterium tuberculosis
AKGYLANQENVMNPAT

SEQ ID NO: 114108 - protein, 16 aa, Mycobacterium tuberculosis
KGYLANQENVMNPATW

SEQ ID NO: 114109 - protein, 16 aa, Mycobacterium tuberculosis
GYLANQENVMNPATWS

SEQ ID NO: 114110 - protein, 16 aa, Mycobacterium tuberculosis
YLANQENVMNPATWSG

SEQ ID NO: 114111 - protein, 16 aa, Mycobacterium tuberculosis
LANQENVMNPATWSGT

SEQ ID NO: 114112 - protein, 16 aa, Mycobacterium tuberculosis
ANQENVMNPATWSGTG

SEQ ID NO: 114113 - protein, 16 aa, Mycobacterium tuberculosis
NQENVMNPATWSGTGV

SEQ ID NO: 114114 - protein, 16 aa, Mycobacterium tuberculosis
QENVMNPATWSGTGVV

SEQ ID NO: 114115 - protein, 16 aa, Mycobacterium tuberculosis
ENVMNPATWSGTGVVA

SEQ ID NO: 114116 - protein, 16 aa, Mycobacterium tuberculosis
NVMNPATWSGTGVVAS

SEQ ID NO: 114117 - protein, 16 aa, Mycobacterium tuberculosis
VMNPATWSGTGVVASH

SEQ ID NO: 114118 - protein, 16 aa, Mycobacterium tuberculosis
MNPATWSGTGVVASHM

SEQ ID NO: 114119 - protein, 16 aa, Mycobacterium tuberculosis
NPATWSGTGVVASHMT

SEQ ID NO: 114120 - protein, 16 aa, Mycobacterium tuberculosis
PATWSGTGVVASHMTA

SEQ ID NO: 114121 - protein, 16 aa, Mycobacterium tuberculosis
ATWSGTGVVASHMTAT

SEQ ID NO: 114122 - protein, 16 aa, Mycobacterium tuberculosis
TWSGTGVVASHMTATE

SEQ ID NO: 114123 - protein, 16 aa, Mycobacterium tuberculosis
WSGTGVVASHMTATEI

SEQ ID NO: 114124 - protein, 16 aa, Mycobacterium tuberculosis
SGTGVVASHMTATEIT

SEQ ID NO: 114125 - protein, 16 aa, Mycobacterium tuberculosis
GTGVVASHMTATEITN

SEQ ID NO: 114126 - protein, 16 aa, Mycobacterium tuberculosis
TGVVASHMTATEITNE

SEQ ID NO: 114127 - protein, 16 aa, Mycobacterium tuberculosis
GVVASHMTATEITNEL

SEQ ID NO: 114128 - protein, 16 aa, Mycobacterium tuberculosis
VVASHMTATEITNELN

SEQ ID NO: 114129 - protein, 16 aa, Mycobacterium tuberculosis
VASHMTATEITNELNK

SEQ ID NO: 114130 - protein, 16 aa, Mycobacterium tuberculosis
ASHMTATEITNELNKV

SEQ ID NO: 114131 - protein, 16 aa, Mycobacterium tuberculosis
SHMTATEITNELNKVL

SEQ ID NO: 114132 - protein, 16 aa, Mycobacterium tuberculosis
HMTATEITNELNKVLT

SEQ ID NO: 114133 - protein, 16 aa, Mycobacterium tuberculosis
MTATEITNELNKVLTG

SEQ ID NO: 114134 - protein, 16 aa, Mycobacterium tuberculosis
TATEITNELNKVLTGG

SEQ ID NO: 114135 - protein, 16 aa, Mycobacterium tuberculosis
ATEITNELNKVLTGGT

SEQ ID NO: 114136 - protein, 16 aa, Mycobacterium tuberculosis
TEITNELNKVLTGGTR

SEQ ID NO: 114137 - protein, 16 aa, Mycobacterium tuberculosis
EITNELNKVLTGGTRL

SEQ ID NO: 114138 - protein, 16 aa, Mycobacterium tuberculosis
ITNELNKVLTGGTRLA

SEQ ID NO: 114139 - protein, 16 aa, Mycobacterium tuberculosis
TNELNKVLTGGTRLAE

SEQ ID NO: 114140 - protein, 16 aa, Mycobacterium tuberculosis
NELNKVLTGGTRLAEG

SEQ ID NO: 114141 - protein, 16 aa, Mycobacterium tuberculosis
ELNKVLTGGTRLAEGL

SEQ ID NO: 114142 - protein, 16 aa, Mycobacterium tuberculosis
LNKVLTGGTRLAEGLV

SEQ ID NO: 114143 - protein, 16 aa, Mycobacterium tuberculosis
NKVLTGGTRLAEGLVQ

SEQ ID NO: 114144 - protein, 16 aa, Mycobacterium tuberculosis
KVLTGGTRLAEGLVQA

SEQ ID NO: 114145 - protein, 16 aa, Mycobacterium tuberculosis
VLTGGTRLAEGLVQAA

SEQ ID NO: 114146 - protein, 16 aa, Mycobacterium tuberculosis
LTGGTRLAEGLVQAAA

SEQ ID NO: 114147 - protein, 16 aa, Mycobacterium tuberculosis
TGGTRLAEGLVQAAAL

SEQ ID NO: 114148 - protein, 16 aa, Mycobacterium tuberculosis
GGTRLAEGLVQAAALM

SEQ ID NO: 114149 - protein, 16 aa, Mycobacterium tuberculosis
GTRLAEGLVQAAALME

SEQ ID NO: 114150 - protein, 16 aa, Mycobacterium tuberculosis
TRLAEGLVQAAALMEG

SEQ ID NO: 114151 - protein, 16 aa, Mycobacterium tuberculosis
RLAEGLVQAAALMEGH

SEQ ID NO: 114152 - protein, 16 aa, Mycobacterium tuberculosis
LAEGLVQAAALMEGHE

SEQ ID NO: 114153 - protein, 16 aa, Mycobacterium tuberculosis
AEGLVQAAALMEGHEA

SEQ ID NO: 114154 - protein, 16 aa, Mycobacterium tuberculosis
EGLVQAAALMEGHEAD

SEQ ID NO: 114155 - protein, 16 aa, Mycobacterium tuberculosis
GLVQAAALMEGHEADS

SEQ ID NO: 114156 - protein, 16 aa, Mycobacterium tuberculosis
LVQAAALMEGHEADSQ

SEQ ID NO: 114157 - protein, 16 aa, Mycobacterium tuberculosis
VQAAALMEGHEADSQT

SEQ ID NO: 114158 - protein, 16 aa, Mycobacterium tuberculosis
QAAALMEGHEADSQTA

SEQ ID NO: 114159 - protein, 16 aa, Mycobacterium tuberculosis
AAALMEGHEADSQTAF

SEQ ID NO: 114160 - protein, 16 aa, Mycobacterium tuberculosis
AALMEGHEADSQTAFQ

SEQ ID NO: 114161 - protein, 16 aa, Mycobacterium tuberculosis
ALMEGHEADSQTAFQA

SEQ ID NO: 114162 - protein, 16 aa, Mycobacterium tuberculosis
LMEGHEADSQTAFQAL

SEQ ID NO: 114163 - protein, 16 aa, Mycobacterium tuberculosis
MEGHEADSQTAFQALF

SEQ ID NO: 114164 - protein, 16 aa, Mycobacterium tuberculosis
EGHEADSQTAFQALFG

SEQ ID NO: 114165 - protein, 16 aa, Mycobacterium tuberculosis
GHEADSQTAFQALFGA

SEQ ID NO: 114166 - protein, 16 aa, Mycobacterium tuberculosis
HEADSQTAFQALFGAS

SEQ ID NO: 114167 - protein, 16 aa, Mycobacterium tuberculosis
EADSQTAFQALFGASH

SEQ ID NO: 114168 - protein, 16 aa, Mycobacterium tuberculosis
ADSQTAFQALFGASHG

SEQ ID NO: 114169 - protein, 16 aa, Mycobacterium tuberculosis
DSQTAFQALFGASHGS

SEQ ID NO: 114170 - protein, 13 aa, Mycobacterium tuberculosis
MDPTVLADAVARM

SEQ ID NO: 114171 - protein, 13 aa, Mycobacterium tuberculosis
DPTVLADAVARMA

SEQ ID NO: 114172 - protein, 13 aa, Mycobacterium tuberculosis
PTVLADAVARMAE

SEQ ID NO: 114173 - protein, 13 aa, Mycobacterium tuberculosis
TVLADAVARMAEF

SEQ ID NO: 114174 - protein, 13 aa, Mycobacterium tuberculosis
VLADAVARMAEFG

SEQ ID NO: 114175 - protein, 13 aa, Mycobacterium tuberculosis
LADAVARMAEFGR

SEQ ID NO: 114176 - protein, 13 aa, Mycobacterium tuberculosis
ADAVARMAEFGRH

SEQ ID NO: 114177 - protein, 13 aa, Mycobacterium tuberculosis
DAVARMAEFGRHV

SEQ ID NO: 114178 - protein, 13 aa, Mycobacterium tuberculosis
AVARMAEFGRHVE

SEQ ID NO: 114179 - protein, 13 aa, Mycobacterium tuberculosis
VARMAEFGRHVEE

SEQ ID NO: 114180 - protein, 13 aa, Mycobacterium tuberculosis
ARMAEFGRHVEEL

SEQ ID NO: 114181 - protein, 13 aa, Mycobacterium tuberculosis
RMAEFGRHVEELV

SEQ ID NO: 114182 - protein, 13 aa, Mycobacterium tuberculosis
MAEFGRHVEELVA

SEQ ID NO: 114183 - protein, 13 aa, Mycobacterium tuberculosis
AEFGRHVEELVAE

SEQ ID NO: 114184 - protein, 13 aa, Mycobacterium tuberculosis
EFGRHVEELVAEI

SEQ ID NO: 114185 - protein, 13 aa, Mycobacterium tuberculosis
FGRHVEELVAEIE

SEQ ID NO: 114186 - protein, 13 aa, Mycobacterium tuberculosis
GRHVEELVAEIES

SEQ ID NO: 114187 - protein, 13 aa, Mycobacterium tuberculosis
RHVEELVAEIESL

SEQ ID NO: 114188 - protein, 13 aa, Mycobacterium tuberculosis
HVEELVAEIESLV

SEQ ID NO: 114189 - protein, 13 aa, Mycobacterium tuberculosis
VEELVAEIESLVT

SEQ ID NO: 114190 - protein, 13 aa, Mycobacterium tuberculosis
EELVAEIESLVTR

SEQ ID NO: 114191 - protein, 13 aa, Mycobacterium tuberculosis
ELVAEIESLVTRL

SEQ ID NO: 114192 - protein, 13 aa, Mycobacterium tuberculosis
LVAEIESLVTRLH

SEQ ID NO: 114193 - protein, 13 aa, Mycobacterium tuberculosis
VAEIESLVTRLHV

SEQ ID NO: 114194 - protein, 13 aa, Mycobacterium tuberculosis
AEIESLVTRLHVT

SEQ ID NO: 114195 - protein, 13 aa, Mycobacterium tuberculosis
EIESLVTRLHVTW

SEQ ID NO: 114196 - protein, 13 aa, Mycobacterium tuberculosis
IESLVTRLHVTWT

SEQ ID NO: 114197 - protein, 13 aa, Mycobacterium tuberculosis
ESLVTRLHVTWTG

SEQ ID NO: 114198 - protein, 13 aa, Mycobacterium tuberculosis
SLVTRLHVTWTGE

SEQ ID NO: 114199 - protein, 13 aa, Mycobacterium tuberculosis
LVTRLHVTWTGEG

SEQ ID NO: 114200 - protein, 13 aa, Mycobacterium tuberculosis
VTRLHVTWTGEGA

SEQ ID NO: 114201 - protein, 13 aa, Mycobacterium tuberculosis
TRLHVTWTGEGAA

SEQ ID NO: 114202 - protein, 13 aa, Mycobacterium tuberculosis
RLHVTWTGEGAAA

SEQ ID NO: 114203 - protein, 13 aa, Mycobacterium tuberculosis
LHVTWTGEGAAAH

SEQ ID NO: 114204 - protein, 13 aa, Mycobacterium tuberculosis
HVTWTGEGAAAHA

SEQ ID NO: 114205 - protein, 13 aa, Mycobacterium tuberculosis
VTWTGEGAAAHAE

SEQ ID NO: 114206 - protein, 13 aa, Mycobacterium tuberculosis
TWTGEGAAAHAEA

SEQ ID NO: 114207 - protein, 13 aa, Mycobacterium tuberculosis
WTGEGAAAHAEAQ

SEQ ID NO: 114208 - protein, 13 aa, Mycobacterium tuberculosis
TGEGAAAHAEAQR

SEQ ID NO: 114209 - protein, 13 aa, Mycobacterium tuberculosis
GEGAAAHAEAQRH

SEQ ID NO: 114210 - protein, 13 aa, Mycobacterium tuberculosis
EGAAAHAEAQRHW

SEQ ID NO: 114211 - protein, 13 aa, Mycobacterium tuberculosis
GAAAHAEAQRHWA

SEQ ID NO: 114212 - protein, 13 aa, Mycobacterium tuberculosis
AAAHAEAQRHWAA

SEQ ID NO: 114213 - protein, 13 aa, Mycobacterium tuberculosis
AAHAEAQRHWAAG

SEQ ID NO: 114214 - protein, 13 aa, Mycobacterium tuberculosis
AHAEAQRHWAAGE

SEQ ID NO: 114215 - protein, 13 aa, Mycobacterium tuberculosis
HAEAQRHWAAGEA

SEQ ID NO: 114216 - protein, 13 aa, Mycobacterium tuberculosis
AEAQRHWAAGEAM

SEQ ID NO: 114217 - protein, 13 aa, Mycobacterium tuberculosis
EAQRHWAAGEAMM

SEQ ID NO: 114218 - protein, 13 aa, Mycobacterium tuberculosis
AQRHWAAGEAMMR

SEQ ID NO: 114219 - protein, 13 aa, Mycobacterium tuberculosis
QRHWAAGEAMMRQ

SEQ ID NO: 114220 - protein, 13 aa, Mycobacterium tuberculosis
RHWAAGEAMMRQA

SEQ ID NO: 114221 - protein, 13 aa, Mycobacterium tuberculosis
HWAAGEAMMRQAL

SEQ ID NO: 114222 - protein, 13 aa, Mycobacterium tuberculosis
WAAGEAMMRQALA

SEQ ID NO: 114223 - protein, 13 aa, Mycobacterium tuberculosis
AAGEAMMRQALAQ

SEQ ID NO: 114224 - protein, 13 aa, Mycobacterium tuberculosis
AGEAMMRQALAQL

SEQ ID NO: 114225 - protein, 13 aa, Mycobacterium tuberculosis
GEAMMRQALAQLT

SEQ ID NO: 114226 - protein, 13 aa, Mycobacterium tuberculosis
EAMMRQALAQLTA

SEQ ID NO: 114227 - protein, 13 aa, Mycobacterium tuberculosis
AMMRQALAQLTAA

SEQ ID NO: 114228 - protein, 13 aa, Mycobacterium tuberculosis
MMRQALAQLTAAG

SEQ ID NO: 114229 - protein, 13 aa, Mycobacterium tuberculosis
MRQALAQLTAAGQ

SEQ ID NO: 114230 - protein, 13 aa, Mycobacterium tuberculosis
RQALAQLTAAGQS

SEQ ID NO: 114231 - protein, 13 aa, Mycobacterium tuberculosis
QALAQLTAAGQSA

SEQ ID NO: 114232 - protein, 13 aa, Mycobacterium tuberculosis
ALAQLTAAGQSAH

SEQ ID NO: 114233 - protein, 13 aa, Mycobacterium tuberculosis
LAQLTAAGQSAHA

SEQ ID NO: 114234 - protein, 13 aa, Mycobacterium tuberculosis
AQLTAAGQSAHAN

SEQ ID NO: 114235 - protein, 13 aa, Mycobacterium tuberculosis
QLTAAGQSAHANY

SEQ ID NO: 114236 - protein, 13 aa, Mycobacterium tuberculosis
LTAAGQSAHANYT

SEQ ID NO: 114237 - protein, 13 aa, Mycobacterium tuberculosis
TAAGQSAHANYTG

SEQ ID NO: 114238 - protein, 13 aa, Mycobacterium tuberculosis
AAGQSAHANYTGA

SEQ ID NO: 114239 - protein, 13 aa, Mycobacterium tuberculosis
AGQSAHANYTGAM

SEQ ID NO: 114240 - protein, 13 aa, Mycobacterium tuberculosis
GQSAHANYTGAMA

SEQ ID NO: 114241 - protein, 13 aa, Mycobacterium tuberculosis
QSAHANYTGAMAT

SEQ ID NO: 114242 - protein, 13 aa, Mycobacterium tuberculosis
SAHANYTGAMATN

SEQ ID NO: 114243 - protein, 13 aa, Mycobacterium tuberculosis
AHANYTGAMATNL

SEQ ID NO: 114244 - protein, 13 aa, Mycobacterium tuberculosis
HANYTGAMATNLG

SEQ ID NO: 114245 - protein, 13 aa, Mycobacterium tuberculosis
ANYTGAMATNLGM

SEQ ID NO: 114246 - protein, 13 aa, Mycobacterium tuberculosis
NYTGAMATNLGMW

SEQ ID NO: 114247 - protein, 13 aa, Mycobacterium tuberculosis
YTGAMATNLGMWS

SEQ ID NO: 114248 - protein, 14 aa, Mycobacterium tuberculosis
MDPTVLADAVARMA

SEQ ID NO: 114249 - protein, 14 aa, Mycobacterium tuberculosis
DPTVLADAVARMAE

SEQ ID NO: 114250 - protein, 14 aa, Mycobacterium tuberculosis
PTVLADAVARMAEF

SEQ ID NO: 114251 - protein, 14 aa, Mycobacterium tuberculosis
TVLADAVARMAEFG

SEQ ID NO: 114252 - protein, 14 aa, Mycobacterium tuberculosis
VLADAVARMAEFGR

SEQ ID NO: 114253 - protein, 14 aa, Mycobacterium tuberculosis
LADAVARMAEFGRH

SEQ ID NO: 114254 - protein, 14 aa, Mycobacterium tuberculosis
ADAVARMAEFGRHV

SEQ ID NO: 114255 - protein, 14 aa, Mycobacterium tuberculosis
DAVARMAEFGRHVE

SEQ ID NO: 114256 - protein, 14 aa, Mycobacterium tuberculosis
AVARMAEFGRHVEE

SEQ ID NO: 114257 - protein, 14 aa, Mycobacterium tuberculosis
VARMAEFGRHVEEL

SEQ ID NO: 114258 - protein, 14 aa, Mycobacterium tuberculosis
ARMAEFGRHVEELV

SEQ ID NO: 114259 - protein, 14 aa, Mycobacterium tuberculosis
RMAEFGRHVEELVA

SEQ ID NO: 114260 - protein, 14 aa, Mycobacterium tuberculosis
MAEFGRHVEELVAE

SEQ ID NO: 114261 - protein, 14 aa, Mycobacterium tuberculosis
AEFGRHVEELVAEI

SEQ ID NO: 114262 - protein, 14 aa, Mycobacterium tuberculosis
EFGRHVEELVAEIE

SEQ ID NO: 114263 - protein, 14 aa, Mycobacterium tuberculosis
FGRHVEELVAEIES

SEQ ID NO: 114264 - protein, 14 aa, Mycobacterium tuberculosis
GRHVEELVAEIESL

SEQ ID NO: 114265 - protein, 14 aa, Mycobacterium tuberculosis
RHVEELVAEIESLV

SEQ ID NO: 114266 - protein, 14 aa, Mycobacterium tuberculosis
HVEELVAEIESLVT

SEQ ID NO: 114267 - protein, 14 aa, Mycobacterium tuberculosis
VEELVAEIESLVTR

SEQ ID NO: 114268 - protein, 14 aa, Mycobacterium tuberculosis
EELVAEIESLVTRL

SEQ ID NO: 114269 - protein, 14 aa, Mycobacterium tuberculosis
ELVAEIESLVTRLH

SEQ ID NO: 114270 - protein, 14 aa, Mycobacterium tuberculosis
LVAEIESLVTRLHV

SEQ ID NO: 114271 - protein, 14 aa, Mycobacterium tuberculosis
VAEIESLVTRLHVT

SEQ ID NO: 114272 - protein, 14 aa, Mycobacterium tuberculosis
AEIESLVTRLHVTW

SEQ ID NO: 114273 - protein, 14 aa, Mycobacterium tuberculosis
EIESLVTRLHVTWT

SEQ ID NO: 114274 - protein, 14 aa, Mycobacterium tuberculosis
IESLVTRLHVTWTG

SEQ ID NO: 114275 - protein, 14 aa, Mycobacterium tuberculosis
ESLVTRLHVTWTGE

SEQ ID NO: 114276 - protein, 14 aa, Mycobacterium tuberculosis
SLVTRLHVTWTGEG

SEQ ID NO: 114277 - protein, 14 aa, Mycobacterium tuberculosis
LVTRLHVTWTGEGA

SEQ ID NO: 114278 - protein, 14 aa, Mycobacterium tuberculosis
VTRLHVTWTGEGAA

SEQ ID NO: 114279 - protein, 14 aa, Mycobacterium tuberculosis
TRLHVTWTGEGAAA

SEQ ID NO: 114280 - protein, 14 aa, Mycobacterium tuberculosis
RLHVTWTGEGAAAH

SEQ ID NO: 114281 - protein, 14 aa, Mycobacterium tuberculosis
LHVTWTGEGAAAHA

SEQ ID NO: 114282 - protein, 14 aa, Mycobacterium tuberculosis
HVTWTGEGAAAHAE

SEQ ID NO: 114283 - protein, 14 aa, Mycobacterium tuberculosis
VTWTGEGAAAHAEA

SEQ ID NO: 114284 - protein, 14 aa, Mycobacterium tuberculosis
TWTGEGAAAHAEAQ

SEQ ID NO: 114285 - protein, 14 aa, Mycobacterium tuberculosis
WTGEGAAAHAEAQR

SEQ ID NO: 114286 - protein, 14 aa, Mycobacterium tuberculosis
TGEGAAAHAEAQRH

SEQ ID NO: 114287 - protein, 14 aa, Mycobacterium tuberculosis
GEGAAAHAEAQRHW

SEQ ID NO: 114288 - protein, 14 aa, Mycobacterium tuberculosis
EGAAAHAEAQRHWA

SEQ ID NO: 114289 - protein, 14 aa, Mycobacterium tuberculosis
GAAAHAEAQRHWAA

SEQ ID NO: 114290 - protein, 14 aa, Mycobacterium tuberculosis
AAAHAEAQRHWAAG

SEQ ID NO: 114291 - protein, 14 aa, Mycobacterium tuberculosis
AAHAEAQRHWAAGE

SEQ ID NO: 114292 - protein, 14 aa, Mycobacterium tuberculosis
AHAEAQRHWAAGEA

SEQ ID NO: 114293 - protein, 14 aa, Mycobacterium tuberculosis
HAEAQRHWAAGEAM

SEQ ID NO: 114294 - protein, 14 aa, Mycobacterium tuberculosis
AEAQRHWAAGEAMM

SEQ ID NO: 114295 - protein, 14 aa, Mycobacterium tuberculosis
EAQRHWAAGEAMMR

SEQ ID NO: 114296 - protein, 14 aa, Mycobacterium tuberculosis
AQRHWAAGEAMMRQ

SEQ ID NO: 114297 - protein, 14 aa, Mycobacterium tuberculosis
QRHWAAGEAMMRQA

SEQ ID NO: 114298 - protein, 14 aa, Mycobacterium tuberculosis
RHWAAGEAMMRQAL

SEQ ID NO: 114299 - protein, 14 aa, Mycobacterium tuberculosis
HWAAGEAMMRQALA

SEQ ID NO: 114300 - protein, 14 aa, Mycobacterium tuberculosis
WAAGEAMMRQALAQ

SEQ ID NO: 114301 - protein, 14 aa, Mycobacterium tuberculosis
AAGEAMMRQALAQL

SEQ ID NO: 114302 - protein, 14 aa, Mycobacterium tuberculosis
AGEAMMRQALAQLT

SEQ ID NO: 114303 - protein, 14 aa, Mycobacterium tuberculosis
GEAMMRQALAQLTA

SEQ ID NO: 114304 - protein, 14 aa, Mycobacterium tuberculosis
EAMMRQALAQLTAA

SEQ ID NO: 114305 - protein, 14 aa, Mycobacterium tuberculosis
AMMRQALAQLTAAG

SEQ ID NO: 114306 - protein, 14 aa, Mycobacterium tuberculosis
MMRQALAQLTAAGQ

SEQ ID NO: 114307 - protein, 14 aa, Mycobacterium tuberculosis
MRQALAQLTAAGQS

SEQ ID NO: 114308 - protein, 14 aa, Mycobacterium tuberculosis
RQALAQLTAAGQSA

SEQ ID NO: 114309 - protein, 14 aa, Mycobacterium tuberculosis
QALAQLTAAGQSAH

SEQ ID NO: 114310 - protein, 14 aa, Mycobacterium tuberculosis
ALAQLTAAGQSAHA

SEQ ID NO: 114311 - protein, 14 aa, Mycobacterium tuberculosis
LAQLTAAGQSAHAN

SEQ ID NO: 114312 - protein, 14 aa, Mycobacterium tuberculosis
AQLTAAGQSAHANY

SEQ ID NO: 114313 - protein, 14 aa, Mycobacterium tuberculosis
QLTAAGQSAHANYT

SEQ ID NO: 114314 - protein, 14 aa, Mycobacterium tuberculosis
LTAAGQSAHANYTG

SEQ ID NO: 114315 - protein, 14 aa, Mycobacterium tuberculosis
TAAGQSAHANYTGA

SEQ ID NO: 114316 - protein, 14 aa, Mycobacterium tuberculosis
AAGQSAHANYTGAM

SEQ ID NO: 114317 - protein, 14 aa, Mycobacterium tuberculosis
AGQSAHANYTGAMA

SEQ ID NO: 114318 - protein, 14 aa, Mycobacterium tuberculosis
GQSAHANYTGAMAT

SEQ ID NO: 114319 - protein, 14 aa, Mycobacterium tuberculosis
QSAHANYTGAMATN

SEQ ID NO: 114320 - protein, 14 aa, Mycobacterium tuberculosis
SAHANYTGAMATNL

SEQ ID NO: 114321 - protein, 14 aa, Mycobacterium tuberculosis
AHANYTGAMATNLG

SEQ ID NO: 114322 - protein, 14 aa, Mycobacterium tuberculosis
HANYTGAMATNLGM

SEQ ID NO: 114323 - protein, 14 aa, Mycobacterium tuberculosis
ANYTGAMATNLGMW

SEQ ID NO: 114324 - protein, 14 aa, Mycobacterium tuberculosis
NYTGAMATNLGMWS

SEQ ID NO: 114325 - protein, 15 aa, Mycobacterium tuberculosis
MDPTVLADAVARMAE

SEQ ID NO: 114326 - protein, 15 aa, Mycobacterium tuberculosis
DPTVLADAVARMAEF

SEQ ID NO: 114327 - protein, 15 aa, Mycobacterium tuberculosis
PTVLADAVARMAEFG

SEQ ID NO: 114328 - protein, 15 aa, Mycobacterium tuberculosis
TVLADAVARMAEFGR

SEQ ID NO: 114329 - protein, 15 aa, Mycobacterium tuberculosis
VLADAVARMAEFGRH

SEQ ID NO: 114330 - protein, 15 aa, Mycobacterium tuberculosis
LADAVARMAEFGRHV

SEQ ID NO: 114331 - protein, 15 aa, Mycobacterium tuberculosis
ADAVARMAEFGRHVE

SEQ ID NO: 114332 - protein, 15 aa, Mycobacterium tuberculosis
DAVARMAEFGRHVEE

SEQ ID NO: 114333 - protein, 15 aa, Mycobacterium tuberculosis
AVARMAEFGRHVEEL

SEQ ID NO: 114334 - protein, 15 aa, Mycobacterium tuberculosis
VARMAEFGRHVEELV

SEQ ID NO: 114335 - protein, 15 aa, Mycobacterium tuberculosis
ARMAEFGRHVEELVA

SEQ ID NO: 114336 - protein, 15 aa, Mycobacterium tuberculosis
RMAEFGRHVEELVAE

SEQ ID NO: 114337 - protein, 15 aa, Mycobacterium tuberculosis
MAEFGRHVEELVAEI

SEQ ID NO: 114338 - protein, 15 aa, Mycobacterium tuberculosis
AEFGRHVEELVAEIE

SEQ ID NO: 114339 - protein, 15 aa, Mycobacterium tuberculosis
EFGRHVEELVAEIES

SEQ ID NO: 114340 - protein, 15 aa, Mycobacterium tuberculosis
FGRHVEELVAEIESL

SEQ ID NO: 114341 - protein, 15 aa, Mycobacterium tuberculosis
GRHVEELVAEIESLV

SEQ ID NO: 114342 - protein, 15 aa, Mycobacterium tuberculosis
RHVEELVAEIESLVT

SEQ ID NO: 114343 - protein, 15 aa, Mycobacterium tuberculosis
HVEELVAEIESLVTR

SEQ ID NO: 114344 - protein, 15 aa, Mycobacterium tuberculosis
VEELVAEIESLVTRL

SEQ ID NO: 114345 - protein, 15 aa, Mycobacterium tuberculosis
EELVAEIESLVTRLH

SEQ ID NO: 114346 - protein, 15 aa, Mycobacterium tuberculosis
ELVAEIESLVTRLHV

SEQ ID NO: 114347 - protein, 15 aa, Mycobacterium tuberculosis
LVAEIESLVTRLHVT

SEQ ID NO: 114348 - protein, 15 aa, Mycobacterium tuberculosis
VAEIESLVTRLHVTW

SEQ ID NO: 114349 - protein, 15 aa, Mycobacterium tuberculosis
AEIESLVTRLHVTWT

SEQ ID NO: 114350 - protein, 15 aa, Mycobacterium tuberculosis
EIESLVTRLHVTWTG

SEQ ID NO: 114351 - protein, 15 aa, Mycobacterium tuberculosis
IESLVTRLHVTWTGE

SEQ ID NO: 114352 - protein, 15 aa, Mycobacterium tuberculosis
ESLVTRLHVTWTGEG

SEQ ID NO: 114353 - protein, 15 aa, Mycobacterium tuberculosis
SLVTRLHVTWTGEGA

SEQ ID NO: 114354 - protein, 15 aa, Mycobacterium tuberculosis
LVTRLHVTWTGEGAA

SEQ ID NO: 114355 - protein, 15 aa, Mycobacterium tuberculosis
VTRLHVTWTGEGAAA

SEQ ID NO: 114356 - protein, 15 aa, Mycobacterium tuberculosis
TRLHVTWTGEGAAAH

SEQ ID NO: 114357 - protein, 15 aa, Mycobacterium tuberculosis
RLHVTWTGEGAAAHA

SEQ ID NO: 114358 - protein, 15 aa, Mycobacterium tuberculosis
LHVTWTGEGAAAHAE

SEQ ID NO: 114359 - protein, 15 aa, Mycobacterium tuberculosis
HVTWTGEGAAAHAEA

SEQ ID NO: 114360 - protein, 15 aa, Mycobacterium tuberculosis
VTWTGEGAAAHAEAQ

SEQ ID NO: 114361 - protein, 15 aa, Mycobacterium tuberculosis
TWTGEGAAAHAEAQR

SEQ ID NO: 114362 - protein, 15 aa, Mycobacterium tuberculosis
WTGEGAAAHAEAQRH

SEQ ID NO: 114363 - protein, 15 aa, Mycobacterium tuberculosis
TGEGAAAHAEAQRHW

SEQ ID NO: 114364 - protein, 15 aa, Mycobacterium tuberculosis
GEGAAAHAEAQRHWA

SEQ ID NO: 114365 - protein, 15 aa, Mycobacterium tuberculosis
EGAAAHAEAQRHWAA

SEQ ID NO: 114366 - protein, 15 aa, Mycobacterium tuberculosis
GAAAHAEAQRHWAAG

SEQ ID NO: 114367 - protein, 15 aa, Mycobacterium tuberculosis
AAAHAEAQRHWAAGE

SEQ ID NO: 114368 - protein, 15 aa, Mycobacterium tuberculosis
AAHAEAQRHWAAGEA

SEQ ID NO: 114369 - protein, 15 aa, Mycobacterium tuberculosis
AHAEAQRHWAAGEAM

SEQ ID NO: 114370 - protein, 15 aa, Mycobacterium tuberculosis
HAEAQRHWAAGEAMM

SEQ ID NO: 114371 - protein, 15 aa, Mycobacterium tuberculosis
AEAQRHWAAGEAMMR

SEQ ID NO: 114372 - protein, 15 aa, Mycobacterium tuberculosis
EAQRHWAAGEAMMRQ

SEQ ID NO: 114373 - protein, 15 aa, Mycobacterium tuberculosis
AQRHWAAGEAMMRQA

SEQ ID NO: 114374 - protein, 15 aa, Mycobacterium tuberculosis
QRHWAAGEAMMRQAL

SEQ ID NO: 114375 - protein, 15 aa, Mycobacterium tuberculosis
RHWAAGEAMMRQALA

SEQ ID NO: 114376 - protein, 15 aa, Mycobacterium tuberculosis
HWAAGEAMMRQALAQ

SEQ ID NO: 114377 - protein, 15 aa, Mycobacterium tuberculosis
WAAGEAMMRQALAQL

SEQ ID NO: 114378 - protein, 15 aa, Mycobacterium tuberculosis
AAGEAMMRQALAQLT

SEQ ID NO: 114379 - protein, 15 aa, Mycobacterium tuberculosis
AGEAMMRQALAQLTA

SEQ ID NO: 114380 - protein, 15 aa, Mycobacterium tuberculosis
GEAMMRQALAQLTAA

SEQ ID NO: 114381 - protein, 15 aa, Mycobacterium tuberculosis
EAMMRQALAQLTAAG

SEQ ID NO: 114382 - protein, 15 aa, Mycobacterium tuberculosis
AMMRQALAQLTAAGQ

SEQ ID NO: 114383 - protein, 15 aa, Mycobacterium tuberculosis
MMRQALAQLTAAGQS

SEQ ID NO: 114384 - protein, 15 aa, Mycobacterium tuberculosis
MRQALAQLTAAGQSA

SEQ ID NO: 114385 - protein, 15 aa, Mycobacterium tuberculosis
RQALAQLTAAGQSAH

SEQ ID NO: 114386 - protein, 15 aa, Mycobacterium tuberculosis
QALAQLTAAGQSAHA

SEQ ID NO: 114387 - protein, 15 aa, Mycobacterium tuberculosis
ALAQLTAAGQSAHAN

SEQ ID NO: 114388 - protein, 15 aa, Mycobacterium tuberculosis
LAQLTAAGQSAHANY

SEQ ID NO: 114389 - protein, 15 aa, Mycobacterium tuberculosis
AQLTAAGQSAHANYT

SEQ ID NO: 114390 - protein, 15 aa, Mycobacterium tuberculosis
QLTAAGQSAHANYTG

SEQ ID NO: 114391 - protein, 15 aa, Mycobacterium tuberculosis
LTAAGQSAHANYTGA

SEQ ID NO: 114392 - protein, 15 aa, Mycobacterium tuberculosis
TAAGQSAHANYTGAM

SEQ ID NO: 114393 - protein, 15 aa, Mycobacterium tuberculosis
AAGQSAHANYTGAMA

SEQ ID NO: 114394 - protein, 15 aa, Mycobacterium tuberculosis
AGQSAHANYTGAMAT

SEQ ID NO: 114395 - protein, 15 aa, Mycobacterium tuberculosis
GQSAHANYTGAMATN

SEQ ID NO: 114396 - protein, 15 aa, Mycobacterium tuberculosis
QSAHANYTGAMATNL

SEQ ID NO: 114397 - protein, 15 aa, Mycobacterium tuberculosis
SAHANYTGAMATNLG

SEQ ID NO: 114398 - protein, 15 aa, Mycobacterium tuberculosis
AHANYTGAMATNLGM

SEQ ID NO: 114399 - protein, 15 aa, Mycobacterium tuberculosis
HANYTGAMATNLGMW

SEQ ID NO: 114400 - protein, 15 aa, Mycobacterium tuberculosis
ANYTGAMATNLGMWS

SEQ ID NO: 114401 - protein, 16 aa, Mycobacterium tuberculosis
MDPTVLADAVARMAEF

SEQ ID NO: 114402 - protein, 16 aa, Mycobacterium tuberculosis
DPTVLADAVARMAEFG

SEQ ID NO: 114403 - protein, 16 aa, Mycobacterium tuberculosis
PTVLADAVARMAEFGR

SEQ ID NO: 114404 - protein, 16 aa, Mycobacterium tuberculosis
TVLADAVARMAEFGRH

SEQ ID NO: 114405 - protein, 16 aa, Mycobacterium tuberculosis
VLADAVARMAEFGRHV

SEQ ID NO: 114406 - protein, 16 aa, Mycobacterium tuberculosis
LADAVARMAEFGRHVE

SEQ ID NO: 114407 - protein, 16 aa, Mycobacterium tuberculosis
ADAVARMAEFGRHVEE

SEQ ID NO: 114408 - protein, 16 aa, Mycobacterium tuberculosis
DAVARMAEFGRHVEEL

SEQ ID NO: 114409 - protein, 16 aa, Mycobacterium tuberculosis
AVARMAEFGRHVEELV

SEQ ID NO: 114410 - protein, 16 aa, Mycobacterium tuberculosis
VARMAEFGRHVEELVA

SEQ ID NO: 114411 - protein, 16 aa, Mycobacterium tuberculosis
ARMAEFGRHVEELVAE

SEQ ID NO: 114412 - protein, 16 aa, Mycobacterium tuberculosis
RMAEFGRHVEELVAEI

SEQ ID NO: 114413 - protein, 16 aa, Mycobacterium tuberculosis
MAEFGRHVEELVAEIE

SEQ ID NO: 114414 - protein, 16 aa, Mycobacterium tuberculosis
AEFGRHVEELVAEIES

SEQ ID NO: 114415 - protein, 16 aa, Mycobacterium tuberculosis
EFGRHVEELVAEIESL

SEQ ID NO: 114416 - protein, 16 aa, Mycobacterium tuberculosis
FGRHVEELVAEIESLV

SEQ ID NO: 114417 - protein, 16 aa, Mycobacterium tuberculosis
GRHVEELVAEIESLVT

SEQ ID NO: 114418 - protein, 16 aa, Mycobacterium tuberculosis
RHVEELVAEIESLVTR

SEQ ID NO: 114419 - protein, 16 aa, Mycobacterium tuberculosis
HVEELVAEIESLVTRL

SEQ ID NO: 114420 - protein, 16 aa, Mycobacterium tuberculosis
VEELVAEIESLVTRLH

SEQ ID NO: 114421 - protein, 16 aa, Mycobacterium tuberculosis
EELVAEIESLVTRLHV

SEQ ID NO: 114422 - protein, 16 aa, Mycobacterium tuberculosis
ELVAEIESLVTRLHVT

SEQ ID NO: 114423 - protein, 16 aa, Mycobacterium tuberculosis
LVAEIESLVTRLHVTW

SEQ ID NO: 114424 - protein, 16 aa, Mycobacterium tuberculosis
VAEIESLVTRLHVTWT

SEQ ID NO: 114425 - protein, 16 aa, Mycobacterium tuberculosis
AEIESLVTRLHVTWTG

SEQ ID NO: 114426 - protein, 16 aa, Mycobacterium tuberculosis
EIESLVTRLHVTWTGE

SEQ ID NO: 114427 - protein, 16 aa, Mycobacterium tuberculosis
IESLVTRLHVTWTGEG

SEQ ID NO: 114428 - protein, 16 aa, Mycobacterium tuberculosis
ESLVTRLHVTWTGEGA

SEQ ID NO: 114429 - protein, 16 aa, Mycobacterium tuberculosis
SLVTRLHVTWTGEGAA

SEQ ID NO: 114430 - protein, 16 aa, Mycobacterium tuberculosis
LVTRLHVTWTGEGAAA

SEQ ID NO: 114431 - protein, 16 aa, Mycobacterium tuberculosis
VTRLHVTWTGEGAAAH

SEQ ID NO: 114432 - protein, 16 aa, Mycobacterium tuberculosis
TRLHVTWTGEGAAAHA

SEQ ID NO: 114433 - protein, 16 aa, Mycobacterium tuberculosis
RLHVTWTGEGAAAHAE

SEQ ID NO: 114434 - protein, 16 aa, Mycobacterium tuberculosis
LHVTWTGEGAAAHAEA

SEQ ID NO: 114435 - protein, 16 aa, Mycobacterium tuberculosis
HVTWTGEGAAAHAEAQ

SEQ ID NO: 114436 - protein, 16 aa, Mycobacterium tuberculosis
VTWTGEGAAAHAEAQR

SEQ ID NO: 114437 - protein, 16 aa, Mycobacterium tuberculosis
TWTGEGAAAHAEAQRH

SEQ ID NO: 114438 - protein, 16 aa, Mycobacterium tuberculosis
WTGEGAAAHAEAQRHW

SEQ ID NO: 114439 - protein, 16 aa, Mycobacterium tuberculosis
TGEGAAAHAEAQRHWA

SEQ ID NO: 114440 - protein, 16 aa, Mycobacterium tuberculosis
GEGAAAHAEAQRHWAA

SEQ ID NO: 114441 - protein, 16 aa, Mycobacterium tuberculosis
EGAAAHAEAQRHWAAG

SEQ ID NO: 114442 - protein, 16 aa, Mycobacterium tuberculosis
GAAAHAEAQRHWAAGE

SEQ ID NO: 114443 - protein, 16 aa, Mycobacterium tuberculosis
AAAHAEAQRHWAAGEA

SEQ ID NO: 114444 - protein, 16 aa, Mycobacterium tuberculosis
AAHAEAQRHWAAGEAM

SEQ ID NO: 114445 - protein, 16 aa, Mycobacterium tuberculosis
AHAEAQRHWAAGEAMM

SEQ ID NO: 114446 - protein, 16 aa, Mycobacterium tuberculosis
HAEAQRHWAAGEAMMR

SEQ ID NO: 114447 - protein, 16 aa, Mycobacterium tuberculosis
AEAQRHWAAGEAMMRQ

SEQ ID NO: 114448 - protein, 16 aa, Mycobacterium tuberculosis
EAQRHWAAGEAMMRQA

SEQ ID NO: 114449 - protein, 16 aa, Mycobacterium tuberculosis
AQRHWAAGEAMMRQAL

SEQ ID NO: 114450 - protein, 16 aa, Mycobacterium tuberculosis
QRHWAAGEAMMRQALA

SEQ ID NO: 114451 - protein, 16 aa, Mycobacterium tuberculosis
RHWAAGEAMMRQALAQ

SEQ ID NO: 114452 - protein, 16 aa, Mycobacterium tuberculosis
HWAAGEAMMRQALAQL

SEQ ID NO: 114453 - protein, 16 aa, Mycobacterium tuberculosis
WAAGEAMMRQALAQLT

SEQ ID NO: 114454 - protein, 16 aa, Mycobacterium tuberculosis
AAGEAMMRQALAQLTA

SEQ ID NO: 114455 - protein, 16 aa, Mycobacterium tuberculosis
AGEAMMRQALAQLTAA

SEQ ID NO: 114456 - protein, 16 aa, Mycobacterium tuberculosis
GEAMMRQALAQLTAAG

SEQ ID NO: 114457 - protein, 16 aa, Mycobacterium tuberculosis
EAMMRQALAQLTAAGQ

SEQ ID NO: 114458 - protein, 16 aa, Mycobacterium tuberculosis
AMMRQALAQLTAAGQS

SEQ ID NO: 114459 - protein, 16 aa, Mycobacterium tuberculosis
MMRQALAQLTAAGQSA

SEQ ID NO: 114460 - protein, 16 aa, Mycobacterium tuberculosis
MRQALAQLTAAGQSAH

SEQ ID NO: 114461 - protein, 16 aa, Mycobacterium tuberculosis
RQALAQLTAAGQSAHA

SEQ ID NO: 114462 - protein, 16 aa, Mycobacterium tuberculosis
QALAQLTAAGQSAHAN

SEQ ID NO: 114463 - protein, 16 aa, Mycobacterium tuberculosis
ALAQLTAAGQSAHANY

SEQ ID NO: 114464 - protein, 16 aa, Mycobacterium tuberculosis
LAQLTAAGQSAHANYT

SEQ ID NO: 114465 - protein, 16 aa, Mycobacterium tuberculosis
AQLTAAGQSAHANYTG

SEQ ID NO: 114466 - protein, 16 aa, Mycobacterium tuberculosis
QLTAAGQSAHANYTGA

SEQ ID NO: 114467 - protein, 16 aa, Mycobacterium tuberculosis
LTAAGQSAHANYTGAM

SEQ ID NO: 114468 - protein, 16 aa, Mycobacterium tuberculosis
TAAGQSAHANYTGAMA

SEQ ID NO: 114469 - protein, 16 aa, Mycobacterium tuberculosis
AAGQSAHANYTGAMAT

SEQ ID NO: 114470 - protein, 16 aa, Mycobacterium tuberculosis
AGQSAHANYTGAMATN

SEQ ID NO: 114471 - protein, 16 aa, Mycobacterium tuberculosis
GQSAHANYTGAMATNL

SEQ ID NO: 114472 - protein, 16 aa, Mycobacterium tuberculosis
QSAHANYTGAMATNLG

SEQ ID NO: 114473 - protein, 16 aa, Mycobacterium tuberculosis
SAHANYTGAMATNLGM

SEQ ID NO: 114474 - protein, 16 aa, Mycobacterium tuberculosis
AHANYTGAMATNLGMW

SEQ ID NO: 114475 - protein, 16 aa, Mycobacterium tuberculosis
HANYTGAMATNLGMWS

SEQ ID NO: 114476 - protein, 13 aa, Mycobacterium tuberculosis
MGADDTLRVEPAV

SEQ ID NO: 114477 - protein, 13 aa, Mycobacterium tuberculosis
GADDTLRVEPAVM

SEQ ID NO: 114478 - protein, 13 aa, Mycobacterium tuberculosis
ADDTLRVEPAVMQ

SEQ ID NO: 114479 - protein, 13 aa, Mycobacterium tuberculosis
DDTLRVEPAVMQG

SEQ ID NO: 114480 - protein, 13 aa, Mycobacterium tuberculosis
DTLRVEPAVMQGF

SEQ ID NO: 114481 - protein, 13 aa, Mycobacterium tuberculosis
TLRVEPAVMQGFA

SEQ ID NO: 114482 - protein, 13 aa, Mycobacterium tuberculosis
LRVEPAVMQGFAA

SEQ ID NO: 114483 - protein, 13 aa, Mycobacterium tuberculosis
RVEPAVMQGFAAS

SEQ ID NO: 114484 - protein, 13 aa, Mycobacterium tuberculosis
VEPAVMQGFAASL

SEQ ID NO: 114485 - protein, 13 aa, Mycobacterium tuberculosis
EPAVMQGFAASLD

SEQ ID NO: 114486 - protein, 13 aa, Mycobacterium tuberculosis
PAVMQGFAASLDG

SEQ ID NO: 114487 - protein, 13 aa, Mycobacterium tuberculosis
AVMQGFAASLDGA

SEQ ID NO: 114488 - protein, 13 aa, Mycobacterium tuberculosis
VMQGFAASLDGAA

SEQ ID NO: 114489 - protein, 13 aa, Mycobacterium tuberculosis
MQGFAASLDGAAE

SEQ ID NO: 114490 - protein, 13 aa, Mycobacterium tuberculosis
QGFAASLDGAAEH

SEQ ID NO: 114491 - protein, 13 aa, Mycobacterium tuberculosis
GFAASLDGAAEHL

SEQ ID NO: 114492 - protein, 13 aa, Mycobacterium tuberculosis
FAASLDGAAEHLA

SEQ ID NO: 114493 - protein, 13 aa, Mycobacterium tuberculosis
AASLDGAAEHLAV

SEQ ID NO: 114494 - protein, 13 aa, Mycobacterium tuberculosis
ASLDGAAEHLAVQ

SEQ ID NO: 114495 - protein, 13 aa, Mycobacterium tuberculosis
SLDGAAEHLAVQL

SEQ ID NO: 114496 - protein, 13 aa, Mycobacterium tuberculosis
LDGAAEHLAVQLA

SEQ ID NO: 114497 - protein, 13 aa, Mycobacterium tuberculosis
DGAAEHLAVQLAE

SEQ ID NO: 114498 - protein, 13 aa, Mycobacterium tuberculosis
GAAEHLAVQLAEL

SEQ ID NO: 114499 - protein, 13 aa, Mycobacterium tuberculosis
AAEHLAVQLAELD

SEQ ID NO: 114500 - protein, 13 aa, Mycobacterium tuberculosis
AEHLAVQLAELDA

SEQ ID NO: 114501 - protein, 13 aa, Mycobacterium tuberculosis
EHLAVQLAELDAQ

SEQ ID NO: 114502 - protein, 13 aa, Mycobacterium tuberculosis
HLAVQLAELDAQV

SEQ ID NO: 114503 - protein, 13 aa, Mycobacterium tuberculosis
LAVQLAELDAQVG

SEQ ID NO: 114504 - protein, 13 aa, Mycobacterium tuberculosis
AVQLAELDAQVGQ

SEQ ID NO: 114505 - protein, 13 aa, Mycobacterium tuberculosis
VQLAELDAQVGQM

SEQ ID NO: 114506 - protein, 13 aa, Mycobacterium tuberculosis
QLAELDAQVGQML

SEQ ID NO: 114507 - protein, 13 aa, Mycobacterium tuberculosis
LAELDAQVGQMLG

SEQ ID NO: 114508 - protein, 13 aa, Mycobacterium tuberculosis
AELDAQVGQMLGG

SEQ ID NO: 114509 - protein, 13 aa, Mycobacterium tuberculosis
ELDAQVGQMLGGW

SEQ ID NO: 114510 - protein, 13 aa, Mycobacterium tuberculosis
LDAQVGQMLGGWR

SEQ ID NO: 114511 - protein, 13 aa, Mycobacterium tuberculosis
DAQVGQMLGGWRG

SEQ ID NO: 114512 - protein, 13 aa, Mycobacterium tuberculosis
AQVGQMLGGWRGA

SEQ ID NO: 114513 - protein, 13 aa, Mycobacterium tuberculosis
QVGQMLGGWRGAS

SEQ ID NO: 114514 - protein, 13 aa, Mycobacterium tuberculosis
VGQMLGGWRGASG

SEQ ID NO: 114515 - protein, 13 aa, Mycobacterium tuberculosis
GQMLGGWRGASGS

SEQ ID NO: 114516 - protein, 13 aa, Mycobacterium tuberculosis
QMLGGWRGASGSA

SEQ ID NO: 114517 - protein, 13 aa, Mycobacterium tuberculosis
MLGGWRGASGSAY

SEQ ID NO: 114518 - protein, 13 aa, Mycobacterium tuberculosis
LGGWRGASGSAYG

SEQ ID NO: 114519 - protein, 13 aa, Mycobacterium tuberculosis
GGWRGASGSAYGS

SEQ ID NO: 114520 - protein, 13 aa, Mycobacterium tuberculosis
GWRGASGSAYGSA

SEQ ID NO: 114521 - protein, 13 aa, Mycobacterium tuberculosis
WRGASGSAYGSAW

SEQ ID NO: 114522 - protein, 13 aa, Mycobacterium tuberculosis
RGASGSAYGSAWE

SEQ ID NO: 114523 - protein, 13 aa, Mycobacterium tuberculosis
GASGSAYGSAWEL

SEQ ID NO: 114524 - protein, 13 aa, Mycobacterium tuberculosis
ASGSAYGSAWELW

SEQ ID NO: 114525 - protein, 13 aa, Mycobacterium tuberculosis
SGSAYGSAWELWH

SEQ ID NO: 114526 - protein, 13 aa, Mycobacterium tuberculosis
GSAYGSAWELWHR

SEQ ID NO: 114527 - protein, 13 aa, Mycobacterium tuberculosis
SAYGSAWELWHRG

SEQ ID NO: 114528 - protein, 13 aa, Mycobacterium tuberculosis
AYGSAWELWHRGA

SEQ ID NO: 114529 - protein, 13 aa, Mycobacterium tuberculosis
YGSAWELWHRGAG

SEQ ID NO: 114530 - protein, 13 aa, Mycobacterium tuberculosis
GSAWELWHRGAGE

SEQ ID NO: 114531 - protein, 13 aa, Mycobacterium tuberculosis
SAWELWHRGAGEV

SEQ ID NO: 114532 - protein, 13 aa, Mycobacterium tuberculosis
AWELWHRGAGEVQ

SEQ ID NO: 114533 - protein, 13 aa, Mycobacterium tuberculosis
WELWHRGAGEVQL

SEQ ID NO: 114534 - protein, 13 aa, Mycobacterium tuberculosis
ELWHRGAGEVQLG

SEQ ID NO: 114535 - protein, 13 aa, Mycobacterium tuberculosis
LWHRGAGEVQLGL

SEQ ID NO: 114536 - protein, 13 aa, Mycobacterium tuberculosis
WHRGAGEVQLGLS

SEQ ID NO: 114537 - protein, 13 aa, Mycobacterium tuberculosis
HRGAGEVQLGLSM

SEQ ID NO: 114538 - protein, 13 aa, Mycobacterium tuberculosis
RGAGEVQLGLSML

SEQ ID NO: 114539 - protein, 13 aa, Mycobacterium tuberculosis
GAGEVQLGLSMLA

SEQ ID NO: 114540 - protein, 13 aa, Mycobacterium tuberculosis
AGEVQLGLSMLAA

SEQ ID NO: 114541 - protein, 13 aa, Mycobacterium tuberculosis
GEVQLGLSMLAAA

SEQ ID NO: 114542 - protein, 13 aa, Mycobacterium tuberculosis
EVQLGLSMLAAAI

SEQ ID NO: 114543 - protein, 13 aa, Mycobacterium tuberculosis
VQLGLSMLAAAIA

SEQ ID NO: 114544 - protein, 13 aa, Mycobacterium tuberculosis
QLGLSMLAAAIAH

SEQ ID NO: 114545 - protein, 13 aa, Mycobacterium tuberculosis
LGLSMLAAAIAHA

SEQ ID NO: 114546 - protein, 13 aa, Mycobacterium tuberculosis
GLSMLAAAIAHAG

SEQ ID NO: 114547 - protein, 13 aa, Mycobacterium tuberculosis
LSMLAAAIAHAGA

SEQ ID NO: 114548 - protein, 13 aa, Mycobacterium tuberculosis
SMLAAAIAHAGAG

SEQ ID NO: 114549 - protein, 13 aa, Mycobacterium tuberculosis
MLAAAIAHAGAGY

SEQ ID NO: 114550 - protein, 13 aa, Mycobacterium tuberculosis
LAAAIAHAGAGYQ

SEQ ID NO: 114551 - protein, 13 aa, Mycobacterium tuberculosis
AAAIAHAGAGYQH

SEQ ID NO: 114552 - protein, 13 aa, Mycobacterium tuberculosis
AAIAHAGAGYQHN

SEQ ID NO: 114553 - protein, 13 aa, Mycobacterium tuberculosis
AIAHAGAGYQHNE

SEQ ID NO: 114554 - protein, 13 aa, Mycobacterium tuberculosis
IAHAGAGYQHNET

SEQ ID NO: 114555 - protein, 13 aa, Mycobacterium tuberculosis
AHAGAGYQHNETA

SEQ ID NO: 114556 - protein, 13 aa, Mycobacterium tuberculosis
HAGAGYQHNETAS

SEQ ID NO: 114557 - protein, 13 aa, Mycobacterium tuberculosis
AGAGYQHNETASA

SEQ ID NO: 114558 - protein, 13 aa, Mycobacterium tuberculosis
GAGYQHNETASAQ

SEQ ID NO: 114559 - protein, 13 aa, Mycobacterium tuberculosis
AGYQHNETASAQV

SEQ ID NO: 114560 - protein, 13 aa, Mycobacterium tuberculosis
GYQHNETASAQVL

SEQ ID NO: 114561 - protein, 13 aa, Mycobacterium tuberculosis
YQHNETASAQVLR

SEQ ID NO: 114562 - protein, 13 aa, Mycobacterium tuberculosis
QHNETASAQVLRE

SEQ ID NO: 114563 - protein, 13 aa, Mycobacterium tuberculosis
HNETASAQVLREV

SEQ ID NO: 114564 - protein, 13 aa, Mycobacterium tuberculosis
NETASAQVLREVG

SEQ ID NO: 114565 - protein, 13 aa, Mycobacterium tuberculosis
ETASAQVLREVGG

SEQ ID NO: 114566 - protein, 13 aa, Mycobacterium tuberculosis
TASAQVLREVGGG

SEQ ID NO: 114567 - protein, 14 aa, Mycobacterium tuberculosis
MGADDTLRVEPAVM

SEQ ID NO: 114568 - protein, 14 aa, Mycobacterium tuberculosis
GADDTLRVEPAVMQ

SEQ ID NO: 114569 - protein, 14 aa, Mycobacterium tuberculosis
ADDTLRVEPAVMQG

SEQ ID NO: 114570 - protein, 14 aa, Mycobacterium tuberculosis
DDTLRVEPAVMQGF

SEQ ID NO: 114571 - protein, 14 aa, Mycobacterium tuberculosis
DTLRVEPAVMQGFA

SEQ ID NO: 114572 - protein, 14 aa, Mycobacterium tuberculosis
TLRVEPAVMQGFAA

SEQ ID NO: 114573 - protein, 14 aa, Mycobacterium tuberculosis
LRVEPAVMQGFAAS

SEQ ID NO: 114574 - protein, 14 aa, Mycobacterium tuberculosis
RVEPAVMQGFAASL

SEQ ID NO: 114575 - protein, 14 aa, Mycobacterium tuberculosis
VEPAVMQGFAASLD

SEQ ID NO: 114576 - protein, 14 aa, Mycobacterium tuberculosis
EPAVMQGFAASLDG

SEQ ID NO: 114577 - protein, 14 aa, Mycobacterium tuberculosis
PAVMQGFAASLDGA

SEQ ID NO: 114578 - protein, 14 aa, Mycobacterium tuberculosis
AVMQGFAASLDGAA

SEQ ID NO: 114579 - protein, 14 aa, Mycobacterium tuberculosis
VMQGFAASLDGAAE

SEQ ID NO: 114580 - protein, 14 aa, Mycobacterium tuberculosis
MQGFAASLDGAAEH

SEQ ID NO: 114581 - protein, 14 aa, Mycobacterium tuberculosis
QGFAASLDGAAEHL

SEQ ID NO: 114582 - protein, 14 aa, Mycobacterium tuberculosis
GFAASLDGAAEHLA

SEQ ID NO: 114583 - protein, 14 aa, Mycobacterium tuberculosis
FAASLDGAAEHLAV

SEQ ID NO: 114584 - protein, 14 aa, Mycobacterium tuberculosis
AASLDGAAEHLAVQ

SEQ ID NO: 114585 - protein, 14 aa, Mycobacterium tuberculosis
ASLDGAAEHLAVQL

SEQ ID NO: 114586 - protein, 14 aa, Mycobacterium tuberculosis
SLDGAAEHLAVQLA

SEQ ID NO: 114587 - protein, 14 aa, Mycobacterium tuberculosis
LDGAAEHLAVQLAE

SEQ ID NO: 114588 - protein, 14 aa, Mycobacterium tuberculosis
DGAAEHLAVQLAEL

SEQ ID NO: 114589 - protein, 14 aa, Mycobacterium tuberculosis
GAAEHLAVQLAELD

SEQ ID NO: 114590 - protein, 14 aa, Mycobacterium tuberculosis
AAEHLAVQLAELDA

SEQ ID NO: 114591 - protein, 14 aa, Mycobacterium tuberculosis
AEHLAVQLAELDAQ

SEQ ID NO: 114592 - protein, 14 aa, Mycobacterium tuberculosis
EHLAVQLAELDAQV

SEQ ID NO: 114593 - protein, 14 aa, Mycobacterium tuberculosis
HLAVQLAELDAQVG

SEQ ID NO: 114594 - protein, 14 aa, Mycobacterium tuberculosis
LAVQLAELDAQVGQ

SEQ ID NO: 114595 - protein, 14 aa, Mycobacterium tuberculosis
AVQLAELDAQVGQM

SEQ ID NO: 114596 - protein, 14 aa, Mycobacterium tuberculosis
VQLAELDAQVGQML

SEQ ID NO: 114597 - protein, 14 aa, Mycobacterium tuberculosis
QLAELDAQVGQMLG

SEQ ID NO: 114598 - protein, 14 aa, Mycobacterium tuberculosis
LAELDAQVGQMLGG

SEQ ID NO: 114599 - protein, 14 aa, Mycobacterium tuberculosis
AELDAQVGQMLGGW

SEQ ID NO: 114600 - protein, 14 aa, Mycobacterium tuberculosis
ELDAQVGQMLGGWR

SEQ ID NO: 114601 - protein, 14 aa, Mycobacterium tuberculosis
LDAQVGQMLGGWRG

SEQ ID NO: 114602 - protein, 14 aa, Mycobacterium tuberculosis
DAQVGQMLGGWRGA

SEQ ID NO: 114603 - protein, 14 aa, Mycobacterium tuberculosis
AQVGQMLGGWRGAS

SEQ ID NO: 114604 - protein, 14 aa, Mycobacterium tuberculosis
QVGQMLGGWRGASG

SEQ ID NO: 114605 - protein, 14 aa, Mycobacterium tuberculosis
VGQMLGGWRGASGS

SEQ ID NO: 114606 - protein, 14 aa, Mycobacterium tuberculosis
GQMLGGWRGASGSA

SEQ ID NO: 114607 - protein, 14 aa, Mycobacterium tuberculosis
QMLGGWRGASGSAY

SEQ ID NO: 114608 - protein, 14 aa, Mycobacterium tuberculosis
MLGGWRGASGSAYG

SEQ ID NO: 114609 - protein, 14 aa, Mycobacterium tuberculosis
LGGWRGASGSAYGS

SEQ ID NO: 114610 - protein, 14 aa, Mycobacterium tuberculosis
GGWRGASGSAYGSA

SEQ ID NO: 114611 - protein, 14 aa, Mycobacterium tuberculosis
GWRGASGSAYGSAW

SEQ ID NO: 114612 - protein, 14 aa, Mycobacterium tuberculosis
WRGASGSAYGSAWE

SEQ ID NO: 114613 - protein, 14 aa, Mycobacterium tuberculosis
RGASGSAYGSAWEL

SEQ ID NO: 114614 - protein, 14 aa, Mycobacterium tuberculosis
GASGSAYGSAWELW

SEQ ID NO: 114615 - protein, 14 aa, Mycobacterium tuberculosis
ASGSAYGSAWELWH

SEQ ID NO: 114616 - protein, 14 aa, Mycobacterium tuberculosis
SGSAYGSAWELWHR

SEQ ID NO: 114617 - protein, 14 aa, Mycobacterium tuberculosis
GSAYGSAWELWHRG

SEQ ID NO: 114618 - protein, 14 aa, Mycobacterium tuberculosis
SAYGSAWELWHRGA

SEQ ID NO: 114619 - protein, 14 aa, Mycobacterium tuberculosis
AYGSAWELWHRGAG

SEQ ID NO: 114620 - protein, 14 aa, Mycobacterium tuberculosis
YGSAWELWHRGAGE

SEQ ID NO: 114621 - protein, 14 aa, Mycobacterium tuberculosis
GSAWELWHRGAGEV

SEQ ID NO: 114622 - protein, 14 aa, Mycobacterium tuberculosis
SAWELWHRGAGEVQ

SEQ ID NO: 114623 - protein, 14 aa, Mycobacterium tuberculosis
AWELWHRGAGEVQL

SEQ ID NO: 114624 - protein, 14 aa, Mycobacterium tuberculosis
WELWHRGAGEVQLG

SEQ ID NO: 114625 - protein, 14 aa, Mycobacterium tuberculosis
ELWHRGAGEVQLGL

SEQ ID NO: 114626 - protein, 14 aa, Mycobacterium tuberculosis
LWHRGAGEVQLGLS

SEQ ID NO: 114627 - protein, 14 aa, Mycobacterium tuberculosis
WHRGAGEVQLGLSM

SEQ ID NO: 114628 - protein, 14 aa, Mycobacterium tuberculosis
HRGAGEVQLGLSML

SEQ ID NO: 114629 - protein, 14 aa, Mycobacterium tuberculosis
RGAGEVQLGLSMLA

SEQ ID NO: 114630 - protein, 14 aa, Mycobacterium tuberculosis
GAGEVQLGLSMLAA

SEQ ID NO: 114631 - protein, 14 aa, Mycobacterium tuberculosis
AGEVQLGLSMLAAA

SEQ ID NO: 114632 - protein, 14 aa, Mycobacterium tuberculosis
GEVQLGLSMLAAAI

SEQ ID NO: 114633 - protein, 14 aa, Mycobacterium tuberculosis
EVQLGLSMLAAAIA

SEQ ID NO: 114634 - protein, 14 aa, Mycobacterium tuberculosis
VQLGLSMLAAAIAH

SEQ ID NO: 114635 - protein, 14 aa, Mycobacterium tuberculosis
QLGLSMLAAAIAHA

SEQ ID NO: 114636 - protein, 14 aa, Mycobacterium tuberculosis
LGLSMLAAAIAHAG

SEQ ID NO: 114637 - protein, 14 aa, Mycobacterium tuberculosis
GLSMLAAAIAHAGA

SEQ ID NO: 114638 - protein, 14 aa, Mycobacterium tuberculosis
LSMLAAAIAHAGAG

SEQ ID NO: 114639 - protein, 14 aa, Mycobacterium tuberculosis
SMLAAAIAHAGAGY

SEQ ID NO: 114640 - protein, 14 aa, Mycobacterium tuberculosis
MLAAAIAHAGAGYQ

SEQ ID NO: 114641 - protein, 14 aa, Mycobacterium tuberculosis
LAAAIAHAGAGYQH

SEQ ID NO: 114642 - protein, 14 aa, Mycobacterium tuberculosis
AAAIAHAGAGYQHN

SEQ ID NO: 114643 - protein, 14 aa, Mycobacterium tuberculosis
AAIAHAGAGYQHNE

SEQ ID NO: 114644 - protein, 14 aa, Mycobacterium tuberculosis
AIAHAGAGYQHNET

SEQ ID NO: 114645 - protein, 14 aa, Mycobacterium tuberculosis
IAHAGAGYQHNETA

SEQ ID NO: 114646 - protein, 14 aa, Mycobacterium tuberculosis
AHAGAGYQHNETAS

SEQ ID NO: 114647 - protein, 14 aa, Mycobacterium tuberculosis
HAGAGYQHNETASA

SEQ ID NO: 114648 - protein, 14 aa, Mycobacterium tuberculosis
AGAGYQHNETASAQ

SEQ ID NO: 114649 - protein, 14 aa, Mycobacterium tuberculosis
GAGYQHNETASAQV

SEQ ID NO: 114650 - protein, 14 aa, Mycobacterium tuberculosis
AGYQHNETASAQVL

SEQ ID NO: 114651 - protein, 14 aa, Mycobacterium tuberculosis
GYQHNETASAQVLR

SEQ ID NO: 114652 - protein, 14 aa, Mycobacterium tuberculosis
YQHNETASAQVLRE

SEQ ID NO: 114653 - protein, 14 aa, Mycobacterium tuberculosis
QHNETASAQVLREV

SEQ ID NO: 114654 - protein, 14 aa, Mycobacterium tuberculosis
HNETASAQVLREVG

SEQ ID NO: 114655 - protein, 14 aa, Mycobacterium tuberculosis
NETASAQVLREVGG

SEQ ID NO: 114656 - protein, 14 aa, Mycobacterium tuberculosis
ETASAQVLREVGGG

SEQ ID NO: 114657 - protein, 15 aa, Mycobacterium tuberculosis
MGADDTLRVEPAVMQ

SEQ ID NO: 114658 - protein, 15 aa, Mycobacterium tuberculosis
GADDTLRVEPAVMQG

SEQ ID NO: 114659 - protein, 15 aa, Mycobacterium tuberculosis
ADDTLRVEPAVMQGF

SEQ ID NO: 114660 - protein, 15 aa, Mycobacterium tuberculosis
DDTLRVEPAVMQGFA

SEQ ID NO: 114661 - protein, 15 aa, Mycobacterium tuberculosis
DTLRVEPAVMQGFAA

SEQ ID NO: 114662 - protein, 15 aa, Mycobacterium tuberculosis
TLRVEPAVMQGFAAS

SEQ ID NO: 114663 - protein, 15 aa, Mycobacterium tuberculosis
LRVEPAVMQGFAASL

SEQ ID NO: 114664 - protein, 15 aa, Mycobacterium tuberculosis
RVEPAVMQGFAASLD

SEQ ID NO: 114665 - protein, 15 aa, Mycobacterium tuberculosis
VEPAVMQGFAASLDG

SEQ ID NO: 114666 - protein, 15 aa, Mycobacterium tuberculosis
EPAVMQGFAASLDGA

SEQ ID NO: 114667 - protein, 15 aa, Mycobacterium tuberculosis
PAVMQGFAASLDGAA

SEQ ID NO: 114668 - protein, 15 aa, Mycobacterium tuberculosis
AVMQGFAASLDGAAE

SEQ ID NO: 114669 - protein, 15 aa, Mycobacterium tuberculosis
VMQGFAASLDGAAEH

SEQ ID NO: 114670 - protein, 15 aa, Mycobacterium tuberculosis
MQGFAASLDGAAEHL

SEQ ID NO: 114671 - protein, 15 aa, Mycobacterium tuberculosis
QGFAASLDGAAEHLA

SEQ ID NO: 114672 - protein, 15 aa, Mycobacterium tuberculosis
GFAASLDGAAEHLAV

SEQ ID NO: 114673 - protein, 15 aa, Mycobacterium tuberculosis
FAASLDGAAEHLAVQ

SEQ ID NO: 114674 - protein, 15 aa, Mycobacterium tuberculosis
AASLDGAAEHLAVQL

SEQ ID NO: 114675 - protein, 15 aa, Mycobacterium tuberculosis
ASLDGAAEHLAVQLA

SEQ ID NO: 114676 - protein, 15 aa, Mycobacterium tuberculosis
SLDGAAEHLAVQLAE

SEQ ID NO: 114677 - protein, 15 aa, Mycobacterium tuberculosis
LDGAAEHLAVQLAEL

SEQ ID NO: 114678 - protein, 15 aa, Mycobacterium tuberculosis
DGAAEHLAVQLAELD

SEQ ID NO: 114679 - protein, 15 aa, Mycobacterium tuberculosis
GAAEHLAVQLAELDA

SEQ ID NO: 114680 - protein, 15 aa, Mycobacterium tuberculosis
AAEHLAVQLAELDAQ

SEQ ID NO: 114681 - protein, 15 aa, Mycobacterium tuberculosis
AEHLAVQLAELDAQV

SEQ ID NO: 114682 - protein, 15 aa, Mycobacterium tuberculosis
EHLAVQLAELDAQVG

SEQ ID NO: 114683 - protein, 15 aa, Mycobacterium tuberculosis
HLAVQLAELDAQVGQ

SEQ ID NO: 114684 - protein, 15 aa, Mycobacterium tuberculosis
LAVQLAELDAQVGQM

SEQ ID NO: 114685 - protein, 15 aa, Mycobacterium tuberculosis
AVQLAELDAQVGQML

SEQ ID NO: 114686 - protein, 15 aa, Mycobacterium tuberculosis
VQLAELDAQVGQMLG

SEQ ID NO: 114687 - protein, 15 aa, Mycobacterium tuberculosis
QLAELDAQVGQMLGG

SEQ ID NO: 114688 - protein, 15 aa, Mycobacterium tuberculosis
LAELDAQVGQMLGGW

SEQ ID NO: 114689 - protein, 15 aa, Mycobacterium tuberculosis
AELDAQVGQMLGGWR

SEQ ID NO: 114690 - protein, 15 aa, Mycobacterium tuberculosis
ELDAQVGQMLGGWRG

SEQ ID NO: 114691 - protein, 15 aa, Mycobacterium tuberculosis
LDAQVGQMLGGWRGA

SEQ ID NO: 114692 - protein, 15 aa, Mycobacterium tuberculosis
DAQVGQMLGGWRGAS

SEQ ID NO: 114693 - protein, 15 aa, Mycobacterium tuberculosis
AQVGQMLGGWRGASG

SEQ ID NO: 114694 - protein, 15 aa, Mycobacterium tuberculosis
QVGQMLGGWRGASGS

SEQ ID NO: 114695 - protein, 15 aa, Mycobacterium tuberculosis
VGQMLGGWRGASGSA

SEQ ID NO: 114696 - protein, 15 aa, Mycobacterium tuberculosis
GQMLGGWRGASGSAY

SEQ ID NO: 114697 - protein, 15 aa, Mycobacterium tuberculosis
QMLGGWRGASGSAYG

SEQ ID NO: 114698 - protein, 15 aa, Mycobacterium tuberculosis
MLGGWRGASGSAYGS

SEQ ID NO: 114699 - protein, 15 aa, Mycobacterium tuberculosis
LGGWRGASGSAYGSA

SEQ ID NO: 114700 - protein, 15 aa, Mycobacterium tuberculosis
GGWRGASGSAYGSAW

SEQ ID NO: 114701 - protein, 15 aa, Mycobacterium tuberculosis
GWRGASGSAYGSAWE

SEQ ID NO: 114702 - protein, 15 aa, Mycobacterium tuberculosis
WRGASGSAYGSAWEL

SEQ ID NO: 114703 - protein, 15 aa, Mycobacterium tuberculosis
RGASGSAYGSAWELW

SEQ ID NO: 114704 - protein, 15 aa, Mycobacterium tuberculosis
GASGSAYGSAWELWH

SEQ ID NO: 114705 - protein, 15 aa, Mycobacterium tuberculosis
ASGSAYGSAWELWHR

SEQ ID NO: 114706 - protein, 15 aa, Mycobacterium tuberculosis
SGSAYGSAWELWHRG

SEQ ID NO: 114707 - protein, 15 aa, Mycobacterium tuberculosis
GSAYGSAWELWHRGA

SEQ ID NO: 114708 - protein, 15 aa, Mycobacterium tuberculosis
SAYGSAWELWHRGAG

SEQ ID NO: 114709 - protein, 15 aa, Mycobacterium tuberculosis
AYGSAWELWHRGAGE

SEQ ID NO: 114710 - protein, 15 aa, Mycobacterium tuberculosis
YGSAWELWHRGAGEV

SEQ ID NO: 114711 - protein, 15 aa, Mycobacterium tuberculosis
GSAWELWHRGAGEVQ

SEQ ID NO: 114712 - protein, 15 aa, Mycobacterium tuberculosis
SAWELWHRGAGEVQL

SEQ ID NO: 114713 - protein, 15 aa, Mycobacterium tuberculosis
AWELWHRGAGEVQLG

SEQ ID NO: 114714 - protein, 15 aa, Mycobacterium tuberculosis
WELWHRGAGEVQLGL

SEQ ID NO: 114715 - protein, 15 aa, Mycobacterium tuberculosis
ELWHRGAGEVQLGLS

SEQ ID NO: 114716 - protein, 15 aa, Mycobacterium tuberculosis
LWHRGAGEVQLGLSM

SEQ ID NO: 114717 - protein, 15 aa, Mycobacterium tuberculosis
WHRGAGEVQLGLSML

SEQ ID NO: 114718 - protein, 15 aa, Mycobacterium tuberculosis
HRGAGEVQLGLSMLA

SEQ ID NO: 114719 - protein, 15 aa, Mycobacterium tuberculosis
RGAGEVQLGLSMLAA

SEQ ID NO: 114720 - protein, 15 aa, Mycobacterium tuberculosis
GAGEVQLGLSMLAAA

SEQ ID NO: 114721 - protein, 15 aa, Mycobacterium tuberculosis
AGEVQLGLSMLAAAI

SEQ ID NO: 114722 - protein, 15 aa, Mycobacterium tuberculosis
GEVQLGLSMLAAAIA

SEQ ID NO: 114723 - protein, 15 aa, Mycobacterium tuberculosis
EVQLGLSMLAAAIAH

SEQ ID NO: 114724 - protein, 15 aa, Mycobacterium tuberculosis
VQLGLSMLAAAIAHA

SEQ ID NO: 114725 - protein, 15 aa, Mycobacterium tuberculosis
QLGLSMLAAAIAHAG

SEQ ID NO: 114726 - protein, 15 aa, Mycobacterium tuberculosis
LGLSMLAAAIAHAGA

SEQ ID NO: 114727 - protein, 15 aa, Mycobacterium tuberculosis
GLSMLAAAIAHAGAG

SEQ ID NO: 114728 - protein, 15 aa, Mycobacterium tuberculosis
LSMLAAAIAHAGAGY

SEQ ID NO: 114729 - protein, 15 aa, Mycobacterium tuberculosis
SMLAAAIAHAGAGYQ

SEQ ID NO: 114730 - protein, 15 aa, Mycobacterium tuberculosis
MLAAAIAHAGAGYQH

SEQ ID NO: 114731 - protein, 15 aa, Mycobacterium tuberculosis
LAAAIAHAGAGYQHN

SEQ ID NO: 114732 - protein, 15 aa, Mycobacterium tuberculosis
AAAIAHAGAGYQHNE

SEQ ID NO: 114733 - protein, 15 aa, Mycobacterium tuberculosis
AAIAHAGAGYQHNET

SEQ ID NO: 114734 - protein, 15 aa, Mycobacterium tuberculosis
AIAHAGAGYQHNETA

SEQ ID NO: 114735 - protein, 15 aa, Mycobacterium tuberculosis
IAHAGAGYQHNETAS

SEQ ID NO: 114736 - protein, 15 aa, Mycobacterium tuberculosis
AHAGAGYQHNETASA

SEQ ID NO: 114737 - protein, 15 aa, Mycobacterium tuberculosis
HAGAGYQHNETASAQ

SEQ ID NO: 114738 - protein, 15 aa, Mycobacterium tuberculosis
AGAGYQHNETASAQV

SEQ ID NO: 114739 - protein, 15 aa, Mycobacterium tuberculosis
GAGYQHNETASAQVL

SEQ ID NO: 114740 - protein, 15 aa, Mycobacterium tuberculosis
AGYQHNETASAQVLR

SEQ ID NO: 114741 - protein, 15 aa, Mycobacterium tuberculosis
GYQHNETASAQVLRE

SEQ ID NO: 114742 - protein, 15 aa, Mycobacterium tuberculosis
YQHNETASAQVLREV

SEQ ID NO: 114743 - protein, 15 aa, Mycobacterium tuberculosis
QHNETASAQVLREVG

SEQ ID NO: 114744 - protein, 15 aa, Mycobacterium tuberculosis
HNETASAQVLREVGG

SEQ ID NO: 114745 - protein, 15 aa, Mycobacterium tuberculosis
NETASAQVLREVGGG

SEQ ID NO: 114746 - protein, 16 aa, Mycobacterium tuberculosis
MGADDTLRVEPAVMQG

SEQ ID NO: 114747 - protein, 16 aa, Mycobacterium tuberculosis
GADDTLRVEPAVMQGF

SEQ ID NO: 114748 - protein, 16 aa, Mycobacterium tuberculosis
ADDTLRVEPAVMQGFA

SEQ ID NO: 114749 - protein, 16 aa, Mycobacterium tuberculosis
DDTLRVEPAVMQGFAA

SEQ ID NO: 114750 - protein, 16 aa, Mycobacterium tuberculosis
DTLRVEPAVMQGFAAS

SEQ ID NO: 114751 - protein, 16 aa, Mycobacterium tuberculosis
TLRVEPAVMQGFAASL

SEQ ID NO: 114752 - protein, 16 aa, Mycobacterium tuberculosis
LRVEPAVMQGFAASLD

SEQ ID NO: 114753 - protein, 16 aa, Mycobacterium tuberculosis
RVEPAVMQGFAASLDG

SEQ ID NO: 114754 - protein, 16 aa, Mycobacterium tuberculosis
VEPAVMQGFAASLDGA

SEQ ID NO: 114755 - protein, 16 aa, Mycobacterium tuberculosis
EPAVMQGFAASLDGAA

SEQ ID NO: 114756 - protein, 16 aa, Mycobacterium tuberculosis
PAVMQGFAASLDGAAE

SEQ ID NO: 114757 - protein, 16 aa, Mycobacterium tuberculosis
AVMQGFAASLDGAAEH

SEQ ID NO: 114758 - protein, 16 aa, Mycobacterium tuberculosis
VMQGFAASLDGAAEHL

SEQ ID NO: 114759 - protein, 16 aa, Mycobacterium tuberculosis
MQGFAASLDGAAEHLA

SEQ ID NO: 114760 - protein, 16 aa, Mycobacterium tuberculosis
QGFAASLDGAAEHLAV

SEQ ID NO: 114761 - protein, 16 aa, Mycobacterium tuberculosis
GFAASLDGAAEHLAVQ

SEQ ID NO: 114762 - protein, 16 aa, Mycobacterium tuberculosis
FAASLDGAAEHLAVQL

SEQ ID NO: 114763 - protein, 16 aa, Mycobacterium tuberculosis
AASLDGAAEHLAVQLA

SEQ ID NO: 114764 - protein, 16 aa, Mycobacterium tuberculosis
ASLDGAAEHLAVQLAE

SEQ ID NO: 114765 - protein, 16 aa, Mycobacterium tuberculosis
SLDGAAEHLAVQLAEL

SEQ ID NO: 114766 - protein, 16 aa, Mycobacterium tuberculosis
LDGAAEHLAVQLAELD

SEQ ID NO: 114767 - protein, 16 aa, Mycobacterium tuberculosis
DGAAEHLAVQLAELDA

SEQ ID NO: 114768 - protein, 16 aa, Mycobacterium tuberculosis
GAAEHLAVQLAELDAQ

SEQ ID NO: 114769 - protein, 16 aa, Mycobacterium tuberculosis
AAEHLAVQLAELDAQV

SEQ ID NO: 114770 - protein, 16 aa, Mycobacterium tuberculosis
AEHLAVQLAELDAQVG

SEQ ID NO: 114771 - protein, 16 aa, Mycobacterium tuberculosis
EHLAVQLAELDAQVGQ

SEQ ID NO: 114772 - protein, 16 aa, Mycobacterium tuberculosis
HLAVQLAELDAQVGQM

SEQ ID NO: 114773 - protein, 16 aa, Mycobacterium tuberculosis
LAVQLAELDAQVGQML

SEQ ID NO: 114774 - protein, 16 aa, Mycobacterium tuberculosis
AVQLAELDAQVGQMLG

SEQ ID NO: 114775 - protein, 16 aa, Mycobacterium tuberculosis
VQLAELDAQVGQMLGG

SEQ ID NO: 114776 - protein, 16 aa, Mycobacterium tuberculosis
QLAELDAQVGQMLGGW

SEQ ID NO: 114777 - protein, 16 aa, Mycobacterium tuberculosis
LAELDAQVGQMLGGWR

SEQ ID NO: 114778 - protein, 16 aa, Mycobacterium tuberculosis
AELDAQVGQMLGGWRG

SEQ ID NO: 114779 - protein, 16 aa, Mycobacterium tuberculosis
ELDAQVGQMLGGWRGA

SEQ ID NO: 114780 - protein, 16 aa, Mycobacterium tuberculosis
LDAQVGQMLGGWRGAS

SEQ ID NO: 114781 - protein, 16 aa, Mycobacterium tuberculosis
DAQVGQMLGGWRGASG

SEQ ID NO: 114782 - protein, 16 aa, Mycobacterium tuberculosis
AQVGQMLGGWRGASGS

SEQ ID NO: 114783 - protein, 16 aa, Mycobacterium tuberculosis
QVGQMLGGWRGASGSA

SEQ ID NO: 114784 - protein, 16 aa, Mycobacterium tuberculosis
VGQMLGGWRGASGSAY

SEQ ID NO: 114785 - protein, 16 aa, Mycobacterium tuberculosis
GQMLGGWRGASGSAYG

SEQ ID NO: 114786 - protein, 16 aa, Mycobacterium tuberculosis
QMLGGWRGASGSAYGS

SEQ ID NO: 114787 - protein, 16 aa, Mycobacterium tuberculosis
MLGGWRGASGSAYGSA

SEQ ID NO: 114788 - protein, 16 aa, Mycobacterium tuberculosis
LGGWRGASGSAYGSAW

SEQ ID NO: 114789 - protein, 16 aa, Mycobacterium tuberculosis
GGWRGASGSAYGSAWE

SEQ ID NO: 114790 - protein, 16 aa, Mycobacterium tuberculosis
GWRGASGSAYGSAWEL

SEQ ID NO: 114791 - protein, 16 aa, Mycobacterium tuberculosis
WRGASGSAYGSAWELW

SEQ ID NO: 114792 - protein, 16 aa, Mycobacterium tuberculosis
RGASGSAYGSAWELWH

SEQ ID NO: 114793 - protein, 16 aa, Mycobacterium tuberculosis
GASGSAYGSAWELWHR

SEQ ID NO: 114794 - protein, 16 aa, Mycobacterium tuberculosis
ASGSAYGSAWELWHRG

SEQ ID NO: 114795 - protein, 16 aa, Mycobacterium tuberculosis
SGSAYGSAWELWHRGA

SEQ ID NO: 114796 - protein, 16 aa, Mycobacterium tuberculosis
GSAYGSAWELWHRGAG

SEQ ID NO: 114797 - protein, 16 aa, Mycobacterium tuberculosis
SAYGSAWELWHRGAGE

SEQ ID NO: 114798 - protein, 16 aa, Mycobacterium tuberculosis
AYGSAWELWHRGAGEV

SEQ ID NO: 114799 - protein, 16 aa, Mycobacterium tuberculosis
YGSAWELWHRGAGEVQ

SEQ ID NO: 114800 - protein, 16 aa, Mycobacterium tuberculosis
GSAWELWHRGAGEVQL

SEQ ID NO: 114801 - protein, 16 aa, Mycobacterium tuberculosis
SAWELWHRGAGEVQLG

SEQ ID NO: 114802 - protein, 16 aa, Mycobacterium tuberculosis
AWELWHRGAGEVQLGL

SEQ ID NO: 114803 - protein, 16 aa, Mycobacterium tuberculosis
WELWHRGAGEVQLGLS

SEQ ID NO: 114804 - protein, 16 aa, Mycobacterium tuberculosis
ELWHRGAGEVQLGLSM

SEQ ID NO: 114805 - protein, 16 aa, Mycobacterium tuberculosis
LWHRGAGEVQLGLSML

SEQ ID NO: 114806 - protein, 16 aa, Mycobacterium tuberculosis
WHRGAGEVQLGLSMLA

SEQ ID NO: 114807 - protein, 16 aa, Mycobacterium tuberculosis
HRGAGEVQLGLSMLAA

SEQ ID NO: 114808 - protein, 16 aa, Mycobacterium tuberculosis
RGAGEVQLGLSMLAAA

SEQ ID NO: 114809 - protein, 16 aa, Mycobacterium tuberculosis
GAGEVQLGLSMLAAAI

SEQ ID NO: 114810 - protein, 16 aa, Mycobacterium tuberculosis
AGEVQLGLSMLAAAIA

SEQ ID NO: 114811 - protein, 16 aa, Mycobacterium tuberculosis
GEVQLGLSMLAAAIAH

SEQ ID NO: 114812 - protein, 16 aa, Mycobacterium tuberculosis
EVQLGLSMLAAAIAHA

SEQ ID NO: 114813 - protein, 16 aa, Mycobacterium tuberculosis
VQLGLSMLAAAIAHAG

SEQ ID NO: 114814 - protein, 16 aa, Mycobacterium tuberculosis
QLGLSMLAAAIAHAGA

SEQ ID NO: 114815 - protein, 16 aa, Mycobacterium tuberculosis
LGLSMLAAAIAHAGAG

SEQ ID NO: 114816 - protein, 16 aa, Mycobacterium tuberculosis
GLSMLAAAIAHAGAGY

SEQ ID NO: 114817 - protein, 16 aa, Mycobacterium tuberculosis
LSMLAAAIAHAGAGYQ

SEQ ID NO: 114818 - protein, 16 aa, Mycobacterium tuberculosis
SMLAAAIAHAGAGYQH

SEQ ID NO: 114819 - protein, 16 aa, Mycobacterium tuberculosis
MLAAAIAHAGAGYQHN

SEQ ID NO: 114820 - protein, 16 aa, Mycobacterium tuberculosis
LAAAIAHAGAGYQHNE

SEQ ID NO: 114821 - protein, 16 aa, Mycobacterium tuberculosis
AAAIAHAGAGYQHNET

SEQ ID NO: 114822 - protein, 16 aa, Mycobacterium tuberculosis
AAIAHAGAGYQHNETA

SEQ ID NO: 114823 - protein, 16 aa, Mycobacterium tuberculosis
AIAHAGAGYQHNETAS

SEQ ID NO: 114824 - protein, 16 aa, Mycobacterium tuberculosis
IAHAGAGYQHNETASA

SEQ ID NO: 114825 - protein, 16 aa, Mycobacterium tuberculosis
AHAGAGYQHNETASAQ

SEQ ID NO: 114826 - protein, 16 aa, Mycobacterium tuberculosis
HAGAGYQHNETASAQV

SEQ ID NO: 114827 - protein, 16 aa, Mycobacterium tuberculosis
AGAGYQHNETASAQVL

SEQ ID NO: 114828 - protein, 16 aa, Mycobacterium tuberculosis
GAGYQHNETASAQVLR

SEQ ID NO: 114829 - protein, 16 aa, Mycobacterium tuberculosis
AGYQHNETASAQVLRE

SEQ ID NO: 114830 - protein, 16 aa, Mycobacterium tuberculosis
GYQHNETASAQVLREV

SEQ ID NO: 114831 - protein, 16 aa, Mycobacterium tuberculosis
YQHNETASAQVLREVG

SEQ ID NO: 114832 - protein, 16 aa, Mycobacterium tuberculosis
QHNETASAQVLREVGG

SEQ ID NO: 114833 - protein, 16 aa, Mycobacterium tuberculosis
HNETASAQVLREVGGG

SEQ ID NO: 114834 - protein, 13 aa, Mycobacterium tuberculosis
MSRQASRQVSIIR

SEQ ID NO: 114835 - protein, 13 aa, Mycobacterium tuberculosis
SRQASRQVSIIRS

SEQ ID NO: 114836 - protein, 13 aa, Mycobacterium tuberculosis
RQASRQVSIIRSA

SEQ ID NO: 114837 - protein, 13 aa, Mycobacterium tuberculosis
QASRQVSIIRSAG

SEQ ID NO: 114838 - protein, 13 aa, Mycobacterium tuberculosis
ASRQVSIIRSAGD

SEQ ID NO: 114839 - protein, 13 aa, Mycobacterium tuberculosis
SRQVSIIRSAGDG

SEQ ID NO: 114840 - protein, 13 aa, Mycobacterium tuberculosis
RQVSIIRSAGDGN

SEQ ID NO: 114841 - protein, 13 aa, Mycobacterium tuberculosis
QVSIIRSAGDGNR

SEQ ID NO: 114842 - protein, 13 aa, Mycobacterium tuberculosis
VSIIRSAGDGNRS

SEQ ID NO: 114843 - protein, 13 aa, Mycobacterium tuberculosis
SIIRSAGDGNRSC

SEQ ID NO: 114844 - protein, 13 aa, Mycobacterium tuberculosis
IIRSAGDGNRSCG

SEQ ID NO: 114845 - protein, 13 aa, Mycobacterium tuberculosis
IRSAGDGNRSCGC

SEQ ID NO: 114846 - protein, 13 aa, Mycobacterium tuberculosis
RSAGDGNRSCGCV

SEQ ID NO: 114847 - protein, 13 aa, Mycobacterium tuberculosis
SAGDGNRSCGCVT

SEQ ID NO: 114848 - protein, 13 aa, Mycobacterium tuberculosis
AGDGNRSCGCVTP

SEQ ID NO: 114849 - protein, 13 aa, Mycobacterium tuberculosis
GDGNRSCGCVTPK

SEQ ID NO: 114850 - protein, 13 aa, Mycobacterium tuberculosis
DGNRSCGCVTPKE

SEQ ID NO: 114851 - protein, 13 aa, Mycobacterium tuberculosis
GNRSCGCVTPKEG

SEQ ID NO: 114852 - protein, 13 aa, Mycobacterium tuberculosis
NRSCGCVTPKEGV

SEQ ID NO: 114853 - protein, 13 aa, Mycobacterium tuberculosis
RSCGCVTPKEGVW

SEQ ID NO: 114854 - protein, 13 aa, Mycobacterium tuberculosis
SCGCVTPKEGVWV

SEQ ID NO: 114855 - protein, 13 aa, Mycobacterium tuberculosis
CGCVTPKEGVWVV

SEQ ID NO: 114856 - protein, 13 aa, Mycobacterium tuberculosis
GCVTPKEGVWVVT

SEQ ID NO: 114857 - protein, 13 aa, Mycobacterium tuberculosis
CVTPKEGVWVVTL

SEQ ID NO: 114858 - protein, 13 aa, Mycobacterium tuberculosis
VTPKEGVWVVTLR

SEQ ID NO: 114859 - protein, 13 aa, Mycobacterium tuberculosis
TPKEGVWVVTLRV

SEQ ID NO: 114860 - protein, 13 aa, Mycobacterium tuberculosis
PKEGVWVVTLRVV

SEQ ID NO: 114861 - protein, 13 aa, Mycobacterium tuberculosis
KEGVWVVTLRVVP

SEQ ID NO: 114862 - protein, 13 aa, Mycobacterium tuberculosis
EGVWVVTLRVVPE

SEQ ID NO: 114863 - protein, 13 aa, Mycobacterium tuberculosis
GVWVVTLRVVPEG

SEQ ID NO: 114864 - protein, 13 aa, Mycobacterium tuberculosis
VWVVTLRVVPEGL

SEQ ID NO: 114865 - protein, 13 aa, Mycobacterium tuberculosis
WVVTLRVVPEGLA

SEQ ID NO: 114866 - protein, 13 aa, Mycobacterium tuberculosis
VVTLRVVPEGLAA

SEQ ID NO: 114867 - protein, 13 aa, Mycobacterium tuberculosis
VTLRVVPEGLAAA

SEQ ID NO: 114868 - protein, 13 aa, Mycobacterium tuberculosis
TLRVVPEGLAAAS

SEQ ID NO: 114869 - protein, 13 aa, Mycobacterium tuberculosis
LRVVPEGLAAASA

SEQ ID NO: 114870 - protein, 13 aa, Mycobacterium tuberculosis
RVVPEGLAAASAA

SEQ ID NO: 114871 - protein, 13 aa, Mycobacterium tuberculosis
VVPEGLAAASAAV

SEQ ID NO: 114872 - protein, 13 aa, Mycobacterium tuberculosis
VPEGLAAASAAVE

SEQ ID NO: 114873 - protein, 13 aa, Mycobacterium tuberculosis
PEGLAAASAAVEA

SEQ ID NO: 114874 - protein, 13 aa, Mycobacterium tuberculosis
EGLAAASAAVEAL

SEQ ID NO: 114875 - protein, 13 aa, Mycobacterium tuberculosis
GLAAASAAVEALT

SEQ ID NO: 114876 - protein, 13 aa, Mycobacterium tuberculosis
LAAASAAVEALTA

SEQ ID NO: 114877 - protein, 13 aa, Mycobacterium tuberculosis
AAASAAVEALTAR

SEQ ID NO: 114878 - protein, 13 aa, Mycobacterium tuberculosis
AASAAVEALTARL

SEQ ID NO: 114879 - protein, 13 aa, Mycobacterium tuberculosis
ASAAVEALTARLA

SEQ ID NO: 114880 - protein, 13 aa, Mycobacterium tuberculosis
SAAVEALTARLAA

SEQ ID NO: 114881 - protein, 13 aa, Mycobacterium tuberculosis
AAVEALTARLAAA

SEQ ID NO: 114882 - protein, 13 aa, Mycobacterium tuberculosis
AVEALTARLAAAH

SEQ ID NO: 114883 - protein, 13 aa, Mycobacterium tuberculosis
VEALTARLAAAHA

SEQ ID NO: 114884 - protein, 13 aa, Mycobacterium tuberculosis
EALTARLAAAHAG

SEQ ID NO: 114885 - protein, 13 aa, Mycobacterium tuberculosis
ALTARLAAAHAGA

SEQ ID NO: 114886 - protein, 13 aa, Mycobacterium tuberculosis
LTARLAAAHAGAA

SEQ ID NO: 114887 - protein, 13 aa, Mycobacterium tuberculosis
TARLAAAHAGAAP

SEQ ID NO: 114888 - protein, 13 aa, Mycobacterium tuberculosis
ARLAAAHAGAAPA

SEQ ID NO: 114889 - protein, 13 aa, Mycobacterium tuberculosis
RLAAAHAGAAPAI

SEQ ID NO: 114890 - protein, 13 aa, Mycobacterium tuberculosis
LAAAHAGAAPAIT

SEQ ID NO: 114891 - protein, 13 aa, Mycobacterium tuberculosis
AAAHAGAAPAITA

SEQ ID NO: 114892 - protein, 13 aa, Mycobacterium tuberculosis
AAHAGAAPAITAV

SEQ ID NO: 114893 - protein, 13 aa, Mycobacterium tuberculosis
AHAGAAPAITAVV

SEQ ID NO: 114894 - protein, 13 aa, Mycobacterium tuberculosis
HAGAAPAITAVVA

SEQ ID NO: 114895 - protein, 13 aa, Mycobacterium tuberculosis
AGAAPAITAVVAP

SEQ ID NO: 114896 - protein, 13 aa, Mycobacterium tuberculosis
GAAPAITAVVAPA

SEQ ID NO: 114897 - protein, 13 aa, Mycobacterium tuberculosis
AAPAITAVVAPAA

SEQ ID NO: 114898 - protein, 13 aa, Mycobacterium tuberculosis
APAITAVVAPAAD

SEQ ID NO: 114899 - protein, 13 aa, Mycobacterium tuberculosis
PAITAVVAPAADP

SEQ ID NO: 114900 - protein, 13 aa, Mycobacterium tuberculosis
AITAVVAPAADPV

SEQ ID NO: 114901 - protein, 13 aa, Mycobacterium tuberculosis
ITAVVAPAADPVS

SEQ ID NO: 114902 - protein, 13 aa, Mycobacterium tuberculosis
TAVVAPAADPVSL

SEQ ID NO: 114903 - protein, 13 aa, Mycobacterium tuberculosis
AVVAPAADPVSLQ

SEQ ID NO: 114904 - protein, 13 aa, Mycobacterium tuberculosis
VVAPAADPVSLQS

SEQ ID NO: 114905 - protein, 13 aa, Mycobacterium tuberculosis
VAPAADPVSLQSA

SEQ ID NO: 114906 - protein, 13 aa, Mycobacterium tuberculosis
APAADPVSLQSAV

SEQ ID NO: 114907 - protein, 13 aa, Mycobacterium tuberculosis
PAADPVSLQSAVG

SEQ ID NO: 114908 - protein, 13 aa, Mycobacterium tuberculosis
AADPVSLQSAVGF

SEQ ID NO: 114909 - protein, 13 aa, Mycobacterium tuberculosis
ADPVSLQSAVGFS

SEQ ID NO: 114910 - protein, 13 aa, Mycobacterium tuberculosis
DPVSLQSAVGFSA

SEQ ID NO: 114911 - protein, 13 aa, Mycobacterium tuberculosis
PVSLQSAVGFSAL

SEQ ID NO: 114912 - protein, 13 aa, Mycobacterium tuberculosis
VSLQSAVGFSALG

SEQ ID NO: 114913 - protein, 13 aa, Mycobacterium tuberculosis
SLQSAVGFSALGS

SEQ ID NO: 114914 - protein, 13 aa, Mycobacterium tuberculosis
LQSAVGFSALGSE

SEQ ID NO: 114915 - protein, 13 aa, Mycobacterium tuberculosis
QSAVGFSALGSEH

SEQ ID NO: 114916 - protein, 13 aa, Mycobacterium tuberculosis
SAVGFSALGSEHA

SEQ ID NO: 114917 - protein, 13 aa, Mycobacterium tuberculosis
AVGFSALGSEHAA

SEQ ID NO: 114918 - protein, 13 aa, Mycobacterium tuberculosis
VGFSALGSEHAAI

SEQ ID NO: 114919 - protein, 13 aa, Mycobacterium tuberculosis
GFSALGSEHAAIA

SEQ ID NO: 114920 - protein, 13 aa, Mycobacterium tuberculosis
FSALGSEHAAIAG

SEQ ID NO: 114921 - protein, 13 aa, Mycobacterium tuberculosis
SALGSEHAAIAGE

SEQ ID NO: 114922 - protein, 13 aa, Mycobacterium tuberculosis
ALGSEHAAIAGEG

SEQ ID NO: 114923 - protein, 13 aa, Mycobacterium tuberculosis
LGSEHAAIAGEGV

SEQ ID NO: 114924 - protein, 13 aa, Mycobacterium tuberculosis
GSEHAAIAGEGVE

SEQ ID NO: 114925 - protein, 13 aa, Mycobacterium tuberculosis
SEHAAIAGEGVEE

SEQ ID NO: 114926 - protein, 13 aa, Mycobacterium tuberculosis
EHAAIAGEGVEEL

SEQ ID NO: 114927 - protein, 13 aa, Mycobacterium tuberculosis
HAAIAGEGVEELG

SEQ ID NO: 114928 - protein, 13 aa, Mycobacterium tuberculosis
AAIAGEGVEELGR

SEQ ID NO: 114929 - protein, 13 aa, Mycobacterium tuberculosis
AIAGEGVEELGRS

SEQ ID NO: 114930 - protein, 13 aa, Mycobacterium tuberculosis
IAGEGVEELGRSG

SEQ ID NO: 114931 - protein, 13 aa, Mycobacterium tuberculosis
AGEGVEELGRSGV

SEQ ID NO: 114932 - protein, 13 aa, Mycobacterium tuberculosis
GEGVEELGRSGVA

SEQ ID NO: 114933 - protein, 13 aa, Mycobacterium tuberculosis
EGVEELGRSGVAV

SEQ ID NO: 114934 - protein, 13 aa, Mycobacterium tuberculosis
GVEELGRSGVAVG

SEQ ID NO: 114935 - protein, 13 aa, Mycobacterium tuberculosis
VEELGRSGVAVGE

SEQ ID NO: 114936 - protein, 13 aa, Mycobacterium tuberculosis
EELGRSGVAVGES

SEQ ID NO: 114937 - protein, 13 aa, Mycobacterium tuberculosis
ELGRSGVAVGESG

SEQ ID NO: 114938 - protein, 13 aa, Mycobacterium tuberculosis
LGRSGVAVGESGI

SEQ ID NO: 114939 - protein, 13 aa, Mycobacterium tuberculosis
GRSGVAVGESGIG

SEQ ID NO: 114940 - protein, 13 aa, Mycobacterium tuberculosis
RSGVAVGESGIGY

SEQ ID NO: 114941 - protein, 13 aa, Mycobacterium tuberculosis
SGVAVGESGIGYA

SEQ ID NO: 114942 - protein, 13 aa, Mycobacterium tuberculosis
GVAVGESGIGYAA

SEQ ID NO: 114943 - protein, 13 aa, Mycobacterium tuberculosis
VAVGESGIGYAAG

SEQ ID NO: 114944 - protein, 13 aa, Mycobacterium tuberculosis
AVGESGIGYAAGD

SEQ ID NO: 114945 - protein, 13 aa, Mycobacterium tuberculosis
VGESGIGYAAGDA

SEQ ID NO: 114946 - protein, 13 aa, Mycobacterium tuberculosis
GESGIGYAAGDAV

SEQ ID NO: 114947 - protein, 13 aa, Mycobacterium tuberculosis
ESGIGYAAGDAVA

SEQ ID NO: 114948 - protein, 13 aa, Mycobacterium tuberculosis
SGIGYAAGDAVAA

SEQ ID NO: 114949 - protein, 13 aa, Mycobacterium tuberculosis
GIGYAAGDAVAAA

SEQ ID NO: 114950 - protein, 13 aa, Mycobacterium tuberculosis
IGYAAGDAVAAAT

SEQ ID NO: 114951 - protein, 13 aa, Mycobacterium tuberculosis
GYAAGDAVAAATY

SEQ ID NO: 114952 - protein, 13 aa, Mycobacterium tuberculosis
YAAGDAVAAATYL

SEQ ID NO: 114953 - protein, 13 aa, Mycobacterium tuberculosis
AAGDAVAAATYLV

SEQ ID NO: 114954 - protein, 13 aa, Mycobacterium tuberculosis
AGDAVAAATYLVS

SEQ ID NO: 114955 - protein, 13 aa, Mycobacterium tuberculosis
GDAVAAATYLVSG

SEQ ID NO: 114956 - protein, 13 aa, Mycobacterium tuberculosis
DAVAAATYLVSGG

SEQ ID NO: 114957 - protein, 13 aa, Mycobacterium tuberculosis
AVAAATYLVSGGS

SEQ ID NO: 114958 - protein, 13 aa, Mycobacterium tuberculosis
VAAATYLVSGGSL

SEQ ID NO: 114959 - protein, 14 aa, Mycobacterium tuberculosis
MSRQASRQVSIIRS

SEQ ID NO: 114960 - protein, 14 aa, Mycobacterium tuberculosis
SRQASRQVSIIRSA

SEQ ID NO: 114961 - protein, 14 aa, Mycobacterium tuberculosis
RQASRQVSIIRSAG

SEQ ID NO: 114962 - protein, 14 aa, Mycobacterium tuberculosis
QASRQVSIIRSAGD

SEQ ID NO: 114963 - protein, 14 aa, Mycobacterium tuberculosis
ASRQVSIIRSAGDG

SEQ ID NO: 114964 - protein, 14 aa, Mycobacterium tuberculosis
SRQVSIIRSAGDGN

SEQ ID NO: 114965 - protein, 14 aa, Mycobacterium tuberculosis
RQVSIIRSAGDGNR

SEQ ID NO: 114966 - protein, 14 aa, Mycobacterium tuberculosis
QVSIIRSAGDGNRS

SEQ ID NO: 114967 - protein, 14 aa, Mycobacterium tuberculosis
VSIIRSAGDGNRSC

SEQ ID NO: 114968 - protein, 14 aa, Mycobacterium tuberculosis
SIIRSAGDGNRSCG

SEQ ID NO: 114969 - protein, 14 aa, Mycobacterium tuberculosis
IIRSAGDGNRSCGC

SEQ ID NO: 114970 - protein, 14 aa, Mycobacterium tuberculosis
IRSAGDGNRSCGCV

SEQ ID NO: 114971 - protein, 14 aa, Mycobacterium tuberculosis
RSAGDGNRSCGCVT

SEQ ID NO: 114972 - protein, 14 aa, Mycobacterium tuberculosis
SAGDGNRSCGCVTP

SEQ ID NO: 114973 - protein, 14 aa, Mycobacterium tuberculosis
AGDGNRSCGCVTPK

SEQ ID NO: 114974 - protein, 14 aa, Mycobacterium tuberculosis
GDGNRSCGCVTPKE

SEQ ID NO: 114975 - protein, 14 aa, Mycobacterium tuberculosis
DGNRSCGCVTPKEG

SEQ ID NO: 114976 - protein, 14 aa, Mycobacterium tuberculosis
GNRSCGCVTPKEGV

SEQ ID NO: 114977 - protein, 14 aa, Mycobacterium tuberculosis
NRSCGCVTPKEGVW

SEQ ID NO: 114978 - protein, 14 aa, Mycobacterium tuberculosis
RSCGCVTPKEGVWV

SEQ ID NO: 114979 - protein, 14 aa, Mycobacterium tuberculosis
SCGCVTPKEGVWVV

SEQ ID NO: 114980 - protein, 14 aa, Mycobacterium tuberculosis
CGCVTPKEGVWVVT

SEQ ID NO: 114981 - protein, 14 aa, Mycobacterium tuberculosis
GCVTPKEGVWVVTL

SEQ ID NO: 114982 - protein, 14 aa, Mycobacterium tuberculosis
CVTPKEGVWVVTLR

SEQ ID NO: 114983 - protein, 14 aa, Mycobacterium tuberculosis
VTPKEGVWVVTLRV

SEQ ID NO: 114984 - protein, 14 aa, Mycobacterium tuberculosis
TPKEGVWVVTLRVV

SEQ ID NO: 114985 - protein, 14 aa, Mycobacterium tuberculosis
PKEGVWVVTLRVVP

SEQ ID NO: 114986 - protein, 14 aa, Mycobacterium tuberculosis
KEGVWVVTLRVVPE

SEQ ID NO: 114987 - protein, 14 aa, Mycobacterium tuberculosis
EGVWVVTLRVVPEG

SEQ ID NO: 114988 - protein, 14 aa, Mycobacterium tuberculosis
GVWVVTLRVVPEGL

SEQ ID NO: 114989 - protein, 14 aa, Mycobacterium tuberculosis
VWVVTLRVVPEGLA

SEQ ID NO: 114990 - protein, 14 aa, Mycobacterium tuberculosis
WVVTLRVVPEGLAA

SEQ ID NO: 114991 - protein, 14 aa, Mycobacterium tuberculosis
VVTLRVVPEGLAAA

SEQ ID NO: 114992 - protein, 14 aa, Mycobacterium tuberculosis
VTLRVVPEGLAAAS

SEQ ID NO: 114993 - protein, 14 aa, Mycobacterium tuberculosis
TLRVVPEGLAAASA

SEQ ID NO: 114994 - protein, 14 aa, Mycobacterium tuberculosis
LRVVPEGLAAASAA

SEQ ID NO: 114995 - protein, 14 aa, Mycobacterium tuberculosis
RVVPEGLAAASAAV

SEQ ID NO: 114996 - protein, 14 aa, Mycobacterium tuberculosis
VVPEGLAAASAAVE

SEQ ID NO: 114997 - protein, 14 aa, Mycobacterium tuberculosis
VPEGLAAASAAVEA

SEQ ID NO: 114998 - protein, 14 aa, Mycobacterium tuberculosis
PEGLAAASAAVEAL

SEQ ID NO: 114999 - protein, 14 aa, Mycobacterium tuberculosis
EGLAAASAAVEALT

SEQ ID NO: 115000 - protein, 14 aa, Mycobacterium tuberculosis
GLAAASAAVEALTA

SEQ ID NO: 115001 - protein, 14 aa, Mycobacterium tuberculosis
LAAASAAVEALTAR

SEQ ID NO: 115002 - protein, 14 aa, Mycobacterium tuberculosis
AAASAAVEALTARL

SEQ ID NO: 115003 - protein, 14 aa, Mycobacterium tuberculosis
AASAAVEALTARLA

SEQ ID NO: 115004 - protein, 14 aa, Mycobacterium tuberculosis
ASAAVEALTARLAA

SEQ ID NO: 115005 - protein, 14 aa, Mycobacterium tuberculosis
SAAVEALTARLAAA

SEQ ID NO: 115006 - protein, 14 aa, Mycobacterium tuberculosis
AAVEALTARLAAAH

SEQ ID NO: 115007 - protein, 14 aa, Mycobacterium tuberculosis
AVEALTARLAAAHA

SEQ ID NO: 115008 - protein, 14 aa, Mycobacterium tuberculosis
VEALTARLAAAHAG

SEQ ID NO: 115009 - protein, 14 aa, Mycobacterium tuberculosis
EALTARLAAAHAGA

SEQ ID NO: 115010 - protein, 14 aa, Mycobacterium tuberculosis
ALTARLAAAHAGAA

SEQ ID NO: 115011 - protein, 14 aa, Mycobacterium tuberculosis
LTARLAAAHAGAAP

SEQ ID NO: 115012 - protein, 14 aa, Mycobacterium tuberculosis
TARLAAAHAGAAPA

SEQ ID NO: 115013 - protein, 14 aa, Mycobacterium tuberculosis
ARLAAAHAGAAPAI

SEQ ID NO: 115014 - protein, 14 aa, Mycobacterium tuberculosis
RLAAAHAGAAPAIT

SEQ ID NO: 115015 - protein, 14 aa, Mycobacterium tuberculosis
LAAAHAGAAPAITA

SEQ ID NO: 115016 - protein, 14 aa, Mycobacterium tuberculosis
AAAHAGAAPAITAV

SEQ ID NO: 115017 - protein, 14 aa, Mycobacterium tuberculosis
AAHAGAAPAITAVV

SEQ ID NO: 115018 - protein, 14 aa, Mycobacterium tuberculosis
AHAGAAPAITAVVA

SEQ ID NO: 115019 - protein, 14 aa, Mycobacterium tuberculosis
HAGAAPAITAVVAP

SEQ ID NO: 115020 - protein, 14 aa, Mycobacterium tuberculosis
AGAAPAITAVVAPA

SEQ ID NO: 115021 - protein, 14 aa, Mycobacterium tuberculosis
GAAPAITAVVAPAA

SEQ ID NO: 115022 - protein, 14 aa, Mycobacterium tuberculosis
AAPAITAVVAPAAD

SEQ ID NO: 115023 - protein, 14 aa, Mycobacterium tuberculosis
APAITAVVAPAADP

SEQ ID NO: 115024 - protein, 14 aa, Mycobacterium tuberculosis
PAITAVVAPAADPV

SEQ ID NO: 115025 - protein, 14 aa, Mycobacterium tuberculosis
AITAVVAPAADPVS

SEQ ID NO: 115026 - protein, 14 aa, Mycobacterium tuberculosis
ITAVVAPAADPVSL

SEQ ID NO: 115027 - protein, 14 aa, Mycobacterium tuberculosis
TAVVAPAADPVSLQ

SEQ ID NO: 115028 - protein, 14 aa, Mycobacterium tuberculosis
AVVAPAADPVSLQS

SEQ ID NO: 115029 - protein, 14 aa, Mycobacterium tuberculosis
VVAPAADPVSLQSA

SEQ ID NO: 115030 - protein, 14 aa, Mycobacterium tuberculosis
VAPAADPVSLQSAV

SEQ ID NO: 115031 - protein, 14 aa, Mycobacterium tuberculosis
APAADPVSLQSAVG

SEQ ID NO: 115032 - protein, 14 aa, Mycobacterium tuberculosis
PAADPVSLQSAVGF

SEQ ID NO: 115033 - protein, 14 aa, Mycobacterium tuberculosis
AADPVSLQSAVGFS

SEQ ID NO: 115034 - protein, 14 aa, Mycobacterium tuberculosis
ADPVSLQSAVGFSA

SEQ ID NO: 115035 - protein, 14 aa, Mycobacterium tuberculosis
DPVSLQSAVGFSAL

SEQ ID NO: 115036 - protein, 14 aa, Mycobacterium tuberculosis
PVSLQSAVGFSALG

SEQ ID NO: 115037 - protein, 14 aa, Mycobacterium tuberculosis
VSLQSAVGFSALGS

SEQ ID NO: 115038 - protein, 14 aa, Mycobacterium tuberculosis
SLQSAVGFSALGSE

SEQ ID NO: 115039 - protein, 14 aa, Mycobacterium tuberculosis
LQSAVGFSALGSEH

SEQ ID NO: 115040 - protein, 14 aa, Mycobacterium tuberculosis
QSAVGFSALGSEHA

SEQ ID NO: 115041 - protein, 14 aa, Mycobacterium tuberculosis
SAVGFSALGSEHAA

SEQ ID NO: 115042 - protein, 14 aa, Mycobacterium tuberculosis
AVGFSALGSEHAAI

SEQ ID NO: 115043 - protein, 14 aa, Mycobacterium tuberculosis
VGFSALGSEHAAIA

SEQ ID NO: 115044 - protein, 14 aa, Mycobacterium tuberculosis
GFSALGSEHAAIAG

SEQ ID NO: 115045 - protein, 14 aa, Mycobacterium tuberculosis
FSALGSEHAAIAGE

SEQ ID NO: 115046 - protein, 14 aa, Mycobacterium tuberculosis
SALGSEHAAIAGEG

SEQ ID NO: 115047 - protein, 14 aa, Mycobacterium tuberculosis
ALGSEHAAIAGEGV

SEQ ID NO: 115048 - protein, 14 aa, Mycobacterium tuberculosis
LGSEHAAIAGEGVE

SEQ ID NO: 115049 - protein, 14 aa, Mycobacterium tuberculosis
GSEHAAIAGEGVEE

SEQ ID NO: 115050 - protein, 14 aa, Mycobacterium tuberculosis
SEHAAIAGEGVEEL

SEQ ID NO: 115051 - protein, 14 aa, Mycobacterium tuberculosis
EHAAIAGEGVEELG

SEQ ID NO: 115052 - protein, 14 aa, Mycobacterium tuberculosis
HAAIAGEGVEELGR

SEQ ID NO: 115053 - protein, 14 aa, Mycobacterium tuberculosis
AAIAGEGVEELGRS

SEQ ID NO: 115054 - protein, 14 aa, Mycobacterium tuberculosis
AIAGEGVEELGRSG

SEQ ID NO: 115055 - protein, 14 aa, Mycobacterium tuberculosis
IAGEGVEELGRSGV

SEQ ID NO: 115056 - protein, 14 aa, Mycobacterium tuberculosis
AGEGVEELGRSGVA

SEQ ID NO: 115057 - protein, 14 aa, Mycobacterium tuberculosis
GEGVEELGRSGVAV

SEQ ID NO: 115058 - protein, 14 aa, Mycobacterium tuberculosis
EGVEELGRSGVAVG

SEQ ID NO: 115059 - protein, 14 aa, Mycobacterium tuberculosis
GVEELGRSGVAVGE

SEQ ID NO: 115060 - protein, 14 aa, Mycobacterium tuberculosis
VEELGRSGVAVGES

SEQ ID NO: 115061 - protein, 14 aa, Mycobacterium tuberculosis
EELGRSGVAVGESG

SEQ ID NO: 115062 - protein, 14 aa, Mycobacterium tuberculosis
ELGRSGVAVGESGI

SEQ ID NO: 115063 - protein, 14 aa, Mycobacterium tuberculosis
LGRSGVAVGESGIG

SEQ ID NO: 115064 - protein, 14 aa, Mycobacterium tuberculosis
GRSGVAVGESGIGY

SEQ ID NO: 115065 - protein, 14 aa, Mycobacterium tuberculosis
RSGVAVGESGIGYA

SEQ ID NO: 115066 - protein, 14 aa, Mycobacterium tuberculosis
SGVAVGESGIGYAA

SEQ ID NO: 115067 - protein, 14 aa, Mycobacterium tuberculosis
GVAVGESGIGYAAG

SEQ ID NO: 115068 - protein, 14 aa, Mycobacterium tuberculosis
VAVGESGIGYAAGD

SEQ ID NO: 115069 - protein, 14 aa, Mycobacterium tuberculosis
AVGESGIGYAAGDA

SEQ ID NO: 115070 - protein, 14 aa, Mycobacterium tuberculosis
VGESGIGYAAGDAV

SEQ ID NO: 115071 - protein, 14 aa, Mycobacterium tuberculosis
GESGIGYAAGDAVA

SEQ ID NO: 115072 - protein, 14 aa, Mycobacterium tuberculosis
ESGIGYAAGDAVAA

SEQ ID NO: 115073 - protein, 14 aa, Mycobacterium tuberculosis
SGIGYAAGDAVAAA

SEQ ID NO: 115074 - protein, 14 aa, Mycobacterium tuberculosis
GIGYAAGDAVAAAT

SEQ ID NO: 115075 - protein, 14 aa, Mycobacterium tuberculosis
IGYAAGDAVAAATY

SEQ ID NO: 115076 - protein, 14 aa, Mycobacterium tuberculosis
GYAAGDAVAAATYL

SEQ ID NO: 115077 - protein, 14 aa, Mycobacterium tuberculosis
YAAGDAVAAATYLV

SEQ ID NO: 115078 - protein, 14 aa, Mycobacterium tuberculosis
AAGDAVAAATYLVS

SEQ ID NO: 115079 - protein, 14 aa, Mycobacterium tuberculosis
AGDAVAAATYLVSG

SEQ ID NO: 115080 - protein, 14 aa, Mycobacterium tuberculosis
GDAVAAATYLVSGG

SEQ ID NO: 115081 - protein, 14 aa, Mycobacterium tuberculosis
DAVAAATYLVSGGS

SEQ ID NO: 115082 - protein, 14 aa, Mycobacterium tuberculosis
AVAAATYLVSGGSL

SEQ ID NO: 115083 - protein, 15 aa, Mycobacterium tuberculosis
MSRQASRQVSIIRSA

SEQ ID NO: 115084 - protein, 15 aa, Mycobacterium tuberculosis
SRQASRQVSIIRSAG

SEQ ID NO: 115085 - protein, 15 aa, Mycobacterium tuberculosis
RQASRQVSIIRSAGD

SEQ ID NO: 115086 - protein, 15 aa, Mycobacterium tuberculosis
QASRQVSIIRSAGDG

SEQ ID NO: 115087 - protein, 15 aa, Mycobacterium tuberculosis
ASRQVSIIRSAGDGN

SEQ ID NO: 115088 - protein, 15 aa, Mycobacterium tuberculosis
SRQVSIIRSAGDGNR

SEQ ID NO: 115089 - protein, 15 aa, Mycobacterium tuberculosis
RQVSIIRSAGDGNRS

SEQ ID NO: 115090 - protein, 15 aa, Mycobacterium tuberculosis
QVSIIRSAGDGNRSC

SEQ ID NO: 115091 - protein, 15 aa, Mycobacterium tuberculosis
VSIIRSAGDGNRSCG

SEQ ID NO: 115092 - protein, 15 aa, Mycobacterium tuberculosis
SIIRSAGDGNRSCGC

SEQ ID NO: 115093 - protein, 15 aa, Mycobacterium tuberculosis
IIRSAGDGNRSCGCV

SEQ ID NO: 115094 - protein, 15 aa, Mycobacterium tuberculosis
IRSAGDGNRSCGCVT

SEQ ID NO: 115095 - protein, 15 aa, Mycobacterium tuberculosis
RSAGDGNRSCGCVTP

SEQ ID NO: 115096 - protein, 15 aa, Mycobacterium tuberculosis
SAGDGNRSCGCVTPK

SEQ ID NO: 115097 - protein, 15 aa, Mycobacterium tuberculosis
AGDGNRSCGCVTPKE

SEQ ID NO: 115098 - protein, 15 aa, Mycobacterium tuberculosis
GDGNRSCGCVTPKEG

SEQ ID NO: 115099 - protein, 15 aa, Mycobacterium tuberculosis
DGNRSCGCVTPKEGV

SEQ ID NO: 115100 - protein, 15 aa, Mycobacterium tuberculosis
GNRSCGCVTPKEGVW

SEQ ID NO: 115101 - protein, 15 aa, Mycobacterium tuberculosis
NRSCGCVTPKEGVWV

SEQ ID NO: 115102 - protein, 15 aa, Mycobacterium tuberculosis
RSCGCVTPKEGVWVV

SEQ ID NO: 115103 - protein, 15 aa, Mycobacterium tuberculosis
SCGCVTPKEGVWVVT

SEQ ID NO: 115104 - protein, 15 aa, Mycobacterium tuberculosis
CGCVTPKEGVWVVTL

SEQ ID NO: 115105 - protein, 15 aa, Mycobacterium tuberculosis
GCVTPKEGVWVVTLR

SEQ ID NO: 115106 - protein, 15 aa, Mycobacterium tuberculosis
CVTPKEGVWVVTLRV

SEQ ID NO: 115107 - protein, 15 aa, Mycobacterium tuberculosis
VTPKEGVWVVTLRVV

SEQ ID NO: 115108 - protein, 15 aa, Mycobacterium tuberculosis
TPKEGVWVVTLRVVP

SEQ ID NO: 115109 - protein, 15 aa, Mycobacterium tuberculosis
PKEGVWVVTLRVVPE

SEQ ID NO: 115110 - protein, 15 aa, Mycobacterium tuberculosis
KEGVWVVTLRVVPEG

SEQ ID NO: 115111 - protein, 15 aa, Mycobacterium tuberculosis
EGVWVVTLRVVPEGL

SEQ ID NO: 115112 - protein, 15 aa, Mycobacterium tuberculosis
GVWVVTLRVVPEGLA

SEQ ID NO: 115113 - protein, 15 aa, Mycobacterium tuberculosis
VWVVTLRVVPEGLAA

SEQ ID NO: 115114 - protein, 15 aa, Mycobacterium tuberculosis
WVVTLRVVPEGLAAA

SEQ ID NO: 115115 - protein, 15 aa, Mycobacterium tuberculosis
VVTLRVVPEGLAAAS

SEQ ID NO: 115116 - protein, 15 aa, Mycobacterium tuberculosis
VTLRVVPEGLAAASA

SEQ ID NO: 115117 - protein, 15 aa, Mycobacterium tuberculosis
TLRVVPEGLAAASAA

SEQ ID NO: 115118 - protein, 15 aa, Mycobacterium tuberculosis
LRVVPEGLAAASAAV

SEQ ID NO: 115119 - protein, 15 aa, Mycobacterium tuberculosis
RVVPEGLAAASAAVE

SEQ ID NO: 115120 - protein, 15 aa, Mycobacterium tuberculosis
VVPEGLAAASAAVEA

SEQ ID NO: 115121 - protein, 15 aa, Mycobacterium tuberculosis
VPEGLAAASAAVEAL

SEQ ID NO: 115122 - protein, 15 aa, Mycobacterium tuberculosis
PEGLAAASAAVEALT

SEQ ID NO: 115123 - protein, 15 aa, Mycobacterium tuberculosis
EGLAAASAAVEALTA

SEQ ID NO: 115124 - protein, 15 aa, Mycobacterium tuberculosis
GLAAASAAVEALTAR

SEQ ID NO: 115125 - protein, 15 aa, Mycobacterium tuberculosis
LAAASAAVEALTARL

SEQ ID NO: 115126 - protein, 15 aa, Mycobacterium tuberculosis
AAASAAVEALTARLA

SEQ ID NO: 115127 - protein, 15 aa, Mycobacterium tuberculosis
AASAAVEALTARLAA

SEQ ID NO: 115128 - protein, 15 aa, Mycobacterium tuberculosis
ASAAVEALTARLAAA

SEQ ID NO: 115129 - protein, 15 aa, Mycobacterium tuberculosis
SAAVEALTARLAAAH

SEQ ID NO: 115130 - protein, 15 aa, Mycobacterium tuberculosis
AAVEALTARLAAAHA

SEQ ID NO: 115131 - protein, 15 aa, Mycobacterium tuberculosis
AVEALTARLAAAHAG

SEQ ID NO: 115132 - protein, 15 aa, Mycobacterium tuberculosis
VEALTARLAAAHAGA

SEQ ID NO: 115133 - protein, 15 aa, Mycobacterium tuberculosis
EALTARLAAAHAGAA

SEQ ID NO: 115134 - protein, 15 aa, Mycobacterium tuberculosis
ALTARLAAAHAGAAP

SEQ ID NO: 115135 - protein, 15 aa, Mycobacterium tuberculosis
LTARLAAAHAGAAPA

SEQ ID NO: 115136 - protein, 15 aa, Mycobacterium tuberculosis
TARLAAAHAGAAPAI

SEQ ID NO: 115137 - protein, 15 aa, Mycobacterium tuberculosis
ARLAAAHAGAAPAIT

SEQ ID NO: 115138 - protein, 15 aa, Mycobacterium tuberculosis
RLAAAHAGAAPAITA

SEQ ID NO: 115139 - protein, 15 aa, Mycobacterium tuberculosis
LAAAHAGAAPAITAV

SEQ ID NO: 115140 - protein, 15 aa, Mycobacterium tuberculosis
AAAHAGAAPAITAVV

SEQ ID NO: 115141 - protein, 15 aa, Mycobacterium tuberculosis
AAHAGAAPAITAVVA

SEQ ID NO: 115142 - protein, 15 aa, Mycobacterium tuberculosis
AHAGAAPAITAVVAP

SEQ ID NO: 115143 - protein, 15 aa, Mycobacterium tuberculosis
HAGAAPAITAVVAPA

SEQ ID NO: 115144 - protein, 15 aa, Mycobacterium tuberculosis
AGAAPAITAVVAPAA

SEQ ID NO: 115145 - protein, 15 aa, Mycobacterium tuberculosis
GAAPAITAVVAPAAD

SEQ ID NO: 115146 - protein, 15 aa, Mycobacterium tuberculosis
AAPAITAVVAPAADP

SEQ ID NO: 115147 - protein, 15 aa, Mycobacterium tuberculosis
APAITAVVAPAADPV

SEQ ID NO: 115148 - protein, 15 aa, Mycobacterium tuberculosis
PAITAVVAPAADPVS

SEQ ID NO: 115149 - protein, 15 aa, Mycobacterium tuberculosis
AITAVVAPAADPVSL

SEQ ID NO: 115150 - protein, 15 aa, Mycobacterium tuberculosis
ITAVVAPAADPVSLQ

SEQ ID NO: 115151 - protein, 15 aa, Mycobacterium tuberculosis
TAVVAPAADPVSLQS

SEQ ID NO: 115152 - protein, 15 aa, Mycobacterium tuberculosis
AVVAPAADPVSLQSA

SEQ ID NO: 115153 - protein, 15 aa, Mycobacterium tuberculosis
VVAPAADPVSLQSAV

SEQ ID NO: 115154 - protein, 15 aa, Mycobacterium tuberculosis
VAPAADPVSLQSAVG

SEQ ID NO: 115155 - protein, 15 aa, Mycobacterium tuberculosis
APAADPVSLQSAVGF

SEQ ID NO: 115156 - protein, 15 aa, Mycobacterium tuberculosis
PAADPVSLQSAVGFS

SEQ ID NO: 115157 - protein, 15 aa, Mycobacterium tuberculosis
AADPVSLQSAVGFSA

SEQ ID NO: 115158 - protein, 15 aa, Mycobacterium tuberculosis
ADPVSLQSAVGFSAL

SEQ ID NO: 115159 - protein, 15 aa, Mycobacterium tuberculosis
DPVSLQSAVGFSALG

SEQ ID NO: 115160 - protein, 15 aa, Mycobacterium tuberculosis
PVSLQSAVGFSALGS

SEQ ID NO: 115161 - protein, 15 aa, Mycobacterium tuberculosis
VSLQSAVGFSALGSE

SEQ ID NO: 115162 - protein, 15 aa, Mycobacterium tuberculosis
SLQSAVGFSALGSEH

SEQ ID NO: 115163 - protein, 15 aa, Mycobacterium tuberculosis
LQSAVGFSALGSEHA

SEQ ID NO: 115164 - protein, 15 aa, Mycobacterium tuberculosis
QSAVGFSALGSEHAA

SEQ ID NO: 115165 - protein, 15 aa, Mycobacterium tuberculosis
SAVGFSALGSEHAAI

SEQ ID NO: 115166 - protein, 15 aa, Mycobacterium tuberculosis
AVGFSALGSEHAAIA

SEQ ID NO: 115167 - protein, 15 aa, Mycobacterium tuberculosis
VGFSALGSEHAAIAG

SEQ ID NO: 115168 - protein, 15 aa, Mycobacterium tuberculosis
GFSALGSEHAAIAGE

SEQ ID NO: 115169 - protein, 15 aa, Mycobacterium tuberculosis
FSALGSEHAAIAGEG

SEQ ID NO: 115170 - protein, 15 aa, Mycobacterium tuberculosis
SALGSEHAAIAGEGV

SEQ ID NO: 115171 - protein, 15 aa, Mycobacterium tuberculosis
ALGSEHAAIAGEGVE

SEQ ID NO: 115172 - protein, 15 aa, Mycobacterium tuberculosis
LGSEHAAIAGEGVEE

SEQ ID NO: 115173 - protein, 15 aa, Mycobacterium tuberculosis
GSEHAAIAGEGVEEL

SEQ ID NO: 115174 - protein, 15 aa, Mycobacterium tuberculosis
SEHAAIAGEGVEELG

SEQ ID NO: 115175 - protein, 15 aa, Mycobacterium tuberculosis
EHAAIAGEGVEELGR

SEQ ID NO: 115176 - protein, 15 aa, Mycobacterium tuberculosis
HAAIAGEGVEELGRS

SEQ ID NO: 115177 - protein, 15 aa, Mycobacterium tuberculosis
AAIAGEGVEELGRSG

SEQ ID NO: 115178 - protein, 15 aa, Mycobacterium tuberculosis
AIAGEGVEELGRSGV

SEQ ID NO: 115179 - protein, 15 aa, Mycobacterium tuberculosis
IAGEGVEELGRSGVA

SEQ ID NO: 115180 - protein, 15 aa, Mycobacterium tuberculosis
AGEGVEELGRSGVAV

SEQ ID NO: 115181 - protein, 15 aa, Mycobacterium tuberculosis
GEGVEELGRSGVAVG

SEQ ID NO: 115182 - protein, 15 aa, Mycobacterium tuberculosis
EGVEELGRSGVAVGE

SEQ ID NO: 115183 - protein, 15 aa, Mycobacterium tuberculosis
GVEELGRSGVAVGES

SEQ ID NO: 115184 - protein, 15 aa, Mycobacterium tuberculosis
VEELGRSGVAVGESG

SEQ ID NO: 115185 - protein, 15 aa, Mycobacterium tuberculosis
EELGRSGVAVGESGI

SEQ ID NO: 115186 - protein, 15 aa, Mycobacterium tuberculosis
ELGRSGVAVGESGIG

SEQ ID NO: 115187 - protein, 15 aa, Mycobacterium tuberculosis
LGRSGVAVGESGIGY

SEQ ID NO: 115188 - protein, 15 aa, Mycobacterium tuberculosis
GRSGVAVGESGIGYA

SEQ ID NO: 115189 - protein, 15 aa, Mycobacterium tuberculosis
RSGVAVGESGIGYAA

SEQ ID NO: 115190 - protein, 15 aa, Mycobacterium tuberculosis
SGVAVGESGIGYAAG

SEQ ID NO: 115191 - protein, 15 aa, Mycobacterium tuberculosis
GVAVGESGIGYAAGD

SEQ ID NO: 115192 - protein, 15 aa, Mycobacterium tuberculosis
VAVGESGIGYAAGDA

SEQ ID NO: 115193 - protein, 15 aa, Mycobacterium tuberculosis
AVGESGIGYAAGDAV

SEQ ID NO: 115194 - protein, 15 aa, Mycobacterium tuberculosis
VGESGIGYAAGDAVA

SEQ ID NO: 115195 - protein, 15 aa, Mycobacterium tuberculosis
GESGIGYAAGDAVAA

SEQ ID NO: 115196 - protein, 15 aa, Mycobacterium tuberculosis
ESGIGYAAGDAVAAA

SEQ ID NO: 115197 - protein, 15 aa, Mycobacterium tuberculosis
SGIGYAAGDAVAAAT

SEQ ID NO: 115198 - protein, 15 aa, Mycobacterium tuberculosis
GIGYAAGDAVAAATY

SEQ ID NO: 115199 - protein, 15 aa, Mycobacterium tuberculosis
IGYAAGDAVAAATYL

SEQ ID NO: 115200 - protein, 15 aa, Mycobacterium tuberculosis
GYAAGDAVAAATYLV

SEQ ID NO: 115201 - protein, 15 aa, Mycobacterium tuberculosis
YAAGDAVAAATYLVS

SEQ ID NO: 115202 - protein, 15 aa, Mycobacterium tuberculosis
AAGDAVAAATYLVSG

SEQ ID NO: 115203 - protein, 15 aa, Mycobacterium tuberculosis
AGDAVAAATYLVSGG

SEQ ID NO: 115204 - protein, 15 aa, Mycobacterium tuberculosis
GDAVAAATYLVSGGS

SEQ ID NO: 115205 - protein, 15 aa, Mycobacterium tuberculosis
DAVAAATYLVSGGSL

SEQ ID NO: 115206 - protein, 16 aa, Mycobacterium tuberculosis
MSRQASRQVSIIRSAG

SEQ ID NO: 115207 - protein, 16 aa, Mycobacterium tuberculosis
SRQASRQVSIIRSAGD

SEQ ID NO: 115208 - protein, 16 aa, Mycobacterium tuberculosis
RQASRQVSIIRSAGDG

SEQ ID NO: 115209 - protein, 16 aa, Mycobacterium tuberculosis
QASRQVSIIRSAGDGN

SEQ ID NO: 115210 - protein, 16 aa, Mycobacterium tuberculosis
ASRQVSIIRSAGDGNR

SEQ ID NO: 115211 - protein, 16 aa, Mycobacterium tuberculosis
SRQVSIIRSAGDGNRS

SEQ ID NO: 115212 - protein, 16 aa, Mycobacterium tuberculosis
RQVSIIRSAGDGNRSC

SEQ ID NO: 115213 - protein, 16 aa, Mycobacterium tuberculosis
QVSIIRSAGDGNRSCG

SEQ ID NO: 115214 - protein, 16 aa, Mycobacterium tuberculosis
VSIIRSAGDGNRSCGC

SEQ ID NO: 115215 - protein, 16 aa, Mycobacterium tuberculosis
SIIRSAGDGNRSCGCV

SEQ ID NO: 115216 - protein, 16 aa, Mycobacterium tuberculosis
IIRSAGDGNRSCGCVT

SEQ ID NO: 115217 - protein, 16 aa, Mycobacterium tuberculosis
IRSAGDGNRSCGCVTP

SEQ ID NO: 115218 - protein, 16 aa, Mycobacterium tuberculosis
RSAGDGNRSCGCVTPK

SEQ ID NO: 115219 - protein, 16 aa, Mycobacterium tuberculosis
SAGDGNRSCGCVTPKE

SEQ ID NO: 115220 - protein, 16 aa, Mycobacterium tuberculosis
AGDGNRSCGCVTPKEG

SEQ ID NO: 115221 - protein, 16 aa, Mycobacterium tuberculosis
GDGNRSCGCVTPKEGV

SEQ ID NO: 115222 - protein, 16 aa, Mycobacterium tuberculosis
DGNRSCGCVTPKEGVW

SEQ ID NO: 115223 - protein, 16 aa, Mycobacterium tuberculosis
GNRSCGCVTPKEGVWV

SEQ ID NO: 115224 - protein, 16 aa, Mycobacterium tuberculosis
NRSCGCVTPKEGVWVV

SEQ ID NO: 115225 - protein, 16 aa, Mycobacterium tuberculosis
RSCGCVTPKEGVWVVT

SEQ ID NO: 115226 - protein, 16 aa, Mycobacterium tuberculosis
SCGCVTPKEGVWVVTL

SEQ ID NO: 115227 - protein, 16 aa, Mycobacterium tuberculosis
CGCVTPKEGVWVVTLR

SEQ ID NO: 115228 - protein, 16 aa, Mycobacterium tuberculosis
GCVTPKEGVWVVTLRV

SEQ ID NO: 115229 - protein, 16 aa, Mycobacterium tuberculosis
CVTPKEGVWVVTLRVV

SEQ ID NO: 115230 - protein, 16 aa, Mycobacterium tuberculosis
VTPKEGVWVVTLRVVP

SEQ ID NO: 115231 - protein, 16 aa, Mycobacterium tuberculosis
TPKEGVWVVTLRVVPE

SEQ ID NO: 115232 - protein, 16 aa, Mycobacterium tuberculosis
PKEGVWVVTLRVVPEG

SEQ ID NO: 115233 - protein, 16 aa, Mycobacterium tuberculosis
KEGVWVVTLRVVPEGL

SEQ ID NO: 115234 - protein, 16 aa, Mycobacterium tuberculosis
EGVWVVTLRVVPEGLA

SEQ ID NO: 115235 - protein, 16 aa, Mycobacterium tuberculosis
GVWVVTLRVVPEGLAA

SEQ ID NO: 115236 - protein, 16 aa, Mycobacterium tuberculosis
VWVVTLRVVPEGLAAA

SEQ ID NO: 115237 - protein, 16 aa, Mycobacterium tuberculosis
WVVTLRVVPEGLAAAS

SEQ ID NO: 115238 - protein, 16 aa, Mycobacterium tuberculosis
VVTLRVVPEGLAAASA

SEQ ID NO: 115239 - protein, 16 aa, Mycobacterium tuberculosis
VTLRVVPEGLAAASAA

SEQ ID NO: 115240 - protein, 16 aa, Mycobacterium tuberculosis
TLRVVPEGLAAASAAV

SEQ ID NO: 115241 - protein, 16 aa, Mycobacterium tuberculosis
LRVVPEGLAAASAAVE

SEQ ID NO: 115242 - protein, 16 aa, Mycobacterium tuberculosis
RVVPEGLAAASAAVEA

SEQ ID NO: 115243 - protein, 16 aa, Mycobacterium tuberculosis
VVPEGLAAASAAVEAL

SEQ ID NO: 115244 - protein, 16 aa, Mycobacterium tuberculosis
VPEGLAAASAAVEALT

SEQ ID NO: 115245 - protein, 16 aa, Mycobacterium tuberculosis
PEGLAAASAAVEALTA

SEQ ID NO: 115246 - protein, 16 aa, Mycobacterium tuberculosis
EGLAAASAAVEALTAR

SEQ ID NO: 115247 - protein, 16 aa, Mycobacterium tuberculosis
GLAAASAAVEALTARL

SEQ ID NO: 115248 - protein, 16 aa, Mycobacterium tuberculosis
LAAASAAVEALTARLA

SEQ ID NO: 115249 - protein, 16 aa, Mycobacterium tuberculosis
AAASAAVEALTARLAA

SEQ ID NO: 115250 - protein, 16 aa, Mycobacterium tuberculosis
AASAAVEALTARLAAA

SEQ ID NO: 115251 - protein, 16 aa, Mycobacterium tuberculosis
ASAAVEALTARLAAAH

SEQ ID NO: 115252 - protein, 16 aa, Mycobacterium tuberculosis
SAAVEALTARLAAAHA

SEQ ID NO: 115253 - protein, 16 aa, Mycobacterium tuberculosis
AAVEALTARLAAAHAG

SEQ ID NO: 115254 - protein, 16 aa, Mycobacterium tuberculosis
AVEALTARLAAAHAGA

SEQ ID NO: 115255 - protein, 16 aa, Mycobacterium tuberculosis
VEALTARLAAAHAGAA

SEQ ID NO: 115256 - protein, 16 aa, Mycobacterium tuberculosis
EALTARLAAAHAGAAP

SEQ ID NO: 115257 - protein, 16 aa, Mycobacterium tuberculosis
ALTARLAAAHAGAAPA

SEQ ID NO: 115258 - protein, 16 aa, Mycobacterium tuberculosis
LTARLAAAHAGAAPAI

SEQ ID NO: 115259 - protein, 16 aa, Mycobacterium tuberculosis
TARLAAAHAGAAPAIT

SEQ ID NO: 115260 - protein, 16 aa, Mycobacterium tuberculosis
ARLAAAHAGAAPAITA

SEQ ID NO: 115261 - protein, 16 aa, Mycobacterium tuberculosis
RLAAAHAGAAPAITAV

SEQ ID NO: 115262 - protein, 16 aa, Mycobacterium tuberculosis
LAAAHAGAAPAITAVV

SEQ ID NO: 115263 - protein, 16 aa, Mycobacterium tuberculosis
AAAHAGAAPAITAVVA

SEQ ID NO: 115264 - protein, 16 aa, Mycobacterium tuberculosis
AAHAGAAPAITAVVAP

SEQ ID NO: 115265 - protein, 16 aa, Mycobacterium tuberculosis
AHAGAAPAITAVVAPA

SEQ ID NO: 115266 - protein, 16 aa, Mycobacterium tuberculosis
HAGAAPAITAVVAPAA

SEQ ID NO: 115267 - protein, 16 aa, Mycobacterium tuberculosis
AGAAPAITAVVAPAAD

SEQ ID NO: 115268 - protein, 16 aa, Mycobacterium tuberculosis
GAAPAITAVVAPAADP

SEQ ID NO: 115269 - protein, 16 aa, Mycobacterium tuberculosis
AAPAITAVVAPAADPV

SEQ ID NO: 115270 - protein, 16 aa, Mycobacterium tuberculosis
APAITAVVAPAADPVS

SEQ ID NO: 115271 - protein, 16 aa, Mycobacterium tuberculosis
PAITAVVAPAADPVSL

SEQ ID NO: 115272 - protein, 16 aa, Mycobacterium tuberculosis
AITAVVAPAADPVSLQ

SEQ ID NO: 115273 - protein, 16 aa, Mycobacterium tuberculosis
ITAVVAPAADPVSLQS

SEQ ID NO: 115274 - protein, 16 aa, Mycobacterium tuberculosis
TAVVAPAADPVSLQSA

SEQ ID NO: 115275 - protein, 16 aa, Mycobacterium tuberculosis
AVVAPAADPVSLQSAV

SEQ ID NO: 115276 - protein, 16 aa, Mycobacterium tuberculosis
VVAPAADPVSLQSAVG

SEQ ID NO: 115277 - protein, 16 aa, Mycobacterium tuberculosis
VAPAADPVSLQSAVGF

SEQ ID NO: 115278 - protein, 16 aa, Mycobacterium tuberculosis
APAADPVSLQSAVGFS

SEQ ID NO: 115279 - protein, 16 aa, Mycobacterium tuberculosis
PAADPVSLQSAVGFSA

SEQ ID NO: 115280 - protein, 16 aa, Mycobacterium tuberculosis
AADPVSLQSAVGFSAL

SEQ ID NO: 115281 - protein, 16 aa, Mycobacterium tuberculosis
ADPVSLQSAVGFSALG

SEQ ID NO: 115282 - protein, 16 aa, Mycobacterium tuberculosis
DPVSLQSAVGFSALGS

SEQ ID NO: 115283 - protein, 16 aa, Mycobacterium tuberculosis
PVSLQSAVGFSALGSE

SEQ ID NO: 115284 - protein, 16 aa, Mycobacterium tuberculosis
VSLQSAVGFSALGSEH

SEQ ID NO: 115285 - protein, 16 aa, Mycobacterium tuberculosis
SLQSAVGFSALGSEHA

SEQ ID NO: 115286 - protein, 16 aa, Mycobacterium tuberculosis
LQSAVGFSALGSEHAA

SEQ ID NO: 115287 - protein, 16 aa, Mycobacterium tuberculosis
QSAVGFSALGSEHAAI

SEQ ID NO: 115288 - protein, 16 aa, Mycobacterium tuberculosis
SAVGFSALGSEHAAIA

SEQ ID NO: 115289 - protein, 16 aa, Mycobacterium tuberculosis
AVGFSALGSEHAAIAG

SEQ ID NO: 115290 - protein, 16 aa, Mycobacterium tuberculosis
VGFSALGSEHAAIAGE

SEQ ID NO: 115291 - protein, 16 aa, Mycobacterium tuberculosis
GFSALGSEHAAIAGEG

SEQ ID NO: 115292 - protein, 16 aa, Mycobacterium tuberculosis
FSALGSEHAAIAGEGV

SEQ ID NO: 115293 - protein, 16 aa, Mycobacterium tuberculosis
SALGSEHAAIAGEGVE

SEQ ID NO: 115294 - protein, 16 aa, Mycobacterium tuberculosis
ALGSEHAAIAGEGVEE

SEQ ID NO: 115295 - protein, 16 aa, Mycobacterium tuberculosis
LGSEHAAIAGEGVEEL

SEQ ID NO: 115296 - protein, 16 aa, Mycobacterium tuberculosis
GSEHAAIAGEGVEELG

SEQ ID NO: 115297 - protein, 16 aa, Mycobacterium tuberculosis
SEHAAIAGEGVEELGR

SEQ ID NO: 115298 - protein, 16 aa, Mycobacterium tuberculosis
EHAAIAGEGVEELGRS

SEQ ID NO: 115299 - protein, 16 aa, Mycobacterium tuberculosis
HAAIAGEGVEELGRSG

SEQ ID NO: 115300 - protein, 16 aa, Mycobacterium tuberculosis
AAIAGEGVEELGRSGV

SEQ ID NO: 115301 - protein, 16 aa, Mycobacterium tuberculosis
AIAGEGVEELGRSGVA

SEQ ID NO: 115302 - protein, 16 aa, Mycobacterium tuberculosis
IAGEGVEELGRSGVAV

SEQ ID NO: 115303 - protein, 16 aa, Mycobacterium tuberculosis
AGEGVEELGRSGVAVG

SEQ ID NO: 115304 - protein, 16 aa, Mycobacterium tuberculosis
GEGVEELGRSGVAVGE

SEQ ID NO: 115305 - protein, 16 aa, Mycobacterium tuberculosis
EGVEELGRSGVAVGES

SEQ ID NO: 115306 - protein, 16 aa, Mycobacterium tuberculosis
GVEELGRSGVAVGESG

SEQ ID NO: 115307 - protein, 16 aa, Mycobacterium tuberculosis
VEELGRSGVAVGESGI

SEQ ID NO: 115308 - protein, 16 aa, Mycobacterium tuberculosis
EELGRSGVAVGESGIG

SEQ ID NO: 115309 - protein, 16 aa, Mycobacterium tuberculosis
ELGRSGVAVGESGIGY

SEQ ID NO: 115310 - protein, 16 aa, Mycobacterium tuberculosis
LGRSGVAVGESGIGYA

SEQ ID NO: 115311 - protein, 16 aa, Mycobacterium tuberculosis
GRSGVAVGESGIGYAA

SEQ ID NO: 115312 - protein, 16 aa, Mycobacterium tuberculosis
RSGVAVGESGIGYAAG

SEQ ID NO: 115313 - protein, 16 aa, Mycobacterium tuberculosis
SGVAVGESGIGYAAGD

SEQ ID NO: 115314 - protein, 16 aa, Mycobacterium tuberculosis
GVAVGESGIGYAAGDA

SEQ ID NO: 115315 - protein, 16 aa, Mycobacterium tuberculosis
VAVGESGIGYAAGDAV

SEQ ID NO: 115316 - protein, 16 aa, Mycobacterium tuberculosis
AVGESGIGYAAGDAVA

SEQ ID NO: 115317 - protein, 16 aa, Mycobacterium tuberculosis
VGESGIGYAAGDAVAA

SEQ ID NO: 115318 - protein, 16 aa, Mycobacterium tuberculosis
GESGIGYAAGDAVAAA

SEQ ID NO: 115319 - protein, 16 aa, Mycobacterium tuberculosis
ESGIGYAAGDAVAAAT

SEQ ID NO: 115320 - protein, 16 aa, Mycobacterium tuberculosis
SGIGYAAGDAVAAATY

SEQ ID NO: 115321 - protein, 16 aa, Mycobacterium tuberculosis
GIGYAAGDAVAAATYL

SEQ ID NO: 115322 - protein, 16 aa, Mycobacterium tuberculosis
IGYAAGDAVAAATYLV

SEQ ID NO: 115323 - protein, 16 aa, Mycobacterium tuberculosis
GYAAGDAVAAATYLVS

SEQ ID NO: 115324 - protein, 16 aa, Mycobacterium tuberculosis
YAAGDAVAAATYLVSG

SEQ ID NO: 115325 - protein, 16 aa, Mycobacterium tuberculosis
AAGDAVAAATYLVSGG

SEQ ID NO: 115326 - protein, 16 aa, Mycobacterium tuberculosis
AGDAVAAATYLVSGGS

SEQ ID NO: 115327 - protein, 16 aa, Mycobacterium tuberculosis
GDAVAAATYLVSGGSL

SEQ ID NO: 115328 - protein, 13 aa, Mycobacterium tuberculosis
MQLVDRVRGAVTG

SEQ ID NO: 115329 - protein, 13 aa, Mycobacterium tuberculosis
QLVDRVRGAVTGM

SEQ ID NO: 115330 - protein, 13 aa, Mycobacterium tuberculosis
LVDRVRGAVTGMS

SEQ ID NO: 115331 - protein, 13 aa, Mycobacterium tuberculosis
VDRVRGAVTGMSR

SEQ ID NO: 115332 - protein, 13 aa, Mycobacterium tuberculosis
DRVRGAVTGMSRR

SEQ ID NO: 115333 - protein, 13 aa, Mycobacterium tuberculosis
RVRGAVTGMSRRL

SEQ ID NO: 115334 - protein, 13 aa, Mycobacterium tuberculosis
VRGAVTGMSRRLV

SEQ ID NO: 115335 - protein, 13 aa, Mycobacterium tuberculosis
RGAVTGMSRRLVV

SEQ ID NO: 115336 - protein, 13 aa, Mycobacterium tuberculosis
GAVTGMSRRLVVG

SEQ ID NO: 115337 - protein, 13 aa, Mycobacterium tuberculosis
AVTGMSRRLVVGA

SEQ ID NO: 115338 - protein, 13 aa, Mycobacterium tuberculosis
VTGMSRRLVVGAV

SEQ ID NO: 115339 - protein, 13 aa, Mycobacterium tuberculosis
TGMSRRLVVGAVG

SEQ ID NO: 115340 - protein, 13 aa, Mycobacterium tuberculosis
GMSRRLVVGAVGA

SEQ ID NO: 115341 - protein, 13 aa, Mycobacterium tuberculosis
MSRRLVVGAVGAA

SEQ ID NO: 115342 - protein, 13 aa, Mycobacterium tuberculosis
SRRLVVGAVGAAL

SEQ ID NO: 115343 - protein, 13 aa, Mycobacterium tuberculosis
RRLVVGAVGAALV

SEQ ID NO: 115344 - protein, 13 aa, Mycobacterium tuberculosis
RLVVGAVGAALVS

SEQ ID NO: 115345 - protein, 13 aa, Mycobacterium tuberculosis
LVVGAVGAALVSG

SEQ ID NO: 115346 - protein, 13 aa, Mycobacterium tuberculosis
VVGAVGAALVSGL

SEQ ID NO: 115347 - protein, 13 aa, Mycobacterium tuberculosis
VGAVGAALVSGLV

SEQ ID NO: 115348 - protein, 13 aa, Mycobacterium tuberculosis
GAVGAALVSGLVG

SEQ ID NO: 115349 - protein, 13 aa, Mycobacterium tuberculosis
AVGAALVSGLVGA

SEQ ID NO: 115350 - protein, 13 aa, Mycobacterium tuberculosis
VGAALVSGLVGAV

SEQ ID NO: 115351 - protein, 13 aa, Mycobacterium tuberculosis
GAALVSGLVGAVG

SEQ ID NO: 115352 - protein, 13 aa, Mycobacterium tuberculosis
AALVSGLVGAVGG

SEQ ID NO: 115353 - protein, 13 aa, Mycobacterium tuberculosis
ALVSGLVGAVGGT

SEQ ID NO: 115354 - protein, 13 aa, Mycobacterium tuberculosis
LVSGLVGAVGGTA

SEQ ID NO: 115355 - protein, 13 aa, Mycobacterium tuberculosis
VSGLVGAVGGTAT

SEQ ID NO: 115356 - protein, 13 aa, Mycobacterium tuberculosis
SGLVGAVGGTATA

SEQ ID NO: 115357 - protein, 13 aa, Mycobacterium tuberculosis
GLVGAVGGTATAG

SEQ ID NO: 115358 - protein, 13 aa, Mycobacterium tuberculosis
LVGAVGGTATAGA

SEQ ID NO: 115359 - protein, 13 aa, Mycobacterium tuberculosis
VGAVGGTATAGAF

SEQ ID NO: 115360 - protein, 13 aa, Mycobacterium tuberculosis
GAVGGTATAGAFS

SEQ ID NO: 115361 - protein, 13 aa, Mycobacterium tuberculosis
AVGGTATAGAFSR

SEQ ID NO: 115362 - protein, 13 aa, Mycobacterium tuberculosis
VGGTATAGAFSRP

SEQ ID NO: 115363 - protein, 13 aa, Mycobacterium tuberculosis
GGTATAGAFSRPG

SEQ ID NO: 115364 - protein, 13 aa, Mycobacterium tuberculosis
GTATAGAFSRPGL

SEQ ID NO: 115365 - protein, 13 aa, Mycobacterium tuberculosis
TATAGAFSRPGLP

SEQ ID NO: 115366 - protein, 13 aa, Mycobacterium tuberculosis
ATAGAFSRPGLPV

SEQ ID NO: 115367 - protein, 13 aa, Mycobacterium tuberculosis
TAGAFSRPGLPVE

SEQ ID NO: 115368 - protein, 13 aa, Mycobacterium tuberculosis
AGAFSRPGLPVEY

SEQ ID NO: 115369 - protein, 13 aa, Mycobacterium tuberculosis
GAFSRPGLPVEYL

SEQ ID NO: 115370 - protein, 13 aa, Mycobacterium tuberculosis
AFSRPGLPVEYLQ

SEQ ID NO: 115371 - protein, 13 aa, Mycobacterium tuberculosis
FSRPGLPVEYLQV

SEQ ID NO: 115372 - protein, 13 aa, Mycobacterium tuberculosis
SRPGLPVEYLQVP

SEQ ID NO: 115373 - protein, 13 aa, Mycobacterium tuberculosis
RPGLPVEYLQVPS

SEQ ID NO: 115374 - protein, 13 aa, Mycobacterium tuberculosis
PGLPVEYLQVPSP

SEQ ID NO: 115375 - protein, 13 aa, Mycobacterium tuberculosis
GLPVEYLQVPSPS

SEQ ID NO: 115376 - protein, 13 aa, Mycobacterium tuberculosis
LPVEYLQVPSPSM

SEQ ID NO: 115377 - protein, 13 aa, Mycobacterium tuberculosis
PVEYLQVPSPSMG

SEQ ID NO: 115378 - protein, 13 aa, Mycobacterium tuberculosis
VEYLQVPSPSMGR

SEQ ID NO: 115379 - protein, 13 aa, Mycobacterium tuberculosis
EYLQVPSPSMGRD

SEQ ID NO: 115380 - protein, 13 aa, Mycobacterium tuberculosis
YLQVPSPSMGRDI

SEQ ID NO: 115381 - protein, 13 aa, Mycobacterium tuberculosis
LQVPSPSMGRDIK

SEQ ID NO: 115382 - protein, 13 aa, Mycobacterium tuberculosis
QVPSPSMGRDIKV

SEQ ID NO: 115383 - protein, 13 aa, Mycobacterium tuberculosis
VPSPSMGRDIKVQ

SEQ ID NO: 115384 - protein, 13 aa, Mycobacterium tuberculosis
PSPSMGRDIKVQF

SEQ ID NO: 115385 - protein, 13 aa, Mycobacterium tuberculosis
SPSMGRDIKVQFQ

SEQ ID NO: 115386 - protein, 13 aa, Mycobacterium tuberculosis
PSMGRDIKVQFQS

SEQ ID NO: 115387 - protein, 13 aa, Mycobacterium tuberculosis
SMGRDIKVQFQSG

SEQ ID NO: 115388 - protein, 13 aa, Mycobacterium tuberculosis
MGRDIKVQFQSGG

SEQ ID NO: 115389 - protein, 13 aa, Mycobacterium tuberculosis
GRDIKVQFQSGGA

SEQ ID NO: 115390 - protein, 13 aa, Mycobacterium tuberculosis
RDIKVQFQSGGAN

SEQ ID NO: 115391 - protein, 13 aa, Mycobacterium tuberculosis
DIKVQFQSGGANS

SEQ ID NO: 115392 - protein, 13 aa, Mycobacterium tuberculosis
IKVQFQSGGANSP

SEQ ID NO: 115393 - protein, 13 aa, Mycobacterium tuberculosis
KVQFQSGGANSPA

SEQ ID NO: 115394 - protein, 13 aa, Mycobacterium tuberculosis
VQFQSGGANSPAL

SEQ ID NO: 115395 - protein, 13 aa, Mycobacterium tuberculosis
QFQSGGANSPALY

SEQ ID NO: 115396 - protein, 13 aa, Mycobacterium tuberculosis
FQSGGANSPALYL

SEQ ID NO: 115397 - protein, 13 aa, Mycobacterium tuberculosis
QSGGANSPALYLL

SEQ ID NO: 115398 - protein, 13 aa, Mycobacterium tuberculosis
SGGANSPALYLLD

SEQ ID NO: 115399 - protein, 13 aa, Mycobacterium tuberculosis
GGANSPALYLLDG

SEQ ID NO: 115400 - protein, 13 aa, Mycobacterium tuberculosis
GANSPALYLLDGL

SEQ ID NO: 115401 - protein, 13 aa, Mycobacterium tuberculosis
ANSPALYLLDGLR

SEQ ID NO: 115402 - protein, 13 aa, Mycobacterium tuberculosis
NSPALYLLDGLRA

SEQ ID NO: 115403 - protein, 13 aa, Mycobacterium tuberculosis
SPALYLLDGLRAQ

SEQ ID NO: 115404 - protein, 13 aa, Mycobacterium tuberculosis
PALYLLDGLRAQD

SEQ ID NO: 115405 - protein, 13 aa, Mycobacterium tuberculosis
ALYLLDGLRAQDD

SEQ ID NO: 115406 - protein, 13 aa, Mycobacterium tuberculosis
LYLLDGLRAQDDF

SEQ ID NO: 115407 - protein, 13 aa, Mycobacterium tuberculosis
YLLDGLRAQDDFS

SEQ ID NO: 115408 - protein, 13 aa, Mycobacterium tuberculosis
LLDGLRAQDDFSG

SEQ ID NO: 115409 - protein, 13 aa, Mycobacterium tuberculosis
LDGLRAQDDFSGW

SEQ ID NO: 115410 - protein, 13 aa, Mycobacterium tuberculosis
DGLRAQDDFSGWD

SEQ ID NO: 115411 - protein, 13 aa, Mycobacterium tuberculosis
GLRAQDDFSGWDI

SEQ ID NO: 115412 - protein, 13 aa, Mycobacterium tuberculosis
LRAQDDFSGWDIN

SEQ ID NO: 115413 - protein, 13 aa, Mycobacterium tuberculosis
RAQDDFSGWDINT

SEQ ID NO: 115414 - protein, 13 aa, Mycobacterium tuberculosis
AQDDFSGWDINTP

SEQ ID NO: 115415 - protein, 13 aa, Mycobacterium tuberculosis
QDDFSGWDINTPA

SEQ ID NO: 115416 - protein, 13 aa, Mycobacterium tuberculosis
DDFSGWDINTPAF

SEQ ID NO: 115417 - protein, 13 aa, Mycobacterium tuberculosis
DFSGWDINTPAFE

SEQ ID NO: 115418 - protein, 13 aa, Mycobacterium tuberculosis
FSGWDINTPAFEW

SEQ ID NO: 115419 - protein, 13 aa, Mycobacterium tuberculosis
SGWDINTPAFEWY

SEQ ID NO: 115420 - protein, 13 aa, Mycobacterium tuberculosis
GWDINTPAFEWYD

SEQ ID NO: 115421 - protein, 13 aa, Mycobacterium tuberculosis
WDINTPAFEWYDQ

SEQ ID NO: 115422 - protein, 13 aa, Mycobacterium tuberculosis
DINTPAFEWYDQS

SEQ ID NO: 115423 - protein, 13 aa, Mycobacterium tuberculosis
INTPAFEWYDQSG

SEQ ID NO: 115424 - protein, 13 aa, Mycobacterium tuberculosis
NTPAFEWYDQSGL

SEQ ID NO: 115425 - protein, 13 aa, Mycobacterium tuberculosis
TPAFEWYDQSGLS

SEQ ID NO: 115426 - protein, 13 aa, Mycobacterium tuberculosis
PAFEWYDQSGLSV

SEQ ID NO: 115427 - protein, 13 aa, Mycobacterium tuberculosis
AFEWYDQSGLSVV

SEQ ID NO: 115428 - protein, 13 aa, Mycobacterium tuberculosis
FEWYDQSGLSVVM

SEQ ID NO: 115429 - protein, 13 aa, Mycobacterium tuberculosis
EWYDQSGLSVVMP

SEQ ID NO: 115430 - protein, 13 aa, Mycobacterium tuberculosis
WYDQSGLSVVMPV

SEQ ID NO: 115431 - protein, 13 aa, Mycobacterium tuberculosis
YDQSGLSVVMPVG

SEQ ID NO: 115432 - protein, 13 aa, Mycobacterium tuberculosis
DQSGLSVVMPVGG

SEQ ID NO: 115433 - protein, 13 aa, Mycobacterium tuberculosis
QSGLSVVMPVGGQ

SEQ ID NO: 115434 - protein, 13 aa, Mycobacterium tuberculosis
SGLSVVMPVGGQS

SEQ ID NO: 115435 - protein, 13 aa, Mycobacterium tuberculosis
GLSVVMPVGGQSS

SEQ ID NO: 115436 - protein, 13 aa, Mycobacterium tuberculosis
LSVVMPVGGQSSF

SEQ ID NO: 115437 - protein, 13 aa, Mycobacterium tuberculosis
SVVMPVGGQSSFY

SEQ ID NO: 115438 - protein, 13 aa, Mycobacterium tuberculosis
VVMPVGGQSSFYS

SEQ ID NO: 115439 - protein, 13 aa, Mycobacterium tuberculosis
VMPVGGQSSFYSD

SEQ ID NO: 115440 - protein, 13 aa, Mycobacterium tuberculosis
MPVGGQSSFYSDW

SEQ ID NO: 115441 - protein, 13 aa, Mycobacterium tuberculosis
PVGGQSSFYSDWY

SEQ ID NO: 115442 - protein, 13 aa, Mycobacterium tuberculosis
VGGQSSFYSDWYQ

SEQ ID NO: 115443 - protein, 13 aa, Mycobacterium tuberculosis
GGQSSFYSDWYQP

SEQ ID NO: 115444 - protein, 13 aa, Mycobacterium tuberculosis
GQSSFYSDWYQPA

SEQ ID NO: 115445 - protein, 13 aa, Mycobacterium tuberculosis
QSSFYSDWYQPAC

SEQ ID NO: 115446 - protein, 13 aa, Mycobacterium tuberculosis
SSFYSDWYQPACG

SEQ ID NO: 115447 - protein, 13 aa, Mycobacterium tuberculosis
SFYSDWYQPACGK

SEQ ID NO: 115448 - protein, 13 aa, Mycobacterium tuberculosis
FYSDWYQPACGKA

SEQ ID NO: 115449 - protein, 13 aa, Mycobacterium tuberculosis
YSDWYQPACGKAG

SEQ ID NO: 115450 - protein, 13 aa, Mycobacterium tuberculosis
SDWYQPACGKAGC

SEQ ID NO: 115451 - protein, 13 aa, Mycobacterium tuberculosis
DWYQPACGKAGCQ

SEQ ID NO: 115452 - protein, 13 aa, Mycobacterium tuberculosis
WYQPACGKAGCQT

SEQ ID NO: 115453 - protein, 13 aa, Mycobacterium tuberculosis
YQPACGKAGCQTY

SEQ ID NO: 115454 - protein, 13 aa, Mycobacterium tuberculosis
QPACGKAGCQTYK

SEQ ID NO: 115455 - protein, 13 aa, Mycobacterium tuberculosis
PACGKAGCQTYKW

SEQ ID NO: 115456 - protein, 13 aa, Mycobacterium tuberculosis
ACGKAGCQTYKWE

SEQ ID NO: 115457 - protein, 13 aa, Mycobacterium tuberculosis
CGKAGCQTYKWET

SEQ ID NO: 115458 - protein, 13 aa, Mycobacterium tuberculosis
GKAGCQTYKWETF

SEQ ID NO: 115459 - protein, 13 aa, Mycobacterium tuberculosis
KAGCQTYKWETFL

SEQ ID NO: 115460 - protein, 13 aa, Mycobacterium tuberculosis
AGCQTYKWETFLT

SEQ ID NO: 115461 - protein, 13 aa, Mycobacterium tuberculosis
GCQTYKWETFLTS

SEQ ID NO: 115462 - protein, 13 aa, Mycobacterium tuberculosis
CQTYKWETFLTSE

SEQ ID NO: 115463 - protein, 13 aa, Mycobacterium tuberculosis
QTYKWETFLTSEL

SEQ ID NO: 115464 - protein, 13 aa, Mycobacterium tuberculosis
TYKWETFLTSELP

SEQ ID NO: 115465 - protein, 13 aa, Mycobacterium tuberculosis
YKWETFLTSELPG

SEQ ID NO: 115466 - protein, 13 aa, Mycobacterium tuberculosis
KWETFLTSELPGW

SEQ ID NO: 115467 - protein, 13 aa, Mycobacterium tuberculosis
WETFLTSELPGWL

SEQ ID NO: 115468 - protein, 13 aa, Mycobacterium tuberculosis
ETFLTSELPGWLQ

SEQ ID NO: 115469 - protein, 13 aa, Mycobacterium tuberculosis
TFLTSELPGWLQA

SEQ ID NO: 115470 - protein, 13 aa, Mycobacterium tuberculosis
FLTSELPGWLQAN

SEQ ID NO: 115471 - protein, 13 aa, Mycobacterium tuberculosis
LTSELPGWLQANR

SEQ ID NO: 115472 - protein, 13 aa, Mycobacterium tuberculosis
TSELPGWLQANRH

SEQ ID NO: 115473 - protein, 13 aa, Mycobacterium tuberculosis
SELPGWLQANRHV

SEQ ID NO: 115474 - protein, 13 aa, Mycobacterium tuberculosis
ELPGWLQANRHVK

SEQ ID NO: 115475 - protein, 13 aa, Mycobacterium tuberculosis
LPGWLQANRHVKP

SEQ ID NO: 115476 - protein, 13 aa, Mycobacterium tuberculosis
PGWLQANRHVKPT

SEQ ID NO: 115477 - protein, 13 aa, Mycobacterium tuberculosis
GWLQANRHVKPTG

SEQ ID NO: 115478 - protein, 13 aa, Mycobacterium tuberculosis
WLQANRHVKPTGS

SEQ ID NO: 115479 - protein, 13 aa, Mycobacterium tuberculosis
LQANRHVKPTGSA

SEQ ID NO: 115480 - protein, 13 aa, Mycobacterium tuberculosis
QANRHVKPTGSAV

SEQ ID NO: 115481 - protein, 13 aa, Mycobacterium tuberculosis
ANRHVKPTGSAVV

SEQ ID NO: 115482 - protein, 13 aa, Mycobacterium tuberculosis
NRHVKPTGSAVVG

SEQ ID NO: 115483 - protein, 13 aa, Mycobacterium tuberculosis
RHVKPTGSAVVGL

SEQ ID NO: 115484 - protein, 13 aa, Mycobacterium tuberculosis
HVKPTGSAVVGLS

SEQ ID NO: 115485 - protein, 13 aa, Mycobacterium tuberculosis
VKPTGSAVVGLSM

SEQ ID NO: 115486 - protein, 13 aa, Mycobacterium tuberculosis
KPTGSAVVGLSMA

SEQ ID NO: 115487 - protein, 13 aa, Mycobacterium tuberculosis
PTGSAVVGLSMAA

SEQ ID NO: 115488 - protein, 13 aa, Mycobacterium tuberculosis
TGSAVVGLSMAAS

SEQ ID NO: 115489 - protein, 13 aa, Mycobacterium tuberculosis
GSAVVGLSMAASS

SEQ ID NO: 115490 - protein, 13 aa, Mycobacterium tuberculosis
SAVVGLSMAASSA

SEQ ID NO: 115491 - protein, 13 aa, Mycobacterium tuberculosis
AVVGLSMAASSAL

SEQ ID NO: 115492 - protein, 13 aa, Mycobacterium tuberculosis
VVGLSMAASSALT

SEQ ID NO: 115493 - protein, 13 aa, Mycobacterium tuberculosis
VGLSMAASSALTL

SEQ ID NO: 115494 - protein, 13 aa, Mycobacterium tuberculosis
GLSMAASSALTLA

SEQ ID NO: 115495 - protein, 13 aa, Mycobacterium tuberculosis
LSMAASSALTLAI

SEQ ID NO: 115496 - protein, 13 aa, Mycobacterium tuberculosis
SMAASSALTLAIY

SEQ ID NO: 115497 - protein, 13 aa, Mycobacterium tuberculosis
MAASSALTLAIYH

SEQ ID NO: 115498 - protein, 13 aa, Mycobacterium tuberculosis
AASSALTLAIYHP

SEQ ID NO: 115499 - protein, 13 aa, Mycobacterium tuberculosis
ASSALTLAIYHPQ

SEQ ID NO: 115500 - protein, 13 aa, Mycobacterium tuberculosis
SSALTLAIYHPQQ

SEQ ID NO: 115501 - protein, 13 aa, Mycobacterium tuberculosis
SALTLAIYHPQQF

SEQ ID NO: 115502 - protein, 13 aa, Mycobacterium tuberculosis
ALTLAIYHPQQFV

SEQ ID NO: 115503 - protein, 13 aa, Mycobacterium tuberculosis
LTLAIYHPQQFVY

SEQ ID NO: 115504 - protein, 13 aa, Mycobacterium tuberculosis
TLAIYHPQQFVYA

SEQ ID NO: 115505 - protein, 13 aa, Mycobacterium tuberculosis
LAIYHPQQFVYAG

SEQ ID NO: 115506 - protein, 13 aa, Mycobacterium tuberculosis
AIYHPQQFVYAGA

SEQ ID NO: 115507 - protein, 13 aa, Mycobacterium tuberculosis
IYHPQQFVYAGAM

SEQ ID NO: 115508 - protein, 13 aa, Mycobacterium tuberculosis
YHPQQFVYAGAMS

SEQ ID NO: 115509 - protein, 13 aa, Mycobacterium tuberculosis
HPQQFVYAGAMSG

SEQ ID NO: 115510 - protein, 13 aa, Mycobacterium tuberculosis
PQQFVYAGAMSGL

SEQ ID NO: 115511 - protein, 13 aa, Mycobacterium tuberculosis
QQFVYAGAMSGLL

SEQ ID NO: 115512 - protein, 13 aa, Mycobacterium tuberculosis
QFVYAGAMSGLLD

SEQ ID NO: 115513 - protein, 13 aa, Mycobacterium tuberculosis
FVYAGAMSGLLDP

SEQ ID NO: 115514 - protein, 13 aa, Mycobacterium tuberculosis
VYAGAMSGLLDPS

SEQ ID NO: 115515 - protein, 13 aa, Mycobacterium tuberculosis
YAGAMSGLLDPSQ

SEQ ID NO: 115516 - protein, 13 aa, Mycobacterium tuberculosis
AGAMSGLLDPSQA

SEQ ID NO: 115517 - protein, 13 aa, Mycobacterium tuberculosis
GAMSGLLDPSQAM

SEQ ID NO: 115518 - protein, 13 aa, Mycobacterium tuberculosis
AMSGLLDPSQAMG

SEQ ID NO: 115519 - protein, 13 aa, Mycobacterium tuberculosis
MSGLLDPSQAMGP

SEQ ID NO: 115520 - protein, 13 aa, Mycobacterium tuberculosis
SGLLDPSQAMGPT

SEQ ID NO: 115521 - protein, 13 aa, Mycobacterium tuberculosis
GLLDPSQAMGPTL

SEQ ID NO: 115522 - protein, 13 aa, Mycobacterium tuberculosis
LLDPSQAMGPTLI

SEQ ID NO: 115523 - protein, 13 aa, Mycobacterium tuberculosis
LDPSQAMGPTLIG

SEQ ID NO: 115524 - protein, 13 aa, Mycobacterium tuberculosis
DPSQAMGPTLIGL

SEQ ID NO: 115525 - protein, 13 aa, Mycobacterium tuberculosis
PSQAMGPTLIGLA

SEQ ID NO: 115526 - protein, 13 aa, Mycobacterium tuberculosis
SQAMGPTLIGLAM

SEQ ID NO: 115527 - protein, 13 aa, Mycobacterium tuberculosis
QAMGPTLIGLAMG

SEQ ID NO: 115528 - protein, 13 aa, Mycobacterium tuberculosis
AMGPTLIGLAMGD

SEQ ID NO: 115529 - protein, 13 aa, Mycobacterium tuberculosis
MGPTLIGLAMGDA

SEQ ID NO: 115530 - protein, 13 aa, Mycobacterium tuberculosis
GPTLIGLAMGDAG

SEQ ID NO: 115531 - protein, 13 aa, Mycobacterium tuberculosis
PTLIGLAMGDAGG

SEQ ID NO: 115532 - protein, 13 aa, Mycobacterium tuberculosis
TLIGLAMGDAGGY

SEQ ID NO: 115533 - protein, 13 aa, Mycobacterium tuberculosis
LIGLAMGDAGGYK

SEQ ID NO: 115534 - protein, 13 aa, Mycobacterium tuberculosis
IGLAMGDAGGYKA

SEQ ID NO: 115535 - protein, 13 aa, Mycobacterium tuberculosis
GLAMGDAGGYKAS

SEQ ID NO: 115536 - protein, 13 aa, Mycobacterium tuberculosis
LAMGDAGGYKASD

SEQ ID NO: 115537 - protein, 13 aa, Mycobacterium tuberculosis
AMGDAGGYKASDM

SEQ ID NO: 115538 - protein, 13 aa, Mycobacterium tuberculosis
MGDAGGYKASDMW

SEQ ID NO: 115539 - protein, 13 aa, Mycobacterium tuberculosis
GDAGGYKASDMWG

SEQ ID NO: 115540 - protein, 13 aa, Mycobacterium tuberculosis
DAGGYKASDMWGP

SEQ ID NO: 115541 - protein, 13 aa, Mycobacterium tuberculosis
AGGYKASDMWGPK

SEQ ID NO: 115542 - protein, 13 aa, Mycobacterium tuberculosis
GGYKASDMWGPKE

SEQ ID NO: 115543 - protein, 13 aa, Mycobacterium tuberculosis
GYKASDMWGPKED

SEQ ID NO: 115544 - protein, 13 aa, Mycobacterium tuberculosis
YKASDMWGPKEDP

SEQ ID NO: 115545 - protein, 13 aa, Mycobacterium tuberculosis
KASDMWGPKEDPA

SEQ ID NO: 115546 - protein, 13 aa, Mycobacterium tuberculosis
ASDMWGPKEDPAW

SEQ ID NO: 115547 - protein, 13 aa, Mycobacterium tuberculosis
SDMWGPKEDPAWQ

SEQ ID NO: 115548 - protein, 13 aa, Mycobacterium tuberculosis
DMWGPKEDPAWQR

SEQ ID NO: 115549 - protein, 13 aa, Mycobacterium tuberculosis
MWGPKEDPAWQRN

SEQ ID NO: 115550 - protein, 13 aa, Mycobacterium tuberculosis
WGPKEDPAWQRND

SEQ ID NO: 115551 - protein, 13 aa, Mycobacterium tuberculosis
GPKEDPAWQRNDP

SEQ ID NO: 115552 - protein, 13 aa, Mycobacterium tuberculosis
PKEDPAWQRNDPL

SEQ ID NO: 115553 - protein, 13 aa, Mycobacterium tuberculosis
KEDPAWQRNDPLL

SEQ ID NO: 115554 - protein, 13 aa, Mycobacterium tuberculosis
EDPAWQRNDPLLN

SEQ ID NO: 115555 - protein, 13 aa, Mycobacterium tuberculosis
DPAWQRNDPLLNV

SEQ ID NO: 115556 - protein, 13 aa, Mycobacterium tuberculosis
PAWQRNDPLLNVG

SEQ ID NO: 115557 - protein, 13 aa, Mycobacterium tuberculosis
AWQRNDPLLNVGK

SEQ ID NO: 115558 - protein, 13 aa, Mycobacterium tuberculosis
WQRNDPLLNVGKL

SEQ ID NO: 115559 - protein, 13 aa, Mycobacterium tuberculosis
QRNDPLLNVGKLI

SEQ ID NO: 115560 - protein, 13 aa, Mycobacterium tuberculosis
RNDPLLNVGKLIA

SEQ ID NO: 115561 - protein, 13 aa, Mycobacterium tuberculosis
NDPLLNVGKLIAN

SEQ ID NO: 115562 - protein, 13 aa, Mycobacterium tuberculosis
DPLLNVGKLIANN

SEQ ID NO: 115563 - protein, 13 aa, Mycobacterium tuberculosis
PLLNVGKLIANNT

SEQ ID NO: 115564 - protein, 13 aa, Mycobacterium tuberculosis
LLNVGKLIANNTR

SEQ ID NO: 115565 - protein, 13 aa, Mycobacterium tuberculosis
LNVGKLIANNTRV

SEQ ID NO: 115566 - protein, 13 aa, Mycobacterium tuberculosis
NVGKLIANNTRVW

SEQ ID NO: 115567 - protein, 13 aa, Mycobacterium tuberculosis
VGKLIANNTRVWV

SEQ ID NO: 115568 - protein, 13 aa, Mycobacterium tuberculosis
GKLIANNTRVWVY

SEQ ID NO: 115569 - protein, 13 aa, Mycobacterium tuberculosis
KLIANNTRVWVYC

SEQ ID NO: 115570 - protein, 13 aa, Mycobacterium tuberculosis
LIANNTRVWVYCG

SEQ ID NO: 115571 - protein, 13 aa, Mycobacterium tuberculosis
IANNTRVWVYCGN

SEQ ID NO: 115572 - protein, 13 aa, Mycobacterium tuberculosis
ANNTRVWVYCGNG

SEQ ID NO: 115573 - protein, 13 aa, Mycobacterium tuberculosis
NNTRVWVYCGNGK

SEQ ID NO: 115574 - protein, 13 aa, Mycobacterium tuberculosis
NTRVWVYCGNGKP

SEQ ID NO: 115575 - protein, 13 aa, Mycobacterium tuberculosis
TRVWVYCGNGKPS

SEQ ID NO: 115576 - protein, 13 aa, Mycobacterium tuberculosis
RVWVYCGNGKPSD

SEQ ID NO: 115577 - protein, 13 aa, Mycobacterium tuberculosis
VWVYCGNGKPSDL

SEQ ID NO: 115578 - protein, 13 aa, Mycobacterium tuberculosis
WVYCGNGKPSDLG

SEQ ID NO: 115579 - protein, 13 aa, Mycobacterium tuberculosis
VYCGNGKPSDLGG

SEQ ID NO: 115580 - protein, 13 aa, Mycobacterium tuberculosis
YCGNGKPSDLGGN

SEQ ID NO: 115581 - protein, 13 aa, Mycobacterium tuberculosis
CGNGKPSDLGGNN

SEQ ID NO: 115582 - protein, 13 aa, Mycobacterium tuberculosis
GNGKPSDLGGNNL

SEQ ID NO: 115583 - protein, 13 aa, Mycobacterium tuberculosis
NGKPSDLGGNNLP

SEQ ID NO: 115584 - protein, 13 aa, Mycobacterium tuberculosis
GKPSDLGGNNLPA

SEQ ID NO: 115585 - protein, 13 aa, Mycobacterium tuberculosis
KPSDLGGNNLPAK

SEQ ID NO: 115586 - protein, 13 aa, Mycobacterium tuberculosis
PSDLGGNNLPAKF

SEQ ID NO: 115587 - protein, 13 aa, Mycobacterium tuberculosis
SDLGGNNLPAKFL

SEQ ID NO: 115588 - protein, 13 aa, Mycobacterium tuberculosis
DLGGNNLPAKFLE

SEQ ID NO: 115589 - protein, 13 aa, Mycobacterium tuberculosis
LGGNNLPAKFLEG

SEQ ID NO: 115590 - protein, 13 aa, Mycobacterium tuberculosis
GGNNLPAKFLEGF

SEQ ID NO: 115591 - protein, 13 aa, Mycobacterium tuberculosis
GNNLPAKFLEGFV

SEQ ID NO: 115592 - protein, 13 aa, Mycobacterium tuberculosis
NNLPAKFLEGFVR

SEQ ID NO: 115593 - protein, 13 aa, Mycobacterium tuberculosis
NLPAKFLEGFVRT

SEQ ID NO: 115594 - protein, 13 aa, Mycobacterium tuberculosis
LPAKFLEGFVRTS

SEQ ID NO: 115595 - protein, 13 aa, Mycobacterium tuberculosis
PAKFLEGFVRTSN

SEQ ID NO: 115596 - protein, 13 aa, Mycobacterium tuberculosis
AKFLEGFVRTSNI

SEQ ID NO: 115597 - protein, 13 aa, Mycobacterium tuberculosis
KFLEGFVRTSNIK

SEQ ID NO: 115598 - protein, 13 aa, Mycobacterium tuberculosis
FLEGFVRTSNIKF

SEQ ID NO: 115599 - protein, 13 aa, Mycobacterium tuberculosis
LEGFVRTSNIKFQ

SEQ ID NO: 115600 - protein, 13 aa, Mycobacterium tuberculosis
EGFVRTSNIKFQD

SEQ ID NO: 115601 - protein, 13 aa, Mycobacterium tuberculosis
GFVRTSNIKFQDA

SEQ ID NO: 115602 - protein, 13 aa, Mycobacterium tuberculosis
FVRTSNIKFQDAY

SEQ ID NO: 115603 - protein, 13 aa, Mycobacterium tuberculosis
VRTSNIKFQDAYN

SEQ ID NO: 115604 - protein, 13 aa, Mycobacterium tuberculosis
RTSNIKFQDAYNA

SEQ ID NO: 115605 - protein, 13 aa, Mycobacterium tuberculosis
TSNIKFQDAYNAG

SEQ ID NO: 115606 - protein, 13 aa, Mycobacterium tuberculosis
SNIKFQDAYNAGG

SEQ ID NO: 115607 - protein, 13 aa, Mycobacterium tuberculosis
NIKFQDAYNAGGG

SEQ ID NO: 115608 - protein, 13 aa, Mycobacterium tuberculosis
IKFQDAYNAGGGH

SEQ ID NO: 115609 - protein, 13 aa, Mycobacterium tuberculosis
KFQDAYNAGGGHN

SEQ ID NO: 115610 - protein, 13 aa, Mycobacterium tuberculosis
FQDAYNAGGGHNG

SEQ ID NO: 115611 - protein, 13 aa, Mycobacterium tuberculosis
QDAYNAGGGHNGV

SEQ ID NO: 115612 - protein, 13 aa, Mycobacterium tuberculosis
DAYNAGGGHNGVF

SEQ ID NO: 115613 - protein, 13 aa, Mycobacterium tuberculosis
AYNAGGGHNGVFD

SEQ ID NO: 115614 - protein, 13 aa, Mycobacterium tuberculosis
YNAGGGHNGVFDF

SEQ ID NO: 115615 - protein, 13 aa, Mycobacterium tuberculosis
NAGGGHNGVFDFP

SEQ ID NO: 115616 - protein, 13 aa, Mycobacterium tuberculosis
AGGGHNGVFDFPD

SEQ ID NO: 115617 - protein, 13 aa, Mycobacterium tuberculosis
GGGHNGVFDFPDS

SEQ ID NO: 115618 - protein, 13 aa, Mycobacterium tuberculosis
GGHNGVFDFPDSG

SEQ ID NO: 115619 - protein, 13 aa, Mycobacterium tuberculosis
GHNGVFDFPDSGT

SEQ ID NO: 115620 - protein, 13 aa, Mycobacterium tuberculosis
HNGVFDFPDSGTH

SEQ ID NO: 115621 - protein, 13 aa, Mycobacterium tuberculosis
NGVFDFPDSGTHS

SEQ ID NO: 115622 - protein, 13 aa, Mycobacterium tuberculosis
GVFDFPDSGTHSW

SEQ ID NO: 115623 - protein, 13 aa, Mycobacterium tuberculosis
VFDFPDSGTHSWE

SEQ ID NO: 115624 - protein, 13 aa, Mycobacterium tuberculosis
FDFPDSGTHSWEY

SEQ ID NO: 115625 - protein, 13 aa, Mycobacterium tuberculosis
DFPDSGTHSWEYW

SEQ ID NO: 115626 - protein, 13 aa, Mycobacterium tuberculosis
FPDSGTHSWEYWG

SEQ ID NO: 115627 - protein, 13 aa, Mycobacterium tuberculosis
PDSGTHSWEYWGA

SEQ ID NO: 115628 - protein, 13 aa, Mycobacterium tuberculosis
DSGTHSWEYWGAQ

SEQ ID NO: 115629 - protein, 13 aa, Mycobacterium tuberculosis
SGTHSWEYWGAQL

SEQ ID NO: 115630 - protein, 13 aa, Mycobacterium tuberculosis
GTHSWEYWGAQLN

SEQ ID NO: 115631 - protein, 13 aa, Mycobacterium tuberculosis
THSWEYWGAQLNA

SEQ ID NO: 115632 - protein, 13 aa, Mycobacterium tuberculosis
HSWEYWGAQLNAM

SEQ ID NO: 115633 - protein, 13 aa, Mycobacterium tuberculosis
SWEYWGAQLNAMK

SEQ ID NO: 115634 - protein, 13 aa, Mycobacterium tuberculosis
WEYWGAQLNAMKP

SEQ ID NO: 115635 - protein, 13 aa, Mycobacterium tuberculosis
EYWGAQLNAMKPD

SEQ ID NO: 115636 - protein, 13 aa, Mycobacterium tuberculosis
YWGAQLNAMKPDL

SEQ ID NO: 115637 - protein, 13 aa, Mycobacterium tuberculosis
WGAQLNAMKPDLQ

SEQ ID NO: 115638 - protein, 13 aa, Mycobacterium tuberculosis
GAQLNAMKPDLQR

SEQ ID NO: 115639 - protein, 13 aa, Mycobacterium tuberculosis
AQLNAMKPDLQRA

SEQ ID NO: 115640 - protein, 13 aa, Mycobacterium tuberculosis
QLNAMKPDLQRAL

SEQ ID NO: 115641 - protein, 13 aa, Mycobacterium tuberculosis
LNAMKPDLQRALG

SEQ ID NO: 115642 - protein, 13 aa, Mycobacterium tuberculosis
NAMKPDLQRALGA

SEQ ID NO: 115643 - protein, 13 aa, Mycobacterium tuberculosis
AMKPDLQRALGAT

SEQ ID NO: 115644 - protein, 13 aa, Mycobacterium tuberculosis
MKPDLQRALGATP

SEQ ID NO: 115645 - protein, 13 aa, Mycobacterium tuberculosis
KPDLQRALGATPN

SEQ ID NO: 115646 - protein, 13 aa, Mycobacterium tuberculosis
PDLQRALGATPNT

SEQ ID NO: 115647 - protein, 13 aa, Mycobacterium tuberculosis
DLQRALGATPNTG

SEQ ID NO: 115648 - protein, 13 aa, Mycobacterium tuberculosis
LQRALGATPNTGP

SEQ ID NO: 115649 - protein, 13 aa, Mycobacterium tuberculosis
QRALGATPNTGPA

SEQ ID NO: 115650 - protein, 13 aa, Mycobacterium tuberculosis
RALGATPNTGPAP

SEQ ID NO: 115651 - protein, 13 aa, Mycobacterium tuberculosis
ALGATPNTGPAPQ

SEQ ID NO: 115652 - protein, 13 aa, Mycobacterium tuberculosis
LGATPNTGPAPQG

SEQ ID NO: 115653 - protein, 13 aa, Mycobacterium tuberculosis
GATPNTGPAPQGA

SEQ ID NO: 115654 - protein, 14 aa, Mycobacterium tuberculosis
MQLVDRVRGAVTGM

SEQ ID NO: 115655 - protein, 14 aa, Mycobacterium tuberculosis
QLVDRVRGAVTGMS

SEQ ID NO: 115656 - protein, 14 aa, Mycobacterium tuberculosis
LVDRVRGAVTGMSR

SEQ ID NO: 115657 - protein, 14 aa, Mycobacterium tuberculosis
VDRVRGAVTGMSRR

SEQ ID NO: 115658 - protein, 14 aa, Mycobacterium tuberculosis
DRVRGAVTGMSRRL

SEQ ID NO: 115659 - protein, 14 aa, Mycobacterium tuberculosis
RVRGAVTGMSRRLV

SEQ ID NO: 115660 - protein, 14 aa, Mycobacterium tuberculosis
VRGAVTGMSRRLVV

SEQ ID NO: 115661 - protein, 14 aa, Mycobacterium tuberculosis
RGAVTGMSRRLVVG

SEQ ID NO: 115662 - protein, 14 aa, Mycobacterium tuberculosis
GAVTGMSRRLVVGA

SEQ ID NO: 115663 - protein, 14 aa, Mycobacterium tuberculosis
AVTGMSRRLVVGAV

SEQ ID NO: 115664 - protein, 14 aa, Mycobacterium tuberculosis
VTGMSRRLVVGAVG

SEQ ID NO: 115665 - protein, 14 aa, Mycobacterium tuberculosis
TGMSRRLVVGAVGA

SEQ ID NO: 115666 - protein, 14 aa, Mycobacterium tuberculosis
GMSRRLVVGAVGAA

SEQ ID NO: 115667 - protein, 14 aa, Mycobacterium tuberculosis
MSRRLVVGAVGAAL

SEQ ID NO: 115668 - protein, 14 aa, Mycobacterium tuberculosis
SRRLVVGAVGAALV

SEQ ID NO: 115669 - protein, 14 aa, Mycobacterium tuberculosis
RRLVVGAVGAALVS

SEQ ID NO: 115670 - protein, 14 aa, Mycobacterium tuberculosis
RLVVGAVGAALVSG

SEQ ID NO: 115671 - protein, 14 aa, Mycobacterium tuberculosis
LVVGAVGAALVSGL

SEQ ID NO: 115672 - protein, 14 aa, Mycobacterium tuberculosis
VVGAVGAALVSGLV

SEQ ID NO: 115673 - protein, 14 aa, Mycobacterium tuberculosis
VGAVGAALVSGLVG

SEQ ID NO: 115674 - protein, 14 aa, Mycobacterium tuberculosis
GAVGAALVSGLVGA

SEQ ID NO: 115675 - protein, 14 aa, Mycobacterium tuberculosis
AVGAALVSGLVGAV

SEQ ID NO: 115676 - protein, 14 aa, Mycobacterium tuberculosis
VGAALVSGLVGAVG

SEQ ID NO: 115677 - protein, 14 aa, Mycobacterium tuberculosis
GAALVSGLVGAVGG

SEQ ID NO: 115678 - protein, 14 aa, Mycobacterium tuberculosis
AALVSGLVGAVGGT

SEQ ID NO: 115679 - protein, 14 aa, Mycobacterium tuberculosis
ALVSGLVGAVGGTA

SEQ ID NO: 115680 - protein, 14 aa, Mycobacterium tuberculosis
LVSGLVGAVGGTAT

SEQ ID NO: 115681 - protein, 14 aa, Mycobacterium tuberculosis
VSGLVGAVGGTATA

SEQ ID NO: 115682 - protein, 14 aa, Mycobacterium tuberculosis
SGLVGAVGGTATAG

SEQ ID NO: 115683 - protein, 14 aa, Mycobacterium tuberculosis
GLVGAVGGTATAGA

SEQ ID NO: 115684 - protein, 14 aa, Mycobacterium tuberculosis
LVGAVGGTATAGAF

SEQ ID NO: 115685 - protein, 14 aa, Mycobacterium tuberculosis
VGAVGGTATAGAFS

SEQ ID NO: 115686 - protein, 14 aa, Mycobacterium tuberculosis
GAVGGTATAGAFSR

SEQ ID NO: 115687 - protein, 14 aa, Mycobacterium tuberculosis
AVGGTATAGAFSRP

SEQ ID NO: 115688 - protein, 14 aa, Mycobacterium tuberculosis
VGGTATAGAFSRPG

SEQ ID NO: 115689 - protein, 14 aa, Mycobacterium tuberculosis
GGTATAGAFSRPGL

SEQ ID NO: 115690 - protein, 14 aa, Mycobacterium tuberculosis
GTATAGAFSRPGLP

SEQ ID NO: 115691 - protein, 14 aa, Mycobacterium tuberculosis
TATAGAFSRPGLPV

SEQ ID NO: 115692 - protein, 14 aa, Mycobacterium tuberculosis
ATAGAFSRPGLPVE

SEQ ID NO: 115693 - protein, 14 aa, Mycobacterium tuberculosis
TAGAFSRPGLPVEY

SEQ ID NO: 115694 - protein, 14 aa, Mycobacterium tuberculosis
AGAFSRPGLPVEYL

SEQ ID NO: 115695 - protein, 14 aa, Mycobacterium tuberculosis
GAFSRPGLPVEYLQ

SEQ ID NO: 115696 - protein, 14 aa, Mycobacterium tuberculosis
AFSRPGLPVEYLQV

SEQ ID NO: 115697 - protein, 14 aa, Mycobacterium tuberculosis
FSRPGLPVEYLQVP

SEQ ID NO: 115698 - protein, 14 aa, Mycobacterium tuberculosis
SRPGLPVEYLQVPS

SEQ ID NO: 115699 - protein, 14 aa, Mycobacterium tuberculosis
RPGLPVEYLQVPSP

SEQ ID NO: 115700 - protein, 14 aa, Mycobacterium tuberculosis
PGLPVEYLQVPSPS

SEQ ID NO: 115701 - protein, 14 aa, Mycobacterium tuberculosis
GLPVEYLQVPSPSM

SEQ ID NO: 115702 - protein, 14 aa, Mycobacterium tuberculosis
LPVEYLQVPSPSMG

SEQ ID NO: 115703 - protein, 14 aa, Mycobacterium tuberculosis
PVEYLQVPSPSMGR

SEQ ID NO: 115704 - protein, 14 aa, Mycobacterium tuberculosis
VEYLQVPSPSMGRD

SEQ ID NO: 115705 - protein, 14 aa, Mycobacterium tuberculosis
EYLQVPSPSMGRDI

SEQ ID NO: 115706 - protein, 14 aa, Mycobacterium tuberculosis
YLQVPSPSMGRDIK

SEQ ID NO: 115707 - protein, 14 aa, Mycobacterium tuberculosis
LQVPSPSMGRDIKV

SEQ ID NO: 115708 - protein, 14 aa, Mycobacterium tuberculosis
QVPSPSMGRDIKVQ

SEQ ID NO: 115709 - protein, 14 aa, Mycobacterium tuberculosis
VPSPSMGRDIKVQF

SEQ ID NO: 115710 - protein, 14 aa, Mycobacterium tuberculosis
PSPSMGRDIKVQFQ

SEQ ID NO: 115711 - protein, 14 aa, Mycobacterium tuberculosis
SPSMGRDIKVQFQS

SEQ ID NO: 115712 - protein, 14 aa, Mycobacterium tuberculosis
PSMGRDIKVQFQSG

SEQ ID NO: 115713 - protein, 14 aa, Mycobacterium tuberculosis
SMGRDIKVQFQSGG

SEQ ID NO: 115714 - protein, 14 aa, Mycobacterium tuberculosis
MGRDIKVQFQSGGA

SEQ ID NO: 115715 - protein, 14 aa, Mycobacterium tuberculosis
GRDIKVQFQSGGAN

SEQ ID NO: 115716 - protein, 14 aa, Mycobacterium tuberculosis
RDIKVQFQSGGANS

SEQ ID NO: 115717 - protein, 14 aa, Mycobacterium tuberculosis
DIKVQFQSGGANSP

SEQ ID NO: 115718 - protein, 14 aa, Mycobacterium tuberculosis
IKVQFQSGGANSPA

SEQ ID NO: 115719 - protein, 14 aa, Mycobacterium tuberculosis
KVQFQSGGANSPAL

SEQ ID NO: 115720 - protein, 14 aa, Mycobacterium tuberculosis
VQFQSGGANSPALY

SEQ ID NO: 115721 - protein, 14 aa, Mycobacterium tuberculosis
QFQSGGANSPALYL

SEQ ID NO: 115722 - protein, 14 aa, Mycobacterium tuberculosis
FQSGGANSPALYLL

SEQ ID NO: 115723 - protein, 14 aa, Mycobacterium tuberculosis
QSGGANSPALYLLD

SEQ ID NO: 115724 - protein, 14 aa, Mycobacterium tuberculosis
SGGANSPALYLLDG

SEQ ID NO: 115725 - protein, 14 aa, Mycobacterium tuberculosis
GGANSPALYLLDGL

SEQ ID NO: 115726 - protein, 14 aa, Mycobacterium tuberculosis
GANSPALYLLDGLR

SEQ ID NO: 115727 - protein, 14 aa, Mycobacterium tuberculosis
ANSPALYLLDGLRA

SEQ ID NO: 115728 - protein, 14 aa, Mycobacterium tuberculosis
NSPALYLLDGLRAQ

SEQ ID NO: 115729 - protein, 14 aa, Mycobacterium tuberculosis
SPALYLLDGLRAQD

SEQ ID NO: 115730 - protein, 14 aa, Mycobacterium tuberculosis
PALYLLDGLRAQDD

SEQ ID NO: 115731 - protein, 14 aa, Mycobacterium tuberculosis
ALYLLDGLRAQDDF

SEQ ID NO: 115732 - protein, 14 aa, Mycobacterium tuberculosis
LYLLDGLRAQDDFS

SEQ ID NO: 115733 - protein, 14 aa, Mycobacterium tuberculosis
YLLDGLRAQDDFSG

SEQ ID NO: 115734 - protein, 14 aa, Mycobacterium tuberculosis
LLDGLRAQDDFSGW

SEQ ID NO: 115735 - protein, 14 aa, Mycobacterium tuberculosis
LDGLRAQDDFSGWD

SEQ ID NO: 115736 - protein, 14 aa, Mycobacterium tuberculosis
DGLRAQDDFSGWDI

SEQ ID NO: 115737 - protein, 14 aa, Mycobacterium tuberculosis
GLRAQDDFSGWDIN

SEQ ID NO: 115738 - protein, 14 aa, Mycobacterium tuberculosis
LRAQDDFSGWDINT

SEQ ID NO: 115739 - protein, 14 aa, Mycobacterium tuberculosis
RAQDDFSGWDINTP

SEQ ID NO: 115740 - protein, 14 aa, Mycobacterium tuberculosis
AQDDFSGWDINTPA

SEQ ID NO: 115741 - protein, 14 aa, Mycobacterium tuberculosis
QDDFSGWDINTPAF

SEQ ID NO: 115742 - protein, 14 aa, Mycobacterium tuberculosis
DDFSGWDINTPAFE

SEQ ID NO: 115743 - protein, 14 aa, Mycobacterium tuberculosis
DFSGWDINTPAFEW

SEQ ID NO: 115744 - protein, 14 aa, Mycobacterium tuberculosis
FSGWDINTPAFEWY

SEQ ID NO: 115745 - protein, 14 aa, Mycobacterium tuberculosis
SGWDINTPAFEWYD

SEQ ID NO: 115746 - protein, 14 aa, Mycobacterium tuberculosis
GWDINTPAFEWYDQ

SEQ ID NO: 115747 - protein, 14 aa, Mycobacterium tuberculosis
WDINTPAFEWYDQS

SEQ ID NO: 115748 - protein, 14 aa, Mycobacterium tuberculosis
DINTPAFEWYDQSG

SEQ ID NO: 115749 - protein, 14 aa, Mycobacterium tuberculosis
INTPAFEWYDQSGL

SEQ ID NO: 115750 - protein, 14 aa, Mycobacterium tuberculosis
NTPAFEWYDQSGLS

SEQ ID NO: 115751 - protein, 14 aa, Mycobacterium tuberculosis
TPAFEWYDQSGLSV

SEQ ID NO: 115752 - protein, 14 aa, Mycobacterium tuberculosis
PAFEWYDQSGLSVV

SEQ ID NO: 115753 - protein, 14 aa, Mycobacterium tuberculosis
AFEWYDQSGLSVVM

SEQ ID NO: 115754 - protein, 14 aa, Mycobacterium tuberculosis
FEWYDQSGLSVVMP

SEQ ID NO: 115755 - protein, 14 aa, Mycobacterium tuberculosis
EWYDQSGLSVVMPV

SEQ ID NO: 115756 - protein, 14 aa, Mycobacterium tuberculosis
WYDQSGLSVVMPVG

SEQ ID NO: 115757 - protein, 14 aa, Mycobacterium tuberculosis
YDQSGLSVVMPVGG

SEQ ID NO: 115758 - protein, 14 aa, Mycobacterium tuberculosis
DQSGLSVVMPVGGQ

SEQ ID NO: 115759 - protein, 14 aa, Mycobacterium tuberculosis
QSGLSVVMPVGGQS

SEQ ID NO: 115760 - protein, 14 aa, Mycobacterium tuberculosis
SGLSVVMPVGGQSS

SEQ ID NO: 115761 - protein, 14 aa, Mycobacterium tuberculosis
GLSVVMPVGGQSSF

SEQ ID NO: 115762 - protein, 14 aa, Mycobacterium tuberculosis
LSVVMPVGGQSSFY

SEQ ID NO: 115763 - protein, 14 aa, Mycobacterium tuberculosis
SVVMPVGGQSSFYS

SEQ ID NO: 115764 - protein, 14 aa, Mycobacterium tuberculosis
VVMPVGGQSSFYSD

SEQ ID NO: 115765 - protein, 14 aa, Mycobacterium tuberculosis
VMPVGGQSSFYSDW

SEQ ID NO: 115766 - protein, 14 aa, Mycobacterium tuberculosis
MPVGGQSSFYSDWY

SEQ ID NO: 115767 - protein, 14 aa, Mycobacterium tuberculosis
PVGGQSSFYSDWYQ

SEQ ID NO: 115768 - protein, 14 aa, Mycobacterium tuberculosis
VGGQSSFYSDWYQP

SEQ ID NO: 115769 - protein, 14 aa, Mycobacterium tuberculosis
GGQSSFYSDWYQPA

SEQ ID NO: 115770 - protein, 14 aa, Mycobacterium tuberculosis
GQSSFYSDWYQPAC

SEQ ID NO: 115771 - protein, 14 aa, Mycobacterium tuberculosis
QSSFYSDWYQPACG

SEQ ID NO: 115772 - protein, 14 aa, Mycobacterium tuberculosis
SSFYSDWYQPACGK

SEQ ID NO: 115773 - protein, 14 aa, Mycobacterium tuberculosis
SFYSDWYQPACGKA

SEQ ID NO: 115774 - protein, 14 aa, Mycobacterium tuberculosis
FYSDWYQPACGKAG

SEQ ID NO: 115775 - protein, 14 aa, Mycobacterium tuberculosis
YSDWYQPACGKAGC

SEQ ID NO: 115776 - protein, 14 aa, Mycobacterium tuberculosis
SDWYQPACGKAGCQ

SEQ ID NO: 115777 - protein, 14 aa, Mycobacterium tuberculosis
DWYQPACGKAGCQT

SEQ ID NO: 115778 - protein, 14 aa, Mycobacterium tuberculosis
WYQPACGKAGCQTY

SEQ ID NO: 115779 - protein, 14 aa, Mycobacterium tuberculosis
YQPACGKAGCQTYK

SEQ ID NO: 115780 - protein, 14 aa, Mycobacterium tuberculosis
QPACGKAGCQTYKW

SEQ ID NO: 115781 - protein, 14 aa, Mycobacterium tuberculosis
PACGKAGCQTYKWE

SEQ ID NO: 115782 - protein, 14 aa, Mycobacterium tuberculosis
ACGKAGCQTYKWET

SEQ ID NO: 115783 - protein, 14 aa, Mycobacterium tuberculosis
CGKAGCQTYKWETF

SEQ ID NO: 115784 - protein, 14 aa, Mycobacterium tuberculosis
GKAGCQTYKWETFL

SEQ ID NO: 115785 - protein, 14 aa, Mycobacterium tuberculosis
KAGCQTYKWETFLT

SEQ ID NO: 115786 - protein, 14 aa, Mycobacterium tuberculosis
AGCQTYKWETFLTS

SEQ ID NO: 115787 - protein, 14 aa, Mycobacterium tuberculosis
GCQTYKWETFLTSE

SEQ ID NO: 115788 - protein, 14 aa, Mycobacterium tuberculosis
CQTYKWETFLTSEL

SEQ ID NO: 115789 - protein, 14 aa, Mycobacterium tuberculosis
QTYKWETFLTSELP

SEQ ID NO: 115790 - protein, 14 aa, Mycobacterium tuberculosis
TYKWETFLTSELPG

SEQ ID NO: 115791 - protein, 14 aa, Mycobacterium tuberculosis
YKWETFLTSELPGW

SEQ ID NO: 115792 - protein, 14 aa, Mycobacterium tuberculosis
KWETFLTSELPGWL

SEQ ID NO: 115793 - protein, 14 aa, Mycobacterium tuberculosis
WETFLTSELPGWLQ

SEQ ID NO: 115794 - protein, 14 aa, Mycobacterium tuberculosis
ETFLTSELPGWLQA

SEQ ID NO: 115795 - protein, 14 aa, Mycobacterium tuberculosis
TFLTSELPGWLQAN

SEQ ID NO: 115796 - protein, 14 aa, Mycobacterium tuberculosis
FLTSELPGWLQANR

SEQ ID NO: 115797 - protein, 14 aa, Mycobacterium tuberculosis
LTSELPGWLQANRH

SEQ ID NO: 115798 - protein, 14 aa, Mycobacterium tuberculosis
TSELPGWLQANRHV

SEQ ID NO: 115799 - protein, 14 aa, Mycobacterium tuberculosis
SELPGWLQANRHVK

SEQ ID NO: 115800 - protein, 14 aa, Mycobacterium tuberculosis
ELPGWLQANRHVKP

SEQ ID NO: 115801 - protein, 14 aa, Mycobacterium tuberculosis
LPGWLQANRHVKPT

SEQ ID NO: 115802 - protein, 14 aa, Mycobacterium tuberculosis
PGWLQANRHVKPTG

SEQ ID NO: 115803 - protein, 14 aa, Mycobacterium tuberculosis
GWLQANRHVKPTGS

SEQ ID NO: 115804 - protein, 14 aa, Mycobacterium tuberculosis
WLQANRHVKPTGSA

SEQ ID NO: 115805 - protein, 14 aa, Mycobacterium tuberculosis
LQANRHVKPTGSAV

SEQ ID NO: 115806 - protein, 14 aa, Mycobacterium tuberculosis
QANRHVKPTGSAVV

SEQ ID NO: 115807 - protein, 14 aa, Mycobacterium tuberculosis
ANRHVKPTGSAVVG

SEQ ID NO: 115808 - protein, 14 aa, Mycobacterium tuberculosis
NRHVKPTGSAVVGL

SEQ ID NO: 115809 - protein, 14 aa, Mycobacterium tuberculosis
RHVKPTGSAVVGLS

SEQ ID NO: 115810 - protein, 14 aa, Mycobacterium tuberculosis
HVKPTGSAVVGLSM

SEQ ID NO: 115811 - protein, 14 aa, Mycobacterium tuberculosis
VKPTGSAVVGLSMA

SEQ ID NO: 115812 - protein, 14 aa, Mycobacterium tuberculosis
KPTGSAVVGLSMAA

SEQ ID NO: 115813 - protein, 14 aa, Mycobacterium tuberculosis
PTGSAVVGLSMAAS

SEQ ID NO: 115814 - protein, 14 aa, Mycobacterium tuberculosis
TGSAVVGLSMAASS

SEQ ID NO: 115815 - protein, 14 aa, Mycobacterium tuberculosis
GSAVVGLSMAASSA

SEQ ID NO: 115816 - protein, 14 aa, Mycobacterium tuberculosis
SAVVGLSMAASSAL

SEQ ID NO: 115817 - protein, 14 aa, Mycobacterium tuberculosis
AVVGLSMAASSALT

SEQ ID NO: 115818 - protein, 14 aa, Mycobacterium tuberculosis
VVGLSMAASSALTL

SEQ ID NO: 115819 - protein, 14 aa, Mycobacterium tuberculosis
VGLSMAASSALTLA

SEQ ID NO: 115820 - protein, 14 aa, Mycobacterium tuberculosis
GLSMAASSALTLAI

SEQ ID NO: 115821 - protein, 14 aa, Mycobacterium tuberculosis
LSMAASSALTLAIY

SEQ ID NO: 115822 - protein, 14 aa, Mycobacterium tuberculosis
SMAASSALTLAIYH

SEQ ID NO: 115823 - protein, 14 aa, Mycobacterium tuberculosis
MAASSALTLAIYHP

SEQ ID NO: 115824 - protein, 14 aa, Mycobacterium tuberculosis
AASSALTLAIYHPQ

SEQ ID NO: 115825 - protein, 14 aa, Mycobacterium tuberculosis
ASSALTLAIYHPQQ

SEQ ID NO: 115826 - protein, 14 aa, Mycobacterium tuberculosis
SSALTLAIYHPQQF

SEQ ID NO: 115827 - protein, 14 aa, Mycobacterium tuberculosis
SALTLAIYHPQQFV

SEQ ID NO: 115828 - protein, 14 aa, Mycobacterium tuberculosis
ALTLAIYHPQQFVY

SEQ ID NO: 115829 - protein, 14 aa, Mycobacterium tuberculosis
LTLAIYHPQQFVYA

SEQ ID NO: 115830 - protein, 14 aa, Mycobacterium tuberculosis
TLAIYHPQQFVYAG

SEQ ID NO: 115831 - protein, 14 aa, Mycobacterium tuberculosis
LAIYHPQQFVYAGA

SEQ ID NO: 115832 - protein, 14 aa, Mycobacterium tuberculosis
AIYHPQQFVYAGAM

SEQ ID NO: 115833 - protein, 14 aa, Mycobacterium tuberculosis
IYHPQQFVYAGAMS

SEQ ID NO: 115834 - protein, 14 aa, Mycobacterium tuberculosis
YHPQQFVYAGAMSG

SEQ ID NO: 115835 - protein, 14 aa, Mycobacterium tuberculosis
HPQQFVYAGAMSGL

SEQ ID NO: 115836 - protein, 14 aa, Mycobacterium tuberculosis
PQQFVYAGAMSGLL

SEQ ID NO: 115837 - protein, 14 aa, Mycobacterium tuberculosis
QQFVYAGAMSGLLD

SEQ ID NO: 115838 - protein, 14 aa, Mycobacterium tuberculosis
QFVYAGAMSGLLDP

SEQ ID NO: 115839 - protein, 14 aa, Mycobacterium tuberculosis
FVYAGAMSGLLDPS

SEQ ID NO: 115840 - protein, 14 aa, Mycobacterium tuberculosis
VYAGAMSGLLDPSQ

SEQ ID NO: 115841 - protein, 14 aa, Mycobacterium tuberculosis
YAGAMSGLLDPSQA

SEQ ID NO: 115842 - protein, 14 aa, Mycobacterium tuberculosis
AGAMSGLLDPSQAM

SEQ ID NO: 115843 - protein, 14 aa, Mycobacterium tuberculosis
GAMSGLLDPSQAMG

SEQ ID NO: 115844 - protein, 14 aa, Mycobacterium tuberculosis
AMSGLLDPSQAMGP

SEQ ID NO: 115845 - protein, 14 aa, Mycobacterium tuberculosis
MSGLLDPSQAMGPT

SEQ ID NO: 115846 - protein, 14 aa, Mycobacterium tuberculosis
SGLLDPSQAMGPTL

SEQ ID NO: 115847 - protein, 14 aa, Mycobacterium tuberculosis
GLLDPSQAMGPTLI

SEQ ID NO: 115848 - protein, 14 aa, Mycobacterium tuberculosis
LLDPSQAMGPTLIG

SEQ ID NO: 115849 - protein, 14 aa, Mycobacterium tuberculosis
LDPSQAMGPTLIGL

SEQ ID NO: 115850 - protein, 14 aa, Mycobacterium tuberculosis
DPSQAMGPTLIGLA

SEQ ID NO: 115851 - protein, 14 aa, Mycobacterium tuberculosis
PSQAMGPTLIGLAM

SEQ ID NO: 115852 - protein, 14 aa, Mycobacterium tuberculosis
SQAMGPTLIGLAMG

SEQ ID NO: 115853 - protein, 14 aa, Mycobacterium tuberculosis
QAMGPTLIGLAMGD

SEQ ID NO: 115854 - protein, 14 aa, Mycobacterium tuberculosis
AMGPTLIGLAMGDA

SEQ ID NO: 115855 - protein, 14 aa, Mycobacterium tuberculosis
MGPTLIGLAMGDAG

SEQ ID NO: 115856 - protein, 14 aa, Mycobacterium tuberculosis
GPTLIGLAMGDAGG

SEQ ID NO: 115857 - protein, 14 aa, Mycobacterium tuberculosis
PTLIGLAMGDAGGY

SEQ ID NO: 115858 - protein, 14 aa, Mycobacterium tuberculosis
TLIGLAMGDAGGYK

SEQ ID NO: 115859 - protein, 14 aa, Mycobacterium tuberculosis
LIGLAMGDAGGYKA

SEQ ID NO: 115860 - protein, 14 aa, Mycobacterium tuberculosis
IGLAMGDAGGYKAS

SEQ ID NO: 115861 - protein, 14 aa, Mycobacterium tuberculosis
GLAMGDAGGYKASD

SEQ ID NO: 115862 - protein, 14 aa, Mycobacterium tuberculosis
LAMGDAGGYKASDM

SEQ ID NO: 115863 - protein, 14 aa, Mycobacterium tuberculosis
AMGDAGGYKASDMW

SEQ ID NO: 115864 - protein, 14 aa, Mycobacterium tuberculosis
MGDAGGYKASDMWG

SEQ ID NO: 115865 - protein, 14 aa, Mycobacterium tuberculosis
GDAGGYKASDMWGP

SEQ ID NO: 115866 - protein, 14 aa, Mycobacterium tuberculosis
DAGGYKASDMWGPK

SEQ ID NO: 115867 - protein, 14 aa, Mycobacterium tuberculosis
AGGYKASDMWGPKE

SEQ ID NO: 115868 - protein, 14 aa, Mycobacterium tuberculosis
GGYKASDMWGPKED

SEQ ID NO: 115869 - protein, 14 aa, Mycobacterium tuberculosis
GYKASDMWGPKEDP

SEQ ID NO: 115870 - protein, 14 aa, Mycobacterium tuberculosis
YKASDMWGPKEDPA

SEQ ID NO: 115871 - protein, 14 aa, Mycobacterium tuberculosis
KASDMWGPKEDPAW

SEQ ID NO: 115872 - protein, 14 aa, Mycobacterium tuberculosis
ASDMWGPKEDPAWQ

SEQ ID NO: 115873 - protein, 14 aa, Mycobacterium tuberculosis
SDMWGPKEDPAWQR

SEQ ID NO: 115874 - protein, 14 aa, Mycobacterium tuberculosis
DMWGPKEDPAWQRN

SEQ ID NO: 115875 - protein, 14 aa, Mycobacterium tuberculosis
MWGPKEDPAWQRND

SEQ ID NO: 115876 - protein, 14 aa, Mycobacterium tuberculosis
WGPKEDPAWQRNDP

SEQ ID NO: 115877 - protein, 14 aa, Mycobacterium tuberculosis
GPKEDPAWQRNDPL

SEQ ID NO: 115878 - protein, 14 aa, Mycobacterium tuberculosis
PKEDPAWQRNDPLL

SEQ ID NO: 115879 - protein, 14 aa, Mycobacterium tuberculosis
KEDPAWQRNDPLLN

SEQ ID NO: 115880 - protein, 14 aa, Mycobacterium tuberculosis
EDPAWQRNDPLLNV

SEQ ID NO: 115881 - protein, 14 aa, Mycobacterium tuberculosis
DPAWQRNDPLLNVG

SEQ ID NO: 115882 - protein, 14 aa, Mycobacterium tuberculosis
PAWQRNDPLLNVGK

SEQ ID NO: 115883 - protein, 14 aa, Mycobacterium tuberculosis
AWQRNDPLLNVGKL

SEQ ID NO: 115884 - protein, 14 aa, Mycobacterium tuberculosis
WQRNDPLLNVGKLI

SEQ ID NO: 115885 - protein, 14 aa, Mycobacterium tuberculosis
QRNDPLLNVGKLIA

SEQ ID NO: 115886 - protein, 14 aa, Mycobacterium tuberculosis
RNDPLLNVGKLIAN

SEQ ID NO: 115887 - protein, 14 aa, Mycobacterium tuberculosis
NDPLLNVGKLIANN

SEQ ID NO: 115888 - protein, 14 aa, Mycobacterium tuberculosis
DPLLNVGKLIANNT

SEQ ID NO: 115889 - protein, 14 aa, Mycobacterium tuberculosis
PLLNVGKLIANNTR

SEQ ID NO: 115890 - protein, 14 aa, Mycobacterium tuberculosis
LLNVGKLIANNTRV

SEQ ID NO: 115891 - protein, 14 aa, Mycobacterium tuberculosis
LNVGKLIANNTRVW

SEQ ID NO: 115892 - protein, 14 aa, Mycobacterium tuberculosis
NVGKLIANNTRVWV

SEQ ID NO: 115893 - protein, 14 aa, Mycobacterium tuberculosis
VGKLIANNTRVWVY

SEQ ID NO: 115894 - protein, 14 aa, Mycobacterium tuberculosis
GKLIANNTRVWVYC

SEQ ID NO: 115895 - protein, 14 aa, Mycobacterium tuberculosis
KLIANNTRVWVYCG

SEQ ID NO: 115896 - protein, 14 aa, Mycobacterium tuberculosis
LIANNTRVWVYCGN

SEQ ID NO: 115897 - protein, 14 aa, Mycobacterium tuberculosis
IANNTRVWVYCGNG

SEQ ID NO: 115898 - protein, 14 aa, Mycobacterium tuberculosis
ANNTRVWVYCGNGK

SEQ ID NO: 115899 - protein, 14 aa, Mycobacterium tuberculosis
NNTRVWVYCGNGKP

SEQ ID NO: 115900 - protein, 14 aa, Mycobacterium tuberculosis
NTRVWVYCGNGKPS

SEQ ID NO: 115901 - protein, 14 aa, Mycobacterium tuberculosis
TRVWVYCGNGKPSD

SEQ ID NO: 115902 - protein, 14 aa, Mycobacterium tuberculosis
RVWVYCGNGKPSDL

SEQ ID NO: 115903 - protein, 14 aa, Mycobacterium tuberculosis
VWVYCGNGKPSDLG

SEQ ID NO: 115904 - protein, 14 aa, Mycobacterium tuberculosis
WVYCGNGKPSDLGG

SEQ ID NO: 115905 - protein, 14 aa, Mycobacterium tuberculosis
VYCGNGKPSDLGGN

SEQ ID NO: 115906 - protein, 14 aa, Mycobacterium tuberculosis
YCGNGKPSDLGGNN

SEQ ID NO: 115907 - protein, 14 aa, Mycobacterium tuberculosis
CGNGKPSDLGGNNL

SEQ ID NO: 115908 - protein, 14 aa, Mycobacterium tuberculosis
GNGKPSDLGGNNLP

SEQ ID NO: 115909 - protein, 14 aa, Mycobacterium tuberculosis
NGKPSDLGGNNLPA

SEQ ID NO: 115910 - protein, 14 aa, Mycobacterium tuberculosis
GKPSDLGGNNLPAK

SEQ ID NO: 115911 - protein, 14 aa, Mycobacterium tuberculosis
KPSDLGGNNLPAKF

SEQ ID NO: 115912 - protein, 14 aa, Mycobacterium tuberculosis
PSDLGGNNLPAKFL

SEQ ID NO: 115913 - protein, 14 aa, Mycobacterium tuberculosis
SDLGGNNLPAKFLE

SEQ ID NO: 115914 - protein, 14 aa, Mycobacterium tuberculosis
DLGGNNLPAKFLEG

SEQ ID NO: 115915 - protein, 14 aa, Mycobacterium tuberculosis
LGGNNLPAKFLEGF

SEQ ID NO: 115916 - protein, 14 aa, Mycobacterium tuberculosis
GGNNLPAKFLEGFV

SEQ ID NO: 115917 - protein, 14 aa, Mycobacterium tuberculosis
GNNLPAKFLEGFVR

SEQ ID NO: 115918 - protein, 14 aa, Mycobacterium tuberculosis
NNLPAKFLEGFVRT

SEQ ID NO: 115919 - protein, 14 aa, Mycobacterium tuberculosis
NLPAKFLEGFVRTS

SEQ ID NO: 115920 - protein, 14 aa, Mycobacterium tuberculosis
LPAKFLEGFVRTSN

SEQ ID NO: 115921 - protein, 14 aa, Mycobacterium tuberculosis
PAKFLEGFVRTSNI

SEQ ID NO: 115922 - protein, 14 aa, Mycobacterium tuberculosis
AKFLEGFVRTSNIK

SEQ ID NO: 115923 - protein, 14 aa, Mycobacterium tuberculosis
KFLEGFVRTSNIKF

SEQ ID NO: 115924 - protein, 14 aa, Mycobacterium tuberculosis
FLEGFVRTSNIKFQ

SEQ ID NO: 115925 - protein, 14 aa, Mycobacterium tuberculosis
LEGFVRTSNIKFQD

SEQ ID NO: 115926 - protein, 14 aa, Mycobacterium tuberculosis
EGFVRTSNIKFQDA

SEQ ID NO: 115927 - protein, 14 aa, Mycobacterium tuberculosis
GFVRTSNIKFQDAY

SEQ ID NO: 115928 - protein, 14 aa, Mycobacterium tuberculosis
FVRTSNIKFQDAYN

SEQ ID NO: 115929 - protein, 14 aa, Mycobacterium tuberculosis
VRTSNIKFQDAYNA

SEQ ID NO: 115930 - protein, 14 aa, Mycobacterium tuberculosis
RTSNIKFQDAYNAG

SEQ ID NO: 115931 - protein, 14 aa, Mycobacterium tuberculosis
TSNIKFQDAYNAGG

SEQ ID NO: 115932 - protein, 14 aa, Mycobacterium tuberculosis
SNIKFQDAYNAGGG

SEQ ID NO: 115933 - protein, 14 aa, Mycobacterium tuberculosis
NIKFQDAYNAGGGH

SEQ ID NO: 115934 - protein, 14 aa, Mycobacterium tuberculosis
IKFQDAYNAGGGHN

SEQ ID NO: 115935 - protein, 14 aa, Mycobacterium tuberculosis
KFQDAYNAGGGHNG

SEQ ID NO: 115936 - protein, 14 aa, Mycobacterium tuberculosis
FQDAYNAGGGHNGV

SEQ ID NO: 115937 - protein, 14 aa, Mycobacterium tuberculosis
QDAYNAGGGHNGVF

SEQ ID NO: 115938 - protein, 14 aa, Mycobacterium tuberculosis
DAYNAGGGHNGVFD

SEQ ID NO: 115939 - protein, 14 aa, Mycobacterium tuberculosis
AYNAGGGHNGVFDF

SEQ ID NO: 115940 - protein, 14 aa, Mycobacterium tuberculosis
YNAGGGHNGVFDFP

SEQ ID NO: 115941 - protein, 14 aa, Mycobacterium tuberculosis
NAGGGHNGVFDFPD

SEQ ID NO: 115942 - protein, 14 aa, Mycobacterium tuberculosis
AGGGHNGVFDFPDS

SEQ ID NO: 115943 - protein, 14 aa, Mycobacterium tuberculosis
GGGHNGVFDFPDSG

SEQ ID NO: 115944 - protein, 14 aa, Mycobacterium tuberculosis
GGHNGVFDFPDSGT

SEQ ID NO: 115945 - protein, 14 aa, Mycobacterium tuberculosis
GHNGVFDFPDSGTH

SEQ ID NO: 115946 - protein, 14 aa, Mycobacterium tuberculosis
HNGVFDFPDSGTHS

SEQ ID NO: 115947 - protein, 14 aa, Mycobacterium tuberculosis
NGVFDFPDSGTHSW

SEQ ID NO: 115948 - protein, 14 aa, Mycobacterium tuberculosis
GVFDFPDSGTHSWE

SEQ ID NO: 115949 - protein, 14 aa, Mycobacterium tuberculosis
VFDFPDSGTHSWEY

SEQ ID NO: 115950 - protein, 14 aa, Mycobacterium tuberculosis
FDFPDSGTHSWEYW

SEQ ID NO: 115951 - protein, 14 aa, Mycobacterium tuberculosis
DFPDSGTHSWEYWG

SEQ ID NO: 115952 - protein, 14 aa, Mycobacterium tuberculosis
FPDSGTHSWEYWGA

SEQ ID NO: 115953 - protein, 14 aa, Mycobacterium tuberculosis
PDSGTHSWEYWGAQ

SEQ ID NO: 115954 - protein, 14 aa, Mycobacterium tuberculosis
DSGTHSWEYWGAQL

SEQ ID NO: 115955 - protein, 14 aa, Mycobacterium tuberculosis
SGTHSWEYWGAQLN

SEQ ID NO: 115956 - protein, 14 aa, Mycobacterium tuberculosis
GTHSWEYWGAQLNA

SEQ ID NO: 115957 - protein, 14 aa, Mycobacterium tuberculosis
THSWEYWGAQLNAM

SEQ ID NO: 115958 - protein, 14 aa, Mycobacterium tuberculosis
HSWEYWGAQLNAMK

SEQ ID NO: 115959 - protein, 14 aa, Mycobacterium tuberculosis
SWEYWGAQLNAMKP

SEQ ID NO: 115960 - protein, 14 aa, Mycobacterium tuberculosis
WEYWGAQLNAMKPD

SEQ ID NO: 115961 - protein, 14 aa, Mycobacterium tuberculosis
EYWGAQLNAMKPDL

SEQ ID NO: 115962 - protein, 14 aa, Mycobacterium tuberculosis
YWGAQLNAMKPDLQ

SEQ ID NO: 115963 - protein, 14 aa, Mycobacterium tuberculosis
WGAQLNAMKPDLQR

SEQ ID NO: 115964 - protein, 14 aa, Mycobacterium tuberculosis
GAQLNAMKPDLQRA

SEQ ID NO: 115965 - protein, 14 aa, Mycobacterium tuberculosis
AQLNAMKPDLQRAL

SEQ ID NO: 115966 - protein, 14 aa, Mycobacterium tuberculosis
QLNAMKPDLQRALG

SEQ ID NO: 115967 - protein, 14 aa, Mycobacterium tuberculosis
LNAMKPDLQRALGA

SEQ ID NO: 115968 - protein, 14 aa, Mycobacterium tuberculosis
NAMKPDLQRALGAT

SEQ ID NO: 115969 - protein, 14 aa, Mycobacterium tuberculosis
AMKPDLQRALGATP

SEQ ID NO: 115970 - protein, 14 aa, Mycobacterium tuberculosis
MKPDLQRALGATPN

SEQ ID NO: 115971 - protein, 14 aa, Mycobacterium tuberculosis
KPDLQRALGATPNT

SEQ ID NO: 115972 - protein, 14 aa, Mycobacterium tuberculosis
PDLQRALGATPNTG

SEQ ID NO: 115973 - protein, 14 aa, Mycobacterium tuberculosis
DLQRALGATPNTGP

SEQ ID NO: 115974 - protein, 14 aa, Mycobacterium tuberculosis
LQRALGATPNTGPA

SEQ ID NO: 115975 - protein, 14 aa, Mycobacterium tuberculosis
QRALGATPNTGPAP

SEQ ID NO: 115976 - protein, 14 aa, Mycobacterium tuberculosis
RALGATPNTGPAPQ

SEQ ID NO: 115977 - protein, 14 aa, Mycobacterium tuberculosis
ALGATPNTGPAPQG

SEQ ID NO: 115978 - protein, 14 aa, Mycobacterium tuberculosis
LGATPNTGPAPQGA

SEQ ID NO: 115979 - protein, 15 aa, Mycobacterium tuberculosis
MQLVDRVRGAVTGMS

SEQ ID NO: 115980 - protein, 15 aa, Mycobacterium tuberculosis
QLVDRVRGAVTGMSR

SEQ ID NO: 115981 - protein, 15 aa, Mycobacterium tuberculosis
LVDRVRGAVTGMSRR

SEQ ID NO: 115982 - protein, 15 aa, Mycobacterium tuberculosis
VDRVRGAVTGMSRRL

SEQ ID NO: 115983 - protein, 15 aa, Mycobacterium tuberculosis
DRVRGAVTGMSRRLV

SEQ ID NO: 115984 - protein, 15 aa, Mycobacterium tuberculosis
RVRGAVTGMSRRLVV

SEQ ID NO: 115985 - protein, 15 aa, Mycobacterium tuberculosis
VRGAVTGMSRRLVVG

SEQ ID NO: 115986 - protein, 15 aa, Mycobacterium tuberculosis
RGAVTGMSRRLVVGA

SEQ ID NO: 115987 - protein, 15 aa, Mycobacterium tuberculosis
GAVTGMSRRLVVGAV

SEQ ID NO: 115988 - protein, 15 aa, Mycobacterium tuberculosis
AVTGMSRRLVVGAVG

SEQ ID NO: 115989 - protein, 15 aa, Mycobacterium tuberculosis
VTGMSRRLVVGAVGA

SEQ ID NO: 115990 - protein, 15 aa, Mycobacterium tuberculosis
TGMSRRLVVGAVGAA

SEQ ID NO: 115991 - protein, 15 aa, Mycobacterium tuberculosis
GMSRRLVVGAVGAAL

SEQ ID NO: 115992 - protein, 15 aa, Mycobacterium tuberculosis
MSRRLVVGAVGAALV

SEQ ID NO: 115993 - protein, 15 aa, Mycobacterium tuberculosis
SRRLVVGAVGAALVS

SEQ ID NO: 115994 - protein, 15 aa, Mycobacterium tuberculosis
RRLVVGAVGAALVSG

SEQ ID NO: 115995 - protein, 15 aa, Mycobacterium tuberculosis
RLVVGAVGAALVSGL

SEQ ID NO: 115996 - protein, 15 aa, Mycobacterium tuberculosis
LVVGAVGAALVSGLV

SEQ ID NO: 115997 - protein, 15 aa, Mycobacterium tuberculosis
VVGAVGAALVSGLVG

SEQ ID NO: 115998 - protein, 15 aa, Mycobacterium tuberculosis
VGAVGAALVSGLVGA

SEQ ID NO: 115999 - protein, 15 aa, Mycobacterium tuberculosis
GAVGAALVSGLVGAV

SEQ ID NO: 116000 - protein, 15 aa, Mycobacterium tuberculosis
AVGAALVSGLVGAVG

SEQ ID NO: 116001 - protein, 15 aa, Mycobacterium tuberculosis
VGAALVSGLVGAVGG

SEQ ID NO: 116002 - protein, 15 aa, Mycobacterium tuberculosis
GAALVSGLVGAVGGT

SEQ ID NO: 116003 - protein, 15 aa, Mycobacterium tuberculosis
AALVSGLVGAVGGTA

SEQ ID NO: 116004 - protein, 15 aa, Mycobacterium tuberculosis
ALVSGLVGAVGGTAT

SEQ ID NO: 116005 - protein, 15 aa, Mycobacterium tuberculosis
LVSGLVGAVGGTATA

SEQ ID NO: 116006 - protein, 15 aa, Mycobacterium tuberculosis
VSGLVGAVGGTATAG

SEQ ID NO: 116007 - protein, 15 aa, Mycobacterium tuberculosis
SGLVGAVGGTATAGA

SEQ ID NO: 116008 - protein, 15 aa, Mycobacterium tuberculosis
GLVGAVGGTATAGAF

SEQ ID NO: 116009 - protein, 15 aa, Mycobacterium tuberculosis
LVGAVGGTATAGAFS

SEQ ID NO: 116010 - protein, 15 aa, Mycobacterium tuberculosis
VGAVGGTATAGAFSR

SEQ ID NO: 116011 - protein, 15 aa, Mycobacterium tuberculosis
GAVGGTATAGAFSRP

SEQ ID NO: 116012 - protein, 15 aa, Mycobacterium tuberculosis
AVGGTATAGAFSRPG

SEQ ID NO: 116013 - protein, 15 aa, Mycobacterium tuberculosis
VGGTATAGAFSRPGL

SEQ ID NO: 116014 - protein, 15 aa, Mycobacterium tuberculosis
GGTATAGAFSRPGLP

SEQ ID NO: 116015 - protein, 15 aa, Mycobacterium tuberculosis
GTATAGAFSRPGLPV

SEQ ID NO: 116016 - protein, 15 aa, Mycobacterium tuberculosis
TATAGAFSRPGLPVE

SEQ ID NO: 116017 - protein, 15 aa, Mycobacterium tuberculosis
ATAGAFSRPGLPVEY

SEQ ID NO: 116018 - protein, 15 aa, Mycobacterium tuberculosis
TAGAFSRPGLPVEYL

SEQ ID NO: 116019 - protein, 15 aa, Mycobacterium tuberculosis
AGAFSRPGLPVEYLQ

SEQ ID NO: 116020 - protein, 15 aa, Mycobacterium tuberculosis
GAFSRPGLPVEYLQV

SEQ ID NO: 116021 - protein, 15 aa, Mycobacterium tuberculosis
AFSRPGLPVEYLQVP

SEQ ID NO: 116022 - protein, 15 aa, Mycobacterium tuberculosis
FSRPGLPVEYLQVPS

SEQ ID NO: 116023 - protein, 15 aa, Mycobacterium tuberculosis
SRPGLPVEYLQVPSP

SEQ ID NO: 116024 - protein, 15 aa, Mycobacterium tuberculosis
RPGLPVEYLQVPSPS

SEQ ID NO: 116025 - protein, 15 aa, Mycobacterium tuberculosis
PGLPVEYLQVPSPSM

SEQ ID NO: 116026 - protein, 15 aa, Mycobacterium tuberculosis
GLPVEYLQVPSPSMG

SEQ ID NO: 116027 - protein, 15 aa, Mycobacterium tuberculosis
LPVEYLQVPSPSMGR

SEQ ID NO: 116028 - protein, 15 aa, Mycobacterium tuberculosis
PVEYLQVPSPSMGRD

SEQ ID NO: 116029 - protein, 15 aa, Mycobacterium tuberculosis
VEYLQVPSPSMGRDI

SEQ ID NO: 116030 - protein, 15 aa, Mycobacterium tuberculosis
EYLQVPSPSMGRDIK

SEQ ID NO: 116031 - protein, 15 aa, Mycobacterium tuberculosis
YLQVPSPSMGRDIKV

SEQ ID NO: 116032 - protein, 15 aa, Mycobacterium tuberculosis
LQVPSPSMGRDIKVQ

SEQ ID NO: 116033 - protein, 15 aa, Mycobacterium tuberculosis
QVPSPSMGRDIKVQF

SEQ ID NO: 116034 - protein, 15 aa, Mycobacterium tuberculosis
VPSPSMGRDIKVQFQ

SEQ ID NO: 116035 - protein, 15 aa, Mycobacterium tuberculosis
PSPSMGRDIKVQFQS

SEQ ID NO: 116036 - protein, 15 aa, Mycobacterium tuberculosis
SPSMGRDIKVQFQSG

SEQ ID NO: 116037 - protein, 15 aa, Mycobacterium tuberculosis
PSMGRDIKVQFQSGG

SEQ ID NO: 116038 - protein, 15 aa, Mycobacterium tuberculosis
SMGRDIKVQFQSGGA

SEQ ID NO: 116039 - protein, 15 aa, Mycobacterium tuberculosis
MGRDIKVQFQSGGAN

SEQ ID NO: 116040 - protein, 15 aa, Mycobacterium tuberculosis
GRDIKVQFQSGGANS

SEQ ID NO: 116041 - protein, 15 aa, Mycobacterium tuberculosis
RDIKVQFQSGGANSP

SEQ ID NO: 116042 - protein, 15 aa, Mycobacterium tuberculosis
DIKVQFQSGGANSPA

SEQ ID NO: 116043 - protein, 15 aa, Mycobacterium tuberculosis
IKVQFQSGGANSPAL

SEQ ID NO: 116044 - protein, 15 aa, Mycobacterium tuberculosis
KVQFQSGGANSPALY

SEQ ID NO: 116045 - protein, 15 aa, Mycobacterium tuberculosis
VQFQSGGANSPALYL

SEQ ID NO: 116046 - protein, 15 aa, Mycobacterium tuberculosis
QFQSGGANSPALYLL

SEQ ID NO: 116047 - protein, 15 aa, Mycobacterium tuberculosis
FQSGGANSPALYLLD

SEQ ID NO: 116048 - protein, 15 aa, Mycobacterium tuberculosis
QSGGANSPALYLLDG

SEQ ID NO: 116049 - protein, 15 aa, Mycobacterium tuberculosis
SGGANSPALYLLDGL

SEQ ID NO: 116050 - protein, 15 aa, Mycobacterium tuberculosis
GGANSPALYLLDGLR

SEQ ID NO: 116051 - protein, 15 aa, Mycobacterium tuberculosis
GANSPALYLLDGLRA

SEQ ID NO: 116052 - protein, 15 aa, Mycobacterium tuberculosis
ANSPALYLLDGLRAQ

SEQ ID NO: 116053 - protein, 15 aa, Mycobacterium tuberculosis
NSPALYLLDGLRAQD

SEQ ID NO: 116054 - protein, 15 aa, Mycobacterium tuberculosis
SPALYLLDGLRAQDD

SEQ ID NO: 116055 - protein, 15 aa, Mycobacterium tuberculosis
PALYLLDGLRAQDDF

SEQ ID NO: 116056 - protein, 15 aa, Mycobacterium tuberculosis
ALYLLDGLRAQDDFS

SEQ ID NO: 116057 - protein, 15 aa, Mycobacterium tuberculosis
LYLLDGLRAQDDFSG

SEQ ID NO: 116058 - protein, 15 aa, Mycobacterium tuberculosis
YLLDGLRAQDDFSGW

SEQ ID NO: 116059 - protein, 15 aa, Mycobacterium tuberculosis
LLDGLRAQDDFSGWD

SEQ ID NO: 116060 - protein, 15 aa, Mycobacterium tuberculosis
LDGLRAQDDFSGWDI

SEQ ID NO: 116061 - protein, 15 aa, Mycobacterium tuberculosis
DGLRAQDDFSGWDIN

SEQ ID NO: 116062 - protein, 15 aa, Mycobacterium tuberculosis
GLRAQDDFSGWDINT

SEQ ID NO: 116063 - protein, 15 aa, Mycobacterium tuberculosis
LRAQDDFSGWDINTP

SEQ ID NO: 116064 - protein, 15 aa, Mycobacterium tuberculosis
RAQDDFSGWDINTPA

SEQ ID NO: 116065 - protein, 15 aa, Mycobacterium tuberculosis
AQDDFSGWDINTPAF

SEQ ID NO: 116066 - protein, 15 aa, Mycobacterium tuberculosis
QDDFSGWDINTPAFE

SEQ ID NO: 116067 - protein, 15 aa, Mycobacterium tuberculosis
DDFSGWDINTPAFEW

SEQ ID NO: 116068 - protein, 15 aa, Mycobacterium tuberculosis
DFSGWDINTPAFEWY

SEQ ID NO: 116069 - protein, 15 aa, Mycobacterium tuberculosis
FSGWDINTPAFEWYD

SEQ ID NO: 116070 - protein, 15 aa, Mycobacterium tuberculosis
SGWDINTPAFEWYDQ

SEQ ID NO: 116071 - protein, 15 aa, Mycobacterium tuberculosis
GWDINTPAFEWYDQS

SEQ ID NO: 116072 - protein, 15 aa, Mycobacterium tuberculosis
WDINTPAFEWYDQSG

SEQ ID NO: 116073 - protein, 15 aa, Mycobacterium tuberculosis
DINTPAFEWYDQSGL

SEQ ID NO: 116074 - protein, 15 aa, Mycobacterium tuberculosis
INTPAFEWYDQSGLS

SEQ ID NO: 116075 - protein, 15 aa, Mycobacterium tuberculosis
NTPAFEWYDQSGLSV

SEQ ID NO: 116076 - protein, 15 aa, Mycobacterium tuberculosis
TPAFEWYDQSGLSVV

SEQ ID NO: 116077 - protein, 15 aa, Mycobacterium tuberculosis
PAFEWYDQSGLSVVM

SEQ ID NO: 116078 - protein, 15 aa, Mycobacterium tuberculosis
AFEWYDQSGLSVVMP

SEQ ID NO: 116079 - protein, 15 aa, Mycobacterium tuberculosis
FEWYDQSGLSVVMPV

SEQ ID NO: 116080 - protein, 15 aa, Mycobacterium tuberculosis
EWYDQSGLSVVMPVG

SEQ ID NO: 116081 - protein, 15 aa, Mycobacterium tuberculosis
WYDQSGLSVVMPVGG

SEQ ID NO: 116082 - protein, 15 aa, Mycobacterium tuberculosis
YDQSGLSVVMPVGGQ

SEQ ID NO: 116083 - protein, 15 aa, Mycobacterium tuberculosis
DQSGLSVVMPVGGQS

SEQ ID NO: 116084 - protein, 15 aa, Mycobacterium tuberculosis
QSGLSVVMPVGGQSS

SEQ ID NO: 116085 - protein, 15 aa, Mycobacterium tuberculosis
SGLSVVMPVGGQSSF

SEQ ID NO: 116086 - protein, 15 aa, Mycobacterium tuberculosis
GLSVVMPVGGQSSFY

SEQ ID NO: 116087 - protein, 15 aa, Mycobacterium tuberculosis
LSVVMPVGGQSSFYS

SEQ ID NO: 116088 - protein, 15 aa, Mycobacterium tuberculosis
SVVMPVGGQSSFYSD

SEQ ID NO: 116089 - protein, 15 aa, Mycobacterium tuberculosis
VVMPVGGQSSFYSDW

SEQ ID NO: 116090 - protein, 15 aa, Mycobacterium tuberculosis
VMPVGGQSSFYSDWY

SEQ ID NO: 116091 - protein, 15 aa, Mycobacterium tuberculosis
MPVGGQSSFYSDWYQ

SEQ ID NO: 116092 - protein, 15 aa, Mycobacterium tuberculosis
PVGGQSSFYSDWYQP

SEQ ID NO: 116093 - protein, 15 aa, Mycobacterium tuberculosis
VGGQSSFYSDWYQPA

SEQ ID NO: 116094 - protein, 15 aa, Mycobacterium tuberculosis
GGQSSFYSDWYQPAC

SEQ ID NO: 116095 - protein, 15 aa, Mycobacterium tuberculosis
GQSSFYSDWYQPACG

SEQ ID NO: 116096 - protein, 15 aa, Mycobacterium tuberculosis
QSSFYSDWYQPACGK

SEQ ID NO: 116097 - protein, 15 aa, Mycobacterium tuberculosis
SSFYSDWYQPACGKA

SEQ ID NO: 116098 - protein, 15 aa, Mycobacterium tuberculosis
SFYSDWYQPACGKAG

SEQ ID NO: 116099 - protein, 15 aa, Mycobacterium tuberculosis
FYSDWYQPACGKAGC

SEQ ID NO: 116100 - protein, 15 aa, Mycobacterium tuberculosis
YSDWYQPACGKAGCQ

SEQ ID NO: 116101 - protein, 15 aa, Mycobacterium tuberculosis
SDWYQPACGKAGCQT

SEQ ID NO: 116102 - protein, 15 aa, Mycobacterium tuberculosis
DWYQPACGKAGCQTY

SEQ ID NO: 116103 - protein, 15 aa, Mycobacterium tuberculosis
WYQPACGKAGCQTYK

SEQ ID NO: 116104 - protein, 15 aa, Mycobacterium tuberculosis
YQPACGKAGCQTYKW

SEQ ID NO: 116105 - protein, 15 aa, Mycobacterium tuberculosis
QPACGKAGCQTYKWE

SEQ ID NO: 116106 - protein, 15 aa, Mycobacterium tuberculosis
PACGKAGCQTYKWET

SEQ ID NO: 116107 - protein, 15 aa, Mycobacterium tuberculosis
ACGKAGCQTYKWETF

SEQ ID NO: 116108 - protein, 15 aa, Mycobacterium tuberculosis
CGKAGCQTYKWETFL

SEQ ID NO: 116109 - protein, 15 aa, Mycobacterium tuberculosis
GKAGCQTYKWETFLT

SEQ ID NO: 116110 - protein, 15 aa, Mycobacterium tuberculosis
KAGCQTYKWETFLTS

SEQ ID NO: 116111 - protein, 15 aa, Mycobacterium tuberculosis
AGCQTYKWETFLTSE

SEQ ID NO: 116112 - protein, 15 aa, Mycobacterium tuberculosis
GCQTYKWETFLTSEL

SEQ ID NO: 116113 - protein, 15 aa, Mycobacterium tuberculosis
CQTYKWETFLTSELP

SEQ ID NO: 116114 - protein, 15 aa, Mycobacterium tuberculosis
QTYKWETFLTSELPG

SEQ ID NO: 116115 - protein, 15 aa, Mycobacterium tuberculosis
TYKWETFLTSELPGW

SEQ ID NO: 116116 - protein, 15 aa, Mycobacterium tuberculosis
YKWETFLTSELPGWL

SEQ ID NO: 116117 - protein, 15 aa, Mycobacterium tuberculosis
KWETFLTSELPGWLQ

SEQ ID NO: 116118 - protein, 15 aa, Mycobacterium tuberculosis
WETFLTSELPGWLQA

SEQ ID NO: 116119 - protein, 15 aa, Mycobacterium tuberculosis
ETFLTSELPGWLQAN

SEQ ID NO: 116120 - protein, 15 aa, Mycobacterium tuberculosis
TFLTSELPGWLQANR

SEQ ID NO: 116121 - protein, 15 aa, Mycobacterium tuberculosis
FLTSELPGWLQANRH

SEQ ID NO: 116122 - protein, 15 aa, Mycobacterium tuberculosis
LTSELPGWLQANRHV

SEQ ID NO: 116123 - protein, 15 aa, Mycobacterium tuberculosis
TSELPGWLQANRHVK

SEQ ID NO: 116124 - protein, 15 aa, Mycobacterium tuberculosis
SELPGWLQANRHVKP

SEQ ID NO: 116125 - protein, 15 aa, Mycobacterium tuberculosis
ELPGWLQANRHVKPT

SEQ ID NO: 116126 - protein, 15 aa, Mycobacterium tuberculosis
LPGWLQANRHVKPTG

SEQ ID NO: 116127 - protein, 15 aa, Mycobacterium tuberculosis
PGWLQANRHVKPTGS

SEQ ID NO: 116128 - protein, 15 aa, Mycobacterium tuberculosis
GWLQANRHVKPTGSA

SEQ ID NO: 116129 - protein, 15 aa, Mycobacterium tuberculosis
WLQANRHVKPTGSAV

SEQ ID NO: 116130 - protein, 15 aa, Mycobacterium tuberculosis
LQANRHVKPTGSAVV

SEQ ID NO: 116131 - protein, 15 aa, Mycobacterium tuberculosis
QANRHVKPTGSAVVG

SEQ ID NO: 116132 - protein, 15 aa, Mycobacterium tuberculosis
ANRHVKPTGSAVVGL

SEQ ID NO: 116133 - protein, 15 aa, Mycobacterium tuberculosis
NRHVKPTGSAVVGLS

SEQ ID NO: 116134 - protein, 15 aa, Mycobacterium tuberculosis
RHVKPTGSAVVGLSM

SEQ ID NO: 116135 - protein, 15 aa, Mycobacterium tuberculosis
HVKPTGSAVVGLSMA

SEQ ID NO: 116136 - protein, 15 aa, Mycobacterium tuberculosis
VKPTGSAVVGLSMAA

SEQ ID NO: 116137 - protein, 15 aa, Mycobacterium tuberculosis
KPTGSAVVGLSMAAS

SEQ ID NO: 116138 - protein, 15 aa, Mycobacterium tuberculosis
PTGSAVVGLSMAASS

SEQ ID NO: 116139 - protein, 15 aa, Mycobacterium tuberculosis
TGSAVVGLSMAASSA

SEQ ID NO: 116140 - protein, 15 aa, Mycobacterium tuberculosis
GSAVVGLSMAASSAL

SEQ ID NO: 116141 - protein, 15 aa, Mycobacterium tuberculosis
SAVVGLSMAASSALT

SEQ ID NO: 116142 - protein, 15 aa, Mycobacterium tuberculosis
AVVGLSMAASSALTL

SEQ ID NO: 116143 - protein, 15 aa, Mycobacterium tuberculosis
VVGLSMAASSALTLA

SEQ ID NO: 116144 - protein, 15 aa, Mycobacterium tuberculosis
VGLSMAASSALTLAI

SEQ ID NO: 116145 - protein, 15 aa, Mycobacterium tuberculosis
GLSMAASSALTLAIY

SEQ ID NO: 116146 - protein, 15 aa, Mycobacterium tuberculosis
LSMAASSALTLAIYH

SEQ ID NO: 116147 - protein, 15 aa, Mycobacterium tuberculosis
SMAASSALTLAIYHP

SEQ ID NO: 116148 - protein, 15 aa, Mycobacterium tuberculosis
MAASSALTLAIYHPQ

SEQ ID NO: 116149 - protein, 15 aa, Mycobacterium tuberculosis
AASSALTLAIYHPQQ

SEQ ID NO: 116150 - protein, 15 aa, Mycobacterium tuberculosis
ASSALTLAIYHPQQF

SEQ ID NO: 116151 - protein, 15 aa, Mycobacterium tuberculosis
SSALTLAIYHPQQFV

SEQ ID NO: 116152 - protein, 15 aa, Mycobacterium tuberculosis
SALTLAIYHPQQFVY

SEQ ID NO: 116153 - protein, 15 aa, Mycobacterium tuberculosis
ALTLAIYHPQQFVYA

SEQ ID NO: 116154 - protein, 15 aa, Mycobacterium tuberculosis
LTLAIYHPQQFVYAG

SEQ ID NO: 116155 - protein, 15 aa, Mycobacterium tuberculosis
TLAIYHPQQFVYAGA

SEQ ID NO: 116156 - protein, 15 aa, Mycobacterium tuberculosis
LAIYHPQQFVYAGAM

SEQ ID NO: 116157 - protein, 15 aa, Mycobacterium tuberculosis
AIYHPQQFVYAGAMS

SEQ ID NO: 116158 - protein, 15 aa, Mycobacterium tuberculosis
IYHPQQFVYAGAMSG

SEQ ID NO: 116159 - protein, 15 aa, Mycobacterium tuberculosis
YHPQQFVYAGAMSGL

SEQ ID NO: 116160 - protein, 15 aa, Mycobacterium tuberculosis
HPQQFVYAGAMSGLL

SEQ ID NO: 116161 - protein, 15 aa, Mycobacterium tuberculosis
PQQFVYAGAMSGLLD

SEQ ID NO: 116162 - protein, 15 aa, Mycobacterium tuberculosis
QQFVYAGAMSGLLDP

SEQ ID NO: 116163 - protein, 15 aa, Mycobacterium tuberculosis
QFVYAGAMSGLLDPS

SEQ ID NO: 116164 - protein, 15 aa, Mycobacterium tuberculosis
FVYAGAMSGLLDPSQ

SEQ ID NO: 116165 - protein, 15 aa, Mycobacterium tuberculosis
VYAGAMSGLLDPSQA

SEQ ID NO: 116166 - protein, 15 aa, Mycobacterium tuberculosis
YAGAMSGLLDPSQAM

SEQ ID NO: 116167 - protein, 15 aa, Mycobacterium tuberculosis
AGAMSGLLDPSQAMG

SEQ ID NO: 116168 - protein, 15 aa, Mycobacterium tuberculosis
GAMSGLLDPSQAMGP

SEQ ID NO: 116169 - protein, 15 aa, Mycobacterium tuberculosis
AMSGLLDPSQAMGPT

SEQ ID NO: 116170 - protein, 15 aa, Mycobacterium tuberculosis
MSGLLDPSQAMGPTL

SEQ ID NO: 116171 - protein, 15 aa, Mycobacterium tuberculosis
SGLLDPSQAMGPTLI

SEQ ID NO: 116172 - protein, 15 aa, Mycobacterium tuberculosis
GLLDPSQAMGPTLIG

SEQ ID NO: 116173 - protein, 15 aa, Mycobacterium tuberculosis
LLDPSQAMGPTLIGL

SEQ ID NO: 116174 - protein, 15 aa, Mycobacterium tuberculosis
LDPSQAMGPTLIGLA

SEQ ID NO: 116175 - protein, 15 aa, Mycobacterium tuberculosis
DPSQAMGPTLIGLAM

SEQ ID NO: 116176 - protein, 15 aa, Mycobacterium tuberculosis
PSQAMGPTLIGLAMG

SEQ ID NO: 116177 - protein, 15 aa, Mycobacterium tuberculosis
SQAMGPTLIGLAMGD

SEQ ID NO: 116178 - protein, 15 aa, Mycobacterium tuberculosis
QAMGPTLIGLAMGDA

SEQ ID NO: 116179 - protein, 15 aa, Mycobacterium tuberculosis
AMGPTLIGLAMGDAG

SEQ ID NO: 116180 - protein, 15 aa, Mycobacterium tuberculosis
MGPTLIGLAMGDAGG

SEQ ID NO: 116181 - protein, 15 aa, Mycobacterium tuberculosis
GPTLIGLAMGDAGGY

SEQ ID NO: 116182 - protein, 15 aa, Mycobacterium tuberculosis
PTLIGLAMGDAGGYK

SEQ ID NO: 116183 - protein, 15 aa, Mycobacterium tuberculosis
TLIGLAMGDAGGYKA

SEQ ID NO: 116184 - protein, 15 aa, Mycobacterium tuberculosis
LIGLAMGDAGGYKAS

SEQ ID NO: 116185 - protein, 15 aa, Mycobacterium tuberculosis
IGLAMGDAGGYKASD

SEQ ID NO: 116186 - protein, 15 aa, Mycobacterium tuberculosis
GLAMGDAGGYKASDM

SEQ ID NO: 116187 - protein, 15 aa, Mycobacterium tuberculosis
LAMGDAGGYKASDMW

SEQ ID NO: 116188 - protein, 15 aa, Mycobacterium tuberculosis
AMGDAGGYKASDMWG

SEQ ID NO: 116189 - protein, 15 aa, Mycobacterium tuberculosis
MGDAGGYKASDMWGP

SEQ ID NO: 116190 - protein, 15 aa, Mycobacterium tuberculosis
GDAGGYKASDMWGPK

SEQ ID NO: 116191 - protein, 15 aa, Mycobacterium tuberculosis
DAGGYKASDMWGPKE

SEQ ID NO: 116192 - protein, 15 aa, Mycobacterium tuberculosis
AGGYKASDMWGPKED

SEQ ID NO: 116193 - protein, 15 aa, Mycobacterium tuberculosis
GGYKASDMWGPKEDP

SEQ ID NO: 116194 - protein, 15 aa, Mycobacterium tuberculosis
GYKASDMWGPKEDPA

SEQ ID NO: 116195 - protein, 15 aa, Mycobacterium tuberculosis
YKASDMWGPKEDPAW

SEQ ID NO: 116196 - protein, 15 aa, Mycobacterium tuberculosis
KASDMWGPKEDPAWQ

SEQ ID NO: 116197 - protein, 15 aa, Mycobacterium tuberculosis
ASDMWGPKEDPAWQR

SEQ ID NO: 116198 - protein, 15 aa, Mycobacterium tuberculosis
SDMWGPKEDPAWQRN

SEQ ID NO: 116199 - protein, 15 aa, Mycobacterium tuberculosis
DMWGPKEDPAWQRND

SEQ ID NO: 116200 - protein, 15 aa, Mycobacterium tuberculosis
MWGPKEDPAWQRNDP

SEQ ID NO: 116201 - protein, 15 aa, Mycobacterium tuberculosis
WGPKEDPAWQRNDPL

SEQ ID NO: 116202 - protein, 15 aa, Mycobacterium tuberculosis
GPKEDPAWQRNDPLL

SEQ ID NO: 116203 - protein, 15 aa, Mycobacterium tuberculosis
PKEDPAWQRNDPLLN

SEQ ID NO: 116204 - protein, 15 aa, Mycobacterium tuberculosis
KEDPAWQRNDPLLNV

SEQ ID NO: 116205 - protein, 15 aa, Mycobacterium tuberculosis
EDPAWQRNDPLLNVG

SEQ ID NO: 116206 - protein, 15 aa, Mycobacterium tuberculosis
DPAWQRNDPLLNVGK

SEQ ID NO: 116207 - protein, 15 aa, Mycobacterium tuberculosis
PAWQRNDPLLNVGKL

SEQ ID NO: 116208 - protein, 15 aa, Mycobacterium tuberculosis
AWQRNDPLLNVGKLI

SEQ ID NO: 116209 - protein, 15 aa, Mycobacterium tuberculosis
WQRNDPLLNVGKLIA

SEQ ID NO: 116210 - protein, 15 aa, Mycobacterium tuberculosis
QRNDPLLNVGKLIAN

SEQ ID NO: 116211 - protein, 15 aa, Mycobacterium tuberculosis
RNDPLLNVGKLIANN

SEQ ID NO: 116212 - protein, 15 aa, Mycobacterium tuberculosis
NDPLLNVGKLIANNT

SEQ ID NO: 116213 - protein, 15 aa, Mycobacterium tuberculosis
DPLLNVGKLIANNTR

SEQ ID NO: 116214 - protein, 15 aa, Mycobacterium tuberculosis
PLLNVGKLIANNTRV

SEQ ID NO: 116215 - protein, 15 aa, Mycobacterium tuberculosis
LLNVGKLIANNTRVW

SEQ ID NO: 116216 - protein, 15 aa, Mycobacterium tuberculosis
LNVGKLIANNTRVWV

SEQ ID NO: 116217 - protein, 15 aa, Mycobacterium tuberculosis
NVGKLIANNTRVWVY

SEQ ID NO: 116218 - protein, 15 aa, Mycobacterium tuberculosis
VGKLIANNTRVWVYC

SEQ ID NO: 116219 - protein, 15 aa, Mycobacterium tuberculosis
GKLIANNTRVWVYCG

SEQ ID NO: 116220 - protein, 15 aa, Mycobacterium tuberculosis
KLIANNTRVWVYCGN

SEQ ID NO: 116221 - protein, 15 aa, Mycobacterium tuberculosis
LIANNTRVWVYCGNG

SEQ ID NO: 116222 - protein, 15 aa, Mycobacterium tuberculosis
IANNTRVWVYCGNGK

SEQ ID NO: 116223 - protein, 15 aa, Mycobacterium tuberculosis
ANNTRVWVYCGNGKP

SEQ ID NO: 116224 - protein, 15 aa, Mycobacterium tuberculosis
NNTRVWVYCGNGKPS

SEQ ID NO: 116225 - protein, 15 aa, Mycobacterium tuberculosis
NTRVWVYCGNGKPSD

SEQ ID NO: 116226 - protein, 15 aa, Mycobacterium tuberculosis
TRVWVYCGNGKPSDL

SEQ ID NO: 116227 - protein, 15 aa, Mycobacterium tuberculosis
RVWVYCGNGKPSDLG

SEQ ID NO: 116228 - protein, 15 aa, Mycobacterium tuberculosis
VWVYCGNGKPSDLGG

SEQ ID NO: 116229 - protein, 15 aa, Mycobacterium tuberculosis
WVYCGNGKPSDLGGN

SEQ ID NO: 116230 - protein, 15 aa, Mycobacterium tuberculosis
VYCGNGKPSDLGGNN

SEQ ID NO: 116231 - protein, 15 aa, Mycobacterium tuberculosis
YCGNGKPSDLGGNNL

SEQ ID NO: 116232 - protein, 15 aa, Mycobacterium tuberculosis
CGNGKPSDLGGNNLP

SEQ ID NO: 116233 - protein, 15 aa, Mycobacterium tuberculosis
GNGKPSDLGGNNLPA

SEQ ID NO: 116234 - protein, 15 aa, Mycobacterium tuberculosis
NGKPSDLGGNNLPAK

SEQ ID NO: 116235 - protein, 15 aa, Mycobacterium tuberculosis
GKPSDLGGNNLPAKF

SEQ ID NO: 116236 - protein, 15 aa, Mycobacterium tuberculosis
KPSDLGGNNLPAKFL

SEQ ID NO: 116237 - protein, 15 aa, Mycobacterium tuberculosis
PSDLGGNNLPAKFLE

SEQ ID NO: 116238 - protein, 15 aa, Mycobacterium tuberculosis
SDLGGNNLPAKFLEG

SEQ ID NO: 116239 - protein, 15 aa, Mycobacterium tuberculosis
DLGGNNLPAKFLEGF

SEQ ID NO: 116240 - protein, 15 aa, Mycobacterium tuberculosis
LGGNNLPAKFLEGFV

SEQ ID NO: 116241 - protein, 15 aa, Mycobacterium tuberculosis
GGNNLPAKFLEGFVR

SEQ ID NO: 116242 - protein, 15 aa, Mycobacterium tuberculosis
GNNLPAKFLEGFVRT

SEQ ID NO: 116243 - protein, 15 aa, Mycobacterium tuberculosis
NNLPAKFLEGFVRTS

SEQ ID NO: 116244 - protein, 15 aa, Mycobacterium tuberculosis
NLPAKFLEGFVRTSN

SEQ ID NO: 116245 - protein, 15 aa, Mycobacterium tuberculosis
LPAKFLEGFVRTSNI

SEQ ID NO: 116246 - protein, 15 aa, Mycobacterium tuberculosis
PAKFLEGFVRTSNIK

SEQ ID NO: 116247 - protein, 15 aa, Mycobacterium tuberculosis
AKFLEGFVRTSNIKF

SEQ ID NO: 116248 - protein, 15 aa, Mycobacterium tuberculosis
KFLEGFVRTSNIKFQ

SEQ ID NO: 116249 - protein, 15 aa, Mycobacterium tuberculosis
FLEGFVRTSNIKFQD

SEQ ID NO: 116250 - protein, 15 aa, Mycobacterium tuberculosis
LEGFVRTSNIKFQDA

SEQ ID NO: 116251 - protein, 15 aa, Mycobacterium tuberculosis
EGFVRTSNIKFQDAY

SEQ ID NO: 116252 - protein, 15 aa, Mycobacterium tuberculosis
GFVRTSNIKFQDAYN

SEQ ID NO: 116253 - protein, 15 aa, Mycobacterium tuberculosis
FVRTSNIKFQDAYNA

SEQ ID NO: 116254 - protein, 15 aa, Mycobacterium tuberculosis
VRTSNIKFQDAYNAG

SEQ ID NO: 116255 - protein, 15 aa, Mycobacterium tuberculosis
RTSNIKFQDAYNAGG

SEQ ID NO: 116256 - protein, 15 aa, Mycobacterium tuberculosis
TSNIKFQDAYNAGGG

SEQ ID NO: 116257 - protein, 15 aa, Mycobacterium tuberculosis
SNIKFQDAYNAGGGH

SEQ ID NO: 116258 - protein, 15 aa, Mycobacterium tuberculosis
NIKFQDAYNAGGGHN

SEQ ID NO: 116259 - protein, 15 aa, Mycobacterium tuberculosis
IKFQDAYNAGGGHNG

SEQ ID NO: 116260 - protein, 15 aa, Mycobacterium tuberculosis
KFQDAYNAGGGHNGV

SEQ ID NO: 116261 - protein, 15 aa, Mycobacterium tuberculosis
FQDAYNAGGGHNGVF

SEQ ID NO: 116262 - protein, 15 aa, Mycobacterium tuberculosis
QDAYNAGGGHNGVFD

SEQ ID NO: 116263 - protein, 15 aa, Mycobacterium tuberculosis
DAYNAGGGHNGVFDF

SEQ ID NO: 116264 - protein, 15 aa, Mycobacterium tuberculosis
AYNAGGGHNGVFDFP

SEQ ID NO: 116265 - protein, 15 aa, Mycobacterium tuberculosis
YNAGGGHNGVFDFPD

SEQ ID NO: 116266 - protein, 15 aa, Mycobacterium tuberculosis
NAGGGHNGVFDFPDS

SEQ ID NO: 116267 - protein, 15 aa, Mycobacterium tuberculosis
AGGGHNGVFDFPDSG

SEQ ID NO: 116268 - protein, 15 aa, Mycobacterium tuberculosis
GGGHNGVFDFPDSGT

SEQ ID NO: 116269 - protein, 15 aa, Mycobacterium tuberculosis
GGHNGVFDFPDSGTH

SEQ ID NO: 116270 - protein, 15 aa, Mycobacterium tuberculosis
GHNGVFDFPDSGTHS

SEQ ID NO: 116271 - protein, 15 aa, Mycobacterium tuberculosis
HNGVFDFPDSGTHSW

SEQ ID NO: 116272 - protein, 15 aa, Mycobacterium tuberculosis
NGVFDFPDSGTHSWE

SEQ ID NO: 116273 - protein, 15 aa, Mycobacterium tuberculosis
GVFDFPDSGTHSWEY

SEQ ID NO: 116274 - protein, 15 aa, Mycobacterium tuberculosis
VFDFPDSGTHSWEYW

SEQ ID NO: 116275 - protein, 15 aa, Mycobacterium tuberculosis
FDFPDSGTHSWEYWG

SEQ ID NO: 116276 - protein, 15 aa, Mycobacterium tuberculosis
DFPDSGTHSWEYWGA

SEQ ID NO: 116277 - protein, 15 aa, Mycobacterium tuberculosis
FPDSGTHSWEYWGAQ

SEQ ID NO: 116278 - protein, 15 aa, Mycobacterium tuberculosis
PDSGTHSWEYWGAQL

SEQ ID NO: 116279 - protein, 15 aa, Mycobacterium tuberculosis
DSGTHSWEYWGAQLN

SEQ ID NO: 116280 - protein, 15 aa, Mycobacterium tuberculosis
SGTHSWEYWGAQLNA

SEQ ID NO: 116281 - protein, 15 aa, Mycobacterium tuberculosis
GTHSWEYWGAQLNAM

SEQ ID NO: 116282 - protein, 15 aa, Mycobacterium tuberculosis
THSWEYWGAQLNAMK

SEQ ID NO: 116283 - protein, 15 aa, Mycobacterium tuberculosis
HSWEYWGAQLNAMKP

SEQ ID NO: 116284 - protein, 15 aa, Mycobacterium tuberculosis
SWEYWGAQLNAMKPD

SEQ ID NO: 116285 - protein, 15 aa, Mycobacterium tuberculosis
WEYWGAQLNAMKPDL

SEQ ID NO: 116286 - protein, 15 aa, Mycobacterium tuberculosis
EYWGAQLNAMKPDLQ

SEQ ID NO: 116287 - protein, 15 aa, Mycobacterium tuberculosis
YWGAQLNAMKPDLQR

SEQ ID NO: 116288 - protein, 15 aa, Mycobacterium tuberculosis
WGAQLNAMKPDLQRA

SEQ ID NO: 116289 - protein, 15 aa, Mycobacterium tuberculosis
GAQLNAMKPDLQRAL

SEQ ID NO: 116290 - protein, 15 aa, Mycobacterium tuberculosis
AQLNAMKPDLQRALG

SEQ ID NO: 116291 - protein, 15 aa, Mycobacterium tuberculosis
QLNAMKPDLQRALGA

SEQ ID NO: 116292 - protein, 15 aa, Mycobacterium tuberculosis
LNAMKPDLQRALGAT

SEQ ID NO: 116293 - protein, 15 aa, Mycobacterium tuberculosis
NAMKPDLQRALGATP

SEQ ID NO: 116294 - protein, 15 aa, Mycobacterium tuberculosis
AMKPDLQRALGATPN

SEQ ID NO: 116295 - protein, 15 aa, Mycobacterium tuberculosis
MKPDLQRALGATPNT

SEQ ID NO: 116296 - protein, 15 aa, Mycobacterium tuberculosis
KPDLQRALGATPNTG

SEQ ID NO: 116297 - protein, 15 aa, Mycobacterium tuberculosis
PDLQRALGATPNTGP

SEQ ID NO: 116298 - protein, 15 aa, Mycobacterium tuberculosis
DLQRALGATPNTGPA

SEQ ID NO: 116299 - protein, 15 aa, Mycobacterium tuberculosis
LQRALGATPNTGPAP

SEQ ID NO: 116300 - protein, 15 aa, Mycobacterium tuberculosis
QRALGATPNTGPAPQ

SEQ ID NO: 116301 - protein, 15 aa, Mycobacterium tuberculosis
RALGATPNTGPAPQG

SEQ ID NO: 116302 - protein, 15 aa, Mycobacterium tuberculosis
ALGATPNTGPAPQGA

SEQ ID NO: 116303 - protein, 16 aa, Mycobacterium tuberculosis
MQLVDRVRGAVTGMSR

SEQ ID NO: 116304 - protein, 16 aa, Mycobacterium tuberculosis
QLVDRVRGAVTGMSRR

SEQ ID NO: 116305 - protein, 16 aa, Mycobacterium tuberculosis
LVDRVRGAVTGMSRRL

SEQ ID NO: 116306 - protein, 16 aa, Mycobacterium tuberculosis
VDRVRGAVTGMSRRLV

SEQ ID NO: 116307 - protein, 16 aa, Mycobacterium tuberculosis
DRVRGAVTGMSRRLVV

SEQ ID NO: 116308 - protein, 16 aa, Mycobacterium tuberculosis
RVRGAVTGMSRRLVVG

SEQ ID NO: 116309 - protein, 16 aa, Mycobacterium tuberculosis
VRGAVTGMSRRLVVGA

SEQ ID NO: 116310 - protein, 16 aa, Mycobacterium tuberculosis
RGAVTGMSRRLVVGAV

SEQ ID NO: 116311 - protein, 16 aa, Mycobacterium tuberculosis
GAVTGMSRRLVVGAVG

SEQ ID NO: 116312 - protein, 16 aa, Mycobacterium tuberculosis
AVTGMSRRLVVGAVGA

SEQ ID NO: 116313 - protein, 16 aa, Mycobacterium tuberculosis
VTGMSRRLVVGAVGAA

SEQ ID NO: 116314 - protein, 16 aa, Mycobacterium tuberculosis
TGMSRRLVVGAVGAAL

SEQ ID NO: 116315 - protein, 16 aa, Mycobacterium tuberculosis
GMSRRLVVGAVGAALV

SEQ ID NO: 116316 - protein, 16 aa, Mycobacterium tuberculosis
MSRRLVVGAVGAALVS

SEQ ID NO: 116317 - protein, 16 aa, Mycobacterium tuberculosis
SRRLVVGAVGAALVSG

SEQ ID NO: 116318 - protein, 16 aa, Mycobacterium tuberculosis
RRLVVGAVGAALVSGL

SEQ ID NO: 116319 - protein, 16 aa, Mycobacterium tuberculosis
RLVVGAVGAALVSGLV

SEQ ID NO: 116320 - protein, 16 aa, Mycobacterium tuberculosis
LVVGAVGAALVSGLVG

SEQ ID NO: 116321 - protein, 16 aa, Mycobacterium tuberculosis
VVGAVGAALVSGLVGA

SEQ ID NO: 116322 - protein, 16 aa, Mycobacterium tuberculosis
VGAVGAALVSGLVGAV

SEQ ID NO: 116323 - protein, 16 aa, Mycobacterium tuberculosis
GAVGAALVSGLVGAVG

SEQ ID NO: 116324 - protein, 16 aa, Mycobacterium tuberculosis
AVGAALVSGLVGAVGG

SEQ ID NO: 116325 - protein, 16 aa, Mycobacterium tuberculosis
VGAALVSGLVGAVGGT

SEQ ID NO: 116326 - protein, 16 aa, Mycobacterium tuberculosis
GAALVSGLVGAVGGTA

SEQ ID NO: 116327 - protein, 16 aa, Mycobacterium tuberculosis
AALVSGLVGAVGGTAT

SEQ ID NO: 116328 - protein, 16 aa, Mycobacterium tuberculosis
ALVSGLVGAVGGTATA

SEQ ID NO: 116329 - protein, 16 aa, Mycobacterium tuberculosis
LVSGLVGAVGGTATAG

SEQ ID NO: 116330 - protein, 16 aa, Mycobacterium tuberculosis
VSGLVGAVGGTATAGA

SEQ ID NO: 116331 - protein, 16 aa, Mycobacterium tuberculosis
SGLVGAVGGTATAGAF

SEQ ID NO: 116332 - protein, 16 aa, Mycobacterium tuberculosis
GLVGAVGGTATAGAFS

SEQ ID NO: 116333 - protein, 16 aa, Mycobacterium tuberculosis
LVGAVGGTATAGAFSR

SEQ ID NO: 116334 - protein, 16 aa, Mycobacterium tuberculosis
VGAVGGTATAGAFSRP

SEQ ID NO: 116335 - protein, 16 aa, Mycobacterium tuberculosis
GAVGGTATAGAFSRPG

SEQ ID NO: 116336 - protein, 16 aa, Mycobacterium tuberculosis
AVGGTATAGAFSRPGL

SEQ ID NO: 116337 - protein, 16 aa, Mycobacterium tuberculosis
VGGTATAGAFSRPGLP

SEQ ID NO: 116338 - protein, 16 aa, Mycobacterium tuberculosis
GGTATAGAFSRPGLPV

SEQ ID NO: 116339 - protein, 16 aa, Mycobacterium tuberculosis
GTATAGAFSRPGLPVE

SEQ ID NO: 116340 - protein, 16 aa, Mycobacterium tuberculosis
TATAGAFSRPGLPVEY

SEQ ID NO: 116341 - protein, 16 aa, Mycobacterium tuberculosis
ATAGAFSRPGLPVEYL

SEQ ID NO: 116342 - protein, 16 aa, Mycobacterium tuberculosis
TAGAFSRPGLPVEYLQ

SEQ ID NO: 116343 - protein, 16 aa, Mycobacterium tuberculosis
AGAFSRPGLPVEYLQV

SEQ ID NO: 116344 - protein, 16 aa, Mycobacterium tuberculosis
GAFSRPGLPVEYLQVP

SEQ ID NO: 116345 - protein, 16 aa, Mycobacterium tuberculosis
AFSRPGLPVEYLQVPS

SEQ ID NO: 116346 - protein, 16 aa, Mycobacterium tuberculosis
FSRPGLPVEYLQVPSP

SEQ ID NO: 116347 - protein, 16 aa, Mycobacterium tuberculosis
SRPGLPVEYLQVPSPS

SEQ ID NO: 116348 - protein, 16 aa, Mycobacterium tuberculosis
RPGLPVEYLQVPSPSM

SEQ ID NO: 116349 - protein, 16 aa, Mycobacterium tuberculosis
PGLPVEYLQVPSPSMG

SEQ ID NO: 116350 - protein, 16 aa, Mycobacterium tuberculosis
GLPVEYLQVPSPSMGR

SEQ ID NO: 116351 - protein, 16 aa, Mycobacterium tuberculosis
LPVEYLQVPSPSMGRD

SEQ ID NO: 116352 - protein, 16 aa, Mycobacterium tuberculosis
PVEYLQVPSPSMGRDI

SEQ ID NO: 116353 - protein, 16 aa, Mycobacterium tuberculosis
VEYLQVPSPSMGRDIK

SEQ ID NO: 116354 - protein, 16 aa, Mycobacterium tuberculosis
EYLQVPSPSMGRDIKV

SEQ ID NO: 116355 - protein, 16 aa, Mycobacterium tuberculosis
YLQVPSPSMGRDIKVQ

SEQ ID NO: 116356 - protein, 16 aa, Mycobacterium tuberculosis
LQVPSPSMGRDIKVQF

SEQ ID NO: 116357 - protein, 16 aa, Mycobacterium tuberculosis
QVPSPSMGRDIKVQFQ

SEQ ID NO: 116358 - protein, 16 aa, Mycobacterium tuberculosis
VPSPSMGRDIKVQFQS

SEQ ID NO: 116359 - protein, 16 aa, Mycobacterium tuberculosis
PSPSMGRDIKVQFQSG

SEQ ID NO: 116360 - protein, 16 aa, Mycobacterium tuberculosis
SPSMGRDIKVQFQSGG

SEQ ID NO: 116361 - protein, 16 aa, Mycobacterium tuberculosis
PSMGRDIKVQFQSGGA

SEQ ID NO: 116362 - protein, 16 aa, Mycobacterium tuberculosis
SMGRDIKVQFQSGGAN

SEQ ID NO: 116363 - protein, 16 aa, Mycobacterium tuberculosis
MGRDIKVQFQSGGANS

SEQ ID NO: 116364 - protein, 16 aa, Mycobacterium tuberculosis
GRDIKVQFQSGGANSP

SEQ ID NO: 116365 - protein, 16 aa, Mycobacterium tuberculosis
RDIKVQFQSGGANSPA

SEQ ID NO: 116366 - protein, 16 aa, Mycobacterium tuberculosis
DIKVQFQSGGANSPAL

SEQ ID NO: 116367 - protein, 16 aa, Mycobacterium tuberculosis
IKVQFQSGGANSPALY

SEQ ID NO: 116368 - protein, 16 aa, Mycobacterium tuberculosis
KVQFQSGGANSPALYL

SEQ ID NO: 116369 - protein, 16 aa, Mycobacterium tuberculosis
VQFQSGGANSPALYLL

SEQ ID NO: 116370 - protein, 16 aa, Mycobacterium tuberculosis
QFQSGGANSPALYLLD

SEQ ID NO: 116371 - protein, 16 aa, Mycobacterium tuberculosis
FQSGGANSPALYLLDG

SEQ ID NO: 116372 - protein, 16 aa, Mycobacterium tuberculosis
QSGGANSPALYLLDGL

SEQ ID NO: 116373 - protein, 16 aa, Mycobacterium tuberculosis
SGGANSPALYLLDGLR

SEQ ID NO: 116374 - protein, 16 aa, Mycobacterium tuberculosis
GGANSPALYLLDGLRA

SEQ ID NO: 116375 - protein, 16 aa, Mycobacterium tuberculosis
GANSPALYLLDGLRAQ

SEQ ID NO: 116376 - protein, 16 aa, Mycobacterium tuberculosis
ANSPALYLLDGLRAQD

SEQ ID NO: 116377 - protein, 16 aa, Mycobacterium tuberculosis
NSPALYLLDGLRAQDD

SEQ ID NO: 116378 - protein, 16 aa, Mycobacterium tuberculosis
SPALYLLDGLRAQDDF

SEQ ID NO: 116379 - protein, 16 aa, Mycobacterium tuberculosis
PALYLLDGLRAQDDFS

SEQ ID NO: 116380 - protein, 16 aa, Mycobacterium tuberculosis
ALYLLDGLRAQDDFSG

SEQ ID NO: 116381 - protein, 16 aa, Mycobacterium tuberculosis
LYLLDGLRAQDDFSGW

SEQ ID NO: 116382 - protein, 16 aa, Mycobacterium tuberculosis
YLLDGLRAQDDFSGWD

SEQ ID NO: 116383 - protein, 16 aa, Mycobacterium tuberculosis
LLDGLRAQDDFSGWDI

SEQ ID NO: 116384 - protein, 16 aa, Mycobacterium tuberculosis
LDGLRAQDDFSGWDIN

SEQ ID NO: 116385 - protein, 16 aa, Mycobacterium tuberculosis
DGLRAQDDFSGWDINT

SEQ ID NO: 116386 - protein, 16 aa, Mycobacterium tuberculosis
GLRAQDDFSGWDINTP

SEQ ID NO: 116387 - protein, 16 aa, Mycobacterium tuberculosis
LRAQDDFSGWDINTPA

SEQ ID NO: 116388 - protein, 16 aa, Mycobacterium tuberculosis
RAQDDFSGWDINTPAF

SEQ ID NO: 116389 - protein, 16 aa, Mycobacterium tuberculosis
AQDDFSGWDINTPAFE

SEQ ID NO: 116390 - protein, 16 aa, Mycobacterium tuberculosis
QDDFSGWDINTPAFEW

SEQ ID NO: 116391 - protein, 16 aa, Mycobacterium tuberculosis
DDFSGWDINTPAFEWY

SEQ ID NO: 116392 - protein, 16 aa, Mycobacterium tuberculosis
DFSGWDINTPAFEWYD

SEQ ID NO: 116393 - protein, 16 aa, Mycobacterium tuberculosis
FSGWDINTPAFEWYDQ

SEQ ID NO: 116394 - protein, 16 aa, Mycobacterium tuberculosis
SGWDINTPAFEWYDQS

SEQ ID NO: 116395 - protein, 16 aa, Mycobacterium tuberculosis
GWDINTPAFEWYDQSG

SEQ ID NO: 116396 - protein, 16 aa, Mycobacterium tuberculosis
WDINTPAFEWYDQSGL

SEQ ID NO: 116397 - protein, 16 aa, Mycobacterium tuberculosis
DINTPAFEWYDQSGLS

SEQ ID NO: 116398 - protein, 16 aa, Mycobacterium tuberculosis
INTPAFEWYDQSGLSV

SEQ ID NO: 116399 - protein, 16 aa, Mycobacterium tuberculosis
NTPAFEWYDQSGLSVV

SEQ ID NO: 116400 - protein, 16 aa, Mycobacterium tuberculosis
TPAFEWYDQSGLSVVM

SEQ ID NO: 116401 - protein, 16 aa, Mycobacterium tuberculosis
PAFEWYDQSGLSVVMP

SEQ ID NO: 116402 - protein, 16 aa, Mycobacterium tuberculosis
AFEWYDQSGLSVVMPV

SEQ ID NO: 116403 - protein, 16 aa, Mycobacterium tuberculosis
FEWYDQSGLSVVMPVG

SEQ ID NO: 116404 - protein, 16 aa, Mycobacterium tuberculosis
EWYDQSGLSVVMPVGG

SEQ ID NO: 116405 - protein, 16 aa, Mycobacterium tuberculosis
WYDQSGLSVVMPVGGQ

SEQ ID NO: 116406 - protein, 16 aa, Mycobacterium tuberculosis
YDQSGLSVVMPVGGQS

SEQ ID NO: 116407 - protein, 16 aa, Mycobacterium tuberculosis
DQSGLSVVMPVGGQSS

SEQ ID NO: 116408 - protein, 16 aa, Mycobacterium tuberculosis
QSGLSVVMPVGGQSSF

SEQ ID NO: 116409 - protein, 16 aa, Mycobacterium tuberculosis
SGLSVVMPVGGQSSFY

SEQ ID NO: 116410 - protein, 16 aa, Mycobacterium tuberculosis
GLSVVMPVGGQSSFYS

SEQ ID NO: 116411 - protein, 16 aa, Mycobacterium tuberculosis
LSVVMPVGGQSSFYSD

SEQ ID NO: 116412 - protein, 16 aa, Mycobacterium tuberculosis
SVVMPVGGQSSFYSDW

SEQ ID NO: 116413 - protein, 16 aa, Mycobacterium tuberculosis
VVMPVGGQSSFYSDWY

SEQ ID NO: 116414 - protein, 16 aa, Mycobacterium tuberculosis
VMPVGGQSSFYSDWYQ

SEQ ID NO: 116415 - protein, 16 aa, Mycobacterium tuberculosis
MPVGGQSSFYSDWYQP

SEQ ID NO: 116416 - protein, 16 aa, Mycobacterium tuberculosis
PVGGQSSFYSDWYQPA

SEQ ID NO: 116417 - protein, 16 aa, Mycobacterium tuberculosis
VGGQSSFYSDWYQPAC

SEQ ID NO: 116418 - protein, 16 aa, Mycobacterium tuberculosis
GGQSSFYSDWYQPACG

SEQ ID NO: 116419 - protein, 16 aa, Mycobacterium tuberculosis
GQSSFYSDWYQPACGK

SEQ ID NO: 116420 - protein, 16 aa, Mycobacterium tuberculosis
QSSFYSDWYQPACGKA

SEQ ID NO: 116421 - protein, 16 aa, Mycobacterium tuberculosis
SSFYSDWYQPACGKAG

SEQ ID NO: 116422 - protein, 16 aa, Mycobacterium tuberculosis
SFYSDWYQPACGKAGC

SEQ ID NO: 116423 - protein, 16 aa, Mycobacterium tuberculosis
FYSDWYQPACGKAGCQ

SEQ ID NO: 116424 - protein, 16 aa, Mycobacterium tuberculosis
YSDWYQPACGKAGCQT

SEQ ID NO: 116425 - protein, 16 aa, Mycobacterium tuberculosis
SDWYQPACGKAGCQTY

SEQ ID NO: 116426 - protein, 16 aa, Mycobacterium tuberculosis
DWYQPACGKAGCQTYK

SEQ ID NO: 116427 - protein, 16 aa, Mycobacterium tuberculosis
WYQPACGKAGCQTYKW

SEQ ID NO: 116428 - protein, 16 aa, Mycobacterium tuberculosis
YQPACGKAGCQTYKWE

SEQ ID NO: 116429 - protein, 16 aa, Mycobacterium tuberculosis
QPACGKAGCQTYKWET

SEQ ID NO: 116430 - protein, 16 aa, Mycobacterium tuberculosis
PACGKAGCQTYKWETF

SEQ ID NO: 116431 - protein, 16 aa, Mycobacterium tuberculosis
ACGKAGCQTYKWETFL

SEQ ID NO: 116432 - protein, 16 aa, Mycobacterium tuberculosis
CGKAGCQTYKWETFLT

SEQ ID NO: 116433 - protein, 16 aa, Mycobacterium tuberculosis
GKAGCQTYKWETFLTS

SEQ ID NO: 116434 - protein, 16 aa, Mycobacterium tuberculosis
KAGCQTYKWETFLTSE

SEQ ID NO: 116435 - protein, 16 aa, Mycobacterium tuberculosis
AGCQTYKWETFLTSEL

SEQ ID NO: 116436 - protein, 16 aa, Mycobacterium tuberculosis
GCQTYKWETFLTSELP

SEQ ID NO: 116437 - protein, 16 aa, Mycobacterium tuberculosis
CQTYKWETFLTSELPG

SEQ ID NO: 116438 - protein, 16 aa, Mycobacterium tuberculosis
QTYKWETFLTSELPGW

SEQ ID NO: 116439 - protein, 16 aa, Mycobacterium tuberculosis
TYKWETFLTSELPGWL

SEQ ID NO: 116440 - protein, 16 aa, Mycobacterium tuberculosis
YKWETFLTSELPGWLQ

SEQ ID NO: 116441 - protein, 16 aa, Mycobacterium tuberculosis
KWETFLTSELPGWLQA

SEQ ID NO: 116442 - protein, 16 aa, Mycobacterium tuberculosis
WETFLTSELPGWLQAN

SEQ ID NO: 116443 - protein, 16 aa, Mycobacterium tuberculosis
ETFLTSELPGWLQANR

SEQ ID NO: 116444 - protein, 16 aa, Mycobacterium tuberculosis
TFLTSELPGWLQANRH

SEQ ID NO: 116445 - protein, 16 aa, Mycobacterium tuberculosis
FLTSELPGWLQANRHV

SEQ ID NO: 116446 - protein, 16 aa, Mycobacterium tuberculosis
LTSELPGWLQANRHVK

SEQ ID NO: 116447 - protein, 16 aa, Mycobacterium tuberculosis
TSELPGWLQANRHVKP

SEQ ID NO: 116448 - protein, 16 aa, Mycobacterium tuberculosis
SELPGWLQANRHVKPT

SEQ ID NO: 116449 - protein, 16 aa, Mycobacterium tuberculosis
ELPGWLQANRHVKPTG

SEQ ID NO: 116450 - protein, 16 aa, Mycobacterium tuberculosis
LPGWLQANRHVKPTGS

SEQ ID NO: 116451 - protein, 16 aa, Mycobacterium tuberculosis
PGWLQANRHVKPTGSA

SEQ ID NO: 116452 - protein, 16 aa, Mycobacterium tuberculosis
GWLQANRHVKPTGSAV

SEQ ID NO: 116453 - protein, 16 aa, Mycobacterium tuberculosis
WLQANRHVKPTGSAVV

SEQ ID NO: 116454 - protein, 16 aa, Mycobacterium tuberculosis
LQANRHVKPTGSAVVG

SEQ ID NO: 116455 - protein, 16 aa, Mycobacterium tuberculosis
QANRHVKPTGSAVVGL

SEQ ID NO: 116456 - protein, 16 aa, Mycobacterium tuberculosis
ANRHVKPTGSAVVGLS

SEQ ID NO: 116457 - protein, 16 aa, Mycobacterium tuberculosis
NRHVKPTGSAVVGLSM

SEQ ID NO: 116458 - protein, 16 aa, Mycobacterium tuberculosis
RHVKPTGSAVVGLSMA

SEQ ID NO: 116459 - protein, 16 aa, Mycobacterium tuberculosis
HVKPTGSAVVGLSMAA

SEQ ID NO: 116460 - protein, 16 aa, Mycobacterium tuberculosis
VKPTGSAVVGLSMAAS

SEQ ID NO: 116461 - protein, 16 aa, Mycobacterium tuberculosis
KPTGSAVVGLSMAASS

SEQ ID NO: 116462 - protein, 16 aa, Mycobacterium tuberculosis
PTGSAVVGLSMAASSA

SEQ ID NO: 116463 - protein, 16 aa, Mycobacterium tuberculosis
TGSAVVGLSMAASSAL

SEQ ID NO: 116464 - protein, 16 aa, Mycobacterium tuberculosis
GSAVVGLSMAASSALT

SEQ ID NO: 116465 - protein, 16 aa, Mycobacterium tuberculosis
SAVVGLSMAASSALTL

SEQ ID NO: 116466 - protein, 16 aa, Mycobacterium tuberculosis
AVVGLSMAASSALTLA

SEQ ID NO: 116467 - protein, 16 aa, Mycobacterium tuberculosis
VVGLSMAASSALTLAI

SEQ ID NO: 116468 - protein, 16 aa, Mycobacterium tuberculosis
VGLSMAASSALTLAIY

SEQ ID NO: 116469 - protein, 16 aa, Mycobacterium tuberculosis
GLSMAASSALTLAIYH

SEQ ID NO: 116470 - protein, 16 aa, Mycobacterium tuberculosis
LSMAASSALTLAIYHP

SEQ ID NO: 116471 - protein, 16 aa, Mycobacterium tuberculosis
SMAASSALTLAIYHPQ

SEQ ID NO: 116472 - protein, 16 aa, Mycobacterium tuberculosis
MAASSALTLAIYHPQQ

SEQ ID NO: 116473 - protein, 16 aa, Mycobacterium tuberculosis
AASSALTLAIYHPQQF

SEQ ID NO: 116474 - protein, 16 aa, Mycobacterium tuberculosis
ASSALTLAIYHPQQFV

SEQ ID NO: 116475 - protein, 16 aa, Mycobacterium tuberculosis
SSALTLAIYHPQQFVY

SEQ ID NO: 116476 - protein, 16 aa, Mycobacterium tuberculosis
SALTLAIYHPQQFVYA

SEQ ID NO: 116477 - protein, 16 aa, Mycobacterium tuberculosis
ALTLAIYHPQQFVYAG

SEQ ID NO: 116478 - protein, 16 aa, Mycobacterium tuberculosis
LTLAIYHPQQFVYAGA

SEQ ID NO: 116479 - protein, 16 aa, Mycobacterium tuberculosis
TLAIYHPQQFVYAGAM

SEQ ID NO: 116480 - protein, 16 aa, Mycobacterium tuberculosis
LAIYHPQQFVYAGAMS

SEQ ID NO: 116481 - protein, 16 aa, Mycobacterium tuberculosis
AIYHPQQFVYAGAMSG

SEQ ID NO: 116482 - protein, 16 aa, Mycobacterium tuberculosis
IYHPQQFVYAGAMSGL

SEQ ID NO: 116483 - protein, 16 aa, Mycobacterium tuberculosis
YHPQQFVYAGAMSGLL

SEQ ID NO: 116484 - protein, 16 aa, Mycobacterium tuberculosis
HPQQFVYAGAMSGLLD

SEQ ID NO: 116485 - protein, 16 aa, Mycobacterium tuberculosis
PQQFVYAGAMSGLLDP

SEQ ID NO: 116486 - protein, 16 aa, Mycobacterium tuberculosis
QQFVYAGAMSGLLDPS

SEQ ID NO: 116487 - protein, 16 aa, Mycobacterium tuberculosis
QFVYAGAMSGLLDPSQ

SEQ ID NO: 116488 - protein, 16 aa, Mycobacterium tuberculosis
FVYAGAMSGLLDPSQA

SEQ ID NO: 116489 - protein, 16 aa, Mycobacterium tuberculosis
VYAGAMSGLLDPSQAM

SEQ ID NO: 116490 - protein, 16 aa, Mycobacterium tuberculosis
YAGAMSGLLDPSQAMG

SEQ ID NO: 116491 - protein, 16 aa, Mycobacterium tuberculosis
AGAMSGLLDPSQAMGP

SEQ ID NO: 116492 - protein, 16 aa, Mycobacterium tuberculosis
GAMSGLLDPSQAMGPT

SEQ ID NO: 116493 - protein, 16 aa, Mycobacterium tuberculosis
AMSGLLDPSQAMGPTL

SEQ ID NO: 116494 - protein, 16 aa, Mycobacterium tuberculosis
MSGLLDPSQAMGPTLI

SEQ ID NO: 116495 - protein, 16 aa, Mycobacterium tuberculosis
SGLLDPSQAMGPTLIG

SEQ ID NO: 116496 - protein, 16 aa, Mycobacterium tuberculosis
GLLDPSQAMGPTLIGL

SEQ ID NO: 116497 - protein, 16 aa, Mycobacterium tuberculosis
LLDPSQAMGPTLIGLA

SEQ ID NO: 116498 - protein, 16 aa, Mycobacterium tuberculosis
LDPSQAMGPTLIGLAM

SEQ ID NO: 116499 - protein, 16 aa, Mycobacterium tuberculosis
DPSQAMGPTLIGLAMG

SEQ ID NO: 116500 - protein, 16 aa, Mycobacterium tuberculosis
PSQAMGPTLIGLAMGD

SEQ ID NO: 116501 - protein, 16 aa, Mycobacterium tuberculosis
SQAMGPTLIGLAMGDA

SEQ ID NO: 116502 - protein, 16 aa, Mycobacterium tuberculosis
QAMGPTLIGLAMGDAG

SEQ ID NO: 116503 - protein, 16 aa, Mycobacterium tuberculosis
AMGPTLIGLAMGDAGG

SEQ ID NO: 116504 - protein, 16 aa, Mycobacterium tuberculosis
MGPTLIGLAMGDAGGY

SEQ ID NO: 116505 - protein, 16 aa, Mycobacterium tuberculosis
GPTLIGLAMGDAGGYK

SEQ ID NO: 116506 - protein, 16 aa, Mycobacterium tuberculosis
PTLIGLAMGDAGGYKA

SEQ ID NO: 116507 - protein, 16 aa, Mycobacterium tuberculosis
TLIGLAMGDAGGYKAS

SEQ ID NO: 116508 - protein, 16 aa, Mycobacterium tuberculosis
LIGLAMGDAGGYKASD

SEQ ID NO: 116509 - protein, 16 aa, Mycobacterium tuberculosis
IGLAMGDAGGYKASDM

SEQ ID NO: 116510 - protein, 16 aa, Mycobacterium tuberculosis
GLAMGDAGGYKASDMW

SEQ ID NO: 116511 - protein, 16 aa, Mycobacterium tuberculosis
LAMGDAGGYKASDMWG

SEQ ID NO: 116512 - protein, 16 aa, Mycobacterium tuberculosis
AMGDAGGYKASDMWGP

SEQ ID NO: 116513 - protein, 16 aa, Mycobacterium tuberculosis
MGDAGGYKASDMWGPK

SEQ ID NO: 116514 - protein, 16 aa, Mycobacterium tuberculosis
GDAGGYKASDMWGPKE

SEQ ID NO: 116515 - protein, 16 aa, Mycobacterium tuberculosis
DAGGYKASDMWGPKED

SEQ ID NO: 116516 - protein, 16 aa, Mycobacterium tuberculosis
AGGYKASDMWGPKEDP

SEQ ID NO: 116517 - protein, 16 aa, Mycobacterium tuberculosis
GGYKASDMWGPKEDPA

SEQ ID NO: 116518 - protein, 16 aa, Mycobacterium tuberculosis
GYKASDMWGPKEDPAW

SEQ ID NO: 116519 - protein, 16 aa, Mycobacterium tuberculosis
YKASDMWGPKEDPAWQ

SEQ ID NO: 116520 - protein, 16 aa, Mycobacterium tuberculosis
KASDMWGPKEDPAWQR

SEQ ID NO: 116521 - protein, 16 aa, Mycobacterium tuberculosis
ASDMWGPKEDPAWQRN

SEQ ID NO: 116522 - protein, 16 aa, Mycobacterium tuberculosis
SDMWGPKEDPAWQRND

SEQ ID NO: 116523 - protein, 16 aa, Mycobacterium tuberculosis
DMWGPKEDPAWQRNDP

SEQ ID NO: 116524 - protein, 16 aa, Mycobacterium tuberculosis
MWGPKEDPAWQRNDPL

SEQ ID NO: 116525 - protein, 16 aa, Mycobacterium tuberculosis
WGPKEDPAWQRNDPLL

SEQ ID NO: 116526 - protein, 16 aa, Mycobacterium tuberculosis
GPKEDPAWQRNDPLLN

SEQ ID NO: 116527 - protein, 16 aa, Mycobacterium tuberculosis
PKEDPAWQRNDPLLNV

SEQ ID NO: 116528 - protein, 16 aa, Mycobacterium tuberculosis
KEDPAWQRNDPLLNVG

SEQ ID NO: 116529 - protein, 16 aa, Mycobacterium tuberculosis
EDPAWQRNDPLLNVGK

SEQ ID NO: 116530 - protein, 16 aa, Mycobacterium tuberculosis
DPAWQRNDPLLNVGKL

SEQ ID NO: 116531 - protein, 16 aa, Mycobacterium tuberculosis
PAWQRNDPLLNVGKLI

SEQ ID NO: 116532 - protein, 16 aa, Mycobacterium tuberculosis
AWQRNDPLLNVGKLIA

SEQ ID NO: 116533 - protein, 16 aa, Mycobacterium tuberculosis
WQRNDPLLNVGKLIAN

SEQ ID NO: 116534 - protein, 16 aa, Mycobacterium tuberculosis
QRNDPLLNVGKLIANN

SEQ ID NO: 116535 - protein, 16 aa, Mycobacterium tuberculosis
RNDPLLNVGKLIANNT

SEQ ID NO: 116536 - protein, 16 aa, Mycobacterium tuberculosis
NDPLLNVGKLIANNTR

SEQ ID NO: 116537 - protein, 16 aa, Mycobacterium tuberculosis
DPLLNVGKLIANNTRV

SEQ ID NO: 116538 - protein, 16 aa, Mycobacterium tuberculosis
PLLNVGKLIANNTRVW

SEQ ID NO: 116539 - protein, 16 aa, Mycobacterium tuberculosis
LLNVGKLIANNTRVWV

SEQ ID NO: 116540 - protein, 16 aa, Mycobacterium tuberculosis
LNVGKLIANNTRVWVY

SEQ ID NO: 116541 - protein, 16 aa, Mycobacterium tuberculosis
NVGKLIANNTRVWVYC

SEQ ID NO: 116542 - protein, 16 aa, Mycobacterium tuberculosis
VGKLIANNTRVWVYCG

SEQ ID NO: 116543 - protein, 16 aa, Mycobacterium tuberculosis
GKLIANNTRVWVYCGN

SEQ ID NO: 116544 - protein, 16 aa, Mycobacterium tuberculosis
KLIANNTRVWVYCGNG

SEQ ID NO: 116545 - protein, 16 aa, Mycobacterium tuberculosis
LIANNTRVWVYCGNGK

SEQ ID NO: 116546 - protein, 16 aa, Mycobacterium tuberculosis
IANNTRVWVYCGNGKP

SEQ ID NO: 116547 - protein, 16 aa, Mycobacterium tuberculosis
ANNTRVWVYCGNGKPS

SEQ ID NO: 116548 - protein, 16 aa, Mycobacterium tuberculosis
NNTRVWVYCGNGKPSD

SEQ ID NO: 116549 - protein, 16 aa, Mycobacterium tuberculosis
NTRVWVYCGNGKPSDL

SEQ ID NO: 116550 - protein, 16 aa, Mycobacterium tuberculosis
TRVWVYCGNGKPSDLG

SEQ ID NO: 116551 - protein, 16 aa, Mycobacterium tuberculosis
RVWVYCGNGKPSDLGG

SEQ ID NO: 116552 - protein, 16 aa, Mycobacterium tuberculosis
VWVYCGNGKPSDLGGN

SEQ ID NO: 116553 - protein, 16 aa, Mycobacterium tuberculosis
WVYCGNGKPSDLGGNN

SEQ ID NO: 116554 - protein, 16 aa, Mycobacterium tuberculosis
VYCGNGKPSDLGGNNL

SEQ ID NO: 116555 - protein, 16 aa, Mycobacterium tuberculosis
YCGNGKPSDLGGNNLP

SEQ ID NO: 116556 - protein, 16 aa, Mycobacterium tuberculosis
CGNGKPSDLGGNNLPA

SEQ ID NO: 116557 - protein, 16 aa, Mycobacterium tuberculosis
GNGKPSDLGGNNLPAK

SEQ ID NO: 116558 - protein, 16 aa, Mycobacterium tuberculosis
NGKPSDLGGNNLPAKF

SEQ ID NO: 116559 - protein, 16 aa, Mycobacterium tuberculosis
GKPSDLGGNNLPAKFL

SEQ ID NO: 116560 - protein, 16 aa, Mycobacterium tuberculosis
KPSDLGGNNLPAKFLE

SEQ ID NO: 116561 - protein, 16 aa, Mycobacterium tuberculosis
PSDLGGNNLPAKFLEG

SEQ ID NO: 116562 - protein, 16 aa, Mycobacterium tuberculosis
SDLGGNNLPAKFLEGF

SEQ ID NO: 116563 - protein, 16 aa, Mycobacterium tuberculosis
DLGGNNLPAKFLEGFV

SEQ ID NO: 116564 - protein, 16 aa, Mycobacterium tuberculosis
LGGNNLPAKFLEGFVR

SEQ ID NO: 116565 - protein, 16 aa, Mycobacterium tuberculosis
GGNNLPAKFLEGFVRT

SEQ ID NO: 116566 - protein, 16 aa, Mycobacterium tuberculosis
GNNLPAKFLEGFVRTS

SEQ ID NO: 116567 - protein, 16 aa, Mycobacterium tuberculosis
NNLPAKFLEGFVRTSN

SEQ ID NO: 116568 - protein, 16 aa, Mycobacterium tuberculosis
NLPAKFLEGFVRTSNI

SEQ ID NO: 116569 - protein, 16 aa, Mycobacterium tuberculosis
LPAKFLEGFVRTSNIK

SEQ ID NO: 116570 - protein, 16 aa, Mycobacterium tuberculosis
PAKFLEGFVRTSNIKF

SEQ ID NO: 116571 - protein, 16 aa, Mycobacterium tuberculosis
AKFLEGFVRTSNIKFQ

SEQ ID NO: 116572 - protein, 16 aa, Mycobacterium tuberculosis
KFLEGFVRTSNIKFQD

SEQ ID NO: 116573 - protein, 16 aa, Mycobacterium tuberculosis
FLEGFVRTSNIKFQDA

SEQ ID NO: 116574 - protein, 16 aa, Mycobacterium tuberculosis
LEGFVRTSNIKFQDAY

SEQ ID NO: 116575 - protein, 16 aa, Mycobacterium tuberculosis
EGFVRTSNIKFQDAYN

SEQ ID NO: 116576 - protein, 16 aa, Mycobacterium tuberculosis
GFVRTSNIKFQDAYNA

SEQ ID NO: 116577 - protein, 16 aa, Mycobacterium tuberculosis
FVRTSNIKFQDAYNAG

SEQ ID NO: 116578 - protein, 16 aa, Mycobacterium tuberculosis
VRTSNIKFQDAYNAGG

SEQ ID NO: 116579 - protein, 16 aa, Mycobacterium tuberculosis
RTSNIKFQDAYNAGGG

SEQ ID NO: 116580 - protein, 16 aa, Mycobacterium tuberculosis
TSNIKFQDAYNAGGGH

SEQ ID NO: 116581 - protein, 16 aa, Mycobacterium tuberculosis
SNIKFQDAYNAGGGHN

SEQ ID NO: 116582 - protein, 16 aa, Mycobacterium tuberculosis
NIKFQDAYNAGGGHNG

SEQ ID NO: 116583 - protein, 16 aa, Mycobacterium tuberculosis
IKFQDAYNAGGGHNGV

SEQ ID NO: 116584 - protein, 16 aa, Mycobacterium tuberculosis
KFQDAYNAGGGHNGVF

SEQ ID NO: 116585 - protein, 16 aa, Mycobacterium tuberculosis
FQDAYNAGGGHNGVFD

SEQ ID NO: 116586 - protein, 16 aa, Mycobacterium tuberculosis
QDAYNAGGGHNGVFDF

SEQ ID NO: 116587 - protein, 16 aa, Mycobacterium tuberculosis
DAYNAGGGHNGVFDFP

SEQ ID NO: 116588 - protein, 16 aa, Mycobacterium tuberculosis
AYNAGGGHNGVFDFPD

SEQ ID NO: 116589 - protein, 16 aa, Mycobacterium tuberculosis
YNAGGGHNGVFDFPDS

SEQ ID NO: 116590 - protein, 16 aa, Mycobacterium tuberculosis
NAGGGHNGVFDFPDSG

SEQ ID NO: 116591 - protein, 16 aa, Mycobacterium tuberculosis
AGGGHNGVFDFPDSGT

SEQ ID NO: 116592 - protein, 16 aa, Mycobacterium tuberculosis
GGGHNGVFDFPDSGTH

SEQ ID NO: 116593 - protein, 16 aa, Mycobacterium tuberculosis
GGHNGVFDFPDSGTHS

SEQ ID NO: 116594 - protein, 16 aa, Mycobacterium tuberculosis
GHNGVFDFPDSGTHSW

SEQ ID NO: 116595 - protein, 16 aa, Mycobacterium tuberculosis
HNGVFDFPDSGTHSWE

SEQ ID NO: 116596 - protein, 16 aa, Mycobacterium tuberculosis
NGVFDFPDSGTHSWEY

SEQ ID NO: 116597 - protein, 16 aa, Mycobacterium tuberculosis
GVFDFPDSGTHSWEYW

SEQ ID NO: 116598 - protein, 16 aa, Mycobacterium tuberculosis
VFDFPDSGTHSWEYWG

SEQ ID NO: 116599 - protein, 16 aa, Mycobacterium tuberculosis
FDFPDSGTHSWEYWGA

SEQ ID NO: 116600 - protein, 16 aa, Mycobacterium tuberculosis
DFPDSGTHSWEYWGAQ

SEQ ID NO: 116601 - protein, 16 aa, Mycobacterium tuberculosis
FPDSGTHSWEYWGAQL

SEQ ID NO: 116602 - protein, 16 aa, Mycobacterium tuberculosis
PDSGTHSWEYWGAQLN

SEQ ID NO: 116603 - protein, 16 aa, Mycobacterium tuberculosis
DSGTHSWEYWGAQLNA

SEQ ID NO: 116604 - protein, 16 aa, Mycobacterium tuberculosis
SGTHSWEYWGAQLNAM

SEQ ID NO: 116605 - protein, 16 aa, Mycobacterium tuberculosis
GTHSWEYWGAQLNAMK

SEQ ID NO: 116606 - protein, 16 aa, Mycobacterium tuberculosis
THSWEYWGAQLNAMKP

SEQ ID NO: 116607 - protein, 16 aa, Mycobacterium tuberculosis
HSWEYWGAQLNAMKPD

SEQ ID NO: 116608 - protein, 16 aa, Mycobacterium tuberculosis
SWEYWGAQLNAMKPDL

SEQ ID NO: 116609 - protein, 16 aa, Mycobacterium tuberculosis
WEYWGAQLNAMKPDLQ

SEQ ID NO: 116610 - protein, 16 aa, Mycobacterium tuberculosis
EYWGAQLNAMKPDLQR

SEQ ID NO: 116611 - protein, 16 aa, Mycobacterium tuberculosis
YWGAQLNAMKPDLQRA

SEQ ID NO: 116612 - protein, 16 aa, Mycobacterium tuberculosis
WGAQLNAMKPDLQRAL

SEQ ID NO: 116613 - protein, 16 aa, Mycobacterium tuberculosis
GAQLNAMKPDLQRALG

SEQ ID NO: 116614 - protein, 16 aa, Mycobacterium tuberculosis
AQLNAMKPDLQRALGA

SEQ ID NO: 116615 - protein, 16 aa, Mycobacterium tuberculosis
QLNAMKPDLQRALGAT

SEQ ID NO: 116616 - protein, 16 aa, Mycobacterium tuberculosis
LNAMKPDLQRALGATP

SEQ ID NO: 116617 - protein, 16 aa, Mycobacterium tuberculosis
NAMKPDLQRALGATPN

SEQ ID NO: 116618 - protein, 16 aa, Mycobacterium tuberculosis
AMKPDLQRALGATPNT

SEQ ID NO: 116619 - protein, 16 aa, Mycobacterium tuberculosis
MKPDLQRALGATPNTG

SEQ ID NO: 116620 - protein, 16 aa, Mycobacterium tuberculosis
KPDLQRALGATPNTGP

SEQ ID NO: 116621 - protein, 16 aa, Mycobacterium tuberculosis
PDLQRALGATPNTGPA

SEQ ID NO: 116622 - protein, 16 aa, Mycobacterium tuberculosis
DLQRALGATPNTGPAP

SEQ ID NO: 116623 - protein, 16 aa, Mycobacterium tuberculosis
LQRALGATPNTGPAPQ

SEQ ID NO: 116624 - protein, 16 aa, Mycobacterium tuberculosis
QRALGATPNTGPAPQG

SEQ ID NO: 116625 - protein, 16 aa, Mycobacterium tuberculosis
RALGATPNTGPAPQGA

SEQ ID NO: 116626 - protein, 13 aa, Mycobacterium tuberculosis
MTDVSRKIRAWGR

SEQ ID NO: 116627 - protein, 13 aa, Mycobacterium tuberculosis
TDVSRKIRAWGRR

SEQ ID NO: 116628 - protein, 13 aa, Mycobacterium tuberculosis
DVSRKIRAWGRRL

SEQ ID NO: 116629 - protein, 13 aa, Mycobacterium tuberculosis
VSRKIRAWGRRLM

SEQ ID NO: 116630 - protein, 13 aa, Mycobacterium tuberculosis
SRKIRAWGRRLMI

SEQ ID NO: 116631 - protein, 13 aa, Mycobacterium tuberculosis
RKIRAWGRRLMIG

SEQ ID NO: 116632 - protein, 13 aa, Mycobacterium tuberculosis
KIRAWGRRLMIGT

SEQ ID NO: 116633 - protein, 13 aa, Mycobacterium tuberculosis
IRAWGRRLMIGTA

SEQ ID NO: 116634 - protein, 13 aa, Mycobacterium tuberculosis
RAWGRRLMIGTAA

SEQ ID NO: 116635 - protein, 13 aa, Mycobacterium tuberculosis
AWGRRLMIGTAAA

SEQ ID NO: 116636 - protein, 13 aa, Mycobacterium tuberculosis
WGRRLMIGTAAAV

SEQ ID NO: 116637 - protein, 13 aa, Mycobacterium tuberculosis
GRRLMIGTAAAVV

SEQ ID NO: 116638 - protein, 13 aa, Mycobacterium tuberculosis
RRLMIGTAAAVVL

SEQ ID NO: 116639 - protein, 13 aa, Mycobacterium tuberculosis
RLMIGTAAAVVLP

SEQ ID NO: 116640 - protein, 13 aa, Mycobacterium tuberculosis
LMIGTAAAVVLPG

SEQ ID NO: 116641 - protein, 13 aa, Mycobacterium tuberculosis
MIGTAAAVVLPGL

SEQ ID NO: 116642 - protein, 13 aa, Mycobacterium tuberculosis
IGTAAAVVLPGLV

SEQ ID NO: 116643 - protein, 13 aa, Mycobacterium tuberculosis
GTAAAVVLPGLVG

SEQ ID NO: 116644 - protein, 13 aa, Mycobacterium tuberculosis
TAAAVVLPGLVGL

SEQ ID NO: 116645 - protein, 13 aa, Mycobacterium tuberculosis
AAAVVLPGLVGLA

SEQ ID NO: 116646 - protein, 13 aa, Mycobacterium tuberculosis
AAVVLPGLVGLAG

SEQ ID NO: 116647 - protein, 13 aa, Mycobacterium tuberculosis
AVVLPGLVGLAGG

SEQ ID NO: 116648 - protein, 13 aa, Mycobacterium tuberculosis
VVLPGLVGLAGGA

SEQ ID NO: 116649 - protein, 13 aa, Mycobacterium tuberculosis
VLPGLVGLAGGAA

SEQ ID NO: 116650 - protein, 13 aa, Mycobacterium tuberculosis
LPGLVGLAGGAAT

SEQ ID NO: 116651 - protein, 13 aa, Mycobacterium tuberculosis
PGLVGLAGGAATA

SEQ ID NO: 116652 - protein, 13 aa, Mycobacterium tuberculosis
GLVGLAGGAATAG

SEQ ID NO: 116653 - protein, 13 aa, Mycobacterium tuberculosis
LVGLAGGAATAGA

SEQ ID NO: 116654 - protein, 13 aa, Mycobacterium tuberculosis
VGLAGGAATAGAF

SEQ ID NO: 116655 - protein, 13 aa, Mycobacterium tuberculosis
GLAGGAATAGAFS

SEQ ID NO: 116656 - protein, 13 aa, Mycobacterium tuberculosis
LAGGAATAGAFSR

SEQ ID NO: 116657 - protein, 13 aa, Mycobacterium tuberculosis
AGGAATAGAFSRP

SEQ ID NO: 116658 - protein, 13 aa, Mycobacterium tuberculosis
GGAATAGAFSRPG

SEQ ID NO: 116659 - protein, 13 aa, Mycobacterium tuberculosis
GAATAGAFSRPGL

SEQ ID NO: 116660 - protein, 13 aa, Mycobacterium tuberculosis
AATAGAFSRPGLP

SEQ ID NO: 116661 - protein, 13 aa, Mycobacterium tuberculosis
ATAGAFSRPGLPV

SEQ ID NO: 116662 - protein, 13 aa, Mycobacterium tuberculosis
TAGAFSRPGLPVE

SEQ ID NO: 116663 - protein, 13 aa, Mycobacterium tuberculosis
AGAFSRPGLPVEY

SEQ ID NO: 116664 - protein, 13 aa, Mycobacterium tuberculosis
GAFSRPGLPVEYL

SEQ ID NO: 116665 - protein, 13 aa, Mycobacterium tuberculosis
AFSRPGLPVEYLQ

SEQ ID NO: 116666 - protein, 13 aa, Mycobacterium tuberculosis
FSRPGLPVEYLQV

SEQ ID NO: 116667 - protein, 13 aa, Mycobacterium tuberculosis
SRPGLPVEYLQVP

SEQ ID NO: 116668 - protein, 13 aa, Mycobacterium tuberculosis
RPGLPVEYLQVPS

SEQ ID NO: 116669 - protein, 13 aa, Mycobacterium tuberculosis
PGLPVEYLQVPSP

SEQ ID NO: 116670 - protein, 13 aa, Mycobacterium tuberculosis
GLPVEYLQVPSPS

SEQ ID NO: 116671 - protein, 13 aa, Mycobacterium tuberculosis
LPVEYLQVPSPSM

SEQ ID NO: 116672 - protein, 13 aa, Mycobacterium tuberculosis
PVEYLQVPSPSMG

SEQ ID NO: 116673 - protein, 13 aa, Mycobacterium tuberculosis
VEYLQVPSPSMGR

SEQ ID NO: 116674 - protein, 13 aa, Mycobacterium tuberculosis
EYLQVPSPSMGRD

SEQ ID NO: 116675 - protein, 13 aa, Mycobacterium tuberculosis
YLQVPSPSMGRDI

SEQ ID NO: 116676 - protein, 13 aa, Mycobacterium tuberculosis
LQVPSPSMGRDIK

SEQ ID NO: 116677 - protein, 13 aa, Mycobacterium tuberculosis
QVPSPSMGRDIKV

SEQ ID NO: 116678 - protein, 13 aa, Mycobacterium tuberculosis
VPSPSMGRDIKVQ

SEQ ID NO: 116679 - protein, 13 aa, Mycobacterium tuberculosis
PSPSMGRDIKVQF

SEQ ID NO: 116680 - protein, 13 aa, Mycobacterium tuberculosis
SPSMGRDIKVQFQ

SEQ ID NO: 116681 - protein, 13 aa, Mycobacterium tuberculosis
PSMGRDIKVQFQS

SEQ ID NO: 116682 - protein, 13 aa, Mycobacterium tuberculosis
SMGRDIKVQFQSG

SEQ ID NO: 116683 - protein, 13 aa, Mycobacterium tuberculosis
MGRDIKVQFQSGG

SEQ ID NO: 116684 - protein, 13 aa, Mycobacterium tuberculosis
GRDIKVQFQSGGN

SEQ ID NO: 116685 - protein, 13 aa, Mycobacterium tuberculosis
RDIKVQFQSGGNN

SEQ ID NO: 116686 - protein, 13 aa, Mycobacterium tuberculosis
DIKVQFQSGGNNS

SEQ ID NO: 116687 - protein, 13 aa, Mycobacterium tuberculosis
IKVQFQSGGNNSP

SEQ ID NO: 116688 - protein, 13 aa, Mycobacterium tuberculosis
KVQFQSGGNNSPA

SEQ ID NO: 116689 - protein, 13 aa, Mycobacterium tuberculosis
VQFQSGGNNSPAV

SEQ ID NO: 116690 - protein, 13 aa, Mycobacterium tuberculosis
QFQSGGNNSPAVY

SEQ ID NO: 116691 - protein, 13 aa, Mycobacterium tuberculosis
FQSGGNNSPAVYL

SEQ ID NO: 116692 - protein, 13 aa, Mycobacterium tuberculosis
QSGGNNSPAVYLL

SEQ ID NO: 116693 - protein, 13 aa, Mycobacterium tuberculosis
SGGNNSPAVYLLD

SEQ ID NO: 116694 - protein, 13 aa, Mycobacterium tuberculosis
GGNNSPAVYLLDG

SEQ ID NO: 116695 - protein, 13 aa, Mycobacterium tuberculosis
GNNSPAVYLLDGL

SEQ ID NO: 116696 - protein, 13 aa, Mycobacterium tuberculosis
NNSPAVYLLDGLR

SEQ ID NO: 116697 - protein, 13 aa, Mycobacterium tuberculosis
NSPAVYLLDGLRA

SEQ ID NO: 116698 - protein, 13 aa, Mycobacterium tuberculosis
SPAVYLLDGLRAQ

SEQ ID NO: 116699 - protein, 13 aa, Mycobacterium tuberculosis
PAVYLLDGLRAQD

SEQ ID NO: 116700 - protein, 13 aa, Mycobacterium tuberculosis
AVYLLDGLRAQDD

SEQ ID NO: 116701 - protein, 13 aa, Mycobacterium tuberculosis
VYLLDGLRAQDDY

SEQ ID NO: 116702 - protein, 13 aa, Mycobacterium tuberculosis
YLLDGLRAQDDYN

SEQ ID NO: 116703 - protein, 13 aa, Mycobacterium tuberculosis
LLDGLRAQDDYNG

SEQ ID NO: 116704 - protein, 13 aa, Mycobacterium tuberculosis
LDGLRAQDDYNGW

SEQ ID NO: 116705 - protein, 13 aa, Mycobacterium tuberculosis
DGLRAQDDYNGWD

SEQ ID NO: 116706 - protein, 13 aa, Mycobacterium tuberculosis
GLRAQDDYNGWDI

SEQ ID NO: 116707 - protein, 13 aa, Mycobacterium tuberculosis
LRAQDDYNGWDIN

SEQ ID NO: 116708 - protein, 13 aa, Mycobacterium tuberculosis
RAQDDYNGWDINT

SEQ ID NO: 116709 - protein, 13 aa, Mycobacterium tuberculosis
AQDDYNGWDINTP

SEQ ID NO: 116710 - protein, 13 aa, Mycobacterium tuberculosis
QDDYNGWDINTPA

SEQ ID NO: 116711 - protein, 13 aa, Mycobacterium tuberculosis
DDYNGWDINTPAF

SEQ ID NO: 116712 - protein, 13 aa, Mycobacterium tuberculosis
DYNGWDINTPAFE

SEQ ID NO: 116713 - protein, 13 aa, Mycobacterium tuberculosis
YNGWDINTPAFEW

SEQ ID NO: 116714 - protein, 13 aa, Mycobacterium tuberculosis
NGWDINTPAFEWY

SEQ ID NO: 116715 - protein, 13 aa, Mycobacterium tuberculosis
GWDINTPAFEWYY

SEQ ID NO: 116716 - protein, 13 aa, Mycobacterium tuberculosis
WDINTPAFEWYYQ

SEQ ID NO: 116717 - protein, 13 aa, Mycobacterium tuberculosis
DINTPAFEWYYQS

SEQ ID NO: 116718 - protein, 13 aa, Mycobacterium tuberculosis
INTPAFEWYYQSG

SEQ ID NO: 116719 - protein, 13 aa, Mycobacterium tuberculosis
NTPAFEWYYQSGL

SEQ ID NO: 116720 - protein, 13 aa, Mycobacterium tuberculosis
TPAFEWYYQSGLS

SEQ ID NO: 116721 - protein, 13 aa, Mycobacterium tuberculosis
PAFEWYYQSGLSI

SEQ ID NO: 116722 - protein, 13 aa, Mycobacterium tuberculosis
AFEWYYQSGLSIV

SEQ ID NO: 116723 - protein, 13 aa, Mycobacterium tuberculosis
FEWYYQSGLSIVM

SEQ ID NO: 116724 - protein, 13 aa, Mycobacterium tuberculosis
EWYYQSGLSIVMP

SEQ ID NO: 116725 - protein, 13 aa, Mycobacterium tuberculosis
WYYQSGLSIVMPV

SEQ ID NO: 116726 - protein, 13 aa, Mycobacterium tuberculosis
YYQSGLSIVMPVG

SEQ ID NO: 116727 - protein, 13 aa, Mycobacterium tuberculosis
YQSGLSIVMPVGG

SEQ ID NO: 116728 - protein, 13 aa, Mycobacterium tuberculosis
QSGLSIVMPVGGQ

SEQ ID NO: 116729 - protein, 13 aa, Mycobacterium tuberculosis
SGLSIVMPVGGQS

SEQ ID NO: 116730 - protein, 13 aa, Mycobacterium tuberculosis
GLSIVMPVGGQSS

SEQ ID NO: 116731 - protein, 13 aa, Mycobacterium tuberculosis
LSIVMPVGGQSSF

SEQ ID NO: 116732 - protein, 13 aa, Mycobacterium tuberculosis
SIVMPVGGQSSFY

SEQ ID NO: 116733 - protein, 13 aa, Mycobacterium tuberculosis
IVMPVGGQSSFYS

SEQ ID NO: 116734 - protein, 13 aa, Mycobacterium tuberculosis
VMPVGGQSSFYSD

SEQ ID NO: 116735 - protein, 13 aa, Mycobacterium tuberculosis
MPVGGQSSFYSDW

SEQ ID NO: 116736 - protein, 13 aa, Mycobacterium tuberculosis
PVGGQSSFYSDWY

SEQ ID NO: 116737 - protein, 13 aa, Mycobacterium tuberculosis
VGGQSSFYSDWYS

SEQ ID NO: 116738 - protein, 13 aa, Mycobacterium tuberculosis
GGQSSFYSDWYSP

SEQ ID NO: 116739 - protein, 13 aa, Mycobacterium tuberculosis
GQSSFYSDWYSPA

SEQ ID NO: 116740 - protein, 13 aa, Mycobacterium tuberculosis
QSSFYSDWYSPAC

SEQ ID NO: 116741 - protein, 13 aa, Mycobacterium tuberculosis
SSFYSDWYSPACG

SEQ ID NO: 116742 - protein, 13 aa, Mycobacterium tuberculosis
SFYSDWYSPACGK

SEQ ID NO: 116743 - protein, 13 aa, Mycobacterium tuberculosis
FYSDWYSPACGKA

SEQ ID NO: 116744 - protein, 13 aa, Mycobacterium tuberculosis
YSDWYSPACGKAG

SEQ ID NO: 116745 - protein, 13 aa, Mycobacterium tuberculosis
SDWYSPACGKAGC

SEQ ID NO: 116746 - protein, 13 aa, Mycobacterium tuberculosis
DWYSPACGKAGCQ

SEQ ID NO: 116747 - protein, 13 aa, Mycobacterium tuberculosis
WYSPACGKAGCQT

SEQ ID NO: 116748 - protein, 13 aa, Mycobacterium tuberculosis
YSPACGKAGCQTY

SEQ ID NO: 116749 - protein, 13 aa, Mycobacterium tuberculosis
SPACGKAGCQTYK

SEQ ID NO: 116750 - protein, 13 aa, Mycobacterium tuberculosis
PACGKAGCQTYKW

SEQ ID NO: 116751 - protein, 13 aa, Mycobacterium tuberculosis
ACGKAGCQTYKWE

SEQ ID NO: 116752 - protein, 13 aa, Mycobacterium tuberculosis
CGKAGCQTYKWET

SEQ ID NO: 116753 - protein, 13 aa, Mycobacterium tuberculosis
GKAGCQTYKWETF

SEQ ID NO: 116754 - protein, 13 aa, Mycobacterium tuberculosis
KAGCQTYKWETFL

SEQ ID NO: 116755 - protein, 13 aa, Mycobacterium tuberculosis
AGCQTYKWETFLT

SEQ ID NO: 116756 - protein, 13 aa, Mycobacterium tuberculosis
GCQTYKWETFLTS

SEQ ID NO: 116757 - protein, 13 aa, Mycobacterium tuberculosis
CQTYKWETFLTSE

SEQ ID NO: 116758 - protein, 13 aa, Mycobacterium tuberculosis
QTYKWETFLTSEL

SEQ ID NO: 116759 - protein, 13 aa, Mycobacterium tuberculosis
TYKWETFLTSELP

SEQ ID NO: 116760 - protein, 13 aa, Mycobacterium tuberculosis
YKWETFLTSELPQ

SEQ ID NO: 116761 - protein, 13 aa, Mycobacterium tuberculosis
KWETFLTSELPQW

SEQ ID NO: 116762 - protein, 13 aa, Mycobacterium tuberculosis
WETFLTSELPQWL

SEQ ID NO: 116763 - protein, 13 aa, Mycobacterium tuberculosis
ETFLTSELPQWLS

SEQ ID NO: 116764 - protein, 13 aa, Mycobacterium tuberculosis
TFLTSELPQWLSA

SEQ ID NO: 116765 - protein, 13 aa, Mycobacterium tuberculosis
FLTSELPQWLSAN

SEQ ID NO: 116766 - protein, 13 aa, Mycobacterium tuberculosis
LTSELPQWLSANR

SEQ ID NO: 116767 - protein, 13 aa, Mycobacterium tuberculosis
TSELPQWLSANRA

SEQ ID NO: 116768 - protein, 13 aa, Mycobacterium tuberculosis
SELPQWLSANRAV

SEQ ID NO: 116769 - protein, 13 aa, Mycobacterium tuberculosis
ELPQWLSANRAVK

SEQ ID NO: 116770 - protein, 13 aa, Mycobacterium tuberculosis
LPQWLSANRAVKP

SEQ ID NO: 116771 - protein, 13 aa, Mycobacterium tuberculosis
PQWLSANRAVKPT

SEQ ID NO: 116772 - protein, 13 aa, Mycobacterium tuberculosis
QWLSANRAVKPTG

SEQ ID NO: 116773 - protein, 13 aa, Mycobacterium tuberculosis
WLSANRAVKPTGS

SEQ ID NO: 116774 - protein, 13 aa, Mycobacterium tuberculosis
LSANRAVKPTGSA

SEQ ID NO: 116775 - protein, 13 aa, Mycobacterium tuberculosis
SANRAVKPTGSAA

SEQ ID NO: 116776 - protein, 13 aa, Mycobacterium tuberculosis
ANRAVKPTGSAAI

SEQ ID NO: 116777 - protein, 13 aa, Mycobacterium tuberculosis
NRAVKPTGSAAIG

SEQ ID NO: 116778 - protein, 13 aa, Mycobacterium tuberculosis
RAVKPTGSAAIGL

SEQ ID NO: 116779 - protein, 13 aa, Mycobacterium tuberculosis
AVKPTGSAAIGLS

SEQ ID NO: 116780 - protein, 13 aa, Mycobacterium tuberculosis
VKPTGSAAIGLSM

SEQ ID NO: 116781 - protein, 13 aa, Mycobacterium tuberculosis
KPTGSAAIGLSMA

SEQ ID NO: 116782 - protein, 13 aa, Mycobacterium tuberculosis
PTGSAAIGLSMAG

SEQ ID NO: 116783 - protein, 13 aa, Mycobacterium tuberculosis
TGSAAIGLSMAGS

SEQ ID NO: 116784 - protein, 13 aa, Mycobacterium tuberculosis
GSAAIGLSMAGSS

SEQ ID NO: 116785 - protein, 13 aa, Mycobacterium tuberculosis
SAAIGLSMAGSSA

SEQ ID NO: 116786 - protein, 13 aa, Mycobacterium tuberculosis
AAIGLSMAGSSAM

SEQ ID NO: 116787 - protein, 13 aa, Mycobacterium tuberculosis
AIGLSMAGSSAMI

SEQ ID NO: 116788 - protein, 13 aa, Mycobacterium tuberculosis
IGLSMAGSSAMIL

SEQ ID NO: 116789 - protein, 13 aa, Mycobacterium tuberculosis
GLSMAGSSAMILA

SEQ ID NO: 116790 - protein, 13 aa, Mycobacterium tuberculosis
LSMAGSSAMILAA

SEQ ID NO: 116791 - protein, 13 aa, Mycobacterium tuberculosis
SMAGSSAMILAAY

SEQ ID NO: 116792 - protein, 13 aa, Mycobacterium tuberculosis
MAGSSAMILAAYH

SEQ ID NO: 116793 - protein, 13 aa, Mycobacterium tuberculosis
AGSSAMILAAYHP

SEQ ID NO: 116794 - protein, 13 aa, Mycobacterium tuberculosis
GSSAMILAAYHPQ

SEQ ID NO: 116795 - protein, 13 aa, Mycobacterium tuberculosis
SSAMILAAYHPQQ

SEQ ID NO: 116796 - protein, 13 aa, Mycobacterium tuberculosis
SAMILAAYHPQQF

SEQ ID NO: 116797 - protein, 13 aa, Mycobacterium tuberculosis
AMILAAYHPQQFI

SEQ ID NO: 116798 - protein, 13 aa, Mycobacterium tuberculosis
MILAAYHPQQFIY

SEQ ID NO: 116799 - protein, 13 aa, Mycobacterium tuberculosis
ILAAYHPQQFIYA

SEQ ID NO: 116800 - protein, 13 aa, Mycobacterium tuberculosis
LAAYHPQQFIYAG

SEQ ID NO: 116801 - protein, 13 aa, Mycobacterium tuberculosis
AAYHPQQFIYAGS

SEQ ID NO: 116802 - protein, 13 aa, Mycobacterium tuberculosis
AYHPQQFIYAGSL

SEQ ID NO: 116803 - protein, 13 aa, Mycobacterium tuberculosis
YHPQQFIYAGSLS

SEQ ID NO: 116804 - protein, 13 aa, Mycobacterium tuberculosis
HPQQFIYAGSLSA

SEQ ID NO: 116805 - protein, 13 aa, Mycobacterium tuberculosis
PQQFIYAGSLSAL

SEQ ID NO: 116806 - protein, 13 aa, Mycobacterium tuberculosis
QQFIYAGSLSALL

SEQ ID NO: 116807 - protein, 13 aa, Mycobacterium tuberculosis
QFIYAGSLSALLD

SEQ ID NO: 116808 - protein, 13 aa, Mycobacterium tuberculosis
FIYAGSLSALLDP

SEQ ID NO: 116809 - protein, 13 aa, Mycobacterium tuberculosis
IYAGSLSALLDPS

SEQ ID NO: 116810 - protein, 13 aa, Mycobacterium tuberculosis
YAGSLSALLDPSQ

SEQ ID NO: 116811 - protein, 13 aa, Mycobacterium tuberculosis
AGSLSALLDPSQG

SEQ ID NO: 116812 - protein, 13 aa, Mycobacterium tuberculosis
GSLSALLDPSQGM

SEQ ID NO: 116813 - protein, 13 aa, Mycobacterium tuberculosis
SLSALLDPSQGMG

SEQ ID NO: 116814 - protein, 13 aa, Mycobacterium tuberculosis
LSALLDPSQGMGP

SEQ ID NO: 116815 - protein, 13 aa, Mycobacterium tuberculosis
SALLDPSQGMGPS

SEQ ID NO: 116816 - protein, 13 aa, Mycobacterium tuberculosis
ALLDPSQGMGPSL

SEQ ID NO: 116817 - protein, 13 aa, Mycobacterium tuberculosis
LLDPSQGMGPSLI

SEQ ID NO: 116818 - protein, 13 aa, Mycobacterium tuberculosis
LDPSQGMGPSLIG

SEQ ID NO: 116819 - protein, 13 aa, Mycobacterium tuberculosis
DPSQGMGPSLIGL

SEQ ID NO: 116820 - protein, 13 aa, Mycobacterium tuberculosis
PSQGMGPSLIGLA

SEQ ID NO: 116821 - protein, 13 aa, Mycobacterium tuberculosis
SQGMGPSLIGLAM

SEQ ID NO: 116822 - protein, 13 aa, Mycobacterium tuberculosis
QGMGPSLIGLAMG

SEQ ID NO: 116823 - protein, 13 aa, Mycobacterium tuberculosis
GMGPSLIGLAMGD

SEQ ID NO: 116824 - protein, 13 aa, Mycobacterium tuberculosis
MGPSLIGLAMGDA

SEQ ID NO: 116825 - protein, 13 aa, Mycobacterium tuberculosis
GPSLIGLAMGDAG

SEQ ID NO: 116826 - protein, 13 aa, Mycobacterium tuberculosis
PSLIGLAMGDAGG

SEQ ID NO: 116827 - protein, 13 aa, Mycobacterium tuberculosis
SLIGLAMGDAGGY

SEQ ID NO: 116828 - protein, 13 aa, Mycobacterium tuberculosis
LIGLAMGDAGGYK

SEQ ID NO: 116829 - protein, 13 aa, Mycobacterium tuberculosis
IGLAMGDAGGYKA

SEQ ID NO: 116830 - protein, 13 aa, Mycobacterium tuberculosis
GLAMGDAGGYKAA

SEQ ID NO: 116831 - protein, 13 aa, Mycobacterium tuberculosis
LAMGDAGGYKAAD

SEQ ID NO: 116832 - protein, 13 aa, Mycobacterium tuberculosis
AMGDAGGYKAADM

SEQ ID NO: 116833 - protein, 13 aa, Mycobacterium tuberculosis
MGDAGGYKAADMW

SEQ ID NO: 116834 - protein, 13 aa, Mycobacterium tuberculosis
GDAGGYKAADMWG

SEQ ID NO: 116835 - protein, 13 aa, Mycobacterium tuberculosis
DAGGYKAADMWGP

SEQ ID NO: 116836 - protein, 13 aa, Mycobacterium tuberculosis
AGGYKAADMWGPS

SEQ ID NO: 116837 - protein, 13 aa, Mycobacterium tuberculosis
GGYKAADMWGPSS

SEQ ID NO: 116838 - protein, 13 aa, Mycobacterium tuberculosis
GYKAADMWGPSSD

SEQ ID NO: 116839 - protein, 13 aa, Mycobacterium tuberculosis
YKAADMWGPSSDP

SEQ ID NO: 116840 - protein, 13 aa, Mycobacterium tuberculosis
KAADMWGPSSDPA

SEQ ID NO: 116841 - protein, 13 aa, Mycobacterium tuberculosis
AADMWGPSSDPAW

SEQ ID NO: 116842 - protein, 13 aa, Mycobacterium tuberculosis
ADMWGPSSDPAWE

SEQ ID NO: 116843 - protein, 13 aa, Mycobacterium tuberculosis
DMWGPSSDPAWER

SEQ ID NO: 116844 - protein, 13 aa, Mycobacterium tuberculosis
MWGPSSDPAWERN

SEQ ID NO: 116845 - protein, 13 aa, Mycobacterium tuberculosis
WGPSSDPAWERND

SEQ ID NO: 116846 - protein, 13 aa, Mycobacterium tuberculosis
GPSSDPAWERNDP

SEQ ID NO: 116847 - protein, 13 aa, Mycobacterium tuberculosis
PSSDPAWERNDPT

SEQ ID NO: 116848 - protein, 13 aa, Mycobacterium tuberculosis
SSDPAWERNDPTQ

SEQ ID NO: 116849 - protein, 13 aa, Mycobacterium tuberculosis
SDPAWERNDPTQQ

SEQ ID NO: 116850 - protein, 13 aa, Mycobacterium tuberculosis
DPAWERNDPTQQI

SEQ ID NO: 116851 - protein, 13 aa, Mycobacterium tuberculosis
PAWERNDPTQQIP

SEQ ID NO: 116852 - protein, 13 aa, Mycobacterium tuberculosis
AWERNDPTQQIPK

SEQ ID NO: 116853 - protein, 13 aa, Mycobacterium tuberculosis
WERNDPTQQIPKL

SEQ ID NO: 116854 - protein, 13 aa, Mycobacterium tuberculosis
ERNDPTQQIPKLV

SEQ ID NO: 116855 - protein, 13 aa, Mycobacterium tuberculosis
RNDPTQQIPKLVA

SEQ ID NO: 116856 - protein, 13 aa, Mycobacterium tuberculosis
NDPTQQIPKLVAN

SEQ ID NO: 116857 - protein, 13 aa, Mycobacterium tuberculosis
DPTQQIPKLVANN

SEQ ID NO: 116858 - protein, 13 aa, Mycobacterium tuberculosis
PTQQIPKLVANNT

SEQ ID NO: 116859 - protein, 13 aa, Mycobacterium tuberculosis
TQQIPKLVANNTR

SEQ ID NO: 116860 - protein, 13 aa, Mycobacterium tuberculosis
QQIPKLVANNTRL

SEQ ID NO: 116861 - protein, 13 aa, Mycobacterium tuberculosis
QIPKLVANNTRLW

SEQ ID NO: 116862 - protein, 13 aa, Mycobacterium tuberculosis
IPKLVANNTRLWV

SEQ ID NO: 116863 - protein, 13 aa, Mycobacterium tuberculosis
PKLVANNTRLWVY

SEQ ID NO: 116864 - protein, 13 aa, Mycobacterium tuberculosis
KLVANNTRLWVYC

SEQ ID NO: 116865 - protein, 13 aa, Mycobacterium tuberculosis
LVANNTRLWVYCG

SEQ ID NO: 116866 - protein, 13 aa, Mycobacterium tuberculosis
VANNTRLWVYCGN

SEQ ID NO: 116867 - protein, 13 aa, Mycobacterium tuberculosis
ANNTRLWVYCGNG

SEQ ID NO: 116868 - protein, 13 aa, Mycobacterium tuberculosis
NNTRLWVYCGNGT

SEQ ID NO: 116869 - protein, 13 aa, Mycobacterium tuberculosis
NTRLWVYCGNGTP

SEQ ID NO: 116870 - protein, 13 aa, Mycobacterium tuberculosis
TRLWVYCGNGTPN

SEQ ID NO: 116871 - protein, 13 aa, Mycobacterium tuberculosis
RLWVYCGNGTPNE

SEQ ID NO: 116872 - protein, 13 aa, Mycobacterium tuberculosis
LWVYCGNGTPNEL

SEQ ID NO: 116873 - protein, 13 aa, Mycobacterium tuberculosis
WVYCGNGTPNELG

SEQ ID NO: 116874 - protein, 13 aa, Mycobacterium tuberculosis
VYCGNGTPNELGG

SEQ ID NO: 116875 - protein, 13 aa, Mycobacterium tuberculosis
YCGNGTPNELGGA

SEQ ID NO: 116876 - protein, 13 aa, Mycobacterium tuberculosis
CGNGTPNELGGAN

SEQ ID NO: 116877 - protein, 13 aa, Mycobacterium tuberculosis
GNGTPNELGGANI

SEQ ID NO: 116878 - protein, 13 aa, Mycobacterium tuberculosis
NGTPNELGGANIP

SEQ ID NO: 116879 - protein, 13 aa, Mycobacterium tuberculosis
GTPNELGGANIPA

SEQ ID NO: 116880 - protein, 13 aa, Mycobacterium tuberculosis
TPNELGGANIPAE

SEQ ID NO: 116881 - protein, 13 aa, Mycobacterium tuberculosis
PNELGGANIPAEF

SEQ ID NO: 116882 - protein, 13 aa, Mycobacterium tuberculosis
NELGGANIPAEFL

SEQ ID NO: 116883 - protein, 13 aa, Mycobacterium tuberculosis
ELGGANIPAEFLE

SEQ ID NO: 116884 - protein, 13 aa, Mycobacterium tuberculosis
LGGANIPAEFLEN

SEQ ID NO: 116885 - protein, 13 aa, Mycobacterium tuberculosis
GGANIPAEFLENF

SEQ ID NO: 116886 - protein, 13 aa, Mycobacterium tuberculosis
GANIPAEFLENFV

SEQ ID NO: 116887 - protein, 13 aa, Mycobacterium tuberculosis
ANIPAEFLENFVR

SEQ ID NO: 116888 - protein, 13 aa, Mycobacterium tuberculosis
NIPAEFLENFVRS

SEQ ID NO: 116889 - protein, 13 aa, Mycobacterium tuberculosis
IPAEFLENFVRSS

SEQ ID NO: 116890 - protein, 13 aa, Mycobacterium tuberculosis
PAEFLENFVRSSN

SEQ ID NO: 116891 - protein, 13 aa, Mycobacterium tuberculosis
AEFLENFVRSSNL

SEQ ID NO: 116892 - protein, 13 aa, Mycobacterium tuberculosis
EFLENFVRSSNLK

SEQ ID NO: 116893 - protein, 13 aa, Mycobacterium tuberculosis
FLENFVRSSNLKF

SEQ ID NO: 116894 - protein, 13 aa, Mycobacterium tuberculosis
LENFVRSSNLKFQ

SEQ ID NO: 116895 - protein, 13 aa, Mycobacterium tuberculosis
ENFVRSSNLKFQD

SEQ ID NO: 116896 - protein, 13 aa, Mycobacterium tuberculosis
NFVRSSNLKFQDA

SEQ ID NO: 116897 - protein, 13 aa, Mycobacterium tuberculosis
FVRSSNLKFQDAY

SEQ ID NO: 116898 - protein, 13 aa, Mycobacterium tuberculosis
VRSSNLKFQDAYN

SEQ ID NO: 116899 - protein, 13 aa, Mycobacterium tuberculosis
RSSNLKFQDAYNA

SEQ ID NO: 116900 - protein, 13 aa, Mycobacterium tuberculosis
SSNLKFQDAYNAA

SEQ ID NO: 116901 - protein, 13 aa, Mycobacterium tuberculosis
SNLKFQDAYNAAG

SEQ ID NO: 116902 - protein, 13 aa, Mycobacterium tuberculosis
NLKFQDAYNAAGG

SEQ ID NO: 116903 - protein, 13 aa, Mycobacterium tuberculosis
LKFQDAYNAAGGH

SEQ ID NO: 116904 - protein, 13 aa, Mycobacterium tuberculosis
KFQDAYNAAGGHN

SEQ ID NO: 116905 - protein, 13 aa, Mycobacterium tuberculosis
FQDAYNAAGGHNA

SEQ ID NO: 116906 - protein, 13 aa, Mycobacterium tuberculosis
QDAYNAAGGHNAV

SEQ ID NO: 116907 - protein, 13 aa, Mycobacterium tuberculosis
DAYNAAGGHNAVF

SEQ ID NO: 116908 - protein, 13 aa, Mycobacterium tuberculosis
AYNAAGGHNAVFN

SEQ ID NO: 116909 - protein, 13 aa, Mycobacterium tuberculosis
YNAAGGHNAVFNF

SEQ ID NO: 116910 - protein, 13 aa, Mycobacterium tuberculosis
NAAGGHNAVFNFP

SEQ ID NO: 116911 - protein, 13 aa, Mycobacterium tuberculosis
AAGGHNAVFNFPP

SEQ ID NO: 116912 - protein, 13 aa, Mycobacterium tuberculosis
AGGHNAVFNFPPN

SEQ ID NO: 116913 - protein, 13 aa, Mycobacterium tuberculosis
GGHNAVFNFPPNG

SEQ ID NO: 116914 - protein, 13 aa, Mycobacterium tuberculosis
GHNAVFNFPPNGT

SEQ ID NO: 116915 - protein, 13 aa, Mycobacterium tuberculosis
HNAVFNFPPNGTH

SEQ ID NO: 116916 - protein, 13 aa, Mycobacterium tuberculosis
NAVFNFPPNGTHS

SEQ ID NO: 116917 - protein, 13 aa, Mycobacterium tuberculosis
AVFNFPPNGTHSW

SEQ ID NO: 116918 - protein, 13 aa, Mycobacterium tuberculosis
VFNFPPNGTHSWE

SEQ ID NO: 116919 - protein, 13 aa, Mycobacterium tuberculosis
FNFPPNGTHSWEY

SEQ ID NO: 116920 - protein, 13 aa, Mycobacterium tuberculosis
NFPPNGTHSWEYW

SEQ ID NO: 116921 - protein, 13 aa, Mycobacterium tuberculosis
FPPNGTHSWEYWG

SEQ ID NO: 116922 - protein, 13 aa, Mycobacterium tuberculosis
PPNGTHSWEYWGA

SEQ ID NO: 116923 - protein, 13 aa, Mycobacterium tuberculosis
PNGTHSWEYWGAQ

SEQ ID NO: 116924 - protein, 13 aa, Mycobacterium tuberculosis
NGTHSWEYWGAQL

SEQ ID NO: 116925 - protein, 13 aa, Mycobacterium tuberculosis
GTHSWEYWGAQLN

SEQ ID NO: 116926 - protein, 13 aa, Mycobacterium tuberculosis
THSWEYWGAQLNA

SEQ ID NO: 116927 - protein, 13 aa, Mycobacterium tuberculosis
HSWEYWGAQLNAM

SEQ ID NO: 116928 - protein, 13 aa, Mycobacterium tuberculosis
SWEYWGAQLNAMK

SEQ ID NO: 116929 - protein, 13 aa, Mycobacterium tuberculosis
WEYWGAQLNAMKG

SEQ ID NO: 116930 - protein, 13 aa, Mycobacterium tuberculosis
EYWGAQLNAMKGD

SEQ ID NO: 116931 - protein, 13 aa, Mycobacterium tuberculosis
YWGAQLNAMKGDL

SEQ ID NO: 116932 - protein, 13 aa, Mycobacterium tuberculosis
WGAQLNAMKGDLQ

SEQ ID NO: 116933 - protein, 13 aa, Mycobacterium tuberculosis
GAQLNAMKGDLQS

SEQ ID NO: 116934 - protein, 13 aa, Mycobacterium tuberculosis
AQLNAMKGDLQSS

SEQ ID NO: 116935 - protein, 13 aa, Mycobacterium tuberculosis
QLNAMKGDLQSSL

SEQ ID NO: 116936 - protein, 13 aa, Mycobacterium tuberculosis
LNAMKGDLQSSLG

SEQ ID NO: 116937 - protein, 13 aa, Mycobacterium tuberculosis
NAMKGDLQSSLGA

SEQ ID NO: 116938 - protein, 13 aa, Mycobacterium tuberculosis
AMKGDLQSSLGAG

SEQ ID NO: 116939 - protein, 14 aa, Mycobacterium tuberculosis
MTDVSRKIRAWGRR

SEQ ID NO: 116940 - protein, 14 aa, Mycobacterium tuberculosis
TDVSRKIRAWGRRL

SEQ ID NO: 116941 - protein, 14 aa, Mycobacterium tuberculosis
DVSRKIRAWGRRLM

SEQ ID NO: 116942 - protein, 14 aa, Mycobacterium tuberculosis
VSRKIRAWGRRLMI

SEQ ID NO: 116943 - protein, 14 aa, Mycobacterium tuberculosis
SRKIRAWGRRLMIG

SEQ ID NO: 116944 - protein, 14 aa, Mycobacterium tuberculosis
RKIRAWGRRLMIGT

SEQ ID NO: 116945 - protein, 14 aa, Mycobacterium tuberculosis
KIRAWGRRLMIGTA

SEQ ID NO: 116946 - protein, 14 aa, Mycobacterium tuberculosis
IRAWGRRLMIGTAA

SEQ ID NO: 116947 - protein, 14 aa, Mycobacterium tuberculosis
RAWGRRLMIGTAAA

SEQ ID NO: 116948 - protein, 14 aa, Mycobacterium tuberculosis
AWGRRLMIGTAAAV

SEQ ID NO: 116949 - protein, 14 aa, Mycobacterium tuberculosis
WGRRLMIGTAAAVV

SEQ ID NO: 116950 - protein, 14 aa, Mycobacterium tuberculosis
GRRLMIGTAAAVVL

SEQ ID NO: 116951 - protein, 14 aa, Mycobacterium tuberculosis
RRLMIGTAAAVVLP

SEQ ID NO: 116952 - protein, 14 aa, Mycobacterium tuberculosis
RLMIGTAAAVVLPG

SEQ ID NO: 116953 - protein, 14 aa, Mycobacterium tuberculosis
LMIGTAAAVVLPGL

SEQ ID NO: 116954 - protein, 14 aa, Mycobacterium tuberculosis
MIGTAAAVVLPGLV

SEQ ID NO: 116955 - protein, 14 aa, Mycobacterium tuberculosis
IGTAAAVVLPGLVG

SEQ ID NO: 116956 - protein, 14 aa, Mycobacterium tuberculosis
GTAAAVVLPGLVGL

SEQ ID NO: 116957 - protein, 14 aa, Mycobacterium tuberculosis
TAAAVVLPGLVGLA

SEQ ID NO: 116958 - protein, 14 aa, Mycobacterium tuberculosis
AAAVVLPGLVGLAG

SEQ ID NO: 116959 - protein, 14 aa, Mycobacterium tuberculosis
AAVVLPGLVGLAGG

SEQ ID NO: 116960 - protein, 14 aa, Mycobacterium tuberculosis
AVVLPGLVGLAGGA

SEQ ID NO: 116961 - protein, 14 aa, Mycobacterium tuberculosis
VVLPGLVGLAGGAA

SEQ ID NO: 116962 - protein, 14 aa, Mycobacterium tuberculosis
VLPGLVGLAGGAAT

SEQ ID NO: 116963 - protein, 14 aa, Mycobacterium tuberculosis
LPGLVGLAGGAATA

SEQ ID NO: 116964 - protein, 14 aa, Mycobacterium tuberculosis
PGLVGLAGGAATAG

SEQ ID NO: 116965 - protein, 14 aa, Mycobacterium tuberculosis
GLVGLAGGAATAGA

SEQ ID NO: 116966 - protein, 14 aa, Mycobacterium tuberculosis
LVGLAGGAATAGAF

SEQ ID NO: 116967 - protein, 14 aa, Mycobacterium tuberculosis
VGLAGGAATAGAFS

SEQ ID NO: 116968 - protein, 14 aa, Mycobacterium tuberculosis
GLAGGAATAGAFSR

SEQ ID NO: 116969 - protein, 14 aa, Mycobacterium tuberculosis
LAGGAATAGAFSRP

SEQ ID NO: 116970 - protein, 14 aa, Mycobacterium tuberculosis
AGGAATAGAFSRPG

SEQ ID NO: 116971 - protein, 14 aa, Mycobacterium tuberculosis
GGAATAGAFSRPGL

SEQ ID NO: 116972 - protein, 14 aa, Mycobacterium tuberculosis
GAATAGAFSRPGLP

SEQ ID NO: 116973 - protein, 14 aa, Mycobacterium tuberculosis
AATAGAFSRPGLPV

SEQ ID NO: 116974 - protein, 14 aa, Mycobacterium tuberculosis
ATAGAFSRPGLPVE

SEQ ID NO: 116975 - protein, 14 aa, Mycobacterium tuberculosis
TAGAFSRPGLPVEY

SEQ ID NO: 116976 - protein, 14 aa, Mycobacterium tuberculosis
AGAFSRPGLPVEYL

SEQ ID NO: 116977 - protein, 14 aa, Mycobacterium tuberculosis
GAFSRPGLPVEYLQ

SEQ ID NO: 116978 - protein, 14 aa, Mycobacterium tuberculosis
AFSRPGLPVEYLQV

SEQ ID NO: 116979 - protein, 14 aa, Mycobacterium tuberculosis
FSRPGLPVEYLQVP

SEQ ID NO: 116980 - protein, 14 aa, Mycobacterium tuberculosis
SRPGLPVEYLQVPS

SEQ ID NO: 116981 - protein, 14 aa, Mycobacterium tuberculosis
RPGLPVEYLQVPSP

SEQ ID NO: 116982 - protein, 14 aa, Mycobacterium tuberculosis
PGLPVEYLQVPSPS

SEQ ID NO: 116983 - protein, 14 aa, Mycobacterium tuberculosis
GLPVEYLQVPSPSM

SEQ ID NO: 116984 - protein, 14 aa, Mycobacterium tuberculosis
LPVEYLQVPSPSMG

SEQ ID NO: 116985 - protein, 14 aa, Mycobacterium tuberculosis
PVEYLQVPSPSMGR

SEQ ID NO: 116986 - protein, 14 aa, Mycobacterium tuberculosis
VEYLQVPSPSMGRD

SEQ ID NO: 116987 - protein, 14 aa, Mycobacterium tuberculosis
EYLQVPSPSMGRDI

SEQ ID NO: 116988 - protein, 14 aa, Mycobacterium tuberculosis
YLQVPSPSMGRDIK

SEQ ID NO: 116989 - protein, 14 aa, Mycobacterium tuberculosis
LQVPSPSMGRDIKV

SEQ ID NO: 116990 - protein, 14 aa, Mycobacterium tuberculosis
QVPSPSMGRDIKVQ

SEQ ID NO: 116991 - protein, 14 aa, Mycobacterium tuberculosis
VPSPSMGRDIKVQF

SEQ ID NO: 116992 - protein, 14 aa, Mycobacterium tuberculosis
PSPSMGRDIKVQFQ

SEQ ID NO: 116993 - protein, 14 aa, Mycobacterium tuberculosis
SPSMGRDIKVQFQS

SEQ ID NO: 116994 - protein, 14 aa, Mycobacterium tuberculosis
PSMGRDIKVQFQSG

SEQ ID NO: 116995 - protein, 14 aa, Mycobacterium tuberculosis
SMGRDIKVQFQSGG

SEQ ID NO: 116996 - protein, 14 aa, Mycobacterium tuberculosis
MGRDIKVQFQSGGN

SEQ ID NO: 116997 - protein, 14 aa, Mycobacterium tuberculosis
GRDIKVQFQSGGNN

SEQ ID NO: 116998 - protein, 14 aa, Mycobacterium tuberculosis
RDIKVQFQSGGNNS

SEQ ID NO: 116999 - protein, 14 aa, Mycobacterium tuberculosis
DIKVQFQSGGNNSP

SEQ ID NO: 117000 - protein, 14 aa, Mycobacterium tuberculosis
IKVQFQSGGNNSPA

SEQ ID NO: 117001 - protein, 14 aa, Mycobacterium tuberculosis
KVQFQSGGNNSPAV

SEQ ID NO: 117002 - protein, 14 aa, Mycobacterium tuberculosis
VQFQSGGNNSPAVY

SEQ ID NO: 117003 - protein, 14 aa, Mycobacterium tuberculosis
QFQSGGNNSPAVYL

SEQ ID NO: 117004 - protein, 14 aa, Mycobacterium tuberculosis
FQSGGNNSPAVYLL

SEQ ID NO: 117005 - protein, 14 aa, Mycobacterium tuberculosis
QSGGNNSPAVYLLD

SEQ ID NO: 117006 - protein, 14 aa, Mycobacterium tuberculosis
SGGNNSPAVYLLDG

SEQ ID NO: 117007 - protein, 14 aa, Mycobacterium tuberculosis
GGNNSPAVYLLDGL

SEQ ID NO: 117008 - protein, 14 aa, Mycobacterium tuberculosis
GNNSPAVYLLDGLR

SEQ ID NO: 117009 - protein, 14 aa, Mycobacterium tuberculosis
NNSPAVYLLDGLRA

SEQ ID NO: 117010 - protein, 14 aa, Mycobacterium tuberculosis
NSPAVYLLDGLRAQ

SEQ ID NO: 117011 - protein, 14 aa, Mycobacterium tuberculosis
SPAVYLLDGLRAQD

SEQ ID NO: 117012 - protein, 14 aa, Mycobacterium tuberculosis
PAVYLLDGLRAQDD

SEQ ID NO: 117013 - protein, 14 aa, Mycobacterium tuberculosis
AVYLLDGLRAQDDY

SEQ ID NO: 117014 - protein, 14 aa, Mycobacterium tuberculosis
VYLLDGLRAQDDYN

SEQ ID NO: 117015 - protein, 14 aa, Mycobacterium tuberculosis
YLLDGLRAQDDYNG

SEQ ID NO: 117016 - protein, 14 aa, Mycobacterium tuberculosis
LLDGLRAQDDYNGW

SEQ ID NO: 117017 - protein, 14 aa, Mycobacterium tuberculosis
LDGLRAQDDYNGWD

SEQ ID NO: 117018 - protein, 14 aa, Mycobacterium tuberculosis
DGLRAQDDYNGWDI

SEQ ID NO: 117019 - protein, 14 aa, Mycobacterium tuberculosis
GLRAQDDYNGWDIN

SEQ ID NO: 117020 - protein, 14 aa, Mycobacterium tuberculosis
LRAQDDYNGWDINT

SEQ ID NO: 117021 - protein, 14 aa, Mycobacterium tuberculosis
RAQDDYNGWDINTP

SEQ ID NO: 117022 - protein, 14 aa, Mycobacterium tuberculosis
AQDDYNGWDINTPA

SEQ ID NO: 117023 - protein, 14 aa, Mycobacterium tuberculosis
QDDYNGWDINTPAF

SEQ ID NO: 117024 - protein, 14 aa, Mycobacterium tuberculosis
DDYNGWDINTPAFE

SEQ ID NO: 117025 - protein, 14 aa, Mycobacterium tuberculosis
DYNGWDINTPAFEW

SEQ ID NO: 117026 - protein, 14 aa, Mycobacterium tuberculosis
YNGWDINTPAFEWY

SEQ ID NO: 117027 - protein, 14 aa, Mycobacterium tuberculosis
NGWDINTPAFEWYY

SEQ ID NO: 117028 - protein, 14 aa, Mycobacterium tuberculosis
GWDINTPAFEWYYQ

SEQ ID NO: 117029 - protein, 14 aa, Mycobacterium tuberculosis
WDINTPAFEWYYQS

SEQ ID NO: 117030 - protein, 14 aa, Mycobacterium tuberculosis
DINTPAFEWYYQSG

SEQ ID NO: 117031 - protein, 14 aa, Mycobacterium tuberculosis
INTPAFEWYYQSGL

SEQ ID NO: 117032 - protein, 14 aa, Mycobacterium tuberculosis
NTPAFEWYYQSGLS

SEQ ID NO: 117033 - protein, 14 aa, Mycobacterium tuberculosis
TPAFEWYYQSGLSI

SEQ ID NO: 117034 - protein, 14 aa, Mycobacterium tuberculosis
PAFEWYYQSGLSIV

SEQ ID NO: 117035 - protein, 14 aa, Mycobacterium tuberculosis
AFEWYYQSGLSIVM

SEQ ID NO: 117036 - protein, 14 aa, Mycobacterium tuberculosis
FEWYYQSGLSIVMP

SEQ ID NO: 117037 - protein, 14 aa, Mycobacterium tuberculosis
EWYYQSGLSIVMPV

SEQ ID NO: 117038 - protein, 14 aa, Mycobacterium tuberculosis
WYYQSGLSIVMPVG

SEQ ID NO: 117039 - protein, 14 aa, Mycobacterium tuberculosis
YYQSGLSIVMPVGG

SEQ ID NO: 117040 - protein, 14 aa, Mycobacterium tuberculosis
YQSGLSIVMPVGGQ

SEQ ID NO: 117041 - protein, 14 aa, Mycobacterium tuberculosis
QSGLSIVMPVGGQS

SEQ ID NO: 117042 - protein, 14 aa, Mycobacterium tuberculosis
SGLSIVMPVGGQSS

SEQ ID NO: 117043 - protein, 14 aa, Mycobacterium tuberculosis
GLSIVMPVGGQSSF

SEQ ID NO: 117044 - protein, 14 aa, Mycobacterium tuberculosis
LSIVMPVGGQSSFY

SEQ ID NO: 117045 - protein, 14 aa, Mycobacterium tuberculosis
SIVMPVGGQSSFYS

SEQ ID NO: 117046 - protein, 14 aa, Mycobacterium tuberculosis
IVMPVGGQSSFYSD

SEQ ID NO: 117047 - protein, 14 aa, Mycobacterium tuberculosis
VMPVGGQSSFYSDW

SEQ ID NO: 117048 - protein, 14 aa, Mycobacterium tuberculosis
MPVGGQSSFYSDWY

SEQ ID NO: 117049 - protein, 14 aa, Mycobacterium tuberculosis
PVGGQSSFYSDWYS

SEQ ID NO: 117050 - protein, 14 aa, Mycobacterium tuberculosis
VGGQSSFYSDWYSP

SEQ ID NO: 117051 - protein, 14 aa, Mycobacterium tuberculosis
GGQSSFYSDWYSPA

SEQ ID NO: 117052 - protein, 14 aa, Mycobacterium tuberculosis
GQSSFYSDWYSPAC

SEQ ID NO: 117053 - protein, 14 aa, Mycobacterium tuberculosis
QSSFYSDWYSPACG

SEQ ID NO: 117054 - protein, 14 aa, Mycobacterium tuberculosis
SSFYSDWYSPACGK

SEQ ID NO: 117055 - protein, 14 aa, Mycobacterium tuberculosis
SFYSDWYSPACGKA

SEQ ID NO: 117056 - protein, 14 aa, Mycobacterium tuberculosis
FYSDWYSPACGKAG

SEQ ID NO: 117057 - protein, 14 aa, Mycobacterium tuberculosis
YSDWYSPACGKAGC

SEQ ID NO: 117058 - protein, 14 aa, Mycobacterium tuberculosis
SDWYSPACGKAGCQ

SEQ ID NO: 117059 - protein, 14 aa, Mycobacterium tuberculosis
DWYSPACGKAGCQT

SEQ ID NO: 117060 - protein, 14 aa, Mycobacterium tuberculosis
WYSPACGKAGCQTY

SEQ ID NO: 117061 - protein, 14 aa, Mycobacterium tuberculosis
YSPACGKAGCQTYK

SEQ ID NO: 117062 - protein, 14 aa, Mycobacterium tuberculosis
SPACGKAGCQTYKW

SEQ ID NO: 117063 - protein, 14 aa, Mycobacterium tuberculosis
PACGKAGCQTYKWE

SEQ ID NO: 117064 - protein, 14 aa, Mycobacterium tuberculosis
ACGKAGCQTYKWET

SEQ ID NO: 117065 - protein, 14 aa, Mycobacterium tuberculosis
CGKAGCQTYKWETF

SEQ ID NO: 117066 - protein, 14 aa, Mycobacterium tuberculosis
GKAGCQTYKWETFL

SEQ ID NO: 117067 - protein, 14 aa, Mycobacterium tuberculosis
KAGCQTYKWETFLT

SEQ ID NO: 117068 - protein, 14 aa, Mycobacterium tuberculosis
AGCQTYKWETFLTS

SEQ ID NO: 117069 - protein, 14 aa, Mycobacterium tuberculosis
GCQTYKWETFLTSE

SEQ ID NO: 117070 - protein, 14 aa, Mycobacterium tuberculosis
CQTYKWETFLTSEL

SEQ ID NO: 117071 - protein, 14 aa, Mycobacterium tuberculosis
QTYKWETFLTSELP

SEQ ID NO: 117072 - protein, 14 aa, Mycobacterium tuberculosis
TYKWETFLTSELPQ

SEQ ID NO: 117073 - protein, 14 aa, Mycobacterium tuberculosis
YKWETFLTSELPQW

SEQ ID NO: 117074 - protein, 14 aa, Mycobacterium tuberculosis
KWETFLTSELPQWL

SEQ ID NO: 117075 - protein, 14 aa, Mycobacterium tuberculosis
WETFLTSELPQWLS

SEQ ID NO: 117076 - protein, 14 aa, Mycobacterium tuberculosis
ETFLTSELPQWLSA

SEQ ID NO: 117077 - protein, 14 aa, Mycobacterium tuberculosis
TFLTSELPQWLSAN

SEQ ID NO: 117078 - protein, 14 aa, Mycobacterium tuberculosis
FLTSELPQWLSANR

SEQ ID NO: 117079 - protein, 14 aa, Mycobacterium tuberculosis
LTSELPQWLSANRA

SEQ ID NO: 117080 - protein, 14 aa, Mycobacterium tuberculosis
TSELPQWLSANRAV

SEQ ID NO: 117081 - protein, 14 aa, Mycobacterium tuberculosis
SELPQWLSANRAVK

SEQ ID NO: 117082 - protein, 14 aa, Mycobacterium tuberculosis
ELPQWLSANRAVKP

SEQ ID NO: 117083 - protein, 14 aa, Mycobacterium tuberculosis
LPQWLSANRAVKPT

SEQ ID NO: 117084 - protein, 14 aa, Mycobacterium tuberculosis
PQWLSANRAVKPTG

SEQ ID NO: 117085 - protein, 14 aa, Mycobacterium tuberculosis
QWLSANRAVKPTGS

SEQ ID NO: 117086 - protein, 14 aa, Mycobacterium tuberculosis
WLSANRAVKPTGSA

SEQ ID NO: 117087 - protein, 14 aa, Mycobacterium tuberculosis
LSANRAVKPTGSAA

SEQ ID NO: 117088 - protein, 14 aa, Mycobacterium tuberculosis
SANRAVKPTGSAAI

SEQ ID NO: 117089 - protein, 14 aa, Mycobacterium tuberculosis
ANRAVKPTGSAAIG

SEQ ID NO: 117090 - protein, 14 aa, Mycobacterium tuberculosis
NRAVKPTGSAAIGL

SEQ ID NO: 117091 - protein, 14 aa, Mycobacterium tuberculosis
RAVKPTGSAAIGLS

SEQ ID NO: 117092 - protein, 14 aa, Mycobacterium tuberculosis
AVKPTGSAAIGLSM

SEQ ID NO: 117093 - protein, 14 aa, Mycobacterium tuberculosis
VKPTGSAAIGLSMA

SEQ ID NO: 117094 - protein, 14 aa, Mycobacterium tuberculosis
KPTGSAAIGLSMAG

SEQ ID NO: 117095 - protein, 14 aa, Mycobacterium tuberculosis
PTGSAAIGLSMAGS

SEQ ID NO: 117096 - protein, 14 aa, Mycobacterium tuberculosis
TGSAAIGLSMAGSS

SEQ ID NO: 117097 - protein, 14 aa, Mycobacterium tuberculosis
GSAAIGLSMAGSSA

SEQ ID NO: 117098 - protein, 14 aa, Mycobacterium tuberculosis
SAAIGLSMAGSSAM

SEQ ID NO: 117099 - protein, 14 aa, Mycobacterium tuberculosis
AAIGLSMAGSSAMI

SEQ ID NO: 117100 - protein, 14 aa, Mycobacterium tuberculosis
AIGLSMAGSSAMIL

SEQ ID NO: 117101 - protein, 14 aa, Mycobacterium tuberculosis
IGLSMAGSSAMILA

SEQ ID NO: 117102 - protein, 14 aa, Mycobacterium tuberculosis
GLSMAGSSAMILAA

SEQ ID NO: 117103 - protein, 14 aa, Mycobacterium tuberculosis
LSMAGSSAMILAAY

SEQ ID NO: 117104 - protein, 14 aa, Mycobacterium tuberculosis
SMAGSSAMILAAYH

SEQ ID NO: 117105 - protein, 14 aa, Mycobacterium tuberculosis
MAGSSAMILAAYHP

SEQ ID NO: 117106 - protein, 14 aa, Mycobacterium tuberculosis
AGSSAMILAAYHPQ

SEQ ID NO: 117107 - protein, 14 aa, Mycobacterium tuberculosis
GSSAMILAAYHPQQ

SEQ ID NO: 117108 - protein, 14 aa, Mycobacterium tuberculosis
SSAMILAAYHPQQF

SEQ ID NO: 117109 - protein, 14 aa, Mycobacterium tuberculosis
SAMILAAYHPQQFI

SEQ ID NO: 117110 - protein, 14 aa, Mycobacterium tuberculosis
AMILAAYHPQQFIY

SEQ ID NO: 117111 - protein, 14 aa, Mycobacterium tuberculosis
MILAAYHPQQFIYA

SEQ ID NO: 117112 - protein, 14 aa, Mycobacterium tuberculosis
ILAAYHPQQFIYAG

SEQ ID NO: 117113 - protein, 14 aa, Mycobacterium tuberculosis
LAAYHPQQFIYAGS

SEQ ID NO: 117114 - protein, 14 aa, Mycobacterium tuberculosis
AAYHPQQFIYAGSL

SEQ ID NO: 117115 - protein, 14 aa, Mycobacterium tuberculosis
AYHPQQFIYAGSLS

SEQ ID NO: 117116 - protein, 14 aa, Mycobacterium tuberculosis
YHPQQFIYAGSLSA

SEQ ID NO: 117117 - protein, 14 aa, Mycobacterium tuberculosis
HPQQFIYAGSLSAL

SEQ ID NO: 117118 - protein, 14 aa, Mycobacterium tuberculosis
PQQFIYAGSLSALL

SEQ ID NO: 117119 - protein, 14 aa, Mycobacterium tuberculosis
QQFIYAGSLSALLD

SEQ ID NO: 117120 - protein, 14 aa, Mycobacterium tuberculosis
QFIYAGSLSALLDP

SEQ ID NO: 117121 - protein, 14 aa, Mycobacterium tuberculosis
FIYAGSLSALLDPS

SEQ ID NO: 117122 - protein, 14 aa, Mycobacterium tuberculosis
IYAGSLSALLDPSQ

SEQ ID NO: 117123 - protein, 14 aa, Mycobacterium tuberculosis
YAGSLSALLDPSQG

SEQ ID NO: 117124 - protein, 14 aa, Mycobacterium tuberculosis
AGSLSALLDPSQGM

SEQ ID NO: 117125 - protein, 14 aa, Mycobacterium tuberculosis
GSLSALLDPSQGMG

SEQ ID NO: 117126 - protein, 14 aa, Mycobacterium tuberculosis
SLSALLDPSQGMGP

SEQ ID NO: 117127 - protein, 14 aa, Mycobacterium tuberculosis
LSALLDPSQGMGPS

SEQ ID NO: 117128 - protein, 14 aa, Mycobacterium tuberculosis
SALLDPSQGMGPSL

SEQ ID NO: 117129 - protein, 14 aa, Mycobacterium tuberculosis
ALLDPSQGMGPSLI

SEQ ID NO: 117130 - protein, 14 aa, Mycobacterium tuberculosis
LLDPSQGMGPSLIG

SEQ ID NO: 117131 - protein, 14 aa, Mycobacterium tuberculosis
LDPSQGMGPSLIGL

SEQ ID NO: 117132 - protein, 14 aa, Mycobacterium tuberculosis
DPSQGMGPSLIGLA

SEQ ID NO: 117133 - protein, 14 aa, Mycobacterium tuberculosis
PSQGMGPSLIGLAM

SEQ ID NO: 117134 - protein, 14 aa, Mycobacterium tuberculosis
SQGMGPSLIGLAMG

SEQ ID NO: 117135 - protein, 14 aa, Mycobacterium tuberculosis
QGMGPSLIGLAMGD

SEQ ID NO: 117136 - protein, 14 aa, Mycobacterium tuberculosis
GMGPSLIGLAMGDA

SEQ ID NO: 117137 - protein, 14 aa, Mycobacterium tuberculosis
MGPSLIGLAMGDAG

SEQ ID NO: 117138 - protein, 14 aa, Mycobacterium tuberculosis
GPSLIGLAMGDAGG

SEQ ID NO: 117139 - protein, 14 aa, Mycobacterium tuberculosis
PSLIGLAMGDAGGY

SEQ ID NO: 117140 - protein, 14 aa, Mycobacterium tuberculosis
SLIGLAMGDAGGYK

SEQ ID NO: 117141 - protein, 14 aa, Mycobacterium tuberculosis
LIGLAMGDAGGYKA

SEQ ID NO: 117142 - protein, 14 aa, Mycobacterium tuberculosis
IGLAMGDAGGYKAA

SEQ ID NO: 117143 - protein, 14 aa, Mycobacterium tuberculosis
GLAMGDAGGYKAAD

SEQ ID NO: 117144 - protein, 14 aa, Mycobacterium tuberculosis
LAMGDAGGYKAADM

SEQ ID NO: 117145 - protein, 14 aa, Mycobacterium tuberculosis
AMGDAGGYKAADMW

SEQ ID NO: 117146 - protein, 14 aa, Mycobacterium tuberculosis
MGDAGGYKAADMWG

SEQ ID NO: 117147 - protein, 14 aa, Mycobacterium tuberculosis
GDAGGYKAADMWGP

SEQ ID NO: 117148 - protein, 14 aa, Mycobacterium tuberculosis
DAGGYKAADMWGPS

SEQ ID NO: 117149 - protein, 14 aa, Mycobacterium tuberculosis
AGGYKAADMWGPSS

SEQ ID NO: 117150 - protein, 14 aa, Mycobacterium tuberculosis
GGYKAADMWGPSSD

SEQ ID NO: 117151 - protein, 14 aa, Mycobacterium tuberculosis
GYKAADMWGPSSDP

SEQ ID NO: 117152 - protein, 14 aa, Mycobacterium tuberculosis
YKAADMWGPSSDPA

SEQ ID NO: 117153 - protein, 14 aa, Mycobacterium tuberculosis
KAADMWGPSSDPAW

SEQ ID NO: 117154 - protein, 14 aa, Mycobacterium tuberculosis
AADMWGPSSDPAWE

SEQ ID NO: 117155 - protein, 14 aa, Mycobacterium tuberculosis
ADMWGPSSDPAWER

SEQ ID NO: 117156 - protein, 14 aa, Mycobacterium tuberculosis
DMWGPSSDPAWERN

SEQ ID NO: 117157 - protein, 14 aa, Mycobacterium tuberculosis
MWGPSSDPAWERND

SEQ ID NO: 117158 - protein, 14 aa, Mycobacterium tuberculosis
WGPSSDPAWERNDP

SEQ ID NO: 117159 - protein, 14 aa, Mycobacterium tuberculosis
GPSSDPAWERNDPT

SEQ ID NO: 117160 - protein, 14 aa, Mycobacterium tuberculosis
PSSDPAWERNDPTQ

SEQ ID NO: 117161 - protein, 14 aa, Mycobacterium tuberculosis
SSDPAWERNDPTQQ

SEQ ID NO: 117162 - protein, 14 aa, Mycobacterium tuberculosis
SDPAWERNDPTQQI

SEQ ID NO: 117163 - protein, 14 aa, Mycobacterium tuberculosis
DPAWERNDPTQQIP

SEQ ID NO: 117164 - protein, 14 aa, Mycobacterium tuberculosis
PAWERNDPTQQIPK

SEQ ID NO: 117165 - protein, 14 aa, Mycobacterium tuberculosis
AWERNDPTQQIPKL

SEQ ID NO: 117166 - protein, 14 aa, Mycobacterium tuberculosis
WERNDPTQQIPKLV

SEQ ID NO: 117167 - protein, 14 aa, Mycobacterium tuberculosis
ERNDPTQQIPKLVA

SEQ ID NO: 117168 - protein, 14 aa, Mycobacterium tuberculosis
RNDPTQQIPKLVAN

SEQ ID NO: 117169 - protein, 14 aa, Mycobacterium tuberculosis
NDPTQQIPKLVANN

SEQ ID NO: 117170 - protein, 14 aa, Mycobacterium tuberculosis
DPTQQIPKLVANNT

SEQ ID NO: 117171 - protein, 14 aa, Mycobacterium tuberculosis
PTQQIPKLVANNTR

SEQ ID NO: 117172 - protein, 14 aa, Mycobacterium tuberculosis
TQQIPKLVANNTRL

SEQ ID NO: 117173 - protein, 14 aa, Mycobacterium tuberculosis
QQIPKLVANNTRLW

SEQ ID NO: 117174 - protein, 14 aa, Mycobacterium tuberculosis
QIPKLVANNTRLWV

SEQ ID NO: 117175 - protein, 14 aa, Mycobacterium tuberculosis
IPKLVANNTRLWVY

SEQ ID NO: 117176 - protein, 14 aa, Mycobacterium tuberculosis
PKLVANNTRLWVYC

SEQ ID NO: 117177 - protein, 14 aa, Mycobacterium tuberculosis
KLVANNTRLWVYCG

SEQ ID NO: 117178 - protein, 14 aa, Mycobacterium tuberculosis
LVANNTRLWVYCGN

SEQ ID NO: 117179 - protein, 14 aa, Mycobacterium tuberculosis
VANNTRLWVYCGNG

SEQ ID NO: 117180 - protein, 14 aa, Mycobacterium tuberculosis
ANNTRLWVYCGNGT

SEQ ID NO: 117181 - protein, 14 aa, Mycobacterium tuberculosis
NNTRLWVYCGNGTP

SEQ ID NO: 117182 - protein, 14 aa, Mycobacterium tuberculosis
NTRLWVYCGNGTPN

SEQ ID NO: 117183 - protein, 14 aa, Mycobacterium tuberculosis
TRLWVYCGNGTPNE

SEQ ID NO: 117184 - protein, 14 aa, Mycobacterium tuberculosis
RLWVYCGNGTPNEL

SEQ ID NO: 117185 - protein, 14 aa, Mycobacterium tuberculosis
LWVYCGNGTPNELG

SEQ ID NO: 117186 - protein, 14 aa, Mycobacterium tuberculosis
WVYCGNGTPNELGG

SEQ ID NO: 117187 - protein, 14 aa, Mycobacterium tuberculosis
VYCGNGTPNELGGA

SEQ ID NO: 117188 - protein, 14 aa, Mycobacterium tuberculosis
YCGNGTPNELGGAN

SEQ ID NO: 117189 - protein, 14 aa, Mycobacterium tuberculosis
CGNGTPNELGGANI

SEQ ID NO: 117190 - protein, 14 aa, Mycobacterium tuberculosis
GNGTPNELGGANIP

SEQ ID NO: 117191 - protein, 14 aa, Mycobacterium tuberculosis
NGTPNELGGANIPA

SEQ ID NO: 117192 - protein, 14 aa, Mycobacterium tuberculosis
GTPNELGGANIPAE

SEQ ID NO: 117193 - protein, 14 aa, Mycobacterium tuberculosis
TPNELGGANIPAEF

SEQ ID NO: 117194 - protein, 14 aa, Mycobacterium tuberculosis
PNELGGANIPAEFL

SEQ ID NO: 117195 - protein, 14 aa, Mycobacterium tuberculosis
NELGGANIPAEFLE

SEQ ID NO: 117196 - protein, 14 aa, Mycobacterium tuberculosis
ELGGANIPAEFLEN

SEQ ID NO: 117197 - protein, 14 aa, Mycobacterium tuberculosis
LGGANIPAEFLENF

SEQ ID NO: 117198 - protein, 14 aa, Mycobacterium tuberculosis
GGANIPAEFLENFV

SEQ ID NO: 117199 - protein, 14 aa, Mycobacterium tuberculosis
GANIPAEFLENFVR

SEQ ID NO: 117200 - protein, 14 aa, Mycobacterium tuberculosis
ANIPAEFLENFVRS

SEQ ID NO: 117201 - protein, 14 aa, Mycobacterium tuberculosis
NIPAEFLENFVRSS

SEQ ID NO: 117202 - protein, 14 aa, Mycobacterium tuberculosis
IPAEFLENFVRSSN

SEQ ID NO: 117203 - protein, 14 aa, Mycobacterium tuberculosis
PAEFLENFVRSSNL

SEQ ID NO: 117204 - protein, 14 aa, Mycobacterium tuberculosis
AEFLENFVRSSNLK

SEQ ID NO: 117205 - protein, 14 aa, Mycobacterium tuberculosis
EFLENFVRSSNLKF

SEQ ID NO: 117206 - protein, 14 aa, Mycobacterium tuberculosis
FLENFVRSSNLKFQ

SEQ ID NO: 117207 - protein, 14 aa, Mycobacterium tuberculosis
LENFVRSSNLKFQD

SEQ ID NO: 117208 - protein, 14 aa, Mycobacterium tuberculosis
ENFVRSSNLKFQDA

SEQ ID NO: 117209 - protein, 14 aa, Mycobacterium tuberculosis
NFVRSSNLKFQDAY

SEQ ID NO: 117210 - protein, 14 aa, Mycobacterium tuberculosis
FVRSSNLKFQDAYN

SEQ ID NO: 117211 - protein, 14 aa, Mycobacterium tuberculosis
VRSSNLKFQDAYNA

SEQ ID NO: 117212 - protein, 14 aa, Mycobacterium tuberculosis
RSSNLKFQDAYNAA

SEQ ID NO: 117213 - protein, 14 aa, Mycobacterium tuberculosis
SSNLKFQDAYNAAG

SEQ ID NO: 117214 - protein, 14 aa, Mycobacterium tuberculosis
SNLKFQDAYNAAGG

SEQ ID NO: 117215 - protein, 14 aa, Mycobacterium tuberculosis
NLKFQDAYNAAGGH

SEQ ID NO: 117216 - protein, 14 aa, Mycobacterium tuberculosis
LKFQDAYNAAGGHN

SEQ ID NO: 117217 - protein, 14 aa, Mycobacterium tuberculosis
KFQDAYNAAGGHNA

SEQ ID NO: 117218 - protein, 14 aa, Mycobacterium tuberculosis
FQDAYNAAGGHNAV

SEQ ID NO: 117219 - protein, 14 aa, Mycobacterium tuberculosis
QDAYNAAGGHNAVF

SEQ ID NO: 117220 - protein, 14 aa, Mycobacterium tuberculosis
DAYNAAGGHNAVFN

SEQ ID NO: 117221 - protein, 14 aa, Mycobacterium tuberculosis
AYNAAGGHNAVFNF

SEQ ID NO: 117222 - protein, 14 aa, Mycobacterium tuberculosis
YNAAGGHNAVFNFP

SEQ ID NO: 117223 - protein, 14 aa, Mycobacterium tuberculosis
NAAGGHNAVFNFPP

SEQ ID NO: 117224 - protein, 14 aa, Mycobacterium tuberculosis
AAGGHNAVFNFPPN

SEQ ID NO: 117225 - protein, 14 aa, Mycobacterium tuberculosis
AGGHNAVFNFPPNG

SEQ ID NO: 117226 - protein, 14 aa, Mycobacterium tuberculosis
GGHNAVFNFPPNGT

SEQ ID NO: 117227 - protein, 14 aa, Mycobacterium tuberculosis
GHNAVFNFPPNGTH

SEQ ID NO: 117228 - protein, 14 aa, Mycobacterium tuberculosis
HNAVFNFPPNGTHS

SEQ ID NO: 117229 - protein, 14 aa, Mycobacterium tuberculosis
NAVFNFPPNGTHSW

SEQ ID NO: 117230 - protein, 14 aa, Mycobacterium tuberculosis
AVFNFPPNGTHSWE

SEQ ID NO: 117231 - protein, 14 aa, Mycobacterium tuberculosis
VFNFPPNGTHSWEY

SEQ ID NO: 117232 - protein, 14 aa, Mycobacterium tuberculosis
FNFPPNGTHSWEYW

SEQ ID NO: 117233 - protein, 14 aa, Mycobacterium tuberculosis
NFPPNGTHSWEYWG

SEQ ID NO: 117234 - protein, 14 aa, Mycobacterium tuberculosis
FPPNGTHSWEYWGA

SEQ ID NO: 117235 - protein, 14 aa, Mycobacterium tuberculosis
PPNGTHSWEYWGAQ

SEQ ID NO: 117236 - protein, 14 aa, Mycobacterium tuberculosis
PNGTHSWEYWGAQL

SEQ ID NO: 117237 - protein, 14 aa, Mycobacterium tuberculosis
NGTHSWEYWGAQLN

SEQ ID NO: 117238 - protein, 14 aa, Mycobacterium tuberculosis
GTHSWEYWGAQLNA

SEQ ID NO: 117239 - protein, 14 aa, Mycobacterium tuberculosis
THSWEYWGAQLNAM

SEQ ID NO: 117240 - protein, 14 aa, Mycobacterium tuberculosis
HSWEYWGAQLNAMK

SEQ ID NO: 117241 - protein, 14 aa, Mycobacterium tuberculosis
SWEYWGAQLNAMKG

SEQ ID NO: 117242 - protein, 14 aa, Mycobacterium tuberculosis
WEYWGAQLNAMKGD

SEQ ID NO: 117243 - protein, 14 aa, Mycobacterium tuberculosis
EYWGAQLNAMKGDL

SEQ ID NO: 117244 - protein, 14 aa, Mycobacterium tuberculosis
YWGAQLNAMKGDLQ

SEQ ID NO: 117245 - protein, 14 aa, Mycobacterium tuberculosis
WGAQLNAMKGDLQS

SEQ ID NO: 117246 - protein, 14 aa, Mycobacterium tuberculosis
GAQLNAMKGDLQSS

SEQ ID NO: 117247 - protein, 14 aa, Mycobacterium tuberculosis
AQLNAMKGDLQSSL

SEQ ID NO: 117248 - protein, 14 aa, Mycobacterium tuberculosis
QLNAMKGDLQSSLG

SEQ ID NO: 117249 - protein, 14 aa, Mycobacterium tuberculosis
LNAMKGDLQSSLGA

SEQ ID NO: 117250 - protein, 14 aa, Mycobacterium tuberculosis
NAMKGDLQSSLGAG

SEQ ID NO: 117251 - protein, 15 aa, Mycobacterium tuberculosis
MTDVSRKIRAWGRRL

SEQ ID NO: 117252 - protein, 15 aa, Mycobacterium tuberculosis
TDVSRKIRAWGRRLM

SEQ ID NO: 117253 - protein, 15 aa, Mycobacterium tuberculosis
DVSRKIRAWGRRLMI

SEQ ID NO: 117254 - protein, 15 aa, Mycobacterium tuberculosis
VSRKIRAWGRRLMIG

SEQ ID NO: 117255 - protein, 15 aa, Mycobacterium tuberculosis
SRKIRAWGRRLMIGT

SEQ ID NO: 117256 - protein, 15 aa, Mycobacterium tuberculosis
RKIRAWGRRLMIGTA

SEQ ID NO: 117257 - protein, 15 aa, Mycobacterium tuberculosis
KIRAWGRRLMIGTAA

SEQ ID NO: 117258 - protein, 15 aa, Mycobacterium tuberculosis
IRAWGRRLMIGTAAA

SEQ ID NO: 117259 - protein, 15 aa, Mycobacterium tuberculosis
RAWGRRLMIGTAAAV

SEQ ID NO: 117260 - protein, 15 aa, Mycobacterium tuberculosis
AWGRRLMIGTAAAVV

SEQ ID NO: 117261 - protein, 15 aa, Mycobacterium tuberculosis
WGRRLMIGTAAAVVL

SEQ ID NO: 117262 - protein, 15 aa, Mycobacterium tuberculosis
GRRLMIGTAAAVVLP

SEQ ID NO: 117263 - protein, 15 aa, Mycobacterium tuberculosis
RRLMIGTAAAVVLPG

SEQ ID NO: 117264 - protein, 15 aa, Mycobacterium tuberculosis
RLMIGTAAAVVLPGL

SEQ ID NO: 117265 - protein, 15 aa, Mycobacterium tuberculosis
LMIGTAAAVVLPGLV

SEQ ID NO: 117266 - protein, 15 aa, Mycobacterium tuberculosis
MIGTAAAVVLPGLVG

SEQ ID NO: 117267 - protein, 15 aa, Mycobacterium tuberculosis
IGTAAAVVLPGLVGL

SEQ ID NO: 117268 - protein, 15 aa, Mycobacterium tuberculosis
GTAAAVVLPGLVGLA

SEQ ID NO: 117269 - protein, 15 aa, Mycobacterium tuberculosis
TAAAVVLPGLVGLAG

SEQ ID NO: 117270 - protein, 15 aa, Mycobacterium tuberculosis
AAAVVLPGLVGLAGG

SEQ ID NO: 117271 - protein, 15 aa, Mycobacterium tuberculosis
AAVVLPGLVGLAGGA

SEQ ID NO: 117272 - protein, 15 aa, Mycobacterium tuberculosis
AVVLPGLVGLAGGAA

SEQ ID NO: 117273 - protein, 15 aa, Mycobacterium tuberculosis
VVLPGLVGLAGGAAT

SEQ ID NO: 117274 - protein, 15 aa, Mycobacterium tuberculosis
VLPGLVGLAGGAATA

SEQ ID NO: 117275 - protein, 15 aa, Mycobacterium tuberculosis
LPGLVGLAGGAATAG

SEQ ID NO: 117276 - protein, 15 aa, Mycobacterium tuberculosis
PGLVGLAGGAATAGA

SEQ ID NO: 117277 - protein, 15 aa, Mycobacterium tuberculosis
GLVGLAGGAATAGAF

SEQ ID NO: 117278 - protein, 15 aa, Mycobacterium tuberculosis
LVGLAGGAATAGAFS

SEQ ID NO: 117279 - protein, 15 aa, Mycobacterium tuberculosis
VGLAGGAATAGAFSR

SEQ ID NO: 117280 - protein, 15 aa, Mycobacterium tuberculosis
GLAGGAATAGAFSRP

SEQ ID NO: 117281 - protein, 15 aa, Mycobacterium tuberculosis
LAGGAATAGAFSRPG

SEQ ID NO: 117282 - protein, 15 aa, Mycobacterium tuberculosis
AGGAATAGAFSRPGL

SEQ ID NO: 117283 - protein, 15 aa, Mycobacterium tuberculosis
GGAATAGAFSRPGLP

SEQ ID NO: 117284 - protein, 15 aa, Mycobacterium tuberculosis
GAATAGAFSRPGLPV

SEQ ID NO: 117285 - protein, 15 aa, Mycobacterium tuberculosis
AATAGAFSRPGLPVE

SEQ ID NO: 117286 - protein, 15 aa, Mycobacterium tuberculosis
ATAGAFSRPGLPVEY

SEQ ID NO: 117287 - protein, 15 aa, Mycobacterium tuberculosis
TAGAFSRPGLPVEYL

SEQ ID NO: 117288 - protein, 15 aa, Mycobacterium tuberculosis
AGAFSRPGLPVEYLQ

SEQ ID NO: 117289 - protein, 15 aa, Mycobacterium tuberculosis
GAFSRPGLPVEYLQV

SEQ ID NO: 117290 - protein, 15 aa, Mycobacterium tuberculosis
AFSRPGLPVEYLQVP

SEQ ID NO: 117291 - protein, 15 aa, Mycobacterium tuberculosis
FSRPGLPVEYLQVPS

SEQ ID NO: 117292 - protein, 15 aa, Mycobacterium tuberculosis
SRPGLPVEYLQVPSP

SEQ ID NO: 117293 - protein, 15 aa, Mycobacterium tuberculosis
RPGLPVEYLQVPSPS

SEQ ID NO: 117294 - protein, 15 aa, Mycobacterium tuberculosis
PGLPVEYLQVPSPSM

SEQ ID NO: 117295 - protein, 15 aa, Mycobacterium tuberculosis
GLPVEYLQVPSPSMG

SEQ ID NO: 117296 - protein, 15 aa, Mycobacterium tuberculosis
LPVEYLQVPSPSMGR

SEQ ID NO: 117297 - protein, 15 aa, Mycobacterium tuberculosis
PVEYLQVPSPSMGRD

SEQ ID NO: 117298 - protein, 15 aa, Mycobacterium tuberculosis
VEYLQVPSPSMGRDI

SEQ ID NO: 117299 - protein, 15 aa, Mycobacterium tuberculosis
EYLQVPSPSMGRDIK

SEQ ID NO: 117300 - protein, 15 aa, Mycobacterium tuberculosis
YLQVPSPSMGRDIKV

SEQ ID NO: 117301 - protein, 15 aa, Mycobacterium tuberculosis
LQVPSPSMGRDIKVQ

SEQ ID NO: 117302 - protein, 15 aa, Mycobacterium tuberculosis
QVPSPSMGRDIKVQF

SEQ ID NO: 117303 - protein, 15 aa, Mycobacterium tuberculosis
VPSPSMGRDIKVQFQ

SEQ ID NO: 117304 - protein, 15 aa, Mycobacterium tuberculosis
PSPSMGRDIKVQFQS

SEQ ID NO: 117305 - protein, 15 aa, Mycobacterium tuberculosis
SPSMGRDIKVQFQSG

SEQ ID NO: 117306 - protein, 15 aa, Mycobacterium tuberculosis
PSMGRDIKVQFQSGG

SEQ ID NO: 117307 - protein, 15 aa, Mycobacterium tuberculosis
SMGRDIKVQFQSGGN

SEQ ID NO: 117308 - protein, 15 aa, Mycobacterium tuberculosis
MGRDIKVQFQSGGNN

SEQ ID NO: 117309 - protein, 15 aa, Mycobacterium tuberculosis
GRDIKVQFQSGGNNS

SEQ ID NO: 117310 - protein, 15 aa, Mycobacterium tuberculosis
RDIKVQFQSGGNNSP

SEQ ID NO: 117311 - protein, 15 aa, Mycobacterium tuberculosis
DIKVQFQSGGNNSPA

SEQ ID NO: 117312 - protein, 15 aa, Mycobacterium tuberculosis
IKVQFQSGGNNSPAV

SEQ ID NO: 117313 - protein, 15 aa, Mycobacterium tuberculosis
KVQFQSGGNNSPAVY

SEQ ID NO: 117314 - protein, 15 aa, Mycobacterium tuberculosis
VQFQSGGNNSPAVYL

SEQ ID NO: 117315 - protein, 15 aa, Mycobacterium tuberculosis
QFQSGGNNSPAVYLL

SEQ ID NO: 117316 - protein, 15 aa, Mycobacterium tuberculosis
FQSGGNNSPAVYLLD

SEQ ID NO: 117317 - protein, 15 aa, Mycobacterium tuberculosis
QSGGNNSPAVYLLDG

SEQ ID NO: 117318 - protein, 15 aa, Mycobacterium tuberculosis
SGGNNSPAVYLLDGL

SEQ ID NO: 117319 - protein, 15 aa, Mycobacterium tuberculosis
GGNNSPAVYLLDGLR

SEQ ID NO: 117320 - protein, 15 aa, Mycobacterium tuberculosis
GNNSPAVYLLDGLRA

SEQ ID NO: 117321 - protein, 15 aa, Mycobacterium tuberculosis
NNSPAVYLLDGLRAQ

SEQ ID NO: 117322 - protein, 15 aa, Mycobacterium tuberculosis
NSPAVYLLDGLRAQD

SEQ ID NO: 117323 - protein, 15 aa, Mycobacterium tuberculosis
SPAVYLLDGLRAQDD

SEQ ID NO: 117324 - protein, 15 aa, Mycobacterium tuberculosis
PAVYLLDGLRAQDDY

SEQ ID NO: 117325 - protein, 15 aa, Mycobacterium tuberculosis
AVYLLDGLRAQDDYN

SEQ ID NO: 117326 - protein, 15 aa, Mycobacterium tuberculosis
VYLLDGLRAQDDYNG

SEQ ID NO: 117327 - protein, 15 aa, Mycobacterium tuberculosis
YLLDGLRAQDDYNGW

SEQ ID NO: 117328 - protein, 15 aa, Mycobacterium tuberculosis
LLDGLRAQDDYNGWD

SEQ ID NO: 117329 - protein, 15 aa, Mycobacterium tuberculosis
LDGLRAQDDYNGWDI

SEQ ID NO: 117330 - protein, 15 aa, Mycobacterium tuberculosis
DGLRAQDDYNGWDIN

SEQ ID NO: 117331 - protein, 15 aa, Mycobacterium tuberculosis
GLRAQDDYNGWDINT

SEQ ID NO: 117332 - protein, 15 aa, Mycobacterium tuberculosis
LRAQDDYNGWDINTP

SEQ ID NO: 117333 - protein, 15 aa, Mycobacterium tuberculosis
RAQDDYNGWDINTPA

SEQ ID NO: 117334 - protein, 15 aa, Mycobacterium tuberculosis
AQDDYNGWDINTPAF

SEQ ID NO: 117335 - protein, 15 aa, Mycobacterium tuberculosis
QDDYNGWDINTPAFE

SEQ ID NO: 117336 - protein, 15 aa, Mycobacterium tuberculosis
DDYNGWDINTPAFEW

SEQ ID NO: 117337 - protein, 15 aa, Mycobacterium tuberculosis
DYNGWDINTPAFEWY

SEQ ID NO: 117338 - protein, 15 aa, Mycobacterium tuberculosis
YNGWDINTPAFEWYY

SEQ ID NO: 117339 - protein, 15 aa, Mycobacterium tuberculosis
NGWDINTPAFEWYYQ

SEQ ID NO: 117340 - protein, 15 aa, Mycobacterium tuberculosis
GWDINTPAFEWYYQS

SEQ ID NO: 117341 - protein, 15 aa, Mycobacterium tuberculosis
WDINTPAFEWYYQSG

SEQ ID NO: 117342 - protein, 15 aa, Mycobacterium tuberculosis
DINTPAFEWYYQSGL

SEQ ID NO: 117343 - protein, 15 aa, Mycobacterium tuberculosis
INTPAFEWYYQSGLS

SEQ ID NO: 117344 - protein, 15 aa, Mycobacterium tuberculosis
NTPAFEWYYQSGLSI

SEQ ID NO: 117345 - protein, 15 aa, Mycobacterium tuberculosis
TPAFEWYYQSGLSIV

SEQ ID NO: 117346 - protein, 15 aa, Mycobacterium tuberculosis
PAFEWYYQSGLSIVM

SEQ ID NO: 117347 - protein, 15 aa, Mycobacterium tuberculosis
AFEWYYQSGLSIVMP

SEQ ID NO: 117348 - protein, 15 aa, Mycobacterium tuberculosis
FEWYYQSGLSIVMPV

SEQ ID NO: 117349 - protein, 15 aa, Mycobacterium tuberculosis
EWYYQSGLSIVMPVG

SEQ ID NO: 117350 - protein, 15 aa, Mycobacterium tuberculosis
WYYQSGLSIVMPVGG

SEQ ID NO: 117351 - protein, 15 aa, Mycobacterium tuberculosis
YYQSGLSIVMPVGGQ

SEQ ID NO: 117352 - protein, 15 aa, Mycobacterium tuberculosis
YQSGLSIVMPVGGQS

SEQ ID NO: 117353 - protein, 15 aa, Mycobacterium tuberculosis
QSGLSIVMPVGGQSS

SEQ ID NO: 117354 - protein, 15 aa, Mycobacterium tuberculosis
SGLSIVMPVGGQSSF

SEQ ID NO: 117355 - protein, 15 aa, Mycobacterium tuberculosis
GLSIVMPVGGQSSFY

SEQ ID NO: 117356 - protein, 15 aa, Mycobacterium tuberculosis
LSIVMPVGGQSSFYS

SEQ ID NO: 117357 - protein, 15 aa, Mycobacterium tuberculosis
SIVMPVGGQSSFYSD

SEQ ID NO: 117358 - protein, 15 aa, Mycobacterium tuberculosis
IVMPVGGQSSFYSDW

SEQ ID NO: 117359 - protein, 15 aa, Mycobacterium tuberculosis
VMPVGGQSSFYSDWY

SEQ ID NO: 117360 - protein, 15 aa, Mycobacterium tuberculosis
MPVGGQSSFYSDWYS

SEQ ID NO: 117361 - protein, 15 aa, Mycobacterium tuberculosis
PVGGQSSFYSDWYSP

SEQ ID NO: 117362 - protein, 15 aa, Mycobacterium tuberculosis
VGGQSSFYSDWYSPA

SEQ ID NO: 117363 - protein, 15 aa, Mycobacterium tuberculosis
GGQSSFYSDWYSPAC

SEQ ID NO: 117364 - protein, 15 aa, Mycobacterium tuberculosis
GQSSFYSDWYSPACG

SEQ ID NO: 117365 - protein, 15 aa, Mycobacterium tuberculosis
QSSFYSDWYSPACGK

SEQ ID NO: 117366 - protein, 15 aa, Mycobacterium tuberculosis
SSFYSDWYSPACGKA

SEQ ID NO: 117367 - protein, 15 aa, Mycobacterium tuberculosis
SFYSDWYSPACGKAG

SEQ ID NO: 117368 - protein, 15 aa, Mycobacterium tuberculosis
FYSDWYSPACGKAGC

SEQ ID NO: 117369 - protein, 15 aa, Mycobacterium tuberculosis
YSDWYSPACGKAGCQ

SEQ ID NO: 117370 - protein, 15 aa, Mycobacterium tuberculosis
SDWYSPACGKAGCQT

SEQ ID NO: 117371 - protein, 15 aa, Mycobacterium tuberculosis
DWYSPACGKAGCQTY

SEQ ID NO: 117372 - protein, 15 aa, Mycobacterium tuberculosis
WYSPACGKAGCQTYK

SEQ ID NO: 117373 - protein, 15 aa, Mycobacterium tuberculosis
YSPACGKAGCQTYKW

SEQ ID NO: 117374 - protein, 15 aa, Mycobacterium tuberculosis
SPACGKAGCQTYKWE

SEQ ID NO: 117375 - protein, 15 aa, Mycobacterium tuberculosis
PACGKAGCQTYKWET

SEQ ID NO: 117376 - protein, 15 aa, Mycobacterium tuberculosis
ACGKAGCQTYKWETF

SEQ ID NO: 117377 - protein, 15 aa, Mycobacterium tuberculosis
CGKAGCQTYKWETFL

SEQ ID NO: 117378 - protein, 15 aa, Mycobacterium tuberculosis
GKAGCQTYKWETFLT

SEQ ID NO: 117379 - protein, 15 aa, Mycobacterium tuberculosis
KAGCQTYKWETFLTS

SEQ ID NO: 117380 - protein, 15 aa, Mycobacterium tuberculosis
AGCQTYKWETFLTSE

SEQ ID NO: 117381 - protein, 15 aa, Mycobacterium tuberculosis
GCQTYKWETFLTSEL

SEQ ID NO: 117382 - protein, 15 aa, Mycobacterium tuberculosis
CQTYKWETFLTSELP

SEQ ID NO: 117383 - protein, 15 aa, Mycobacterium tuberculosis
QTYKWETFLTSELPQ

SEQ ID NO: 117384 - protein, 15 aa, Mycobacterium tuberculosis
TYKWETFLTSELPQW

SEQ ID NO: 117385 - protein, 15 aa, Mycobacterium tuberculosis
YKWETFLTSELPQWL

SEQ ID NO: 117386 - protein, 15 aa, Mycobacterium tuberculosis
KWETFLTSELPQWLS

SEQ ID NO: 117387 - protein, 15 aa, Mycobacterium tuberculosis
WETFLTSELPQWLSA

SEQ ID NO: 117388 - protein, 15 aa, Mycobacterium tuberculosis
ETFLTSELPQWLSAN

SEQ ID NO: 117389 - protein, 15 aa, Mycobacterium tuberculosis
TFLTSELPQWLSANR

SEQ ID NO: 117390 - protein, 15 aa, Mycobacterium tuberculosis
FLTSELPQWLSANRA

SEQ ID NO: 117391 - protein, 15 aa, Mycobacterium tuberculosis
LTSELPQWLSANRAV

SEQ ID NO: 117392 - protein, 15 aa, Mycobacterium tuberculosis
TSELPQWLSANRAVK

SEQ ID NO: 117393 - protein, 15 aa, Mycobacterium tuberculosis
SELPQWLSANRAVKP

SEQ ID NO: 117394 - protein, 15 aa, Mycobacterium tuberculosis
ELPQWLSANRAVKPT

SEQ ID NO: 117395 - protein, 15 aa, Mycobacterium tuberculosis
LPQWLSANRAVKPTG

SEQ ID NO: 117396 - protein, 15 aa, Mycobacterium tuberculosis
PQWLSANRAVKPTGS

SEQ ID NO: 117397 - protein, 15 aa, Mycobacterium tuberculosis
QWLSANRAVKPTGSA

SEQ ID NO: 117398 - protein, 15 aa, Mycobacterium tuberculosis
WLSANRAVKPTGSAA

SEQ ID NO: 117399 - protein, 15 aa, Mycobacterium tuberculosis
LSANRAVKPTGSAAI

SEQ ID NO: 117400 - protein, 15 aa, Mycobacterium tuberculosis
SANRAVKPTGSAAIG

SEQ ID NO: 117401 - protein, 15 aa, Mycobacterium tuberculosis
ANRAVKPTGSAAIGL

SEQ ID NO: 117402 - protein, 15 aa, Mycobacterium tuberculosis
NRAVKPTGSAAIGLS

SEQ ID NO: 117403 - protein, 15 aa, Mycobacterium tuberculosis
RAVKPTGSAAIGLSM

SEQ ID NO: 117404 - protein, 15 aa, Mycobacterium tuberculosis
AVKPTGSAAIGLSMA

SEQ ID NO: 117405 - protein, 15 aa, Mycobacterium tuberculosis
VKPTGSAAIGLSMAG

SEQ ID NO: 117406 - protein, 15 aa, Mycobacterium tuberculosis
KPTGSAAIGLSMAGS

SEQ ID NO: 117407 - protein, 15 aa, Mycobacterium tuberculosis
PTGSAAIGLSMAGSS

SEQ ID NO: 117408 - protein, 15 aa, Mycobacterium tuberculosis
TGSAAIGLSMAGSSA

SEQ ID NO: 117409 - protein, 15 aa, Mycobacterium tuberculosis
GSAAIGLSMAGSSAM

SEQ ID NO: 117410 - protein, 15 aa, Mycobacterium tuberculosis
SAAIGLSMAGSSAMI

SEQ ID NO: 117411 - protein, 15 aa, Mycobacterium tuberculosis
AAIGLSMAGSSAMIL

SEQ ID NO: 117412 - protein, 15 aa, Mycobacterium tuberculosis
AIGLSMAGSSAMILA

SEQ ID NO: 117413 - protein, 15 aa, Mycobacterium tuberculosis
IGLSMAGSSAMILAA

SEQ ID NO: 117414 - protein, 15 aa, Mycobacterium tuberculosis
GLSMAGSSAMILAAY

SEQ ID NO: 117415 - protein, 15 aa, Mycobacterium tuberculosis
LSMAGSSAMILAAYH

SEQ ID NO: 117416 - protein, 15 aa, Mycobacterium tuberculosis
SMAGSSAMILAAYHP

SEQ ID NO: 117417 - protein, 15 aa, Mycobacterium tuberculosis
MAGSSAMILAAYHPQ

SEQ ID NO: 117418 - protein, 15 aa, Mycobacterium tuberculosis
AGSSAMILAAYHPQQ

SEQ ID NO: 117419 - protein, 15 aa, Mycobacterium tuberculosis
GSSAMILAAYHPQQF

SEQ ID NO: 117420 - protein, 15 aa, Mycobacterium tuberculosis
SSAMILAAYHPQQFI

SEQ ID NO: 117421 - protein, 15 aa, Mycobacterium tuberculosis
SAMILAAYHPQQFIY

SEQ ID NO: 117422 - protein, 15 aa, Mycobacterium tuberculosis
AMILAAYHPQQFIYA

SEQ ID NO: 117423 - protein, 15 aa, Mycobacterium tuberculosis
MILAAYHPQQFIYAG

SEQ ID NO: 117424 - protein, 15 aa, Mycobacterium tuberculosis
ILAAYHPQQFIYAGS

SEQ ID NO: 117425 - protein, 15 aa, Mycobacterium tuberculosis
LAAYHPQQFIYAGSL

SEQ ID NO: 117426 - protein, 15 aa, Mycobacterium tuberculosis
AAYHPQQFIYAGSLS

SEQ ID NO: 117427 - protein, 15 aa, Mycobacterium tuberculosis
AYHPQQFIYAGSLSA

SEQ ID NO: 117428 - protein, 15 aa, Mycobacterium tuberculosis
YHPQQFIYAGSLSAL

SEQ ID NO: 117429 - protein, 15 aa, Mycobacterium tuberculosis
HPQQFIYAGSLSALL

SEQ ID NO: 117430 - protein, 15 aa, Mycobacterium tuberculosis
PQQFIYAGSLSALLD

SEQ ID NO: 117431 - protein, 15 aa, Mycobacterium tuberculosis
QQFIYAGSLSALLDP

SEQ ID NO: 117432 - protein, 15 aa, Mycobacterium tuberculosis
QFIYAGSLSALLDPS

SEQ ID NO: 117433 - protein, 15 aa, Mycobacterium tuberculosis
FIYAGSLSALLDPSQ

SEQ ID NO: 117434 - protein, 15 aa, Mycobacterium tuberculosis
IYAGSLSALLDPSQG

SEQ ID NO: 117435 - protein, 15 aa, Mycobacterium tuberculosis
YAGSLSALLDPSQGM

SEQ ID NO: 117436 - protein, 15 aa, Mycobacterium tuberculosis
AGSLSALLDPSQGMG

SEQ ID NO: 117437 - protein, 15 aa, Mycobacterium tuberculosis
GSLSALLDPSQGMGP

SEQ ID NO: 117438 - protein, 15 aa, Mycobacterium tuberculosis
SLSALLDPSQGMGPS

SEQ ID NO: 117439 - protein, 15 aa, Mycobacterium tuberculosis
LSALLDPSQGMGPSL

SEQ ID NO: 117440 - protein, 15 aa, Mycobacterium tuberculosis
SALLDPSQGMGPSLI

SEQ ID NO: 117441 - protein, 15 aa, Mycobacterium tuberculosis
ALLDPSQGMGPSLIG

SEQ ID NO: 117442 - protein, 15 aa, Mycobacterium tuberculosis
LLDPSQGMGPSLIGL

SEQ ID NO: 117443 - protein, 15 aa, Mycobacterium tuberculosis
LDPSQGMGPSLIGLA

SEQ ID NO: 117444 - protein, 15 aa, Mycobacterium tuberculosis
DPSQGMGPSLIGLAM

SEQ ID NO: 117445 - protein, 15 aa, Mycobacterium tuberculosis
PSQGMGPSLIGLAMG

SEQ ID NO: 117446 - protein, 15 aa, Mycobacterium tuberculosis
SQGMGPSLIGLAMGD

SEQ ID NO: 117447 - protein, 15 aa, Mycobacterium tuberculosis
QGMGPSLIGLAMGDA

SEQ ID NO: 117448 - protein, 15 aa, Mycobacterium tuberculosis
GMGPSLIGLAMGDAG

SEQ ID NO: 117449 - protein, 15 aa, Mycobacterium tuberculosis
MGPSLIGLAMGDAGG

SEQ ID NO: 117450 - protein, 15 aa, Mycobacterium tuberculosis
GPSLIGLAMGDAGGY

SEQ ID NO: 117451 - protein, 15 aa, Mycobacterium tuberculosis
PSLIGLAMGDAGGYK

SEQ ID NO: 117452 - protein, 15 aa, Mycobacterium tuberculosis
SLIGLAMGDAGGYKA

SEQ ID NO: 117453 - protein, 15 aa, Mycobacterium tuberculosis
LIGLAMGDAGGYKAA

SEQ ID NO: 117454 - protein, 15 aa, Mycobacterium tuberculosis
IGLAMGDAGGYKAAD

SEQ ID NO: 117455 - protein, 15 aa, Mycobacterium tuberculosis
GLAMGDAGGYKAADM

SEQ ID NO: 117456 - protein, 15 aa, Mycobacterium tuberculosis
LAMGDAGGYKAADMW

SEQ ID NO: 117457 - protein, 15 aa, Mycobacterium tuberculosis
AMGDAGGYKAADMWG

SEQ ID NO: 117458 - protein, 15 aa, Mycobacterium tuberculosis
MGDAGGYKAADMWGP

SEQ ID NO: 117459 - protein, 15 aa, Mycobacterium tuberculosis
GDAGGYKAADMWGPS

SEQ ID NO: 117460 - protein, 15 aa, Mycobacterium tuberculosis
DAGGYKAADMWGPSS

SEQ ID NO: 117461 - protein, 15 aa, Mycobacterium tuberculosis
AGGYKAADMWGPSSD

SEQ ID NO: 117462 - protein, 15 aa, Mycobacterium tuberculosis
GGYKAADMWGPSSDP

SEQ ID NO: 117463 - protein, 15 aa, Mycobacterium tuberculosis
GYKAADMWGPSSDPA

SEQ ID NO: 117464 - protein, 15 aa, Mycobacterium tuberculosis
YKAADMWGPSSDPAW

SEQ ID NO: 117465 - protein, 15 aa, Mycobacterium tuberculosis
KAADMWGPSSDPAWE

SEQ ID NO: 117466 - protein, 15 aa, Mycobacterium tuberculosis
AADMWGPSSDPAWER

SEQ ID NO: 117467 - protein, 15 aa, Mycobacterium tuberculosis
ADMWGPSSDPAWERN

SEQ ID NO: 117468 - protein, 15 aa, Mycobacterium tuberculosis
DMWGPSSDPAWERND

SEQ ID NO: 117469 - protein, 15 aa, Mycobacterium tuberculosis
MWGPSSDPAWERNDP

SEQ ID NO: 117470 - protein, 15 aa, Mycobacterium tuberculosis
WGPSSDPAWERNDPT

SEQ ID NO: 117471 - protein, 15 aa, Mycobacterium tuberculosis
GPSSDPAWERNDPTQ

SEQ ID NO: 117472 - protein, 15 aa, Mycobacterium tuberculosis
PSSDPAWERNDPTQQ

SEQ ID NO: 117473 - protein, 15 aa, Mycobacterium tuberculosis
SSDPAWERNDPTQQI

SEQ ID NO: 117474 - protein, 15 aa, Mycobacterium tuberculosis
SDPAWERNDPTQQIP

SEQ ID NO: 117475 - protein, 15 aa, Mycobacterium tuberculosis
DPAWERNDPTQQIPK

SEQ ID NO: 117476 - protein, 15 aa, Mycobacterium tuberculosis
PAWERNDPTQQIPKL

SEQ ID NO: 117477 - protein, 15 aa, Mycobacterium tuberculosis
AWERNDPTQQIPKLV

SEQ ID NO: 117478 - protein, 15 aa, Mycobacterium tuberculosis
WERNDPTQQIPKLVA

SEQ ID NO: 117479 - protein, 15 aa, Mycobacterium tuberculosis
ERNDPTQQIPKLVAN

SEQ ID NO: 117480 - protein, 15 aa, Mycobacterium tuberculosis
RNDPTQQIPKLVANN

SEQ ID NO: 117481 - protein, 15 aa, Mycobacterium tuberculosis
NDPTQQIPKLVANNT

SEQ ID NO: 117482 - protein, 15 aa, Mycobacterium tuberculosis
DPTQQIPKLVANNTR

SEQ ID NO: 117483 - protein, 15 aa, Mycobacterium tuberculosis
PTQQIPKLVANNTRL

SEQ ID NO: 117484 - protein, 15 aa, Mycobacterium tuberculosis
TQQIPKLVANNTRLW

SEQ ID NO: 117485 - protein, 15 aa, Mycobacterium tuberculosis
QQIPKLVANNTRLWV

SEQ ID NO: 117486 - protein, 15 aa, Mycobacterium tuberculosis
QIPKLVANNTRLWVY

SEQ ID NO: 117487 - protein, 15 aa, Mycobacterium tuberculosis
IPKLVANNTRLWVYC

SEQ ID NO: 117488 - protein, 15 aa, Mycobacterium tuberculosis
PKLVANNTRLWVYCG

SEQ ID NO: 117489 - protein, 15 aa, Mycobacterium tuberculosis
KLVANNTRLWVYCGN

SEQ ID NO: 117490 - protein, 15 aa, Mycobacterium tuberculosis
LVANNTRLWVYCGNG

SEQ ID NO: 117491 - protein, 15 aa, Mycobacterium tuberculosis
VANNTRLWVYCGNGT

SEQ ID NO: 117492 - protein, 15 aa, Mycobacterium tuberculosis
ANNTRLWVYCGNGTP

SEQ ID NO: 117493 - protein, 15 aa, Mycobacterium tuberculosis
NNTRLWVYCGNGTPN

SEQ ID NO: 117494 - protein, 15 aa, Mycobacterium tuberculosis
NTRLWVYCGNGTPNE

SEQ ID NO: 117495 - protein, 15 aa, Mycobacterium tuberculosis
TRLWVYCGNGTPNEL

SEQ ID NO: 117496 - protein, 15 aa, Mycobacterium tuberculosis
RLWVYCGNGTPNELG

SEQ ID NO: 117497 - protein, 15 aa, Mycobacterium tuberculosis
LWVYCGNGTPNELGG

SEQ ID NO: 117498 - protein, 15 aa, Mycobacterium tuberculosis
WVYCGNGTPNELGGA

SEQ ID NO: 117499 - protein, 15 aa, Mycobacterium tuberculosis
VYCGNGTPNELGGAN

SEQ ID NO: 117500 - protein, 15 aa, Mycobacterium tuberculosis
YCGNGTPNELGGANI

SEQ ID NO: 117501 - protein, 15 aa, Mycobacterium tuberculosis
CGNGTPNELGGANIP

SEQ ID NO: 117502 - protein, 15 aa, Mycobacterium tuberculosis
GNGTPNELGGANIPA

SEQ ID NO: 117503 - protein, 15 aa, Mycobacterium tuberculosis
NGTPNELGGANIPAE

SEQ ID NO: 117504 - protein, 15 aa, Mycobacterium tuberculosis
GTPNELGGANIPAEF

SEQ ID NO: 117505 - protein, 15 aa, Mycobacterium tuberculosis
TPNELGGANIPAEFL

SEQ ID NO: 117506 - protein, 15 aa, Mycobacterium tuberculosis
PNELGGANIPAEFLE

SEQ ID NO: 117507 - protein, 15 aa, Mycobacterium tuberculosis
NELGGANIPAEFLEN

SEQ ID NO: 117508 - protein, 15 aa, Mycobacterium tuberculosis
ELGGANIPAEFLENF

SEQ ID NO: 117509 - protein, 15 aa, Mycobacterium tuberculosis
LGGANIPAEFLENFV

SEQ ID NO: 117510 - protein, 15 aa, Mycobacterium tuberculosis
GGANIPAEFLENFVR

SEQ ID NO: 117511 - protein, 15 aa, Mycobacterium tuberculosis
GANIPAEFLENFVRS

SEQ ID NO: 117512 - protein, 15 aa, Mycobacterium tuberculosis
ANIPAEFLENFVRSS

SEQ ID NO: 117513 - protein, 15 aa, Mycobacterium tuberculosis
NIPAEFLENFVRSSN

SEQ ID NO: 117514 - protein, 15 aa, Mycobacterium tuberculosis
IPAEFLENFVRSSNL

SEQ ID NO: 117515 - protein, 15 aa, Mycobacterium tuberculosis
PAEFLENFVRSSNLK

SEQ ID NO: 117516 - protein, 15 aa, Mycobacterium tuberculosis
AEFLENFVRSSNLKF

SEQ ID NO: 117517 - protein, 15 aa, Mycobacterium tuberculosis
EFLENFVRSSNLKFQ

SEQ ID NO: 117518 - protein, 15 aa, Mycobacterium tuberculosis
FLENFVRSSNLKFQD

SEQ ID NO: 117519 - protein, 15 aa, Mycobacterium tuberculosis
LENFVRSSNLKFQDA

SEQ ID NO: 117520 - protein, 15 aa, Mycobacterium tuberculosis
ENFVRSSNLKFQDAY

SEQ ID NO: 117521 - protein, 15 aa, Mycobacterium tuberculosis
NFVRSSNLKFQDAYN

SEQ ID NO: 117522 - protein, 15 aa, Mycobacterium tuberculosis
FVRSSNLKFQDAYNA

SEQ ID NO: 117523 - protein, 15 aa, Mycobacterium tuberculosis
VRSSNLKFQDAYNAA

SEQ ID NO: 117524 - protein, 15 aa, Mycobacterium tuberculosis
RSSNLKFQDAYNAAG

SEQ ID NO: 117525 - protein, 15 aa, Mycobacterium tuberculosis
SSNLKFQDAYNAAGG

SEQ ID NO: 117526 - protein, 15 aa, Mycobacterium tuberculosis
SNLKFQDAYNAAGGH

SEQ ID NO: 117527 - protein, 15 aa, Mycobacterium tuberculosis
NLKFQDAYNAAGGHN

SEQ ID NO: 117528 - protein, 15 aa, Mycobacterium tuberculosis
LKFQDAYNAAGGHNA

SEQ ID NO: 117529 - protein, 15 aa, Mycobacterium tuberculosis
KFQDAYNAAGGHNAV

SEQ ID NO: 117530 - protein, 15 aa, Mycobacterium tuberculosis
FQDAYNAAGGHNAVF

SEQ ID NO: 117531 - protein, 15 aa, Mycobacterium tuberculosis
QDAYNAAGGHNAVFN

SEQ ID NO: 117532 - protein, 15 aa, Mycobacterium tuberculosis
DAYNAAGGHNAVFNF

SEQ ID NO: 117533 - protein, 15 aa, Mycobacterium tuberculosis
AYNAAGGHNAVFNFP

SEQ ID NO: 117534 - protein, 15 aa, Mycobacterium tuberculosis
YNAAGGHNAVFNFPP

SEQ ID NO: 117535 - protein, 15 aa, Mycobacterium tuberculosis
NAAGGHNAVFNFPPN

SEQ ID NO: 117536 - protein, 15 aa, Mycobacterium tuberculosis
AAGGHNAVFNFPPNG

SEQ ID NO: 117537 - protein, 15 aa, Mycobacterium tuberculosis
AGGHNAVFNFPPNGT

SEQ ID NO: 117538 - protein, 15 aa, Mycobacterium tuberculosis
GGHNAVFNFPPNGTH

SEQ ID NO: 117539 - protein, 15 aa, Mycobacterium tuberculosis
GHNAVFNFPPNGTHS

SEQ ID NO: 117540 - protein, 15 aa, Mycobacterium tuberculosis
HNAVFNFPPNGTHSW

SEQ ID NO: 117541 - protein, 15 aa, Mycobacterium tuberculosis
NAVFNFPPNGTHSWE

SEQ ID NO: 117542 - protein, 15 aa, Mycobacterium tuberculosis
AVFNFPPNGTHSWEY

SEQ ID NO: 117543 - protein, 15 aa, Mycobacterium tuberculosis
VFNFPPNGTHSWEYW

SEQ ID NO: 117544 - protein, 15 aa, Mycobacterium tuberculosis
FNFPPNGTHSWEYWG

SEQ ID NO: 117545 - protein, 15 aa, Mycobacterium tuberculosis
NFPPNGTHSWEYWGA

SEQ ID NO: 117546 - protein, 15 aa, Mycobacterium tuberculosis
FPPNGTHSWEYWGAQ

SEQ ID NO: 117547 - protein, 15 aa, Mycobacterium tuberculosis
PPNGTHSWEYWGAQL

SEQ ID NO: 117548 - protein, 15 aa, Mycobacterium tuberculosis
PNGTHSWEYWGAQLN

SEQ ID NO: 117549 - protein, 15 aa, Mycobacterium tuberculosis
NGTHSWEYWGAQLNA

SEQ ID NO: 117550 - protein, 15 aa, Mycobacterium tuberculosis
GTHSWEYWGAQLNAM

SEQ ID NO: 117551 - protein, 15 aa, Mycobacterium tuberculosis
THSWEYWGAQLNAMK

SEQ ID NO: 117552 - protein, 15 aa, Mycobacterium tuberculosis
HSWEYWGAQLNAMKG

SEQ ID NO: 117553 - protein, 15 aa, Mycobacterium tuberculosis
SWEYWGAQLNAMKGD

SEQ ID NO: 117554 - protein, 15 aa, Mycobacterium tuberculosis
WEYWGAQLNAMKGDL

SEQ ID NO: 117555 - protein, 15 aa, Mycobacterium tuberculosis
EYWGAQLNAMKGDLQ

SEQ ID NO: 117556 - protein, 15 aa, Mycobacterium tuberculosis
YWGAQLNAMKGDLQS

SEQ ID NO: 117557 - protein, 15 aa, Mycobacterium tuberculosis
WGAQLNAMKGDLQSS

SEQ ID NO: 117558 - protein, 15 aa, Mycobacterium tuberculosis
GAQLNAMKGDLQSSL

SEQ ID NO: 117559 - protein, 15 aa, Mycobacterium tuberculosis
AQLNAMKGDLQSSLG

SEQ ID NO: 117560 - protein, 15 aa, Mycobacterium tuberculosis
QLNAMKGDLQSSLGA

SEQ ID NO: 117561 - protein, 15 aa, Mycobacterium tuberculosis
LNAMKGDLQSSLGAG

SEQ ID NO: 117562 - protein, 16 aa, Mycobacterium tuberculosis
MTDVSRKIRAWGRRLM

SEQ ID NO: 117563 - protein, 16 aa, Mycobacterium tuberculosis
TDVSRKIRAWGRRLMI

SEQ ID NO: 117564 - protein, 16 aa, Mycobacterium tuberculosis
DVSRKIRAWGRRLMIG

SEQ ID NO: 117565 - protein, 16 aa, Mycobacterium tuberculosis
VSRKIRAWGRRLMIGT

SEQ ID NO: 117566 - protein, 16 aa, Mycobacterium tuberculosis
SRKIRAWGRRLMIGTA

SEQ ID NO: 117567 - protein, 16 aa, Mycobacterium tuberculosis
RKIRAWGRRLMIGTAA

SEQ ID NO: 117568 - protein, 16 aa, Mycobacterium tuberculosis
KIRAWGRRLMIGTAAA

SEQ ID NO: 117569 - protein, 16 aa, Mycobacterium tuberculosis
IRAWGRRLMIGTAAAV

SEQ ID NO: 117570 - protein, 16 aa, Mycobacterium tuberculosis
RAWGRRLMIGTAAAVV

SEQ ID NO: 117571 - protein, 16 aa, Mycobacterium tuberculosis
AWGRRLMIGTAAAVVL

SEQ ID NO: 117572 - protein, 16 aa, Mycobacterium tuberculosis
WGRRLMIGTAAAVVLP

SEQ ID NO: 117573 - protein, 16 aa, Mycobacterium tuberculosis
GRRLMIGTAAAVVLPG

SEQ ID NO: 117574 - protein, 16 aa, Mycobacterium tuberculosis
RRLMIGTAAAVVLPGL

SEQ ID NO: 117575 - protein, 16 aa, Mycobacterium tuberculosis
RLMIGTAAAVVLPGLV

SEQ ID NO: 117576 - protein, 16 aa, Mycobacterium tuberculosis
LMIGTAAAVVLPGLVG

SEQ ID NO: 117577 - protein, 16 aa, Mycobacterium tuberculosis
MIGTAAAVVLPGLVGL

SEQ ID NO: 117578 - protein, 16 aa, Mycobacterium tuberculosis
IGTAAAVVLPGLVGLA

SEQ ID NO: 117579 - protein, 16 aa, Mycobacterium tuberculosis
GTAAAVVLPGLVGLAG

SEQ ID NO: 117580 - protein, 16 aa, Mycobacterium tuberculosis
TAAAVVLPGLVGLAGG

SEQ ID NO: 117581 - protein, 16 aa, Mycobacterium tuberculosis
AAAVVLPGLVGLAGGA

SEQ ID NO: 117582 - protein, 16 aa, Mycobacterium tuberculosis
AAVVLPGLVGLAGGAA

SEQ ID NO: 117583 - protein, 16 aa, Mycobacterium tuberculosis
AVVLPGLVGLAGGAAT

SEQ ID NO: 117584 - protein, 16 aa, Mycobacterium tuberculosis
VVLPGLVGLAGGAATA

SEQ ID NO: 117585 - protein, 16 aa, Mycobacterium tuberculosis
VLPGLVGLAGGAATAG

SEQ ID NO: 117586 - protein, 16 aa, Mycobacterium tuberculosis
LPGLVGLAGGAATAGA

SEQ ID NO: 117587 - protein, 16 aa, Mycobacterium tuberculosis
PGLVGLAGGAATAGAF

SEQ ID NO: 117588 - protein, 16 aa, Mycobacterium tuberculosis
GLVGLAGGAATAGAFS

SEQ ID NO: 117589 - protein, 16 aa, Mycobacterium tuberculosis
LVGLAGGAATAGAFSR

SEQ ID NO: 117590 - protein, 16 aa, Mycobacterium tuberculosis
VGLAGGAATAGAFSRP

SEQ ID NO: 117591 - protein, 16 aa, Mycobacterium tuberculosis
GLAGGAATAGAFSRPG

SEQ ID NO: 117592 - protein, 16 aa, Mycobacterium tuberculosis
LAGGAATAGAFSRPGL

SEQ ID NO: 117593 - protein, 16 aa, Mycobacterium tuberculosis
AGGAATAGAFSRPGLP

SEQ ID NO: 117594 - protein, 16 aa, Mycobacterium tuberculosis
GGAATAGAFSRPGLPV

SEQ ID NO: 117595 - protein, 16 aa, Mycobacterium tuberculosis
GAATAGAFSRPGLPVE

SEQ ID NO: 117596 - protein, 16 aa, Mycobacterium tuberculosis
AATAGAFSRPGLPVEY

SEQ ID NO: 117597 - protein, 16 aa, Mycobacterium tuberculosis
ATAGAFSRPGLPVEYL

SEQ ID NO: 117598 - protein, 16 aa, Mycobacterium tuberculosis
TAGAFSRPGLPVEYLQ

SEQ ID NO: 117599 - protein, 16 aa, Mycobacterium tuberculosis
AGAFSRPGLPVEYLQV

SEQ ID NO: 117600 - protein, 16 aa, Mycobacterium tuberculosis
GAFSRPGLPVEYLQVP

SEQ ID NO: 117601 - protein, 16 aa, Mycobacterium tuberculosis
AFSRPGLPVEYLQVPS

SEQ ID NO: 117602 - protein, 16 aa, Mycobacterium tuberculosis
FSRPGLPVEYLQVPSP

SEQ ID NO: 117603 - protein, 16 aa, Mycobacterium tuberculosis
SRPGLPVEYLQVPSPS

SEQ ID NO: 117604 - protein, 16 aa, Mycobacterium tuberculosis
RPGLPVEYLQVPSPSM

SEQ ID NO: 117605 - protein, 16 aa, Mycobacterium tuberculosis
PGLPVEYLQVPSPSMG

SEQ ID NO: 117606 - protein, 16 aa, Mycobacterium tuberculosis
GLPVEYLQVPSPSMGR

SEQ ID NO: 117607 - protein, 16 aa, Mycobacterium tuberculosis
LPVEYLQVPSPSMGRD

SEQ ID NO: 117608 - protein, 16 aa, Mycobacterium tuberculosis
PVEYLQVPSPSMGRDI

SEQ ID NO: 117609 - protein, 16 aa, Mycobacterium tuberculosis
VEYLQVPSPSMGRDIK

SEQ ID NO: 117610 - protein, 16 aa, Mycobacterium tuberculosis
EYLQVPSPSMGRDIKV

SEQ ID NO: 117611 - protein, 16 aa, Mycobacterium tuberculosis
YLQVPSPSMGRDIKVQ

SEQ ID NO: 117612 - protein, 16 aa, Mycobacterium tuberculosis
LQVPSPSMGRDIKVQF

SEQ ID NO: 117613 - protein, 16 aa, Mycobacterium tuberculosis
QVPSPSMGRDIKVQFQ

SEQ ID NO: 117614 - protein, 16 aa, Mycobacterium tuberculosis
VPSPSMGRDIKVQFQS

SEQ ID NO: 117615 - protein, 16 aa, Mycobacterium tuberculosis
PSPSMGRDIKVQFQSG

SEQ ID NO: 117616 - protein, 16 aa, Mycobacterium tuberculosis
SPSMGRDIKVQFQSGG

SEQ ID NO: 117617 - protein, 16 aa, Mycobacterium tuberculosis
PSMGRDIKVQFQSGGN

SEQ ID NO: 117618 - protein, 16 aa, Mycobacterium tuberculosis
SMGRDIKVQFQSGGNN

SEQ ID NO: 117619 - protein, 16 aa, Mycobacterium tuberculosis
MGRDIKVQFQSGGNNS

SEQ ID NO: 117620 - protein, 16 aa, Mycobacterium tuberculosis
GRDIKVQFQSGGNNSP

SEQ ID NO: 117621 - protein, 16 aa, Mycobacterium tuberculosis
RDIKVQFQSGGNNSPA

SEQ ID NO: 117622 - protein, 16 aa, Mycobacterium tuberculosis
DIKVQFQSGGNNSPAV

SEQ ID NO: 117623 - protein, 16 aa, Mycobacterium tuberculosis
IKVQFQSGGNNSPAVY

SEQ ID NO: 117624 - protein, 16 aa, Mycobacterium tuberculosis
KVQFQSGGNNSPAVYL

SEQ ID NO: 117625 - protein, 16 aa, Mycobacterium tuberculosis
VQFQSGGNNSPAVYLL

SEQ ID NO: 117626 - protein, 16 aa, Mycobacterium tuberculosis
QFQSGGNNSPAVYLLD

SEQ ID NO: 117627 - protein, 16 aa, Mycobacterium tuberculosis
FQSGGNNSPAVYLLDG

SEQ ID NO: 117628 - protein, 16 aa, Mycobacterium tuberculosis
QSGGNNSPAVYLLDGL

SEQ ID NO: 117629 - protein, 16 aa, Mycobacterium tuberculosis
SGGNNSPAVYLLDGLR

SEQ ID NO: 117630 - protein, 16 aa, Mycobacterium tuberculosis
GGNNSPAVYLLDGLRA

SEQ ID NO: 117631 - protein, 16 aa, Mycobacterium tuberculosis
GNNSPAVYLLDGLRAQ

SEQ ID NO: 117632 - protein, 16 aa, Mycobacterium tuberculosis
NNSPAVYLLDGLRAQD

SEQ ID NO: 117633 - protein, 16 aa, Mycobacterium tuberculosis
NSPAVYLLDGLRAQDD

SEQ ID NO: 117634 - protein, 16 aa, Mycobacterium tuberculosis
SPAVYLLDGLRAQDDY

SEQ ID NO: 117635 - protein, 16 aa, Mycobacterium tuberculosis
PAVYLLDGLRAQDDYN

SEQ ID NO: 117636 - protein, 16 aa, Mycobacterium tuberculosis
AVYLLDGLRAQDDYNG

SEQ ID NO: 117637 - protein, 16 aa, Mycobacterium tuberculosis
VYLLDGLRAQDDYNGW

SEQ ID NO: 117638 - protein, 16 aa, Mycobacterium tuberculosis
YLLDGLRAQDDYNGWD

SEQ ID NO: 117639 - protein, 16 aa, Mycobacterium tuberculosis
LLDGLRAQDDYNGWDI

SEQ ID NO: 117640 - protein, 16 aa, Mycobacterium tuberculosis
LDGLRAQDDYNGWDIN

SEQ ID NO: 117641 - protein, 16 aa, Mycobacterium tuberculosis
DGLRAQDDYNGWDINT

SEQ ID NO: 117642 - protein, 16 aa, Mycobacterium tuberculosis
GLRAQDDYNGWDINTP

SEQ ID NO: 117643 - protein, 16 aa, Mycobacterium tuberculosis
LRAQDDYNGWDINTPA

SEQ ID NO: 117644 - protein, 16 aa, Mycobacterium tuberculosis
RAQDDYNGWDINTPAF

SEQ ID NO: 117645 - protein, 16 aa, Mycobacterium tuberculosis
AQDDYNGWDINTPAFE

SEQ ID NO: 117646 - protein, 16 aa, Mycobacterium tuberculosis
QDDYNGWDINTPAFEW

SEQ ID NO: 117647 - protein, 16 aa, Mycobacterium tuberculosis
DDYNGWDINTPAFEWY

SEQ ID NO: 117648 - protein, 16 aa, Mycobacterium tuberculosis
DYNGWDINTPAFEWYY

SEQ ID NO: 117649 - protein, 16 aa, Mycobacterium tuberculosis
YNGWDINTPAFEWYYQ

SEQ ID NO: 117650 - protein, 16 aa, Mycobacterium tuberculosis
NGWDINTPAFEWYYQS

SEQ ID NO: 117651 - protein, 16 aa, Mycobacterium tuberculosis
GWDINTPAFEWYYQSG

SEQ ID NO: 117652 - protein, 16 aa, Mycobacterium tuberculosis
WDINTPAFEWYYQSGL

SEQ ID NO: 117653 - protein, 16 aa, Mycobacterium tuberculosis
DINTPAFEWYYQSGLS

SEQ ID NO: 117654 - protein, 16 aa, Mycobacterium tuberculosis
INTPAFEWYYQSGLSI

SEQ ID NO: 117655 - protein, 16 aa, Mycobacterium tuberculosis
NTPAFEWYYQSGLSIV

SEQ ID NO: 117656 - protein, 16 aa, Mycobacterium tuberculosis
TPAFEWYYQSGLSIVM

SEQ ID NO: 117657 - protein, 16 aa, Mycobacterium tuberculosis
PAFEWYYQSGLSIVMP

SEQ ID NO: 117658 - protein, 16 aa, Mycobacterium tuberculosis
AFEWYYQSGLSIVMPV

SEQ ID NO: 117659 - protein, 16 aa, Mycobacterium tuberculosis
FEWYYQSGLSIVMPVG

SEQ ID NO: 117660 - protein, 16 aa, Mycobacterium tuberculosis
EWYYQSGLSIVMPVGG

SEQ ID NO: 117661 - protein, 16 aa, Mycobacterium tuberculosis
WYYQSGLSIVMPVGGQ

SEQ ID NO: 117662 - protein, 16 aa, Mycobacterium tuberculosis
YYQSGLSIVMPVGGQS

SEQ ID NO: 117663 - protein, 16 aa, Mycobacterium tuberculosis
YQSGLSIVMPVGGQSS

SEQ ID NO: 117664 - protein, 16 aa, Mycobacterium tuberculosis
QSGLSIVMPVGGQSSF

SEQ ID NO: 117665 - protein, 16 aa, Mycobacterium tuberculosis
SGLSIVMPVGGQSSFY

SEQ ID NO: 117666 - protein, 16 aa, Mycobacterium tuberculosis
GLSIVMPVGGQSSFYS

SEQ ID NO: 117667 - protein, 16 aa, Mycobacterium tuberculosis
LSIVMPVGGQSSFYSD

SEQ ID NO: 117668 - protein, 16 aa, Mycobacterium tuberculosis
SIVMPVGGQSSFYSDW

SEQ ID NO: 117669 - protein, 16 aa, Mycobacterium tuberculosis
IVMPVGGQSSFYSDWY

SEQ ID NO: 117670 - protein, 16 aa, Mycobacterium tuberculosis
VMPVGGQSSFYSDWYS

SEQ ID NO: 117671 - protein, 16 aa, Mycobacterium tuberculosis
MPVGGQSSFYSDWYSP

SEQ ID NO: 117672 - protein, 16 aa, Mycobacterium tuberculosis
PVGGQSSFYSDWYSPA

SEQ ID NO: 117673 - protein, 16 aa, Mycobacterium tuberculosis
VGGQSSFYSDWYSPAC

SEQ ID NO: 117674 - protein, 16 aa, Mycobacterium tuberculosis
GGQSSFYSDWYSPACG

SEQ ID NO: 117675 - protein, 16 aa, Mycobacterium tuberculosis
GQSSFYSDWYSPACGK

SEQ ID NO: 117676 - protein, 16 aa, Mycobacterium tuberculosis
QSSFYSDWYSPACGKA

SEQ ID NO: 117677 - protein, 16 aa, Mycobacterium tuberculosis
SSFYSDWYSPACGKAG

SEQ ID NO: 117678 - protein, 16 aa, Mycobacterium tuberculosis
SFYSDWYSPACGKAGC

SEQ ID NO: 117679 - protein, 16 aa, Mycobacterium tuberculosis
FYSDWYSPACGKAGCQ

SEQ ID NO: 117680 - protein, 16 aa, Mycobacterium tuberculosis
YSDWYSPACGKAGCQT

SEQ ID NO: 117681 - protein, 16 aa, Mycobacterium tuberculosis
SDWYSPACGKAGCQTY

SEQ ID NO: 117682 - protein, 16 aa, Mycobacterium tuberculosis
DWYSPACGKAGCQTYK

SEQ ID NO: 117683 - protein, 16 aa, Mycobacterium tuberculosis
WYSPACGKAGCQTYKW

SEQ ID NO: 117684 - protein, 16 aa, Mycobacterium tuberculosis
YSPACGKAGCQTYKWE

SEQ ID NO: 117685 - protein, 16 aa, Mycobacterium tuberculosis
SPACGKAGCQTYKWET

SEQ ID NO: 117686 - protein, 16 aa, Mycobacterium tuberculosis
PACGKAGCQTYKWETF

SEQ ID NO: 117687 - protein, 16 aa, Mycobacterium tuberculosis
ACGKAGCQTYKWETFL

SEQ ID NO: 117688 - protein, 16 aa, Mycobacterium tuberculosis
CGKAGCQTYKWETFLT

SEQ ID NO: 117689 - protein, 16 aa, Mycobacterium tuberculosis
GKAGCQTYKWETFLTS

SEQ ID NO: 117690 - protein, 16 aa, Mycobacterium tuberculosis
KAGCQTYKWETFLTSE

SEQ ID NO: 117691 - protein, 16 aa, Mycobacterium tuberculosis
AGCQTYKWETFLTSEL

SEQ ID NO: 117692 - protein, 16 aa, Mycobacterium tuberculosis
GCQTYKWETFLTSELP

SEQ ID NO: 117693 - protein, 16 aa, Mycobacterium tuberculosis
CQTYKWETFLTSELPQ

SEQ ID NO: 117694 - protein, 16 aa, Mycobacterium tuberculosis
QTYKWETFLTSELPQW

SEQ ID NO: 117695 - protein, 16 aa, Mycobacterium tuberculosis
TYKWETFLTSELPQWL

SEQ ID NO: 117696 - protein, 16 aa, Mycobacterium tuberculosis
YKWETFLTSELPQWLS

SEQ ID NO: 117697 - protein, 16 aa, Mycobacterium tuberculosis
KWETFLTSELPQWLSA

SEQ ID NO: 117698 - protein, 16 aa, Mycobacterium tuberculosis
WETFLTSELPQWLSAN

SEQ ID NO: 117699 - protein, 16 aa, Mycobacterium tuberculosis
ETFLTSELPQWLSANR

SEQ ID NO: 117700 - protein, 16 aa, Mycobacterium tuberculosis
TFLTSELPQWLSANRA

SEQ ID NO: 117701 - protein, 16 aa, Mycobacterium tuberculosis
FLTSELPQWLSANRAV

SEQ ID NO: 117702 - protein, 16 aa, Mycobacterium tuberculosis
LTSELPQWLSANRAVK

SEQ ID NO: 117703 - protein, 16 aa, Mycobacterium tuberculosis
TSELPQWLSANRAVKP

SEQ ID NO: 117704 - protein, 16 aa, Mycobacterium tuberculosis
SELPQWLSANRAVKPT

SEQ ID NO: 117705 - protein, 16 aa, Mycobacterium tuberculosis
ELPQWLSANRAVKPTG

SEQ ID NO: 117706 - protein, 16 aa, Mycobacterium tuberculosis
LPQWLSANRAVKPTGS

SEQ ID NO: 117707 - protein, 16 aa, Mycobacterium tuberculosis
PQWLSANRAVKPTGSA

SEQ ID NO: 117708 - protein, 16 aa, Mycobacterium tuberculosis
QWLSANRAVKPTGSAA

SEQ ID NO: 117709 - protein, 16 aa, Mycobacterium tuberculosis
WLSANRAVKPTGSAAI

SEQ ID NO: 117710 - protein, 16 aa, Mycobacterium tuberculosis
LSANRAVKPTGSAAIG

SEQ ID NO: 117711 - protein, 16 aa, Mycobacterium tuberculosis
SANRAVKPTGSAAIGL

SEQ ID NO: 117712 - protein, 16 aa, Mycobacterium tuberculosis
ANRAVKPTGSAAIGLS

SEQ ID NO: 117713 - protein, 16 aa, Mycobacterium tuberculosis
NRAVKPTGSAAIGLSM

SEQ ID NO: 117714 - protein, 16 aa, Mycobacterium tuberculosis
RAVKPTGSAAIGLSMA

SEQ ID NO: 117715 - protein, 16 aa, Mycobacterium tuberculosis
AVKPTGSAAIGLSMAG

SEQ ID NO: 117716 - protein, 16 aa, Mycobacterium tuberculosis
VKPTGSAAIGLSMAGS

SEQ ID NO: 117717 - protein, 16 aa, Mycobacterium tuberculosis
KPTGSAAIGLSMAGSS

SEQ ID NO: 117718 - protein, 16 aa, Mycobacterium tuberculosis
PTGSAAIGLSMAGSSA

SEQ ID NO: 117719 - protein, 16 aa, Mycobacterium tuberculosis
TGSAAIGLSMAGSSAM

SEQ ID NO: 117720 - protein, 16 aa, Mycobacterium tuberculosis
GSAAIGLSMAGSSAMI

SEQ ID NO: 117721 - protein, 16 aa, Mycobacterium tuberculosis
SAAIGLSMAGSSAMIL

SEQ ID NO: 117722 - protein, 16 aa, Mycobacterium tuberculosis
AAIGLSMAGSSAMILA

SEQ ID NO: 117723 - protein, 16 aa, Mycobacterium tuberculosis
AIGLSMAGSSAMILAA

SEQ ID NO: 117724 - protein, 16 aa, Mycobacterium tuberculosis
IGLSMAGSSAMILAAY

SEQ ID NO: 117725 - protein, 16 aa, Mycobacterium tuberculosis
GLSMAGSSAMILAAYH

SEQ ID NO: 117726 - protein, 16 aa, Mycobacterium tuberculosis
LSMAGSSAMILAAYHP

SEQ ID NO: 117727 - protein, 16 aa, Mycobacterium tuberculosis
SMAGSSAMILAAYHPQ

SEQ ID NO: 117728 - protein, 16 aa, Mycobacterium tuberculosis
MAGSSAMILAAYHPQQ

SEQ ID NO: 117729 - protein, 16 aa, Mycobacterium tuberculosis
AGSSAMILAAYHPQQF

SEQ ID NO: 117730 - protein, 16 aa, Mycobacterium tuberculosis
GSSAMILAAYHPQQFI

SEQ ID NO: 117731 - protein, 16 aa, Mycobacterium tuberculosis
SSAMILAAYHPQQFIY

SEQ ID NO: 117732 - protein, 16 aa, Mycobacterium tuberculosis
SAMILAAYHPQQFIYA

SEQ ID NO: 117733 - protein, 16 aa, Mycobacterium tuberculosis
AMILAAYHPQQFIYAG

SEQ ID NO: 117734 - protein, 16 aa, Mycobacterium tuberculosis
MILAAYHPQQFIYAGS

SEQ ID NO: 117735 - protein, 16 aa, Mycobacterium tuberculosis
ILAAYHPQQFIYAGSL

SEQ ID NO: 117736 - protein, 16 aa, Mycobacterium tuberculosis
LAAYHPQQFIYAGSLS

SEQ ID NO: 117737 - protein, 16 aa, Mycobacterium tuberculosis
AAYHPQQFIYAGSLSA

SEQ ID NO: 117738 - protein, 16 aa, Mycobacterium tuberculosis
AYHPQQFIYAGSLSAL

SEQ ID NO: 117739 - protein, 16 aa, Mycobacterium tuberculosis
YHPQQFIYAGSLSALL

SEQ ID NO: 117740 - protein, 16 aa, Mycobacterium tuberculosis
HPQQFIYAGSLSALLD

SEQ ID NO: 117741 - protein, 16 aa, Mycobacterium tuberculosis
PQQFIYAGSLSALLDP

SEQ ID NO: 117742 - protein, 16 aa, Mycobacterium tuberculosis
QQFIYAGSLSALLDPS

SEQ ID NO: 117743 - protein, 16 aa, Mycobacterium tuberculosis
QFIYAGSLSALLDPSQ

SEQ ID NO: 117744 - protein, 16 aa, Mycobacterium tuberculosis
FIYAGSLSALLDPSQG

SEQ ID NO: 117745 - protein, 16 aa, Mycobacterium tuberculosis
IYAGSLSALLDPSQGM

SEQ ID NO: 117746 - protein, 16 aa, Mycobacterium tuberculosis
YAGSLSALLDPSQGMG

SEQ ID NO: 117747 - protein, 16 aa, Mycobacterium tuberculosis
AGSLSALLDPSQGMGP

SEQ ID NO: 117748 - protein, 16 aa, Mycobacterium tuberculosis
GSLSALLDPSQGMGPS

SEQ ID NO: 117749 - protein, 16 aa, Mycobacterium tuberculosis
SLSALLDPSQGMGPSL

SEQ ID NO: 117750 - protein, 16 aa, Mycobacterium tuberculosis
LSALLDPSQGMGPSLI

SEQ ID NO: 117751 - protein, 16 aa, Mycobacterium tuberculosis
SALLDPSQGMGPSLIG

SEQ ID NO: 117752 - protein, 16 aa, Mycobacterium tuberculosis
ALLDPSQGMGPSLIGL

SEQ ID NO: 117753 - protein, 16 aa, Mycobacterium tuberculosis
LLDPSQGMGPSLIGLA

SEQ ID NO: 117754 - protein, 16 aa, Mycobacterium tuberculosis
LDPSQGMGPSLIGLAM

SEQ ID NO: 117755 - protein, 16 aa, Mycobacterium tuberculosis
DPSQGMGPSLIGLAMG

SEQ ID NO: 117756 - protein, 16 aa, Mycobacterium tuberculosis
PSQGMGPSLIGLAMGD

SEQ ID NO: 117757 - protein, 16 aa, Mycobacterium tuberculosis
SQGMGPSLIGLAMGDA

SEQ ID NO: 117758 - protein, 16 aa, Mycobacterium tuberculosis
QGMGPSLIGLAMGDAG

SEQ ID NO: 117759 - protein, 16 aa, Mycobacterium tuberculosis
GMGPSLIGLAMGDAGG

SEQ ID NO: 117760 - protein, 16 aa, Mycobacterium tuberculosis
MGPSLIGLAMGDAGGY

SEQ ID NO: 117761 - protein, 16 aa, Mycobacterium tuberculosis
GPSLIGLAMGDAGGYK

SEQ ID NO: 117762 - protein, 16 aa, Mycobacterium tuberculosis
PSLIGLAMGDAGGYKA

SEQ ID NO: 117763 - protein, 16 aa, Mycobacterium tuberculosis
SLIGLAMGDAGGYKAA

SEQ ID NO: 117764 - protein, 16 aa, Mycobacterium tuberculosis
LIGLAMGDAGGYKAAD

SEQ ID NO: 117765 - protein, 16 aa, Mycobacterium tuberculosis
IGLAMGDAGGYKAADM

SEQ ID NO: 117766 - protein, 16 aa, Mycobacterium tuberculosis
GLAMGDAGGYKAADMW

SEQ ID NO: 117767 - protein, 16 aa, Mycobacterium tuberculosis
LAMGDAGGYKAADMWG

SEQ ID NO: 117768 - protein, 16 aa, Mycobacterium tuberculosis
AMGDAGGYKAADMWGP

SEQ ID NO: 117769 - protein, 16 aa, Mycobacterium tuberculosis
MGDAGGYKAADMWGPS

SEQ ID NO: 117770 - protein, 16 aa, Mycobacterium tuberculosis
GDAGGYKAADMWGPSS

SEQ ID NO: 117771 - protein, 16 aa, Mycobacterium tuberculosis
DAGGYKAADMWGPSSD

SEQ ID NO: 117772 - protein, 16 aa, Mycobacterium tuberculosis
AGGYKAADMWGPSSDP

SEQ ID NO: 117773 - protein, 16 aa, Mycobacterium tuberculosis
GGYKAADMWGPSSDPA

SEQ ID NO: 117774 - protein, 16 aa, Mycobacterium tuberculosis
GYKAADMWGPSSDPAW

SEQ ID NO: 117775 - protein, 16 aa, Mycobacterium tuberculosis
YKAADMWGPSSDPAWE

SEQ ID NO: 117776 - protein, 16 aa, Mycobacterium tuberculosis
KAADMWGPSSDPAWER

SEQ ID NO: 117777 - protein, 16 aa, Mycobacterium tuberculosis
AADMWGPSSDPAWERN

SEQ ID NO: 117778 - protein, 16 aa, Mycobacterium tuberculosis
ADMWGPSSDPAWERND

SEQ ID NO: 117779 - protein, 16 aa, Mycobacterium tuberculosis
DMWGPSSDPAWERNDP

SEQ ID NO: 117780 - protein, 16 aa, Mycobacterium tuberculosis
MWGPSSDPAWERNDPT

SEQ ID NO: 117781 - protein, 16 aa, Mycobacterium tuberculosis
WGPSSDPAWERNDPTQ

SEQ ID NO: 117782 - protein, 16 aa, Mycobacterium tuberculosis
GPSSDPAWERNDPTQQ

SEQ ID NO: 117783 - protein, 16 aa, Mycobacterium tuberculosis
PSSDPAWERNDPTQQI

SEQ ID NO: 117784 - protein, 16 aa, Mycobacterium tuberculosis
SSDPAWERNDPTQQIP

SEQ ID NO: 117785 - protein, 16 aa, Mycobacterium tuberculosis
SDPAWERNDPTQQIPK

SEQ ID NO: 117786 - protein, 16 aa, Mycobacterium tuberculosis
DPAWERNDPTQQIPKL

SEQ ID NO: 117787 - protein, 16 aa, Mycobacterium tuberculosis
PAWERNDPTQQIPKLV

SEQ ID NO: 117788 - protein, 16 aa, Mycobacterium tuberculosis
AWERNDPTQQIPKLVA

SEQ ID NO: 117789 - protein, 16 aa, Mycobacterium tuberculosis
WERNDPTQQIPKLVAN

SEQ ID NO: 117790 - protein, 16 aa, Mycobacterium tuberculosis
ERNDPTQQIPKLVANN

SEQ ID NO: 117791 - protein, 16 aa, Mycobacterium tuberculosis
RNDPTQQIPKLVANNT

SEQ ID NO: 117792 - protein, 16 aa, Mycobacterium tuberculosis
NDPTQQIPKLVANNTR

SEQ ID NO: 117793 - protein, 16 aa, Mycobacterium tuberculosis
DPTQQIPKLVANNTRL

SEQ ID NO: 117794 - protein, 16 aa, Mycobacterium tuberculosis
PTQQIPKLVANNTRLW

SEQ ID NO: 117795 - protein, 16 aa, Mycobacterium tuberculosis
TQQIPKLVANNTRLWV

SEQ ID NO: 117796 - protein, 16 aa, Mycobacterium tuberculosis
QQIPKLVANNTRLWVY

SEQ ID NO: 117797 - protein, 16 aa, Mycobacterium tuberculosis
QIPKLVANNTRLWVYC

SEQ ID NO: 117798 - protein, 16 aa, Mycobacterium tuberculosis
IPKLVANNTRLWVYCG

SEQ ID NO: 117799 - protein, 16 aa, Mycobacterium tuberculosis
PKLVANNTRLWVYCGN

SEQ ID NO: 117800 - protein, 16 aa, Mycobacterium tuberculosis
KLVANNTRLWVYCGNG

SEQ ID NO: 117801 - protein, 16 aa, Mycobacterium tuberculosis
LVANNTRLWVYCGNGT

SEQ ID NO: 117802 - protein, 16 aa, Mycobacterium tuberculosis
VANNTRLWVYCGNGTP

SEQ ID NO: 117803 - protein, 16 aa, Mycobacterium tuberculosis
ANNTRLWVYCGNGTPN

SEQ ID NO: 117804 - protein, 16 aa, Mycobacterium tuberculosis
NNTRLWVYCGNGTPNE

SEQ ID NO: 117805 - protein, 16 aa, Mycobacterium tuberculosis
NTRLWVYCGNGTPNEL

SEQ ID NO: 117806 - protein, 16 aa, Mycobacterium tuberculosis
TRLWVYCGNGTPNELG

SEQ ID NO: 117807 - protein, 16 aa, Mycobacterium tuberculosis
RLWVYCGNGTPNELGG

SEQ ID NO: 117808 - protein, 16 aa, Mycobacterium tuberculosis
LWVYCGNGTPNELGGA

SEQ ID NO: 117809 - protein, 16 aa, Mycobacterium tuberculosis
WVYCGNGTPNELGGAN

SEQ ID NO: 117810 - protein, 16 aa, Mycobacterium tuberculosis
VYCGNGTPNELGGANI

SEQ ID NO: 117811 - protein, 16 aa, Mycobacterium tuberculosis
YCGNGTPNELGGANIP

SEQ ID NO: 117812 - protein, 16 aa, Mycobacterium tuberculosis
CGNGTPNELGGANIPA

SEQ ID NO: 117813 - protein, 16 aa, Mycobacterium tuberculosis
GNGTPNELGGANIPAE

SEQ ID NO: 117814 - protein, 16 aa, Mycobacterium tuberculosis
NGTPNELGGANIPAEF

SEQ ID NO: 117815 - protein, 16 aa, Mycobacterium tuberculosis
GTPNELGGANIPAEFL

SEQ ID NO: 117816 - protein, 16 aa, Mycobacterium tuberculosis
TPNELGGANIPAEFLE

SEQ ID NO: 117817 - protein, 16 aa, Mycobacterium tuberculosis
PNELGGANIPAEFLEN

SEQ ID NO: 117818 - protein, 16 aa, Mycobacterium tuberculosis
NELGGANIPAEFLENF

SEQ ID NO: 117819 - protein, 16 aa, Mycobacterium tuberculosis
ELGGANIPAEFLENFV

SEQ ID NO: 117820 - protein, 16 aa, Mycobacterium tuberculosis
LGGANIPAEFLENFVR

SEQ ID NO: 117821 - protein, 16 aa, Mycobacterium tuberculosis
GGANIPAEFLENFVRS

SEQ ID NO: 117822 - protein, 16 aa, Mycobacterium tuberculosis
GANIPAEFLENFVRSS

SEQ ID NO: 117823 - protein, 16 aa, Mycobacterium tuberculosis
ANIPAEFLENFVRSSN

SEQ ID NO: 117824 - protein, 16 aa, Mycobacterium tuberculosis
NIPAEFLENFVRSSNL

SEQ ID NO: 117825 - protein, 16 aa, Mycobacterium tuberculosis
IPAEFLENFVRSSNLK

SEQ ID NO: 117826 - protein, 16 aa, Mycobacterium tuberculosis
PAEFLENFVRSSNLKF

SEQ ID NO: 117827 - protein, 16 aa, Mycobacterium tuberculosis
AEFLENFVRSSNLKFQ

SEQ ID NO: 117828 - protein, 16 aa, Mycobacterium tuberculosis
EFLENFVRSSNLKFQD

SEQ ID NO: 117829 - protein, 16 aa, Mycobacterium tuberculosis
FLENFVRSSNLKFQDA

SEQ ID NO: 117830 - protein, 16 aa, Mycobacterium tuberculosis
LENFVRSSNLKFQDAY

SEQ ID NO: 117831 - protein, 16 aa, Mycobacterium tuberculosis
ENFVRSSNLKFQDAYN

SEQ ID NO: 117832 - protein, 16 aa, Mycobacterium tuberculosis
NFVRSSNLKFQDAYNA

SEQ ID NO: 117833 - protein, 16 aa, Mycobacterium tuberculosis
FVRSSNLKFQDAYNAA

SEQ ID NO: 117834 - protein, 16 aa, Mycobacterium tuberculosis
VRSSNLKFQDAYNAAG

SEQ ID NO: 117835 - protein, 16 aa, Mycobacterium tuberculosis
RSSNLKFQDAYNAAGG

SEQ ID NO: 117836 - protein, 16 aa, Mycobacterium tuberculosis
SSNLKFQDAYNAAGGH

SEQ ID NO: 117837 - protein, 16 aa, Mycobacterium tuberculosis
SNLKFQDAYNAAGGHN

SEQ ID NO: 117838 - protein, 16 aa, Mycobacterium tuberculosis
NLKFQDAYNAAGGHNA

SEQ ID NO: 117839 - protein, 16 aa, Mycobacterium tuberculosis
LKFQDAYNAAGGHNAV

SEQ ID NO: 117840 - protein, 16 aa, Mycobacterium tuberculosis
KFQDAYNAAGGHNAVF

SEQ ID NO: 117841 - protein, 16 aa, Mycobacterium tuberculosis
FQDAYNAAGGHNAVFN

SEQ ID NO: 117842 - protein, 16 aa, Mycobacterium tuberculosis
QDAYNAAGGHNAVFNF

SEQ ID NO: 117843 - protein, 16 aa, Mycobacterium tuberculosis
DAYNAAGGHNAVFNFP

SEQ ID NO: 117844 - protein, 16 aa, Mycobacterium tuberculosis
AYNAAGGHNAVFNFPP

SEQ ID NO: 117845 - protein, 16 aa, Mycobacterium tuberculosis
YNAAGGHNAVFNFPPN

SEQ ID NO: 117846 - protein, 16 aa, Mycobacterium tuberculosis
NAAGGHNAVFNFPPNG

SEQ ID NO: 117847 - protein, 16 aa, Mycobacterium tuberculosis
AAGGHNAVFNFPPNGT

SEQ ID NO: 117848 - protein, 16 aa, Mycobacterium tuberculosis
AGGHNAVFNFPPNGTH

SEQ ID NO: 117849 - protein, 16 aa, Mycobacterium tuberculosis
GGHNAVFNFPPNGTHS

SEQ ID NO: 117850 - protein, 16 aa, Mycobacterium tuberculosis
GHNAVFNFPPNGTHSW

SEQ ID NO: 117851 - protein, 16 aa, Mycobacterium tuberculosis
HNAVFNFPPNGTHSWE

SEQ ID NO: 117852 - protein, 16 aa, Mycobacterium tuberculosis
NAVFNFPPNGTHSWEY

SEQ ID NO: 117853 - protein, 16 aa, Mycobacterium tuberculosis
AVFNFPPNGTHSWEYW

SEQ ID NO: 117854 - protein, 16 aa, Mycobacterium tuberculosis
VFNFPPNGTHSWEYWG

SEQ ID NO: 117855 - protein, 16 aa, Mycobacterium tuberculosis
FNFPPNGTHSWEYWGA

SEQ ID NO: 117856 - protein, 16 aa, Mycobacterium tuberculosis
NFPPNGTHSWEYWGAQ

SEQ ID NO: 117857 - protein, 16 aa, Mycobacterium tuberculosis
FPPNGTHSWEYWGAQL

SEQ ID NO: 117858 - protein, 16 aa, Mycobacterium tuberculosis
PPNGTHSWEYWGAQLN

SEQ ID NO: 117859 - protein, 16 aa, Mycobacterium tuberculosis
PNGTHSWEYWGAQLNA

SEQ ID NO: 117860 - protein, 16 aa, Mycobacterium tuberculosis
NGTHSWEYWGAQLNAM

SEQ ID NO: 117861 - protein, 16 aa, Mycobacterium tuberculosis
GTHSWEYWGAQLNAMK

SEQ ID NO: 117862 - protein, 16 aa, Mycobacterium tuberculosis
THSWEYWGAQLNAMKG

SEQ ID NO: 117863 - protein, 16 aa, Mycobacterium tuberculosis
HSWEYWGAQLNAMKGD

SEQ ID NO: 117864 - protein, 16 aa, Mycobacterium tuberculosis
SWEYWGAQLNAMKGDL

SEQ ID NO: 117865 - protein, 16 aa, Mycobacterium tuberculosis
WEYWGAQLNAMKGDLQ

SEQ ID NO: 117866 - protein, 16 aa, Mycobacterium tuberculosis
EYWGAQLNAMKGDLQS

SEQ ID NO: 117867 - protein, 16 aa, Mycobacterium tuberculosis
YWGAQLNAMKGDLQSS

SEQ ID NO: 117868 - protein, 16 aa, Mycobacterium tuberculosis
WGAQLNAMKGDLQSSL

SEQ ID NO: 117869 - protein, 16 aa, Mycobacterium tuberculosis
GAQLNAMKGDLQSSLG

SEQ ID NO: 117870 - protein, 16 aa, Mycobacterium tuberculosis
AQLNAMKGDLQSSLGA

SEQ ID NO: 117871 - protein, 16 aa, Mycobacterium tuberculosis
QLNAMKGDLQSSLGAG

SEQ ID NO: 117872 - protein, 94 aa, Mycobacterium tuberculosis
MCGDQSDHVLQHWTVDISIDEHEGLTRAKARLRWREKELVGVGLARLNPADRNVPEIGDELSVARALSDLGKRMLKVSTHDIEAVTHQPARLLY

SEQ ID NO: 117873 - protein, 8 aa, Mycobacterium tuberculosis
HVLQHWTV

SEQ ID NO: 117874 - protein, 8 aa, Mycobacterium tuberculosis
LQHWTVDI

SEQ ID NO: 117875 - protein, 8 aa, Mycobacterium tuberculosis
SIDEHEGL

SEQ ID NO: 117876 - protein, 8 aa, Mycobacterium tuberculosis
GLTRAKAR

SEQ ID NO: 117877 - protein, 8 aa, Mycobacterium tuberculosis
RAKARLRW

SEQ ID NO: 117878 - protein, 8 aa, Mycobacterium tuberculosis
ARLRWREK

SEQ ID NO: 117879 - protein, 8 aa, Mycobacterium tuberculosis
REKELVGV

SEQ ID NO: 117880 - protein, 8 aa, Mycobacterium tuberculosis
KELVGVGL

SEQ ID NO: 117881 - protein, 8 aa, Mycobacterium tuberculosis
ELVGVGLA

SEQ ID NO: 117882 - protein, 8 aa, Mycobacterium tuberculosis
LVGVGLAR

SEQ ID NO: 117883 - protein, 8 aa, Mycobacterium tuberculosis
GLARLNPA

SEQ ID NO: 117884 - protein, 8 aa, Mycobacterium tuberculosis
VPEIGDEL

SEQ ID NO: 117885 - protein, 8 aa, Mycobacterium tuberculosis
EIGDELSV

SEQ ID NO: 117886 - protein, 8 aa, Mycobacterium tuberculosis
ELSVARAL

SEQ ID NO: 117887 - protein, 8 aa, Mycobacterium tuberculosis
RALSDLGK

SEQ ID NO: 117888 - protein, 8 aa, Mycobacterium tuberculosis
DLGKRMLK

SEQ ID NO: 117889 - protein, 8 aa, Mycobacterium tuberculosis
KRMLKVST

SEQ ID NO: 117890 - protein, 8 aa, Mycobacterium tuberculosis
RMLKVSTH

SEQ ID NO: 117891 - protein, 8 aa, Mycobacterium tuberculosis
STHDIEAV

SEQ ID NO: 117892 - protein, 8 aa, Mycobacterium tuberculosis
EAVTHQPA

SEQ ID NO: 117893 - protein, 8 aa, Mycobacterium tuberculosis
AVTHQPAR

SEQ ID NO: 117894 - protein, 8 aa, Mycobacterium tuberculosis
THQPARLL

SEQ ID NO: 117895 - protein, 8 aa, Mycobacterium tuberculosis
HQPARLLY

SEQ ID NO: 117896 - protein, 9 aa, Mycobacterium tuberculosis
MCGDQSDHV

SEQ ID NO: 117897 - protein, 9 aa, Mycobacterium tuberculosis
QSDHVLQHW

SEQ ID NO: 117898 - protein, 9 aa, Mycobacterium tuberculosis
VLQHWTVDI

SEQ ID NO: 117899 - protein, 9 aa, Mycobacterium tuberculosis
SIDEHEGLT

SEQ ID NO: 117900 - protein, 9 aa, Mycobacterium tuberculosis
GLTRAKARL

SEQ ID NO: 117901 - protein, 9 aa, Mycobacterium tuberculosis
LTRAKARLR

SEQ ID NO: 117902 - protein, 9 aa, Mycobacterium tuberculosis
RAKARLRWR

SEQ ID NO: 117903 - protein, 9 aa, Mycobacterium tuberculosis
KARLRWREK

SEQ ID NO: 117904 - protein, 9 aa, Mycobacterium tuberculosis
RLRWREKEL

SEQ ID NO: 117905 - protein, 9 aa, Mycobacterium tuberculosis
ELVGVGLAR

SEQ ID NO: 117906 - protein, 9 aa, Mycobacterium tuberculosis
LVGVGLARL

SEQ ID NO: 117907 - protein, 9 aa, Mycobacterium tuberculosis
RLNPADRNV

SEQ ID NO: 117908 - protein, 9 aa, Mycobacterium tuberculosis
NVPEIGDEL

SEQ ID NO: 117909 - protein, 9 aa, Mycobacterium tuberculosis
PEIGDELSV

SEQ ID NO: 117910 - protein, 9 aa, Mycobacterium tuberculosis
DELSVARAL

SEQ ID NO: 117911 - protein, 9 aa, Mycobacterium tuberculosis
SVARALSDL

SEQ ID NO: 117912 - protein, 9 aa, Mycobacterium tuberculosis
ARALSDLGK

SEQ ID NO: 117913 - protein, 9 aa, Mycobacterium tuberculosis
RALSDLGKR

SEQ ID NO: 117914 - protein, 9 aa, Mycobacterium tuberculosis
ALSDLGKRM

SEQ ID NO: 117915 - protein, 9 aa, Mycobacterium tuberculosis
DLGKRMLKV

SEQ ID NO: 117916 - protein, 9 aa, Mycobacterium tuberculosis
KRMLKVSTH

SEQ ID NO: 117917 - protein, 9 aa, Mycobacterium tuberculosis
MLKVSTHDI

SEQ ID NO: 117918 - protein, 9 aa, Mycobacterium tuberculosis
KVSTHDIEA

SEQ ID NO: 117919 - protein, 9 aa, Mycobacterium tuberculosis
EAVTHQPAR

SEQ ID NO: 117920 - protein, 9 aa, Mycobacterium tuberculosis
AVTHQPARL

SEQ ID NO: 117921 - protein, 10 aa, Mycobacterium tuberculosis
HVLQHWTVDI

SEQ ID NO: 117922 - protein, 10 aa, Mycobacterium tuberculosis
LQHWTVDISI

SEQ ID NO: 117923 - protein, 10 aa, Mycobacterium tuberculosis
DISIDEHEGL

SEQ ID NO: 117924 - protein, 10 aa, Mycobacterium tuberculosis
GLTRAKARLR

SEQ ID NO: 117925 - protein, 10 aa, Mycobacterium tuberculosis
LTRAKARLRW

SEQ ID NO: 117926 - protein, 10 aa, Mycobacterium tuberculosis
TRAKARLRWR

SEQ ID NO: 117927 - protein, 10 aa, Mycobacterium tuberculosis
RLRWREKELV

SEQ ID NO: 117928 - protein, 10 aa, Mycobacterium tuberculosis
REKELVGVGL

SEQ ID NO: 117929 - protein, 10 aa, Mycobacterium tuberculosis
ELVGVGLARL

SEQ ID NO: 117930 - protein, 10 aa, Mycobacterium tuberculosis
NPADRNVPEI

SEQ ID NO: 117931 - protein, 10 aa, Mycobacterium tuberculosis
EIGDELSVAR

SEQ ID NO: 117932 - protein, 10 aa, Mycobacterium tuberculosis
VARALSDLGK

SEQ ID NO: 117933 - protein, 10 aa, Mycobacterium tuberculosis
ALSDLGKRML

SEQ ID NO: 117934 - protein, 10 aa, Mycobacterium tuberculosis
LSDLGKRMLK

SEQ ID NO: 117935 - protein, 10 aa, Mycobacterium tuberculosis
RMLKVSTHDI

SEQ ID NO: 117936 - protein, 10 aa, Mycobacterium tuberculosis
KVSTHDIEAV

SEQ ID NO: 117937 - protein, 10 aa, Mycobacterium tuberculosis
EAVTHQPARL

SEQ ID NO: 117938 - protein, 10 aa, Mycobacterium tuberculosis
VTHQPARLLY

SEQ ID NO: 117939 - protein, 11 aa, Mycobacterium tuberculosis
QSDHVLQHWTV

SEQ ID NO: 117940 - protein, 11 aa, Mycobacterium tuberculosis
VLQHWTVDISI

SEQ ID NO: 117941 - protein, 11 aa, Mycobacterium tuberculosis
ISIDEHEGLTR

SEQ ID NO: 117942 - protein, 11 aa, Mycobacterium tuberculosis
SIDEHEGLTRA

SEQ ID NO: 117943 - protein, 11 aa, Mycobacterium tuberculosis
GLTRAKARLRW

SEQ ID NO: 117944 - protein, 11 aa, Mycobacterium tuberculosis
LTRAKARLRWR

SEQ ID NO: 117945 - protein, 11 aa, Mycobacterium tuberculosis
RAKARLRWREK

SEQ ID NO: 117946 - protein, 11 aa, Mycobacterium tuberculosis
KARLRWREKEL

SEQ ID NO: 117947 - protein, 11 aa, Mycobacterium tuberculosis
KELVGVGLARL

SEQ ID NO: 117948 - protein, 11 aa, Mycobacterium tuberculosis
NVPEIGDELSV

SEQ ID NO: 117949 - protein, 11 aa, Mycobacterium tuberculosis
ELSVARALSDL

SEQ ID NO: 117950 - protein, 11 aa, Mycobacterium tuberculosis
SVARALSDLGK

SEQ ID NO: 117951 - protein, 11 aa, Mycobacterium tuberculosis
VARALSDLGKR

SEQ ID NO: 117952 - protein, 11 aa, Mycobacterium tuberculosis
ALSDLGKRMLK

SEQ ID NO: 117953 - protein, 11 aa, Mycobacterium tuberculosis
MLKVSTHDIEA

SEQ ID NO: 117954 - protein, 11 aa, Mycobacterium tuberculosis
DIEAVTHQPAR

SEQ ID NO: 117955 - protein, 11 aa, Mycobacterium tuberculosis
IEAVTHQPARL

SEQ ID NO: 117956 - protein, 11 aa, Mycobacterium tuberculosis
EAVTHQPARLL

SEQ ID NO: 117957 - protein, 11 aa, Mycobacterium tuberculosis
AVTHQPARLLY

SEQ ID NO: 117958 - protein, 13 aa, Mycobacterium tuberculosis
MCGDQSDHVLQHW

SEQ ID NO: 117959 - protein, 13 aa, Mycobacterium tuberculosis
CGDQSDHVLQHWT

SEQ ID NO: 117960 - protein, 13 aa, Mycobacterium tuberculosis
GDQSDHVLQHWTV

SEQ ID NO: 117961 - protein, 13 aa, Mycobacterium tuberculosis
DQSDHVLQHWTVD

SEQ ID NO: 117962 - protein, 13 aa, Mycobacterium tuberculosis
QSDHVLQHWTVDI

SEQ ID NO: 117963 - protein, 13 aa, Mycobacterium tuberculosis
SDHVLQHWTVDIS

SEQ ID NO: 117964 - protein, 13 aa, Mycobacterium tuberculosis
DHVLQHWTVDISI

SEQ ID NO: 117965 - protein, 13 aa, Mycobacterium tuberculosis
HVLQHWTVDISID

SEQ ID NO: 117966 - protein, 13 aa, Mycobacterium tuberculosis
VLQHWTVDISIDE

SEQ ID NO: 117967 - protein, 13 aa, Mycobacterium tuberculosis
LQHWTVDISIDEH

SEQ ID NO: 117968 - protein, 13 aa, Mycobacterium tuberculosis
QHWTVDISIDEHE

SEQ ID NO: 117969 - protein, 13 aa, Mycobacterium tuberculosis
HWTVDISIDEHEG

SEQ ID NO: 117970 - protein, 13 aa, Mycobacterium tuberculosis
WTVDISIDEHEGL

SEQ ID NO: 117971 - protein, 13 aa, Mycobacterium tuberculosis
TVDISIDEHEGLT

SEQ ID NO: 117972 - protein, 13 aa, Mycobacterium tuberculosis
VDISIDEHEGLTR

SEQ ID NO: 117973 - protein, 13 aa, Mycobacterium tuberculosis
DISIDEHEGLTRA

SEQ ID NO: 117974 - protein, 13 aa, Mycobacterium tuberculosis
ISIDEHEGLTRAK

SEQ ID NO: 117975 - protein, 13 aa, Mycobacterium tuberculosis
SIDEHEGLTRAKA

SEQ ID NO: 117976 - protein, 13 aa, Mycobacterium tuberculosis
IDEHEGLTRAKAR

SEQ ID NO: 117977 - protein, 13 aa, Mycobacterium tuberculosis
DEHEGLTRAKARL

SEQ ID NO: 117978 - protein, 13 aa, Mycobacterium tuberculosis
EHEGLTRAKARLR

SEQ ID NO: 117979 - protein, 13 aa, Mycobacterium tuberculosis
HEGLTRAKARLRW

SEQ ID NO: 117980 - protein, 13 aa, Mycobacterium tuberculosis
EGLTRAKARLRWR

SEQ ID NO: 117981 - protein, 13 aa, Mycobacterium tuberculosis
GLTRAKARLRWRE

SEQ ID NO: 117982 - protein, 13 aa, Mycobacterium tuberculosis
LTRAKARLRWREK

SEQ ID NO: 117983 - protein, 13 aa, Mycobacterium tuberculosis
TRAKARLRWREKE

SEQ ID NO: 117984 - protein, 13 aa, Mycobacterium tuberculosis
RAKARLRWREKEL

SEQ ID NO: 117985 - protein, 13 aa, Mycobacterium tuberculosis
AKARLRWREKELV

SEQ ID NO: 117986 - protein, 13 aa, Mycobacterium tuberculosis
KARLRWREKELVG

SEQ ID NO: 117987 - protein, 13 aa, Mycobacterium tuberculosis
ARLRWREKELVGV

SEQ ID NO: 117988 - protein, 13 aa, Mycobacterium tuberculosis
RLRWREKELVGVG

SEQ ID NO: 117989 - protein, 13 aa, Mycobacterium tuberculosis
LRWREKELVGVGL

SEQ ID NO: 117990 - protein, 13 aa, Mycobacterium tuberculosis
RWREKELVGVGLA

SEQ ID NO: 117991 - protein, 13 aa, Mycobacterium tuberculosis
WREKELVGVGLAR

SEQ ID NO: 117992 - protein, 13 aa, Mycobacterium tuberculosis
REKELVGVGLARL

SEQ ID NO: 117993 - protein, 13 aa, Mycobacterium tuberculosis
EKELVGVGLARLN

SEQ ID NO: 117994 - protein, 13 aa, Mycobacterium tuberculosis
KELVGVGLARLNP

SEQ ID NO: 117995 - protein, 13 aa, Mycobacterium tuberculosis
ELVGVGLARLNPA

SEQ ID NO: 117996 - protein, 13 aa, Mycobacterium tuberculosis
LVGVGLARLNPAD

SEQ ID NO: 117997 - protein, 13 aa, Mycobacterium tuberculosis
VGVGLARLNPADR

SEQ ID NO: 117998 - protein, 13 aa, Mycobacterium tuberculosis
GVGLARLNPADRN

SEQ ID NO: 117999 - protein, 13 aa, Mycobacterium tuberculosis
VGLARLNPADRNV

SEQ ID NO: 118000 - protein, 13 aa, Mycobacterium tuberculosis
GLARLNPADRNVP

SEQ ID NO: 118001 - protein, 13 aa, Mycobacterium tuberculosis
LARLNPADRNVPE

SEQ ID NO: 118002 - protein, 13 aa, Mycobacterium tuberculosis
ARLNPADRNVPEI

SEQ ID NO: 118003 - protein, 13 aa, Mycobacterium tuberculosis
RLNPADRNVPEIG

SEQ ID NO: 118004 - protein, 13 aa, Mycobacterium tuberculosis
LNPADRNVPEIGD

SEQ ID NO: 118005 - protein, 13 aa, Mycobacterium tuberculosis
NPADRNVPEIGDE

SEQ ID NO: 118006 - protein, 13 aa, Mycobacterium tuberculosis
PADRNVPEIGDEL

SEQ ID NO: 118007 - protein, 13 aa, Mycobacterium tuberculosis
ADRNVPEIGDELS

SEQ ID NO: 118008 - protein, 13 aa, Mycobacterium tuberculosis
DRNVPEIGDELSV

SEQ ID NO: 118009 - protein, 13 aa, Mycobacterium tuberculosis
RNVPEIGDELSVA

SEQ ID NO: 118010 - protein, 13 aa, Mycobacterium tuberculosis
NVPEIGDELSVAR

SEQ ID NO: 118011 - protein, 13 aa, Mycobacterium tuberculosis
VPEIGDELSVARA

SEQ ID NO: 118012 - protein, 13 aa, Mycobacterium tuberculosis
PEIGDELSVARAL

SEQ ID NO: 118013 - protein, 13 aa, Mycobacterium tuberculosis
EIGDELSVARALS

SEQ ID NO: 118014 - protein, 13 aa, Mycobacterium tuberculosis
IGDELSVARALSD

SEQ ID NO: 118015 - protein, 13 aa, Mycobacterium tuberculosis
GDELSVARALSDL

SEQ ID NO: 118016 - protein, 13 aa, Mycobacterium tuberculosis
DELSVARALSDLG

SEQ ID NO: 118017 - protein, 13 aa, Mycobacterium tuberculosis
ELSVARALSDLGK

SEQ ID NO: 118018 - protein, 13 aa, Mycobacterium tuberculosis
LSVARALSDLGKR

SEQ ID NO: 118019 - protein, 13 aa, Mycobacterium tuberculosis
SVARALSDLGKRM

SEQ ID NO: 118020 - protein, 13 aa, Mycobacterium tuberculosis
VARALSDLGKRML

SEQ ID NO: 118021 - protein, 13 aa, Mycobacterium tuberculosis
ARALSDLGKRMLK

SEQ ID NO: 118022 - protein, 13 aa, Mycobacterium tuberculosis
RALSDLGKRMLKV

SEQ ID NO: 118023 - protein, 13 aa, Mycobacterium tuberculosis
ALSDLGKRMLKVS

SEQ ID NO: 118024 - protein, 13 aa, Mycobacterium tuberculosis
LSDLGKRMLKVST

SEQ ID NO: 118025 - protein, 13 aa, Mycobacterium tuberculosis
SDLGKRMLKVSTH

SEQ ID NO: 118026 - protein, 13 aa, Mycobacterium tuberculosis
DLGKRMLKVSTHD

SEQ ID NO: 118027 - protein, 13 aa, Mycobacterium tuberculosis
LGKRMLKVSTHDI

SEQ ID NO: 118028 - protein, 13 aa, Mycobacterium tuberculosis
GKRMLKVSTHDIE

SEQ ID NO: 118029 - protein, 13 aa, Mycobacterium tuberculosis
KRMLKVSTHDIEA

SEQ ID NO: 118030 - protein, 13 aa, Mycobacterium tuberculosis
RMLKVSTHDIEAV

SEQ ID NO: 118031 - protein, 13 aa, Mycobacterium tuberculosis
MLKVSTHDIEAVT

SEQ ID NO: 118032 - protein, 13 aa, Mycobacterium tuberculosis
LKVSTHDIEAVTH

SEQ ID NO: 118033 - protein, 13 aa, Mycobacterium tuberculosis
KVSTHDIEAVTHQ

SEQ ID NO: 118034 - protein, 13 aa, Mycobacterium tuberculosis
VSTHDIEAVTHQP

SEQ ID NO: 118035 - protein, 13 aa, Mycobacterium tuberculosis
STHDIEAVTHQPA

SEQ ID NO: 118036 - protein, 13 aa, Mycobacterium tuberculosis
THDIEAVTHQPAR

SEQ ID NO: 118037 - protein, 13 aa, Mycobacterium tuberculosis
HDIEAVTHQPARL

SEQ ID NO: 118038 - protein, 13 aa, Mycobacterium tuberculosis
DIEAVTHQPARLL

SEQ ID NO: 118039 - protein, 13 aa, Mycobacterium tuberculosis
IEAVTHQPARLLY

SEQ ID NO: 118040 - protein, 14 aa, Mycobacterium tuberculosis
MCGDQSDHVLQHWT

SEQ ID NO: 118041 - protein, 14 aa, Mycobacterium tuberculosis
CGDQSDHVLQHWTV

SEQ ID NO: 118042 - protein, 14 aa, Mycobacterium tuberculosis
GDQSDHVLQHWTVD

SEQ ID NO: 118043 - protein, 14 aa, Mycobacterium tuberculosis
DQSDHVLQHWTVDI

SEQ ID NO: 118044 - protein, 14 aa, Mycobacterium tuberculosis
QSDHVLQHWTVDIS

SEQ ID NO: 118045 - protein, 14 aa, Mycobacterium tuberculosis
SDHVLQHWTVDISI

SEQ ID NO: 118046 - protein, 14 aa, Mycobacterium tuberculosis
DHVLQHWTVDISID

SEQ ID NO: 118047 - protein, 14 aa, Mycobacterium tuberculosis
HVLQHWTVDISIDE

SEQ ID NO: 118048 - protein, 14 aa, Mycobacterium tuberculosis
VLQHWTVDISIDEH

SEQ ID NO: 118049 - protein, 14 aa, Mycobacterium tuberculosis
LQHWTVDISIDEHE

SEQ ID NO: 118050 - protein, 14 aa, Mycobacterium tuberculosis
QHWTVDISIDEHEG

SEQ ID NO: 118051 - protein, 14 aa, Mycobacterium tuberculosis
HWTVDISIDEHEGL

SEQ ID NO: 118052 - protein, 14 aa, Mycobacterium tuberculosis
WTVDISIDEHEGLT

SEQ ID NO: 118053 - protein, 14 aa, Mycobacterium tuberculosis
TVDISIDEHEGLTR

SEQ ID NO: 118054 - protein, 14 aa, Mycobacterium tuberculosis
VDISIDEHEGLTRA

SEQ ID NO: 118055 - protein, 14 aa, Mycobacterium tuberculosis
DISIDEHEGLTRAK

SEQ ID NO: 118056 - protein, 14 aa, Mycobacterium tuberculosis
ISIDEHEGLTRAKA

SEQ ID NO: 118057 - protein, 14 aa, Mycobacterium tuberculosis
SIDEHEGLTRAKAR

SEQ ID NO: 118058 - protein, 14 aa, Mycobacterium tuberculosis
IDEHEGLTRAKARL

SEQ ID NO: 118059 - protein, 14 aa, Mycobacterium tuberculosis
DEHEGLTRAKARLR

SEQ ID NO: 118060 - protein, 14 aa, Mycobacterium tuberculosis
EHEGLTRAKARLRW

SEQ ID NO: 118061 - protein, 14 aa, Mycobacterium tuberculosis
HEGLTRAKARLRWR

SEQ ID NO: 118062 - protein, 14 aa, Mycobacterium tuberculosis
EGLTRAKARLRWRE

SEQ ID NO: 118063 - protein, 14 aa, Mycobacterium tuberculosis
GLTRAKARLRWREK

SEQ ID NO: 118064 - protein, 14 aa, Mycobacterium tuberculosis
LTRAKARLRWREKE

SEQ ID NO: 118065 - protein, 14 aa, Mycobacterium tuberculosis
TRAKARLRWREKEL

SEQ ID NO: 118066 - protein, 14 aa, Mycobacterium tuberculosis
RAKARLRWREKELV

SEQ ID NO: 118067 - protein, 14 aa, Mycobacterium tuberculosis
AKARLRWREKELVG

SEQ ID NO: 118068 - protein, 14 aa, Mycobacterium tuberculosis
KARLRWREKELVGV

SEQ ID NO: 118069 - protein, 14 aa, Mycobacterium tuberculosis
ARLRWREKELVGVG

SEQ ID NO: 118070 - protein, 14 aa, Mycobacterium tuberculosis
RLRWREKELVGVGL

SEQ ID NO: 118071 - protein, 14 aa, Mycobacterium tuberculosis
LRWREKELVGVGLA

SEQ ID NO: 118072 - protein, 14 aa, Mycobacterium tuberculosis
RWREKELVGVGLAR

SEQ ID NO: 118073 - protein, 14 aa, Mycobacterium tuberculosis
WREKELVGVGLARL

SEQ ID NO: 118074 - protein, 14 aa, Mycobacterium tuberculosis
REKELVGVGLARLN

SEQ ID NO: 118075 - protein, 14 aa, Mycobacterium tuberculosis
EKELVGVGLARLNP

SEQ ID NO: 118076 - protein, 14 aa, Mycobacterium tuberculosis
KELVGVGLARLNPA

SEQ ID NO: 118077 - protein, 14 aa, Mycobacterium tuberculosis
ELVGVGLARLNPAD

SEQ ID NO: 118078 - protein, 14 aa, Mycobacterium tuberculosis
LVGVGLARLNPADR

SEQ ID NO: 118079 - protein, 14 aa, Mycobacterium tuberculosis
VGVGLARLNPADRN

SEQ ID NO: 118080 - protein, 14 aa, Mycobacterium tuberculosis
GVGLARLNPADRNV

SEQ ID NO: 118081 - protein, 14 aa, Mycobacterium tuberculosis
VGLARLNPADRNVP

SEQ ID NO: 118082 - protein, 14 aa, Mycobacterium tuberculosis
GLARLNPADRNVPE

SEQ ID NO: 118083 - protein, 14 aa, Mycobacterium tuberculosis
LARLNPADRNVPEI

SEQ ID NO: 118084 - protein, 14 aa, Mycobacterium tuberculosis
ARLNPADRNVPEIG

SEQ ID NO: 118085 - protein, 14 aa, Mycobacterium tuberculosis
RLNPADRNVPEIGD

SEQ ID NO: 118086 - protein, 14 aa, Mycobacterium tuberculosis
LNPADRNVPEIGDE

SEQ ID NO: 118087 - protein, 14 aa, Mycobacterium tuberculosis
NPADRNVPEIGDEL

SEQ ID NO: 118088 - protein, 14 aa, Mycobacterium tuberculosis
PADRNVPEIGDELS

SEQ ID NO: 118089 - protein, 14 aa, Mycobacterium tuberculosis
ADRNVPEIGDELSV

SEQ ID NO: 118090 - protein, 14 aa, Mycobacterium tuberculosis
DRNVPEIGDELSVA

SEQ ID NO: 118091 - protein, 14 aa, Mycobacterium tuberculosis
RNVPEIGDELSVAR

SEQ ID NO: 118092 - protein, 14 aa, Mycobacterium tuberculosis
NVPEIGDELSVARA

SEQ ID NO: 118093 - protein, 14 aa, Mycobacterium tuberculosis
VPEIGDELSVARAL

SEQ ID NO: 118094 - protein, 14 aa, Mycobacterium tuberculosis
PEIGDELSVARALS

SEQ ID NO: 118095 - protein, 14 aa, Mycobacterium tuberculosis
EIGDELSVARALSD

SEQ ID NO: 118096 - protein, 14 aa, Mycobacterium tuberculosis
IGDELSVARALSDL

SEQ ID NO: 118097 - protein, 14 aa, Mycobacterium tuberculosis
GDELSVARALSDLG

SEQ ID NO: 118098 - protein, 14 aa, Mycobacterium tuberculosis
DELSVARALSDLGK

SEQ ID NO: 118099 - protein, 14 aa, Mycobacterium tuberculosis
ELSVARALSDLGKR

SEQ ID NO: 118100 - protein, 14 aa, Mycobacterium tuberculosis
LSVARALSDLGKRM

SEQ ID NO: 118101 - protein, 14 aa, Mycobacterium tuberculosis
SVARALSDLGKRML

SEQ ID NO: 118102 - protein, 14 aa, Mycobacterium tuberculosis
VARALSDLGKRMLK

SEQ ID NO: 118103 - protein, 14 aa, Mycobacterium tuberculosis
ARALSDLGKRMLKV

SEQ ID NO: 118104 - protein, 14 aa, Mycobacterium tuberculosis
RALSDLGKRMLKVS

SEQ ID NO: 118105 - protein, 14 aa, Mycobacterium tuberculosis
ALSDLGKRMLKVST

SEQ ID NO: 118106 - protein, 14 aa, Mycobacterium tuberculosis
LSDLGKRMLKVSTH

SEQ ID NO: 118107 - protein, 14 aa, Mycobacterium tuberculosis
SDLGKRMLKVSTHD

SEQ ID NO: 118108 - protein, 14 aa, Mycobacterium tuberculosis
DLGKRMLKVSTHDI

SEQ ID NO: 118109 - protein, 14 aa, Mycobacterium tuberculosis
LGKRMLKVSTHDIE

SEQ ID NO: 118110 - protein, 14 aa, Mycobacterium tuberculosis
GKRMLKVSTHDIEA

SEQ ID NO: 118111 - protein, 14 aa, Mycobacterium tuberculosis
KRMLKVSTHDIEAV

SEQ ID NO: 118112 - protein, 14 aa, Mycobacterium tuberculosis
RMLKVSTHDIEAVT

SEQ ID NO: 118113 - protein, 14 aa, Mycobacterium tuberculosis
MLKVSTHDIEAVTH

SEQ ID NO: 118114 - protein, 14 aa, Mycobacterium tuberculosis
LKVSTHDIEAVTHQ

SEQ ID NO: 118115 - protein, 14 aa, Mycobacterium tuberculosis
KVSTHDIEAVTHQP

SEQ ID NO: 118116 - protein, 14 aa, Mycobacterium tuberculosis
VSTHDIEAVTHQPA

SEQ ID NO: 118117 - protein, 14 aa, Mycobacterium tuberculosis
STHDIEAVTHQPAR

SEQ ID NO: 118118 - protein, 14 aa, Mycobacterium tuberculosis
THDIEAVTHQPARL

SEQ ID NO: 118119 - protein, 14 aa, Mycobacterium tuberculosis
HDIEAVTHQPARLL

SEQ ID NO: 118120 - protein, 14 aa, Mycobacterium tuberculosis
DIEAVTHQPARLLY

SEQ ID NO: 118121 - protein, 15 aa, Mycobacterium tuberculosis
MCGDQSDHVLQHWTV

SEQ ID NO: 118122 - protein, 15 aa, Mycobacterium tuberculosis
CGDQSDHVLQHWTVD

SEQ ID NO: 118123 - protein, 15 aa, Mycobacterium tuberculosis
GDQSDHVLQHWTVDI

SEQ ID NO: 118124 - protein, 15 aa, Mycobacterium tuberculosis
DQSDHVLQHWTVDIS

SEQ ID NO: 118125 - protein, 15 aa, Mycobacterium tuberculosis
QSDHVLQHWTVDISI

SEQ ID NO: 118126 - protein, 15 aa, Mycobacterium tuberculosis
SDHVLQHWTVDISID

SEQ ID NO: 118127 - protein, 15 aa, Mycobacterium tuberculosis
DHVLQHWTVDISIDE

SEQ ID NO: 118128 - protein, 15 aa, Mycobacterium tuberculosis
HVLQHWTVDISIDEH

SEQ ID NO: 118129 - protein, 15 aa, Mycobacterium tuberculosis
VLQHWTVDISIDEHE

SEQ ID NO: 118130 - protein, 15 aa, Mycobacterium tuberculosis
LQHWTVDISIDEHEG

SEQ ID NO: 118131 - protein, 15 aa, Mycobacterium tuberculosis
QHWTVDISIDEHEGL

SEQ ID NO: 118132 - protein, 15 aa, Mycobacterium tuberculosis
HWTVDISIDEHEGLT

SEQ ID NO: 118133 - protein, 15 aa, Mycobacterium tuberculosis
WTVDISIDEHEGLTR

SEQ ID NO: 118134 - protein, 15 aa, Mycobacterium tuberculosis
TVDISIDEHEGLTRA

SEQ ID NO: 118135 - protein, 15 aa, Mycobacterium tuberculosis
VDISIDEHEGLTRAK

SEQ ID NO: 118136 - protein, 15 aa, Mycobacterium tuberculosis
DISIDEHEGLTRAKA

SEQ ID NO: 118137 - protein, 15 aa, Mycobacterium tuberculosis
ISIDEHEGLTRAKAR

SEQ ID NO: 118138 - protein, 15 aa, Mycobacterium tuberculosis
SIDEHEGLTRAKARL

SEQ ID NO: 118139 - protein, 15 aa, Mycobacterium tuberculosis
IDEHEGLTRAKARLR

SEQ ID NO: 118140 - protein, 15 aa, Mycobacterium tuberculosis
DEHEGLTRAKARLRW

SEQ ID NO: 118141 - protein, 15 aa, Mycobacterium tuberculosis
EHEGLTRAKARLRWR

SEQ ID NO: 118142 - protein, 15 aa, Mycobacterium tuberculosis
HEGLTRAKARLRWRE

SEQ ID NO: 118143 - protein, 15 aa, Mycobacterium tuberculosis
EGLTRAKARLRWREK

SEQ ID NO: 118144 - protein, 15 aa, Mycobacterium tuberculosis
GLTRAKARLRWREKE

SEQ ID NO: 118145 - protein, 15 aa, Mycobacterium tuberculosis
LTRAKARLRWREKEL

SEQ ID NO: 118146 - protein, 15 aa, Mycobacterium tuberculosis
TRAKARLRWREKELV

SEQ ID NO: 118147 - protein, 15 aa, Mycobacterium tuberculosis
RAKARLRWREKELVG

SEQ ID NO: 118148 - protein, 15 aa, Mycobacterium tuberculosis
AKARLRWREKELVGV

SEQ ID NO: 118149 - protein, 15 aa, Mycobacterium tuberculosis
KARLRWREKELVGVG

SEQ ID NO: 118150 - protein, 15 aa, Mycobacterium tuberculosis
ARLRWREKELVGVGL

SEQ ID NO: 118151 - protein, 15 aa, Mycobacterium tuberculosis
RLRWREKELVGVGLA

SEQ ID NO: 118152 - protein, 15 aa, Mycobacterium tuberculosis
LRWREKELVGVGLAR

SEQ ID NO: 118153 - protein, 15 aa, Mycobacterium tuberculosis
RWREKELVGVGLARL

SEQ ID NO: 118154 - protein, 15 aa, Mycobacterium tuberculosis
WREKELVGVGLARLN

SEQ ID NO: 118155 - protein, 15 aa, Mycobacterium tuberculosis
REKELVGVGLARLNP

SEQ ID NO: 118156 - protein, 15 aa, Mycobacterium tuberculosis
EKELVGVGLARLNPA

SEQ ID NO: 118157 - protein, 15 aa, Mycobacterium tuberculosis
KELVGVGLARLNPAD

SEQ ID NO: 118158 - protein, 15 aa, Mycobacterium tuberculosis
ELVGVGLARLNPADR

SEQ ID NO: 118159 - protein, 15 aa, Mycobacterium tuberculosis
LVGVGLARLNPADRN

SEQ ID NO: 118160 - protein, 15 aa, Mycobacterium tuberculosis
VGVGLARLNPADRNV

SEQ ID NO: 118161 - protein, 15 aa, Mycobacterium tuberculosis
GVGLARLNPADRNVP

SEQ ID NO: 118162 - protein, 15 aa, Mycobacterium tuberculosis
VGLARLNPADRNVPE

SEQ ID NO: 118163 - protein, 15 aa, Mycobacterium tuberculosis
GLARLNPADRNVPEI

SEQ ID NO: 118164 - protein, 15 aa, Mycobacterium tuberculosis
LARLNPADRNVPEIG

SEQ ID NO: 118165 - protein, 15 aa, Mycobacterium tuberculosis
ARLNPADRNVPEIGD

SEQ ID NO: 118166 - protein, 15 aa, Mycobacterium tuberculosis
RLNPADRNVPEIGDE

SEQ ID NO: 118167 - protein, 15 aa, Mycobacterium tuberculosis
LNPADRNVPEIGDEL

SEQ ID NO: 118168 - protein, 15 aa, Mycobacterium tuberculosis
NPADRNVPEIGDELS

SEQ ID NO: 118169 - protein, 15 aa, Mycobacterium tuberculosis
PADRNVPEIGDELSV

SEQ ID NO: 118170 - protein, 15 aa, Mycobacterium tuberculosis
ADRNVPEIGDELSVA

SEQ ID NO: 118171 - protein, 15 aa, Mycobacterium tuberculosis
DRNVPEIGDELSVAR

SEQ ID NO: 118172 - protein, 15 aa, Mycobacterium tuberculosis
RNVPEIGDELSVARA

SEQ ID NO: 118173 - protein, 15 aa, Mycobacterium tuberculosis
NVPEIGDELSVARAL

SEQ ID NO: 118174 - protein, 15 aa, Mycobacterium tuberculosis
VPEIGDELSVARALS

SEQ ID NO: 118175 - protein, 15 aa, Mycobacterium tuberculosis
PEIGDELSVARALSD

SEQ ID NO: 118176 - protein, 15 aa, Mycobacterium tuberculosis
EIGDELSVARALSDL

SEQ ID NO: 118177 - protein, 15 aa, Mycobacterium tuberculosis
IGDELSVARALSDLG

SEQ ID NO: 118178 - protein, 15 aa, Mycobacterium tuberculosis
GDELSVARALSDLGK

SEQ ID NO: 118179 - protein, 15 aa, Mycobacterium tuberculosis
DELSVARALSDLGKR

SEQ ID NO: 118180 - protein, 15 aa, Mycobacterium tuberculosis
ELSVARALSDLGKRM

SEQ ID NO: 118181 - protein, 15 aa, Mycobacterium tuberculosis
LSVARALSDLGKRML

SEQ ID NO: 118182 - protein, 15 aa, Mycobacterium tuberculosis
SVARALSDLGKRMLK

SEQ ID NO: 118183 - protein, 15 aa, Mycobacterium tuberculosis
VARALSDLGKRMLKV

SEQ ID NO: 118184 - protein, 15 aa, Mycobacterium tuberculosis
ARALSDLGKRMLKVS

SEQ ID NO: 118185 - protein, 15 aa, Mycobacterium tuberculosis
RALSDLGKRMLKVST

SEQ ID NO: 118186 - protein, 15 aa, Mycobacterium tuberculosis
ALSDLGKRMLKVSTH

SEQ ID NO: 118187 - protein, 15 aa, Mycobacterium tuberculosis
LSDLGKRMLKVSTHD

SEQ ID NO: 118188 - protein, 15 aa, Mycobacterium tuberculosis
SDLGKRMLKVSTHDI

SEQ ID NO: 118189 - protein, 15 aa, Mycobacterium tuberculosis
DLGKRMLKVSTHDIE

SEQ ID NO: 118190 - protein, 15 aa, Mycobacterium tuberculosis
LGKRMLKVSTHDIEA

SEQ ID NO: 118191 - protein, 15 aa, Mycobacterium tuberculosis
GKRMLKVSTHDIEAV

SEQ ID NO: 118192 - protein, 15 aa, Mycobacterium tuberculosis
KRMLKVSTHDIEAVT

SEQ ID NO: 118193 - protein, 15 aa, Mycobacterium tuberculosis
RMLKVSTHDIEAVTH

SEQ ID NO: 118194 - protein, 15 aa, Mycobacterium tuberculosis
MLKVSTHDIEAVTHQ

SEQ ID NO: 118195 - protein, 15 aa, Mycobacterium tuberculosis
LKVSTHDIEAVTHQP

SEQ ID NO: 118196 - protein, 15 aa, Mycobacterium tuberculosis
KVSTHDIEAVTHQPA

SEQ ID NO: 118197 - protein, 15 aa, Mycobacterium tuberculosis
VSTHDIEAVTHQPAR

SEQ ID NO: 118198 - protein, 15 aa, Mycobacterium tuberculosis
STHDIEAVTHQPARL

SEQ ID NO: 118199 - protein, 15 aa, Mycobacterium tuberculosis
THDIEAVTHQPARLL

SEQ ID NO: 118200 - protein, 15 aa, Mycobacterium tuberculosis
HDIEAVTHQPARLLY

SEQ ID NO: 118201 - protein, 16 aa, Mycobacterium tuberculosis
MCGDQSDHVLQHWTVD

SEQ ID NO: 118202 - protein, 16 aa, Mycobacterium tuberculosis
CGDQSDHVLQHWTVDI

SEQ ID NO: 118203 - protein, 16 aa, Mycobacterium tuberculosis
GDQSDHVLQHWTVDIS

SEQ ID NO: 118204 - protein, 16 aa, Mycobacterium tuberculosis
DQSDHVLQHWTVDISI

SEQ ID NO: 118205 - protein, 16 aa, Mycobacterium tuberculosis
QSDHVLQHWTVDISID

SEQ ID NO: 118206 - protein, 16 aa, Mycobacterium tuberculosis
SDHVLQHWTVDISIDE

SEQ ID NO: 118207 - protein, 16 aa, Mycobacterium tuberculosis
DHVLQHWTVDISIDEH

SEQ ID NO: 118208 - protein, 16 aa, Mycobacterium tuberculosis
HVLQHWTVDISIDEHE

SEQ ID NO: 118209 - protein, 16 aa, Mycobacterium tuberculosis
VLQHWTVDISIDEHEG

SEQ ID NO: 118210 - protein, 16 aa, Mycobacterium tuberculosis
LQHWTVDISIDEHEGL

SEQ ID NO: 118211 - protein, 16 aa, Mycobacterium tuberculosis
QHWTVDISIDEHEGLT

SEQ ID NO: 118212 - protein, 16 aa, Mycobacterium tuberculosis
HWTVDISIDEHEGLTR

SEQ ID NO: 118213 - protein, 16 aa, Mycobacterium tuberculosis
WTVDISIDEHEGLTRA

SEQ ID NO: 118214 - protein, 16 aa, Mycobacterium tuberculosis
TVDISIDEHEGLTRAK

SEQ ID NO: 118215 - protein, 16 aa, Mycobacterium tuberculosis
VDISIDEHEGLTRAKA

SEQ ID NO: 118216 - protein, 16 aa, Mycobacterium tuberculosis
DISIDEHEGLTRAKAR

SEQ ID NO: 118217 - protein, 16 aa, Mycobacterium tuberculosis
ISIDEHEGLTRAKARL

SEQ ID NO: 118218 - protein, 16 aa, Mycobacterium tuberculosis
SIDEHEGLTRAKARLR

SEQ ID NO: 118219 - protein, 16 aa, Mycobacterium tuberculosis
IDEHEGLTRAKARLRW

SEQ ID NO: 118220 - protein, 16 aa, Mycobacterium tuberculosis
DEHEGLTRAKARLRWR

SEQ ID NO: 118221 - protein, 16 aa, Mycobacterium tuberculosis
EHEGLTRAKARLRWRE

SEQ ID NO: 118222 - protein, 16 aa, Mycobacterium tuberculosis
HEGLTRAKARLRWREK

SEQ ID NO: 118223 - protein, 16 aa, Mycobacterium tuberculosis
EGLTRAKARLRWREKE

SEQ ID NO: 118224 - protein, 16 aa, Mycobacterium tuberculosis
GLTRAKARLRWREKEL

SEQ ID NO: 118225 - protein, 16 aa, Mycobacterium tuberculosis
LTRAKARLRWREKELV

SEQ ID NO: 118226 - protein, 16 aa, Mycobacterium tuberculosis
TRAKARLRWREKELVG

SEQ ID NO: 118227 - protein, 16 aa, Mycobacterium tuberculosis
RAKARLRWREKELVGV

SEQ ID NO: 118228 - protein, 16 aa, Mycobacterium tuberculosis
AKARLRWREKELVGVG

SEQ ID NO: 118229 - protein, 16 aa, Mycobacterium tuberculosis
KARLRWREKELVGVGL

SEQ ID NO: 118230 - protein, 16 aa, Mycobacterium tuberculosis
ARLRWREKELVGVGLA

SEQ ID NO: 118231 - protein, 16 aa, Mycobacterium tuberculosis
RLRWREKELVGVGLAR

SEQ ID NO: 118232 - protein, 16 aa, Mycobacterium tuberculosis
LRWREKELVGVGLARL

SEQ ID NO: 118233 - protein, 16 aa, Mycobacterium tuberculosis
RWREKELVGVGLARLN

SEQ ID NO: 118234 - protein, 16 aa, Mycobacterium tuberculosis
WREKELVGVGLARLNP

SEQ ID NO: 118235 - protein, 16 aa, Mycobacterium tuberculosis
REKELVGVGLARLNPA

SEQ ID NO: 118236 - protein, 16 aa, Mycobacterium tuberculosis
EKELVGVGLARLNPAD

SEQ ID NO: 118237 - protein, 16 aa, Mycobacterium tuberculosis
KELVGVGLARLNPADR

SEQ ID NO: 118238 - protein, 16 aa, Mycobacterium tuberculosis
ELVGVGLARLNPADRN

SEQ ID NO: 118239 - protein, 16 aa, Mycobacterium tuberculosis
LVGVGLARLNPADRNV

SEQ ID NO: 118240 - protein, 16 aa, Mycobacterium tuberculosis
VGVGLARLNPADRNVP

SEQ ID NO: 118241 - protein, 16 aa, Mycobacterium tuberculosis
GVGLARLNPADRNVPE

SEQ ID NO: 118242 - protein, 16 aa, Mycobacterium tuberculosis
VGLARLNPADRNVPEI

SEQ ID NO: 118243 - protein, 16 aa, Mycobacterium tuberculosis
GLARLNPADRNVPEIG

SEQ ID NO: 118244 - protein, 16 aa, Mycobacterium tuberculosis
LARLNPADRNVPEIGD

SEQ ID NO: 118245 - protein, 16 aa, Mycobacterium tuberculosis
ARLNPADRNVPEIGDE

SEQ ID NO: 118246 - protein, 16 aa, Mycobacterium tuberculosis
RLNPADRNVPEIGDEL

SEQ ID NO: 118247 - protein, 16 aa, Mycobacterium tuberculosis
LNPADRNVPEIGDELS

SEQ ID NO: 118248 - protein, 16 aa, Mycobacterium tuberculosis
NPADRNVPEIGDELSV

SEQ ID NO: 118249 - protein, 16 aa, Mycobacterium tuberculosis
PADRNVPEIGDELSVA

SEQ ID NO: 118250 - protein, 16 aa, Mycobacterium tuberculosis
ADRNVPEIGDELSVAR

SEQ ID NO: 118251 - protein, 16 aa, Mycobacterium tuberculosis
DRNVPEIGDELSVARA

SEQ ID NO: 118252 - protein, 16 aa, Mycobacterium tuberculosis
RNVPEIGDELSVARAL

SEQ ID NO: 118253 - protein, 16 aa, Mycobacterium tuberculosis
NVPEIGDELSVARALS

SEQ ID NO: 118254 - protein, 16 aa, Mycobacterium tuberculosis
VPEIGDELSVARALSD

SEQ ID NO: 118255 - protein, 16 aa, Mycobacterium tuberculosis
PEIGDELSVARALSDL

SEQ ID NO: 118256 - protein, 16 aa, Mycobacterium tuberculosis
EIGDELSVARALSDLG

SEQ ID NO: 118257 - protein, 16 aa, Mycobacterium tuberculosis
IGDELSVARALSDLGK

SEQ ID NO: 118258 - protein, 16 aa, Mycobacterium tuberculosis
GDELSVARALSDLGKR

SEQ ID NO: 118259 - protein, 16 aa, Mycobacterium tuberculosis
DELSVARALSDLGKRM

SEQ ID NO: 118260 - protein, 16 aa, Mycobacterium tuberculosis
ELSVARALSDLGKRML

SEQ ID NO: 118261 - protein, 16 aa, Mycobacterium tuberculosis
LSVARALSDLGKRMLK

SEQ ID NO: 118262 - protein, 16 aa, Mycobacterium tuberculosis
SVARALSDLGKRMLKV

SEQ ID NO: 118263 - protein, 16 aa, Mycobacterium tuberculosis
VARALSDLGKRMLKVS

SEQ ID NO: 118264 - protein, 16 aa, Mycobacterium tuberculosis
ARALSDLGKRMLKVST

SEQ ID NO: 118265 - protein, 16 aa, Mycobacterium tuberculosis
RALSDLGKRMLKVSTH

SEQ ID NO: 118266 - protein, 16 aa, Mycobacterium tuberculosis
ALSDLGKRMLKVSTHD

SEQ ID NO: 118267 - protein, 16 aa, Mycobacterium tuberculosis
LSDLGKRMLKVSTHDI

SEQ ID NO: 118268 - protein, 16 aa, Mycobacterium tuberculosis
SDLGKRMLKVSTHDIE

SEQ ID NO: 118269 - protein, 16 aa, Mycobacterium tuberculosis
DLGKRMLKVSTHDIEA

SEQ ID NO: 118270 - protein, 16 aa, Mycobacterium tuberculosis
LGKRMLKVSTHDIEAV

SEQ ID NO: 118271 - protein, 16 aa, Mycobacterium tuberculosis
GKRMLKVSTHDIEAVT

SEQ ID NO: 118272 - protein, 16 aa, Mycobacterium tuberculosis
KRMLKVSTHDIEAVTH

SEQ ID NO: 118273 - protein, 16 aa, Mycobacterium tuberculosis
RMLKVSTHDIEAVTHQ

SEQ ID NO: 118274 - protein, 16 aa, Mycobacterium tuberculosis
MLKVSTHDIEAVTHQP

SEQ ID NO: 118275 - protein, 16 aa, Mycobacterium tuberculosis
LKVSTHDIEAVTHQPA

SEQ ID NO: 118276 - protein, 16 aa, Mycobacterium tuberculosis
KVSTHDIEAVTHQPAR

SEQ ID NO: 118277 - protein, 16 aa, Mycobacterium tuberculosis
VSTHDIEAVTHQPARL

SEQ ID NO: 118278 - protein, 16 aa, Mycobacterium tuberculosis
STHDIEAVTHQPARLL

SEQ ID NO: 118279 - protein, 16 aa, Mycobacterium tuberculosis
THDIEAVTHQPARLLY

SEQ ID NO: 118280 - protein, 172 aa, Mycobacterium tuberculosis
MKNARTTLIAAAIAGTLVTTSPAGIANADDAGLDPNAAAGPDAVGFDPNLPPAPDAAPVDTPPAPEDAGFDPNLPPPLAPDFLSPPAEEAPPVPVAYSVNWDAIAQCESGGNWSINTGNGYYGGLRFTAGTWRANGGSGSAANASREEQIRVAENVLRSQGIRAWPVCGRRG

SEQ ID NO: 118281 - protein, 8 aa, Mycobacterium tuberculosis
RTTLIAAA

SEQ ID NO: 118282 - protein, 8 aa, Mycobacterium tuberculosis
TTLIAAAI

SEQ ID NO: 118283 - protein, 8 aa, Mycobacterium tuberculosis
TLIAAAIA

SEQ ID NO: 118284 - protein, 8 aa, Mycobacterium tuberculosis
AAAIAGTL

SEQ ID NO: 118285 - protein, 8 aa, Mycobacterium tuberculosis
AAIAGTLV

SEQ ID NO: 118286 - protein, 8 aa, Mycobacterium tuberculosis
TLVTTSPA

SEQ ID NO: 118287 - protein, 8 aa, Mycobacterium tuberculosis
TTSPAGIA

SEQ ID NO: 118288 - protein, 8 aa, Mycobacterium tuberculosis
SPAGIANA

SEQ ID NO: 118289 - protein, 8 aa, Mycobacterium tuberculosis
GLDPNAAA

SEQ ID NO: 118290 - protein, 8 aa, Mycobacterium tuberculosis
AAAGPDAV

SEQ ID NO: 118291 - protein, 8 aa, Mycobacterium tuberculosis
NLPPAPDA

SEQ ID NO: 118292 - protein, 8 aa, Mycobacterium tuberculosis
LPPAPDAA

SEQ ID NO: 118293 - protein, 8 aa, Mycobacterium tuberculosis
PAPDAAPV

SEQ ID NO: 118294 - protein, 8 aa, Mycobacterium tuberculosis
APVDTPPA

SEQ ID NO: 118295 - protein, 8 aa, Mycobacterium tuberculosis
DPNLPPPL

SEQ ID NO: 118296 - protein, 8 aa, Mycobacterium tuberculosis
LPPPLAPD

SEQ ID NO: 118297 - protein, 8 aa, Mycobacterium tuberculosis
PLAPDFLS

SEQ ID NO: 118298 - protein, 8 aa, Mycobacterium tuberculosis
FLSPPAEE

SEQ ID NO: 118299 - protein, 8 aa, Mycobacterium tuberculosis
EEAPPVPV

SEQ ID NO: 118300 - protein, 8 aa, Mycobacterium tuberculosis
EAPPVPVA

SEQ ID NO: 118301 - protein, 8 aa, Mycobacterium tuberculosis
APPVPVAY

SEQ ID NO: 118302 - protein, 8 aa, Mycobacterium tuberculosis
PVPVAYSV

SEQ ID NO: 118303 - protein, 8 aa, Mycobacterium tuberculosis
YSVNWDAI

SEQ ID NO: 118304 - protein, 8 aa, Mycobacterium tuberculosis
SVNWDAIA

SEQ ID NO: 118305 - protein, 8 aa, Mycobacterium tuberculosis
ESGGNWSI

SEQ ID NO: 118306 - protein, 8 aa, Mycobacterium tuberculosis
SINTGNGY

SEQ ID NO: 118307 - protein, 8 aa, Mycobacterium tuberculosis
NGYYGGLR

SEQ ID NO: 118308 - protein, 8 aa, Mycobacterium tuberculosis
GYYGGLRF

SEQ ID NO: 118309 - protein, 8 aa, Mycobacterium tuberculosis
GLRFTAGT

SEQ ID NO: 118310 - protein, 8 aa, Mycobacterium tuberculosis
RFTAGTWR

SEQ ID NO: 118311 - protein, 8 aa, Mycobacterium tuberculosis
FTAGTWRA

SEQ ID NO: 118312 - protein, 8 aa, Mycobacterium tuberculosis
GSAANASR

SEQ ID NO: 118313 - protein, 8 aa, Mycobacterium tuberculosis
RVAENVLR

SEQ ID NO: 118314 - protein, 8 aa, Mycobacterium tuberculosis
AENVLRSQ

SEQ ID NO: 118315 - protein, 8 aa, Mycobacterium tuberculosis
NVLRSQGI

SEQ ID NO: 118316 - protein, 8 aa, Mycobacterium tuberculosis
VLRSQGIR

SEQ ID NO: 118317 - protein, 8 aa, Mycobacterium tuberculosis
RSQGIRAW

SEQ ID NO: 118318 - protein, 8 aa, Mycobacterium tuberculosis
QGIRAWPV

SEQ ID NO: 118319 - protein, 8 aa, Mycobacterium tuberculosis
RAWPVCGR

SEQ ID NO: 118320 - protein, 9 aa, Mycobacterium tuberculosis
MKNARTTLI

SEQ ID NO: 118321 - protein, 9 aa, Mycobacterium tuberculosis
RTTLIAAAI

SEQ ID NO: 118322 - protein, 9 aa, Mycobacterium tuberculosis
LIAAAIAGT

SEQ ID NO: 118323 - protein, 9 aa, Mycobacterium tuberculosis
IAAAIAGTL

SEQ ID NO: 118324 - protein, 9 aa, Mycobacterium tuberculosis
AAAIAGTLV

SEQ ID NO: 118325 - protein, 9 aa, Mycobacterium tuberculosis
AIAGTLVTT

SEQ ID NO: 118326 - protein, 9 aa, Mycobacterium tuberculosis
LVTTSPAGI

SEQ ID NO: 118327 - protein, 9 aa, Mycobacterium tuberculosis
TSPAGIANA

SEQ ID NO: 118328 - protein, 9 aa, Mycobacterium tuberculosis
IANADDAGL

SEQ ID NO: 118329 - protein, 9 aa, Mycobacterium tuberculosis
GLDPNAAAG

SEQ ID NO: 118330 - protein, 9 aa, Mycobacterium tuberculosis
NAAAGPDAV

SEQ ID NO: 118331 - protein, 9 aa, Mycobacterium tuberculosis
AAGPDAVGF

SEQ ID NO: 118332 - protein, 9 aa, Mycobacterium tuberculosis
NLPPAPDAA

SEQ ID NO: 118333 - protein, 9 aa, Mycobacterium tuberculosis
PPAPDAAPV

SEQ ID NO: 118334 - protein, 9 aa, Mycobacterium tuberculosis
PPAPEDAGF

SEQ ID NO: 118335 - protein, 9 aa, Mycobacterium tuberculosis
LPPPLAPDF

SEQ ID NO: 118336 - protein, 9 aa, Mycobacterium tuberculosis
APDFLSPPA

SEQ ID NO: 118337 - protein, 9 aa, Mycobacterium tuberculosis
FLSPPAEEA

SEQ ID NO: 118338 - protein, 9 aa, Mycobacterium tuberculosis
PPAEEAPPV

SEQ ID NO: 118339 - protein, 9 aa, Mycobacterium tuberculosis
AEEAPPVPV

SEQ ID NO: 118340 - protein, 9 aa, Mycobacterium tuberculosis
EAPPVPVAY

SEQ ID NO: 118341 - protein, 9 aa, Mycobacterium tuberculosis
PPVPVAYSV

SEQ ID NO: 118342 - protein, 9 aa, Mycobacterium tuberculosis
VPVAYSVNW

SEQ ID NO: 118343 - protein, 9 aa, Mycobacterium tuberculosis
AYSVNWDAI

SEQ ID NO: 118344 - protein, 9 aa, Mycobacterium tuberculosis
CESGGNWSI

SEQ ID NO: 118345 - protein, 9 aa, Mycobacterium tuberculosis
WSINTGNGY

SEQ ID NO: 118346 - protein, 9 aa, Mycobacterium tuberculosis
SINTGNGYY

SEQ ID NO: 118347 - protein, 9 aa, Mycobacterium tuberculosis
TGNGYYGGL

SEQ ID NO: 118348 - protein, 9 aa, Mycobacterium tuberculosis
YYGGLRFTA

SEQ ID NO: 118349 - protein, 9 aa, Mycobacterium tuberculosis
RFTAGTWRA

SEQ ID NO: 118350 - protein, 9 aa, Mycobacterium tuberculosis
RANGGSGSA

SEQ ID NO: 118351 - protein, 9 aa, Mycobacterium tuberculosis
NASREEQIR

SEQ ID NO: 118352 - protein, 9 aa, Mycobacterium tuberculosis
EQIRVAENV

SEQ ID NO: 118353 - protein, 9 aa, Mycobacterium tuberculosis
AENVLRSQG

SEQ ID NO: 118354 - protein, 9 aa, Mycobacterium tuberculosis
NVLRSQGIR

SEQ ID NO: 118355 - protein, 9 aa, Mycobacterium tuberculosis
VLRSQGIRA

SEQ ID NO: 118356 - protein, 9 aa, Mycobacterium tuberculosis
SQGIRAWPV

SEQ ID NO: 118357 - protein, 9 aa, Mycobacterium tuberculosis
RAWPVCGRR

SEQ ID NO: 118358 - protein, 10 aa, Mycobacterium tuberculosis
TLIAAAIAGT

SEQ ID NO: 118359 - protein, 10 aa, Mycobacterium tuberculosis
LIAAAIAGTL

SEQ ID NO: 118360 - protein, 10 aa, Mycobacterium tuberculosis
IAAAIAGTLV

SEQ ID NO: 118361 - protein, 10 aa, Mycobacterium tuberculosis
AAIAGTLVTT

SEQ ID NO: 118362 - protein, 10 aa, Mycobacterium tuberculosis
TLVTTSPAGI

SEQ ID NO: 118363 - protein, 10 aa, Mycobacterium tuberculosis
TTSPAGIANA

SEQ ID NO: 118364 - protein, 10 aa, Mycobacterium tuberculosis
GIANADDAGL

SEQ ID NO: 118365 - protein, 10 aa, Mycobacterium tuberculosis
GLDPNAAAGP

SEQ ID NO: 118366 - protein, 10 aa, Mycobacterium tuberculosis
AAAGPDAVGF

SEQ ID NO: 118367 - protein, 10 aa, Mycobacterium tuberculosis
LPPAPDAAPV

SEQ ID NO: 118368 - protein, 10 aa, Mycobacterium tuberculosis
DAAPVDTPPA

SEQ ID NO: 118369 - protein, 10 aa, Mycobacterium tuberculosis
APVDTPPAPE

SEQ ID NO: 118370 - protein, 10 aa, Mycobacterium tuberculosis
TPPAPEDAGF

SEQ ID NO: 118371 - protein, 10 aa, Mycobacterium tuberculosis
PEDAGFDPNL

SEQ ID NO: 118372 - protein, 10 aa, Mycobacterium tuberculosis
GFDPNLPPPL

SEQ ID NO: 118373 - protein, 10 aa, Mycobacterium tuberculosis
NLPPPLAPDF

SEQ ID NO: 118374 - protein, 10 aa, Mycobacterium tuberculosis
LPPPLAPDFL

SEQ ID NO: 118375 - protein, 10 aa, Mycobacterium tuberculosis
LAPDFLSPPA

SEQ ID NO: 118376 - protein, 10 aa, Mycobacterium tuberculosis
FLSPPAEEAP

SEQ ID NO: 118377 - protein, 10 aa, Mycobacterium tuberculosis
PAEEAPPVPV

SEQ ID NO: 118378 - protein, 10 aa, Mycobacterium tuberculosis
AEEAPPVPVA

SEQ ID NO: 118379 - protein, 10 aa, Mycobacterium tuberculosis
EEAPPVPVAY

SEQ ID NO: 118380 - protein, 10 aa, Mycobacterium tuberculosis
EAPPVPVAYS

SEQ ID NO: 118381 - protein, 10 aa, Mycobacterium tuberculosis
APPVPVAYSV

SEQ ID NO: 118382 - protein, 10 aa, Mycobacterium tuberculosis
IAQCESGGNW

SEQ ID NO: 118383 - protein, 10 aa, Mycobacterium tuberculosis
WSINTGNGYY

SEQ ID NO: 118384 - protein, 10 aa, Mycobacterium tuberculosis
NTGNGYYGGL

SEQ ID NO: 118385 - protein, 10 aa, Mycobacterium tuberculosis
TGNGYYGGLR

SEQ ID NO: 118386 - protein, 10 aa, Mycobacterium tuberculosis
GYYGGLRFTA

SEQ ID NO: 118387 - protein, 10 aa, Mycobacterium tuberculosis
GGLRFTAGTW

SEQ ID NO: 118388 - protein, 10 aa, Mycobacterium tuberculosis
GLRFTAGTWR

SEQ ID NO: 118389 - protein, 10 aa, Mycobacterium tuberculosis
RANGGSGSAA

SEQ ID NO: 118390 - protein, 10 aa, Mycobacterium tuberculosis
EEQIRVAENV

SEQ ID NO: 118391 - protein, 10 aa, Mycobacterium tuberculosis
QIRVAENVLR

SEQ ID NO: 118392 - protein, 10 aa, Mycobacterium tuberculosis
AENVLRSQGI

SEQ ID NO: 118393 - protein, 10 aa, Mycobacterium tuberculosis
ENVLRSQGIR

SEQ ID NO: 118394 - protein, 10 aa, Mycobacterium tuberculosis
RSQGIRAWPV

SEQ ID NO: 118395 - protein, 10 aa, Mycobacterium tuberculosis
GIRAWPVCGR

SEQ ID NO: 118396 - protein, 11 aa, Mycobacterium tuberculosis
NARTTLIAAAI

SEQ ID NO: 118397 - protein, 11 aa, Mycobacterium tuberculosis
TLIAAAIAGTL

SEQ ID NO: 118398 - protein, 11 aa, Mycobacterium tuberculosis
LIAAAIAGTLV

SEQ ID NO: 118399 - protein, 11 aa, Mycobacterium tuberculosis
SPAGIANADDA

SEQ ID NO: 118400 - protein, 11 aa, Mycobacterium tuberculosis
DPNAAAGPDAV

SEQ ID NO: 118401 - protein, 11 aa, Mycobacterium tuberculosis
NAAAGPDAVGF

SEQ ID NO: 118402 - protein, 11 aa, Mycobacterium tuberculosis
DPNLPPAPDAA

SEQ ID NO: 118403 - protein, 11 aa, Mycobacterium tuberculosis
NLPPAPDAAPV

SEQ ID NO: 118404 - protein, 11 aa, Mycobacterium tuberculosis
DTPPAPEDAGF

SEQ ID NO: 118405 - protein, 11 aa, Mycobacterium tuberculosis
NLPPPLAPDFL

SEQ ID NO: 118406 - protein, 11 aa, Mycobacterium tuberculosis
LPPPLAPDFLS

SEQ ID NO: 118407 - protein, 11 aa, Mycobacterium tuberculosis
PLAPDFLSPPA

SEQ ID NO: 118408 - protein, 11 aa, Mycobacterium tuberculosis
FLSPPAEEAPP

SEQ ID NO: 118409 - protein, 11 aa, Mycobacterium tuberculosis
PPAEEAPPVPV

SEQ ID NO: 118410 - protein, 11 aa, Mycobacterium tuberculosis
AEEAPPVPVAY

SEQ ID NO: 118411 - protein, 11 aa, Mycobacterium tuberculosis
EAPPVPVAYSV

SEQ ID NO: 118412 - protein, 11 aa, Mycobacterium tuberculosis
PPVPVAYSVNW

SEQ ID NO: 118413 - protein, 11 aa, Mycobacterium tuberculosis
VPVAYSVNWDA

SEQ ID NO: 118414 - protein, 11 aa, Mycobacterium tuberculosis
AQCESGGNWSI

SEQ ID NO: 118415 - protein, 11 aa, Mycobacterium tuberculosis
NWSINTGNGYY

SEQ ID NO: 118416 - protein, 11 aa, Mycobacterium tuberculosis
NTGNGYYGGLR

SEQ ID NO: 118417 - protein, 11 aa, Mycobacterium tuberculosis
GLRFTAGTWRA

SEQ ID NO: 118418 - protein, 11 aa, Mycobacterium tuberculosis
AANASREEQIR

SEQ ID NO: 118419 - protein, 11 aa, Mycobacterium tuberculosis
REEQIRVAENV

SEQ ID NO: 118420 - protein, 11 aa, Mycobacterium tuberculosis
EEQIRVAENVL

SEQ ID NO: 118421 - protein, 11 aa, Mycobacterium tuberculosis
EQIRVAENVLR

SEQ ID NO: 118422 - protein, 11 aa, Mycobacterium tuberculosis
GIRAWPVCGRR

SEQ ID NO: 118423 - protein, 13 aa, Mycobacterium tuberculosis
MKNARTTLIAAAI

SEQ ID NO: 118424 - protein, 13 aa, Mycobacterium tuberculosis
KNARTTLIAAAIA

SEQ ID NO: 118425 - protein, 13 aa, Mycobacterium tuberculosis
NARTTLIAAAIAG

SEQ ID NO: 118426 - protein, 13 aa, Mycobacterium tuberculosis
ARTTLIAAAIAGT

SEQ ID NO: 118427 - protein, 13 aa, Mycobacterium tuberculosis
RTTLIAAAIAGTL

SEQ ID NO: 118428 - protein, 13 aa, Mycobacterium tuberculosis
TTLIAAAIAGTLV

SEQ ID NO: 118429 - protein, 13 aa, Mycobacterium tuberculosis
TLIAAAIAGTLVT

SEQ ID NO: 118430 - protein, 13 aa, Mycobacterium tuberculosis
LIAAAIAGTLVTT

SEQ ID NO: 118431 - protein, 13 aa, Mycobacterium tuberculosis
IAAAIAGTLVTTS

SEQ ID NO: 118432 - protein, 13 aa, Mycobacterium tuberculosis
AAAIAGTLVTTSP

SEQ ID NO: 118433 - protein, 13 aa, Mycobacterium tuberculosis
AAIAGTLVTTSPA

SEQ ID NO: 118434 - protein, 13 aa, Mycobacterium tuberculosis
AIAGTLVTTSPAG

SEQ ID NO: 118435 - protein, 13 aa, Mycobacterium tuberculosis
IAGTLVTTSPAGI

SEQ ID NO: 118436 - protein, 13 aa, Mycobacterium tuberculosis
AGTLVTTSPAGIA

SEQ ID NO: 118437 - protein, 13 aa, Mycobacterium tuberculosis
GTLVTTSPAGIAN

SEQ ID NO: 118438 - protein, 13 aa, Mycobacterium tuberculosis
TLVTTSPAGIANA

SEQ ID NO: 118439 - protein, 13 aa, Mycobacterium tuberculosis
LVTTSPAGIANAD

SEQ ID NO: 118440 - protein, 13 aa, Mycobacterium tuberculosis
VTTSPAGIANADD

SEQ ID NO: 118441 - protein, 13 aa, Mycobacterium tuberculosis
TTSPAGIANADDA

SEQ ID NO: 118442 - protein, 13 aa, Mycobacterium tuberculosis
TSPAGIANADDAG

SEQ ID NO: 118443 - protein, 13 aa, Mycobacterium tuberculosis
SPAGIANADDAGL

SEQ ID NO: 118444 - protein, 13 aa, Mycobacterium tuberculosis
PAGIANADDAGLD

SEQ ID NO: 118445 - protein, 13 aa, Mycobacterium tuberculosis
AGIANADDAGLDP

SEQ ID NO: 118446 - protein, 13 aa, Mycobacterium tuberculosis
GIANADDAGLDPN

SEQ ID NO: 118447 - protein, 13 aa, Mycobacterium tuberculosis
IANADDAGLDPNA

SEQ ID NO: 118448 - protein, 13 aa, Mycobacterium tuberculosis
ANADDAGLDPNAA

SEQ ID NO: 118449 - protein, 13 aa, Mycobacterium tuberculosis
NADDAGLDPNAAA

SEQ ID NO: 118450 - protein, 13 aa, Mycobacterium tuberculosis
ADDAGLDPNAAAG

SEQ ID NO: 118451 - protein, 13 aa, Mycobacterium tuberculosis
DDAGLDPNAAAGP

SEQ ID NO: 118452 - protein, 13 aa, Mycobacterium tuberculosis
DAGLDPNAAAGPD

SEQ ID NO: 118453 - protein, 13 aa, Mycobacterium tuberculosis
AGLDPNAAAGPDA

SEQ ID NO: 118454 - protein, 13 aa, Mycobacterium tuberculosis
GLDPNAAAGPDAV

SEQ ID NO: 118455 - protein, 13 aa, Mycobacterium tuberculosis
LDPNAAAGPDAVG

SEQ ID NO: 118456 - protein, 13 aa, Mycobacterium tuberculosis
DPNAAAGPDAVGF

SEQ ID NO: 118457 - protein, 13 aa, Mycobacterium tuberculosis
PNAAAGPDAVGFD

SEQ ID NO: 118458 - protein, 13 aa, Mycobacterium tuberculosis
NAAAGPDAVGFDP

SEQ ID NO: 118459 - protein, 13 aa, Mycobacterium tuberculosis
AAAGPDAVGFDPN

SEQ ID NO: 118460 - protein, 13 aa, Mycobacterium tuberculosis
AAGPDAVGFDPNL

SEQ ID NO: 118461 - protein, 13 aa, Mycobacterium tuberculosis
AGPDAVGFDPNLP

SEQ ID NO: 118462 - protein, 13 aa, Mycobacterium tuberculosis
GPDAVGFDPNLPP

SEQ ID NO: 118463 - protein, 13 aa, Mycobacterium tuberculosis
PDAVGFDPNLPPA

SEQ ID NO: 118464 - protein, 13 aa, Mycobacterium tuberculosis
DAVGFDPNLPPAP

SEQ ID NO: 118465 - protein, 13 aa, Mycobacterium tuberculosis
AVGFDPNLPPAPD

SEQ ID NO: 118466 - protein, 13 aa, Mycobacterium tuberculosis
VGFDPNLPPAPDA

SEQ ID NO: 118467 - protein, 13 aa, Mycobacterium tuberculosis
GFDPNLPPAPDAA

SEQ ID NO: 118468 - protein, 13 aa, Mycobacterium tuberculosis
FDPNLPPAPDAAP

SEQ ID NO: 118469 - protein, 13 aa, Mycobacterium tuberculosis
DPNLPPAPDAAPV

SEQ ID NO: 118470 - protein, 13 aa, Mycobacterium tuberculosis
PNLPPAPDAAPVD

SEQ ID NO: 118471 - protein, 13 aa, Mycobacterium tuberculosis
NLPPAPDAAPVDT

SEQ ID NO: 118472 - protein, 13 aa, Mycobacterium tuberculosis
LPPAPDAAPVDTP

SEQ ID NO: 118473 - protein, 13 aa, Mycobacterium tuberculosis
PPAPDAAPVDTPP

SEQ ID NO: 118474 - protein, 13 aa, Mycobacterium tuberculosis
PAPDAAPVDTPPA

SEQ ID NO: 118475 - protein, 13 aa, Mycobacterium tuberculosis
APDAAPVDTPPAP

SEQ ID NO: 118476 - protein, 13 aa, Mycobacterium tuberculosis
PDAAPVDTPPAPE

SEQ ID NO: 118477 - protein, 13 aa, Mycobacterium tuberculosis
DAAPVDTPPAPED

SEQ ID NO: 118478 - protein, 13 aa, Mycobacterium tuberculosis
AAPVDTPPAPEDA

SEQ ID NO: 118479 - protein, 13 aa, Mycobacterium tuberculosis
APVDTPPAPEDAG

SEQ ID NO: 118480 - protein, 13 aa, Mycobacterium tuberculosis
PVDTPPAPEDAGF

SEQ ID NO: 118481 - protein, 13 aa, Mycobacterium tuberculosis
VDTPPAPEDAGFD

SEQ ID NO: 118482 - protein, 13 aa, Mycobacterium tuberculosis
DTPPAPEDAGFDP

SEQ ID NO: 118483 - protein, 13 aa, Mycobacterium tuberculosis
TPPAPEDAGFDPN

SEQ ID NO: 118484 - protein, 13 aa, Mycobacterium tuberculosis
PPAPEDAGFDPNL

SEQ ID NO: 118485 - protein, 13 aa, Mycobacterium tuberculosis
PAPEDAGFDPNLP

SEQ ID NO: 118486 - protein, 13 aa, Mycobacterium tuberculosis
APEDAGFDPNLPP

SEQ ID NO: 118487 - protein, 13 aa, Mycobacterium tuberculosis
PEDAGFDPNLPPP

SEQ ID NO: 118488 - protein, 13 aa, Mycobacterium tuberculosis
EDAGFDPNLPPPL

SEQ ID NO: 118489 - protein, 13 aa, Mycobacterium tuberculosis
DAGFDPNLPPPLA

SEQ ID NO: 118490 - protein, 13 aa, Mycobacterium tuberculosis
AGFDPNLPPPLAP

SEQ ID NO: 118491 - protein, 13 aa, Mycobacterium tuberculosis
GFDPNLPPPLAPD

SEQ ID NO: 118492 - protein, 13 aa, Mycobacterium tuberculosis
FDPNLPPPLAPDF

SEQ ID NO: 118493 - protein, 13 aa, Mycobacterium tuberculosis
DPNLPPPLAPDFL

SEQ ID NO: 118494 - protein, 13 aa, Mycobacterium tuberculosis
PNLPPPLAPDFLS

SEQ ID NO: 118495 - protein, 13 aa, Mycobacterium tuberculosis
NLPPPLAPDFLSP

SEQ ID NO: 118496 - protein, 13 aa, Mycobacterium tuberculosis
LPPPLAPDFLSPP

SEQ ID NO: 118497 - protein, 13 aa, Mycobacterium tuberculosis
PPPLAPDFLSPPA

SEQ ID NO: 118498 - protein, 13 aa, Mycobacterium tuberculosis
PPLAPDFLSPPAE

SEQ ID NO: 118499 - protein, 13 aa, Mycobacterium tuberculosis
PLAPDFLSPPAEE

SEQ ID NO: 118500 - protein, 13 aa, Mycobacterium tuberculosis
LAPDFLSPPAEEA

SEQ ID NO: 118501 - protein, 13 aa, Mycobacterium tuberculosis
APDFLSPPAEEAP

SEQ ID NO: 118502 - protein, 13 aa, Mycobacterium tuberculosis
PDFLSPPAEEAPP

SEQ ID NO: 118503 - protein, 13 aa, Mycobacterium tuberculosis
DFLSPPAEEAPPV

SEQ ID NO: 118504 - protein, 13 aa, Mycobacterium tuberculosis
FLSPPAEEAPPVP

SEQ ID NO: 118505 - protein, 13 aa, Mycobacterium tuberculosis
LSPPAEEAPPVPV

SEQ ID NO: 118506 - protein, 13 aa, Mycobacterium tuberculosis
SPPAEEAPPVPVA

SEQ ID NO: 118507 - protein, 13 aa, Mycobacterium tuberculosis
PPAEEAPPVPVAY

SEQ ID NO: 118508 - protein, 13 aa, Mycobacterium tuberculosis
PAEEAPPVPVAYS

SEQ ID NO: 118509 - protein, 13 aa, Mycobacterium tuberculosis
AEEAPPVPVAYSV

SEQ ID NO: 118510 - protein, 13 aa, Mycobacterium tuberculosis
EEAPPVPVAYSVN

SEQ ID NO: 118511 - protein, 13 aa, Mycobacterium tuberculosis
EAPPVPVAYSVNW

SEQ ID NO: 118512 - protein, 13 aa, Mycobacterium tuberculosis
APPVPVAYSVNWD

SEQ ID NO: 118513 - protein, 13 aa, Mycobacterium tuberculosis
PPVPVAYSVNWDA

SEQ ID NO: 118514 - protein, 13 aa, Mycobacterium tuberculosis
PVPVAYSVNWDAI

SEQ ID NO: 118515 - protein, 13 aa, Mycobacterium tuberculosis
VPVAYSVNWDAIA

SEQ ID NO: 118516 - protein, 13 aa, Mycobacterium tuberculosis
PVAYSVNWDAIAQ

SEQ ID NO: 118517 - protein, 13 aa, Mycobacterium tuberculosis
VAYSVNWDAIAQC

SEQ ID NO: 118518 - protein, 13 aa, Mycobacterium tuberculosis
AYSVNWDAIAQCE

SEQ ID NO: 118519 - protein, 13 aa, Mycobacterium tuberculosis
YSVNWDAIAQCES

SEQ ID NO: 118520 - protein, 13 aa, Mycobacterium tuberculosis
SVNWDAIAQCESG

SEQ ID NO: 118521 - protein, 13 aa, Mycobacterium tuberculosis
VNWDAIAQCESGG

SEQ ID NO: 118522 - protein, 13 aa, Mycobacterium tuberculosis
NWDAIAQCESGGN

SEQ ID NO: 118523 - protein, 13 aa, Mycobacterium tuberculosis
WDAIAQCESGGNW

SEQ ID NO: 118524 - protein, 13 aa, Mycobacterium tuberculosis
DAIAQCESGGNWS

SEQ ID NO: 118525 - protein, 13 aa, Mycobacterium tuberculosis
AIAQCESGGNWSI

SEQ ID NO: 118526 - protein, 13 aa, Mycobacterium tuberculosis
IAQCESGGNWSIN

SEQ ID NO: 118527 - protein, 13 aa, Mycobacterium tuberculosis
AQCESGGNWSINT

SEQ ID NO: 118528 - protein, 13 aa, Mycobacterium tuberculosis
QCESGGNWSINTG

SEQ ID NO: 118529 - protein, 13 aa, Mycobacterium tuberculosis
CESGGNWSINTGN

SEQ ID NO: 118530 - protein, 13 aa, Mycobacterium tuberculosis
ESGGNWSINTGNG

SEQ ID NO: 118531 - protein, 13 aa, Mycobacterium tuberculosis
SGGNWSINTGNGY

SEQ ID NO: 118532 - protein, 13 aa, Mycobacterium tuberculosis
GGNWSINTGNGYY

SEQ ID NO: 118533 - protein, 13 aa, Mycobacterium tuberculosis
GNWSINTGNGYYG

SEQ ID NO: 118534 - protein, 13 aa, Mycobacterium tuberculosis
NWSINTGNGYYGG

SEQ ID NO: 118535 - protein, 13 aa, Mycobacterium tuberculosis
WSINTGNGYYGGL

SEQ ID NO: 118536 - protein, 13 aa, Mycobacterium tuberculosis
SINTGNGYYGGLR

SEQ ID NO: 118537 - protein, 13 aa, Mycobacterium tuberculosis
INTGNGYYGGLRF

SEQ ID NO: 118538 - protein, 13 aa, Mycobacterium tuberculosis
NTGNGYYGGLRFT

SEQ ID NO: 118539 - protein, 13 aa, Mycobacterium tuberculosis
TGNGYYGGLRFTA

SEQ ID NO: 118540 - protein, 13 aa, Mycobacterium tuberculosis
GNGYYGGLRFTAG

SEQ ID NO: 118541 - protein, 13 aa, Mycobacterium tuberculosis
NGYYGGLRFTAGT

SEQ ID NO: 118542 - protein, 13 aa, Mycobacterium tuberculosis
GYYGGLRFTAGTW

SEQ ID NO: 118543 - protein, 13 aa, Mycobacterium tuberculosis
YYGGLRFTAGTWR

SEQ ID NO: 118544 - protein, 13 aa, Mycobacterium tuberculosis
YGGLRFTAGTWRA

SEQ ID NO: 118545 - protein, 13 aa, Mycobacterium tuberculosis
GGLRFTAGTWRAN

SEQ ID NO: 118546 - protein, 13 aa, Mycobacterium tuberculosis
GLRFTAGTWRANG

SEQ ID NO: 118547 - protein, 13 aa, Mycobacterium tuberculosis
LRFTAGTWRANGG

SEQ ID NO: 118548 - protein, 13 aa, Mycobacterium tuberculosis
RFTAGTWRANGGS

SEQ ID NO: 118549 - protein, 13 aa, Mycobacterium tuberculosis
FTAGTWRANGGSG

SEQ ID NO: 118550 - protein, 13 aa, Mycobacterium tuberculosis
TAGTWRANGGSGS

SEQ ID NO: 118551 - protein, 13 aa, Mycobacterium tuberculosis
AGTWRANGGSGSA

SEQ ID NO: 118552 - protein, 13 aa, Mycobacterium tuberculosis
GTWRANGGSGSAA

SEQ ID NO: 118553 - protein, 13 aa, Mycobacterium tuberculosis
TWRANGGSGSAAN

SEQ ID NO: 118554 - protein, 13 aa, Mycobacterium tuberculosis
WRANGGSGSAANA

SEQ ID NO: 118555 - protein, 13 aa, Mycobacterium tuberculosis
RANGGSGSAANAS

SEQ ID NO: 118556 - protein, 13 aa, Mycobacterium tuberculosis
ANGGSGSAANASR

SEQ ID NO: 118557 - protein, 13 aa, Mycobacterium tuberculosis
NGGSGSAANASRE

SEQ ID NO: 118558 - protein, 13 aa, Mycobacterium tuberculosis
GGSGSAANASREE

SEQ ID NO: 118559 - protein, 13 aa, Mycobacterium tuberculosis
GSGSAANASREEQ

SEQ ID NO: 118560 - protein, 13 aa, Mycobacterium tuberculosis
SGSAANASREEQI

SEQ ID NO: 118561 - protein, 13 aa, Mycobacterium tuberculosis
GSAANASREEQIR

SEQ ID NO: 118562 - protein, 13 aa, Mycobacterium tuberculosis
SAANASREEQIRV

SEQ ID NO: 118563 - protein, 13 aa, Mycobacterium tuberculosis
AANASREEQIRVA

SEQ ID NO: 118564 - protein, 13 aa, Mycobacterium tuberculosis
ANASREEQIRVAE

SEQ ID NO: 118565 - protein, 13 aa, Mycobacterium tuberculosis
NASREEQIRVAEN

SEQ ID NO: 118566 - protein, 13 aa, Mycobacterium tuberculosis
ASREEQIRVAENV

SEQ ID NO: 118567 - protein, 13 aa, Mycobacterium tuberculosis
SREEQIRVAENVL

SEQ ID NO: 118568 - protein, 13 aa, Mycobacterium tuberculosis
REEQIRVAENVLR

SEQ ID NO: 118569 - protein, 13 aa, Mycobacterium tuberculosis
EEQIRVAENVLRS

SEQ ID NO: 118570 - protein, 13 aa, Mycobacterium tuberculosis
EQIRVAENVLRSQ

SEQ ID NO: 118571 - protein, 13 aa, Mycobacterium tuberculosis
QIRVAENVLRSQG

SEQ ID NO: 118572 - protein, 13 aa, Mycobacterium tuberculosis
IRVAENVLRSQGI

SEQ ID NO: 118573 - protein, 13 aa, Mycobacterium tuberculosis
RVAENVLRSQGIR

SEQ ID NO: 118574 - protein, 13 aa, Mycobacterium tuberculosis
VAENVLRSQGIRA

SEQ ID NO: 118575 - protein, 13 aa, Mycobacterium tuberculosis
AENVLRSQGIRAW

SEQ ID NO: 118576 - protein, 13 aa, Mycobacterium tuberculosis
ENVLRSQGIRAWP

SEQ ID NO: 118577 - protein, 13 aa, Mycobacterium tuberculosis
NVLRSQGIRAWPV

SEQ ID NO: 118578 - protein, 13 aa, Mycobacterium tuberculosis
VLRSQGIRAWPVC

SEQ ID NO: 118579 - protein, 13 aa, Mycobacterium tuberculosis
LRSQGIRAWPVCG

SEQ ID NO: 118580 - protein, 13 aa, Mycobacterium tuberculosis
RSQGIRAWPVCGR

SEQ ID NO: 118581 - protein, 13 aa, Mycobacterium tuberculosis
SQGIRAWPVCGRR

SEQ ID NO: 118582 - protein, 13 aa, Mycobacterium tuberculosis
QGIRAWPVCGRRG

SEQ ID NO: 118583 - protein, 14 aa, Mycobacterium tuberculosis
MKNARTTLIAAAIA

SEQ ID NO: 118584 - protein, 14 aa, Mycobacterium tuberculosis
KNARTTLIAAAIAG

SEQ ID NO: 118585 - protein, 14 aa, Mycobacterium tuberculosis
NARTTLIAAAIAGT

SEQ ID NO: 118586 - protein, 14 aa, Mycobacterium tuberculosis
ARTTLIAAAIAGTL

SEQ ID NO: 118587 - protein, 14 aa, Mycobacterium tuberculosis
RTTLIAAAIAGTLV

SEQ ID NO: 118588 - protein, 14 aa, Mycobacterium tuberculosis
TTLIAAAIAGTLVT

SEQ ID NO: 118589 - protein, 14 aa, Mycobacterium tuberculosis
TLIAAAIAGTLVTT

SEQ ID NO: 118590 - protein, 14 aa, Mycobacterium tuberculosis
LIAAAIAGTLVTTS

SEQ ID NO: 118591 - protein, 14 aa, Mycobacterium tuberculosis
IAAAIAGTLVTTSP

SEQ ID NO: 118592 - protein, 14 aa, Mycobacterium tuberculosis
AAAIAGTLVTTSPA

SEQ ID NO: 118593 - protein, 14 aa, Mycobacterium tuberculosis
AAIAGTLVTTSPAG

SEQ ID NO: 118594 - protein, 14 aa, Mycobacterium tuberculosis
AIAGTLVTTSPAGI

SEQ ID NO: 118595 - protein, 14 aa, Mycobacterium tuberculosis
IAGTLVTTSPAGIA

SEQ ID NO: 118596 - protein, 14 aa, Mycobacterium tuberculosis
AGTLVTTSPAGIAN

SEQ ID NO: 118597 - protein, 14 aa, Mycobacterium tuberculosis
GTLVTTSPAGIANA

SEQ ID NO: 118598 - protein, 14 aa, Mycobacterium tuberculosis
TLVTTSPAGIANAD

SEQ ID NO: 118599 - protein, 14 aa, Mycobacterium tuberculosis
LVTTSPAGIANADD

SEQ ID NO: 118600 - protein, 14 aa, Mycobacterium tuberculosis
VTTSPAGIANADDA

SEQ ID NO: 118601 - protein, 14 aa, Mycobacterium tuberculosis
TTSPAGIANADDAG

SEQ ID NO: 118602 - protein, 14 aa, Mycobacterium tuberculosis
TSPAGIANADDAGL

SEQ ID NO: 118603 - protein, 14 aa, Mycobacterium tuberculosis
SPAGIANADDAGLD

SEQ ID NO: 118604 - protein, 14 aa, Mycobacterium tuberculosis
PAGIANADDAGLDP

SEQ ID NO: 118605 - protein, 14 aa, Mycobacterium tuberculosis
AGIANADDAGLDPN

SEQ ID NO: 118606 - protein, 14 aa, Mycobacterium tuberculosis
GIANADDAGLDPNA

SEQ ID NO: 118607 - protein, 14 aa, Mycobacterium tuberculosis
IANADDAGLDPNAA

SEQ ID NO: 118608 - protein, 14 aa, Mycobacterium tuberculosis
ANADDAGLDPNAAA

SEQ ID NO: 118609 - protein, 14 aa, Mycobacterium tuberculosis
NADDAGLDPNAAAG

SEQ ID NO: 118610 - protein, 14 aa, Mycobacterium tuberculosis
ADDAGLDPNAAAGP

SEQ ID NO: 118611 - protein, 14 aa, Mycobacterium tuberculosis
DDAGLDPNAAAGPD

SEQ ID NO: 118612 - protein, 14 aa, Mycobacterium tuberculosis
DAGLDPNAAAGPDA

SEQ ID NO: 118613 - protein, 14 aa, Mycobacterium tuberculosis
AGLDPNAAAGPDAV

SEQ ID NO: 118614 - protein, 14 aa, Mycobacterium tuberculosis
GLDPNAAAGPDAVG

SEQ ID NO: 118615 - protein, 14 aa, Mycobacterium tuberculosis
LDPNAAAGPDAVGF

SEQ ID NO: 118616 - protein, 14 aa, Mycobacterium tuberculosis
DPNAAAGPDAVGFD

SEQ ID NO: 118617 - protein, 14 aa, Mycobacterium tuberculosis
PNAAAGPDAVGFDP

SEQ ID NO: 118618 - protein, 14 aa, Mycobacterium tuberculosis
NAAAGPDAVGFDPN

SEQ ID NO: 118619 - protein, 14 aa, Mycobacterium tuberculosis
AAAGPDAVGFDPNL

SEQ ID NO: 118620 - protein, 14 aa, Mycobacterium tuberculosis
AAGPDAVGFDPNLP

SEQ ID NO: 118621 - protein, 14 aa, Mycobacterium tuberculosis
AGPDAVGFDPNLPP

SEQ ID NO: 118622 - protein, 14 aa, Mycobacterium tuberculosis
GPDAVGFDPNLPPA

SEQ ID NO: 118623 - protein, 14 aa, Mycobacterium tuberculosis
PDAVGFDPNLPPAP

SEQ ID NO: 118624 - protein, 14 aa, Mycobacterium tuberculosis
DAVGFDPNLPPAPD

SEQ ID NO: 118625 - protein, 14 aa, Mycobacterium tuberculosis
AVGFDPNLPPAPDA

SEQ ID NO: 118626 - protein, 14 aa, Mycobacterium tuberculosis
VGFDPNLPPAPDAA

SEQ ID NO: 118627 - protein, 14 aa, Mycobacterium tuberculosis
GFDPNLPPAPDAAP

SEQ ID NO: 118628 - protein, 14 aa, Mycobacterium tuberculosis
FDPNLPPAPDAAPV

SEQ ID NO: 118629 - protein, 14 aa, Mycobacterium tuberculosis
DPNLPPAPDAAPVD

SEQ ID NO: 118630 - protein, 14 aa, Mycobacterium tuberculosis
PNLPPAPDAAPVDT

SEQ ID NO: 118631 - protein, 14 aa, Mycobacterium tuberculosis
NLPPAPDAAPVDTP

SEQ ID NO: 118632 - protein, 14 aa, Mycobacterium tuberculosis
LPPAPDAAPVDTPP

SEQ ID NO: 118633 - protein, 14 aa, Mycobacterium tuberculosis
PPAPDAAPVDTPPA

SEQ ID NO: 118634 - protein, 14 aa, Mycobacterium tuberculosis
PAPDAAPVDTPPAP

SEQ ID NO: 118635 - protein, 14 aa, Mycobacterium tuberculosis
APDAAPVDTPPAPE

SEQ ID NO: 118636 - protein, 14 aa, Mycobacterium tuberculosis
PDAAPVDTPPAPED

SEQ ID NO: 118637 - protein, 14 aa, Mycobacterium tuberculosis
DAAPVDTPPAPEDA

SEQ ID NO: 118638 - protein, 14 aa, Mycobacterium tuberculosis
AAPVDTPPAPEDAG

SEQ ID NO: 118639 - protein, 14 aa, Mycobacterium tuberculosis
APVDTPPAPEDAGF

SEQ ID NO: 118640 - protein, 14 aa, Mycobacterium tuberculosis
PVDTPPAPEDAGFD

SEQ ID NO: 118641 - protein, 14 aa, Mycobacterium tuberculosis
VDTPPAPEDAGFDP

SEQ ID NO: 118642 - protein, 14 aa, Mycobacterium tuberculosis
DTPPAPEDAGFDPN

SEQ ID NO: 118643 - protein, 14 aa, Mycobacterium tuberculosis
TPPAPEDAGFDPNL

SEQ ID NO: 118644 - protein, 14 aa, Mycobacterium tuberculosis
PPAPEDAGFDPNLP

SEQ ID NO: 118645 - protein, 14 aa, Mycobacterium tuberculosis
PAPEDAGFDPNLPP

SEQ ID NO: 118646 - protein, 14 aa, Mycobacterium tuberculosis
APEDAGFDPNLPPP

SEQ ID NO: 118647 - protein, 14 aa, Mycobacterium tuberculosis
PEDAGFDPNLPPPL

SEQ ID NO: 118648 - protein, 14 aa, Mycobacterium tuberculosis
EDAGFDPNLPPPLA

SEQ ID NO: 118649 - protein, 14 aa, Mycobacterium tuberculosis
DAGFDPNLPPPLAP

SEQ ID NO: 118650 - protein, 14 aa, Mycobacterium tuberculosis
AGFDPNLPPPLAPD

SEQ ID NO: 118651 - protein, 14 aa, Mycobacterium tuberculosis
GFDPNLPPPLAPDF

SEQ ID NO: 118652 - protein, 14 aa, Mycobacterium tuberculosis
FDPNLPPPLAPDFL

SEQ ID NO: 118653 - protein, 14 aa, Mycobacterium tuberculosis
DPNLPPPLAPDFLS

SEQ ID NO: 118654 - protein, 14 aa, Mycobacterium tuberculosis
PNLPPPLAPDFLSP

SEQ ID NO: 118655 - protein, 14 aa, Mycobacterium tuberculosis
NLPPPLAPDFLSPP

SEQ ID NO: 118656 - protein, 14 aa, Mycobacterium tuberculosis
LPPPLAPDFLSPPA

SEQ ID NO: 118657 - protein, 14 aa, Mycobacterium tuberculosis
PPPLAPDFLSPPAE

SEQ ID NO: 118658 - protein, 14 aa, Mycobacterium tuberculosis
PPLAPDFLSPPAEE

SEQ ID NO: 118659 - protein, 14 aa, Mycobacterium tuberculosis
PLAPDFLSPPAEEA

SEQ ID NO: 118660 - protein, 14 aa, Mycobacterium tuberculosis
LAPDFLSPPAEEAP

SEQ ID NO: 118661 - protein, 14 aa, Mycobacterium tuberculosis
APDFLSPPAEEAPP

SEQ ID NO: 118662 - protein, 14 aa, Mycobacterium tuberculosis
PDFLSPPAEEAPPV

SEQ ID NO: 118663 - protein, 14 aa, Mycobacterium tuberculosis
DFLSPPAEEAPPVP

SEQ ID NO: 118664 - protein, 14 aa, Mycobacterium tuberculosis
FLSPPAEEAPPVPV

SEQ ID NO: 118665 - protein, 14 aa, Mycobacterium tuberculosis
LSPPAEEAPPVPVA

SEQ ID NO: 118666 - protein, 14 aa, Mycobacterium tuberculosis
SPPAEEAPPVPVAY

SEQ ID NO: 118667 - protein, 14 aa, Mycobacterium tuberculosis
PPAEEAPPVPVAYS

SEQ ID NO: 118668 - protein, 14 aa, Mycobacterium tuberculosis
PAEEAPPVPVAYSV

SEQ ID NO: 118669 - protein, 14 aa, Mycobacterium tuberculosis
AEEAPPVPVAYSVN

SEQ ID NO: 118670 - protein, 14 aa, Mycobacterium tuberculosis
EEAPPVPVAYSVNW

SEQ ID NO: 118671 - protein, 14 aa, Mycobacterium tuberculosis
EAPPVPVAYSVNWD

SEQ ID NO: 118672 - protein, 14 aa, Mycobacterium tuberculosis
APPVPVAYSVNWDA

SEQ ID NO: 118673 - protein, 14 aa, Mycobacterium tuberculosis
PPVPVAYSVNWDAI

SEQ ID NO: 118674 - protein, 14 aa, Mycobacterium tuberculosis
PVPVAYSVNWDAIA

SEQ ID NO: 118675 - protein, 14 aa, Mycobacterium tuberculosis
VPVAYSVNWDAIAQ

SEQ ID NO: 118676 - protein, 14 aa, Mycobacterium tuberculosis
PVAYSVNWDAIAQC

SEQ ID NO: 118677 - protein, 14 aa, Mycobacterium tuberculosis
VAYSVNWDAIAQCE

SEQ ID NO: 118678 - protein, 14 aa, Mycobacterium tuberculosis
AYSVNWDAIAQCES

SEQ ID NO: 118679 - protein, 14 aa, Mycobacterium tuberculosis
YSVNWDAIAQCESG

SEQ ID NO: 118680 - protein, 14 aa, Mycobacterium tuberculosis
SVNWDAIAQCESGG

SEQ ID NO: 118681 - protein, 14 aa, Mycobacterium tuberculosis
VNWDAIAQCESGGN

SEQ ID NO: 118682 - protein, 14 aa, Mycobacterium tuberculosis
NWDAIAQCESGGNW

SEQ ID NO: 118683 - protein, 14 aa, Mycobacterium tuberculosis
WDAIAQCESGGNWS

SEQ ID NO: 118684 - protein, 14 aa, Mycobacterium tuberculosis
DAIAQCESGGNWSI

SEQ ID NO: 118685 - protein, 14 aa, Mycobacterium tuberculosis
AIAQCESGGNWSIN

SEQ ID NO: 118686 - protein, 14 aa, Mycobacterium tuberculosis
IAQCESGGNWSINT

SEQ ID NO: 118687 - protein, 14 aa, Mycobacterium tuberculosis
AQCESGGNWSINTG

SEQ ID NO: 118688 - protein, 14 aa, Mycobacterium tuberculosis
QCESGGNWSINTGN

SEQ ID NO: 118689 - protein, 14 aa, Mycobacterium tuberculosis
CESGGNWSINTGNG

SEQ ID NO: 118690 - protein, 14 aa, Mycobacterium tuberculosis
ESGGNWSINTGNGY

SEQ ID NO: 118691 - protein, 14 aa, Mycobacterium tuberculosis
SGGNWSINTGNGYY

SEQ ID NO: 118692 - protein, 14 aa, Mycobacterium tuberculosis
GGNWSINTGNGYYG

SEQ ID NO: 118693 - protein, 14 aa, Mycobacterium tuberculosis
GNWSINTGNGYYGG

SEQ ID NO: 118694 - protein, 14 aa, Mycobacterium tuberculosis
NWSINTGNGYYGGL

SEQ ID NO: 118695 - protein, 14 aa, Mycobacterium tuberculosis
WSINTGNGYYGGLR

SEQ ID NO: 118696 - protein, 14 aa, Mycobacterium tuberculosis
SINTGNGYYGGLRF

SEQ ID NO: 118697 - protein, 14 aa, Mycobacterium tuberculosis
INTGNGYYGGLRFT

SEQ ID NO: 118698 - protein, 14 aa, Mycobacterium tuberculosis
NTGNGYYGGLRFTA

SEQ ID NO: 118699 - protein, 14 aa, Mycobacterium tuberculosis
TGNGYYGGLRFTAG

SEQ ID NO: 118700 - protein, 14 aa, Mycobacterium tuberculosis
GNGYYGGLRFTAGT

SEQ ID NO: 118701 - protein, 14 aa, Mycobacterium tuberculosis
NGYYGGLRFTAGTW

SEQ ID NO: 118702 - protein, 14 aa, Mycobacterium tuberculosis
GYYGGLRFTAGTWR

SEQ ID NO: 118703 - protein, 14 aa, Mycobacterium tuberculosis
YYGGLRFTAGTWRA

SEQ ID NO: 118704 - protein, 14 aa, Mycobacterium tuberculosis
YGGLRFTAGTWRAN

SEQ ID NO: 118705 - protein, 14 aa, Mycobacterium tuberculosis
GGLRFTAGTWRANG

SEQ ID NO: 118706 - protein, 14 aa, Mycobacterium tuberculosis
GLRFTAGTWRANGG

SEQ ID NO: 118707 - protein, 14 aa, Mycobacterium tuberculosis
LRFTAGTWRANGGS

SEQ ID NO: 118708 - protein, 14 aa, Mycobacterium tuberculosis
RFTAGTWRANGGSG

SEQ ID NO: 118709 - protein, 14 aa, Mycobacterium tuberculosis
FTAGTWRANGGSGS

SEQ ID NO: 118710 - protein, 14 aa, Mycobacterium tuberculosis
TAGTWRANGGSGSA

SEQ ID NO: 118711 - protein, 14 aa, Mycobacterium tuberculosis
AGTWRANGGSGSAA

SEQ ID NO: 118712 - protein, 14 aa, Mycobacterium tuberculosis
GTWRANGGSGSAAN

SEQ ID NO: 118713 - protein, 14 aa, Mycobacterium tuberculosis
TWRANGGSGSAANA

SEQ ID NO: 118714 - protein, 14 aa, Mycobacterium tuberculosis
WRANGGSGSAANAS

SEQ ID NO: 118715 - protein, 14 aa, Mycobacterium tuberculosis
RANGGSGSAANASR

SEQ ID NO: 118716 - protein, 14 aa, Mycobacterium tuberculosis
ANGGSGSAANASRE

SEQ ID NO: 118717 - protein, 14 aa, Mycobacterium tuberculosis
NGGSGSAANASREE

SEQ ID NO: 118718 - protein, 14 aa, Mycobacterium tuberculosis
GGSGSAANASREEQ

SEQ ID NO: 118719 - protein, 14 aa, Mycobacterium tuberculosis
GSGSAANASREEQI

SEQ ID NO: 118720 - protein, 14 aa, Mycobacterium tuberculosis
SGSAANASREEQIR

SEQ ID NO: 118721 - protein, 14 aa, Mycobacterium tuberculosis
GSAANASREEQIRV

SEQ ID NO: 118722 - protein, 14 aa, Mycobacterium tuberculosis
SAANASREEQIRVA

SEQ ID NO: 118723 - protein, 14 aa, Mycobacterium tuberculosis
AANASREEQIRVAE

SEQ ID NO: 118724 - protein, 14 aa, Mycobacterium tuberculosis
ANASREEQIRVAEN

SEQ ID NO: 118725 - protein, 14 aa, Mycobacterium tuberculosis
NASREEQIRVAENV

SEQ ID NO: 118726 - protein, 14 aa, Mycobacterium tuberculosis
ASREEQIRVAENVL

SEQ ID NO: 118727 - protein, 14 aa, Mycobacterium tuberculosis
SREEQIRVAENVLR

SEQ ID NO: 118728 - protein, 14 aa, Mycobacterium tuberculosis
REEQIRVAENVLRS

SEQ ID NO: 118729 - protein, 14 aa, Mycobacterium tuberculosis
EEQIRVAENVLRSQ

SEQ ID NO: 118730 - protein, 14 aa, Mycobacterium tuberculosis
EQIRVAENVLRSQG

SEQ ID NO: 118731 - protein, 14 aa, Mycobacterium tuberculosis
QIRVAENVLRSQGI

SEQ ID NO: 118732 - protein, 14 aa, Mycobacterium tuberculosis
IRVAENVLRSQGIR

SEQ ID NO: 118733 - protein, 14 aa, Mycobacterium tuberculosis
RVAENVLRSQGIRA

SEQ ID NO: 118734 - protein, 14 aa, Mycobacterium tuberculosis
VAENVLRSQGIRAW

SEQ ID NO: 118735 - protein, 14 aa, Mycobacterium tuberculosis
AENVLRSQGIRAWP

SEQ ID NO: 118736 - protein, 14 aa, Mycobacterium tuberculosis
ENVLRSQGIRAWPV

SEQ ID NO: 118737 - protein, 14 aa, Mycobacterium tuberculosis
NVLRSQGIRAWPVC

SEQ ID NO: 118738 - protein, 14 aa, Mycobacterium tuberculosis
VLRSQGIRAWPVCG

SEQ ID NO: 118739 - protein, 14 aa, Mycobacterium tuberculosis
LRSQGIRAWPVCGR

SEQ ID NO: 118740 - protein, 14 aa, Mycobacterium tuberculosis
RSQGIRAWPVCGRR

SEQ ID NO: 118741 - protein, 14 aa, Mycobacterium tuberculosis
SQGIRAWPVCGRRG

SEQ ID NO: 118742 - protein, 15 aa, Mycobacterium tuberculosis
MKNARTTLIAAAIAG

SEQ ID NO: 118743 - protein, 15 aa, Mycobacterium tuberculosis
KNARTTLIAAAIAGT

SEQ ID NO: 118744 - protein, 15 aa, Mycobacterium tuberculosis
NARTTLIAAAIAGTL

SEQ ID NO: 118745 - protein, 15 aa, Mycobacterium tuberculosis
ARTTLIAAAIAGTLV

SEQ ID NO: 118746 - protein, 15 aa, Mycobacterium tuberculosis
RTTLIAAAIAGTLVT

SEQ ID NO: 118747 - protein, 15 aa, Mycobacterium tuberculosis
TTLIAAAIAGTLVTT

SEQ ID NO: 118748 - protein, 15 aa, Mycobacterium tuberculosis
TLIAAAIAGTLVTTS

SEQ ID NO: 118749 - protein, 15 aa, Mycobacterium tuberculosis
LIAAAIAGTLVTTSP

SEQ ID NO: 118750 - protein, 15 aa, Mycobacterium tuberculosis
IAAAIAGTLVTTSPA

SEQ ID NO: 118751 - protein, 15 aa, Mycobacterium tuberculosis
AAAIAGTLVTTSPAG

SEQ ID NO: 118752 - protein, 15 aa, Mycobacterium tuberculosis
AAIAGTLVTTSPAGI

SEQ ID NO: 118753 - protein, 15 aa, Mycobacterium tuberculosis
AIAGTLVTTSPAGIA

SEQ ID NO: 118754 - protein, 15 aa, Mycobacterium tuberculosis
IAGTLVTTSPAGIAN

SEQ ID NO: 118755 - protein, 15 aa, Mycobacterium tuberculosis
AGTLVTTSPAGIANA

SEQ ID NO: 118756 - protein, 15 aa, Mycobacterium tuberculosis
GTLVTTSPAGIANAD

SEQ ID NO: 118757 - protein, 15 aa, Mycobacterium tuberculosis
TLVTTSPAGIANADD

SEQ ID NO: 118758 - protein, 15 aa, Mycobacterium tuberculosis
LVTTSPAGIANADDA

SEQ ID NO: 118759 - protein, 15 aa, Mycobacterium tuberculosis
VTTSPAGIANADDAG

SEQ ID NO: 118760 - protein, 15 aa, Mycobacterium tuberculosis
TTSPAGIANADDAGL

SEQ ID NO: 118761 - protein, 15 aa, Mycobacterium tuberculosis
TSPAGIANADDAGLD

SEQ ID NO: 118762 - protein, 15 aa, Mycobacterium tuberculosis
SPAGIANADDAGLDP

SEQ ID NO: 118763 - protein, 15 aa, Mycobacterium tuberculosis
PAGIANADDAGLDPN

SEQ ID NO: 118764 - protein, 15 aa, Mycobacterium tuberculosis
AGIANADDAGLDPNA

SEQ ID NO: 118765 - protein, 15 aa, Mycobacterium tuberculosis
GIANADDAGLDPNAA

SEQ ID NO: 118766 - protein, 15 aa, Mycobacterium tuberculosis
IANADDAGLDPNAAA

SEQ ID NO: 118767 - protein, 15 aa, Mycobacterium tuberculosis
ANADDAGLDPNAAAG

SEQ ID NO: 118768 - protein, 15 aa, Mycobacterium tuberculosis
NADDAGLDPNAAAGP

SEQ ID NO: 118769 - protein, 15 aa, Mycobacterium tuberculosis
ADDAGLDPNAAAGPD

SEQ ID NO: 118770 - protein, 15 aa, Mycobacterium tuberculosis
DDAGLDPNAAAGPDA

SEQ ID NO: 118771 - protein, 15 aa, Mycobacterium tuberculosis
DAGLDPNAAAGPDAV

SEQ ID NO: 118772 - protein, 15 aa, Mycobacterium tuberculosis
AGLDPNAAAGPDAVG

SEQ ID NO: 118773 - protein, 15 aa, Mycobacterium tuberculosis
GLDPNAAAGPDAVGF

SEQ ID NO: 118774 - protein, 15 aa, Mycobacterium tuberculosis
LDPNAAAGPDAVGFD

SEQ ID NO: 118775 - protein, 15 aa, Mycobacterium tuberculosis
DPNAAAGPDAVGFDP

SEQ ID NO: 118776 - protein, 15 aa, Mycobacterium tuberculosis
PNAAAGPDAVGFDPN

SEQ ID NO: 118777 - protein, 15 aa, Mycobacterium tuberculosis
NAAAGPDAVGFDPNL

SEQ ID NO: 118778 - protein, 15 aa, Mycobacterium tuberculosis
AAAGPDAVGFDPNLP

SEQ ID NO: 118779 - protein, 15 aa, Mycobacterium tuberculosis
AAGPDAVGFDPNLPP

SEQ ID NO: 118780 - protein, 15 aa, Mycobacterium tuberculosis
AGPDAVGFDPNLPPA

SEQ ID NO: 118781 - protein, 15 aa, Mycobacterium tuberculosis
GPDAVGFDPNLPPAP

SEQ ID NO: 118782 - protein, 15 aa, Mycobacterium tuberculosis
PDAVGFDPNLPPAPD

SEQ ID NO: 118783 - protein, 15 aa, Mycobacterium tuberculosis
DAVGFDPNLPPAPDA

SEQ ID NO: 118784 - protein, 15 aa, Mycobacterium tuberculosis
AVGFDPNLPPAPDAA

SEQ ID NO: 118785 - protein, 15 aa, Mycobacterium tuberculosis
VGFDPNLPPAPDAAP

SEQ ID NO: 118786 - protein, 15 aa, Mycobacterium tuberculosis
GFDPNLPPAPDAAPV

SEQ ID NO: 118787 - protein, 15 aa, Mycobacterium tuberculosis
FDPNLPPAPDAAPVD

SEQ ID NO: 118788 - protein, 15 aa, Mycobacterium tuberculosis
DPNLPPAPDAAPVDT

SEQ ID NO: 118789 - protein, 15 aa, Mycobacterium tuberculosis
PNLPPAPDAAPVDTP

SEQ ID NO: 118790 - protein, 15 aa, Mycobacterium tuberculosis
NLPPAPDAAPVDTPP

SEQ ID NO: 118791 - protein, 15 aa, Mycobacterium tuberculosis
LPPAPDAAPVDTPPA

SEQ ID NO: 118792 - protein, 15 aa, Mycobacterium tuberculosis
PPAPDAAPVDTPPAP

SEQ ID NO: 118793 - protein, 15 aa, Mycobacterium tuberculosis
PAPDAAPVDTPPAPE

SEQ ID NO: 118794 - protein, 15 aa, Mycobacterium tuberculosis
APDAAPVDTPPAPED

SEQ ID NO: 118795 - protein, 15 aa, Mycobacterium tuberculosis
PDAAPVDTPPAPEDA

SEQ ID NO: 118796 - protein, 15 aa, Mycobacterium tuberculosis
DAAPVDTPPAPEDAG

SEQ ID NO: 118797 - protein, 15 aa, Mycobacterium tuberculosis
AAPVDTPPAPEDAGF

SEQ ID NO: 118798 - protein, 15 aa, Mycobacterium tuberculosis
APVDTPPAPEDAGFD

SEQ ID NO: 118799 - protein, 15 aa, Mycobacterium tuberculosis
PVDTPPAPEDAGFDP

SEQ ID NO: 118800 - protein, 15 aa, Mycobacterium tuberculosis
VDTPPAPEDAGFDPN

SEQ ID NO: 118801 - protein, 15 aa, Mycobacterium tuberculosis
DTPPAPEDAGFDPNL

SEQ ID NO: 118802 - protein, 15 aa, Mycobacterium tuberculosis
TPPAPEDAGFDPNLP

SEQ ID NO: 118803 - protein, 15 aa, Mycobacterium tuberculosis
PPAPEDAGFDPNLPP

SEQ ID NO: 118804 - protein, 15 aa, Mycobacterium tuberculosis
PAPEDAGFDPNLPPP

SEQ ID NO: 118805 - protein, 15 aa, Mycobacterium tuberculosis
APEDAGFDPNLPPPL

SEQ ID NO: 118806 - protein, 15 aa, Mycobacterium tuberculosis
PEDAGFDPNLPPPLA

SEQ ID NO: 118807 - protein, 15 aa, Mycobacterium tuberculosis
EDAGFDPNLPPPLAP

SEQ ID NO: 118808 - protein, 15 aa, Mycobacterium tuberculosis
DAGFDPNLPPPLAPD

SEQ ID NO: 118809 - protein, 15 aa, Mycobacterium tuberculosis
AGFDPNLPPPLAPDF

SEQ ID NO: 118810 - protein, 15 aa, Mycobacterium tuberculosis
GFDPNLPPPLAPDFL

SEQ ID NO: 118811 - protein, 15 aa, Mycobacterium tuberculosis
FDPNLPPPLAPDFLS

SEQ ID NO: 118812 - protein, 15 aa, Mycobacterium tuberculosis
DPNLPPPLAPDFLSP

SEQ ID NO: 118813 - protein, 15 aa, Mycobacterium tuberculosis
PNLPPPLAPDFLSPP

SEQ ID NO: 118814 - protein, 15 aa, Mycobacterium tuberculosis
NLPPPLAPDFLSPPA

SEQ ID NO: 118815 - protein, 15 aa, Mycobacterium tuberculosis
LPPPLAPDFLSPPAE

SEQ ID NO: 118816 - protein, 15 aa, Mycobacterium tuberculosis
PPPLAPDFLSPPAEE

SEQ ID NO: 118817 - protein, 15 aa, Mycobacterium tuberculosis
PPLAPDFLSPPAEEA

SEQ ID NO: 118818 - protein, 15 aa, Mycobacterium tuberculosis
PLAPDFLSPPAEEAP

SEQ ID NO: 118819 - protein, 15 aa, Mycobacterium tuberculosis
LAPDFLSPPAEEAPP

SEQ ID NO: 118820 - protein, 15 aa, Mycobacterium tuberculosis
APDFLSPPAEEAPPV

SEQ ID NO: 118821 - protein, 15 aa, Mycobacterium tuberculosis
PDFLSPPAEEAPPVP

SEQ ID NO: 118822 - protein, 15 aa, Mycobacterium tuberculosis
DFLSPPAEEAPPVPV

SEQ ID NO: 118823 - protein, 15 aa, Mycobacterium tuberculosis
FLSPPAEEAPPVPVA

SEQ ID NO: 118824 - protein, 15 aa, Mycobacterium tuberculosis
LSPPAEEAPPVPVAY

SEQ ID NO: 118825 - protein, 15 aa, Mycobacterium tuberculosis
SPPAEEAPPVPVAYS

SEQ ID NO: 118826 - protein, 15 aa, Mycobacterium tuberculosis
PPAEEAPPVPVAYSV

SEQ ID NO: 118827 - protein, 15 aa, Mycobacterium tuberculosis
PAEEAPPVPVAYSVN

SEQ ID NO: 118828 - protein, 15 aa, Mycobacterium tuberculosis
AEEAPPVPVAYSVNW

SEQ ID NO: 118829 - protein, 15 aa, Mycobacterium tuberculosis
EEAPPVPVAYSVNWD

SEQ ID NO: 118830 - protein, 15 aa, Mycobacterium tuberculosis
EAPPVPVAYSVNWDA

SEQ ID NO: 118831 - protein, 15 aa, Mycobacterium tuberculosis
APPVPVAYSVNWDAI

SEQ ID NO: 118832 - protein, 15 aa, Mycobacterium tuberculosis
PPVPVAYSVNWDAIA

SEQ ID NO: 118833 - protein, 15 aa, Mycobacterium tuberculosis
PVPVAYSVNWDAIAQ

SEQ ID NO: 118834 - protein, 15 aa, Mycobacterium tuberculosis
VPVAYSVNWDAIAQC

SEQ ID NO: 118835 - protein, 15 aa, Mycobacterium tuberculosis
PVAYSVNWDAIAQCE

SEQ ID NO: 118836 - protein, 15 aa, Mycobacterium tuberculosis
VAYSVNWDAIAQCES

SEQ ID NO: 118837 - protein, 15 aa, Mycobacterium tuberculosis
AYSVNWDAIAQCESG

SEQ ID NO: 118838 - protein, 15 aa, Mycobacterium tuberculosis
YSVNWDAIAQCESGG

SEQ ID NO: 118839 - protein, 15 aa, Mycobacterium tuberculosis
SVNWDAIAQCESGGN

SEQ ID NO: 118840 - protein, 15 aa, Mycobacterium tuberculosis
VNWDAIAQCESGGNW

SEQ ID NO: 118841 - protein, 15 aa, Mycobacterium tuberculosis
NWDAIAQCESGGNWS

SEQ ID NO: 118842 - protein, 15 aa, Mycobacterium tuberculosis
WDAIAQCESGGNWSI

SEQ ID NO: 118843 - protein, 15 aa, Mycobacterium tuberculosis
DAIAQCESGGNWSIN

SEQ ID NO: 118844 - protein, 15 aa, Mycobacterium tuberculosis
AIAQCESGGNWSINT

SEQ ID NO: 118845 - protein, 15 aa, Mycobacterium tuberculosis
IAQCESGGNWSINTG

SEQ ID NO: 118846 - protein, 15 aa, Mycobacterium tuberculosis
AQCESGGNWSINTGN

SEQ ID NO: 118847 - protein, 15 aa, Mycobacterium tuberculosis
QCESGGNWSINTGNG

SEQ ID NO: 118848 - protein, 15 aa, Mycobacterium tuberculosis
CESGGNWSINTGNGY

SEQ ID NO: 118849 - protein, 15 aa, Mycobacterium tuberculosis
ESGGNWSINTGNGYY

SEQ ID NO: 118850 - protein, 15 aa, Mycobacterium tuberculosis
SGGNWSINTGNGYYG

SEQ ID NO: 118851 - protein, 15 aa, Mycobacterium tuberculosis
GGNWSINTGNGYYGG

SEQ ID NO: 118852 - protein, 15 aa, Mycobacterium tuberculosis
GNWSINTGNGYYGGL

SEQ ID NO: 118853 - protein, 15 aa, Mycobacterium tuberculosis
NWSINTGNGYYGGLR

SEQ ID NO: 118854 - protein, 15 aa, Mycobacterium tuberculosis
WSINTGNGYYGGLRF

SEQ ID NO: 118855 - protein, 15 aa, Mycobacterium tuberculosis
SINTGNGYYGGLRFT

SEQ ID NO: 118856 - protein, 15 aa, Mycobacterium tuberculosis
INTGNGYYGGLRFTA

SEQ ID NO: 118857 - protein, 15 aa, Mycobacterium tuberculosis
NTGNGYYGGLRFTAG

SEQ ID NO: 118858 - protein, 15 aa, Mycobacterium tuberculosis
TGNGYYGGLRFTAGT

SEQ ID NO: 118859 - protein, 15 aa, Mycobacterium tuberculosis
GNGYYGGLRFTAGTW

SEQ ID NO: 118860 - protein, 15 aa, Mycobacterium tuberculosis
NGYYGGLRFTAGTWR

SEQ ID NO: 118861 - protein, 15 aa, Mycobacterium tuberculosis
GYYGGLRFTAGTWRA

SEQ ID NO: 118862 - protein, 15 aa, Mycobacterium tuberculosis
YYGGLRFTAGTWRAN

SEQ ID NO: 118863 - protein, 15 aa, Mycobacterium tuberculosis
YGGLRFTAGTWRANG

SEQ ID NO: 118864 - protein, 15 aa, Mycobacterium tuberculosis
GGLRFTAGTWRANGG

SEQ ID NO: 118865 - protein, 15 aa, Mycobacterium tuberculosis
GLRFTAGTWRANGGS

SEQ ID NO: 118866 - protein, 15 aa, Mycobacterium tuberculosis
LRFTAGTWRANGGSG

SEQ ID NO: 118867 - protein, 15 aa, Mycobacterium tuberculosis
RFTAGTWRANGGSGS

SEQ ID NO: 118868 - protein, 15 aa, Mycobacterium tuberculosis
FTAGTWRANGGSGSA

SEQ ID NO: 118869 - protein, 15 aa, Mycobacterium tuberculosis
TAGTWRANGGSGSAA

SEQ ID NO: 118870 - protein, 15 aa, Mycobacterium tuberculosis
AGTWRANGGSGSAAN

SEQ ID NO: 118871 - protein, 15 aa, Mycobacterium tuberculosis
GTWRANGGSGSAANA

SEQ ID NO: 118872 - protein, 15 aa, Mycobacterium tuberculosis
TWRANGGSGSAANAS

SEQ ID NO: 118873 - protein, 15 aa, Mycobacterium tuberculosis
WRANGGSGSAANASR

SEQ ID NO: 118874 - protein, 15 aa, Mycobacterium tuberculosis
RANGGSGSAANASRE

SEQ ID NO: 118875 - protein, 15 aa, Mycobacterium tuberculosis
ANGGSGSAANASREE

SEQ ID NO: 118876 - protein, 15 aa, Mycobacterium tuberculosis
NGGSGSAANASREEQ

SEQ ID NO: 118877 - protein, 15 aa, Mycobacterium tuberculosis
GGSGSAANASREEQI

SEQ ID NO: 118878 - protein, 15 aa, Mycobacterium tuberculosis
GSGSAANASREEQIR

SEQ ID NO: 118879 - protein, 15 aa, Mycobacterium tuberculosis
SGSAANASREEQIRV

SEQ ID NO: 118880 - protein, 15 aa, Mycobacterium tuberculosis
GSAANASREEQIRVA

SEQ ID NO: 118881 - protein, 15 aa, Mycobacterium tuberculosis
SAANASREEQIRVAE

SEQ ID NO: 118882 - protein, 15 aa, Mycobacterium tuberculosis
AANASREEQIRVAEN

SEQ ID NO: 118883 - protein, 15 aa, Mycobacterium tuberculosis
ANASREEQIRVAENV

SEQ ID NO: 118884 - protein, 15 aa, Mycobacterium tuberculosis
NASREEQIRVAENVL

SEQ ID NO: 118885 - protein, 15 aa, Mycobacterium tuberculosis
ASREEQIRVAENVLR

SEQ ID NO: 118886 - protein, 15 aa, Mycobacterium tuberculosis
SREEQIRVAENVLRS

SEQ ID NO: 118887 - protein, 15 aa, Mycobacterium tuberculosis
REEQIRVAENVLRSQ

SEQ ID NO: 118888 - protein, 15 aa, Mycobacterium tuberculosis
EEQIRVAENVLRSQG

SEQ ID NO: 118889 - protein, 15 aa, Mycobacterium tuberculosis
EQIRVAENVLRSQGI

SEQ ID NO: 118890 - protein, 15 aa, Mycobacterium tuberculosis
QIRVAENVLRSQGIR

SEQ ID NO: 118891 - protein, 15 aa, Mycobacterium tuberculosis
IRVAENVLRSQGIRA

SEQ ID NO: 118892 - protein, 15 aa, Mycobacterium tuberculosis
RVAENVLRSQGIRAW

SEQ ID NO: 118893 - protein, 15 aa, Mycobacterium tuberculosis
VAENVLRSQGIRAWP

SEQ ID NO: 118894 - protein, 15 aa, Mycobacterium tuberculosis
AENVLRSQGIRAWPV

SEQ ID NO: 118895 - protein, 15 aa, Mycobacterium tuberculosis
ENVLRSQGIRAWPVC

SEQ ID NO: 118896 - protein, 15 aa, Mycobacterium tuberculosis
NVLRSQGIRAWPVCG

SEQ ID NO: 118897 - protein, 15 aa, Mycobacterium tuberculosis
VLRSQGIRAWPVCGR

SEQ ID NO: 118898 - protein, 15 aa, Mycobacterium tuberculosis
LRSQGIRAWPVCGRR

SEQ ID NO: 118899 - protein, 15 aa, Mycobacterium tuberculosis
RSQGIRAWPVCGRRG

SEQ ID NO: 118900 - protein, 16 aa, Mycobacterium tuberculosis
MKNARTTLIAAAIAGT

SEQ ID NO: 118901 - protein, 16 aa, Mycobacterium tuberculosis
KNARTTLIAAAIAGTL

SEQ ID NO: 118902 - protein, 16 aa, Mycobacterium tuberculosis
NARTTLIAAAIAGTLV

SEQ ID NO: 118903 - protein, 16 aa, Mycobacterium tuberculosis
ARTTLIAAAIAGTLVT

SEQ ID NO: 118904 - protein, 16 aa, Mycobacterium tuberculosis
RTTLIAAAIAGTLVTT

SEQ ID NO: 118905 - protein, 16 aa, Mycobacterium tuberculosis
TTLIAAAIAGTLVTTS

SEQ ID NO: 118906 - protein, 16 aa, Mycobacterium tuberculosis
TLIAAAIAGTLVTTSP

SEQ ID NO: 118907 - protein, 16 aa, Mycobacterium tuberculosis
LIAAAIAGTLVTTSPA

SEQ ID NO: 118908 - protein, 16 aa, Mycobacterium tuberculosis
IAAAIAGTLVTTSPAG

SEQ ID NO: 118909 - protein, 16 aa, Mycobacterium tuberculosis
AAAIAGTLVTTSPAGI

SEQ ID NO: 118910 - protein, 16 aa, Mycobacterium tuberculosis
AAIAGTLVTTSPAGIA

SEQ ID NO: 118911 - protein, 16 aa, Mycobacterium tuberculosis
AIAGTLVTTSPAGIAN

SEQ ID NO: 118912 - protein, 16 aa, Mycobacterium tuberculosis
IAGTLVTTSPAGIANA

SEQ ID NO: 118913 - protein, 16 aa, Mycobacterium tuberculosis
AGTLVTTSPAGIANAD

SEQ ID NO: 118914 - protein, 16 aa, Mycobacterium tuberculosis
GTLVTTSPAGIANADD

SEQ ID NO: 118915 - protein, 16 aa, Mycobacterium tuberculosis
TLVTTSPAGIANADDA

SEQ ID NO: 118916 - protein, 16 aa, Mycobacterium tuberculosis
LVTTSPAGIANADDAG

SEQ ID NO: 118917 - protein, 16 aa, Mycobacterium tuberculosis
VTTSPAGIANADDAGL

SEQ ID NO: 118918 - protein, 16 aa, Mycobacterium tuberculosis
TTSPAGIANADDAGLD

SEQ ID NO: 118919 - protein, 16 aa, Mycobacterium tuberculosis
TSPAGIANADDAGLDP

SEQ ID NO: 118920 - protein, 16 aa, Mycobacterium tuberculosis
SPAGIANADDAGLDPN

SEQ ID NO: 118921 - protein, 16 aa, Mycobacterium tuberculosis
PAGIANADDAGLDPNA

SEQ ID NO: 118922 - protein, 16 aa, Mycobacterium tuberculosis
AGIANADDAGLDPNAA

SEQ ID NO: 118923 - protein, 16 aa, Mycobacterium tuberculosis
GIANADDAGLDPNAAA

SEQ ID NO: 118924 - protein, 16 aa, Mycobacterium tuberculosis
IANADDAGLDPNAAAG

SEQ ID NO: 118925 - protein, 16 aa, Mycobacterium tuberculosis
ANADDAGLDPNAAAGP

SEQ ID NO: 118926 - protein, 16 aa, Mycobacterium tuberculosis
NADDAGLDPNAAAGPD

SEQ ID NO: 118927 - protein, 16 aa, Mycobacterium tuberculosis
ADDAGLDPNAAAGPDA

SEQ ID NO: 118928 - protein, 16 aa, Mycobacterium tuberculosis
DDAGLDPNAAAGPDAV

SEQ ID NO: 118929 - protein, 16 aa, Mycobacterium tuberculosis
DAGLDPNAAAGPDAVG

SEQ ID NO: 118930 - protein, 16 aa, Mycobacterium tuberculosis
AGLDPNAAAGPDAVGF

SEQ ID NO: 118931 - protein, 16 aa, Mycobacterium tuberculosis
GLDPNAAAGPDAVGFD

SEQ ID NO: 118932 - protein, 16 aa, Mycobacterium tuberculosis
LDPNAAAGPDAVGFDP

SEQ ID NO: 118933 - protein, 16 aa, Mycobacterium tuberculosis
DPNAAAGPDAVGFDPN

SEQ ID NO: 118934 - protein, 16 aa, Mycobacterium tuberculosis
PNAAAGPDAVGFDPNL

SEQ ID NO: 118935 - protein, 16 aa, Mycobacterium tuberculosis
NAAAGPDAVGFDPNLP

SEQ ID NO: 118936 - protein, 16 aa, Mycobacterium tuberculosis
AAAGPDAVGFDPNLPP

SEQ ID NO: 118937 - protein, 16 aa, Mycobacterium tuberculosis
AAGPDAVGFDPNLPPA

SEQ ID NO: 118938 - protein, 16 aa, Mycobacterium tuberculosis
AGPDAVGFDPNLPPAP

SEQ ID NO: 118939 - protein, 16 aa, Mycobacterium tuberculosis
GPDAVGFDPNLPPAPD

SEQ ID NO: 118940 - protein, 16 aa, Mycobacterium tuberculosis
PDAVGFDPNLPPAPDA

SEQ ID NO: 118941 - protein, 16 aa, Mycobacterium tuberculosis
DAVGFDPNLPPAPDAA

SEQ ID NO: 118942 - protein, 16 aa, Mycobacterium tuberculosis
AVGFDPNLPPAPDAAP

SEQ ID NO: 118943 - protein, 16 aa, Mycobacterium tuberculosis
VGFDPNLPPAPDAAPV

SEQ ID NO: 118944 - protein, 16 aa, Mycobacterium tuberculosis
GFDPNLPPAPDAAPVD

SEQ ID NO: 118945 - protein, 16 aa, Mycobacterium tuberculosis
FDPNLPPAPDAAPVDT

SEQ ID NO: 118946 - protein, 16 aa, Mycobacterium tuberculosis
DPNLPPAPDAAPVDTP

SEQ ID NO: 118947 - protein, 16 aa, Mycobacterium tuberculosis
PNLPPAPDAAPVDTPP

SEQ ID NO: 118948 - protein, 16 aa, Mycobacterium tuberculosis
NLPPAPDAAPVDTPPA

SEQ ID NO: 118949 - protein, 16 aa, Mycobacterium tuberculosis
LPPAPDAAPVDTPPAP

SEQ ID NO: 118950 - protein, 16 aa, Mycobacterium tuberculosis
PPAPDAAPVDTPPAPE

SEQ ID NO: 118951 - protein, 16 aa, Mycobacterium tuberculosis
PAPDAAPVDTPPAPED

SEQ ID NO: 118952 - protein, 16 aa, Mycobacterium tuberculosis
APDAAPVDTPPAPEDA

SEQ ID NO: 118953 - protein, 16 aa, Mycobacterium tuberculosis
PDAAPVDTPPAPEDAG

SEQ ID NO: 118954 - protein, 16 aa, Mycobacterium tuberculosis
DAAPVDTPPAPEDAGF

SEQ ID NO: 118955 - protein, 16 aa, Mycobacterium tuberculosis
AAPVDTPPAPEDAGFD

SEQ ID NO: 118956 - protein, 16 aa, Mycobacterium tuberculosis
APVDTPPAPEDAGFDP

SEQ ID NO: 118957 - protein, 16 aa, Mycobacterium tuberculosis
PVDTPPAPEDAGFDPN

SEQ ID NO: 118958 - protein, 16 aa, Mycobacterium tuberculosis
VDTPPAPEDAGFDPNL

SEQ ID NO: 118959 - protein, 16 aa, Mycobacterium tuberculosis
DTPPAPEDAGFDPNLP

SEQ ID NO: 118960 - protein, 16 aa, Mycobacterium tuberculosis
TPPAPEDAGFDPNLPP

SEQ ID NO: 118961 - protein, 16 aa, Mycobacterium tuberculosis
PPAPEDAGFDPNLPPP

SEQ ID NO: 118962 - protein, 16 aa, Mycobacterium tuberculosis
PAPEDAGFDPNLPPPL

SEQ ID NO: 118963 - protein, 16 aa, Mycobacterium tuberculosis
APEDAGFDPNLPPPLA

SEQ ID NO: 118964 - protein, 16 aa, Mycobacterium tuberculosis
PEDAGFDPNLPPPLAP

SEQ ID NO: 118965 - protein, 16 aa, Mycobacterium tuberculosis
EDAGFDPNLPPPLAPD

SEQ ID NO: 118966 - protein, 16 aa, Mycobacterium tuberculosis
DAGFDPNLPPPLAPDF

SEQ ID NO: 118967 - protein, 16 aa, Mycobacterium tuberculosis
AGFDPNLPPPLAPDFL

SEQ ID NO: 118968 - protein, 16 aa, Mycobacterium tuberculosis
GFDPNLPPPLAPDFLS

SEQ ID NO: 118969 - protein, 16 aa, Mycobacterium tuberculosis
FDPNLPPPLAPDFLSP

SEQ ID NO: 118970 - protein, 16 aa, Mycobacterium tuberculosis
DPNLPPPLAPDFLSPP

SEQ ID NO: 118971 - protein, 16 aa, Mycobacterium tuberculosis
PNLPPPLAPDFLSPPA

SEQ ID NO: 118972 - protein, 16 aa, Mycobacterium tuberculosis
NLPPPLAPDFLSPPAE

SEQ ID NO: 118973 - protein, 16 aa, Mycobacterium tuberculosis
LPPPLAPDFLSPPAEE

SEQ ID NO: 118974 - protein, 16 aa, Mycobacterium tuberculosis
PPPLAPDFLSPPAEEA

SEQ ID NO: 118975 - protein, 16 aa, Mycobacterium tuberculosis
PPLAPDFLSPPAEEAP

SEQ ID NO: 118976 - protein, 16 aa, Mycobacterium tuberculosis
PLAPDFLSPPAEEAPP

SEQ ID NO: 118977 - protein, 16 aa, Mycobacterium tuberculosis
LAPDFLSPPAEEAPPV

SEQ ID NO: 118978 - protein, 16 aa, Mycobacterium tuberculosis
APDFLSPPAEEAPPVP

SEQ ID NO: 118979 - protein, 16 aa, Mycobacterium tuberculosis
PDFLSPPAEEAPPVPV

SEQ ID NO: 118980 - protein, 16 aa, Mycobacterium tuberculosis
DFLSPPAEEAPPVPVA

SEQ ID NO: 118981 - protein, 16 aa, Mycobacterium tuberculosis
FLSPPAEEAPPVPVAY

SEQ ID NO: 118982 - protein, 16 aa, Mycobacterium tuberculosis
LSPPAEEAPPVPVAYS

SEQ ID NO: 118983 - protein, 16 aa, Mycobacterium tuberculosis
SPPAEEAPPVPVAYSV

SEQ ID NO: 118984 - protein, 16 aa, Mycobacterium tuberculosis
PPAEEAPPVPVAYSVN

SEQ ID NO: 118985 - protein, 16 aa, Mycobacterium tuberculosis
PAEEAPPVPVAYSVNW

SEQ ID NO: 118986 - protein, 16 aa, Mycobacterium tuberculosis
AEEAPPVPVAYSVNWD

SEQ ID NO: 118987 - protein, 16 aa, Mycobacterium tuberculosis
EEAPPVPVAYSVNWDA

SEQ ID NO: 118988 - protein, 16 aa, Mycobacterium tuberculosis
EAPPVPVAYSVNWDAI

SEQ ID NO: 118989 - protein, 16 aa, Mycobacterium tuberculosis
APPVPVAYSVNWDAIA

SEQ ID NO: 118990 - protein, 16 aa, Mycobacterium tuberculosis
PPVPVAYSVNWDAIAQ

SEQ ID NO: 118991 - protein, 16 aa, Mycobacterium tuberculosis
PVPVAYSVNWDAIAQC

SEQ ID NO: 118992 - protein, 16 aa, Mycobacterium tuberculosis
VPVAYSVNWDAIAQCE

SEQ ID NO: 118993 - protein, 16 aa, Mycobacterium tuberculosis
PVAYSVNWDAIAQCES

SEQ ID NO: 118994 - protein, 16 aa, Mycobacterium tuberculosis
VAYSVNWDAIAQCESG

SEQ ID NO: 118995 - protein, 16 aa, Mycobacterium tuberculosis
AYSVNWDAIAQCESGG

SEQ ID NO: 118996 - protein, 16 aa, Mycobacterium tuberculosis
YSVNWDAIAQCESGGN

SEQ ID NO: 118997 - protein, 16 aa, Mycobacterium tuberculosis
SVNWDAIAQCESGGNW

SEQ ID NO: 118998 - protein, 16 aa, Mycobacterium tuberculosis
VNWDAIAQCESGGNWS

SEQ ID NO: 118999 - protein, 16 aa, Mycobacterium tuberculosis
NWDAIAQCESGGNWSI

SEQ ID NO: 119000 - protein, 16 aa, Mycobacterium tuberculosis
WDAIAQCESGGNWSIN

SEQ ID NO: 119001 - protein, 16 aa, Mycobacterium tuberculosis
DAIAQCESGGNWSINT

SEQ ID NO: 119002 - protein, 16 aa, Mycobacterium tuberculosis
AIAQCESGGNWSINTG

SEQ ID NO: 119003 - protein, 16 aa, Mycobacterium tuberculosis
IAQCESGGNWSINTGN

SEQ ID NO: 119004 - protein, 16 aa, Mycobacterium tuberculosis
AQCESGGNWSINTGNG

SEQ ID NO: 119005 - protein, 16 aa, Mycobacterium tuberculosis
QCESGGNWSINTGNGY

SEQ ID NO: 119006 - protein, 16 aa, Mycobacterium tuberculosis
CESGGNWSINTGNGYY

SEQ ID NO: 119007 - protein, 16 aa, Mycobacterium tuberculosis
ESGGNWSINTGNGYYG

SEQ ID NO: 119008 - protein, 16 aa, Mycobacterium tuberculosis
SGGNWSINTGNGYYGG

SEQ ID NO: 119009 - protein, 16 aa, Mycobacterium tuberculosis
GGNWSINTGNGYYGGL

SEQ ID NO: 119010 - protein, 16 aa, Mycobacterium tuberculosis
GNWSINTGNGYYGGLR

SEQ ID NO: 119011 - protein, 16 aa, Mycobacterium tuberculosis
NWSINTGNGYYGGLRF

SEQ ID NO: 119012 - protein, 16 aa, Mycobacterium tuberculosis
WSINTGNGYYGGLRFT

SEQ ID NO: 119013 - protein, 16 aa, Mycobacterium tuberculosis
SINTGNGYYGGLRFTA

SEQ ID NO: 119014 - protein, 16 aa, Mycobacterium tuberculosis
INTGNGYYGGLRFTAG

SEQ ID NO: 119015 - protein, 16 aa, Mycobacterium tuberculosis
NTGNGYYGGLRFTAGT

SEQ ID NO: 119016 - protein, 16 aa, Mycobacterium tuberculosis
TGNGYYGGLRFTAGTW

SEQ ID NO: 119017 - protein, 16 aa, Mycobacterium tuberculosis
GNGYYGGLRFTAGTWR

SEQ ID NO: 119018 - protein, 16 aa, Mycobacterium tuberculosis
NGYYGGLRFTAGTWRA

SEQ ID NO: 119019 - protein, 16 aa, Mycobacterium tuberculosis
GYYGGLRFTAGTWRAN

SEQ ID NO: 119020 - protein, 16 aa, Mycobacterium tuberculosis
YYGGLRFTAGTWRANG

SEQ ID NO: 119021 - protein, 16 aa, Mycobacterium tuberculosis
YGGLRFTAGTWRANGG

SEQ ID NO: 119022 - protein, 16 aa, Mycobacterium tuberculosis
GGLRFTAGTWRANGGS

SEQ ID NO: 119023 - protein, 16 aa, Mycobacterium tuberculosis
GLRFTAGTWRANGGSG

SEQ ID NO: 119024 - protein, 16 aa, Mycobacterium tuberculosis
LRFTAGTWRANGGSGS

SEQ ID NO: 119025 - protein, 16 aa, Mycobacterium tuberculosis
RFTAGTWRANGGSGSA

SEQ ID NO: 119026 - protein, 16 aa, Mycobacterium tuberculosis
FTAGTWRANGGSGSAA

SEQ ID NO: 119027 - protein, 16 aa, Mycobacterium tuberculosis
TAGTWRANGGSGSAAN

SEQ ID NO: 119028 - protein, 16 aa, Mycobacterium tuberculosis
AGTWRANGGSGSAANA

SEQ ID NO: 119029 - protein, 16 aa, Mycobacterium tuberculosis
GTWRANGGSGSAANAS

SEQ ID NO: 119030 - protein, 16 aa, Mycobacterium tuberculosis
TWRANGGSGSAANASR

SEQ ID NO: 119031 - protein, 16 aa, Mycobacterium tuberculosis
WRANGGSGSAANASRE

SEQ ID NO: 119032 - protein, 16 aa, Mycobacterium tuberculosis
RANGGSGSAANASREE

SEQ ID NO: 119033 - protein, 16 aa, Mycobacterium tuberculosis
ANGGSGSAANASREEQ

SEQ ID NO: 119034 - protein, 16 aa, Mycobacterium tuberculosis
NGGSGSAANASREEQI

SEQ ID NO: 119035 - protein, 16 aa, Mycobacterium tuberculosis
GGSGSAANASREEQIR

SEQ ID NO: 119036 - protein, 16 aa, Mycobacterium tuberculosis
GSGSAANASREEQIRV

SEQ ID NO: 119037 - protein, 16 aa, Mycobacterium tuberculosis
SGSAANASREEQIRVA

SEQ ID NO: 119038 - protein, 16 aa, Mycobacterium tuberculosis
GSAANASREEQIRVAE

SEQ ID NO: 119039 - protein, 16 aa, Mycobacterium tuberculosis
SAANASREEQIRVAEN

SEQ ID NO: 119040 - protein, 16 aa, Mycobacterium tuberculosis
AANASREEQIRVAENV

SEQ ID NO: 119041 - protein, 16 aa, Mycobacterium tuberculosis
ANASREEQIRVAENVL

SEQ ID NO: 119042 - protein, 16 aa, Mycobacterium tuberculosis
NASREEQIRVAENVLR

SEQ ID NO: 119043 - protein, 16 aa, Mycobacterium tuberculosis
ASREEQIRVAENVLRS

SEQ ID NO: 119044 - protein, 16 aa, Mycobacterium tuberculosis
SREEQIRVAENVLRSQ

SEQ ID NO: 119045 - protein, 16 aa, Mycobacterium tuberculosis
REEQIRVAENVLRSQG

SEQ ID NO: 119046 - protein, 16 aa, Mycobacterium tuberculosis
EEQIRVAENVLRSQGI

SEQ ID NO: 119047 - protein, 16 aa, Mycobacterium tuberculosis
EQIRVAENVLRSQGIR

SEQ ID NO: 119048 - protein, 16 aa, Mycobacterium tuberculosis
QIRVAENVLRSQGIRA

SEQ ID NO: 119049 - protein, 16 aa, Mycobacterium tuberculosis
IRVAENVLRSQGIRAW

SEQ ID NO: 119050 - protein, 16 aa, Mycobacterium tuberculosis
RVAENVLRSQGIRAWP

SEQ ID NO: 119051 - protein, 16 aa, Mycobacterium tuberculosis
VAENVLRSQGIRAWPV

SEQ ID NO: 119052 - protein, 16 aa, Mycobacterium tuberculosis
AENVLRSQGIRAWPVC

SEQ ID NO: 119053 - protein, 16 aa, Mycobacterium tuberculosis
ENVLRSQGIRAWPVCG

SEQ ID NO: 119054 - protein, 16 aa, Mycobacterium tuberculosis
NVLRSQGIRAWPVCGR

SEQ ID NO: 119055 - protein, 16 aa, Mycobacterium tuberculosis
VLRSQGIRAWPVCGRR

SEQ ID NO: 119056 - protein, 16 aa, Mycobacterium tuberculosis
LRSQGIRAWPVCGRRG

SEQ ID NO: 119057 - protein, 297 aa, Mycobacterium tuberculosis
MSSGNSSLGIIVGIDDSPAAQVAVRWAARDAELRKIPLTLVHAVSPEVATWLEVPLPPGVLRWQQDHGRHLIDDALKVVEQASLRAGPPTVHSEIVPAAAVPTLVDMSKDAVLMVVGCLGSGRWPGRLLGSVSSGLLRHAHCPVVIIHDEDSVMPHPQQAPVLVGVDGSSASELATAIAFDEASRRNVDLVALHAWSDVDVSEWPGIDWPATQSMAEQVLAERLAGWQERYPNVAITRVVVRDQPARQLVQRSEEAQLVVVGSRGRGGYAGMLVGSVGETVAQLARTPVIVARESLT

SEQ ID NO: 119058 - protein, 8 aa, Mycobacterium tuberculosis
MSSGNSSL

SEQ ID NO: 119059 - protein, 8 aa, Mycobacterium tuberculosis
SLGIIVGI

SEQ ID NO: 119060 - protein, 8 aa, Mycobacterium tuberculosis
GIDDSPAA

SEQ ID NO: 119061 - protein, 8 aa, Mycobacterium tuberculosis
SPAAQVAV

SEQ ID NO: 119062 - protein, 8 aa, Mycobacterium tuberculosis
PAAQVAVR

SEQ ID NO: 119063 - protein, 8 aa, Mycobacterium tuberculosis
AAQVAVRW

SEQ ID NO: 119064 - protein, 8 aa, Mycobacterium tuberculosis
AQVAVRWA

SEQ ID NO: 119065 - protein, 8 aa, Mycobacterium tuberculosis
QVAVRWAA

SEQ ID NO: 119066 - protein, 8 aa, Mycobacterium tuberculosis
VAVRWAAR

SEQ ID NO: 119067 - protein, 8 aa, Mycobacterium tuberculosis
WAARDAEL

SEQ ID NO: 119068 - protein, 8 aa, Mycobacterium tuberculosis
AARDAELR

SEQ ID NO: 119069 - protein, 8 aa, Mycobacterium tuberculosis
AELRKIPL

SEQ ID NO: 119070 - protein, 8 aa, Mycobacterium tuberculosis
RKIPLTLV

SEQ ID NO: 119071 - protein, 8 aa, Mycobacterium tuberculosis
IPLTLVHA

SEQ ID NO: 119072 - protein, 8 aa, Mycobacterium tuberculosis
PLTLVHAV

SEQ ID NO: 119073 - protein, 8 aa, Mycobacterium tuberculosis
VSPEVATW

SEQ ID NO: 119074 - protein, 8 aa, Mycobacterium tuberculosis
SPEVATWL

SEQ ID NO: 119075 - protein, 8 aa, Mycobacterium tuberculosis
EVATWLEV

SEQ ID NO: 119076 - protein, 8 aa, Mycobacterium tuberculosis
EVPLPPGV

SEQ ID NO: 119077 - protein, 8 aa, Mycobacterium tuberculosis
VPLPPGVL

SEQ ID NO: 119078 - protein, 8 aa, Mycobacterium tuberculosis
LPPGVLRW

SEQ ID NO: 119079 - protein, 8 aa, Mycobacterium tuberculosis
RWQQDHGR

SEQ ID NO: 119080 - protein, 8 aa, Mycobacterium tuberculosis
HLIDDALK

SEQ ID NO: 119081 - protein, 8 aa, Mycobacterium tuberculosis
LIDDALKV

SEQ ID NO: 119082 - protein, 8 aa, Mycobacterium tuberculosis
ALKVVEQA

SEQ ID NO: 119083 - protein, 8 aa, Mycobacterium tuberculosis
KVVEQASL

SEQ ID NO: 119084 - protein, 8 aa, Mycobacterium tuberculosis
VVEQASLR

SEQ ID NO: 119085 - protein, 8 aa, Mycobacterium tuberculosis
SLRAGPPT

SEQ ID NO: 119086 - protein, 8 aa, Mycobacterium tuberculosis
EIVPAAAV

SEQ ID NO: 119087 - protein, 8 aa, Mycobacterium tuberculosis
VPAAAVPT

SEQ ID NO: 119088 - protein, 8 aa, Mycobacterium tuberculosis
AAAVPTLV

SEQ ID NO: 119089 - protein, 8 aa, Mycobacterium tuberculosis
AVPTLVDM

SEQ ID NO: 119090 - protein, 8 aa, Mycobacterium tuberculosis
VPTLVDMS

SEQ ID NO: 119091 - protein, 8 aa, Mycobacterium tuberculosis
PTLVDMSK

SEQ ID NO: 119092 - protein, 8 aa, Mycobacterium tuberculosis
DMSKDAVL

SEQ ID NO: 119093 - protein, 8 aa, Mycobacterium tuberculosis
SKDAVLMV

SEQ ID NO: 119094 - protein, 8 aa, Mycobacterium tuberculosis
VLMVVGCL

SEQ ID NO: 119095 - protein, 8 aa, Mycobacterium tuberculosis
GSGRWPGR

SEQ ID NO: 119096 - protein, 8 aa, Mycobacterium tuberculosis
GRWPGRLL

SEQ ID NO: 119097 - protein, 8 aa, Mycobacterium tuberculosis
RLLGSVSS

SEQ ID NO: 119098 - protein, 8 aa, Mycobacterium tuberculosis
SVSSGLLR

SEQ ID NO: 119099 - protein, 8 aa, Mycobacterium tuberculosis
GLLRHAHC

SEQ ID NO: 119100 - protein, 8 aa, Mycobacterium tuberculosis
HAHCPVVI

SEQ ID NO: 119101 - protein, 8 aa, Mycobacterium tuberculosis
IIHDEDSV

SEQ ID NO: 119102 - protein, 8 aa, Mycobacterium tuberculosis
IHDEDSVM

SEQ ID NO: 119103 - protein, 8 aa, Mycobacterium tuberculosis
VMPHPQQA

SEQ ID NO: 119104 - protein, 8 aa, Mycobacterium tuberculosis
HPQQAPVL

SEQ ID NO: 119105 - protein, 8 aa, Mycobacterium tuberculosis
QAPVLVGV

SEQ ID NO: 119106 - protein, 8 aa, Mycobacterium tuberculosis
SASELATA

SEQ ID NO: 119107 - protein, 8 aa, Mycobacterium tuberculosis
ELATAIAF

SEQ ID NO: 119108 - protein, 8 aa, Mycobacterium tuberculosis
TAIAFDEA

SEQ ID NO: 119109 - protein, 8 aa, Mycobacterium tuberculosis
IAFDEASR

SEQ ID NO: 119110 - protein, 8 aa, Mycobacterium tuberculosis
ALHAWSDV

SEQ ID NO: 119111 - protein, 8 aa, Mycobacterium tuberculosis
HAWSDVDV

SEQ ID NO: 119112 - protein, 8 aa, Mycobacterium tuberculosis
DVSEWPGI

SEQ ID NO: 119113 - protein, 8 aa, Mycobacterium tuberculosis
SEWPGIDW

SEQ ID NO: 119114 - protein, 8 aa, Mycobacterium tuberculosis
WPGIDWPA

SEQ ID NO: 119115 - protein, 8 aa, Mycobacterium tuberculosis
GIDWPATQ

SEQ ID NO: 119116 - protein, 8 aa, Mycobacterium tuberculosis
WPATQSMA

SEQ ID NO: 119117 - protein, 8 aa, Mycobacterium tuberculosis
TQSMAEQV

SEQ ID NO: 119118 - protein, 8 aa, Mycobacterium tuberculosis
SMAEQVLA

SEQ ID NO: 119119 - protein, 8 aa, Mycobacterium tuberculosis
VLAERLAG

SEQ ID NO: 119120 - protein, 8 aa, Mycobacterium tuberculosis
RLAGWQER

SEQ ID NO: 119121 - protein, 8 aa, Mycobacterium tuberculosis
LAGWQERY

SEQ ID NO: 119122 - protein, 8 aa, Mycobacterium tuberculosis
WQERYPNV

SEQ ID NO: 119123 - protein, 8 aa, Mycobacterium tuberculosis
ERYPNVAI

SEQ ID NO: 119124 - protein, 8 aa, Mycobacterium tuberculosis
RYPNVAIT

SEQ ID NO: 119125 - protein, 8 aa, Mycobacterium tuberculosis
YPNVAITR

SEQ ID NO: 119126 - protein, 8 aa, Mycobacterium tuberculosis
NVAITRVV

SEQ ID NO: 119127 - protein, 8 aa, Mycobacterium tuberculosis
VAITRVVV

SEQ ID NO: 119128 - protein, 8 aa, Mycobacterium tuberculosis
AITRVVVR

SEQ ID NO: 119129 - protein, 8 aa, Mycobacterium tuberculosis
VVRDQPAR

SEQ ID NO: 119130 - protein, 8 aa, Mycobacterium tuberculosis
SEEAQLVV

SEQ ID NO: 119131 - protein, 8 aa, Mycobacterium tuberculosis
EEAQLVVV

SEQ ID NO: 119132 - protein, 8 aa, Mycobacterium tuberculosis
QLVVVGSR

SEQ ID NO: 119133 - protein, 8 aa, Mycobacterium tuberculosis
VVVGSRGR

SEQ ID NO: 119134 - protein, 8 aa, Mycobacterium tuberculosis
GSRGRGGY

SEQ ID NO: 119135 - protein, 8 aa, Mycobacterium tuberculosis
GRGGYAGM

SEQ ID NO: 119136 - protein, 8 aa, Mycobacterium tuberculosis
GGYAGMLV

SEQ ID NO: 119137 - protein, 8 aa, Mycobacterium tuberculosis
ETVAQLAR

SEQ ID NO: 119138 - protein, 8 aa, Mycobacterium tuberculosis
TVAQLART

SEQ ID NO: 119139 - protein, 8 aa, Mycobacterium tuberculosis
AQLARTPV

SEQ ID NO: 119140 - protein, 8 aa, Mycobacterium tuberculosis
QLARTPVI

SEQ ID NO: 119141 - protein, 8 aa, Mycobacterium tuberculosis
RTPVIVAR

SEQ ID NO: 119142 - protein, 8 aa, Mycobacterium tuberculosis
VIVARESL

SEQ ID NO: 119143 - protein, 9 aa, Mycobacterium tuberculosis
SSLGIIVGI

SEQ ID NO: 119144 - protein, 9 aa, Mycobacterium tuberculosis
GIDDSPAAQ

SEQ ID NO: 119145 - protein, 9 aa, Mycobacterium tuberculosis
DSPAAQVAV

SEQ ID NO: 119146 - protein, 9 aa, Mycobacterium tuberculosis
SPAAQVAVR

SEQ ID NO: 119147 - protein, 9 aa, Mycobacterium tuberculosis
PAAQVAVRW

SEQ ID NO: 119148 - protein, 9 aa, Mycobacterium tuberculosis
AQVAVRWAA

SEQ ID NO: 119149 - protein, 9 aa, Mycobacterium tuberculosis
QVAVRWAAR

SEQ ID NO: 119150 - protein, 9 aa, Mycobacterium tuberculosis
RWAARDAEL

SEQ ID NO: 119151 - protein, 9 aa, Mycobacterium tuberculosis
WAARDAELR

SEQ ID NO: 119152 - protein, 9 aa, Mycobacterium tuberculosis
AARDAELRK

SEQ ID NO: 119153 - protein, 9 aa, Mycobacterium tuberculosis
ELRKIPLTL

SEQ ID NO: 119154 - protein, 9 aa, Mycobacterium tuberculosis
KIPLTLVHA

SEQ ID NO: 119155 - protein, 9 aa, Mycobacterium tuberculosis
IPLTLVHAV

SEQ ID NO: 119156 - protein, 9 aa, Mycobacterium tuberculosis
LVHAVSPEV

SEQ ID NO: 119157 - protein, 9 aa, Mycobacterium tuberculosis
AVSPEVATW

SEQ ID NO: 119158 - protein, 9 aa, Mycobacterium tuberculosis
VATWLEVPL

SEQ ID NO: 119159 - protein, 9 aa, Mycobacterium tuberculosis
LEVPLPPGV

SEQ ID NO: 119160 - protein, 9 aa, Mycobacterium tuberculosis
EVPLPPGVL

SEQ ID NO: 119161 - protein, 9 aa, Mycobacterium tuberculosis
PLPPGVLRW

SEQ ID NO: 119162 - protein, 9 aa, Mycobacterium tuberculosis
WQQDHGRHL

SEQ ID NO: 119163 - protein, 9 aa, Mycobacterium tuberculosis
QQDHGRHLI

SEQ ID NO: 119164 - protein, 9 aa, Mycobacterium tuberculosis
HLIDDALKV

SEQ ID NO: 119165 - protein, 9 aa, Mycobacterium tuberculosis
LIDDALKVV

SEQ ID NO: 119166 - protein, 9 aa, Mycobacterium tuberculosis
KVVEQASLR

SEQ ID NO: 119167 - protein, 9 aa, Mycobacterium tuberculosis
SLRAGPPTV

SEQ ID NO: 119168 - protein, 9 aa, Mycobacterium tuberculosis
GPPTVHSEI

SEQ ID NO: 119169 - protein, 9 aa, Mycobacterium tuberculosis
TVHSEIVPA

SEQ ID NO: 119170 - protein, 9 aa, Mycobacterium tuberculosis
SEIVPAAAV

SEQ ID NO: 119171 - protein, 9 aa, Mycobacterium tuberculosis
VPAAAVPTL

SEQ ID NO: 119172 - protein, 9 aa, Mycobacterium tuberculosis
PAAAVPTLV

SEQ ID NO: 119173 - protein, 9 aa, Mycobacterium tuberculosis
TLVDMSKDA

SEQ ID NO: 119174 - protein, 9 aa, Mycobacterium tuberculosis
LVDMSKDAV

SEQ ID NO: 119175 - protein, 9 aa, Mycobacterium tuberculosis
MSKDAVLMV

SEQ ID NO: 119176 - protein, 9 aa, Mycobacterium tuberculosis
SKDAVLMVV

SEQ ID NO: 119177 - protein, 9 aa, Mycobacterium tuberculosis
WPGRLLGSV

SEQ ID NO: 119178 - protein, 9 aa, Mycobacterium tuberculosis
LLGSVSSGL

SEQ ID NO: 119179 - protein, 9 aa, Mycobacterium tuberculosis
GSVSSGLLR

SEQ ID NO: 119180 - protein, 9 aa, Mycobacterium tuberculosis
SVSSGLLRH

SEQ ID NO: 119181 - protein, 9 aa, Mycobacterium tuberculosis
LLRHAHCPV

SEQ ID NO: 119182 - protein, 9 aa, Mycobacterium tuberculosis
HAHCPVVII

SEQ ID NO: 119183 - protein, 9 aa, Mycobacterium tuberculosis
VIIHDEDSV

SEQ ID NO: 119184 - protein, 9 aa, Mycobacterium tuberculosis
IIHDEDSVM

SEQ ID NO: 119185 - protein, 9 aa, Mycobacterium tuberculosis
SVMPHPQQA

SEQ ID NO: 119186 - protein, 9 aa, Mycobacterium tuberculosis
MPHPQQAPV

SEQ ID NO: 119187 - protein, 9 aa, Mycobacterium tuberculosis
HPQQAPVLV

SEQ ID NO: 119188 - protein, 9 aa, Mycobacterium tuberculosis
QQAPVLVGV

SEQ ID NO: 119189 - protein, 9 aa, Mycobacterium tuberculosis
SASELATAI

SEQ ID NO: 119190 - protein, 9 aa, Mycobacterium tuberculosis
SELATAIAF

SEQ ID NO: 119191 - protein, 9 aa, Mycobacterium tuberculosis
ATAIAFDEA

SEQ ID NO: 119192 - protein, 9 aa, Mycobacterium tuberculosis
TAIAFDEAS

SEQ ID NO: 119193 - protein, 9 aa, Mycobacterium tuberculosis
AIAFDEASR

SEQ ID NO: 119194 - protein, 9 aa, Mycobacterium tuberculosis
IAFDEASRR

SEQ ID NO: 119195 - protein, 9 aa, Mycobacterium tuberculosis
RRNVDLVAL

SEQ ID NO: 119196 - protein, 9 aa, Mycobacterium tuberculosis
WSDVDVSEW

SEQ ID NO: 119197 - protein, 9 aa, Mycobacterium tuberculosis
EWPGIDWPA

SEQ ID NO: 119198 - protein, 9 aa, Mycobacterium tuberculosis
WPGIDWPAT

SEQ ID NO: 119199 - protein, 9 aa, Mycobacterium tuberculosis
IDWPATQSM

SEQ ID NO: 119200 - protein, 9 aa, Mycobacterium tuberculosis
WPATQSMAE

SEQ ID NO: 119201 - protein, 9 aa, Mycobacterium tuberculosis
ATQSMAEQV

SEQ ID NO: 119202 - protein, 9 aa, Mycobacterium tuberculosis
QSMAEQVLA

SEQ ID NO: 119203 - protein, 9 aa, Mycobacterium tuberculosis
SMAEQVLAE

SEQ ID NO: 119204 - protein, 9 aa, Mycobacterium tuberculosis
MAEQVLAER

SEQ ID NO: 119205 - protein, 9 aa, Mycobacterium tuberculosis
AEQVLAERL

SEQ ID NO: 119206 - protein, 9 aa, Mycobacterium tuberculosis
VLAERLAGW

SEQ ID NO: 119207 - protein, 9 aa, Mycobacterium tuberculosis
RLAGWQERY

SEQ ID NO: 119208 - protein, 9 aa, Mycobacterium tuberculosis
QERYPNVAI

SEQ ID NO: 119209 - protein, 9 aa, Mycobacterium tuberculosis
RYPNVAITR

SEQ ID NO: 119210 - protein, 9 aa, Mycobacterium tuberculosis
YPNVAITRV

SEQ ID NO: 119211 - protein, 9 aa, Mycobacterium tuberculosis
NVAITRVVV

SEQ ID NO: 119212 - protein, 9 aa, Mycobacterium tuberculosis
VAITRVVVR

SEQ ID NO: 119213 - protein, 9 aa, Mycobacterium tuberculosis
VVVRDQPAR

SEQ ID NO: 119214 - protein, 9 aa, Mycobacterium tuberculosis
QPARQLVQR

SEQ ID NO: 119215 - protein, 9 aa, Mycobacterium tuberculosis
QLVQRSEEA

SEQ ID NO: 119216 - protein, 9 aa, Mycobacterium tuberculosis
SEEAQLVVV

SEQ ID NO: 119217 - protein, 9 aa, Mycobacterium tuberculosis
AQLVVVGSR

SEQ ID NO: 119218 - protein, 9 aa, Mycobacterium tuberculosis
LVVVGSRGR

SEQ ID NO: 119219 - protein, 9 aa, Mycobacterium tuberculosis
YAGMLVGSV

SEQ ID NO: 119220 - protein, 9 aa, Mycobacterium tuberculosis
MLVGSVGET

SEQ ID NO: 119221 - protein, 9 aa, Mycobacterium tuberculosis
LVGSVGETV

SEQ ID NO: 119222 - protein, 9 aa, Mycobacterium tuberculosis
SVGETVAQL

SEQ ID NO: 119223 - protein, 9 aa, Mycobacterium tuberculosis
ETVAQLART

SEQ ID NO: 119224 - protein, 9 aa, Mycobacterium tuberculosis
VAQLARTPV

SEQ ID NO: 119225 - protein, 9 aa, Mycobacterium tuberculosis
AQLARTPVI

SEQ ID NO: 119226 - protein, 9 aa, Mycobacterium tuberculosis
QLARTPVIV

SEQ ID NO: 119227 - protein, 10 aa, Mycobacterium tuberculosis
MSSGNSSLGI

SEQ ID NO: 119228 - protein, 10 aa, Mycobacterium tuberculosis
NSSLGIIVGI

SEQ ID NO: 119229 - protein, 10 aa, Mycobacterium tuberculosis
IIVGIDDSPA

SEQ ID NO: 119230 - protein, 10 aa, Mycobacterium tuberculosis
GIDDSPAAQV

SEQ ID NO: 119231 - protein, 10 aa, Mycobacterium tuberculosis
DSPAAQVAVR

SEQ ID NO: 119232 - protein, 10 aa, Mycobacterium tuberculosis
SPAAQVAVRW

SEQ ID NO: 119233 - protein, 10 aa, Mycobacterium tuberculosis
AQVAVRWAAR

SEQ ID NO: 119234 - protein, 10 aa, Mycobacterium tuberculosis
VRWAARDAEL

SEQ ID NO: 119235 - protein, 10 aa, Mycobacterium tuberculosis
RWAARDAELR

SEQ ID NO: 119236 - protein, 10 aa, Mycobacterium tuberculosis
WAARDAELRK

SEQ ID NO: 119237 - protein, 10 aa, Mycobacterium tuberculosis
AELRKIPLTL

SEQ ID NO: 119238 - protein, 10 aa, Mycobacterium tuberculosis
ELRKIPLTLV

SEQ ID NO: 119239 - protein, 10 aa, Mycobacterium tuberculosis
KIPLTLVHAV

SEQ ID NO: 119240 - protein, 10 aa, Mycobacterium tuberculosis
IPLTLVHAVS

SEQ ID NO: 119241 - protein, 10 aa, Mycobacterium tuberculosis
TLVHAVSPEV

SEQ ID NO: 119242 - protein, 10 aa, Mycobacterium tuberculosis
HAVSPEVATW

SEQ ID NO: 119243 - protein, 10 aa, Mycobacterium tuberculosis
AVSPEVATWL

SEQ ID NO: 119244 - protein, 10 aa, Mycobacterium tuberculosis
SPEVATWLEV

SEQ ID NO: 119245 - protein, 10 aa, Mycobacterium tuberculosis
EVATWLEVPL

SEQ ID NO: 119246 - protein, 10 aa, Mycobacterium tuberculosis
WLEVPLPPGV

SEQ ID NO: 119247 - protein, 10 aa, Mycobacterium tuberculosis
LEVPLPPGVL

SEQ ID NO: 119248 - protein, 10 aa, Mycobacterium tuberculosis
EVPLPPGVLR

SEQ ID NO: 119249 - protein, 10 aa, Mycobacterium tuberculosis
VPLPPGVLRW

SEQ ID NO: 119250 - protein, 10 aa, Mycobacterium tuberculosis
PLPPGVLRWQ

SEQ ID NO: 119251 - protein, 10 aa, Mycobacterium tuberculosis
VLRWQQDHGR

SEQ ID NO: 119252 - protein, 10 aa, Mycobacterium tuberculosis
WQQDHGRHLI

SEQ ID NO: 119253 - protein, 10 aa, Mycobacterium tuberculosis
HLIDDALKVV

SEQ ID NO: 119254 - protein, 10 aa, Mycobacterium tuberculosis
ALKVVEQASL

SEQ ID NO: 119255 - protein, 10 aa, Mycobacterium tuberculosis
KVVEQASLRA

SEQ ID NO: 119256 - protein, 10 aa, Mycobacterium tuberculosis
GPPTVHSEIV

SEQ ID NO: 119257 - protein, 10 aa, Mycobacterium tuberculosis
TVHSEIVPAA

SEQ ID NO: 119258 - protein, 10 aa, Mycobacterium tuberculosis
HSEIVPAAAV

SEQ ID NO: 119259 - protein, 10 aa, Mycobacterium tuberculosis
EIVPAAAVPT

SEQ ID NO: 119260 - protein, 10 aa, Mycobacterium tuberculosis
IVPAAAVPTL

SEQ ID NO: 119261 - protein, 10 aa, Mycobacterium tuberculosis
VPAAAVPTLV

SEQ ID NO: 119262 - protein, 10 aa, Mycobacterium tuberculosis
AVPTLVDMSK

SEQ ID NO: 119263 - protein, 10 aa, Mycobacterium tuberculosis
TLVDMSKDAV

SEQ ID NO: 119264 - protein, 10 aa, Mycobacterium tuberculosis
DMSKDAVLMV

SEQ ID NO: 119265 - protein, 10 aa, Mycobacterium tuberculosis
MSKDAVLMVV

SEQ ID NO: 119266 - protein, 10 aa, Mycobacterium tuberculosis
MVVGCLGSGR

SEQ ID NO: 119267 - protein, 10 aa, Mycobacterium tuberculosis
GRWPGRLLGS

SEQ ID NO: 119268 - protein, 10 aa, Mycobacterium tuberculosis
WPGRLLGSVS

SEQ ID NO: 119269 - protein, 10 aa, Mycobacterium tuberculosis
RLLGSVSSGL

SEQ ID NO: 119270 - protein, 10 aa, Mycobacterium tuberculosis
LLGSVSSGLL

SEQ ID NO: 119271 - protein, 10 aa, Mycobacterium tuberculosis
SVSSGLLRHA

SEQ ID NO: 119272 - protein, 10 aa, Mycobacterium tuberculosis
GLLRHAHCPV

SEQ ID NO: 119273 - protein, 10 aa, Mycobacterium tuberculosis
LLRHAHCPVV

SEQ ID NO: 119274 - protein, 10 aa, Mycobacterium tuberculosis
VVIIHDEDSV

SEQ ID NO: 119275 - protein, 10 aa, Mycobacterium tuberculosis
VIIHDEDSVM

SEQ ID NO: 119276 - protein, 10 aa, Mycobacterium tuberculosis
VMPHPQQAPV

SEQ ID NO: 119277 - protein, 10 aa, Mycobacterium tuberculosis
MPHPQQAPVL

SEQ ID NO: 119278 - protein, 10 aa, Mycobacterium tuberculosis
APVLVGVDGS

SEQ ID NO: 119279 - protein, 10 aa, Mycobacterium tuberculosis
VLVGVDGSSA

SEQ ID NO: 119280 - protein, 10 aa, Mycobacterium tuberculosis
GVDGSSASEL

SEQ ID NO: 119281 - protein, 10 aa, Mycobacterium tuberculosis
SSASELATAI

SEQ ID NO: 119282 - protein, 10 aa, Mycobacterium tuberculosis
LATAIAFDEA

SEQ ID NO: 119283 - protein, 10 aa, Mycobacterium tuberculosis
TAIAFDEASR

SEQ ID NO: 119284 - protein, 10 aa, Mycobacterium tuberculosis
AIAFDEASRR

SEQ ID NO: 119285 - protein, 10 aa, Mycobacterium tuberculosis
AFDEASRRNV

SEQ ID NO: 119286 - protein, 10 aa, Mycobacterium tuberculosis
EASRRNVDLV

SEQ ID NO: 119287 - protein, 10 aa, Mycobacterium tuberculosis
RRNVDLVALH

SEQ ID NO: 119288 - protein, 10 aa, Mycobacterium tuberculosis
LVALHAWSDV

SEQ ID NO: 119289 - protein, 10 aa, Mycobacterium tuberculosis
ALHAWSDVDV

SEQ ID NO: 119290 - protein, 10 aa, Mycobacterium tuberculosis
SEWPGIDWPA

SEQ ID NO: 119291 - protein, 10 aa, Mycobacterium tuberculosis
GIDWPATQSM

SEQ ID NO: 119292 - protein, 10 aa, Mycobacterium tuberculosis
WPATQSMAEQ

SEQ ID NO: 119293 - protein, 10 aa, Mycobacterium tuberculosis
SMAEQVLAER

SEQ ID NO: 119294 - protein, 10 aa, Mycobacterium tuberculosis
MAEQVLAERL

SEQ ID NO: 119295 - protein, 10 aa, Mycobacterium tuberculosis
AEQVLAERLA

SEQ ID NO: 119296 - protein, 10 aa, Mycobacterium tuberculosis
QVLAERLAGW

SEQ ID NO: 119297 - protein, 10 aa, Mycobacterium tuberculosis
VLAERLAGWQ

SEQ ID NO: 119298 - protein, 10 aa, Mycobacterium tuberculosis
RLAGWQERYP

SEQ ID NO: 119299 - protein, 10 aa, Mycobacterium tuberculosis
WQERYPNVAI

SEQ ID NO: 119300 - protein, 10 aa, Mycobacterium tuberculosis
ERYPNVAITR

SEQ ID NO: 119301 - protein, 10 aa, Mycobacterium tuberculosis
RYPNVAITRV

SEQ ID NO: 119302 - protein, 10 aa, Mycobacterium tuberculosis
YPNVAITRVV

SEQ ID NO: 119303 - protein, 10 aa, Mycobacterium tuberculosis
NVAITRVVVR

SEQ ID NO: 119304 - protein, 10 aa, Mycobacterium tuberculosis
RVVVRDQPAR

SEQ ID NO: 119305 - protein, 10 aa, Mycobacterium tuberculosis
VVRDQPARQL

SEQ ID NO: 119306 - protein, 10 aa, Mycobacterium tuberculosis
VRDQPARQLV

SEQ ID NO: 119307 - protein, 10 aa, Mycobacterium tuberculosis
RQLVQRSEEA

SEQ ID NO: 119308 - protein, 10 aa, Mycobacterium tuberculosis
EAQLVVVGSR

SEQ ID NO: 119309 - protein, 10 aa, Mycobacterium tuberculosis
QLVVVGSRGR

SEQ ID NO: 119310 - protein, 10 aa, Mycobacterium tuberculosis
GYAGMLVGSV

SEQ ID NO: 119311 - protein, 10 aa, Mycobacterium tuberculosis
GMLVGSVGET

SEQ ID NO: 119312 - protein, 10 aa, Mycobacterium tuberculosis
MLVGSVGETV

SEQ ID NO: 119313 - protein, 10 aa, Mycobacterium tuberculosis
SVGETVAQLA

SEQ ID NO: 119314 - protein, 10 aa, Mycobacterium tuberculosis
TVAQLARTPV

SEQ ID NO: 119315 - protein, 10 aa, Mycobacterium tuberculosis
AQLARTPVIV

SEQ ID NO: 119316 - protein, 10 aa, Mycobacterium tuberculosis
QLARTPVIVA

SEQ ID NO: 119317 - protein, 10 aa, Mycobacterium tuberculosis
LARTPVIVAR

SEQ ID NO: 119318 - protein, 10 aa, Mycobacterium tuberculosis
TPVIVARESL

SEQ ID NO: 119319 - protein, 11 aa, Mycobacterium tuberculosis
MSSGNSSLGII

SEQ ID NO: 119320 - protein, 11 aa, Mycobacterium tuberculosis
GIIVGIDDSPA

SEQ ID NO: 119321 - protein, 11 aa, Mycobacterium tuberculosis
IIVGIDDSPAA

SEQ ID NO: 119322 - protein, 11 aa, Mycobacterium tuberculosis
VGIDDSPAAQV

SEQ ID NO: 119323 - protein, 11 aa, Mycobacterium tuberculosis
GIDDSPAAQVA

SEQ ID NO: 119324 - protein, 11 aa, Mycobacterium tuberculosis
DSPAAQVAVRW

SEQ ID NO: 119325 - protein, 11 aa, Mycobacterium tuberculosis
AAQVAVRWAAR

SEQ ID NO: 119326 - protein, 11 aa, Mycobacterium tuberculosis
AVRWAARDAEL

SEQ ID NO: 119327 - protein, 11 aa, Mycobacterium tuberculosis
RWAARDAELRK

SEQ ID NO: 119328 - protein, 11 aa, Mycobacterium tuberculosis
AELRKIPLTLV

SEQ ID NO: 119329 - protein, 11 aa, Mycobacterium tuberculosis
RKIPLTLVHAV

SEQ ID NO: 119330 - protein, 11 aa, Mycobacterium tuberculosis
IPLTLVHAVSP

SEQ ID NO: 119331 - protein, 11 aa, Mycobacterium tuberculosis
LTLVHAVSPEV

SEQ ID NO: 119332 - protein, 11 aa, Mycobacterium tuberculosis
TLVHAVSPEVA

SEQ ID NO: 119333 - protein, 11 aa, Mycobacterium tuberculosis
VHAVSPEVATW

SEQ ID NO: 119334 - protein, 11 aa, Mycobacterium tuberculosis
HAVSPEVATWL

SEQ ID NO: 119335 - protein, 11 aa, Mycobacterium tuberculosis
VSPEVATWLEV

SEQ ID NO: 119336 - protein, 11 aa, Mycobacterium tuberculosis
PEVATWLEVPL

SEQ ID NO: 119337 - protein, 11 aa, Mycobacterium tuberculosis
TWLEVPLPPGV

SEQ ID NO: 119338 - protein, 11 aa, Mycobacterium tuberculosis
WLEVPLPPGVL

SEQ ID NO: 119339 - protein, 11 aa, Mycobacterium tuberculosis
EVPLPPGVLRW

SEQ ID NO: 119340 - protein, 11 aa, Mycobacterium tuberculosis
PLPPGVLRWQQ

SEQ ID NO: 119341 - protein, 11 aa, Mycobacterium tuberculosis
GVLRWQQDHGR

SEQ ID NO: 119342 - protein, 11 aa, Mycobacterium tuberculosis
RWQQDHGRHLI

SEQ ID NO: 119343 - protein, 11 aa, Mycobacterium tuberculosis
LIDDALKVVEQ

SEQ ID NO: 119344 - protein, 11 aa, Mycobacterium tuberculosis
ALKVVEQASLR

SEQ ID NO: 119345 - protein, 11 aa, Mycobacterium tuberculosis
PPTVHSEIVPA

SEQ ID NO: 119346 - protein, 11 aa, Mycobacterium tuberculosis
TVHSEIVPAAA

SEQ ID NO: 119347 - protein, 11 aa, Mycobacterium tuberculosis
EIVPAAAVPTL

SEQ ID NO: 119348 - protein, 11 aa, Mycobacterium tuberculosis
IVPAAAVPTLV

SEQ ID NO: 119349 - protein, 11 aa, Mycobacterium tuberculosis
AAVPTLVDMSK

SEQ ID NO: 119350 - protein, 11 aa, Mycobacterium tuberculosis
VPTLVDMSKDA

SEQ ID NO: 119351 - protein, 11 aa, Mycobacterium tuberculosis
PTLVDMSKDAV

SEQ ID NO: 119352 - protein, 11 aa, Mycobacterium tuberculosis
TLVDMSKDAVL

SEQ ID NO: 119353 - protein, 11 aa, Mycobacterium tuberculosis
DMSKDAVLMVV

SEQ ID NO: 119354 - protein, 11 aa, Mycobacterium tuberculosis
LMVVGCLGSGR

SEQ ID NO: 119355 - protein, 11 aa, Mycobacterium tuberculosis
CLGSGRWPGRL

SEQ ID NO: 119356 - protein, 11 aa, Mycobacterium tuberculosis
GRWPGRLLGSV

SEQ ID NO: 119357 - protein, 11 aa, Mycobacterium tuberculosis
WPGRLLGSVSS

SEQ ID NO: 119358 - protein, 11 aa, Mycobacterium tuberculosis
GRLLGSVSSGL

SEQ ID NO: 119359 - protein, 11 aa, Mycobacterium tuberculosis
RLLGSVSSGLL

SEQ ID NO: 119360 - protein, 11 aa, Mycobacterium tuberculosis
LLGSVSSGLLR

SEQ ID NO: 119361 - protein, 11 aa, Mycobacterium tuberculosis
SVSSGLLRHAH

SEQ ID NO: 119362 - protein, 11 aa, Mycobacterium tuberculosis
GLLRHAHCPVV

SEQ ID NO: 119363 - protein, 11 aa, Mycobacterium tuberculosis
LLRHAHCPVVI

SEQ ID NO: 119364 - protein, 11 aa, Mycobacterium tuberculosis
PVVIIHDEDSV

SEQ ID NO: 119365 - protein, 11 aa, Mycobacterium tuberculosis
VVIIHDEDSVM

SEQ ID NO: 119366 - protein, 11 aa, Mycobacterium tuberculosis
SVMPHPQQAPV

SEQ ID NO: 119367 - protein, 11 aa, Mycobacterium tuberculosis
VMPHPQQAPVL

SEQ ID NO: 119368 - protein, 11 aa, Mycobacterium tuberculosis
MPHPQQAPVLV

SEQ ID NO: 119369 - protein, 11 aa, Mycobacterium tuberculosis
HPQQAPVLVGV

SEQ ID NO: 119370 - protein, 11 aa, Mycobacterium tuberculosis
APVLVGVDGSS

SEQ ID NO: 119371 - protein, 11 aa, Mycobacterium tuberculosis
VLVGVDGSSAS

SEQ ID NO: 119372 - protein, 11 aa, Mycobacterium tuberculosis
GVDGSSASELA

SEQ ID NO: 119373 - protein, 11 aa, Mycobacterium tuberculosis
SASELATAIAF

SEQ ID NO: 119374 - protein, 11 aa, Mycobacterium tuberculosis
ELATAIAFDEA

SEQ ID NO: 119375 - protein, 11 aa, Mycobacterium tuberculosis
ATAIAFDEASR

SEQ ID NO: 119376 - protein, 11 aa, Mycobacterium tuberculosis
TAIAFDEASRR

SEQ ID NO: 119377 - protein, 11 aa, Mycobacterium tuberculosis
IAFDEASRRNV

SEQ ID NO: 119378 - protein, 11 aa, Mycobacterium tuberculosis
ASRRNVDLVAL

SEQ ID NO: 119379 - protein, 11 aa, Mycobacterium tuberculosis
RNVDLVALHAW

SEQ ID NO: 119380 - protein, 11 aa, Mycobacterium tuberculosis
DLVALHAWSDV

SEQ ID NO: 119381 - protein, 11 aa, Mycobacterium tuberculosis
HAWSDVDVSEW

SEQ ID NO: 119382 - protein, 11 aa, Mycobacterium tuberculosis
GIDWPATQSMA

SEQ ID NO: 119383 - protein, 11 aa, Mycobacterium tuberculosis
WPATQSMAEQV

SEQ ID NO: 119384 - protein, 11 aa, Mycobacterium tuberculosis
QSMAEQVLAER

SEQ ID NO: 119385 - protein, 11 aa, Mycobacterium tuberculosis
SMAEQVLAERL

SEQ ID NO: 119386 - protein, 11 aa, Mycobacterium tuberculosis
AEQVLAERLAG

SEQ ID NO: 119387 - protein, 11 aa, Mycobacterium tuberculosis
VLAERLAGWQE

SEQ ID NO: 119388 - protein, 11 aa, Mycobacterium tuberculosis
LAERLAGWQER

SEQ ID NO: 119389 - protein, 11 aa, Mycobacterium tuberculosis
AERLAGWQERY

SEQ ID NO: 119390 - protein, 11 aa, Mycobacterium tuberculosis
RLAGWQERYPN

SEQ ID NO: 119391 - protein, 11 aa, Mycobacterium tuberculosis
ERYPNVAITRV

SEQ ID NO: 119392 - protein, 11 aa, Mycobacterium tuberculosis
RYPNVAITRVV

SEQ ID NO: 119393 - protein, 11 aa, Mycobacterium tuberculosis
YPNVAITRVVV

SEQ ID NO: 119394 - protein, 11 aa, Mycobacterium tuberculosis
ITRVVVRDQPA

SEQ ID NO: 119395 - protein, 11 aa, Mycobacterium tuberculosis
VVRDQPARQLV

SEQ ID NO: 119396 - protein, 11 aa, Mycobacterium tuberculosis
QLVQRSEEAQL

SEQ ID NO: 119397 - protein, 11 aa, Mycobacterium tuberculosis
LVQRSEEAQLV

SEQ ID NO: 119398 - protein, 11 aa, Mycobacterium tuberculosis
EEAQLVVVGSR

SEQ ID NO: 119399 - protein, 11 aa, Mycobacterium tuberculosis
AQLVVVGSRGR

SEQ ID NO: 119400 - protein, 11 aa, Mycobacterium tuberculosis
VVVGSRGRGGY

SEQ ID NO: 119401 - protein, 11 aa, Mycobacterium tuberculosis
RGRGGYAGMLV

SEQ ID NO: 119402 - protein, 11 aa, Mycobacterium tuberculosis
GGYAGMLVGSV

SEQ ID NO: 119403 - protein, 11 aa, Mycobacterium tuberculosis
GMLVGSVGETV

SEQ ID NO: 119404 - protein, 11 aa, Mycobacterium tuberculosis
MLVGSVGETVA

SEQ ID NO: 119405 - protein, 11 aa, Mycobacterium tuberculosis
SVGETVAQLAR

SEQ ID NO: 119406 - protein, 11 aa, Mycobacterium tuberculosis
ETVAQLARTPV

SEQ ID NO: 119407 - protein, 11 aa, Mycobacterium tuberculosis
TVAQLARTPVI

SEQ ID NO: 119408 - protein, 11 aa, Mycobacterium tuberculosis
AQLARTPVIVA

SEQ ID NO: 119409 - protein, 11 aa, Mycobacterium tuberculosis
QLARTPVIVAR

SEQ ID NO: 119410 - protein, 11 aa, Mycobacterium tuberculosis
RTPVIVARESL

SEQ ID NO: 119411 - protein, 11 aa, Mycobacterium tuberculosis
TPVIVARESLT

SEQ ID NO: 119412 - protein, 13 aa, Mycobacterium tuberculosis
MSSGNSSLGIIVG

SEQ ID NO: 119413 - protein, 13 aa, Mycobacterium tuberculosis
SSGNSSLGIIVGI

SEQ ID NO: 119414 - protein, 13 aa, Mycobacterium tuberculosis
SGNSSLGIIVGID

SEQ ID NO: 119415 - protein, 13 aa, Mycobacterium tuberculosis
GNSSLGIIVGIDD

SEQ ID NO: 119416 - protein, 13 aa, Mycobacterium tuberculosis
NSSLGIIVGIDDS

SEQ ID NO: 119417 - protein, 13 aa, Mycobacterium tuberculosis
SSLGIIVGIDDSP

SEQ ID NO: 119418 - protein, 13 aa, Mycobacterium tuberculosis
SLGIIVGIDDSPA

SEQ ID NO: 119419 - protein, 13 aa, Mycobacterium tuberculosis
LGIIVGIDDSPAA

SEQ ID NO: 119420 - protein, 13 aa, Mycobacterium tuberculosis
GIIVGIDDSPAAQ

SEQ ID NO: 119421 - protein, 13 aa, Mycobacterium tuberculosis
IIVGIDDSPAAQV

SEQ ID NO: 119422 - protein, 13 aa, Mycobacterium tuberculosis
IVGIDDSPAAQVA

SEQ ID NO: 119423 - protein, 13 aa, Mycobacterium tuberculosis
VGIDDSPAAQVAV

SEQ ID NO: 119424 - protein, 13 aa, Mycobacterium tuberculosis
GIDDSPAAQVAVR

SEQ ID NO: 119425 - protein, 13 aa, Mycobacterium tuberculosis
IDDSPAAQVAVRW

SEQ ID NO: 119426 - protein, 13 aa, Mycobacterium tuberculosis
DDSPAAQVAVRWA

SEQ ID NO: 119427 - protein, 13 aa, Mycobacterium tuberculosis
DSPAAQVAVRWAA

SEQ ID NO: 119428 - protein, 13 aa, Mycobacterium tuberculosis
SPAAQVAVRWAAR

SEQ ID NO: 119429 - protein, 13 aa, Mycobacterium tuberculosis
PAAQVAVRWAARD

SEQ ID NO: 119430 - protein, 13 aa, Mycobacterium tuberculosis
AAQVAVRWAARDA

SEQ ID NO: 119431 - protein, 13 aa, Mycobacterium tuberculosis
AQVAVRWAARDAE

SEQ ID NO: 119432 - protein, 13 aa, Mycobacterium tuberculosis
QVAVRWAARDAEL

SEQ ID NO: 119433 - protein, 13 aa, Mycobacterium tuberculosis
VAVRWAARDAELR

SEQ ID NO: 119434 - protein, 13 aa, Mycobacterium tuberculosis
AVRWAARDAELRK

SEQ ID NO: 119435 - protein, 13 aa, Mycobacterium tuberculosis
VRWAARDAELRKI

SEQ ID NO: 119436 - protein, 13 aa, Mycobacterium tuberculosis
RWAARDAELRKIP

SEQ ID NO: 119437 - protein, 13 aa, Mycobacterium tuberculosis
WAARDAELRKIPL

SEQ ID NO: 119438 - protein, 13 aa, Mycobacterium tuberculosis
AARDAELRKIPLT

SEQ ID NO: 119439 - protein, 13 aa, Mycobacterium tuberculosis
ARDAELRKIPLTL

SEQ ID NO: 119440 - protein, 13 aa, Mycobacterium tuberculosis
RDAELRKIPLTLV

SEQ ID NO: 119441 - protein, 13 aa, Mycobacterium tuberculosis
DAELRKIPLTLVH

SEQ ID NO: 119442 - protein, 13 aa, Mycobacterium tuberculosis
AELRKIPLTLVHA

SEQ ID NO: 119443 - protein, 13 aa, Mycobacterium tuberculosis
ELRKIPLTLVHAV

SEQ ID NO: 119444 - protein, 13 aa, Mycobacterium tuberculosis
LRKIPLTLVHAVS

SEQ ID NO: 119445 - protein, 13 aa, Mycobacterium tuberculosis
RKIPLTLVHAVSP

SEQ ID NO: 119446 - protein, 13 aa, Mycobacterium tuberculosis
KIPLTLVHAVSPE

SEQ ID NO: 119447 - protein, 13 aa, Mycobacterium tuberculosis
IPLTLVHAVSPEV

SEQ ID NO: 119448 - protein, 13 aa, Mycobacterium tuberculosis
PLTLVHAVSPEVA

SEQ ID NO: 119449 - protein, 13 aa, Mycobacterium tuberculosis
LTLVHAVSPEVAT

SEQ ID NO: 119450 - protein, 13 aa, Mycobacterium tuberculosis
TLVHAVSPEVATW

SEQ ID NO: 119451 - protein, 13 aa, Mycobacterium tuberculosis
LVHAVSPEVATWL

SEQ ID NO: 119452 - protein, 13 aa, Mycobacterium tuberculosis
VHAVSPEVATWLE

SEQ ID NO: 119453 - protein, 13 aa, Mycobacterium tuberculosis
HAVSPEVATWLEV

SEQ ID NO: 119454 - protein, 13 aa, Mycobacterium tuberculosis
AVSPEVATWLEVP

SEQ ID NO: 119455 - protein, 13 aa, Mycobacterium tuberculosis
VSPEVATWLEVPL

SEQ ID NO: 119456 - protein, 13 aa, Mycobacterium tuberculosis
SPEVATWLEVPLP

SEQ ID NO: 119457 - protein, 13 aa, Mycobacterium tuberculosis
PEVATWLEVPLPP

SEQ ID NO: 119458 - protein, 13 aa, Mycobacterium tuberculosis
EVATWLEVPLPPG

SEQ ID NO: 119459 - protein, 13 aa, Mycobacterium tuberculosis
VATWLEVPLPPGV

SEQ ID NO: 119460 - protein, 13 aa, Mycobacterium tuberculosis
ATWLEVPLPPGVL

SEQ ID NO: 119461 - protein, 13 aa, Mycobacterium tuberculosis
TWLEVPLPPGVLR

SEQ ID NO: 119462 - protein, 13 aa, Mycobacterium tuberculosis
WLEVPLPPGVLRW

SEQ ID NO: 119463 - protein, 13 aa, Mycobacterium tuberculosis
LEVPLPPGVLRWQ

SEQ ID NO: 119464 - protein, 13 aa, Mycobacterium tuberculosis
EVPLPPGVLRWQQ

SEQ ID NO: 119465 - protein, 13 aa, Mycobacterium tuberculosis
VPLPPGVLRWQQD

SEQ ID NO: 119466 - protein, 13 aa, Mycobacterium tuberculosis
PLPPGVLRWQQDH

SEQ ID NO: 119467 - protein, 13 aa, Mycobacterium tuberculosis
LPPGVLRWQQDHG

SEQ ID NO: 119468 - protein, 13 aa, Mycobacterium tuberculosis
PPGVLRWQQDHGR

SEQ ID NO: 119469 - protein, 13 aa, Mycobacterium tuberculosis
PGVLRWQQDHGRH

SEQ ID NO: 119470 - protein, 13 aa, Mycobacterium tuberculosis
GVLRWQQDHGRHL

SEQ ID NO: 119471 - protein, 13 aa, Mycobacterium tuberculosis
VLRWQQDHGRHLI

SEQ ID NO: 119472 - protein, 13 aa, Mycobacterium tuberculosis
LRWQQDHGRHLID

SEQ ID NO: 119473 - protein, 13 aa, Mycobacterium tuberculosis
RWQQDHGRHLIDD

SEQ ID NO: 119474 - protein, 13 aa, Mycobacterium tuberculosis
WQQDHGRHLIDDA

SEQ ID NO: 119475 - protein, 13 aa, Mycobacterium tuberculosis
QQDHGRHLIDDAL

SEQ ID NO: 119476 - protein, 13 aa, Mycobacterium tuberculosis
QDHGRHLIDDALK

SEQ ID NO: 119477 - protein, 13 aa, Mycobacterium tuberculosis
DHGRHLIDDALKV

SEQ ID NO: 119478 - protein, 13 aa, Mycobacterium tuberculosis
HGRHLIDDALKVV

SEQ ID NO: 119479 - protein, 13 aa, Mycobacterium tuberculosis
GRHLIDDALKVVE

SEQ ID NO: 119480 - protein, 13 aa, Mycobacterium tuberculosis
RHLIDDALKVVEQ

SEQ ID NO: 119481 - protein, 13 aa, Mycobacterium tuberculosis
HLIDDALKVVEQA

SEQ ID NO: 119482 - protein, 13 aa, Mycobacterium tuberculosis
LIDDALKVVEQAS

SEQ ID NO: 119483 - protein, 13 aa, Mycobacterium tuberculosis
IDDALKVVEQASL

SEQ ID NO: 119484 - protein, 13 aa, Mycobacterium tuberculosis
DDALKVVEQASLR

SEQ ID NO: 119485 - protein, 13 aa, Mycobacterium tuberculosis
DALKVVEQASLRA

SEQ ID NO: 119486 - protein, 13 aa, Mycobacterium tuberculosis
ALKVVEQASLRAG

SEQ ID NO: 119487 - protein, 13 aa, Mycobacterium tuberculosis
LKVVEQASLRAGP

SEQ ID NO: 119488 - protein, 13 aa, Mycobacterium tuberculosis
KVVEQASLRAGPP

SEQ ID NO: 119489 - protein, 13 aa, Mycobacterium tuberculosis
VVEQASLRAGPPT

SEQ ID NO: 119490 - protein, 13 aa, Mycobacterium tuberculosis
VEQASLRAGPPTV

SEQ ID NO: 119491 - protein, 13 aa, Mycobacterium tuberculosis
EQASLRAGPPTVH

SEQ ID NO: 119492 - protein, 13 aa, Mycobacterium tuberculosis
QASLRAGPPTVHS

SEQ ID NO: 119493 - protein, 13 aa, Mycobacterium tuberculosis
ASLRAGPPTVHSE

SEQ ID NO: 119494 - protein, 13 aa, Mycobacterium tuberculosis
SLRAGPPTVHSEI

SEQ ID NO: 119495 - protein, 13 aa, Mycobacterium tuberculosis
LRAGPPTVHSEIV

SEQ ID NO: 119496 - protein, 13 aa, Mycobacterium tuberculosis
RAGPPTVHSEIVP

SEQ ID NO: 119497 - protein, 13 aa, Mycobacterium tuberculosis
AGPPTVHSEIVPA

SEQ ID NO: 119498 - protein, 13 aa, Mycobacterium tuberculosis
GPPTVHSEIVPAA

SEQ ID NO: 119499 - protein, 13 aa, Mycobacterium tuberculosis
PPTVHSEIVPAAA

SEQ ID NO: 119500 - protein, 13 aa, Mycobacterium tuberculosis
PTVHSEIVPAAAV

SEQ ID NO: 119501 - protein, 13 aa, Mycobacterium tuberculosis
TVHSEIVPAAAVP

SEQ ID NO: 119502 - protein, 13 aa, Mycobacterium tuberculosis
VHSEIVPAAAVPT

SEQ ID NO: 119503 - protein, 13 aa, Mycobacterium tuberculosis
HSEIVPAAAVPTL

SEQ ID NO: 119504 - protein, 13 aa, Mycobacterium tuberculosis
SEIVPAAAVPTLV

SEQ ID NO: 119505 - protein, 13 aa, Mycobacterium tuberculosis
EIVPAAAVPTLVD

SEQ ID NO: 119506 - protein, 13 aa, Mycobacterium tuberculosis
IVPAAAVPTLVDM

SEQ ID NO: 119507 - protein, 13 aa, Mycobacterium tuberculosis
VPAAAVPTLVDMS

SEQ ID NO: 119508 - protein, 13 aa, Mycobacterium tuberculosis
PAAAVPTLVDMSK

SEQ ID NO: 119509 - protein, 13 aa, Mycobacterium tuberculosis
AAAVPTLVDMSKD

SEQ ID NO: 119510 - protein, 13 aa, Mycobacterium tuberculosis
AAVPTLVDMSKDA

SEQ ID NO: 119511 - protein, 13 aa, Mycobacterium tuberculosis
AVPTLVDMSKDAV

SEQ ID NO: 119512 - protein, 13 aa, Mycobacterium tuberculosis
VPTLVDMSKDAVL

SEQ ID NO: 119513 - protein, 13 aa, Mycobacterium tuberculosis
PTLVDMSKDAVLM

SEQ ID NO: 119514 - protein, 13 aa, Mycobacterium tuberculosis
TLVDMSKDAVLMV

SEQ ID NO: 119515 - protein, 13 aa, Mycobacterium tuberculosis
LVDMSKDAVLMVV

SEQ ID NO: 119516 - protein, 13 aa, Mycobacterium tuberculosis
VDMSKDAVLMVVG

SEQ ID NO: 119517 - protein, 13 aa, Mycobacterium tuberculosis
DMSKDAVLMVVGC

SEQ ID NO: 119518 - protein, 13 aa, Mycobacterium tuberculosis
MSKDAVLMVVGCL

SEQ ID NO: 119519 - protein, 13 aa, Mycobacterium tuberculosis
SKDAVLMVVGCLG

SEQ ID NO: 119520 - protein, 13 aa, Mycobacterium tuberculosis
KDAVLMVVGCLGS

SEQ ID NO: 119521 - protein, 13 aa, Mycobacterium tuberculosis
DAVLMVVGCLGSG

SEQ ID NO: 119522 - protein, 13 aa, Mycobacterium tuberculosis
AVLMVVGCLGSGR

SEQ ID NO: 119523 - protein, 13 aa, Mycobacterium tuberculosis
VLMVVGCLGSGRW

SEQ ID NO: 119524 - protein, 13 aa, Mycobacterium tuberculosis
LMVVGCLGSGRWP

SEQ ID NO: 119525 - protein, 13 aa, Mycobacterium tuberculosis
MVVGCLGSGRWPG

SEQ ID NO: 119526 - protein, 13 aa, Mycobacterium tuberculosis
VVGCLGSGRWPGR

SEQ ID NO: 119527 - protein, 13 aa, Mycobacterium tuberculosis
VGCLGSGRWPGRL

SEQ ID NO: 119528 - protein, 13 aa, Mycobacterium tuberculosis
GCLGSGRWPGRLL

SEQ ID NO: 119529 - protein, 13 aa, Mycobacterium tuberculosis
CLGSGRWPGRLLG

SEQ ID NO: 119530 - protein, 13 aa, Mycobacterium tuberculosis
LGSGRWPGRLLGS

SEQ ID NO: 119531 - protein, 13 aa, Mycobacterium tuberculosis
GSGRWPGRLLGSV

SEQ ID NO: 119532 - protein, 13 aa, Mycobacterium tuberculosis
SGRWPGRLLGSVS

SEQ ID NO: 119533 - protein, 13 aa, Mycobacterium tuberculosis
GRWPGRLLGSVSS

SEQ ID NO: 119534 - protein, 13 aa, Mycobacterium tuberculosis
RWPGRLLGSVSSG

SEQ ID NO: 119535 - protein, 13 aa, Mycobacterium tuberculosis
WPGRLLGSVSSGL

SEQ ID NO: 119536 - protein, 13 aa, Mycobacterium tuberculosis
PGRLLGSVSSGLL

SEQ ID NO: 119537 - protein, 13 aa, Mycobacterium tuberculosis
GRLLGSVSSGLLR

SEQ ID NO: 119538 - protein, 13 aa, Mycobacterium tuberculosis
RLLGSVSSGLLRH

SEQ ID NO: 119539 - protein, 13 aa, Mycobacterium tuberculosis
LLGSVSSGLLRHA

SEQ ID NO: 119540 - protein, 13 aa, Mycobacterium tuberculosis
LGSVSSGLLRHAH

SEQ ID NO: 119541 - protein, 13 aa, Mycobacterium tuberculosis
GSVSSGLLRHAHC

SEQ ID NO: 119542 - protein, 13 aa, Mycobacterium tuberculosis
SVSSGLLRHAHCP

SEQ ID NO: 119543 - protein, 13 aa, Mycobacterium tuberculosis
VSSGLLRHAHCPV

SEQ ID NO: 119544 - protein, 13 aa, Mycobacterium tuberculosis
SSGLLRHAHCPVV

SEQ ID NO: 119545 - protein, 13 aa, Mycobacterium tuberculosis
SGLLRHAHCPVVI

SEQ ID NO: 119546 - protein, 13 aa, Mycobacterium tuberculosis
GLLRHAHCPVVII

SEQ ID NO: 119547 - protein, 13 aa, Mycobacterium tuberculosis
LLRHAHCPVVIIH

SEQ ID NO: 119548 - protein, 13 aa, Mycobacterium tuberculosis
LRHAHCPVVIIHD

SEQ ID NO: 119549 - protein, 13 aa, Mycobacterium tuberculosis
RHAHCPVVIIHDE

SEQ ID NO: 119550 - protein, 13 aa, Mycobacterium tuberculosis
HAHCPVVIIHDED

SEQ ID NO: 119551 - protein, 13 aa, Mycobacterium tuberculosis
AHCPVVIIHDEDS

SEQ ID NO: 119552 - protein, 13 aa, Mycobacterium tuberculosis
HCPVVIIHDEDSV

SEQ ID NO: 119553 - protein, 13 aa, Mycobacterium tuberculosis
CPVVIIHDEDSVM

SEQ ID NO: 119554 - protein, 13 aa, Mycobacterium tuberculosis
PVVIIHDEDSVMP

SEQ ID NO: 119555 - protein, 13 aa, Mycobacterium tuberculosis
VVIIHDEDSVMPH

SEQ ID NO: 119556 - protein, 13 aa, Mycobacterium tuberculosis
VIIHDEDSVMPHP

SEQ ID NO: 119557 - protein, 13 aa, Mycobacterium tuberculosis
IIHDEDSVMPHPQ

SEQ ID NO: 119558 - protein, 13 aa, Mycobacterium tuberculosis
IHDEDSVMPHPQQ

SEQ ID NO: 119559 - protein, 13 aa, Mycobacterium tuberculosis
HDEDSVMPHPQQA

SEQ ID NO: 119560 - protein, 13 aa, Mycobacterium tuberculosis
DEDSVMPHPQQAP

SEQ ID NO: 119561 - protein, 13 aa, Mycobacterium tuberculosis
EDSVMPHPQQAPV

SEQ ID NO: 119562 - protein, 13 aa, Mycobacterium tuberculosis
DSVMPHPQQAPVL

SEQ ID NO: 119563 - protein, 13 aa, Mycobacterium tuberculosis
SVMPHPQQAPVLV

SEQ ID NO: 119564 - protein, 13 aa, Mycobacterium tuberculosis
VMPHPQQAPVLVG

SEQ ID NO: 119565 - protein, 13 aa, Mycobacterium tuberculosis
MPHPQQAPVLVGV

SEQ ID NO: 119566 - protein, 13 aa, Mycobacterium tuberculosis
PHPQQAPVLVGVD

SEQ ID NO: 119567 - protein, 13 aa, Mycobacterium tuberculosis
HPQQAPVLVGVDG

SEQ ID NO: 119568 - protein, 13 aa, Mycobacterium tuberculosis
PQQAPVLVGVDGS

SEQ ID NO: 119569 - protein, 13 aa, Mycobacterium tuberculosis
QQAPVLVGVDGSS

SEQ ID NO: 119570 - protein, 13 aa, Mycobacterium tuberculosis
QAPVLVGVDGSSA

SEQ ID NO: 119571 - protein, 13 aa, Mycobacterium tuberculosis
APVLVGVDGSSAS

SEQ ID NO: 119572 - protein, 13 aa, Mycobacterium tuberculosis
PVLVGVDGSSASE

SEQ ID NO: 119573 - protein, 13 aa, Mycobacterium tuberculosis
VLVGVDGSSASEL

SEQ ID NO: 119574 - protein, 13 aa, Mycobacterium tuberculosis
LVGVDGSSASELA

SEQ ID NO: 119575 - protein, 13 aa, Mycobacterium tuberculosis
VGVDGSSASELAT

SEQ ID NO: 119576 - protein, 13 aa, Mycobacterium tuberculosis
GVDGSSASELATA

SEQ ID NO: 119577 - protein, 13 aa, Mycobacterium tuberculosis
VDGSSASELATAI

SEQ ID NO: 119578 - protein, 13 aa, Mycobacterium tuberculosis
DGSSASELATAIA

SEQ ID NO: 119579 - protein, 13 aa, Mycobacterium tuberculosis
GSSASELATAIAF

SEQ ID NO: 119580 - protein, 13 aa, Mycobacterium tuberculosis
SSASELATAIAFD

SEQ ID NO: 119581 - protein, 13 aa, Mycobacterium tuberculosis
SASELATAIAFDE

SEQ ID NO: 119582 - protein, 13 aa, Mycobacterium tuberculosis
ASELATAIAFDEA

SEQ ID NO: 119583 - protein, 13 aa, Mycobacterium tuberculosis
SELATAIAFDEAS

SEQ ID NO: 119584 - protein, 13 aa, Mycobacterium tuberculosis
ELATAIAFDEASR

SEQ ID NO: 119585 - protein, 13 aa, Mycobacterium tuberculosis
LATAIAFDEASRR

SEQ ID NO: 119586 - protein, 13 aa, Mycobacterium tuberculosis
ATAIAFDEASRRN

SEQ ID NO: 119587 - protein, 13 aa, Mycobacterium tuberculosis
TAIAFDEASRRNV

SEQ ID NO: 119588 - protein, 13 aa, Mycobacterium tuberculosis
AIAFDEASRRNVD

SEQ ID NO: 119589 - protein, 13 aa, Mycobacterium tuberculosis
IAFDEASRRNVDL

SEQ ID NO: 119590 - protein, 13 aa, Mycobacterium tuberculosis
AFDEASRRNVDLV

SEQ ID NO: 119591 - protein, 13 aa, Mycobacterium tuberculosis
FDEASRRNVDLVA

SEQ ID NO: 119592 - protein, 13 aa, Mycobacterium tuberculosis
DEASRRNVDLVAL

SEQ ID NO: 119593 - protein, 13 aa, Mycobacterium tuberculosis
EASRRNVDLVALH

SEQ ID NO: 119594 - protein, 13 aa, Mycobacterium tuberculosis
ASRRNVDLVALHA

SEQ ID NO: 119595 - protein, 13 aa, Mycobacterium tuberculosis
SRRNVDLVALHAW

SEQ ID NO: 119596 - protein, 13 aa, Mycobacterium tuberculosis
RRNVDLVALHAWS

SEQ ID NO: 119597 - protein, 13 aa, Mycobacterium tuberculosis
RNVDLVALHAWSD

SEQ ID NO: 119598 - protein, 13 aa, Mycobacterium tuberculosis
NVDLVALHAWSDV

SEQ ID NO: 119599 - protein, 13 aa, Mycobacterium tuberculosis
VDLVALHAWSDVD

SEQ ID NO: 119600 - protein, 13 aa, Mycobacterium tuberculosis
DLVALHAWSDVDV

SEQ ID NO: 119601 - protein, 13 aa, Mycobacterium tuberculosis
LVALHAWSDVDVS

SEQ ID NO: 119602 - protein, 13 aa, Mycobacterium tuberculosis
VALHAWSDVDVSE

SEQ ID NO: 119603 - protein, 13 aa, Mycobacterium tuberculosis
ALHAWSDVDVSEW

SEQ ID NO: 119604 - protein, 13 aa, Mycobacterium tuberculosis
LHAWSDVDVSEWP

SEQ ID NO: 119605 - protein, 13 aa, Mycobacterium tuberculosis
HAWSDVDVSEWPG

SEQ ID NO: 119606 - protein, 13 aa, Mycobacterium tuberculosis
AWSDVDVSEWPGI

SEQ ID NO: 119607 - protein, 13 aa, Mycobacterium tuberculosis
WSDVDVSEWPGID

SEQ ID NO: 119608 - protein, 13 aa, Mycobacterium tuberculosis
SDVDVSEWPGIDW

SEQ ID NO: 119609 - protein, 13 aa, Mycobacterium tuberculosis
DVDVSEWPGIDWP

SEQ ID NO: 119610 - protein, 13 aa, Mycobacterium tuberculosis
VDVSEWPGIDWPA

SEQ ID NO: 119611 - protein, 13 aa, Mycobacterium tuberculosis
DVSEWPGIDWPAT

SEQ ID NO: 119612 - protein, 13 aa, Mycobacterium tuberculosis
VSEWPGIDWPATQ

SEQ ID NO: 119613 - protein, 13 aa, Mycobacterium tuberculosis
SEWPGIDWPATQS

SEQ ID NO: 119614 - protein, 13 aa, Mycobacterium tuberculosis
EWPGIDWPATQSM

SEQ ID NO: 119615 - protein, 13 aa, Mycobacterium tuberculosis
WPGIDWPATQSMA

SEQ ID NO: 119616 - protein, 13 aa, Mycobacterium tuberculosis
PGIDWPATQSMAE

SEQ ID NO: 119617 - protein, 13 aa, Mycobacterium tuberculosis
GIDWPATQSMAEQ

SEQ ID NO: 119618 - protein, 13 aa, Mycobacterium tuberculosis
IDWPATQSMAEQV

SEQ ID NO: 119619 - protein, 13 aa, Mycobacterium tuberculosis
DWPATQSMAEQVL

SEQ ID NO: 119620 - protein, 13 aa, Mycobacterium tuberculosis
WPATQSMAEQVLA

SEQ ID NO: 119621 - protein, 13 aa, Mycobacterium tuberculosis
PATQSMAEQVLAE

SEQ ID NO: 119622 - protein, 13 aa, Mycobacterium tuberculosis
ATQSMAEQVLAER

SEQ ID NO: 119623 - protein, 13 aa, Mycobacterium tuberculosis
TQSMAEQVLAERL

SEQ ID NO: 119624 - protein, 13 aa, Mycobacterium tuberculosis
QSMAEQVLAERLA

SEQ ID NO: 119625 - protein, 13 aa, Mycobacterium tuberculosis
SMAEQVLAERLAG

SEQ ID NO: 119626 - protein, 13 aa, Mycobacterium tuberculosis
MAEQVLAERLAGW

SEQ ID NO: 119627 - protein, 13 aa, Mycobacterium tuberculosis
AEQVLAERLAGWQ

SEQ ID NO: 119628 - protein, 13 aa, Mycobacterium tuberculosis
EQVLAERLAGWQE

SEQ ID NO: 119629 - protein, 13 aa, Mycobacterium tuberculosis
QVLAERLAGWQER

SEQ ID NO: 119630 - protein, 13 aa, Mycobacterium tuberculosis
VLAERLAGWQERY

SEQ ID NO: 119631 - protein, 13 aa, Mycobacterium tuberculosis
LAERLAGWQERYP

SEQ ID NO: 119632 - protein, 13 aa, Mycobacterium tuberculosis
AERLAGWQERYPN

SEQ ID NO: 119633 - protein, 13 aa, Mycobacterium tuberculosis
ERLAGWQERYPNV

SEQ ID NO: 119634 - protein, 13 aa, Mycobacterium tuberculosis
RLAGWQERYPNVA

SEQ ID NO: 119635 - protein, 13 aa, Mycobacterium tuberculosis
LAGWQERYPNVAI

SEQ ID NO: 119636 - protein, 13 aa, Mycobacterium tuberculosis
AGWQERYPNVAIT

SEQ ID NO: 119637 - protein, 13 aa, Mycobacterium tuberculosis
GWQERYPNVAITR

SEQ ID NO: 119638 - protein, 13 aa, Mycobacterium tuberculosis
WQERYPNVAITRV

SEQ ID NO: 119639 - protein, 13 aa, Mycobacterium tuberculosis
QERYPNVAITRVV

SEQ ID NO: 119640 - protein, 13 aa, Mycobacterium tuberculosis
ERYPNVAITRVVV

SEQ ID NO: 119641 - protein, 13 aa, Mycobacterium tuberculosis
RYPNVAITRVVVR

SEQ ID NO: 119642 - protein, 13 aa, Mycobacterium tuberculosis
YPNVAITRVVVRD

SEQ ID NO: 119643 - protein, 13 aa, Mycobacterium tuberculosis
PNVAITRVVVRDQ

SEQ ID NO: 119644 - protein, 13 aa, Mycobacterium tuberculosis
NVAITRVVVRDQP

SEQ ID NO: 119645 - protein, 13 aa, Mycobacterium tuberculosis
VAITRVVVRDQPA

SEQ ID NO: 119646 - protein, 13 aa, Mycobacterium tuberculosis
AITRVVVRDQPAR

SEQ ID NO: 119647 - protein, 13 aa, Mycobacterium tuberculosis
ITRVVVRDQPARQ

SEQ ID NO: 119648 - protein, 13 aa, Mycobacterium tuberculosis
TRVVVRDQPARQL

SEQ ID NO: 119649 - protein, 13 aa, Mycobacterium tuberculosis
RVVVRDQPARQLV

SEQ ID NO: 119650 - protein, 13 aa, Mycobacterium tuberculosis
VVVRDQPARQLVQ

SEQ ID NO: 119651 - protein, 13 aa, Mycobacterium tuberculosis
VVRDQPARQLVQR

SEQ ID NO: 119652 - protein, 13 aa, Mycobacterium tuberculosis
VRDQPARQLVQRS

SEQ ID NO: 119653 - protein, 13 aa, Mycobacterium tuberculosis
RDQPARQLVQRSE

SEQ ID NO: 119654 - protein, 13 aa, Mycobacterium tuberculosis
DQPARQLVQRSEE

SEQ ID NO: 119655 - protein, 13 aa, Mycobacterium tuberculosis
QPARQLVQRSEEA

SEQ ID NO: 119656 - protein, 13 aa, Mycobacterium tuberculosis
PARQLVQRSEEAQ

SEQ ID NO: 119657 - protein, 13 aa, Mycobacterium tuberculosis
ARQLVQRSEEAQL

SEQ ID NO: 119658 - protein, 13 aa, Mycobacterium tuberculosis
RQLVQRSEEAQLV

SEQ ID NO: 119659 - protein, 13 aa, Mycobacterium tuberculosis
QLVQRSEEAQLVV

SEQ ID NO: 119660 - protein, 13 aa, Mycobacterium tuberculosis
LVQRSEEAQLVVV

SEQ ID NO: 119661 - protein, 13 aa, Mycobacterium tuberculosis
VQRSEEAQLVVVG

SEQ ID NO: 119662 - protein, 13 aa, Mycobacterium tuberculosis
QRSEEAQLVVVGS

SEQ ID NO: 119663 - protein, 13 aa, Mycobacterium tuberculosis
RSEEAQLVVVGSR

SEQ ID NO: 119664 - protein, 13 aa, Mycobacterium tuberculosis
SEEAQLVVVGSRG

SEQ ID NO: 119665 - protein, 13 aa, Mycobacterium tuberculosis
EEAQLVVVGSRGR

SEQ ID NO: 119666 - protein, 13 aa, Mycobacterium tuberculosis
EAQLVVVGSRGRG

SEQ ID NO: 119667 - protein, 13 aa, Mycobacterium tuberculosis
AQLVVVGSRGRGG

SEQ ID NO: 119668 - protein, 13 aa, Mycobacterium tuberculosis
QLVVVGSRGRGGY

SEQ ID NO: 119669 - protein, 13 aa, Mycobacterium tuberculosis
LVVVGSRGRGGYA

SEQ ID NO: 119670 - protein, 13 aa, Mycobacterium tuberculosis
VVVGSRGRGGYAG

SEQ ID NO: 119671 - protein, 13 aa, Mycobacterium tuberculosis
VVGSRGRGGYAGM

SEQ ID NO: 119672 - protein, 13 aa, Mycobacterium tuberculosis
VGSRGRGGYAGML

SEQ ID NO: 119673 - protein, 13 aa, Mycobacterium tuberculosis
GSRGRGGYAGMLV

SEQ ID NO: 119674 - protein, 13 aa, Mycobacterium tuberculosis
SRGRGGYAGMLVG

SEQ ID NO: 119675 - protein, 13 aa, Mycobacterium tuberculosis
RGRGGYAGMLVGS

SEQ ID NO: 119676 - protein, 13 aa, Mycobacterium tuberculosis
GRGGYAGMLVGSV

SEQ ID NO: 119677 - protein, 13 aa, Mycobacterium tuberculosis
RGGYAGMLVGSVG

SEQ ID NO: 119678 - protein, 13 aa, Mycobacterium tuberculosis
GGYAGMLVGSVGE

SEQ ID NO: 119679 - protein, 13 aa, Mycobacterium tuberculosis
GYAGMLVGSVGET

SEQ ID NO: 119680 - protein, 13 aa, Mycobacterium tuberculosis
YAGMLVGSVGETV

SEQ ID NO: 119681 - protein, 13 aa, Mycobacterium tuberculosis
AGMLVGSVGETVA

SEQ ID NO: 119682 - protein, 13 aa, Mycobacterium tuberculosis
GMLVGSVGETVAQ

SEQ ID NO: 119683 - protein, 13 aa, Mycobacterium tuberculosis
MLVGSVGETVAQL

SEQ ID NO: 119684 - protein, 13 aa, Mycobacterium tuberculosis
LVGSVGETVAQLA

SEQ ID NO: 119685 - protein, 13 aa, Mycobacterium tuberculosis
VGSVGETVAQLAR

SEQ ID NO: 119686 - protein, 13 aa, Mycobacterium tuberculosis
GSVGETVAQLART

SEQ ID NO: 119687 - protein, 13 aa, Mycobacterium tuberculosis
SVGETVAQLARTP

SEQ ID NO: 119688 - protein, 13 aa, Mycobacterium tuberculosis
VGETVAQLARTPV

SEQ ID NO: 119689 - protein, 13 aa, Mycobacterium tuberculosis
GETVAQLARTPVI

SEQ ID NO: 119690 - protein, 13 aa, Mycobacterium tuberculosis
ETVAQLARTPVIV

SEQ ID NO: 119691 - protein, 13 aa, Mycobacterium tuberculosis
TVAQLARTPVIVA

SEQ ID NO: 119692 - protein, 13 aa, Mycobacterium tuberculosis
VAQLARTPVIVAR

SEQ ID NO: 119693 - protein, 13 aa, Mycobacterium tuberculosis
AQLARTPVIVARE

SEQ ID NO: 119694 - protein, 13 aa, Mycobacterium tuberculosis
QLARTPVIVARES

SEQ ID NO: 119695 - protein, 13 aa, Mycobacterium tuberculosis
LARTPVIVARESL

SEQ ID NO: 119696 - protein, 13 aa, Mycobacterium tuberculosis
ARTPVIVARESLT

SEQ ID NO: 119697 - protein, 14 aa, Mycobacterium tuberculosis
MSSGNSSLGIIVGI

SEQ ID NO: 119698 - protein, 14 aa, Mycobacterium tuberculosis
SSGNSSLGIIVGID

SEQ ID NO: 119699 - protein, 14 aa, Mycobacterium tuberculosis
SGNSSLGIIVGIDD

SEQ ID NO: 119700 - protein, 14 aa, Mycobacterium tuberculosis
GNSSLGIIVGIDDS

SEQ ID NO: 119701 - protein, 14 aa, Mycobacterium tuberculosis
NSSLGIIVGIDDSP

SEQ ID NO: 119702 - protein, 14 aa, Mycobacterium tuberculosis
SSLGIIVGIDDSPA

SEQ ID NO: 119703 - protein, 14 aa, Mycobacterium tuberculosis
SLGIIVGIDDSPAA

SEQ ID NO: 119704 - protein, 14 aa, Mycobacterium tuberculosis
LGIIVGIDDSPAAQ

SEQ ID NO: 119705 - protein, 14 aa, Mycobacterium tuberculosis
GIIVGIDDSPAAQV

SEQ ID NO: 119706 - protein, 14 aa, Mycobacterium tuberculosis
IIVGIDDSPAAQVA

SEQ ID NO: 119707 - protein, 14 aa, Mycobacterium tuberculosis
IVGIDDSPAAQVAV

SEQ ID NO: 119708 - protein, 14 aa, Mycobacterium tuberculosis
VGIDDSPAAQVAVR

SEQ ID NO: 119709 - protein, 14 aa, Mycobacterium tuberculosis
GIDDSPAAQVAVRW

SEQ ID NO: 119710 - protein, 14 aa, Mycobacterium tuberculosis
IDDSPAAQVAVRWA

SEQ ID NO: 119711 - protein, 14 aa, Mycobacterium tuberculosis
DDSPAAQVAVRWAA

SEQ ID NO: 119712 - protein, 14 aa, Mycobacterium tuberculosis
DSPAAQVAVRWAAR

SEQ ID NO: 119713 - protein, 14 aa, Mycobacterium tuberculosis
SPAAQVAVRWAARD

SEQ ID NO: 119714 - protein, 14 aa, Mycobacterium tuberculosis
PAAQVAVRWAARDA

SEQ ID NO: 119715 - protein, 14 aa, Mycobacterium tuberculosis
AAQVAVRWAARDAE

SEQ ID NO: 119716 - protein, 14 aa, Mycobacterium tuberculosis
AQVAVRWAARDAEL

SEQ ID NO: 119717 - protein, 14 aa, Mycobacterium tuberculosis
QVAVRWAARDAELR

SEQ ID NO: 119718 - protein, 14 aa, Mycobacterium tuberculosis
VAVRWAARDAELRK

SEQ ID NO: 119719 - protein, 14 aa, Mycobacterium tuberculosis
AVRWAARDAELRKI

SEQ ID NO: 119720 - protein, 14 aa, Mycobacterium tuberculosis
VRWAARDAELRKIP

SEQ ID NO: 119721 - protein, 14 aa, Mycobacterium tuberculosis
RWAARDAELRKIPL

SEQ ID NO: 119722 - protein, 14 aa, Mycobacterium tuberculosis
WAARDAELRKIPLT

SEQ ID NO: 119723 - protein, 14 aa, Mycobacterium tuberculosis
AARDAELRKIPLTL

SEQ ID NO: 119724 - protein, 14 aa, Mycobacterium tuberculosis
ARDAELRKIPLTLV

SEQ ID NO: 119725 - protein, 14 aa, Mycobacterium tuberculosis
RDAELRKIPLTLVH

SEQ ID NO: 119726 - protein, 14 aa, Mycobacterium tuberculosis
DAELRKIPLTLVHA

SEQ ID NO: 119727 - protein, 14 aa, Mycobacterium tuberculosis
AELRKIPLTLVHAV

SEQ ID NO: 119728 - protein, 14 aa, Mycobacterium tuberculosis
ELRKIPLTLVHAVS

SEQ ID NO: 119729 - protein, 14 aa, Mycobacterium tuberculosis
LRKIPLTLVHAVSP

SEQ ID NO: 119730 - protein, 14 aa, Mycobacterium tuberculosis
RKIPLTLVHAVSPE

SEQ ID NO: 119731 - protein, 14 aa, Mycobacterium tuberculosis
KIPLTLVHAVSPEV

SEQ ID NO: 119732 - protein, 14 aa, Mycobacterium tuberculosis
IPLTLVHAVSPEVA

SEQ ID NO: 119733 - protein, 14 aa, Mycobacterium tuberculosis
PLTLVHAVSPEVAT

SEQ ID NO: 119734 - protein, 14 aa, Mycobacterium tuberculosis
LTLVHAVSPEVATW

SEQ ID NO: 119735 - protein, 14 aa, Mycobacterium tuberculosis
TLVHAVSPEVATWL

SEQ ID NO: 119736 - protein, 14 aa, Mycobacterium tuberculosis
LVHAVSPEVATWLE

SEQ ID NO: 119737 - protein, 14 aa, Mycobacterium tuberculosis
VHAVSPEVATWLEV

SEQ ID NO: 119738 - protein, 14 aa, Mycobacterium tuberculosis
HAVSPEVATWLEVP

SEQ ID NO: 119739 - protein, 14 aa, Mycobacterium tuberculosis
AVSPEVATWLEVPL

SEQ ID NO: 119740 - protein, 14 aa, Mycobacterium tuberculosis
VSPEVATWLEVPLP

SEQ ID NO: 119741 - protein, 14 aa, Mycobacterium tuberculosis
SPEVATWLEVPLPP

SEQ ID NO: 119742 - protein, 14 aa, Mycobacterium tuberculosis
PEVATWLEVPLPPG

SEQ ID NO: 119743 - protein, 14 aa, Mycobacterium tuberculosis
EVATWLEVPLPPGV

SEQ ID NO: 119744 - protein, 14 aa, Mycobacterium tuberculosis
VATWLEVPLPPGVL

SEQ ID NO: 119745 - protein, 14 aa, Mycobacterium tuberculosis
ATWLEVPLPPGVLR

SEQ ID NO: 119746 - protein, 14 aa, Mycobacterium tuberculosis
TWLEVPLPPGVLRW

SEQ ID NO: 119747 - protein, 14 aa, Mycobacterium tuberculosis
WLEVPLPPGVLRWQ

SEQ ID NO: 119748 - protein, 14 aa, Mycobacterium tuberculosis
LEVPLPPGVLRWQQ

SEQ ID NO: 119749 - protein, 14 aa, Mycobacterium tuberculosis
EVPLPPGVLRWQQD

SEQ ID NO: 119750 - protein, 14 aa, Mycobacterium tuberculosis
VPLPPGVLRWQQDH

SEQ ID NO: 119751 - protein, 14 aa, Mycobacterium tuberculosis
PLPPGVLRWQQDHG

SEQ ID NO: 119752 - protein, 14 aa, Mycobacterium tuberculosis
LPPGVLRWQQDHGR

SEQ ID NO: 119753 - protein, 14 aa, Mycobacterium tuberculosis
PPGVLRWQQDHGRH

SEQ ID NO: 119754 - protein, 14 aa, Mycobacterium tuberculosis
PGVLRWQQDHGRHL

SEQ ID NO: 119755 - protein, 14 aa, Mycobacterium tuberculosis
GVLRWQQDHGRHLI

SEQ ID NO: 119756 - protein, 14 aa, Mycobacterium tuberculosis
VLRWQQDHGRHLID

SEQ ID NO: 119757 - protein, 14 aa, Mycobacterium tuberculosis
LRWQQDHGRHLIDD

SEQ ID NO: 119758 - protein, 14 aa, Mycobacterium tuberculosis
RWQQDHGRHLIDDA

SEQ ID NO: 119759 - protein, 14 aa, Mycobacterium tuberculosis
WQQDHGRHLIDDAL

SEQ ID NO: 119760 - protein, 14 aa, Mycobacterium tuberculosis
QQDHGRHLIDDALK

SEQ ID NO: 119761 - protein, 14 aa, Mycobacterium tuberculosis
QDHGRHLIDDALKV

SEQ ID NO: 119762 - protein, 14 aa, Mycobacterium tuberculosis
DHGRHLIDDALKVV

SEQ ID NO: 119763 - protein, 14 aa, Mycobacterium tuberculosis
HGRHLIDDALKVVE

SEQ ID NO: 119764 - protein, 14 aa, Mycobacterium tuberculosis
GRHLIDDALKVVEQ

SEQ ID NO: 119765 - protein, 14 aa, Mycobacterium tuberculosis
RHLIDDALKVVEQA

SEQ ID NO: 119766 - protein, 14 aa, Mycobacterium tuberculosis
HLIDDALKVVEQAS

SEQ ID NO: 119767 - protein, 14 aa, Mycobacterium tuberculosis
LIDDALKVVEQASL

SEQ ID NO: 119768 - protein, 14 aa, Mycobacterium tuberculosis
IDDALKVVEQASLR

SEQ ID NO: 119769 - protein, 14 aa, Mycobacterium tuberculosis
DDALKVVEQASLRA

SEQ ID NO: 119770 - protein, 14 aa, Mycobacterium tuberculosis
DALKVVEQASLRAG

SEQ ID NO: 119771 - protein, 14 aa, Mycobacterium tuberculosis
ALKVVEQASLRAGP

SEQ ID NO: 119772 - protein, 14 aa, Mycobacterium tuberculosis
LKVVEQASLRAGPP

SEQ ID NO: 119773 - protein, 14 aa, Mycobacterium tuberculosis
KVVEQASLRAGPPT

SEQ ID NO: 119774 - protein, 14 aa, Mycobacterium tuberculosis
VVEQASLRAGPPTV

SEQ ID NO: 119775 - protein, 14 aa, Mycobacterium tuberculosis
VEQASLRAGPPTVH

SEQ ID NO: 119776 - protein, 14 aa, Mycobacterium tuberculosis
EQASLRAGPPTVHS

SEQ ID NO: 119777 - protein, 14 aa, Mycobacterium tuberculosis
QASLRAGPPTVHSE

SEQ ID NO: 119778 - protein, 14 aa, Mycobacterium tuberculosis
ASLRAGPPTVHSEI

SEQ ID NO: 119779 - protein, 14 aa, Mycobacterium tuberculosis
SLRAGPPTVHSEIV

SEQ ID NO: 119780 - protein, 14 aa, Mycobacterium tuberculosis
LRAGPPTVHSEIVP

SEQ ID NO: 119781 - protein, 14 aa, Mycobacterium tuberculosis
RAGPPTVHSEIVPA

SEQ ID NO: 119782 - protein, 14 aa, Mycobacterium tuberculosis
AGPPTVHSEIVPAA

SEQ ID NO: 119783 - protein, 14 aa, Mycobacterium tuberculosis
GPPTVHSEIVPAAA

SEQ ID NO: 119784 - protein, 14 aa, Mycobacterium tuberculosis
PPTVHSEIVPAAAV

SEQ ID NO: 119785 - protein, 14 aa, Mycobacterium tuberculosis
PTVHSEIVPAAAVP

SEQ ID NO: 119786 - protein, 14 aa, Mycobacterium tuberculosis
TVHSEIVPAAAVPT

SEQ ID NO: 119787 - protein, 14 aa, Mycobacterium tuberculosis
VHSEIVPAAAVPTL

SEQ ID NO: 119788 - protein, 14 aa, Mycobacterium tuberculosis
HSEIVPAAAVPTLV

SEQ ID NO: 119789 - protein, 14 aa, Mycobacterium tuberculosis
SEIVPAAAVPTLVD

SEQ ID NO: 119790 - protein, 14 aa, Mycobacterium tuberculosis
EIVPAAAVPTLVDM

SEQ ID NO: 119791 - protein, 14 aa, Mycobacterium tuberculosis
IVPAAAVPTLVDMS

SEQ ID NO: 119792 - protein, 14 aa, Mycobacterium tuberculosis
VPAAAVPTLVDMSK

SEQ ID NO: 119793 - protein, 14 aa, Mycobacterium tuberculosis
PAAAVPTLVDMSKD

SEQ ID NO: 119794 - protein, 14 aa, Mycobacterium tuberculosis
AAAVPTLVDMSKDA

SEQ ID NO: 119795 - protein, 14 aa, Mycobacterium tuberculosis
AAVPTLVDMSKDAV

SEQ ID NO: 119796 - protein, 14 aa, Mycobacterium tuberculosis
AVPTLVDMSKDAVL

SEQ ID NO: 119797 - protein, 14 aa, Mycobacterium tuberculosis
VPTLVDMSKDAVLM

SEQ ID NO: 119798 - protein, 14 aa, Mycobacterium tuberculosis
PTLVDMSKDAVLMV

SEQ ID NO: 119799 - protein, 14 aa, Mycobacterium tuberculosis
TLVDMSKDAVLMVV

SEQ ID NO: 119800 - protein, 14 aa, Mycobacterium tuberculosis
LVDMSKDAVLMVVG

SEQ ID NO: 119801 - protein, 14 aa, Mycobacterium tuberculosis
VDMSKDAVLMVVGC

SEQ ID NO: 119802 - protein, 14 aa, Mycobacterium tuberculosis
DMSKDAVLMVVGCL

SEQ ID NO: 119803 - protein, 14 aa, Mycobacterium tuberculosis
MSKDAVLMVVGCLG

SEQ ID NO: 119804 - protein, 14 aa, Mycobacterium tuberculosis
SKDAVLMVVGCLGS

SEQ ID NO: 119805 - protein, 14 aa, Mycobacterium tuberculosis
KDAVLMVVGCLGSG

SEQ ID NO: 119806 - protein, 14 aa, Mycobacterium tuberculosis
DAVLMVVGCLGSGR

SEQ ID NO: 119807 - protein, 14 aa, Mycobacterium tuberculosis
AVLMVVGCLGSGRW

SEQ ID NO: 119808 - protein, 14 aa, Mycobacterium tuberculosis
VLMVVGCLGSGRWP

SEQ ID NO: 119809 - protein, 14 aa, Mycobacterium tuberculosis
LMVVGCLGSGRWPG

SEQ ID NO: 119810 - protein, 14 aa, Mycobacterium tuberculosis
MVVGCLGSGRWPGR

SEQ ID NO: 119811 - protein, 14 aa, Mycobacterium tuberculosis
VVGCLGSGRWPGRL

SEQ ID NO: 119812 - protein, 14 aa, Mycobacterium tuberculosis
VGCLGSGRWPGRLL

SEQ ID NO: 119813 - protein, 14 aa, Mycobacterium tuberculosis
GCLGSGRWPGRLLG

SEQ ID NO: 119814 - protein, 14 aa, Mycobacterium tuberculosis
CLGSGRWPGRLLGS

SEQ ID NO: 119815 - protein, 14 aa, Mycobacterium tuberculosis
LGSGRWPGRLLGSV

SEQ ID NO: 119816 - protein, 14 aa, Mycobacterium tuberculosis
GSGRWPGRLLGSVS

SEQ ID NO: 119817 - protein, 14 aa, Mycobacterium tuberculosis
SGRWPGRLLGSVSS

SEQ ID NO: 119818 - protein, 14 aa, Mycobacterium tuberculosis
GRWPGRLLGSVSSG

SEQ ID NO: 119819 - protein, 14 aa, Mycobacterium tuberculosis
RWPGRLLGSVSSGL

SEQ ID NO: 119820 - protein, 14 aa, Mycobacterium tuberculosis
WPGRLLGSVSSGLL

SEQ ID NO: 119821 - protein, 14 aa, Mycobacterium tuberculosis
PGRLLGSVSSGLLR

SEQ ID NO: 119822 - protein, 14 aa, Mycobacterium tuberculosis
GRLLGSVSSGLLRH

SEQ ID NO: 119823 - protein, 14 aa, Mycobacterium tuberculosis
RLLGSVSSGLLRHA

SEQ ID NO: 119824 - protein, 14 aa, Mycobacterium tuberculosis
LLGSVSSGLLRHAH

SEQ ID NO: 119825 - protein, 14 aa, Mycobacterium tuberculosis
LGSVSSGLLRHAHC

SEQ ID NO: 119826 - protein, 14 aa, Mycobacterium tuberculosis
GSVSSGLLRHAHCP

SEQ ID NO: 119827 - protein, 14 aa, Mycobacterium tuberculosis
SVSSGLLRHAHCPV

SEQ ID NO: 119828 - protein, 14 aa, Mycobacterium tuberculosis
VSSGLLRHAHCPVV

SEQ ID NO: 119829 - protein, 14 aa, Mycobacterium tuberculosis
SSGLLRHAHCPVVI

SEQ ID NO: 119830 - protein, 14 aa, Mycobacterium tuberculosis
SGLLRHAHCPVVII

SEQ ID NO: 119831 - protein, 14 aa, Mycobacterium tuberculosis
GLLRHAHCPVVIIH

SEQ ID NO: 119832 - protein, 14 aa, Mycobacterium tuberculosis
LLRHAHCPVVIIHD

SEQ ID NO: 119833 - protein, 14 aa, Mycobacterium tuberculosis
LRHAHCPVVIIHDE

SEQ ID NO: 119834 - protein, 14 aa, Mycobacterium tuberculosis
RHAHCPVVIIHDED

SEQ ID NO: 119835 - protein, 14 aa, Mycobacterium tuberculosis
HAHCPVVIIHDEDS

SEQ ID NO: 119836 - protein, 14 aa, Mycobacterium tuberculosis
AHCPVVIIHDEDSV

SEQ ID NO: 119837 - protein, 14 aa, Mycobacterium tuberculosis
HCPVVIIHDEDSVM

SEQ ID NO: 119838 - protein, 14 aa, Mycobacterium tuberculosis
CPVVIIHDEDSVMP

SEQ ID NO: 119839 - protein, 14 aa, Mycobacterium tuberculosis
PVVIIHDEDSVMPH

SEQ ID NO: 119840 - protein, 14 aa, Mycobacterium tuberculosis
VVIIHDEDSVMPHP

SEQ ID NO: 119841 - protein, 14 aa, Mycobacterium tuberculosis
VIIHDEDSVMPHPQ

SEQ ID NO: 119842 - protein, 14 aa, Mycobacterium tuberculosis
IIHDEDSVMPHPQQ

SEQ ID NO: 119843 - protein, 14 aa, Mycobacterium tuberculosis
IHDEDSVMPHPQQA

SEQ ID NO: 119844 - protein, 14 aa, Mycobacterium tuberculosis
HDEDSVMPHPQQAP

SEQ ID NO: 119845 - protein, 14 aa, Mycobacterium tuberculosis
DEDSVMPHPQQAPV

SEQ ID NO: 119846 - protein, 14 aa, Mycobacterium tuberculosis
EDSVMPHPQQAPVL

SEQ ID NO: 119847 - protein, 14 aa, Mycobacterium tuberculosis
DSVMPHPQQAPVLV

SEQ ID NO: 119848 - protein, 14 aa, Mycobacterium tuberculosis
SVMPHPQQAPVLVG

SEQ ID NO: 119849 - protein, 14 aa, Mycobacterium tuberculosis
VMPHPQQAPVLVGV

SEQ ID NO: 119850 - protein, 14 aa, Mycobacterium tuberculosis
MPHPQQAPVLVGVD

SEQ ID NO: 119851 - protein, 14 aa, Mycobacterium tuberculosis
PHPQQAPVLVGVDG

SEQ ID NO: 119852 - protein, 14 aa, Mycobacterium tuberculosis
HPQQAPVLVGVDGS

SEQ ID NO: 119853 - protein, 14 aa, Mycobacterium tuberculosis
PQQAPVLVGVDGSS

SEQ ID NO: 119854 - protein, 14 aa, Mycobacterium tuberculosis
QQAPVLVGVDGSSA

SEQ ID NO: 119855 - protein, 14 aa, Mycobacterium tuberculosis
QAPVLVGVDGSSAS

SEQ ID NO: 119856 - protein, 14 aa, Mycobacterium tuberculosis
APVLVGVDGSSASE

SEQ ID NO: 119857 - protein, 14 aa, Mycobacterium tuberculosis
PVLVGVDGSSASEL

SEQ ID NO: 119858 - protein, 14 aa, Mycobacterium tuberculosis
VLVGVDGSSASELA

SEQ ID NO: 119859 - protein, 14 aa, Mycobacterium tuberculosis
LVGVDGSSASELAT

SEQ ID NO: 119860 - protein, 14 aa, Mycobacterium tuberculosis
VGVDGSSASELATA

SEQ ID NO: 119861 - protein, 14 aa, Mycobacterium tuberculosis
GVDGSSASELATAI

SEQ ID NO: 119862 - protein, 14 aa, Mycobacterium tuberculosis
VDGSSASELATAIA

SEQ ID NO: 119863 - protein, 14 aa, Mycobacterium tuberculosis
DGSSASELATAIAF

SEQ ID NO: 119864 - protein, 14 aa, Mycobacterium tuberculosis
GSSASELATAIAFD

SEQ ID NO: 119865 - protein, 14 aa, Mycobacterium tuberculosis
SSASELATAIAFDE

SEQ ID NO: 119866 - protein, 14 aa, Mycobacterium tuberculosis
SASELATAIAFDEA

SEQ ID NO: 119867 - protein, 14 aa, Mycobacterium tuberculosis
ASELATAIAFDEAS

SEQ ID NO: 119868 - protein, 14 aa, Mycobacterium tuberculosis
SELATAIAFDEASR

SEQ ID NO: 119869 - protein, 14 aa, Mycobacterium tuberculosis
ELATAIAFDEASRR

SEQ ID NO: 119870 - protein, 14 aa, Mycobacterium tuberculosis
LATAIAFDEASRRN

SEQ ID NO: 119871 - protein, 14 aa, Mycobacterium tuberculosis
ATAIAFDEASRRNV

SEQ ID NO: 119872 - protein, 14 aa, Mycobacterium tuberculosis
TAIAFDEASRRNVD

SEQ ID NO: 119873 - protein, 14 aa, Mycobacterium tuberculosis
AIAFDEASRRNVDL

SEQ ID NO: 119874 - protein, 14 aa, Mycobacterium tuberculosis
IAFDEASRRNVDLV

SEQ ID NO: 119875 - protein, 14 aa, Mycobacterium tuberculosis
AFDEASRRNVDLVA

SEQ ID NO: 119876 - protein, 14 aa, Mycobacterium tuberculosis
FDEASRRNVDLVAL

SEQ ID NO: 119877 - protein, 14 aa, Mycobacterium tuberculosis
DEASRRNVDLVALH

SEQ ID NO: 119878 - protein, 14 aa, Mycobacterium tuberculosis
EASRRNVDLVALHA

SEQ ID NO: 119879 - protein, 14 aa, Mycobacterium tuberculosis
ASRRNVDLVALHAW

SEQ ID NO: 119880 - protein, 14 aa, Mycobacterium tuberculosis
SRRNVDLVALHAWS

SEQ ID NO: 119881 - protein, 14 aa, Mycobacterium tuberculosis
RRNVDLVALHAWSD

SEQ ID NO: 119882 - protein, 14 aa, Mycobacterium tuberculosis
RNVDLVALHAWSDV

SEQ ID NO: 119883 - protein, 14 aa, Mycobacterium tuberculosis
NVDLVALHAWSDVD

SEQ ID NO: 119884 - protein, 14 aa, Mycobacterium tuberculosis
VDLVALHAWSDVDV

SEQ ID NO: 119885 - protein, 14 aa, Mycobacterium tuberculosis
DLVALHAWSDVDVS

SEQ ID NO: 119886 - protein, 14 aa, Mycobacterium tuberculosis
LVALHAWSDVDVSE

SEQ ID NO: 119887 - protein, 14 aa, Mycobacterium tuberculosis
VALHAWSDVDVSEW

SEQ ID NO: 119888 - protein, 14 aa, Mycobacterium tuberculosis
ALHAWSDVDVSEWP

SEQ ID NO: 119889 - protein, 14 aa, Mycobacterium tuberculosis
LHAWSDVDVSEWPG

SEQ ID NO: 119890 - protein, 14 aa, Mycobacterium tuberculosis
HAWSDVDVSEWPGI

SEQ ID NO: 119891 - protein, 14 aa, Mycobacterium tuberculosis
AWSDVDVSEWPGID

SEQ ID NO: 119892 - protein, 14 aa, Mycobacterium tuberculosis
WSDVDVSEWPGIDW

SEQ ID NO: 119893 - protein, 14 aa, Mycobacterium tuberculosis
SDVDVSEWPGIDWP

SEQ ID NO: 119894 - protein, 14 aa, Mycobacterium tuberculosis
DVDVSEWPGIDWPA

SEQ ID NO: 119895 - protein, 14 aa, Mycobacterium tuberculosis
VDVSEWPGIDWPAT

SEQ ID NO: 119896 - protein, 14 aa, Mycobacterium tuberculosis
DVSEWPGIDWPATQ

SEQ ID NO: 119897 - protein, 14 aa, Mycobacterium tuberculosis
VSEWPGIDWPATQS

SEQ ID NO: 119898 - protein, 14 aa, Mycobacterium tuberculosis
SEWPGIDWPATQSM

SEQ ID NO: 119899 - protein, 14 aa, Mycobacterium tuberculosis
EWPGIDWPATQSMA

SEQ ID NO: 119900 - protein, 14 aa, Mycobacterium tuberculosis
WPGIDWPATQSMAE

SEQ ID NO: 119901 - protein, 14 aa, Mycobacterium tuberculosis
PGIDWPATQSMAEQ

SEQ ID NO: 119902 - protein, 14 aa, Mycobacterium tuberculosis
GIDWPATQSMAEQV

SEQ ID NO: 119903 - protein, 14 aa, Mycobacterium tuberculosis
IDWPATQSMAEQVL

SEQ ID NO: 119904 - protein, 14 aa, Mycobacterium tuberculosis
DWPATQSMAEQVLA

SEQ ID NO: 119905 - protein, 14 aa, Mycobacterium tuberculosis
WPATQSMAEQVLAE

SEQ ID NO: 119906 - protein, 14 aa, Mycobacterium tuberculosis
PATQSMAEQVLAER

SEQ ID NO: 119907 - protein, 14 aa, Mycobacterium tuberculosis
ATQSMAEQVLAERL

SEQ ID NO: 119908 - protein, 14 aa, Mycobacterium tuberculosis
TQSMAEQVLAERLA

SEQ ID NO: 119909 - protein, 14 aa, Mycobacterium tuberculosis
QSMAEQVLAERLAG

SEQ ID NO: 119910 - protein, 14 aa, Mycobacterium tuberculosis
SMAEQVLAERLAGW

SEQ ID NO: 119911 - protein, 14 aa, Mycobacterium tuberculosis
MAEQVLAERLAGWQ

SEQ ID NO: 119912 - protein, 14 aa, Mycobacterium tuberculosis
AEQVLAERLAGWQE

SEQ ID NO: 119913 - protein, 14 aa, Mycobacterium tuberculosis
EQVLAERLAGWQER

SEQ ID NO: 119914 - protein, 14 aa, Mycobacterium tuberculosis
QVLAERLAGWQERY

SEQ ID NO: 119915 - protein, 14 aa, Mycobacterium tuberculosis
VLAERLAGWQERYP

SEQ ID NO: 119916 - protein, 14 aa, Mycobacterium tuberculosis
LAERLAGWQERYPN

SEQ ID NO: 119917 - protein, 14 aa, Mycobacterium tuberculosis
AERLAGWQERYPNV

SEQ ID NO: 119918 - protein, 14 aa, Mycobacterium tuberculosis
ERLAGWQERYPNVA

SEQ ID NO: 119919 - protein, 14 aa, Mycobacterium tuberculosis
RLAGWQERYPNVAI

SEQ ID NO: 119920 - protein, 14 aa, Mycobacterium tuberculosis
LAGWQERYPNVAIT

SEQ ID NO: 119921 - protein, 14 aa, Mycobacterium tuberculosis
AGWQERYPNVAITR

SEQ ID NO: 119922 - protein, 14 aa, Mycobacterium tuberculosis
GWQERYPNVAITRV

SEQ ID NO: 119923 - protein, 14 aa, Mycobacterium tuberculosis
WQERYPNVAITRVV

SEQ ID NO: 119924 - protein, 14 aa, Mycobacterium tuberculosis
QERYPNVAITRVVV

SEQ ID NO: 119925 - protein, 14 aa, Mycobacterium tuberculosis
ERYPNVAITRVVVR

SEQ ID NO: 119926 - protein, 14 aa, Mycobacterium tuberculosis
RYPNVAITRVVVRD

SEQ ID NO: 119927 - protein, 14 aa, Mycobacterium tuberculosis
YPNVAITRVVVRDQ

SEQ ID NO: 119928 - protein, 14 aa, Mycobacterium tuberculosis
PNVAITRVVVRDQP

SEQ ID NO: 119929 - protein, 14 aa, Mycobacterium tuberculosis
NVAITRVVVRDQPA

SEQ ID NO: 119930 - protein, 14 aa, Mycobacterium tuberculosis
VAITRVVVRDQPAR

SEQ ID NO: 119931 - protein, 14 aa, Mycobacterium tuberculosis
AITRVVVRDQPARQ

SEQ ID NO: 119932 - protein, 14 aa, Mycobacterium tuberculosis
ITRVVVRDQPARQL

SEQ ID NO: 119933 - protein, 14 aa, Mycobacterium tuberculosis
TRVVVRDQPARQLV

SEQ ID NO: 119934 - protein, 14 aa, Mycobacterium tuberculosis
RVVVRDQPARQLVQ

SEQ ID NO: 119935 - protein, 14 aa, Mycobacterium tuberculosis
VVVRDQPARQLVQR

SEQ ID NO: 119936 - protein, 14 aa, Mycobacterium tuberculosis
VVRDQPARQLVQRS

SEQ ID NO: 119937 - protein, 14 aa, Mycobacterium tuberculosis
VRDQPARQLVQRSE

SEQ ID NO: 119938 - protein, 14 aa, Mycobacterium tuberculosis
RDQPARQLVQRSEE

SEQ ID NO: 119939 - protein, 14 aa, Mycobacterium tuberculosis
DQPARQLVQRSEEA

SEQ ID NO: 119940 - protein, 14 aa, Mycobacterium tuberculosis
QPARQLVQRSEEAQ

SEQ ID NO: 119941 - protein, 14 aa, Mycobacterium tuberculosis
PARQLVQRSEEAQL

SEQ ID NO: 119942 - protein, 14 aa, Mycobacterium tuberculosis
ARQLVQRSEEAQLV

SEQ ID NO: 119943 - protein, 14 aa, Mycobacterium tuberculosis
RQLVQRSEEAQLVV

SEQ ID NO: 119944 - protein, 14 aa, Mycobacterium tuberculosis
QLVQRSEEAQLVVV

SEQ ID NO: 119945 - protein, 14 aa, Mycobacterium tuberculosis
LVQRSEEAQLVVVG

SEQ ID NO: 119946 - protein, 14 aa, Mycobacterium tuberculosis
VQRSEEAQLVVVGS

SEQ ID NO: 119947 - protein, 14 aa, Mycobacterium tuberculosis
QRSEEAQLVVVGSR

SEQ ID NO: 119948 - protein, 14 aa, Mycobacterium tuberculosis
RSEEAQLVVVGSRG

SEQ ID NO: 119949 - protein, 14 aa, Mycobacterium tuberculosis
SEEAQLVVVGSRGR

SEQ ID NO: 119950 - protein, 14 aa, Mycobacterium tuberculosis
EEAQLVVVGSRGRG

SEQ ID NO: 119951 - protein, 14 aa, Mycobacterium tuberculosis
EAQLVVVGSRGRGG

SEQ ID NO: 119952 - protein, 14 aa, Mycobacterium tuberculosis
AQLVVVGSRGRGGY

SEQ ID NO: 119953 - protein, 14 aa, Mycobacterium tuberculosis
QLVVVGSRGRGGYA

SEQ ID NO: 119954 - protein, 14 aa, Mycobacterium tuberculosis
LVVVGSRGRGGYAG

SEQ ID NO: 119955 - protein, 14 aa, Mycobacterium tuberculosis
VVVGSRGRGGYAGM

SEQ ID NO: 119956 - protein, 14 aa, Mycobacterium tuberculosis
VVGSRGRGGYAGML

SEQ ID NO: 119957 - protein, 14 aa, Mycobacterium tuberculosis
VGSRGRGGYAGMLV

SEQ ID NO: 119958 - protein, 14 aa, Mycobacterium tuberculosis
GSRGRGGYAGMLVG

SEQ ID NO: 119959 - protein, 14 aa, Mycobacterium tuberculosis
SRGRGGYAGMLVGS

SEQ ID NO: 119960 - protein, 14 aa, Mycobacterium tuberculosis
RGRGGYAGMLVGSV

SEQ ID NO: 119961 - protein, 14 aa, Mycobacterium tuberculosis
GRGGYAGMLVGSVG

SEQ ID NO: 119962 - protein, 14 aa, Mycobacterium tuberculosis
RGGYAGMLVGSVGE

SEQ ID NO: 119963 - protein, 14 aa, Mycobacterium tuberculosis
GGYAGMLVGSVGET

SEQ ID NO: 119964 - protein, 14 aa, Mycobacterium tuberculosis
GYAGMLVGSVGETV

SEQ ID NO: 119965 - protein, 14 aa, Mycobacterium tuberculosis
YAGMLVGSVGETVA

SEQ ID NO: 119966 - protein, 14 aa, Mycobacterium tuberculosis
AGMLVGSVGETVAQ

SEQ ID NO: 119967 - protein, 14 aa, Mycobacterium tuberculosis
GMLVGSVGETVAQL

SEQ ID NO: 119968 - protein, 14 aa, Mycobacterium tuberculosis
MLVGSVGETVAQLA

SEQ ID NO: 119969 - protein, 14 aa, Mycobacterium tuberculosis
LVGSVGETVAQLAR

SEQ ID NO: 119970 - protein, 14 aa, Mycobacterium tuberculosis
VGSVGETVAQLART

SEQ ID NO: 119971 - protein, 14 aa, Mycobacterium tuberculosis
GSVGETVAQLARTP

SEQ ID NO: 119972 - protein, 14 aa, Mycobacterium tuberculosis
SVGETVAQLARTPV

SEQ ID NO: 119973 - protein, 14 aa, Mycobacterium tuberculosis
VGETVAQLARTPVI

SEQ ID NO: 119974 - protein, 14 aa, Mycobacterium tuberculosis
GETVAQLARTPVIV

SEQ ID NO: 119975 - protein, 14 aa, Mycobacterium tuberculosis
ETVAQLARTPVIVA

SEQ ID NO: 119976 - protein, 14 aa, Mycobacterium tuberculosis
TVAQLARTPVIVAR

SEQ ID NO: 119977 - protein, 14 aa, Mycobacterium tuberculosis
VAQLARTPVIVARE

SEQ ID NO: 119978 - protein, 14 aa, Mycobacterium tuberculosis
AQLARTPVIVARES

SEQ ID NO: 119979 - protein, 14 aa, Mycobacterium tuberculosis
QLARTPVIVARESL

SEQ ID NO: 119980 - protein, 14 aa, Mycobacterium tuberculosis
LARTPVIVARESLT

SEQ ID NO: 119981 - protein, 15 aa, Mycobacterium tuberculosis
MSSGNSSLGIIVGID

SEQ ID NO: 119982 - protein, 15 aa, Mycobacterium tuberculosis
SSGNSSLGIIVGIDD

SEQ ID NO: 119983 - protein, 15 aa, Mycobacterium tuberculosis
SGNSSLGIIVGIDDS

SEQ ID NO: 119984 - protein, 15 aa, Mycobacterium tuberculosis
GNSSLGIIVGIDDSP

SEQ ID NO: 119985 - protein, 15 aa, Mycobacterium tuberculosis
NSSLGIIVGIDDSPA

SEQ ID NO: 119986 - protein, 15 aa, Mycobacterium tuberculosis
SSLGIIVGIDDSPAA

SEQ ID NO: 119987 - protein, 15 aa, Mycobacterium tuberculosis
SLGIIVGIDDSPAAQ

SEQ ID NO: 119988 - protein, 15 aa, Mycobacterium tuberculosis
LGIIVGIDDSPAAQV

SEQ ID NO: 119989 - protein, 15 aa, Mycobacterium tuberculosis
GIIVGIDDSPAAQVA

SEQ ID NO: 119990 - protein, 15 aa, Mycobacterium tuberculosis
IIVGIDDSPAAQVAV

SEQ ID NO: 119991 - protein, 15 aa, Mycobacterium tuberculosis
IVGIDDSPAAQVAVR

SEQ ID NO: 119992 - protein, 15 aa, Mycobacterium tuberculosis
VGIDDSPAAQVAVRW

SEQ ID NO: 119993 - protein, 15 aa, Mycobacterium tuberculosis
GIDDSPAAQVAVRWA

SEQ ID NO: 119994 - protein, 15 aa, Mycobacterium tuberculosis
IDDSPAAQVAVRWAA

SEQ ID NO: 119995 - protein, 15 aa, Mycobacterium tuberculosis
DDSPAAQVAVRWAAR

SEQ ID NO: 119996 - protein, 15 aa, Mycobacterium tuberculosis
DSPAAQVAVRWAARD

SEQ ID NO: 119997 - protein, 15 aa, Mycobacterium tuberculosis
SPAAQVAVRWAARDA

SEQ ID NO: 119998 - protein, 15 aa, Mycobacterium tuberculosis
PAAQVAVRWAARDAE

SEQ ID NO: 119999 - protein, 15 aa, Mycobacterium tuberculosis
AAQVAVRWAARDAEL

SEQ ID NO: 120000 - protein, 15 aa, Mycobacterium tuberculosis
AQVAVRWAARDAELR

SEQ ID NO: 120001 - protein, 15 aa, Mycobacterium tuberculosis
QVAVRWAARDAELRK

SEQ ID NO: 120002 - protein, 15 aa, Mycobacterium tuberculosis
VAVRWAARDAELRKI

SEQ ID NO: 120003 - protein, 15 aa, Mycobacterium tuberculosis
AVRWAARDAELRKIP

SEQ ID NO: 120004 - protein, 15 aa, Mycobacterium tuberculosis
VRWAARDAELRKIPL

SEQ ID NO: 120005 - protein, 15 aa, Mycobacterium tuberculosis
RWAARDAELRKIPLT

SEQ ID NO: 120006 - protein, 15 aa, Mycobacterium tuberculosis
WAARDAELRKIPLTL

SEQ ID NO: 120007 - protein, 15 aa, Mycobacterium tuberculosis
AARDAELRKIPLTLV

SEQ ID NO: 120008 - protein, 15 aa, Mycobacterium tuberculosis
ARDAELRKIPLTLVH

SEQ ID NO: 120009 - protein, 15 aa, Mycobacterium tuberculosis
RDAELRKIPLTLVHA

SEQ ID NO: 120010 - protein, 15 aa, Mycobacterium tuberculosis
DAELRKIPLTLVHAV

SEQ ID NO: 120011 - protein, 15 aa, Mycobacterium tuberculosis
AELRKIPLTLVHAVS

SEQ ID NO: 120012 - protein, 15 aa, Mycobacterium tuberculosis
ELRKIPLTLVHAVSP

SEQ ID NO: 120013 - protein, 15 aa, Mycobacterium tuberculosis
LRKIPLTLVHAVSPE

SEQ ID NO: 120014 - protein, 15 aa, Mycobacterium tuberculosis
RKIPLTLVHAVSPEV

SEQ ID NO: 120015 - protein, 15 aa, Mycobacterium tuberculosis
KIPLTLVHAVSPEVA

SEQ ID NO: 120016 - protein, 15 aa, Mycobacterium tuberculosis
IPLTLVHAVSPEVAT

SEQ ID NO: 120017 - protein, 15 aa, Mycobacterium tuberculosis
PLTLVHAVSPEVATW

SEQ ID NO: 120018 - protein, 15 aa, Mycobacterium tuberculosis
LTLVHAVSPEVATWL

SEQ ID NO: 120019 - protein, 15 aa, Mycobacterium tuberculosis
TLVHAVSPEVATWLE

SEQ ID NO: 120020 - protein, 15 aa, Mycobacterium tuberculosis
LVHAVSPEVATWLEV

SEQ ID NO: 120021 - protein, 15 aa, Mycobacterium tuberculosis
VHAVSPEVATWLEVP

SEQ ID NO: 120022 - protein, 15 aa, Mycobacterium tuberculosis
HAVSPEVATWLEVPL

SEQ ID NO: 120023 - protein, 15 aa, Mycobacterium tuberculosis
AVSPEVATWLEVPLP

SEQ ID NO: 120024 - protein, 15 aa, Mycobacterium tuberculosis
VSPEVATWLEVPLPP

SEQ ID NO: 120025 - protein, 15 aa, Mycobacterium tuberculosis
SPEVATWLEVPLPPG

SEQ ID NO: 120026 - protein, 15 aa, Mycobacterium tuberculosis
PEVATWLEVPLPPGV

SEQ ID NO: 120027 - protein, 15 aa, Mycobacterium tuberculosis
EVATWLEVPLPPGVL

SEQ ID NO: 120028 - protein, 15 aa, Mycobacterium tuberculosis
VATWLEVPLPPGVLR

SEQ ID NO: 120029 - protein, 15 aa, Mycobacterium tuberculosis
ATWLEVPLPPGVLRW

SEQ ID NO: 120030 - protein, 15 aa, Mycobacterium tuberculosis
TWLEVPLPPGVLRWQ

SEQ ID NO: 120031 - protein, 15 aa, Mycobacterium tuberculosis
WLEVPLPPGVLRWQQ

SEQ ID NO: 120032 - protein, 15 aa, Mycobacterium tuberculosis
LEVPLPPGVLRWQQD

SEQ ID NO: 120033 - protein, 15 aa, Mycobacterium tuberculosis
EVPLPPGVLRWQQDH

SEQ ID NO: 120034 - protein, 15 aa, Mycobacterium tuberculosis
VPLPPGVLRWQQDHG

SEQ ID NO: 120035 - protein, 15 aa, Mycobacterium tuberculosis
PLPPGVLRWQQDHGR

SEQ ID NO: 120036 - protein, 15 aa, Mycobacterium tuberculosis
LPPGVLRWQQDHGRH

SEQ ID NO: 120037 - protein, 15 aa, Mycobacterium tuberculosis
PPGVLRWQQDHGRHL

SEQ ID NO: 120038 - protein, 15 aa, Mycobacterium tuberculosis
PGVLRWQQDHGRHLI

SEQ ID NO: 120039 - protein, 15 aa, Mycobacterium tuberculosis
GVLRWQQDHGRHLID

SEQ ID NO: 120040 - protein, 15 aa, Mycobacterium tuberculosis
VLRWQQDHGRHLIDD

SEQ ID NO: 120041 - protein, 15 aa, Mycobacterium tuberculosis
LRWQQDHGRHLIDDA

SEQ ID NO: 120042 - protein, 15 aa, Mycobacterium tuberculosis
RWQQDHGRHLIDDAL

SEQ ID NO: 120043 - protein, 15 aa, Mycobacterium tuberculosis
WQQDHGRHLIDDALK

SEQ ID NO: 120044 - protein, 15 aa, Mycobacterium tuberculosis
QQDHGRHLIDDALKV

SEQ ID NO: 120045 - protein, 15 aa, Mycobacterium tuberculosis
QDHGRHLIDDALKVV

SEQ ID NO: 120046 - protein, 15 aa, Mycobacterium tuberculosis
DHGRHLIDDALKVVE

SEQ ID NO: 120047 - protein, 15 aa, Mycobacterium tuberculosis
HGRHLIDDALKVVEQ

SEQ ID NO: 120048 - protein, 15 aa, Mycobacterium tuberculosis
GRHLIDDALKVVEQA

SEQ ID NO: 120049 - protein, 15 aa, Mycobacterium tuberculosis
RHLIDDALKVVEQAS

SEQ ID NO: 120050 - protein, 15 aa, Mycobacterium tuberculosis
HLIDDALKVVEQASL

SEQ ID NO: 120051 - protein, 15 aa, Mycobacterium tuberculosis
LIDDALKVVEQASLR

SEQ ID NO: 120052 - protein, 15 aa, Mycobacterium tuberculosis
IDDALKVVEQASLRA

SEQ ID NO: 120053 - protein, 15 aa, Mycobacterium tuberculosis
DDALKVVEQASLRAG

SEQ ID NO: 120054 - protein, 15 aa, Mycobacterium tuberculosis
DALKVVEQASLRAGP

SEQ ID NO: 120055 - protein, 15 aa, Mycobacterium tuberculosis
ALKVVEQASLRAGPP

SEQ ID NO: 120056 - protein, 15 aa, Mycobacterium tuberculosis
LKVVEQASLRAGPPT

SEQ ID NO: 120057 - protein, 15 aa, Mycobacterium tuberculosis
KVVEQASLRAGPPTV

SEQ ID NO: 120058 - protein, 15 aa, Mycobacterium tuberculosis
VVEQASLRAGPPTVH

SEQ ID NO: 120059 - protein, 15 aa, Mycobacterium tuberculosis
VEQASLRAGPPTVHS

SEQ ID NO: 120060 - protein, 15 aa, Mycobacterium tuberculosis
EQASLRAGPPTVHSE

SEQ ID NO: 120061 - protein, 15 aa, Mycobacterium tuberculosis
QASLRAGPPTVHSEI

SEQ ID NO: 120062 - protein, 15 aa, Mycobacterium tuberculosis
ASLRAGPPTVHSEIV

SEQ ID NO: 120063 - protein, 15 aa, Mycobacterium tuberculosis
SLRAGPPTVHSEIVP

SEQ ID NO: 120064 - protein, 15 aa, Mycobacterium tuberculosis
LRAGPPTVHSEIVPA

SEQ ID NO: 120065 - protein, 15 aa, Mycobacterium tuberculosis
RAGPPTVHSEIVPAA

SEQ ID NO: 120066 - protein, 15 aa, Mycobacterium tuberculosis
AGPPTVHSEIVPAAA

SEQ ID NO: 120067 - protein, 15 aa, Mycobacterium tuberculosis
GPPTVHSEIVPAAAV

SEQ ID NO: 120068 - protein, 15 aa, Mycobacterium tuberculosis
PPTVHSEIVPAAAVP

SEQ ID NO: 120069 - protein, 15 aa, Mycobacterium tuberculosis
PTVHSEIVPAAAVPT

SEQ ID NO: 120070 - protein, 15 aa, Mycobacterium tuberculosis
TVHSEIVPAAAVPTL

SEQ ID NO: 120071 - protein, 15 aa, Mycobacterium tuberculosis
VHSEIVPAAAVPTLV

SEQ ID NO: 120072 - protein, 15 aa, Mycobacterium tuberculosis
HSEIVPAAAVPTLVD

SEQ ID NO: 120073 - protein, 15 aa, Mycobacterium tuberculosis
SEIVPAAAVPTLVDM

SEQ ID NO: 120074 - protein, 15 aa, Mycobacterium tuberculosis
EIVPAAAVPTLVDMS

SEQ ID NO: 120075 - protein, 15 aa, Mycobacterium tuberculosis
IVPAAAVPTLVDMSK

SEQ ID NO: 120076 - protein, 15 aa, Mycobacterium tuberculosis
VPAAAVPTLVDMSKD

SEQ ID NO: 120077 - protein, 15 aa, Mycobacterium tuberculosis
PAAAVPTLVDMSKDA

SEQ ID NO: 120078 - protein, 15 aa, Mycobacterium tuberculosis
AAAVPTLVDMSKDAV

SEQ ID NO: 120079 - protein, 15 aa, Mycobacterium tuberculosis
AAVPTLVDMSKDAVL

SEQ ID NO: 120080 - protein, 15 aa, Mycobacterium tuberculosis
AVPTLVDMSKDAVLM

SEQ ID NO: 120081 - protein, 15 aa, Mycobacterium tuberculosis
VPTLVDMSKDAVLMV

SEQ ID NO: 120082 - protein, 15 aa, Mycobacterium tuberculosis
PTLVDMSKDAVLMVV

SEQ ID NO: 120083 - protein, 15 aa, Mycobacterium tuberculosis
TLVDMSKDAVLMVVG

SEQ ID NO: 120084 - protein, 15 aa, Mycobacterium tuberculosis
LVDMSKDAVLMVVGC

SEQ ID NO: 120085 - protein, 15 aa, Mycobacterium tuberculosis
VDMSKDAVLMVVGCL

SEQ ID NO: 120086 - protein, 15 aa, Mycobacterium tuberculosis
DMSKDAVLMVVGCLG

SEQ ID NO: 120087 - protein, 15 aa, Mycobacterium tuberculosis
MSKDAVLMVVGCLGS

SEQ ID NO: 120088 - protein, 15 aa, Mycobacterium tuberculosis
SKDAVLMVVGCLGSG

SEQ ID NO: 120089 - protein, 15 aa, Mycobacterium tuberculosis
KDAVLMVVGCLGSGR

SEQ ID NO: 120090 - protein, 15 aa, Mycobacterium tuberculosis
DAVLMVVGCLGSGRW

SEQ ID NO: 120091 - protein, 15 aa, Mycobacterium tuberculosis
AVLMVVGCLGSGRWP

SEQ ID NO: 120092 - protein, 15 aa, Mycobacterium tuberculosis
VLMVVGCLGSGRWPG

SEQ ID NO: 120093 - protein, 15 aa, Mycobacterium tuberculosis
LMVVGCLGSGRWPGR

SEQ ID NO: 120094 - protein, 15 aa, Mycobacterium tuberculosis
MVVGCLGSGRWPGRL

SEQ ID NO: 120095 - protein, 15 aa, Mycobacterium tuberculosis
VVGCLGSGRWPGRLL

SEQ ID NO: 120096 - protein, 15 aa, Mycobacterium tuberculosis
VGCLGSGRWPGRLLG

SEQ ID NO: 120097 - protein, 15 aa, Mycobacterium tuberculosis
GCLGSGRWPGRLLGS

SEQ ID NO: 120098 - protein, 15 aa, Mycobacterium tuberculosis
CLGSGRWPGRLLGSV

SEQ ID NO: 120099 - protein, 15 aa, Mycobacterium tuberculosis
LGSGRWPGRLLGSVS

SEQ ID NO: 120100 - protein, 15 aa, Mycobacterium tuberculosis
GSGRWPGRLLGSVSS

SEQ ID NO: 120101 - protein, 15 aa, Mycobacterium tuberculosis
SGRWPGRLLGSVSSG

SEQ ID NO: 120102 - protein, 15 aa, Mycobacterium tuberculosis
GRWPGRLLGSVSSGL

SEQ ID NO: 120103 - protein, 15 aa, Mycobacterium tuberculosis
RWPGRLLGSVSSGLL

SEQ ID NO: 120104 - protein, 15 aa, Mycobacterium tuberculosis
WPGRLLGSVSSGLLR

SEQ ID NO: 120105 - protein, 15 aa, Mycobacterium tuberculosis
PGRLLGSVSSGLLRH

SEQ ID NO: 120106 - protein, 15 aa, Mycobacterium tuberculosis
GRLLGSVSSGLLRHA

SEQ ID NO: 120107 - protein, 15 aa, Mycobacterium tuberculosis
RLLGSVSSGLLRHAH

SEQ ID NO: 120108 - protein, 15 aa, Mycobacterium tuberculosis
LLGSVSSGLLRHAHC

SEQ ID NO: 120109 - protein, 15 aa, Mycobacterium tuberculosis
LGSVSSGLLRHAHCP

SEQ ID NO: 120110 - protein, 15 aa, Mycobacterium tuberculosis
GSVSSGLLRHAHCPV

SEQ ID NO: 120111 - protein, 15 aa, Mycobacterium tuberculosis
SVSSGLLRHAHCPVV

SEQ ID NO: 120112 - protein, 15 aa, Mycobacterium tuberculosis
VSSGLLRHAHCPVVI

SEQ ID NO: 120113 - protein, 15 aa, Mycobacterium tuberculosis
SSGLLRHAHCPVVII

SEQ ID NO: 120114 - protein, 15 aa, Mycobacterium tuberculosis
SGLLRHAHCPVVIIH

SEQ ID NO: 120115 - protein, 15 aa, Mycobacterium tuberculosis
GLLRHAHCPVVIIHD

SEQ ID NO: 120116 - protein, 15 aa, Mycobacterium tuberculosis
LLRHAHCPVVIIHDE

SEQ ID NO: 120117 - protein, 15 aa, Mycobacterium tuberculosis
LRHAHCPVVIIHDED

SEQ ID NO: 120118 - protein, 15 aa, Mycobacterium tuberculosis
RHAHCPVVIIHDEDS

SEQ ID NO: 120119 - protein, 15 aa, Mycobacterium tuberculosis
HAHCPVVIIHDEDSV

SEQ ID NO: 120120 - protein, 15 aa, Mycobacterium tuberculosis
AHCPVVIIHDEDSVM

SEQ ID NO: 120121 - protein, 15 aa, Mycobacterium tuberculosis
HCPVVIIHDEDSVMP

SEQ ID NO: 120122 - protein, 15 aa, Mycobacterium tuberculosis
CPVVIIHDEDSVMPH

SEQ ID NO: 120123 - protein, 15 aa, Mycobacterium tuberculosis
PVVIIHDEDSVMPHP

SEQ ID NO: 120124 - protein, 15 aa, Mycobacterium tuberculosis
VVIIHDEDSVMPHPQ

SEQ ID NO: 120125 - protein, 15 aa, Mycobacterium tuberculosis
VIIHDEDSVMPHPQQ

SEQ ID NO: 120126 - protein, 15 aa, Mycobacterium tuberculosis
IIHDEDSVMPHPQQA

SEQ ID NO: 120127 - protein, 15 aa, Mycobacterium tuberculosis
IHDEDSVMPHPQQAP

SEQ ID NO: 120128 - protein, 15 aa, Mycobacterium tuberculosis
HDEDSVMPHPQQAPV

SEQ ID NO: 120129 - protein, 15 aa, Mycobacterium tuberculosis
DEDSVMPHPQQAPVL

SEQ ID NO: 120130 - protein, 15 aa, Mycobacterium tuberculosis
EDSVMPHPQQAPVLV

SEQ ID NO: 120131 - protein, 15 aa, Mycobacterium tuberculosis
DSVMPHPQQAPVLVG

SEQ ID NO: 120132 - protein, 15 aa, Mycobacterium tuberculosis
SVMPHPQQAPVLVGV

SEQ ID NO: 120133 - protein, 15 aa, Mycobacterium tuberculosis
VMPHPQQAPVLVGVD

SEQ ID NO: 120134 - protein, 15 aa, Mycobacterium tuberculosis
MPHPQQAPVLVGVDG

SEQ ID NO: 120135 - protein, 15 aa, Mycobacterium tuberculosis
PHPQQAPVLVGVDGS

SEQ ID NO: 120136 - protein, 15 aa, Mycobacterium tuberculosis
HPQQAPVLVGVDGSS

SEQ ID NO: 120137 - protein, 15 aa, Mycobacterium tuberculosis
PQQAPVLVGVDGSSA

SEQ ID NO: 120138 - protein, 15 aa, Mycobacterium tuberculosis
QQAPVLVGVDGSSAS

SEQ ID NO: 120139 - protein, 15 aa, Mycobacterium tuberculosis
QAPVLVGVDGSSASE

SEQ ID NO: 120140 - protein, 15 aa, Mycobacterium tuberculosis
APVLVGVDGSSASEL

SEQ ID NO: 120141 - protein, 15 aa, Mycobacterium tuberculosis
PVLVGVDGSSASELA

SEQ ID NO: 120142 - protein, 15 aa, Mycobacterium tuberculosis
VLVGVDGSSASELAT

SEQ ID NO: 120143 - protein, 15 aa, Mycobacterium tuberculosis
LVGVDGSSASELATA

SEQ ID NO: 120144 - protein, 15 aa, Mycobacterium tuberculosis
VGVDGSSASELATAI

SEQ ID NO: 120145 - protein, 15 aa, Mycobacterium tuberculosis
GVDGSSASELATAIA

SEQ ID NO: 120146 - protein, 15 aa, Mycobacterium tuberculosis
VDGSSASELATAIAF

SEQ ID NO: 120147 - protein, 15 aa, Mycobacterium tuberculosis
DGSSASELATAIAFD

SEQ ID NO: 120148 - protein, 15 aa, Mycobacterium tuberculosis
GSSASELATAIAFDE

SEQ ID NO: 120149 - protein, 15 aa, Mycobacterium tuberculosis
SSASELATAIAFDEA

SEQ ID NO: 120150 - protein, 15 aa, Mycobacterium tuberculosis
SASELATAIAFDEAS

SEQ ID NO: 120151 - protein, 15 aa, Mycobacterium tuberculosis
ASELATAIAFDEASR

SEQ ID NO: 120152 - protein, 15 aa, Mycobacterium tuberculosis
SELATAIAFDEASRR

SEQ ID NO: 120153 - protein, 15 aa, Mycobacterium tuberculosis
ELATAIAFDEASRRN

SEQ ID NO: 120154 - protein, 15 aa, Mycobacterium tuberculosis
LATAIAFDEASRRNV

SEQ ID NO: 120155 - protein, 15 aa, Mycobacterium tuberculosis
ATAIAFDEASRRNVD

SEQ ID NO: 120156 - protein, 15 aa, Mycobacterium tuberculosis
TAIAFDEASRRNVDL

SEQ ID NO: 120157 - protein, 15 aa, Mycobacterium tuberculosis
AIAFDEASRRNVDLV

SEQ ID NO: 120158 - protein, 15 aa, Mycobacterium tuberculosis
IAFDEASRRNVDLVA

SEQ ID NO: 120159 - protein, 15 aa, Mycobacterium tuberculosis
AFDEASRRNVDLVAL

SEQ ID NO: 120160 - protein, 15 aa, Mycobacterium tuberculosis
FDEASRRNVDLVALH

SEQ ID NO: 120161 - protein, 15 aa, Mycobacterium tuberculosis
DEASRRNVDLVALHA

SEQ ID NO: 120162 - protein, 15 aa, Mycobacterium tuberculosis
EASRRNVDLVALHAW

SEQ ID NO: 120163 - protein, 15 aa, Mycobacterium tuberculosis
ASRRNVDLVALHAWS

SEQ ID NO: 120164 - protein, 15 aa, Mycobacterium tuberculosis
SRRNVDLVALHAWSD

SEQ ID NO: 120165 - protein, 15 aa, Mycobacterium tuberculosis
RRNVDLVALHAWSDV

SEQ ID NO: 120166 - protein, 15 aa, Mycobacterium tuberculosis
RNVDLVALHAWSDVD

SEQ ID NO: 120167 - protein, 15 aa, Mycobacterium tuberculosis
NVDLVALHAWSDVDV

SEQ ID NO: 120168 - protein, 15 aa, Mycobacterium tuberculosis
VDLVALHAWSDVDVS

SEQ ID NO: 120169 - protein, 15 aa, Mycobacterium tuberculosis
DLVALHAWSDVDVSE

SEQ ID NO: 120170 - protein, 15 aa, Mycobacterium tuberculosis
LVALHAWSDVDVSEW

SEQ ID NO: 120171 - protein, 15 aa, Mycobacterium tuberculosis
VALHAWSDVDVSEWP

SEQ ID NO: 120172 - protein, 15 aa, Mycobacterium tuberculosis
ALHAWSDVDVSEWPG

SEQ ID NO: 120173 - protein, 15 aa, Mycobacterium tuberculosis
LHAWSDVDVSEWPGI

SEQ ID NO: 120174 - protein, 15 aa, Mycobacterium tuberculosis
HAWSDVDVSEWPGID

SEQ ID NO: 120175 - protein, 15 aa, Mycobacterium tuberculosis
AWSDVDVSEWPGIDW

SEQ ID NO: 120176 - protein, 15 aa, Mycobacterium tuberculosis
WSDVDVSEWPGIDWP

SEQ ID NO: 120177 - protein, 15 aa, Mycobacterium tuberculosis
SDVDVSEWPGIDWPA

SEQ ID NO: 120178 - protein, 15 aa, Mycobacterium tuberculosis
DVDVSEWPGIDWPAT

SEQ ID NO: 120179 - protein, 15 aa, Mycobacterium tuberculosis
VDVSEWPGIDWPATQ

SEQ ID NO: 120180 - protein, 15 aa, Mycobacterium tuberculosis
DVSEWPGIDWPATQS

SEQ ID NO: 120181 - protein, 15 aa, Mycobacterium tuberculosis
VSEWPGIDWPATQSM

SEQ ID NO: 120182 - protein, 15 aa, Mycobacterium tuberculosis
SEWPGIDWPATQSMA

SEQ ID NO: 120183 - protein, 15 aa, Mycobacterium tuberculosis
EWPGIDWPATQSMAE

SEQ ID NO: 120184 - protein, 15 aa, Mycobacterium tuberculosis
WPGIDWPATQSMAEQ

SEQ ID NO: 120185 - protein, 15 aa, Mycobacterium tuberculosis
PGIDWPATQSMAEQV

SEQ ID NO: 120186 - protein, 15 aa, Mycobacterium tuberculosis
GIDWPATQSMAEQVL

SEQ ID NO: 120187 - protein, 15 aa, Mycobacterium tuberculosis
IDWPATQSMAEQVLA

SEQ ID NO: 120188 - protein, 15 aa, Mycobacterium tuberculosis
DWPATQSMAEQVLAE

SEQ ID NO: 120189 - protein, 15 aa, Mycobacterium tuberculosis
WPATQSMAEQVLAER

SEQ ID NO: 120190 - protein, 15 aa, Mycobacterium tuberculosis
PATQSMAEQVLAERL

SEQ ID NO: 120191 - protein, 15 aa, Mycobacterium tuberculosis
ATQSMAEQVLAERLA

SEQ ID NO: 120192 - protein, 15 aa, Mycobacterium tuberculosis
TQSMAEQVLAERLAG

SEQ ID NO: 120193 - protein, 15 aa, Mycobacterium tuberculosis
QSMAEQVLAERLAGW

SEQ ID NO: 120194 - protein, 15 aa, Mycobacterium tuberculosis
SMAEQVLAERLAGWQ

SEQ ID NO: 120195 - protein, 15 aa, Mycobacterium tuberculosis
MAEQVLAERLAGWQE

SEQ ID NO: 120196 - protein, 15 aa, Mycobacterium tuberculosis
AEQVLAERLAGWQER

SEQ ID NO: 120197 - protein, 15 aa, Mycobacterium tuberculosis
EQVLAERLAGWQERY

SEQ ID NO: 120198 - protein, 15 aa, Mycobacterium tuberculosis
QVLAERLAGWQERYP

SEQ ID NO: 120199 - protein, 15 aa, Mycobacterium tuberculosis
VLAERLAGWQERYPN

SEQ ID NO: 120200 - protein, 15 aa, Mycobacterium tuberculosis
LAERLAGWQERYPNV

SEQ ID NO: 120201 - protein, 15 aa, Mycobacterium tuberculosis
AERLAGWQERYPNVA

SEQ ID NO: 120202 - protein, 15 aa, Mycobacterium tuberculosis
ERLAGWQERYPNVAI

SEQ ID NO: 120203 - protein, 15 aa, Mycobacterium tuberculosis
RLAGWQERYPNVAIT

SEQ ID NO: 120204 - protein, 15 aa, Mycobacterium tuberculosis
LAGWQERYPNVAITR

SEQ ID NO: 120205 - protein, 15 aa, Mycobacterium tuberculosis
AGWQERYPNVAITRV

SEQ ID NO: 120206 - protein, 15 aa, Mycobacterium tuberculosis
GWQERYPNVAITRVV

SEQ ID NO: 120207 - protein, 15 aa, Mycobacterium tuberculosis
WQERYPNVAITRVVV

SEQ ID NO: 120208 - protein, 15 aa, Mycobacterium tuberculosis
QERYPNVAITRVVVR

SEQ ID NO: 120209 - protein, 15 aa, Mycobacterium tuberculosis
ERYPNVAITRVVVRD

SEQ ID NO: 120210 - protein, 15 aa, Mycobacterium tuberculosis
RYPNVAITRVVVRDQ

SEQ ID NO: 120211 - protein, 15 aa, Mycobacterium tuberculosis
YPNVAITRVVVRDQP

SEQ ID NO: 120212 - protein, 15 aa, Mycobacterium tuberculosis
PNVAITRVVVRDQPA

SEQ ID NO: 120213 - protein, 15 aa, Mycobacterium tuberculosis
NVAITRVVVRDQPAR

SEQ ID NO: 120214 - protein, 15 aa, Mycobacterium tuberculosis
VAITRVVVRDQPARQ

SEQ ID NO: 120215 - protein, 15 aa, Mycobacterium tuberculosis
AITRVVVRDQPARQL

SEQ ID NO: 120216 - protein, 15 aa, Mycobacterium tuberculosis
ITRVVVRDQPARQLV

SEQ ID NO: 120217 - protein, 15 aa, Mycobacterium tuberculosis
TRVVVRDQPARQLVQ

SEQ ID NO: 120218 - protein, 15 aa, Mycobacterium tuberculosis
RVVVRDQPARQLVQR

SEQ ID NO: 120219 - protein, 15 aa, Mycobacterium tuberculosis
VVVRDQPARQLVQRS

SEQ ID NO: 120220 - protein, 15 aa, Mycobacterium tuberculosis
VVRDQPARQLVQRSE

SEQ ID NO: 120221 - protein, 15 aa, Mycobacterium tuberculosis
VRDQPARQLVQRSEE

SEQ ID NO: 120222 - protein, 15 aa, Mycobacterium tuberculosis
RDQPARQLVQRSEEA

SEQ ID NO: 120223 - protein, 15 aa, Mycobacterium tuberculosis
DQPARQLVQRSEEAQ

SEQ ID NO: 120224 - protein, 15 aa, Mycobacterium tuberculosis
QPARQLVQRSEEAQL

SEQ ID NO: 120225 - protein, 15 aa, Mycobacterium tuberculosis
PARQLVQRSEEAQLV

SEQ ID NO: 120226 - protein, 15 aa, Mycobacterium tuberculosis
ARQLVQRSEEAQLVV

SEQ ID NO: 120227 - protein, 15 aa, Mycobacterium tuberculosis
RQLVQRSEEAQLVVV

SEQ ID NO: 120228 - protein, 15 aa, Mycobacterium tuberculosis
QLVQRSEEAQLVVVG

SEQ ID NO: 120229 - protein, 15 aa, Mycobacterium tuberculosis
LVQRSEEAQLVVVGS

SEQ ID NO: 120230 - protein, 15 aa, Mycobacterium tuberculosis
VQRSEEAQLVVVGSR

SEQ ID NO: 120231 - protein, 15 aa, Mycobacterium tuberculosis
QRSEEAQLVVVGSRG

SEQ ID NO: 120232 - protein, 15 aa, Mycobacterium tuberculosis
RSEEAQLVVVGSRGR

SEQ ID NO: 120233 - protein, 15 aa, Mycobacterium tuberculosis
SEEAQLVVVGSRGRG

SEQ ID NO: 120234 - protein, 15 aa, Mycobacterium tuberculosis
EEAQLVVVGSRGRGG

SEQ ID NO: 120235 - protein, 15 aa, Mycobacterium tuberculosis
EAQLVVVGSRGRGGY

SEQ ID NO: 120236 - protein, 15 aa, Mycobacterium tuberculosis
AQLVVVGSRGRGGYA

SEQ ID NO: 120237 - protein, 15 aa, Mycobacterium tuberculosis
QLVVVGSRGRGGYAG

SEQ ID NO: 120238 - protein, 15 aa, Mycobacterium tuberculosis
LVVVGSRGRGGYAGM

SEQ ID NO: 120239 - protein, 15 aa, Mycobacterium tuberculosis
VVVGSRGRGGYAGML

SEQ ID NO: 120240 - protein, 15 aa, Mycobacterium tuberculosis
VVGSRGRGGYAGMLV

SEQ ID NO: 120241 - protein, 15 aa, Mycobacterium tuberculosis
VGSRGRGGYAGMLVG

SEQ ID NO: 120242 - protein, 15 aa, Mycobacterium tuberculosis
GSRGRGGYAGMLVGS

SEQ ID NO: 120243 - protein, 15 aa, Mycobacterium tuberculosis
SRGRGGYAGMLVGSV

SEQ ID NO: 120244 - protein, 15 aa, Mycobacterium tuberculosis
RGRGGYAGMLVGSVG

SEQ ID NO: 120245 - protein, 15 aa, Mycobacterium tuberculosis
GRGGYAGMLVGSVGE

SEQ ID NO: 120246 - protein, 15 aa, Mycobacterium tuberculosis
RGGYAGMLVGSVGET

SEQ ID NO: 120247 - protein, 15 aa, Mycobacterium tuberculosis
GGYAGMLVGSVGETV

SEQ ID NO: 120248 - protein, 15 aa, Mycobacterium tuberculosis
GYAGMLVGSVGETVA

SEQ ID NO: 120249 - protein, 15 aa, Mycobacterium tuberculosis
YAGMLVGSVGETVAQ

SEQ ID NO: 120250 - protein, 15 aa, Mycobacterium tuberculosis
AGMLVGSVGETVAQL

SEQ ID NO: 120251 - protein, 15 aa, Mycobacterium tuberculosis
GMLVGSVGETVAQLA

SEQ ID NO: 120252 - protein, 15 aa, Mycobacterium tuberculosis
MLVGSVGETVAQLAR

SEQ ID NO: 120253 - protein, 15 aa, Mycobacterium tuberculosis
LVGSVGETVAQLART

SEQ ID NO: 120254 - protein, 15 aa, Mycobacterium tuberculosis
VGSVGETVAQLARTP

SEQ ID NO: 120255 - protein, 15 aa, Mycobacterium tuberculosis
GSVGETVAQLARTPV

SEQ ID NO: 120256 - protein, 15 aa, Mycobacterium tuberculosis
SVGETVAQLARTPVI

SEQ ID NO: 120257 - protein, 15 aa, Mycobacterium tuberculosis
VGETVAQLARTPVIV

SEQ ID NO: 120258 - protein, 15 aa, Mycobacterium tuberculosis
GETVAQLARTPVIVA

SEQ ID NO: 120259 - protein, 15 aa, Mycobacterium tuberculosis
ETVAQLARTPVIVAR

SEQ ID NO: 120260 - protein, 15 aa, Mycobacterium tuberculosis
TVAQLARTPVIVARE

SEQ ID NO: 120261 - protein, 15 aa, Mycobacterium tuberculosis
VAQLARTPVIVARES

SEQ ID NO: 120262 - protein, 15 aa, Mycobacterium tuberculosis
AQLARTPVIVARESL

SEQ ID NO: 120263 - protein, 15 aa, Mycobacterium tuberculosis
QLARTPVIVARESLT

SEQ ID NO: 120264 - protein, 16 aa, Mycobacterium tuberculosis
MSSGNSSLGIIVGIDD

SEQ ID NO: 120265 - protein, 16 aa, Mycobacterium tuberculosis
SSGNSSLGIIVGIDDS

SEQ ID NO: 120266 - protein, 16 aa, Mycobacterium tuberculosis
SGNSSLGIIVGIDDSP

SEQ ID NO: 120267 - protein, 16 aa, Mycobacterium tuberculosis
GNSSLGIIVGIDDSPA

SEQ ID NO: 120268 - protein, 16 aa, Mycobacterium tuberculosis
NSSLGIIVGIDDSPAA

SEQ ID NO: 120269 - protein, 16 aa, Mycobacterium tuberculosis
SSLGIIVGIDDSPAAQ

SEQ ID NO: 120270 - protein, 16 aa, Mycobacterium tuberculosis
SLGIIVGIDDSPAAQV

SEQ ID NO: 120271 - protein, 16 aa, Mycobacterium tuberculosis
LGIIVGIDDSPAAQVA

SEQ ID NO: 120272 - protein, 16 aa, Mycobacterium tuberculosis
GIIVGIDDSPAAQVAV

SEQ ID NO: 120273 - protein, 16 aa, Mycobacterium tuberculosis
IIVGIDDSPAAQVAVR

SEQ ID NO: 120274 - protein, 16 aa, Mycobacterium tuberculosis
IVGIDDSPAAQVAVRW

SEQ ID NO: 120275 - protein, 16 aa, Mycobacterium tuberculosis
VGIDDSPAAQVAVRWA

SEQ ID NO: 120276 - protein, 16 aa, Mycobacterium tuberculosis
GIDDSPAAQVAVRWAA

SEQ ID NO: 120277 - protein, 16 aa, Mycobacterium tuberculosis
IDDSPAAQVAVRWAAR

SEQ ID NO: 120278 - protein, 16 aa, Mycobacterium tuberculosis
DDSPAAQVAVRWAARD

SEQ ID NO: 120279 - protein, 16 aa, Mycobacterium tuberculosis
DSPAAQVAVRWAARDA

SEQ ID NO: 120280 - protein, 16 aa, Mycobacterium tuberculosis
SPAAQVAVRWAARDAE

SEQ ID NO: 120281 - protein, 16 aa, Mycobacterium tuberculosis
PAAQVAVRWAARDAEL

SEQ ID NO: 120282 - protein, 16 aa, Mycobacterium tuberculosis
AAQVAVRWAARDAELR

SEQ ID NO: 120283 - protein, 16 aa, Mycobacterium tuberculosis
AQVAVRWAARDAELRK

SEQ ID NO: 120284 - protein, 16 aa, Mycobacterium tuberculosis
QVAVRWAARDAELRKI

SEQ ID NO: 120285 - protein, 16 aa, Mycobacterium tuberculosis
VAVRWAARDAELRKIP

SEQ ID NO: 120286 - protein, 16 aa, Mycobacterium tuberculosis
AVRWAARDAELRKIPL

SEQ ID NO: 120287 - protein, 16 aa, Mycobacterium tuberculosis
VRWAARDAELRKIPLT

SEQ ID NO: 120288 - protein, 16 aa, Mycobacterium tuberculosis
RWAARDAELRKIPLTL

SEQ ID NO: 120289 - protein, 16 aa, Mycobacterium tuberculosis
WAARDAELRKIPLTLV

SEQ ID NO: 120290 - protein, 16 aa, Mycobacterium tuberculosis
AARDAELRKIPLTLVH

SEQ ID NO: 120291 - protein, 16 aa, Mycobacterium tuberculosis
ARDAELRKIPLTLVHA

SEQ ID NO: 120292 - protein, 16 aa, Mycobacterium tuberculosis
RDAELRKIPLTLVHAV

SEQ ID NO: 120293 - protein, 16 aa, Mycobacterium tuberculosis
DAELRKIPLTLVHAVS

SEQ ID NO: 120294 - protein, 16 aa, Mycobacterium tuberculosis
AELRKIPLTLVHAVSP

SEQ ID NO: 120295 - protein, 16 aa, Mycobacterium tuberculosis
ELRKIPLTLVHAVSPE

SEQ ID NO: 120296 - protein, 16 aa, Mycobacterium tuberculosis
LRKIPLTLVHAVSPEV

SEQ ID NO: 120297 - protein, 16 aa, Mycobacterium tuberculosis
RKIPLTLVHAVSPEVA

SEQ ID NO: 120298 - protein, 16 aa, Mycobacterium tuberculosis
KIPLTLVHAVSPEVAT

SEQ ID NO: 120299 - protein, 16 aa, Mycobacterium tuberculosis
IPLTLVHAVSPEVATW

SEQ ID NO: 120300 - protein, 16 aa, Mycobacterium tuberculosis
PLTLVHAVSPEVATWL

SEQ ID NO: 120301 - protein, 16 aa, Mycobacterium tuberculosis
LTLVHAVSPEVATWLE

SEQ ID NO: 120302 - protein, 16 aa, Mycobacterium tuberculosis
TLVHAVSPEVATWLEV

SEQ ID NO: 120303 - protein, 16 aa, Mycobacterium tuberculosis
LVHAVSPEVATWLEVP

SEQ ID NO: 120304 - protein, 16 aa, Mycobacterium tuberculosis
VHAVSPEVATWLEVPL

SEQ ID NO: 120305 - protein, 16 aa, Mycobacterium tuberculosis
HAVSPEVATWLEVPLP

SEQ ID NO: 120306 - protein, 16 aa, Mycobacterium tuberculosis
AVSPEVATWLEVPLPP

SEQ ID NO: 120307 - protein, 16 aa, Mycobacterium tuberculosis
VSPEVATWLEVPLPPG

SEQ ID NO: 120308 - protein, 16 aa, Mycobacterium tuberculosis
SPEVATWLEVPLPPGV

SEQ ID NO: 120309 - protein, 16 aa, Mycobacterium tuberculosis
PEVATWLEVPLPPGVL

SEQ ID NO: 120310 - protein, 16 aa, Mycobacterium tuberculosis
EVATWLEVPLPPGVLR

SEQ ID NO: 120311 - protein, 16 aa, Mycobacterium tuberculosis
VATWLEVPLPPGVLRW

SEQ ID NO: 120312 - protein, 16 aa, Mycobacterium tuberculosis
ATWLEVPLPPGVLRWQ

SEQ ID NO: 120313 - protein, 16 aa, Mycobacterium tuberculosis
TWLEVPLPPGVLRWQQ

SEQ ID NO: 120314 - protein, 16 aa, Mycobacterium tuberculosis
WLEVPLPPGVLRWQQD

SEQ ID NO: 120315 - protein, 16 aa, Mycobacterium tuberculosis
LEVPLPPGVLRWQQDH

SEQ ID NO: 120316 - protein, 16 aa, Mycobacterium tuberculosis
EVPLPPGVLRWQQDHG

SEQ ID NO: 120317 - protein, 16 aa, Mycobacterium tuberculosis
VPLPPGVLRWQQDHGR

SEQ ID NO: 120318 - protein, 16 aa, Mycobacterium tuberculosis
PLPPGVLRWQQDHGRH

SEQ ID NO: 120319 - protein, 16 aa, Mycobacterium tuberculosis
LPPGVLRWQQDHGRHL

SEQ ID NO: 120320 - protein, 16 aa, Mycobacterium tuberculosis
PPGVLRWQQDHGRHLI

SEQ ID NO: 120321 - protein, 16 aa, Mycobacterium tuberculosis
PGVLRWQQDHGRHLID

SEQ ID NO: 120322 - protein, 16 aa, Mycobacterium tuberculosis
GVLRWQQDHGRHLIDD

SEQ ID NO: 120323 - protein, 16 aa, Mycobacterium tuberculosis
VLRWQQDHGRHLIDDA

SEQ ID NO: 120324 - protein, 16 aa, Mycobacterium tuberculosis
LRWQQDHGRHLIDDAL

SEQ ID NO: 120325 - protein, 16 aa, Mycobacterium tuberculosis
RWQQDHGRHLIDDALK

SEQ ID NO: 120326 - protein, 16 aa, Mycobacterium tuberculosis
WQQDHGRHLIDDALKV

SEQ ID NO: 120327 - protein, 16 aa, Mycobacterium tuberculosis
QQDHGRHLIDDALKVV

SEQ ID NO: 120328 - protein, 16 aa, Mycobacterium tuberculosis
QDHGRHLIDDALKVVE

SEQ ID NO: 120329 - protein, 16 aa, Mycobacterium tuberculosis
DHGRHLIDDALKVVEQ

SEQ ID NO: 120330 - protein, 16 aa, Mycobacterium tuberculosis
HGRHLIDDALKVVEQA

SEQ ID NO: 120331 - protein, 16 aa, Mycobacterium tuberculosis
GRHLIDDALKVVEQAS

SEQ ID NO: 120332 - protein, 16 aa, Mycobacterium tuberculosis
RHLIDDALKVVEQASL

SEQ ID NO: 120333 - protein, 16 aa, Mycobacterium tuberculosis
HLIDDALKVVEQASLR

SEQ ID NO: 120334 - protein, 16 aa, Mycobacterium tuberculosis
LIDDALKVVEQASLRA

SEQ ID NO: 120335 - protein, 16 aa, Mycobacterium tuberculosis
IDDALKVVEQASLRAG

SEQ ID NO: 120336 - protein, 16 aa, Mycobacterium tuberculosis
DDALKVVEQASLRAGP

SEQ ID NO: 120337 - protein, 16 aa, Mycobacterium tuberculosis
DALKVVEQASLRAGPP

SEQ ID NO: 120338 - protein, 16 aa, Mycobacterium tuberculosis
ALKVVEQASLRAGPPT

SEQ ID NO: 120339 - protein, 16 aa, Mycobacterium tuberculosis
LKVVEQASLRAGPPTV

SEQ ID NO: 120340 - protein, 16 aa, Mycobacterium tuberculosis
KVVEQASLRAGPPTVH

SEQ ID NO: 120341 - protein, 16 aa, Mycobacterium tuberculosis
VVEQASLRAGPPTVHS

SEQ ID NO: 120342 - protein, 16 aa, Mycobacterium tuberculosis
VEQASLRAGPPTVHSE

SEQ ID NO: 120343 - protein, 16 aa, Mycobacterium tuberculosis
EQASLRAGPPTVHSEI

SEQ ID NO: 120344 - protein, 16 aa, Mycobacterium tuberculosis
QASLRAGPPTVHSEIV

SEQ ID NO: 120345 - protein, 16 aa, Mycobacterium tuberculosis
ASLRAGPPTVHSEIVP

SEQ ID NO: 120346 - protein, 16 aa, Mycobacterium tuberculosis
SLRAGPPTVHSEIVPA

SEQ ID NO: 120347 - protein, 16 aa, Mycobacterium tuberculosis
LRAGPPTVHSEIVPAA

SEQ ID NO: 120348 - protein, 16 aa, Mycobacterium tuberculosis
RAGPPTVHSEIVPAAA

SEQ ID NO: 120349 - protein, 16 aa, Mycobacterium tuberculosis
AGPPTVHSEIVPAAAV

SEQ ID NO: 120350 - protein, 16 aa, Mycobacterium tuberculosis
GPPTVHSEIVPAAAVP

SEQ ID NO: 120351 - protein, 16 aa, Mycobacterium tuberculosis
PPTVHSEIVPAAAVPT

SEQ ID NO: 120352 - protein, 16 aa, Mycobacterium tuberculosis
PTVHSEIVPAAAVPTL

SEQ ID NO: 120353 - protein, 16 aa, Mycobacterium tuberculosis
TVHSEIVPAAAVPTLV

SEQ ID NO: 120354 - protein, 16 aa, Mycobacterium tuberculosis
VHSEIVPAAAVPTLVD

SEQ ID NO: 120355 - protein, 16 aa, Mycobacterium tuberculosis
HSEIVPAAAVPTLVDM

SEQ ID NO: 120356 - protein, 16 aa, Mycobacterium tuberculosis
SEIVPAAAVPTLVDMS

SEQ ID NO: 120357 - protein, 16 aa, Mycobacterium tuberculosis
EIVPAAAVPTLVDMSK

SEQ ID NO: 120358 - protein, 16 aa, Mycobacterium tuberculosis
IVPAAAVPTLVDMSKD

SEQ ID NO: 120359 - protein, 16 aa, Mycobacterium tuberculosis
VPAAAVPTLVDMSKDA

SEQ ID NO: 120360 - protein, 16 aa, Mycobacterium tuberculosis
PAAAVPTLVDMSKDAV

SEQ ID NO: 120361 - protein, 16 aa, Mycobacterium tuberculosis
AAAVPTLVDMSKDAVL

SEQ ID NO: 120362 - protein, 16 aa, Mycobacterium tuberculosis
AAVPTLVDMSKDAVLM

SEQ ID NO: 120363 - protein, 16 aa, Mycobacterium tuberculosis
AVPTLVDMSKDAVLMV

SEQ ID NO: 120364 - protein, 16 aa, Mycobacterium tuberculosis
VPTLVDMSKDAVLMVV

SEQ ID NO: 120365 - protein, 16 aa, Mycobacterium tuberculosis
PTLVDMSKDAVLMVVG

SEQ ID NO: 120366 - protein, 16 aa, Mycobacterium tuberculosis
TLVDMSKDAVLMVVGC

SEQ ID NO: 120367 - protein, 16 aa, Mycobacterium tuberculosis
LVDMSKDAVLMVVGCL

SEQ ID NO: 120368 - protein, 16 aa, Mycobacterium tuberculosis
VDMSKDAVLMVVGCLG

SEQ ID NO: 120369 - protein, 16 aa, Mycobacterium tuberculosis
DMSKDAVLMVVGCLGS

SEQ ID NO: 120370 - protein, 16 aa, Mycobacterium tuberculosis
MSKDAVLMVVGCLGSG

SEQ ID NO: 120371 - protein, 16 aa, Mycobacterium tuberculosis
SKDAVLMVVGCLGSGR

SEQ ID NO: 120372 - protein, 16 aa, Mycobacterium tuberculosis
KDAVLMVVGCLGSGRW

SEQ ID NO: 120373 - protein, 16 aa, Mycobacterium tuberculosis
DAVLMVVGCLGSGRWP

SEQ ID NO: 120374 - protein, 16 aa, Mycobacterium tuberculosis
AVLMVVGCLGSGRWPG

SEQ ID NO: 120375 - protein, 16 aa, Mycobacterium tuberculosis
VLMVVGCLGSGRWPGR

SEQ ID NO: 120376 - protein, 16 aa, Mycobacterium tuberculosis
LMVVGCLGSGRWPGRL

SEQ ID NO: 120377 - protein, 16 aa, Mycobacterium tuberculosis
MVVGCLGSGRWPGRLL

SEQ ID NO: 120378 - protein, 16 aa, Mycobacterium tuberculosis
VVGCLGSGRWPGRLLG

SEQ ID NO: 120379 - protein, 16 aa, Mycobacterium tuberculosis
VGCLGSGRWPGRLLGS

SEQ ID NO: 120380 - protein, 16 aa, Mycobacterium tuberculosis
GCLGSGRWPGRLLGSV

SEQ ID NO: 120381 - protein, 16 aa, Mycobacterium tuberculosis
CLGSGRWPGRLLGSVS

SEQ ID NO: 120382 - protein, 16 aa, Mycobacterium tuberculosis
LGSGRWPGRLLGSVSS

SEQ ID NO: 120383 - protein, 16 aa, Mycobacterium tuberculosis
GSGRWPGRLLGSVSSG

SEQ ID NO: 120384 - protein, 16 aa, Mycobacterium tuberculosis
SGRWPGRLLGSVSSGL

SEQ ID NO: 120385 - protein, 16 aa, Mycobacterium tuberculosis
GRWPGRLLGSVSSGLL

SEQ ID NO: 120386 - protein, 16 aa, Mycobacterium tuberculosis
RWPGRLLGSVSSGLLR

SEQ ID NO: 120387 - protein, 16 aa, Mycobacterium tuberculosis
WPGRLLGSVSSGLLRH

SEQ ID NO: 120388 - protein, 16 aa, Mycobacterium tuberculosis
PGRLLGSVSSGLLRHA

SEQ ID NO: 120389 - protein, 16 aa, Mycobacterium tuberculosis
GRLLGSVSSGLLRHAH

SEQ ID NO: 120390 - protein, 16 aa, Mycobacterium tuberculosis
RLLGSVSSGLLRHAHC

SEQ ID NO: 120391 - protein, 16 aa, Mycobacterium tuberculosis
LLGSVSSGLLRHAHCP

SEQ ID NO: 120392 - protein, 16 aa, Mycobacterium tuberculosis
LGSVSSGLLRHAHCPV

SEQ ID NO: 120393 - protein, 16 aa, Mycobacterium tuberculosis
GSVSSGLLRHAHCPVV

SEQ ID NO: 120394 - protein, 16 aa, Mycobacterium tuberculosis
SVSSGLLRHAHCPVVI

SEQ ID NO: 120395 - protein, 16 aa, Mycobacterium tuberculosis
VSSGLLRHAHCPVVII

SEQ ID NO: 120396 - protein, 16 aa, Mycobacterium tuberculosis
SSGLLRHAHCPVVIIH

SEQ ID NO: 120397 - protein, 16 aa, Mycobacterium tuberculosis
SGLLRHAHCPVVIIHD

SEQ ID NO: 120398 - protein, 16 aa, Mycobacterium tuberculosis
GLLRHAHCPVVIIHDE

SEQ ID NO: 120399 - protein, 16 aa, Mycobacterium tuberculosis
LLRHAHCPVVIIHDED

SEQ ID NO: 120400 - protein, 16 aa, Mycobacterium tuberculosis
LRHAHCPVVIIHDEDS

SEQ ID NO: 120401 - protein, 16 aa, Mycobacterium tuberculosis
RHAHCPVVIIHDEDSV

SEQ ID NO: 120402 - protein, 16 aa, Mycobacterium tuberculosis
HAHCPVVIIHDEDSVM

SEQ ID NO: 120403 - protein, 16 aa, Mycobacterium tuberculosis
AHCPVVIIHDEDSVMP

SEQ ID NO: 120404 - protein, 16 aa, Mycobacterium tuberculosis
HCPVVIIHDEDSVMPH

SEQ ID NO: 120405 - protein, 16 aa, Mycobacterium tuberculosis
CPVVIIHDEDSVMPHP

SEQ ID NO: 120406 - protein, 16 aa, Mycobacterium tuberculosis
PVVIIHDEDSVMPHPQ

SEQ ID NO: 120407 - protein, 16 aa, Mycobacterium tuberculosis
VVIIHDEDSVMPHPQQ

SEQ ID NO: 120408 - protein, 16 aa, Mycobacterium tuberculosis
VIIHDEDSVMPHPQQA

SEQ ID NO: 120409 - protein, 16 aa, Mycobacterium tuberculosis
IIHDEDSVMPHPQQAP

SEQ ID NO: 120410 - protein, 16 aa, Mycobacterium tuberculosis
IHDEDSVMPHPQQAPV

SEQ ID NO: 120411 - protein, 16 aa, Mycobacterium tuberculosis
HDEDSVMPHPQQAPVL

SEQ ID NO: 120412 - protein, 16 aa, Mycobacterium tuberculosis
DEDSVMPHPQQAPVLV

SEQ ID NO: 120413 - protein, 16 aa, Mycobacterium tuberculosis
EDSVMPHPQQAPVLVG

SEQ ID NO: 120414 - protein, 16 aa, Mycobacterium tuberculosis
DSVMPHPQQAPVLVGV

SEQ ID NO: 120415 - protein, 16 aa, Mycobacterium tuberculosis
SVMPHPQQAPVLVGVD

SEQ ID NO: 120416 - protein, 16 aa, Mycobacterium tuberculosis
VMPHPQQAPVLVGVDG

SEQ ID NO: 120417 - protein, 16 aa, Mycobacterium tuberculosis
MPHPQQAPVLVGVDGS

SEQ ID NO: 120418 - protein, 16 aa, Mycobacterium tuberculosis
PHPQQAPVLVGVDGSS

SEQ ID NO: 120419 - protein, 16 aa, Mycobacterium tuberculosis
HPQQAPVLVGVDGSSA

SEQ ID NO: 120420 - protein, 16 aa, Mycobacterium tuberculosis
PQQAPVLVGVDGSSAS

SEQ ID NO: 120421 - protein, 16 aa, Mycobacterium tuberculosis
QQAPVLVGVDGSSASE

SEQ ID NO: 120422 - protein, 16 aa, Mycobacterium tuberculosis
QAPVLVGVDGSSASEL

SEQ ID NO: 120423 - protein, 16 aa, Mycobacterium tuberculosis
APVLVGVDGSSASELA

SEQ ID NO: 120424 - protein, 16 aa, Mycobacterium tuberculosis
PVLVGVDGSSASELAT

SEQ ID NO: 120425 - protein, 16 aa, Mycobacterium tuberculosis
VLVGVDGSSASELATA

SEQ ID NO: 120426 - protein, 16 aa, Mycobacterium tuberculosis
LVGVDGSSASELATAI

SEQ ID NO: 120427 - protein, 16 aa, Mycobacterium tuberculosis
VGVDGSSASELATAIA

SEQ ID NO: 120428 - protein, 16 aa, Mycobacterium tuberculosis
GVDGSSASELATAIAF

SEQ ID NO: 120429 - protein, 16 aa, Mycobacterium tuberculosis
VDGSSASELATAIAFD

SEQ ID NO: 120430 - protein, 16 aa, Mycobacterium tuberculosis
DGSSASELATAIAFDE

SEQ ID NO: 120431 - protein, 16 aa, Mycobacterium tuberculosis
GSSASELATAIAFDEA

SEQ ID NO: 120432 - protein, 16 aa, Mycobacterium tuberculosis
SSASELATAIAFDEAS

SEQ ID NO: 120433 - protein, 16 aa, Mycobacterium tuberculosis
SASELATAIAFDEASR

SEQ ID NO: 120434 - protein, 16 aa, Mycobacterium tuberculosis
ASELATAIAFDEASRR

SEQ ID NO: 120435 - protein, 16 aa, Mycobacterium tuberculosis
SELATAIAFDEASRRN

SEQ ID NO: 120436 - protein, 16 aa, Mycobacterium tuberculosis
ELATAIAFDEASRRNV

SEQ ID NO: 120437 - protein, 16 aa, Mycobacterium tuberculosis
LATAIAFDEASRRNVD

SEQ ID NO: 120438 - protein, 16 aa, Mycobacterium tuberculosis
ATAIAFDEASRRNVDL

SEQ ID NO: 120439 - protein, 16 aa, Mycobacterium tuberculosis
TAIAFDEASRRNVDLV

SEQ ID NO: 120440 - protein, 16 aa, Mycobacterium tuberculosis
AIAFDEASRRNVDLVA

SEQ ID NO: 120441 - protein, 16 aa, Mycobacterium tuberculosis
IAFDEASRRNVDLVAL

SEQ ID NO: 120442 - protein, 16 aa, Mycobacterium tuberculosis
AFDEASRRNVDLVALH

SEQ ID NO: 120443 - protein, 16 aa, Mycobacterium tuberculosis
FDEASRRNVDLVALHA

SEQ ID NO: 120444 - protein, 16 aa, Mycobacterium tuberculosis
DEASRRNVDLVALHAW

SEQ ID NO: 120445 - protein, 16 aa, Mycobacterium tuberculosis
EASRRNVDLVALHAWS

SEQ ID NO: 120446 - protein, 16 aa, Mycobacterium tuberculosis
ASRRNVDLVALHAWSD

SEQ ID NO: 120447 - protein, 16 aa, Mycobacterium tuberculosis
SRRNVDLVALHAWSDV

SEQ ID NO: 120448 - protein, 16 aa, Mycobacterium tuberculosis
RRNVDLVALHAWSDVD

SEQ ID NO: 120449 - protein, 16 aa, Mycobacterium tuberculosis
RNVDLVALHAWSDVDV

SEQ ID NO: 120450 - protein, 16 aa, Mycobacterium tuberculosis
NVDLVALHAWSDVDVS

SEQ ID NO: 120451 - protein, 16 aa, Mycobacterium tuberculosis
VDLVALHAWSDVDVSE

SEQ ID NO: 120452 - protein, 16 aa, Mycobacterium tuberculosis
DLVALHAWSDVDVSEW

SEQ ID NO: 120453 - protein, 16 aa, Mycobacterium tuberculosis
LVALHAWSDVDVSEWP

SEQ ID NO: 120454 - protein, 16 aa, Mycobacterium tuberculosis
VALHAWSDVDVSEWPG

SEQ ID NO: 120455 - protein, 16 aa, Mycobacterium tuberculosis
ALHAWSDVDVSEWPGI

SEQ ID NO: 120456 - protein, 16 aa, Mycobacterium tuberculosis
LHAWSDVDVSEWPGID

SEQ ID NO: 120457 - protein, 16 aa, Mycobacterium tuberculosis
HAWSDVDVSEWPGIDW

SEQ ID NO: 120458 - protein, 16 aa, Mycobacterium tuberculosis
AWSDVDVSEWPGIDWP

SEQ ID NO: 120459 - protein, 16 aa, Mycobacterium tuberculosis
WSDVDVSEWPGIDWPA

SEQ ID NO: 120460 - protein, 16 aa, Mycobacterium tuberculosis
SDVDVSEWPGIDWPAT

SEQ ID NO: 120461 - protein, 16 aa, Mycobacterium tuberculosis
DVDVSEWPGIDWPATQ

SEQ ID NO: 120462 - protein, 16 aa, Mycobacterium tuberculosis
VDVSEWPGIDWPATQS

SEQ ID NO: 120463 - protein, 16 aa, Mycobacterium tuberculosis
DVSEWPGIDWPATQSM

SEQ ID NO: 120464 - protein, 16 aa, Mycobacterium tuberculosis
VSEWPGIDWPATQSMA

SEQ ID NO: 120465 - protein, 16 aa, Mycobacterium tuberculosis
SEWPGIDWPATQSMAE

SEQ ID NO: 120466 - protein, 16 aa, Mycobacterium tuberculosis
EWPGIDWPATQSMAEQ

SEQ ID NO: 120467 - protein, 16 aa, Mycobacterium tuberculosis
WPGIDWPATQSMAEQV

SEQ ID NO: 120468 - protein, 16 aa, Mycobacterium tuberculosis
PGIDWPATQSMAEQVL

SEQ ID NO: 120469 - protein, 16 aa, Mycobacterium tuberculosis
GIDWPATQSMAEQVLA

SEQ ID NO: 120470 - protein, 16 aa, Mycobacterium tuberculosis
IDWPATQSMAEQVLAE

SEQ ID NO: 120471 - protein, 16 aa, Mycobacterium tuberculosis
DWPATQSMAEQVLAER

SEQ ID NO: 120472 - protein, 16 aa, Mycobacterium tuberculosis
WPATQSMAEQVLAERL

SEQ ID NO: 120473 - protein, 16 aa, Mycobacterium tuberculosis
PATQSMAEQVLAERLA

SEQ ID NO: 120474 - protein, 16 aa, Mycobacterium tuberculosis
ATQSMAEQVLAERLAG

SEQ ID NO: 120475 - protein, 16 aa, Mycobacterium tuberculosis
TQSMAEQVLAERLAGW

SEQ ID NO: 120476 - protein, 16 aa, Mycobacterium tuberculosis
QSMAEQVLAERLAGWQ

SEQ ID NO: 120477 - protein, 16 aa, Mycobacterium tuberculosis
SMAEQVLAERLAGWQE

SEQ ID NO: 120478 - protein, 16 aa, Mycobacterium tuberculosis
MAEQVLAERLAGWQER

SEQ ID NO: 120479 - protein, 16 aa, Mycobacterium tuberculosis
AEQVLAERLAGWQERY

SEQ ID NO: 120480 - protein, 16 aa, Mycobacterium tuberculosis
EQVLAERLAGWQERYP

SEQ ID NO: 120481 - protein, 16 aa, Mycobacterium tuberculosis
QVLAERLAGWQERYPN

SEQ ID NO: 120482 - protein, 16 aa, Mycobacterium tuberculosis
VLAERLAGWQERYPNV

SEQ ID NO: 120483 - protein, 16 aa, Mycobacterium tuberculosis
LAERLAGWQERYPNVA

SEQ ID NO: 120484 - protein, 16 aa, Mycobacterium tuberculosis
AERLAGWQERYPNVAI

SEQ ID NO: 120485 - protein, 16 aa, Mycobacterium tuberculosis
ERLAGWQERYPNVAIT

SEQ ID NO: 120486 - protein, 16 aa, Mycobacterium tuberculosis
RLAGWQERYPNVAITR

SEQ ID NO: 120487 - protein, 16 aa, Mycobacterium tuberculosis
LAGWQERYPNVAITRV

SEQ ID NO: 120488 - protein, 16 aa, Mycobacterium tuberculosis
AGWQERYPNVAITRVV

SEQ ID NO: 120489 - protein, 16 aa, Mycobacterium tuberculosis
GWQERYPNVAITRVVV

SEQ ID NO: 120490 - protein, 16 aa, Mycobacterium tuberculosis
WQERYPNVAITRVVVR

SEQ ID NO: 120491 - protein, 16 aa, Mycobacterium tuberculosis
QERYPNVAITRVVVRD

SEQ ID NO: 120492 - protein, 16 aa, Mycobacterium tuberculosis
ERYPNVAITRVVVRDQ

SEQ ID NO: 120493 - protein, 16 aa, Mycobacterium tuberculosis
RYPNVAITRVVVRDQP

SEQ ID NO: 120494 - protein, 16 aa, Mycobacterium tuberculosis
YPNVAITRVVVRDQPA

SEQ ID NO: 120495 - protein, 16 aa, Mycobacterium tuberculosis
PNVAITRVVVRDQPAR

SEQ ID NO: 120496 - protein, 16 aa, Mycobacterium tuberculosis
NVAITRVVVRDQPARQ

SEQ ID NO: 120497 - protein, 16 aa, Mycobacterium tuberculosis
VAITRVVVRDQPARQL

SEQ ID NO: 120498 - protein, 16 aa, Mycobacterium tuberculosis
AITRVVVRDQPARQLV

SEQ ID NO: 120499 - protein, 16 aa, Mycobacterium tuberculosis
ITRVVVRDQPARQLVQ

SEQ ID NO: 120500 - protein, 16 aa, Mycobacterium tuberculosis
TRVVVRDQPARQLVQR

SEQ ID NO: 120501 - protein, 16 aa, Mycobacterium tuberculosis
RVVVRDQPARQLVQRS

SEQ ID NO: 120502 - protein, 16 aa, Mycobacterium tuberculosis
VVVRDQPARQLVQRSE

SEQ ID NO: 120503 - protein, 16 aa, Mycobacterium tuberculosis
VVRDQPARQLVQRSEE

SEQ ID NO: 120504 - protein, 16 aa, Mycobacterium tuberculosis
VRDQPARQLVQRSEEA

SEQ ID NO: 120505 - protein, 16 aa, Mycobacterium tuberculosis
RDQPARQLVQRSEEAQ

SEQ ID NO: 120506 - protein, 16 aa, Mycobacterium tuberculosis
DQPARQLVQRSEEAQL

SEQ ID NO: 120507 - protein, 16 aa, Mycobacterium tuberculosis
QPARQLVQRSEEAQLV

SEQ ID NO: 120508 - protein, 16 aa, Mycobacterium tuberculosis
PARQLVQRSEEAQLVV

SEQ ID NO: 120509 - protein, 16 aa, Mycobacterium tuberculosis
ARQLVQRSEEAQLVVV

SEQ ID NO: 120510 - protein, 16 aa, Mycobacterium tuberculosis
RQLVQRSEEAQLVVVG

SEQ ID NO: 120511 - protein, 16 aa, Mycobacterium tuberculosis
QLVQRSEEAQLVVVGS

SEQ ID NO: 120512 - protein, 16 aa, Mycobacterium tuberculosis
LVQRSEEAQLVVVGSR

SEQ ID NO: 120513 - protein, 16 aa, Mycobacterium tuberculosis
VQRSEEAQLVVVGSRG

SEQ ID NO: 120514 - protein, 16 aa, Mycobacterium tuberculosis
QRSEEAQLVVVGSRGR

SEQ ID NO: 120515 - protein, 16 aa, Mycobacterium tuberculosis
RSEEAQLVVVGSRGRG

SEQ ID NO: 120516 - protein, 16 aa, Mycobacterium tuberculosis
SEEAQLVVVGSRGRGG

SEQ ID NO: 120517 - protein, 16 aa, Mycobacterium tuberculosis
EEAQLVVVGSRGRGGY

SEQ ID NO: 120518 - protein, 16 aa, Mycobacterium tuberculosis
EAQLVVVGSRGRGGYA

SEQ ID NO: 120519 - protein, 16 aa, Mycobacterium tuberculosis
AQLVVVGSRGRGGYAG

SEQ ID NO: 120520 - protein, 16 aa, Mycobacterium tuberculosis
QLVVVGSRGRGGYAGM

SEQ ID NO: 120521 - protein, 16 aa, Mycobacterium tuberculosis
LVVVGSRGRGGYAGML

SEQ ID NO: 120522 - protein, 16 aa, Mycobacterium tuberculosis
VVVGSRGRGGYAGMLV

SEQ ID NO: 120523 - protein, 16 aa, Mycobacterium tuberculosis
VVGSRGRGGYAGMLVG

SEQ ID NO: 120524 - protein, 16 aa, Mycobacterium tuberculosis
VGSRGRGGYAGMLVGS

SEQ ID NO: 120525 - protein, 16 aa, Mycobacterium tuberculosis
GSRGRGGYAGMLVGSV

SEQ ID NO: 120526 - protein, 16 aa, Mycobacterium tuberculosis
SRGRGGYAGMLVGSVG

SEQ ID NO: 120527 - protein, 16 aa, Mycobacterium tuberculosis
RGRGGYAGMLVGSVGE

SEQ ID NO: 120528 - protein, 16 aa, Mycobacterium tuberculosis
GRGGYAGMLVGSVGET

SEQ ID NO: 120529 - protein, 16 aa, Mycobacterium tuberculosis
RGGYAGMLVGSVGETV

SEQ ID NO: 120530 - protein, 16 aa, Mycobacterium tuberculosis
GGYAGMLVGSVGETVA

SEQ ID NO: 120531 - protein, 16 aa, Mycobacterium tuberculosis
GYAGMLVGSVGETVAQ

SEQ ID NO: 120532 - protein, 16 aa, Mycobacterium tuberculosis
YAGMLVGSVGETVAQL

SEQ ID NO: 120533 - protein, 16 aa, Mycobacterium tuberculosis
AGMLVGSVGETVAQLA

SEQ ID NO: 120534 - protein, 16 aa, Mycobacterium tuberculosis
GMLVGSVGETVAQLAR

SEQ ID NO: 120535 - protein, 16 aa, Mycobacterium tuberculosis
MLVGSVGETVAQLART

SEQ ID NO: 120536 - protein, 16 aa, Mycobacterium tuberculosis
LVGSVGETVAQLARTP

SEQ ID NO: 120537 - protein, 16 aa, Mycobacterium tuberculosis
VGSVGETVAQLARTPV

SEQ ID NO: 120538 - protein, 16 aa, Mycobacterium tuberculosis
GSVGETVAQLARTPVI

SEQ ID NO: 120539 - protein, 16 aa, Mycobacterium tuberculosis
SVGETVAQLARTPVIV

SEQ ID NO: 120540 - protein, 16 aa, Mycobacterium tuberculosis
VGETVAQLARTPVIVA

SEQ ID NO: 120541 - protein, 16 aa, Mycobacterium tuberculosis
GETVAQLARTPVIVAR

SEQ ID NO: 120542 - protein, 16 aa, Mycobacterium tuberculosis
ETVAQLARTPVIVARE

SEQ ID NO: 120543 - protein, 16 aa, Mycobacterium tuberculosis
TVAQLARTPVIVARES

SEQ ID NO: 120544 - protein, 16 aa, Mycobacterium tuberculosis
VAQLARTPVIVARESL

SEQ ID NO: 120545 - protein, 16 aa, Mycobacterium tuberculosis
AQLARTPVIVARESLT

SEQ ID NO: 120546 - protein, 362 aa, Mycobacterium tuberculosis
MLRLVVGALLLVLAFAGGYAVAACKTVTLTVDGTAMRVTTMKSRVIDIVEENGFSVDDRDDLYPAAGVQVHDADTIVLRRSRPLQISLDGHDAKQVWTTASTVDEALAQLAMTDTAPAAASRASRVPLSGMALPVVSAKTVQLNDGGLVRTVHLPAPNVAGLLSAAGVPLLQSDHVVPAATAPIVEGMQIQVTRNRIKKVTERLPLPPNARRVEDPEMNMSREVVEDPGVPGTQDVTFAVAEVNGVETGRLPVANVVVTPAHEAVVRVGTKPGTEVPPVIDGSIWDAIAGCEAGGNWAINTGNGYYGGVQFDQGTWEANGGLRYAPRADLATREEQIAVAEVTRLRQGWGAWPVCAARAGAR

SEQ ID NO: 120547 - protein, 8 aa, Mycobacterium tuberculosis
MLRLVVGA

SEQ ID NO: 120548 - protein, 8 aa, Mycobacterium tuberculosis
RLVVGALL

SEQ ID NO: 120549 - protein, 8 aa, Mycobacterium tuberculosis
LVVGALLL

SEQ ID NO: 120550 - protein, 8 aa, Mycobacterium tuberculosis
VVGALLLV

SEQ ID NO: 120551 - protein, 8 aa, Mycobacterium tuberculosis
ALLLVLAF

SEQ ID NO: 120552 - protein, 8 aa, Mycobacterium tuberculosis
LLLVLAFA

SEQ ID NO: 120553 - protein, 8 aa, Mycobacterium tuberculosis
VLAFAGGY

SEQ ID NO: 120554 - protein, 8 aa, Mycobacterium tuberculosis
LAFAGGYA

SEQ ID NO: 120555 - protein, 8 aa, Mycobacterium tuberculosis
AFAGGYAV

SEQ ID NO: 120556 - protein, 8 aa, Mycobacterium tuberculosis
FAGGYAVA

SEQ ID NO: 120557 - protein, 8 aa, Mycobacterium tuberculosis
GYAVAACK

SEQ ID NO: 120558 - protein, 8 aa, Mycobacterium tuberculosis
AVAACKTV

SEQ ID NO: 120559 - protein, 8 aa, Mycobacterium tuberculosis
TLTVDGTA

SEQ ID NO: 120560 - protein, 8 aa, Mycobacterium tuberculosis
LTVDGTAM

SEQ ID NO: 120561 - protein, 8 aa, Mycobacterium tuberculosis
TVDGTAMR

SEQ ID NO: 120562 - protein, 8 aa, Mycobacterium tuberculosis
TAMRVTTM

SEQ ID NO: 120563 - protein, 8 aa, Mycobacterium tuberculosis
AMRVTTMK

SEQ ID NO: 120564 - protein, 8 aa, Mycobacterium tuberculosis
RVTTMKSR

SEQ ID NO: 120565 - protein, 8 aa, Mycobacterium tuberculosis
TTMKSRVI

SEQ ID NO: 120566 - protein, 8 aa, Mycobacterium tuberculosis
DIVEENGF

SEQ ID NO: 120567 - protein, 8 aa, Mycobacterium tuberculosis
VEENGFSV

SEQ ID NO: 120568 - protein, 8 aa, Mycobacterium tuberculosis
NGFSVDDR

SEQ ID NO: 120569 - protein, 8 aa, Mycobacterium tuberculosis
SVDDRDDL

SEQ ID NO: 120570 - protein, 8 aa, Mycobacterium tuberculosis
DLYPAAGV

SEQ ID NO: 120571 - protein, 8 aa, Mycobacterium tuberculosis
YPAAGVQV

SEQ ID NO: 120572 - protein, 8 aa, Mycobacterium tuberculosis
HDADTIVL

SEQ ID NO: 120573 - protein, 8 aa, Mycobacterium tuberculosis
DADTIVLR

SEQ ID NO: 120574 - protein, 8 aa, Mycobacterium tuberculosis
TIVLRRSR

SEQ ID NO: 120575 - protein, 8 aa, Mycobacterium tuberculosis
VLRRSRPL

SEQ ID NO: 120576 - protein, 8 aa, Mycobacterium tuberculosis
RSRPLQIS

SEQ ID NO: 120577 - protein, 8 aa, Mycobacterium tuberculosis
SLDGHDAK

SEQ ID NO: 120578 - protein, 8 aa, Mycobacterium tuberculosis
KQVWTTAS

SEQ ID NO: 120579 - protein, 8 aa, Mycobacterium tuberculosis
TASTVDEA

SEQ ID NO: 120580 - protein, 8 aa, Mycobacterium tuberculosis
EALAQLAM

SEQ ID NO: 120581 - protein, 8 aa, Mycobacterium tuberculosis
ALAQLAMT

SEQ ID NO: 120582 - protein, 8 aa, Mycobacterium tuberculosis
AQLAMTDT

SEQ ID NO: 120583 - protein, 8 aa, Mycobacterium tuberculosis
QLAMTDTA

SEQ ID NO: 120584 - protein, 8 aa, Mycobacterium tuberculosis
AMTDTAPA

SEQ ID NO: 120585 - protein, 8 aa, Mycobacterium tuberculosis
MTDTAPAA

SEQ ID NO: 120586 - protein, 8 aa, Mycobacterium tuberculosis
DTAPAAAS

SEQ ID NO: 120587 - protein, 8 aa, Mycobacterium tuberculosis
TAPAAASR

SEQ ID NO: 120588 - protein, 8 aa, Mycobacterium tuberculosis
APAAASRA

SEQ ID NO: 120589 - protein, 8 aa, Mycobacterium tuberculosis
AAASRASR

SEQ ID NO: 120590 - protein, 8 aa, Mycobacterium tuberculosis
AASRASRV

SEQ ID NO: 120591 - protein, 8 aa, Mycobacterium tuberculosis
SRASRVPL

SEQ ID NO: 120592 - protein, 8 aa, Mycobacterium tuberculosis
VPLSGMAL

SEQ ID NO: 120593 - protein, 8 aa, Mycobacterium tuberculosis
SGMALPVV

SEQ ID NO: 120594 - protein, 8 aa, Mycobacterium tuberculosis
MALPVVSA

SEQ ID NO: 120595 - protein, 8 aa, Mycobacterium tuberculosis
ALPVVSAK

SEQ ID NO: 120596 - protein, 8 aa, Mycobacterium tuberculosis
LPVVSAKT

SEQ ID NO: 120597 - protein, 8 aa, Mycobacterium tuberculosis
PVVSAKTV

SEQ ID NO: 120598 - protein, 8 aa, Mycobacterium tuberculosis
VQLNDGGL

SEQ ID NO: 120599 - protein, 8 aa, Mycobacterium tuberculosis
QLNDGGLV

SEQ ID NO: 120600 - protein, 8 aa, Mycobacterium tuberculosis
GLVRTVHL

SEQ ID NO: 120601 - protein, 8 aa, Mycobacterium tuberculosis
HLPAPNVA

SEQ ID NO: 120602 - protein, 8 aa, Mycobacterium tuberculosis
LPAPNVAG

SEQ ID NO: 120603 - protein, 8 aa, Mycobacterium tuberculosis
APNVAGLL

SEQ ID NO: 120604 - protein, 8 aa, Mycobacterium tuberculosis
NVAGLLSA

SEQ ID NO: 120605 - protein, 8 aa, Mycobacterium tuberculosis
GLLSAAGV

SEQ ID NO: 120606 - protein, 8 aa, Mycobacterium tuberculosis
LSAAGVPL

SEQ ID NO: 120607 - protein, 8 aa, Mycobacterium tuberculosis
SAAGVPLL

SEQ ID NO: 120608 - protein, 8 aa, Mycobacterium tuberculosis
PLLQSDHV

SEQ ID NO: 120609 - protein, 8 aa, Mycobacterium tuberculosis
LLQSDHVV

SEQ ID NO: 120610 - protein, 8 aa, Mycobacterium tuberculosis
HVVPAATA

SEQ ID NO: 120611 - protein, 8 aa, Mycobacterium tuberculosis
VPAATAPI

SEQ ID NO: 120612 - protein, 8 aa, Mycobacterium tuberculosis
PIVEGMQI

SEQ ID NO: 120613 - protein, 8 aa, Mycobacterium tuberculosis
GMQIQVTR

SEQ ID NO: 120614 - protein, 8 aa, Mycobacterium tuberculosis
QIQVTRNR

SEQ ID NO: 120615 - protein, 8 aa, Mycobacterium tuberculosis
IQVTRNRI

SEQ ID NO: 120616 - protein, 8 aa, Mycobacterium tuberculosis
QVTRNRIK

SEQ ID NO: 120617 - protein, 8 aa, Mycobacterium tuberculosis
VTRNRIKK

SEQ ID NO: 120618 - protein, 8 aa, Mycobacterium tuberculosis
RIKKVTER

SEQ ID NO: 120619 - protein, 8 aa, Mycobacterium tuberculosis
KVTERLPL

SEQ ID NO: 120620 - protein, 8 aa, Mycobacterium tuberculosis
RLPLPPNA

SEQ ID NO: 120621 - protein, 8 aa, Mycobacterium tuberculosis
LPLPPNAR

SEQ ID NO: 120622 - protein, 8 aa, Mycobacterium tuberculosis
LPPNARRV

SEQ ID NO: 120623 - protein, 8 aa, Mycobacterium tuberculosis
RRVEDPEM

SEQ ID NO: 120624 - protein, 8 aa, Mycobacterium tuberculosis
DPEMNMSR

SEQ ID NO: 120625 - protein, 8 aa, Mycobacterium tuberculosis
EMNMSREV

SEQ ID NO: 120626 - protein, 8 aa, Mycobacterium tuberculosis
MNMSREVV

SEQ ID NO: 120627 - protein, 8 aa, Mycobacterium tuberculosis
EVVEDPGV

SEQ ID NO: 120628 - protein, 8 aa, Mycobacterium tuberculosis
GVPGTQDV

SEQ ID NO: 120629 - protein, 8 aa, Mycobacterium tuberculosis
TQDVTFAV

SEQ ID NO: 120630 - protein, 8 aa, Mycobacterium tuberculosis
VTFAVAEV

SEQ ID NO: 120631 - protein, 8 aa, Mycobacterium tuberculosis
AVAEVNGV

SEQ ID NO: 120632 - protein, 8 aa, Mycobacterium tuberculosis
AEVNGVET

SEQ ID NO: 120633 - protein, 8 aa, Mycobacterium tuberculosis
ETGRLPVA

SEQ ID NO: 120634 - protein, 8 aa, Mycobacterium tuberculosis
RLPVANVV

SEQ ID NO: 120635 - protein, 8 aa, Mycobacterium tuberculosis
LPVANVVV

SEQ ID NO: 120636 - protein, 8 aa, Mycobacterium tuberculosis
VVTPAHEA

SEQ ID NO: 120637 - protein, 8 aa, Mycobacterium tuberculosis
VTPAHEAV

SEQ ID NO: 120638 - protein, 8 aa, Mycobacterium tuberculosis
TPAHEAVV

SEQ ID NO: 120639 - protein, 8 aa, Mycobacterium tuberculosis
AVVRVGTK

SEQ ID NO: 120640 - protein, 8 aa, Mycobacterium tuberculosis
GTKPGTEV

SEQ ID NO: 120641 - protein, 8 aa, Mycobacterium tuberculosis
PPVIDGSI

SEQ ID NO: 120642 - protein, 8 aa, Mycobacterium tuberculosis
SIWDAIAG

SEQ ID NO: 120643 - protein, 8 aa, Mycobacterium tuberculosis
EAGGNWAI

SEQ ID NO: 120644 - protein, 8 aa, Mycobacterium tuberculosis
AINTGNGY

SEQ ID NO: 120645 - protein, 8 aa, Mycobacterium tuberculosis
GYYGGVQF

SEQ ID NO: 120646 - protein, 8 aa, Mycobacterium tuberculosis
VQFDQGTW

SEQ ID NO: 120647 - protein, 8 aa, Mycobacterium tuberculosis
EANGGLRY

SEQ ID NO: 120648 - protein, 8 aa, Mycobacterium tuberculosis
GGLRYAPR

SEQ ID NO: 120649 - protein, 8 aa, Mycobacterium tuberculosis
GLRYAPRA

SEQ ID NO: 120650 - protein, 8 aa, Mycobacterium tuberculosis
RYAPRADL

SEQ ID NO: 120651 - protein, 8 aa, Mycobacterium tuberculosis
APRADLAT

SEQ ID NO: 120652 - protein, 8 aa, Mycobacterium tuberculosis
EQIAVAEV

SEQ ID NO: 120653 - protein, 8 aa, Mycobacterium tuberculosis
IAVAEVTR

SEQ ID NO: 120654 - protein, 8 aa, Mycobacterium tuberculosis
AVAEVTRL

SEQ ID NO: 120655 - protein, 8 aa, Mycobacterium tuberculosis
VAEVTRLR

SEQ ID NO: 120656 - protein, 8 aa, Mycobacterium tuberculosis
AEVTRLRQ

SEQ ID NO: 120657 - protein, 8 aa, Mycobacterium tuberculosis
VTRLRQGW

SEQ ID NO: 120658 - protein, 8 aa, Mycobacterium tuberculosis
RLRQGWGA

SEQ ID NO: 120659 - protein, 8 aa, Mycobacterium tuberculosis
QGWGAWPV

SEQ ID NO: 120660 - protein, 8 aa, Mycobacterium tuberculosis
WGAWPVCA

SEQ ID NO: 120661 - protein, 8 aa, Mycobacterium tuberculosis
GAWPVCAA

SEQ ID NO: 120662 - protein, 8 aa, Mycobacterium tuberculosis
WPVCAARA

SEQ ID NO: 120663 - protein, 8 aa, Mycobacterium tuberculosis
CAARAGAR

SEQ ID NO: 120664 - protein, 9 aa, Mycobacterium tuberculosis
MLRLVVGAL

SEQ ID NO: 120665 - protein, 9 aa, Mycobacterium tuberculosis
RLVVGALLL

SEQ ID NO: 120666 - protein, 9 aa, Mycobacterium tuberculosis
LVVGALLLV

SEQ ID NO: 120667 - protein, 9 aa, Mycobacterium tuberculosis
VVGALLLVL

SEQ ID NO: 120668 - protein, 9 aa, Mycobacterium tuberculosis
GALLLVLAF

SEQ ID NO: 120669 - protein, 9 aa, Mycobacterium tuberculosis
ALLLVLAFA

SEQ ID NO: 120670 - protein, 9 aa, Mycobacterium tuberculosis
LVLAFAGGY

SEQ ID NO: 120671 - protein, 9 aa, Mycobacterium tuberculosis
VLAFAGGYA

SEQ ID NO: 120672 - protein, 9 aa, Mycobacterium tuberculosis
LAFAGGYAV

SEQ ID NO: 120673 - protein, 9 aa, Mycobacterium tuberculosis
FAGGYAVAA

SEQ ID NO: 120674 - protein, 9 aa, Mycobacterium tuberculosis
GGYAVAACK

SEQ ID NO: 120675 - protein, 9 aa, Mycobacterium tuberculosis
YAVAACKTV

SEQ ID NO: 120676 - protein, 9 aa, Mycobacterium tuberculosis
VAACKTVTL

SEQ ID NO: 120677 - protein, 9 aa, Mycobacterium tuberculosis
TLTVDGTAM

SEQ ID NO: 120678 - protein, 9 aa, Mycobacterium tuberculosis
LTVDGTAMR

SEQ ID NO: 120679 - protein, 9 aa, Mycobacterium tuberculosis
TVDGTAMRV

SEQ ID NO: 120680 - protein, 9 aa, Mycobacterium tuberculosis
GTAMRVTTM

SEQ ID NO: 120681 - protein, 9 aa, Mycobacterium tuberculosis
TAMRVTTMK

SEQ ID NO: 120682 - protein, 9 aa, Mycobacterium tuberculosis
AMRVTTMKS

SEQ ID NO: 120683 - protein, 9 aa, Mycobacterium tuberculosis
RVTTMKSRV

SEQ ID NO: 120684 - protein, 9 aa, Mycobacterium tuberculosis
TMKSRVIDI

SEQ ID NO: 120685 - protein, 9 aa, Mycobacterium tuberculosis
MKSRVIDIV

SEQ ID NO: 120686 - protein, 9 aa, Mycobacterium tuberculosis
IVEENGFSV

SEQ ID NO: 120687 - protein, 9 aa, Mycobacterium tuberculosis
SVDDRDDLY

SEQ ID NO: 120688 - protein, 9 aa, Mycobacterium tuberculosis
LYPAAGVQV

SEQ ID NO: 120689 - protein, 9 aa, Mycobacterium tuberculosis
YPAAGVQVH

SEQ ID NO: 120690 - protein, 9 aa, Mycobacterium tuberculosis
VQVHDADTI

SEQ ID NO: 120691 - protein, 9 aa, Mycobacterium tuberculosis
QVHDADTIV

SEQ ID NO: 120692 - protein, 9 aa, Mycobacterium tuberculosis
VHDADTIVL

SEQ ID NO: 120693 - protein, 9 aa, Mycobacterium tuberculosis
HDADTIVLR

SEQ ID NO: 120694 - protein, 9 aa, Mycobacterium tuberculosis
DADTIVLRR

SEQ ID NO: 120695 - protein, 9 aa, Mycobacterium tuberculosis
DTIVLRRSR

SEQ ID NO: 120696 - protein, 9 aa, Mycobacterium tuberculosis
IVLRRSRPL

SEQ ID NO: 120697 - protein, 9 aa, Mycobacterium tuberculosis
VLRRSRPLQ

SEQ ID NO: 120698 - protein, 9 aa, Mycobacterium tuberculosis
RSRPLQISL

SEQ ID NO: 120699 - protein, 9 aa, Mycobacterium tuberculosis
ISLDGHDAK

SEQ ID NO: 120700 - protein, 9 aa, Mycobacterium tuberculosis
SLDGHDAKQ

SEQ ID NO: 120701 - protein, 9 aa, Mycobacterium tuberculosis
KQVWTTAST

SEQ ID NO: 120702 - protein, 9 aa, Mycobacterium tuberculosis
QVWTTASTV

SEQ ID NO: 120703 - protein, 9 aa, Mycobacterium tuberculosis
TTASTVDEA

SEQ ID NO: 120704 - protein, 9 aa, Mycobacterium tuberculosis
TASTVDEAL

SEQ ID NO: 120705 - protein, 9 aa, Mycobacterium tuberculosis
TVDEALAQL

SEQ ID NO: 120706 - protein, 9 aa, Mycobacterium tuberculosis
DEALAQLAM

SEQ ID NO: 120707 - protein, 9 aa, Mycobacterium tuberculosis
EALAQLAMT

SEQ ID NO: 120708 - protein, 9 aa, Mycobacterium tuberculosis
AQLAMTDTA

SEQ ID NO: 120709 - protein, 9 aa, Mycobacterium tuberculosis
LAMTDTAPA

SEQ ID NO: 120710 - protein, 9 aa, Mycobacterium tuberculosis
AMTDTAPAA

SEQ ID NO: 120711 - protein, 9 aa, Mycobacterium tuberculosis
MTDTAPAAA

SEQ ID NO: 120712 - protein, 9 aa, Mycobacterium tuberculosis
DTAPAAASR

SEQ ID NO: 120713 - protein, 9 aa, Mycobacterium tuberculosis
TAPAAASRA

SEQ ID NO: 120714 - protein, 9 aa, Mycobacterium tuberculosis
APAAASRAS

SEQ ID NO: 120715 - protein, 9 aa, Mycobacterium tuberculosis
PAAASRASR

SEQ ID NO: 120716 - protein, 9 aa, Mycobacterium tuberculosis
AAASRASRV

SEQ ID NO: 120717 - protein, 9 aa, Mycobacterium tuberculosis
ASRASRVPL

SEQ ID NO: 120718 - protein, 9 aa, Mycobacterium tuberculosis
RVPLSGMAL

SEQ ID NO: 120719 - protein, 9 aa, Mycobacterium tuberculosis
PLSGMALPV

SEQ ID NO: 120720 - protein, 9 aa, Mycobacterium tuberculosis
GMALPVVSA

SEQ ID NO: 120721 - protein, 9 aa, Mycobacterium tuberculosis
MALPVVSAK

SEQ ID NO: 120722 - protein, 9 aa, Mycobacterium tuberculosis
ALPVVSAKT

SEQ ID NO: 120723 - protein, 9 aa, Mycobacterium tuberculosis
LPVVSAKTV

SEQ ID NO: 120724 - protein, 9 aa, Mycobacterium tuberculosis
VVSAKTVQL

SEQ ID NO: 120725 - protein, 9 aa, Mycobacterium tuberculosis
TVQLNDGGL

SEQ ID NO: 120726 - protein, 9 aa, Mycobacterium tuberculosis
VQLNDGGLV

SEQ ID NO: 120727 - protein, 9 aa, Mycobacterium tuberculosis
QLNDGGLVR

SEQ ID NO: 120728 - protein, 9 aa, Mycobacterium tuberculosis
LVRTVHLPA

SEQ ID NO: 120729 - protein, 9 aa, Mycobacterium tuberculosis
TVHLPAPNV

SEQ ID NO: 120730 - protein, 9 aa, Mycobacterium tuberculosis
LPAPNVAGL

SEQ ID NO: 120731 - protein, 9 aa, Mycobacterium tuberculosis
NVAGLLSAA

SEQ ID NO: 120732 - protein, 9 aa, Mycobacterium tuberculosis
LLSAAGVPL

SEQ ID NO: 120733 - protein, 9 aa, Mycobacterium tuberculosis
VPLLQSDHV

SEQ ID NO: 120734 - protein, 9 aa, Mycobacterium tuberculosis
PLLQSDHVV

SEQ ID NO: 120735 - protein, 9 aa, Mycobacterium tuberculosis
LQSDHVVPA

SEQ ID NO: 120736 - protein, 9 aa, Mycobacterium tuberculosis
VVPAATAPI

SEQ ID NO: 120737 - protein, 9 aa, Mycobacterium tuberculosis
VPAATAPIV

SEQ ID NO: 120738 - protein, 9 aa, Mycobacterium tuberculosis
ATAPIVEGM

SEQ ID NO: 120739 - protein, 9 aa, Mycobacterium tuberculosis
APIVEGMQI

SEQ ID NO: 120740 - protein, 9 aa, Mycobacterium tuberculosis
IVEGMQIQV

SEQ ID NO: 120741 - protein, 9 aa, Mycobacterium tuberculosis
EGMQIQVTR

SEQ ID NO: 120742 - protein, 9 aa, Mycobacterium tuberculosis
MQIQVTRNR

SEQ ID NO: 120743 - protein, 9 aa, Mycobacterium tuberculosis
QVTRNRIKK

SEQ ID NO: 120744 - protein, 9 aa, Mycobacterium tuberculosis
VTRNRIKKV

SEQ ID NO: 120745 - protein, 9 aa, Mycobacterium tuberculosis
RIKKVTERL

SEQ ID NO: 120746 - protein, 9 aa, Mycobacterium tuberculosis
RLPLPPNAR

SEQ ID NO: 120747 - protein, 9 aa, Mycobacterium tuberculosis
PLPPNARRV

SEQ ID NO: 120748 - protein, 9 aa, Mycobacterium tuberculosis
RVEDPEMNM

SEQ ID NO: 120749 - protein, 9 aa, Mycobacterium tuberculosis
EMNMSREVV

SEQ ID NO: 120750 - protein, 9 aa, Mycobacterium tuberculosis
REVVEDPGV

SEQ ID NO: 120751 - protein, 9 aa, Mycobacterium tuberculosis
VPGTQDVTF

SEQ ID NO: 120752 - protein, 9 aa, Mycobacterium tuberculosis
GTQDVTFAV

SEQ ID NO: 120753 - protein, 9 aa, Mycobacterium tuberculosis
TQDVTFAVA

SEQ ID NO: 120754 - protein, 9 aa, Mycobacterium tuberculosis
DVTFAVAEV

SEQ ID NO: 120755 - protein, 9 aa, Mycobacterium tuberculosis
FAVAEVNGV

SEQ ID NO: 120756 - protein, 9 aa, Mycobacterium tuberculosis
EVNGVETGR

SEQ ID NO: 120757 - protein, 9 aa, Mycobacterium tuberculosis
GVETGRLPV

SEQ ID NO: 120758 - protein, 9 aa, Mycobacterium tuberculosis
RLPVANVVV

SEQ ID NO: 120759 - protein, 9 aa, Mycobacterium tuberculosis
LPVANVVVT

SEQ ID NO: 120760 - protein, 9 aa, Mycobacterium tuberculosis
VANVVVTPA

SEQ ID NO: 120761 - protein, 9 aa, Mycobacterium tuberculosis
VVTPAHEAV

SEQ ID NO: 120762 - protein, 9 aa, Mycobacterium tuberculosis
VTPAHEAVV

SEQ ID NO: 120763 - protein, 9 aa, Mycobacterium tuberculosis
TPAHEAVVR

SEQ ID NO: 120764 - protein, 9 aa, Mycobacterium tuberculosis
PAHEAVVRV

SEQ ID NO: 120765 - protein, 9 aa, Mycobacterium tuberculosis
EAVVRVGTK

SEQ ID NO: 120766 - protein, 9 aa, Mycobacterium tuberculosis
EVPPVIDGS

SEQ ID NO: 120767 - protein, 9 aa, Mycobacterium tuberculosis
VPPVIDGSI

SEQ ID NO: 120768 - protein, 9 aa, Mycobacterium tuberculosis
PPVIDGSIW

SEQ ID NO: 120769 - protein, 9 aa, Mycobacterium tuberculosis
VIDGSIWDA

SEQ ID NO: 120770 - protein, 9 aa, Mycobacterium tuberculosis
SIWDAIAGC

SEQ ID NO: 120771 - protein, 9 aa, Mycobacterium tuberculosis
CEAGGNWAI

SEQ ID NO: 120772 - protein, 9 aa, Mycobacterium tuberculosis
WAINTGNGY

SEQ ID NO: 120773 - protein, 9 aa, Mycobacterium tuberculosis
AINTGNGYY

SEQ ID NO: 120774 - protein, 9 aa, Mycobacterium tuberculosis
TGNGYYGGV

SEQ ID NO: 120775 - protein, 9 aa, Mycobacterium tuberculosis
VQFDQGTWE

SEQ ID NO: 120776 - protein, 9 aa, Mycobacterium tuberculosis
QFDQGTWEA

SEQ ID NO: 120777 - protein, 9 aa, Mycobacterium tuberculosis
GTWEANGGL

SEQ ID NO: 120778 - protein, 9 aa, Mycobacterium tuberculosis
WEANGGLRY

SEQ ID NO: 120779 - protein, 9 aa, Mycobacterium tuberculosis
LRYAPRADL

SEQ ID NO: 120780 - protein, 9 aa, Mycobacterium tuberculosis
YAPRADLAT

SEQ ID NO: 120781 - protein, 9 aa, Mycobacterium tuberculosis
DLATREEQI

SEQ ID NO: 120782 - protein, 9 aa, Mycobacterium tuberculosis
ATREEQIAV

SEQ ID NO: 120783 - protein, 9 aa, Mycobacterium tuberculosis
EEQIAVAEV

SEQ ID NO: 120784 - protein, 9 aa, Mycobacterium tuberculosis
QIAVAEVTR

SEQ ID NO: 120785 - protein, 9 aa, Mycobacterium tuberculosis
AVAEVTRLR

SEQ ID NO: 120786 - protein, 9 aa, Mycobacterium tuberculosis
RLRQGWGAW

SEQ ID NO: 120787 - protein, 9 aa, Mycobacterium tuberculosis
RQGWGAWPV

SEQ ID NO: 120788 - protein, 9 aa, Mycobacterium tuberculosis
WGAWPVCAA

SEQ ID NO: 120789 - protein, 9 aa, Mycobacterium tuberculosis
GAWPVCAAR

SEQ ID NO: 120790 - protein, 9 aa, Mycobacterium tuberculosis
WPVCAARAG

SEQ ID NO: 120791 - protein, 10 aa, Mycobacterium tuberculosis
MLRLVVGALL

SEQ ID NO: 120792 - protein, 10 aa, Mycobacterium tuberculosis
RLVVGALLLV

SEQ ID NO: 120793 - protein, 10 aa, Mycobacterium tuberculosis
LVVGALLLVL

SEQ ID NO: 120794 - protein, 10 aa, Mycobacterium tuberculosis
VVGALLLVLA

SEQ ID NO: 120795 - protein, 10 aa, Mycobacterium tuberculosis
LLLVLAFAGG

SEQ ID NO: 120796 - protein, 10 aa, Mycobacterium tuberculosis
LLVLAFAGGY

SEQ ID NO: 120797 - protein, 10 aa, Mycobacterium tuberculosis
LVLAFAGGYA

SEQ ID NO: 120798 - protein, 10 aa, Mycobacterium tuberculosis
VLAFAGGYAV

SEQ ID NO: 120799 - protein, 10 aa, Mycobacterium tuberculosis
LAFAGGYAVA

SEQ ID NO: 120800 - protein, 10 aa, Mycobacterium tuberculosis
FAGGYAVAAC

SEQ ID NO: 120801 - protein, 10 aa, Mycobacterium tuberculosis
YAVAACKTVT

SEQ ID NO: 120802 - protein, 10 aa, Mycobacterium tuberculosis
AVAACKTVTL

SEQ ID NO: 120803 - protein, 10 aa, Mycobacterium tuberculosis
AACKTVTLTV

SEQ ID NO: 120804 - protein, 10 aa, Mycobacterium tuberculosis
VTLTVDGTAM

SEQ ID NO: 120805 - protein, 10 aa, Mycobacterium tuberculosis
TLTVDGTAMR

SEQ ID NO: 120806 - protein, 10 aa, Mycobacterium tuberculosis
LTVDGTAMRV

SEQ ID NO: 120807 - protein, 10 aa, Mycobacterium tuberculosis
GTAMRVTTMK

SEQ ID NO: 120808 - protein, 10 aa, Mycobacterium tuberculosis
TAMRVTTMKS

SEQ ID NO: 120809 - protein, 10 aa, Mycobacterium tuberculosis
AMRVTTMKSR

SEQ ID NO: 120810 - protein, 10 aa, Mycobacterium tuberculosis
MRVTTMKSRV

SEQ ID NO: 120811 - protein, 10 aa, Mycobacterium tuberculosis
TTMKSRVIDI

SEQ ID NO: 120812 - protein, 10 aa, Mycobacterium tuberculosis
TMKSRVIDIV

SEQ ID NO: 120813 - protein, 10 aa, Mycobacterium tuberculosis
DIVEENGFSV

SEQ ID NO: 120814 - protein, 10 aa, Mycobacterium tuberculosis
EENGFSVDDR

SEQ ID NO: 120815 - protein, 10 aa, Mycobacterium tuberculosis
FSVDDRDDLY

SEQ ID NO: 120816 - protein, 10 aa, Mycobacterium tuberculosis
DLYPAAGVQV

SEQ ID NO: 120817 - protein, 10 aa, Mycobacterium tuberculosis
VQVHDADTIV

SEQ ID NO: 120818 - protein, 10 aa, Mycobacterium tuberculosis
QVHDADTIVL

SEQ ID NO: 120819 - protein, 10 aa, Mycobacterium tuberculosis
HDADTIVLRR

SEQ ID NO: 120820 - protein, 10 aa, Mycobacterium tuberculosis
VLRRSRPLQI

SEQ ID NO: 120821 - protein, 10 aa, Mycobacterium tuberculosis
RRSRPLQISL

SEQ ID NO: 120822 - protein, 10 aa, Mycobacterium tuberculosis
QISLDGHDAK

SEQ ID NO: 120823 - protein, 10 aa, Mycobacterium tuberculosis
SLDGHDAKQV

SEQ ID NO: 120824 - protein, 10 aa, Mycobacterium tuberculosis
KQVWTTASTV

SEQ ID NO: 120825 - protein, 10 aa, Mycobacterium tuberculosis
WTTASTVDEA

SEQ ID NO: 120826 - protein, 10 aa, Mycobacterium tuberculosis
TTASTVDEAL

SEQ ID NO: 120827 - protein, 10 aa, Mycobacterium tuberculosis
TASTVDEALA

SEQ ID NO: 120828 - protein, 10 aa, Mycobacterium tuberculosis
STVDEALAQL

SEQ ID NO: 120829 - protein, 10 aa, Mycobacterium tuberculosis
TVDEALAQLA

SEQ ID NO: 120830 - protein, 10 aa, Mycobacterium tuberculosis
ALAQLAMTDT

SEQ ID NO: 120831 - protein, 10 aa, Mycobacterium tuberculosis
AQLAMTDTAP

SEQ ID NO: 120832 - protein, 10 aa, Mycobacterium tuberculosis
QLAMTDTAPA

SEQ ID NO: 120833 - protein, 10 aa, Mycobacterium tuberculosis
LAMTDTAPAA

SEQ ID NO: 120834 - protein, 10 aa, Mycobacterium tuberculosis
AMTDTAPAAA

SEQ ID NO: 120835 - protein, 10 aa, Mycobacterium tuberculosis
TDTAPAAASR

SEQ ID NO: 120836 - protein, 10 aa, Mycobacterium tuberculosis
DTAPAAASRA

SEQ ID NO: 120837 - protein, 10 aa, Mycobacterium tuberculosis
APAAASRASR

SEQ ID NO: 120838 - protein, 10 aa, Mycobacterium tuberculosis
AASRASRVPL

SEQ ID NO: 120839 - protein, 10 aa, Mycobacterium tuberculosis
ASRASRVPLS

SEQ ID NO: 120840 - protein, 10 aa, Mycobacterium tuberculosis
RASRVPLSGM

SEQ ID NO: 120841 - protein, 10 aa, Mycobacterium tuberculosis
VPLSGMALPV

SEQ ID NO: 120842 - protein, 10 aa, Mycobacterium tuberculosis
PLSGMALPVV

SEQ ID NO: 120843 - protein, 10 aa, Mycobacterium tuberculosis
SGMALPVVSA

SEQ ID NO: 120844 - protein, 10 aa, Mycobacterium tuberculosis
GMALPVVSAK

SEQ ID NO: 120845 - protein, 10 aa, Mycobacterium tuberculosis
ALPVVSAKTV

SEQ ID NO: 120846 - protein, 10 aa, Mycobacterium tuberculosis
LPVVSAKTVQ

SEQ ID NO: 120847 - protein, 10 aa, Mycobacterium tuberculosis
TVQLNDGGLV

SEQ ID NO: 120848 - protein, 10 aa, Mycobacterium tuberculosis
QLNDGGLVRT

SEQ ID NO: 120849 - protein, 10 aa, Mycobacterium tuberculosis
LNDGGLVRTV

SEQ ID NO: 120850 - protein, 10 aa, Mycobacterium tuberculosis
GLVRTVHLPA

SEQ ID NO: 120851 - protein, 10 aa, Mycobacterium tuberculosis
RTVHLPAPNV

SEQ ID NO: 120852 - protein, 10 aa, Mycobacterium tuberculosis
HLPAPNVAGL

SEQ ID NO: 120853 - protein, 10 aa, Mycobacterium tuberculosis
LPAPNVAGLL

SEQ ID NO: 120854 - protein, 10 aa, Mycobacterium tuberculosis
APNVAGLLSA

SEQ ID NO: 120855 - protein, 10 aa, Mycobacterium tuberculosis
GLLSAAGVPL

SEQ ID NO: 120856 - protein, 10 aa, Mycobacterium tuberculosis
LLSAAGVPLL

SEQ ID NO: 120857 - protein, 10 aa, Mycobacterium tuberculosis
GVPLLQSDHV

SEQ ID NO: 120858 - protein, 10 aa, Mycobacterium tuberculosis
VPLLQSDHVV

SEQ ID NO: 120859 - protein, 10 aa, Mycobacterium tuberculosis
LLQSDHVVPA

SEQ ID NO: 120860 - protein, 10 aa, Mycobacterium tuberculosis
LQSDHVVPAA

SEQ ID NO: 120861 - protein, 10 aa, Mycobacterium tuberculosis
HVVPAATAPI

SEQ ID NO: 120862 - protein, 10 aa, Mycobacterium tuberculosis
VVPAATAPIV

SEQ ID NO: 120863 - protein, 10 aa, Mycobacterium tuberculosis
PIVEGMQIQV

SEQ ID NO: 120864 - protein, 10 aa, Mycobacterium tuberculosis
GMQIQVTRNR

SEQ ID NO: 120865 - protein, 10 aa, Mycobacterium tuberculosis
MQIQVTRNRI

SEQ ID NO: 120866 - protein, 10 aa, Mycobacterium tuberculosis
QIQVTRNRIK

SEQ ID NO: 120867 - protein, 10 aa, Mycobacterium tuberculosis
IQVTRNRIKK

SEQ ID NO: 120868 - protein, 10 aa, Mycobacterium tuberculosis
QVTRNRIKKV

SEQ ID NO: 120869 - protein, 10 aa, Mycobacterium tuberculosis
RNRIKKVTER

SEQ ID NO: 120870 - protein, 10 aa, Mycobacterium tuberculosis
RLPLPPNARR

SEQ ID NO: 120871 - protein, 10 aa, Mycobacterium tuberculosis
LPLPPNARRV

SEQ ID NO: 120872 - protein, 10 aa, Mycobacterium tuberculosis
NARRVEDPEM

SEQ ID NO: 120873 - protein, 10 aa, Mycobacterium tuberculosis
RRVEDPEMNM

SEQ ID NO: 120874 - protein, 10 aa, Mycobacterium tuberculosis
GVPGTQDVTF

SEQ ID NO: 120875 - protein, 10 aa, Mycobacterium tuberculosis
VPGTQDVTFA

SEQ ID NO: 120876 - protein, 10 aa, Mycobacterium tuberculosis
EVNGVETGRL

SEQ ID NO: 120877 - protein, 10 aa, Mycobacterium tuberculosis
ETGRLPVANV

SEQ ID NO: 120878 - protein, 10 aa, Mycobacterium tuberculosis
LPVANVVVTP

SEQ ID NO: 120879 - protein, 10 aa, Mycobacterium tuberculosis
VANVVVTPAH

SEQ ID NO: 120880 - protein, 10 aa, Mycobacterium tuberculosis
NVVVTPAHEA

SEQ ID NO: 120881 - protein, 10 aa, Mycobacterium tuberculosis
VVVTPAHEAV

SEQ ID NO: 120882 - protein, 10 aa, Mycobacterium tuberculosis
VVTPAHEAVV

SEQ ID NO: 120883 - protein, 10 aa, Mycobacterium tuberculosis
VTPAHEAVVR

SEQ ID NO: 120884 - protein, 10 aa, Mycobacterium tuberculosis
TPAHEAVVRV

SEQ ID NO: 120885 - protein, 10 aa, Mycobacterium tuberculosis
RVGTKPGTEV

SEQ ID NO: 120886 - protein, 10 aa, Mycobacterium tuberculosis
EVPPVIDGSI

SEQ ID NO: 120887 - protein, 10 aa, Mycobacterium tuberculosis
VPPVIDGSIW

SEQ ID NO: 120888 - protein, 10 aa, Mycobacterium tuberculosis
PVIDGSIWDA

SEQ ID NO: 120889 - protein, 10 aa, Mycobacterium tuberculosis
VIDGSIWDAI

SEQ ID NO: 120890 - protein, 10 aa, Mycobacterium tuberculosis
IAGCEAGGNW

SEQ ID NO: 120891 - protein, 10 aa, Mycobacterium tuberculosis
WAINTGNGYY

SEQ ID NO: 120892 - protein, 10 aa, Mycobacterium tuberculosis
NTGNGYYGGV

SEQ ID NO: 120893 - protein, 10 aa, Mycobacterium tuberculosis
GGVQFDQGTW

SEQ ID NO: 120894 - protein, 10 aa, Mycobacterium tuberculosis
VQFDQGTWEA

SEQ ID NO: 120895 - protein, 10 aa, Mycobacterium tuberculosis
GTWEANGGLR

SEQ ID NO: 120896 - protein, 10 aa, Mycobacterium tuberculosis
TWEANGGLRY

SEQ ID NO: 120897 - protein, 10 aa, Mycobacterium tuberculosis
ANGGLRYAPR

SEQ ID NO: 120898 - protein, 10 aa, Mycobacterium tuberculosis
GLRYAPRADL

SEQ ID NO: 120899 - protein, 10 aa, Mycobacterium tuberculosis
YAPRADLATR

SEQ ID NO: 120900 - protein, 10 aa, Mycobacterium tuberculosis
LATREEQIAV

SEQ ID NO: 120901 - protein, 10 aa, Mycobacterium tuberculosis
REEQIAVAEV

SEQ ID NO: 120902 - protein, 10 aa, Mycobacterium tuberculosis
EQIAVAEVTR

SEQ ID NO: 120903 - protein, 10 aa, Mycobacterium tuberculosis
QIAVAEVTRL

SEQ ID NO: 120904 - protein, 10 aa, Mycobacterium tuberculosis
IAVAEVTRLR

SEQ ID NO: 120905 - protein, 10 aa, Mycobacterium tuberculosis
AEVTRLRQGW

SEQ ID NO: 120906 - protein, 10 aa, Mycobacterium tuberculosis
LRQGWGAWPV

SEQ ID NO: 120907 - protein, 10 aa, Mycobacterium tuberculosis
RQGWGAWPVC

SEQ ID NO: 120908 - protein, 10 aa, Mycobacterium tuberculosis
WGAWPVCAAR

SEQ ID NO: 120909 - protein, 10 aa, Mycobacterium tuberculosis
WPVCAARAGA

SEQ ID NO: 120910 - protein, 11 aa, Mycobacterium tuberculosis
MLRLVVGALLL

SEQ ID NO: 120911 - protein, 11 aa, Mycobacterium tuberculosis
RLVVGALLLVL

SEQ ID NO: 120912 - protein, 11 aa, Mycobacterium tuberculosis
LVVGALLLVLA

SEQ ID NO: 120913 - protein, 11 aa, Mycobacterium tuberculosis
VVGALLLVLAF

SEQ ID NO: 120914 - protein, 11 aa, Mycobacterium tuberculosis
LLLVLAFAGGY

SEQ ID NO: 120915 - protein, 11 aa, Mycobacterium tuberculosis
LLVLAFAGGYA

SEQ ID NO: 120916 - protein, 11 aa, Mycobacterium tuberculosis
LVLAFAGGYAV

SEQ ID NO: 120917 - protein, 11 aa, Mycobacterium tuberculosis
VLAFAGGYAVA

SEQ ID NO: 120918 - protein, 11 aa, Mycobacterium tuberculosis
LAFAGGYAVAA

SEQ ID NO: 120919 - protein, 11 aa, Mycobacterium tuberculosis
FAGGYAVAACK

SEQ ID NO: 120920 - protein, 11 aa, Mycobacterium tuberculosis
YAVAACKTVTL

SEQ ID NO: 120921 - protein, 11 aa, Mycobacterium tuberculosis
VAACKTVTLTV

SEQ ID NO: 120922 - protein, 11 aa, Mycobacterium tuberculosis
TVTLTVDGTAM

SEQ ID NO: 120923 - protein, 11 aa, Mycobacterium tuberculosis
VTLTVDGTAMR

SEQ ID NO: 120924 - protein, 11 aa, Mycobacterium tuberculosis
TLTVDGTAMRV

SEQ ID NO: 120925 - protein, 11 aa, Mycobacterium tuberculosis
TVDGTAMRVTT

SEQ ID NO: 120926 - protein, 11 aa, Mycobacterium tuberculosis
DGTAMRVTTMK

SEQ ID NO: 120927 - protein, 11 aa, Mycobacterium tuberculosis
TAMRVTTMKSR

SEQ ID NO: 120928 - protein, 11 aa, Mycobacterium tuberculosis
AMRVTTMKSRV

SEQ ID NO: 120929 - protein, 11 aa, Mycobacterium tuberculosis
TTMKSRVIDIV

SEQ ID NO: 120930 - protein, 11 aa, Mycobacterium tuberculosis
RVIDIVEENGF

SEQ ID NO: 120931 - protein, 11 aa, Mycobacterium tuberculosis
SVDDRDDLYPA

SEQ ID NO: 120932 - protein, 11 aa, Mycobacterium tuberculosis
YPAAGVQVHDA

SEQ ID NO: 120933 - protein, 11 aa, Mycobacterium tuberculosis
GVQVHDADTIV

SEQ ID NO: 120934 - protein, 11 aa, Mycobacterium tuberculosis
VQVHDADTIVL

SEQ ID NO: 120935 - protein, 11 aa, Mycobacterium tuberculosis
QVHDADTIVLR

SEQ ID NO: 120936 - protein, 11 aa, Mycobacterium tuberculosis
DADTIVLRRSR

SEQ ID NO: 120937 - protein, 11 aa, Mycobacterium tuberculosis
DTIVLRRSRPL

SEQ ID NO: 120938 - protein, 11 aa, Mycobacterium tuberculosis
LQISLDGHDAK

SEQ ID NO: 120939 - protein, 11 aa, Mycobacterium tuberculosis
ISLDGHDAKQV

SEQ ID NO: 120940 - protein, 11 aa, Mycobacterium tuberculosis
SLDGHDAKQVW

SEQ ID NO: 120941 - protein, 11 aa, Mycobacterium tuberculosis
WTTASTVDEAL

SEQ ID NO: 120942 - protein, 11 aa, Mycobacterium tuberculosis
TTASTVDEALA

SEQ ID NO: 120943 - protein, 11 aa, Mycobacterium tuberculosis
STVDEALAQLA

SEQ ID NO: 120944 - protein, 11 aa, Mycobacterium tuberculosis
TVDEALAQLAM

SEQ ID NO: 120945 - protein, 11 aa, Mycobacterium tuberculosis
ALAQLAMTDTA

SEQ ID NO: 120946 - protein, 11 aa, Mycobacterium tuberculosis
AQLAMTDTAPA

SEQ ID NO: 120947 - protein, 11 aa, Mycobacterium tuberculosis
QLAMTDTAPAA

SEQ ID NO: 120948 - protein, 11 aa, Mycobacterium tuberculosis
LAMTDTAPAAA

SEQ ID NO: 120949 - protein, 11 aa, Mycobacterium tuberculosis
AMTDTAPAAAS

SEQ ID NO: 120950 - protein, 11 aa, Mycobacterium tuberculosis
MTDTAPAAASR

SEQ ID NO: 120951 - protein, 11 aa, Mycobacterium tuberculosis
TAPAAASRASR

SEQ ID NO: 120952 - protein, 11 aa, Mycobacterium tuberculosis
APAAASRASRV

SEQ ID NO: 120953 - protein, 11 aa, Mycobacterium tuberculosis
AAASRASRVPL

SEQ ID NO: 120954 - protein, 11 aa, Mycobacterium tuberculosis
ASRVPLSGMAL

SEQ ID NO: 120955 - protein, 11 aa, Mycobacterium tuberculosis
RVPLSGMALPV

SEQ ID NO: 120956 - protein, 11 aa, Mycobacterium tuberculosis
VPLSGMALPVV

SEQ ID NO: 120957 - protein, 11 aa, Mycobacterium tuberculosis
SGMALPVVSAK

SEQ ID NO: 120958 - protein, 11 aa, Mycobacterium tuberculosis
MALPVVSAKTV

SEQ ID NO: 120959 - protein, 11 aa, Mycobacterium tuberculosis
LPVVSAKTVQL

SEQ ID NO: 120960 - protein, 11 aa, Mycobacterium tuberculosis
KTVQLNDGGLV

SEQ ID NO: 120961 - protein, 11 aa, Mycobacterium tuberculosis
TVQLNDGGLVR

SEQ ID NO: 120962 - protein, 11 aa, Mycobacterium tuberculosis
VQLNDGGLVRT

SEQ ID NO: 120963 - protein, 11 aa, Mycobacterium tuberculosis
QLNDGGLVRTV

SEQ ID NO: 120964 - protein, 11 aa, Mycobacterium tuberculosis
HLPAPNVAGLL

SEQ ID NO: 120965 - protein, 11 aa, Mycobacterium tuberculosis
LPAPNVAGLLS

SEQ ID NO: 120966 - protein, 11 aa, Mycobacterium tuberculosis
APNVAGLLSAA

SEQ ID NO: 120967 - protein, 11 aa, Mycobacterium tuberculosis
NVAGLLSAAGV

SEQ ID NO: 120968 - protein, 11 aa, Mycobacterium tuberculosis
GLLSAAGVPLL

SEQ ID NO: 120969 - protein, 11 aa, Mycobacterium tuberculosis
LLSAAGVPLLQ

SEQ ID NO: 120970 - protein, 11 aa, Mycobacterium tuberculosis
GVPLLQSDHVV

SEQ ID NO: 120971 - protein, 11 aa, Mycobacterium tuberculosis
PLLQSDHVVPA

SEQ ID NO: 120972 - protein, 11 aa, Mycobacterium tuberculosis
LLQSDHVVPAA

SEQ ID NO: 120973 - protein, 11 aa, Mycobacterium tuberculosis
LQSDHVVPAAT

SEQ ID NO: 120974 - protein, 11 aa, Mycobacterium tuberculosis
HVVPAATAPIV

SEQ ID NO: 120975 - protein, 11 aa, Mycobacterium tuberculosis
ATAPIVEGMQI

SEQ ID NO: 120976 - protein, 11 aa, Mycobacterium tuberculosis
APIVEGMQIQV

SEQ ID NO: 120977 - protein, 11 aa, Mycobacterium tuberculosis
IVEGMQIQVTR

SEQ ID NO: 120978 - protein, 11 aa, Mycobacterium tuberculosis
EGMQIQVTRNR

SEQ ID NO: 120979 - protein, 11 aa, Mycobacterium tuberculosis
GMQIQVTRNRI

SEQ ID NO: 120980 - protein, 11 aa, Mycobacterium tuberculosis
MQIQVTRNRIK

SEQ ID NO: 120981 - protein, 11 aa, Mycobacterium tuberculosis
QIQVTRNRIKK

SEQ ID NO: 120982 - protein, 11 aa, Mycobacterium tuberculosis
IQVTRNRIKKV

SEQ ID NO: 120983 - protein, 11 aa, Mycobacterium tuberculosis
RIKKVTERLPL

SEQ ID NO: 120984 - protein, 11 aa, Mycobacterium tuberculosis
RLPLPPNARRV

SEQ ID NO: 120985 - protein, 11 aa, Mycobacterium tuberculosis
RVEDPEMNMSR

SEQ ID NO: 120986 - protein, 11 aa, Mycobacterium tuberculosis
MSREVVEDPGV

SEQ ID NO: 120987 - protein, 11 aa, Mycobacterium tuberculosis
EVVEDPGVPGT

SEQ ID NO: 120988 - protein, 11 aa, Mycobacterium tuberculosis
GVPGTQDVTFA

SEQ ID NO: 120989 - protein, 11 aa, Mycobacterium tuberculosis
VPGTQDVTFAV

SEQ ID NO: 120990 - protein, 11 aa, Mycobacterium tuberculosis
TQDVTFAVAEV

SEQ ID NO: 120991 - protein, 11 aa, Mycobacterium tuberculosis
VTFAVAEVNGV

SEQ ID NO: 120992 - protein, 11 aa, Mycobacterium tuberculosis
FAVAEVNGVET

SEQ ID NO: 120993 - protein, 11 aa, Mycobacterium tuberculosis
AEVNGVETGRL

SEQ ID NO: 120994 - protein, 11 aa, Mycobacterium tuberculosis
ETGRLPVANVV

SEQ ID NO: 120995 - protein, 11 aa, Mycobacterium tuberculosis
LPVANVVVTPA

SEQ ID NO: 120996 - protein, 11 aa, Mycobacterium tuberculosis
NVVVTPAHEAV

SEQ ID NO: 120997 - protein, 11 aa, Mycobacterium tuberculosis
VVVTPAHEAVV

SEQ ID NO: 120998 - protein, 11 aa, Mycobacterium tuberculosis
VVTPAHEAVVR

SEQ ID NO: 120999 - protein, 11 aa, Mycobacterium tuberculosis
VTPAHEAVVRV

SEQ ID NO: 121000 - protein, 11 aa, Mycobacterium tuberculosis
GTKPGTEVPPV

SEQ ID NO: 121001 - protein, 11 aa, Mycobacterium tuberculosis
TEVPPVIDGSI

SEQ ID NO: 121002 - protein, 11 aa, Mycobacterium tuberculosis
EVPPVIDGSIW

SEQ ID NO: 121003 - protein, 11 aa, Mycobacterium tuberculosis
PVIDGSIWDAI

SEQ ID NO: 121004 - protein, 11 aa, Mycobacterium tuberculosis
VIDGSIWDAIA

SEQ ID NO: 121005 - protein, 11 aa, Mycobacterium tuberculosis
SIWDAIAGCEA

SEQ ID NO: 121006 - protein, 11 aa, Mycobacterium tuberculosis
NWAINTGNGYY

SEQ ID NO: 121007 - protein, 11 aa, Mycobacterium tuberculosis
EANGGLRYAPR

SEQ ID NO: 121008 - protein, 11 aa, Mycobacterium tuberculosis
GLRYAPRADLA

SEQ ID NO: 121009 - protein, 11 aa, Mycobacterium tuberculosis
RYAPRADLATR

SEQ ID NO: 121010 - protein, 11 aa, Mycobacterium tuberculosis
APRADLATREE

SEQ ID NO: 121011 - protein, 11 aa, Mycobacterium tuberculosis
DLATREEQIAV

SEQ ID NO: 121012 - protein, 11 aa, Mycobacterium tuberculosis
EQIAVAEVTRL

SEQ ID NO: 121013 - protein, 11 aa, Mycobacterium tuberculosis
QIAVAEVTRLR

SEQ ID NO: 121014 - protein, 11 aa, Mycobacterium tuberculosis
VAEVTRLRQGW

SEQ ID NO: 121015 - protein, 11 aa, Mycobacterium tuberculosis
EVTRLRQGWGA

SEQ ID NO: 121016 - protein, 11 aa, Mycobacterium tuberculosis
RLRQGWGAWPV

SEQ ID NO: 121017 - protein, 11 aa, Mycobacterium tuberculosis
RQGWGAWPVCA

SEQ ID NO: 121018 - protein, 11 aa, Mycobacterium tuberculosis
GWGAWPVCAAR

SEQ ID NO: 121019 - protein, 11 aa, Mycobacterium tuberculosis
WGAWPVCAARA

SEQ ID NO: 121020 - protein, 11 aa, Mycobacterium tuberculosis
WPVCAARAGAR

SEQ ID NO: 121021 - protein, 13 aa, Mycobacterium tuberculosis
MSSGNSSLGIIVG

SEQ ID NO: 121022 - protein, 13 aa, Mycobacterium tuberculosis
SSGNSSLGIIVGI

SEQ ID NO: 121023 - protein, 13 aa, Mycobacterium tuberculosis
SGNSSLGIIVGID

SEQ ID NO: 121024 - protein, 13 aa, Mycobacterium tuberculosis
GNSSLGIIVGIDD

SEQ ID NO: 121025 - protein, 13 aa, Mycobacterium tuberculosis
NSSLGIIVGIDDS

SEQ ID NO: 121026 - protein, 13 aa, Mycobacterium tuberculosis
SSLGIIVGIDDSP

SEQ ID NO: 121027 - protein, 13 aa, Mycobacterium tuberculosis
SLGIIVGIDDSPA

SEQ ID NO: 121028 - protein, 13 aa, Mycobacterium tuberculosis
LGIIVGIDDSPAA

SEQ ID NO: 121029 - protein, 13 aa, Mycobacterium tuberculosis
GIIVGIDDSPAAQ

SEQ ID NO: 121030 - protein, 13 aa, Mycobacterium tuberculosis
IIVGIDDSPAAQV

SEQ ID NO: 121031 - protein, 13 aa, Mycobacterium tuberculosis
IVGIDDSPAAQVA

SEQ ID NO: 121032 - protein, 13 aa, Mycobacterium tuberculosis
VGIDDSPAAQVAV

SEQ ID NO: 121033 - protein, 13 aa, Mycobacterium tuberculosis
GIDDSPAAQVAVR

SEQ ID NO: 121034 - protein, 13 aa, Mycobacterium tuberculosis
IDDSPAAQVAVRW

SEQ ID NO: 121035 - protein, 13 aa, Mycobacterium tuberculosis
DDSPAAQVAVRWA

SEQ ID NO: 121036 - protein, 13 aa, Mycobacterium tuberculosis
DSPAAQVAVRWAA

SEQ ID NO: 121037 - protein, 13 aa, Mycobacterium tuberculosis
SPAAQVAVRWAAR

SEQ ID NO: 121038 - protein, 13 aa, Mycobacterium tuberculosis
PAAQVAVRWAARD

SEQ ID NO: 121039 - protein, 13 aa, Mycobacterium tuberculosis
AAQVAVRWAARDA

SEQ ID NO: 121040 - protein, 13 aa, Mycobacterium tuberculosis
AQVAVRWAARDAE

SEQ ID NO: 121041 - protein, 13 aa, Mycobacterium tuberculosis
QVAVRWAARDAEL

SEQ ID NO: 121042 - protein, 13 aa, Mycobacterium tuberculosis
VAVRWAARDAELR

SEQ ID NO: 121043 - protein, 13 aa, Mycobacterium tuberculosis
AVRWAARDAELRK

SEQ ID NO: 121044 - protein, 13 aa, Mycobacterium tuberculosis
VRWAARDAELRKI

SEQ ID NO: 121045 - protein, 13 aa, Mycobacterium tuberculosis
RWAARDAELRKIP

SEQ ID NO: 121046 - protein, 13 aa, Mycobacterium tuberculosis
WAARDAELRKIPL

SEQ ID NO: 121047 - protein, 13 aa, Mycobacterium tuberculosis
AARDAELRKIPLT

SEQ ID NO: 121048 - protein, 13 aa, Mycobacterium tuberculosis
ARDAELRKIPLTL

SEQ ID NO: 121049 - protein, 13 aa, Mycobacterium tuberculosis
RDAELRKIPLTLV

SEQ ID NO: 121050 - protein, 13 aa, Mycobacterium tuberculosis
DAELRKIPLTLVH

SEQ ID NO: 121051 - protein, 13 aa, Mycobacterium tuberculosis
AELRKIPLTLVHA

SEQ ID NO: 121052 - protein, 13 aa, Mycobacterium tuberculosis
ELRKIPLTLVHAV

SEQ ID NO: 121053 - protein, 13 aa, Mycobacterium tuberculosis
LRKIPLTLVHAVS

SEQ ID NO: 121054 - protein, 13 aa, Mycobacterium tuberculosis
RKIPLTLVHAVSP

SEQ ID NO: 121055 - protein, 13 aa, Mycobacterium tuberculosis
KIPLTLVHAVSPE

SEQ ID NO: 121056 - protein, 13 aa, Mycobacterium tuberculosis
IPLTLVHAVSPEV

SEQ ID NO: 121057 - protein, 13 aa, Mycobacterium tuberculosis
PLTLVHAVSPEVA

SEQ ID NO: 121058 - protein, 13 aa, Mycobacterium tuberculosis
LTLVHAVSPEVAT

SEQ ID NO: 121059 - protein, 13 aa, Mycobacterium tuberculosis
TLVHAVSPEVATW

SEQ ID NO: 121060 - protein, 13 aa, Mycobacterium tuberculosis
LVHAVSPEVATWL

SEQ ID NO: 121061 - protein, 13 aa, Mycobacterium tuberculosis
VHAVSPEVATWLE

SEQ ID NO: 121062 - protein, 13 aa, Mycobacterium tuberculosis
HAVSPEVATWLEV

SEQ ID NO: 121063 - protein, 13 aa, Mycobacterium tuberculosis
AVSPEVATWLEVP

SEQ ID NO: 121064 - protein, 13 aa, Mycobacterium tuberculosis
VSPEVATWLEVPL

SEQ ID NO: 121065 - protein, 13 aa, Mycobacterium tuberculosis
SPEVATWLEVPLP

SEQ ID NO: 121066 - protein, 13 aa, Mycobacterium tuberculosis
PEVATWLEVPLPP

SEQ ID NO: 121067 - protein, 13 aa, Mycobacterium tuberculosis
EVATWLEVPLPPG

SEQ ID NO: 121068 - protein, 13 aa, Mycobacterium tuberculosis
VATWLEVPLPPGV

SEQ ID NO: 121069 - protein, 13 aa, Mycobacterium tuberculosis
ATWLEVPLPPGVL

SEQ ID NO: 121070 - protein, 13 aa, Mycobacterium tuberculosis
TWLEVPLPPGVLR

SEQ ID NO: 121071 - protein, 13 aa, Mycobacterium tuberculosis
WLEVPLPPGVLRW

SEQ ID NO: 121072 - protein, 13 aa, Mycobacterium tuberculosis
LEVPLPPGVLRWQ

SEQ ID NO: 121073 - protein, 13 aa, Mycobacterium tuberculosis
EVPLPPGVLRWQQ

SEQ ID NO: 121074 - protein, 13 aa, Mycobacterium tuberculosis
VPLPPGVLRWQQD

SEQ ID NO: 121075 - protein, 13 aa, Mycobacterium tuberculosis
PLPPGVLRWQQDH

SEQ ID NO: 121076 - protein, 13 aa, Mycobacterium tuberculosis
LPPGVLRWQQDHG

SEQ ID NO: 121077 - protein, 13 aa, Mycobacterium tuberculosis
PPGVLRWQQDHGR

SEQ ID NO: 121078 - protein, 13 aa, Mycobacterium tuberculosis
PGVLRWQQDHGRH

SEQ ID NO: 121079 - protein, 13 aa, Mycobacterium tuberculosis
GVLRWQQDHGRHL

SEQ ID NO: 121080 - protein, 13 aa, Mycobacterium tuberculosis
VLRWQQDHGRHLI

SEQ ID NO: 121081 - protein, 13 aa, Mycobacterium tuberculosis
LRWQQDHGRHLID

SEQ ID NO: 121082 - protein, 13 aa, Mycobacterium tuberculosis
RWQQDHGRHLIDD

SEQ ID NO: 121083 - protein, 13 aa, Mycobacterium tuberculosis
WQQDHGRHLIDDA

SEQ ID NO: 121084 - protein, 13 aa, Mycobacterium tuberculosis
QQDHGRHLIDDAL

SEQ ID NO: 121085 - protein, 13 aa, Mycobacterium tuberculosis
QDHGRHLIDDALK

SEQ ID NO: 121086 - protein, 13 aa, Mycobacterium tuberculosis
DHGRHLIDDALKV

SEQ ID NO: 121087 - protein, 13 aa, Mycobacterium tuberculosis
HGRHLIDDALKVV

SEQ ID NO: 121088 - protein, 13 aa, Mycobacterium tuberculosis
GRHLIDDALKVVE

SEQ ID NO: 121089 - protein, 13 aa, Mycobacterium tuberculosis
RHLIDDALKVVEQ

SEQ ID NO: 121090 - protein, 13 aa, Mycobacterium tuberculosis
HLIDDALKVVEQA

SEQ ID NO: 121091 - protein, 13 aa, Mycobacterium tuberculosis
LIDDALKVVEQAS

SEQ ID NO: 121092 - protein, 13 aa, Mycobacterium tuberculosis
IDDALKVVEQASL

SEQ ID NO: 121093 - protein, 13 aa, Mycobacterium tuberculosis
DDALKVVEQASLR

SEQ ID NO: 121094 - protein, 13 aa, Mycobacterium tuberculosis
DALKVVEQASLRA

SEQ ID NO: 121095 - protein, 13 aa, Mycobacterium tuberculosis
ALKVVEQASLRAG

SEQ ID NO: 121096 - protein, 13 aa, Mycobacterium tuberculosis
LKVVEQASLRAGP

SEQ ID NO: 121097 - protein, 13 aa, Mycobacterium tuberculosis
KVVEQASLRAGPP

SEQ ID NO: 121098 - protein, 13 aa, Mycobacterium tuberculosis
VVEQASLRAGPPT

SEQ ID NO: 121099 - protein, 13 aa, Mycobacterium tuberculosis
VEQASLRAGPPTV

SEQ ID NO: 121100 - protein, 13 aa, Mycobacterium tuberculosis
EQASLRAGPPTVH

SEQ ID NO: 121101 - protein, 13 aa, Mycobacterium tuberculosis
QASLRAGPPTVHS

SEQ ID NO: 121102 - protein, 13 aa, Mycobacterium tuberculosis
ASLRAGPPTVHSE

SEQ ID NO: 121103 - protein, 13 aa, Mycobacterium tuberculosis
SLRAGPPTVHSEI

SEQ ID NO: 121104 - protein, 13 aa, Mycobacterium tuberculosis
LRAGPPTVHSEIV

SEQ ID NO: 121105 - protein, 13 aa, Mycobacterium tuberculosis
RAGPPTVHSEIVP

SEQ ID NO: 121106 - protein, 13 aa, Mycobacterium tuberculosis
AGPPTVHSEIVPA

SEQ ID NO: 121107 - protein, 13 aa, Mycobacterium tuberculosis
GPPTVHSEIVPAA

SEQ ID NO: 121108 - protein, 13 aa, Mycobacterium tuberculosis
PPTVHSEIVPAAA

SEQ ID NO: 121109 - protein, 13 aa, Mycobacterium tuberculosis
PTVHSEIVPAAAV

SEQ ID NO: 121110 - protein, 13 aa, Mycobacterium tuberculosis
TVHSEIVPAAAVP

SEQ ID NO: 121111 - protein, 13 aa, Mycobacterium tuberculosis
VHSEIVPAAAVPT

SEQ ID NO: 121112 - protein, 13 aa, Mycobacterium tuberculosis
HSEIVPAAAVPTL

SEQ ID NO: 121113 - protein, 13 aa, Mycobacterium tuberculosis
SEIVPAAAVPTLV

SEQ ID NO: 121114 - protein, 13 aa, Mycobacterium tuberculosis
EIVPAAAVPTLVD

SEQ ID NO: 121115 - protein, 13 aa, Mycobacterium tuberculosis
IVPAAAVPTLVDM

SEQ ID NO: 121116 - protein, 13 aa, Mycobacterium tuberculosis
VPAAAVPTLVDMS

SEQ ID NO: 121117 - protein, 13 aa, Mycobacterium tuberculosis
PAAAVPTLVDMSK

SEQ ID NO: 121118 - protein, 13 aa, Mycobacterium tuberculosis
AAAVPTLVDMSKD

SEQ ID NO: 121119 - protein, 13 aa, Mycobacterium tuberculosis
AAVPTLVDMSKDA

SEQ ID NO: 121120 - protein, 13 aa, Mycobacterium tuberculosis
AVPTLVDMSKDAV

SEQ ID NO: 121121 - protein, 13 aa, Mycobacterium tuberculosis
VPTLVDMSKDAVL

SEQ ID NO: 121122 - protein, 13 aa, Mycobacterium tuberculosis
PTLVDMSKDAVLM

SEQ ID NO: 121123 - protein, 13 aa, Mycobacterium tuberculosis
TLVDMSKDAVLMV

SEQ ID NO: 121124 - protein, 13 aa, Mycobacterium tuberculosis
LVDMSKDAVLMVV

SEQ ID NO: 121125 - protein, 13 aa, Mycobacterium tuberculosis
VDMSKDAVLMVVG

SEQ ID NO: 121126 - protein, 13 aa, Mycobacterium tuberculosis
DMSKDAVLMVVGC

SEQ ID NO: 121127 - protein, 13 aa, Mycobacterium tuberculosis
MSKDAVLMVVGCL

SEQ ID NO: 121128 - protein, 13 aa, Mycobacterium tuberculosis
SKDAVLMVVGCLG

SEQ ID NO: 121129 - protein, 13 aa, Mycobacterium tuberculosis
KDAVLMVVGCLGS

SEQ ID NO: 121130 - protein, 13 aa, Mycobacterium tuberculosis
DAVLMVVGCLGSG

SEQ ID NO: 121131 - protein, 13 aa, Mycobacterium tuberculosis
AVLMVVGCLGSGR

SEQ ID NO: 121132 - protein, 13 aa, Mycobacterium tuberculosis
VLMVVGCLGSGRW

SEQ ID NO: 121133 - protein, 13 aa, Mycobacterium tuberculosis
LMVVGCLGSGRWP

SEQ ID NO: 121134 - protein, 13 aa, Mycobacterium tuberculosis
MVVGCLGSGRWPG

SEQ ID NO: 121135 - protein, 13 aa, Mycobacterium tuberculosis
VVGCLGSGRWPGR

SEQ ID NO: 121136 - protein, 13 aa, Mycobacterium tuberculosis
VGCLGSGRWPGRL

SEQ ID NO: 121137 - protein, 13 aa, Mycobacterium tuberculosis
GCLGSGRWPGRLL

SEQ ID NO: 121138 - protein, 13 aa, Mycobacterium tuberculosis
CLGSGRWPGRLLG

SEQ ID NO: 121139 - protein, 13 aa, Mycobacterium tuberculosis
LGSGRWPGRLLGS

SEQ ID NO: 121140 - protein, 13 aa, Mycobacterium tuberculosis
GSGRWPGRLLGSV

SEQ ID NO: 121141 - protein, 13 aa, Mycobacterium tuberculosis
SGRWPGRLLGSVS

SEQ ID NO: 121142 - protein, 13 aa, Mycobacterium tuberculosis
GRWPGRLLGSVSS

SEQ ID NO: 121143 - protein, 13 aa, Mycobacterium tuberculosis
RWPGRLLGSVSSG

SEQ ID NO: 121144 - protein, 13 aa, Mycobacterium tuberculosis
WPGRLLGSVSSGL

SEQ ID NO: 121145 - protein, 13 aa, Mycobacterium tuberculosis
PGRLLGSVSSGLL

SEQ ID NO: 121146 - protein, 13 aa, Mycobacterium tuberculosis
GRLLGSVSSGLLR

SEQ ID NO: 121147 - protein, 13 aa, Mycobacterium tuberculosis
RLLGSVSSGLLRH

SEQ ID NO: 121148 - protein, 13 aa, Mycobacterium tuberculosis
LLGSVSSGLLRHA

SEQ ID NO: 121149 - protein, 13 aa, Mycobacterium tuberculosis
LGSVSSGLLRHAH

SEQ ID NO: 121150 - protein, 13 aa, Mycobacterium tuberculosis
GSVSSGLLRHAHC

SEQ ID NO: 121151 - protein, 13 aa, Mycobacterium tuberculosis
SVSSGLLRHAHCP

SEQ ID NO: 121152 - protein, 13 aa, Mycobacterium tuberculosis
VSSGLLRHAHCPV

SEQ ID NO: 121153 - protein, 13 aa, Mycobacterium tuberculosis
SSGLLRHAHCPVV

SEQ ID NO: 121154 - protein, 13 aa, Mycobacterium tuberculosis
SGLLRHAHCPVVI

SEQ ID NO: 121155 - protein, 13 aa, Mycobacterium tuberculosis
GLLRHAHCPVVII

SEQ ID NO: 121156 - protein, 13 aa, Mycobacterium tuberculosis
LLRHAHCPVVIIH

SEQ ID NO: 121157 - protein, 13 aa, Mycobacterium tuberculosis
LRHAHCPVVIIHD

SEQ ID NO: 121158 - protein, 13 aa, Mycobacterium tuberculosis
RHAHCPVVIIHDE

SEQ ID NO: 121159 - protein, 13 aa, Mycobacterium tuberculosis
HAHCPVVIIHDED

SEQ ID NO: 121160 - protein, 13 aa, Mycobacterium tuberculosis
AHCPVVIIHDEDS

SEQ ID NO: 121161 - protein, 13 aa, Mycobacterium tuberculosis
HCPVVIIHDEDSV

SEQ ID NO: 121162 - protein, 13 aa, Mycobacterium tuberculosis
CPVVIIHDEDSVM

SEQ ID NO: 121163 - protein, 13 aa, Mycobacterium tuberculosis
PVVIIHDEDSVMP

SEQ ID NO: 121164 - protein, 13 aa, Mycobacterium tuberculosis
VVIIHDEDSVMPH

SEQ ID NO: 121165 - protein, 13 aa, Mycobacterium tuberculosis
VIIHDEDSVMPHP

SEQ ID NO: 121166 - protein, 13 aa, Mycobacterium tuberculosis
IIHDEDSVMPHPQ

SEQ ID NO: 121167 - protein, 13 aa, Mycobacterium tuberculosis
IHDEDSVMPHPQQ

SEQ ID NO: 121168 - protein, 13 aa, Mycobacterium tuberculosis
HDEDSVMPHPQQA

SEQ ID NO: 121169 - protein, 13 aa, Mycobacterium tuberculosis
DEDSVMPHPQQAP

SEQ ID NO: 121170 - protein, 13 aa, Mycobacterium tuberculosis
EDSVMPHPQQAPV

SEQ ID NO: 121171 - protein, 13 aa, Mycobacterium tuberculosis
DSVMPHPQQAPVL

SEQ ID NO: 121172 - protein, 13 aa, Mycobacterium tuberculosis
SVMPHPQQAPVLV

SEQ ID NO: 121173 - protein, 13 aa, Mycobacterium tuberculosis
VMPHPQQAPVLVG

SEQ ID NO: 121174 - protein, 13 aa, Mycobacterium tuberculosis
MPHPQQAPVLVGV

SEQ ID NO: 121175 - protein, 13 aa, Mycobacterium tuberculosis
PHPQQAPVLVGVD

SEQ ID NO: 121176 - protein, 13 aa, Mycobacterium tuberculosis
HPQQAPVLVGVDG

SEQ ID NO: 121177 - protein, 13 aa, Mycobacterium tuberculosis
PQQAPVLVGVDGS

SEQ ID NO: 121178 - protein, 13 aa, Mycobacterium tuberculosis
QQAPVLVGVDGSS

SEQ ID NO: 121179 - protein, 13 aa, Mycobacterium tuberculosis
QAPVLVGVDGSSA

SEQ ID NO: 121180 - protein, 13 aa, Mycobacterium tuberculosis
APVLVGVDGSSAS

SEQ ID NO: 121181 - protein, 13 aa, Mycobacterium tuberculosis
PVLVGVDGSSASE

SEQ ID NO: 121182 - protein, 13 aa, Mycobacterium tuberculosis
VLVGVDGSSASEL

SEQ ID NO: 121183 - protein, 13 aa, Mycobacterium tuberculosis
LVGVDGSSASELA

SEQ ID NO: 121184 - protein, 13 aa, Mycobacterium tuberculosis
VGVDGSSASELAT

SEQ ID NO: 121185 - protein, 13 aa, Mycobacterium tuberculosis
GVDGSSASELATA

SEQ ID NO: 121186 - protein, 13 aa, Mycobacterium tuberculosis
VDGSSASELATAI

SEQ ID NO: 121187 - protein, 13 aa, Mycobacterium tuberculosis
DGSSASELATAIA

SEQ ID NO: 121188 - protein, 13 aa, Mycobacterium tuberculosis
GSSASELATAIAF

SEQ ID NO: 121189 - protein, 13 aa, Mycobacterium tuberculosis
SSASELATAIAFD

SEQ ID NO: 121190 - protein, 13 aa, Mycobacterium tuberculosis
SASELATAIAFDE

SEQ ID NO: 121191 - protein, 13 aa, Mycobacterium tuberculosis
ASELATAIAFDEA

SEQ ID NO: 121192 - protein, 13 aa, Mycobacterium tuberculosis
SELATAIAFDEAS

SEQ ID NO: 121193 - protein, 13 aa, Mycobacterium tuberculosis
ELATAIAFDEASR

SEQ ID NO: 121194 - protein, 13 aa, Mycobacterium tuberculosis
LATAIAFDEASRR

SEQ ID NO: 121195 - protein, 13 aa, Mycobacterium tuberculosis
ATAIAFDEASRRN

SEQ ID NO: 121196 - protein, 13 aa, Mycobacterium tuberculosis
TAIAFDEASRRNV

SEQ ID NO: 121197 - protein, 13 aa, Mycobacterium tuberculosis
AIAFDEASRRNVD

SEQ ID NO: 121198 - protein, 13 aa, Mycobacterium tuberculosis
IAFDEASRRNVDL

SEQ ID NO: 121199 - protein, 13 aa, Mycobacterium tuberculosis
AFDEASRRNVDLV

SEQ ID NO: 121200 - protein, 13 aa, Mycobacterium tuberculosis
FDEASRRNVDLVA

SEQ ID NO: 121201 - protein, 13 aa, Mycobacterium tuberculosis
DEASRRNVDLVAL

SEQ ID NO: 121202 - protein, 13 aa, Mycobacterium tuberculosis
EASRRNVDLVALH

SEQ ID NO: 121203 - protein, 13 aa, Mycobacterium tuberculosis
ASRRNVDLVALHA

SEQ ID NO: 121204 - protein, 13 aa, Mycobacterium tuberculosis
SRRNVDLVALHAW

SEQ ID NO: 121205 - protein, 13 aa, Mycobacterium tuberculosis
RRNVDLVALHAWS

SEQ ID NO: 121206 - protein, 13 aa, Mycobacterium tuberculosis
RNVDLVALHAWSD

SEQ ID NO: 121207 - protein, 13 aa, Mycobacterium tuberculosis
NVDLVALHAWSDV

SEQ ID NO: 121208 - protein, 13 aa, Mycobacterium tuberculosis
VDLVALHAWSDVD

SEQ ID NO: 121209 - protein, 13 aa, Mycobacterium tuberculosis
DLVALHAWSDVDV

SEQ ID NO: 121210 - protein, 13 aa, Mycobacterium tuberculosis
LVALHAWSDVDVS

SEQ ID NO: 121211 - protein, 13 aa, Mycobacterium tuberculosis
VALHAWSDVDVSE

SEQ ID NO: 121212 - protein, 13 aa, Mycobacterium tuberculosis
ALHAWSDVDVSEW

SEQ ID NO: 121213 - protein, 13 aa, Mycobacterium tuberculosis
LHAWSDVDVSEWP

SEQ ID NO: 121214 - protein, 13 aa, Mycobacterium tuberculosis
HAWSDVDVSEWPG

SEQ ID NO: 121215 - protein, 13 aa, Mycobacterium tuberculosis
AWSDVDVSEWPGI

SEQ ID NO: 121216 - protein, 13 aa, Mycobacterium tuberculosis
WSDVDVSEWPGID

SEQ ID NO: 121217 - protein, 13 aa, Mycobacterium tuberculosis
SDVDVSEWPGIDW

SEQ ID NO: 121218 - protein, 13 aa, Mycobacterium tuberculosis
DVDVSEWPGIDWP

SEQ ID NO: 121219 - protein, 13 aa, Mycobacterium tuberculosis
VDVSEWPGIDWPA

SEQ ID NO: 121220 - protein, 13 aa, Mycobacterium tuberculosis
DVSEWPGIDWPAT

SEQ ID NO: 121221 - protein, 13 aa, Mycobacterium tuberculosis
VSEWPGIDWPATQ

SEQ ID NO: 121222 - protein, 13 aa, Mycobacterium tuberculosis
SEWPGIDWPATQS

SEQ ID NO: 121223 - protein, 13 aa, Mycobacterium tuberculosis
EWPGIDWPATQSM

SEQ ID NO: 121224 - protein, 13 aa, Mycobacterium tuberculosis
WPGIDWPATQSMA

SEQ ID NO: 121225 - protein, 13 aa, Mycobacterium tuberculosis
PGIDWPATQSMAE

SEQ ID NO: 121226 - protein, 13 aa, Mycobacterium tuberculosis
GIDWPATQSMAEQ

SEQ ID NO: 121227 - protein, 13 aa, Mycobacterium tuberculosis
IDWPATQSMAEQV

SEQ ID NO: 121228 - protein, 13 aa, Mycobacterium tuberculosis
DWPATQSMAEQVL

SEQ ID NO: 121229 - protein, 13 aa, Mycobacterium tuberculosis
WPATQSMAEQVLA

SEQ ID NO: 121230 - protein, 13 aa, Mycobacterium tuberculosis
PATQSMAEQVLAE

SEQ ID NO: 121231 - protein, 13 aa, Mycobacterium tuberculosis
ATQSMAEQVLAER

SEQ ID NO: 121232 - protein, 13 aa, Mycobacterium tuberculosis
TQSMAEQVLAERL

SEQ ID NO: 121233 - protein, 13 aa, Mycobacterium tuberculosis
QSMAEQVLAERLA

SEQ ID NO: 121234 - protein, 13 aa, Mycobacterium tuberculosis
SMAEQVLAERLAG

SEQ ID NO: 121235 - protein, 13 aa, Mycobacterium tuberculosis
MAEQVLAERLAGW

SEQ ID NO: 121236 - protein, 13 aa, Mycobacterium tuberculosis
AEQVLAERLAGWQ

SEQ ID NO: 121237 - protein, 13 aa, Mycobacterium tuberculosis
EQVLAERLAGWQE

SEQ ID NO: 121238 - protein, 13 aa, Mycobacterium tuberculosis
QVLAERLAGWQER

SEQ ID NO: 121239 - protein, 13 aa, Mycobacterium tuberculosis
VLAERLAGWQERY

SEQ ID NO: 121240 - protein, 13 aa, Mycobacterium tuberculosis
LAERLAGWQERYP

SEQ ID NO: 121241 - protein, 13 aa, Mycobacterium tuberculosis
AERLAGWQERYPN

SEQ ID NO: 121242 - protein, 13 aa, Mycobacterium tuberculosis
ERLAGWQERYPNV

SEQ ID NO: 121243 - protein, 13 aa, Mycobacterium tuberculosis
RLAGWQERYPNVA

SEQ ID NO: 121244 - protein, 13 aa, Mycobacterium tuberculosis
LAGWQERYPNVAI

SEQ ID NO: 121245 - protein, 13 aa, Mycobacterium tuberculosis
AGWQERYPNVAIT

SEQ ID NO: 121246 - protein, 13 aa, Mycobacterium tuberculosis
GWQERYPNVAITR

SEQ ID NO: 121247 - protein, 13 aa, Mycobacterium tuberculosis
WQERYPNVAITRV

SEQ ID NO: 121248 - protein, 13 aa, Mycobacterium tuberculosis
QERYPNVAITRVV

SEQ ID NO: 121249 - protein, 13 aa, Mycobacterium tuberculosis
ERYPNVAITRVVV

SEQ ID NO: 121250 - protein, 13 aa, Mycobacterium tuberculosis
RYPNVAITRVVVR

SEQ ID NO: 121251 - protein, 13 aa, Mycobacterium tuberculosis
YPNVAITRVVVRD

SEQ ID NO: 121252 - protein, 13 aa, Mycobacterium tuberculosis
PNVAITRVVVRDQ

SEQ ID NO: 121253 - protein, 13 aa, Mycobacterium tuberculosis
NVAITRVVVRDQP

SEQ ID NO: 121254 - protein, 13 aa, Mycobacterium tuberculosis
VAITRVVVRDQPA

SEQ ID NO: 121255 - protein, 13 aa, Mycobacterium tuberculosis
AITRVVVRDQPAR

SEQ ID NO: 121256 - protein, 13 aa, Mycobacterium tuberculosis
ITRVVVRDQPARQ

SEQ ID NO: 121257 - protein, 13 aa, Mycobacterium tuberculosis
TRVVVRDQPARQL

SEQ ID NO: 121258 - protein, 13 aa, Mycobacterium tuberculosis
RVVVRDQPARQLV

SEQ ID NO: 121259 - protein, 13 aa, Mycobacterium tuberculosis
VVVRDQPARQLVQ

SEQ ID NO: 121260 - protein, 13 aa, Mycobacterium tuberculosis
VVRDQPARQLVQR

SEQ ID NO: 121261 - protein, 13 aa, Mycobacterium tuberculosis
VRDQPARQLVQRS

SEQ ID NO: 121262 - protein, 13 aa, Mycobacterium tuberculosis
RDQPARQLVQRSE

SEQ ID NO: 121263 - protein, 13 aa, Mycobacterium tuberculosis
DQPARQLVQRSEE

SEQ ID NO: 121264 - protein, 13 aa, Mycobacterium tuberculosis
QPARQLVQRSEEA

SEQ ID NO: 121265 - protein, 13 aa, Mycobacterium tuberculosis
PARQLVQRSEEAQ

SEQ ID NO: 121266 - protein, 13 aa, Mycobacterium tuberculosis
ARQLVQRSEEAQL

SEQ ID NO: 121267 - protein, 13 aa, Mycobacterium tuberculosis
RQLVQRSEEAQLV

SEQ ID NO: 121268 - protein, 13 aa, Mycobacterium tuberculosis
QLVQRSEEAQLVV

SEQ ID NO: 121269 - protein, 13 aa, Mycobacterium tuberculosis
LVQRSEEAQLVVV

SEQ ID NO: 121270 - protein, 13 aa, Mycobacterium tuberculosis
VQRSEEAQLVVVG

SEQ ID NO: 121271 - protein, 13 aa, Mycobacterium tuberculosis
QRSEEAQLVVVGS

SEQ ID NO: 121272 - protein, 13 aa, Mycobacterium tuberculosis
RSEEAQLVVVGSR

SEQ ID NO: 121273 - protein, 13 aa, Mycobacterium tuberculosis
SEEAQLVVVGSRG

SEQ ID NO: 121274 - protein, 13 aa, Mycobacterium tuberculosis
EEAQLVVVGSRGR

SEQ ID NO: 121275 - protein, 13 aa, Mycobacterium tuberculosis
EAQLVVVGSRGRG

SEQ ID NO: 121276 - protein, 13 aa, Mycobacterium tuberculosis
AQLVVVGSRGRGG

SEQ ID NO: 121277 - protein, 13 aa, Mycobacterium tuberculosis
QLVVVGSRGRGGY

SEQ ID NO: 121278 - protein, 13 aa, Mycobacterium tuberculosis
LVVVGSRGRGGYA

SEQ ID NO: 121279 - protein, 13 aa, Mycobacterium tuberculosis
VVVGSRGRGGYAG

SEQ ID NO: 121280 - protein, 13 aa, Mycobacterium tuberculosis
VVGSRGRGGYAGM

SEQ ID NO: 121281 - protein, 13 aa, Mycobacterium tuberculosis
VGSRGRGGYAGML

SEQ ID NO: 121282 - protein, 13 aa, Mycobacterium tuberculosis
GSRGRGGYAGMLV

SEQ ID NO: 121283 - protein, 13 aa, Mycobacterium tuberculosis
SRGRGGYAGMLVG

SEQ ID NO: 121284 - protein, 13 aa, Mycobacterium tuberculosis
RGRGGYAGMLVGS

SEQ ID NO: 121285 - protein, 13 aa, Mycobacterium tuberculosis
GRGGYAGMLVGSV

SEQ ID NO: 121286 - protein, 13 aa, Mycobacterium tuberculosis
RGGYAGMLVGSVG

SEQ ID NO: 121287 - protein, 13 aa, Mycobacterium tuberculosis
GGYAGMLVGSVGE

SEQ ID NO: 121288 - protein, 13 aa, Mycobacterium tuberculosis
GYAGMLVGSVGET

SEQ ID NO: 121289 - protein, 13 aa, Mycobacterium tuberculosis
YAGMLVGSVGETV

SEQ ID NO: 121290 - protein, 13 aa, Mycobacterium tuberculosis
AGMLVGSVGETVA

SEQ ID NO: 121291 - protein, 13 aa, Mycobacterium tuberculosis
GMLVGSVGETVAQ

SEQ ID NO: 121292 - protein, 13 aa, Mycobacterium tuberculosis
MLVGSVGETVAQL

SEQ ID NO: 121293 - protein, 13 aa, Mycobacterium tuberculosis
LVGSVGETVAQLA

SEQ ID NO: 121294 - protein, 13 aa, Mycobacterium tuberculosis
VGSVGETVAQLAR

SEQ ID NO: 121295 - protein, 13 aa, Mycobacterium tuberculosis
GSVGETVAQLART

SEQ ID NO: 121296 - protein, 13 aa, Mycobacterium tuberculosis
SVGETVAQLARTP

SEQ ID NO: 121297 - protein, 13 aa, Mycobacterium tuberculosis
VGETVAQLARTPV

SEQ ID NO: 121298 - protein, 13 aa, Mycobacterium tuberculosis
GETVAQLARTPVI

SEQ ID NO: 121299 - protein, 13 aa, Mycobacterium tuberculosis
ETVAQLARTPVIV

SEQ ID NO: 121300 - protein, 13 aa, Mycobacterium tuberculosis
TVAQLARTPVIVA

SEQ ID NO: 121301 - protein, 13 aa, Mycobacterium tuberculosis
VAQLARTPVIVAR

SEQ ID NO: 121302 - protein, 13 aa, Mycobacterium tuberculosis
AQLARTPVIVARE

SEQ ID NO: 121303 - protein, 13 aa, Mycobacterium tuberculosis
QLARTPVIVARES

SEQ ID NO: 121304 - protein, 13 aa, Mycobacterium tuberculosis
LARTPVIVARESL

SEQ ID NO: 121305 - protein, 13 aa, Mycobacterium tuberculosis
ARTPVIVARESLT

SEQ ID NO: 121306 - protein, 14 aa, Mycobacterium tuberculosis
MSSGNSSLGIIVGI

SEQ ID NO: 121307 - protein, 14 aa, Mycobacterium tuberculosis
SSGNSSLGIIVGID

SEQ ID NO: 121308 - protein, 14 aa, Mycobacterium tuberculosis
SGNSSLGIIVGIDD

SEQ ID NO: 121309 - protein, 14 aa, Mycobacterium tuberculosis
GNSSLGIIVGIDDS

SEQ ID NO: 121310 - protein, 14 aa, Mycobacterium tuberculosis
NSSLGIIVGIDDSP

SEQ ID NO: 121311 - protein, 14 aa, Mycobacterium tuberculosis
SSLGIIVGIDDSPA

SEQ ID NO: 121312 - protein, 14 aa, Mycobacterium tuberculosis
SLGIIVGIDDSPAA

SEQ ID NO: 121313 - protein, 14 aa, Mycobacterium tuberculosis
LGIIVGIDDSPAAQ

SEQ ID NO: 121314 - protein, 14 aa, Mycobacterium tuberculosis
GIIVGIDDSPAAQV

SEQ ID NO: 121315 - protein, 14 aa, Mycobacterium tuberculosis
IIVGIDDSPAAQVA

SEQ ID NO: 121316 - protein, 14 aa, Mycobacterium tuberculosis
IVGIDDSPAAQVAV

SEQ ID NO: 121317 - protein, 14 aa, Mycobacterium tuberculosis
VGIDDSPAAQVAVR

SEQ ID NO: 121318 - protein, 14 aa, Mycobacterium tuberculosis
GIDDSPAAQVAVRW

SEQ ID NO: 121319 - protein, 14 aa, Mycobacterium tuberculosis
IDDSPAAQVAVRWA

SEQ ID NO: 121320 - protein, 14 aa, Mycobacterium tuberculosis
DDSPAAQVAVRWAA

SEQ ID NO: 121321 - protein, 14 aa, Mycobacterium tuberculosis
DSPAAQVAVRWAAR

SEQ ID NO: 121322 - protein, 14 aa, Mycobacterium tuberculosis
SPAAQVAVRWAARD

SEQ ID NO: 121323 - protein, 14 aa, Mycobacterium tuberculosis
PAAQVAVRWAARDA

SEQ ID NO: 121324 - protein, 14 aa, Mycobacterium tuberculosis
AAQVAVRWAARDAE

SEQ ID NO: 121325 - protein, 14 aa, Mycobacterium tuberculosis
AQVAVRWAARDAEL

SEQ ID NO: 121326 - protein, 14 aa, Mycobacterium tuberculosis
QVAVRWAARDAELR

SEQ ID NO: 121327 - protein, 14 aa, Mycobacterium tuberculosis
VAVRWAARDAELRK

SEQ ID NO: 121328 - protein, 14 aa, Mycobacterium tuberculosis
AVRWAARDAELRKI

SEQ ID NO: 121329 - protein, 14 aa, Mycobacterium tuberculosis
VRWAARDAELRKIP

SEQ ID NO: 121330 - protein, 14 aa, Mycobacterium tuberculosis
RWAARDAELRKIPL

SEQ ID NO: 121331 - protein, 14 aa, Mycobacterium tuberculosis
WAARDAELRKIPLT

SEQ ID NO: 121332 - protein, 14 aa, Mycobacterium tuberculosis
AARDAELRKIPLTL

SEQ ID NO: 121333 - protein, 14 aa, Mycobacterium tuberculosis
ARDAELRKIPLTLV

SEQ ID NO: 121334 - protein, 14 aa, Mycobacterium tuberculosis
RDAELRKIPLTLVH

SEQ ID NO: 121335 - protein, 14 aa, Mycobacterium tuberculosis
DAELRKIPLTLVHA

SEQ ID NO: 121336 - protein, 14 aa, Mycobacterium tuberculosis
AELRKIPLTLVHAV

SEQ ID NO: 121337 - protein, 14 aa, Mycobacterium tuberculosis
ELRKIPLTLVHAVS

SEQ ID NO: 121338 - protein, 14 aa, Mycobacterium tuberculosis
LRKIPLTLVHAVSP

SEQ ID NO: 121339 - protein, 14 aa, Mycobacterium tuberculosis
RKIPLTLVHAVSPE

SEQ ID NO: 121340 - protein, 14 aa, Mycobacterium tuberculosis
KIPLTLVHAVSPEV

SEQ ID NO: 121341 - protein, 14 aa, Mycobacterium tuberculosis
IPLTLVHAVSPEVA

SEQ ID NO: 121342 - protein, 14 aa, Mycobacterium tuberculosis
PLTLVHAVSPEVAT

SEQ ID NO: 121343 - protein, 14 aa, Mycobacterium tuberculosis
LTLVHAVSPEVATW

SEQ ID NO: 121344 - protein, 14 aa, Mycobacterium tuberculosis
TLVHAVSPEVATWL

SEQ ID NO: 121345 - protein, 14 aa, Mycobacterium tuberculosis
LVHAVSPEVATWLE

SEQ ID NO: 121346 - protein, 14 aa, Mycobacterium tuberculosis
VHAVSPEVATWLEV

SEQ ID NO: 121347 - protein, 14 aa, Mycobacterium tuberculosis
HAVSPEVATWLEVP

SEQ ID NO: 121348 - protein, 14 aa, Mycobacterium tuberculosis
AVSPEVATWLEVPL

SEQ ID NO: 121349 - protein, 14 aa, Mycobacterium tuberculosis
VSPEVATWLEVPLP

SEQ ID NO: 121350 - protein, 14 aa, Mycobacterium tuberculosis
SPEVATWLEVPLPP

SEQ ID NO: 121351 - protein, 14 aa, Mycobacterium tuberculosis
PEVATWLEVPLPPG

SEQ ID NO: 121352 - protein, 14 aa, Mycobacterium tuberculosis
EVATWLEVPLPPGV

SEQ ID NO: 121353 - protein, 14 aa, Mycobacterium tuberculosis
VATWLEVPLPPGVL

SEQ ID NO: 121354 - protein, 14 aa, Mycobacterium tuberculosis
ATWLEVPLPPGVLR

SEQ ID NO: 121355 - protein, 14 aa, Mycobacterium tuberculosis
TWLEVPLPPGVLRW

SEQ ID NO: 121356 - protein, 14 aa, Mycobacterium tuberculosis
WLEVPLPPGVLRWQ

SEQ ID NO: 121357 - protein, 14 aa, Mycobacterium tuberculosis
LEVPLPPGVLRWQQ

SEQ ID NO: 121358 - protein, 14 aa, Mycobacterium tuberculosis
EVPLPPGVLRWQQD

SEQ ID NO: 121359 - protein, 14 aa, Mycobacterium tuberculosis
VPLPPGVLRWQQDH

SEQ ID NO: 121360 - protein, 14 aa, Mycobacterium tuberculosis
PLPPGVLRWQQDHG

SEQ ID NO: 121361 - protein, 14 aa, Mycobacterium tuberculosis
LPPGVLRWQQDHGR

SEQ ID NO: 121362 - protein, 14 aa, Mycobacterium tuberculosis
PPGVLRWQQDHGRH

SEQ ID NO: 121363 - protein, 14 aa, Mycobacterium tuberculosis
PGVLRWQQDHGRHL

SEQ ID NO: 121364 - protein, 14 aa, Mycobacterium tuberculosis
GVLRWQQDHGRHLI

SEQ ID NO: 121365 - protein, 14 aa, Mycobacterium tuberculosis
VLRWQQDHGRHLID

SEQ ID NO: 121366 - protein, 14 aa, Mycobacterium tuberculosis
LRWQQDHGRHLIDD

SEQ ID NO: 121367 - protein, 14 aa, Mycobacterium tuberculosis
RWQQDHGRHLIDDA

SEQ ID NO: 121368 - protein, 14 aa, Mycobacterium tuberculosis
WQQDHGRHLIDDAL

SEQ ID NO: 121369 - protein, 14 aa, Mycobacterium tuberculosis
QQDHGRHLIDDALK

SEQ ID NO: 121370 - protein, 14 aa, Mycobacterium tuberculosis
QDHGRHLIDDALKV

SEQ ID NO: 121371 - protein, 14 aa, Mycobacterium tuberculosis
DHGRHLIDDALKVV

SEQ ID NO: 121372 - protein, 14 aa, Mycobacterium tuberculosis
HGRHLIDDALKVVE

SEQ ID NO: 121373 - protein, 14 aa, Mycobacterium tuberculosis
GRHLIDDALKVVEQ

SEQ ID NO: 121374 - protein, 14 aa, Mycobacterium tuberculosis
RHLIDDALKVVEQA

SEQ ID NO: 121375 - protein, 14 aa, Mycobacterium tuberculosis
HLIDDALKVVEQAS

SEQ ID NO: 121376 - protein, 14 aa, Mycobacterium tuberculosis
LIDDALKVVEQASL

SEQ ID NO: 121377 - protein, 14 aa, Mycobacterium tuberculosis
IDDALKVVEQASLR

SEQ ID NO: 121378 - protein, 14 aa, Mycobacterium tuberculosis
DDALKVVEQASLRA

SEQ ID NO: 121379 - protein, 14 aa, Mycobacterium tuberculosis
DALKVVEQASLRAG

SEQ ID NO: 121380 - protein, 14 aa, Mycobacterium tuberculosis
ALKVVEQASLRAGP

SEQ ID NO: 121381 - protein, 14 aa, Mycobacterium tuberculosis
LKVVEQASLRAGPP

SEQ ID NO: 121382 - protein, 14 aa, Mycobacterium tuberculosis
KVVEQASLRAGPPT

SEQ ID NO: 121383 - protein, 14 aa, Mycobacterium tuberculosis
VVEQASLRAGPPTV

SEQ ID NO: 121384 - protein, 14 aa, Mycobacterium tuberculosis
VEQASLRAGPPTVH

SEQ ID NO: 121385 - protein, 14 aa, Mycobacterium tuberculosis
EQASLRAGPPTVHS

SEQ ID NO: 121386 - protein, 14 aa, Mycobacterium tuberculosis
QASLRAGPPTVHSE

SEQ ID NO: 121387 - protein, 14 aa, Mycobacterium tuberculosis
ASLRAGPPTVHSEI

SEQ ID NO: 121388 - protein, 14 aa, Mycobacterium tuberculosis
SLRAGPPTVHSEIV

SEQ ID NO: 121389 - protein, 14 aa, Mycobacterium tuberculosis
LRAGPPTVHSEIVP

SEQ ID NO: 121390 - protein, 14 aa, Mycobacterium tuberculosis
RAGPPTVHSEIVPA

SEQ ID NO: 121391 - protein, 14 aa, Mycobacterium tuberculosis
AGPPTVHSEIVPAA

SEQ ID NO: 121392 - protein, 14 aa, Mycobacterium tuberculosis
GPPTVHSEIVPAAA

SEQ ID NO: 121393 - protein, 14 aa, Mycobacterium tuberculosis
PPTVHSEIVPAAAV

SEQ ID NO: 121394 - protein, 14 aa, Mycobacterium tuberculosis
PTVHSEIVPAAAVP

SEQ ID NO: 121395 - protein, 14 aa, Mycobacterium tuberculosis
TVHSEIVPAAAVPT

SEQ ID NO: 121396 - protein, 14 aa, Mycobacterium tuberculosis
VHSEIVPAAAVPTL

SEQ ID NO: 121397 - protein, 14 aa, Mycobacterium tuberculosis
HSEIVPAAAVPTLV

SEQ ID NO: 121398 - protein, 14 aa, Mycobacterium tuberculosis
SEIVPAAAVPTLVD

SEQ ID NO: 121399 - protein, 14 aa, Mycobacterium tuberculosis
EIVPAAAVPTLVDM

SEQ ID NO: 121400 - protein, 14 aa, Mycobacterium tuberculosis
IVPAAAVPTLVDMS

SEQ ID NO: 121401 - protein, 14 aa, Mycobacterium tuberculosis
VPAAAVPTLVDMSK

SEQ ID NO: 121402 - protein, 14 aa, Mycobacterium tuberculosis
PAAAVPTLVDMSKD

SEQ ID NO: 121403 - protein, 14 aa, Mycobacterium tuberculosis
AAAVPTLVDMSKDA

SEQ ID NO: 121404 - protein, 14 aa, Mycobacterium tuberculosis
AAVPTLVDMSKDAV

SEQ ID NO: 121405 - protein, 14 aa, Mycobacterium tuberculosis
AVPTLVDMSKDAVL

SEQ ID NO: 121406 - protein, 14 aa, Mycobacterium tuberculosis
VPTLVDMSKDAVLM

SEQ ID NO: 121407 - protein, 14 aa, Mycobacterium tuberculosis
PTLVDMSKDAVLMV

SEQ ID NO: 121408 - protein, 14 aa, Mycobacterium tuberculosis
TLVDMSKDAVLMVV

SEQ ID NO: 121409 - protein, 14 aa, Mycobacterium tuberculosis
LVDMSKDAVLMVVG

SEQ ID NO: 121410 - protein, 14 aa, Mycobacterium tuberculosis
VDMSKDAVLMVVGC

SEQ ID NO: 121411 - protein, 14 aa, Mycobacterium tuberculosis
DMSKDAVLMVVGCL

SEQ ID NO: 121412 - protein, 14 aa, Mycobacterium tuberculosis
MSKDAVLMVVGCLG

SEQ ID NO: 121413 - protein, 14 aa, Mycobacterium tuberculosis
SKDAVLMVVGCLGS

SEQ ID NO: 121414 - protein, 14 aa, Mycobacterium tuberculosis
KDAVLMVVGCLGSG

SEQ ID NO: 121415 - protein, 14 aa, Mycobacterium tuberculosis
DAVLMVVGCLGSGR

SEQ ID NO: 121416 - protein, 14 aa, Mycobacterium tuberculosis
AVLMVVGCLGSGRW

SEQ ID NO: 121417 - protein, 14 aa, Mycobacterium tuberculosis
VLMVVGCLGSGRWP

SEQ ID NO: 121418 - protein, 14 aa, Mycobacterium tuberculosis
LMVVGCLGSGRWPG

SEQ ID NO: 121419 - protein, 14 aa, Mycobacterium tuberculosis
MVVGCLGSGRWPGR

SEQ ID NO: 121420 - protein, 14 aa, Mycobacterium tuberculosis
VVGCLGSGRWPGRL

SEQ ID NO: 121421 - protein, 14 aa, Mycobacterium tuberculosis
VGCLGSGRWPGRLL

SEQ ID NO: 121422 - protein, 14 aa, Mycobacterium tuberculosis
GCLGSGRWPGRLLG

SEQ ID NO: 121423 - protein, 14 aa, Mycobacterium tuberculosis
CLGSGRWPGRLLGS

SEQ ID NO: 121424 - protein, 14 aa, Mycobacterium tuberculosis
LGSGRWPGRLLGSV

SEQ ID NO: 121425 - protein, 14 aa, Mycobacterium tuberculosis
GSGRWPGRLLGSVS

SEQ ID NO: 121426 - protein, 14 aa, Mycobacterium tuberculosis
SGRWPGRLLGSVSS

SEQ ID NO: 121427 - protein, 14 aa, Mycobacterium tuberculosis
GRWPGRLLGSVSSG

SEQ ID NO: 121428 - protein, 14 aa, Mycobacterium tuberculosis
RWPGRLLGSVSSGL

SEQ ID NO: 121429 - protein, 14 aa, Mycobacterium tuberculosis
WPGRLLGSVSSGLL

SEQ ID NO: 121430 - protein, 14 aa, Mycobacterium tuberculosis
PGRLLGSVSSGLLR

SEQ ID NO: 121431 - protein, 14 aa, Mycobacterium tuberculosis
GRLLGSVSSGLLRH

SEQ ID NO: 121432 - protein, 14 aa, Mycobacterium tuberculosis
RLLGSVSSGLLRHA

SEQ ID NO: 121433 - protein, 14 aa, Mycobacterium tuberculosis
LLGSVSSGLLRHAH

SEQ ID NO: 121434 - protein, 14 aa, Mycobacterium tuberculosis
LGSVSSGLLRHAHC

SEQ ID NO: 121435 - protein, 14 aa, Mycobacterium tuberculosis
GSVSSGLLRHAHCP

SEQ ID NO: 121436 - protein, 14 aa, Mycobacterium tuberculosis
SVSSGLLRHAHCPV

SEQ ID NO: 121437 - protein, 14 aa, Mycobacterium tuberculosis
VSSGLLRHAHCPVV

SEQ ID NO: 121438 - protein, 14 aa, Mycobacterium tuberculosis
SSGLLRHAHCPVVI

SEQ ID NO: 121439 - protein, 14 aa, Mycobacterium tuberculosis
SGLLRHAHCPVVII

SEQ ID NO: 121440 - protein, 14 aa, Mycobacterium tuberculosis
GLLRHAHCPVVIIH

SEQ ID NO: 121441 - protein, 14 aa, Mycobacterium tuberculosis
LLRHAHCPVVIIHD

SEQ ID NO: 121442 - protein, 14 aa, Mycobacterium tuberculosis
LRHAHCPVVIIHDE

SEQ ID NO: 121443 - protein, 14 aa, Mycobacterium tuberculosis
RHAHCPVVIIHDED

SEQ ID NO: 121444 - protein, 14 aa, Mycobacterium tuberculosis
HAHCPVVIIHDEDS

SEQ ID NO: 121445 - protein, 14 aa, Mycobacterium tuberculosis
AHCPVVIIHDEDSV

SEQ ID NO: 121446 - protein, 14 aa, Mycobacterium tuberculosis
HCPVVIIHDEDSVM

SEQ ID NO: 121447 - protein, 14 aa, Mycobacterium tuberculosis
CPVVIIHDEDSVMP

SEQ ID NO: 121448 - protein, 14 aa, Mycobacterium tuberculosis
PVVIIHDEDSVMPH

SEQ ID NO: 121449 - protein, 14 aa, Mycobacterium tuberculosis
VVIIHDEDSVMPHP

SEQ ID NO: 121450 - protein, 14 aa, Mycobacterium tuberculosis
VIIHDEDSVMPHPQ

SEQ ID NO: 121451 - protein, 14 aa, Mycobacterium tuberculosis
IIHDEDSVMPHPQQ

SEQ ID NO: 121452 - protein, 14 aa, Mycobacterium tuberculosis
IHDEDSVMPHPQQA

SEQ ID NO: 121453 - protein, 14 aa, Mycobacterium tuberculosis
HDEDSVMPHPQQAP

SEQ ID NO: 121454 - protein, 14 aa, Mycobacterium tuberculosis
DEDSVMPHPQQAPV

SEQ ID NO: 121455 - protein, 14 aa, Mycobacterium tuberculosis
EDSVMPHPQQAPVL

SEQ ID NO: 121456 - protein, 14 aa, Mycobacterium tuberculosis
DSVMPHPQQAPVLV

SEQ ID NO: 121457 - protein, 14 aa, Mycobacterium tuberculosis
SVMPHPQQAPVLVG

SEQ ID NO: 121458 - protein, 14 aa, Mycobacterium tuberculosis
VMPHPQQAPVLVGV

SEQ ID NO: 121459 - protein, 14 aa, Mycobacterium tuberculosis
MPHPQQAPVLVGVD

SEQ ID NO: 121460 - protein, 14 aa, Mycobacterium tuberculosis
PHPQQAPVLVGVDG

SEQ ID NO: 121461 - protein, 14 aa, Mycobacterium tuberculosis
HPQQAPVLVGVDGS

SEQ ID NO: 121462 - protein, 14 aa, Mycobacterium tuberculosis
PQQAPVLVGVDGSS

SEQ ID NO: 121463 - protein, 14 aa, Mycobacterium tuberculosis
QQAPVLVGVDGSSA

SEQ ID NO: 121464 - protein, 14 aa, Mycobacterium tuberculosis
QAPVLVGVDGSSAS

SEQ ID NO: 121465 - protein, 14 aa, Mycobacterium tuberculosis
APVLVGVDGSSASE

SEQ ID NO: 121466 - protein, 14 aa, Mycobacterium tuberculosis
PVLVGVDGSSASEL

SEQ ID NO: 121467 - protein, 14 aa, Mycobacterium tuberculosis
VLVGVDGSSASELA

SEQ ID NO: 121468 - protein, 14 aa, Mycobacterium tuberculosis
LVGVDGSSASELAT

SEQ ID NO: 121469 - protein, 14 aa, Mycobacterium tuberculosis
VGVDGSSASELATA

SEQ ID NO: 121470 - protein, 14 aa, Mycobacterium tuberculosis
GVDGSSASELATAI

SEQ ID NO: 121471 - protein, 14 aa, Mycobacterium tuberculosis
VDGSSASELATAIA

SEQ ID NO: 121472 - protein, 14 aa, Mycobacterium tuberculosis
DGSSASELATAIAF

SEQ ID NO: 121473 - protein, 14 aa, Mycobacterium tuberculosis
GSSASELATAIAFD

SEQ ID NO: 121474 - protein, 14 aa, Mycobacterium tuberculosis
SSASELATAIAFDE

SEQ ID NO: 121475 - protein, 14 aa, Mycobacterium tuberculosis
SASELATAIAFDEA

SEQ ID NO: 121476 - protein, 14 aa, Mycobacterium tuberculosis
ASELATAIAFDEAS

SEQ ID NO: 121477 - protein, 14 aa, Mycobacterium tuberculosis
SELATAIAFDEASR

SEQ ID NO: 121478 - protein, 14 aa, Mycobacterium tuberculosis
ELATAIAFDEASRR

SEQ ID NO: 121479 - protein, 14 aa, Mycobacterium tuberculosis
LATAIAFDEASRRN

SEQ ID NO: 121480 - protein, 14 aa, Mycobacterium tuberculosis
ATAIAFDEASRRNV

SEQ ID NO: 121481 - protein, 14 aa, Mycobacterium tuberculosis
TAIAFDEASRRNVD

SEQ ID NO: 121482 - protein, 14 aa, Mycobacterium tuberculosis
AIAFDEASRRNVDL

SEQ ID NO: 121483 - protein, 14 aa, Mycobacterium tuberculosis
IAFDEASRRNVDLV

SEQ ID NO: 121484 - protein, 14 aa, Mycobacterium tuberculosis
AFDEASRRNVDLVA

SEQ ID NO: 121485 - protein, 14 aa, Mycobacterium tuberculosis
FDEASRRNVDLVAL

SEQ ID NO: 121486 - protein, 14 aa, Mycobacterium tuberculosis
DEASRRNVDLVALH

SEQ ID NO: 121487 - protein, 14 aa, Mycobacterium tuberculosis
EASRRNVDLVALHA

SEQ ID NO: 121488 - protein, 14 aa, Mycobacterium tuberculosis
ASRRNVDLVALHAW

SEQ ID NO: 121489 - protein, 14 aa, Mycobacterium tuberculosis
SRRNVDLVALHAWS

SEQ ID NO: 121490 - protein, 14 aa, Mycobacterium tuberculosis
RRNVDLVALHAWSD

SEQ ID NO: 121491 - protein, 14 aa, Mycobacterium tuberculosis
RNVDLVALHAWSDV

SEQ ID NO: 121492 - protein, 14 aa, Mycobacterium tuberculosis
NVDLVALHAWSDVD

SEQ ID NO: 121493 - protein, 14 aa, Mycobacterium tuberculosis
VDLVALHAWSDVDV

SEQ ID NO: 121494 - protein, 14 aa, Mycobacterium tuberculosis
DLVALHAWSDVDVS

SEQ ID NO: 121495 - protein, 14 aa, Mycobacterium tuberculosis
LVALHAWSDVDVSE

SEQ ID NO: 121496 - protein, 14 aa, Mycobacterium tuberculosis
VALHAWSDVDVSEW

SEQ ID NO: 121497 - protein, 14 aa, Mycobacterium tuberculosis
ALHAWSDVDVSEWP

SEQ ID NO: 121498 - protein, 14 aa, Mycobacterium tuberculosis
LHAWSDVDVSEWPG

SEQ ID NO: 121499 - protein, 14 aa, Mycobacterium tuberculosis
HAWSDVDVSEWPGI

SEQ ID NO: 121500 - protein, 14 aa, Mycobacterium tuberculosis
AWSDVDVSEWPGID

SEQ ID NO: 121501 - protein, 14 aa, Mycobacterium tuberculosis
WSDVDVSEWPGIDW

SEQ ID NO: 121502 - protein, 14 aa, Mycobacterium tuberculosis
SDVDVSEWPGIDWP

SEQ ID NO: 121503 - protein, 14 aa, Mycobacterium tuberculosis
DVDVSEWPGIDWPA

SEQ ID NO: 121504 - protein, 14 aa, Mycobacterium tuberculosis
VDVSEWPGIDWPAT

SEQ ID NO: 121505 - protein, 14 aa, Mycobacterium tuberculosis
DVSEWPGIDWPATQ

SEQ ID NO: 121506 - protein, 14 aa, Mycobacterium tuberculosis
VSEWPGIDWPATQS

SEQ ID NO: 121507 - protein, 14 aa, Mycobacterium tuberculosis
SEWPGIDWPATQSM

SEQ ID NO: 121508 - protein, 14 aa, Mycobacterium tuberculosis
EWPGIDWPATQSMA

SEQ ID NO: 121509 - protein, 14 aa, Mycobacterium tuberculosis
WPGIDWPATQSMAE

SEQ ID NO: 121510 - protein, 14 aa, Mycobacterium tuberculosis
PGIDWPATQSMAEQ

SEQ ID NO: 121511 - protein, 14 aa, Mycobacterium tuberculosis
GIDWPATQSMAEQV

SEQ ID NO: 121512 - protein, 14 aa, Mycobacterium tuberculosis
IDWPATQSMAEQVL

SEQ ID NO: 121513 - protein, 14 aa, Mycobacterium tuberculosis
DWPATQSMAEQVLA

SEQ ID NO: 121514 - protein, 14 aa, Mycobacterium tuberculosis
WPATQSMAEQVLAE

SEQ ID NO: 121515 - protein, 14 aa, Mycobacterium tuberculosis
PATQSMAEQVLAER

SEQ ID NO: 121516 - protein, 14 aa, Mycobacterium tuberculosis
ATQSMAEQVLAERL

SEQ ID NO: 121517 - protein, 14 aa, Mycobacterium tuberculosis
TQSMAEQVLAERLA

SEQ ID NO: 121518 - protein, 14 aa, Mycobacterium tuberculosis
QSMAEQVLAERLAG

SEQ ID NO: 121519 - protein, 14 aa, Mycobacterium tuberculosis
SMAEQVLAERLAGW

SEQ ID NO: 121520 - protein, 14 aa, Mycobacterium tuberculosis
MAEQVLAERLAGWQ

SEQ ID NO: 121521 - protein, 14 aa, Mycobacterium tuberculosis
AEQVLAERLAGWQE

SEQ ID NO: 121522 - protein, 14 aa, Mycobacterium tuberculosis
EQVLAERLAGWQER

SEQ ID NO: 121523 - protein, 14 aa, Mycobacterium tuberculosis
QVLAERLAGWQERY

SEQ ID NO: 121524 - protein, 14 aa, Mycobacterium tuberculosis
VLAERLAGWQERYP

SEQ ID NO: 121525 - protein, 14 aa, Mycobacterium tuberculosis
LAERLAGWQERYPN

SEQ ID NO: 121526 - protein, 14 aa, Mycobacterium tuberculosis
AERLAGWQERYPNV

SEQ ID NO: 121527 - protein, 14 aa, Mycobacterium tuberculosis
ERLAGWQERYPNVA

SEQ ID NO: 121528 - protein, 14 aa, Mycobacterium tuberculosis
RLAGWQERYPNVAI

SEQ ID NO: 121529 - protein, 14 aa, Mycobacterium tuberculosis
LAGWQERYPNVAIT

SEQ ID NO: 121530 - protein, 14 aa, Mycobacterium tuberculosis
AGWQERYPNVAITR

SEQ ID NO: 121531 - protein, 14 aa, Mycobacterium tuberculosis
GWQERYPNVAITRV

SEQ ID NO: 121532 - protein, 14 aa, Mycobacterium tuberculosis
WQERYPNVAITRVV

SEQ ID NO: 121533 - protein, 14 aa, Mycobacterium tuberculosis
QERYPNVAITRVVV

SEQ ID NO: 121534 - protein, 14 aa, Mycobacterium tuberculosis
ERYPNVAITRVVVR

SEQ ID NO: 121535 - protein, 14 aa, Mycobacterium tuberculosis
RYPNVAITRVVVRD

SEQ ID NO: 121536 - protein, 14 aa, Mycobacterium tuberculosis
YPNVAITRVVVRDQ

SEQ ID NO: 121537 - protein, 14 aa, Mycobacterium tuberculosis
PNVAITRVVVRDQP

SEQ ID NO: 121538 - protein, 14 aa, Mycobacterium tuberculosis
NVAITRVVVRDQPA

SEQ ID NO: 121539 - protein, 14 aa, Mycobacterium tuberculosis
VAITRVVVRDQPAR

SEQ ID NO: 121540 - protein, 14 aa, Mycobacterium tuberculosis
AITRVVVRDQPARQ

SEQ ID NO: 121541 - protein, 14 aa, Mycobacterium tuberculosis
ITRVVVRDQPARQL

SEQ ID NO: 121542 - protein, 14 aa, Mycobacterium tuberculosis
TRVVVRDQPARQLV

SEQ ID NO: 121543 - protein, 14 aa, Mycobacterium tuberculosis
RVVVRDQPARQLVQ

SEQ ID NO: 121544 - protein, 14 aa, Mycobacterium tuberculosis
VVVRDQPARQLVQR

SEQ ID NO: 121545 - protein, 14 aa, Mycobacterium tuberculosis
VVRDQPARQLVQRS

SEQ ID NO: 121546 - protein, 14 aa, Mycobacterium tuberculosis
VRDQPARQLVQRSE

SEQ ID NO: 121547 - protein, 14 aa, Mycobacterium tuberculosis
RDQPARQLVQRSEE

SEQ ID NO: 121548 - protein, 14 aa, Mycobacterium tuberculosis
DQPARQLVQRSEEA

SEQ ID NO: 121549 - protein, 14 aa, Mycobacterium tuberculosis
QPARQLVQRSEEAQ

SEQ ID NO: 121550 - protein, 14 aa, Mycobacterium tuberculosis
PARQLVQRSEEAQL

SEQ ID NO: 121551 - protein, 14 aa, Mycobacterium tuberculosis
ARQLVQRSEEAQLV

SEQ ID NO: 121552 - protein, 14 aa, Mycobacterium tuberculosis
RQLVQRSEEAQLVV

SEQ ID NO: 121553 - protein, 14 aa, Mycobacterium tuberculosis
QLVQRSEEAQLVVV

SEQ ID NO: 121554 - protein, 14 aa, Mycobacterium tuberculosis
LVQRSEEAQLVVVG

SEQ ID NO: 121555 - protein, 14 aa, Mycobacterium tuberculosis
VQRSEEAQLVVVGS

SEQ ID NO: 121556 - protein, 14 aa, Mycobacterium tuberculosis
QRSEEAQLVVVGSR

SEQ ID NO: 121557 - protein, 14 aa, Mycobacterium tuberculosis
RSEEAQLVVVGSRG

SEQ ID NO: 121558 - protein, 14 aa, Mycobacterium tuberculosis
SEEAQLVVVGSRGR

SEQ ID NO: 121559 - protein, 14 aa, Mycobacterium tuberculosis
EEAQLVVVGSRGRG

SEQ ID NO: 121560 - protein, 14 aa, Mycobacterium tuberculosis
EAQLVVVGSRGRGG

SEQ ID NO: 121561 - protein, 14 aa, Mycobacterium tuberculosis
AQLVVVGSRGRGGY

SEQ ID NO: 121562 - protein, 14 aa, Mycobacterium tuberculosis
QLVVVGSRGRGGYA

SEQ ID NO: 121563 - protein, 14 aa, Mycobacterium tuberculosis
LVVVGSRGRGGYAG

SEQ ID NO: 121564 - protein, 14 aa, Mycobacterium tuberculosis
VVVGSRGRGGYAGM

SEQ ID NO: 121565 - protein, 14 aa, Mycobacterium tuberculosis
VVGSRGRGGYAGML

SEQ ID NO: 121566 - protein, 14 aa, Mycobacterium tuberculosis
VGSRGRGGYAGMLV

SEQ ID NO: 121567 - protein, 14 aa, Mycobacterium tuberculosis
GSRGRGGYAGMLVG

SEQ ID NO: 121568 - protein, 14 aa, Mycobacterium tuberculosis
SRGRGGYAGMLVGS

SEQ ID NO: 121569 - protein, 14 aa, Mycobacterium tuberculosis
RGRGGYAGMLVGSV

SEQ ID NO: 121570 - protein, 14 aa, Mycobacterium tuberculosis
GRGGYAGMLVGSVG

SEQ ID NO: 121571 - protein, 14 aa, Mycobacterium tuberculosis
RGGYAGMLVGSVGE

SEQ ID NO: 121572 - protein, 14 aa, Mycobacterium tuberculosis
GGYAGMLVGSVGET

SEQ ID NO: 121573 - protein, 14 aa, Mycobacterium tuberculosis
GYAGMLVGSVGETV

SEQ ID NO: 121574 - protein, 14 aa, Mycobacterium tuberculosis
YAGMLVGSVGETVA

SEQ ID NO: 121575 - protein, 14 aa, Mycobacterium tuberculosis
AGMLVGSVGETVAQ

SEQ ID NO: 121576 - protein, 14 aa, Mycobacterium tuberculosis
GMLVGSVGETVAQL

SEQ ID NO: 121577 - protein, 14 aa, Mycobacterium tuberculosis
MLVGSVGETVAQLA

SEQ ID NO: 121578 - protein, 14 aa, Mycobacterium tuberculosis
LVGSVGETVAQLAR

SEQ ID NO: 121579 - protein, 14 aa, Mycobacterium tuberculosis
VGSVGETVAQLART

SEQ ID NO: 121580 - protein, 14 aa, Mycobacterium tuberculosis
GSVGETVAQLARTP

SEQ ID NO: 121581 - protein, 14 aa, Mycobacterium tuberculosis
SVGETVAQLARTPV

SEQ ID NO: 121582 - protein, 14 aa, Mycobacterium tuberculosis
VGETVAQLARTPVI

SEQ ID NO: 121583 - protein, 14 aa, Mycobacterium tuberculosis
GETVAQLARTPVIV

SEQ ID NO: 121584 - protein, 14 aa, Mycobacterium tuberculosis
ETVAQLARTPVIVA

SEQ ID NO: 121585 - protein, 14 aa, Mycobacterium tuberculosis
TVAQLARTPVIVAR

SEQ ID NO: 121586 - protein, 14 aa, Mycobacterium tuberculosis
VAQLARTPVIVARE

SEQ ID NO: 121587 - protein, 14 aa, Mycobacterium tuberculosis
AQLARTPVIVARES

SEQ ID NO: 121588 - protein, 14 aa, Mycobacterium tuberculosis
QLARTPVIVARESL

SEQ ID NO: 121589 - protein, 14 aa, Mycobacterium tuberculosis
LARTPVIVARESLT

SEQ ID NO: 121590 - protein, 15 aa, Mycobacterium tuberculosis
MSSGNSSLGIIVGID

SEQ ID NO: 121591 - protein, 15 aa, Mycobacterium tuberculosis
SSGNSSLGIIVGIDD

SEQ ID NO: 121592 - protein, 15 aa, Mycobacterium tuberculosis
SGNSSLGIIVGIDDS

SEQ ID NO: 121593 - protein, 15 aa, Mycobacterium tuberculosis
GNSSLGIIVGIDDSP

SEQ ID NO: 121594 - protein, 15 aa, Mycobacterium tuberculosis
NSSLGIIVGIDDSPA

SEQ ID NO: 121595 - protein, 15 aa, Mycobacterium tuberculosis
SSLGIIVGIDDSPAA

SEQ ID NO: 121596 - protein, 15 aa, Mycobacterium tuberculosis
SLGIIVGIDDSPAAQ

SEQ ID NO: 121597 - protein, 15 aa, Mycobacterium tuberculosis
LGIIVGIDDSPAAQV

SEQ ID NO: 121598 - protein, 15 aa, Mycobacterium tuberculosis
GIIVGIDDSPAAQVA

SEQ ID NO: 121599 - protein, 15 aa, Mycobacterium tuberculosis
IIVGIDDSPAAQVAV

SEQ ID NO: 121600 - protein, 15 aa, Mycobacterium tuberculosis
IVGIDDSPAAQVAVR

SEQ ID NO: 121601 - protein, 15 aa, Mycobacterium tuberculosis
VGIDDSPAAQVAVRW

SEQ ID NO: 121602 - protein, 15 aa, Mycobacterium tuberculosis
GIDDSPAAQVAVRWA

SEQ ID NO: 121603 - protein, 15 aa, Mycobacterium tuberculosis
IDDSPAAQVAVRWAA

SEQ ID NO: 121604 - protein, 15 aa, Mycobacterium tuberculosis
DDSPAAQVAVRWAAR

SEQ ID NO: 121605 - protein, 15 aa, Mycobacterium tuberculosis
DSPAAQVAVRWAARD

SEQ ID NO: 121606 - protein, 15 aa, Mycobacterium tuberculosis
SPAAQVAVRWAARDA

SEQ ID NO: 121607 - protein, 15 aa, Mycobacterium tuberculosis
PAAQVAVRWAARDAE

SEQ ID NO: 121608 - protein, 15 aa, Mycobacterium tuberculosis
AAQVAVRWAARDAEL

SEQ ID NO: 121609 - protein, 15 aa, Mycobacterium tuberculosis
AQVAVRWAARDAELR

SEQ ID NO: 121610 - protein, 15 aa, Mycobacterium tuberculosis
QVAVRWAARDAELRK

SEQ ID NO: 121611 - protein, 15 aa, Mycobacterium tuberculosis
VAVRWAARDAELRKI

SEQ ID NO: 121612 - protein, 15 aa, Mycobacterium tuberculosis
AVRWAARDAELRKIP

SEQ ID NO: 121613 - protein, 15 aa, Mycobacterium tuberculosis
VRWAARDAELRKIPL

SEQ ID NO: 121614 - protein, 15 aa, Mycobacterium tuberculosis
RWAARDAELRKIPLT

SEQ ID NO: 121615 - protein, 15 aa, Mycobacterium tuberculosis
WAARDAELRKIPLTL

SEQ ID NO: 121616 - protein, 15 aa, Mycobacterium tuberculosis
AARDAELRKIPLTLV

SEQ ID NO: 121617 - protein, 15 aa, Mycobacterium tuberculosis
ARDAELRKIPLTLVH

SEQ ID NO: 121618 - protein, 15 aa, Mycobacterium tuberculosis
RDAELRKIPLTLVHA

SEQ ID NO: 121619 - protein, 15 aa, Mycobacterium tuberculosis
DAELRKIPLTLVHAV

SEQ ID NO: 121620 - protein, 15 aa, Mycobacterium tuberculosis
AELRKIPLTLVHAVS

SEQ ID NO: 121621 - protein, 15 aa, Mycobacterium tuberculosis
ELRKIPLTLVHAVSP

SEQ ID NO: 121622 - protein, 15 aa, Mycobacterium tuberculosis
LRKIPLTLVHAVSPE

SEQ ID NO: 121623 - protein, 15 aa, Mycobacterium tuberculosis
RKIPLTLVHAVSPEV

SEQ ID NO: 121624 - protein, 15 aa, Mycobacterium tuberculosis
KIPLTLVHAVSPEVA

SEQ ID NO: 121625 - protein, 15 aa, Mycobacterium tuberculosis
IPLTLVHAVSPEVAT

SEQ ID NO: 121626 - protein, 15 aa, Mycobacterium tuberculosis
PLTLVHAVSPEVATW

SEQ ID NO: 121627 - protein, 15 aa, Mycobacterium tuberculosis
LTLVHAVSPEVATWL

SEQ ID NO: 121628 - protein, 15 aa, Mycobacterium tuberculosis
TLVHAVSPEVATWLE

SEQ ID NO: 121629 - protein, 15 aa, Mycobacterium tuberculosis
LVHAVSPEVATWLEV

SEQ ID NO: 121630 - protein, 15 aa, Mycobacterium tuberculosis
VHAVSPEVATWLEVP

SEQ ID NO: 121631 - protein, 15 aa, Mycobacterium tuberculosis
HAVSPEVATWLEVPL

SEQ ID NO: 121632 - protein, 15 aa, Mycobacterium tuberculosis
AVSPEVATWLEVPLP

SEQ ID NO: 121633 - protein, 15 aa, Mycobacterium tuberculosis
VSPEVATWLEVPLPP

SEQ ID NO: 121634 - protein, 15 aa, Mycobacterium tuberculosis
SPEVATWLEVPLPPG

SEQ ID NO: 121635 - protein, 15 aa, Mycobacterium tuberculosis
PEVATWLEVPLPPGV

SEQ ID NO: 121636 - protein, 15 aa, Mycobacterium tuberculosis
EVATWLEVPLPPGVL

SEQ ID NO: 121637 - protein, 15 aa, Mycobacterium tuberculosis
VATWLEVPLPPGVLR

SEQ ID NO: 121638 - protein, 15 aa, Mycobacterium tuberculosis
ATWLEVPLPPGVLRW

SEQ ID NO: 121639 - protein, 15 aa, Mycobacterium tuberculosis
TWLEVPLPPGVLRWQ

SEQ ID NO: 121640 - protein, 15 aa, Mycobacterium tuberculosis
WLEVPLPPGVLRWQQ

SEQ ID NO: 121641 - protein, 15 aa, Mycobacterium tuberculosis
LEVPLPPGVLRWQQD

SEQ ID NO: 121642 - protein, 15 aa, Mycobacterium tuberculosis
EVPLPPGVLRWQQDH

SEQ ID NO: 121643 - protein, 15 aa, Mycobacterium tuberculosis
VPLPPGVLRWQQDHG

SEQ ID NO: 121644 - protein, 15 aa, Mycobacterium tuberculosis
PLPPGVLRWQQDHGR

SEQ ID NO: 121645 - protein, 15 aa, Mycobacterium tuberculosis
LPPGVLRWQQDHGRH

SEQ ID NO: 121646 - protein, 15 aa, Mycobacterium tuberculosis
PPGVLRWQQDHGRHL

SEQ ID NO: 121647 - protein, 15 aa, Mycobacterium tuberculosis
PGVLRWQQDHGRHLI

SEQ ID NO: 121648 - protein, 15 aa, Mycobacterium tuberculosis
GVLRWQQDHGRHLID

SEQ ID NO: 121649 - protein, 15 aa, Mycobacterium tuberculosis
VLRWQQDHGRHLIDD

SEQ ID NO: 121650 - protein, 15 aa, Mycobacterium tuberculosis
LRWQQDHGRHLIDDA

SEQ ID NO: 121651 - protein, 15 aa, Mycobacterium tuberculosis
RWQQDHGRHLIDDAL

SEQ ID NO: 121652 - protein, 15 aa, Mycobacterium tuberculosis
WQQDHGRHLIDDALK

SEQ ID NO: 121653 - protein, 15 aa, Mycobacterium tuberculosis
QQDHGRHLIDDALKV

SEQ ID NO: 121654 - protein, 15 aa, Mycobacterium tuberculosis
QDHGRHLIDDALKVV

SEQ ID NO: 121655 - protein, 15 aa, Mycobacterium tuberculosis
DHGRHLIDDALKVVE

SEQ ID NO: 121656 - protein, 15 aa, Mycobacterium tuberculosis
HGRHLIDDALKVVEQ

SEQ ID NO: 121657 - protein, 15 aa, Mycobacterium tuberculosis
GRHLIDDALKVVEQA

SEQ ID NO: 121658 - protein, 15 aa, Mycobacterium tuberculosis
RHLIDDALKVVEQAS

SEQ ID NO: 121659 - protein, 15 aa, Mycobacterium tuberculosis
HLIDDALKVVEQASL

SEQ ID NO: 121660 - protein, 15 aa, Mycobacterium tuberculosis
LIDDALKVVEQASLR

SEQ ID NO: 121661 - protein, 15 aa, Mycobacterium tuberculosis
IDDALKVVEQASLRA

SEQ ID NO: 121662 - protein, 15 aa, Mycobacterium tuberculosis
DDALKVVEQASLRAG

SEQ ID NO: 121663 - protein, 15 aa, Mycobacterium tuberculosis
DALKVVEQASLRAGP

SEQ ID NO: 121664 - protein, 15 aa, Mycobacterium tuberculosis
ALKVVEQASLRAGPP

SEQ ID NO: 121665 - protein, 15 aa, Mycobacterium tuberculosis
LKVVEQASLRAGPPT

SEQ ID NO: 121666 - protein, 15 aa, Mycobacterium tuberculosis
KVVEQASLRAGPPTV

SEQ ID NO: 121667 - protein, 15 aa, Mycobacterium tuberculosis
VVEQASLRAGPPTVH

SEQ ID NO: 121668 - protein, 15 aa, Mycobacterium tuberculosis
VEQASLRAGPPTVHS

SEQ ID NO: 121669 - protein, 15 aa, Mycobacterium tuberculosis
EQASLRAGPPTVHSE

SEQ ID NO: 121670 - protein, 15 aa, Mycobacterium tuberculosis
QASLRAGPPTVHSEI

SEQ ID NO: 121671 - protein, 15 aa, Mycobacterium tuberculosis
ASLRAGPPTVHSEIV

SEQ ID NO: 121672 - protein, 15 aa, Mycobacterium tuberculosis
SLRAGPPTVHSEIVP

SEQ ID NO: 121673 - protein, 15 aa, Mycobacterium tuberculosis
LRAGPPTVHSEIVPA

SEQ ID NO: 121674 - protein, 15 aa, Mycobacterium tuberculosis
RAGPPTVHSEIVPAA

SEQ ID NO: 121675 - protein, 15 aa, Mycobacterium tuberculosis
AGPPTVHSEIVPAAA

SEQ ID NO: 121676 - protein, 15 aa, Mycobacterium tuberculosis
GPPTVHSEIVPAAAV

SEQ ID NO: 121677 - protein, 15 aa, Mycobacterium tuberculosis
PPTVHSEIVPAAAVP

SEQ ID NO: 121678 - protein, 15 aa, Mycobacterium tuberculosis
PTVHSEIVPAAAVPT

SEQ ID NO: 121679 - protein, 15 aa, Mycobacterium tuberculosis
TVHSEIVPAAAVPTL

SEQ ID NO: 121680 - protein, 15 aa, Mycobacterium tuberculosis
VHSEIVPAAAVPTLV

SEQ ID NO: 121681 - protein, 15 aa, Mycobacterium tuberculosis
HSEIVPAAAVPTLVD

SEQ ID NO: 121682 - protein, 15 aa, Mycobacterium tuberculosis
SEIVPAAAVPTLVDM

SEQ ID NO: 121683 - protein, 15 aa, Mycobacterium tuberculosis
EIVPAAAVPTLVDMS

SEQ ID NO: 121684 - protein, 15 aa, Mycobacterium tuberculosis
IVPAAAVPTLVDMSK

SEQ ID NO: 121685 - protein, 15 aa, Mycobacterium tuberculosis
VPAAAVPTLVDMSKD

SEQ ID NO: 121686 - protein, 15 aa, Mycobacterium tuberculosis
PAAAVPTLVDMSKDA

SEQ ID NO: 121687 - protein, 15 aa, Mycobacterium tuberculosis
AAAVPTLVDMSKDAV

SEQ ID NO: 121688 - protein, 15 aa, Mycobacterium tuberculosis
AAVPTLVDMSKDAVL

SEQ ID NO: 121689 - protein, 15 aa, Mycobacterium tuberculosis
AVPTLVDMSKDAVLM

SEQ ID NO: 121690 - protein, 15 aa, Mycobacterium tuberculosis
VPTLVDMSKDAVLMV

SEQ ID NO: 121691 - protein, 15 aa, Mycobacterium tuberculosis
PTLVDMSKDAVLMVV

SEQ ID NO: 121692 - protein, 15 aa, Mycobacterium tuberculosis
TLVDMSKDAVLMVVG

SEQ ID NO: 121693 - protein, 15 aa, Mycobacterium tuberculosis
LVDMSKDAVLMVVGC

SEQ ID NO: 121694 - protein, 15 aa, Mycobacterium tuberculosis
VDMSKDAVLMVVGCL

SEQ ID NO: 121695 - protein, 15 aa, Mycobacterium tuberculosis
DMSKDAVLMVVGCLG

SEQ ID NO: 121696 - protein, 15 aa, Mycobacterium tuberculosis
MSKDAVLMVVGCLGS

SEQ ID NO: 121697 - protein, 15 aa, Mycobacterium tuberculosis
SKDAVLMVVGCLGSG

SEQ ID NO: 121698 - protein, 15 aa, Mycobacterium tuberculosis
KDAVLMVVGCLGSGR

SEQ ID NO: 121699 - protein, 15 aa, Mycobacterium tuberculosis
DAVLMVVGCLGSGRW

SEQ ID NO: 121700 - protein, 15 aa, Mycobacterium tuberculosis
AVLMVVGCLGSGRWP

SEQ ID NO: 121701 - protein, 15 aa, Mycobacterium tuberculosis
VLMVVGCLGSGRWPG

SEQ ID NO: 121702 - protein, 15 aa, Mycobacterium tuberculosis
LMVVGCLGSGRWPGR

SEQ ID NO: 121703 - protein, 15 aa, Mycobacterium tuberculosis
MVVGCLGSGRWPGRL

SEQ ID NO: 121704 - protein, 15 aa, Mycobacterium tuberculosis
VVGCLGSGRWPGRLL

SEQ ID NO: 121705 - protein, 15 aa, Mycobacterium tuberculosis
VGCLGSGRWPGRLLG

SEQ ID NO: 121706 - protein, 15 aa, Mycobacterium tuberculosis
GCLGSGRWPGRLLGS

SEQ ID NO: 121707 - protein, 15 aa, Mycobacterium tuberculosis
CLGSGRWPGRLLGSV

SEQ ID NO: 121708 - protein, 15 aa, Mycobacterium tuberculosis
LGSGRWPGRLLGSVS

SEQ ID NO: 121709 - protein, 15 aa, Mycobacterium tuberculosis
GSGRWPGRLLGSVSS

SEQ ID NO: 121710 - protein, 15 aa, Mycobacterium tuberculosis
SGRWPGRLLGSVSSG

SEQ ID NO: 121711 - protein, 15 aa, Mycobacterium tuberculosis
GRWPGRLLGSVSSGL

SEQ ID NO: 121712 - protein, 15 aa, Mycobacterium tuberculosis
RWPGRLLGSVSSGLL

SEQ ID NO: 121713 - protein, 15 aa, Mycobacterium tuberculosis
WPGRLLGSVSSGLLR

SEQ ID NO: 121714 - protein, 15 aa, Mycobacterium tuberculosis
PGRLLGSVSSGLLRH

SEQ ID NO: 121715 - protein, 15 aa, Mycobacterium tuberculosis
GRLLGSVSSGLLRHA

SEQ ID NO: 121716 - protein, 15 aa, Mycobacterium tuberculosis
RLLGSVSSGLLRHAH

SEQ ID NO: 121717 - protein, 15 aa, Mycobacterium tuberculosis
LLGSVSSGLLRHAHC

SEQ ID NO: 121718 - protein, 15 aa, Mycobacterium tuberculosis
LGSVSSGLLRHAHCP

SEQ ID NO: 121719 - protein, 15 aa, Mycobacterium tuberculosis
GSVSSGLLRHAHCPV

SEQ ID NO: 121720 - protein, 15 aa, Mycobacterium tuberculosis
SVSSGLLRHAHCPVV

SEQ ID NO: 121721 - protein, 15 aa, Mycobacterium tuberculosis
VSSGLLRHAHCPVVI

SEQ ID NO: 121722 - protein, 15 aa, Mycobacterium tuberculosis
SSGLLRHAHCPVVII

SEQ ID NO: 121723 - protein, 15 aa, Mycobacterium tuberculosis
SGLLRHAHCPVVIIH

SEQ ID NO: 121724 - protein, 15 aa, Mycobacterium tuberculosis
GLLRHAHCPVVIIHD

SEQ ID NO: 121725 - protein, 15 aa, Mycobacterium tuberculosis
LLRHAHCPVVIIHDE

SEQ ID NO: 121726 - protein, 15 aa, Mycobacterium tuberculosis
LRHAHCPVVIIHDED

SEQ ID NO: 121727 - protein, 15 aa, Mycobacterium tuberculosis
RHAHCPVVIIHDEDS

SEQ ID NO: 121728 - protein, 15 aa, Mycobacterium tuberculosis
HAHCPVVIIHDEDSV

SEQ ID NO: 121729 - protein, 15 aa, Mycobacterium tuberculosis
AHCPVVIIHDEDSVM

SEQ ID NO: 121730 - protein, 15 aa, Mycobacterium tuberculosis
HCPVVIIHDEDSVMP

SEQ ID NO: 121731 - protein, 15 aa, Mycobacterium tuberculosis
CPVVIIHDEDSVMPH

SEQ ID NO: 121732 - protein, 15 aa, Mycobacterium tuberculosis
PVVIIHDEDSVMPHP

SEQ ID NO: 121733 - protein, 15 aa, Mycobacterium tuberculosis
VVIIHDEDSVMPHPQ

SEQ ID NO: 121734 - protein, 15 aa, Mycobacterium tuberculosis
VIIHDEDSVMPHPQQ

SEQ ID NO: 121735 - protein, 15 aa, Mycobacterium tuberculosis
IIHDEDSVMPHPQQA

SEQ ID NO: 121736 - protein, 15 aa, Mycobacterium tuberculosis
IHDEDSVMPHPQQAP

SEQ ID NO: 121737 - protein, 15 aa, Mycobacterium tuberculosis
HDEDSVMPHPQQAPV

SEQ ID NO: 121738 - protein, 15 aa, Mycobacterium tuberculosis
DEDSVMPHPQQAPVL

SEQ ID NO: 121739 - protein, 15 aa, Mycobacterium tuberculosis
EDSVMPHPQQAPVLV

SEQ ID NO: 121740 - protein, 15 aa, Mycobacterium tuberculosis
DSVMPHPQQAPVLVG

SEQ ID NO: 121741 - protein, 15 aa, Mycobacterium tuberculosis
SVMPHPQQAPVLVGV

SEQ ID NO: 121742 - protein, 15 aa, Mycobacterium tuberculosis
VMPHPQQAPVLVGVD

SEQ ID NO: 121743 - protein, 15 aa, Mycobacterium tuberculosis
MPHPQQAPVLVGVDG

SEQ ID NO: 121744 - protein, 15 aa, Mycobacterium tuberculosis
PHPQQAPVLVGVDGS

SEQ ID NO: 121745 - protein, 15 aa, Mycobacterium tuberculosis
HPQQAPVLVGVDGSS

SEQ ID NO: 121746 - protein, 15 aa, Mycobacterium tuberculosis
PQQAPVLVGVDGSSA

SEQ ID NO: 121747 - protein, 15 aa, Mycobacterium tuberculosis
QQAPVLVGVDGSSAS

SEQ ID NO: 121748 - protein, 15 aa, Mycobacterium tuberculosis
QAPVLVGVDGSSASE

SEQ ID NO: 121749 - protein, 15 aa, Mycobacterium tuberculosis
APVLVGVDGSSASEL

SEQ ID NO: 121750 - protein, 15 aa, Mycobacterium tuberculosis
PVLVGVDGSSASELA

SEQ ID NO: 121751 - protein, 15 aa, Mycobacterium tuberculosis
VLVGVDGSSASELAT

SEQ ID NO: 121752 - protein, 15 aa, Mycobacterium tuberculosis
LVGVDGSSASELATA

SEQ ID NO: 121753 - protein, 15 aa, Mycobacterium tuberculosis
VGVDGSSASELATAI

SEQ ID NO: 121754 - protein, 15 aa, Mycobacterium tuberculosis
GVDGSSASELATAIA

SEQ ID NO: 121755 - protein, 15 aa, Mycobacterium tuberculosis
VDGSSASELATAIAF

SEQ ID NO: 121756 - protein, 15 aa, Mycobacterium tuberculosis
DGSSASELATAIAFD

SEQ ID NO: 121757 - protein, 15 aa, Mycobacterium tuberculosis
GSSASELATAIAFDE

SEQ ID NO: 121758 - protein, 15 aa, Mycobacterium tuberculosis
SSASELATAIAFDEA

SEQ ID NO: 121759 - protein, 15 aa, Mycobacterium tuberculosis
SASELATAIAFDEAS

SEQ ID NO: 121760 - protein, 15 aa, Mycobacterium tuberculosis
ASELATAIAFDEASR

SEQ ID NO: 121761 - protein, 15 aa, Mycobacterium tuberculosis
SELATAIAFDEASRR

SEQ ID NO: 121762 - protein, 15 aa, Mycobacterium tuberculosis
ELATAIAFDEASRRN

SEQ ID NO: 121763 - protein, 15 aa, Mycobacterium tuberculosis
LATAIAFDEASRRNV

SEQ ID NO: 121764 - protein, 15 aa, Mycobacterium tuberculosis
ATAIAFDEASRRNVD

SEQ ID NO: 121765 - protein, 15 aa, Mycobacterium tuberculosis
TAIAFDEASRRNVDL

SEQ ID NO: 121766 - protein, 15 aa, Mycobacterium tuberculosis
AIAFDEASRRNVDLV

SEQ ID NO: 121767 - protein, 15 aa, Mycobacterium tuberculosis
IAFDEASRRNVDLVA

SEQ ID NO: 121768 - protein, 15 aa, Mycobacterium tuberculosis
AFDEASRRNVDLVAL

SEQ ID NO: 121769 - protein, 15 aa, Mycobacterium tuberculosis
FDEASRRNVDLVALH

SEQ ID NO: 121770 - protein, 15 aa, Mycobacterium tuberculosis
DEASRRNVDLVALHA

SEQ ID NO: 121771 - protein, 15 aa, Mycobacterium tuberculosis
EASRRNVDLVALHAW

SEQ ID NO: 121772 - protein, 15 aa, Mycobacterium tuberculosis
ASRRNVDLVALHAWS

SEQ ID NO: 121773 - protein, 15 aa, Mycobacterium tuberculosis
SRRNVDLVALHAWSD

SEQ ID NO: 121774 - protein, 15 aa, Mycobacterium tuberculosis
RRNVDLVALHAWSDV

SEQ ID NO: 121775 - protein, 15 aa, Mycobacterium tuberculosis
RNVDLVALHAWSDVD

SEQ ID NO: 121776 - protein, 15 aa, Mycobacterium tuberculosis
NVDLVALHAWSDVDV

SEQ ID NO: 121777 - protein, 15 aa, Mycobacterium tuberculosis
VDLVALHAWSDVDVS

SEQ ID NO: 121778 - protein, 15 aa, Mycobacterium tuberculosis
DLVALHAWSDVDVSE

SEQ ID NO: 121779 - protein, 15 aa, Mycobacterium tuberculosis
LVALHAWSDVDVSEW

SEQ ID NO: 121780 - protein, 15 aa, Mycobacterium tuberculosis
VALHAWSDVDVSEWP

SEQ ID NO: 121781 - protein, 15 aa, Mycobacterium tuberculosis
ALHAWSDVDVSEWPG

SEQ ID NO: 121782 - protein, 15 aa, Mycobacterium tuberculosis
LHAWSDVDVSEWPGI

SEQ ID NO: 121783 - protein, 15 aa, Mycobacterium tuberculosis
HAWSDVDVSEWPGID

SEQ ID NO: 121784 - protein, 15 aa, Mycobacterium tuberculosis
AWSDVDVSEWPGIDW

SEQ ID NO: 121785 - protein, 15 aa, Mycobacterium tuberculosis
WSDVDVSEWPGIDWP

SEQ ID NO: 121786 - protein, 15 aa, Mycobacterium tuberculosis
SDVDVSEWPGIDWPA

SEQ ID NO: 121787 - protein, 15 aa, Mycobacterium tuberculosis
DVDVSEWPGIDWPAT

SEQ ID NO: 121788 - protein, 15 aa, Mycobacterium tuberculosis
VDVSEWPGIDWPATQ

SEQ ID NO: 121789 - protein, 15 aa, Mycobacterium tuberculosis
DVSEWPGIDWPATQS

SEQ ID NO: 121790 - protein, 15 aa, Mycobacterium tuberculosis
VSEWPGIDWPATQSM

SEQ ID NO: 121791 - protein, 15 aa, Mycobacterium tuberculosis
SEWPGIDWPATQSMA

SEQ ID NO: 121792 - protein, 15 aa, Mycobacterium tuberculosis
EWPGIDWPATQSMAE

SEQ ID NO: 121793 - protein, 15 aa, Mycobacterium tuberculosis
WPGIDWPATQSMAEQ

SEQ ID NO: 121794 - protein, 15 aa, Mycobacterium tuberculosis
PGIDWPATQSMAEQV

SEQ ID NO: 121795 - protein, 15 aa, Mycobacterium tuberculosis
GIDWPATQSMAEQVL

SEQ ID NO: 121796 - protein, 15 aa, Mycobacterium tuberculosis
IDWPATQSMAEQVLA

SEQ ID NO: 121797 - protein, 15 aa, Mycobacterium tuberculosis
DWPATQSMAEQVLAE

SEQ ID NO: 121798 - protein, 15 aa, Mycobacterium tuberculosis
WPATQSMAEQVLAER

SEQ ID NO: 121799 - protein, 15 aa, Mycobacterium tuberculosis
PATQSMAEQVLAERL

SEQ ID NO: 121800 - protein, 15 aa, Mycobacterium tuberculosis
ATQSMAEQVLAERLA

SEQ ID NO: 121801 - protein, 15 aa, Mycobacterium tuberculosis
TQSMAEQVLAERLAG

SEQ ID NO: 121802 - protein, 15 aa, Mycobacterium tuberculosis
QSMAEQVLAERLAGW

SEQ ID NO: 121803 - protein, 15 aa, Mycobacterium tuberculosis
SMAEQVLAERLAGWQ

SEQ ID NO: 121804 - protein, 15 aa, Mycobacterium tuberculosis
MAEQVLAERLAGWQE

SEQ ID NO: 121805 - protein, 15 aa, Mycobacterium tuberculosis
AEQVLAERLAGWQER

SEQ ID NO: 121806 - protein, 15 aa, Mycobacterium tuberculosis
EQVLAERLAGWQERY

SEQ ID NO: 121807 - protein, 15 aa, Mycobacterium tuberculosis
QVLAERLAGWQERYP

SEQ ID NO: 121808 - protein, 15 aa, Mycobacterium tuberculosis
VLAERLAGWQERYPN

SEQ ID NO: 121809 - protein, 15 aa, Mycobacterium tuberculosis
LAERLAGWQERYPNV

SEQ ID NO: 121810 - protein, 15 aa, Mycobacterium tuberculosis
AERLAGWQERYPNVA

SEQ ID NO: 121811 - protein, 15 aa, Mycobacterium tuberculosis
ERLAGWQERYPNVAI

SEQ ID NO: 121812 - protein, 15 aa, Mycobacterium tuberculosis
RLAGWQERYPNVAIT

SEQ ID NO: 121813 - protein, 15 aa, Mycobacterium tuberculosis
LAGWQERYPNVAITR

SEQ ID NO: 121814 - protein, 15 aa, Mycobacterium tuberculosis
AGWQERYPNVAITRV

SEQ ID NO: 121815 - protein, 15 aa, Mycobacterium tuberculosis
GWQERYPNVAITRVV

SEQ ID NO: 121816 - protein, 15 aa, Mycobacterium tuberculosis
WQERYPNVAITRVVV

SEQ ID NO: 121817 - protein, 15 aa, Mycobacterium tuberculosis
QERYPNVAITRVVVR

SEQ ID NO: 121818 - protein, 15 aa, Mycobacterium tuberculosis
ERYPNVAITRVVVRD

SEQ ID NO: 121819 - protein, 15 aa, Mycobacterium tuberculosis
RYPNVAITRVVVRDQ

SEQ ID NO: 121820 - protein, 15 aa, Mycobacterium tuberculosis
YPNVAITRVVVRDQP

SEQ ID NO: 121821 - protein, 15 aa, Mycobacterium tuberculosis
PNVAITRVVVRDQPA

SEQ ID NO: 121822 - protein, 15 aa, Mycobacterium tuberculosis
NVAITRVVVRDQPAR

SEQ ID NO: 121823 - protein, 15 aa, Mycobacterium tuberculosis
VAITRVVVRDQPARQ

SEQ ID NO: 121824 - protein, 15 aa, Mycobacterium tuberculosis
AITRVVVRDQPARQL

SEQ ID NO: 121825 - protein, 15 aa, Mycobacterium tuberculosis
ITRVVVRDQPARQLV

SEQ ID NO: 121826 - protein, 15 aa, Mycobacterium tuberculosis
TRVVVRDQPARQLVQ

SEQ ID NO: 121827 - protein, 15 aa, Mycobacterium tuberculosis
RVVVRDQPARQLVQR

SEQ ID NO: 121828 - protein, 15 aa, Mycobacterium tuberculosis
VVVRDQPARQLVQRS

SEQ ID NO: 121829 - protein, 15 aa, Mycobacterium tuberculosis
VVRDQPARQLVQRSE

SEQ ID NO: 121830 - protein, 15 aa, Mycobacterium tuberculosis
VRDQPARQLVQRSEE

SEQ ID NO: 121831 - protein, 15 aa, Mycobacterium tuberculosis
RDQPARQLVQRSEEA

SEQ ID NO: 121832 - protein, 15 aa, Mycobacterium tuberculosis
DQPARQLVQRSEEAQ

SEQ ID NO: 121833 - protein, 15 aa, Mycobacterium tuberculosis
QPARQLVQRSEEAQL

SEQ ID NO: 121834 - protein, 15 aa, Mycobacterium tuberculosis
PARQLVQRSEEAQLV

SEQ ID NO: 121835 - protein, 15 aa, Mycobacterium tuberculosis
ARQLVQRSEEAQLVV

SEQ ID NO: 121836 - protein, 15 aa, Mycobacterium tuberculosis
RQLVQRSEEAQLVVV

SEQ ID NO: 121837 - protein, 15 aa, Mycobacterium tuberculosis
QLVQRSEEAQLVVVG

SEQ ID NO: 121838 - protein, 15 aa, Mycobacterium tuberculosis
LVQRSEEAQLVVVGS

SEQ ID NO: 121839 - protein, 15 aa, Mycobacterium tuberculosis
VQRSEEAQLVVVGSR

SEQ ID NO: 121840 - protein, 15 aa, Mycobacterium tuberculosis
QRSEEAQLVVVGSRG

SEQ ID NO: 121841 - protein, 15 aa, Mycobacterium tuberculosis
RSEEAQLVVVGSRGR

SEQ ID NO: 121842 - protein, 15 aa, Mycobacterium tuberculosis
SEEAQLVVVGSRGRG

SEQ ID NO: 121843 - protein, 15 aa, Mycobacterium tuberculosis
EEAQLVVVGSRGRGG

SEQ ID NO: 121844 - protein, 15 aa, Mycobacterium tuberculosis
EAQLVVVGSRGRGGY

SEQ ID NO: 121845 - protein, 15 aa, Mycobacterium tuberculosis
AQLVVVGSRGRGGYA

SEQ ID NO: 121846 - protein, 15 aa, Mycobacterium tuberculosis
QLVVVGSRGRGGYAG

SEQ ID NO: 121847 - protein, 15 aa, Mycobacterium tuberculosis
LVVVGSRGRGGYAGM

SEQ ID NO: 121848 - protein, 15 aa, Mycobacterium tuberculosis
VVVGSRGRGGYAGML

SEQ ID NO: 121849 - protein, 15 aa, Mycobacterium tuberculosis
VVGSRGRGGYAGMLV

SEQ ID NO: 121850 - protein, 15 aa, Mycobacterium tuberculosis
VGSRGRGGYAGMLVG

SEQ ID NO: 121851 - protein, 15 aa, Mycobacterium tuberculosis
GSRGRGGYAGMLVGS

SEQ ID NO: 121852 - protein, 15 aa, Mycobacterium tuberculosis
SRGRGGYAGMLVGSV

SEQ ID NO: 121853 - protein, 15 aa, Mycobacterium tuberculosis
RGRGGYAGMLVGSVG

SEQ ID NO: 121854 - protein, 15 aa, Mycobacterium tuberculosis
GRGGYAGMLVGSVGE

SEQ ID NO: 121855 - protein, 15 aa, Mycobacterium tuberculosis
RGGYAGMLVGSVGET

SEQ ID NO: 121856 - protein, 15 aa, Mycobacterium tuberculosis
GGYAGMLVGSVGETV

SEQ ID NO: 121857 - protein, 15 aa, Mycobacterium tuberculosis
GYAGMLVGSVGETVA

SEQ ID NO: 121858 - protein, 15 aa, Mycobacterium tuberculosis
YAGMLVGSVGETVAQ

SEQ ID NO: 121859 - protein, 15 aa, Mycobacterium tuberculosis
AGMLVGSVGETVAQL

SEQ ID NO: 121860 - protein, 15 aa, Mycobacterium tuberculosis
GMLVGSVGETVAQLA

SEQ ID NO: 121861 - protein, 15 aa, Mycobacterium tuberculosis
MLVGSVGETVAQLAR

SEQ ID NO: 121862 - protein, 15 aa, Mycobacterium tuberculosis
LVGSVGETVAQLART

SEQ ID NO: 121863 - protein, 15 aa, Mycobacterium tuberculosis
VGSVGETVAQLARTP

SEQ ID NO: 121864 - protein, 15 aa, Mycobacterium tuberculosis
GSVGETVAQLARTPV

SEQ ID NO: 121865 - protein, 15 aa, Mycobacterium tuberculosis
SVGETVAQLARTPVI

SEQ ID NO: 121866 - protein, 15 aa, Mycobacterium tuberculosis
VGETVAQLARTPVIV

SEQ ID NO: 121867 - protein, 15 aa, Mycobacterium tuberculosis
GETVAQLARTPVIVA

SEQ ID NO: 121868 - protein, 15 aa, Mycobacterium tuberculosis
ETVAQLARTPVIVAR

SEQ ID NO: 121869 - protein, 15 aa, Mycobacterium tuberculosis
TVAQLARTPVIVARE

SEQ ID NO: 121870 - protein, 15 aa, Mycobacterium tuberculosis
VAQLARTPVIVARES

SEQ ID NO: 121871 - protein, 15 aa, Mycobacterium tuberculosis
AQLARTPVIVARESL

SEQ ID NO: 121872 - protein, 15 aa, Mycobacterium tuberculosis
QLARTPVIVARESLT

SEQ ID NO: 121873 - protein, 16 aa, Mycobacterium tuberculosis
MSSGNSSLGIIVGIDD

SEQ ID NO: 121874 - protein, 16 aa, Mycobacterium tuberculosis
SSGNSSLGIIVGIDDS

SEQ ID NO: 121875 - protein, 16 aa, Mycobacterium tuberculosis
SGNSSLGIIVGIDDSP

SEQ ID NO: 121876 - protein, 16 aa, Mycobacterium tuberculosis
GNSSLGIIVGIDDSPA

SEQ ID NO: 121877 - protein, 16 aa, Mycobacterium tuberculosis
NSSLGIIVGIDDSPAA

SEQ ID NO: 121878 - protein, 16 aa, Mycobacterium tuberculosis
SSLGIIVGIDDSPAAQ

SEQ ID NO: 121879 - protein, 16 aa, Mycobacterium tuberculosis
SLGIIVGIDDSPAAQV

SEQ ID NO: 121880 - protein, 16 aa, Mycobacterium tuberculosis
LGIIVGIDDSPAAQVA

SEQ ID NO: 121881 - protein, 16 aa, Mycobacterium tuberculosis
GIIVGIDDSPAAQVAV

SEQ ID NO: 121882 - protein, 16 aa, Mycobacterium tuberculosis
IIVGIDDSPAAQVAVR

SEQ ID NO: 121883 - protein, 16 aa, Mycobacterium tuberculosis
IVGIDDSPAAQVAVRW

SEQ ID NO: 121884 - protein, 16 aa, Mycobacterium tuberculosis
VGIDDSPAAQVAVRWA

SEQ ID NO: 121885 - protein, 16 aa, Mycobacterium tuberculosis
GIDDSPAAQVAVRWAA

SEQ ID NO: 121886 - protein, 16 aa, Mycobacterium tuberculosis
IDDSPAAQVAVRWAAR

SEQ ID NO: 121887 - protein, 16 aa, Mycobacterium tuberculosis
DDSPAAQVAVRWAARD

SEQ ID NO: 121888 - protein, 16 aa, Mycobacterium tuberculosis
DSPAAQVAVRWAARDA

SEQ ID NO: 121889 - protein, 16 aa, Mycobacterium tuberculosis
SPAAQVAVRWAARDAE

SEQ ID NO: 121890 - protein, 16 aa, Mycobacterium tuberculosis
PAAQVAVRWAARDAEL

SEQ ID NO: 121891 - protein, 16 aa, Mycobacterium tuberculosis
AAQVAVRWAARDAELR

SEQ ID NO: 121892 - protein, 16 aa, Mycobacterium tuberculosis
AQVAVRWAARDAELRK

SEQ ID NO: 121893 - protein, 16 aa, Mycobacterium tuberculosis
QVAVRWAARDAELRKI

SEQ ID NO: 121894 - protein, 16 aa, Mycobacterium tuberculosis
VAVRWAARDAELRKIP

SEQ ID NO: 121895 - protein, 16 aa, Mycobacterium tuberculosis
AVRWAARDAELRKIPL

SEQ ID NO: 121896 - protein, 16 aa, Mycobacterium tuberculosis
VRWAARDAELRKIPLT

SEQ ID NO: 121897 - protein, 16 aa, Mycobacterium tuberculosis
RWAARDAELRKIPLTL

SEQ ID NO: 121898 - protein, 16 aa, Mycobacterium tuberculosis
WAARDAELRKIPLTLV

SEQ ID NO: 121899 - protein, 16 aa, Mycobacterium tuberculosis
AARDAELRKIPLTLVH

SEQ ID NO: 121900 - protein, 16 aa, Mycobacterium tuberculosis
ARDAELRKIPLTLVHA

SEQ ID NO: 121901 - protein, 16 aa, Mycobacterium tuberculosis
RDAELRKIPLTLVHAV

SEQ ID NO: 121902 - protein, 16 aa, Mycobacterium tuberculosis
DAELRKIPLTLVHAVS

SEQ ID NO: 121903 - protein, 16 aa, Mycobacterium tuberculosis
AELRKIPLTLVHAVSP

SEQ ID NO: 121904 - protein, 16 aa, Mycobacterium tuberculosis
ELRKIPLTLVHAVSPE

SEQ ID NO: 121905 - protein, 16 aa, Mycobacterium tuberculosis
LRKIPLTLVHAVSPEV

SEQ ID NO: 121906 - protein, 16 aa, Mycobacterium tuberculosis
RKIPLTLVHAVSPEVA

SEQ ID NO: 121907 - protein, 16 aa, Mycobacterium tuberculosis
KIPLTLVHAVSPEVAT

SEQ ID NO: 121908 - protein, 16 aa, Mycobacterium tuberculosis
IPLTLVHAVSPEVATW

SEQ ID NO: 121909 - protein, 16 aa, Mycobacterium tuberculosis
PLTLVHAVSPEVATWL

SEQ ID NO: 121910 - protein, 16 aa, Mycobacterium tuberculosis
LTLVHAVSPEVATWLE

SEQ ID NO: 121911 - protein, 16 aa, Mycobacterium tuberculosis
TLVHAVSPEVATWLEV

SEQ ID NO: 121912 - protein, 16 aa, Mycobacterium tuberculosis
LVHAVSPEVATWLEVP

SEQ ID NO: 121913 - protein, 16 aa, Mycobacterium tuberculosis
VHAVSPEVATWLEVPL

SEQ ID NO: 121914 - protein, 16 aa, Mycobacterium tuberculosis
HAVSPEVATWLEVPLP

SEQ ID NO: 121915 - protein, 16 aa, Mycobacterium tuberculosis
AVSPEVATWLEVPLPP

SEQ ID NO: 121916 - protein, 16 aa, Mycobacterium tuberculosis
VSPEVATWLEVPLPPG

SEQ ID NO: 121917 - protein, 16 aa, Mycobacterium tuberculosis
SPEVATWLEVPLPPGV

SEQ ID NO: 121918 - protein, 16 aa, Mycobacterium tuberculosis
PEVATWLEVPLPPGVL

SEQ ID NO: 121919 - protein, 16 aa, Mycobacterium tuberculosis
EVATWLEVPLPPGVLR

SEQ ID NO: 121920 - protein, 16 aa, Mycobacterium tuberculosis
VATWLEVPLPPGVLRW

SEQ ID NO: 121921 - protein, 16 aa, Mycobacterium tuberculosis
ATWLEVPLPPGVLRWQ

SEQ ID NO: 121922 - protein, 16 aa, Mycobacterium tuberculosis
TWLEVPLPPGVLRWQQ

SEQ ID NO: 121923 - protein, 16 aa, Mycobacterium tuberculosis
WLEVPLPPGVLRWQQD

SEQ ID NO: 121924 - protein, 16 aa, Mycobacterium tuberculosis
LEVPLPPGVLRWQQDH

SEQ ID NO: 121925 - protein, 16 aa, Mycobacterium tuberculosis
EVPLPPGVLRWQQDHG

SEQ ID NO: 121926 - protein, 16 aa, Mycobacterium tuberculosis
VPLPPGVLRWQQDHGR

SEQ ID NO: 121927 - protein, 16 aa, Mycobacterium tuberculosis
PLPPGVLRWQQDHGRH

SEQ ID NO: 121928 - protein, 16 aa, Mycobacterium tuberculosis
LPPGVLRWQQDHGRHL

SEQ ID NO: 121929 - protein, 16 aa, Mycobacterium tuberculosis
PPGVLRWQQDHGRHLI

SEQ ID NO: 121930 - protein, 16 aa, Mycobacterium tuberculosis
PGVLRWQQDHGRHLID

SEQ ID NO: 121931 - protein, 16 aa, Mycobacterium tuberculosis
GVLRWQQDHGRHLIDD

SEQ ID NO: 121932 - protein, 16 aa, Mycobacterium tuberculosis
VLRWQQDHGRHLIDDA

SEQ ID NO: 121933 - protein, 16 aa, Mycobacterium tuberculosis
LRWQQDHGRHLIDDAL

SEQ ID NO: 121934 - protein, 16 aa, Mycobacterium tuberculosis
RWQQDHGRHLIDDALK

SEQ ID NO: 121935 - protein, 16 aa, Mycobacterium tuberculosis
WQQDHGRHLIDDALKV

SEQ ID NO: 121936 - protein, 16 aa, Mycobacterium tuberculosis
QQDHGRHLIDDALKVV

SEQ ID NO: 121937 - protein, 16 aa, Mycobacterium tuberculosis
QDHGRHLIDDALKVVE

SEQ ID NO: 121938 - protein, 16 aa, Mycobacterium tuberculosis
DHGRHLIDDALKVVEQ

SEQ ID NO: 121939 - protein, 16 aa, Mycobacterium tuberculosis
HGRHLIDDALKVVEQA

SEQ ID NO: 121940 - protein, 16 aa, Mycobacterium tuberculosis
GRHLIDDALKVVEQAS

SEQ ID NO: 121941 - protein, 16 aa, Mycobacterium tuberculosis
RHLIDDALKVVEQASL

SEQ ID NO: 121942 - protein, 16 aa, Mycobacterium tuberculosis
HLIDDALKVVEQASLR

SEQ ID NO: 121943 - protein, 16 aa, Mycobacterium tuberculosis
LIDDALKVVEQASLRA

SEQ ID NO: 121944 - protein, 16 aa, Mycobacterium tuberculosis
IDDALKVVEQASLRAG

SEQ ID NO: 121945 - protein, 16 aa, Mycobacterium tuberculosis
DDALKVVEQASLRAGP

SEQ ID NO: 121946 - protein, 16 aa, Mycobacterium tuberculosis
DALKVVEQASLRAGPP

SEQ ID NO: 121947 - protein, 16 aa, Mycobacterium tuberculosis
ALKVVEQASLRAGPPT

SEQ ID NO: 121948 - protein, 16 aa, Mycobacterium tuberculosis
LKVVEQASLRAGPPTV

SEQ ID NO: 121949 - protein, 16 aa, Mycobacterium tuberculosis
KVVEQASLRAGPPTVH

SEQ ID NO: 121950 - protein, 16 aa, Mycobacterium tuberculosis
VVEQASLRAGPPTVHS

SEQ ID NO: 121951 - protein, 16 aa, Mycobacterium tuberculosis
VEQASLRAGPPTVHSE

SEQ ID NO: 121952 - protein, 16 aa, Mycobacterium tuberculosis
EQASLRAGPPTVHSEI

SEQ ID NO: 121953 - protein, 16 aa, Mycobacterium tuberculosis
QASLRAGPPTVHSEIV

SEQ ID NO: 121954 - protein, 16 aa, Mycobacterium tuberculosis
ASLRAGPPTVHSEIVP

SEQ ID NO: 121955 - protein, 16 aa, Mycobacterium tuberculosis
SLRAGPPTVHSEIVPA

SEQ ID NO: 121956 - protein, 16 aa, Mycobacterium tuberculosis
LRAGPPTVHSEIVPAA

SEQ ID NO: 121957 - protein, 16 aa, Mycobacterium tuberculosis
RAGPPTVHSEIVPAAA

SEQ ID NO: 121958 - protein, 16 aa, Mycobacterium tuberculosis
AGPPTVHSEIVPAAAV

SEQ ID NO: 121959 - protein, 16 aa, Mycobacterium tuberculosis
GPPTVHSEIVPAAAVP

SEQ ID NO: 121960 - protein, 16 aa, Mycobacterium tuberculosis
PPTVHSEIVPAAAVPT

SEQ ID NO: 121961 - protein, 16 aa, Mycobacterium tuberculosis
PTVHSEIVPAAAVPTL

SEQ ID NO: 121962 - protein, 16 aa, Mycobacterium tuberculosis
TVHSEIVPAAAVPTLV

SEQ ID NO: 121963 - protein, 16 aa, Mycobacterium tuberculosis
VHSEIVPAAAVPTLVD

SEQ ID NO: 121964 - protein, 16 aa, Mycobacterium tuberculosis
HSEIVPAAAVPTLVDM

SEQ ID NO: 121965 - protein, 16 aa, Mycobacterium tuberculosis
SEIVPAAAVPTLVDMS

SEQ ID NO: 121966 - protein, 16 aa, Mycobacterium tuberculosis
EIVPAAAVPTLVDMSK

SEQ ID NO: 121967 - protein, 16 aa, Mycobacterium tuberculosis
IVPAAAVPTLVDMSKD

SEQ ID NO: 121968 - protein, 16 aa, Mycobacterium tuberculosis
VPAAAVPTLVDMSKDA

SEQ ID NO: 121969 - protein, 16 aa, Mycobacterium tuberculosis
PAAAVPTLVDMSKDAV

SEQ ID NO: 121970 - protein, 16 aa, Mycobacterium tuberculosis
AAAVPTLVDMSKDAVL

SEQ ID NO: 121971 - protein, 16 aa, Mycobacterium tuberculosis
AAVPTLVDMSKDAVLM

SEQ ID NO: 121972 - protein, 16 aa, Mycobacterium tuberculosis
AVPTLVDMSKDAVLMV

SEQ ID NO: 121973 - protein, 16 aa, Mycobacterium tuberculosis
VPTLVDMSKDAVLMVV

SEQ ID NO: 121974 - protein, 16 aa, Mycobacterium tuberculosis
PTLVDMSKDAVLMVVG

SEQ ID NO: 121975 - protein, 16 aa, Mycobacterium tuberculosis
TLVDMSKDAVLMVVGC

SEQ ID NO: 121976 - protein, 16 aa, Mycobacterium tuberculosis
LVDMSKDAVLMVVGCL

SEQ ID NO: 121977 - protein, 16 aa, Mycobacterium tuberculosis
VDMSKDAVLMVVGCLG

SEQ ID NO: 121978 - protein, 16 aa, Mycobacterium tuberculosis
DMSKDAVLMVVGCLGS

SEQ ID NO: 121979 - protein, 16 aa, Mycobacterium tuberculosis
MSKDAVLMVVGCLGSG

SEQ ID NO: 121980 - protein, 16 aa, Mycobacterium tuberculosis
SKDAVLMVVGCLGSGR

SEQ ID NO: 121981 - protein, 16 aa, Mycobacterium tuberculosis
KDAVLMVVGCLGSGRW

SEQ ID NO: 121982 - protein, 16 aa, Mycobacterium tuberculosis
DAVLMVVGCLGSGRWP

SEQ ID NO: 121983 - protein, 16 aa, Mycobacterium tuberculosis
AVLMVVGCLGSGRWPG

SEQ ID NO: 121984 - protein, 16 aa, Mycobacterium tuberculosis
VLMVVGCLGSGRWPGR

SEQ ID NO: 121985 - protein, 16 aa, Mycobacterium tuberculosis
LMVVGCLGSGRWPGRL

SEQ ID NO: 121986 - protein, 16 aa, Mycobacterium tuberculosis
MVVGCLGSGRWPGRLL

SEQ ID NO: 121987 - protein, 16 aa, Mycobacterium tuberculosis
VVGCLGSGRWPGRLLG

SEQ ID NO: 121988 - protein, 16 aa, Mycobacterium tuberculosis
VGCLGSGRWPGRLLGS

SEQ ID NO: 121989 - protein, 16 aa, Mycobacterium tuberculosis
GCLGSGRWPGRLLGSV

SEQ ID NO: 121990 - protein, 16 aa, Mycobacterium tuberculosis
CLGSGRWPGRLLGSVS

SEQ ID NO: 121991 - protein, 16 aa, Mycobacterium tuberculosis
LGSGRWPGRLLGSVSS

SEQ ID NO: 121992 - protein, 16 aa, Mycobacterium tuberculosis
GSGRWPGRLLGSVSSG

SEQ ID NO: 121993 - protein, 16 aa, Mycobacterium tuberculosis
SGRWPGRLLGSVSSGL

SEQ ID NO: 121994 - protein, 16 aa, Mycobacterium tuberculosis
GRWPGRLLGSVSSGLL

SEQ ID NO: 121995 - protein, 16 aa, Mycobacterium tuberculosis
RWPGRLLGSVSSGLLR

SEQ ID NO: 121996 - protein, 16 aa, Mycobacterium tuberculosis
WPGRLLGSVSSGLLRH

SEQ ID NO: 121997 - protein, 16 aa, Mycobacterium tuberculosis
PGRLLGSVSSGLLRHA

SEQ ID NO: 121998 - protein, 16 aa, Mycobacterium tuberculosis
GRLLGSVSSGLLRHAH

SEQ ID NO: 121999 - protein, 16 aa, Mycobacterium tuberculosis
RLLGSVSSGLLRHAHC

SEQ ID NO: 122000 - protein, 16 aa, Mycobacterium tuberculosis
LLGSVSSGLLRHAHCP

SEQ ID NO: 122001 - protein, 16 aa, Mycobacterium tuberculosis
LGSVSSGLLRHAHCPV

SEQ ID NO: 122002 - protein, 16 aa, Mycobacterium tuberculosis
GSVSSGLLRHAHCPVV

SEQ ID NO: 122003 - protein, 16 aa, Mycobacterium tuberculosis
SVSSGLLRHAHCPVVI

SEQ ID NO: 122004 - protein, 16 aa, Mycobacterium tuberculosis
VSSGLLRHAHCPVVII

SEQ ID NO: 122005 - protein, 16 aa, Mycobacterium tuberculosis
SSGLLRHAHCPVVIIH

SEQ ID NO: 122006 - protein, 16 aa, Mycobacterium tuberculosis
SGLLRHAHCPVVIIHD

SEQ ID NO: 122007 - protein, 16 aa, Mycobacterium tuberculosis
GLLRHAHCPVVIIHDE

SEQ ID NO: 122008 - protein, 16 aa, Mycobacterium tuberculosis
LLRHAHCPVVIIHDED

SEQ ID NO: 122009 - protein, 16 aa, Mycobacterium tuberculosis
LRHAHCPVVIIHDEDS

SEQ ID NO: 122010 - protein, 16 aa, Mycobacterium tuberculosis
RHAHCPVVIIHDEDSV

SEQ ID NO: 122011 - protein, 16 aa, Mycobacterium tuberculosis
HAHCPVVIIHDEDSVM

SEQ ID NO: 122012 - protein, 16 aa, Mycobacterium tuberculosis
AHCPVVIIHDEDSVMP

SEQ ID NO: 122013 - protein, 16 aa, Mycobacterium tuberculosis
HCPVVIIHDEDSVMPH

SEQ ID NO: 122014 - protein, 16 aa, Mycobacterium tuberculosis
CPVVIIHDEDSVMPHP

SEQ ID NO: 122015 - protein, 16 aa, Mycobacterium tuberculosis
PVVIIHDEDSVMPHPQ

SEQ ID NO: 122016 - protein, 16 aa, Mycobacterium tuberculosis
VVIIHDEDSVMPHPQQ

SEQ ID NO: 122017 - protein, 16 aa, Mycobacterium tuberculosis
VIIHDEDSVMPHPQQA

SEQ ID NO: 122018 - protein, 16 aa, Mycobacterium tuberculosis
IIHDEDSVMPHPQQAP

SEQ ID NO: 122019 - protein, 16 aa, Mycobacterium tuberculosis
IHDEDSVMPHPQQAPV

SEQ ID NO: 122020 - protein, 16 aa, Mycobacterium tuberculosis
HDEDSVMPHPQQAPVL

SEQ ID NO: 122021 - protein, 16 aa, Mycobacterium tuberculosis
DEDSVMPHPQQAPVLV

SEQ ID NO: 122022 - protein, 16 aa, Mycobacterium tuberculosis
EDSVMPHPQQAPVLVG

SEQ ID NO: 122023 - protein, 16 aa, Mycobacterium tuberculosis
DSVMPHPQQAPVLVGV

SEQ ID NO: 122024 - protein, 16 aa, Mycobacterium tuberculosis
SVMPHPQQAPVLVGVD

SEQ ID NO: 122025 - protein, 16 aa, Mycobacterium tuberculosis
VMPHPQQAPVLVGVDG

SEQ ID NO: 122026 - protein, 16 aa, Mycobacterium tuberculosis
MPHPQQAPVLVGVDGS

SEQ ID NO: 122027 - protein, 16 aa, Mycobacterium tuberculosis
PHPQQAPVLVGVDGSS

SEQ ID NO: 122028 - protein, 16 aa, Mycobacterium tuberculosis
HPQQAPVLVGVDGSSA

SEQ ID NO: 122029 - protein, 16 aa, Mycobacterium tuberculosis
PQQAPVLVGVDGSSAS

SEQ ID NO: 122030 - protein, 16 aa, Mycobacterium tuberculosis
QQAPVLVGVDGSSASE

SEQ ID NO: 122031 - protein, 16 aa, Mycobacterium tuberculosis
QAPVLVGVDGSSASEL

SEQ ID NO: 122032 - protein, 16 aa, Mycobacterium tuberculosis
APVLVGVDGSSASELA

SEQ ID NO: 122033 - protein, 16 aa, Mycobacterium tuberculosis
PVLVGVDGSSASELAT

SEQ ID NO: 122034 - protein, 16 aa, Mycobacterium tuberculosis
VLVGVDGSSASELATA

SEQ ID NO: 122035 - protein, 16 aa, Mycobacterium tuberculosis
LVGVDGSSASELATAI

SEQ ID NO: 122036 - protein, 16 aa, Mycobacterium tuberculosis
VGVDGSSASELATAIA

SEQ ID NO: 122037 - protein, 16 aa, Mycobacterium tuberculosis
GVDGSSASELATAIAF

SEQ ID NO: 122038 - protein, 16 aa, Mycobacterium tuberculosis
VDGSSASELATAIAFD

SEQ ID NO: 122039 - protein, 16 aa, Mycobacterium tuberculosis
DGSSASELATAIAFDE

SEQ ID NO: 122040 - protein, 16 aa, Mycobacterium tuberculosis
GSSASELATAIAFDEA

SEQ ID NO: 122041 - protein, 16 aa, Mycobacterium tuberculosis
SSASELATAIAFDEAS

SEQ ID NO: 122042 - protein, 16 aa, Mycobacterium tuberculosis
SASELATAIAFDEASR

SEQ ID NO: 122043 - protein, 16 aa, Mycobacterium tuberculosis
ASELATAIAFDEASRR

SEQ ID NO: 122044 - protein, 16 aa, Mycobacterium tuberculosis
SELATAIAFDEASRRN

SEQ ID NO: 122045 - protein, 16 aa, Mycobacterium tuberculosis
ELATAIAFDEASRRNV

SEQ ID NO: 122046 - protein, 16 aa, Mycobacterium tuberculosis
LATAIAFDEASRRNVD

SEQ ID NO: 122047 - protein, 16 aa, Mycobacterium tuberculosis
ATAIAFDEASRRNVDL

SEQ ID NO: 122048 - protein, 16 aa, Mycobacterium tuberculosis
TAIAFDEASRRNVDLV

SEQ ID NO: 122049 - protein, 16 aa, Mycobacterium tuberculosis
AIAFDEASRRNVDLVA

SEQ ID NO: 122050 - protein, 16 aa, Mycobacterium tuberculosis
IAFDEASRRNVDLVAL

SEQ ID NO: 122051 - protein, 16 aa, Mycobacterium tuberculosis
AFDEASRRNVDLVALH

SEQ ID NO: 122052 - protein, 16 aa, Mycobacterium tuberculosis
FDEASRRNVDLVALHA

SEQ ID NO: 122053 - protein, 16 aa, Mycobacterium tuberculosis
DEASRRNVDLVALHAW

SEQ ID NO: 122054 - protein, 16 aa, Mycobacterium tuberculosis
EASRRNVDLVALHAWS

SEQ ID NO: 122055 - protein, 16 aa, Mycobacterium tuberculosis
ASRRNVDLVALHAWSD

SEQ ID NO: 122056 - protein, 16 aa, Mycobacterium tuberculosis
SRRNVDLVALHAWSDV

SEQ ID NO: 122057 - protein, 16 aa, Mycobacterium tuberculosis
RRNVDLVALHAWSDVD

SEQ ID NO: 122058 - protein, 16 aa, Mycobacterium tuberculosis
RNVDLVALHAWSDVDV

SEQ ID NO: 122059 - protein, 16 aa, Mycobacterium tuberculosis
NVDLVALHAWSDVDVS

SEQ ID NO: 122060 - protein, 16 aa, Mycobacterium tuberculosis
VDLVALHAWSDVDVSE

SEQ ID NO: 122061 - protein, 16 aa, Mycobacterium tuberculosis
DLVALHAWSDVDVSEW

SEQ ID NO: 122062 - protein, 16 aa, Mycobacterium tuberculosis
LVALHAWSDVDVSEWP

SEQ ID NO: 122063 - protein, 16 aa, Mycobacterium tuberculosis
VALHAWSDVDVSEWPG

SEQ ID NO: 122064 - protein, 16 aa, Mycobacterium tuberculosis
ALHAWSDVDVSEWPGI

SEQ ID NO: 122065 - protein, 16 aa, Mycobacterium tuberculosis
LHAWSDVDVSEWPGID

SEQ ID NO: 122066 - protein, 16 aa, Mycobacterium tuberculosis
HAWSDVDVSEWPGIDW

SEQ ID NO: 122067 - protein, 16 aa, Mycobacterium tuberculosis
AWSDVDVSEWPGIDWP

SEQ ID NO: 122068 - protein, 16 aa, Mycobacterium tuberculosis
WSDVDVSEWPGIDWPA

SEQ ID NO: 122069 - protein, 16 aa, Mycobacterium tuberculosis
SDVDVSEWPGIDWPAT

SEQ ID NO: 122070 - protein, 16 aa, Mycobacterium tuberculosis
DVDVSEWPGIDWPATQ

SEQ ID NO: 122071 - protein, 16 aa, Mycobacterium tuberculosis
VDVSEWPGIDWPATQS

SEQ ID NO: 122072 - protein, 16 aa, Mycobacterium tuberculosis
DVSEWPGIDWPATQSM

SEQ ID NO: 122073 - protein, 16 aa, Mycobacterium tuberculosis
VSEWPGIDWPATQSMA

SEQ ID NO: 122074 - protein, 16 aa, Mycobacterium tuberculosis
SEWPGIDWPATQSMAE

SEQ ID NO: 122075 - protein, 16 aa, Mycobacterium tuberculosis
EWPGIDWPATQSMAEQ

SEQ ID NO: 122076 - protein, 16 aa, Mycobacterium tuberculosis
WPGIDWPATQSMAEQV

SEQ ID NO: 122077 - protein, 16 aa, Mycobacterium tuberculosis
PGIDWPATQSMAEQVL

SEQ ID NO: 122078 - protein, 16 aa, Mycobacterium tuberculosis
GIDWPATQSMAEQVLA

SEQ ID NO: 122079 - protein, 16 aa, Mycobacterium tuberculosis
IDWPATQSMAEQVLAE

SEQ ID NO: 122080 - protein, 16 aa, Mycobacterium tuberculosis
DWPATQSMAEQVLAER

SEQ ID NO: 122081 - protein, 16 aa, Mycobacterium tuberculosis
WPATQSMAEQVLAERL

SEQ ID NO: 122082 - protein, 16 aa, Mycobacterium tuberculosis
PATQSMAEQVLAERLA

SEQ ID NO: 122083 - protein, 16 aa, Mycobacterium tuberculosis
ATQSMAEQVLAERLAG

SEQ ID NO: 122084 - protein, 16 aa, Mycobacterium tuberculosis
TQSMAEQVLAERLAGW

SEQ ID NO: 122085 - protein, 16 aa, Mycobacterium tuberculosis
QSMAEQVLAERLAGWQ

SEQ ID NO: 122086 - protein, 16 aa, Mycobacterium tuberculosis
SMAEQVLAERLAGWQE

SEQ ID NO: 122087 - protein, 16 aa, Mycobacterium tuberculosis
MAEQVLAERLAGWQER

SEQ ID NO: 122088 - protein, 16 aa, Mycobacterium tuberculosis
AEQVLAERLAGWQERY

SEQ ID NO: 122089 - protein, 16 aa, Mycobacterium tuberculosis
EQVLAERLAGWQERYP

SEQ ID NO: 122090 - protein, 16 aa, Mycobacterium tuberculosis
QVLAERLAGWQERYPN

SEQ ID NO: 122091 - protein, 16 aa, Mycobacterium tuberculosis
VLAERLAGWQERYPNV

SEQ ID NO: 122092 - protein, 16 aa, Mycobacterium tuberculosis
LAERLAGWQERYPNVA

SEQ ID NO: 122093 - protein, 16 aa, Mycobacterium tuberculosis
AERLAGWQERYPNVAI

SEQ ID NO: 122094 - protein, 16 aa, Mycobacterium tuberculosis
ERLAGWQERYPNVAIT

SEQ ID NO: 122095 - protein, 16 aa, Mycobacterium tuberculosis
RLAGWQERYPNVAITR

SEQ ID NO: 122096 - protein, 16 aa, Mycobacterium tuberculosis
LAGWQERYPNVAITRV

SEQ ID NO: 122097 - protein, 16 aa, Mycobacterium tuberculosis
AGWQERYPNVAITRVV

SEQ ID NO: 122098 - protein, 16 aa, Mycobacterium tuberculosis
GWQERYPNVAITRVVV

SEQ ID NO: 122099 - protein, 16 aa, Mycobacterium tuberculosis
WQERYPNVAITRVVVR

SEQ ID NO: 122100 - protein, 16 aa, Mycobacterium tuberculosis
QERYPNVAITRVVVRD

SEQ ID NO: 122101 - protein, 16 aa, Mycobacterium tuberculosis
ERYPNVAITRVVVRDQ

SEQ ID NO: 122102 - protein, 16 aa, Mycobacterium tuberculosis
RYPNVAITRVVVRDQP

SEQ ID NO: 122103 - protein, 16 aa, Mycobacterium tuberculosis
YPNVAITRVVVRDQPA

SEQ ID NO: 122104 - protein, 16 aa, Mycobacterium tuberculosis
PNVAITRVVVRDQPAR

SEQ ID NO: 122105 - protein, 16 aa, Mycobacterium tuberculosis
NVAITRVVVRDQPARQ

SEQ ID NO: 122106 - protein, 16 aa, Mycobacterium tuberculosis
VAITRVVVRDQPARQL

SEQ ID NO: 122107 - protein, 16 aa, Mycobacterium tuberculosis
AITRVVVRDQPARQLV

SEQ ID NO: 122108 - protein, 16 aa, Mycobacterium tuberculosis
ITRVVVRDQPARQLVQ

SEQ ID NO: 122109 - protein, 16 aa, Mycobacterium tuberculosis
TRVVVRDQPARQLVQR

SEQ ID NO: 122110 - protein, 16 aa, Mycobacterium tuberculosis
RVVVRDQPARQLVQRS

SEQ ID NO: 122111 - protein, 16 aa, Mycobacterium tuberculosis
VVVRDQPARQLVQRSE

SEQ ID NO: 122112 - protein, 16 aa, Mycobacterium tuberculosis
VVRDQPARQLVQRSEE

SEQ ID NO: 122113 - protein, 16 aa, Mycobacterium tuberculosis
VRDQPARQLVQRSEEA

SEQ ID NO: 122114 - protein, 16 aa, Mycobacterium tuberculosis
RDQPARQLVQRSEEAQ

SEQ ID NO: 122115 - protein, 16 aa, Mycobacterium tuberculosis
DQPARQLVQRSEEAQL

SEQ ID NO: 122116 - protein, 16 aa, Mycobacterium tuberculosis
QPARQLVQRSEEAQLV

SEQ ID NO: 122117 - protein, 16 aa, Mycobacterium tuberculosis
PARQLVQRSEEAQLVV

SEQ ID NO: 122118 - protein, 16 aa, Mycobacterium tuberculosis
ARQLVQRSEEAQLVVV

SEQ ID NO: 122119 - protein, 16 aa, Mycobacterium tuberculosis
RQLVQRSEEAQLVVVG

SEQ ID NO: 122120 - protein, 16 aa, Mycobacterium tuberculosis
QLVQRSEEAQLVVVGS

SEQ ID NO: 122121 - protein, 16 aa, Mycobacterium tuberculosis
LVQRSEEAQLVVVGSR

SEQ ID NO: 122122 - protein, 16 aa, Mycobacterium tuberculosis
VQRSEEAQLVVVGSRG

SEQ ID NO: 122123 - protein, 16 aa, Mycobacterium tuberculosis
QRSEEAQLVVVGSRGR

SEQ ID NO: 122124 - protein, 16 aa, Mycobacterium tuberculosis
RSEEAQLVVVGSRGRG

SEQ ID NO: 122125 - protein, 16 aa, Mycobacterium tuberculosis
SEEAQLVVVGSRGRGG

SEQ ID NO: 122126 - protein, 16 aa, Mycobacterium tuberculosis
EEAQLVVVGSRGRGGY

SEQ ID NO: 122127 - protein, 16 aa, Mycobacterium tuberculosis
EAQLVVVGSRGRGGYA

SEQ ID NO: 122128 - protein, 16 aa, Mycobacterium tuberculosis
AQLVVVGSRGRGGYAG

SEQ ID NO: 122129 - protein, 16 aa, Mycobacterium tuberculosis
QLVVVGSRGRGGYAGM

SEQ ID NO: 122130 - protein, 16 aa, Mycobacterium tuberculosis
LVVVGSRGRGGYAGML

SEQ ID NO: 122131 - protein, 16 aa, Mycobacterium tuberculosis
VVVGSRGRGGYAGMLV

SEQ ID NO: 122132 - protein, 16 aa, Mycobacterium tuberculosis
VVGSRGRGGYAGMLVG

SEQ ID NO: 122133 - protein, 16 aa, Mycobacterium tuberculosis
VGSRGRGGYAGMLVGS

SEQ ID NO: 122134 - protein, 16 aa, Mycobacterium tuberculosis
GSRGRGGYAGMLVGSV

SEQ ID NO: 122135 - protein, 16 aa, Mycobacterium tuberculosis
SRGRGGYAGMLVGSVG

SEQ ID NO: 122136 - protein, 16 aa, Mycobacterium tuberculosis
RGRGGYAGMLVGSVGE

SEQ ID NO: 122137 - protein, 16 aa, Mycobacterium tuberculosis
GRGGYAGMLVGSVGET

SEQ ID NO: 122138 - protein, 16 aa, Mycobacterium tuberculosis
RGGYAGMLVGSVGETV

SEQ ID NO: 122139 - protein, 16 aa, Mycobacterium tuberculosis
GGYAGMLVGSVGETVA

SEQ ID NO: 122140 - protein, 16 aa, Mycobacterium tuberculosis
GYAGMLVGSVGETVAQ

SEQ ID NO: 122141 - protein, 16 aa, Mycobacterium tuberculosis
YAGMLVGSVGETVAQL

SEQ ID NO: 122142 - protein, 16 aa, Mycobacterium tuberculosis
AGMLVGSVGETVAQLA

SEQ ID NO: 122143 - protein, 16 aa, Mycobacterium tuberculosis
GMLVGSVGETVAQLAR

SEQ ID NO: 122144 - protein, 16 aa, Mycobacterium tuberculosis
MLVGSVGETVAQLART

SEQ ID NO: 122145 - protein, 16 aa, Mycobacterium tuberculosis
LVGSVGETVAQLARTP

SEQ ID NO: 122146 - protein, 16 aa, Mycobacterium tuberculosis
VGSVGETVAQLARTPV

SEQ ID NO: 122147 - protein, 16 aa, Mycobacterium tuberculosis
GSVGETVAQLARTPVI

SEQ ID NO: 122148 - protein, 16 aa, Mycobacterium tuberculosis
SVGETVAQLARTPVIV

SEQ ID NO: 122149 - protein, 16 aa, Mycobacterium tuberculosis
VGETVAQLARTPVIVA

SEQ ID NO: 122150 - protein, 16 aa, Mycobacterium tuberculosis
GETVAQLARTPVIVAR

SEQ ID NO: 122151 - protein, 16 aa, Mycobacterium tuberculosis
ETVAQLARTPVIVARE

SEQ ID NO: 122152 - protein, 16 aa, Mycobacterium tuberculosis
TVAQLARTPVIVARES

SEQ ID NO: 122153 - protein, 16 aa, Mycobacterium tuberculosis
VAQLARTPVIVARESL

SEQ ID NO: 122154 - protein, 16 aa, Mycobacterium tuberculosis
AQLARTPVIVARESLT

SEQ ID NO: 122155 - protein, 407 aa, Mycobacterium tuberculosis
MSGRHRKPTTSNVSVAKIAFTGAVLGGGGIAMAAQATAATDGEWDQVARCESGGNWSINTGNGYLGGLQFTQSTWAAHGGGEFAPSAQLASREQQIAVGERVLATQGRGAWPVCGRGLSNATPREVLPASAAMDAPLDAAAVNGEPAPLAPPPADPAPPVELAANDLPAPLGEPLPAAPADPAPPADLAPPAPADVAPPVELAVNDLPAPLGEPLPAAPADPAPPADLAPPAPADLAPPAPADLAPPAPADLAPPVELAVNDLPAPLGEPLPAAPAELAPPADLAPASADLAPPAPADLAPPAPAELAPPAPADLAPPAAVNEQTAPGDQPATAPGGPVGLATDLELPEPDPQPADAPPPGDVTEAPAETPQVSNIAYTKKLWQAIRAQDVCGNDALDSLAQPYVIG

SEQ ID NO: 122156 - protein, 8 aa, Mycobacterium tuberculosis
PTTSNVSV

SEQ ID NO: 122157 - protein, 8 aa, Mycobacterium tuberculosis
TTSNVSVA

SEQ ID NO: 122158 - protein, 8 aa, Mycobacterium tuberculosis
TSNVSVAK

SEQ ID NO: 122159 - protein, 8 aa, Mycobacterium tuberculosis
VSVAKIAF

SEQ ID NO: 122160 - protein, 8 aa, Mycobacterium tuberculosis
SVAKIAFT

SEQ ID NO: 122161 - protein, 8 aa, Mycobacterium tuberculosis
AKIAFTGA

SEQ ID NO: 122162 - protein, 8 aa, Mycobacterium tuberculosis
KIAFTGAV

SEQ ID NO: 122163 - protein, 8 aa, Mycobacterium tuberculosis
IAFTGAVL

SEQ ID NO: 122164 - protein, 8 aa, Mycobacterium tuberculosis
AVLGGGGI

SEQ ID NO: 122165 - protein, 8 aa, Mycobacterium tuberculosis
VLGGGGIA

SEQ ID NO: 122166 - protein, 8 aa, Mycobacterium tuberculosis
GIAMAAQA

SEQ ID NO: 122167 - protein, 8 aa, Mycobacterium tuberculosis
AMAAQATA

SEQ ID NO: 122168 - protein, 8 aa, Mycobacterium tuberculosis
MAAQATAA

SEQ ID NO: 122169 - protein, 8 aa, Mycobacterium tuberculosis
TAATDGEW

SEQ ID NO: 122170 - protein, 8 aa, Mycobacterium tuberculosis
ESGGNWSI

SEQ ID NO: 122171 - protein, 8 aa, Mycobacterium tuberculosis
SINTGNGY

SEQ ID NO: 122172 - protein, 8 aa, Mycobacterium tuberculosis
GYLGGLQF

SEQ ID NO: 122173 - protein, 8 aa, Mycobacterium tuberculosis
YLGGLQFT

SEQ ID NO: 122174 - protein, 8 aa, Mycobacterium tuberculosis
GLQFTQST

SEQ ID NO: 122175 - protein, 8 aa, Mycobacterium tuberculosis
LQFTQSTW

SEQ ID NO: 122176 - protein, 8 aa, Mycobacterium tuberculosis
FTQSTWAA

SEQ ID NO: 122177 - protein, 8 aa, Mycobacterium tuberculosis
TQSTWAAH

SEQ ID NO: 122178 - protein, 8 aa, Mycobacterium tuberculosis
AAHGGGEF

SEQ ID NO: 122179 - protein, 8 aa, Mycobacterium tuberculosis
EFAPSAQL

SEQ ID NO: 122180 - protein, 8 aa, Mycobacterium tuberculosis
FAPSAQLA

SEQ ID NO: 122181 - protein, 8 aa, Mycobacterium tuberculosis
APSAQLAS

SEQ ID NO: 122182 - protein, 8 aa, Mycobacterium tuberculosis
QQIAVGER

SEQ ID NO: 122183 - protein, 8 aa, Mycobacterium tuberculosis
QIAVGERV

SEQ ID NO: 122184 - protein, 8 aa, Mycobacterium tuberculosis
RVLATQGR

SEQ ID NO: 122185 - protein, 8 aa, Mycobacterium tuberculosis
QGRGAWPV

SEQ ID NO: 122186 - protein, 8 aa, Mycobacterium tuberculosis
GAWPVCGR

SEQ ID NO: 122187 - protein, 8 aa, Mycobacterium tuberculosis
WPVCGRGL

SEQ ID NO: 122188 - protein, 8 aa, Mycobacterium tuberculosis
GLSNATPR

SEQ ID NO: 122189 - protein, 8 aa, Mycobacterium tuberculosis
TPREVLPA

SEQ ID NO: 122190 - protein, 8 aa, Mycobacterium tuberculosis
EVLPASAA

SEQ ID NO: 122191 - protein, 8 aa, Mycobacterium tuberculosis
VLPASAAM

SEQ ID NO: 122192 - protein, 8 aa, Mycobacterium tuberculosis
SAAMDAPL

SEQ ID NO: 122193 - protein, 8 aa, Mycobacterium tuberculosis
AMDAPLDA

SEQ ID NO: 122194 - protein, 8 aa, Mycobacterium tuberculosis
MDAPLDAA

SEQ ID NO: 122195 - protein, 8 aa, Mycobacterium tuberculosis
APLDAAAV

SEQ ID NO: 122196 - protein, 8 aa, Mycobacterium tuberculosis
AAVNGEPA

SEQ ID NO: 122197 - protein, 8 aa, Mycobacterium tuberculosis
APLAPPPA

SEQ ID NO: 122198 - protein, 8 aa, Mycobacterium tuberculosis
APPPADPA

SEQ ID NO: 122199 - protein, 8 aa, Mycobacterium tuberculosis
PADPAPPV

SEQ ID NO: 122200 - protein, 8 aa, Mycobacterium tuberculosis
DPAPPVEL

SEQ ID NO: 122201 - protein, 8 aa, Mycobacterium tuberculosis
VELAANDL

SEQ ID NO: 122202 - protein, 8 aa, Mycobacterium tuberculosis
LPAPLGEP

SEQ ID NO: 122203 - protein, 8 aa, Mycobacterium tuberculosis
PLGEPLPA

SEQ ID NO: 122204 - protein, 8 aa, Mycobacterium tuberculosis
EPLPAAPA

SEQ ID NO: 122205 - protein, 8 aa, Mycobacterium tuberculosis
DLAPPAPA

SEQ ID NO: 122206 - protein, 8 aa, Mycobacterium tuberculosis
APPAPADV

SEQ ID NO: 122207 - protein, 8 aa, Mycobacterium tuberculosis
PADVAPPV

SEQ ID NO: 122208 - protein, 8 aa, Mycobacterium tuberculosis
DVAPPVEL

SEQ ID NO: 122209 - protein, 8 aa, Mycobacterium tuberculosis
APPVELAV

SEQ ID NO: 122210 - protein, 8 aa, Mycobacterium tuberculosis
VELAVNDL

SEQ ID NO: 122211 - protein, 8 aa, Mycobacterium tuberculosis
LAVNDLPA

SEQ ID NO: 122212 - protein, 8 aa, Mycobacterium tuberculosis
LPAPLGEP

SEQ ID NO: 122213 - protein, 8 aa, Mycobacterium tuberculosis
PLGEPLPA

SEQ ID NO: 122214 - protein, 8 aa, Mycobacterium tuberculosis
EPLPAAPA

SEQ ID NO: 122215 - protein, 8 aa, Mycobacterium tuberculosis
DLAPPAPA

SEQ ID NO: 122216 - protein, 8 aa, Mycobacterium tuberculosis
APPAPADL

SEQ ID NO: 122217 - protein, 8 aa, Mycobacterium tuberculosis
DLAPPAPA

SEQ ID NO: 122218 - protein, 8 aa, Mycobacterium tuberculosis
APPAPADL

SEQ ID NO: 122219 - protein, 8 aa, Mycobacterium tuberculosis
DLAPPAPA

SEQ ID NO: 122220 - protein, 8 aa, Mycobacterium tuberculosis
APPAPADL

SEQ ID NO: 122221 - protein, 8 aa, Mycobacterium tuberculosis
DLAPPVEL

SEQ ID NO: 122222 - protein, 8 aa, Mycobacterium tuberculosis
APPVELAV

SEQ ID NO: 122223 - protein, 8 aa, Mycobacterium tuberculosis
VELAVNDL

SEQ ID NO: 122224 - protein, 8 aa, Mycobacterium tuberculosis
LAVNDLPA

SEQ ID NO: 122225 - protein, 8 aa, Mycobacterium tuberculosis
LPAPLGEP

SEQ ID NO: 122226 - protein, 8 aa, Mycobacterium tuberculosis
PLGEPLPA

SEQ ID NO: 122227 - protein, 8 aa, Mycobacterium tuberculosis
EPLPAAPA

SEQ ID NO: 122228 - protein, 8 aa, Mycobacterium tuberculosis
LPAAPAEL

SEQ ID NO: 122229 - protein, 8 aa, Mycobacterium tuberculosis
ELAPPADL

SEQ ID NO: 122230 - protein, 8 aa, Mycobacterium tuberculosis
PPADLAPA

SEQ ID NO: 122231 - protein, 8 aa, Mycobacterium tuberculosis
APASADLA

SEQ ID NO: 122232 - protein, 8 aa, Mycobacterium tuberculosis
DLAPPAPA

SEQ ID NO: 122233 - protein, 8 aa, Mycobacterium tuberculosis
APPAPADL

SEQ ID NO: 122234 - protein, 8 aa, Mycobacterium tuberculosis
DLAPPAPA

SEQ ID NO: 122235 - protein, 8 aa, Mycobacterium tuberculosis
APPAPAEL

SEQ ID NO: 122236 - protein, 8 aa, Mycobacterium tuberculosis
ELAPPAPA

SEQ ID NO: 122237 - protein, 8 aa, Mycobacterium tuberculosis
APPAPADL

SEQ ID NO: 122238 - protein, 8 aa, Mycobacterium tuberculosis
DLAPPAAV

SEQ ID NO: 122239 - protein, 8 aa, Mycobacterium tuberculosis
ATAPGGPV

SEQ ID NO: 122240 - protein, 8 aa, Mycobacterium tuberculosis
APGGPVGL

SEQ ID NO: 122241 - protein, 8 aa, Mycobacterium tuberculosis
GLATDLEL

SEQ ID NO: 122242 - protein, 8 aa, Mycobacterium tuberculosis
APAETPQV

SEQ ID NO: 122243 - protein, 8 aa, Mycobacterium tuberculosis
ETPQVSNI

SEQ ID NO: 122244 - protein, 8 aa, Mycobacterium tuberculosis
TPQVSNIA

SEQ ID NO: 122245 - protein, 8 aa, Mycobacterium tuberculosis
PQVSNIAY

SEQ ID NO: 122246 - protein, 8 aa, Mycobacterium tuberculosis
QVSNIAYT

SEQ ID NO: 122247 - protein, 8 aa, Mycobacterium tuberculosis
VSNIAYTK

SEQ ID NO: 122248 - protein, 8 aa, Mycobacterium tuberculosis
IAYTKKLW

SEQ ID NO: 122249 - protein, 8 aa, Mycobacterium tuberculosis
YTKKLWQA

SEQ ID NO: 122250 - protein, 8 aa, Mycobacterium tuberculosis
KLWQAIRA

SEQ ID NO: 122251 - protein, 8 aa, Mycobacterium tuberculosis
DVCGNDAL

SEQ ID NO: 122252 - protein, 8 aa, Mycobacterium tuberculosis
ALDSLAQP

SEQ ID NO: 122253 - protein, 8 aa, Mycobacterium tuberculosis
LDSLAQPY

SEQ ID NO: 122254 - protein, 8 aa, Mycobacterium tuberculosis
DSLAQPYV

SEQ ID NO: 122255 - protein, 8 aa, Mycobacterium tuberculosis
SLAQPYVI

SEQ ID NO: 122256 - protein, 9 aa, Mycobacterium tuberculosis
KPTTSNVSV

SEQ ID NO: 122257 - protein, 9 aa, Mycobacterium tuberculosis
TTSNVSVAK

SEQ ID NO: 122258 - protein, 9 aa, Mycobacterium tuberculosis
NVSVAKIAF

SEQ ID NO: 122259 - protein, 9 aa, Mycobacterium tuberculosis
VAKIAFTGA

SEQ ID NO: 122260 - protein, 9 aa, Mycobacterium tuberculosis
AKIAFTGAV

SEQ ID NO: 122261 - protein, 9 aa, Mycobacterium tuberculosis
KIAFTGAVL

SEQ ID NO: 122262 - protein, 9 aa, Mycobacterium tuberculosis
VLGGGGIAM

SEQ ID NO: 122263 - protein, 9 aa, Mycobacterium tuberculosis
IAMAAQATA

SEQ ID NO: 122264 - protein, 9 aa, Mycobacterium tuberculosis
AMAAQATAA

SEQ ID NO: 122265 - protein, 9 aa, Mycobacterium tuberculosis
MAAQATAAT

SEQ ID NO: 122266 - protein, 9 aa, Mycobacterium tuberculosis
ATAATDGEW

SEQ ID NO: 122267 - protein, 9 aa, Mycobacterium tuberculosis
ATDGEWDQV

SEQ ID NO: 122268 - protein, 9 aa, Mycobacterium tuberculosis
CESGGNWSI

SEQ ID NO: 122269 - protein, 9 aa, Mycobacterium tuberculosis
WSINTGNGY

SEQ ID NO: 122270 - protein, 9 aa, Mycobacterium tuberculosis
SINTGNGYL

SEQ ID NO: 122271 - protein, 9 aa, Mycobacterium tuberculosis
YLGGLQFTQ

SEQ ID NO: 122272 - protein, 9 aa, Mycobacterium tuberculosis
LQFTQSTWA

SEQ ID NO: 122273 - protein, 9 aa, Mycobacterium tuberculosis
FTQSTWAAH

SEQ ID NO: 122274 - protein, 9 aa, Mycobacterium tuberculosis
WAAHGGGEF

SEQ ID NO: 122275 - protein, 9 aa, Mycobacterium tuberculosis
GEFAPSAQL

SEQ ID NO: 122276 - protein, 9 aa, Mycobacterium tuberculosis
QLASREQQI

SEQ ID NO: 122277 - protein, 9 aa, Mycobacterium tuberculosis
EQQIAVGER

SEQ ID NO: 122278 - protein, 9 aa, Mycobacterium tuberculosis
QQIAVGERV

SEQ ID NO: 122279 - protein, 9 aa, Mycobacterium tuberculosis
VLATQGRGA

SEQ ID NO: 122280 - protein, 9 aa, Mycobacterium tuberculosis
LATQGRGAW

SEQ ID NO: 122281 - protein, 9 aa, Mycobacterium tuberculosis
TQGRGAWPV

SEQ ID NO: 122282 - protein, 9 aa, Mycobacterium tuberculosis
WPVCGRGLS

SEQ ID NO: 122283 - protein, 9 aa, Mycobacterium tuberculosis
RGLSNATPR

SEQ ID NO: 122284 - protein, 9 aa, Mycobacterium tuberculosis
TPREVLPAS

SEQ ID NO: 122285 - protein, 9 aa, Mycobacterium tuberculosis
EVLPASAAM

SEQ ID NO: 122286 - protein, 9 aa, Mycobacterium tuberculosis
LPASAAMDA

SEQ ID NO: 122287 - protein, 9 aa, Mycobacterium tuberculosis
ASAAMDAPL

SEQ ID NO: 122288 - protein, 9 aa, Mycobacterium tuberculosis
AMDAPLDAA

SEQ ID NO: 122289 - protein, 9 aa, Mycobacterium tuberculosis
MDAPLDAAA

SEQ ID NO: 122290 - protein, 9 aa, Mycobacterium tuberculosis
DAPLDAAAV

SEQ ID NO: 122291 - protein, 9 aa, Mycobacterium tuberculosis
AVNGEPAPL

SEQ ID NO: 122292 - protein, 9 aa, Mycobacterium tuberculosis
PPADPAPPV

SEQ ID NO: 122293 - protein, 9 aa, Mycobacterium tuberculosis
DPAPPVELA

SEQ ID NO: 122294 - protein, 9 aa, Mycobacterium tuberculosis
ELAANDLPA

SEQ ID NO: 122295 - protein, 9 aa, Mycobacterium tuberculosis
AANDLPAPL

SEQ ID NO: 122296 - protein, 9 aa, Mycobacterium tuberculosis
LPAPLGEPL

SEQ ID NO: 122297 - protein, 9 aa, Mycobacterium tuberculosis
APLGEPLPA

SEQ ID NO: 122298 - protein, 9 aa, Mycobacterium tuberculosis
PLGEPLPAA

SEQ ID NO: 122299 - protein, 9 aa, Mycobacterium tuberculosis
EPLPAAPAD

SEQ ID NO: 122300 - protein, 9 aa, Mycobacterium tuberculosis
LPAAPADPA

SEQ ID NO: 122301 - protein, 9 aa, Mycobacterium tuberculosis
APADPAPPA

SEQ ID NO: 122302 - protein, 9 aa, Mycobacterium tuberculosis
PPADLAPPA

SEQ ID NO: 122303 - protein, 9 aa, Mycobacterium tuberculosis
APPAPADVA

SEQ ID NO: 122304 - protein, 9 aa, Mycobacterium tuberculosis
APADVAPPV

SEQ ID NO: 122305 - protein, 9 aa, Mycobacterium tuberculosis
DVAPPVELA

SEQ ID NO: 122306 - protein, 9 aa, Mycobacterium tuberculosis
VAPPVELAV

SEQ ID NO: 122307 - protein, 9 aa, Mycobacterium tuberculosis
ELAVNDLPA

SEQ ID NO: 122308 - protein, 9 aa, Mycobacterium tuberculosis
AVNDLPAPL

SEQ ID NO: 122309 - protein, 9 aa, Mycobacterium tuberculosis
LPAPLGEPL

SEQ ID NO: 122310 - protein, 9 aa, Mycobacterium tuberculosis
APLGEPLPA

SEQ ID NO: 122311 - protein, 9 aa, Mycobacterium tuberculosis
PLGEPLPAA

SEQ ID NO: 122312 - protein, 9 aa, Mycobacterium tuberculosis
EPLPAAPAD

SEQ ID NO: 122313 - protein, 9 aa, Mycobacterium tuberculosis
LPAAPADPA

SEQ ID NO: 122314 - protein, 9 aa, Mycobacterium tuberculosis
APADPAPPA

SEQ ID NO: 122315 - protein, 9 aa, Mycobacterium tuberculosis
PPADLAPPA

SEQ ID NO: 122316 - protein, 9 aa, Mycobacterium tuberculosis
APPAPADLA

SEQ ID NO: 122317 - protein, 9 aa, Mycobacterium tuberculosis
APADLAPPA

SEQ ID NO: 122318 - protein, 9 aa, Mycobacterium tuberculosis
APPAPADLA

SEQ ID NO: 122319 - protein, 9 aa, Mycobacterium tuberculosis
APADLAPPA

SEQ ID NO: 122320 - protein, 9 aa, Mycobacterium tuberculosis
APPAPADLA

SEQ ID NO: 122321 - protein, 9 aa, Mycobacterium tuberculosis
APADLAPPV

SEQ ID NO: 122322 - protein, 9 aa, Mycobacterium tuberculosis
DLAPPVELA

SEQ ID NO: 122323 - protein, 9 aa, Mycobacterium tuberculosis
LAPPVELAV

SEQ ID NO: 122324 - protein, 9 aa, Mycobacterium tuberculosis
ELAVNDLPA

SEQ ID NO: 122325 - protein, 9 aa, Mycobacterium tuberculosis
AVNDLPAPL

SEQ ID NO: 122326 - protein, 9 aa, Mycobacterium tuberculosis
LPAPLGEPL

SEQ ID NO: 122327 - protein, 9 aa, Mycobacterium tuberculosis
APLGEPLPA

SEQ ID NO: 122328 - protein, 9 aa, Mycobacterium tuberculosis
PLGEPLPAA

SEQ ID NO: 122329 - protein, 9 aa, Mycobacterium tuberculosis
EPLPAAPAE

SEQ ID NO: 122330 - protein, 9 aa, Mycobacterium tuberculosis
PLPAAPAEL

SEQ ID NO: 122331 - protein, 9 aa, Mycobacterium tuberculosis
LPAAPAELA

SEQ ID NO: 122332 - protein, 9 aa, Mycobacterium tuberculosis
APAELAPPA

SEQ ID NO: 122333 - protein, 9 aa, Mycobacterium tuberculosis
AELAPPADL

SEQ ID NO: 122334 - protein, 9 aa, Mycobacterium tuberculosis
ELAPPADLA

SEQ ID NO: 122335 - protein, 9 aa, Mycobacterium tuberculosis
APPADLAPA

SEQ ID NO: 122336 - protein, 9 aa, Mycobacterium tuberculosis
DLAPASADL

SEQ ID NO: 122337 - protein, 9 aa, Mycobacterium tuberculosis
APPAPADLA

SEQ ID NO: 122338 - protein, 9 aa, Mycobacterium tuberculosis
APADLAPPA

SEQ ID NO: 122339 - protein, 9 aa, Mycobacterium tuberculosis
LAPPAPAEL

SEQ ID NO: 122340 - protein, 9 aa, Mycobacterium tuberculosis
APAELAPPA

SEQ ID NO: 122341 - protein, 9 aa, Mycobacterium tuberculosis
AELAPPAPA

SEQ ID NO: 122342 - protein, 9 aa, Mycobacterium tuberculosis
APPAPADLA

SEQ ID NO: 122343 - protein, 9 aa, Mycobacterium tuberculosis
APADLAPPA

SEQ ID NO: 122344 - protein, 9 aa, Mycobacterium tuberculosis
QTAPGDQPA

SEQ ID NO: 122345 - protein, 9 aa, Mycobacterium tuberculosis
TAPGGPVGL

SEQ ID NO: 122346 - protein, 9 aa, Mycobacterium tuberculosis
APGGPVGLA

SEQ ID NO: 122347 - protein, 9 aa, Mycobacterium tuberculosis
GPVGLATDL

SEQ ID NO: 122348 - protein, 9 aa, Mycobacterium tuberculosis
LPEPDPQPA

SEQ ID NO: 122349 - protein, 9 aa, Mycobacterium tuberculosis
EAPAETPQV

SEQ ID NO: 122350 - protein, 9 aa, Mycobacterium tuberculosis
AETPQVSNI

SEQ ID NO: 122351 - protein, 9 aa, Mycobacterium tuberculosis
ETPQVSNIA

SEQ ID NO: 122352 - protein, 9 aa, Mycobacterium tuberculosis
TPQVSNIAY

SEQ ID NO: 122353 - protein, 9 aa, Mycobacterium tuberculosis
QVSNIAYTK

SEQ ID NO: 122354 - protein, 9 aa, Mycobacterium tuberculosis
VSNIAYTKK

SEQ ID NO: 122355 - protein, 9 aa, Mycobacterium tuberculosis
YTKKLWQAI

SEQ ID NO: 122356 - protein, 9 aa, Mycobacterium tuberculosis
TKKLWQAIR

SEQ ID NO: 122357 - protein, 9 aa, Mycobacterium tuberculosis
KLWQAIRAQ

SEQ ID NO: 122358 - protein, 9 aa, Mycobacterium tuberculosis
WQAIRAQDV

SEQ ID NO: 122359 - protein, 9 aa, Mycobacterium tuberculosis
CGNDALDSL

SEQ ID NO: 122360 - protein, 9 aa, Mycobacterium tuberculosis
ALDSLAQPY

SEQ ID NO: 122361 - protein, 10 aa, Mycobacterium tuberculosis
KPTTSNVSVA

SEQ ID NO: 122362 - protein, 10 aa, Mycobacterium tuberculosis
PTTSNVSVAK

SEQ ID NO: 122363 - protein, 10 aa, Mycobacterium tuberculosis
TTSNVSVAKI

SEQ ID NO: 122364 - protein, 10 aa, Mycobacterium tuberculosis
SVAKIAFTGA

SEQ ID NO: 122365 - protein, 10 aa, Mycobacterium tuberculosis
VAKIAFTGAV

SEQ ID NO: 122366 - protein, 10 aa, Mycobacterium tuberculosis
AVLGGGGIAM

SEQ ID NO: 122367 - protein, 10 aa, Mycobacterium tuberculosis
VLGGGGIAMA

SEQ ID NO: 122368 - protein, 10 aa, Mycobacterium tuberculosis
GIAMAAQATA

SEQ ID NO: 122369 - protein, 10 aa, Mycobacterium tuberculosis
IAMAAQATAA

SEQ ID NO: 122370 - protein, 10 aa, Mycobacterium tuberculosis
AMAAQATAAT

SEQ ID NO: 122371 - protein, 10 aa, Mycobacterium tuberculosis
AQATAATDGE

SEQ ID NO: 122372 - protein, 10 aa, Mycobacterium tuberculosis
QATAATDGEW

SEQ ID NO: 122373 - protein, 10 aa, Mycobacterium tuberculosis
AATDGEWDQV

SEQ ID NO: 122374 - protein, 10 aa, Mycobacterium tuberculosis
NTGNGYLGGL

SEQ ID NO: 122375 - protein, 10 aa, Mycobacterium tuberculosis
YLGGLQFTQS

SEQ ID NO: 122376 - protein, 10 aa, Mycobacterium tuberculosis
GGLQFTQSTW

SEQ ID NO: 122377 - protein, 10 aa, Mycobacterium tuberculosis
GLQFTQSTWA

SEQ ID NO: 122378 - protein, 10 aa, Mycobacterium tuberculosis
LQFTQSTWAA

SEQ ID NO: 122379 - protein, 10 aa, Mycobacterium tuberculosis
TWAAHGGGEF

SEQ ID NO: 122380 - protein, 10 aa, Mycobacterium tuberculosis
WAAHGGGEFA

SEQ ID NO: 122381 - protein, 10 aa, Mycobacterium tuberculosis
GEFAPSAQLA

SEQ ID NO: 122382 - protein, 10 aa, Mycobacterium tuberculosis
FAPSAQLASR

SEQ ID NO: 122383 - protein, 10 aa, Mycobacterium tuberculosis
AQLASREQQI

SEQ ID NO: 122384 - protein, 10 aa, Mycobacterium tuberculosis
QLASREQQIA

SEQ ID NO: 122385 - protein, 10 aa, Mycobacterium tuberculosis
LASREQQIAV

SEQ ID NO: 122386 - protein, 10 aa, Mycobacterium tuberculosis
QQIAVGERVL

SEQ ID NO: 122387 - protein, 10 aa, Mycobacterium tuberculosis
ATQGRGAWPV

SEQ ID NO: 122388 - protein, 10 aa, Mycobacterium tuberculosis
GLSNATPREV

SEQ ID NO: 122389 - protein, 10 aa, Mycobacterium tuberculosis
TPREVLPASA

SEQ ID NO: 122390 - protein, 10 aa, Mycobacterium tuberculosis
REVLPASAAM

SEQ ID NO: 122391 - protein, 10 aa, Mycobacterium tuberculosis
VLPASAAMDA

SEQ ID NO: 122392 - protein, 10 aa, Mycobacterium tuberculosis
LPASAAMDAP

SEQ ID NO: 122393 - protein, 10 aa, Mycobacterium tuberculosis
AAMDAPLDAA

SEQ ID NO: 122394 - protein, 10 aa, Mycobacterium tuberculosis
AMDAPLDAAA

SEQ ID NO: 122395 - protein, 10 aa, Mycobacterium tuberculosis
MDAPLDAAAV

SEQ ID NO: 122396 - protein, 10 aa, Mycobacterium tuberculosis
DAAAVNGEPA

SEQ ID NO: 122397 - protein, 10 aa, Mycobacterium tuberculosis
AAVNGEPAPL

SEQ ID NO: 122398 - protein, 10 aa, Mycobacterium tuberculosis
EPAPLAPPPA

SEQ ID NO: 122399 - protein, 10 aa, Mycobacterium tuberculosis
PLAPPPADPA

SEQ ID NO: 122400 - protein, 10 aa, Mycobacterium tuberculosis
PPPADPAPPV

SEQ ID NO: 122401 - protein, 10 aa, Mycobacterium tuberculosis
PADPAPPVEL

SEQ ID NO: 122402 - protein, 10 aa, Mycobacterium tuberculosis
LAANDLPAPL

SEQ ID NO: 122403 - protein, 10 aa, Mycobacterium tuberculosis
DLPAPLGEPL

SEQ ID NO: 122404 - protein, 10 aa, Mycobacterium tuberculosis
LPAPLGEPLP

SEQ ID NO: 122405 - protein, 10 aa, Mycobacterium tuberculosis
APLGEPLPAA

SEQ ID NO: 122406 - protein, 10 aa, Mycobacterium tuberculosis
LPAAPADPAP

SEQ ID NO: 122407 - protein, 10 aa, Mycobacterium tuberculosis
APPADLAPPA

SEQ ID NO: 122408 - protein, 10 aa, Mycobacterium tuberculosis
DLAPPAPADV

SEQ ID NO: 122409 - protein, 10 aa, Mycobacterium tuberculosis
DVAPPVELAV

SEQ ID NO: 122410 - protein, 10 aa, Mycobacterium tuberculosis
LAVNDLPAPL

SEQ ID NO: 122411 - protein, 10 aa, Mycobacterium tuberculosis
DLPAPLGEPL

SEQ ID NO: 122412 - protein, 10 aa, Mycobacterium tuberculosis
LPAPLGEPLP

SEQ ID NO: 122413 - protein, 10 aa, Mycobacterium tuberculosis
APLGEPLPAA

SEQ ID NO: 122414 - protein, 10 aa, Mycobacterium tuberculosis
LPAAPADPAP

SEQ ID NO: 122415 - protein, 10 aa, Mycobacterium tuberculosis
APPADLAPPA

SEQ ID NO: 122416 - protein, 10 aa, Mycobacterium tuberculosis
DLAPPAPADL

SEQ ID NO: 122417 - protein, 10 aa, Mycobacterium tuberculosis
DLAPPAPADL

SEQ ID NO: 122418 - protein, 10 aa, Mycobacterium tuberculosis
DLAPPAPADL

SEQ ID NO: 122419 - protein, 10 aa, Mycobacterium tuberculosis
DLAPPVELAV

SEQ ID NO: 122420 - protein, 10 aa, Mycobacterium tuberculosis
LAVNDLPAPL

SEQ ID NO: 122421 - protein, 10 aa, Mycobacterium tuberculosis
DLPAPLGEPL

SEQ ID NO: 122422 - protein, 10 aa, Mycobacterium tuberculosis
LPAPLGEPLP

SEQ ID NO: 122423 - protein, 10 aa, Mycobacterium tuberculosis
APLGEPLPAA

SEQ ID NO: 122424 - protein, 10 aa, Mycobacterium tuberculosis
EPLPAAPAEL

SEQ ID NO: 122425 - protein, 10 aa, Mycobacterium tuberculosis
PLPAAPAELA

SEQ ID NO: 122426 - protein, 10 aa, Mycobacterium tuberculosis
LPAAPAELAP

SEQ ID NO: 122427 - protein, 10 aa, Mycobacterium tuberculosis
AAPAELAPPA

SEQ ID NO: 122428 - protein, 10 aa, Mycobacterium tuberculosis
AELAPPADLA

SEQ ID NO: 122429 - protein, 10 aa, Mycobacterium tuberculosis
LAPPADLAPA

SEQ ID NO: 122430 - protein, 10 aa, Mycobacterium tuberculosis
PPADLAPASA

SEQ ID NO: 122431 - protein, 10 aa, Mycobacterium tuberculosis
DLAPASADLA

SEQ ID NO: 122432 - protein, 10 aa, Mycobacterium tuberculosis
DLAPPAPADL

SEQ ID NO: 122433 - protein, 10 aa, Mycobacterium tuberculosis
DLAPPAPAEL

SEQ ID NO: 122434 - protein, 10 aa, Mycobacterium tuberculosis
ELAPPAPADL

SEQ ID NO: 122435 - protein, 10 aa, Mycobacterium tuberculosis
APADLAPPAA

SEQ ID NO: 122436 - protein, 10 aa, Mycobacterium tuberculosis
PADLAPPAAV

SEQ ID NO: 122437 - protein, 10 aa, Mycobacterium tuberculosis
QPATAPGGPV

SEQ ID NO: 122438 - protein, 10 aa, Mycobacterium tuberculosis
ATAPGGPVGL

SEQ ID NO: 122439 - protein, 10 aa, Mycobacterium tuberculosis
APGGPVGLAT

SEQ ID NO: 122440 - protein, 10 aa, Mycobacterium tuberculosis
ELPEPDPQPA

SEQ ID NO: 122441 - protein, 10 aa, Mycobacterium tuberculosis
TEAPAETPQV

SEQ ID NO: 122442 - protein, 10 aa, Mycobacterium tuberculosis
ETPQVSNIAY

SEQ ID NO: 122443 - protein, 10 aa, Mycobacterium tuberculosis
QVSNIAYTKK

SEQ ID NO: 122444 - protein, 10 aa, Mycobacterium tuberculosis
AYTKKLWQAI

SEQ ID NO: 122445 - protein, 10 aa, Mycobacterium tuberculosis
YTKKLWQAIR

SEQ ID NO: 122446 - protein, 10 aa, Mycobacterium tuberculosis
AQDVCGNDAL

SEQ ID NO: 122447 - protein, 10 aa, Mycobacterium tuberculosis
DALDSLAQPY

SEQ ID NO: 122448 - protein, 10 aa, Mycobacterium tuberculosis
ALDSLAQPYV

SEQ ID NO: 122449 - protein, 11 aa, Mycobacterium tuberculosis
TTSNVSVAKIA

SEQ ID NO: 122450 - protein, 11 aa, Mycobacterium tuberculosis
TSNVSVAKIAF

SEQ ID NO: 122451 - protein, 11 aa, Mycobacterium tuberculosis
SVAKIAFTGAV

SEQ ID NO: 122452 - protein, 11 aa, Mycobacterium tuberculosis
FTGAVLGGGGI

SEQ ID NO: 122453 - protein, 11 aa, Mycobacterium tuberculosis
GAVLGGGGIAM

SEQ ID NO: 122454 - protein, 11 aa, Mycobacterium tuberculosis
AVLGGGGIAMA

SEQ ID NO: 122455 - protein, 11 aa, Mycobacterium tuberculosis
VLGGGGIAMAA

SEQ ID NO: 122456 - protein, 11 aa, Mycobacterium tuberculosis
GIAMAAQATAA

SEQ ID NO: 122457 - protein, 11 aa, Mycobacterium tuberculosis
IAMAAQATAAT

SEQ ID NO: 122458 - protein, 11 aa, Mycobacterium tuberculosis
TAATDGEWDQV

SEQ ID NO: 122459 - protein, 11 aa, Mycobacterium tuberculosis
AATDGEWDQVA

SEQ ID NO: 122460 - protein, 11 aa, Mycobacterium tuberculosis
QVARCESGGNW

SEQ ID NO: 122461 - protein, 11 aa, Mycobacterium tuberculosis
YLGGLQFTQST

SEQ ID NO: 122462 - protein, 11 aa, Mycobacterium tuberculosis
GLQFTQSTWAA

SEQ ID NO: 122463 - protein, 11 aa, Mycobacterium tuberculosis
LQFTQSTWAAH

SEQ ID NO: 122464 - protein, 11 aa, Mycobacterium tuberculosis
STWAAHGGGEF

SEQ ID NO: 122465 - protein, 11 aa, Mycobacterium tuberculosis
GEFAPSAQLAS
